US007129338B1

(12) United States Patent
Ota et al.

(10) Patent No.: US 7,129,338 B1
(45) Date of Patent: Oct. 31, 2006

(54) SECRETORY PROTEIN OR MEMBRANE PROTEIN

(75) Inventors: Toshio Ota, Kanagawa (JP); Takao Isogai, Ibaraki (JP); Tetsuo Nishikawa, Tokyo (JP); Yuri Kawai, Chiba (JP); Tomoyasu Sugiyama, Chiba (JP); Koji Hayashi, Chiba (JP)

(73) Assignee: Research Association for Biotechnology, Tokyo (JP)

( * ) Notice: Subject to any disclaimer, the term of this patent is extended or adjusted under 35 U.S.C. 154(b) by 131 days.

(21) Appl. No.: 10/305,278

(22) Filed: Nov. 27, 2002

Related U.S. Application Data

(63) Continuation of application No. 09/611,523, filed on Jul. 7, 2000, now abandoned.

(60) Provisional application No. 60/183,323, filed on Feb. 17, 2000, provisional application No. 60/159,586, filed on Oct. 18, 1999.

(30) Foreign Application Priority Data

Jul. 8, 1999 (JP) ................................. 11-194179
Jan. 11, 2000 (JP) ............................ 2000-118775
May 2, 2000 (JP) ............................ 2000-183766

(51) Int. Cl.
*C07H 19/167* (2006.01)
*C07H 19/173* (2006.01)
(52) U.S. Cl. ................................................... 536/23.5
(58) Field of Classification Search ............... 536/23.5, 536/23.52
See application file for complete search history.

(56) References Cited

U.S. PATENT DOCUMENTS 6,512,095 B1 * 1/2003 Baum ......................... 530/350

FOREIGN PATENT DOCUMENTS

| EP | 1 026 242 A1 | 9/2000 |
|---|---|---|
| WO | WO 98/40483 A2 | 9/1998 |
| WO | WO 99/28462 A2 | 6/1999 |
| WO | WO 99/54460 A2 | 10/1999 |
| WO | WO 00/05367 A2 | 2/2000 |
| WO | WO 00/08158 A3 | 2/2000 |
| WO | WO 00/28032 A3 | 5/2000 |
| WO | WO 00/29435 A1 | 5/2000 |
| WO | WO 00/60076 A2 | 10/2000 |
| WO | WO 01/12662 A2 | 2/2001 |

OTHER PUBLICATIONS

Wood et al., "Human PRO355 Nucleotide Sequence," Database EMBL, Aug. 12, 1999, 2 Sheets, Abstract, Retrieved from GENESEQ Database Accession No. AAX80055, XP-002313304.

Baum et al., "Human Lymphoid Derived Dendritic Cell Adhesion Molecule Encoding DNA," Database EMBL, May 31, 2000, 2 Sheets, Abstract, Retrieved from GENESEQ Database Accession No. AAZ50882, XP-002313305.

Baum et al., "Human Lymphoid Derived Dendritic Cell Adhesion Molecule," Database EMBL, May 31, 2000, 2 Sheets, Abstract, Retrieved from GENESEQ Database Accession No. AAY45092, XP-002313306.

Tang et al., "Human Cell Surface Receptor Protein cDNA #8," Database EMBL, Aug. 22, 2000, 2 Sheets, Abstract, Retrieved from GENESEQ Database Accession No. AAA27051, XP-002313307.

Tang et al., "Human Cell Surface Receptor Protein cDNA #8," Database EMBL, Aug. 22, 2000, 2 Sheets, Abstract, Retrieved from GENESEQ Database Accession No. AAY94341, XP-002313308.

Ni et al., "Human Secreted Protein #11," Database EMBL, Nov. 21, 2000, 2 Sheets, Abstract, Retrieved from GENESEQ Database Accession No. AAA80616, XP-002313309.

Ni et al., "Protein Encoded by human Secreted Protein Gene #11," Database EMBL, Nov. 21, 2000, 2 Sheets, Abstract, Retrieved from GENESEQ Database Accession No. AAB25619, XP-002313310.

Adams et al., "Initial Assessment of Human Gene Diversity and Expression Patterns Based Upon 83 Million Nucleotides of cDNA Sequence," Nature, MacMillan Journals Ltd., vol. 377, Supp., pp. 3-174, 1995, XP-002042918.

Altschul et al., "Basic Local Alignment Search Tool," J. Mol. Biol., Academic Press Limited, vol. 215, pp. 403-410, 1990, XP-000604562.

Carninci et al., High-Efficiency Full-Length cDNA Cloning by Biotinylated CAP Trapper, Genomics, Academic Press, vol. 37, No. 3, pp. 327-336, 1996, XP-002081729.

Jacobs et al., "A Genetic Selection for Isolating cDNAs Encoding Secreted Proteins," Gene, Elsevier Science Publishers, vol. 198, No. 1-2, pp. 289-296, 1997, XP-004116069.

Maruyama et al., "Oligo-Capping: a Simple Method to Replace the Cap Structure of Eukaryotic mRNAs with Oligoribonucleotides," Gene, Elsevier Science Publishers, vol. 138, pp. 171-174, 1994, XP-002017391.

Maruyama et al., "Protein, Nucleic Acid and Enzyme," vol. 38, No. 3, pp. 476-481, 1993.

Nakai et al., "A Knowledge Base for Predicting Protein Localization Sites in Eukaryotic Cells," Genomics, Academic Press, Inc., vol. 14, pp. 897-911, 1992, XP-000953039.

Pearson et al., "Improved Tools for Biological Sequence Comparison," Proc. Natl. Acad. Sci., National Academy of Science, vol. 85, pp. 2444-2448, 1988, XP-002060460.

(Continued)

*Primary Examiner*—Marjorie A. Moran
(74) *Attorney, Agent, or Firm*—Foley & Lardner LLP

(57) ABSTRACT

Human cDNA encoding a secretory or membrane protein useful as a candidate for developing medicine or as a target molecule for developing medicine. The expression level of the polynucleotide of the present invention increased in NT2 cells after retinoic acid-treatment. Accordingly, this cDNA is associated neurological disease.

6 Claims, 6 Drawing Sheets

OTHER PUBLICATIONS

Suzuki et al., Construction and Characterization of A Full Length-Enriched and A 5'-End-Enriched cDNA Library, Gene, Elsevier Science Publishers, vol. 200, No. 1-2, pp. 149-156, 1997, XP-004126489.

Tashiro et al., "Signal Sequence Trap: A Cloning Strategy for Secreted Proteins and Type I Membrane Proteins," Science, American Association for the Advancement of Science, vol. 261, pp. 600-603, 1993, XP-000673204.

* cited by examiner

US 7,129,338 B1

SECRETORY PROTEIN OR MEMBRANE PROTEIN

This application is a continuation of application Ser. No. 09/611,523, filed Jul. 7, 2000 now abandoned.

FIELD OF THE INVENTION

The present invention relates to a polynucleotide encoding a novel protein, a protein encoded by the polynucleotide, and novel usages of these.

BACKGROUND OF THE INVENTION

Currently, sequencing projects, the determination and analysis of the genomic DNA of various living organisms are in progress all over the world. The whole genomic sequences of more than 10 species of prokaryotes, a lower eukaryote, yeast, and a multicellular eukaryote, C. elegans have been already determined. As to the human genome, which is supposed to be composed of three thousand million base pairs, world wide cooperative projects are under way to analyze it, and the whole structure is predicted to be determined by the years 2002-2003. The aim of the determination of genomic sequence is to reveal the functions of all genes and their regulation and to understand living organisms as a network of interactions between genes, proteins, cells or individuals through deducing the information in a genome, which is viewed as a blueprint of the highly complicated living organisms. To understand living organisms by utilizing the genomic information from various species is not only important as an academic subject, but also socially significant from the viewpoint of industrial application.

However, determination of genomic sequences itself cannot identify the functions of all genes. For example, for yeast, the function of only approximately half of the 6000 genes, which is predicted based on the genomic sequence, has been deduced. As for humans, the number of genes is predicted to be approximately one hundred thousand. Therefore, it is desirable to establish "a high throughput analysis system of gene functions" which allows us to identify rapidly and efficiently the functions of vast amounts of the genes obtained by the genomic sequencing.

Many genes in the eukaryotic genome are split by introns into multiple exons. Thus, it is difficult to predict correctly the structure of encoded proteins solely based on genomic information. In contrast, cDNA, which is produced from mRNA that lacks introns, encodes a protein as a single continuous amino acid sequence and allows us to identify the primary structure of the protein easily. In human cDNA research, to date, more than one million ESTs (Expression Sequence Tags) are available from public domains (public databases), and the ESTs presumably cover not less than 80% of all human genes.

The information of ESTs is utilized for analyzing the structure of human genome, or for predicting the exon-regions of genomic sequences or their expression profile. However, many human ESTs have been derived from proximal regions to the 3'-end of cDNA, and information around the 5'-end of mRNA is extremely little. Among these human cDNAs, the number of the corresponding mRNAs whose encoding protein sequences are deduced is approximately 7000, and further, the number of full-length clones is only 5500. Thus, even including cDNA registered as EST, the percentage of human cDNA obtained so far is estimated to be 10–15% of all the genes.

It is possible to identify the transcription start site of mRNA on the genomic sequence based on the 5'-end sequence of a full-length cDNA, and to analyze factors involved in the stability of mRNA that is contained in the cDNA, or in its regulation of expression at the translation stage. Also, since a full-length cDNA contains ATG, the translation start site, in the 5'-region, it can be translated into a protein in a correct frame. Therefore, it is possible to produce a large amount of the protein encoded by the cDNA or to analyze biological activity of the expressed protein by utilizing an appropriate expression system. Thus, analysis of a full-length cDNA provides valuable information that complements the information from genome sequencing. Also, full-length cDNA clones that can be expressed are extremely valuable in empirical analysis of gene function and in industrial application.

In particular, human secretory proteins or membrane proteins would be useful by itself as a medicine like tissue plasminogen activator (TPA), or as a target of medicines like membrane receptors.

Therefore, it has great significance to isolate novel full-length cDNA clones of humans, of which only a few have been isolated. Especially, isolation of a novel cDNA clone encoding a secretory protein or membrane protein is desired since the protein itself, or a molecule that interacts with the membrane protein would be useful as a medicine, and also the clones potentially include a gene associated with diseases. Thus, identification of the full-length cDNA clones encoding those proteins has great significance.

SUMMARY OF THE INVENTION

An objective of the present invention is to provide a polynucleotide encoding a novel protein, a protein encoded by said polynucleotide, and novel usages of these.

The inventors have developed a method for efficiently cloning a human full-length cDNA that is predicted by the ATGpr etc. to be a full-length cDNA clone, from a full-length-enriched cDNA library that is synthesized by the oligo-capping method [K. Maruyama and S. Sugano, Gene, 138: 171–174 (1994); Y. Suzuki et al., Gene, 200: 149–156 (1997)]. Then, the inventors determined the nucleotide sequence of the obtained cDNA clones from both 5'- and 3'-ends. By utilizing the sequences, the inventors selected clones that were expected to contain a signal by the PSORT (Nakai K. and Kanehisa M. (1992) Genomics 14: 897–911), and obtained clones that contain a cDNA encoding a secretory protein or membrane protein. The inventors found that it is possible to synthesize a novel full-length cDNA by using the combination of a primer that is designed based on the nucleotide sequence of the 5'-ends of the selected full-length cDNA clones and any of an oligo-dT primer or a 3'-primer that is designed based on the nucleotide sequence of the 3'-ends of the selected clones.

The full-length cDNA clones of the present invention have high fullness ratio since these were obtained by the combination of (1) construction of a full-length-enriched cDNA library that is synthesized by the oligo-capping method, and (2) a system in which fullness ratio is evaluated from the nucleotide sequence of the 5'-end.

Furthermore, the inventors have analyzed the nucleotide sequence of the full-length cDNA clones obtained by the method, and deduced the amino acid sequence encoded by the nucleotide sequence. Then, the inventors have performed the BLAST search (Altschul S. F. Gish W., Miller W., Myers E. W., and Lipman D. J. (1990) J. Mol. Biol. 215: 403–410; Gish W., and Stares D. J. (1993) Nature Genet. 3: 266–272;

of the GenBank and SwissProt using the deduced amino acid sequence to accomplish the present invention.

Homology analysis in which the analysis is carried out against a non-full-length cDNA fragment to postulate the function of a protein encoded by said fragment, is being commonly performed. However, since such analysis is based on the information of the fragment, it is not clear as to whether this fragment corresponds to a part that is functionally important in the protein. In other words, the reliability of the homology analysis based on the information of a fragment is doubtful, as information relating to the structure of the whole protein is not available. However, the homology analysis of the present invention is conducted based on the information of a full-length cDNA comprising the whole coding region of the cDNA, and therefore, the homology of various portions of the protein can be analyzed. Hence, the reliability of the homology analysis has been dramatically improved in the present invention.

The present invention relates to the polynucleotide mentioned below, a protein encoded by the polynucleotide, and their usage.

First, the present invention relates to (1) an isolated polynucleotide selected from the group consisting of (a) a polynucleotide comprising a coding region of the nucleotide sequence set forth in any one of the SEQ ID NOs in Table 1;

(b) a polynucleotide comprising a nucleotide sequence encoding a protein comprising the amino acid sequence set forth in any one of the SEQ ID NOs in Table 1;

(c) a polynucleotide comprising a nucleotide sequence encoding a protein comprising an amino acid sequence selected from the amino acid sequences set forth in the SEQ ID NOs in Table 1, in which one or more amino acids are substituted, deleted, inserted, and/or added, wherein said protein is functionally equivalent to the protein comprising said amino acid sequence selected from the amino acid sequences set forth in the SEQ ID NOs in Table 1;

(d) a polynucleotide that hybridizes with a polynucleotide comprising a nucleotide sequence selected from the nucleotide sequences set forth in the SEQ ID NOs in Table 1, and that comprises a nucleotide sequence encoding a protein functionally equivalent to the protein encoded by the nucleotide sequence selected from the nucleotide sequences set forth in the SEQ ID NOs in Table 1;

(e) a polynucleotide comprising a nucleotide sequence encoding a partial amino acid sequence of a protein encoded by the polynucleotide of (a) to (d);

(f) a polynucleotide comprising a nucleotide sequence with at least 70% identity to the nucleotide sequence set forth in any one of the SEQ ID NOs in Table 1.

Table 1 shows the name of the cDNA clones isolated in the examples described later, comprising the full-length cDNA of the present invention, the corresponding SEQ ID NOs. of the nucleotide sequences of the cDNA clones, and the corresponding SEQ ID NOs. of the amino acid sequences deduced from the cDNA nucleotide sequences.

TABLE 1

| Amino acid sequence | Nucleotide sequence | Clone Name |
|---|---|---|
| SEQ ID NO: 2 | SEQ ID NO: 1 | PSEC0001 |
| SEQ ID NO: 4 | SEQ ID NO: 3 | nnnnnnnn |

TABLE 1-continued

| Amino acid sequence | Nucleotide sequence | Clone Name |
|---|---|---|
| SEQ ID NO: 6 | SEQ ID NO: 5 | PSEC0005 |
| SEQ ID NO: 8 | SEQ ID NO: 7 | PSEC0007 |
| SEQ ID NO: 10 | SEQ ID NO: 9 | PSEC0008 |
| SEQ ID NO: 12 | SEQ ID NO: 11 | PSEC0012 |
| SEQ ID NO: 14 | SEQ ID NO: 13 | PSEC0017 |
| SEQ ID NO: 16 | SEQ ID NO: 15 | PSEC0019 |
| SEQ ID NO: 18 | SEQ ID NO: 17 | PSEC0020 |
| SEQ ID NO: 20 | SEQ ID NO: 19 | PSEC0021 |
| SEQ ID NO: 22 | SEQ ID NO: 21 | PSEC0028 |
| SEQ ID NO: 24 | SEQ ID NO: 23 | PSEC0029 |
| SEQ ID NO: 26 | SEQ ID NO: 25 | PSEC0030 |
| SEQ ID NO: 28 | SEQ ID NO: 27 | PSEC0031 |
| SEQ ID NO: 30 | SEQ ID NO: 29 | PSEC0035 |
| SEQ ID NO: 32 | SEQ ID NO: 31 | PSEC0038 |
| SEQ ID NO: 34 | SEQ ID NO: 33 | PSEC0040 |
| SEQ ID NO: 36 | SEQ ID NO: 35 | PSEC0041 |
| SEQ ID NO: 38 | SEQ ID NO: 37 | PSEC0045 |
| SEQ ID NO: 40 | SEQ ID NO: 39 | PSEC0048 |
| SEQ ID NO: 42 | SEQ ID NO: 41 | PSEC0049 |
| SEQ ID NO: 44 | SEQ ID NO: 43 | PSEC0051 |
| SEQ ID NO: 46 | SEQ ID NO: 45 | PSEC0052 |
| SEQ ID NO: 48 | SEQ ID NO: 47 | PSEC0053 |
| SEQ ID NO: 50 | SEQ ID NO: 49 | PSEC0055 |
| SEQ ID NO: 52 | SEQ ID NO: 51 | PSEC0059 |
| SEQ ID NO: 54 | SEQ ID NO: 53 | PSEC0061 |
| SEQ ID NO: 56 | SEQ ID NO: 55 | PSEC0068 |
| SEQ ID NO: 58 | SEQ ID NO: 57 | PSEC0070 |
| SEQ ID NO: 60 | SEQ ID NO: 59 | PSEC0071 |
| SEQ ID NO: 62 | SEQ ID NO: 61 | PSEC0072 |
| SEQ ID NO: 64 | SEQ ID NO: 63 | PSEC0073 |
| SEQ ID NO: 66 | SEQ ID NO: 65 | PSEC0074 |
| SEQ ID NO: 68 | SEQ ID NO: 67 | PSEC0075 |
| SEQ ID NO: 70 | SEQ ID NO: 69 | PSEC0076 |
| SEQ ID NO: 72 | SEQ ID NO: 71 | PSEC0077 |
| SEQ ID NO: 74 | SEQ ID NO: 73 | PSEC0079 |
| SEQ ID NO: 76 | SEQ ID NO: 75 | PSEC0080 |
| SEQ ID NO: 78 | SEQ ID NO: 77 | PSEC0081 |
| SEQ ID NO: 80 | SEQ ID NO: 79 | PSEC0082 |
| SEQ ID NO: 82 | SEQ ID NO: 81 | PSEC0085 |
| SEQ ID NO: 84 | SEQ ID NO: 83 | PSEC0086 |
| SEQ ID NO: 86 | SEQ ID NO: 85 | PSEC0087 |
| SEQ ID NO: 88 | SEQ ID NO: 87 | PSEC0088 |
| SEQ ID NO: 90 | SEQ ID NO: 89 | PSEC0090 |
| SEQ ID NO: 92 | SEQ ID NO: 91 | PSEC0094 |
| SEQ ID NO: 94 | SEQ ID NO: 93 | PSEC0095 |
| SEQ ID NO: 96 | SEQ ID NO: 95 | PSEC0098 |
| SEQ ID NO: 98 | SEQ ID NO: 97 | PSEC0099 |
| SEQ ID NO: 100 | SEQ ID NO: 99 | PSEC0100 |
| SEQ ID NO: 102 | SEQ ID NO: 101 | PSEC0101 |
| SEQ ID NO: 104 | SEQ ID NO: 103 | PSEC0104 |
| SEQ ID NO: 106 | SEQ ID NO: 105 | PSEC0105 |
| SEQ ID NO: 108 | SEQ ID NO: 107 | PSEC0106 |
| SEQ ID NO: 110 | SEQ ID NO: 109 | PSEC0107 |
| SEQ ID NO: 112 | SEQ ID NO: 111 | PSEC0108 |
| SEQ ID NO: 114 | SEQ ID NO: 113 | PSEC0109 |
| SEQ ID NO: 116 | SEQ ID NO: 115 | PSEC0110 |
| SEQ ID NO: 118 | SEQ ID NO: 117 | PSEC0111 |
| SEQ ID NO: 120 | SEQ ID NO: 119 | PSEC0112 |
| SEQ ID NO: 122 | SEQ ID NO: 121 | PSEC0113 |
| SEQ ID NO: 124 | SEQ ID NO: 123 | PSEC0119 |
| SEQ ID NO: 126 | SEQ ID NO: 125 | PSEC0120 |
| SEQ ID NO: 128 | SEQ ID NO: 127 | PSEC0121 |
| SEQ ID NO: 130 | SEQ ID NO: 129 | PSEC0124 |
| SEQ ID NO: 132 | SEQ ID NO: 131 | PSEC0125 |
| SEQ ID NO: 134 | SEQ ID NO: 133 | PSEC0126 |
| SEQ ID NO: 136 | SEQ ID NO: 135 | PSEC0127 |
| SEQ ID NO: 138 | SEQ ID NO: 137 | PSEC0128 |
| SEQ ID NO: 140 | SEQ ID NO: 139 | PSEC0129 |
| SEQ ID NO: 142 | SEQ ID NO: 141 | PSEC0130 |
| SEQ ID NO: 144 | SEQ ID NO: 143 | PSEC0131 |
| SEQ ID NO: 146 | SEQ ID NO: 145 | PSEC0133 |
| SEQ ID NO: 148 | SEQ ID NO: 147 | PSEC0134 |
| SEQ ID NO: 150 | SEQ ID NO: 149 | PSEC0135 |
| SEQ ID NO: 152 | SEQ ID NO: 151 | PSEC0136 |
| SEQ ID NO: 154 | SEQ ID NO: 153 | PSEC0137 |
| SEQ ID NO: 156 | SEQ ID NO: 155 | PSEC0139 |

TABLE 1-continued

| Amino acid sequence | Nucleotide sequence | Clone Name |
|---|---|---|
| SEQ ID NO: 158 | SEQ ID NO: 157 | PSEC0143 |
| SEQ ID NO: 160 | SEQ ID NO: 159 | PSEC0144 |
| SEQ ID NO: 162 | SEQ ID NO: 161 | nnnnnnnn |
| SEQ ID NO: 164 | SEQ ID NO: 163 | PSEC0147 |
| SEQ ID NO: 166 | SEQ ID NO: 165 | PSEC0149 |
| SEQ ID NO: 168 | SEQ ID NO: 167 | PSEC0150 |
| SEQ ID NO: 170 | SEQ ID NO: 169 | PSEC0151 |
| SEQ ID NO: 172 | SEQ ID NO: 171 | PSEC0152 |
| SEQ ID NO: 174 | SEQ ID NO: 173 | PSEC0158 |
| SEQ ID NO: 176 | SEQ ID NO: 175 | PSEC0159 |
| SEQ ID NO: 178 | SEQ ID NO: 177 | PSEC0161 |
| SEQ ID NO: 180 | SEQ ID NO: 179 | PSEC0162 |
| SEQ ID NO: 182 | SEQ ID NO: 181 | PSEC0163 |
| SEQ ID NO: 184 | SEQ ID NO: 183 | PSEC0164 |
| SEQ ID NO: 186 | SEQ ID NO: 185 | PSEC0165 |
| SEQ ID NO: 188 | SEQ ID NO: 187 | PSEC0167 |
| SEQ ID NO: 190 | SEQ ID NO: 189 | PSEC0168 |
| SEQ ID NO: 192 | SEQ ID NO: 191 | PSEC0169 |
| SEQ ID NO: 194 | SEQ ID NO: 193 | PSEC0170 |
| SEQ ID NO: 196 | SEQ ID NO: 195 | PSEC0171 |
| SEQ ID NO: 198 | SEQ ID NO: 197 | PSEC0172 |
| SEQ ID NO: 200 | SEQ ID NO: 199 | PSEC0173 |
| SEQ ID NO: 202 | SEQ ID NO: 201 | PSEC0178 |
| SEQ ID NO: 204 | SEQ ID NO: 203 | PSEC0181 |
| SEQ ID NO: 206 | SEQ ID NO: 205 | PSEC0182 |
| SEQ ID NO: 208 | SEQ ID NO: 207 | PSEC0183 |
| SEQ ID NO: 210 | SEQ ID NO: 209 | PSEC0190 |
| SEQ ID NO: 212 | SEQ ID NO: 211 | PSEC0191 |
| SEQ ID NO: 214 | SEQ ID NO: 213 | PSEC0192 |
| SEQ ID NO: 216 | SEQ ID NO: 215 | PSEC0197 |
| SEQ ID NO: 218 | SEQ ID NO: 217 | PSEC0198 |
| SEQ ID NO: 220 | SEQ ID NO: 219 | PSEC0199 |
| SEQ ID NO: 222 | SEQ ID NO: 221 | PSEC0200 |
| SEQ ID NO: 224 | SEQ ID NO: 223 | PSEC0203 |
| SEQ ID NO: 226 | SEQ ID NO: 225 | PSEC0204 |
| SEQ ID NO: 228 | SEQ ID NO: 227 | PSEC0205 |
| SEQ ID NO: 230 | SEQ ID NO: 229 | PSEC0207 |
| SEQ ID NO: 232 | SEQ ID NO: 231 | PSEC0209 |
| SEQ ID NO: 234 | SEQ ID NO: 233 | PSEC0210 |
| SEQ ID NO: 236 | SEQ ID NO: 235 | PSEC0213 |
| SEQ ID NO: 238 | SEQ ID NO: 237 | PSEC0214 |
| SEQ ID NO: 240 | SEQ ID NO: 239 | PSEC0215 |
| SEQ ID NO: 242 | SEQ ID NO: 241 | PSEC0216 |
| SEQ ID NO: 244 | SEQ ID NO: 243 | PSEC0218 |
| SEQ ID NO: 246 | SEQ ID NO: 245 | PSEC0220 |
| SEQ ID NO: 248 | SEQ ID NO: 247 | PSEC0222 |
| SEQ ID NO: 250 | SEQ ID NO: 249 | PSEC0223 |
| SEQ ID NO: 252 | SEQ ID NO: 251 | PSEC0224 |
| SEQ ID NO: 254 | SEQ ID NO: 253 | PSEC0226 |
| SEQ ID NO: 256 | SEQ ID NO: 255 | PSEC0227 |
| SEQ ID NO: 258 | SEQ ID NO: 257 | PSEC0228 |
| SEQ ID NO: 260 | SEQ ID NO: 259 | PSEC0230 |
| SEQ ID NO: 262 | SEQ ID NO: 261 | PSEC0232 |
| SEQ ID NO: 264 | SEQ ID NO: 263 | PSEC0233 |
| SEQ ID NO: 266 | SEQ ID NO: 265 | PSEC0235 |
| SEQ ID NO: 268 | SEQ ID NO: 267 | PSEC0236 |
| SEQ ID NO: 270 | SEQ ID NO: 269 | PSEC0240 |
| SEQ ID NO: 272 | SEQ ID NO: 271 | PSEC0241 |
| SEQ ID NO: 274 | SEQ ID NO: 273 | PSEC0243 |
| SEQ ID NO: 276 | SEQ ID NO: 275 | PSEC0244 |
| SEQ ID NO: 278 | SEQ ID NO: 277 | PSEC0245 |
| SEQ ID NO: 280 | SEQ ID NO: 279 | PSEC0246 |
| SEQ ID NO: 282 | SEQ ID NO: 281 | PSEC0247 |
| SEQ ID NO: 284 | SEQ ID NO: 283 | PSEC0248 |
| SEQ ID NO: 286 | SEQ ID NO: 285 | PSEC0249 |
| SEQ ID NO: 288 | SEQ ID NO: 287 | PSEC0250 |
| SEQ ID NO: 290 | SEQ ID NO: 289 | PSEC0252 |
| SEQ ID NO: 292 | SEQ ID NO: 291 | PSEC0253 |
| SEQ ID NO: 294 | SEQ ID NO: 293 | PSEC0255 |
| SEQ ID NO: 296 | SEQ ID NO: 295 | PSEC0258 |
| SEQ ID NO: 298 | SEQ ID NO: 297 | PSEC0259 |
| SEQ ID NO: 300 | SEQ ID NO: 299 | PSEC0260 |
| SEQ ID NO: 302 | SEQ ID NO: 301 | PSEC0261 |
| SEQ ID NO: 304 | SEQ ID NO: 303 | PSEC0263 |
| SEQ ID NO: 306 | SEQ ID NO: 305 | PSEC0027 |
| SEQ ID NO: 308 | SEQ ID NO: 307 | PSEC0047 |
| SEQ ID NO: 310 | SEQ ID NO: 309 | PSEC0066 |
| SEQ ID NO: 312 | SEQ ID NO: 311 | nnnnnnnn |
| SEQ ID NO: 314 | SEQ ID NO: 313 | PSEC0069 |
| SEQ ID NO: 316 | SEQ ID NO: 315 | PSEC0092 |
| SEQ ID NO: 318 | SEQ ID NO: 317 | PSEC0103 |
| SEQ ID NO: 320 | SEQ ID NO: 319 | PSEC0117 |
| SEQ ID NO: 322 | SEQ ID NO: 321 | PSEC0142 |
| SEQ ID NO: 324 | SEQ ID NO: 323 | PSEC0212 |
| SEQ ID NO: 326 | SEQ ID NO: 325 | PSEC0239 |
| SEQ ID NO: 328 | SEQ ID NO: 327 | PSEC0242 |
| SEQ ID NO: 330 | SEQ ID NO: 329 | PSEC0251 |
| SEQ ID NO: 332 | SEQ ID NO: 331 | PSEC0256 |
| SEQ ID NO: 334 | SEQ ID NO: 333 | PSEC0195 |
| SEQ ID NO: 336 | SEQ ID NO: 335 | PSEC0206 |
| SEQ ID NO: 342 | SEQ ID NO: 341 | PSEC0078 |
| SEQ ID NO: 344 | SEQ ID NO: 343 | PSEC0084 |
| SEQ ID NO: 346 | SEQ ID NO: 345 | PSEC0237 |
| SEQ ID NO: 348 | SEQ ID NO: 347 | PSEC0264 |
| SEQ ID NO: 350 | SEQ ID NO: 349 | PSEC0265 |

Furthermore, the present invention relates to the above polynucleotide, a protein encoded by the polynucleotide, and the use of them as described below.

(2) A substantially pure protein encoded by the polynucleotide of (1).

(3) Use of an oligonucleotide as a primer for synthesizing the polynucleotide comprising the nucleotide sequence set forth in any one of SEQ ID NOs: 370–540 or the complementary strand thereof, wherein said oligonucleotide is complementary to said polynucleotide or the complementary strand thereof and comprises at least 15 nucleotides.

(4) A primer set for synthesizing polynucleotides, the primer set comprising an oligo-dT primer and an oligonucleotide complementary to the complementary strand of the polynucleotide comprising the nucleotide sequence set forth in any one of SEQ ID NOs: 370–540, wherein said oligonucleotide comprises at least 15 nucleotides.

(5) A primer set for synthesizing polynucleotides, the primer set comprising a combination of an oligonucleotide comprising a nucleotide sequence complementary to the complementary strand of the polynucleotide comprising a 5'-end nucleotide sequence and an oligonucleotide comprising a nucleotide sequence complementary to the polynucleotide comprising a 3'-end nucleotide sequence, wherein said oligonucleotides comprise at least 15 nucleotides and wherein said combination of 5'-end nucleotide sequence/3'-end nucleotide sequence is selected from the combinations of 5'-end nucleotide sequence/3'-end nucleotide sequence set forth in the SEQ ID NOs in Table 342.

(6) A polynucleotide that can be synthesized with the primer set of (4) or (5).

(7) A polynucleotide comprising a coding region in the polynucleotide of (6).

(8) A protein encoded by polynucleotide of (7).

(9) A partial peptide of the protein of (8).

(10) An antibody against the protein or peptide of any one of (2), (8), and (9).

(11) A vector comprising the polynucleotide of (1) or (7).

(12) A transformant carrying the polynucleotide of (1) or (7), or the vector of (11).

(13) A transformant expressively carrying the polynucleotide of (1) or (7), or the vector of (11).

(14) A method for producing the protein or peptide of any one of (2), (8), and (9), comprising culturing the transformant of (13) and recovering the expression product.

(15) An oligonucleotide comprising the nucleotide sequence set forth in any one of the SEQ ID NOs in Table 1 or the nucleotide sequence complementary to the complementary strand thereof, wherein said oligonucleotide comprises 15 nucleotides or more.

(16) Use of the oligonucleotide of (15) as a primer for synthesizing a polynucleotide.

(17) Use of the oligonucleotide of (15) as a probe for detecting a gene.

(18) An antisense polynucleotide against the polynucleotide of (1), or the portion thereof.

(19) A method for synthesizing a polynucleotide, the method comprising:

a) synthesizing a complementary strand using a cDNA library as a template, and using the primer set of (4) or (5), or the primer of (16); and b) recovering the synthesized product.

(20) The method of (19), wherein the cDNA library is obtainable by oligo-capping method.

(21) The method of (19), wherein the complementary strand is obtainable by PCR.

(22) A method for detecting the polynucleotide of (1), the method comprising:

a) incubating a target polynucleotide with the oligonucleotide of (15) under the conditions where hybridization occurs, and b) detecting the hybridization of the target polynucleotide with the oligonucleotide of (15).

(23) A database of polynucleotides and/or proteins, the database comprising information on at least one sequence selected from the nucleotide sequences set forth in the SEQ ID NOs in Table 1 and/or the amino acid sequences set forth in the SEQ ID NOs in Table 1, or a medium on which the database is stored.

Table 342 shows a SEQ IDs of the nucleotide sequences defining 5'- and 3'-ends in the full-length cDNA of the present invention (173 clones), and the corresponding plasmid clones obtained in the examples described later, which contain the polynucleotides as an insert. Blank shows that the sequence of the 3'-end corresponding to the 5'-end has not been determined within the same clone. The SEQ ID of the 5'-sequence are shown on the right side of the name of the 5'-sequence, and the SEQ ID of the 3'-sequence are shown on the right side of the name of the 3'-sequence.

Any patents, patent applications, and publications cited herein are incorporated by reference.

PCR conditions (annealing temperature and 4 kinds of cycle numbers) used are indicated under the respective clone names or gene names. RA(−) and RA(+) represent undifferentiated NT2 cells and NT2 cells respectively cultured in the presence of retinoic acid. Each sample was analyzed by PCR with 4 types of conditions with different number of cycles (as mentioned above).

Figure 5:
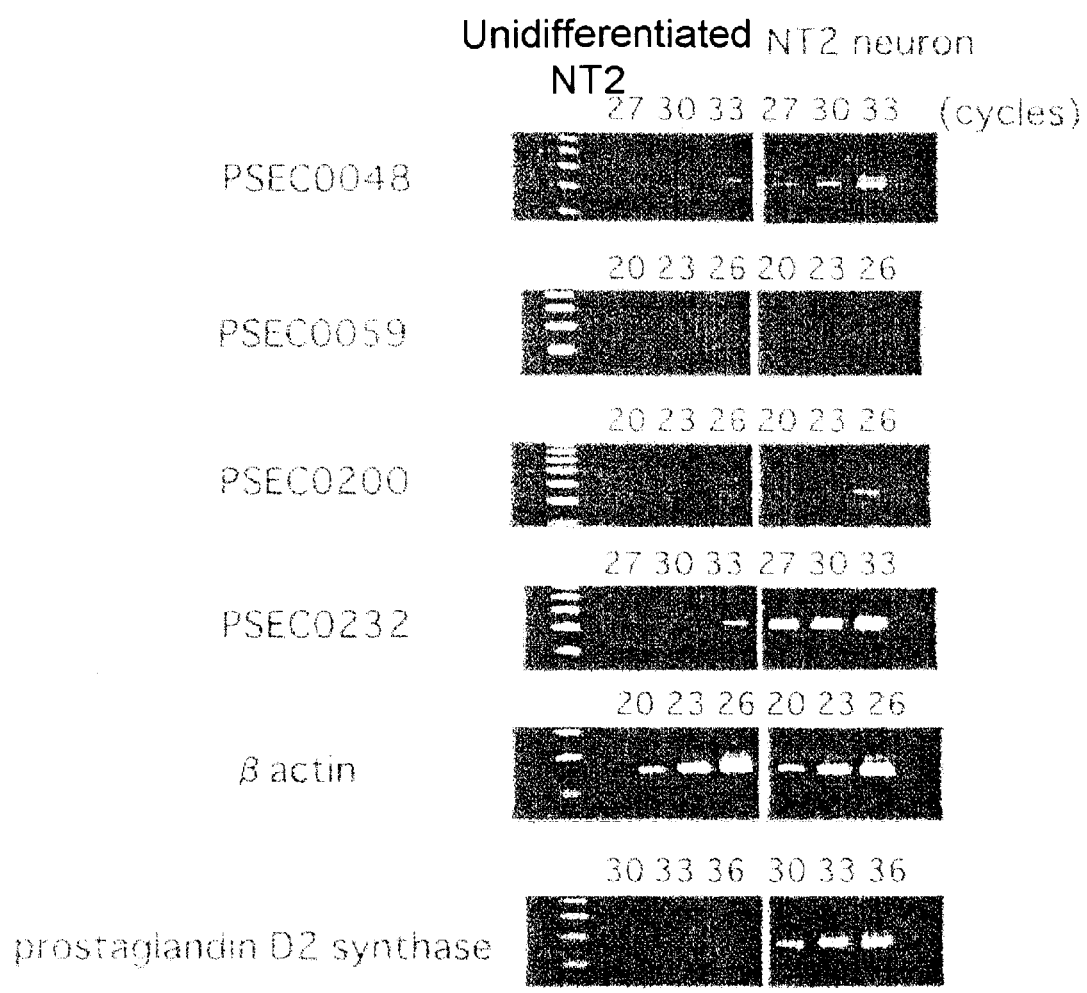

FIG. 5 is a photograph showing results of analyzing gene expression of PSEC clones in undifferentiated NT2 cells and NT2 neurons using RT-PCR.

Figure 4:
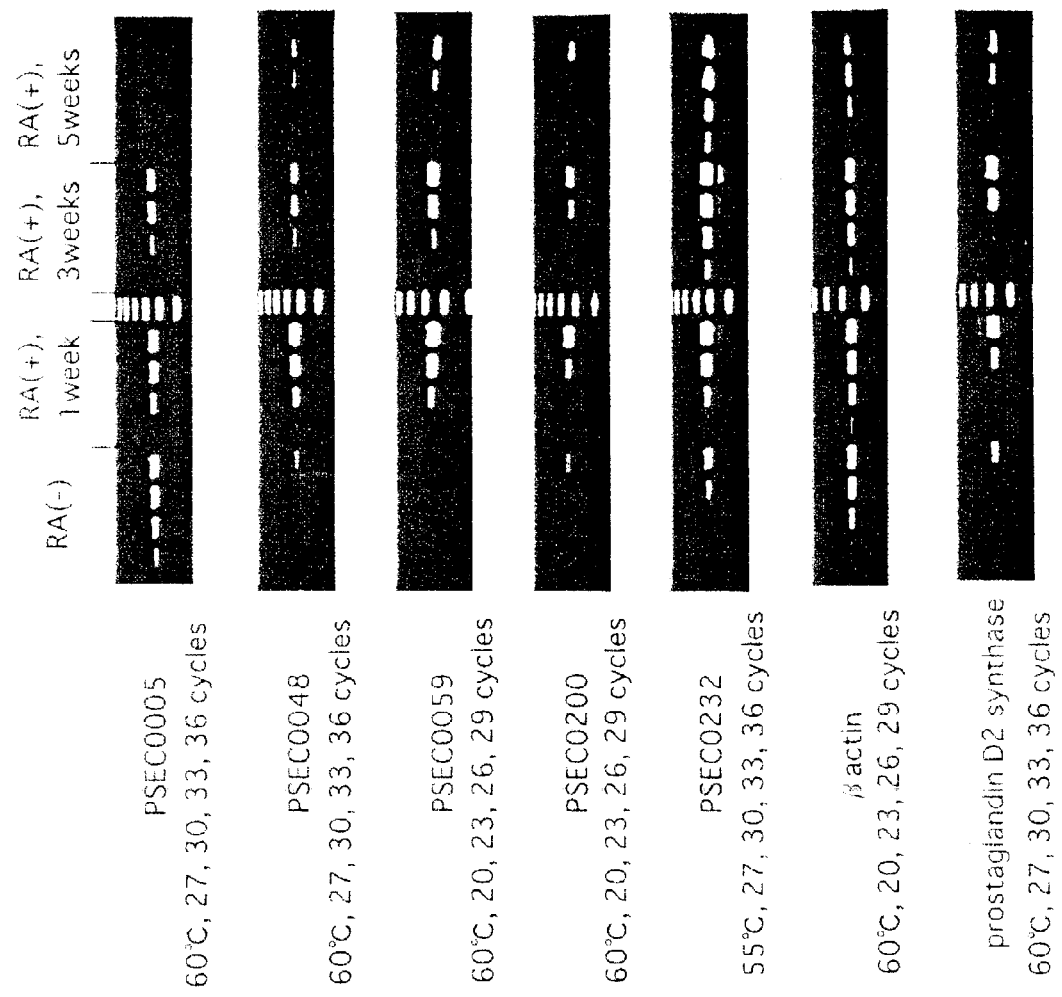
FIG. 4 is a photograph showing results of analyzing temporal expression of PSEC clones in NT cells at a pre-differentiation stage and at 1, 3, or 5 weeks after retinoic acid-treatment using RT-PCR.

In the PCR experiment, the annealing temperature was the same as that used in FIG. 4. Each sample was analyzed by PCR with 3 types of conditions with different number of cycles as indicated in the figure.

Figure 6:
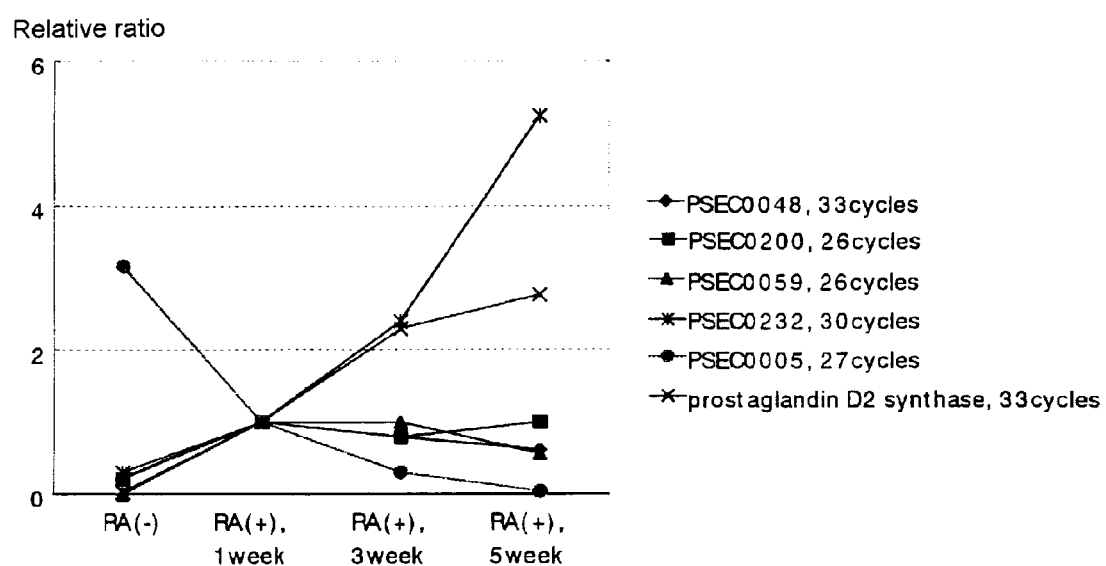

FIG. 6 is a diagram showing temporal change in the expression level of the RT-PCR amplification products derived from PSEC clones. PCR conditions (the number of cycles) used are indicated adjacent to the respective clone names or gene names. RA(−) and RA(+) represent undifferentiated NT2 cells and NT2 cells respectively cultured in the presence of retinoic acid. Each point presented on the diagram was determined as a ratio obtained as follows. First, 3 independent data were averaged. Next, the average value was normalized by the corresponding average value representing the expression level of actin. Finally, the ratio was determined taking the amount of the products in NT2 cells cultured in the presence of retinoic acid for 1 week as 1.

DETAILED DESCRIPTION OF THE INVENTION

Herein, "polynucleotide" is defined as a molecule in which multiple nucleotides are polymerized such as DNA or RNA. There are no limitations in the number of the polymerized nucleotides. In case that the polymer contains relatively low number of nucleotides, it is also described as an "oligonucleotide". The polynucleotide or the oligonucleotide of the present invention can be a natural or chemically synthesized product. Alternatively, it can be synthesized using a template DNA by an enzymatic reaction such as PCR.

All the cDNA provided by the invention are full-length cDNA. Herein, a "full-length cDNA" is defined as a cDNA that contains both ATG codon (the translation start site) and the stop codon. Accordingly, the untranslated regions, which are originally found in the upstream or downstream of the protein coding region in natural mRNA, may or may not be contained.

An "isolated polynucleotide" is a polynucleotide the structure of which is not identical to that of any naturally occurring nucleic acid or to that of any fragment of a naturally occurring genomic nucleic acid spanning more than three separate genes. The term therefore covers, for example, (a) a DNA which has the sequence of part of a naturally occurring genomic DNA molecule but is not flanked by both of the coding sequences that flank that part of the molecule in the genome of the organism in which it naturally occurs;

(b) a nucleic acid incorporated into a vector or into the genomic DNA of a prokaryote or eukaryote in a manner such that the resulting molecule is not identical to any naturally occurring vector or genomic DNA;

(c) a separate molecule such as a cDNA, a genomic fragment, a fragment produced by polymerase chain reaction (PCR), or a restriction fragment; and (d) a recombinant nucleotide sequence that is part of a hybrid gene, i.e., a gene encoding a fusion protein. Specifically excluded from this definition are nucleic acids present in mixtures of different (i) DNA molecules, (ii) transfected cells, or (iii) cell clones: e.g., as these occur in a DNA library such as a cDNA or genomic DNA library.

The term "substantially pure" as used herein in reference to a given polypeptide means that the protein or polypeptide is substantially free from other biological macromolecules. The substantially pure protein or polypeptide is at least 75% (e.g., at least 80, 85, 95, or 99%) pure by dry weight. Purity can be measured by any appropriate standard method, for example, by column chromatography, polyacrylamide gel electrophoresis, or HPLC analysis.

The present invention provides substantially pure human secretory protein or membrane protein comprising the amino acid sequence as shown in any SEQ ID NO: 2–336 and SEQ ID NO: 342–350; the ID number is also in Table 1. The 156 proteins out of 173 proteins of the present invention are encoded by the cDNA clones, shown in List 1. These clones were "the clones isolated from the full-length-enriched human cDNA libraries constructed by the oligo-capping method, using the programs such as ATGpr, and predicted by the PSORT to be a secretory protein or membrane protein which has a signal sequence in the N-terminus".

The list shown below indicates, in order, the following information separating each of these with a double-slash mark, //.

clone name (PSEC number),
length of cDNA,
length of amino acid sequence,
ATG No. from the 5' end,
ATGpr1 value,
definition of annotation data,
Accession No. of annotation data,
P value,
length of compared sequence,
homology The annotation data are not shown for clones that did not exhibit explicit homology as a result of BLAST analysis of GenBank and SwissProt. The ATG No. from the 5' end means the position of ATG of the translation frame of the compared sequence counted from the 5' end. In other words, for example, when comparing with the translation frame from the first ATG, it is shown as "$1^{st}$", and when comparing with the transiation frame beginning with the second ATG, it is shown as the "$2^{nd}$". The P value indicates similarity between two sequences as a score by considering the probability that the two sequences are accidentally similar. In general, as the value is lower, the similarity is higher. In general, as the value is lower, the homology is higher.

(Altschul, S. F., Gish, W., Miller, W., Myers, E. W. & Lipman, D. J. (1990) "Basic local alignment search tool." J. Mol. Biol. 215:403–410; Gish, W. & States, D. J. (1993) "Identification of protein coding regions by database similarity search." Nature Genet. 3:266–272)

List 1

PSEC0001//1992bp//226aa//1st//0.94//GOLGI 4-TRANSMEMBRANE SPANNING TRANSPORTER MTP (KIAA0108).//Q15012//3.90E-53//221aa//46% nnnnnnnn//1883bp//326aa//1st//0.94//Homo sapiens death effector domain-containing testicular molecule mRNA, complete cds.//AF043733//3.10E-37//852bp//62%

PSEC0005//1366bp//220aa//1st//0.94//Homo sapiens CLDN6 gene for claudin-6.//AJ249735//5.00E-285//1295bp//99%

PSEC0007//3425bp//570aa//1st//0.94//Homo sapiens FK506-binding protein (FKBP63) mRNA, partial cds.//AF089745//0//1580bp//99%

PSEC0008//978bp//215aa//1st//0.94//HYPOTHETICAL 72.5 KD PROTEIN C2F7. 10 IN CHROMOSOME I.//Q09701//1.60E-13//119aa//36%

PSEC0012//1499bp//183aa//1st//0.82

PSEC0017//3125bp//273aa//1st//0.33//Mus musculus membrane protein TMS-2 mRNA, complete cds.//AF181685//3.00E-303//1949bp//82%

PSEC0009//1927bp//339aa//1st//0.9//Homo sapiens NPD003 mRNA, complete cds.//AF078855//0//1904bp//99%

PSEC0020//1483bp//393aa//1st//0.69

PSEC0021//1851bp//116aa//3rd//0.82

PSEC0028//2395bp//348aa//2nd//0. 56//VESICULAR INTEGRAL-MEMBRANE PROTEIN VIP36 PRECURSOR (VIP36).//P49256//9. 30E-100//355aa//54%

PSEC0029//1683bp//300aa//1st//0.9//OXIDOREDUCTASE UCPA (EC 1.-.-.-).//P37440//1.00E-21//217aa//32%

PSEC0030//1584bp//406aa//1st//0.26

PSEC0031//1336bp//136aa//2nd//0.2

PSEC0035//1729bp//406aa//1st//0.93//NEURONAL OLFACTOMEDIN-RELATED ER LOCALIZED PROTEIN PRECURSOR(NOEL) (1B426B).//Q62609//6.30E-33//373aa//28%

PSEC0038//1883bp//223aa//1st//0.9//TRIOSE PHOSPHATE/PHOSPHATE TRANSLOCATOR, NON-GREEN PLASTID PRECURSOR (CTPT).//P52178//6.60E-13//157aa//33%

PSEC0040//2027bp//216aa//2nd//0.82

PSEC0041//2518bp//240aa//2nd//0.51

PSEC0045//1631bp//372aa//1st//0.85

PSEC0048//3707bp//383aa//2nd//0.71//Homo sapiens serine protease mRNA, complete cds.//AF015287//0//1638bp//99%

PSEC0049//2652bp//131aa//1st//0.35//Homo sapiens brain my047 protein mRNA, complete cds.//AF063605//0//2651bp//99%

PSEC0051//3293bp//227aa//3rd//0.63

PSEC0052//3635bp//578aa//2nd//0.94//AQUALYSIN I PRECURSOR (EC 3. 4. 21. -).//P08594//1.60E-46//348aa//36%

PSEC0053//2366bp//285aa//1st//0.94//COLLAGEN ALPHA 1(XII) CHAIN PRECURSOR (FIBROCHIMERIN).//P13944//1.50E-37//227aa//31%

PSEC0055//2147bp//331aa//2nd//0.92//UDP N-ACETYLGLUCOSAMINE TRANSPORTER (GOLGI UDP-GLCNAC TRANSPORTER).//Q00974//4.80E-42//314aa//31%

PSEC0059//2863bp//230aa//3rd//0.72//Mus musculus claudin-2 mRNA, complete cds.//AF072128//4.50E-127//777bp//86% PSEC0061//1931bp//464aa//1st//0.94//BETA-MANNOSYLTRANSFERASE (EC 2. 4. 1.-).//P16661//6.00E-42//356aa//35%

PSEC0068//1717bp//194aa//1st//0.64

PSEC0070//2510bp//286aa//3rd//0.94//OLIGOSACCHARYL TRANSFERASE STT3 SUBUNIT HOMOLOG.//P46975//2.50E-99//301aa//63%

PSEC0071//3558bp//875aa//1st//0.94//INTER-ALPHA-TRYPSIN INHIBITOR HEAVY CHAIN H3 PRECURSOR (ITI HEAVY CHAIN H3) (SERUM-DERIVED HYALURONAN-ASSOCIATED PROTEIN) (SHAP).//Q06033//9.30E-141//576aa//37%

PSEC0072//2092bp//350aa//1st//0. 94//Homo sapiens mRNA for putative vacuolar proton ATPase membrane sector associated protein M8–9.//Y17975//2.10E-133//622bp//99%

PSEC0073//2341bp//523aa//1st//0.94//UDP-GLUCU-RONOSYLTRANSFERASE 2C1 MICROSOMAL (EC 2. 4. 1. 17) (UDPGT) (FRAGMENT).//P36514//7.90E-71//477aa//36%

PSEC0074//2971bp//770aa//1st//0.89//*Mus musculus* mRNA for semaphorin W, complete cds.//AB021291//0//2579bp//85%

PSEC0075//2244bp//633aa//2nd//0.79

PSEC0076//3253bp//860aa//1st//0.94//MITOCHONDRIAL PRECURSOR PROTEINS IMPORT RECEPTOR (72 KD MITOCHONDRIAL OUTER MEMBRANE PROTEIN) (MITOCHONDRIAL IMPORT RECEPTOR FOR THE ADP/ATP CARRIER) (TRANSLOCASE OF OUTER MEMBRANE TOM70).//P23231//3.80E-11//194aa//28%

PSEC0077//2195bp//483aa//1st//0.94//TROPONIN T, CARDIAC MUSCLE ISOFORMS (TNTC).//P02642//0.00000018//120aa//28%

PSEC0079//1290bp//189aa//2nd//0.94

PSEC0080//3171bp//740aa//2nd//0.94//*Homo sapiens* mRNA for NAALADase II protein.//AJ012370//0//3131bp//99%

PSEC0081//2890bp//172aa//1st//0.94

PSEC0082//1878bp//331aa//1st//0.94//PROBABLE OXIDOREDUCTASE (EC 1. -. -. -).//Q03326//7.30E-30//269aa//34%

PSEC0085//2392bp//280aa//1st//0.85//PROBABLE PROTEIN DISULFIDE ISOMERASE P5 PRECURSOR (EC 5.3.4.1).//P38660//5.60E-10//105aa//39%

PSEC0086//1821bp//390aa//1st//0.83//CELL SURFACE A33 ANTIGEN PRECURSOR.//Q99795//2.30E-23//259aa//32%

PSEC0087//1808bp//441aa//1st//0.94//*Homo sapiens* G protein-coupled receptor mRNA, complete cds.//AF181862//5.40E-27//1114bp//60%

PSEC0088//2015bp//467aa//1st//0.94//CATHEPSIN B PRECURSOR (EC 3. 4. 22. 1).//P07688//1.10E-39//315aa//34%

PSEC0090//1722bp//543aa//1st//0.92//*Homo sapiens* heparanase (HPA) mRNA, complete cds.//AF144325//0//1722bp//99%

PSEC0094//2291bp//564aa//1st//0.93//PROTEIN PTM1 PRECURSOR.//P32857//7.10E-15//284aa//28%

PSEC0095//2080bp//349aa//1st//0.94

PSEC0098//2185bp//208aa//1st//0.94

PSEC0099//1627bp//350aa//2nd//0.91

PSEC0100//1391bp//172aa//1st//0.77//*Homo sapiens* clone 24952 mRNA sequence, complete cds.//AF131758//7.70E-308//1391bp//99%

PSEC0101//2547bp//258aa//2nd//0.92

PSEC0104//1430bp//418aa//2nd//0.79

PSEC0105//2506bp//494aa//1st//0.94

PSEC0106//2465bp//326aa//2nd//0.94

PSEC0107//2557bp//130aa//2nd//0.89

PSEC0108//3099bp//267aa//3rd//0.86//HYPOTHETICAL 49.3 KD PROTEIN C30D11.06C IN CHROMOSOME I.//Q09906//9.80E-17//307aa//28%

PSEC0109//2563bp//736aa//1st//0.94//*Rattus norvegicus* leprecan (leprel) mRNA, complete cds.//AF087433//0//2501bp//84%

PSEC0110//2179bp//344aa//1st//0.94

PSEC0111//3362bp//208aa//1st//0.83

PSEC0112//3598bp//349aa//4th//0.74

PSEC0113//2451bp//423aa//1st//0.79//36 KD NUCLEOLAR PROTEIN HNP36 (DELAYED-EARLY RESPONSE PROTEIN 12) (DER12).//Q61672//4.20E-22//169aa//34%

PSEC0119//2518bp//555aa//1st//0.87//HYPOTHETICAL 63.9 KD PROTEIN C1F12. 09 IN CHROMOSOME I.//Q10351//4.50E-26//240aa//30%

PSEC0120//2250bp//302aa//2nd//0.94//Human alpha-1, 3-mannosyl-glycoprotein beta-1, 2-N-acetylglucosaminyltransferase (MGAT) gene, complete cds.//M61829//0//2235bp//92%

PSEC0021//1666bp//358aa//1st//0.94//HYPOTHETICAL 39.9 KD PROTEIN T15H9. 1 IN CHROMOSOME II PRECURSOR.//Q10005//4.10E-106//351aa//58%

PSEC0124//1686bp//476aa//1st//0.91//VITELLOGENIC CARBOXYPEPTIDASE PRECURSOR (EC 3. 4. 16.-).//P42660//1.10E-103//444aa//45%

PSEC0125//1999bp//256aa//1st//0.74//*Homo sapiens* mRNA for type II membrane protein, complete cds, clone: HP10328.//AB015630//4.50E-306//1433bp//98%

PSEC0126//1906bp//102aa//1st//0.89//*Homo sapiens* mRNA for leukotriene B4 omega-hydroxylase, complete cds.//AB002454//3.90E-251//970bp//86%

PSEC0127//1773bp//218aa//1st//0.94

PSEC0128//2134bp//306aa//1st//0.94

PSEC0129//1828bp//135aa//1st//0.94

PSEC0130//2934bp//265aa//1st//0.68

PSEC0131//1658bp//297aa//1st//0.94

PSEC0133//2023bp//240aa//1st//0.94

PSEC0134//1898bp//144aa//6th//0.71

PSEC0135//1755bp//322aa//3rd//0.75//*Homo sapiens* lymphatic endothelium-specific hyaluronan receptor LYVE-1 mRNA, complete cds.//AF118108//0//1640bp//99%

PSEC0136//1907bp//392aa//1st//0.93

PSEC0137//2981bp//571aa//1st//0.94

PSEC0139//1361bp//218aa//2nd//0.89

PSEC0143//1976bp//125aa//1st//0.74//ENDOSOMAL P24A PROTEIN PRECURSOR (70 KD ENDOMEMBRANE PROTEIN) (PHEROMONE ALPHA-FACTOR TRANSPORTER) (ACIDIC 24 KD LATE ENDOCYTIC INTERMEDIATE COMPONENT).//P32802//1.00E-19//129aa//38%

PSEC0144//2067bp//247aa//1st//0.94//*Homo sapiens* CGI-78 protein mRNA, complete cds.//AF151835//0//1961bp//99% nnnnnnnn//2807bp//346aa//7th//0.79//PUTATIVE G PROTEIN-COUPLED RECEPTOR GPR17 (R12).//Q13304//3.00E-44//308aa//36%

PSEC0147//1964bp//520aa//1st//0. 91//HYPOTHETICAL 52.8 KD PROTEIN T05E11.5 IN CHROMOSOME IV.//P49049//3.60E-19//203aa//38%

PSEC0149//1988bp//432aa//1st//0.94

PSEC0150//2259bp//217aa//1st//0. 94//*Homo sapiens* T-box protein TBX3 (TBX3) mRNA, complete cds.//AF170708//2.60E-140//673bp//98%

PSEC051//1688bp//467aa//1st//0.93//TISSUE ALPHA-L-FUCOSIDASE PRECURSOR (EC 3.2.1.51) (ALPHA-L-FUCOSIDASE I) (ALPHA-L-FUCOSIDE FUCOHYDROLASE).//P04066//5.20E-145//459aa//55%

PSEC0152//2130bp//374aa//2nd//0.86

PSEC0158//1836bp//137aa//4th//0.94//*Homo sapiens* lifeguard (LFG) mRNA, complete cds.//AF190461//2.50E-44//591bp//68%

PSEC0159//2198bp//372aa//1st//0.8//*Homo sapiens* mRNA for type II membrane protein, complete cds, clone: HP10328.//AB015630//0//2186bp//99%

PSEC0161//2222bp//496aa//1st//0.89//GLUCOSE TRANSPORTER TYPE 5, SMALL INTESTINE (FRUCTOSE TRANSPORTER).//P22732//8.10E-101//479aa//42%

PSEC0162//1320bp//271aa//1st//0.83

PSEC0163//2167bp//578aa//1st//0. 94//HYPOTHETICAL 67.8 KD PROTEIN IN IKI1-ERG9 INTERGENIC REGION.//P38875//3. 10E-48//228aa//36%

PSEC0164//1877bp//463aa//1st//0.93//GLIOMA PATHOGENESIS-RELATED PROTEIN (RTVP-1 PROTEIN).//P48060//1.80E-27//169aa//39%

PSEC0165//2111bp//242aa//1st//0.83

PSEC0167//874bp//103aa//7th//0.73

PSEC0168//2533bp//269aa//1st//0. 94//HYPOTHETICAL 42.5 KD PROTEIN IN TSM1-ARE1 INTERGENIC REGION.//P25625//2.50E-18//179aa//30%

PSEC0169//1792bp//204aa//1st//0.75//*Homo sapiens* transmembrane 4 superfamily protein mRNA, complete cds.//AF100759//0//1771bp//99%

PSEC0070//2622bp//353aa//1st//0.94//*Homo sapiens* E21G4 (E21G4) mRNA, complete cds.//AF191019//0//2542bp//99%

PSEC0171//2005bp//301aa//2nd//0.91

PSEC0172//2012bp//415aa//1st//0.92//*Homo sapiens* procollagen C-terminal proteinase enhancer protein 2 (PCOLCE2) mRNA, complete cds.//AF098269//0//1741bp//99%

PSEC0173//1740bp//406aa//1st//0.91//NEURONAL OLFACTOMEDIN-RELATED ER LOCALIZED PROTEIN PRECURSOR(NOEL) (1B426B).//Q62609//6.60E-33//373aa//28%

PSEC0178//2308bp//222aa//3rd//0.94

PSEC0181//1890bp//165aa//3rd//0.66

PSEC0182//2153bp//657aa//2nd//0.82//*Homo sapiens* mRNA for UDP-GalNAc:polypeptide N-acetylgalactosaminyltransferase 7.//AJ002744//0//2006bp//99%

PSEC0183//2031bp//451aa//1st//0.88//CARTILAGE MATRIX PROTEIN PRECURSOR (MATRILIN-1).//P05099//5.50E-63//228aa//54%

PSEC0190//1841bp//194aa//1st//0.87

PSEC0191//1493bp//472aa//1st//0.87//ELASTIN PRECURSOR (TROPOELASTIN).//P15502//5.00E-113//367aa//67%

PSEC0192//1557bp//153aa//1st//0.93

PSEC0197//3555bp//576aa//2nd//0.85//PEROXISOMAL-COENZYME A SYNTHETASE (EC 6.-. -. -).//P38137//1.30E-33//169aa//32%

PSEC0198//2083bp//343aa//1st//0.94

PSEC0199//2586bp//283aa//1st//0.94

PSEC0200//1548bp//443aa//1st//0.94//*Mus musculus* immunosuperfamily protein B12 mRNA, complete cds.//AF061260//4.30E-243//1297bp//89%

PSEC0203//1457bp//323aa//1st//0.87

PSEC0204//1484bp//142aa//1st//0.74

PSEC0205//1656bp//435aa//1st//0.94//CELL DIVISION CONTROL PROTEIN 91.//P41733//7.70E-41//290aa//33%

PSEC0207//1754bp//262aa//3rd//0.94//*Homo sapiens* multispanning nuclear envelope membrane protein nurim (NRM29) mRNA, partial cds.//AF143676//0.00E+00//1399bp//99%

PSEC0209//2144bp//186aa//1st//0.93//*Homo sapiens* Pancreas-specific TSA305 mRNA complete cds.//AB020335//0//1770bp//99%

PSEC0210//1689bp//349aa//1st//0.71

PSEC0213//1824bp//323aa//1st//0.94

PSEC0214//1959bp//141aa//1st//0.94

PSEC0215//2112bp//551aa//2nd//0.94//*Homo sapiens* emilin precursor, mRNA, complete cds and 3' UTR.//AF088916//0//1470bp//98%

PSEC0216//1765bp//410aa//2nd//0.89

PSEC0218//1369bp//242aa//1st//0.69//*Homo sapiens* torsinA (DYT1) mRNA, complete cds.//AF007871//3.10E-26//619bp//61%

PSEC0220//1584bp//365aa//1st//0.94//Mouse Wnt-6 mRNA, complete cds.//M89800//5.50E-198//1310bp//82%

PSEC0222//899bp//139aa//2nd//0.94

PSEC0223//1874bp//221aa//1st//0.94

PSEC0224//1463bp//170aa//1st//0.89//UROMODULIN PRECURSOR (TAMM-HORSFALL URINARY GLYCOPROTEIN) (THP).//P48733//8.30E-10//141aa//36%

PSEC0226//2103bp//477aa//1st//0.94//*Mus musculus* carboxypeptidase X2 mRNA, complete cds.//AF017639//1.00E-114//1057bp//66%

PSEC0227//1410bp//379aa//2nd//0.81//Cricetulus griseus SREBP cleavage activating protein (SCAP) mRNA, complete cds.//U67060//2.50E-231//1099bp//84%

PSEC0228//1483bp//146aa//1st//0.92//COP-COATED VESICLE MEMBRANE PROTEIN P24 PRECURSOR (P24A) (RNP21.4).//Q63524//5. 90E-21//110aa//32%

PSEC0230//1784bp//271aa//1st//0.76//SIGNAL RECOGNITION PARTICLE RECEPTOR BETA SUBUNIT (SR-BETA).//P47758//5.80E-123//271aa//90% PSEC0232//1709bp//246aa//1st//0. 75//30 KD ADIPOCYTE COMPLEMENT-RELATED PROTEIN PRECURSOR (ACRP30) (ADIPOCYTE SPECIFIC PROTEIN ADIP0Q).//Q60994//3.30E-24//242aa//32%

PSEC0233//2499bp//267aa//1st//0.82

PSEC0235//1601bp//211aa//1st//0.94

PSEC0236//1906bp//529aa//1st//0.94//LAMININ GAMMA-1 CHAIN PRECURSOR (LAMININ B2 CHAIN).//P1047//5.00E-181//472aa//62%

PSEC0240//1638bp//253aa//1st//0.94//WNT-11 PROTEIN PRECURSOR.//O96014//3.40E-109//220aa//93%

PSEC0241//3593bp//622aa//1st//0.85//*Homo sapiens* cerebral cell adhesion molecule mRNA, complete cds.//AF177203//2.50E-121//1541bp//68%

PSEC0243//2835bp//743aa//3rd//0.77

PSEC0244//2063bp//287aa//1st//0.91

PSEC0245//2896bp//418aa//3rd//0.91//INTEGRAL MEMBRANE GLYCOPROTEIN GP210 PRECURSOR.//P11654//3.40E-205//483aa//78%

PSEC0246//2969bp//345aa//1st//0.94//LOW-DENSITY LIPOPROTEIN RECEPTOR-RELATED PROTEIN 2 PRECURSOR (MEGALIN) (GLYCOPROTEIN 330).//P98158//1.60E-22//126aa//42%

PSEC0247//2872bp//236aa//1st//0.94//PLATELET-ENDOTHELIAL TETRASPAN ANTIGEN 3 (PETA-3) (GP27) (MEMBRANE GLYCOPROTEIN SFA-1) (CD151 ANTIGEN).//O35566//3.30E-28//237aa//29%

PSEC0248//2694bp//172aa//1st//0.84

PSEC0249//3320bp//534aa//1st//0.94//BUTYROPHILIN PRECURSOR (BT).//Q62556//1.10E-21//276aa//32%

PSEC0250//2179bp//223aa//2nd//0.74//TWISTED GASTRULATION PROTEIN PRECURSOR.//P54356//1.50E-34//231aa//35%

PSEC0252//2617bp//491aa//3rd//0.89//HYPOTHETICAL 56.2 KD PROTEIN IN ERG8-UBP8 INTERGENIC REGION.//Q04991//2.40E-15//208aa//29%

PSEC0253//2872bp//265aa//1st//0.69//PHOSPHATIDYLINOSITOL-4-PHOSPHATE 5-KINASE TYPE II ALPHA (EC 2.7.1.68) (PIP5KII-ALPHA) (1-PHOSPHATIDYLINOSITOL-4-PHOSPHATE KINASE) (PTDINS(4)P-5-KINASE B ISOFORM) (DIPHOSPHOINOSITIDE KINASE).//O70172//1.30E-139//240aa//62%

PSEC0255//3774bp//687aa//2nd//0.89//*Homo sapiens* mRNA for TM7XN1 protein.//AJ11101//0//3700bp//99%

PSEC0258//3791bp//349aa//1st//0.94

PSEC0259//2583bp//242aa//2nd//0.89//CYTOCHROME B561 (CYTOCHROME B-561).//095245//3.70E-44//211aa//47%

PSEC0260//2492bp//496aa//1st//0.94

PSEC0261//3080bp//806aa//2nd//0.76//MITOCHONDRIAL PRECURSOR PROTEINS IMPORT RECEPTOR 72 MD MITOCHONDRIAL OUTER MEMBRANE PROTEIN) (MITOCHONDRIAL IMPORT RECEPTOR FOR THE ADT/ATP CARRIER) (TRANSLOCASE OF OUTER MEMBRANE TOM70).//P23231//4.60E-07//176aa//23%

PSEC0283//4144bp//971aa//2nd//0.94

PSEC0084//2788bp//335aa//1st//0.86//IMPLANTATION-ASSOCIATED PROTEIN.//035777//1.80E–167//335aa//92%

PSEC0237//1419bp//248aa//1st//0.81//*Homo sapiens* CTG4a mRNA, complete cds.//U80744//8.30E–22//157bp//61%

PSEC0264//2617bp/167aa//1st//0.94

PSEC0265//2646bp//192aa//1st//0.76

(Annotation 1) Clones with relatively low score in the ATGpr1 (PSEC0017, ATGpr1 0.33; PSEC0030, ATGpr1 0.26; PSEC0031, ATGpr1 0.20; PSEC0049, ATGpr1 0.35): These clones, in which data of the 5'-end sequence (one pass sequencing) was not sorted by the ATGpr, were selected as a clone having both the signal sequence and long ORF based on the data of the 5'-end sequence, and the sequence of their full-length cDNA clones was analyzed. All the clones have the signal sequence in the N-terminus. In addition, the above 4 clones except PSEC0049 had portions not contained in known EST in the 5'-end when compared to known EST. PSEC0049 had portions not contained in EST in the 5'-end within the ORF of the cDNA when compared with known EST. Thus, it turned out that these clones were full-length cDNA clones.

The next 15 proteins out of the 173 proteins of the present invention were encoded by the cDNA clones as shown in List 2 (PSEC0027, PSEC0047, PSEC0066, nnnnnnnn, PSEC0069, PSEC0078, PSEC0092, PSEC0103, PSEC0117, PSEC0142, PSEC0212, PSEC0239, PSEC0242, PSEC0251, and PSEC0256). These clones were predicted to encode a membrane protein (containing the transmembrane helix) by the MEMSAT (Jones D. T., Taylor W. R., and Thornton J. M. (1994) Biochemistry 33: 30308–3049). Similarly, the clones were predicted to encode a membrane protein by the SOSUI (Hirokawa T. et al. (1998) Bioinformatics 14:378–379) (Mitsui Information Development Inc.). Thus, the clones were those "isolated from the human cDNA libraries constructed by the oligo-capping method, predicted to be a full-length cDNA clone by ATGpr etc., and predicted to encode a membrane protein by both MEMSAT and SOSUI". The protein encoded by the clones are also classified into the category of a secretory proteins or membrane proteins described above. Two clones among the 15 clones (PSEC0243, and PSEC0251) were predicted to encode a membrane protein without a signal sequence in the N-terminus. However, in both clones; if translation starts from the third ATG (having high scores in the ATGpr1), the resulting protein will contain a signal sequence in the N-terminus. Accordingly, it is possible that the two clones are classified into the category of secretory proteins or membrane proteins that contains a signal sequence in N-terminus.

The list shown below indicates PSEC number, length of cDNA, length of amino acid sequence, ATG No. from the 5' end, ATGpr1 value, predicted result for signal sequence by PSORT, predicted result for membrane protein by MEMSAT and SOSUI, definition of annotation data, Accession No. of annotation data, P value, length of compared sequence, and homology in this order, separating each of these with a double-slash mark, //. The annotation data are not shown for clones that did not exhibit explicit homology as a result of BLAST analysis of GenBank and SwissProt.

List 2

PSEC0027//1085bp//271aa//1st//0.94//No //transmembrane

PSEC0047//2078bp//267aa//1st//0.94//No //transmembrane//INTEGRAL MEMBRANE PROTEIN 28 (TRANSMEMBRANE PROTEIN B3-16) //042204//1.80E-66//264aa//44%

PSBC0092//3624bp//465aa//1st//0.94//No //transmembrane//Homo sapiens mRNA for heparan-sulfate 6-sulfotransferase, complete eds.//AB006179//2.708-102//1057bp//71%

PSEC0066//2682bp//474aa//1st//0.79//No //transmembrane//TETRACYCLINE RESISTANCE PROTEIN, CLASS B (TETA (E)).//Q07232//7.508-19//173aa//315 nnnnnnnn//2406bp//730aa//1st//0.26//No //transmembrane//VERY-LONG-CHAIN AACYL-COA SYNTHETASE (EC 6. 2. 1.-) (VERY-LONG-CHAIN- FATTY-ACID-COA LINGASE).//035488//2.50E-140//520aa//45%

PSEC0069//2568bp//433aa//2nd//0.94//No //transmembrane

PSEC0103//2630bp//236aa//1st//0.94//No //transmembrane//Homo sapiens neuroendocrine-specific protein-like protein 1 (NSFL1) mRNA, complete cds.//AF119397//0//2594bp//99%

PSEC0117//1873bp//583aa//1st//0.94//No //transmembrane//*Rattus norvegicus* lipolysis-stimulated remnant receptor beta subunit mRNA, complete cds.//AF119689//2.005-221//1045bp//78%

PSEC0142//2153bp//343aa//2nd//0.94//No //transmembrane//PROBABLE G PROTEIN-COUPLED RECEPTOR RTA.//P23749//1.20E-159//343aa//84%

PSEC0212//1577bp//111aa//1st//0394//No //transmembrane//Homo sapiens NJAC protein (NJAC) mRNA, complete cds.//AF144108//1.408-237//1303bp//91%

PSEC0239//1712bp//423aa//2nd//0.18//No //transmembrane//Homo sapiens aspartyl proteins mRNA, complete eds.//AF050171//0111715bp//93%

PSEC0242//3017bp//401aa//1st//0.9//No //transmembrane

PSEC0251//2373bp//393aa//1st//0.78//No //transmembrane

PSEC0256//3520bp//612aa//1st//0.89//No //transmembrane//*Homo sapiens* protoadherin alpha 12 (PCDH-alpha 12) mRNA, complete eds.//AF162308//0//3520bp//99%

PSEC0078//2194bp//333aa//2nd//0.24//No //transmembrane//M-Sema F=e factor in neutral network development [mice, neonatal brain, mRNA, 3508 nt].//S79463//1.50E-282//1945bp//83%

(Annotation 1)

Clones with relatively low score in the ATGpr1 (PSEC0239, ATGpr1 0.18): PSEC0236 was selected as a clone having high score in the ATGpr based on the 5'-end sequence data (one pass sequencing), and also was predicted to be a membrane protein (containing the transmembrane helix) by the MBMSAT and SOSUL. In addition, the comparison with known ESTs revealed that the clone has a portion not contained in ESTs in the 5'-end of the cDNA.

(Annotation)

PSEC0242 and PSEC0251: The clones are classified into the category of the cDNA encoding the polypeptide "containing the signal sequence in the N-terminus", if translation starts from the third ATG.

PSEC0242: No.3 ATG, ATGpr1 0.82, SP-Yes, ORF 171-1343, 391 aa, Signal peptide 24 aa;

PSEC0251: No.3 ATG, ATGpr1 0.77, SP-Yes, ORF 116-1256, 380 aa, Signal peptide 28 aa.

Herein, "SP-Yes" means that a signal sequence is present at the N-terminus predicted by the PSORT.

(Annotation 3) The ATGpr1 value for PSEC0078 was 0.24. This is a clone exhibited high ATGpr1 value based on the 5'-end sequence data (one pass sequencing), and also has been predicted to be a membrane protein (having a transmembrane helix) by MHMSAT and SOSUI analyses. In addition, in comparison with EST sequences, the cDNA sequence was not found to be 50 bp or more shorter than any FT sequences, the cDNA sequence was not found to be 50 bp or more shorter than any FST sequence at their 5'-end, and therefore the clone was not judged to be a incomplete cDNA clone by using ESTs as criteria for the judgement.

The last 2 proteins among the 173 proteins of the present invention were encoded by the cDNA clones shown in List 3 (PSEC0195, and PSEC0206). As a result of the homology search of the SwissProt, PSEC0195, and PSEC0206 were fund to have relatively high homology with mouse plasma membrane adapter HA2/AP2 adaptin alpha C subunit, and human carboxypeptidase H precursor (prohormone processing carboxypeptidase) in the secretory granule, respectively. Accordingly, the proteins are classified into the category of secretory proteins or membrane proteins.

List 3

The list shown below indicates PSEC number, length of cDNA, length of amino acid sequence, ATG No. from the 5' end, ATGpr1 value, predicted result for signal sequence by PSORT, predicted result for membrane protein by MEMSAT and SOSUI, definition of annotation data, Accession No. of annotation data, P value, length of compared sequence, and homology in this order, separating each of these with a double-slash mark, //.

PSEC0195//1979bp//467aa//2nd//0.80//No//No//ALPHA-ADAPTIN C (CLATHRIN ASSEMBLY PROTEIN COMPLEX 2 ALPHA-C LARGE CHAIN) (100 KD COATED VESICLE PROTEIN C) (PLASMA MEMBRANE ADAPTOR HA2/AP2 ADAPTIN ALPHA C SUBUNIT).//P17427//1.8E-144//281aa//98%

PSEC0206//1606bp//430aa//3rd//0.90//No//No//CARBOXYPEPTIDASE H PRECURSOR (EC 3.4.17.10) (CPH) (CARBOXYPEPTIDASE E) (CPE) (ENKEPHALIN CONVERTASE) (PROHORMONE PROCESSING CARBOXYPEPTIDASE).//P15087//1.8E-103//397aa//49%

Since the amino acid sequence of the secretory protein or membrane protein of the present invention has been determined, it is possible to analyze its biological function(s) by expressing it as a recombinant protein utilizing an appropriate expression system, or by using a specific antibody against it.

For example, the biological activity of a secretory protein or membrane protein can be analyzed according to the methods described in "Glycobiology" (Fukuda M., and Kobata A. edit., (1993)), "Growth Factors" (McKay I., and Leigh I. edit., (1993)), and "Extracellular Matrix" (Haralson M. A., Hassell J. R. edit., (1995)) in the series of "The Practical Approach" (IRL PRESS), or "Glycoprotein Analysis in Biomedicine" (Hounsell E. F. edit., (1993)) in the series of "Method in Molecular Biology" (Humana Press). Alternatively, the methods disclosed in "New protocols in biochemical experiments Vol. 7: Growth and differentiation factors and their receptors" (Japan Biochemistry Society edit. (1991)) (Tokyo Kagaku-Dojin), or "Vol. 296: Neurotransmitter Transporters", "Vol. 294: Ion Channels (Part C)", "Vol. 293: Ion Channels (Part B)", "Vol. 292: ABC Transporters", "Vol. 288: Chemokine Receptors", "Vol. 287: Chemokines", "Vol. 248: Proteolytic Enzymes", "Vol. 245: Extracellular Matrix Components", "Vol. 244: Proteolytic Enzymes", "Vol. 230: Guide to Techniques in Glycobiology", "Vol. 198: Peptide Growth Factors", "Vol. 192: Biomembranes", "Vol. 191: Biomembranes", and "Vol. 149: Drug and Enzyme Targeting" in the series of "Methods in Enzymology" (Academic Press) may be used to analyze the biological activity of a secretory protein or membrane protein.

As for secretory proteins and membrane proteins, in the search of the Online Mendelian Inheritance in Man (OMIM) using the following keywords, the results obtained with each keyword, suggest the association of the proteins with many diseases, as described below. Therefore, the secretory proteins and membrane proteins are useful as a target in the medicinal industry.

New information is constantly updated in the OMIM database. Therefore, it is possible for one skilled in the art to find a new relationship between a particular disease and a gene of the present invention in the updated database.

Keywords used in the search of the OMIM (1) secretion protein (2) membrane protein Shown in the search result are only the accession numbers in the OMIM. Using the number, data showing the relationship between a disease and a gene or protein can be seen. The OMIM data has been renewed everyday.

1) Secretion Protein 268 entries found, searching for "secretion protein"

104760, 176860, 160900, 107400, 118910, 139320, 603850, 147572, 176880, 600946, 603215, 157147, 600174, 151675, 170280, 179512, 179513, 138120, 179509, 246700, 179510, 600626, 179511, 600998, 109270, 601489, 154545, 179490, 185860, 603216, 122559, 601746, 147290, 602672, 146770, 603062, 179508, 131230, 601591, 602421, 139250, 167805, 167770, 600041, 600564, 118825, 601146, 300090, 600753, 601652, 600759, 600768, 602434, 182590, 603166, 308230, 602534, 603489, 107470, 150390, 104610, 173120, 158106, 143890, 306900, 308700, 134797, 137350, 227500, 176300, 107730, 600760, 138079, 120180, 120160, 120150, 124092, 138160, 101000, 227600, 600509, 601199, 142410, 104311, 193400, 201910, 107300, 122560, 272800, 217000, 590050, 147670, 133170, 176730, 300300, 134370, 274600, 120140, 162151, 158070, 152790, 120120, 106100, 300200, 192340, 190160, 138040, 147470, 147620, 173350, 147380, 152200, 152760, 157145, 153450, 264080, 113811, 600937, 600840, 188545, 202110, 600514, 186590, 603372, 136435, 137241, 252800, 214500, 207750, 138850, 139191, 142640, 138130, 189907, 603692, 600633, 603355, 107270, 600377, 147892, 232200, 600281, 232800, 602358, 137035, 601771, 601769, 253200, 601933, 118444, 600270, 120700, 600945, 603732,

-continued 147660, 600761, 172400, 600823, 600877, 130080, 171060, 107740, 307800, 602843, 130660, 152780, 124020, 601124, 601340, 601604, 601610, 171050, 312060, 232700, 300159, 142703, 600734, 125255, 168450, 123812, 188540, 147940, 188450, 600839, 182452, 188400, 182280, 176760, 263200, 600264, 188826, 252650, 601185, 162641, 137216, 601398, 601538, 118888, 118445, 601745, 190180, 601922, 182098, 602008, 147440, 602384, 600031, 109160, 602663, 151670, 602682, 602730, 602779, 146880, 603061, 142704, 603140, 106150, 600732, 153620, 603318, 139392, 600042, 102200, 603493, 182100, 264300, 603795, 184600

2) Membrane Protein 1017 entries found, searching for "membrane protein"

130500, 305360, 153330, 173610, 170995, 109270, 170993, 309060, 120920, 602333, 133740, 133710, 602690, 133730, 159430, 600897, 133090, 601178, 602413, 602003, 109280, 603237, 602173, 107776, 602334, 125305, 602335, 182879, 154045, 309845, 600594, 603718, 603241, 603214, 603657, 603177, 600182, 601476, 602879, 136950, 600723, 601114, 185880, 185881, 300096, 602257, 160900, 177070, 603062, 603344, 602977, 310200, 600959, 300100, 186945, 600039, 600267, 128240, 182900, 601097, 136430, 600946, 602534, 601047, 143450, 603141, 603700, 600579, 256540, 159440, 602414, 600403, 602048, 188860, 137290, 158343, 184756, 602910, 603179, 600279, 108733, 107770, 173335, 602625, 154050, 219800, 603850, 601028, 600447, 104225, 186946, 601767, 603143, 121015, 603215, 227400, 603735, 600179, 602421, 180721,
176801, 176860, 600753, 603142, 176790, 600266, 601239, 115501, 143890, 121014, 121011, 125950, 603534, 304040, 601134, 600754, 601510, 601595, 190315, 300172, 602216, 602261, 602262, 602461, 131560, 179514, 179512, 176981, 142461, 139310, 312080, 176640, 128239, 185470, 310300, 601403, 601757, 273800, 151460, 176943, 104311, 168468, 120130, 602887, 600164, 601531, 601832, 104775, 600040, 603583, 176894, 602631, 166945, 182180, 120620, 141180, 601014, 139150, 182860, 177061, 600174, 180069, 191275, 104760, 601693, 300017, 603518, 601009, 134651, 601107, 603868, 600168, 136425, 603531, 603291, 600917, 603216, 102720, 300118, 179590, 135630, 602285, 107450, 602296, 303630, 176878, 120090, 600322, 138160, 601212, 603293, 131230, 112205, 600763, 600718, 300187, 170715, 601966, 300051, 602474,
120070, 600691, 600855, 182309, 602101, 602857, 194355, 162230, 600874, 113730, 155550, 602701, 306400, 601789, 231200, 107271, 175100, 182870, 305100, 301000, 601313, 157147, 147670, 139200, 603593, 157655, 600934, 155970, 602049, 155960, 155760, 118990, 135620, 308230, 602694, 162060, 300023, 160993, 153619, 153432, 120131, 603823, 603167, 601023, 600816, 165040, 601681, 166490, 300112, 120190, 300145, 163970, 600772, 602926, 602933, 602202, 400015, 151510, 600759, 602672, 602654, 603821, 116952, 151430, 602632, 155975, 602217, 150370, 600752, 601179, 600932, 603048, 603234, 601805, 603822, 603869, 601717, 601181, 313440, 139130, 107777, 109190, 603452, 191163, 191164, 602370, 176877, 103195, 600523, 191328, 601275, 204200, 602426, 603820, 600551, 600695, 600552, 600553, 602306, 601523,
602507, 602299, 600583, 114070, 600632, 603498, 185430, 600587, 235200, 173470, 603199, 601633, 602500, 208900, 180297, 156225, 516020, 190195, 141900, 102680, 193300, 101000, 193400, 300011, 107400, 257220, 107741, 180380, 203200. 111700. 600024, 304800, 600065, 110750, 179605, 113705, 601638, 222900, 120120, 602509, 602469, 600930, 601383, 176261, 602574, 602997, 311770, 131550, 603616, 308700, 603372, 256100, 224100, 276903, 305900, 516000, 131195, 314555, 601567, 603866, 306900, 103390, 186720, 173850, 601050, 602505, 186590, 246530, 602689, 194380, 300041, 162643, 152790, 120150, 600682, 600106, 272750, 188040, 602382, 601497, 113811, 182138, 212138, 601309, 109690, 114760, 176805, 601253, 123900, 602581, 189980, 191190, 110700, 600163, 137167, 600580, 601610, 190000, 123825, 603491,
600135, 186591, 173910, 138140, 107266, 120950, 601081, 603690, 244400, 312700, 171060, 601199, 601758, 170500, 277900, 601997, 314850, 601880, 603009, 120220, 603126, 164920, 602934, 164730, 163890, 603434, 107269, 602909, 600877, 256550, 164761, 602872, 120110, 126150, 158070, 266200, 223360, 250800, 269920, 252650, 603355, 154582, 138190, 300035, 602640, 227650, 158120, 153700, 182380, 155740, 204500, 603401, 601975, 300135, 136350, 602924, 300167, 185050, 176100, 300189, 151525, 300200, 165180, 230800, 602158, 602676, 603411, 193245, 120325, 601848, 192500, 603102, 147795, 245900, 137060, 147557, 120650, 602377, 307800, 120930, 308100, 142800, 191092, 232300, 173510, 602225, 180470, 190930, 186357, 134638, 600544, 601373, 600509, 600359, 603784, 600395, 600653, 603754, 601597, 601066,
600185, 601295, 600978, 205400, 603274, 600418, 600839, 516050, 601691, 601007, 600650, 600308, 603261, 601193, 600004, 600017, 516040, 253800, 276901, 600019, 257200, 108780, 300037, 300104, 300126, 255125, 203300, 300191, 426000, 302060, 304700, 201475, 252010, 193210, 311030, 306250, 248600, 191740, 108360, 131244, 600423, 232200, 191305, 231680, 103320, 190180, 600493, 111200, 226200, 312600, 600170, 111680, 186910, 203100, 600536, 600238, 186830, 186760, 186745, 186711, 106180, 112203, 103180, 182530, 182160, 600644, 307030, 192321, 600667, 125647, 179080, 114207, 114860, 176000, 116930, 600748, 173515, 173325, 600377, 171760, 171050, 118425, 170260, 191315, 600798, 600821, 600823, 600444, 600840, 159465, 600857, 158380, 600867, 154360, 152427, 150330, 110900, 147840, 147360, 147280,
146880, 312610, 120940, 142871, 142790, 600937, 142600, 134390, 111250, 600979, 600997,

-continued 142460, 186845, 134635, 601017, 139191, 139090, 138850, 601040, 138720, 122561, 131100,
123610, 217070, 100500, 603377, 602354, 603302, 603207, 603086, 602188, 602095, 603867,
603842, 603798, 602602, 601194, 602607, 603713, 603681, 601252, 603648, 603646, 603644,
601282, 601284, 603667, 603712, 603594, 601872, 603425, 601843, 603263, 603208, 601411,
603201, 603189, 601463, 603164, 603152, 603087, 602874, 601492, 602893, 602057, 602859,
602746, 603879, 603510, 602458, 603380, 601581, 603765, 603283, 601599, 601733, 601852,
602316, 601615, 601617, 602184, 602894, 603005, 603030, 603861. 602835, 602136, 600153,
600074, 600046, 600023, 601625, 516006, 600018, 600016, 516002, 601590, 313475, 313470,
600244,
600528, 601611, 600282, 600327, 601568, 600368, 601730, 601535, 601745, 601929, 300169,
300150, 300132, 601533, 600385, 600464, 600424, 600429, 601756, 601488, 516005, 251100,
516004, 600918, 516003, 602192, 516001, 240500, 600465, 602241, 602243, 230200, 601485,
601478, 601416, 602297, 601459, 601839, 602314, 193065, 193001, 191306, 600504, 601020,
191191, 602372, 190181, 600534, 188380, 186854, 186360, 600530, 185250, 182331, 600535,
182305, 601296, 600582, 600732, 600734, 600742, 600782, 176802, 176266, 600769, 601883,
600864, 601901, 176260, 173490, 600910, 601905, 171890, 600916, 601987, 602679, 162651,
161555, 160994, 602714, 602715, 602724, 602736, 300007, 602783, 275630, 602836, 270200,
602871, 159460, 602876, 154540, 153900, 602890, 601153, 602190, 602905, 153634, 153337,
602914,
152310, 151690, 151625, 602935, 602974, 150325, 602992, 150320, 250790, 603006, 603007,
603008, 150292, 233690, 603046, 150210, 603061, 147940, 603063, 221770, 223100, 603097,
147880, 603118, 147730, 146928, 146630, 142622, 603149, 603150, 603151, 600923, 138981,
138590, 138330, 216950, 603192, 138297, 603202, 601002, 602343, 138230, 136131, 603217,
603220, 134660, 131390, 131235, 603242, 603243, 130130, 602345, 603547, 126455, 601123, 126064,
125240, 602359, 603312, 602380, 603318, 123890, 123836, 603356, 603361, 603366, 123830,
179610, 188060, 123620, 120980, 186355, 118510, 114835, 114217, 113810, 603499, 182310,
111740, 109610, 603548, 603564, 108740, 603598, 603613, 107273, 603626, 602518, 179410,
603647, 602515, 603652, 106195, 602573, 178990, 105210, 104615, 167055, 603717, 104614,
603728,
104210, 603749, 603750, 103850, 602608, 603787, 603788, 603796, 173445, 103220, 102910,
102681, 102670, 102642, 603833, 173391, 102576, 102575, 171833, 102573, 101800, 603875,
601108

There are several methods for analyzing the expression levels of genes associated with diseases. Differences in gene expression levels between diseased and normal tissues are studied by the analytical methods, for example, Northern hybridization and differential display. Other examples include a method with high-density cDNA filter, a method with DNA microarray and methods with PCR amplification (Experimental Medicine, Vol. 17, No. 8, 980–1056 (1999); Cell Engineering (additional volume) DNA Microarray and Advanced PCR Methods, Muramatsu & Naba (eds.), Shujunsya). The levels of gene expression between diseased tissues and normal tissues can be studied by any of these analytical methods. When explicit difference in expression level is observed for a gene, it can be concluded that the gene is closely associated with a disease or disorder. Instead of diseased tissues, cultured cells can be used for the assessment. Similarly, when gene expression is explicitly different between normal cells and cells reproducing disease-associated specific features, it can be concluded that the gene is closely associated with a disease or disorder. When the expression levels of genes are evidently varied during major cellular events (such as differentiation and apoptosis), the genes are involved in the cellular events and accordingly are candidates for disease- and/or disorder-associated genes. Further, genes exhibiting tissue-specific expression are genes playing important parts in the tissue functions and, therefore, can be candidates for genes associated with diseases and/or disorders affecting the tissues.

For example, non-enzymic protein glycation reaction is believed to be a cause for a variety of chronic diabetic complications. Accordingly, genes, of which expression levels are elevated or decreased in a glycated protein-dependent manner, are associated with diabetic complications caused by glycated proteins (Diabetes 1996, 45 (Suppl. 3), S67–S72; Diabetes 1997, 46 (Suppl. 2). S19–S25). The onset of rheumatoid arthritis is thought to be involved in the proliferation of synovial cells covering inner surfaces of joint cavity and in inflammatory reaction resulted from the action of cytokines produced by leukocytes infiltrating into the joint synovial tissues (Rheumatism Information Center). Recent studies have also revealed that tissue necrosis factor (TNF)-α participates in the onset (Current opinion in immunology 1999, 11, 657–662). When the expression of a gene exhibits responsiveness to the action of TNF on synovial cells, the gene is considered to be involved in rheumatoid arthritis. Genes associated with neural differentiation can be candidates for causative genes for neurological diseases as well as candidates for genes usable for treating the diseases.

Clones exhibiting differences in the expression levels thereof can be selected by using gene expression analysis. The selection comprises, for example; analyzing cDNA clones by using high-density cDNA filter; and statistically treating the multiple signal values (signal values of radioisotope in the radiolabeled probes or values obtained by measuring fluorescence intensities emitted from the fluorescent labels) for the respective clones by two-sample t-test, where the signal values are determined by multiple experiments of hybridization. The clones of interest are selectable based on the statistically significant differences in the signal distribution at $p<0.05$. However, selectable clones with significant difference in the expression levels thereof may be changed depending on the partial modification of statistical treatment. For example, the clones may be selected by conducting statistical treatment with two-sample t-test at $p<0.01$; or genes exhibiting more explicit differences in the expression levels thereof can be selected by performing statistical treatment with a pre-determined cut-off value for the significant signal difference. An alternative method is that the expression levels are simply compared with each other, and then, the clones of interest are selected based on the ratio of the expression levels thereof.

Clones exhibiting differences in the expression levels thereof can also be selected by comparing the expression levels by PCR analysis, for example, by using the method of determining the band intensities representing the amounts of PCR products with ethidium bromide staining; or the method of determining the values of radioisotope signals or fluorescence intensities of the probes hybridized to the PCR products when radiolabeled or fluorescent dye-labeled probes, respectively, are used in the hybridization. If the expression level ratios obtained in multiple PCR experiments are constantly at least 2-fold, such a clone can be judged to exhibit the difference in the expression level thereof. When the ratios are several-fold or not less than 10-fold, the clone can be selected as a gene exhibiting the explicit difference in the expression level thereof.

A survey of genes of which expression levels are varied in response to TNF α (Tumor Necrosis Factor-alpha) in the primary cell culture of synovial tissue detected the following clones with elevated expression levels in the presence of TNF α:

PSEC0070, PSEC0073, PSEC0084, PSEC0100, PSEC0109, PSEC0120, PSEC0131, PSEC0161, PSEC0183, PSEC0192, PSEC0197, PSEC0205, PSEC0207, PSEC0210, PSEC0213, PSEC0222, PSEC0230, PSEC0241, PSEC0252, PSEC0259.

On the other hand, clones with decreased expression levels in the presence of TNF α are PSEC0105 and PSEC0245. These clones are candidates for rheumatoid arthritis-associated genes.

A survey of genes of which expression levels are varied in response to the stimulation for inducing cell differentiation (stimulation using retinoic acid (RA)) in cultured cells of neural strain, NT2, detected the following clones with varied expression levels: PSEC005, PSEC0048, PSEC0059, PSEC0200, and PSEC0232. These are important genes associated with neural differentiation. The following clones also had varied their expression levels: PSEC0017, PSEC0019, PSEC0021, PSEC0030, PSEC0041, PSEC0047, PSEC0049, PSEC0055, PSEC0066, PSEC0070, PSEC0071, PSEC0072, PSEC0074, PSEC0075, PSEC0076, PSEC0080, PSEC0081, PSEC0084, PSEC0088, PSEC0094, PSEC0103, PSEC0104, PSEC0105, PSEC0112, PSEC0113, PSEC0117, PSEC0119, PSEC0120, PSEC0127, PSEC0129, PSEC0136, PSEC0139, PSEC0143, PSEC0144, PSEC0152, PSEC0161, PSEC0169, PSEC0171, PSEC0181, PSEC0182, PSEC0192, PSEC0195, PSEC0203, PSEC0215, PSEC0223, PSEC0235, PSEC0239, PSEC0243, PSEC0251, PSEC0255, PSEC0265.

These clones are also associated with neural differentiation and, therefore, are candidates for genes associated with neurological diseases.

Based on the functional analyses using a secretory protein or membrane protein, it is possible to develop a medicine.

In case of a membrane protein, it is most likely to be a protein that that functions as a receptor or ligand on the cell surface. Therefore, it is possible to reveal a new relationship between a ligand and receptor by screening the membrane protein of the invention based on the binding activity with the known ligand or receptor. Screening can be performed according to the known methods.

For example, a ligand against the protein of the invention can be screened in the following manner. Namely, a ligand that binds to a specific protein can be screened by a method comprising the steps of: (a) contacting a test sample with the protein of the invention or a partial peptide thereof, or cells expressing these, and (b) selecting a test sample that binds to said protein, said partial peptide, or said cells.

On the other hand, for example, screening using cells expressing the protein of the present invention that is a receptor protein can also be performed as follows. It is possible to screen receptors that is capable of binding to a specific protein by using procedures (a) attaching the sample cells to the protein of the invention or its partial peptide, and (b) selecting cells that can bind to the said protein or its partial peptide.

In a following screening as an example, first the protein of the invention is expressed, and the recombinant protein is purified. Next, the purified protein is labeled, binding assay is performed using a various cell lines or primary cultured cells, and cells that are expressing a receptor are selected (Growth and differentiation factors and their receptors, Shin-Seikagaku Jikken Kouza Vol. 7 (1991) Honjyo, Arai, Taniguchi, and Muramatsu edit, p 203–236, Tokyo-Kagaku-Doujin). A protein of the invention can be labeled with RI such as $^{125}I$, and enzyme (alkaline phosphatase etc.). Alternatively, a protein of the invention may be used without labeling and then detected by using a labeled antibody against the protein. The cells that are selected by the above screening methods, which express a receptor of the protein of the invention, can be used for the further screening of an agonists or antagonists of the said receptor.

Once the ligand binding to the protein of the invention, the receptor of the protein of the invention or the cells expressing the receptor are obtained by screening, it is possible to screen a compound that binds to the ligand and receptor. Also it is possible to screen a compound that can inhibit both bindings (agonists or antagonists of the receptor, for example) by utilizing the binding activities.

When the protein of the invention is a receptor, the screening method comprises the steps of (a) contacting the protein of the invention or cells expressing the protein of the invention with the ligand, in the presence of a test sample, (b) detecting the binding activity between said protein or cells expressing said protein and the ligand, and (c) selecting a compound that reduces said binding activity when compared to the activity in the absence of the test sample. Furthermore, the protein of the invention is a ligand, the screening method comprises the steps of (a) contacting the protein of the invention with its receptor or cells expressing the receptor in the presence of samples, (b) detecting the binding activity between the protein and its receptor or the cells expressing the receptor, and (c) selecting a compound that can potentially reduce the binding activity compared to the activity in the absence of the sample.

Samples to screen include cell extracts, expressed products from a gene library, synthesized low molecular compound, synthesized peptide, and natural compounds, for example, but are not construed to be listed here. A compound that is isolated by the above screening using a binding activity of the protein of the invention can also be used as a sample.

A compound isolated by the screening may be a candidate to be an agonist or an antagonist of the receptor of the protein. By utilizing an assay that monitors a change in the intracellular signaling such as phosphorylation that results from reduction of the binding between the protein and its receptor, it is possible to identify whether the obtained compound is an agonist or antagonist of the receptor. Also, the compound may be a candidate of a molecule that can inhibit the interaction between the protein and its associated proteins (including a receptor) in vivo. Such compounds can be used for developing drugs for precaution or cures of a disease with which the protein is associated.

Secretory proteins may regulate cellular conditions such as growth and differentiation. It is possible to find out a novel factor that regulates cellular conditions by adding the secretory protein of the invention to a certain kind of cell, and performing a screening by utilizing the cellular changes in growth or differentiation, or activation of a particular gene.

The screening can be performed, for example, as follows. First, the protein of the invention is expressed and purified in a recombinant form. Then, the purified protein is added to a various kind of cell lines or primary cultured cells, and the change in the cell growth and differentiation is monitored. The induction of a particular gene that is known to be involved in a certain cellular change is detected with the amounts of mRNA and protein. Alternatively, the amount of an intracellular molecule (low molecular compounds, etc.) that is changed by the function of a gene product (protein) that is known to be functioning in a certain cellular change is used for the detection.

Once the screening reveals that the protein of the invention can regulate cellular conditions or the functions, it is possible to apply the protein as a pharmaceutical and diagnostic medicine for associated diseases by itself or by altering a part of it into an appropriate composition.

As is above described for membrane proteins, the secretory protein provided by the invention may be used to explore a novel ligand-receptor interaction using a screening based on the binding activity to a known ligand or receptor. A similar method can be used to identify an agonist or the antagonist. The resulting compounds obtained by the methods can be a candidate of a compound that can inhibit the interaction between the protein of the invention and an interacting molecule (including a receptor). The compounds may be able to use as a preventive, therapeutic, and diagnostic medicine for the diseases, in which the protein may play a certain role.

If the protein or gene of the invention is associated with diseases, it is possible to screen a gene or compound that can regulate its expression and/or activity either directly or indirectly by utilizing the protein of the present invention.

For example, the protein of the invention is expressed and purified as a recombinant protein. Then, the protein or gene that interacts with the protein of the invention is purified, and screened based on the binding. Alternatively, the screening can be performed by adding with a compound of a candidate of the inhibitor added in advance and monitoring the change of binding activity. The compound obtained by the screening can be used for developing pharmaceutical and diagnostic medicines for the diseases with which the protein of the present invention is associated. Similarly, if the regulatory factor obtained by the screening is a protein, the protein itself can be used as a pharmaceutical, and if there is a compound that affects the original expression level and/or activity of the protein, it also can be used for the same purpose.

If the secrete or membrane protein of the present invention has an enzymatic activity, it is possible to identify the activity by adding a compound to the protein of the present invention under an appropriate condition, and monitoring the change of the compound. It is also possible to screen a compound that inhibits the activity of the protein of the invention by utilizing the activity as an index.

In a screening given as an example, the protein of the invention is expressed and the recombinant protein is purified. Then, compounds are contacted with the purified protein, and the amount of the compound and the reaction products is examined. Alternatively, compounds that are candidates of an inhibitor are pretreated, then a compound (substrate) that can react with the purified protein is added, and the amount of the substrate and the reaction products is examined.

The compounds obtained in the screening may be used as a medicine for diseases with which the protein of the invention is associated. Also they can be applied for tests that examine whether the protein of the invention functions normally in vivo.

Whether the secretory or membrane protein of the present invention is a novel protein associated with diseases or not is determined in another method than described above, by obtaining a specific antibody against the protein of the invention, and examining the relationship between the expression or activity of the protein and a certain disease. In an alternative way, it may be analyzed referred to the methods in "Molecular Diagnosis of Genetic Diseases" (Elles R. edit, (1996) in the series of "Method in Molecular Biology" (Humana Press).

The secrete or membrane protein of the present invention can be prepared as a recombinant protein or a natural protein. For example, a recombinant protein can be prepared by introducing a vector containing a DNA insert encoding the protein of the invention into an appropriate host cell, and purifying the expressed products from the transformant, as described below. On the other hand, a natural protein can be prepared, for example, by utilizing an affinity column which is bound with the antibody against the protein of the invention, as described below ("Current Protocols in Molecular Biology" Ausubel et al. edit. (1987) John Wily & Sons, Section 16.1–16.19). The antibody used in the preparation of an affinity column can be a monoclonal antibody or polyclonal antibody. Alternatively, it is possible to prepare the protein of the invention by in vitro translation (See "On the fidelity of mRNA translation in the nuclease-treated rabbit reticulocyte lysate system." Dasso M. C., and Jackson R. J. (1989) Nucleic Acids Res. 17: 3129–3144).

Proteins functionally equivalent to the proteins of the present invention can be prepared based on the activities, which were clarified in the above-mentioned manner, of the proteins of the present invention. Using the biological activity possessed by the protein of the invention as an index, it is possible to verify whether or not a particular protein is functionally equivalent to the protein of the invention by examining whether or not the protein has said activity.

Proteins functionally equivalent to the proteins of the present invention can be prepared by those skilled in the art, for example, by using a method for introducing mutations into an amino acid sequence of a protein (for example, site-directed mutagenesis (Current Protocols in Molecular Biology, edit, Ausubel et al., (1987) John Wiley & Sons, Section 8.1–8.5). Besides, such proteins can be generated by spontaneous mutations. The present invention comprises the proteins having one or more amino acid substitutions, deletions, insertions and/or additions in the amino acid sequences of the proteins of the present invention (Table 1), as far as the proteins have the equivalent functions to those of the proteins identified in the present Examples described later.

There are no limitations in the number and sites of amino acid mutations, as far as the proteins maintain the functions thereof. The number of mutations is typically 30% or less, or 20% or less, or 10% or less, preferably within 5% or less, or 3% or less of the total amino acids, more preferably within 2% or less or 1% or less of the total amino acids. From the viewpoint of maintaining the protein function, it is preferable that a substituted amino has a similar property to that of the original amino acid. For example, Ala, Val, Leu, Ile, Pro, Met, Phe and Trp are assumed to have similar properties to one another because they are all classified into a group of non-polar amino acids. Similarly, substitution can be performed among non-charged amino acid such as Gly, Ser, Thr, Cys, Tyr, Asn, and Gln, acidic amino acids such as Asp and Glu, and basic amino acids such as Lys, Arg, and His.

In addition, proteins functionally equivalent to the proteins of the present invention can be isolated by using techniques of hybridization or gene amplification known to those skilled in the art. Specifically, using the hybridization technique (Current Protocols in Molecular Biology, edit, Ausubel et al., (1987) John Wiley & Sons, Section 6.3–6.4)), those skilled in the art can usually isolate a DNA highly homologous to the DNA encoding the protein identified in the present Example based on the identified nucleotide sequence (Table 1) or a portion thereof and obtain the functionally equivalent protein from the isolated DNA. The present invention include proteins encoded by the DNAs hybridizing with the DNAs encoding the proteins identified in the present Example, as far as the proteins are functionally equivalent to the proteins identified in the present Example. Organisms from which the functionally equivalent proteins are isolated are illustrated by vertebrates such as human, mouse, rat, rabbit, pig and bovine, but are not limited to these animals.

Washing conditions of hybridization for the isolation of DNAs encoding the functionally equivalent proteins are usually "1×SSC, 0.1% SDS, 37"C"; more stringent conditions are "0.5×SSC, 0.1% SDS, 42"C"; and still more stringent conditions are "0.1×SSC, 0.1% SDS, 65° C.". Alternatively, the following conditions can be given as hybridization conditions of the present invention. Namely, conditions in which the hybridization is done at "6×SSC, 40% Formamide, 25"C", and the washing at "1×SSC, 55"C" can be given. More preferable conditions are those in which the hybridization is done at "6×SSC, 40% Formamide, 37"C", and the washing at "0.2×SSC, 55"C". Even more preferable are those in which the hybridization is done at "6×SSC, 50% Formamide, 37"C", and the washing at "0.1× SSC, 62° C.". The more stringent the conditions of hybridization are, the more frequently the DNAs highly homologous to the probe sequence are isolated. Therefore, it is preferable to conduct hybridization under stringent conditions. Examples of stringent conditions in the present invention are, washing conditions of "0.5×SSC, 0.1% SDS, 42"C", or alternatively, hybridization conditions of "6×SSC, 40% Formamide, 37"C", and the washing at "0.2×SSC, 55"C". However, the above-mentioned combinations of SSC, SDS and temperature conditions are indicated just as examples. Those skilled in the art can select the hybridization conditions with similar stringency to those mentioned above by properly combining the above-mentioned or other factors (for example, probe concentration, probe length and duration of hybridization reaction) that determines the stringency of hybridization.

The amino acid sequences of proteins isolated by using the hybridization techniques usually exhibit high homology to those of the proteins of the present invention, which are shown in Table 1. The present invention encompasses a polynucleotide comprising a nucleotide sequence that has a high identity to the nucleotide sequence of claim 1 (a). Furthermore, the present invention encompasses a peptide, or protein comprising an amino acid sequence that has a high identity to the amino acid sequence encoded by the encoded polynucleotide of claim 1 (b). The term "high identity" indicates sequence identity of at least 40% or more; preferably 60% or more; and more preferably 70% or more. Alternatively, more preferable is identity of 90% or more, or 93% or more, or 95% or more, furthermore, 97% or more, or 99% or more. The identity can be determined by using the BLAST search algorithm.

With the gene amplification technique (PCR) (Current Protocols in Molecular Biology, edit, Ausubel et al., (1987) John Wiley & Sons, Section 6.3–6.4)) using primers designed based on the DNA sequence (Table 1) or a portion thereof identified in the present Example, it is possible to isolate a DNA fragment highly homologous to the DNA sequence or a portion thereof and to obtain functionally equivalent protein to a particular protein identified in the present Example based on the isolated DNA fragment.

The "percent identity" of two amino acid sequences or of two nucleic acids is determined using the algorithm of Karlin and Altschul (Proc. Natl. Acad. Sci. USA 87:2264–2268, 1990), modified as in Karlin and Altschul (Proc. Natl. Acad. Sci. USA 90:5873–5877, 1993). Such an algorithm is incorporated into the BLASTN and BLASTX program of Altschul et al. (J. Mol. Biol. 215:403–410, 1990). BLAST nucleotide searches are performed with BLASTN programs, score=100, wordlength=12. BLAST protein searches are performed with BLASTX program, score=50, wordlength=3. When gaps exist between two sequences, Gapped BLAST is utilized as described in Altschul et al. (Nucleic Acids Res. 25:3389–3402, 1997). When utilizing BLAST and Gapped BLAST programs, the default parameters of the respective programs (e.g., BLASTX and BALSTN) are used.

The present invention also includes a partial peptide of the proteins of the invention. The partial peptide comprises a protein generated as a result that a signal peptide has been removed from a secretory protein. If the protein of the present invention has an activity as a receptor or a ligand, the partial peptide may function as a competitive inhibitor of the protein and may bind to the receptor (or ligand). In addition, the present invention comprises an antigen peptide for raising antibodies. For the peptides to be specific for the protein of the invention, the peptides comprise at least 7 amino acids, preferably 8 amino acids or more, more preferably 9 amino acids or more, and even more preferably 8 amino acids or more. The peptide can be used for preparing antibodies against the protein of the invention, or competitive inhibitors of them, and also screening for a receptor that binds to the protein of the invention. The partial peptides of the invention can be produced, for example, by genetic engineering methods, known methods for synthesizing peptides, or digesting the protein of the invention with an appropriate peptidase.

The present invention also relates to a polynucleotide encoding the protein of the invention. The polynucleotide of the invention can be provided in any form as far as it encodes the protein of the invention, and thus includes cDNA, genomic DNA, and chemically synthesized DNA, etc. The polynucleotide also includes a DNA comprising any nucleotide sequence that is obtained based on the degeneracy of the genetic code, as far as it encodes the protein of the invention. The polynucleotide of the invention can be isolated by the standard methods such as hybridization using a probe DNA comprising the nucleotide sequence set forth in odd SEQ ID NOs of SEQ ID NO: 1 to SEQ ID NO: 335, or the portions of them, or by PCR using primers that are synthesized based on the nucleotide sequence.

For example, all the clones provided by the present invention, which were isolated in the example mentioned below, (173 clones) are novel and full-length, and encode a secretory protein or membrane protein. All the cDNA clones provided by the invention are characterized as follows.

A full-length-enriched cDNA library that is obtained by the oligo-capping method, and selected based on the features of the 5'-end sequence: by the score in the ATGpr (or described as ATGpr1), which predicts the fullness ratio of the 5'-end, and by the PSORT, which predicts the presence of the signal sequence, as those containing the signal sequence in the 5'-end, or transmembrane region in the protein coding region. Furthermore, as a result of the homology search using the 5'-end sequences, the clones were found to be not identical to any of the known human mRNA (therefore to be novel).

The present invention also relates to a vector into which the polynucleotide of the invention is inserted. The vector of the invention is not limited as long as it contains the inserted polynucleotide stably. For example, if E. coli is used as a host, vectors such as pBluescript vector (Stratagene) are preferable as a cloning vector. To produce the protein of the invention, expression vectors are especially useful. Any expression vector can be used as far as it is capable of expressing the protein in vitro, in E. coli, in cultured cells, or in vivo. For example, pBEST vector (Promega) is preferable for in vitro expression, pET vector (Invitrogen) for E. coli, pME18S-FL3 vector (GenBank Accession No. AB009864) for cultured cells, and pME18S vector (Mol. Cell. Biol. (1988) δ: 466–472) for in vivo expression. To insert the polynucleotide of the invention, ligation utilizing restriction sites can be performed according to the standard method (Current Protocols in Molecular Biology (1987) Ausubel et al. edit, John Wily & Sons, Section 11.4–11.11).

The present invention also relates to a transformant carrying the polynucleotide or the vector of the invention. Any cell can be used as a host into which the vector of the invention is inserted, and various kinds of host cells can be used depending on the purposes. For strong expression of the protein in eukaryotic cells, COS cells or CHO cells can be used, for example.

Introduction of the vector into host cells can be performed, for example, by calcium phosphate precipitation method, electroporation method (Current Protocols in Molecular Biology (1987) Ausubel et al. edit, John Wily & Sons, Section 9.1–9.9), lipofectamine method (GIBCO-BRL), or microinjection method, etc.

The present invention also relates to a oligonucleotide having a length of at least 15 nucleotides, comprising a nucleotide sequence that is complementary to a polynucleotide comprising the nucleotide sequence set forth in odd SEQ ID NOs of SEQ ID NO: 1 to SEQ ID NO: 335, or its complementary strand. The oligonucleotide of the present invention hybridizes with a polynucleotide of odd SEQ ID NOs of SEQ ID NO: 1 to SEQ ID NO: 335 encoding the protein of the invention, or its complementary strand, under the standard conditions for hybridization, or preferably under stringent conditions, and in principle does not preferably hybridize with DNA encoding other proteins. Such oligonucleotide can be used as a probe for isolation and detection of the polynucleotide of the invention, and as a primer for amplifying the polynucleotide of the present invention. As a primer, the DNA usually has a length of 15–100 bp, preferably 15–50 bp, and more preferably has a length of 15–35 bp. As a probe, the DNA contains the entire sequence of the DNA of the invention, or at least the portion of it, and has a length of at least 15 bp, preferably 30 bp or more, and more preferably 50 bp or more.

Any sequence shown in SEQ ID NOs: 370–540 and that shown in SEQ ID NOs: 541–679 can be chosen as the nucleotide sequence comprising the 5'-end primer and the 3'-end primer, respectively, to synthesize the full-length cDNAs of the present invention. Although, among these nucleotide sequences, some nucleotide sequences have already been known as EST sequences, the primers designed based on the present invention is novel in that they make it possible to synthesize full-length cDNA. The known EST sequences do not serve to design such primers because the EST sequences lack the crucial information about the location thereof within the corresponding cDNAs.

Each of the full-length cDNAs of the present inventions can be synthesized by PCR (Current Protocols in Molecular Biology, ed., Ausubel et al., (1987) John Wiley & Sons, Section 6.1–6.4) using a pair of primers selected from the 5'-end sequences and the 3'-end sequences or using a primer pair consisting of a primer selected from the 5'-end sequences and a primer with oligo(dT) sequence complementary to the poly(A) sequence.

Specifically, PCR can be performed using an oligonucleotide that has 15 nucleotides longer, and specifically hybridizes with the complementary strand of the polynucleotide that contains the nucleotide sequence selected from the 5'-end sequences shown in Table 342 (SEQ ID NO: 370–540), and an oligo-dT primer as a 5'-, and 3'-primer, respectively. The length of the primers is usually 15–100 bp, and favorably between 15–35 bp. In case of LA PCR, which is described below, the primer length of 25–35 bp may provide a good result.

A method to design a primer that enables a specific amplification based on the given nucleotide sequence is known to those skilled in the art (Current Protocols in Molecular Biology, Ausubel et al. edit, (1987) John Wiley & Sons, Section 6.1–6.4). In designing a primer based on the 5'-end sequence, the primer is designed so as that, in principle, the amplification products will include the translation start site. Accordingly, in case that a given 5'-end nucleotide sequence is the 5'-untranslated region (5'UTR), any part of the sequence can be used as a 5'-primer as far as the specificity toward the target cDNA is insured. The translation start site can be predicted using a known method such as the ATGpr as described below.

When synthesizing a full-length cDNA, the target nucleotide sequence to be amplified can extend to several thousand bp in some cDNA. However, it is possible to amplify such a long nucleotides by using such as LA PCR (Long and Accurate PCR). It is advantageous to use LA PCR when synthesizing long DNA. In LA PCR, in which a special DNA polymerase having 3' 5' exonuclease activity is used, misincorporated nucleotides can be removed. Accordingly, accurate synthesis of the complementary strand can be achieved even with a long nucleotide sequence. By using LA PCR, it is reported that amplification of a nucleotide with 20 kb longer can be achieved under desirable condition (Takeshi Hayashi (1996) Jikken-lgaku Bessatsu, "Advanced Technologies in PCR" Youdo-sha).

A template DNA for synthesizing the cDNA of the present invention can be obtained by using cDNA libraries that are prepared by various methods. The full-length cDNA clones obtained here are those with high fullness ratio, which were obtained using a combination of (1) a method to prepare a full-length-enriched cDNA library using the oligo-capping method, and (2) an estimation system for fullness using the 5'-end sequence (selection based on the estimation by the ATGpr after removing clones that are non-full-length compared to the ESTs). However, it is possible to easily obtain a full-length cDNA by using the primers that are provided by the present invention, not by the above described specialized method.

The problem with the cDNA libraries prepared by the known methods or commercially available is that mRNA contained in the libraries has very low fullness ratio. Thus, it is difficult to screen full-length cDNA clone directly from the library using ordinary cloning methods. The present invention has revealed a primer that is capable of synthesizing a full-length cDNA. If provided with primers, it is possible to synthesize a target full-length cDNA by using enzymatic reactions such as PCR. In particular, a full-length-enriched cDNA library, synthesized by methods such as oligo-capping, is desirable to synthesize a full-length cDNA with more reliability.

Transcriptional regulatory regions including promoters in the genotype can be isolated by utilizing the 5'-end sequences of the full-length cDNA clones of the present invention. The rough draft (slightly inaccurate sequencing result obtained in the analysis of human genome) covering 90% or more of the entire human genome is expected to be achieved in the spring of 2000, and the entire analysis of human genome sequence is expected to be completed by 2003. Because of the presence of long introns, it is hard to determine the transcription initiation sites in human genome by using analytical software. The utilization of the 5'-end sequences of the full-length cDNA sequences of the present invention makes it easy to isolate promoter-containing genomic regions that are located upstream of transcription initiation sites and are involved in mRNA transcription regulation. This is because the mRNA transcription initiation sites in the genome can be identified easily based on the 5'-end sequences of the full-length cDNAs.

The polynucleotide of the present invention can be used for examination and diagnosis of the abnormality of the protein of the invention. For example, it is possible to examine the abnormal expression of the gene encoding the protein using the polynucleotide of the invention as a probe for Northern hybridization or as a primer for RT-PCR. Also, the polynucleotide of the invention can be used as a primer for polymerase chain reaction (PCR) such as the genomic DNA-PCR, and RT-PCR to amplify the polynucleotide encoding the protein of the invention, or the regulatory region of the expression, with which it is possible to examine and diagnose the abnormality of the sequence by RFLP analysis, SSCP, and direct sequencing, etc.

Furthermore, the "polynucleotide having a length of at least 15 nucleotides, comprising a nucleotide sequence that is complementary to a polynucleotide comprising the nucleotide sequence set forth in odd SEQ ID NOs of SEQ ID NO: 1 to SEQ ID NO: 335, or its complementary strand" includes an antisense polynucleotide for suppressing the expression of the protein of the invention. To exert the antisense effect, the antisense polynucleotide has a length of at least 15 bp or more, for example, 50 bp or more, preferably 100 bp or more, and more preferably 500 bp or more, and has a length of usually 3000 bp or less and preferably 2000 bp or less. The antisense DNA can be used in the gene therapy of the diseases that are caused by the abnormality of the protein of the invention (abnormal function or abnormal expression). Said antisense DNA can be prepared, for example, by the phosphorothioate method ("Physicochemical properties of phosphorothioate oligodeoxynucleotides." Stein (1988) Nucleic Acids Res. 16: 3209–3221) based on the nucleotide sequence of the DNA encoding the protein (for example, the DNA set forth in odd SEQ ID NOs of SEQ ID NO: 1 to SEQ ID NO: 335).

The polynucleotide or antisense DNA of the present invention can be used in gene therapy, for example, by administrating it into a patient by the in vivo or ex vivo method with virus vectors such as retrovirus vectors, adenovirus vectors, and adeno-associated virus vectors, or non-virus vectors such as liposome.

The present invention also relates to antibodies that bind to the protein of the invention. There are no limitations in the form of the antibodies of the invention. They include polyclonal antibodies, monoclonal antibodies, or their portions that can bind to the antigen. They also include antibodies of all classes. Furthermore, special antibodies such as humanized antibodies are also included.

The polyclonal antibody of the invention can be obtained according to the standard method by synthesizing an oligopeptide corresponding to the amino acid sequence and immunizing rabbits with the peptide (Current Protocols in Molecular Biology (1987) Ausubel et al. edit, John Wily & Sons, Section 11.12–11.13). The monoclonal antibody of the invention can be obtained according to the standard method by purifying the protein expressed in E. coli, immunizing mice with the protein, and producing a hybridoma cell by fusing the spleen cells and myeloma cells (Current Protocols in Molecular Biology (1987) Ausubel et al. edit, John Wily & Sons, Section 11.4–11.11).

The antibody binding to the protein of the present invention can be used for purification of the protein of the invention, and also for detection and/or diagnosis of the abnormalities of the expression and structure of the protein. Specifically, proteins can be extracted, for example, from tissues, blood, or cells, and the protein of the invention is detected by Western blotting, immunoprecipitation, or ELISA, etc. for the above purpose.

Furthermore, the antibody binding to the protein of the present invention can be utilized for treating the diseases that associates with the protein of the invention. If the antibodies are used for treating patients, human antibodies or humanized antibodies are preferable in terms of their low antigenicity. The human antibodies can be prepared by immunizing a mouse whose immune system is replaced with that of human ("Functional transplant of megabase human immunoglobulin loci recapitulates human antibody response in mice" Mendez M. J. et al. (1997) Nat. Genet. 15: 146–156, for a reference). The humanized antibodies can be prepared by recombination of the hypervariable region of a monoclonal antibody (Methods in Enzymology (1991) 203: 99–121).

The present invention further relates to databases comprising at least a sequence of polynucleotides and/or protein, or a medium recorded in such databases, selected from the sequence data of the nucleotide and/or the amino acids indicated in Table 1. The term "database" means a set of accumulated information as machine-searchable and readable information of nucleotide sequence. The databases of the present invention comprise at least one of the novel nucleotide sequences of polynucleotides provided by the present invention. The databases of the present invention can consist of only the sequence data of the novel polynucleotides provided by the present invention or can comprise other information on nucleotide sequences of known full-length cDNAs or ESTs. The databases of the present invention can be comprised of not only the information on the nucleotide sequences but also the information on the gene functions revealed by the present invention. Additional information such as names of DNA clones carrying the full-length cDNAs can be recorded or linked together with the sequence data in the databases.

The database of the present invention is useful for gaining complete gene sequence information from partial sequence information of a gene of interest. The database of the present invention comprises nucleotide sequence information of full-length cDNAs. Consequently, by comparing the information in this database with the nucleotide sequence of a partial gene fragment yielded by differential display method or subtraction method, the information on the full-length nucleotide sequence of interest can be gained from the sequence of the partial fragment as a starting clue.

The sequence information of the full-length cDNAs constituting the database of the present invention contains not only the information on the complete sequences but also extra information on expression frequency of the genes as well as homology of the genes to known genes and known proteins. Thus the extra information facilitates rapid functional analyses of partial gene fragments. Further, the information on human genes is accumulated in the database of the present invention, and therefore, the database is useful for isolating a human homologue of a gene originating from other species. The human homologue can be isolated based on the nucleotide sequence of the gene from the original species.

At present, information on a wide variety of gene fragments can be obtained by differential display method and subtraction method. In general, these gene fragments are utilized as tools for isolating the full-length sequences thereof. When the gene fragment corresponds to an already-known gene, the full-length sequence is easily obtained by comparing the partial sequence with the information in known databases. However, when there exists no information corresponding to the partial sequence of interest in the known databases, cDNA cloning should be carried out for the full-length cDNA. It is often difficult to obtain the full-length nucleotide sequence using the partial sequence information as an initial clue. If the full-length of the gene is not available, the amino acid sequence of the protein encoded by the gene remains unidentified. Thus the database of the present invention can contribute to the identification of full-length cDNAs corresponding to gene fragments, which cannot be revealed by using databases of known genes. The present invention has provided 173 proteins that are novel secretory proteins or membrane proteins, and full-length cDNA clones encoding the proteins. It has great significance to provide a novel full-length cDNA clone of humans, as only few a of which have been isolated. It was found that the secretory proteins and membrane proteins of the present invention are associated with many diseases. Those genes and proteins associated with diseases are useful for developing medicines as they can be used as a diagnostic marker, or a target for gene therapy or developing medicines that is capable of regulating their expression and activity. Especially, the cDNA clones encoding a secretory protein are extremely important for medicinal industry since the protein itself is expected to be effective as a medicine, and also the gene may have potential to be associated with many diseases. Moreover, those proteins such as membrane proteins and the genes encoding the proteins may be used as a disease marker. These cDNA clones are also important for medicinal industry as they may be effective for treating diseases through the regulation of the expression and activity of their encoded proteins.

The invention is illustrated more specifically with reference to the following examples, but is not to be construed as being limited thereto.

EXAMPLE 1

Construction of a cDNA Library by the Oligo-Capping Method

The NT-2 neuron progenitor cells (Stratagene), a teratocarcinoma cell line from human embryo testis, which can differentiate into neurons by treatment with retinoic acid were used. The NT-2 cells were cultured according to the manufacturer's instructions as follows.

(1) NT-2 cells were cultured without induction by retinoic acid treatment (NT2RM1).
(2) After cultured, NT-2 cells were induced by adding retinoic acid, and then were cultured for 48 hours (NT2RP1).
(3) After cultured, NT-2 cells were induced by adding retinoic acid, and then were cultured for 2 weeks (NT2RP2).

The cells were harvested separately, from which mRNA was extracted by the method described in the literature (Molecular Cloning 2nd edition. Sambrook J., Fritsch, E. F., and Maniatis T. (1989) Cold Spring Harbor Laboratory Press). Furthermore, poly(A)$^+$ RNA was purified from the mRNA using oligo-dT cellulose.

Similarly, human placenta tissues (PLACE1), human ovary cancer tissues (OVARC1), and human embryo-derived tissues that were enriched with brain (HEMBA1) were used to extract mRNA by the method described in the literature (Molecular Cloning 2nd edition. Sambrook J., Fritsch, E. F., and Maniatis T. (1989) Cold Spring Harbor Laboratory Press). Furthermore, poly(A)$^+$RNA was purified from the mRNA using oligo-dT cellulose.

Figure 1:
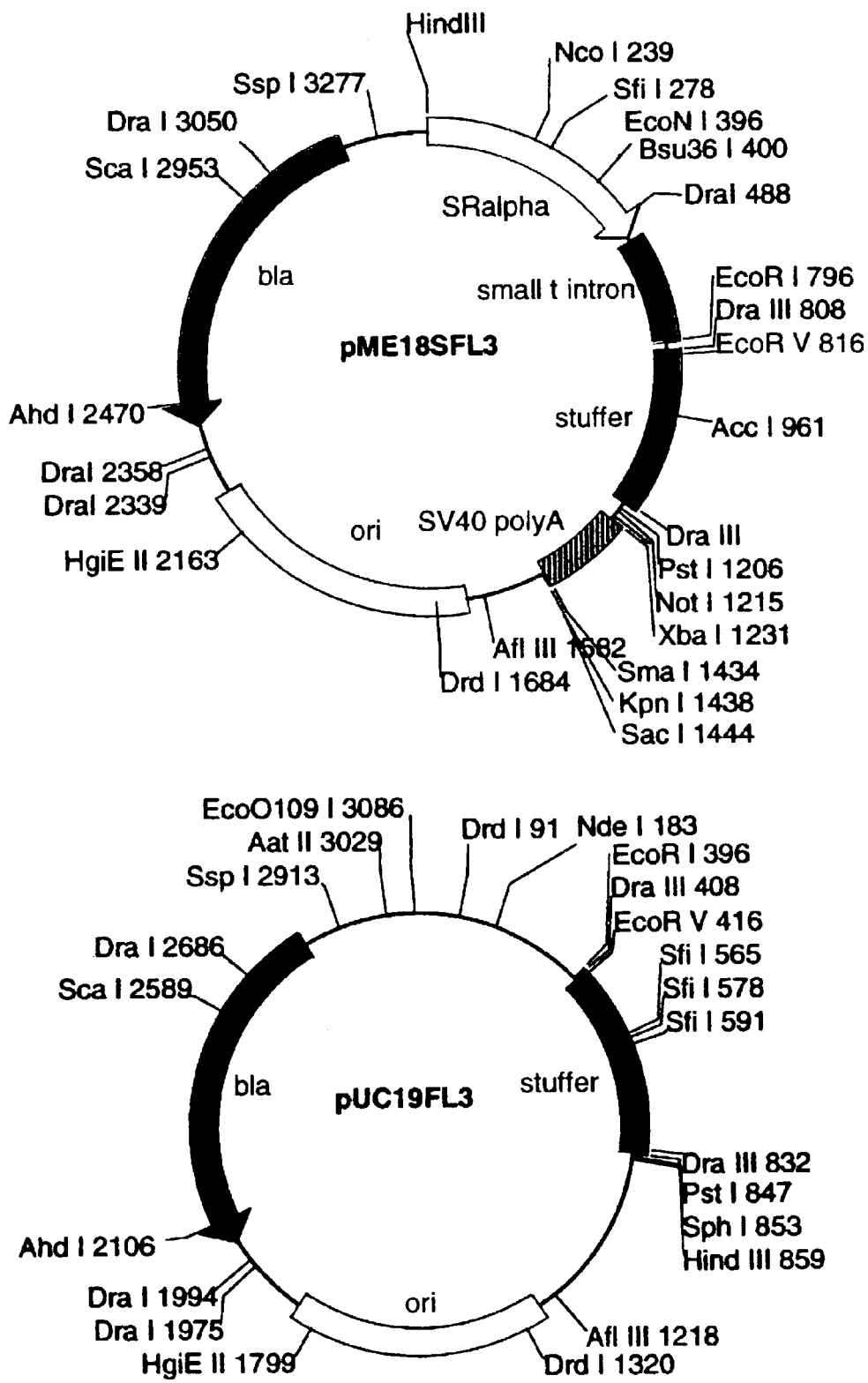
FIG. 1 shows the restriction maps of vectors pME18SFL3 and pUC19FL3.

Each poly(A)$^+$RNA was used to construct a cDNA library by the oligo-capping method (Maruyama M. and Sugano S. (1994) Gene 138: 171–174). Using the Oligo-cap linker (SEQ ID NO: 337) and the Oligo-dT primer (SEQ ID NO: 338), BAP (bacterial alkaline phosphatase) treatment, TAP (tobacco acid phosphatase) treatment, RNA ligation, the first strand cDNA synthesis, and removal of RNA were performed as described in the reference (Suzuki and Kanno (1996) Protein Nucleic acid and Enzyme. 41: 197–201; Suzuki Y. et al. (1997) Gene 200: 149–156). Next, 5'- and 3'-PCR primers (SEQ ID NO: 339, and 340, respectively) were used for performing PCR (polymerase chain reaction) to convert the cDNA into double stranded cDNA, which was then digested with SfiI. Then, the DraIII-cleaved pUC19FL3 vector (FIG. 1; for NT2RM1, and NT2RP1), or the DraIII-cleaved pME18SFL3 (FIG. 1) (GenBank AB009864, expression vector; for NT2RP2, NT2RP3, PLACE1, OVARC1, and HEMBA1) was used for cloning the cDNA in an unidirectional manner, and cDNA libraries were obtained. The clones having an insert cDNA with a length of 1 kb or less were discarded from NT2RM1, NT2RP1, NT2RP2, PLACE1, OVARC1, and HEMBA1, and the clones having an insert cDNA with a length of 2 kb or less were discarded from NT2RP3. Then, the nucleotide sequence of the 5'- and 3'-ends of the cDNA clones was analyzed with a DNA sequencer (ABI PRISM 377, PE Biosystems) after sequencing reactions were performed with the DNA sequencing reagents (Dye Terminator Cycle Sequencing FS Ready Reaction Kit, dRhodamine Terminator Cycle Sequencing FS Ready Reaction Kit, or BigDye Terminator Cycle Sequencing FS Ready Reaction Kit, from by PE Biosystems) according to the instructions.

The so analyzed 5'-end and 3'-end nucleotide sequences of the clones are shown in SEQ ID NOs: 370–540 and in SEQ ID NOs: 541–679, respectively. The SEQ IDs and the corresponding PSEC clones are as indicated in Table 342.

The cDNA libraries of NT2RP2 and HEMBA1 were constructed using eukaryotic expression vector pME18SFL3. The vector contains SRα promoter and SV40 small t intron in the upstream of the cloning site, and SV40 polyA added signal sequence site in the downstream. As the cloning site of pME18SFL3 has asymmetrical DraIII sites, and the ends of cDNA fragments contain SfiI sites complementary to the DraIII sites, the cloned cDNA fragments can be inserted into the downstream of the SRα promoter unidirectionally. Therefore, clones containing full-length cDNA can be expressed transiently by introducing the obtained plasmid directly into COS cells. Thus, the clones can be analyzed very easily in terms of the proteins that are the gene products of the clones, or in terms of the biological activities of the proteins.

The fullness ratio at the 5'-end sequences of the cDNA clones in the libraries constructed by the oligo-capping method was determined as follows. Of all the clones whose 5'-end sequences were found in those of known human mRNA in the public database, a clone was judged to be "full-length", if it had a longer 5'-end sequence than that of the known human mRNA, or, even though the 5'-end sequence was shorter, if it contained the translation initiation codon. A clone that did not contain the translation initiation codon was judged to be "non-full-length". The fullness ratio ((the number of full-length clones)/(the number of full-length and non-full-length clones)) at the 5'-end of the cDNA clones from each library was determined by comparing with the known human mRNA (NT2RM1: 69%; NT2RP1: 75%; NT2RP2: 62% NT2RP3: 61%, PLACE1: 68%; OVARC1: 59%; and HEMBA1: 53%). The result indicates that the fullness ratio at the 5'-end sequence was extremely high.

The relationship between the cDNA libraries and the clones is shown below.

NT2RM1: PSEC0001-PSEC0017
NT2RP1: PSEC0019-PSEC0047
NT2RP2: PSEC0048-PSEC0085, PSEC0092-PSEC0109, PSEC0111-PSEC0113, PSEC0173
NT2RP3: PSBC0241-PSBC0265
PLACE1: PSEC0086-PSEC0090, PSEC0110, PSEC0117-PSBC0172
OVARC1: PSEC0178-PSEC0183, PSEC0239-PSEC0240

EXAMPLE 2

Estimation of the fullness ratio at the 5'-end of the cDNA by the ATGpr and the ESTiMateFL. The ATGpr, developed by Salamov A. A., Nishikawa T., and Swindells, M. B. in the Helix Research Institute, is a program for prediction of the translation initiation codon based on the characteristics of the sequences in the vicinity of the ATG codon [A. A. Salamov, T. Nishikawa, and M. B. Swindells, Bioinformatics, 14:384–390 (1998)]. The results are shown with expectations (also described as ATGpr1 below) that an ATG is a true initiation codon (0.05–0.94). When the program was applied to the 5'-end sequences of the clones from the cDNA library that was obtained by the oligo-capping method and that had 65% fullness ratio, the sensitivity and specificity of estimation of a full-length clones (clone containing the N-terminal end of ORF) were improved to 82–83% by selecting only clones having the ATGpr1 score 0.6 or higher. Furthermore, the 17,365 clones in which the 5'-end sequence is identical to a known human mRNA and which were cloned from the human cDNA libraries constructed by the oligo-capping method, were estimated by the program. Briefly, the maximal ATGpr1 score of the clones was determined, and then their 5'-end sequence was compared with the known human mRNA to estimate whether the clone is full-length or not. The result was summarized in Table 2. It is indicated that the method for the selection through the combination of the ATGpr and the clones isolated from the human cDNA library that was constructed by the oligo-capping method was very efficient.

TABLE 2

| maximal ATGpr1 Score | number of full-length and not-full-length clones | number of full-length clones | fullness ratio |
|---|---|---|---|
| >=0.70 | 10,226 | 8,428 | 82.4% |
| >=0.50 | 12,171 | 9,422 | 77.4% |
| >=0.30 | 14,102 | 10,054 | 71.3% |
| >=0.17 | 15,647 | 10,385 | 66.4% |
| >=0.05 | 17,365 | 10,608 | 61.1% |

* number of full-length clones, the number of the clones which contain the N-terminus of the ORF; the number of not-full-length clones, number of the clones which does not contain the N-terminus of the ORF; fullness ratio, the resulting number of (the number of full-length clones)/(the number of full-length and not-full-length clones)

The ESTiMateFL, developed by Nishikawa and Ota in the Helix Research Institute, is a method for the selection of a clone with high fullness ratio by comparing with the 5'-end or 3'-end sequences of ESTs in the public database.

By the method, a cDNA clone is judged presumably not to be full-length if there are any ESTs that have longer 5'-end or 3'-end sequences than the clone. The method is systematized for high throughput analysis. A clone is judged to be full-length if the clone has a longer 5'-end sequence than ESTs in the public database. Even if a clone has a shorter 5'-end, the clone is judged to be full-length if the difference in length is within 50 bases, and otherwise judged not to be full-length, for convenience. The precision of the prediction by comparing cDNA clones with ESTs is improved with increasing number of ESTs to be compared. However, when only a limited number of ESTs are available, the reliability becomes low. Thus, the method is effective in excluding clones with high probability of being not-full-length, from the cDNA clones that is synthesized by the oligo-capping method and that have the 5'-end sequences with about 60% fullness ratio. In particular, the ESTiMateFL is efficiently used to estimate the fullness ratio at the 3'-end sequence of cDNA of a human unknown mRNA that has a significant number of ESTs in the public database.

The results were summarized in Tables 3 and 4. It was confirmed that, in estimating the fullness ratio at the 5'-end sequence of the clones of the human cDNA library that was constructed by the oligo-capping method, the fullness ratio was improved even for the clones having low score in the ATGpr by combining the ATGpr and ESTiMateFL. The result was applied to the estimation of the fullness ratio at the 5'-end sequence of the clones whose complete cDNA sequences were determined. The number of full-length clones, the number of not-full-length clones, and the fullness ratio indicate the number of the clones which contain the N-terminus of the ORF, the number of the clones which does not contain the N-terminus of the ORF, and the resulting number of (the number of full-length clones)/(the number of full-length and not-full-length clones), respectively.

TABLE 3

The fullness ratio at the 5'-end sequence of the cDNA clones that were judged to be full-length by comparing the ORF of the known human mRNA and that were obtained by the oligo-capping method, wherein the ratio was evaluated by comparing the cDNA clones with ESTs.

| maximal ATGpr1 Score | number of full-length clones | number of not-full-length clones | fullness ratio |
|---|---|---|---|
| >=0.30 | 8,646 | 907 | 90.5% |
| >=0.17 | 10,158 | 1,150 | 89.8% |
| >=0.05 | 15,351 | 2,728 | 84.9% |

TABLE 4

The fullness ratio at the 5'-end sequence of the cDNA clones that were judged to be not-full-length by comparing the ORF of the known human mRNA and that were obtained by the oligo-capping method, wherein the ratio was evaluated by comparing the cDNA clones with ESTs.

| maximal ATGpr1 Score | number of full-length clones | number of not-full-length clones | fullness ratio |
|---|---|---|---|
| >=0.30 | 1,271 | 2,156 | 37.1% |
| >=0.17 | 1,678 | 2,907 | 36.6% |
| >=0.05 | 2,512 | 4,529 | 35.7% |

EXAMPLE 3

Selection of the Clones Containing the Signal Sequence and the Full-Length-Enriched Clones From the clones in each library constructed by the oligo-capping method, those clones predicted to contain the signal sequence (most likely to be a secretory protein or membrane protein) were specifically selected by analyzing the amino acid sequence that are predicted by all the ATG codons within the 5'-end sequence, for the presence of the signal peptide, which is characteristic in the N-terminus of many secretory proteins, by using the PSORT, developed by Nakai and Kanehisa, which predicts the localization of a protein.

PSEC0001-PSEC0066 were not selected by the ATGpr score of the 5'-end sequence (one pass sequencing), but selected by the presence of both the signal sequence (analyzed by the PSORT), and the ORF (Open reading frame; a region translated to be amino acids) in the 5'-end sequence. PSEC0068-PSEC0265 were selected as those having the maximal ATGpr1 score of the 5'-end sequence (one pass sequencing) 0.7 or higher, in which both the signal sequence (analyzed by the PSORT) and the ORF exist in the 5'-end sequence.

EXAMPLE 4

Analysis of the Complete cDNA sequence and Classification by Categories

For the 173 clones selected in Example 3, the nucleotide sequence of the full-length cDNA and the deduced amino acid sequences were determined. The nucleotide sequences were finally determined by overlapping completely the partial nucleotide sequences of the full-length following three methods. The amino acid sequences were deduced from the determined cDNA sequences. The results were shown in SEQUENCE LISTING (Only the results of the 173 clones that were classified into a secretory protein or membrane protein were shown).

(1) Long-read sequencing from both ends of the cDNA inserts a Licor DNA sequencer (After sequence reactions were performed according to the manual for the Licor sequencer (Aroka), DNA sequence was determined by the sequencer.)

(2) Nested sequencing by the Primer Island method which utilizes the in vitro transfer of AT2 transposon (Devine S. E., and Boeke J. D. (1994) Nucleic Acids Res. 22: 3765–3772) (After clones were obtained using a kit from PE Biosystems, sequence reactions were performed using the DNA sequencing reagents from the company, according to the manufacturer's instructions, and DNA sequence was determined using an ABI PRISM 377 sequencer.)

(3) Primer walking by the dideoxy terminator method using custom synthesized DNA primers (After sequencing reactions were performed using the DNA sequencing reagents from PB Biosystems and custom synthesized DNA primers according to the manufacturer's instructions, DNA sequence was determined using an ABI PRISM 377 sequencer).

These sequences were subjected to the analysis by the ATGpr and PSORT and also to the BLAST search of the GenBank and SwissProt. As a result, most clones (152 clones out of 173) were predicted to be a secretory protein or membrane protein that contains a signal sequence in the N-terminus. Furthermore, those clones, in which a signal sequence was not found by the PSORT, (PSEC0027, PSEC0047, PSEC0066, nnnnnnnn, PSEC0069, PSEC0092, PSEC0103, PSEC0117, PSEC0142, PSEC0212, PSEC0239, PSEC0242, PSEC0251, PSEC0256, PSEC0006, PSEC0043, PSEC0058, PSEC0195, PSEC0206, and PSEC0211) were subjected to the analysis by the MEMSAT and SOSUI for the identity as a membrane protein (containing the transmembrane helix). As a result, 14 clones among the 20 clones were predicted to contain the transmembrane helix (PSEC0027, PSEC0047, PSEC0066, nnnnnnnn, PSEC0069, PSEC0092, PSEC0103, PSEC0117, PSEC0142, PSEC0212, PSEC0239, PSEC0242, PSEC0251, and PSEC0256). Thus, the clones were predicted to be a membrane protein. As a result of the homology search of the SwissProt, PSEC0195 and PSEC0206 were found to have relatively high homology with mouse plasma membrane adapter HA2/AP2 adaptin α C subunit, and human carboxypeptidase H precursor (prohormone processing carboxypeptidase) in the secretory granule, respectively.

The above results were shown in List 1, List 2, and List 3. Therein, the function of each cDNA clone (annotation) was shown as well. The categories of the 168 clones out of 173 clones were shown in the followings.

1. Clones that are predicted to be a full-length cDNA clone encoding a secretory protein or membrane protein (168 clones)

(Most clones have the ATGpr1 score 0.5 or higher).

1) Clones that are predicted to be a full-length cDNA clone encoding a secretory protein or membrane protein, in which a signal sequence is present in the N-terminus (152 clones, List 1).

PSEC0001 PSEC0049 PSEC0085 PSEC0113 nnnnnnnn PSEC0051 PSEC0086 PSEC0119

PSEC0005 PSEC0052 PSEC0087 PSEC0120

PSEC0007 PSEC0053 PSEC0088 PSEC0121
PSEC0008 PSEC0055 PSEC0090 PSEC0124
PSEC0012 PSEC0059 PSEC0094 PSEC0125
PSEC0017 PSEC0061 PSEC0095 PSEC0126
PSEC0019 PSEC0068 PSEC0098 PSEC0127
PSEC0020 PSEC0070 PSEC0099 PSEC0128
PSEC0021 PSEC0071 PSEC0100 PSEC0129
PSEC0028 PSEC0072 PSEC0101 PSEC0130
PSEC0029 PSEC0073 PSEC0104 PSEC0131
PSEC0030 PSEC0074 PSEC0105 PSEC0133
PSEC0031 PSEC0075 PSEC0106 PSEC0134
PSEC0035 PSEC0076 PSEC0107 PSEC0135
PSEC0038 PSEC0077 PSEC0108 PSEC0136
PSEC0040 PSEC0079 PSEC0109 PSEC0137
PSEC0041 PSEC0080 PSEC0110 PSEC0139
PSEC0045 PSEC0081 PSEC0111 PSEC0143
PSEC0048 PSEC0082 PSEC0112 PSEC0144
nnnnnnnn PSEC0178 PSEC0216 PSEC0247
PSEC0147 PSEC0181 PSEC0218 PSEC0248
PSEC0149 PSEC0182 PSEC0220 PSEC0249
PSEC0150 PSEC0183 PSEC0222 PSEC0250
PSEC0151 PSEC0190 PSEC0223 PSEC0252
PSEC0152 PSEC0191 PSEC0224 PSEC0253
PSEC0158 PSEC0192 PSEC0226 PSEC0255
PSEC0159 PSEC0197 PSEC0227 PSEC0258
PSEC0161 PSEC0198 PSEC0228 PSEC0259
PSEC0162 PSEC0199 PSEC0230 PSEC0260
PSEC0163 PSEC0200 PSEC0232 PSEC0261
PSEC0164 PSEC0203 PSEC0233 PSEC0263
PSEC0165 PSEC0204 PSEC0235
PSEC0167 PSEC0205 PSEC0236
PSEC0168 PSEC0207 PSEC0240
PSEC0169 PSEC0209 PSEC0241
PSEC0170 PSEC0210 PSEC0243
PSEC0171 PSEC0213 PSEC0244
PSEC0172 PSEC0214 PSEC0245
PSEC0173 PSEC0215 PSEC0246

(Annotation 1)

Clones that have the ATGpr1 score 0.5 or lower (PSEC0017, ATGpr1 0.33; PSEC0030, ATGpr1 0.26; PSEC0031, ATGpr1 0.20; PSEC0049, ATGpr1 0.35): These clones, in which data of the 5'-end sequence (one pass sequencing) was not sorted by the ATGpr, were selected as a clone having both the signal sequence and long ORF based on the data of the 5'-end sequence, and the sequence of their full-length cDNA clones was determined. All the clones have a signal sequence in the N-terminus. In addition, the above 4 clones except PSEC0049 have longer 5'-end compared to the corresponding EST. PSEC0049 has an ORF that has longer 5'-end than that of EST. Thus, these clones turned out to be full-length cDNA clones.

2) Clones that are predicted to be, a full-length cDNA encoding a secretory protein or membrane protein, in which the signal sequence is not present in the N-terminus, and predicted to be a membrane protein (14 clones, List 2).

PSEC0027
PSEC0047
PSEC0066
nnnnnnnn
PSEC0069
PSEC0092
PSEC0103
PSEC0117
PSEC0142
PSEC0212
PSEC0239
PSEC0242
PSEC0251
PSEC0256

(Annotation 3)

Clones that have the ATGpr1 score 0.5 or lower (PSEC0239, ATGpr1 0.18): PSEC0239 was selected as a clone having high ATGpr1 score of the 5'-end sequence (one pass sequencing), in which the signal sequence was predicted to be present. Although this clone was predicted to be without the signal sequence in the N-terminus according to the predicted ORF after complete sequencing, the clone was predicted to be a membrane protein (having the transmembrane helix) by the MEMSAT and SOSUI. In addition, the clone was found to contain a longer 5'-sequence than ESTs by comparing with them.

(Annotation 4)

PSEC0242 and PSEC0251: Both clones are classified into the cDNA encoding the polypeptide "containing a signal sequence in the N-terminus", if translation starts from their third ATG codon.

PSEC0242: No.3 ATG, ATGpr1 0.82, SP-Yes, ORF 171-1343 391 aa, Signal peptide 24;
PSEC0251: No.3 ATG, ATGpr1 0.77, SP-Yes, ORF 116-1256 380 aa, Signal peptide 28.

2. Clones that are predicted to be neither of a secretory protein or membrane protein by the PSORT, MEMSAT, and SOSUI, but predicted to be full-length by the ATGpr, which were isolated from the full-length-enriched human cDNA libraries constructed by the oligo-capping method (2 clones)

(Both clones have the ATGpr score 0.5 or higher).
PSEC0195, and PSEC0206.

According to the result of the homology search of the SwissProt, PSEC0195 and PSEC0206 were found to have relatively high homology with mouse plasma membrane adapter HA2/AP2 adaptin α C subunit, and human carboxypeptidase H precursor (prohormone processing carboxypeptidase) in the secretory granule, respectively. Thus, the proteins are classified into the category of "a secretory protein or membrane protein" (see List 3).

EXAMPLE 5

Selection of Clones Predicted to Have Signal Sequences

Specific selection was carried out for clones predicted to have signal sequences (having high probability of being secretory and/or membrane proteins) by testing the presence of a sequence predicted as a characteristic signal peptide found in amino-terminal sequences of many secretory proteins. The selection was performed by surveying all the possible amino acid sequences that are initiated with distinct ATG codons located in the 5'-end sequence and that are encoded by a cDNA isolated from each library prepared by oligo-capping method, by using a computer program, "PSORT" developed for predicting domain localization in a protein by Nakai and Kanehisa. Specifically, based on the 5'-end sequence data (one pass sequencing), the clones were selected under the conditions that the signal sequence (analyzed by PSORT) had a maximal ATGpr1 value of 0.7 or higher and the corresponding ORF was found in the 5'-end sequence.

The correspondence between the clones and the cDNA libraries is as follows:

NT2RP2: PSEC0078, PSEC0084

NT2RP3: PSEC0264, PSEC0265

HEMBA1: PSEC0237

EXAMPLE 6

Sequencing of the Full-Length cDNAs and Categorization Thereof

Nucleotide sequences were determined for the 5 full-length cDNAs selected in Example 5 by assembling the sequence data derived from both strands. Amino acid sequences were then deduced from the full-length nucleotide sequences. The sequences were subjected to the analyses with ATGpr and PSORT programs. Furthermore, databases such as GenBank and SwissProt were searched for the full-length sequences by BLAST. There were 4 clones (PSEC0084, PSEC0237, PSEC0264, and PSEC0265) that were predicted to encode secretory proteins having signal sequences at their N-termini. As for another clone (PSEC0078), no signal sequence was detected in the deduced amino acid sequence thereof by PSORT. By using MEMSAT and SOSUI programs, this clone was further analyzed to assess whether or not the protein encoded by this clone was a membrane protein (having a transmembrane helix). The result showed that a transmembrane helix was predicted to be present in this protein. In other words, the protein was presumed to be a membrane protein.

From the matching data obtained by BLAST analysis, matching data including information on proteins whose functions were relatively easy to be predicted were chosen to present them herein. Some clones were, however, selected simply because of the high homology in the matching data. These results are shown in List 1 and List 2 together with the annotation of the function of each cDNA clone. The categorization of the 5 clones is described below.

Results obtained by BLAST analysis are presented herein for the above-mentioned clones other than the 5 clones based on the same criterion as mentioned above for the selection. Clones predicted to cover the full-length cDNA sequences and to encode secretory and/or membrane proteins (5 clones)

clones predicted to cover the full-length cDNA sequences and to encode secretory and/or membrane proteins with signal sequences at the N-terminal ends thereof (4 clones) (List 1)

(ATGpr1 value is 0.5 or higher)

PSEC0084, PSEC0237, PSEC0264, PSEC0265 a clone predicted to cover the full-length cDNA sequence and to encode secretory and/or membrane protein without signal sequence at the N-terminal end thereof (1 clones) (List 2)

PSEC0078

(Annotation) The ATGpr1 value was 0.24. This is a clone exhibiting high ATGpr1 value and selected as having a signal sequence in the prediction based on the 5'-end sequence data (one pass sequencing). However, based on the ORF deduced from the full-length sequence determined later, this clone has been finally judged not to have the signal sequence at the N-terminus thereof. Nonetheless, the clone has been predicted to encode a membrane protein (having a transmembrane helix) by MEMSAT and SOSUI analyses. In addition, in comparison with EST sequences, the cDNA sequence was not found to be 50 bp or more shorter than any EST sequence at their 5'-end, and therefore the clone was not judged to be a incomplete cDNA clone by using ESTs as criteria for the judgment.

EXAMPLE 7

Gene expression Analysis with Hybridization Using High Density DNA Filter

Nylon membrane for DNA spotting was prepared according to the following procedure. E. coli was cultured in each well of a 96-well plate (in a LB medium at 37° C. for 16 hours). A sample of each culture was suspended in 10 µl of sterile water in a well of a 96-well plate. The plate was heated at 100° C. for 10 minutes. Then, the boiled samples were analyzed by PCR. PCR was performed in a 20 µl solution by using TaKaRa PCR Amplification Kit (Takara) according to the supplier's protocol. Primers used for the amplification of an insert cDNA in a plasmid were a pair of sequencing primers, ME761FW (5' tacggaagtgttacttctgc 3') and ME1250RV (5' tgtgggaggtttttctcta 3'), or a pair of primers, M13M4 (5' gttttcccagtcacgac 3') and M13RV (5' caggaaacagctatgac 3'). PCR was performed using a thermal cycler, GeneAmp System 9600 (PE Biosystems) at 95° C. for 5 minutes; at 95° C. for 10 seconds and at 68° C. for 1 minute for 10 cycles; at 98° C. for 20 seconds and at 60° C. for 3 minutes for 20 cycles; and at 72° C. for 10 minutes. After the PCR, the 20 µl reaction solution was loaded onto a 1% agarose gel and fractionated by electrophoresis. DNA on the gel was stained with ethidium bromide to confirm the amplification of cDNA. When cDNAs were not amplified by PCR, plasmids containing the corresponding insert cDNAs were prepared by the alkali-extraction method (J. Sambrook, E. F., Fritsh, & T. Maniatis, "Molecular Cloning, A laboratory manual/2nd edition, Cold Spring Harbor Laboratory Press, 1989).

Preparation of DNA array was carried out by the following procedure. A sample of a DNA solution was added in each well of a 384-well plate. DNA was spotted onto a nylon membrane (Boehringer) by using a 384-pin tool of Biomek 2000 Laboratory Automation System (Beckman-Coulter). Specifically, the 384-well plate containing the DNA was placed under the 384-pin tool. The independent 384 needles were simultaneously dipped into the DNA solution for DNA deposition. The needles were gently pressed onto a nylon membrane and the DNA deposited at the tips of needles was spotted onto the membrane. Denaturation of the spotted DNA and immobilization of the DNA on the nylon membrane were carried out according to standard methods (J.

Sambrook, E. F., Fritsh, & T. Maniatis, "Molecular Cloning, A laboratory manual/2nd edition, Cold Spring Harbor Laboratory Press, 1989).

A probe for hybridization was radioisotope-labeled first strand cDNA. Synthesis of the first strand cDNA was performed by using Thermoscript™ RT-PCR System (GIBCO). Specifically, the first strand cDNA was synthesized by using 1.5 µg of mRNAs from various human tissues (Clontech), 1 µl of 50 µM Oligo(dT) 20 and 50 µCi [$\alpha^{33}$P] dATP according to an attached protocol. Purification of a probe was carried out by using ProbeQuant™ G-50 micro column (Amersham-Pharmacia Biotech) according to an attached protocol. In the next step, 2 units of E. coli RNase H were added to the reaction mixture. The mixture was incubated at room temperature for 10 minutes, and then, 100 µg of human COT-1 DNA (GIBCO) was added thereto. The mixture was incubated at 97° C. for 10 minutes and then was allowed to stand on ice to give hybridization probe.

Hybridization of the radioisotope-labeled probe to the DNA array was performed according to standard methods (J. Sambrook, E. F., Fritsh, & T. Maniatis, Molecular Cloning, A laboratory manual/2nd edition, Cold Spring Harbor Laboratory Press, 1989). The membrane was washed as follows: the nylon membrane was washed 3 times by incubating it in Washing solution 1 (2×SSC, 1% SDS) at room temperature (about 26° C.) for 20 minutes; then the membrane was washed 3 times by incubating it in Washing solution 2 (0.1×SSC, 1% SDS) at 65° C. for 20 minutes.

Figure 2:
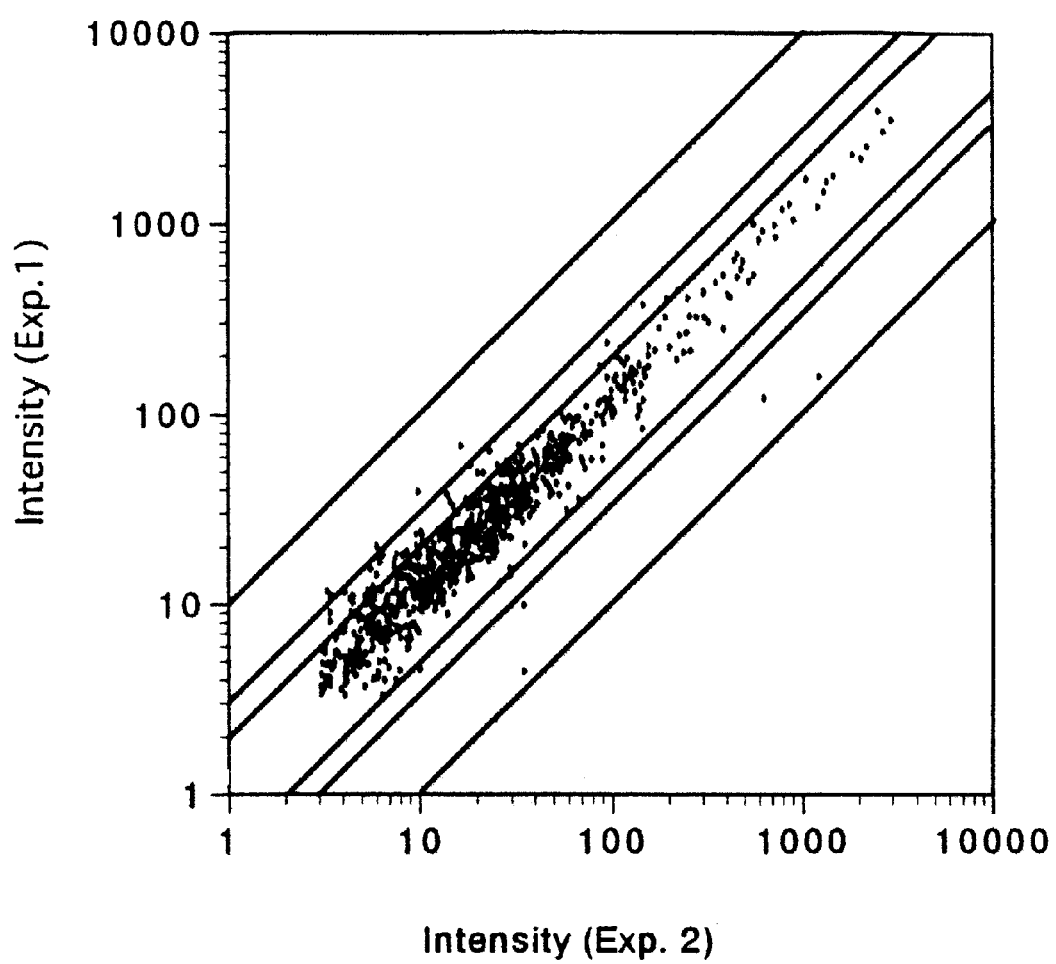
FIG. 2 shows the reproducibility of gene expression analysis. The ordinate and the abscissa show the intensities of gene expression obtained in experiments different from each other.

Autoradiography was performed by using an image plate for BAS2000 (Fuji Photo Film Co., Ltd.). Specifically, the nylon membrane with probe hybridized thereon was wrapped with a piece of Saran Wrap and brought into tight contact with the image plate on the light-sensitive surface. The membrane with the image plate was placed in an imaging cassette for radioisotope and allowed to stand in dark place for 4 hours. The radioactivity recorded on the image plate was analyzed by using BAS2000 (Fuji Photo Film Co., Ltd.). The activity was subjected to electronic conversion and recorded as an image file of autoradiogram. The signal intensity of each DNA spot was analyzed by using Visage High Density Grid Analysis Systems (Genomic Solutions Inc.). The signal intensity was converted into numerical data. The data were taken in duplicate. The reproducibility was assessed by comparing the signal intensities of the corresponding spots on the duplicated DNA filters that were hybridized to a single DNA probe (FIG. 2). In 95% of entire spots, the ratio between the corresponding spots falls within a range of 2 or less, and the correlation coefficient is r=1.97. Thus, the reproducibility is satisfactory.

Figure 3:
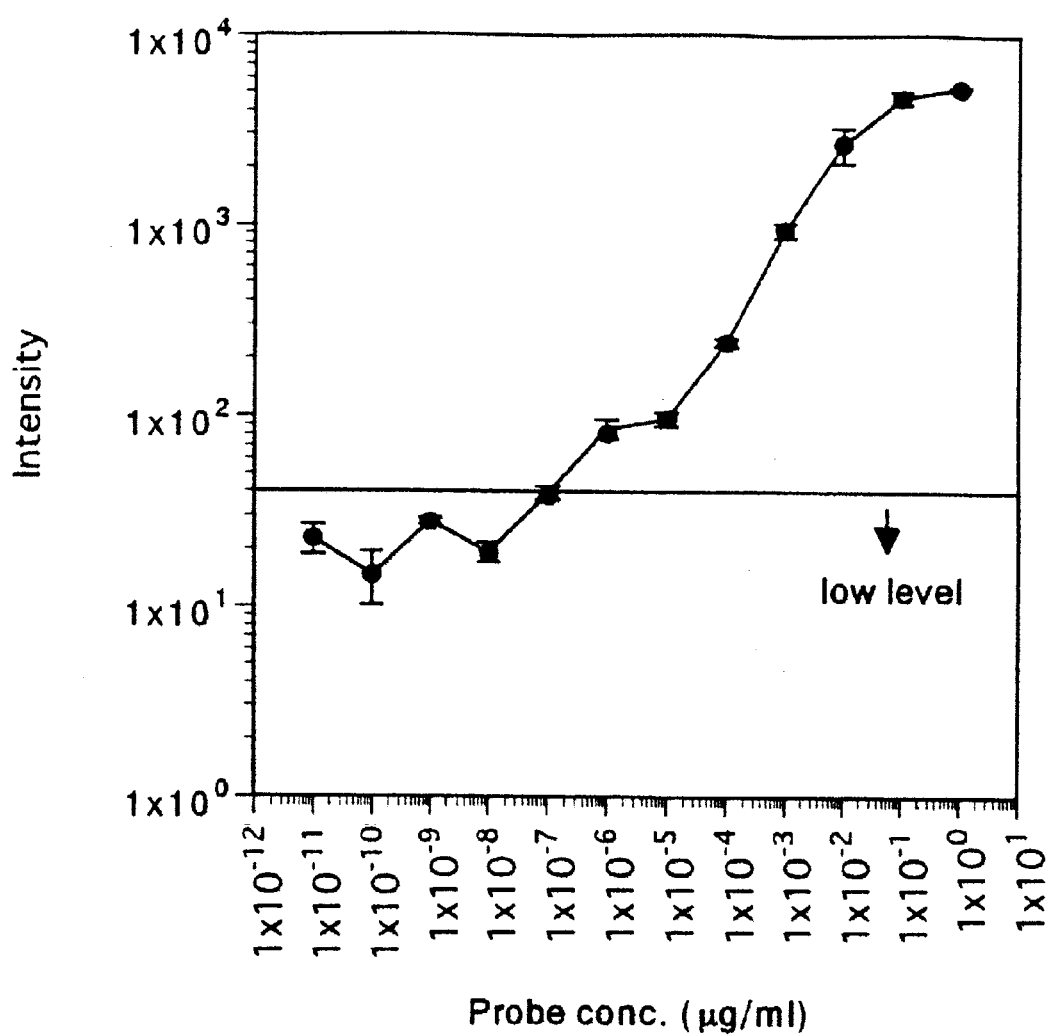
FIG. 3 shows the detection limit in gene expression analysis. The intensity of expression is shown in the ordinate, and the concentration (μg/ml) of the probe used is shown in the abscissa.

The detection sensitivity in gene expression analysis was estimated by examining increases in the signal intensity of probe concentration-dependent spot in hybridization using a probe complementary to the DNA spotted on the nylon membrane. DNA used was PLACE1008092 (the same as DNA deposited in GenBank under an Accession No. AF107253). The DNA array with DNA of PLACE1008092 was prepared according to the above-mentioned method. The probe used was prepared as follows: mRNA was synthesized in vitro from the clone, PLACE1008092. By using this mRNA as a template, radioisotope-labeled first strand cDNA was synthesized in the same manner as described above, and the cDNA was used as the probe. In order to synthesize mRNA from PLACE1008092 in vitro, a plasmid in which the 5' end of the cDNA PLACE1008092 was ligated to the T7 promoter of pBluescript SK(-) was constructed. Specifically, the PLACE1008092 insert was cut out from pME18SFL3 carrying the cDNA at a DraIII site thereof by XhoI digestion. The resulting PLACE1008092 fragment was ligated to XhoI-predigested pBluescript SK(-) by using DNA ligation kit ver.2 (Takara). The in vitro mRNA synthesis from PLACE1008092 inserted into pBluescript SK(-) was carried out by using Ampliscribe™ T7 high yield transcription kit (Epicentre technologies). Hybridization and the analysis of signal intensity of each DNA spot were performed by the same methods as described above. When the probe concentration is 1×10$^7$ µg/ml or less, there was no increase of signal intensity proportional to the probe concentration. Therefore, it was assumed to be difficult to compare the signals with one another in this concentration range. Thus, the spots with the intensity of 40 or less were uniformly taken as low level signals (FIG. 3). Within a concentration of the probe ranging from 1×10$^7$ µg/ml to 0.1 µg/ml, the signal was found to increase in a probe concentration-dependent manner. The detection limit represented as the ratio of the expression level of test mRNA to that of total mRNA in a sample was 1:100,000.

Tables 5–161 (also containing clones without description in Examples) show the expression of each cDNA in human normal tissues (heart, lung, pituitary gland, thymus, brain, kidney, liver and spleen). The expression levels are indicated with numerical values of 0–10,000. Genes that were expressed in at least a single tissue are indicated below by the corresponding clone names:

clone: HEMBA1000446, HEMBA000675, HEMBA100322, HEMBA1001552, HEMBA1001680, HEMBA1001879, HEMBA1002441, HEMBA1002706, HEMBA1002715, HEMBA1002913, HEMBA1002981, HEMBA1003280, HEMBA1003702, HEMBA1003764, HEMBA1004100, HEMBA1004633, HEMBA1005096, HEMBA1005452, HEMBA1005628, HEMBA1005833, HEMBA1006099, HEMBA1006391, HEMBA1006813, HEMBA1007104, HEMBA1007186, NT2RM1000558, NT2RP1000125, NT2RP1000279, NT2RP1000837, NT2RP1001023, NT2RP2000396, NT2RP2000428, NT2RP2000557, NT2RP2000601, NT2RP2000720, NT2RP2001087, NT2RP2001142, NT2RP2001270, NT2RP2001341, NT2RP2001499, NT2RP2001508, NT2RP2001768, NT2RP2002429, NT2RP2002695, NT2RP2002907, NT2RP2002927, NT2RP2002934, NT2RP2003050, NT2RP2003115, NT2RP2003227, NT2RP2003902, NT2RP2004130, NT2RP2004755, NT2RP2004795, NT2RP2004966, NT2RP2005219, NT2RP2005322, NT2RP2005671, NT2RP2005970, NT2RP2006435, NT2RP3000234, NT2RP3000266, NT2RP3000326, NT2RP3000638, NT2RP3000719, NT2RP3001359, NT2RP3001613, NT2RP3001861, NT2RP3003097, NT2RP3003235, NT2RP3003258, NT2RP3003368, NT2RP3003549, NT2RP3003731, NT2RP3003789, NT2RP3004541, OVARC1000636, OVARC1001849, PLACE1000456, PLACE1001098, PLACE1001300, PLACE1001904, PLACE1002376, PLACE1002379, PLACE1003405, PLACE1003724, PLACE1004113, PLACE1004273, PLACE1004757, PLACE1004850, PLACE1005047, PLACE1005760, PLACE1006472, PLACE1006610, PLACE1007635, PLACE1009580, PLACE1010330, PLACE1010482, PLACE1011134, PLACE1011146, PLACE1011360, PLACE1011386, PLACE1011514, PLACE1011835.

Genes that were expressed in all the tissues tested are indicated below by the corresponding clone names:

clone: HEMBA1002715, NT2RP1001023, NT2RP2000396, NT2RP2003902, NT2RP2005970, NT2RP3003258, NT2RP3003731, PLACE1003405, PLACE1003724.

Genes that were expressed at low levels in any of the tissues tested are indicated below by the corresponding clone names:

clone: HEMBA1000296, HEMBA1001490, HEMBA1004078, HEMBA1004149, HEMBA1005301, HEMBA1005703, HEMBA1006019, HEMBA1006549, HEMBA1007053, NT2RM1000066, NT2RM1000566, NT2RM1000634, NT2RM1000726, NT2RM1000853, NT2RM101103, NT2RP1000255, NT2RP1000477, NT2RP1000533, NT2RP1000544, NT2RP 1000567, NT2RP1000593, NT2RP1000769, NT2RP1000905, NT2RP1000921, NT2RP1001042, NT2RP2000028, NT2RP2000116, NT2RP2000168, NT2RP2000279, NT2RP2000358, NT2RP2002115, NT2RP2003471, NT2RP2004036, NT2RP2004049, NT2RP2004076, NT2RP2004974, NT2RP2005670, NT2RP2006028, NT2RP2006400, NT2RP2006476, NT2RP3001619, NT2RP3001874, NT2RP3002337, NT2RP3003536, NT2RP3004059, NT2RP3004063, OVARC1000363, OVARC1001499, OVARC1001510, OVARC1001636, PLACE1001022, PLACE1003085, PLACE1003378, PLACE1003549, PLACE1004170, PLACE1004322, PLACE1004507, PLACE1004904, PLACE1006269, nnnnnnnnnnnn, PLACE1007190, PLACE1007338, PLACE1007878, PLACE1007885, PLACE1008738, PLACE1008994, PLACE1009772, PLACE1010021, PLACE1010978.

Genes exhibiting characteristic features in the expression thereof were selected by statistical analysis of these data. Two examples are shown below to describe the selection of genes of which expression is varied greatly among tissues. The β-actin gene is used frequently as a control in gene expression analysis. Genes of which expression is varied greatly among tissues as compared that of the β-actin gene were determined as follows. Specifically, sum of squared deviation was calculated in the signal intensity of β-actin observed in each tissue, which was divided by 7 degrees of freedom to determine a variance $S_a^2$. Next, sum of squared deviation was calculated in the signal intensity of a compared gene in each tissue, which was divided by 7 degrees of freedom to determine a variance $S_b^2$. By taking variance ratio F as $F=S_b^2/S_a^2$, genes with a significance level of 5% or more were extracted in the F distribution. Genes extracted are indicated below by the corresponding clone names: NT2RP1001023(PSEC0045).

Gene of OVARC1000037 (heterogeneous nuclear ribonucleoprotein (hnRNP)) which expression is varied little. Genes of which expression is varied greatly among tissues as compared that of the OVARC1000037 gene were determined as follows. Specifically, sum of squared deviation was calculated in the signal intensity of β-actin observed in each tissue, which was divided by 7 degrees of freedom to determine a variance $S_a^2$. Next, sum of squared deviation was calculated in the signal intensity of a gene to be compared observed in each tissue, which was divided by 7 degrees of freedom to determine a variance $S_b^2$. By taking variance ratio F as $F=S_b^2/S_a^2$, genes with a significance level of 5% or more were extracted in the F distribution. Genes extracted are indicated below by the corresponding clone names: clone: NT2RP 1001023 (PSEC0045), NT2RP2005970 (PSEC0084), Thus, characteristic features in the expression of a gene are illustrated by comparing and statistically analyzing the expression of many genes.

Analysis of genes associated with neural cell differentiation

Genes involved in neural cell differentiation are useful for treating neurological diseases. It is possible that genes with varying expression levels in response to induction of cellular differentiation in neural cells are associated with neurological diseases.

A survey was performed for genes of which expression levels are varied in response to induction of differentiation (stimulation by retinoic acid (RA)) in cultured cells of a neural strain, NT2.

The NT2 cells were treated basically according to supplier's instruction manual. "Undifferentiated NT2 cells" means NT2 cells successively cultured in an Opti-MEM I (GIBCO-BRL; catalog No. 31985) containing 10% (v/v) fetal bovine serum and 1% (v/v) penicillin-streptomycin (GIBCO BRL). NT2 cells cultured in the presence of retinoic acid" means the cells resulted from transferring undifferentiated NT2 cells into a retinoic acid-containing medium, which consists of D-MEM (GIBCO BRL; catalog No. 11965), 10% (v/v) fetal bovine serum, 1% (v/v) penicillin-streptomycin and 10 μM retinoic acid (GIBCO-BRL), and the subsequent successive culture therein for 5 weeks. "NT2 cells that were cultured in the presence of retinoic acid and then further cultured in the presence of cell-division inhibitor added" means NT2 cells resulted from transferring NT2 cells cultured in the presence of retinoic acid for 5 weeks into a cell-division inhibitor-containing medium, which consisted of D-MEM (GIBCO BRL; catalog No.11965), 10% (v/v) fetal bovine serum, 1% (v/v) penicillin-streptomycin, 10 μM retinoic acid, 10 μM FudR (5-fluoro-2'-deoxyuridine: GIBCO BRL), 10 μM Urd (Uridine: GIBCO BRL) and 1 μg M araC (Cytosine β-D-Arabinofuranoside: GIBCO BRL), and the subsequence successive culture for 2 weeks. Each of the cells were treated with trypsin and then harvested. Total RNAs were extracted from the cells by using S.N.A.P.™ Total RNA Isolation kit (Invitrogen$^{(r)}$). The labeling of probe used for hybridization was carried out by using 10 μg of the total RNA according to the same methods as described above. The data were obtained in triplicate (n=3). The data of signal value representing gene expression level in the cells in the presence of stimulation for inducing differentiation were compared with those in the absence of the stimulation. The comparison was performed by statistical treatment of two-sample t-test. Clones with significant difference in the signal distribution were selected under the condition of p<0.05. In this analysis, clones with the difference can be statistically detected even when the signals were low. Accordingly, clones with signal value of 40 or less were also assessed for the selection.

Tables 162–341 show the expression level of each cDNA in undifferentiated NT2 cells, NT2 cells cultured in the presence of RA, and NT2 cells that were cultured in the presence of RA and that were further cultured in the presence of cell-division inhibitor added.

Averaged signal values ($M_1$, $M_2$) and sample variances ($s_1^2$, $s_2^2$) were calculated for each gene in each of the cells, and then, the pooled sample variances $s^2$ were obtained from the sample variances of the two types of cells to be compared. The t values were determined according to the following formula: $t=(M1-M2)/s/(\frac{1}{3}+\frac{1}{3})^{1/2}$. When the determined t-value was greater than a t-value at P, which means the probability of significance level, of 0.05 or 0.01 in the t-distribution table with 4 degrees of freedom, the difference was judged to be found in the expression level of the gene between the two types of cells at p<0.05 or p<0.01, respectively. The tables also include the information on an increase (+) or decrease (−) in the expression level of a gene in the treated cells when the level is compared with that of untreated undifferentiated cells.

Clones of which expression levels increased by RA are as follows:

PSEC0017, PSEC0021, PSEC0041, PSEC0047, PSEC0049, PSEC0055, PSEC0066, PSEC0070, PSEC0071, PSEC0072, PSEC0074, PSEC0075, PSEC0076, PSEC0080, PSEC0084, PSEC0088, PSEC0094, PSEC0103, PSEC0105, PSEC0112, PSEC0113, PSEC0119, PSEC0127, PSEC0129, PSEC0139, PSEC0143, PSEC0144, PSEC0152, PSEC0171, PSEC0181, PSEC0182, PSEC0192, PSEC0195, PSEC0200, PSEC0203, PSEC0215, PSEC0223, PSEC0235, PSEC0239, PSEC0243, PSEC0255, PSEC0265.

Clones of which expression levels increase by RA/inhibitor are as follows:

PSEC0017, PSEC0019, PSEC0030, PSEC0041, PSEC0047, PSEC0048, PSEC0049, PSEC0059, PSEC0066, PSEC0072, PSEC0081, PSEC0084, PSEC0094, PSEC0104, PSEC0117, PSEC0119, PSEC0120, PSEC0129, PSEC0136, PSEC0139, PSEC0143, PSEC0152, PSEC0161, PSEC0169, PSEC0181, PSEC0182, PSEC0192, PSEC0203, PSEC0223, PSEC0235, PSEC0251, PSEC0265.

Clones of which expression levels increase in the presence of both RA and RA/inhibitor are as follows:

PSEC0017, PSEC0041, PSEC0047, PSEC0049, PSEC0066, PSEC0072, PSEC0084, PSEC0094, PSEC0119, PSEC0129, PSEC0139, PSEC0143, PSEC0152, PSEC0181, PSEC0182, PSEC0192, PSEC0203, PSEC0223, PSEC0235, PSEC0265.

These are neurological disease-associated clones.

Analysis of rheumatoid arthritis-associated genes

The onset of rheumatoid arthritis is thought to be involved in the proliferation of synovial cells covering inner surfaces of joint cavity and in inflammatory reaction resulted from the action of cytokines produced by leukocytes infiltrating into the joint synovial tissues (Rheumatism Information Center). Recent studies have also revealed that tissue necrosis factor (TNF)-α participates in the onset (Current opinion in immunology 1999, 11, 657–662). When the expression of a gene exhibits responsiveness to the action of TNF on synovial cells, the gene is considered to be involved in rheumatoid arthritis.

A survey was performed for genes of which expression levels are varied in response to TNF-α in the primary cell culture of synovial tissue. The primary cultured cells of the smooth muscle (Cell Applications) were grown to be confluent in a culture dish, and then, human TNF-α (Boehringer-Mannheim) was added at a final concentration of 10 ng/ml thereto. The culture was further continued for 24 hours.

Total RNA was extracted from the cells by using S.N.A.P.™ Total RNA Isolation kit (Invitrogen). The labeling of probe used for hybridization was carried out by using 10 μg of the total RNA according to the same methods as described above. The data were obtained in triplicates (n=3). The data of signal value representing gene expression level in the cells in the presence of TNF stimulation were compared with those in the absence of the stimulation. The comparison was performed by statistical treatment of two-sample t-test. Clones with significant difference in the signal distribution were selected under the condition of p<0.05. In this analysis, clones with the difference can be statistically detected even when the signals were low. Accordingly, clones with signal value of 40 or less were also assessed for the selection.

Table 343 shows the expression level of each cDNA in synovial cells cultured in the absence or presence of TNF.

Averaged signal values ($M_1$, $M_2$) and sample variances ($s_1^2$, $s_2^2$) for each gene were calculated in each of the cells, and then, the pooled sample variances $s^2$ were obtained from the sample variances of the two types of cells to be compared. The t-values were determined according to the following formula: $t=(M_1-M_2)/s/(\frac{1}{3}+\frac{1}{3})^{1/2}$. When the determined t-value was greater than a t-value at P, which means the probability of significance level, of 0.05 or 0.01 in the t-distribution table with 4 degrees of freedom, the difference was judged to be found in the expression level of the gene between the two types of cells at p<0.05 or p<0.01, respectively. The tables also include the information of an increase (+) or decrease (−) in the expression level of a gene in the stimulated cells when the level is compared with that of unstimulated cells.

PSEC clones of which expression levels are elevated by TNF-α are as follows:

PSEC0070, PSEC0073, PSEC0084, PSEC0100, PSEC0109, PSEC0120, PSEC0131, PSEC0161, PSEC0183, PSEC0192, PSEC0197, PSEC0205, PSEC0207, PSEC0210, PSEC0213, PSEC0222, PSEC0230, PSEC0241, PSEC0252, PSEC0259.

PSEC clones of which expression levels decrease by TNF-α are as follows:

PSEC0105, PSEC0245.

These are rheumatoid arthritis-associated clones.

TABLE 5

Expression of each cDNA in human tissues (containing clones that are not described in Examples.)

| Clone_name | Heart | Lung | P.gland | Thymus | Brain | Kidney | Liver | Spleen |
|---|---|---|---|---|---|---|---|---|
| GAPDH(Cr1) | 38.210 | 32.670 | 23.820 | 13.580 | 11.230 | 21.120 | 24.910 | 22.440 |
| β actin(Cr2) | 279.280 | 368.870 | 111.100 | 117.500 | 92.880 | 114.650 | 82.990 | 256.790 |
| ADRGL1000005 | 53.882 | 23.005 | 32.749 | 22.858 | 26.564 | 24.940 | 22.644 | 27.001 |
| ADRGL1000007 | 94.778 | 85.185 | 160.457 | 67.191 | 101.768 | 62.489 | 67.150 | 73.543 |
| ADRGL1000009 | 11.141 | 50.520 | 10.357 | 7.177 | 6.013 | 5.219 | 14.272 | 21.225 |
| ADRGL1000011 | 71.656 | 24.579 | 29.358 | 19.473 | 24.898 | 30.747 | 49.220 | 22.221 |
| ADRGL1000027 | 36.238 | 25.252 | 20.855 | 7.328 | 11.196 | 14.298 | 19.658 | 11.288 |
| ADRGL1000058 | 66.209 | 129.497 | 55.226 | 49.241 | 30.219 | 55.872 | 67.027 | 243.436 |
| ADRGL1000069 | 38.630 | 23.459 | 28.991 | 12.540 | 27.353 | 33.633 | 28.774 | 20.911 |
| ADRGL1000077 | 97.465 | 63.656 | 448.427 | 83.412 | 71.108 | 53.740 | 67.906 | 89.439 |
| ADRGL1000092 | 89.423 | 45.692 | 55.810 | 26.033 | 44.148 | 73.339 | 96.037 | 73.091 |

TABLE 5-continued

Expression of each cDNA in human tissues (containing clones that are not described in Examples.)

| Clone_name | Heart | Lung | P.gland | Thymus | Brain | Kidney | Liver | Spleen |
|---|---|---|---|---|---|---|---|---|
| ADRGL1000099 | 73.675 | 24.424 | 36.128 | 17.024 | 25.964 | 41.391 | 42.837 | 29.666 |
| ADRGL1000136 | 141.745 | 63.974 | 77.017 | 24.777 | 33.549 | 58.986 | 295.009 | 84.985 |
| ADRGL1000147 | 394.563 | 155.829 | 271.210 | 92.899 | 165.627 | 251.266 | 253.420 | 150.294 |
| ADRGL1000159 | 50.073 | 25.425 | 39.296 | 15.194 | 16.125 | 20.040 | 33.720 | 23.278 |
| ADRGL1000160 | 69.386 | 31.051 | 59.416 | 20.154 | 39.799 | 27.027 | 47.169 | 20.716 |
| ADRGL1000171 | 57.047 | 23.011 | 43.063 | 23.860 | 40.581 | 59.814 | 117.055 | 32.630 |
| ADRGL1000181 | 45.892 | 18.666 | 34.476 | 15.434 | 34.225 | 32.962 | 39.693 | 16.334 |
| BCGI1000015 | 153.242 | 42.337 | 92.865 | 41.003 | 45.168 | 88.524 | 85.990 | 73.392 |
| BGGI11000016 | 177.367 | 94.731 | 119.688 | 34.159 | 30.249 | 98.806 | 98.783 | 39.204 |
| BGGI11000017 | 84.712 | 32.614 | 38.131 | 20.878 | 18.769 | 32.340 | 39.666 | 20.750 |
| BGGI11000022 | 52.468 | 20.452 | 67.167 | 12.167 | 11.158 | 18.241 | 19.197 | 11.937 |
| BGGI11000031 | 30.008 | 17.072 | 40.883 | 12.585 | 13.313 | 15.525 | 16.757 | 13.406 |
| BGGI11000042 | 49.926 | 36.336 | 51.176 | 26.964 | 43.122 | 43.770 | 49.107 | 38.776 |
| BGGI11000046 | 31.618 | 26.472 | 34.182 | 31.854 | 12.650 | 25.784 | 18.430 | 25.385 |
| BNGH41000020 | 5031.103 | 2993.496 | 1444.841 | 537.162 | 6973.542 | 6029.124 | 3350.527 | 3649.144 |
| BNGH41000025 | 91.717 | 35.026 | 73.901 | 27.713 | 30.765 | 36.523 | 37.596 | 47.074 |
| BNGH41000026 | 176.757 | 77.439 | 98.345 | 35.807 | 56.991 | 91.310 | 75.797 | 70.241 |
| BNGH41000027 | 65.029 | 56.353 | 25.896 | 22.494 | 12.763 | 23.748 | 17.836 | 23.859 |
| BNGH41000035 | 148.779 | 66.776 | 119.727 | 56.576 | 60.996 | 96.959 | 72.461 | 64.458 |
| BNGH41000037 | 79.500 | 29.611 | 43.438 | 18.317 | 20.857 | 36.272 | 27.525 | 24.771 |
| BNGH41000042 | 224.484 | 110.084 | 168.448 | 104.351 | 102.259 | 125.323 | 86.783 | 122.959 |
| BNGH41000048 | 56.144 | 32.253 | 54.063 | 14.729 | 27.312 | 22.435 | 29.566 | 28.937 |
| BNGH41000056 | 67.258 | 18.694 | 30.075 | 15.602 | 10.072 | 20.735 | 16.100 | 7.642 |
| BNGH41000087 | 98.262 | 46.173 | 77.657 | 35.329 | 40.900 | 50.029 | 50.841 | 45.285 |
| BNGH41000091 | 50.895 | 16.985 | 28.392 | 10.147 | 5.469 | 22.794 | 10.725 | 12.410 |
| BNGH41000157 | 69.043 | 34.730 | 40.597 | 18.088 | 27.072 | 22.074 | 25.410 | 24.950 |
| BNGH41000169 | 44.850 | 21.770 | 28.655 | 11.403 | 25.991 | 28.509 | 25.634 | 25.843 |
| BNGH41000181 | 17.163 | 15.689 | 13.948 | 3.996 | 9.287 | 13.139 | 15.553 | 16.575 |
| BNGH41000198 | 81.510 | 36.250 | 60.860 | 20.585 | 26.929 | 35.751 | 31.695 | 28.325 |
| BNGH41000219 | 30.302 | 25.156 | 22.187 | 13.757 | 11.208 | 15.235 | 27.285 | 35.709 |
| BNGH41000229 | 252.790 | 65.948 | 93.499 | 51.108 | 92.555 | 101.245 | 96.716 | 78.266 |
| BNGH41000237 | 85.757 | 46.997 | 55.170 | 26.780 | 33.764 | 47.456 | 37.007 | 39.131 |
| BNGH41000238 | 17.744 | 36.938 | 42.360 | 14.922 | 35.749 | 68.474 | 39.238 | 13.241 |
| BNGH41000243 | 45.446 | 23.667 | 44.798 | 20.875 | 10.516 | 23.918 | 22.443 | 27.033 |
| BNGH41000270 | 60.889 | 18.651 | 29.618 | 10.724 | 15.979 | 12.351 | 19.152 | 22.314 |
| BRAWH1000004 | 43.673 | 28.539 | 7.640 | 11.388 | 19.198 | 14.903 | 32.353 | 23.777 |
| BRAWH1000018 | 59.409 | 17.941 | 102.270 | 17.107 | 709.078 | 25.732 | 24.214 | 24.767 |
| BRAWH1000021 | 104.772 | 29.951 | 51.142 | 21.042 | 1169.154 | 55.762 | 66.754 | 27.969 |
| BRAWH1000027 | 152.205 | 47.310 | 67.089 | 32.199 | 64.521 | 70.731 | 79.670 | 40.928 |
| BRAWH1000029 | 106.376 | 49.221 | 55.840 | 40.856 | 59.552 | 56.487 | 64.886 | 100.132 |
| BRAWH1000040 | 29.419 | 16.761 | 31.101 | 16.622 | 30.633 | 18.200 | 17.998 | 15.196 |
| BRAWH1000050 | 161.264 | 71.786 | 118.976 | 51.863 | 61.542 | 97.720 | 81.271 | 69.194 |
| BRAWH1000051 | 74.067 | 34.341 | 44.047 | 20.726 | 30.434 | 42.055 | 53.856 | 24.624 |
| BRAWH1000060 | 68.789 | 22.598 | 35.012 | 16.493 | 19.127 | 38.662 | 34.923 | 28.094 |
| BRAWH1000075 | 17.318 | 16.898 | 36.437 | 8.901 | 18.133 | 17.219 | 9.321 | 11.200 |
| BRAWH1000081 | 43.025 | 12.998 | 28.267 | 7.655 | 123.677 | 17.673 | 15.924 | 9.844 |
| BRAWH1000084 | 174.384 | 42.178 | 80.534 | 47.752 | 152.188 | 77.111 | 110.167 | 102.296 |
| BRAWH1000095 | 118.239 | 59.676 | 64.528 | 28.174 | 116.975 | 53.814 | 746.700 | 35.985 |
| BRAWH1000096 | 146.112 | 44.967 | 85.882 | 27.491 | 145.013 | 52.880 | 52.427 | 58.678 |
| BRAWH1000097 | 95.841 | 72.506 | 174.954 | 65.637 | 64.200 | 73.707 | 63.827 | 63.762 |
| BRAWH1000100 | 11.943 | 19.037 | 18.950 | 13.536 | 92.145 | 16.582 | 16.646 | 10.218 |
| BRAWH1000101 | 134.838 | 57.232 | 106.632 | 40.741 | 96.396 | 71.642 | 88.432 | 57.336 |

TABLE 6

| BRAWH1000104 | 25.414 | 18.303 | 14.825 | 7.695 | 38.918 | 23.970 | 23.794 | 11.048 |
|---|---|---|---|---|---|---|---|---|
| BRAWH1000107 | 16.949 | 5.616 | 12.463 | 5.518 | 6.355 | 5.084 | 9.107 | 6.573 |
| BRAWH1000110 | 615.476 | 492.704 | 869.088 | 383.612 | 368.156 | 369.621 | 277.348 | 340.450 |
| BRAWH1000111 | 175.556 | 68.459 | 92.209 | 45.974 | 64.703 | 81.723 | 90.749 | 57.301 |
| BRAWH1000135 | 199.303 | 38.098 | 72.093 | 26.809 | 57.720 | 91.668 | 87.016 | 35.866 |
| BRAWH1000190 | 56.386 | 41.640 | 57.914 | 22.782 | 55.671 | 40.034 | 35.280 | 40.134 |
| HEMBA1000005 | 11.985 | 23.427 | 18.882 | 9.766 | 12.656 | 9.959 | 23.443 | 21.677 |
| HEMBA1000006 | 37.398 | 24.521 | 24.529 | 15.587 | 22.317 | 13.336 | 16.038 | 15.295 |
| HEMBA1000012 | 81.820 | 57.193 | 66.828 | 26.683 | 55.423 | 58.731 | 85.614 | 66.259 |
| HEMBA1000020 | 157.967 | 64.157 | 115.635 | 51.940 | 77.293 | 77.321 | 83.989 | 74.362 |
| HEMBA1000030 | 82.882 | 35.447 | 66.058 | 26.464 | 40.990 | 60.871 | 47.058 | 50.652 |
| HEMBA1000034 | 47.434 | 17.878 | 50.696 | 5.594 | 14.005 | 6.673 | 24.652 | 7.134 |
| HEMBA1000042 | 147.376 | 94.003 | 330.908 | 69.071 | 76.472 | 55.477 | 37.783 | 60.479 |
| HEMBA1000045 | 28.478 | 20.289 | 20.548 | 12.445 | 11.835 | 22.788 | 11.196 | 15.775 |
| HEMBA1000046 | 85.160 | 84.475 | 242.940 | 57.017 | 68.488 | 45.288 | 37.098 | 47.486 |
| HEMBA1000047 | 21.380 | 18.899 | 18.166 | 11.393 | 11.185 | 12.292 | 6.491 | 12.018 |
| HEMBA1000048 | 243.559 | 55.114 | 84.448 | 24.247 | 43.131 | 99.333 | 57.041 | 37.362 |

TABLE 6-continued

| | | | | | | | | |
|---|---|---|---|---|---|---|---|---|
| HEMBA1000050 | 22.711 | 11.876 | 21.972 | 7.477 | 4.096 | 13.675 | 10.347 | 7.770 |
| HEMBA1000053 | 45.071 | 26.410 | 38.158 | 15.982 | 30.754 | 36.740 | 34.184 | 24.269 |
| HEMBA1000060 | 101.197 | 34.766 | 50.643 | 19.938 | 34.641 | 54.061 | 42.309 | 22.530 |
| HEMBA1000072 | 240.166 | 213.938 | 224.688 | 163.030 | 115.246 | 207.809 | 212.361 | 276.098 |
| HEMBA1000073 | 23.202 | 9.580 | 10.815 | 1.698 | 6.680 | 18.155 | 12.304 | 14.973 |
| HEMBA1000076 | 95.997 | 46.783 | 177.931 | 32.617 | 48.964 | 50.792 | 33.947 | 44.142 |
| HEMBA1000084 | 66.603 | 25.710 | 48.434 | 18.006 | 22.553 | 38.118 | 40.479 | 29.683 |
| HEMBA1000087 | 70.084 | 17.515 | 26.544 | 8.450 | 17.590 | 29.220 | 19.519 | 22.565 |
| HEMBA1000088 | 15.474 | 8.614 | 19.903 | 4.775 | 4.519 | 11.446 | 34.905 | 6.528 |
| HEMBA1000091 | 80.622 | 38.604 | 59.393 | 23.956 | 44.939 | 49.760 | 33.946 | 24.614 |
| HEMBA1000111 | 85.814 | 95.270 | 270.642 | 75.147 | 54.384 | 70.071 | 29.529 | 55.422 |
| HEMBA1000121 | 55.476 | 43.368 | 146.465 | 37.419 | 29.398 | 30.694 | 17.702 | 30.398 |
| HEMBA1000128 | 37.278 | 27.165 | 34.516 | 13.619 | 17.702 | 28.069 | 12.834 | 23.965 |
| HEMBA1000129 | 51.488 | 19.659 | 44.907 | 12.208 | 27.243 | 30.959 | 24.383 | 26.851 |
| HEMBA1000141 | 12.961 | 24.515 | 32.107 | 14.353 | 13.502 | 11.152 | 8.907 | 20.635 |
| HEMBA1000146 | 29.273 | 11.479 | 20.418 | 8.202 | 9.575 | 14.877 | 10.000 | 7.817 |
| HEMBA1000150 | 534.562 | 326.814 | 684.147 | 211.774 | 218.448 | 322.240 | 235.752 | 256.883 |
| HEMBA1000154 | 95.272 | 92.253 | 101.483 | 54.276 | 42.896 | 75.526 | 92.689 | 188.019 |
| HEMBA1000156 | 50.177 | 72.591 | 58.026 | 31.149 | 21.865 | 38.964 | 27.634 | 50.220 |
| HEMBA1000158 | 260.718 | 63.920 | 89.680 | 36.337 | 44.915 | 93.421 | 111.344 | 53.562 |
| HEMBA1000168 | 74.416 | 61.152 | 62.826 | 30.512 | 23.287 | 34.966 | 44.005 | 33.564 |
| HEMBA1000180 | 28.502 | 22.412 | 28.571 | 11.701 | 19.230 | 10.903 | 11.731 | 14.102 |
| HEMBA1000185 | 115.723 | 50.661 | 213.994 | 51.166 | 43.435 | 56.261 | 38.862 | 44.992 |
| HEMBA1000188 | 21.302 | 14.879 | 16.948 | 11.392 | 11.821 | 10.656 | 12.501 | 6.979 |
| HEMBA1000193 | 14.122 | 8.318 | 11.905 | 7.519 | 4.736 | 3.349 | 8.544 | 7.842 |
| HEMBA1000194 | 54.688 | 49.534 | 143.817 | 37.736 | 20.221 | 34.328 | 23.359 | 56.497 |
| HEMBA1000201 | 21.062 | 14.098 | 8.690 | 6.237 | 5.109 | 5.059 | 9.317 | 10.522 |
| HEMBA1000213 | 22.388 | 25.532 | 25.777 | 8.470 | 17.320 | 9.084 | 8.469 | 11.766 |
| HEMBA1000216 | 65.935 | 51.368 | 92.680 | 19.202 | 33.659 | 40.971 | 36.328 | 34.891 |
| HEMBA1000227 | 52.577 | 31.332 | 34.925 | 19.503 | 18.411 | 21.504 | 22.590 | 25.781 |
| HEMBA1000231 | 114.369 | 54.299 | 131.256 | 38.550 | 43.246 | 29.778 | 24.266 | 30.410 |
| HEMBA1000237 | 91.024 | 91.360 | 199.338 | 58.292 | 93.250 | 57.000 | 49.319 | 59.288 |
| HEMBA1000243 | 53.456 | 43.969 | 117.519 | 38.431 | 25.396 | 32.604 | 38.910 | 32.153 |
| HEMBA1000244 | 173.469 | 104.733 | 115.584 | 33.079 | 65.527 | 124.532 | 90.927 | 78.610 |
| HEMBA1000251 | 22.709 | 12.333 | 14.367 | 9.019 | 16.095 | 13.221 | 11.516 | 11.018 |
| HEMBA1000254 | 74.060 | 35.626 | 130.009 | 20.848 | 37.481 | 24.002 | 20.553 | 13.215 |
| HEMBA1000264 | 29.478 | 15.248 | 23.537 | 9.473 | 3.863 | 11.228 | 13.690 | 3.797 |
| HEMBA1000269 | 36.718 | 13.465 | 28.932 | 20.412 | 9.705 | 12.833 | 7.348 | 24.793 |
| HEMBA1000275 | 66.201 | 39.367 | 84.077 | 38.846 | 77.871 | 49.267 | 36.211 | 38.871 |
| HEMBA1000280 | 33.299 | 36.073 | 54.357 | 24.720 | 38.017 | 35.751 | 21.696 | 30.785 |
| HEMBA1000282 | 93.815 | 121.083 | 171.037 | 93.484 | 123.971 | 70.384 | 56.916 | 92.414 |
| HEMBA1000287 | 12.439 | 24.935 | 29.793 | 10.840 | 37.925 | 9.632 | 2.866 | 7.311 |
| HEMBA1000288 | 45.269 | 30.009 | 145.363 | 25.471 | 9.769 | 16.272 | 9.701 | 15.510 |
| HEMBA1000290 | 14.803 | 5.750 | 10.615 | 5.725 | 2.559 | 8.602 | 8.358 | 9.224 |
| HEMBA1000296 | 27.085 | 22.625 | 21.195 | 9.790 | 16.909 | 12.402 | 15.289 | 17.159 |
| HEMBA1000300 | 98.491 | 119.119 | 304.884 | 73.660 | 85.595 | 48.175 | 43.496 | 66.547 |
| HEMBA1000302 | 23.840 | 15.442 | 27.722 | 16.143 | 13.081 | 13.879 | 8.259 | 12.569 |

TABLE 7

| | | | | | | | | |
|---|---|---|---|---|---|---|---|---|
| HEMBA1000303 | 129.286 | 51.013 | 88.777 | 32.513 | 50.462 | 82.994 | 44.818 | 49.271 |
| HEMBA1000304 | 112.022 | 67.470 | 328.677 | 54.678 | 79.305 | 43.526 | 38.469 | 55.762 |
| HEMBA1000307 | 14.054 | 22.013 | 31.964 | 13.167 | 15.571 | 7.974 | 10.014 | 8.685 |
| HEMBA1000312 | 97.082 | 69.330 | 183.923 | 45.322 | 45.087 | 52.968 | 37.741 | 38.246 |
| HEMBA1000318 | 16.164 | 16.264 | 18.766 | 11.688 | 3.620 | 10.732 | 8.295 | 14.675 |
| HEMBA1000327 | 29.404 | 59.618 | 81.347 | 41.731 | 85.004 | 48.526 | 49.421 | 46.866 |
| HEMBA1000333 | 16.964 | 13.930 | 14.530 | 1.872 | 5.776 | 1.571 | 0.392 | 3.743 |
| HEMBA1000338 | 121.878 | 62.572 | 348.751 | 55.463 | 49.114 | 38.561 | 30.698 | 40.644 |
| HEMBA1000343 | 25.229 | 29.781 | 46.395 | 20.673 | 5.872 | 16.551 | 10.139 | 14.088 |
| HEMBA1000349 | 23.061 | 12.586 | 31.755 | 7.020 | 17.658 | 11.622 | 14.807 | 15.611 |
| HEMBA1000351 | 92.847 | 57.338 | 196.577 | 41.762 | 37.094 | 35.370 | 27.645 | 28.615 |
| HEMBA1000355 | 85.210 | 38.388 | 64.299 | 18.101 | 33.114 | 43.511 | 37.808 | 26.628 |
| HEMBA1000356 | 60.438 | 38.786 | 62.442 | 20.784 | 17.694 | 38.058 | 40.431 | 28.899 |
| HEMBA1000357 | 84.898 | 55.990 | 206.803 | 54.151 | 42.793 | 39.432 | 26.076 | 44.579 |
| HEMBA1000366 | 47.131 | 42.031 | 90.450 | 27.056 | 20.718 | 23.499 | 14.632 | 23.547 |
| HEMBA1000369 | 71.428 | 40.685 | 54.384 | 17.613 | 21.422 | 34.985 | 37.622 | 36.900 |
| HEMBA1000370 | 16.354 | 14.949 | 22.988 | 7.916 | 18.390 | 15.359 | 13.426 | 6.647 |
| HEMBA1000376 | 80.183 | 75.300 | 201.705 | 55.266 | 66.687 | 44.612 | 55.386 | 56.070 |
| HEMBA1000387 | 100.497 | 129.367 | 351.196 | 80.257 | 104.250 | 74.007 | 57.619 | 79.876 |
| HEMBA1000389 | 69.342 | 34.021 | 71.118 | 22.346 | 27.319 | 47.936 | 53.026 | 34.161 |
| HEMBA1000390 | 19.206 | 25.788 | 21.028 | 12.401 | 18.372 | 13.751 | 16.243 | 15.036 |
| HEMBA1000392 | 19.400 | 22.884 | 44.179 | 8.776 | 11.742 | 10.594 | 12.266 | 12.463 |
| HEMBA1000396 | 75.409 | 50.195 | 81.870 | 27.979 | 30.393 | 31.235 | 17.771 | 19.584 |
| HEMBA1000411 | 35.966 | 24.397 | 25.987 | 10.341 | 31.398 | 31.214 | 50.056 | 18.580 |
| HEMBA1000418 | 8.165 | 10.778 | 14.987 | 4.031 | 12.495 | 7.913 | 6.363 | 2.306 |
| HEMBA1000422 | 93.699 | 38.329 | 85.266 | 39.826 | 45.992 | 44.729 | 42.886 | 34.308 |

TABLE 7-continued

| | | | | | | | | |
|---|---|---|---|---|---|---|---|---|
| HEMBA1000428 | 51.017 | 30.690 | 79.229 | 26.579 | 24.840 | 17.767 | 18.424 | 18.608 |
| HEMBA1000434 | 1.747 | 3.214 | 11.346 | 1.210 | 1.602 | 2.927 | 2.788 | 2.756 |
| HEMBA1000442 | 21.750 | 7.698 | 16.227 | 7.252 | 3.336 | 17.969 | 11.723 | 10.645 |
| HEMBA1000443 | 67.291 | 35.910 | 34.775 | 26.420 | 16.860 | 31.691 | 47.856 | 102.287 |
| HEMBA1000446 | 236.986 | 69.546 | 90.283 | 32.233 | 34.107 | 119.377 | 108.645 | 60.266 |
| HEMBA1000456 | 95.368 | 37.560 | 63.451 | 22.640 | 41.092 | 65.256 | 62.972 | 43.493 |
| HEMBA1000459 | 28.924 | 35.333 | 74.945 | 20.475 | 25.324 | 26.253 | 13.654 | 31.317 |
| HEMBA1000460 | 18.649 | 27.246 | 21.973 | 9.613 | 15.230 | 14.091 | 9.746 | 16.955 |
| HEMBA1000462 | 220.184 | 42.636 | 96.490 | 31.332 | 83.626 | 109.503 | 92.971 | 62.126 |
| HEMBA1000464 | 34.277 | 15.137 | 27.210 | 10.862 | 15.595 | 20.793 | 16.716 | 16.539 |
| HEMBA1000468 | 41.755 | 41.852 | 68.356 | 10.400 | 23.452 | 43.909 | 24.048 | 22.968 |
| HEMBA1000469 | 68.229 | 71.011 | 256.705 | 47.636 | 29.853 | 34.188 | 22.568 | 39.190 |
| HEMBA1000477 | 185.220 | 47.546 | 102.939 | 26.276 | 40.188 | 95.247 | 52.454 | 28.109 |
| HEMBA1000481 | 47.276 | 37.528 | 24.407 | 17.115 | 24.182 | 29.826 | 20.717 | 25.819 |
| HEMBA1000488 | 96.226 | 31.249 | 71.522 | 21.667 | 27.715 | 44.499 | 53.708 | 33.306 |
| HEMBA1000490 | 29.915 | 13.747 | 32.568 | 14.002 | 12.056 | 6.900 | 11.274 | 7.559 |
| HEMBA1000491 | 80.198 | 22.903 | 47.786 | 20.675 | 32.551 | 52.682 | 37.109 | 28.282 |
| HEMBA1000498 | 191.186 | 112.767 | 454.998 | 88.614 | 102.997 | 82.927 | 53.205 | 120.837 |
| HEMBA1000501 | 57.318 | 55.923 | 180.158 | 44.170 | 27.291 | 34.954 | 18.532 | 34.117 |
| HEMBA1000504 | 1.033 | 5.893 | 7.152 | 1.726 | 0.520 | 2.245 | 2.551 | 1.091 |
| HEMBA1000505 | 55.746 | 36.631 | 48.155 | 21.562 | 14.691 | 34.729 | 19.508 | 31.925 |
| HEMBA1000507 | 204.165 | 114.530 | 305.249 | 86.138 | 81.505 | 97.289 | 230.331 | 95.150 |
| HEMBA1000508 | 205.724 | 105.067 | 309.791 | 72.709 | 70.180 | 77.388 | 63.849 | 45.940 |
| HEMBA1000518 | 39.157 | 29.100 | 31.505 | 16.650 | 14.796 | 15.847 | 24.729 | 17.601 |
| HEMBA1000519 | 166.937 | 142.676 | 468.435 | 148.478 | 123.978 | 128.646 | 85.670 | 111.076 |
| HEMBA1000520 | 0.000 | 0.000 | 0.000 | 10.341 | 10.619 | 1.488 | 9.513 | 9.395 |
| HEMBA1000523 | 38.708 | 22.090 | 40.875 | 13.852 | 21.603 | 32.384 | 20.478 | 21.422 |
| HEMBA1000531 | 21.874 | 34.044 | 40.027 | 12.264 | 11.034 | 29.775 | 20.421 | 12.540 |
| HEMBA1000534 | 0.000 | 0.000 | 0.000 | 34.434 | 48.940 | 25.365 | 41.242 | 72.583 |
| HEMBA1000538 | 0.000 | 0.000 | 0.000 | 17.833 | 19.981 | 17.606 | 26.698 | 23.904 |
| HEMBA1000540 | 21.974 | 47.343 | 33.145 | 42.629 | 27.059 | 33.931 | 16.639 | 31.893 |
| HEMBA1000542 | 64.656 | 33.152 | 58.093 | 30.174 | 35.278 | 55.508 | 47.917 | 47.623 |
| HEMBA1000545 | 148.870 | 136.401 | 48.802 | 8.499 | 12.534 | 7.119 | 25.484 | 15.094 |
| HEMBA1000547 | 14.825 | 20.199 | 32.694 | 7.058 | 22.359 | 12.020 | 13.535 | 20.227 |
| HEMBA1000551 | 163.806 | 171.089 | 543.876 | 131.764 | 115.775 | 116.646 | 69.596 | 152.516 |
| HEMBA1000555 | 10.531 | 20.199 | 25.801 | 24.488 | 14.071 | 15.431 | 5.986 | 10.933 |
| HEMBA1000557 | 80.051 | 48.396 | 168.724 | 37.150 | 32.863 | 31.872 | 22.800 | 30.926 |
| HEMBA1000561 | 56.992 | 22.797 | 51.047 | 10.187 | 16.301 | 34.904 | 24.661 | 22.470 |

TABLE 8

| | | | | | | | | |
|---|---|---|---|---|---|---|---|---|
| HEMBA1000563 | 9.473 | 11.545 | 18.205 | 6.139 | 12.689 | 10.132 | 7.939 | 14.253 |
| HEMBA1000567 | 41.385 | 38.483 | 27.881 | 32.207 | 15.544 | 26.052 | 15.086 | 86.601 |
| HEMBA1000568 | 44.686 | 33.379 | 126.524 | 26.300 | 22.533 | 17.402 | 26.970 | 18.707 |
| HEMBA1000569 | 58.184 | 27.187 | 41.012 | 21.787 | 12.925 | 36.191 | 33.944 | 23.225 |
| HEMBA1000575 | 155.833 | 155.759 | 434.526 | 92.140 | 79.143 | 69.949 | 59.928 | 71.189 |
| HEMBA1000588 | 41.087 | 26.072 | 31.610 | 14.580 | 18.024 | 18.458 | 23.553 | 13.279 |
| HEMBA1000590 | 29.693 | 17.090 | 23.618 | 7.069 | 6.633 | 16.725 | 20.068 | 13.042 |
| HEMBA1000591 | 106.772 | 54.874 | 98.079 | 34.099 | 31.776 | 57.170 | 48.488 | 32.766 |
| HEMBA1000592 | 7.408 | 10.031 | 9.435 | 9.551 | 8.209 | 5.142 | 7.480 | 10.319 |
| HEMBA1000594 | 18.401 | 11.048 | 22.547 | 15.327 | 9.596 | 12.099 | 8.751 | 6.852 |
| HEMBA1000604 | 96.047 | 78.462 | 146.030 | 49.571 | 36.099 | 70.815 | 41.797 | 47.748 |
| HEMBA1000607 | 46.819 | 15.606 | 46.037 | 9.438 | 19.149 | 21.038 | 17.317 | 25.404 |
| HEMBA1000608 | 8.985 | 3.040 | 6.705 | 0.000 | 7.378 | 4.453 | 0.000 | 5.544 |
| HEMBA1000622 | 45.570 | 55.746 | 113.666 | 40.310 | 18.167 | 19.390 | 15.895 | 29.149 |
| HEMBA1000634 | 126.532 | 49.146 | 138.073 | 29.094 | 95.787 | 79.662 | 50.271 | 71.657 |
| HEMBA1000636 | 151.899 | 51.270 | 126.200 | 39.161 | 51.864 | 62.611 | 54.056 | 39.415 |
| HEMBA1000637 | 33.241 | 23.587 | 39.380 | 18.047 | 16.265 | 30.075 | 28.226 | 24.559 |
| HEMBA1000655 | 80.165 | 70.766 | 219.283 | 58.901 | 61.320 | 45.821 | 40.741 | 62.639 |
| HEMBA1000657 | 60.961 | 31.993 | 41.401 | 18.008 | 30.565 | 35.201 | 35.611 | 42.178 |
| HEMBA1000662 | 8.600 | 8.490 | 11.263 | 5.475 | 2.201 | 6.140 | 1.557 | 2.504 |
| HEMBA1000664 | 14.358 | 5.082 | 3.637 | 2.670 | 3.516 | 4.913 | 3.094 | 3.579 |
| HEMBA1000671 | 11.588 | 15.473 | 26.067 | 17.940 | 8.865 | 7.647 | 10.779 | 21.196 |
| HEMBA1000673 | 73.174 | 77.410 | 193.253 | 46.051 | 34.388 | 33.975 | 25.896 | 31.646 |
| HEMBA1000675 | 7.666 | 12.047 | 22.123 | 5.764 | 42.036 | 15.788 | 10.254 | 15.555 |
| HEMBA1000678 | 7.453 | 12.314 | 21.083 | 12.174 | 14.897 | 12.628 | 6.969 | 6.584 |
| HEMBA1000682 | 118.965 | 125.696 | 255.731 | 86.894 | 61.443 | 66.299 | 49.060 | 82.939 |
| HEMBA10006S6 | 25.079 | 17.463 | 23.126 | 12.722 | 10.282 | 13.835 | 21.393 | 18.154 |
| HEMBA1000702 | 206.683 | 94.357 | 266.585 | 62.386 | 79.930 | 90.914 | 98.397 | 60.559 |
| HEMBA1000705 | 25.430 | 25.862 | 47.190 | 13.191 | 19.599 | 26.364 | 25.013 | 18.833 |
| HEMBA1000713 | 56.893 | 25.288 | 70.751 | 17.660 | 24.138 | 23.311 | 21.805 | 21.736 |
| HEMBA1000718 | 50.149 | 43.869 | 128.515 | 28.289 | 23.213 | 18.458 | 10.003 | 17.419 |
| HEMBA1000719 | 37.969 | 17.467 | 28.513 | 12.147 | 12.768 | 22.643 | 14.744 | 14.432 |
| HEMBA1000722 | 15.150 | 9.762 | 14.699 | 6.768 | 11.726 | 12.080 | 5.907 | 9.953 |
| HEMBA1000726 | 159.817 | 111.276 | 463.937 | 91.448 | 109.093 | 58.587 | 46.517 | 70.087 |
| HEMBA1000727 | 22.867 | 26.803 | 28.886 | 21.475 | 11.199 | 14.966 | 8.634 | 30.401 |

TABLE 8-continued

| | | | | | | | | |
|---|---|---|---|---|---|---|---|---|
| HEMBA1000732 | 28.630 | 11.011 | 12.790 | 4.617 | 3.548 | 13.325 | 19.978 | 13.472 |
| HEMBA1000736 | 24.568 | 21.982 | 21.410 | 7.431 | 11.376 | 41.026 | 31.698 | 16.801 |
| HEMBA1000743 | 0.741 | 4.467 | 1.793 | 1.637 | 1.227 | 3.642 | 4.563 | 3.368 |
| HEMBA1000745 | 8.930 | 7.067 | 14.546 | 3.314 | 10.067 | 5.403 | 9.225 | 6.085 |
| HEMBA1000747 | 21.442 | 12.487 | 25.662 | 17.081 | 5.384 | 10.287 | 9.865 | 8.267 |
| HEMBA1000748 | 22.924 | 14.885 | 35.721 | 12.634 | 3.045 | 11.508 | 4.110 | 11.756 |
| HEMBA1000749 | 67.267 | 50.826 | 159.211 | 43.879 | 20.345 | 29.613 | 19.447 | 31.693 |
| HEMBA1000752 | 54.929 | 35.778 | 162.005 | 28.209 | 31.540 | 25.132 | 15.650 | 20.776 |
| HEMBA1000753 | 120.889 | 83.878 | 155.892 | 48.092 | 54.307 | 53.238 | 38.941 | 39.331 |
| HEMBA1000757 | 20.234 | 22.592 | 52.608 | 29.935 | 23.071 | 24.503 | 14.548 | 43.779 |
| HEMBA1000760 | 12.599 | 38.665 | 19.973 | 15.800 | 30.188 | 14.155 | 10.570 | 39.229 |
| HEMBA1000769 | 114.956 | 74.924 | 304.424 | 66.815 | 39.365 | 48.405 | 39.918 | 55.931 |
| HEMBA1000773 | 2.162 | 5.360 | 11.883 | 4.445 | 0.965 | 3.158 | 3.956 | 2.663 |
| HEMBA1000774 | 128.563 | 115.732 | 330.111 | 84.461 | 69.618 | 59.363 | 42.656 | 56.152 |
| HEMBA1000780 | 6.850 | 7.130 | 24.176 | 6.924 | 6.903 | 6.546 | 6.667 | 9.576 |
| HEMBA1000783 | 8.127 | 5.076 | 13.701 | 3.276 | 8.863 | 6.241 | 5.435 | 4.429 |
| HEMBA1000791 | 41.433 | 51.546 | 108.542 | 29.633 | 42.735 | 44.515 | 43.187 | 40.856 |
| HEMBA1000793 | 108.761 | 30.885 | 54.568 | 18.670 | 31.512 | 54.669 | 45.458 | 34.788 |
| HEMBA1000802 | 15.062 | 11.125 | 9.052 | 10.300 | 11.505 | 12.950 | 15.354 | 16.952 |
| HEMBA1000813 | 106.763 | 52.683 | 69.701 | 32.507 | 44.369 | 65.862 | 59.842 | 56.799 |
| HEMBA1000817 | 19.480 | 7.070 | 17.915 | 4.016 | 15.239 | 18.434 | 11.273 | 8.079 |
| HEMBA1000822 | 9.520 | 10.358 | 15.760 | 7.218 | 8.704 | 11.185 | 6.639 | 4.662 |
| HEMBA1000827 | 96.001 | 12.420 | 24.041 | 8.305 | 24.000 | 6.709 | 3.488 | 8.591 |
| HEMBA1000833 | 53.675 | 28.970 | 35.897 | 14.604 | 26.383 | 29.036 | 20.591 | 14.341 |
| HEMBA1000835 | 74.696 | 67.353 | 83.737 | 34.349 | 42.834 | 61.145 | 66.784 | 52.015 |
| HEMBA1000843 | 74.227 | 54.197 | 92.042 | 37.825 | 58.573 | 98.943 | 87.569 | 55.077 |
| HEMBA1000851 | 23.913 | 14.070 | 13.081 | 6.847 | 8.634 | 12.419 | 19.200 | 22.286 |
| HEMBA1000852 | 56.702 | 54.074 | 105.085 | 31.127 | 34.200 | 31.843 | 28.843 | 30.311 |
| HEMBA1000867 | 15.548 | 10.247 | 11.912 | 6.256 | 1.227 | 12.374 | 8.518 | 5.611 |

TABLE 9

| | | | | | | | | |
|---|---|---|---|---|---|---|---|---|
| HEMBA1000869 | 19.696 | 18.785 | 34.039 | 15.061 | 6.930 | 13.298 | 14.305 | 14.112 |
| HEMBA1000870 | 64.189 | 38.246 | 44.665 | 12.647 | 23.970 | 41.195 | 21.911 | 17.508 |
| HEMBA1000872 | 46.848 | 46.546 | 86.933 | 36.087 | 40.608 | 42.532 | 43.479 | 36.141 |
| HEMBA1000875 | 35.460 | 41.166 | 32.238 | 11.297 | 35.077 | 29.781 | 19.453 | 23.540 |
| HEMBA1000876 | 89.976 | 56.654 | 194.869 | 42.595 | 57.670 | 53.567 | 36.331 | 40.884 |
| HEMBA1000907 | 22.959 | 9.656 | 10.917 | 3.599 | 3.363 | 5.327 | 13.032 | 10.676 |
| HEMBA1000908 | 45.409 | 18.456 | 30.665 | 12.448 | 8.174 | 19.529 | 24.789 | 16.299 |
| HEMBA1000910 | 47.107 | 13.681 | 26.933 | 5.866 | 7.073 | 19.938 | 22.971 | 11.592 |
| HEMBA1000918 | 67.437 | 29.880 | 114.873 | 25.206 | 16.670 | 25.895 | 26.769 | 24.710 |
| HEMBA1000919 | 44.938 | 29.704 | 40.184 | 22.126 | 16.008 | 24.639 | 23.073 | 20.233 |
| HEMBA1000934 | 162.546 | 35.314 | 59.012 | 18.820 | 30.796 | 53.492 | 33.824 | 20.798 |
| HEMBA1000935 | 16.284 | 29.481 | 71.669 | 12.587 | 23.834 | 13.188 | 7.830 | 13.322 |
| HEMBA1000940 | 44.243 | 39.296 | 75.619 | 25.080 | 28.113 | 39.401 | 25.948 | 30.168 |
| HEMBA1000942 | 126.095 | 96.812 | 260.912 | 62.657 | 49.118 | 47.891 | 35.814 | 49.631 |
| HEMBA1000943 | 14.439 | 12.702 | 14.690 | 4.792 | 8.391 | 11.856 | 11.039 | 7.414 |
| HEMBA1000946 | 15.461 | 5.506 | 18.692 | 9.000 | 5.772 | 0.000 | 19.405 | 9.939 |
| HEMBA1000960 | 179.860 | 151.073 | 343.747 | 107.319 | 85.691 | 117.093 | 82.928 | 94.494 |
| HEMBA1000962 | 73.395 | 34.803 | 60.061 | 26.562 | 28.789 | 47.944 | 60.067 | 31.619 |
| HEMBA1000968 | 14.529 | 12.486 | 35.270 | 18.733 | 6.213 | 7.458 | 7.214 | 4.624 |
| HEMBA1000971 | 50.148 | 19.281 | 37.515 | 12.222 | 19.562 | 29.874 | 22.045 | 23.135 |
| HEMBA1000972 | 51.100 | 33.450 | 188.137 | 28.972 | 24.576 | 23.736 | 13.731 | 27.272 |
| HEMBA1000974 | 5.609 | 10.649 | 12.866 | 2.929 | 2.603 | 3.800 | 6.104 | 4.964 |
| HEMBA1000975 | 34.417 | 19.132 | 42.499 | 15.644 | 4.009 | 16.478 | 14.192 | 14.353 |
| HEMBA1000979 | 90.061 | 38.532 | 99.641 | 19.754 | 27.516 | 38.801 | 31.347 | 36.440 |
| HEMBA1000981 | 35.338 | 31.281 | 38.672 | 19.544 | 34.385 | 38.280 | 24.897 | 29.059 |
| HEMBA1000983 | 71.391 | 34.501 | 58.683 | 22.640 | 32.825 | 32.384 | 27.465 | 31.286 |
| HEMBA1000985 | 9.290 | 20.363 | 22.497 | 4.058 | 6.343 | 9.035 | 7.852 | 3.257 |
| HEMBA1000986 | 128.714 | 74.713 | 236.019 | 56.662 | 52.957 | 85.340 | 63.718 | 54.892 |
| HEMBA1000991 | 72.707 | 55.780 | 160.717 | 34.676 | 32.494 | 41.317 | 23.483 | 37.846 |
| HEMBA1001007 | 123.690 | 42.563 | 69.807 | 23.525 | 34.263 | 47.777 | 47.496 | 48.154 |
| HEMBA1001008 | 124.864 | 47.842 | 83.746 | 18.125 | 25.490 | 52.693 | 30.668 | 24.961 |
| HEMBA1001009 | 37.843 | 29.269 | 36.715 | 11.055 | 17.115 | 17.937 | 17.701 | 22.055 |
| HEMBA1001014 | 109.049 | 83.356 | 233.234 | 60.123 | 61.977 | 94.424 | 47.095 | 74.625 |
| HEMBA1001017 | 50.408 | 20.212 | 48.394 | 16.020 | 28.537 | 31.917 | 27.876 | 24.283 |
| HEMBA1001019 | 7.327 | 7.582 | 14.865 | 6.154 | 10.598 | 5.643 | 3.920 | 77188 |
| HEMBA1001020 | 53.067 | 55.646 | 115.814 | 31.640 | 25.647 | 24.596 | 23.146 | 27.169 |
| HEMBA1001021 | 115.724 | 42.415 | 59.434 | 28.828 | 26.181 | 64.484 | 64.173 | 29.614 |
| HEMBA1001022 | 37.883 | 25.835 | 28.969 | 18.452 | 20.270 | 22.790 | 25.194 | 20.783 |
| HEMBA1001024 | 23.524 | 15.235 | 16.511 | 8.023 | 11.818 | 13.894 | 8.606 | 8.098 |
| HEMBA1001026 | 21.343 | 12.515 | 18.851 | 6.888 | 7.288 | 12.663 | 8.419 | 7.418 |
| HEMBA1001043 | 10.374 | 11.995 | 9.892 | 10.750 | 19.163 | 9.299 | 8.047 | 8.589 |
| HEMBA1001051 | 124.869 | 115.181 | 387.345 | 100.376 | 67.510 | 61.660 | 46.295 | 68.994 |
| HEMBA1001052 | 38.892 | 13.860 | 19.067 | 12.855 | 11.445 | 24.382 | 15.726 | 12.323 |
| HEMBA1001059 | 98.097 | 41.525 | 66.565 | 27.826 | 26.220 | 46.725 | 42.356 | 36.506 |

TABLE 9-continued

| | | | | | | | | |
|---|---|---|---|---|---|---|---|---|
| HEMBA1001060 | 116.857 | 74.020 | 161.485 | 61.750 | 50.524 | 52.957 | 38.575 | 52.612 |
| HEMBA1001064 | 32.251 | 24.026 | 33.937 | 14.007 | 7.907 | 13.710 | 17.387 | 16.720 |
| HEMBA1001071 | 25.850 | 16.043 | 19.924 | 7.855 | 3.425 | 9.530 | 6.779 | 24.242 |
| HEMBA1001077 | 24.689 | 23.055 | 64.486 | 19.413 | 16.821 | 16.858 | 13.165 | 12.873 |
| HEMBA1001078 | 33.254 | 26.761 | 41.713 | 26.498 | 24.531 | 31.498 | 25.302 | 23.636 |
| HEMBA1001080 | 57.701 | 23.951 | 31.254 | 22.489 | 24.848 | 33.265 | 31.880 | 26.484 |
| HEMBA1001084 | 62.698 | 41.625 | 171.096 | 31.438 | 31.760 | 24.829 | 17.487 | 26.581 |
| HEMBA1001085 | 159.252 | 116.909 | 294.247 | 77.235 | 81.384 | 76.498 | 59.989 | 55.574 |
| HEMBA1001088 | 74.704 | 42.537 | 46.695 | 19.266 | 25.146 | 33.498 | 44.927 | 26.310 |
| HEMBA1001093 | 30.048 | 28.810 | 72.081 | 20.831 | 14.610 | 11.033 | 15.558 | 22.531 |
| HEMBA1001094 | 5.535 | 8.779 | 10.059 | 3.089 | 4.628 | 4.521 | 4.834 | 4.468 |
| HEMBA1001099 | 18.322 | 24.021 | 14.814 | 7.146 | 13.778 | 16.055 | 11.044 | 10.190 |
| HEMBA1001104 | 21.919 | 13.788 | 35.048 | 9.637 | 18.058 | 24.450 | 21.559 | 18.527 |
| HEMBA1001109 | 186.384 | 190.240 | 540.908 | 155.496 | 134.630 | 93.324 | 78.690 | 116.187 |
| HEMBA1001114 | 89.023 | 252.529 | 187.547 | 75.857 | 35.109 | 66.259 | 69.432 | 341.702 |
| HEMBA1001121 | 32.820 | 25.812 | 89.860 | 19.710 | 34.244 | 18.209 | 9.519 | 15.621 |
| HEMBA1001122 | 3.304 | 6.213 | 8.316 | 4.763 | 19.120 | 5.650 | 4.506 | 23.059 |
| HEMBA1001123 | 108.859 | 55.807 | 190.789 | 41.415 | 39.028 | 42.683 | 25.551 | 30.174 |
| HEMBA1001133 | 50.744 | 21.167 | 36.786 | 14.764 | 34.752 | 26.702 | 23.524 | 11.367 |
| HEMBA1001137 | 38.685 | 21.659 | 46.297 | 21.567 | 13.174 | 15.867 | 11.767 | 25.508 |

TABLE 10

| | | | | | | | | |
|---|---|---|---|---|---|---|---|---|
| HEMBA1001140 | 60.453 | 66.122 | 169.353 | 48.837 | 60.363 | 44.403 | 30.367 | 43.561 |
| HEMBA1001144 | 278.126 | 195.811 | 643.688 | 207.291 | 166.089 | 101.134 | 106.333 | 142.120 |
| HEMBA1001145 | 58.539 | 241.368 | 206.084 | 46.342 | 39.316 | 61.827 | 91.170 | 66.852 |
| HEMBA1001158 | 29.417 | 28.121 | 43.877 | 13.337 | 24.176 | 19.965 | 18.089 | 28.622 |
| HEMBA1001172 | 74.727 | 47.695 | 213.708 | 37.115 | 24.460 | 26.620 | 19.178 | 32.709 |
| HEMBA1001174 | 6.279 | 8.617 | 8.831 | 7.914 | 2.574 | 8.031 | 3.119 | 4.980 |
| HEMBA1001175 | 29.561 | 34.909 | 43.568 | 19.819 | 34.829 | 16.588 | 19.883 | 17.824 |
| HEMBA1001182 | 136.762 | 64.608 | 105.979 | 44.066 | 83.417 | 86.736 | 126.297 | 79.785 |
| HEMBA1001184 | 16.758 | 9.703 | 22.060 | 9.016 | 11.018 | 10.205 | 6.347 | 9.176 |
| HEMBA1001192 | 15.119 | 10.798 | 11.626 | 6.559 | 5.736 | 3.435 | 9.089 | 11.273 |
| HEMBA1001197 | 82.571 | 114.743 | 110.687 | 83.431 | 56.396 | 68.797 | 99.959 | 73.379 |
| HEMBA1001208 | 40.250 | 30.964 | 37.220 | 19.514 | 11.451 | 24.172 | 27.637 | 12.469 |
| HEMBA1001213 | 81.501 | 37.345 | 57.618 | 18.958 | 24.480 | 52.160 | 51.978 | 31.326 |
| HEMBA1001214 | 36.798 | 16.011 | 20.958 | 17.612 | 12.418 | 20.697 | 19.108 | 21.328 |
| HEMBA1001221 | 14.108 | 10.456 | 11.382 | 7.001 | 17.058 | 10.307 | 7.980 | 11.111 |
| HEMBA1001225 | 13.961 | 14.077 | 13.384 | 5.925 | 5.876 | 13.456 | 12.076 | 5.825 |
| HEMBA1001226 | 173.501 | 137.685 | 444.754 | 120.060 | 113.306 | 75.167 | 63.960 | 67.304 |
| HEMBA1001228 | 115.971 | 48.677 | 102.518 | 36.755 | 64.214 | 50.002 | 60.915 | 35.178 |
| HEMBA1001229 | 246.802 | 111.161 | 135.886 | 43.460 | 94.703 | 148.387 | 156.871 | 115.302 |
| HEMBA1001235 | 43.880 | 86.102 | 81.818 | 36.769 | 54.172 | 65.830 | 70.065 | 66.201 |
| HEMBA1001238 | 67.342 | 62.561 | 136.273 | 36.471 | 33.652 | 41.838 | 26.195 | 28.747 |
| HEMBA1001242 | 55.562 | 43.106 | 58.593 | 41.382 | 47.200 | 38.498 | 43.114 | 44.230 |
| HEMBA1001247 | 28.768 | 22.129 | 16.518 | 10.576 | 8.758 | 17.031 | 9.651 | 13.385 |
| HEMBA1001253 | 58.130 | 60.415 | 66.640 | 18.982 | 45.992 | 54.071 | 95.073 | 63.393 |
| HEMBA1001257 | 33.557 | 18.509 | 24.256 | 10.657 | 12.732 | 31.261 | 24.849 | 9.134 |
| HEMBA1001261 | 585.214 | 143.415 | 243.791 | 98.186 | 169.988 | 310.109 | 234.388 | 25.796 |
| HEMBA1001262 | 27.336 | 17.339 | 19.088 | 5.647 | 15.678 | 20.899 | 11.464 | 19.889 |
| HEMBA1001265 | 36.604 | 28.090 | 152.221 | 27.730 | 49.893 | 34.423 | 16.502 | 26.993 |
| HEMBA1001266 | 69.367 | 67.414 | 170.657 | 45.898 | 31.802 | 39.554 | 41.287 | 52.480 |
| HEMBA1001269 | 69.921 | 44.649 | 36.964 | 34.126 | 22.232 | 42.207 | 49.848 | 39.719 |
| HEMBA1001272 | 20.406 | 15.416 | 11.514 | 7.843 | 8.604 | 7.893 | 20.960 | 13.545 |
| HEMBA1001279 | 113.597 | 76.085 | 147.371 | 41.113 | 50.841 | 58.248 | 43.344 | 47.548 |
| HEMBA1001281 | 45.326 | 37.551 | 65.225 | 44.536 | 46.787 | 41.371 | 32.229 | 56.625 |
| HEMBA1001286 | 370.697 | 150.949 | 236.623 | 103.571 | 123.976 | 219.461 | 196.233 | 117.566 |
| HEMBA1001289 | 41.041 | 24.670 | 40.151 | 15.175 | 30.612 | 27.627 | 26.637 | 19.344 |
| HEMBA1001291 | 76.537 | 40.444 | 50.226 | 18.776 | 38.423 | 55.355 | 46.692 | 35.972 |
| HEMBA1001294 | 82.258 | 72.319 | 157.642 | 42.143 | 20.735 | 29.333 | 17.711 | 34.443 |
| HEMBA1001296 | 53.487 | 17.150 | 31.045 | 10.275 | 15.918 | 21.120 | 15.842 | 13.595 |
| HEMBA1001297 | 13.397 | 24.306 | 19.513 | 11.631 | 14.701 | 4.543 | 9.800 | 8.121 |
| HEMBA1001299 | 122.378 | 135.140 | 326.747 | 90.817 | 73.749 | 56.152 | 49.803 | 80.999 |
| HEMBA1001302 | 56.839 | 29.036 | 56.412 | 19.108 | 20.078 | 34.481 | 51.929 | 37.087 |
| HEMBA1001303 | 14.975 | 18.442 | 43.778 | 16.797 | 10.985 | 11.442 | 9.787 | 19.264 |
| HEMBA1001306 | 262.869 | 135.864 | 244.234 | 109.949 | 109.582 | 147.334 | 146.509 | 115.543 |
| HEMBA1001308 | 174.017 | 96.705 | 220.049 | 56.953 | 61.486 | 74.225 | 56.171 | 58.657 |
| HEMBA1001310 | 103.029 | 52.915 | 67.714 | 22.895 | 38.245 | 67.233 | 49.204 | 51.006 |
| HEMBA1001312 | 98.664 | 47.333 | 61.080 | 18.118 | 33.555 | 47.007 | 41.795 | 38.627 |
| HEMBA1001319 | 2.396 | 8.234 | 13.960 | 1.828 | 5.485 | 3.003 | 5.682 | 3.780 |
| HEMBA1001322 | 139.794 | 39.912 | 105.709 | 27.700 | 41.977 | 70.428 | 70.602 | 46.470 |
| HEMBA1001323 | 33.347 | 16.728 | 25.356 | 11.399 | 17.982 | 11.181 | 6.356 | 12.033 |
| HEMBA1001326 | 86.190 | 37.984 | 69.933 | 24.331 | 30.078 | 49.223 | 46.365 | 16.347 |
| HEMBA1001327 | 7.232 | 9.387 | 23.180 | 7.314 | 5.185 | 9.563 | 4.423 | 5.267 |
| HEMBA1001330 | 115.768 | 106.951 | 275.315 | 73.389 | 24.661 | 70.535 | 40.088 | 77.680 |
| HEMBA1001348 | 15.770 | 21.874 | 26.347 | 9.575 | 13.666 | 23.703 | 12.647 | 13.724 |

TABLE 10-continued

| | | | | | | | | |
|---|---|---|---|---|---|---|---|---|
| HEMBA1001350 | 75.857 | 38.749 | 51.454 | 16.428 | 34.291 | 56.400 | 34.055 | 24.753 |
| HEMBA1001351 | 52.274 | 55.313 | 56.544 | 30.521 | 46.408 | 29.604 | 44.212 | 30.972 |
| HEMBA1001352 | 68.321 | 46.617 | 54.427 | 17.559 | 29.887 | 39.484 | 52.789 | 29.131 |
| HEMBA1001353 | 39.891 | 57.492 | 54.971 | 31.425 | 27.945 | 45.687 | 29.741 | 66.188 |
| HEMBA1001358 | 45.659 | 52.406 | 59.774 | 46.865 | 40.225 | 47.618 | 32.581 | 59.101 |
| HEMBA1001361 | 22.908 | 16.519 | 28.635 | 11.897 | 15.569 | 13.635 | 13.938 | 16.914 |
| HEMBA1001364 | 18.896 | 17.205 | 23.355 | 7.224 | 9.469 | 13.379 | 76.125 | 15.026 |
| HEMBA1001375 | 61.506 | 22.179 | 38.795 | 12.798 | 25.778 | 40.077 | 21.715 | 22.300 |
| HEMBA1001377 | 140.430 | 131.029 | 307.084 | 83.191 | 100.026 | 74.475 | 63.988 | 96.351 |
| HEMBA1001383 | 23.974 | 26.206 | 28.704 | 11.442 | 17.819 | 19.160 | 16.899 | 7.766 |
| HEMBA1001387 | 58.343 | 34.130 | 63.677 | 19.556 | 30.371 | 42.397 | 40.247 | 49.239 |

TABLE 11

| | | | | | | | | |
|---|---|---|---|---|---|---|---|---|
| HEMBA1001388 | 48.601 | 24.690 | 39.877 | 18.958 | 10.634 | 32.922 | 22.224 | 33.218 |
| HEMBA1001390 | 132.003 | 94.390 | 254.352 | 56.412 | 64.490 | 47.169 | 44.169 | 57.312 |
| HEMBA1001391 | 18.302 | 9.686 | 12.994 | 6.299 | 10.600 | 8.500 | 7.116 | 5.544 |
| HEMBA1001398 | 91.232 | 50.992 | 142.408 | 36.081 | 29.548 | 29.490 | 28.704 | 29.984 |
| HEMBA1001405 | 58.645 | 22.354 | 32.227 | 15.864 | 9.285 | 19.993 | 24.564 | 13.964 |
| HEMBA1001406 | 36.434 | 22.693 | 105.808 | 18.094 | 19.994 | 13.316 | 18.019 | 16.592 |
| HEMBA1001407 | 38.781 | 19.637 | 24.599 | 18.935 | 13.107 | 23.014 | 18.826 | 15.060 |
| HEMBA1001411 | 28.412 | 7.180 | 21.950 | 8.303 | 9.708 | 14.302 | 8.598 | 6.663 |
| HEMBA1001413 | 66.736 | 26.480 | 35.635 | 15.400 | 24.013 | 18.356 | 24.304 | 20.769 |
| HEMBA1001414 | 20.720 | 7.567 | 18.414 | 12.522 | 9.722 | 12.903 | 18.283 | 18.581 |
| HEMBA1001415 | 76.802 | 54.702 | 159.510 | 34.156 | 20.989 | 32.235 | 21.694 | 26.676 |
| HEMBA1001416 | 41.784 | 23.474 | 29.453 | 12.230 | 24.881 | 24.993 | 25.847 | 28.651 |
| HEMBA1001432 | 74.066 | 60.077 | 190.870 | 40.409 | 63.619 | 36.879 | 66.751 | 33.675 |
| HEMBA1001433 | 132.672 | 110.163 | 246.542 | 77.852 | 61.676 | 50.447 | 37.821 | 64.403 |
| HEMBA1001435 | 138.669 | 108.645 | 334.104 | 89.523 | 68.855 | 59.723 | 58.393 | 56.483 |
| HEMBA1001442 | 13.093 | 8.604 | 11.177 | 7.985 | 15.704 | 7.291 | 6.742 | 6.336 |
| HEMBA1001446 | 102.450 | 63.255 | 146.442 | 40.086 | 27.976 | 37.353 | 30.266 | 41.647 |
| HEMBA1001450 | 72.339 | 35.494 | 55.103 | 30.799 | 31.322 | 42.457 | 42.764 | 41.349 |
| HEMBA1001454 | 146.726 | 128.060 | 438.247 | 88.679 | 43.129 | 54.712 | 41.131 | 31.250 |
| HEMBA1001455 | 5.879 | 8.197 | 8.325 | 5.561 | 4.437 | 5.252 | 4.300 | 7.359 |
| HEMBA1001459 | 17.432 | 15.927 | 16.490 | 6.749 | 2.733 | 5.888 | 7.836 | 10.963 |
| HEMBA1001461 | 61.531 | 52.734 | 57.136 | 38.874 | 24.764 | 19.473 | 23.241 | 32.318 |
| HEMBA1001462 | 10.875 | 14.911 | 16.843 | 12.984 | 13.465 | 48.381 | 7.061 | 25.992 |
| HEMBA1001463 | 137.907 | 83.753 | 340.496 | 93.114 | 51.866 | 61.784 | 37.705 | 68.960 |
| HEMBA1001469 | 85.416 | 21.757 | 29.463 | 15.911 | 84.887 | 77.440 | 27.033 | 29.537 |
| HEMBA1001473 | 20.582 | 31.855 | 36.498 | 8.307 | 3.680 | 16.703 | 21.371 | 19.890 |
| HEMBA1001476 | 135.720 | 113.851 | 246.800 | 65.595 | 57.431 | 63.903 | 65.229 | 67.697 |
| HEMBA1001477 | 5.228 | 2.001 | 4.505 | 2.645 | 1.540 | 3.243 | 1.426 | 2.876 |
| HEMBA1001478 | 14.335 | 10.180 | 12.692 | 5.468 | 4.474 | 5.444 | 2.171 | 4.539 |
| HEMBA1001480 | 88.891 | 28.381 | 49.689 | 21.660 | 14.126 | 36.334 | 38.272 | 30.563 |
| HEMBA1001483 | 29.872 | 5.156 | 20.900 | 4.647 | 5.264 | 9.545 | 13.805 | 4.424 |
| HEMBA1001490 | 6.867 | 6.967 | 14.148 | 7.289 | 1.585 | 5.016 | 5.792 | 5.999 |
| HEMBA1001495 | 431.282 | 118.073 | 203.714 | 73.985 | 176.836 | 195.947 | 194.164 | 146.945 |
| HEMBA1001497 | 93.817 | 60.807 | 227.867 | 55.576 | 41.006 | 34.182 | 23.206 | 45.223 |
| HEMBA1001510 | 174.254 | 120.414 | 343.336 | 76.008 | 76.932 | 73.234 | 61.531 | 76.899 |
| HEMBA1001515 | 45.158 | 26.337 | 67.169 | 15.756 | 15.962 | 10.664 | 9.567 | 12.346 |
| HEMBA1001517 | 51.005 | 47.728 | 80.287 | 34.595 | 28.246 | 21.020 | 17.229 | 33.972 |
| HEMBA1001522 | 7.431 | 8.980 | 7.032 | 7.566 | 5.011 | 6.466 | 6.447 | 4.824 |
| HEMBA1001526 | 48.774 | 21.300 | 32.732 | 18.831 | 22.395 | 22.767 | 23.530 | 17.914 |
| HEMBA1001533 | 129.423 | 85.570 | 262.800 | 70.163 | 46.649 | 44.926 | 26.457 | 37.421 |
| HEMBA1001547 | 59.442 | 26.656 | 27.947 | 8.053 | 15.558 | 53.508 | 108.861 | 25.371 |
| HEMBA1001552 | 41.663 | 33.242 | 115.535 | 26.222 | 30.447 | 18.258 | 21.358 | 25.853 |
| HEMBA1001553 | 58.388 | 75.765 | 66.228 | 32.264 | 36.396 | 54.513 | 64.874 | 41.905 |
| HEMBA1001557 | 182.516 | 80.827 | 161.852 | 69.344 | 80.644 | 123.765 | 111.732 | 70.946 |
| HEMBA1001563 | 39.649 | 31.429 | 85.246 | 26.057 | 12.157 | 15.987 | 10.065 | 17.083 |
| HEMBA1001566 | 37.835 | 49.964 | 108.284 | 35.793 | 23.255 | 25.180 | 21.368 | 39.375 |
| HEMBA1001569 | 75.584 | 44.631 | 109.624 | 35.487 | 130.340 | 63.130 | 44.960 | 55.257 |
| HEMBA1001570 | 198.300 | 125.319 | 444.153 | 119.332 | 74.267 | 79.979 | 64.732 | 90.896 |
| HEMBA1001579 | 103.128 | 60.654 | 48.704 | 22.469 | 22.629 | 67.058 | 24.391 | 34.300 |
| HEMBA1001581 | 153.698 | 126.225 | 312.570 | 131.687 | 142.104 | 91.884 | 67.267 | 94.418 |
| HEMBA1001582 | 3.551 | 7.087 | 15.302 | 4.019 | 8.190 | 4.888 | 4.671 | 5.144 |
| HEMBA1001585 | 27.271 | 18.375 | 25.179 | 14.108 | 5.648 | 14.993 | 7.628 | 12.297 |
| HEMBA1001589 | 109.877 | 22.722 | 49.216 | 20.427 | 22.904 | 64.665 | 57.120 | 21.314 |
| HEMBA1001595 | 71.600 | 62.349 | 46.938 | 34.447 | 29.362 | 34.516 | 45.233 | 35.562 |
| HEMBA1001604 | 41.253 | 27.004 | 34.167 | 16.004 | 6.061 | 21.932 | 18.414 | 23.101 |
| HEMBA1001608 | 35.073 | 29.270 | 41.525 | 21.276 | 22.867 | 22.699 | 14.094 | 15.366 |
| HEMBA1001615 | 556.575 | 105.703 | 103.519 | 47.686 | 27.311 | 81.914 | 42.373 | 58.652 |
| HEMBA1001620 | 134.940 | 29.972 | 79.824 | 31.924 | 62.056 | 54.423 | 64.359 | 36.203 |
| HEMBA1001621 | 70.036 | 30.704 | 63.807 | 15.048 | 19.545 | 42.391 | 33.266 | 40.516 |
| HEMBA1001635 | 39.932 | 29.397 | 35.653 | 16.214 | 18.765 | 19.655 | 22.405 | 14.095 |
| HEMBA1001636 | 73.726 | 18.596 | 35.798 | 14.928 | 12.865 | 24.352 | 31.819 | 22.414 |
| HEMBA1001640 | 48.402 | 45.105 | 79.588 | 28.452 | 22.449 | 25.101 | 30.009 | 43.819 |

TABLE 11-continued

| | | | | | | | | |
|---|---|---|---|---|---|---|---|---|
| HEMBA1001647 | 82.402 | 39.456 | 75.907 | 35.084 | 26.220 | 48.859 | 71.158 | 46.463 |
| HEMBA1001651 | 390.307 | 66.648 | 181.929 | 51.802 | 112.530 | 208.201 | 178.161 | 96.640 |

TABLE 12

| | | | | | | | | |
|---|---|---|---|---|---|---|---|---|
| HEMBA1001655 | 60.366 | 18.983 | 58.438 | 20.404 | 25.072 | 27.162 | 29.260 | 26.673 |
| HEMBA1001658 | 6.754 | 15.270 | 17.542 | 13.420 | 5.060 | 4.800 | 4.973 | 4.979 |
| HEMBA1001661 | 87.199 | 20.304 | 32.793 | 13.056 | 8.394 | 24.098 | 22.916 | 24.583 |
| HEMBA1001665 | 160.583 | 20.830 | 54.460 | 12.363 | 48.457 | 86.024 | 73.847 | 21.248 |
| HEMBA1001670 | 16.953 | 38.651 | 17.002 | 34.999 | 14.855 | 17.849 | 22.906 | 29.478 |
| HEMBA1001672 | 32.013 | 18.885 | 29.000 | 10.798 | 7.763 | 13.782 | 17.314 | 12.393 |
| HEMBA1001673 | 38.188 | 67.401 | 34.336 | 38.037 | 14.401 | 17.612 | 30.520 | 43.461 |
| HEMBA1001675 | 25.652 | 15.594 | 33.810 | 5.390 | 15.796 | 13.173 | 20.020 | 12.830 |
| HEMBA1001676 | 91.000 | 54.310 | 85.397 | 92.681 | 131.468 | 50.365 | 47.230 | 68.405 |
| HEMBA1001678 | 218.382 | 128.995 | 336.408 | 93.889 | 115.305 | 80.843 | 48.879 | 83.933 |
| HEMBA1001680 | 82.159 | 51.521 | 165.818 | 33.978 | 36.449 | 33.368 | 38.495 | 35.261 |
| HEMBA1001681 | 1.654 | 0.785 | 0.840 | 2.142 | 2.581 | 2.772 | 2.146 | 2.424 |
| HEMBA1001684 | 143.985 | 84.151 | 377.154 | 72.850 | 69.097 | 61.638 | 30.820 | 52.077 |
| HEMBA1001695 | 16.068 | 10.112 | 14.571 | 6.860 | 4.930 | 4.572 | 6.164 | 7.330 |
| HEMBA1001702 | 26.509 | 13.637 | 8.186 | 8.466 | 4.041 | 2.043 | 3.870 | 3.613 |
| HEMBA1001709 | 67.279 | 26.552 | 35.845 | 13.982 | 21.742 | 28.610 | 24.540 | 19.603 |
| HEMBA1001711 | 20.072 | 29.559 | 39.037 | 20.902 | 21.639 | 12.713 | 14.718 | 33.127 |
| HEMBA1001712 | 80.448 | 25.222 | 51.628 | 19.393 | 12.482 | 38.014 | 39.474 | 14.831 |
| HEMBA1001714 | 360.368 | 55.902 | 142.225 | 33.748 | 51.048 | 144.094 | 124.654 | 59.543 |
| HEMBA1001717 | 78.599 | 137.380 | 18.549 | 12.298 | 5.575 | 38.689 | 10.120 | 6.047 |
| HEMBA1001718 | 51.621 | 52.280 | 151.597 | 31.305 | 21.166 | 29.146 | 14.075 | 24.411 |
| HEMBA1001723 | 17.072 | 13.658 | 8.525 | 5.653 | 8.811 | 9.350 | 11.097 | 7.268 |
| HEMBA1001731 | 35.728 | 22.781 | 41.531 | 15.151 | 12.421 | 15.292 | 14.020 | 16.584 |
| HEMBA1001734 | 52.546 | 40.599 | 99.556 | 25.099 | 24.031 | 28.537 | 17.389 | 32.936 |
| HEMBA1001736 | 177.269 | 58.328 | 110.046 | 33.820 | 58.955 | 108.630 | 91.464 | 62.571 |
| HEMBA1001741 | 41.432 | 12.649 | 29.883 | 14.886 | 16.207 | 10.446 | 11.420 | 7.286 |
| HEMBA1001744 | 5.531 | 6.849 | 12.961 | 13.191 | 14.151 | 4.519 | 8.367 | 8.623 |
| HEMBA1001745 | 41.752 | 17.786 | 36.239 | 12.476 | 21.118 | 23.635 | 15.410 | 16.514 |
| HEMBA1001746 | 27.437 | 14.874 | 24.099 | 8.668 | 21.929 | 19.488 | 11.306 | 10.070 |
| HEMBA1001761 | 93.148 | 46.911 | 179.597 | 28.212 | 33.421 | 34.026 | 19.164 | 25.901 |
| HEMBA1001762 | 55.612 | 45.069 | 102.148 | 38.307 | 35.260 | 33.316 | 21.274 | 45.248 |
| HEMBA1001781 | 13.298 | 21.385 | 26.693 | 6.898 | 17.098 | 52.601 | 11.768 | 23.068 |
| HEMBA1001784 | 89.965 | 43.765 | 70.064 | 26.575 | 31.708 | 50.347 | 52.265 | 31.618 |
| HEMBA1001791 | 182.379 | 81.719 | 171.066 | 44.628 | 49.350 | 82.856 | 58.215 | 48.207 |
| HEMBA1001794 | 248.582 | 163.789 | 153.778 | 73.632 | 50.595 | 152.279 | 178.827 | 132.329 |
| HEMBA1001800 | 23.432 | 21.165 | 27.668 | 11.281 | 20.728 | 24.910 | 36.900 | 22.729 |
| HEMBA1001803 | 17.343 | 8.333 | 22.801 | 6.620 | 6.043 | 7.560 | 6.613 | 10.079 |
| HEMBA1001804 | 109.775 | 44.797 | 59.456 | 29.337 | 34.849 | 44.372 | 36.696 | 35.851 |
| HEMBA1001808 | 78.129 | 23.567 | 38.056 | 15.858 | 23.507 | 27.136 | 14.673 | 12.332 |
| HEMBA1001809 | 66.887 | 31.733 | 54.127 | 33.314 | 26.179 | 35.618 | 41.552 | 46.141 |
| HEMBA1001811 | 58.974 | 24.196 | 37.583 | 17.314 | 16.018 | 21.582 | 15.074 | 19.831 |
| HEMBA1001815 | 71.286 | 63.775 | 155.707 | 37.153 | 29.944 | 35.297 | 25.257 | 24.172 |
| HEMBA1001816 | 38.494 | 19.017 | 16.797 | 7.139 | 5.598 | 16.061 | 22.304 | 14.646 |
| HEMBA1001819 | 18.590 | 21.371 | 38.109 | 20.938 | 21.358 | 15.313 | 14.917 | 25.144 |
| HEMBA1001820 | 10.884 | 9.530 | 8.017 | 3.507 | 4.470 | 3.473 | 2.999 | 3.099 |
| HEMBA1001822 | 74.239 | 95.719 | 91.314 | 62.121 | 28.285 | 42.988 | 38.222 | 47.532 |
| HEMBA1001824 | 155.543 | 93.583 | 301.248 | 95.135 | 67.478 | 89.045 | 64.562 | 61.114 |
| HEMBA1001835 | 23.616 | 7.706 | 25.753 | 5.777 | 19.660 | 19.809 | 12.020 | 10.462 |
| HEMBA1001844 | 149.876 | 52.023 | 230.213 | 48.968 | 42.113 | 39.652 | 33.559 | 40.495 |
| HEMBA1001847 | 52.045 | 19.220 | 40.636 | 20.235 | 5.196 | 35.109 | 20.186 | 35.814 |
| HEMBA1001849 | 101.048 | 104.708 | 250.547 | 53.025 | 28.022 | 40.644 | 33.371 | 35.250 |
| HEMBA1001850 | 105.331 | 27.032 | 39.813 | 15.808 | 31.525 | 42.751 | 44.306 | 18.213 |
| HEMBA1001861 | 3.104 | 4.469 | 6.763 | 3.292 | 4.454 | 2.945 | 0.995 | 3.121 |
| HEMBA1001862 | 50.279 | 145.708 | 102.412 | 25.750 | 34.563 | 40.833 | 22.588 | 71.713 |
| HEMBA1001864 | 24.313 | 31.572 | 50.378 | 32.237 | 24.991 | 21.182 | 21.031 | 28.126 |
| HEMBA1001866 | 57.711 | 54.190 | 146.615 | 31.714 | 19.527 | 26.041 | 22.874 | 21.249 |
| HEMBA1001869 | 55.280 | 99.559 | 58.454 | 35.799 | 45.195 | 40.562 | 22.644 | 40.891 |
| HEMBA1001871 | 75.011 | 44.336 | 77.195 | 41.540 | 39.300 | 54.584 | 34.598 | 42.631 |
| HEMBA1001876 | 34.287 | 31.955 | 30.568 | 85.092 | 19.827 | 15.356 | 8.554 | 21.861 |
| HEMBA1001878 | 17.361 | 17.619 | 17.545 | 15.644 | 5.481 | 11.657 | 14.965 | 18.117 |
| HEMBA1001879 | 57.004 | 22.429 | 37.128 | 16.562 | 20.200 | 35.414 | 21.946 | 17.114 |
| HEMBA1001884 | 68.009 | 84.640 | 41.930 | 38.470 | 27.460 | 36.604 | 25.345 | 26.320 |
| HEMBA1001886 | 12.711 | 12.605 | 37.824 | 31.827 | 15.893 | 14.038 | 6.697 | 38.737 |
| HEMBA1001888 | 63.251 | 46.960 | 165.623 | 41.706 | 21.154 | 29.117 | 21.131 | 33.090 |

TABLE 13

| | | | | | | | | |
|---|---|---|---|---|---|---|---|---|
| HEMBA1001890 | 42.902 | 42.848 | 42.779 | 30.112 | 25.432 | 24.430 | 22.605 | 26.730 |
| HEMBA1001896 | 66.448 | 24.720 | 44.103 | 21.972 | 17.708 | 30.703 | 19.628 | 23.571 |

TABLE 13-continued

| | | | | | | | | |
|---|---|---|---|---|---|---|---|---|
| HEMBA1001899 | 36.251 | 25.553 | 24.121 | 14.701 | 12.301 | 21.838 | 17.455 | 20.813 |
| HEMBA1001904 | 54.904 | 256.020 | 233.857 | 243.646 | 55.587 | 234.548 | 188.571 | 526.744 |
| HEMBA1001910 | 40.309 | 10.865 | 13.738 | 11.244 | 8.226 | 15.367 | 15.894 | 13.300 |
| HEMBA1001911 | 35.962 | 23.128 | 26.357 | 25.151 | 11.860 | 24.224 | 22.870 | 18.238 |
| HEMBA1001912 | 59.924 | 66.966 | 97.679 | 51.180 | 45.903 | 33.336 | 33.019 | 40.551 |
| HEMBA1001913 | 175.368 | 39.664 | 67.432 | 33.132 | 26.376 | 63.459 | 70.607 | 52.824 |
| HEMBA1001915 | 14.756 | 14.666 | 30.224 | 8.295 | 7.629 | 17.718 | 6.737 | 8.522 |
| HEMBA1001918 | 5.018 | 8.961 | 27.591 | 7.538 | 11.032 | 8.265 | 4.852 | 4.772 |
| HEMBA1001921 | 4.431 | 8.444 | 18.196 | 11.252 | 12.587 | 7.417 | 7.668 | 2.769 |
| HEMBA1001931 | 3.948 | 0.000 | 4.664 | 1.422 | 3.480 | 2.935 | 1.127 | 2.898 |
| HEMBA1001939 | 94.821 | 24.679 | 81.706 | 24.209 | 16.692 | 37.223 | 29.835 | 13.058 |
| HEMBA1001940 | 54.512 | 33.931 | 145.138 | 26.273 | 27.653 | 18.649 | 13.136 | 19.614 |
| HEMBA1001942 | 38.572 | 16.710 | 32.402 | 18.718 | 14.782 | 25.435 | 26.410 | 16.143 |
| HEMBA1001944 | 210.898 | 71.197 | 96.883 | 48.156 | 38.533 | 82.132 | 92.097 | 74.740 |
| HEMBA1001945 | 31.531 | 17.019 | 14.533 | 10.175 | 3.037 | 17.421 | 12.222 | 11.694 |
| HEMBA1001950 | 7.103 | 7.424 | 9.611 | 3.281 | 4.091 | 7.632 | 5.310 | 4.044 |
| HEMBA1001951 | 46.024 | 19.234 | 101.026 | 19.207 | 13.212 | 23.714 | 20.006 | 19.402 |
| HEMBA1001958 | 44.554 | 12.806 | 35.277 | 17.321 | 13.181 | 22.652 | 28.735 | 20.948 |
| HEMBA1001960 | 20.513 | 7.802 | 16.888 | 8.822 | 2.948 | 8.826 | 10.834 | 12.935 |
| HEMBA1001962 | 4.367 | 5.104 | 4.205 | 2.811 | 3.031 | 4.870 | 2.364 | 2.994 |
| HEMBA1001964 | 35.944 | 22.281 | 62.761 | 18.757 | 6.663 | 17.775 | 8.068 | 8.601 |
| HEMBA1001967 | 47.345 | 29.504 | 42.717 | 13.526 | 22.051 | 33.555 | 23.601 | 37.521 |
| HEMBA1001979 | 35.138 | 6.478 | 16.732 | 12.797 | 5.919 | 13.447 | 10.355 | 9.155 |
| HEMBA1001987 | 60.083 | 52.275 | 190.331 | 45.735 | 24.898 | 26.381 | 17.514 | 28.891 |
| HEMBA1001991 | 111.286 | 79.833 | 276.566 | 56.455 | 50.862 | 50.789 | 40.252 | 54.919 |
| HEMBA1002003 | 66.389 | 23.989 | 53.710 | 17.039 | 17.174 | 30.547 | 28.422 | 24.474 |
| HEMBA1002005 | 86.885 | 41.457 | 150.127 | 33.935 | 15.339 | 24.541 | 24.237 | 27.345 |
| HEMBA1002008 | 32.101 | 25.375 | 86.511 | 18.349 | 8.912 | 7.593 | 18.519 | 14.967 |
| HEMBA1002018 | 66.105 | 22.380 | 36.174 | 16.334 | 21.482 | 27.922 | 34.098 | 27.804 |
| HEMBA1002022 | 13.986 | 8.018 | 13.490 | 0.000 | 2.985 | 5.730 | 6.036 | 1.433 |
| HEMBA1002029 | 132.547 | 305.823 | 115.974 | 144.692 | 70.087 | 74.071 | 37.046 | 204.730 |
| HEMBA1002030 | 17.077 | 10.337 | 14.524 | 5.906 | 8.466 | 5.897 | 6.258 | 6.824 |
| HEMBA1002035 | 48.658 | 12.959 | 10.324 | 14.325 | 7.176 | 14.446 | 14.084 | 13.506 |
| HEMBA1002037 | 16.343 | 34.097 | 27.567 | 14.451 | 12.568 | 15.087 | 13.819 | 12.140 |
| HEMBA1002038 | 68.477 | 31.733 | 91.391 | 16.935 | 8.370 | 6.020 | 17.500 | 19.367 |
| HEMBA1002039 | 15.944 | 22.707 | 17.807 | 13.914 | 7.910 | 3.306 | 4.716 | 11.003 |
| HEMBA1002042 | 41.657 | 27.877 | 32.654 | 21.111 | 14.815 | 10.217 | 24.300 | 22.659 |
| HEMBA1002043 | 149.364 | 92.912 | 208.642 | 70.906 | 53.861 | 84.089 | 81.242 | 61.829 |
| HEMBA1002048 | 137.253 | 29.889 | 60.279 | 19.894 | 21.605 | 66.594 | 55.483 | 30.137 |
| HEMBA1002049 | 98.417 | 84.099 | 271.170 | 63.157 | 87.434 | 48.247 | 39.557 | 53.676 |
| HEMBA1002053 | 33.636 | 19.194 | 25.821 | 11.890 | 16.358 | 16.441 | 25.376 | 27.152 |
| HEMBA1002055 | 67.115 | 34.916 | 39.511 | 37.518 | 17.449 | 25.297 | 28.606 | 39.067 |
| HEMBA1002056 | 13.684 | 12.039 | 16.129 | 14.136 | 1.311 | 8.564 | 4.481 | 12.538 |
| HEMBA1002061 | 11.815 | 14.960 | 29.478 | 10.168 | 10.973 | 11.179 | 9.701 | 8.124 |
| HEMBA1002080 | 59.350 | 80.319 | 81.497 | 43.371 | 72.416 | 39.904 | 45.653 | 53.581 |
| HEMBA1002084 | 11.331 | 7.502 | 15.981 | 7.301 | 10.773 | 13.652 | 6.835 | 5.555 |
| HEMBA1002085 | 69.868 | 62.174 | 111.196 | 13.760 | 19.083 | 101.175 | 43.117 | 14.011 |
| HEMBA1002092 | 127.409 | 33.016 | 60.924 | 24.219 | 32.654 | 72.141 | 50.433 | 27.770 |
| HEMBA1002098 | 34.645 | 16.695 | 25.357 | 15.741 | 15.632 | 18.082 | 12.882 | 20.451 |
| HEMBA1002100 | 118.301 | 90.733 | 129.453 | 60.276 | 41.079 | 89.713 | 44.294 | 67.352 |
| HEMBA1002101 | 57.160 | 69.427 | 106.418 | 34.067 | 32.565 | 38.238 | 15.932 | 74.139 |
| HEMBA1002102 | 104.746 | 76.058 | 178.766 | 45.801 | 50.114 | 53.399 | 40.628 | 54.459 |
| HEMBA1002105 | 35.380 | 25.812 | 31.300 | 14.131 | 14.867 | 29.842 | 22.894 | 23.960 |
| HEMBA1002107 | 62.621 | 45.738 | 65.486 | 28.199 | 31.808 | 52.057 | 163.850 | 77.437 |
| HEMBA1002113 | 745.018 | 396.517 | 1335.986 | 321.385 | 369.500 | 391.825 | 236.013 | 348.025 |
| HEMBA1002119 | 35.812 | 23.546 | 72.351 | 18.292 | 19.991 | 18.086 | 26.533 | 25.611 |
| HEMBA1002125 | 42.106 | 14.033 | 45.440 | 15.858 | 20.474 | 47.217 | 28.894 | 33.563 |
| HEMBA1002131 | 84.269 | 29.512 | 46.944 | 12.807 | 29.311 | 40.381 | 49.691 | 37.106 |
| HEMBA1002133 | 37.736 | 19.103 | 27.034 | 45.990 | 11.161 | 21.694 | 20.410 | 24.305 |
| HEMBA1002139 | 25.756 | 10.925 | 20.941 | 4.978 | 11.839 | 9.451 | 7.795 | 9.431 |
| HEMBA1002141 | 20.036 | 14.349 | 19.713 | 9.608 | 3.638 | 14.521 | 10.225 | 10.190 |
| HEMBA1002144 | 86.896 | 68.335 | 193.756 | 56.749 | 45.612 | 36.918 | 23.020 | 39.262 |

TABLE 14

| | | | | | | | | |
|---|---|---|---|---|---|---|---|---|
| HEMBA1002147 | 135.045 | 48.848 | 87.208 | 42.412 | 46.318 | 67.257 | 83.313 | 45.988 |
| HEMBA1002150 | 347.113 | 89.434 | 182.502 | 48.715 | 86.270 | 215.282 | 234.394 | 85.507 |
| HEMBA1002151 | 60.410 | 19.140 | 11.868 | 10.122 | 7.938 | 26.996 | 19.485 | 14.196 |
| HEMBA1002153 | 32.258 | 25.478 | 35.746 | 20.325 | 25.638 | 15.972 | 26.019 | 19.827 |
| HEMBA1002156 | 118.226 | 31.167 | 44.382 | 21.446 | 21.743 | 47.426 | 40.620 | 16.858 |
| HEMBA1002160 | 166.654 | 114.853 | 336.241 | 90.651 | 71.047 | 63.857 | 41.633 | 55.419 |
| HEMBA1002161 | 72.851 | 68.019 | 132.156 | 42.302 | 37.035 | 29.438 | 49.436 | 41.818 |
| HEMBA1002162 | 122.516 | 62.989 | 307.464 | 68.589 | 51.141 | 55.242 | 37.823 | 54.952 |
| HEMBA1002163 | 49.889 | 43.602 | 64.932 | 20.426 | 7.151 | 0.000 | 30.979 | 32.578 |
| HEMBA1002164 | 110.221 | 59.044 | 71.408 | 32.652 | 19.476 | 39.440 | 43.639 | 52.404 |
| HEMBA1002166 | 312.686 | 256.137 | 768.834 | 194.638 | 171.071 | 159.271 | 134.442 | 213.993 |

TABLE 14-continued

| | | | | | | | | |
|---|---|---|---|---|---|---|---|---|
| HEMBA1002167 | 139.053 | 18.430 | 69.693 | 11.057 | 30.091 | 50.202 | 48.620 | 13.648 |
| HEMBA1002173 | 137.562 | 47.918 | 197.006 | 36.833 | 26.164 | 29.478 | 20.169 | 23.078 |
| HEMBA1002177 | 100.895 | 25.141 | 41.676 | 25.857 | 17.903 | 28.153 | 22.687 | 14.081 |
| HEMBA1002178 | 102.831 | 19.500 | 46.717 | 13.290 | 32.323 | 37.856 | 44.115 | 27.390 |
| HEMBA1002179 | 55.617 | 56.403 | 85.686 | 45.680 | 26.918 | 60.684 | 59.110 | 64.849 |
| HEMBA1002185 | 85.236 | 71.958 | 212.844 | 43.915 | 27.049 | 32.172 | 22.480 | 32.386 |
| HEMBA1002188 | 79.413 | 28.280 | 31.826 | 23.275 | 21.094 | 33.295 | 36.478 | 18.236 |
| HEMBA1002189 | 56.349 | 70.609 | 148.011 | 47.092 | 32.460 | 30.101 | 34.751 | 30.532 |
| HEMBA1002191 | 149.027 | 80.765 | 149.493 | 49.599 | 42.372 | 60.095 | 35.614 | 44.348 |
| HEMBA1002192 | 15.125 | 24.996 | 24.821 | 15.373 | 16.495 | 12.778 | 5.075 | 13.566 |
| HEMBA1002195 | 57.368 | 28.635 | 52.828 | 16.254 | 22.600 | 31.843 | 32.995 | 29.791 |
| HEMBA1002196 | 14.884 | 12.040 | 36.633 | 16.632 | 15.443 | 16.808 | 12.691 | 17.451 |
| HEMBA1002199 | 24.937 | 13.539 | 27.878 | 15.728 | 17.426 | 10.639 | 19.664 | 8.927 |
| HEMBA1002204 | 9.525 | 5.141 | 14.869 | 6.784 | 4.619 | 10.508 | 27.818 | 9.410 |
| HEMBA1002208 | 80.832 | 44.154 | 68.317 | 68.994 | 37.453 | 74.064 | 81.827 | 112.820 |
| HEMBA1002212 | 8.709 | 6.241 | 10.946 | 9.855 | 2.602 | 5.864 | 5.366 | 4.214 |
| HEMBA1002215 | 36.521 | 28.098 | 31.165 | 19.157 | 20.170 | 17.045 | 19.124 | 21.605 |
| HEMBA1002217 | 50.834 | 62.759 | 64.668 | 59.460 | 28.990 | 37.379 | 29.963 | 64.813 |
| HEMBA1002220 | 27.731 | 14.997 | 21.655 | 8.451 | 6.409 | 5.663 | 1.641 | 6.714 |
| HEMBA1002226 | 91.222 | 113.507 | 269.906 | 85.183 | 68.283 | 59.461 | 56.996 | 78.924 |
| HEMBA1002227 | 55.957 | 91.527 | 79.169 | 45.309 | 54.892 | 28.856 | 14.142 | 101.597 |
| HEMBA1002229 | 170.518 | 117.589 | 418.739 | 112.916 | 121.703 | 85.889 | 63.450 | 90.668 |
| HEMBA1002237 | 47.252 | 49.329 | 124.721 | 32.838 | 24.807 | 23.399 | 15.399 | 26.185 |
| HEMBA1002239 | 103.363 | 107.010 | 190.830 | 54.740 | 72.381 | 50.451 | 45.873 | 70.581 |
| HEMBA1002241 | 70.729 | 45.281 | 81.541 | 43.824 | 30.449 | 54.328 | 62.401 | 55.767 |
| HEMBA1002253 | 25.559 | 27.877 | 35.744 | 16.605 | 13.851 | 18.938 | 18.391 | 14.286 |
| HEMBA1002257 | 6.344 | 5.787 | 15.404 | 4.338 | 1.225 | 7.119 | 4.456 | 3.711 |
| HEMBA1002259 | 48.436 | 19.578 | 38.228 | 12.875 | 21.884 | 23.928 | 18.619 | 17.988 |
| HEMBA1002262 | 271.029 | 219.564 | 645.284 | 192.491 | 147.403 | 112.552 | 83.057 | 137.280 |
| HEMBA1002265 | 56.947 | 30.786 | 32.747 | 24.827 | 15.078 | 28.043 | 29.609 | 27.237 |
| HEMBA1002267 | 108.413 | 102.522 | 243.566 | 58.776 | 30.097 | 53.750 | 24.099 | 29.752 |
| HEMBA1002270 | 51.540 | 26.396 | 27.766 | 20.313 | 15.579 | 28.348 | 19.144 | 16.695 |
| HEMBA1002286 | 44.897 | 17.027 | 19.776 | 11.608 | 10.900 | 25.959 | 14.425 | 10.031 |
| HEMBA1002290 | 46.449 | 29.289 | 34.095 | 19.879 | 8.778 | 26.461 | 22.368 | 13.907 |
| HEMBA1002302 | 152.883 | 48.105 | 92.158 | 43.064 | 48.204 | 66.899 | 80.872 | 58.027 |
| HEMBA1002304 | 6.050 | 6.814 | 19.492 | 7.905 | 4.038 | 7.098 | 5.307 | 1.737 |
| HEMBA1002307 | 100.402 | 132.737 | 29.225 | 24.612 | 24.050 | 42.355 | 39.076 | 37.573 |
| HEMBA1002316 | 504.772 | 93.620 | 191.534 | 46.814 | 134.386 | 238.599 | 265.167 | 88.087 |
| HEMBA1002319 | 2.868 | 2.456 | 9.670 | 0.933 | 4.715 | 4.369 | 5.615 | 4.579 |
| HEMBA1002320 | 10.783 | 7.936 | 12.646 | 4.775 | 10.008 | 4.330 | 5.128 | 3.630 |
| HEMBA1002321 | 10.743 | 9.992 | 10.165 | 4.549 | 2.547 | 7.952 | 4.048 | 5.700 |
| HEMBA1002328 | 89.382 | 28.578 | 41.753 | 17.175 | 20.280 | 46.772 | 34.722 | 18.301 |
| HEMBA1002333 | 63.542 | 21.208 | 32.148 | 11.559 | 15.490 | 29.410 | 33.449 | 21.452 |
| HEMBA1002337 | 93.059 | 61.863 | 189.067 | 60.545 | 43.745 | 40.085 | 13.954 | 34.456 |
| HEMBA1002339 | 354.195 | 154.586 | 211.807 | 141.794 | 124.733 | 173.522 | 284.831 | 192.502 |
| HEMBA1002341 | 116.488 | 29.538 | 63.800 | 15.812 | 36.228 | 50.321 | 45.600 | 28.278 |
| HEMBA1002348 | 6.882 | 4.859 | 18.593 | 4.056 | 4.011 | 5.790 | 4.476 | 4.606 |
| HEMBA1002349 | 6.318 | 7.600 | 13.603 | 5.490 | 2.590 | 6.088 | 1.306 | 3.748 |
| HEMBA1002353 | 14.497 | 13.001 | 12.249 | 10.426 | 11.840 | 13.977 | 17.141 | 16.760 |
| HEMBA1002356 | 104.283 | 29.278 | 40.945 | 24.892 | 20.681 | 42.242 | 45.108 | 28.190 |
| HEMBA1002357 | 64.855 | 251.508 | 219.532 | 215.420 | 68.836 | 206.728 | 136.339 | 380.371 |
| HEMBA1002360 | 87.281 | 64.882 | 77.475 | 30.773 | 56.108 | 61.060 | 59.371 | 56.291 |
| HEMBA1002363 | 71.449 | 51.764 | 63.278 | 52.711 | 43.280 | 33.755 | 31.248 | 49.484 |

TABLE 15

| | | | | | | | | |
|---|---|---|---|---|---|---|---|---|
| HEMBA1002365 | 13.435 | 10.346 | 9.534 | 5.175 | 9.470 | 4.446 | 10.802 | 9.325 |
| HEMBA1002370 | 29.997 | 4.107 | 11.054 | 4.163 | 3.224 | 9.009 | 7.477 | 2.921 |
| HEMBA1002374 | 91.498 | 18.475 | 11.325 | 15.862 | 10.204 | 18.275 | 29.203 | 18.856 |
| HEMBA1002376 | 186.416 | 75.425 | 127.578 | 52.056 | 38.450 | 99.590 | 90.190 | 86.994 |
| HEMBA1002377 | 81.350 | 41.908 | 63.893 | 37.221 | 23.657 | 110.374 | 162.166 | 50.770 |
| HEMBA1002380 | 189.521 | 137.466 | 477.021 | 137.908 | 491.500 | 90.431 | 81.778 | 127.767 |
| HEMBA1002381 | 195.037 | 101.891 | 447.953 | 125.938 | 88.330 | 90.756 | 70.293 | 106.965 |
| HEMBA1002384 | 35.247 | 22.319 | 42.496 | 14.694 | 19.780 | 40.126 | 24.243 | 12.399 |
| HEMBA1002389 | 44.796 | 8.467 | 36.790 | 11.793 | 9.362 | 18.736 | 15.497 | 20.728 |
| HEMBA1002396 | 101.267 | 69.467 | 33.025 | 16.553 | 26.429 | 25.964 | 22.294 | 23.666 |
| HEMBA1002402 | 75.818 | 24.148 | 28.457 | 8.848 | 9.913 | 21.219 | 16.569 | 22.818 |
| HEMBA1002417 | 132.807 | 33.708 | 84.436 | 22.910 | 38.826 | 58.589 | 58.836 | 38.486 |
| HEMBA1002419 | 75.547 | 31.202 | 41.690 | 13.558 | 16.457 | 27.281 | 19.705 | 13.013 |
| HEMBA1002420 | 20.818 | 20.448 | 35.559 | 17.034 | 13.878 | 23.652 | 14.721 | 24.637 |
| HEMBA1002421 | 23.903 | 25.285 | 59.023 | 7.957 | 14.189 | 24.230 | 61.011 | 21.849 |
| HEMBA1002423 | 12.762 | 11.755 | 25.941 | 12.938 | 14.177 | 14.263 | 12.495 | 7.512 |
| HEMBA1002424 | 111.995 | 32.293 | 46.657 | 24.424 | 25.667 | 42.797 | 41.513 | 31.249 |
| HEMBA1002426 | 60.617 | 23.489 | 45.906 | 20.305 | 25.173 | 30.860 | 37.738 | 21.223 |
| HEMBA1002430 | 24.143 | 3.128 | 4.900 | 1.517 | 4.594 | 3.316 | 8.552 | 3.069 |
| HEMBA1002439 | 59.808 | 37.476 | 93.025 | 16.789 | 23.324 | 47.857 | 33.099 | 27.888 |

TABLE 15-continued

| | | | | | | | | |
|---|---|---|---|---|---|---|---|---|
| HEMBA1002441 | 77.869 | 99.262 | 110.341 | 38.723 | 34.562 | 65.309 | 85.421 | 66.581 |
| HEMBA1002454 | 58.292 | 15.281 | 38.384 | 7.520 | 19.044 | 25.972 | 22.845 | 22.015 |
| HEMBA1002458 | 57.329 | 46.103 | 101.242 | 30.906 | 82.184 | 61.800 | 26.094 | 59.039 |
| HEMBA1002460 | 32.814 | 9.205 | 25.085 | 12.160 | 23.009 | 18.683 | 14.678 | 14.249 |
| HEMBA1002462 | 98.420 | 38.135 | 55.208 | 10.919 | 24.257 | 49.697 | 43.851 | 32.387 |
| HEMBA1002465 | 11.819 | 15.260 | 28.272 | 11.939 | 11.225 | 10.938 | 13.593 | 20.635 |
| HEMBA1002469 | 129.538 | 61.348 | 120.187 | 39.999 | 39.213 | 76.320 | 69.012 | 86.309 |
| HEMBA1002475 | 3.180 | 5.116 | 4.323 | 2.230 | 1.467 | 4.495 | 10.058 | 15.691 |
| HEMBA1002477 | 93.696 | 64.730 | 238.114 | 55.207 | 43.349 | 42.487 | 29.532 | 52.786 |
| HEMBA1002480 | 210.023 | 58.823 | 84.566 | 37.478 | 45.060 | 106.554 | 97.791 | 70.487 |
| HEMBA1002481 | 104.499 | 76.474 | 222.903 | 71.502 | 68.097 | 67.421 | 42.334 | 82.875 |
| HEMBA1002486 | 81.465 | 42.269 | 169.291 | 49.953 | 40.852 | 39.475 | 29.153 | 26.233 |
| HEMBA1002490 | 66.695 | 11.331 | 31.314 | 14.602 | 25.852 | 35.945 | 35.954 | 15.278 |
| HEMBA1002495 | 59.387 | 12.315 | 25.235 | 7.937 | 4.091 | 17.402 | 14.269 | 10.773 |
| HEMBA1002498 | 56.425 | 23.969 | 67.108 | 11.632 | 15.655 | 24.420 | 8.272 | 12.219 |
| HEMBA1002501 | 40.955 | 16.994 | 22.074 | 13.575 | 16.498 | 21.707 | 39.506 | 24.619 |
| HEMBA1002503 | 81.763 | 65.044 | 154.595 | 39.638 | 33.778 | 31.214 | 32.219 | 26.800 |
| HEMBA1002504 | 155.357 | 95.219 | 279.391 | 90.092 | 120.246 | 70.516 | 52.190 | 53.323 |
| HEMBA1002508 | 99.443 | 88.234 | 259.961 | 107.085 | 79.039 | 59.181 | 59.924 | 61.423 |
| HEMBA1002513 | 50.560 | 22.902 | 30.431 | 26.184 | 20.783 | 30.500 | 32.903 | 22.864 |
| HEMBA1002515 | 60.938 | 23.064 | 25.098 | 16.172 | 5.716 | 20.264 | 20.643 | 13.727 |
| HEMBA1002524 | 94.350 | 36.789 | 56.675 | 25.998 | 28.978 | 49.840 | 57.148 | 25.205 |
| HEMBA1002538 | 116.609 | 19.632 | 26.764 | 12.798 | 20.203 | 16.422 | 17.588 | 15.759 |
| HEMBA1002542 | 81.641 | 81.952 | 188.888 | 54.986 | 41.864 | 32.890 | 30.719 | 38.321 |
| HEMBA1002544 | 52.394 | 49.175 | 98.415 | 47.569 | 28.375 | 28.766 | 20.948 | 21.614 |
| HEMBA1002546 | 76.538 | 62.763 | 156.051 | 47.625 | 74.374 | 45.975 | 34.756 | 46.753 |
| HEMBA1002547 | 11.448 | 4.516 | 10.647 | 4.733 | 12.220 | 11.801 | 9.959 | 7.127 |
| HEMBA1002550 | 67.373 | 39.322 | 48.468 | 15.671 | 16.497 | 121.814 | 94.586 | 25.401 |
| HEMBA1002551 | 94.391 | 14.109 | 27.085 | 11.976 | 8.787 | 41.811 | 16.656 | 18.665 |
| HEMBA1002552 | 204.583 | 77.430 | 205.444 | 49.448 | 44.756 | 67.408 | 63.216 | 57.684 |
| HEMBA1002555 | 25.583 | 16.987 | 6.743 | 7.020 | 5.608 | 14.795 | 10.111 | 7.416 |
| HEMBA1002558 | 92.744 | 77.405 | 245.703 | 59.079 | 41.247 | 33.253 | 41.617 | 41.270 |
| HEMBA1002561 | 53.810 | 51.725 | 155.895 | 34.956 | 27.689 | 17.264 | 10.138 | 27.124 |
| HEMBA1002562 | 15.261 | 10.822 | 15.435 | 8.259 | 18.723 | 12.036 | 9.056 | 10.429 |
| HEMBA1002568 | 24.946 | 17.442 | 35.354 | 17.552 | 10.576 | 15.262 | 16.158 | 22.328 |
| HEMBA1002569 | 112.340 | 34.133 | 118.192 | 37.823 | 57.431 | 54.936 | 26.164 | 27.309 |
| HEMBA1002570 | 43.528 | 50.809 | 52.195 | 34.901 | 23.728 | 28.874 | 9.812 | 50.494 |
| HEMBA1002574 | 106.101 | 25.148 | 46.793 | 16.369 | 26.322 | 57.278 | 42.795 | 31.310 |
| HEMBA1002583 | 36.042 | 17.582 | 15.178 | 12.456 | 13.418 | 20.158 | 16.837 | 16.418 |
| HEMBA1002587 | 61.527 | 32.123 | 45.811 | 22.217 | 18.974 | 32.461 | 40.250 | 39.915 |
| HEMBA1002590 | 151.583 | 106.074 | 287.276 | 84.766 | 32.321 | 58.221 | 38.642 | 53.855 |
| HEMBA1002592 | 97.854 | 85.949 | 220.496 | 89.335 | 52.684 | 53.653 | 35.724 | 57.578 |
| HEMBA1002595 | 146.016 | 25.688 | 60.427 | 24.156 | 31.909 | 86.770 | 79.174 | 26.760 |
| HEMBA1002609 | 97.442 | 41.926 | 56.054 | 29.427 | 35.650 | 35.839 | 44.688 | 47.074 |

TABLE 16

| | | | | | | | | |
|---|---|---|---|---|---|---|---|---|
| HEMBA1002617 | 26.792 | 86.617 | 59.446 | 73.277 | 12.909 | 21.055 | 16.612 | 49.136 |
| HEMBA1002619 | 101.131 | 25.998 | 30.959 | 15.921 | 21.913 | 40.814 | 35.003 | 28.108 |
| HEMBA1002621 | 14.592 | 25.845 | 18.082 | 8.927 | 7.391 | 8.869 | 5.823 | 12.283 |
| HEMBA1002624 | 254.635 | 42.837 | 73.568 | 48.036 | 71.673 | 113.228 | 101.786 | 53.514 |
| HEMBA1002628 | 13.044 | 21.509 | 23.649 | 9.956 | 16.559 | 10.257 | 7.527 | 11.624 |
| HEMBA1002629 | 32.199 | 16.370 | 29.306 | 15.884 | 5.722 | 15.410 | 42.964 | 19.680 |
| HEMBA1002632 | 55.206 | 48.044 | 90.986 | 36.904 | 27.840 | 28.811 | 37.912 | 40.048 |
| HEMBA1002645 | 95.909 | 89.897 | 220.184 | 68.171 | 48.643 | 56.847 | 41.355 | 59.667 |
| HEMBA1002651 | 39.882 | 27.730 | 33.313 | 16.958 | 11.617 | 23.904 | 29.214 | 16.599 |
| HEMBA1002652 | 107.869 | 24.187 | 46.646 | 22.248 | 22.950 | 37.216 | 25.827 | 23.282 |
| HEMBA1002659 | 133.320 | 62.916 | 259.854 | 57.860 | 53.172 | 46.511 | 45.193 | 47.291 |
| HEMBA1002661 | 88.495 | 68.014 | 154.170 | 35.196 | 22.499 | 26.290 | 22.314 | 23.727 |
| HEMBA1002666 | 34.174 | 20.511 | 39.391 | 17.036 | 15.852 | 20.842 | 19.202 | 13.470 |
| HEMBA1002667 | 155.384 | 166.244 | 164.658 | 29.523 | 520.013 | 30.234 | 25.612 | 83.769 |
| HEMBA1002673 | 71.650 | 40.718 | 73.822 | 33.403 | 39.914 | 40.129 | 38.619 | 22.532 |
| HEMBA1002678 | 161.681 | 89.986 | 247.534 | 84.722 | 54.176 | 46.941 | 61.944 | 77.085 |
| HEMBA1002679 | 56.416 | 61.838 | 66.537 | 37.679 | 18.172 | 29.420 | 38.238 | 44.113 |
| HEMBA1002688 | 6.756 | 3.364 | 5.387 | 3.816 | 1.793 | 4.608 | 3.600 | 2.944 |
| HEMBA1002696 | 49.639 | 17.555 | 29.241 | 14.788 | 12.463 | 31.752 | 34.100 | 14.772 |
| HEMBA1002703 | 185.328 | 96.718 | 97.793 | 54.473 | 50.688 | 113.980 | 87.727 | 59.878 |
| HEMBA1002706 | 49.533 | 30.340 | 35.679 | 18.469 | 19.118 | 26.777 | 29.277 | 29.224 |
| HEMBA1002712 | 52.878 | 59.111 | 110.506 | 41.591 | 43.597 | 39.604 | 30.872 | 26.457 |
| HEMBA1002715 | 149.045 | 59.858 | 87.643 | 47.473 | 41.264 | 95.279 | 127.808 | 65.580 |
| HEMBA1002716 | 23.142 | 6.155 | 17.077 | 15.783 | 23.557 | 19.064 | 27.647 | 7.572 |
| HEMBA1002718 | 26.328 | 19.063 | 41.749 | 26.345 | 16.735 | 28.367 | 26.822 | 21.779 |
| HEMBA1002728 | 117.984 | 88.950 | 293.019 | 81.290 | 43.679 | 65.830 | 46.321 | 57.003 |
| HEMBA1002730 | 131.726 | 26.862 | 67.877 | 28.628 | 36.686 | 49.987 | 50.380 | 43.208 |
| HEMBA1002734 | 77.679 | 26.481 | 34.604 | 21.128 | 21.756 | 41.413 | 60.057 | 45.992 |
| HEMBA1002742 | 10.730 | 11.276 | 12.768 | 7.910 | 1.394 | 8.502 | 8.297 | 10.909 |

TABLE 16-continued

| | | | | | | | | |
|---|---|---|---|---|---|---|---|---|
| HEMBA1002746 | 60.876 | 22.803 | 35.400 | 15.830 | 15.630 | 30.605 | 31.889 | 32.759 |
| HEMBA1002748 | 76.748 | 26.130 | 38.669 | 17.760 | 32.833 | 43.493 | 53.440 | 49.691 |
| HEMBA1002750 | 40.663 | 45.306 | 95.205 | 18.200 | 10.037 | 22.527 | 29.331 | 30.774 |
| HEMBA1002755 | 94.758 | 62.505 | 220.964 | 63.414 | 37.572 | 44.593 | 28.497 | 39.737 |
| HEMBA1002759 | 13.935 | 3.117 | 8.450 | 3.792 | 2.291 | 8.714 | 10.261 | 5.285 |
| HEMBA1002763 | 430.941 | 88.931 | 172.920 | 71.623 | 88.921 | 195.471 | 197.995 | 118.224 |
| HEMBA1002767 | 65.682 | 25.272 | 35.782 | 14.035 | 19.183 | 31.497 | 33.393 | 18.347 |
| HEMBA1002768 | 100.803 | 57.554 | 59.457 | 35.570 | 28.006 | 43.770 | 40.930 | 38.215 |
| HEMBA1002769 | 103.210 | 30.236 | 54.098 | 17.099 | 19.753 | 35.636 | 41.922 | 26.940 |
| HEMBA1002770 | 20.350 | 16.268 | 28.054 | 21.736 | 10.754 | 12.030 | 14.991 | 11.776 |
| HEMBA1002777 | 130.615 | 37.655 | 72.072 | 41.794 | 31.219 | 54.881 | 59.342 | 43.652 |
| HEMBA1002779 | 97.457 | 29.259 | 75.705 | 22.719 | 22.643 | 33.689 | 38.357 | 27.804 |
| HEMBA1002780 | 72.338 | 50.411 | 181.356 | 42.070 | 19.957 | 31.370 | 27.642 | 39.672 |
| HEMBA1002790 | 87.371 | 61.291 | 152.514 | 38.033 | 29.616 | 28.032 | 20.352 | 34.761 |
| HEMBA1002794 | 202.405 | 77.515 | 95.182 | 31.252 | 41.834 | 100.167 | 80.301 | 50.036 |
| HEMBA1002798 | 9.194 | 21.334 | 22.468 | 20.281 | 12.823 | 11.156 | 11.647 | 15.735 |
| HEMBA1002801 | 10.311 | 4.603 | 11.704 | 3.190 | 4.420 | 3.016 | 13.829 | 6.693 |
| HEMBA1002810 | 42.583 | 45.313 | 55.088 | 35.416 | 29.480 | 60.935 | 44.046 | 51.794 |
| HEMBA1002816 | 52.084 | 37.823 | 56.994 | 35.902 | 25.574 | 33.389 | 50.974 | 49.045 |
| HEMBA1002818 | 321.516 | 100.826 | 187.799 | 84.893 | 81.695 | 152.339 | 171.186 | 117.409 |
| HEMBA1002820 | 139.924 | 107.278 | 533.137 | 90.533 | 79.745 | 59.869 | 54.302 | 52.958 |
| HEMBA1002826 | 40.776 | 6.495 | 16.825 | 5.349 | 3.319 | 11.765 | 7.355 | 8.363 |
| HEMBA1002833 | 119.102 | 44.248 | 40.839 | 17.864 | 23.748 | 44.398 | 57.302 | 36.668 |
| HEMBA1002850 | 5.941 | 8.407 | 13.251 | 6.179 | 2.932 | 4.352 | 4.844 | 3.735 |
| HEMBA1002862 | 60.735 | 32.524 | 30.030 | 9.693 | 9.527 | 27.595 | 19.397 | 18.101 |
| HEMBA1002863 | 77.126 | 30.401 | 44.872 | 22.577 | 28.639 | 50.264 | 55.374 | 45.005 |
| HEMBA1002867 | 25.385 | 13.583 | 42.122 | 15.283 | 9.501 | 22.992 | 15.180 | 16.196 |
| HEMBA1002876 | 101.249 | 55.603 | 38.073 | 36.480 | 23.017 | 53.318 | 51.363 | 56.689 |
| HEMBA1002886 | 9.474 | 14.188 | 23.688 | 7.657 | 11.980 | 14.640 | 6.432 | 18.574 |
| HEMBA1002896 | 78.580 | 27.420 | 49.774 | 16.754 | 20.366 | 36.684 | 35.283 | 42.662 |
| HEMBA1002913 | 126.001 | 32.845 | 58.138 | 14.590 | 22.846 | 54.873 | 56.608 | 38.801 |
| HEMBA1002921 | 63.378 | 25.443 | 37.615 | 15.333 | 19.054 | 28.881 | 37.595 | 34.298 |
| HEMBA1002924 | 65.007 | 29.109 | 104.125 | 15.411 | 19.920 | 31.099 | 23.998 | 19.182 |
| HEMBA1002934 | 432.841 | 308.291 | 644.522 | 180.470 | 145.293 | 273.733 | 166.153 | 242.809 |
| HEMBA1002935 | 92.005 | 52.184 | 221.722 | 49.477 | 41.867 | 34.331 | 29.646 | 38.889 |

TABLE 17

| | | | | | | | | |
|---|---|---|---|---|---|---|---|---|
| HEMBA1002937 | 38.698 | 30.844 | 33.817 | 12.784 | 18.251 | 14.107 | 24.131 | 18.662 |
| HEMBA1002939 | 39.755 | 22.867 | 33.838 | 19.077 | 13.734 | 19.266 | 17.364 | 17.750 |
| HEMBA1002944 | 53.762 | 33.349 | 51.861 | 21.860 | 18.241 | 23.920 | 21.112 | 16.286 |
| HEMBA1002951 | 38.716 | 29.783 | 39.196 | 19.808 | 29.614 | 19.702 | 28.422 | 21.177 |
| HEMBA1002954 | 24.907 | 8.542 | 20.941 | 9.265 | 13.758 | 15.056 | 7.297 | 13.424 |
| HEMBA1002962 | 86.680 | 62.578 | 220.246 | 62.027 | 37.753 | 44.037 | 31.812 | 41.725 |
| HEMBA1002968 | 105.871 | 78.850 | 221.414 | 65.545 | 40.380 | 43.093 | 38.816 | 50.281 |
| HEMBA1002970 | 48.034 | 34.741 | 30.834 | 18.482 | 6.639 | 17.125 | 23.514 | 36.180 |
| HEMBA1002971 | 39.492 | 44.145 | 35.618 | 25.614 | 12.932 | 25.193 | 14.823 | 23.202 |
| HEMBA1002973 | 83.710 | 70.965 | 156.167 | 43.307 | 28.902 | 29.947 | 26.101 | 34.769 |
| HEMBA1002978 | 35.833 | 19.362 | 27.056 | 13.075 | 20.398 | 11.324 | 16.059 | 13.956 |
| HEMBA1002981 | 107.112 | 35.200 | 56.576 | 23.695 | 26.105 | 33.054 | 37.119 | 21.249 |
| HEMBA1002985 | 79.217 | 44.154 | 116.532 | 27.950 | 26.158 | 37.462 | 28.927 | 20.335 |
| HEMBA1002986 | 61.056 | 78.203 | 68.834 | 49.967 | 64.529 | 38.333 | 28.919 | 20.529 |
| HEMBA1002988 | 37.307 | 36.609 | 71.802 | 20.621 | 8.965 | 16.229 | 15.956 | 22.796 |
| HEMBA1002992 | 97.720 | 72.656 | 79.841 | 50.454 | 34.289 | 57.004 | 61.291 | 91.211 |
| HEMBA1002995 | 51.473 | 63.779 | 55.081 | 36.903 | 25.007 | 38.630 | 19.510 | 48.529 |
| HEMBA1002997 | 41.734 | 70.805 | 29.264 | 27.019 | 33.664 | 24.201 | 18.442 | 25.973 |
| HEMBA1002999 | 35.341 | 16.456 | 18.357 | 11.146 | 7.034 | 12.086 | 13.966 | 9.970 |
| HEMBA1003004 | 55.654 | 33.689 | 35.194 | 15.119 | 16.204 | 20.866 | 27.891 | 20.055 |
| HEMBA1003006 | 40.682 | 24.886 | 20.750 | 20.903 | 26.595 | 25.445 | 20.310 | 20.924 |
| HEMBA1003008 | 29.269 | 20.922 | 74.697 | 25.061 | 17.787 | 10.271 | 5.688 | 12.638 |
| HEMBA1003021 | 130.889 | 123.646 | 311.225 | 101.957 | 95.443 | 64.844 | 60.969 | 90.296 |
| HEMBA1003027 | 54.935 | 32.610 | 44.710 | 18.890 | 52.131 | 26.286 | 28.112 | 31.561 |
| HEMBA1003029 | 33.333 | 42.436 | 60.787 | 20.829 | 34.111 | 29.704 | 49.230 | 45.833 |
| HEMBA1003031 | 34.000 | 25.311 | 18.494 | 14.998 | 13.316 | 13.955 | 15.773 | 27.136 |
| HEMBA1003032 | 171.114 | 46.990 | 71.365 | 23.640 | 50.526 | 81.278 | 84.036 | 46.352 |
| HEMBA1003033 | 168.563 | 118.674 | 378.771 | 109.222 | 90.670 | 70.150 | 55.336 | 77.819 |
| HEMBA1003034 | 173.162 | 127.221 | 484.135 | 108.238 | 85.630 | 61.733 | 36.799 | 63.312 |
| HEMBA1003035 | 11.693 | 5.195 | 9.305 | 4.478 | 5.058 | 11.024 | 2.553 | 4.409 |
| HEMBA1003037 | 261.159 | 89.481 | 145.321 | 58.521 | 65.732 | 104.677 | 89.571 | 71.674 |
| HEMBA1003041 | 103.945 | 105.085 | 291.931 | 93.188 | 75.193 | 53.097 | 39.564 | 58.217 |
| HEMBA1003046 | 40.254 | 39.965 | 46.856 | 26.192 | 11.615 | 35.659 | 25.378 | 32.416 |
| HEMBA1003047 | 127.888 | 49.341 | 139.750 | 32.219 | 32.320 | 57.450 | 33.390 | 28.702 |
| HEMBA1003048 | 87.433 | 35.962 | 42.305 | 12.040 | 20.442 | 39.108 | 29.597 | 21.461 |
| HEMBA1003064 | 6.366 | 8.535 | 6.201 | 8.809 | 4.415 | 7.239 | 3.330 | 7.829 |
| HEMBA1003067 | 55.833 | 34.508 | 77.097 | 26.154 | 20.523 | 28.755 | 24.783 | 17.488 |
| HEMBA1003071 | 54.728 | 22.509 | 28.869 | 17.461 | 19.647 | 20.624 | 22.285 | 19.438 |

TABLE 17-continued

| | | | | | | | | |
|---|---|---|---|---|---|---|---|---|
| HEMBA1003072 | 62.421 | 30.769 | 31.225 | 26.146 | 22.906 | 21.483 | 17.616 | 19.134 |
| HEMBA1003076 | 111.254 | 51.085 | 78.972 | 37.151 | 40.422 | 49.911 | 47.023 | 64.737 |
| HEMBA1003077 | 36.471 | 15.407 | 24.522 | 8.009 | 8.453 | 18.661 | 13.797 | 5.837 |
| HEMBA1003078 | 34.143 | 38.741 | 77.906 | 31.907 | 37.169 | 17.933 | 17.439 | 18.923 |
| HEMBA1003079 | 28.559 | 39.563 | 41.646 | 26.110 | 25.889 | 25.576 | 18.026 | 24.526 |
| HEMBA1003083 | 61.036 | 48.635 | 169.439 | 52.788 | 60.016 | 41.611 | 29.619 | 67.469 |
| HEMBA1003086 | 49.032 | 40.488 | 154.409 | 29.869 | 12.063 | 16.544 | 16.039 | 19.219 |
| HEMBA1003090 | 34.778 | 14.860 | 23.758 | 12.710 | 24.132 | 15.848 | 25.027 | 14.265 |
| HEMBA1003094 | 184.999 | 43.363 | 72.116 | 30.096 | 53.636 | 78.251 | 84.551 | 34.775 |
| HEMBA1003096 | 31.440 | 18.030 | 25.774 | 10.290 | 11.781 | 14.033 | 27.791 | 11.348 |
| HEMBA1003098 | 36.774 | 64.970 | 88.562 | 34.074 | 24.271 | 25.656 | 18.003 | 31.059 |
| HEMBA1003101 | 55.716 | 24.121 | 22.316 | 11.682 | 13.163 | 21.315 | 25.117 | 15.689 |
| HEMBA1003109 | 48.411 | 21.093 | 39.285 | 21.315 | 21.724 | 27.826 | 31.034 | 21.809 |
| HEMBA1003114 | 41.101 | 24.786 | 22.792 | 14.164 | 14.657 | 18.320 | 15.152 | 16.038 |
| HEMBA1003117 | 22.939 | 13.535 | 20.191 | 6.812 | 10.538 | 14.917 | 18.015 | 12.566 |
| HEMBA1003120 | 24.531 | 24.408 | 55.805 | 26.574 | 13.838 | 15.423 | 15.080 | 21.728 |
| HEMBA1003129 | 40.276 | 46.792 | 104.463 | 37.995 | 37.989 | 21.990 | 26.267 | 38.207 |
| HEMBA1003133 | 50.080 | 22.873 | 35.022 | 15.164 | 20.000 | 21.592 | 25.551 | 27.656 |
| HEMBA1003136 | 146.630 | 23.706 | 65.990 | 18.301 | 31.049 | 69.754 | 51.669 | 25.346 |
| HEMBA1003142 | 69.008 | 47.867 | 130.557 | 32.955 | 30.384 | 25.274 | 27.118 | 29.493 |
| HEMBA1003148 | 59.282 | 20.084 | 32.740 | 18.292 | 18.973 | 32.206 | 22.003 | 24.674 |
| HEMBA1003151 | 53.856 | 20.003 | 51.824 | 13.233 | 9.854 | 27.114 | 22.251 | 13.546 |
| HEMBA1003152 | 20.577 | 9.803 | 19.388 | 10.017 | 5.761 | 31.586 | 23.227 | 6.853 |
| HEMBA1003157 | 16.477 | 9.272 | 16.246 | 9.919 | 17.605 | 7.547 | 10.156 | 10.181 |
| HEMBA1003166 | 293.814 | 257.380 | 671.361 | 260.521 | 221.325 | 137.459 | 148.208 | 199.758 |
| HEMBA1003171 | 17.730 | 8.702 | 16.527 | 6.499 | 6.963 | 7.361 | 5.733 | 7.164 |

TABLE 18

| | | | | | | | | |
|---|---|---|---|---|---|---|---|---|
| HEMBA1003175 | 38.620 | 40.445 | 100.302 | 29.594 | 17.624 | 21.152 | 13.386 | 15.936 |
| HEMBA1003179 | 63.835 | 33.869 | 50.631 | 27.163 | 25.502 | 35.500 | 39.052 | 37.713 |
| HEMBA1003186 | 100.461 | 75.611 | 231.787 | 75.781 | 58.278 | 54.222 | 55.862 | 61.615 |
| HEMBA1003196 | 36.422 | 27.557 | 45.633 | 20.623 | 18.740 | 21.756 | 30.501 | 35.864 |
| HEMBA1003197 | 8.462 | 9.564 | 5.534 | 5.965 | 4.051 | 3.138 | 7.054 | 7.066 |
| HEMBA1003199 | 34.650 | 18.409 | 81.183 | 15.696 | 16.799 | 9.492 | 17.381 | 15.917 |
| HEMBA1003202 | 79.337 | 59.764 | 236.822 | 43.286 | 41.820 | 31.106 | 32.936 | 45.183 |
| HEMBA1003204 | 66.523 | 56.272 | 172.818 | 48.560 | 31.451 | 33.193 | 27.421 | 28.849 |
| HEMBA1003210 | 23.713 | 52.768 | 35.498 | 5.529 | 38.451 | 16.353 | 59.417 | 17.563 |
| HEMBA1003212 | 126.394 | 90.709 | 372.474 | 74.164 | 62.392 | 59.663 | 45.714 | 54.363 |
| HEMBA1003218 | 19.415 | 13.105 | 13.670 | 6.371 | 4.792 | 13.681 | 10.789 | 6.536 |
| HEMBA1003220 | 81.171 | 86.642 | 147.453 | 89.495 | 42.391 | 47.586 | 54.647 | 123.019 |
| HEMBA1003222 | 25.803 | 22.891 | 28.577 | 7.994 | 11.404 | 10.413 | 9.856 | 14.985 |
| HEMBA1003225 | 105.735 | 21.238 | 40.848 | 11.586 | 20.280 | 48.243 | 44.574 | 19.547 |
| HEMBA1003229 | 30.394 | 26.363 | 41.333 | 22.998 | 17.475 | 14.707 | 20.154 | 19.749 |
| HEMBA1003230 | 69.643 | 70.015 | 42.439 | 31.176 | 20.775 | 56.815 | 40.191 | 75.238 |
| HEMBA1003235 | 44.989 | 43.337 | 105.267 | 33.038 | 19.405 | 20.834 | 22.018 | 29.856 |
| HEMBA1003236 | 8.677 | 17.896 | 8.735 | 7.270 | 7.328 | 17.286 | 5.295 | 18.441 |
| HEMBA1003250 | 7.260 | 12.598 | 12.993 | 4.750 | 4.815 | 7.242 | 5.982 | 4.378 |
| HEMBA1003252 | 56.274 | 51.495 | 65.197 | 28.241 | 33.512 | 44.917 | 62.506 | 60.076 |
| HEMBA1003257 | 71.751 | 16.083 | 40.414 | 13.391 | 19.441 | 38.988 | 28.614 | 19.028 |
| HEMBA1003268 | 19.492 | 18.996 | 46.948 | 14.167 | 12.769 | 11.524 | 8.622 | 17.414 |
| HEMBA1003273 | 48.113 | 38.933 | 125.242 | 29.404 | 21.135 | 22.989 | 17.240 | 24.704 |
| HEMBA1003276 | 36.279 | 34.802 | 113.584 | 23.812 | 17.208 | 20.437 | 14.685 | 26.145 |
| HEMBA1003277 | 31.363 | 12.827 | 21.514 | 10.462 | 11.287 | 13.206 | 16.182 | 14.465 |
| HEMBA1003278 | 36.998 | 24.906 | 71.222 | 17.479 | 15.791 | 16.787 | 10.948 | 17.841 |
| HEMBA1003280 | 50.716 | 16.000 | 38.057 | 16.933 | 20.792 | 37.901 | 30.931 | 31.493 |
| HEMBA1003281 | 66.732 | 21.393 | 32.728 | 15.032 | 18.415 | 26.844 | 28.577 | 24.898 |
| HEMBA1003284 | 9.746 | 8.482 | 12.941 | 5.779 | 5.747 | 5.813 | 3.545 | 3.499 |
| HEMBA1003286 | 69.502 | 35.947 | 60.729 | 21.827 | 29.473 | 52.233 | 50.283 | 47.695 |
| HEMBA1003291 | 13.248 | 9.951 | 10.909 | 3.504 | 18.100 | 6.561 | 6.341 | 7.647 |
| HEMBA1003294 | 69.599 | 52.239 | 168.555 | 39.127 | 38.460 | 40.377 | 24.057 | 27.486 |
| HEMBA1003296 | 61.933 | 31.456 | 37.947 | 21.206 | 23.199 | 23.249 | 34.580 | 37.768 |
| HEMBA1003304 | 7.117 | 5.972 | 8.976 | 6.154 | 8.839 | 4.199 | 3.461 | 3.227 |
| HEMBA1003306 | 17.590 | 15.590 | 22.443 | 8.410 | 11.282 | 8.448 | 6.333 | 9.387 |
| HEMBA1003309 | 6.845 | 10.103 | 12.198 | 14.015 | 7.776 | 8.709 | 3.955 | 18.326 |
| HEMBA1003314 | 637.052 | 210.608 | 238.618 | 105.098 | 198.106 | 299.884 | 273.738 | 171.516 |
| HEMBA1003315 | 83.736 | 51.612 | 84.690 | 32.381 | 29.482 | 56.694 | 53.105 | 54.024 |
| HEMBA1003322 | 108.401 | 88.539 | 256.570 | 51.502 | 51.083 | 44.130 | 42.804 | 45.519 |
| HEMBA1003326 | 42.723 | 20.581 | 14.759 | 11.799 | 7.780 | 18.087 | 12.420 | 9.516 |
| HEMBA1003327 | 61.811 | 36.702 | 87.698 | 28.181 | 19.784 | 18.596 | 17.453 | 18.377 |
| HEMBA1003328 | 53.406 | 51.712 | 114.941 | 36.926 | 25.000 | 18.669 | 22.079 | 32.865 |
| HEMBA1003330 | 108.955 | 82.099 | 207.708 | 73.413 | 52.244 | 50.838 | 55.920 | 55.390 |
| HEMBA1003348 | 121.625 | 110.275 | 337.182 | 94.209 | 99.717 | 67.000 | 43.513 | 80.023 |
| HEMBA1003369 | 5.861 | 23.644 | 14.930 | 4.979 | 1.726 | 9.064 | 3.020 | 5.373 |
| HEMBA1003370 | 315.016 | 197.956 | 369.117 | 140.044 | 139.216 | 140.758 | 150.458 | 124.948 |
| HEMBA1003373 | 50.135 | 31.291 | 53.330 | 17.430 | 5.513 | 19.164 | 8.117 | 19.638 |

TABLE 18-continued

| | | | | | | | | |
|---|---|---|---|---|---|---|---|---|
| HEMBA1003376 | 174.269 | 170.290 | 519.668 | 126.099 | 89.798 | 108.226 | 81.818 | 107.084 |
| HEMBA1003380 | 43.015 | 24.657 | 74.071 | 29.281 | 24.407 | 19.711 | 13.485 | 20.047 |
| HEMBA1003384 | 25.555 | 30.071 | 68.079 | 15.389 | 9.455 | 11.810 | 8.800 | 14.281 |
| HEMBA1003387 | 6.515 | 2.588 | 2.697 | 1.577 | 1.109 | 1.803 | 1.986 | 3.464 |
| HEMBA1003392 | 111.457 | 25.882 | 42.253 | 17.323 | 29.007 | 50.086 | 29.337 | 23.550 |
| HEMBA1003395 | 16.068 | 18.666 | 35.483 | 15.254 | 9.873 | 10.355 | 6.207 | 12.514 |
| HEMBA1003399 | 45.227 | 21.480 | 37.035 | 19.231 | 15.354 | 19.471 | 27.860 | 34.116 |
| HEMBA1003400 | 116.210 | 36.907 | 58.706 | 24.811 | 49.133 | 53.819 | 60.041 | 53.109 |
| HEMBA1003402 | 32.500 | 16.239 | 27.864 | 8.795 | 12.867 | 17.141 | 11.617 | 14.596 |
| HEMBA1003403 | 60.260 | 43.377 | 46.720 | 20.221 | 26.579 | 36.738 | 44.891 | 45.870 |
| HEMBA1003408 | 196.676 | 49.687 | 70.460 | 29.354 | 50.910 | 84.358 | 77.062 | 46.433 |
| HEMBA1003412 | 104.813 | 43.934 | 55.699 | 47.250 | 43.763 | 61.953 | 59.463 | 47.139 |
| HEMBA1003417 | 22.445 | 13.970 | 25.036 | 8.433 | 7.282 | 10.593 | 5.696 | 11.032 |
| HEMBA1003418 | 57.411 | 57.397 | 76.232 | 97.795 | 45.336 | 43.450 | 22.206 | 90.604 |
| HEMBA1003420 | 29.838 | 15.856 | 201.831 | 11.319 | 8.067 | 11.379 | 12.938 | 14.721 |
| HEMBA1003425 | 17.466 | 15.895 | 21.662 | 4.733 | 6.723 | 8.483 | 10.838 | 9.083 |
| HEMBA1003433 | 23.931 | 18.435 | 24.576 | 12.136 | 10.421 | 10.074 | 11.092 | 11.581 |

TABLE 19

| | | | | | | | | |
|---|---|---|---|---|---|---|---|---|
| HEMBA1003440 | 91.727 | 41.727 | 39.257 | 19.755 | 26.941 | 45.998 | 31.620 | 35.845 |
| HEMBA1003442 | 7.090 | 22.535 | 10.452 | 33.897 | 10.259 | 15.118 | 7.093 | 14.790 |
| HEMBA1003447 | 82.161 | 36.670 | 48.248 | 26.789 | 18.587 | 41.591 | 42.314 | 35.065 |
| HEMBA1003453 | 50.472 | 26.692 | 25.954 | 16.130 | 11.252 | 16.584 | 28.534 | 21.256 |
| HEMBA1003461 | 55.687 | 25.328 | 42.686 | 17.261 | 18.856 | 27.281 | 22.795 | 17.854 |
| HEMBA1003463 | 40.102 | 23.311 | 34.469 | 13.456 | 19.704 | 20.277 | 16.984 | 18.124 |
| HEMBA1003465 | 92.245 | 40.963 | 61.816 | 28.410 | 36.051 | 39.389 | 40.220 | 36.851 |
| HEMBA1003480 | 114.075 | 114.841 | 266.076 | 76.366 | 67.942 | 56.459 | 51.589 | 62.191 |
| HEMBA1003485 | 44.403 | 28.836 | 33.659 | 14.371 | 8.636 | 26.284 | 16.036 | 14.582 |
| HEMBA1003487 | 42.939 | 15.463 | 23.730 | 9.752 | 15.729 | 24.902 | 21.136 | 16.494 |
| HEMBA1003492 | 31.026 | 21.538 | 56.674 | 14.934 | 12.014 | 12.082 | 9.567 | 14.655 |
| HEMBA1003494 | 97.366 | 260.496 | 50.174 | 48.821 | 12.504 | 74.554 | 20.623 | 180.841 |
| HEMBA1003497 | 39.000 | 17.943 | 24.659 | 11.432 | 13.881 | 21.376 | 18.562 | 6.072 |
| HEMBA1003503 | 54.774 | 21.486 | 28.175 | 12.948 | 17.154 | 30.911 | 36.463 | 16.806 |
| HEMBA1003511 | 18.672 | 14.740 | 43.023 | 11.794 | 13.330 | 8.925 | 16.405 | 11.615 |
| HEMBA1003528 | 385.123 | 191.234 | 239.319 | 81.329 | 123.915 | 213.945 | 179.430 | 96.672 |
| HEMBA1003530 | 43.820 | 12.384 | 23.693 | 10.695 | 21.216 | 20.067 | 28.030 | 16.204 |
| HEMBA1003531 | 111.104 | 73.542 | 215.578 | 67.833 | 214.022 | 56.139 | 50.217 | 66.992 |
| HEMBA1003532 | 145.137 | 62.379 | 83.827 | 37.506 | 53.388 | 90.314 | 77.728 | 60.515 |
| HEMBA1003538 | 61.123 | 20.746 | 32.949 | 11.160 | 19.286 | 34.305 | 28.231 | 13.837 |
| HEMBA1003545 | 21.489 | 10.501 | 20.608 | 5.904 | 7.197 | 10.239 | 6.617 | 8.168 |
| HEMBA1003546 | 31.371 | 32.365 | 28.613 | 13.365 | 226.243 | 16.427 | 16.554 | 24.821 |
| HEMBA1003548 | 4.466 | 8.124 | 9.845 | 4.563 | 7.542 | 6.155 | 5.647 | 8.387 |
| HEMBA1003553 | 79.837 | 51.515 | 50.379 | 23.327 | 28.564 | 49.154 | 63.525 | 48.955 |
| HEMBA1003555 | 20.066 | 8.873 | 13.692 | 4.762 | 3.684 | 10.112 | 10.962 | 6.521 |
| HEMBA1003556 | 57.280 | 36.399 | 128.391 | 29.283 | 16.426 | 19.257 | 18.121 | 24.622 |
| HEMBA1003560 | 9.290 | 4.426 | 2.529 | 2.848 | 1.767 | 2.983 | 6.207 | 6.539 |
| HEMBA1003565 | 42.648 | 29.588 | 20.996 | 8.344 | 13.984 | 21.927 | 21.847 | 22.043 |
| HEMBA1003568 | 7.244 | 1.649 | 7.712 | 2.430 | 3.763 | 3.172 | 2.836 | 2.592 |
| HEMBA1003569 | 25.048 | 20.536 | 23.764 | 33.957 | 13.740 | 16.235 | 19.512 | 16.518 |
| HEMBA1003571 | 111.721 | 94.378 | 326.335 | 84.368 | 71.788 | 50.029 | 48.001 | 59.960 |
| HEMBA1003579 | 3.335 | 7.399 | 15.353 | 6.553 | 8.948 | 2.872 | 9.198 | 6.421 |
| HEMBA1003580 | 274.105 | 50.292 | 102.103 | 26.686 | 59.875 | 128.943 | 110.375 | 35.695 |
| HEMBA1003581 | 112.013 | 31.295 | 94.083 | 21.641 | 36.215 | 54.336 | 50.711 | 21.238 |
| HEMBA1003591 | 97.076 | 64.326 | 77.160 | 89.876 | 47.882 | 53.615 | 40.656 | 45.172 |
| HEMBA1003595 | 32.697 | 22.842 | 84.629 | 19.075 | 11.339 | 6.305 | 5.581 | 18.085 |
| HEMBA1003597 | 48.561 | 25.846 | 108.491 | 20.931 | 15.952 | 19.375 | 17.580 | 20.153 |
| HEMBA1003598 | 49.728 | 20.134 | 22.468 | 12.142 | 11.688 | 18.934 | 21.743 | 15.025 |
| HEMBA1003600 | 32.772 | 35.099 | 56.905 | 26.268 | 29.290 | 38.873 | 53.305 | 56.783 |
| HEMBA1003602 | 18.248 | 10.116 | 16.162 | 6.182 | 10.970 | 8.064 | 14.736 | 17.188 |
| HEMBA1003604 | 205.949 | 53.579 | 69.723 | 24.549 | 49.902 | 105.181 | 98.166 | 47.144 |
| HEMBA1003610 | 140.996 | 29.255 | 95.048 | 15.492 | 103.150 | 72.233 | 54.670 | 30.688 |
| HEMBA1003615 | 57.258 | 20.035 | 34.102 | 12.808 | 16.022 | 24.378 | 18.759 | 20.876 |
| HEMBA1003617 | 48.414 | 20.375 | 29.789 | 12.148 | 22.291 | 18.199 | 18.770 | 18.242 |
| HEMBA1003620 | 52.899 | 22.318 | 45.502 | 19.575 | 19.962 | 25.239 | 39.072 | 29.451 |
| HEMBA1003621 | 102.827 | 102.094 | 226.373 | 80.194 | 64.742 | 58.874 | 67.142 | 60.680 |
| HEMBA1003622 | 19.815 | 13.838 | 25.009 | 16.055 | 8.339 | 12.261 | 15.369 | 13.833 |
| HEMBA1003630 | 20.008 | 16.381 | 30.244 | 13.871 | 5.573 | 9.992 | 10.303 | 11.422 |
| HEMBA1003637 | 37.880 | 29.848 | 106.379 | 23.251 | 18.468 | 17.181 | 12.409 | 18.500 |
| HEMBA1003640 | 39.068 | 31.672 | 100.901 | 22.572 | 22.223 | 21.513 | 17.417 | 20.420 |
| HEMBA1003645 | 25.820 | 19.380 | 48.445 | 13.481 | 9.247 | 12.142 | 54.230 | 5.711 |
| HEMBA1003646 | 38.243 | 16.329 | 22.003 | 9.624 | 13.311 | 24.606 | 19.177 | 19.938 |
| HEMBA1003647 | 10.261 | 10.718 | 12.323 | 7.860 | 7.892 | 7.607 | 7.882 | 10.058 |
| HEMBA1003656 | 40.171 | 31.269 | 66.874 | 28.981 | 19.429 | 18.898 | 23.172 | 30.178 |
| HEMBA1003662 | 25.325 | 17.011 | 19.352 | 6.387 | 10.041 | 10.909 | 14.055 | 18.544 |
| HEMBA1003666 | 23.086 | 11.187 | 17.407 | 5.803 | 8.262 | 9.774 | 15.332 | 13.851 |

TABLE 19-continued

| | | | | | | | | |
|---|---|---|---|---|---|---|---|---|
| HEMBA1003667 | 304.975 | 209.929 | 337.134 | 96.636 | 131.792 | 179.317 | 140.769 | 174.256 |
| HEMBA1003670 | 12.944 | 8.894 | 15.235 | 3.344 | 2.565 | 7.057 | 6.425 | 7.073 |
| HEMBA1003674 | 143.262 | 32.196 | 51.919 | 33.863 | 62.734 | 66.675 | 65.424 | 47.173 |
| HEMBA1003677 | 80.516 | 45.946 | 220.695 | 45.985 | 43.474 | 38.916 | 30.594 | 46.808 |
| HEMBA1003679 | 25.325 | 7.795 | 16.167 | 6.727 | 5.941 | 12.433 | 12.034 | 11.720 |
| HEMBA1003680 | 42.317 | 25.723 | 33.794 | 24.664 | 23.985 | 25.419 | 38.990 | 39.343 |
| HEMBA1003684 | 18.273 | 10.175 | 17.733 | 13.315 | 4.937 | 9.099 | 10.182 | 10.574 |
| HEMBA1003690 | 115.021 | 65.531 | 75.876 | 46.324 | 43.039 | 71.797 | 85.431 | 56.592 |

TABLE 20

| | | | | | | | | |
|---|---|---|---|---|---|---|---|---|
| HEMBA1003692 | 83.253 | 96.347 | 194.372 | 63.188 | 40.872 | 47.354 | 39.288 | 42.644 |
| HEMBA1003702 | 88.125 | 35.028 | 48.251 | 23.719 | 29.023 | 42.879 | 46.956 | 36.550 |
| HEMBA1003711 | 93.732 | 50.280 | 140.199 | 32.886 | 33.424 | 47.500 | 41.959 | 36.807 |
| HEMBA1003714 | 75.923 | 20.696 | 37.340 | 14.414 | 28.237 | 32.029 | 29.145 | 16.214 |
| HEMBA1003715 | 54.160 | 54.486 | 142.871 | 31.894 | 31.122 | 28.832 | 20.640 | 26.672 |
| HEMBA1003717 | 70.553 | 38.574 | 120.922 | 45.101 | 29.491 | 29.344 | 27.200 | 38.418 |
| HEMBA1003720 | 83.687 | 94.829 | 133.285 | 55.896 | 49.519 | 43.330 | 22.099 | 41.137 |
| HEMBA1003725 | 46.157 | 55.932 | 71.704 | 30.085 | 21.305 | 22.378 | 18.643 | 31.573 |
| HEMBA1003728 | 103.795 | 35.668 | 58.184 | 16.485 | 21.818 | 42.286 | 37.790 | 34.280 |
| HEMBA1003729 | 49.957 | 21.508 | 47.663 | 20.231 | 15.376 | 18.567 | 21.294 | 17.427 |
| HEMBA1003732 | 13.069 | 1.953 | 6.558 | 3.228 | 2.195 | 3.652 | 3.024 | 4.336 |
| HEMBA1003733 | 52.409 | 32.781 | 76.684 | 22.919 | 83.426 | 18.921 | 13.867 | 14.220 |
| HEMBA1003742 | 40.426 | 20.265 | 50.667 | 26.589 | 21.518 | 42.057 | 44.130 | 24.802 |
| HEMBA1003743 | 26.918 | 22.118 | 23.392 | 18.886 | 18.530 | 12.506 | 17.162 | 18.069 |
| HEMBA1003758 | 110.630 | 126.359 | 315.104 | 79.435 | 58.130 | 58.587 | 34.868 | 73.429 |
| HEMBA1003760 | 78.949 | 0.000 | 26.318 | 15.194 | 14.440 | 32.057 | 34.468 | 19.471 |
| HEMBA1003764 | 45.855 | 30.390 | 82.720 | 23.891 | 19.630 | 164.051 | 37.797 | 57.861 |
| HEMBA1003769 | 87.589 | 47.227 | 62.942 | 27.144 | 32.047 | 46.499 | 39.296 | 38.944 |
| HEMBA1003773 | 63.842 | 14.722 | 21.132 | 12.002 | 9.850 | 33.904 | 29.817 | 13.165 |
| HEMBA1003783 | 17.751 | 16.975 | 23.942 | 16.465 | 13.884 | 6.842 | 9.757 | 20.650 |
| HEMBA1003784 | 13.500 | 17.233 | 21.849 | 13.856 | 12.436 | 17.394 | 11.099 | 13.140 |
| HEMBA1003794 | 386.642 | 303.008 | 322.299 | 109.371 | 145.316 | 286.778 | 287.377 | 239.938 |
| HEMBA1003799 | 39.392 | 23.099 | 29.603 | 15.022 | 13.775 | 16.550 | 24.428 | 19.403 |
| HEMBA1003803 | 63.548 | 21.899 | 44.323 | 20.132 | 18.580 | 28.795 | 24.744 | 35.938 |
| HEMBA1003804 | 80.382 | 26.816 | 48.558 | 16.154 | 27.867 | 31.087 | 37.611 | 22.634 |
| HEMBA1003805 | 103.669 | 42.485 | 42.930 | 19.994 | 36.377 | 43.797 | 32.147 | 28.376 |
| HEMBA1003807 | 21.717 | 13.940 | 25.512 | 9.492 | 6.870 | 9.649 | 8.812 | 7.611 |
| HEMBA1003810 | 20.102 | 11.572 | 7.558 | 20.338 | 17.855 | 7.640 | 4.451 | 6.585 |
| HEMBA1003827 | 432.964 | 219.520 | 240.291 | 155.416 | 219.584 | 266.037 | 283.204 | 241.127 |
| HEMBA1003836 | 177.311 | 135.831 | 482.334 | 146.466 | 136.063 | 93.790 | 92.728 | 122.237 |
| HEMBA1003838 | 223.674 | 185.295 | 641.368 | 134.002 | 79.993 | 115.711 | 87.137 | 118.957 |
| HEMBA1003843 | 13.867 | 10.178 | 27.409 | 17.850 | 21.104 | 13.382 | 11.701 | 13.634 |
| HEMBA1003846 | 133.994 | 57.556 | 58.738 | 34.962 | 50.550 | 56.395 | 40.861 | 60.253 |
| HEMBA1003856 | 27.378 | 13.868 | 16.982 | 14.248 | 8.662 | 11.259 | 9.145 | 9.934 |
| HEMBA1003857 | 101.908 | 95.527 | 253.525 | 75.110 | 52.628 | 51.958 | 45.837 | 48.871 |
| HEMBA1003864 | 52.130 | 18.071 | 24.567 | 9.568 | 13.009 | 16.810 | 29.271 | 16.795 |
| HEMBA1003866 | 27.257 | 12.805 | 22.440 | 12.069 | 15.414 | 19.103 | 9.229 | 7.524 |
| HEMBA1003868 | 95.701 | 54.991 | 58.923 | 31.090 | 41.733 | 69.461 | 48.174 | 43.486 |
| HEMBA1003879 | 62.950 | 44.572 | 159.217 | 48.098 | 42.446 | 37.097 | 36.010 | 45.824 |
| HEMBA1003880 | 134.462 | 70.074 | 103.271 | 50.699 | 47.956 | 67.668 | 44.498 | 30.581 |
| HEMBA1003884 | 99.190 | 48.465 | 73.499 | 34.796 | 54.399 | 57.269 | 63.551 | 68.830 |
| HEMBA1003885 | 77.675 | 69.096 | 172.968 | 55.129 | 49.424 | 41.309 | 24.247 | 31.596 |
| HEMBA1003887 | 60.203 | 22.185 | 33.582 | 16.896 | 21.181 | 29.281 | 31.275 | 22.835 |
| HEMBA1003890 | 12.753 | 8.056 | 15.506 | 7.762 | 16.057 | 139.271 | 387.408 | 5.124 |
| HEMBA1003893 | 386.525 | 281.955 | 515.307 | 187.300 | 180.355 | 212.964 | 137.297 | 122.335 |
| HEMBA1003896 | 411.418 | 232.899 | 382.182 | 144.104 | 165.806 | 233.857 | 186.700 | 143.577 |
| HEMBA1003902 | 39.732 | 39.491 | 114.984 | 20.297 | 23.509 | 16.793 | 14.124 | 20.479 |
| HEMBA1003904 | 32.775 | 21.109 | 45.629 | 10.006 | 13.109 | 14.294 | 24.342 | 17.444 |
| HEMBA1003908 | 8.660 | 8.873 | 15.689 | 7.298 | 15.429 | 6.307 | 2.267 | 5.699 |
| HEMBA1003926 | 132.636 | 253.614 | 316.882 | 183.017 | 124.195 | 147.955 | 105.962 | 360.995 |
| HEMBA1003937 | 87.005 | 63.862 | 200.940 | 40.687 | 36.238 | 35.284 | 29.695 | 40.418 |
| HEMBA1003939 | 28.064 | 25.844 | 35.675 | 20.306 | 20.378 | 19.070 | 16.457 | 15.626 |
| HEMBA1003940 | 27.800 | 13.368 | 18.045 | 10.235 | 10.394 | 14.633 | 17.733 | 9.868 |
| HEMBA1003941 | 57.997 | 16.835 | 24.582 | 17.381 | 15.884 | 23.428 | 19.757 | 13.795 |
| HEMBA1003942 | 38.168 | 19.747 | 45.852 | 32.660 | 22.333 | 24.695 | 10.791 | 21.900 |
| HEMBA1003945 | 59.457 | 32.900 | 46.079 | 23.037 | 21.163 | 36.632 | 32.279 | 26.903 |
| HEMBA1003949 | 12.870 | 13.019 | 20.678 | 7.159 | 38.521 | 442.120 | 272.494 | 21.625 |
| HEMBA1003950 | 8.366 | 8.726 | 5.814 | 3.195 | 4.756 | 3.396 | 8.814 | 5.401 |
| HEMBA1003953 | 23.527 | 10.310 | 11.872 | 9.390 | 8.494 | 10.637 | 10.973 | 5.252 |
| HEMBA1003958 | 131.082 | 90.718 | 253.084 | 74.499 | 85.036 | 62.450 | 34.852 | 86.629 |
| HEMBA1003959 | 12.105 | 11.228 | 18.520 | 6.548 | 7.960 | 18.122 | 12.612 | 10.591 |
| HEMBA1003960 | 53.133 | 29.785 | 31.879 | 18.932 | 16.178 | 21.708 | 32.094 | 35.333 |
| HEMBA1003966 | 58.245 | 19.415 | 68.506 | 20.791 | 26.975 | 28.975 | 27.825 | 25.303 |
| HEMBA1003967 | 1.859 | 3.908 | 9.364 | 6.033 | 4.054 | 4.384 | 4.208 | 4.986 |

TABLE 21

| | | | | | | | | |
|---|---|---|---|---|---|---|---|---|
| HEMBA1003968 | 40.219 | 26.894 | 55.357 | 16.296 | 14.511 | 28.531 | 22.648 | 15.420 |
| HEMBA1003974 | 147.167 | 439.547 | 139.030 | 117.010 | 33.973 | 54.122 | 29.356 | 338.820 |
| HEMBA1003976 | 20.167 | 17.809 | 13.159 | 9.187 | 5.748 | 6.820 | 6.962 | 10.367 |
| HEMBA1003977 | 32.761 | 12.350 | 24.212 | 6.558 | 6.776 | 12.413 | 17.016 | 9.367 |
| HEMBA1003978 | 40.564 | 13.858 | 10.812 | 11.585 | 11.203 | 23.881 | 20.489 | 17.488 |
| HEMBA1003981 | 65.803 | 34.462 | 71.399 | 26.801 | 31.348 | 48.051 | 31.355 | 42.728 |
| HEMBA1003982 | 15.104 | 89.360 | 20.946 | 18.086 | 1.620 | 3.781 | 3.102 | 64.356 |
| HEMBA1003985 | 15.199 | 10.866 | 21.715 | 9.199 | 1.517 | 8.041 | 5.977 | 7.569 |
| HEMBA1003987 | 48.695 | 30.080 | 108.473 | 25.632 | 23.222 | 28.008 | 21.302 | 24.940 |
| HEMBA1003989 | 47.841 | 51.466 | 128.889 | 32.288 | 24.298 | 24.627 | 15.392 | 23.174 |
| HEMBA1004000 | 36.424 | 35.098 | 34.843 | 16.292 | 19.541 | 20.604 | 16.803 | 21.872 |
| HEMBA1004006 | 8.411 | 42.393 | 12.931 | 2.863 | 3.395 | 0.000 | 4.943 | 9.742 |
| HEMBA1004007 | 135.300 | 114.014 | 286.000 | 90.971 | 64.473 | 74.153 | 71.985 | 79.319 |
| HEMBA1004010 | 58.331 | 152.845 | 38.786 | 18.676 | 18.819 | 35.229 | 31.514 | 80.599 |
| HEMBA1004011 | 62.306 | 16.294 | 38.336 | 12.356 | 13.756 | 29.683 | 26.091 | 7.986 |
| HEMBA1004012 | 47.010 | 38.053 | 139.110 | 42.415 | 22.159 | 34.340 | 27.215 | 32.550 |
| HEMBA1004015 | 24.416 | 26.249 | 27.372 | 12.243 | 13.962 | 25.082 | 25.133 | 12.269 |
| HEMBA1004024 | 149.457 | 114.788 | 479.037 | 80.679 | 77.896 | 75.066 | 57.366 | 93.859 |
| HEMBA1004029 | 81.485 | 31.944 | 43.520 | 19.897 | 20.191 | 38.768 | 36.482 | 19.376 |
| HEMBA1004038 | 26.629 | 15.823 | 19.708 | 12.109 | 7.832 | 14.400 | 12.855 | 17.771 |
| HEMBA1004042 | 8.177 | 10.678 | 12.830 | 6.612 | 11.484 | 7.963 | 11.320 | 10.405 |
| HEMBA1004045 | 24.675 | 30.855 | 37.128 | 20.069 | 23.538 | 15.509 | 17.299 | 17.447 |
| HEMBA1004048 | 95.795 | 48.977 | 78.760 | 36.608 | 40.779 | 45.132 | 47.334 | 63.844 |
| HEMBA1004049 | 55.947 | 543.954 | 47.428 | 49.034 | 19.297 | 56.209 | 23.320 | 68.865 |
| HEMBA1004051 | 69.776 | 31.608 | 51.948 | 13.046 | 25.684 | 38.632 | 30.423 | 32.553 |
| HEMBA1004053 | 29.222 | 70.670 | 84.481 | 24.394 | 15.007 | 23.414 | 13.218 | 23.973 |
| HEMBA1004055 | 39.564 | 23.202 | 34.928 | 8.151 | 5.353 | 28.619 | 15.237 | 14.807 |
| HEMBA1004056 | 136.121 | 122.072 | 413.353 | 75.363 | 81.883 | 66.439 | 41.004 | 85.794 |
| HEMBA1004060 | 17.642 | 11.826 | 29.995 | 9.507 | 4.910 | 13.895 | 8.679 | 8.388 |
| HEMBA1004061 | 17.144 | 13.460 | 20.009 | 16.913 | 8.228 | 14.145 | 12.424 | 5.810 |
| HEMBA1004067 | 165.029 | 79.589 | 104.390 | 62.419 | 50.783 | 89.115 | 94.004 | 91.850 |
| HEMBA1004071 | 28.405 | 34.722 | 37.707 | 19.775 | 14.692 | 17.342 | 23.864 | 27.554 |
| HEMBA1004074 | 128.445 | 51.388 | 148.050 | 35.606 | 37.851 | 50.216 | 53.461 | 46.373 |
| HEMBA1004078 | 26.126 | 14.714 | 20.940 | 9.721 | 16.211 | 17.398 | 17.388 | 14.057 |
| HEMBA1004085 | 42.006 | 24.067 | 36.862 | 15.417 | 17.609 | 19.555 | 28.362 | 21.993 |
| HEMBA1004086 | 27.330 | 49.843 | 21.238 | 43.213 | 24.232 | 16.260 | 12.409 | 22.262 |
| HEMBA1004097 | 45.296 | 15.292 | 27.795 | 13.971 | 26.928 | 26.002 | 33.192 | 19.361 |
| HEMBA1004100 | 40.930 | 37.210 | 48.942 | 23.245 | 10.184 | 25.744 | 21.452 | 28.594 |
| HEMBA1004103 | 101.036 | 101.281 | 184.668 | 64.176 | 44.322 | 55.385 | 41.050 | 40.000 |
| HEMBA1004110 | 89.903 | 65.107 | 57.751 | 43.841 | 27.836 | 21.315 | 27.631 | 34.280 |
| HEMBA1004111 | 171.907 | 134.108 | 296.310 | 95.474 | 115.874 | 78.450 | 80.011 | 98.760 |
| HEMBA1004124 | 177.408 | 71.838 | 103.065 | 37.865 | 46.198 | 68.531 | 109.364 | 77.083 |
| HEMBA1004130 | 64.543 | 54.797 | 171.602 | 50.628 | 35.382 | 25.601 | 19.599 | 23.097 |
| HEMBA1004131 | 41.654 | 24.184 | 33.975 | 26.913 | 23.365 | 28.790 | 20.022 | 24.999 |
| HEMBA1004132 | 55.906 | 42.840 | 162.243 | 42.708 | 30.251 | 28.863 | 19.780 | 22.237 |
| HEMBA1004133 | 64.624 | 30.838 | 38.522 | 29.390 | 20.897 | 28.027 | 28.747 | 33.333 |
| HEMBA1004138 | 61.197 | 21.853 | 23.858 | 17.376 | 9.337 | 30.080 | 17.345 | 22.082 |
| HEMBA1004143 | 15.715 | 9.656 | 21.209 | 10.565 | 10.539 | 14.067 | 11.441 | 9.994 |
| HEMBA1004146 | 40.893 | 21.789 | 90.537 | 30.633 | 32.870 | 23.542 | 14.368 | 20.982 |
| HEMBA1004148 | 59.990 | 18.796 | 22.167 | 11.049 | 17.531 | 18.309 | 29.374 | 22.628 |
| HEMBA1004149 | 16.284 | 11.131 | 18.385 | 7.758 | 7.634 | 7.677 | 5.890 | 13.683 |
| HEMBA1004150 | 5.223 | 4.403 | 4.468 | 3.044 | 2.553 | 2.158 | 2.062 | 2.260 |
| HEMBA1004154 | 111.110 | 40.836 | 69.965 | 31.437 | 46.253 | 58.472 | 62.983 | 47.866 |
| HEMBA1004164 | 139.670 | 107.565 | 315.189 | 77.326 | 47.327 | 57.372 | 46.726 | 67.257 |
| HEMBA1004168 | 24.042 | 16.530 | 18.698 | 9.347 | 9.400 | 13.838 | 3.054 | 13.060 |
| HEMBA1004199 | 22.894 | 9.047 | 10.461 | 8.631 | 7.704 | 7.849 | 6.889 | 7.253 |
| HEMBA1004200 | 33.301 | 51.362 | 83.462 | 26.185 | 27.548 | 17.580 | 17.235 | 32.109 |
| HEMBA1004201 | 54.766 | 23.783 | 32.370 | 17.449 | 21.835 | 22.123 | 25.993 | 20.006 |
| HEMBA1004202 | 14.526 | 10.484 | 12.784 | 6.804 | 5.704 | 9.594 | 8.672 | 11.673 |
| HEMBA1004203 | 47.655 | 20.140 | 34.882 | 13.604 | 14.171 | 19.946 | 16.079 | 18.151 |
| HEMBA1004207 | 6.344 | 3.206 | 11.421 | 3.936 | 6.145 | 5.704 | 21.692 | 7.780 |
| HEMBA1004210 | 33.071 | 43.543 | 33.120 | 16.340 | 41.396 | 21.814 | 19.639 | 15.015 |
| HEMBA1004225 | 73.182 | 63.749 | 226.133 | 59.565 | 43.156 | 32.703 | 25.781 | 40.078 |
| HEMBA1004227 | 83.820 | 31.222 | 42.541 | 16.931 | 17.786 | 28.177 | 25.468 | 30.978 |

TABLE 22

| | | | | | | | | |
|---|---|---|---|---|---|---|---|---|
| HEMBA1004235 | 99.954 | 57.144 | 62.536 | 27.672 | 34.345 | 69.613 | 47.182 | 38.807 |
| HEMBA1004237 | 27.504 | 21.542 | 17.029 | 18.289 | 11.697 | 19.212 | 12.031 | 16.922 |
| HEMBA1004238 | 79.210 | 38.454 | 102.493 | 34.130 | 27.841 | 36.089 | 27.438 | 34.578 |
| HEMBA1004241 | 5.663 | 2.654 | 7.035 | 2.556 | 1.072 | 2.912 | 4.422 | 1.294 |
| HEMBA1004242 | 256.862 | 65.757 | 191.327 | 80.010 | 76.455 | 85.478 | 89.242 | 62.567 |
| HEMBA1004243 | 72.699 | 55.276 | 60.764 | 28.287 | 47.148 | 36.800 | 28.491 | 47.743 |
| HEMBA1004246 | 44.915 | 30.967 | 100.300 | 22.414 | 17.109 | 15.470 | 12.686 | 18.700 |
| HEMBA1004247 | 66.750 | 16.238 | 24.674 | 18.889 | 22.763 | 31.897 | 38.415 | 17.377 |
| HEMBA1004248 | 13.953 | 18.412 | 17.581 | 11.953 | 11.378 | 14.538 | 12.794 | 9.562 |

TABLE 22-continued

| | | | | | | | | |
|---|---|---|---|---|---|---|---|---|
| HEMBA1004250 | 24.439 | 10.494 | 10.631 | 6.401 | 5.142 | 14.218 | 12.652 | 11.966 |
| HEMBA1004252 | 37.349 | 20.650 | 22.246 | 9.949 | 9.550 | 14.570 | 21.841 | 18.200 |
| HEMBA1004260 | 10.994 | 19.320 | 16.415 | 15.707 | 20.374 | 13.845 | 11.265 | 19.838 |
| HEMBA1004264 | 22.716 | 14.715 | 13.358 | 7.615 | 5.234 | 12.282 | 15.089 | 11.397 |
| HEMBA1004267 | 235.310 | 195.750 | 654.331 | 171.071 | 174.292 | 115.073 | 102.973 | 144.125 |
| HEMBA1004272 | 28.776 | 19.025 | 23.678 | 13.063 | 12.012 | 15.529 | 14.123 | 14.593 |
| HEMBA1004274 | 62.157 | 50.491 | 53.598 | 30.356 | 36.472 | 42.005 | 58.020 | 51.617 |
| HEMBA1004275 | 70.423 | 38.514 | 45.176 | 17.443 | 18.132 | 34.031 | 36.295 | 22.171 |
| HEMBA1004276 | 33.630 | 4.481 | 14.011 | 9.548 | 9.099 | 14.035 | 10.406 | 8.615 |
| HEMBA1004279 | 16.536 | 11.082 | 13.356 | 14.834 | 7.333 | 10.255 | 8.919 | 12.068 |
| HEMBA1004284 | 29.688 | 30.297 | 64.483 | 13.658 | 17.646 | 17.327 | 17.630 | 13.770 |
| HEMBA1004286 | 32.471 | 16.566 | 18.049 | 12.391 | 6.773 | 17.625 | 23.811 | 13.547 |
| HEMBA1004289 | 81.573 | 62.930 | 165.571 | 49.704 | 34.785 | 37.379 | 28.939 | 41.740 |
| HEMBA1004293 | 72.466 | 34.902 | 48.669 | 32.705 | 17.408 | 57.764 | 53.695 | 45.065 |
| HEMBA1004295 | 37.595 | 12.116 | 29.975 | 11.634 | 5.514 | 25.018 | 23.797 | 20.926 |
| HEMBA1004302 | 10.880 | 5.912 | 7.885 | 10.025 | 5.190 | 6.060 | 5.264 | 9.355 |
| HEMBA1004306 | 426.811 | 177.321 | 335.168 | 107.646 | 123.947 | 256.397 | 251.772 | 134.005 |
| HEMBA1004312 | 37.953 | 30.864 | 105.533 | 30.747 | 25.847 | 16.140 | 16.283 | 24.272 |
| HEMBA1004314 | 29.396 | 23.332 | 95.584 | 22.179 | 18.544 | 11.015 | 8.804 | 20.974 |
| HEMBA1004321 | 47.670 | 29.150 | 105.316 | 35.655 | 23.139 | 31.309 | 29.736 | 47.858 |
| HEMBA1004323 | 87.295 | 65.931 | 221.440 | 44.690 | 41.425 | 36.609 | 34.117 | 39.135 |
| HEMBA1004327 | 65.869 | 21.284 | 21.540 | 11.985 | 14.419 | 27.213 | 27.030 | 20.118 |
| HEMBA1004329 | 67.920 | 44.687 | 132.755 | 32.977 | 21.556 | 32.356 | 17.478 | 26.773 |
| HEMBA1004330 | 8.765 | 7.655 | 16.827 | 7.164 | 3.843 | 9.511 | 7.660 | 4.615 |
| HEMBA1004334 | 16.438 | 21.355 | 31.680 | 15.109 | 26.670 | 13.368 | 10.581 | 13.568 |
| HEMBA1004335 | 204.961 | 102.859 | 325.226 | 69.979 | 64.392 | 78.772 | 71.641 | 83.525 |
| HEMBA1004341 | 186.677 | 30.208 | 61.439 | 15.995 | 41.404 | 87.221 | 89.558 | 40.224 |
| HEMBA1004344 | 261.676 | 76.316 | 123.332 | 42.705 | 51.432 | 26.797 | 42.054 | 59.071 |
| HEMBA1004347 | 65.249 | 32.610 | 97.858 | 37.038 | 21.953 | 33.115 | 33.526 | 36.846 |
| HEMBA1004349 | 22.353 | 35.727 | 29.441 | 19.803 | 18.786 | 23.126 | 19.103 | 18.719 |
| HEMBA1004352 | 75.508 | 65.544 | 237.050 | 49.039 | 34.141 | 32.597 | 28.166 | 46.343 |
| HEMBA1004353 | 54.322 | 66.042 | 132.169 | 40.563 | 27.380 | 39.551 | 30.556 | 56.886 |
| HEMBA1004354 | 43.687 | 29.352 | 79.264 | 22.784 | 20.533 | 21.755 | 16.860 | 22.429 |
| HEMBA1004356 | 44.730 | 22.201 | 27.487 | 10.404 | 8.280 | 22.159 | 16.039 | 15.038 |
| HEMBA1004360 | 91.412 | 28.429 | 71.634 | 26.232 | 36.259 | 59.602 | 38.361 | 50.410 |
| HEMBA1004366 | 9.956 | 10.099 | 14.263 | 5.481 | 5.631 | 6.802 | 6.791 | 6.167 |
| HEMBA1004372 | 3.613 | 4.593 | 5.338 | 0.000 | 1.638 | 1.507 | 3.555 | 1.568 |
| HEMBA1004377 | 53.834 | 41.410 | 47.048 | 29.140 | 26.163 | 34.545 | 30.827 | 33.572 |
| HEMBA1004389 | 20.540 | 22.800 | 24.474 | 14.497 | 13.968 | 16.620 | 14.951 | 17.114 |
| HEMBA1004391 | 60.284 | 22.653 | 44.013 | 14.283 | 19.018 | 31.716 | 23.931 | 23.617 |
| HEMBA1004393 | 177.786 | 197.548 | 108.554 | 32.455 | 75.399 | 76.587 | 39.772 | 44.665 |
| HEMBA1004394 | 28.949 | 11.849 | 12.442 | 5.544 | 10.440 | 17.825 | 10.981 | 8.836 |
| HEMBA1004396 | 37.907 | 26.956 | 102.760 | 18.571 | 16.519 | 15.025 | 13.681 | 21.980 |
| HEMBA1004401 | 22.519 | 21.858 | 30.601 | 14.945 | 13.592 | 15.418 | 20.530 | 20.774 |
| HEMBA1004405 | 42.933 | 38.835 | 117.844 | 34.528 | 23.557 | 19.155 | 18.550 | 29.842 |
| HEMBA1004408 | 50.497 | 27.151 | 55.000 | 25.559 | 15.351 | 19.522 | 15.546 | 20.863 |
| HEMBA1004414 | 45.769 | 51.722 | 64.316 | 19.655 | 19.324 | 39.735 | 26.527 | 36.385 |
| HEMBA1004429 | 61.867 | 59.067 | 190.058 | 39.014 | 50.304 | 38.462 | 27.517 | 46.317 |
| HEMBA1004433 | 49.568 | 39.828 | 146.938 | 37.521 | 28.383 | 24.241 | 24.651 | 42.005 |
| HEMBA1004440 | 31.849 | 22.499 | 37.132 | 18.742 | 22.366 | 23.183 | 21.969 | 35.073 |
| HEMBA1004444 | 59.488 | 46.586 | 163.763 | 30.695 | 29.990 | 24.833 | 22.908 | 37.635 |
| HEMBA1004446 | 22.134 | 12.309 | 29.426 | 11.920 | 3.385 | 14.862 | 10.855 | 16.078 |
| HEMBA1004451 | 31.688 | 21.261 | 28.136 | 18.194 | 15.678 | 19.695 | 21.159 | 27.156 |
| HEMBA1004452 | 36.593 | 5.268 | 18.479 | 3.443 | 5.737 | 17.680 | 14.173 | 7.972 |
| HEMBA1004454 | 50.056 | 27.897 | 32.786 | 24.382 | 20.631 | 24.494 | 22.897 | 29.042 |

TABLE 23

| | | | | | | | | |
|---|---|---|---|---|---|---|---|---|
| HEMBA1004460 | 138.550 | 96.143 | 356.058 | 74.883 | 54.735 | 70.698 | 38.344 | 55.945 |
| HEMBA1004461 | 64.074 | 19.163 | 24.808 | 12.846 | 16.373 | 23.508 | 22.827 | 10.137 |
| HEMBA1004468 | 134.439 | 72.774 | 210.409 | 77.409 | 60.142 | 56.229 | 42.361 | 49.457 |
| HEMBA1004479 | 82.994 | 32.899 | 92.282 | 35.519 | 44.435 | 43.183 | 31.836 | 37.116 |
| HEMBA1004482 | 5.602 | 7.682 | 11.248 | 36.034 | 2.926 | 5.535 | 5.693 | 5.972 |
| HEMBA1004491 | 16.736 | 6.285 | 17.615 | 14.018 | 11.729 | 19.804 | 10.683 | 11.280 |
| HEMBA1004499 | 94.095 | 71.456 | 148.355 | 58.479 | 48.596 | 46.968 | 46.648 | 57.279 |
| HEMBA1004502 | 21.523 | 9.344 | 18.265 | 7.282 | 9.979 | 2.762 | 3.174 | 13.389 |
| HEMBA1004505 | 26.042 | 15.980 | 43.855 | 17.516 | 15.469 | 22.190 | 22.873 | 15.812 |
| HEMBA1004506 | 12.004 | 29.395 | 42.664 | 21.849 | 21.426 | 14.469 | 9.224 | 9.845 |
| HEMBA1004507 | 96.377 | 87.688 | 99.177 | 103.472 | 34.160 | 81.068 | 54.939 | 151.142 |
| HEMBA1004509 | 52.657 | 14.880 | 19.120 | 16.228 | 17.009 | 24.783 | 24.565 | 13.476 |
| HEMBA1004523 | 20.156 | 18.209 | 11.197 | 16.529 | 14.651 | 13.004 | 20.267 | 19.467 |
| HEMBA1004528 | 42.620 | 27.819 | 48.069 | 14.426 | 25.267 | 43.038 | 40.239 | 37.718 |
| HEMBA1004534 | 75.090 | 41.159 | 44.399 | 31.300 | 16.686 | 31.317 | 21.009 | 18.589 |
| HEMBA1004536 | 31.531 | 13.343 | 23.664 | 14.085 | 4.408 | 13.133 | 12.981 | 15.201 |
| HEMBA1004538 | 352.363 | 181.508 | 233.819 | 97.018 | 122.402 | 183.507 | 100.197 | 150.062 |
| HEMBA1004542 | 47.360 | 17.733 | 29.238 | 17.280 | 12.324 | 17.317 | 22.764 | 15.212 |

TABLE 23-continued

| | | | | | | | | |
|---|---|---|---|---|---|---|---|---|
| HEMBA1004552 | 63.401 | 29.585 | 26.857 | 43.567 | 39.674 | 38.686 | 23.830 | 33.542 |
| HEMBA1004554 | 62.231 | 11.953 | 25.084 | 16.273 | 32.820 | 33.809 | 20.812 | 5.536 |
| HEMBA1004558 | 30.217 | 12.133 | 31.036 | 15.840 | 30.638 | 65.183 | 19.155 | 30.921 |
| HEMBA1004560 | 68.901 | 16.566 | 17.908 | 16.431 | 10.034 | 30.093 | 22.379 | 22.683 |
| HEMBA1004564 | 48.119 | 14.911 | 35.565 | 31.983 | 32.464 | 30.028 | 20.965 | 32.479 |
| HEMBA1004566 | 32.479 | 29.553 | 20.970 | 32.788 | 42.949 | 40.715 | 23.273 | 32.960 |
| HEMBA1004573 | 17.728 | 13.843 | 7.118 | 9.972 | 19.952 | 9.755 | 9.278 | 8.100 |
| HEMBA1004576 | 39.572 | 26.733 | 42.044 | 10.704 | 37.505 | 32.441 | 17.232 | 25.361 |
| HEMBA1004577 | 46.233 | 11.570 | 97.881 | 39.434 | 13.437 | 41.089 | 34.426 | 35.314 |
| HEMBA1004586 | 82.532 | 71.398 | 213.814 | 70.289 | 52.589 | 45.729 | 23.395 | 38.312 |
| HEMBA1004596 | 72.534 | 32.493 | 45.820 | 27.585 | 27.854 | 34.997 | 33.847 | 38.473 |
| HEMBA1004604 | 99.019 | 48.582 | 103.587 | 36.723 | 49.392 | 48.377 | 56.558 | 69.256 |
| HEMBA1004607 | 53.557 | 37.013 | 100.999 | 27.559 | 26.143 | 28.796 | 21.692 | 42.044 |
| HEMBA1004610 | 20.690 | 14.854 | 69.908 | 15.349 | 12.120 | 9.108 | 8.858 | 15.087 |
| HEMBA1004617 | 22.592 | 20.386 | 42.426 | 22.819 | 15.568 | 10.691 | 6.697 | 10.317 |
| HEMBA1004622 | 78.025 | 46.803 | 209.059 | 49.931 | 29.836 | 29.902 | 12.194 | 27.438 |
| HEMBA1004626 | 38.170 | 36.312 | 110.684 | 22.791 | 14.118 | 17.193 | 15.579 | 20.821 |
| HEMBA1004629 | 33.858 | 37.886 | 87.440 | 53.228 | 47.341 | 28.160 | 12.170 | 28.096 |
| HEMBA1004631 | 35.946 | 10.475 | 4.434 | 7.390 | 17.128 | 22.775 | 9.569 | 32.852 |
| HEMBA1004632 | 27.084 | 13.891 | 23.598 | 10.209 | 7.802 | 11.754 | 22.566 | 6.362 |
| HEMBA1004633 | 78.391 | 33.135 | 114.054 | 17.197 | 49.008 | 60.659 | 48.857 | 40.810 |
| HEMBA1004636 | 52.397 | 20.706 | 34.962 | 10.085 | 22.609 | 21.255 | 13.502 | 25.039 |
| HEMBA1004637 | 4.228 | 4.304 | 6.747 | 5.278 | 9.756 | 4.086 | 2.597 | 5.024 |
| HEMBA1004638 | 0.241 | 0.000 | 0.000 | 1.008 | 0.000 | 0.000 | 0.113 | 0.000 |
| HEMBA1004645 | 57.971 | 29.263 | 111.067 | 32.645 | 17.998 | 27.214 | 20.560 | 24.845 |
| HEMBA1004656 | 16.139 | 9.194 | 21.399 | 12.766 | 18.216 | 14.099 | 17.122 | 12.004 |
| HEMBA1004657 | 20.820 | 23.742 | 69.842 | 9.422 | 138.932 | 42.697 | 9.048 | 13.383 |
| HEMBA1004666 | 7.321 | 3.174 | 18.097 | 5.962 | 9.830 | 5.098 | 2.525 | 7.512 |
| HEMBA1004669 | 94.910 | 36.291 | 111.210 | 30.591 | 20.021 | 28.018 | 25.500 | 25.624 |
| HEMBA1004670 | 57.231 | 17.070 | 60.538 | 23.280 | 13.173 | 24.312 | 23.413 | 14.342 |
| HEMBA1004672 | 63.471 | 50.154 | 146.619 | 39.883 | 31.559 | 25.617 | 20.328 | 28.099 |
| HEMBA1004689 | 152.993 | 93.435 | 103.311 | 81.212 | 50.901 | 83.998 | 57.329 | 84.276 |
| HEMBA1004690 | 28.240 | 10.247 | 13.401 | 8.159 | 4.952 | 13.963 | 13.991 | 11.785 |
| HEMBA1004693 | 18.359 | 15.228 | 20.803 | 14.290 | 13.070 | 16.726 | 9.014 | 13.531 |
| HEMBA1004697 | 81.532 | 48.847 | 148.587 | 58.849 | 34.416 | 51.983 | 42.641 | 50.271 |
| HEMBA1004702 | 97.518 | 62.966 | 49.904 | 20.714 | 42.224 | 58.936 | 64.906 | 37.506 |
| HEMBA1004704 | 99.561 | 48.717 | 236.687 | 38.866 | 33.457 | 38.377 | 24.626 | 31.783 |
| HEMBA1004705 | 12.717 | 12.313 | 40.950 | 9.649 | 17.803 | 10.638 | 5.969 | 4.810 |
| HEMBA1004706 | 33.616 | 9.825 | 16.175 | 10.779 | 10.830 | 17.906 | 13.036 | 12.703 |
| HEMBA1004709 | 51.126 | 39.934 | 136.723 | 32.285 | 25.072 | 21.674 | 15.230 | 23.755 |
| HEMBA1004711 | 46.766 | 9.203 | 57.020 | 12.805 | 14.304 | 16.154 | 12.982 | 9.790 |
| HEMBA1004723 | 121.283 | 47.643 | 73.497 | 30.236 | 56.917 | 65.719 | 56.298 | 52.009 |
| HEMBA1004725 | 56.905 | 32.051 | 70.171 | 12.221 | 48.208 | 34.021 | 35.739 | 12.501 |
| HEMBA1004730 | 36.072 | 10.037 | 30.016 | 7.633 | 13.361 | 7.545 | 8.989 | 34.832 |
| HEMBA1004733 | 30.769 | 29.884 | 23.348 | 6.988 | 2.998 | 8.055 | 8.031 | 2.822 |
| HEMBA1004734 | 11.912 | 11.974 | 36.595 | 3.988 | 12.556 | 7.653 | 4.303 | 15.670 |

TABLE 24

| | | | | | | | | |
|---|---|---|---|---|---|---|---|---|
| HEMBA1004736 | 55.309 | 25.331 | 132.333 | 45.653 | 38.696 | 23.516 | 19.970 | 34.509 |
| HEMBA1004748 | 53.832 | 20.004 | 172.069 | 29.562 | 22.161 | 14.904 | 12.665 | 18.349 |
| HEMBA1004749 | 127.285 | 45.137 | 73.698 | 27.788 | 33.184 | 60.214 | 44.636 | 42.250 |
| HEMBA1004751 | 81.283 | 64.830 | 173.888 | 54.165 | 36.368 | 41.802 | 31.283 | 43.505 |
| HEMBA1004752 | 59.058 | 32.785 | 109.428 | 32.254 | 29.090 | 34.259 | 30.970 | 33.029 |
| HEMBA1004753 | 204.044 | 247.466 | 406.165 | 156.689 | 102.755 | 131.323 | 83.515 | 263.882 |
| HEMBA1004755 | 57.638 | 59.677 | 83.850 | 22.148 | 29.800 | 30.642 | 13.064 | 23.261 |
| HEMBA1004756 | 9.965 | 16.228 | 11.023 | 8.349 | 6.780 | 9.109 | 111.628 | 14.885 |
| HEMBA1004758 | 36.487 | 26.558 | 116.970 | 22.341 | 14.553 | 14.773 | 11.840 | 14.406 |
| HEMBA1004763 | 67.343 | 19.641 | 33.742 | 13.841 | 16.720 | 25.489 | 23.061 | 18.650 |
| HEMBA1004768 | 29.177 | 24.043 | 38.303 | 6.673 | 10.298 | 3.197 | 10.352 | 13.391 |
| HEMBA1004770 | 10.327 | 14.492 | 10.901 | 6.416 | 6.310 | 7.963 | 10.868 | 7.955 |
| HEMBA1004771 | 46.910 | 34.314 | 76.491 | 31.609 | 22.830 | 23.102 | 30.433 | 32.358 |
| HEMBA1004775 | 39.253 | 28.706 | 63.968 | 24.931 | 18.754 | 43.049 | 32.720 | 26.795 |
| HEMBA1004776 | 22.604 | 11.017 | 10.103 | 5.466 | 9.000 | 16.400 | 10.105 | 8.046 |
| HEMBA1004778 | 78.144 | 77.681 | 223.475 | 37.540 | 33.791 | 32.337 | 24.067 | 43.529 |
| HEMBA1004784 | 9.826 | 18.370 | 102.812 | 8.313 | 15.151 | 11.373 | 9.479 | 6.329 |
| HEMBA1004785 | 25.723 | 16.345 | 26.216 | 6.651 | 10.649 | 10.674 | 13.732 | 11.615 |
| HEMBA1004789 | 18.173 | 14.508 | 16.096 | 7.804 | 8.691 | 10.011 | 7.713 | 11.389 |
| HEMBA1004795 | 14.283 | 12.973 | 25.122 | 11.028 | 9.351 | 9.757 | 9.905 | 12.028 |
| HEMBA1004797 | 65.927 | 33.745 | 73.888 | 34.142 | 28.246 | 40.067 | 32.715 | 25.583 |
| HEMBA1004803 | 36.634 | 41.124 | 65.880 | 27.072 | 30.957 | 22.607 | 22.520 | 26.554 |
| HEMBA1004806 | 11.997 | 8.183 | 21.467 | 8.868 | 9.653 | 9.000 | 7.894 | 8.399 |
| HEMBA1004807 | 16.352 | 14.481 | 22.459 | 11.249 | 12.009 | 13.340 | 7.935 | 9.118 |
| HEMBA1004816 | 29.782 | 24.075 | 95.884 | 18.110 | 29.259 | 8.180 | 12.578 | 10.934 |
| HEMBA1004820 | 8.636 | 7.466 | 8.862 | 4.249 | 4.018 | 4.269 | 6.876 | 3.493 |
| HEMBA1004833 | 159.947 | 50.729 | 81.248 | 38.650 | 64.754 | 83.155 | 56.657 | 65.121 |

TABLE 24-continued

| | | | | | | | | |
|---|---|---|---|---|---|---|---|---|
| HEMBA1004847 | 51.456 | 25.570 | 40.694 | 21.115 | 36.572 | 35.053 | 31.537 | 40.529 |
| HEMBA1004850 | 77.254 | 24.014 | 38.620 | 21.854 | 26.080 | 54.413 | 50.197 | 24.185 |
| HEMBA1004863 | 57.117 | 32.704 | 72.480 | 23.951 | 31.887 | 25.058 | 20.050 | 20.982 |
| HEMBA1004864 | 46.043 | 27.344 | 59.824 | 26.750 | 13.898 | 16.719 | 20.308 | 17.843 |
| HEMBA1004865 | 12.257 | 14.642 | 31.748 | 44.090 | 14.331 | 13.454 | 13.835 | 15.797 |
| HEMBA1004880 | 56.788 | 50.021 | 126.837 | 35.420 | 26.589 | 24.064 | 20.647 | 23.264 |
| HEMBA1004882 | 42.450 | 18.453 | 29.340 | 16.782 | 13.013 | 13.652 | 10.676 | 19.977 |
| HEMBA1004885 | 8.545 | 4.947 | 5.350 | 4.891 | 2.933 | 3.711 | 3.652 | 6.615 |
| HEMBA1004889 | 28.103 | 22.485 | 32.049 | 17.078 | 14.363 | 23.391 | 15.605 | 16.916 |
| HEMBA1004900 | 19.922 | 15.709 | 33.254 | 10.423 | 9.045 | 6.539 | 5.245 | 9.440 |
| HEMBA1004909 | 88.522 | 49.269 | 163.284 | 48.147 | 35.537 | 36.045 | 18.861 | 27.933 |
| HEMBA1004918 | 64.384 | 43.134 | 105.868 | 34.899 | 22.323 | 24.073 | 15.857 | 25.370 |
| HEMBA1004923 | 47.731 | 37.996 | 69.168 | 19.659 | 26.441 | 18.192 | 10.213 | 20.111 |
| HEMBA1004929 | 11.048 | 14.003 | 10.808 | 12.050 | 7.539 | 9.882 | 8.967 | 11.809 |
| HEMBA1004930 | 101.277 | 92.425 | 279.652 | 80.664 | 66.618 | 34.331 | 31.091 | 41.874 |
| HEMBA1004933 | 9.145 | 5.566 | 12.895 | 7.786 | 12.296 | 10.327 | 96.467 | 5.417 |
| HEMBA1004934 | 7.311 | 7.106 | 43.966 | 10.208 | 4.750 | 5.866 | 9.143 | 12.805 |
| HEMBA1004937 | 43.331 | 27.219 | 38.802 | 15.368 | 17.734 | 15.280 | 15.784 | 46.365 |
| HEMBA1004943 | 51.072 | 26.833 | 32.001 | 21.614 | 16.458 | 27.585 | 29.628 | 38.533 |
| HEMBA1004944 | 84.363 | 46.788 | 126.294 | 43.803 | 28.989 | 38.514 | 31.589 | 23.074 |
| HEMBA1004946 | 64.638 | 28.144 | 37.908 | 17.163 | 24.332 | 27.854 | 34.636 | 31.712 |
| HEMBA1004952 | 90.835 | 18.893 | 40.862 | 12.824 | 20.090 | 33.568 | 20.062 | 19.020 |
| HEMBA1004954 | 14.656 | 36.003 | 41.485 | 27.126 | 23.696 | 20.777 | 6.946 | 29.261 |
| HEMBA1004956 | 5.975 | 9.923 | 6.635 | 7.743 | 0.953 | 4.578 | 1.565 | 5.188 |
| HEMBA1004960 | 86.030 | 77.420 | 136.061 | 60.735 | 49.221 | 47.560 | 29.646 | 45.929 |
| HEMBA1004971 | 31.046 | 5.439 | 7.559 | 12.468 | 17.946 | 16.068 | 19.705 | 18.480 |
| HEMBA1004972 | 77.318 | 38.259 | 56.654 | 35.819 | 27.295 | 40.233 | 30.004 | 50.710 |
| HEMBA1004973 | 35.524 | 13.502 | 16.731 | 9.641 | 11.726 | 14.716 | 19.197 | 22.580 |
| HEMBA1004977 | 6.756 | 9.870 | 11.419 | 9.684 | 29.373 | 8.701 | 2.217 | 10.523 |
| HEMBA1004978 | 8.689 | 11.088 | 13.909 | 9.999 | 5.158 | 5.699 | 2.642 | 10.106 |
| HEMBA1004980 | 34.093 | 33.440 | 87.268 | 25.974 | 18.071 | 16.453 | 11.605 | 22.124 |
| HEMBA1004982 | 14.750 | 8.271 | 17.944 | 9.205 | 8.250 | 11.553 | 6.083 | 5.456 |
| HEMBA1004983 | 38.285 | 13.488 | 20.831 | 11.831 | 3.348 | 10.309 | 11.455 | 8.305 |
| HEMBA1004995 | 27.256 | 28.515 | 26.297 | 18.434 | 25.474 | 22.491 | 24.452 | 33.683 |
| HEMBA1005004 | 13.855 | 10.490 | 33.238 | 10.381 | 7.816 | 13.134 | 7.576 | 14.698 |
| HEMBA1005008 | 64.714 | 26.633 | 22.502 | 18.478 | 23.532 | 28.617 | 18.581 | 16.940 |
| HEMBA1005009 | 34.543 | 15.673 | 19.462 | 18.045 | 14.122 | 26.432 | 12.593 | 23.116 |

TABLE 25

| | | | | | | | | |
|---|---|---|---|---|---|---|---|---|
| HEMBA1005019 | 49.260 | 24.872 | 25.349 | 20.834 | 30.144 | 32.629 | 20.777 | 27.016 |
| HEMBA1005021 | 37.224 | 63.713 | 38.065 | 17.061 | 15.647 | 20.369 | 25.859 | 32.656 |
| HEMBA1005029 | 30.265 | 17.783 | 35.352 | 16.531 | 19.588 | 26.517 | 15.798 | 16.604 |
| HEMBA1005035 | 393.404 | 200.167 | 574.746 | 133.872 | 210.689 | 177.872 | 156.563 | 170.510 |
| HEMBA1005036 | 115.345 | 41.961 | 73.015 | 39.541 | 44.451 | 66.623 | 55.833 | 51.349 |
| HEMBA1005039 | 28.850 | 19.922 | 57.018 | 13.971 | 11.999 | 26.427 | 15.206 | 7.350 |
| HEMBA1005047 | 93.995 | 31.868 | 54.335 | 18.576 | 28.338 | 31.562 | 31.930 | 23.751 |
| HEMBA1005050 | 78.015 | 41.690 | 73.330 | 29.830 | 26.504 | 35.887 | 21.640 | 35.653 |
| HEMBA1005062 | 23.050 | 15.803 | 29.553 | 15.707 | 7.836 | 15.618 | 19.435 | 13.336 |
| HEMBA1005066 | 10.980 | 11.364 | 31.553 | 13.509 | 5.668 | 10.541 | 5.005 | 10.849 |
| HEMBA1005067 | 39.308 | 34.578 | 39.795 | 44.519 | 24.643 | 21.272 | 19.379 | 20.121 |
| HEMBA1005070 | 73.155 | 34.949 | 68.556 | 29.956 | 38.004 | 38.211 | 48.007 | 31.733 |
| HEMBA1005075 | 88.089 | 37.798 | 148.675 | 40.537 | 33.271 | 33.074 | 28.661 | 30.201 |
| HEMBA1005078 | 100.064 | 37.746 | 66.827 | 33.115 | 41.170 | 55.560 | 51.231 | 17.112 |
| HEMBA1005079 | 137.757 | 86.238 | 294.118 | 73.304 | 76.035 | 75.084 | 47.255 | 76.170 |
| HEMBA1005083 | 18.102 | 7.642 | 17.087 | 6.711 | 6.184 | 8.675 | 9.287 | 9.609 |
| HEMBA1005084 | 82.712 | 38.248 | 47.063 | 26.664 | 27.435 | 37.552 | 38.419 | 28.349 |
| HEMBA1005088 | 31.610 | 22.435 | 76.774 | 22.700 | 18.926 | 23.875 | 8.895 | 12.447 |
| HEMBA1005089 | 68.944 | 55.156 | 178.226 | 34.742 | 32.350 | 38.645 | 22.869 | 28.148 |
| HEMBA1005090 | 148.861 | 86.156 | 117.997 | 94.811 | 57.034 | 81.098 | 54.187 | 116.066 |
| HEMBA1005096 | 83.125 | 30.911 | 63.940 | 33.378 | 33.962 | 48.589 | 35.467 | 36.021 |
| HEMBA1005101 | 69.080 | 14.020 | 34.136 | 10.197 | 13.998 | 34.420 | 22.696 | 15.975 |
| HEMBA1005107 | 82.659 | 25.203 | 36.223 | 11.215 | 21.514 | 32.720 | 25.972 | 21.337 |
| HEMBA1005113 | 7.977 | 17.225 | 31.501 | 7.563 | 44.493 | 5.157 | 6.957 | 9.761 |
| HEMBA1005123 | 173.637 | 77.260 | 555.672 | 126.908 | 94.628 | 90.446 | 70.735 | 90.016 |
| HEMBA1005133 | 58.192 | 40.749 | 122.920 | 29.864 | 16.700 | 17.652 | 8.802 | 18.988 |
| HEMBA1005135 | 8.259 | 9.125 | 14.962 | 2.213 | 16.732 | 6.892 | 3.383 | 6.189 |
| HEMBA1005145 | 185.299 | 101.220 | 352.159 | 92.082 | 88.750 | 122.118 | 76.475 | 90.044 |
| HEMBA1005149 | 220.122 | 109.352 | 274.492 | 120.663 | 125.192 | 96.704 | 92.083 | 128.030 |
| HEMBA1005152 | 125.948 | 96.291 | 226.882 | 58.505 | 33.738 | 46.323 | 27.534 | 34.457 |
| HEMBA1005159 | 15.760 | 11.274 | 9.399 | 6.198 | 6.191 | 6.861 | 12.001 | 4.556 |
| HEMBA1005172 | 1653.208 | 89.658 | 73.666 | 54.667 | 33.118 | 55.680 | 32.520 | 70.907 |
| HEMBA1005185 | 9.954 | 17.248 | 10.492 | 34.452 | 3.558 | 3.117 | 6.026 | 11.173 |
| HEMBA1005186 | 23.745 | 10.048 | 27.091 | 13.067 | 7.719 | 15.412 | 15.086 | 15.591 |
| HEMBA1005195 | 14.573 | 8.648 | 11.038 | 19.306 | 6.313 | 25.313 | 13.510 | 9.183 |
| HEMBA1005201 | 52.322 | 13.197 | 47.505 | 13.091 | 12.078 | 8.531 | 23.532 | 9.848 |

TABLE 25-continued

| | | | | | | | | |
|---|---|---|---|---|---|---|---|---|
| HEMBA1005202 | 98.566 | 30.141 | 71.588 | 27.954 | 44.381 | 66.294 | 42.390 | 39.695 |
| HEMBA1005204 | 184.429 | 287.156 | 382.039 | 168.753 | 203.458 | 222.970 | 143.609 | 358.646 |
| HEMBA1005206 | 148.946 | 61.309 | 84.791 | 34.139 | 49.115 | 66.295 | 83.608 | 76.159 |
| HEMBA1005219 | 21.685 | 17.755 | 9.606 | 8.236 | 8.038 | 13.031 | 7.751 | 11.441 |
| HEMBA1005223 | 79.969 | 42.665 | 113.460 | 40.547 | 32.099 | 53.017 | 26.025 | 32.004 |
| HEMBA1005229 | 26.819 | 9.926 | 21.841 | 3.135 | 5.090 | 6.656 | 4.681 | 7.079 |
| HEMBA1005230 | 71.184 | 67.313 | 201.065 | 79.279 | 59.679 | 77.484 | 47.808 | 66.511 |
| HEMBA1005232 | 7.374 | 6.386 | 17.522 | 8.552 | 3.285 | 12.098 | 4.975 | 3.965 |
| HEMBA1005238 | 96.780 | 44.134 | 51.932 | 8.128 | 20.776 | 69.291 | 49.474 | 35.019 |
| HEMBA1005241 | 142.598 | 104.185 | 428.635 | 78.773 | 78.033 | 74.434 | 42.333 | 63.097 |
| HEMBA1005244 | 76.771 | 32.597 | 37.797 | 16.459 | 12.489 | 35.934 | 31.814 | 35.602 |
| HEMBA1005246 | 241.316 | 60.348 | 73.077 | 25.067 | 41.351 | 117.666 | 88.193 | 54.014 |
| HEMBA1005251 | 37.505 | 33.247 | 108.631 | 23.585 | 14.915 | 23.393 | 14.302 | 16.409 |
| HEMBA1005252 | 53.401 | 25.532 | 37.199 | 15.002 | 20.744 | 31.279 | 24.207 | 27.562 |
| HEMBA1005267 | 17.238 | 39.564 | 20.097 | 27.506 | 31.874 | 11.013 | 14.526 | 14.024 |
| HEMBA1005274 | 16.538 | 8.744 | 18.308 | 9.021 | 10.103 | 11.943 | 8.914 | 11.978 |
| HEMBA1005275 | 69.133 | 43.329 | 216.468 | 46.290 | 57.647 | 37.411 | 25.040 | 41.913 |
| HEMBA1005288 | 65.401 | 50.495 | 150.714 | 33.833 | 34.633 | 28.241 | 24.910 | 40.164 |
| HEMBA1005293 | 17.403 | 9.430 | 23.201 | 4.467 | 3.192 | 25.620 | 6.775 | 8.771 |
| HEMBA1005296 | 223.097 | 811.623 | 894.835 | 738.361 | 220.523 | 698.319 | 418.435 | 1376.785 |
| HEMBA1005301 | 36.708 | 16.970 | 29.798 | 11.929 | 12.544 | 22.221 | 35.726 | 32.270 |
| HEMBA1005304 | 83.978 | 71.914 | 260.016 | 50.686 | 36.101 | 36.160 | 24.896 | 47.838 |
| HEMBA1005305 | 44.218 | 33.773 | 74.215 | 27.494 | 27.352 | 34.920 | 21.424 | 38.882 |
| HEMBA1005311 | 33.034 | 20.140 | 48.263 | 13.836 | 7.908 | 8.958 | 9.090 | 10.440 |
| HEMBA1005313 | 11.165 | 36.175 | 17.550 | 7.047 | 11.502 | 14.209 | 63.072 | 9.124 |
| HEMBA1005314 | 6.948 | 2.955 | 22.604 | 6.336 | 3.812 | 5.787 | 4.069 | 4.891 |
| HEMBA1005315 | 72.349 | 54.139 | 156.842 | 34.545 | 43.132 | 26.415 | 28.942 | 28.442 |
| HEMBA1005317 | 20.230 | 8.451 | 17.258 | 9.796 | 11.664 | 9.976 | 9.263 | 8.017 |

TABLE 26

| | | | | | | | | |
|---|---|---|---|---|---|---|---|---|
| HEMBA1005318 | 14.755 | 5.931 | 13.883 | 5.228 | 5.376 | 9.013 | 5.511 | 4.846 |
| HEMBA1005324 | 98.070 | 33.348 | 44.270 | 26.052 | 35.446 | 48.523 | 30.889 | 17.915 |
| HEMBA1005331 | 24.826 | 335.211 | 15.947 | 26.496 | 14.744 | 21.427 | 16.942 | 29.580 |
| HEMBA1005337 | 19.080 | 18.022 | 19.429 | 5.217 | 20.830 | 29.867 | 32.481 | 44.585 |
| HEMBA1005338 | 61.533 | 38.788 | 63.113 | 23.657 | 30.437 | 48.455 | 40.921 | 36.285 |
| HEMBA1005344 | 384.481 | 88.937 | 143.574 | 53.983 | 72.524 | 167.620 | 135.992 | 68.042 |
| HEMBA1005353 | 111.629 | 68.949 | 220.401 | 62.090 | 53.484 | 67.048 | 30.456 | 42.612 |
| HEMBA1005359 | 87.635 | 64.332 | 175.543 | 59.707 | 36.743 | 34.233 | 21.666 | 47.596 |
| HEMBA1005362 | 25.674 | 25.093 | 18.642 | 30.797 | 21.917 | 19.092 | 20.883 | 12.720 |
| HEMBA1005364 | 6.677 | 2.817 | 5.168 | 13.116 | 19.753 | 5.180 | 2.877 | 7.198 |
| HEMBA1005367 | 51.911 | 28.536 | 74.559 | 28.446 | 30.138 | 27.987 | 16.766 | 22.415 |
| HEMBA1005372 | 11.289 | 6.819 | 11.700 | 5.659 | 9.177 | 6.402 | 9.312 | 4.913 |
| HEMBA1005374 | 64.639 | 57.505 | 120.218 | 32.738 | 30.987 | 24.792 | 23.695 | 30.728 |
| HEMBA1005379 | 29.549 | 13.813 | 12.040 | 8.862 | 7.648 | 11.978 | 9.051 | 4.019 |
| HEMBA1005382 | 140.116 | 94.743 | 104.609 | 70.213 | 26.226 | 53.452 | 88.235 | 85.480 |
| HEMBA1005384 | 33.109 | 15.221 | 21.713 | 10.250 | 8.543 | 11.030 | 7.498 | 9.010 |
| HEMBA1005386 | 111.062 | 30.547 | 52.790 | 29.541 | 31.691 | 44.619 | 35.179 | 29.136 |
| HEMBA1005389 | 66.821 | 32.429 | 129.272 | 42.528 | 35.894 | 16.765 | 11.513 | 24.601 |
| HEMBA1005394 | 35.794 | 18.327 | 22.715 | 25.833 | 26.639 | 30.857 | 16.944 | 24.443 |
| HEMBA1005403 | 40.404 | 14.030 | 54.041 | 14.621 | 15.504 | 27.461 | 15.586 | 32.390 |
| HEMBA1005408 | 51.701 | 45.069 | 71.813 | 44.257 | 67.383 | 35.010 | 23.690 | 44.612 |
| HEMBA1005410 | 4.534 | 4.269 | 11.774 | 12.035 | 10.197 | 6.188 | 3.955 | 8.910 |
| HEMBA1005411 | 75.220 | 94.039 | 163.001 | 67.133 | 50.499 | 41.243 | 22.652 | 35.008 |
| HEMBA1005423 | 35.745 | 26.430 | 69.138 | 35.773 | 15.442 | 19.286 | 14.057 | 23.010 |
| HEMBA1005426 | 14.366 | 12.073 | 14.418 | 5.345 | 11.591 | 8.954 | 3.082 | 7.203 |
| HEMBA1005427 | 66.444 | 99.596 | 61.088 | 47.865 | 59.821 | 53.861 | 25.223 | 46.397 |
| HEMBA1005430 | 52.945 | 15.385 | 36.316 | 19.210 | 23.854 | 37.895 | 19.556 | 18.127 |
| HEMBA1005438 | 51.806 | 28.359 | 33.314 | 17.787 | 19.295 | 21.754 | 13.422 | 29.941 |
| HEMBA1005443 | 108.954 | 165.667 | 426.408 | 91.550 | 77.559 | 76.024 | 105.042 | 108.232 |
| HEMBA1005447 | 51.383 | 39.578 | 65.244 | 29.171 | 28.000 | 21.457 | 18.763 | 23.755 |
| HEMBA1005449 | 86.452 | 20.253 | 41.861 | 15.939 | 27.647 | 39.311 | 28.567 | 27.508 |
| HEMBA1005452 | 110.567 | 52.128 | 74.119 | 42.532 | 39.847 | 53.326 | 67.529 | 72.233 |
| HEMBA1005454 | 7.997 | 16.821 | 17.998 | 14.293 | 14.436 | 8.454 | 6.498 | 11.445 |
| HEMBA1005468 | 185.066 | 78.008 | 126.372 | 56.026 | 56.490 | 78.922 | 61.083 | 57.511 |
| HEMBA1005469 | 88.419 | 54.761 | 196.280 | 63.682 | 53.661 | 42.639 | 23.441 | 30.144 |
| HEMBA1005472 | 37.878 | 41.710 | 88.807 | 34.196 | 28.126 | 21.983 | 24.350 | 30.575 |
| HEMBA1005474 | 89.169 | 55.263 | 212.086 | 51.664 | 50.480 | 66.508 | 39.590 | 30.322 |
| HEMBA1005475 | 212.273 | 98.359 | 182.707 | 110.945 | 105.968 | 98.316 | 56.095 | 68.647 |
| HEMBA1005489 | 61.603 | 40.439 | 42.459 | 21.361 | 21.335 | 31.130 | 11.578 | 25.898 |
| HEMBA1005497 | 10.325 | 12.396 | 5.705 | 8.252 | 5.611 | 9.949 | 2.213 | 16.039 |
| HEMBA1005500 | 86.636 | 39.755 | 180.843 | 46.031 | 28.664 | 31.809 | 14.951 | 31.189 |
| HEMBA1005506 | 24.029 | 3.468 | 17.794 | 7.400 | 5.464 | 9.419 | 6.593 | 3.517 |
| HEMBA1005508 | 12.944 | 12.524 | 22.247 | 8.536 | 16.857 | 11.561 | 7.741 | 12.059 |
| HEMBA1005511 | 116.338 | 59.193 | 267.636 | 59.921 | 58.995 | 43.190 | 30.786 | 51.049 |
| HEMBA1005513 | 167.332 | 70.217 | 88.519 | 56.620 | 54.920 | 73.797 | 80.751 | 68.624 |

TABLE 26-continued

| | | | | | | | | |
|---|---|---|---|---|---|---|---|---|
| HEMBA1005517 | 37.667 | 10.443 | 23.901 | 8.903 | 17.777 | 21.966 | 23.844 | 18.611 |
| HEMBA1005518 | 109.105 | 25.679 | 71.345 | 23.319 | 36.856 | 47.397 | 27.618 | 27.825 |
| HEMBA1005520 | 200.267 | 104.176 | 459.373 | 133.255 | 106.207 | 95.070 | 67.199 | 94.086 |
| HEMBA1005522 | 36.421 | 15.946 | 24.796 | 12.598 | 8.472 | 14.558 | 16.899 | 13.857 |
| HEMBA1005526 | 116.274 | 72.899 | 292.397 | 82.002 | 73.603 | 66.198 | 34.319 | 47.682 |
| HEMBA1005528 | 13.037 | 9.406 | 30.550 | 14.612 | 15.947 | 16.516 | 7.583 | 24.988 |
| HEMBA1005530 | 56.516 | 26.583 | 63.811 | 13.686 | 21.441 | 29.159 | 24.254 | 21.717 |
| HEMBA1005538 | 5.523 | 17.373 | 36.952 | 7.017 | 10.885 | 11.406 | 15.411 | 35.789 |
| HEMBA1005539 | 76.498 | 30.847 | 69.424 | 17.584 | 24.989 | 35.829 | 28.772 | 25.913 |
| HEMBA1005545 | 46.912 | 10.940 | 32.124 | 15.206 | 46.822 | 33.595 | 31.865 | 24.090 |
| HEMBA1005548 | 57.779 | 14.326 | 15.050 | 10.139 | 18.638 | 22.115 | 22.271 | 39.291 |
| HEMBA1005552 | 41.489 | 120.695 | 363.831 | 84.934 | 81.893 | 79.223 | 60.281 | 62.088 |
| HEMBA1005558 | 52.488 | 20.021 | 24.397 | 9.638 | 22.919 | 24.422 | 21.466 | 8.178 |
| HEMBA1005568 | 74.152 | 61.206 | 184.989 | 53.681 | 38.261 | 33.077 | 24.038 | 37.014 |
| HEMBA1005570 | 54.151 | 68.747 | 74.768 | 17.273 | 26.562 | 31.212 | 27.080 | 30.221 |
| HEMBA1005576 | 71.454 | 57.260 | 39.016 | 21.283 | 8.931 | 30.461 | 29.371 | 19.991 |
| HEMBA1005577 | 40.771 | 13.448 | 21.181 | 13.021 | 6.610 | 18.266 | 12.838 | 10.181 |
| HEMBA1005581 | 81.577 | 27.270 | 38.708 | 10.847 | 19.565 | 33.479 | 28.804 | 16.842 |
| HEMBA1005582 | 24.681 | 30.135 | 30.933 | 14.220 | 7.764 | 10.454 | 12.847 | 13.157 |

TABLE 27

| | | | | | | | | |
|---|---|---|---|---|---|---|---|---|
| HEMBA1005583 | 23.564 | 22.466 | 98.629 | 9.735 | 10.545 | 12.468 | 10.523 | 17.884 |
| HEMBA1005588 | 96.041 | 96.264 | 266.022 | 69.126 | 54.588 | 44.105 | 34.310 | 52.441 |
| HEMBA1005593 | 61.102 | 40.350 | 125.688 | 37.987 | 35.953 | 41.577 | 39.834 | 47.357 |
| HEMBA1005595 | 52.429 | 18.652 | 31.240 | 8.095 | 8.750 | 14.586 | 12.433 | 7.264 |
| HEMBA1005597 | 125.119 | 43.335 | 90.414 | 24.402 | 44.780 | 74.946 | 66.352 | 45.322 |
| HEMBA1005606 | 141.646 | 66.667 | 95.041 | 30.084 | 57.974 | 107.329 | 84.655 | 46.145 |
| HEMBA1005609 | 77.991 | 60.190 | 244.951 | 52.002 | 41.602 | 40.406 | 26.928 | 42.614 |
| HEMBA1005616 | 47.760 | 62.865 | 190.870 | 42.670 | 41.809 | 32.256 | 23.683 | 43.139 |
| HEMBA1005621 | 33.797 | 18.993 | 22.515 | 11.333 | 11.545 | 16.964 | 12.122 | 13.910 |
| HEMBA1005627 | 128.661 | 66.487 | 148.021 | 45.359 | 42.161 | 42.054 | 30.884 | 43.319 |
| HEMBA1005628 | 43.539 | 36.758 | 85.714 | 25.524 | 46.601 | 19.229 | 82.784 | 36.636 |
| HEMBA1005631 | 21.340 | 8.467 | 38.068 | 22.476 | 18.318 | 17.813 | 12.599 | 28.199 |
| HEMBA1005632 | 113.190 | 73.661 | 233.637 | 59.097 | 45.388 | 52.090 | 29.944 | 37.461 |
| HEMBA1005634 | 123.668 | 195.912 | 390.579 | 101.523 | 107.528 | 72.729 | 54.939 | 130.473 |
| HEMBA1005662 | 15.391 | 11.345 | 23.021 | 7.453 | 5.561 | 13.084 | 8.973 | 5.282 |
| HEMBA1005666 | 33.844 | 30.419 | 34.983 | 13.220 | 31.573 | 24.609 | 13.796 | 28.043 |
| HEMBA1005670 | 91.667 | 63.609 | 255.523 | 57.730 | 46.927 | 45.285 | 23.794 | 46.684 |
| HEMBA1005671 | 63.448 | 55.388 | 34.948 | 26.297 | 20.567 | 2.367 | 5.666 | 13.509 |
| HEMBA1005679 | 53.089 | 33.284 | 126.705 | 39.666 | 32.151 | 40.446 | 37.522 | 36.817 |
| HEMBA1005680 | 115.289 | 72.018 | 220.408 | 76.653 | 55.707 | 68.735 | 32.613 | 36.282 |
| HEMBA1005685 | 68.783 | 46.211 | 72.197 | 30.110 | 32.724 | 43.022 | 37.740 | 33.510 |
| HEMBA1005698 | 37.890 | 35.679 | 44.793 | 29.794 | 25.150 | 48.613 | 15.651 | 20.648 |
| HEMBA1005699 | 14.243 | 17.539 | 37.269 | 9.035 | 12.276 | 5.454 | 5.259 | 6.787 |
| HEMBA1005703 | 19.524 | 15.116 | 20.249 | 7.662 | 15.489 | 11.648 | 8.488 | 10.229 |
| HEMBA1005705 | 35.316 | 35.677 | 66.552 | 26.492 | 29.605 | 90.298 | 18.303 | 44.730 |
| HEMBA1005712 | 20.312 | 29.695 | 30.267 | 17.829 | 17.668 | 17.695 | 14.517 | 23.820 |
| HEMBA1005717 | 47.313 | 15.037 | 30.499 | 6.950 | 13.391 | 32.044 | 15.084 | 7.078 |
| HEMBA1005718 | 88.576 | 81.734 | 176.773 | 75.414 | 46.080 | 58.797 | 49.803 | 76.705 |
| HEMBA1005721 | 84.981 | 42.340 | 58.434 | 18.134 | 34.246 | 43.284 | 34.523 | 41.460 |
| HEMBA1005722 | 174.952 | 92.346 | 194.868 | 55.652 | 48.768 | 63.471 | 92.755 | 56.031 |
| HEMBA1005724 | 32.655 | 8.284 | 5.342 | 4.000 | 14.801 | 15.671 | 9.324 | 5.953 |
| HEMBA1005732 | 89.624 | 24.907 | 32.546 | 5.638 | 21.753 | 30.046 | 28.487 | 20.595 |
| HEMBA1005737 | 25.179 | 16.797 | 16.017 | 10.703 | 12.731 | 12.444 | 8.579 | 7.257 |
| HEMBA1005742 | 11.547 | 23.162 | 24.345 | 20.921 | 29.934 | 18.597 | 13.749 | 22.702 |
| HEMBA1005746 | 36.098 | 14.407 | 21.907 | 16.923 | 13.431 | 12.235 | 10.908 | 8.606 |
| HEMBA1005747 | 80.718 | 30.396 | 44.843 | 21.861 | 30.274 | 80.588 | 47.082 | 26.037 |
| HEMBA1005749 | 35.749 | 31.758 | 64.769 | 22.766 | 28.853 | 26.733 | 31.698 | 30.753 |
| HEMBA1005755 | 34.680 | 39.133 | 30.663 | 37.837 | 21.308 | 24.392 | 15.905 | 25.470 |
| HEMBA1005760 | 118.125 | 41.490 | 33.276 | 25.724 | 28.933 | 46.295 | 36.173 | 31.205 |
| HEMBA1005765 | 94.451 | 70.516 | 200.826 | 48.023 | 37.340 | 35.414 | 31.098 | 40.041 |
| HEMBA1005766 | 112.861 | 70.359 | 87.247 | 48.958 | 51.073 | 52.147 | 72.391 | 63.859 |
| HEMBA1005780 | 55.961 | 34.713 | 89.816 | 28.466 | 46.254 | 28.283 | 25.156 | 29.122 |
| HEMBA1005795 | 18.800 | 38.386 | 19.666 | 10.007 | 13.009 | 11.811 | 13.106 | 14.493 |
| HEMBA1005809 | 67.301 | 66.510 | 87.390 | 53.061 | 43.975 | 35.574 | 35.334 | 57.818 |
| HEMBA1005813 | 52.911 | 84.881 | 160.064 | 38.752 | 43.727 | 30.799 | 23.426 | 57.177 |
| HEMBA1005815 | 30.398 | 30.434 | 43.366 | 19.911 | 16.123 | 39.746 | 26.743 | 28.548 |
| HEMBA1005822 | 40.948 | 47.746 | 65.298 | 51.932 | 30.845 | 20.187 | 22.641 | 29.114 |
| HEMBA1005829 | 114.982 | 70.536 | 272.004 | 48.816 | 36.558 | 40.259 | 23.443 | 35.824 |
| HEMBA1005833 | 59.540 | 25.743 | 29.266 | 15.545 | 24.711 | 26.964 | 17.968 | 18.807 |
| HEMBA1005834 | 151.440 | 82.917 | 322.413 | 102.348 | 74.711 | 59.590 | 35.082 | 70.415 |
| HEMBA1005844 | 66.624 | 11.865 | 96.556 | 95.719 | 56.133 | 75.546 | 55.974 | 122.840 |
| HEMBA1005852 | 71.743 | 77.830 | 72.218 | 53.009 | 85.623 | 78.593 | 90.291 | 87.310 |
| HEMBA1005853 | 62.809 | 83.326 | 343.381 | 63.897 | 79.208 | 48.939 | 27.359 | 58.468 |
| HEMBA1005878 | 139.991 | 109.928 | 447.600 | 93.748 | 65.325 | 53.917 | 35.383 | 63.446 |

TABLE 27-continued

| | | | | | | | | |
|---|---|---|---|---|---|---|---|---|
| HEMBA1005883 | 5.211 | 6.310 | 6.808 | 14.769 | 10.070 | 6.635 | 4.486 | 11.850 |
| HEMBA1005884 | 9.136 | 10.768 | 29.442 | 9.504 | 7.302 | 9.142 | 4.561 | 12.287 |
| HEMBA1005891 | 8.927 | 12.500 | 12.662 | 5.996 | 7.370 | 7.346 | 1.250 | 5.470 |
| HEMBA1005894 | 70.006 | 59.347 | 177.879 | 49.407 | 29.584 | 23.227 | 14.651 | 36.934 |
| HEMBA1005898 | 84.399 | 61.254 | 234.549 | 59.872 | 43.955 | 25.491 | 23.019 | 41.130 |
| HEMBA1005902 | 38.306 | 16.873 | 52.804 | 16.742 | 33.189 | 39.317 | 26.778 | 43.681 |
| HEMBA1005907 | 4.806 | 3.997 | 8.804 | 5.339 | 3.957 | 17.078 | 5.311 | 4.941 |
| HEMBA1005909 | 4.140 | 3.733 | 23.479 | 2.443 | 4.661 | 6.683 | 0.750 | 10.643 |
| HEMBA1005911 | 143.926 | 92.633 | 316.302 | 83.107 | 51.954 | 60.593 | 39.302 | 55.189 |
| HEMBA1005912 | 18.801 | 17.269 | 13.568 | 32.298 | 21.976 | 14.454 | 12.917 | 26.318 |

TABLE 28

| | | | | | | | | |
|---|---|---|---|---|---|---|---|---|
| HEMBA1005913 | 10.533 | 16.117 | 14.368 | 16.655 | 8.179 | 7.135 | 7.907 | 12.918 |
| HEMBA1005921 | 83.262 | 45.648 | 252.573 | 51.044 | 41.764 | 22.286 | 23.762 | 46.202 |
| HEMBA1005922 | 64.440 | 17.427 | 35.136 | 20.084 | 33.779 | 24.835 | 18.394 | 14.883 |
| HEMBA1005929 | 173.002 | 139.696 | 378.444 | 96.543 | 83.075 | 72.298 | 55.205 | 94.716 |
| HEMBA1005931 | 146.354 | 89.551 | 224.601 | 83.623 | 63.406 | 73.122 | 54.973 | 59.891 |
| HEMBA1005934 | 141.558 | 91.791 | 227.012 | 89.834 | 99.341 | 96.876 | 62.967 | 55.492 |
| HEMBA1005945 | 144.693 | 21.871 | 38.980 | 19.915 | 46.699 | 78.590 | 80.430 | 30.052 |
| HEMBA1005962 | 67.209 | 34.719 | 63.745 | 21.004 | 17.931 | 29.331 | 21.199 | 20.008 |
| HEMBA1005963 | 18.320 | 6.954 | 9.127 | 5.913 | 2.497 | 8.674 | 7.674 | 4.873 |
| HEMBA1005990 | 581.646 | 117.336 | 139.967 | 53.671 | 242.262 | 424.182 | 418.873 | 85.511 |
| HEMBA1005991 | 67.437 | 59.327 | 188.570 | 42.994 | 21.101 | 33.868 | 19.164 | 11.619 |
| HEMBA1005999 | 193.878 | 135.695 | 450.789 | 126.399 | 129.150 | 103.289 | 53.193 | 115.911 |
| HEMBA1006002 | 73.560 | 26.438 | 22.156 | 12.657 | 16.731 | 16.116 | 10.600 | 19.305 |
| HEMBA1006005 | 59.620 | 7.083 | 16.863 | 8.213 | 29.019 | 53.513 | 52.130 | 23.838 |
| HEMBA1006011 | 25.811 | 30.413 | 39.888 | 21.434 | 54.488 | 30.978 | 27.996 | 25.339 |
| HEMBA1006013 | 51.604 | 13.251 | 19.743 | 11.817 | 15.364 | 28.363 | 21.493 | 18.674 |
| HEMBA1006016 | 101.929 | 42.149 | 115.996 | 36.228 | 39.875 | 46.607 | 33.305 | 26.397 |
| HEMBA1006019 | 31.772 | 18.482 | 22.979 | 15.207 | 22.984 | 24.244 | 26.246 | 14.100 |
| HEMBA1006021 | 26.984 | 10.213 | 45.937 | 9.253 | 20.615 | 14.587 | 14.203 | 12.296 |
| HEMBA1006022 | 100.930 | 40.046 | 62.368 | 42.744 | 23.660 | 46.057 | 25.008 | 19.323 |
| HEMBA1006031 | 42.088 | 41.281 | 14.729 | 11.264 | 12.725 | 36.716 | 13.037 | 5.133 |
| HEMBA1006035 | 10.089 | 10.059 | 27.290 | 8.123 | 6.309 | 6.629 | 2.039 | 5.229 |
| HEMBA1006036 | 188.431 | 82.469 | 443.914 | 119.939 | 80.135 | 81.126 | 54.157 | 94.631 |
| HEMBA1006042 | 69.906 | 33.773 | 134.462 | 30.108 | 23.244 | 29.765 | 29.479 | 29.607 |
| HEMBA1006044 | 53.721 | 10.199 | 12.818 | 4.725 | 8.467 | 5.436 | 2.586 | 4.088 |
| HEMBA1006045 | 48.078 | 43.730 | 61.128 | 28.336 | 25.311 | 26.461 | 23.478 | 44.272 |
| HEMBA1006048 | 35.685 | 18.435 | 41.495 | 19.225 | 19.636 | 34.213 | 26.302 | 28.809 |
| HEMBA1006053 | 0.000 | 356.500 | 78.844 | 24.270 | 47.030 | 114.986 | 63.574 | 385.970 |
| HEMBA1006055 | 7.603 | 5.331 | 12.625 | 4.484 | 13.776 | 12.227 | 9.079 | 5.545 |
| HEMBA1006058 | 51.872 | 19.394 | 14.828 | 7.834 | 11.877 | 25.640 | 15.830 | 21.486 |
| HEMBA1006063 | 72.886 | 52.429 | 63.882 | 34.021 | 30.125 | 39.536 | 28.303 | 35.860 |
| HEMBA1006067 | 6.005 | 14.253 | 7.505 | 3.169 | 2.242 | 3.352 | 4.358 | 0.888 |
| HEMBA1006081 | 70.282 | 19.151 | 25.838 | 8.981 | 9.908 | 26.560 | 16.837 | 23.976 |
| HEMBA1006089 | 54.392 | 23.145 | 42.709 | 18.278 | 17.433 | 17.768 | 18.372 | 23.981 |
| HEMBA1006090 | 71.092 | 20.389 | 36.832 | 15.386 | 17.868 | 38.904 | 35.031 | 18.238 |
| HEMBA1006091 | 69.022 | 28.947 | 126.425 | 16.353 | 30.302 | 56.034 | 53.660 | 66.468 |
| HEMBA1006093 | 111.885 | 11.435 | 50.738 | 16.185 | 27.687 | 43.178 | 26.048 | 14.980 |
| HEMBA1006099 | 40.381 | 27.136 | 39.149 | 18.199 | 31.100 | 31.158 | 28.536 | 26.484 |
| HEMBA1006100 | 36.979 | 48.991 | 259.267 | 41.090 | 50.094 | 24.833 | 13.379 | 34.466 |
| HEMBA1006108 | 40.170 | 19.301 | 21.811 | 11.126 | 8.795 | 12.441 | 8.780 | 16.453 |
| HEMBA1006114 | 42.849 | 44.783 | 46.702 | 33.193 | 23.220 | 34.626 | 28.294 | 51.756 |
| HEMBA1006121 | 160.208 | 21.943 | 26.728 | 10.160 | 21.331 | 17.129 | 26.838 | 25.137 |
| HEMBA1006124 | 63.151 | 11.764 | 15.994 | 17.764 | 14.099 | 57.249 | 29.200 | 8.240 |
| HEMBA1006125 | 72.730 | 70.406 | 57.020 | 50.057 | 45.287 | 40.856 | 45.665 | 68.939 |
| HEMBA1006130 | 36.221 | 31.688 | 34.742 | 7.817 | 28.246 | 34.473 | 25.726 | 21.315 |
| HEMBA1006138 | 160.258 | 170.815 | 435.120 | 106.719 | 139.660 | 100.947 | 67.854 | 89.604 |
| HEMBA1006142 | 127.194 | 85.725 | 238.562 | 54.531 | 52.936 | 65.032 | 45.938 | 59.791 |
| HEMBA1006150 | 66.777 | 58.231 | 76.666 | 59.941 | 19.605 | 46.114 | 33.261 | 75.731 |
| HEMBA1006151 | 189.265 | 57.959 | 104.921 | 29.646 | 46.546 | 66.736 | 74.155 | 88.383 |
| HEMBA1006155 | 141.288 | 19.560 | 50.142 | 11.752 | 32.711 | 79.435 | 60.621 | 32.838 |
| HEMBA1006158 | 17.276 | 12.039 | 19.210 | 7.139 | 7.468 | 23.241 | 7.360 | 13.357 |
| HEMBA1006164 | 140.272 | 70.843 | 382.965 | 97.488 | 87.832 | 69.460 | 42.210 | 85.135 |
| HEMBA1006171 | 66.839 | 48.304 | 34.618 | 13.911 | 21.700 | 40.783 | 26.049 | 37.233 |
| HEMBA1006173 | 63.939 | 35.393 | 52.598 | 22.894 | 32.403 | 35.413 | 40.872 | 67.870 |
| HEMBA1006176 | 51.671 | 222.661 | 52.703 | 39.369 | 29.305 | 59.271 | 24.272 | 83.343 |
| HEMBA1006182 | 72.842 | 38.362 | 132.455 | 29.730 | 26.735 | 30.382 | 19.907 | 34.405 |
| HEMBA1006197 | 16.655 | 31.338 | 37.528 | 55.808 | 23.143 | 18.848 | 13.456 | 40.765 |
| HEMBA1006198 | 30.466 | 15.178 | 21.337 | 16.185 | 25.764 | 15.643 | 14.389 | 18.561 |
| HEMBA1006213 | 38.783 | 20.120 | 38.136 | 15.627 | 10.604 | 25.761 | 21.716 | 35.282 |
| HEMBA1006217 | 32.003 | 18.510 | 33.960 | 4.079 | 17.107 | 31.016 | 36.526 | 19.419 |
| HEMBA1006226 | 40.304 | 60.090 | 110.529 | 40.359 | 39.915 | 62.796 | 35.202 | 59.281 |
| HEMBA1006235 | 40.954 | 9.021 | 21.361 | 7.280 | 14.241 | 13.056 | 4.951 | 7.077 |
| HEMBA1006248 | 42.946 | 17.521 | 32.092 | 10.747 | 12.992 | 19.331 | 18.339 | 17.999 |
| HEMBA1006251 | 84.944 | 24.303 | 30.554 | 15.291 | 24.212 | 30.870 | 18.154 | 10.996 |

TABLE 29

| | | | | | | | | |
|---|---|---|---|---|---|---|---|---|
| HEMBA1006252 | 36.069 | 24.612 | 74.170 | 29.506 | 28.055 | 19.517 | 14.085 | 15.356 |
| HEMBA1006253 | 75.854 | 7.002 | 20.773 | 16.455 | 11.705 | 12.936 | 6.506 | 11.398 |
| HEMBA1006259 | 37.456 | 48.402 | 136.000 | 39.735 | 19.462 | 25.242 | 19.832 | 25.931 |
| HEMBA1006261 | 23.677 | 23.578 | 6.874 | 13.012 | 7.127 | 69.427 | 7.141 | 17.143 |
| HEMBA1006268 | 35.886 | 12.563 | 30.879 | 8.970 | 7.077 | 19.793 | 22.288 | 18.289 |
| HEMBA1006271 | 122.980 | 98.618 | 185.469 | 77.610 | 45.268 | 47.910 | 36.533 | 47.867 |
| HEMBA1006272 | 16.261 | 12.829 | 9.416 | 4.968 | 5.925 | 27.766 | 15.997 | 7.567 |
| HEMBA1006273 | 47.890 | 12.641 | 71.219 | 20.880 | 30.446 | 30.473 | 18.419 | 22.459 |
| HEMBA1006276 | 79.296 | 11.878 | 30.854 | 34.032 | 8.760 | 27.168 | 16.165 | 7.501 |
| HEMBA1006278 | 40.093 | 7.717 | 26.091 | 4.506 | 18.669 | 11.680 | 11.224 | 9.893 |
| HEMBA1006283 | 16.994 | 23.586 | 25.614 | 25.226 | 23.447 | 59.086 | 28.267 | 25.848 |
| HEMBA1006284 | 29.982 | 22.166 | 27.891 | 20.874 | 8.594 | 18.386 | 15.293 | 13.396 |
| HEMBA1006291 | 22.745 | 13.071 | 36.861 | 9.670 | 4.059 | 11.649 | 31.851 | 7.519 |
| HEMBA1006292 | 17.718 | 8.916 | 20.081 | 10.169 | 4.378 | 7.903 | 9.259 | 7.898 |
| HEMBA1006293 | 31.307 | 10.056 | 8.749 | 4.645 | 4.097 | 6.631 | 8.473 | 7.189 |
| HEMBA1006299 | 21.091 | 5.917 | 6.157 | 1.371 | 4.543 | 2.465 | 1.701 | 2.648 |
| HEMBA1006309 | 69.975 | 25.568 | 110.869 | 33.191 | 19.510 | 31.160 | 24.850 | 17.764 |
| HEMBA1006310 | 40.983 | 23.265 | 36.585 | 20.570 | 11.748 | 29.056 | 27.263 | 17.748 |
| HEMBA1006311 | 85.398 | 20.844 | 64.711 | 8.925 | 20.171 | 92.798 | 9.481 | 19.313 |
| HEMBA1006313 | 27.762 | 12.975 | 47.707 | 17.417 | 7.455 | 13.117 | 9.891 | 6.082 |
| HEMBA1006316 | 23.345 | 3.751 | 3.303 | 2.158 | 8.774 | 9.668 | 8.505 | 3.270 |
| HEMBA1006328 | 79.937 | 83.744 | 185.981 | 41.111 | 28.820 | 37.527 | 35.377 | 85.968 |
| HEMBA1006334 | 22.524 | 16.717 | 17.679 | 5.994 | 8.506 | 9.813 | 3.866 | 5.361 |
| HEMBA1006335 | 72.666 | 41.477 | 35.235 | 27.435 | 6.110 | 5.851 | 24.375 | 8.434 |
| HEMBA1006344 | 34.707 | 67.866 | 132.978 | 46.518 | 34.812 | 40.158 | 41.934 | 25.330 |
| HEMBA1006347 | 34.301 | 16.445 | 32.190 | 19.603 | 16.749 | 20.762 | 20.884 | 15.376 |
| HEMBA1006349 | 139.389 | 26.300 | 48.767 | 43.275 | 22.026 | 24.648 | 22.876 | 21.499 |
| HEMBA1006352 | 21.127 | 17.873 | 15.526 | 9.410 | 8.472 | 14.845 | 7.491 | 9.414 |
| HEMBA1006357 | 94.337 | 82.319 | 287.531 | 67.888 | 76.120 | 47.179 | 41.500 | 59.557 |
| HEMBA1006358 | 48.925 | 31.345 | 132.494 | 32.473 | 25.019 | 28.197 | 13.250 | 24.899 |
| HEMBA1006359 | 57.203 | 18.522 | 160.314 | 70.923 | 17.441 | 30.686 | 11.154 | 47.991 |
| HEMBA1006360 | 29.518 | 10.133 | 15.515 | 17.275 | 6.141 | 13.876 | 6.804 | 8.361 |
| HEMBA1006364 | 59.236 | 7.900 | 27.522 | 12.114 | 5.401 | 15.432 | 17.981 | 6.672 |
| HEMBA1006377 | 67.120 | 31.113 | 57.269 | 33.567 | 23.849 | 45.246 | 31.609 | 20.280 |
| HEMBA1006380 | 73.227 | 57.029 | 182.581 | 57.870 | 22.288 | 33.416 | 23.616 | 40.932 |
| HEMBA1006381 | 359.346 | 122.755 | 376.090 | 126.304 | 112.826 | 146.346 | 91.469 | 93.252 |
| HEMBA1006385 | 60.234 | 62.166 | 257.945 | 59.429 | 59.157 | 40.136 | 35.385 | 17.281 |
| HEMBA1006390 | 71.393 | 38.752 | 46.828 | 25.848 | 16.455 | 41.253 | 16.013 | 27.609 |
| HEMBA1006391 | 61.261 | 18.765 | 20.686 | 10.972 | 10.022 | 39.431 | 27.305 | 11.797 |
| HEMBA1006398 | 42.089 | 3.225 | 18.036 | 5.299 | 25.386 | 6.480 | 0.000 | 3.308 |
| HEMBA1006405 | 137.413 | 28.645 | 40.904 | 17.896 | 18.180 | 84.926 | 41.325 | 24.773 |
| HEMBA1006410 | 149.580 | 32.840 | 61.022 | 20.027 | 39.718 | 54.551 | 23.826 | 33.928 |
| HEMBA1006416 | 96.031 | 62.892 | 198.896 | 50.538 | 38.551 | 37.025 | 37.809 | 33.447 |
| HEMBA1006418 | 23.236 | 18.335 | 23.851 | 11.378 | 10.280 | 28.208 | 46.245 | 36.223 |
| HEMBA1006419 | 189.293 | 101.979 | 476.145 | 90.626 | 79.213 | 64.306 | 40.042 | 52.384 |
| HEMBA1006421 | 39.702 | 26.487 | 127.221 | 23.773 | 16.184 | 14.460 | 12.270 | 13.523 |
| HEMBA1006424 | 4.484 | 36.452 | 10.588 | 3.778 | 4.512 | 7.346 | 2.324 | 3.323 |
| HEMBA1006426 | 88.597 | 67.224 | 230.530 | 60.836 | 32.273 | 40.489 | 17.284 | 36.244 |
| HEMBA1006430 | 61.672 | 17.989 | 69.151 | 15.913 | 11.038 | 15.595 | 9.696 | 17.632 |
| HEMBA1006438 | 45.084 | 34.475 | 111.512 | 27.012 | 15.035 | 34.111 | 12.678 | 11.056 |
| HEMBA1006445 | 48.245 | 13.919 | 53.981 | 9.326 | 15.672 | 34.167 | 27.442 | 18.331 |
| HEMBA1006446 | 22.911 | 3.160 | 3.324 | 1.568 | 4.341 | 2.585 | 1.331 | 0.000 |
| HEMBA1006456 | 36.915 | 28.165 | 141.114 | 18.927 | 65.823 | 33.549 | 13.651 | 33.405 |
| HEMBA1006461 | 60.747 | 42.392 | 161.108 | 40.447 | 22.274 | 32.823 | 18.018 | 27.165 |
| HEMBA1006467 | 13.357 | 6.130 | 15.734 | 10.759 | 4.032 | 4.471 | 6.183 | 2.655 |
| HEMBA1006470 | 73.960 | 30.706 | 103.625 | 27.235 | 29.870 | 33.756 | 33.818 | 24.286 |
| HEMBA1006471 | 19.032 | 4.504 | 7.503 | 2.933 | 2.522 | 5.224 | 10.020 | 1.873 |
| HEMBA1006474 | 25.718 | 12.420 | 21.381 | 11.498 | 9.614 | 19.875 | 17.655 | 13.491 |
| HEMBA1006476 | 180.042 | 91.936 | 63.588 | 43.462 | 42.248 | 109.725 | 88.725 | 65.945 |
| HEMBA1006482 | 129.627 | 169.312 | 167.982 | 151.338 | 57.839 | 95.521 | 75.480 | 239.325 |
| HEMBA1006483 | 99.620 | 64.773 | 232.207 | 50.445 | 29.074 | 37.572 | 23.818 | 27.130 |
| HEMBA1006485 | 41.690 | 4.055 | 17.445 | 11.682 | 4.522 | 9.351 | 6.411 | 10.066 |
| HEMBA1006486 | 76.250 | 36.421 | 29.634 | 46.687 | 17.302 | 21.229 | 17.832 | 15.706 |
| HEMBA1006489 | 5.771 | 32.673 | 2.141 | 5.240 | 2.356 | 4.324 | 4.739 | 7.328 |

TABLE 30

| | | | | | | | | |
|---|---|---|---|---|---|---|---|---|
| HEMBA1006492 | 14.002 | 19.916 | 24.662 | 35.451 | 8.836 | 8.075 | 11.419 | 12.090 |
| HEMBA1006494 | 7.279 | 0.000 | 19.790 | 3.750 | 8.718 | 8.343 | 5.851 | 5.887 |
| HEMBA1006497 | 41.284 | 12.396 | 23.326 | 6.590 | 7.186 | 11.228 | 9.062 | 5.781 |
| HEMBA1006501 | 160.565 | 16.895 | 26.893 | 13.446 | 17.608 | 65.467 | 41.560 | 6.197 |
| HEMBA1006502 | 53.451 | 19.114 | 39.593 | 25.366 | 10.919 | 15.054 | 17.536 | 15.658 |
| HEMBA1006507 | 19.274 | 8.180 | 10.287 | 4.521 | 7.939 | 5.288 | 15.480 | 10.062 |
| HEMBA1006517 | 95.989 | 30.085 | 91.871 | 18.732 | 21.918 | 45.881 | 29.819 | 16.672 |
| HEMBA1006521 | 31.224 | 27.873 | 37.864 | 18.318 | 9.774 | 14.205 | 14.646 | 13.907 |
| HEMBA1006529 | 28.702 | 20.010 | 34.050 | 20.150 | 16.588 | 7.353 | 8.993 | 17.327 |

TABLE 30-continued

| | | | | | | | | |
|---|---|---|---|---|---|---|---|---|
| HEMBA1006530 | 18.445 | 16.411 | 29.175 | 14.433 | 12.214 | 16.734 | 15.731 | 8.081 |
| HEMBA1006535 | 11.627 | 7.208 | 18.048 | 3.956 | 8.160 | 19.824 | 5.837 | 3.457 |
| HEMBA1006536 | 68.087 | 40.009 | 142.475 | 43.263 | 34.343 | 42.050 | 42.157 | 23.975 |
| HEMBA1006540 | 20.393 | 10.867 | 35.153 | 8.637 | 8.656 | 15.027 | 11.094 | 10.350 |
| HEMBA1006544 | 30.281 | 4.662 | 59.940 | 7.791 | 7.169 | 15.883 | 8.745 | 8.693 |
| HEMBA1006546 | 68.722 | 53.155 | 127.193 | 49.337 | 73.807 | 60.506 | 22.328 | 34.045 |
| HEMBA1006549 | 13.885 | 13.666 | 21.800 | 11.666 | 8.491 | 14.211 | 8.987 | 6.080 |
| HEMBA1006559 | 26.976 | 22.040 | 38.197 | 16.910 | 14.550 | 14.058 | 13.018 | 17.217 |
| HEMBA1006562 | 55.924 | 24.663 | 75.789 | 20.363 | 17.181 | 26.651 | 18.158 | 19.510 |
| HEMBA1006566 | 20.849 | 6.116 | 14.933 | 8.767 | 9.572 | 6.937 | 5.229 | 4.788 |
| HEMBA1006569 | 67.508 | 20.299 | 44.291 | 27.048 | 12.798 | 15.243 | 24.739 | 31.861 |
| HEMBA1006572 | 21.817 | 4.339 | 15.862 | 1.796 | 3.407 | 11.582 | 8.381 | 5.922 |
| HEMBA1006579 | 5.427 | 18.336 | 4.219 | 3.440 | 2.139 | 5.460 | 3.967 | 5.110 |
| HEMBA1006583 | 31.967 | 15.854 | 29.307 | 14.271 | 11.747 | 26.889 | 17.058 | 10.451 |
| HEMBA1006595 | 59.014 | 41.577 | 148.359 | 30.660 | 16.681 | 19.571 | 13.265 | 24.768 |
| HEMBA1006597 | 111.817 | 64.480 | 210.001 | 47.574 | 27.392 | 47.009 | 27.887 | 28.666 |
| HEMBA1006606 | 79.184 | 47.311 | 131.822 | 40.177 | 33.228 | 35.403 | 25.240 | 31.687 |
| HEMBA1006612 | 43.105 | 20.909 | 46.913 | 39.205 | 20.348 | 25.383 | 18.706 | 17.150 |
| HEMBA1006617 | 79.139 | 62.924 | 235.236 | 60.258 | 30.407 | 40.264 | 28.184 | 38.643 |
| HEMBA1006624 | 449.384 | 84.050 | 165.494 | 39.352 | 209.908 | 291.427 | 208.533 | 65.478 |
| HEMBA1006631 | 168.309 | 108.316 | 381.778 | 89.696 | 71.812 | 80.634 | 39.325 | 50.996 |
| HEMBA1006635 | 51.406 | 33.730 | 158.286 | 28.605 | 19.347 | 19.781 | 9.639 | 12.894 |
| HEMBA1006639 | 67.363 | 30.354 | 51.867 | 15.409 | 33.210 | 43.083 | 25.295 | 12.985 |
| HEMBA1006643 | 229.685 | 30.246 | 56.218 | 16.406 | 35.196 | 68.642 | 41.724 | 17.931 |
| HEMBA1006648 | 80.985 | 32.464 | 39.607 | 14.926 | 36.718 | 12.135 | 32.217 | 48.853 |
| HEMBA1006652 | 118.455 | 69.232 | 231.917 | 50.609 | 51.023 | 50.716 | 21.698 | 29.527 |
| HEMBA1006653 | 46.971 | 16.614 | 46.472 | 16.579 | 12.358 | 15.364 | 13.867 | 9.224 |
| HEMBA1006658 | 89.823 | 28.363 | 60.976 | 37.660 | 28.124 | 47.014 | 33.470 | 16.872 |
| HEMBA1006659 | 79.863 | 33.626 | 48.217 | 49.132 | 29.124 | 33.070 | 25.182 | 33.784 |
| HEMBA1006665 | 25.726 | 26.740 | 39.661 | 13.975 | 13.287 | 15.240 | 12.046 | 10.419 |
| HEMBA1006666 | 8.276 | 4.281 | 10.565 | 6.319 | 4.257 | 10.392 | 2.791 | 2.171 |
| HEMBA1006671 | 39.553 | 178.623 | 135.413 | 18.941 | 17.294 | 37.782 | 10.166 | 32.048 |
| HEMBA1006674 | 100.472 | 44.108 | 176.724 | 46.922 | 36.367 | 44.809 | 43.576 | 43.269 |
| HEMBA1006676 | 120.417 | 42.888 | 163.816 | 29.504 | 40.435 | 60.162 | 32.540 | 34.825 |
| HEMBA1006682 | 27.104 | 2.556 | 23.174 | 4.035 | 8.982 | 19.092 | 3.958 | 0.000 |
| HEMBA1006688 | 57.351 | 56.288 | 111.358 | 60.597 | 65.322 | 37.545 | 20.757 | 20.789 |
| HEMBA1006695 | 132.496 | 140.334 | 315.655 | 97.296 | 56.206 | 54.392 | 37.622 | 57.596 |
| HEMBA1006696 | 65.136 | 25.204 | 42.137 | 26.654 | 26.490 | 30.156 | 6.159 | 27.512 |
| HEMBA1006702 | 4.275 | 4.328 | 8.881 | 7.114 | 3.362 | 1.846 | 7.796 | 1.965 |
| HEMBA1006707 | 52.417 | 20.766 | 26.862 | 21.409 | 19.843 | 32.229 | 13.146 | 18.546 |
| HEMBA1006708 | 126.875 | 38.520 | 66.803 | 31.253 | 33.294 | 55.347 | 32.071 | 18.229 |
| HEMBA1006709 | 67.500 | 31.686 | 94.432 | 24.924 | 17.365 | 30.329 | 18.603 | 23.474 |
| HEMBA1006717 | 110.641 | 21.536 | 29.255 | 12.664 | 16.091 | 54.326 | 26.752 | 11.544 |
| HEMBA1006724 | 34.421 | 23.073 | 25.607 | 18.231 | 12.305 | 27.570 | 10.585 | 17.797 |
| HEMBA1006731 | 36.072 | 18.255 | 41.441 | 15.382 | 16.479 | 17.272 | 10.826 | 15.482 |
| HEMBA1006737 | 60.467 | 14.107 | 30.096 | 14.542 | 20.232 | 22.606 | 10.316 | 11.440 |
| HEMBA1006742 | 60.258 | 45.190 | 134.964 | 35.452 | 21.315 | 21.889 | 15.223 | 23.529 |
| HEMBA1006743 | 41.970 | 22.864 | 31.760 | 22.024 | 15.126 | 23.989 | 13.179 | 16.281 |
| HEMBA1006744 | 181.068 | 97.273 | 433.004 | 103.006 | 69.785 | 59.354 | 46.770 | 61.806 |
| HEMBA1006749 | 51.776 | 9.753 | 37.994 | 13.564 | 23.164 | 34.516 | 28.426 | 23.238 |
| HEMBA1006752 | 124.800 | 60.318 | 88.111 | 59.765 | 47.490 | 69.461 | 37.541 | 47.074 |
| HEMBA1006754 | 49.957 | 30.459 | 86.726 | 23.747 | 17.745 | 16.269 | 10.783 | 12.424 |
| HEMBA1006758 | 75.460 | 21.737 | 26.190 | 19.832 | 18.249 | 38.492 | 30.654 | 15.933 |
| HEMBA1006767 | 14.002 | 15.106 | 11.961 | 16.059 | 5.628 | 13.334 | 8.382 | 8.573 |
| HEMBA1006770 | 120.485 | 21.505 | 62.144 | 29.559 | 32.512 | 49.739 | 45.952 | 28.318 |

TABLE 31

| | | | | | | | | |
|---|---|---|---|---|---|---|---|---|
| HEMBA1006779 | 81.492 | 51.077 | 162.657 | 41.163 | 39.166 | 36.722 | 18.025 | 29.256 |
| HEMBA1006780 | 78.359 | 78.052 | 345.442 | 73.371 | 68.858 | 55.888 | 41.524 | 39.494 |
| HEMBA1006789 | 29.455 | 21.233 | 20.400 | 14.349 | 11.547 | 38.549 | 19.736 | 25.701 |
| HEMBA1006795 | 143.727 | 88.701 | 218.732 | 55.068 | 49.500 | 46.284 | 21.141 | 40.750 |
| HEMBA1006796 | 87.214 | 15.814 | 115.542 | 17.685 | 16.790 | 38.694 | 15.525 | 15.352 |
| HEMBA1006805 | 68.116 | 31.212 | 153.041 | 33.162 | 30.301 | 34.197 | 24.275 | 30.733 |
| HEMBA1006807 | 94.524 | 86.723 | 157.559 | 64.349 | 36.505 | 62.933 | 23.097 | 55.508 |
| HEMBA1006813 | 40.696 | 4.415 | 4.750 | 4.264 | 10.978 | 7.562 | 6.201 | 3.198 |
| HEMBA1006819 | 53.717 | 15.217 | 30.071 | 14.679 | 17.006 | 30.866 | 20.346 | 6.250 |
| HEMBA1006821 | 39.052 | 30.425 | 111.325 | 35.769 | 34.975 | 22.216 | 18.924 | 20.698 |
| HEMBA1006824 | 68.491 | 61.498 | 201.721 | 47.107 | 40.322 | 27.255 | 21.689 | 27.074 |
| HEMBA1006832 | 84.462 | 89.500 | 102.038 | 77.046 | 40.147 | 75.996 | 66.799 | 71.706 |
| HEMBA1006834 | 123.958 | 57.085 | 160.407 | 48.909 | 41.460 | 61.443 | 30.402 | 31.940 |
| HEMBA1006835 | 33.705 | 19.529 | 38.470 | 23.193 | 18.979 | 22.344 | 22.426 | 16.742 |
| HEMBA1006843 | 52.436 | 44.642 | 96.773 | 258.615 | 195.878 | 33.141 | 8.256 | 13.117 |
| HEMBA1006849 | 88.931 | 34.224 | 158.388 | 39.483 | 30.349 | 34.943 | 15.743 | 28.240 |
| HEMBA1006850 | 44.733 | 24.923 | 67.667 | 24.186 | 15.829 | 36.593 | 11.223 | 18.454 |
| HEMBA1006861 | 215.207 | 94.180 | 158.997 | 67.349 | 259.512 | 135.856 | 371.932 | 44.063 |

TABLE 31-continued

| | | | | | | | | |
|---|---|---|---|---|---|---|---|---|
| HEMBA1006865 | 124.996 | 59.773 | 124.376 | 43.328 | 69.356 | 71.072 | 66.350 | 45.129 |
| HEMBA1006867 | 16.632 | 11.094 | 39.646 | 14.084 | 12.902 | 11.855 | 5.865 | 18.338 |
| HEMBA1006873 | 9.965 | 9.279 | 7.010 | 5.013 | 6.262 | 5.127 | 7.141 | 8.422 |
| HEMBA1006877 | 44.043 | 18.321 | 20.546 | 8.172 | 14.670 | 13.165 | 16.493 | 9.073 |
| HEMBA1006878 | 100.427 | 34.418 | 109.029 | 25.739 | 29.525 | 48.800 | 41.513 | 17.905 |
| HEMBA1006879 | 108.299 | 42.811 | 121.051 | 60.872 | 47.507 | 40.075 | 14.429 | 51.924 |
| HEMBA1006884 | 95.426 | 29.331 | 67.556 | 27.787 | 25.909 | 106.818 | 47.878 | 47.793 |
| HEMBA1006885 | 107.720 | 54.342 | 127.920 | 62.272 | 55.739 | 51.739 | 36.790 | 50.612 |
| HEMBA1006886 | 50.841 | 22.970 | 51.528 | 12.561 | 20.660 | 23.207 | 26.952 | 19.149 |
| HEMBA1006889 | 81.809 | 20.952 | 21.474 | 12.691 | 24.681 | 41.822 | 48.768 | 15.196 |
| HEMBA1006896 | 68.030 | 97.285 | 75.370 | 52.746 | 23.109 | 44.481 | 37.701 | 50.662 |
| HEMBA1006900 | 61.515 | 36.410 | 61.016 | 23.329 | 21.390 | 38.404 | 27.583 | 22.774 |
| HEMBA1006902 | 43.283 | 19.713 | 47.129 | 12.105 | 11.602 | 27.830 | 26.548 | 13.885 |
| HEMBA1006912 | 183.904 | 90.995 | 338.160 | 78.230 | 79.588 | 63.729 | 39.994 | 64.953 |
| HEMBA1006914 | 54.548 | 39.053 | 48.945 | 35.736 | 25.895 | 38.586 | 22.479 | 33.810 |
| HEMBA1006916 | 62.872 | 0.000 | 65.115 | 29.982 | 32.625 | 61.537 | 62.750 | 30.818 |
| HEMBA1006921 | 64.867 | 21.840 | 74.902 | 15.692 | 30.866 | 41.257 | 25.569 | 10.362 |
| HEMBA1006926 | 51.195 | 10.616 | 76.671 | 24.435 | 20.300 | 84.402 | 29.503 | 20.967 |
| HEMBA1006927 | 24.016 | 13.778 | 23.573 | 5.335 | 15.250 | 11.291 | 11.672 | 7.086 |
| HEMBA1006929 | 7.146 | 8.487 | 5.431 | 5.526 | 1.676 | 5.970 | 5.688 | 3.134 |
| HEMBA1006936 | 68.233 | 22.847 | 45.566 | 20.391 | 16.346 | 25.493 | 20.196 | 17.720 |
| HEMBA1006938 | 14.202 | 8.409 | 31.234 | 7.743 | 5.002 | 6.780 | 6.773 | 5.945 |
| HEMBA1006941 | 30.559 | 24.290 | 40.928 | 13.779 | 16.040 | 34.253 | 22.542 | 18.507 |
| HEMBA1006942 | 147.487 | 57.842 | 121.883 | 69.207 | 55.456 | 76.853 | 61.942 | 66.640 |
| HEMBA1006945 | 80.546 | 64.930 | 104.037 | 63.709 | 40.444 | 54.676 | 33.533 | 31.915 |
| HEMBA1006949 | 10.292 | 41.467 | 23.921 | 1.860 | 15.813 | 7.071 | 10.866 | 5.231 |
| HEMBA1006952 | 58.685 | 12.572 | 34.750 | 8.032 | 18.283 | 39.764 | 15.332 | 12.456 |
| HEMBA1006960 | 91.939 | 38.895 | 93.164 | 24.834 | 34.400 | 36.160 | 36.715 | 34.791 |
| HEMBA1006973 | 74.208 | 24.793 | 50.621 | 17.619 | 22.844 | 24.971 | 24.844 | 16.167 |
| HEMBA1006974 | 48.691 | 39.013 | 59.414 | 48.064 | 16.799 | 38.579 | 21.301 | 46.006 |
| HEMBA1006976 | 35.907 | 15.675 | 32.116 | 19.091 | 14.522 | 30.574 | 25.042 | 18.348 |
| HEMBA1006989 | 6.422 | 2.207 | 2.374 | 3.336 | 2.670 | 3.696 | 2.557 | 3.536 |
| HEMBA1006993 | 334.266 | 64.150 | 357.947 | 46.138 | 95.466 | 144.777 | 109.174 | 54.000 |
| HEMBA1006996 | 9.183 | 9.870 | 15.032 | 9.483 | 5.722 | 9.518 | 8.368 | 9.637 |
| HEMBA1007001 | 117.610 | 95.668 | 334.868 | 56.093 | 55.288 | 47.863 | 27.205 | 56.828 |
| HEMBA1007002 | 93.134 | 41.846 | 72.311 | 21.453 | 16.249 | 59.722 | 46.434 | 40.628 |
| HEMBA1007013 | 65.734 | 23.106 | 53.712 | 16.933 | 20.783 | 34.293 | 29.163 | 29.338 |
| HEMBA1007016 | 36.649 | 14.972 | 27.491 | 6.385 | 9.597 | 17.982 | 16.658 | 15.035 |
| HEMBA1007017 | 6.290 | 0.000 | 8.194 | 2.155 | 5.231 | 2.329 | 1.949 | 0.000 |
| HEMBA1007018 | 19.457 | 15.664 | 19.767 | 14.280 | 10.586 | 15.084 | 9.105 | 14.124 |
| HEMBA1007044 | 139.784 | 50.078 | 125.738 | 15.913 | 53.729 | 123.367 | 90.838 | 36.173 |
| HEMBA1007045 | 49.576 | 7.913 | 39.757 | 9.069 | 10.104 | 19.099 | 12.683 | 7.276 |
| HEMBA1007051 | 36.374 | 44.117 | 129.384 | 27.586 | 19.407 | 24.088 | 15.546 | 9.363 |
| HEMBA1007052 | 69.582 | 19.611 | 40.507 | 19.050 | 9.213 | 19.409 | 18.969 | 10.939 |
| HEMBA1007053 | 25.326 | 27.611 | 21.861 | 14.031 | 14.266 | 20.128 | 7.847 | 9.544 |
| HEMBA1007057 | 45.897 | 13.545 | 33.857 | 18.616 | 25.861 | 36.241 | 14.769 | 13.902 |

TABLE 32

| | | | | | | | | |
|---|---|---|---|---|---|---|---|---|
| HEMBA1007062 | 129.012 | 18.903 | 40.670 | 21.323 | 29.469 | 40.252 | 29.408 | 15.700 |
| HEMBA1007063 | 81.681 | 45.884 | 187.380 | 52.391 | 36.943 | 28.608 | 35.303 | 41.236 |
| HEMBA1007066 | 98.396 | 32.970 | 35.373 | 22.961 | 11.085 | 42.430 | 26.631 | 14.760 |
| HEMBA1007069 | 23.449 | 21.519 | 78.409 | 16.835 | 27.425 | 17.217 | 9.095 | 16.163 |
| HEMBA1007073 | 54.833 | 42.548 | 40.682 | 29.352 | 11.879 | 7.937 | 24.282 | 19.372 |
| HEMBA1007076 | 83.020 | 48.746 | 248.260 | 61.189 | 50.193 | 68.045 | 43.836 | 35.650 |
| HEMBA1007078 | 151.561 | 159.600 | 446.445 | 189.146 | 130.283 | 98.734 | 65.934 | 117.079 |
| HEMBA1007080 | 43.963 | 44.765 | 174.545 | 66.950 | 45.879 | 43.194 | 43.909 | 50.100 |
| HEMBA1007084 | 78.948 | 60.672 | 268.327 | 63.769 | 63.088 | 60.307 | 35.006 | 46.866 |
| HEMBA1007085 | 263.538 | 108.018 | 162.599 | 48.155 | 77.545 | 161.321 | 63.614 | 80.640 |
| HEMBA1007087 | 85.598 | 25.085 | 47.862 | 25.580 | 13.918 | 62.815 | 143.461 | 30.856 |
| HEMBA1007089 | 21.131 | 32.023 | 21.145 | 14.738 | 7.213 | 19.681 | 9.036 | 10.026 |
| HEMBA1007095 | 147.777 | 215.051 | 136.910 | 63.992 | 170.706 | 117.992 | 103.152 | 86.452 |
| HEMBA1007101 | 78.959 | 53.790 | 147.891 | 35.676 | 28.082 | 27.200 | 19.131 | 25.922 |
| HEMBA1007104 | 66.308 | 23.279 | 45.417 | 11.902 | 19.468 | 48.054 | 26.760 | 16.647 |
| HEMBA1007106 | 28.449 | 17.761 | 41.268 | 28.670 | 17.681 | 14.174 | 10.999 | 7.534 |
| HEMBA1007112 | 12.759 | 8.412 | 16.340 | 9.319 | 7.661 | 7.304 | 13.296 | 6.622 |
| HEMBA1007113 | 126.702 | 0.000 | 229.408 | 64.551 | 40.242 | 39.032 | 13.319 | 26.174 |
| HEMBA1007121 | 219.036 | 207.410 | 696.658 | 149.217 | 168.827 | 131.628 | 642.099 | 128.755 |
| HEMBA1007129 | 50.726 | 42.510 | 63.847 | 31.663 | 26.417 | 24.371 | 18.928 | 20.103 |
| HEMBA1007147 | 111.299 | 117.722 | 312.811 | 79.949 | 67.395 | 74.391 | 35.758 | 54.184 |
| HEMBA1007149 | 83.453 | 6.442 | 19.831 | 7.332 | 11.043 | 9.349 | 9.831 | 8.756 |
| HEMBA1007151 | 97.211 | 33.530 | 53.944 | 24.544 | 18.501 | 35.246 | 36.228 | 24.174 |
| HEMBA1007172 | 52.683 | 25.324 | 438.704 | 42.182 | 28.599 | 38.126 | 26.167 | 25.770 |
| HEMBA1007174 | 52.921 | 13.482 | 44.770 | 21.384 | 19.520 | 28.559 | 22.332 | 20.471 |
| HEMBA1007176 | 89.919 | 24.768 | 53.414 | 32.841 | 44.643 | 73.679 | 87.040 | 30.762 |
| HEMBA1007178 | 93.941 | 73.120 | 135.427 | 34.313 | 32.040 | 34.622 | 22.898 | 24.897 |

TABLE 32-continued

| | | | | | | | | |
|---|---|---|---|---|---|---|---|---|
| HEMBA1007185 | 62.558 | 18.807 | 36.824 | 15.490 | 20.528 | 37.568 | 22.260 | 12.783 |
| HEMBA1007186 | 70.967 | 31.546 | 59.038 | 21.059 | 21.332 | 35.648 | 42.864 | 11.346 |
| HEMBA1007194 | 53.376 | 38.911 | 126.660 | 33.992 | 23.875 | 21.109 | 12.122 | 23.307 |
| HEMBA1007200 | 74.955 | 53.829 | 44.212 | 23.979 | 20.225 | 32.762 | 55.417 | 22.176 |
| HEMBA1007203 | 87.803 | 26.807 | 41.357 | 14.648 | 9.791 | 23.392 | 30.167 | 17.274 |
| HEMBA1007206 | 82.800 | 73.675 | 225.293 | 44.461 | 28.674 | 37.091 | 14.673 | 34.505 |
| HEMBA1007224 | 25.614 | 40.402 | 50.116 | 21.484 | 14.920 | 22.548 | 13.197 | 20.053 |
| HEMBA1007226 | 88.512 | 43.606 | 93.121 | 22.209 | 17.911 | 38.704 | 43.759 | 31.721 |
| HEMBA1007240 | 131.657 | 62.804 | 86.650 | 9.510 | 21.890 | 53.116 | 42.250 | 16.655 |
| HEMBA1007241 | 12.225 | 7.719 | 18.461 | 5.051 | 6.724 | 15.945 | 3.135 | 5.390 |
| HEMBA1007242 | 21.409 | 14.030 | 13.648 | 11.068 | 6.265 | 17.370 | 8.487 | 5.236 |
| HEMBA1007243 | 61.824 | 25.854 | 40.264 | 17.235 | 23.438 | 39.197 | 31.904 | 20.347 |
| HEMBA1007251 | 37.660 | 16.946 | 37.149 | 16.699 | 12.180 | 19.482 | 30.321 | 10.262 |
| HEMBA1007256 | 53.905 | 43.642 | 113.110 | 31.642 | 27.946 | 30.492 | 18.548 | 23.645 |
| HEMBA1007267 | 80.741 | 40.085 | 207.160 | 61.174 | 38.220 | 29.008 | 32.292 | 29.672 |
| HEMBA1007273 | 41.062 | 9.087 | 11.906 | 5.193 | 6.445 | 7.723 | 9.225 | 4.483 |
| HEMBA1007279 | 54.376 | 20.734 | 133.494 | 27.987 | 21.355 | 19.941 | 17.364 | 19.503 |
| HEMBA1007281 | 8.523 | 5.717 | 4.731 | 3.403 | 2.317 | 2.497 | 2.740 | 0.000 |
| HEMBA1007283 | 25.940 | 14.444 | 24.974 | 23.487 | 19.771 | 23.418 | 19.378 | 26.409 |
| HEMBA1007288 | 57.959 | 39.576 | 155.227 | 28.725 | 24.689 | 25.110 | 16.998 | 16.095 |
| HEMBA1007291 | 37.974 | 19.069 | 59.253 | 20.445 | 13.404 | 17.376 | 13.060 | 13.147 |
| HEMBA1007299 | 446.640 | 93.668 | 199.852 | 61.423 | 94.129 | 249.345 | 241.373 | 85.323 |
| HEMBA1007300 | 103.752 | 25.694 | 24.914 | 18.217 | 40.413 | 26.018 | 31.407 | 16.669 |
| HEMBA1007301 | 49.752 | 18.178 | 32.677 | 18.170 | 33.650 | 33.786 | 22.892 | 12.782 |
| HEMBA1007319 | 13.312 | 10.598 | 23.453 | 16.511 | 4.278 | 9.382 | 2.996 | 8.570 |
| HEMBA1007320 | 53.723 | 23.595 | 62.301 | 29.439 | 16.672 | 32.932 | 28.191 | 18.418 |
| HEMBA1007322 | 45.986 | 125.362 | 77.545 | 43.693 | 17.955 | 45.689 | 39.556 | 80.836 |
| HEMBA1007323 | 64.720 | 16.869 | 22.970 | 11.238 | 11.687 | 32.209 | 25.350 | 7.506 |
| HEMBA1007326 | 313.094 | 189.188 | 862.276 | 214.045 | 178.109 | 171.587 | 70.819 | 115.174 |
| HEMBA1007327 | 78.767 | 61.102 | 219.980 | 55.002 | 29.411 | 44.095 | 29.354 | 42.286 |
| HEMBA1007332 | 71.516 | 9.318 | 34.879 | 5.559 | 7.452 | 24.826 | 12.763 | 20.050 |
| HEMBA1007341 | 89.805 | 53.431 | 207.395 | 82.402 | 105.877 | 47.861 | 32.826 | 50.162 |
| HEMBA1007342 | 22.063 | 17.289 | 28.253 | 18.196 | 17.751 | 26.378 | 13.820 | 9.173 |
| HEMBA1007347 | 112.392 | 64.499 | 230.022 | 60.348 | 47.557 | 63.758 | 30.683 | 33.285 |
| HEMAB1007353 | 1.685 | 3.520 | 0.575 | 1.860 | 1.976 | 0.107 | 2.061 | 0.788 |
| HEMBB1000005 | 60.047 | 46.027 | 121.870 | 38.241 | 20.699 | 18.268 | 20.068 | 26.957 |
| HEMBB1000008 | 97.929 | 53.604 | 274.179 | 68.681 | 38.935 | 39.328 | 26.881 | 34.873 |

TABLE 33

| | | | | | | | | |
|---|---|---|---|---|---|---|---|---|
| HEMBB1000018 | 122.130 | 127.861 | 329.165 | 120.419 | 57.867 | 95.203 | 75.902 | 92.924 |
| HEMBB1000024 | 181.606 | 97.019 | 373.954 | 102.401 | 70.406 | 70.591 | 40.304 | 66.798 |
| HEMBB1000025 | 85.919 | 29.049 | 45.055 | 23.789 | 13.946 | 24.397 | 29.349 | 13.072 |
| HEMBB1000030 | 108.167 | 68.316 | 303.677 | 83.010 | 68.378 | 81.687 | 34.886 | 37.617 |
| HEMBB1000036 | 107.960 | 11.573 | 50.484 | 11.277 | 20.480 | 41.381 | 25.378 | 14.730 |
| HEMBB1000037 | 77.688 | 29.380 | 69.658 | 56.679 | 27.020 | 54.062 | 30.086 | 15.311 |
| HEMBB1000039 | 52.550 | 48.503 | 140.795 | 30.096 | 18.739 | 26.012 | 15.151 | 21.723 |
| HEMBB1000044 | 134.136 | 75.469 | 218.667 | 61.596 | 32.667 | 29.659 | 43.360 | 42.831 |
| HEMBB1000048 | 17.937 | 21.052 | 31.004 | 18.291 | 11.321 | 20.120 | 21.506 | 15.078 |
| HEMBB1000050 | 74.210 | 33.681 | 207.484 | 35.691 | 22.905 | 25.584 | 18.572 | 17.494 |
| HEMBB1000054 | 68.273 | 47.191 | 246.350 | 44.008 | 24.522 | 29.259 | 22.570 | 21.316 |
| HEMBB1000055 | 72.875 | 112.284 | 61.172 | 110.297 | 21.358 | 70.636 | 93.824 | 132.288 |
| HEMBB1000059 | 331.577 | 184.687 | 662.540 | 182.481 | 130.065 | 131.364 | 90.002 | 121.903 |
| HEMBB1000072 | 240.733 | 98.890 | 326.893 | 75.919 | 67.742 | 118.222 | 108.108 | 91.458 |
| HEMBB1000081 | 23.138 | 27.174 | 85.100 | 21.146 | 30.856 | 20.458 | 7.513 | 15.351 |
| HEMBB1000083 | 120.759 | 58.163 | 188.224 | 40.609 | 37.789 | 59.334 | 33.712 | 39.101 |
| HEMBB1000089 | 67.618 | 54.952 | 191.832 | 56.629 | 24.609 | 36.847 | 30.680 | 26.912 |
| HEMBB1000094 | 355.534 | 116.828 | 161.958 | 31.504 | 29.300 | 49.613 | 36.239 | 35.197 |
| HEMBB1000097 | 27.834 | 63.724 | 51.488 | 14.249 | 22.834 | 34.068 | 18.547 | 16.455 |
| HEMBB1000099 | 157.641 | 91.912 | 456.470 | 71.078 | 50.739 | 64.471 | 32.108 | 43.354 |
| HEMBB1000103 | 75.781 | 59.392 | 114.974 | 44.216 | 31.915 | 47.628 | 23.669 | 56.268 |
| HEMBB1000106 | 62.814 | 44.996 | 77.918 | 35.044 | 19.825 | 40.409 | 26.156 | 46.001 |
| HEMBB1000113 | 43.660 | 33.435 | 95.987 | 42.744 | 19.714 | 20.114 | 15.899 | 21.606 |
| HEMBB1000119 | 57.350 | 21.211 | 42.528 | 17.770 | 19.517 | 28.754 | 23.570 | 30.104 |
| HEMBB1000133 | 92.950 | 65.230 | 58.619 | 69.544 | 53.706 | 104.229 | 39.058 | 80.858 |
| HEMBB1000134 | 44.120 | 20.654 | 76.693 | 40.611 | 24.712 | 37.185 | 42.327 | 21.963 |
| HEMBB1000136 | 21.810 | 7.191 | 44.517 | 15.599 | 7.339 | 22.582 | 12.399 | 24.899 |
| HEMBB1000141 | 163.867 | 99.946 | 331.822 | 95.807 | 55.858 | 64.560 | 36.737 | 52.602 |
| HEMBB1000144 | 96.831 | 97.019 | 183.423 | 88.529 | 36.185 | 15.577 | 29.259 | 32.144 |
| HEMBB1000147 | 59.253 | 9.088 | 62.426 | 7.391 | 11.451 | 7.175 | 11.502 | 10.693 |
| HEMBB1000152 | 56.391 | 28.723 | 34.597 | 15.309 | 19.424 | 32.469 | 29.105 | 19.117 |
| HEMBB1000154 | 85.308 | 47.878 | 101.061 | 33.881 | 19.477 | 27.298 | 20.174 | 15.366 |
| HEMBB1000155 | 35.691 | 36.132 | 109.038 | 28.164 | 29.608 | 22.283 | 16.557 | 17.041 |
| HEMBB1000173 | 170.611 | 173.001 | 494.253 | 143.666 | 83.705 | 123.932 | 65.317 | 76.388 |
| HEMBB1000175 | 32.273 | 19.114 | 23.481 | 10.948 | 4.039 | 29.180 | 7.135 | 13.322 |
| HEMBB1000176 | 56.984 | 51.334 | 90.749 | 69.004 | 40.144 | 52.980 | 25.845 | 19.359 |

TABLE 33-continued

| | | | | | | | | |
|---|---|---|---|---|---|---|---|---|
| HEMBB1000198 | 70.426 | 12.768 | 26.381 | 10.237 | 6.266 | 11.215 | 8.858 | 5.363 |
| HEMBB1000208 | 42.474 | 8.966 | 34.929 | 10.418 | 12.883 | 9.285 | 12.335 | 7.978 |
| HEMBB1000209 | 43.846 | 10.700 | 9.943 | 10.934 | 8.858 | 12.135 | 9.049 | 4.168 |
| HEMBB1000212 | 27.532 | 12.579 | 76.077 | 15.361 | 33.518 | 17.471 | 13.132 | 16.552 |
| HEMBB1000215 | 178.324 | 89.053 | 294.606 | 95.420 | 68.598 | 89.720 | 51.270 | 61.235 |
| HEMBB1000217 | 148.073 | 45.416 | 96.614 | 47.569 | 37.572 | 89.989 | 48.073 | 33.510 |
| HEMBB1000218 | 88.298 | 123.000 | 347.859 | 84.124 | 41.828 | 57.417 | 21.147 | 34.605 |
| HEMBB1000226 | 70.693 | 14.949 | 41.586 | 31.786 | 30.261 | 28.577 | 14.779 | 27.177 |
| HEMBB1000230 | 28.681 | 8.910 | 13.549 | 5.500 | 3.547 | 9.616 | 6.632 | 3.293 |
| HEMBB1000240 | 44.662 | 12.588 | 13.211 | 10.455 | 4.589 | 41.554 | 8.171 | 7.082 |
| HEMBB1000244 | 22.390 | 13.510 | 42.662 | 18.503 | 18.758 | 11.192 | 2.111 | 13.188 |
| HEMBB1000250 | 20.878 | 6.254 | 20.741 | 9.109 | 1.841 | 13.561 | 9.540 | 2.708 |
| HEMBB1000258 | 101.717 | 75.034 | 336.781 | 79.281 | 52.303 | 67.231 | 33.313 | 34.880 |
| HEMBB1000264 | 99.327 | 57.280 | 269.540 | 83.791 | 39.799 | 96.654 | 62.346 | 79.783 |
| HEMBB1000266 | 70.747 | 23.082 | 23.217 | 14.456 | 28.745 | 34.547 | 15.022 | 15.672 |
| HEMBB1000272 | 14.990 | 14.502 | 10.270 | 6.954 | 12.730 | 6.133 | 4.205 | 16.611 |
| HEMBB1000274 | 105.245 | 46.925 | 190.978 | 49.759 | 41.568 | 43.127 | 18.199 | 25.826 |
| HEMBB1000276 | 6.479 | 2.218 | 2.501 | 4.783 | 1.754 | 2.070 | 2.079 | 1.252 |
| HEMBB1000284 | 4.790 | 5.088 | 7.884 | 3.489 | 2.213 | 3.213 | 1.981 | 3.304 |
| HEMBB1000307 | 52.330 | 30.191 | 128.450 | 28.961 | 22.039 | 15.869 | 9.113 | 21.677 |
| HEMBB1000309 | 86.347 | 36.463 | 96.140 | 43.964 | 34.442 | 33.118 | 18.805 | 21.507 |
| HEMBB1000312 | 41.862 | 30.986 | 40.349 | 24.933 | 7.383 | 79.360 | 24.114 | 16.788 |
| HEMBB1000317 | 49.311 | 18.053 | 26.189 | 10.490 | 10.102 | 21.107 | 12.632 | 13.384 |
| HEMBB1000318 | 87.180 | 33.847 | 208.954 | 43.556 | 23.043 | 27.764 | 9.191 | 17.641 |
| HEMBB1000332 | 3.892 | 11.256 | 14.087 | 42.331 | 28.145 | 14.132 | 2.408 | 14.319 |
| HEMBB1000335 | 27.939 | 30.864 | 21.167 | 28.071 | 12.651 | 30.027 | 12.746 | 21.153 |
| HEMBB1000336 | 68.463 | 26.023 | 48.843 | 10.608 | 22.871 | 23.654 | 23.868 | 13.927 |
| HEMBB1000337 | 289.853 | 59.290 | 93.527 | 52.168 | 54.197 | 125.769 | 126.562 | 60.614 |

TABLE 34

| | | | | | | | | |
|---|---|---|---|---|---|---|---|---|
| HEMBB1000338 | 54.685 | 45.765 | 123.480 | 44.612 | 17.722 | 26.663 | 17.708 | 29.721 |
| HEMBB1000339 | 144.258 | 108.124 | 265.125 | 105.421 | 89.798 | 89.055 | 56.944 | 50.241 |
| HEMBB1000341 | 113.271 | 46.622 | 132.906 | 32.751 | 40.166 | 37.986 | 28.017 | 30.881 |
| HEMBB1000343 | 130.737 | 71.935 | 259.845 | 80.183 | 46.681 | 45.761 | 43.928 | 46.721 |
| HEMBB1000354 | 202.146 | 151.264 | 495.642 | 157.908 | 153.529 | 142.579 | 67.161 | 105.322 |
| HEMBB1000358 | 92.244 | 22.827 | 29.160 | 24.670 | 22.387 | 48.989 | 59.506 | 28.803 |
| HEMBB1000369 | 55.720 | 25.874 | 97.758 | 27.483 | 21.576 | 23.750 | 17.278 | 16.569 |
| HEMBB1000373 | 52.572 | 59.105 | 70.779 | 61.379 | 38.792 | 44.185 | 31.504 | 45.653 |
| HEMBB1000374 | 153.545 | 115.183 | 389.274 | 108.150 | 98.073 | 80.319 | 58.214 | 75.906 |
| HEMBB1000376 | 95.394 | 132.554 | 369.986 | 146.818 | 60.328 | 63.876 | 73.647 | 43.202 |
| HEMBB1000383 | 37.023 | 35.429 | 24.954 | 13.017 | 10.381 | 22.638 | 16.842 | 8.781 |
| HEMBB1000391 | 127.327 | 30.055 | 106.971 | 24.962 | 30.891 | 57.827 | 37.484 | 11.921 |
| HEMBB1000399 | 35.143 | 10.865 | 22.406 | 8.561 | 4.100 | 8.569 | 2.643 | 8.889 |
| HEMBB1000402 | 82.616 | 20.485 | 44.946 | 25.430 | 13.012 | 19.024 | 7.725 | 18.695 |
| HEMBB1000404 | 18.903 | 12.568 | 10.300 | 8.593 | 9.455 | 9.301 | 2.672 | 7.956 |
| HEMBB1000407 | 19.286 | 8.572 | 18.593 | 3.281 | 2.599 | 13.454 | 2.473 | 3.407 |
| HEMBB1000420 | 95.847 | 66.573 | 138.307 | 54.950 | 39.330 | 56.220 | 37.608 | 43.081 |
| HEMBB1000430 | 274.820 | 161.981 | 153.601 | 40.874 | 406.081 | 489.107 | 693.805 | 115.638 |
| HEMBB1000434 | 350.936 | 139.481 | 599.497 | 199.198 | 125.426 | 113.500 | 65.776 | 77.687 |
| HEMBB1000438 | 67.342 | 10.187 | 25.472 | 7.136 | 8.148 | 27.875 | 7.217 | 6.701 |
| HEMBB1000441 | 84.086 | 98.109 | 312.643 | 78.842 | 60.934 | 76.141 | 46.589 | 35.267 |
| HEMBB1000447 | 76.519 | 88.156 | 54.883 | 26.628 | 31.157 | 24.328 | 25.777 | 38.008 |
| HEMBB1000449 | 22.367 | 11.282 | 25.245 | 11.267 | 1.700 | 13.053 | 5.731 | 8.109 |
| HEMBB1000453 | 26.781 | 29.875 | 49.056 | 22.139 | 35.305 | 22.456 | 14.006 | 15.902 |
| HEMBB1000455 | 37.937 | 43.401 | 129.423 | 29.222 | 40.584 | 24.577 | 21.227 | 20.356 |
| HEMBB1000472 | 146.390 | 61.195 | 235.753 | 80.306 | 44.122 | 82.882 | 52.783 | 87.457 |
| HEMBB1000480 | 138.135 | 67.904 | 194.466 | 46.367 | 41.944 | 60.409 | 34.897 | 40.785 |
| HEMBB1000486 | 78.511 | 63.045 | 211.876 | 47.786 | 39.049 | 36.558 | 20.396 | 17.632 |
| HEMBB1000487 | 21.510 | 22.091 | 29.116 | 10.718 | 21.056 | 15.854 | 13.086 | 10.892 |
| HEMBB1000490 | 232.419 | 148.116 | 562.064 | 159.218 | 134.370 | 107.861 | 60.296 | 110.306 |
| HEMBB1000491 | 149.070 | 107.169 | 349.100 | 81.342 | 44.330 | 51.147 | 33.633 | 59.342 |
| HEMBB1000492 | 18.194 | 21.930 | 19.080 | 9.690 | 6.821 | 10.632 | 9.805 | 5.454 |
| HEMBB1000493 | 286.390 | 34.074 | 64.876 | 31.406 | 23.065 | 49.816 | 39.824 | 39.921 |
| HEMBB1000510 | 133.225 | 95.239 | 380.177 | 165.002 | 101.728 | 72.504 | 64.646 | 83.048 |
| HEMBB1000516 | 137.574 | 35.610 | 61.963 | 35.305 | 10.932 | 78.851 | 39.905 | 19.224 |
| HEMBB1000518 | 8.388 | 3.261 | 26.133 | 5.489 | 1.531 | 1.500 | 1.611 | 1.901 |
| HEMB81000523 | 153.793 | 88.071 | 329.880 | 82.474 | 43.568 | 69.756 | 32.830 | 51.127 |
| HEMBB1000530 | 46.151 | 13.390 | 40.950 | 8.319 | 32.799 | 6.126 | 10.689 | 8.426 |
| HEMBB1000542 | 57.808 | 36.831 | 46.332 | 20.306 | 19.414 | 5.489 | 13.314 | 22.747 |
| HEMBB1000550 | 39.123 | 26.036 | 79.169 | 22.945 | 10.597 | 23.147 | 37.266 | 20.568 |
| HEMBB1000554 | 192.214 | 105.635 | 349.184 | 148.874 | 90.632 | 98.169 | 55.377 | 100.995 |
| HEMBB1000556 | 100.759 | 22.180 | 68.289 | 37.737 | 35.176 | 41.190 | 47.163 | 40.126 |
| HEMBB1000564 | 101.412 | 37.586 | 144.386 | 37.463 | 27.344 | 59.939 | 31.447 | 9.452 |
| HEMBB1000567 | 361.516 | 76.515 | 125.177 | 66.960 | 83.698 | 221.216 | 145.840 | 54.204 |
| HEMBB1000569 | 63.847 | 46.712 | 54.356 | 18.197 | 23.752 | 36.942 | 31.264 | 39.479 |

TABLE 34-continued

| | | | | | | | | |
|---|---|---|---|---|---|---|---|---|
| HEMBB1000573 | 99.088 | 89.487 | 373.557 | 76.986 | 76.236 | 63.534 | 39.587 | 58.648 |
| HEMBB1000575 | 74.071 | 67.726 | 296.427 | 63.469 | 37.530 | 42.388 | 33.544 | 46.151 |
| HEMBB1000579 | 27.868 | 12.805 | 18.934 | 6.889 | 3.743 | 24.452 | 24.367 | 23.262 |
| HEMBB1000585 | 30.826 | 34.244 | 65.882 | 26.172 | 19.828 | 26.184 | 16.826 | 33.888 |
| HEMBB1000586 | 85.397 | 75.643 | 187.543 | 99.762 | 48.456 | 35.430 | 28.693 | 50.228 |
| HEMBB1000589 | 135.404 | 58.619 | 243.853 | 51.181 | 36.284 | 29.883 | 21.561 | 27.997 |
| HEMBB1000591 | 99.680 | 60.946 | 242.306 | 54.695 | 36.589 | 52.616 | 32.332 | 33.066 |
| HEMBB1000592 | 30.320 | 18.740 | 34.338 | 11.753 | 8.732 | 28.305 | 13.707 | 12.164 |
| HEMBB1000593 | 148.639 | 68.816 | 255.892 | 61.084 | 46.829 | 61.565 | 49.545 | 66.588 |
| HEMBB1000595 | 27.140 | 21.001 | 29.869 | 21.272 | 9.199 | 21.841 | 16.487 | 29.680 |
| HEMBB1000598 | 39.074 | 31.891 | 85.011 | 22.815 | 13.772 | 21.958 | 13.576 | 26.747 |
| HEMBB1000611 | 14.828 | 6.552 | 11.601 | 7.498 | 7.461 | 15.614 | 9.246 | 9.161 |
| HEMBB1000617 | 193.986 | 137.945 | 458.678 | 127.725 | 87.855 | 84.583 | 46.273 | 77.986 |
| HEMBB1000623 | 65.566 | 26.480 | 50.777 | 19.193 | 18.923 | 40.974 | 28.571 | 23.219 |
| HEMBB1000630 | 62.606 | 23.074 | 40.815 | 18.796 | 14.186 | 31.973 | 21.492 | 13.779 |
| HEMBB1000631 | 61.311 | 41.283 | 27.586 | 23.498 | 24.433 | 35.043 | 48.566 | 22.826 |
| HEMBB1000632 | 58.747 | 55.433 | 156.750 | 30.460 | 29.661 | 33.497 | 21.899 | 21.857 |
| HEMBB1000636 | 127.885 | 47.562 | 59.456 | 48.965 | 33.643 | 65.366 | 42.360 | 37.349 |
| HEMBB1000637 | 817.391 | 628.017 | 1645.738 | 524.605 | 482.307 | 443.855 | 191.753 | 265.704 |

TABLE 35

| | | | | | | | | |
|---|---|---|---|---|---|---|---|---|
| HEMBB1000638 | 55.058 | 47.453 | 95.751 | 42.262 | 25.684 | 15.056 | 22.121 | 28.829 |
| HEMBB1000642 | 179.188 | 88.317 | 251.754 | 80.865 | 42.468 | 81.296 | 37.696 | 52.009 |
| HEMBB1000643 | 43.411 | 25.689 | 113.037 | 18.985 | 11.038 | 14.245 | 8.276 | 18.743 |
| HEMBB1000649 | 27.852 | 45.202 | 137.371 | 34.816 | 24.496 | 9.967 | 11.881 | 22.322 |
| HEMBB1000652 | 84.942 | 61.856 | 126.562 | 78.131 | 42.090 | 36.343 | 22.852 | 31.597 |
| HEMBB1000655 | 418.308 | 73.377 | 56.858 | 57.166 | 32.733 | 57.424 | 38.897 | 44.477 |
| HEMBB1000665 | 16.253 | 13.954 | 10.766 | 20.817 | 6.796 | 13.110 | 7.987 | 4.458 |
| HEMBB1000668 | 28.587 | 13.435 | 14.606 | 13.788 | 25.844 | 15.049 | 12.549 | 11.202 |
| HEMBB1000671 | 239.020 | 122.952 | 561.221 | 119.970 | 96.244 | 75.058 | 66.812 | 88.267 |
| HEMBB1000673 | 11.633 | 5.779 | 14.629 | 14.904 | 5.916 | 4.811 | 2.141 | 12.812 |
| HEMBB1000679 | 16.899 | 7.357 | 23.438 | 7.697 | 1.049 | 30.246 | 7.774 | 7.063 |
| HEMBB1000684 | 188.240 | 157.754 | 430.254 | 128.150 | 66.411 | 89.722 | 49.173 | 67.832 |
| HEMBB1000692 | 4.978 | 9.265 | 11.569 | 5.085 | 1.158 | 3.240 | 3.421 | 1.785 |
| HEMBB1000693 | 63.119 | 40.561 | 59.522 | 22.326 | 25.408 | 13.898 | 31.488 | 20.706 |
| HEMBB1000705 | 15.560 | 31.798 | 122.757 | 36.451 | 19.928 | 11.568 | 2.839 | 10.179 |
| HEMBB1000706 | 22.553 | 13.626 | 23.777 | 8.621 | 11.683 | 41.509 | 10.019 | 7.584 |
| HEMBB1000709 | 74.737 | 77.864 | 245.726 | 50.833 | 51.093 | 50.427 | 37.955 | 51.357 |
| HEMBB1000714 | 23.726 | 10.733 | 6.625 | 12.298 | 6.349 | 9.891 | 2.142 | 14.350 |
| HEMBB1000725 | 24.239 | 9.575 | 11.437 | 13.761 | 12.596 | 17.372 | 8.105 | 16.144 |
| HEMBB1000726 | 86.971 | 84.395 | 208.396 | 65.157 | 43.881 | 37.441 | 22.020 | 39.067 |
| HEMBB1000729 | 51.556 | 25.288 | 140.931 | 23.005 | 27.775 | 18.629 | 12.838 | 14.902 |
| HEMBB1000735 | 39.002 | 38.955 | 166.616 | 42.588 | 21.380 | 43.330 | 7.181 | 21.192 |
| HEMBB1000749 | 115.917 | 94.942 | 454.741 | 136.454 | 54.340 | 39.253 | 32.933 | 49.141 |
| HEMBB1000763 | 47.835 | 25.201 | 36.488 | 16.952 | 21.036 | 31.919 | 14.990 | 12.111 |
| HEMBB1000770 | 30.598 | 45.410 | 167.003 | 32.786 | 26.482 | 25.698 | 18.186 | 24.127 |
| HEMBB1000774 | 27.168 | 21.690 | 33.470 | 20.937 | 12.916 | 22.598 | 8.092 | 17.606 |
| HEMBB1000777 | 246.286 | 57.131 | 58.743 | 31.851 | 40.345 | 119.113 | 81.364 | 53.990 |
| HEMBB1000781 | 41.945 | 36.620 | 34.149 | 24.543 | 23.561 | 16.383 | 14.371 | 20.775 |
| HEMBB1000788 | 10.756 | 10.608 | 5.481 | 6.429 | 2.950 | 5.995 | 4.522 | 4.589 |
| HEMBB1000789 | 28.490 | 9.620 | 26.151 | 16.088 | 11.640 | 16.477 | 7.916 | 7.672 |
| HEMBB1000790 | 74.318 | 56.925 | 185.959 | 63.749 | 33.523 | 24.232 | 24.414 | 28.423 |
| HEMBB1000794 | 18.080 | 17.254 | 38.876 | 24.305 | 7.427 | 10.338 | 5.445 | 9.305 |
| HEMBB1000807 | 50.070 | 31.869 | 22.751 | 19.865 | 20.934 | 27.002 | 18.350 | 27.280 |
| HEMBB1000809 | 334.541 | 42.976 | 42.300 | 26.454 | 9.545 | 31.526 | 31.677 | 44.152 |
| HEMBB1000810 | 189.365 | 50.676 | 163.325 | 33.349 | 38.994 | 74.400 | 45.398 | 19.262 |
| HEMBB1000821 | 40.710 | 9.304 | 21.006 | 6.841 | 5.422 | 15.981 | 10.835 | 5.685 |
| HEMBB1000822 | 8.726 | 3.570 | 3.541 | 1.411 | 7.255 | 5.519 | 1.285 | 1.525 |
| HEMBB1000826 | 68.485 | 40.348 | 201.149 | 68.467 | 43.204 | 31.769 | 32.812 | 55.367 |
| HEMBB1000827 | 50.671 | 34.326 | 108.391 | 32.946 | 15.076 | 25.813 | 18.713 | 25.457 |
| HEMBB1000831 | 38.060 | 20.466 | 29.131 | 12.368 | 19.990 | 20.562 | 25.373 | 6.415 |
| HEMBB1000835 | 59.181 | 56.345 | 127.358 | 58.150 | 44.350 | 35.831 | 25.687 | 35.108 |
| HEMBB1000840 | 117.639 | 63.375 | 340.802 | 61.186 | 48.924 | 38.995 | 20.712 | 30.526 |
| HEMBB1000848 | 98.938 | 53.024 | 210.423 | 42.569 | 28.984 | 47.603 | 29.642 | 29.431 |
| HEMBB1000852 | 1.827 | 2.160 | 0.621 | 2.559 | 1.621 | 1.272 | 1.364 | 1.086 |
| HEMBB1000857 | 16.897 | 16.768 | 19.951 | 14.921 | 12.912 | 17.270 | 10.179 | 14.915 |
| HEMBB1000858 | 25.634 | 16.531 | 8.162 | 8.209 | 14.482 | 12.749 | 92.823 | 10.102 |
| HEMBB1000867 | 106.946 | 56.331 | 264.748 | 50.278 | 36.949 | 41.202 | 26.795 | 29.760 |
| HEMBB1000870 | 68.550 | 62.423 | 192.351 | 52.406 | 39.303 | 55.641 | 23.738 | 27.427 |
| HEMBB1000876 | 21.813 | 12.044 | 24.968 | 11.314 | 7.689 | 10.690 | 11.143 | 26.241 |
| HEMBB1000881 | 30.089 | 16.478 | 28.345 | 14.926 | 18.419 | 17.763 | 18.901 | 20.494 |
| HEMBB1000883 | 11.669 | 10.263 | 26.185 | 6.975 | 2.780 | 8.223 | 2.906 | 3.540 |
| HEMBB1000887 | 42.638 | 32.274 | 66.780 | 22.979 | 31.512 | 42.842 | 20.622 | 22.566 |
| HEMBB1000888 | 20.318 | 8.193 | 11.483 | 5.178 | 4.073 | 8.708 | 6.801 | 4.342 |
| HEMBB1000890 | 40.795 | 42.287 | 112.076 | 25.031 | 11.171 | 23.116 | 15.491 | 16.447 |

TABLE 35-continued

| | | | | | | | | |
|---|---|---|---|---|---|---|---|---|
| HEMBB1000893 | 38.227 | 10.603 | 88.306 | 24.535 | 14.440 | 12.863 | 9.734 | 17.727 |
| HEMBB1000900 | 23.814 | 8.709 | 17.013 | 9.267 | 10.928 | 12.199 | 14.105 | 11.108 |
| HEMBB1000905 | 63.589 | 43.501 | 37.125 | 41.367 | 26.379 | 29.649 | 38.699 | 31.891 |
| HEMBB1000908 | 42.944 | 54.674 | 120.821 | 34.982 | 28.838 | 28.194 | 15.897 | 26.230 |
| HEMBB1000910 | 72.960 | 51.795 | 161.850 | 41.050 | 36.594 | 37.378 | 13.612 | 23.263 |
| HEMBB1000913 | 33.820 | 35.219 | 96.448 | 24.688 | 12.371 | 26.067 | 14.715 | 19.268 |
| HEMBB1000915 | 1910.513 | 222.511 | 693.345 | 124.825 | 532.993 | 1548.228 | 1159.943 | 223.176 |
| HEMBB1000917 | 99.638 | 64.212 | 310.142 | 53.316 | 39.091 | 34.989 | 22.324 | 40.667 |
| HEMBB1000927 | 80.569 | 11.252 | 19.448 | 8.653 | 21.944 | 24.546 | 17.769 | 17.391 |
| HEMBB1000932 | 33.128 | 33.556 | 95.029 | 29.041 | 17.945 | 21.758 | 22.973 | 31.034 |

TABLE 36

| | | | | | | | | |
|---|---|---|---|---|---|---|---|---|
| HEMBB1000933 | 883.639 | 393.035 | 605.052 | 289.543 | 312.660 | 538.431 | 353.155 | 291.706 |
| HEMBB1000936 | 23.212 | 17.243 | 46.380 | 14.205 | 25.527 | 13.908 | 8.530 | 11.716 |
| HEMBB1000939 | 105.016 | 36.905 | 52.525 | 19.304 | 30.111 | 35.223 | 41.856 | 37.146 |
| HEMBB1000941 | 6.540 | 27.555 | 15.872 | 4.660 | 6.130 | 17.648 | 83.246 | 9.541 |
| HEMBB1000947 | 36.384 | 18.020 | 47.143 | 21.361 | 9.565 | 34.299 | 13.482 | 13.269 |
| HEMBB1000954 | 16.970 | 17.878 | 19.810 | 11.407 | 6.851 | 17.302 | 10.023 | 8.877 |
| HEMBB1000959 | 22.223 | 21.226 | 78.296 | 22.443 | 5.599 | 10.268 | 10.673 | 12.183 |
| HEMBB1000973 | 11.584 | 10.364 | 21.189 | 8.579 | 7.102 | 23.845 | 5.510 | 9.891 |
| HEMBB1000975 | 99.598 | 37.022 | 69.027 | 23.084 | 27.137 | 40.162 | 56.997 | 30.316 |
| HEMBB1000981 | 10.199 | 12.524 | 23.602 | 20.141 | 5.813 | 6.152 | 13.771 | 4.102 |
| HEMBB1000985 | 13.065 | 8.026 | 7.574 | 4.776 | 6.642 | 2.985 | 6.049 | 3.612 |
| HEMBB1000991 | 67.124 | 17.092 | 28.053 | 8.864 | 8.560 | 28.394 | 25.072 | 10.907 |
| HEMBB1000996 | 170.256 | 127.636 | 352.650 | 90.350 | 64.926 | 71.240 | 60.014 | 102.622 |
| HEMBB1001000 | 48.257 | 19.380 | 16.573 | 15.226 | 10.611 | 14.541 | 7.698 | 9.642 |
| HEMBB1001004 | 0.797 | 1.839 | 0.439 | 0.000 | 0.000 | 0.318 | 0.000 | 0.000 |
| HEMBB1001008 | 17.533 | 13.975 | 16.434 | 11.194 | 6.400 | 12.238 | 6.478 | 9.235 |
| HEMBB1001011 | 39.743 | 19.337 | 28.396 | 15.752 | 15.302 | 17.720 | 15.586 | 16.702 |
| HEMBB1001014 | 121.726 | 46.352 | 244.715 | 50.619 | 33.004 | 55.708 | 30.100 | 34.469 |
| HEMBB1001020 | 86.065 | 68.022 | 243.352 | 67.763 | 53.522 | 50.406 | 30.247 | 49.844 |
| HEMBB1001024 | 66.546 | 59.010 | 205.347 | 41.480 | 31.865 | 35.052 | 21.045 | 39.489 |
| HEMBB1001026 | 36.265 | 27.027 | 76.443 | 19.990 | 25.484 | 27.657 | 12.014 | 23.129 |
| HEMBB1001037 | 64.392 | 37.810 | 120.090 | 20.652 | 22.459 | 27.294 | 18.918 | 28.917 |
| HEMBB1001042 | 58.936 | 20.428 | 42.468 | 17.255 | 15.600 | 32.463 | 20.274 | 18.506 |
| HEMBB1001046 | 76.790 | 22.021 | 40.791 | 13.932 | 17.825 | 47.853 | 26.672 | 30.056 |
| HEMBB1001047 | 76.665 | 39.237 | 208.757 | 53.469 | 44.539 | 37.624 | 16.049 | 20.262 |
| HEMBB1001048 | 133.028 | 58.176 | 140.515 | 48.390 | 34.614 | 42.111 | 29.526 | 34.858 |
| HEMBB1001051 | 22.699 | 8.465 | 13.142 | 9.942 | 10.065 | 9.946 | 5.881 | 8.790 |
| HEMBB1001056 | 40.040 | 16.494 | 45.000 | 22.674 | 18.685 | 21.131 | 18.431 | 12.498 |
| HEMBB1001058 | 88.873 | 59.116 | 223.822 | 45.122 | 34.696 | 29.783 | 21.562 | 25.222 |
| HEMBB1001060 | 35.486 | 18.631 | 33.852 | 60.851 | 26.807 | 13.499 | 12.993 | 19.391 |
| HEMBB1001063 | 53.418 | 36.359 | 125.166 | 33.156 | 24.220 | 19.182 | 16.188 | 14.597 |
| HEMBB1001068 | 79.181 | 46.879 | 78.756 | 35.034 | 26.835 | 79.006 | 63.198 | 43.296 |
| HEMBB1001082 | 66.296 | 58.491 | 173.393 | 49.675 | 25.253 | 33.015 | 14.189 | 22.904 |
| HEMBB1001095 | 64.435 | 31.409 | 20.825 | 17.116 | 14.939 | 41.581 | 21.497 | 13.792 |
| HEEBB1001096 | 43.372 | 28.562 | 94.366 | 32.120 | 13.089 | 21.236 | 15.814 | 22.034 |
| HEMBB1001101 | 79.652 | 21.131 | 40.775 | 18.757 | 35.350 | 46.263 | 18.855 | 13.874 |
| HEMBB1001102 | 51.740 | 27.685 | 86.794 | 21.160 | 12.958 | 16.450 | 7.235 | 8.605 |
| HEMBB1001104 | 61.846 | 33.489 | 28.997 | 14.789 | 10.623 | 20.859 | 15.993 | 10.658 |
| HEMBB1001105 | 69.199 | 32.868 | 132.855 | 27.292 | 32.605 | 49.984 | 20.779 | 23.761 |
| HEMBB1001112 | 161.356 | 78.361 | 73.588 | 64.617 | 86.150 | 93.363 | 87.696 | 95.854 |
| HEMBB1001113 | 114.744 | 130.208 | 298.139 | 107.218 | 73.757 | 61.718 | 32.824 | 66.952 |
| HEMBB1001114 | 105.358 | 95.960 | 365.719 | 66.457 | 62.314 | 35.251 | 34.480 | 51.970 |
| HEMBB1001115 | 67.274 | 16.815 | 13.190 | 26.838 | 17.638 | 29.948 | 23.803 | 34.239 |
| HEMBB1001117 | 2.434 | 10.619 | 14.951 | 4.152 | 4.937 | 2.694 | 2.729 | 18.952 |
| HEMBB1001119 | 18.198 | 17.501 | 58.077 | 15.560 | 5.202 | 13.437 | 5.261 | 9.614 |
| HEMBB1001126 | 306.301 | 111.345 | 266.365 | 81.302 | 76.905 | 130.782 | 58.863 | 61.487 |
| HEMBB1001133 | 39.673 | 36.703 | 178.312 | 45.328 | 36.363 | 38.712 | 14.400 | 26.997 |
| HEMBB1001137 | 53.424 | 19.209 | 46.849 | 14.453 | 13.705 | 30.395 | 18.865 | 15.761 |
| HEMBB1001142 | 105.888 | 131.411 | 405.403 | 98.008 | 104.700 | 62.754 | 32.598 | 75.485 |
| HEMBB1001145 | 114.864 | 106.329 | 348.161 | 78.364 | 57.587 | 54.983 | 24.738 | 51.568 |
| HEMBB1001151 | 149.618 | 23.632 | 66.607 | 14.582 | 34.238 | 68.060 | 46.084 | 19.806 |
| HEMBB1001153 | 92.263 | 53.444 | 153.351 | 44.131 | 37.191 | 34.991 | 21.708 | 32.599 |
| HEMBB1001158 | 64.416 | 30.844 | 50.578 | 22.880 | 32.523 | 47.046 | 24.553 | 39.658 |
| HEMBB1001169 | 96.424 | 70.158 | 253.814 | 76.490 | 44.058 | 37.113 | 24.102 | 38.757 |
| HEMBB1001170 | 34.989 | 7.730 | 32.617 | 5.324 | 4.217 | 11.418 | 7.623 | 5.208 |
| HEMBB1001175 | 46.512 | 27.401 | 45.252 | 21.001 | 15.416 | 20.636 | 17.361 | 36.021 |
| HEMBB1001177 | 126.389 | 86.212 | 396.633 | 84.357 | 48.470 | 40.910 | 34.438 | 42.680 |
| HEMBB1001182 | 70.825 | 30.508 | 45.077 | 19.262 | 28.316 | 32.507 | 25.771 | 26.488 |
| HEMBB1001192 | 30.059 | 21.703 | 61.610 | 20.151 | 5.688 | 22.456 | 24.299 | 31.214 |
| HEMBB1001199 | 1.469 | 0.000 | 0.000 | 4.430 | 0.797 | 2.148 | 1.260 | 1.223 |
| HEMBB1001200 | 2.266 | 1.426 | 2.071 | 5.734 | 0.000 | 2.413 | 1.567 | 2.969 |
| HEMBB1001208 | 111.969 | 37.738 | 122.154 | 28.426 | 28.653 | 55.253 | 32.443 | 21.624 |
| HEMBB1001209 | 103.602 | 77.445 | 233.649 | 60.849 | 25.456 | 40.993 | 26.273 | 33.636 |
| HEMBB1001210 | 14.499 | 40.527 | 32.902 | 6.231 | 10.125 | 16.413 | 17.251 | 28.930 |

TABLE 37

| | | | | | | | | |
|---|---|---|---|---|---|---|---|---|
| HEMBB1001215 | 219.922 | 83.033 | 126.326 | 63.007 | 71.733 | 115.441 | 61.961 | 72.230 |
| HEMBB1001217 | 63.633 | 22.116 | 41.047 | 17.479 | 20.160 | 53.164 | 31.645 | 18.739 |
| HEMBB1001218 | 98.226 | 47.137 | 142.266 | 53.412 | 29.467 | 23.819 | 20.495 | 24.079 |
| HEMBB1001221 | 0.524 | 1.310 | 12.795 | 0.988 | 0.992 | 0.867 | 0.000 | 1.767 |
| HEMBB1001224 | 52.109 | 37.281 | 86.318 | 28.364 | 24.177 | 19.072 | 16.478 | 20.321 |
| HEMBB1001230 | 38.785 | 17.158 | 30.714 | 15.256 | 12.698 | 31.469 | 27.596 | 17.436 |
| HEMBB1001234 | 335.966 | 64.817 | 131.669 | 43.601 | 69.385 | 167.134 | 101.415 | 57.258 |
| HEMBB1001235 | 152.870 | 67.952 | 84.726 | 40.262 | 26.665 | 52.686 | 38.623 | 49.693 |
| HEMBB1001237 | 16.971 | 23.623 | 33.663 | 30.744 | 21.161 | 18.495 | 18.264 | 25.643 |
| HEMBB1001242 | 26.787 | 15.716 | 22.922 | 4.200 | 5.187 | 11.277 | 10.621 | 7.589 |
| HEMBB1001244 | 280.439 | 9.589 | 9.743 | 8.128 | 2.116 | 4.366 | 2.735 | 2.871 |
| HEMBB1001249 | 51.892 | 27.766 | 106.010 | 25.983 | 19.890 | 21.254 | 16.839 | 21.542 |
| HEMBB1001253 | 50.869 | 33.773 | 58.857 | 31.656 | 8.253 | 38.144 | 20.639 | 25.942 |
| HEMBB1001254 | 28.109 | 8.716 | 61.080 | 12.779 | 6.376 | 18.461 | 22.558 | 8.559 |
| HEMBB1001266 | 2.010 | 9.088 | 3.704 | 1.682 | 16.420 | 18.653 | 1.717 | 1.611 |
| HEMBB1001267 | 131.334 | 93.697 | 391.730 | 88.886 | 45.610 | 62.418 | 33.457 | 63.350 |
| HEMBB1001271 | 31.480 | 28.408 | 63.773 | 19.821 | 15.244 | 12.530 | 8.683 | 10.739 |
| HEMBB1001282 | 41.166 | 11.440 | 25.546 | 10.847 | 7.531 | 21.762 | 15.737 | 10.592 |
| HEMBB1001287 | 195.274 | 200.678 | 131.870 | 63.454 | 15.491 | 70.758 | 43.360 | 52.931 |
| HEMBB1001288 | 40.232 | 10.227 | 25.481 | 9.789 | 5.520 | 21.519 | 16.538 | 9.861 |
| HEMBB1001289 | 84.233 | 74.730 | 246.417 | 61.615 | 31.689 | 36.447 | 24.521 | 38.077 |
| HEMBB1001290 | 57.742 | 13.181 | 11.174 | 33.921 | 23.320 | 24.860 | 82.615 | 15.369 |
| HEMBB1001294 | 80.761 | 23.745 | 72.937 | 16.689 | 20.147 | 45.268 | 37.686 | 22.951 |
| HEMBB1001299 | 58.616 | 17.094 | 44.424 | 13.532 | 14.650 | 31.325 | 32.822 | 12.329 |
| HEMBB1001302 | 87.107 | 24.979 | 56.357 | 23.389 | 20.784 | 37.921 | 28.849 | 21.981 |
| HEMBB1001304 | 12.134 | 0.119 | 5.246 | 19.403 | 1.810 | 3.978 | 2.153 | 1.580 |
| HEMBB1001314 | 6.410 | 5.111 | 25.042 | 5.961 | 3.244 | 7.037 | 2.954 | 2.258 |
| HEMBB1001315 | 3.706 | 8.398 | 10.733 | 3.067 | 1.405 | 3.652 | 1.659 | 1.943 |
| HEMBB1001317 | 39.137 | 34.918 | 87.084 | 32.290 | 25.473 | 21.551 | 14.009 | 18.118 |
| HEMBB1001326 | 13.902 | 5.726 | 7.704 | 2.886 | 2.324 | 1.546 | 2.008 | 5.612 |
| HEMBB1001331 | 34.871 | 17.866 | 37.859 | 11.626 | 6.188 | 23.138 | 24.975 | 17.786 |
| HEMBB1001335 | 22.550 | 20.911 | 19.341 | 12.458 | 15.964 | 18.477 | 15.941 | 5.614 |
| HEMBB1001337 | 61.645 | 43.894 | 187.675 | 45.250 | 52.185 | 20.178 | 25.750 | 29.233 |
| HEMBB1001339 | 20.634 | 25.030 | 21.230 | 11.541 | 12.874 | 18.490 | 12.601 | 13.466 |
| HEMBB1001344 | 31.209 | 8.322 | 15.710 | 5.412 | 6.749 | 16.517 | 16.482 | 9.869 |
| HEMBB1001346 | 44.149 | 21.512 | 38.191 | 15.415 | 9.432 | 26.936 | 17.706 | 15.965 |
| HEMBB1001348 | 66.624 | 40.319 | 173.356 | 39.887 | 26.835 | 31.783 | 20.641 | 26.670 |
| HEMBB1001350 | 103.603 | 17.400 | 35.832 | 13.555 | 13.837 | 54.503 | 34.694 | 19.925 |
| HEMBB1001356 | 12.440 | 11.385 | 25.095 | 8.592 | 6.787 | 7.806 | 8.759 | 8.923 |
| HEMBB1001364 | 28.525 | 14.483 | 31.452 | 11.829 | 13.494 | 12.620 | 13.025 | 10.117 |
| HEMBB1001366 | 57.883 | 53.690 | 210.263 | 52.112 | 27.208 | 41.191 | 29.156 | 32.064 |
| HEMBB1001367 | 140.660 | 59.744 | 283.101 | 54.260 | 46.338 | 67.368 | 43.944 | 48.485 |
| HEMBB1001369 | 17.341 | 20.708 | 71.044 | 14.855 | 7.629 | 12.537 | 7.158 | 14.407 |
| HEMBB1001380 | 50.204 | 67.647 | 124.463 | 41.290 | 43.730 | 41.591 | 29.026 | 63.358 |
| HEMBB1001381 | 19.588 | 19.545 | 34.218 | 14.113 | 18.710 | 9.428 | 10.202 | 13.801 |
| HEMBB1001384 | 17.779 | 11.154 | 26.926 | 11.606 | 19.030 | 10.038 | 7.367 | 14.535 |
| HEMBB1001387 | 20.705 | 16.837 | 19.148 | 9.955 | 8.901 | 15.994 | 7.831 | 13.345 |
| HEMBB1001394 | 21.419 | 19.091 | 32.720 | 17.551 | 19.172 | 11.590 | 12.282 | 11.322 |
| HEMBB1001407 | 39.158 | 17.718 | 75.721 | 24.299 | 17.481 | 17.410 | 20.342 | 15.525 |
| HEMBB1001410 | 18.880 | 3.346 | 6.042 | 2.907 | 2.655 | 0.000 | 2.839 | 2.094 |
| HEMBB1001413 | 32.291 | 25.769 | 80.279 | 17.033 | 21.102 | 11.132 | 12.610 | 24.207 |
| HEMBB1001419 | 36.323 | 42.415 | 185.239 | 24.790 | 21.849 | 17.972 | 13.895 | 31.342 |
| HEMBB1001421 | 29.464 | 57.495 | 109.370 | 12.065 | 15.685 | 64.181 | 165.647 | 23.322 |
| HEMBB1001424 | 9.663 | 7.148 | 10.294 | 6.073 | 6.773 | 7.183 | 5.215 | 8.524 |
| HEMBB1001426 | 36.471 | 25.897 | 86.872 | 20.138 | 17.823 | 19.534 | 15.347 | 23.782 |
| HEMBB1001429 | 60.351 | 47.669 | 39.928 | 29.802 | 21.695 | 39.456 | 39.474 | 41.210 |
| HEMBB1001436 | 168.445 | 86.814 | 350.902 | 88.825 | 54.546 | 86.724 | 48.813 | 58.527 |
| HEMBB1001443 | 20.733 | 11.137 | 12.445 | 8.769 | 16.707 | 14.531 | 9.581 | 12.477 |
| HEMBB1001449 | 70.239 | 34.064 | 146.511 | 28.311 | 23.391 | 19.979 | 16.080 | 22.377 |
| HEMBB1001454 | 60.851 | 40.766 | 133.878 | 33.168 | 28.709 | 36.541 | 29.720 | 26.623 |
| HEMBB1001458 | 77.938 | 28.808 | 33.472 | 15.970 | 29.260 | 40.965 | 25.268 | 28.079 |
| HEMBB1001461 | 44.192 | 44.580 | 179.531 | 65.974 | 16.217 | 45.935 | 14.669 | 27.974 |
| HEMBB1001463 | 57.949 | 102.937 | 230.980 | 60.751 | 41.957 | 48.857 | 25.233 | 38.517 |
| HEMBB1001464 | 18.058 | 9.999 | 14.908 | 10.039 | 7.528 | 8.680 | 2.638 | 2.964 |

TABLE 38

| | | | | | | | | |
|---|---|---|---|---|---|---|---|---|
| HEMBB1001466 | 31.340 | 22.324 | 20.480 | 15.496 | 3.611 | 15.533 | 10.020 | 13.761 |
| HEMMB1001482 | 12.741 | 4.057 | 9.987 | 4.175 | 4.887 | 24.039 | 4.114 | 4.470 |
| HEMBB1001500 | 26.823 | 21.417 | 65.107 | 17.492 | 9.196 | 12.958 | 6.167 | 14.603 |
| HEMBB1001505 | 116.783 | 105.297 | 302.199 | 104.682 | 36.419 | 54.346 | 38.027 | 46.591 |
| HEMBB1001521 | 55.379 | 38.602 | 133.188 | 25.792 | 20.204 | 23.504 | 18.628 | 22.786 |
| HEMBB1001527 | 331.186 | 160.160 | 252.225 | 131.308 | 116.694 | 179.333 | 72.732 | 79.869 |
| HEMBB1001530 | 24.722 | 25.693 | 57.090 | 19.457 | 7.662 | 20.875 | 31.031 | 23.503 |
| HEMBB1001531 | 43.913 | 51.679 | 130.225 | 34.674 | 21.061 | 27.704 | 18.966 | 32.578 |
| HEMBB1001532 | 6.957 | 3.901 | 34.322 | 7.593 | 1.875 | 8.172 | 300.808 | 7.501 |

TABLE 38-continued

| | | | | | | | | |
|---|---|---|---|---|---|---|---|---|
| HEMBB1001535 | 71.554 | 59.202 | 131.794 | 46.369 | 28.936 | 34.644 | 21.690 | 23.017 |
| HEMBB1001536 | 73.109 | 48.204 | 106.813 | 35.175 | 16.411 | 22.356 | 19.126 | 20.785 |
| HEMBB1001537 | 40.809 | 54.756 | 140.043 | 43.830 | 21.583 | 31.273 | 8.692 | 29.500 |
| HEMBB1001542 | 79.436 | 33.152 | 94.294 | 34.360 | 26.100 | 44.300 | 19.679 | 22.657 |
| HEMBB1001543 | 55.819 | 14.588 | 8.417 | 4.239 | 7.702 | 20.740 | 11.834 | 18.032 |
| HEMBB1001547 | 10.746 | 8.433 | 12.415 | 9.202 | 10.101 | 15.047 | 10.631 | 8.198 |
| HEMBB1001548 | 163.125 | 42.223 | 39.134 | 33.781 | 26.421 | 115.789 | 76.174 | 67.211 |
| HEMBB1001551 | 32.248 | 10.176 | 8.937 | 9.728 | 20.037 | 69.247 | 7078.074 | 11.439 |
| HEMBB1001555 | 62.998 | 58.959 | 166.842 | 57.865 | 40.731 | 30.981 | 17.189 | 40.721 |
| HEMBB1001562 | 67.088 | 35.544 | 83.929 | 24.475 | 18.852 | 28.472 | 27.682 | 23.295 |
| HEMBB1001564 | 139.467 | 320.422 | 580.390 | 304.052 | 124.857 | 300.720 | 202.502 | 439.361 |
| HEMBB1001565 | 56.749 | 43.545 | 123.727 | 39.891 | 29.530 | 30.029 | 17.527 | 28.501 |
| HEMBB1001569 | 34.482 | 26.904 | 100.487 | 28.883 | 16.462 | 19.020 | 8.403 | 16.605 |
| HEMBB1001573 | 48.940 | 40.308 | 65.598 | 41.979 | 32.247 | 35.238 | 25.583 | 36.979 |
| HEMB81001585 | 153.364 | 57.831 | 211.685 | 61.076 | 40.832 | 38.446 | 18.915 | 42.636 |
| HEMBB1001586 | 44.946 | 40.343 | 113.224 | 34.426 | 18.386 | 24.673 | 16.535 | 26.124 |
| HEMBB1001588 | 157.947 | 130.811 | 402.650 | 111.293 | 69.831 | 80.240 | 46.050 | 75.499 |
| HEMBB1001595 | 12.602 | 11.160 | 44.464 | 13.949 | 6.811 | 11.538 | 4.359 | 11.569 |
| HEMBB1001596 | 53.986 | 20.798 | 39.629 | 25.473 | 20.578 | 32.621 | 23.309 | 38.564 |
| HEMBB1001599 | 29.275 | 7.352 | 13.267 | 11.568 | 5.279 | 15.756 | 10.260 | 5.135 |
| HEMBB1001603 | 3.581 | 2.642 | 7.782 | 4.279 | 3.051 | 0.341 | 1.424 | 3.160 |
| HEMBB1001606 | 6.897 | 7.220 | 7.226 | 7.657 | 3.104 | 5.383 | 5.658 | 4.364 |
| HEMBB1001612 | 101.576 | 58.128 | 240.469 | 58.770 | 36.287 | 42.917 | 27.221 | 40.063 |
| HEMBB1001618 | 52.604 | 38.648 | 141.745 | 37.723 | 24.274 | 24.922 | 17.197 | 24.223 |
| HEMBB1001619 | 59.431 | 78.268 | 138.545 | 63.285 | 52.275 | 37.035 | 22.185 | 38.081 |
| HEMBB1001623 | 33.128 | 8.489 | 11.122 | 6.318 | 8.326 | 16.007 | 3.331 | 7.918 |
| HEMBB1001625 | 10.068 | 16.076 | 8.496 | 7.577 | 2.293 | 8.389 | 1.716 | 4.647 |
| HEMBB1001630 | 7.144 | 5.464 | 31.186 | 8.383 | 3.256 | 11.196 | 3.053 | 5.942 |
| HEMBB1001635 | 18.151 | 8.186 | 33.138 | 13.501 | 9.143 | 9.688 | 44.037 | 8.859 |
| HEMBB1001637 | 40.224 | 35.174 | 58.964 | 24.082 | 26.640 | 26.340 | 20.792 | 26.243 |
| HEMBB1001641 | 21.655 | 10.768 | 33.553 | 9.122 | 5.845 | 7.210 | 5.796 | 8.300 |
| HEMBB1001653 | 76.468 | 45.984 | 138.114 | 33.606 | 30.023 | 33.136 | 16.720 | 25.949 |
| HEMBB1001665 | 3.000 | 0.352 | 5.654 | 0.275 | 0.718 | 0.106 | 0.899 | 0.407 |
| HEMBB1001666 | 48.027 | 23.276 | 59.669 | 22.201 | 9.196 | 20.512 | 10.659 | 15.687 |
| HEMBB1001667 | 2.570 | 7.909 | 3.107 | 5.847 | 8.690 | 2.748 | 1.999 | 8.738 |
| HEMBB1001668 | 2.545 | 8.886 | 13.392 | 8.498 | 18.131 | 3.355 | 1.531 | 3.932 |
| HEMBB1001669 | 5.751 | 5.364 | 10.395 | 3.219 | 4.970 | 5.110 | 4.341 | 2.139 |
| HEMBB1001670 | 17.795 | 10.903 | 34.891 | 20.715 | 11.725 | 22.401 | 12.909 | 20.514 |
| HEMBB1001673 | 69.924 | 44.194 | 58.806 | 53.036 | 21.640 | 40.433 | 25.038 | 49.339 |
| HEMBB1001675 | 58.961 | 13.650 | 21.648 | 10.914 | 9.356 | 22.270 | 15.894 | 11.977 |
| HEMBB1001679 | 51.245 | 9.166 | 29.461 | 6.718 | 11.101 | 24.642 | 13.266 | 4.383 |
| HEMBB1001684 | 27.854 | 11.218 | 30.139 | 14.666 | 11.546 | 25.422 | 15.072 | 13.683 |
| HEMBB1001685 | 9.626 | 8.721 | 34.446 | 7.134 | 4.659 | 1.316 | 3.180 | 6.172 |
| HEMBB1001695 | 2.706 | 4.723 | 4.741 | 1.162 | 8.059 | 1.109 | 1.036 | 1.119 |
| HEMBB1001703 | 116.774 | 37.756 | 115.693 | 36.901 | 34.790 | 69.383 | 44.901 | 43.576 |
| HEMBB1001704 | 67.385 | 52.606 | 211.228 | 52.452 | 40.406 | 43.432 | 33.952 | 54.662 |
| HEMBB1001706 | 122.282 | 70.476 | 227.746 | 77.627 | 63.608 | 53.010 | 38.740 | 56.789 |
| HEMBB1001707 | 111.416 | 69.815 | 154.286 | 51.656 | 60.773 | 50.260 | 33.306 | 43.746 |
| HEMBB1001717 | 14.112 | 16.260 | 60.454 | 10.609 | 5.688 | 9.921 | 4.816 | 8.073 |
| HEMBB1001731 | 29.550 | 36.222 | 21.992 | 33.872 | 22.551 | 35.654 | 37.976 | 32.089 |
| HEMBB1001734 | 75.818 | 39.477 | 107.419 | 26.507 | 15.856 | 20.715 | 17.010 | 17.320 |
| HEMBB1001735 | 63.245 | 22.136 | 169.823 | 34.289 | 26.478 | 18.371 | 17.292 | 27.924 |
| HEMBB1001736 | 20.722 | 18.061 | 27.944 | 17.598 | 12.534 | 9.551 | 10.504 | 13.178 |
| HEMBB1001747 | 21.158 | 15.281 | 18.501 | 9.967 | 9.806 | 11.088 | 17.268 | 12.572 |
| HEMBB1001749 | 89.421 | 90.342 | 429.206 | 126.585 | 53.728 | 56.733 | 28.560 | 64.467 |

TABLE 39

| | | | | | | | | |
|---|---|---|---|---|---|---|---|---|
| HEMBB1001753 | 85.135 | 63.020 | 101.881 | 44.766 | 60.100 | 46.138 | 48.988 | 44.990 |
| HEMBB1001756 | 86.556 | 37.048 | 83.531 | 33.276 | 42.763 | 54.273 | 32.005 | 30.821 |
| HEMBB1001757 | 1.981 | 3.522 | 5.232 | 3.590 | 1.394 | 7.486 | 3.256 | 3.014 |
| HEMBB1001760 | 13.573 | 14.554 | 21.053 | 7.204 | 5.280 | 8.129 | 5.242 | 4.088 |
| HEMBB1001762 | 26.210 | 15.945 | 24.826 | 8.467 | 6.461 | 26.934 | 6.893 | 9.656 |
| HEMBB1001780 | 18.738 | 33.363 | 27.562 | 17.311 | 13.893 | 4.277 | 14.584 | 19.429 |
| HEMBB1001785 | 3.266 | 2.954 | 7.974 | 3.522 | 3.900 | 7.429 | 3.964 | 4.008 |
| HEMBB1001788 | 77.710 | 51.716 | 232.298 | 72.096 | 40.555 | 41.418 | 29.586 | 33.423 |
| HEMBB1001793 | 221.348 | 29.215 | 45.528 | 20.500 | 22.918 | 33.927 | 36.095 | 25.245 |
| HEMBB1001797 | 4.049 | 9.015 | 10.442 | 4.015 | 2.532 | 8.773 | 2.904 | 6.333 |
| HEMBB1001802 | 430.563 | 24.213 | 34.832 | 14.183 | 17.392 | 26.448 | 23.001 | 29.744 |
| HEMBB1001812 | 91.804 | 71.389 | 218.174 | 56.457 | 56.645 | 54.459 | 15.772 | 55.255 |
| HEMBB1001815 | 506.853 | 426.652 | 275.995 | 120.005 | 129.468 | 289.852 | 148.011 | 122.368 |
| HEMBB1001816 | 90.696 | 55.478 | 178.334 | 52.637 | 25.170 | 45.331 | 35.194 | 47.899 |
| HEMBB1001831 | 22.874 | 14.551 | 46.474 | 16.825 | 9.329 | 19.975 | 9.745 | 18.634 |
| HEMBB1001834 | 456.615 | 299.793 | 406.927 | 41.146 | 284.283 | 499.103 | 267.485 | 306.611 |
| HEMBB1001836 | 138.292 | 91.469 | 348.309 | 101.544 | 73.058 | 67.103 | 40.539 | 76.261 |
| HEMBB1001839 | 9.720 | 6.600 | 7.318 | 0.000 | 2.606 | 4.296 | 2.217 | 2.738 |

TABLE 39-continued

| | | | | | | | | |
|---|---|---|---|---|---|---|---|---|
| HEMBB1001841 | 345.524 | 134.230 | 67.049 | 25.938 | 60.560 | 21.530 | 21.177 | 18.486 |
| HEMBB1001844 | 61.041 | 25.820 | 34.819 | 14.237 | 14.648 | 34.333 | 20.655 | 31.102 |
| HEMBB1001847 | 126.241 | 111.341 | 239.122 | 147.873 | 65.849 | 86.164 | 47.980 | 108.378 |
| HEMBB1001848 | 40.802 | 39.856 | 24.837 | 12.646 | 9.727 | 18.893 | 18.093 | 17.754 |
| HEMBB1001850 | 171.151 | 101.141 | 118.680 | 33.622 | 64.050 | 118.364 | 50.599 | 75.857 |
| HEMBB1001859 | 133.676 | 77.853 | 231.163 | 65.024 | 41.660 | 123.173 | 103.961 | 48.695 |
| HEMBB1001863 | 115.353 | 92.421 | 255.141 | 83.601 | 85.833 | 53.693 | 30.832 | 49.888 |
| HEMBB1001867 | 15.427 | 15.822 | 8.336 | 10.061 | 4.673 | 8.415 | 6.299 | 9.816 |
| HEMBB1001868 | 24.470 | 17.457 | 24.238 | 7.996 | 8.810 | 8.133 | 10.520 | 11.923 |
| HEMBB1001869 | 82.894 | 76.711 | 234.322 | 61.007 | 44.801 | 45.547 | 29.853 | 39.008 |
| HEMBB1001872 | 15.921 | 7.288 | 5.998 | 10.151 | 2.561 | 5.674 | 9.542 | 5.964 |
| HEMBB1001874 | 36.336 | 11.065 | 22.113 | 15.221 | 9.515 | 14.138 | 6.058 | 5.891 |
| HEMBB1001875 | 7.615 | 19.234 | 13.755 | 26.314 | 11.646 | 3.662 | 5.863 | 7.228 |
| HEMBB1001880 | 107.638 | 82.806 | 115.014 | 59.163 | 39.712 | 47.440 | 27.454 | 37.214 |
| HEMBB1001899 | 15.785 | 11.630 | 15.181 | 7.571 | 2.259 | 12.203 | 4.190 | 3.366 |
| HEMBB1001903 | 59.215 | 24.149 | 27.564 | 15.205 | 8.601 | 28.805 | 15.592 | 15.765 |
| HEMBB1001905 | 29.932 | 24.402 | 20.256 | 15.117 | 8.559 | 17.138 | 12.021 | 12.009 |
| HEMBB1001906 | 15.456 | 13.077 | 51.260 | 10.147 | 16.547 | 10.906 | 7.943 | 9.129 |
| HEMBB1001908 | 35.095 | 32.316 | 100.465 | 26.514 | 24.742 | 20.649 | 8.759 | 14.223 |
| HEMBB1001910 | 67.419 | 35.922 | 139.126 | 58.266 | 43.100 | 26.178 | 19.330 | 29.710 |
| HEMBB1001911 | 50.456 | 46.682 | 196.311 | 58.337 | 31.782 | 35.278 | 19.934 | 32.009 |
| HEMBB1001915 | 40.796 | 27.017 | 19.351 | 20.885 | 15.345 | 12.662 | 9.798 | 36.052 |
| HEMBB1001921 | 95.398 | 115.190 | 314.157 | 85.049 | 59.940 | 59.397 | 36.034 | 60.585 |
| HEMBB1001922 | 54.587 | 37.299 | 107.814 | 29.796 | 15.712 | 23.741 | 15.662 | 16.568 |
| HEMBB1001925 | 35.478 | 39.156 | 106.631 | 23.241 | 15.055 | 16.405 | 13.936 | 15.471 |
| HEMBB1001930 | 9.272 | 7.467 | 11.545 | 7.045 | 3.402 | 5.636 | 2.969 | 5.808 |
| HEMBB1001944 | 122.259 | 83.163 | 268.572 | 86.582 | 66.995 | 51.236 | 27.262 | 45.542 |
| HEMBB1001945 | 55.555 | 20.668 | 28.702 | 7.169 | 21.076 | 24.208 | 18.042 | 10.472 |
| HEMBB1001947 | 47.254 | 12.987 | 21.887 | 16.223 | 6.133 | 25.673 | 16.697 | 13.440 |
| HEMBB1001950 | 99.345 | 31.711 | 42.202 | 32.724 | 17.168 | 68.211 | 28.763 | 30.429 |
| HEMBB1001952 | 67.117 | 40.169 | 164.691 | 39.168 | 16.287 | 31.103 | 11.276 | 24.511 |
| HEMBB1001953 | 56.049 | 47.572 | 147.635 | 34.659 | 22.662 | 21.660 | 13.445 | 22.280 |
| HEMBB1001957 | 43.669 | 20.350 | 106.261 | 26.369 | 16.837 | 16.589 | 5.199 | 12.837 |
| HEMBB1001959 | 26.731 | 45.573 | 72.402 | 48.003 | 21.477 | 24.564 | 17.194 | 36.361 |
| HEMBB1001962 | 59.585 | 38.413 | 125.747 | 48.471 | 52.786 | 46.598 | 20.834 | 29.320 |
| HEMBB1001967 | 156.252 | 96.306 | 460.639 | 121.361 | 89.090 | 70.066 | 46.606 | 68.839 |
| HEMBB1001973 | 62.418 | 55.111 | 203.353 | 61.777 | 40.564 | 39.531 | 24.193 | 43.482 |
| HEMBB1001978 | 205.611 | 67.998 | 184.804 | 55.506 | 42.195 | 56.711 | 62.043 | 55.171 |
| HEMBB1001983 | 115.219 | 97.908 | 189.950 | 79.417 | 69.496 | 62.957 | 41.995 | 65.291 |
| HEMBB1001987 | 23.094 | 30.009 | 63.743 | 16.838 | 10.970 | 10.414 | 5.543 | 10.645 |
| HEMBB1001988 | 26.549 | 17.876 | 71.399 | 12.651 | 11.631 | 11.873 | 6.563 | 10.248 |
| HEMBB1001990 | 61.049 | 28.808 | 125.791 | 31.477 | 30.752 | 26.525 | 9.894 | 24.366 |
| HEMBB1001996 | 40.435 | 12.303 | 17.096 | 14.159 | 3.837 | 18.573 | 11.696 | 13.433 |
| HEMBB1001997 | 91.453 | 62.313 | 247.838 | 64.724 | 40.131 | 29.522 | 27.492 | 42.942 |
| HEMBB1001999 | 28.583 | 9.839 | 33.748 | 34.520 | 11.455 | 23.048 | 14.798 | 25.158 |
| HEMBB1002002 | 19.354 | 10.115 | 14.415 | 9.527 | 16.781 | 12.044 | 7.088 | 14.724 |

TABLE 40

| | | | | | | | | |
|---|---|---|---|---|---|---|---|---|
| HEMBB1002005 | 127.202 | 87.407 | 314.165 | 82.406 | 66.505 | 55.577 | 40.792 | 64.185 |
| HEMBB1002009 | 0.000 | 1.364 | 22.770 | 0.807 | 4.369 | 1.295 | 0.000 | 0.000 |
| HEMBB1002013 | 28.258 | 13.676 | 16.813 | 10.399 | 10.765 | 17.046 | 7.782 | 9.691 |
| HEMBB1002015 | 105.576 | 48.524 | 66.937 | 36.377 | 38.220 | 74.637 | 28.221 | 34.621 |
| HEMBB1002024 | 216.724 | 27.841 | 16.159 | 12.961 | 10.268 | 16.725 | 13.378 | 30.580 |
| HEMBB1002035 | 46.139 | 20.267 | 93.090 | 25.830 | 19.155 | 14.290 | 9.089 | 10.861 |
| HEMBB1002039 | 56.819 | 33.510 | 91.779 | 23.686 | 12.816 | 13.451 | 13.710 | 16.666 |
| HEMBB1002041 | 64.639 | 34.426 | 51.061 | 22.611 | 27.241 | 31.364 | 25.209 | 28.240 |
| HEMBB1002042 | 108.989 | 70.262 | 244.087 | 61.596 | 54.097 | 58.195 | 45.407 | 53.478 |
| HEMBB1002043 | 45.022 | 36.752 | 179.777 | 48.242 | 21.779 | 25.603 | 30.919 | 28.446 |
| HEMBB1002044 | 13.181 | 2.012 | 5.797 | 1.053 | 1.982 | 1.313 | 3.432 | 2.045 |
| HEMBB1002045 | 289.530 | 197.322 | 441.790 | 143.182 | 150.349 | 206.083 | 108.290 | 118.515 |
| HEMBB1002049 | 35.193 | 24.481 | 83.015 | 26.999 | 19.710 | 27.535 | 16.278 | 24.921 |
| HEMBB1002050 | 37.095 | 16.954 | 49.110 | 12.868 | 13.580 | 16.690 | 9.422 | 14.540 |
| HEMBB1002051 | 36.389 | 19.655 | 68.218 | 18.665 | 8.800 | 22.352 | 16.403 | 17.616 |
| HEMBB1002068 | 75.935 | 30.174 | 53.312 | 27.588 | 23.758 | 28.553 | 40.522 | 36.664 |
| HEMBB1002069 | 213.038 | 176.212 | 471.114 | 127.141 | 113.252 | 145.813 | 82.555 | 84.929 |
| HEMBB1002075 | 42.631 | 31.316 | 161.071 | 28.782 | 21.239 | 25.996 | 13.087 | 18.589 |
| HEMBB1002079 | 16.958 | 10.592 | 15.974 | 7.658 | 4.913 | 11.054 | 12.406 | 9.170 |
| HEMBB1002080 | 43.775 | 32.579 | 72.576 | 24.001 | 9.827 | 28.608 | 17.214 | 17.433 |
| HEMBB1002082 | 26.775 | 8.257 | 21.193 | 4.448 | 6.280 | 19.090 | 464.903 | 8.346 |
| HEMBB1002084 | 17.127 | 6.840 | 43.925 | 4.043 | 9.757 | 26.316 | 9.627 | 6.512 |
| HEMBB1002088 | 90.318 | 38.977 | 65.816 | 40.755 | 47.974 | 81.367 | 57.452 | 75.281 |
| HEMBB1002092 | 192.949 | 59.522 | 268.965 | 49.978 | 47.797 | 60.595 | 48.524 | 38.080 |
| HEMBB1002094 | 127.875 | 84.707 | 379.671 | 89.066 | 80.779 | 70.636 | 38.807 | 57.037 |
| HEMBB1002103 | 29.830 | 9.307 | 18.867 | 12.419 | 117.011 | 11.825 | 10.555 | 6.133 |
| HEMBB1002109 | 28.380 | 23.579 | 104.568 | 24.307 | 17.018 | 17.089 | 11.301 | 21.844 |

TABLE 40-continued

| | | | | | | | | |
|---|---|---|---|---|---|---|---|---|
| HEMBB1002115 | 71.073 | 86.440 | 117.523 | 95.976 | 28.307 | 85.908 | 60.445 | 114.378 |
| HEMBB1002120 | 16.393 | 10.090 | 4.147 | 2.085 | 3.568 | 9.594 | 4.954 | 4.539 |
| HEMBB1002121 | 12.050 | 2.757 | 6.522 | 1.146 | 2.007 | 0.000 | 1.999 | 1.549 |
| HEMBB1002134 | 784.781 | 365.377 | 605.805 | 262.168 | 223.204 | 719.592 | 534.370 | 450.949 |
| HEMBB1002136 | 109.220 | 32.405 | 75.010 | 27.402 | 26.278 | 36.231 | 38.283 | 23.593 |
| HEMBB1002138 | 17.812 | 14.057 | 17.210 | 7.413 | 9.287 | 10.613 | 20.319 | 9.644 |
| HEMBB1002139 | 51.267 | 37.549 | 168.617 | 27.467 | 17.855 | 27.091 | 16.428 | 23.177 |
| HEMBB1002141 | 82.369 | 29.424 | 54.387 | 14.566 | 15.214 | 39.768 | 33.139 | 22.856 |
| HEMBB1002142 | 70.553 | 42.309 | 156.252 | 36.636 | 14.797 | 26.769 | 15.277 | 22.894 |
| HEMBB1002145 | 40.661 | 16.263 | 15.725 | 8.229 | 13.984 | 21.757 | 14.873 | 15.525 |
| HEMBB1002152 | 46.728 | 36.893 | 105.608 | 65.422 | 40.064 | 25.225 | 29.211 | 42.935 |
| HEMBB1002162 | 40.153 | 34.008 | 96.274 | 29.709 | 19.847 | 47.860 | 22.055 | 40.550 |
| HEMBB1002173 | 53.191 | 41.151 | 147.055 | 26.912 | 34.538 | 16.431 | 19.449 | 25.327 |
| HEMBB1002189 | 73.400 | 88.057 | 211.287 | 73.810 | 54.029 | 46.682 | 45.749 | 55.885 |
| HEMBB1002190 | 33.242 | 51.561 | 233.972 | 49.809 | 19.665 | 27.376 | 13.129 | 61.389 |
| HEMBB1002193 | 69.174 | 22.324 | 33.672 | 10.803 | 18.423 | 27.938 | 24.748 | 16.109 |
| HEMBB1002217 | 50.175 | 37.602 | 98.092 | 38.769 | 24.723 | 33.043 | 18.735 | 39.436 |
| HEMBB1002218 | 596.902 | 272.867 | 712.867 | 191.461 | 186.314 | 373.711 | 195.571 | 197.556 |
| HEMBB1002228 | 88.583 | 45.763 | 205.932 | 47.852 | 46.693 | 41.923 | 37.485 | 53.876 |
| HEMBB1002232 | 56.752 | 32.790 | 128.643 | 36.535 | 28.693 | 32.710 | 31.447 | 41.940 |
| HEMBB1002245 | 31.084 | 9.332 | 17.943 | 11.049 | 11.834 | 11.864 | 17.012 | 14.199 |
| HEMBB1002247 | 151.502 | 27.325 | 64.167 | 10.018 | 26.829 | 62.501 | 35.734 | 21.698 |
| HEMBB1002249 | 153.327 | 94.814 | 380.989 | 101.573 | 65.579 | 80.049 | 62.653 | 85.673 |
| HEMBM1002254 | 43.885 | 36.756 | 118.582 | 29.328 | 19.323 | 11.675 | 12.693 | 22.229 |
| HEMBB1002255 | 8.633 | 2.293 | 14.174 | 8.771 | 1.813 | 2.385 | 3.358 | 3.589 |
| HEMBB1002266 | 5.303 | 5.716 | 8.530 | 6.222 | 1.842 | 2.404 | 4.411 | 2.295 |
| HEMBB1002271 | 160.682 | 46.654 | 157.828 | 58.291 | 63.843 | 72.913 | 62.659 | 73.702 |
| HEMBB1002280 | 24.597 | 13.246 | 76.763 | 13.976 | 7.742 | 9.196 | 9.200 | 16.479 |
| HEMBB1002296 | 67.004 | 21.270 | 52.536 | 34.388 | 49.938 | 53.045 | 123.030 | 41.218 |
| HEMBB1002300 | 94.815 | 28.682 | 50.102 | 35.939 | 13.923 | 29.792 | 25.246 | 21.629 |
| HEMBB1002302 | 51.059 | 31.157 | 28.441 | 17.568 | 17.905 | 26.026 | 22.516 | 30.501 |
| HEMBB1002306 | 35.213 | 49.812 | 33.017 | 23.300 | 15.072 | 17.296 | 14.490 | 16.293 |
| HEMBB1002316 | 19.773 | 8.638 | 19.354 | 3.667 | 9.274 | 9.974 | 8.613 | 6.883 |
| HEMBB1002326 | 201.896 | 126.797 | 406.052 | 154.628 | 89.356 | 85.970 | 54.052 | 98.198 |
| HEMBB1002327 | 85.792 | 48.221 | 184.126 | 47.724 | 32.764 | 29.959 | 17.415 | 34.542 |
| HEMBB1002329 | 69.191 | 21.714 | 43.746 | 25.618 | 17.775 | 24.892 | 32.481 | 27.906 |
| HEMBB1002340 | 18.233 | 28.462 | 7.730 | 3.702 | 3.055 | 4.522 | 2.914 | 5.745 |

TABLE 41

| | | | | | | | | |
|---|---|---|---|---|---|---|---|---|
| HEMBB1002342 | 74.746 | 83.579 | 169.482 | 40.919 | 23.495 | 26.453 | 33.215 | 66.420 |
| HEMBB1002358 | 149.857 | 132.962 | 286.214 | 85.160 | 50.855 | 67.646 | 36.624 | 78.432 |
| HEMBB1002359 | 160.804 | 77.260 | 219.199 | 68.995 | 44.093 | 58.049 | 35.955 | 51.139 |
| HEMBB1002364 | 102.885 | 74.409 | 188.270 | 50.973 | 55.276 | 45.770 | 40.780 | 59.739 |
| HEMBB1002366 | 152.074 | 77.016 | 248.465 | 68.268 | 81.100 | 64.637 | 39.912 | 60.303 |
| HEMBB1002371 | 44.433 | 12.342 | 26.565 | 13.307 | 36.600 | 10.553 | 9.238 | 5.351 |
| HEMBB1002381 | 134.427 | 77.953 | 207.310 | 57.210 | 48.215 | 64.049 | 51.493 | 77.629 |
| HEMBB1002383 | 164.205 | 52.312 | 94.064 | 31.346 | 31.368 | 30.947 | 43.038 | 47.640 |
| HEMBB1002387 | 196.859 | 164.904 | 235.139 | 49.485 | 25.102 | 93.004 | 52.536 | 43.092 |
| HEMBB1002409 | 82.986 | 49.978 | 112.097 | 29.207 | 15.402 | 37.667 | 36.064 | 38.132 |
| HEMBB1002413 | 123.367 | 87.690 | 361.106 | 87.505 | 57.485 | 48.097 | 23.254 | 49.302 |
| HEMBB1002415 | 87.091 | 31.703 | 92.595 | 31.804 | 23.352 | 27.293 | 21.815 | 24.444 |
| HEMBB1002424 | 13.162 | 19.511 | 15.995 | 5.848 | 21.533 | 16.980 | 18.246 | 25.253 |
| HEMBB1002425 | 84.086 | 69.689 | 238.147 | 82.198 | 36.928 | 41.171 | 26.823 | 47.957 |
| HEMBB1002427 | 143.727 | 26.894 | 50.430 | 25.865 | 40.707 | 52.937 | 38.610 | 47.517 |
| HEMBB1002442 | 163.853 | 121.153 | 501.168 | 129.909 | 73.231 | 81.033 | 47.108 | 287.238 |
| HEMBB1002447 | 107.214 | 80.007 | 214.338 | 58.963 | 41.313 | 60.452 | 49.159 | 44.523 |
| HEMBB1002453 | 163.250 | 93.442 | 384.443 | 93.027 | 68.808 | 58.565 | 46.254 | 58.810 |
| HEMBB1002457 | 116.756 | 104.520 | 330.657 | 83.026 | 46.720 | 50.971 | 38.415 | 57.991 |
| HEMBB1002458 | 18.721 | 11.278 | 23.232 | 9.587 | 7.205 | 6.051 | 4.659 | 4.343 |
| HEMBB1002463 | 229.657 | 146.001 | 663.683 | 193.622 | 138.458 | 104.827 | 52.827 | 110.558 |
| HEMBB1002465 | 44.210 | 23.316 | 33.631 | 20.895 | 17.932 | 26.471 | 19.122 | 19.703 |
| HEMBB1002477 | 98.948 | 27.813 | 153.875 | 11.062 | 36.071 | 16.072 | 13.791 | 8.347 |
| HEMBB1002479 | 23.249 | 59.003 | 73.224 | 14.014 | 10.084 | 13.246 | 1.980 | 8.949 |
| HEMBB1002489 | 78.748 | 24.690 | 71.038 | 31.400 | 39.869 | 43.673 | 44.800 | 75.957 |
| HEMBB1002492 | 9.080 | 6.989 | 26.130 | 3.092 | 1.453 | 5.606 | 1.415 | 2.381 |
| HEMBB1002495 | 95.752 | 104.949 | 301.328 | 60.728 | 72.404 | 45.161 | 24.771 | 61.121 |
| HEMBB1002502 | 17.132 | 17.866 | 14.643 | 16.170 | 15.224 | 14.056 | 4.504 | 23.313 |
| HEMBB1002509 | 0.913 | 2.235 | 7.269 | 4.304 | 0.743 | 1.283 | 1.504 | 6.154 |
| HEMBB1002510 | 0.732 | 0.000 | 0.000 | 1.858 | 0.926 | 0.000 | 0.000 | 0.000 |
| HEMBB1002520 | 249.875 | 127.604 | 585.470 | 169.423 | 138.712 | 90.360 | 100.598 | 112.828 |
| HEMBB1002522 | 24.741 | 27.480 | 12.342 | 14.142 | 17.452 | 5.861 | 8.292 | 8.541 |
| HEMBB1002527 | 63.012 | 61.066 | 87.388 | 46.392 | 29.555 | 37.187 | 25.642 | 36.089 |
| HEMBB1002530 | 72.655 | 45.682 | 83.329 | 21.750 | 21.479 | 53.227 | 440.333 | 38.710 |
| HEMBB1002531 | 40.398 | 18.832 | 10.308 | 9.953 | 5.539 | 16.743 | 11.880 | 8.115 |
| HEMBB1002534 | 78.552 | 49.139 | 154.741 | 66.211 | 30.154 | 46.591 | 28.712 | 37.112 |

TABLE 41-continued

| | | | | | | | | |
|---|---|---|---|---|---|---|---|---|
| HEMBB1002536 | 27.609 | 22.843 | 52.264 | 17.646 | 8.234 | 13.078 | 23.458 | 15.919 |
| HEMBB1002544 | 24.012 | 6.185 | 27.814 | 13.117 | 39.363 | 15.921 | 9.427 | 14.017 |
| HEMBB1002545 | 108.234 | 31.929 | 243.949 | 50.972 | 16.032 | 40.343 | 31.828 | 13.472 |
| HEMBB1002550 | 31.850 | 11.452 | 10.668 | 11.228 | 11.049 | 10.100 | 14.262 | 14.910 |
| HEMBB1002556 | 125.621 | 89.607 | 311.607 | 79.974 | 50.209 | 57.837 | 53.696 | 54.119 |
| HEMBB1002571 | 33.047 | 21.526 | 54.457 | 14.847 | 25.892 | 21.961 | 5.482 | 18.608 |
| HEMBB1002579 | 75.252 | 55.132 | 229.479 | 48.891 | 31.521 | 43.266 | 24.667 | 31.554 |
| HEMBB1002582 | 100.572 | 56.574 | 258.453 | 63.093 | 45.740 | 39.580 | 26.474 | 45.912 |
| HEMBB1002584 | 8.325 | 7.614 | 13.574 | 6.883 | 1.796 | 7.655 | 6.183 | 4.955 |
| HEMBB1002587 | 57.430 | 44.383 | 60.900 | 47.981 | 30.048 | 30.562 | 19.161 | 20.854 |
| HEMBB1002590 | 114.241 | 78.587 | 179.926 | 65.737 | 28.629 | 43.657 | 33.101 | 34.032 |
| HEMBB1002596 | 278.617 | 90.944 | 275.018 | 69.006 | 68.247 | 114.505 | 88.149 | 59.750 |
| HEMBB1002600 | 17.618 | 16.003 | 23.907 | 4.699 | 9.726 | 10.133 | 7.945 | 8.940 |
| HEMBB1002601 | 67.910 | 48.188 | 183.948 | 45.346 | 38.021 | 37.423 | 21.860 | 33.698 |
| HEMBB1002603 | 69.793 | 43.222 | 141.343 | 36.733 | 28.849 | 35.264 | 22.033 | 29.436 |
| HEMBB1002607 | 64.941 | 36.284 | 134.598 | 39.424 | 22.220 | 31.501 | 15.575 | 31.024 |
| HEMBB1002610 | 22.852 | 9.200 | 51.294 | 16.832 | 6.664 | 12.856 | 6.433 | 6.515 |
| HEMBB1002613 | 85.026 | 60.872 | 161.891 | 47.532 | 36.559 | 44.841 | 24.569 | 31.062 |
| HEMBB1002614 | 65.074 | 30.721 | 39.687 | 10.970 | 15.910 | 13.297 | 10.461 | 5.438 |
| HEMBB1002615 | 230.370 | 55.581 | 35.517 | 11.758 | 7.258 | 46.064 | 22.857 | 86.789 |
| HEMBB1002617 | 69.016 | 67.288 | 254.296 | 42.530 | 30.217 | 36.395 | 21.284 | 37.688 |
| HEMBB1002623 | 92.506 | 78.124 | 204.116 | 60.739 | 20.110 | 48.078 | 32.253 | 43.355 |
| HEMBB1002624 | 77.755 | 27.026 | 163.976 | 33.2092 | 5.309 | 20.104 | 21.741 | 24.486 |
| HEMBB1002631 | 10.297 | 18.892 | 12.879 | 14.916 | 7.219 | 5.864 | 6.990 | 11.537 |
| HEMBB1002635 | 88.049 | 68.172 | 141.149 | 41.853 | 40.290 | 23.649 | 21.781 | 44.425 |
| HEMBB1002644 | 98.956 | 65.380 | 26.659 | 19.268 | 9.200 | 38.890 | 35.668 | 29.597 |
| HEMBB1002654 | 127.571 | 78.659 | 51.653 | 28.747 | 32.125 | 137.732 | 315.048 | 39.477 |
| HEMBB1002661 | 106.501 | 46.651 | 47.116 | 19.470 | 20.684 | 30.561 | 24.281 | 118.028 |

TABLE 42

| | | | | | | | | |
|---|---|---|---|---|---|---|---|---|
| HEMBB1002663 | 100.783 | 42.600 | 100.008 | 36.841 | 24.382 | 35.028 | 41.975 | 18.150 |
| HEMMB1002664 | 179.828 | 131.008 | 395.057 | 51.235 | 74.731 | 89.130 | 40.814 | 55.262 |
| HEMBB1002667 | 2.206 | 3.466 | 5.138 | 4.981 | 2.314 | 4.033 | 3.301 | 1.422 |
| HEMBB1002683 | 118.247 | 69.327 | 247.117 | 55.886 | 44.381 | 25.944 | 27.017 | 42.278 |
| HEMBB1002684 | 40.291 | 21.056 | 46.317 | 17.772 | 9.039 | 5.460 | 8.120 | 14.377 |
| HEMBB1002686 | 30.893 | 12.882 | 26.031 | 19.059 | 3.146 | 12.807 | 18.055 | 9.131 |
| HEMBB1002692 | 48.969 | 24.335 | 52.440 | 29.779 | 19.960 | 25.893 | 38.755 | 15.268 |
| HEMBB1002693 | 129.760 | 76.886 | 322.740 | 70.620 | 62.314 | 67.760 | 73.429 | 39.005 |
| HEMBB1002697 | 41.673 | 38.793 | 25.105 | 8.999 | 2.058 | 7.613 | 10.266 | 29.797 |
| HEMBB1002699 | 223.756 | 165.884 | 369.080 | 116.529 | 77.378 | 109.419 | 79.393 | 99.532 |
| HEMBB1002702 | 13.506 | 15.782 | 24.367 | 3.561 | 6.434 | 15.599 | 13.253 | 24.914 |
| HEMBB1002705 | 29.934 | 20.276 | 16.478 | 21.230 | 7.599 | 11.487 | 18.202 | 30.589 |
| HEMB01002712 | 29.588 | 10.805 | 47.572 | 15.673 | 13.434 | 15.691 | 7.559 | 16.536 |
| IMR321000028 | 77.081 | 39.937 | 40.934 | 18.725 | 8.281 | 41.195 | 27.733 | 21.472 |
| IMR321000031 | 50.644 | 21.357 | 34.754 | 22.184 | 15.786 | 31.242 | 22.705 | 14.148 |
| IMR321000034 | 76.518 | 63.230 | 37.290 | 51.243 | 23.808 | 43.858 | 26.605 | 67.455 |
| IMR321000039 | 66.895 | 68.027 | 83.136 | 36.653 | 27.339 | 62.232 | 57.760 | 88.100 |
| IMR321000044 | 1.614 | 0.000 | 0.000 | 0.000 | 0.000 | 0.000 | 1.970 | 0.000 |
| IMR321000063 | 131.633 | 84.822 | 66.499 | 84.753 | 43.262 | 73.363 | 69.831 | 80.878 |
| IMR321000085 | 157.704 | 34.180 | 42.747 | 11.752 | 50.766 | 66.106 | 54.160 | 47.424 |
| IMR321000089 | 52.645 | 22.980 | 31.408 | 17.365 | 13.731 | 36.296 | 27.222 | 10.181 |
| IMR321000091 | 39.993 | 32.664 | 43.895 | 41.311 | 25.143 | 35.002 | 20.444 | 63.906 |
| LIVER1000004 | 45.674 | 30.112 | 69.445 | 16.874 | 11.073 | 28.505 | 106.044 | 24.660 |
| LIVER1000008 | 23.703 | 14.444 | 22.304 | 9.381 | 15.657 | 274.776 | 344.333 | 11.282 |
| LIVER1000011 | 107.957 | 31.187 | 106.032 | 30.434 | 41.030 | 41.256 | 348.474 | 63.939 |
| LIVER1000022 | 402.839 | 177.843 | 270.232 | 82.143 | 125.292 | 206.780 | 141.934 | 124.260 |
| LIVER1000025 | 61.584 | 42.776 | 172.307 | 36.300 | 26.856 | 33.045 | 34.820 | 42.189 |
| LIVER1000030 | 62.987 | 24.034 | 69.275 | 29.784 | 17.581 | 22.393 | 51.178 | 22.556 |
| LIVER1000045 | 27.941 | 4.859 | 27.468 | 7.384 | 9.755 | 14.426 | 20.651 | 24.802 |
| LIVER1000046 | 180.297 | 117.998 | 24.240 | 23.527 | 16.373 | 7.466 | 27.795 | 66.724 |
| LIVER1000072 | 24.097 | 35.964 | 6.976 | 11.158 | 7.657 | 8.260 | 16.555 | 4.898 |
| LIVER1000077 | 90.518 | 39.165 | 17.306 | 13.193 | 25.835 | 52.139 | 348.056 | 37.506 |
| LIVER1000080 | 17.084 | 4.918 | 5.980 | 9.600 | 2.294 | 5.176 | 6.495 | 4.479 |
| LIVER1000086 | 82.711 | 55.169 | 150.708 | 18.858 | 19.278 | 176.018 | 481.085 | 27.747 |
| LIVER1000092 | 61.883 | 36.836 | 116.592 | 27.330 | 16.805 | 25.266 | 35.863 | 24.160 |
| LIVER1000095 | 54.562 | 13.959 | 104.146 | 23.878 | 13.158 | 200.163 | 137.395 | 5.508 |
| LIVER1000097 | 138.286 | 11.401 | 12.265 | 8.127 | 9.389 | 9.669 | 32.751 | 7.159 |
| LIVER1000098 | 58.055 | 39.291 | 47.410 | 18.991 | 19.124 | 20.338 | 142.508 | 19.104 |
| LIVER1000100 | 81.693 | 64.546 | 94.504 | 29.185 | 18.588 | 42.254 | 23.727 | 58.633 |
| LIVER1000101 | 52.507 | 16.303 | 57.500 | 10.286 | 8.662 | 17.642 | 6.129 | 27.273 |
| LIVER1000106 | 46.259 | 32.121 | 32.438 | 11.568 | 9.377 | 13.216 | 102.126 | 16.904 |
| LIVER1000108 | 26.277 | 50.565 | 62.172 | 25.422 | 16.619 | 17.243 | 38.369 | 18.508 |
| LIVER1000115 | 23.571 | 18.673 | 71.367 | 14.244 | 11.023 | 17.910 | 427.626 | 11.136 |
| LIVER1000120 | 100.902 | 21.640 | 35.183 | 16.565 | 26.236 | 39.037 | 87.151 | 16.249 |
| LIVER1000138 | 69.624 | 27.584 | 56.479 | 22.794 | 25.076 | 42.015 | 35.937 | 23.833 |

TABLE 42-continued

| | | | | | | | | |
|---|---|---|---|---|---|---|---|---|
| LIVER1000146 | 107.757 | 63.296 | 209.735 | 54.534 | 42.231 | 45.210 | 254.168 | 42.466 |
| LIVER1000148 | 141.467 | 42.327 | 108.510 | 37.031 | 31.920 | 62.584 | 125.466 | 65.728 |
| LIVER1000157 | 97.282 | 37.198 | 50.979 | 49.952 | 35.021 | 43.954 | 52.527 | 43.221 |
| LIVER1000161 | 100.902 | 24.883 | 57.647 | 28.329 | 31.562 | 42.781 | 89.198 | 30.740 |
| LIVER1000167 | 97.214 | 29.093 | 41.460 | 25.700 | 26.316 | 112.706 | 332.789 | 30.702 |
| LIVER1000174 | 53.927 | 23.440 | 26.353 | 13.595 | 12.625 | 36.580 | 71.460 | 10.512 |
| LIVER1000185 | 49.746 | 20.428 | 31.630 | 13.964 | 13.391 | 16.773 | 16.676 | 14.878 |
| LIVER1000187 | 38.332 | 8.211 | 15.200 | 4.654 | 8.084 | 9.846 | 567.808 | 8.320 |
| LIVER1000190 | 93.672 | 29.635 | 50.518 | 15.812 | 18.768 | 23.709 | 41.865 | 11.496 |
| LIVER1000192 | 141.875 | 53.337 | 99.330 | 32.936 | 41.210 | 79.500 | 128.608 | 47.907 |
| MAMMA1000009 | 99.036 | 77.266 | 234.005 | 72.924 | 40.612 | 44.930 | 25.218 | 35.909 |
| MAMMA1000015 | 40.458 | 7.192 | 19.901 | 13.017 | 12.921 | 18.315 | 13.014 | 8.185 |
| MAMMA1000019 | 62.999 | 29.927 | 150.049 | 52.037 | 36.450 | 42.958 | 38.148 | 30.172 |
| MAMMA1000020 | 58.696 | 30.055 | 181.093 | 40.615 | 38.572 | 34.176 | 18.169 | 20.807 |
| MAMMA1000024 | 15.610 | 5.088 | 15.411 | 7.263 | 3.468 | 11.662 | 37.960 | 9.224 |
| MAMMA1000025 | 53.706 | 37.358 | 123.944 | 37.766 | 29.177 | 24.650 | 18.530 | 21.156 |
| MAMMA1000043 | 170.220 | 108.774 | 290.077 | 126.472 | 100.059 | 82.087 | 70.843 | 76.243 |
| MAMMA1000045 | 83.118 | 48.873 | 22.107 | 10.125 | 5.779 | 15.440 | 7.895 | 8.811 |
| MAMMA1000046 | 117.084 | 44.858 | 285.890 | 66.458 | 43.862 | 36.388 | 23.428 | 22.376 |

TABLE 43

| | | | | | | | | |
|---|---|---|---|---|---|---|---|---|
| MAMMA1000055 | 65.118 | 40.884 | 57.307 | 29.859 | 27.445 | 33.405 | 22.066 | 23.563 |
| MAMMA1000057 | 170.331 | 108.479 | 421.160 | 100.366 | 84.331 | 77.475 | 42.047 | 55.847 |
| MAMMA1000060 | 79.698 | 50.265 | 153.319 | 49.223 | 28.927 | 42.539 | 25.636 | 52.458 |
| MAMMA1000069 | 118.921 | 35.010 | 182.272 | 48.764 | 43.720 | 61.342 | 45.357 | 33.115 |
| MAMMA1000084 | 128.354 | 92.819 | 277.404 | 87.542 | 63.176 | 65.262 | 34.266 | 45.092 |
| MAMMA1000085 | 40.199 | 20.019 | 40.608 | 21.956 | 13.181 | 18.822 | 36.347 | 26.209 |
| MAMMA1000092 | 77.338 | 37.915 | 167.474 | 43.988 | 16.101 | 26.961 | 15.531 | 22.390 |
| MAMMA1000096 | 55.344 | 38.495 | 38.888 | 25.605 | 11.893 | 44.990 | 24.784 | 25.160 |
| MAMMA1000097 | 62.546 | 54.694 | 52.522 | 52.269 | 24.807 | 65.730 | 25.787 | 23.298 |
| MAMMA1000102 | 67.585 | 32.797 | 91.551 | 31.689 | 19.430 | 26.892 | 22.353 | 16.842 |
| MAMMA1000103 | 63.752 | 26.301 | 89.530 | 30.004 | 12.188 | 31.709 | 11.461 | 14.718 |
| MAMMA1000106 | 37.916 | 23.228 | 90.795 | 22.075 | 14.445 | 24.686 | 16.649 | 17.569 |
| MAMMA1000117 | 58.533 | 24.502 | 43.190 | 22.445 | 16.140 | 27.418 | 15.487 | 13.269 |
| MAMMA1000118 | 104.168 | 58.433 | 63.822 | 8.833 | 24.039 | 42.731 | 38.062 | 43.242 |
| MAMMA1000129 | 170.665 | 72.256 | 98.813 | 45.970 | 22.181 | 58.739 | 50.197 | 14.587 |
| MAMMA1000133 | 62.435 | 25.090 | 33.061 | 20.713 | 14.310 | 34.686 | 18.642 | 14.101 |
| MAMMA1000134 | 106.522 | 79.090 | 246.344 | 90.530 | 127.758 | 76.596 | 45.325 | 60.360 |
| MAMMA1000139 | 78.566 | 47.362 | 99.179 | 34.535 | 22.772 | 37.601 | 28.841 | 28.280 |
| MAMMA1000141 | 30.121 | 20.528 | 28.150 | 13.910 | 5.510 | 14.314 | 12.120 | 15.748 |
| MAMMA1000143 | 16.647 | 8.669 | 41.797 | 8.690 | 9.949 | 10.059 | 4.040 | 8.280 |
| MAMMA1000150 | 128.128 | 259.413 | 21.844 | 28.777 | 86.623 | 42.827 | 51.840 | 42.986 |
| MAMMA1000155 | 205.031 | 88.642 | 291.247 | 110.884 | 80.817 | 97.755 | 63.045 | 78.585 |
| MAMMA1000163 | 43.643 | 36.898 | 57.239 | 22.848 | 21.852 | 41.672 | 11.036 | 10.618 |
| MAMMA1000171 | 141.225 | 46.928 | 265.746 | 98.189 | 60.007 | 66.037 | 34.872 | 50.109 |
| MAMMA1000173 | 103.027 | 21.955 | 68.080 | 33.572 | 25.668 | 45.271 | 40.340 | 52.609 |
| MAMMA1000175 | 19.316 | 8.683 | 7.960 | 4.550 | 3.535 | 7.894 | 5.974 | 4.015 |
| MAMMA1000183 | 57.490 | 35.830 | 148.702 | 42.892 | 23.250 | 23.680 | 21.050 | 46.992 |
| MAMMA1000191 | 88.722 | 31.449 | 40.834 | 26.064 | 22.392 | 26.766 | 36.253 | 27.729 |
| MAMMA1000192 | 53.467 | 25.096 | 30.205 | 28.380 | 21.976 | 101.288 | 128.339 | 44.025 |
| MAMMA1000193 | 83.936 | 36.823 | 36.836 | 29.409 | 18.905 | 35.131 | 35.059 | 36.667 |
| MAMMA1000198 | 132.127 | 93.550 | 347.292 | 70.840 | 49.278 | 62.924 | 38.858 | 66.720 |
| MAMMA1000204 | 64.455 | 59.079 | 71.789 | 26.771 | 29.275 | 55.156 | 62.132 | 49.295 |
| MAMMA1000207 | 45.771 | 62.052 | 52.332 | 19.986 | 16.418 | 37.618 | 225.196 | 18.506 |
| MAMMA1000214 | 100.292 | 62.311 | 289.223 | 62.541 | 32.825 | 57.748 | 32.755 | 39.770 |
| MAMMA1000220 | 91.389 | 23.816 | 43.034 | 13.919 | 12.649 | 42.421 | 29.143 | 20.494 |
| MAMMA1000221 | 39.338 | 35.655 | 11.931 | 39.315 | 9.426 | 18.802 | 27.741 | 17.121 |
| MAMMA1000226 | 65.096 | 20.174 | 11.901 | 11.838 | 17.236 | 23.487 | 43.016 | 24.801 |
| MAMMA1000227 | 94.333 | 64.156 | 183.365 | 82.763 | 58.478 | 66.811 | 43.961 | 53.250 |
| MAMMA1000230 | 116.378 | 47.908 | 97.869 | 47.218 | 38.196 | 56.380 | 71.726 | 37.727 |
| MAMMA1000241 | 53.737 | 85.177 | 107.748 | 60.815 | 31.230 | 51.839 | 36.525 | 22.770 |
| MAMMA1000245 | 107.413 | 148.468 | 205.437 | 144.478 | 51.682 | 86.017 | 93.183 | 198.398 |
| MAMMA1000248 | 205.478 | 88.411 | 342.827 | 76.468 | 51.702 | 110.723 | 70.650 | 60.978 |
| MAMMA1000251 | 115.401 | 47.888 | 209.360 | 39.959 | 42.597 | 57.904 | 34.572 | 51.015 |
| MAMMA1000254 | 43.161 | 20.910 | 114.081 | 20.548 | 9.699 | 9.885 | 5.346 | 32.024 |
| MAMMA1000257 | 142.781 | 70.118 | 332.822 | 104.425 | 84.387 | 124.673 | 78.270 | 116.103 |
| MAMMA1000262 | 18.952 | 34.301 | 19.786 | 32.516 | 14.840 | 15.513 | 23.805 | 35.519 |
| MAMMA1000264 | 59.532 | 20.630 | 124.043 | 44.847 | 29.466 | 21.390 | 22.616 | 37.039 |
| NAMMA1000266 | 55.476 | 28.959 | 122.654 | 35.663 | 27.018 | 24.021 | 20.212 | 38.284 |
| MAMMA1000270 | 142.968 | 64.234 | 270.948 | 75.022 | 64.760 | 68.130 | 64.006 | 73.994 |
| MAMMA1000271 | 53.605 | 9.611 | 35.682 | 12.139 | 16.139 | 24.236 | 26.722 | 26.433 |
| MAMMA1000277 | 56.407 | 16.435 | 98.448 | 19.751 | 12.725 | 33.047 | 23.839 | 33.012 |
| MAMMA1000278 | 40.286 | 13.365 | 19.395 | 9.730 | 12.609 | 20.423 | 25.204 | 22.237 |
| MAMMA1000279 | 68.661 | 36.984 | 173.379 | 46.809 | 34.441 | 42.500 | 26.143 | 48.597 |
| MAMMA1000283 | 55.199 | 27.095 | 46.168 | 22.395 | 15.870 | 21.308 | 16.298 | 18.504 |

TABLE 43-continued

| | | | | | | | | |
|---|---|---|---|---|---|---|---|---|
| MAMMA1000284 | 76.726 | 67.676 | 42.784 | 39.851 | 34.586 | 47.651 | 39.169 | 48.342 |
| MAMMA1000287 | 73.583 | 58.726 | 142.953 | 39.301 | 31.007 | 27.370 | 29.006 | 35.599 |
| MAMMA1000294 | 457.450 | 361.106 | 313.407 | 116.696 | 112.848 | 343.951 | 155.948 | 100.375 |
| MAMMA1000298 | 31.731 | 25.511 | 41.413 | 16.220 | 16.320 | 14.676 | 22.043 | 20.205 |
| MAMMA1000302 | 109.379 | 58.532 | 280.880 | 69.156 | 44.790 | 36.788 | 28.220 | 40.861 |
| MAMMA1000303 | 67.505 | 14.147 | 18.804 | 11.073 | 33.859 | 26.599 | 30.177 | 30.810 |
| MAMMA1000305 | 32.363 | 19.693 | 108.733 | 15.375 | 12.695 | 14.455 | 13.3S3 | 15.189 |
| MAMMA1000307 | 279.600 | 75.098 | 397.421 | 75.020 | 45.244 | 68.757 | 131.117 | 116.800 |
| MAMMA1000309 | 11.679 | 39.455 | 13.529 | 3.502 | 3.904 | 8.895 | 10.500 | 6.744 |
| MAMMA1000312 | 22.645 | 50.288 | 9.368 | 4.180 | 3.450 | 4.882 | 7.079 | 7.576 |

TABLE 44

| | | | | | | | | |
|---|---|---|---|---|---|---|---|---|
| MAMMA1000313 | 79.577 | 69.550 | 54.317 | 10.741 | 60.526 | 42.964 | 18.206 | 37.303 |
| MAMMA1000331 | 80.910 | 48.868 | 139.047 | 33.811 | 22.564 | 15.207 | 18.580 | 21.385 |
| MAMMA1000335 | 54.800 | 22.399 | 33.190 | 18.244 | 16.273 | 30.688 | 26.611 | 30.790 |
| MAMMA1000339 | 69.222 | 40.948 | 83.679 | 13.158 | 20.941 | 22.134 | 20.026 | 10.739 |
| MAMMA1000340 | 57.498 | 34.708 | 164.968 | 32.922 | 28.610 | 23.069 | 18.858 | 23.519 |
| MAMMA1000348 | 78.099 | 102.955 | 374.737 | 55.033 | 32.546 | 66.256 | 22.303 | 23.575 |
| MAMMA1000356 | 152.238 | 116.086 | 454.516 | 67.232 | 34.525 | 47.884 | 22.865 | 61.267 |
| MAMMA1000358 | 34.367 | 56.332 | 15.362 | 15.091 | 16.743 | 17.405 | 19.645 | 7.358 |
| MAMMA1000360 | 71.104 | 74.351 | 246.244 | 43.414 | 24.093 | 24.945 | 14.842 | 14.739 |
| MAMMA1000631 | 101.653 | 93.468 | 230.215 | 73.577 | 45.022 | 37.236 | 37.987 | 42.992 |
| MAMMA1000363 | 71.108 | 19.232 | 39.013 | 13.717 | 23.713 | 30.739 | 27.813 | 32.485 |
| MAMMA1000370 | 171.867 | 108.830 | 110.466 | 80.949 | 52.076 | 79.266 | 57.877 | 247.810 |
| MAMMA1000371 | 100.543 | 32.223 | 80.873 | 48.039 | 49.442 | 91.739 | 57.647 | 46.599 |
| MAMMA1000372 | 206.850 | 114.326 | 609.068 | 130.138 | 79.980 | 80.890 | 54.857 | 97.509 |
| MAMMA1000385 | 72.074 | 60.911 | 238.462 | 40.061 | 34.528 | 31.361 | 22.458 | 45.681 |
| MAMMA1000388 | 118.855 | 69.094 | 105.789 | 42.626 | 50.059 | 55.389 | 37.396 | 37.825 |
| MAMMA1000395 | 97.031 | 44.493 | 34.493 | 20.201 | 19.036 | 27.695 | 24.269 | 17.433 |
| MAMMA1000402 | 126.085 | 107.637 | 256.584 | 68.415 | 45.669 | 61.486 | 30.340 | 30.943 |
| MAMMA1000403 | 87.558 | 63.749 | 208.574 | 64.857 | 45.578 | 44.799 | 22.710 | 42.239 |
| MAMMA1000410 | 43.073 | 43.539 | 94.207 | 39.613 | 19.880 | 22.573 | 16.272 | 21.003 |
| MAMMA1000413 | 30.829 | 13.370 | 70.418 | 17.102 | 13.392 | 15.291 | 11.599 | 15.353 |
| MAMMA1000414 | 125.550 | 111.622 | 81.672 | 15.722 | 51.528 | 14.549 | 28.214 | 13.858 |
| MAMMA1000416 | 179.864 | 103.793 | 427.214 | 107.383 | 105.899 | 121.441 | 55.040 | 84.667 |
| MAMMA1000421 | 131.712 | 73.475 | 307.780 | 70.841 | 55.037 | 49.498 | 34.519 | 46.482 |
| MAMMA1000422 | 12.614 | 14.628 | 30.167 | 16.100 | 11.675 | 22.441 | 18.843 | 54.831 |
| MAMMA1000423 | 34.100 | 22.150 | 69.677 | 18.461 | 13.815 | 15.645 | 8.500 | 8.869 |
| MAMMA1000424 | 9.330 | 4.056 | 36.234 | 8.171 | 0.971 | 2.769 | 0.745 | 7.267 |
| MAMMA1000429 | 575.321 | 219.603 | 317.414 | 158.529 | 150.779 | 290.300 | 196.161 | 149.619 |
| MAMMA1000431 | 143.825 | 79.993 | 275.497 | 82.499 | 52.496 | 63.425 | 43.337 | 66.733 |
| MAMMA1000432 | 65.212 | 17.117 | 24.472 | 28.083 | 17.360 | 33.881 | 27.547 | 29.615 |
| MAMMA1000437 | 89.375 | 88.947 | 265.572 | 60.025 | 69.885 | 45.195 | 30.823 | 31.510 |
| MAMMA1000444 | 120.017 | 124.234 | 477.772 | 115.966 | 65.200 | 66.888 | 31.943 | 88.274 |
| MAMMA1000446 | 50.201 | 66.027 | 41.406 | 8.991 | 18.971 | 29.395 | 7.985 | 37.220 |
| MAMMA1000449 | 81.386 | 41.427 | 180.761 | 40.414 | 25.983 | 35.232 | 23.109 | 27.942 |
| MAMMA1000457 | 47.862 | 13.862 | 15.095 | 11.981 | 7.566 | 21.142 | 12.971 | 10.872 |
| MAMMA1000458 | 34.485 | 13.749 | 22.864 | 12.116 | 11.199 | 18.881 | 15.924 | 10.046 |
| MAMMA1000468 | 8.235 | 7.843 | 6.029 | 5.004 | 5.503 | 8.258 | 7.138 | 1.618 |
| MAMMA1000472 | 250.243 | 67.964 | 110.774 | 68.614 | 73.186 | 111.758 | 88.016 | 79.409 |
| MAMMA1000473 | 54.174 | 16.506 | 40.489 | 16.002 | 17.450 | 26.506 | 17.741 | 13.900 |
| MAMMA1000477 | 77.316 | 50.237 | 238.943 | 56.460 | 38.807 | 32.776 | 36.438 | 35.332 |
| MAMMA1000478 | 201.299 | 157.097 | 496.514 | 127.872 | 82.832 | 77.444 | 49.296 | 86.763 |
| MAMMA1000483 | 107.340 | 74.564 | 252.463 | 60.824 | 31.055 | 44.198 | 44.167 | 87.449 |
| HAMMA1000490 | 14.473 | 14.068 | 16.023 | 12.496 | 8.202 | 15.654 | 11.091 | 12.344 |
| MAMMA1000496 | 32.756 | 10.554 | 20.693 | 10.676 | 19.830 | 19.282 | 13.204 | 13.410 |
| MAMMA1000500 | 23.016 | 17.584 | 49.151 | 15.706 | 13.914 | 19.063 | 11.094 | 22.904 |
| MAMMA1000501 | 196.637 | 102.490 | 468.793 | 104.118 | 67.761 | 83.834 | 76.446 | 86.912 |
| MAMMA1000503 | 7.083 | 4.085 | 3.866 | 1.004 | 1.005 | 3.752 | 4.005 | 3.248 |
| MAMMA1000506 | 201.452 | 116.279 | 151.434 | 56.847 | 78.502 | 149.780 | 99.352 | 64.069 |
| MAMMA1000510 | 70.898 | 18.432 | 60.927 | 39.187 | 33.327 | 42.829 | 40.993 | 33.127 |
| MAMMA1000515 | 43.923 | 30.031 | 85.637 | 35.744 | 18.805 | 21.837 | 19.339 | 17.922 |
| MAMMA1000516 | 74.742 | 48.811 | 148.307 | 43.452 | 18.069 | 34.061 | 19.122 | 26.985 |
| MAMMA1000522 | 53.273 | 23.845 | 132.197 | 22.861 | 14.594 | 24.776 | 12.095 | 27.578 |
| MAMMA1000524 | 130.806 | 61.389 | 266.529 | 71.558 | 50.972 | 73.691 | 47.484 | 55.510 |
| MAMMA1000528 | 38.579 | 27.136 | 46.940 | 35.839 | 15.860 | 29.316 | 19.300 | 24.797 |
| MAMMA1000534 | 32.603 | 20.088 | 33.950 | 10.973 | 7.185 | 10.580 | 7.972 | 10.160 |
| MAMMA1000541 | 165.518 | 58.806 | 85.648 | 63.188 | 27.705 | 52.036 | 46.200 | 39.018 |
| MAMMA1000550 | 119.597 | 203.059 | 41.184 | 24.393 | 5.859 | 48.433 | 766.194 | 63.005 |
| MAMMA1000556 | 31.963 | 15.056 | 15.588 | 8.634 | 11.294 | 15.698 | 21.467 | 16.597 |
| MAMMA1000559 | 57.738 | 31.181 | 242.155 | 29.443 | 19.030 | 26.908 | 13.520 | 41.571 |
| MAMMA1000565 | 118.770 | 30.318 | 289.829 | 37.509 | 33.728 | 38.720 | 18.344 | 26.847 |
| MAMMA1000567 | 77.050 | 44.379 | 224.645 | 48.804 | 41.102 | 56.039 | 36.496 | 63.529 |
| MAMMA1000576 | 271.038 | 180.600 | 661.566 | 221.987 | 157.443 | 132.385 | 93.679 | 129.843 |
| MAMMA1000582 | 54.936 | 43.406 | 272.366 | 14.342 | 18.896 | 29.396 | 46.333 | 40.210 |
| MAMMA1000583 | 90.692 | 51.670 | 147.946 | 34.905 | 17.175 | 23.177 | 19.077 | 40.824 |

TABLE 45

| | | | | | | | | |
|---|---|---|---|---|---|---|---|---|
| MAMMA1000585 | 89.865 | 50.008 | 288.673 | 52.259 | 29.243 | 39.188 | 24.088 | 46.734 |
| MAMMA1000587 | 47.955 | 14.789 | 58.279 | 12.415 | 6.584 | 14.410 | 15.734 | 6.826 |
| MAMMA1000591 | 77.705 | 38.280 | 81.784 | 28.019 | 20.094 | 28.578 | 24.299 | 19.949 |
| MAMMA1000594 | 194.593 | 94.384 | 488.898 | 91.064 | 59.244 | 55.681 | 43.577 | 75.029 |
| MAMMA1000597 | 496.923 | 264.906 | 751.636 | 196.294 | 121.483 | 306.397 | 199.968 | 160.426 |
| MAMMA1000605 | 324.584 | 183.667 | 990.246 | 209.555 | 135.844 | 158.096 | 97.598 | 149.183 |
| MAMMA1000612 | 68.113 | 22.051 | 42.999 | 14.074 | 19.294 | 41.220 | 29.460 | 15.713 |
| MAMMA1000614 | 580.099 | 136.874 | 402.890 | 69.022 | 127.808 | 309.892 | 249.344 | 194.110 |
| MAMMA1000616 | 2.590 | 16.442 | 13.809 | 1.109 | 3.011 | 7.500 | 3.036 | 3.188 |
| MAMMA1000621 | 19.258 | 12.723 | 14.307 | 13.200 | 5.971 | 12.028 | 11.561 | 11.081 |
| MAMMA1000623 | 60.189 | 23.285 | 25.913 | 12.057 | 10.648 | 23.327 | 19.218 | 20.667 |
| MAMMA1000625 | 651.334 | 249.117 | 346.876 | 155.944 | 192.671 | 373.924 | 300.473 | 274.263 |
| MAMMA1000635 | 4.459 | 2.994 | 4.756 | 2.883 | 0.000 | 4.118 | 5.584 | 9.542 |
| MAMMA1000643 | 24.259 | 51.698 | 115.511 | 47.881 | 17.554 | 52.330 | 16.308 | 38.448 |
| MAMMA1000646 | 72.487 | 111.121 | 22.868 | 9.213 | 27.074 | 81.604 | 46.859 | 34.048 |
| MAMMA1000652 | 152.920 | 94.568 | 319.943 | 76.610 | 67.817 | 87.605 | 41.747 | 77.720 |
| MAMMA1000657 | 116.830 | 41.097 | 278.504 | 38.131 | 36.289 | 67.327 | 34.224 | 32.593 |
| MAMMA1000664 | 48.908 | 37.993 | 133.863 | 26.712 | 16.308 | 21.135 | 14.102 | 35.215 |
| MAMMA1000667 | 77.285 | 24.312 | 99.732 | 25.027 | 29.493 | 43.769 | 22.193 | 24.502 |
| MAMMA1000668 | 42.561 | 28.100 | 54.970 | 17.454 | 18.336 | 50.398 | 38.233 | 26.553 |
| MAMMA1000669 | 22.797 | 14.382 | 57.803 | 14.670 | 6.337 | 12.841 | 7.392 | 12.088 |
| MAMMA1000670 | 66.748 | 22.566 | 46.836 | 26.498 | 25.826 | 33.332 | 38.768 | 39.130 |
| MAMMA1000672 | 128.331 | 25.209 | 67.913 | 35.262 | 28.783 | 64.713 | 38.934 | 40.592 |
| MAMMA1000681 | 66.397 | 40.677 | 32.249 | 14.404 | 13.181 | 26.710 | 30.054 | 37.369 |
| MAMMA1000684 | 85.908 | 107.381 | 66.100 | 35.992 | 32.881 | 41.006 | 36.719 | 77.834 |
| MAMMA1000696 | 165.293 | 107.442 | 551.458 | 130.714 | 88.510 | 70.985 | 43.857 | 55.551 |
| MAMMA1000702 | 82.316 | 25.689 | 52.797 | 22.639 | 22.884 | 48.899 | 39.297 | 29.636 |
| MAMMA1000706 | 81.416 | 25.442 | 34.529 | 20.432 | 15.562 | 39.909 | 33.303 | 25.371 |
| MAMMA1000707 | 128.277 | 17.100 | 51.835 | 15.001 | 33.473 | 48.628 | 46.555 | 24.075 |
| MAMMA1000713 | 75.263 | 59.677 | 109.995 | 37.970 | 23.975 | 33.874 | 30.149 | 39.491 |
| MAMMA1000714 | 228.366 | 288.017 | 246.261 | 56.045 | 25.380 | 80.480 | 51.219 | 64.589 |
| MAMMA1000718 | 98.208 | 92.149 | 245.750 | 79.940 | 49.064 | 50.180 | 40.223 | 49.032 |
| MAMMA1000720 | 158.737 | 111.227 | 446.586 | 101.175 | 73.612 | 78.021 | 29.904 | 60.252 |
| MAMMA1000723 | 64.930 | 49.053 | 148.286 | 40.276 | 28.806 | 19.434 | 18.845 | 24.784 |
| MAMMA1000731 | 31.516 | 11.357 | 68.834 | 12.436 | 11.755 | 7.989 | 7.536 | 7.367 |
| MAMMA1000732 | 121.291 | 56.513 | 230.064 | 68.746 | 51.582 | 53.763 | 35.440 | 49.335 |
| MAMMA1000733 | 24.525 | 14.171 | 58.717 | 16.852 | 7.153 | 14.100 | 8.586 | 10.632 |
| MAMMA1000734 | 113.011 | 127.466 | 142.152 | 102.345 | 44.860 | 84.456 | 43.098 | 98.011 |
| MAMMA1000736 | 142.978 | 48.490 | 130.520 | 34.595 | 40.252 | 73.418 | 82.810 | 69.461 |
| MAMMA1000738 | 110.304 | 61.504 | 28.831 | 38.642 | 18.942 | 31.735 | 48.926 | 35.128 |
| MAMMA1000744 | 140.264 | 94.669 | 281.287 | 76.261 | 79.000 | 63.977 | 43.557 | 40.380 |
| MAMMA1000746 | 26.385 | 50.110 | 37.264 | 16.895 | 10.790 | 35.280 | 3.177 | 11.010 |
| MAMMA1000748 | 73.879 | 36.619 | 52.587 | 30.957 | 36.810 | 46.899 | 25.359 | 24.846 |
| MAMMA1000751 | 42.505 | 27.882 | 58.087 | 44.924 | 28.537 | 43.075 | 32.581 | 61.052 |
| MAMMA1000752 | 55.785 | 55.799 | 193.100 | 53.436 | 25.798 | 29.655 | 21.969 | 44.384 |
| MAMMA1000757 | 314.709 | 210.647 | 536.246 | 187.416 | 161.327 | 151.926 | 112.625 | 152.076 |
| MAMMA1000760 | 218.937 | 178.377 | 534.346 | 131.736 | 100.173 | 95.443 | 58.158 | 91.220 |
| MAMMA1000761 | 147.993 | 73.793 | 349.399 | 85.319 | 65.436 | 75.180 | 43.310 | 63.428 |
| MAMMA1000775 | 75.873 | 25.684 | 170.040 | 34.150 | 30.063 | 20.938 | 15.825 | 18.992 |
| MAMMA1000776 | 101.206 | 81.986 | 253.211 | 57.436 | 51.043 | 51.597 | 28.394 | 33.452 |
| MAMMA1000778 | 71.839 | 47.596 | 214.100 | 42.749 | 28.124 | 29.701 | 17.866 | 26.497 |
| MAMMA1000781 | 67.901 | 30.437 | 97.580 | 26.658 | 23.265 | 29.056 | 17.488 | 26.972 |
| MAMMA1000782 | 286.062 | 65.796 | 174.951 | 84.753 | 88.062 | 151.891 | 90.446 | 86.369 |
| MAMMA1000784 | 135.655 | 91.366 | 264.154 | 67.248 | 65.127 | 26.625 | 29.991 | 78.501 |
| MAMMA1000788 | 143.478 | 49.979 | 98.983 | 34.503 | 30.600 | 55.026 | 29.032 | 46.210 |
| MAMMA1000798 | 62.822 | 41.315 | 139.860 | 37.055 | 26.873 | 27.100 | 11.942 | 32.539 |
| MAMMA1000802 | 132.633 | 86.328 | 341.638 | 76.811 | 64.234 | 64.772 | 38.532 | 61.561 |
| MAMMA1000810 | 150.779 | 88.200 | 372.241 | 99.538 | 80.592 | 81.887 | 42.150 | 57.891 |
| MAMMA1000813 | 31.571 | 14.636 | 31.497 | 9.531 | 9.356 | 14.627 | 12.633 | 10.718 |
| MAMMA1000814 | 197.602 | 134.253 | 279.885 | 107.679 | 82.142 | 99.046 | 64.626 | 62.091 |
| MAMMA1000824 | 65.693 | 21.602 | 64.020 | 38.421 | 35.405 | 29.268 | 31.671 | 38.813 |
| MAMMA1000827 | 146.098 | 70.894 | 157.448 | 47.656 | 39.428 | 44.524 | 33.051 | 44.519 |
| MAMMA1000831 | 55.332 | 19.954 | 29.847 | 13.557 | 9.407 | 21.580 | 16.602 | 6.497 |
| MAMMA1000838 | 39.583 | 28.962 | 39.815 | 28.681 | 49.251 | 39.669 | 14.663 | 19.273 |

TABLE 46

| | | | | | | | | |
|---|---|---|---|---|---|---|---|---|
| MAMMA1000839 | 157.898 | 138.792 | 503.964 | 113.084 | 86.648 | 85.964 | 57.386 | 102.963 |
| MAMMA1000841 | 44.843 | 37.288 | 50.074 | 28.351 | 19.319 | 37.537 | 13.012 | 20.655 |
| MAMMA1000842 | 174.347 | 36.747 | 169.008 | 44.926 | 48.610 | 78.492 | 50.804 | 35.389 |
| MAMMA1000843 | 8.643 | 4.650 | 14.084 | 4.758 | 2.185 | 6.547 | 5.283 | 1.757 |
| MAMMA1000845 | 40.044 | 33.955 | 33.012 | 21.488 | 15.747 | 23.310 | 17.728 | 15.607 |
| MAMMA1000851 | 197.033 | 79.321 | 307.054 | 96.446 | 73.025 | 75.853 | 98.526 | 72.039 |
| MAMMA1000854 | 66.648 | 33.221 | 63.298 | 17.429 | 20.157 | 33.288 | 22.320 | 21.685 |
| MAMMA1000855 | 10.264 | 4.185 | 17.702 | 3.794 | 3.995 | 2.454 | 9.158 | 3.568 |
| MAMMA1000856 | 186.269 | 40.945 | 84.561 | 27.973 | 38.378 | 82.629 | 60.529 | 25.726 |

TABLE 46-continued

| | | | | | | | | |
|---|---|---|---|---|---|---|---|---|
| MAMMA1000859 | 64.234 | 121.939 | 60.662 | 34.958 | 42.945 | 39.557 | 20.320 | 33.032 |
| MAMMA1000862 | 40.107 | 21.345 | 23.693 | 16.808 | 28.277 | 22.661 | 14.238 | 14.693 |
| MAMMA1000863 | 98.576 | 70.285 | 234.996 | 67.796 | 55.215 | 72.466 | 36.802 | 70.885 |
| MAMMA1000865 | 1.106 | 0.000 | 0.000 | 0.000 | 2.321 | 0.000 | 0.000 | 0.000 |
| MAMMA1000867 | 46.228 | 24.216 | 64.376 | 21.736 | 17.699 | 18.758 | 10.742 | 6.964 |
| MAMMA1000875 | 124.814 | 80.537 | 231.558 | 88.627 | 57.015 | 82.859 | 46.826 | 53.611 |
| MAMMA1000876 | 87.475 | 36.523 | 94.191 | 19.763 | 21.466 | 42.434 | 27.201 | 24.439 |
| MAMMA1000877 | 201.968 | 107.716 | 538.232 | 164.333 | 86.827 | 114.380 | 80.171 | 97.872 |
| MAMMA1000878 | 99.671 | 67.833 | 257.022 | 71.323 | 29.066 | 47.487 | 36.714 | 37.365 |
| MAMMA1000880 | 76.396 | 60.884 | 153.335 | 45.836 | 17.649 | 44.996 | 19.238 | 35.353 |
| MAMMA1000881 | 63.646 | 33.072 | 177.731 | 43.034 | 30.410 | 31.086 | 12.184 | 38.045 |
| MAMMA1000883 | 71.807 | 24.931 | 43.109 | 16.630 | 18.675 | 40.320 | 44.419 | 55.440 |
| MAMMA1000897 | 88.466 | 0.000 | 7.404 | 0.000 | 0.000 | 0.000 | 0.000 | 0.721 |
| MAMMA1000898 | 380.818 | 52.977 | 134.846 | 45.311 | 63.221 | 164.332 | 122.071 | 52.933 |
| MAMMA1000905 | 97.555 | 63.528 | 161.117 | 57.777 | 42.205 | 50.312 | 28.216 | 42.710 |
| MAMMA1000906 | 57.788 | 33.146 | 125.096 | 29.019 | 13.531 | 29.380 | 16.982 | 14.930 |
| MAMMA1000908 | 30.597 | 19.222 | 40.351 | 11.584 | 5.445 | 10.392 | 13.469 | 11.612 |
| MAMMA1000911 | 9.952 | 29.425 | 3.998 | 9.963 | 1.886 | 7.419 | 5.350 | 126.406 |
| MAMMA1000914 | 82.184 | 23.137 | 69.228 | 20.659 | 18.111 | 35.329 | 22.616 | 18.859 |
| MAMMA1000920 | 92.123 | 62.032 | 37.206 | 16.675 | 15.550 | 47.235 | 47.680 | 26.801 |
| MAMMA1000921 | 107.169 | 69.026 | 207.821 | 102.347 | 60.403 | 64.787 | 35.902 | 77.424 |
| MAMMA1000931 | 211.796 | 140.234 | 424.498 | 95.390 | 40.229 | 51.643 | 49.349 | 95.211 |
| MAMMA1000940 | 145.411 | 82.982 | 268.876 | 70.972 | 55.532 | 61.420 | 51.119 | 60.328 |
| MAMMA1000941 | 182.800 | 134.847 | 509.857 | 131.137 | 79.478 | 106.717 | 53.292 | 91.187 |
| MAMMA1000942 | 195.078 | 123.131 | 446.428 | 117.435 | 68.234 | 90.801 | 63.506 | 75.814 |
| MAMMA1000943 | 196.926 | 99.988 | 558.754 | 109.551 | 89.006 | 81.092 | 51.063 | 85.539 |
| MAMMA1000952 | 161.019 | 97.081 | 355.265 | 78.330 | 98.779 | 104.172 | 79.021 | 96.980 |
| MAMMA1000956 | 43.741 | 16.217 | 14.918 | 11.103 | 5.840 | 41.230 | 24.471 | 6.893 |
| MAMMA1000957 | 95.532 | 53.066 | 225.645 | 64.794 | 42.610 | 47.323 | 34.337 | 45.567 |
| MAMMA1000962 | 281.600 | 192.048 | 781.968 | 204.962 | 120.611 | 123.900 | 84.354 | 140.995 |
| MAMMA1000966 | 151.087 | 157.558 | 417.591 | 111.282 | 64.746 | 81.685 | 51.694 | 78.953 |
| MAMMA1000968 | 217.975 | 107.043 | 313.251 | 58.469 | 41.964 | 45.044 | 41.392 | 63.998 |
| MAMMA1000972 | 18.150 | 48.148 | 119.482 | 22.427 | 18.041 | 15.672 | 12.870 | 33.135 |
| MAMMA1000973 | 36.667 | 18.879 | 24.787 | 11.758 | 12.527 | 19.441 | 17.828 | 22.312 |
| MAMMA1000975 | 44.972 | 19.058 | 38.995 | 20.137 | 30.793 | 22.864 | 65.817 | 45.398 |
| MAMMA1000976 | 122.625 | 67.075 | 216.981 | 70.671 | 60.470 | 91.475 | 60.614 | 81.173 |
| MAMMA1000979 | 81.812 | 102.452 | 145.415 | 68.435 | 53.443 | 56.902 | 38.749 | 89.759 |
| MAMMA1000986 | 118.211 | 39.368 | 239.204 | 68.513 | 49.208 | 56.431 | 42.354 | 94.152 |
| MAMMA1000987 | 81.466 | 50.679 | 249.660 | 43.686 | 35.580 | 49.753 | 23.004 | 41.997 |
| MAMMA1000988 | 150.907 | 68.191 | 242.562 | 63.946 | 34.252 | 81.162 | 48.528 | 86.723 |
| MAMMA1000994 | 101.984 | 21.000 | 41.248 | 21.154 | 26.136 | 49.152 | 44.373 | 50.523 |
| MAMMA1000998 | 166.669 | 75.193 | 367.111 | 91.202 | 105.673 | 107.213 | 56.957 | 84.216 |
| MAMMA1001003 | 73.580 | 37.252 | 146.092 | 47.279 | 34.315 | 35.674 | 26.101 | 59.032 |
| MAMMA1001007 | 3.055 | 0.000 | 5.547 | 0.000 | 1.411 | 3.633 | 0.800 | 0.000 |
| MAMMA1001008 | 40.892 | 31.048 | 65.220 | 38.501 | 74.831 | 38.859 | 47.979 | 31.121 |
| MAMMA1001013 | 135.486 | 126.855 | 372.544 | 93.280 | 57.270 | 56.674 | 44.237 | 52.328 |
| MAMMA1001014 | 85.681 | 25.361 | 77.414 | 32.516 | 25.227 | 20.809 | 35.346 | 16.624 |
| MAMMA1001021 | 93.867 | 49.224 | 180.659 | 41.205 | 34.542 | 34.975 | 35.352 | 29.726 |
| MAMMA1001024 | 141.736 | 49.918 | 229.735 | 52.670 | 41.069 | 54.541 | 41.726 | 36.711 |
| MAMMA1001025 | 13.661 | 8.964 | 12.310 | 5.843 | 13.733 | 6.698 | 4.305 | 5.091 |
| MAMMA1001028 | 36.353 | 24.719 | 14.061 | 10.363 | 34.518 | 16.233 | 15.746 | 11.316 |
| MAMMA1001030 | 33.596 | 27.602 | 35.295 | 20.296 | 15.861 | 14.989 | 25.031 | 23.535 |
| MAMMA1001035 | 235.880 | 125.555 | 517.898 | 181.208 | 139.149 | 129.655 | 96.375 | 134.509 |
| MAMMA1001036 | 133.350 | 45.689 | 152.344 | 60.632 | 47.114 | 60.433 | 40.803 | 40.973 |
| MAMMA1001037 | 180.875 | 100.457 | 403.651 | 52.277 | 55.761 | 72.026 | 38.313 | 51.826 |

TABLE 47

| | | | | | | | | |
|---|---|---|---|---|---|---|---|---|
| MAMMA1001038 | 26.248 | 12.160 | 150.692 | 32.129 | 5.309 | 10.436 | 15.903 | 27.263 |
| MAMMA1001041 | 113.231 | 27.602 | 43.846 | 32.708 | 45.924 | 41.820 | 46.929 | 16.614 |
| MAMMA1001043 | 218.483 | 23.847 | 68.163 | 22.306 | 10.449 | 41.046 | 45.779 | 31.087 |
| MAMMA1001050 | 157.361 | 80.096 | 220.216 | 71.548 | 69.197 | 49.684 | 13.493 | 49.872 |
| MAMMA1001054 | 102.456 | 62.728 | 134.003 | 63.324 | 43.343 | 21.184 | 38.007 | 39.478 |
| MAMMA1001059 | 136.357 | 48.942 | 59.998 | 52.931 | 26.061 | 111.283 | 69.714 | 40.010 |
| MAMMA1001066 | 387.798 | 103.377 | 293.890 | 140.850 | 119.334 | 176.295 | 158.563 | 60.324 |
| MAMMA1001067 | 82.327 | 39.420 | 127.017 | 37.076 | 29.891 | 30.670 | 19.782 | 14.257 |
| MAMMA1001072 | 150.398 | 31.601 | 52.273 | 21.983 | 32.143 | 57.421 | 47.051 | 26.375 |
| MAMMA1001073 | 101.957 | 23.218 | 17.217 | 11.405 | 43.228 | 24.053 | 24.142 | 5.176 |
| MAMMA1001074 | 104.201 | 41.827 | 240.332 | 94.124 | 55.071 | 89.717 | 16.387 | 14.966 |
| MAMMA1001075 | 32.081 | 34.601 | 23.705 | 29.782 | 21.196 | 23.184 | 14.757 | 17.497 |
| MAMMA1001078 | 102.185 | 111.402 | 317.478 | 75.869 | 35.841 | 49.660 | 61.285 | 61.244 |
| MAMMA1001080 | 367.248 | 210.764 | 130.259 | 89.003 | 81.982 | 186.406 | 141.739 | 266.507 |
| MAMMA1001082 | 50.264 | 39.773 | 20.039 | 17.602 | 43.163 | 26.358 | 17.452 | 14.352 |
| MAMMA1001091 | 3.576 | 11.403 | 27.522 | 0.000 | 18.321 | 4.593 | 0.000 | 0.000 |
| MAMMA1001092 | 50.554 | 25.306 | 48.577 | 16.425 | 15.153 | 18.849 | 11.524 | 4.155 |
| MAMMA1001094 | 353.180 | 12.506 | 112.379 | 42.145 | 78.386 | 130.368 | 113.824 | 62.964 |

TABLE 47-continued

| | | | | | | | | |
|---|---|---|---|---|---|---|---|---|
| MAMMA1001105 | 138.777 | 111.226 | 113.121 | 82.426 | 80.960 | 45.158 | 16.891 | 45.652 |
| MAMMA1001110 | 15.141 | 8.661 | 7.407 | 3.823 | 5.537 | 6.280 | 3.216 | 4.392 |
| MAMMA1001126 | 299.120 | 223.060 | 683.480 | 194.522 | 164.920 | 119.375 | 96.413 | 88.784 |
| MAMMA1001133 | 243.826 | 187.024 | 529.603 | 144.907 | 119.301 | 111.573 | 61.515 | 94.605 |
| MAMMA1001139 | 291.212 | 867.784 | 447.960 | 473.187 | 227.579 | 348.627 | 121.382 | 173.640 |
| MAMMA1001141 | 36.320 | 18.295 | 40.066 | 9.930 | 5.202 | 26.277 | 16.337 | 13.996 |
| MAMMA1001143 | 163.308 | 70.387 | 153.588 | 67.249 | 59.919 | 67.023 | 43.805 | 40.903 |
| MAMMA1001145 | 110.718 | 43.148 | 141.067 | 30.890 | 31.851 | 11.000 | 10.119 | 13.322 |
| MAMMA1001150 | 80.076 | 29.005 | 50.289 | 15.249 | 7.495 | 33.674 | 48.052 | 22.629 |
| MAMMA1001154 | 203.206 | 129.777 | 429.878 | 121.700 | 90.014 | 77.333 | 45.155 | 71.154 |
| MAMMA1001159 | 46.847 | 28.763 | 19.301 | 13.704 | 8.444 | 23.404 | 21.664 | 24.248 |
| MAMMA1001161 | 185.601 | 233.229 | 485.605 | 141.151 | 109.607 | 107.154 | 96.161 | 79.043 |
| MAMMA1001162 | 196.299 | 51.198 | 67.587 | 29.962 | 40.684 | 78.949 | 43.247 | 18.714 |
| MAMMA1001181 | 116.505 | 35.688 | 88.127 | 33.728 | 40.701 | 41.280 | 16.749 | 26.312 |
| MAMMA1001186 | 155.118 | 85.120 | 303.506 | 69.532 | 51.017 | 85.296 | 42.211 | 48.082 |
| MAMMA1001189 | 60.587 | 31.052 | 16.618 | 30.386 | 22.337 | 29.809 | 50.065 | 54.044 |
| MAMMA1001191 | 120.521 | 18.093 | 41.909 | 22.249 | 21.661 | 39.122 | 50.157 | 24.623 |
| MAMMA1001198 | 229.338 | 561.556 | 755.924 | 695.028 | 205.811 | 536.623 | 412.766 | 746.035 |
| MAMMA1001202 | 322.950 | 274.854 | 664.569 | 248.672 | 218.550 | 168.136 | 144.829 | 179.567 |
| MAMMA1001203 | 170.551 | 101.121 | 330.599 | 85.243 | 72.915 | 53.390 | 44.564 | 52.183 |
| MAMMA1001206 | 132.103 | 114.504 | 202.256 | 65.195 | 71.217 | 61.327 | 43.601 | 48.988 |
| MAMMA1001208 | 55.417 | 28.101 | 30.608 | 21.282 | 25.686 | 27.394 | 20.016 | 15.433 |
| MAMMA1001215 | 199.721 | 123.016 | 194.852 | 82.919 | 72.839 | 87.841 | 68.245 | 60.078 |
| MAMMA1001220 | 223.133 | 154.557 | 404.346 | 110.968 | 91.387 | 74.073 | 58.534 | 62.841 |
| MAMMA1001222 | 5.585 | 4.936 | 6.763 | 1.952 | 0.474 | 2.171 | 20.800 | 5.022 |
| MAMMA1001223 | 94.809 | 29.294 | 42.345 | 15.601 | 20.861 | 20.316 | 32.445 | 15.726 |
| MAMMA1001232 | 130.199 | 45.692 | 227.125 | 47.671 | 38.837 | 45.692 | 59.906 | 32.862 |
| MAMMA1001234 | 129.344 | 27.935 | 227.692 | 95.815 | 64.344 | 61.799 | 49.210 | 34.673 |
| MAMMA1001237 | 29.560 | 11.083 | 23.224 | 7.241 | 4.489 | 20.199 | 16.883 | 11.003 |
| MAMMA1001243 | 20.832 | 11.598 | 47.127 | 7.253 | 32.689 | 20.073 | 7.954 | 6.544 |
| MAMMA1001244 | 44.925 | 10.751 | 11.473 | 9.770 | 11.102 | 14.902 | 16.779 | 4.470 |
| MAMMA1001249 | 43.758 | 23.671 | 15.616 | 19.023 | 10.556 | 26.846 | 10.975 | 13.758 |
| MAMMA1001256 | 169.303 | 81.917 | 266.686 | 187.649 | 131.656 | 44.850 | 55.325 | 59.786 |
| MAMMA1001259 | 70.213 | 24.036 | 18.445 | 18.447 | 25.202 | 45.289 | 34.303 | 19.546 |
| MAMMA1001260 | 154.426 | 64.153 | 81.115 | 52.438 | 46.566 | 80.874 | 64.937 | 87.761 |
| MAMMA1001262 | 153.326 | 53.618 | 54.054 | 40.354 | 54.252 | 66.415 | 134.449 | 25.835 |
| MAMMA1001268 | 97.760 | 53.599 | 146.494 | 47.068 | 42.826 | 34.360 | 20.976 | 28.286 |
| MAMMA1001271 | 305.116 | 66.364 | 106.518 | 32.761 | 65.392 | 128.314 | 130.796 | 39.913 |
| MAMMA1001274 | 73.329 | 94.857 | 235.488 | 85.814 | 64.385 | 71.860 | 51.097 | 62.114 |
| MAMMA1001280 | 66.399 | 17.595 | 13.218 | 9.853 | 3.831 | 37.015 | 12.303 | 6.374 |
| MAMMA1001283 | 145.535 | 67.060 | 129.301 | 56.055 | 38.490 | 56.397 | 52.661 | 34.076 |
| MAMMA1001284 | 253.434 | 60.199 | 204.903 | 48.139 | 63.272 | 100.485 | 93.658 | 76.590 |
| MAMMA1001286 | 86.284 | 38.290 | 49.421 | 32.175 | 40.490 | 57.666 | 59.470 | 32.210 |
| MAMMA1001289 | 169.737 | 90.053 | 62.200 | 32.142 | 102.670 | 66.398 | 64.913 | 47.082 |
| MAMMA1001292 | 103.898 | 20.400 | 28.796 | 15.498 | 31.006 | 29.378 | 26.545 | 31.970 |
| MAMMA1001296 | 225.022 | 173.717 | 324.251 | 133.662 | 60.125 | 88.173 | 70.926 | 89.316 |

TABLE 48

| | | | | | | | | |
|---|---|---|---|---|---|---|---|---|
| MAMMA1001298 | 80.876 | 60.189 | 230.669 | 38.485 | 32.838 | 36.675 | 21.032 | 21.836 |
| MAMMA1001305 | 153.258 | 67.563 | 141.529 | 36.286 | 31.766 | 65.281 | 41.627 | 30.730 |
| MAMMA1001309 | 6.490 | 8.306 | 6.534 | 3.621 | 4.269 | 0.000 | 5.861 | 6.705 |
| MAMMA1001310 | 148.253 | 53.093 | 165.786 | 46.753 | 41.171 | 63.488 | 82.639 | 54.927 |
| MAMMA1001322 | 20.005 | 14.809 | 29.403 | 19.332 | 11.227 | 14.549 | 14.163 | 15.700 |
| MAMMA1001324 | 82.605 | 28.652 | 85.996 | 52.506 | 31.339 | 41.688 | 30.365 | 20.179 |
| MAMMA1001330 | 180.949 | 117.040 | 245.119 | 52.680 | 15.121 | 97.89 | 181.121 | 27.980 |
| MAMMA1001333 | 101.101 | 75.972 | 213.812 | 59.950 | 49.965 | 59.640 | 32.340 | 37.307 |
| MAMMA1001334 | 156.564 | 108.340 | 81.315 | 64.901 | 34.949 | 73.510 | 65.555 | 73.287 |
| MAMMA1001337 | 105.507 | 35.111 | 33.563 | 11.119 | 20.426 | 44.148 | 21.930 | 33.068 |
| MAMMA1001341 | 100.751 | 32.100 | 19.251 | 23.188 | 38.019 | 38.614 | 42.286 | 29.671 |
| MAMMA1001343 | 128.875 | 95.425 | 301.822 | 74.316 | 77.337 | 85.431 | 18.963 | 98.899 |
| MAMMA1001344 | 32.880 | 35.930 | 40.648 | 21.963 | 23.320 | 30.315 | 16.394 | 21.074 |
| MAMMA1001346 | 49.749 | 17.537 | 51.635 | 21.147 | 20.480 | 22.107 | 26.805 | 24.306 |
| MAMMA1001383 | 202.565 | 186.453 | 597.532 | 117.616 | 100.238 | 103.083 | 68.993 | 76.274 |
| MAMMA1001388 | 149.105 | 66.100 | 213.624 | 45.488 | 52.686 | 66.868 | 85.346 | 57.974 |
| MAMMA1001396 | 197.435 | 81.919 | 430.433 | 80.848 | 94.812 | 95.399 | 75.293 | 90.889 |
| MAMMA1001397 | 116.167 | 86.809 | 175.125 | 67.323 | 58.616 | 56.833 | 61.558 | 52.233 |
| MAMMA1001401 | 101.761 | 12.090 | 194.999 | 62.960 | 48.162 | 57.422 | 73.403 | 78.023 |
| MAMMA1001408 | 62.875 | 17.757 | 62.603 | 9.779 | 13.557 | 44.301 | 11.008 | 20.408 |
| MAMMA1001411 | 271.344 | 54.507 | 67.489 | 20.558 | 68.557 | 157.085 | 134.884 | 38.338 |
| MAMMA1001414 | 74.836 | 21.511 | 88.459 | 27.219 | 20.603 | 32.791 | 16.798 | 25.126 |
| MAMMA1001415 | 207.635 | 38.228 | 51.690 | 26.716 | 68.700 | 89.184 | 99.527 | 41.848 |
| MAMMA1001418 | 103.090 | 36.102 | 91.976 | 39.234 | 28.949 | 21.016 | 31.339 | 23.195 |
| MAMMA1001419 | 106.299 | 52.357 | 210.943 | 52.570 | 45.256 | 41.351 | 37.624 | 25.914 |
| MAMMA1001420 | 133.835 | 25.587 | 149.981 | 15.816 | 19.703 | 28.670 | 26.323 | 15.896 |
| MAMMA1001426 | 265.539 | 180.062 | 165.308 | 87.320 | 89.096 | 170.869 | 109.848 | 84.172 |

TABLE 48-continued

| | | | | | | | | |
|---|---|---|---|---|---|---|---|---|
| MAMMA1001428 | 310.313 | 180.134 | 229.960 | 136.337 | 147.398 | 262.499 | 135.345 | 83.047 |
| MAMMA1001432 | 266.375 | 101.317 | 387.676 | 86.786 | 60.159 | 83.974 | 37.205 | 60.775 |
| MAMMA1001435 | 99.596 | 48.079 | 193.151 | 53.623 | 21.154 | 41.869 | 30.388 | 39.835 |
| MAMMA1001442 | 103.071 | 100.872 | 193.544 | 78.030 | 54.054 | 54.359 | 43.164 | 50.128 |
| MAMMA1001446 | 180.367 | 105.551 | 197.748 | 98.484 | 72.694 | 46.485 | 39.641 | 61.589 |
| MAMMA1001450 | 61.785 | 51.961 | 68.660 | 34.362 | 32.591 | 32.211 | 28.904 | 9.424 |
| MAMMA1001452 | 180.732 | 124.244 | 432.438 | 115.549 | 111.829 | 104.153 | 92.517 | 96.081 |
| MAMMA1001465 | 528.588 | 255.549 | 770.820 | 359.206 | 364.762 | 388.404 | 209.219 | 264.053 |
| MAMMA1001476 | 33.639 | 19.551 | 25.289 | 5.909 | 17.988 | 24.584 | 26.252 | 11.981 |
| MAMMA1001478 | 117.183 | 61.333 | 141.393 | 46.785 | 39.649 | 32.143 | 33.776 | 40.723 |
| MAMMA1001479 | 156.131 | 59.931 | 31.646 | 28.808 | 44.671 | 62.901 | 69.911 | 26.759 |
| MAMMA1001487 | 67.613 | 53.042 | 92.480 | 34.918 | 30.928 | 40.427 | 21.489 | 11.238 |
| MAMMA1001498 | 96.522 | 111.213 | 222.159 | 50.813 | 14.811 | 23.385 | 56.209 | 28.054 |
| MAMMA1001501 | 216.969 | 55.879 | 84.459 | 38.369 | 49.731 | 88.169 | 43.395 | 32.036 |
| MAMMA1001502 | 124.674 | 57.815 | 131.281 | 46.452 | 43.478 | 54.854 | 34.762 | 36.860 |
| MAMMA1001510 | 21.993 | 7.591 | 13.571 | 10.197 | 11.745 | 6.993 | 14.922 | 8.048 |
| MAMMA1001522 | 56.601 | 24.819 | 109.236 | 27.569 | 21.472 | 26.994 | 29.481 | 17.416 |
| MAMMA1001529 | 83.190 | 23.330 | 52.489 | 20.883 | 31.879 | 41.170 | 29.923 | 20.596 |
| MAMMA1001532 | 47.058 | 33.575 | 98.780 | 33.881 | 17.641 | 23.522 | 25.583 | 30.896 |
| MAMMA1001533 | 91.390 | 40.032 | 30.146 | 22.218 | 20.573 | 25.298 | 46.390 | 16.233 |
| MAMMA1001534 | 0.341 | 0.000 | 0.000 | 0.000 | 0.608 | 6.274 | 0.000 | 0.000 |
| MAMMA1001535 | 32.482 | 21.042 | 23.902 | 24.788 | 14.317 | 27.839 | 5.277 | 10.537 |
| MAMMA1001547 | 122.717 | 75.842 | 186.325 | 45.519 | 46.073 | 43.338 | 36.590 | 24.660 |
| MAMMA1001551 | 103.124 | 52.282 | 155.615 | 43.540 | 38.692 | 47.685 | 20.767 | 32.181 |
| MAMMA1001569 | 47.916 | 19.726 | 56.549 | 24.376 | 18.319 | 34.666 | 36.128 | 11.381 |
| MAMMA1001575 | 137.304 | 30.090 | 50.539 | 31.981 | 29.095 | 50.896 | 55.992 | 33.156 |
| MAMMA1001576 | 355.571 | 57.322 | 87.851 | 39.259 | 62.142 | 115.580 | 85.589 | 39.636 |
| MAMMA1001584 | 59.860 | 30.398 | 60.438 | 23.526 | 24.246 | 30.161 | 16.694 | 22.305 |
| MAMMA1001586 | 6.157 | 32.887 | 0.000 | 2.133 | 1.210 | 6.758 | 2.949 | 4.371 |
| MAMMA1001590 | 150.616 | 76.439 | 214.250 | 84.714 | 45.244 | 61.639 | 37.913 | 52.869 |
| MAMMA1001599 | 40.717 | 29.889 | 37.283 | 14.016 | 19.295 | 24.401 | 27.880 | 19.119 |
| MAMMA1001600 | 109.112 | 32.647 | 49.324 | 13.148 | 24.411 | 44.599 | 35.258 | 20.344 |
| MAMMA1001604 | 153.185 | 34.765 | 63.275 | 52.861 | 9.643 | 15.339 | 24.456 | 16.253 |
| MAMMA1001606 | 217.088 | 99.469 | 248.919 | 91.848 | 90.788 | 88.514 | 79.192 | 78.371 |
| MAMMA1001609 | 64.637 | 23.619 | 74.281 | 18.302 | 10.063 | 9.100 | 19.011 | 13.860 |
| MAMMA1001614 | 74.839 | 29.828 | 9.202 | 11.550 | 18.036 | 35.992 | 21.716 | 14.483 |
| MAMMA1001615 | 11.970 | 10.164 | 10.048 | 11.622 | 4.999 | 35.674 | 12.056 | 11.852 |

TABLE 49

| | | | | | | | | |
|---|---|---|---|---|---|---|---|---|
| MAMMA1001619 | 361.714 | 56.104 | 138.945 | 35.137 | 88.004 | 177.280 | 155.721 | 44.365 |
| MAMMA1001620 | 113.233 | 58.799 | 320.014 | 88.182 | 65.387 | 62.891 | 47.797 | 49.428 |
| MAMMA1001623 | 32.719 | 15.493 | 22.246 | 8.396 | 13.561 | 16.233 | 7.490 | 7.940 |
| MAMMA1001626 | 75.279 | 8.514 | 13.728 | 10.774 | 12.665 | 56.613 | 57.493 | 6.962 |
| MAMMA1001627 | 28.468 | 7.652 | 39.356 | 8.734 | 4.064 | 8.190 | 14.443 | 7.576 |
| MAMMA1001630 | 36.419 | 36.649 | 115.287 | 20.971 | 7.371 | 8.511 | 10.371 | 16.570 |
| MAMMA1001633 | 77.945 | 25.597 | 143.786 | 22.273 | 51.279 | 40.689 | 37.952 | 19.350 |
| MAMMA1001634 | 132.937 | 95.570 | 297.140 | 83.974 | 56.835 | 62.263 | 58.952 | 66.333 |
| MAMMA1001635 | 140.754 | 47.359 | 225.161 | 34.126 | 24.717 | 38.086 | 34.792 | 34.698 |
| MAMMA1001649 | 30.569 | 12.321 | 20.513 | 11.727 | 13.713 | 19.299 | 12.550 | 9.106 |
| MAMMA1001654 | 150.282 | 91.691 | 90.096 | 34.969 | 64.959 | 66.853 | 62.712 | 58.197 |
| MAMMA1001660 | 133.470 | 97.805 | 42.199 | 61.020 | 54.089 | 65.813 | 66.019 | 54.874 |
| MAMMA1001663 | 394.964 | 202.523 | 572.820 | 154.372 | 162.177 | 148.843 | 118.542 | 79.262 |
| MAMMA1001670 | 109.171 | 38.230 | 119.077 | 31.362 | 18.030 | 43.797 | 53.194 | 28.426 |
| MAMMA1001671 | 145.809 | 21.188 | 31.621 | 20.983 | 11.973 | 13.009 | 10.867 | 8.816 |
| MAMMA1001679 | 74.490 | 17.313 | 20.426 | 10.837 | 8.375 | 23.180 | 9.271 | 18.786 |
| MAMMA1001683 | 147.044 | 87.078 | 260.375 | 71.605 | 39.630 | 48.331 | 49.633 | 41.012 |
| MAMMA1001686 | 12.824 | 14.464 | 46.223 | 12.860 | 21.575 | 12.528 | 5.274 | 9.906 |
| MAMMA1001688 | 290.960 | 584.756 | 484.182 | 407.752 | 105.060 | 319.616 | 241.392 | 1824.687 |
| MAMMA1001689 | 74.686 | 28.294 | 39.725 | 20.248 | 8.261 | 19.721 | 31.387 | 18.923 |
| MAMMA1001692 | 90.375 | 64.474 | 198.053 | 56.976 | 35.470 | 19.914 | 16.899 | 28.825 |
| MAMMA1001711 | 111.425 | 82.300 | 189.195 | 30.269 | 36.663 | 51.227 | 10.898 | 27.229 |
| MAMMA1001715 | 67.545 | 40.330 | 71.553 | 28.616 | 19.372 | 25.019 | 24.223 | 13.907 |
| MAMMA1001730 | 33.925 | 17.096 | 21.837 | 11.464 | 4.477 | 36.743 | 11.375 | 8.587 |
| MAMMA1001735 | 79.384 | 42.172 | 38.240 | 23.675 | 25.390 | 20.932 | 27.953 | 11.313 |
| MAMMA1001740 | 100.894 | 25.218 | 94.454 | 17.836 | 17.794 | 23.366 | 21.945 | 16.107 |
| MAMMA1001743 | 199.112 | 118.364 | 141.535 | 72.049 | 46.384 | 86.104 | 96.828 | 100.038 |
| MAMMA1001744 | 23.256 | 20.454 | 0.000 | 2.086 | 2.551 | 2.098 | 5.703 | 0.000 |
| MAMMA1001745 | 121.679 | 94.047 | 301.292 | 106.455 | 100.677 | 125.697 | 46.388 | 55.894 |
| MAMMA1001751 | 58.670 | 37.967 | 90.572 | 30.921 | 14.618 | 26.060 | 33.416 | 32.380 |
| MAMMA1001752 | 284.221 | 89.024 | 175.680 | 74.746 | 86.008 | 159.864 | 103.908 | 99.685 |
| MAMMA1001754 | 57.620 | 30.193 | 53.390 | 14.833 | 35.182 | 39.454 | 17.523 | 12.754 |
| MAMMA1001757 | 14.456 | 8.290 | 7.632 | 7.247 | 6.076 | 15.580 | 5.382 | 5.641 |
| MAMMA1001760 | 283.527 | 155.103 | 596.815 | 118.229 | 106.868 | 115.717 | 105.154 | 147.707 |
| MAMMA1001764 | 33.825 | 15.661 | 33.885 | 14.429 | 5.043 | 11.697 | 22.420 | 16.539 |
| MAMMA1001767 | 41.791 | 27.578 | 112.242 | 22.484 | 21.848 | 16.357 | 11.576 | 9.361 |

TABLE 49-continued

| | | | | | | | | |
|---|---|---|---|---|---|---|---|---|
| MAMMA1001768 | 50.861 | 34.645 | 129.707 | 25.692 | 23.037 | 24.674 | 27.811 | 11.075 |
| MAMMA1001769 | 206.737 | 82.818 | 645.195 | 110.913 | 102.640 | 105.607 | 80.653 | 102.144 |
| MAMMA1001771 | 123.973 | 30.551 | 49.772 | 16.877 | 55.099 | 52.348 | 41.113 | 48.806 |
| MAMMA1001773 | 47.743 | 27.204 | 35.277 | 8.450 | 18.002 | 17.141 | 23.713 | 30.755 |
| MAMMA1001778 | 104.585 | 49.619 | 92.589 | 42.249 | 35.085 | 50.584 | 39.215 | 26.862 |
| MAMMA1001783 | 140.821 | 89.274 | 371.095 | 82.231 | 85.003 | 87.248 | 61.999 | 71.448 |
| MAMMA1001785 | 119.072 | 65.819 | 256.400 | 60.491 | 37.351 | 65.802 | 45.875 | 54.652 |
| MAMMA1001788 | 37.967 | 8.305 | 25.708 | 9.749 | 9.870 | 11.494 | 13.172 | 10.408 |
| MAMMA1001790 | 202.092 | 181.258 | 279.482 | 57.700 | 22.737 | 29.284 | 28.819 | 46.106 |
| MAMMA1001800 | 24.282 | 11.444 | 30.466 | 12.517 | 1.763 | 8.501 | 13.065 | 25.671 |
| MAMMA1001804 | 150.744 | 16.771 | 51.213 | 14.975 | 33.630 | 67.533 | 64.799 | 20.701 |
| MAMMA1001806 | 62.312 | 54.896 | 146.142 | 37.371 | 11.402 | 36.501 | 43.675 | 52.846 |
| MAMMA1001812 | 17.002 | 11.569 | 32.023 | 10.166 | 5.995 | 9.576 | 10.245 | 11.255 |
| MAMMA1001815 | 50.743 | 27.272 | 61.778 | 19.704 | 15.636 | 25.863 | 15.187 | 22.130 |
| MAMMA1001817 | 10.653 | 7.578 | 15.446 | 7.044 | 7.758 | 3.611 | 7.974 | 11.601 |
| MAMMA1001818 | 48.733 | 19.657 | 87.193 | 21.647 | 18.566 | 18.770 | 19.255 | 18.678 |
| MAMMA1001819 | 165.340 | 99.233 | 343.318 | 111.523 | 112.261 | 57.848 | 73.268 | 87.725 |
| MAMMA1001820 | 48.662 | 22.951 | 34.879 | 16.243 | 11.743 | 9.468 | 15.897 | 11.396 |
| MAMMA1001824 | 125.683 | 53.824 | 187.383 | 58.214 | 53.691 | 47.999 | 45.347 | 37.548 |
| MAMMA1001832 | 56.633 | 30.370 | 42.082 | 21.957 | 23.518 | 23.996 | 20.046 | 8.482 |
| MAMMA1001836 | 128.477 | 58.280 | 179.541 | 45.913 | 43.465 | 44.952 | 56.814 | 24.346 |
| MAMMA1001837 | 118.428 | 66.031 | 172.658 | 60.299 | 38.153 | 37.090 | 17.947 | 50.301 |
| MAMMA1001848 | 42.562 | 27.622 | 82.759 | 24.693 | 20.435 | 22.941 | 15.102 | 19.124 |
| MAMMA1001850 | 402.506 | 243.182 | 312.586 | 171.182 | 143.034 | 232.615 | 91.466 | 106.637 |
| MAMMA1001851 | 123.305 | 30.035 | 69.870 | 64.763 | 41.560 | 39.454 | 33.329 | 45.924 |
| MAMMA1001852 | 198.774 | 161.311 | 321.896 | 118.228 | 133.655 | 112.820 | 91.724 | 115.602 |
| MAMMA1001854 | 158.894 | 117.462 | 234.984 | 44.823 | 77.240 | 42.929 | 39.634 | 45.321 |
| MAMMA1001858 | 148.310 | 133.834 | 240.344 | 51.820 | 24.063 | 35.871 | 73.151 | 58.279 |

TABLE 50

| | | | | | | | | |
|---|---|---|---|---|---|---|---|---|
| MAMMA1001864 | 169.742 | 52.389 | 185.785 | 37.880 | 50.896 | 67.999 | 55.272 | 23.142 |
| MAMMA1001868 | 82.643 | 56.439 | 59.491 | 62.418 | 34.438 | 47.003 | 29.588 | 35.585 |
| MAMMA1001874 | 9.192 | 9.651 | 51.178 | 7.405 | 11.275 | 9.054 | 7.189 | 10.453 |
| MAMMA1001878 | 190.515 | 70.315 | 227.600 | 164.835 | 101.886 | 72.219 | 79.645 | 146.982 |
| MAMMA1001880 | 159.918 | 94.489 | 292.528 | 95.467 | 48.528 | 98.588 | 39.271 | 81.114 |
| MAMMA1001885 | 117.729 | 44.975 | 110.656 | 53.460 | 26.142 | 52.223 | 41.423 | 29.156 |
| MAMMA1001890 | 127.969 | 47.712 | 247.654 | 60.558 | 29.367 | 36.838 | 39.109 | 41.483 |
| MAMMA1001893 | 90.120 | 22.271 | 50.435 | 19.070 | 23.222 | 27.783 | 36.643 | 18.711 |
| MAMMA1001901 | 78.854 | 67.274 | 188.894 | 57.356 | 38.856 | 45.633 | 22.050 | 26.367 |
| MAMMA1001907 | 159.767 | 70.062 | 305.846 | 76.004 | 91.563 | 25.690 | 68.288 | 28.595 |
| MAMMA1001908 | 44.964 | 27.928 | 41.967 | 55.852 | 40.219 | 53.008 | 32.123 | 40.375 |
| MAMMA1001919 | 0.000 | 82.865 | 12.109 | 0.000 | 2.270 | 0.000 | 0.000 | 5.175 |
| MAMMA1001931 | 59.705 | 9.869 | 29.213 | 49.582 | 13.981 | 18.165 | 29.466 | 11.467 |
| MAMMA1001937 | 47.045 | 26.453 | 33.302 | 16.535 | 17.844 | 31.265 | 29.899 | 19.650 |
| MAMMA1001951 | 114.033 | 76.574 | 311.618 | 70.531 | 55.661 | 40.552 | 39.990 | 40.224 |
| MAMMA1001956 | 171.199 | 78.116 | 295.630 | 76.171 | 65.654 | 47.426 | 67.568 | 57.411 |
| MAMMA1001957 | 114.304 | 40.789 | 155.366 | 46.819 | 41.429 | 43.671 | 26.153 | 26.982 |
| MAMMA1001960 | 99.822 | 63.449 | 192.955 | 55.422 | 57.938 | 23.395 | 42.027 | 44.844 |
| MAMMA1001963 | 6.938 | 3.651 | 9.148 | 3.671 | 3.337 | 0.000 | 0.000 | 5.275 |
| MAMMA1001969 | 237.109 | 164.919 | 517.768 | 178.594 | 149.500 | 109.284 | 97.612 | 137.120 |
| MAMMA1001970 | 199.358 | 123.085 | 297.080 | 101.158 | 41.691 | 71.806 | 71.685 | 61.125 |
| MAMMA1001978 | 1.206 | 0.000 | 0.000 | 0.000 | 1.081 | 1.561 | 0.000 | 0.000 |
| MAMMA1001992 | 189.502 | 91.630 | 283.440 | 78.807 | 70.640 | 63.218 | 71.282 | 32.898 |
| MAMMA1001994 | 85.231 | 21.385 | 143.259 | 40.178 | 38.484 | 54.686 | 24.893 | 33.837 |
| MAMMA1002008 | 66.834 | 77.793 | 37.647 | 14.813 | 20.016 | 33.334 | 39.365 | 10.388 |
| MAMMA1002009 | 144.462 | 65.030 | 407.911 | 107.350 | 55.438 | 47.107 | 40.434 | 57.138 |
| MAMMA1002011 | 32.832 | 13.901 | 27.624 | 10.188 | 19.701 | 17.344 | 22.354 | 14.449 |
| MAMMA1002022 | 107.727 | 67.057 | 159.576 | 65.640 | 59.239 | 37.381 | 36.122 | 50.747 |
| MAMMA1002024 | 176.885 | 70.125 | 207.390 | 72.614 | 55.279 | 78.953 | 108.945 | 46.948 |
| MAMMA1002032 | 270.523 | 130.983 | 362.313 | 98.620 | 95.826 | 104.970 | 73.966 | 83.780 |
| MAMMA1002033 | 132.652 | 119.984 | 303.660 | 81.264 | 93.758 | 74.391 | 34.919 | 49.831 |
| MAMMA1002041 | 19.611 | 15.313 | 18.901 | 14.070 | 10.859 | 15.705 | 11.098 | 10.476 |
| MAMMA1002042 | 78.700 | 42.958 | 161.397 | 37.566 | 30.208 | 55.486 | 24.562 | 23.890 |
| MAMMA1002045 | 7.131 | 8.948 | 24.018 | 14.459 | 14.811 | 11.172 | 1.533 | 10.371 |
| MAMMA1002047 | 82.875 | 57.343 | 192.240 | 55.806 | 45.781 | 34.315 | 27.824 | 37.210 |
| MAMMA1002056 | 212.189 | 152.323 | 474.785 | 146.238 | 94.617 | 84.218 | 104.806 | 75.923 |
| MAMMA1002058 | 149.112 | 126.148 | 334.116 | 98.541 | 74.809 | 81.670 | 44.227 | 65.825 |
| MAMMA1002060 | 13.278 | 7.931 | 14.514 | 12.643 | 5.782 | 6.917 | 16.902 | 5.536 |
| MAMMA1002065 | 128.185 | 46.405 | 127.810 | 82.855 | 59.107 | 72.737 | 63.052 | 39.667 |
| MAMMA1002068 | 110.652 | 64.982 | 163.753 | 51.583 | 45.893 | 40.656 | 37.400 | 24.128 |
| MAMMA1002070 | 61.186 | 24.791 | 29.988 | 16.102 | 15.306 | 31.362 | 22.002 | 21.338 |
| MAMMA1002078 | 170.197 | 38.633 | 93.014 | 30.633 | 33.682 | 90.533 | 42.110 | 14.299 |
| MAMMA1002080 | 21.195 | 14.596 | 12.646 | 10.208 | 14.094 | 14.792 | 10.377 | 10.263 |
| MAMMA1002082 | 111.870 | 77.716 | 117.819 | 55.009 | 54.940 | 28.457 | 25.946 | 21.254 |
| MAMMA1002084 | 74.297 | 40.086 | 152.790 | 30.118 | 30.052 | 28.788 | 24.428 | 24.140 |

TABLE 50-continued

| | | | | | | | | |
|---|---|---|---|---|---|---|---|---|
| MAMMA1002087 | 17.991 | 17.619 | 30.479 | 8.932 | 13.026 | 13.365 | 9.996 | 6.344 |
| MAMMA1002091 | 78.604 | 26.611 | 41.258 | 17.086 | 26.812 | 39.757 | 46.803 | 27.660 |
| MAMMA1002093 | 17.498 | 0.000 | 5.942 | 5.592 | 5.630 | 8.103 | 11.278 | 4.689 |
| MAMMA1002095 | 78.790 | 13.430 | 22.728 | 13.058 | 20.650 | 32.157 | 32.621 | 8.152 |
| MAMMA1002108 | 91.919 | 6.035 | 31.027 | 13.639 | 7.939 | 32.486 | 27.923 | 11.735 |
| MAMMA1002112 | 24.376 | 27.337 | 10.667 | 11.574 | 5.250 | 15.678 | 14.329 | 37.463 |
| MAMMA1002118 | 12.060 | 5.100 | 8.756 | 5.943 | 6.502 | 7.856 | 7.396 | 3.149 |
| MAMMA1002119 | 122.271 | 36.908 | 59.513 | 20.581 | 36.895 | 38.172 | 39.046 | 32.476 |
| MAMMA1002125 | 159.277 | 83.844 | 373.786 | 60.523 | 54.991 | 63.367 | 35.366 | 35.797 |
| MAMMA1002126 | 231.380 | 139.298 | 431.047 | 153.496 | 117.027 | 84.728 | 70.558 | 62.381 |
| MAMMA1002128 | 102.647 | 35.864 | 48.863 | 19.098 | 20.911 | 44.235 | 39.193 | 25.406 |
| MAMMA1002132 | 226.752 | 118.230 | 198.712 | 79.589 | 88.860 | 84.266 | 50.630 | 48.550 |
| MAMMA1002140 | 54.642 | 53.227 | 115.593 | 42.121 | 33.524 | 31.026 | 24.905 | 32.121 |
| MAMMA1002142 | 121.646 | 33.612 | 49.214 | 19.085 | 27.295 | 103.698 | 68.348 | 39.850 |
| MAMMA1002143 | 150.595 | 15.368 | 78.681 | 38.118 | 5.895 | 13.974 | 10.806 | 45.937 |
| MAMMA1002145 | 237.202 | 72.397 | 165.166 | 45.537 | 53.986 | 87.872 | 73.605 | 22.437 |
| MAMMA1002147 | 73.366 | 34.088 | 45.076 | 27.984 | 33.648 | 53.571 | 33.082 | 8.766 |
| MAMMA1002153 | 133.485 | 74.073 | 143.431 | 55.132 | 46.673 | 85.911 | 25.126 | 19.099 |
| MAMMA1002155 | 320.181 | 146.275 | 552.191 | 86.240 | 120.874 | 124.338 | 93.185 | 96.378 |

TABLE 51

| | | | | | | | | |
|---|---|---|---|---|---|---|---|---|
| MAMMA1002156 | 3.612 | 2.088 | 14.013 | 0.880 | 0.000 | 0.000 | 0.000 | 0.554 |
| MAMMA1002158 | 10.916 | 40.655 | 88.575 | 24.125 | 14.786 | 21.144 | 21.721 | 31.526 |
| MAMMA1002164 | 109.211 | 29.584 | 54.163 | 32.089 | 28.633 | 56.844 | 29.378 | 23.138 |
| MAMMA1002165 | 166.029 | 111.787 | 135.468 | 73.710 | 66.970 | 77.137 | 88.540 | 53.125 |
| MAMMA1002170 | 0.000 | 0.000 | 0.000 | 1.159 | 0.000 | 0.000 | 0.000 | 0.000 |
| MAMMA1002174 | 139.902 | 178.299 | 326.262 | 182.252 | 147.225 | 141.399 | 87.695 | 71.650 |
| MAMMA1002175 | 49.635 | 20.661 | 21.290 | 16.108 | 13.918 | 22.449 | 12.876 | 18.564 |
| MAMMA1002180 | 117.470 | 55.089 | 69.154 | 18.969 | 36.764 | 45.946 | 59.721 | 45.237 |
| MAMMA1002198 | 123.227 | 67.539 | 235.488 | 54.699 | 51.835 | 48.796 | 31.324 | 62.413 |
| MAMMA1002205 | 114.861 | 63.437 | 420.688 | 47.331 | 61.775 | 61.499 | 42.296 | 74.029 |
| MAMMA1002206 | 86.539 | 30.665 | 50.318 | 17.788 | 32.139 | 63.320 | 64.272 | 56.392 |
| MAMMA1002209 | 124.961 | 73.557 | 143.211 | 32.601 | 43.486 | 64.448 | 43.661 | 36.987 |
| MAMMA1002215 | 446.836 | 148.590 | 401.477 | 150.983 | 162.248 | 310.059 | 210.563 | 225.764 |
| MAMMA1002219 | 103.054 | 68.338 | 110.047 | 29.595 | 35.094 | 50.008 | 34.183 | 47.670 |
| MAMMA1002224 | 155.329 | 135.036 | 325.596 | 92.243 | 139.113 | 54.888 | 50.692 | 104.338 |
| MAMMA1002229 | 54.055 | 19.297 | 24.594 | 8.408 | 18.280 | 19.024 | 14.880 | 18.482 |
| MAMMA1002230 | 131.172 | 96.706 | 345.936 | 76.632 | 50.164 | 62.315 | 35.205 | 65.811 |
| MAMMA1002233 | 40.299 | 20.503 | 27.780 | 14.645 | 13.380 | 24.157 | 18.866 | 16.294 |
| MAMMA1002234 | 16.951 | 13.815 | 19.460 | 7.251 | 4.128 | 10.631 | 13.812 | 19.438 |
| MANMA1002236 | 50.642 | 23.553 | 50.683 | 14.162 | 51.817 | 24.897 | 29.324 | 44.837 |
| MAMMA1002243 | 88.955 | 30.943 | 38.127 | 26.451 | 21.889 | 37.268 | 32.369 | 10.849 |
| MAMMA1002250 | 101.569 | 23.851 | 171.031 | 56.513 | 74.300 | 48.863 | 11.431 | 66.114 |
| MAMMA1002253 | 515.165 | 161.871 | 322.750 | 80.630 | 175.660 | 370.878 | 217.429 | 157.156 |
| MAMMA1002267 | 129.167 | 239.800 | 180.046 | 95.357 | 56.654 | 98.387 | 72.076 | 331.998 |
| MAMMA1002268 | 36.456 | 16.771 | 39.216 | 17.501 | 24.043 | 16.873 | 20.704 | 13.929 |
| MAMMA1002269 | 27.848 | 6.625 | 13.419 | 16.093 | 10.154 | 9.666 | 6.915 | 4.635 |
| MAMMA1002282 | 53.648 | 58.269 | 178.298 | 38.160 | 60.059 | 34.106 | 22.977 | 37.892 |
| MAMMA1002292 | 62.491 | 17.873 | 48.526 | 22.803 | 16.647 | 14.012 | 30.027 | 30.270 |
| MAMMA1002293 | 236.280 | 162.513 | 481.000 | 154.526 | 85.449 | 104.060 | 60.152 | 54.729 |
| MAMMA1002294 | 110.705 | 24.664 | 124.002 | 36.492 | 33.138 | 43.853 | 25.143 | 19.816 |
| MAMMA1002297 | 66.424 | 40.774 | 88.229 | 32.940 | 16.126 | 21.061 | 14.524 | 17.505 |
| MAMMA1002298 | 104.368 | 30.772 | 64.493 | 24.071 | 29.853 | 40.308 | 35.653 | 29.912 |
| MAMMA1002299 | 102.764 | 41.185 | 67.139 | 29.656 | 30.944 | 33.813 | 19.722 | 23.248 |
| MAMMA1002308 | 69.299 | 30.798 | 86.503 | 30.668 | 29.756 | 27.771 | 17.935 | 16.223 |
| MAMMA1002310 | 494.257 | 272.509 | 645.571 | 186.568 | 219.463 | 344.867 | 183.571 | 203.149 |
| MAMMA1002311 | 151.653 | 60.941 | 315.707 | 69.190 | 66.700 | 63.609 | 50.563 | 40.723 |
| MAMMA1002312 | 79.548 | 36.483 | 113.839 | 34.110 | 19.878 | 36.852 | 19.114 | 16.993 |
| MAMMA1002317 | 96.094 | 32.026 | 188.632 | 45.170 | 46.365 | 46.409 | 41.391 | 20.920 |
| MAMMA1002319 | 141.320 | 69.599 | 218.472 | 74.218 | 50.463 | 59.927 | 44.261 | 42.418 |
| MAMMA1002322 | 144.393 | 65.401 | 253.730 | 67.857 | 46.931 | 25.375 | 51.002 | 44.826 |
| MAMMA1002329 | 49.002 | 17.163 | 28.349 | 17.067 | 21.239 | 27.218 | 20.223 | 13.611 |
| MAMMA1002332 | 55.840 | 30.915 | 137.766 | 47.492 | 35.312 | 32.956 | 23.130 | 16.413 |
| MAMMA1002333 | 75.478 | 17.882 | 32.309 | 19.280 | 28.576 | 31.145 | 41.629 | 17.637 |
| MAMMA1002335 | 171.866 | 50.373 | 149.587 | 54.778 | 40.367 | 18.695 | 38.972 | 26.410 |
| MAMMA1002339 | 91.741 | 62.618 | 152.049 | 63.915 | 53.097 | 48.035 | 33.591 | 31.797 |
| MAMMA1002347 | 98.915 | 55.800 | 120.784 | 40.650 | 55.929 | 33.327 | 45.235 | 27.501 |
| MAMMA1002351 | 70.045 | 22.016 | 35.600 | 18.333 | 20.122 | 33.583 | 21.722 | 19.631 |
| MAMMA1002352 | 52.143 | 17.786 | 22.690 | 23.069 | 12.412 | 24.411 | 13.818 | 11.949 |
| MAMMA1002353 | 128.336 | 52.785 | 144.030 | 46.481 | 46.561 | 36.806 | 12.132 | 34.575 |
| MAMMA1002355 | 46.995 | 34.505 | 123.684 | 29.737 | 22.025 | 29.352 | 6.766 | 22.664 |
| MAMMA1002356 | 40.901 | 21.732 | 86.932 | 22.189 | 25.451 | 22.826 | 13.215 | 18.951 |
| MAMMA1002359 | 276.825 | 92.529 | 330.418 | 168.428 | 142.084 | 59.794 | 89.656 | 51.182 |
| MAMMA1002360 | 42.725 | 25.740 | 47.382 | 16.661 | 18.409 | 9.982 | 9.481 | 12.121 |
| MAMMA1002361 | 152.118 | 88.131 | 201.317 | 50.907 | 41.767 | 51.778 | 26.886 | 27.245 |

TABLE 51-continued

| | | | | | | | | |
|---|---|---|---|---|---|---|---|---|
| MAMMA1002362 | 39.281 | 22.692 | 119.094 | 21.154 | 14.517 | 23.579 | 14.318 | 19.590 |
| MAMMA1002367 | 142.262 | 75.867 | 50.909 | 48.285 | 31.065 | 65.479 | 60.201 | 210.780 |
| MAMMA1002371 | 119.755 | 66.644 | 278.090 | 138.658 | 42.317 | 49.599 | 32.494 | 49.257 |
| MAMMA1002380 | 90.587 | 47.691 | 161.106 | 38.559 | 31.139 | 36.350 | 34.696 | 25.229 |
| MAMMA1002384 | 90.935 | 85.538 | 249.278 | 71.113 | 46.508 | 40.126 | 29.975 | 44.417 |
| MAMMA1002385 | 13.712 | 7.306 | 6.051 | 7.420 | 3.720 | 9.699 | 8.116 | 7.609 |
| MAMMA1002390 | 119.086 | 26.468 | 66.535 | 12.989 | 40.464 | 53.956 | 37.080 | 19.518 |
| MAMMA1002392 | 90.573 | 32.273 | 97.224 | 19.547 | 21.438 | 26.503 | 20.868 | 14.255 |
| MAMMA1002396 | 167.171 | 132.603 | 370.476 | 113.135 | 82.112 | 77.745 | 28.921 | 53.900 |
| MAMMA1002399 | 73.011 | 45.586 | 115.522 | 33.773 | 19.180 | 17.808 | 26.587 | 22.269 |

TABLE 52

| | | | | | | | | |
|---|---|---|---|---|---|---|---|---|
| MAMMA1002400 | 10.797 | 7.113 | 11.587 | 4.041 | 5.847 | 4.732 | 4.516 | 4.194 |
| MAMMA1002409 | 93.810 | 75.886 | 50.232 | 41.725 | 30.159 | 43.673 | 520.771 | 70.327 |
| MAMMA1002411 | 81.111 | 34.713 | 76.973 | 23.185 | 26.301 | 31.997 | 16.726 | 11.902 |
| MAMMA1002413 | 199.066 | 68.034 | 377.354 | 55.454 | 56.059 | 50.318 | 26.763 | 38.961 |
| MAMMA1002417 | 30.976 | 26.195 | 58.136 | 15.593 | 17.649 | 14.266 | 7.765 | 11.383 |
| MAMMA1002427 | 87.721 | 47.715 | 208.629 | 48.123 | 38.391 | 40.117 | 26.156 | 31.585 |
| MAMMA1002428 | 108.350 | 83.671 | 293.146 | 88.263 | 84.156 | 51.786 | 57.518 | 57.126 |
| MAMMA1002433 | 90.843 | 23.726 | 38.263 | 19.586 | 19.565 | 44.397 | 36.529 | 25.042 |
| MAMMA1002434 | 117.152 | 72.024 | 272.113 | 68.694 | 66.706 | 54.616 | 45.191 | 46.511 |
| MAMMA1002446 | 102.855 | 36.748 | 90.796 | 22.955 | 36.351 | 49.598 | 42.676 | 12.897 |
| MAMMA1002447 | 77.962 | 49.457 | 171.445 | 42.653 | 21.446 | 36.510 | 25.929 | 27.967 |
| MAMMA1002454 | 314.500 | 201.950 | 539.572 | 188.845 | 118.797 | 99.696 | 72.794 | 103.951 |
| MAMMA1002461 | 204.681 | 47.899 | 153.652 | 28.137 | 56.943 | 63.968 | 55.245 | 48.401 |
| MAMMA1002463 | 130.489 | 40.148 | 72.561 | 25.745 | 31.969 | 67.395 | 41.920 | 28.713 |
| MAMMA1002465 | 94.697 | 34.520 | 44.484 | 18.573 | 24.045 | 50.857 | 37.103 | 17.415 |
| MAMMA1002466 | 27.080 | 25.120 | 36.208 | 16.549 | 16.920 | 44.337 | 37.029 | 13.891 |
| MAMMA1002470 | 66.277 | 10.542 | 19.623 | 14.778 | 9.384 | 20.022 | 21.241 | 15.324 |
| MAMMA1002475 | 35.982 | 26.009 | 77.707 | 23.670 | 24.685 | 10.963 | 12.591 | 26.386 |
| MAMMA1002480 | 85.342 | 48.419 | 144.499 | 40.755 | 50.788 | 48.101 | 35.187 | 30.058 |
| MAMMA1002485 | 256.024 | 56.235 | 75.461 | 32.978 | 72.095 | 120.038 | 77.311 | 49.943 |
| MAMMA1002494 | 66.749 | 23.381 | 164.418 | 25.376 | 48.947 | 43.136 | 11.733 | 14.401 |
| MAMMA1002498 | 58.032 | 20.346 | 24.265 | 12.932 | 13.125 | 26.950 | 19.794 | 5.551 |
| MAMMA1002524 | 73.628 | 20.842 | 11.923 | 21.047 | 20.268 | 27.749 | 12.366 | 14.645 |
| MAMMA1002530 | 82.789 | 19.903 | 43.603 | 13.551 | 9.151 | 28.535 | 27.989 | 12.505 |
| MAMMA1002538 | 101.182 | 27.725 | 28.460 | 21.181 | 31.900 | 45.529 | 26.380 | 25.658 |
| MAMMA1002545 | 131.415 | 100.020 | 322.993 | 72.173 | 54.265 | 23.145 | 30.820 | 51.328 |
| MAMMA1002554 | 51.033 | 30.923 | 62.549 | 16.548 | 18.644 | 38.344 | 32.052 | 17.411 |
| MAMMA1002556 | 201.613 | 62.773 | 211.073 | 70.139 | 99.337 | 37.921 | 45.357 | 46.536 |
| MAMMA1002561 | 199.748 | 128.004 | 586.968 | 135.854 | 118.280 | 54.740 | 81.217 | 51.656 |
| MAMMA1002565 | 57.918 | 43.508 | 20.564 | 13.434 | 36.930 | 27.532 | 51.392 | 13.777 |
| MAMMA1002566 | 29.155 | 16.405 | 7.906 | 3.460 | 1.967 | 13.518 | 5.709 | 5.318 |
| MAMMA1002571 | 73.034 | 22.187 | 37.154 | 25.594 | 6.079 | 28.030 | 19.946 | 20.955 |
| MAMMA1002573 | 218.479 | 62.669 | 183.544 | 61.350 | 46.029 | 113.781 | 65.617 | 60.521 |
| MAMMA1002576 | 109.621 | 18.498 | 33.802 | 10.617 | 22.615 | 43.283 | 55.199 | 26.452 |
| MAMMA1002584 | 244.467 | 197.626 | 384.879 | 79.185 | 103.251 | 112.917 | 113.914 | 151.642 |
| MAMMA1002585 | 133.865 | 28.963 | 56.983 | 17.186 | 16.306 | 13.727 | 51.687 | 25.753 |
| MAMMA1002586 | 67.168 | 39.043 | 34.776 | 15.656 | 19.252 | 29.596 | 35.555 | 19.945 |
| MAMMA1002589 | 98.120 | 25.567 | 26.638 | 16.923 | 18.956 | 18.249 | 16.364 | 12.591 |
| MAMMA1002590 | 268.176 | 57.804 | 202.329 | 36.276 | 77.487 | 180.923 | 123.883 | 42.552 |
| MAMMA1002593 | 131.425 | 64.951 | 130.257 | 54.131 | 23.515 | 55.983 | 37.410 | 36.272 |
| MAMMA1002597 | 76.091 | 50.352 | 131.097 | 33.606 | 42.551 | 25.425 | 36.396 | 34.764 |
| MAMMA1002598 | 69.190 | 45.133 | 59.324 | 58.225 | 35.339 | 68.531 | 47.164 | 70.246 |
| MAMMA1002603 | 122.932 | 40.124 | 155.801 | 51.386 | 48.672 | 98.075 | 64.732 | 66.103 |
| MAMMA1002612 | 330.999 | 152.583 | 441.574 | 105.603 | 112.764 | 175.106 | 98.853 | 99.475 |
| MAMMA1002617 | 363.139 | 211.631 | 557.754 | 145.485 | 146.260 | 203.052 | 110.009 | 118.254 |
| MAMMA1002618 | 90.423 | 66.208 | 129.807 | 53.454 | 46.096 | 53.758 | 43.899 | 55.854 |
| MAMMA1002619 | 34.076 | 14.223 | 23.292 | 10.350 | 14.540 | 15.236 | 12.465 | 13.642 |
| MAMMA1002622 | 112.756 | 60.308 | 263.518 | 46.461 | 43.508 | 41.984 | 32.044 | 52.630 |
| MAMMA1002623 | 89.689 | 68.083 | 149.811 | 64.401 | 102.216 | 102.611 | 54.682 | 73.325 |
| MAMMA1002625 | 83.660 | 44.949 | 94.038 | 26.154 | 32.540 | 34.576 | 38.497 | 28.162 |
| MAMMA1002627 | 9.090 | 2.616 | 7.631 | 2.675 | 0.000 | 3.940 | 7.852 | 8.826 |
| MAMMA1002629 | 111.050 | 96.279 | 397.433 | 77.573 | 45.933 | 89.752 | 53.737 | 108.399 |
| MAMMA1002631 | 50.470 | 10.960 | 11.524 | 6.679 | 3.741 | 10.219 | 10.741 | 11.301 |
| MAMMA1002633 | 32.234 | 20.386 | 37.729 | 16.053 | 9.358 | 12.456 | 8.681 | 32.169 |
| MAMMA1002636 | 59.898 | 50.529 | 142.123 | 25.014 | 15.348 | 18.150 | 38.018 | 22.608 |
| MAMMA1002637 | 58.583 | 21.541 | 11.323 | 5.892 | 74.789 | 18.069 | 26.406 | 22.104 |
| MAMMA1002646 | 55.442 | 29.770 | 36.308 | 23.176 | 15.750 | 18.816 | 26.997 | 38.809 |
| MAMMA1002648 | 49.661 | 48.800 | 69.217 | 43.621 | 64.730 | 39.438 | 38.742 | 48.014 |
| MAMMA1002650 | 15.384 | 6.907 | 9.595 | 4.820 | 3.958 | 6.140 | 8.225 | 6.042 |
| MAMMA1002652 | 61.935 | 69.556 | 44.994 | 60.882 | 59.089 | 42.135 | 62.414 | 54.651 |
| MAMMA1002655 | 49.617 | 25.105 | 13.568 | 11.569 | 8.462 | 23.347 | 10.991 | 22.157 |
| MAMMA1002662 | 122.410 | 44.430 | 94.935 | 34.850 | 32.770 | 58.417 | 41.476 | 39.910 |
| MAMMA1002665 | 236.733 | 190.056 | 600.904 | 183.784 | 112.684 | 133.133 | 101.570 | 153.389 |
| MAMMA1002671 | 89.496 | 41.623 | 60.274 | 25.563 | 20.577 | 26.452 | 50.459 | 40.518 |

TABLE 53

| | | | | | | | | |
|---|---|---|---|---|---|---|---|---|
| MAMMA1002673 | 94.294 | 135.347 | 302.435 | 85.978 | 116.544 | 122.876 | 58.765 | 72.402 |
| MAMMA1002684 | 169.486 | 32.550 | 60.424 | 32.013 | 39.987 | 86.564 | 80.699 | 45.058 |
| MAMMA1002685 | 25.020 | 18.401 | 21.785 | 11.312 | 11.628 | 3.402 | 5.660 | 25.002 |
| MAMMA1002692 | 7.274 | 9.361 | 3.697 | 10.386 | 2.003 | 4.100 | 3.302 | 9.849 |
| MAMMA1002693 | 66.711 | 52.339 | 15.641 | 32.934 | 10.671 | 20.167 | 32.429 | 30.795 |
| MAMMA1002698 | 39.272 | 32.200 | 43.657 | 33.153 | 4.354 | 11.796 | 12.328 | 34.409 |
| MAMMA1002699 | 18.348 | 10.645 | 5.272 | 3.333 | 2.314 | 3.625 | 12.679 | 6.883 |
| MAMMA1002701 | 66.193 | 107.821 | 326.150 | 82.189 | 33.993 | 57.919 | 29.820 | 56.144 |
| MAMMA1002708 | 232.250 | 119.730 | 163.846 | 75.850 | 65.245 | 76.116 | 103.624 | 109.697 |
| MAMMA1002711 | 128.862 | 101.834 | 359.100 | 105.535 | 79.020 | 76.543 | 26.135 | 61.975 |
| MAMMA1002712 | 55.151 | 50.304 | 36.811 | 8.507 | 18.857 | 25.978 | 44.085 | 47.001 |
| MAMMA1002716 | 32.821 | 37.741 | 37.674 | 23.554 | 13.366 | 39.383 | 49.740 | 33.088 |
| MAMMA1002721 | 128.620 | 78.060 | 360.516 | 86.920 | 49.826 | 57.925 | 48.421 | 76.576 |
| MAMMA1002723 | 67.425 | 45.775 | 59.116 | 53.954 | 27.853 | 31.646 | 28.039 | 37.993 |
| MAMMA1002727 | 4.194 | 5.317 | 4.081 | 4.586 | 3.879 | 1.679 | 6.885 | 6.203 |
| MAMMA1002728 | 45.508 | 63.239 | 134.784 | 49.369 | 17.238 | 32.733 | 26.228 | 67.828 |
| MAMMA1002742 | 486.871 | 191.088 | 183.567 | 79.031 | 108.740 | 257.374 | 156.771 | 126.280 |
| MAMMA1002743 | 17.914 | 25.779 | 65.317 | 19.354 | 14.843 | 12.214 | 24.184 | 22.277 |
| MAMMA1002744 | 70.172 | 65.184 | 190.550 | 59.599 | 40.023 | 33.273 | 23.675 | 53.991 |
| MAMMA1002746 | 14.967 | 8.271 | 6.293 | 9.116 | 3.957 | 9.800 | 1.039 | 7.011 |
| MAMMA1002748 | 53.355 | 180.966 | 171.425 | 25.271 | 3.510 | 13.742 | 11.775 | 23.747 |
| MAMMA1002754 | 64.093 | 69.489 | 189.499 | 44.022 | 29.371 | 15.039 | 15.857 | 30.299 |
| MAMMA1002758 | 25.835 | 7.240 | 9.756 | 5.507 | 5.640 | 9.500 | 11.968 | 9.173 |
| MAMMA1002762 | 65.824 | 58.122 | 104.988 | 33.940 | 18.698 | 86.679 | 92.471 | 84.012 |
| MAMMA1002764 | 104.828 | 95.058 | 295.803 | 59.465 | 52.006 | 47.508 | 45.629 | 48.337 |
| MAMMA1002765 | 81.926 | 54.425 | 185.685 | 56.838 | 25.634 | 30.254 | 22.519 | 36.212 |
| MAMMA1002769 | 20.078 | 9.062 | 33.997 | 9.878 | 15.366 | 12.293 | 19.431 | 15.797 |
| MAMMA1002771 | 92.652 | 248.038 | 91.136 | 106.297 | 36.324 | 95.235 | 52.022 | 929.910 |
| MAMMA1002775 | 51.236 | 37.084 | 125.540 | 30.088 | 37.975 | 21.242 | 25.695 | 24.387 |
| MAMMA1002780 | 23.190 | 24.572 | 73.778 | 29.564 | 12.337 | 13.199 | 6.027 | 19.175 |
| MAMMA1002782 | 76.728 | 28.066 | 76.753 | 28.366 | 26.053 | 26.045 | 13.885 | 33.944 |
| MAMMA1002795 | 17.412 | 3.178 | 14.907 | 9.264 | 2.359 | 6.615 | 10.186 | 19.921 |
| MAMMA1002796 | 28.596 | 28.390 | 48.340 | 13.930 | 16.360 | 14.274 | 13.494 | 19.709 |
| MAMMA1002805 | 25.198 | 16.430 | 30.126 | 13.856 | 9.933 | 47.769 | 23.312 | 13.432 |
| MAMMA1002806 | 84.431 | 28.564 | 34.957 | 32.528 | 49.335 | 29.125 | 31.705 | 30.489 |
| MAMMA1002807 | 64.374 | 42.471 | 124.060 | 39.454 | 51.288 | 34.538 | 23.265 | 46.125 |
| MAMMA1002814 | 28.078 | 31.573 | 133.666 | 36.466 | 14.707 | 19.459 | 22.590 | 33.539 |
| MAMMA1002817 | 8.719 | 10.443 | 6.527 | 4.036 | 1.155 | 2.240 | 8.038 | 11.128 |
| MAMMA1002820 | 15.173 | 5.049 | 24.747 | 14.605 | 7.416 | 9.432 | 16.038 | 5.111 |
| MAMMA1002830 | 91.438 | 212.662 | 185.761 | 75.492 | 49.491 | 111.835 | 311.632 | 133.132 |
| MAMMA1002833 | 90.875 | 71.138 | 237.238 | 50.346 | 44.689 | 47.222 | 25.094 | 46.080 |
| MAMMA1002835 | 28.488 | 23.244 | 28.102 | 14.935 | 9.604 | 12.597 | 16.302 | 12.709 |
| MAMMA1002838 | 84.752 | 56.692 | 166.200 | 49.694 | 30.237 | 32.930 | 11.628 | 26.416 |
| MAMMA1002842 | 98.706 | 53.519 | 151.675 | 23.902 | 32.033 | 41.236 | 27.950 | 47.227 |
| MAMMA1002843 | 76.343 | 31.051 | 107.479 | 18.190 | 24.282 | 30.456 | 19.401 | 13.727 |
| MAMMA1002844 | 311.853 | 139.150 | 228.560 | 66.881 | 72.282 | 201.758 | 152.946 | 94.166 |
| MAMMA1002845 | 4.464 | 5.631 | 16.258 | 13.028 | 3.642 | 8.306 | 5.338 | 22.843 |
| MAMMA1002857 | 77.604 | 209.913 | 235.780 | 167.148 | 50.200 | 178.228 | 129.737 | 278.807 |
| MAMMA1002858 | 113.809 | 319.730 | 662.654 | 523.500 | 84.144 | 532.413 | 382.518 | 1000.090 |
| MAMMA1002863 | 108.297 | 33.190 | 66.980 | 38.305 | 26.112 | 45.735 | 86.883 | 51.987 |
| MAMMA1002868 | 65.375 | 102.643 | 253.035 | 92.062 | 91.774 | 46.567 | 38.439 | 58.468 |
| MAMMA1002869 | 85.453 | 22.923 | 80.058 | 19.164 | 22.933 | 26.217 | 42.600 | 30.859 |
| MAMMA1002871 | 28.097 | 6.998 | 5.660 | 1.623 | 3.087 | 7.477 | 5.467 | 3.406 |
| MAMMA1002875 | 20.954 | 16.542 | 18.160 | 22.628 | 23.110 | 21.099 | 24.952 | 32.949 |
| MAMMA1002879 | 33.352 | 14.773 | 9.446 | 6.359 | 8.506 | 13.275 | 30.077 | 23.108 |
| MAMMA1002880 | 46.288 | 35.830 | 71.009 | 12.119 | 12.813 | 15.447 | 20.107 | 22.354 |
| MAMMA1002881 | 57.225 | 55.154 | 238.977 | 25.333 | 27.378 | 18.964 | 34.053 | 52.410 |
| MAMMA1002885 | 87.039 | 28.425 | 35.323 | 14.016 | 29.952 | 34.101 | 61.975 | 26.271 |
| MAMMA1002886 | 398.174 | 39.003 | 88.206 | 52.831 | 26.325 | 197.562 | 39.216 | 20.561 |
| MAMMA1002887 | 45.505 | 7.809 | 7.548 | 7.024 | 9.968 | 8.271 | 13.675 | 5.111 |
| MAMMA1002890 | 65.426 | 61.707 | 153.034 | 36.444 | 19.739 | 40.974 | 38.649 | 41.029 |
| MAMMA1002892 | 58.445 | 53.672 | 210.646 | 36.086 | 31.508 | 36.186 | 13.729 | 35.746 |
| MAMMA1002893 | 76.469 | 18.593 | 25.600 | 5.864 | 9.192 | 24.826 | 20.585 | 11.290 |
| MAMMA1002895 | 33.029 | 30.313 | 81.623 | 21.896 | 10.209 | 8.431 | 11.614 | 21.933 |

TABLE 54

| | | | | | | | | |
|---|---|---|---|---|---|---|---|---|
| MAMMA1002898 | 88.538 | 24.524 | 42.725 | 9.653 | 16.551 | 32.137 | 42.359 | 30.615 |
| MAMMA1002905 | 191.445 | 39.095 | 72.714 | 28.234 | 32.209 | 91.200 | 60.899 | 51.358 |
| MAMMA1002906 | 92.692 | 27.862 | 53.273 | 26.259 | 34.130 | 57.141 | 67.635 | 26.917 |
| MAMMA1002908 | 77.656 | 66.964 | 209.054 | 54.014 | 54.429 | 43.639 | 58.626 | 50.901 |
| MAMMA1002909 | 157.128 | 123.626 | 654.652 | 152.777 | 89.304 | 83.884 | 61.550 | 89.879 |
| MAMMA1002918 | 55.362 | 26.201 | 35.298 | 14.931 | 10.960 | 19.166 | 27.775 | 29.119 |
| MAMMA1002925 | 50.571 | 70.116 | 54.395 | 18.011 | 27.814 | 43.511 | 11.984 | 57.467 |
| MAMMA1002926 | 105.041 | 221.644 | 119.112 | 66.217 | 73.866 | 245.600 | 1218.974 | 550.265 |
| MAMMA1002930 | 68.089 | 38.713 | 147.112 | 32.243 | 19.181 | 31.875 | 24.698 | 46.379 |

TABLE 54-continued

| | | | | | | | | |
|---|---|---|---|---|---|---|---|---|
| MAMMA1002937 | 207.866 | 61.711 | 89.764 | 38.377 | 38.050 | 97.677 | 156.876 | 119.279 |
| MAMMA1002938 | 34.139 | 13.727 | 21.350 | 7.309 | 10.152 | 15.165 | 14.230 | 14.534 |
| MAMMA1002941 | 18.884 | 30.845 | 50.805 | 19.591 | 7.699 | 16.322 | 11.528 | 24.529 |
| MAMMA1002947 | 63.095 | 31.441 | 46.623 | 20.590 | 18.624 | 28.594 | 29.987 | 39.586 |
| MAMMA1002964 | 43.981 | 37.785 | 133.836 | 22.173 | 11.661 | 25.346 | 15.389 | 28.296 |
| MAMMA1002967 | 37.974 | 16.689 | 23.126 | 13.527 | 10.863 | 35.085 | 22.091 | 25.886 |
| MAMMA1002970 | 178.268 | 124.368 | 533.590 | 120.984 | 97.317 | 92.795 | 66.069 | 109.854 |
| MAMMA1002971 | 99.466 | 79.461 | 50.710 | 19.662 | 15.091 | 40.745 | 37.592 | 51.546 |
| MAMMA1002972 | 83.922 | 33.377 | 50.911 | 16.436 | 12.354 | 42.113 | 50.137 | 45.819 |
| MAMMA1002973 | 117.540 | 70.913 | 318.513 | 45.601 | 38.568 | 34.070 | 22.903 | 68.699 |
| MAMMA1002979 | 80.771 | 204.398 | 227.280 | 56.459 | 375.745 | 119.386 | 122.750 | 226.538 |
| MAMMA1002982 | 19.895 | 9.493 | 14.202 | 6.265 | 0.000 | 0.000 | 0.000 | 5.076 |
| MAMMA1002987 | 65.397 | 50.918 | 156.507 | 28.534 | 30.958 | 22.630 | 16.594 | 36.952 |
| MAMMA1003003 | 104.891 | 69.630 | 125.933 | 48.800 | 36.915 | 48.025 | 45.716 | 47.346 |
| MAMMA1003004 | 41.353 | 106.059 | 274.622 | 111.746 | 92.691 | 59.597 | 33.719 | 77.654 |
| MAMMA1003007 | 20.423 | 21.289 | 75.498 | 16.044 | 8.909 | 15.878 | 6.947 | 15.193 |
| MAMMA1003011 | 45.615 | 37.641 | 29.754 | 23.843 | 21.157 | 33.395 | 48.907 | 39.054 |
| MAMMA1003013 | 65.088 | 58.284 | 49.438 | 27.289 | 18.877 | 31.768 | 67.950 | 59.419 |
| MAMMA1003015 | 36.817 | 29.585 | 89.251 | 19.826 | 4.679 | 16.602 | 6.959 | 10.432 |
| MAMMA1003019 | 10.026 | 30.107 | 5.244 | 7.467 | 2.375 | 6.403 | 3.225 | 6.184 |
| MAMMA1003020 | 48.046 | 31.761 | 50.515 | 13.842 | 17.142 | 19.341 | 28.497 | 20.218 |
| MAMMA1003026 | 28.646 | 14.274 | 3.514 | 8.603 | 6.618 | 9.838 | 11.161 | 6.781 |
| MAMMA1003031 | 248.219 | 140.526 | 311.997 | 98.494 | 105.194 | 112.752 | 66.462 | 132.570 |
| MAMMA1003033 | 47.072 | 27.208 | 130.132 | 44.811 | 42.096 | 33.806 | 17.555 | 36.757 |
| MAMMA1003035 | 102.528 | 49.560 | 45.025 | 30.912 | 25.924 | 64.046 | 42.175 | 56.246 |
| MAMMA1003039 | 37.382 | 19.822 | 98.219 | 37.555 | 17.115 | 27.935 | 9.656 | 25.906 |
| MAMMA1003040 | 76.014 | 95.416 | 243.138 | 114.795 | 84.250 | 59.989 | 42.107 | 100.448 |
| MAMMA1003044 | 79.444 | 46.915 | 90.545 | 40.709 | 21.121 | 25.258 | 13.745 | 23.444 |
| MAMMA1003047 | 376.340 | 121.483 | 150.100 | 91.015 | 100.397 | 168.621 | 175.219 | 122.400 |
| MAMMA1003049 | 26.899 | 9.631 | 9.169 | 2.907 | 5.679 | 12.149 | 5.016 | 10.003 |
| MAMMA1003055 | 38.639 | 24.977 | 76.695 | 21.811 | 15.758 | 11.937 | 6.277 | 20.034 |
| MAMMA1003056 | 31.238 | 13.811 | 32.121 | 15.345 | 7.891 | 17.689 | 3.176 | 18.147 |
| MAMMA1003057 | 68.258 | 35.596 | 34.053 | 23.862 | 19.335 | 28.373 | 32.521 | 36.634 |
| MAMMA1003066 | 43.837 | 46.015 | 117.875 | 31.178 | 11.361 | 17.068 | 9.179 | 35.831 |
| MAMMA1003075 | 16.366 | 6.334 | 32.629 | 10.374 | 3.215 | 6.507 | 2.433 | 11.804 |
| MAMMA1003089 | 49.867 | 51.500 | 220.715 | 36.189 | 24.057 | 14.625 | 14.530 | 41.852 |
| MAMMA1003092 | 22.129 | 73.102 | 15.615 | 27.304 | 11.693 | 9.575 | 15.986 | 84.963 |
| MAMMA1003095 | 8.240 | 37.313 | 24.078 | 8.354 | 10.123 | 9.662 | 24.609 | 12.392 |
| MAMMA1003099 | 44.094 | 27.545 | 96.117 | 16.060 | 12.184 | 15.519 | 4.930 | 23.720 |
| MAMMA1003102 | 44.491 | 18.730 | 31.447 | 14.500 | 22.389 | 16.929 | 20.089 | 20.899 |
| MAMMA1003104 | 35.977 | 19.146 | 34.647 | 14.588 | 10.720 | 11.459 | 11.385 | 18.999 |
| MAMMA1003113 | 41.697 | 21.092 | 30.337 | 15.635 | 14.764 | 14.690 | 17.723 | 23.810 |
| MAMMA1003126 | 20.042 | 39.595 | 102.916 | 21.241 | 15.167 | 17.921 | 20.876 | 26.563 |
| MAMMA1003127 | 57.961 | 27.221 | 102.332 | 12.486 | 8.002 | 12.295 | 13.773 | 22.285 |
| MAMMA1003131 | 267.516 | 37.924 | 129.263 | 66.563 | 86.667 | 135.209 | 95.293 | 83.256 |
| MAMMA1003135 | 22.855 | 14.308 | 5.624 | 7.938 | 2.690 | 14.984 | 7.633 | 17.269 |
| MAMMA1003140 | 6.575 | 9.140 | 33.040 | 4.487 | 0.895 | 1.900 | 5.064 | 5.312 |
| MAMMA1003146 | 14.105 | 18.018 | 18.562 | 11.213 | 11.461 | 16.500 | 8.591 | 9.815 |
| MAMMA1003150 | 311.806 | 87.992 | 58.938 | 77.271 | 104.739 | 165.139 | 115.042 | 46.945 |
| MAMMA1003154 | 93.002 | 39.912 | 37.471 | 22.819 | 19.655 | 31.742 | 26.299 | 27.565 |
| MAMMA1003155 | 41.709 | 26.308 | 36.508 | 14.326 | 18.674 | 30.842 | 23.489 | 18.046 |
| MAMMA1003157 | 34.876 | 32.317 | 147.845 | 12.108 | 24.093 | 12.999 | 8.766 | 19.930 |
| MAMMA1003163 | 37.900 | 25.338 | 29.052 | 18.551 | 20.826 | 32.639 | 35.893 | 33.749 |
| MAMMA1003164 | 26.961 | 14.747 | 18.545 | 13.932 | 5.852 | 14.778 | 13.694 | 20.137 |
| MAMMA1003166 | 12.213 | 5.478 | 7.671 | 8.749 | 1.781 | 3.094 | 8.412 | 7.640 |

TABLE 55

| | | | | | | | | |
|---|---|---|---|---|---|---|---|---|
| NB9N31000010 | 31.105 | 17.113 | 26.284 | 14.271 | 7.540 | 17.180 | 16.220 | 11.568 |
| NB9N31000016 | 63.431 | 16.195 | 24.879 | 17.001 | 16.740 | 25.216 | 14.845 | 17.364 |
| NB9N31000043 | 87.438 | 35.161 | 58.144 | 20.813 | 36.473 | 36.956 | 51.575 | 34.673 |
| NB9N31000045 | 83.399 | 109.448 | 62.101 | 95.653 | 93.734 | 94.218 | 166.654 | 74.328 |
| NB9N31000054 | 41.821 | 12.636 | 37.831 | 15.025 | 15.265 | 18.963 | 10.894 | 13.189 |
| NB9N31000076 | 22.822 | 22.709 | 57.320 | 14.223 | 12.517 | 9.029 | 11.713 | 24.494 |
| NB9N31000086 | 31.281 | 74.504 | 22.661 | 29.164 | 11.744 | 29.951 | 13.909 | 30.012 |
| NT2RM1000001 | 11.595 | 9.900 | 11.540 | 4.467 | 4.016 | 8.823 | 6.775 | 5.184 |
| NT2RM1000018 | 333.185 | 68.022 | 171.103 | 77.680 | 48.418 | 138.131 | 122.906 | 79.595 |
| NT2RM1000032 | 37.506 | 9.768 | 23.088 | 9.453 | 13.222 | 16.128 | 22.911 | 12.495 |
| NT2RM1000035 | 185.573 | 46.513 | 81.354 | 56.890 | 39.846 | 82.885 | 74.450 | 52.553 |
| NT2RM1000037 | 185.843 | 60.878 | 116.479 | 50.830 | 36.658 | 98.591 | 49.882 | 54.356 |
| NT2RM1000039 | 228.804 | 172.849 | 444.715 | 104.606 | 82.108 | 214.282 | 139.766 | 101.078 |
| NT2RM1000042 | 55.479 | 102.774 | 112.292 | 145.900 | 52.898 | 89.445 | 80.537 | 184.618 |
| NT2RM1000055 | 1.083 | 0.593 | 0.000 | 0.000 | 0.252 | 0.000 | 5.227 | 0.000 |
| NT2RM1000059 | 212.057 | 100.267 | 173.989 | 78.130 | 50.792 | 143.445 | 83.189 | 102.504 |
| NT2RM1000062 | 11.755 | 9.438 | 11.334 | 1.925 | 2.705 | 2.434 | 25.015 | 10.555 |
| NT2RM1000065 | 153.505 | 42.956 | 56.248 | 29.740 | 66.820 | 67.974 | 42.112 | 65.531 |

TABLE 55-continued

| | | | | | | | | |
|---|---|---|---|---|---|---|---|---|
| NT2RM1000066 | 26.794 | 6.539 | 7.914 | 2.716 | 6.609 | 8.275 | 11.533 | 13.605 |
| NT2RM1000071 | 42.919 | 126.091 | 61.623 | 97.378 | 24.665 | 45.008 | 74.491 | 266.252 |
| NT2RM1000080 | 12.803 | 1.714 | 1.023 | 4.022 | 2.135 | 8.919 | 13.254 | 4.329 |
| NT2RM1000086 | 393.857 | 146.368 | 283.360 | 100.835 | 117.874 | 205.973 | 155.085 | 102.325 |
| NT2RM1000092 | 12.949 | 18.015 | 4.187 | 6.602 | 2.600 | 0.000 | 5.579 | 17.636 |
| NT2RM1000118 | 0.000 | 0.276 | 0.000 | 0.180 | 0.000 | 0.000 | 0.000 | 0.655 |
| NT2RM1000119 | 18.719 | 5.828 | 9.051 | 5.794 | 3.873 | 6.048 | 19.700 | 10.812 |
| NT2RM1000121 | 2.231 | 0.000 | 7.566 | 3.177 | 3.735 | 3.309 | 1.697 | 3.614 |
| NT2RM1000122 | 309.647 | 84.904 | 138.129 | 58.379 | 75.966 | 213.166 | 141.553 | 57.569 |
| NT2RM1000127 | 14.133 | 3.707 | 2.380 | 2.322 | 3.743 | 4.212 | 8.594 | 5.786 |
| NT2RM1000131 | 1.661 | 1.269 | 0.348 | 0.000 | 0.768 | 0.000 | 2.271 | 2.221 |
| NT2RM1000132 | 10.432 | 7.649 | 9.599 | 3.479 | 7.287 | 11.592 | 13.046 | 10.752 |
| NT2RM1000153 | 39.773 | 9.302 | 10.314 | 3.465 | 4.419 | 11.775 | 17.131 | 12.503 |
| NT2RM1000184 | 85.966 | 171.937 | 58.982 | 34.486 | 22.674 | 51.668 | 129.969 | 177.417 |
| NT2RM1000186 | 2.149 | 4.607 | 0.000 | 0.000 | 1.586 | 1.226 | 3.974 | 7.121 |
| NT2RM1000187 | 29.354 | 12.303 | 16.019 | 17.222 | 15.020 | 17.176 | 15.232 | 18.703 |
| NT2RM1000199 | 16.274 | 0.000 | 17.316 | 6.834 | 4.725 | 5.212 | 8.917 | 6.720 |
| NT2RM1000213 | 17.361 | 14.639 | 43.481 | 9.904 | 8.998 | 12.127 | 6.422 | 10.141 |
| NT2RM1000215 | 8.787 | 10.858 | 90.070 | 4.505 | 89.435 | 12.158 | 6.380 | 7.453 |
| NT2RM1000218 | 0.000 | 10.196 | 7.239 | 2.227 | 1.452 | 4.273 | 8.324 | 4.445 |
| NT2RM1000224 | 35.730 | 65.418 | 0.000 | 47.537 | 20.172 | 44.102 | 26.563 | 63.368 |
| NT2RM1000236 | 52.706 | 47.803 | 20.481 | 19.138 | 42.513 | 21.813 | 58.118 | 100.492 |
| NT2RM1000242 | 0.000 | 0.000 | 0.000 | 0.000 | 0.000 | 0.000 | 0.000 | 0.000 |
| NT2RM1000244 | 13.988 | 12.654 | 6.957 | 9.937 | 6.047 | 8.026 | 8.938 | 3.968 |
| NT2RM1000252 | 283.006 | 144.306 | 358.324 | 169.383 | 149.200 | 192.609 | 174.288 | 239.093 |
| NT2RM1000256 | 284.496 | 113.021 | 203.771 | 67.954 | 94.270 | 152.181 | 132.435 | 150.452 |
| NT2RM1000257 | 8.203 | 8.081 | 9.713 | 9.716 | 0.000 | 5.002 | 7.893 | 7.694 |
| NT2RM1000260 | 548.461 | 312.072 | 494.663 | 164.454 | 249.491 | 313.672 | 232.568 | 270.549 |
| NT2RM1000269 | 9.472 | 7.461 | 6.606 | 10.004 | 8.876 | 5.844 | 16.818 | 6.933 |
| NT2RM1000271 | 8.917 | 1.259 | 3.857 | 2.440 | 2.317 | 4.289 | 4.982 | 5.727 |
| NT2RM1000272 | 83.425 | 97.598 | 29.246 | 80.462 | 22.650 | 25.350 | 34.266 | 157.515 |
| NT2RM1000273 | 27.031 | 19.960 | 21.872 | 11.127 | 5.201 | 25.896 | 29.976 | 17.270 |
| NT2RM1000274 | 42.234 | 91.340 | 28.306 | 26.224 | 11.534 | 34.723 | 32.623 | 85.440 |
| NT2RM1000280 | 14.289 | 12.359 | 21.912 | 7.205 | 7.361 | 10.397 | 4.200 | 10.119 |
| NT2RM1000295 | 8.249 | 4.916 | 17.445 | 4.671 | 9.099 | 9.454 | 2.185 | 1.092 |
| NT2RM1000300 | 41.252 | 31.172 | 62.474 | 15.266 | 6.023 | 14.825 | 6.206 | 14.221 |
| NT2RM1000304 | 130.855 | 217.805 | 133.583 | 142.504 | 77.271 | 155.874 | 78.198 | 321.054 |
| NT2RM1000314 | 255.347 | 113.392 | 165.204 | 56.831 | 114.936 | 189.937 | 108.461 | 113.313 |
| NT2RM1000318 | 4.002 | 22.985 | 8.505 | 14.343 | 0.836 | 6.124 | 14.391 | 25.194 |
| NT2RM1000335 | 10.157 | 10.048 | 6.881 | 7.482 | 5.897 | 3.558 | 14.151 | 14.353 |
| NT2RM1000341 | 41.219 | 3.681 | 1.562 | 0.000 | 0.000 | 10.884 | 5.578 | 6.704 |
| NT2RM1000350 | 302.316 | 74.071 | 106.873 | 34.040 | 61.895 | 149.078 | 112.517 | 85.201 |
| NT2RM1000354 | 6.027 | 0.000 | 0.000 | 1.807 | 0.000 | 0.921 | 2.303 | 1.256 |
| NT2RM1000355 | 74.362 | 158.811 | 209.578 | 39.101 | 103.936 | 249.368 | 14.695 | 225.724 |
| NT2RM1000361 | 16.299 | 10.575 | 9.446 | 7.432 | 8.424 | 7.383 | 4.356 | 5.053 |
| NT2RM1000365 | 0.000 | 0.000 | 0.000 | 0.000 | 1.447 | 0.000 | 0.000 | 0.000 |

TABLE 56

| | | | | | | | | |
|---|---|---|---|---|---|---|---|---|
| NT2RM1000372 | 93.583 | 9.616 | 49.091 | 28.751 | 33.904 | 61.678 | 39.147 | 31.524 |
| NT2RM1000377 | 42.186 | 17.871 | 22.783 | 12.668 | 13.142 | 15.587 | 18.377 | 23.602 |
| NT2RM1000388 | 8.811 | 19.351 | 1.155 | 5.242 | 0.780 | 5.795 | 6.201 | 11.464 |
| NT2RM1000394 | 0.899 | 1.862 | 0.813 | 1.925 | 0.438 | 0.000 | 0.000 | 0.000 |
| NT2RM1000399 | 1.641 | 5.386 | 0.000 | 2.270 | 0.570 | 0.319 | 2.023 | 1.257 |
| NT2RM1000407 | 69.180 | 19.536 | 39.379 | 6.299 | 21.106 | 27.229 | 14.102 | 13.378 |
| NT2RM1000421 | 0.890 | 0.000 | 0.000 | 0.000 | 0.456 | 0.150 | 0.000 | 0.000 |
| NT2RM1000422 | 102.028 | 152.115 | 200.732 | 297.482 | 65.137 | 134.344 | 50.452 | 241.878 |
| NT2RM1000430 | 16.769 | 3.286 | 12.402 | 4.398 | 4.506 | 12.149 | 11.238 | 7.508 |
| NT2RM1000462 | 167.815 | 117.695 | 165.008 | 62.828 | 65.195 | 81.561 | 72.026 | 118.786 |
| NT2RM1000499 | 16.037 | 22.127 | 75.152 | 12.507 | 7.415 | 7.335 | 41.299 | 22.217 |
| NT2RM1000512 | 126.610 | 24.122 | 12.786 | 25.082 | 11.161 | 46.878 | 21.802 | 31.090 |
| NT2RM1000519 | 7.852 | 28.718 | 9.178 | 14.716 | 6.756 | 27.934 | 11.081 | 10.474 |
| NT2RM1000527 | 29.692 | 15.338 | 24.471 | 17.418 | 45.221 | 59.291 | 31.450 | 14.020 |
| NT2RM1000539 | 14.790 | 19.300 | 31.135 | 14.824 | 2.560 | 6.669 | 3.751 | 10.774 |
| NT2RM1000542 | 118.560 | 38.555 | 21.020 | 20.675 | 29.849 | 30.176 | 22.378 | 32.507 |
| NT2RM1000553 | 37.329 | 18.841 | 47.329 | 24.533 | 23.901 | 33.590 | 34.084 | 33.966 |
| NT2RM1000555 | 77.352 | 46.168 | 43.953 | 21.772 | 15.838 | 16.936 | 12.057 | 35.840 |
| NT2RM1000558 | 55.132 | 15.424 | 20.508 | 7.987 | 7.249 | 8.886 | 23.984 | 21.919 |
| NT2RM1000563 | 39.161 | 14.058 | 17.872 | 12.234 | 8.871 | 14.324 | 12.341 | 13.462 |
| NT2RM1000566 | 3.172 | 7.323 | 0.000 | 2.755 | 1.243 | 3.584 | 2.944 | 4.754 |
| NT2RM1000570 | 65.428 | 72.508 | 44.124 | 24.498 | 15.164 | 26.341 | 21.720 | 56.340 |
| NT2RM1000571 | 20.300 | 15.881 | 9.841 | 14.197 | 7.525 | 7.964 | 16.668 | 9.893 |
| NT2RM1000574 | 45.305 | 32.953 | 5.746 | 5.977 | 1.945 | 5.060 | 1.526 | 3.809 |
| NT2RM1000580 | 10.540 | 9.295 | 12.139 | 8.734 | 2.114 | 6.532 | 5.687 | 7.120 |
| NT2RM1000620 | 11.778 | 12.782 | 21.632 | 15.504 | 5.894 | 4.488 | 3.359 | 17.303 |
| NT2RM1000623 | 3.914 | 2.515 | 0.416 | 3.125 | 0.251 | 0.715 | 0.355 | 2.159 |

TABLE 56-continued

| | | | | | | | | |
|---|---|---|---|---|---|---|---|---|
| NT2RM1000630 | 17.633 | 6.091 | 6.532 | 3.910 | 2.095 | 8.257 | 7.963 | 6.411 |
| NT2RM1000633 | 5.563 | 70.230 | 93.799 | 22.316 | 42.967 | 24.174 | 6.091 | 43.328 |
| NT2RM1000634 | 3.427 | 3.869 | 2.248 | 1.997 | 0.487 | 0.000 | 1.258 | 3.039 |
| NT2RM1000642 | 87.902 | 31.353 | 26.846 | 11.421 | 21.495 | 75.074 | 66.152 | 42.393 |
| NT2RM1000647 | 46.410 | 65.742 | 56.619 | 55.351 | 49.439 | 30.233 | 26.128 | 50.923 |
| NT2RM1000648 | 25.285 | 9.969 | 8.914 | 5.538 | 3.383 | 6.086 | 5.045 | 5.201 |
| NT2RM1000650 | 22.370 | 16.864 | 19.881 | 11.036 | 29.031 | 8.360 | 13.836 | 11.166 |
| NT2RM1000661 | 23.325 | 6.294 | 12.692 | 7.551 | 6.360 | 11.076 | 18.036 | 9.158 |
| NT2RM1000666 | 13.966 | 1.244 | 3.221 | 1.629 | 1.543 | 4.997 | 1.079 | 2.418 |
| NT2RM1000669 | 7.339 | 9.184 | 2.145 | 1.453 | 1.159 | 1.973 | 0.824 | 6.789 |
| NT2RM1000672 | 58.162 | 25.532 | 15.778 | 9.171 | 22.446 | 58.987 | 16.791 | 14.945 |
| NT2RM1000681 | 21.724 | 106.663 | 3.979 | 14.842 | 2.185 | 20.284 | 16.034 | 21.688 |
| NT2RM1000691 | 4.381 | 9.202 | 2.832 | 3.483 | 1.268 | 0.878 | 2.181 | 3.652 |
| NT2RM1000698 | 31.943 | 17.379 | 9.609 | 16.495 | 5.185 | 8.614 | 8.628 | 12.092 |
| NT2RM1000699 | 10.439 | 2.722 | 5.406 | 4.115 | 3.535 | 6.367 | 10.784 | 8.214 |
| NT2RM1000702 | 32.110 | 7.097 | 17.438 | 3.946 | 5.019 | 19.783 | 16.192 | 9.778 |
| NT2RM1000703 | 32.168 | 17.962 | 20.468 | 14.964 | 19.912 | 19.806 | 20.940 | 16.286 |
| NT2RM1000704 | 25.926 | 35.690 | 22.230 | 11.998 | 15.536 | 38.075 | 52.384 | 26.689 |
| NT2RM1000725 | 12.567 | 91.681 | 3.742 | 10.735 | 0.262 | 10.694 | 14.773 | 17.602 |
| NT2RM1000726 | 7.525 | 9.354 | 5.608 | 7.297 | 2.528 | 3.884 | 3.237 | 8.489 |
| NT2RM1000731 | 144.609 | 19.850 | 46.338 | 14.141 | 85.767 | 40.231 | 32.791 | 30.972 |
| NT2RM1000741 | 14.291 | 4.715 | 6.122 | 2.576 | 3.554 | 8.230 | 5.265 | 7.328 |
| NT2RM1000742 | 30.801 | 9.241 | 6.240 | 6.116 | 3.655 | 11.131 | 7.680 | 11.315 |
| NT2RM1000744 | 69.419 | 21.887 | 27.283 | 15.799 | 11.433 | 38.093 | 24.162 | 24.341 |
| NT2RM1000746 | 12.863 | 7.631 | 12.042 | 6.326 | 6.665 | 9.321 | 8.974 | 11.118 |
| NT2RM1000747 | 24.565 | 39.958 | 11.215 | 5.537 | 1.866 | 7.009 | 10.940 | 21.461 |
| NT2RM1000752 | 13.148 | 7.585 | 3.359 | 5.748 | 4.905 | 1.290 | 6.516 | 8.686 |
| NT2RM1000767 | 146.795 | 35.621 | 33.719 | 11.495 | 31.430 | 63.425 | 41.576 | 22.788 |
| NT2RM1000770 | 24.395 | 7.712 | 21.569 | 11.954 | 11.449 | 9.412 | 14.053 | 17.537 |
| NT2RM1000772 | 2.148 | 5.100 | 1.271 | 2.181 | 0.000 | 1.505 | 6.132 | 3.034 |
| NT2RM1000779 | 284.561 | 185.275 | 301.250 | 139.318 | 150.250 | 196.541 | 146.279 | 96.926 |
| NT2RM1000780 | 9.227 | 9.621 | 4.260 | 6.864 | 3.591 | 4.298 | 8.898 | 2.912 |
| NT2RM1000781 | 0.000 | 0.000 | 4.468 | 0.666 | 2.562 | 3.064 | 2.407 | 2.127 |
| NT2RM1000789 | 79.877 | 28.387 | 74.545 | 23.140 | 28.956 | 35.852 | 51.230 | 46.548 |
| NT2RM1000800 | 4.947 | 10.706 | 34.906 | 3.617 | 6.856 | 4.436 | 8.934 | 3.531 |
| NT2RM1000802 | 209.372 | 41.025 | 60.767 | 12.693 | 69.721 | 155.310 | 133.291 | 27.049 |
| NT2RM1000811 | 0.000 | 0.807 | 0.000 | 3.615 | 0.593 | 0.000 | 1.896 | 1.921 |

TABLE 57

| | | | | | | | | |
|---|---|---|---|---|---|---|---|---|
| NT2RM1000826 | 55.971 | 29.000 | 28.733 | 20.800 | 12.255 | 7.195 | 28.144 | 23.708 |
| NT2RM1000829 | 39.377 | 19.978 | 34.233 | 28.539 | 40.659 | 14.500 | 22.956 | 26.065 |
| NT2RM1000831 | 92.244 | 176.233 | 212.504 | 115.234 | 47.485 | 121.255 | 114.428 | 264.692 |
| NT2RM1000833 | 20.877 | 17.302 | 8.876 | 4.821 | 8.474 | 6.471 | 16.424 | 13.119 |
| NT2RM1000834 | 7.920 | 13.142 | 7.973 | 9.896 | 4.809 | 8.919 | 6.281 | 8.562 |
| NT2RM1000841 | 31.899 | 32.922 | 28.948 | 39.736 | 19.743 | 24.819 | 26.306 | 46.020 |
| NT2RM1000848 | 10.486 | 17.213 | 11.047 | 9.143 | 7.207 | 4.310 | 8.632 | 18.858 |
| NT2RM1000850 | 4.705 | 2.700 | 0.000 | 1.184 | 0.000 | 1.597 | 2.104 | 7.243 |
| NT2RM1000852 | 27.699 | 10.440 | 14.655 | 3.679 | 11.796 | 13.435 | 15.920 | 11.316 |
| NT2RM1000853 | 0.000 | 4.915 | 0.000 | 1.897 | 0.000 | 0.000 | 19.505 | 3.017 |
| NT2RM1000855 | 295.899 | 111.992 | 196.426 | 53.443 | 65.232 | 138.673 | 132.776 | 97.678 |
| NT2RM1000857 | 419.515 | 279.225 | 710.235 | 153.528 | 198.222 | 264.575 | 140.191 | 196.436 |
| NT2RM1000858 | 450.537 | 223.032 | 628.109 | 128.574 | 92.997 | 272.161 | 183.324 | 165.845 |
| NT2RM1000867 | 36.148 | 35.491 | 71.518 | 26.137 | 22.828 | 37.610 | 46.674 | 48.259 |
| NT2RM1000874 | 94.766 | 25.329 | 40.690 | 15.917 | 33.235 | 69.767 | 75.898 | 34.795 |
| NT2RM1000882 | 32.751 | 18.077 | 43.528 | 12.957 | 13.381 | 12.209 | 10.357 | 22.709 |
| NT2RM1000883 | 312.282 | 118.317 | 233.345 | 90.226 | 109.110 | 311.111 | 130.746 | 182.823 |
| NT2RM1000885 | 252.089 | 146.253 | 191.597 | 129.087 | 63.370 | 152.039 | 156.686 | 193.445 |
| NT2RM1000893 | 28.474 | 12.532 | 13.539 | 21.087 | 13.367 | 23.959 | 22.465 | 14.066 |
| NT2RM1000894 | 246.338 | 100.240 | 188.863 | 51.822 | 48.537 | 189.474 | 182.264 | 80.716 |
| NT2RM1000898 | 8.028 | 11.716 | 12.431 | 3.461 | 8.055 | 10.349 | 3.262 | 8.889 |
| NT2RM1000899 | 20.978 | 2.796 | 3.034 | 4.018 | 6.936 | 7.286 | 6.525 | 8.715 |
| NT2RM1000905 | 90.972 | 37.943 | 146.214 | 36.300 | 72.541 | 61.959 | 55.239 | 46.935 |
| NT2RM1000910 | 21.235 | 22.607 | 15.176 | 6.355 | 3.770 | 20.204 | 15.343 | 18.656 |
| NT2RM1000914 | 199.944 | 90.792 | 169.446 | 46.693 | 65.449 | 122.556 | 87.145 | 72.117 |
| NT2RM1000919 | 36.141 | 16.161 | 19.116 | 13.229 | 8.891 | 18.002 | 10.279 | 10.389 |
| NT2RM1000921 | 0.242 | 1.831 | 11.629 | 2.787 | 0.000 | 1.344 | 1.305 | 2.292 |
| NT2RM1000922 | 13.119 | 18.060 | 5.555 | 12.140 | 3.037 | 3.684 | 6.526 | 16.464 |
| NT2RM1000924 | 29.895 | 12.894 | 4.946 | 4.788 | 7.984 | 10.841 | 16.108 | 5.749 |
| NT2RM1000927 | 48.046 | 34.032 | 49.155 | 23.882 | 14.687 | 14.867 | 17.603 | 20.582 |
| NT2RM1000951 | 13.349 | 11.379 | 12.531 | 13.272 | 6.919 | 7.215 | 10.192 | 8.882 |
| NT2RM1000956 | 5.337 | 16.522 | 6.739 | 2.246 | 6.192 | 6.379 | 6.215 | 8.675 |
| NT2RM1000960 | 24.574 | 14.841 | 49.930 | 16.747 | 44.584 | 52.121 | 23.270 | 34.312 |
| NT2RM1000961 | 20.594 | 16.610 | 28.449 | 33.770 | 11.295 | 30.987 | 65.017 | 30.389 |
| NT2RM1000962 | 1.479 | 8.158 | 49.309 | 6.863 | 4.421 | 9.226 | 13.337 | 10.246 |
| NT2RM1000973 | 69.241 | 51.561 | 16.390 | 19.560 | 15.357 | 27.890 | 33.675 | 45.410 |

TABLE 57-continued

| | | | | | | | | |
|---|---|---|---|---|---|---|---|---|
| NT2RM1000978 | 0.000 | 0.000 | 0.000 | 0.000 | 0.000 | 0.000 | 0.000 | 0.368 |
| NT2RM1000982 | 7.275 | 2.308 | 2.120 | 2.059 | 1.138 | 1.293 | 1.746 | 4.769 |
| NT2RM1000991 | 13.759 | 6.798 | 22.345 | 7.467 | 6.192 | 11.494 | 1.942 | 9.039 |
| NT2RM1000994 | 12.087 | 15.119 | 14.969 | 10.866 | 9.132 | 2.303 | 4.549 | 14.654 |
| NT2RM1001002 | 46.263 | 5.707 | 19.271 | 15.499 | 18.065 | 33.283 | 21.225 | 33.831 |
| NT2RM1001003 | 14.107 | 33.647 | 23.710 | 23.835 | 3.391 | 10.638 | 8.307 | 14.681 |
| NT2RM1001008 | 4.937 | 4.696 | 0.740 | 4.466 | 2.554 | 3.192 | 3.215 | 10.971 |
| NT2RM1001011 | 67.834 | 16.031 | 21.431 | 8.274 | 20.203 | 46.979 | 40.030 | 18.121 |
| NT2RM1001013 | 25.323 | 6.694 | 3.303 | 6.673 | 8.650 | 15.882 | 23.168 | 23.126 |
| NT2RM1001017 | 8.644 | 4.934 | 1.214 | 2.455 | 1.873 | 2.894 | 4.062 | 7.068 |
| NT2RM1001018 | 224.654 | 234.771 | 124.092 | 68.774 | 75.070 | 85.777 | 124.713 | 184.612 |
| NT2RM1001026 | 23.853 | 12.510 | 10.387 | 14.301 | 5.568 | 12.341 | 14.618 | 17.008 |
| NT2RM1001028 | 11.717 | 13.271 | 17.437 | 18.862 | 5.641 | 12.231 | 8.930 | 11.443 |
| NT2RM1001043 | 21.614 | 13.830 | 4.261 | 8.481 | 4.770 | 7.687 | 17.274 | 10.663 |
| NT2RM1001044 | 21.983 | 20.272 | 44.315 | 8.181 | 4.171 | 5.809 | 4.623 | 9.565 |
| NT2RM1001059 | 3.169 | 2.991 | 1.316 | 0.000 | 0.352 | 2.727 | 2.878 | 3.632 |
| NT2RM1001063 | 0.879 | 5.544 | 0.768 | 1.254 | 0.973 | 4.181 | 1.761 | 5.391 |
| NT2RM1001066 | 3.011 | 3.061 | 0.000 | 3.241 | 0.000 | 1.348 | 1.228 | 3.011 |
| NT2RM1001072 | 113.706 | 7.601 | 5.972 | 2.306 | 0.165 | 3.139 | 5.672 | 5.851 |
| NT2RM1001074 | 32.455 | 14.324 | 28.723 | 10.090 | 6.573 | 10.841 | 7.837 | 10.538 |
| NT2RM1001076 | 7.339 | 4.891 | 0.792 | 2.511 | 0.000 | 5.644 | 6.602 | 2.026 |
| NT2RM1001082 | 63.705 | 50.432 | 105.417 | 34.113 | 20.331 | 17.230 | 16.378 | 21.799 |
| NT2RM1001085 | 13.921 | 7.236 | 4.420 | 3.206 | 4.563 | 0.966 | 5.984 | 4.704 |
| NT2RM1001092 | 16.133 | 28.559 | 80.293 | 36.442 | 13.840 | 23.671 | 15.948 | 30.844 |
| NT2RM1001102 | 2.299 | 0.000 | 0.000 | 0.000 | 0.000 | 2.006 | 1.301 | 2.772 |
| NT2RM1001103 | 4.293 | 14.550 | 11.888 | 3.980 | 17.852 | 6.345 | 2.505 | 12.387 |
| NT2RM1001105 | 0.000 | 0.418 | 0.000 | 0.686 | 0.000 | 0.000 | 0.000 | 1.156 |
| NT2RM1001112 | 6.983 | 5.403 | 12.985 | 7.889 | 7.226 | 5.412 | 8.469 | 12.089 |

TABLE 58

| | | | | | | | | |
|---|---|---|---|---|---|---|---|---|
| NT2RM1001115 | 100.486 | 24.788 | 67.251 | 18.301 | 19.421 | 53.304 | 29.318 | 21.097 |
| NT2RM1001122 | 18.980 | 19.515 | 19.938 | 11.109 | 10.211 | 34.308 | 33.955 | 13.422 |
| NT2RM1001136 | 4.811 | 3.751 | 2.520 | 1.126 | 0.765 | 2.194 | 2.817 | 5.117 |
| NT2RM1001139 | 78.791 | 18.931 | 27.710 | 8.382 | 21.060 | 31.349 | 14.028 | 14.521 |
| NT2RM2000003 | 27.773 | 13.438 | 12.296 | 3.254 | 10.288 | 4.103 | 14.697 | 22.880 |
| NT2RM2000006 | 64.154 | 36.637 | 117.073 | 30.277 | 27.783 | 25.842 | 17.647 | 24.349 |
| NT2RM2000010 | 57.806 | 33.217 | 60.148 | 20.749 | 86.788 | 23.487 | 19.722 | 22.651 |
| NT2RM2000013 | 24.877 | 27.244 | 40.874 | 15.590 | 40.045 | 30.831 | 48.932 | 36.344 |
| NT2RM2000030 | 68.595 | 26.308 | 27.271 | 17.595 | 26.608 | 41.165 | 43.837 | 27.939 |
| NT2RM2000032 | 22.984 | 13.418 | 59.847 | 11.737 | 13.094 | 11.681 | 12.137 | 11.426 |
| NT2RM2000039 | 35.892 | 5.887 | 28.101 | 23.568 | 9.710 | 51.053 | 23.006 | 23.405 |
| NT2RM2000042 | 7.936 | 9.200 | 20.886 | 10.060 | 5.098 | 11.101 | 20.459 | 10.744 |
| NT2RM2000092 | 12.085 | 11.085 | 15.415 | 5.779 | 5.195 | 6.720 | 11.106 | 5.712 |
| NT2RM2000093 | 51.998 | 31.271 | 57.365 | 24.041 | 26.832 | 24.640 | 12.930 | 20.135 |
| NT2RM2000101 | 34.341 | 46.687 | 64.294 | 27.692 | 29.563 | 48.487 | 33.388 | 54.246 |
| NT2RM2000104 | 73.163 | 48.315 | 58.786 | 33.739 | 39.845 | 53.753 | 69.151 | 73.279 |
| NT2RM2000124 | 35.818 | 16.923 | 31.954 | 10.723 | 11.012 | 23.770 | 21.401 | 22.254 |
| NT2RM2000155 | 31.139 | 23.019 | 27.033 | 12.467 | 9.797 | 13.085 | 10.315 | 17.050 |
| NT2RM2000191 | 151.075 | 54.651 | 87.171 | 59.579 | 62.006 | 74.514 | 126.950 | 91.326 |
| NT2RM2000192 | 0.760 | 2.690 | 0.971 | 4.582 | 1.137 | 2.242 | 1.413 | 0.000 |
| NT2RM2000239 | 92.578 | 36.060 | 71.933 | 31.157 | 21.570 | 60.155 | 49.672 | 39.127 |
| NT2RM2000240 | 104.218 | 69.966 | 77.545 | 23.453 | 53.412 | 78.029 | 64.223 | 83.906 |
| NT2RM2000241 | 70.281 | 31.167 | 42.733 | 18.007 | 14.544 | 13.466 | 26.176 | 42.298 |
| NT2RM2000250 | 72.366 | 22.586 | 52.512 | 23.631 | 19.076 | 29.100 | 50.616 | 50.848 |
| NT2RM2000259 | 90.122 | 33.799 | 39.931 | 17.198 | 9.865 | 44.083 | 74.558 | 29.086 |
| NT2RM2000260 | 340.036 | 40.469 | 141.962 | 35.653 | 77.794 | 188.072 | 216.739 | 59.426 |
| NT2RM2000265 | 24.506 | 4.177 | 38.440 | 1.951 | 3.495 | 14.217 | 14.995 | 14.683 |
| NT2RM2000287 | 131.692 | 88.080 | 127.535 | 51.611 | 38.294 | 53.574 | 55.104 | 70.583 |
| NT2RM2000306 | 45.342 | 24.950 | 44.593 | 13.884 | 40.471 | 40.133 | 22.666 | 33.254 |
| NT2RM2000312 | 13.383 | 57.043 | 78.915 | 13.258 | 60.055 | 90.975 | 183.675 | 38.391 |
| NT2RM2000322 | 33.318 | 18.077 | 22.354 | 11.030 | 6.002 | 8.829 | 16.962 | 15.344 |
| NT2RM2000343 | 70.618 | 78.514 | 302.242 | 43.179 | 64.338 | 35.838 | 84.150 | 77.161 |
| NT2RM2000359 | 79.203 | 25.437 | 34.945 | 19.556 | 16.348 | 47.922 | 31.041 | 20.663 |
| NT2RM2000362 | 138.367 | 75.052 | 100.195 | 73.363 | 49.276 | 128.683 | 126.847 | 106.528 |
| NT2RM2000363 | 41.249 | 17.128 | 40.363 | 12.316 | 18.047 | 6.982 | 11.907 | 9.239 |
| NT2RM2000368 | 225.366 | 121.451 | 100.718 | 49.727 | 89.663 | 128.354 | 136.054 | 93.203 |
| NT2RM2000371 | 88.897 | 208.325 | 97.848 | 212.525 | 33.081 | 80.287 | 140.890 | 131.756 |
| NT2RM2000374 | 54.398 | 55.656 | 153.004 | 34.316 | 25.750 | 36.072 | 34.151 | 51.955 |
| NT2RM2000387 | 31.537 | 35.012 | 44.269 | 24.245 | 23.611 | 19.094 | 24.288 | 26.745 |
| NT2RM2000393 | 43.873 | 18.662 | 32.917 | 12.496 | 14.167 | 17.560 | 23.452 | 33.102 |
| NT2RM2000395 | 11.936 | 2.901 | 3.145 | 1.722 | 4.564 | 6.102 | 4.725 | 9.257 |
| NT2RM2000402 | 26.540 | 28.616 | 42.681 | 18.209 | 10.970 | 24.876 | 20.077 | 26.993 |
| NT2RM2000405 | 29.390 | 26.302 | 56.236 | 18.391 | 18.624 | 17.673 | 19.408 | 19.435 |
| NT2RM2000407 | 213.973 | 77.583 | 145.459 | 42.798 | 73.678 | 124.360 | 103.989 | 122.635 |
| NT2RM2000410 | 46.375 | 23.782 | 29.096 | 10.711 | 13.331 | 26.855 | 27.992 | 20.820 |

TABLE 58-continued

| | | | | | | | | |
|---|---|---|---|---|---|---|---|---|
| NT2RM2000420 | 41.781 | 29.100 | 39.676 | 24.872 | 16.605 | 26.730 | 29.136 | 43.708 |
| NT2RM2000422 | 400.274 | 145.824 | 265.042 | 51.828 | 73.571 | 186.812 | 131.563 | 125.088 |
| NT2RM2000423 | 119.707 | 56.563 | 272.757 | 58.213 | 50.981 | 60.353 | 42.529 | 86.903 |
| NT2RM2000452 | 44.543 | 24.735 | 36.727 | 13.780 | 10.160 | 32.134 | 23.468 | 26.716 |
| NT2RM2000469 | 28.062 | 19.762 | 14.685 | 5.603 | 7.485 | 22.242 | 10.716 | 6.249 |
| NT2RM2000490 | 57.984 | 29.556 | 42.743 | 16.403 | 19.316 | 36.503 | 21.106 | 31.221 |
| NT2RM2000497 | 44.862 | 39.966 | 107.561 | 23.488 | 15.277 | 19.316 | 13.374 | 16.412 |
| NT2RM2000502 | 49.184 | 33.683 | 39.515 | 14.256 | 18.792 | 23.598 | 23.921 | 27.778 |
| NT2RM2000504 | 53.653 | 30.376 | 46.453 | 19.836 | 22.267 | 39.106 | 28.508 | 19.188 |
| NT2RM2000514 | 40.702 | 23.938 | 23.980 | 9.704 | 12.601 | 20.319 | 19.147 | 27.441 |
| NT2RM2000522 | 6.782 | 0.000 | 4.730 | 3.680 | 1.616 | 2.008 | 4.021 | 14.506 |
| NT2RM2000540 | 28.543 | 24.938 | 24.326 | 8.984 | 9.799 | 16.595 | 10.471 | 17.045 |
| NT2RM2000556 | 0.000 | 0.000 | 0.000 | 0.000 | 0.000 | 0.000 | 0.000 | 0.000 |
| NT2RM2000565 | 52.454 | 32.231 | 48.697 | 17.373 | 14.758 | 42.730 | 24.240 | 28.218 |
| NT2RM2000566 | 31.997 | 22.486 | 34.598 | 11.793 | 7.665 | 32.508 | 18.105 | 35.032 |
| NT2RM2000567 | 57.110 | 29.163 | 45.058 | 10.738 | 15.606 | 44.727 | 22.394 | 28.766 |
| NT2RM2000569 | 113.652 | 91.632 | 187.867 | 40.645 | 36.420 | 58.576 | 40.151 | 50.117 |
| NT2RM2000577 | 61.308 | 16.114 | 35.195 | 12.694 | 14.986 | 83.608 | 36.221 | 60.695 |
| NT2RM2000581 | 152.797 | 45.271 | 66.363 | 20.096 | 32.397 | 79.582 | 62.192 | 40.676 |

TABLE 59

| | | | | | | | | |
|---|---|---|---|---|---|---|---|---|
| NT2RM2000582 | 96.163 | 83.789 | 104.868 | 37.893 | 45.777 | 67.766 | 50.428 | 50.631 |
| NT2RM2000588 | 109.847 | 89.480 | 119.521 | 70.534 | 32.168 | 143.491 | 88.984 | 95.908 |
| NT2RM2000589 | 91.130 | 45.398 | 66.143 | 21.774 | 22.548 | 80.656 | 43.864 | 35.379 |
| NT2RM2000594 | 31.068 | 22.138 | 28.684 | 10.809 | 13.325 | 34.179 | 10.310 | 16.391 |
| NT2RM2000599 | 275.423 | 132.063 | 221.911 | 86.738 | 66.363 | 237.294 | 209.381 | 119.304 |
| NT2RM2000609 | 26.687 | 13.378 | 20.025 | 9.729 | 14.321 | 19.395 | 17.956 | 8.545 |
| NT2RM2000612 | 40.704 | 19.012 | 36.338 | 9.471 | 15.531 | 27.049 | 24.872 | 30.269 |
| NT2RM2000622 | 45.492 | 46.307 | 46.012 | 27.097 | 17.426 | 48.495 | 30.090 | 42.927 |
| NT2RM2000623 | 279.041 | 219.374 | 245.200 | 90.410 | 123.723 | 286.194 | 221.925 | 144.950 |
| NT2RM2000624 | 52.551 | 88.174 | 87.665 | 60.273 | 35.044 | 29.084 | 27.783 | 54.409 |
| NT2RM2000632 | 15.461 | 13.673 | 11.853 | 13.378 | 8.044 | 7.114 | 6.910 | 5.808 |
| NT2RM2000635 | 24.726 | 21.442 | 42.243 | 17.900 | 14.353 | 23.119 | 10.306 | 20.675 |
| NT2RM2000636 | 45.247 | 47.662 | 62.828 | 24.460 | 33.311 | 28.868 | 35.751 | 35.343 |
| NT2RM2000639 | 34.707 | 19.290 | 26.594 | 15.919 | 12.875 | 28.297 | 20.526 | 11.317 |
| NT2RM2000649 | 39.662 | 37.102 | 62.088 | 31.152 | 32.252 | 42.335 | 27.796 | 50.424 |
| NT2RM2000658 | 53.598 | 26.723 | 55.360 | 19.176 | 26.348 | 46.815 | 23.949 | 20.812 |
| NT2RM2000660 | 84.441 | 62.193 | 66.364 | 13.329 | 36.417 | 48.267 | 23.694 | 40.215 |
| NT2RM2000669 | 17.352 | 23.877 | 38.180 | 11.181 | 16.885 | 17.594 | 13.008 | 20.479 |
| NT2RM2000689 | 118.126 | 102.565 | 102.237 | 102.435 | 37.057 | 156.147 | 96.539 | 140.413 |
| NT2RM2000691 | 29.467 | 12.787 | 29.631 | 9.783 | 15.294 | 28.392 | 15.401 | 17.161 |
| NT2RM2000714 | 238.396 | 61.067 | 122.264 | 38.290 | 60.785 | 222.914 | 188.827 | 77.434 |
| NT2RM2000718 | 9.515 | 10.199 | 19.686 | 5.036 | 7.922 | 8.962 | 7.572 | 22.010 |
| NT2RM2000732 | 44.022 | 24.869 | 42.915 | 12.209 | 29.863 | 38.537 | 30.201 | 17.415 |
| NT2RM2000735 | 112.208 | 47.966 | 111.282 | 57.228 | 38.980 | 78.590 | 45.888 | 59.237 |
| NT2RM2000740 | 23.990 | 62.438 | 143.286 | 24.030 | 26.159 | 35.449 | 22.001 | 29.845 |
| NT2RM2000743 | 15.424 | 14.901 | 23.591 | 12.391 | 9.779 | 16.339 | 8.950 | 8.560 |
| NT2RM2000772 | 79.885 | 34.020 | 54.908 | 31.068 | 31.256 | 64.893 | 44.735 | 55.557 |
| NT2RM2000773 | 56.846 | 36.465 | 77.155 | 26.645 | 32.523 | 60.130 | 42.946 | 53.958 |
| NT2RM2000776 | 56.550 | 40.820 | 69.793 | 43.736 | 22.285 | 89.348 | 33.285 | 45.221 |
| NT2RM2000784 | 54.586 | 33.888 | 45.181 | 19.559 | 21.292 | 43.103 | 25.540 | 42.124 |
| NT2RM2000795 | 169.462 | 132.660 | 456.283 | 117.450 | 94.702 | 91.566 | 59.832 | 91.914 |
| NT2RM2000796 | 12.942 | 12.033 | 20.129 | 5.817 | 6.070 | 11.596 | 8.538 | 11.009 |
| NT2RM2000798 | 67.292 | 147.984 | 71.980 | 42.802 | 43.127 | 85.427 | 63.126 | 132.706 |
| NT2RM2000801 | 145.709 | 142.451 | 160.966 | 85.365 | 73.827 | 214.221 | 157.384 | 174.371 |
| NT2RM2000821 | 29.716 | 25.994 | 36.976 | 14.293 | 9.638 | 63.473 | 12.133 | 3.427 |
| NT2RM2000829 | 77.695 | 36.834 | 148.015 | 32.077 | 69.569 | 70.012 | 26.103 | 73.222 |
| NT2RM2000837 | 85.748 | 27.100 | 51.022 | 19.432 | 22.405 | 48.733 | 36.614 | 45.277 |
| NT2RM2000924 | 41.170 | 22.739 | 31.818 | 6.582 | 16.935 | 130.595 | 55.870 | 42.226 |
| NT2RM2000930 | 45.514 | 31.120 | 39.165 | 20.017 | 17.433 | 49.111 | 28.135 | 30.171 |
| NT2RM2000937 | 85.092 | 19.912 | 28.613 | 13.728 | 34.425 | 55.176 | 53.959 | 15.755 |
| NT2RM2000939 | 63.956 | 41.986 | 59.137 | 18.909 | 23.056 | 57.088 | 26.370 | 29.465 |
| NT2RM2000942 | 141.275 | 345.015 | 119.378 | 242.434 | 78.282 | 274.472 | 112.054 | 436.171 |
| NT2RM2000951 | 32.383 | 20.717 | 32.763 | 17.041 | 10.179 | 32.704 | 19.494 | 30.498 |
| NT2RM2000952 | 33.160 | 18.882 | 34.052 | 15.194 | 27.783 | 44.540 | 16.881 | 31.012 |
| NT2RM2000966 | 54.007 | 44.546 | 57.551 | 30.397 | 27.965 | 78.353 | 44.947 | 77.916 |
| NT2RM2000973 | 96.188 | 97.082 | 100.373 | 31.654 | 38.259 | 115.479 | 60.146 | 151.200 |
| NT2RM2000983 | 66.024 | 27.357 | 40.970 | 16.277 | 25.768 | 44.322 | 40.901 | 34.882 |
| NT2RM2000984 | 38.635 | 39.635 | 42.628 | 14.734 | 10.729 | 39.002 | 24.661 | 39.000 |
| NT2RM2000994 | 38.406 | 43.907 | 36.416 | 29.496 | 24.408 | 22.384 | 18.679 | 31.517 |
| NT2RM2001004 | 74.509 | 45.438 | 146.622 | 36.919 | 35.918 | 125.242 | 81.529 | 92.360 |
| NT2RM2001022 | 195.677 | 346.056 | 350.501 | 243.410 | 179.341 | 419.711 | 214.981 | 540.668 |
| NT2RM2001035 | 23.201 | 26.826 | 34.867 | 15.930 | 11.692 | 19.371 | 11.576 | 23.987 |
| NT2RM2001038 | 18.846 | 16.860 | 28.577 | 14.251 | 9.432 | 21.182 | 12.726 | 12.544 |
| NT2RM2001043 | 31.149 | 17.293 | 22.001 | 11.462 | 11.232 | 18.219 | 25.898 | 31.106 |

TABLE 59-continued

| | | | | | | | | |
|---|---|---|---|---|---|---|---|---|
| NT2RM2001050 | 101.638 | 45.617 | 56.097 | 28.126 | 32.674 | 61.600 | 49.621 | 79.938 |
| NT2RM2001055 | 83.075 | 29.856 | 49.927 | 15.739 | 32.251 | 60.461 | 35.926 | 29.242 |
| NT2RM2001065 | 21.466 | 21.970 | 40.162 | 20.006 | 27.398 | 26.370 | 15.034 | 14.433 |
| NT2RM2001075 | 366.658 | 258.334 | 337.690 | 128.945 | 166.931 | 370.161 | 257.064 | 228.430 |
| NT2RM2001083 | 230.683 | 79.913 | 107.950 | 30.576 | 63.142 | 203.365 | 79.590 | 24.253 |
| NT2RM2001100 | 182.772 | 114.627 | 137.289 | 65.878 | 54.062 | 141.899 | 155.507 | 119.434 |
| NT2RM2001105 | 101.949 | 70.116 | 95.624 | 50.863 | 39.812 | 104.272 | 87.573 | 85.122 |
| NT2RM2001109 | 48.591 | 27.328 | 30.825 | 11.569 | 12.495 | 53.494 | 34.958 | 45.222 |
| NT2RM2001110 | 99.871 | 68.967 | 152.982 | 31.616 | 42.715 | 78.028 | 71.894 | 63.509 |
| NT2RM2001126 | 57.602 | 33.922 | 47.638 | 18.667 | 20.095 | 52.257 | 42.378 | 28.204 |

TABLE 60

| | | | | | | | | |
|---|---|---|---|---|---|---|---|---|
| NT2RM2001131 | 59.454 | 21.547 | 32.934 | 24.063 | 22.706 | 37.676 | 28.873 | 17.418 |
| NT2RM2001141 | 116.250 | 82.599 | 275.090 | 51.756 | 53.614 | 85.069 | 47.274 | 63.199 |
| NT2RM2001152 | 20.261 | 21.814 | 23.297 | 10.506 | 9.194 | 20.068 | 10.068 | 22.007 |
| NT2RM2001177 | 44.847 | 43.449 | 52.307 | 26.604 | 19.552 | 41.709 | 26.283 | 55.231 |
| NT2RM2001194 | 164.727 | 54.905 | 97.293 | 28.358 | 44.057 | 146.597 | 99.019 | 118.606 |
| NT2RM2001195 | 36.939 | 36.245 | 34.818 | 15.750 | 15.727 | 32.602 | 21.861 | 34.274 |
| NT2RM2001196 | 125.134 | 23.362 | 52.729 | 15.781 | 26.090 | 77.518 | 62.058 | 31.794 |
| NT2RM2001201 | 56.981 | 42.504 | 62.447 | 20.139 | 31.351 | 68.607 | 32.835 | 44.422 |
| NT2RM2001221 | 65.764 | 32.746 | 40.357 | 19.565 | 25.529 | 40.240 | 33.849 | 36.497 |
| NT2RM2001238 | 34.807 | 25.200 | 33.023 | 13.254 | 14.872 | 43.011 | 20.155 | 18.493 |
| NT2RM2001243 | 50.316 | 49.076 | 42.361 | 34.148 | 33.121 | 68.021 | 35.734 | 60.810 |
| NT2RM2001244 | 39.082 | 47.756 | 54.069 | 35.242 | 30.728 | 59.908 | 22.778 | 50.393 |
| NT2RM2001247 | 138.825 | 184.906 | 146.564 | 65.082 | 57.954 | 94.133 | 78.544 | 136.745 |
| NT2RM2001256 | 28.147 | 18.773 | 29.336 | 14.133 | 9.881 | 8.739 | 16.106 | 25.473 |
| NT2RM2001269 | 21.655 | 19.444 | 36.676 | 14.235 | 17.978 | 11.919 | 14.441 | 17.847 |
| NT2RM2001278 | 105.133 | 67.683 | 225.135 | 41.243 | 42.803 | 61.361 | 51.930 | 64.103 |
| NT2RM2001291 | 21.264 | 19.798 | 31.162 | 8.619 | 11.535 | 15.945 | 16.243 | 12.482 |
| NT2RM2001294 | 60.754 | 44.696 | 66.102 | 25.820 | 20.715 | 42.950 | 28.321 | 33.134 |
| NT2RM2001295 | 43.856 | 35.189 | 40.675 | 10.220 | 16.301 | 35.694 | 20.908 | 35.879 |
| NT2RM2001302 | 30.816 | 16.802 | 26.058 | 10.228 | 12.245 | 25.513 | 14.404 | 12.416 |
| NT2RM2001306 | 11.584 | 52.176 | 16.722 | 6.379 | 6.616 | 13.560 | 8.347 | 10.145 |
| NT2RM2001312 | 33.361 | 18.866 | 54.572 | 11.148 | 10.119 | 13.848 | 8.526 | 26.714 |
| NT2RM2001319 | 13.127 | 22.841 | 23.586 | 17.119 | 10.492 | 18.998 | 4.495 | 36.587 |
| NT2RM2001324 | 103.673 | 83.091 | 165.198 | 32.861 | 22.836 | 56.112 | 31.793 | 39.459 |
| NT2RM2001345 | 49.634 | 25.168 | 35.284 | 14.837 | 16.900 | 100.618 | 25.540 | 19.919 |
| NT2RM2001360 | 74.152 | 33.097 | 38.122 | 17.660 | 16.021 | 50.562 | 31.265 | 21.915 |
| NT2RM2001370 | 28.821 | 12.859 | 21.986 | 6.327 | 5.734 | 26.406 | 10.631 | 2.394 |
| NT2RM2001391 | 16.127 | 5.412 | 27.834 | 4.575 | 4.553 | 14.188 | 3.910 | 9.994 |
| NT2RM2001393 | 57.930 | 25.241 | 58.135 | 14.781 | 20.544 | 47.187 | 32.903 | 28.104 |
| NT2RM2001420 | 17.272 | 10.676 | 16.079 | 6.774 | 6.751 | 2.717 | 3.157 | 8.464 |
| NT2RM2001423 | 17.345 | 9.837 | 15.261 | 12.233 | 6.527 | 15.432 | 10.007 | 10.935 |
| NT2RM2001424 | 196.973 | 74.966 | 136.019 | 35.222 | 48.814 | 142.268 | 95.111 | 56.187 |
| NT2RM2001482 | 265.035 | 123.493 | 274.926 | 59.811 | 62.022 | 227.572 | 99.155 | 72.372 |
| NT2RM2001499 | 65.942 | 48.790 | 62.383 | 28.605 | 19.730 | 68.321 | 23.722 | 26.475 |
| NT2RM2001504 | 39.282 | 24.742 | 30.958 | 9.395 | 16.991 | 46.880 | 13.034 | 16.709 |
| NT2RM2001524 | 24.755 | 14.244 | 24.384 | 9.699 | 10.204 | 16.924 | 9.647 | 14.539 |
| NT2RM2001530 | 5.573 | 8.914 | 10.768 | 5.856 | 3.286 | 9.623 | 4.337 | 7.511 |
| NT2RM2001533 | 69.137 | 57.026 | 127.055 | 29.970 | 34.159 | 33.371 | 27.483 | 25.268 |
| NT2RM2001540 | 65.400 | 54.541 | 73.017 | 63.277 | 35.636 | 49.097 | 31.308 | 76.346 |
| NT2RM2001544 | 18.067 | 19.624 | 25.228 | 12.549 | 7.049 | 19.380 | 11.033 | 9.485 |
| NT2RM2001547 | 22.357 | 25.608 | 19.122 | 11.755 | 13.130 | 14.503 | 12.339 | 10.697 |
| NT2RM2001558 | 59.623 | 25.861 | 31.696 | 14.111 | 16.568 | 53.758 | 34.606 | 18.325 |
| NT2RM2001575 | 53.128 | 46.425 | 111.368 | 27.392 | 24.257 | 43.005 | 25.405 | 24.423 |
| NT2RM2001582 | 59.050 | 42.778 | 132.294 | 24.555 | 24.449 | 28.347 | 22.303 | 22.397 |
| NT2RM2001588 | 35.342 | 21.815 | 27.343 | 8.806 | 14.132 | 21.498 | 16.451 | 22.464 |
| NT2RM2001592 | 19.456 | 18.542 | 28.436 | 10.182 | 12.538 | 15.234 | 15.478 | 15.460 |
| NT2RM2001603 | 42.456 | 15.253 | 41.037 | 12.377 | 16.738 | 23.117 | 21.517 | 12.277 |
| NT2RM2001605 | 60.434 | 36.233 | 43.204 | 13.580 | 20.116 | 41.260 | 20.117 | 15.459 |
| NT2RM2001611 | 54.771 | 39.056 | 128.984 | 17.180 | 24.100 | 40.047 | 19.191 | 16.136 |
| NT2RM2001613 | 39.500 | 22.894 | 27.579 | 12.321 | 11.577 | 26.696 | 21.149 | 24.773 |
| NT2RM2001626 | 202.358 | 40.774 | 93.458 | 19.731 | 45.138 | 168.993 | 96.729 | 42.842 |
| NT2RM2001632 | 30.160 | 45.268 | 47.586 | 25.780 | 18.848 | 32.974 | 21.939 | 45.513 |
| NT2RM2001633 | 6.521 | 9.885 | 12.546 | 7.571 | 6.017 | 11.226 | 7.294 | 20.798 |
| NT2RM2001635 | 188.515 | 41.783 | 101.462 | 30.227 | 41.863 | 115.049 | 88.246 | 58.313 |
| NT2RM2001636 | 26.880 | 23.087 | 31.788 | 15.679 | 14.225 | 22.589 | 16.870 | 26.264 |
| NT2RM2001637 | 13.020 | 5.524 | 6.631 | 4.897 | 11.170 | 10.700 | 20.526 | 5.331 |
| NT2RM2001639 | 71.531 | 28.740 | 32.389 | 12.149 | 15.813 | 54.897 | 28.931 | 13.443 |
| NT2RM2001641 | 39.297 | 32.462 | 49.334 | 14.630 | 22.002 | 30.556 | 21.763 | 16.776 |
| NT2RM2001643 | 25.535 | 12.621 | 15.764 | 6.658 | 12.027 | 21.274 | 22.136 | 12.847 |
| NT2RM2001648 | 26.584 | 18.351 | 24.507 | 8.310 | 6.636 | 18.218 | 14.277 | 13.561 |
| NT2RM2001652 | 18.655 | 15.854 | 22.304 | 6.782 | 9.644 | 25.729 | 7.851 | 20.144 |
| NT2RM2001659 | 16.893 | 10.861 | 16.538 | 3.750 | 4.964 | 9.228 | 6.172 | 11.278 |
| NT2RM2001660 | 17.414 | 13.987 | 20.619 | 12.709 | 10.544 | 12.482 | 10.671 | 11.244 |
| NT2RM2001664 | 32.470 | 29.186 | 27.804 | 16.171 | 15.728 | 29.928 | 13.136 | 17.877 |

TABLE 61

| | | | | | | | | |
|---|---|---|---|---|---|---|---|---|
| NT2RM2001668 | 89.325 | 61.356 | 52.221 | 32.055 | 34.144 | 88.196 | 46.704 | 35.968 |
| NT2RM2001670 | 58.448 | 20.552 | 40.552 | 17.717 | 15.452 | 67.725 | 25.514 | 50.962 |
| NT2RM2001671 | 31.368 | 15.752 | 21.018 | 19.630 | 8.650 | 62.746 | 15.913 | 35.807 |
| NT2RM2001675 | 7.281 | 7.210 | 6.726 | 2.026 | 5.059 | 4.678 | 4.675 | 6.219 |
| NT2RM2001681 | 6.784 | 7.472 | 11.234 | 3.584 | 7.454 | 5.095 | 5.298 | 21.547 |
| NT2RM2001685 | 28.752 | 21.105 | 22.146 | 9.525 | 9.058 | 19.334 | 21.485 | 26.476 |
| NT2RM2001688 | 35.233 | 25.279 | 43.734 | 11.154 | 11.656 | 30.491 | 20.238 | 33.991 |
| NT2RM2001695 | 82.068 | 103.403 | 239.543 | 46.305 | 60.347 | 69.201 | 35.903 | 61.706 |
| NT2RM2001696 | 101.355 | 65.027 | 68.822 | 31.652 | 35.701 | 110.799 | 51.358 | 52.359 |
| NT2RM2001698 | 146.791 | 45.033 | 83.099 | 28.886 | 31.134 | 111.891 | 66.042 | 79.232 |
| NT2RM2001699 | 24.737 | 20.994 | 25.919 | 13.654 | 8.984 | 19.132 | 14.447 | 42.307 |
| NT2RM2001700 | 14.734 | 8.383 | 12.975 | 3.702 | 1.312 | 7.813 | 9.485 | 4.374 |
| NT2RM2001704 | 50.393 | 27.867 | 50.059 | 14.943 | 24.129 | 36.190 | 27.006 | 62.522 |
| NT2RM2001706 | 75.476 | 62.308 | 144.702 | 48.167 | 41.996 | 55.679 | 28.916 | 57.741 |
| NT2RM2001714 | 14.876 | 12.916 | 25.654 | 7.345 | 10.946 | 13.341 | 5.670 | 10.957 |
| NT2RM2001716 | 294.058 | 99.615 | 122.970 | 48.569 | 68.313 | 188.154 | 109.177 | 48.112 |
| NT2RM2001718 | 109.052 | 48.161 | 57.895 | 15.717 | 34.379 | 105.548 | 62.864 | 26.050 |
| NT2RM2001723 | 20.352 | 14.923 | 16.575 | 7.233 | 8.937 | 39.809 | 8.807 | 9.491 |
| NT2RM2001727 | 57.044 | 41.046 | 46.272 | 22.665 | 16.545 | 51.332 | 33.590 | 46.539 |
| NT2RM2001730 | 27.206 | 22.859 | 24.865 | 8.552 | 9.397 | 19.553 | 13.897 | 12.427 |
| NT2RM2001738 | 25.036 | 6.229 | 18.054 | 7.967 | 10.452 | 22.532 | 14.238 | 26.610 |
| NT2RM2001743 | 31.219 | 15.575 | 27.495 | 8.999 | 13.856 | 19.966 | 21.123 | 40.203 |
| NT2RM2001753 | 41.699 | 57.379 | 66.833 | 29.155 | 36.474 | 48.608 | 37.342 | 50.583 |
| NT2RM2001755 | 102.308 | 95.543 | 95.880 | 48.800 | 50.926 | 85.016 | 56.946 | 58.535 |
| NT2RM2001760 | 36.852 | 29.592 | 43.280 | 11.529 | 16.235 | 41.973 | 21.095 | 36.897 |
| NT2RM2001765 | 17.310 | 22.525 | 20.809 | 5.472 | 6.161 | 36.420 | 11.083 | 21.129 |
| NT2RM2001767 | 507.383 | 198.624 | 244.752 | 82.225 | 86.662 | 313.630 | 261.579 | 156.449 |
| NT2RM2001768 | 14.334 | 16.852 | 22.405 | 14.516 | 7.327 | 13.653 | 4.371 | 27.736 |
| NT2RM2001771 | 33.884 | 31.815 | 59.888 | 20.959 | 19.261 | 40.662 | 26.114 | 70.587 |
| NT2RM2001778 | 14.653 | 9.177 | 12.741 | 0.999 | 6.577 | 9.552 | 8.651 | 6.525 |
| NT2RM2001782 | 49.540 | 17.667 | 39.944 | 11.809 | 19.235 | 60.433 | 38.302 | 42.078 |
| NT2RM2001784 | 31.529 | 23.807 | 34.905 | 9.620 | 16.512 | 26.774 | 14.749 | 17.008 |
| NT2RM2001785 | 73.444 | 32.799 | 54.722 | 14.868 | 28.332 | 74.431 | 52.678 | 40.155 |
| NT2RM2001792 | 82.550 | 48.689 | 54.661 | 13.880 | 26.470 | 67.309 | 56.934 | 51.170 |
| NT2RM2001795 | 130.534 | 65.803 | 79.887 | 22.935 | 40.781 | 108.971 | 66.672 | 68.900 |
| NT2RM2001797 | 17.770 | 23.911 | 46.302 | 31.918 | 15.965 | 38.330 | 15.267 | 61.440 |
| NT2RM2001800 | 32.076 | 15.750 | 32.039 | 9.323 | 10.196 | 25.569 | 24.848 | 32.579 |
| NT2RM2001803 | 18.883 | 19.806 | 27.862 | 15.915 | 15.790 | 17.317 | 12.178 | 25.827 |
| NT2RM2001805 | 10.973 | 6.105 | 12.362 | 3.395 | 7.748 | 17.242 | 7.464 | 10.576 |
| NT2RM2001806 | 41.604 | 28.683 | 30.345 | 12.360 | 14.554 | 35.269 | 18.192 | 22.416 |
| NT2RM2001813 | 11.155 | 10.752 | 12.187 | 5.926 | 6.671 | 17.463 | 7.004 | 10.764 |
| NT2RM2001814 | 16.422 | 18.276 | 19.059 | 5.168 | 10.179 | 14.993 | 12.571 | 9.506 |
| NT2RM2001818 | 37.340 | 15.047 | 25.378 | 7.050 | 13.614 | 28.082 | 23.903 | 16.747 |
| NT2RM2001823 | 13.814 | 13.268 | 12.712 | 4.562 | 7.791 | 10.847 | 8.737 | 7.819 |
| NT2RM2001825 | 27.524 | 37.936 | 22.505 | 15.145 | 17.486 | 21.050 | 17.161 | 33.945 |
| NT2RM2001832 | 68.657 | 29.677 | 30.202 | 9.749 | 22.522 | 37.241 | 30.727 | 18.205 |
| NT2RM2001839 | 53.715 | 31.908 | 39.273 | 13.944 | 12.144 | 27.291 | 25.952 | 18.816 |
| NT2RM2001840 | 108.411 | 98.429 | 259.021 | 48.048 | 32.857 | 58.314 | 28.523 | 37.338 |
| NT2RM2001851 | 52.202 | 39.752 | 63.088 | 24.308 | 18.778 | 32.821 | 26.626 | 85.666 |
| NT2RM2001855 | 33.026 | 24.176 | 29.953 | 16.912 | 19.394 | 23.562 | 31.355 | 25.910 |
| NT2RM2001867 | 30.838 | 22.957 | 35.457 | 14.948 | 16.183 | 32.799 | 17.562 | 46.800 |
| NT2RM2001869 | 129.599 | 162.083 | 180.222 | 173.694 | 64.737 | 231.277 | 145.176 | 147.129 |
| NT2RM2001879 | 14.477 | 14.016 | 20.104 | 6.241 | 7.997 | 18.463 | 6.634 | 17.934 |
| NT2RM2001883 | 42.649 | 14.914 | 59.041 | 11.657 | 28.809 | 14.670 | 17.172 | 5.396 |
| NT2RM2001886 | 31.621 | 19.917 | 31.650 | 19.861 | 14.683 | 19.396 | 24.619 | 18.912 |
| NT2RM2001887 | 19.995 | 18.787 | 31.384 | 9.308 | 6.192 | 7.945 | 11.032 | 6.537 |
| NT2RM2001896 | 5201.332 | 1475.462 | 2605.875 | 738.729 | 3013.651 | 6911.225 | 5347.627 | 1306.593 |
| NT2RM2001902 | 9.512 | 5.176 | 9.030 | 3.230 | 3.539 | 7.418 | 7.583 | 3.383 |
| NT2RM2001903 | 63.243 | 40.127 | 55.162 | 28.793 | 22.732 | 77.356 | 28.595 | 48.438 |
| NT2RM2001930 | 108.255 | 64.649 | 109.195 | 31.339 | 39.123 | 80.005 | 62.289 | 59.426 |
| NT2RM2001935 | 36.519 | 23.148 | 18.415 | 4.134 | 11.165 | 15.562 | 19.141 | 10.042 |
| NT2RM2001936 | 78.536 | 47.939 | 51.879 | 18.980 | 21.013 | 48.576 | 35.554 | 52.419 |
| NT2RM2001939 | 23.961 | 5.651 | 21.192 | 6.301 | 5.377 | 17.197 | 7.025 | 5.482 |
| NT2RM2001941 | 71.450 | 49.630 | 78.923 | 19.738 | 22.274 | 54.128 | 31.260 | 34.949 |

TABLE 62

| | | | | | | | | |
|---|---|---|---|---|---|---|---|---|
| NT2RM2001950 | 46.415 | 29.816 | 36.996 | 18.559 | 8.239 | 39.347 | 13.956 | 23.224 |
| NT2RM2001952 | 2.871 | 2.886 | 10.623 | 6.195 | 0.000 | 2.538 | 1.846 | 8.237 |
| NT2RM2001976 | 42.702 | 29.344 | 52.698 | 20.599 | 18.125 | 57.645 | 24.197 | 33.972 |
| NT2RM2001982 | 20.947 | 25.776 | 25.162 | 18.275 | 10.576 | 18.050 | 9.191 | 14.830 |
| NT2RM2001983 | 23.643 | 16.045 | 27.661 | 9.316 | 13.749 | 23.964 | 18.258 | 17.035 |
| NT2RM2001984 | 147.043 | 51.662 | 81.658 | 22.066 | 35.725 | 120.259 | 90.102 | 44.130 |
| NT2RM2001989 | 76.106 | 50.939 | 80.150 | 44.331 | 24.785 | 39.074 | 34.205 | 61.176 |
| NT2RM2001996 | 37.798 | 41.931 | 43.246 | 23.083 | 19.109 | 45.858 | 26.665 | 31.923 |
| NT2RM2001997 | 63.158 | 41.928 | 28.543 | 20.691 | 22.046 | 58.320 | 33.747 | 34.764 |

TABLE 62-continued

| | | | | | | | | |
|---|---|---|---|---|---|---|---|---|
| NT2RM2001998 | 47.869 | 29.374 | 50.969 | 17.042 | 23.450 | 45.674 | 22.546 | 20.062 |
| NT2RM2001999 | 23.045 | 23.925 | 34.107 | 16.137 | 19.923 | 26.601 | 19.613 | 27.167 |
| NT2RM2002003 | 60.554 | 45.534 | 133.518 | 30.271 | 23.148 | 57.270 | 34.688 | 36.304 |
| NT2RM2002004 | 16.782 | 14.896 | 24.193 | 8.483 | 9.918 | 13.788 | 12.592 | 4.939 |
| NT2RM2002009 | 22.784 | 26.292 | 37.573 | 16.205 | 17.990 | 24.047 | 10.371 | 17.159 |
| NT2RM2002014 | 12.027 | 11.499 | 20.605 | 9.676 | 8.686 | 10.127 | 8.085 | 17.091 |
| NT2RM2002019 | 45.009 | 49.617 | 61.370 | 29.641 | 24.044 | 45.990 | 20.852 | 29.924 |
| NT2RM2002029 | 100.329 | 58.955 | 73.738 | 25.096 | 36.513 | 90.878 | 44.848 | 41.854 |
| NT2RM2002030 | 53.030 | 36.122 | 48.637 | 23.542 | 18.217 | 49.856 | 26.265 | 32.557 |
| NT2RM2002034 | 55.319 | 58.655 | 69.310 | 15.775 | 34.696 | 119.355 | 37.851 | 31.637 |
| NT2RM2002049 | 30.306 | 26.333 | 67.224 | 12.461 | 13.486 | 32.196 | 19.763 | 26.143 |
| NT2RM2002055 | 4.746 | 9.322 | 10.601 | 1.587 | 3.475 | 2.738 | 4.711 | 1.253 |
| NT2RM2002072 | 274.106 | 142.825 | 221.668 | 99.170 | 111.051 | 240.179 | 193.919 | 147.089 |
| NT2RM2002088 | 66.101 | 43.548 | 67.009 | 20.108 | 29.769 | 38.434 | 34.203 | 37.710 |
| NT2RM2002091 | 157.752 | 95.255 | 103.301 | 42.530 | 51.107 | 91.971 | 64.745 | 58.827 |
| NT2RM2002100 | 36.481 | 42.661 | 83.563 | 34.382 | 22.604 | 42.960 | 30.266 | 45.203 |
| NT2RM2002109 | 65.961 | 25.178 | 54.629 | 11.426 | 17.601 | 56.066 | 33.541 | 37.167 |
| NT2RM2002126 | 271.768 | 145.370 | 244.199 | 79.521 | 110.685 | 272.182 | 195.547 | 168.748 |
| NT2RM2002128 | 30.978 | 20.989 | 35.773 | 13.699 | 15.221 | 20.446 | 37.022 | 29.430 |
| NT2RM2002129 | 53.911 | 38.709 | 50.544 | 14.507 | 24.022 | 54.089 | 40.427 | 15.416 |
| NT2RM2002142 | 157.794 | 95.271 | 127.900 | 44.871 | 54.994 | 121.896 | 116.748 | 122.762 |
| NT2RM2002144 | 39.141 | 23.769 | 42.061 | 18.362 | 18.425 | 90.424 | 32.619 | 22.086 |
| NT2RM2002145 | 69.465 | 33.538 | 54.629 | 19.065 | 28.804 | 64.861 | 31.013 | 26.312 |
| NT2RM2002153 | 57.982 | 34.658 | 45.808 | 37.204 | 22.363 | 85.615 | 33.858 | 45.468 |
| NT2RM2002163 | 46.164 | 22.611 | 32.853 | 10.533 | 12.313 | 28.767 | 18.529 | 24.578 |
| NT2RM2002170 | 20.367 | 15.918 | 26.954 | 17.854 | 7.659 | 21.614 | 6.584 | 31.812 |
| NT2RM2002178 | 72.826 | 29.934 | 35.113 | 17.819 | 17.814 | 57.676 | 53.788 | 36.064 |
| NT2RM2002179 | 20.487 | 16.890 | 26.778 | 4.596 | 7.536 | 27.483 | 11.691 | 22.514 |
| NT2RM2002270 | 75.965 | 30.835 | 59.481 | 19.162 | 23.264 | 67.579 | 38.824 | 31.179 |
| NT2RM2002326 | 25.054 | 17.109 | 25.901 | 10.631 | 13.295 | 20.170 | 15.155 | 11.219 |
| NT2RM2002337 | 49.608 | 30.430 | 44.382 | 14.424 | 20.214 | 49.783 | 38.536 | 36.266 |
| NT2RM2002339 | 126.783 | 46.855 | 62.446 | 22.680 | 35.280 | 129.046 | 67.853 | 46.026 |
| NT2RM2002345 | 34.662 | 27.251 | 30.489 | 17.636 | 9.930 | 27.503 | 20.940 | 24.302 |
| NT2RM2002368 | 53.018 | 67.271 | 118.627 | 55.152 | 36.416 | 61.876 | 35.957 | 79.909 |
| NT2RM2002381 | 29.049 | 17.380 | 20.968 | 5.965 | 9.584 | 35.715 | 13.371 | 27.731 |
| NT2RM2002424 | 23.738 | 30.901 | 58.344 | 39.153 | 17.434 | 49.766 | 25.216 | 77.325 |
| NT2RM2002450 | 40.370 | 29.535 | 54.082 | 14.242 | 16.219 | 34.988 | 19.676 | 33.464 |
| NT2RM2002482 | 44.705 | 26.737 | 46.955 | 14.769 | 18.437 | 42.664 | 46.045 | 30.188 |
| NT2RM2002492 | 113.197 | 127.579 | 109.738 | 72.932 | 49.321 | 103.335 | 74.905 | 97.173 |
| NT2RM2002575 | 112.457 | 88.605 | 247.074 | 59.323 | 48.212 | 80.685 | 45.794 | 62.455 |
| NT2RM2002580 | 64.838 | 62.853 | 111.962 | 57.513 | 26.109 | 65.998 | 30.240 | 69.813 |
| NT2RM2002592 | 110.441 | 70.152 | 96.103 | 45.340 | 44.856 | 104.438 | 69.434 | 96.173 |
| NT2RM2002608 | 20.462 | 46.581 | 29.949 | 14.231 | 13.430 | 29.384 | 17.823 | 61.212 |
| NT2RM2002615 | 33.564 | 24.375 | 25.868 | 12.468 | 16.085 | 46.176 | 71.069 | 33.280 |
| NT2RM2002622 | 95.365 | 53.669 | 62.071 | 44.205 | 38.612 | 108.504 | 47.073 | 91.258 |
| NT2RM2002630 | 118.784 | 86.444 | 276.792 | 68.615 | 58.079 | 85.846 | 51.946 | 80.285 |
| NT2RM2002634 | 36.887 | 30.749 | 31.925 | 22.948 | 20.535 | 42.111 | 32.736 | 22.117 |
| NT2RM2002645 | 51.215 | 209.069 | 58.292 | 23.942 | 32.501 | 97.660 | 24.132 | 61.537 |
| NT2RM2002646 | 69.318 | 57.452 | 61.629 | 25.645 | 19.295 | 50.329 | 23.768 | 24.267 |
| NT2RM2002647 | 31.140 | 27.535 | 50.514 | 14.850 | 14.557 | 35.612 | 29.190 | 42.269 |
| NT2RM2002652 | 42.576 | 30.866 | 34.782 | 11.897 | 12.829 | 46.172 | 14.955 | 30.578 |
| NT2RM2002692 | 53.871 | 40.724 | 63.208 | 39.953 | 38.748 | 37.914 | 30.444 | 71.284 |
| NT2RM2002721 | 81.740 | 78.721 | 123.105 | 75.203 | 80.050 | 98.931 | 44.593 | 72.005 |
| NT2RM2002748 | 91.982 | 206.064 | 112.357 | 241.969 | 54.156 | 135.810 | 67.060 | 228.776 |
| NT2RM2002764 | 46.071 | 41.769 | 48.814 | 22.081 | 22.119 | 34.365 | 32.761 | 36.777 |

TABLE 63

| | | | | | | | | |
|---|---|---|---|---|---|---|---|---|
| NT2RM2002772 | 80.296 | 40.944 | 68.101 | 23.056 | 28.389 | 72.818 | 41.505 | 60.302 |
| NT2RM2002811 | 63.439 | 38.909 | 43.044 | 17.983 | 20.375 | 56.523 | 23.815 | 28.434 |
| NT2RM2002818 | 50.605 | 52.430 | 151.915 | 32.193 | 19.702 | 26.680 | 17.380 | 40.512 |
| NT2RM2002879 | 24.562 | 28.586 | 34.172 | 8.860 | 6.095 | 18.514 | 12.159 | 30.354 |
| NT2RM2002979 | 84.387 | 41.192 | 53.776 | 21.436 | 31.083 | 74.067 | 53.736 | 47.429 |
| NT2RM2002981 | 59.340 | 25.706 | 33.191 | 11.478 | 15.597 | 54.899 | 35.830 | 32.861 |
| NT2RM2002995 | 42.179 | 21.303 | 31.267 | 13.206 | 10.830 | 32.109 | 30.448 | 42.538 |
| NT2RM2003031 | 44.114 | 29.430 | 46.063 | 16.774 | 17.437 | 43.222 | 40.155 | 25.053 |
| NT2RM2003042 | 106.509 | 160.917 | 155.488 | 83.058 | 73.174 | 152.473 | 69.308 | 122.583 |
| NT2RM2003044 | 33.909 | 33.603 | 47.142 | 12.698 | 45.517 | 25.310 | 25.508 | 29.529 |
| NT2RM2003090 | 47.953 | 25.520 | 41.051 | 9.604 | 15.180 | 34.197 | 23.552 | 25.659 |
| NT2RM2003095 | 43.943 | 31.580 | 32.103 | 11.759 | 18.398 | 29.592 | 34.666 | 28.874 |
| NT2RM2003116 | 20.590 | 18.126 | 22.701 | 10.734 | 10.194 | 11.727 | 12.203 | 14.479 |
| NT2RM2003222 | 21.398 | 10.313 | 27.148 | 5.349 | 13.395 | 13.068 | 20.550 | 25.145 |
| NT2RM2003224 | 110.266 | 37.406 | 48.819 | 30.835 | 29.947 | 80.454 | 57.677 | 53.588 |
| NT2RM2003250 | 30.062 | 26.498 | 38.776 | 15.773 | 16.547 | 23.997 | 24.660 | 26.915 |
| NT2RM2003258 | 12.707 | 12.077 | 15.752 | 5.247 | 7.979 | 8.239 | 5.752 | 8.852 |
| NT2RM2003262 | 37.575 | 42.567 | 50.603 | 27.374 | 33.378 | 31.965 | 36.375 | 43.803 |

TABLE 63-continued

| | | | | | | | | |
|---|---|---|---|---|---|---|---|---|
| NT2RM4000023 | 49.690 | 44.882 | 57.421 | 17.352 | 24.868 | 53.007 | 25.083 | 35.943 |
| NT2RM4000024 | 33.710 | 23.142 | 26.564 | 7.803 | 10.308 | 34.975 | 25.466 | 17.156 |
| NT2RM4000027 | 6.576 | 5.40 | 9.541 | 2.488 | 3.969 | 5.783 | 1.681 | 9.230 |
| NT2RM4000030 | 107.340 | 43.649 | 64.579 | 25.595 | 27.984 | 81.398 | 45.801 | 45.851 |
| NT2RM4000033 | 54.521 | 41.188 | 116.087 | 19.883 | 18.324 | 28.028 | 14.764 | 29.244 |
| NT2RM4000034 | 8.646 | 20.135 | 21.495 | 9.212 | 9.086 | 13.100 | 7.920 | 12.176 |
| NT2RM4000046 | 42.055 | 17.446 | 23.148 | 8.687 | 9.540 | 32.532 | 23.736 | 18.823 |
| NT2RM4000052 | 23.740 | 17.236 | 25.146 | 8.065 | 5.341 | 17.707 | 13.080 | 13.561 |
| NT2RM4000054 | 440.502 | 221.475 | 352.643 | 107.153 | 132.322 | 410.274 | 281.112 | 209.475 |
| NT2RM4000061 | 30.264 | 15.792 | 27.807 | 6.396 | 10.845 | 21.557 | 14.902 | 4.276 |
| NT2RM4000074 | 8.073 | 35.126 | 41.073 | 20.510 | 9.480 | 34.431 | 24.493 | 47.368 |
| NT2RM4000085 | 22.897 | 19.315 | 23.277 | 16.541 | 12.977 | 24.111 | 12.451 | 24.618 |
| NT2RM4000086 | 50.715 | 22.670 | 78.725 | 20.299 | 18.247 | 28.085 | 16.663 | 27.361 |
| NT2RM4000100 | 17.872 | 21.935 | 15.019 | 10.707 | 10.091 | 15.553 | 12.260 | 12.129 |
| NT2RM4000101 | 42.770 | 15.330 | 25.672 | 6.552 | 7.785 | 24.576 | 15.561 | 5.064 |
| NT2RM4000102 | 407.848 | 190.329 | 321.537 | 152.733 | 208.613 | 334.316 | 212.009 | 231.229 |
| NT2RM4000104 | 23.885 | 13.626 | 17.310 | 3.131 | 7.950 | 21.156 | 10.845 | 7.969 |
| NT2RM4000115 | 32.088 | 10.072 | 16.134 | 5.693 | 9.226 | 13.512 | 10.582 | 7.588 |
| NT2RM4000129 | 36.681 | 21.490 | 22.965 | 12.521 | 11.849 | 23.308 | 16.146 | 10.761 |
| NT2RM4000139 | 25.930 | 23.620 | 31.564 | 24.607 | 22.610 | 18.556 | 14.008 | 44.620 |
| NT2RM4000149 | 33.404 | 17.925 | 29.734 | 13.712 | 15.989 | 18.474 | 26.736 | 42.075 |
| NT2RM4000155 | 21.566 | 44.820 | 46.750 | 15.598 | 16.524 | 14.928 | 9.733 | 8.224 |
| NT2RM4000156 | 16.586 | 6.239 | 5.822 | 3.387 | 3.958 | 28.594 | 7.207 | 15.119 |
| NT2RM4000167 | 20.171 | 16.879 | 15.859 | 11.667 | 2.739 | 8.443 | 3.474 | 21.050 |
| NT2RM4000169 | 30.428 | 28.089 | 36.443 | 24.244 | 11.338 | 20.566 | 13.227 | 60.152 |
| NT2RM4000191 | 52.656 | 25.321 | 40.946 | 12.980 | 18.787 | 41.092 | 35.047 | 38.394 |
| NT2RM4000197 | 15.240 | 11.946 | 16.612 | 2.282 | 13.434 | 15.387 | 8.823 | 5.757 |
| NT2RM4000198 | 88.525 | 63.904 | 196.728 | 39.099 | 37.803 | 49.371 | 53.195 | 32.774 |
| NT2RM4000199 | 52.380 | 24.904 | 46.280 | 17.110 | 18.960 | 33.287 | 27.322 | 30.945 |
| NT2RM4000200 | 33.395 | 16.462 | 28.537 | 10.600 | 16.103 | 20.714 | 14.030 | 6.949 |
| NT2RM4000202 | 30.208 | 20.922 | 42.468 | 9.182 | 9.970 | 16.908 | 10.274 | 12.811 |
| NT2RM4000210 | 66.407 | 27.815 | 30.474 | 15.335 | 16.812 | 41.212 | 27.389 | 47.172 |
| NT2RM4000215 | 25.869 | 24.845 | 36.251 | 22.848 | 13.152 | 31.488 | 12.403 | 27.548 |
| NT2RM4000220 | 47.201 | 39.573 | 38.877 | 20.267 | 19.583 | 51.592 | 35.424 | 51.912 |
| NT2RM4000229 | 38.395 | 26.396 | 42.302 | 13.878 | 14.171 | 29.316 | 28.424 | 16.590 |
| NT2RM4000231 | 54.697 | 33.959 | 43.440 | 18.016 | 23.895 | 29.537 | 28.746 | 34.406 |
| NT2RM4000233 | 209.479 | 90.187 | 137.270 | 36.159 | 66.994 | 160.853 | 100.732 | 62.965 |
| NT2RM4000244 | 16.916 | 9.010 | 13.401 | 4.357 | 9.911 | 12.907 | 8.771 | 8.963 |
| NT2RM4000251 | 143.833 | 19.474 | 33.500 | 11.060 | 16.673 | 31.966 | 32.833 | 8.105 |
| NT2RM4000255 | 35.799 | 17.398 | 36.446 | 10.625 | 12.098 | 29.741 | 23.847 | 15.929 |
| NT2RM4000265 | 102.046 | 79.778 | 222.138 | 64.769 | 51.026 | 72.136 | 39.083 | 49.420 |
| NT2RM4000283 | 285.571 | 172.391 | 189.067 | 109.857 | 94.953 | 255.306 | 162.352 | 166.824 |
| NT2RM4000284 | 23.615 | 36.279 | 30.562 | 12.441 | 17.835 | 25.501 | 27.248 | 34.927 |
| NT2RM4000290 | 74.673 | 36.513 | 57.081 | 15.623 | 22.008 | 73.912 | 45.709 | 43.178 |
| NT2RM4000295 | 24.000 | 18.871 | 22.693 | 8.987 | 11.022 | 47.890 | 18.701 | 14.976 |
| NT2RM4000306 | 140.029 | 42.148 | 61.817 | 18.306 | 78.561 | 140.760 | 92.030 | 34.220 |

TABLE 64

| | | | | | | | | |
|---|---|---|---|---|---|---|---|---|
| NT2RM4000307 | 20.678 | 19.168 | 22.141 | 9.050 | 9.145 | 23.385 | 14.343 | 13.754 |
| NT2RM4000309 | 41.662 | 20.618 | 26.408 | 8.581 | 10.787 | 30.894 | 18.116 | 11.868 |
| NT2RM4000313 | 36.434 | 20.403 | 33.260 | 17.080 | 12.239 | 39.520 | 34.145 | 43.040 |
| NT2RM4000318 | 52.262 | 31.467 | 139.471 | 20.774 | 17.880 | 23.820 | 17.441 | 19.608 |
| NT2RM4000324 | 51.333 | 27.748 | 39.958 | 9.932 | 17.995 | 63.248 | 27.625 | 42.800 |
| NT2RM4000326 | 32.179 | 16.471 | 20.536 | 8.435 | 10.621 | 23.791 | 17.926 | 20.620 |
| NT2RM4000327 | 60.230 | 58.958 | 198.666 | 69.302 | 28.376 | 44.008 | 20.961 | 43.734 |
| NT2RM4000344 | 63.708 | 65.489 | 173.360 | 38.949 | 27.536 | 34.270 | 15.519 | 42.106 |
| NT2RM4000349 | 30.022 | 14.663 | 14.070 | 7.442 | 10.197 | 22.535 | 12.455 | 16.210 |
| NT2RM4000354 | 46.698 | 15.085 | 27.013 | 11.329 | 7.922 | 27.895 | 13.694 | 15.005 |
| NT2RM4000356 | 32.497 | 24.336 | 32.372 | 13.972 | 11.464 | 43.673 | 31.608 | 29.630 |
| NT2RM4000366 | 528.262 | 330.865 | 423.109 | 167.985 | 170.232 | 378.411 | 215.606 | 442.307 |
| NT2RM4000368 | 51.220 | 51.300 | 153.236 | 33.445 | 22.538 | 43.253 | 17.539 | 64.383 |
| NT2RM4000373 | 25.297 | 22.861 | 32.020 | 19.516 | 16.128 | 25.045 | 13.784 | 37.614 |
| NT2RM4000386 | 22.576 | 9.738 | 24.078 | 8.987 | 9.704 | 21.730 | 24.414 | 23.758 |
| NT2RM4000395 | 61.364 | 79.696 | 124.563 | 37.133 | 40.433 | 107.248 | 46.227 | 46.047 |
| NT2RM4000414 | 159.474 | 59.130 | 69.911 | 18.566 | 40.333 | 119.002 | 79.051 | 21.561 |
| NT2RM4000417 | 15.712 | 20.634 | 23.502 | 7.213 | 7.502 | 15.030 | 7.412 | 1.867 |
| NT2RM4000421 | 15.106 | 14.708 | 19.062 | 8.549 | 6.469 | 15.114 | 8.074 | 20.588 |
| NT2RM4000425 | 101.441 | 83.854 | 259.486 | 55.511 | 39.319 | 53.250 | 31.739 | 69.026 |
| NT2RM4000433 | 51.457 | 24.650 | 39.654 | 12.379 | 16.608 | 41.763 | 37.139 | 36.708 |
| NT2RM4000436 | 51.207 | 21.755 | 29.307 | 13.444 | 12.333 | 34.290 | 27.223 | 37.320 |
| NT2RM4000444 | 40.864 | 26.268 | 67.826 | 11.797 | 17.600 | 39.060 | 23.113 | 28.672 |
| NT2RM4000457 | 63.983 | 39.080 | 61.124 | 23.292 | 28.748 | 50.040 | 26.813 | 31.965 |
| NT2RM4000471 | 41.652 | 29.088 | 37.803 | 8.939 | 15.093 | 35.469 | 20.877 | 14.796 |
| NT2RM4000472 | 68.502 | 62.226 | 206.357 | 48.752 | 23.646 | 77.597 | 28.412 | 104.099 |
| NT2RM4000486 | 30.140 | 26.427 | 28.452 | 18.097 | 7.542 | 22.184 | 12.697 | 24.533 |

TABLE 64-continued

| | | | | | | | | |
|---|---|---|---|---|---|---|---|---|
| NT2RM4000490 | 51.124 | 23.641 | 42.235 | 9.300 | 14.683 | 56.785 | 25.625 | 17.105 |
| NT2RM4000496 | 110.770 | 31.642 | 65.060 | 13.739 | 27.500 | 68.720 | 52.247 | 37.631 |
| NT2RM4000505 | 134.100 | 84.063 | 126.035 | 43.665 | 56.053 | 130.720 | 81.120 | 71.520 |
| NT2RM4000511 | 73.441 | 160.671 | 81.146 | 172.018 | 35.906 | 98.128 | 55.037 | 164.299 |
| NT2RM4000514 | 24.804 | 23.670 | 34.085 | 13.945 | 16.589 | 32.103 | 21.758 | 11.170 |
| NT2RM4000515 | 56.528 | 99.798 | 88.516 | 40.030 | 41.279 | 67.061 | 40.210 | 72.202 |
| NT2RM4000517 | 94.295 | 97.384 | 143.107 | 76.451 | 43.905 | 144.940 | 69.520 | 145.604 |
| NT2RM4000520 | 13.459 | 13.780 | 16.902 | 5.273 | 5.564 | 7.899 | 7.054 | 14.968 |
| NT2RM4000531 | 29.188 | 24.283 | 26.738 | 11.063 | 12.826 | 18.929 | 23.443 | 20.712 |
| NT2RM4000532 | 14.395 | 12.711 | 19.277 | 9.437 | 8.520 | 12.914 | 15.215 | 13.835 |
| NT2RM4000533 | 18.380 | 13.704 | 18.165 | 8.534 | 7.454 | 15.515 | 10.288 | 7.686 |
| NT2RM4000534 | 17.803 | 11.768 | 18.975 | 7.585 | 10.236 | 14.119 | 11.420 | 19.497 |
| NT2RM4000563 | 53.983 | 34.056 | 51.401 | 17.700 | 36.352 | 45.609 | 32.373 | 33.367 |
| NT2RM4000566 | 36.586 | 22.989 | 35.859 | 9.957 | 21.078 | 25.668 | 24.949 | 21.224 |
| NT2RM4000568 | 59.423 | 29.845 | 36.652 | 12.139 | 25.850 | 70.617 | 54.001 | 29.192 |
| NT2RM4000585 | 48.810 | 27.673 | 38.443 | 12.701 | 20.510 | 33.948 | 23.868 | 27.346 |
| NT2RM4000587 | 29.705 | 26.644 | 25.876 | 12.729 | 11.927 | 16.240 | 17.926 | 19.718 |
| NT2RM4000590 | 32.164 | 21.289 | 29.186 | 8.941 | 11.617 | 18.856 | 16.495 | 13.544 |
| NT2RM4000593 | 61.080 | 32.766 | 38.970 | 15.411 | 20.660 | 33.032 | 30.484 | 25.715 |
| NT2RM4000595 | 41.141 | 22.473 | 35.313 | 9.766 | 11.448 | 11.237 | 20.012 | 12.069 |
| NT2RM4000603 | 78.976 | 52.410 | 58.176 | 24.839 | 24.042 | 50.072 | 40.363 | 31.910 |
| NT2RM4000611 | 15.953 | 10.734 | 13.469 | 9.013 | 8.977 | 10.161 | 7.157 | 22.979 |
| NT2RM4000616 | 45.814 | 37.309 | 35.175 | 17.505 | 23.768 | 40.117 | 27.918 | 39.007 |
| NT2RM4000621 | 57.493 | 77.709 | 73.014 | 76.819 | 24.081 | 71.204 | 46.769 | 83.169 |
| NT2RM4000648 | 28.637 | 18.518 | 26.908 | 8.210 | 13.083 | 15.965 | 12.644 | 11.022 |
| NT2RM4000649 | 85.058 | 41.743 | 59.668 | 13.629 | 29.612 | 55.983 | 39.586 | 36.405 |
| NT2RM4000658 | 135.688 | 61.028 | 120.722 | 28.197 | 43.765 | 79.777 | 46.011 | 96.630 |
| NT2RM4000661 | 71.864 | 99.345 | 52.294 | 18.409 | 29.132 | 62.897 | 45.030 | 41.904 |
| NT2RM4000673 | 135.680 | 61.584 | 75.017 | 24.321 | 20.618 | 70.048 | 46.608 | 45.107 |
| NT2RM4000674 | 75.722 | 36.633 | 51.480 | 16.765 | 16.961 | 34.561 | 42.749 | 30.664 |
| NT2RM4000689 | 41.790 | 28.540 | 39.966 | 15.401 | 8.448 | 22.615 | 15.641 | 20.045 |
| NT2RM4000698 | 61.169 | 46.347 | 64.951 | 24.102 | 41.257 | 63.885 | 38.390 | 29.637 |
| NT2RM4000700 | 27.239 | 106.106 | 27.114 | 9.273 | 11.699 | 12.813 | 14.815 | 12.082 |
| NT2RM4000701 | 227.264 | 115.040 | 182.483 | 47.970 | 70.324 | 76.813 | 128.958 | 65.330 |
| NT2RM4000712 | 43.183 | 27.951 | 46.394 | 10.240 | 14.368 | 19.562 | 26.208 | 16.644 |
| NT2RM4000717 | 34.386 | 22.333 | 19.262 | 10.038 | 12.975 | 19.299 | 13.148 | 20.540 |
| NT2RM4000733 | 75.958 | 43.996 | 58.928 | 24.743 | 28.885 | 88.871 | 65.331 | 37.193 |

TABLE 65

| | | | | | | | | |
|---|---|---|---|---|---|---|---|---|
| NT2RM4000734 | 24.197 | 38.270 | 53.725 | 16.970 | 13.155 | 39.087 | 23.333 | 39.227 |
| NT2RM4000741 | 43.844 | 13.589 | 30.427 | 10.346 | 8.744 | 26.119 | 12.592 | 26.083 |
| NT2RM4000744 | 50.833 | 14.548 | 25.024 | 23.480 | 10.805 | 62.136 | 17.742 | 83.553 |
| NT2RM4000749 | 80.902 | 71.083 | 91.633 | 27.354 | 60.031 | 198.030 | 52.328 | 100.669 |
| NT2RM4000751 | 22.688 | 29.768 | 53.788 | 53.315 | 27.282 | 19.811 | 22.272 | 42.714 |
| NT2RM4000752 | 52.247 | 32.866 | 40.812 | 14.427 | 15.224 | 9.355 | 23.407 | 43.927 |
| NT2RM4000760 | 33.235 | 16.169 | 27.997 | 11.989 | 19.412 | 13.254 | 10.563 | 10.820 |
| NT2RM4000761 | 2403.264 | 848.134 | 3887.956 | 172.265 | 1449.525 | 4450.958 | 2359.029 | 400.128 |
| NT2RM4000764 | 301.709 | 144.132 | 163.494 | 49.659 | 143.743 | 257.369 | 245.639 | 103.045 |
| NT2RM4000768 | 11.747 | 9.247 | 11.542 | 9.135 | 9.038 | 10.345 | 6.336 | 11.267 |
| NT2RM4000778 | 6.893 | 5.725 | 9.950 | 5.466 | 4.458 | 5.886 | 5.079 | 5.685 |
| NT2RM4000779 | 238.073 | 96.516 | 182.851 | 51.850 | 99.170 | 184.671 | 138.565 | 75.926 |
| NT2RM4000787 | 69.121 | 57.977 | 157.708 | 28.426 | 29.213 | 21.609 | 22.633 | 11.420 |
| NT2RM4000790 | 60.309 | 46.026 | 83.182 | 23.988 | 30.494 | 22.815 | 35.485 | 31.417 |
| NT2RM4000795 | 453.425 | 108.548 | 204.710 | 17.809 | 92.365 | 272.802 | 147.653 | 47.088 |
| NT2RM4000796 | 144.288 | 57.098 | 70.720 | 23.213 | 47.104 | 97.550 | 50.426 | 30.942 |
| NT2RM4000798 | 59.938 | 28.301 | 25.839 | 10.244 | 18.327 | 23.444 | 20.572 | 11.548 |
| NT2RM4000800 | 150.768 | 122.487 | 195.880 | 137.376 | 57.284 | 146.130 | 97.369 | 185.386 |
| NT2RM4000813 | 37.084 | 20.876 | 36.294 | 12.655 | 14.527 | 25.975 | 22.848 | 11.921 |
| NT2RM4000820 | 86.855 | 60.381 | 192.196 | 39.751 | 37.738 | 50.427 | 35.797 | 26.747 |
| NT2RM4000827 | 41.788 | 28.006 | 51.622 | 20.945 | 21.631 | 21.541 | 30.438 | 31.570 |
| NT2RM4000830 | 68.078 | 30.965 | 59.647 | 20.203 | 26.347 | 37.484 | 30.029 | 44.496 |
| NT2RM4000833 | 111.407 | 74.480 | 77.732 | 17.832 | 39.802 | 56.697 | 25.292 | 36.404 |
| NT2RM4000841 | 49.942 | 45.599 | 72.313 | 16.308 | 20.094 | 29.644 | 26.188 | 28.854 |
| NT2RM4000846 | 104.561 | 76.278 | 275.932 | 57.490 | 49.037 | 63.058 | 36.772 | 14.948 |
| NT2RM4000848 | 125.196 | 36.830 | 101.007 | 17.584 | 32.806 | 82.740 | 51.262 | 19.922 |
| NT2RM4000852 | 113.009 | 77.800 | 126.639 | 43.464 | 43.880 | 57.479 | 52.365 | 44.156 |
| NT2RM4000855 | 64.608 | 50.229 | 146.326 | 22.844 | 23.661 | 28.928 | 25.813 | 51.332 |
| NT2RM4000859 | 24.418 | 19.759 | 24.141 | 10.385 | 14.916 | 34.345 | 18.598 | 11.625 |
| NT2RM4000868 | 16.564 | 14.752 | 14.556 | 11.565 | 9.114 | 12.226 | 17.324 | 12.029 |
| NT2RM4000870 | 55.531 | 47.020 | 57.796 | 18.791 | 30.154 | 39.778 | 25.127 | 26.057 |
| NT2RM4000879 | 103.887 | 41.773 | 56.495 | 12.837 | 31.154 | 67.942 | 43.586 | 22.044 |
| NT2RM4000882 | 81.982 | 42.561 | 80.304 | 22.840 | 38.713 | 36.853 | 45.646 | 48.992 |
| NT2RM4000887 | 151.731 | 36.758 | 112.092 | 22.645 | 40.960 | 98.527 | 85.229 | 22.008 |
| NT2RM4000895 | 84.679 | 41.293 | 172.935 | 28.755 | 27.724 | 44.297 | 19.644 | 26.291 |
| NT2RM4000897 | 45.994 | 42.630 | 58.329 | 17.578 | 25.299 | 44.317 | 41.019 | 30.575 |

TABLE 65-continued

| | | | | | | | | |
|---|---|---|---|---|---|---|---|---|
| NT2RM4000901 | 13.138 | 13.528 | 18.046 | 7.930 | 5.669 | 7.738 | 9.304 | 5.798 |
| NT2RM4000950 | 13.710 | 21.028 | 17.402 | 10.585 | 11.390 | 13.090 | 8.272 | 13.397 |
| NT2RM4000965 | 54.459 | 36.282 | 50.127 | 15.952 | 25.327 | 23.064 | 21.414 | 26.049 |
| NT2RM4000971 | 41.258 | 27.847 | 39.604 | 12.433 | 17.061 | 72.230 | 20.025 | 17.430 |
| NT2RM4000979 | 33.580 | 21.677 | 32.692 | 7.475 | 11.647 | 22.259 | 16.549 | 12.389 |
| NT2RM4000987 | 51.637 | 23.981 | 27.883 | 11.309 | 12.974 | 42.714 | 19.808 | 18.064 |
| NT2RM4000989 | 43.246 | 16.680 | 33.780 | 10.504 | 10.430 | 22.581 | 33.282 | 15.269 |
| NT2RM4000991 | 6.595 | 8.954 | 14.910 | 4.216 | 4.093 | 24.193 | 3.472 | 15.581 |
| NT2RM4000992 | 61.901 | 44.659 | 179.747 | 37.376 | 29.327 | 33.667 | 22.750 | 38.582 |
| NT2RM4000996 | 12.902 | 17.829 | 47.104 | 22.304 | 9.589 | 15.133 | 12.379 | 41.017 |
| NT2RM4000997 | 139.754 | 107.958 | 216.478 | 45.750 | 59.135 | 79.871 | 47.855 | 52.159 |
| NT2RM4001001 | 222.229 | 90.117 | 123.641 | 25.902 | 74.114 | 102.439 | 120.879 | 88.667 |
| NT2RM4001002 | 22.453 | 23.223 | 34.127 | 15.841 | 13.942 | 17.616 | 10.393 | 26.669 |
| NT2RM4001016 | 39.433 | 22.372 | 27.844 | 7.677 | 15.230 | 29.791 | 22.346 | 14.840 |
| NT2RM4001025 | 123.159 | 184.713 | 262.665 | 136.422 | 89.809 | 167.042 | 104.628 | 258.452 |
| NT2RM4001027 | 1.003 | 0.083 | 0.000 | 0.188 | 1.139 | 0.903 | 0.000 | 13.341 |
| NT2RM4001032 | 15.446 | 8.560 | 20.283 | 7.827 | 10.702 | 9.129 | 9.798 | 10.321 |
| NT2RM4001047 | 18.565 | 7.922 | 16.869 | 2.924 | 7.503 | 4.130 | 9.323 | 18.916 |
| NT2RM4001049 | 87.157 | 64.640 | 99.050 | 20.618 | 35.192 | 44.265 | 24.923 | 27.816 |
| NT2RM4001051 | 45.597 | 65.440 | 63.291 | 17.761 | 11.312 | 31.198 | 20.661 | 24.356 |
| NT2RM4001052 | 83.704 | 54.084 | 58.884 | 12.670 | 16.509 | 36.706 | 54.060 | 39.934 |
| NT2RM4001053 | 55.548 | 69.868 | 192.178 | 27.160 | 24.862 | 42.613 | 24.525 | 28.003 |
| NT2RM4001054 | 29.223 | 12.533 | 27.929 | 5.313 | 10.023 | 15.125 | 15.911 | 14.263 |
| NT2RM4001059 | 181.587 | 40.368 | 91.633 | 17.857 | 33.606 | 105.399 | 88.210 | 64.703 |
| NT2RM4001071 | 29.020 | 21.136 | 81.470 | 8.928 | 13.093 | 5.999 | 16.142 | 11.555 |
| NT2RM4001084 | 42.690 | 28.922 | 39.816 | 12.808 | 14.924 | 24.390 | 23.123 | 13.779 |
| NT2RM4001092 | 102.531 | 57.027 | 86.268 | 31.684 | 25.916 | 49.946 | 45.616 | 58.081 |
| NT2RM4001100 | 43.266 | 33.448 | 49.943 | 8.293 | 19.072 | 24.126 | 16.221 | 46.701 |

TABLE 66

| | | | | | | | | |
|---|---|---|---|---|---|---|---|---|
| NT2RM4001116 | 27.726 | 26.051 | 28.521 | 6.793 | 9.001 | 18.038 | 14.406 | 8.177 |
| NT2RM4001119 | 56.668 | 21.890 | 35.980 | 9.796 | 15.859 | 38.916 | 35.588 | 15.608 |
| NT2RM4001140 | 136.817 | 79.720 | 322.522 | 72.609 | 64.281 | 53.073 | 51.451 | 56.047 |
| NT2RM4001148 | 238.824 | 52.972 | 84.009 | 16.224 | 62.535 | 137.805 | 147.073 | 38.797 |
| NT2RM4001151 | 49.119 | 18.810 | 31.963 | 9.013 | 16.522 | 24.362 | 37.118 | 17.496 |
| NT2RM4001155 | 51.322 | 26.524 | 38.663 | 9.832 | 19.192 | 16.401 | 24.191 | 12.958 |
| NT2RM4001157 | 29.926 | 19.538 | 29.560 | 8.442 | 11.794 | 23.764 | 9.393 | 5.071 |
| NT2RM4001160 | 72.399 | 50.574 | 60.230 | 13.285 | 29.392 | 49.862 | 35.181 | 33.807 |
| NT2RM4001163 | 150.688 | 70.942 | 95.070 | 47.204 | 58.092 | 77.447 | 65.654 | 40.117 |
| NT2RM4001187 | 46.613 | 33.666 | 37.323 | 10.669 | 19.756 | 22.493 | 19.909 | 13.410 |
| NT2RM4001191 | 62.821 | 78.568 | 138.398 | 23.085 | 37.250 | 19.851 | 28.068 | 31.505 |
| NT2RM4001200 | 48.487 | 41.856 | 115.958 | 43.120 | 35.674 | 29.433 | 29.755 | 46.933 |
| NT2RM4001203 | 29.740 | 33.257 | 26.183 | 10.711 | 18.414 | 17.515 | 13.820 | 29.510 |
| NT2RM4001204 | 85.368 | 2.729 | 5.406 | 1.939 | 1.539 | 2.503 | 5.782 | 1.987 |
| NT2RM4001217 | 22.326 | 14.483 | 20.894 | 6.910 | 10.252 | 17.142 | 14.178 | 16.377 |
| NT2RM4001245 | 102.964 | 61.341 | 59.224 | 17.873 | 32.330 | 47.902 | 39.713 | 28.855 |
| NT2RM4001247 | 60.472 | 48.248 | 105.685 | 27.869 | 20.131 | 20.633 | 22.912 | 17.998 |
| NT2RM4001256 | 38.132 | 20.867 | 27.791 | 11.662 | 11.297 | 22.362 | 18.443 | 14.221 |
| NT2RM4001258 | 13.173 | 14.508 | 15.622 | 2.115 | 6.064 | 10.903 | 11.147 | 31.184 |
| NT2RM4001267 | 18.994 | 10.887 | 19.555 | 6.271 | 8.494 | 3.421 | 7.779 | 13.809 |
| NT2RM4001273 | 57.388 | 34.293 | 59.413 | 25.522 | 17.714 | 21.978 | 30.691 | 39.740 |
| NT2RM4001281 | 52.686 | 24.825 | 33.241 | 13.708 | 11.390 | 31.923 | 19.522 | 23.080 |
| NT2RM4001286 | 481.183 | 1240.433 | 782.259 | 477.895 | 296.841 | 681.688 | 413.930 | 936.577 |
| NT2RM4001290 | 25.298 | 23.154 | 13.373 | 6.552 | 0.000 | 12.469 | 8.723 | 14.611 |
| NT2RM4001309 | 48.445 | 24.031 | 36.511 | 15.060 | 18.354 | 33.040 | 18.409 | 21.487 |
| NT2RM4001313 | 61.618 | 55.950 | 171.030 | 27.704 | 18.541 | 31.137 | 15.527 | 37.397 |
| NT2RM4001316 | 49.175 | 40.348 | 93.903 | 19.571 | 16.907 | 28.903 | 20.127 | 14.212 |
| NT2RM4001320 | 73.145 | 43.895 | 149.769 | 28.755 | 24.031 | 24.203 | 22.973 | 27.654 |
| NT2RM4001321 | 49.367 | 26.564 | 28.912 | 10.370 | 15.275 | 21.145 | 21.285 | 20.579 |
| NT2RM4001325 | 38.855 | 43.433 | 53.158 | 15.234 | 25.333 | 31.624 | 26.184 | 15.840 |
| NT2RM4001333 | 48.466 | 17.343 | 99.002 | 20.144 | 115.167 | 148.955 | 12.312 | 8.170 |
| NT2RM4001340 | 30.804 | 28.992 | 40.576 | 27.062 | 32.009 | 10.155 | 18.551 | 26.573 |
| NT2RM4001344 | 30.624 | 35.092 | 33.290 | 12.667 | 12.525 | 9.910 | 11.004 | 11.417 |
| NT2RM4001347 | 14.549 | 14.691 | 20.853 | 11.657 | 13.229 | 14.366 | 8.959 | 54.748 |
| NT2RM4001357 | 58.256 | 26.925 | 40.009 | 14.812 | 13.213 | 104.908 | 348.697 | 7.592 |
| NT2RM4001360 | 86.062 | 33.099 | 53.959 | 12.261 | 27.140 | 48.858 | 36.604 | 20.008 |
| NT2RM4001371 | 57.075 | 37.841 | 49.730 | 24.239 | 25.868 | 54.098 | 8.910 | 31.242 |
| NT2RM4001377 | 101.216 | 75.138 | 68.626 | 19.407 | 36.169 | 52.589 | 30.583 | 31.839 |
| NT2RM4001382 | 56.509 | 78.201 | 56.186 | 36.607 | 24.700 | 70.227 | 41.803 | 66.511 |
| NT2RM4001384 | 13.506 | 11.432 | 7.793 | 6.199 | 7.970 | 12.881 | 6.788 | 7.108 |
| NT2RM4001400 | 21.837 | 16.958 | 21.913 | 10.795 | 7.913 | 16.255 | 9.524 | 12.188 |
| NT2RM4001409 | 28.309 | 17.011 | 26.656 | 9.796 | 12.960 | 23.632 | 14.054 | 20.949 |
| NT2RM4001410 | 29.072 | 19.001 | 30.576 | 8.925 | 14.550 | 18.489 | 21.014 | 17.448 |
| NT2RM4001411 | 8.505 | 7.030 | 30.358 | 2.388 | 3.324 | 0.962 | 1.969 | 1.931 |
| NT2RM4001412 | 59.413 | 25.935 | 59.821 | 15.231 | 22.577 | 30.927 | 24.563 | 11.190 |

TABLE 66-continued

| | | | | | | | | |
|---|---|---|---|---|---|---|---|---|
| NT2RM4001414 | 64.093 | 33.321 | 33.046 | 9.873 | 26.265 | 24.538 | 20.805 | 20.958 |
| NT2RM4001436 | 33.680 | 29.671 | 20.088 | 7.331 | 12.620 | 14.939 | 11.468 | 14.185 |
| NT2RM4001437 | 70.569 | 41.529 | 158.116 | 28.707 | 19.302 | 25.565 | 23.649 | 23.787 |
| NT2RM4001444 | 63.099 | 33.815 | 51.190 | 21.250 | 36.920 | 56.421 | 41.830 | 35.180 |
| NT2RM4001454 | 15.293 | 16.251 | 33.213 | 14.589 | 11.226 | 13.235 | 7.237 | 9.931 |
| NT2RM4001455 | 8.636 | 7.947 | 12.910 | 5.235 | 6.864 | 7.007 | 13.432 | 28.743 |
| NT2RM4001483 | 74.168 | 64.931 | 192.825 | 43.272 | 33.854 | 44.722 | 22.451 | 46.563 |
| NT2RM4001489 | 27.884 | 28.159 | 36.108 | 13.377 | 14.505 | 15.628 | 23.221 | 19.361 |
| NT2RM4001495 | 260.493 | 117.396 | 133.602 | 31.705 | 64.659 | 91.833 | 54.255 | 51.382 |
| NT2RM4001499 | 68.936 | 37.210 | 73.295 | 19.265 | 26.638 | 41.151 | 25.000 | 25.754 |
| NT2RM4001515 | 11.646 | 7.906 | 18.332 | 5.318 | 7.167 | 15.640 | 6.612 | 8.512 |
| NT2RM4001519 | 12.556 | 9.937 | 20.664 | 5.346 | 32.689 | 10.138 | 7.966 | 8.328 |
| NT2RM4001522 | 71.440 | 69.438 | 164.718 | 40.425 | 35.841 | 32.755 | 19.774 | 38.742 |
| NT2RM4001523 | 24.710 | 16.532 | 29.750 | 8.848 | 11.883 | 12.279 | 19.569 | 31.077 |
| NT2RM4001550 | 24.908 | 22.060 | 34.537 | 19.909 | 20.432 | 20.143 | 15.284 | 28.090 |
| NT2RM4001553 | 73.682 | 40.371 | 52.795 | 27.094 | 23.686 | 46.848 | 27.034 | 27.166 |
| NT2RM4001554 | 53.585 | 30.046 | 33.134 | 23.878 | 15.283 | 26.877 | 16.771 | 20.649 |
| NT2RM4001557 | 19.423 | 19.434 | 24.184 | 11.971 | 12.237 | 21.486 | 7.653 | 15.404 |
| NT2RM4001565 | 65.552 | 37.852 | 90.440 | 18.538 | 17.294 | 23.128 | 23.413 | 18.529 |

TABLE 67

| | | | | | | | | |
|---|---|---|---|---|---|---|---|---|
| NT2RM4001566 | 100.46 | 48.659 | 87.457 | 28.565 | 28.860 | 79.976 | 52.286 | 9.785 |
| NT2RM4001569 | 7.010 | 5.598 | 41.076 | 3.288 | 8.597 | 0.901 | 6.611 | 1.304 |
| NT2RM4001579 | 41.258 | 24.859 | 37.584 | 7.247 | 15.119 | 35.411 | 21.050 | 31.905 |
| NT2RM4001582 | 36.827 | 23.162 | 29.372 | 10.109 | 10.956 | 22.015 | 19.971 | 25.442 |
| NT2RM4001589 | 57.574 | 32.795 | 61.841 | 23.877 | 20.226 | 47.320 | 41.167 | 35.619 |
| NT2RM4001592 | 32.950 | 21.429 | 32.007 | 7.221 | 14.392 | 17.425 | 7.965 | 10.850 |
| NT2RM4001594 | 55.970 | 26.805 | 46.827 | 13.556 | 21.275 | 46.488 | 34.751 | 25.706 |
| NT2RM4001597 | 113.189 | 66.565 | 189.284 | 36.307 | 35.658 | 51.457 | 41.254 | 42.293 |
| NT2RM4001605 | 16.347 | 11.965 | 18.084 | 2.805 | 4.141 | 11.032 | 9.672 | 10.297 |
| NT2RM4001609 | 173.865 | 587.184 | 265.155 | 76.761 | 120.584 | 182.319 | 73.643 | 191.832 |
| NT2RM4001610 | 89.090 | 32.924 | 55.024 | 13.942 | 38.114 | 56.107 | 36.218 | 28.535 |
| NT2RM4001611 | 30.709 | 14.204 | 28.060 | 6.394 | 11.242 | 12.351 | 22.333 | 13.486 |
| NT2RM4001618 | 77.313 | 59.231 | 178.569 | 26.795 | 28.633 | 44.101 | 23.934 | 50.341 |
| NT2RM4001622 | 42.484 | 50.813 | 37.378 | 16.153 | 35.073 | 39.451 | 29.062 | 30.213 |
| NT2RM4001624 | 55.088 | 36.243 | 39.342 | 10.093 | 11.389 | 25.162 | 26.300 | 19.356 |
| NT2RM4001625 | 165.457 | 44.283 | 55.076 | 16.243 | 29.704 | 87.349 | 62.707 | 32.707 |
| NT2RM4001629 | 23.424 | 34.729 | 31.319 | 10.721 | 9.407 | 17.262 | 17.006 | 17.599 |
| NT2RM4001632 | 49.318 | 105.740 | 108.162 | 80.539 | 33.853 | 62.834 | 39.339 | 102.299 |
| NT2RM4001642 | 26.758 | 24.864 | 25.229 | 7.187 | 11.536 | 12.746 | 15.743 | 16.315 |
| NT2RM4001647 | 140.643 | 83.479 | 257.397 | 53.466 | 49.798 | 64.749 | 33.054 | 65.546 |
| NT2RM4001650 | 20.039 | 17.016 | 26.536 | 7.633 | 8.417 | 10.633 | 14.969 | 25.969 |
| NT2RM4001662 | 93.433 | 61.261 | 62.868 | 18.713 | 28.801 | 43.545 | 39.576 | 18.233 |
| NT2RM4001666 | 99.250 | 58.594 | 135.514 | 19.947 | 25.792 | 43.075 | 21.822 | 28.747 |
| NT2RM4001670 | 108.596 | 50.059 | 60.195 | 8.757 | 26.897 | 80.647 | 55.639 | 44.557 |
| NT2RM4001682 | 23.010 | 37.857 | 52.107 | 34.229 | 26.474 | 24.078 | 19.040 | 48.902 |
| NT2RM4001710 | 71.974 | 22.009 | 43.652 | 12.553 | 17.193 | 33.805 | 36.338 | 25.346 |
| NT2RM4001712 | 30.145 | 17.963 | 29.768 | 6.775 | 12.959 | 13.705 | 17.401 | 11.444 |
| NT2RM4001714 | 39.284 | 71.253 | 45.168 | 23.590 | 23.852 | 34.014 | 32.992 | 44.464 |
| NT2RM4001715 | 39.876 | 47.568 | 68.485 | 29.814 | 28.676 | 29.317 | 23.694 | 38.125 |
| NT2RM4001727 | 18.826 | 16.671 | 24.630 | 8.765 | 12.634 | 14.525 | 9.624 | 7.446 |
| NT2RM4001731 | 163.786 | 60.747 | 103.744 | 21.266 | 23.073 | 109.348 | 70.159 | 88.870 |
| NT2RM4001735 | 25.147 | 42.977 | 27.836 | 33.257 | 23.484 | 16.531 | 22.623 | 48.984 |
| NT2RM4001739 | 29.621 | 22.031 | 33.503 | 11.627 | 16.721 | 10.593 | 7.382 | 14.863 |
| NT2RM4001741 | 117.616 | 80.979 | 99.834 | 34.861 | 34.797 | 49.703 | 68.739 | 91.553 |
| NT2RM4001746 | 61.847 | 44.910 | 113.561 | 21.148 | 31.787 | 37.464 | 33.824 | 23.274 |
| NT2RM4001754 | 72.161 | 34.709 | 70.656 | 13.473 | 25.420 | 34.023 | 22.194 | 15.154 |
| NT2RM4001757 | 38.117 | 23.659 | 28.972 | 12.593 | 10.724 | 21.161 | 24.761 | 19.803 |
| NT2RM4001758 | 24.391 | 23.518 | 27.924 | 5.579 | 12.781 | 14.153 | 7.027 | 6.943 |
| NT2RM4001768 | 51.099 | 53.221 | 60.158 | 17.044 | 37.261 | 58.428 | 34.390 | 27.280 |
| NT2RM4001775 | 15.024 | 11.154 | 13.303 | 2.644 | 9.532 | 9.892 | 6.237 | 4.050 |
| NT2RM4001776 | 24.497 | 20.843 | 16.325 | 5.116 | 12.075 | 8.815 | 13.233 | 6.515 |
| NT2RM4001783 | 44.218 | 34.754 | 35.521 | 11.654 | 27.683 | 28.899 | 24.397 | 19.284 |
| NT2RM4001793 | 75.698 | 74.949 | 146.739 | 24.426 | 38.218 | 21.996 | 28.324 | 24.241 |
| NT2RM4001810 | 25.287 | 22.294 | 22.627 | 8.986 | 12.014 | 13.754 | 22.602 | 19.691 |
| NT2RM4001813 | 108.290 | 15.721 | 11.311 | 3.071 | 4.660 | 7.061 | 9.406 | 9.278 |
| NT2RM4001818 | 55.110 | 32.332 | 35.827 | 10.603 | 18.181 | 30.893 | 25.538 | 20.147 |
| NT2RM4001819 | 221.187 | 103.477 | 118.661 | 33.955 | 61.689 | 117.958 | 105.557 | 45.891 |
| NT2RM4001823 | 31.566 | 19.207 | 30.580 | 9.100 | 12.589 | 18.948 | 23.046 | 12.498 |
| NT2RM4001828 | 33.606 | 37.243 | 60.904 | 39.892 | 17.528 | 52.576 | 22.264 | 20.662 |
| NT2RM4001835 | 31.946 | 48.485 | 36.681 | 12.402 | 10.874 | 32.404 | 26.073 | 33.367 |
| NT2RM4001836 | 68.101 | 53.948 | 86.019 | 25.292 | 41.216 | 44.492 | 46.063 | 49.677 |
| NT2RM4001841 | 77.551 | 75.005 | 64.963 | 39.736 | 29.180 | 60.179 | 38.346 | 53.737 |
| NT2RM4001842 | 41.837 | 31.217 | 153.538 | 19.696 | 13.432 | 18.888 | 13.674 | 12.515 |
| NT2RM4001843 | 47.451 | 47.021 | 41.491 | 12.355 | 14.857 | 30.666 | 19.358 | 23.477 |

TABLE 67-continued

| | | | | | | | | |
|---|---|---|---|---|---|---|---|---|
| NT2RM4001856 | 35.284 | 17.427 | 22.905 | 18.860 | 0.000 | 35.066 | 18.473 | 17.632 |
| NT2RM4001858 | 34.556 | 13.809 | 35.731 | 11.606 | 5.891 | 13.370 | 14.536 | 27.815 |
| NT2RM4001861 | 102.500 | 55.955 | 86.639 | 33.805 | 25.003 | 43.868 | 45.531 | 30.143 |
| NT2RM4001863 | 41.449 | 33.911 | 68.502 | 24.321 | 16.482 | 31.445 | 31.424 | 32.578 |
| NT2RM4001865 | 40.706 | 38.767 | 51.589 | 19.138 | 24.325 | 53.955 | 38.078 | 30.584 |
| NT2RM4001869 | 87.261 | 35.753 | 43.743 | 13.720 | 22.315 | 49.946 | 39.651 | 110.541 |
| NT2RM4001873 | 31.012 | 19.677 | 42.836 | 19.140 | 23.082 | 17.690 | 23.735 | 26.533 |
| NT2RM4001876 | 263.450 | 78.666 | 162.933 | 35.889 | 80.574 | 217.874 | 135.056 | 71.907 |
| NT2RM4001880 | 52.575 | 35.308 | 47.881 | 20.693 | 7.377 | 39.267 | 19.933 | 16.114 |
| NT2RM4001885 | 62.625 | 53.956 | 164.215 | 33.733 | 28.885 | 40.932 | 20.399 | 40.632 |

TABLE 68

| | | | | | | | | |
|---|---|---|---|---|---|---|---|---|
| NT2RM4001889 | 44.826 | 54.188 | 57.058 | 17.324 | 30.679 | 30.191 | 31.401 | 27.309 |
| NT2RM4001894 | 33.180 | 21.032 | 38.644 | 10.368 | 15.617 | 23.290 | 26.653 | 24.028 |
| NT2RM4001897 | 55.973 | 37.135 | 42.706 | 11.443 | 18.977 | 24.084 | 62.995 | 21.376 |
| NT2RM4001899 | 79.426 | 37.833 | 50.793 | 22.892 | 10.010 | 19.933 | 39.828 | 71.231 |
| NT2RM4001905 | 71.913 | 42.987 | 131.041 | 19.900 | 22.521 | 28.037 | 22.888 | 34.298 |
| NT2RM4001922 | 68.361 | 66.765 | 167.103 | 32.535 | 29.282 | 32.842 | 21.101 | 29.820 |
| NT2RM4001930 | 9.761 | 18.972 | 11.870 | 12.179 | 5.722 | 7.704 | 2.893 | 19.882 |
| NT2RM4001938 | 13.300 | 9.323 | 20.059 | 5.226 | 22.340 | 8.605 | 6.836 | 2.737 |
| NT2RM4001940 | 44.499 | 28.342 | 53.112 | 22.045 | 19.769 | 35.835 | 24.329 | 24.211 |
| NT2RM4001942 | 71.378 | 109.603 | 137.250 | 99.315 | 68.782 | 123.550 | 44.362 | 143.236 |
| NT2RM4001953 | 73.750 | 67.064 | 218.754 | 37.265 | 39.359 | 37.249 | 28.374 | 31.774 |
| NT2RM4001965 | 27.774 | 33.648 | 57.473 | 21.916 | 18.921 | 11.704 | 7.776 | 32.933 |
| NT2RM4001966 | 49.431 | 24.684 | 41.501 | 12.421 | 18.343 | 29.179 | 21.379 | 18.604 |
| NT2RM4001969 | 28.734 | 22.964 | 33.007 | 12.456 | 14.747 | 23.958 | 15.690 | 13.553 |
| NT2RM4001974 | 82.202 | 23.827 | 35.591 | 10.813 | 20.091 | 38.983 | 35.402 | 27.290 |
| NT2RM4001979 | 50.759 | 32.744 | 64.327 | 26.669 | 29.268 | 32.957 | 29.294 | 45.426 |
| NT2RM4001980 | 64.506 | 28.217 | 65.730 | 29.832 | 30.129 | 51.434 | 39.037 | 38.269 |
| NT2RM4001984 | 8.940 | 10.121 | 18.976 | 9.204 | 7.020 | 7.587 | 10.490 | 17.931 |
| NT2RM4001987 | 76.782 | 27.219 | 64.310 | 10.713 | 13.598 | 56.046 | 41.155 | 21.341 |
| NT2RM4002013 | 19.064 | 9.935 | 20.167 | 9.513 | 9.423 | 13.449 | 15.551 | 64.982 |
| NT2RM4002018 | 23.330 | 15.361 | 28.649 | 4.482 | 9.866 | 15.203 | 14.895 | 11.409 |
| NT2RM4002033 | 103.629 | 76.058 | 255.894 | 33.739 | 36.068 | 40.994 | 22.684 | 32.604 |
| NT2RM4002034 | 97.025 | 74.014 | 204.281 | 25.591 | 40.356 | 66.335 | 30.838 | 29.885 |
| NT2RM4002044 | 128.284 | 97.260 | 283.326 | 56.682 | 49.448 | 68.685 | 42.993 | 56.693 |
| NT2RM4002047 | 42.016 | 31.010 | 47.604 | 17.496 | 19.793 | 15.043 | 24.593 | 16.651 |
| NT2RM4002054 | 75.334 | 24.437 | 33.919 | 5.362 | 20.426 | 36.508 | 26.858 | 12.455 |
| NT2RM4002055 | 28.223 | 41.574 | 41.231 | 17.667 | 21.073 | 24.192 | 30.052 | 56.881 |
| NT2RM4002059 | 24.790 | 47.792 | 30.688 | 32.255 | 11.889 | 26.659 | 17.375 | 42.684 |
| NT2RM4002061 | 15.353 | 22.159 | 24.342 | 33.358 | 8.569 | 13.680 | 9.654 | 12.890 |
| NT2RM4002062 | 35.603 | 17.782 | 25.712 | 9.437 | 13.693 | 23.679 | 11.468 | 12.877 |
| NT2RM4002063 | 106.902 | 59.539 | 161.049 | 27.157 | 37.323 | 44.770 | 45.190 | 17.589 |
| NT2RM4002066 | 69.187 | 29.278 | 44.089 | 14.142 | 12.777 | 47.854 | 23.625 | 20.028 |
| NT2RM4002067 | 72.915 | 65.950 | 164.446 | 33.322 | 23.243 | 29.901 | 19.168 | 38.472 |
| NT2RM4002073 | 26.509 | 19.553 | 24.129 | 7.501 | 12.225 | 19.453 | 13.427 | 15.358 |
| NT2RM4002074 | 23.768 | 16.727 | 27.356 | 9.430 | 10.288 | 9.267 | 19.036 | 9.923 |
| NT2RM4002075 | 14.729 | 8.566 | 14.082 | 6.113 | 8.179 | 19.921 | 8.913 | 5.764 |
| NT2RM4002076 | 33.772 | 34.570 | 24.768 | 12.754 | 12.370 | 22.729 | 21.957 | 5.088 |
| NT2RM4002078 | 65.837 | 45.074 | 59.931 | 29.244 | 28.319 | 38.890 | 38.136 | 27.441 |
| NT2RM4002081 | 72.328 | 49.374 | 162.917 | 29.519 | 33.925 | 46.864 | 32.277 | 29.982 |
| NT2RM4002082 | 31.523 | 20.963 | 24.293 | 4.626 | 7.828 | 18.917 | 11.827 | 4.512 |
| NT2RM4002093 | 13.703 | 12.906 | 28.190 | 14.073 | 16.132 | 8.993 | 10.746 | 15.942 |
| NT2RM4002109 | 48.477 | 33.601 | 44.587 | 16.373 | 19.020 | 45.752 | 31.367 | 24.718 |
| NT2RM4002115 | 52.087 | 16.294 | 25.726 | 5.046 | 11.691 | 15.294 | 19.312 | 5.666 |
| NT2RM4002118 | 6.461 | 10.205 | 16.364 | 2.841 | 6.221 | 5.928 | 9.423 | 8.612 |
| NT2RM4002128 | 24.014 | 12.586 | 38.670 | 8.609 | 8.704 | 17.808 | 16.887 | 18.787 |
| NT2RM4002137 | 60.650 | 30.735 | 54.930 | 9.746 | 20.827 | 30.629 | 27.756 | 30.682 |
| NT2RM4002139 | 59.820 | 72.323 | 217.660 | 35.299 | 32.433 | 22.926 | 18.198 | 31.925 |
| NT2RM4002140 | 31.939 | 27.988 | 54.095 | 19.817 | 18.951 | 36.147 | 28.930 | 19.620 |
| NT2RM4002145 | 55.935 | 18.752 | 37.184 | 6.758 | 24.220 | 24.455 | 54.028 | 17.830 |
| NT2RM4002146 | 10.714 | 7.232 | 14.881 | 2.330 | 4.463 | 6.475 | 3.969 | 22.927 |
| NT2RM4002161 | 21.929 | 10.374 | 17.604 | 4.124 | 7.983 | 12.456 | 8.266 | 7.504 |
| NT2RM4002174 | 36.217 | 21.020 | 78.760 | 11.488 | 14.155 | 12.056 | 10.913 | 19.766 |
| NT2RM4002178 | 51.201 | 34.975 | 146.685 | 25.841 | 26.852 | 32.083 | 18.490 | 38.988 |
| NT2RM4002180 | 88.245 | 86.565 | 200.162 | 36.530 | 47.240 | 50.257 | 25.291 | 41.037 |
| NT2RM4002185 | 60.374 | 34.725 | 47.531 | 10.870 | 17.954 | 36.151 | 35.104 | 14.336 |
| NT2RM4002189 | 443.685 | 125.746 | 233.812 | 62.020 | 80.189 | 317.532 | 213.671 | 55.692 |
| NT2RM4002194 | 110.410 | 60.176 | 66.781 | 14.262 | 24.395 | 63.199 | 46.341 | 16.491 |
| NT2RM4002198 | 19.112 | 25.320 | 30.650 | 6.006 | 16.046 | 10.695 | 12.653 | 18.533 |
| NT2RM4002205 | 86.368 | 52.183 | 210.523 | 37.437 | 37.350 | 41.233 | 35.023 | 46.891 |
| NT2RM4002213 | 87.023 | 29.632 | 69.582 | 22.287 | 36.169 | 49.771 | 58.648 | 47.205 |
| NT2RM4002216 | 28.034 | 36.860 | 39.984 | 61.988 | 14.040 | 23.466 | 28.018 | 31.505 |
| NT2RM4002226 | 59.214 | 25.842 | 44.190 | 19.726 | 22.840 | 30.160 | 21.306 | 34.363 |
| NT2RM4002237 | 84.115 | 47.301 | 42.516 | 13.185 | 17.445 | 121.874 | 282.813 | 42.699 |
| NT2RM4002240 | 21.140 | 20.818 | 18.200 | 11.226 | 4.270 | 17.260 | 9.804 | 24.400 |

TABLE 69

| | | | | | | | | |
|---|---|---|---|---|---|---|---|---|
| NT2RM4002251 | 39.895 | 25.621 | 38.004 | 9.808 | 12.483 | 27.050 | 27.880 | 15.570 |
| NT2RM4002256 | 62.880 | 50.437 | 132.459 | 16.059 | 20.051 | 22.911 | 18.973 | 36.148 |
| NT2RM4002262 | 40.381 | 19.221 | 18.726 | 4.067 | 10.643 | 11.552 | 18.506 | 11.180 |
| NT2RM4002266 | 33.927 | 16.247 | 29.395 | 7.271 | 10.706 | 15.907 | 16.746 | 45.558 |
| NT2RM4002276 | 31.555 | 29.432 | 34.470 | 12.227 | 15.207 | 18.832 | 24.174 | 41.738 |
| NT2RM4002278 | 24.493 | 44.932 | 54.554 | 19.947 | 24.631 | 19.085 | 14.211 | 28.361 |
| NT2RM4002281 | 73.045 | 68.535 | 120.767 | 28.971 | 77.810 | 35.833 | 33.197 | 34.350 |
| NT2RM4002287 | 95.529 | 67.191 | 148.977 | 16.383 | 32.882 | 42.647 | 36.149 | 22.550 |
| NT2RM4002294 | 37.325 | 40.622 | 32.626 | 7.879 | 22.188 | 17.681 | 21.208 | 18.691 |
| NT2RM4002298 | 15.253 | 25.056 | 14.186 | 6.186 | 12.213 | 8.996 | 13.334 | 20.467 |
| NT2RM4002301 | 25.506 | 22.524 | 24.351 | 8.779 | 13.463 | 11.537 | 16.605 | 21.093 |
| NT2RM4002306 | 64.514 | 27.130 | 40.307 | 8.697 | 16.098 | 30.071 | 33.558 | 17.520 |
| NT2RM4002323 | 46.276 | 37.334 | 108.848 | 13.787 | 18.840 | 15.998 | 23.739 | 23.002 |
| NT2RM4002334 | 84.665 | 44.953 | 240.849 | 13.009 | 61.866 | 67.867 | 63.381 | 16.555 |
| NT2RM4002339 | 40.226 | 15.664 | 17.738 | 4.286 | 11.781 | 13.743 | 14.276 | 7.602 |
| NT2RM4002344 | 15.209 | 14.735 | 15.127 | 5.186 | 14.835 | 5.571 | 6.021 | 15.852 |
| NT2RM4002345 | 29.537 | 16.084 | 44.040 | 7.161 | 49.725 | 20.214 | 15.169 | 93.476 |
| NT2RM4002352 | 25.146 | 26.320 | 39.068 | 10.070 | 10.828 | 17.765 | 20.622 | 16.556 |
| NT2RM4002362 | 22.727 | 18.967 | 35.121 | 7.780 | 16.102 | 13.358 | 9.862 | 21.089 |
| NT2RM4002373 | 49.413 | 25.049 | 39.501 | 16.293 | 10.820 | 16.723 | 21.117 | 10.960 |
| NT2RM4002374 | 45.312 | 17.702 | 80.866 | 14.495 | 13.876 | 25.509 | 12.233 | 16.564 |
| NT2RM4002376 | 44.035 | 32.785 | 33.965 | 15.793 | 15.635 | 33.518 | 17.499 | 20.037 |
| NT2RM4002383 | 143.921 | 114.177 | 338.801 | 56.564 | 36.130 | 62.968 | 25.071 | 60.431 |
| NT2RM4002390 | 19.946 | 15.647 | 23.593 | 13.554 | 0.000 | 15.764 | 10.120 | 21.189 |
| NT2RM4002398 | 33.574 | 85.078 | 55.577 | 19.871 | 29.143 | 36.917 | 34.014 | 15.071 |
| NT2RM4002409 | 62.430 | 25.690 | 44.155 | 15.629 | 15.274 | 43.916 | 36.612 | 24.609 |
| NT2RM4002414 | 122.797 | 27.569 | 49.085 | 13.732 | 29.300 | 20.609 | 24.789 | 22.958 |
| NT2RM4002438 | 60.880 | 24.210 | 57.361 | 13.303 | 21.819 | 19.128 | 27.861 | 33.288 |
| NT2RM4002440 | 50.958 | 29.949 | 58.790 | 16.516 | 17.087 | 22.853 | 27.261 | 86.320 |
| NT2RM4002446 | 85.102 | 43.893 | 64.557 | 15.166 | 30.454 | 59.828 | 43.072 | 34.360 |
| NT2RM4002450 | 29.806 | 50.782 | 20.662 | 10.226 | 5.031 | 56.095 | 6.391 | 48.088 |
| NT2RM4002452 | 38.119 | 24.046 | 27.781 | 13.792 | 11.741 | 21.974 | 28.908 | 14.192 |
| NT2RM4002457 | 56.998 | 45.958 | 72.065 | 21.106 | 21.980 | 25.587 | 22.709 | 26.372 |
| NT2RM4002458 | 17.499 | 9.159 | 12.416 | 3.859 | 12.704 | 4.423 | 1.634 | 7.476 |
| NT2RM4002460 | 37.183 | 7.502 | 15.263 | 2.616 | 9.265 | 20.827 | 12.805 | 1.464 |
| NT2RM4002464 | 12.680 | 10.529 | 5.512 | 5.737 | 10.707 | 1.669 | 5.391 | 12.187 |
| NT2RM4002479 | 85.068 | 45.694 | 66.175 | 35.340 | 44.661 | 52.236 | 42.316 | 33.845 |
| NT2RM4002482 | 714.577 | 349.138 | 482.476 | 135.984 | 180.855 | 462.386 | 321.086 | 260.860 |
| NT2RM4002489 | 41.987 | 36.475 | 28.303 | 18.347 | 20.193 | 45.527 | 22.970 | 15.427 |
| NT2RM4002493 | 101.547 | 19.009 | 34.214 | 7.129 | 20.617 | 58.926 | 20.613 | 6.136 |
| NT2RM4002499 | 104.508 | 114.364 | 295.841 | 132.961 | 45.496 | 125.546 | 54.809 | 138.353 |
| NT2RM4002504 | 130.575 | 85.186 | 319.621 | 58.095 | 51.615 | 65.385 | 43.397 | 39.625 |
| NT2RM4002506 | 17.534 | 7.716 | 22.097 | 8.307 | 8.641 | 11.973 | 11.217 | 19.715 |
| NT2RM4002510 | 20.570 | 20.274 | 28.261 | 7.195 | 10.108 | 9.354 | 16.982 | 8.405 |
| NT2RM4002527 | 29.097 | 14.199 | 26.008 | 7.215 | 11.820 | 15.320 | 15.507 | 11.537 |
| NT2RM4002532 | 119.266 | 103.485 | 252.069 | 38.479 | 49.581 | 51.534 | 30.506 | 48.759 |
| NT2RM4002534 | 46.720 | 29.222 | 28.381 | 12.470 | 17.005 | 30.785 | 27.381 | 25.218 |
| NT2RM4002535 | 150.736 | 124.425 | 370.470 | 71.472 | 69.884 | 70.122 | 44.328 | 39.348 |
| NT2RM4002554 | 46.680 | 4.678 | 15.042 | 2.434 | 7.853 | 8.287 | 11.868 | 8.546 |
| NT2RM4002558 | 64.523 | 30.756 | 60.861 | 17.849 | 28.435 | 32.697 | 50.330 | 26.839 |
| NT2RM4002565 | 26.150 | 21.759 | 29.418 | 10.020 | 13.855 | 14.504 | 15.952 | 20.143 |
| NT2RM4002567 | 13.750 | 9.555 | 16.128 | 7.961 | 6.533 | 14.816 | 11.242 | 24.778 |
| NT2RM4002571 | 64.981 | 32.370 | 51.874 | 13.381 | 25.113 | 37.880 | 40.593 | 30.327 |
| NT2RM4002572 | 21.932 | 17.415 | 44.482 | 6.169 | 9.094 | 15.081 | 8.955 | 11.463 |
| NT2RM4002577 | 13.390 | 34.537 | 17.827 | 8.379 | 17.150 | 9.208 | 20.440 | 135.375 |
| NT2RM4002583 | 43.872 | 21.818 | 41.335 | 7.938 | 12.820 | 25.087 | 16.879 | 8.165 |
| NT2RM4002584 | 48.978 | 41.874 | 47.589 | 19.263 | 15.387 | 18.002 | 26.572 | 29.591 |
| NT2RM4002593 | 43.140 | 21.408 | 34.068 | 14.481 | 17.864 | 27.459 | 22.581 | 18.025 |
| NT2RM4002594 | 3.494 | 32.355 | 54.474 | 10.039 | 23.934 | 38.188 | 30.209 | 28.918 |
| NT2RM4002604 | 49.799 | 31.218 | 31.584 | 14.197 | 10.658 | 52.255 | 31.422 | 27.262 |
| NT2RM4002614 | 18.848 | 9.948 | 15.663 | 7.767 | 10.103 | 19.152 | 15.480 | 10.800 |
| NT2RM4002616 | 52.378 | 28.130 | 31.691 | 6.189 | 16.589 | 25.551 | 20.412 | 22.945 |
| NT2RM4002623 | 31.915 | 15.505 | 22.179 | 7.046 | 11.143 | 28.155 | 15.957 | 8.295 |
| NT2RM4002634 | 27.202 | 13.607 | 23.468 | 4.566 | 6.856 | 27.565 | 17.040 | 9.308 |

TABLE 70

| | | | | | | | | |
|---|---|---|---|---|---|---|---|---|
| NT2RM4002636 | 2.342 | 5.234 | 9.517 | 3.874 | 1.465 | 2.585 | 2.436 | 4.543 |
| NT2RP1000002 | 114.491 | 47.508 | 61.586 | 25.000 | 29.448 | 84.026 | 73.878 | 59.624 |
| NT2RP1000006 | 71.057 | 28.511 | 44.224 | 10.202 | 17.523 | 40.868 | 37.373 | 15.237 |
| NT2RP1000015 | 7.192 | 9.953 | 16.089 | 4.506 | 3.649 | 7.738 | 3.651 | 8.661 |
| NT2RP1000018 | 5.882 | 0.000 | 0.000 | 0.000 | 0.000 | 2.690 | 4.737 | 0.000 |
| NT2RP1000034 | 273.802 | 61.801 | 59.676 | 50.413 | 101.761 | 283.598 | 21.883 | 51.696 |
| NT2RP1000035 | 14.407 | 14.328 | 5.278 | 5.331 | 3.905 | 19.347 | 5.560 | 9.946 |
| NT2RP1000040 | 2.229 | 2.143 | 2.569 | 1.482 | 0.842 | 0.251 | 1.226 | 0.963 |
| NT2RP1000042 | 2.962 | 1.516 | 2.106 | 0.450 | 3.003 | 1.458 | 1.788 | 0.000 |

TABLE 70-continued

| | | | | | | | | |
|---|---|---|---|---|---|---|---|---|
| NT2RP1000048 | 3.312 | 5.643 | 4.404 | 1.520 | 1.452 | 2.742 | 0.779 | 17.389 |
| NT2RP1000050 | 37.260 | 7.381 | 21.735 | 7.969 | 7.544 | 14.598 | 18.930 | 19.749 |
| NT2RP1000056 | 2.575 | 8.244 | 12.209 | 2.506 | 2.248 | 50.055 | 1.919 | 18.856 |
| NT2RP1000058 | 7.701 | 2.152 | 6.853 | 1.889 | 5.740 | 5.703 | 5.884 | 4.654 |
| NT2RP1000063 | 17.863 | 6.661 | 8.488 | 2.745 | 0.000 | 7.494 | 5.484 | 2.401 |
| NT2RP1000068 | 4.612 | 5.197 | 4.140 | 0.833 | 1.697 | 1.068 | 0.863 | 1.468 |
| NT2RP1000072 | 143.838 | 99.413 | 72.321 | 37.376 | 27.104 | 99.463 | 69.787 | 134.954 |
| NT2RP1000073 | 1.552 | 1.742 | 0.000 | 0.919 | 0.996 | 0.623 | 4.055 | 9.765 |
| NT2RP1000078 | 2.896 | 0.000 | 0.000 | 0.230 | 0.741 | 0.763 | 0.567 | 3.421 |
| NT2RP1000079 | 49.027 | 29.657 | 15.514 | 6.677 | 6.650 | 9.256 | 18.182 | 28.375 |
| NT2RP1000080 | 16.385 | 16.693 | 8.875 | 4.934 | 5.832 | 9.673 | 15.737 | 12.194 |
| NT2RP1000086 | 7.169 | 3.761 | 10.248 | 2.946 | 7.423 | 5.286 | 3.826 | 0.000 |
| NT2RP1000087 | 0.000 | 5.038 | 0.000 | 1.221 | 3.506 | 2.887 | 0.000 | 2.053 |
| NT2RP1000089 | 4.302 | 9.012 | 8.097 | 5.674 | 2.992 | 4.624 | 0.418 | 13.867 |
| NT2RP1000090 | 52.428 | 58.867 | 69.998 | 38.821 | 17.374 | 29.637 | 36.043 | 79.235 |
| NT2RP1000100 | 3.207 | 3.774 | 1.540 | 2.138 | 1.112 | 1.149 | 0.000 | 1.791 |
| NT2RP1000101 | 92.707 | 46.496 | 68.186 | 33.782 | 33.861 | 36.104 | 55.994 | 56.718 |
| NT2RP1000111 | 4.451 | 9.940 | 6.651 | 2.623 | 8.151 | 2.766 | 11.052 | 2.965 |
| NT2RP1000112 | 3.985 | 3.478 | 0.000 | 2.480 | 0.000 | 1.727 | 2.041 | 2.374 |
| NT2RP1000124 | 24.505 | 9.928 | 6.917 | 5.644 | 2.553 | 12.703 | 2.802 | 42.644 |
| NT2RP1000125 | 24.817 | 79.995 | 139.555 | 48.819 | 97.770 | 62.060 | 44.484 | 52.427 |
| NT2RP1000129 | 28.170 | 30.324 | 26.037 | 10.799 | 3.638 | 16.350 | 16.315 | 13.950 |
| NT2RP1000130 | 5.381 | 7.279 | 14.556 | 2.578 | 10.778 | 12.987 | 0.000 | 20.710 |
| NT2RP1000154 | 17.054 | 18.625 | 18.032 | 7.765 | 17.883 | 13.855 | 12.502 | 19.133 |
| NT2RP1000163 | 18.531 | 7.739 | 9.822 | 4.145 | 3.589 | 2.512 | 6.952 | 17.030 |
| NT2RP1000170 | 14.775 | 6.603 | 3.911 | 1.557 | 5.549 | 3.844 | 7.224 | 15.609 |
| NT2RP1000174 | 10.066 | 4.006 | 4.875 | 1.601 | 3.951 | 1.497 | 5.060 | 0.857 |
| NT2RP1000181 | 108.209 | 58.429 | 137.843 | 40.129 | 31.719 | 74.897 | 73.935 | 56.201 |
| NT2RP1000191 | 9.285 | 6.645 | 5.460 | 3.099 | 6.842 | 12.624 | 5.864 | 2.766 |
| NT2RP1000202 | 4.547 | 3.462 | 7.203 | 6.298 | 6.151 | 3.022 | 2.481 | 4.122 |
| NT2RP1000239 | 0.000 | 0.000 | 4.313 | 1.852 | 1.396 | 1.558 | 2.101 | 1.136 |
| NT2RP1000243 | 10.228 | 5.330 | 3.864 | 1.538 | 6.834 | 4.100 | 5.184 | 5.579 |
| NT2RP1000255 | 6.844 | 3.187 | 2.512 | 1.848 | 1.326 | 2.012 | 5.711 | 5.678 |
| NT2RP1000259 | 10.073 | 6.510 | 10.276 | 1.573 | 3.601 | 8.515 | 4.509 | 4.367 |
| NT2RP1000261 | 0.000 | 0.000 | 0.000 | 0.000 | 1.606 | 0.000 | 1.763 | 0.000 |
| NT2RP1000269 | 233.453 | 119.331 | 130.392 | 48.933 | 78.334 | 111.105 | 129.953 | 95.341 |
| NT2RP1000271 | 504.212 | 314.887 | 684.003 | 191.587 | 126.841 | 351.080 | 221.963 | 268.189 |
| NT2RP1000272 | 130.317 | 52.877 | 78.345 | 38.313 | 30.575 | 71.136 | 50.465 | 37.296 |
| NT2RP1000279 | 103.540 | 36.699 | 55.522 | 23.329 | 29.320 | 68.415 | 50.629 | 9.388 |
| NT2RP1000290 | 383.695 | 214.173 | 295.250 | 136.106 | 105.408 | 257.258 | 215.344 | 195.667 |
| NT2RP1000293 | 139.263 | 71.666 | 91.679 | 43.735 | 54.577 | 85.003 | 75.569 | 61.144 |
| NT2RP1000300 | 219.317 | 94.497 | 120.961 | 62.228 | 73.747 | 166.238 | 105.443 | 25.701 |
| NT2RP1000324 | 205.212 | 96.463 | 109.241 | 73.482 | 49.779 | 120.952 | 75.697 | 54.085 |
| NT2RP1000325 | 567.975 | 208.141 | 235.225 | 74.690 | 106.786 | 296.190 | 175.163 | 181.979 |
| NT2RP1000326 | 114.548 | 37.978 | 60.587 | 21.766 | 22.713 | 70.707 | 48.865 | 22.186 |
| NT2RP1000331 | 14.215 | 11.082 | 12.198 | 9.945 | 5.554 | 9.595 | 5.409 | 16.164 |
| NT2RP1000333 | 175.329 | 62.474 | 124.398 | 35.732 | 30.723 | 116.009 | 80.360 | 48.737 |
| NT2RP1000336 | 5.071 | 3.476 | 0.000 | 2.085 | 1.485 | 4.216 | 5.855 | 5.234 |
| NT2RP1000347 | 8.732 | 4.239 | 0.000 | 3.444 | 2.753 | 3.942 | 4.829 | 4.180 |
| NT2RP1000348 | 9.118 | 3.224 | 2.495 | 2.895 | 3.816 | 3.756 | 4.511 | 1.450 |
| NT2RP1000349 | 6.925 | 4.441 | 0.000 | 1.180 | 2.776 | 3.407 | 3.025 | 2.512 |
| NT2RP1000353 | 26.257 | 80.510 | 62.172 | 39.139 | 13.657 | 50.445 | 33.300 | 118.905 |
| NT2RP1000356 | 25.146 | 46.385 | 82.299 | 43.972 | 13.987 | 49.489 | 26.724 | 110.239 |
| NT2RP1000357 | 213.820 | 128.901 | 421.667 | 86.179 | 76.445 | 136.345 | 94.747 | 87.310 |
| NT2RP1000358 | 186.987 | 64.055 | 108.939 | 32.778 | 41.723 | 110.904 | 74.510 | 67.426 |

TABLE 71

| | | | | | | | | |
|---|---|---|---|---|---|---|---|---|
| NT2RP1000360 | 297.314 | 134.601 | 191.99 | 71.819 | 85.890 | 202.062 | 147.810 | 89.594 |
| NT2RP1000363 | 364.040 | 212.933 | 280.442 | 136.437 | 123.748 | 247.266 | 256.906 | 128.344 |
| NT2RP1000376 | 127.768 | 49.154 | 84.631 | 29.920 | 40.910 | 71.095 | 82.258 | 43.951 |
| NT2RP1000386 | 39.353 | 145.725 | 56.520 | 52.245 | 252.336 | 185.039 | 121.336 | 65.534 |
| NT2RP1000407 | 2.663 | 0.197 | 0.000 | 2.423 | 0.000 | 3.032 | 2.424 | 3.461 |
| NT2RP1000409 | 0.000 | 5.878 | 0.000 | 0.850 | 0.000 | 0.424 | 0.000 | 0.000 |
| NT2RP1000413 | 7.153 | 2.048 | 2.681 | 0.000 | 8.303 | 4.015 | 0.344 | 0.307 |
| NT2RP1000416 | 0.000 | 0.000 | 0.034 | 0.000 | 0.000 | 0.000 | 0.000 | 0.000 |
| NT2RP1000418 | 9.174 | 4.984 | 8.733 | 3.988 | 5.668 | 7.649 | 7.116 | 4.283 |
| NT2RP1000420 | 2.125 | 0.924 | 0.000 | 0.000 | 0.000 | 0.000 | 0.147 | 0.000 |
| NT2RP1000434 | 0.000 | 19.791 | 0.000 | 0.750 | 0.000 | 0.189 | 1.654 | 0.000 |
| NT2RP1000439 | 134.853 | 56.272 | 115.668 | 51.887 | 49.782 | 73.229 | 64.079 | 15.355 |
| NT2RP1000443 | 58.432 | 1.440 | 0.000 | 3.540 | 5.276 | 7.299 | 4.900 | 2.656 |
| NT2RP1000447 | 3.820 | 2.955 | 0.800 | 3.240 | 1.187 | 3.303 | 1.052 | 3.063 |
| NT2RP1000448 | 3.888 | 0.697 | 0.000 | 0.778 | 1.043 | 0.314 | 0.856 | 0.000 |
| NT2RP1000451 | 5.766 | 4.110 | 3.245 | 4.480 | 1.272 | 3.036 | 1.022 | 3.138 |
| NT2RP1000458 | 277.437 | 139.151 | 249.632 | 114.073 | 87.709 | 342.919 | 188.141 | 160.796 |
| NT2RP1000460 | 216.381 | 129.722 | 192.470 | 86.161 | 96.273 | 135.913 | 170.172 | 91.267 |

TABLE 71-continued

| | | | | | | | | |
|---|---|---|---|---|---|---|---|---|
| NT2RP1000465 | 290.518 | 221.955 | 402.881 | 192.151 | 210.010 | 230.322 | 182.401 | 205.887 |
| NT2RP1000468 | 29.203 | 30.933 | 61.862 | 19.161 | 13.854 | 16.791 | 11.220 | 11.713 |
| NT2RP1000470 | 247.991 | 94.630 | 118.548 | 33.073 | 62.185 | 113.536 | 101.037 | 71.927 |
| NT2RP1000477 | 3.039 | 1.894 | 0.000 | 0.887 | 1.636 | 2.721 | 1.261 | 1.757 |
| NT2RP1000478 | 2.842 | 0.655 | 0.000 | 0.363 | 1.122 | 0.412 | 1.375 | 0.000 |
| NT2RP1000481 | 5.676 | 0.693 | 1.376 | 2.294 | 1.991 | 0.993 | 2.480 | 1.941 |
| NT2RP1000493 | 5.004 | 0.820 | 0.000 | 1.070 | 0.687 | 1.252 | 0.401 | 0.344 |
| NT2RP1000513 | 183.214 | 62.178 | 133.983 | 29.869 | 42.569 | 122.982 | 62.701 | 55.329 |
| NT2RP1000522 | 183.947 | 57.483 | 120.005 | 32.529 | 32.275 | 110.978 | 93.419 | 62.294 |
| NT2RP1000533 | 21.686 | 8.198 | 15.700 | 5.816 | 6.071 | 12.902 | 9.030 | 5.528 |
| NT2RP1000544 | 3.732 | 10.988 | 1.704 | 2.465 | 2.581 | 6.543 | 9.371 | 6.069 |
| NT2RP1000547 | 0.300 | 0.310 | 0.170 | 0.000 | 0.000 | 0.000 | 0.000 | 0.000 |
| NT2RP1000551 | 3.716 | 1.322 | 3.371 | 0.657 | 1.870 | 1.149 | 3.287 | 1.199 |
| NT2RP1000567 | 18.148 | 4.535 | 7.630 | 1.128 | 0.978 | 9.115 | 8.337 | 2.192 |
| NT2RP1000574 | 2.807 | 2.740 | 4.159 | 0.000 | 1.266 | 2.846 | 0.662 | 0.000 |
| NT2RP1000577 | 5.767 | 6.059 | 6.234 | 2.033 | 4.066 | 4.517 | 1.545 | 3.168 |
| NT2RP1000579 | 13.591 | 6.812 | 7.808 | 2.066 | 3.452 | 4.699 | 7.020 | 6.279 |
| NT2RP1000581 | 23.446 | 8.664 | 15.950 | 5.531 | 6.046 | 15.075 | 12.761 | 9.085 |
| NT2RP1000593 | 6.058 | 14.376 | 5.780 | 2.580 | 5.057 | 9.162 | 5.483 | 15.975 |
| NT2RP1000604 | 3.081 | 4.126 | 5.413 | 5.134 | 3.748 | 4.785 | 3.835 | 2.255 |
| NT2RP1000609 | 27.487 | 3.174 | 10.612 | 2.228 | 3.986 | 13.382 | 13.762 | 3.825 |
| NT2RP1000613 | 4.356 | 2.265 | 1.529 | 1.100 | 0.000 | 1.184 | 2.710 | 0.767 |
| NT2RP1000622 | 15.005 | 7.496 | 8.013 | 1.968 | 1.752 | 7.985 | 7.518 | 6.485 |
| NT2RP1000627 | 17.344 | 14.772 | 22.410 | 6.441 | 12.047 | 16.356 | 20.729 | 10.336 |
| NT2RP1000629 | 15.718 | 4.144 | 12.352 | 4.104 | 4.312 | 7.820 | 11.024 | 7.693 |
| NT2RP1000630 | 65.249 | 32.499 | 52.699 | 15.138 | 14.415 | 30.508 | 33.741 | 18.936 |
| NT2RP1000639 | 43.900 | 18.204 | 18.020 | 10.187 | 10.606 | 19.791 | 14.683 | 16.200 |
| NT2RP1000640 | 86.217 | 156.971 | 37.078 | 60.057 | 32.726 | 29.102 | 17.026 | 76.883 |
| NT2RP1000646 | 7.394 | 16.894 | 13.629 | 5.542 | 5.660 | 7.382 | 1.582 | 2.851 |
| NT2RP1000659 | 26.494 | 13.979 | 53.935 | 11.276 | 9.119 | 12.945 | 10.602 | 15.936 |
| NT2RP1000674 | 10.820 | 5.502 | 9.633 | 4.224 | 4.542 | 3.907 | 5.942 | 5.755 |
| NT2RP1000677 | 187.310 | 76.173 | 99.589 | 25.959 | 49.679 | 90.146 | 95.230 | 63.227 |
| NT2RP1000679 | 9.839 | 5.907 | 7.263 | 2.229 | 1.965 | 2.520 | 3.853 | 6.223 |
| NT2RP1000688 | 30.741 | 21.137 | 41.993 | 9.852 | 14.205 | 17.736 | 20.738 | 18.729 |
| NT2RP1000689 | 8.594 | 2.814 | 13.021 | 1.222 | 4.171 | 7.394 | 4.473 | 3.167 |
| NT2RP1000695 | 1.813 | 3.104 | 2.068 | 0.810 | 0.000 | 0.000 | 0.786 | 0.000 |
| NT2RP1000701 | 1.280 | 1.032 | 0.000 | 0.000 | 0.000 | 0.855 | 0.000 | 0.607 |
| NT2RP1000702 | 4.112 | 3.346 | 8.473 | 1.156 | 1.698 | 1.616 | 4.749 | 0.000 |
| NT2RP1000713 | 0.233 | 0.022 | 0.927 | 0.000 | 0.000 | 0.000 | 0.300 | 0.000 |
| NT2RP1000721 | 199.987 | 95.449 | 152.563 | 45.581 | 64.142 | 102.872 | 121.431 | 76.919 |
| NT2RP1000730 | 24.414 | 16.302 | 64.370 | 4.470 | 6.129 | 18.698 | 8.948 | 6.185 |
| NT2RP1000733 | 9.992 | 13.894 | 13.138 | 3.593 | 3.087 | 6.945 | 6.918 | 10.277 |
| NT2RP1000738 | 357.551 | 171.924 | 254.026 | 65.731 | 120.196 | 211.970 | 169.539 | 140.421 |
| NT2RP1000739 | 261.372 | 106.684 | 146.597 | 37.731 | 77.575 | 193.277 | 164.547 | 67.465 |
| NT2RP1000740 | 60.717 | 34.534 | 37.472 | 15.130 | 15.350 | 35.255 | 35.792 | 28.239 |
| NT2RP1000746 | 13.275 | 9.551 | 20.132 | 3.375 | 1.635 | 3.601 | 3.265 | 3.969 |

TABLE 72

| | | | | | | | | |
|---|---|---|---|---|---|---|---|---|
| NT2RP1000750 | 134.663 | 52.958 | 80.346 | 28.605 | 36.158 | 71.713 | 92.250 | 39.685 |
| NT2RP1000751 | 17.717 | 44.325 | 31.914 | 32.295 | 15.461 | 19.059 | 18.084 | 64.708 |
| NT2RP1000767 | 12.860 | 6.572 | 9.057 | 2.510 | 3.872 | 3.120 | 5.111 | 4.085 |
| NT2RP1000769 | 27.412 | 21.636 | 18.089 | 7.324 | 7.758 | 13.441 | 12.436 | 7.317 |
| NT2RP1000780 | 7.664 | 2.995 | 3.269 | 2.715 | 2.030 | 0.000 | 0.000 | 0.000 |
| NT2RP1000782 | 11.618 | 23.259 | 28.607 | 5.886 | 16.596 | 14.946 | 5.301 | 7.061 |
| NT2RP1000796 | 118.585 | 56.532 | 75.809 | 15.096 | 41.498 | 78.341 | 73.407 | 26.885 |
| NT2RP1000797 | 215.680 | 107.927 | 100.844 | 28.806 | 53.841 | 131.952 | 306.946 | 77.792 |
| NT2RP1000800 | 5.249 | 3.787 | 2.211 | 1.617 | 7.056 | 3.306 | 3.512 | 2.851 |
| NT2RP1000825 | 49.312 | 22.623 | 29.009 | 4.529 | 15.271 | 16.815 | 24.570 | 12.101 |
| NT2RP1000833 | 67.848 | 23.702 | 41.132 | 9.260 | 13.328 | 25.255 | 29.305 | 27.307 |
| NT2RP1000834 | 21.157 | 17.555 | 15.686 | 11.112 | 11.392 | 19.117 | 14.348 | 17.998 |
| NT2RP1000836 | 12.434 | 11.272 | 7.839 | 3.196 | 2.621 | 7.219 | 5.827 | 5.382 |
| NT2RP1000837 | 98.746 | 40.415 | 104.822 | 21.833 | 23.029 | 41.395 | 35.068 | 27.483 |
| NT2RP1000846 | 14.775 | 11.209 | 35.656 | 4.957 | 5.131 | 7.919 | 3.229 | 5.512 |
| NT2RP1000847 | 27.431 | 18.237 | 16.588 | 10.757 | 10.320 | 14.784 | 19.182 | 10.029 |
| NT2RP1000851 | 214.374 | 87.847 | 128.937 | 45.113 | 51.955 | 144.598 | 108.723 | 51.968 |
| NT2RP1000856 | 26.023 | 29.514 | 67.757 | 23.663 | 28.185 | 38.015 | 15.874 | 11.458 |
| NT2RP1000860 | 163.711 | 61.100 | 101.078 | 35.949 | 41.953 | 87.889 | 80.204 | 48.859 |
| NT2RP1000902 | 24.271 | 31.899 | 49.716 | 12.862 | 11.237 | 22.189 | 17.326 | 17.501 |
| NT2RP1000903 | 68.716 | 24.490 | 31.806 | 9.135 | 15.239 | 68.242 | 28.337 | 14.115 |
| NT2RP1000905 | 25.662 | 13.385 | 22.530 | 7.568 | 3.894 | 6.452 | 12.011 | 13.929 |
| NT2RP1000915 | 22.768 | 32.699 | 39.412 | 17.920 | 10.752 | 16.493 | 10.059 | 19.431 |
| NT2RP1000916 | 36.356 | 17.076 | 24.787 | 8.241 | 2.752 | 29.963 | 18.336 | 4.134 |
| NT2RP1000921 | 20.200 | 10.536 | 22.363 | 8.324 | 5.717 | 15.896 | 15.473 | 4.407 |
| NT2RP1000943 | 9.440 | 4.278 | 14.836 | 10.665 | 2.682 | 3.445 | 1.686 | 1.791 |
| NT2RP1000944 | 65.067 | 27.816 | 40.730 | 12.441 | 18.584 | 43.858 | 29.682 | 34.740 |

TABLE 72-continued

| | | | | | | | | |
|---|---|---|---|---|---|---|---|---|
| NT2RP1000947 | 18.414 | 12.386 | 22.697 | 15.197 | 10.849 | 17.723 | 9.687 | 20.200 |
| NT2RP1000954 | 28.307 | 24.912 | 28.425 | 5.358 | 10.337 | 20.625 | 13.192 | 15.554 |
| NT2RP1000958 | 21.987 | 38.788 | 40.914 | 23.030 | 11.285 | 20.525 | 21.953 | 28.920 |
| NT2RP1000959 | 84.562 | 81.956 | 164.902 | 59.895 | 32.501 | 60.329 | 47.308 | 77.704 |
| NT2RP1000966 | 104.461 | 73.705 | 101.907 | 58.853 | 28.479 | 65.560 | 39.891 | 37.125 |
| NT2RP1000974 | 213.892 | 124.166 | 171.079 | 71.813 | 73.877 | 160.514 | 104.131 | 41.698 |
| NT2RP1000980 | 16.802 | 11.080 | 6.958 | 4.146 | 7.799 | 7.626 | 6.311 | 2.017 |
| NT2RP1000981 | 50.385 | 24.506 | 35.067 | 13.841 | 17.653 | 24.416 | 15.302 | 5.946 |
| NT2RP1000988 | 19.623 | 11.058 | 22.064 | 9.003 | 7.658 | 18.310 | 15.545 | 11.394 |
| NT2RP1001002 | 56.891 | 35.510 | 22.993 | 6.717 | 20.078 | 27.348 | 21.988 | 16.177 |
| NT2RP1001004 | 23.268 | 13.134 | 13.405 | 6.295 | 5.883 | 11.999 | 12.399 | 18.783 |
| NT2RP1001007 | 29.127 | 10.102 | 12.426 | 8.003 | 3.193 | 18.313 | 13.582 | 9.737 |
| NT2RP1001011 | 36.507 | 27.547 | 42.002 | 16.657 | 13.048 | 28.628 | 24.654 | 12.589 |
| NT2RP1001013 | 9.942 | 14.082 | 54.179 | 41.030 | 16.518 | 29.607 | 9.620 | 52.526 |
| NT2RP1001014 | 19.677 | 17.977 | 30.913 | 10.101 | 11.200 | 9.468 | 17.655 | 12.776 |
| NT2RP1001020 | 39.078 | 9.107 | 36.274 | 3.816 | 13.500 | 15.531 | 15.121 | 4.580 |
| NT2RP1001023 | 5309.613 | 985.566 | 1698.618 | 284.967 | 1874.160 | 4332.654 | 3092.785 | 808.260 |
| NT2RP1001027 | 73.098 | 53.184 | 34.629 | 18.681 | 24.296 | 93.325 | 67.199 | 51.245 |
| NT2RP1001031 | 6.737 | 3.944 | 1.413 | 2.625 | 2.583 | 4.462 | 2.652 | 2.043 |
| NT2RP1001033 | 34.383 | 18.547 | 52.827 | 11.061 | 12.794 | 15.798 | 10.825 | 16.802 |
| NT2RP1001042 | 16.664 | 10.042 | 32.855 | 18.106 | 26.513 | 10.262 | 8.945 | 11.915 |
| NT2RP1001045 | 189.863 | 33.846 | 51.766 | 24.186 | 48.474 | 72.682 | 35.437 | 30.767 |
| NT2RP1001073 | 12.246 | 10.612 | 7.850 | 6.640 | 5.048 | 9.855 | 6.935 | 5.520 |
| NT2RP1001079 | 91.852 | 71.311 | 176.776 | 25.199 | 28.090 | 49.291 | 51.519 | 16.408 |
| NT2RP1001080 | 36.634 | 23.422 | 19.061 | 11.316 | 14.731 | 18.812 | 18.139 | 11.376 |
| NT2RP1001113 | 14.930 | 5.617 | 8.219 | 2.444 | 3.358 | 9.872 | 5.861 | 3.904 |
| NT2RP1001159 | 327.758 | 59.111 | 125.411 | 72.993 | 66.677 | 187.780 | 55.003 | 98.072 |
| NT2RP1001173 | 16.780 | 13.137 | 27.175 | 6.169 | 17.090 | 13.269 | 9.476 | 11.252 |
| NT2RP1001176 | 12.987 | 10.035 | 21.336 | 6.618 | 14.457 | 10.468 | 9.085 | 4.024 |
| NT2RP1001177 | 47.481 | 25.797 | 35.864 | 7.900 | 13.900 | 29.446 | 22.230 | 7.579 |
| NT2RP1001185 | 90.471 | 76.839 | 221.325 | 28.708 | 27.738 | 39.654 | 27.055 | 27.069 |
| NT2RP1001199 | 15.790 | 17.518 | 27.913 | 11.849 | 14.093 | 14.390 | 10.829 | 11.780 |
| NT2RP1001205 | 22.415 | 19.355 | 38.756 | 18.438 | 19.648 | 28.439 | 20.497 | 36.255 |
| NT2RP1001215 | 26.469 | 21.856 | 25.048 | 13.068 | 11.039 | 25.483 | 15.692 | 15.808 |
| NT2RP1001225 | 54.629 | 20.260 | 37.472 | 13.542 | 10.291 | 26.429 | 33.484 | 22.194 |
| NT2RP1001245 | 11.787 | 8.531 | 12.195 | 4.229 | 4.219 | 12.906 | 5.042 | 9.166 |
| NT2RP1001247 | 6.228 | 6.100 | 7.648 | 1.747 | 1.022 | 2.368 | 3.698 | 2.028 |

TABLE 73

| | | | | | | | | |
|---|---|---|---|---|---|---|---|---|
| NT2RP1001248 | 49.226 | 25.943 | 116.648 | 10.461 | 11.820 | 12.652 | 13.256 | 17.837 |
| NT2RP1001253 | 16.172 | 14.468 | 19.494 | 5.712 | 7.057 | 20.880 | 11.966 | 15.830 |
| NT2RP1001286 | 31.909 | 17.523 | 37.293 | 9.003 | 10.973 | 24.180 | 18.180 | 18.610 |
| NT2RP1001294 | 25.024 | 26.137 | 24.014 | 7.577 | 12.732 | 16.248 | 11.737 | 14.676 |
| NT2RP1001302 | 20.570 | 17.865 | 14.990 | 7.914 | 7.089 | 11.711 | 10.424 | 6.370 |
| NT2RP1001310 | 73.669 | 50.596 | 61.003 | 20.191 | 35.975 | 42.746 | 31.795 | 30.891 |
| NT2RP1001311 | 107.757 | 35.881 | 46.474 | 17.712 | 21.645 | 48.944 | 43.729 | 26.945 |
| NT2RP1001313 | 55.324 | 32.674 | 63.966 | 13.492 | 14.357 | 18.129 | 17.116 | 14.648 |
| NT2RP1001324 | 35.171 | 18.577 | 22.653 | 7.819 | 11.963 | 16.113 | 15.675 | 21.371 |
| NT2RP1001349 | 44.453 | 17.959 | 25.475 | 6.766 | 11.881 | 22.818 | 27.028 | 20.116 |
| NT2RP1001361 | 55.753 | 27.902 | 58.131 | 21.682 | 28.045 | 60.728 | 52.605 | 27.148 |
| NT2RP1001379 | 126.769 | 137.614 | 71.862 | 24.018 | 47.600 | 154.003 | 231.914 | 35.839 |
| NT2RP1001385 | 74.494 | 89.642 | 123.622 | 19.403 | 22.929 | 45.989 | 34.307 | 19.045 |
| NT2RP1001395 | 45.302 | 31.340 | 24.575 | 7.512 | 17.756 | 24.165 | 18.832 | 16.437 |
| NT2RP1001410 | 23.514 | 23.629 | 40.104 | 12.632 | 9.318 | 21.843 | 13.537 | 8.295 |
| NT2RP1001424 | 10.618 | 33.112 | 10.799 | 2.636 | 4.204 | 7.482 | 8.833 | 25.347 |
| NT2RP1001432 | 12.466 | 40.995 | 9.503 | 1.789 | 6.323 | 5.098 | 8.187 | 7.252 |
| NT2RP1001449 | 55.536 | 20.728 | 66.767 | 10.440 | 26.188 | 27.184 | 29.004 | 30.274 |
| NT2RP1001457 | 30.322 | 32.721 | 37.777 | 8.330 | 12.956 | 20.340 | 25.841 | 17.849 |
| NT2RP1001459 | 88.712 | 62.417 | 75.498 | 27.541 | 35.602 | 62.144 | 51.183 | 51.852 |
| NT2RP1001466 | 16.844 | 23.355 | 27.785 | 10.621 | 12.274 | 14.384 | 8.050 | 13.792 |
| NT2RP1001475 | 89.839 | 111.813 | 276.258 | 35.857 | 23.078 | 34.083 | 16.906 | 15.713 |
| NT2RP1001482 | 9.804 | 7.238 | 3.123 | 7.419 | 2.367 | 3.451 | 2.538 | 1.692 |
| NT2RP1001494 | 18.452 | 17.405 | 15.730 | 1.433 | 3.642 | 8.911 | 7.609 | 6.956 |
| NT2RP1001500 | 2.143 | 2.316 | 3.634 | 2.456 | 0.000 | 0.086 | 0.162 | 0.765 |
| NT2RP1001517 | 14.740 | 13.801 | 16.801 | 3.704 | 5.628 | 8.123 | 9.615 | 6.297 |
| NT2RP1001540 | 50.226 | 35.070 | 52.423 | 11.150 | 17.869 | 36.090 | 28.195 | 7.025 |
| NT2RP1001543 | 87.779 | 27.665 | 55.068 | 12.390 | 25.264 | 48.623 | 28.462 | 18.547 |
| NT2RP1001546 | 51.476 | 99.385 | 143.880 | 25.320 | 72.799 | 104.259 | 38.212 | 42.007 |
| NT2RP1001550 | 67.741 | 63.428 | 53.684 | 15.107 | 31.309 | 40.950 | 26.433 | 16.133 |
| NT2RP1001553 | 34.956 | 17.566 | 22.966 | 10.039 | 10.915 | 17.367 | 20.710 | 19.945 |
| NT2RP1001555 | 33.240 | 52.576 | 54.908 | 25.406 | 21.523 | 42.121 | 29.401 | 24.807 |
| NT2RP1001563 | 30.536 | 23.522 | 26.745 | 10.623 | 16.136 | 20.228 | 17.699 | 11.340 |
| NT2RP1001569 | 90.271 | 31.802 | 37.662 | 7.791 | 18.755 | 32.159 | 31.572 | 22.545 |
| NT2RP1001584 | 125.503 | 64.642 | 101.860 | 20.979 | 38.153 | 69.983 | 85.177 | 68.021 |
| NT2RP1001599 | 25.536 | 22.635 | 29.822 | 7.141 | 9.316 | 19.848 | 14.150 | 13.608 |

TABLE 73-continued

| | | | | | | | | |
|---|---|---|---|---|---|---|---|---|
| NT2RP1001616 | 38.077 | 18.321 | 20.981 | 7.268 | 5.256 | 12.873 | 14.067 | 12.210 |
| NT2RP1001654 | 77.215 | 24.275 | 26.850 | 14.308 | 14.684 | 36.754 | 26.803 | 17.786 |
| NT2RP1001665 | 20.132 | 15.451 | 16.433 | 5.156 | 9.958 | 5.979 | 8.761 | 8.109 |
| NT2RP1001679 | 261.384 | 264.730 | 245.821 | 192.156 | 85.798 | 197.731 | 172.668 | 434.739 |
| NT2RP1001681 | 21.960 | 21.892 | 16.974 | 17.231 | 5.379 | 21.608 | 10.982 | 20.811 |
| NT2RP1001694 | 27.832 | 32.368 | 36.517 | 12.438 | 29.150 | 109.147 | 231.086 | 69.267 |
| NT2RP2000001 | 79.348 | 34.825 | 26.858 | 8.546 | 17.604 | 24.165 | 27.629 | 18.039 |
| NT2RP2000006 | 32.218 | 26.701 | 47.407 | 11.066 | 8.723 | 14.994 | 13.215 | 12.652 |
| NT2RP2000007 | 54.262 | 32.503 | 34.116 | 12.829 | 11.972 | 20.410 | 21.705 | 11.281 |
| NT2RP2000008 | 34.810 | 31.036 | 59.562 | 20.809 | 17.226 | 20.509 | 17.286 | 54.391 |
| NT2RP2000010 | 12.320 | 9.820 | 24.557 | 3.019 | 5.341 | 8.149 | 10.076 | 5.865 |
| NT2RP2000011 | 121.718 | 115.419 | 216.553 | 41.153 | 44.035 | 64.567 | 50.108 | 46.745 |
| NT2RP2000027 | 74.085 | 69.757 | 136.369 | 23.981 | 28.217 | 40.308 | 24.108 | 20.710 |
| NT2RP2000028 | 23.699 | 28.386 | 27.077 | 10.607 | 11.433 | 22.532 | 14.265 | 11.554 |
| NT2RP2000032 | 10.199 | 6.568 | 16.529 | 6.282 | 6.462 | 9.523 | 8.119 | 8.527 |
| NT2RP2000040 | 383.423 | 222.501 | 199.099 | 79.455 | 81.787 | 229.220 | 181.239 | 162.128 |
| NT2RP2000042 | 97.011 | 62.254 | 67.677 | 29.525 | 13.003 | 45.921 | 45.196 | 41.158 |
| NT2RP2000045 | 73.700 | 49.722 | 66.899 | 21.221 | 17.180 | 32.492 | 32.785 | 35.403 |
| NT2RP2000051 | 37.323 | 46.342 | 93.958 | 33.924 | 13.292 | 43.534 | 29.174 | 17.962 |
| NT2RP2000054 | 99.806 | 54.072 | 69.945 | 21.897 | 22.707 | 40.001 | 40.807 | 38.782 |
| NT2RP2000056 | 57.518 | 40.207 | 41.868 | 18.309 | 24.303 | 26.794 | 25.564 | 25.156 |
| NT2RP2000057 | 156.050 | 177.739 | 178.741 | 136.241 | 76.886 | 130.744 | 163.333 | 207.593 |
| NT2RP2000061 | 59.366 | 13.414 | 39.371 | 6.372 | 16.511 | 22.699 | 22.699 | 5.023 |
| NT2RP2000070 | 107.618 | 50.674 | 57.709 | 17.458 | 29.909 | 83.478 | 48.688 | 26.235 |
| NT2RP2000076 | 48.409 | 27.260 | 29.570 | 12.733 | 8.235 | 32.852 | 11.701 | 13.485 |
| NT2RP2000077 | 94.993 | 53.327 | 77.668 | 25.110 | 14.024 | 49.100 | 33.647 | 31.168 |
| NT2RP2000079 | 62.685 | 66.203 | 139.230 | 32.930 | 26.739 | 30.432 | 16.329 | 18.678 |
| NT2RP2000088 | 71.164 | 29.601 | 52.899 | 11.567 | 20.381 | 42.871 | 35.756 | 8.836 |

TABLE 97

| | | | | | | | | |
|---|---|---|---|---|---|---|---|---|
| NT2RP2000091 | 39.115 | 38.293 | 35.366 | 17.159 | 14.253 | 18.714 | 15.927 | 10.202 |
| NT2RP2000092 | 75.001 | 89.256 | 171.691 | 60.810 | 53.472 | 55.591 | 34.478 | 54.330 |
| NT2RP2000097 | 31.201 | 13.401 | 21.451 | 11.261 | 15.139 | 18.293 | 17.851 | 11.653 |
| NT2RP2000098 | 26.707 | 11.006 | 13.971 | 6.330 | 7.991 | 11.945 | 7.052 | 5.446 |
| NT2RP2000108 | 169.612 | 134.647 | 385.078 | 90.234 | 79.343 | 81.573 | 54.191 | 92.458 |
| NT2RP2000114 | 32.814 | 21.256 | 23.561 | 8.385 | 6.127 | 16.427 | 11.227 | 18.744 |
| NT2RP2000116 | 24.247 | 26.308 | 35.305 | 21.085 | 8.128 | 21.812 | 11.292 | 29.326 |
| NT2RP2000119 | 87.773 | 75.708 | 213.188 | 30.879 | 26.975 | 32.244 | 18.663 | 23.323 |
| NT2RP2000120 | 28.158 | 40.341 | 40.702 | 11.423 | 17.144 | 20.974 | 18.758 | 14.232 |
| NT2RP2000126 | 68.253 | 51.174 | 75.714 | 25.719 | 32.146 | 30.674 | 19.806 | 13.086 |
| NT2RP2000133 | 40.974 | 21.406 | 31.855 | 9.468 | 16.094 | 19.158 | 19.716 | 9.703 |
| NT2RP2000147 | 121.104 | 61.190 | 75.784 | 23.438 | 33.839 | 75.147 | 46.430 | 37.718 |
| NT2RP2000153 | 96.598 | 63.476 | 66.144 | 23.377 | 31.821 | 72.069 | 43.415 | 32.773 |
| NT2RP2000156 | 115.309 | 87.137 | 200.582 | 37.008 | 35.422 | 38.443 | 28.450 | 20.252 |
| NT2RP2000157 | 24.318 | 18.096 | 28.697 | 14.121 | 12.284 | 22.086 | 12.179 | 10.163 |
| NT2RP2000161 | 9.493 | 12.679 | 24.575 | 5.678 | 7.191 | 9.079 | 8.105 | 9.807 |
| NT2RP2000168 | 11.413 | 14.646 | 19.908 | 3.979 | 5.383 | 6.466 | 8.554 | 3.206 |
| NT2RP2000173 | 228.420 | 98.033 | 150.036 | 37.188 | 58.850 | 114.315 | 90.491 | 66.465 |
| NT2RP2000175 | 78.839 | 44.514 | 71.096 | 15.404 | 30.614 | 50.131 | 40.431 | 40.206 |
| NT2RP2000178 | 60.513 | 42.174 | 41.614 | 14.454 | 19.558 | 28.068 | 22.439 | 16.249 |
| NT2RP2000183 | 120.139 | 90.798 | 139.074 | 34.168 | 44.541 | 64.271 | 60.391 | 53.828 |
| NT2RP2000195 | 91.304 | 70.037 | 204.874 | 30.805 | 27.133 | 45.934 | 28.749 | 18.697 |
| NT2RP2000204 | 91.419 | 106.652 | 263.856 | 91.981 | 356.822 | 154.895 | 68.553 | 248.768 |
| NT2RP2000205 | 30.577 | 27.665 | 61.321 | 18.312 | 9.596 | 17.099 | 7.227 | 6.812 |
| NT2RP2000208 | 53.204 | 48.346 | 85.459 | 22.464 | 20.371 | 37.407 | 31.136 | 31.123 |
| NT2RP2000224 | 69.062 | 62.644 | 64.951 | 28.002 | 14.265 | 42.146 | 33.510 | 51.634 |
| NT2RP2000230 | 56.320 | 38.161 | 51.891 | 19.712 | 16.865 | 28.186 | 30.382 | 25.164 |
| NT2RP2000231 | 237.426 | 116.377 | 160.416 | 68.560 | 85.769 | 155.055 | 119.086 | 87.184 |
| NT2RP2000232 | 49.708 | 32.849 | 24.700 | 10.366 | 11.881 | 31.935 | 21.623 | 13.775 |
| NT2RP2000233 | 74.158 | 43.941 | 52.603 | 20.024 | 20.149 | 47.211 | 52.894 | 52.273 |
| NT2RP2000239 | 32.380 | 15.399 | 30.197 | 8.574 | 4.025 | 17.013 | 20.268 | 23.735 |
| NT2RP2000240 | 49.173 | 38.363 | 78.202 | 15.737 | 15.654 | 21.302 | 17.214 | 20.486 |
| NT2RP2000248 | 17.308 | 13.339 | 13.368 | 4.823 | 12.687 | 8.493 | 12.992 | 9.218 |
| NT2RP2000256 | 37.650 | 25.977 | 25.477 | 12.706 | 9.212 | 23.055 | 14.601 | 18.126 |
| NT2RP2000257 | 69.335 | 66.181 | 244.979 | 45.881 | 37.192 | 46.969 | 31.322 | 46.624 |
| NT2RP2000258 | 39.114 | 41.740 | 49.525 | 15.968 | 19.509 | 29.341 | 17.580 | 17.049 |
| NT2RP2000261 | 46.051 | 30.214 | 48.737 | 10.438 | 13.441 | 22.674 | 19.894 | 19.556 |
| NT2RP2000270 | 73.075 | 55.962 | 155.102 | 33.557 | 25.014 | 49.469 | 26.505 | 41.022 |
| NT2RP2000274 | 15.514 | 7.310 | 20.284 | 4.327 | 6.428 | 13.479 | 7.807 | 4.833 |
| NT2RP2000277 | 12.320 | 12.198 | 8.692 | 2.395 | 5.097 | 7.436 | 9.834 | 3.452 |
| NT2RP2000279 | 12.294 | 6.735 | 9.825 | 2.486 | 5.467 | 4.265 | 7.545 | 6.898 |
| NT2RP2000283 | 63.324 | 49.998 | 59.636 | 18.166 | 19.261 | 33.586 | 39.787 | 48.270 |
| NT2RP2000288 | 38.289 | 22.877 | 35.809 | 11.594 | 14.150 | 24.632 | 25.978 | 24.657 |
| NT2RP2000289 | 51.997 | 39.352 | 53.601 | 14.746 | 19.914 | 36.153 | 31.476 | 28.603 |
| NT2RP2000297 | 76.236 | 71.227 | 206.854 | 45.839 | 34.290 | 40.991 | 22.703 | 77.905 |

TABLE 97-continued

| | | | | | | | | |
|---|---|---|---|---|---|---|---|---|
| NT2RP2000298 | 28.739 | 29.954 | 34.444 | 15.641 | 10.562 | 21.620 | 14.607 | 21.804 |
| NT2RP2000310 | 29.075 | 14.696 | 16.125 | 5.503 | 10.245 | 16.627 | 19.121 | 11.456 |
| NT2RP2000327 | 45.414 | 16.201 | 24.879 | 17.704 | 13.651 | 24.922 | 17.858 | 30.618 |
| NT2RP2000328 | 36.600 | 35.521 | 50.933 | 15.515 | 23.798 | 33.981 | 22.925 | 32.863 |
| NT2RP2000329 | 45.820 | 29.353 | 14.112 | 22.985 | 11.584 | 34.848 | 35.626 | 29.436 |
| NT2RP2000333 | 33.894 | 26.367 | 89.382 | 12.302 | 13.127 | 27.377 | 10.155 | 15.517 |
| NT2RP2000337 | 14.768 | 17.723 | 21.972 | 6.203 | 6.291 | 12.498 | 8.041 | 5.971 |
| NT2RP2000346 | 53.051 | 82.391 | 46.420 | 15.624 | 13.030 | 26.358 | 27.011 | 31.395 |
| NT2RP2000357 | 30.149 | 22.042 | 28.730 | 11.084 | 7.733 | 16.593 | 11.667 | 6.892 |
| NT2RP2000358 | 16.228 | 10.853 | 14.700 | 2.291 | 4.114 | 11.789 | 8.150 | 7.184 |
| NT2RP2000366 | 82.288 | 25.117 | 44.596 | 10.329 | 16.344 | 44.774 | 37.686 | 6.290 |
| NT2RP2000369 | 21.429 | 15.884 | 19.746 | 6.532 | 11.361 | 9.148 | 7.691 | 12.275 |
| NT2RP2000376 | 205.303 | 111.496 | 120.655 | 34.558 | 45.976 | 138.158 | 139.412 | 79.987 |
| NT2RP2000394 | 31.766 | 23.882 | 31.577 | 11.745 | 14.448 | 23.860 | 24.285 | 20.279 |
| NT2RP2000396 | 231.332 | 142.481 | 190.587 | 52.114 | 101.706 | 157.153 | 153.536 | 79.610 |
| NT2RP2000412 | 67.028 | 66.250 | 119.740 | 21.685 | 25.253 | 30.952 | 32.657 | 39.766 |
| NT2RP2000414 | 97.169 | 86.021 | 59.155 | 47.116 | 24.169 | 74.619 | 64.790 | 62.555 |
| NT2RP2000420 | 34.977 | 33.139 | 27.658 | 7.585 | 9.872 | 17.817 | 19.531 | 15.065 |
| NT2RP2000422 | 17.226 | 26.571 | 24.546 | 8.167 | 6.449 | 11.697 | 14.485 | 17.945 |

TABLE 75

| | | | | | | | | |
|---|---|---|---|---|---|---|---|---|
| NT2RP2000426 | 114.626 | 117.810 | 111.501 | 29.759 | 51.358 | 87.480 | 90.640 | 100.150 |
| NT2RP2000428 | 56.117 | 63.709 | 38.237 | 12.835 | 20.360 | 38.761 | 41.161 | 42.507 |
| NT2RP2000438 | 54.621 | 34.534 | 49.392 | 15.765 | 13.700 | 27.527 | 31.816 | 22.667 |
| NT2RP2000447 | 41.157 | 17.807 | 23.084 | 6.863 | 12.794 | 25.289 | 17.738 | 11.474 |
| NT2RP2000448 | 26.410 | 27.807 | 28.584 | 7.787 | 12.459 | 20.751 | 18.164 | 12.208 |
| NT2RP2000459 | 44.499 | 36.093 | 89.605 | 12.882 | 14.284 | 17.465 | 15.331 | 9.860 |
| NT2RP2000479 | 21.922 | 30.183 | 53.808 | 9.553 | 8.835 | 9.648 | 8.854 | 6.739 |
| NT2RP2000498 | 97.221 | 94.691 | 207.697 | 30.335 | 41.292 | 29.900 | 25.090 | 43.440 |
| NT2RP2000503 | 15.067 | 15.551 | 20.810 | 5.166 | 10.196 | 9.766 | 10.763 | 12.056 |
| NT2RP2000510 | 8.340 | 5.361 | 8.647 | 4.438 | 7.160 | 4.784 | 7.812 | 3.890 |
| NT2RP2000514 | 10.423 | 8.148 | 14.693 | 2.596 | 1.773 | 12.792 | 6.695 | 2.902 |
| NT2RP2000516 | 24.587 | 13.672 | 21.344 | 7.854 | 6.333 | 13.895 | 7.396 | 10.960 |
| NT2RP2000523 | 10.281 | 2.981 | 4.878 | 1.371 | 8.071 | 0.000 | 6.857 | 1.961 |
| NT2RP2000533 | 26.452 | 20.054 | 30.481 | 4.391 | 7.628 | 16.125 | 48.840 | 17.396 |
| NT2RP2000540 | 52.523 | 22.512 | 28.503 | 13.567 | 14.612 | 28.427 | 22.545 | 11.372 |
| NT2RP2000547 | 22.542 | 17.741 | 11.176 | 7.337 | 26.779 | 12.216 | 8.288 | 6.918 |
| NT2RP2000557 | 91.024 | 63.951 | 163.497 | 30.438 | 30.047 | 43.813 | 31.490 | 9.367 |
| NT2RP2000558 | 53.959 | 47.359 | 125.971 | 27.348 | 16.844 | 24.191 | 17.114 | 21.905 |
| NT2RP2000564 | 30.446 | 23.046 | 22.258 | 13.084 | 14.165 | 16.265 | 14.861 | 11.150 |
| NT2RP2000565 | 12.593 | 5.857 | 10.293 | 5.077 | 0.000 | 4.189 | 5.009 | 9.707 |
| NT2RP2000583 | 92.921 | 56.070 | 68.992 | 29.211 | 14.291 | 50.282 | 32.844 | 34.467 |
| NT2RP2000591 | 14.655 | 9.331 | 13.087 | 3.504 | 0.000 | 10.526 | 4.362 | 2.073 |
| NT2RP2000599 | 8.002 | 4.780 | 7.951 | 1.807 | 1.614 | 6.232 | 2.299 | 8.293 |
| NT2RP2000601 | 63.609 | 21.655 | 47.106 | 9.673 | 13.430 | 48.855 | 32.575 | 8.428 |
| NT2RP2000603 | 101.578 | 37.142 | 48.248 | 16.412 | 25.194 | 51.543 | 39.363 | 20.157 |
| NT2RP2000610 | 78.342 | 66.011 | 110.636 | 42.146 | 27.855 | 28.332 | 30.624 | 31.736 |
| NT2RP2000614 | 139.380 | 106.590 | 188.604 | 171.750 | 58.678 | 83.079 | 86.298 | 185.276 |
| NT2RP2000616 | 124.143 | 34.073 | 58.053 | 15.031 | 27.800 | 81.174 | 49.504 | 27.143 |
| NT2RP2000617 | 50.724 | 37.802 | 37.086 | 17.602 | 12.086 | 34.751 | 20.157 | 16.389 |
| NT2RP2000623 | 39.247 | 19.740 | 34.797 | 9.070 | 10.223 | 19.775 | 10.261 | 13.251 |
| NT2RP2000634 | 29.431 | 24.224 | 35.865 | 13.077 | 19.480 | 16.373 | 23.806 | 11.338 |
| NT2RP2000636 | 39.598 | 28.832 | 34.563 | 11.868 | 13.914 | 14.342 | 6.334 | 10.485 |
| NT2RP2000638 | 43.027 | 34.379 | 58.259 | 14.094 | 15.200 | 22.724 | 21.525 | 6.843 |
| NT2RP2000644 | 87.622 | 66.336 | 227.352 | 37.298 | 35.466 | 29.256 | 23.666 | 11.793 |
| NT2RP2000649 | 28.849 | 24.035 | 32.562 | 15.166 | 18.629 | 25.012 | 15.485 | 15.528 |
| NT2RP2000652 | 39.595 | 25.065 | 30.965 | 10.579 | 14.587 | 24.849 | 13.667 | 10.824 |
| NT2RP2000656 | 12.851 | 14.986 | 7.925 | 2.952 | 4.388 | 9.997 | 3.990 | 6.959 |
| NT2RP2000658 | 8.192 | 5.499 | 7.563 | 1.162 | 3.535 | 5.669 | 3.050 | 2.703 |
| NT2RP2000663 | 38.633 | 21.653 | 37.840 | 5.964 | 12.174 | 20.777 | 13.553 | 39.917 |
| NT2RP2000664 | 102.627 | 41.981 | 90.611 | 25.300 | 30.038 | 73.440 | 66.686 | 30.392 |
| NT2RP2000668 | 41.209 | 35.434 | 46.568 | 16.251 | 14.705 | 25.339 | 29.016 | 11.020 |
| NT2RP2000678 | 6.908 | 2.096 | 21.949 | 0.402 | 5.899 | 0.262 | 1.098 | 1.488 |
| NT2RP2000694 | 47.376 | 19.986 | 45.832 | 2.636 | 16.192 | 24.523 | 19.843 | 12.311 |
| NT2RP2000704 | 159.158 | 114.202 | 205.746 | 44.471 | 48.627 | 68.161 | 47.919 | 40.349 |
| NT2RP2000710 | 33.138 | 26.994 | 21.890 | 10.683 | 6.833 | 17.938 | 13.596 | 8.070 |
| N72RP2000112 | 15.016 | 11.689 | 29.736 | 12.471 | 8.668 | 17.629 | 19.970 | 23.796 |
| NT2RP2000715 | 61.771 | 35.912 | 115.757 | 20.470 | 17.051 | 26.042 | 17.159 | 21.325 |
| NT2RP2000720 | 38.951 | 26.992 | 43.620 | 14.647 | 11.930 | 21.500 | 23.895 | 26.128 |
| NT2RP2000731 | 8.039 | 11.373 | 11.261 | 2.986 | 4.755 | 2.127 | 4.657 | 5.827 |
| NT2RP2000739 | 83.662 | 28.893 | 61.699 | 15.623 | 21.878 | 30.716 | 28.485 | 17.190 |
| NT2RP2000748 | 21.953 | 22.377 | 38.996 | 16.815 | 15.564 | 15.846 | 20.219 | 20.054 |
| NT2RP2000749 | 46.622 | 49.334 | 65.231 | 13.317 | 57.514 | 52.159 | 26.941 | 23.868 |
| NT2RP2000758 | 79.204 | 43.258 | 49.681 | 18.768 | 17.058 | 49.245 | 31.463 | 9.472 |
| NT2RP2000764 | 65.396 | 28.914 | 41.243 | 10.203 | 16.308 | 36.761 | 32.438 | 13.134 |

TABLE 75-continued

| | | | | | | | | |
|---|---|---|---|---|---|---|---|---|
| NT2RP2000766 | 40.275 | 50.060 | 83.340 | 10.610 | 48.180 | 26.506 | 18.850 | 15.663 |
| NT2RP2000777 | 92.029 | 39.471 | 41.396 | 32.309 | 33.513 | 94.887 | 43.480 | 40.212 |
| NT2RP2000786 | 91.676 | 61.265 | 70.189 | 16.798 | 30.669 | 51.517 | 41.968 | 37.840 |
| NT2RP2000793 | 245.992 | 91.135 | 151.153 | 57.903 | 62.361 | 191.087 | 132.793 | 68.352 |
| NT2RP2000796 | 24.053 | 16.664 | 26.693 | 12.773 | 8.297 | 14.258 | 11.004 | 10.440 |
| NT2RP2000809 | 118.982 | 88.958 | 221.024 | 42.198 | 50.535 | 65.921 | 39.243 | 46.532 |
| NT2RP2000812 | 23.931 | 28.037 | 26.224 | 15.476 | 9.968 | 23.492 | 19.671 | 6.489 |
| NT2RP2000814 | 9.108 | 7.645 | 7.698 | 5.179 | 4.196 | 5.655 | 3.821 | 2.231 |
| NT2RP2000816 | 49.615 | 22.174 | 23.358 | 8.758 | 4.975 | 23.109 | 16.789 | 17.124 |
| NT2RP2000818 | 8.156 | 2.591 | 1.260 | 0.492 | 0.840 | 1.656 | 0.942 | 0.250 |

TABLE 76

| | | | | | | | | |
|---|---|---|---|---|---|---|---|---|
| NT2RP2000819 | 18.931 | 14.180 | 22.186 | 4.470 | 4.973 | 11.664 | 8.535 | 5.164 |
| NT2RP2000841 | 28.455 | 24.097 | 27.497 | 8.335 | 10.021 | 20.722 | 20.951 | 21.582 |
| NT2RP2000842 | 34.381 | 17.071 | 34.845 | 8.688 | 13.092 | 22.498 | 16.807 | 14.291 |
| NT2RP2000845 | 168.513 | 153.241 | 289.355 | 60.191 | 54.194 | 71.809 | 58.470 | 61.375 |
| NT2RP2000863 | 43.408 | 19.456 | 21.479 | 5.334 | 8.450 | 25.326 | 17.757 | 8.334 |
| NT2RP2000880 | 57.370 | 45.920 | 51.291 | 29.897 | 15.173 | 32.007 | 24.723 | 27.411 |
| NT2RP2000892 | 10.063 | 13.581 | 18.264 | 3.215 | 4.302 | 10.350 | 11.152 | 10.295 |
| NT2RP2000894 | 64.414 | 18.305 | 26.241 | 9.579 | 7.189 | 24.935 | 24.193 | 12.407 |
| NT2RP2000903 | 38.945 | 14.595 | 23.755 | 3.839 | 8.850 | 15.625 | 14.467 | 11.189 |
| NT2RP2000906 | 43.895 | 24.347 | 34.459 | 12.388 | 12.400 | 29.304 | 18.688 | 23.184 |
| NT2RP2000910 | 76.036 | 47.430 | 175.193 | 28.258 | 21.020 | 30.976 | 28.638 | 37.229 |
| NT2RP2000931 | 68.351 | 104.907 | 108.794 | 52.697 | 65.250 | 51.718 | 29.344 | 55.383 |
| NT2RP2000932 | 30.706 | 39.023 | 31.030 | 6.448 | 13.290 | 15.553 | 11.313 | 11.145 |
| NT2RP2000938 | 55.079 | 37.641 | 47.798 | 12.045 | 19.899 | 32.600 | 18.046 | 21.528 |
| NT2RP2000943 | 64.610 | 32.689 | 54.181 | 11.802 | 18.241 | 33.817 | 55.424 | 23.572 |
| NT2RP2000957 | 20.426 | 12.332 | 17.780 | 3.161 | 5.343 | 6.479 | 8.015 | 4.052 |
| NT2RP2000958 | 74.825 | 23.934 | 37.910 | 10.227 | 22.164 | 41.633 | 29.369 | 21.256 |
| NT2RP2000959 | 15.840 | 25.063 | 17.980 | 5.521 | 4.208 | 9.176 | 3.539 | 6.349 |
| NT2RP2000965 | 52.687 | 40.458 | 51.330 | 27.882 | 16.372 | 29.535 | 32.993 | 35.643 |
| NT2RP2000970 | 84.866 | 72.715 | 196.279 | 29.249 | 36.529 | 42.914 | 24.489 | 33.313 |
| NT2RP2000973 | 42.690 | 30.786 | 42.102 | 8.964 | 13.498 | 23.369 | 20.702 | 18.360 |
| NT2RP2000985 | 33.281 | 22.399 | 26.930 | 8.628 | 4.869 | 20.022 | 22.445 | 14.030 |
| NT2RP2000987 | 47.736 | 66.487 | 94.477 | 25.911 | 19.844 | 27.890 | 23.633 | 33.551 |
| NT2RP2000997 | 42.801 | 43.070 | 56.966 | 15.270 | 16.292 | 49.613 | 53.625 | 99.622 |
| NT2RP2001024 | 47.605 | 28.976 | 34.658 | 13.810 | 14.526 | 32.054 | 39.269 | 22.962 |
| NT2RP2001028 | 32.502 | 24.770 | 88.599 | 12.437 | 11.259 | 13.181 | 13.919 | 9.824 |
| NT2RP2001036 | 206.163 | 234.625 | 568.339 | 116.746 | 85.893 | 125.996 | 88.623 | 100.568 |
| NT2RP2001039 | 26.909 | 37.527 | 31.356 | 6.335 | 15.429 | 17.827 | 107.341 | 12.412 |
| NT2RP2001044 | 51.134 | 33.868 | 42.988 | 9.015 | 23.633 | 31.422 | 25.682 | 20.463 |
| NT2RP2001056 | 84.875 | 95.778 | 164.256 | 33.325 | 35.039 | 45.764 | 30.831 | 44.980 |
| NT2RP2001065 | 57.092 | 61.052 | 49.599 | 18.558 | 20.229 | 29.013 | 30.628 | 32.966 |
| NT2RP2001067 | 17.223 | 18.596 | 14.258 | 5.284 | 6.021 | 4.582 | 10.045 | 8.782 |
| NT2RP2001070 | 92.615 | 68.975 | 230.584 | 37.646 | 41.225 | 36.295 | 43.293 | 26.959 |
| NT2RP2001081 | 134.654 | 80.124 | 269.700 | 35.425 | 37.697 | 42.849 | 35.852 | 45.105 |
| NT2RP2001087 | 54.476 | 40.059 | 74.079 | 12.377 | 21.043 | 25.654 | 22.663 | 15.956 |
| NT2RP2001094 | 11.558 | 8.400 | 11.506 | 4.416 | 3.583 | 4.503 | 4.258 | 5.446 |
| NT2RP2001119 | 66.924 | 57.741 | 177.347 | 36.523 | 37.388 | 40.013 | 41.672 | 39.968 |
| NT2RP2001127 | 52.585 | 39.380 | 36.247 | 9.959 | 18.625 | 16.757 | 28.865 | 13.483 |
| NT2RP2001133 | 94.638 | 97.465 | 155.477 | 25.417 | 36.346 | 28.836 | 28.731 | 38.218 |
| NT2RP2001137 | 61.770 | 53.486 | 51.726 | 12.991 | 40.072 | 20.107 | 24.686 | 30.341 |
| NT2RP2001142 | 54.131 | 38.507 | 34.342 | 8.552 | 14.688 | 17.434 | 23.807 | 20.602 |
| NT2RP2001149 | 96.617 | 49.914 | 71.348 | 17.462 | 14.077 | 23.064 | 30.676 | 22.427 |
| NT2RP2001168 | 313.055 | 217.008 | 205.763 | 65.294 | 77.914 | 146.883 | 169.121 | 159.484 |
| NT2RP2001173 | 25.149 | 27.272 | 22.710 | 16.143 | 12.538 | 13.238 | 14.902 | 9.473 |
| NT2RP2001174 | 21.134 | 17.440 | 22.879 | 11.089 | 14.190 | 18.125 | 50.600 | 22.839 |
| NT2RP2001184 | 99.803 | 60.549 | 84.254 | 29.471 | 35.438 | 70.558 | 65.859 | 57.928 |
| NT2RP2001196 | 19.492 | 14.580 | 26.749 | 5.551 | 9.060 | 20.695 | 9.289 | 15.340 |
| NT2RP2001200 | 39.331 | 44.223 | 52.647 | 14.745 | 26.231 | 26.146 | 33.102 | 31.874 |
| N12RP2001218 | 32.396 | 16.531 | 28.960 | 21.387 | 13.855 | 8.618 | 18.872 | 11.236 |
| NT2RP2001223 | 86.393 | 27.183 | 46.400 | 14.290 | 23.545 | 53.375 | 28.096 | 26.084 |
| NT2RP2001226 | 223.868 | 143.880 | 155.700 | 46.575 | 60.808 | 148.876 | 100.150 | 92.898 |
| NT2RP2001227 | 100.969 | 51.807 | 65.094 | 19.398 | 24.302 | 57.877 | 36.375 | 36.204 |
| NT2RP2001232 | 49.733 | 30.526 | 64.154 | 11.691 | 29.542 | 27.238 | 22.294 | 35.950 |
| NT2RP2001233 | 42.734 | 36.288 | 152.784 | 58.935 | 18.921 | 38.027 | 28.582 | 69.539 |
| NT2RP2001245 | 28.251 | 16.266 | 32.594 | 18.419 | 8.746 | 38.272 | 8.565 | 38.035 |
| NT2RP2001246 | 24.708 | 44.426 | 35.600 | 19.345 | 16.443 | 35.994 | 31.550 | 37.123 |
| NT2RP2001268 | 44.328 | 34.570 | 58.263 | 12.894 | 20.636 | 54.014 | 31.715 | 54.645 |
| NT2RP2001270 | 37.478 | 15.214 | 29.740 | 12.749 | 67.050 | 24.740 | 26.469 | 21.423 |
| NT2RP2001276 | 15.931 | 7.906 | 12.674 | 9.235 | 4.389 | 12.549 | 17.273 | 10.235 |
| NT2RP2001277 | 22.937 | 21.147 | 33.688 | 12.970 | 7.618 | 12.672 | 2.878 | 16.107 |
| NT2RP2001290 | 66.867 | 20.688 | 27.890 | 13.340 | 37.970 | 38.444 | 27.073 | 34.029 |
| NT2RP2001295 | 22.777 | 21.635 | 31.845 | 7.387 | 12.979 | 24.206 | 7.863 | 10.592 |
| NT2RP2001297 | 105.753 | 198.744 | 183.982 | 210.648 | 32.481 | 152.615 | 178.985 | 399.018 |
| NT2RP2001301 | 47.099 | 37.782 | 53.504 | 25.117 | 15.392 | 49.389 | 38.668 | 29.281 |

TABLE 77

| | | | | | | | | |
|---|---|---|---|---|---|---|---|---|
| NT2RP2001312 | 493.097 | 175.989 | 324.513 | 96.070 | 132.150 | 315.768 | 282.270 | 146.542 |
| NT2RP2001327 | 188.839 | 50.032 | 95.732 | 33.162 | 58.029 | 112.666 | 87.335 | 71.442 |
| NT2RP2001328 | 177.255 | 162.267 | 495.438 | 96.591 | 104.203 | 93.675 | 57.120 | 68.709 |
| NT2RP2001341 | 196.358 | 92.246 | 40.237 | 32.288 | 34.069 | 91.368 | 77.221 | 45.741 |
| NT2RP2001347 | 148.143 | 157.594 | 486.643 | 72.828 | 67.867 | 81.012 | 36.464 | 72.260 |
| NT2RP2001366 | 160.323 | 170.553 | 496.412 | 116.205 | 96.521 | 146.562 | 77.918 | 108.669 |
| NT2RP2001378 | 217.791 | 51.524 | 110.978 | 31.128 | 51.690 | 147.191 | 118.132 | 56.442 |
| NT2RP2001381 | 16.578 | 13.963 | 19.068 | 15.119 | 9.576 | 8.483 | 2.703 | 10.418 |
| NT2RP2001388 | 84.013 | 52.476 | 228.213 | 47.276 | 49.007 | 52.881 | 33.168 | 44.592 |
| NT2RP2001391 | 806.136 | 1438.949 | 1005.471 | 960.225 | 243.432 | 1160.112 | 1119.907 | 1127.811 |
| NT2RP2001392 | 56.943 | 65.258 | 70.204 | 19.962 | 26.883 | 46.456 | 23.261 | 14.231 |
| NT2RP2001394 | 104.258 | 120.852 | 350.764 | 78.963 | 59.635 | 75.686 | 42.505 | 53.751 |
| NT2RP2001397 | 37.759 | 22.378 | 38.780 | 40.524 | 15.364 | 21.089 | 16.393 | 16.560 |
| NT2RP2001400 | 24.214 | 10.586 | 19.685 | 10.414 | 12.173 | 24.380 | 11.796 | 22.055 |
| NT2RP2001408 | 34.405 | 28.262 | 69.823 | 33.071 | 21.313 | 29.278 | 20.555 | 45.713 |
| NT2RP2001420 | 74.700 | 70.462 | 212.932 | 44.495 | 49.469 | 33.427 | 30.009 | 41.019 |
| NT2RP2001423 | 20.045 | 17.202 | 38.815 | 16.204 | 11.082 | 21.739 | 12.751 | 10.452 |
| NT2RP2001427 | 88.620 | 91.272 | 206.946 | 51.057 | 36.829 | 49.854 | 34.587 | 57.012 |
| NT2RP2001428 | 47.617 | 45.465 | 55.112 | 19.580 | 15.421 | 24.651 | 10.915 | 29.985 |
| NT2RP2001436 | 19.654 | 25.606 | 50.345 | 11.202 | 18.548 | 32.033 | 22.720 | 5.351 |
| NT2RP2001440 | 11.871 | 12.123 | 19.145 | 7.724 | 5.414 | 7.413 | 19.955 | 16.145 |
| NT2RP2001445 | 11.934 | 7.217 | 22.053 | 5.885 | 6.872 | 7.794 | 3.377 | 20.818 |
| NT2RP2001449 | 20.271 | 20.423 | 53.385 | 13.242 | 8.026 | 8.439 | 6.342 | 9.186 |
| NT2RP2001450 | 47.497 | 32.496 | 58.237 | 18.660 | 21.208 | 28.880 | 23.620 | 30.207 |
| NT2RP2001467 | 40.279 | 40.050 | 115.089 | 25.502 | 21.744 | 18.716 | 21.445 | 37.772 |
| NT2RP2001469 | 66.890 | 35.784 | 93.465 | 23.588 | 33.470 | 54.095 | 54.103 | 33.386 |
| NT2RP2001480 | 69.698 | 53.669 | 54.777 | 16.208 | 26.373 | 44.943 | 30.622 | 26.208 |
| NT2RP2001495 | 14.156 | 12.199 | 18.018 | 8.178 | 14.762 | 10.694 | 8.800 | 14.613 |
| NT2RP2001499 | 40.983 | 50.266 | 57.334 | 23.302 | 22.298 | 37.271 | 26.788 | 35.187 |
| NT2RP2001506 | 83.528 | 66.377 | 104.162 | 41.795 | 65.692 | 61.567 | 55.661 | 35.667 |
| NT2RP2001508 | 25.746 | 36.879 | 44.112 | 33.620 | 14.149 | 23.999 | 19.783 | 36.174 |
| NT2RP2001511 | 231.898 | 147.751 | 199.611 | 46.927 | 77.381 | 122.787 | 130.829 | 108.021 |
| NT2RP2001514 | 121.671 | 47.391 | 103.398 | 24.149 | 31.957 | 72.965 | 63.365 | 38.173 |
| NT2RP2001520 | 38.773 | 20.470 | 34.140 | 14.159 | 13.366 | 19.602 | 22.077 | 7.741 |
| NT2RP2001526 | 102.469 | 96.418 | 139.331 | 62.159 | 83.922 | 85.309 | 60.450 | 66.763 |
| NT2RP2001529 | 189.308 | 69.082 | 103.704 | 31.713 | 54.543 | 173.158 | 96.700 | 74.482 |
| NT2RP2001536 | 22.047 | 14.186 | 19.269 | 9.553 | 7.196 | 16.531 | 13.646 | 17.343 |
| NT2RP2001538 | 123.315 | 222.563 | 281.173 | 191.775 | 90.257 | 199.255 | 133.592 | 422.435 |
| NT2RP2001547 | 45.201 | 33.999 | 42.028 | 12.917 | 14.746 | 31.438 | 29.406 | 24.085 |
| NT2RP2001560 | 146.079 | 68.501 | 131.623 | 35.625 | 46.061 | 88.704 | 90.584 | 78.703 |
| NT2RP2001562 | 53.975 | 35.141 | 47.262 | 23.297 | 18.361 | 43.041 | 30.635 | 47.577 |
| NT2RP2001566 | 55.453 | 48.563 | 91.463 | 37.157 | 27.507 | 54.780 | 37.595 | 42.663 |
| NT2RP2001569 | 131.940 | 142.523 | 361.640 | 62.136 | 60.136 | 90.021 | 46.500 | 62.567 |
| NT2RP2001576 | 103.537 | 76.306 | 58.434 | 23.607 | 34.646 | 91.306 | 67.270 | 45.219 |
| NT2RP2001581 | 149.528 | 208.681 | 239.575 | 139.522 | 72.883 | 196.577 | 126.583 | 231.505 |
| NT2RP2001597 | 52.409 | 27.790 | 43.630 | 13.807 | 18.650 | 35.875 | 23.646 | 43.012 |
| NT2RP2001601 | 33.796 | 37.430 | 70.562 | 17.535 | 15.251 | 22.525 | 13.760 | 29.828 |
| NT2RP2001613 | 10.438 | 5.350 | 6.715 | 3.155 | 6.423 | 9.119 | 9.830 | 14.501 |
| NT2RP2001628 | 87.399 | 43.401 | 48.713 | 17.774 | 25.577 | 50.117 | 31.175 | 117.652 |
| NT2RP2001634 | 38.792 | 56.546 | 47.793 | 23.992 | 16.006 | 30.530 | 21.235 | 42.849 |
| NT2RP2001635 | 63.818 | 69.842 | 156.279 | 31.411 | 36.011 | 40.036 | 38.853 | 22.210 |
| NT2RP2001660 | 31.664 | 25.538 | 25.905 | 6.081 | 11.137 | 20.048 | 20.365 | 48.159 |
| NT2RP2001662 | 122.557 | 88.914 | 242.932 | 52.514 | 43.761 | 63.759 | 56.518 | 43.557 |
| NT2RP2001663 | 33.056 | 34.206 | 58.783 | 11.163 | 16.477 | 39.485 | 20.869 | 25.608 |
| NT2RP2001672 | 51.656 | 46.965 | 140.882 | 31.231 | 26.225 | 33.037 | 25.666 | 35.948 |
| NT2RP2001675 | 8.589 | 6.791 | 12.510 | 1.982 | 5.806 | 3.149 | 4.861 | 6.461 |
| NT2RP2001677 | 61.810 | 49.851 | 68.423 | 17.674 | 27.233 | 40.323 | 46.466 | 47.741 |
| NT2RP2001678 | 70.100 | 86.779 | 193.110 | 58.566 | 46.915 | 65.668 | 62.835 | 64.186 |
| NT2RP2001683 | 16.088 | 14.728 | 26.445 | 9.496 | 10.015 | 9.959 | 25.390 | 9.277 |
| NT2RP2001699 | 116.996 | 54.743 | 185.463 | 33.235 | 33.217 | 64.457 | 41.391 | 50.672 |
| NT2RP2001707 | 94.748 | 66.728 | 100.874 | 19.387 | 34.234 | 58.720 | 45.599 | 68.302 |
| NT2RP2001720 | 81.079 | 33.745 | 39.415 | 16.859 | 16.907 | 38.973 | 31.931 | 30.227 |
| NT2RP2O01721 | 73.164 | 35.354 | 62.124 | 25.944 | 28.378 | 69.464 | 66.522 | 35.468 |
| NT2RP2001740 | 23.081 | 30.430 | 27.131 | 12.949 | 12.248 | 21.055 | 20.053 | 28.546 |

TABLE 78

| | | | | | | | | |
|---|---|---|---|---|---|---|---|---|
| NT2RP2001748 | 164.370 | 51.538 | 151.756 | 22.608 | 36.134 | 86.312 | 52.323 | 35.004 |
| NT2RP2001755 | 10.363 | 5.707 | 7.354 | 3.303 | 2.490 | 20.122 | 2.133 | 9.371 |
| NT2RP2001762 | 10.743 | 10.704 | 7.130 | 4.777 | 5.648 | 16.360 | 7.429 | 3.763 |
| NT2RP2001768 | 122.047 | 71.860 | 129.000 | 29.098 | 38.722 | 67.999 | 58.129 | 48.111 |
| NT2RP2001769 | 29.307 | 28.706 | 32.455 | 11.608 | 15.175 | 19.399 | 20.505 | 29.469 |
| NT2RP2001784 | 18.824 | 19.322 | 24.434 | 8.167 | 13.814 | 14.835 | 14.266 | 10.332 |
| NT2RP2001805 | 111.510 | 63.886 | 82.038 | 33.170 | 41.704 | 47.921 | 62.218 | 54.508 |
| NT2RP2001813 | 15.000 | 10.225 | 13.797 | 4.221 | 9.786 | 3.548 | 11.805 | 8.246 |
| NT2RP2001817 | 14.005 | 12.403 | 19.383 | 6.848 | 8.320 | 6.884 | 10.608 | 15.163 |

TABLE 78-continued

| | | | | | | | | |
|---|---|---|---|---|---|---|---|---|
| NT2RP2001818 | 30.494 | 21.374 | 23.441 | 6.808 | 14.438 | 12.858 | 13.055 | 9.397 |
| NT2RP2001837 | 153.478 | 143.980 | 348.522 | 65.249 | 56.344 | 69.434 | 48.042 | 62.813 |
| NT2RP2001839 | 68.237 | 44.006 | 65.237 | 21.186 | 23.824 | 37.874 | 35.524 | 54.235 |
| NT2RP2001861 | 45.604 | 33.558 | 72.763 | 21.180 | 25.185 | 40.479 | 31.542 | 29.326 |
| NT2RP2001869 | 79.101 | 52.967 | 123.399 | 29.766 | 25.811 | 40.870 | 38.251 | 38.150 |
| NT2RP2001876 | 20.847 | 28.536 | 35.991 | 18.044 | 13.257 | 29.195 | 20.056 | 35.651 |
| NT2RP2001878 | 105.429 | 34.989 | 86.887 | 21.675 | 33.547 | 76.806 | 64.301 | 35.521 |
| NT2RP2001881 | 25.562 | 5.186 | 16.935 | 8.594 | 6.002 | 8.017 | 5.474 | 16.018 |
| NT2RP2001883 | 162.487 | 96.494 | 76.800 | 26.663 | 40.257 | 93.069 | 57.806 | 50.662 |
| NT2RP2001884 | 40.027 | 29.435 | 18.175 | 19.127 | 0.000 | 34.665 | 13.313 | 27.989 |
| NT2RP2001885 | 41.527 | 29.494 | 60.284 | 13.719 | 9.345 | 26.427 | 24.717 | 30.448 |
| NT2RP2001898 | 152.071 | 65.585 | 135.420 | 33.617 | 41.173 | 112.042 | 64.105 | 57.703 |
| NT2RP2001900 | 20.075 | 16.336 | 54.207 | 10.431 | 9.790 | 20.098 | 19.168 | 30.123 |
| NT2RP2001903 | 389.922 | 207.168 | 314.475 | 131.627 | 170.618 | 361.733 | 261.185 | 289.339 |
| NT2RP2001907 | 118.240 | 77.557 | 213.664 | 50.816 | 46.691 | 58.895 | 52.711 | 56.061 |
| NT2RP2001915 | 29.335 | 9.240 | 29.213 | 5.804 | 10.101 | 8.718 | 14.671 | 15.535 |
| NT2RP2001921 | 70.657 | 42.199 | 23.786 | 27.411 | 23.817 | 52.083 | 27.655 | 30.244 |
| NT2RP2001926 | 86.771 | 11.953 | 10.434 | 11.123 | 10.945 | 27.144 | 37.077 | 26.703 |
| NT2RP2001933 | 210.457 | 80.003 | 159.875 | 38.312 | 53.192 | 114.539 | 90.251 | 48.849 |
| NT2RP2001936 | 9.271 | 13.789 | 9.841 | 9.560 | 6.311 | 8.706 | 3.968 | 4.244 |
| NT2RP2001943 | 329.800 | 151.136 | 357.167 | 96.135 | 99.997 | 227.342 | 186.800 | 161.131 |
| NT2RP2001946 | 36.700 | 27.839 | 38.317 | 18.830 | 11.786 | 20.082 | 32.636 | 29.552 |
| NT2RP2001947 | 49.825 | 40.322 | 58.260 | 17.399 | 25.524 | 30.411 | 31.309 | 15.258 |
| NT2RP2001948 | 6.858 | 5.149 | 39.338 | 5.855 | 16.449 | 8.590 | 3.943 | 39.227 |
| NT2RP2001956 | 204.499 | 97.036 | 150.184 | 34.215 | 55.776 | 144.746 | 109.645 | 45.142 |
| NT2RP2001969 | 63.044 | 42.091 | 64.895 | 18.446 | 22.555 | 64.128 | 29.876 | 27.818 |
| NT2RP2001976 | 8.014 | 10.925 | 13.322 | 14.259 | 2.776 | 2.729 | 6.432 | 21.452 |
| NT2RP2001978 | 60.910 | 40.459 | 87.051 | 23.282 | 28.689 | 25.497 | 33.528 | 35.507 |
| NT2RP2001985 | 73.126 | 35.661 | 72.052 | 21.029 | 30.385 | 52.486 | 46.885 | 41.899 |
| NT2RP2001991 | 32.897 | 34.028 | 33.239 | 10.548 | 15.586 | 20.531 | 18.489 | 33.157 |
| NT2RP2001997 | 38.265 | 33.006 | 69.711 | 20.057 | 29.835 | 29.074 | 30.213 | 39.156 |
| NT2RP2002015 | 341.660 | 572.382 | 464.288 | 330.114 | 80.297 | 366.270 | 346.254 | 476.966 |
| NT2RP2002017 | 33.468 | 25.736 | 55.897 | 13.982 | 18.424 | 23.720 | 12.540 | 17.897 |
| NT2RP2002025 | 201.899 | 111.493 | 125.922 | 38.775 | 57.018 | 118.130 | 92.718 | 55.437 |
| NT2RP2002030 | 147.806 | 150.643 | 447.960 | 95.773 | 104.163 | 95.260 | 65.007 | 88.254 |
| NT2RP2002032 | 170.695 | 55.335 | 101.868 | 30.495 | 58.859 | 127.664 | 86.380 | 56.817 |
| NT2RP2002033 | 147.111 | 92.379 | 481.152 | 84.872 | 61.493 | 72.667 | 37.144 | 74.278 |
| NT2RP2002041 | 15.097 | 12.379 | 17.284 | 5.762 | 7.552 | 5.398 | 10.885 | 30.538 |
| NT2RP2002046 | 75.094 | 19.275 | 25.228 | 11.030 | 8.158 | 11.642 | 14.255 | 15.385 |
| NT2RP2002047 | 19.261 | 15.499 | 12.076 | 6.530 | 14.384 | 9.918 | 10.225 | 22.164 |
| NT2RP2002050 | 71.226 | 75.633 | 97.017 | 33.238 | 36.421 | 49.003 | 42.582 | 45.656 |
| NT2RP2002052 | 75.004 | 67.588 | 69.616 | 25.123 | 25.691 | 49.820 | 32.819 | 35.546 |
| NT2RP2002058 | 9.803 | 11.955 | 11.648 | 6.527 | 5.940 | 8.570 | 15.678 | 16.434 |
| NT2RP2002060 | 147.927 | 40.191 | 79.254 | 17.661 | 30.022 | 83.968 | 55.933 | 35.933 |
| NT2RP2002063 | 8.334 | 10.615 | 17.124 | 3.910 | 9.032 | 6.499 | 6.095 | 43.967 |
| NT2RP2002066 | 85.296 | 31.968 | 71.727 | 16.697 | 28.928 | 52.589 | 40.814 | 37.383 |
| NT2RP2002070 | 24.791 | 21.309 | 66.961 | 13.511 | 11.537 | 11.893 | 11.300 | 28.065 |
| NT2RP2002076 | 28.441 | 16.541 | 17.729 | 6.137 | 10.519 | 13.321 | 11.910 | 9.273 |
| NT2RP2002078 | 75.992 | 38.941 | 77.227 | 23.502 | 30.063 | 65.434 | 39.358 | 28.599 |
| NT2RP2002079 | 15.378 | 6.595 | 12.418 | 5.815 | 11.345 | 7.129 | 16.510 | 27.362 |
| NT2RP2002099 | 78.520 | 17.490 | 39.514 | 8.705 | 17.165 | 51.830 | 37.473 | 36.146 |
| NT2RP2002105 | 45.619 | 26.109 | 41.837 | 15.263 | 18.979 | 33.970 | 43.561 | 26.203 |
| NT2RP2002115 | 4.270 | 4.361 | 2.711 | 1.795 | 2.838 | 1.055 | 1.725 | 0.659 |
| NT2RP2002124 | 9.528 | 14.188 | 19.276 | 6.091 | 6.494 | 4.046 | 5.259 | 20.125 |
| NT2RP2002137 | 42.205 | 16.239 | 58.339 | 7.326 | 12.132 | 22.097 | 14.684 | 13.003 |

TABLE 79

| | | | | | | | | |
|---|---|---|---|---|---|---|---|---|
| NT2RP2002139 | 134.906 | 45.566 | 87.430 | 23.245 | 34.053 | 84.389 | 66.692 | 39.692 |
| NT2RP2002154 | 73.877 | 40.956 | 58.084 | 17.359 | 21.276 | 53.977 | 32.847 | 25.981 |
| NT2RP2002155 | 312.813 | 448.404 | 208.112 | 246.578 | 165.102 | 220.200 | 117.089 | 396.951 |
| NT2RP2002172 | 30.233 | 30.674 | 55.659 | 15.991 | 11.479 | 50.028 | 14.567 | 76.933 |
| NT2RP2002185 | 35.127 | 22.047 | 31.771 | 9.436 | 13.476 | 23.455 | 23.637 | 18.868 |
| NT2RP2002188 | 281.595 | 70.032 | 141.729 | 44.333 | 58.463 | 164.587 | 118.094 | 78.046 |
| NT2RP2002192 | 28.830 | 19.474 | 84.849 | 18.536 | 13.421 | 8.267 | 10.908 | 25.727 |
| NT2RP2002193 | 51.545 | 23.270 | 33.672 | 10.534 | 17.989 | 33.897 | 31.972 | 33.050 |
| NT2RP2002208 | 28.592 | 23.922 | 46.625 | 15.986 | 13.078 | 25.948 | 18.689 | 40.263 |
| NT2RP2002219 | 13.529 | 18.299 | 23.304 | 8.697 | 7.005 | 20.832 | 6.994 | 4.421 |
| NT2RP2002231 | 3.623 | 9.145 | 18.238 | 6.451 | 5.394 | 5.290 | 2.444 | 1.640 |
| NT2RP2002232 | 41.922 | 30.600 | 40.665 | 10.290 | 12.646 | 31.637 | 16.070 | 23.193 |
| NT2RP2002235 | 25.174 | 12.829 | 11.461 | 1.747 | 8.624 | 10.246 | 12.594 | 16.053 |
| NT2RP2002239 | 123.883 | 99.627 | 183.537 | 54.220 | 35.311 | 68.845 | 72.486 | 114.538 |
| NT2RP2002252 | 173.209 | 45.051 | 80.502 | 16.296 | 33.546 | 82.843 | 82.445 | 52.048 |
| NT2RP2002256 | 6.776 | 3.892 | 12.301 | 3.488 | 7.236 | 6.566 | 9.391 | 9.526 |
| NT2RP2002257 | 14.914 | 18.059 | 11.330 | 3.304 | 7.442 | 11.747 | 12.965 | 136.057 |
| NT2RP2002259 | 25.623 | 20.902 | 41.590 | 9.164 | 7.968 | 18.892 | 22.893 | 29.020 |

TABLE 79-continued

| | | | | | | | | |
|---|---|---|---|---|---|---|---|---|
| NT2RP2002264 | 35.467 | 21.380 | 27.456 | 3.962 | 7.884 | 26.448 | 8.234 | 20.246 |
| NT2RP2002267 | 99.224 | 90.968 | 353.970 | 55.091 | 43.373 | 63.895 | 30.469 | 55.401 |
| NT2RP2002270 | 12.038 | 20.146 | 13.141 | 7.551 | 3.523 | 7.777 | 6.701 | 19.108 |
| NT2RP2002281 | 49.615 | 38.410 | 43.936 | 21.926 | 17.935 | 51.455 | 14.825 | 35.239 |
| NT2RP2002288 | 18.840 | 15.310 | 15.237 | 4.623 | 6.951 | 4.505 | 6.438 | 4.321 |
| NT2RP2002292 | 70.138 | 79.487 | 98.062 | 32.152 | 32.815 | 48.306 | 41.287 | 55.682 |
| NT2RP2002299 | 28.411 | 21.790 | 28.450 | 15.762 | 10.016 | 23.812 | 12.394 | 31.923 |
| NT2RP2002304 | 17.776 | 27.505 | 25.401 | 9.478 | 10.570 | 14.112 | 10.173 | 10.213 |
| NT2RP2002312 | 32.053 | 26.004 | 19.733 | 5.118 | 10.392 | 41.845 | 21.011 | 16.815 |
| NT2RP2002316 | 15.618 | 29.406 | 20.363 | 11.321 | 29.588 | 16.866 | 17.862 | 43.519 |
| NT2RP2002325 | 32.321 | 23.882 | 28.697 | 6.692 | 9.875 | 26.435 | 21.261 | 36.989 |
| NT2RP2002333 | 117.384 | 75.765 | 92.724 | 37.475 | 55.245 | 56.768 | 79.089 | 134.509 |
| NT2RP2002371 | 35.025 | 49.789 | 54.117 | 20.073 | 31.179 | 10.486 | 24.281 | 48.279 |
| NT2RP2002373 | 73.024 | 55.638 | 58.797 | 24.729 | 33.686 | 48.754 | 58.440 | 58.483 |
| NT2RP2002381 | 4.610 | 6.610 | 5.950 | 2.906 | 4.109 | 10.398 | 7.035 | 3.142 |
| NT2RP2002385 | 73.600 | 28.798 | 39.973 | 10.268 | 23.738 | 57.377 | 29.062 | 18.367 |
| NT2RP2002394 | 4.749 | 3.341 | 5.573 | 1.941 | 3.227 | 11.225 | 3.017 | 2.611 |
| NT2RP2002408 | 30.199 | 16.610 | 24.803 | 8.840 | 11.966 | 22.778 | 22.751 | 14.463 |
| NT2RP2002409 | 466.226 | 415.995 | 746.844 | 183.086 | 221.410 | 247.550 | 216.812 | 235.852 |
| NT2RP2002424 | 73.955 | 40.022 | 38.701 | 11.417 | 21.269 | 38.757 | 36.192 | 25.977 |
| NT2RP2002426 | 42.246 | 46.209 | 138.641 | 18.951 | 43.167 | 21.993 | 14.146 | 29.925 |
| NT2RP2002429 | 38.796 | 37.515 | 37.290 | 13.976 | 31.959 | 40.592 | 16.576 | 28.408 |
| NT2RP2002437 | 41.182 | 44.109 | 103.486 | 16.002 | 6.706 | 22.769 | 11.006 | 18.502 |
| NT2RP2002439 | 300.787 | 110.081 | 147.018 | 33.619 | 60.331 | 171.025 | 155.332 | 90.923 |
| NT2RP2002442 | 51.674 | 59.162 | 57.683 | 24.271 | 21.412 | 43.427 | 38.136 | 78.512 |
| NT2RP2002457 | 87.804 | 91.782 | 200.265 | 53.883 | 50.903 | 42.083 | 43.069 | 58.125 |
| NT2RP2002464 | 97.665 | 38.612 | 69.981 | 20.743 | 31.183 | 66.794 | 48.779 | 34.847 |
| NT2RP2002475 | 87.229 | 49.226 | 48.473 | 16.952 | 38.519 | 51.432 | 45.816 | 27.604 |
| NT2RP2002479 | 43.495 | 20.334 | 24.184 | 10.295 | 13.868 | 35.366 | 19.292 | 22.684 |
| NT2RP2002487 | 95.041 | 44.922 | 72.897 | 21.815 | 31.046 | 43.590 | 37.943 | 47.177 |
| NT2RP2002498 | 32.022 | 15.599 | 33.143 | 12.736 | 8.092 | 15.582 | 24.301 | 15.152 |
| NT2RP2002503 | 143.137 | 80.337 | 119.421 | 48.392 | 35.509 | 96.570 | 63.743 | 69.363 |
| NT2RP2002504 | 28.779 | 12.130 | 143.283 | 15.019 | 25.676 | 16.936 | 24.779 | 15.731 |
| NT2RP2002510 | 389.826 | 185.539 | 464.842 | 123.573 | 125.657 | 192.079 | 171.751 | 115.972 |
| NT2RP2002520 | 28.465 | 20.629 | 47.388 | 22.909 | 14.948 | 38.504 | 25.659 | 37.802 |
| NT2RP2002527 | 82.404 | 66.911 | 163.583 | 35.753 | 34.220 | 51.754 | 33.562 | 45.539 |
| NT2RP2002533 | 453.205 | 209.788 | 357.064 | 113.267 | 150.283 | 251.157 | 262.839 | 188.717 |
| NT2RP2002537 | 39.475 | 40.266 | 89.504 | 25.635 | 20.657 | 31.517 | 13.708 | 23.210 |
| NT2RP2002542 | 68.000 | 79.669 | 80.611 | 82.297 | 29.448 | 38.068 | 33.806 | 62.834 |
| NT2RP2002546 | 27.656 | 17.241 | 60.211 | 11.584 | 0.000 | 26.089 | 6.935 | 5.274 |
| NT2RP2002549 | 41.394 | 22.287 | 57.825 | 30.309 | 7.713 | 40.681 | 12.786 | 23.580 |
| NT2RP2002564 | 135.808 | 83.403 | 115.471 | 41.607 | 30.969 | 95.939 | 62.575 | 50.150 |
| NT2RP2002591 | 34.917 | 38.064 | 103.943 | 37.411 | 25.346 | 30.888 | 24.127 | 41.780 |
| NT2RP2002595 | 29.155 | 28.991 | 47.139 | 17.440 | 18.604 | 24.511 | 28.272 | 25.178 |
| N72RP2002602 | 62.164 | 42.498 | 49.596 | 18.894 | 40.679 | 48.767 | 25.334 | 7.981 |
| NT2RP2002606 | 23.368 | 18.641 | 18.058 | 7.405 | 14.392 | 5.066 | 8.402 | 33.190 |

TABLE 80

| | | | | | | | | |
|---|---|---|---|---|---|---|---|---|
| NT2RP2002609 | 51.566 | 22.622 | 50.513 | 11.534 | 20.249 | 18.692 | 26.812 | 44.491 |
| NT2RP2002618 | 54.802 | 20.530 | 64.541 | 20.957 | 20.177 | 31.222 | 20.834 | 32.080 |
| NT2RP2002621 | 108.854 | 151.631 | 361.642 | 75.866 | 73.104 | 87.556 | 37.662 | 72.940 |
| NT2RP2002643 | 79.459 | 49.749 | 159.326 | 32.265 | 31.588 | 30.054 | 50.389 | 48.139 |
| NT2RP2002672 | 97.309 | 70.875 | 124.816 | 41.317 | 54.912 | 65.352 | 54.912 | 61.191 |
| NT2RP2002673 | 33.731 | 27.367 | 31.454 | 11.741 | 16.225 | 18.592 | 18.872 | 41.668 |
| NT2RP2002674 | 13.503 | 12.059 | 23.980 | 5.008 | 15.903 | 5.926 | 8.720 | 8.883 |
| NT2RP2O02686 | 45.156 | 22.604 | 57.057 | 22.253 | 22.373 | 30.389 | 27.672 | 13.377 |
| NT2RP2002688 | 85.273 | 71.163 | 154.737 | 61.783 | 35.115 | 56.421 | 42.460 | 68.118 |
| NT2RP2002695 | 80.865 | 40.613 | 62.941 | 16.213 | 22.197 | 43.453 | 30.540 | 28.172 |
| NT2RP2002701 | 68.274 | 58.034 | 54.220 | 24.008 | 29.811 | 75.585 | 54.744 | 29.997 |
| NT2RP2002706 | 66.710 | 49.408 | 147.083 | 42.409 | 25.501 | 40.462 | 31.482 | 31.678 |
| NT2RP2002710 | 876.030 | 389.806 | 785.892 | 246.642 | 312.053 | 990.051 | 876.290 | 401.334 |
| NT2RP2002721 | 120.344 | 48.897 | 112.902 | 26.906 | 37.076 | 81.599 | 62.600 | 40.801 |
| NT2RP2002727 | 19.985 | 16.809 | 28.658 | 5.885 | 10.968 | 18.932 | 17.127 | 19.197 |
| NT2RP2002734 | 84.484 | 81.389 | 244.997 | 57.973 | 45.229 | 35.711 | 33.199 | 39.655 |
| NT2RP2002736 | 18.170 | 7.757 | 29.873 | 5.264 | 10.456 | 10.179 | 9.257 | 11.010 |
| NT2RP2002740 | 13.219 | 14.424 | 23.343 | 12.863 | 6.975 | 8.152 | 8.795 | 7.772 |
| NT2RP2002741 | 77.823 | 67.266 | 223.592 | 33.955 | 36.594 | 51.261 | 45.295 | 14.049 |
| NT2RP2002750 | 140.558 | 111.369 | 512.500 | 99.367 | 68.412 | 72.711 | 76.999 | 72.280 |
| NT2RP2002752 | 177.349 | 105.312 | 290.520 | 63.592 | 64.508 | 103.376 | 92.228 | 65.849 |
| NT2RP2002753 | 131.824 | 60.851 | 110.980 | 32.981 | 43.667 | 85.850 | 102.908 | 117.429 |
| NT2RP2002760 | 130.675 | 58.967 | 119.405 | 28.837 | 37.588 | 59.420 | 51.267 | 51.768 |
| NT2RP2002769 | 19.077 | 14.018 | 32.873 | 14.190 | 12.332 | 10.357 | 25.988 | 25.043 |
| NT2RP2002778 | 38.616 | 37.548 | 30.303 | 18.271 | 16.022 | 71.865 | 31.460 | 77.045 |
| NT2RP2002791 | 95.319 | 55.458 | 105.096 | 34.190 | 38.076 | 66.995 | 54.639 | 45.519 |
| NT2RP2002800 | 90.052 | 59.554 | 197.798 | 40.413 | 37.123 | 87.119 | 52.880 | 48.173 |

TABLE 80-continued

| | | | | | | | | |
|---|---|---|---|---|---|---|---|---|
| NT2RP2002805 | 14.997 | 12.041 | 9.573 | 4.470 | 8.397 | 5.324 | 5.699 | 14.665 |
| NT2RP2002811 | 84.563 | 36.955 | 70.308 | 17.273 | 24.509 | 89.018 | 46.163 | 49.186 |
| NT2RP2002824 | 44.392 | 48.364 | 75.269 | 21.980 | 25.621 | 56.385 | 42.073 | 38.118 |
| NT2RP2002839 | 45.683 | 28.499 | 42.893 | 12.083 | 18.567 | 22.078 | 23.650 | 21.604 |
| NT2RP2002845 | 46.337 | 22.545 | 45.003 | 11.450 | 16.060 | 6.978 | 26.900 | 14.552 |
| NT2RP2002851 | 26.773 | 11.114 | 27.648 | 7.358 | 7.968 | 15.413 | 17.314 | 11.937 |
| NT2RP2002862 | 122.430 | 114.903 | 392.000 | 81.893 | 61.001 | 82.758 | 60.301 | 50.334 |
| NT2RP2002880 | 46.913 | 32.677 | 29.822 | 12.750 | 16.704 | 35.359 | 14.768 | 24.866 |
| NT2RP2002885 | 24.335 | 26.185 | 27.114 | 10.146 | 19.062 | 54.580 | 55.170 | 22.593 |
| NT2RP2002891 | 33.411 | 27.772 | 38.018 | 14.600 | 16.632 | 38.658 | 34.150 | 26.201 |
| NT2RP2002907 | 31.117 | 36.465 | 35.948 | 13.227 | 13.010 | 49.335 | 37.225 | 26.747 |
| NT2RP2002925 | 30.213 | 17.281 | 33.298 | 11.072 | 11.726 | 25.559 | 24.754 | 17.499 |
| NT2RP2002927 | 21.224 | 35.383 | 40.539 | 21.437 | 7.365 | 35.485 | 14.771 | 39.460 |
| NT2RP2002928 | 13.771 | 14.521 | 49.574 | 11.977 | 6.869 | 9.129 | 7.289 | 8.057 |
| NT2RP2002929 | 21.741 | 22.530 | 32.027 | 7.934 | 12.601 | 20.143 | 13.573 | 25.568 |
| NT2RP2002934 | 63.248 | 35.331 | 42.688 | 10.849 | 16.987 | 39.637 | 27.937 | 23.467 |
| NT2RP2002939 | 53.914 | 30.833 | 62.082 | 15.330 | 19.313 | 35.512 | 35.749 | 26.290 |
| NT2RP2002942 | 82.129 | 82.694 | 187.805 | 50.572 | 53.315 | 49.000 | 38.922 | 90.399 |
| NT2RP2002954 | 33.490 | 25.335 | 35.779 | 11.591 | 11.217 | 27.293 | 16.672 | 26.618 |
| NT2RP2002959 | 18.029 | 22.305 | 18.230 | 8.391 | 14.540 | 12.392 | 9.227 | 31.203 |
| NT2RP2002974 | 34.775 | 17.807 | 29.755 | 6.220 | 18.382 | 28.562 | 36.888 | 41.144 |
| NT2RP2002976 | 7.266 | 6.893 | 13.152 | 2.886 | 5.205 | 17.007 | 6.657 | 17.861 |
| NT2RP2002979 | 156.906 | 139.229 | 395.529 | 82.939 | 71.144 | 104.220 | 76.074 | 81.377 |
| NT2RP2002980 | 98.467 | 79.422 | 285.396 | 49.557 | 40.675 | 57.510 | 33.004 | 50.480 |
| NT2RP2002986 | 210.452 | 66.962 | 105.842 | 25.570 | 34.404 | 156.863 | 99.482 | 35.944 |
| NT2RP2002987 | 170.131 | 130.848 | 355.987 | 114.067 | 85.014 | 125.562 | 105.241 | 119.400 |
| NT2RP2002988 | 35.092 | 33.804 | 42.437 | 7.516 | 22.093 | 78.216 | 26.257 | 53.462 |
| NT2RP2002993 | 41.408 | 20.150 | 29.978 | 8.083 | 13.951 | 19.869 | 17.068 | 17.776 |
| NT2RP2003000 | 91.683 | 72.701 | 265.303 | 52.674 | 45.922 | 52.225 | 38.486 | 61.960 |
| NT2RP2003008 | 19.429 | 42.300 | 26.458 | 14.959 | 11.323 | 22.796 | 23.430 | 31.344 |
| NT2RP2003020 | 146.283 | 83.102 | 231.026 | 31.287 | 198.298 | 95.120 | 89.298 | 74.362 |
| NT2RP2003032 | 42.858 | 35.052 | 46.187 | 15.872 | 16.376 | 25.572 | 24.460 | 29.698 |
| NT2RP2003034 | 97.685 | 100.455 | 302.158 | 45.216 | 40.853 | 44.346 | 20.833 | 60.360 |
| NT2RP2003042 | 32.097 | 30.146 | 30.859 | 9.131 | 14.406 | 14.312 | 25.483 | 23.898 |
| NT2RP2003050 | 43.965 | 23.480 | 42.356 | 12.150 | 15.913 | 20.938 | 29.611 | 20.940 |
| NT2RP2003060 | 43.467 | 23.385 | 32.696 | 13.554 | 17.473 | 48.442 | 37.686 | 31.235 |
| NT2RP2003073 | 90.622 | 74.038 | 305.973 | 46.484 | 45.555 | 68.737 | 36.287 | 64.071 |

TABLE 81

| | | | | | | | | |
|---|---|---|---|---|---|---|---|---|
| NT2RP2003099 | 69.980 | 61.964 | 197.831 | 28.962 | 29.485 | 52.756 | 36.145 | 46.753 |
| NT2RP2003108 | 22.037 | 23.450 | 29.734 | 12.784 | 12.243 | 25.414 | 19.582 | 14.441 |
| NT2RP2003115 | 175.202 | 76.490 | 219.003 | 26.090 | 53.025 | 89.403 | 96.086 | 53.165 |
| NT2RP2003117 | 132.572 | 135.106 | 428.449 | 65.631 | 66.802 | 77.649 | 41.504 | 75.169 |
| NT2RP2003121 | 77.521 | 49.860 | 42.009 | 15.143 | 26.745 | 31.652 | 32.041 | 27.916 |
| NT2RP2003125 | 35.377 | 29.656 | 27.135 | 9.957 | 16.383 | 12.805 | 20.265 | 8.252 |
| NT2RP2003127 | 29.566 | 16.867 | 20.397 | 5.212 | 10.531 | 18.240 | 19.752 | 7.540 |
| NT2RP2003129 | 50.461 | 54.112 | 157.477 | 25.025 | 29.892 | 16.686 | 23.103 | 33.770 |
| NT2RP2003137 | 8.001 | 18.759 | 14.140 | 10.321 | 7.469 | 15.281 | 5.429 | 3.225 |
| NT2RP2003138 | 52.296 | 44.278 | 85.267 | 21.446 | 22.368 | 30.612 | 24.709 | 34.031 |
| NT2RP2003146 | 55.329 | 37.398 | 52.403 | 14.492 | 12.222 | 29.608 | 23.329 | 32.663 |
| NT2RP2003148 | 150.386 | 104.523 | 330.270 | 60.524 | 70.523 | 90.836 | 76.602 | 100.291 |
| NT2RP2003150 | 26.432 | 11.157 | 23.761 | 15.678 | 11.132 | 36.468 | 7.133 | 18.954 |
| NT2RP2003157 | 58.172 | 46.518 | 54.963 | 42.288 | 23.422 | 50.314 | 42.129 | 48.145 |
| NT2RP2003158 | 44.248 | 20.906 | 37.740 | 8.136 | 17.954 | 27.119 | 19.062 | 38.471 |
| NT2RP2003161 | 19.274 | 11.968 | 16.062 | 2.701 | 7.578 | 17.086 | 7.441 | 31.024 |
| NT2RP2003164 | 49.401 | 19.110 | 28.830 | 12.219 | 12.819 | 22.155 | 19.787 | 34.090 |
| NT2RP2003165 | 89.985 | 65.955 | 218.487 | 37.132 | 35.205 | 34.406 | 24.887 | 33.303 |
| NT2RP2003177 | 43.596 | 22.142 | 51.196 | 11.148 | 3.934 | 15.303 | 13.349 | 69.154 |
| NT2RP2003179 | 69.718 | 46.328 | 169.618 | 30.883 | 22.456 | 37.444 | 43.967 | 45.776 |
| NT2RP2003194 | 144.137 | 17.980 | 22.293 | 13.420 | 10.852 | 20.144 | 19.065 | 43.611 |
| NT2RP2003206 | 7.840 | 5.369 | 10.850 | 6.014 | 4.029 | 11.290 | 7.725 | 3.709 |
| NT2RP2003210 | 51.322 | 21.586 | 38.521 | 12.974 | 17.884 | 37.608 | 30.477 | 29.805 |
| NT2RP2003227 | 42.906 | 18.716 | 24.162 | 17.143 | 9.513 | 37.425 | 15.949 | 23.165 |
| NT2RP2003228 | 58.612 | 29.572 | 62.903 | 22.926 | 28.577 | 30.449 | 37.367 | 63.378 |
| NT2RP2003230 | 5.885 | 10.431 | 148.181 | 5.253 | 9.252 | 9.617 | 6.228 | 22.492 |
| NT2RP2003231 | 69.197 | 41.691 | 59.459 | 34.789 | 15.272 | 58.827 | 33.617 | 37.859 |
| NT2RP2003237 | 30.563 | 38.860 | 123.572 | 28.832 | 11.050 | 15.189 | 9.580 | 23.097 |
| NT2RP2003239 | 33.469 | 21.053 | 50.845 | 20.348 | 11.513 | 25.692 | 7.484 | 35.924 |
| NT2RP2003243 | 145.467 | 34.182 | 76.360 | 17.705 | 28.702 | 66.482 | 55.093 | 28.921 |
| NT2RP2003265 | 29.516 | 23.976 | 32.673 | 9.710 | 15.918 | 17.608 | 20.157 | 14.165 |
| NT2RP2003267 | 65.087 | 29.515 | 67.969 | 24.282 | 21.518 | 34.797 | 27.241 | 43.679 |
| NT2RP2003272 | 41.457 | 22.351 | 19.055 | 27.076 | 19.762 | 28.028 | 26.982 | 45.977 |
| NT2RP2003277 | 107.913 | 82.634 | 92.986 | 31.633 | 32.424 | 67.812 | 26.460 | 53.116 |
| NT2RP2003280 | 19.151 | 14.918 | 20.689 | 11.633 | 7.567 | 43.338 | 5.070 | 12.961 |
| NT2RP2003286 | 21.848 | 17.740 | 29.829 | 11.104 | 6.965 | 28.110 | 26.734 | 26.233 |

TABLE 81-continued

| | | | | | | | | |
|---|---|---|---|---|---|---|---|---|
| NT2RP2003293 | 94.719 | 83.407 | 364.260 | 76.134 | 56.105 | 78.539 | 44.376 | 97.047 |
| NT2RP2003295 | 17.874 | 16.886 | 18.717 | 18.256 | 19.625 | 15.088 | 25.617 | 16.166 |
| NT2RP2003297 | 9.592 | 10.816 | 15.547 | 2.211 | 5.615 | 8.461 | 10.162 | 5.662 |
| NT2RP2003300 | 15.144 | 16.953 | 26.519 | 10.354 | 14.045 | 6.847 | 8.974 | 11.058 |
| NT2RP2003302 | 22.071 | 15.550 | 64.230 | 26.397 | 10.289 | 12.880 | 11.722 | 68.523 |
| NT2RP2003307 | 22.086 | 9.418 | 17.120 | 5.220 | 6.112 | 15.691 | 17.396 | 7.096 |
| NT2RP2003308 | 17.436 | 24.315 | 20.930 | 11.886 | 7.814 | 20.422 | 12.860 | 31.766 |
| NT2RP2003311 | 22.001 | 9.144 | 13.842 | 5.360 | 10.014 | 18.616 | 5.176 | 21.146 |
| NT2RP2003329 | 44.872 | 14.471 | 19.961 | 10.976 | 13.401 | 22.292 | 12.093 | 14.770 |
| NT2RP2003339 | 20.422 | 19.625 | 85.412 | 16.458 | 12.443 | 17.818 | 9.125 | 13.152 |
| NT2RP2003345 | 23.118 | 8.297 | 17.237 | 4.695 | 8.379 | 12.952 | 12.259 | 23.215 |
| NT2RP2003347 | 12.389 | 4.636 | 9.822 | 7.720 | 7.500 | 12.461 | 7.182 | 16.011 |
| NT2RP2003367 | 10.794 | 19.368 | 21.160 | 7.884 | 14.120 | 12.142 | 14.419 | 13.409 |
| NT2RP2003369 | 41.141 | 18.327 | 38.318 | 11.072 | 14.356 | 33.971 | 28.126 | 19.613 |
| NT2RP2003383 | 55.891 | 32.218 | 76.058 | 21.558 | 27.536 | 76.861 | 50.564 | 36.175 |
| NT2RP2003390 | 73.620 | 57.765 | 91.034 | 41.124 | 35.539 | 63.744 | 46.234 | 42.766 |
| NT2RP2003391 | 241.564 | 161.239 | 277.051 | 75.828 | 95.432 | 220.668 | 152.546 | 143.981 |
| NT2RP2003393 | 11.758 | 13.507 | 20.112 | 4.687 | 11.809 | 12.940 | 19.991 | 21.749 |
| NT2RP2003394 | 7.323 | 9.816 | 9.506 | 2.871 | 10.713 | 1.307 | 6.346 | 14.753 |
| NT2RP2003401 | 25.259 | 3.938 | 8.376 | 2.832 | 4.096 | 7.246 | 16.169 | 7.442 |
| NT2RP2003403 | 31.239 | 26.205 | 109.072 | 18.680 | 14.206 | 9.380 | 14.946 | 8.745 |
| NT2RP2003433 | 79.603 | 33.408 | 70.460 | 19.431 | 29.526 | 42.730 | 34.783 | 28.629 |
| NT2RP2003445 | 38.525 | 33.248 | 95.090 | 23.648 | 21.333 | 27.951 | 21.347 | 33.662 |
| NT2RP2003446 | 67.228 | 39.971 | 49.302 | 18.878 | 21.829 | 54.339 | 39.113 | 29.464 |
| NT2RP2003456 | 1.902 | 13.833 | 10.178 | 7.437 | 1.522 | 5.049 | 1.410 | 3.486 |
| NT2RP2003466 | 72.001 | 27.022 | 47.862 | 12.506 | 26.814 | 66.543 | 51.004 | 41.515 |
| NT2RP2003459 | 35.915 | 29.791 | 90.766 | 19.568 | 17.254 | 24.857 | 16.952 | 39.575 |
| NT2RP2003470 | 20.820 | 31.916 | 84.744 | 64.680 | 20.126 | 61.522 | 22.215 | 98.657 |

TABLE 82

| | | | | | | | | |
|---|---|---|---|---|---|---|---|---|
| NT2RP2003471 | 7.424 | 5.547 | 6.488 | 7.037 | 5.447 | 6.505 | 7.782 | 10.212 |
| NT2RP2003480 | 78.094 | 65.408 | 137.798 | 31.787 | 40.594 | 58.633 | 37.776 | 39.678 |
| NT2RP2003495 | 15.982 | 11.924 | 14.233 | 7.870 | 5.725 | 11.076 | 8.329 | 14.404 |
| NT2RP2003499 | 55.449 | 13.382 | 25.597 | 4.229 | 14.517 | 54.430 | 36.252 | 15.105 |
| NT2RP2003505 | 55.425 | 27.024 | 46.996 | 11.964 | 7.933 | 31.002 | 31.997 | 27.989 |
| NT2RP2003506 | 29.029 | 19.815 | 26.696 | 9.949 | 12.205 | 23.185 | 12.152 | 24.906 |
| NT2RP2003511 | 85.237 | 37.479 | 50.383 | 22.212 | 25.152 | 50.854 | 41.079 | 36.551 |
| NT2RP2003513 | 2.085 | 4.521 | 4.122 | 3.531 | 5.027 | 3.740 | 2.918 | 7.377 |
| NT2RP2003517 | 37.834 | 17.587 | 35.502 | 11.597 | 12.069 | 30.516 | 43.651 | 39.873 |
| NT2RP2003522 | 24.832 | 37.794 | 30.938 | 13.985 | 21.613 | 21.384 | 15.975 | 15.713 |
| NT2RP2003525 | 112.839 | 77.947 | 318.616 | 53.968 | 64.300 | 64.511 | 45.220 | 44.281 |
| NT2RP2003533 | 95.494 | 87.932 | 267.080 | 44.833 | 35.543 | 46.891 | 33.401 | 37.402 |
| NT2RP2003541 | 59.237 | 40.256 | 51.598 | 18.653 | 24.451 | 41.018 | 38.504 | 56.566 |
| NT2RP2003543 | 60.456 | 24.016 | 25.862 | 11.661 | 16.145 | 17.623 | 31.288 | 25.312 |
| NT2RP2003545 | 5.111 | 9.859 | 11.338 | 12.197 | 5.950 | 2.774 | 8.060 | 34.030 |
| NT2RP2003559 | 26.905 | 22.287 | 37.874 | 13.292 | 12.911 | 24.477 | 17.350 | 31.685 |
| NT2RP2003564 | 29.146 | 18.045 | 64.896 | 13.749 | 13.213 | 15.703 | 17.055 | 25.744 |
| NT2RP2003565 | 71.340 | 106.907 | 131.344 | 34.826 | 44.614 | 78.728 | 62.826 | 61.650 |
| NT2RP2003567 | 70.892 | 54.381 | 72.715 | 19.440 | 21.968 | 61.162 | 50.325 | 46.459 |
| NT2RP2003575 | 8.045 | 11.848 | 16.656 | 3.697 | 4.227 | 5.271 | 7.753 | 9.628 |
| NT2RP2003576 | 94.175 | 119.128 | 189.789 | 159.528 | 39.210 | 94.530 | 84.153 | 280.017 |
| NT2RP2003579 | 55.985 | 110.923 | 72.170 | 19.865 | 32.853 | 121.326 | 99.589 | 58.803 |
| NT2RP2003581 | 72.231 | 34.935 | 63.218 | 15.922 | 25.161 | 44.829 | 45.801 | 38.825 |
| NT2RP2003587 | 109.102 | 46.403 | 76.235 | 20.483 | 28.667 | 127.344 | 62.139 | 47.892 |
| NT2RP2003590 | 27.361 | 26.330 | 26.653 | 9.837 | 5.016 | 24.313 | 17.397 | 36.147 |
| NT2RP2003593 | 98.848 | 66.189 | 91.401 | 17.565 | 31.030 | 61.583 | 54.982 | 56.233 |
| NT2RP2003596 | 20.156 | 17.830 | 46.567 | 15.376 | 7.364 | 8.849 | 10.462 | 35.925 |
| NT2RP2003599 | 99.163 | 72.506 | 53.708 | 30.551 | 33.831 | 64.394 | 76.259 | 72.122 |
| NT2RP2003600 | 39.566 | 25.200 | 27.397 | 13.373 | 16.019 | 22.567 | 30.947 | 25.783 |
| NT2RP2003604 | 30.188 | 48.497 | 24.769 | 15.941 | 13.513 | 20.832 | 18.908 | 35.739 |
| NT2RP2003629 | 12.593 | 10.012 | 13.520 | 5.134 | 7.235 | 8.896 | 12.558 | 21.197 |
| NT2RP2003630 | 55.769 | 31.553 | 55.456 | 13.290 | 24.270 | 37.506 | 32.166 | 28.383 |
| NT2RP2003643 | 20.532 | 14.638 | 38.212 | 9.363 | 17.760 | 18.713 | 18.506 | 19.629 |
| NT2RP2003655 | 46.795 | 29.612 | 38.397 | 10.145 | 18.688 | 20.220 | 24.997 | 18.685 |
| NT2RP2003664 | 23.372 | 28.188 | 21.831 | 11.981 | 11.047 | 39.022 | 14.701 | 15.715 |
| NT2RP2003668 | 98.074 | 71.678 | 215.011 | 48.838 | 58.733 | 45.358 | 46.022 | 49.968 |
| NT2RP2003681 | 36.469 | 27.937 | 30.101 | 11.600 | 12.659 | 14.676 | 15.349 | 16.155 |
| NT2RP2003691 | 57.166 | 66.814 | 140.266 | 28.579 | 24.877 | 10.915 | 18.651 | 30.704 |
| NT2RP2003702 | 77.231 | 74.259 | 157.835 | 37.740 | 29.269 | 33.935 | 36.174 | 35.262 |
| NT2RP2003704 | 33.958 | 19.273 | 90.406 | 13.087 | 15.614 | 12.526 | 13.208 | 27.631 |
| NT2RP2003706 | 15.581 | 9.802 | 10.782 | 1.905 | 1.888 | 20.850 | 8.045 | 6.106 |
| NT2RP2003713 | 16.960 | 13.155 | 19.058 | 12.333 | 6.597 | 11.248 | 12.533 | 12.834 |
| NT2RP2003714 | 58.106 | 48.190 | 156.974 | 28.216 | 25.935 | 21.990 | 15.804 | 26.140 |
| NT2RP2003727 | 16.878 | 30.048 | 11.471 | 24.840 | 10.360 | 26.581 | 2.051 | 18.209 |
| NT2RP2003737 | 35.097 | 27.626 | 24.696 | 15.279 | 8.490 | 48.230 | 26.577 | 18.778 |

TABLE 82-continued

| | | | | | | | | |
|---|---|---|---|---|---|---|---|---|
| NT2RP2003751 | 24.927 | 12.926 | 14.285 | 5.654 | 5.362 | 15.115 | 11.036 | 11.385 |
| NT2RP2003760 | 61.964 | 14.851 | 34.689 | 31.937 | 11.912 | 70.013 | 35.412 | 50.086 |
| NT2RP2003764 | 70.923 | 28.030 | 49.140 | 23.190 | 33.253 | 31.845 | 28.042 | 21.978 |
| NT2RP2003769 | 42.617 | 20.886 | 27.599 | 7.054 | 10.396 | 11.852 | 16.178 | 10.912 |
| NT2RP2003770 | 137.506 | 66.296 | 82.283 | 29.001 | 19.657 | 59.586 | 43.465 | 55.063 |
| NT2RP2003777 | 79.392 | 37.432 | 49.453 | 21.542 | 23.944 | 31.481 | 38.443 | 30.003 |
| NT2RP2003781 | 113.598 | 78.822 | 248.846 | 43.005 | 41.064 | 65.158 | 51.558 | 43.936 |
| NT2RP2003785 | 39.008 | 38.895 | 81.842 | 23.800 | 81.398 | 60.210 | 21.078 | 32.965 |
| NT2RP2003793 | 29.403 | 32.842 | 38.373 | 11.279 | 11.070 | 27.094 | 13.519 | 16.114 |
| NT2RP2003806 | 141.377 | 86.683 | 300.547 | 56.391 | 57.427 | 54.142 | 52.055 | 74.576 |
| NT2RP2003825 | 200.861 | 142.661 | 421.147 | 81.431 | 83.143 | 96.953 | 65.464 | 115.589 |
| NT2RP2003840 | 100.905 | 61.436 | 80.952 | 27.801 | 38.812 | 73.708 | 55.685 | 43.672 |
| NT2RP2003857 | 135.915 | 99.087 | 88.444 | 48.707 | 32.982 | 109.107 | 66.696 | 63.138 |
| NT2RP2003859 | 112.898 | 91.670 | 144.716 | 35.434 | 18.445 | 66.240 | 39.367 | 23.246 |
| NT2RP2003871 | 16.891 | 14.873 | 18.946 | 20.075 | 9.742 | 10.433 | 6.276 | 13.332 |
| NT2RP2003876 | 20.553 | 78.667 | 33.132 | 17.736 | 9.744 | 22.067 | 11.629 | 10.917 |
| NT2RP2003878 | 10.935 | 24.440 | 15.728 | 7.186 | 11.534 | 5.285 | 2.003 | 13.835 |
| NT2RP2003885 | 86.861 | 91.093 | 40.636 | 9.621 | 12.995 | 23.247 | 25.798 | 7.129 |
| NT2RP2003898 | 42.684 | 30.561 | 43.471 | 13.576 | 37.187 | 19.007 | 22.509 | 33.529 |

TABLE 83

| | | | | | | | | |
|---|---|---|---|---|---|---|---|---|
| NT2RP2003902 | 147.643 | 124.985 | 109.475 | 45.984 | 48.594 | 124.353 | 51.962 | 58.344 |
| NT2RP2003912 | 125.311 | 242.124 | 511.945 | 129.243 | 109.998 | 129.880 | 47.537 | 95.222 |
| NT2RP2003931 | 26.887 | 8.179 | 6.459 | 2.307 | 5.260 | 8.153 | 1.858 | 3.142 |
| NT2RP2003940 | 186.397 | 64.618 | 262.034 | 55.607 | 30.649 | 41.635 | 23.343 | 65.087 |
| NT2RP2003950 | 36.158 | 19.195 | 49.413 | 13.592 | 20.939 | 19.343 | 26.770 | 21.989 |
| NT2RP2003952 | 15.955 | 17.931 | 35.750 | 13.974 | 12.406 | 27.300 | 20.083 | 13.016 |
| NT2RP2003968 | 45.877 | 22.833 | 13.459 | 11.361 | 12.355 | 12.353 | 12.010 | 25.113 |
| NT2RP2003976 | 37.958 | 44.808 | 95.495 | 38.986 | 28.544 | 21.209 | 8.325 | 15.117 |
| NT2RP2003981 | 38.654 | 43.006 | 57.657 | 15.338 | 29.345 | 30.659 | 23.563 | 25.867 |
| NT2RP2003984 | 132.353 | 65.644 | 60.516 | 16.394 | 44.914 | 84.097 | 45.289 | 33.280 |
| NT2RP2003986 | 186.062 | 146.313 | 421.324 | 109.891 | 71.468 | 70.656 | 43.927 | 53.945 |
| NT2RP2003988 | 112.131 | 82.329 | 348.163 | 81.784 | 60.909 | 64.387 | 44.174 | 58.384 |
| NT2RP2004013 | 35.821 | 31.054 | 41.104 | 24.447 | 20.809 | 33.899 | 21.394 | 38.113 |
| NT2RP2004014 | 51.068 | 77.076 | 125.407 | 38.647 | 29.948 | 34.055 | 26.943 | 33.783 |
| NT2RP2004036 | 34.592 | 12.491 | 12.862 | 9.166 | 7.965 | 9.771 | 12.722 | 18.319 |
| NT2RP2004041 | 61.828 | 31.728 | 66.443 | 16.578 | 28.668 | 39.049 | 31.113 | 30.197 |
| NT2RP2004042 | 95.416 | 34.628 | 56.458 | 18.193 | 31.581 | 50.180 | 28.757 | 19.510 |
| NT2RP2004049 | 30.836 | 31.163 | 33.858 | 10.780 | 19.423 | 28.518 | 29.763 | 8.339 |
| NT2RP2004060 | 33.939 | 22.080 | 47.086 | 13.117 | 10.598 | 29.819 | 24.922 | 24.074 |
| NT2RP2004066 | 36.939 | 51.977 | 61.500 | 23.281 | 20.470 | 26.729 | 15.403 | 25.483 |
| NT2RP2004069 | 29.217 | 33.889 | 47.332 | 22.168 | 14.676 | 23.715 | 30.550 | 18.563 |
| NT2RP2004076 | 9.020 | 12.153 | 35.232 | 4.198 | 9.970 | 5.069 | 6.316 | 20.634 |
| NT2RP2004080 | 23.022 | 8.835 | 21.995 | 4.309 | 8.489 | 27.512 | 5.327 | 10.188 |
| NT2RP2004081 | 38.786 | 30.091 | 83.806 | 31.063 | 33.602 | 10.431 | 18.338 | 56.090 |
| NT2RP2004098 | 47.764 | 21.424 | 36.354 | 14.003 | 22.548 | 26.497 | 22.648 | 13.621 |
| NT2RP2004108 | 28.744 | 38.559 | 67.714 | 34.947 | 23.442 | 39.884 | 20.636 | 48.103 |
| NT2RP2004124 | 43.031 | 24.659 | 37.232 | 12.008 | 12.194 | 23.487 | 10.186 | 21.361 |
| NT2RP2004130 | 62.738 | 36.522 | 73.772 | 37.407 | 24.390 | 44.094 | 20.478 | 34.479 |
| NT2RP2004133 | 163.939 | 56.278 | 112.008 | 40.808 | 61.092 | 157.167 | 95.384 | 52.343 |
| NT2RP2004141 | 49.570 | 22.611 | 50.916 | 9.793 | 20.924 | 53.203 | 22.033 | 30.466 |
| NT2RP2004142 | 34.850 | 23.492 | 33.078 | 17.102 | 15.132 | 27.703 | 11.237 | 17.601 |
| NT2RP2004152 | 14.256 | 11.207 | 21.943 | 19.655 | 8.860 | 14.997 | 12.981 | 8.353 |
| NT2RP2004165 | 147.447 | 92.813 | 238.228 | 40.497 | 54.357 | 70.413 | 30.081 | 44.940 |
| NT2RP2004170 | 107.111 | 64.978 | 194.673 | 41.028 | 56.020 | 66.291 | 58.470 | 56.553 |
| NT2RP2004172 | 22.440 | 15.213 | 19.562 | 6.795 | 12.099 | 15.400 | 14.334 | 12.024 |
| NT2RP2004176 | 120.902 | 23.723 | 54.734 | 12.552 | 24.966 | 70.512 | 39.664 | 28.280 |
| NT2RP2004179 | 72.406 | 30.327 | 45.178 | 12.821 | 11.733 | 33.905 | 35.842 | 30.011 |
| NT2RP2004187 | 25.235 | 21.870 | 33.704 | 11.364 | 19.908 | 8.982 | 12.208 | 16.442 |
| NT2RP2004190 | 33.406 | 32.037 | 37.882 | 8.251 | 10.063 | 16.897 | 16.826 | 36.649 |
| NT2RP2004194 | 84.064 | 81.541 | 54.017 | 35.398 | 25.386 | 70.700 | 59.372 | 84.014 |
| NT2RP2004196 | 105.711 | 65.320 | 61.236 | 35.178 | 35.795 | 83.939 | 40.164 | 46.168 |
| NT2RP2004205 | 144.445 | 71.761 | 300.198 | 38.897 | 46.886 | 102.336 | 55.538 | 55.936 |
| NT2RP2004207 | 34.894 | 12.571 | 14.703 | 6.333 | 7.074 | 34.908 | 17.403 | 14.550 |
| NT2RP2004226 | 63.802 | 26.160 | 69.559 | 17.665 | 24.160 | 72.242 | 27.469 | 21.672 |
| NT2RP2004232 | 19.053 | 14.404 | 25.695 | 7.555 | 9.877 | 15.593 | 12.523 | 32.679 |
| NT2RP2004239 | 49.739 | 30.594 | 47.640 | 22.915 | 18.596 | 31.416 | 32.672 | 84.520 |
| NT2RP2004240 | 43.946 | 56.977 | 36.742 | 39.656 | 38.450 | 39.881 | 22.758 | 41.302 |
| NT2RP2004242 | 24.272 | 10.675 | 24.496 | 11.743 | 14.023 | 31.038 | 18.900 | 15.124 |
| NT2RP2004245 | 18.673 | 23.813 | 15.945 | 12.936 | 16.016 | 18.326 | 7.178 | 10.903 |
| NT2RP2004270 | 234.182 | 227.894 | 511.563 | 104.046 | 110.474 | 124.225 | 90.436 | 89.248 |
| NT2RP2004300 | 59.573 | 43.407 | 77.768 | 15.466 | 13.124 | 34.892 | 25.094 | 19.570 |
| NT2RP2004304 | 30.539 | 31.035 | 68.652 | 13.187 | 14.829 | 18.430 | 12.663 | 17.214 |
| NT2RP2004313 | 52.639 | 26.629 | 35.836 | 12.439 | 13.307 | 42.833 | 29.621 | 25.693 |
| NT2RP2004316 | 7.937 | 6.053 | 8.996 | 2.798 | 3.869 | 5.139 | 1.817 | 5.009 |

TABLE 83-continued

| | | | | | | | | |
|---|---|---|---|---|---|---|---|---|
| NT2RP2004321 | 16.873 | 18.267 | 25.584 | 5.327 | 9.905 | 12.235 | 12.417 | 6.754 |
| NT2RP2004336 | 27.640 | 16.775 | 31.426 | 5.804 | 11.702 | 19.152 | 18.808 | 17.712 |
| NT2RP2004339 | 253.896 | 255.780 | 749.568 | 115.658 | 151.722 | 126.261 | 70.845 | 110.855 |
| NT2RP2004347 | 39.311 | 42.402 | 63.341 | 12.445 | 14.095 | 30.534 | 11.378 | 12.471 |
| NT2RP2004364 | 71.148 | 60.019 | 167.378 | 28.894 | 26.652 | 36.565 | 22.223 | 23.600 |
| NT2RP2004365 | 27.548 | 25.940 | 29.162 | 10.909 | 8.661 | 13.199 | 18.665 | 18.356 |
| NT2RP2004366 | 34.341 | 34.055 | 33.525 | 8.555 | 14.786 | 3.641 | 15.740 | 27.122 |
| NT2RP2004373 | 28.456 | 29.195 | 22.244 | 7.193 | 17.101 | 34.007 | 21.569 | 14.963 |
| NT2RP2004375 | 22.258 | 23.633 | 23.795 | 24.768 | 8.964 | 14.617 | 11.807 | 28.153 |
| NT2RP2004389 | 26.163 | 41.878 | 17.940 | 111.246 | 10.837 | 22.718 | 14.078 | 16.693 |

TABLE 84

| | | | | | | | | |
|---|---|---|---|---|---|---|---|---|
| NT2RP2004392 | 80.969 | 136.238 | 185.407 | 107.306 | 71.728 | 98.742 | 40.421 | 94.207 |
| NT2RP2004396 | 74.685 | 55.569 | 232.453 | 39.577 | 40.329 | 51.827 | 19.795 | 36.180 |
| NT2RP2004399 | 60.880 | 42.455 | 62.661 | 13.504 | 14.626 | 15.041 | 17.402 | 11.134 |
| NT2RP2004400 | 48.188 | 46.127 | 127.225 | 31.390 | 26.256 | 16.692 | 21.998 | 27.979 |
| NT2RP2004404 | 94.197 | 59.189 | 80.085 | 33.584 | 39.340 | 32.995 | 41.822 | 41.552 |
| NT2RP2004410 | 42.321 | 76.331 | 55.926 | 19.723 | 73.546 | 51.855 | 24.894 | 53.454 |
| NT2RP2004412 | 13.609 | 18.755 | 18.039 | 11.352 | 6.207 | 29.062 | 12.037 | 4.016 |
| NT2RP2004414 | 14.966 | 13.344 | 29.690 | 8.080 | 8.676 | 35.340 | 12.897 | 8.527 |
| NT2RP2004425 | 15.759 | 4.692 | 13.145 | 5.794 | 4.150 | 4.256 | 11.714 | 5.665 |
| NT2RP2004441 | 42.510 | 30.709 | 103.682 | 26.465 | 17.475 | 15.766 | 15.563 | 25.352 |
| NT2RP2004463 | 64.696 | 47.400 | 81.626 | 29.385 | 29.125 | 65.475 | 55.192 | 37.759 |
| NT2RP2004416 | 27.281 | 77.743 | 30.875 | 42.538 | 9.672 | 26.270 | 24.224 | 25.991 |
| NT2RP2004488 | 22.602 | 16.334 | 32.445 | 12.940 | 12.612 | 19.801 | 12.795 | 25.305 |
| NT2RP2004490 | 108.056 | 33.325 | 36.585 | 11.778 | 28.608 | 83.898 | 48.408 | 47.844 |
| NT2RP2004495 | 24.445 | 8.305 | 18.686 | 11.202 | 4.044 | 24.630 | 15.828 | 7.643 |
| NT2RP2004512 | 4.285 | 7.813 | 16.614 | 6.915 | 11.355 | 6.603 | 2.640 | 14.259 |
| NT2RP2004523 | 100.195 | 69.639 | 192.670 | 43.236 | 39.566 | 47.481 | 28.357 | 44.602 |
| NT2RP2004524 | 44.944 | 32.536 | 60.310 | 17.428 | 15.331 | 26.455 | 22.167 | 50.697 |
| NT2RP2004536 | 61.814 | 19.213 | 31.957 | 8.029 | 18.302 | 52.061 | 24.818 | 16.740 |
| NT2RP2004538 | 844.732 | 696.798 | 1443.610 | 22.320 | 403.488 | 580.281 | 434.455 | 470.608 |
| NT2RP2004548 | 81.639 | 84.667 | 179.445 | 54.320 | 34.612 | 101.391 | 35.028 | 58.770 |
| NT2RP2004551 | 20.101 | 20.257 | 8.701 | 5.567 | 6.509 | 4.732 | 2.996 | 4.857 |
| NT2RP2004556 | 186.686 | 124.741 | 397.345 | 91.884 | 102.226 | 91.039 | 70.486 | 107.235 |
| NT2RP2004568 | 92.661 | 117.910 | 131.215 | 47.958 | 44.000 | 46.192 | 45.819 | 146.073 |
| NT2RP2004580 | 117.798 | 112.312 | 308.956 | 61.075 | 41.911 | 54.139 | 28.004 | 55.832 |
| NT2RP2004585 | 88.489 | 51.782 | 72.459 | 31.850 | 12.237 | 75.503 | 38.854 | 53.952 |
| NT2RP2004587 | 9.681 | 12.544 | 13.758 | 5.129 | 6.286 | 5.708 | 2.284 | 3.479 |
| NT2RP2004594 | 17.013 | 7.543 | 15.550 | 11.674 | 7.962 | 3.168 | 5.020 | 19.533 |
| NT2RP2004600 | 24.043 | 10.196 | 26.881 | 5.520 | 4.919 | 5.752 | 8.192 | 20.142 |
| NT2RP2004602 | 123.606 | 61.805 | 80.505 | 32.526 | 37.163 | 36.752 | 6.232 | 36.380 |
| NT2RP2004606 | 95.195 | 78.770 | 115.775 | 31.102 | 36.965 | 58.545 | 65.119 | 56.082 |
| NT2RP2004614 | 88.734 | 53.501 | 57.570 | 36.772 | 25.720 | 49.230 | 34.724 | 39.520 |
| NT2RP2004648 | 20.700 | 23.018 | 14.031 | 14.391 | 8.537 | 50.158 | 15.799 | 9.179 |
| NT2RP2004655 | 15.547 | 12.030 | 20.925 | 7.353 | 6.707 | 24.083 | 10.703 | 5.977 |
| NT2RP2004664 | 115.653 | 30.969 | 45.941 | 18.159 | 33.692 | 93.784 | 43.213 | 29.634 |
| NT2RP2004670 | 37.342 | 20.435 | 29.733 | 8.337 | 17.064 | 23.260 | 22.585 | 18.670 |
| NT2RP2004675 | 90.376 | 87.838 | 277.252 | 52.918 | 33.597 | 43.245 | 31.102 | 40.195 |
| NT2RP2004681 | 80.974 | 41.493 | 71.220 | 24.851 | 34.241 | 54.143 | 45.414 | 29.175 |
| NT2RP2004689 | 15.361 | 6.449 | 9.318 | 5.269 | 6.188 | 5.655 | 17.368 | 7.173 |
| NT2RP2004709 | 76.835 | 57.745 | 96.083 | 23.386 | 38.263 | 34.748 | 18.462 | 31.462 |
| NT2RP2004710 | 55.266 | 57.910 | 39.262 | 18.404 | 10.078 | 36.682 | 30.725 | 36.367 |
| NT2RP2004721 | 326.635 | 50.412 | 98.334 | 21.234 | 65.676 | 230.530 | 162.452 | 35.853 |
| NT2RP2004736 | 151.717 | 95.950 | 265.487 | 84.638 | 82.942 | 67.704 | 64.264 | 123.565 |
| NT2RP2004743 | 34.118 | 25.149 | 128.802 | 17.805 | 15.041 | 28.540 | 44.641 | 29.720 |
| NT2RP2004750 | 83.958 | 75.396 | 199.356 | 68.993 | 52.468 | 133.541 | 50.743 | 56.041 |
| NT2RP2004755 | 31.604 | 24.450 | 46.432 | 13.888 | 69.303 | 26.643 | 15.757 | 22.713 |
| NT2RP2004767 | 79.661 | 59.962 | 217.503 | 30.858 | 29.576 | 29.740 | 25.153 | 35.482 |
| NT2RP2004768 | 13.287 | 13.098 | 19.823 | 9.173 | 5.193 | 3.545 | 2.323 | 8.664 |
| NT2RP2004775 | 10.197 | 8.827 | 40.973 | 5.720 | 4.909 | 3.010 | 5.098 | 1.954 |
| NT2RP2004791 | 68.964 | 37.186 | 133.612 | 23.163 | 25.209 | 12.978 | 21.406 | 22.080 |
| NT2RP2004794 | 230.935 | 115.789 | 236.516 | 45.963 | 115.577 | 229.430 | 167.093 | 66.975 |
| NT2RP2004795 | 38.086 | 12.315 | 42.332 | 9.762 | 10.237 | 23.540 | 30.190 | 27.839 |
| NT2RP2004799 | 32.524 | 12.267 | 12.671 | 2.945 | 22.824 | 24.117 | 5.268 | 5.775 |
| NT2RP2004802 | 10.030 | 10.579 | 12.121 | 10.897 | 8.541 | 5.714 | 8.012 | 10.032 |
| NT2RP2004810 | 42.256 | 25.180 | 28.300 | 12.413 | 6.788 | 15.976 | 14.419 | 10.508 |
| NT2RP2004816 | 30.283 | 32.534 | 22.857 | 17.849 | 20.763 | 23.062 | 16.143 | 21.647 |
| NT2RP2004837 | 247.337 | 65.232 | 133.432 | 34.923 | 121.558 | 220.470 | 155.775 | 58.119 |
| NT2RP2004841 | 18.863 | 23.561 | 19.087 | 12.969 | 6.680 | 26.241 | 6.007 | 27.597 |
| NT2RP2004847 | 273.546 | 127.737 | 198.598 | 82.212 | 76.886 | 209.860 | 173.790 | 137.505 |
| NT2RP2004861 | 39.358 | 31.567 | 90.952 | 21.161 | 16.051 | 19.568 | 16.014 | 16.274 |
| NT2RP2004891 | 15.367 | 22.365 | 32.446 | 11.399 | 17.811 | 26.917 | 58.022 | 46.071 |
| NT2RP2004932 | 183.953 | 95.539 | 145.469 | 60.038 | 97.052 | 126.042 | 109.623 | 90.071 |
| NT2RP2004933 | 18.660 | 21.000 | 61.644 | 10.893 | 8.184 | 31.855 | 24.143 | 11.593 |
| NT2RP2004936 | 10.618 | 16.165 | 27.376 | 5.543 | 8.959 | 13.920 | 6.220 | 8.621 |

TABLE 85

| | | | | | | | | |
|---|---|---|---|---|---|---|---|---|
| NT2RP2004951 | 30.413 | 16.712 | 16.279 | 18.835 | 12.085 | 15.888 | 11.101 | 14.477 |
| NT2RP2004959 | 7.613 | 10.358 | 13.406 | 5.314 | 5.926 | 11.986 | 2.543 | 5.752 |
| NT2RP2004961 | 42.335 | 32.379 | 69.235 | 34.253 | 21.447 | 34.663 | 18.456 | 42.255 |
| NT2RP2004962 | 30.669 | 30.353 | 89.154 | 14.113 | 9.384 | 17.622 | 8.128 | 20.787 |
| NT2RP2004966 | 42.472 | 14.720 | 27.864 | 9.661 | 13.817 | 26.018 | 22.899 | 25.847 |
| NT2RP2004967 | 57.426 | 40.541 | 179.390 | 31.892 | 23.923 | 31.052 | 16.791 | 43.678 |
| NT2RP2004974 | 31.596 | 11.054 | 27.118 | 11.874 | 12.196 | 35.458 | 18.873 | 24.149 |
| NT2RP2004978 | 92.366 | 58.297 | 58.744 | 11.187 | 26.598 | 42.390 | 34.073 | 15.958 |
| NT2RP2004982 | 2.062 | 5.171 | 6.063 | 2.288 | 3.775 | 3.554 | 3.062 | 0.000 |
| NT2RP2004985 | 87.939 | 67.149 | 78.678 | 45.629 | 27.293 | 69.956 | 48.241 | 62.719 |
| NT2RP2004999 | 54.349 | 44.327 | 160.162 | 26.886 | 23.352 | 26.240 | 26.943 | 41.559 |
| NT2RP2005000 | 26.080 | 14.589 | 21.728 | 7.864 | 8.002 | 19.702 | 12.179 | 15.480 |
| NT2RP2005001 | 26.862 | 13.183 | 23.055 | 6.161 | 9.633 | 14.650 | 18.615 | 13.447 |
| NT2RP2005003 | 69.867 | 63.795 | 165.289 | 39.371 | 25.182 | 33.952 | 24.278 | 47.013 |
| NT2RP2005012 | 30.982 | 21.105 | 42.355 | 15.018 | 14.157 | 41.891 | 24.522 | 29.434 |
| NT2RP2005018 | 111.833 | 49.415 | 78.251 | 22.107 | 42.271 | 59.226 | 38.060 | 18.699 |
| NT2RP2005020 | 60.906 | 32.923 | 38.225 | 11.918 | 20.379 | 16.776 | 20.985 | 35.434 |
| NT2RP2005022 | 44.931 | 25.614 | 37.383 | 8.777 | 13.169 | 17.643 | 25.803 | 22.979 |
| NT2RP2005027 | 57.511 | 85.851 | 98.132 | 22.401 | 17.117 | 35.304 | 31.116 | 36.532 |
| NT2RP2005031 | 14.601 | 8.758 | 14.468 | 5.468 | 5.699 | 7.564 | 8.732 | 3.246 |
| NT2RP2005035 | 61.937 | 41.750 | 49.801 | 22.387 | 27.920 | 58.127 | 29.585 | 39.144 |
| NT2RP2005037 | 27.745 | 16.434 | 26.221 | 9.584 | 20.837 | 24.795 | 25.368 | 30.429 |
| NT2RP2005038 | 13.976 | 3.551 | 12.702 | 3.787 | 6.660 | 9.747 | 35.202 | 6.795 |
| NT2RP2005048 | 55.851 | 47.103 | 55.038 | 22.550 | 27.846 | 30.149 | 28.713 | 25.891 |
| NT2RP2005069 | 89.645 | 160.853 | 309.743 | 119.361 | 135.285 | 158.356 | 127.275 | 142.122 |
| NT2RP2005073 | 28.642 | 24.071 | 29.062 | 8.191 | 14.897 | 17.052 | 25.028 | 53.376 |
| NT2RP2005097 | 17.446 | 11.744 | 11.103 | 4.196 | 6.885 | 7.430 | 12.482 | 11.248 |
| NT2RP2005108 | 22.062 | 6.419 | 8.005 | 4.736 | 8.210 | 16.355 | 10.080 | 48.380 |
| NT2RP2005116 | 161.700 | 61.851 | 96.374 | 39.093 | 51.697 | 82.025 | 122.651 | 68.891 |
| NT2RP2005126 | 24.712 | 30.925 | 25.757 | 24.268 | 22.706 | 35.722 | 14.976 | 36.438 |
| NT2RP2005135 | 38.054 | 16.075 | 22.834 | 7.220 | 8.729 | 26.814 | 9.825 | 8.452 |
| NT2RP2005139 | 25.339 | 21.341 | 24.789 | 9.299 | 9.331 | 10.389 | 15.907 | 13.632 |
| NT2RP2005140 | 25.302 | 14.152 | 18.762 | 7.827 | 14.629 | 21.623 | 15.226 | 7.661 |
| NT2RP2005144 | 57.910 | 24.627 | 35.294 | 9.403 | 20.129 | 22.753 | 25.702 | 14.422 |
| NT2RP2005147 | 35.344 | 15.053 | 40.777 | 7.320 | 13.980 | 7.943 | 9.818 | 7.040 |
| NT2RP2005148 | 71.460 | 50.351 | 93.151 | 24.862 | 24.403 | 40.037 | 28.927 | 30.934 |
| NT2RP2005159 | 32.863 | 9.249 | 11.688 | 11.160 | 6.240 | 11.164 | 8.584 | 7.623 |
| NT2RP2005162 | 33.677 | 20.731 | 31.783 | 9.893 | 9.733 | 6.520 | 16.473 | 12.891 |
| NT2RP2005163 | 406.419 | 245.982 | 312.290 | 125.386 | 135.331 | 256.832 | 253.752 | 198.401 |
| NT2RP2005168 | 44.795 | 9.276 | 16.080 | 8.798 | 9.082 | 15.704 | 20.783 | 14.247 |
| NT2RP2005181 | 58.670 | 24.911 | 19.589 | 19.590 | 10.885 | 16.528 | 28.301 | 18.946 |
| NT2RP2005204 | 61.862 | 36.997 | 48.257 | 21.014 | 21.820 | 26.400 | 20.001 | 33.933 |
| NT2RP2005219 | 118.951 | 44.601 | 71.232 | 24.297 | 39.166 | 94.145 | 83.743 | 57.016 |
| NT2RP2005227 | 63.965 | 85.586 | 198.792 | 37.680 | 26.287 | 29.966 | 35.172 | 44.374 |
| NT2RP2005237 | 95.186 | 85.568 | 117.090 | 33.460 | 57.400 | 91.954 | 81.365 | 194.934 |
| NT2RP2005239 | 45.116 | 20.823 | 33.169 | 16.031 | 8.498 | 11.991 | 27.107 | 20.678 |
| NT2RP2005247 | 55.177 | 33.524 | 91.868 | 28.505 | 25.628 | 27.978 | 38.659 | 30.388 |
| NT2RP2005254 | 67.776 | 32.943 | 35.931 | 20.251 | 16.723 | 35.298 | 24.338 | 25.348 |
| NT2RP2005210 | 36.792 | 20.989 | 23.940 | 12.941 | 20.407 | 34.731 | 24.269 | 12.424 |
| NT2RP2005276 | 34.791 | 50.008 | 19.917 | 15.429 | 19.430 | 30.784 | 9.484 | 44.820 |
| NT2RP2005287 | 75.555 | 49.491 | 25.557 | 16.229 | 7.738 | 23.753 | 21.837 | 56.655 |
| NT2RP2005288 | 84.486 | 30.764 | 16.471 | 9.015 | 8.671 | 29.745 | 15.169 | 27.020 |
| NT2RP2005289 | 74.343 | 79.634 | 195.975 | 30.937 | 28.926 | 33.261 | 20.112 | 23.154 |
| NT2RP2005293 | 32.574 | 17.527 | 13.426 | 14.326 | 12.226 | 25.911 | 15.734 | 9.065 |
| NT2RP2005315 | 30.488 | 58.065 | 52.471 | 14.353 | 24.658 | 23.599 | 29.610 | 56.840 |
| NT2RP2005322 | 54.278 | 66.487 | 69.926 | 39.640 | 44.675 | 56.756 | 45.067 | 30.738 |
| NT2RP2005325 | 244.369 | 45.065 | 114.652 | 20.676 | 66.949 | 180.520 | 130.512 | 46.096 |
| NT2RP2005336 | 118.767 | 75.218 | 151.013 | 52.856 | 19.178 | 13.614 | 34.194 | 55.755 |
| NT2RP2005343 | 83.426 | 73.474 | 185.631 | 30.816 | 16.652 | 38.395 | 18.655 | 27.604 |
| NT2RP2005344 | 13.456 | 15.006 | 16.224 | 6.558 | 7.385 | 8.066 | 8.800 | 3.847 |
| NT2RP2005347 | 29.998 | 29.498 | 40.925 | 17.105 | 11.916 | 12.479 | 19.200 | 17.201 |
| NT2RP2005354 | 200.810 | 179.788 | 410.980 | 73.329 | 74.840 | 81.380 | 48.521 | 65.973 |
| NT2RP2005358 | 51.404 | 44.153 | 60.127 | 16.579 | 25.468 | 31.822 | 38.900 | 37.828 |
| NT2RP2005360 | 73.041 | 47.709 | 39.257 | 21.144 | 21.993 | 56.153 | 28.537 | 28.347 |

TABLE 86

| | | | | | | | | |
|---|---|---|---|---|---|---|---|---|
| NT2RP2005378 | 276.722 | 60.663 | 120.794 | 35.912 | 75.334 | 165.512 | 90.853 | 98.444 |
| NT2RP2005391 | 150.127 | 47.813 | 76.113 | 25.253 | 31.400 | 92.500 | 35.776 | 47.335 |
| NT2RP2005393 | 70.899 | 55.424 | 140.116 | 29.969 | 28.518 | 49.057 | 25.746 | 34.105 |
| NT2RP2005407 | 49.576 | 20.202 | 38.801 | 8.339 | 17.993 | 20.349 | 19.728 | 11.408 |
| NT2RP2005419 | 14.831 | 11.867 | 19.565 | 9.795 | 8.679 | 10.513 | 8.946 | 8.857 |
| NT2RP2005425 | 18.167 | 59.599 | 35.636 | 25.050 | 15.104 | 8.153 | 9.614 | 51.727 |
| NT2RP2005429 | 59.197 | 19.497 | 39.350 | 10.173 | 18.944 | 57.213 | 14.988 | 13.492 |
| NT2RP2005436 | 79.164 | 77.083 | 60.113 | 36.736 | 34.134 | 54.347 | 21.339 | 40.541 |
| NT2RP2005441 | 13.042 | 15.338 | 15.762 | 8.369 | 12.826 | 20.597 | 9.547 | 15.936 |

TABLE 86-continued

| | | | | | | | | |
|---|---|---|---|---|---|---|---|---|
| NT2RP2005442 | 38.553 | 25.938 | 32.259 | 17.285 | 15.576 | 32.634 | 33.798 | 38.091 |
| NT2RP2005444 | 71.342 | 49.614 | 44.203 | 32.335 | 34.594 | 66.817 | 40.260 | 65.040 |
| NT2RP2005453 | 14.907 | 15.128 | 11.162 | 5.959 | 22.081 | 9.421 | 11.234 | 15.739 |
| NT2RP2005457 | 140.563 | 10.504 | 365.826 | 82.692 | 104.746 | 121.659 | 116.087 | 102.686 |
| NT2RP2005458 | 20.125 | 11.007 | 11.247 | 8.652 | 9.030 | 17.490 | 6.559 | 3.649 |
| NT2RP2005463 | 33.251 | 29.837 | 73.818 | 20.532 | 31.448 | 29.345 | 25.049 | 51.072 |
| NT2RP2005464 | 15.800 | 16.043 | 35.864 | 14.911 | 13.341 | 13.525 | 14.209 | 18.361 |
| NT2RP2005465 | 14.668 | 18.280 | 26.584 | 6.257 | 10.356 | 14.681 | 6.572 | 9.479 |
| NT2RP2005472 | 16.851 | 25.760 | 9.199 | 8.686 | 4.966 | 40.418 | 42.443 | 7.644 |
| NT2RP2005476 | 46.416 | 52.525 | 104.203 | 20.584 | 20.782 | 24.546 | 5.316 | 32.360 |
| NT2RP2005490 | 61.983 | 24.419 | 28.345 | 12.864 | 15.040 | 12.501 | 22.637 | 19.383 |
| NT2RP2005491 | 374.811 | 74.888 | 145.408 | 24.336 | 165.612 | 317.177 | 231.269 | 69.296 |
| NT2RP2005495 | 31.802 | 17.805 | 29.680 | 11.830 | 10.557 | 8.912 | 14.827 | 34.592 |
| NT2RP2005496 | 148.755 | 112.441 | 375.031 | 47.535 | 53.667 | 47.282 | 40.191 | 44.995 |
| NT2RP2005498 | 44.735 | 18.772 | 34.164 | 9.402 | 20.468 | 26.500 | 17.998 | 17.049 |
| NT2RP2005501 | 40.853 | 37.008 | 48.454 | 14.020 | 18.699 | 36.333 | 14.886 | 19.992 |
| NT2RP2005506 | 90.354 | 86.896 | 75.939 | 25.611 | 32.147 | 174.626 | 79.478 | 131.787 |
| NT2RP2005509 | 49.249 | 30.854 | 40.983 | 21.945 | 13.500 | 50.085 | 24.330 | 36.909 |
| NT2RP2005514 | 27.107 | 19.658 | 27.479 | 12.890 | 10.652 | 12.518 | 18.695 | 17.325 |
| NT2RP2005520 | 17.919 | 21.654 | 27.300 | 18.855 | 10.163 | 12.223 | 7.568 | 30.261 |
| NT2RP2005525 | 39.486 | 38.604 | 46.862 | 28.621 | 21.332 | 32.985 | 26.679 | 36.176 |
| NT2RP2005531 | 14.400 | 12.033 | 22.722 | 7.730 | 9.380 | 14.414 | 16.744 | 11.422 |
| NT2RP2005535 | 101.541 | 107.605 | 200.015 | 82.259 | 60.740 | 56.504 | 51.248 | 118.559 |
| NT2RP2005539 | 66.664 | 29.346 | 46.698 | 21.888 | 19.870 | 64.043 | 30.246 | 26.001 |
| NT2RP2005540 | 20.513 | 15.829 | 14.697 | 8.223 | 3.931 | 49.149 | 7.536 | 29.160 |
| NT2RP2005541 | 64.709 | 41.297 | 53.989 | 27.868 | 23.974 | 31.435 | 25.336 | 31.933 |
| NT2RP2005549 | 32.008 | 17.222 | 22.169 | 5.861 | 8.219 | 16.966 | 10.809 | 20.882 |
| NT2RP2005555 | 32.893 | 26.046 | 65.848 | 10.597 | 20.624 | 14.475 | 13.940 | 32.764 |
| NT2RP2005S557 | 17.756 | 22.321 | 31.949 | 8.994 | 15.581 | 5.592 | 13.074 | 7.963 |
| NT2RP2005581 | 90.896 | 89.844 | 311.596 | 54.248 | 36.454 | 51.670 | 42.717 | 57.487 |
| NT2RP2005586 | 15.319 | 12.081 | 23.020 | 7.054 | 4.455 | 13.988 | 9.947 | 14.644 |
| NT2RP2005597 | 70.922 | 36.752 | 50.127 | 12.506 | 18.474 | 43.281 | 28.038 | 27.738 |
| NT2RP2005600 | 57.039 | 36.730 | 42.297 | 19.089 | 22.952 | 20.349 | 26.429 | 35.687 |
| NT2RP2005605 | 89.117 | 41.403 | 109.938 | 32.943 | 40.472 | 75.058 | 52.177 | 50.487 |
| NT2RP2005614 | 7.627 | 7.626 | 13.603 | 2.503 | 13.051 | 6.276 | 5.809 | 8.317 |
| NT2RP2005620 | 42.734 | 21.553 | 33.023 | 9.850 | 14.899 | 31.978 | 27.521 | 25.649 |
| NT2RP2005622 | 17.770 | 22.460 | 29.124 | 15.992 | 11.139 | 27.623 | 9.965 | 36.314 |
| NT2RP2005632 | 14.999 | 31.771 | 43.031 | 12.307 | 17.618 | 13.899 | 11.335 | 15.678 |
| NT2RP2005635 | 49.456 | 30.521 | 47.412 | 10.091 | 23.056 | 33.511 | 25.653 | 30.736 |
| NT2RP2005637 | 12.810 | 11.271 | 23.258 | 10.723 | 0.000 | 8.150 | 7.172 | 12.007 |
| NT2RP2005640 | 4.097 | 3.653 | 9.894 | 0.840 | 1.980 | 8.957 | 6.220 | 1.795 |
| NT2RP2005645 | 20.889 | 32.389 | 36.306 | 18.400 | 17.660 | 5.119 | 17.090 | 35.045 |
| NT2RP2005651 | 73.019 | 20.719 | 36.098 | 13.026 | 13.892 | 30.207 | 30.624 | 40.618 |
| NT2RP2005654 | 39.235 | 27.889 | 43.919 | 18.330 | 15.864 | 16.064 | 25.659 | 25.595 |
| NT2RP2005666 | 62.014 | 31.370 | 41.680 | 13.597 | 18.813 | 69.986 | 43.533 | 15.230 |
| NT2RP2005669 | 64.432 | 53.672 | 65.910 | 23.933 | 25.429 | 55.388 | 61.239 | 61.894 |
| NT2RP2005670 | 37.363 | 15.333 | 17.547 | 8.556 | 14.756 | 36.642 | 25.697 | 14.161 |
| NT2RP2005671 | 43.306 | 44.120 | 31.058 | 10.830 | 17.143 | 63.049 | 30.396 | 23.799 |
| NT2RP2005675 | 142.194 | 57.967 | 69.677 | 20.463 | 42.418 | 100.132 | 100.664 | 78.669 |
| NT2RP2005683 | 25.353 | 27.395 | 30.738 | 14.852 | 10.519 | 19.049 | 11.915 | 16.611 |
| NT2RP2005690 | 15.846 | 16.544 | 27.961 | 9.000 | 6.927 | 4.338 | 11.115 | 16.932 |
| NT2RP2005694 | 76.694 | 67.508 | 146.549 | 25.507 | 24.945 | 11.950 | 27.362 | 28.108 |
| NT2RP2005701 | 423.656 | 185.579 | 226.672 | 116.197 | 135.844 | 350.114 | 247.379 | 185.727 |
| NT2RP2005712 | 27.492 | 13.221 | 17.195 | 4.214 | 6.957 | 24.369 | 21.985 | 16.350 |
| NT2RP2005719 | 10.978 | 10.918 | 15.474 | 8.156 | 13.142 | 16.466 | 10.245 | 5.368 |

TABLE 87

| | | | | | | | | |
|---|---|---|---|---|---|---|---|---|
| NT2RP2005722 | 34.666 | 61.425 | 70.544 | 51.843 | 34.010 | 57.142 | 30.735 | 84.009 |
| NT2RP2005723 | 37.670 | 25.612 | 103.399 | 9.672 | 11.861 | 29.530 | 9.230 | 34.076 |
| NT2RP2005726 | 84.115 | 36.206 | 48.072 | 11.996 | 17.484 | 39.045 | 38.061 | 2.448 |
| NT2RP2005729 | 58.884 | 54.269 | 60.427 | 19.257 | 22.993 | 12.151 | 26.199 | 35.691 |
| NT2RP2005731 | 17.800 | 7.316 | 9.355 | 4.076 | 7.122 | 6.849 | 10.218 | 6.724 |
| NT2RP2005732 | 135.853 | 30.248 | 89.882 | 31.905 | 49.498 | 82.876 | 94.937 | 95.379 |
| NT2RP2005737 | 185.624 | 120.622 | 192.481 | 48.397 | 56.581 | 148.601 | 144.906 | 98.588 |
| NT2RP2005741 | 46.137 | 31.647 | 35.369 | 13.164 | 19.315 | 12.578 | 24.931 | 17.774 |
| NT2RP2005748 | 37.338 | 25.300 | 30.354 | 12.292 | 9.999 | 24.185 | 17.843 | 16.711 |
| NT2RP2005752 | 83.285 | 59.855 | 77.223 | 35.613 | 43.031 | 39.000 | 35.985 | 52.873 |
| NT2RP2005753 | 420.897 | 246.480 | 444.538 | 136.522 | 121.988 | 399.581 | 356.877 | 181.575 |
| NT2RP2005763 | 20.019 | 6.095 | 33.705 | 10.540 | 9.232 | 5.201 | 14.128 | 11.843 |
| NT2RP2005767 | 46.813 | 15.583 | 33.205 | 10.684 | 15.614 | 27.907 | 23.447 | 10.054 |
| NT2RP2005773 | 291.831 | 182.413 | 441.247 | 117.268 | 110.788 | 192.144 | 163.936 | 144.244 |
| NT2RP2005774 | 55.239 | 48.822 | 145.962 | 59.822 | 22.432 | 33.644 | 24.248 | 66.283 |
| NT2RP2005775 | 30.878 | 18.336 | 17.192 | 11.176 | 0.000 | 19.156 | 17.205 | 15.094 |
| NT2RP2005781 | 56.648 | 31.034 | 24.498 | 10.923 | 17.115 | 16.751 | 30.579 | 26.075 |
| NT2RP2005784 | 153.655 | 51.631 | 100.244 | 26.389 | 25.452 | 104.958 | 92.590 | 20.477 |

TABLE 87-continued

| | | | | | | | | |
|---|---|---|---|---|---|---|---|---|
| NT2RP2005789 | 74.249 | 51.916 | 68.043 | 24.721 | 19.271 | 60.694 | 30.122 | 14.401 |
| NT2RP2005799 | 71.863 | 10.045 | 12.797 | 6.316 | 3.181 | 47.328 | 6.050 | 3.897 |
| NT2RP2005804 | 52.496 | 43.561 | 70.286 | 25.906 | 16.838 | 25.088 | 23.482 | 31.711 |
| NT2RP2005812 | 49.420 | 17.666 | 27.165 | 8.036 | 15.484 | 13.521 | 16.634 | 20.990 |
| NT2RP2005815 | 27.570 | 20.859 | 32.235 | 11.501 | 9.452 | 14.728 | 19.248 | 36.742 |
| NT2RP2005835 | 112.785 | 78.188 | 150.766 | 35.828 | 53.880 | 99.576 | 62.221 | 32.500 |
| NT2RP2005841 | 41.693 | 18.145 | 43.677 | 15.477 | 18.203 | 8.667 | 17.036 | 33.652 |
| NT2RP2005853 | 70.296 | 52.756 | 205.381 | 30.242 | 23.198 | 54.689 | 16.871 | 24.992 |
| NT2RP2005857 | 23.173 | 20.068 | 18.329 | 34.075 | 5.778 | 4.049 | 6.163 | 12.771 |
| NT2RP2005859 | 33.168 | 17.202 | 37.200 | 12.544 | 13.483 | 19.950 | 9.659 | 26.739 |
| NT2RP2005860 | 31.260 | 19.609 | 26.277 | 8.837 | 10.871 | 17.943 | 20.399 | 13.975 |
| NT2RP2005863 | 21.267 | 29.851 | 26.528 | 17.209 | 15.572 | 12.614 | 18.527 | 11.789 |
| NT2RP2005868 | 39.601 | 30.998 | 45.149 | 22.672 | 23.499 | 19.410 | 12.734 | 17.486 |
| NT2RP2005876 | 182.087 | 242.226 | 222.167 | 16.258 | 31.298 | 2198.108 | 17.529 | 20.489 |
| NT2RP2005878 | 91.078 | 63.689 | 193.261 | 46.963 | 36.817 | 19.789 | 29.099 | 39.512 |
| NT2RP2005883 | 20.941 | 23.594 | 20.782 | 9.131 | 19.950 | 18.957 | 6.938 | 12.667 |
| NT2RP2005886 | 39.296 | 39.439 | 60.317 | 47.352 | 18.027 | 22.441 | 30.721 | 46.169 |
| NT2RP2006887 | 57.014 | 35.877 | 88.514 | 16.318 | 48.626 | 59.689 | 24.351 | 36.393 |
| NT2RP2005890 | 1.467 | 3.944 | 6.429 | 8.930 | 1.110 | 0.000 | 0.985 | 1.454 |
| NT2RP2005901 | 20.981 | 6.590 | 21.187 | 2.036 | 7.367 | 5.299 | 7.158 | 4.126 |
| NT2RP2005902 | 20.393 | 16.947 | 32.820 | 8.084 | 22.093 | 14.130 | 8.168 | 6.766 |
| NT2RP2005908 | 151.932 | 107.992 | 314.719 | 54.159 | 56.994 | 88.516 | 49.539 | 55.664 |
| NT2RP2005927 | 44.735 | 18.407 | 16.648 | 7.455 | 11.632 | 30.787 | 17.918 | 15.966 |
| NT2RP2005933 | 9.824 | 12.141 | 12.068 | 9.453 | 13.104 | 26.904 | 7.543 | 21.967 |
| NT2RP2005941 | 212.014 | 56.163 | 125.056 | 30.940 | 64.307 | 146.736 | 115.114 | 49.381 |
| NT2RP2005942 | 18.504 | 15.139 | 25.696 | 8.924 | 13.074 | 17.417 | 7.750 | 20.426 |
| NT2RP2005946 | 9.728 | 10.356 | 21.222 | 6.005 | 9.750 | 8.251 | 6.713 | 15.168 |
| NT2RP2005970 | 270.432 | 161.716 | 481.318 | 122.569 | 121.562 | 121.380 | 132.328 | 127.095 |
| NT2RP2005980 | 46.492 | 47.170 | 116.755 | 26.037 | 32.671 | 22.244 | 18.314 | 24.318 |
| NT2RP2005994 | 24.928 | 29.869 | 28.280 | 11.011 | 14.761 | 16.126 | 15.547 | 12.085 |
| NT2RP2006004 | 33.199 | 22.482 | 40.736 | 2.254 | 13.327 | 15.670 | 22.705 | 28.705 |
| NT2RP2006013 | 37.195 | 30.477 | 49.417 | 14.196 | 16.611 | 24.253 | 14.883 | 27.870 |
| NT2RP2006023 | 352.327 | 279.775 | 760.112 | 199.154 | 108.052 | 252.378 | 165.286 | 194.967 |
| NT2RP2006028 | 16.154 | 16.322 | 9.466 | 8.482 | 6.921 | 16.415 | 12.189 | 19.676 |
| NT2RP2006038 | 0.000 | 0.000 | 0.000 | 2.022 | 0.000 | 0.000 | 2.750 | 0.000 |
| NT2RP2006042 | 171.799 | 43.226 | 84.802 | 30.749 | 34.076 | 105.581 | 87.203 | 50.321 |
| NT2RP2006043 | 42.853 | 34.278 | 46.615 | 31.083 | 20.581 | 20.396 | 21.562 | 24.255 |
| NT2RP2006052 | 81.736 | 38.197 | 32.678 | 22.263 | 18.783 | 11.840 | 20.855 | 18.722 |
| NT2RP2006057 | 10.366 | 16.636 | 17.971 | 3.253 | 8.817 | 19.481 | 5.521 | 4.099 |
| NT2RP2006064 | 49.505 | 48.411 | 44.958 | 10.467 | 13.976 | 35.690 | 11.141 | 42.302 |
| NT2RP2006068 | 32.753 | 25.167 | 31.742 | 12.673 | 13.801 | 29.984 | 17.008 | 20.715 |
| NT2RP2006069 | 5.168 | 1.476 | 0.000 | 0.885 | 3.204 | 1.811 | 3.399 | 1.150 |
| NT2RP2006071 | 44.047 | 28.636 | 40.383 | 20.021 | 15.376 | 32.715 | 25.050 | 58.869 |
| NT2RP2006090 | 36.345 | 15.495 | 26.707 | 7.612 | 10.138 | 27.073 | 18.729 | 16.094 |
| NT2RP2006092 | 26.028 | 24.133 | 41.028 | 12.793 | 22.737 | 20.714 | 23.958 | 24.611 |
| NT2RP2006097 | 26.828 | 35.230 | 63.866 | 22.123 | 14.392 | 27.780 | 13.780 | 24.430 |

TABLE 88

| | | | | | | | | |
|---|---|---|---|---|---|---|---|---|
| NT2RP2006098 | 9.221 | 8.862 | 15.825 | 1.548 | 7.695 | 2.607 | 2.890 | 5.114 |
| NT2RP2006099 | 36.984 | 26.268 | 76.849 | 17.513 | 9.927 | 22.657 | 13.432 | 24.422 |
| NT2RP2006100 | 6.166 | 9.812 | 13.286 | 1.403 | 7.183 | 10.053 | 6.143 | 24.935 |
| NT2RP2006103 | 61.199 | 24.990 | 32.481 | 5.365 | 8.444 | 14.474 | 6.643 | 15.554 |
| NT2RP2006106 | 160.473 | 47.046 | 79.073 | 14.926 | 42.304 | 95.141 | 66.256 | 54.310 |
| NT2RP2006127 | 299.049 | 72.341 | 157.315 | 35.299 | 69.360 | 160.904 | 129.470 | 82.790 |
| NT2RP2006134 | 7.925 | 6.856 | 14.868 | 7.190 | 5.404 | 8.696 | 12.032 | 8.793 |
| NT2RP2006141 | 34.209 | 25.853 | 25.279 | 11.925 | 12.291 | 24.288 | 16.957 | 12.817 |
| NT2RP2006166 | 145.927 | 143.316 | 390.446 | 53.472 | 49.950 | 70.158 | 31.362 | 36.423 |
| NT2RP2006176 | 38.237 | 32.296 | 48.672 | 13.808 | 41.752 | 37.097 | 22.363 | 19.576 |
| NT2RP2006181 | 7.938 | 2.562 | 3.108 | 2.599 | 3.019 | 2.533 | 2.693 | 7.338 |
| NT2RP2006184 | 427.733 | 164.565 | 311.744 | 90.540 | 136.553 | 294.751 | 209.379 | 191.687 |
| NT2RP2006186 | 9.611 | 7.571 | 10.891 | 2.107 | 7.906 | 2.215 | 13.759 | 17.231 |
| NT2RP2006196 | 64.570 | 46.625 | 187.805 | 24.294 | 26.945 | 31.212 | 13.067 | 38.607 |
| NT2RP2006199 | 32.521 | 17.361 | 28.888 | 10.561 | 7.708 | 21.719 | 25.552 | 11.042 |
| NT2RP2006200 | 45.197 | 30.904 | 68.326 | 12.637 | 20.289 | 14.015 | 24.697 | 16.848 |
| NT2RP2006210 | 13.063 | 42.759 | 41.239 | 76.812 | 21.527 | 21.342 | 4.951 | 46.272 |
| NT2RP2006219 | 19.770 | 12.088 | 17.232 | 4.165 | 9.125 | 6.702 | 12.944 | 14.193 |
| NT2RP2006224 | 56.084 | 46.968 | 124.695 | 25.238 | 22.235 | 39.796 | 14.970 | 39.612 |
| NT2RP2006237 | 23.936 | 13.588 | 29.768 | 8.240 | 8.266 | 24.478 | 15.621 | 12.940 |
| NT2RP2006238 | 30.339 | 10.705 | 17.681 | 1.647 | 9.826 | 9.810 | 5.796 | 9.385 |
| NT2RP2006258 | 134.594 | 65.669 | 94.583 | 35.749 | 42.474 | 37.896 | 67.144 | 58.117 |
| NT2RP2006261 | 30.527 | 20.607 | 20.756 | 7.023 | 10.500 | 26.668 | 20.779 | 32.986 |
| NT2RP2006269 | 273.686 | 190.160 | 282.087 | 75.118 | 88.026 | 221.069 | 173.956 | 143.367 |
| NT2RP2006275 | 85.280 | 39.874 | 56.619 | 10.486 | 19.434 | 48.212 | 55.210 | 39.859 |
| NT2RP2006282 | 18.372 | 26.364 | 78.637 | 7.247 | 13.037 | 10.134 | 7.395 | 10.427 |
| NT2RP2006302 | 35.243 | 63.455 | 48.101 | 22.449 | 24.844 | 39.182 | 9.675 | 14.948 |

TABLE 88-continued

| | | | | | | | | |
|---|---|---|---|---|---|---|---|---|
| NT2RP2006312 | 65.434 | 60.394 | 81.415 | 26.895 | 27.020 | 35.036 | 41.172 | 38.133 |
| NT2RP2006320 | 42.111 | 32.881 | 107.012 | 21.102 | 25.087 | 24.083 | 19.555 | 40.879 |
| NT2RP2006321 | 7.504 | 10.403 | 35.594 | 9.608 | 9.770 | 25.528 | 7.823 | 3.899 |
| NT2RP2006323 | 7.851 | 2.520 | 3.223 | 1.919 | 1.885 | 6.166 | 3.878 | 3.640 |
| NT2RP2006333 | 30.987 | 16.865 | 28.885 | 6.560 | 9.086 | 8.529 | 9.411 | 9.392 |
| NT2RP2006334 | 12.349 | 6.246 | 10.111 | 7.506 | 2.643 | 10.779 | 6.657 | 9.120 |
| NT2RP2006338 | 3.452 | 3.965 | 5.603 | 1.571 | 3.999 | 1.378 | 0.000 | 6.658 |
| NT2RP2006339 | 25.764 | 16.783 | 14.506 | 7.871 | 9.927 | 10.052 | 16.010 | 8.999 |
| NT2RP2006355 | 20.663 | 13.101 | 11.565 | 6.563 | 7.455 | 7.126 | 9.386 | 6.085 |
| NT2RP2006365 | 4.545 | 5.794 | 3.527 | 6.016 | 4.317 | 2.172 | 4.635 | 2.088 |
| NT2RP2006374 | 411.795 | 181.700 | 244.772 | 88.732 | 81.469 | 224.300 | 186.562 | 160.290 |
| NT2RP2006393 | 49.201 | 46.271 | 138.242 | 24.009 | 21.170 | 18.558 | 17.331 | 21.921 |
| NT2RP2006394 | 28.334 | 29.547 | 20.558 | 4.570 | 13.741 | 24.300 | 15.936 | 15.737 |
| NT2RP2006400 | 24.921 | 12.448 | 22.520 | 10.436 | 6.781 | 12.164 | 12.987 | 14.072 |
| NT2RP2006411 | 170.083 | 45.848 | 109.486 | 76.812 | 50.885 | 136.021 | 80.411 | 46.178 |
| NT2RP2006429 | 17.592 | 22.689 | 50.747 | 10.696 | 17.317 | 23.371 | 18.641 | 17.956 |
| NT2RP2006435 | 55.611 | 34.885 | 57.426 | 16.304 | 26.895 | 37.137 | 39.774 | 37.506 |
| NT2RP2006436 | 152.017 | 117.923 | 294.214 | 79.789 | 75.537 | 107.196 | 47.063 | 35.486 |
| NT2RP2006441 | 24.518 | 19.297 | 41.744 | 27.285 | 33.736 | 14.991 | 17.341 | 13.076 |
| NT2RP2006447 | 13.367 | 6.103 | 5.701 | 2.225 | 4.629 | 8.175 | 4.129 | 2.450 |
| NT2RP2006454 | 12.135 | 6.375 | 11.243 | 2.681 | 0.000 | 18.444 | 3.071 | 5.464 |
| NT2RP2006455 | 11.895 | 17.452 | 13.837 | 6.890 | 6.158 | 14.783 | 6.071 | 8.830 |
| NT2RP2006456 | 38.021 | 19.288 | 35.373 | 9.022 | 12.219 | 34.935 | 12.195 | 8.454 |
| NT2RP2006464 | 65.475 | 59.218 | 64.107 | 23.982 | 11.975 | 46.736 | 45.415 | 26.468 |
| NT2RP2006467 | 182.556 | 82.534 | 110.746 | 33.773 | 58.531 | 134.845 | 89.415 | 79.911 |
| NT2RP2006472 | 52.035 | 81.984 | 49.222 | 27.110 | 22.246 | 58.236 | 23.092 | 21.013 |
| NT2RP2006474 | 87.750 | 59.508 | 90.991 | 40.960 | 68.884 | 46.386 | 41.819 | 43.544 |
| NT2RP2006475 | 31.939 | 25.175 | 56.713 | 5.942 | 98.476 | 222.460 | 20.356 | 7.479 |
| NT2RP2006476 | 21.072 | 30.518 | 25.064 | 26.064 | 6.000 | 10.383 | 11.027 | 21.451 |
| NT2RP2006501 | 49.705 | 32.865 | 29.408 | 27.184 | 4.907 | 32.045 | 10.526 | 22.257 |
| NT2RP2006512 | 27.180 | 32.082 | 24.613 | 26.192 | 14.264 | 30.488 | 12.111 | 19.931 |
| NT2RP2006526 | 1.990 | 16.410 | 1.143 | 0.714 | 1.146 | 0.000 | 1.142 | 0.000 |
| NT2RP2006527 | 89.786 | 37.810 | 65.465 | 19.956 | 29.390 | 58.611 | 41.655 | 42.817 |
| NT2RP2006534 | 12.307 | 17.082 | 25.981 | 7.920 | 10.780 | 7.152 | 5.503 | 7.803 |
| NT2RP2006537 | 152.141 | 97.164 | 238.317 | 56.113 | 45.970 | 66.047 | 31.701 | 24.076 |
| NT2RP2006543 | 41.814 | 17.923 | 95.586 | 6.904 | 6.956 | 16.769 | 11.226 | 15.747 |
| NT2RP2006554 | 5.859 | 5.374 | 21.959 | 8.776 | 3.884 | 8.154 | 5.595 | 4.909 |

TABLE 89

| | | | | | | | | |
|---|---|---|---|---|---|---|---|---|
| NT2RP2006565 | 8.167 | 7.704 | 24.371 | 5.814 | 14.320 | 10.696 | 2.358 | 4.111 |
| NT2RP2006571 | 279.311 | 52.710 | 116.641 | 23.676 | 53.970 | 199.457 | 130.143 | 46.164 |
| NT2RP2006573 | 14.833 | 9.728 | 14.833 | 10.165 | 4.273 | 12.181 | 5.836 | 11.189 |
| NT2RP2006598 | 50.217 | 58.672 | 84.436 | 36.450 | 20.183 | 47.448 | 27.628 | 33.428 |
| NT2RP2006601 | 363.326 | 80.354 | 103.722 | 48.729 | 76.933 | 194.071 | 89.671 | 34.186 |
| NT2RP3000002 | 54.787 | 35.587 | 138.409 | 14.410 | 15.645 | 42.782 | 17.893 | 13.809 |
| NT2RP3000011 | 86.241 | 70.778 | 179.249 | 26.157 | 23.114 | 44.263 | 20.905 | 26.577 |
| NT2RP3000014 | 13.859 | 16.745 | 34.145 | 13.964 | 62.052 | 11.790 | 6.030 | 23.999 |
| NT2RP3000016 | 37.105 | 33.786 | 44.744 | 13.554 | 18.247 | 35.947 | 22.381 | 14.827 |
| NT2RP3000022 | 94.200 | 21.219 | 43.091 | 11.156 | 18.896 | 66.602 | 28.935 | 18.892 |
| NT2RP3000024 | 7.842 | 17.722 | 80.534 | 57.536 | 15.195 | 28.526 | 14.924 | 31.215 |
| NT2RP3000031 | 40.539 | 15.466 | 45.699 | 14.680 | 16.043 | 21.658 | 37.591 | 14.624 |
| NT2RP3000034 | 47.041 | 16.354 | 46.033 | 9.722 | 17.283 | 27.871 | 22.418 | 14.394 |
| NT2RP3000037 | 207.077 | 121.888 | 344.732 | 90.995 | 100.871 | 120.707 | 93.233 | 68.047 |
| NT2RP3000040 | 19.046 | 21.059 | 10.120 | 5.362 | 4.717 | 7.751 | 13.678 | 12.858 |
| NT2RP3000041 | 52.107 | 45.044 | 152.312 | 40.210 | 22.300 | 35.890 | 26.992 | 49.633 |
| NT2RP3000046 | 66.472 | 44.521 | 156.649 | 32.533 | 24.374 | 70.316 | 23.701 | 21.537 |
| NTZRP3000047 | 67.673 | 24.262 | 49.113 | 15.475 | 21.518 | 33.173 | 30.093 | 27.627 |
| NT2RP3000049 | 48.739 | 25.122 | 91.910 | 30.451 | 29.572 | 32.060 | 28.583 | 20.154 |
| NT2RP3000050 | 26.074 | 40.719 | 88.636 | 24.767 | 22.328 | 23.604 | 11.688 | 48.303 |
| NT2RP3000051 | 66.710 | 26.569 | 41.823 | 15.685 | 23.009 | 34.385 | 30.860 | 29.647 |
| NT2RP3000054 | 102.785 | 62.230 | 100.267 | 27.596 | 31.738 | 71.470 | 53.863 | 44.388 |
| NT2RP3000055 | 75.199 | 57.387 | 100.976 | 32.041 | 39.402 | 46.743 | 33.378 | 38.034 |
| NT2RP3000056 | 39.543 | 22.913 | 30.865 | 6.902 | 18.029 | 31.675 | 21.577 | 18.143 |
| NT2RP3000059 | 37.238 | 25.053 | 41.439 | 8.975 | 11.901 | 30.284 | 16.708 | 27.602 |
| NT2RP3000063 | 185.029 | 52.340 | 95.324 | 25.648 | 51.543 | 102.170 | 98.453 | 32.215 |
| NT2RP3000068 | 31.037 | 24.156 | 26.439 | 9.761 | 13.197 | 30.638 | 22.295 | 20.840 |
| NT2RP3000069 | 10.170 | 17.834 | 29.064 | 3.122 | 10.074 | 26.020 | 12.191 | 15.438 |
| NT2RP3000072 | 14.842 | 17.988 | 11.379 | 7.153 | 9.559 | 10.360 | 3.475 | 9.404 |
| NT2RP3000080 | 324.225 | 127.554 | 363.840 | 79.623 | 88.104 | 197.811 | 132.385 | 96.818 |
| NT2RP3000085 | 51.661 | 29.771 | 37.844 | 10.819 | 18.134 | 39.828 | 23.587 | 17.525 |
| NT2RP3000087 | 17.091 | 10.622 | 46.219 | 24.865 | 22.511 | 28.404 | 15.603 | 41.935 |
| NT2RP3000092 | 35.685 | 15.980 | 24.034 | 8.335 | 8.477 | 12.472 | 10.082 | 10.611 |
| NT2RP3000109 | 18.561 | 16.632 | 14.110 | 13.437 | 4.116 | 20.790 | 11.884 | 10.865 |
| NT2RP3000119 | 77.508 | 36.674 | 39.664 | 14.435 | 17.248 | 54.174 | 31.225 | 36.072 |
| NT2RP3000125 | 73.603 | 69.403 | 81.547 | 42.247 | 34.639 | 56.907 | 38.200 | 46.977 |

TABLE 89-continued

| | | | | | | | | |
|---|---|---|---|---|---|---|---|---|
| NT2RP3000131 | 120.919 | 64.403 | 90.654 | 35.148 | 31.692 | 68.253 | 45.665 | 51.614 |
| NT2RP3000134 | 112.388 | 83.404 | 239.571 | 43.058 | 33.667 | 26.549 | 37.483 | 34.264 |
| NT2RP3000137 | 62.456 | 42.787 | 44.389 | 14.934 | 21.465 | 33.205 | 29.974 | 26.136 |
| NT2RP3000142 | 26.473 | 48.731 | 52.053 | 38.739 | 20.973 | 36.445 | 18.076 | 21.664 |
| NT2RP3000148 | 63.507 | 22.034 | 36.823 | 8.026 | 12.884 | 44.451 | 23.171 | 18.256 |
| NT2RP3000149 | 97.776 | 30.350 | 50.788 | 16.701 | 25.676 | 64.729 | 43.962 | 43.994 |
| NT2RP3000163 | 26.802 | 19.938 | 31.411 | 6.275 | 9.088 | 20.951 | 21.878 | 23.068 |
| NT2RP3000168 | 795.144 | 114.786 | 283.896 | 44.650 | 145.359 | 605.075 | 401.513 | 129.011 |
| NT2RP3000169 | 24.676 | 16.941 | 26.930 | 10.017 | 9.998 | 22.440 | 17.412 | 12.677 |
| NT2RP3000171 | 98.370 | 112.386 | 277.503 | 71.994 | 84.185 | 92.446 | 72.076 | 90.890 |
| NT2RP3000172 | 61.369 | 27.571 | 34.375 | 12.627 | 22.318 | 30.658 | 22.317 | 17.859 |
| NT2RP3000186 | 94.000 | 91.952 | 162.821 | 37.334 | 35.006 | 23.969 | 28.600 | 28.365 |
| NT2RP3000197 | 73.123 | 35.637 | 164.002 | 24.125 | 21.785 | 35.486 | 29.445 | 24.978 |
| NT2RP3000201 | 102.553 | 70.806 | 142.754 | 44.107 | 29.649 | 62.714 | 48.605 | 33.413 |
| NT2RP3000204 | 18.200 | 14.164 | 20.111 | 7.985 | 6.611 | 22.398 | 6.414 | 16.458 |
| NT2RP3000207 | 156.781 | 36.850 | 65.015 | 12.469 | 27.276 | 91.928 | 59.198 | 23.678 |
| NT2RP3000216 | 198.806 | 79.206 | 109.849 | 21.139 | 46.927 | 98.763 | 89.370 | 46.993 |
| NT2RP3000220 | 41.042 | 21.189 | 35.304 | 10.343 | 13.834 | 34.368 | 22.050 | 8.817 |
| NT2RP3000221 | 14.840 | 11.900 | 19.520 | 9.467 | 7.825 | 20.185 | 21.420 | 5.118 |
| NT2RP3000232 | 27.369 | 22.973 | 47.647 | 25.604 | 26.475 | 26.635 | 21.694 | 58.778 |
| NT2RP3000233 | 29.604 | 18.166 | 20.836 | 7.062 | 10.046 | 10.901 | 14.488 | 13.964 |
| NT2RP3000234 | 81.664 | 54.616 | 83.379 | 20.000 | 23.342 | 34.772 | 28.379 | 31.629 |
| NT2RP3000235 | 83.990 | 44.388 | 63.809 | 18.177 | 16.009 | 48.324 | 46.171 | 18.108 |
| NT2RP3000239 | 37.735 | 37.968 | 34.913 | 18.056 | 20.915 | 38.341 | 15.352 | 39.089 |
| NT2RP3000247 | 39.588 | 21.300 | 20.867 | 8.851 | 13.233 | 20.777 | 17.822 | 10.760 |
| NT2RP3000251 | 113.350 | 59.317 | 72.549 | 22.848 | 36.203 | 92.438 | 60.767 | 66.928 |
| NT2RP3000252 | 60.796 | 43.494 | 58.311 | 14.499 | 17.495 | 33.029 | 20.185 | 17.559 |
| NT2RP3000255 | 70.857 | 30.714 | 38.046 | 8.728 | 10.951 | 35.304 | 33.779 | 15.636 |

TABLE 90

| | | | | | | | | |
|---|---|---|---|---|---|---|---|---|
| NT2RP3000262 | 12.216 | 24.325 | 22.227 | 10.435 | 13.784 | 14.416 | 11.609 | 16.866 |
| NT2RP3000266 | 60.888 | 57.736 | 67.209 | 20.988 | 24.591 | 38.289 | 23.653 | 41.422 |
| NT2RP3000267 | 44.661 | 37.513 | 25.280 | 10.160 | 9.316 | 10.177 | 21.121 | 21.341 |
| NT2RP3000271 | 83.084 | 46.052 | 52.186 | 20.876 | 28.139 | 32.541 | 43.838 | 26.269 |
| NT2RP3000278 | 32.035 | 43.936 | 47.584 | 38.351 | 21.589 | 32.926 | 27.054 | 36.075 |
| NT2RP3000281 | 90.519 | 61.619 | 132.576 | 27.694 | 29.002 | 49.528 | 37.903 | 38.324 |
| NT2RP3000292 | 3.966 | 10.376 | 3.409 | 3.495 | 2.695 | 5.631 | 11.626 | 1.198 |
| NT2RP3000299 | 59.244 | 17.953 | 32.272 | 11.088 | 19.017 | 25.398 | 24.814 | 30.991 |
| NT2RP3000304 | 112.022 | 42.176 | 44.039 | 17.256 | 21.312 | 68.495 | 41.001 | 11.248 |
| NT2RP3000310 | 51.923 | 40.371 | 23.866 | 18.763 | 12.225 | 17.033 | 12.288 | 8.239 |
| NT2RP3000312 | 53.784 | 42.298 | 111.962 | 28.662 | 28.499 | 47.636 | 21.749 | 17.055 |
| NT2RP3000320 | 207.335 | 105.256 | 82.557 | 32.315 | 34.370 | 306.433 | 171.177 | 16.257 |
| NT2RP3000322 | 58.959 | 145.034 | 68.676 | 49.667 | 43.457 | 53.749 | 59.223 | 53.805 |
| NT2RP3000324 | 48.873 | 14.767 | 34.844 | 16.823 | 13.446 | 25.783 | 30.738 | 24.781 |
| NT2RP3000326 | 65.235 | 51.932 | 107.139 | 28.709 | 7.123 | 38.932 | 21.519 | 21.276 |
| NT2RP3000329 | 93.768 | 78.384 | 210.960 | 64.677 | 30.715 | 47.282 | 30.786 | 30.002 |
| NT2RP3000330 | 24.642 | 49.689 | 27.966 | 9.468 | 6.970 | 26.195 | 18.445 | 15.597 |
| NT2RP3000333 | 6.551 | 4.474 | 6.490 | 3.373 | 1.210 | 8.119 | 6.219 | 2.641 |
| NT2RP3000341 | 105.554 | 78.685 | 292.105 | 48.172 | 44.341 | 47.850 | 37.664 | 24.434 |
| NT2RP3000344 | 21.848 | 16.348 | 18.737 | 15.208 | 14.171 | 11.842 | 9.663 | 8.826 |
| NT2RP3000345 | 13.615 | 4.231 | 8.891 | 4.341 | 4.244 | 9.519 | 7.200 | 2.442 |
| NT2RP3000348 | 215.751 | 824.234 | 231.063 | 124.822 | 216.289 | 288.551 | 206.453 | 397.251 |
| NT2RP3000350 | 75.031 | 53.082 | 54.573 | 26.912 | 16.935 | 64.380 | 20.038 | 26.035 |
| NT2RP3000359 | 60.599 | 28.652 | 25.133 | 36.113 | 16.097 | 67.120 | 56.693 | 48.617 |
| NT2RP3000361 | 97.227 | 40.753 | 62.678 | 25.399 | 25.559 | 78.478 | 40.608 | 39.929 |
| NT2RP3000366 | 29.933 | 23.388 | 51.997 | 16.575 | 24.680 | 39.191 | 19.302 | 20.995 |
| NT2RP3000378 | 36.122 | 36.646 | 53.425 | 29.190 | 18.810 | 14.993 | 29.540 | 12.427 |
| NT2RP3000384 | 94.244 | 64.810 | 247.061 | 65.250 | 53.993 | 55.586 | 28.548 | 35.998 |
| NT2RP3000389 | 145.164 | 130.566 | 88.715 | 60.458 | 59.767 | 126.866 | 46.046 | 46.304 |
| NT2RP3000393 | 34.304 | 26.482 | 38.672 | 12.816 | 10.966 | 53.247 | 23.028 | 22.722 |
| NT2RP3000395 | 130.734 | 261.655 | 185.074 | 139.360 | 67.626 | 191.905 | 113.593 | 356.673 |
| NT2RP3000397 | 23.796 | 14.400 | 15.115 | 8.197 | 10.685 | 19.437 | 11.865 | 15.686 |
| NT2RP3000398 | 53.315 | 53.724 | 168.232 | 39.457 | 13.432 | 46.057 | 24.302 | 28.636 |
| NT2RP3000403 | 57.006 | 49.114 | 63.081 | 38.685 | 24.406 | 48.333 | 25.226 | 24.101 |
| NT2RP3000418 | 50.531 | 48.172 | 170.356 | 32.562 | 26.123 | 10.592 | 29.707 | 10.604 |
| NT2RP3000424 | 63.365 | 21.340 | 38.478 | 16.563 | 16.925 | 53.214 | 30.826 | 17.735 |
| NT2RP3000427 | 62.721 | 39.857 | 128.557 | 24.313 | 28.283 | 29.359 | 22.716 | 18.652 |
| NT2RP3000431 | 16.834 | 8.211 | 12.394 | 7.692 | 12.872 | 8.065 | 13.418 | 13.114 |
| NT2RP3000433 | 50.616 | 79.462 | 104.236 | 42.090 | 39.902 | 42.064 | 33.371 | 38.488 |
| NT2RP3000436 | 16.242 | 16.422 | 40.709 | 16.813 | 6.539 | 20.516 | 10.885 | 17.733 |
| NT2RP3000439 | 71.848 | 23.969 | 40.354 | 14.754 | 15.239 | 53.741 | 31.396 | 8.363 |
| NT2RP3000441 | 11.212 | 9.002 | 12.696 | 5.044 | 10.679 | 13.013 | 5.428 | 5.597 |
| NT2RP3000444 | 22.933 | 18.685 | 29.664 | 9.645 | 13.646 | 17.025 | 18.757 | 13.305 |
| NT2RP3000448 | 33.060 | 20.309 | 55.374 | 17.566 | 24.368 | 22.687 | 16.155 | 11.895 |
| NT2RP3000449 | 6.959 | 23.459 | 17.422 | 10.472 | 7.118 | 8.871 | 9.364 | 3.475 |

TABLE 90-continued

| | | | | | | | | |
|---|---|---|---|---|---|---|---|---|
| NT2RP3000451 | 125.446 | 62.063 | 59.005 | 22.337 | 34.264 | 60.126 | 41.591 | 27.148 |
| NT2RP3000456 | 88.916 | 43.502 | 69.366 | 17.277 | 29.249 | 56.726 | 42.776 | 41.151 |
| NT2RP3000460 | 53.276 | 27.765 | 47.239 | 14.257 | 14.152 | 40.035 | 29.749 | 13.869 |
| NT2RP3000471 | 120.686 | 35.942 | 65.409 | 19.114 | 21.966 | 84.016 | 40.300 | 40.267 |
| NT2RP3000477 | 135.254 | 69.833 | 123.785 | 56.384 | 66.460 | 143.732 | 64.962 | 29.801 |
| NF2RP3000478 | 29.313 | 21.768 | 61.753 | 10.082 | 21.998 | 33.287 | 14.477 | 44.282 |
| NT2RP3000481 | 10.750 | 3.732 | 5.456 | 0.726 | 2.539 | 11.124 | 6.047 | 2.438 |
| NT2RP3000484 | 37.552 | 21.006 | 28.635 | 15.721 | 14.002 | 24.786 | 24.639 | 18.179 |
| NT2RP3000487 | 57.292 | 37.922 | 107.654 | 33.349 | 33.101 | 34.015 | 30.560 | 34.378 |
| NT2RP3000512 | 40.012 | 21.185 | 25.342 | 10.503 | 13.140 | 44.846 | 27.137 | 10.397 |
| NT2RP3000523 | 99.365 | 56.104 | 57.485 | 32.088 | 34.445 | 78.588 | 42.509 | 36.741 |
| NT2RP3000526 | 45.488 | 30.104 | 53.085 | 16.516 | 10.374 | 24.429 | 16.363 | 12.300 |
| NT2RP3000527 | 44.308 | 22.761 | 18.000 | 7.682 | 12.301 | 36.809 | 24.394 | 15.830 |
| NT2RP3000531 | 317.473 | 170.480 | 234.934 | 104.005 | 126.165 | 204.346 | 175.754 | 116.929 |
| NT2RP3000532 | 69.884 | 23.745 | 36.210 | 16.034 | 19.464 | 37.931 | 28.117 | 30.722 |
| NT2RP3000542 | 53.226 | 27.049 | 115.161 | 42.422 | 30.182 | 44.442 | 28.283 | 44.087 |
| NT2RP3000554 | 46.760 | 48.740 | 47.313 | 22.048 | 25.077 | 32.396 | 21.710 | 28.087 |
| NT2RP3000561 | 34.700 | 20.076 | 36.509 | 11.166 | 12.551 | 31.072 | 12.335 | 21.743 |
| NT2RP3000562 | 61.916 | 30.119 | 37.119 | 14.204 | 15.849 | 36.832 | 26.415 | 21.173 |

TABLE 91

| | | | | | | | | |
|---|---|---|---|---|---|---|---|---|
| NT2RP3000578 | 15.402 | 10.162 | 16.063 | 7.228 | 4.718 | 6.130 | 9.838 | 13.311 |
| NT2RP3000582 | 39.271 | 21.923 | 38.385 | 15.003 | 10.964 | 17.246 | 14.457 | 23.415 |
| NT2RP3000584 | 50.928 | 29.642 | 70.817 | 14.592 | 15.938 | 25.450 | 18.096 | 13.886 |
| NT2RP3000586 | 104.429 | 33.153 | 41.205 | 15.381 | 26.618 | 56.849 | 60.938 | 32.115 |
| NT2RP3000590 | 26.385 | 19.138 | 20.258 | 7.852 | 11.948 | 19.961 | 17.171 | 14.281 |
| NT2RP3000592 | 38.458 | 13.253 | 18.849 | 6.663 | 11.214 | 15.506 | 10.347 | 13.365 |
| NT2RP3000596 | 97.160 | 124.897 | 111.320 | 54.127 | 55.968 | 95.489 | 58.183 | 68.801 |
| NT2RP3000599 | 27.723 | 23.836 | 21.699 | 6.517 | 10.630 | 24.268 | 12.753 | 5.443 |
| NT2RP3000603 | 58.661 | 36.820 | 44.037 | 20.279 | 17.695 | 42.330 | 42.704 | 30.254 |
| NT2RP3000605 | 28.480 | 12.057 | 23.849 | 6.629 | 7.081 | 16.695 | 13.635 | 14.891 |
| NT2RP3000607 | 24.868 | 40.289 | 21.827 | 5.879 | 13.852 | 13.642 | 13.588 | 19.173 |
| NT2RP3000616 | 13.295 | 18.170 | 13.744 | 4.297 | 8.368 | 12.637 | 6.395 | 3.593 |
| NT2RP3000621 | 32.066 | 35.204 | 40.136 | 10.823 | 13.912 | 32.917 | 35.694 | 30.496 |
| NT2RP3000622 | 77.250 | 48.804 | 56.101 | 26.510 | 26.964 | 60.270 | 33.756 | 35.001 |
| NT2RP3000624 | 69.148 | 40.431 | 50.570 | 17.495 | 18.274 | 44.392 | 30.661 | 19.154 |
| NT2RP3000628 | 101.279 | 78.344 | 315.194 | 66.794 | 47.806 | 62.753 | 39.571 | 65.891 |
| NT2RP3000631 | 83.274 | 57.931 | 64.862 | 38.915 | 26.193 | 49.662 | 32.548 | 66.985 |
| NT2RP3000632 | 75.512 | 46.888 | 137.791 | 36.803 | 25.072 | 37.533 | 39.161 | 39.835 |
| NT2RP3000638 | 42.585 | 33.637 | 37.613 | 14.925 | 17.500 | 33.937 | 31.430 | 24.095 |
| NT2RP3000644 | 165.984 | 142.937 | 393.193 | 71.526 | 75.904 | 86.493 | 86.017 | 83.257 |
| NT2RP3000645 | 406.046 | 291.113 | 353.711 | 137.438 | 154.952 | 264.140 | 265.679 | 203.054 |
| NT2RP3000652 | 27.913 | 38.545 | 66.305 | 53.070 | 30.592 | 38.016 | 20.919 | 70.560 |
| NT2RP3000658 | 119.274 | 49.302 | 84.139 | 19.097 | 26.904 | 41.744 | 58.038 | 42.209 |
| NT2RP3000660 | 154.015 | 93.717 | 291.388 | 47.970 | 61.811 | 77.378 | 54.638 | 32.448 |
| NT2RP3000661 | 61.960 | 37.363 | 58.907 | 19.857 | 23.806 | 34.888 | 27.236 | 22.377 |
| NF2RP3000665 | 36.030 | 11.500 | 21.945 | 7.361 | 8.773 | 16.187 | 15.502 | 4.205 |
| NT2RP3000676 | 93.465 | 71.379 | 82.472 | 34.775 | 44.271 | 57.208 | 63.670 | 56.415 |
| NT2RP3000677 | 112.363 | 32.537 | 52.925 | 14.666 | 38.145 | 49.852 | 47.252 | 14.122 |
| NT2RP3000681 | 36.511 | 66.476 | 75.231 | 35.416 | 18.401 | 37.570 | 41.478 | 66.253 |
| NT2RP3000683 | 58.416 | 64.592 | 97.551 | 38.537 | 29.638 | 37.665 | 22.530 | 57.162 |
| NT2RP3000685 | 114.973 | 74.466 | 133.468 | 30.843 | 36.634 | 44.885 | 43.642 | 44.225 |
| NT2RP3000690 | 44.317 | 22.720 | 28.586 | 11.755 | 16.142 | 19.525 | 23.913 | 12.295 |
| NT2RP3000698 | 67.409 | 29.101 | 27.424 | 12.677 | 18.813 | 30.558 | 35.120 | 22.330 |
| NT2RP3000708 | 69.762 | 31.242 | 34.468 | 18.438 | 17.109 | 25.677 | 35.649 | 27.340 |
| NT2RP3000719 | 101.619 | 37.708 | 40.561 | 16.843 | 22.310 | 30.132 | 41.665 | 29.714 |
| NT2RP3000721 | 62.292 | 33.883 | 41.328 | 20.719 | 17.808 | 29.864 | 31.463 | 34.754 |
| NT2RP3000728 | 15.781 | 13.248 | 15.483 | 9.343 | 7.806 | 5.356 | 8.199 | 8.869 |
| NT2RP3000730 | 16.503 | 10.183 | 12.261 | 4.259 | 5.390 | 10.857 | 12.834 | 7.121 |
| NT2RP3000733 | 55.476 | 33.770 | 134.994 | 26.531 | 11.886 | 24.025 | 14.564 | 29.631 |
| NT2RP3000735 | 21.669 | 7.407 | 9.693 | 5.816 | 9.383 | 28.210 | 2.497 | 11.449 |
| NT2RP3000736 | 44.789 | 26.680 | 38.153 | 13.731 | 16.809 | 30.640 | 25.306 | 25.557 |
| NT2RP3000739 | 206.032 | 42.295 | 130.965 | 26.071 | 58.557 | 146.191 | 92.971 | 37.396 |
| NT2RP3000742 | 348.588 | 140.896 | 195.591 | 50.032 | 81.126 | 190.392 | 158.586 | 73.831 |
| NT2RP3000753 | 62.272 | 31.221 | 40.211 | 20.489 | 20.282 | 94.033 | 25.801 | 41.475 |
| NT2RP3000759 | 29.716 | 22.350 | 32.951 | 18.751 | 26.712 | 22.364 | 11.768 | 12.157 |
| NT2RP3000789 | 39.203 | 42.612 | 22.684 | 12.737 | 16.316 | 24.563 | 14.289 | 8.744 |
| NT2RP3000815 | 81.211 | 54.520 | 145.901 | 29.707 | 22.766 | 48.640 | 24.152 | 22.295 |
| NT2RP3000818 | 77.152 | 41.510 | 81.608 | 27.176 | 30.804 | 51.380 | 29.052 | 28.761 |
| NT2RP3000820 | 76.041 | 118.421 | 231.975 | 55.326 | 38.009 | 77.248 | 35.255 | 64.172 |
| NT2RP3000821 | 125.957 | 64.013 | 112.255 | 27.822 | 47.320 | 81.799 | 57.688 | 32.892 |
| NT2RP3000825 | 4.611 | 0.000 | 4.826 | 2.088 | 0.000 | 3.614 | 3.042 | 11.736 |
| NT2RP3000826 | 143.292 | 64.787 | 162.627 | 46.686 | 56.407 | 101.167 | 61.127 | 46.725 |
| NT2RP3000836 | 83.974 | 80.423 | 210.942 | 45.858 | 32.214 | 23.251 | 37.753 | 44.587 |
| NT2RP3000838 | 199.574 | 535.714 | 166.498 | 90.546 | 149.924 | 216.645 | 161.565 | 295.666 |

TABLE 91-continued

| | | | | | | | | |
|---|---|---|---|---|---|---|---|---|
| NT2RP3000839 | 16.488 | 6.477 | 7.238 | 3.037 | 1.517 | 11.754 | 5.693 | 6.807 |
| NT2RP3000841 | 43.065 | 36.679 | 115.803 | 21.240 | 15.592 | 30.244 | 12.610 | 21.751 |
| NT2RP3000845 | 98.566 | 28.826 | 47.444 | 11.595 | 21.815 | 115.944 | 48.273 | 28.363 |
| NT2RP3000847 | 102.018 | 59.230 | 140.464 | 36.275 | 34.261 | 46.634 | 43.858 | 48.553 |
| NT2RP3000848 | 43.608 | 33.763 | 54.299 | 20.531 | 16.249 | 35.936 | 17.881 | 22.982 |
| NT2RP3000850 | 162.391 | 74.431 | 281.196 | 66.439 | 66.101 | 84.573 | 58.454 | 43.150 |
| NT2RP3000852 | 20.645 | 19.238 | 19.388 | 15.545 | 10.909 | 11.941 | 10.740 | 8.905 |
| NT2RP3000859 | 151.904 | 86.258 | 69.935 | 21.801 | 30.699 | 73.401 | 46.530 | 35.975 |
| NT2RP3000861 | 97.656 | 79.986 | 361.968 | 92.325 | 57.527 | 85.858 | 37.902 | 78.976 |
| NT2RP3000862 | 87.649 | 39.014 | 36.132 | 15.942 | 23.416 | 47.236 | 69.109 | 15.390 |

TABLE 92

| | | | | | | | | |
|---|---|---|---|---|---|---|---|---|
| NT2RP3000865 | 63.270 | 47.853 | 102.873 | 32.472 | 33.487 | 53.656 | 34.278 | 21.893 |
| NT2RP3000866 | 34.716 | 25.903 | 38.593 | 12.760 | 15.744 | 54.423 | 32.374 | 18.694 |
| NT2RP3000868 | 85.284 | 61.512 | 85.178 | 31.575 | 34.644 | 53.975 | 41.313 | 22.132 |
| NT2RP3000869 | 77.514 | 27.048 | 71.150 | 21.470 | 27.958 | 26.061 | 26.717 | 11.830 |
| NT2RP3000871 | 32.339 | 15.895 | 28.790 | 10.764 | 12.347 | 17.382 | 19.415 | 15.477 |
| NT2RP3000875 | 64.304 | 26.967 | 41.187 | 17.427 | 17.449 | 63.004 | 27.104 | 29.777 |
| NT2RP3000895 | 37.607 | 26.551 | 21.094 | 10.531 | 9.611 | 39.637 | 23.121 | 22.804 |
| NT2RP3000900 | 142.017 | 81.808 | 211.235 | 53.019 | 47.970 | 81.157 | 50.066 | 57.451 |
| NT2RP3000901 | 70.807 | 27.339 | 68.215 | 18.628 | 38.633 | 87.435 | 34.055 | 17.677 |
| NT2RP3000903 | 13.003 | 24.507 | 60.511 | 13.378 | 13.428 | 29.263 | 6.790 | 12.691 |
| NT2RP3000904 | 52.698 | 18.398 | 31.708 | 12.964 | 16.730 | 32.075 | 26.793 | 6.596 |
| NT2RP3000907 | 166.727 | 60.470 | 136.938 | 38.479 | 50.160 | 105.219 | 95.047 | 42.673 |
| NT2RP3000913 | 94.023 | 47.327 | 91.333 | 23.378 | 31.301 | 50.434 | 47.912 | 29.311 |
| NT2RP3000917 | 32.888 | 39.658 | 21.466 | 16.870 | 11.875 | 27.038 | 18.723 | 21.313 |
| NT2RP3000919 | 94.068 | 33.556 | 46.679 | 16.703 | 24.240 | 78.449 | 55.568 | 30.552 |
| NT2RP3000921 | 37.830 | 26.534 | 66.403 | 7.357 | 8.929 | 61.748 | 8.623 | 14.620 |
| NT2RP3000942 | 171.953 | 62.500 | 108.369 | 33.025 | 42.178 | 102.140 | 75.932 | 47.639 |
| NT2RP3000968 | 113.182 | 183.788 | 251.225 | 112.172 | 45.194 | 135.391 | 114.314 | 284.978 |
| NT2RP3000974 | 31.061 | 18.639 | 28.044 | 11.335 | 13.883 | 20.765 | 19.154 | 8.182 |
| NT2RP3000980 | 75.435 | 43.616 | 144.923 | 25.869 | 22.636 | 53.158 | 21.266 | 5.678 |
| NT2RP3000984 | 80.420 | 55.909 | 211.662 | 30.046 | 34.753 | 46.023 | 41.008 | 39.028 |
| NT2RP3000994 | 26.597 | 13.100 | 24.899 | 10.246 | 18.755 | 15.021 | 12.030 | 11.524 |
| NT2RP3001001 | 41.741 | 14.316 | 24.372 | 9.822 | 11.943 | 20.619 | 21.560 | 7.191 |
| NT2RP3001004 | 21.324 | 19.490 | 22.465 | 8.748 | 12.668 | 37.792 | 8.027 | 5.197 |
| NT2RP3001007 | 73.322 | 49.966 | 175.492 | 41.711 | 29.860 | 30.759 | 23.563 | 18.521 |
| NT2RP3001012 | 17.551 | 14.673 | 17.235 | 9.520 | 7.664 | 14.146 | 11.598 | 11.610 |
| NT2RP3001042 | 56.542 | 31.176 | 40.712 | 11.357 | 21.273 | 42.340 | 30.644 | 16.851 |
| NT2RP3001044 | 57.032 | 39.083 | 68.934 | 22.349 | 40.025 | 60.364 | 34.476 | 25.794 |
| NT2RP3001048 | 39.639 | 23.540 | 39.473 | 18.858 | 15.279 | 32.436 | 23.205 | 26.116 |
| NT2RP3001050 | 40.144 | 37.630 | 102.740 | 17.755 | 44.501 | 73.595 | 26.881 | 21.142 |
| NT2RP3001055 | 36.578 | 21.787 | 34.665 | 11.391 | 15.586 | 44.493 | 17.343 | 39.665 |
| NT2RP3001057 | 40.477 | 31.367 | 56.914 | 35.425 | 16.396 | 40.782 | 15.582 | 41.540 |
| NT2RP3001061 | 35.545 | 23.074 | 31.908 | 11.906 | 22.306 | 27.393 | 25.460 | 19.287 |
| NT2RP3001069 | 106.748 | 62.272 | 150.656 | 32.917 | 23.305 | 58.467 | 35.766 | 47.515 |
| NT2RP3001074 | 14.550 | 14.541 | 22.555 | 7.827 | 16.140 | 15.294 | 11.052 | 4.620 |
| NT2RP3001078 | 52.226 | 37.483 | 61.489 | 16.718 | 18.374 | 26.786 | 29.722 | 37.845 |
| NT2RP3001081 | 27.544 | 17.926 | 40.857 | 14.999 | 13.731 | 23.258 | 19.326 | 14.022 |
| NT2RP3001084 | 48.930 | 20.162 | 28.411 | 8.915 | 19.688 | 35.485 | 28.948 | 20.795 |
| NT2RP3001095 | 5.532 | 7.106 | 9.117 | 1.907 | 1.873 | 1.686 | 4.160 | 6.179 |
| NT2RP3001096 | 72.786 | 64.406 | 72.692 | 26.305 | 30.582 | 41.528 | 32.077 | 27.965 |
| NT2RP3001097 | 25.257 | 17.811 | 73.704 | 11.171 | 12.488 | 5.176 | 10.401 | 15.261 |
| NT2RP3001107 | 81.894 | 32.783 | 61.356 | 24.675 | 27.453 | 53.316 | 37.116 | 40.327 |
| NT2RP3001109 | 29.099 | 23.842 | 24.494 | 12.892 | 16.120 | 14.893 | 15.303 | 18.912 |
| NT2RP3001111 | 69.862 | 29.991 | 36.252 | 13.681 | 16.731 | 44.954 | 31.601 | 22.477 |
| NT2RP3001112 | 57.507 | 80.536 | 82.448 | 80.792 | 39.380 | 58.111 | 23.819 | 75.560 |
| NT2RP3001113 | 17.615 | 26.847 | 19.375 | 9.970 | 8.233 | 11.421 | 5.759 | 13.956 |
| NT2RP3001115 | 21.858 | 18.916 | 28.812 | 7.324 | 4.563 | 13.477 | 9.463 | 11.057 |
| NT2RP3001116 | 40.872 | 22.335 | 23.917 | 10.468 | 15.106 | 15.973 | 21.496 | 6.979 |
| NT2RP3001119 | 124.291 | 38.911 | 66.173 | 19.498 | 29.478 | 73.564 | 71.005 | 23.217 |
| NT2RP3001120 | 18.656 | 32.833 | 65.009 | 14.974 | 14.114 | 43.177 | 17.732 | 46.909 |
| NT2RP3001126 | 37.515 | 26.047 | 38.382 | 9.469 | 16.381 | 17.926 | 22.835 | 12.549 |
| NT2RP3001127 | 11.834 | 4.025 | 5.195 | 3.694 | 4.697 | 2.608 | 36.686 | 5.923 |
| NT2RP3001133 | 70.288 | 79.857 | 161.425 | 34.123 | 22.428 | 47.625 | 46.500 | 34.323 |
| NT2RP3001140 | 23.850 | 15.525 | 27.441 | 7.787 | 14.096 | 43.859 | 22.377 | 36.073 |
| NT2RP3001147 | 41.415 | 23.333 | 25.696 | 7.439 | 15.613 | 27.307 | 21.623 | 12.688 |
| NT2RP3001150 | 50.310 | 27.305 | 40.429 | 13.413 | 12.407 | 17.499 | 22.391 | 24.362 |
| NT2RP3001152 | 3.974 | 1.479 | 1.712 | 0.807 | 0.788 | 0.915 | 1.821 | 0.000 |
| NT2RP3001155 | 39.961 | 39.114 | 41.386 | 21.748 | 14.042 | 40.594 | 41.468 | 31.833 |
| NT2RP3001156 | 31.035 | 17.102 | 23.691 | 6.973 | 9.466 | 31.538 | 17.411 | 9.742 |
| NT2RP3001159 | 137.273 | 38.120 | 74.062 | 19.455 | 36.267 | 73.862 | 75.135 | 35.944 |
| NT2RP3001170 | 35.615 | 34.235 | 64.722 | 18.272 | 20.302 | 35.625 | 22.021 | 14.394 |
| NT2RP3001176 | 58.889 | 60.413 | 127.466 | 30.928 | 33.027 | 62.693 | 23.996 | 56.392 |
| NT2RP3001195 | 72.627 | 47.832 | 119.011 | 16.902 | 19.658 | 15.312 | 25.740 | 27.006 |
| NT2RP3001209 | 458.437 | 263.607 | 330.947 | 136.852 | 187.739 | 350.320 | 327.764 | 223.342 |

TABLE 93

| | | | | | | | | |
|---|---|---|---|---|---|---|---|---|
| NT2RP3001214 | 15.760 | 24.578 | 18.804 | 10.536 | 12.107 | 7.011 | 7.277 | 12.208 |
| NT2RP3001216 | 29.191 | 41.925 | 42.777 | 28.031 | 31.602 | 30.104 | 23.133 | 26.408 |
| NT2RP3001221 | 25.240 | 20.176 | 20.644 | 4.858 | 10.770 | 7.315 | 13.513 | 8.946 |
| NT2RP3001226 | 54.304 | 47.592 | 67.642 | 24.341 | 24.384 | 38.331 | 32.669 | 45.697 |
| NT2RP3001230 | 23.680 | 20.599 | 27.561 | 11.735 | 11.032 | 25.537 | 13.367 | 12.758 |
| NT2RP3001232 | 4.151 | 14.071 | 13.135 | 9.855 | 6.746 | 9.778 | 5.130 | 7.513 |
| NT2RP3001236 | 28.593 | 14.443 | 35.687 | 7.512 | 5.884 | 10.789 | 13.692 | 14.135 |
| NT2RP3001239 | 15.380 | 5.089 | 16.960 | 4.419 | 3.497 | 6.366 | 6.599 | 8.021 |
| NT2RP3001240 | 11.531 | 13.481 | 30.743 | 12.073 | 14.733 | 12.342 | 22.647 | 11.311 |
| NT2RP3001245 | 17.405 | 11.231 | 97.349 | 10.570 | 10.667 | 11.712 | 11.709 | 5.360 |
| NT2RP3001253 | 29.416 | 21.939 | 30.308 | 17.125 | 8.767 | 28.879 | 20.229 | 15.732 |
| NT2RP3001259 | 66.464 | 26.700 | 30.561 | 28.122 | 16.780 | 50.988 | 35.111 | 9.149 |
| NT2RP3001260 | 15.811 | 4.776 | 8.508 | 3.773 | 11.179 | 5.131 | 7.611 | 6.513 |
| NT2RP3001264 | 17.474 | 9.326 | 19.891 | 6.147 | 0.000 | 13.645 | 11.466 | 13.410 |
| NT2RP3001268 | 10.917 | 11.531 | 28.253 | 21.540 | 5.251 | 19.724 | 6.886 | 19.730 |
| NT2RP3001271 | 504.472 | 230.117 | 363.954 | 129.052 | 147.454 | 341.938 | 290.090 | 221.262 |
| NT2RP3001272 | 53.274 | 65.558 | 170.406 | 46.512 | 25.065 | 49.775 | 25.165 | 40.714 |
| NT2RP3001274 | 379.452 | 180.634 | 305.168 | 109.916 | 102.975 | 251.219 | 221.619 | 125.753 |
| NT2RP3001275 | 69.350 | 44.463 | 39.465 | 12.598 | 20.694 | 29.868 | 27.346 | 15.608 |
| NT2RP3001280 | 84.373 | 66.148 | 58.661 | 22.588 | 41.962 | 35.792 | 31.005 | 24.067 |
| NT2RP3001281 | 108.112 | 65.094 | 147.713 | 26.972 | 40.778 | 44.735 | 37.860 | 23.491 |
| NT2RP3001288 | 37.247 | 71.613 | 48.891 | 21.593 | 34.714 | 52.211 | 28.610 | 57.051 |
| NT2RP3001297 | 74.827 | 48.767 | 64.601 | 33.081 | 24.851 | 55.981 | 45.160 | 38.893 |
| NT2RP3001300 | 97.287 | 54.906 | 120.465 | 40.784 | 42.784 | 70.008 | 44.204 | 40.196 |
| NT2RP3001301 | 11.093 | 5.654 | 18.227 | 4.517 | 6.710 | 15.021 | 4.763 | 1.496 |
| NT2RP3001307 | 61.481 | 16.300 | 67.269 | 13.678 | 18.372 | 43.312 | 26.354 | 11.694 |
| NT2RP3001310 | 25.947 | 50.116 | 44.928 | 47.746 | 27.742 | 21.494 | 12.532 | 23.321 |
| NT2RP3001318 | 2.615 | 3.369 | 14.422 | 2.026 | 3.965 | 19.407 | 1.976 | 0.653 |
| NT2RP3001322 | 23.311 | 16.139 | 27.515 | 12.075 | 11.630 | 21.825 | 11.372 | 27.956 |
| NT2RP3001325 | 22.066 | 21.492 | 31.828 | 22.944 | 8.193 | 35.016 | 13.134 | 12.706 |
| NT2RP3001338 | 267.619 | 127.929 | 200.245 | 81.462 | 81.219 | 191.701 | 160.006 | 129.805 |
| NT2RP3001339 | 55.924 | 18.296 | 23.218 | 9.542 | 15.077 | 30.484 | 15.924 | 10.368 |
| NT2RP3001340 | 298.177 | 147.842 | 242.840 | 118.851 | 106.391 | 255.313 | 197.733 | 160.604 |
| NT2RP3001341 | 23.654 | 19.357 | 26.001 | 10.758 | 14.654 | 8.713 | 20.669 | 6.157 |
| NT2RP3001354 | 87.315 | 79.863 | 264.818 | 54.210 | 48.577 | 53.865 | 34.407 | 62.241 |
| NT2RP3001355 | 42.549 | 24.220 | 47.797 | 11.284 | 26.805 | 23.247 | 21.876 | 15.122 |
| NT2RP3001356 | 34.895 | 26.366 | 50.692 | 16.458 | 11.954 | 15.544 | 17.696 | 14.918 |
| NT2RP3001359 | 69.545 | 40.643 | 64.520 | 10.543 | 19.486 | 38.410 | 36.229 | 16.040 |
| NT2RP3001364 | 52.551 | 18.103 | 37.863 | 13.181 | 12.916 | 34.493 | 28.810 | 10.544 |
| NT2RP3001373 | 92.853 | 21.226 | 65.327 | 12.110 | 28.221 | 75.073 | 40.142 | 19.775 |
| NT2RP3001374 | 18.567 | 16.153 | 13.874 | 9.085 | 8.007 | 19.729 | 12.896 | 13.227 |
| NT2RP3001383 | 35.886 | 15.749 | 32.731 | 12.969 | 13.335 | 20.056 | 21.243 | 6.300 |
| NT2RP3001384 | 48.057 | 31.309 | 50.523 | 17.718 | 21.014 | 25.468 | 27.812 | 18.039 |
| NT2RP3001388 | 55.759 | 50.699 | 117.391 | 21.210 | 51.970 | 52.288 | 26.887 | 29.189 |
| NT2RP3001392 | 21.410 | 21.933 | 25.706 | 8.332 | 7.588 | 8.588 | 10.071 | 8.795 |
| NT2RP3001396 | 15.219 | 8.348 | 19.141 | 7.594 | 10.677 | 11.741 | 7.988 | 10.281 |
| NT2RP3001398 | 232.068 | 78.008 | 227.136 | 38.826 | 59.027 | 175.527 | 102.665 | 51.488 |
| NT2RP3001399 | 92.466 | 61.566 | 193.463 | 33.588 | 29.343 | 44.058 | 36.467 | 18.064 |
| NT2RP3001402 | 26.552 | 22.030 | 30.054 | 10.244 | 16.784 | 15.120 | 12.991 | 23.925 |
| NT2RP3001407 | 18.523 | 26.250 | 28.873 | 22.708 | 11.616 | 32.784 | 12.119 | 9.034 |
| NT2RP3001416 | 46.040 | 28.810 | 36.947 | 10.094 | 15.710 | 31.887 | 29.218 | 27.952 |
| NT2RP3001420 | 39.104 | 40.226 | 112.497 | 29.782 | 17.944 | 17.648 | 21.378 | 24.813 |
| NT2RP3001425 | 39.881 | 24.233 | 38.220 | 17.938 | 17.233 | 24.809 | 27.932 | 23.131 |
| NT2RP3001426 | 93.587 | 58.250 | 74.483 | 29.242 | 37.668 | 70.217 | 46.545 | 43.211 |
| NT2RP3001427 | 42.182 | 35.278 | 33.424 | 18.910 | 17.612 | 29.923 | 26.039 | 24.764 |
| NT2RP3001428 | 59.474 | 65.787 | 162.966 | 40.062 | 19.191 | 22.870 | 32.859 | 22.870 |
| NT2RP3001429 | 35.365 | 23.903 | 90.012 | 12.419 | 8.727 | 11.508 | 11.358 | 8.026 |
| NT2RP3001432 | 42.083 | 23.762 | 67.215 | 13.740 | 8.729 | 9.061 | 7.315 | 14.038 |
| NT2RP3001439 | 136.789 | 39.813 | 81.846 | 20.164 | 30.564 | 96.253 | 70.005 | 58.770 |
| NT2RP3001441 | 38.061 | 24.064 | 25.139 | 12.626 | 14.885 | 31.263 | 17.597 | 19.725 |
| NT2RP3001446 | 20.584 | 15.857 | 21.782 | 11.500 | 7.326 | 13.920 | 17.301 | 7.485 |
| NT2RP3001447 | 104.606 | 70.020 | 154.062 | 30.513 | 35.791 | 54.330 | 36.473 | 40.409 |
| NT2RP3001449 | 10.642 | 11.657 | 12.517 | 5.248 | 3.069 | 9.786 | 3.931 | 5.883 |
| NT2RP3001453 | 87.023 | 43.788 | 114.632 | 22.536 | 14.076 | 36.685 | 26.653 | 35.481 |

TABLE 94

| | | | | | | | | |
|---|---|---|---|---|---|---|---|---|
| NT2RP3001457 | 57.656 | 31.667 | 38.475 | 9.474 | 16.537 | 32.376 | 23.383 | 23.793 |
| NT2RP3001459 | 60.291 | 21.305 | 34.270 | 9.400 | 12.047 | 30.246 | 18.427 | 13.216 |
| NT2RP3001463 | 37.349 | 24.189 | 26.737 | 11.241 | 16.712 | 12.719 | 16.251 | 18.600 |
| NT2RP3001466 | 3.829 | 2.179 | 4.207 | 1.152 | 6.985 | 7.668 | 4.907 | 8.467 |
| NT2RP3001472 | 42.523 | 90.955 | 71.226 | 30.689 | 20.551 | 29.208 | 32.709 | 50.536 |
| NT2RP3001475 | 78.059 | 60.351 | 58.086 | 17.203 | 25.592 | 46.882 | 39.257 | 36.666 |
| NT2RP3001479 | 51.578 | 39.412 | 55.653 | 11.108 | 26.361 | 52.488 | 31.590 | 18.401 |
| NT2RP3001490 | 9.839 | 19.316 | 39.150 | 6.364 | 17.825 | 19.656 | 7.865 | 7.287 |
| NT2RP3001492 | 26.968 | 22.905 | 24.652 | 26.603 | 12.384 | 24.009 | 18.581 | 38.062 |

TABLE 94-continued

| | | | | | | | | |
|---|---|---|---|---|---|---|---|---|
| NT2RP3001495 | 42.340 | 19.294 | 36.741 | 7.565 | 17.241 | 28.985 | 27.157 | 19.314 |
| NT2RP3001497 | 32.950 | 17.434 | 21.044 | 7.024 | 15.546 | 10.180 | 19.393 | 11.452 |
| NT2RP3001501 | 49.067 | 12.638 | 47.469 | 8.720 | 17.879 | 41.926 | 36.474 | 34.151 |
| NT2RP3001527 | 128.120 | 106.243 | 244.961 | 55.672 | 47.467 | 62.628 | 70.008 | 82.431 |
| NT2RP3001529 | 126.912 | 81.307 | 206.759 | 36.211 | 39.398 | 67.609 | 39.145 | 62.778 |
| NT2RP3001538 | 88.926 | 38.255 | 69.884 | 13.233 | 24.804 | 68.411 | 33.275 | 32.991 |
| NT2RP3001539 | 81.817 | 43.540 | 51.302 | 22.808 | 20.905 | 63.546 | 26.220 | 38.541 |
| NT2RP3001542 | 11.704 | 7.892 | 19.344 | 6.489 | 4.478 | 17.599 | 4.710 | 7.688 |
| NT2RP3001549 | 60.840 | 55.102 | 62.218 | 28.542 | 25.159 | 35.315 | 25.069 | 26.210 |
| NT2RP3001554 | 63.142 | 38.335 | 57.520 | 12.016 | 24.143 | 31.920 | 38.546 | 16.779 |
| NT2RP3001560 | 31.508 | 10.439 | 17.431 | 4.171 | 2.833 | 51.650 | 11.927 | 4.890 |
| NT2RP3001561 | 63.493 | 90.177 | 97.829 | 34.619 | 16.230 | 73.893 | 63.557 | 42.901 |
| NT2RP3001564 | 24.224 | 31.924 | 65.851 | 31.318 | 22.874 | 32.192 | 22.750 | 54.688 |
| NT2RP3001568 | 67.785 | 39.398 | 77.618 | 15.998 | 21.374 | 60.561 | 47.360 | 27.334 |
| NT2RP3001575 | 158.363 | 105.187 | 188.761 | 35.371 | 49.236 | 104.929 | 66.520 | 52.127 |
| NT2RP3001580 | 22.928 | 24.103 | 27.902 | 11.308 | 13.846 | 10.773 | 15.209 | 6.535 |
| NT2RP3001587 | 30.882 | 46.805 | 32.389 | 23.716 | 21.127 | 18.550 | 19.430 | 26.668 |
| NT2RP3001589 | 87.238 | 55.913 | 140.234 | 21.405 | 30.269 | 16.502 | 28.129 | 10.227 |
| NT2RP3001592 | 47.242 | 30.596 | 31.040 | 13.899 | 18.557 | 41.892 | 35.638 | 42.607 |
| NT2RP3001607 | 16.545 | 13.286 | 20.677 | 4.980 | 9.882 | 24.464 | 11.354 | 5.914 |
| NT2RP3001608 | 107.899 | 35.856 | 58.646 | 18.572 | 27.828 | 41.340 | 38.549 | 32.556 |
| NT2RP3001613 | 181.447 | 52.790 | 94.058 | 22.958 | 35.402 | 79.493 | 85.697 | 41.703 |
| NT2RP3001619 | 37.170 | 25.761 | 28.424 | 19.581 | 14.720 | 20.892 | 19.236 | 19.461 |
| NT2RP3001621 | 25.051 | 25.597 | 20.759 | 20.248 | 14.008 | 11.806 | 23.506 | 15.754 |
| NT2RP3001629 | 42.495 | 29.023 | 21.485 | 11.692 | 14.221 | 12.517 | 24.496 | 15.072 |
| NT2RP3001630 | 55.203 | 33.318 | 32.380 | 8.398 | 13.075 | 15.299 | 24.396 | 22.471 |
| NT2RP3001631 | 44.095 | 28.385 | 25.774 | 21.960 | 8.104 | 12.247 | 12.424 | 22.548 |
| NT2RP3001634 | 49.389 | 31.519 | 50.276 | 17.438 | 9.120 | 14.725 | 16.971 | 25.097 |
| NT2RP3001642 | 58.384 | 63.135 | 64.537 | 32.197 | 35.654 | 40.765 | 40.711 | 48.812 |
| NT2RP3001646 | 46.102 | 25.499 | 30.071 | 11.012 | 13.561 | 30.364 | 19.040 | 15.478 |
| NT2RP3001650 | 24.560 | 13.692 | 28.286 | 3.177 | 10.587 | 18.321 | 16.939 | 9.216 |
| NT2RP3001667 | 25.379 | 40.979 | 30.064 | 11.709 | 14.158 | 32.432 | 17.482 | 25.227 |
| NT2RP3001671 | 51.796 | 35.962 | 30.710 | 14.900 | 16.883 | 48.652 | 22.108 | 17.635 |
| NT2RP3001672 | 125.298 | 47.766 | 73.324 | 32.053 | 41.587 | 103.311 | 68.493 | 24.949 |
| NT2RP3001676 | 44.058 | 36.932 | 114.623 | 30.805 | 23.379 | 25.887 | 17.997 | 8.670 |
| NT2RP3001678 | 48.527 | 41.805 | 54.658 | 14.292 | 18.855 | 29.685 | 32.419 | 36.221 |
| NT2RP3001679 | 56.508 | 36.021 | 81.826 | 15.299 | 18.731 | 40.182 | 31.070 | 17.889 |
| NT2RP3001682 | 33.136 | 20.214 | 19.464 | 8.314 | 10.046 | 16.063 | 14.268 | 5.567 |
| NT2RP3001685 | 95.365 | 62.809 | 194.220 | 24.485 | 21.045 | 38.439 | 16.225 | 11.304 |
| NT2RP3001688 | 122.935 | 103.280 | 232.690 | 54.732 | 41.328 | 31.580 | 55.067 | 32.257 |
| NT2RP3001690 | 48.596 | 45.935 | 42.137 | 20.012 | 17.447 | 39.119 | 24.083 | 18.809 |
| NT2RP3001693 | 76.315 | 27.860 | 52.551 | 37.607 | 26.960 | 72.114 | 45.231 | 19.480 |
| NT2RP3001696 | 35.875 | 28.246 | 35.927 | 21.333 | 60.841 | 9.615 | 24.315 | 9.560 |
| NT2RP3001698 | 43.726 | 102.017 | 42.229 | 16.546 | 27.452 | 36.516 | 25.269 | 42.349 |
| NT2RP3001708 | 36.121 | 26.604 | 23.161 | 16.082 | 1.714 | 11.104 | 2.885 | 20.780 |
| NT2RP3001712 | 113.609 | 129.822 | 366.565 | 126.311 | 59.689 | 78.525 | 41.638 | 61.807 |
| NT2RP3001716 | 9.845 | 7.608 | 13.734 | 5.525 | 8.563 | 23.994 | 5.143 | 4.152 |
| NT2RP3001724 | 43.121 | 23.040 | 32.820 | 19.574 | 11.027 | 20.906 | 11.708 | 5.732 |
| NT2RP3001727 | 72.718 | 46.280 | 190.324 | 43.096 | 41.722 | 61.017 | 47.265 | 36.342 |
| NT2RP3001729 | 10.639 | 10.707 | 8.428 | 17.052 | 3.948 | 3.216 | 64.178 | 7.190 |
| NT2RP3001730 | 63.737 | 67.851 | 122.541 | 39.916 | 31.307 | 27.433 | 31.876 | 23.118 |
| NT2RP3001733 | 40.642 | 8.190 | 17.849 | 8.778 | 11.778 | 26.030 | 18.334 | 5.155 |
| NT2RP3001737 | 106.767 | 31.997 | 40.871 | 23.282 | 26.905 | 36.357 | 25.210 | 18.710 |
| NT2RP3001738 | 174.651 | 37.341 | 91.532 | 33.803 | 49.232 | 87.359 | 90.833 | 19.024 |
| NT2RP3001739 | 119.404 | 43.837 | 72.501 | 19.331 | 38.072 | 77.999 | 61.245 | 24.127 |

TABLE 95

| | | | | | | | | |
|---|---|---|---|---|---|---|---|---|
| NT2RP3001742 | 58.731 | 59.672 | 86.234 | 43.100 | 39.678 | 62.316 | 23.594 | 32.745 |
| NT2RP3001751 | 48.631 | 34.876 | 158.212 | 47.830 | 31.536 | 36.350 | 15.916 | 18.927 |
| NT2RP3001752 | 94.578 | 61.575 | 307.338 | 43.572 | 55.894 | 46.187 | 9.168 | 38.702 |
| NT2RP3001753 | 23.594 | 18.268 | 28.874 | 16.113 | 17.103 | 13.403 | 14.360 | 7.574 |
| NT2RP3001754 | 257.019 | 147.414 | 145.593 | 48.124 | 69.378 | 138.023 | 89.833 | 70.678 |
| NT2RP3001756 | 106.542 | 23.060 | 11.890 | 3.761 | 12.461 | 39.172 | 8.157 | 5.587 |
| NT2RP3001764 | 97.616 | 41.097 | 57.216 | 18.829 | 29.263 | 46.634 | 32.748 | 8.673 |
| NT2RP3001771 | 89.626 | 20.149 | 49.519 | 15.739 | 25.796 | 66.030 | 41.963 | 10.077 |
| NT2RP3001777 | 58.067 | 26.504 | 49.752 | 19.057 | 29.401 | 31.279 | 31.451 | 13.675 |
| NT2RP3001782 | 78.349 | 53.349 | 189.787 | 42.036 | 31.814 | 40.007 | 32.537 | 31.265 |
| NT2RP3001792 | 116.784 | 33.273 | 79.277 | 30.838 | 34.190 | 79.914 | 66.384 | 24.845 |
| NT2RP3001799 | 56.002 | 33.221 | 58.797 | 25.754 | 26.042 | 47.831 | 44.737 | 16.237 |
| NT2RP3001819 | 99.523 | 31.676 | 64.535 | 11.784 | 27.979 | 48.855 | 30.729 | 15.920 |
| NT2RP3001829 | 73.466 | 107.350 | 119.232 | 72.609 | 47.731 | 75.897 | 53.911 | 85.472 |
| NT2RP3001836 | 24.805 | 27.404 | 43.716 | 32.034 | 20.484 | 30.135 | 10.824 | 26.221 |
| NT2RP3001839 | 65.164 | 48.291 | 49.763 | 22.383 | 28.432 | 53.489 | 36.072 | 27.184 |
| NT2RP3001844 | 66.622 | 61.308 | 123.313 | 25.118 | 28.657 | 41.010 | 27.431 | 29.936 |
| NT2RP3001848 | 155.399 | 71.963 | 136.546 | 46.040 | 30.799 | 64.847 | 88.349 | 81.167 |

TABLE 95-continued

| | | | | | | | | |
|---|---|---|---|---|---|---|---|---|
| NT2RP3001854 | 27.874 | 31.416 | 19.202 | 25.627 | 11.291 | 39.721 | 17.078 | 15.781 |
| NT2RP3001855 | 27.658 | 6.272 | 33.869 | 13.508 | 8.116 | 5.497 | 12.706 | 16.492 |
| NT2RP3001857 | 56.318 | 28.077 | 35.198 | 13.759 | 19.378 | 31.136 | 31.027 | 10.998 |
| NT2RP3001858 | 54.103 | 24.171 | 29.092 | 13.284 | 15.411 | 32.167 | 36.372 | 11.561 |
| NT2RP3001861 | 63.497 | 29.741 | 57.635 | 20.968 | 28.106 | 45.119 | 47.585 | 13.999 |
| NT2RP3001866 | 10.249 | 12.382 | 19.920 | 12.616 | 11.772 | 42.626 | 11.074 | 7.998 |
| NT2RP3001871 | 12.631 | 15.883 | 25.471 | 6.868 | 6.207 | 12.620 | 4.571 | 4.517 |
| NT2RP3001874 | 11.507 | 11.103 | 18.203 | 4.856 | 8.061 | 6.546 | 18.725 | 3.916 |
| NT2RP3001878 | 18.465 | 9.045 | 11.792 | 9.332 | 8.403 | 9.161 | 9.699 | 4.707 |
| NT2RP3001885 | 96.791 | 37.635 | 150.137 | 59.749 | 39.678 | 65.282 | 51.265 | 28.873 |
| NT2RP3001896 | 32.191 | 20.738 | 27.405 | 6.654 | 24.453 | 44.306 | 22.893 | 9.765 |
| NT2RP3001898 | 78.914 | 42.917 | 61.453 | 15.826 | 29.295 | 67.204 | 51.298 | 17.212 |
| NT2RP3001899 | 41.343 | 15.205 | 21.780 | 9.260 | 12.053 | 26.711 | 26.329 | 25.656 |
| NT2RP3001901 | 66.535 | 31.714 | 47.183 | 21.483 | 19.792 | 40.418 | 25.763 | 53.079 |
| NT2RP3001915 | 13.485 | 9.383 | 12.294 | 10.822 | 7.631 | 16.078 | 5.131 | 7.213 |
| NT2RP3001926 | 6.261 | 3.066 | 9.593 | 3.684 | 3.576 | 9.671 | 11.215 | 1.684 |
| NT2RP3001929 | 60.492 | 34.768 | 142.251 | 36.157 | 39.929 | 21.055 | 30.245 | 40.792 |
| NT2RP3001931 | 61.641 | 53.696 | 67.258 | 14.577 | 19.384 | 29.503 | 29.562 | 27.881 |
| NT2RP3001938 | 40.274 | 25.723 | 28.062 | 7.496 | 13.890 | 31.768 | 21.367 | 10.885 |
| NT2RP3001943 | 28.287 | 39.405 | 55.585 | 15.302 | 25.639 | 35.454 | 26.626 | 14.424 |
| NT2RP3001944 | 73.315 | 27.407 | 47.229 | 18.622 | 23.648 | 23.459 | 28.532 | 14.827 |
| NT2RP3001945 | 34.740 | 226.973 | 44.000 | 46.158 | 19.151 | 46.315 | 28.688 | 17.572 |
| NT2RP3001947 | 116.378 | 37.593 | 58.570 | 24.995 | 34.634 | 68.127 | 58.533 | 46.304 |
| NT2RP3001949 | 21.954 | 11.535 | 33.877 | 4.860 | 16.683 | 22.117 | 14.558 | 17.598 |
| NT2RP3001952 | 143.519 | 121.088 | 53.648 | 50.889 | 37.440 | 105.617 | 83.380 | 63.243 |
| NT2RP3001954 | 62.996 | 26.992 | 48.377 | 12.537 | 20.542 | 32.191 | 29.976 | 25.668 |
| NT2RP3001956 | 129.978 | 158.142 | 151.322 | 123.162 | 62.713 | 92.406 | 67.282 | 100.024 |
| NT2RP3001967 | 93.636 | 55.466 | 88.272 | 10.572 | 29.097 | 36.626 | 46.055 | 17.092 |
| NT2RP3001969 | 34.479 | 21.534 | 19.898 | 9.167 | 5.399 | 15.105 | 15.158 | 2.531 |
| NT2RP3001976 | 37.230 | 23.786 | 60.518 | 23.795 | 22.136 | 24.440 | 19.911 | 25.309 |
| NT2RP3001986 | 24.216 | 19.727 | 27.547 | 10.801 | 12.852 | 13.805 | 18.920 | 10.726 |
| NT2RP3001989 | 1.471 | 1.909 | 7.536 | 0.621 | 1.861 | 0.578 | 0.269 | 1.159 |
| NT2RP3002002 | 86.258 | 90.727 | 227.536 | 60.750 | 55.252 | 43.279 | 35.951 | 27.250 |
| NT2RP3002004 | 19.703 | 13.852 | 27.972 | 4.752 | 16.286 | 18.094 | 19.787 | 7.343 |
| NT2RP3002007 | 23.474 | 20.861 | 30.066 | 11.557 | 12.246 | 16.556 | 11.639 | 9.539 |
| NT2RP3002014 | 73.272 | 44.064 | 105.038 | 21.583 | 22.923 | 30.079 | 37.416 | 19.158 |
| NT2RP3002015 | 45.650 | 25.353 | 31.414 | 12.464 | 11.588 | 23.493 | 22.893 | 14.440 |
| NT2RP3002033 | 7.919 | 7.838 | 6.105 | 2.217 | 2.555 | 1.242 | 5.234 | 1.639 |
| NT2RP3002045 | 21.618 | 5.917 | 11.205 | 1.926 | 3.123 | 8.022 | 6.419 | 4.266 |
| NT2RP3002054 | 12.875 | 15.125 | 21.352 | 7.162 | 14.499 | 15.344 | 8.332 | 4.770 |
| NT2RP3002056 | 15.165 | 25.056 | 14.776 | 16.349 | 11.179 | 12.472 | 5.599 | 27.199 |
| NT2RP3002057 | 34.454 | 21.088 | 18.683 | 15.978 | 12.035 | 23.460 | 21.618 | 18.390 |
| NT2RP3002061 | 35.549 | 24.492 | 34.009 | 18.402 | 15.138 | 21.477 | 15.115 | 17.613 |
| NT2RP3002062 | 30.631 | 13.014 | 52.221 | 11.461 | 16.044 | 21.886 | 8.319 | 7.954 |
| NT2RP3002063 | 23.330 | 22.063 | 18.919 | 7.923 | 12.276 | 13.149 | 10.874 | 7.143 |
| NT2RP3002064 | 108.343 | 49.219 | 61.758 | 11.778 | 26.355 | 47.256 | 44.374 | 26.732 |

TABLE 96

| | | | | | | | | |
|---|---|---|---|---|---|---|---|---|
| NT2RP3002071 | 18.641 | 8.678 | 10.550 | 3.877 | 8.890 | 15.118 | 11.681 | 9.986 |
| NT2RP3002073 | 21.421 | 28.270 | 17.244 | 8.390 | 7.984 | 14.893 | 9.734 | 12.810 |
| NT2RP3002074 | 58.380 | 28.105 | 42.899 | 18.734 | 20.881 | 18.721 | 29.611 | 19.857 |
| NT2RP3002075 | 59.306 | 37.344 | 42.700 | 25.078 | 27.978 | 35.950 | 33.241 | 20.022 |
| NT2RP3002077 | 120.301 | 28.839 | 29.039 | 10.364 | 16.319 | 40.212 | 29.213 | 9.478 |
| NT2RP3002081 | 26.831 | 15.778 | 21.982 | 12.572 | 10.820 | 14.083 | 12.614 | 11.083 |
| NT2RP3002086 | 87.926 | 53.777 | 142.446 | 48.023 | 26.542 | 32.148 | 26.246 | 52.677 |
| NT2RP3002094 | 33.062 | 35.549 | 57.575 | 42.152 | 21.321 | 27.615 | 18.554 | 12.485 |
| NT2RP3002096 | 49.540 | 22.516 | 39.610 | 9.388 | 18.743 | 33.193 | 33.700 | 12.017 |
| NT2RP3002097 | 26.334 | 27.838 | 34.989 | 21.007 | 14.939 | 24.394 | 20.920 | 11.430 |
| NT2RP3002098 | 44.592 | 23.806 | 37.622 | 21.688 | 21.108 | 22.573 | 24.025 | 31.657 |
| NT2RP3002102 | 79.033 | 86.261 | 164.477 | 46.235 | 35.252 | 56.190 | 33.162 | 43.258 |
| NT2RP3002106 | 77.525 | 71.059 | 239.471 | 34.504 | 16.297 | 23.309 | 16.557 | 32.205 |
| NT2RP3002108 | 44.613 | 18.028 | 23.167 | 12.003 | 9.700 | 17.108 | 11.361 | 8.970 |
| NT2RP3002109 | 48.832 | 54.217 | 110.537 | 30.507 | 53.885 | 32.217 | 28.672 | 32.057 |
| NT2RP3002110 | 89.630 | 210.042 | 214.246 | 193.998 | 55.568 | 79.385 | 66.216 | 96.572 |
| NT2RP3002113 | 56.372 | 35.313 | 57.256 | 20.790 | 24.151 | 40.633 | 31.916 | 21.890 |
| NT2RP3002120 | 29.242 | 37.086 | 18.529 | 14.039 | 12.431 | 13.596 | 15.152 | 8.244 |
| NT2RP3002121 | 16.794 | 22.468 | 34.546 | 15.934 | 19.042 | 18.137 | 15.462 | 9.151 |
| NT2RP3002126 | 41.432 | 79.714 | 33.116 | 16.398 | 35.960 | 52.883 | 34.750 | 31.846 |
| NT2RP3002128 | 181.295 | 79.422 | 107.432 | 30.207 | 38.340 | 110.226 | 72.274 | 55.110 |
| NT2RP3002130 | 146.473 | 43.354 | 77.922 | 29.452 | 37.242 | 74.976 | 38.796 | 20.167 |
| NT2RP3002133 | 57.753 | 91.578 | 70.347 | 18.863 | 21.214 | 49.924 | 14.482 | 21.057 |
| NT2RP3002136 | 43.801 | 49.959 | 66.820 | 35.859 | 53.999 | 51.027 | 15.709 | 17.711 |
| NT2RP3002140 | 64.973 | 38.168 | 59.056 | 29.445 | 31.803 | 46.421 | 49.899 | 13.225 |
| NT2RP3002142 | 132.430 | 135.567 | 308.150 | 95.713 | 104.450 | 105.460 | 76.193 | 111.169 |
| NT2RP3002146 | 110.073 | 69.842 | 274.145 | 50.104 | 54.554 | 46.952 | 38.770 | 22.003 |

TABLE 96-continued

| | | | | | | | | |
|---|---|---|---|---|---|---|---|---|
| NT2RP3002147 | 79.974 | 78.251 | 76.290 | 23.131 | 32.938 | 49.028 | 36.864 | 20.569 |
| NT2RP3002151 | 28.317 | 56.044 | 35.024 | 31.238 | 13.466 | 19.730 | 29.531 | 21.213 |
| NT2RP3002155 | 113.358 | 59.837 | 83.053 | 31.667 | 33.044 | 85.787 | 59.718 | 11.547 |
| NT2RP3002156 | 18.567 | 17.466 | 43.089 | 11.697 | 14.283 | 20.150 | 19.476 | 8.599 |
| NT2RP3002160 | 45.470 | 32.287 | 51.148 | 8.537 | 17.337 | 18.576 | 19.383 | 9.987 |
| NT2RP3002163 | 58.319 | 76.385 | 85.220 | 36.452 | 25.979 | 54.323 | 41.118 | 65.634 |
| NT2RP3002165 | 99.653 | 52.118 | 87.449 | 32.574 | 44.305 | 65.099 | 54.567 | 25.366 |
| NT2RP3002166 | 37.449 | 18.398 | 38.523 | 7.973 | 18.270 | 16.300 | 16.573 | 5.836 |
| NT2RP3002173 | 138.293 | 67.332 | 233.564 | 25.504 | 39.519 | 46.406 | 22.234 | 32.147 |
| NT2RP3002174 | 34.983 | 25.592 | 20.612 | 10.322 | 10.075 | 33.100 | 18.166 | 8.352 |
| NT2RP3002181 | 25.553 | 17.452 | 12.477 | 15.521 | 6.186 | 13.861 | 17.883 | 5.289 |
| NT2RP3002185 | 130.901 | 22.501 | 42.897 | 20.805 | 18.996 | 58.093 | 23.439 | 7.852 |
| NT2RP3002193 | 48.914 | 35.893 | 57.402 | 12.166 | 28.331 | 65.610 | 51.617 | 21.157 |
| NT2RP3002204 | 25.437 | 16.825 | 30.602 | 6.124 | 18.001 | 26.166 | 12.479 | 21.873 |
| NT2RP3002244 | 49.842 | 27.141 | 57.904 | 22.937 | 24.682 | 26.606 | 32.340 | 22.561 |
| NT2RP3002248 | 86.580 | 63.454 | 102.977 | 40.434 | 37.198 | 51.108 | 39.002 | 34.672 |
| NT2RP3002253 | 55.575 | 9.382 | 8.780 | 13.506 | 12.566 | 16.080 | 15.217 | 3.963 |
| NT2RP3002255 | 35.015 | 68.339 | 52.684 | 56.744 | 24.356 | 32.145 | 25.739 | 37.424 |
| NT2RP3002264 | 55.986 | 34.735 | 59.125 | 27.856 | 28.745 | 42.746 | 33.939 | 8.983 |
| NT2RP3002267 | 80.099 | 23.461 | 44.639 | 24.189 | 20.404 | 52.393 | 26.915 | 33.436 |
| NT2RP3002273 | 112.221 | 85.604 | 140.868 | 66.160 | 58.014 | 79.427 | 50.417 | 36.059 |
| NT2RP3002276 | 62.303 | 48.041 | 50.683 | 13.361 | 24.974 | 43.308 | 34.452 | 31.732 |
| NT2RP3002281 | 40.333 | 19.037 | 24.587 | 16.378 | 13.790 | 21.545 | 20.931 | 8.966 |
| NT2RP3002286 | 27.525 | 24.696 | 32.519 | 15.907 | 12.207 | 12.167 | 13.138 | 14.040 |
| NT2RP3002297 | 184.330 | 104.754 | 239.133 | 101.492 | 75.626 | 106.831 | 74.738 | 83.240 |
| NT2RP3002301 | 53.311 | 19.361 | 38.416 | 18.640 | 28.458 | 40.874 | 31.521 | 16.259 |
| NT2RP3002303 | 151.906 | 66.595 | 108.440 | 41.097 | 41.354 | 98.439 | 62.889 | 20.317 |
| NT2RP3002304 | 9.712 | 7.368 | 13.268 | 9.520 | 3.566 | 6.387 | 8.272 | 2.623 |
| NT2RP3002309 | 34.656 | 9.379 | 19.868 | 19.687 | 8.915 | 31.244 | 28.005 | 8.625 |
| NT2RP3002311 | 44.224 | 21.425 | 31.676 | 9.614 | 15.336 | 23.060 | 17.155 | 24.047 |
| NT2RP3002315 | 60.149 | 39.087 | 49.728 | 29.239 | 27.551 | 69.218 | 44.550 | 30.664 |
| NT2RP3002319 | 29.909 | 14.381 | 39.512 | 12.835 | 8.358 | 20.152 | 26.375 | 28.658 |
| NT2RP3002324 | 84.644 | 48.794 | 79.950 | 26.759 | 38.717 | 55.982 | 49.196 | 49.374 |
| NT2RP3002330 | 40.225 | 35.781 | 41.419 | 18.069 | 24.353 | 43.432 | 29.047 | 24.194 |
| NT2RP3002333 | 739.604 | 109.838 | 247.248 | 63.516 | 145.604 | 638.213 | 368.164 | 89.849 |
| NT2RP3002337 | 12.429 | 9.488 | 14.787 | 4.435 | 5.777 | 6.399 | 6.548 | 8.159 |
| NT2RP3002342 | 18.485 | 16.965 | 24.764 | 8.272 | 19.656 | 13.221 | 7.806 | 10.971 |

TABLE 97

| | | | | | | | | |
|---|---|---|---|---|---|---|---|---|
| NT2RP3002343 | 98.077 | 41.393 | 159.033 | 34.235 | 37.461 | 51.737 | 39.000 | 34.837 |
| NT2RP3002351 | 11.568 | 8.544 | 17.447 | 8.504 | 7.516 | 10.032 | 16.378 | 11.298 |
| NT2RP3002352 | 61.768 | 50.393 | 66.786 | 25.296 | 17.190 | 34.146 | 31.668 | 29.346 |
| NT2RP3002353 | 84.753 | 66.818 | 124.498 | 39.521 | 45.715 | 83.255 | 42.335 | 39.394 |
| NT2RP3002362 | 147.017 | 77.918 | 101.793 | 33.659 | 48.293 | 105.808 | 93.191 | 47.902 |
| NT2RP3002363 | 51.360 | 22.194 | 27.308 | 16.354 | 18.149 | 41.241 | 27.368 | 9.958 |
| NT2RP3002377 | 22.585 | 15.479 | 26.241 | 11.831 | 11.702 | 22.164 | 19.250 | 14.688 |
| NT2RP3002383 | 36.652 | 26.590 | 37.776 | 12.961 | 18.317 | 29.595 | 32.435 | 19.372 |
| NT2RP3002388 | 41.759 | 29.432 | 82.187 | 16.223 | 19.758 | 13.702 | 16.544 | 34.308 |
| NT2RP3002394 | 64.877 | 31.565 | 40.945 | 18.641 | 23.109 | 44.424 | 35.200 | 24.054 |
| NT2RP3002398 | 344.708 | 216.589 | 379.846 | 153.561 | 145.584 | 244.214 | 334.003 | 155.648 |
| NT2RP3002399 | 120.898 | 118.841 | 123.581 | 92.322 | 61.939 | 76.458 | 34.837 | 92.415 |
| NT2RP3002402 | 52.959 | 35.232 | 68.571 | 16.571 | 20.492 | 53.151 | 21.545 | 24.518 |
| NT2RP3002409 | 167.688 | 37.697 | 100.184 | 25.069 | 35.882 | 114.827 | 88.945 | 40.800 |
| NT2RP3002410 | 144.081 | 109.377 | 101.178 | 45.575 | 39.226 | 71.259 | 45.433 | 41.401 |
| NT2RP3002411 | 93.030 | 33.468 | 50.254 | 10.997 | 27.600 | 27.023 | 23.738 | 15.047 |
| NT2RP3002429 | 43.781 | 19.997 | 33.403 | 9.720 | 14.797 | 31.472 | 21.609 | 8.498 |
| NT2RP3002448 | 18.505 | 12.378 | 25.831 | 8.000 | 12.388 | 14.483 | 16.180 | 11.704 |
| NT2RP3002454 | 22.834 | 27.433 | 27.109 | 11.518 | 12.679 | 23.830 | 18.696 | 7.724 |
| NT2RP3002455 | 42.267 | 39.024 | 48.252 | 18.078 | 25.184 | 40.843 | 26.300 | 25.891 |
| NT2RP3002456 | 63.618 | 62.895 | 132.023 | 60.865 | 48.457 | 47.502 | 34.943 | 107.915 |
| NT2RP3002462 | 81.232 | 66.732 | 75.545 | 22.706 | 28.463 | 63.509 | 41.976 | 23.685 |
| NT2RP3002469 | 31.281 | 25.018 | 41.900 | 16.283 | 18.312 | 31.313 | 22.887 | 8.884 |
| NT2RP3002470 | 394.179 | 240.381 | 344.971 | 150.134 | 156.904 | 226.629 | 242.639 | 129.974 |
| NT2RP3002484 | 119.962 | 120.572 | 179.767 | 55.590 | 78.186 | 80.561 | 80.333 | 27.126 |
| NT2RP3002491 | 20.237 | 11.861 | 12.690 | 4.614 | 6.231 | 7.954 | 11.431 | 9.537 |
| NT2RP3002494 | 102.258 | 227.475 | 73.714 | 31.409 | 28.100 | 91.250 | 58.572 | 81.116 |
| NT2RP3002497 | 111.163 | 46.894 | 64.415 | 16.949 | 25.888 | 63.935 | 42.893 | 24.093 |
| NT2RP3002500 | 77.111 | 26.529 | 42.337 | 12.959 | 16.485 | 30.996 | 37.915 | 22.524 |
| NT2RP3002501 | 53.661 | 44.526 | 44.009 | 16.212 | 22.884 | 27.120 | 37.461 | 16.746 |
| NT2RP3002512 | 63.608 | 44.357 | 40.061 | 20.054 | 21.830 | 23.291 | 29.988 | 18.925 |
| NT2RP3002529 | 45.341 | 43.112 | 48.262 | 25.498 | 22.514 | 23.399 | 23.938 | 31.672 |
| NT2RP3002533 | 94.195 | 65.870 | 61.041 | 18.300 | 73.412 | 49.543 | 39.779 | 31.520 |
| NT2RP3002539 | 48.864 | 37.046 | 54.572 | 30.194 | 21.685 | 26.897 | 29.822 | 42.332 |
| NT2RP3002540 | 30.794 | 21.358 | 37.383 | 11.560 | 13.724 | 17.298 | 19.581 | 11.502 |
| NT2RP3002543 | 223.940 | 110.144 | 120.839 | 52.219 | 64.994 | 144.657 | 115.227 | 76.872 |

TABLE 97-continued

| | | | | | | | | |
|---|---|---|---|---|---|---|---|---|
| NT2RP3002545 | 15.100 | 41.894 | 32.270 | 19.423 | 32.049 | 13.151 | 11.195 | 10.417 |
| NT2RP3002549 | 28.199 | 14.150 | 27.495 | 13.528 | 19.671 | 17.420 | 11.163 | 7.548 |
| NT2RP3002552 | 47.064 | 17.945 | 25.504 | 12.370 | 13.372 | 28.220 | 22.837 | 14.570 |
| NT2RP3002558 | 61.923 | 30.846 | 56.966 | 17.185 | 28.359 | 33.407 | 22.300 | 21.755 |
| NT2RP3002565 | 62.350 | 42.196 | 107.270 | 25.722 | 27.937 | 33.279 | 27.380 | 20.262 |
| NT2RP3002566 | 54.275 | 39.776 | 49.593 | 22.587 | 24.849 | 18.616 | 38.067 | 25.776 |
| NT2RP3002571 | 16.476 | 11.788 | 20.308 | 3.165 | 5.305 | 12.738 | 11.591 | 7.492 |
| NT2RP3002572 | 65.635 | 36.206 | 37.772 | 17.526 | 23.615 | 29.016 | 17.205 | 16.571 |
| NT2RP3002573 | 104.009 | 83.178 | 49.387 | 56.147 | 11.324 | 27.549 | 32.818 | 43.821 |
| NT2RP3002577 | 52.884 | 22.337 | 33.591 | 12.529 | 6.690 | 22.718 | 19.368 | 7.491 |
| NT2RP3002579 | 71.729 | 30.291 | 36.007 | 21.690 | 15.920 | 21.971 | 21.241 | 10.888 |
| NT2RP3002582 | 81.979 | 51.167 | 67.043 | 31.231 | 41.904 | 56.964 | 46.155 | 37.227 |
| NT2RP3002587 | 26.087 | 32.407 | 69.922 | 18.487 | 19.982 | 21.677 | 19.805 | 12.145 |
| NT2RP3002590 | 7.512 | 8.105 | 10.729 | 21.190 | 15.305 | 8.973 | 7.009 | 4.548 |
| NT2RP3002602 | 47.775 | 17.298 | 29.784 | 12.271 | 15.119 | 25.375 | 31.820 | 9.770 |
| NT2RP3002603 | 161.708 | 183.767 | 216.650 | 65.839 | 78.955 | 109.597 | 71.485 | 115.706 |
| NT2RP3002621 | 119.248 | 24.598 | 40.553 | 16.479 | 9.925 | 62.060 | 30.435 | 25.390 |
| NT2RP3002622 | 69.767 | 50.020 | 145.390 | 29.140 | 21.618 | 41.045 | 15.163 | 15.918 |
| NT2RP3002624 | 1.393 | 5.920 | 0.000 | 0.942 | 2.232 | 1.299 | 2.998 | 1.562 |
| NT2RP3002628 | 9.999 | 8.708 | 17.715 | 17.122 | 8.351 | 14.530 | 9.109 | 5.659 |
| NT2RP3002629 | 249.675 | 59.767 | 98.304 | 56.623 | 88.848 | 134.353 | 115.158 | 40.132 |
| NT2RP3002631 | 0.595 | 0.000 | 0.000 | 0.000 | 0.000 | 0.000 | 0.000 | 0.000 |
| NF2RP3002647 | 30.462 | 15.046 | 27.336 | 16.536 | 12.777 | 15.918 | 14.630 | 14.888 |
| NT2RP3002649 | 120.351 | 83.386 | 89.024 | 51.631 | 33.853 | 77.229 | 31.648 | 30.637 |
| NT2RP3002650 | 78.123 | 37.371 | 55.575 | 21.740 | 26.972 | 61.290 | 42.009 | 51.110 |
| NT2RP3002652 | 40.736 | 15.102 | 33.402 | 15.021 | 16.044 | 39.523 | 34.502 | 10.676 |
| NT2RP3002654 | 32.673 | 14.185 | 26.107 | 12.823 | 19.846 | 18.421 | 24.175 | 8.617 |
| NT2RP3002657 | 79.710 | 86.415 | 129.177 | 41.769 | 103.657 | 80.846 | 59.737 | 46.192 |

TABLE 98

| | | | | | | | | |
|---|---|---|---|---|---|---|---|---|
| NT2RP3002659 | 18.914 | 12.170 | 24.486 | 6.353 | 13.890 | 36.308 | 7.922 | 9.590 |
| NT2RP3002660 | 64.465 | 53.376 | 119.655 | 42.835 | 35.909 | 41.916 | 10.430 | 27.532 |
| NT2RP3002663 | 30.048 | 20.813 | 29.457 | 13.786 | 13.557 | 15.463 | 15.414 | 13.216 |
| NT2RP3002664 | 14.659 | 18.990 | 23.494 | 8.867 | 10.564 | 9.625 | 5.085 | 4.798 |
| NT2RP3002667 | 15.216 | 16.234 | 11.286 | 11.809 | 8.647 | 8.484 | 26.055 | 18.907 |
| NT2RP3002671 | 39.495 | 26.960 | 28.177 | 15.153 | 12.285 | 24.589 | 13.809 | 14.654 |
| NT2RP3002682 | 11.347 | 14.990 | 21.206 | 28.999 | 14.002 | 9.455 | 16.128 | 33.677 |
| NT2RP3002684 | 13.722 | 11.697 | 16.858 | 8.392 | 12.676 | 7.181 | 5.777 | 4.503 |
| NT2RP3002687 | 2.560 | 4.651 | 10.162 | 1.691 | 1.917 | 2.141 | 3.706 | 3.397 |
| NT2RP3002688 | 15.864 | 2.884 | 22.879 | 1.260 | 13.309 | 20.413 | 8.939 | 1.088 |
| NT2RP3002698 | 28.485 | 12.350 | 29.970 | 11.179 | 18.339 | 22.012 | 15.073 | 59.183 |
| NT2RP3002701 | 144.580 | 68.552 | 65.738 | 22.713 | 47.971 | 117.171 | 58.063 | 64.453 |
| NT2RP3002705 | 50.811 | 34.865 | 76.689 | 77.242 | 38.688 | 84.791 | 28.441 | 54.479 |
| NT2RP3002708 | 107.193 | 25.745 | 48.335 | 10.739 | 20.147 | 29.081 | 22.130 | 32.554 |
| NT2RP3002711 | 38.410 | 19.460 | 31.129 | 24.261 | 21.934 | 31.711 | 19.413 | 9.154 |
| NT2RP3002712 | 127.597 | 337.217 | 172.297 | 85.410 | 157.291 | 209.750 | 71.600 | 90.235 |
| NT2RP3002713 | 25.722 | 12.997 | 26.653 | 9.930 | 11.236 | 16.757 | 16.310 | 18.652 |
| NT2RP3002721 | 48.039 | 15.327 | 24.924 | 23.105 | 19.153 | 24.353 | 19.280 | 10.413 |
| NT2RP3002722 | 421.087 | 147.659 | 338.772 | 115.647 | 164.233 | 259.199 | 308.668 | 136.618 |
| NT2RP3002723 | 43.086 | 85.012 | 67.010 | 38.528 | 35.204 | 150.941 | 121.373 | 45.387 |
| NT2RP3002737 | 71.494 | 27.672 | 52.178 | 22.716 | 32.049 | 58.862 | 47.802 | 16.796 |
| NT2RP3002738 | 47.542 | 16.654 | 36.964 | 9.362 | 16.223 | 38.458 | 25.360 | 23.198 |
| NT2RP3002742 | 81.782 | 149.322 | 102.776 | 54.228 | 44.909 | 105.384 | 127.394 | 33.680 |
| NT2RP3002744 | 2.263 | 4.168 | 21.735 | 2.015 | 3.502 | 1.976 | 2.225 | 0.560 |
| NT2RP3002756 | 22.619 | 12.182 | 21.840 | 8.009 | 10.135 | 11.380 | 12.917 | 4.838 |
| NT2RP3002757 | 113.772 | 65.294 | 69.951 | 34.431 | 19.743 | 281.518 | 37.409 | 82.637 |
| NT2RP3002758 | 60.176 | 82.911 | 68.360 | 23.774 | 51.197 | 81.519 | 55.695 | 20.674 |
| NT2RP3002762 | 70.007 | 62.402 | 96.808 | 44.296 | 70.524 | 111.844 | 35.008 | 61.053 |
| NT2RP3002763 | 65.632 | 38.286 | 93.384 | 42.890 | 27.102 | 55.601 | 31.878 | 35.587 |
| NT2RP3002770 | 35.381 | 13.511 | 35.913 | 7.950 | 10.042 | 24.469 | 17.980 | 11.225 |
| NT2RP3002771 | 40.863 | 23.186 | 29.004 | 13.976 | 35.897 | 25.254 | 18.920 | 17.572 |
| NT2RP3002785 | 13.960 | 5.890 | 4.173 | 2.677 | 2.677 | 9.071 | 5.889 | 5.289 |
| NT2RP3002790 | 34.782 | 20.599 | 28.673 | 15.987 | 14.483 | 19.288 | 18.105 | 19.768 |
| NT2RP3002799 | 39.751 | 31.026 | 83.485 | 29.150 | 23.866 | 22.566 | 21.257 | 45.619 |
| NT2RP3002801 | 47.659 | 26.163 | 128.555 | 31.073 | 22.498 | 26.337 | 24.586 | 24.190 |
| NT2RP3002802 | 146.487 | 73.131 | 121.221 | 33.066 | 38.992 | 67.510 | 59.237 | 21.826 |
| NT2RP3002810 | 10.160 | 45.362 | 22.360 | 7.561 | 8.729 | 7.648 | 14.315 | 7.654 |
| NT2RP3002818 | 4.667 | 6.464 | 10.095 | 3.200 | 6.216 | 4.871 | 5.874 | 11.909 |
| NT2RP3002821 | 76.117 | 34.802 | 53.630 | 32.950 | 28.735 | 58.082 | 41.128 | 16.704 |
| NT2RP3002823 | 11.784 | 13.818 | 14.562 | 1.977 | 7.384 | 12.328 | 6.617 | 11.325 |
| NT2RP3002825 | 51.146 | 13.354 | 18.612 | 8.300 | 12.766 | 20.235 | 20.838 | 24.852 |
| NT2RP3002829 | 35.187 | 38.250 | 97.142 | 25.989 | 24.214 | 26.885 | 16.084 | 21.503 |
| NT2RP3002831 | 66.496 | 27.156 | 68.213 | 17.668 | 23.336 | 61.962 | 46.206 | 37.479 |
| NT2RP3002836 | 130.172 | 72.920 | 90.667 | 20.404 | 36.995 | 100.291 | 59.703 | 56.686 |
| NT2RP3002845 | 64.337 | 22.726 | 40.173 | 14.166 | 18.291 | 22.445 | 10.215 | 12.196 |

TABLE 98-continued

| | | | | | | | | |
|---|---|---|---|---|---|---|---|---|
| NT2RP3002852 | 38.556 | 19.001 | 25.493 | 7.993 | 8.490 | 26.043 | 16.609 | 7.989 |
| NT2RP3002861 | 2.544 | 8.478 | 5.538 | 2.371 | 1.076 | 11.828 | 8.852 | 2.388 |
| NT2RP3002869 | 119.363 | 36.492 | 65.104 | 27.751 | 37.200 | 48.198 | 61.052 | 17.114 |
| NT2RP3002874 | 24.807 | 10.169 | 15.126 | 5.983 | 8.446 | 11.486 | 15.977 | 17.599 |
| NT2RP3002876 | 64.967 | 22.806 | 49.911 | 23.937 | 25.658 | 54.137 | 50.714 | 12.582 |
| NT2RP3002877 | 86.753 | 69.686 | 258.276 | 48.444 | 44.144 | 53.777 | 36.801 | 48.742 |
| NT2RP3002887 | 32.513 | 9.192 | 16.424 | 15.590 | 7.085 | 25.821 | 19.262 | 5.065 |
| NT2RP3002900 | 17.592 | 22.036 | 56.235 | 9.751 | 17.946 | 18.936 | 16.030 | 15.494 |
| NT2RP3002902 | 77.119 | 87.651 | 99.208 | 65.469 | 23.869 | 49.857 | 35.525 | 68.682 |
| NT2RP3002909 | 651.498 | 271.044 | 348.888 | 147.447 | 159.876 | 403.448 | 375.523 | 192.134 |
| NT2RP3002911 | 18.365 | 31.404 | 29.903 | 8.152 | 11.463 | 10.299 | 14.454 | 11.143 |
| NT2RP3002948 | 31.554 | 19.471 | 22.058 | 5.625 | 13.560 | 11.821 | 12.470 | 4.969 |
| NT2RP3002953 | 86.292 | 18.063 | 24.427 | 6.969 | 18.812 | 14.379 | 32.470 | 9.777 |
| NT2RP3002955 | 19.801 | 7.571 | 12.412 | 9.001 | 5.316 | 8.726 | 8.912 | 8.536 |
| NT2RP3002958 | 41.536 | 22.160 | 22.741 | 5.690 | 11.415 | 41.119 | 17.410 | 12.258 |
| NT2RP3002969 | 37.280 | 28.189 | 25.925 | 9.002 | 18.977 | 16.248 | 14.471 | 9.514 |
| NT2RP3002972 | 22.208 | 18.736 | 16.171 | 2.364 | 9.532 | 9.859 | 13.526 | 7.568 |
| NT2RP3002978 | 17.816 | 15.240 | 32.009 | 15.003 | 9.596 | 5.319 | 8.999 | 3.049 |
| NT2RP3002983 | 7.404 | 5.940 | 7.102 | 1.188 | 7.742 | 3.489 | 6.275 | 6.214 |

TABLE 99

| | | | | | | | | |
|---|---|---|---|---|---|---|---|---|
| NT2RP3002985 | 54.322 | 20.945 | 33.398 | 9.562 | 18.165 | 28.438 | 25.968 | 20.623 |
| NT2RP3002988 | 17.700 | 17.268 | 27.888 | 13.345 | 13.104 | 15.971 | 19.252 | 22.620 |
| NT2RP3003000 | 76.725 | 68.978 | 102.455 | 35.327 | 36.878 | 75.681 | 73.309 | 47.982 |
| NT2RP3003008 | 40.397 | 31.290 | 39.838 | 8.641 | 14.630 | 21.543 | 20.015 | 10.881 |
| NT2RP3003012 | 14.280 | 14.189 | 33.526 | 7.156 | 11.442 | 14.530 | 6.941 | 4.141 |
| NT2RP3003015 | 54.108 | 13.725 | 29.619 | 7.455 | 12.688 | 24.800 | 30.124 | 11.125 |
| NT2RP3003018 | 10.045 | 6.127 | 17.611 | 6.653 | 9.081 | 19.649 | 6.155 | 2.761 |
| NT2RP3003028 | 75.625 | 33.179 | 39.416 | 26.480 | 25.319 | 7.487 | 13.397 | 10.834 |
| NT2RP3003029 | 86.986 | 50.846 | 63.900 | 15.149 | 20.126 | 31.780 | 36.530 | 32.637 |
| NT2RP3003032 | 136.276 | 96.942 | 314.984 | 60.769 | 68.889 | 66.630 | 49.952 | 17.929 |
| NT2RP3003041 | 0.774 | 0.000 | 0.000 | 0.000 | 0.000 | 0.000 | 1.309 | 0.000 |
| NT2RP3003044 | 58.906 | 34.057 | 37.901 | 33.307 | 16.940 | 40.357 | 27.766 | 20.617 |
| NT2RP3003047 | 299.110 | 142.539 | 196.643 | 84.285 | 77.718 | 179.257 | 155.007 | 76.424 |
| NT2RP3003050 | 109.372 | 50.507 | 141.571 | 31.797 | 25.077 | 71.052 | 48.869 | 21.064 |
| NT2RP3003053 | 274.051 | 115.298 | 324.746 | 103.977 | 94.331 | 152.747 | 122.042 | 87.952 |
| NT2RP3003059 | 2.357 | 7.346 | 12.467 | 3.194 | 4.084 | 5.560 | 5.012 | 5.335 |
| NT2RP3003061 | 73.691 | 33.582 | 61.169 | 13.328 | 36.122 | 45.965 | 43.431 | 12.628 |
| NT2RP3003068 | 37.384 | 20.186 | 32.010 | 15.417 | 17.562 | 24.065 | 18.951 | 10.008 |
| NT2RP3003071 | 67.292 | 86.945 | 86.857 | 82.004 | 27.275 | 45.183 | 35.965 | 42.507 |
| NT2RP3003076 | 416.323 | 202.004 | 220.395 | 107.162 | 152.849 | 340.664 | 234.319 | 136.293 |
| NT2RP3003078 | 71.012 | 26.534 | 49.393 | 29.939 | 5.761 | 38.583 | 27.416 | 13.913 |
| NT2RP3003081 | 19.188 | 18.554 | 20.891 | 20.934 | 9.794 | 13.502 | 9.853 | 16.047 |
| NT2RP3003090 | 24.820 | 15.196 | 39.751 | 22.524 | 18.155 | 24.073 | 18.075 | 11.570 |
| NT2RP3003097 | 40.069 | 29.407 | 79.380 | 21.495 | 17.378 | 23.253 | 27.673 | 8.566 |
| NT2RP3003098 | 13.217 | 23.032 | 48.998 | 16.354 | 11.329 | 10.279 | 11.069 | 6.398 |
| NT2RP3003101 | 39.920 | 30.326 | 45.276 | 16.850 | 23.417 | 25.447 | 16.056 | 8.843 |
| NT2RP3003109 | 119.924 | 108.927 | 295.233 | 59.830 | 51.482 | 54.674 | 35.646 | 24.366 |
| NT2RP3003121 | 2393.421 | 71.299 | 32.543 | 7.629 | 41.587 | 1873.484 | 227.334 | 18.974 |
| NT2RP3003133 | 11.661 | 5.814 | 23.481 | 8.926 | 17.718 | 13.665 | 11.081 | 14.402 |
| NT2RP3003137 | 68.371 | 27.614 | 38.170 | 18.316 | 18.742 | 45.822 | 36.054 | 10.575 |
| NT2RP3003138 | 44.343 | 32.139 | 50.171 | 17.889 | 22.092 | 27.827 | 31.428 | 9.428 |
| NT2RP3003139 | 32.937 | 37.068 | 127.432 | 21.947 | 22.860 | 33.577 | 10.762 | 15.124 |
| NT2RP3003145 | 64.875 | 32.258 | 72.318 | 22.546 | 31.586 | 50.878 | 56.040 | 16.059 |
| NT2RP3003150 | 42.321 | 27.108 | 62.590 | 18.416 | 21.031 | 25.656 | 29.781 | 16.540 |
| NT2RP3003157 | 188.220 | 140.662 | 506.895 | 130.211 | 104.053 | 100.283 | 60.660 | 81.294 |
| NT2RP3003185 | 35.909 | 24.691 | 42.997 | 16.452 | 17.320 | 37.070 | 32.807 | 25.906 |
| NT2RP3003193 | 48.750 | 36.867 | 108.147 | 41.546 | 24.503 | 37.327 | 24.359 | 47.838 |
| NT2RP3003197 | 43.343 | 21.902 | 29.083 | 20.464 | 12.340 | 28.720 | 23.116 | 10.543 |
| NT2RP3003203 | 153.994 | 40.417 | 93.798 | 29.132 | 49.066 | 119.739 | 77.380 | 29.340 |
| NT2RP3003204 | 52.532 | 32.770 | 132.406 | 37.419 | 35.096 | 33.072 | 28.607 | 12.176 |
| NT2RP3003210 | 47.284 | 47.257 | 92.480 | 28.382 | 35.162 | 29.885 | 33.588 | 22.998 |
| NT2RP3003212 | 51.752 | 32.358 | 143.629 | 28.494 | 28.759 | 34.382 | 24.899 | 16.702 |
| NT2RP3003213 | 50.864 | 21.698 | 54.368 | 14.258 | 27.197 | 21.835 | 26.272 | 24.633 |
| NT2RP3003224 | 13.983 | 12.957 | 12.821 | 7.212 | 9.704 | 11.616 | 6.674 | 9.347 |
| NT2RP3003226 | 16.228 | 18.549 | 16.359 | 5.465 | 13.435 | 9.616 | 13.939 | 5.004 |
| NT2RP3003230 | 31.730 | 19.544 | 37.790 | 12.117 | 10.448 | 26.264 | 14.491 | 4.525 |
| NT2RP3003235 | 49.021 | 57.135 | 135.476 | 23.077 | 25.398 | 43.447 | 24.772 | 17.016 |
| NT2RP3003242 | 16.643 | 9.743 | 12.011 | 3.953 | 5.705 | 9.943 | 7.847 | 1.564 |
| NT2RP3003251 | 105.227 | 79.924 | 206.051 | 45.598 | 38.945 | 39.441 | 42.132 | 48.708 |
| NT2RP3003252 | 72.597 | 32.121 | 56.052 | 21.016 | 24.060 | 43.414 | 42.743 | 34.203 |
| NT2RP3003258 | 161.647 | 70.976 | 113.824 | 51.504 | 62.130 | 87.395 | 113.828 | 62.410 |
| NT2RP3003260 | 114.060 | 56.574 | 37.258 | 44.299 | 21.435 | 88.808 | 31.572 | 22.039 |
| NT2RP3003264 | 67.795 | 44.399 | 153.011 | 36.137 | 30.168 | 47.695 | 22.285 | 16.139 |
| NT2RP3003273 | 11.164 | 9.672 | 10.474 | 15.421 | 5.945 | 12.757 | 7.385 | 3.145 |

TABLE 99-continued

| | | | | | | | | |
|---|---|---|---|---|---|---|---|---|
| NT2RP3003278 | 21.149 | 2.696 | 5.589 | 11.706 | 2.774 | 13.626 | 10.155 | 3.221 |
| NT2RP3003280 | 27.159 | 20.262 | 31.552 | 13.961 | 13.568 | 10.944 | 21.479 | 28.154 |
| NT2RP3003282 | 46.749 | 20.720 | 28.508 | 11.886 | 15.656 | 31.511 | 27.454 | 26.077 |
| NT2RP3003290 | 149.162 | 75.603 | 249.880 | 57.514 | 56.137 | 81.416 | 57.703 | 30.573 |
| NT2RP3003301 | 52.258 | 34.467 | 128.126 | 22.579 | 18.873 | 27.921 | 26.294 | 25.862 |
| NT2RP3003302 | 46.288 | 23.690 | 92.158 | 17.983 | 15.001 | 23.542 | 18.752 | 19.610 |
| NT2RP3003311 | 4.124 | 7.411 | 10.651 | 6.453 | 14.885 | 11.665 | 3.658 | 3.020 |
| NT2RP3003312 | 14.814 | 8.617 | 14.507 | 5.774 | 2.403 | 16.774 | 9.193 | 8.645 |
| NT2RP3003313 | 15.411 | 6.290 | 9.374 | 4.661 | 3.186 | 10.303 | 5.674 | 15.392 |
| NT2RP3003327 | 48.258 | 39.473 | 117.218 | 19.521 | 16.192 | 24.164 | 15.226 | 21.848 |

TABLE 100

| | | | | | | | | |
|---|---|---|---|---|---|---|---|---|
| NT2RP3003330 | 29.506 | 12.597 | 10.896 | 8.585 | 8.115 | 8.559 | 6.939 | 9.940 |
| NT2RP3003344 | 29.694 | 14.023 | 28.467 | 10.446 | 14.551 | 23.190 | 14.110 | 21.136 |
| NT2RP3003346 | 105.530 | 66.425 | 241.668 | 37.233 | 38.412 | 50.911 | 50.114 | 35.893 |
| NT2RP3003349 | 20.318 | 21.037 | 19.247 | 6.025 | 8.572 | 15.104 | 15.004 | 13.774 |
| NT2RP3003353 | 10.529 | 10.306 | 3.139 | 3.872 | 5.195 | 16.793 | 3.277 | 2.796 |
| NT2RP3003354 | 481.127 | 242.462 | 577.215 | 170.336 | 177.749 | 307.555 | 235.179 | 214.175 |
| NT2RP3003368 | 47.684 | 23.833 | 38.838 | 12.045 | 15.329 | 29.997 | 27.654 | 13.096 |
| NT2RP3003375 | 9.531 | 13.959 | 20.610 | 8.653 | 7.770 | 15.597 | 5.760 | 11.087 |
| NT2RP3003377 | 166.751 | 42.971 | 84.536 | 25.743 | 44.033 | 73.870 | 73.821 | 25.200 |
| NT2RP3003384 | 44.335 | 23.396 | 37.902 | 18.516 | 20.006 | 33.001 | 24.969 | 18.065 |
| NT2RP3003385 | 94.843 | 42.782 | 74.715 | 20.456 | 31.187 | 68.473 | 67.072 | 48.712 |
| NT2RP3003396 | 33.482 | 30.352 | 33.756 | 14.143 | 15.615 | 30.475 | 16.101 | 15.251 |
| NT2RP3003403 | 53.313 | 37.215 | 59.716 | 18.488 | 19.630 | 41.023 | 7.020 | 14.203 |
| NT2RP3003409 | 34.343 | 23.644 | 29.939 | 10.044 | 13.315 | 26.899 | 23.574 | 10.007 |
| NT2RP3003411 | 79.480 | 70.920 | 90.615 | 61.424 | 39.065 | 48.593 | 32.903 | 26.101 |
| NT2RP3003420 | 61.545 | 52.479 | 134.682 | 28.549 | 32.168 | 25.103 | 23.751 | 18.844 |
| NT2RP3003425 | 28.870 | 18.577 | 22.890 | 8.071 | 10.241 | 21.558 | 25.924 | 11.363 |
| NT2RP3003426 | 126.098 | 63.120 | 93.804 | 24.452 | 32.319 | 90.461 | 44.692 | 26.808 |
| NT2RP3003427 | 53.936 | 61.645 | 67.284 | 18.467 | 14.098 | 40.426 | 41.425 | 24.813 |
| NT2RP3003433 | 97.022 | 87.577 | 196.547 | 46.930 | 103.713 | 35.421 | 49.581 | 51.308 |
| NT2RP3003437 | 70.471 | 90.341 | 101.893 | 38.490 | 90.843 | 65.265 | 43.848 | 39.524 |
| NT2RP3003448 | 166.318 | 99.558 | 171.792 | 33.106 | 57.030 | 82.442 | 40.878 | 33.734 |
| NT2RP3003455 | 98.805 | 99.945 | 87.828 | 44.898 | 40.079 | 47.665 | 54.700 | 42.051 |
| NT2RP3003462 | 42.184 | 21.903 | 23.018 | 11.812 | 14.369 | 18.994 | 22.972 | 14.965 |
| NT2RP3003464 | 20.285 | 19.800 | 20.515 | 13.066 | 11.398 | 11.185 | 9.509 | 8.151 |
| NT2RP3003469 | 63.020 | 31.314 | 45.443 | 12.277 | 22.567 | 43.698 | 25.742 | 22.878 |
| NT2RP3003473 | 49.194 | 61.265 | 73.244 | 52.029 | 33.239 | 49.762 | 41.082 | 60.344 |
| NT2RP3003474 | 25.607 | 8.816 | 7.783 | 3.674 | 4.629 | 13.456 | 6.864 | 6.240 |
| NT2RP3003475 | 68.962 | 28.799 | 37.252 | 11.016 | 19.936 | 32.908 | 31.492 | 21.824 |
| NT2RP3003490 | 20.464 | 20.731 | 22.026 | 3.717 | 16.041 | 3.738 | 7.208 | 8.419 |
| NT2RP3003491 | 10.282 | 25.486 | 15.580 | 15.193 | 6.202 | 6.287 | 6.927 | 9.848 |
| NT2RP3003493 | 225.729 | 58.149 | 69.338 | 48.207 | 44.647 | 93.915 | 53.796 | 47.878 |
| NT2RP3003500 | 16.211 | 21.791 | 23.783 | 12.174 | 8.905 | 10.384 | 6.189 | 9.984 |
| NT2RP3003527 | 35.235 | 13.032 | 16.125 | 4.540 | 9.823 | 21.336 | 14.921 | 8.623 |
| NT2RP3003532 | 35.952 | 35.805 | 89.452 | 21.080 | 32.372 | 12.131 | 23.670 | 14.186 |
| NT2RP3003535 | 30.511 | 17.215 | 16.247 | 3.432 | 9.615 | 14.199 | 11.449 | 7.658 |
| NT2RP3003536 | 35.415 | 11.045 | 31.565 | 10.484 | 18.265 | 21.717 | 21.923 | 38.703 |
| NT2RP3003543 | 69.871 | 52.348 | 78.481 | 28.057 | 40.066 | 19.654 | 56.835 | 72.031 |
| NT2RP3003549 | 42.025 | 14.802 | 50.570 | 18.842 | 33.282 | 15.787 | 31.229 | 23.611 |
| NT2RP3003552 | 4.529 | 4.296 | 2.807 | 0.000 | 4.647 | 10.319 | 2.766 | 9.014 |
| NT2RP3003555 | 57.410 | 40.350 | 57.743 | 40.386 | 32.961 | 12.721 | 42.457 | 36.766 |
| NT2RP3003559 | 20.066 | 11.398 | 15.254 | 4.806 | 6.892 | 5.159 | 6.000 | 8.501 |
| NT2RP3003564 | 66.462 | 28.214 | 41.863 | 14.294 | 13.568 | 36.338 | 25.239 | 22.138 |
| NT2RP3003572 | 50.882 | 28.277 | 31.870 | 11.128 | 15.322 | 36.904 | 28.134 | 19.912 |
| NT2RP3003576 | 236.584 | 162.700 | 666.955 | 119.960 | 79.895 | 90.587 | 262.925 | 105.267 |
| NT2RP3003587 | 34.277 | 96.685 | 36.352 | 13.214 | 15.718 | 5.529 | 28.863 | 23.236 |
| NT2RP3003589 | 69.284 | 86.270 | 72.517 | 19.025 | 34.071 | 58.468 | 35.012 | 42.995 |
| NT2RP3003592 | 93.627 | 36.255 | 60.268 | 26.747 | 38.599 | 27.570 | 31.962 | 29.013 |
| NT2RP3003593 | 64.187 | 68.925 | 34.760 | 5.259 | 11.913 | 10.024 | 11.351 | 30.666 |
| NT2RP3003614 | 202.651 | 80.341 | 135.229 | 42.309 | 52.562 | 65.826 | 104.861 | 77.771 |
| NT2RP3003621 | 15.164 | 13.030 | 15.710 | 5.347 | 0.000 | 7.392 | 5.209 | 11.686 |
| NT2RP3003625 | 131.346 | 86.625 | 204.034 | 32.075 | 25.952 | 35.395 | 31.357 | 56.208 |
| NT2RP3003627 | 95.853 | 64.906 | 113.102 | 24.418 | 43.349 | 33.276 | 48.816 | 77.820 |
| NT2RP3003636 | 87.887 | 33.546 | 51.644 | 14.475 | 38.157 | 18.067 | 40.566 | 25.499 |
| NT2RP3003642 | 33.158 | 29.959 | 62.265 | 29.745 | 29.841 | 31.737 | 24.361 | 56.869 |
| NT2RP3003645 | 42.276 | 23.456 | 37.015 | 12.651 | 15.281 | 37.561 | 21.220 | 15.411 |
| NT2RP3003648 | 53.111 | 36.625 | 54.165 | 13.954 | 21.371 | 20.753 | 30.160 | 30.265 |
| NT2RP3003649 | 13.907 | 1.465 | 7.845 | 4.909 | 3.500 | 3.731 | 3.722 | 21.889 |
| NT2RP3003650 | 70.844 | 54.077 | 30.996 | 32.103 | 41.741 | 11.885 | 4.037 | 9.110 |
| NT2RP3003656 | 60.131 | 39.399 | 21.967 | 19.082 | 28.005 | 21.521 | 5.926 | 6.462 |
| NT2RP3003659 | 60.751 | 25.453 | 29.389 | 28.617 | 49.090 | 33.702 | 21.321 | 11.457 |
| NT2RP3003662 | 44.735 | 45.811 | 57.204 | 18.032 | 8.625 | 30.812 | 16.749 | 60.144 |
| NT2RP3003664 | 31.481 | 40.038 | 50.322 | 14.238 | 24.609 | 25.151 | 18.244 | 27.693 |
| NT2RP3003665 | 9.682 | 7.431 | 10.792 | 3.210 | 5.228 | 8.900 | 22.769 | 15.662 |

TABLE 101

| | | | | | | | | |
|---|---|---|---|---|---|---|---|---|
| NT2RP3003671 | 19.991 | 16.142 | 32.517 | 10.512 | 26.620 | 6.813 | 15.367 | 4.134 |
| NT2RP3003672 | 59.637 | 70.861 | 52.702 | 21.219 | 42.465 | 28.220 | 33.602 | 25.472 |
| NT2RP3003673 | 22.381 | 26.615 | 29.196 | 8.319 | 9.184 | 13.218 | 19.475 | 8.663 |
| NT2RP3003679 | 210.406 | 183.454 | 88.575 | 68.184 | 55.109 | 70.199 | 47.217 | 161.678 |
| NT2RP3003680 | 36.432 | 9.726 | 11.980 | 2.868 | 17.580 | 10.982 | 9.675 | 4.489 |
| NT2RP3003686 | 23.300 | 18.187 | 60.813 | 12.758 | 15.373 | 14.321 | 13.248 | 18.094 |
| NT2RP3003689 | 16.292 | 10.228 | 7.344 | 18.943 | 22.892 | 23.049 | 1.755 | 14.648 |
| NT2RP3003697 | 18.041 | 18.889 | 23.041 | 11.465 | 5.304 | 14.646 | 14.387 | 27.765 |
| NT2RP3003701 | 23.411 | 19.362 | 26.737 | 5.128 | 15.953 | 19.109 | 21.561 | 12.363 |
| NT2RP3003704 | 83.293 | 69.818 | 227.532 | 48.512 | 34.531 | 23.793 | 34.747 | 31.728 |
| NT2RP3003714 | 27.845 | 26.701 | 35.031 | 16.071 | 1.707 | 11.396 | 10.568 | 7.157 |
| NT2RP3003716 | 23.382 | 29.412 | 32.116 | 1.957 | 10.013 | 19.271 | 16.236 | 6.862 |
| NT2RP3003721 | 47.677 | 30.191 | 49.197 | 16.267 | 34.684 | 31.096 | 35.668 | 28.013 |
| NT2RP3003722 | 23.636 | 24.625 | 30.510 | 14.691 | 14.255 | 9.224 | 6.260 | 18.801 |
| NT2RP3003726 | 71.518 | 25.344 | 63.123 | 17.350 | 34.451 | 43.109 | 46.483 | 33.548 |
| NT2RP3003729 | 48.252 | 22.558 | 41.664 | 11.182 | 23.933 | 14.940 | 29.613 | 40.648 |
| NT2RP3003731 | 117.126 | 53.921 | 150.601 | 44.104 | 59.737 | 67.883 | 52.971 | 70.102 |
| NT2RP3003740 | 95.127 | 38.608 | 55.360 | 23.461 | 31.988 | 57.694 | 54.566 | 25.167 |
| NT2RP3003746 | 16.191 | 12.220 | 16.980 | 7.510 | 13.596 | 12.664 | 8.103 | 4.718 |
| NT2RP3003749 | 0.000 | 0.000 | 0.000 | 0.603 | 0.000 | 2.487 | 2.557 | 3.945 |
| NT2RP3003754 | 15.865 | 21.394 | 19.162 | 12.449 | 13.299 | 26.475 | 9.854 | 18.648 |
| NT2RP3003759 | 0.000 | 0.000 | 0.000 | 1.040 | 0.228 | 0.000 | 0.000 | 0.000 |
| NT2RP3003764 | 83.938 | 66.804 | 64.694 | 34.845 | 35.239 | 58.222 | 58.654 | 59.695 |
| NT2RP3003766 | 65.630 | 30.349 | 55.241 | 12.627 | 24.046 | 19.839 | 39.865 | 29.001 |
| NT2RP3003767 | 70.910 | 69.657 | 250.723 | 42.998 | 34.723 | 31.166 | 25.595 | 43.641 |
| NT2RP3003778 | 131.825 | 86.793 | 385.771 | 86.755 | 57.514 | 68.379 | 54.893 | 62.981 |
| NT2RP3003779 | 109.510 | 79.471 | 82.764 | 30.193 | 42.973 | 68.003 | 45.497 | 45.498 |
| NT2RP3003783 | 20.728 | 49.548 | 65.851 | 31.076 | 42.337 | 19.891 | 30.990 | 36.938 |
| NT2RP3003787 | 52.420 | 24.376 | 34.398 | 5.999 | 3.586 | 110.807 | 52.440 | 37.987 |
| NT2RP3003789 | 49.434 | 35.220 | 51.425 | 19.152 | 23.911 | 36.130 | 35.358 | 51.169 |
| NT2RP3003795 | 35.141 | 27.549 | 49.460 | 9.850 | 9.646 | 24.082 | 23.805 | 22.055 |
| NT2RP3003799 | 43.365 | 13.905 | 22.874 | 6.981 | 14.894 | 24.044 | 24.707 | 15.462 |
| NT2RP3003800 | 33.918 | 17.363 | 27.230 | 9.216 | 12.645 | 25.354 | 23.431 | 31.197 |
| NT2RP3003805 | 63.293 | 44.084 | 37.398 | 25.212 | 22.134 | 20.827 | 35.180 | 33.836 |
| NT2RP3003809 | 31.815 | 50.351 | 23.357 | 8.497 | 6.068 | 18.501 | 12.588 | 23.610 |
| NT2RP3003819 | 524.121 | 195.245 | 386.972 | 66.656 | 124.750 | 204.320 | 163.951 | 105.623 |
| NT2RP3003824 | 23.645 | 17.797 | 34.795 | 9.543 | 22.963 | 19.518 | 18.840 | 18.478 |
| NT2RP3003825 | 100.544 | 64.212 | 102.915 | 27.816 | 51.197 | 72.544 | 46.338 | 78.067 |
| NT2RP3003828 | 13.857 | 3.284 | 8.953 | 5.968 | 12.172 | 6.483 | 4.696 | 6.839 |
| NT2RP3003831 | 58.812 | 63.105 | 141.638 | 36.763 | 42.372 | 35.689 | 36.027 | 61.956 |
| NT2RP3003833 | 37.263 | 25.079 | 32.114 | 16.395 | 15.132 | 21.745 | 17.267 | 29.782 |
| NT2RP3003836 | 139.979 | 72.806 | 102.049 | 51.574 | 60.838 | 71.273 | 62.037 | 67.712 |
| NT2RP3003842 | 173.727 | 172.520 | 421.266 | 66.791 | 82.994 | 67.844 | 51.328 | 70.400 |
| NT2RP3003843 | 40.446 | 57.570 | 27.866 | 10.205 | 61.585 | 12.265 | 18.777 | 39.377 |
| NT2RP3003844 | 71.843 | 59.271 | 53.342 | 25.835 | 23.638 | 29.874 | 45.658 | 29.555 |
| NT2RP3003846 | 9.016 | 12.338 | 29.501 | 8.508 | 8.017 | 9.155 | 11.844 | 13.878 |
| NT2RP3003849 | 59.374 | 29.253 | 45.542 | 15.609 | 18.400 | 31.563 | 24.824 | 35.683 |
| NT2RP3003862 | 28.859 | 32.198 | 37.516 | 7.219 | 14.207 | 16.311 | 10.540 | 19.157 |
| NT2RP3003870 | 163.978 | 56.534 | 97.566 | 27.696 | 45.763 | 66.411 | 66.181 | 41.207 |
| NT2RP3003874 | 25.106 | 64.501 | 32.262 | 14.095 | 20.034 | 22.879 | 79.189 | 8.302 |
| NT2RP3003876 | 57.365 | 29.873 | 42.814 | 12.716 | 37.174 | 19.085 | 11.236 | 26.223 |
| NT2RP3003880 | 46.503 | 23.356 | 32.742 | 9.926 | 15.723 | 26.939 | 26.220 | 22.845 |
| NT2RP3003889 | 7.749 | 87.132 | 0.000 | 4.141 | 0.000 | 9.987 | 0.000 | 44.372 |
| NT2RP3003891 | 25.663 | 16.659 | 18.188 | 7.572 | 4.310 | 18.561 | 10.999 | 21.695 |
| NT2RP3003914 | 84.860 | 63.645 | 125.797 | 31.137 | 33.556 | 38.079 | 39.405 | 63.562 |
| NT2RP3003915 | 24.657 | 11.712 | 30.742 | 7.298 | 10.691 | 17.859 | 22.731 | 9.083 |
| NT2RP3003918 | 73.118 | 28.378 | 32.082 | 12.218 | 25.015 | 44.211 | 27.234 | 26.810 |
| NT2RP3003920 | 52.911 | 76.524 | 182.384 | 22.589 | 23.248 | 24.928 | 25.551 | 47.359 |
| NT2RP3003924 | 42.265 | 34.488 | 91.378 | 12.690 | 20.859 | 21.272 | 23.509 | 18.187 |
| NT2RP3003932 | 43.906 | 36.677 | 103.580 | 18.902 | 39.162 | 15.130 | 39.334 | 27.069 |
| NT2RP3003939 | 45.015 | 23.114 | 34.980 | 14.860 | 22.109 | 22.574 | 16.204 | 23.960 |
| NT2RP3003940 | 73.958 | 53.552 | 60.719 | 18.245 | 37.229 | 44.476 | 29.223 | 32.163 |
| NT2RP3003943 | 76.185 | 17.072 | 23.043 | 7.858 | 34.360 | 21.195 | 34.259 | 44.238 |
| NT2RP3003959 | 33.097 | 24.518 | 31.719 | 13.955 | 19.977 | 24.442 | 23.073 | 22.296 |

TABLE 102

| | | | | | | | | |
|---|---|---|---|---|---|---|---|---|
| NT2RP3003963 | 225.975 | 65.265 | 81.733 | 29.808 | 52.069 | 80.205 | 81.146 | 44.991 |
| NT2RP3003965 | 116.328 | 148.769 | 160.481 | 123.378 | 65.718 | 64.058 | 36.726 | 123.379 |
| NT2RP3003972 | 178.647 | 135.585 | 147.168 | 34.841 | 77.695 | 106.673 | 70.941 | 52.120 |
| NT2RP3003973 | 62.806 | 37.262 | 47.172 | 25.442 | 23.541 | 30.764 | 27.857 | 45.075 |
| NT2RP3003979 | 42.205 | 32.192 | 109.653 | 39.966 | 32.734 | 35.850 | 18.262 | 64.857 |
| NT2RP3003980 | 43.589 | 24.631 | 26.030 | 11.906 | 6.253 | 21.641 | 13.122 | 23.086 |
| NT2RP3003982 | 12.297 | 22.386 | 11.608 | 2.387 | 11.030 | 5.747 | 12.456 | 34.995 |
| NT2RP3003989 | 17.308 | 4.219 | 22.495 | 7.718 | 11.234 | 3.600 | 3.546 | 106.880 |
| NT2RP3003992 | 38.217 | 23.384 | 39.566 | 7.169 | 21.356 | 24.091 | 21.385 | 25.954 |

TABLE 102-continued

| | | | | | | | | |
|---|---|---|---|---|---|---|---|---|
| NT2RP3004000 | 14.260 | 12.046 | 9.623 | 3.141 | 15.292 | 10.563 | 26.334 | 5.687 |
| NT2RP3004001 | 15.524 | 17.005 | 53.914 | 11.406 | 10.314 | 27.264 | 13.462 | 16.712 |
| NT2RP3004005 | 9.869 | 9.263 | 84.786 | 19.372 | 0.000 | 4.857 | 1.497 | 9.756 |
| NT2RP3004013 | 14.485 | 12.461 | 42.406 | 11.492 | 13.049 | 8.125 | 6.478 | 17.758 |
| NT2RP3004016 | 26.353 | 20.174 | 14.242 | 8.659 | 7.098 | 11.464 | 20.928 | 17.553 |
| NT2RP3004025 | 60.555 | 22.329 | 39.729 | 22.559 | 18.276 | 23.525 | 24.555 | 35.771 |
| NT2RP3004030 | 612.399 | 230.471 | 834.283 | 175.098 | 230.371 | 417.549 | 400.971 | 300.584 |
| NT2RP3004041 | 35.758 | 19.204 | 29.889 | 17.016 | 20.612 | 23.674 | 15.019 | 17.667 |
| NT2RP3004042 | 212.341 | 150.283 | 197.509 | 53.931 | 78.902 | 164.218 | 126.411 | 98.212 |
| NT2RP3004044 | 72.252 | 110.791 | 51.482 | 17.239 | 26.945 | 24.143 | 30.198 | 21.882 |
| NT2RP3004051 | 152.863 | 73.839 | 142.232 | 35.932 | 51.071 | 43.163 | 38.869 | 49.345 |
| NT2RP3004052 | 121.021 | 59.192 | 74.633 | 29.148 | 35.481 | 72.900 | 21.817 | 40.892 |
| NT2RP3004053 | 98.068 | 91.523 | 277.692 | 61.036 | 78.666 | 68.730 | 38.992 | 75.069 |
| NT2RP3004055 | 94.456 | 63.815 | 20.623 | 13.216 | 5.886 | 21.414 | 72.807 | 7.926 |
| NT2RP3004059 | 26.860 | 40.017 | 21.750 | 33.539 | 23.030 | 10.773 | 12.908 | 18.849 |
| NT2RP3004063 | 18.643 | 7.895 | 20.299 | 7.097 | 24.752 | 5.609 | 24.116 | 30.966 |
| NT2RP3004067 | 252.237 | 73.282 | 95.895 | 48.083 | 19.941 | 65.794 | 83.498 | 20.778 |
| NT2RP3004070 | 48.573 | 60.633 | 86.573 | 21.957 | 33.015 | 28.191 | 23.513 | 30.233 |
| NT2RP3004075 | 38.601 | 29.096 | 32.376 | 11.710 | 25.118 | 31.470 | 27.043 | 31.641 |
| NT2RP3004078 | 123.241 | 42.946 | 72.005 | 18.027 | 27.424 | 76.975 | 68.265 | 35.076 |
| NT2RP3004083 | 44.275 | 15.592 | 19.299 | 10.656 | 16.243 | 25.486 | 10.927 | 25.077 |
| NT2RP3004084 | 20.841 | 11.260 | 17.316 | 13.491 | 18.285 | 6.670 | 5.617 | 3.170 |
| NT2RP3004087 | 61.884 | 66.963 | 88.119 | 34.544 | 41.231 | 18.188 | 46.470 | 43.578 |
| NT2RP3004090 | 36.365 | 32.568 | 40.579 | 21.173 | 17.529 | 18.879 | 17.880 | 26.579 |
| NT2RP3004093 | 161.528 | 139.905 | 344.325 | 50.577 | 97.795 | 88.393 | 53.404 | 59.593 |
| NT2RP3004095 | 200.143 | 125.167 | 292.455 | 60.637 | 74.060 | 107.607 | 74.457 | 93.441 |
| NT2RP3004102 | 189.415 | 73.338 | 84.114 | 25.857 | 52.758 | 90.150 | 84.260 | 44.710 |
| NT2RP3004110 | 147.625 | 133.897 | 357.078 | 89.105 | 74.491 | 121.974 | 73.119 | 123.538 |
| NT2RP3004119 | 104.164 | 75.262 | 197.706 | 41.776 | 44.915 | 38.873 | 58.991 | 47.932 |
| NT2RP3004125 | 312.772 | 144.655 | 288.945 | 81.440 | 117.997 | 203.963 | 194.543 | 177.494 |
| NT2RP3004129 | 32.046 | 25.525 | 80.210 | 15.236 | 13.862 | 6.399 | 91.521 | 13.988 |
| NT2RP3004130 | 49.467 | 45.820 | 69.122 | 17.019 | 28.933 | 35.035 | 32.730 | 28.345 |
| NT2RP3004133 | 55.970 | 58.961 | 100.212 | 16.731 | 9.248 | 33.261 | 34.485 | 27.866 |
| NT2RP3004145 | 105.806 | 51.341 | 52.276 | 13.000 | 30.673 | 49.189 | 43.159 | 26.374 |
| NT2RP3004148 | 206.658 | 51.505 | 96.093 | 26.557 | 47.130 | 133.546 | 97.568 | 36.471 |
| NT2RP3004155 | 65.340 | 68.555 | 193.114 | 35.362 | 55.725 | 47.245 | 42.482 | 35.181 |
| NT2RP3004165 | 31.599 | 44.217 | 34.859 | 21.674 | 20.207 | 39.412 | 7.182 | 33.175 |
| NT2RP3004179 | 35.856 | 20.632 | 34.990 | 9.754 | 16.663 | 24.234 | 26.890 | 25.902 |
| NT2RP3004185 | 32.929 | 15.710 | 25.847 | 5.595 | 13.361 | 12.464 | 17.666 | 14.309 |
| NT2RP3004188 | 125.817 | 53.211 | 66.560 | 31.419 | 32.369 | 61.530 | 53.134 | 39.182 |
| NT2RP3004189 | 71.207 | 30.246 | 39.386 | 13.328 | 16.496 | 45.470 | 27.774 | 13.851 |
| NT2RP3004190 | 23.559 | 32.253 | 43.574 | 9.312 | 53.269 | 16.769 | 14.567 | 17.553 |
| NT2RP3004191 | 83.281 | 88.775 | 164.178 | 69.201 | 36.600 | 55.079 | 55.128 | 50.378 |
| NT2RP3004202 | 65.428 | 24.275 | 29.745 | 9.879 | 16.541 | 26.270 | 30.799 | 19.098 |
| NT2RP3004205 | 85.092 | 47.734 | 63.971 | 13.089 | 27.925 | 58.672 | 54.078 | 34.998 |
| NT2RP3004206 | 14.256 | 29.344 | 64.128 | 15.347 | 7.707 | 19.033 | 11.635 | 37.827 |
| NT2RP3004207 | 43.461 | 19.436 | 50.653 | 17.280 | 18.710 | 28.637 | 29.185 | 24.442 |
| NT2RP3004209 | 25.959 | 24.203 | 39.564 | 19.865 | 19.485 | 19.029 | 15.259 | 22.310 |
| NT2RP3004215 | 31.701 | 16.545 | 24.589 | 8.189 | 19.140 | 22.457 | 12.156 | 6.928 |
| NT2RP3004219 | 155.994 | 82.391 | 96.342 | 22.107 | 51.385 | 131.790 | 96.886 | 48.658 |
| NT2RP3004242 | 24.137 | 26.975 | 34.382 | 16.270 | 12.213 | 15.115 | 13.723 | 32.886 |
| NT2RP3004246 | 77.637 | 61.572 | 206.426 | 50.779 | 31.994 | 42.306 | 32.830 | 60.878 |
| NT2RP3004253 | 33.041 | 24.223 | 39.674 | 7.658 | 22.082 | 33.370 | 29.632 | 32.520 |
| NT2RP3004258 | 33.065 | 42.534 | 65.365 | 25.376 | 34.541 | 29.550 | 19.844 | 49.800 |
| NT2RP3004262 | 71.434 | 29.972 | 47.060 | 12.020 | 24.614 | 35.849 | 39.562 | 57.434 |

TABLE 103

| | | | | | | | | |
|---|---|---|---|---|---|---|---|---|
| NT2RP3004275 | 98.699 | 36.290 | 83.006 | 24.540 | 22.746 | 61.823 | 54.050 | 37.950 |
| NT2RP3004282 | 220.789 | 134.052 | 178.061 | 49.657 | 96.836 | 146.266 | 106.109 | 47.357 |
| NT2RP3004289 | 15.745 | 32.192 | 24.193 | 7.292 | 8.756 | 13.882 | 7.956 | 36.428 |
| NT2RP3004294 | 60.266 | 26.724 | 26.421 | 11.149 | 5.484 | 19.565 | 13.721 | 12.117 |
| NT2RP3004298 | 132.592 | 61.132 | 108.061 | 41.028 | 51.835 | 81.222 | 91.861 | 86.967 |
| NT2RP3004309 | 144.028 | 38.007 | 72.661 | 18.449 | 49.804 | 89.984 | 72.157 | 51.104 |
| NT2RP3004321 | 231.684 | 53.180 | 108.237 | 29.746 | 51.266 | 130.535 | 104.335 | 90.745 |
| NT2RP3004322 | 37.875 | 23.343 | 26.724 | 12.249 | 19.668 | 22.470 | 23.599 | 36.486 |
| NT2RP3004332 | 106.333 | 91.471 | 249.231 | 44.955 | 55.341 | 76.389 | 72.376 | 107.059 |
| NT2RP3004334 | 68.850 | 32.416 | 38.130 | 9.752 | 18.775 | 14.058 | 18.048 | 16.320 |
| NT2RP3004336 | 51.294 | 59.827 | 77.110 | 20.736 | 37.630 | 26.664 | 34.386 | 34.983 |
| NT2RP3004338 | 18.622 | 16.241 | 17.569 | 3.872 | 10.946 | 14.386 | 14.110 | 86.362 |
| NT2RP3004341 | 19.200 | 20.230 | 19.614 | 6.657 | 8.502 | 12.520 | 6.268 | 32.744 |
| NT2RP3004345 | 23.625 | 19.497 | 30.403 | 9.060 | 9.720 | 11.640 | 14.563 | 16.985 |
| NT2RP3004348 | 152.635 | 117.901 | 359.204 | 67.822 | 108.792 | 59.212 | 48.175 | 79.425 |
| NT2RP3004349 | 156.222 | 104.964 | 468.032 | 69.388 | 77.765 | 53.467 | 43.103 | 73.727 |
| NT2RP3004355 | 58.395 | 30.712 | 72.395 | 19.596 | 16.476 | 48.617 | 127.957 | 121.148 |
| NT2RP3004356 | 110.831 | 61.735 | 75.603 | 20.147 | 52.762 | 88.239 | 65.266 | 48.103 |

TABLE 103-continued

| | | | | | | | | |
|---|---|---|---|---|---|---|---|---|
| NT2RP3004360 | 41.674 | 35.467 | 41.306 | 19.910 | 12.453 | 15.566 | 22.989 | 27.326 |
| NT2RP3004361 | 46.996 | 33.404 | 30.049 | 14.201 | 14.577 | 23.509 | 11.195 | 14.723 |
| NT2RP3004374 | 95.389 | 57.120 | 48.566 | 15.283 | 39.161 | 43.002 | 46.264 | 23.628 |
| NT2RP3004378 | 58.764 | 49.662 | 50.107 | 18.157 | 38.127 | 30.939 | 38.526 | 49.716 |
| NT2RP3004399 | 16.800 | 27.122 | 23.992 | 18.781 | 27.937 | 12.441 | 19.782 | 23.253 |
| NT2RP3004405 | 76.975 | 42.401 | 68.536 | 14.461 | 40.127 | 30.855 | 27.361 | 25.603 |
| NT2RP3004406 | 59.371 | 18.451 | 36.531 | 9.936 | 27.693 | 43.690 | 31.470 | 25.327 |
| NT2RP3004411 | 92.442 | 48.901 | 74.904 | 12.415 | 33.625 | 61.907 | 28.318 | 22.563 |
| NT2RP3004424 | 40.886 | 26.604 | 29.952 | 10.559 | 13.320 | 23.158 | 18.753 | 13.677 |
| NT2RP3004428 | 141.707 | 50.415 | 59.329 | 18.251 | 39.655 | 61.213 | 57.747 | 33.647 |
| NT2RP3004432 | 26.049 | 27.127 | 235.751 | 18.465 | 175.041 | 22.755 | 14.727 | 14.260 |
| NT2RP3004434 | 146.690 | 70.435 | 71.916 | 32.310 | 42.640 | 67.791 | 64.267 | 46.448 |
| NT2RP3004446 | 27.192 | 19.189 | 44.272 | 8.673 | 16.147 | 5.257 | 19.506 | 10.316 |
| NT2RP3004451 | 45.826 | 26.986 | 81.355 | 14.858 | 17.991 | 15.972 | 19.748 | 17.124 |
| NT2RP3004454 | 13.596 | 21.506 | 24.434 | 5.907 | 6.024 | 8.062 | 8.872 | 9.047 |
| NT2RP3004466 | 267.157 | 127.933 | 175.917 | 65.272 | 67.867 | 153.148 | 173.844 | 118.891 |
| NT2RP3004470 | 150.361 | 134.643 | 271.527 | 54.812 | 70.601 | 50.612 | 49.084 | 95.231 |
| NT2RP3004472 | 13.995 | 10.444 | 6.945 | 8.463 | 7.742 | 9.150 | 3.258 | 25.525 |
| NT2RP3004475 | 89.313 | 39.845 | 56.364 | 22.197 | 34.071 | 46.397 | 52.228 | 36.349 |
| NT2RP3004480 | 27.508 | 23.946 | 28.297 | 14.978 | 36.756 | 18.216 | 23.949 | 28.732 |
| NT2RP3004481 | 31.506 | 22.386 | 32.532 | 15.846 | 17.215 | 13.188 | 11.393 | 75.655 |
| NT2RP3004490 | 5.922 | 2.592 | 0.000 | 0.000 | 0.000 | 0.000 | 8.285 | 6.621 |
| NT2RP3004496 | 24.027 | 28.908 | 28.749 | 24.196 | 13.349 | 15.561 | 11.595 | 12.252 |
| NT2RP3004498 | 109.432 | 51.964 | 126.945 | 23.368 | 34.097 | 43.928 | 34.988 | 37.439 |
| NT2RP3004503 | 162.798 | 115.770 | 489.798 | 56.760 | 66.406 | 56.670 | 46.593 | 74.722 |
| NT2RP3004504 | 62.371 | 28.837 | 57.527 | 18.389 | 15.784 | 30.245 | 70.081 | 29.325 |
| NT2RP3004505 | 25.650 | 46.920 | 38.179 | 15.593 | 11.983 | 15.997 | 28.823 | 36.454 |
| NT2RP3004507 | 50.531 | 32.594 | 47.091 | 13.176 | 25.414 | 16.514 | 34.107 | 31.896 |
| NT2RP3004519 | 38.355 | 14.576 | 23.652 | 7.881 | 25.541 | 10.577 | 6.345 | 25.622 |
| NT2RP3004524 | 38.228 | 27.009 | 84.901 | 19.528 | 13.759 | 17.664 | 33.496 | 24.924 |
| NT2RP3004527 | 27.651 | 20.933 | 12.117 | 3.539 | 15.253 | 9.821 | 3.786 | 15.761 |
| NT2RP3004534 | 33.516 | 8.840 | 42.395 | 18.636 | 0.000 | 23.692 | 5.434 | 9.045 |
| NT2RP3004539 | 100.285 | 63.233 | 118.931 | 33.763 | 38.717 | 95.714 | 53.713 | 73.442 |
| NT2RP3004541 | 36.828 | 14.720 | 43.013 | 5.166 | 8.200 | 26.251 | 15.421 | 12.869 |
| NT2RP3004544 | 52.885 | 38.258 | 53.085 | 39.055 | 11.567 | 35.154 | 22.436 | 94.341 |
| NT2RP3004551 | 26.759 | 17.006 | 33.344 | 4.740 | 15.511 | 10.082 | 17.450 | 14.870 |
| NT2RP3004552 | 100.028 | 33.565 | 57.413 | 16.213 | 39.101 | 26.011 | 44.497 | 30.764 |
| NT2RP3004557 | 44.768 | 30.470 | 33.284 | 14.695 | 20.775 | 13.301 | 18.512 | 22.802 |
| NT2RP3004561 | 103.770 | 34.283 | 58.620 | 21.128 | 33.914 | 22.418 | 32.255 | 61.361 |
| NT2RP3004566 | 99.005 | 43.108 | 55.789 | 20.777 | 24.049 | 34.687 | 45.052 | 36.253 |
| NT2RP3004569 | 94.551 | 49.341 | 39.943 | 22.787 | 36.432 | 39.608 | 53.015 | 37.001 |
| NT2RP3004572 | 55.491 | 23.041 | 40.509 | 14.634 | 14.847 | 45.626 | 30.377 | 41.143 |
| NT2RP3004578 | 38.321 | 36.168 | 39.762 | 17.939 | 20.596 | 29.096 | 32.099 | 23.011 |
| NT2RP3004584 | 62.502 | 25.851 | 65.773 | 21.818 | 32.015 | 37.561 | 47.268 | 25.404 |
| NT2RP3004588 | 88.255 | 39.095 | 216.247 | 40.330 | 34.231 | 51.647 | 25.258 | 19.672 |
| NT2RP3004594 | 46.177 | 56.747 | 57.402 | 32.610 | 13.065 | 12.913 | 32.945 | 25.495 |

TABLE 104

| | | | | | | | | |
|---|---|---|---|---|---|---|---|---|
| NT2RP3004603 | 78.679 | 80.544 | 62.737 | 47.277 | 28.549 | 51.397 | 38.270 | 98.212 |
| NT2RP3004612 | 74.014 | 32.975 | 30.756 | 11.218 | 37.649 | 29.374 | 13.820 | 21.608 |
| NT2RP3004617 | 34.514 | 16.958 | 15.437 | 7.541 | 9.813 | 10.362 | 13.498 | 6.437 |
| NT2RP3004618 | 45.654 | 67.084 | 24.650 | 10.899 | 12.856 | 27.696 | 15.781 | 34.862 |
| NT2RP3004625 | 75.276 | 30.663 | 96.644 | 20.740 | 43.066 | 82.423 | 59.145 | 28.086 |
| NT2RP3004635 | 67.742 | 53.096 | 56.701 | 30.583 | 29.960 | 46.122 | 44.888 | 61.643 |
| NT2RP3004640 | 89.717 | 58.380 | 202.476 | 49.309 | 45.610 | 45.215 | 57.393 | 54.691 |
| NT2RP3004642 | 173.246 | 73.060 | 118.760 | 36.694 | 65.566 | 113.287 | 76.702 | 49.519 |
| NT2RP3004647 | 101.143 | 79.944 | 113.136 | 52.874 | 50.982 | 53.766 | 48.670 | 44.858 |
| NT2RP3004652 | 203.591 | 158.366 | 434.477 | 72.065 | 120.412 | 63.735 | 70.579 | 53.556 |
| NT2RP3004669 | 83.602 | 70.489 | 66.421 | 12.848 | 23.192 | 58.448 | 88.231 | 37.292 |
| NT2RP3004670 | 193.547 | 128.951 | 178.554 | 73.935 | 102.781 | 166.902 | 107.905 | 94.007 |
| NT2RP4000008 | 19.767 | 47.505 | 24.109 | 17.304 | 29.354 | 55.419 | 33.855 | 34.432 |
| NT2RP4000018 | 56.348 | 39.769 | 80.074 | 15.072 | 26.721 | 42.484 | 38.619 | 43.517 |
| NT2RP4000023 | 53.022 | 17.753 | 34.758 | 10.911 | 23.301 | 26.391 | 19.092 | 19.833 |
| NT2RP4000025 | 45.646 | 56.593 | 72.466 | 8.582 | 83.053 | 47.152 | 45.373 | 52.951 |
| NT2RP4000035 | 119.584 | 72.523 | 321.911 | 40.713 | 60.319 | 94.350 | 45.943 | 45.399 |
| NT2RP4000041 | 186.503 | 56.255 | 41.691 | 8.801 | 47.224 | 60.208 | 34.302 | 31.401 |
| NT2RP4000049 | 47.651 | 27.923 | 39.552 | 7.903 | 6.803 | 18.769 | 24.059 | 13.748 |
| NT2RP4000050 | 46.861 | 18.274 | 33.191 | 8.103 | 13.428 | 12.029 | 13.779 | 7.279 |
| NT2RP4000051 | 40.843 | 29.142 | 32.303 | 10.190 | 21.384 | 40.455 | 39.037 | 17.835 |
| NT2RP4000063 | 43.284 | 30.034 | 25.813 | 11.605 | 18.431 | 28.262 | 27.310 | 20.178 |
| NT2RP4000065 | 11.102 | 17.154 | 21.158 | 43.890 | 19.264 | 6.730 | 6.069 | 32.776 |
| NT2RP4000070 | 59.796 | 43.567 | 133.907 | 34.788 | 23.019 | 47.653 | 20.318 | 14.552 |
| NT2RP4000074 | 18.725 | 4.052 | 10.370 | 1.424 | 4.150 | 8.454 | 6.795 | 2.366 |
| NT2RP4000078 | 62.113 | 86.532 | 57.818 | 34.813 | 30.151 | 56.743 | 50.257 | 36.799 |
| NT2RP4000080 | 224.722 | 111.931 | 192.627 | 75.992 | 91.873 | 205.033 | 130.550 | 126.661 |

TABLE 104-continued

| | | | | | | | | |
|---|---|---|---|---|---|---|---|---|
| NT2RP4000099 | 321.974 | 219.279 | 1600.483 | 150.687 | 285.007 | 248.048 | 126.052 | 293.699 |
| NT2RP4000102 | 8.753 | 18.572 | 15.774 | 4.228 | 7.806 | 9.573 | 53.928 | 13.964 |
| NT2RP4000103 | 34.791 | 23.847 | 32.776 | 10.952 | 8.411 | 17.791 | 47.841 | 72.767 |
| NT2RP4000108 | 62.537 | 43.717 | 44.931 | 25.841 | 148.533 | 28.159 | 30.906 | 35.415 |
| NT2RP4000109 | 261.144 | 124.505 | 231.410 | 69.135 | 84.528 | 232.287 | 157.290 | 146.451 |
| NT2RP4000111 | 28.240 | 10.956 | 13.276 | 3.790 | 9.951 | 18.128 | 12.668 | 12.698 |
| NT2RP4000112 | 174.823 | 126.761 | 222.355 | 29.525 | 41.360 | 94.077 | 68.016 | 67.817 |
| NT2RP4000115 | 104.464 | 46.026 | 87.051 | 17.566 | 38.187 | 78.479 | 43.365 | 44.515 |
| NT2RP4000129 | 20.582 | 20.434 | 22.054 | 7.476 | 11.813 | 11.733 | 11.125 | 12.513 |
| NT2RP4000137 | 40.931 | 26.333 | 38.192 | 19.805 | 13.933 | 28.819 | 22.933 | 25.032 |
| NT2RP4000138 | 53.828 | 41.054 | 56.796 | 8.100 | 30.556 | 62.995 | 15.210 | 44.386 |
| NT2RP4000141 | 62.206 | 42.856 | 27.517 | 15.337 | 27.602 | 16.576 | 20.734 | 34.135 |
| NT2RP4000147 | 26.467 | 16.245 | 24.754 | 8.363 | 10.418 | 21.963 | 32.513 | 27.229 |
| NT2RP4000150 | 170.729 | 155.621 | 193.591 | 111.407 | 84.297 | 120.085 | 78.831 | 153.213 |
| NT2RP4000151 | 89.499 | 70.326 | 88.485 | 15.693 | 34.976 | 55.423 | 46.381 | 38.147 |
| NT2RP4000157 | 374.212 | 306.778 | 1320.234 | 101.052 | 267.293 | 258.633 | 142.467 | 214.943 |
| NT2RP4000159 | 21.294 | 38.510 | 22.222 | 4.978 | 9.029 | 6.726 | 11.020 | 2.839 |
| NT2RP4000163 | 38.106 | 28.442 | 47.497 | 14.252 | 14.961 | 40.800 | 33.454 | 23.270 |
| NT2RP4000167 | 20.173 | 26.500 | 23.216 | 7.845 | 5.552 | 5.423 | 7.245 | 14.035 |
| NT2RP4000171 | 81.073 | 52.022 | 67.728 | 21.187 | 28.509 | 44.872 | 35.093 | 37.752 |
| NT2RP4000175 | 81.743 | 84.274 | 82.433 | 36.175 | 79.980 | 58.585 | 86.742 | 88.656 |
| NT2RP4000180 | 58.476 | 59.435 | 73.494 | 30.105 | 37.648 | 47.113 | 80.700 | 76.984 |
| NT2RP4000185 | 92.601 | 101.645 | 150.266 | 44.577 | 77.183 | 75.717 | 60.488 | 85.600 |
| NT2RP4000192 | 127.476 | 49.521 | 75.782 | 5.687 | 46.143 | 55.129 | 61.367 | 32.097 |
| NT2RP4000194 | 56.167 | 54.180 | 31.757 | 11.553 | 23.917 | 32.670 | 26.241 | 35.726 |
| NT2RP4000196 | 92.478 | 57.125 | 90.828 | 20.213 | 49.026 | 42.066 | 78.755 | 73.674 |
| NT2RP4000210 | 488.775 | 304.062 | 484.740 | 166.128 | 178.561 | 369.938 | 361.357 | 310.071 |
| NT2RP4000212 | 262.175 | 187.947 | 456.537 | 97.216 | 100.219 | 119.552 | 87.129 | 138.067 |
| NT2RP4000214 | 209.094 | 145.483 | 438.818 | 74.480 | 101.385 | 69.191 | 73.163 | 99.829 |
| NT2RP4000216 | 27.754 | 23.804 | 32.743 | 9.142 | 21.766 | 20.150 | 23.347 | 26.648 |
| NT2RP4000218 | 116.307 | 61.722 | 177.365 | 25.931 | 25.141 | 34.742 | 29.243 | 62.428 |
| NT2RP4000223 | 305.665 | 161.526 | 257.394 | 54.652 | 135.566 | 196.254 | 184.146 | 106.046 |
| NT2RP4000243 | 143.570 | 175.090 | 348.917 | 55.746 | 78.966 | 68.882 | 62.393 | 92.330 |
| NT2RP4000246 | 46.967 | 55.303 | 46.655 | 12.855 | 24.581 | 16.374 | 23.615 | 32.643 |
| NT2RP4000250 | 53.966 | 193.957 | 78.957 | 33.077 | 29.249 | 79.779 | 38.597 | 115.514 |
| NT2RP4000256 | 61.500 | 54.535 | 57.504 | 13.472 | 28.112 | 22.609 | 19.612 | 30.227 |
| NT2RP4000257 | 146.739 | 75.562 | 68.081 | 16.986 | 74.826 | 29.177 | 32.953 | 39.299 |

TABLE 105

| | | | | | | | | |
|---|---|---|---|---|---|---|---|---|
| NT2RP4000259 | 36.679 | 60.559 | 46.332 | 10.684 | 19.988 | 21.634 | 16.480 | 15.511 |
| NT2RP4000261 | 43.317 | 19.258 | 30.162 | 7.462 | 9.311 | 20.800 | 15.617 | 17.669 |
| NT2RP4000262 | 57.147 | 28.869 | 41.516 | 10.478 | 21.699 | 32.040 | 20.770 | 27.384 |
| NT2RP4000263 | 26.287 | 13.027 | 49.010 | 13.046 | 27.187 | 12.910 | 17.489 | 13.293 |
| NT2RP4000280 | 404.385 | 153.579 | 276.968 | 132.346 | 126.840 | 273.688 | 195.012 | 134.292 |
| NT2RP4000286 | 349.970 | 68.061 | 124.456 | 10.943 | 103.023 | 163.664 | 158.229 | 165.646 |
| NT2RP4000290 | 69.776 | 37.297 | 56.790 | 14.548 | 26.462 | 24.909 | 28.704 | 27.597 |
| NT2RP4000291 | 92.235 | 210.055 | 87.276 | 110.666 | 29.297 | 73.542 | 109.583 | 151.177 |
| NT2RP4000301 | 72.312 | 25.823 | 43.205 | 17.404 | 22.667 | 20.721 | 34.359 | 47.720 |
| NT2RP4000312 | 30.600 | 23.813 | 38.345 | 71.709 | 0.000 | 27.976 | 30.543 | 16.077 |
| NT2RP4000321 | 152.139 | 101.314 | 320.889 | 47.164 | 45.419 | 56.735 | 18.656 | 58.799 |
| NT2RP4000323 | 37.462 | 25.699 | 95.138 | 15.085 | 11.924 | 10.455 | 5.460 | 17.376 |
| NT2RP4000324 | 336.502 | 41.027 | 28.832 | 17.302 | 54.837 | 40.659 | 43.151 | 23.155 |
| NT2RP4000334 | 115.354 | 138.505 | 182.550 | 93.928 | 63.038 | 90.617 | 72.433 | 115.991 |
| NT2RP4000343 | 75.003 | 25.817 | 17.727 | 13.013 | 26.022 | 34.661 | 24.607 | 19.361 |
| NT2RP4000348 | 56.032 | 12.454 | 12.331 | 15.203 | 15.484 | 6.180 | 3.506 | 18.446 |
| NT2RP4000349 | 7.762 | 0.000 | 0.000 | 3.720 | 0.000 | 0.000 | 0.000 | 6.473 |
| NT2RP4000355 | 87.546 | 71.121 | 115.193 | 27.548 | 24.554 | 33.248 | 29.345 | 30.833 |
| NT2RP4000356 | 211.845 | 121.033 | 114.259 | 51.743 | 65.136 | 144.965 | 93.350 | 89.148 |
| NT2RP4000360 | 70.699 | 38.241 | 86.142 | 10.374 | 34.417 | 19.318 | 20.576 | 39.379 |
| NT2RP4000367 | 18.288 | 5.279 | 7.668 | 4.052 | 7.149 | 4.373 | 5.067 | 3.767 |
| NT2RP4000370 | 32.692 | 19.934 | 38.747 | 6.510 | 17.936 | 9.489 | 6.000 | 24.412 |
| NT2RP4000373 | 8.950 | 23.267 | 11.530 | 6.424 | 4.499 | 3.890 | 0.839 | 4.844 |
| NT2RP4000376 | 35.864 | 18.265 | 19.621 | 12.884 | 15.395 | 5.826 | 23.805 | 21.083 |
| NT2RP4000381 | 46.926 | 33.826 | 103.826 | 18.455 | 27.076 | 17.117 | 10.557 | 22.372 |
| NT2RP4000388 | 5084.865 | 1317.306 | 2099.929 | 227.725 | 2132.319 | 3323.080 | 4907.667 | 1152.125 |
| NT2RP4000390 | 257.545 | 160.161 | 219.816 | 71.826 | 85.442 | 187.036 | 159.581 | 156.149 |
| NT2RP4000393 | 12.640 | 11.957 | 20.415 | 9.221 | 11.409 | 7.438 | 11.324 | 8.524 |
| NT2RP4000398 | 17.518 | 22.876 | 62.033 | 33.290 | 29.094 | 38.274 | 16.243 | 64.756 |
| NT2RP4000406 | 72.166 | 37.198 | 50.776 | 14.912 | 16.850 | 25.605 | 52.793 | 18.016 |
| NT2RP4000407 | 17.281 | 27.203 | 36.363 | 15.988 | 14.182 | 13.109 | 11.945 | 14.661 |
| NT2RP4000413 | 28.139 | 4.608 | 24.755 | 4.471 | 18.199 | 9.618 | 9.564 | 3.410 |
| NT2RP4000415 | 52.988 | 28.236 | 62.216 | 11.670 | 19.273 | 18.078 | 30.417 | 40.803 |
| NT2RP4000417 | 120.835 | 54.541 | 46.666 | 20.336 | 52.684 | 49.364 | 45.494 | 40.422 |
| NT2RP4000423 | 45.442 | 44.179 | 39.359 | 11.506 | 22.404 | 15.869 | 30.636 | 33.860 |
| NT2RP4000424 | 69.125 | 46.323 | 210.620 | 28.361 | 37.650 | 36.808 | 16.234 | 39.788 |

TABLE 105-continued

| | | | | | | | | |
|---|---|---|---|---|---|---|---|---|
| NT2RP4000447 | 43.171 | 50.572 | 84.440 | 39.944 | 38.491 | 45.721 | 39.832 | 64.904 |
| NT2RP4000448 | 19.367 | 24.180 | 80.917 | 16.101 | 11.296 | 3.059 | 13.254 | 21.512 |
| NT2RP4000449 | 13.620 | 10.795 | 11.538 | 2.925 | 6.616 | 4.388 | 8.988 | 2.997 |
| NT2RP4000453 | 16.784 | 23.231 | 20.252 | 12.639 | 17.714 | 8.345 | 19.980 | 15.034 |
| NT2RP4000455 | 24.141 | 9.211 | 25.236 | 8.774 | 21.609 | 10.059 | 20.357 | 12.379 |
| NT2RP4000456 | 119.272 | 61.157 | 163.661 | 22.286 | 65.150 | 132.301 | 52.249 | 54.831 |
| NT2RP4000457 | 64.206 | 43.798 | 49.492 | 18.495 | 31.270 | 76.065 | 78.938 | 18.719 |
| NT2RP4000461 | 24.023 | 16.736 | 42.860 | 8.086 | 28.640 | 24.287 | 12.689 | 10.443 |
| NT2RP4000462 | 61.975 | 32.022 | 55.648 | 25.804 | 23.165 | 20.388 | 41.481 | 46.650 |
| NT2RP4000463 | 44.030 | 41.396 | 65.217 | 27.109 | 26.324 | 27.922 | 36.605 | 49.391 |
| NT2RP4000471 | 37.502 | 19.098 | 33.476 | 5.338 | 11.489 | 19.044 | 0.000 | 11.363 |
| NT2RP4000472 | 13.349 | 14.082 | 11.918 | 3.395 | 5.066 | 10.401 | 8.705 | 6.892 |
| NT2RP4000476 | 8.321 | 93.773 | 34.435 | 13.728 | 23.669 | 4.372 | 15.350 | 7.001 |
| NT2RP4000480 | 211.458 | 95.964 | 129.427 | 15.810 | 72.857 | 76.584 | 80.179 | 54.430 |
| NT2RP4000481 | 31.888 | 26.600 | 25.630 | 7.943 | 9.597 | 13.290 | 14.597 | 17.385 |
| NT2RP4000483 | 21.998 | 15.487 | 14.048 | 11.756 | 10.365 | 13.738 | 23.308 | 15.114 |
| NT2RP4000487 | 60.364 | 31.407 | 22.474 | 11.302 | 12.610 | 14.044 | 7.594 | 9.748 |
| NT2RP4000496 | 5.856 | 1.759 | 0.000 | 1.020 | 0.000 | 1.332 | 1.331 | 1.300 |
| NT2RP4000497 | 14.222 | 23.785 | 35.435 | 9.191 | 6.838 | 6.266 | 19.870 | 19.909 |
| NT2RP4000498 | 10.973 | 30.501 | 18.513 | 11.562 | 11.061 | 3.896 | 18.332 | 11.258 |
| NT2RP4000500 | 28.356 | 22.346 | 29.213 | 6.186 | 20.760 | 15.985 | 16.224 | 7.833 |
| NT2RP4000507 | 65.764 | 65.249 | 44.910 | 11.415 | 12.964 | 62.638 | 27.083 | 16.799 |
| NT2RP4000515 | 326.302 | 155.582 | 205.890 | 76.678 | 101.826 | 196.853 | 160.500 | 152.025 |
| NT2RP4000516 | 44.610 | 41.687 | 143.747 | 33.380 | 28.078 | 31.697 | 20.743 | 51.511 |
| NT2RP4000517 | 43.875 | 14.219 | 143.214 | 16.861 | 8.127 | 16.458 | 9.150 | 20.642 |
| NT2RP4000518 | 26.023 | 21.987 | 59.276 | 7.160 | 16.049 | 11.817 | 12.546 | 27.280 |
| NT2RP4000519 | 26.153 | 8.810 | 13.853 | 3.109 | 6.990 | 8.139 | 7.151 | 18.564 |
| NT2RP4000524 | 1.938 | 0.000 | 0.000 | 0.000 | 0.000 | 0.000 | 0.000 | 11.634 |

TABLE 106

| | | | | | | | | |
|---|---|---|---|---|---|---|---|---|
| NT2RP4000528 | 12.526 | 60.186 | 18.819 | 3.919 | 15.244 | 19.800 | 6.732 | 22.213 |
| NT2RP4000537 | 119.677 | 216.504 | 170.091 | 45.816 | 89.192 | 83.433 | 71.078 | 86.062 |
| NT2RP4000541 | 106.565 | 47.194 | 70.174 | 11.695 | 21.855 | 33.231 | 40.279 | 26.263 |
| NT2RP4000543 | 121.504 | 31.320 | 49.049 | 15.964 | 35.981 | 45.932 | 36.402 | 28.580 |
| NT2RP4000545 | 109.666 | 94.098 | 286.924 | 83.348 | 51.684 | 53.797 | 34.347 | 94.961 |
| NT2RP4000546 | 34.736 | 33.000 | 110.405 | 21.240 | 28.754 | 7.806 | 12.598 | 34.617 |
| NT2RP4000549 | 27.942 | 60.396 | 16.907 | 8.050 | 24.334 | 25.452 | 36.475 | 51.804 |
| NT2RP4000556 | 22.418 | 10.709 | 22.462 | 7.923 | 12.069 | 10.840 | 14.194 | 24.088 |
| NT2RP4000557 | 22.285 | 18.841 | 21.106 | 3.617 | 11.430 | 13.950 | 15.418 | 23.701 |
| NT2RP4000558 | 98.220 | 60.580 | 112.943 | 14.814 | 42.417 | 80.107 | 52.601 | 55.628 |
| NT2RP4000560 | 145.648 | 126.576 | 198.616 | 29.117 | 67.842 | 111.268 | 88.953 | 88.195 |
| NT2RP4000568 | 4.653 | 7.710 | 9.495 | 4.212 | 14.707 | 5.118 | 4.418 | 1.728 |
| NT2RP4000583 | 100.314 | 94.610 | 258.628 | 54.914 | 59.898 | 38.219 | 57.364 | 56.537 |
| NT2RP4000585 | 36.734 | 19.742 | 25.585 | 3.609 | 10.851 | 9.594 | 12.368 | 9.441 |
| NT2RP4000588 | 24.965 | 28.422 | 24.615 | 3.894 | 8.655 | 9.562 | 10.506 | 9.648 |
| NT2RP4000590 | 82.643 | 29.520 | 74.380 | 7.381 | 16.388 | 16.999 | 38.929 | 28.565 |
| NT2RP4000599 | 5.134 | 12.959 | 2.254 | 2.300 | 0.000 | 5.232 | 2.076 | 4.437 |
| NT2RP4000603 | 48.331 | 23.244 | 35.033 | 10.422 | 23.763 | 77.588 | 27.888 | 18.472 |
| NT2RP4000607 | 43.033 | 46.964 | 51.845 | 3.610 | 170.311 | 14.213 | 16.592 | 35.286 |
| NT2RP4000614 | 93.469 | 104.724 | 288.948 | 65.946 | 55.948 | 39.332 | 42.871 | 69.619 |
| NT2RP4000634 | 41.268 | 55.106 | 42.366 | 20.080 | 29.301 | 16.909 | 25.716 | 34.506 |
| NT2RP4000638 | 38.714 | 37.491 | 60.350 | 10.197 | 20.301 | 7.339 | 21.773 | 11.532 |
| NT2RP4000648 | 28.051 | 19.136 | 29.021 | 11.429 | 52.517 | 8.564 | 11.255 | 17.817 |
| NT2RP4000657 | 59.641 | 34.960 | 39.531 | 15.723 | 16.922 | 9.859 | 13.485 | 21.954 |
| NT2RP4000691 | 25.254 | 56.069 | 53.527 | 20.960 | 17.701 | 25.333 | 15.651 | 24.709 |
| NT2RP4000697 | 41.565 | 23.570 | 47.024 | 8.681 | 17.064 | 41.529 | 26.741 | 15.415 |
| NT2RP4000704 | 150.527 | 58.692 | 94.083 | 27.108 | 61.336 | 83.179 | 82.422 | 52.001 |
| NT2RP4000710 | 544.068 | 385.881 | 401.163 | 199.745 | 308.821 | 570.526 | 370.976 | 288.408 |
| NT2RP4000713 | 28.318 | 29.133 | 25.800 | 8.247 | 17.041 | 12.819 | 13.220 | 15.778 |
| NT2RP4000724 | 15.864 | 37.851 | 33.515 | 4.863 | 0.000 | 12.161 | 11.700 | 21.516 |
| NT2RP4000725 | 73.250 | 28.340 | 42.587 | 10.791 | 15.656 | 23.049 | 29.695 | 16.914 |
| NT2RP4000728 | 398.420 | 264.734 | 679.544 | 140.230 | 76.304 | 191.521 | 224.945 | 194.628 |
| NT2RP4000737 | 10.955 | 3.270 | 11.232 | 3.668 | 5.117 | 2.568 | 5.042 | 3.466 |
| NT2RP4000739 | 15.887 | 23.255 | 23.005 | 9.500 | 14.336 | 12.603 | 11.904 | 11.565 |
| NT2RP4000749 | 66.966 | 32.925 | 44.669 | 15.449 | 15.178 | 33.005 | 27.405 | 18.522 |
| NT2RP4000769 | 65.261 | 48.013 | 75.648 | 22.094 | 24.165 | 36.022 | 30.919 | 26.509 |
| NT2RP4000774 | 42.939 | 36.592 | 46.497 | 13.414 | 18.307 | 19.211 | 16.686 | 12.228 |
| NT2RP4000781 | 34.651 | 17.546 | 33.740 | 8.360 | 9.849 | 17.872 | 14.911 | 6.625 |
| NT2RP4000783 | 29.279 | 12.391 | 20.881 | 15.327 | 3.867 | 20.509 | 21.416 | 4.930 |
| NT2RP4000787 | 0.000 | 0.000 | 0.000 | 0.000 | 0.000 | 0.000 | 0.000 | 0.000 |
| NT2RP4000788 | 57.142 | 47.566 | 42.475 | 22.374 | 15.545 | 36.822 | 18.884 | 32.902 |
| NT2RP4000792 | 26.349 | 10.430 | 22.784 | 9.272 | 0.000 | 13.445 | 11.068 | 16.223 |
| NT2RP4000809 | 33.934 | 109.004 | 47.604 | 14.815 | 14.118 | 130.537 | 459.568 | 2.963 |
| NT2RP4000817 | 76.682 | 20.256 | 38.151 | 11.596 | 23.415 | 26.562 | 17.001 | 12.542 |
| NT2RP4000821 | 121.213 | 96.900 | 50.576 | 24.242 | 27.444 | 74.033 | 37.727 | 20.369 |

TABLE 106-continued

| | | | | | | | | |
|---|---|---|---|---|---|---|---|---|
| NT2RP4000822 | 140.413 | 82.390 | 238.604 | 35.669 | 42.569 | 28.697 | 55.099 | 10.656 |
| NT2RP4000823 | 135.384 | 158.604 | 92.017 | 60.055 | 51.992 | 105.428 | 517.857 | 15.029 |
| NT2RP4000831 | 62.896 | 29.385 | 59.567 | 15.141 | 27.742 | 44.635 | 56.751 | 39.831 |
| NT2RP4000833 | 122.764 | 143.283 | 293.871 | 54.134 | 35.213 | 59.985 | 36.700 | 53.259 |
| NT2RP4000837 | 96.184 | 62.893 | 85.421 | 24.336 | 12.853 | 108.156 | 63.147 | 18.389 |
| NT2RP4000839 | 80.940 | 59.635 | 88.717 | 37.592 | 8.300 | 49.470 | 22.530 | 10.946 |
| NT2RP4000846 | 58.077 | 31.507 | 77.224 | 17.876 | 9.450 | 20.275 | 20.877 | 18.662 |
| NT2RP4000848 | 103.080 | 69.956 | 299.625 | 42.214 | 26.206 | 34.689 | 23.120 | 18.618 |
| NT2RP4000855 | 34.677 | 17.013 | 12.507 | 9.287 | 13.091 | 8.694 | 28.917 | 11.970 |
| NT2RP4000863 | 8.561 | 4.898 | 3.423 | 2.559 | 3.763 | 0.240 | 1.403 | 4.230 |
| NT2RP4000865 | 48.035 | 43.964 | 108.504 | 74.371 | 40.824 | 29.915 | 36.035 | 54.061 |
| NT2RP4000873 | 196.286 | 173.321 | 390.821 | 72.791 | 40.443 | 97.997 | 66.825 | 71.502 |
| NT2RP4000874 | 114.596 | 38.794 | 67.452 | 24.650 | 26.653 | 63.430 | 52.080 | 41.554 |
| NT2RP4000875 | 185.360 | 106.889 | 455.763 | 90.088 | 37.851 | 83.221 | 55.792 | 83.494 |
| NT2RP4000878 | 204.507 | 172.927 | 327.443 | 75.171 | 78.099 | 84.553 | 88.900 | 49.029 |
| NT2RP4000879 | 9.334 | 12.529 | 11.389 | 5.490 | 6.675 | 16.421 | 0.958 | 4.164 |
| NT2RP4000880 | 38.501 | 38.645 | 67.150 | 20.860 | 34.803 | 27.293 | 40.144 | 14.100 |
| NT2RP4000894 | 134.523 | 44.853 | 121.558 | 10.896 | 45.448 | 46.826 | 69.374 | 12.711 |
| NT2RP4000899 | 115.121 | 187.401 | 170.218 | 144.109 | 38.964 | 96.487 | 103.728 | 166.562 |

TABLE 107

| | | | | | | | | |
|---|---|---|---|---|---|---|---|---|
| NT2RP4000902 | 185.480 | 188.808 | 401.324 | 78.930 | 64.333 | 95.484 | 61.641 | 85.667 |
| NT2RP4000906 | 0.305 | 1.603 | 0.000 | 0.000 | 0.170 | 0.372 | 0.278 | 0.771 |
| NT2RP4000907 | 32.198 | 42.723 | 44.472 | 21.830 | 25.520 | 24.599 | 19.934 | 29.737 |
| NT2RP4000915 | 46.291 | 15.516 | 19.755 | 9.014 | 17.749 | 25.501 | 19.811 | 5.257 |
| NT2RP4000916 | 16.757 | 34.708 | 57.738 | 23.947 | 17.681 | 49.695 | 16.463 | 25.121 |
| NT2RP4000918 | 446.948 | 180.459 | 261.903 | 104.431 | 141.078 | 221.658 | 308.724 | 195.950 |
| NT2RP4000925 | 33.696 | 20.203 | 25.426 | 9.727 | 8.694 | 5.257 | 12.183 | 6.460 |
| NT2RP4000927 | 32.369 | 2.391 | 13.088 | 3.360 | 6.917 | 9.429 | 12.242 | 9.739 |
| NT2RP4000928 | 132.499 | 77.919 | 75.824 | 27.459 | 38.566 | 63.795 | 51.626 | 47.129 |
| NT2RP4000929 | 10.454 | 6.358 | 16.205 | 5.348 | 5.657 | 12.035 | 5.522 | 3.568 |
| NT2RP4000946 | 132.281 | 63.256 | 114.387 | 25.969 | 53.023 | 57.751 | 42.531 | 26.322 |
| NT2RP4000947 | 2.292 | 0.165 | 0.000 | 0.681 | 0.000 | 0.000 | 0.000 | 0.000 |
| NT2RP4000949 | 61.713 | 79.888 | 67.197 | 17.482 | 26.263 | 41.870 | 34.746 | 13.260 |
| NT2RP4000955 | 138.011 | 52.132 | 123.547 | 28.823 | 73.259 | 121.259 | 99.293 | 22.957 |
| NT2RP4000959 | 41.008 | 45.994 | 71.680 | 28.437 | 32.234 | 40.989 | 21.659 | 24.213 |
| NT2RP4000962 | 18.486 | 6.696 | 26.840 | 19.188 | 7.866 | 19.686 | 12.214 | 6.047 |
| NT2RP4000973 | 36.650 | 32.445 | 36.565 | 12.436 | 12.341 | 24.833 | 9.337 | 14.157 |
| NT2RP4000975 | 76.542 | 69.291 | 152.889 | 24.672 | 28.007 | 28.454 | 22.694 | 22.187 |
| NT2RP4000979 | 34.880 | 19.409 | 37.326 | 20.821 | 11.127 | 35.561 | 8.305 | 14.375 |
| NT2RP4000984 | 5.549 | 5.330 | 0.000 | 9.035 | 5.964 | 4.130 | 9.900 | 5.147 |
| NT2RP4000986 | 67.644 | 33.142 | 45.802 | 10.889 | 17.544 | 33.261 | 23.729 | 20.835 |
| NT2RP4000988 | 51.541 | 48.973 | 114.030 | 19.535 | 18.718 | 5.732 | 14.224 | 16.391 |
| NT2RP4000989 | 59.625 | 24.400 | 48.553 | 14.412 | 13.785 | 30.921 | 35.963 | 28.297 |
| NT2RP4000990 | 18.308 | 8.624 | 16.388 | 16.947 | 32.230 | 29.187 | 8.098 | 10.761 |
| NT2RP4000994 | 61.619 | 79.591 | 73.376 | 19.693 | 19.056 | 47.138 | 20.380 | 42.869 |
| NT2RP4000996 | 84.850 | 105.301 | 82.603 | 17.132 | 51.465 | 48.697 | 18.081 | 61.243 |
| NT2RP4000997 | 67.079 | 54.671 | 60.172 | 84.356 | 34.967 | 41.069 | 18.376 | 96.597 |
| NT2RP4001001 | 14.206 | 21.359 | 18.095 | 11.766 | 11.811 | 15.392 | 12.511 | 20.370 |
| NT2RP4001004 | 33.229 | 16.130 | 9.361 | 5.116 | 9.588 | 16.002 | 13.550 | 14.012 |
| NT2RP4001006 | 43.300 | 32.280 | 76.984 | 15.078 | 9.382 | 26.487 | 11.510 | 24.738 |
| NT2RP4001009 | 18.841 | 26.736 | 22.167 | 10.117 | 15.306 | 18.272 | 18.325 | 18.908 |
| NT2RP4001010 | 66.828 | 26.273 | 64.129 | 11.395 | 22.696 | 42.432 | 33.273 | 30.440 |
| NT2RP4001013 | 172.600 | 136.757 | 152.076 | 50.579 | 71.395 | 91.790 | 74.989 | 69.214 |
| NT2RP4001029 | 51.999 | 52.569 | 51.080 | 19.391 | 11.246 | 37.483 | 22.170 | 20.460 |
| NT2RP4001036 | 50.398 | 28.370 | 38.461 | 20.941 | 14.732 | 21.283 | 16.094 | 22.458 |
| NT2RP4001041 | 63.254 | 27.315 | 44.653 | 17.800 | 14.949 | 39.536 | 29.151 | 12.363 |
| NT2RP4001042 | 120.393 | 53.507 | 99.807 | 25.727 | 52.624 | 62.242 | 42.161 | 65.349 |
| NT2RP4001046 | 84.525 | 39.857 | 54.695 | 12.528 | 15.796 | 44.068 | 31.184 | 29.152 |
| NT2RP4001050 | 23.495 | 16.696 | 14.229 | 3.130 | 7.595 | 15.142 | 37.084 | 15.929 |
| NT2RP4001051 | 55.986 | 46.618 | 105.231 | 34.838 | 19.098 | 22.295 | 20.760 | 29.183 |
| NT2RP4001057 | 106.673 | 52.182 | 65.933 | 22.523 | 26.382 | 66.537 | 20.457 | 21.945 |
| NT2RP4001063 | 170.235 | 69.039 | 102.410 | 24.821 | 14.098 | 94.361 | 66.708 | 23.759 |
| NT2RP4001064 | 89.983 | 57.290 | 64.770 | 15.070 | 12.139 | 42.538 | 37.978 | 28.126 |
| NT2RP4001067 | 32.210 | 18.655 | 23.175 | 7.147 | 6.320 | 18.181 | 17.994 | 8.877 |
| NT2RP4001078 | 70.346 | 22.808 | 30.478 | 9.119 | 13.915 | 11.118 | 32.316 | 11.554 |
| NT2RP4001079 | 39.015 | 23.923 | 38.401 | 7.023 | 14.496 | 15.803 | 18.762 | 14.515 |
| NT2RP4001080 | 14.552 | 29.116 | 54.653 | 6.580 | 5.732 | 7.627 | 7.008 | 8.413 |
| NT2RP4001086 | 62.838 | 43.770 | 64.943 | 29.980 | 22.792 | 56.125 | 30.073 | 45.256 |
| NT2RP4001095 | 108.108 | 110.235 | 255.542 | 37.781 | 80.702 | 55.098 | 43.809 | 54.938 |
| NT2RP4001098 | 70.282 | 49.290 | 54.985 | 17.657 | 20.245 | 37.384 | 31.281 | 34.153 |
| NT2RP4001100 | 197.231 | 163.233 | 346.289 | 64.078 | 75.241 | 107.015 | 69.878 | 66.887 |
| NT2RP4001105 | 230.319 | 76.169 | 70.257 | 26.174 | 57.028 | 86.626 | 87.810 | 59.540 |
| NT2RP4001110 | 57.855 | 44.336 | 61.199 | 25.702 | 18.898 | 18.716 | 33.736 | 20.912 |
| NT2RP4001115 | 72.571 | 43.734 | 66.947 | 20.426 | 27.358 | 20.977 | 47.782 | 23.254 |

TABLE 107-continued

| | | | | | | | | |
|---|---|---|---|---|---|---|---|---|
| NT2RP4001117 | 53.949 | 26.454 | 27.949 | 9.754 | 12.786 | 27.164 | 23.470 | 15.958 |
| NT2RP4001122 | 74.373 | 73.859 | 55.273 | 28.246 | 24.494 | 39.511 | 36.880 | 32.941 |
| NT2RP4001123 | 103.600 | 40.395 | 69.670 | 16.738 | 17.045 | 55.106 | 52.069 | 29.553 |
| NT2RP4001126 | 70.020 | 118.846 | 92.913 | 55.909 | 48.688 | 56.960 | 35.367 | 78.750 |
| NT2RP4001127 | 17.316 | 17.921 | 16.598 | 4.302 | 4.543 | 7.932 | 6.088 | 3.388 |
| NT2RP4001138 | 34.858 | 28.363 | 20.031 | 8.100 | 8.737 | 16.238 | 16.525 | 11.957 |
| NT2RP4001143 | 89.870 | 104.250 | 131.882 | 30.154 | 34.329 | 44.010 | 63.462 | 45.180 |
| NT2RP4001148 | 10.496 | 8.968 | 14.713 | 2.463 | 2.640 | 2.953 | 4.275 | 13.549 |
| NT2RP4001149 | 121.101 | 16.961 | 36.641 | 6.362 | 14.072 | 27.469 | 27.329 | 17.906 |
| NT2RP4001150 | 90.570 | 29.463 | 50.833 | 11.559 | 12.988 | 28.002 | 41.812 | 17.678 |

TABLE 108

| | | | | | | | | |
|---|---|---|---|---|---|---|---|---|
| NT2RP4001159 | 38.009 | 23.566 | 30.231 | 13.969 | 15.202 | 22.514 | 8.474 | 15.455 |
| NT2RP4001162 | 26.480 | 12.988 | 32.747 | 7.435 | 8.821 | 8.329 | 10.137 | 7.744 |
| NT2RP4001170 | 22.282 | 12.703 | 20.500 | 4.074 | 19.879 | 9.183 | 5.871 | 4.037 |
| NT2RP4001174 | 160.485 | 77.682 | 283.123 | 47.118 | 44.041 | 51.544 | 63.046 | 39.356 |
| NT2RP4001175 | 105.636 | 84.266 | 237.685 | 56.987 | 37.302 | 44.846 | 49.808 | 28.044 |
| NT2RP4001176 | 316.295 | 539.044 | 440.109 | 306.340 | 44.764 | 249.181 | 449.982 | 321.567 |
| NT2RP4001184 | 58.252 | 23.348 | 36.224 | 15.108 | 13.298 | 29.737 | 56.984 | 16.700 |
| NT2RP4001198 | 155.102 | 120.100 | 81.937 | 37.566 | 13.326 | 92.551 | 80.670 | 61.997 |
| NT2RP4001199 | 22.232 | 18.559 | 25.847 | 3.025 | 0.000 | 22.887 | 29.205 | 23.250 |
| NT2RP4001206 | 167.873 | 59.707 | 53.222 | 31.978 | 27.295 | 101.042 | 75.329 | 47.196 |
| NT2RP4001207 | 6.816 | 7.800 | 9.463 | 4.474 | 4.601 | 2.301 | 0.915 | 9.232 |
| NT2RP4001210 | 5.482 | 9.826 | 9.141 | 8.107 | 1.396 | 3.060 | 4.469 | 2.598 |
| NT2RP4001213 | 18.439 | 21.799 | 46.620 | 26.850 | 14.691 | 14.012 | 16.268 | 14.828 |
| NT2RP4001214 | 7.837 | 5.075 | 21.917 | 3.759 | 2.750 | 2.889 | 2.203 | 1.557 |
| NT2RP4001219 | 17.372 | 12.922 | 29.465 | 15.168 | 7.172 | 11.232 | 12.740 | 10.296 |
| NT2RP4001228 | 60.317 | 46.912 | 82.456 | 22.249 | 23.349 | 41.381 | 20.046 | 18.506 |
| NT2RP4001235 | 70.885 | 42.694 | 74.087 | 20.626 | 11.053 | 41.808 | 8.307 | 26.337 |
| NT2RP4001256 | 53.903 | 27.494 | 40.975 | 9.302 | 9.044 | 22.660 | 27.827 | 9.288 |
| NT2RP4001257 | 91.093 | 39.253 | 66.828 | 12.871 | 33.167 | 19.549 | 35.715 | 16.676 |
| NT2RP4001260 | 30.932 | 22.193 | 31.916 | 6.755 | 16.733 | 19.462 | 6.274 | 7.635 |
| NT2RP4001261 | 203.546 | 343.200 | 241.244 | 94.907 | 116.433 | 194.685 | 126.891 | 64.973 |
| NT2RP4001274 | 29.234 | 29.291 | 20.294 | 16.725 | 11.827 | 4.089 | 12.005 | 6.899 |
| NT2RP4001276 | 288.394 | 86.186 | 155.256 | 76.171 | 77.526 | 99.724 | 126.975 | 37.044 |
| NT2RP4001283 | 602.951 | 260.199 | 332.966 | 68.876 | 287.262 | 624.729 | 534.357 | 126.212 |
| NT2RP4001299 | 44.703 | 49.576 | 35.736 | 19.564 | 12.675 | 15.229 | 13.741 | 18.202 |
| NT2RP4001313 | 28.076 | 13.041 | 11.004 | 3.551 | 7.304 | 11.207 | 9.673 | 4.674 |
| NT2RP4001315 | 24.647 | 15.443 | 77.362 | 12.324 | 7.639 | 21.010 | 12.223 | 11.809 |
| NT2RP4001320 | 98.164 | 61.534 | 65.437 | 15.593 | 22.738 | 54.032 | 34.155 | 23.969 |
| NT2RP4001325 | 144.734 | 90.080 | 132.401 | 61.000 | 64.433 | 99.148 | 198.660 | 71.382 |
| NT2RP4001336 | 33.783 | 28.245 | 46.453 | 11.843 | 24.831 | 17.470 | 36.926 | 23.698 |
| NT2RP4001339 | 68.525 | 15.937 | 41.646 | 9.764 | 25.036 | 39.624 | 26.253 | 9.570 |
| NT2RP4001343 | 161.856 | 91.193 | 100.371 | 27.738 | 38.512 | 92.415 | 57.982 | 44.590 |
| NT2RP4001344 | 144.107 | 58.474 | 66.215 | 21.137 | 22.316 | 72.157 | 71.543 | 28.102 |
| NT2RP4001345 | 50.445 | 32.733 | 43.703 | 11.121 | 15.544 | 24.026 | 24.553 | 13.451 |
| NT2RP4001351 | 111.802 | 66.455 | 97.136 | 54.896 | 34.425 | 45.604 | 34.545 | 34.491 |
| NT2RP4001353 | 19.537 | 9.810 | 20.460 | 6.940 | 6.519 | 12.325 | 7.907 | 7.125 |
| NT2RP4001355 | 43.678 | 23.203 | 33.304 | 7.482 | 15.675 | 24.196 | 21.364 | 10.692 |
| NT2RP4001367 | 14.283 | 17.653 | 14.776 | 4.211 | 8.006 | 2.253 | 3.639 | 0.000 |
| NT2RP4001372 | 140.185 | 27.600 | 56.900 | 12.537 | 24.364 | 62.204 | 41.922 | 18.450 |
| NT2RP4001373 | 126.580 | 38.189 | 93.856 | 23.267 | 28.220 | 77.754 | 42.832 | 38.641 |
| NT2RP4001375 | 62.861 | 32.389 | 48.017 | 13.250 | 23.490 | 43.660 | 31.665 | 13.296 |
| NT2RP4001379 | 77.263 | 41.191 | 123.636 | 24.440 | 18.057 | 56.629 | 33.185 | 12.466 |
| NT2RP4001381 | 67.146 | 46.036 | 150.720 | 64.411 | 23.477 | 41.258 | 40.245 | 17.295 |
| NT2RP4001386 | 47.308 | 42.624 | 147.963 | 19.177 | 12.559 | 15.127 | 15.891 | 6.679 |
| NT2RP4001389 | 32.461 | 38.092 | 48.803 | 17.637 | 14.303 | 29.242 | 28.109 | 24.013 |
| NT2RP4001396 | 15.198 | 11.286 | 9.852 | 4.401 | 3.270 | 4.252 | 5.253 | 5.075 |
| NT2RP4001407 | 13.731 | 19.546 | 21.832 | 9.379 | 5.846 | 11.131 | 8.899 | 4.678 |
| NT2RP4001409 | 26.965 | 45.073 | 26.488 | 6.042 | 6.075 | 16.036 | 1.306 | 7.105 |
| NT2RP4001410 | 111.952 | 58.388 | 89.502 | 31.596 | 42.948 | 111.493 | 177.918 | 34.807 |
| NT2RP4001414 | 63.484 | 72.860 | 54.366 | 30.455 | 26.471 | 40.346 | 21.075 | 42.279 |
| NT2RP4001424 | 18.505 | 15.050 | 18.180 | 8.353 | 8.456 | 7.908 | 12.261 | 8.200 |
| NT2RP4001433 | 28.627 | 47.828 | 111.176 | 1.742 | 3.250 | 41.197 | 17.950 | 7.176 |
| NT2RP4001438 | 93.429 | 51.160 | 63.518 | 28.266 | 34.394 | 39.516 | 76.342 | 59.077 |
| NT2RP4001442 | 46.900 | 23.169 | 80.514 | 5.365 | 17.576 | 19.430 | 14.414 | 23.765 |
| NT2RP4001447 | 20.522 | 17.746 | 37.089 | 10.313 | 11.549 | 14.801 | 15.207 | 21.970 |
| NT2RP4001466 | 84.366 | 74.971 | 78.307 | 31.341 | 28.164 | 50.904 | 37.694 | 43.489 |
| NT2RP4001467 | 15.268 | 25.951 | 20.698 | 4.979 | 5.450 | 12.316 | 14.737 | 10.161 |
| NT2RP4001472 | 23.447 | 20.560 | 19.664 | 9.955 | 16.415 | 13.051 | 11.929 | 10.897 |
| NT2RP4001474 | 23.982 | 25.100 | 20.243 | 9.361 | 9.008 | 17.381 | 16.055 | 15.142 |
| NT2RP4001483 | 21.106 | 19.511 | 25.457 | 6.485 | 5.041 | 10.975 | 9.879 | 11.486 |
| NT2RP4001488 | 27.970 | 20.497 | 49.782 | 9.070 | 13.416 | 14.898 | 20.195 | 30.898 |
| NT2RP4001492 | 147.304 | 52.305 | 152.125 | 29.017 | 25.021 | 50.537 | 64.959 | 35.615 |
| NT2RP4001498 | 25.282 | 13.660 | 23.919 | 9.033 | 6.316 | 17.644 | 16.153 | 13.136 |
| NT2RP4001502 | 104.608 | 138.488 | 125.018 | 60.785 | 58.647 | 81.803 | 46.693 | 100.340 |

TABLE 109

| | | | | | | | | |
|---|---|---|---|---|---|---|---|---|
| NT2RP4001503 | 16.918 | 68.637 | 34.943 | 6.221 | 4.744 | 16.123 | 9.930 | 6.312 |
| NT2RP4001507 | 45.444 | 50.856 | 165.482 | 28.606 | 29.404 | 30.143 | 22.556 | 24.934 |
| NT2RP4001510 | 32.998 | 28.050 | 63.008 | 35.045 | 3.511 | 13.039 | 13.396 | 31.578 |
| NT2RP4001516 | 103.727 | 30.191 | 54.389 | 13.924 | 22.032 | 60.980 | 55.131 | 21.835 |
| NT2RP4001520 | 99.702 | 61.159 | 80.454 | 19.076 | 44.823 | 57.892 | 65.886 | 85.758 |
| NT2RP4001523 | 74.331 | 53.855 | 97.039 | 28.897 | 26.233 | 31.769 | 22.342 | 34.713 |
| NT2RP4001524 | 63.685 | 43.657 | 79.486 | 31.768 | 17.811 | 34.268 | 61.096 | 32.252 |
| NT2RP4001529 | 55.817 | 26.458 | 47.156 | 18.137 | 9.583 | 36.746 | 22.545 | 17.561 |
| NT2RP4001531 | 76.426 | 49.034 | 79.547 | 19.985 | 15.454 | 48.895 | 27.165 | 35.500 |
| NT2RP4001546 | 475.672 | 254.067 | 158.609 | 114.463 | 52.423 | 188.321 | 90.884 | 193.923 |
| NT2RP4001547 | 35.657 | 46.341 | 75.052 | 22.751 | 21.180 | 18.635 | 16.599 | 17.284 |
| NT2RP4001551 | 15.709 | 5.677 | 9.034 | 3.319 | 2.064 | 4.065 | 8.300 | 1.720 |
| NT2RP4001555 | 35.187 | 13.947 | 15.040 | 6.049 | 8.613 | 14.662 | 15.505 | 1.914 |
| NT2RP4001567 | 23.617 | 22.434 | 19.944 | 10.030 | 13.497 | 14.121 | 17.021 | 12.931 |
| NT2RP4001568 | 656.402 | 328.894 | 456.250 | 169.687 | 176.926 | 432.308 | 269.108 | 137.575 |
| NT2RP4001569 | 71.047 | 45.066 | 68.921 | 13.181 | 27.919 | 55.014 | 36.067 | 22.875 |
| NT2RP4001571 | 31.048 | 30.838 | 25.301 | 9.879 | 38.867 | 28.423 | 12.829 | 7.326 |
| NT2RP4001574 | 104.513 | 60.846 | 51.480 | 12.719 | 37.902 | 43.358 | 52.975 | 26.473 |
| NT2RP4001575 | 99.868 | 54.792 | 66.563 | 18.178 | 23.871 | 48.657 | 33.611 | 35.035 |
| NT2RP4001578 | 27.146 | 46.286 | 41.253 | 12.060 | 16.868 | 28.516 | 38.747 | 21.566 |
| NT2RP4001592 | 56.759 | 41.720 | 35.056 | 13.288 | 19.751 | 32.000 | 46.040 | 26.863 |
| NT2RP4001593 | 34.423 | 36.251 | 40.059 | 19.801 | 27.006 | 22.857 | 28.378 | 30.708 |
| NT2RP4001605 | 35.830 | 55.962 | 46.086 | 30.654 | 17.304 | 12.782 | 25.954 | 20.171 |
| NT2RP4001606 | 36.059 | 22.836 | 25.785 | 9.780 | 11.049 | 23.731 | 22.906 | 11.246 |
| NT2RP4001607 | 12.252 | 38.564 | 26.768 | 11.976 | 11.793 | 10.856 | 12.358 | 17.689 |
| NT2RP4001610 | 41.606 | 26.761 | 24.395 | 9.284 | 13.420 | 18.581 | 25.355 | 17.897 |
| NT2RP4001614 | 5.320 | 7.451 | 3.713 | 3.222 | 6.786 | 0.000 | 4.236 | 3.006 |
| NT2RP4001623 | 17.761 | 23.809 | 29.296 | 18.722 | 11.464 | 7.465 | 7.749 | 11.940 |
| NT2RP4001626 | 39.777 | 77.553 | 31.850 | 125.728 | 14.578 | 17.234 | 15.665 | 43.780 |
| NT2RP4001634 | 42.268 | 33.465 | 29.710 | 15.079 | 5.960 | 12.998 | 22.448 | 22.801 |
| NT2RP4001638 | 28.002 | 28.424 | 27.619 | 11.196 | 10.399 | 6.955 | 19.293 | 11.952 |
| NT2RP4001644 | 13.937 | 31.012 | 33.018 | 11.442 | 10.696 | 15.844 | 17.103 | 18.814 |
| NT2RP4001646 | 110.825 | 35.914 | 100.039 | 15.650 | 68.751 | 72.780 | 36.023 | 14.760 |
| NT2RP4001656 | 113.964 | 57.203 | 81.638 | 25.444 | 41.071 | 67.708 | 57.712 | 34.629 |
| NT2RP4001666 | 75.518 | 31.622 | 54.757 | 17.666 | 17.943 | 29.002 | 29.742 | 13.617 |
| NT2RP4001670 | 143.248 | 64.754 | 95.837 | 25.903 | 20.467 | 58.425 | 77.751 | 32.776 |
| NT2RP4001677 | 364.565 | 222.618 | 310.713 | 96.394 | 105.468 | 224.860 | 256.793 | 96.732 |
| NT2RP4001679 | 225.706 | 136.839 | 407.981 | 82.012 | 82.799 | 62.241 | 83.957 | 50.075 |
| NT2RP4001695 | 51.430 | 18.839 | 33.607 | 11.914 | 5.205 | 20.014 | 20.606 | 3.263 |
| NT2RP4001696 | 92.139 | 56.306 | 51.701 | 21.125 | 15.829 | 67.642 | 34.335 | 27.080 |
| NT2RP4001699 | 20.126 | 24.412 | 12.024 | 6.153 | 9.166 | 12.777 | 38.966 | 11.931 |
| NT2RP4001717 | 104.794 | 22.524 | 47.196 | 16.831 | 10.332 | 44.003 | 26.697 | 10.303 |
| NT2RP4001719 | 4.115 | 3.996 | 6.251 | 6.793 | 0.000 | 3.648 | 0.000 | 5.696 |
| NT2RP4001725 | 32.499 | 19.952 | 25.192 | 14.409 | 10.172 | 27.215 | 32.425 | 18.951 |
| NT2RP4001726 | 54.527 | 36.453 | 64.243 | 26.169 | 28.497 | 40.523 | 55.394 | 19.268 |
| NT2RP4001730 | 12.704 | 4.465 | 10.741 | 6.560 | 6.940 | 4.424 | 3.677 | 4.124 |
| NT2RP4001739 | 100.531 | 27.275 | 89.269 | 26.597 | 21.415 | 57.785 | 66.185 | 25.777 |
| NT2RP4001741 | 110.382 | 99.274 | 234.294 | 44.252 | 36.564 | 43.056 | 33.008 | 41.898 |
| NT2RP4001753 | 39.441 | 20.491 | 71.424 | 37.461 | 1.805 | 37.216 | 18.904 | 38.683 |
| NT2RP4001760 | 14.764 | 11.531 | 4.629 | 15.113 | 4.914 | 5.657 | 5.650 | 2.825 |
| NT2RP4001787 | 258.392 | 145.823 | 264.342 | 128.018 | 104.482 | 137.855 | 226.897 | 211.755 |
| NT2RP4001790 | 34.934 | 24.033 | 47.502 | 23.049 | 19.224 | 20.959 | 21.785 | 26.319 |
| NT2RP4001795 | 64.250 | 59.518 | 90.887 | 55.846 | 29.460 | 30.950 | 41.200 | 41.068 |
| NT2RP4001803 | 30.124 | 17.002 | 33.008 | 12.028 | 5.604 | 11.542 | 8.057 | 8.711 |
| NT2RP4001805 | 69.724 | 47.736 | 91.734 | 21.767 | 28.977 | 49.346 | 29.736 | 15.069 |
| NT2RP4001809 | 249.052 | 50.599 | 114.889 | 32.414 | 75.066 | 114.744 | 91.752 | 13.588 |
| NT2RP4001817 | 46.954 | 36.438 | 25.771 | 14.621 | 13.677 | 59.903 | 27.216 | 21.236 |
| NT2RP4001822 | 177.317 | 48.258 | 102.447 | 19.403 | 35.452 | 81.929 | 51.381 | 28.953 |
| NT2RP4001823 | 30.502 | 15.399 | 18.920 | 5.780 | 6.496 | 10.465 | 7.520 | 6.128 |
| NT2RP4001827 | 65.786 | 52.243 | 54.585 | 30.666 | 20.071 | 35.276 | 26.036 | 20.301 |
| NT2RP4001828 | 265.068 | 110.898 | 195.484 | 63.750 | 99.323 | 140.250 | 144.652 | 63.747 |
| NT2RP4001836 | 136.462 | 50.159 | 118.930 | 24.890 | 59.417 | 39.904 | 29.937 | 18.265 |
| NT2RP4001838 | 154.169 | 54.298 | 78.857 | 23.853 | 25.980 | 67.323 | 52.328 | 17.783 |
| NT2RP4001841 | 53.995 | 81.543 | 68.608 | 23.556 | 51.873 | 35.401 | 32.437 | 39.023 |

TABLE 110

| | | | | | | | | |
|---|---|---|---|---|---|---|---|---|
| NT2RP4001849 | 127.297 | 17.445 | 38.764 | 4.795 | 19.911 | 39.260 | 53.938 | 8.385 |
| NT2RP4001861 | 247.889 | 113.986 | 152.565 | 70.140 | 77.706 | 119.545 | 74.993 | 93.651 |
| NT2RP4001877 | 101.731 | 60.233 | 139.463 | 63.735 | 37.564 | 43.408 | 50.482 | 50.974 |
| NT2RP4001879 | 52.541 | 46.318 | 81.300 | 25.097 | 20.585 | 42.533 | 33.249 | 30.904 |
| NT2RP4001889 | 70.569 | 45.627 | 140.257 | 26.366 | 28.442 | 18.192 | 17.861 | 25.113 |
| NT2RP4001893 | 25.380 | 22.592 | 43.017 | 18.499 | 15.138 | 9.424 | 8.376 | 6.982 |
| NT2RP4001896 | 34.081 | 20.051 | 44.749 | 10.547 | 15.271 | 19.037 | 14.839 | 13.968 |
| NT2RP4001898 | 214.122 | 125.432 | 418.651 | 67.171 | 53.688 | 119.010 | 53.767 | 70.070 |
| NT2RP4001901 | 98.678 | 53.976 | 182.276 | 39.521 | 42.438 | 38.087 | 23.271 | 32.169 |

TABLE 110-continued

| | | | | | | | | |
|---|---|---|---|---|---|---|---|---|
| NT2RP4001910 | 37.857 | 50.894 | 99.896 | 25.518 | 57.751 | 122.391 | 71.018 | 74.327 |
| NT2RP4001925 | 63.642 | 29.438 | 46.884 | 25.210 | 22.129 | 45.913 | 35.236 | 19.704 |
| NT2RP4001926 | 21.200 | 13.827 | 24.573 | 7.083 | 11.581 | 7.544 | 10.754 | 9.806 |
| NT2RP4001927 | 19.268 | 17.900 | 28.017 | 9.329 | 12.222 | 11.234 | 14.514 | 7.786 |
| NT2RP4001931 | 97.433 | 45.715 | 58.255 | 21.472 | 23.167 | 20.695 | 41.852 | 23.242 |
| NT2RP4001933 | 94.894 | 38.536 | 49.116 | 18.868 | 30.123 | 17.978 | 20.041 | 20.718 |
| NT2RP4001938 | 286.138 | 121.070 | 279.936 | 37.391 | 35.937 | 120.491 | 73.356 | 57.647 |
| NT2RP4001942 | 65.948 | 38.369 | 38.848 | 27.689 | 31.221 | 62.157 | 96.580 | 29.143 |
| NT2RP4001945 | 41.368 | 18.714 | 27.898 | 8.014 | 14.644 | 17.772 | 15.860 | 11.677 |
| NT2RP4001946 | 26.736 | 25.374 | 44.253 | 18.892 | 16.137 | 18.739 | 15.375 | 19.575 |
| NT2RP4001947 | 3.902 | 6.862 | 18.880 | 3.327 | 6.771 | 2.037 | 3.124 | 8.202 |
| NT2RP4001950 | 43.788 | 52.338 | 61.416 | 20.392 | 18.601 | 15.837 | 9.943 | 21.246 |
| NT2RP4001953 | 74.594 | 54.521 | 201.576 | 35.155 | 25.200 | 19.900 | 24.690 | 37.538 |
| NT2RP4001966 | 59.559 | 15.062 | 48.054 | 10.833 | 25.873 | 32.505 | 27.673 | 16.883 |
| NT2RP4001970 | 250.998 | 97.493 | 91.936 | 22.958 | 56.420 | 113.696 | 71.723 | 47.051 |
| NT2RP4001975 | 66.332 | 42.906 | 96.575 | 25.793 | 35.690 | 65.632 | 31.289 | 42.704 |
| NT2RP4001988 | 34.115 | 69.980 | 24.419 | 10.144 | 8.048 | 24.865 | 25.619 | 34.649 |
| NT2RP4001996 | 34.292 | 25.552 | 27.656 | 12.286 | 17.188 | 25.718 | 14.676 | 10.275 |
| NT2RP4002014 | 96.789 | 141.748 | 123.891 | 28.921 | 44.195 | 55.818 | 35.380 | 37.118 |
| NT2RP4002018 | 51.913 | 24.760 | 41.235 | 10.014 | 19.687 | 23.559 | 18.245 | 34.018 |
| NT2RP4002035 | 29.954 | 14.435 | 25.087 | 12.863 | 31.601 | 28.211 | 23.642 | 22.189 |
| NT2RP4002043 | 22.692 | 22.569 | 32.601 | 19.499 | 11.381 | 22.102 | 20.695 | 23.533 |
| NT2RP4002046 | 96.899 | 76.132 | 55.715 | 18.254 | 26.488 | 53.136 | 30.705 | 25.046 |
| NT2RP4002047 | 32.738 | 46.847 | 44.327 | 32.723 | 15.068 | 26.152 | 13.938 | 32.144 |
| NT2RP4002052 | 15.972 | 18.197 | 19.425 | 11.638 | 8.069 | 13.935 | 10.066 | 12.588 |
| NT2RP4002056 | 135.983 | 113.302 | 169.971 | 38.787 | 125.176 | 113.563 | 77.593 | 83.524 |
| NT2RP4002057 | 84.885 | 34.408 | 60.458 | 17.766 | 21.946 | 77.991 | 75.176 | 47.433 |
| NT2RP4002058 | 23.685 | 18.994 | 29.136 | 10.874 | 14.415 | 11.785 | 16.779 | 16.312 |
| NT2RP4002064 | 30.635 | 14.897 | 33.490 | 16.524 | 16.922 | 12.258 | 15.014 | 25.572 |
| NT2RP4002071 | 44.464 | 31.989 | 67.896 | 26.934 | 14.700 | 35.364 | 41.060 | 22.140 |
| NT2RP4002075 | 12.341 | 23.187 | 23.062 | 7.438 | 8.387 | 13.256 | 7.411 | 9.609 |
| NT2RP4002078 | 29.846 | 42.027 | 82.198 | 17.811 | 5.991 | 41.201 | 10.199 | 52.455 |
| NT2RP4002081 | 188.987 | 84.568 | 105.808 | 21.123 | 35.926 | 97.846 | 71.564 | 35.425 |
| NT2RP4002083 | 2.403 | 4.985 | 0.000 | 0.314 | 0.000 | 0.000 | 1.168 | 0.000 |
| NT2RP4002099 | 78.239 | 28.086 | 39.672 | 11.893 | 30.439 | 25.384 | 40.614 | 18.182 |
| NT2RP4002106 | 58.519 | 39.159 | 55.467 | 21.121 | 12.917 | 66.398 | 104.992 | 30.602 |
| NT2RP4002111 | 276.429 | 227.374 | 252.398 | 129.656 | 67.040 | 206.459 | 208.212 | 245.585 |
| NT2RP4002112 | 24.864 | 26.469 | 24.698 | 12.961 | 9.167 | 27.016 | 16.882 | 13.120 |
| NT2RP4002116 | 43.886 | 61.673 | 98.270 | 42.933 | 38.005 | 36.286 | 25.145 | 12.745 |
| NT2RP4002122 | 44.771 | 24.552 | 24.373 | 26.789 | 12.328 | 6.628 | 8.237 | 19.312 |
| NT2RP4002126 | 58.138 | 23.058 | 51.469 | 13.176 | 13.341 | 21.828 | 27.785 | 31.381 |
| NT2RP4002133 | 86.426 | 80.537 | 66.020 | 23.353 | 23.704 | 46.666 | 42.292 | 33.380 |
| NT2RP4002136 | 84.825 | 38.199 | 57.051 | 14.996 | 23.918 | 31.464 | 46.186 | 26.328 |
| NT2RP4002139 | 76.548 | 64.715 | 56.669 | 34.571 | 20.583 | 36.387 | 35.415 | 37.823 |
| NT2RP4002174 | 100.223 | 26.806 | 136.927 | 21.487 | 10.831 | 17.747 | 16.730 | 22.815 |
| NT2RP4002185 | 84.685 | 98.123 | 101.806 | 56.809 | 25.728 | 38.576 | 50.054 | 42.202 |
| NT2RP4002186 | 76.426 | 104.170 | 270.574 | 75.854 | 79.446 | 47.076 | 41.217 | 75.609 |
| NT2RP4002187 | 47.198 | 70.549 | 84.418 | 12.734 | 27.208 | 71.434 | 52.262 | 26.859 |
| NT2RP4002188 | 35.383 | 30.278 | 67.328 | 48.848 | 43.711 | 39.200 | 18.696 | 45.047 |
| NT2RP4002199 | 8.790 | 3.765 | 7.735 | 3.103 | 3.671 | 4.856 | 6.602 | 4.582 |
| NT2RP4002206 | 65.655 | 41.544 | 56.183 | 14.975 | 16.172 | 23.112 | 30.357 | 19.694 |
| NT2RP4002210 | 89.632 | 39.449 | 49.442 | 26.733 | 14.817 | 29.546 | 36.670 | 13.077 |
| NT2RP4002222 | 66.188 | 28.126 | 48.518 | 18.433 | 9.476 | 18.229 | 30.855 | 13.676 |
| NT2RP4002241 | 21.472 | 73.064 | 52.707 | 19.669 | 16.108 | 20.165 | 24.348 | 35.568 |
| NT2RP4002248 | 89.806 | 44.853 | 53.025 | 15.207 | 28.490 | 47.016 | 40.320 | 26.933 |

TABLE 111

| | | | | | | | | |
|---|---|---|---|---|---|---|---|---|
| NT2RP4002250 | 9.932 | 2.790 | 2.832 | 3.032 | 2.884 | 3.939 | 3.541 | 2.731 |
| NT2RP4002259 | 98.207 | 83.004 | 106.317 | 27.935 | 22.544 | 53.580 | 27.771 | 28.361 |
| NT2RP4002268 | 76.648 | 38.869 | 74.529 | 23.758 | 30.978 | 42.466 | 39.855 | 19.465 |
| NT2RP4002288 | 385.663 | 297.805 | 359.839 | 170.051 | 129.643 | 303.550 | 199.320 | 193.830 |
| NT2RP4002290 | 36.179 | 20.072 | 47.837 | 6.799 | 18.426 | 18.201 | 11.227 | 12.869 |
| NT2RP4002298 | 36.246 | 17.225 | 18.192 | 23.131 | 9.100 | 14.492 | 16.163 | 9.824 |
| NT2RP4002306 | 106.632 | 73.744 | 244.843 | 37.397 | 44.511 | 42.955 | 43.305 | 15.782 |
| NT2RP4002308 | 32.611 | 5.236 | 14.575 | 3.239 | 0.000 | 18.399 | 6.762 | 8.392 |
| NT2RP4002336 | 58.486 | 27.861 | 65.731 | 14.287 | 0.000 | 40.974 | 32.637 | 24.822 |
| NT2RP4002340 | 0.000 | 0.000 | 0.000 | 0.000 | 0.000 | 0.000 | 0.000 | 1.608 |
| NT2RP4002361 | 58.644 | 10.427 | 47.735 | 8.516 | 9.638 | 11.404 | 11.251 | 4.202 |
| NT2RP4002367 | 33.403 | 12.467 | 18.470 | 12.044 | 5.048 | 13.606 | 23.450 | 11.551 |
| NT2RP4002368 | 30.961 | 37.918 | 39.910 | 11.210 | 13.572 | 15.090 | 26.947 | 17.073 |
| NT2RP4002377 | 54.340 | 43.892 | 116.766 | 38.442 | 20.404 | 44.896 | 56.968 | 37.630 |
| NT2RP4002408 | 13.226 | 8.072 | 12.192 | 7.437 | 5.595 | 8.466 | 9.233 | 1.448 |
| NT2RP4002425 | 9.657 | 6.220 | 8.381 | 3.685 | 1.438 | 1.029 | 3.019 | 3.646 |
| NT2RP4002432 | 162.057 | 67.674 | 98.832 | 18.405 | 27.254 | 50.612 | 54.723 | 46.891 |
| NT2RP4002447 | 38.164 | 33.834 | 62.023 | 30.863 | 14.303 | 29.507 | 8.767 | 8.930 |

TABLE 111-continued

| | | | | | | | | |
|---|---|---|---|---|---|---|---|---|
| NT2RP4002451 | 7.843 | 13.049 | 15.746 | 6.677 | 3.617 | 8.815 | 1.747 | 9.433 |
| NT2RP4002461 | 96.759 | 88.219 | 116.998 | 47.479 | 57.340 | 32.249 | 36.274 | 24.074 |
| NT2RP4002486 | 134.976 | 61.570 | 83.309 | 71.309 | 46.898 | 61.095 | 41.576 | 21.740 |
| NT2RP4002517 | 58.053 | 36.106 | 59.653 | 12.934 | 25.946 | 17.882 | 24.902 | 21.801 |
| NT2RP4002556 | 43.020 | 59.649 | 60.047 | 47.543 | 16.113 | 30.397 | 20.361 | 21.390 |
| NT2RP4002569 | 55.960 | 24.230 | 25.391 | 9.256 | 12.527 | 28.839 | 41.356 | 15.537 |
| NT2RP4002587 | 66.993 | 24.539 | 29.137 | 12.319 | 10.000 | 27.896 | 26.210 | 13.197 |
| NT2RP4002591 | 30.924 | 17.255 | 64.461 | 40.777 | 19.170 | 45.337 | 11.471 | 35.621 |
| NT2RP4002607 | 54.314 | 34.936 | 46.019 | 25.502 | 12.780 | 34.916 | 29.754 | 19.269 |
| NT2RP4002627 | 77.997 | 65.880 | 94.854 | 27.581 | 43.756 | 52.437 | 23.907 | 43.664 |
| NT2RP4002628 | 21.252 | 24.628 | 31.576 | 38.351 | 13.833 | 13.934 | 20.421 | 19.758 |
| NT2RP4002630 | 70.308 | 48.663 | 165.068 | 28.270 | 26.685 | 23.920 | 21.463 | 25.050 |
| NT2RP4002639 | 34.573 | 25.557 | 46.433 | 21.541 | 27.562 | 30.947 | 24.555 | 20.118 |
| NT2RP4002641 | 107.016 | 60.263 | 102.333 | 24.417 | 23.197 | 63.371 | 31.978 | 22.283 |
| NT2RP4002658 | 49.532 | 66.012 | 31.405 | 43.805 | 11.257 | 29.226 | 40.300 | 36.588 |
| NT2RP4002669 | 139.676 | 37.293 | 45.595 | 14.602 | 38.129 | 45.705 | 53.924 | 19.231 |
| NT2RP4002677 | 20.241 | 31.667 | 46.092 | 45.042 | 15.952 | 20.098 | 16.586 | 53.152 |
| NT2RP4002715 | 66.829 | 32.913 | 90.988 | 19.361 | 54.330 | 49.099 | 48.762 | 33.038 |
| NT2RP4002750 | 74.179 | 34.932 | 56.851 | 17.150 | 20.232 | 23.076 | 29.740 | 18.218 |
| NT2RP4002784 | 67.421 | 24.006 | 62.663 | 18.995 | 23.720 | 28.427 | 58.514 | 16.510 |
| NT2RP4002791 | 28.944 | 34.248 | 39.645 | 19.520 | 14.437 | 25.409 | 18.682 | 19.866 |
| NT2RP4002811 | 191.101 | 48.977 | 64.562 | 15.450 | 18.301 | 79.439 | 82.520 | 19.601 |
| NT2RP4002830 | 105.586 | 49.177 | 76.222 | 25.375 | 47.589 | 45.374 | 21.154 | 24.854 |
| NT2RP4002832 | 25.813 | 10.744 | 26.473 | 5.157 | 5.007 | 10.239 | 3.522 | 4.192 |
| NT2RP4002850 | 149.082 | 57.743 | 102.303 | 28.532 | 37.913 | 75.770 | 47.566 | 29.262 |
| NT2RP4002874 | 60.455 | 22.464 | 40.061 | 7.249 | 18.394 | 31.321 | 29.662 | 14.021 |
| NT2RP4002884 | 143.158 | 172.626 | 226.029 | 43.885 | 40.049 | 72.829 | 100.195 | 80.578 |
| NT2RP4002888 | 674.861 | 131.669 | 285.125 | 53.073 | 130.491 | 374.710 | 309.640 | 77.843 |
| NT2RP4002891 | 49.251 | 19.998 | 83.408 | 45.255 | 22.748 | 23.519 | 25.198 | 32.282 |
| NT2RP4002894 | 52.025 | 17.730 | 44.439 | 15.465 | 30.670 | 53.933 | 19.786 | 17.490 |
| NT2RP4002896 | 62.611 | 29.872 | 36.349 | 8.160 | 14.509 | 32.175 | 23.150 | 9.215 |
| NT2RP4002905 | 66.278 | 20.133 | 27.924 | 9.606 | 17.387 | 37.876 | 9.098 | 11.326 |
| NT2RP4002907 | 133.109 | 146.263 | 986.435 | 80.359 | 7.640 | 119.281 | 47.532 | 4.835 |
| NT2RP5003459 | 104.697 | 52.694 | 23.001 | 28.403 | 58.257 | 68.072 | 73.297 | 73.672 |
| NT2RP5003461 | 13.597 | 25.252 | 19.706 | 20.131 | 10.924 | 4.203 | 12.049 | 16.282 |
| NT2RP5003471 | 67.015 | 71.340 | 73.641 | 28.289 | 26.026 | 42.807 | 59.142 | 75.646 |
| NT2RP5003477 | 99.313 | 40.896 | 89.264 | 23.215 | 24.470 | 47.291 | 53.314 | 38.937 |
| NT2RP5003487 | 149.480 | 394.096 | 441.718 | 265.002 | 121.873 | 351.279 | 181.435 | 545.031 |
| NT2RP5003492 | 121.748 | 38.219 | 55.597 | 23.529 | 23.174 | 61.042 | 47.790 | 32.333 |
| NT2RP5003500 | 28.243 | 13.949 | 28.326 | 7.609 | 6.374 | 19.974 | 10.924 | 7.373 |
| NT2RP5003506 | 134.622 | 138.997 | 142.784 | 43.006 | 50.574 | 83.904 | 56.185 | 74.393 |
| NT2RP5003512 | 34.416 | 11.927 | 16.738 | 3.974 | 7.691 | 7.518 | 10.845 | 8.612 |
| NT2RP5003522 | 70.316 | 37.613 | 44.952 | 19.574 | 25.328 | 22.112 | 21.875 | 28.029 |
| NT2RP5003524 | 37.812 | 24.325 | 51.778 | 11.791 | 10.830 | 11.580 | 15.958 | 15.290 |
| NT2RP5003527 | 548.452 | 324.151 | 547.100 | 240.290 | 240.483 | 435.490 | 606.993 | 396.820 |
| NT2RP5003531 | 218.385 | 231.836 | 102.817 | 12.058 | 28.603 | 161.069 | 24.666 | 55.299 |

TABLE 112

| | | | | | | | | |
|---|---|---|---|---|---|---|---|---|
| NT2RP5003534 | 52.710 | 32.028 | 38.558 | 7.019 | 15.506 | 20.156 | 15.510 | 8.979 |
| NT2RP6000020 | 210.149 | 130.471 | 144.056 | 41.190 | 61.827 | 130.501 | 91.960 | 129.873 |
| NT2RP6000022 | 21.538 | 14.233 | 20.157 | 9.477 | 8.940 | 8.583 | 13.793 | 19.548 |
| NT2RP6000050 | 71.839 | 29.419 | 34.531 | 13.907 | 10.240 | 25.335 | 35.367 | 26.244 |
| NT2RP6000063 | 64.066 | 28.604 | 49.917 | 15.400 | 35.731 | 36.275 | 41.783 | 27.262 |
| NT2RP6000074 | 158.830 | 63.135 | 82.278 | 24.913 | 42.059 | 81.152 | 81.658 | 52.773 |
| NT2RP6000083 | 77.705 | 50.820 | 78.153 | 25.019 | 26.843 | 53.073 | 63.619 | 37.514 |
| NT2RP6000100 | 50.338 | 49.391 | 48.240 | 38.749 | 18.889 | 28.023 | 21.991 | 17.677 |
| NT2RP6000123 | 93.881 | 40.481 | 91.240 | 14.231 | 12.925 | 21.554 | 11.762 | 21.172 |
| NT2RP6000129 | 88.985 | 47.556 | 65.182 | 18.250 | 6.578 | 44.353 | 35.215 | 33.928 |
| NT2RP6000147 | 32.349 | 57.944 | 378.808 | 14.768 | 31.975 | 24.474 | 24.050 | 25.120 |
| NT2RP6000163 | 25.983 | 24.930 | 19.397 | 3.670 | 5.619 | 4.373 | 7.249 | 6.228 |
| NT2RP6000181 | 156.005 | 46.707 | 83.042 | 23.577 | 40.609 | 63.752 | 82.227 | 48.686 |
| N72RP6000182 | 88.398 | 83.770 | 188.105 | 36.383 | 59.805 | 37.752 | 28.971 | 44.514 |
| 0VARC1000001 | 80.247 | 58.966 | 66.050 | 19.840 | 25.013 | 40.518 | 55.886 | 20.561 |
| 0VARC1000003 | 20.948 | 26.924 | 29.257 | 6.511 | 9.613 | 12.291 | 10.501 | 12.627 |
| 0VARC1000004 | 80.203 | 65.653 | 78.764 | 43.217 | 16.647 | 43.045 | 49.235 | 40.643 |
| 0VARC1000006 | 30.735 | 28.510 | 27.987 | 8.280 | 13.556 | 26.127 | 22.928 | 6.489 |
| 0VARC1000013 | 57.790 | 56.730 | 33.604 | 8.558 | 12.487 | 25.216 | 24.982 | 13.217 |
| 0VARC1000014 | 77.754 | 46.427 | 51.294 | 14.220 | 15.288 | 23.140 | 45.111 | 37.444 |
| 0VARC1000017 | 117.243 | 44.469 | 63.710 | 20.838 | 20.603 | 56.329 | 47.142 | 30.588 |
| 0VARC1000026 | 48.571 | 90.236 | 108.886 | 113.202 | 47.802 | 62.912 | 49.285 | 92.751 |
| 0VARC1000035 | 49.364 | 29.380 | 53.296 | 24.565 | 28.515 | 42.393 | 36.018 | 23.376 |
| 0VARC1000037 | 217.386 | 150.962 | 123.831 | 103.776 | 107.202 | 127.890 | 99.068 | 110.962 |
| 0VARC1000058 | 126.770 | 102.554 | 238.989 | 41.391 | 55.660 | 36.598 | 18.334 | 26.662 |
| 0VARC1000060 | 69.220 | 52.141 | 61.680 | 16.724 | 30.594 | 25.644 | 26.946 | 50.637 |
| 0VARC1000068 | 13.131 | 13.623 | 21.327 | 11.889 | 11.183 | 5.229 | 8.992 | 12.530 |

TABLE 112-continued

| | | | | | | | | |
|---|---|---|---|---|---|---|---|---|
| 0VARC1000069 | 101.314 | 75.808 | 53.487 | 27.968 | 38.426 | 35.714 | 36.399 | 56.941 |
| 0VARC1000071 | 18.796 | 24.923 | 14.847 | 12.360 | 18.401 | 4.200 | 10.123 | 10.463 |
| 0VARC1000075 | 2485.301 | 555.545 | 463.529 | 172.018 | 1135.376 | 1656.344 | 703.861 | 375.646 |
| 0VARC1000083 | 28.000 | 26.575 | 47.619 | 26.281 | 19.723 | 45.186 | 32.169 | 29.140 |
| 0VARC1000085 | 102.017 | 92.945 | 160.004 | 82.480 | 133.814 | 49.366 | 47.840 | 68.991 |
| 0VARC1000086 | 90.269 | 76.669 | 42.857 | 41.659 | 25.286 | 36.964 | 47.871 | 41.838 |
| 0VARC1000087 | 19.951 | 31.052 | 13.384 | 10.950 | 9.727 | 13.579 | 27.946 | 13.255 |
| 0VARC1000090 | 102.718 | 128.317 | 77.866 | 86.960 | 52.554 | 50.597 | 59.255 | 73.796 |
| 0VARC1000091 | 20.738 | 22.588 | 16.835 | 15.147 | 15.944 | 18.317 | 24.472 | 14.038 |
| 0VARC1000092 | 45.388 | 47.278 | 30.923 | 56.969 | 21.795 | 27.471 | 24.142 | 30.390 |
| 0VARC1000105 | 56.618 | 51.625 | 28.040 | 39.250 | 20.320 | 35.440 | 41.724 | 47.581 |
| 0VARC1000106 | 97.264 | 85.498 | 48.102 | 31.853 | 33.621 | 45.854 | 56.254 | 52.554 |
| 0VARC1000109 | 114.256 | 62.904 | 50.032 | 28.577 | 38.160 | 60.871 | 53.325 | 44.146 |
| 0VARC1000113 | 34.168 | 25.308 | 21.666 | 38.682 | 21.936 | 24.745 | 30.026 | 25.837 |
| 0VARC1000114 | 55.942 | 73.163 | 50.779 | 53.005 | 19.962 | 35.869 | 27.590 | 39.625 |
| 0VARC1000133 | 5.433 | 9.465 | 6.445 | 3.599 | 2.421 | 3.824 | 7.063 | 6.210 |
| 0VARC1000137 | 41.293 | 26.211 | 21.220 | 13.873 | 15.408 | 25.975 | 29.535 | 16.677 |
| 0VARC1000139 | 84.491 | 47.729 | 43.252 | 31.553 | 35.336 | 57.357 | 112.486 | 56.571 |
| 0VARC1000145 | 26.915 | 13.800 | 13.435 | 8.493 | 4.736 | 16.675 | 21.906 | 9.604 |
| 0VARC1000148 | 95.785 | 51.946 | 47.706 | 22.802 | 33.066 | 41.883 | 45.597 | 39.685 |
| 0VARC1000151 | 111.083 | 48.761 | 50.667 | 22.177 | 24.840 | 81.184 | 53.839 | 31.939 |
| 0VARC1000157 | 62.383 | 114.029 | 28.960 | 63.914 | 19.555 | 36.685 | 41.200 | 59.747 |
| 0VARC1000162 | 5.118 | 14.000 | 6.832 | 5.603 | 6.337 | 4.543 | 9.793 | 8.590 |
| 0VARC1000168 | 81.607 | 75.614 | 57.301 | 56.633 | 36.377 | 46.771 | 48.149 | 49.790 |
| 0VARC1000169 | 78.957 | 58.791 | 36.013 | 29.258 | 23.912 | 45.597 | 77.117 | 58.589 |
| 0VARC1000178 | 106.533 | 52.682 | 38.525 | 31.101 | 37.430 | 64.424 | 120.686 | 45.081 |
| 0VARC1000182 | 15.786 | 9.753 | 6.250 | 2.924 | 6.078 | 5.238 | 9.722 | 7.079 |
| 0VARC1000186 | 178.795 | 62.303 | 67.117 | 22.063 | 47.239 | 71.323 | 93.931 | 44.381 |
| 0VARC1000188 | 55.199 | 40.588 | 29.176 | 19.785 | 20.797 | 37.219 | 38.548 | 31.660 |
| 0VARC1000191 | 14.885 | 2.691 | 6.015 | 3.796 | 3.482 | 9.072 | 4.942 | 5.421 |
| 0VARC1000198 | 72.128 | 80.950 | 54.486 | 54.117 | 33.922 | 43.403 | 37.363 | 41.179 |
| 0VARC1000208 | 73.832 | 151.668 | 79.809 | 82.075 | 69.383 | 50.018 | 50.296 | 63.159 |
| 0VARC1000209 | 45.018 | 32.401 | 13.771 | 12.070 | 17.681 | 55.006 | 120.917 | 35.627 |
| 0VARC1000212 | 50.452 | 37.867 | 27.931 | 26.874 | 23.195 | 35.446 | 34.851 | 30.436 |
| 0VARC1000216 | 33.528 | 22.596 | 8.224 | 10.405 | 12.069 | 17.504 | 239.016 | 15.017 |
| 0VARC1000240 | 101.692 | 80.568 | 37.390 | 41.065 | 36.961 | 25.139 | 30.705 | 41.984 |
| 0VARC1000241 | 96.730 | 62.529 | 34.963 | 20.886 | 28.711 | 41.611 | 41.876 | 40.107 |

TABLE 113

| | | | | | | | | |
|---|---|---|---|---|---|---|---|---|
| 0VARC1000249 | 61.518 | 33.009 | 33.209 | 13.471 | 15.622 | 30.315 | 31.563 | 26.366 |
| 0VARC1000254 | 86.926 | 108.103 | 77.039 | 42.563 | 81.235 | 81.095 | 78.301 | 85.308 |
| 0VARC1000255 | 60.970 | 39.851 | 26.458 | 25.736 | 26.168 | 36.286 | 39.977 | 34.354 |
| 0VARC1000267 | 99.396 | 106.106 | 72.814 | 56.946 | 76.696 | 67.094 | 68.179 | 55.598 |
| 0VARC1000275 | 1.361 | 3.837 | 0.000 | 0.676 | 1.682 | 4.413 | 19.023 | 14.619 |
| 0VARC1000287 | 32.661 | 22.716 | 11.398 | 11.361 | 9.849 | 19.833 | 62.592 | 48.262 |
| 0VARC1000288 | 82.750 | 57.876 | 28.088 | 21.493 | 23.388 | 32.508 | 34.475 | 29.764 |
| 0VARC1000298 | 23.487 | 30.867 | 16.778 | 9.152 | 10.710 | 22.218 | 12.148 | 15.140 |
| 0VARC1000302 | 29.507 | 43.409 | 20.343 | 19.607 | 16.971 | 18.175 | 10.089 | 15.944 |
| 0VARC1000304 | 45.645 | 44.852 | 33.516 | 20.672 | 15.744 | 39.549 | 33.592 | 42.327 |
| 0VARC1000307 | 24.624 | 30.250 | 26.631 | 15.444 | 18.919 | 21.450 | 27.043 | 23.654 |
| 0VARC1000309 | 50.270 | 38.396 | 29.381 | 16.928 | 23.152 | 40.904 | 33.254 | 20.287 |
| 0VARC1000312 | 54.891 | 39.339 | 41.157 | 12.112 | 22.445 | 49.126 | 63.285 | 25.737 |
| 0VARC1000313 | 62.108 | 49.417 | 23.463 | 16.503 | 20.288 | 43.637 | 40.674 | 39.428 |
| 0VARC1000321 | 38.317 | 91.534 | 39.988 | 16.691 | 58.665 | 36.640 | 32.452 | 40.394 |
| 0VARC1000326 | 58.790 | 34.963 | 27.371 | 25.834 | 24.229 | 32.514 | 31.258 | 28.072 |
| 0VARC1000327 | 79.408 | 45.673 | 47.401 | 27.601 | 25.688 | 51.080 | 44.339 | 24.826 |
| 0VARC1000331 | 67.541 | 33.220 | 28.427 | 25.603 | 24.396 | 42.607 | 52.669 | 29.584 |
| 0VARC1000335 | 12.573 | 16.067 | 12.457 | 10.283 | 12.062 | 15.090 | 16.235 | 11.984 |
| 0VARC1000347 | 10.404 | 19.839 | 9.744 | 14.234 | 10.300 | 11.772 | 15.807 | 14.484 |
| 0VARC1000348 | 104.509 | 53.231 | 29.087 | 28.611 | 27.286 | 49.055 | 59.346 | 36.658 |
| 0VARC1000363 | 23.207 | 29.136 | 17.234 | 17.138 | 22.355 | 12.064 | 14.282 | 17.705 |
| 0VARC1000377 | 24.447 | 20.967 | 8.919 | 11.225 | 9.000 | 9.306 | 12.677 | 10.839 |
| 0VARC1000382 | 43.425 | 38.484 | 25.520 | 12.983 | 19.971 | 27.581 | 24.011 | 20.004 |
| 0VARC1000384 | 39.526 | 33.430 | 34.510 | 29.733 | 34.546 | 26.194 | 23.240 | 27.218 |
| 0VARC1000401 | 19.377 | 21.365 | 10.833 | 14.856 | 8.159 | 13.368 | 15.387 | 15.593 |
| 0VARC1000406 | 246.308 | 104.316 | 212.801 | 47.902 | 275.450 | 229.284 | 231.727 | 63.004 |
| 0VARC1000407 | 37.707 | 28.148 | 15.167 | 29.769 | 18.198 | 20.301 | 24.339 | 24.226 |
| 0VARC1000408 | 176.546 | 182.488 | 168.003 | 92.253 | 152.822 | 131.022 | 104.696 | 123.181 |
| 0VARC1000410 | 132.351 | 71.592 | 33.987 | 19.006 | 47.593 | 63.597 | 105.036 | 45.064 |
| 0VARC1000411 | 24.928 | 46.964 | 21.466 | 16.795 | 18.354 | 16.759 | 17.621 | 24.921 |
| 0VARC1000414 | 53.052 | 80.288 | 77.929 | 45.828 | 64.588 | 36.694 | 43.527 | 34.813 |
| 0VARC1000420 | 210.281 | 97.795 | 116.314 | 65.770 | 48.502 | 138.372 | 122.961 | 79.364 |
| 0VARC1000421 | 126.414 | 65.308 | 43.609 | 41.965 | 30.984 | 66.717 | 77.617 | 43.013 |
| 0VARC1000427 | 85.522 | 76.052 | 61.132 | 54.694 | 43.202 | 55.414 | 85.904 | 58.425 |
| 0VARC1000431 | 29.754 | 43.257 | 31.464 | 59.910 | 40.269 | 33.174 | 24.118 | 40.748 |

TABLE 113-continued

| | | | | | | | | |
|---|---|---|---|---|---|---|---|---|
| 0VARC1000437 | 101.746 | 108.759 | 36.433 | 33.368 | 38.706 | 67.360 | 68.627 | 59.999 |
| 0VARC1000439 | 55.100 | 39.820 | 23.665 | 17.682 | 26.837 | 27.173 | 37.589 | 27.642 |
| 0VARC1000440 | 9.304 | 16.390 | 4.607 | 5.910 | 7.569 | 12.799 | 5.759 | 8.778 |
| 0VARC1000442 | 71.954 | 97.290 | 60.169 | 48.043 | 50.925 | 49.780 | 49.452 | 49.132 |
| 0VARC1000443 | 23.336 | 24.854 | 21.466 | 6.313 | 14.231 | 15.300 | 17.929 | 17.277 |
| 0VARC1000461 | 38.961 | 27.338 | 30.933 | 18.801 | 25.228 | 29.577 | 31.675 | 33.815 |
| 0VARC1000465 | 24.244 | 26.635 | 23.588 | 15.988 | 16.431 | 17.245 | 18.033 | 20.237 |
| 0VARC1000466 | 78.845 | 45.309 | 35.183 | 22.710 | 29.028 | 42.270 | 78.325 | 34.551 |
| 0VARC1000467 | 68.457 | 41.646 | 26.636 | 17.995 | 24.535 | 32.636 | 50.520 | 33.453 |
| 0VARC1000470 | 79.505 | 66.390 | 34.473 | 51.974 | 38.874 | 30.248 | 35.482 | 44.070 |
| 0VARC1000473 | 104.626 | 46.950 | 38.060 | 19.545 | 49.878 | 53.144 | 60.639 | 36.861 |
| 0VARC1000479 | 13.043 | 22.838 | 18.446 | 27.648 | 14.611 | 11.592 | 14.222 | 14.645 |
| 0VARC1000484 | 81.135 | 119.477 | 61.550 | 71.199 | 61.618 | 42.186 | 32.384 | 37.475 |
| 0VARC1000486 | 43.060 | 37.552 | 15.873 | 26.931 | 21.970 | 20.014 | 12.533 | 17.483 |
| 0VARC1000496 | 6.894 | 5.795 | 2.024 | 9.550 | 5.845 | 4.482 | 5.597 | 6.952 |
| 0VARC1000520 | 10.944 | 13.261 | 5.969 | 10.975 | 8.640 | 4.681 | 5.177 | 7.377 |
| 0VARC1000522 | 57.377 | 36.524 | 49.921 | 34.183 | 62.162 | 27.574 | 36.847 | 42.071 |
| 0VARC1000526 | 89.641 | 108.239 | 58.125 | 65.691 | 63.235 | 45.200 | 63.148 | 66.145 |
| 0VARC1000529 | 57.424 | 54.050 | 21.682 | 25.091 | 30.072 | 29.592 | 53.851 | 44.743 |
| 0VARC1000533 | 259.058 | 92.210 | 92.325 | 54.816 | 108.661 | 158.123 | 180.752 | 58.313 |
| 0VARC1000543 | 9.147 | 20.003 | 8.468 | 14.598 | 10.808 | 7.160 | 7.656 | 9.778 |
| 0VARC1000550 | 51.120 | 35.681 | 19.454 | 19.769 | 24.341 | 23.780 | 29.758 | 19.911 |
| 0VARC1000553 | 106.477 | 109.455 | 53.476 | 65.549 | 62.372 | 43.061 | 54.040 | 60.551 |
| 0VARC1000556 | 84.636 | 47.645 | 29.302 | 13.010 | 36.300 | 34.811 | 56.871 | 26.716 |
| 0VARC1000557 | 30.381 | 33.997 | 15.138 | 26.106 | 16.920 | 12.137 | 18.572 | 18.092 |
| 0VARC1000661 | 130.212 | 131.086 | 62.529 | 70.306 | 56.212 | 50.615 | 66.315 | 60.071 |
| 0VARC1000564 | 43.577 | 60.550 | 30.136 | 18.864 | 19.300 | 44.661 | 34.156 | 37.974 |
| 0VARC1000573 | 74.996 | 71.429 | 42.493 | 41.906 | 33.040 | 35.765 | 29.517 | 39.465 |

TABLE 114

| | | | | | | | | |
|---|---|---|---|---|---|---|---|---|
| 0VARC1000576 | 322.369 | 178.635 | 134.897 | 63.583 | 61.558 | 195.012 | 191.660 | 126.973 |
| 0VARC1000578 | 41.245 | 47.399 | 27.512 | 62.221 | 23.000 | 19.402 | 20.991 | 28.222 |
| 0VARC1000581 | 19.381 | 18.054 | 16.597 | 12.946 | 10.926 | 16.921 | 23.687 | 17.958 |
| 0VARC1000586 | 58.760 | 84.513 | 39.858 | 53.327 | 17.530 | 41.985 | 63.279 | 95.673 |
| 0VARC1000588 | 52.736 | 46.547 | 28.747 | 35.144 | 19.236 | 20.189 | 27.881 | 28.239 |
| 0VARC1000605 | 25.011 | 21.584 | 16.038 | 16.026 | 12.949 | 28.632 | 20.949 | 12.415 |
| 0VARC1000622 | 236.401 | 229.625 | 142.634 | 146.619 | 111.039 | 103.900 | 84.581 | 117.758 |
| 0VARC1000636 | 62.041 | 58.870 | 30.872 | 26.680 | 23.116 | 39.517 | 52.845 | 27.699 |
| 0VARC1000640 | 37.774 | 40.454 | 27.435 | 25.421 | 14.327 | 20.971 | 27.326 | 24.570 |
| 0VARC1000649 | 119.925 | 80.531 | 59.932 | 34.951 | 42.653 | 66.545 | 126.333 | 64.422 |
| 0VARC1000561 | 91.942 | 47.731 | 46.674 | 29.765 | 29.826 | 53.562 | 68.611 | 41.478 |
| 0VARC1000677 | 47.303 | 42.727 | 39.478 | 18.654 | 17.990 | 29.788 | 33.925 | 31.139 |
| 0VARC1000678 | 53.878 | 40.134 | 32.060 | 37.092 | 23.552 | 26.846 | 42.330 | 32.378 |
| 0VARC1000679 | 25.552 | 33.892 | 27.236 | 13.826 | 12.729 | 13.248 | 18.589 | 22.125 |
| 0VARC1000681 | 64.996 | 39.676 | 33.010 | 23.036 | 25.157 | 35.864 | 32.183 | 28.963 |
| 0VARC1000682 | 89.453 | 46.031 | 48.073 | 26.181 | 22.664 | 56.539 | 67.656 | 36.205 |
| 0VARC1000689 | 40.766 | 43.141 | 31.489 | 16.450 | 18.494 | 36.522 | 52.050 | 50.362 |
| 0VARC1000700 | 65.661 | 65.260 | 46.443 | 51.382 | 36.724 | 40.865 | 31.889 | 43.299 |
| 0VARC1000703 | 68.421 | 67.574 | 44.166 | 43.328 | 32.848 | 43.707 | 34.063 | 33.710 |
| 0VARC1000722 | 90.588 | 55.674 | 40.426 | 28.083 | 33.617 | 39.059 | 84.669 | 53.295 |
| 0VARC1000726 | 223.039 | 61.254 | 64.375 | 36.671 | 46.678 | 62.745 | 120.014 | 59.080 |
| 0VARC1000727 | 101.498 | 52.857 | 32.778 | 21.030 | 24.747 | 45.216 | 39.732 | 28.241 |
| 0VARC1000730 | 32.092 | 36.451 | 14.144 | 26.825 | 11.752 | 14.326 | 24.052 | 21.653 |
| 0VARC1000741 | 93.409 | 52.169 | 37.001 | 21.498 | 22.633 | 47.358 | 43.609 | 24.156 |
| 0VARC1000746 | 18.880 | 20.011 | 11.250 | 10.152 | 10.039 | 12.336 | 11.833 | 14.185 |
| 0VARC1000764 | 94.412 | 66.494 | 49.103 | 37.950 | 38.405 | 57.102 | 51.799 | 45.024 |
| 0VARC1000769 | 61.249 | 87.994 | 63.412 | 48.573 | 49.372 | 46.621 | 37.596 | 54.747 |
| 0VARC1000771 | 17.704 | 22.392 | 12.731 | 11.680 | 15.094 | 14.537 | 11.734 | 13.386 |
| 0VARC1000773 | 309.712 | 63.691 | 128.640 | 93.505 | 135.643 | 247.891 | 47.762 | 56.423 |
| 0VARC1000775 | 39.822 | 40.473 | 19.087 | 17.945 | 17.047 | 20.931 | 22.217 | 24.299 |
| 0VARC1000778 | 57.819 | 40.229 | 23.354 | 27.887 | 19.703 | 25.351 | 15.434 | 16.858 |
| 0VARC1000779 | 13.359 | 9.700 | 3.596 | 4.604 | 3.376 | 6.590 | 5.881 | 4.469 |
| 0VARC1000781 | 28.426 | 18.324 | 19.364 | 8.066 | 2.533 | 18.289 | 13.313 | 9.987 |
| 0VARC1000787 | 57.756 | 46.552 | 31.436 | 36.327 | 24.660 | 31.315 | 26.423 | 26.916 |
| 0VARC1000789 | 56.045 | 42.830 | 21.343 | 32.278 | 26.180 | 29.815 | 35.483 | 31.401 |
| 0VARC1000800 | 152.906 | 115.192 | 91.456 | 100.625 | 80.665 | 74.709 | 72.586 | 83.426 |
| 0VARC1000802 | 56.307 | 41.592 | 29.261 | 21.865 | 29.614 | 38.004 | 29.144 | 37.338 |
| 0VARC1000810 | 117.305 | 73.073 | 45.217 | 47.024 | 30.840 | 54.331 | 22.585 | 30.212 |
| 0VARC1000811 | 24.376 | 21.125 | 12.822 | 10.066 | 8.476 | 14.818 | 12.129 | 13.407 |
| 0VARC1000814 | 109.717 | 173.696 | 116.374 | 110.400 | 99.820 | 81.598 | 52.542 | 70.043 |
| 0VARC1000816 | 38.942 | 32.627 | 29.109 | 10.508 | 18.910 | 26.961 | 43.388 | 30.931 |
| 0VARC1000817 | 7.152 | 7.754 | 5.073 | 4.922 | 1.435 | 3.770 | 5.107 | 7.052 |
| 0VARC1000834 | 52.593 | 59.148 | 30.623 | 25.871 | 27.698 | 43.601 | 43.333 | 33.619 |
| 0VARC1000846 | 128.045 | 121.550 | 80.555 | 82.014 | 63.814 | 79.270 | 47.279 | 73.330 |
| 0VARC1000850 | 63.194 | 47.834 | 24.998 | 22.731 | 23.832 | 31.759 | 43.348 | 29.789 |

TABLE 114-continued

| | | | | | | | | |
|---|---|---|---|---|---|---|---|---|
| 0VARC1000853 | 47.482 | 127.726 | 57.523 | 25.369 | 55.048 | 41.556 | 32.136 | 37.576 |
| 0VARC1000862 | 31.255 | 26.218 | 21.640 | 13.240 | 25.873 | 16.507 | 16.932 | 8.079 |
| 0VARC1000873 | 59.654 | 49.105 | 31.649 | 32.533 | 37.513 | 39.866 | 44.461 | 30.226 |
| 0VARC1000875 | 178.627 | 94.134 | 92.359 | 64.818 | 79.244 | 116.581 | 163.150 | 75.514 |
| 0VARC1000876 | 8.798 | 15.017 | 5.566 | 12.799 | 6.112 | 8.158 | 8.444 | 16.825 |
| 0VARC1000883 | 44.435 | 33.208 | 17.857 | 33.562 | 21.585 | 25.327 | 28.768 | 27.716 |
| 0VARC1000885 | 11.029 | 16.263 | 7.277 | 16.699 | 8.434 | 58.765 | 18.303 | 13.712 |
| 0VARC1000886 | 41.813 | 40.086 | 18.851 | 13.178 | 22.604 | 30.692 | 35.601 | 21.522 |
| 0VARC1000890 | 216.895 | 167.860 | 92.458 | 66.405 | 70.562 | 97.108 | 128.741 | 96.438 |
| 0VARC1000891 | 20.905 | 24.028 | 19.790 | 8.818 | 7.749 | 13.015 | 11.884 | 12.875 |
| 0VARC1000897 | 9.048 | 31.172 | 6.976 | 6.993 | 2.984 | 7.384 | 6.185 | 9.271 |
| 0VARC1000912 | 15.809 | 11.325 | 6.349 | 14.551 | 6.939 | 9.404 | 13.732 | 9.946 |
| 0VARC1000914 | 26.259 | 35.138 | 27.276 | 22.701 | 17.946 | 18.401 | 14.325 | 19.336 |
| 0VARC1000915 | 75.637 | 70.430 | 44.897 | 67.623 | 39.966 | 40.708 | 37.700 | 37.607 |
| 0VARC1000916 | 51.456 | 41.509 | 29.511 | 22.182 | 21.453 | 30.494 | 39.766 | 29.531 |
| 0VARC1000924 | 31.774 | 26.872 | 12.891 | 6.378 | 16.342 | 20.449 | 32.562 | 22.496 |
| 0VARC1000928 | 36.954 | 58.011 | 21.195 | 13.024 | 27.684 | 15.057 | 30.125 | 17.883 |
| 0VARC1000936 | 22.358 | 30.709 | 22.132 | 20.757 | 13.382 | 30.025 | 17.362 | 22.497 |
| 0VARC1000937 | 50.958 | 48.239 | 37.559 | 26.648 | 23.630 | 35.710 | 37.949 | 33.063 |

TABLE 115

| | | | | | | | | |
|---|---|---|---|---|---|---|---|---|
| 0VARC1000945 | 72.670 | 66.756 | 35.734 | 31.061 | 28.439 | 44.288 | 57.299 | 34.609 |
| 0VARC1000948 | 13.138 | 9.821 | 6.873 | 5.701 | 6.145 | 7.947 | 8.485 | 6.560 |
| 0VARC1000956 | 53.521 | 35.128 | 27.412 | 25.007 | 31.512 | 30.356 | 47.794 | 38.003 |
| 0VARC1000959 | 73.657 | 56.906 | 34.594 | 53.936 | 29.777 | 37.237 | 43.699 | 40.734 |
| 0VARC1000960 | 336.284 | 304.478 | 264.514 | 301.674 | 301.925 | 170.334 | 206.868 | 211.921 |
| 0VARC1000964 | 109.457 | 89.334 | 92.736 | 42.962 | 107.425 | 66.304 | 100.429 | 104.440 |
| 0VARC1000971 | 23.347 | 22.555 | 11.767 | 9.454 | 10.751 | 11.968 | 14.346 | 9.949 |
| 0VARC1000975 | 38.653 | 41.668 | 22.926 | 16.702 | 21.947 | 23.016 | 30.329 | 22.999 |
| 0VARC1000976 | 5.549 | 11.344 | 5.097 | 7.562 | 6.992 | 4.915 | 5.760 | 8.357 |
| 0VARC1000981 | 38.051 | 38.818 | 23.473 | 34.246 | 24.179 | 25.155 | 27.878 | 49.594 |
| 0VARC1000982 | 18.237 | 20.180 | 8.868 | 15.397 | 12.870 | 12.622 | 17.681 | 16.489 |
| 0VARC1000984 | 64.280 | 32.461 | 21.258 | 21.860 | 23.534 | 26.715 | 40.246 | 32.960 |
| 0VARC1000995 | 98.670 | 98.801 | 50.363 | 66.552 | 60.125 | 43.967 | 46.967 | 67.398 |
| 0VARC1000996 | 23.461 | 22.409 | 9.648 | 11.387 | 13.424 | 14.277 | 20.244 | 19.657 |
| 0VARC1000999 | 142.766 | 147.956 | 91.391 | 112.389 | 86.587 | 72.322 | 63.450 | 71.881 |
| 0VARC1001000 | 196.742 | 223.698 | 123.240 | 137.198 | 124.411 | 96.923 | 91.581 | 110.353 |
| 0VARC1001004 | 15.837 | 24.777 | 8.416 | 6.761 | 11.301 | 5.392 | 7.712 | 7.076 |
| 0VARC1001010 | 20.746 | 21.844 | 10.176 | 13.214 | 12.974 | 9.756 | 20.656 | 11.492 |
| 0VARC1001011 | 56.262 | 49.134 | 31.219 | 40.269 | 29.627 | 26.821 | 32.007 | 29.717 |
| 0VARC1001030 | 267.698 | 257.417 | 369.890 | 123.083 | 481.589 | 213.259 | 236.252 | 156.604 |
| 0VARC1001032 | 25.684 | 32.175 | 13.978 | 17.255 | 17.403 | 12.728 | 21.746 | 22.424 |
| 0VARC1001034 | 26.408 | 30.129 | 18.682 | 14.209 | 24.225 | 14.437 | 22.093 | 19.148 |
| 0VARC1001038 | 38.346 | 41.992 | 24.957 | 24.612 | 28.412 | 29.918 | 36.871 | 30.300 |
| 0VARC1001040 | 98.109 | 163.189 | 57.680 | 96.342 | 37.120 | 36.870 | 51.690 | 65.780 |
| 0VARC1001041 | 93.629 | 176.563 | 45.646 | 73.484 | 59.177 | 42.401 | 48.353 | 76.436 |
| 0VARC1001044 | 29.011 | 33.627 | 14.802 | 21.262 | 17.318 | 16.763 | 22.227 | 22.829 |
| 0VARC1001049 | 156.011 | 131.461 | 99.014 | 60.845 | 95.518 | 95.243 | 124.468 | 83.710 |
| 0VARC1001051 | 180.769 | 195.784 | 75.946 | 127.551 | 72.219 | 104.988 | 166.021 | 161.466 |
| 0VARC1001054 | 44.196 | 25.475 | 14.270 | 15.193 | 14.800 | 17.493 | 25.623 | 19.511 |
| 0VARC1001055 | 49.946 | 52.425 | 26.074 | 16.256 | 16.038 | 22.736 | 26.492 | 26.988 |
| 0VARC1001062 | 9.764 | 52.550 | 13.991 | 22.860 | 14.380 | 12.344 | 7.304 | 17.143 |
| 0VARC1001065 | 20.300 | 19.807 | 20.195 | 9.804 | 10.947 | 15.910 | 27.631 | 19.975 |
| 0VARC1001068 | 56.993 | 44.653 | 31.867 | 20.677 | 17.254 | 28.843 | 44.829 | 31.704 |
| 0VARC1001072 | 156.343 | 67.114 | 52.898 | 30.164 | 30.884 | 59.064 | 66.747 | 40.238 |
| 0VARC1001073 | 34.815 | 40.406 | 29.440 | 33.203 | 20.617 | 29.525 | 38.538 | 21.374 |
| 0VARC1001074 | 18.735 | 18.807 | 6.927 | 9.591 | 8.229 | 12.569 | 22.029 | 15.581 |
| 0VARC1001078 | 170.789 | 81.144 | 63.392 | 42.879 | 41.437 | 60.250 | 97.102 | 51.664 |
| 0VARC1001085 | 48.583 | 37.562 | 22.446 | 18.020 | 16.558 | 51.666 | 25.272 | 24.844 |
| 0VARC1001086 | 94.509 | 38.291 | 23.565 | 18.437 | 19.838 | 42.555 | 39.613 | 26.858 |
| 0VARC1001091 | 59.024 | 54.767 | 39.117 | 31.558 | 15.085 | 41.665 | 65.548 | 38.043 |
| 0VARC1001092 | 78.369 | 48.366 | 35.270 | 24.652 | 27.135 | 48.099 | 68.542 | 28.251 |
| 0VARC1001104 | 9.822 | 12.079 | 8.053 | 6.860 | 3.025 | 6.895 | 13.769 | 8.849 |
| 0VARC1001107 | 132.584 | 59.642 | 57.112 | 32.997 | 46.497 | 103.685 | 120.752 | 61.479 |
| 0VARC1001113 | 35.730 | 35.073 | 29.872 | 25.624 | 16.230 | 24.132 | 39.291 | 35.356 |
| 0VARC1001117 | 91.761 | 65.878 | 42.978 | 55.698 | 23.367 | 45.042 | 42.492 | 38.455 |
| 0VARC1001118 | 78.150 | 72.874 | 45.679 | 47.079 | 35.711 | 49.123 | 35.261 | 47.146 |
| 0VARC1001125 | 19.282 | 29.524 | 14.882 | 30.810 | 6.474 | 16.234 | 19.586 | 21.569 |
| 0VARC1001129 | 26.932 | 18.396 | 14.691 | 12.212 | 8.606 | 16.751 | 19.030 | 7.081 |
| 0VARC1001132 | 7.132 | 10.388 | 7.883 | 7.540 | 6.168 | 4.130 | 6.582 | 8.385 |
| 0VARC1001138 | 308.799 | 242.318 | 123.419 | 77.068 | 99.486 | 165.174 | 159.386 | 99.862 |
| 0VARC1001141 | 48.972 | 28.503 | 23.912 | 13.741 | 19.193 | 23.582 | 30.980 | 24.417 |
| 0VARC1001154 | 66.885 | 91.460 | 43.947 | 37.042 | 36.702 | 48.431 | 80.339 | 79.168 |
| 0VARC1001161 | 71.634 | 56.342 | 31.340 | 42.482 | 14.597 | 25.244 | 28.686 | 26.648 |
| 0VARC1001162 | 80.697 | 81.514 | 58.697 | 43.494 | 34.028 | 46.796 | 40.262 | 50.829 |

TABLE 115-continued

| | | | | | | | | |
|---|---|---|---|---|---|---|---|---|
| 0VARC1001163 | 170.857 | 43.068 | 59.424 | 17.764 | 29.289 | 91.606 | 90.481 | 55.488 |
| 0VARC1001167 | 77.273 | 85.145 | 46.746 | 44.768 | 32.264 | 35.631 | 32.410 | 29.958 |
| 0VARC1001169 | 10.634 | 15.674 | 9.302 | 5.674 | 5.124 | 9.510 | 12.220 | 9.744 |
| 0VARC1001170 | 48.257 | 49.203 | 32.879 | 28.366 | 23.146 | 21.439 | 43.645 | 39.076 |
| 0VARC1001171 | 71.425 | 65.035 | 38.595 | 39.746 | 29.129 | 40.964 | 39.089 | 54.225 |
| 0VARC1001173 | 116.007 | 101.332 | 67.406 | 103.307 | 65.939 | 60.129 | 54.280 | 60.387 |
| 0VARC1001176 | 245.124 | 107.908 | 82.421 | 85.014 | 77.976 | 145.459 | 105.359 | 82.551 |
| 0VARC1001180 | 195.252 | 157.056 | 72.136 | 68.290 | 69.367 | 72.299 | 67.658 | 67.806 |
| 0VARC1001188 | 63.149 | 49.538 | 32.804 | 26.683 | 20.348 | 25.538 | 21.817 | 24.241 |
| 0VARC1001200 | 21.549 | 27.975 | 18.502 | 11.241 | 24.300 | 13.472 | 12.226 | 12.568 |

TABLE 116

| | | | | | | | | |
|---|---|---|---|---|---|---|---|---|
| 0VARC1001202 | 122.810 | 79.160 | 74.976 | 45.179 | 34.305 | 57.752 | 54.521 | 52.075 |
| 0VARC1001206 | 42.615 | 25.397 | 25.932 | 13.326 | 28.104 | 29.089 | 32.918 | 22.690 |
| 0VARC1001209 | 72.876 | 58.366 | 36.700 | 24.151 | 40.859 | 38.440 | 59.191 | 47.601 |
| 0VARC1001219 | 33.632 | 13.311 | 13.625 | 12.687 | 15.459 | 16.636 | 29.651 | 23.801 |
| 0VARC1001222 | 32.786 | 21.648 | 10.686 | 9.886 | 10.225 | 25.581 | 20.058 | 17.564 |
| 0VARC1001232 | 117.540 | 87.613 | 50.146 | 34.554 | 30.246 | 57.933 | 49.208 | 37.950 |
| 0VARC1001240 | 75.374 | 60.625 | 38.831 | 32.204 | 26.238 | 32.631 | 20.938 | 29.225 |
| 0VARC1001243 | 9.543 | 16.485 | 6.223 | 5.619 | 1.978 | 7.592 | 11.212 | 9.204 |
| 0VARC1001244 | 169.003 | 111.321 | 69.720 | 46.121 | 39.223 | 93.281 | 105.487 | 89.348 |
| 0VARC1001246 | 102.652 | 232.219 | 202.228 | 159.295 | 307.379 | 168.939 | 66.384 | 180.606 |
| 0VARC1001247 | 51.814 | 49.398 | 25.400 | 17.972 | 24.516 | 29.579 | 38.406 | 32.633 |
| 0VARC1001260 | 53.551 | 100.419 | 29.364 | 25.020 | 34.864 | 30.489 | 28.556 | 34.131 |
| 0VARC1001261 | 48.536 | 42.261 | 28.153 | 13.070 | 26.118 | 36.641 | 37.660 | 22.612 |
| 0VARC1001268 | 51.904 | 118.717 | 47.463 | 24.361 | 63.661 | 38.492 | 51.108 | 43.123 |
| 0VARC1001270 | 20.955 | 18.655 | 11.209 | 10.629 | 7.297 | 10.404 | 10.615 | 9.730 |
| 0VARC1001271 | 82.087 | 105.253 | 59.789 | 67.369 | 40.952 | 49.040 | 49.902 | 56.550 |
| 0VARC1001282 | 2.151 | 7.862 | 2.074 | 5.144 | 2.146 | 4.070 | 1.658 | 4.939 |
| 0VARC1001296 | 11.865 | 15.267 | 7.897 | 10.844 | 6.153 | 11.518 | 15.515 | 10.296 |
| 0VARC1001306 | 25.532 | 50.725 | 28.628 | 24.049 | 17.847 | 22.716 | 24.404 | 32.492 |
| 0VARC1001314 | 12.995 | 19.789 | 11.346 | 14.481 | 11.454 | 16.041 | 17.642 | 15.122 |
| 0VARC1001316 | 14.093 | 43.453 | 9.049 | 9.287 | 10.402 | 12.676 | 9.571 | 8.634 |
| 0VARC1001329 | 236.298 | 224.291 | 230.056 | 140.553 | 147.173 | 134.506 | 88.940 | 124.623 |
| 0VARC1001330 | 34.063 | 30.737 | 21.299 | 12.416 | 9.409 | 18.781 | 21.774 | 14.306 |
| 0VARC1001336 | 64.433 | 86.449 | 37.979 | 30.312 | 22.554 | 34.649 | 46.151 | 36.127 |
| 0VARC1001338 | 29.434 | 27.732 | 16.123 | 16.132 | 16.945 | 20.146 | 25.217 | 26.946 |
| 0VARC1001339 | 32.829 | 42.256 | 31.603 | 10.158 | 27.332 | 21.573 | 35.452 | 25.220 |
| 0VARC1001340 | 27.630 | 18.361 | 12.822 | 7.427 | 6.739 | 12.500 | 23.923 | 14.457 |
| 0VARC1001341 | 95.252 | 81.979 | 52.630 | 68.282 | 53.071 | 55.813 | 59.589 | 60.054 |
| 0VARC1001342 | 100.966 | 252.091 | 51.417 | 202.538 | 60.427 | 87.325 | 80.221 | 137.940 |
| 0VARC1001344 | 103.513 | 107.791 | 75.126 | 75.888 | 55.791 | 47.394 | 56.015 | 68.157 |
| 0VARC1001357 | 10.771 | 20.444 | 6.064 | 5.959 | 2.545 | 8.202 | 6.654 | 9.212 |
| 0VARC1001359 | 74.406 | 41.612 | 39.409 | 39.521 | 22.602 | 47.817 | 49.919 | 41.248 |
| 0VARC1001360 | 12.963 | 15.729 | 5.865 | 8.162 | 5.343 | 8.344 | 7.449 | 5.231 |
| 0VARC1001369 | 30.741 | 30.024 | 17.593 | 14.376 | 15.376 | 19.395 | 28.970 | 17.236 |
| 0VARC1001372 | 47.372 | 31.878 | 28.420 | 22.363 | 23.533 | 27.224 | 35.738 | 26.351 |
| 0VARC1001376 | 65.628 | 113.295 | 43.890 | 78.146 | 52.979 | 38.758 | 43.990 | 55.762 |
| 0VARC1001381 | 115.063 | 118.072 | 70.088 | 92.127 | 69.013 | 60.845 | 53.880 | 62.779 |
| 0VARC1001391 | 39.498 | 37.024 | 30.883 | 12.771 | 21.036 | 26.802 | 26.851 | 18.964 |
| 0VARC1001392 | 17.841 | 35.639 | 29.498 | 12.487 | 18.354 | 13.407 | 13.843 | 15.944 |
| 0VARC1001399 | 43.831 | 87.706 | 37.282 | 44.533 | 34.853 | 26.357 | 28.943 | 38.749 |
| 0VARC1001417 | 26.403 | 24.005 | 20.041 | 15.997 | 12.488 | 15.218 | 23.379 | 13.202 |
| 0VARC1001419 | 102.361 | 46.760 | 47.763 | 31.720 | 43.416 | 60.531 | 66.782 | 40.700 |
| 0VARC1001425 | 36.511 | 32.857 | 19.181 | 27.837 | 18.684 | 27.353 | 39.805 | 22.560 |
| 0VARC1001436 | 56.321 | 33.132 | 21.728 | 19.600 | 24.952 | 23.512 | 43.382 | 21.101 |
| 0VARC1001442 | 85.715 | 36.595 | 24.645 | 21.266 | 30.507 | 37.805 | 58.999 | 27.499 |
| 0VARC1001451 | 34.303 | 30.697 | 30.804 | 34.477 | 24.521 | 23.798 | 19.177 | 24.423 |
| 0VARC1001452 | 53.317 | 30.445 | 17.186 | 12.444 | 18.765 | 27.539 | 29.572 | 22.163 |
| 0VARC1001453 | 16.620 | 33.383 | 8.673 | 8.363 | 7.911 | 7.294 | 15.113 | 10.726 |
| 0VARC1001476 | 23.408 | 34.646 | 23.709 | 17.349 | 17.688 | 17.078 | 15.241 | 27.167 |
| 0VARC1001480 | 69.410 | 32.323 | 28.385 | 21.037 | 14.968 | 36.453 | 52.487 | 28.092 |
| 0VARC1001489 | 10.998 | 9.249 | 5.028 | 7.129 | 6.338 | 4.046 | 10.274 | 9.908 |
| 0VARC1001493 | 55.166 | 55.346 | 14.849 | 9.601 | 15.915 | 27.767 | 38.065 | 22.112 |
| 0VARC1001496 | 85.220 | 65.108 | 29.250 | 24.050 | 41.730 | 36.194 | 61.219 | 38.523 |
| 0VARC1001499 | 27.560 | 27.910 | 16.669 | 16.239 | 20.204 | 20.989 | 35.173 | 22.472 |
| 0VARC1001506 | 67.326 | 60.488 | 43.800 | 30.337 | 35.006 | 34.184 | 46.403 | 31.327 |
| 0VARC1001509 | 45.793 | 56.347 | 29.884 | 32.079 | 26.485 | 23.100 | 23.398 | 18.605 |
| 0VARC1001510 | 14.065 | 17.712 | 12.458 | 11.811 | 11.932 | 6.535 | 17.532 | 9.275 |
| 0VARC1001516 | 64.781 | 44.167 | 26.084 | 28.410 | 30.019 | 33.509 | 55.926 | 34.068 |
| 0VARC1001525 | 8.675 | 10.658 | 6.559 | 6.011 | 4.611 | 3.863 | 6.484 | 5.884 |
| 0VARC1001542 | 34.447 | 36.452 | 18.588 | 20.569 | 17.086 | 20.034 | 32.156 | 28.167 |
| 0VARC1001544 | 97.739 | 98.662 | 46.751 | 55.837 | 47.415 | 35.307 | 53.917 | 51.833 |
| 0VARC1001546 | 40.692 | 24.215 | 14.449 | 9.924 | 10.317 | 17.393 | 21.638 | 34.075 |
| 0VARC1001547 | 4.108 | 6.476 | 2.931 | 4.799 | 7.154 | 5.168 | 4.549 | 5.293 |
| 0VARC1001555 | 48.644 | 45.769 | 33.072 | 18.823 | 21.553 | 30.921 | 53.633 | 33.664 |

TABLE 117

| | | | | | | | | |
|---|---|---|---|---|---|---|---|---|
| 0VARC1001560 | 9.995 | 11.616 | 22.248 | 5.899 | 8.179 | 16.185 | 10.151 | 7.957 |
| 0VARC1001569 | 40.746 | 31.448 | 15.414 | 17.742 | 13.831 | 32.806 | 32.162 | 24.321 |
| 0VARC1001570 | 45.828 | 32.466 | 28.804 | 16.797 | 17.223 | 29.282 | 50.455 | 32.827 |
| 0VARC1001577 | 18.703 | 19.196 | 13.453 | 17.108 | 9.651 | 14.718 | 23.685 | 24.544 |
| 0VARC1001578 | 4.894 | 1.347 | 3.487 | 1.668 | 2.647 | 3.022 | 0.000 | 0.000 |
| 0VARC1001596 | 84.296 | 49.737 | 31.737 | 18.041 | 23.005 | 61.151 | 47.274 | 34.947 |
| 0VARC1001600 | 54.416 | 43.232 | 24.561 | 22.726 | 16.594 | 23.734 | 27.443 | 19.377 |
| 0VARC1001607 | 21.077 | 19.469 | 15.218 | 12.687 | 5.720 | 14.273 | 22.223 | 16.907 |
| 0VARC1001610 | 22.320 | 13.445 | 7.606 | 4.839 | 6.723 | 8.590 | 14.535 | 14.413 |
| 0VARC1001611 | 10.788 | 15.290 | 11.190 | 3.816 | 6.271 | 10.248 | 18.405 | 10.394 |
| 0VARC1001615 | 83.171 | 33.856 | 33.256 | 23.489 | 27.385 | 39.578 | 60.842 | 26.422 |
| 0VARC1001636 | 19.126 | 18.265 | 9.929 | 10.903 | 5.896 | 14.319 | 20.083 | 11.921 |
| 0VARC1001668 | 184.639 | 178.409 | 101.057 | 130.922 | 77.578 | 71.883 | 78.800 | 99.902 |
| 0VARC1001702 | 74.853 | 43.682 | 37.735 | 17.471 | 24.833 | 47.858 | 40.347 | 30.531 |
| 0VARC1001703 | 20.271 | 16.866 | 19.593 | 10.314 | 12.106 | 14.193 | 17.305 | 11.237 |
| 0VARC1001710 | 104.705 | 53.627 | 46.081 | 22.841 | 30.909 | 61.922 | 57.754 | 30.671 |
| 0VARC1001711 | 38.919 | 48.731 | 30.797 | 20.615 | 17.927 | 29.742 | 29.051 | 30.493 |
| 0VARC1001713 | 58.871 | 50.075 | 38.715 | 24.728 | 28.026 | 37.714 | 59.338 | 46.137 |
| 0VARC1001725 | 12.462 | 6.462 | 9.161 | 5.766 | 5.579 | 7.643 | 12.283 | 11.952 |
| 0VARC1001726 | 60.846 | 30.421 | 22.951 | 16.102 | 17.141 | 25.341 | 40.000 | 23.764 |
| 0VARC1001727 | 12.749 | 6.695 | 1.629 | 3.384 | 2.943 | 5.347 | 11.864 | 5.882 |
| 0VARC1001731 | 417.237 | 296.389 | 159.879 | 90.412 | 79.927 | 104.739 | 112.601 | 182.645 |
| 0VARC1001735 | 29.333 | 21.981 | 13.004 | 10.850 | 7.779 | 19.246 | 25.926 | 9.776 |
| 0VARC1001741 | 62.439 | 80.254 | 36.924 | 40.754 | 30.175 | 31.693 | 40.353 | 35.965 |
| 0VARC1001745 | 105.943 | 90.392 | 54.073 | 48.385 | 29.915 | 42.496 | 52.805 | 40.912 |
| 0VARC1001759 | 6.344 | 6.101 | 7.549 | 5.672 | 5.285 | 7.629 | 4.284 | 16.699 |
| 0VARC1001762 | 15.752 | 20.242 | 8.966 | 13.129 | 12.132 | 11.198 | 17.879 | 12.812 |
| 0VARC1001766 | 50.421 | 44.814 | 32.524 | 34.416 | 32.044 | 28.483 | 26.974 | 25.134 |
| 0VARC1001767 | 12.694 | 11.424 | 7.232 | 4.392 | 4.561 | 7.783 | 6.753 | 3.775 |
| 0VARC1001768 | 30.851 | 32.866 | 18.111 | 12.623 | 14.716 | 15.800 | 18.499 | 17.641 |
| 0VARC1001770 | 99.967 | 29.814 | 24.915 | 16.646 | 18.553 | 49.766 | 33.065 | 24.957 |
| 0VARC1001776 | 84.733 | 66.614 | 35.351 | 18.038 | 20.855 | 40.357 | 40.259 | 38.765 |
| 0VARC1001791 | 82.228 | 59.107 | 38.878 | 27.000 | 19.647 | 41.210 | 58.352 | 34.508 |
| 0VARC1001795 | 35.170 | 31.032 | 19.091 | 14.053 | 19.096 | 16.818 | 23.677 | 24.540 |
| 0VARC1001798 | 113.936 | 95.099 | 73.266 | 84.613 | 71.384 | 61.440 | 58.197 | 68.677 |
| 0VARC1001802 | 125.877 | 98.941 | 72.747 | 75.225 | 59.196 | 77.683 | 67.227 | 71.441 |
| 0VARC1001805 | 10.464 | 10.835 | 12.686 | 8.980 | 8.339 | 13.601 | 7.696 | 8.902 |
| 0VARC1001907 | 135.513 | 172.138 | 42.410 | 25.456 | 42.245 | 77.908 | 59.683 | 39.476 |
| 0VARC1001809 | 118.235 | 105.836 | 62.430 | 46.885 | 49.795 | 56.085 | 64.919 | 59.018 |
| 0VARC1001812 | 67.287 | 48.010 | 53.706 | 41.376 | 36.383 | 38.322 | 38.347 | 31.540 |
| 0VARC1001813 | 69.943 | 84.621 | 53.953 | 56.458 | 42.844 | 41.002 | 32.364 | 36.514 |
| 0VARC1001820 | 52.381 | 53.833 | 35.503 | 41.319 | 24.742 | 28.840 | 25.646 | 28.845 |
| 0VARC1001828 | 8.200 | 10.217 | 4.364 | 9.812 | 6.280 | 8.885 | 6.886 | 8.407 |
| 0VARC1001833 | 86.833 | 60.894 | 37.693 | 22.705 | 29.730 | 50.489 | 52.516 | 40.092 |
| 0VARC1001839 | 39.140 | 38.162 | 14.245 | 19.805 | 17.227 | 23.521 | 26.722 | 22.628 |
| 0VARC1001846 | 14.794 | 24.500 | 15.503 | 10.407 | 8.977 | 15.603 | 9.900 | 14.219 |
| 0VARC1001849 | 73.011 | 60.883 | 43.536 | 39.792 | 33.900 | 30.397 | 28.153 | 30.952 |
| 0VARC1001861 | 63.938 | 43.449 | 26.931 | 16.558 | 17.111 | 24.800 | 36.196 | 21.959 |
| 0VARC1001873 | 37.219 | 38.842 | 19.844 | 22.293 | 20.314 | 24.148 | 34.160 | 26.819 |
| 0VARC1001879 | 76.088 | 51.361 | 39.655 | 29.363 | 28.800 | 45.644 | 47.894 | 29.618 |
| 0VARC1001880 | 135.860 | 84.254 | 58.296 | 66.680 | 55.691 | 73.306 | 83.823 | 57.413 |
| 0VARC1001883 | 81.852 | 74.425 | 52.983 | 53.494 | 55.481 | 39.665 | 45.082 | 50.587 |
| 0VARC1001900 | 55.149 | 42.744 | 20.659 | 17.501 | 28.891 | 25.216 | 36.722 | 27.567 |
| 0VARC1001901 | 35.402 | 43.250 | 19.139 | 18.068 | 14.966 | 16.860 | 28.327 | 21.865 |
| 0VARC1001911 | 26.676 | 31.540 | 16.048 | 15.000 | 9.189 | 16.480 | 16.595 | 14.072 |
| 0VARC1001916 | 57.008 | 57.583 | 30.437 | 33.497 | 24.346 | 38.467 | 49.017 | 28.751 |
| 0VARC1001928 | 11.760 | 11.451 | 9.871 | 8.924 | 3.218 | 9.310 | 7.928 | 8.861 |
| 0VARC1001937 | 41.094 | 331.797 | 26.182 | 31.807 | 18.612 | 29.201 | 28.632 | 31.167 |
| 0VARC1001940 | 31.671 | 25.633 | 19.059 | 18.927 | 15.166 | 24.914 | 25.701 | 31.361 |
| 0VARC1001942 | 30.967 | 37.334 | 26.741 | 17.951 | 21.439 | 17.640 | 29.921 | 25.107 |
| 0VARC1001943 | 85.434 | 52.979 | 27.869 | 23.583 | 35.086 | 45.562 | 49.703 | 36.562 |
| 0VARC1001949 | 27.732 | 45.197 | 29.233 | 33.177 | 22.996 | 24.826 | 26.681 | 54.991 |
| 0VARC1001950 | 114.630 | 90.867 | 57.193 | 51.930 | 43.996 | 70.058 | 71.925 | 46.593 |
| 0VARC1001952 | 140.095 | 114.529 | 76.000 | 76.812 | 57.544 | 76.600 | 127.024 | 117.497 |

TABLE 118

| | | | | | | | | |
|---|---|---|---|---|---|---|---|---|
| OVARC1001954 | 38.148 | 34.154 | 24.826 | 18.570 | 18.070 | 29.136 | 28.466 | 23.093 |
| OVARC1001963 | 70.685 | 73.510 | 38.247 | 43.880 | 39.594 | 41.763 | 47.995 | 42.856 |
| OVARC1001983 | 103.819 | 85.974 | 83.133 | 104.971 | 53.259 | 65.630 | 60.001 | 74.940 |
| OVARC1001987 | 55.904 | 47.294 | 16.298 | 23.921 | 28.833 | 28.724 | 72.176 | 33.793 |
| OVARC1001989 | 126.786 | 123.408 | 98.472 | 101.800 | 109.717 | 72.479 | 80.807 | 76.628 |
| OVARC1001991 | 106.789 | 61.566 | 52.852 | 26.772 | 46.555 | 61.290 | 57.420 | 50.807 |
| OVARC1002005 | 43.909 | 50.446 | 52.235 | 34.217 | 36.792 | 22.115 | 37.361 | 38.275 |
| OVARC1002044 | 68.989 | 92.088 | 47.242 | 60.982 | 37.959 | 40.246 | 32.518 | 39.591 |
| OVARC1002046 | 142.697 | 103.646 | 61.978 | 48.709 | 50.959 | 89.078 | 107.957 | 65.922 |

TABLE 118-continued

| | | | | | | | | |
|---|---|---|---|---|---|---|---|---|
| OVARC1002050 | 150.418 | 79.832 | 52.259 | 30.717 | 50.113 | 74.307 | 95.763 | 52.005 |
| OVARC1002058 | 31.725 | 28.126 | 16.056 | 14.204 | 10.314 | 24.705 | 25.418 | 21.662 |
| OVARC1002066 | 22.845 | 30.065 | 5.783 | 10.572 | 14.029 | 17.339 | 17.127 | 29.452 |
| OVARC1002082 | 142.891 | 132.300 | 69.068 | 83.947 | 73.662 | 57.050 | 101.160 | 35.803 |
| OVARC1002091 | 49.223 | 46.691 | 28.357 | 26.618 | 29.431 | 30.906 | 42.116 | 35.122 |
| OVARC1002092 | 16.502 | 13.069 | 11.455 | 8.986 | 10.442 | 10.939 | 11.841 | 11.658 |
| OVARC1002093 | 206.510 | 229.583 | 94.978 | 52.679 | 65.398 | 105.804 | 108.886 | 66.303 |
| OVARC1002094 | 57.983 | 70.842 | 22.175 | 21.837 | 26.392 | 25.855 | 44.104 | 28.562 |
| OVARC1002107 | 81.163 | 81.383 | 51.719 | 88.540 | 57.860 | 40.826 | 46.289 | 44.621 |
| OVARC1002112 | 71.336 | 80.431 | 40.320 | 85.579 | 47.248 | 39.907 | 60.603 | 67.156 |
| OVARC1002126 | 114.239 | 87.851 | 47.175 | 35.010 | 40.692 | 63.760 | 106.294 | 65.520 |
| OVARC1002127 | 55.311 | 43.006 | 22.728 | 10.831 | 21.021 | 26.217 | 51.525 | 32.857 |
| OVARC1002138 | 8.951 | 13.827 | 3.935 | 7.856 | 8.359 | 7.853 | 10.350 | 10.188 |
| OVARC1002143 | 46.546 | 34.713 | 16.666 | 15.769 | 19.276 | 24.331 | 31.142 | 20.410 |
| OVARC1002156 | 12.544 | 23.040 | 10.035 | 15.363 | 8.291 | 12.374 | 13.614 | 15.810 |
| OVARC1002158 | 56.221 | 28.255 | 18.260 | 10.748 | 16.251 | 20.791 | 31.215 | 19.064 |
| OVARC1002165 | 101.989 | 143.172 | 84.011 | 82.086 | 75.946 | 58.837 | 85.203 | 75.063 |
| OVARC1002176 | 207.395 | 83.881 | 84.413 | 54.135 | 104.278 | 114.458 | 134.235 | 69.297 |
| OVARC1002178 | 17.313 | 27.443 | 12.750 | 10.705 | 15.530 | 12.936 | 23.362 | 17.872 |
| OVARC1002182 | 40.283 | 37.762 | 18.779 | 11.770 | 18.311 | 21.416 | 34.402 | 24.309 |
| OVARC1002185 | 36.278 | 33.563 | 17.925 | 17.394 | 20.095 | 28.241 | 45.498 | 31.989 |
| PLACE1000004 | 41.829 | 37.799 | 18.473 | 16.218 | 12.661 | 20.372 | 25.010 | 22.000 |
| PLACE1000005 | 33.315 | 36.712 | 26.079 | 24.859 | 17.404 | 25.038 | 28.162 | 24.028 |
| PLACE1000006 | 48.081 | 38.647 | 24.284 | 19.081 | 18.255 | 32.116 | 54.951 | 30.255 |
| PLACE1000007 | 24.221 | 25.983 | 17.339 | 11.998 | 16.921 | 17.706 | 46.581 | 21.338 |
| PLACE1000014 | 57.292 | 49.432 | 36.234 | 32.812 | 25.276 | 24.815 | 35.655 | 32.759 |
| PLACE1000031 | 42.309 | 61.878 | 50.107 | 46.094 | 37.373 | 29.757 | 38.437 | 47.194 |
| PLACE1000033 | 7.856 | 22.257 | 8.411 | 7.606 | 9.169 | 11.609 | 12.768 | 10.286 |
| PLACE1000040 | 36.717 | 30.479 | 20.358 | 21.457 | 23.948 | 12.296 | 22.459 | 20.099 |
| PLACE1000048 | 32.105 | 28.302 | 21.619 | 18.209 | 13.458 | 16.364 | 16.026 | 12.244 |
| PLACE1000050 | 33.955 | 41.358 | 21.915 | 18.172 | 15.208 | 24.691 | 30.515 | 22.038 |
| PLACE1000061 | 159.492 | 228.723 | 82.722 | 177.569 | 132.119 | 143.553 | 116.181 | 188.103 |
| PLACE1000066 | 59.266 | 55.710 | 42.829 | 38.851 | 46.700 | 47.171 | 50.185 | 56.938 |
| PLACE1000075 | 15.690 | 15.994 | 12.949 | 6.500 | 11.914 | 10.574 | 6.929 | 11.391 |
| PLACE1000078 | 46.952 | 57.637 | 52.225 | 42.480 | 22.126 | 28.527 | 38.463 | 41.033 |
| PLACE1000081 | 75.884 | 63.282 | 38.644 | 23.924 | 29.174 | 30.920 | 50.546 | 41.886 |
| PLACE1000086 | 85.184 | 67.162 | 52.586 | 27.421 | 38.070 | 64.488 | 55.431 | 42.640 |
| PLACE1000094 | 49.828 | 42.276 | 20.226 | 10.189 | 9.355 | 21.041 | 19.625 | 8.506 |
| PLACE1000101 | 10.188 | 23.449 | 16.699 | 19.362 | 17.073 | 11.091 | 13.623 | 19.675 |
| PLACE1000121 | 56.678 | 34.412 | 30.070 | 13.506 | 19.044 | 31.104 | 40.290 | 25.078 |
| PLACE1000133 | 39.057 | 29.915 | 23.128 | 29.843 | 20.718 | 24.672 | 26.803 | 39.107 |
| PLACE1000142 | 59.811 | 47.628 | 31.984 | 14.740 | 21.065 | 43.454 | 61.693 | 35.205 |
| PLACE1000146 | 68.834 | 62.270 | 34.321 | 47.131 | 27.243 | 17.729 | 39.001 | 47.833 |
| PLACE1000163 | 102.015 | 87.206 | 45.923 | 38.164 | 45.943 | 62.968 | 120.625 | 52.326 |
| PLACE1000172 | 9.508 | 23.847 | 6.470 | 9.595 | 10.491 | 12.594 | 4.745 | 20.625 |
| PLACE1000181 | 51.412 | 36.469 | 31.628 | 23.060 | 30.850 | 23.966 | 21.392 | 24.437 |
| PLACE1000184 | 16.961 | 3.226 | 6.684 | 2.195 | 8.764 | 24.786 | 5.246 | 4.794 |
| PLACE1000185 | 62.981 | 45.178 | 41.261 | 26.145 | 25.092 | 35.082 | 37.231 | 52.199 |
| PLACE1000198 | 34.090 | 28.795 | 19.770 | 10.196 | 14.083 | 15.181 | 22.504 | 21.227 |
| PLACE1000213 | 29.427 | 38.826 | 20.161 | 17.037 | 20.362 | 61.122 | 55.368 | 17.891 |
| PLACE1000214 | 8.728 | 14.768 | 9.733 | 11.456 | 12.426 | 6.184 | 8.011 | 2.408 |
| PLACE1000220 | 35.035 | 36.902 | 22.387 | 16.421 | 20.597 | 25.167 | 26.274 | 20.792 |
| PLACE1000231 | 348.135 | 182.545 | 114.755 | 86.687 | 95.201 | 164.292 | 106.589 | 98.294 |
| PLACE1000236 | 79.604 | 83.001 | 31.919 | 29.088 | 25.550 | 32.712 | 26.593 | 31.426 |
| PLACE1000245 | 86.867 | 78.966 | 48.398 | 55.441 | 30.699 | 45.854 | 59.148 | 58.356 |

TABLE 119

| | | | | | | | | |
|---|---|---|---|---|---|---|---|---|
| PLACE1000246 | 63.620 | 60.061 | 23.370 | 26.968 | 16.702 | 28.102 | 27.116 | 50.991 |
| PLACE1000258 | 107.386 | 86.542 | 60.892 | 92.906 | 67.210 | 62.207 | 74.824 | 84.168 |
| PLACE1000288 | 61.904 | 530.859 | 32.390 | 151.291 | 33.764 | 52.872 | 47.184 | 566.824 |
| PLACE1000292 | 134.374 | 107.978 | 64.652 | 76.783 | 64.315 | 53.082 | 46.786 | 54.840 |
| PLACE1000302 | 36.212 | 31.351 | 48.891 | 8.192 | 73.167 | 20.044 | 16.870 | 23.303 |
| PLACE1000304 | 77.695 | 50.861 | 24.615 | 19.705 | 21.314 | 32.791 | 44.370 | 34.969 |
| PLACE1000308 | 13.844 | 18.591 | 10.915 | 15.228 | 13.497 | 11.170 | 8.490 | 10.525 |
| PLACE1000309 | 171.086 | 79.282 | 53.477 | 30.661 | 44.221 | 99.582 | 89.605 | 51.438 |
| PLACE1000312 | 25.013 | 29.701 | 14.081 | 15.125 | 7.699 | 11.121 | 12.364 | 24.742 |
| PLACE1000330 | 29.657 | 13.102 | 12.306 | 10.127 | 9.659 | 16.951 | 19.395 | 12.431 |
| PLACE1000332 | 13.294 | 6.752 | 7.366 | 6.938 | 4.823 | 5.141 | 7.821 | 8.302 |
| PLACE1000347 | 46.531 | 37.378 | 19.406 | 17.234 | 19.477 | 19.786 | 29.460 | 24.427 |
| PLACE1000351 | 93.299 | 56.437 | 40.461 | 27.466 | 26.428 | 44.784 | 56.685 | 47.749 |
| PLACE1000374 | 89.871 | 66.668 | 53.557 | 66.616 | 45.909 | 45.689 | 49.979 | 76.296 |
| PLACE1000380 | 22.012 | 21.037 | 15.351 | 9.985 | 12.229 | 7.428 | 19.713 | 17.050 |
| PLACE1000383 | 29.005 | 24.752 | 16.349 | 15.183 | 11.959 | 16.827 | 29.293 | 19.713 |
| PLACE1000397 | 35.368 | 26.208 | 19.042 | 6.636 | 9.008 | 19.143 | 19.667 | 12.826 |
| PLACE1000401 | 121.012 | 77.115 | 91.986 | 73.017 | 85.204 | 77.208 | 97.740 | 89.014 |

TABLE 119-continued

| | | | | | | | | |
|---|---|---|---|---|---|---|---|---|
| PLACE1000406 | 43.944 | 37.883 | 20.305 | 20.530 | 17.412 | 26.601 | 31.601 | 28.177 |
| PLACE1000412 | 14.283 | 24.094 | 8.322 | 10.240 | 8.659 | 9.837 | 13.298 | 15.409 |
| PLACE1000420 | 95.364 | 99.949 | 57.598 | 50.129 | 39.257 | 39.215 | 34.611 | 48.196 |
| PLACE1000421 | 59.754 | 60.388 | 52.953 | 37.350 | 31.433 | 40.619 | 40.095 | 47.679 |
| PLACE1000423 | 49.130 | 51.837 | 22.800 | 9.952 | 21.218 | 55.558 | 49.895 | 90.332 |
| PLACE1000424 | 57.584 | 46.928 | 23.243 | 25.445 | 11.122 | 23.277 | 21.409 | 24.420 |
| PLACE1000430 | 9.008 | 14.497 | 9.324 | 6.648 | 12.506 | 3.176 | 4.529 | 9.751 |
| PLACE1000433 | 61.817 | 33.422 | 22.755 | 10.220 | 12.877 | 30.460 | 38.040 | 20.834 |
| PLACE1000435 | 58.251 | 49.033 | 24.534 | 33.925 | 25.131 | 18.878 | 26.453 | 33.894 |
| PLACE1000437 | 37.691 | 42.505 | 19.354 | 13.578 | 22.936 | 27.017 | 52.788 | 24.766 |
| PLACE1000442 | 28.959 | 53.891 | 36.443 | 45.883 | 36.218 | 29.092 | 28.915 | 59.563 |
| PLACE1000444 | 222.629 | 268.192 | 164.724 | 178.057 | 143.884 | 113.247 | 125.051 | 157.345 |
| PLACE1000453 | 60.912 | 56.717 | 45.737 | 28.913 | 34.374 | 46.491 | 47.877 | 46.094 |
| PLACE1000456 | 59.850 | 55.649 | 26.148 | 10.788 | 16.900 | 32.811 | 31.014 | 25.102 |
| PLACE1000465 | 63.781 | 32.184 | 28.609 | 22.813 | 15.851 | 25.834 | 76.172 | 29.680 |
| PLACE1000481 | 117.442 | 55.048 | 43.008 | 40.607 | 39.135 | 57.771 | 62.403 | 44.241 |
| PLACE1000492 | 85.199 | 42.804 | 28.200 | 13.820 | 16.493 | 35.818 | 62.470 | 37.299 |
| PLACE1000508 | 48.116 | 30.697 | 17.662 | 19.193 | 14.645 | 26.367 | 39.846 | 23.454 |
| PLACE1000512 | 23.066 | 37.331 | 52.438 | 15.899 | 43.633 | 17.392 | 16.605 | 25.441 |
| PLACE1000540 | 6.354 | 22.237 | 6.827 | 9.533 | 6.338 | 8.582 | 5.690 | 8.570 |
| PLACE1000541 | 139.592 | 95.891 | 62.856 | 44.350 | 48.779 | 102.808 | 118.737 | 83.454 |
| PLACE1000546 | 24.434 | 15.843 | 9.613 | 13.003 | 8.921 | 13.653 | 21.807 | 14.697 |
| PLACE1000547 | 138.587 | 72.254 | 64.656 | 57.672 | 49.694 | 71.928 | 84.849 | 56.997 |
| PLACE1000560 | 39.727 | 25.726 | 19.961 | 10.708 | 14.907 | 22.472 | 42.419 | 29.563 |
| PLACE1000562 | 74.380 | 77.139 | 35.608 | 44.686 | 31.444 | 29.868 | 26.773 | 50.026 |
| PLACE1000564 | 45.712 | 39.050 | 20.165 | 14.663 | 19.526 | 22.670 | 43.140 | 35.028 |
| PLACE1000583 | 122.345 | 132.820 | 73.526 | 90.516 | 75.343 | 62.557 | 52.925 | 95.075 |
| PLACE1000581 | 99.842 | 63.364 | 42.075 | 55.988 | 38.170 | 36.599 | 30.062 | 36.245 |
| PLACE1000588 | 86.166 | 135.917 | 34.894 | 41.374 | 26.506 | 42.479 | 60.642 | 72.805 |
| PLACE1000596 | 49.265 | 55.996 | 23.832 | 26.469 | 29.318 | 57.681 | 28.073 | 35.812 |
| PLACE1000599 | 79.259 | 72.325 | 37.975 | 49.064 | 36.704 | 32.501 | 40.446 | 38.539 |
| PLACE1000605 | 46.938 | 54.185 | 20.654 | 19.011 | 15.275 | 25.549 | 73.210 | 37.742 |
| PLACE1000610 | 45.555 | 31.108 | 16.017 | 11.318 | 13.984 | 22.493 | 36.775 | 27.839 |
| PLACE1000611 | 83.806 | 72.237 | 34.984 | 19.496 | 31.956 | 36.823 | 73.743 | 37.315 |
| PLACE1000626 | 25.444 | 20.294 | 26.796 | 13.307 | 42.252 | 20.623 | 23.163 | 24.644 |
| PLACE1000633 | 51.819 | 72.312 | 34.517 | 36.919 | 35.957 | 28.726 | 32.601 | 40.217 |
| PLACE1000636 | 19.979 | 28.179 | 10.228 | 15.590 | 13.380 | 12.707 | 24.141 | 13.996 |
| PLACE1000653 | 19.174 | 29.714 | 9.902 | 11.497 | 12.647 | 8.885 | 20.791 | 11.318 |
| PLACE1000656 | 207.889 | 68.319 | 57.763 | 33.548 | 59.611 | 78.748 | 110.176 | 49.086 |
| PLACE1000663 | 27.908 | 22.175 | 79.442 | 9.906 | 106.232 | 14.462 | 23.389 | 15.120 |
| PLACE1000706 | 283.571 | 94.948 | 65.754 | 40.790 | 70.486 | 112.748 | 210.569 | 73.830 |
| PLACE1000712 | 61.631 | 49.744 | 23.617 | 15.665 | 21.178 | 14.931 | 57.877 | 39.148 |
| PLACE1000716 | 26.011 | 26.336 | 15.816 | 9.969 | 11.091 | 19.128 | 22.664 | 15.949 |
| PLACE1000740 | 34.490 | 32.481 | 19.323 | 13.899 | 13.528 | 23.824 | 29.403 | 19.851 |
| PLACE1000748 | 8.182 | 18.702 | 8.763 | 10.496 | 2.952 | 8.739 | 11.227 | 11.219 |
| PLACE1000749 | 246.155 | 158.647 | 101.055 | 70.317 | 70.301 | 173.879 | 198.491 | 125.375 |

TABLE 120

| | | | | | | | | |
|---|---|---|---|---|---|---|---|---|
| PLACE1000751 | 8.591 | 28.632 | 6.888 | 6.628 | 8.859 | 7.678 | 7.926 | 11.115 |
| PLACE1000755 | 22.080 | 22.789 | 11.946 | 14.166 | 9.125 | 11.761 | 20.466 | 14.904 |
| PLACE1000769 | 16.024 | 19.119 | 15.504 | 12.207 | 5.547 | 12.731 | 21.034 | 18.074 |
| PLACE1000778 | 109.940 | 168.867 | 46.116 | 36.217 | 54.573 | 33.450 | 40.021 | 61.410 |
| PLACE1000785 | 54.501 | 35.590 | 19.231 | 21.344 | 11.939 | 17.233 | 19.818 | 30.628 |
| PLACE1000786 | 63.401 | 34.818 | 26.260 | 25.783 | 21.236 | 33.236 | 29.738 | 24.419 |
| PLACE1000793 | 48.092 | 49.470 | 31.204 | 14.276 | 17.894 | 36.450 | 38.082 | 31.337 |
| PLACE1000795 | 38.178 | 43.688 | 29.889 | 21.674 | 10.765 | 21.955 | 41.921 | 41.550 |
| PLACE1000798 | 31.236 | 40.770 | 22.606 | 25.191 | 17.921 | 17.856 | 21.782 | 21.758 |
| PLACE1000812 | 24.169 | 23.549 | 17.121 | 14.965 | 8.140 | 11.726 | 13.094 | 25.608 |
| PLACE1000823 | 81.457 | 18.801 | 40.416 | 88.702 | 37.795 | 36.623 | 32.882 | 44.655 |
| PLACE1000825 | 72.220 | 107.715 | 51.491 | 134.346 | 31.956 | 47.353 | 61.449 | 155.007 |
| PLACE1000838 | 44.642 | 81.659 | 25.304 | 15.146 | 16.808 | 62.951 | 59.936 | 33.016 |
| PLACE1000841 | 19.731 | 9.168 | 3.325 | 14.206 | 7.817 | 19.073 | 12.783 | 10.985 |
| PLACE1000843 | 23.326 | 27.970 | 19.816 | 10.746 | 10.401 | 15.372 | 21.004 | 17.198 |
| PLACE1000849 | 171.333 | 62.539 | 65.353 | 38.857 | 44.284 | 93.732 | 118.022 | 61.526 |
| PLACE1000856 | 36.302 | 20.267 | 19.938 | 11.857 | 16.559 | 18.275 | 24.314 | 14.524 |
| PLACE1000863 | 61.947 | 24.729 | 17.318 | 10.548 | 32.356 | 45.071 | 40.695 | 26.491 |
| PLACE1000876 | 79.589 | 41.303 | 31.803 | 21.682 | 30.566 | 41.161 | 58.457 | 35.801 |
| PLACE1000899 | 36.028 | 54.514 | 19.200 | 14.563 | 23.816 | 17.191 | 23.052 | 18.916 |
| PLACE1000907 | 34.468 | 58.737 | 45.762 | 53.355 | 33.953 | 45.831 | 23.987 | 112.516 |
| PLACE1000909 | 17.260 | 18.289 | 7.853 | 7.770 | 4.100 | 9.541 | 11.860 | 5.411 |
| PLACE1000912 | 72.300 | 41.738 | 29.873 | 18.579 | 21.304 | 47.829 | 47.423 | 31.816 |
| PLACE1000914 | 34.274 | 20.778 | 16.170 | 8.631 | 12.137 | 13.771 | 20.247 | 22.212 |
| PLACE1000918 | 6.646 | 24.953 | 6.298 | 21.039 | 6.076 | 8.001 | 14.538 | 7.614 |
| PLACE1000927 | 28.004 | 62.278 | 11.519 | 25.240 | 15.288 | 27.303 | 24.639 | 36.302 |
| PLACE1000931 | 60.013 | 70.374 | 41.114 | 48.090 | 31.983 | 37.593 | 35.750 | 38.045 |

TABLE 120-continued

| | | | | | | | | |
|---|---|---|---|---|---|---|---|---|
| PLACE1000944 | 15.469 | 20.100 | 11.329 | 9.563 | 11.301 | 10.496 | 10.907 | 13.479 |
| PLACE1000948 | 32.119 | 174.384 | 19.147 | 11.561 | 8.864 | 13.716 | 16.344 | 23.012 |
| PLACE1000958 | 24.559 | 28.912 | 20.683 | 12.101 | 15.980 | 17.758 | 18.551 | 16.227 |
| PLACE1000972 | 120.934 | 92.640 | 56.098 | 49.344 | 42.043 | 64.933 | 66.648 | 83.486 |
| PLACE1000977 | 5.160 | 23.071 | 5.930 | 7.450 | 7.265 | 6.795 | 7.348 | 13.664 |
| PLACE1000979 | 36.518 | 36.872 | 31.314 | 43.863 | 34.967 | 34.693 | 38.011 | 58.543 |
| PLACE1000986 | 39.462 | 32.248 | 17.759 | 9.962 | 10.922 | 17.210 | 20.134 | 11.670 |
| PLACE1000987 | 85.543 | 56.030 | 33.710 | 26.097 | 53.247 | 35.833 | 43.907 | 42.264 |
| PLACE1001000 | 15.969 | 18.182 | 11.199 | 15.991 | 10.697 | 10.336 | 15.117 | 15.657 |
| PLACE1001007 | 41.857 | 48.683 | 23.082 | 21.556 | 18.037 | 24.959 | 24.887 | 38.857 |
| PLACE1001010 | 29.468 | 27.943 | 26.350 | 21.964 | 14.359 | 16.726 | 17.763 | 18.489 |
| PLACE1001015 | 20.540 | 30.643 | 16.387 | 20.211 | 7.569 | 13.946 | 8.904 | 23.581 |
| PLACE1001016 | 77.787 | 62.441 | 29.862 | 30.282 | 22.094 | 36.963 | 57.898 | 62.858 |
| PLACE1001022 | 33.101 | 30.827 | 19.383 | 11.100 | 14.872 | 22.156 | 23.755 | 20.499 |
| PLACE1001024 | 86.274 | 27.421 | 25.662 | 12.087 | 19.171 | 38.266 | 41.922 | 20.735 |
| PLACE1001036 | 80.642 | 165.022 | 64.983 | 46.681 | 67.747 | 121.474 | 402.289 | 252.956 |
| PLACE1001038 | 452.345 | 139.825 | 89.101 | 67.372 | 64.392 | 122.656 | 119.479 | 107.665 |
| PLACE1001048 | 49.948 | 49.581 | 16.660 | 14.592 | 10.687 | 24.644 | 36.889 | 36.435 |
| PLACE1001054 | 134.306 | 67.365 | 61.474 | 36.835 | 33.520 | 69.944 | 111.570 | 67.974 |
| PLACE1001062 | 74.158 | 68.783 | 52.589 | 64.589 | 49.941 | 41.816 | 51.497 | 54.685 |
| PLACE1001063 | 10.880 | 13.653 | 8.862 | 9.859 | 6.427 | 6.510 | 8.010 | 9.447 |
| PLACE1001076 | 14.575 | 15.670 | 12.223 | 5.950 | 12.881 | 9.910 | 15.204 | 12.067 |
| PLACE1001081 | 12.530 | 13.285 | 8.314 | 5.016 | 4.852 | 19.472 | 31.441 | 10.426 |
| PLACE1001088 | 25.759 | 16.332 | 10.811 | 9.362 | 11.626 | 15.207 | 22.359 | 14.210 |
| PLACE1001092 | 15.938 | 44.121 | 18.940 | 15.854 | 15.358 | 18.646 | 27.718 | 25.006 |
| PLACE1001098 | 51.863 | 74.664 | 44.477 | 36.802 | 35.002 | 36.534 | 40.789 | 44.072 |
| PLACE1001100 | 69.984 | 61.458 | 42.513 | 37.432 | 21.199 | 38.215 | 39.752 | 36.621 |
| PLACE1001104 | 37.879 | 43.589 | 22.459 | 19.257 | 15.200 | 22.158 | 23.976 | 24.947 |
| PLACE1001114 | 50.995 | 43.129 | 28.583 | 41.340 | 23.689 | 22.370 | 24.583 | 26.608 |
| PLACE1001118 | 55.858 | 39.536 | 30.416 | 29.284 | 13.566 | 35.583 | 35.042 | 61.564 |
| PLACE1001123 | 30.236 | 32.692 | 12.932 | 16.066 | 9.901 | 19.213 | 20.910 | 28.778 |
| PLACE1001136 | 127.205 | 106.279 | 47.874 | 46.520 | 45.126 | 54.639 | 67.043 | 60.071 |
| PLACE1001144 | 59.577 | 74.773 | 33.377 | 21.823 | 38.443 | 32.412 | 40.190 | 39.315 |
| PLACE1001147 | 59.813 | 42.869 | 21.085 | 20.092 | 30.181 | 39.398 | 45.339 | 34.463 |
| PLACE1001148 | 37.059 | 29.368 | 18.220 | 13.240 | 14.014 | 19.609 | 42.976 | 28.919 |
| PLACE1001159 | 23.780 | 18.761 | 10.274 | 9.929 | 12.302 | 17.285 | 19.282 | 17.753 |
| PLACE1001168 | 26.768 | 24.323 | 12.289 | 8.468 | 8.558 | 14.711 | 22.168 | 20.921 |

TABLE 121

| | | | | | | | | |
|---|---|---|---|---|---|---|---|---|
| PLACE1001171 | 37.609 | 26.312 | 19.416 | 9.788 | 11.645 | 20.994 | 34.674 | 26.387 |
| PLACE1001183 | 48.472 | 34.255 | 16.988 | 12.402 | 13.998 | 24.043 | 41.590 | 34.738 |
| PLACE1001185 | 98.156 | 72.026 | 33.520 | 17.455 | 34.874 | 41.246 | 78.451 | 45.433 |
| PLACE1001201 | 20.710 | 28.202 | 14.832 | 19.137 | 16.156 | 11.504 | 21.093 | 18.878 |
| PLACE1001229 | 33.202 | 50.727 | 25.432 | 24.039 | 19.810 | 29.842 | 30.368 | 33.000 |
| PLACE1001231 | 28.893 | 32.022 | 21.470 | 16.244 | 15.489 | 23.482 | 30.611 | 22.184 |
| PLACE1001238 | 67.072 | 60.114 | 37.423 | 43.278 | 30.120 | 34.706 | 41.011 | 38.313 |
| PLACE1001241 | 21.610 | 25.407 | 7.984 | 17.578 | 8.443 | 14.781 | 31.035 | 14.575 |
| PLACE1001242 | 45.592 | 69.441 | 28.266 | 26.878 | 24.774 | 29.386 | 68.093 | 55.636 |
| PLACE1001247 | 14.525 | 18.387 | 7.186 | 6.906 | 8.128 | 9.488 | 6.808 | 15.989 |
| PLACE1001250 | 49.114 | 30.049 | 15.521 | 12.388 | 20.092 | 23.448 | 40.190 | 18.900 |
| PLACE1001257 | 62.294 | 83.027 | 38.705 | 44.550 | 45.672 | 38.236 | 37.267 | 51.354 |
| PLACE1001272 | 63.255 | 35.776 | 22.716 | 18.567 | 23.479 | 28.934 | 54.496 | 33.742 |
| PLACE1001279 | 20.477 | 21.478 | 8.935 | 8.448 | 12.817 | 12.013 | 16.223 | 11.151 |
| PLACE1001280 | 68.512 | 56.354 | 46.699 | 32.609 | 50.557 | 37.478 | 30.514 | 34.496 |
| PLACE1001294 | 16.622 | 36.699 | 12.414 | 23.498 | 22.103 | 14.441 | 14.208 | 23.363 |
| PLACE1001295 | 158.866 | 63.791 | 43.310 | 26.850 | 56.659 | 72.706 | 110.093 | 39.852 |
| PLACE1001300 | 64.491 | 33.466 | 14.714 | 9.167 | 18.136 | 13.210 | 28.528 | 23.798 |
| PLACE1001304 | 70.999 | 60.035 | 54.352 | 72.569 | 49.765 | 40.745 | 55.843 | 97.914 |
| PLACE1001311 | 77.711 | 67.514 | 37.479 | 36.657 | 50.824 | 35.191 | 38.273 | 47.028 |
| PLACE1001323 | 85.671 | 92.960 | 47.002 | 40.309 | 44.877 | 41.038 | 46.429 | 45.578 |
| PLACE1001325 | 63.854 | 83.048 | 40.238 | 34.763 | 38.177 | 31.146 | 36.745 | 54.898 |
| PLACE1001340 | 50.316 | 43.105 | 32.357 | 18.188 | 41.779 | 27.080 | 44.703 | 34.275 |
| PLACE1001344 | 21.096 | 20.141 | 12.901 | 11.211 | 11.242 | 13.229 | 17.699 | 15.374 |
| PLACE1001351 | 21.665 | 30.334 | 17.172 | 16.561 | 21.087 | 13.674 | 23.521 | 25.699 |
| PLACE1001366 | 51.121 | 41.493 | 20.763 | 22.794 | 22.644 | 20.945 | 39.950 | 30.512 |
| PLACE1001377 | 17.643 | 7.950 | 8.199 | 6.636 | 10.878 | 8.266 | 14.816 | 8.211 |
| PLACE1001383 | 19.371 | 31.320 | 12.152 | 16.238 | 10.327 | 18.369 | 19.779 | 20.881 |
| PLACE1001384 | 12.523 | 28.763 | 17.012 | 8.145 | 10.197 | 11.093 | 21.749 | 13.042 |
| PLACE1001387 | 74.695 | 38.816 | 24.690 | 18.993 | 17.630 | 44.878 | 42.628 | 24.984 |
| PLACE1001395 | 16.685 | 20.986 | 21.294 | 11.232 | 11.885 | 13.388 | 11.627 | 17.398 |
| PLACE1001399 | 226.500 | 168.857 | 120.411 | 105.668 | 74.590 | 106.559 | 109.855 | 113.693 |
| PLACE1001401 | 7.198 | 22.276 | 6.559 | 8.709 | 5.336 | 6.428 | 17.374 | 13.590 |
| PLACE1001407 | 36.871 | 35.435 | 20.290 | 26.813 | 14.205 | 17.551 | 44.441 | 18.269 |
| PLACE1001412 | 37.695 | 27.537 | 14.076 | 15.165 | 12.728 | 15.789 | 38.368 | 22.732 |
| PLACE1001414 | 217.145 | 130.533 | 105.385 | 81.994 | 74.062 | 115.387 | 103.177 | 72.729 |

TABLE 121-continued

| | | | | | | | | |
|---|---|---|---|---|---|---|---|---|
| PLACE1001416 | 35.223 | 39.103 | 34.029 | 25.498 | 14.222 | 24.743 | 21.597 | 25.005 |
| PLACE1001433 | 145.429 | 164.813 | 104.366 | 153.159 | 55.364 | 82.221 | 118.995 | 143.644 |
| PLACE1001440 | 58.228 | 39.255 | 26.807 | 18.655 | 18.643 | 29.783 | 43.995 | 27.882 |
| PLACE1001456 | 45.774 | 64.005 | 62.545 | 47.264 | 46.872 | 43.771 | 53.047 | 50.036 |
| PLACE1001464 | 14.904 | 12.569 | 12.016 | 7.606 | 7.643 | 10.634 | 21.002 | 14.923 |
| PLACE1001468 | 12.628 | 13.185 | 11.183 | 8.049 | 10.407 | 10.393 | 17.688 | 12.134 |
| PLACE1001484 | 111.986 | 88.704 | 61.951 | 103.045 | 57.131 | 47.838 | 72.549 | 64.633 |
| PLACE1001500 | 112.534 | 66.487 | 40.149 | 29.195 | 31.131 | 66.175 | 52.403 | 47.197 |
| PLACE1001502 | 111.530 | 51.123 | 42.187 | 21.773 | 27.041 | 52.42 | 55.175 | 32.016 |
| PLACE1001503 | 104.144 | 79.570 | 47.845 | 42.970 | 37.990 | 50.672 | 57.729 | 52.788 |
| PLACE1001505 | 20.479 | 27.535 | 13.492 | 15.526 | 12.841 | 22.000 | 19.770 | 21.944 |
| PLACE1001513 | 30.859 | 24.448 | 21.001 | 14.991 | 10.141 | 18.450 | 24.882 | 26.311 |
| PLACE1001516 | 133.217 | 89.711 | 99.042 | 58.879 | 78.064 | 73.719 | 71.012 | 63.994 |
| PLACE1001517 | 69.164 | 42.110 | 28.024 | 23.097 | 19.564 | 24.584 | 39.431 | 31.706 |
| PLACE1001523 | 44.322 | 26.222 | 15.440 | 33.292 | 16.685 | 26.064 | 28.195 | 35.152 |
| PLACE1001526 | 12.214 | 48.804 | 32.938 | 18.497 | 27.271 | 29.631 | 19.107 | 33.278 |
| PLACE1001534 | 14.278 | 14.916 | 17.792 | 13.675 | 17.033 | 22.739 | 18.831 | 18.893 |
| PLACE1001536 | 25.937 | 21.827 | 14.716 | 13.316 | 8.319 | 14.594 | 19.891 | 10.823 |
| PLACE1001545 | 81.173 | 118.411 | 60.729 | 57.604 | 60.102 | 55.719 | 62.273 | 73.495 |
| PLACE1001551 | 29.258 | 24.058 | 15.777 | 17.582 | 14.381 | 14.773 | 23.849 | 25.399 |
| PLACE1001564 | 12.683 | 21.942 | 10.266 | 7.274 | 6.981 | 12.704 | 27.781 | 11.258 |
| PLACE1001570 | 10.554 | 41.593 | 5.601 | 19.923 | 9.421 | 18.406 | 16.691 | 18.288 |
| PLACE1001571 | 127.122 | 86.608 | 38.342 | 58.413 | 34.598 | 53.965 | 49.662 | 34.301 |
| PLACE1001595 | 116.778 | 213.788 | 32.313 | 32.498 | 34.618 | 50.204 | 34.174 | 37.047 |
| PLACE1001602 | 23.415 | 17.913 | 9.921 | 11.848 | 9.736 | 11.310 | 8.437 | 13.830 |
| PLACE1001603 | 49.559 | 59.889 | 39.368 | 29.795 | 29.035 | 28.595 | 39.306 | 37.052 |
| PLACE1001608 | 26.740 | 49.685 | 21.856 | 26.287 | 32.997 | 19.418 | 12.572 | 39.795 |
| PLACE1001610 | 103.785 | 116.714 | 78.094 | 80.451 | 74.242 | 57.490 | 65.946 | 70.900 |

TABLE 122

| | | | | | | | | |
|---|---|---|---|---|---|---|---|---|
| PLACE1001611 | 58.972 | 40.610 | 21.168 | 17.897 | 20.458 | 26.980 | 37.282 | 29.415 |
| PLACE1001629 | 23.692 | 21.349 | 10.779 | 11.703 | 9.654 | 17.389 | 16.943 | 17.712 |
| PLACE1001632 | 56.162 | 39.917 | 28.058 | 32.960 | 30.608 | 36.189 | 37.819 | 50.929 |
| PLACE1001634 | 18.018 | 22.871 | 12.492 | 5.629 | 10.744 | 11.917 | 13.604 | 13.552 |
| PLACE1001637 | 61.890 | 34.286 | 23.149 | 18.271 | 16.901 | 31.188 | 43.749 | 17.679 |
| PLACE1001640 | 80.631 | 63.007 | 32.766 | 49.291 | 29.961 | 30.898 | 32.648 | 42.726 |
| PLACE1001655 | 29.386 | 40.949 | 10.818 | 14.407 | 12.505 | 8.704 | 14.876 | 16.268 |
| PLACE1001672 | 34.615 | 40.370 | 24.145 | 16.896 | 19.193 | 20.408 | 30.495 | 28.727 |
| PLACE1001676 | 10.323 | 5.349 | 4.889 | 7.928 | 5.142 | 5.752 | 4.884 | 4.020 |
| PLACE1001683 | 99.245 | 101.853 | 51.020 | 46.928 | 31.257 | 45.917 | 57.578 | 71.255 |
| PLACE1001691 | 55.061 | 48.826 | 32.495 | 70.656 | 37.287 | 27.851 | 24.285 | 45.922 |
| PLACE1001692 | 50.688 | 45.778 | 29.336 | 31.751 | 20.230 | 23.603 | 23.387 | 30.475 |
| PLACE1001705 | 54.991 | 45.920 | 32.949 | 30.739 | 23.884 | 24.736 | 21.290 | 26.568 |
| PLACE1001716 | 19.961 | 39.584 | 17.983 | 14.122 | 11.592 | 15.645 | 26.052 | 30.073 |
| PLACE1001720 | 45.804 | 36.576 | 23.337 | 13.159 | 14.367 | 26.395 | 38.216 | 23.892 |
| PLACE1001728 | 25.294 | 12.023 | 10.018 | 4.500 | 6.969 | 13.369 | 17.313 | 10.651 |
| PLACE1001729 | 54.474 | 30.538 | 23.378 | 14.206 | 12.538 | 34.543 | 36.119 | 24.025 |
| PLACE1001739 | 72.181 | 46.505 | 32.326 | 17.618 | 26.461 | 46.354 | 57.211 | 33.755 |
| PLACE1001740 | 44.321 | 37.300 | 20.706 | 23.395 | 18.627 | 20.277 | 22.849 | 29.188 |
| PLACE1001745 | 88.492 | 59.243 | 42.077 | 24.655 | 33.811 | 52.589 | 78.154 | 41.999 |
| PLACE1001746 | 34.637 | 42.251 | 39.371 | 25.196 | 29.098 | 20.925 | 24.039 | 30.103 |
| PLACE1001748 | 68.976 | 42.569 | 32.885 | 20.301 | 21.057 | 36.582 | 50.459 | 30.910 |
| PLACE1001753 | 49.985 | 45.870 | 23.560 | 22.075 | 3.690 | 25.936 | 41.529 | 38.920 |
| PLACE1001756 | 58.884 | 78.676 | 32.148 | 72.106 | 23.706 | 32.912 | 52.816 | 82.360 |
| PLACE1001761 | 80.396 | 70.047 | 114.350 | 98.694 | 126.278 | 53.735 | 66.182 | 112.998 |
| PLACE1001767 | 101.474 | 95.179 | 45.516 | 33.144 | 52.766 | 54.932 | 101.273 | 76.611 |
| PLACE1001771 | 19.712 | 26.759 | 20.057 | 12.622 | 18.385 | 16.780 | 19.880 | 23.194 |
| PLACE1001175 | 4.588 | 40.521 | 8.311 | 6.556 | 7.390 | 9.035 | 9.683 | 17.408 |
| PLACE1001777 | 61.261 | 31.312 | 29.820 | 13.022 | 17.840 | 32.541 | 34.897 | 21.794 |
| PLACE1001781 | 16.525 | 17.889 | 7.311 | 9.028 | 3.652 | 9.892 | 13.994 | 12.461 |
| PLACE1001783 | 82.003 | 24.962 | 30.707 | 19.043 | 16.757 | 38.137 | 43.807 | 19.485 |
| PLACE1001786 | 24.406 | 20.572 | 9.992 | 12.368 | 9.648 | 12.063 | 27.946 | 22.791 |
| PLACE1001788 | 39.981 | 29.419 | 23.164 | 10.091 | 15.084 | 30.627 | 38.055 | 36.556 |
| PLACE1001795 | 36.820 | 39.616 | 20.098 | 14.057 | 16.433 | 21.056 | 32.809 | 26.943 |
| PLACE1001799 | 128.712 | 38.515 | 26.836 | 13.466 | 28.718 | 51.074 | 76.434 | 36.462 |
| PLACE1001810 | 14.418 | 17.039 | 10.361 | 10.109 | 9.092 | 9.695 | 10.813 | 10.585 |
| PLACE1001817 | 30.913 | 22.601 | 33.584 | 11.211 | 34.814 | 38.481 | 19.140 | 20.248 |
| PLACE1001821 | 44.377 | 41.515 | 23.006 | 22.091 | 25.640 | 19.095 | 24.750 | 27.083 |
| PLACE1001836 | 51.521 | 27.558 | 20.807 | 7.935 | 23.084 | 27.957 | 36.704 | 21.625 |
| PLACE1001844 | 29.459 | 29.744 | 21.870 | 21.220 | 18.464 | 14.961 | 23.954 | 18.459 |
| PLACE1001845 | 33.946 | 36.421 | 18.233 | 14.133 | 19.354 | 20.298 | 32.062 | 33.894 |
| PLACE1001858 | 36.762 | 28.558 | 15.393 | 27.399 | 23.094 | 20.179 | 32.496 | 27.946 |
| PLACE1001869 | 41.811 | 29.631 | 16.671 | 13.297 | 14.417 | 29.644 | 49.283 | 21.491 |
| PLACE1001890 | 21.015 | 19.216 | 7.813 | 9.785 | 8.947 | 7.055 | 22.588 | 20.287 |
| PLACE1001897 | 41.587 | 43.503 | 18.203 | 17.788 | 18.625 | 34.484 | 37.521 | 38.175 |

TABLE 122-continued

| | | | | | | | | |
|---|---|---|---|---|---|---|---|---|
| PLACE1001902 | 33.879 | 86.444 | 26.521 | 77.375 | 23.800 | 40.850 | 29.474 | 82.496 |
| PLACE1001904 | 42.359 | 28.323 | 18.415 | 13.316 | 15.185 | 24.027 | 48.664 | 25.843 |
| PLACE1001907 | 99.999 | 94.157 | 52.221 | 54.031 | 60.482 | 55.231 | 87.790 | 65.770 |
| PLACE1001910 | 76.138 | 126.370 | 33.663 | 25.331 | 33.103 | 39.045 | 66.245 | 37.978 |
| PLACE1001912 | 72.652 | 96.989 | 43.604 | 44.098 | 51.566 | 44.297 | 53.061 | 61.896 |
| PLACE1001918 | 59.029 | 60.982 | 33.789 | 30.466 | 29.328 | 46.949 | 78.822 | 51.365 |
| PLACE1001920 | 9.437 | 24.354 | 8.429 | 22.027 | 10.009 | 15.594 | 8.844 | 29.435 |
| PLACE1001928 | 20.462 | 35.914 | 14.995 | 17.670 | 10.114 | 16.420 | 22.437 | 22.775 |
| PLACE1001930 | 16.268 | 28.124 | 18.470 | 13.279 | 15.554 | 13.919 | 22.090 | 19.274 |
| PLACE1001949 | 23.830 | 22.587 | 13.269 | 10.049 | 11.377 | 14.909 | 26.537 | 9.643 |
| PLACE1001959 | 40.952 | 30.344 | 15.913 | 13.328 | 24.661 | 21.015 | 37.170 | 18.763 |
| PLACE1001969 | 12.458 | 20.205 | 14.372 | 15.468 | 10.543 | 9.561 | 13.870 | 16.621 |
| PLACE1001974 | 21.533 | 45.767 | 37.839 | 18.194 | 36.382 | 18.154 | 19.101 | 21.180 |
| PLACE1001981 | 37.122 | 27.300 | 20.961 | 8.701 | 16.875 | 15.523 | 25.093 | 21.729 |
| PLACE1001983 | 84.898 | 45.469 | 30.920 | 16.864 | 17.046 | 41.287 | 52.042 | 28.458 |
| PLACE1001989 | 47.501 | 59.400 | 30.952 | 30.644 | 23.359 | 33.328 | 33.521 | 32.148 |
| PLACE1002004 | 96.924 | 138.468 | 70.255 | 74.069 | 44.965 | 61.641 | 60.598 | 60.144 |
| PLACE1002008 | 67.655 | 101.031 | 63.838 | 57.207 | 53.740 | 50.343 | 63.192 | 74.655 |
| PLACE1002015 | 48.810 | 48.095 | 25.042 | 26.422 | 28.835 | 36.724 | 35.174 | 29.389 |

TABLE 123

| | | | | | | | | |
|---|---|---|---|---|---|---|---|---|
| PLACE1002044 | 15.432 | 19.617 | 12.298 | 7.674 | 10.740 | 14.882 | 16.986 | 23.255 |
| PLACE1002046 | 35.129 | 24.586 | 16.894 | 16.958 | 15.796 | 25.488 | 45.998 | 25.557 |
| PLACE1002052 | 13.131 | 11.184 | 10.040 | 6.082 | 7.542 | 10.153 | 10.668 | 10.355 |
| PLACE1002066 | 77.695 | 109.726 | 92.490 | 79.876 | 58.443 | 57.230 | 64.889 | 69.207 |
| PLACE1002072 | 97.971 | 90.711 | 48.605 | 48.732 | 39.945 | 44.244 | 40.362 | 47.906 |
| PLACE1002073 | 48.101 | 39.394 | 30.681 | 27.085 | 15.219 | 30.451 | 35.202 | 22.863 |
| PLACE1002080 | 147.011 | 90.983 | 77.089 | 67.438 | 53.419 | 83.047 | 71.583 | 70.087 |
| PLACE1002081 | 6.752 | 13.958 | 11.761 | 8.303 | 6.211 | 11.142 | 11.382 | 8.460 |
| PLACE1002090 | 19.854 | 27.734 | 20.058 | 14.085 | 36.381 | 18.780 | 21.857 | 42.680 |
| PLACE1002095 | 60.336 | 45.829 | 29.642 | 33.247 | 26.663 | 24.615 | 34.539 | 41.411 |
| PLACE1002102 | 164.050 | 58.094 | 40.254 | 32.448 | 30.279 | 73.576 | 158.991 | 75.372 |
| PLACE1002109 | 45.221 | 57.996 | 53.572 | 43.855 | 38.839 | 41.641 | 47.534 | 53.651 |
| PLACE1002115 | 9.512 | 11.954 | 8.778 | 7.248 | 4.013 | 7.023 | 5.912 | 6.295 |
| PLACE1002119 | 36.430 | 58.455 | 53.047 | 27.115 | 43.709 | 26.254 | 23.542 | 33.029 |
| PLACE1002140 | 48.179 | 44.018 | 31.256 | 17.883 | 20.743 | 30.803 | 35.802 | 31.498 |
| PLACE1002150 | 14.549 | 14.324 | 13.952 | 8.635 | 12.089 | 7.434 | 7.940 | 13.111 |
| PLACE1002153 | 99.975 | 52.998 | 35.156 | 18.899 | 19.864 | 38.034 | 40.428 | 32.754 |
| PLACE1002157 | 55.938 | 35.819 | 25.050 | 31.682 | 30.081 | 23.109 | 34.931 | 28.217 |
| PLACE1002163 | 57.219 | 47.664 | 19.449 | 22.757 | 26.545 | 33.066 | 43.744 | 29.963 |
| PLACE1002168 | 30.977 | 46.777 | 30.115 | 44.322 | 21.088 | 30.717 | 33.746 | 25.283 |
| PLACE1002170 | 68.838 | 22.754 | 23.239 | 11.296 | 13.008 | 21.765 | 31.640 | 17.540 |
| PLACE1002171 | 23.819 | 23.126 | 16.254 | 25.334 | 9.191 | 13.358 | 14.604 | 12.880 |
| PLACE1002180 | 18.621 | 18.513 | 11.924 | 11.799 | 15.091 | 9.384 | 14.450 | 16.442 |
| PLACE1002184 | 11.237 | 16.438 | 6.314 | 6.973 | 5.890 | 7.372 | 15.552 | 5.123 |
| PLACE1002200 | 41.279 | 32.645 | 19.848 | 12.160 | 14.612 | 26.495 | 24.978 | 18.652 |
| PLACE1002205 | 8.060 | 8.833 | 8.840 | 5.678 | 9.502 | 7.453 | 5.919 | 5.027 |
| PLACE1002213 | 132.823 | 94.631 | 54.268 | 62.752 | 37.757 | 66.436 | 72.589 | 61.367 |
| PLACE1002219 | 28.945 | 25.808 | 12.888 | 18.583 | 11.494 | 15.981 | 15.553 | 12.757 |
| PLACE1002227 | 82.051 | 55.700 | 42.058 | 32.436 | 34.199 | 39.449 | 33.444 | 40.762 |
| PLACE1002253 | 58.857 | 21.589 | 23.552 | 8.315 | 9.457 | 21.335 | 22.438 | 14.348 |
| PLACE1002256 | 11.668 | 27.097 | 12.608 | 15.320 | 10.327 | 9.326 | 7.247 | 18.657 |
| PLACE1002259 | 12.944 | 16.713 | 14.115 | 16.119 | 13.177 | 10.814 | 8.343 | 7.436 |
| PLACE1002285 | 12.935 | 14.107 | 10.661 | 5.670 | 8.397 | 8.906 | 13.661 | 8.898 |
| PLACE1002301 | 40.882 | 61.873 | 38.880 | 19.138 | 39.970 | 34.344 | 28.064 | 32.685 |
| PLACE1002310 | 16.971 | 21.006 | 23.836 | 10.651 | 24.965 | 17.853 | 17.328 | 20.350 |
| PLACE1002311 | 32.060 | 30.946 | 17.177 | 14.219 | 10.905 | 20.580 | 20.767 | 19.139 |
| PLACE1002319 | 21.289 | 17.105 | 17.384 | 12.607 | 9.953 | 15.052 | 12.933 | 13.930 |
| PLACE1002329 | 41.607 | 28.970 | 16.757 | 13.513 | 9.723 | 19.282 | 28.768 | 18.428 |
| PLACE1002333 | 10.233 | 17.705 | 5.802 | 5.259 | 5.108 | 7.829 | 11.050 | 8.546 |
| PLACE1002342 | 48.414 | 46.073 | 26.203 | 18.031 | 31.808 | 29.119 | 31.805 | 35.900 |
| PLACE1002343 | 38.774 | 31.024 | 21.839 | 9.918 | 13.209 | 21.177 | 28.826 | 23.746 |
| PLACE1002355 | 37.547 | 27.979 | 16.049 | 8.792 | 11.795 | 19.972 | 18.057 | 19.576 |
| PLACE1002358 | 48.964 | 52.954 | 25.597 | 17.560 | 25.248 | 26.885 | 39.078 | 44.650 |
| PLACE1002359 | 70.702 | 60.072 | 41.768 | 24.857 | 27.424 | 38.617 | 51.234 | 48.247 |
| PLACE1002374 | 119.415 | 70.407 | 40.003 | 52.366 | 27.254 | 71.202 | 86.975 | 59.999 |
| PLACE1002376 | 76.607 | 80.189 | 66.224 | 38.374 | 30.440 | 43.752 | 57.781 | 47.015 |
| PLACE1002379 | 46.960 | 37.677 | 24.324 | 15.686 | 8.747 | 27.687 | 38.031 | 38.157 |
| PLACE1002386 | 34.135 | 56.039 | 21.956 | 15.130 | 13.263 | 40.392 | 20.988 | 18.948 |
| PLACE1002395 | 50.771 | 34.342 | 21.705 | 12.792 | 17.447 | 30.904 | 41.999 | 26.921 |
| PLACE1002399 | 26.369 | 26.554 | 11.941 | 11.546 | 12.821 | 16.487 | 21.773 | 21.163 |
| PLACE1002407 | 24.383 | 13.800 | 14.460 | 6.932 | 17.857 | 10.390 | 8.160 | 9.349 |
| PLACE1002433 | 48.909 | 60.537 | 30.096 | 33.352 | 22.856 | 24.152 | 49.419 | 48.535 |
| PLACE1002437 | 41.702 | 30.287 | 21.358 | 10.885 | 8.866 | 22.078 | 29.556 | 17.959 |
| PLACE1002438 | 13.555 | 11.187 | 8.617 | 6.781 | 2.684 | 9.005 | 7.945 | 7.896 |

TABLE 123-continued

| | | | | | | | | |
|---|---|---|---|---|---|---|---|---|
| PLACE1002446 | 21.605 | 27.628 | 11.792 | 11.569 | 10.494 | 11.830 | 17.464 | 16.893 |
| PLACE1002447 | 35.206 | 16.567 | 12.839 | 7.714 | 16.646 | 21.325 | 23.151 | 14.505 |
| PLACE1002450 | 7.279 | 19.248 | 9.887 | 11.951 | 10.923 | 5.788 | 16.070 | 16.657 |
| PLACE1002462 | 28.126 | 22.054 | 9.073 | 8.084 | 9.639 | 12.889 | 28.071 | 18.658 |
| PLACE1002465 | 50.708 | 38.829 | 28.583 | 22.053 | 22.627 | 24.578 | 37.561 | 35.602 |
| PLACE1002474 | 42.838 | 48.831 | 28.190 | 20.034 | 25.208 | 37.936 | 39.355 | 29.560 |
| PLACE1002477 | 68.476 | 88.049 | 43.373 | 49.594 | 28.828 | 30.662 | 33.024 | 45.912 |
| PLACE1002493 | 20.932 | 15.425 | 14.743 | 9.609 | 5.982 | 13.112 | 18.554 | 13.289 |
| PLACE1002497 | 62.857 | 26.623 | 15.819 | 9.997 | 10.197 | 19.095 | 23.320 | 14.788 |
| PLACE1002499 | 25.484 | 35.975 | 17.658 | 12.207 | 20.785 | 19.603 | 26.553 | 24.711 |

TABLE 124

| | | | | | | | | |
|---|---|---|---|---|---|---|---|---|
| PLACE1002500 | 61.430 | 52.592 | 20.851 | 20.792 | 20.608 | 26.596 | 35.837 | 25.000 |
| PLACE1002514 | 57.950 | 34.821 | 25.761 | 14.063 | 20.170 | 29.748 | 38.465 | 28.873 |
| PLACE1002518 | 33.229 | 41.213 | 15.047 | 27.600 | 25.421 | 15.108 | 39.619 | 19.093 |
| PLACE1002529 | 20.589 | 17.020 | 8.550 | 4.795 | 6.064 | 5.232 | 8.483 | 8.689 |
| PLACE1002532 | 228.966 | 81.188 | 71.766 | 41.993 | 49.408 | 124.500 | 121.100 | 70.493 |
| PLACE1002536 | 54.940 | 104.532 | 50.236 | 37.932 | 32.704 | 37.719 | 49.674 | 44.065 |
| PLACE1002537 | 50.443 | 35.983 | 26.347 | 14.124 | 16.394 | 28.846 | 22.586 | 18.551 |
| PLACE1002539 | 43.269 | 40.064 | 22.458 | 15.887 | 20.345 | 19.917 | 47.789 | 34.032 |
| PLACE1002547 | 56.046 | 40.874 | 34.045 | 20.245 | 32.445 | 28.657 | 42.402 | 32.824 |
| PLACE1002571 | 22.915 | 18.915 | 20.884 | 11.040 | 19.304 | 18.369 | 20.827 | 18.977 |
| PLACE1002578 | 110.554 | 134.909 | 53.782 | 65.675 | 56.576 | 47.716 | 58.650 | 75.950 |
| PLACE1002583 | 10.726 | 15.813 | 12.765 | 12.655 | 12.171 | 11.770 | 8.242 | 11.466 |
| PLACE1002591 | 30.958 | 26.809 | 17.781 | 9.878 | 19.760 | 16.773 | 24.345 | 16.337 |
| PLACE1002598 | 14.446 | 16.092 | 4.386 | 12.890 | 11.213 | 8.112 | 5.827 | 10.365 |
| PLACE1002604 | 31.921 | 44.779 | 19.490 | 23.538 | 18.247 | 17.300 | 19.554 | 24.344 |
| PLACE1002612 | 55.401 | 62.901 | 26.650 | 24.921 | 30.069 | 38.235 | 60.295 | 44.841 |
| PLACE1002625 | 23.240 | 23.910 | 6.945 | 6.719 | 8.340 | 13.804 | 18.338 | 12.847 |
| PLACE1002638 | 47.938 | 43.765 | 20.041 | 12.130 | 17.684 | 35.619 | 30.109 | 30.357 |
| PLACE1002655 | 99.112 | 95.019 | 46.543 | 45.871 | 43.662 | 48.343 | 74.802 | 60.920 |
| PLACE1002665 | 56.436 | 48.910 | 34.541 | 41.310 | 34.121 | 40.016 | 45.653 | 42.518 |
| PLACE1002685 | 125.131 | 56.394 | 32.422 | 13.563 | 38.268 | 66.967 | 86.419 | 50.297 |
| PLACE1002692 | 132.787 | 228.548 | 52.995 | 46.294 | 48.882 | 52.021 | 80.560 | 61.182 |
| PLACE1002714 | 44.319 | 53.609 | 23.573 | 28.126 | 20.794 | 16.095 | 44.240 | 36.632 |
| PLACE1002721 | 48.707 | 45.968 | 24.879 | 33.949 | 24.596 | 24.407 | 47.991 | 34.094 |
| PLACE1002722 | 51.611 | 20.165 | 11.297 | 10.959 | 22.220 | 21.294 | 29.351 | 14.502 |
| PLACE1002726 | 125.645 | 66.983 | 41.963 | 24.383 | 43.077 | 52.449 | 71.534 | 49.750 |
| PLACE1002756 | 76.684 | 90.401 | 34.602 | 33.347 | 35.450 | 32.003 | 38.085 | 37.112 |
| PLACE1002768 | 37.065 | 34.695 | 22.471 | 18.473 | 10.495 | 27.644 | 30.569 | 9.688 |
| PLACE1002772 | 19.381 | 21.230 | 12.133 | 12.530 | 9.455 | 11.715 | 18.808 | 10.755 |
| PLACE1002775 | 215.958 | 171.561 | 119.480 | 99.390 | 61.339 | 134.546 | 191.663 | 118.381 |
| PLACE1002780 | 176.781 | 287.195 | 23.632 | 43.077 | 19.593 | 82.890 | 72.700 | 18.752 |
| PLACE1002782 | 27.818 | 23.226 | 15.927 | 9.468 | 12.050 | 16.476 | 22.237 | 15.411 |
| PLACE1002794 | 34.691 | 31.569 | 16.222 | 15.221 | 8.616 | 19.358 | 32.122 | 23.951 |
| PLACE1002795 | 34.772 | 50.236 | 36.000 | 40.363 | 13.011 | 24.050 | 29.340 | 37.202 |
| PLACE1002811 | 40.778 | 28.219 | 23.615 | 10.194 | 9.406 | 18.249 | 26.914 | 13.705 |
| PLACE1002815 | 32.688 | 27.116 | 17.000 | 9.929 | 13.556 | 19.575 | 20.271 | 16.079 |
| PLACE1002816 | 121.530 | 77.053 | 58.292 | 56.734 | 32.151 | 78.899 | 64.752 | 42.913 |
| PLACE1002822 | 35.773 | 43.718 | 34.305 | 25.631 | 11.831 | 23.639 | 48.755 | 30.733 |
| PLACE1002833 | 24.398 | 36.649 | 16.262 | 14.271 | 19.041 | 21.708 | 18.804 | 12.550 |
| PLACE1002834 | 20.377 | 29.028 | 18.884 | 38.505 | 26.786 | 19.706 | 15.958 | 54.212 |
| PLACE1002835 | 104.711 | 48.012 | 49.299 | 39.789 | 40.131 | 89.778 | 70.476 | 54.471 |
| PLACE1002839 | 22.755 | 19.054 | 13.353 | 10.924 | 8.604 | 13.987 | 21.043 | 11.363 |
| PLACE1002851 | 22.576 | 22.474 | 16.954 | 12.287 | 11.607 | 17.683 | 15.934 | 14.373 |
| PLACE1002853 | 34.418 | 31.665 | 25.145 | 13.903 | 16.657 | 15.712 | 10.771 | 9.732 |
| PLACE1002881 | 102.976 | 97.917 | 70.514 | 87.830 | 51.598 | 50.758 | 41.241 | 42.291 |
| PLACE1002901 | 71.648 | 63.698 | 66.555 | 29.645 | 45.140 | 59.208 | 76.206 | 45.691 |
| PLACE1002904 | 6.345 | 11.408 | 5.948 | 6.331 | 4.476 | 4.773 | 15.458 | 10.017 |
| PLACE1002905 | 43.777 | 43.201 | 24.460 | 25.880 | 14.443 | 21.261 | 27.020 | 24.149 |
| PLACE1002908 | 38.273 | 28.688 | 19.809 | 11.922 | 14.762 | 22.711 | 23.772 | 25.263 |
| PLACE1002911 | 280.363 | 142.219 | 110.578 | 86.148 | 94.746 | 116.830 | 190.264 | 121.060 |
| PLACE1002941 | 45.141 | 51.204 | 25.368 | 25.127 | 21.749 | 21.182 | 28.172 | 23.976 |
| PLACE1002950 | 22.227 | 42.383 | 28.848 | 18.964 | 13.679 | 40.551 | 30.415 | 27.392 |
| PLACE1002955 | 118.340 | 126.144 | 74.949 | 61.222 | 67.700 | 127.593 | 138.479 | 103.622 |
| PLACE1002958 | 42.823 | 73.248 | 29.043 | 43.999 | 21.046 | 30.246 | 30.209 | 53.696 |
| PLACE1002962 | 7.154 | 11.720 | 8.629 | 3.908 | 11.152 | 5.236 | 10.848 | 10.215 |
| PLACE1002967 | 62.925 | 77.879 | 33.266 | 40.761 | 36.265 | 24.991 | 35.749 | 78.774 |
| PLACE1002968 | 73.792 | 79.691 | 34.647 | 36.303 | 26.835 | 30.815 | 23.266 | 26.721 |
| PLACE1002976 | 24.111 | 38.815 | 16.069 | 23.739 | 17.440 | 20.322 | 26.434 | 27.217 |
| PLACE1002991 | 83.434 | 88.462 | 43.928 | 55.219 | 35.522 | 33.200 | 32.513 | 44.550 |
| PLACE1002993 | 62.886 | 51.207 | 37.983 | 33.434 | 28.969 | 27.082 | 27.450 | 28.611 |
| PLACE1002996 | 19.729 | 20.547 | 14.273 | 16.278 | 5.760 | 11.996 | 16.766 | 16.581 |
| PLACE1003010 | 240.363 | 125.220 | 98.211 | 60.019 | 42.226 | 129.379 | 119.840 | 90.413 |
| PLACE1003025 | 68.787 | 25.412 | 19.967 | 14.489 | 16.064 | 28.852 | 59.970 | 29.353 |
| PLACE1003027 | 22.588 | 27.019 | 12.986 | 10.960 | 16.947 | 17.092 | 18.805 | 11.735 |

TABLE 125

| | | | | | | | | |
|---|---|---|---|---|---|---|---|---|
| PLACE1003044 | 14.108 | 16.171 | 12.882 | 10.168 | 11.272 | 11.173 | 13.588 | 13.162 |
| PLACE1003045 | 9.931 | 13.537 | 6.830 | 5.366 | 4.210 | 11.198 | 8.884 | 10.489 |
| PLACE1003052 | 44.591 | 46.375 | 21.677 | 18.989 | 17.471 | 26.652 | 30.614 | 25.422 |
| PLACE1003083 | 20.536 | 22.159 | 9.236 | 10.342 | 7.370 | 10.043 | 10.531 | 9.741 |
| PLACE1003085 | 24.408 | 20.399 | 11.964 | 14.547 | 6.525 | 15.327 | 21.584 | 12.854 |
| PLACE1003092 | 12.637 | 30.662 | 12.298 | 17.303 | 9.545 | 11.397 | 14.192 | 24.648 |
| PLACE1003097 | 21.163 | 28.352 | 8.518 | 7.565 | 3.855 | 8.878 | 9.083 | 12.625 |
| PLACE1003100 | 43.307 | 32.855 | 19.035 | 17.015 | 15.982 | 50.024 | 32.500 | 18.851 |
| PLACE1003108 | 58.475 | 45.704 | 33.791 | 31.380 | 26.209 | 26.815 | 25.220 | 26.126 |
| PLACE1003115 | 143.932 | 81.794 | 76.879 | 39.097 | 80.354 | 68.496 | 127.480 | 88.406 |
| PLACE1003120 | 100.979 | 101.665 | 82.247 | 77.470 | 49.512 | 53.513 | 62.113 | 89.513 |
| PLACE1003135 | 6.556 | 10.790 | 5.392 | 16.841 | 4.741 | 6.451 | 6.382 | 9.459 |
| PLACE1003136 | 55.512 | 44.451 | 32.908 | 30.362 | 21.310 | 28.720 | 24.260 | 37.347 |
| PLACE1003141 | 7.159 | 13.191 | 10.628 | 9.244 | 4.399 | 6.923 | 11.238 | 10.791 |
| PLACE1003145 | 37.746 | 12.816 | 10.773 | 3.856 | 7.578 | 23.487 | 24.678 | 15.744 |
| PLACE1003147 | 15.381 | 13.149 | 11.750 | 9.884 | 10.068 | 7.642 | 10.640 | 10.362 |
| PLACE1003153 | 70.554 | 49.471 | 30.621 | 42.667 | 28.210 | 30.997 | 31.700 | 41.448 |
| PLACE1003163 | 37.733 | 16.360 | 12.470 | 5.123 | 13.824 | 40.304 | 50.483 | 17.288 |
| PLACE1003172 | 223.164 | 104.257 | 83.462 | 50.706 | 45.640 | 123.594 | 116.341 | 107.613 |
| PLACE1003174 | 6.847 | 14.478 | 8.537 | 6.465 | 6.249 | 8.629 | 8.998 | 9.029 |
| PLACE1003176 | 12.670 | 10.690 | 9.875 | 9.192 | 3.516 | 6.864 | 12.376 | 12.198 |
| PLACE1003181 | 11.687 | 8.674 | 6.252 | 6.507 | 4.411 | 6.989 | 5.948 | 7.466 |
| PLACE1003184 | 23.604 | 20.100 | 15.005 | 12.717 | 8.845 | 11.973 | 22.555 | 14.655 |
| PLACE1003190 | 12.444 | 5.722 | 6.366 | 11.024 | 5.871 | 14.481 | 12.229 | 12.369 |
| PLACE1003200 | 4.994 | 7.575 | 2.794 | 1.074 | 2.399 | 1.597 | 1.208 | 4.980 |
| PLACE1003205 | 156.027 | 157.191 | 53.553 | 83.830 | 63.878 | 61.050 | 52.411 | 61.365 |
| PLACE1003209 | 19.507 | 25.938 | 12.603 | 10.839 | 9.269 | 15.181 | 16.630 | 15.534 |
| PLACE1003214 | 38.350 | 83.164 | 20.591 | 69.513 | 15.776 | 19.528 | 39.872 | 125.749 |
| PLACE1003229 | 49.722 | 43.024 | 29.429 | 25.068 | 15.677 | 21.087 | 17.077 | 23.421 |
| PLACE1003238 | 17.754 | 10.174 | 7.246 | 3.501 | 3.841 | 9.069 | 7.319 | 5.314 |
| PLACE1003249 | 51.840 | 53.347 | 30.500 | 32.695 | 22.004 | 24.099 | 28.567 | 28.591 |
| PLACE1003256 | 348.304 | 244.002 | 177.910 | 180.405 | 124.873 | 188.558 | 160.554 | 142.541 |
| PLACE1003258 | 11.993 | 6.155 | 2.063 | 1.279 | 4.364 | 5.665 | 7.306 | 7.153 |
| PLACE1003279 | 141.943 | 126.197 | 62.494 | 87.403 | 63.808 | 59.323 | 70.538 | 91.072 |
| PLACE1003294 | 61.234 | 50.989 | 24.331 | 20.131 | 23.485 | 28.680 | 40.974 | 34.169 |
| PLACE1003296 | 41.072 | 45.050 | 21.216 | 19.875 | 16.935 | 42.888 | 30.941 | 33.241 |
| PLACE1003297 | 21.895 | 44.307 | 20.050 | 21.456 | 14.465 | 22.409 | 27.850 | 28.987 |
| PLACE1003302 | 11.776 | 33.428 | 28.663 | 42.408 | 24.581 | 29.862 | 17.565 | 71.757 |
| PLACE1003334 | 28.230 | 35.424 | 22.095 | 24.742 | 15.104 | 19.475 | 23.808 | 27.587 |
| PLACE1003337 | 7.957 | 26.706 | 3.267 | 14.838 | 4.774 | 19.084 | 12.500 | 28.263 |
| PLACE1003342 | 45.708 | 24.591 | 13.442 | 10.821 | 11.910 | 22.698 | 29.220 | 24.007 |
| PLACE1003343 | 17.266 | 13.753 | 6.616 | 6.894 | 8.198 | 9.061 | 13.065 | 7.734 |
| PLACE1003344 | 323.950 | 233.808 | 153.566 | 133.460 | 157.350 | 204.264 | 266.356 | 264.565 |
| PLACE1003353 | 53.698 | 66.145 | 26.553 | 32.701 | 25.639 | 48.208 | 44.219 | 57.187 |
| PLACE1003361 | 84.141 | 102.796 | 46.744 | 55.344 | 40.194 | 47.082 | 41.263 | 49.755 |
| PLACE1003366 | 87.834 | 63.858 | 27.852 | 28.427 | 27.117 | 31.747 | 33.446 | 27.075 |
| PLACE1003369 | 47.071 | 39.619 | 16.521 | 17.558 | 18.957 | 16.856 | 24.902 | 19.932 |
| PLACE1003372 | 24.973 | 37.849 | 16.679 | 21.014 | 16.249 | 20.971 | 27.530 | 18.337 |
| PLACE1003373 | 94.491 | 102.178 | 34.895 | 57.049 | 44.893 | 39.537 | 40.009 | 45.753 |
| PLACE1003375 | 36.319 | 27.954 | 14.531 | 8.317 | 18.694 | 17.347 | 38.060 | 21.672 |
| PLACE1003378 | 10.936 | 9.134 | 3.801 | 3.628 | 4.293 | 9.302 | 10.181 | 37.634 |
| PLACE1003383 | 23.472 | 30.580 | 11.017 | 13.956 | 16.293 | 19.925 | 21.999 | 14.820 |
| PLACE1003394 | 32.582 | 51.968 | 30.162 | 18.863 | 25.768 | 26.807 | 51.214 | 29.166 |
| PLACE1003401 | 24.258 | 20.812 | 11.820 | 9.448 | 8.433 | 7.409 | 11.371 | 10.841 |
| PLACE1003405 | 200.792 | 69.910 | 68.877 | 50.446 | 73.544 | 91.798 | 149.248 | 62.838 |
| PLACE1003407 | 150.376 | 60.878 | 43.383 | 28.913 | 48.667 | 65.167 | 94.258 | 52.526 |
| PLACE1003420 | 68.281 | 66.140 | 34.814 | 35.102 | 35.617 | 32.390 | 42.536 | 52.238 |
| PLACE1003428 | 34.299 | 47.479 | 25.133 | 24.448 | 23.830 | 14.848 | 52.937 | 29.065 |
| PLACE1003432 | 42.089 | 50.659 | 29.613 | 35.048 | 15.118 | 31.218 | 32.711 | 33.577 |
| PLACE1003438 | 140.387 | 63.379 | 51.749 | 27.965 | 32.257 | 72.208 | 70.053 | 46.148 |
| PLACE1003452 | 19.655 | 37.426 | 19.169 | 15.047 | 11.209 | 15.772 | 25.014 | 15.196 |
| PLACE1003454 | 126.775 | 72.771 | 50.122 | 30.788 | 40.364 | 92.647 | 99.924 | 32.089 |
| PLACE1003455 | 241.296 | 81.923 | 63.513 | 47.555 | 58.375 | 109.875 | 96.270 | 58.596 |
| PLACE1003456 | 118.238 | 97.468 | 61.858 | 80.667 | 54.057 | 56.681 | 53.136 | 61.523 |

TABLE 126

| | | | | | | | | |
|---|---|---|---|---|---|---|---|---|
| PLACE1003460 | 102.833 | 81.573 | 50.363 | 49.760 | 31.621 | 74.863 | 91.750 | 61.493 |
| PLACE1003478 | 40.947 | 22.624 | 17.515 | 11.339 | 9.308 | 17.242 | 28.787 | 13.341 |
| PLACE1003484 | 93.925 | 88.475 | 99.487 | 63.575 | 89.873 | 53.034 | 49.889 | 59.266 |
| PLACE1003493 | 268.545 | 164.272 | 115.044 | 85.931 | 75.866 | 116.655 | 174.628 | 103.683 |
| PLACE1003503 | 73.547 | 147.014 | 62.133 | 98.370 | 49.594 | 72.492 | 61.425 | 119.480 |
| PLACE1003505 | 22.557 | 36.343 | 17.315 | 10.863 | 10.402 | 19.193 | 31.835 | 20.526 |
| PLACE1003516 | 28.486 | 21.226 | 19.003 | 17.714 | 12.254 | 12.104 | 19.556 | 13.167 |
| PLACE1003519 | 139.419 | 169.111 | 84.259 | 142.580 | 98.798 | 125.181 | 74.459 | 170.077 |
| PLACE1003520 | 122.960 | 94.921 | 139.217 | 91.721 | 132.495 | 50.021 | 63.727 | 115.192 |

TABLE 126-continued

| | | | | | | | | |
|---|---|---|---|---|---|---|---|---|
| PLACE1003521 | 17.223 | 38.437 | 23.494 | 26.093 | 12.149 | 17.512 | 27.072 | 33.729 |
| PLACE1003525 | 175.790 | 102.294 | 111.400 | 74.179 | 68.238 | 165.232 | 232.487 | 100.600 |
| PLACE1003528 | 295.594 | 306.633 | 154.188 | 294.409 | 135.971 | 193.013 | 253.930 | 588.036 |
| PLACE1003529 | 198.617 | 81.732 | 80.067 | 39.906 | 48.188 | 118.411 | 106.875 | 72.890 |
| PLACE1003537 | 25.845 | 23.817 | 16.068 | 12.471 | 8.856 | 18.413 | 24.516 | 16.865 |
| PLACE1003549 | 39.079 | 30.714 | 21.959 | 18.378 | 20.930 | 26.350 | 37.243 | 23.667 |
| PLACE1003553 | 44.809 | 34.386 | 16.950 | 14.206 | 12.373 | 13.162 | 26.918 | 17.820 |
| PLACE1003566 | 108.286 | 89.542 | 60.257 | 82.707 | 41.128 | 52.437 | 55.865 | 54.986 |
| PLACE1003568 | 19.139 | 24.013 | 10.812 | 8.744 | 6.874 | 6.665 | 12.296 | 6.869 |
| PLACE1003573 | 28.529 | 30.963 | 16.094 | 16.508 | 11.491 | 20.438 | 20.129 | 16.769 |
| PLACE1003575 | 69.620 | 62.783 | 42.283 | 48.323 | 24.844 | 28.963 | 18.823 | 28.675 |
| PLACE1003583 | 13.478 | 10.930 | 8.008 | 6.298 | 3.054 | 6.089 | 10.292 | 7.945 |
| PLACE1003584 | 42.140 | 46.380 | 30.421 | 29.764 | 19.273 | 18.780 | 16.951 | 29.274 |
| PLACE1003592 | 98.964 | 131.059 | 76.620 | 85.120 | 70.369 | 47.996 | 51.112 | 68.235 |
| PLACE1003593 | 2.455 | 7.069 | 2.213 | 8.879 | 4.615 | 4.374 | 3.167 | 7.202 |
| PLACE1003594 | 22.619 | 21.370 | 12.280 | 14.568 | 22.143 | 26.231 | 42.506 | 19.308 |
| PLACE1003596 | 21.737 | 41.627 | 16.247 | 20.950 | 11.333 | 20.528 | 17.988 | 29.793 |
| PLACE1003598 | 197.107 | 100.809 | 87.842 | 57.151 | 53.833 | 101.281 | 103.552 | 70.110 |
| PLACE1003602 | 27.633 | 19.867 | 12.883 | 13.595 | 7.853 | 15.616 | 14.765 | 13.631 |
| PLACE1003605 | 13.132 | 30.464 | 12.191 | 29.665 | 9.628 | 29.537 | 19.949 | 40.233 |
| PLACE1003611 | 37.261 | 46.658 | 40.208 | 40.687 | 21.349 | 29.193 | 33.706 | 37.181 |
| PLACE1003618 | 22.786 | 32.124 | 18.870 | 19.849 | 15.708 | 16.877 | 16.986 | 14.810 |
| PLACE1003625 | 16.924 | 16.778 | 13.947 | 11.520 | 16.451 | 12.566 | 11.487 | 11.026 |
| PLACE1003626 | 94.235 | 146.631 | 108.588 | 90.620 | 68.485 | 68.227 | 76.568 | 114.286 |
| PLACE1003630 | 66.350 | 38.194 | 46.810 | 34.410 | 25.790 | 40.498 | 47.259 | 42.273 |
| PLACE1003635 | 16.711 | 14.910 | 11.010 | 9.614 | 7.598 | 1.425 | 11.967 | 16.224 |
| PLACE1003638 | 42.833 | 38.250 | 23.900 | 33.007 | 18.162 | 21.521 | 20.597 | 26.688 |
| PLACE1003644 | 32.340 | 47.319 | 50.856 | 35.086 | 25.956 | 21.602 | 39.503 | 41.265 |
| PLACE1003654 | 8.702 | 11.750 | 4.857 | 7.626 | 4.620 | 4.783 | 6.412 | 11.622 |
| PLACE1003656 | 13.584 | 9.710 | 6.305 | 3.192 | 2.939 | 12.859 | 10.981 | 8.367 |
| PLACE1003660 | 48.712 | 57.359 | 34.700 | 32.321 | 18.997 | 26.256 | 31.653 | 37.509 |
| PLACE1003669 | 18.575 | 20.941 | 11.934 | 7.933 | 11.712 | 11.416 | 9.244 | 12.275 |
| PLACE1003670 | 208.802 | 92.009 | 91.713 | 62.162 | 57.129 | 95.305 | 111.081 | 85.224 |
| PLACE1003671 | 86.484 | 44.662 | 34.415 | 21.211 | 22.436 | 39.601 | 73.903 | 47.170 |
| PLACE1003697 | 20.072 | 30.957 | 22.381 | 12.263 | 12.054 | 18.778 | 27.550 | 30.714 |
| PLACE1003704 | 37.863 | 72.473 | 31.653 | 35.394 | 19.396 | 26.513 | 28.063 | 51.598 |
| PLACE1003709 | 2.009 | 0.961 | 4.994 | 3.081 | 0.994 | 2.151 | 2.305 | 18.174 |
| PLACE1003711 | 69.991 | 36.386 | 26.693 | 20.921 | 22.954 | 36.509 | 43.017 | 28.963 |
| PLACE1003723 | 64.751 | 56.292 | 26.163 | 27.145 | 23.419 | 26.594 | 37.972 | 40.416 |
| PLACE1003724 | 108.825 | 79.454 | 49.180 | 55.077 | 46.271 | 43.499 | 54.124 | 55.073 |
| PLACE1003737 | 13.653 | 29.915 | 11.983 | 5.933 | 6.965 | 11.338 | 19.286 | 17.493 |
| PLACE1003738 | 55.859 | 28.082 | 23.047 | 12.820 | 11.647 | 24.406 | 34.244 | 18.965 |
| PLACE1003742 | 45.939 | 34.288 | 20.111 | 23.290 | 11.889 | 14.690 | 17.236 | 19.752 |
| PLACE1003744 | 133.197 | 117.135 | 50.274 | 33.621 | 26.974 | 59.212 | 81.540 | 51.429 |
| PLACE1003758 | 38.274 | 21.475 | 16.086 | 7.215 | 7.692 | 19.346 | 23.882 | 14.658 |
| PLACE1003760 | 26.760 | 76.015 | 54.262 | 18.973 | 62.442 | 50.339 | 24.164 | 38.587 |
| PLACE1003762 | 49.564 | 49.023 | 28.238 | 25.452 | 24.491 | 29.452 | 34.554 | 31.123 |
| PLACE1003765 | 85.304 | 73.829 | 31.423 | 19.820 | 32.647 | 27.644 | 30.190 | 31.980 |
| PLACE1003768 | 44.313 | 74.709 | 35.890 | 37.486 | 26.457 | 32.675 | 31.043 | 35.883 |
| PLACE1003771 | 21.353 | 25.511 | 22.664 | 14.067 | 11.332 | 17.660 | 19.140 | 20.831 |
| PLACE1003772 | 15.300 | 89.280 | 10.876 | 29.963 | 10.651 | 30.651 | 32.442 | 57.246 |
| PLACE1003783 | 21.327 | 19.915 | 8.006 | 6.790 | 10.404 | 11.752 | 17.155 | 9.593 |
| PLACE1003784 | 14.398 | 17.600 | 9.155 | 10.940 | 7.089 | 6.528 | 9.014 | 11.598 |
| PLACE1003788 | 17.074 | 15.719 | 6.961 | 5.352 | 7.010 | 9.378 | 16.965 | 9.723 |
| PLACE1003795 | 47.580 | 49.926 | 26.154 | 21.194 | 19.200 | 30.157 | 37.011 | 26.330 |

TABLE 127

| | | | | | | | | |
|---|---|---|---|---|---|---|---|---|
| PLACE1003827 | 65.231 | 45.890 | 25.681 | 25.602 | 26.890 | 38.750 | 51.689 | 32.624 |
| PLACE1003833 | 108.277 | 73.312 | 42.599 | 42.885 | 36.400 | 47.382 | 71.347 | 50.389 |
| PLACE1003839 | 58.333 | 54.929 | 43.243 | 27.226 | 31.205 | 43.659 | 43.726 | 50.779 |
| PLACE1003845 | 57.999 | 40.351 | 25.022 | 12.391 | 22.439 | 35.548 | 37.628 | 22.735 |
| PLACE1003850 | 127.357 | 63.517 | 33.460 | 23.365 | 30.954 | 53.921 | 59.726 | 38.279 |
| PLACE1003852 | 31.154 | 57.883 | 11.655 | 9.912 | 13.233 | 18.435 | 22.723 | 22.101 |
| PLACE1003858 | 41.915 | 20.593 | 18.192 | 8.183 | 16.756 | 18.529 | 28.232 | 22.273 |
| PLACE1003861 | 58.968 | 44.111 | 19.141 | 13.711 | 17.998 | 21.832 | 39.228 | 39.849 |
| PLACE1003864 | 22.459 | 38.407 | 12.279 | 15.595 | 10.850 | 13.808 | 20.707 | 23.670 |
| PLACE1003870 | 101.899 | 127.451 | 62.650 | 94.009 | 74.206 | 51.275 | 57.946 | 89.658 |
| PLACE1003885 | 60.423 | 33.558 | 22.851 | 16.758 | 22.675 | 33.025 | 39.475 | 20.419 |
| PLACE1003886 | 59.008 | 70.715 | 28.043 | 22.294 | 24.099 | 36.534 | 39.216 | 36.502 |
| PLACE1003888 | 31.386 | 33.156 | 12.296 | 8.686 | 9.487 | 8.891 | 17.821 | 19.193 |
| PLACE1003892 | 9.030 | 10.854 | 5.434 | 3.842 | 5.628 | 6.081 | 11.548 | 5.474 |
| PLACE1003900 | 56.299 | 34.490 | 17.726 | 16.257 | 24.111 | 27.255 | 40.929 | 21.927 |
| PLACE1003902 | 13.429 | 29.453 | 12.159 | 9.597 | 16.000 | 7.119 | 13.508 | 10.317 |
| PLACE1003903 | 42.879 | 27.988 | 14.980 | 9.315 | 15.918 | 18.933 | 45.780 | 18.960 |
| PLACE1003915 | 12.145 | 27.163 | 12.885 | 10.567 | 14.419 | 14.179 | 19.072 | 14.872 |

TABLE 127-continued

| | | | | | | | | |
|---|---|---|---|---|---|---|---|---|
| PLACE1003918 | 19.087 | 26.774 | 21.996 | 28.560 | 16.673 | 17.769 | 20.733 | 39.272 |
| PLACE1003923 | 17.938 | 34.010 | 16.114 | 10.428 | 12.304 | 11.045 | 13.677 | 13.626 |
| PLACE1003932 | 12.148 | 25.177 | 11.239 | 11.640 | 9.027 | 11.609 | 13.946 | 10.585 |
| PLACE1003936 | 98.915 | 71.254 | 54.545 | 43.722 | 60.900 | 44.493 | 55.944 | 33.641 |
| PLACE1003966 | 9.602 | 25.105 | 6.373 | 20.612 | 8.000 | 8.156 | 16.577 | 22.580 |
| PLACE1003968 | 155.532 | 59.259 | 61.976 | 41.239 | 67.653 | 64.474 | 101.806 | 78.393 |
| PLACE1004018 | 54.312 | 58.203 | 24.249 | 21.023 | 23.896 | 22.724 | 51.031 | 32.530 |
| PLACE1004020 | 83.348 | 98.787 | 59.310 | 57.638 | 36.190 | 62.304 | 66.390 | 82.643 |
| PLACE1004028 | 24.781 | 24.415 | 11.783 | 9.512 | 7.540 | 20.059 | 22.302 | 17.720 |
| PLACE1004034 | 17.910 | 20.422 | 11.915 | 15.479 | 8.400 | 11.398 | 19.335 | 11.027 |
| PLACE1004042 | 56.266 | 68.516 | 27.953 | 28.385 | 23.656 | 36.706 | 42.138 | 31.854 |
| PLACE1004078 | 55.853 | 64.437 | 45.957 | 50.360 | 28.188 | 33.762 | 44.473 | 44.379 |
| PLACE1004103 | 82.183 | 108.065 | 67.258 | 73.844 | 58.609 | 52.188 | 48.497 | 62.546 |
| PLACE1004104 | 28.527 | 25.472 | 19.215 | 14.931 | 10.266 | 14.257 | 42.824 | 30.092 |
| PLACE1004113 | 88.762 | 79.179 | 40.847 | 46.070 | 24.179 | 32.925 | 49.556 | 52.027 |
| PLACE1004114 | 34.482 | 51.070 | 24.001 | 25.218 | 13.524 | 23.678 | 16.143 | 24.982 |
| PLACE1004118 | 7.959 | 17.781 | 10.600 | 6.021 | 5.716 | 7.170 | 22.166 | 12.479 |
| PLACE1004128 | 157.419 | 76.024 | 59.277 | 39.964 | 32.057 | 70.811 | 86.636 | 81.153 |
| PLACE1004130 | 12.810 | 19.897 | 10.691 | 14.553 | 5.947 | 9.537 | 14.197 | 13.183 |
| PLACE1004149 | 389.247 | 289.561 | 187.336 | 173.146 | 139.349 | 219.176 | 218.135 | 176.125 |
| PLACE1004156 | 154.127 | 148.253 | 89.024 | 112.406 | 77.253 | 73.380 | 83.983 | 73.719 |
| PLACE1004160 | 380.298 | 97.742 | 180.381 | 64.718 | 155.863 | 307.172 | 350.794 | 93.857 |
| PLACE1004161 | 169.005 | 53.952 | 58.840 | 40.858 | 55.087 | 99.826 | 113.689 | 55.889 |
| PLACE1004166 | 34.880 | 53.232 | 25.983 | 22.633 | 19.476 | 13.270 | 20.643 | 32.986 |
| PLACE1004168 | 60.294 | 31.301 | 30.139 | 19.493 | 14.214 | 37.430 | 32.263 | 32.104 |
| PLACE1004170 | 20.591 | 14.931 | 15.171 | 7.631 | 5.880 | 13.252 | 14.579 | 12.294 |
| PLACE1004178 | 15.161 | 17.955 | 94.893 | 8.136 | 138.324 | 12.187 | 13.182 | 8.196 |
| PLACE1004183 | 82.644 | 31.272 | 45.235 | 14.851 | 34.570 | 64.117 | 65.703 | 24.241 |
| PLACE1004197 | 16.554 | 15.430 | 12.063 | 9.295 | 4.620 | 10.632 | 9.453 | 14.626 |
| PLACE1004199 | 105.771 | 35.874 | 42.409 | 13.689 | 33.976 | 72.635 | 99.795 | 29.738 |
| PLACE1004203 | 97.622 | 38.875 | 29.121 | 21.384 | 27.473 | 49.790 | 59.416 | 36.062 |
| PLACE1004242 | 76.021 | 94.358 | 69.979 | 49.223 | 46.887 | 46.304 | 63.046 | 50.392 |
| PLACE1004249 | 57.692 | 54.868 | 42.542 | 29.091 | 28.894 | 31.370 | 30.144 | 27.719 |
| PLACE1004255 | 7.624 | 6.797 | 5.218 | 3.278 | 3.974 | 5.853 | 8.367 | 4.680 |
| PLACE1004256 | 27.907 | 27.196 | 30.222 | 10.195 | 51.103 | 28.629 | 16.493 | 16.024 |
| PLACE1004257 | 23.879 | 16.029 | 12.630 | 21.613 | 22.449 | 22.658 | 10.030 | 25.329 |
| PLACE1004258 | 25.963 | 21.667 | 16.937 | 13.963 | 16.737 | 16.892 | 20.871 | 16.224 |
| PLACE1004270 | 72.433 | 34.960 | 27.059 | 31.207 | 28.043 | 44.279 | 50.286 | 21.577 |
| PLACE1004272 | 21.378 | 17.600 | 17.337 | 7.701 | 21.982 | 15.067 | 15.410 | 15.983 |
| PLACE1004273 | 40.856 | 173.858 | 38.516 | 140.311 | 31.529 | 139.986 | 91.578 | 179.424 |
| PLACE1004274 | 30.795 | 11.771 | 7.313 | 6.800 | 6.612 | 8.810 | 12.741 | 9.115 |
| PLACE1004Z77 | 43.258 | 37.923 | 22.392 | 22.375 | 12.191 | 32.785 | 30.462 | 29.403 |
| PLACE1004279 | 66.082 | 58.555 | 62.441 | 58.027 | 41.289 | 37.682 | 41.595 | 57.510 |
| PLACE1004282 | 40.317 | 23.357 | 16.305 | 12.448 | 7.975 | 25.489 | 24.710 | 19.388 |
| PLACE1004284 | 8.514 | 16.033 | 16.324 | 4.991 | 19.954 | 16.281 | 10.800 | 11.690 |
| PLACE1004289 | 57.838 | 64.819 | 44.685 | 56.740 | 38.403 | 41.069 | 27.562 | 40.271 |

TABLE 128

| | | | | | | | | |
|---|---|---|---|---|---|---|---|---|
| PLACE1004299 | 72.960 | 55.550 | 24.647 | 14.840 | 20.355 | 39.409 | 46.267 | 40.773 |
| PLACE1004302 | 0.000 | 2.283 | 0.000 | 2.351 | 1.896 | 0.000 | 0.000 | 2.398 |
| PLACE1004305 | 48.425 | 22.731 | 21.012 | 11.875 | 13.056 | 23.176 | 27.227 | 15.060 |
| PLACE1004316 | 13.028 | 20.460 | 9.292 | 6.569 | 6.425 | 10.734 | 13.111 | 14.995 |
| PLACE1004322 | 5.597 | 14.420 | 3.361 | 13.438 | 2.427 | 2.862 | 15.463 | 30.143 |
| PLACE1004325 | 210.567 | 142.328 | 97.326 | 76.987 | 66.867 | 109.387 | 137.359 | 89.195 |
| PLACE1004332 | 20.898 | 80.056 | 11.714 | 95.127 | 6.945 | 10.855 | 19.856 | 120.861 |
| PLACE1004336 | 162.448 | 109.014 | 85.745 | 88.818 | 74.380 | 88.121 | 64.528 | 76.583 |
| PLACE1004346 | 33.011 | 29.261 | 14.760 | 16.784 | 13.075 | 16.208 | 18.604 | 15.045 |
| PLACE1004358 | 303.987 | 155.290 | 114.636 | 79.890 | 97.745 | 151.939 | 184.597 | 122.929 |
| PLACE1004376 | 26.954 | 55.450 | 24.865 | 32.727 | 18.065 | 20.930 | 21.337 | 31.788 |
| PLACE1004384 | 41.561 | 34.784 | 24.877 | 26.743 | 16.820 | 18.362 | 17.481 | 21.709 |
| PLACE1004385 | 2.815 | 8.008 | 1.116 | 0.789 | 0.276 | 1.941 | 4.609 | 1.615 |
| PLACE1004388 | 9.428 | 16.190 | 11.060 | 5.000 | 14.211 | 5.122 | 9.688 | 9.607 |
| PLACE1004405 | 8.173 | 12.654 | 5.345 | 1.830 | 0.933 | 5.888 | 9.305 | 5.124 |
| PLACE1004407 | 29.905 | 23.442 | 14.979 | 13.177 | 16.639 | 25.030 | 34.013 | 28.941 |
| PLACE1004424 | 10.514 | 15.521 | 10.255 | 7.446 | 7.421 | 9.255 | 10.500 | 10.362 |
| PLACE1004425 | 19.759 | 20.897 | 10.508 | 10.323 | 4.107 | 7.623 | 8.354 | 13.395 |
| PLACE1004427 | 27.135 | 16.966 | 10.908 | 6.848 | 6.240 | 12.886 | 13.355 | 13.321 |
| PLACE1004428 | 57.419 | 64.170 | 30.987 | 36.844 | 18.316 | 25.562 | 30.009 | 32.786 |
| PLACE1004433 | 14.267 | 16.470 | 9.620 | 5.755 | 5.704 | 9.109 | 18.352 | 17.362 |
| PLACE1004435 | 17.934 | 21.109 | 25.397 | 11.056 | 16.381 | 15.263 | 11.508 | 12.972 |
| PLACE1004437 | 80.263 | 28.301 | 25.518 | 11.113 | 18.894 | 28.285 | 48.525 | 32.402 |
| PLACE1004441 | 54.134 | 47.973 | 28.455 | 25.980 | 23.238 | 32.602 | 42.800 | 31.312 |
| PLACE1004446 | 21.816 | 51.429 | 12.869 | 9.278 | 14.108 | 22.134 | 27.233 | 19.664 |
| PLACE1004450 | 7.462 | 10.131 | 7.421 | 5.906 | 3.377 | 6.452 | 10.209 | 6.066 |
| PLACE1004451 | 20.207 | 31.572 | 19.505 | 19.989 | 13.665 | 10.206 | 15.250 | 18.302 |

TABLE 128-continued

| | | | | | | | | |
|---|---|---|---|---|---|---|---|---|
| PLACE1004456 | 53.328 | 61.854 | 40.178 | 40.750 | 22.994 | 32.386 | 43.215 | 51.423 |
| PLACE1004458 | 11.625 | 26.331 | 11.664 | 5.811 | 6.713 | 7.889 | 9.892 | 25.194 |
| PLACE1004460 | 14.565 | 10.490 | 5.224 | 4.840 | 4.848 | 10.082 | 10.381 | 9.064 |
| PLACE1004467 | 55.048 | 46.934 | 30.599 | 25.322 | 18.898 | 22.765 | 24.523 | 37.228 |
| PLACE1004471 | 79.809 | 63.442 | 37.258 | 59.178 | 37.277 | 29.527 | 32.628 | 61.028 |
| PLACE1004473 | 11.959 | 24.287 | 10.007 | 12.507 | 6.941 | 16.855 | 16.517 | 14.312 |
| PLACE1004475 | 28.089 | 59.714 | 31.110 | 18.183 | 27.680 | 29.310 | 26.516 | 47.243 |
| PLACE1004482 | 25.293 | 47.010 | 16.830 | 16.111 | 11.400 | 30.429 | 30.968 | 35.155 |
| PLACE1004491 | 1.664 | 6.234 | 6.646 | 3.270 | 2.102 | 2.892 | 5.873 | 2.357 |
| PLACE1004492 | 28.976 | 64.765 | 17.444 | 33.197 | 14.425 | 13.718 | 15.087 | 46.827 |
| PLACE1004506 | 115.632 | 78.203 | 46.045 | 35.757 | 41.896 | 69.416 | 85.790 | 78.043 |
| PLACE1004507 | 19.324 | 9.642 | 5.560 | 5.074 | 6.375 | 9.835 | 14.279 | 13.049 |
| PLACE1004510 | 68.938 | 32.074 | 18.477 | 12.138 | 20.444 | 31.944 | 40.037 | 21.097 |
| PLACE1004516 | 12.480 | 28.346 | 11.965 | 12.861 | 14.262 | 12.534 | 22.486 | 21.487 |
| PLACE1004518 | 113.615 | 41.314 | 32.970 | 20.351 | 31.552 | 61.934 | 56.694 | 31.846 |
| PLACE1004519 | 17.977 | 18.444 | 5.463 | 12.802 | 4.820 | 7.889 | 17.402 | 10.594 |
| PLACE1004520 | 151.375 | 60.864 | 33.949 | 19.465 | 34.865 | 66.695 | 80.040 | 24.602 |
| PLACE1004530 | 43.149 | 50.004 | 13.982 | 11.859 | 13.432 | 25.111 | 26.818 | 14.729 |
| PLACE1004545 | 10.167 | 15.345 | 7.071 | 4.082 | 3.066 | 9.778 | 48.382 | 17.084 |
| PLACE1004547 | 23.679 | 18.172 | 11.002 | 9.917 | 9.918 | 8.124 | 14.641 | 11.578 |
| PLACE1004548 | 65.295 | 50.486 | 25.299 | 24.808 | 18.285 | 24.829 | 25.884 | 36.422 |
| PLACE1004550 | 26.366 | 18.052 | 12.431 | 9.837 | 11.528 | 18.472 | 24.539 | 12.011 |
| PLACE1004551 | 36.555 | 34.112 | 16.064 | 11.068 | 19.459 | 22.324 | 30.835 | 27.019 |
| PLACE1004559 | 7.230 | 9.773 | 4.555 | 3.840 | 5.493 | 5.484 | 6.749 | 3.314 |
| PLACE1004562 | 28.572 | 30.296 | 23.163 | 8.674 | 27.528 | 15.650 | 14.237 | 9.875 |
| PLACE1004564 | 36.735 | 40.092 | 17.343 | 20.204 | 19.250 | 16.933 | 27.924 | 22.272 |
| PLACE1004604 | 0.000 | 12.587 | 0.000 | 0.000 | 0.000 | 0.000 | 0.000 | 19.840 |
| PLACE1004611 | 146.180 | 120.698 | 55.658 | 62.073 | 72.842 | 61.052 | 49.103 | 61.906 |
| PLACE1004629 | 33.357 | 43.299 | 24.243 | 20.920 | 25.719 | 18.242 | 25.782 | 34.340 |
| PLACE1004630 | 115.833 | 50.627 | 40.441 | 11.469 | 40.312 | 43.201 | 76.589 | 27.684 |
| PLACE1004637 | 93.560 | 57.213 | 41.313 | 29.790 | 25.704 | 57.715 | 75.530 | 37.977 |
| PLACE1004645 | 73.214 | 93.376 | 36.462 | 56.662 | 22.216 | 68.433 | 63.089 | 99.155 |
| PLACE1004646 | 46.760 | 48.123 | 29.675 | 17.834 | 15.130 | 24.754 | 48.692 | 22.337 |
| PLACE1004648 | 350.190 | 101.385 | 110.514 | 45.573 | 70.332 | 215.200 | 161.060 | 64.085 |
| PLACE1004655 | 89.992 | 149.462 | 51.420 | 99.781 | 32.385 | 132.613 | 125.965 | 155.546 |
| PLACE1004658 | 116.215 | 50.154 | 45.513 | 37.950 | 33.846 | 45.145 | 68.297 | 39.519 |
| PLACE1004664 | 17.737 | 19.569 | 14.876 | 12.928 | 9.845 | 14.381 | 22.040 | 15.050 |

TABLE 129

| | | | | | | | | |
|---|---|---|---|---|---|---|---|---|
| PLACE1004672 | 115.072 | 106.617 | 82.206 | 119.303 | 40.425 | 71.021 | 72.226 | 74.522 |
| PLACE1004674 | 31.963 | 33.509 | 24.678 | 21.646 | 15.932 | 29.638 | 23.353 | 28.211 |
| PLACE1004681 | 42.868 | 52.263 | 26.896 | 24.625 | 15.862 | 23.571 | 27.757 | 20.193 |
| PLACE1004686 | 77.947 | 73.361 | 53.514 | 71.286 | 30.833 | 39.791 | 36.511 | 33.040 |
| PLACE1004690 | 32.648 | 58.935 | 35.179 | 14.534 | 30.457 | 39.275 | 32.277 | 31.724 |
| PLACE1004691 | 54.201 | 46.001 | 30.198 | 29.746 | 20.988 | 25.836 | 29.486 | 27.807 |
| PLACE1004693 | 14.777 | 12.312 | 8.393 | 5.596 | 11.162 | 10.119 | 16.032 | 13.442 |
| PLACE1004701 | 70.824 | 100.375 | 71.192 | 54.004 | 102.558 | 32.216 | 35.594 | 76.510 |
| PLACE1004705 | 65.005 | 44.191 | 23.752 | 22.321 | 16.770 | 23.327 | 38.083 | 39.081 |
| PLACE1004708 | 27.110 | 53.686 | 25.099 | 16.995 | 21.305 | 56.740 | 40.801 | 33.150 |
| PLACE1004716 | 39.167 | 36.771 | 27.872 | 31.814 | 17.418 | 21.095 | 22.468 | 30.805 |
| PLACE1004722 | 19.479 | 18.949 | 14.424 | 12.942 | 8.398 | 12.638 | 19.361 | 14.771 |
| PLACE1004736 | 243.492 | 165.849 | 137.412 | 105.409 | 67.657 | 152.337 | 156.408 | 125.947 |
| PLACE1004737 | 19.476 | 29.675 | 15.599 | 11.243 | 8.873 | 11.625 | 22.792 | 35.249 |
| PLACE1004740 | 75.304 | 51.308 | 47.454 | 36.445 | 39.722 | 39.387 | 38.438 | 45.080 |
| PLACE1004743 | 68.266 | 20.761 | 16.980 | 15.277 | 16.469 | 24.996 | 43.820 | 20.166 |
| PLACE1004751 | 52.682 | 43.427 | 21.010 | 38.514 | 12.476 | 20.526 | 37.750 | 28.532 |
| PLACE1004757 | 64.866 | 62.789 | 28.623 | 23.370 | 20.456 | 30.243 | 39.909 | 29.888 |
| PLACE1004761 | 26.949 | 16.825 | 13.926 | 8.696 | 8.320 | 11.691 | 16.318 | 12.117 |
| PLACE1004773 | 54.251 | 32.451 | 26.443 | 19.663 | 14.012 | 23.566 | 35.213 | 33.476 |
| PLACE1004775 | 0.000 | 0.417 | 0.000 | 0.196 | 0.000 | 0.000 | 0.000 | 0.000 |
| PLACE1004777 | 23.178 | 24.645 | 17.477 | 11.418 | 17.912 | 15.186 | 20.914 | 17.641 |
| PLACE1004793 | 10.099 | 9.825 | 8.108 | 2.235 | 6.900 | 9.166 | 12.992 | 9.524 |
| PLACE1004796 | 188.258 | 55.088 | 53.995 | 32.705 | 46.720 | 104.831 | 97.648 | 39.050 |
| PLACE1004804 | 47.571 | 38.570 | 28.854 | 17.511 | 18.650 | 30.285 | 28.014 | 30.229 |
| PLACE1004813 | 13.617 | 19.594 | 9.102 | 9.930 | 7.091 | 9.407 | 7.283 | 12.102 |
| PLACE1004814 | 41.930 | 105.336 | 65.246 | 82.329 | 68.081 | 42.266 | 24.121 | 54.793 |
| PLACE1004815 | 11.260 | 11.968 | 10.846 | 11.794 | 7.165 | 7.448 | 6.082 | 10.511 |
| PLACE1004816 | 16.128 | 75.555 | 15.363 | 11.777 | 8.852 | 11.495 | 48.534 | 15.257 |
| PLACE1004824 | 104.392 | 119.714 | 59.183 | 79.068 | 52.724 | 50.466 | 50.930 | 68.338 |
| PLACE1004827 | 36.438 | 26.140 | 22.831 | 30.150 | 21.998 | 23.534 | 21.266 | 27.294 |
| PLACE1004836 | 31.163 | 22.975 | 17.358 | 12.887 | 15.510 | 26.557 | 30.452 | 21.872 |
| PLACE1004838 | 51.513 | 33.252 | 27.542 | 18.538 | 19.154 | 26.439 | 33.316 | 30.452 |
| PLACE1004840 | 6.312 | 14.806 | 6.440 | 5.491 | 4.111 | 4.374 | 5.846 | 7.493 |
| PLACE1004842 | 36.592 | 16.317 | 15.880 | 3.917 | 12.485 | 19.399 | 19.475 | 15.636 |
| PLACE1004850 | 49.730 | 32.337 | 19.817 | 10.970 | 14.421 | 24.250 | 37.921 | 22.827 |

TABLE 129-continued

| | | | | | | | | |
|---|---|---|---|---|---|---|---|---|
| PLACE1004868 | 12.619 | 15.190 | 6.828 | 7.862 | 5.213 | 6.832 | 14.431 | 11.456 |
| PLACE1004885 | 47.128 | 43.214 | 27.198 | 28.397 | 13.325 | 24.000 | 19.111 | 27.465 |
| PLACE1004886 | 8.456 | 11.696 | 9.985 | 10.337 | 6.285 | 8.607 | 7.712 | 8.362 |
| PLACE1004887 | 25.379 | 95.649 | 19.675 | 41.800 | 19.005 | 29.704 | 27.795 | 64.943 |
| PLACE1004896 | 15.949 | 20.476 | 11.823 | 11.627 | 11.685 | 16.543 | 32.352 | 19.012 |
| PLACE1004900 | 156.735 | 97.505 | 60.889 | 55.961 | 42.544 | 67.669 | 87.798 | 52.760 |
| PLACE1004902 | 34.587 | 45.710 | 25.541 | 18.321 | 13.921 | 16.696 | 14.779 | 18.931 |
| PLACE1004904 | 13.083 | 9.418 | 10.864 | 6.532 | 3.426 | 12.069 | 11.291 | 11.270 |
| PLACE1004911 | 9.050 | 2.555 | 6.611 | 0.560 | 18.979 | 5.276 | 77.886 | 87.866 |
| PLACE1004913 | 5.777 | 13.239 | 7.908 | 7.304 | 5.359 | 5.827 | 5.467 | 4.992 |
| PLACE1004918 | 7.297 | 6.323 | 2.714 | 3.829 | 2.441 | 5.039 | 6.811 | 7.534 |
| PLACE1004930 | 13.399 | 20.023 | 7.288 | 16.589 | 5.485 | 9.041 | 11.559 | 29.767 |
| PLACE1004934 | 23.550 | 42.322 | 19.288 | 14.581 | 15.341 | 18.403 | 23.466 | 22.456 |
| PLACE1004937 | 62.000 | 36.002 | 39.437 | 12.652 | 29.690 | 26.536 | 31.417 | 16.660 |
| PLACE1004949 | 54.760 | 253.300 | 30.259 | 54.618 | 16.463 | 68.966 | 58.166 | 114.761 |
| PLACE1004969 | 34.833 | 23.924 | 16.977 | 12.463 | 10.067 | 19.834 | 24.891 | 18.488 |
| PLACE1004970 | 0.656 | 0.020 | 0.000 | 0.313 | 0.000 | 0.298 | 0.381 | 0.000 |
| PLACE1004972 | 6.558 | 13.022 | 6.101 | 7.857 | 6.753 | 5.710 | 11.774 | 11.235 |
| PLACE1004974 | 11.126 | 11.290 | 3.841 | 6.990 | 3.694 | 5.403 | 9.800 | 10.261 |
| PLACE1004975 | 80.214 | 39.062 | 26.710 | 22.285 | 23.842 | 39.120 | 65.032 | 40.567 |
| PLACE1004979 | 152.165 | 104.604 | 79.308 | 83.496 | 72.355 | 66.036 | 91.372 | 96.121 |
| PLACE1004982 | 31.283 | 43.568 | 24.303 | 20.310 | 19.273 | 22.947 | 20.250 | 25.778 |
| PLACE1004985 | 27.380 | 21.550 | 10.343 | 7.433 | 6.839 | 10.865 | 15.730 | 9.181 |
| PLACE1005003 | 13.462 | 10.074 | 3.185 | 3.847 | 4.249 | 8.207 | 9.511 | 7.821 |
| PLACE1005004 | 14.310 | 19.771 | 9.570 | 8.293 | 4.301 | 13.694 | 14.781 | 11.577 |
| PLACE1005005 | 68.568 | 52.286 | 38.586 | 41.076 | 30.307 | 32.858 | 34.815 | 41.036 |
| PLACE1005011 | 44.494 | 36.131 | 20.623 | 8.452 | 15.065 | 19.701 | 49.060 | 34.432 |
| PLACE1005026 | 15.741 | 9.737 | 2.380 | 4.186 | 5.033 | 9.113 | 16.290 | 8.131 |

TABLE 130

| | | | | | | | | |
|---|---|---|---|---|---|---|---|---|
| PLACE1005021 | 96.103 | 120.663 | 38.137 | 45.870 | 39.089 | 34.870 | 44.104 | 36.457 |
| PLACE1005031 | 53.784 | 60.972 | 22.926 | 20.892 | 23.652 | 30.271 | 33.677 | 36.405 |
| PLACE1005036 | 59.627 | 65.001 | 32.797 | 39.527 | 17.608 | 26.473 | 31.634 | 38.146 |
| PLACE1005041 | 4.201 | 12.290 | 6.164 | 5.522 | 7.108 | 4.000 | 7.035 | 4.518 |
| PLACE1005046 | 87.532 | 76.016 | 48.856 | 51.696 | 38.790 | 39.618 | 40.595 | 41.016 |
| PLACE1005047 | 46.051 | 25.735 | 13.704 | 11.855 | 15.156 | 16.153 | 36.409 | 23.815 |
| PLACE1005052 | 46.575 | 28.140 | 12.015 | 12.780 | 14.059 | 19.834 | 31.197 | 29.860 |
| PLACE1005055 | 8.158 | 27.571 | 18.813 | 20.078 | 22.643 | 10.820 | 20.439 | 26.659 |
| PLACE1005066 | 42.175 | 53.415 | 23.566 | 15.585 | 25.138 | 25.274 | 51.837 | 39.544 |
| PLACE1005077 | 24.309 | 28.659 | 13.050 | 14.623 | 12.679 | 15.734 | 21.504 | 21.488 |
| PLACE1005085 | 92.222 | 93.468 | 34.255 | 47.138 | 34.582 | 40.497 | 36.255 | 38.289 |
| PLACE1005086 | 102.289 | 115.876 | 53.702 | 57.228 | 50.800 | 42.000 | 46.257 | 54.679 |
| PLACE1005088 | 544.154 | 104.456 | 118.967 | 73.371 | 168.988 | 196.566 | 151.442 | 82.439 |
| PLACE1005089 | 15.670 | 20.631 | 11.122 | 11.637 | 9.823 | 8.077 | 15.337 | 12.098 |
| PLACE1005101 | 240.793 | 118.635 | 90.799 | 64.835 | 74.093 | 133.434 | 208.569 | 89.985 |
| PLACE1005102 | 211.056 | 131.745 | 94.963 | 67.285 | 83.058 | 115.827 | 185.343 | 115.880 |
| PLACE1005108 | 106.691 | 120.848 | 45.131 | 39.846 | 39.785 | 42.063 | 67.557 | 51.335 |
| PLACE1005110 | 44.564 | 38.347 | 24.937 | 14.829 | 19.447 | 30.115 | 34.784 | 22.848 |
| PLACE1005111 | 23.753 | 40.474 | 14.465 | 9.594 | 18.283 | 14.066 | 20.594 | 18.691 |
| PLACE1005123 | 59.496 | 91.632 | 49.521 | 37.074 | 43.380 | 35.861 | 40.754 | 46.181 |
| PLACE1005124 | 40.401 | 51.742 | 18.340 | 18.486 | 14.709 | 15.661 | 58.570 | 27.105 |
| PLACE1005128 | 204.940 | 150.075 | 112.018 | 69.631 | 91.526 | 103.298 | 146.254 | 123.511 |
| PLACE1005130 | 60.815 | 73.959 | 31.043 | 64.232 | 33.067 | 33.874 | 55.788 | 78.228 |
| PLACE1005141 | 31.384 | 66.806 | 13.194 | 14.252 | 14.502 | 14.628 | 19.090 | 38.173 |
| PLACE1005146 | 41.144 | 50.277 | 22.100 | 13.293 | 17.449 | 21.199 | 50.528 | 27.607 |
| PLACE1005152 | 24.085 | 22.701 | 12.226 | 17.968 | 9.903 | 11.357 | 15.172 | 18.599 |
| PLACE1005157 | 12.965 | 19.465 | 14.891 | 8.624 | 4.456 | 13.395 | 11.532 | 13.083 |
| PLACE1005162 | 36.700 | 33.286 | 16.285 | 22.399 | 12.111 | 12.771 | 17.199 | 79.584 |
| PLACE1005170 | 10.498 | 22.471 | 9.375 | 11.193 | 6.555 | 8.512 | 31.001 | 12.095 |
| PLACE1005176 | 14.622 | 9.067 | 7.477 | 7.780 | 4.490 | 12.946 | 17.364 | 70.281 |
| PLACE1005181 | 6.793 | 9.688 | 13.589 | 5.174 | 11.314 | 5.046 | 10.911 | 5.455 |
| PLACE1005184 | 45.108 | 51.852 | 28.259 | 28.577 | 14.895 | 17.723 | 18.400 | 25.953 |
| PLACE1005186 | 44.227 | 18.348 | 9.815 | 8.521 | 7.622 | 25.120 | 58.044 | 15.795 |
| PLACE1005187 | 35.399 | 20.464 | 13.526 | 17.276 | 12.357 | 24.314 | 23.687 | 19.988 |
| PLACE1005189 | 22.364 | 32.597 | 20.000 | 13.876 | 11.241 | 20.988 | 33.066 | 19.839 |
| PLACE1005193 | 49.047 | 60.518 | 24.364 | 25.042 | 13.468 | 27.467 | 43.397 | 28.759 |
| PLACE1005200 | 33.619 | 67.147 | 18.122 | 26.564 | 10.723 | 25.057 | 36.262 | 35.781 |
| PLACE1005206 | 7.546 | 16.382 | 8.064 | 9.582 | 7.561 | 2.781 | 8.835 | 9.588 |
| PLACE1005216 | 12.005 | 12.262 | 6.329 | 7.983 | 11.377 | 8.113 | 19.335 | 10.996 |
| PLACE1005223 | 61.568 | 52.800 | 42.403 | 50.792 | 22.094 | 32.500 | 31.112 | 40.207 |
| PLACE1005225 | 56.429 | 68.319 | 36.647 | 41.380 | 13.973 | 38.303 | 34.273 | 28.689 |
| PLACE1005232 | 167.040 | 125.455 | 69.019 | 54.944 | 48.079 | 58.072 | 51.258 | 47.854 |
| PLACE1005239 | 39.974 | 13.868 | 24.220 | 12.450 | 8.314 | 22.398 | 17.024 | 10.214 |
| PLACE1005243 | 44.314 | 40.194 | 24.574 | 15.713 | 15.164 | 30.409 | 32.149 | 27.769 |
| PLACE1005250 | 16.580 | 27.491 | 8.463 | 9.418 | 9.886 | 6.064 | 14.623 | 19.833 |

TABLE 130-continued

| | | | | | | | | |
|---|---|---|---|---|---|---|---|---|
| PLACE1005261 | 13.408 | 16.822 | 8.222 | 5.682 | 5.972 | 7.195 | 10.054 | 11.287 |
| PLACE1005266 | 20.535 | 27.721 | 31.380 | 28.026 | 16.734 | 16.639 | 19.888 | 14.312 |
| PLACE1005271 | 93.263 | 83.479 | 52.747 | 61.756 | 25.077 | 54.250 | 44.786 | 57.870 |
| PLACE1005217 | 49.402 | 22.460 | 14.621 | 13.425 | 7.075 | 14.242 | 10.306 | 12.244 |
| PLACE1005287 | 22.199 | 38.345 | 37.586 | 27.355 | 20.932 | 23.076 | 24.235 | 32.916 |
| PLACE1005299 | 103.926 | 106.254 | 44.038 | 32.012 | 31.443 | 51.044 | 46.947 | 40.737 |
| PLACE1005305 | 31.910 | 44.987 | 25.573 | 14.702 | 9.928 | 36.933 | 23.937 | 7.784 |
| PLACE1005307 | 8.172 | 12.030 | 16.098 | 3.745 | 9.584 | 6.781 | 7.722 | 11.443 |
| PLACE1005308 | 40.902 | 25.016 | 19.027 | 14.696 | 9.927 | 17.505 | 29.543 | 18.123 |
| PLACE1005313 | 39.342 | 24.175 | 12.571 | 9.132 | 10.374 | 15.637 | 19.991 | 21.756 |
| PLACE1005320 | 11.271 | 17.455 | 5.231 | 8.538 | 6.936 | 8.957 | 11.506 | 3.500 |
| PLACE1005327 | 17.688 | 40.290 | 17.575 | 16.817 | 11.658 | 12.028 | 22.217 | 11.328 |
| PLACE1005331 | 53.315 | 18.698 | 8.600 | 7.329 | 10.301 | 14.685 | 21.018 | 30.181 |
| PLACE1005335 | 77.870 | 63.026 | 41.750 | 23.138 | 24.128 | 41.168 | 47.208 | 30.379 |
| PLACE1005336 | 21.324 | 20.435 | 19.530 | 20.249 | 15.524 | 17.918 | 9.870 | 18.733 |
| PLACE1005351 | 322.456 | 95.522 | 98.703 | 40.129 | 88.620 | 198.287 | 224.069 | 67.745 |
| PLACE1005366 | 43.968 | 40.039 | 29.574 | 12.918 | 26.291 | 12.458 | 22.106 | 17.170 |
| PLACE1005373 | 45.621 | 33.656 | 36.861 | 29.023 | 24.691 | 30.472 | 35.702 | 32.653 |
| PLACE1005374 | 65.634 | 77.534 | 33.162 | 35.300 | 28.763 | 35.173 | 31.282 | 34.469 |

TABLE 131

| | | | | | | | | |
|---|---|---|---|---|---|---|---|---|
| PLACE1005383 | 192.459 | 99.179 | 41.513 | 26.019 | 36.659 | 74.701 | 68.796 | 45.274 |
| PLACE1005388 | 13.492 | 3.669 | 17.165 | 2.620 | 2.702 | 5.416 | 5.640 | 1.066 |
| PLACE1005409 | 90.786 | 74.023 | 54.915 | 55.853 | 33.620 | 40.200 | 37.456 | 42.420 |
| PLACE1005410 | 46.290 | 42.715 | 17.237 | 13.377 | 5.674 | 22.632 | 23.974 | 18.411 |
| PLACE1005426 | 9.681 | 34.075 | 23.696 | 8.178 | 19.395 | 33.771 | 55.787 | 18.201 |
| PLACE1005431 | 31.798 | 52.111 | 24.865 | 17.489 | 30.465 | 29.753 | 21.758 | 27.288 |
| PLACE1005453 | 73.901 | 79.686 | 50.868 | 59.367 | 41.772 | 40.635 | 21.743 | 44.958 |
| PLACE1005467 | 53.538 | 58.699 | 26.287 | 26.884 | 22.037 | 19.003 | 24.688 | 36.491 |
| PLACE1005471 | 14.111 | 22.568 | 10.718 | 9.783 | 3.667 | 5.561 | 7.986 | 9.066 |
| PLACE1005476 | 19.213 | 15.401 | 6.820 | 10.474 | 5.214 | 8.066 | 10.246 | 12.895 |
| PLACE1005477 | 44.904 | 32.541 | 21.171 | 12.649 | 22.905 | 16.973 | 12.374 | 11.640 |
| PLACE1005480 | 15.176 | 15.901 | 13.557 | 7.819 | 5.374 | 9.674 | 14.794 | 13.766 |
| PLACE1005481 | 38.954 | 28.423 | 22.694 | 20.287 | 10.897 | 21.409 | 20.874 | 20.662 |
| PLACE1005494 | 3.769 | 10.339 | 4.444 | 0.960 | 2.290 | 3.620 | 3.635 | 4.680 |
| PLACE1005495 | 66.611 | 51.739 | 18.659 | 10.826 | 24.448 | 36.783 | 41.876 | 19.394 |
| PLACE1005491 | 225.229 | 70.178 | 56.698 | 22.970 | 70.611 | 95.227 | 102.253 | 52.394 |
| PLACE1005499 | 34.460 | 64.292 | 20.603 | 24.590 | 10.840 | 16.074 | 28.756 | 44.984 |
| PLACE1005502 | 23.366 | 16.975 | 25.072 | 11.122 | 8.644 | 11.079 | 6.947 | 13.065 |
| PLACE1005513 | 9.578 | 9.101 | 6.647 | 6.693 | 5.372 | 7.954 | 6.929 | 7.661 |
| PLACE1005515 | 26.055 | 17.913 | 14.409 | 7.630 | 7.031 | 15.665 | 20.130 | 18.654 |
| PLACE1005519 | 3.105 | 10.749 | 5.162 | 20.785 | 2.814 | 7.220 | 6.981 | 11.525 |
| PLACE1005526 | 20.332 | 17.208 | 9.755 | 7.461 | 4.693 | 10.134 | 18.343 | 11.671 |
| PLACE1005528 | 135.917 | 114.261 | 73.561 | 90.213 | 64.605 | 59.074 | 53.101 | 76.549 |
| PLACE1005530 | 57.987 | 54.808 | 31.774 | 14.143 | 29.079 | 35.603 | 50.048 | 45.019 |
| PLACE1005536 | 46.147 | 63.002 | 37.450 | 8.267 | 20.956 | 24.988 | 38.856 | 33.023 |
| PLACE1005539 | 124.764 | 33.255 | 11.994 | 7.356 | 5.220 | 14.637 | 17.879 | 10.020 |
| PLACE1005543 | 44.082 | 34.128 | 18.253 | 25.879 | 12.291 | 14.141 | 13.931 | 20.699 |
| PLACE1005544 | 74.900 | 40.457 | 28.887 | 25.245 | 13.758 | 39.328 | 41.210 | 26.735 |
| PLACE1005550 | 6.022 | 18.709 | 6.562 | 8.947 | 5.166 | 11.247 | 11.859 | 13.763 |
| PLACE1005554 | 12.467 | 3.872 | 4.316 | 3.594 | 5.956 | 4.592 | 6.885 | 7.371 |
| PLACE1005557 | 38.341 | 19.894 | 13.342 | 7.004 | 10.123 | 21.314 | 24.623 | 20.113 |
| PLACE1005563 | 49.466 | 30.178 | 12.647 | 9.014 | 15.593 | 21.940 | 32.864 | 20.002 |
| PLACE1005569 | 45.144 | 91.673 | 20.105 | 17.832 | 17.112 | 30.056 | 27.968 | 27.306 |
| PLACE1005574 | 10.326 | 17.415 | 23.239 | 15.035 | 8.433 | 11.642 | 6.292 | 7.748 |
| PLACE1005584 | 1.575 | 8.124 | 2.743 | 4.127 | 1.246 | 5.392 | 10.776 | 8.407 |
| PLACE1005590 | 24.799 | 17.304 | 10.072 | 5.828 | 8.195 | 75.095 | 45.627 | 11.276 |
| PLACE1005595 | 23.048 | 17.414 | 15.297 | 11.536 | 9.204 | 8.707 | 25.759 | 17.524 |
| PLACE1005601 | 19.725 | 11.146 | 9.146 | 9.258 | 6.390 | 6.373 | 13.351 | 11.411 |
| PLACE1005603 | 14.600 | 11.398 | 6.074 | 3.038 | 7.570 | 5.089 | 9.929 | 9.078 |
| PLACE1005604 | 41.213 | 46.409 | 18.486 | 29.843 | 23.139 | 24.076 | 25.335 | 30.827 |
| PLACE1005611 | 8.443 | 24.450 | 16.274 | 16.607 | 8.553 | 5.155 | 7.288 | 14.586 |
| PLACE1005622 | 16.882 | 8.675 | 10.537 | 8.137 | 6.368 | 11.349 | 12.772 | 6.731 |
| PLACE1005623 | 14.421 | 31.080 | 6.381 | 15.139 | 12.715 | 20.665 | 16.500 | 16.140 |
| PLACE1005630 | 85.952 | 39.001 | 28.845 | 20.191 | 32.625 | 41.980 | 48.174 | 23.375 |
| PLACE1005639 | 15.544 | 15.138 | 6.500 | 11.153 | 7.691 | 5.800 | 12.445 | 10.861 |
| PLACE1005646 | 77.577 | 49.170 | 33.499 | 22.814 | 34.067 | 36.568 | 56.286 | 41.027 |
| PLACE1005641 | 24.882 | 24.864 | 4.274 | 2.435 | 2.081 | 11.277 | 81.858 | 11.666 |
| PLACE1005648 | 132.845 | 151.402 | 77.779 | 90.885 | 75.286 | 60.577 | 62.598 | 76.522 |
| PLACE1005653 | 54.214 | 52.101 | 51.513 | 45.050 | 58.871 | 26.470 | 27.046 | 42.423 |
| PLACE1005656 | 10.886 | 10.384 | 4.581 | 6.961 | 7.146 | 4.012 | 9.841 | 4.680 |
| PLACE1005659 | 66.511 | 28.923 | 22.280 | 14.717 | 20.121 | 25.706 | 37.588 | 18.352 |
| PLACE1005660 | 33.206 | 32.856 | 16.502 | 12.470 | 13.584 | 17.875 | 18.205 | 12.323 |
| PLACE1005664 | 111.456 | 61.079 | 40.142 | 92.126 | 42.582 | 52.037 | 69.703 | 37.257 |
| PLACE1005668 | 38.297 | 57.391 | 31.059 | 37.247 | 32.602 | 19.836 | 29.982 | 27.528 |

TABLE 131-continued

| | | | | | | | | |
|---|---|---|---|---|---|---|---|---|
| PLACE1005669 | 21.571 | 38.576 | 14.288 | 21.325 | 13.912 | 15.528 | 26.157 | 24.222 |
| PLACE1005682 | 20.262 | 22.261 | 10.868 | 8.411 | 10.729 | 18.322 | 24.974 | 10.469 |
| PLACE1005698 | 30.653 | 32.169 | 14.400 | 9.396 | 8.522 | 24.009 | 33.881 | 18.345 |
| PLACE1005708 | 70.622 | 71.219 | 28.705 | 19.111 | 20.312 | 39.593 | 64.431 | 43.104 |
| PLACE1005725 | 37.970 | 40.199 | 18.153 | 10.564 | 8.703 | 16.434 | 20.139 | 15.072 |
| PLACE1005727 | 10.738 | 20.546 | 10.306 | 14.533 | 4.877 | 13.636 | 6.798 | 18.026 |
| PLACE1005730 | 31.961 | 20.066 | 19.504 | 9.010 | 12.411 | 18.589 | 28.621 | 15.178 |
| PLACE1005736 | 66.424 | 61.842 | 32.233 | 33.306 | 29.857 | 36.600 | 35.215 | 42.162 |
| PLACE1005739 | 28.978 | 27.513 | 14.370 | 8.219 | 7.550 | 14.009 | 24.000 | 20.049 |
| PLACE1005745 | 11.469 | 35.015 | 10.673 | 20.167 | 15.864 | 28.058 | 24.092 | 16.469 |

TABLE 132

| | | | | | | | | |
|---|---|---|---|---|---|---|---|---|
| PLACE1005752 | 90.237 | 41.210 | 18.989 | 8.672 | 12.425 | 46.493 | 43.056 | 16.151 |
| PLACE1005755 | 1.539 | 0.000 | 4.104 | 1.918 | 1.510 | 0.000 | 5.784 | 2.632 |
| PLACE1005756 | 66.572 | 57.026 | 70.208 | 18.341 | 53.529 | 53.169 | 52.915 | 28.510 |
| PLACE1005760 | 79.900 | 86.243 | 41.942 | 41.317 | 39.086 | 38.946 | 63.248 | 58.527 |
| PLACE1005763 | 63.990 | 62.996 | 38.725 | 43.819 | 27.604 | 32.835 | 26.439 | 25.813 |
| PLACE1005768 | 118.359 | 72.826 | 49.483 | 36.802 | 35.749 | 50.090 | 71.856 | 51.056 |
| PLACE1005771 | 79.421 | 64.882 | 40.953 | 41.897 | 27.292 | 23.749 | 34.685 | 36.527 |
| PLACE1005783 | 37.668 | 31.896 | 17.523 | 15.262 | 12.345 | 17.985 | 18.238 | 19.301 |
| PLACE1005799 | 72.863 | 40.078 | 21.736 | 13.084 | 14.828 | 29.177 | 22.331 | 19.278 |
| PLACE1005802 | 6.212 | 17.722 | 27.131 | 6.099 | 7.894 | 19.213 | 7.798 | 5.528 |
| PLACE1005803 | 191.336 | 61.152 | 58.464 | 27.079 | 34.644 | 91.079 | 90.094 | 47.378 |
| PLACE1005804 | 16.294 | 18.066 | 10.826 | 10.126 | 8.393 | 9.317 | 16.782 | 14.973 |
| PLACE1005813 | 75.551 | 91.851 | 75.766 | 52.294 | 39.477 | 54.790 | 85.201 | 93.066 |
| PLACE1005815 | 83.027 | 75.307 | 35.260 | 46.938 | 32.810 | 18.119 | 30.803 | 97.615 |
| PLACE1005828 | 62.100 | 41.315 | 31.342 | 51.062 | 32.258 | 19.627 | 15.080 | 24.684 |
| PLACE1005833 | 15.481 | 278.446 | 15.416 | 31.374 | 13.721 | 24.043 | 14.331 | 47.385 |
| PLACE1005834 | 3.601 | 10.543 | 9.859 | 8.251 | 9.385 | 7.823 | 3.972 | 10.785 |
| PLACE1005835 | 28.240 | 44.997 | 17.530 | 13.182 | 10.234 | 18.255 | 20.661 | 15.389 |
| PLACE1005836 | 48.952 | 28.464 | 13.401 | 6.803 | 8.041 | 17.572 | 26.265 | 12.222 |
| PLACE1005845 | 6.922 | 14.049 | 6.527 | 5.977 | 6.557 | 8.274 | 10.956 | 10.665 |
| PLACE1005850 | 60.537 | 40.486 | 33.654 | 29.867 | 33.148 | 24.454 | 29.715 | 24.623 |
| PLACE1005851 | 5.255 | 8.502 | 7.076 | 7.967 | 6.349 | 5.105 | 3.396 | 5.059 |
| PLACE1005856 | 31.514 | 23.792 | 11.829 | 9.889 | 15.184 | 17.753 | 16.532 | 9.402 |
| PLACE1005875 | 18.708 | 26.502 | 13.111 | 7.247 | 11.323 | 7.852 | 8.071 | 10.929 |
| PLACE1005876 | 11.863 | 17.117 | 12.588 | 7.705 | 10.029 | 6.736 | 10.292 | 10.926 |
| PLACE1005878 | 88.082 | 38.409 | 33.471 | 15.538 | 10.872 | 40.432 | 40.415 | 25.582 |
| PLACE1005880 | 13.768 | 23.162 | 13.625 | 7.279 | 4.396 | 7.444 | 9.160 | 8.620 |
| PLACE1005884 | 6.339 | 23.822 | 4.633 | 5.084 | 1.983 | 6.912 | 6.877 | 7.772 |
| PLACE1005890 | 4.217 | 7.720 | 4.562 | 7.386 | 4.165 | 6.206 | 4.379 | 6.062 |
| PLACE1005898 | 49.218 | 42.891 | 38.186 | 23.065 | 31.910 | 31.010 | 30.359 | 26.109 |
| PLACE1005913 | 88.451 | 79.521 | 44.625 | 46.998 | 40.516 | 45.668 | 41.888 | 48.362 |
| PLACE1005921 | 142.054 | 144.941 | 38.273 | 52.037 | 39.062 | 61.467 | 47.211 | 132.279 |
| PLACE1005923 | 63.053 | 60.900 | 27.149 | 27.188 | 17.336 | 25.033 | 14.933 | 34.055 |
| PLACE1005925 | 48.607 | 40.199 | 37.807 | 26.165 | 30.660 | 26.958 | 27.906 | 18.684 |
| PLACE1005927 | 55.705 | 38.194 | 28.923 | 20.495 | 16.164 | 33.843 | 28.337 | 44.414 |
| PLACE1005932 | 9.087 | 16.013 | 5.744 | 4.478 | 1.709 | 3.696 | 5.067 | 7.086 |
| PLACE1005934 | 77.293 | 56.236 | 26.301 | 30.736 | 24.397 | 28.352 | 30.917 | 30.023 |
| PLACE1005936 | 14.496 | 14.255 | 9.508 | 3.415 | 8.672 | 4.033 | 8.619 | 9.076 |
| PLACE1005939 | 123.849 | 544.154 | 42.334 | 146.300 | 50.110 | 131.268 | 94.038 | 701.375 |
| PLACE1005951 | 30.248 | 32.418 | 15.242 | 18.690 | 12.128 | 15.271 | 23.652 | 24.588 |
| PLACE1005953 | 19.693 | 12.970 | 10.718 | 9.877 | 7.414 | 11.462 | 12.609 | 10.525 |
| PLACE1005955 | 28.767 | 19.227 | 16.323 | 8.434 | 5.041 | 17.159 | 19.002 | 18.594 |
| PLACE1005966 | 12.530 | 5.651 | 4.425 | 4.128 | 2.034 | 2.562 | 6.043 | 9.634 |
| PLACE1005968 | 72.025 | 41.312 | 41.089 | 21.486 | 26.270 | 41.994 | 52.960 | 35.566 |
| PLACE1005975 | 25.485 | 32.376 | 26.520 | 59.431 | 24.469 | 21.685 | 13.392 | 59.446 |
| PLACE1005990 | 28.041 | 21.763 | 14.040 | 6.899 | 9.815 | 14.633 | 20.007 | 16.121 |
| PLACE1005997 | 164.708 | 330.084 | 53.780 | 239.364 | 63.798 | 139.506 | 181.530 | 287.794 |
| PLACE1006002 | 107.705 | 119.425 | 99.629 | 95.897 | 48.384 | 50.827 | 42.380 | 62.761 |
| PLACE1006003 | 17.046 | 17.747 | 14.438 | 8.154 | 10.541 | 11.696 | 8.091 | 13.582 |
| PLACE1006011 | 45.672 | 38.018 | 30.702 | 13.512 | 12.435 | 21.558 | 24.215 | 22.424 |
| PLACE1006017 | 45.647 | 36.734 | 21.158 | 25.570 | 11.110 | 78.839 | 15.505 | 19.245 |
| PLACE1006037 | 16.896 | 39.112 | 14.980 | 27.384 | 13.578 | 19.303 | 24.570 | 28.170 |
| PLACE1006040 | 46.354 | 36.477 | 73.887 | 24.327 | 21.931 | 28.327 | 32.651 | 26.980 |
| PLACE1006063 | 93.783 | 71.598 | 45.048 | 18.263 | 32.191 | 49.881 | 45.260 | 38.790 |
| PLACE1006071 | 21.534 | 36.297 | 13.892 | 8.687 | 12.019 | 30.377 | 49.850 | 20.945 |
| PLACE1006073 | 53.828 | 57.305 | 30.172 | 24.545 | 29.043 | 23.961 | 31.954 | 27.041 |
| PLACE1006074 | 20.455 | 27.006 | 16.076 | 13.730 | 10.251 | 15.582 | 20.631 | 17.603 |
| PLACE1006076 | 34.364 | 32.791 | 16.508 | 20.008 | 10.320 | 9.947 | 9.203 | 13.977 |
| PLACE1006079 | 121.353 | 38.429 | 26.815 | 12.301 | 21.503 | 45.204 | 56.632 | 21.554 |
| PLACE1006093 | 19.742 | 15.385 | 13.757 | 9.509 | 7.004 | 12.267 | 13.690 | 14.363 |
| PLACE1006116 | 35.931 | 6.904 | 15.512 | 3.533 | 7.677 | 15.676 | 16.048 | 10.524 |
| PLACE1006119 | 20.068 | 12.984 | 12.327 | 11.130 | 22.090 | 9.808 | 10.787 | 12.644 |
| PLACE1006129 | 48.539 | 31.749 | 9.463 | 11.635 | 17.430 | 20.020 | 41.668 | 19.917 |
| PLACE1006139 | 91.126 | 109.499 | 54.407 | 53.695 | 49.471 | 92.100 | 63.259 | 79.774 |

TABLE 133

| | | | | | | | | |
|---|---|---|---|---|---|---|---|---|
| PLACE1006143 | 46.098 | 37.379 | 20.702 | 25.574 | 15.236 | 19.435 | 15.116 | 22.985 |
| PLACE1006157 | 13.931 | 16.377 | 3.826 | 8.200 | 5.712 | 12.370 | 15.306 | 9.581 |
| PLACE1006159 | 9.858 | 20.502 | 51.646 | 6.722 | 44.269 | 12.185 | 22.648 | 13.267 |
| PLACE1006164 | 16.798 | 16.274 | 7.126 | 6.999 | 8.372 | 7.194 | 8.960 | 10.950 |
| P1ACE1006167 | 167.052 | 67.298 | 52.083 | 32.075 | 42.820 | 71.882 | 95.636 | 56.466 |
| PLACE1006170 | 53.027 | 29.665 | 19.393 | 10.419 | 17.774 | 25.072 | 30.851 | 21.127 |
| PLACE1006181 | 18.281 | 16.157 | 7.996 | 5.350 | 25.260 | 14.174 | 22.113 | 14.042 |
| PLACE1006187 | 8.548 | 3.516 | 0.000 | 6.682 | 4.886 | 7.985 | 6.385 | 7.927 |
| PLACE1006195 | 29.846 | 28.480 | 17.352 | 16.886 | 13.459 | 17.228 | 26.763 | 6.398 |
| PLACE1006196 | 61.991 | 49.016 | 26.372 | 19.718 | 27.710 | 39.072 | 35.118 | 29.050 |
| PLACE1006197 | 54.536 | 37.860 | 28.958 | 22.575 | 23.293 | 25.482 | 39.927 | 23.557 |
| PLACE1006198 | 28.596 | 28.607 | 16.575 | 17.769 | 13.452 | 15.976 | 27.459 | 22.547 |
| PLACE1006205 | 6.745 | 7.609 | 4.565 | 5.214 | 6.572 | 2.590 | 4.973 | 5.687 |
| PLACE1006208 | 27.187 | 27.254 | 9.873 | 14.328 | 12.512 | 21.992 | 19.863 | 18.823 |
| PLACE1006211 | 51.907 | 59.414 | 30.208 | 13.725 | 28.133 | 32.360 | 44.159 | 27.440 |
| PLACE1006219 | 23.493 | 24.408 | 16.455 | 9.362 | 17.274 | 26.290 | 25.586 | 21.714 |
| PLACE1006223 | 68.934 | 18.764 | 11.909 | 9.616 | 10.504 | 6.495 | 11.267 | 10.706 |
| PLACE1006225 | 11.501 | 12.439 | 4.415 | 6.582 | 6.792 | 8.314 | 14.745 | 11.878 |
| PLACE1006236 | 6.977 | 12.900 | 5.853 | 11.342 | 12.529 | 5.324 | 7.920 | 11.191 |
| PLACE1006239 | 22.381 | 23.765 | 14.765 | 10.878 | 15.210 | 13.043 | 19.412 | 11.809 |
| PLACE1006245 | 22.376 | 34.520 | 10.634 | 11.051 | 12.665 | 11.374 | 19.724 | 21.305 |
| PLACE1006246 | 7.382 | 13.028 | 11.301 | 7.187 | 12.507 | 7.382 | 11.506 | 12.804 |
| PLACE1006248 | 26.428 | 39.894 | 16.473 | 21.809 | 14.977 | 13.745 | 20.862 | 22.348 |
| PLACE1006262 | 31.261 | 23.190 | 19.574 | 15.195 | 26.025 | 14.627 | 19.352 | 15.266 |
| PLACE1006269 | 24.853 | 29.569 | 14.626 | 9.583 | 8.703 | 14.129 | 23.157 | 18.545 |
| PLACE1006275 | 102.949 | 70.174 | 48.183 | 23.852 | 33.229 | 45.824 | 59.434 | 33.371 |
| PLACE1006277 | 48.240 | 62.171 | 21.255 | 16.104 | 9.445 | 23.300 | 38.264 | 21.261 |
| PLACE1006288 | 70.893 | 32.184 | 31.657 | 17.185 | 23.905 | 32.558 | 35.514 | 20.818 |
| PLACE1006290 | 10.445 | 14.155 | 12.302 | 10.566 | 8.624 | 8.747 | 18.914 | 10.719 |
| PLACE1OO6298 | 31.578 | 46.118 | 32.460 | 28.976 | 15.993 | 23.096 | 26.422 | 37.543 |
| PLACE1006311 | 10.845 | 53.957 | 4.561 | 9.947 | 4.631 | 5.498 | 6.778 | 11.014 |
| PLACE1006318 | 58.445 | 16.244 | 19.191 | 15.551 | 8.313 | 29.532 | 32.903 | 13.674 |
| PLACE1006325 | 22.893 | 33.926 | 3.989 | 1.894 | 3.728 | 40.444 | 14.737 | 21.889 |
| PLACE1006331 | 8.939 | 11.370 | 13.783 | 13.776 | 7.560 | 9.956 | 11.998 | 18.468 |
| PLACE1006335 | 32.529 | 28.387 | 14.713 | 11.425 | 11.019 | 17.865 | 33.894 | 21.152 |
| PLACE1006357 | 3.825 | 9.950 | 6.210 | 4.159 | 6.022 | 6.747 | 7.754 | 5.087 |
| PLACE1006360 | 14.089 | 16.595 | 24.796 | 8.248 | 22.949 | 14.298 | 13.022 | 11.859 |
| PLACE1006364 | 50.974 | 44.777 | 21.918 | 23.821 | 14.219 | 27.483 | 47.224 | 26.302 |
| PLACE1006365 | 13.302 | 9.969 | 13.635 | 9.061 | 14.422 | 9.214 | 21.696 | 7.466 |
| PLACE1006368 | 46.065 | 73.155 | 26.650 | 24.050 | 13.240 | 24.936 | 34.207 | 27.153 |
| PLACE1006371 | 34.894 | 28.248 | 11.313 | 5.383 | 9.407 | 18.791 | 14.801 | 7.990 |
| PLACE1005373 | 37.194 | 28.331 | 21.043 | 14.199 | 14.482 | 19.388 | 19.815 | 15.474 |
| PLACE1006382 | 21.094 | 19.698 | 15.454 | 9.638 | 8.482 | 4.374 | 23.912 | 14.924 |
| PLACE1006385 | 81.993 | 38.251 | 25.850 | 13.853 | 17.987 | 36.061 | 46.518 | 25.400 |
| PLACE1006391 | 24.973 | 39.657 | 15.251 | 12.115 | 12.857 | 15.718 | 29.802 | 21.518 |
| PLACE1006412 | 92.185 | 81.544 | 52.558 | 67.133 | 44.434 | 40.171 | 51.400 | 52.505 |
| PLACE1006414 | 22.869 | 15.684 | 6.074 | 8.725 | 2.933 | 4.693 | 8.944 | 10.166 |
| PLACE1006419 | 61.800 | 27.143 | 19.239 | 15.038 | 20.825 | 26.734 | 24.227 | 27.471 |
| PLACE1006438 | 82.798 | 38.554 | 34.340 | 20.259 | 23.756 | 34.334 | 48.209 | 27.402 |
| PLACE1006443 | 215.537 | 110.762 | 106.123 | 67.312 | 72.074 | 128.015 | 104.908 | 86.500 |
| PLACE1006445 | 11.757 | 18.560 | 10.002 | 8.147 | 6.187 | 5.719 | 13.324 | 13.219 |
| PLACE1006447 | 27.394 | 37.610 | 21.247 | 25.976 | 17.672 | 52.681 | 107.122 | 22.397 |
| PLACE1006466 | 16.826 | 15.029 | 9.777 | 6.348 | 6.589 | 37.897 | 68.487 | 10.963 |
| PLACE1006469 | 114.915 | 41.384 | 25.605 | 23.261 | 24.572 | 43.598 | 56.094 | 27.697 |
| PLACE1006470 | 55.482 | 77.949 | 32.199 | 34.721 | 19.002 | 28.695 | 34.080 | 43.083 |
| PLACE1006472 | 28.012 | 90.945 | 17.951 | 34.982 | 34.443 | 50.263 | 43.401 | 25.783 |
| PLACE1006476 | 82.952 | 54.658 | 25.673 | 33.003 | 18.685 | 19.667 | 20.505 | 28.511 |
| PLACE1006482 | 37.848 | 28.214 | 30.184 | 15.252 | 21.907 | 16.121 | 16.707 | 16.335 |
| PLACE1006488 | 97.835 | 75.446 | 33.550 | 35.911 | 33.400 | 45.132 | 55.401 | 62.770 |
| PLACE1006492 | 97.220 | 112.335 | 55.156 | 47.821 | 45.198 | 37.895 | 64.975 | 45.897 |
| PLACE1006506 | 10.034 | 13.735 | 10.029 | 17.741 | 10.467 | 11.563 | 6.929 | 9.994 |
| PLACE1005515 | 8.615 | 13.662 | 12.057 | 16.818 | 11.469 | 8.981 | 15.280 | 14.480 |
| PLACE1006516 | 30.098 | 17.795 | 12.792 | 10.123 | 12.004 | 10.884 | 13.079 | 19.137 |
| PLACE1006520 | 38.963 | 54.680 | 36.238 | 25.639 | 24.822 | 21.437 | 19.311 | 31.254 |

TABLE 134

| | | | | | | | | |
|---|---|---|---|---|---|---|---|---|
| PLACE1006521 | 75.538 | 103.128 | 42.948 | 44.567 | 33.031 | 39.882 | 33.174 | 40.181 |
| PLACE1006529 | 53.118 | 57.618 | 37.171 | 32.693 | 19.830 | 30.529 | 24.356 | 58.315 |
| PLACE1006531 | 40.054 | 29.614 | 19.743 | 13.919 | 11.061 | 28.487 | 25.077 | 22.594 |
| PLACE1006534 | 14.806 | 14.541 | 8.631 | 12.208 | 7.086 | 10.456 | 12.140 | 35.132 |
| PLACE1006540 | 111.144 | 85.745 | 65.687 | 62.909 | 47.508 | 47.210 | 44.007 | 49.020 |
| PLACE1006549 | 105.750 | 35.667 | 33.934 | 19.913 | 34.720 | 68.368 | 52.699 | 40.656 |
| PLACE1006550 | 53.734 | 37.476 | 23.619 | 17.863 | 13.277 | 25.245 | 30.050 | 25.681 |
| PLACE1006552 | 36.731 | 63.851 | 24.515 | 30.033 | 16.150 | 29.038 | 26.902 | 30.874 |
| PLACE1006557 | 59.138 | 32.373 | 20.742 | 27.767 | 14.998 | 53.010 | 66.775 | 24.301 |

TABLE 134-continued

| | | | | | | | | |
|---|---|---|---|---|---|---|---|---|
| PLACE1006563 | 12.150 | 25.131 | 12.554 | 16.291 | 12.325 | 21.067 | 6.774 | 21.632 |
| PLACE1006579 | 42.172 | 33.427 | 19.515 | 12.744 | 11.202 | 30.323 | 25.161 | 17.624 |
| PLACE1006594 | 21.308 | 62.751 | 8.959 | 11.953 | 18.053 | 24.751 | 10.056 | 19.854 |
| PLACE1006598 | 38.010 | 39.953 | 22.806 | 22.256 | 14.136 | 17.359 | 14.218 | 22.463 |
| PLACE1006607 | 29.363 | 43.175 | 35.099 | 25.311 | 27.168 | 25.817 | 24.362 | 33.010 |
| PLACE1006610 | 70.554 | 56.140 | 32.568 | 26.861 | 32.156 | 41.824 | 78.456 | 52.541 |
| PLACE1006615 | 66.799 | 84.729 | 48.211 | 42.137 | 41.400 | 36.165 | 33.872 | 68.891 |
| PLACE1006617 | 46.945 | 34.203 | 20.650 | 24.016 | 10.809 | 19.146 | 13.632 | 19.570 |
| PLACE1006618 | 12.467 | 22.675 | 10.936 | 4.988 | 6.177 | 12.939 | 14.170 | 17.583 |
| PLACE1006626 | 28.824 | 22.724 | 12.096 | 14.424 | 6.491 | 15.673 | 20.994 | 16.846 |
| PLACE1006629 | 20.658 | 24.647 | 17.715 | 14.296 | 9.444 | 12.543 | 13.794 | 16.993 |
| PLACE1006637 | 66.018 | 44.385 | 28.310 | 36.165 | 26.370 | 22.102 | 23.886 | 38.003 |
| PLACE1006640 | 1.906 | 3.182 | 1.497 | 1.860 | 2.901 | 12.736 | 2.835 | 3.364 |
| PLACE1006644 | 47.828 | 33.193 | 17.215 | 13.059 | 19.569 | 23.838 | 40.050 | 24.555 |
| PLACE1006657 | 19.786 | 8.124 | 12.247 | 4.403 | 6.268 | 5.198 | 7.763 | 6.121 |
| PLACE1006673 | 45.242 | 43.900 | 31.743 | 33.164 | 17.416 | 21.697 | 21.257 | 29.264 |
| PLACE1006678 | 16.105 | 18.660 | 7.229 | 6.676 | 2.905 | 9.955 | 9.738 | 6.953 |
| PLACE1006682 | 108.821 | 86.487 | 64.876 | 54.439 | 35.908 | 50.796 | 60.748 | 73.192 |
| PLACE1006684 | 12.327 | 5.526 | 1.745 | 4.542 | 2.823 | 4.669 | 8.079 | 6.963 |
| PLACE1006698 | 35.079 | 26.331 | 16.481 | 11.898 | 16.188 | 18.313 | 21.757 | 18.483 |
| PLACE1006704 | 86.472 | 27.708 | 22.553 | 11.168 | 23.040 | 31.772 | 42.206 | 22.041 |
| PLACE1006708 | 63.065 | 64.979 | 29.269 | 36.158 | 32.310 | 29.740 | 35.534 | 34.620 |
| PLACE1006711 | 83.669 | 46.735 | 36.469 | 20.073 | 24.293 | 44.745 | 40.284 | 31.562 |
| PLACE1006714 | 24.897 | 21.232 | 19.709 | 9.911 | 12.634 | 19.601 | 15.694 | 11.421 |
| PLACE1006716 | 43.488 | 17.230 | 9.950 | 6.619 | 9.686 | 25.065 | 16.540 | 13.432 |
| PLACE1006731 | 28.782 | 29.180 | 22.410 | 16.665 | 26.985 | 19.586 | 12.657 | 19.367 |
| PLACE1006754 | 36.921 | 20.331 | 16.512 | 14.887 | 10.304 | 20.093 | 26.461 | 37.338 |
| PLACE1006160 | 37.757 | 42.174 | 22.283 | 15.705 | 21.554 | 21.150 | 17.013 | 41.393 |
| PLACE1006779 | 3.647 | 8.616 | 3.016 | 6.280 | 6.191 | 5.298 | 7.122 | 6.796 |
| PLACE1006782 | 92.507 | 28.870 | 38.409 | 19.483 | 30.410 | 47.327 | 64.324 | 35.890 |
| PLACE1006783 | 27.658 | 31.732 | 12.496 | 14.567 | 10.900 | 18.396 | 16.357 | 16.765 |
| PLACE1006786 | 24.498 | 14.495 | 7.472 | 4.210 | 11.343 | 13.380 | 15.312 | 7.438 |
| PLACE1006792 | 77.449 | 84.545 | 47.367 | 55.539 | 38.143 | 39.428 | 24.476 | 35.695 |
| PLACE1006795 | 9.133 | 4.460 | 1.737 | 2.793 | 3.353 | 3.139 | 2.968 | 3.320 |
| PLACE1006800 | 4.005 | 5.373 | 6.293 | 5.585 | 5.488 | 3.372 | 4.355 | 6.632 |
| PLACE1006805 | 10.412 | 18.118 | 5.886 | 6.406 | 8.461 | 8.216 | 2.942 | 9.555 |
| PLACE1006809 | 42.846 | 42.011 | 18.294 | 14.933 | 24.393 | 18.264 | 52.680 | 31.248 |
| PLACE1006815 | 28.382 | 27.387 | 16.127 | 14.696 | 18.598 | 11.836 | 22.066 | 24.307 |
| PLACE1006819 | 2.234 | 8.095 | 0.000 | 2.742 | 7.006 | 3.430 | 4.844 | 0.000 |
| PLACE1006820 | 88.654 | 108.172 | 51.115 | 52.888 | 36.795 | 40.511 | 48.278 | 48.233 |
| PLACE1006826 | 36.400 | 44.215 | 19.975 | 9.428 | 19.371 | 14.819 | 20.833 | 17.598 |
| PLACE1006829 | 92.548 | 43.863 | 26.240 | 21.591 | 27.592 | 41.457 | 58.358 | 33.442 |
| PLACE1006853 | 36.698 | 17.968 | 19.226 | 51.037 | 13.795 | 25.742 | 31.212 | 23.318 |
| PLACE1006860 | 6.034 | 4.924 | 7.203 | 4.039 | 4.197 | 4.806 | 5.604 | 5.225 |
| PLACE1006867 | 38.603 | 40.857 | 22.938 | 11.226 | 24.586 | 15.186 | 22.604 | 24.184 |
| PLACE1006875 | 22.250 | 34.942 | 8.578 | 8.800 | 8.892 | 8.348 | 13.170 | 11.720 |
| PLACE1006878 | 39.239 | 23.697 | 15.013 | 10.894 | 12.955 | 15.847 | 22.292 | 15.804 |
| PLACE1006883 | 65.288 | 68.499 | 32.894 | 27.525 | 25.683 | 25.744 | 33.055 | 31.151 |
| PLACE1006898 | 7.500 | 7.894 | 4.988 | 7.018 | 5.096 | 6.810 | 8.442 | 10.343 |
| PLACE1006901 | 21.369 | 32.566 | 11.362 | 7.983 | 8.638 | 19.295 | 23.630 | 15.803 |
| PLACE1006904 | 50.887 | 60.723 | 40.359 | 39.241 | 22.863 | 21.440 | 24.218 | 30.368 |
| PLACE1006917 | 15.269 | 18.119 | 4.506 | 8.871 | 9.082 | 12.291 | 14.762 | 18.898 |
| PLACE1005932 | 74.387 | 50.295 | 37.532 | 27.777 | 18.687 | 40.241 | 61.634 | 41.770 |
| PLACE1006935 | 26.622 | 22.255 | 28.033 | 13.044 | 12.097 | 19.289 | 20.081 | 16.451 |
| PLACE1006956 | 46.862 | 37.348 | 13.802 | 17.258 | 7.757 | 23.631 | 21.753 | 16.324 |

TABLE 135

| | | | | | | | | |
|---|---|---|---|---|---|---|---|---|
| PLACE1006958 | 24.224 | 20.988 | 2.886 | 4.740 | 6.547 | 12.414 | 18.682 | 11.106 |
| PLACE1006959 | 18.928 | 26.190 | 17.859 | 8.749 | 10.471 | 20.650 | 31.538 | 10.229 |
| PLACE1006961 | 117.650 | 81.345 | 44.174 | 45.983 | 28.766 | 40.349 | 60.294 | 45.326 |
| PLACE1006962 | 45.285 | 44.217 | 26.483 | 25.012 | 20.091 | 22.762 | 20.963 | 25.186 |
| PLACE1006966 | 28.233 | 14.490 | 13.064 | 8.732 | 12.926 | 14.261 | 20.842 | 9.575 |
| PLACE1006579 | 17.727 | 17.092 | 9.075 | 8.221 | 7.257 | 14.248 | 14.630 | 10.668 |
| PLACE1006989 | 32.865 | 52.943 | 17.860 | 11.639 | 7.697 | 14.839 | 32.067 | 28.756 |
| PLACE1007001 | 63.189 | 31.010 | 16.872 | 11.652 | 13.459 | 33.428 | 28.562 | 26.941 |
| PLACE1007014 | 92.804 | 49.098 | 38.389 | 21.381 | 19.097 | 50.704 | 38.424 | 25.032 |
| PLACE1007021 | 32.615 | 23.234 | 9.800 | 10.544 | 10.271 | 12.863 | 18.290 | 11.436 |
| PLACE1007026 | 6.113 | 17.016 | 5.244 | 5.923 | 5.797 | 4.186 | 5.493 | 10.123 |
| PLACE1007028 | 32.763 | 23.055 | 16.841 | 11.266 | 15.159 | 13.728 | 15.276 | 14.576 |
| PLACE1007038 | 326.043 | 1311.392 | 60.986 | 281.140 | 73.181 | 232.551 | 242.218 | 1764.485 |
| PLACE1007040 | 29.591 | 22.423 | 21.374 | 13.642 | 14.126 | 14.427 | 15.726 | 19.822 |
| PLACE1007045 | 78.257 | 39.847 | 30.571 | 22.858 | 23.390 | 22.928 | 15.061 | 21.566 |
| PLACE1007048 | 122.391 | 230.938 | 512.462 | 376.525 | 527.636 | 419.669 | 96.387 | 239.735 |
| PLACE1007053 | 25.010 | 19.115 | 11.205 | 9.097 | 8.179 | 14.765 | 16.384 | 14.731 |
| PLACE1007068 | 99.855 | 72.463 | 39.350 | 24.132 | 16.753 | 40.977 | 65.159 | 29.062 |

TABLE 135-continued

| | | | | | | | | |
|---|---|---|---|---|---|---|---|---|
| PLACE1007070 | 18.155 | 27.141 | 16.021 | 17.985 | 10.589 | 22.789 | 20.149 | 22.755 |
| PLACE1007076 | 36.900 | 36.555 | 20.522 | 28.282 | 20.816 | 24.263 | 20.952 | 30.465 |
| PLACE1007077 | 45.865 | 32.193 | 19.090 | 3.110 | 15.647 | 30.538 | 45.495 | 14.900 |
| PLACE1007081 | 5.244 | 5.196 | 3.378 | 1.304 | 2.199 | 3.337 | 3.589 | 2.171 |
| PLACE1007082 | 55.736 | 39.537 | 14.678 | 18.774 | 16.347 | 23.666 | 45.049 | 21.718 |
| PLACE1007092 | 16.389 | 10.500 | 7.344 | 11.776 | 17.009 | 14.076 | 7.700 | 7.525 |
| PLACE1007096 | 46.332 | 24.876 | 22.197 | 12.502 | 9.398 | 24.039 | 25.213 | 11.883 |
| PLACE1007097 | 34.116 | 23.336 | 12.085 | 13.012 | 5.587 | 12.093 | 31.892 | 15.157 |
| PLACE1007099 | 57.957 | 45.253 | 26.945 | 15.165 | 13.161 | 35.273 | 26.948 | 25.079 |
| PLACE1007105 | 28.626 | 17.036 | 14.234 | 9.973 | 8.933 | 12.114 | 17.885 | 14.722 |
| PLACE1007108 | 41.006 | 85.910 | 11.197 | 12.028 | 13.853 | 86.217 | 130.751 | 40.877 |
| PLACE1007111 | 8.964 | 10.681 | 5.940 | 7.255 | 7.501 | 9.749 | 5.640 | 8.886 |
| PLACE1007112 | 30.195 | 16.582 | 14.410 | 10.804 | 11.077 | 14.707 | 17.795 | 20.354 |
| PLACE1007130 | 11.359 | 6.838 | 5.607 | 4.816 | 2.918 | 3.208 | 6.435 | 5.903 |
| PLACE1007132 | 68.292 | 55.387 | 61.678 | 43.595 | 44.456 | 42.578 | 73.359 | 40.514 |
| PLACE1007140 | 24.801 | 47.103 | 18.726 | 21.699 | 14.109 | 24.706 | 33.892 | 29.052 |
| PLACE1007143 | 27.771 | 21.700 | 13.298 | 16.396 | 7.325 | 14.674 | 16.496 | 15.455 |
| PLACE1007169 | 21.059 | 24.932 | 10.043 | 15.314 | 10.493 | 14.373 | 24.878 | 12.622 |
| PLACE1007178 | 29.316 | 18.952 | 15.204 | 8.851 | 14.010 | 19.633 | 12.459 | 9.702 |
| PLACE1007190 | 28.853 | 21.235 | 6.481 | 10.255 | 7.822 | 10.991 | 13.037 | 15.192 |
| PLACE1007201 | 20.919 | 11.754 | 12.200 | 7.867 | 9.329 | 15.651 | 0.737 | 9.150 |
| PLACE1007202 | 75.891 | 83.211 | 41.376 | 35.864 | 26.097 | 42.107 | 8.498 | 71.342 |
| PLACE1007226 | 38.727 | 32.391 | 24.013 | 15.641 | 12.748 | 28.566 | 20.020 | 22.254 |
| PLACE1007238 | 37.920 | 27.260 | 52.707 | 11.101 | 5.882 | 19.768 | 19.683 | 17.554 |
| PLACE1007239 | 25.792 | 17.879 | 12.822 | 11.697 | 11.572 | 18.220 | 21.634 | 16.456 |
| PLACE1007242 | 30.312 | 21.645 | 13.524 | 8.187 | 7.387 | 15.238 | 18.734 | 11.918 |
| PLACE1007243 | 15.786 | 6.525 | 8.256 | 6.326 | 5.657 | 7.341 | 10.310 | 9.966 |
| PLACE1007247 | 47.743 | 24.409 | 31.744 | 16.238 | 32.693 | 32.792 | 30.910 | 21.768 |
| PLACE1007257 | 50.989 | 45.094 | 26.453 | 23.676 | 21.435 | 26.525 | 35.446 | 30.498 |
| PLACE1007274 | 63.868 | 57.917 | 46.739 | 45.986 | 28.012 | 27.790 | 32.367 | 40.126 |
| PLACE1007276 | 45.004 | 47.623 | 29.716 | 29.699 | 15.514 | 21.277 | 23.689 | 25.771 |
| PLACE1007282 | 51.770 | 26.821 | 22.456 | 16.571 | 9.849 | 43.054 | 30.862 | 14.968 |
| PLACE1007286 | 51.312 | 41.826 | 34.573 | 41.722 | 19.403 | 28.174 | 21.307 | 30.962 |
| PLACE1007296 | 8.691 | 28.816 | 22.924 | 7.019 | 9.655 | 18.375 | 19.761 | 16.151 |
| PLACE1007301 | 14.846 | 7.597 | 2.854 | 7.648 | 4.229 | 5.900 | 6.990 | 4.970 |
| PLACE1007314 | 170.251 | 163.936 | 56.463 | 38.977 | 43.654 | 76.971 | 91.606 | 68.061 |
| PLACE1007317 | 7.805 | 11.960 | 5.840 | 5.398 | 4.800 | 9.797 | 18.145 | 7.716 |
| PLACE1007329 | 22.649 | 18.115 | 14.302 | 12.544 | 11.135 | 12.522 | 26.259 | 13.018 |
| PLACE1007338 | 32.760 | 36.157 | 17.328 | 12.019 | 11.239 | 16.157 | 19.433 | 12.376 |
| PLACE1007342 | 35.584 | 25.027 | 13.466 | 10.077 | 8.452 | 19.638 | 24.471 | 16.054 |
| PLACE1007345 | 27.643 | 23.135 | 8.538 | 8.998 | 9.212 | 19.233 | 18.792 | 14.508 |
| PLACE1007346 | 84.876 | 67.312 | 49.862 | 48.124 | 36.586 | 44.530 | 49.735 | 51.509 |
| PLACE1007359 | 41.334 | 34.842 | 12.894 | 10.401 | 10.905 | 16.783 | 28.957 | 21.056 |
| PLACE1007367 | 120.915 | 119.906 | 57.724 | 73.270 | 55.553 | 44.404 | 58.114 | 52.219 |
| PLACE1007375 | 14.867 | 27.740 | 13.196 | 6.713 | 11.526 | 13.015 | 22.797 | 19.523 |
| PLACE1007377 | 44.023 | 32.953 | 18.430 | 10.505 | 15.018 | 23.300 | 20.623 | 14.853 |

TABLE 136

| | | | | | | | | |
|---|---|---|---|---|---|---|---|---|
| PLACE1007386 | 18.828 | 87.737 | 1.254 | 10.203 | 6.191 | 27.672 | 67.719 | 218.918 |
| PLACE1007392 | 8.222 | 11.434 | 10.749 | 9.637 | 5.668 | 4.825 | 14.652 | 34.452 |
| PLACE1007402 | 65.108 | 33.760 | 18.689 | 10.518 | 17.357 | 31.450 | 39.891 | 22.559 |
| PLACE1001409 | 9.770 | 9.329 | 3.971 | 4.482 | 6.413 | 5.266 | 14.242 | 6.437 |
| PLACE1007416 | 27.738 | 14.552 | 13.712 | 11.561 | 17.284 | 15.858 | 12.261 | 11.200 |
| PLACE1007420 | 46.820 | 65.531 | 26.848 | 15.727 | 22.458 | 25.870 | 29.321 | 26.656 |
| PLACE1007431 | 19.972 | 36.820 | 4.499 | 11.250 | 12.525 | 8.981 | 18.986 | 18.539 |
| PLACE1007450 | 45.777 | 50.126 | 22.855 | 30.226 | 21.905 | 18.828 | 17.972 | 24.671 |
| PLACE1007452 | 33.958 | 46.157 | 8.675 | 25.984 | 25.596 | 10.982 | 23.901 | 19.624 |
| PLACE1007454 | 73.816 | 122.886 | 31.320 | 44.109 | 41.875 | 41.307 | 59.818 | 59.212 |
| PLACE1007460 | 46.871 | 45.449 | 25.529 | 18.180 | 20.772 | 23.068 | 34.418 | 21.265 |
| PLACE1007478 | 30.938 | 25.400 | 12.040 | 19.617 | 18.742 | 17.249 | 22.181 | 21.235 |
| PLACE1007484 | 35.483 | 18.194 | 16.643 | 12.842 | 15.645 | 21.889 | 39.282 | 17.141 |
| PLACE1007488 | 12.070 | 11.216 | 5.905 | 2.621 | 6.264 | 5.521 | 13.139 | 9.035 |
| PLACE1007507 | 16.065 | 19.266 | 11.755 | 10.003 | 10.052 | 11.006 | 19.984 | 19.609 |
| PLACEI007511 | 12.031 | 9.468 | 5.676 | 5.965 | 5.991 | 6.407 | 13.848 | 8.173 |
| PLACE1007513 | 28.839 | 33.816 | 17.234 | 10.351 | 5.817 | 26.217 | 25.383 | 15.457 |
| PLACE1007524 | 31.989 | 52.731 | 17.490 | 18.194 | 13.641 | 11.134 | 17.227 | 20.016 |
| PLACE1007525 | 53.144 | 47.497 | 20.989 | 29.065 | 21.557 | 14.406 | 17.969 | 19.213 |
| PLACE1007537 | 114.162 | 62.590 | 29.450 | 28.798 | 42.322 | 39.868 | 74.479 | 42.203 |
| PLACE1007544 | 13.698 | 23.058 | 10.584 | 10.736 | 6.412 | 6.388 | 19.809 | 12.059 |
| PLACE1007547 | 34.533 | 43.022 | 15.777 | 19.820 | 14.818 | 10.460 | 22.065 | 27.725 |
| PLACE1007557 | 68.240 | 54.730 | 20.858 | 22.219 | 17.520 | 22.378 | 30.659 | 28.149 |
| PLACE1007560 | 56.701 | 37.749 | 42.477 | 13.441 | 33.714 | 29.243 | 17.177 | 19.085 |
| PLACE1007565 | 19.954 | 13.569 | 9.536 | 4.633 | 3.515 | 11.734 | 10.232 | 6.747 |
| PLACE1007580 | 5.661 | 16.015 | 3.081 | 3.286 | 2.111 | 3.703 | 7.852 | 3.004 |
| PLACE1007583 | 21.325 | 12.320 | 19.036 | 4.553 | 5.377 | 21.293 | 19.488 | 5.045 |

TABLE 136-continued

| | | | | | | | | |
|---|---|---|---|---|---|---|---|---|
| PLACE1007591 | 23.357 | 23.264 | 12.980 | 17.204 | 13.786 | 15.975 | 15.980 | 13.540 |
| PLACE1007598 | 10.914 | 22.683 | 12.140 | 19.473 | 7.678 | 9.978 | 10.043 | 33.199 |
| PLACE1007610 | 8.777 | 5.574 | 4.440 | 3.931 | 0.000 | 4.051 | 14.144 | 7.161 |
| PLACE1007618 | 27.729 | 17.405 | 12.198 | 7.493 | 7.679 | 9.540 | 14.682 | 10.695 |
| PLACE1007621 | 127.255 | 33.162 | 30.450 | 23.070 | 22.170 | 28.865 | 21.828 | 41.949 |
| PLACE1007626 | 52.820 | 41.475 | 28.151 | 29.773 | 20.867 | 60.602 | 51.332 | 54.570 |
| PLACE1007632 | 59.751 | 36.549 | 27.076 | 16.433 | 16.357 | 35.583 | 30.758 | 23.467 |
| PLACE1007635 | 54.365 | 34.862 | 13.465 | 8.465 | 10.812 | 17.884 | 31.723 | 24.074 |
| PLACE1007645 | 36.884 | 32.380 | 12.803 | 11.465 | 4.647 | 16.976 | 17.366 | 15.901 |
| PLACE1007649 | 22.119 | 4.188 | 5.061 | 14.689 | 4.509 | 20.917 | 21.502 | 5.164 |
| PLACE1007659 | 68.472 | 46.570 | 26.862 | 59.476 | 24.769 | 18.505 | 25.281 | 32.267 |
| PLACE1007669 | 68.844 | 76.485 | 26.431 | 38.944 | 24.278 | 27.709 | 17.065 | 31.698 |
| PLACE1007677 | 36.578 | 30.684 | 12.552 | 23.334 | 10.440 | 22.611 | 14.842 | 25.043 |
| PLACE1007688 | 56.110 | 18.042 | 22.153 | 6.473 | 14.256 | 12.150 | 17.233 | 6.418 |
| PLACE1007690 | 6.860 | 17.051 | 10.688 | 8.318 | 11.590 | 6.899 | 7.099 | 22.589 |
| PLACE1007697 | 12.184 | 6.551 | 4.310 | 0.941 | 2.439 | 6.854 | 5.985 | 3.880 |
| PLACE1007702 | 60.683 | 12.143 | 7.740 | 2.796 | 6.156 | 6.869 | 11.415 | 8.331 |
| PLACE1007705 | 40.045 | 12.817 | 8.512 | 4.274 | 16.193 | 10.241 | 23.445 | 15.595 |
| PLACE1007706 | 39.169 | 33.551 | 11.130 | 5.527 | 15.086 | 10.115 | 2.633 | 16.152 |
| PLACE1007725 | 21.127 | 27.357 | 11.385 | 7.814 | 15.584 | 9.357 | 10.094 | 10.940 |
| PLACE1007729 | 28.499 | 11.383 | 5.377 | 3.729 | 5.453 | 10.931 | 14.086 | 2.233 |
| PLACE1007730 | 24.859 | 34.871 | 14.038 | 4.450 | 6.592 | 10.898 | 20.320 | 10.820 |
| PLACE1007737 | 64.586 | 44.554 | 26.554 | 35.091 | 21.728 | 24.240 | 17.956 | 20.227 |
| PLACE1007743 | 0.859 | 3.414 | 1.135 | 0.831 | 1.756 | 0.000 | 2.807 | 3.029 |
| PLACE1007746 | 32.087 | 24.843 | 12.795 | 9.457 | 15.204 | 23.195 | 23.929 | 16.253 |
| PLACE1007753 | 45.192 | 21.910 | 9.160 | 5.490 | 6.220 | 15.374 | 19.779 | 8.797 |
| PLACE1007769 | 10.061 | 8.971 | 6.218 | 3.760 | 4.071 | 5.692 | 14.415 | 1.425 |
| PLACE1007780 | 67.441 | 127.130 | 21.733 | 15.299 | 22.677 | 23.156 | 29.565 | 40.783 |
| PLACE1007791 | 23.878 | 27.811 | 11.597 | 13.757 | 6.973 | 17.452 | 7.642 | 15.202 |
| PLACE1007807 | 19.033 | 12.372 | 5.484 | 6.978 | 9.961 | 8.811 | 4.940 | 6.447 |
| PLACE1007810 | 4.996 | 1.979 | 9.153 | 2.374 | 1.625 | 2.064 | 0.000 | 2.487 |
| PLACE1007814 | 14.723 | 20.542 | 6.165 | 4.598 | 7.019 | 42.572 | 9.703 | 22.490 |
| PLACE1007828 | 27.262 | 13.301 | 7.076 | 3.678 | 7.841 | 36.007 | 16.434 | 6.803 |
| PLACE1007829 | 39.218 | 31.875 | 29.215 | 36.489 | 31.435 | 20.584 | 14.818 | 23.160 |
| PLACE1007841 | 28.125 | 53.151 | 12.021 | 8.710 | 12.766 | 9.299 | 12.702 | 16.626 |
| PLACE1007842 | 27.286 | 21.658 | 17.505 | 13.015 | 10.257 | 15.529 | 19.091 | 16.698 |
| PLACE1007843 | 5.632 | 5.828 | 4.884 | 2.279 | 5.802 | 2.324 | 1.588 | 5.313 |

TABLE 137

| | | | | | | | | |
|---|---|---|---|---|---|---|---|---|
| PLACE1007845 | 3.434 | 6.356 | 3.584 | 2.435 | 2.658 | 6.674 | 5.597 | 3.658 |
| PLACE1007846 | 40.170 | 23.220 | 10.470 | 9.642 | 6.328 | 8.370 | 6.111 | 14.996 |
| PLACE1007848 | 12.413 | 17.578 | 5.873 | 13.557 | 4.620 | 7.164 | 5.426 | 9.910 |
| PLACE1007552 | 3.936 | 5.252 | 4.966 | 2.146 | 2.510 | 0.958 | 1.562 | 2.641 |
| PLACE1007858 | 4.377 | 15.690 | 8.840 | 10.046 | 13.186 | 7.564 | 4.439 | 10.001 |
| PLACE1007866 | 58.984 | 20.206 | 21.195 | 15.579 | 24.307 | 27.536 | 24.518 | 13.052 |
| PLACE1007871 | 204.996 | 132.437 | 121.332 | 60.458 | 61.024 | 130.512 | 134.180 | 110.829 |
| PLACE1007877 | 75.858 | 20.469 | 18.620 | 9.121 | 11.830 | 21.548 | 25.804 | 17.607 |
| PLACE1007878 | 15.982 | 20.582 | 3.622 | 6.710 | 3.655 | 14.406 | 12.913 | 15.821 |
| PLACE1007881 | 5.139 | 6.128 | 4.453 | 3.005 | 1.236 | 3.305 | 7.871 | 4.530 |
| PLACE1007885 | 10.863 | 10.414 | 2.393 | 2.603 | 1.012 | 13.782 | 10.374 | 10.918 |
| PLACE1007897 | 3.536 | 7.072 | 22.069 | 4.855 | 1.990 | 1.074 | 3.199 | 4.659 |
| PLACE1007908 | 63.322 | 28.830 | 20.884 | 16.585 | 18.747 | 22.332 | 15.351 | 17.050 |
| PLACE1007922 | 6.729 | 11.816 | 3.722 | 1.844 | 4.727 | 16.181 | 8.423 | 4.078 |
| PLACE1007946 | 27.577 | 42.553 | 23.514 | 21.412 | 15.005 | 14.653 | 22.549 | 38.209 |
| PLACE1007950 | 28.154 | 21.145 | 11.483 | 10.791 | 14.345 | 20.195 | 13.857 | 11.448 |
| PLACE1007954 | 1.952 | 1.428 | 1.401 | 0.592 | 0.724 | 0.690 | 1.654 | 2.786 |
| PLACE1007955 | 30.872 | 13.716 | 10.671 | 9.325 | 3.419 | 15.434 | 21.029 | 15.095 |
| PLACE1007956 | 1.554 | 4.401 | 1.470 | 1.778 | 0.511 | 0.943 | 0.995 | 8.053 |
| PLACE1007958 | 23.822 | 7.110 | 10.987 | 1.811 | 8.123 | 9.545 | 15.981 | 7.219 |
| PLACE1007965 | 18.538 | 20.464 | 2.855 | 8.612 | 5.623 | 10.415 | 21.427 | 13.049 |
| PLACE1007969 | 71.000 | 42.207 | 14.155 | 7.330 | 17.492 | 25.314 | 22.985 | 16.519 |
| PLACE1007971 | 8.582 | 17.461 | 12.294 | 9.798 | 9.716 | 7.546 | 12.569 | 20.375 |
| PLACE1007990 | 14.189 | 22.169 | 6.466 | 9.895 | 22.657 | 6.165 | 13.868 | 14.027 |
| PLACE1008000 | 0.000 | 0.000 | 1.759 | 0.861 | 0.988 | 0.774 | 1.458 | 0.870 |
| PLACE1008002 | 0.864 | 4.483 | 1.720 | 0.911 | 2.225 | 0.000 | 3.225 | 2.113 |
| PLACE1008037 | 8.517 | 15.137 | 4.093 | 2.533 | 2.819 | 5.266 | 6.174 | 7.710 |
| PLACE1008044 | 3.591 | 23.823 | 1.467 | 5.023 | 1.182 | 19.457 | 3.724 | 2.532 |
| PLACE1008045 | 18.199 | 6.964 | 4.191 | 3.679 | 17.990 | 6.174 | 6.044 | 5.063 |
| PLACE1008080 | 76.289 | 22.095 | 15.736 | 9.042 | 15.116 | 29.174 | 43.170 | 18.085 |
| PLACE1008092 | 20.084 | 14.350 | 5.254 | 4.007 | 6.883 | 5.838 | 13.221 | 8.271 |
| PLACE1008095 | 66.206 | 18.003 | 15.876 | 6.661 | 9.692 | 30.034 | 18.610 | 15.864 |
| PLACE1008105 | 9.855 | 17.053 | 8.653 | 4.784 | 6.369 | 24.163 | 14.324 | 8.775 |
| PLACE1008107 | 14.915 | 17.501 | 29.282 | 1.321 | 21.336 | 190.243 | 17.482 | 0.000 |
| PLACE1008111 | 8.429 | 3.951 | 10.948 | 3.878 | 3.406 | 5.838 | 4.201 | 5.349 |
| PLACE1008113 | 107.214 | 70.670 | 30.690 | 73.906 | 24.521 | 56.386 | 67.918 | 68.831 |

TABLE 137-continued

| | | | | | | | | |
|---|---|---|---|---|---|---|---|---|
| PLACE1008122 | 31.236 | 2.957 | 2.188 | 2.896 | 3.218 | 4.599 | 3.943 | 4.297 |
| PLACE1008129 | 24.832 | 21.510 | 6.892 | 5.243 | 10.303 | 6.956 | 15.518 | 10.266 |
| PLACE1008132 | 20.962 | 34.980 | 15.446 | 14.729 | 12.780 | 18.057 | 15.326 | 27.742 |
| PLACE1008137 | 97.118 | 20.194 | 22.343 | 16.524 | 21.684 | 39.970 | 38.580 | 25.034 |
| PLACE1008174 | 45.018 | 51.261 | 15.909 | 36.535 | 14.772 | 26.923 | 25.502 | 28.082 |
| PLACE1008177 | 41.484 | 79.290 | 24.754 | 30.372 | 26.003 | 23.816 | 34.010 | 37.711 |
| PLACE1008181 | 1.719 | 2.220 | 2.131 | 0.000 | 1.579 | 0.000 | 6.557 | 3.286 |
| PLACE1008195 | 59.623 | 28.489 | 14.221 | 11.368 | 19.333 | 17.299 | 34.734 | 21.508 |
| PLACE1008198 | 30.548 | 13.400 | 9.985 | 9.568 | 10.838 | 10.004 | 14.071 | 13.967 |
| PLACE1008201 | 18.370 | 7.316 | 4.891 | 5.330 | 6.707 | 8.374 | 16.101 | 15.508 |
| PLACE1008209 | 11.353 | 15.665 | 6.786 | 7.826 | 11.313 | 9.337 | 6.422 | 11.127 |
| PLACE1008226 | 40.512 | 35.430 | 15.314 | 15.161 | 14.198 | 15.868 | 18.668 | 19.246 |
| PLACE1008227 | 40.507 | 49.861 | 13.616 | 20.914 | 14.854 | 9.763 | 13.025 | 19.554 |
| PLACE1008231 | 13.879 | 38.634 | 2.426 | 4.727 | 8.085 | 4.880 | 3.680 | 4.587 |
| PLACE1008238 | 62.239 | 36.096 | 22.111 | 14.596 | 32.492 | 27.046 | 36.607 | 14.304 |
| PLACE1008244 | 2.208 | 6.899 | 2.977 | 5.162 | 5.114 | 4.285 | 6.204 | 4.721 |
| PLACE1008249 | 9.950 | 8.827 | 3.637 | 14.938 | 3.829 | 2.643 | 7.089 | 6.790 |
| PLACE1008266 | 177.598 | 94.617 | 27.398 | 54.336 | 27.771 | 53.728 | 115.566 | 97.747 |
| PLACE1008273 | 26.850 | 24.840 | 19.295 | 15.300 | 10.215 | 14.210 | 25.631 | 13.366 |
| PLACE1008275 | 7.369 | 9.842 | 4.453 | 4.989 | 2.363 | 2.541 | 5.429 | 3.803 |
| PLACE1008280 | 47.000 | 12.903 | 19.045 | 18.567 | 8.878 | 21.704 | 28.612 | 11.871 |
| PLACE1008282 | 19.090 | 11.779 | 14.090 | 10.295 | 11.110 | 31.118 | 29.438 | 15.956 |
| PLACE1008297 | 6.219 | 12.097 | 3.998 | 6.013 | 4.168 | 5.065 | 4.017 | 9.825 |
| PLACE1008303 | 15.637 | 11.812 | 4.839 | 11.352 | 5.186 | 10.716 | 16.193 | 8.079 |
| PLACE1008309 | 8.980 | 7.655 | 17.125 | 5.783 | 7.441 | 4.054 | 15.194 | 6.597 |
| PLACE1008315 | 28.142 | 42.303 | 28.402 | 20.318 | 1.259 | 14.958 | 25.052 | 14.165 |
| PLACE1008329 | 129.029 | 41.587 | 35.939 | 19.948 | 17.798 | 32.238 | 36.345 | 22.076 |
| PLACE1008330 | 40.094 | 61.042 | 26.271 | 19.770 | 13.083 | 8.774 | 16.194 | 11.542 |

TABLE 138

| | | | | | | | | |
|---|---|---|---|---|---|---|---|---|
| PLACE1008331 | 27.986 | 47.595 | 19.541 | 30.549 | 6.771 | 12.430 | 19.559 | 14.501 |
| PLACE1008351 | 31.374 | 25.837 | 26.940 | 15.283 | 21.769 | 12.877 | 29.581 | 16.720 |
| PLACE1008356 | 11.038 | 24.238 | 10.669 | 11.527 | 6.248 | 8.108 | 12.839 | 23.469 |
| PLACE1008359 | 23.219 | 18.821 | 4.585 | 6.804 | 10.499 | 0.000 | 2.547 | 1.436 |
| PLACE1008368 | 7.861 | 12.077 | 7.076 | 8.221 | 6.772 | 3.046 | 4.473 | 8.994 |
| PLACE1008369 | 13.265 | 19.288 | 23.206 | 5.056 | 9.188 | 8.024 | 3.252 | 7.150 |
| PLACE1008392 | 33.219 | 24.613 | 7.199 | 8.079 | 6.094 | 3.416 | 5.773 | 14.321 |
| HLACE1008394 | 408.885 | 231.502 | 159.847 | 115.713 | 108.082 | 197.383 | 152.685 | 161.031 |
| PLACE1008398 | 25.185 | 65.413 | 11.186 | 3.178 | 10.620 | 12.052 | 60.522 | 4.172 |
| PLACE1008401 | 9.122 | 14.441 | 7.348 | 5.588 | 6.040 | 4.705 | 5.467 | 13.166 |
| PLACE1008402 | 9.663 | 11.925 | 9.911 | 6.799 | 5.684 | 2.926 | 6.105 | 8.816 |
| PLACE1008405 | 564.405 | 448.002 | 386.959 | 390.811 | 233.214 | 323.322 | 279.406 | 299.078 |
| PLACE1008409 | 310.254 | 194.222 | 107.706 | 88.926 | 100.879 | 133.079 | 164.162 | 134.635 |
| PLACE1008420 | 102.871 | 44.916 | 30.154 | 14.685 | 18.701 | 45.968 | 47.225 | 19.396 |
| PLACE1008424 | 7.842 | 8.421 | 6.860 | 6.448 | 7.117 | 8.493 | 7.105 | 5.879 |
| PLACE1008426 | 34.481 | 18.699 | 20.403 | 7.577 | 16.885 | 9.223 | 17.802 | 15.759 |
| PLACE1008429 | 19.812 | 18.343 | 10.368 | 12.697 | 6.738 | 14.423 | 9.882 | 12.964 |
| PLACE1008430 | 15.959 | 9.694 | 5.026 | 2.761 | 4.442 | 8.785 | 16.237 | 9.842 |
| PLACE1008437 | 29.520 | 12.626 | 6.518 | 4.954 | 3.470 | 6.216 | 6.790 | 9.990 |
| PLACE1008453 | 45.498 | 38.572 | 11.482 | 14.114 | 13.893 | 18.459 | 30.671 | 26.924 |
| PLACE1008454 | 92.852 | 69.938 | 35.812 | 43.358 | 32.139 | 34.380 | 44.342 | 24.973 |
| PLACE1008455 | 110.060 | 132.654 | 101.535 | 72.107 | 48.679 | 28.207 | 49.762 | 96.618 |
| PLACE1008457 | 221.026 | 164.638 | 87.890 | 67.565 | 56.681 | 96.733 | 57.289 | 64.132 |
| PLACE1008465 | 14.482 | 45.181 | 6.482 | 5.652 | 7.215 | 4.989 | 7.987 | 10.103 |
| PLACE1008469 | 191.519 | 126.151 | 83.503 | 66.767 | 67.955 | 101.454 | 113.684 | 104.824 |
| PLACE1008488 | 12.143 | 25.044 | 5.332 | 0.377 | 5.344 | 4.917 | 4.843 | 10.115 |
| PLACE1008515 | 26.949 | 18.134 | 9.335 | 5.792 | 12.237 | 15.758 | 18.736 | 15.770 |
| PLACE1008524 | 16.341 | 9.879 | 14.963 | 4.596 | 10.881 | 12.847 | 12.491 | 8.424 |
| PLACE1008531 | 26.300 | 44.215 | 12.618 | 14.596 | 8.835 | 12.002 | 17.900 | 27.017 |
| PLACE1008532 | 23.293 | 26.180 | 13.194 | 12.256 | 5.529 | 20.046 | 14.458 | 31.354 |
| PLACE1008533 | 50.837 | 25.004 | 15.099 | 14.960 | 12.107 | 13.885 | 15.331 | 16.687 |
| PLACE1008542 | 7.209 | 11.351 | 11.148 | 11.159 | 7.406 | 3.257 | 4.870 | 8.793 |
| PLACE1008549 | 24.848 | 27.469 | 14.722 | 7.446 | 35.339 | 4.849 | 21.994 | 15.899 |
| PLACE1008560 | 16.248 | 9.601 | 10.580 | 4.328 | 6.786 | 9.843 | 14.007 | 6.753 |
| PLACE1008567 | 31.376 | 46.822 | 16.034 | 16.944 | 14.791 | 13.929 | 17.148 | 17.570 |
| PLACE1008568 | 9.263 | 28.507 | 12.536 | 7.903 | 15.738 | 22.714 | 15.252 | 13.545 |
| PLACE1008569 | 21.434 | 13.045 | 5.050 | 6.520 | 8.664 | 9.142 | 10.799 | 9.664 |
| PLACE1008584 | 29.627 | 24.002 | 13.657 | 10.990 | 11.106 | 13.734 | 22.655 | 21.057 |
| PLACE1008585 | 25.861 | 23.246 | 13.959 | 7.124 | 8.320 | 13.100 | 8.184 | 14.617 |
| PLACE1008603 | 11.593 | 12.897 | 3.634 | 5.109 | 4.753 | 7.887 | 18.167 | 11.774 |
| PLACE1005621 | 6.723 | 3.752 | 3.073 | 2.882 | 0.628 | 2.394 | 2.356 | 6.079 |
| PLACE1008625 | 5.997 | 8.406 | 1.768 | 1.055 | 1.816 | 1.254 | 2.598 | 3.068 |
| PLACE1008626 | 5.484 | 3.562 | 1.402 | 1.123 | 1.403 | 3.049 | 5.665 | 3.510 |
| PLACE1008627 | 49.718 | 18.742 | 10.960 | 7.037 | 8.831 | 13.117 | 21.039 | 15.675 |
| PLACE1008629 | 21.102 | 28.942 | 11.982 | 3.365 | 9.612 | 12.027 | 17.865 | 12.171 |

TABLE 138-continued

| | | | | | | | | |
|---|---|---|---|---|---|---|---|---|
| PLACE1008630 | 9.527 | 21.990 | 10.098 | 9.473 | 7.038 | 5.568 | 7.548 | 9.704 |
| PLACE1008643 | 41.545 | 29.478 | 16.220 | 15.566 | 9.566 | 16.636 | 24.733 | 18.160 |
| PLACE1008650 | 4.202 | 2.471 | 1.051 | 2.532 | 0.932 | 2.348 | 3.778 | 2.601 |
| PLACE1008657 | 10.667 | 16.060 | 5.999 | 8.523 | 5.606 | 4.350 | 8.873 | 8.539 |
| PLACE1008664 | 7.147 | 9.457 | 8.348 | 2.448 | 3.877 | 5.707 | 7.490 | 2.436 |
| PLACE1008693 | 35.830 | 32.008 | 13.154 | 7.301 | 10.960 | 12.214 | 13.885 | 10.914 |
| PLACE1008696 | 30.598 | 14.195 | 9.900 | 6.913 | 8.747 | 8.454 | 9.419 | 10.479 |
| PLACE1008715 | 6.265 | 13.318 | 2.170 | 5.131 | 3.050 | 3.374 | 6.120 | 5.989 |
| PLACE1008716 | 10.756 | 11.071 | 14.349 | 7.225 | 9.919 | 5.434 | 16.844 | 11.965 |
| PLACE1008722 | 19.150 | 29.145 | 12.082 | 14.107 | 7.317 | 7.365 | 11.291 | 13.128 |
| PLACE1008738 | 12.649 | 24.539 | 11.238 | 5.658 | 9.182 | 17.327 | 16.429 | 12.149 |
| PLACE1008742 | 4.334 | 14.217 | 7.739 | 8.863 | 5.946 | 8.825 | 6.516 | 10.305 |
| PLACE1008744 | 8.130 | 10.071 | 2.674 | 2.854 | 2.153 | 2.940 | 3.519 | 4.369 |
| PLACE1008748 | 8.135 | 6.332 | 0.964 | 1.850 | 7.331 | 2.772 | 2.033 | 6.870 |
| PLACE1008757 | 0.000 | 1.927 | 1.248 | 0.983 | 2.427 | 2.818 | 1.135 | 1.993 |
| PLACE1008766 | 4.606 | 24.202 | 3.622 | 1.672 | 4.576 | 4.758 | 5.053 | 2.617 |
| PLACE1008785 | 84.472 | 51.726 | 24.136 | 25.096 | 17.140 | 24.917 | 15.172 | 19.772 |
| PLACE1008790 | 31.403 | 25.252 | 14.095 | 12.995 | 13.157 | 12.786 | 21.229 | 14.549 |
| PLACE1008798 | 3.470 | 1.735 | 2.715 | 1.244 | 2.837 | 1.268 | 3.684 | 4.700 |

TABLE 139

| | | | | | | | | |
|---|---|---|---|---|---|---|---|---|
| PLACE1008807 | 11.746 | 9.388 | 7.010 | 3.398 | 4.152 | 5.286 | 9.954 | 7.993 |
| PLACE1008808 | 10.497 | 2.010 | 1.832 | 1.724 | 2.154 | 0.000 | 2.960 | 3.938 |
| PLACE1008813 | 43.335 | 8.124 | 3.170 | 3.472 | 6.648 | 0.000 | 5.265 | 5.081 |
| PLACE1008836 | 13.208 | 30.377 | 8.014 | 11.550 | 8.774 | 9.700 | 18.296 | 15.156 |
| PLACE1008851 | 35.131 | 44.912 | 12.581 | 38.594 | 17.658 | 12.467 | 22.869 | 17.982 |
| PLACE1008854 | 5.882 | 9.135 | 0.000 | 4.861 | 5.302 | 11.675 | 6.631 | 8.631 |
| PLACE1008864 | 48.984 | 42.179 | 18.396 | 30.397 | 21.064 | 16.595 | 22.139 | 23.902 |
| PLACE1008867 | 12.377 | 56.824 | 11.324 | 9.452 | 18.933 | 14.620 | 10.186 | 16.826 |
| PLACE1008876 | 49.946 | 97.258 | 18.984 | 54.608 | 14.811 | 25.438 | 23.529 | 37.995 |
| PLACE1008887 | 26.489 | 38.089 | 16.208 | 16.042 | 20.811 | 10.479 | 15.115 | 15.164 |
| PLACE1008902 | 22.685 | 13.678 | 2.921 | 7.383 | 19.625 | 2.141 | 5.762 | 6.510 |
| PLACE1008911 | 9.060 | 33.193 | 12.197 | 13.856 | 16.972 | 6.042 | 11.666 | 13.828 |
| PLACE1008917 | 42.217 | 35.405 | 16.607 | 7.160 | 18.874 | 11.592 | 41.024 | 22.806 |
| PLACE1008920 | 32.162 | 3.225 | 1.754 | 3.766 | 3.590 | 9.067 | 6.073 | 2.425 |
| PLACE1008925 | 13.417 | 17.966 | 5.400 | 5.416 | 6.761 | 6.566 | 12.223 | 7.803 |
| PLACE1008930 | 15.886 | 28.504 | 9.408 | 9.552 | 6.095 | 6.477 | 76.830 | 11.057 |
| PLACE1008934 | 23.769 | 18.548 | 12.356 | 6.943 | 12.662 | 6.117 | 11.146 | 9.917 |
| PLACE1008941 | 8.316 | 9.677 | 5.176 | 9.338 | 9.104 | 5.758 | 12.723 | 13.555 |
| PLACE1008947 | 150.057 | 83.432 | 44.128 | 33.278 | 56.786 | 59.699 | 86.640 | 63.955 |
| PLACE1008984 | 8.712 | 10.873 | 4.711 | 5.382 | 2.608 | 4.656 | 10.459 | 7.929 |
| PLACE1008985 | 25.866 | 40.327 | 13.508 | 7.899 | 8.177 | 11.454 | 23.995 | 16.883 |
| PLACE1008994 | 18.162 | 8.786 | 5.711 | 2.403 | 2.775 | 3.796 | 8.332 | 3.014 |
| PLACE1009020 | 11.578 | 10.784 | 5.965 | 4.614 | 3.880 | 6.161 | 11.355 | 7.439 |
| PLACE1009027 | 21.125 | 15.947 | 4.623 | 2.459 | 3.520 | 11.909 | 6.684 | 4.839 |
| PLACE1009039 | 8.664 | 10.154 | 6.735 | 2.521 | 7.750 | 11.874 | 23.006 | 4.885 |
| PLACE1009045 | 23.977 | 20.675 | 6.979 | 7.407 | 4.810 | 5.799 | 35.292 | 9.408 |
| PLACE1009048 | 5.091 | 10.171 | 2.268 | 5.954 | 4.362 | 0.000 | 5.318 | 6.521 |
| PLACE1009050 | 3.470 | 5.590 | 9.098 | 4.708 | 3.880 | 0.000 | 4.164 | 8.669 |
| PLACE1009060 | 34.280 | 32.398 | 9.016 | 17.646 | 9.108 | 20.791 | 23.124 | 21.665 |
| PLACE1009067 | 55.833 | 32.552 | 13.821 | 5.577 | 11.693 | 36.606 | 50.944 | 44.507 |
| PLACE1009071 | 137.113 | 72.622 | 42.839 | 42.259 | 33.328 | 32.445 | 60.967 | 59.816 |
| PLACE1009090 | 30.957 | 25.567 | 12.139 | 8.147 | 11.883 | 22.624 | 22.381 | 10.572 |
| PLACE1009091 | 42.486 | 15.715 | 10.526 | 6.902 | 14.110 | 5.159 | 15.660 | 17.580 |
| PLACE1009094 | 21.335 | 70.138 | 13.676 | 8.271 | 10.714 | 16.361 | 21.919 | 17.604 |
| PLACE1009099 | 7.525 | 13.610 | 8.280 | 12.776 | 8.281 | 12.542 | 10.801 | 31.093 |
| PLACE1009110 | 13.415 | 8.006 | 4.409 | 1.648 | 2.849 | 4.580 | 4.965 | 5.369 |
| PLACE1009111 | 67.629 | 16.954 | 11.182 | 1.515 | 0.000 | 7.804 | 15.142 | 12.395 |
| PLACE1009113 | 10.615 | 8.546 | 4.331 | 4.640 | 5.385 | 6.432 | 5.643 | 10.147 |
| PLACE1009130 | 6.901 | 19.609 | 23.895 | 6.666 | 2.762 | 2.544 | 1.446 | 3.744 |
| PLACE1009150 | 13.031 | 20.426 | 5.736 | 7.683 | 3.673 | 7.990 | 4.988 | 8.429 |
| PLACE1009155 | 72.157 | 61.300 | 57.610 | 55.149 | 41.987 | 39.328 | 50.150 | 57.022 |
| PLACE1009158 | 28.497 | 16.235 | 13.335 | 10.201 | 11.626 | 14.318 | 26.507 | 16.570 |
| PLACE1009166 | 58.030 | 29.706 | 24.997 | 22.721 | 18.028 | 18.384 | 27.587 | 24.065 |
| PLACE1009172 | 16.222 | 19.005 | 7.161 | 4.843 | 6.408 | 6.734 | 8.370 | 6.017 |
| PLACE1009174 | 50.892 | 48.998 | 32.343 | 28.578 | 23.381 | 21.627 | 24.363 | 21.250 |
| PLACE1009183 | 61.545 | 60.739 | 14.751 | 35.658 | 16.796 | 15.529 | 13.831 | 15.373 |
| PLACE1009186 | 5.029 | 11.552 | 6.154 | 4.372 | 2.812 | 8.067 | 6.126 | 4.542 |
| PLACE1009190 | 0.112 | 1.383 | 2.215 | 1.077 | 0.922 | 0.000 | 0.000 | 0.879 |
| PLACE1009196 | 15.938 | 15.069 | 6.337 | 11.235 | 5.301 | 4.199 | 8.229 | 7.836 |
| PLACE1009200 | 56.062 | 49.582 | 26.621 | 32.612 | 20.016 | 13.451 | 19.592 | 29.814 |
| PLACE1009217 | 9.045 | 7.250 | 3.382 | 10.839 | 3.645 | 4.062 | 6.924 | 17.092 |
| PLACE1009230 | 35.137 | 34.356 | 13.699 | 21.015 | 16.141 | 8.394 | 19.789 | 7.528 |
| PLACE1009236 | 34.867 | 17.528 | 8.326 | 7.770 | 9.004 | 12.493 | 27.327 | 9.172 |
| PLACE1009246 | 51.787 | 71.164 | 28.320 | 15.835 | 21.078 | 9.019 | 29.697 | 24.935 |

TABLE 139-continued

| | | | | | | | | |
|---|---|---|---|---|---|---|---|---|
| PLACE1009265 | 92.450 | 36.053 | 21.026 | 11.424 | 10.085 | 43.325 | 58.877 | 30.908 |
| PLACE1009279 | 25.174 | 8.294 | 11.814 | 5.069 | 6.771 | 10.155 | 13.253 | 6.328 |
| PLACE1009298 | 28.708 | 18.088 | 16.943 | 10.646 | 14.479 | 14.708 | 8.886 | 9.738 |
| PLACE1009308 | 175.031 | 34.217 | 34.842 | 16.711 | 32.150 | 62.967 | 72.179 | 28.297 |
| PLACE1009319 | 21.209 | 35.386 | 7.874 | 8.898 | 7.493 | 12.353 | 8.009 | 11.881 |
| PLACE1009328 | 34.584 | 30.370 | 22.052 | 20.297 | 22.536 | 16.474 | 11.081 | 13.533 |
| PLACE1009335 | 3.869 | 10.615 | 12.941 | 6.343 | 1.756 | 4.228 | 4.162 | 27.779 |
| PLACE1009338 | 4.629 | 13.280 | 7.145 | 2.945 | 5.427 | 8.953 | 7.332 | 6.665 |
| PLACE1009344 | 33.854 | 26.440 | 7.150 | 7.043 | 5.231 | 9.005 | 17.883 | 10.752 |
| PLACE1009355 | 10.104 | 50.509 | 4.034 | 2.919 | 3.153 | 6.227 | 6.669 | 19.235 |

TABLE 140

| | | | | | | | | |
|---|---|---|---|---|---|---|---|---|
| PLACE1009368 | 42.051 | 14.861 | 10.631 | 6.209 | 7.101 | 7.025 | 15.596 | 9.443 |
| PLACE1009375 | 19.461 | 10.862 | 1.973 | 2.161 | 5.975 | 8.807 | 9.665 | 4.779 |
| PLACE1009388 | 41.922 | 22.694 | 9.119 | 6.828 | 8.771 | 12.117 | 12.174 | 12.815 |
| PLACE1009398 | 9.410 | 16.113 | 10.077 | 14.136 | 8.930 | 7.363 | 10.053 | 24.623 |
| PLACE1009404 | 27.332 | 38.221 | 8.577 | 12.742 | 8.050 | 16.604 | 26.279 | 8.093 |
| PLACE1009410 | 9.672 | 6.807 | 2.954 | 3.849 | 2.292 | 2.641 | 6.326 | 4.231 |
| PLACE1009417 | 11.321 | 13.342 | 11.760 | 7.145 | 9.842 | 13.265 | 12.016 | 15.150 |
| PLACE1009424 | 143.874 | 161.949 | 83.678 | 44.296 | 55.295 | 145.780 | 98.718 | 82.459 |
| PLACE1009434 | 3.639 | 9.793 | 2.953 | 4.133 | 3.385 | 3.038 | 6.041 | 7.934 |
| PLACE1009443 | 10.126 | 5.900 | 2.564 | 1.418 | 3.826 | 4.205 | 6.190 | 3.051 |
| PLACE1009444 | 75.456 | 51.672 | 32.690 | 29.162 | 27.896 | 35.657 | 35.401 | 25.671 |
| PLACE1009459 | 110.550 | 32.136 | 23.433 | 13.124 | 19.500 | 46.330 | 49.514 | 27.422 |
| PLACE1009460 | 7.804 | 18.196 | 5.042 | 1.388 | 3.715 | 11.334 | 3.840 | 5.965 |
| PLACE1009468 | 24.940 | 28.488 | 14.998 | 8.351 | 9.763 | 9.596 | 31.733 | 20.845 |
| PLACE1009476 | 18.955 | 17.973 | 6.635 | 5.700 | 3.950 | 6.971 | 12.745 | 5.157 |
| PLACE1009477 | 28.528 | 28.026 | 14.306 | 21.520 | 9.248 | 17.462 | 14.475 | 15.028 |
| PLACE1009493 | 9.706 | 13.481 | 2.399 | 3.953 | 1.914 | 6.774 | 6.193 | 9.481 |
| PLACE1009502 | 3.768 | 2.155 | 2.938 | 0.891 | 2.166 | 5.093 | 2.120 | 1.962 |
| PLACE1009524 | 41.369 | 7.099 | 18.781 | 3.777 | 1.184 | 16.229 | 19.248 | 12.391 |
| PLACE1009527 | 41.383 | 14.310 | 8.219 | 3.634 | 8.710 | 15.448 | 19.901 | 11.203 |
| PLACE1009531 | 43.331 | 29.448 | 11.293 | 13.089 | 12.741 | 23.938 | 26.244 | 25.592 |
| PLACE1009535 | 11.347 | 16.999 | 1.257 | 9.551 | 6.031 | 5.821 | 7.459 | 13.160 |
| PLACE1009539 | 27.355 | 33.924 | 17.760 | 19.107 | 12.625 | 17.181 | 18.261 | 21.706 |
| PLACE1009540 | 26.063 | 18.180 | 18.706 | 13.776 | 10.936 | 19.307 | 24.429 | 16.284 |
| PLACE1009542 | 32.314 | 9.517 | 6.333 | 8.159 | 7.348 | 18.062 | 22.235 | 9.384 |
| PLACE1009546 | 12.399 | 7.380 | 5.625 | 1.298 | 3.320 | 4.724 | 8.207 | 4.406 |
| PLACE1009556 | 13.954 | 15.082 | 5.948 | 1.391 | 6.465 | 10.966 | 16.358 | 19.196 |
| PLACE1009569 | 22.909 | 21.209 | 6.670 | 12.434 | 5.803 | 8.233 | 9.438 | 12.507 |
| PLACE1009571 | 13.458 | 10.535 | 6.868 | 4.758 | 5.027 | 9.733 | 7.553 | 9.107 |
| PLACE1009573 | 16.235 | 9.693 | 6.699 | 13.447 | 6.873 | 4.217 | 8.380 | 12.992 |
| PLACE1009576 | 4.851 | 10.697 | 8.157 | 4.542 | 2.949 | 3.677 | 5.201 | 5.143 |
| PLACE1009580 | 35.237 | 47.578 | 24.938 | 26.636 | 15.366 | 25.243 | 27.920 | 23.541 |
| PLACE1009581 | 30.483 | 8.604 | 7.654 | 6.565 | 7.711 | 16.692 | 24.706 | 13.168 |
| PLACE1009587 | 3.476 | 3.868 | 5.230 | 3.387 | 4.099 | 4.838 | 6.514 | 5.783 |
| PLACE1009593 | 7.424 | 8.043 | 3.949 | 5.143 | 4.859 | 7.848 | 5.031 | 4.525 |
| PLACE1009595 | 63.588 | 58.749 | 27.289 | 26.946 | 25.118 | 25.486 | 32.674 | 29.915 |
| PLACE1009596 | 10.136 | 8.803 | 2.554 | 6.077 | 10.559 | 3.608 | 12.421 | 11.189 |
| PLACE1009600 | 15.391 | 21.884 | 10.853 | 7.573 | 11.964 | 20.158 | 11.161 | 14.987 |
| PLACE1009604 | 32.270 | 9.947 | 13.494 | 11.363 | 10.658 | 9.443 | 19.197 | 18.000 |
| PLACE1009607 | 75.364 | 85.156 | 35.035 | 26.439 | 26.445 | 29.568 | 26.168 | 30.122 |
| PLACE1009613 | 4.353 | 6.164 | 2.640 | 5.243 | 1.911 | 2.792 | 2.408 | 6.068 |
| PLACE1009621 | 29.001 | 49.946 | 14.693 | 13.116 | 18.138 | 23.193 | 22.997 | 15.101 |
| PLACE1009622 | 27.300 | 10.327 | 8.159 | 5.651 | 12.385 | 9.234 | 15.408 | 7.132 |
| PLACE1009624 | 27.426 | 19.103 | 3.360 | 2.878 | 7.125 | 4.125 | 12.179 | 7.539 |
| PLACE1009637 | 5.028 | 13.109 | 5.041 | 2.366 | 9.802 | 4.190 | 6.416 | 4.450 |
| PLACE1009639 | 9.956 | 16.237 | 4.056 | 3.880 | 8.587 | 3.660 | 14.640 | 27.577 |
| PLACE1009654 | 29.616 | 69.766 | 58.647 | 5.371 | 50.183 | 22.307 | 21.782 | 12.466 |
| PLAC21009659 | 10.143 | 12.022 | 13.185 | 10.544 | 15.157 | 2.663 | 7.467 | 4.763 |
| PLACE1009665 | 19.662 | 15.718 | 10.263 | 8.654 | 15.968 | 3.947 | 7.286 | 5.058 |
| PLACE1009669 | 74.335 | 65.299 | 22.539 | 17.666 | 23.035 | 36.889 | 47.853 | 26.094 |
| PLACE1009670 | 48.759 | 30.681 | 15.505 | 15.580 | 13.512 | 21.863 | 46.277 | 13.806 |
| PLACE1009708 | 9.584 | 14.533 | 5.232 | 5.640 | 7.390 | 7.392 | 11.586 | 7.014 |
| PLACE1009721 | 0.000 | 5.965 | 1.997 | 1.030 | 1.425 | 4.841 | 5.611 | 3.780 |
| PLACE1009731 | 31.531 | 29.697 | 5.222 | 13.383 | 9.274 | 42.308 | 14.822 | 16.604 |
| PLACE1009735 | 24.842 | 17.444 | 8.225 | 8.391 | 3.900 | 11.001 | 10.728 | 17.147 |
| PLACE1009737 | 20.121 | 19.390 | 12.614 | 11.682 | 4.987 | 10.582 | 13.461 | 11.206 |
| PLACE1009741 | 3.834 | 48.256 | 3.058 | 11.965 | 12.402 | 22.656 | 1.749 | 4.187 |
| PLACE1009752 | 37.588 | 360.319 | 9.532 | 24.594 | 5.279 | 91.807 | 22.992 | 435.143 |
| PLACE1009763 | 15.243 | 3.785 | 8.458 | 12.043 | 11.844 | 8.197 | 7.432 | 17.382 |
| PLACE1009766 | 15.481 | 13.821 | 10.168 | 12.459 | 8.733 | 9.416 | 11.841 | 13.177 |
| PLACE1009772 | 25.177 | 13.697 | 7.336 | 5.603 | 5.178 | 8.892 | 12.233 | 6.915 |
| PLACE1009782 | 8.994 | 6.560 | 6.371 | 4.141 | 13.633 | 6.484 | 6.993 | 16.851 |
| PLACE1009794 | 16.900 | 14.024 | 7.950 | 9.013 | 5.083 | 18.417 | 17.171 | 7.465 |
| PLACE1009798 | 16.321 | 14.039 | 13.398 | 11.317 | 4.355 | 4.228 | 6.535 | 7.202 |

TABLE 141

| | | | | | | | | |
|---|---|---|---|---|---|---|---|---|
| PLACE1009845 | 15.220 | 4.333 | 2.997 | 5.329 | 2.393 | 2.613 | 22.333 | 11.323 |
| PLACE1009849 | 44.946 | 194.619 | 17.197 | 64.071 | 16.467 | 30.251 | 38.997 | 341.202 |
| PLACE1009857 | 21.842 | 11.784 | 14.813 | 9.010 | 7.686 | 17.560 | 23.505 | 10.157 |
| PLACE1009861 | 55.060 | 52.334 | 22.982 | 38.512 | 1.999 | 12.526 | 21.181 | 42.147 |
| PLACE1009872 | 42.867 | 65.398 | 11.814 | 72.397 | 19.845 | 26.217 | 21.062 | 57.158 |
| PLACE1009877 | 144.154 | 73.771 | 52.613 | 35.986 | 26.345 | 12.461 | 20.382 | 36.147 |
| PLACE1009879 | 31.357 | 19.333 | 43.105 | 15.026 | 16.781 | 19.583 | 20.282 | 9.265 |
| PLACE1009886 | 3.579 | 8.567 | 2.869 | 1.043 | 1.021 | 1.571 | 2.025 | 1.893 |
| PLACE1009888 | 10.362 | 6.906 | 3.541 | 1.720 | 7.325 | 6.831 | 7.680 | 6.285 |
| PLACE1009908 | 16.750 | 13.979 | 9.123 | 6.093 | 6.107 | 7.524 | 13.900 | 10.848 |
| PLACE1009919 | 25.958 | 16.368 | 12.802 | 1.838 | 12.682 | 8.032 | 7.157 | 13.099 |
| PLACE1009921 | 5.294 | 5.301 | 2.647 | 2.379 | 6.669 | 1.694 | 6.864 | 1.626 |
| PLACE1009923 | 7.666 | 10.700 | 2.427 | 3.962 | 7.335 | 13.971 | 11.821 | 6.627 |
| PLACE1009924 | 26.023 | 5.683 | 3.961 | 1.712 | 2.571 | 0.000 | 6.021 | 12.826 |
| PLACE1009925 | 3.609 | 1.404 | 0.882 | 1.882 | 0.508 | 7.012 | 3.169 | 2.473 |
| PLACE1009931 | 37.980 | 53.080 | 21.843 | 35.590 | 14.645 | 26.179 | 18.163 | 39.695 |
| PLACE1009935 | 7.854 | 3.468 | 2.666 | 1.324 | 0.764 | 2.382 | 4.922 | 3.501 |
| PLACE1009947 | 44.482 | 21.773 | 17.615 | 11.373 | 13.359 | 12.852 | 18.329 | 12.383 |
| PLACE1009961 | 3.264 | 4.537 | 3.780 | 2.246 | 7.199 | 6.513 | 3.962 | 22.636 |
| PLACE1009971 | 24.201 | 14.113 | 8.964 | 9.558 | 7.736 | 13.999 | 13.695 | 8.124 |
| PLACE1009982 | 90.204 | 37.402 | 17.490 | 17.226 | 11.857 | 37.703 | 32.523 | 24.126 |
| PLACE1009992 | 32.659 | 8.657 | 9.454 | 6.512 | 5.980 | 18.389 | 18.358 | 10.327 |
| PLACE1009995 | 21.779 | 25.489 | 20.929 | 6.918 | 15.829 | 28.418 | 28.296 | 25.865 |
| PLACE1009997 | 39.778 | 25.957 | 22.163 | 18.804 | 12.955 | 27.052 | 15.574 | 19.395 |
| PLACE1010002 | 7.208 | 6.675 | 2.154 | 3.335 | 4.711 | 2.649 | 6.047 | 4.825 |
| PLACE1010011 | 15.700 | 11.002 | 2.148 | 0.691 | 4.571 | 3.619 | 16.561 | 3.132 |
| PLACE1010013 | 18.169 | 7.231 | 5.446 | 11.205 | 1.374 | 6.028 | 15.057 | 9.751 |
| PLACE1010021 | 9.423 | 11.541 | 8.788 | 5.901 | 5.744 | 6.434 | 11.142 | 6.794 |
| PLACE1010023 | 48.546 | 20.475 | 6.683 | 8.439 | 7.872 | 6.849 | 14.748 | 19.147 |
| PLACE1010031 | 23.253 | 23.746 | 12.677 | 11.119 | 9.178 | 23.991 | 11.578 | 15.444 |
| PLACE1010039 | 8.216 | 5.363 | 3.410 | 2.754 | 3.443 | 3.809 | 2.994 | 3.074 |
| PLACE1010045 | 28.520 | 20.935 | 14.936 | 23.387 | 11.939 | 11.927 | 10.256 | 27.268 |
| PLACE1010053 | 11.420 | 12.399 | 2.211 | 6.506 | 4.422 | 6.813 | 4.552 | 6.626 |
| PLACE1010060 | 61.784 | 35.230 | 25.530 | 15.116 | 15.866 | 30.074 | 32.753 | 19.303 |
| PLACE1010069 | 13.551 | 3.560 | 5.924 | 2.419 | 1.178 | 3.632 | 7.745 | 6.202 |
| PLACE1010070 | 12.192 | 12.514 | 5.728 | 3.839 | 6.386 | 6.674 | 3.922 | 9.645 |
| PLACE1010074 | 58.736 | 80.938 | 44.955 | 39.497 | 35.506 | 33.481 | 44.710 | 58.097 |
| PLACE1010076 | 241.223 | 62.057 | 77.062 | 19.863 | 59.519 | 134.094 | 156.661 | 51.913 |
| PLACE1010078 | 85.849 | 26.973 | 22.479 | 14.142 | 12.854 | 44.885 | 40.845 | 17.940 |
| PLACE1010081 | 0.000 | 6.981 | 0.000 | 1.962 | 0.000 | 0.000 | 11.595 | 5.593 |
| PLACE1010083 | 27.240 | 20.600 | 7.478 | 2.813 | 3.550 | 9.386 | 8.886 | 8.608 |
| PLACE1010089 | 10.050 | 12.122 | 5.452 | 5.257 | 8.073 | 1.380 | 4.234 | 6.582 |
| PLACE1010096 | 15.851 | 23.598 | 8.484 | 14.576 | 6.620 | 5.621 | 14.446 | 21.698 |
| PLACE1010102 | 15.331 | 13.251 | 7.699 | 9.155 | 10.558 | 11.564 | 11.290 | 13.860 |
| PLACE1010105 | 35.995 | 25.802 | 14.804 | 18.971 | 17.745 | 14.276 | 23.241 | 18.148 |
| PLACE1010106 | 22.316 | 26.718 | 22.970 | 12.204 | 19.261 | 13.790 | 13.444 | 18.632 |
| PLACE1010130 | 31.537 | 88.713 | 10.371 | 13.604 | 10.772 | 19.911 | 32.607 | 24.027 |
| PLACE1010132 | 29.236 | 14.753 | 8.315 | 9.764 | 5.570 | 12.883 | 10.934 | 9.482 |
| PLACE1010134 | 33.947 | 28.665 | 5.982 | 9.693 | 7.730 | 13.218 | 17.164 | 12.265 |
| PLACE1010139 | 598.413 | 110.617 | 200.038 | 45.054 | 206.627 | 352.839 | 448.388 | 104.360 |
| PLACE1010148 | 3.132 | 9.532 | 1.538 | 2.877 | 4.356 | 4.931 | 4.453 | 19.512 |
| PLACE1010152 | 26.445 | 18.485 | 7.969 | 6.590 | 11.687 | 7.409 | 13.853 | 10.964 |
| PLACE1010155 | 373.743 | 33.940 | 13.008 | 13.408 | 13.152 | 17.546 | 25.269 | 21.191 |
| PLACE1010156 | 9.490 | 17.391 | 7.147 | 7.886 | 7.386 | 11.491 | 14.395 | 7.290 |
| PLACE1010161 | 7.529 | 6.461 | 2.530 | 5.962 | 1.287 | 0.909 | 1.586 | 4.349 |
| PLACE1010181 | 5.294 | 9.629 | 5.205 | 7.060 | 6.824 | 6.992 | 9.982 | 8.729 |
| PLACE1010194 | 26.462 | 22.224 | 13.684 | 8.402 | 9.391 | 9.241 | 14.823 | 14.726 |
| PLACE1010202 | 26.629 | 9.694 | 8.534 | 7.610 | 6.545 | 10.843 | 19.488 | 6.553 |
| PLACE1010231 | 15.631 | 7.185 | 2.841 | 1.402 | 3.191 | 5.438 | 5.656 | 7.547 |
| PLACE1010235 | 35.597 | 8.667 | 2.389 | 6.163 | 3.875 | 2.142 | 6.961 | 3.884 |
| PLACE1010237 | 16.260 | 14.226 | 7.088 | 7.064 | 6.169 | 13.483 | 1580.612 | 9.264 |
| PLACE1010251 | 22.207 | 49.596 | 11.643 | 9.801 | 49.122 | 9.288 | 17.391 | 23.237 |
| PLACE1010261 | 9.199 | 12.479 | 6.658 | 4.050 | 3.058 | 2.869 | 4.685 | 3.866 |
| PLACE1010270 | 3.528 | 2.564 | 2.884 | 1.612 | 2.378 | 5.332 | 5.567 | 4.920 |

TABLE 142

| | | | | | | | | |
|---|---|---|---|---|---|---|---|---|
| PLACE1010273 | 18.198 | 10.799 | 5.456 | 7.563 | 10.408 | 11.696 | 11.805 | 8.650 |
| PLACE1010274 | 20.202 | 18.193 | 10.486 | 9.941 | 13.997 | 14.739 | 14.496 | 20.193 |
| PLACE1010277 | 8.973 | 117.446 | 5.398 | 3.512 | 4.011 | 1.815 | 8.164 | 10.102 |
| PLACE1010293 | 60.036 | 62.516 | 18.939 | 20.260 | 11.120 | 8.879 | 14.863 | 20.261 |
| PLACE1010297 | 10.456 | 6.185 | 4.720 | 3.674 | 4.733 | 7.175 | 13.007 | 16.488 |
| PLACE1010300 | 17.008 | 24.187 | 7.187 | 17.501 | 12.198 | 7.801 | 13.650 | 16.733 |
| PLACE1010310 | 413.605 | 200.863 | 167.599 | 97.554 | 142.759 | 225.854 | 230.002 | 179.252 |
| PLACE1010321 | 36.500 | 66.804 | 16.701 | 11.196 | 12.716 | 16.372 | 17.343 | 18.872 |
| PLACE1010324 | 0.000 | 8.637 | 3.654 | 1.998 | 3.447 | 3.169 | 4.956 | 2.116 |

TABLE 142-continued

| | | | | | | | | |
|---|---|---|---|---|---|---|---|---|
| PLACE1010329 | 30.906 | 39.387 | 9.407 | 14.862 | 11.246 | 12.390 | 12.923 | 13.038 |
| PLACE1010330 | 182.247 | 52.788 | 42.842 | 20.272 | 46.381 | 81.215 | 103.997 | 33.527 |
| PLACE1010335 | 20.429 | 27.007 | 19.301 | 14.056 | 19.661 | 14.766 | 38.945 | 16.803 |
| PLACE1010341 | 15.512 | 16.397 | 5.370 | 6.587 | 7.213 | 4.477 | 8.264 | 8.294 |
| PLACE1010342 | 5.485 | 5.818 | 1.359 | 2.968 | 2.444 | 1.600 | 5.664 | 2.119 |
| PLACE1010346 | 27.509 | 31.551 | 11.234 | 16.701 | 10.972 | 11.936 | 17.866 | 16.679 |
| PLACE1010362 | 37.800 | 42.341 | 20.410 | 19.994 | 20.516 | 14.039 | 23.979 | 21.826 |
| PLACE1010364 | 3.637 | 7.688 | 4.890 | 1.792 | 3.344 | 6.491 | 9.839 | 7.931 |
| PLACE1010368 | 160.448 | 94.255 | 69.658 | 48.395 | 60.226 | 64.663 | 105.004 | 71.078 |
| PLACE1010373 | 50.531 | 36.656 | 15.978 | 12.876 | 19.197 | 22.390 | 35.216 | 29.763 |
| PLACE1010383 | 60.222 | 42.672 | 28.248 | 34.317 | 29.853 | 11.968 | 26.253 | 22.869 |
| PLACE1010385 | 0.000 | 3.211 | 0.000 | 1.653 | 2.697 | 0.000 | 3.102 | 0.000 |
| PLACE1010389 | 45.010 | 32.965 | 23.673 | 18.734 | 15.387 | 31.864 | 30.482 | 22.113 |
| PLACE1010401 | 12.554 | 12.082 | 7.358 | 3.809 | 4.486 | 9.049 | 11.163 | 8.023 |
| PLACE1010410 | 46.622 | 19.531 | 23.525 | 15.038 | 12.094 | 26.576 | 30.580 | 20.641 |
| PLACE1010418 | 63.170 | 54.185 | 47.245 | 53.690 | 29.885 | 39.952 | 35.428 | 40.754 |
| PLACE1010425 | 8.496 | 10.271 | 8.511 | 8.469 | 6.845 | 60.372 | 16.883 | 14.750 |
| PLACE1010443 | 139.820 | 68.717 | 76.495 | 49.901 | 31.535 | 91.673 | 163.084 | 100.340 |
| PLACE1010445 | 55.230 | 63.853 | 40.195 | 41.679 | 24.598 | 29.543 | 39.397 | 42.435 |
| PLACE1010481 | 25.071 | 14.236 | 12.932 | 6.994 | 7.811 | 11.242 | 18.708 | 11.397 |
| PLACE1010482 | 62.044 | 30.485 | 12.054 | 12.510 | 7.434 | 27.561 | 32.378 | 14.322 |
| PLACE1010491 | 6.692 | 11.769 | 7.835 | 7.107 | 2.403 | 7.772 | 8.897 | 7.016 |
| PLACE1010492 | 8.815 | 25.244 | 14.396 | 11.795 | 10.757 | 10.883 | 11.758 | 14.039 |
| PLACE1010509 | 8.728 | 8.603 | 9.041 | 7.620 | 3.097 | 8.537 | 33.229 | 11.438 |
| PLACE1010518 | 53.737 | 47.379 | 37.510 | 43.651 | 35.422 | 32.152 | 29.681 | 41.839 |
| PLACE1010522 | 74.460 | 121.326 | 35.701 | 24.026 | 30.767 | 37.996 | 82.263 | 44.005 |
| PLACE1010529 | 13.116 | 47.273 | 16.874 | 13.123 | 11.833 | 10.805 | 15.047 | 19.475 |
| PLACE1010547 | 10.791 | 15.015 | 13.620 | 12.464 | 6.861 | 9.050 | 12.611 | 9.113 |
| PLACE1010560 | 36.084 | 24.074 | 20.254 | 16.291 | 7.397 | 21.958 | 19.638 | 14.752 |
| PLACE1010562 | 21.600 | 13.040 | 13.412 | 10.004 | 8.160 | 11.786 | 18.067 | 7.693 |
| PLACE1010579 | 5.809 | 7.166 | 3.015 | 3.108 | 2.173 | 6.175 | 8.453 | 8.370 |
| PLACE1010580 | 50.738 | 35.579 | 19.709 | 14.021 | 14.505 | 33.521 | 41.838 | 28.526 |
| PLACE1010599 | 22.697 | 6.399 | 6.660 | 7.383 | 6.210 | 12.163 | 6.932 | 13.134 |
| PLACE1010606 | 17.463 | 9.467 | 5.119 | 4.737 | 13.966 | 8.754 | 6.341 | 10.710 |
| PLACE1010616 | 16.337 | 36.535 | 10.492 | 11.411 | 9.645 | 7.170 | 14.986 | 17.679 |
| PLACE1010622 | 30.437 | 14.238 | 13.526 | 5.708 | 14.881 | 22.701 | 23.807 | 13.849 |
| PLACE1010624 | 25.823 | 18.627 | 12.823 | 9.811 | 10.874 | 16.364 | 11.721 | 14.514 |
| PLACE1010628 | 13.901 | 8.075 | 8.420 | 7.978 | 5.728 | 9.596 | 13.922 | 11.287 |
| PLACE1010629 | 27.634 | 40.133 | 12.859 | 11.330 | 8.045 | 9.191 | 14.370 | 10.210 |
| PLACE1010630 | 12.405 | 13.949 | 22.021 | 11.675 | 24.752 | 13.736 | 15.999 | 18.920 |
| PLACE1010631 | 19.768 | 3.918 | 10.504 | 6.454 | 14.638 | 11.915 | 7h4.522 | 11.552 |
| PLACE1010651 | 61.423 | 22.948 | 13.549 | 11.707 | 15.050 | 34.204 | 25.544 | 13.578 |
| PLACE1010661 | 34.409 | 28.267 | 21.006 | 15.010 | 15.022 | 20.249 | 46.492 | 15.719 |
| PLACE1010662 | 26.892 | 31.410 | 14.036 | 11.805 | 9.079 | 11.854 | 20.418 | 11.826 |
| PLACE1010668 | 48.769 | 42.753 | 31.810 | 18.319 | 31.679 | 38.651 | 30.999 | 41.826 |
| PLACE1010702 | 18.288 | 30.872 | 29.474 | 49.880 | 16.196 | 19.234 | 12.868 | 56.417 |
| PLACE1010709 | 65.293 | 137.910 | 34.914 | 39.908 | 20.047 | 33.698 | 24.664 | 119.725 |
| PLACE1010713 | 30.772 | 37.995 | 14.083 | 5.649 | 14.470 | 23.106 | 20.135 | 20.050 |
| PLACE1010714 | 8.200 | 4.190 | 5.041 | 3.912 | 6.929 | 6.468 | 3.785 | 5.298 |
| PLACE1010716 | 23.008 | 5.374 | 11.836 | 10.138 | 7.071 | 12.870 | 12.608 | 13.906 |
| PLACE1010717 | 17.846 | 18.487 | 9.358 | 10.750 | 8.548 | 10.849 | 15.442 | 15.266 |
| PLACE1010720 | 66.247 | 125.637 | 43.070 | 49.521 | 29.493 | 36.612 | 36.709 | 48.414 |
| PLACE1010739 | 14.550 | 8.279 | 5.945 | 5.951 | 3.067 | 4.103 | 5.256 | 5.571 |
| PLACE1010743 | 9.101 | 4.610 | 3.589 | 2.256 | 1.332 | 3.158 | 5.514 | 4.487 |
| PLACE1010752 | 68.064 | 30.437 | 20.104 | 10.787 | 15.198 | 31.010 | 28.793 | 18.098 |

TABLE 143

| | | | | | | | | |
|---|---|---|---|---|---|---|---|---|
| PLACE1010761 | 26.459 | 111.645 | 25.313 | 97.785 | 46.971 | 35.398 | 19.393 | 56.313 |
| PLACE1010771 | 97.575 | 46.358 | 30.540 | 20.492 | 21.112 | 45.643 | 41.271 | 23.174 |
| PLACE1010784 | 34.813 | 13.196 | 12.948 | 6.263 | 8.395 | 17.778 | 16.235 | 12.720 |
| PLACE1010786 | 35.506 | 55.424 | 19.835 | 19.203 | 16.991 | 22.191 | 24.116 | 30.768 |
| PLACE1010789 | 14.662 | 9.740 | 10.856 | 8.035 | 6.035 | 6.662 | 6.785 | 6.617 |
| PLACE1010800 | 12.898 | 11.478 | 12.969 | 11.574 | 8.280 | 13.756 | 9.074 | 10.785 |
| PLACE1010802 | 9.976 | 7.639 | 11.257 | 6.385 | 8.708 | 6.482 | 9.517 | 9.615 |
| PLACE1010811 | 6.267 | 10.750 | 6.130 | 5.326 | 2.131 | 5.807 | 7.023 | 5.806 |
| PLACE1010813 | 107.134 | 54.846 | 41.785 | 19.939 | 26.019 | 51.877 | 79.848 | 45.993 |
| PLACE1010827 | 11.543 | 12.554 | 6.090 | 2.687 | 4.360 | 10.117 | 10.344 | 9.099 |
| PLACE1010833 | 70.712 | 36.952 | 36.612 | 16.799 | 28.163 | 60.904 | 40.462 | 31.469 |
| PLACE1010839 | 56.261 | 52.196 | 32.723 | 40.363 | 32.757 | 24.743 | 30.658 | 33.056 |
| PLACE1010856 | 15.444 | 56.200 | 14.751 | 17.041 | 11.951 | 20.702 | 14.170 | 62.029 |
| PLACE1010857 | 16.284 | 24.674 | 22.222 | 15.965 | 8.058 | 13.468 | 10.994 | 20.619 |
| PLACE1010870 | 11.360 | 15.311 | 10.708 | 17.750 | 6.704 | 9.120 | 10.270 | 16.911 |
| PLACE1010877 | 12.253 | 23.451 | 12.897 | 9.474 | 11.687 | 13.857 | 6.866 | 12.944 |
| PLACE1010882 | 24.453 | 43.270 | 15.696 | 9.810 | 8.334 | 17.859 | 26.634 | 77.062 |
| PLACE1010891 | 12.636 | 7.098 | 6.674 | 7.840 | 6.799 | 5.426 | 7.441 | 5.870 |

TABLE 143-continued

| | | | | | | | | |
|---|---|---|---|---|---|---|---|---|
| PLACE1010896 | 35.110 | 39.870 | 19.987 | 16.507 | 18.760 | 17.466 | 22.357 | 29.192 |
| PLACE1010900 | 50.692 | 63.882 | 25.595 | 31.970 | 25.080 | 27.551 | 37.245 | 35.556 |
| PLACE1010916 | 17.218 | 31.574 | 12.713 | 10.089 | 10.861 | 13.485 | 21.811 | 16.868 |
| PLACE1010917 | 8.779 | 3.044 | 3.185 | 15.098 | 6.120 | 5.344 | 6.106 | 5.656 |
| PLACE1010924 | 25.229 | 20.092 | 9.911 | 8.013 | 6.493 | 10.958 | 23.409 | 11.594 |
| PLACE1010925 | 49.823 | 61.948 | 23.489 | 34.123 | 17.969 | 19.262 | 17.175 | 29.154 |
| PLACE1010926 | 49.767 | 50.605 | 22.959 | 20.111 | 18.009 | 24.065 | 29.924 | 33.816 |
| PLACE1010942 | 85.218 | 46.665 | 26.680 | 26.313 | 22.818 | 28.713 | 30.538 | 39.140 |
| PLACE1010943 | 316.403 | 113.988 | 93.186 | 72.867 | 91.388 | 149.579 | 188.191 | 112.743 |
| PLACE1010944 | 48.129 | 50.381 | 15.305 | 17.574 | 14.904 | 18.649 | 33.779 | 24.850 |
| PLACE1010947 | 51.058 | 49.164 | 23.114 | 19.450 | 16.597 | 21.983 | 21.814 | 17.333 |
| PLACE1010954 | 73.590 | 77.560 | 34.775 | 41.312 | 25.097 | 30.688 | 27.071 | 36.359 |
| PLACE1010960 | 5.163 | 5.378 | 16.789 | 7.998 | 6.612 | 8.441 | 8.411 | 7.942 |
| PLACE1010965 | 12.476 | 21.628 | 7.886 | 8.825 | 4.194 | 19.265 | 13.526 | 8.153 |
| PLACE1010968 | 34.696 | 21.848 | 9.662 | 5.337 | 11.298 | 19.848 | 21.002 | 15.864 |
| PLACE1010978 | 34.271 | 21.883 | 15.077 | 11.695 | 13.575 | 20.670 | 28.798 | 23.174 |
| PLACE1010982 | 11.927 | 20.104 | 5.539 | 9.523 | 4.555 | 9.333 | 27.370 | 20.028 |
| PLACE1010990 | 23.709 | 22.125 | 15.859 | 11.150 | 14.185 | 15.589 | 24.495 | 18.421 |
| PLACE1011017 | 14.795 | 20.170 | 18.473 | 19.079 | 18.837 | 31.530 | 20.694 | 25.609 |
| PLACE1011019 | 60.412 | 29.348 | 19.532 | 15.616 | 21.011 | 29.657 | 32.510 | 15.026 |
| PLACE1011026 | 6.403 | 27.542 | 4.006 | 7.156 | 5.587 | 9.352 | 6.378 | 23.067 |
| PLACE1011032 | 22.416 | 44.013 | 12.767 | 14.147 | 7.488 | 10.613 | 12.024 | 9.185 |
| PLACE1011041 | 43.649 | 29.675 | 20.339 | 13.342 | 17.790 | 18.671 | 26.478 | 21.550 |
| PLACE1011045 | 48.770 | 37.661 | 20.984 | 15.020 | 24.758 | 23.731 | 42.534 | 24.019 |
| PLACE1011046 | 49.343 | 48.382 | 29.451 | 17.863 | 35.583 | 26.848 | 35.241 | 25.655 |
| PLACE1011054 | 107.000 | 92.094 | 47.988 | 57.849 | 58.878 | 38.779 | 50.411 | 53.030 |
| PLACE1011056 | 226.902 | 159.857 | 111.396 | 119.852 | 115.390 | 99.976 | 141.062 | 137.522 |
| PLACE1011057 | 5.333 | 7.254 | 4.880 | 6.072 | 5.943 | 6.298 | 5.741 | 6.082 |
| PLACE1011059 | 9.231 | 13.844 | 6.945 | 5.804 | 7.325 | 8.493 | 13.139 | 9.998 |
| PLACE1011066 | 24.382 | 54.196 | 22.706 | 25.109 | 25.646 | 15.697 | 16.286 | 16.716 |
| PLACE1011087 | 58.783 | 144.018 | 41.548 | 46.968 | 28.518 | 50.611 | 45.100 | 50.864 |
| PLACE1011090 | 53.056 | 143.896 | 45.260 | 34.467 | 50.933 | 96.133 | 280.440 | 58.429 |
| PLACE1011109 | 75.794 | 119.843 | 42.881 | 49.952 | 43.765 | 33.319 | 35.583 | 34.429 |
| PLACE1011114 | 65.656 | 71.805 | 22.254 | 8.641 | 15.726 | 26.074 | 50.404 | 27.034 |
| PLACE1011116 | 145.171 | 37.399 | 52.539 | 10.533 | 21.813 | 95.906 | 74.823 | 26.509 |
| PLACE1011122 | 18.160 | 20.063 | 14.154 | 12.032 | 7.536 | 12.531 | 122.844 | 13.983 |
| PLACE1011133 | 34.682 | 47.319 | 20.752 | 18.004 | 8.613 | 20.124 | 23.747 | 24.194 |
| PLACE1011134 | 63.554 | 58.080 | 40.465 | 29.503 | 29.773 | 45.368 | 61.612 | 42.362 |
| PLACE1011143 | 25.496 | 15.071 | 13.350 | 11.072 | 8.424 | 16.320 | 18.023 | 11.713 |
| PLACE1011146 | 137.473 | 50.600 | 49.582 | 27.853 | 30.903 | 82.379 | 75.016 | 44.532 |
| PLACE1011160 | 24.414 | 27.486 | 16.449 | 13.837 | 0.000 | 14.398 | 28.311 | 19.373 |
| PLACE1011165 | 34.715 | 26.526 | 18.570 | 10.047 | 8.910 | 23.908 | 18.184 | 13.882 |
| PLACE1011181 | 50.804 | 33.556 | 25.933 | 11.931 | 14.943 | 31.434 | 29.663 | 23.563 |
| PLACE1017185 | 98.259 | 72.519 | 52.464 | 76.221 | 29.442 | 45.963 | 38.543 | 28.172 |
| PLACE1017186 | 40.892 | 33.762 | 25.391 | 13.563 | 18.650 | 28.187 | 25.736 | 15.462 |
| PLACE1017203 | 3.303 | 2.561 | 4.585 | 1.724 | 8.916 | 1.824 | 1.948 | 1.730 |

TABLE 144

| | | | | | | | | |
|---|---|---|---|---|---|---|---|---|
| PLACE1011214 | 19.000 | 30.499 | 15.354 | 20.715 | 13.540 | 15.163 | 22.508 | 23.615 |
| PLACE1011219 | 50.422 | 59.474 | 25.989 | 22.358 | 10.192 | 25.888 | 34.747 | 35.987 |
| PLACE1011221 | 13.282 | 16.503 | 9.149 | 1.3164 | 7.054 | 10.970 | 12.103 | 12.291 |
| PLACE1011229 | 21.300 | 24.016 | 24.142 | 11.920 | 8.874 | 11.425 | 16.577 | 18.885 |
| PLACE1011231 | 57.691 | 22.558 | 21.088 | 13.366 | 17.790 | 47.373 | 24.485 | 19.912 |
| PLACE1011236 | 146.860 | 58.617 | 57.365 | 30.780 | 34.641 | 68.303 | 110.808 | 74.012 |
| PLACE1011247 | 65.406 | 45.970 | 27.363 | 22.989 | 18.925 | 54.590 | 38.380 | 66.200 |
| PLACE1011263 | 18.980 | 16.439 | 15.299 | 13.023 | 14.184 | 8.485 | 11.883 | 15.956 |
| PLACE1011273 | 3.117 | 3.517 | 3.011 | 3.406 | 3.973 | 1.889 | 2.488 | 3.416 |
| PLACE1011278 | 99.532 | 58.735 | 53.312 | 77.774 | 36.414 | 56.820 | 55.573 | 49.298 |
| PLACE1011289 | 65.724 | 17.465 | 19.765 | 15.982 | 16.860 | 28.472 | 40.138 | 23.783 |
| PLACE1011291 | 162.344 | 63.584 | 63.268 | 18.526 | 59.460 | 122.088 | 150.314 | 35.889 |
| PLACE1011296 | 60.289 | 35.108 | 32.914 | 21.911 | 20.435 | 31.931 | 32.378 | 27.683 |
| PLACE1011310 | 12.375 | 27.199 | 12.116 | 10.122 | 5.617 | 13.629 | 12.674 | 18.490 |
| PLACE1011311 | 31.445 | 29.424 | 19.821 | 36.262 | 15.558 | 31.421 | 31.132 | 47.294 |
| PLACE1011321 | 48.851 | 39.888 | 19.447 | 21.568 | 15.965 | 16.409 | 16.955 | 23.945 |
| PLACE1011325 | 25.927 | 17.098 | 14.860 | 7.351 | 9.021 | 14.507 | 18.423 | 13.442 |
| PLACE1011332 | 7.973 | 13.581 | 8.965 | 7.176 | 12.436 | 8.470 | 9.437 | 8.966 |
| PLACE1011340 | 135.172 | 94.377 | 94.222 | 121.189 | 70.843 | 83.242 | 78.735 | 123.304 |
| PLACE1011353 | 20.244 | 35.898 | 18.659 | 17.306 | 20.697 | 18.407 | 11.957 | 19.750 |
| PLACE1011360 | 36.650 | 86.365 | 30.582 | 12.233 | 27.406 | 21.790 | 20.034 | 18.573 |
| PLACE1011364 | 63.297 | 27.430 | 46.019 | 13.619 | 40.083 | 41.537 | 38.082 | 14.810 |
| PLACE1011365 | 14.257 | 15.778 | 11.893 | 10.572 | 8.300 | 11.140 | 12.421 | 11.796 |
| PLACE1011371 | 101.501 | 43.555 | 38.081 | 20.272 | 24.602 | 47.751 | 80.751 | 51.543 |
| PLACE1011375 | 11.873 | 15.442 | 10.915 | 7.912 | 7.069 | 8.106 | 9.387 | 8.664 |
| PLACE1011386 | 207.095 | 98.628 | 73.492 | 39.642 | 58.242 | 102.702 | 134.598 | 72.968 |
| PLACE1011399 | 12.717 | 15.843 | 7.670 | 9.849 | 6.144 | 8.677 | 7.308 | 6.939 |

TABLE 144-continued

| | | | | | | | | |
|---|---|---|---|---|---|---|---|---|
| PLACE1011406 | 60.080 | 56.205 | 37.483 | 22.859 | 14.794 | 35.277 | 39.952 | 36.888 |
| PLACE1011407 | 20.446 | 18.260 | 16.645 | 16.900 | 8.560 | 17.840 | 8.090 | 20.149 |
| PLACE1011419 | 9.047 | 8.378 | 6.933 | 5.544 | 4.330 | 7.245 | 6.219 | 8.740 |
| PLACE1011433 | 13.904 | 35.637 | 21.499 | 14.088 | 12.024 | 17.492 | 15.534 | 27.379 |
| PLACE1011440 | 57.799 | 31.667 | 21.664 | 18.327 | 13.093 | 34.588 | 30.019 | 22.159 |
| PLACE1011452 | 50.007 | 42.314 | 37.053 | 49.949 | 18.696 | 31.802 | 28.114 | 34.843 |
| PLACE1011465 | 35.426 | 19.398 | 13.047 | 12.250 | 12.486 | 25.628 | 23.462 | 18.107 |
| PLACE1011472 | 62.882 | 51.139 | 24.865 | 13.679 | 29.181 | 24.440 | 22.986 | 20.138 |
| PLACE1011477 | 56.690 | 73.733 | 72.345 | 49.100 | 38.345 | 43.680 | 52.566 | 88.177 |
| PLACE1011478 | 63.612 | 53.418 | 38.381 | 43.231 | 23.020 | 32.283 | 28.922 | 47.558 |
| PLACE1011492 | 106.290 | 57.337 | 44.835 | 33.949 | 26.366 | 41.775 | 46.645 | 28.355 |
| PLACE1011498 | 11.479 | 10.039 | 1.690 | 3.014 | 1.593 | 3.917 | 8.921 | 0.000 |
| PLACE1011501 | 6.078 | 13.915 | 3.925 | 4.468 | 3.927 | 10.819 | 15.717 | 55.041 |
| PLACE1011503 | 1.874 | 0.762 | 1.380 | 0.243 | 2.449 | 3.045 | 3.606 | 2.018 |
| PLACE1011509 | 15.310 | 13.049 | 7.406 | 5.231 | 8.198 | 9.010 | 13.173 | 13.881 |
| PLACE1011514 | 63.158 | 72.840 | 43.610 | 53.595 | 30.828 | 44.567 | 49.208 | 51.604 |
| PLACE1011516 | 26.859 | 55.632 | 40.993 | 27.965 | 33.580 | 27.829 | 35.366 | 35.955 |
| PLACE1011520 | 4.008 | 12.681 | 4.680 | 4.882 | 2.815 | 4.425 | 5.052 | 6.373 |
| PLACE1011538 | 46.942 | 112.381 | 14.535 | 10.906 | 7.023 | 21.261 | 18.123 | 15.061 |
| PLACE1011555 | 64.949 | 24.945 | 16.779 | 8.387 | 10.043 | 27.860 | 31.802 | 9.584 |
| PLACE1011561 | 10.363 | 15.824 | 6.531 | 16.410 | 4.737 | 8.801 | 9.321 | 17.672 |
| PLACE1011563 | 10.025 | 6.203 | 5.528 | 4.965 | 4.378 | 7.900 | 10.397 | 8.513 |
| PLACE1011567 | 42.901 | 33.701 | 15.168 | 22.187 | 13.471 | 15.650 | 16.469 | 24.618 |
| PLACE1011569 | 26.547 | 51.848 | 39.883 | 37.100 | 23.589 | 23.252 | 34.227 | 41.438 |
| PLACE1011576 | 65.455 | 90.143 | 56.009 | 77.009 | 47.187 | 46.612 | 36.385 | 75.351 |
| PLACE1011586 | 46.138 | 39.212 | 16.045 | 20.957 | 15.477 | 22.594 | 28.411 | 25.540 |
| PLACE1011635 | 16.794 | 16.170 | 6.079 | 7.918 | 5.168 | 11.027 | 22.021 | 10.224 |
| PLACE1011641 | 1.228 | 0.000 | 3.690 | 2.905 | 1.954 | 3.104 | 3.300 | 2.256 |
| PLACE1011642 | 17.749 | 23.124 | 9.273 | 20.132 | 5.674 | 11.138 | 15.685 | 20.899 |
| PLACE1011643 | 26.441 | 17.121 | 11.726 | 11.897 | 5.398 | 10.061 | 15.157 | 16.472 |
| PLACE1011646 | 84.129 | 76.809 | 63.483 | 68.487 | 61.819 | 46.212 | 52.514 | 53.689 |
| PLACE1011649 | 148.652 | 79.404 | 41.401 | 24.880 | 37.816 | 60.892 | 98.048 | 59.957 |
| PLACE1011650 | 207.033 | 106.793 | 62.104 | 33.902 | 59.773 | 85.346 | 101.285 | 59.651 |
| PLACE1011661 | 89.284 | 69.963 | 52.044 | 1.730 | 41.229 | 46.476 | 38.780 | 47.335 |
| PLACE1011664 | 19.831 | 24.910 | 9.719 | 12.162 | 10.285 | 14.197 | 16.087 | 9.849 |
| PLACE1011672 | 3.166 | 4.324 | 0.000 | 3.511 | 2.518 | 4.317 | 5.108 | 6.001 |
| PLACE1011675 | 5.381 | 4.183 | 13.639 | 3.525 | 18.043 | 13.639 | 14.193 | 4.640 |

TABLE 145

| | | | | | | | | |
|---|---|---|---|---|---|---|---|---|
| PLACE1011682 | 46.195 | 19.920 | 15.150 | 18.241 | 16.697 | 20.650 | 33.169 | 20.683 |
| PLACE1011708 | 140.868 | 80.025 | 46.997 | 44.349 | 48.806 | 85.376 | 98.779 | 53.876 |
| PLACE1011719 | 81.308 | 62.978 | 42.651 | 25.199 | 32.975 | 36.215 | 54.409 | 40.754 |
| PLACE1011725 | 51.825 | 51.140 | 27.931 | 38.736 | 21.984 | 25.006 | 26.264 | 40.599 |
| PLACE1011729 | 24.560 | 24.476 | 13.172 | 17.322 | 11.225 | 10.549 | 10.437 | 11.441 |
| PLACE1011741 | 10.084 | 12.651 | 9.857 | 10.562 | 8.885 | 9.463 | 12.550 | 13.970 |
| PLACE1011749 | 65.367 | 64.514 | 37.914 | 40.516 | 34.378 | 23.889 | 21.546 | 32.149 |
| PLACE1011757 | 18.814 | 44.445 | 37.496 | 28.407 | 37.470 | 13.419 | 20.349 | 44.087 |
| PLACE1011762 | 22.509 | 23.571 | 12.319 | 14.785 | 13.545 | 12.246 | 16.007 | 14.719 |
| PLACE1011778 | 18.861 | 10.736 | 11.124 | 6.662 | 7.815 | 9.039 | 11.917 | 6.723 |
| PLACE1011783 | 121.850 | 129.976 | 50.595 | 57.237 | 55.572 | 43.090 | 130.253 | 61.954 |
| PLACE1011795 | 31.927 | 47.460 | 15.112 | 14.530 | 14.324 | 16.899 | 13.987 | 13.824 |
| PLACE1011810 | 11.913 | 20.873 | 9.762 | 5.145 | 8.850 | 7.953 | 21.006 | 8.397 |
| PLACE1011824 | 19.075 | 38.642 | 12.337 | 13.272 | 9.167 | 11.037 | 20.832 | 9.083 |
| PLACE1011825 | 101.516 | 76.411 | 46.000 | 26.850 | 59.669 | 37.495 | 57.769 | 32.550 |
| PLACE1011835 | 41.770 | 35.699 | 13.510 | 12.484 | 12.451 | 13.661 | 25.449 | 15.527 |
| PLACE1011836 | 75.164 | 61.584 | 46.814 | 31.866 | 60.375 | 30.344 | 47.168 | 42.711 |
| PLACE1011847 | 13.876 | 13.405 | 4.281 | 8.038 | 4.394 | 3.642 | 10.641 | 8.968 |
| PLACE1011855 | 23.160 | 24.900 | 11.611 | 9.421 | 10.774 | 9.353 | 18.255 | 8.246 |
| PLACE1011858 | 17.703 | 19.170 | 8.339 | 6.242 | 7.166 | 9.321 | 11.444 | 10.044 |
| PLACE1011874 | 25.436 | 29.797 | 26.222 | 32.382 | 13.428 | 18.138 | 15.516 | 21.195 |
| PLACE1011875 | 3.069 | 12.743 | 6.998 | 4.382 | 6.338 | 8.026 | 8.980 | 5.065 |
| PLACE1011877 | 32.981 | 22.725 | 17.384 | 15.505 | 5.675 | 26.880 | 25.751 | 19.376 |
| PLACE1011891 | 49.673 | 22.359 | 23.890 | 9.835 | 15.099 | 27.985 | 35.929 | 22.229 |
| PLACE1011896 | 4.107 | 0.000 | 3.756 | 3.007 | 2.732 | 0.000 | 6.891 | 3.826 |
| PLACE1011920 | 31.343 | 26.346 | 21.681 | 17.707 | 11.558 | 18.630 | 38.456 | 21.819 |
| PLACE1011922 | 42.691 | 40.664 | 21.936 | 29.603 | 0.000 | 23.870 | 31.601 | 34.831 |
| PLACE1011923 | 32.608 | 43.041 | 19.701 | 8.083 | 15.625 | 16.742 | 22.157 | 29.615 |
| PLACE1011937 | 92.606 | 35.417 | 26.508 | 20.596 | 9.785 | 43.673 | 39.451 | 0.000 |
| PLACE1011939 | 84.529 | 52.763 | 38.555 | 19.964 | 7.336 | 39.880 | 62.062 | 31.494 |
| PLACE1011940 | 59.607 | 59.623 | 43.124 | 27.246 | 23.603 | 35.438 | 69.861 | 53.973 |
| PLACE1011962 | 100.298 | 63.747 | 55.070 | 41.766 | 37.368 | 61.832 | 65.091 | 63.896 |
| PLACE1011964 | 11.886 | 16.598 | 13.946 | 17.132 | 12.848 | 11.456 | 26.353 | 18.276 |
| PLACE1011978 | 18.640 | 19.836 | 21.517 | 38.291 | 0.000 | 21.287 | 15.757 | 50.491 |
| PLACE1011980 | 92.462 | 82.334 | 53.193 | 72.449 | 39.473 | 41.547 | 40.407 | 54.365 |
| PLACE1011981 | 61.362 | 58.174 | 46.817 | 28.272 | 28.476 | 43.347 | 64.658 | 50.398 |

TABLE 145-continued

| | | | | | | | | |
|---|---|---|---|---|---|---|---|---|
| PLACE1011982 | 15.790 | 14.181 | 4.817 | 8.312 | 3.604 | 7.757 | 7.260 | 0.000 |
| PLACE1011995 | 86.516 | 35.794 | 56.068 | 64.038 | 31.871 | 35.426 | 30.449 | 43.699 |
| PLACE1012023 | 13.104 | 15.527 | 8.953 | 7.883 | 5.966 | 11.716 | 15.046 | 14.091 |
| PLACE1012026 | 7.250 | 6.837 | 6.369 | 2.909 | 2.441 | 4.999 | 8.264 | 5.743 |
| PLACE1012031 | 17.346 | 7.096 | 7.365 | 6.293 | 4.262 | 7.545 | 11.516 | 13.665 |
| PLACE2000003 | 208.422 | 130.772 | 108.228 | 143.386 | 92.061 | 81.725 | 104.515 | 91.349 |
| PLACE2000005 | 71.165 | 33.762 | 15.129 | 19.141 | 15.235 | 28.560 | 47.298 | 41.315 |
| PLACE2000006 | 39.195 | 31.459 | 22.805 | 12.253 | 19.193 | 16.829 | 26.310 | 26.260 |
| PLACE2000007 | 49.369 | 22.909 | 15.022 | 10.283 | 10.043 | 26.310 | 24.168 | 17.472 |
| PLACE2000011 | 71.136 | 45.914 | 39.612 | 33.759 | 26.056 | 33.405 | 30.793 | 16.938 |
| PLACE2000014 | 10.718 | 21.905 | 13.060 | 14.701 | 8.179 | 11.383 | 26.861 | 29.837 |
| PLACE2000015 | 5.458 | 4.184 | 2.923 | 3.035 | 2.593 | 2.078 | 3.383 | 5.945 |
| PLACE2000017 | 46.332 | 45.480 | 23.941 | 25.987 | 21.386 | 18.932 | 16.284 | 17.911 |
| PLACE2000021 | 17.344 | 18.232 | 12.294 | 30.435 | 15.289 | 14.854 | 16.815 | 25.461 |
| PLACE2000022 | 214.445 | 144.482 | 60.979 | 80.113 | 67.083 | 66.864 | 70.170 | 73.024 |
| PLACE2000030 | 187.619 | 114.314 | 63.549 | 40.158 | 41.897 | 68.183 | 115.701 | 63.549 |
| PLACE2000032 | 87.441 | 77.188 | 34.877 | 37.149 | 26.057 | 33.214 | 31.270 | 38.239 |
| PLACE2000033 | 19.139 | 24.471 | 9.846 | 10.438 | 5.300 | 7.546 | 9.886 | 11.140 |
| PLACE2000034 | 42.847 | 21.194 | 15.709 | 12.449 | 11.089 | 18.174 | 25.238 | 21.354 |
| PLACE2000039 | 132.992 | 122.124 | 78.507 | 88.183 | 73.563 | 60.606 | 56.917 | 66.559 |
| PLACE2000043 | 79.648 | 15.614 | 20.878 | 20.687 | 15.011 | 29.880 | 42.418 | 25.222 |
| PLACE2000044 | 108.910 | 74.788 | 39.496 | 27.081 | 33.429 | 62.338 | 73.844 | 45.861 |
| PLACE2000047 | 152.880 | 109.630 | 85.453 | 107.221 | 45.543 | 77.024 | 57.124 | 107.596 |
| PLACE2000050 | 152.213 | 120.823 | 56.724 | 48.747 | 39.963 | 53.086 | 55.785 | 48.395 |
| PLACE2000061 | 29.004 | 14.906 | 13.177 | 8.299 | 8.224 | 15.405 | 20.467 | 10.248 |
| PLACE2000062 | 72.911 | 31.342 | 35.172 | 31.037 | 24.841 | 32.494 | 55.822 | 37.870 |
| PLACE2000072 | 26.412 | 23.969 | 12.046 | 11.850 | 8.875 | 14.949 | 13.677 | 17.280 |
| PLACE2000073 | 30.538 | 11.955 | 9.197 | 2.761 | 2.738 | 11.625 | 16.675 | 7.995 |

TABLE 146

| | | | | | | | | |
|---|---|---|---|---|---|---|---|---|
| PLACE2000097 | 26.855 | 20.822 | 13.598 | 19.129 | 11.744 | 36.567 | 24.316 | 26.522 |
| PLACE2000100 | 65.222 | 58.680 | 32.787 | 36.772 | 34.459 | 33.979 | 29.850 | 45.558 |
| PLACE2000103 | 87.537 | 67.579 | 43.315 | 48.791 | 32.811 | 36.573 | 42.226 | 40.018 |
| PLACE2000106 | 109.631 | 86.434 | 50.857 | 64.247 | 33.823 | 50.406 | 61.798 | 50.310 |
| PLACE2000111 | 67.743 | 54.614 | 49.948 | 32.461 | 25.661 | 39.498 | 39.424 | 45.128 |
| PLACE2000115 | 39.616 | 21.252 | 16.909 | 7.307 | 8.764 | 18.404 | 25.904 | 9.246 |
| PLACE2000118 | 525.051 | 269.098 | 228.675 | 184.616 | 169.233 | 347.407 | 255.751 | 198.972 |
| PLACE2000124 | 349.581 | 275.812 | 246.822 | 261.885 | 198.107 | 204.514 | 181.925 | 196.861 |
| PLACE2000132 | 219.428 | 75.779 | 55.477 | 27.845 | 44.528 | 98.585 | 135.305 | 44.096 |
| PLACE2000136 | 26.471 | 13.700 | 10.948 | 5.229 | 9.552 | 12.386 | 20.372 | 16.417 |
| PLACE2000137 | 136.105 | 55.207 | 38.965 | 25.263 | 38.081 | 60.138 | 77.269 | 40.309 |
| PLACE2000140 | 61.894 | 58.228 | 35.563 | 26.913 | 23.042 | 43.520 | 44.482 | 46.587 |
| PLACE2000147 | 35.744 | 28.047 | 17.366 | 9.287 | 7.856 | 15.456 | 20.704 | 13.852 |
| PLACE2000153 | 10.251 | 5.138 | 4.944 | 3.289 | 1.583 | 8.639 | 8.187 | 4.258 |
| PLACE2000164 | 28.952 | 20.099 | 15.192 | 12.672 | 6.324 | 15.972 | 21.497 | 18.781 |
| PLACE2000170 | 59.457 | 56.458 | 26.480 | 33.136 | 22.805 | 27.949 | 31.835 | 29.350 |
| PLACE2000172 | 44.931 | 19.156 | 12.587 | 7.529 | 12.190 | 15.161 | 26.980 | 16.906 |
| PLACE2000173 | 61.374 | 67.180 | 25.374 | 32.768 | 28.635 | 32.143 | 41.210 | 43.509 |
| PLACE2000174 | 58.350 | 40.462 | 27.593 | 30.601 | 30.132 | 26.716 | 42.849 | 36.942 |
| PLACE2000176 | 67.823 | 54.888 | 28.038 | 22.906 | 22.587 | 33.838 | 40.703 | 24.007 |
| PLACE2000187 | 58.492 | 46.505 | 35.000 | 29.053 | 17.412 | 35.409 | 39.960 | 33.655 |
| PLACE2000216 | 67.045 | 48.042 | 34.386 | 16.556 | 25.028 | 35.589 | 41.068 | 25.755 |
| PLACE2000219 | 102.450 | 53.525 | 43.919 | 40.723 | 27.590 | 45.597 | 40.342 | 27.793 |
| PLACE2000221 | 172.504 | 104.236 | 71.274 | 95.080 | 69.068 | 73.074 | 75.780 | 84.353 |
| PLACE2000223 | 1.924 | 0.000 | 0.337 | 0.072 | 0.489 | 0.000 | 1.615 | 0.884 |
| PLACE2000231 | 46.085 | 20.513 | 17.117 | 6.372 | 14.358 | 19.848 | 38.853 | 25.391 |
| PLACE2000235 | 124.328 | 101.132 | 67.369 | 86.561 | 58.141 | 54.197 | 68.871 | 76.828 |
| PLACE2000246 | 104.336 | 91.568 | 43.204 | 38.961 | 37.372 | 49.589 | 53.726 | 38.556 |
| PLACE2000264 | 80.119 | 58.341 | 26.725 | 32.576 | 29.924 | 31.634 | 35.536 | 46.483 |
| PLACE2000274 | 178.113 | 50.862 | 46.488 | 15.876 | 44.169 | 82.504 | 117.862 | 37.316 |
| PLACE2000287 | 132.856 | 101.370 | 60.760 | 60.336 | 35.602 | 65.837 | 81.297 | 70.741 |
| PLACE2000296 | 49.120 | 36.473 | 16.163 | 15.750 | 18.250 | 18.313 | 35.709 | 33.015 |
| PLACE2000302 | 57.145 | 42.035 | 23.159 | 27.707 | 22.845 | 20.720 | 30.271 | 32.036 |
| PLACE2000305 | 175.494 | 200.830 | 97.799 | 110.854 | 103.121 | 82.645 | 117.383 | 111.334 |
| PLACE2000317 | 43.989 | 47.859 | 17.789 | 17.969 | 19.049 | 22.044 | 50.064 | 40.575 |
| PLACE2000324 | 0.000 | 7.097 | 5.063 | 2.422 | 6.266 | 5.462 | 10.248 | 7.127 |
| PLACE2000334 | 68.183 | 58.423 | 27.660 | 13.890 | 19.395 | 41.882 | 61.667 | 32.402 |
| PLACE2000335 | 124.754 | 148.141 | 79.507 | 92.542 | 69.951 | 70.762 | 73.634 | 60.750 |
| PLACE2000340 | 26.477 | 26.590 | 14.223 | 11.260 | 9.640 | 12.040 | 23.150 | 14.154 |
| PLACE2000341 | 77.833 | 55.873 | 31.663 | 25.403 | 26.509 | 38.745 | 65.207 | 46.925 |
| PLACE2000342 | 106.364 | 52.711 | 44.616 | 37.588 | 44.103 | 48.901 | 80.862 | 45.540 |
| PLACE2000347 | 135.574 | 132.050 | 56.804 | 42.203 | 56.182 | 70.882 | 92.167 | 64.861 |
| PLACE2000357 | 93.053 | 95.338 | 40.039 | 30.886 | 41.634 | 43.514 | 108.320 | 66.738 |
| PLACE2000358 | 37.940 | 54.020 | 19.892 | 24.091 | f9.855 | 30.828 | 46.656 | 38.072 |
| PLACE2000359 | 44.601 | 31.382 | 22.450 | 28.212 | 15.793 | 15.150 | 23.074 | 23.575 |

TABLE 146-continued

| | | | | | | | | |
|---|---|---|---|---|---|---|---|---|
| PLACE2000366 | 121.162 | 103.772 | 44.748 | 43.347 | 42.993 | 37.451 | 42.382 | 49.575 |
| PLACE2000371 | 30.423 | 16.028 | 14.211 | 9.577 | 16.570 | 13.288 | 16.943 | 9.168 |
| PLACE2000373 | 103.200 | 59.241 | 36.611 | 28.313 | 27.244 | 41.111 | 69.708 | 39.196 |
| PLACE2000374 | 113.892 | 55.366 | 30.642 | 21.105 | 30.506 | 39.759 | 73.431 | 35.604 |
| PLACE2000379 | 20.349 | 15.495 | 7.621 | 6.080 | 7.432 | 5.799 | 10.929 | 11.257 |
| PLACE2000386 | 957.979 | 598.564 | 744.423 | 192.993 | 914.385 | 1779.750 | 2073.338 | 474.610 |
| PLACE2000388 | 71.861 | 48.309 | 26.919 | 20.159 | 20.978 | 36.369 | 40.361 | 36.550 |
| PLACE2000392 | 352.525 | 278.976 | 168.585 | 149.394 | 126.536 | 186.631 | 228.238 | 160.402 |
| PLACE2000394 | 53.696 | 72.722 | 49.507 | 50.392 | 15.244 | 41.226 | 40.124 | 40.112 |
| PLACE2000398 | 108.135 | 94.821 | 58.643 | 43.978 | 38.270 | 58.649 | 64.162 | 55.535 |
| PLACE2000399 | 67.901 | 42.851 | 38.688 | 28.243 | 32.488 | 41.332 | 58.492 | 32.287 |
| PLACE2000402 | 63.927 | 53.000 | 27.854 | 20.310 | 22.733 | 39.649 | 49.188 | 31.169 |
| PLACE2000404 | 52.116 | 29.153 | 35.080 | 21.348 | 20.859 | 36.900 | 57.711 | 32.512 |
| PLACE2000411 | 344.233 | 265.387 | 148.539 | 150.545 | 127.069 | 193.357 | 280.999 | 166.692 |
| PLACE2000418 | 98.999 | 55.110 | 38.643 | 40.087 | 26.858 | 47.480 | 51.418 | 37.707 |
| PLACE2000419 | 173.685 | 127.508 | 108.969 | 93.659 | 63.793 | 86.077 | 101.959 | 100.024 |
| PLACE2000425 | 48.498 | 43.030 | 24.787 | 27.067 | 15.782 | 34.775 | 41.783 | 22.576 |
| PLACE2000427 | 68.431 | 46.153 | 34.785 | 21.591 | 19.224 | 40.769 | 48.213 | 24.735 |
| PLACE2000433 | 85.693 | 46.037 | 39.587 | 31.830 | 25.730 | 41.985 | 45.179 | 36.070 |

TABLE 147

| | | | | | | | | |
|---|---|---|---|---|---|---|---|---|
| PLACE2000435 | 627.805 | 144.999 | 138.039 | 57.999 | 150.754 | 199.419 | 258.624 | 106.234 |
| PLACE2000438 | 56.718 | 23.072 | 24.569 | 11.907 | 16.555 | 28.249 | 47.594 | 27.160 |
| PLACE2000450 | 154.687 | 141.268 | 71.263 | 118.445 | 53.787 | 64.455 | 51.630 | 74.221 |
| PLACE2000455 | 67.470 | 36.100 | 20.827 | 16.588 | 21.358 | 35.782 | 37.471 | 28.970 |
| PLACE2000458 | 104.672 | 42.860 | 43.528 | 21.379 | 21.800 | 58.644 | 70.147 | 47.611 |
| PLACE2000464 | 105.901 | 34.595 | 41.144 | 17.313 | 27.129 | 60.407 | 69.472 | 24.244 |
| PLACE2000465 | 80.401 | 104.292 | 71.810 | 73.398 | 40.246 | 50.872 | 47.384 | 76.283 |
| PLACE2000473 | 420.021 | 269.633 | 211.308 | 162.099 | 161.932 | 255.494 | 273.349 | 340.926 |
| PLACE2000477 | 15.988 | 4.741 | 4.305 | 5.801 | 6.451 | 4.611 | 5.267 | 7.301 |
| PLACE3000004 | 150.291 | 87.960 | 55.053 | 66.698 | 49.843 | 55.946 | 72.642 | 62.012 |
| PLACE3000009 | 308.534 | 491.939 | 579.346 | 337.661 | 527.298 | 1010.865 | 903.209 | 416.227 |
| PLACE3000020 | 129.151 | 97.914 | 62.838 | 38.547 | 45.276 | 64.510 | 77.399 | 65.319 |
| PLACE3000029 | 65.003 | 63.572 | 28.269 | 34.591 | 20.999 | 29.355 | 27.242 | 35.815 |
| PLACE3000038 | 60.832 | 39.883 | 31.082 | 31.184 | 18.004 | 26.851 | 33.481 | 34.526 |
| PLACE3000052 | 80.986 | 57.505 | 42.010 | 29.980 | 28.396 | 38.406 | 44.374 | 46.348 |
| PLACE3000059 | 14.309 | 10.723 | 7.978 | 9.607 | 8.219 | 10.311 | 10.168 | 14.892 |
| PLACE3000067 | 148.633 | 122.359 | 72.812 | 107.464 | 67.921 | 73.383 | 51.333 | 59.832 |
| PLACE3000069 | 94.472 | 58.891 | 39.254 | 38.134 | 38.532 | 45.365 | 50.569 | 49.095 |
| PLACE3000070 | 606.923 | 398.146 | 277.096 | 302.922 | 122.053 | 340.430 | 303.517 | 264.024 |
| PLACE3000103 | 37.665 | 49.384 | 23.681 | 21.788 | 14.319 | 19.018 | 24.128 | 23.022 |
| PLACE3000119 | 71.233 | 77.814 | 32.703 | 36.829 | 29.100 | 33.236 | 32.954 | 38.558 |
| PLACE3000121 | 28.770 | 15.821 | 15.686 | 6.769 | 11.774 | 14.597 | 21.083 | 15.791 |
| PLACE3000124 | 136.225 | 102.926 | 73.102 | 88.816 | 50.098 | 64.249 | 70.972 | 88.890 |
| PLACE3000135 | 5.325 | 1.538 | 1.703 | 2.303 | 1.771 | 1.846 | 2.243 | 1.568 |
| PLACE3000136 | 264.467 | 146.748 | 117.350 | 79.000 | 94.116 | 149.983 | 135.199 | 82.816 |
| PLACE3000142 | 84.493 | 43.724 | 33.445 | 21.753 | 29.470 | 39.958 | 59.408 | 36.420 |
| PLACE3000145 | 202.991 | 105.472 | 78.043 | 43.347 | 67.611 | 96.794 | 127.254 | 104.646 |
| PLACE3000147 | 45.022 | 53.334 | 28.294 | 29.723 | 15.237 | 24.991 | 20.260 | 28.896 |
| PLACE3000148 | 50.238 | 25.306 | 12.752 | 14.405 | 11.331 | 16.047 | 21.617 | 14.375 |
| PLACE3000154 | 16.588 | 24.537 | 5.983 | 4.462 | 5.238 | 17.888 | 19.855 | 5.659 |
| PLACE3000155 | 162.823 | 103.374 | 73.169 | 61.895 | 55.036 | 69.498 | 99.138 | 67.036 |
| PLACE3000156 | 293.645 | 80.486 | 96.151 | 36.695 | 86.574 | 251.934 | 180.898 | 69.146 |
| PLACE3000157 | 77.274 | 48.353 | 30.271 | 23.067 | 21.480 | 31.175 | 45.472 | 36.779 |
| PLACE3000158 | 138.262 | 117.084 | 66.013 | 76.854 | 56.610 | 58.354 | 55.566 | 83.250 |
| PLACE3000160 | 12.383 | 13.802 | 3.360 | 3.545 | 2.772 | 7.038 | 7.949 | 11.165 |
| PLACE3000169 | 112.273 | 107.072 | 60.628 | 74.727 | 35.758 | 41.506 | 37.316 | 64.578 |
| PLACE3000181 | 159.980 | 52.030 | 66.098 | 26.437 | 39.138 | 112.925 | 84.309 | 50.931 |
| PLACE3000194 | 59.243 | 40.406 | 43.072 | 30.599 | 27.793 | 33.533 | 39.940 | 36.285 |
| PLACE3000197 | 2.773 | 2.051 | 1.429 | 3.753 | 0.000 | 3.916 | 96.254 | 57.504 |
| PLACE3000199 | 38.435 | 22.543 | 11.795 | 7.257 | 11.967 | 16.257 | 14.819 | 12.260 |
| PLACE3000205 | 98.788 | 82.371 | 76.207 | 41.507 | 69.168 | 50.577 | 62.634 | 65.731 |
| PLACE3000207 | 107.828 | 91.992 | 61.336 | 61.872 | 58.924 | 42.359 | 53.327 | 75.106 |
| PLACE3000208 | 112.570 | 54.203 | 55.951 | 38.351 | 49.935 | 44.990 | 75.532 | 53.240 |
| PLACE3000213 | 26.219 | 39.836 | 11.741 | 11.345 | 7.948 | 12.842 | 24.022 | 17.439 |
| PLACE3000215 | 90.876 | 34.688 | 28.635 | 9.043 | 15.498 | 40.462 | 43.681 | 18.877 |
| PLACE3000218 | 10.221 | 2.943 | 2.894 | 3.797 | 1.404 | 4.853 | 5.114 | 3.490 |
| PLACE3000220 | 61.519 | 52.284 | 29.152 | 23.405 | 20.917 | 20.102 | 32.078 | 28.959 |
| PLACE3000221 | 57.492 | 57.641 | 28.073 | 44.309 | 27.289 | 41.840 | 33.858 | 52.488 |
| PLACE3000225 | 73.279 | 54.393 | 35.962 | 36.879 | 33.401 | 26.367 | 40.176 | 43.907 |
| PLACE3000226 | 73.816 | 45.891 | 30.595 | 22.786 | 30.642 | 32.460 | 45.062 | 32.422 |
| PLACE3000230 | 46.786 | 26.306 | 16.545 | 6.639 | 15.988 | 18.992 | 43.959 | 26.308 |
| PLACE3000231 | 48.528 | 32.588 | 17.433 | 13.571 | 12.141 | 20.113 | 27.942 | 18.127 |
| PLACE3000235 | 85.027 | 89.322 | 36.118 | 40.285 | 33.985 | 29.150 | 33.828 | 45.276 |
| PLACE3000242 | 40.499 | 25.236 | 19.477 | 11.857 | 14.018 | 22.181 | 24.892 | 16.933 |

TABLE 147-continued

| | | | | | | | | |
|---|---|---|---|---|---|---|---|---|
| PLACE3000244 | 8.374 | 6.431 | 4.114 | 3.304 | 1.774 | 5.910 | 8.022 | 3.080 |
| PLACE3000253 | 15.620 | 19.797 | 14.659 | 8.539 | 11.579 | 14.844 | 17.301 | 13.779 |
| PLACE3000254 | 1079.768 | 504.372 | 399.997 | 312.953 | 401.250 | 606.426 | 625.003 | 328.912 |
| PLACE3000271 | 142.610 | 130.398 | 184.934 | 108.646 | 196.939 | 76.216 | 94.895 | 90.942 |
| PLACE3000276 | 50.360 | 33.421 | 20.928 | 13.869 | 24.274 | 23.260 | 48.090 | 23.254 |
| PLACE3000304 | 753.417 | 459.951 | 316.676 | 275.105 | 248.812 | 389.978 | 267.542 | 311.942 |
| PLACE3000309 | 105.170 | 114.674 | 22.694 | 38.446 | 20.838 | 90.058 | 54.287 | 66.550 |
| PLACES000310 | 16.942 | 7h3.257 | 5.349 | 3.549 | 6.010 | 7.279 | 9.574 | 6.330 |
| PLACE3000320 | 37.064 | 33.783 | 10.590 | 11.068 | 12.166 | 12.647 | 17.232 | 15.732 |
| PLACE3000322 | 59.027 | 28.943 | 19.280 | 27.456 | 23.010 | 14.895 | 25.564 | 32.475 |

TABLE 148

| | | | | | | | | |
|---|---|---|---|---|---|---|---|---|
| PLACE3000330 | 216.369 | 112.324 | 67.450 | 57.211 | 77.413 | 103.940 | 153.059 | 92.002 |
| PLACE3000331 | 175.154 | 109.366 | 65.174 | 61.976 | 64.453 | 62.935 | 100.525 | 76.877 |
| PLACE3000336 | 72.694 | 51.382 | 24.596 | 19.447 | 23.969 | 28.997 | 69.879 | 41.462 |
| PLACE3000339 | 30.681 | 21.404 | 10.699 | 10.293 | 10.726 | 16.029 | 27.155 | 16.949 |
| PLACE3000341 | 60.229 | 47.003 | 23.728 | 24.494 | 19.963 | 23.504 | 27.314 | 25.967 |
| PLACE3000350 | 29.438 | 30.806 | 13.412 | 18.894 | 10.478 | 10.194 | 11.370 | 19.246 |
| PLACE3000352 | 133.033 | 66.842 | 27.124 | 22.155 | 31.563 | 39.432 | 49.060 | 26.130 |
| PLACE3000353 | 43.758 | 27.987 | 13.231 | 12.753 | 11.266 | 21.242 | 42.590 | 23.677 |
| PLACE3000362 | 67.720 | 68.906 | 37.576 | 54.837 | 39.546 | 31.556 | 42.322 | 53.834 |
| PLACE3000363 | 57.403 | 38.780 | 25.263 | 14.578 | 19.607 | 23.664 | 46.846 | 21.687 |
| PLACE3000365 | 67.367 | 70.204 | 26.265 | 27.858 | 28.782 | 28.393 | 58.355 | 39.738 |
| PLACE3000373 | 13.237 | 14.898 | 8.160 | 10.479 | 10.212 | 7.337 | 11.629 | 6.545 |
| PLACE3000374 | 65.194 | 47.989 | 28.255 | 34.215 | 25.888 | 25.506 | 40.045 | 29.881 |
| PLACE3000387 | 39.123 | 14.751 | 9.548 | 6.520 | 10.023 | 13.134 | 24.323 | 11.700 |
| PLACE3000388 | 38.498 | 49.657 | 25.044 | 30.962 | 16.063 | 16.391 | 26.317 | 35.550 |
| PLACE3000399 | 148.163 | 127.490 | 65.532 | 74.992 | 56.760 | 50.436 | 71.879 | 57.275 |
| PLACE3000400 | 64.113 | 49.775 | 24.696 | 24.323 | 28.318 | 34.732 | 29.297 | 29.946 |
| PLACE3000401 | 643.361 | 789.055 | 443.841 | 553.459 | 428.754 | 314.650 | 347.522 | 356.250 |
| PLACE3000402 | 93.152 | 75.383 | 36.033 | 35.535 | 33.800 | 26.510 | 39.162 | 39.094 |
| PLACE3000405 | 116.575 | 74.775 | 47.203 | 35.397 | 23.948 | 53.017 | 69.999 | 41.988 |
| PLACE3000406 | 46.734 | 47.216 | 28.404 | 38.943 | 18.564 | 21.735 | 18.510 | 22.439 |
| PLACE3000413 | 172.089 | 63.768 | 60.797 | 25.154 | 38.861 | 86.736 | 100.967 | 39.294 |
| PLACE3000416 | 72.812 | 94.541 | 27.443 | 24.126 | 23.401 | 36.001 | 52.778 | 31.746 |
| PLACE3000425 | 75.299 | 85.243 | 55.831 | 51.775 | 29.832 | 40.724 | 54.413 | 42.424 |
| PLACE3000437 | 152.596 | 106.131 | 91.713 | 79.520 | 53.901 | 88.235 | 140.605 | 71.376 |
| PLACE3000455 | 199.980 | 144.915 | 86.941 | 70.024 | 46.162 | 89.704 | 140.865 | 87.299 |
| PLACE3000475 | 344.660 | 151.608 | 142.664 | 51.432 | 168.147 | 291.157 | 322.276 | 96.413 |
| PLACE3000477 | 105.902 | 72.097 | 35.966 | 23.877 | 17.322 | 48.569 | 53.837 | 34.942 |
| PLACE4000003 | 21.542 | 6.768 | 7.756 | 4.338 | 6.666 | 15.322 | 9.008 | 10.517 |
| PLACE4000008 | 81.624 | 76.594 | 49.347 | 29.174 | 47.030 | 40.800 | 60.131 | 38.137 |
| PLACE4000009 | 254.207 | 142.614 | 81.374 | 67.480 | 67.588 | 123.118 | 127.853 | 80.493 |
| PLACE4000014 | 93.227 | 49.366 | 32.322 | 19.702 | 25.748 | 40.531 | 72.266 | 36.731 |
| PLACE4000029 | 21.650 | 25.863 | 17.118 | 20.048 | 17.456 | 36.449 | 43.230 | 27.051 |
| PLACE4000034 | 49.161 | 79.725 | 28.634 | 23.533 | 19.403 | 43.040 | 40.269 | 23.537 |
| PLACE4000049 | 166.916 | 134.169 | 69.807 | 85.324 | 50.891 | 74.119 | 64.317 | 64.497 |
| PLACE4000052 | 54.863 | 57.074 | 25.752 | 30.034 | 15.812 | 36.433 | 50.349 | 23.477 |
| PLACE4000062 | 78.176 | 55.581 | 32.501 | 23.565 | 14.025 | 47.511 | 74.636 | 26.040 |
| PLACE4000063 | 84.945 | 48.380 | 39.855 | 15.974 | 28.354 | 50.659 | 60.330 | 32.588 |
| PLACE4000089 | 19.057 | 35.752 | 29.230 | 17.534 | 17.492 | 11.406 | 15.833 | 13.554 |
| PLACE4000093 | 26.060 | 15.272 | 12.061 | 6.706 | 13.618 | 11.634 | 18.344 | 13.777 |
| PLACE4000100 | 101.893 | 42.734 | 31.255 | 36.161 | 14.062 | 33.159 | 29.333 | 44.906 |
| PLACE4000103 | 124.173 | 34.660 | 22.754 | 19.690 | 20.649 | 30.763 | 70.971 | 19.503 |
| PLACE4000106 | 98.597 | 75.194 | 36.209 | 29.412 | 33.084 | 61.638 | 76.538 | 44.570 |
| PLACE4000128 | 129.329 | 131.483 | 60.440 | 57.978 | 41.117 | 68.736 | 84.185 | 95.597 |
| PLACE4000129 | 132.932 | 37.431 | 53.267 | 53.097 | 33.745 | 72.527 | 81.857 | 45.648 |
| PLACE4000131 | 156.165 | 156.169 | 86.886 | 106.633 | 78.888 | 107.180 | 102.299 | 66.814 |
| PLACE4000147 | 16.492 | 9.413 | 7.966 | 2.107 | 5.770 | 5.146 | 10.290 | 4.656 |
| PLACE4000156 | 69.314 | 72.955 | 65.884 | 87.221 | 44.343 | 46.822 | 36.362 | 77.048 |
| PLACE4000175 | 60.994 | 54.028 | 16.876 | 13.509 | 17.492 | 17.684 | 32.845 | 26.309 |
| PLACE4000190 | 593.634 | 220.190 | 171.592 | 116.664 | 189.541 | 260.140 | 310.147 | 138.653 |
| PLACE4000192 | 301.266 | 121.069 | 80.280 | 70.432 | 67.302 | 127.637 | 134.475 | 72.627 |
| PLACE4000206 | 259.054 | 236.436 | 119.680 | 97.518 | 77.827 | 86.994 | 97.682 | 154.492 |
| PLACE4000211 | 242.387 | 150.657 | 98.746 | 66.861 | 74.283 | 149.275 | 122.028 | 95.561 |
| PLACE4000214 | 67.058 | 61.229 | 37.510 | 23.741 | 22.459 | 30.120 | 39.510 | 34.868 |
| PLACE4000222 | 106.945 | 86.369 | 43.808 | 41.733 | 40.284 | 26.442 | 41.963 | 46.046 |
| PLACE4000223 | 107.887 | 42.520 | 26.804 | 14.769 | 19.364 | 37.870 | 44.089 | 22.256 |
| PLACE4000229 | 50.488 | 20.289 | 21.176 | 10.728 | 15.908 | 27.323 | 36.955 | 19.875 |
| PLACE4000230 | 83.847 | 33.508 | 24.933 | 10.032 | 18.791 | 28.713 | 41.794 | 26.235 |
| PLACE4000233 | 96.059 | 59.313 | 60.661 | 55.448 | 36.248 | 37.359 | 40.716 | 47.823 |
| PLACE4000239 | 124.398 | 94.107 | 57.093 | 48.109 | 34.394 | 43.667 | 35.791 | 41.364 |
| PLACE4000247 | 54.958 | 32.352 | 28.165 | 18.524 | 15.208 | 25.144 | 27.546 | 21.593 |
| PLACE4000250 | 104.404 | 85.640 | 73.997 | 59.563 | 48.738 | 59.288 | 60.153 | 65.709 |
| PLACE4000252 | 33.790 | 23.180 | 15.501 | 12.390 | 6.684 | 14.866 | 16.958 | 13.472 |
| PLACE4000259 | 113.573 | 49.555 | 27.075 | 21.856 | 43.353 | 38.644 | 52.944 | 26.431 |

TABLE 149

| | | | | | | | | |
|---|---|---|---|---|---|---|---|---|
| PLACE4000261 | 254.068 | 48.744 | 84.359 | 22.460 | 69.697 | 125.015 | 113.583 | 36.809 |
| PLACE4000264 | 39.731 | 29.931 | 13.801 | 9.433 | 14.239 | 13.997 | 27.405 | 15.510 |
| PLACE4000269 | 85.391 | 69.167 | 59.645 | 32.049 | 32.560 | 45.023 | 59.556 | 44.048 |
| PLACE4000270 | 37.293 | 35.516 | 21.356 | 20.183 | 22.145 | 14.735 | 20.334 | 24.680 |
| PLACE4000281 | 132.006 | 130.790 | 59.934 | 124.956 | 58.105 | 75.320 | 65.805 | 106.301 |
| PLACE4000300 | 95.228 | 64.001 | 50.704 | 44.034 | 42.272 | 39.616 | 55.059 | 49.678 |
| PLACE4000320 | 101.920 | 74.756 | 53.518 | 50.074 | 37.273 | 44.289 | 54.376 | 57.927 |
| PLACE4000323 | 106.246 | 90.568 | 59.225 | 75.643 | 65.195 | 71.824 | 67.236 | 63.467 |
| PLACE4000326 | 50.786 | 39.408 | 21.110 | 15.693 | 16.385 | 24.171 | 25.892 | 24.334 |
| PLACE4000344 | 47.237 | 25.071 | 19.282 | 9.754 | 15.816 | 17.064 | 28.344 | 22.605 |
| PLACE4000347 | 270.519 | 135.102 | 97.629 | 73.164 | 79.089 | 145.628 | 174.326 | 132.718 |
| PLACE4000354 | 51.402 | 69.949 | 21.125 | 14.137 | 10.506 | 24.887 | 36.668 | 32.881 |
| PLACE4000367 | 38.537 | 21.917 | 13.300 | 12.406 | 12.328 | 16.184 | 16.983 | 12.631 |
| PLACE4000369 | 87.562 | 48.818 | 27.044 | 18.841 | 17.942 | 39.036 | 46.668 | 28.559 |
| PLACE4000379 | 63.427 | 46.050 | 34.549 | 40.613 | 28.043 | 28.363 | 34.411 | 32.783 |
| PLACE4000387 | 51.546 | 28.804 | 20.204 | 18.439 | 20.155 | 20.584 | 27.432 | 22.848 |
| PLACE4000392 | 16.062 | 7.012 | 6.606 | 5.828 | 5.717 | 7.153 | 9.447 | 4.556 |
| PLACE4000399 | 537.973 | 347.563 | 216.840 | 188.160 | 226.834 | 294.013 | 378.986 | 282.393 |
| PLACE4000401 | 18.633 | 16.086 | 12.450 | 8.891 | 4.760 | 9.336 | 9.594 | 9.016 |
| PLACE4000403 | 122.680 | 74.783 | 64.480 | 32.311 | 31.018 | 61.677 | 74.741 | 57.710 |
| PLACE4000411 | 76.474 | 69.288 | 26.062 | 27.151 | 18.908 | 24.969 | 28.090 | 28.450 |
| PLACE4000415 | 117.128 | 42.809 | 42.067 | 13.307 | 25.782 | 58.009 | 67.901 | 23.594 |
| PLACE4000416 | 155.173 | 151.945 | 41.224 | 24.312 | 34.852 | 60.268 | 78.927 | 60.597 |
| PLACE4000424 | 49.737 | 20.818 | 19.113 | 10.882 | 15.430 | 26.353 | 51.392 | 21.253 |
| PLACE4000431 | 94.197 | 46.298 | 22.172 | 18.259 | 30.613 | 23.575 | 63.847 | 39.828 |
| PLACE4000443 | 5.628 | 10.390 | 1.885 | 3.662 | 4.723 | 4.338 | 8.728 | 4.152 |
| PLACE4000445 | 112.063 | 123.064 | 82.212 | 73.969 | 75.667 | 71.847 | 80.827 | 98.196 |
| PLACE4000450 | 236.301 | 129.164 | 80.479 | 58.100 | 59.886 | 126.244 | 134.749 | 85.784 |
| PLACE4000455 | 48.423 | 52.624 | 22.324 | 12.728 | 17.652 | 29.121 | 33.876 | 28.299 |
| PLACE4000465 | 106.018 | 96.543 | 76.272 | 77.100 | 59.155 | 46.270 | 60.646 | 57.534 |
| PLACE4000466 | 291.255 | 313.894 | 141.390 | 142.098 | 110.817 | 145.538 | 179.778 | 235.989 |
| PLACE4000472 | 361.477 | 283.612 | 184.390 | 172.988 | 162.349 | 205.973 | 249.573 | 175.977 |
| PLACE4000487 | 71.130 | 60.554 | 31.674 | 34.491 | 38.357 | 27.786 | 47.292 | 39.254 |
| PLACE4000489 | 95.437 | 42.543 | 25.117 | 24.559 | 29.344 | 31.561 | 68.977 | 55.815 |
| PLACE4000494 | 88.573 | 62.176 | 35.502 | 19.031 | 26.845 | 35.819 | 41.938 | 46.527 |
| PLACE4000502 | 149.633 | 181.173 | 61.673 | 64.434 | 54.907 | 64.869 | 78.120 | 106.317 |
| PLACE4000521 | 204.368 | 58.842 | 53.769 | 22.018 | 39.396 | 90.039 | 90.251 | 41.190 |
| PLACE4000522 | 70.773 | 56.092 | 27.371 | 16.069 | 23.518 | 31.461 | 43.466 | 39.760 |
| PLACE4000537 | 155.193 | 45.421 | 44.392 | 17.892 | 44.281 | 65.488 | 98.332 | 46.179 |
| PLACE4000548 | 47.086 | 28.598 | 16.763 | 16.406 | 16.740 | 16.619 | 38.465 | 30.778 |
| PLACE4000558 | 10.369 | 12.539 | 7.971 | 5.855 | 5.400 | 4.652 | 8.570 | 10.740 |
| PLACE4000581 | 70.383 | 51.427 | 22.039 | 21.955 | 29.024 | 23.682 | 53.726 | 32.562 |
| PLACE4000590 | 24.623 | 8.914 | 5.754 | 7.501 | 7.952 | 10.260 | 10.943 | 10.189 |
| PLACE4000593 | 72.087 | 47.632 | 23.074 | 21.723 | 26.365 | 31.598 | 47.539 | 27.961 |
| PLACE4000612 | 363.116 | 155.910 | 113.800 | 42.737 | 124.093 | 178.284 | 193.620 | 70.237 |
| PLACE4000638 | 77.534 | 58.517 | 30.744 | 28.131 | 38.112 | 34.764 | 51.100 | 28.946 |
| PLACE4000650 | 45.331 | 36.490 | 20.134 | 15.928 | 17.671 | 20.345 | 43.714 | 24.670 |
| PLACE4000651 | 81.785 | 55.336 | 31.545 | 34.295 | 31.108 | 38.514 | 81.922 | 45.304 |
| PLACE4000654 | 6.383 | 10.852 | 2.069 | 2.695 | 5.385 | 0.000 | 8.009 | 5.077 |
| PLACE4000670 | 26.614 | 19.086 | 6.113 | 5.853 | 8.977 | 8.517 | 8.611 | 9.175 |
| PLACE4000685 | 353.509 | 395.694 | 218.442 | 282.931 | 172.870 | 251.552 | 212.919 | 154.500 |
| PLACE4000687 | 6.072 | 45.334 | 5.252 | 2.662 | 3.323 | 6.156 | 15.595 | 9.677 |
| PLACE5000003 | 40.413 | 19.764 | 16.619 | 10.777 | 8.559 | 21.575 | 38.678 | 19.632 |
| PLACE5000005 | 29.397 | 16.490 | 10.583 | 8.840 | 8.662 | 14.637 | 23.435 | 12.833 |
| PLACE5000019 | 23.138 | 11.436 | 9.892 | 8.427 | 12.232 | 71.988 | 17.815 | 11.445 |
| PLACE5000021 | 11.535 | 7.575 | 5.665 | 2.261 | 3.314 | 5.302 | 13.774 | 6.297 |
| PLACE5000022 | 46.567 | 29.719 | 16.482 | 17.005 | 14.276 | 21.478 | 42.140 | 22.462 |
| PLACE5000024 | 41.449 | 27.083 | 21.424 | 11.180 | 17.296 | 33.257 | 43.529 | 32.884 |
| PLACE5000036 | 70.785 | 39.582 | 20.917 | 20.141 | 20.809 | 27.945 | 49.655 | 22.062 |
| PLACE5000059 | 549.960 | 916.568 | 204.531 | 124.489 | 88.404 | 320.138 | 300.571 | 165.922 |
| PLACE5000076 | 14.669 | 19.597 | 4.256 | 0.960 | 4.723 | 7.492 | 10.966 | 10.788 |
| PLACE5000117 | 42.649 | 51.048 | 28.712 | 26.369 | 19.372 | 24.252 | 35.991 | 32.282 |
| PLACE5000143 | 56.211 | 38.124 | 31.388 | 29.118 | 16.931 | 30.201 | 34.414 | 32.266 |
| PLACE5000152 | 7.979 | 4.543 | 4.880 | 1.278 | 1.829 | 5.715 | 9.925 | 4.547 |

TABLE 150

| | | | | | | | | |
|---|---|---|---|---|---|---|---|---|
| PLACE5000154 | 70.894 | 26.982 | 21.228 | 26.625 | 17.971 | 32.836 | 43.570 | 45.054 |
| PLACE5000155 | 443.969 | 270.563 | 174.040 | 139.163 | 137.024 | 244.271 | 195.771 | 169.360 |
| PLACE5000165 | 529.207 | 254.686 | 202.448 | 123.963 | 145.432 | 257.836 | 242.614 | 165.245 |
| SKNMC1000004 | 20.836 | 13.305 | 17.789 | 33.557 | 11.594 | 10.964 | 6.648 | 21.308 |
| SKNMC1000011 | 19.687 | 9.046 | 7.372 | 8.263 | 7.296 | 15.689 | 11.182 | 14.777 |
| SKNMC1000013 | 9.401 | 12.821 | 9.287 | 3.794 | 5.931 | 6.702 | 10.997 | 8.736 |
| SKNMC1000014 | 49.003 | 43.832 | 32.008 | 24.681 | 23.480 | 20.065 | 21.197 | 18.671 |
| SKNMC1000018 | 33.522 | 17.298 | 13.017 | 4.236 | 8.795 | 16.555 | 20.822 | 15.790 |
| SKNMC1000020 | 41.784 | 25.172 | 10.947 | 6.067 | 6.258 | 17.499 | 22.243 | 15.547 |

TABLE 150-continued

| | | | | | | | | |
|---|---|---|---|---|---|---|---|---|
| SKNMC1000046 | 21.429 | 19.675 | 15.389 | 7.367 | 8.974 | 13.224 | 14.566 | 12.097 |
| SKNMC1000050 | 22.145 | 26.518 | 10.065 | 7.977 | 7.275 | 14.859 | 11.644 | 8.042 |
| SKNMC1000062 | 338.427 | 274.434 | 175.123 | 132.052 | 150.251 | 235.537 | 155.269 | 137.370 |
| SKNMC1000075 | 20.756 | 21.072 | 10.730 | 10.756 | 8.063 | 10.684 | 15.925 | 10.454 |
| SKNMC1000082 | 24.604 | 10.460 | 9.435 | 7.978 | 7.660 | 10.818 | 12.376 | 12.685 |
| SKNMC1000091 | 36.258 | 20.984 | 12.691 | 12.987 | 9.671 | 18.161 | 17.028 | 15.150 |
| SKNMC1000099 | 27.554 | 15.672 | 10.331 | 8.117 | 8.086 | 17.003 | 23.741 | 6.484 |
| SKNMC1000104 | 38.010 | 34.379 | 9.892 | 7.092 | 9.487 | 18.879 | 22.259 | 6.010 |
| SKNMC1000113 | 39.920 | 26.152 | 14.548 | 11.762 | 15.067 | 12.794 | 17.603 | 10.906 |
| SKNMC1000119 | 68.128 | 70.122 | 43.005 | 35.267 | 28.955 | 35.214 | 34.073 | 39.116 |
| SKNMC1000142 | 32.190 | 14.734 | 11.314 | 9.644 | 8.615 | 13.750 | 11.275 | 11.126 |
| SKNMC1000170 | 27.877 | 27.618 | 13.752 | 9.407 | 7.172 | 15.123 | 19.813 | 13.284 |
| SKNMC1000178 | 70.066 | 63.234 | 33.059 | 29.079 | 25.498 | 40.509 | 40.085 | 31.660 |
| SKNMC1000194 | 49.613 | 30.075 | 14.523 | 13.545 | 13.410 | 19.965 | 25.730 | 19.940 |
| SKNMC1000198 | 36.190 | 30.269 | 18.321 | 16.365 | 19.849 | 22.261 | 23.973 | 21.923 |
| SKNMC1000225 | 20.577 | 23.995 | 7.702 | 12.589 | 11.016 | 9.595 | 24.700 | 19.639 |
| SKNMC1000249 | 35.318 | 7.307 | 2.999 | 2.393 | 1.501 | 10.815 | 6.991 | 7.735 |
| SPLEN1000007 | 17.285 | 35.392 | 16.709 | 18.674 | 6.880 | 10.787 | 9.808 | 21.699 |
| SPLEN1000012 | 79.902 | 26.456 | 22.780 | 18.019 | 22.231 | 32.118 | 34.361 | 44.355 |
| SPLEN1000014 | 86.560 | 12.587 | 39.565 | 11.907 | 15.132 | 29.061 | 14.109 | 26.990 |
| SPLEN1000036 | 39.586 | 28.908 | 15.910 | 11.331 | 10.780 | 20.946 | 21.977 | 20.383 |
| SPLEN1000059 | 0.000 | 0.000 | 0.000 | 0.000 | 0.000 | 0.000 | 0.000 | 2.428 |
| SPLEN1000068 | 42.216 | 61.333 | 16.982 | 24.191 | 14.315 | 17.337 | 19.640 | 62.286 |
| SPLEN1000072 | 80.933 | 51.171 | 18.946 | 13.264 | 24.375 | 35.212 | 43.609 | 27.418 |
| SPLEN1000101 | 56.109 | 102.035 | 38.061 | 51.936 | 36.704 | 44.974 | 32.451 | 43.746 |
| SPLEN1000108 | 28.462 | 16.640 | 8.555 | 5.187 | 16.134 | 11.421 | 13.414 | 8.735 |
| SPLEN100O113 | 51.510 | 25.822 | 25.943 | 12.637 | 11.070 | 26.855 | 29.899 | 18.889 |
| SPLEN1000114 | 35.034 | 24.235 | 14.342 | 6.652 | 10.171 | 15.802 | 22.089 | 21.376 |
| SPLEN1000132 | 49.855 | 38.464 | 20.708 | 19.052 | 11.964 | 26.849 | 30.806 | 43.790 |
| SPLEN1000135 | 69.620 | 36.735 | 26.241 | 10.036 | 13.578 | 35.866 | 51.104 | 20.505 |
| SPLEN1000136 | 63.959 | 49.187 | 29.950 | 19.924 | 33.180 | 31.548 | 43.178 | 34.511 |
| SPLEN1000141 | 23.876 | 26.906 | 13.071 | 72.200 | 12.564 | 17.177 | 27.098 | 35.500 |
| SPLEN1000164 | 16.339 | 35.856 | 18.324 | 17.346 | 11.288 | 11.589 | 21.271 | 23.356 |
| SPLEN1000166 | 24.814 | 15.925 | 15.170 | 8.132 | 3.719 | 14.352 | 21.337 | 12.600 |
| SPLEN1000175 | 25.901 | 21.258 | 13.665 | 11.257 | 7.394 | 16.665 | 16.969 | 14.377 |
| SPLEN1000182 | 18.056 | 12.663 | 11.532 | 12.004 | 2.626 | 8.556 | 12.618 | 37.351 |
| SPLEN1000185 | 26.100 | 41.959 | 17.505 | 17.472 | 10.054 | 14.816 | 18.440 | 19.857 |
| THYMU1000004 | 44.412 | 116.214 | 81.748 | 45.350 | 91.679 | 71.223 | 84.954 | 80.324 |
| THYMU1000009 | 92.202 | 35.746 | 24.767 | 13.955 | 26.373 | 40.874 | 48.694 | 33.357 |
| THYMU1000015 | 119.421 | 76.777 | 57.343 | 70.294 | 56.242 | 50.116 | 65.925 | 70.762 |
| THYMU1000016 | 74.630 | 122.372 | 55.398 | 55.977 | 36.943 | 34.305 | 35.686 | 44.484 |
| THYMU1000023 | 48.992 | 17.205 | 14.380 | 8.188 | 8.168 | 17.212 | 29.149 | 11.470 |
| THYMU1000034 | 23.593 | 20.349 | 11.577 | 29.307 | 8.770 | 14.408 | 18.502 | 24.353 |
| THYMU1000035 | 4.371 | 10.319 | 4.870 | 4.657 | 3.211 | 3.832 | 10.406 | 7.814 |
| THYMU1000037 | 20.625 | 19.668 | 15.919 | 5.609 | 7.443 | 10.224 | 15.344 | 11.760 |
| THYMU1000042 | 26.144 | 27.737 | 22.945 | 14.582 | 17.170 | 26.145 | 15.958 | 21.660 |
| THYMU1000047 | 82.365 | 77.958 | 47.962 | 65.513 | 51.443 | 41.986 | 46.858 | 56.202 |
| THYMU1000080 | 61.757 | 49.927 | 18.225 | 18.738 | 26.953 | 26.454 | 51.613 | 35.091 |
| THYMU1000094 | 19.467 | 64.725 | 53.131 | 40.321 | 30.569 | 39.369 | 33.394 | 98.550 |
| THYMU1000109 | 149.316 | 123.466 | 67.770 | 64.336 | 47.280 | 83.698 | 92.747 | 102.494 |
| THYMU1000127 | 60.503 | 74.862 | 44.683 | 42.056 | 26.178 | 36.687 | 45.486 | 39.497 |
| THYMU1000130 | 30.806 | 32.066 | 14.328 | 15.977 | 15.568 | 16.818 | 17.637 | 28.159 |
| THYMU1000137 | 52.374 | 31.029 | 16.014 | 9.647 | 15.418 | 24.408 | 35.666 | 22.622 |
| THYMU1000146 | 18.567 | 26.920 | 15.236 | 10.270 | 16.304 | 10.679 | 17.254 | 15.651 |
| THYMU1000159 | 70.044 | 154.598 | 47.360 | 46.468 | 39.892 | 66.239 | 54.899 | 103.307 |

TABLE 151

| | | | | | | | | |
|---|---|---|---|---|---|---|---|---|
| THYMU1000163 | 30.058 | 118.595 | 78.938 | 55.414 | 75.224 | 98.439 | 193.301 | 119.439 |
| THYMU1000167 | 27.217 | 30.992 | 12.427 | 11.600 | 12.648 | 14.819 | 18.104 | 21.118 |
| THYMU1000186 | 98.908 | 32.919 | 26.632 | 32.071 | 21.873 | 38.437 | 40.004 | 37.219 |
| THYRO1000017 | 32.706 | 74.720 | 34.463 | 29.641 | 25.692 | 21.516 | 24.204 | 26.183 |
| THYRO1000026 | 48.577 | 63.401 | 19.205 | 24.272 | 14.810 | 18.297 | 20.045 | 25.420 |
| THYRO1000034 | 58.496 | 36.741 | 19.420 | 21.474 | 9.545 | 24.247 | 35.259 | 20.763 |
| THYRO1000035 | 16.297 | 9.507 | 7.691 | 4.410 | 6.774 | 24.908 | 13.356 | 9.119 |
| THYRO1000036 | 24.463 | 30.537 | 12.036 | 4.674 | 19.713 | 10.204 | 19.617 | 16.573 |
| THYRO1000040 | 35.751 | 45.426 | 23.899 | 33.153 | 24.644 | 20.641 | 51.980 | 52.710 |
| THYRO1000061 | 55.574 | 30.112 | 25.941 | 16.711 | 34.951 | 38.423 | 43.556 | 36.625 |
| THYRO1000067 | 298.802 | 183.339 | 157.234 | 94.003 | 137.721 | 187.647 | 208.613 | 150.900 |
| THYRO1000070 | 129.995 | 57.987 | 43.780 | 28.114 | 29.001 | 66.142 | 64.121 | 39.508 |
| THYRO1000072 | 48.939 | 68.453 | 35.134 | 30.429 | 26.621 | 21.975 | 26.766 | 30.117 |
| THYRO1000084 | 48.307 | 42.611 | 21.990 | 11.064 | 20.435 | 19.417 | 26.995 | 22.971 |
| THYRO1000085 | 303.121 | 193.955 | 126.839 | 102.212 | 129.747 | 159.374 | 206.341 | 159.771 |
| THYRO1000086 | 18.728 | 11.012 | 7.883 | 6.698 | 5.384 | 7.742 | 20.711 | 9.575 |
| THYRO1000087 | 13.421 | 10.853 | 10.795 | 1.978 | 6.514 | 3.429 | 8.955 | 5.691 |
| THYRO1000092 | 59.642 | 76.269 | 32.514 | 45.631 | 33.042 | 32.861 | 31.754 | 32.557 |

TABLE 151-continued

| | | | | | | | | |
|---|---|---|---|---|---|---|---|---|
| THYRO1000093 | 29.394 | 21.625 | 13.006 | 10.368 | 7.983 | 20.671 | 22.009 | 16.350 |
| THYRO1000099 | 51.966 | 54.362 | 21.025 | 22.941 | 16.286 | 25.517 | 29.813 | 20.577 |
| THYRO1000107 | 29.893 | 53.294 | 14.175 | 20.025 | 13.567 | 9.104 | 21.662 | 17.898 |
| THYRO1000111 | 21.644 | 28.232 | 19.143 | 17.545 | 16.222 | 11.312 | 15.745 | 13.162 |
| THYRO1000121 | 9.799 | 13.392 | 8.363 | 4.392 | 6.118 | 7.651 | 13.401 | 6.079 |
| THYRO1000124 | 30.095 | 17.896 | 14.782 | 10.115 | 12.585 | 13.557 | 25.764 | 13.667 |
| THYRO1000129 | 30.388 | 14.967 | 9.694 | 7.939 | 3.251 | 9.857 | 13.209 | 9.668 |
| THYRO1000130 | 56.966 | 72.160 | 26.934 | 36.742 | 15.654 | 23.842 | 14.862 | 25.040 |
| THYRO1000132 | 83.533 | 105.422 | 51.451 | 54.782 | 42.323 | 42.319 | 52.428 | 41.417 |
| THYRO1000134 | 33.349 | 47.368 | 20.790 | 21.807 | 12.940 | 21.379 | 41.470 | 22.575 |
| THYRO1000144 | 88.955 | 17.323 | 7.936 | 4.025 | 4.431 | 18.779 | 29.660 | 7.581 |
| THYRO1000155 | 11.674 | 3.549 | 2.761 | 3.811 | 1.697 | 0.000 | 7.176 | 2.825 |
| THYRO1000156 | 35.082 | 28.027 | 15.226 | 28.722 | 16.993 | 22.315 | 19.772 | 22.116 |
| THYRO1000163 | 68.114 | 50.535 | 54.325 | 60.945 | 50.945 | 39.516 | 29.854 | 36.208 |
| THYRO1000173 | 43.980 | 34.453 | 18.714 | 18.682 | 5.054 | 34.676 | 33.143 | 20.988 |
| THYRO1000186 | 150.529 | 131.750 | 70.665 | 53.342 | 44.898 | 98.134 | 69.084 | 44.946 |
| THYRO1000187 | 89.162 | 62.977 | 42.088 | 24.103 | 13.600 | 31.751 | 46.152 | 26.272 |
| THYRO1000190 | 34.704 | 43.709 | 35.680 | 47.383 | 21.817 | 20.074 | 24.984 | 29.176 |
| THYRO1000196 | 12.960 | 7.875 | 6.426 | 3.533 | 5.208 | 5.665 | 10.168 | 5.312 |
| THYRO1000197 | 34.949 | 40.382 | 35.820 | 20.214 | 23.273 | 18.953 | 26.665 | 25.266 |
| THYRO1000199 | 19.361 | 13.983 | 9.085 | 8.320 | 10.004 | 7.851 | 11.633 | 10.622 |
| THYRO1000206 | 47.609 | 55.960 | 31.132 | 10.479 | 36.037 | 22.453 | 19.963 | 14.483 |
| THYRO1000221 | 82.534 | 81.160 | 38.961 | 57.909 | 20.347 | 30.565 | 34.158 | 38.238 |
| THYRO1000222 | 15.768 | 62.309 | 7.359 | 7.364 | 8.966 | 8.443 | 11.700 | 23.186 |
| THYRO1000228 | 23.238 | 16.601 | 14.212 | 15.062 | 17.974 | 19.434 | 9.775 | 10.964 |
| THYRO1000241 | 55.874 | 49.255 | 57.277 | 39.823 | 31.045 | 29.731 | 25.058 | 24.705 |
| THYRO1000242 | 13.379 | 26.177 | 12.762 | 19.853 | 8.446 | 8.035 | 12.464 | 24.333 |
| THYRO1000246 | 7.985 | 21.129 | 6.632 | 7.437 | 5.012 | 11.050 | 8.809 | 26.581 |
| THYRO1000253 | 60.014 | 38.765 | 34.683 | 39.349 | 28.961 | 21.254 | 21.340 | 26.307 |
| THYRP1000270 | 3.554 | 0.000 | 2.696 | 1.813 | 2.708 | 4.022 | 4.159 | 3.250 |
| THYRO1000279 | 14.227 | 10.091 | 5.339 | 3.542 | 4.797 | 8.248 | 7.649 | 5.892 |
| THYRO1000285 | 56.886 | 54.148 | 33.944 | 22.809 | 15.320 | 32.641 | 25.655 | 26.150 |
| THYRO1000288 | 12.236 | 23.331 | 7.807 | 4.959 | 7.189 | 8.692 | 6.757 | 6.433 |
| THYRO1000296 | 68.849 | 34.305 | 24.611 | 18.781 | 11.941 | 46.754 | 36.440 | 24.815 |
| THYRO1000320 | 40.309 | 30.149 | 19.537 | 13.455 | 14.834 | 15.964 | 18.078 | 23.604 |
| THYRO1000322 | 24.627 | 37.164 | 14.062 | 13.220 | 24.263 | 67.227 | 13.642 | 17.831 |
| THYRO1000327 | 26.339 | 17.202 | 19.390 | 6.909 | 11.125 | 14.143 | 17.357 | 12.537 |
| THYRO1000343 | 42.016 | 17.813 | 9.604 | 6.474 | 9.696 | 16.820 | 27.338 | 14.579 |
| THYRO1000345 | 34.927 | 30.431 | 13.357 | 14.304 | 4.038 | 18.892 | 23.250 | 25.428 |
| THYRO1000358 | 127.335 | 79.228 | 36.533 | 19.149 | 36.183 | 60.464 | 53.854 | 26.909 |
| THYRO1000368 | 78.311 | 58.596 | 30.918 | 30.458 | 16.882 | 27.090 | 35.669 | 29.402 |
| THYRO1000375 | 44.890 | 71.506 | 29.159 | 43.213 | 19.374 | 23.353 | 20.500 | 28.158 |
| THYRO1000381 | 8.353 | 7.688 | 6.523 | 4.841 | 3.834 | 5.630 | 10.498 | 8.428 |
| THYRO1000387 | 46.186 | 48.531 | 25.979 | 23.533 | 23.474 | 20.675 | 19.353 | 27.678 |
| THYRO1000394 | 80.432 | 59.053 | 40.610 | 41.098 | 48.706 | 38.355 | 26.242 | 29.817 |
| THYRO1000395 | 97.955 | 28.782 | 36.802 | 20.433 | 29.363 | 45.023 | 48.651 | 32.418 |

TABLE 152

| | | | | | | | | |
|---|---|---|---|---|---|---|---|---|
| THYRO1000400 | 29.261 | 30.808 | 14.649 | 12.890 | 12.143 | 17.419 | 17.865 | 20.330 |
| THYRO1000401 | 48.109 | 37.938 | 22.638 | 16.225 | 12.893 | 28.523 | 30.627 | 19.454 |
| THYRO1000407 | 20.235 | 11.480 | 8.357 | 3.709 | 9.881 | 7.211 | 13.275 | 7.999 |
| THYRO1000420 | 68.894 | 43.096 | 35.789 | 24.115 | 20.938 | 30.086 | 31.852 | 26.083 |
| THYRO1000438 | 33.270 | 20.145 | 29.159 | 31.273 | 12.085 | 10.585 | 9.246 | 12.932 |
| THYRO1000452 | 53.893 | 37.152 | 27.337 | 22.464 | 17.753 | 26.548 | 22.201 | 22.293 |
| THYRO1000455 | 2.280 | 0.834 | 0.000 | 0.976 | 0.585 | 1.280 | 2.641 | 1.093 |
| THYRO1000471 | 47.958 | 25.563 | 18.216 | 14.664 | 13.684 | 14.209 | 21.695 | 20.773 |
| THYRO1000481 | 31.917 | 26.285 | 16.526 | 11.506 | 15.682 | 19.322 | 21.433 | 19.881 |
| THYRO1000484 | 105.966 | 101.654 | 49.570 | 65.106 | 44.560 | 42.375 | 53.422 | 61.358 |
| THYRO1000488 | 10.604 | 11.718 | 5.980 | 2.408 | 1.075 | 2.903 | 5.387 | 5.572 |
| THYRO1000501 | 27.472 | 26.976 | 14.433 | 9.731 | 5.970 | 14.226 | 13.623 | 20.839 |
| THYRO1000502 | 5.447 | 3.089 | 4.285 | 1.572 | 3.996 | 4.353 | 4.902 | 2.744 |
| THYRO1000505 | 4.701 | 9.342 | 2.729 | 1.539 | 2.859 | 3.412 | 6.900 | 4.379 |
| THYRO1000535 | 36.284 | 36.608 | 15.352 | 10.179 | 15.441 | 15.802 | 32.978 | 26.549 |
| THYRO1000556 | 98.555 | 26.955 | 23.471 | 9.941 | 21.538 | 34.069 | 54.689 | 21.009 |
| THYRO1000558 | 40.392 | 34.267 | 23.559 | 20.713 | 24.798 | 17.657 | 28.862 | 27.336 |
| THYRO1000569 | 873.069 | 308.078 | 372.545 | 155.422 | 299.039 | 483.635 | 445.882 | 305.921 |
| THYRO1000570 | 35.246 | 19.469 | 12.612 | 19.448 | 7.219 | 17.186 | 18.803 | 17.396 |
| THYRO1000572 | 39.801 | 10.089 | 11.294 | 4.705 | 3.846 | 19.606 | 13.915 | 6.846 |
| THYRO1000573 | 16.251 | 10.017 | 7.249 | 4.045 | 4.497 | 4.783 | 12.198 | 5.097 |
| THYRO1000577 | 10.585 | 9.999 | 5.259 | 3.391 | 2.076 | 7.540 | 7.747 | 5.771 |
| THYRO1000580 | 39.072 | 33.754 | 20.407 | 32.861 | 20.138 | 22.441 | 26.841 | 38.662 |
| THYRO1000584 | 56.308 | 33.150 | 19.548 | 14.340 | 19.384 | 30.365 | 39.545 | 23.407 |
| THYRO1000585 | 43.561 | 24.758 | 28.265 | 16.580 | 20.169 | 22.132 | 27.817 | 24.366 |
| THYRO1000596 | 2.673 | 0.776 | 0.000 | 0.000 | 4.716 | 2.198 | 2.119 | 1.933 |
| THYRO1000602 | 94.197 | 75.969 | 43.440 | 45.120 | 38.294 | 42.518 | 37.044 | 37.636 |

TABLE 152-continued

| | | | | | | | | |
|---|---|---|---|---|---|---|---|---|
| THYRO1000605 | 37.030 | 19.281 | 9.512 | 7.831 | 12.501 | 20.183 | 23.421 | 15.563 |
| THYRO1000615 | 15.039 | 14.895 | 6.698 | 8.884 | 6.498 | 7.491 | 8.656 | 8.551 |
| THYRO1000625 | 49.869 | 34.253 | 18.419 | 29.529 | 18.526 | 18.214 | 20.134 | 21.544 |
| THYRO1000636 | 32.799 | 20.827 | 9.591 | 8.974 | 11.041 | 15.919 | 22.990 | 18.387 |
| THYRO1000637 | 35.581 | 23.050 | 18.908 | 14.371 | 24.139 | 16.485 | 41.751 | 19.963 |
| THYRO1000641 | 28.962 | 17.660 | 13.853 | 8.774 | 18.253 | 16.722 | 20.366 | 17.183 |
| THYRO1000657 | 66.685 | 48.553 | 43.153 | 26.769 | 20.514 | 33.412 | 27.427 | 59.913 |
| THYRO1000658 | 101.090 | 94.403 | 57.365 | 65.686 | 46.570 | 42.965 | 35.054 | 51.149 |
| THYRO1000662 | 30.501 | 28.754 | 7.936 | 6.202 | 14.884 | 24.631 | 23.740 | 14.132 |
| THYRO1000666 | 56.263 | 27.128 | 11.520 | 10.878 | 12.343 | 19.483 | 26.494 | 16.400 |
| THYRO1000676 | 46.904 | 34.507 | 12.093 | 23.243 | 14.596 | 11.035 | 13.272 | 18.504 |
| THYRO1000678 | 12.599 | 11.709 | 10.630 | 7.426 | 8.273 | 5.498 | 7.825 | 12.309 |
| THYRO1000684 | 61.875 | 24.579 | 20.434 | 9.128 | 13.986 | 27.123 | 42.335 | 20.023 |
| THYRO1000694 | 94.566 | 65.001 | 36.187 | 11.784 | 39.648 | 50.883 | 109.147 | 47.741 |
| THYRO1000699 | 228.022 | 178.345 | 154.501 | 107.031 | 135.907 | 157.164 | 148.138 | 139.950 |
| THYRO1000712 | 66.420 | 120.229 | 65.349 | 78.931 | 61.796 | 42.847 | 42.817 | 59.069 |
| THYRO1000715 | 52.182 | 30.514 | 16.829 | 12.645 | 16.476 | 20.968 | 33.909 | 18.460 |
| THYRO1000716 | 34.776 | 27.624 | 13.457 | 11.085 | 11.113 | 8.581 | 20.893 | 12.979 |
| THYRO1000717 | 64.920 | 84.125 | 21.513 | 31.324 | 22.570 | 21.072 | 22.860 | 29.727 |
| THYRO1000723 | 6.184 | 6.744 | 4.434 | 3.785 | 5.307 | 2.617 | 6.718 | 7.719 |
| THYRO1000734 | 15.193 | 18.494 | 9.892 | 17.212 | 6.183 | 7.960 | 17.862 | 10.472 |
| THYRO1000748 | 94.224 | 47.484 | 24.348 | 16.194 | 34.311 | 34.308 | 68.067 | 29.440 |
| THYRO1000755 | 24.375 | 26.453 | 17.994 | 18.096 | 13.613 | 21.492 | 17.967 | 32.148 |
| THYRO1000756 | 50.530 | 55.367 | 19.662 | 10.236 | 15.906 | 24.457 | 28.624 | 19.162 |
| THYRO1000776 | 24.132 | 29.551 | 15.488 | 11.113 | 9.272 | 17.530 | 17.901 | 15.200 |
| THYRO1000777 | 18.780 | 26.388 | 14.190 | 9.047 | 9.368 | 16.446 | 29.480 | 15.416 |
| THYRO1000779 | 1.795 | 0.000 | 0.000 | 2.494 | 7.457 | 0.000 | 6.362 | 2.532 |
| THYRO1000782 | 47.931 | 38.121 | 28.062 | 11.863 | 22.874 | 28.629 | 25.106 | 23.954 |
| THYRO1000783 | 25.655 | 14.286 | 12.376 | 5.578 | 6.270 | 12.787 | 17.848 | 13.045 |
| THYRO1000786 | 52.665 | 48.137 | 29.971 | 29.960 | 23.410 | 37.344 | 61.708 | 40.990 |
| THYRO1000787 | 300.022 | 78.369 | 95.279 | 31.225 | 58.114 | 149.896 | 140.608 | 55.131 |
| THYRO1000792 | 56.669 | 16.981 | 17.506 | 14.737 | 10.487 | 12.435 | 26.185 | 19.757 |
| THYRO1000793 | 21.782 | 17.626 | 12.726 | 12.269 | 7.738 | 18.245 | 14.576 | 9.048 |
| THYRO1000795 | 35.732 | 43.199 | 24.656 | 10.920 | 12.277 | 22.001 | 20.250 | 17.634 |
| THYRO1000796 | 23.496 | 27.404 | 20.088 | 17.955 | 13.259 | 12.893 | 15.542 | 13.569 |
| THYRO1000798 | 46.024 | 29.017 | 22.439 | 17.032 | 17.838 | 27.756 | 29.891 | 12.085 |
| THYRO1000800 | 51.341 | 77.530 | 54.957 | 81.739 | 91.231 | 44.745 | 43.380 | 63.706 |

TABLE 153

| | | | | | | | | |
|---|---|---|---|---|---|---|---|---|
| THYRO1000805 | 29.203 | 24.611 | 12.889 | 12.552 | 8.708 | 24.185 | 31.195 | 17.746 |
| THYRO1000815 | 116.955 | 165.320 | 75.096 | 94.269 | 59.401 | 58.491 | 42.135 | 74.481 |
| THYRO1000829 | 23.576 | 12.796 | 8.360 | 10.367 | 5.365 | 10.395 | 15.475 | 8.236 |
| THYRO1000835 | 26.167 | 23.644 | 13.936 | 14.093 | 11.798 | 32.901 | 18.905 | 17.992 |
| THYRO1000843 | 33.508 | 44.053 | 31.047 | 36.013 | 19.347 | 21.091 | 20.171 | 23.430 |
| THYRO1000846 | 18.033 | 12.383 | 7.953 | 5.357 | 8.714 | 8.050 | 10.459 | 6.930 |
| THYRO1000852 | 26.571 | 15.703 | 9.149 | 9.589 | 4.965 | 8.428 | 10.204 | 11.995 |
| THYRO1000855 | 45.596 | 37.371 | 20.596 | 42.732 | 32.911 | 16.694 | 31.555 | 30.260 |
| THYRO1000865 | 72.472 | 80.181 | 43.954 | 56.430 | 21.283 | 38.134 | 52.647 | 49.076 |
| THYRO1000866 | 136.754 | 43.702 | 88.564 | 12.275 | 34.870 | 89.966 | 25.647 | 39.646 |
| THYRO1000881 | 484.415 | 303.533 | 220.883 | 156.089 | 149.161 | 314.435 | 262.114 | 229.042 |
| THYRO1000894 | 65.638 | 28.931 | 14.132 | 11.237 | 15.661 | 21.378 | 24.165 | 10.595 |
| THYRO1000895 | 19.040 | 17.281 | 11.079 | 9.005 | 6.164 | 7.972 | 11.149 | 13.327 |
| THYRO1000916 | 68.849 | 51.202 | 36.286 | 38.745 | 35.015 | 21.936 | 23.241 | 21.349 |
| THYRO1000917 | 378.890 | 211.431 | 172.873 | 110.307 | 158.147 | 239.935 | 221.829 | 171.250 |
| THYRO1000926 | 74.104 | 25.922 | 17.751 | 14.409 | 20.225 | 27.710 | 40.030 | 15.229 |
| THYRO1000934 | 21.900 | 17.023 | 11.309 | 10.688 | 4.218 | 13.887 | 14.363 | 11.574 |
| THYRO1000951 | 48.727 | 35.250 | 16.046 | 12.962 | 18.778 | 26.338 | 19.255 | 15.211 |
| THYRO1000952 | 34.577 | 22.838 | 17.193 | 11.759 | 7.673 | 21.372 | 18.800 | 19.736 |
| THYRO1000956 | 37.412 | 15.001 | 11.959 | 8.197 | 4.251 | 13.753 | 14.833 | 20.107 |
| THYRO1000960 | 40.709 | 23.743 | 5.462 | 12.106 | 8.269 | 13.882 | 17.580 | 15.391 |
| THYRO1000961 | 3.619 | 4.816 | 1.934 | 2.829 | 5.229 | 4.913 | 6.632 | 5.076 |
| THYRO1000964 | 31.761 | 18.472 | 14.773 | 9.113 | 13.610 | 18.567 | 17.379 | 12.630 |
| THYRO1000971 | 64.832 | 44.237 | 30.605 | 28.185 | 28.067 | 36.041 | 37.405 | 44.344 |
| THYRO1000974 | 107.219 | 62.723 | 34.195 | 40.953 | 32.826 | 39.260 | 30.469 | 42.586 |
| THYRO1000975 | 81.132 | 53.975 | 52.682 | 49.142 | 35.144 | 34.988 | 44.912 | 43.686 |
| THYRO1000983 | 44.267 | 23.344 | 30.088 | 11.305 | 15.039 | 29.019 | 17.082 | 16.694 |
| THYRO1000984 | 43.136 | 31.868 | 22.917 | 23.200 | 16.640 | 18.941 | 14.647 | 19.412 |
| THYRO1000988 | 77.046 | 58.963 | 40.192 | 43.118 | 60.680 | 33.078 | 20.658 | 30.028 |
| THYRO1000991 | 59.477 | 49.735 | 27.299 | 24.412 | 23.236 | 36.791 | 41.514 | 30.530 |
| THYRO1000999 | 46.173 | 27.320 | 24.436 | 16.574 | 12.745 | 22.240 | 23.460 | 20.374 |
| THYRO1001003 | 45.343 | 40.846 | 34.059 | 27.728 | 30.647 | 22.768 | 14.074 | 29.299 |
| THYRO1001015 | 105.149 | 53.043 | 34.722 | 25.220 | 29.072 | 70.219 | 55.045 | 37.157 |
| THYRO1001016 | 55.018 | 27.688 | 20.817 | 19.166 | 16.243 | 14.052 | 10.907 | 20.419 |
| THYRO1001022 | 34.560 | 25.745 | 16.566 | 9.263 | 10.892 | 16.822 | 19.126 | 15.036 |
| THYRO1001031 | 79.734 | 70.269 | 57.437 | 40.146 | 30.024 | 20.905 | 25.507 | 25.466 |

TABLE 153-continued

| | | | | | | | | |
|---|---|---|---|---|---|---|---|---|
| THYRO1001033 | 22.581 | 21.639 | 10.233 | 5.613 | 5.972 | 14.479 | 22.263 | 14.812 |
| THYRO1001062 | 50.552 | 36.895 | 25.102 | 26.692 | 22.143 | 17.789 | 17.845 | 24.414 |
| THYRO1001063 | 75.298 | 52.927 | 34.731 | 26.645 | 26.587 | 31.088 | 36.388 | 28.011 |
| THYRO1001071 | 15.221 | 6.957 | 5.949 | 2.033 | 6.433 | 6.642 | 7.745 | 6.223 |
| THYRO1001080 | 47.009 | 39.873 | 20.480 | 18.101 | 20.162 | 20.086 | 35.494 | 27.474 |
| THYRO1001093 | 66.980 | 65.072 | 31.618 | 33.564 | 16.112 | 27.365 | 31.863 | 34.516 |
| THYRO1001100 | 21.067 | 15.255 | 12.169 | 9.015 | 5.970 | 14.570 | 15.506 | 13.653 |
| THYRO1001102 | 18.746 | 18.080 | 6.257 | 4.335 | 1.730 | 11.510 | 9.775 | 8.902 |
| THYRO1001104 | 18.657 | 25.635 | 14.755 | 25.137 | 12.793 | 22.720 | 23.958 | 26.681 |
| THYRO1001109 | 15.251 | 15.230 | 8.676 | 4.654 | 5.820 | 7.397 | 12.338 | 9.739 |
| THYRO1001113 | 37.344 | 45.395 | 7.359 | 6.259 | 16.170 | 12.948 | 22.426 | 17.552 |
| THYRO1001120 | 80.202 | 35.430 | 22.559 | 15.448 | 18.774 | 31.803 | 42.346 | 22.885 |
| THYRO1001121 | 52.621 | 42.522 | 27.046 | 29.236 | 28.248 | 24.648 | 46.988 | 38.643 |
| THYRO1001128 | 136.958 | 100.049 | 61.329 | 56.461 | 53.098 | 61.086 | 60.358 | 56.767 |
| THYRO1001133 | 94.452 | 101.822 | 62.367 | 57.536 | 40.128 | 46.930 | 37.716 | 49.125 |
| THYRO1001134 | 17.941 | 17.461 | 8.019 | 4.846 | 6.568 | 9.163 | 14.613 | 12.344 |
| THYRO1001142 | 10.016 | 5.374 | 4.501 | 1.699 | 2.274 | 4.180 | 3.267 | 3.903 |
| THYRO1001173 | 315.863 | 215.361 | 158.303 | 99.619 | 143.648 | 173.339 | 189.443 | 126.977 |
| THYRO1001175 | 38.323 | 13.237 | 7.198 | 6.214 | 10.354 | 14.774 | 23.098 | 12.914 |
| THYRO1001177 | 65.825 | 73.170 | 30.535 | 23.781 | 36.556 | 23.552 | 39.234 | 27.932 |
| THYRO1001189 | 71.764 | 109.416 | 54.067 | 80.715 | 51.976 | 45.521 | 44.962 | 108.449 |
| THYRO1001194 | 43.753 | 58.316 | 68.460 | 31.797 | 22.784 | 16.960 | 16.508 | 31.677 |
| THYRO1001204 | 24.393 | 20.084 | 15.874 | 17.477 | 14.104 | 29.010 | 29.959 | 20.054 |
| THYRO1001205 | 444.098 | 372.962 | 225.154 | 217.033 | 189.087 | 246.605 | 214.186 | 193.594 |
| THYRO1001213 | 59.798 | 77.150 | 45.729 | 51.526 | 31.541 | 26.773 | 26.362 | 35.040 |
| THYRO1001224 | 53.123 | 51.273 | 33.830 | 51.454 | 44.844 | 34.214 | 24.649 | 47.409 |
| THYRO1001237 | 106.442 | 74.420 | 27.897 | 20.382 | 32.686 | 50.109 | 49.913 | 35.697 |
| THYRO1001242 | 742.882 | 336.755 | 278.663 | 173.174 | 332.014 | 438.140 | 526.417 | 308.380 |

TABLE 154

| | | | | | | | | |
|---|---|---|---|---|---|---|---|---|
| THYRO1001258 | 115.192 | 68.322 | 37.962 | 28.447 | 39.496 | 73.140 | 89.614 | 50.152 |
| THYRO1001262 | 29.592 | 38.992 | 24.922 | 22.829 | 20.191 | 14.595 | 14.682 | 19.309 |
| THYRO1001266 | 24.695 | 23.851 | 16.014 | 7.968 | 11.573 | 18.488 | 19.268 | 13.434 |
| THYRO1001271 | 37.090 | 37.276 | 12.145 | 11.215 | 2.868 | 19.505 | 17.992 | 11.460 |
| THYRO1001287 | 69.292 | 40.644 | 17.033 | 16.333 | 18.990 | 24.523 | 40.591 | 27.350 |
| THYRO1001290 | 38.183 | 9.778 | 9.132 | 6.909 | 7.883 | 17.550 | 22.844 | 10.046 |
| THYRO1001291 | 27.456 | 31.200 | 13.335 | 8.894 | 13.643 | 16.343 | 24.246 | 14.305 |
| THYRO1001297 | 22.802 | 40.193 | 15.454 | 24.356 | 18.908 | 13.849 | 19.636 | 27.811 |
| THYRO1001302 | 32.724 | 25.039 | 21.076 | 11.586 | 19.524 | 23.410 | 57.069 | 22.259 |
| THYRO1001313 | 54.483 | 44.710 | 22.791 | 17.196 | 22.860 | 28.535 | 38.530 | 26.619 |
| THYRO1001320 | 67.151 | 79.399 | 38.582 | 43.377 | 31.441 | 31.488 | 30.487 | 34.150 |
| THYRO1001321 | 32.185 | 46.760 | 20.156 | 31.133 | 26.936 | 21.803 | 17.729 | 26.264 |
| THYRO1001322 | 56.040 | 44.139 | 25.288 | 32.717 | 26.245 | 19.900 | 28.415 | 30.093 |
| THYRO1001327 | 11.598 | 12.117 | 3.614 | 3.130 | 6.285 | 5.136 | 8.978 | 9.997 |
| THYRO1001336 | 45.342 | 100.054 | 38.339 | 43.663 | 34.416 | 23.794 | 31.249 | 61.226 |
| THYRO1001347 | 8.316 | 11.569 | 4.451 | 4.135 | 3.827 | 2.861 | 6.260 | 3.931 |
| THYRO1001358 | 96.749 | 91.718 | 27.513 | 38.148 | 45.764 | 39.905 | 54.447 | 48.267 |
| THYRO1001363 | 76.229 | 50.596 | 45.707 | 32.563 | 22.003 | 40.930 | 35.965 | 23.714 |
| THYRO1001365 | 63.340 | 44.755 | 24.569 | 15.278 | 14.500 | 31.255 | 62.023 | 22.216 |
| THYRO1001374 | 80.359 | 54.703 | 28.941 | 21.895 | 26.409 | 86.809 | 59.724 | 67.154 |
| THYRO1001401 | 138.528 | 81.793 | 116.025 | 115.772 | 62.059 | 81.850 | 81.710 | 84.369 |
| THYRO1001403 | 75.077 | 60.253 | 47.159 | 43.576 | 31.391 | 38.040 | 41.579 | 34.801 |
| THYRO1001405 | 75.788 | 63.929 | 37.018 | 66.708 | 25.398 | 44.268 | 169.777 | 92.288 |
| THYRO1001406 | 99.789 | 119.681 | 106.617 | 111.553 | 73.294 | 82.322 | 63.741 | 106.694 |
| THYRO1001411 | 164.801 | 155.374 | 122.876 | 101.166 | 90.616 | 97.554 | 90.344 | 81.141 |
| THYRO1001420 | 467.850 | 125.400 | 141.742 | 95.133 | 79.850 | 256.705 | 243.974 | 168.095 |
| THYRO1001426 | 179.694 | 226.744 | 136.659 | 182.920 | 57.912 | 158.699 | 76.886 | 79.382 |
| THYRO1001430 | 42.233 | 36.308 | 24.265 | 13.334 | 24.942 | 28.220 | 31.096 | 31.763 |
| THYRO1001434 | 109.844 | 40.429 | 23.142 | 7.076 | 19.838 | 16.721 | 46.971 | 13.694 |
| THYRO1001456 | 86.810 | 51.093 | 28.827 | 22.686 | 29.334 | 38.972 | 42.073 | 32.789 |
| THYRO1001457 | 98.410 | 46.954 | 51.922 | 44.428 | 26.365 | 68.702 | 73.800 | 71.948 |
| THYRO1001458 | 142.203 | 61.648 | 63.756 | 91.611 | 29.372 | 63.294 | 57.491 | 83.860 |
| THYRO1001459 | 98.569 | 70.732 | 48.940 | 49.572 | 33.394 | 53.365 | 59.458 | 61.428 |
| THYRO1001471 | 29.011 | 30.922 | 22.501 | 12.339 | 12.979 | 11.855 | 19.026 | 15.004 |
| THYRO1001478 | 88.744 | 24.933 | 23.684 | 23.261 | 16.773 | 41.417 | 28.941 | 16.857 |
| THYRO1001480 | 198.549 | 217.139 | 159.064 | 171.096 | 130.028 | 161.021 | 98.977 | 203.804 |
| THYRO1001481 | 72.983 | 76.982 | 51.877 | 37.940 | 41.871 | 34.156 | 32.190 | 31.811 |
| THYRO1001487 | 156.213 | 112.142 | 110.985 | 77.310 | 74.839 | 88.309 | 62.208 | 64.884 |
| THYRO1001495 | 60.311 | 64.175 | 75.269 | 57.588 | 39.964 | 22.882 | 51.168 | 78.626 |
| THYRO1001498 | 60.093 | 50.240 | 28.962 | 43.623 | 28.080 | 27.349 | 44.121 | 57.310 |
| THYRO1001510 | 78.106 | 71.131 | 37.969 | 22.613 | 29.598 | 45.141 | 25.613 | 34.714 |
| THYRO1001512 | 146.930 | 95.726 | 82.300 | 47.386 | 70.311 | 138.360 | 106.274 | 87.137 |
| THYRO1001519 | 143.411 | 115.340 | 57.861 | 92.182 | 36.860 | 89.655 | 54.540 | 72.487 |
| THYRO1001522 | 86.178 | 52.213 | 40.302 | 33.014 | 28.267 | 48.497 | 38.421 | 32.647 |
| THYRO1001523 | 42.807 | 21.996 | 19.646 | 7.023 | 13.176 | 31.304 | 17.358 | 26.586 |

TABLE 154-continued

| | | | | | | | | |
|---|---|---|---|---|---|---|---|---|
| THYRO1001526 | 28.272 | 36.470 | 18.141 | 20.984 | 18.220 | 25.059 | 22.056 | 22.382 |
| THYRO1001529 | 56.422 | 40.050 | 50.636 | 49.921 | 36.172 | 38.431 | 43.929 | 41.984 |
| THYRO1001534 | 79.983 | 41.565 | 36.130 | 45.070 | 31.736 | 27.199 | 39.647 | 22.708 |
| THYRO1001537 | 266.845 | 336.357 | 127.186 | 167.167 | 121.366 | 235.919 | 269.119 | 105.552 |
| THYRO1001541 | 184.924 | 142.434 | 89.266 | 94.007 | 73.101 | 77.708 | 42.435 | 36.282 |
| THYRO1001545 | 45.721 | 28.807 | 17.637 | 23.355 | 11.596 | 33.223 | 26.025 | 32.640 |
| THYRO1001559 | 30.285 | 28.050 | 27.503 | 21.583 | 24.440 | 18.855 | 21.731 | 20.280 |
| THYRO1001563 | 81.147 | 53.590 | 40.132 | 34.989 | 31.762 | 54.315 | 46.120 | 51.808 |
| THYRO1001570 | 160.698 | 53.241 | 43.074 | 13.542 | 48.479 | 91.833 | 66.191 | 35.765 |
| THYRO1001573 | 121.318 | 40.895 | 58.993 | 29.240 | 41.403 | 54.710 | 52.876 | 28.623 |
| THYRO1001584 | 69.312 | 78.135 | 36.886 | 44.973 | 43.785 | 43.480 | 40.786 | 52.141 |
| THYRO1001593 | 44.626 | 47.299 | 8.544 | 35.805 | 8.587 | 5.747 | 5.738 | 4.447 |
| THYRO1001595 | 86.556 | 81.363 | 41.727 | 44.260 | 36.433 | 28.946 | 28.668 | 31.638 |
| THYRO1001596 | 68.810 | 32.126 | 33.747 | 19.824 | 25.437 | 33.051 | 41.347 | 20.355 |
| THYRO1001602 | 83.486 | 75.627 | 45.307 | 63.834 | 30.332 | 45.771 | 44.672 | 49.010 |
| THYRO1001605 | 44.557 | 32.876 | 26.697 | 55.092 | 18.403 | 5.627 | 17.556 | 16.676 |
| THYRO1001608 | 155.484 | 67.359 | 43.850 | 31.079 | 31.843 | 58.215 | 58.920 | 39.494 |
| THYRO1001617 | 84.352 | 72.661 | 68.377 | 48.198 | 54.691 | 37.282 | 30.097 | 54.744 |
| THYRO1001634 | 61.852 | 39.793 | 24.126 | 16.827 | 22.530 | 35.972 | 34.077 | 28.775 |

TABLE 155

| | | | | | | | | |
|---|---|---|---|---|---|---|---|---|
| THYRO1001637 | 114.477 | 126.686 | 100.621 | 117.804 | 62.577 | 74.963 | 57.380 | 70.174 |
| THYRO1001641 | 56.288 | 37.515 | 23.987 | 22.669 | 22.635 | 47.096 | 31.301 | 36.440 |
| THYRO1001656 | 46.272 | 34.075 | 24.272 | 14.259 | 16.135 | 20.671 | 23.336 | 16.130 |
| THYRO1001658 | 38.715 | 35.384 | 15.215 | 12.669 | 11.948 | 23.345 | 31.267 | 21.631 |
| THYRO1001661 | 32.296 | 22.714 | 17.431 | 15.015 | 9.537 | 9.794 | 20.777 | 17.147 |
| THYRO1001671 | 50.011 | 59.547 | 50.424 | 34.364 | 50.747 | 38.082 | 34.858 | 41.054 |
| THYRO1001672 | 174.047 | 48.626 | 52.990 | 17.925 | 41.381 | 103.416 | 95.249 | 37.062 |
| THYRO1001673 | 84.547 | 78.591 | 41.886 | 44.045 | 40.533 | 34.065 | 30.562 | 33.114 |
| THYRO1001677 | 115.789 | 184.195 | 53.250 | 75.184 | 37.282 | 129.575 | 60.337 | 112.501 |
| THYRO1001683 | 38.015 | 42.900 | 56.368 | 28.898 | 58.930 | 62.855 | 51.341 | 29.701 |
| THYRO1001700 | 96.033 | 45.482 | 30.258 | 16.461 | 15.124 | 50.006 | 58.501 | 25.463 |
| THYRO1001702 | 104.525 | 90.670 | 66.901 | 45.679 | 27.558 | 56.203 | 56.767 | 54.824 |
| THYRO1001703 | 130.645 | 112.852 | 65.413 | 39.114 | 40.388 | 88.732 | 101.241 | 68.988 |
| THYRO1001706 | 91.082 | 82.049 | 58.522 | 50.870 | 37.126 | 36.387 | 37.277 | 63.203 |
| THYRO1001721 | 34.852 | 21.558 | 20.543 | 5.921 | 22.162 | 9.493 | 31.475 | 17.215 |
| THYRO1001725 | 49.609 | 39.621 | 22.513 | 28.557 | 23.707 | 34.262 | 31.779 | 30.693 |
| THYRO1001730 | 401.603 | 145.337 | 161.719 | 64.173 | 142.140 | 284.093 | 229.429 | 104.416 |
| THYRO1001738 | 89.896 | 75.892 | 33.629 | 38.777 | 22.430 | 45.582 | 54.154 | 54.913 |
| THYRO1001743 | 49.231 | 21.758 | 27.130 | 12.056 | 9.553 | 33.154 | 29.680 | 20.832 |
| THYRO1001745 | 34.753 | 17.745 | 12.052 | 5.744 | 9.946 | 20.567 | 17.357 | 15.138 |
| THYRO1001746 | 41.622 | 31.766 | 23.996 | 18.634 | 16.249 | 24.636 | 33.799 | 27.306 |
| THYRO1001770 | 103.357 | 62.531 | 51.786 | 43.073 | 39.785 | 65.980 | 54.332 | 47.446 |
| THYRO1001772 | 129.127 | 129.155 | 79.515 | 82.371 | 76.101 | 53.649 | 49.368 | 77.136 |
| THYRO1001778 | 384.882 | 146.526 | 97.702 | 61.349 | 90.096 | 136.302 | 175.998 | 86.468 |
| THYRO1001793 | 105.591 | 94.089 | 51.614 | 51.310 | 47.627 | 57.471 | 55.262 | 69.224 |
| THYRO1001796 | 218.755 | 90.413 | 86.089 | 46.396 | 63.339 | 153.810 | 148.699 | 63.431 |
| THYRO1001800 | 89.126 | 64.948 | 37.534 | 20.212 | 33.235 | 41.405 | 36.130 | 25.761 |
| THYRO1001803 | 272.135 | 195.625 | 179.931 | 121.130 | 156.151 | 183.032 | 218.545 | 154.914 |
| THYRO1001809 | 58.170 | 31.728 | 28.593 | 29.699 | 25.633 | 36.954 | 29.839 | 25.467 |
| THYRO1001817 | 64.728 | 50.418 | 26.089 | 15.924 | 19.828 | 34.567 | 51.140 | 43.878 |
| THYRO1001819 | 190.982 | 76.509 | 54.579 | 22.923 | 63.162 | 79.239 | 96.822 | 48.339 |
| THYRO1001828 | 234.551 | 180.238 | 92.244 | 80.148 | 104.168 | 85.912 | 160.310 | 122.500 |
| THYRO1001854 | 219.242 | 211.323 | 112.250 | 150.918 | 95.727 | 100.608 | 75.437 | 109.696 |
| THYRO1001895 | 44.632 | 35.971 | 20.836 | 14.220 | 19.503 | 17.351 | 23.442 | 22.241 |
| THYRO1001907 | 93.660 | 85.352 | 41.680 | 44.441 | 40.868 | 38.888 | 56.595 | 43.717 |
| TRACH1000006 | 33.077 | 27.517 | 13.610 | 11.659 | 11.195 | 23.390 | 21.396 | 13.682 |
| TRACH1000013 | 26.029 | 19.365 | 8.037 | 11.958 | 5.076 | 14.402 | 20.496 | 12.167 |
| TRACH1000074 | 86.302 | 70.850 | 32.892 | 34.317 | 28.366 | 44.067 | 58.165 | 52.228 |
| TRACH1000095 | 48.021 | 44.110 | 17.672 | 16.895 | 20.410 | 35.389 | 47.442 | 40.607 |
| TRACH1000102 | 160.667 | 128.745 | 55.282 | 64.147 | 57.430 | 67.455 | 96.519 | 73.638 |
| TRACH1000108 | 25.597 | 37.670 | 13.402 | 14.907 | 16.504 | 16.136 | 17.158 | 22.858 |
| TRACH1000126 | 77.681 | 74.516 | 36.350 | 26.803 | 33.821 | 49.762 | 65.600 | 50.277 |
| TRACH1000146 | 73.548 | 74.493 | 25.762 | 17.947 | 22.979 | 32.054 | 38.447 | 25.115 |
| TRACH1000160 | 48.076 | 58.220 | 20.043 | 15.138 | 20.069 | 33.175 | 33.858 | 10.911 |
| TRACH1000184 | 91.686 | 86.638 | 74.932 | 279.361 | 88.220 | 48.252 | 53.846 | 52.975 |
| VESEN1000004 | 62.054 | 51.690 | 18.581 | 21.964 | 17.610 | 26.122 | 42.606 | 29.900 |
| VESEN1000007 | 99.131 | 44.516 | 29.577 | 21.187 | 27.518 | 43.145 | 68.086 | 49.423 |
| VESEN1000013 | 171.250 | 57.002 | 40.813 | 26.552 | 35.545 | 51.737 | 104.132 | 45.994 |
| VESEN1000028 | 154.863 | 100.292 | 99.295 | 65.820 | 64.165 | 105.318 | 97.599 | 79.474 |
| VESEN1000059 | 144.402 | 97.274 | 74.579 | 50.603 | 39.182 | 86.619 | 98.065 | 63.442 |
| VESEN1000100 | 189.864 | 121.300 | 76.817 | 72.933 | 34.794 | 116.439 | 77.465 | 65.031 |
| VESEN1000107 | 86.037 | 54.735 | 41.418 | 35.034 | 31.521 | 66.087 | 66.041 | 39.378 |
| VESEN1000117 | 76.673 | 47.432 | 28.526 | 16.406 | 24.766 | 41.803 | 57.926 | 29.302 |
| VESEN1000122 | 58.990 | 42.673 | 43.051 | 39.986 | 31.414 | 56.718 | 73.186 | 51.792 |

TABLE 155-continued

| | | | | | | | | |
|---|---|---|---|---|---|---|---|---|
| VESEN1000137 | 28.827 | 12.637 | 7.708 | 3.164 | 11.517 | 19.000 | 24.465 | 12.213 |
| VESEN1000195 | 163.283 | 63.672 | 50.465 | 38.118 | 37.080 | 54.086 | 101.701 | 58.407 |
| VESEN1000215 | 9.881 | 2.089 | 6.413 | 1.074 | 2.285 | 0.000 | 7.414 | 9.842 |
| VESEN1000279 | 402.741 | 271.057 | 182.622 | 118.097 | 189.914 | 225.664 | 188.843 | 101.819 |
| VESEN1000363 | 302.568 | 148.812 | 122.811 | 95.469 | 86.731 | 148.698 | 141.113 | 78.717 |
| VESEN1000388 | 162.477 | 40.549 | 65.388 | 30.129 | 37.997 | 96.063 | 69.144 | 66.497 |
| VESEN1000394 | 142.530 | 93.533 | 77.611 | 46.922 | 58.268 | 86.276 | 96.211 | 70.505 |
| VESEN1000410 | 136.126 | 38.001 | 29.774 | 12.727 | 26.741 | 68.866 | 54.097 | 73.237 |
| VESEN1000411 | 95.259 | 49.542 | 42.301 | 40.898 | 26.132 | 46.132 | 57.517 | 59.117 |
| VESEN1000415 | 97.225 | 63.935 | 46.211 | 36.640 | 29.907 | 51.713 | 51.249 | 62.215 |

TABLE 156

| | | | | | | | | |
|---|---|---|---|---|---|---|---|---|
| VESEN1000440 | 101.690 | 47.149 | 49.195 | 32.607 | 27.881 | 49.154 | 46.485 | 40.340 |
| VESEN1000452 | 188.242 | 75.844 | 67.861 | 21.929 | 49.688 | 101.557 | 105.023 | 55.625 |
| VESEN1000539 | 393.622 | 128.413 | 233.289 | 155.268 | 285.073 | 217.892 | 156.970 | 106.498 |
| VESEN1000554 | 44.150 | 40.448 | 28.459 | 17.920 | 17.204 | 20.338 | 40.271 | 30.185 |
| VESEN1000557 | 108.763 | 50.564 | 47.257 | 21.505 | 36.349 | 59.158 | 68.956 | 34.611 |
| VESEN1000575 | 151.228 | 53.084 | 39.503 | 26.612 | 41.610 | 59.636 | 65.502 | 37.85 |
| VESEN1000585 | 106.127 | 43.069 | 41.516 | 30.022 | 40.857 | 51.129 | 80.130 | 52.937 |
| VESEN1000592 | 3.732 | 4.371 | 1.727 | 2.763 | 2.784 | 4.336 | 0.000 | 0.000 |
| VESEN1000658 | 122.632 | 54.799 | 53.689 | 27.783 | 41.778 | 66.943 | 69.146 | 46.823 |
| VESEN1000669 | 454.284 | 184.969 | 184.094 | 116.303 | 152.848 | 275.995 | 209.035 | 150.917 |
| VESEN1000743 | 93.271 | 66.577 | 38.667 | 37.030 | 25.203 | 47.385 | 47.073 | 46.048 |
| VESEN1000752 | 132.397 | 105.539 | 71.129 | 71.113 | 87.050 | 96.768 | 63.315 | 77.177 |
| VESEN1000761 | 58.860 | 37.210 | 39.232 | 28.055 | 41.286 | 48.665 | 37.844 | 25.644 |
| VESEN2000039 | 1610.708 | 423.257 | 575.130 | 281.845 | 514.008 | 1029.335 | 742.044 | 261.643 |
| VESEN2000102 | 157.000 | 68.371 | 47.526 | 31.817 | 43.466 | 78.881 | 87.904 | 46.756 |
| VESEN2000164 | 67.615 | 99.316 | 47.555 | 50.732 | 57.545 | 101.472 | 141.913 | 60.455 |
| VESEN2000175 | 11.198 | 3.920 | 4.227 | 2.329 | 1.448 | 2.820 | 3.186 | 3.710 |
| VESEN2000186 | 302.893 | 166.977 | 128.067 | 101.481 | 89.845 | 151.983 | 136.632 | 157.737 |
| VESEN2000199 | 364.016 | 262.765 | 186.502 | 152.072 | 152.565 | 198.826 | 191.332 | 195.186 |
| VESEN2000200 | 61.361 | 28.617 | 25.760 | 13.454 | 12.471 | 25.754 | 39.784 | 31.121 |
| VESEN2000204 | 59.937 | 29.170 | 19.088 | 10.312 | 16.203 | 30.641 | 61.987 | 24.109 |
| VESEN2000218 | 46.156 | 34.497 | 30.351 | 21.300 | 16.675 | 31.656 | 29.879 | 27.886 |
| VESEN2000230 | 87.277 | 57.160 | 38.252 | 30.651 | 31.117 | 44.365 | 42.098 | 43.558 |
| VESEN2000272 | 18.326 | 25.046 | 19.526 | 14.701 | 21.471 | 15.146 | 23.503 | 20.851 |
| VESEN2000299 | 81.003 | 29.068 | 28.969 | 16.886 | 22.798 | 37.073 | 38.504 | 23.627 |
| VESEN2000323 | 102.974 | 73.231 | 65.632 | 62.476 | 64.170 | 44.083 | 52.687 | 53.681 |
| VESEN2000327 | 273.358 | 190.493 | 102.117 | 60.523 | 95.669 | 114.144 | 160.249 | 65.341 |
| VESEN2000328 | 52.003 | 27.894 | 15.775 | 9.884 | 11.945 | 24.112 | 26.254 | 20.997 |
| VESEN2000330 | 109.315 | 77.876 | 36.393 | 27.267 | 44.428 | 48.237 | 51.597 | 44.132 |
| VESEN2000336 | 55.020 | 22.112 | 15.818 | 14.036 | 11.558 | 21.687 | 27.119 | 27.342 |
| VESEN2000354 | 157.246 | 74.852 | 37.950 | 19.235 | 42.182 | 51.559 | 45.485 | 29.194 |
| VESEN2000378 | 66.998 | 66.140 | 23.647 | 15.673 | 16.217 | 28.709 | 41.497 | 35.393 |
| VESEN2000379 | 54.007 | 68.263 | 27.636 | 45.302 | 17.881 | 35.928 | 44.060 | 55.125 |
| VESEN2000397 | 27.834 | 20.615 | 10.624 | 8.727 | 4.818 | 15.386 | 21.163 | 18.688 |
| VESEN2000416 | 32.241 | 18.712 | 9.825 | 8.843 | 5.474 | 12.685 | 17.453 | 16.485 |
| VESEN2000420 | 26.334 | 9.499 | 7.013 | 2.363 | 5.104 | 8.281 | 2.634 | 1.015 |
| VESEN2000430 | 18.312 | 20.459 | 12.183 | 7.101 | 4.975 | 13.810 | 17.050 | 19.805 |
| VESEN2000448 | 39.040 | 15.163 | 13.638 | 4.769 | 9.693 | 14.334 | 26.387 | 13.923 |
| VESEN2000449 | 130.475 | 60.437 | 47.055 | 28.198 | 46.878 | 64.756 | 79.761 | 49.783 |
| VESEN2000456 | 54.149 | 49.676 | 24.294 | 20.921 | 18.957 | 24.771 | 39.745 | 38.640 |
| VESEN2000562 | 96.176 | 59.785 | 49.030 | 22.452 | 26.435 | 64.420 | 70.890 | 48.405 |
| VESEN2000573 | 9.605 | 2.326 | 1.730 | 0.480 | 0.850 | 3.785 | 3.113 | 2.414 |
| VESEN2000604 | 89.021 | 25.246 | 24.495 | 10.300 | 14.725 | 40.448 | 47.664 | 24.062 |
| VESEN2000614 | 309.658 | 310.143 | 158.396 | 121.428 | 98.306 | 193.176 | 285.544 | 193.901 |
| VESEN2000638 | 20.825 | 13.750 | 9.472 | 3.518 | 6.018 | 8.616 | 15.565 | 14.138 |
| VESEN2000641 | 48.159 | 26.214 | 12.211 | 7.625 | 12.728 | 19.489 | 34.963 | 19.847 |
| YESEN2000645 | 59.209 | 24.195 | 14.955 | 7.186 | 18.507 | 28.178 | 34.263 | 17.733 |
| Y79AA1000013 | 157.258 | 82.237 | 47.630 | 29.858 | 46.920 | 77.296 | 68.488 | 40.042 |
| Y79AA1000030 | 243.192 | 141.007 | 106.937 | 74.649 | 80.890 | 166.613 | 137.379 | 98.647 |
| Y79AA1000033 | 49.439 | 83.718 | 30.433 | 22.365 | 22.376 | 31.534 | 35.936 | 31.220 |
| Y79AA1000037 | 41.732 | 23.568 | 14.154 | 16.224 | 15.348 | 13.136 | 21.199 | 6.632 |
| Y79AA1000041 | 32.341 | 27.270 | 14.230 | 18.610 | 9.838 | 21.052 | 18.336 | 19.147 |
| Y79AA1000059 | 153.140 | 85.760 | 57.915 | 58.738 | 48.608 | 73.595 | 69.769 | 54.893 |
| Y79AA1000065 | 29.024 | 32.383 | 43.083 | 35.688 | 53.004 | 14.961 | 23.027 | 24.640 |
| Y79AA1000081 | 173.505 | 497.689 | 138.675 | 253.938 | 133.917 | 128.427 | 148.052 | 120.067 |
| Y79AA1000127 | 103.173 | 80.281 | 69.484 | 68.351 | 62.524 | 80.674 | 36.808 | 76.356 |
| Y79AA1000130 | 69.801 | 86.217 | 30.612 | 44.271 | 38.125 | 34.801 | 24.913 | 36.307 |
| Y79AA1000131 | 153.662 | 1161.128 | 226.879 | 579.469 | 215.457 | 854.176 | 483.175 | 1147.374 |
| Y79AA1000134 | 127.126 | 50.652 | 49.040 | 26.779 | 39.721 | 89.186 | 71.223 | 41.628 |
| Y79AA1000143 | 38.064 | 56.092 | 35.659 | 31.888 | 43.450 | 26.885 | 22.084 | 33.064 |
| Y79AA1000144 | 20.785 | 16.047 | 11.172 | 9.422 | 12.441 | 12.606 | 10.549 | 17.382 |
| Y79AA1000150 | 70.908 | 50.343 | 31.433 | 31.813 | 43.554 | 44.314 | 68.333 | 45.702 |
| Y79AA1000153 | 473.493 | 498.355 | 203.636 | 356.247 | 217.748 | 319.244 | 390.823 | 511.885 |
| Y79AA1000166 | 75.693 | 64.809 | 33.184 | 43.509 | 28.975 | 33.094 | 32.512 | 48.232 |

TABLE 157

| | | | | | | | | |
|---|---|---|---|---|---|---|---|---|
| Y79AA1000179 | 86.164 | 94.446 | 49.366 | 55.296 | 56.791 | 60.147 | 47.613 | 52.526 |
| Y79AA1000181 | 80.781 | 67.215 | 32.483 | 29.549 | 31.500 | 35.404 | 49.327 | 33.106 |
| Y79AA1000202 | 306.822 | 216.805 | 147.425 | 103.426 | 137.718 | 171.835 | 204.385 | 165.929 |
| Y79AA1000207 | 105.429 | 123.961 | 53.587 | 73.034 | 70.343 | 43.214 | 45.289 | 43.628 |
| Y79AA1000214 | 383.142 | 209.292 | 152.641 | 183.832 | 147.889 | 192.552 | 228.518 | 129.266 |
| Y79AA1000222 | 22.954 | 21.555 | 15.620 | 61.846 | 15.816 | 19.929 | 16.831 | 13.933 |
| Y79AA1000226 | 132.385 | 17.693 | 43.017 | 23.388 | 43.039 | 51.041 | 132.959 | 53.641 |
| Y79AA1000227 | 115.766 | 115.677 | 67.073 | 61.011 | 55.085 | 60.149 | 67.002 | 75.560 |
| Y79AA1000230 | 45.896 | 40.474 | 17.716 | 13.218 | 16.881 | 19.738 | 28.415 | 24.012 |
| Y79AA1000231 | 89.296 | 107.825 | 54.778 | 82.032 | 51.998 | 46.803 | 58.529 | 93.293 |
| Y79AA1000239 | 50.494 | 47.587 | 29.697 | 28.552 | 35.135 | 32.631 | 62.953 | 29.843 |
| Y79AA1000258 | 45.676 | 53.770 | 28.305 | 21.170 | 27.158 | 24.070 | 38.214 | 28.393 |
| Y79AA1000268 | 116.499 | 61.766 | 35.684 | 30.031 | 40.259 | 65.427 | 65.925 | 48.582 |
| Y79AA1000269 | 36.988 | 41.536 | 21.854 | 18.345 | 26.984 | 89.369 | 74.183 | 28.252 |
| Y79AA1000270 | 70.349 | 65.424 | 33.771 | 24.490 | 36.913 | 20.903 | 38.891 | 30.089 |
| Y79AA1000280 | 52.901 | 53.162 | 47.984 | 50.005 | 29.457 | 37.014 | 42.331 | 53.345 |
| Y79AA1000285 | 37.272 | 42.207 | 25.179 | 14.304 | 14.336 | 34.801 | 24.865 | 20.291 |
| Y79AA1000295 | 10.340 | 10.594 | 11.909 | 7.559 | 12.902 | 8.040 | 7.052 | 8.641 |
| Y79AA1000307 | 67.533 | 64.757 | 61.969 | 64.592 | 36.178 | 56.127 | 56.928 | 58.020 |
| Y79AA1000313 | 224.230 | 107.870 | 95.224 | 65.861 | 65.836 | 94.564 | 146.279 | 83.495 |
| Y79AA1000314 | 150.954 | 88.811 | T14.139 | 31.101 | 138.725 | 106.102 | 94.884 | 43.590 |
| Y79AA1000328 | 25.270 | 21.003 | 21.314 | 15.992 | 13.358 | 17.078 | 25.728 | 22.062 |
| Y79AA1000334 | 70.086 | 48.685 | 34.036 | 32.394 | 26.956 | 25.485 | 44.339 | 35.712 |
| Y79AA1000342 | 445.189 | 140.661 | 207.068 | 102.538 | 170.033 | 280.562 | 201.342 | 123.827 |
| Y79AA1000346 | 44.966 | 28.105 | 25.613 | 13.811 | 29.974 | 38.613 | 18.724 | 15.227 |
| Y79AA1000347 | 163.577 | 87.476 | 90.030 | 89.865 | 36.284 | 83.081 | 92.665 | 49.209 |
| Y79AA1000349 | 180.947 | 135.094 | 102.606 | 92.069 | 66.005 | 137.226 | 121.401 | 90.266 |
| Y79AA1000355 | 81.202 | 61.139 | 54.018 | 52.567 | 41.342 | 46.383 | 35.944 | 35.848 |
| Y79AA1000368 | 45.079 | 38.521 | 25.612 | 35.417 | 24.877 | 35.299 | 37.961 | 39.102 |
| Y79AA1000388 | 34.856 | 29.318 | 53.178 | 46.283 | 64.992 | 15.602 | 20.395 | 27.793 |
| Y79AA1000392 | 274.040 | 169.752 | 96.625 | 109.904 | 62.391 | 137.141 | 143.707 | 98.881 |
| Y79AA1000405 | 52.788 | 38.000 | 27.665 | 15.987 | 21.983 | 34.628 | 36.536 | 24.328 |
| Y79AA1000410 | 367.438 | 401.406 | 216.699 | 294.500 | 169.645 | 216.009 | 99.999 | 119.786 |
| Y79AA1000420 | 19.321 | 19.430 | 17.167 | 18.384 | 13.307 | 17.286 | 11.353 | 16.663 |
| Y79AA1000423 | 54.384 | 64.128 | 38.233 | 39.006 | 35.194 | 25.311 | 19.482 | 25.935 |
| Y79AA1000426 | 51.920 | 32.060 | 27.489 | 16.208 | 18.993 | 28.308 | 30.801 | 19.059 |
| Y79AA1000432 | 31.920 | 23.564 | 18.505 | 7.033 | 17.684 | 13.924 | 19.534 | 15.486 |
| Y79AA1000453 | 100.064 | 106.207 | 64.195 | 87.842 | 32.741 | 36.705 | 43.951 | 75.421 |
| Y79AA1000465 | 32.600 | 20.760 | 8.375 | 9.114 | 6.582 | 11.349 | 19.307 | 16.375 |
| Y79AA1000469 | 97.006 | 89.211 | 57.415 | 39.971 | 51.138 | 78.959 | 69.898 | 46.327 |
| Y79AA1000480 | 49.123 | 43.661 | 36.763 | 32.840 | 25.674 | 27.684 | 32.111 | 29.981 |
| Y79AA1000502 | 29.200 | 23.820 | 30.903 | 19.340 | 29.500 | 19.819 | 9.990 | 17.119 |
| Y79AA1000521 | 165.752 | 60.574 | 64.764 | 35.797 | 44.981 | 81.691 | 94.837 | 59.780 |
| Y79AA1000534 | 40.465 | 37.392 | 29.025 | 27.278 | 27.637 | 22.639 | 17.299 | 34.366 |
| Y79AA1000538 | 90.033 | 71.681 | 68.241 | 72.563 | 53.051 | 55.445 | 40.270 | 39.870 |
| Y79AA1000539 | 97.472 | 118.331 | 63.966 | 95.779 | 78.679 | 49.286 | 67.204 | 89.085 |
| Y79AA1000540 | 164.490 | 95.071 | 40.165 | 43.390 | 40.045 | 64.022 | 69.258 | 38.304 |
| Y79AA1000560 | 281.384 | 217.439 | 285.257 | 233.113 | 463.011 | 163.480 | 137.130 | 150.237 |
| Y79AA1000574 | 52.065 | 23.181 | 20.651 | 12.249 | 16.138 | 19.256 | 27.792 | 16.219 |
| Y79AA1000584 | 15.379 | 9.124 | 5.767 | 2.558 | 1.074 | 7.940 | 8.373 | 2.978 |
| Y79AA1000589 | 183.820 | 100.432 | 70.853 | 66.366 | 57.641 | 89.842 | 106.272 | 87.142 |
| Y79AA1000598 | 56.202 | 33.205 | 22.835 | 19.082 | 16.494 | 26.476 | 39.963 | 26.495 |
| Y79AA1000600 | 41.902 | 41.896 | 21.689 | 16.420 | 16.929 | 48.490 | 27.953 | 19.342 |
| Y79AA1000609 | 57.576 | 39.029 | 30.052 | 30.165 | 27.140 | 36.576 | 46.317 | 40.338 |
| Y79AA1000618 | 125.086 | 117.263 | 62.983 | 91.667 | 44.430 | 82.703 | 59.073 | 106.707 |
| Y79AA1000627 | 79.733 | 52.406 | 33.263 | 16.064 | 26.240 | 36.354 | 35.482 | 26.093 |
| Y79AA1000636 | 39.025 | 110.754 | 63.444 | 78.431 | 38.373 | 40.282 | 27.825 | 50.545 |
| Y79AA1000649 | 40.819 | 24.415 | 21.283 | 16.111 | 23.390 | 22.853 | 24.218 | 28.136 |
| Y79AA1000656 | 34.895 | 43.071 | 26.370 | 23.075 | 19.462 | 31.058 | 38.717 | 36.845 |
| Y79AA1000673 | 41.347 | 29.023 | 17.877 | 14.456 | 10.280 | 27.689 | 23.125 | 20.111 |
| Y79AA1000674 | 262.849 | 127.516 | 120.736 | 76.530 | 76.511 | 135.175 | 156.724 | 108.424 |
| Y79AA1000678 | 101.577 | 71.902 | 37.125 | 32.459 | 39.727 | 50.727 | 49.198 | 41.789 |
| Y79AA1000682 | 206.911 | 109.200 | 74.410 | 66.092 | 82.312 | 114.912 | 88.981 | 92.050 |
| Y79AA1000683 | 48.942 | 45.045 | 30.764 | 23.661 | 15.359 | 27.974 | 25.066 | 30.575 |

TABLE 158

| | | | | | | | | |
|---|---|---|---|---|---|---|---|---|
| Y79AA1000697 | 593.441 | 140.294 | 205.250 | 128.388 | 180.538 | 358.317 | 185.955 | 157.146 |
| Y79AA1000700 | 21.077 | 45.357 | 16.113 | 12.299 | 6.003 | 17.423 | 23.401 | 24.353 |
| Y79AA1000702 | 62.438 | 42.446 | 9.035 | 13.744 | 21.360 | 47.616 | 22.905 | 32.458 |
| Y79AA1000704 | 19.430 | 7.058 | 5.353 | 3.179 | 5.193 | 12.141 | 10.206 | 6.710 |
| Y79AA1000705 | 10.998 | 17.592 | 10.298 | 10.719 | 8.004 | 6.779 | 14.333 | 13.157 |
| Y79AA1000117 | 81.752 | 30.031 | 27.106 | 19.428 | 22.464 | 33.577 | 31.373 | 29.033 |
| Y79AA1000722 | 36.212 | 18.985 | 16.192 | 21.995 | 15.249 | 16.693 | 21.786 | 16.366 |
| Y79AA1000724 | 38.197 | 38.149 | 22.178 | 41.307 | 9.368 | 15.888 | 23.618 | 33.068 |
| Y79AA1000726 | 145.871 | 38.218 | 60.209 | 20.692 | 45.339 | 70.254 | 60.747 | 27.206 |

TABLE 158-continued

| | | | | | | | | |
|---|---|---|---|---|---|---|---|---|
| Y79AA1000734 | 39.812 | 31.718 | 23.656 | 19.757 | 17.790 | 29.363 | 24.308 | 23.170 |
| Y79AA1000748 | 27.090 | 25.462 | 9.232 | 12.141 | 5.845 | 15.311 | 22.833 | 15.914 |
| Y79AA1000750 | 117.327 | 94.348 | 68.179 | 74.017 | 55.324 | 60.996 | 55.270 | 67.659 |
| Y79AA1000752 | 1.118 | 1.818 | 0.920 | 1.289 | 0.825 | 1.965 | 2.636 | 3.173 |
| Y79AA1000774 | 28.946 | 29.201 | 13.619 | 12.927 | 18.788 | 15.530 | 30.498 | 24.069 |
| Y79AA1000776 | 62.397 | 39.548 | 26.589 | 27.629 | 27.128 | 25.527 | 51.928 | 36.475 |
| Y79AA1000777 | 88.093 | 76.827 | 25.449 | 23.295 | 19.771 | 37.889 | 47.008 | 33.768 |
| Y79AA1000778 | 89.017 | 55.709 | 39.247 | 33.579 | 21.743 | 40.267 | 35.715 | 34.927 |
| Y79AA1000782 | 57.565 | 23.947 | 20.966 | 11.489 | 12.105 | 36.578 | 36.040 | 18.916 |
| Y79AA1000784 | 39.988 | 33.246 | 27.325 | 20.358 | 20.827 | 23.886 | 24.033 | 27.859 |
| Y79AA1000794 | 41.650 | 24.812 | 15.477 | 16.092 | 14.809 | 22.064 | 28.950 | 21.010 |
| Y79AA1000800 | 41.806 | 25.329 | 17.225 | 7.394 | 11.113 | 22.848 | 25.673 | 22.742 |
| Y79AA1000802 | 11.595 | 15.878 | 4.838 | 4.573 | 8.562 | 8.929 | 13.772 | 8.772 |
| Y79AA1000805 | 65.610 | 45.406 | 23.562 | 18.162 | 27.677 | 27.293 | 47.887 | 38.440 |
| Y79AA1000814 | 63.932 | 47.479 | 31.983 | 34.426 | 26.716 | 43.371 | 35.784 | 35.139 |
| Y79AA1000823 | 22.185 | 48.954 | 19.279 | 19.138 | 20.407 | 22.530 | 21.540 | 22.820 |
| Y79AA1000824 | 27.742 | 25.712 | 19.443 | 10.124 | 16.886 | 17.840 | 25.211 | 16.052 |
| Y79AA1000827 | 25.479 | 15.274 | 10.916 | 8.366 | 10.528 | 8.349 | 18.396 | 16.070 |
| Y79AA1000831 | 72.020 | 40.592 | 97.281 | 14.517 | 90.381 | 82.278 | 84.325 | 35.373 |
| Y79AA1000833 | 471.030 | 168.358 | 184.092 | 104.334 | 176.646 | 249.032 | 310.721 | 135.495 |
| Y79AA1000850 | 68.647 | 36.187 | 20.372 | 16.113 | 21.247 | 21.299 | 56.582 | 51.148 |
| Y79AA1000856 | 77.469 | 45.416 | 31.674 | 22.522 | 37.097 | 33.815 | 62.486 | 52.013 |
| Y79AA1000862 | 113.504 | 90.763 | 34.743 | 41.876 | 44.348 | 44.281 | 54.080 | 52.382 |
| Y79AA1000876 | 9.498 | 19.259 | 12.167 | 8.739 | 10.542 | 5.725 | 6.252 | 6.011 |
| Y79AA1000888 | 44.286 | 18.430 | 12.128 | 10.726 | 16.431 | 17.727 | 35.647 | 22.169 |
| Y79AA1000902 | 25.675 | 20.186 | 13.114 | 21.076 | 13.224 | 15.117 | 12.128 | 12.728 |
| Y79AA1000935 | 349.462 | 152.766 | 266.451 | 85.379 | 264.556 | 178.067 | 253.503 | 154.565 |
| Y79AA1000959 | 32.431 | 15.556 | 16.803 | 4.756 | 23.529 | 16.748 | 16.620 | 10.584 |
| Y79AA1000962 | 37.877 | 67.978 | 25.428 | 20.228 | 38.757 | 20.056 | 35.087 | 28.250 |
| Y79AA1000963 | 77.792 | 69.690 | 30.704 | 66.559 | 22.376 | 45.923 | 60.514 | 78.400 |
| Y79AA1000966 | 60.459 | 53.027 | 38.303 | 43.259 | 53.012 | 58.436 | 77.798 | 55.788 |
| Y79AA1000967 | 112.210 | 96.985 | 52.461 | 31.773 | 74.280 | 67.804 | 71.776 | 42.966 |
| Y79AA1000968 | 67.156 | 75.011 | 31.312 | 31.786 | 52.133 | 37.934 | 58.710 | 32.052 |
| Y79AA1000969 | 73.694 | 47.137 | 29.787 | 20.498 | 30.555 | 33.354 | 44.510 | 23.718 |
| Y79AA1000976 | 19.416 | 22.033 | 12.239 | 12.727 | 10.894 | 13.904 | 19.193 | 13.612 |
| Y79AA1000978 | 50.835 | 57.439 | 51.253 | 31.538 | 53.350 | 33.330 | 50.341 | 51.246 |
| Y79AA1000985 | 162.170 | 116.991 | 54.747 | 54.678 | 61.116 | 58.535 | 131.703 | 97.692 |
| Y79AA1000989 | 160.869 | 133.278 | 169.716 | 48.057 | 196.947 | 67.040 | 105.199 | 90.492 |
| Y79AA1000991 | 172.776 | 159.227 | 83.980 | 68.958 | 59.956 | 152.374 | 108.299 | 84.387 |
| Y79AA1001013 | 199.195 | 153.480 | 107.292 | 61.287 | 92.604 | 113.848 | 154.343 | 119.100 |
| Y79AA1001014 | 68.728 | 72.126 | 41.236 | 31.089 | 17.667 | 51.104 | 41.121 | 35.352 |
| Y79AA1001019 | 66.003 | 34.676 | 36.574 | 22.751 | 21.527 | 33.525 | 40.467 | 35.925 |
| Y79AA1001020 | 58.188 | 33.720 | 31.511 | 41.189 | 21.352 | 33.976 | 46.407 | 37.451 |
| Y79AA1001023 | 75.610 | 41.776 | 31.044 | 17.988 | 30.650 | 42.942 | 60.331 | 30.561 |
| Y79AA1001030 | 103.273 | 36.017 | 33.752 | 31.467 | 19.917 | 43.990 | 63.269 | 32.983 |
| Y79AA1001035 | 0.000 | 0.000 | 28.444 | 28.051 | 16.127 | 41.569 | 62.544 | 47.884 |
| Y79AA1001041 | 77.214 | 55.578 | 30.400 | 23.683 | 26.174 | 46.066 | 33.311 | 28.914 |
| Y79AA1001043 | 62.920 | 86.930 | 40.257 | 39.379 | 42.525 | 44.192 | 65.573 | 44.307 |
| Y79AA1001048 | 69.373 | 57.191 | 47.559 | 29.744 | 25.491 | 59.541 | 61.196 | 33.290 |
| Y79AA1001056 | 28.105 | 21.448 | 25.068 | 14.638 | 27.011 | 27.941 | 27.218 | 31.106 |
| Y79AA1001061 | 77.662 | 63.993 | 57.624 | 52.048 | 42.369 | 42.698 | 30.186 | 47.071 |
| Y79AA1001062 | 23.211 | 15.295 | 22.974 | 9.450 | 20.841 | 12.268 | 15.522 | 19.189 |
| Y79AA1001068 | 89.610 | 80.709 | 62.102 | 78.040 | 39.496 | 47.635 | 42.292 | 49.445 |
| Y79AA1001073 | 167.563 | 77.800 | 50.531 | 46.973 | 52.260 | 47.272 | 72.297 | 55.883 |
| Y79AA1001077 | 128.286 | 91.034 | 82.531 | 52.366 | 71.149 | 130.932 | 105.677 | 65.133 |

TABLE 159

| | | | | | | | | |
|---|---|---|---|---|---|---|---|---|
| Y79AA1001078 | 23.435 | 19.289 | 16.494 | 16.707 | 8.916 | 16.759 | 28.013 | 25.651 |
| Y79AA1001081 | 80.143 | 68.142 | 45.763 | 36.383 | 26.159 | 35.757 | 38.026 | 35.885 |
| Y79AA1001088 | 317.039 | 242.117 | 151.726 | 124.084 | 134.444 | 174.586 | 238.334 | 149.593 |
| Y79AA1001089 | 198.139 | 98.655 | 80.498 | 49.545 | 55.190 | 98.837 | 117.534 | 77.578 |
| Y79AA1001090 | 80.451 | 60.910 | 39.633 | 42.380 | 36.692 | 37.452 | 32.352 | 35.391 |
| Y79AA1001105 | 242.673 | 66.561 | 63.208 | 31.037 | 76.586 | 75.243 | 109.216 | 60.833 |
| Y79AA1001142 | 79.091 | 23.396 | 18.843 | 28.396 | 19.935 | 55.429 | 96.508 | 34.254 |
| Y79AA1001145 | 227.540 | 201.081 | 125.013 | 108.956 | 107.663 | 126.922 | 147.749 | 112.199 |
| Y79AA1001162 | 32.474 | 21.215 | 17.402 | 13.823 | 7.016 | 14.608 | 10.831 | 11.076 |
| Y79AA1001167 | 81.840 | 38.276 | 27.439 | 20.713 | 20.465 | 39.401 | 27.977 | 21.861 |
| Y79AA1001176 | 37.234 | 30.174 | 29.821 | 28.145 | 17.772 | 23.084 | 23.905 | 31.875 |
| Y79AA1001177 | 157.278 | 72.492 | 47.515 | 31.006 | 45.407 | 62.162 | 74.915 | 44.631 |
| Y79AA1001179 | 155.289 | 77.734 | 66.981 | 49.326 | 60.911 | 108.763 | 101.419 | 45.761 |
| Y79AA1001185 | 42.293 | 30.499 | 20.818 | 18.392 | 18.203 | 25.381 | 22.095 | 14.576 |
| Y79AA1001201 | 70.267 | 62.245 | 55.927 | 64.637 | 42.307 | 55.945 | 44.441 | 55.417 |
| Y79AA1001205 | 76.691 | 73.411 | 29.446 | 25.089 | 10.867 | 25.196 | 31.540 | 23.771 |
| Y79AA1001211 | 69.077 | 77.295 | 43.109 | 54.773 | 26.171 | 19.436 | 23.382 | 36.508 |
| Y79AA1001212 | 60.509 | 40.760 | 30.464 | 21.472 | 22.536 | 28.939 | 31.790 | 27.996 |

TABLE 159-continued

| | | | | | | | | |
|---|---|---|---|---|---|---|---|---|
| Y79AA1001216 | 107.414 | 112.384 | 51.845 | 90.341 | 48.098 | 86.493 | 78.661 | 128.332 |
| Y79AA1001228 | 191.014 | 98.191 | 77.471 | 55.138 | 68.036 | 114.392 | 95.311 | 72.216 |
| Y79AA1001233 | 165.200 | 46.959 | 55.748 | 19.356 | 50.639 | 93.326 | 77.766 | 29.974 |
| Y79AA1001236 | 76.419 | 41.716 | 32.067 | 19.238 | 31.896 | 34.830 | 44.490 | 38.856 |
| Y79AA1001239 | 348.195 | 155.335 | 206.398 | 93.364 | 264.580 | 150.282 | 141.282 | 138.685 |
| Y79AA1001240 | 97.619 | 55.824 | 32.015 | 19.335 | 24.480 | 129.654 | 123.682 | 27.590 |
| Y79AA1001255 | 60.196 | 39.594 | 29.713 | 32.087 | 23.430 | 42.093 | 44.389 | 40.863 |
| Y79AA1001264 | 23.500 | 30.229 | 13.518 | 13.380 | 8.385 | 20.450 | 18.219 | 19.822 |
| Y79AA1001272 | 172.136 | 148.159 | 89.874 | 101.905 | 67.677 | 109.162 | 89.962 | 89.461 |
| Y79AA1001281 | 23.525 | 18.360 | 9.518 | 9.700 | 6.169 | 17.324 | 15.120 | 11.543 |
| Y79AA1001299 | 257.530 | 138.510 | 106.642 | 92.167 | 96.141 | 155.017 | 156.902 | 114.884 |
| Y79AA1001312 | 28.599 | 18.932 | 11.140 | 5.860 | 16.123 | 10.337 | 9.558 | 9.283 |
| Y79AA1001319 | 233.396 | 111.817 | 90.283 | 51.100 | 80.506 | 137.595 | 117.523 | 59.456 |
| Y79AA1001323 | 46.240 | 62.299 | 28.364 | 20.915 | 20.142 | 36.013 | 31.769 | 19.583 |
| Y79AA1001328 | 166.188 | 85.958 | 71.107 | 51.952 | 47.867 | 98.151 | 92.634 | 63.952 |
| Y79AA1001343 | 293.557 | 1957.671 | 529.524 | 508.017 | 447.748 | 598.173 | 563.395 | 1662.056 |
| Y79AA1001351 | 23.608 | 13.189 | 12.127 | 7.610 | 6.082 | 11.346 | 6.319 | 6.967 |
| Y79AA1001364 | 23.462 | 34.748 | 26.228 | 44.018 | 18.806 | 18.623 | 17.892 | 57.833 |
| Y79AA1001367 | 74.110 | 39.168 | 25.534 | 16.038 | 21.213 | 33.215 | 35.782 | 29.409 |
| Y79AA1001384 | 44.135 | 26.692 | 19.494 | 6.267 | 19.195 | 15.742 | 34.303 | 21.015 |
| Y79AA1001391 | 88.486 | 45.427 | 33.937 | 20.520 | 35.938 | 38.414 | 60.920 | 32.481 |
| Y79AA1001394 | 73.046 | 48.196 | 27.660 | 20.614 | 16.092 | 26.264 | 37.409 | 30.457 |
| Y79AA1001402 | 277.943 | 171.103 | 185.389 | 101.994 | 137.576 | 164.575 | 126.561 | 96.457 |
| Y79AA1001410 | 37.405 | 47.535 | 22.875 | 21.151 | 18.753 | 29.322 | 20.709 | 19.883 |
| Y79AA1001414 | 40.424 | 18.548 | 20.585 | 8.705 | 9.528 | 27.024 | 20.661 | 18.409 |
| Y79AA1001426 | 128.039 | 45.365 | 44.982 | 17.958 | 30.855 | 79.863 | 82.932 | 35.756 |
| Y79AA1001427 | 102.517 | 75.088 | 38.728 | 26.901 | 42.573 | 49.818 | 79.641 | 62.907 |
| Y79AA1001430 | 88.291 | 44.524 | 17.775 | 15.144 | 26.578 | 35.825 | 47.406 | 24.141 |
| Y79AA1001439 | 22.600 | 31.240 | 12.643 | 11.993 | 13.637 | 8.923 | 33.792 | 21.060 |
| Y79AA1001485 | 12.457 | 15.003 | 6.416 | 6.180 | 7.239 | 8.477 | 11.343 | 9.667 |
| Y79AA1001493 | 3.325 | 3.087 | 0.808 | 0.913 | 0.895 | 2.370 | 3.288 | 1.535 |
| Y79AA1001511 | 34.387 | 42.870 | 31.800 | 22.668 | 30.480 | 30.907 | 27.949 | 41.671 |
| Y79AA1001523 | 131.638 | 41.082 | 28.617 | 24.376 | 38.748 | 38.384 | 55.678 | 16.232 |
| Y79AA1001530 | 64.263 | 17.602 | 37.936 | 9.778 | 39.229 | 26.821 | 36.155 | 15.958 |
| Y79AA1001532 | 84.756 | 81.487 | 57.603 | 49.296 | 52.833 | 44.930 | 58.976 | 47.094 |
| Y79AA1001533 | 71.806 | 80.795 | 31.639 | 34.117 | 34.465 | 30.573 | 56.137 | 27.551 |
| Y79AA1001541 | 21.702 | 23.664 | 13.568 | 13.443 | 17.622 | 19.043 | 24.725 | 17.890 |
| Y79AA1001548 | 160.862 | 125.939 | 91.450 | 78.443 | 96.657 | 102.345 | 81.132 | 92.148 |
| Y79AA1001555 | 154.131 | 77.112 | 44.627 | 26.543 | 33.269 | 64.477 | 72.908 | 37.245 |
| Y79AA1001562 | 19.278 | 39.676 | 21.323 | 15.462 | 21.126 | 20.650 | 11.744 | 27.432 |
| Y79AA1001581 | 29.260 | 1.846 | 4.472 | 2.139 | 6.817 | 9.566 | 8.517 | 4.043 |
| Y79AA1001585 | 10.832 | 9.273 | 5.154 | 4.611 | 8.363 | 3.849 | 8.753 | 6.599 |
| Y79AA1001592 | 95.166 | 61.837 | 49.013 | 45.123 | 38.746 | 42.497 | 50.134 | 62.013 |
| Y79AA1001594 | 58.652 | 50.427 | 16.817 | 20.106 | 22.571 | 18.261 | 35.915 | 34.587 |
| Y79AA1001603 | 161.097 | 182.934 | 69.481 | 89.900 | 86.153 | 86.111 | 124.142 | 148.708 |
| Y79AA1001613 | 143.075 | 94.475 | 65.178 | 44.394 | 70.764 | 86.215 | 108.731 | 75.786 |

TABLE 160

| | | | | | | | | |
|---|---|---|---|---|---|---|---|---|
| Y79AA1001630 | 13.646 | 12.156 | 6.553 | 6.307 | 8.775 | 5.570 | 14.006 | 7.900 |
| Y79AA1001647 | 43.380 | 30.209 | 38.642 | 18.607 | 50.749 | 13.890 | 27.535 | 18.826 |
| Y79AA1001664 | 50.619 | 62.037 | 23.222 | 35.535 | 31.203 | 25.999 | 33.586 | 35.257 |
| Y79AA1001665 | 78.815 | 50.214 | 28.199 | 20.230 | 28.531 | 39.239 | 43.686 | 24.873 |
| Y79AA1001679 | 182.502 | 59.845 | 49.481 | 32.964 | 56.908 | 102.379 | 88.857 | 48.625 |
| Y79AA1001692 | 48.740 | 44.701 | 21.354 | 18.732 | 23.271 | 23.639 | 35.010 | 24.377 |
| Y79AA1001696 | 6.780 | 14.124 | 10.007 | 8.631 | 14.623 | 7.512 | 6.730 | 10.898 |
| Y79AA1001705 | 84.869 | 54.294 | 35.569 | 21.435 | 39.991 | 44.064 | 55.777 | 37.387 |
| Y79AA1001711 | 62.806 | 75.073 | 36.984 | 31.331 | 32.851 | 38.989 | 52.758 | 53.508 |
| Y79AA1001717 | 21.280 | 34.089 | 12.028 | 10.889 | 15.395 | 11.748 | 24.174 | 10.438 |
| Y79AA1001719 | 43.417 | 51.690 | 17.623 | 19.362 | 20.441 | 20.351 | 30.934 | 27.264 |
| Y79AA1001727 | 73.341 | 78.139 | 42.958 | 28.661 | 54.868 | 25.062 | 43.179 | 39.080 |
| Y79AA1001750 | 294.250 | 240.534 | 123.295 | 113.859 | 147.591 | 113.999 | 151.389 | 151.480 |
| Y79AA1001760 | 186.817 | 180.985 | 65.822 | 68.036 | 91.745 | 92.228 | 144.742 | 103.455 |
| Y79AA1001777 | 125.250 | 87.579 | 38.902 | 31.498 | 34.787 | 51.175 | 61.299 | 47.365 |
| Y79AA1001781 | 0.000 | 0.000 | 0.000 | 3.210 | 1.473 | 0.000 | 0.000 | 0.000 |
| Y79AA1001787 | 114.565 | 61.166 | 49.706 | 30.708 | 31.661 | 57.179 | 72.608 | 56.355 |
| Y79AA1001793 | 186.933 | 88.770 | 84.898 | 59.826 | 48.463 | 74.105 | 167.655 | 89.090 |
| Y79AA1001795 | 17.050 | 21.582 | 20.234 | 15.314 | 13.998 | 18.815 | 13.699 | 16.861 |
| Y79AA1001799 | 86.419 | 58.330 | 51.694 | 35.379 | 30.638 | 47.701 | 71.948 | 46.535 |
| Y79AA1001800 | 511.812 | 97.958 | 354.971 | 49.190 | 235.401 | 413.230 | 490.565 | 73.961 |
| Y79AA1001801 | 67.645 | 45.550 | 11.683 | 27.943 | 20.138 | 30.425 | 59.231 | 35.253 |
| Y79AA1001803 | 57.387 | 56.011 | 59.286 | 17.563 | 54.207 | 39.997 | 39.216 | 36.149 |
| Y79AA1001805 | 146.263 | 170.531 | 125.538 | 76.023 | 66.375 | 74.500 | 58.882 | 68.354 |
| Y79AA1001807 | 112.057 | 63.466 | 54.660 | 28.588 | 34.253 | 46.384 | 86.296 | 39.426 |
| Y79AA1001827 | 70.024 | 30.424 | 44.198 | 33.684 | 23.703 | 26.135 | 51.859 | 17.610 |
| Y79AA1001846 | 25.975 | 42.461 | 56.527 | 62.241 | 32.960 | 50.520 | 20.001 | 36.949 |

TABLE 160-continued

| | | | | | | | | |
|---|---|---|---|---|---|---|---|---|
| Y79AA1001848 | 35.746 | 22.982 | 23.160 | 9.894 | 16.543 | 12.462 | 26.092 | 21.091 |
| Y79AA1001853 | 281.071 | 150.082 | 159.752 | 107.770 | 164.169 | 199.036 | 174.168 | 111.109 |
| Y79AA1001863 | 190.420 | 108.799 | 96.407 | 63.758 | 66.145 | 100.694 | 163.628 | 77.595 |
| Y79AA1001866 | 24.530 | 46.991 | 37.466 | 28.167 | 24.388 | 28.450 | 20.721 | 14.899 |
| Y79AA1001874 | 1.221 | 5.487 | 0.848 | 1.231 | 0.291 | 0.598 | 1.506 | 1.497 |
| Y79AA1001875 | 63.952 | 58.462 | 47.436 | 36.846 | 24.598 | 39.313 | 45.106 | 40.636 |
| Y79AA1001907 | 124.410 | 250.090 | 50.333 | 92.943 | 49.772 | 74.402 | 107.811 | 194.562 |
| Y79AA1001908 | 12.574 | 13.547 | 9.612 | 6.931 | 5.169 | 7.911 | 11.534 | 9.867 |
| Y79AA1001923 | 33.869 | 14.234 | 14.248 | 5.718 | 8.352 | 12.798 | 25.326 | 7.829 |
| Y79AA1001927 | 186.717 | 76.975 | 44.024 | 41.115 | 46.490 | 154.336 | 107.236 | 39.239 |
| Y79AA1001930 | 33.259 | 33.470 | 18.855 | 24.382 | 15.694 | 32.271 | 26.423 | 29.042 |
| Y79AA1001932 | 27.741 | 23.277 | 12.768 | 9.914 | 14.699 | 8.522 | 10.994 | 25.644 |
| Y79AA1001933 | 34.948 | 36.160 | 27.478 | 18.608 | 18.230 | 17.284 | 30.314 | 30.361 |
| Y79AA1001942 | 28.803 | 28.253 | 22.497 | 11.034 | 11.547 | 51.771 | 43.263 | 5.042 |
| Y79AA1001963 | 68.323 | 43.878 | 42.080 | 36.240 | 33.736 | 26.445 | 62.945 | 56.785 |
| Y79AA1001968 | 55.189 | 120.287 | 31.107 | 72.431 | 32.780 | 37.209 | 52.124 | 87.863 |
| Y79AA1001983 | 91.447 | 44.245 | 40.209 | 17.481 | 29.219 | 49.886 | 55.561 | 26.162 |
| Y79AA1002000 | 78.569 | 42.344 | 37.253 | 28.054 | 28.700 | 41.938 | 31.511 | 26.090 |
| Y79AA1002004 | 135.629 | 61.297 | 65.308 | 50.333 | 46.897 | 62.884 | 62.761 | 36.527 |
| Y79AA1002008 | 151.334 | 65.665 | 44.780 | 33.954 | 37.173 | 46.166 | 78.471 | 49.925 |
| Y79AA1002012 | 140.300 | 132.533 | 88.285 | 105.977 | 78.145 | 59.701 | 57.183 | 104.179 |
| Y79AA1002017 | 38.327 | 28.859 | 17.564 | 7.197 | 8.297 | 22.866 | 39.108 | 18.179 |
| Y79AA1002022 | 197.012 | 109.640 | 111.812 | 71.115 | 68.794 | 122.840 | 108.973 | 82.268 |
| Y79AA1002027 | 7.861 | 6.807 | 5.719 | 3.405 | 5.503 | 3.619 | 4.936 | 6.690 |
| Y79AA1002050 | 52.645 | 57.007 | 34.182 | 49.101 | 29.451 | 26.571 | 25.198 | 32.168 |
| Y79AA1002058 | 162.814 | 86.786 | 63.856 | 46.043 | 84.452 | 92.949 | 131.501 | 99.159 |
| Y79AA1002060 | 74.517 | 43.157 | 38.911 | 33.852 | 57.622 | 27.031 | 33.624 | 43.906 |
| Y79AA1002062 | 163.546 | 122.645 | 81.975 | 88.856 | 64.753 | 92.455 | 75.321 | 73.162 |
| Y79AA1002065 | 72.537 | 83.880 | 24.771 | 44.298 | 22.044 | 30.756 | 35.287 | 75.559 |
| Y79AA1002067 | 18.914 | 16.681 | 8.561 | 6.098 | 4.972 | 7.856 | 26.231 | 10.844 |
| Y79AA1002069 | 153.130 | 40.848 | 44.030 | 9.535 | 26.886 | 75.515 | 76.585 | 29.038 |
| Y79AA1002070 | 255.333 | 63.953 | 64.787 | 58.175 | 89.400 | 172.062 | 64.355 | 62.998 |
| Y79AA1002074 | 168.399 | 367.145 | 81.099 | 265.515 | 107.873 | 170.520 | 153.058 | 388.635 |
| Y79AA1002076 | 36.931 | 26.480 | 13.779 | 8.886 | 11.642 | 20.354 | 19.122 | 14.650 |
| Y79AA1002083 | 100.267 | 39.527 | 25.359 | 13.076 | 27.519 | 42.095 | 30.686 | 16.092 |
| Y79AA1002084 | 31.602 | 37.320 | 24.313 | 14.210 | 13.535 | 21.829 | 27.098 | 16.412 |
| Y79AA1002086 | 43.060 | 38.449 | 21.971 | 18.749 | 10.203 | 19.023 | 17.056 | 19.318 |

TABLE 161

| | | | | | | | | |
|---|---|---|---|---|---|---|---|---|
| Y79AA1002087 | 13.030 | 15.226 | 11.425 | 22.378 | 3.745 | 12.088 | 10.009 | 24.908 |
| Y79AA1002089 | 40.323 | 26.458 | 12.982 | 15.098 | 16.218 | 17.576 | 3.691 | 24.665 |
| Y79AA1002093 | 46.120 | 27.022 | 18.769 | 15.919 | 7.245 | 24.041 | 28.202 | 24.994 |
| Y79AA1002101 | 43.837 | 30.418 | 18.385 | 11.894 | 11.521 | 24.278 | 23.182 | 15.994 |
| Y79AA1002103 | 43.141 | 24.615 | 23.246 | 31.726 | 17.340 | 31.371 | 32.322 | 48.954 |
| Y79AA1002115 | 20.766 | 22.498 | 17.048 | 10.575 | 15.180 | 11.669 | 14.011 | 12.945 |
| Y79AA1002121 | 27.091 | 49.228 | 19.624 | 15.594 | 14.827 | 12.987 | 19.044 | 18.216 |
| Y79AA1002125 | 48.808 | 64.875 | 48.646 | 23.137 | 27.474 | 32.479 | 34.123 | 51.389 |
| Y79AA1002129 | 20.607 | 25.472 | 14.117 | 14.375 | 7.485 | 13.555 | 11.317 | 12.960 |
| Y79AA1002131 | 46.336 | 22.411 | 18.720 | 14.115 | 7.829 | 20.162 | 15.429 | 12.884 |
| Y79AA1002139 | 17.296 | 11.713 | 5.758 | 6.335 | 6.389 | 11.186 | 2.854 | 4.539 |
| Y79AA1002144 | 45.269 | 47.677 | 66.378 | 20.967 | 59.407 | 32.426 | 31.597 | 21.322 |
| Y79AA1002177 | 301.285 | 121.825 | 100.055 | 57.536 | 81.697 | 176.423 | 154.681 | 88.082 |
| Y79AA1002183 | 78.011 | 99.397 | 37.780 | 10.625 | 40.969 | 35.101 | 65.850 | 66.184 |
| Y79AA1002202 | 57.948 | 69.118 | 26.355 | 26.998 | 31.172 | 30.882 | 39.528 | 28.104 |
| Y79AA1002204 | 108.226 | 53.775 | 45.674 | 14.730 | 26.902 | 42.785 | 47.433 | 32.007 |
| Y79AA1002206 | 23.882 | 20.653 | 11.579 | 11.189 | 8.007 | 20.198 | 14.716 | 14.423 |
| Y79AA1002208 | 17.539 | 19.145 | 14.805 | 15.985 | 9.466 | 19.745 | 11.177 | 17.666 |
| Y79AA1002209 | 12.404 | 10.671 | 11.592 | 3.770 | 5.884 | 7.681 | 9.212 | 6.769 |
| Y79AA1002210 | 36.693 | 21.704 | 11.197 | 4.453 | 8.279 | 31.518 | 24.637 | 13.120 |
| Y79AA1002211 | 60.744 | 40.012 | 23.317 | 18.415 | 22.277 | 33.188 | 47.655 | 53.021 |
| Y79AA1002213 | 88.865 | 66.933 | 24.906 | 28.654 | 40.420 | 32.547 | 31.240 | 41.587 |
| Y79AA1002215 | 57.323 | 74.421 | 32.504 | 25.568 | 33.392 | 47.741 | 30.830 | 34.812 |
| Y79AA1002220 | 7.686 | 27.673 | 7.325 | 5.327 | 8.309 | 5.571 | 9.728 | 9.037 |
| Y79AA1002226 | 33.811 | 70.351 | 53.822 | 44.642 | 43.103 | 43.566 | 31.798 | 56.096 |
| Y79AA1002229 | 133.812 | 49.906 | 27.621 | 14.021 | 32.478 | 73.121 | 60.968 | 21.211 |
| Y79AA1002234 | 53.796 | 27.231 | 31.097 | 16.258 | 22.352 | 39.228 | 41.686 | 31.562 |
| Y79AA1002235 | 9.109 | 6.947 | 3.938 | 3.201 | 5.077 | 8.688 | 8.099 | 8.031 |
| Y79AA1002246 | 46.749 | 34.031 | 22.771 | 19.593 | 19.245 | 14.798 | 40.274 | 41.271 |
| Y79AA1002258 | 75.546 | 58.416 | 30.618 | 24.590 | 30.971 | 35.864 | 47.893 | 50.632 |
| Y79AA1002279 | 67.007 | 468.054 | 23.705 | 27.332 | 22.243 | 72.113 | 23.817 | 64.255 |
| Y79AA1002292 | 107.375 | 48.724 | 45.677 | 27.662 | 41.581 | 54.031 | 48.041 | 36.807 |
| Y79AA1002298 | 16.948 | 16.878 | 8.834 | 7.151 | 8.601 | 7.054 | 11.871 | 9.334 |
| Y79AA1002307 | 29.343 | 26.868 | 16.693 | 17.533 | 20.451 | 13.735 | 13.467 | 11.704 |
| Y79AA1002309 | 38.982 | 33.605 | 15.626 | 14.434 | 15.282 | 17.723 | 25.386 | 17.397 |
| Y79AA1002311 | 31.668 | 30.875 | 21.323 | 22.152 | 19.332 | 10.916 | 32.170 | 15.265 |

TABLE 161-continued

| | | | | | | | | |
|---|---|---|---|---|---|---|---|---|
| Y79AA1002334 | 49.431 | 32.284 | 18.242 | 13.025 | 24.412 | 19.450 | 30.870 | 24.306 |
| Y79AA1002351 | 41.486 | 18.773 | 27.420 | 13.424 | 23.100 | 22.549 | 45.251 | 26.383 |
| Y79AA1002355 | 10.396 | 23.208 | 37.472 | 13.874 | 42.683 | 14.865 | 12.092 | 15.185 |
| Y79AA1002361 | 88.085 | 78.594 | 36.358 | 37.149 | 35.846 | 41.778 | 36.660 | 25.294 |
| Y79AA1002365 | 17.588 | 21.447 | 10.949 | 7.231 | 11.431 | 16.111 | 15.168 | 14.782 |
| Y79AA1002373 | 50.748 | 39.981 | 17.086 | 11.669 | 21.120 | 12.396 | 22.757 | 15.438 |
| Y79AA1002376 | 643.977 | 1773.590 | 553.953 | 585.102 | 666.479 | 319.310 | 496.197 | 1220.015 |
| Y79AA1002378 | 77.584 | 97.591 | 29.238 | 27.161 | 35.356 | 35.168 | 42.325 | 47.261 |
| Y79AA1002381 | 141.196 | 111.531 | 39.904 | 43.874 | 44.814 | 57.151 | 75.416 | 73.250 |
| Y79AA1002388 | 166.548 | 86.006 | 56.942 | 27.181 | 60.647 | 43.749 | 87.173 | 61.931 |
| Y79AA1002399 | 47.127 | 38.224 | 20.037 | 14.800 | 14.138 | 25.545 | 42.014 | 15.674 |
| Y79AA1002407 | 14.750 | 20.995 | 15.394 | 14.318 | 11.321 | 15.977 | 15.721 | 14.711 |
| Y79AA1002413 | 55.733 | 94.994 | 61.674 | 38.953 | 26.005 | 85.902 | 42.923 | 62.238 |
| Y79AA1002416 | 26.021 | 26.133 | 18.893 | 17.489 | 13.172 | 17.322 | 34.129 | 20.886 |
| Y79AA1002429 | 29.180 | 51.475 | 14.818 | 24.101 | 19.762 | 12.675 | 14.708 | 62.243 |
| Y79AA1002431 | 36.374 | 37.521 | 29.072 | 17.134 | 16.314 | 32.188 | 24.257 | 19.906 |
| Y79AA1002433 | 73.392 | 56.725 | 40.689 | 46.773 | 29.753 | 44.782 | 56.569 | 48.003 |
| Y79AA1002445 | 206.082 | 130.492 | 119.284 | 81.825 | 84.172 | 187.480 | 65.701 | 66.873 |
| Y79AA1002461 | 136.322 | 87.178 | 56.327 | 41.540 | 30.726 | 58.954 | 73.797 | 51.203 |
| Y79AA1002466 | 58.460 | 66.910 | 32.039 | 63.994 | 27.818 | 62.743 | 46.169 | 48.544 |
| Y79AA1002471 | 22.153 | 38.198 | 21.750 | 19.098 | 17.619 | 16.828 | 33.234 | 22.949 |
| Y79AA1002472 | 60.980 | 65.699 | 60.101 | 81.738 | 43.775 | 40.296 | 44.510 | 52.633 |
| Y79AA1002474 | 35.222 | 8.126 | 16.456 | 10.777 | 17.029 | 18.827 | 29.379 | 12.444 |
| Y79AA1002482 | 72.994 | 104.184 | 83.915 | 153.120 | 82.291 | 51.719 | 43.236 | 91.558 |
| Y79AA1002487 | 22.033 | 18.529 | 10.754 | 10.800 | 9.046 | 9.098 | 17.186 | 12.270 |
| Y79AA1002490 | 105.735 | 63.572 | 40.499 | 20.017 | 29.453 | 73.670 | 63.467 | 29.681 |
| Y79AA1002493 | 72.446 | 80.901 | 47.379 | 55.984 | .35.093 | 37.512 | 30.823 | 19.166 |
| ZRV6C1006278 | 37.372 | 7.298 | 8.151 | 3.848 | 4.644 | 7.876 | 6.612 | 2.417 |

TABLE 162

Expression of each cDNA in undifferentiated NT2 cells, in NT2 cells cultured in the presence of retinoic acid, or in NT2 cells that were cultured in the presence of retinoic acid and then further cultured in the presence of cell-division inhibitor added (This table also contains clones without description in Examples) In the table, NT2, NT2_RA, and NT2_RA_INHIB represent untreated NT2 cells, retinoic acid-treated NT2 cells, and retinoic acid/inhibitor-treated NT2 cells, respectively. The assay was performed in triplicate (n = 3), and each result was shown in the column of exp.1, exp.2, or exp.3. In addition, "t-test N/R" and "t-test N/I" represent results of the test for significance of difference between the untreated cells and the retinoic acid-treated cells, and between the untreated cells and the retinoic acid/inhibitor-treated cells, respectively. The results of the test are shown in the columns of *:p < 0.05 and **:p < 0.01.

| | NT2 | | | NT2 RA | | | NT2 RA INHIB | | | ttest | + | ttest | + |
|---|---|---|---|---|---|---|---|---|---|---|---|---|---|
| Clone | exp. 1 | exp. 2 | exp. 3 | exp. 1 | exp. 2 | exp. 3 | exp. 1 | exp. 2 | exp. 3 | N/R | − | N/I | − |
| GAPDH(Cr1) | 3.53 | 1.08 | 0.98 | 2.92 | 2.49 | 2.8 | 1.76 | 2.59 | 1.52 | | | | |
| βactin(Cr2) | 155.4 | 118 | 99.68 | 148.5 | 110.7 | 101.3 | 114.7 | 105.8 | 151.1 | | | | |
| ADRGL1000005 | 4.01 | 2.03 | 1.55 | 4.05 | 3.65 | 3.6 | 2.27 | 2.93 | 4.24 | | | | |
| ADRGL1000007 | 11.08 | 5.73 | 7.92 | 15.42 | 10.6 | 13.87 | 8.99 | 8.17 | 9.15 | | | | |
| ADRGL1000009 | 1.11 | 0.72 | 1.04 | 1.66 | 1.89 | 1.03 | 1.22 | 1.62 | 1.58 | | | * | + |
| ADRGL1000011 | 4.27 | 2.7 | 2.85 | 4.32 | 4.35 | 3.38 | 2.76 | 3.27 | 3.06 | | | | |
| ADRGL1000027 | 1.83 | 0.38 | 0.56 | 0.97 | 0.62 | 0.99 | 0.92 | 1.33 | 1.5 | | | | |
| ADRGL1000058 | 3.65 | 2.58 | 1.37 | 2.92 | 3.36 | 2.75 | 2.25 | 3.51 | 2.7 | | | | |
| ADRGL1000069 | 3.25 | 1.85 | 3.28 | 1.86 | 2.53 | 2.85 | 2.01 | 2.89 | 2.7 | | | | |
| ADRGL1000077 | 13.48 | 10.41 | 6.71 | 19.62 | 17.92 | 22.59 | 11.6 | 16.66 | 19.34 | * | + | | |
| ADRGL1000092 | 5.73 | 2.8 | 4.51 | 7.31 | 5.01 | 4.83 | 3.24 | 6.16 | 7.22 | | | | |
| ADRGL1000099 | 5.64 | 3.42 | 2.08 | 5.59 | 3.73 | 4.24 | 3.98 | 3.98 | 4.06 | | | | |
| ADRGL1000136 | 9.97 | 3.52 | 4.19 | 5.77 | 4.73 | 5.86 | 6.61 | 5.16 | 5.49 | | | | |
| ADRGL1000147 | 23.09 | 13.85 | 11.7 | 14.77 | 14.96 | 14.89 | 17.7 | 13.3 | 19.47 | | | | |
| ADRGL1000159 | 6.11 | 2.22 | 3.37 | 5.24 | 2.88 | 4.15 | 2.76 | 2.93 | 3.59 | | | | |
| ADRGL1000160 | 7.16 | 3.48 | 4.19 | 5.94 | 4.59 | 3.41 | 3.95 | 4.67 | 4.25 | | | | |
| ADRGL1000171 | 4.84 | 2.99 | 3.23 | 3.52 | 4.19 | 4.37 | 2.55 | 3.88 | 3.45 | | | | |
| ADRGL1000181 | 5.1 | 3.65 | 2.6 | 3.16 | 4.06 | 2.97 | 2.64 | 3.06 | 3.44 | | | | |
| BGGI11000015 | 13.95 | 6.83 | 6.72 | 9.61 | 9.19 | 10.24 | 9.94 | 10.66 | 10.13 | | | | |
| BGGI11000016 | 15.49 | 5.92 | 7.09 | 11.88 | 11.38 | 8.72 | 11.82 | 10.98 | 10.51 | | | | |
| BGGI11000017 | 7.89 | 2.99 | 3.25 | 4.94 | 4.94 | 4.93 | 3.55 | 4.27 | 3.52 | | | | |
| BGGI11000022 | 8.77 | 5.14 | 5.91 | 7.12 | 7.05 | 4.54 | 5.71 | 5.59 | 5.9 | | | | |
| BGGI11000031 | 4.71 | 2.16 | 2.74 | 4.09 | 3.29 | 3.96 | 4.02 | 3.67 | 2.33 | | | | |
| BGGI11000042 | 6.37 | 5.24 | 3.74 | 5.63 | 6.22 | 4.36 | 4.66 | 5.2 | 4.04 | | | | |
| BGGI11000046 | 19.01 | 12.57 | 9.23 | 12.39 | 15.7 | 12.37 | 8.8 | 10.92 | 9.17 | | | | |

TABLE 162-continued

Expression of each cDNA in undifferentiated NT2 cells, in NT2 cells cultured in the presence of retinoic acid, or in NT2 cells that were cultured in the presence of retinoic acid and then further cultured in the presence of cell-division inhibitor added (This table also contains clones without description in Examples) In the table, NT2, NT2_RA, and NT2_RA_INHIB represent untreated NT2 cells, retinoic acid-treated NT2 cells, and retinoic acid/inhibitor-treated NT2 cells, respectively. The assay was performed in triplicate (n = 3), and each result was shown in the column of exp.1, exp.2, or exp.3. In addition, "t-test N/R" and "t-test N/I" represent results of the test for significance of difference between the untreated cells and the retinoic acid-treated cells, and between the untreated cells and the retinoic acid/inhibitor-treated cells, respectively. The results of the test are shown in the columns of *:p < 0.05 and **:p < 0.01.

| Clone | NT2 exp. 1 | NT2 exp. 2 | NT2 exp. 3 | NT2 RA exp. 1 | NT2 RA exp. 2 | NT2 RA exp. 3 | NT2 RA INHIB exp. 1 | NT2 RA INHIB exp. 2 | NT2 RA INHIB exp. 3 | ttest N/R | + - | ttest N/I | + - |
|---|---|---|---|---|---|---|---|---|---|---|---|---|---|
| BNGH41000020 | 859 | 910.1 | 603 | 164 | 319.2 | 267.4 | 638.2 | 771.6 | 845.4 | ** | − | | |
| BNGH41000025 | 5.35 | 2.06 | 2.09 | 2.76 | 2.76 | 3.77 | 4.23 | 2.01 | 3.06 | | | | |
| BNGH41000026 | 16.2 | 7.69 | 7.05 | 9.34 | 11.37 | 9.66 | 10.13 | 7.16 | 10.71 | | | | |
| BNGH41000027 | 2.31 | 2.18 | 2.5 | 2.9 | 3.01 | 2.82 | 3.68 | 3.48 | 4.21 | ** | + | ** | + |
| BNGH41000035 | 14.57 | 8.83 | 9.36 | 10.92 | 9.55 | 14.75 | 15.02 | 15.18 | 12.2 | | | | |
| BNGH41000037 | 10.56 | 7.46 | 6.2 | 8.16 | 9.21 | 6.42 | 3.37 | 5.45 | 4.98 | | | | |
| BNGH41000042 | 77.1 | 50.85 | 58.45 | 47.64 | 53.39 | 62.67 | 28.12 | 35.48 | 23.44 | | | * | − |
| BNGH41000048 | 3.5 | 2.19 | 1.91 | 4.28 | 2.87 | 2.4 | 1.63 | 3.01 | 1.78 | | | | |
| BNGH41000056 | 2.57 | 2.01 | 1 | 1.91 | 2.63 | 2.15 | 1.41 | 2.4 | 1.79 | | | | |
| BNGH41000087 | 9.84 | 5.84 | 5.53 | 12.49 | 10.24 | 10.25 | 11.74 | 9.68 | 8.53 | | | | |
| BNGH41000091 | 3.37 | 2.59 | 1.21 | 3.29 | 3.01 | 1.55 | 2.95 | 2.57 | 2.13 | | | | |
| DNGH41000157 | 10.63 | 5.64 | 6.15 | 8.53 | 9.05 | 7.74 | 6.38 | 6.68 | 5.75 | | | | |
| BNGH41000169 | 3.77 | 4.34 | 3.82 | 4.9 | 3.48 | 3.32 | 3.4 | 4.16 | 4.19 | | | | |
| BNGH41000181 | 2.47 | 1.59 | 1.84 | 2.93 | 2.1 | 1.8 | 1.7 | 2.66 | 1.59 | | | | |
| BNGH41000198 | 8.13 | 4.64 | 3.79 | 5.48 | 4.35 | 5.59 | 4.3 | 4.15 | 4.35 | | | | |
| BNGH41000219 | 9.61 | 3.92 | 4.87 | 4.17 | 5.29 | 5.45 | 5.24 | 7.12 | 7.13 | | | | |
| BNGH41000229 | 19.61 | 13.28 | 8.68 | 10.86 | 11.27 | 9.36 | 7.9 | 9.5 | 10.85 | | | | |
| BNGH41000237 | 10.9 | 5.47 | 6.45 | 6.65 | 6.97 | 7.79 | 6.36 | 6.25 | 5.44 | | | | |
| BNGH41000238 | 4.58 | 7 | 3.45 | 5.91 | 4.68 | 4.34 | 4.33 | 5.44 | 4.22 | | | | |
| RNGH41000243 | 13.85 | 8.69 | 8.48 | 10.19 | 9.71 | 8.97 | 8.23 | 4.87 | 5.54 | | | | |
| BNGH41000270 | 5.83 | 2.62 | 2.35 | 2.3 | 3.05 | 3.44 | 2.59 | 3.49 | 1.3 | | | | |
| BRAWH1000004 | 4.19 | 2.83 | 2.48 | 5.04 | 3.15 | 3.26 | 1.44 | 3.45 | 2.05 | | | | |
| BRAWH1000018 | 4.85 | 1.95 | 2.29 | 7.47 | 8.8 | 8.85 | 8.68 | 6.61 | 7.96 | ** | + | ** | + |
| BRAWH1000021 | 6.52 | 5.06 | 5.87 | 5.09 | 6.94 | 6.44 | 2.89 | 6.23 | 4.28 | | | | |
| BRAWH1000027 | 11.64 | 8.86 | 7.19 | 8.24 | 10.39 | 11.51 | 5.58 | 7.13 | 8.24 | | | | |
| BRAWH1000029 | 9.58 | 5.15 | 3.52 | 6.01 | 6.72 | 6 | 5.08 | 5.12 | 5.84 | | | | |
| DRAWH1000040 | 4.6 | 1.89 | 2.14 | 2.92 | 2.71 | 2.7 | 2.92 | 2.5 | 3.01 | | | | |
| DRAWH1000050 | 11.48 | 4.95 | 5.19 | 9.74 | 7.25 | 8.62 | 8.25 | 8.09 | 8.93 | | | | |
| DRAWH1000051 | 8.18 | 3.93 | 3.19 | 6.15 | 5.72 | 6.02 | 5.01 | 4.25 | 4.44 | | | | |

TABLE 163

| Clone | exp. 1 | exp. 2 | exp. 3 | exp. 1 | exp. 2 | exp. 3 | exp. 1 | exp. 2 | exp. 3 | ttest N/R | + - | ttest N/I | + - |
|---|---|---|---|---|---|---|---|---|---|---|---|---|---|
| BRAWH1000060 | 2.9 | 2.93 | 1.8 | 3.46 | 3.35 | 2.78 | 2.07 | 3.22 | 2.32 | | | | |
| BRAWH1000075 | 2.06 | 1.78 | 1.17 | 2.08 | 2.99 | 2.28 | 1.92 | 2.13 | 2.14 | | | | |
| BRAWH1000081 | 4.56 | 1.87 | 2.1 | 2.75 | 2.22 | 2.25 | 1.42 | 2.46 | 1.85 | | | | |
| BRAWH1000084 | 26.93 | 16.26 | 13.57 | 23.37 | 33.3 | 27.71 | 19.86 | 27.26 | 24.74 | | | | |
| BRAWH1000095 | 11.47 | 5.88 | 3.86 | 6.15 | 6.04 | 6.04 | 6.03 | 4.2 | 5.03 | | | | |
| BRAWH1000096 | 7.17 | 5.2 | 3.04 | 5.76 | 6.13 | 4.73 | 6.35 | 5.93 | 7.43 | | | | |
| BRAWH1000097 | 7.61 | 5.42 | 4.3 | 8.36 | 9.37 | 10.77 | 5.92 | 6.56 | 7.12 | * | + | | |
| BRAWH1000100 | 2.35 | 1.26 | 1.29 | 3.27 | 4.09 | 3.18 | 3.47 | 3.17 | 3.82 | * | + | * | + |
| BRAWH1000101 | 15.93 | 5.73 | 7.58 | 15.78 | 16.69 | 15.33 | 10.38 | 7.98 | 10.75 | | | | |
| BRAWH1000104 | 1.83 | 1.99 | 1.25 | 3.05 | 2.31 | 2.64 | 0.9 | 2.83 | 2.28 | * | + | | |
| BRAWH1000107 | 5.24 | 3.06 | 2.55 | 3.69 | 4.48 | 3.14 | 2.51 | 6.62 | 2.54 | | | | |
| BRAWH1000110 | 37.02 | 23.89 | 17.95 | 52.01 | 48.45 | 48.78 | 25.83 | 19.88 | 30.82 | * | + | | |
| BRAWH1000111 | 13.78 | 8.87 | 6.05 | 12.15 | 10.84 | 10.06 | 10.64 | 8.06 | 9.74 | | | | |
| BRAWH1000135 | 11.51 | 6.6 | 6.16 | 7.34 | 6.27 | 6.18 | 7.86 | 5.16 | 9.04 | | | | |
| BRAWH1000190 | 5.57 | 3.61 | 3.06 | 4.88 | 4.05 | 4.63 | 4.28 | 3.62 | 5.01 | | | | |
| HEMBA1000005 | 2.17 | 2.36 | 2.39 | 3.59 | 3.26 | 3.09 | 2.51 | 1.69 | 3.76 | ** | + | | |
| HEMBA1000006 | 4.88 | 4.08 | 3.07 | 5.64 | 5.07 | 4.69 | 3.89 | 4.34 | 3.69 | | | | |
| HEMBA1000012 | 7.67 | 9.97 | 9.83 | 7.99 | 7.06 | 6.98 | 3.55 | 5.22 | 3.46 | | | ** | − |
| HEMBA1000020 | 27.06 | 14.56 | 16.3 | 24.94 | 23.65 | 29.76 | 15.51 | 14.38 | 17.35 | | | | |
| HEMBA1000030 | 7.2 | 6.04 | 4.37 | 4.93 | 6.66 | 4.71 | 4.8 | 4.96 | 7.17 | | | | |
| HEMBA1000034 | 5.42 | 3.03 | 3.13 | 3.92 | 5.81 | 5.55 | 2.45 | 2.65 | 5.55 | | | | |
| MEMDA1000042 | 10.53 | 5.34 | 5.29 | 12.34 | 15.71 | 15.33 | 6.74 | 5.14 | 8.81 | * | + | | |
| HEMBA1000045 | 3.35 | 1.45 | 2 | 3.11 | 2.27 | 3.63 | 2.78 | 2.42 | 2.82 | | | | |
| HEMBA1000046 | 4.44 | 3.21 | 3.62 | 6.34 | 8.01 | 11.1 | 5.61 | 5.39 | 6.03 | * | + | ** | + |

TABLE 163-continued

| | | | | | | | | | | | | | |
|---|---|---|---|---|---|---|---|---|---|---|---|---|---|
| HEMBA1000047 | 3.38 | 2.86 | 1.36 | 3.03 | 2.25 | 2.95 | 2.29 | 1.9 | 1.25 | | | | |
| HEMBA1000048 | 6.35 | 3.98 | 4.34 | 16.75 | 14.72 | 14.62 | 7.09 | 8.13 | 7.75 | ** | + | * | + |
| HEMBA1000050 | 1.73 | 0.67 | 0.56 | 1.86 | 1.47 | 1.56 | 1.52 | 2.71 | 1.56 | | | | |
| HEMBA1000053 | 2.66 | 1.5 | 1.58 | 2.81 | 3.5 | 3.13 | 2.37 | 1.92 | 3.37 | * | + | | |
| HEMBA1000060 | 4.78 | 3.18 | 2.77 | 4.56 | 4.67 | 4.59 | 3.9 | 4.27 | 4.27 | | | | |
| HEMBA1000072 | 71.82 | 55.54 | 44.63 | 47.17 | 62.62 | 63.43 | 25.66 | 24.24 | 32.66 | | | * | − |
| HEMBA1000073 | 2.41 | 1.46 | 1.48 | 2.36 | 2.35 | 2.6 | 1.84 | 2.72 | 2.72 | | | | |
| HEMBA1000076 | 10.02 | 11.17 | 8.35 | 27.94 | 21.02 | 20.27 | 16.4 | 9.49 | 15.31 | ** | + | | |
| HEMBA1000084 | 3.64 | 2.86 | 3.72 | 4.85 | 4.96 | 4.11 | 5.09 | 5.98 | 4.83 | * | + | * | + |
| HEMBA1000087 | 3.12 | 2.56 | 2.1 | 4.7 | 3.46 | 2.58 | 2.59 | 4.09 | 3.28 | | | | |
| HEMBA1000088 | 1.57 | 0.55 | 0.65 | 1.47 | 0.74 | 0.92 | 1.69 | 2.19 | 2.78 | | | * | + |
| HEMBA1000091 | 7.82 | 3.65 | 3.58 | 5.14 | 4.68 | 5.32 | 5.87 | 2.69 | 5.02 | | | | |
| HEMDA1000111 | 3.34 | 2.33 | 2.42 | 4.87 | 5.39 | 5.9 | 3.66 | 3.37 | 3.36 | ** | + | | |
| HEMBA1000121 | 3.69 | 2.19 | 1.8 | 4.54 | 7.02 | 6.59 | 3.95 | 3.3 | 4.32 | * | + | | |
| HEMBA1000128 | 4.07 | 1.73 | 1.88 | 3.07 | 3.61 | 4.19 | 4.82 | 5.85 | 5.45 | | | * | + |
| HEMBA1000129 | 4.83 | 2.28 | 2.77 | 2.81 | 3.65 | 3.39 | 2.57 | 2.73 | 3.94 | | | | |
| HEMBA1000141 | 2.71 | 2.09 | 1.62 | 4.16 | 2.77 | 4.01 | 2.77 | 3.67 | 1.66 | * | + | | |
| HEMBA1000146 | 2.9 | 1.3 | 1.8 | 2.65 | 2.28 | 1.73 | 1.61 | 3.65 | 1.85 | | | | |
| HEMBA1000150 | 26.65 | 13.33 | 17.02 | 31.39 | 35.61 | 38.63 | 19.78 | 16.66 | 26.75 | * | + | | |
| HEMBA1000154 | 36.53 | 16.72 | 17.93 | 24.12 | 23.55 | 16.21 | 9 | 9.29 | 13.92 | | | | |
| HEMDA1000156 | 12.63 | 7.55 | 7.2 | 12.13 | 11.18 | 10.85 | 5.44 | 6.27 | 10.52 | | | | |
| HEMBA1000158 | 14.24 | 5.92 | 4.83 | 15.57 | 17.46 | 14.26 | 10.9 | 12.16 | 12.71 | | | | |
| HEMBA1000168 | 10.07 | 5.72 | 5.58 | 8.47 | 10.06 | 8.07 | 7.36 | 7.05 | 5.56 | | | | |
| HEMBA1000180 | 3.67 | 1.14 | 1.34 | 3.4 | 2.55 | 2.88 | 1.78 | 2.08 | 2.49 | | | | |
| HEMBA1000185 | 9.44 | 4.05 | 4.26 | 11.55 | 10.93 | 10.36 | 7.42 | 5.5 | 5.94 | * | + | | |
| HEMBA1000188 | 2.86 | 1.61 | 0.93 | 2.94 | 2.35 | 3.1 | 1.57 | 1.58 | 1.71 | | | | |
| HEMBA1000193 | 1.27 | 0.58 | 0.24 | 1.37 | 0.89 | 0.82 | 0.26 | 0.53 | 0.45 | | | | |
| HEMBA1000194 | 11.09 | 4.55 | 5.41 | 17.15 | 17.6 | 13.81 | 11.08 | 8.03 | 17.29 | * | + | | |
| HEMBA1000201 | 3.51 | 1.9 | 1.75 | 4.07 | 2.62 | 2.46 | 2.06 | 2.69 | 2.83 | | | | |
| HEMBA1000213 | 2.2 | 0.91 | 0.97 | 1.85 | 2.66 | 1.89 | 1.72 | 1.64 | 1.67 | | | | |
| HEMBA1000216 | 4.38 | 3.53 | 3.49 | 7.1 | 6.02 | 3.1 | 3.46 | 3.84 | 4.14 | | | | |
| HEMBA1000Z27 | 6.93 | 1.95 | 2.95 | 5.37 | 3.71 | 3.99 | 3.84 | 2.55 | 3.65 | | | | |

TABLE 164

| | | | | | | | | | | | | | |
|---|---|---|---|---|---|---|---|---|---|---|---|---|---|
| HEMBA1000231 | 5.77 | 4.79 | 1.39 | 5.73 | 5.06 | 5.05 | 2.57 | 4.02 | 3.83 | | | | |
| HEMBA1000237 | 10.5 | 9.41 | 7.28 | 13.8 | 14.47 | 14.03 | 8.59 | 13.21 | 9.08 | ** | + | | |
| HEMBA1000243 | 4.4 | 2.18 | 1.57 | 4.11 | 5.36 | 4.88 | 3.72 | 3.39 | 3.4 | | | | |
| HEMBA1000244 | 11.09 | 6.03 | 5.16 | 9.66 | 7.12 | 6.2 | 9.02 | 6.06 | 9.63 | | | | |
| HEMBA1000251 | 2.83 | 2.17 | 1.02 | 2.88 | 4.48 | 2.64 | 1.69 | 2.92 | 2.44 | | | | |
| HEMBA1000254 | 5.6 | 3.06 | 2.15 | 6.61 | 5.66 | 5.33 | 3.44 | 3.21 | 4.84 | | | | |
| HEMBA1000264 | 3.12 | 2.38 | 1.29 | 3 | 2.42 | 2.07 | 2.39 | 1.18 | 3.05 | | | | |
| HEMBA1000269 | 3.15 | 2.65 | 1.66 | 4.09 | 3.3 | 1.89 | 1.88 | 1.49 | 1.6 | | | | |
| HEMBA1000275 | 10.1 | 8.27 | 6.59 | 12.65 | 12.4 | 13.32 | 7.47 | 7.72 | 5.65 | * | + | | |
| HEMBA1000280 | 2.4 | 1.67 | 1.88 | 3.2 | 3.34 | 2.25 | 0.92 | 2.83 | 1.47 | | | | |
| HEMBA1000282 | 4.3 | 2.15 | 1.99 | 8.2 | 7.71 | 7.54 | 4.05 | 3.59 | 4.68 | ** | + | | |
| HEMBA1000287 | 6.5 | 5 | 3.8 | 6.66 | 6.95 | 7.33 | 6.19 | 6.14 | 4.66 | | | | |
| HEMBA1000288 | 4.22 | 5.47 | 1.6 | 5.44 | 4.7 | 5.08 | 3.8 | 2.7 | 3.03 | | | | |
| HEMBA1000290 | 2.44 | 1.68 | 1.41 | 3.3 | 2.07 | 2.24 | 2.46 | 1.37 | 1.82 | | | | |
| HEMBA1000296 | 4.58 | 3.23 | 3.04 | 3.88 | 4.57 | 3.87 | 2.97 | 3.13 | 3.49 | | | | |
| HEMBA1000300 | 7.18 | 7.47 | 4.77 | 15.63 | 12.41 | 11.86 | 8.05 | 9.96 | 6.36 | ** | + | | |
| HEMBA1000302 | 2.87 | 1.87 | 1.42 | 2.86 | 2.56 | 2.8 | 1.34 | 2.59 | 1.57 | | | | |
| HEMBA1000303 | 12.63 | 6.43 | 5.95 | 8.6 | 9.24 | 8.52 | 6.4 | 8.51 | 7.91 | | | | |
| HEMBA1000304 | 5.94 | 4.85 | 2.91 | 8.58 | 10.98 | 8.79 | 6.22 | 5.73 | 5.36 | * | + | | |
| HEMBA1000307 | 3.35 | 2.83 | 1.79 | 7.52 | 6.27 | 5.03 | 5.54 | 4.79 | 3.97 | * | + | * | + |
| HEMBA1000312 | 7.59 | 5.13 | 7.25 | 13.4 | 9.35 | 10.01 | 7.66 | 6.43 | 8.25 | * | + | | |
| HEMBA1000318 | 4.73 | 3.46 | 2.76 | 7.07 | 6.34 | 4.78 | 4.52 | 5.17 | 4.75 | | | | |
| HEMBA1000327 | 4.9 | 14.95 | 2.36 | 5.69 | 8.99 | 5.72 | 3.18 | 5.4 | 3.63 | | | | |
| HEMBA1000333 | 2.68 | 1.29 | 0.21 | 2.59 | 1.6 | 1.38 | 2.2 | 1.33 | 1.95 | | | | |
| HEMBA1000338 | 7.1 | 5.92 | 3.55 | 10.42 | 12.67 | 10.27 | 5.82 | 7.1 | 5.05 | * | + | | |
| HEMBA1000343 | 4 | 2.99 | 2.01 | 2.63 | 3.79 | 2.89 | 1.22 | 2.1 | 1.84 | | | | |
| HEMBA1000349 | 3.15 | 2.72 | 2.94 | 1.9 | 3.38 | 2.84 | 1.58 | 1.8 | 2.44 | | | * | − |
| HEMBA1000351 | 12.26 | 4.06 | 4.63 | 9.54 | 11.2 | 9.66 | 6.5 | 5.25 | 4.95 | | | | |
| HEMBA1000355 | 5.83 | 4.02 | 3.82 | 5.03 | 5.09 | 4.09 | 3.9 | 3.77 | 4.2 | | | | |
| HEMBA1000356 | 8.5 | 4.16 | 3.88 | 9.66 | 6 | 7.29 | 7.01 | 5.23 | 5.35 | | | | |
| HEMBA1000357 | 6.36 | 2.11 | 3.61 | 7.55 | 7.35 | 8.12 | 3.8 | 3.56 | 3.53 | * | + | | |
| HEMBA1000366 | 2.01 | 1.56 | 0.82 | 2.54 | 1.86 | 2.67 | 1.26 | 2.04 | 1.96 | | | | |
| HEMBA1000369 | 7.61 | 3.99 | 4.13 | 5.06 | 4.64 | 5.24 | 3.29 | 3.78 | 3.59 | | | | |
| HEMDA1000370 | 1.94 | 1.23 | 1.23 | 3.73 | 3.06 | 3.01 | 1.19 | 2.46 | 1.97 | ** | + | | |
| HEM3A1000376 | 5.48 | 4.4 | 4.48 | 8.19 | 9.77 | 8.68 | 4.81 | 5.75 | 4.74 | ** | + | | |
| HEMBA1000387 | 6.72 | 4.8 | 4.24 | 12.88 | 11.31 | 8.93 | 7.04 | 6.86 | 7.9 | * | + | | |
| HEMBA1000389 | 6.41 | 4.31 | 3.18 | 5.44 | 5.19 | 3.87 | 3.87 | 4.16 | 5.13 | | | | |
| HEMBA1000390 | 2.89 | 3.46 | 2.42 | 2.82 | 2.5 | 3.02 | 2.55 | 2.1 | 2.56 | | | | |
| HEMBA1000392 | 1.66 | 1.01 | 0.96 | 2.76 | 2.9 | 2.64 | 1.17 | 2.08 | 1.89 | ** | + | | |
| HEMBA1000396 | 2.67 | 1.46 | 1.17 | 3.48 | 2.29 | 1.9 | 2.07 | 2.04 | 2.6 | | | | |
| HEMBA1000411 | 2.73 | 2.11 | 2 | 2.49 | 2.83 | 1.98 | 1.3 | 2.58 | 1.84 | | | | |

TABLE 164-continued

| HEMBA1000418 | 2.29 | 2.59 | 1.6 | 3.21 | 4.57 | 2.67 | 2.11 | 3.04 | 2.45 | | | | |
|---|---|---|---|---|---|---|---|---|---|---|---|---|---|
| HEMBA1000422 | 5.88 | 3.82 | 2.78 | 5.71 | 5.46 | 6.46 | 2.91 | 5 | 3.36 | | | | |
| HEMBA1000428 | 2.98 | 1.47 | 1 | 5.92 | 5.67 | 4.87 | 3.36 | 3.17 | 3.89 | ** | + | | |
| HEMBA1000434 | 0.46 | 1.18 | 0.48 | 1.51 | 2.2 | 1.01 | 1.46 | 1.36 | 1.4 | | | * | + |
| HEMBA1000442 | 1.91 | 1.74 | 2.18 | 1.99 | 2.71 | 2.66 | 1.77 | 2.2 | 1.7 | | | | |
| HEMBA1000443 | 5.28 | 4.21 | 2.77 | 4.95 | 5.35 | 7.43 | 4.57 | 4.71 | 4 | | | | |
| HEMBA1000446 | 15.47 | 8.43 | 7.47 | 8.86 | 8.46 | 9.56 | 8.97 | 8.38 | 10.15 | | | | |
| HEMBA1000456 | 7.87 | 3.87 | 5.62 | 12.88 | 11.2 | 12.65 | 6.87 | 8.86 | 10.32 | ** | + | | |
| HEMBA1000459 | 3.86 | 2.75 | 1.81 | 4.89 | 5.61 | 4.96 | 2.29 | 3.47 | 3.74 | * | + | | |
| HEMBA1000460 | 2.95 | 1.91 | 1.24 | 1.69 | 3.46 | 2.84 | 3.05 | 2.46 | 5.23 | | | | |
| HEMBA1000462 | 17.16 | 10.03 | 4.79 | 13.14 | 13.57 | 10.69 | 11.49 | 13.69 | 11.75 | | | | |
| HEMBA1000464 | 1.23 | 1.41 | 0.6 | 1.41 | 1.89 | 0.9 | 1.32 | 1.26 | 0.96 | | | | |
| HEMBA1000468 | 1.87 | 1.63 | 0.67 | 3.5 | 1.61 | 1.75 | 2.85 | 2.43 | 2.2 | | | | |
| HEMBA1000469 | 4.36 | 2.95 | 2.67 | 7.93 | 8.36 | 9.97 | 5.39 | 4.1 | 4.79 | ** | + | | |
| HEMBA1000477 | 6.04 | 2.58 | 2.34 | 5.17 | 5.61 | 5.34 | 6 | 5.59 | 6.01 | | | | |

TABLE 165

| HEMBA1000481 | 20.13 | 11.47 | 12.73 | 18.55 | 18.55 | 15.53 | 7.84 | 7.33 | 12.91 | | | | |
|---|---|---|---|---|---|---|---|---|---|---|---|---|---|
| HEMBA1000488 | 7.66 | 4.44 | 4.62 | 7.86 | 6.19 | 6.89 | 3.5 | 5.38 | 6.42 | | | | |
| HEMBA1000490 | 4.18 | 2.68 | 1.34 | 3.95 | 5.37 | 3.63 | 2.12 | 2.88 | 4.31 | | | | |
| HEMBA1000491 | 7.15 | 3.43 | 2.52 | 5.5 | 6.82 | 6.64 | 4.25 | 3.29 | 3.33 | | | | |
| HEMBA1000498 | 10.26 | 6.11 | 4.98 | 10.58 | 18.06 | 18.44 | 9.53 | 6.44 | 8.57 | * | + | | |
| HEMBA1000501 | 10.31 | 9.16 | 7.08 | 7.41 | 5.02 | 8.46 | 4.06 | 4.46 | 3.72 | | | ** | − |
| HEMBA1000504 | 0.29 | 1.06 | 0.88 | 2.55 | 1.79 | 2.74 | 3.2 | 4.91 | 2.54 | * | + | * | + |
| HEMBA1000505 | 4 | 3.11 | 2.61 | 4.34 | 3.87 | 4.06 | 3.11 | 3.95 | 3.94 | | | | |
| HEMBA1000507 | 8.99 | 4.59 | 6.64 | 9.35 | 10.47 | 8.65 | 5.55 | 8.59 | 7.24 | | | | |
| HEMBA1000508 | 8.59 | 6.68 | 6.07 | 11.49 | 13.9 | 16.57 | 7.32 | 8.75 | 9.79 | * | + | | |
| HEMBA1000518 | 2.98 | 1.78 | 1.55 | 2.04 | 2.31 | 1.71 | 2.15 | 1.54 | 1.87 | | | | |
| HEMBA1000519 | 13.74 | 9.63 | 6.41 | 18.15 | 26.1 | 23.45 | 14.61 | 12.39 | 16.75 | * | | | |
| HEMBA1000520 | 0.74 | 1.54 | 1.42 | 0.53 | 4.99 | 5.32 | 0.3 | 3.24 | 3.21 | | | | |
| HEMBA1000523 | 2.58 | 1.73 | 1.85 | 2.49 | 2.81 | 3.42 | 2.38 | 3.31 | 2.63 | | | | |
| HEMBA1000531 | 5.39 | 5.46 | 3.11 | 3.93 | 6.67 | 3.26 | 3.72 | 3.54 | 2.94 | | | | |
| HEMBA1000534 | 0.79 | 3.21 | 2.91 | 1.73 | 9.74 | 6.64 | 0.85 | 6.6 | 3.17 | | | | |
| HEMBA1000538 | −0.07 | 2.6 | 2.6 | 0.69 | 6.28 | 5.42 | 0.12 | 7.11 | 5.18 | | | | |
| HEMBA1000540 | 3.94 | 2.64 | 3.3 | 8.03 | 7.49 | 8.11 | 2.04 | 3.68 | 2.54 | ** | + | | |
| HEMBA1000542 | 5.67 | 3.4 | 2.44 | 3.85 | 3.5 | 5.44 | 3.98 | 3.82 | 4.97 | | | | |
| HEMBA1000545 | 2.41 | 1.53 | 0.38 | 4.15 | 3.69 | 3.21 | 1.98 | 2.16 | 2.09 | * | + | | |
| HEMBA1000547 | 1.74 | 1.59 | 1.68 | 5.72 | 8.77 | 7.03 | 3.43 | 3.74 | 3.3 | ** | + | ** | + |
| HEMBA1000551 | 9.65 | 6.1 | 8.03 | 14.99 | 17.46 | 18.61 | 8.56 | 8.89 | 9.19 | ** | + | | |
| HEMBA1000555 | 5.3 | 2 | 2.07 | 3.79 | 6.18 | 4.25 | 2.7 | 2.98 | 2.37 | | | | |
| HEMBA1000557 | 4.48 | 2.92 | 3.57 | 7.15 | 7.8 | 8.32 | 4.31 | 6.14 | 5.01 | ** | + | | |
| HEMBA1000561 | 3.7 | 1.44 | 1.77 | 4.14 | 3.06 | 3.15 | 3.47 | 4.41 | 2.34 | | | | |
| HEMBA1000563 | 1.24 | 0.37 | 0.85 | 2.27 | 1.82 | 2.27 | 0.66 | 2.98 | 0.86 | * | + | | |
| HEMB41000567 | 3.87 | 1.04 | 1.51 | 8.01 | 8.19 | 8.67 | 5.26 | 3.73 | 4 | ** | + | | |
| HEMB41000568 | 3.88 | 2.11 | 2.05 | 5.69 | 5.23 | 5.4 | 1.77 | 2.82 | 3.91 | * | + | | |
| HEMB41000569 | 4.97 | 2.5 | 2.71 | 6.85 | 4.01 | 5.8 | 3.46 | 3.51 | 4.29 | | | | |
| HEMBA1000575 | 13.92 | 7.22 | 8.43 | 20.52 | 24.59 | 18.68 | 11.63 | 11.79 | 11.04 | * | + | | |
| HEMBA1000588 | 1.28 | 0.91 | 1.2 | 2.91 | 2.49 | 2.9 | 1.78 | 2.48 | 2.62 | ** | + | * | + |
| HEMBA1000590 | 3.14 | 1.5 | 1.84 | 3.09 | 1.65 | 1.71 | 1.44 | 1.82 | 1.81 | | | | |
| HEMBA1000591 | 6.68 | 3.59 | 4.87 | 8.78 | 6.73 | 9.08 | 5.54 | 5.94 | 6.27 | | | | |
| HEMBA1000592 | 1.77 | 1 | 1.66 | 2.61 | 3.4 | 2.25 | 1.98 | 2.18 | 1.99 | * | + | | |
| HEMBA1000594 | 3.25 | 0.68 | 1.19 | 1.74 | 3.07 | 2.12 | 1.39 | 1.15 | 1.72 | | | | |
| HEMBA1000604 | 5.99 | 4.47 | 2.05 | 8.88 | 9.05 | 6.96 | 3.2 | 5.91 | 6.23 | * | + | | |
| HEMBA1000607 | 4.99 | 3.1 | 3.35 | 6.44 | 6.82 | 5.81 | 3.43 | 4.28 | 4.42 | * | + | | |
| HEMBA1000608 | 0.99 | 1.94 | 0.42 | 3.85 | 2.15 | 1.46 | 2.61 | 2.1 | 3.4 | | | | |
| HEMBA1000622 | 2.66 | 1.16 | 0.99 | 4.04 | 3.67 | 4.04 | 2.76 | 3.15 | 3.26 | * | + | | |
| HEMBA1000634 | 28.82 | 15.23 | 16.08 | 35.62 | 36.93 | 32.2 | 24.35 | 21.77 | 26.76 | * | + | | |
| HEMBA1000636 | 10.44 | 4.41 | 5.46 | 7.42 | 7.72 | 8.03 | 6.42 | 4.97 | 5.75 | | | | |
| HEMBA1000637 | 5.28 | 3.33 | 4.09 | 4.63 | 6.26 | 5.53 | 4.14 | 4.87 | 4.43 | | | | |
| HEMBA1000655 | 7.39 | 4.24 | 2.84 | 8.57 | 9.07 | 9.85 | 5.75 | 6.56 | 6.78 | * | + | | |
| HEMBA1000657 | 7.14 | 3.75 | 3.78 | 7.09 | 5.66 | 6.19 | 4.07 | 4.53 | 7.57 | | | | |
| HEMBA1000662 | 2.8 | 1.64 | 1.1 | 1.89 | 1.7 | 1.33 | 1.86 | 1.9 | 1.81 | | | | |
| HEMBA1000664 | 2.6 | 2.45 | 0.17 | 3.74 | 3.57 | 2.7 | 2.86 | 2.52 | 2.77 | | | | |
| HEMBA1000671 | 3.69 | 2.81 | 2.74 | 7.05 | 5.05 | 5.15 | 3.14 | 2.82 | 3.51 | * | + | | |
| HEMBA1000673 | 5.96 | 2.79 | 3.34 | 9.32 | 7.79 | 7.67 | 4.47 | 3.8 | 5.32 | * | + | | |
| HEMBA1000675 | 2.45 | 2.8 | 0.77 | 6.63 | 4.04 | 4.43 | 3.65 | 3.8 | 3.87 | * | + | * | + |
| HEMBA1000678 | 7.03 | 5.09 | 6.34 | 10.12 | 8.74 | 9.2 | 2.93 | 5.72 | 5.28 | * | + | | |
| HEMBA1000682 | 5.22 | 2.07 | 2.75 | 12.42 | 15.95 | 13.04 | 14.17 | 11.88 | 14.92 | ** | + | ** | + |
| HEMBA1000686 | 5.1 | 3.46 | 2.35 | 5.21 | 4.74 | 3.32 | 3.54 | 2.67 | 2.25 | | | | |
| HEMBA1000702 | 9.79 | 6.15 | 6.42 | 10.8 | 11.22 | 8.35 | 8.93 | 8.45 | 8.8 | | | | |
| HEMBA1000705 | 1.79 | 1.26 | 0.4 | 2.12 | 2.25 | 1.15 | 1.75 | 1.57 | 2.17 | | | | |
| HEMBA1000713 | 5.65 | 3.58 | 2.89 | 6.69 | 5.36 | 6.21 | 7.06 | 6.72 | 4.64 | | | | |
| HEMBA1000718 | 4.7 | 2.67 | 2.33 | 5.7 | 6 | 5.76 | 3.69 | 3.85 | 2.59 | * | + | | |

TABLE 166

| | | | | | | | | | | | | | |
|---|---|---|---|---|---|---|---|---|---|---|---|---|---|
| HEMBA1000719 | 4.82 | 2.97 | 2.79 | 3.61 | 4.58 | 3.67 | 3.75 | 2.77 | 3.67 | | | | |
| HEMBA1000722 | 2.03 | 0.86 | 1.42 | 1.98 | 2.82 | 1.59 | 1.34 | 3.92 | 2.07 | | | | |
| HEMBA1000726 | 10.3 | 9.3 | 7.72 | 23.56 | 26.89 | 19.83 | 12.69 | 13.58 | 11.3 | ** | + | * | + |
| HEMDA1000727 | 6.04 | 3.96 | 3.25 | 8.14 | 10.98 | 7.59 | 6.32 | 6.82 | 2.98 | * | + | | |
| HEMBA1000732 | 3.01 | 2.28 | 1.42 | 2.14 | 1.87 | 1.92 | 2.98 | 2.21 | 2.48 | | | | |
| HEMBA1000736 | 4.72 | 2.16 | 2 | 3.64 | 1.97 | 1.99 | 2.73 | 2.2 | 2.64 | | | | |
| HEMBA1000743 | 0.32 | 1.05 | 0.53 | 1.51 | 2.41 | 0.98 | 0.72 | 1.22 | 1.24 | | | | |
| HEMBA1000745 | 1.74 | 1.73 | 1.32 | 1.18 | 1.69 | 2.12 | 1.96 | 2.53 | 1.18 | | | | |
| HEMBA1000747 | 4.19 | 1.78 | 1.08 | 3.03 | 2.21 | 1.78 | 1.85 | 3.32 | 2.09 | | | | |
| HEMBA1000748 | 2.17 | 1.28 | 2.24 | 2.2 | 3.52 | 2.79 | 1.6 | 2.38 | 1.72 | | | | |
| HEMBA1000749 | 4.95 | 3.09 | 2.17 | 6.45 | 8.33 | 7.14 | 3.25 | 4.29 | 3.58 | * | + | | |
| HEMBA1000752 | 4.81 | 3.6 | 2.79 | 5.03 | 6.01 | 4.99 | 4.34 | 3.06 | 3.28 | | | | |
| HEMBA1000753 | 9.91 | 6.17 | 6.18 | 9.28 | 11.1 | 8.29 | 5.77 | 5.12 | 5.5 | | | | |
| HEMBA1000757 | 7.1 | 7.74 | 5.44 | 11.01 | 14.04 | 12.37 | 5.58 | 4.46 | 4.75 | ** | + | | |
| HEMBA1000760 | 16.78 | 13.36 | 13.64 | 8.72 | 12.16 | 6.16 | 8.22 | 7.22 | 7.97 | | | ** | |
| HEMBA1000769 | 7.05 | 2.51 | 3.23 | 9 | 8.67 | 9.72 | 4.24 | 4.83 | 3.98 | * | + | | |
| HEMBA1000773 | 1.32 | 0.68 | 0.25 | 0.36 | 1.46 | 1.1 | 0.81 | 1.64 | 0.68 | | | | |
| HEMBA1000774 | 8 | 3.27 | 7.05 | 12.39 | 12.55 | 13.92 | 7.51 | 8.12 | 7.46 | * | + | | |
| HEMBA1000780 | 2.14 | 1.77 | 0.74 | 2.61 | 2.17 | 1.75 | 1.28 | 2.13 | 1.21 | | | | |
| HEMBA1000783 | 1.08 | 1.96 | 1.07 | 2.21 | 1.08 | 2.2 | 1.9 | 1.74 | 1.44 | | | | |
| HEMBA1000791 | 3.14 | 3.15 | 3.13 | 6.58 | 7.55 | 5.76 | 3.73 | 3.72 | 6.22 | ** | + | | |
| HEMBA1000793 | 9.3 | 4 | 3.98 | 5.49 | 6.95 | 5.86 | 5.38 | 4.76 | 5.7 | | | | |
| HEMBA1000802 | 3.76 | 2.25 | 1.22 | 2.43 | 3.6 | 2.62 | 0.88 | 2.18 | 1.88 | | | | |
| HEMBA1000813 | 9.81 | 3.16 | 4.27 | 6.99 | 7.53 | 7.12 | 3.67 | 6.02 | 6.65 | | | | |
| HEMBA1000817 | 2.66 | 1.43 | 0.92 | 2.74 | 3.08 | 2.72 | 1.26 | 2.52 | 1.67 | | | | |
| HEMBA1000822 | 0.99 | 1.09 | 0.85 | 1.62 | 3.22 | 2.71 | 1.22 | 1.82 | 0.71 | * | + | | |
| HEMBA1000827 | 7.7 | 6.4 | 3.84 | 6.01 | 6.66 | 6.53 | 3.91 | 3.03 | 4.64 | | | | |
| HEMBA1000833 | 5.1 | 2.66 | 2.23 | 8.93 | 7.69 | 7.93 | 7.69 | 5.86 | 6.86 | ** | + | * | + |
| HEMBA1000835 | 5.71 | 3.29 | 3.29 | 5.75 | 3.34 | 4.85 | 2.51 | 3.39 | 3.41 | | | | |
| HEMBA1000843 | 6.36 | 5.57 | 5.21 | 6.61 | 9.85 | 9.29 | 4.9 | 5.64 | 10.02 | | | | |
| HEMBA1000851 | 4.2 | 1.79 | 2.1 | 3.58 | 3.85 | 2.86 | 2.91 | 1.96 | 2.78 | | | | |
| HEMBA1000852 | 5.4 | 3.22 | 2.28 | 5.81 | 4.07 | 5.82 | 2.77 | 3.99 | 3.71 | | | | |
| HEMBA1000867 | 1.61 | 2.47 | 1.06 | 2.17 | 3.19 | 2.37 | 0.68 | 2.24 | 0.83 | | | | |
| HEMBA1000869 | 1.82 | 1.11 | 0.72 | 0.98 | 2.58 | 1.99 | 0.79 | 2.22 | 0.83 | | | | |
| HEMBA1000870 | 6.82 | 3.33 | 3.67 | 6.25 | 6.67 | 4.52 | 3.47 | 4.37 | 5.69 | | | | |
| HEMBA1000872 | 4.12 | 2.25 | 3.08 | 4.7 | 5.64 | 4.68 | 3.33 | 3.29 | 4.33 | * | + | | |
| HEMBA1000875 | 1.77 | 1.41 | 1.93 | 5.81 | 7.31 | 5.85 | 7.19 | 6.68 | 8.14 | ** | + | ** | + |
| HEMBA1000876 | 5.86 | 4.79 | 3.07 | 7.1 | 7.28 | 6.57 | 4.55 | 4.52 | 6.23 | * | + | | |
| HEMBA1000907 | 2.12 | 2.01 | 0.66 | 2.54 | 2.27 | 2.12 | 2.3 | 1.55 | 1.2 | | | | |
| HEMBA1000908 | 4.73 | 8.03 | 3.2 | 3.97 | 8 | 4.77 | 4.32 | 3.17 | 3.88 | | | | |
| HEMBA1000910 | 4.06 | 2.39 | 3.23 | 5.88 | 8 | 5.6 | 4.31 | 3.17 | 3.05 | * | + | | |
| HEMDA1000918 | 3.62 | 1.79 | 2.38 | 3.54 | 2.97 | 3.56 | 2.53 | 2.34 | 2.18 | | | | |
| HEMBA1000919 | 6.44 | 3.37 | 2.05 | 4.74 | 4.83 | 4.38 | 3.75 | 4.79 | 3.18 | | | | |
| HEMBA1000934 | 8.7 | 4.01 | 3.95 | 4.96 | 5.39 | 5.6 | 4.1 | 3.51 | 4.76 | | | | |
| HEMBA1000935 | 2.09 | 1.32 | 1.09 | 2.05 | 2.33 | 2 | 1.1 | 2.66 | 1.72 | | | | |
| HEMBA1000940 | 4.94 | 2.14 | 2.53 | 3.07 | 4.88 | 4.53 | 2.3 | 2.63 | 3.13 | | | | |
| HEMBA1000942 | 6.3 | 3.89 | 2.49 | 7.11 | 9.28 | 8.54 | 5.01 | 6.29 | 5.19 | * | + | | |
| HEMBA1000943 | 1.76 | 1.55 | 1.49 | 3.18 | 2.76 | 2.23 | 1.98 | 2.58 | 2.05 | * | + | * | + |
| HEMBA1000946 | 8.15 | 7.73 | 6 | 5.16 | 5.33 | 4.88 | 2.92 | 2.97 | 2.91 | * | − | ** | − |
| HEMBA1000960 | 9.59 | 5.75 | 7.08 | 15.65 | 18.02 | 18.53 | 8.6 | 9.11 | 11.03 | ** | + | | |
| HEMBA1000962 | 6.47 | 2.77 | 4.32 | 4.75 | 7 | 7.13 | 5.16 | 3.51 | 7.23 | | | | |
| HEMBA1000968 | 7 | 1.7 | 1.54 | 3 | 4.17 | 3.31 | 2.23 | 2.96 | 3.14 | | | | |
| HEMBA1000971 | 5.14 | 1.71 | 2.36 | 4.85 | 4.32 | 4.5 | 3.47 | 4.15 | 3.21 | | | | |
| HEMBA1000972 | 3.69 | 1.13 | 1.73 | 5.98 | 4.9 | 5.9 | 2.76 | 4.55 | 2.35 | * | + | | |
| HEMBA1000974 | 1.6 | 0.93 | 0.68 | 2.29 | 1.66 | 2.44 | 2.01 | 3.61 | 2.23 | * | + | | |
| HEMBA1000975 | 3.28 | 2 | 1.5 | 5.97 | 3.13 | 2.57 | 2.25 | 4.14 | 2.32 | | | | |

TABLE 167

| | | | | | | | | | | | | | |
|---|---|---|---|---|---|---|---|---|---|---|---|---|---|
| HEMBA1000979 | 5.49 | 2.18 | 2.97 | 6.7 | 3.77 | 4.39 | 3.48 | 5.27 | 4.03 | | | | |
| HEMBA1000981 | 9.63 | 9.63 | 8.99 | 5.49 | 6.85 | 5.43 | 3.2 | 5.8 | 4.89 | ** | − | ** | − |
| HEMBA1000983 | 6.43 | 3.92 | 2.91 | 5.46 | 7.35 | 6.51 | 4.3 | 3.18 | 4.68 | | | | |
| HEMBA1000985 | 1.63 | 1.32 | 0.83 | 1.53 | 0.96 | 1.83 | 1.43 | 0.82 | 1.18 | | | | |
| HEMBA1000986 | 8.66 | 3.3 | 4.89 | 7.79 | 10.67 | 12.32 | 6.59 | 5.63 | 7.52 | | | | |
| HEMBA1000991 | 3.99 | 3.51 | 3.27 | 7.03 | 8.03 | 8.59 | 3.11 | 5.46 | 4.41 | ** | + | | |
| HEMBA1001007 | 6.98 | 3.16 | 4.1 | 4.53 | 6.32 | 6.25 | 5.08 | 5.14 | 4.03 | | | | |
| HEMBA1001008 | 3.18 | 2.08 | 1.67 | 6.05 | 4.43 | 4.59 | 2.99 | 3.85 | 3.36 | * | + | | |
| HEMBA1001009 | 3.19 | 2.06 | 1.89 | 3 | 2.73 | 3.35 | 2.83 | 4.13 | 2.55 | | | | |
| HEMBA1001014 | 5.39 | 3.12 | 5.74 | 9.86 | 11.08 | 12.45 | 4.65 | 7.98 | 7.55 | ** | + | | |
| HEMBA1001017 | 7.4 | 4.83 | 4.74 | 5.73 | 6.28 | 5.4 | 4.08 | 4.41 | 5.88 | | | | |
| HEMBA1001019 | 2.85 | 2.29 | 1.26 | 2.91 | 2.72 | 2.07 | 1.51 | 2.11 | 2.14 | | | | |
| HEMBA1001020 | 3.1 | 1.76 | 1.25 | 4.02 | 4.91 | 3.89 | 2.56 | 2.42 | 2.65 | * | + | | |
| HEMBA1001021 | 5.67 | 3.26 | 3.56 | 5.27 | 3.84 | 4.59 | 5.11 | 3.82 | 6.55 | | | | |
| HEMBA1001022 | 4.52 | 3.09 | 3.23 | 5.25 | 4.72 | 3.27 | 2.64 | 3.83 | 3.89 | | | | |
| HEMBA1001024 | 1.94 | 0.42 | 0.87 | 1.28 | 1.11 | 2.19 | 1.54 | 1.4 | 1.01 | | | | |
| HEMBA1001026 | 1.87 | 1.27 | 0.7 | 1.76 | 2.89 | 2.28 | 1.38 | 1.06 | 1.68 | | | | |

TABLE 167-continued

| | | | | | | | | | | | | | |
|---|---|---|---|---|---|---|---|---|---|---|---|---|---|
| HEMBA1001043 | 2.16 | 1.91 | 1.95 | 3.51 | 4.01 | 3.96 | 1.57 | 1.82 | 0.63 | ** | + | | |
| HEMBA1001051 | 12.22 | 4.76 | 5.28 | 19.03 | 15.88 | 16.82 | 10.42 | 7.53 | 10.73 | * | + | | |
| HEMBA1001052 | 1.62 | 0.97 | 1.98 | 2.53 | 4.21 | 2.8 | 2.24 | 1.49 | 2.61 | | | | |
| HEMBA1001059 | 6.89 | 2.24 | 2.49 | 4.96 | 3.77 | 4.85 | 4.31 | 4.18 | 4.43 | | | | |
| HEMBA1001060 | 7.98 | 3.88 | 4.72 | 10.32 | 9.35 | 8.51 | 6.1 | 5.55 | 6.56 | * | + | | |
| HEMBA1001064 | 5.36 | 3.84 | 3.22 | 6.43 | 5.68 | 4.77 | 2.55 | 3.39 | 3.71 | | | | |
| HEMBA1001071 | 1.62 | 1.41 | 0.32 | 16 | 17.18 | 11.61 | 12.79 | 12.04 | 12.64 | ** | + | ** | + |
| HEMBA1001077 | 4.45 | 3.8 | 1.96 | 11.6 | 9.35 | 8.57 | 3.08 | 5.61 | 3.95 | ** | + | | |
| HEMBA1001078 | 14.1 | 8.18 | 8.99 | 5.43 | 6.25 | 7.02 | 4.32 | 6.96 | 5.16 | | | | |
| HEMBA1001080 | 5.79 | 3.95 | 2.49 | 3.69 | 5.23 | 5.89 | 5.35 | 4.03 | 3.93 | | | | |
| HEMBA1001084 | 5.31 | 2.86 | 2.62 | 7.71 | 7.07 | 6.47 | 5.73 | 4.4 | 5.39 | * | + | | |
| HEMBA1001085 | 13.38 | 7.46 | 10.01 | 19.29 | 18.48 | 14.18 | 11.36 | 11.18 | 10.99 | * | + | | |
| HEMBA1001088 | 5.8 | 4.05 | 4.96 | 5.45 | 4.2 | 4.92 | 5.6 | 5.06 | 6.59 | | | | |
| HEMBA1001093 | 2.01 | 1.13 | 0.59 | 2.57 | 2.37 | 1.64 | 1.63 | 2.12 | 1.53 | | | | |
| HEMBA1001094 | 0.9 | 1.06 | 0.61 | 2.27 | 2.81 | 2.04 | 1.48 | 1.38 | 2.02 | ** | + | * | + |
| HEMBA1001099 | 2.64 | 3.87 | 2.39 | 4.48 | 2.58 | 3.18 | 1.73 | 2.49 | 1.54 | | | | |
| HEMBA1001104 | 4.32 | 2.56 | 3.02 | 5.08 | 3.19 | 2.29 | 3.64 | 4.68 | 2.66 | | | | |
| HEMBA1001109 | 15.93 | 10.15 | 10.15 | 27.48 | 26.01 | 22.62 | 15.71 | 11.93 | 11.35 | ** | + | | |
| HEMBA1001114 | 8.6 | 5.78 | 5.64 | 9.84 | 9.77 | 10.41 | 14.65 | 11.13 | 18.58 | * | + | * | + |
| HEMBA1001121 | 2.07 | 1.57 | 0.99 | 2.33 | 3.89 | 3.11 | 2.34 | 1.82 | 1.7 | * | + | | |
| HEMBA1001122 | 2.51 | 5.06 | 1.51 | 4.85 | 12.94 | 9.66 | 6.46 | 7.06 | 7.13 | ** | + | * | + |
| HEMBA1001123 | 10.26 | 5.27 | 4.03 | 8.74 | 8.81 | 11.74 | 6.7 | 7.3 | 6.19 | | | | |
| HEMBA1001133 | 4.14 | 2.91 | 3.18 | 3.04 | 2.73 | 4.12 | 2.58 | 3.25 | 4.04 | | | | |
| HEMBA1001137 | 9.39 | 4 | 4.74 | 6.72 | 8.14 | 6.94 | 8 | 6.14 | 4.6 | | | | |
| HEMBA1001140 | 6.82 | 5.7 | 6.11 | 10.25 | 12.69 | 12.18 | 4.71 | 6.45 | 5.99 | ** | + | | |
| HEMBA1001144 | 14.92 | 3.84 | 7.57 | 18.27 | 23.75 | 20.85 | 12.2 | 8.33 | 12.65 | * | + | | |
| HEMBA1001145 | 28.51 | 33.95 | 19.22 | 28.92 | 30.82 | 30.17 | 44.7 | 41.59 | 36.72 | | | * | + |
| HEMBA1001158 | 5.04 | 3.15 | 2.61 | 5.99 | 3.8 | 6.16 | 5.34 | 3.86 | 4.7 | | | | |
| HEMBA1001172 | 5.81 | 3.09 | 2.82 | 8.57 | 8.02 | 8.53 | 5.72 | 4.06 | 4.92 | * | + | | |
| HEMBA1001174 | 2.3 | 2.42 | 1 | 1.59 | 2.22 | 1.73 | 1.99 | 2.72 | 1.46 | | | | |
| HEMBA1001175 | 4.94 | 2.83 | 3.63 | 9.64 | 8.74 | 8.9 | 6.25 | 5.58 | 6.09 | ** | + | * | + |
| HEMBA1001182 | 15.48 | 8.24 | 12.75 | 16.98 | 16.95 | 14.52 | 6.34 | 9.16 | 8.55 | | | | |
| HEMBA1001184 | 1.37 | 1.11 | 1.17 | 2.46 | 2.2 | 1.94 | 1.7 | 1.64 | 1.09 | ** | + | | |
| HEMBA1001192 | 1.14 | 1.3 | 0.71 | 1.4 | 1.96 | 2.74 | 1.17 | 1.75 | 1.29 | | | | |
| HEMBA1001196 | 9.67 | 6.82 | 7.53 | 12.04 | 9.93 | 10.61 | 8.76 | 5.56 | 6.62 | | | | |
| HEMBA1001197 | 26.77 | 18.72 | 19.29 | 43.93 | 39.7 | 25.47 | 17.6 | 13.26 | 17.88 | | | | |
| HEMBA1001208 | 4.45 | 2.51 | 2.06 | 2.43 | 4.11 | 3.2 | 2.93 | 2.71 | 2.12 | | | | |
| HEMBA1001213 | 4.18 | 2.48 | 2.29 | 4.96 | 5.22 | 3.94 | 3.68 | 3.27 | 5.1 | | | | |
| HEMBA1001214 | 28.24 | 15.89 | 17.42 | 11.21 | 10.37 | 12.48 | 8.74 | 7.69 | 7.51 | | | * | − |

TABLE 168

| | | | | | | | | | | | | | |
|---|---|---|---|---|---|---|---|---|---|---|---|---|---|
| HEMBA1001221 | 2.19 | 1.18 | 0.78 | 2.28 | 2.36 | 2.53 | 2.4 | 3.63 | 1.51 | | | | |
| HEMBA1001225 | 1.21 | 1.77 | 1.22 | 2.62 | 2.13 | 1.37 | 0.82 | 1.74 | 2.82 | | | | |
| HEMBA1001226 | 13.52 | 10.49 | 8.91 | 8.36 | 20 | 19.62 | 7.71 | 0.44 | 7.45 | ** | + | | |
| HEMBA1001228 | 13.05 | 5.12 | 4.29 | 9.55 | 8.22 | 7.69 | 6.04 | 7.48 | 7.86 | | | | |
| HEMBA1001229 | 12.71 | 9.28 | 6.69 | 8.25 | 7.48 | 7.38 | 10.2 | 8.81 | 12.42 | | | | |
| HEMBA1001235 | 4.86 | 4.97 | 4.74 | 7.89 | 8.06 | 6.71 | 5.12 | 7.06 | 11.33 | ** | + | | |
| HEMBA1001238 | 5.14 | 3.54 | 3.32 | 7.04 | 6.92 | 8.57 | 3.98 | 4.55 | 5.25 | * | + | | |
| HEMBA1001242 | 9.9 | 9.56 | 8.33 | 13.88 | 6.68 | 13.26 | 5.82 | 6.16 | 5.11 | | | ** | − |
| HEMBA1001247 | 4.46 | 1.61 | 1.9 | 3.57 | 3.49 | 3.72 | 3 | 3.48 | 3.42 | | | | |
| HEMBA1001253 | 5.27 | 3.3 | 2.61 | 4.73 | 4.85 | 2.62 | 2.61 | 2.92 | 2.88 | | | | |
| HEMBA1001257 | 3.88 | 2.26 | 2.32 | 3.08 | 5.15 | 4.69 | 1.41 | 2.58 | 1.9 | | | | |
| HEMBA1001261 | 30.79 | 16.66 | 18.37 | 18.07 | 18.08 | 21.82 | 20.19 | 23.46 | 27.67 | | | | |
| HEMBA1001262 | 2.76 | 4.04 | 1.52 | 6.54 | 5.42 | 3.57 | 2.84 | 3.16 | 4.61 | | | | |
| HEMBA1001265 | 5.3 | 6.7 | 4.27 | 9.23 | 8.19 | 10.09 | 4.34 | 5.27 | 5.82 | * | + | | |
| HEMBA1001266 | 7.76 | 6.62 | 6.38 | 9.89 | 9.6 | 8.87 | 6.28 | 5.38 | 7.65 | ** | + | | |
| HEMBA1001269 | 37.26 | 20.56 | 22.91 | 8.88 | 18.77 | 19.35 | 8.45 | 11.29 | 14.06 | | | * | − |
| HEMBA1001272 | 1.9 | 1.41 | 1.17 | 1.81 | 2.19 | 2.98 | 1.62 | 1.83 | 1.14 | | | | |
| HEMBA1001279 | 7.18 | 4.55 | 5.66 | 6.03 | 6.98 | 6.47 | 3.39 | 5.47 | 3.9 | | | | |
| HEMBA1001281 | 5.42 | 5.55 | 6.33 | 11.93 | 16.02 | 13.78 | 5.82 | 4.84 | 7.89 | ** | + | | |
| HEMBA1001286 | 25.93 | 14.58 | 10.17 | 19.52 | 21.27 | 19.41 | 15.05 | 12.01 | 17.84 | | | | |
| HEMBA1001289 | 4.9 | 3.9 | 2.72 | 4.42 | 4.59 | 5.54 | 4.24 | 2.99 | 5.3 | | | | |
| HEMBA1001291 | 12.14 | 5.79 | 5.07 | 8.25 | 5.62 | 6.51 | 5.37 | 5.12 | 8.98 | | | | |
| HEMBA1001294 | 3.24 | 2.44 | 2.03 | 4.94 | 4.48 | 4.82 | 2.73 | 2.45 | 3.08 | ** | + | | |
| HEMBA1001296 | 3.68 | 1.37 | 1.28 | 2.91 | 2.24 | 3.02 | 2.56 | 2.34 | 2.65 | | | | |
| HEMBA1001297 | 5.4 | 4.74 | 4.72 | 5.79 | 6.42 | 4.8 | 3.21 | 2.6 | 2.27 | | | ** | − |
| HEMBA1001299 | 6.03 | 3.81 | 4.28 | 7.69 | 11.74 | 10.72 | 5.99 | 5.39 | 5.03 | * | + | | |
| HEMBA1001302 | 6.53 | 3.1 | 5.55 | 4.99 | 5.75 | 7.13 | 4.2 | 5.14 | 4.56 | | | | |
| HEMBA1001303 | 3.57 | 2.21 | 0.92 | 2.41 | 4.91 | 3.42 | 1.52 | 2.66 | 2.14 | | | | |
| HEMBA1001306 | 22.18 | 12.36 | 12.24 | 18.89 | 23.21 | 22.17 | 16.22 | 12.41 | 17.9 | | | | |
| HEMBA1001308 | 11.41 | 6.87 | 7.33 | 12.58 | 12.35 | 13.73 | 8.36 | 8.24 | 9.57 | * | + | | |
| HEMBA1001310 | 7.91 | 5.67 | 6.18 | 9.02 | 7.1 | 8.4 | 7.65 | 6.89 | 8.59 | | | | |
| HEMBA1001312 | 6.83 | 4.78 | 4.59 | 4.91 | 5.69 | 6.9 | 6.83 | 6.24 | 6.66 | | | | |
| HEMBA1001319 | 0.37 | 0.17 | 0.45 | 0.79 | 0.92 | 1.12 | 0.66 | 2.44 | 0.75 | ** | + | | |
| HEMBA1001322 | 7.21 | 5.19 | 6.74 | 8.06 | 10.08 | 9.08 | 6.21 | 7.42 | 7.75 | * | + | | |

TABLE 168-continued

| HEMBA1001323 | 4.23 | 3.25 | 2.82 | 10.32 | 10.14 | 7.03 | 8.56 | 8.82 | 9.24 | ** | + | ** | + |
|---|---|---|---|---|---|---|---|---|---|---|---|---|---|
| HEMBA1001326 | 5.74 | 3.25 | 2.25 | 3.17 | 5.59 | 5.42 | 5.13 | 3.49 | 5.64 | | | | |
| HEMBA1001327 | 2.36 | 2.51 | 1.03 | 2 | 2.41 | 3.09 | 2.74 | 2.46 | 3.87 | | | | |
| HEMBA1001330 | 5.82 | 5.46 | 4.35 | 11.86 | 14.54 | 13.29 | 6.08 | 7.36 | 9.3 | ** | + | | |
| HEMBA1001348 | 3.13 | 2.19 | 2.78 | 4.2 | 2.23 | 2.88 | 1.71 | 2.63 | 2.74 | | | | |
| HEMBA1001350 | 12.36 | 10.68 | 7.51 | 15.66 | 13.69 | 14.52 | 11.25 | 9.44 | 10.45 | * | + | | |
| HEMBA1001351 | 8.18 | 6.48 | 5.91 | 13 | 14.47 | 12.39 | 10.67 | 8.35 | 8.14 | ** | + | | |
| HEMBA1001352 | 7.26 | 6.11 | 6.06 | 7.73 | 6.7 | 6.17 | 5.26 | 7.29 | 6.09 | | | | |
| HEMUA1001353 | 31.32 | 6.87 | 27.53 | 25.75 | 22.23 | 20.82 | 12.94 | 17.74 | 19.72 | * | − | ** | − |
| HEMBA1001358 | 34.05 | 17.05 | 14.31 | 20.81 | 35.28 | 26 | 9.32 | 9.14 | 12.44 | | | | |
| HEMBA1001361 | 1.82 | 1.14 | 2.1 | 2.53 | 3.2 | 3.65 | 3 | 2.26 | 2.92 | * | + | * | + |
| HEMBA1001364 | 1.53 | 0.54 | 0.65 | 1.45 | 1.91 | 1.58 | 2.49 | 1.92 | 1.51 | | | | |
| HEMBA1001375 | 3.85 | 2.39 | 2.36 | 2.46 | 4.27 | 4.44 | 3.43 | 3.13 | 3.87 | | | | |
| HEMBA1001377 | 8.53 | 6.83 | 5.73 | 14.04 | 14.14 | 13.21 | 6.15 | 8.25 | 6.71 | ** | + | | |
| HEMBA1001383 | 2.54 | 1.25 | 1.73 | 3.25 | 2.57 | 3.3 | 1.34 | 2.99 | 1.96 | | | | |
| HEMBA1001387 | 4.07 | 1.84 | 3.25 | 5.31 | 4.33 | 4.27 | 3.43 | 4.91 | 3.24 | | | | |
| HEMBA1001388 | 4.68 | 4.67 | 4.87 | 6.78 | 7.58 | 7.44 | 4.52 | 4.77 | 5.63 | ** | + | | |
| HEMBA1001390 | 7.44 | 5.12 | 5.37 | 11.6 | 11.73 | 11.98 | 10.29 | 9.6 | 11.06 | ** | + | ** | + |
| HEMBA1001391 | 1.33 | 1.22 | 1.11 | 3.9 | 2.02 | 2.65 | 2.4 | 1.36 | 1.99 | * | + | | |
| HEMBA1001398 | 5.47 | 2.84 | 3.19 | 6.23 | 6.58 | 7.24 | 3.41 | 4.42 | 5.15 | * | + | | |
| HEMBA1001405 | 5.26 | 1.42 | 2.09 | 2.65 | 2.11 | 2.81 | 3.1 | 2.12 | 3.28 | | | | |
| HEMBA1001406 | 3.16 | 2.03 | 2.11 | 4.74 | 3.74 | 4.54 | 2.55 | 3.04 | 2.7 | * | + | | |

TABLE 169

| HEMBA1001407 | 5.43 | 1.65 | 2.98 | 3.95 | 4.01 | 3.47 | 2.95 | 2.92 | 2.93 | | | | |
|---|---|---|---|---|---|---|---|---|---|---|---|---|---|
| HEMBA1001411 | 2.17 | 0.69 | 0.63 | 2.51 | 1.83 | 3.63 | 1.29 | 1.35 | 1.63 | | | | |
| HEMBA1001413 | 5.49 | 2.49 | 2.2 | 4.28 | 3.2 | 3.97 | 3.24 | 2.49 | 2.68 | | | | |
| HEMBA1001414 | 3.79 | 2.32 | 2.38 | 3.06 | 1.8 | 2.44 | 2.65 | 3.55 | 3.21 | | | | |
| HEMBA1001415 | 6.49 | 2.16 | 2.76 | 5.46 | 6.84 | 6.46 | 4.32 | 4.17 | 5.11 | | | | |
| HEMBA1001416 | 6.22 | 3.74 | 3.23 | 8.62 | 6.54 | 6.82 | 5.91 | 4.3 | 6.02 | | | | |
| HEMBA1001432 | 5.37 | 2.98 | 3.43 | 7.69 | 6.86 | 7.06 | 3.39 | 4.18 | 4.43 | * | + | | |
| HEMBA1001433 | 4.8 | 2.47 | 2.21 | 6.26 | 5.3 | 4.79 | 3.29 | 2.49 | 2.37 | | | | |
| HEMBA1001435 | 8.18 | 4.71 | 5.41 | 14.34 | 11.54 | 13.2 | 6.78 | 6.29 | 7.26 | ** | + | | |
| HEMBA1001442 | 1.65 | 1.46 | 0.73 | 2.67 | 3.31 | 2.57 | 0.77 | 1.88 | 2.03 | * | + | | |
| HEMBA1001446 | 9.08 | 2.53 | 3.23 | 6.88 | 6.71 | 6.42 | 5.95 | 6.22 | 6.04 | | | | |
| HEMBA1001450 | 7.08 | 5.32 | 4.43 | 8.06 | 5.46 | 8.96 | 5.99 | 5.4 | 5.68 | | | | |
| HEMBA1001454 | 10.16 | 4.17 | 5.03 | 16.08 | 14.78 | 15.21 | 9.95 | 9.22 | 10.42 | ** | + | | |
| HEMBA1001455 | 1.25 | 1.28 | 0.63 | 2.33 | 2.23 | 1.74 | 2.53 | 2.34 | 2.01 | * | + | ** | + |
| HEMBA1001459 | 3.35 | 1.42 | 1.26 | 1.85 | 2.02 | 1.94 | 1.14 | 1.39 | 2.31 | | | | |
| HEMBA1001461 | 8.81 | 3.16 | 4.05 | 10.82 | 10.26 | 6.95 | 6 | 5.33 | 4.95 | | | | |
| HEMBA1001462 | 2.66 | 2.42 | 2.15 | 2.1 | 1.78 | 2.07 | 1.34 | 1.53 | 2.31 | | | | |
| HEMBA1001463 | 7.17 | 2.73 | 3.52 | 7.24 | 7.08 | 8.95 | 4.33 | 5.14 | 4.39 | | | | |
| HEMBA1001469 | 7.79 | 8.03 | 2.81 | 8.15 | 8.71 | 7.67 | 5.88 | 4.2 | 6.47 | | | | |
| HEMBA1001473 | 2.06 | 0.9 | 0.31 | 1.64 | 1.59 | 1.3 | 1.54 | 1.11 | 1.32 | | | | |
| HEMBA1001477 | 1.25 | 0.8 | 0.62 | 0.91 | 1.28 | 0.76 | 1.34 | 2.38 | 1.44 | | | | |
| HEMBA1001477 | 2.09 | 0.93 | 1.34 | 1.5 | 1.78 | 0.98 | 1.62 | 2.3 | 1.59 | | | | |
| HEMBA1001480 | 12.07 | 6.47 | 7.53 | 8.82 | 7.12 | 9.89 | 6 | 6.87 | 5.33 | | | | |
| HEMBA1001483 | 4.46 | 3.27 | 2.35 | 2.86 | 3.34 | 4.48 | 1.86 | 2.27 | 1.82 | | | | |
| HEMBA1001490 | 1.81 | 1.4 | 1.03 | 1.82 | 1.46 | 1.52 | 1.48 | 2.37 | 1.32 | | | | |
| HEMBA1001495 | 36.22 | 21.61 | 21.87 | 15.42 | 21.1 | 17.04 | 16.21 | 19.62 | 20.73 | | | | |
| HEMBA1001497 | 7.26 | 3.96 | 4.28 | 11.8 | 9.61 | 9.85 | 5.21 | 4.28 | 5.2 | * | + | | |
| HEMBA1001510 | 13.72 | 5.93 | 6.56 | 13.7 | 15.62 | 12.58 | 10.78 | 9.6 | 9.58 | | | | |
| HEMBA1001515 | 2.6 | 2 | 0.87 | 2.75 | 3.2 | 2.93 | 2.35 | 3.19 | 2.52 | | | | |
| HEMBA1001517 | 1.89 | 1.95 | 1.22 | 2.95 | 2.33 | 2.76 | 1.72 | 1.66 | 2.42 | * | + | | |
| HEMBA1001522 | 3.61 | 1.7 | 1.12 | 1.99 | 2.84 | 1.73 | 1.04 | 1.87 | 1.3 | | | | |
| HEMBA1001526 | 5.16 | 2.43 | 3.68 | 6.63 | 4.1 | 5.88 | 3.55 | 3.16 | 3.42 | | | | |
| HEMBA1001533 | 8.95 | 4.93 | 4.41 | 7.97 | 8.75 | 10.67 | 4.59 | 5.06 | 4.92 | | | | |
| HEMBA1001547 | 35.19 | 25.44 | 22.4 | 15.45 | 14.19 | 13.27 | 6.7 | 4.99 | 4.47 | * | − | ** | − |
| HEMUA1001552 | 8.07 | 6.24 | 3.86 | 9.62 | 10.94 | 7.97 | 8.18 | 5.74 | 5.97 | | | | |
| HEMBA1001553 | 16.17 | 10.48 | 11.7 | 14.97 | 19.64 | 15.26 | 19.38 | 22.7 | 26.62 | | | * | + |
| HEMBA1001557 | 8.77 | 5.74 | 4.35 | 8.02 | 8.99 | 7.7 | 7.33 | 5.59 | 10.39 | | | | |
| HEMBA1001563 | 3.9 | 1.92 | 1.89 | 5.08 | 3.9 | 4.71 | 2.33 | 3.96 | 2.78 | | | | |
| HEMBA1001566 | 3.98 | 2.49 | 2.79 | 5.22 | 9.83 | 5.76 | 3.59 | 4.31 | 4.01 | | | | |
| HEMBA1001569 | 8.8 | 4.36 | 5.19 | 13.14 | 14.49 | 14.76 | 6.66 | 7.84 | 10.58 | ** | + | | |
| HEMBA1001570 | 10.01 | 5.49 | 7.22 | 16.18 | 15.76 | 21.41 | 6.88 | 8.18 | 7.08 | * | + | | |
| HEMBA1001579 | 14.95 | 9.44 | 8.88 | 11.45 | 10.82 | 11.3 | 6.85 | 6.64 | 9.61 | | | | |
| HEMBA1001581 | 6.6 | 2.62 | 2.74 | 9.65 | 8.35 | 7.34 | 4.2 | 4.87 | 7.29 | * | + | | |
| HEMBA1001582 | 1.39 | 1.89 | 0.99 | 1.46 | 1.52 | 1.21 | 1.87 | 1.43 | 1.14 | | | | |
| HEMBA1001585 | 3.5 | 1.76 | 2.06 | 4.04 | 4.61 | 4.34 | 2.06 | 2.32 | 2.78 | * | + | | |
| HEMBA1001589 | 5.07 | 3.16 | 2.15 | 3.41 | 3.1 | 3.21 | 3.05 | 2.93 | 3.94 | | | | |
| HEMBA1001595 | 13.49 | 4.3 | 6.8 | 10.71 | 10.28 | 9.89 | 6.83 | 8.2 | 8.67 | | | | |
| HEMBA1001604 | 5.72 | 2.28 | 3.75 | 6.52 | 7.03 | 5.34 | 2.89 | 3.22 | 3.58 | | | | |
| HEMBA1001608 | 8.03 | 3.96 | 3.18 | 8.15 | 6.4 | 9.15 | 2.3 | 4.25 | 3.65 | | | | |
| HEMBA1001615 | 46.6 | 32.92 | 22.49 | 33.05 | 34.32 | 33.44 | 126.5 | 104.9 | 149.7 | | | ** | + |
| HEMBA1001620 | 14.48 | 8.32 | 7.64 | 17.62 | 16.71 | 15.28 | 9.29 | 10.91 | 11.09 | * | + | | |

TABLE 169-continued

| | | | | | | | | | | | | |
|---|---|---|---|---|---|---|---|---|---|---|---|---|
| HEMBA1001621 | 9.93 | 5.63 | 3.68 | 7.55 | 6.93 | 6.59 | 5 | 4.37 | 6.21 | | | |
| HEMBA1001635 | 5.73 | 3.82 | 2.42 | 4.14 | 4.05 | 5.67 | 2.93 | 3.94 | 3.69 | | | |
| HEMBA1001636 | 4.39 | 1.44 | 3.08 | 3.97 | 3.02 | 3.88 | 3.71 | 3.49 | 4.55 | | | |
| HEMBA1001640 | 3.49 | 0.97 | 1.46 | 3.57 | 2.02 | 3.07 | 2.4 | 3.06 | 2.05 | | | |
| HEMBA1001647 | 6.4 | 2.49 | 4.47 | 3.2 | 5.99 | 5.63 | 2.28 | 4.03 | 4.16 | | | |

TABLE 170

| | | | | | | | | | | | | |
|---|---|---|---|---|---|---|---|---|---|---|---|---|
| HEMBA1001651 | 21.79 | 9.98 | 12.75 | 16.31 | 17.89 | 15.92 | 12.62 | 14.58 | 15.88 | | | |
| HEMBA1001655 | 4.81 | 3.57 | 3.37 | 4.17 | 7.59 | 5.82 | 3.99 | 4.47 | 4.7 | | | |
| HEMBA1001658 | 2.18 | 2.11 | 2.13 | 1.33 | 1.53 | 2.6 | 1.84 | 1.15 | 1.86 | | | |
| HEMBA1001661 | 8.45 | 3.05 | 2.97 | 4.66 | 4.8 | 5.77 | 3.88 | 4.28 | 4.23 | | | |
| HEMBA1001665 | 5.86 | 2.62 | 4.27 | 4.6 | 3.94 | 3.51 | 4.69 | 4.17 | 4.52 | | | |
| HEMBA1001670 | 4.7 | 2.98 | 3.53 | 6.5 | 7.04 | 7.21 | 4.56 | 5.94 | 4.89 | ** | + | |
| HEMBA1001672 | 2.9 | 1.62 | 1.17 | 2.74 | 2.64 | 2.91 | 2.23 | 3.35 | 2.84 | | | |
| HEMBA1001673 | 9.39 | 3.95 | 5.37 | 12.29 | 9.95 | 9.16 | 6.04 | 3.4 | 6.06 | | | |
| HEMBA1001675 | 2.77 | 1.09 | 1.9 | 3.14 | 3.42 | 1.99 | 2.07 | 3.04 | 2.09 | | | |
| HEMBA1001676 | 66.2 | 42 | 41.28 | 59.83 | 62.25 | 61.28 | 35.33 | 41.76 | 48.98 | | | |
| HEMBA1001678 | 23.82 | 16.82 | 12.46 | 26.08 | 27.44 | 24.59 | 15.29 | 14.2 | 16.03 | | | |
| HEMBA1001680 | 7.07 | 3.71 | 3.69 | 6.51 | 7.15 | 6.71 | 4.41 | 4.86 | 5.34 | | | |
| HEMBA1001681 | 1.95 | 0.92 | 1.52 | 1.86 | 1.78 | 2.38 | 1.26 | 2.56 | 1.49 | | | |
| HEMBA1001684 | 10.32 | 4.07 | 5.37 | 13.29 | 14.64 | 14.01 | 8.6 | 7.77 | 8.12 | * | + | |
| HEMBA1001695 | 1.84 | 2.2 | 0.62 | 1.62 | 1.54 | 2.31 | 1.72 | 2.13 | 0.77 | | | |
| HEMBA1001702 | 3.21 | 1.66 | 2.35 | 4.83 | 3.35 | 4.17 | 3.17 | 4.1 | 3.6 | | | |
| HEMBA1001709 | 3.9 | 1.96 | 2.65 | 5.53 | 4.06 | 6.56 | 5.94 | 7.83 | 7.54 | | ** | + |
| HEMBA1001711 | 2.38 | 2.81 | 1.61 | 5.64 | 7.85 | 8.65 | 3.33 | 2.8 | 5.34 | ** | + | |
| HEMBAL001712 | 2.87 | 1.69 | 2.03 | 2.84 | 2.47 | 3.33 | 3.23 | 2.26 | 2.84 | | | |
| HEMBA1001714 | 27.51 | 15.33 | 17.22 | 17.64 | 16.58 | 15.17 | 22.02 | 17.65 | 27.85 | | | |
| HEMBA1001717 | 1.6 | 0.57 | 0.95 | 1.72 | 1.13 | 1.76 | 8.51 | 5.96 | 6.55 | | ** | + |
| HEMBA1001718 | 3.34 | 3.04 | 3.56 | 7.23 | 5.88 | 7.76 | 3.79 | 4.78 | 3.44 | ** | + | |
| HEMBA1001723 | 3.28 | 1.43 | 2.31 | 5.16 | 4.28 | 5.3 | 2.9 | 4.31 | 2.84 | * | + | |
| HEMBA1001731 | 2.16 | 1.22 | 2.13 | 2.79 | 1.84 | 2.37 | 1.77 | 2.95 | 2.23 | | | |
| HEMBA1001734 | 2.33 | 0.57 | 2.06 | 3.71 | 2.97 | 2.91 | 2.16 | 2.87 | 2.2 | | | |
| HEMBA1001736 | 8.5 | 4.87 | 4.76 | 7.17 | 7.6 | 9.06 | 7.56 | 6.14 | 10.7 | | | |
| HEMBA1001741 | 1.43 | 1.25 | 0.91 | 2.83 | 2.87 | 2.84 | 0.76 | 1.93 | 1.43 | ** | + | |
| HEMBA1001744 | 1.28 | 0.91 | 0.85 | 1.4 | 1.01 | 1.73 | 0.65 | 1.88 | 1.22 | | | |
| HEMBA1001745 | 3.12 | 1.1 | 1.48 | 2.46 | 2.57 | 2.63 | 2.55 | 3.03 | 2.51 | | | |
| HEMBA1001746 | 1.85 | 2.08 | 1.47 | 2.46 | 2.29 | 3.39 | 2.8 | 3.77 | 3.54 | | * | + |
| HEMBA1001761 | 4.88 | 2.73 | 3.04 | 7.7 | 5.44 | 7.35 | 2.96 | 5.66 | 4.32 | * | + | |
| HEMBA1001762 | 1.84 | 0.76 | 1.19 | 2.52 | 2.18 | 2.84 | 1.18 | 3.82 | 1 | * | + | |
| HEMBA1001781 | 3.69 | 1.25 | 2.05 | 4.27 | 2.77 | 4.83 | 2.36 | 3.3 | 2.22 | | | |
| HEMBA1001784 | 5.2 | 3.84 | 2.76 | 3.59 | 2.92 | 3.32 | 3.06 | 2.91 | 4.28 | | | |
| HEMBA1001791 | 11.2 | 5.23 | 3.55 | 8.42 | 10 | 8.96 | 7.67 | 7.29 | 10.19 | | | |
| HEMBA1001794 | 16.08 | 14.18 | 10.1 | 17.79 | 20.03 | 18.56 | 11.08 | 17.68 | 19.33 | * | + | |
| HEMBA1001800 | 3.13 | 2.01 | 2.42 | 2.99 | 2.87 | 3.62 | 3.26 | 1.68 | 2.16 | | | |
| HEMBA1001803 | 1.53 | 0.75 | 0.44 | 1.21 | 1.11 | 1.38 | 1.41 | 1.74 | 1.3 | | | |
| HEMBA1001804 | 13.32 | 7.17 | 6.9 | 11.34 | 8.08 | 9.13 | 6.64 | 6.79 | 7.2 | | | |
| HEMBA1001808 | 2.99 | 2.64 | 1.45 | 3.65 | 1.42 | 1.93 | 2.32 | 1.6 | 1.79 | | | |
| HEMBA1001809 | 8.19 | 6.19 | 4.29 | 9.5 | 5.47 | 7.96 | 5.87 | 6.3 | 5.81 | | | |
| HEMBA1001811 | 22.78 | 13.64 | 9.05 | 9.98 | 11.16 | 7.43 | 11.09 | 9.04 | 12.53 | | | |
| HEMBA1G01815 | 6.31 | 3.66 | 3.82 | 9.75 | 9.09 | 7.86 | 4.84 | 3.89 | 4.99 | * | + | |
| HEMBA1001816 | 2.42 | 2.34 | 2.86 | 3.29 | 2.61 | 3.73 | 2.83 | 1.8 | 2.99 | | | |
| HEMBA1001819 | 6.29 | 5.74 | 3.76 | 9.76 | 8.91 | 7.84 | 4.59 | 4.2 | 3.42 | * | + | |
| HEMBA1001820 | 0.7 | 1.31 | 0.35 | 1.28 | 0.85 | 0.69 | 1 | 1.34 | 0.88 | | | |
| HEMBA1001822 | 14.41 | 5.14 | 6.88 | 15.51 | 2.29 | 15.38 | 7.82 | 5.44 | 7.89 | | | |
| HEMBA1001824 | 8.95 | 4.75 | 6.46 | 8.72 | 13.86 | 15.64 | 6.51 | 9.15 | 7.54 | | | |
| HEMBA1001835 | 1.68 | 1.35 | 0.6 | 1.34 | 1.74 | 3.48 | 1.4 | 1.22 | 1.48 | | | |
| HEMBA1001844 | 7.57 | 4.41 | 3.42 | 10.11 | 10.97 | 6.9 | 6.82 | 4.22 | 6.02 | | | |
| HEMBA1001847 | 7.9 | 4.44 | 3.77 | 6.2 | 5.53 | 6.41 | 3.82 | 3.06 | 3.92 | | | |
| HEMBA1001849 | 8.79 | 2.94 | 4.27 | 12.39 | 11.89 | 10.26 | 7.27 | 5.07 | 7.41 | * | + | |
| HEMBA1001850 | 7.06 | 2.55 | 2.83 | 6.48 | 6.52 | 7.6 | 4.57 | 4.3 | 4.89 | | | |
| HEMBA1001861 | 1.79 | 0.52 | 1.23 | 3.32 | 3.68 | 4.21 | 1.6 | 1.37 | 1.83 | ** | + | |
| HEMBA1001862 | 20.07 | 14.3 | 16.51 | 10.49 | 11.03 | 16.7 | 24.43 | 27.68 | 20.89 | | * | + |
| HEMBA1001864 | 1.89 | 1.29 | 0.85 | 2.99 | 3 | 2.74 | 1.08 | 1.87 | 1.04 | ** | + | |

TABLE 171

| | | | | | | | | | | | | |
|---|---|---|---|---|---|---|---|---|---|---|---|---|
| HEMBA1001866 | 3.9 | 2.3 | 1.44 | 4.16 | 4.87 | 4.12 | 3.87 | 2.04 | 2.67 | | | |
| HEMBA1001869 | 9.74 | 8.73 | 4.94 | 27.07 | 27.58 | 25.58 | 12.15 | 11.95 | 13.97 | * | + | * | + |
| HEMBA1001871 | 74.25 | 58.85 | 43.65 | 34.31 | 39.06 | 32.3 | 22.21 | 20.99 | 22.52 | | | * | − |
| HEMBA1001876 | 3.15 | 3.01 | 2.05 | 6.71 | 7.01 | 5.67 | 24.3 | 20.84 | 22.31 | ** | + | ** | + |
| HEMBA1001878 | 8.91 | 7.59 | 5.14 | 7.69 | 6.34 | 6.19 | 2.57 | 4.4 | 3.62 | | | |
| HEMBA1001879 | 6.77 | 3.64 | 3.77 | 7.79 | 7.79 | 8.38 | 5.4 | 7.09 | 7.12 | * | + | |
| HEMBA1001884 | 8.03 | 4.66 | 4.9 | 8.15 | 7.93 | 9.25 | 2.34 | 3.47 | 2.61 | | | |

TABLE 171-continued

| | | | | | | | | | | | | |
|---|---|---|---|---|---|---|---|---|---|---|---|---|
| HEMBA1001886 | 15.37 | 8.23 | 7.45 | 18.06 | 17.92 | 20.6 | 6.22 | 8.67 | 8.91 | * | + | | |
| HEMBA1001888 | 4.74 | 2.28 | 2.28 | 8.53 | 6.01 | 5.71 | 3.99 | 3.23 | 5.19 | * | + | | |
| HEMBA1001890 | 6.82 | 5.35 | 4.39 | 17.01 | 13.21 | 4.58 | 10.35 | 9.13 | 10.28 | ** | + | ** | + |
| HEMBA1001896 | 7.21 | 3.51 | 4.27 | 4.48 | 4.55 | 6.32 | 4.5 | 3.56 | 4.29 | | | | |
| HEMBA1001899 | 10.27 | 5.12 | 6.13 | 12.84 | 16.36 | 13.59 | 19.93 | 20.02 | 20.79 | * | + | ** | + |
| HEMBA1001904 | 117.8 | 90.63 | 69.63 | 121.81 | 45.7 | 135.1 | 54.06 | 69.53 | 68.48 | | | | |
| HEMBA1001910 | 2.98 | 1.61 | 1.31 | 1.77 | 1.8 | 2.33 | 2.01 | 1.92 | 2.16 | | | | |
| HEMBA1001911 | 24.54 | 11.64 | 15.86 | 17.52 | 15.24 | 14.86 | 10.3 | 9.59 | 10.07 | | | | |
| HEMBA1001912 | 20.82 | 8.69 | 15.18 | 15.64 | 15.33 | 18.75 | 6.84 | 9.35 | 7.93 | | | | |
| HEMBA1001913 | 11.57 | 4.6 | 5.78 | 9.2 | 8.02 | 9.12 | 5.36 | 7.66 | 8.31 | | | | |
| HEMBA1001915 | 2.07 | 1.75 | 1.56 | 2.72 | 4.13 | 3.37 | 2.79 | 1.65 | 1.94 | * | + | | |
| HEMBA1001918 | 2.07 | 1.25 | 1.13 | 3.95 | 3.76 | 3.13 | 1.5 | 2.66 | 1.53 | ** | + | | |
| HEMBA1001921 | 7.05 | 7.38 | 3.11 | 5.25 | 3.04 | 7.8 | 3.53 | 3.11 | 2.74 | | | | |
| HEMBA1001931 | 0.78 | 1.98 | 0.41 | 1.78 | 1.48 | 1.79 | 0.69 | 1.82 | 0.96 | | | | |
| HEMBA1001939 | 2.45 | 1.1 | 1.29 | 2.61 | 2.56 | 3.15 | 2.04 | 3.08 | 2.2 | | | | |
| HEMBA1001940 | 3.74 | 2.59 | 1.93 | 4.33 | 6.11 | 5.9 | 2.78 | 3.06 | 3.22 | * | + | | |
| HEMBA1001942 | 3.67 | 2.27 | 1.69 | 2.35 | 3.04 | 3.41 | 1.26 | 2.11 | 2.03 | | | | |
| HEMBA1001944 | 9.44 | 4.28 | 2.7 | 6.72 | 6.77 | 6.95 | 5.78 | 5.16 | 5.81 | | | | |
| HEMBA1001945 | 2.07 | 0.91 | 0.94 | 1.56 | 3.05 | 1.77 | 1.66 | 1.79 | 2.71 | | | | |
| HEMBA1001950 | 4.31 | 3.64 | 2.4 | 3.3 | 1.98 | 4.19 | 2.53 | 3.33 | 2.77 | | | | |
| HEMBA1001951 | 11.47 | 5.14 | 7.18 | 8.76 | 8.49 | 10.31 | 7.11 | 7.14 | 6.62 | | | | |
| HEMBA1001958 | 5.93 | 3.29 | 3.76 | 7.31 | 5.94 | 5.87 | 2.95 | 3.04 | 4.22 | | | | |
| HEMBA1001960 | 5.09 | 2.29 | 3.83 | 2.58 | 2 | 3.56 | 3.69 | 2.82 | 3.05 | | | | |
| HEMBA1001962 | 0.53 | 0.49 | 0.61 | 0.68 | 0.72 | 0.97 | 0.01 | 1.07 | 0.54 | | | | |
| HEMBA1001964 | 1.04 | 0.26 | 1.15 | 2.39 | 2.99 | 2.5 | 0.67 | 1.12 | 1.07 | ** | + | | |
| HEMBA1001967 | 5.08 | 3.46 | 3.83 | 6.72 | 5.35 | 6.55 | 3.95 | 4.57 | 3.93 | * | + | | |
| HEMBA1001979 | 2.59 | 1.65 | 1.24 | 2.97 | 3.02 | 3.75 | 2.54 | 2.41 | 2.4 | * | + | | |
| HEMBA1001987 | 6.47 | 2.58 | 3.01 | 7.96 | 9.29 | 7.63 | 5.55 | 5.23 | 5.01 | * | + | | |
| HEMBA1001991 | 7.79 | 3.05 | 3.16 | 10.3 | 8.9 | 8.81 | 6.21 | 4.84 | 5.65 | * | + | | |
| HEMBA1002003 | 6.67 | 2.83 | 3.92 | 3.54 | 4.68 | 6.3 | 5.41 | 4.34 | 5.17 | | | | |
| HEMBA1002005 | 4.44 | 1.76 | 2.03 | 5.73 | 4.88 | 5.69 | 3.58 | 2.87 | 3.42 | * | + | | |
| HEMBA1002008 | 2.92 | 0.92 | 1.99 | 4.42 | 4.45 | 4.33 | 2.3 | 2.71 | 2.6 | * | + | | |
| HEMBA1002018 | 7.24 | 3.29 | 3.8 | 4.79 | 5.31 | 4.52 | 3.14 | 4.37 | 3.39 | | | | |
| HEMBA1002022 | 0.68 | 0.34 | 0.54 | 1.12 | 1.17 | 1.66 | 0.59 | 0.97 | 1.25 | * | + | | |
| HEMBA1002029 | 147.9 | 114.2 | 64.17 | 209.3 | 183.3 | 187.5 | 83.85 | 70.94 | 83.09 | * | + | | |
| HEMBA1002030 | 3.84 | 2.17 | 1.78 | 2.59 | 2.01 | 2.76 | 1.95 | 2.52 | 1.44 | | | | |
| HEMBA1002035 | 4.53 | 2.83 | 2.27 | 3.74 | 3.23 | 4.73 | 2.32 | 2.93 | 2.77 | | | | |
| HEMBA1002037 | 7.10 | 3.71 | 4.11 | 7.77 | 6.62 | 7.18 | 5.2 | 4.49 | 4.12 | | | | |
| HEMBA1002038 | 5.05 | 3.39 | 2 | 4.89 | 4.12 | 6.29 | 3.56 | 4.65 | 2.86 | | | | |
| HEMBA1002039 | 2.43 | 1.42 | 2.68 | 4.62 | 4.34 | 5.48 | 2.31 | 3.78 | 2.6 | ** | + | | |
| HEMBA1002042 | 5.07 | 5.1 | 4.66 | 5.37 | 6.66 | 7.8 | 3.75 | 3.26 | 4.84 | | | | |
| HEMBA1002043 | 9.02 | 4.29 | 4.09 | 8.45 | 7.53 | 9.32 | 5.8 | 6.07 | 6.51 | | | | |
| HEMBA1002048 | 3.59 | 2.88 | 2.34 | 3.02 | 3.12 | 3.4 | 3.49 | 2.47 | 3.92 | | | | |
| HEMBA1002049 | 6.44 | 2.94 | 4.68 | 7.87 | 9.3 | 8.66 | 5.4 | 4.91 | 5.09 | * | + | | |
| HEMBA1002053 | 6.69 | 4.81 | 4.26 | 7.69 | 7.89 | 9.03 | 5.94 | 6.61 | 5.76 | * | + | | |
| HEMBA1002055 | 9.71 | 8.18 | 6.93 | 9.3 | 5.31 | 10.84 | 11.8 | 6.23 | 11.57 | | | | |
| HEMBA1002056 | 10.47 | 4.85 | 5.55 | 4.12 | 3.5 | 3.57 | 2.73 | 3.84 | 2.21 | | | | |
| HEMBA1002061 | 2.87 | 2.19 | 2.53 | 7.31 | 4.68 | 4.5 | 2.4 | 3.51 | 2.69 | * | + | | |
| HEMBA1002080 | 60.84 | 42.27 | 48.29 | 35.05 | 22.5 | 22.95 | 22.84 | 15.7 | 24.41 | * | − | ** | − |

TABLE 172

| | | | | | | | | | | | | |
|---|---|---|---|---|---|---|---|---|---|---|---|---|
| HEMBA1002084 | 1.07 | 0.5 | 0.79 | 1.77 | 1.77 | 2.12 | 1.8 | 1.72 | 1.8 | ** | + | ** | + |
| HEMBA1002085 | 15.53 | 10.5 | 9.09 | 3.93 | 5.17 | 5.54 | 4.22 | 4.66 | 4.34 | * | − | * | − |
| HEMBA1002092 | 6.36 | 2.95 | 3.86 | 3.82 | 3.84 | 2.97 | 3.77 | 3.66 | 5.02 | | | | |
| HEMBA1002098 | 2.76 | 1.13 | 1.81 | 2.4 | 2.24 | 2.53 | 2.57 | 2.73 | 1.55 | | | | |
| HEMBA1002100 | 32.5 | 21.44 | 18.67 | 25.5 | 28.16 | 25.35 | 18.35 | 13.17 | 17.71 | | | | |
| HEMBA1002101 | 14.23 | 9.44 | 8.67 | 29.98 | 21.28 | 21.61 | 20.63 | 10.83 | 13.44 | * | + | | |
| HEMBA1002102 | 5.78 | 2.45 | 5.61 | 10.26 | 9.25 | 10.76 | 5.53 | 7.91 | 7.68 | ** | + | | |
| HEMBA1002105 | 3.54 | 2.37 | 3.22 | 6.12 | 5.06 | 5.65 | 3.82 | 6.51 | 5.09 | ** | + | | |
| HEMBA1002107 | 11.45 | 5.11 | 6.25 | 8.68 | 8.52 | 8.38 | 12.57 | 12.66 | 17.5 | | | | |
| HEMBA1002113 | 32.25 | 19.17 | 17.43 | 9.34 | 45.35 | 45.81 | 28.29 | 21.95 | 34.31 | * | + | | |
| HEMBA1002119 | 2.11 | 2.17 | 0.99 | 2.79 | 2.14 | 2.54 | 2.06 | 2.87 | 1.79 | | | | |
| HEMBA1002125 | 5.95 | 2.4 | 2.92 | 5.45 | 9.25 | 7.16 | 7.44 | 6.34 | 6.72 | | | | |
| HEMBA1002131 | 5.93 | 2 | 3.14 | 4.14 | 4.06 | 4.13 | 3.5 | 4.3 | 3.28 | | | | |
| HEMBA1002133 | 6.81 | 5.25 | 2.52 | 6.36 | 5.83 | 7.36 | 4.72 | 7.3 | 4.48 | | | | |
| HEMBA1002139 | 1.09 | 0.26 | 0.36 | 1.2 | 0.84 | 1.33 | 0.99 | 2.43 | 0.56 | | | | |
| HEMBA1002141 | 1.29 | 0.49 | 1.21 | 2.38 | 1.03 | 1.99 | 0.5 | 1.42 | 1.34 | | | | |
| HEMBA1002144 | 5.69 | 3.1 | 2.06 | 7.29 | 6.78 | 8.63 | 2.59 | 3.43 | 5.33 | * | + | | |
| HEMBA1002147 | 21.38 | 10.63 | 10.33 | 16.26 | 8.66 | 14.72 | 7.7 | 9.8 | 14.04 | | | | |
| HEMBA1002150 | 19.09 | 10.95 | 13.29 | 13.45 | 10.91 | 11.19 | 15.49 | 16.53 | 17.44 | | | | |
| HEMBA1002151 | 5.57 | 4.52 | 3.73 | 5.15 | 5.43 | 4.75 | 6.45 | 4.35 | 4.86 | | | | |
| HEMBA1002153 | 2.06 | 0.67 | 0.65 | 2.43 | 2.33 | 1.79 | 1.41 | 1.49 | 1.24 | | | | |
| HEMBA1002156 | 6.64 | 2.07 | 2.79 | 3.49 | 2.76 | 4.92 | 4.24 | 4.29 | 3.26 | | | | |
| HEMBA1002160 | 9.96 | 4.66 | 4.52 | 11.03 | 12.78 | 11.54 | 5.12 | 4.86 | 6.62 | * | + | | |
| HEMBA1002161 | 5.93 | 2.84 | 3.76 | 7.56 | 5.8 | 7.54 | 3.32 | 4.13 | 3.25 | | | | |

TABLE 172-continued

| | | | | | | | | | | | | | |
|---|---|---|---|---|---|---|---|---|---|---|---|---|---|
| HEMBA1002162 | 7.92 | 3.54 | 4.29 | 9.23 | 12.27 | 9.59 | 6.96 | 4.68 | 6.43 | * | + | | |
| HEMBA1002163 | 16.52 | 8.9 | 8.29 | 30.66 | 23.8 | 18.1 | 23.47 | 24.41 | 36.58 | * | + | * | + |
| HEMBA1002164 | 6.58 | 3.37 | 3.2 | 7.61 | 7.12 | 6.96 | 5.68 | 4.84 | 5.16 | | | | |
| HEMBA1002166 | 39.64 | 27.28 | 27.86 | 36.11 | 45.05 | 43.8 | 39.24 | 20.85 | 22.71 | | | | |
| HEMBA1002167 | 4.76 | 1.86 | 1.62 | 2.99 | 2.78 | 2.27 | 3.13 | 3.05 | 2.27 | | | | |
| HEMBA1002173 | 5.99 | 4.25 | 4.52 | 7.86 | 9.55 | 7.59 | 5.43 | 4.55 | 6.47 | * | + | | |
| HEMBA1002177 | 7.43 | 2.78 | 2.92 | 3.23 | 3.61 | 5.94 | 3.11 | 3.88 | 4.09 | | | | |
| HEMBA1002178 | 5.72 | 4.28 | 4.98 | 4.38 | 4.69 | 4.23 | 3.54 | 5.04 | 4.32 | | | | |
| HEMBA1002179 | 38.56 | 31.74 | 22.53 | 17.89 | 19.71 | 18.71 | 27.72 | 23.97 | 26.16 | | | | |
| HEMBA1002185 | 6.54 | 3.16 | 3.12 | 9.32 | 10.15 | 8.6 | 6.14 | 5.78 | 6.76 | * | + | | |
| HEMBA1002188 | 8.98 | 4.74 | 6.39 | 7.79 | 6.15 | 7.58 | 6.43 | 5.81 | 6.6 | | | | |
| HEMBA1002189 | 3.48 | 3.26 | 1.78 | 4.27 | 5.47 | 4.09 | 2.69 | 3.88 | 3.54 | | | | |
| HEMBA1002191 | 8.3 | 3.89 | 4.67 | 8.84 | 6.83 | 6.19 | 5.91 | 5.98 | 6.36 | | | | |
| HEMBA1002192 | 5.28 | 4.26 | 4.29 | 8.27 | 6.01 | 5.9 | 2.94 | 2.49 | 2.82 | | | ** | − |
| HEMBA1002195 | 5.98 | 3.67 | 4.11 | 6.21 | 5.77 | 4.89 | 3.93 | 4.26 | 3.98 | | | | |
| HEMBA1002196 | 1.16 | 1.29 | 1.53 | 2.22 | 2.69 | 3.34 | 2.25 | 2.29 | 2.94 | * | + | ** | + |
| HEMBA1002199 | 2.9 | 1.1 | 2.41 | 4.59 | 4.69 | 3.07 | 3.88 | 2.62 | 3.82 | | | | |
| HEMBA1002204 | 3.61 | 1.66 | 0.98 | 2.22 | 2.66 | 1.99 | 3.47 | 1.11 | 1.87 | | | | |
| HEMBA1002205 | 48.26 | 35.92 | 30.61 | 48.99 | 56.44 | 45.32 | 18.77 | 22.83 | 23.91 | | | * | − |
| HEMBA1002212 | 1.63 | 2.93 | 1.64 | 4.46 | 4.61 | 4.63 | 3.31 | 1.91 | 1.67 | ** | + | | |
| HEMBA1002215 | 6.24 | 3.92 | 3.6 | 5.45 | 4.91 | 5.62 | 4.3 | 4.83 | 3.3 | | | | |
| HEMBA1002217 | 18.63 | 10.54 | 10.96 | 10.92 | 19.47 | 21.75 | 8.18 | 9.72 | 7.73 | | | | |
| HEMBA1002220 | 2.36 | 1.42 | 1.13 | 2.73 | 2.21 | 2.69 | 1.63 | 2.43 | 2.05 | | | | |
| HEMBA1002226 | 7.06 | 3.57 | 4.14 | 9.44 | 8.41 | 9.81 | 3.48 | 7.93 | 5.79 | * | + | | |
| HEMBA1002227 | 23.89 | 11.28 | 12.65 | 63.81 | 64.96 | 61.28 | 43.22 | 41.38 | 46.55 | ** | + | ** | + |
| HEMBA1002229 | 12.93 | 9.6 | 8.96 | 22.59 | 17.4 | 16.24 | 11.18 | 9.43 | 9.71 | * | + | | |
| HEMBA1002237 | 2.73 | 1.56 | 1.22 | 2.88 | 3.54 | 2.57 | 2.65 | 2.19 | 1.5 | | | | |
| HEMBA1002239 | 9.11 | 4.97 | 3.45 | 14.42 | 9.61 | 11 | 4.46 | 5.84 | 6.91 | | | | |
| HEMBA1002241 | 4.16 | 2.92 | 3.35 | 4.29 | 3.16 | 4.98 | 3.45 | 3.5 | 3.33 | | | | |
| HEMBA1002253 | 2 | 1.21 | 0.86 | 1.18 | 1.75 | 2.13 | 1.77 | 1.87 | 1.29 | | | | |
| HEMBA1002257 | 2.5 | 1.06 | 1.11 | 1.47 | 1.72 | 1.38 | 1.46 | 2.73 | 1.02 | | | | |
| HEMRA1002259 | 3.93 | 2.57 | 3.46 | 3.84 | 3.35 | 3.79 | 1.58 | 3.6 | 2.24 | | | | |

TABLE 173

| | | | | | | | | | | | | | |
|---|---|---|---|---|---|---|---|---|---|---|---|---|---|
| HEMBA1002262 | 19.33 | 13.63 | 11.06 | 41.08 | 43.27 | 39.59 | 22.08 | 18 | 19.52 | ** | + | | |
| HEMBA1002265 | 5.77 | 2.24 | 2.87 | 4.81 | 4.22 | 4.54 | 5.24 | 3.12 | 3.12 | | | | |
| HEMBA1002267 | 6.66 | 4.16 | 4.1 | 9.3 | 9.47 | 10.3 | 6.16 | 5.48 | 5.21 | ** | + | | |
| HEMBA1002270 | 6.24 | 3.34 | 3.58 | 7.78 | 8.98 | 7.9 | 3.76 | 4.01 | 4.91 | * | + | | |
| HEMBA1002286 | 2.71 | 2.63 | 1.38 | 2.66 | 4.03 | 3.95 | 2.71 | 3.54 | 3.82 | | | | |
| HEMBA1002290 | 7.29 | 3.76 | 4.66 | 10.41 | 13.32 | 10.04 | 5.97 | 7.37 | 8.02 | * | + | | |
| HEMBA1002302 | 11.09 | 4.74 | 4.9 | 14.47 | 14.16 | 14.79 | 5.34 | 6.14 | 6.47 | * | + | | |
| HEMBA1002304 | 2.15 | 1.99 | 3.2 | 4.13 | 2.57 | 4.4 | 1.76 | 2.42 | 1.31 | | | | |
| HEMBA1002307 | 20.52 | 10.07 | 9.13 | 9.76 | 9.15 | 8.21 | 13.28 | 14.24 | 17.09 | | | | |
| HEMBA1002316 | 21.96 | 17.53 | 15.62 | 14.66 | 14.21 | 3.67 | 14.54 | 18.03 | 17.67 | | | | |
| HEMBA1002319 | 3.87 | 2.44 | 2.95 | 2.86 | 3.71 | 4.51 | 3 | 3.92 | 3.09 | | | | |
| HEMBA1002320 | 2.67 | 1.82 | 1.12 | 4.11 | 5.01 | 6.24 | 3.84 | 4.14 | 3.6 | * | + | * | + |
| HEMBA1002321 | 1.46 | 2.38 | 0.87 | 3.05 | 1.97 | 2.21 | 1.05 | 1.18 | 1.29 | | | | |
| HEMBA1002328 | 4.66 | 1.71 | 1.99 | 5.92 | 5.51 | 4.89 | 3 | 3.99 | 2.69 | | | | |
| HEMBA1002333 | 4.92 | 1.14 | 2.37 | 2.57 | 3.45 | 2.77 | 2.04 | 3.2 | 1.93 | | | | |
| HEMBA1002337 | 5.38 | 3.22 | 4.87 | 9.22 | 12.31 | 1.34 | 4.19 | 5.44 | 4.11 | ** | + | | |
| HEMBA1002339 | 23.81 | 10.43 | 6.17 | 11.11 | 15.11 | 4.91 | 11.67 | 12.27 | 12.43 | | | | |
| HEMBA1002341 | 7.39 | 3.74 | 4.25 | 4.55 | 4.12 | 3.82 | 6.09 | 5.66 | 5.69 | | | | |
| HEMBA1002348 | 2.07 | 1.83 | 0.9 | 1.44 | 1.88 | 2.08 | 1.92 | 2.6 | 1.34 | | | | |
| HEMBA1002349 | 1.51 | 1.42 | 0.34 | 1.38 | 1.3 | 1.96 | 1.46 | 2.19 | 1.38 | | | | |
| HEMBA1002353 | 1.79 | 1.25 | 2.28 | 2.64 | 3.11 | 3.43 | 2.11 | 1.34 | 1.36 | * | + | | |
| HEMBA1002356 | 13.39 | 6.02 | 7.85 | 8.42 | 10.26 | 11 | 4.88 | 6.24 | 6.12 | | | | |
| HEMBA1002357 | 136.4 | 89.6 | 109 | 142.6 | 135.4 | 152.8 | 57.09 | 66.8 | 75.58 | | | * | − |
| HEMBA1002360 | 6.54 | 3.66 | 5.93 | 10.16 | 10.44 | 10.51 | 8.07 | 9.62 | 8.15 | ** | + | * | + |
| HEMBA1002363 | 9.05 | 6.26 | 4.11 | 8.4 | 5.32 | 7.47 | 3.78 | 3.67 | 4.84 | | | | |
| HEMBA1002365 | 2.33 | 1.04 | 1.69 | 2.69 | 1.93 | 1.79 | 0.53 | 1.83 | 2.11 | | | | |
| HEMBA1002370 | 2.04 | 0.84 | 0.68 | 5.63 | 6.49 | 6.21 | 1.4 | 3.02 | 2.46 | ** | + | | |
| HEMBA1002374 | 8.05 | 4.75 | 3.85 | 6.96 | 7.96 | 4.55 | 6.96 | 5.19 | 7.37 | | | | |
| HEMBA1002376 | 22.58 | 10.71 | 1.64 | 20.42 | 22.01 | 21.09 | 9.22 | 9.95 | 12.27 | | | | |
| HEMBA1002377 | 22.23 | 20.26 | 24.74 | 17.13 | 16.56 | 16.97 | 12.65 | 5.84 | 13.5 | * | − | * | − |
| HEMBA1002380 | 10.33 | 4.73 | 6.12 | 25.3 | 20.75 | 23.1 | 10.39 | 11.31 | 10.43 | ** | + | | |
| HEMBA1002381 | 6.11 | 3.6 | 4.83 | 7.07 | 8.7 | 10.4 | 3.87 | 4.54 | 4.53 | * | + | | |
| HEMBA1002384 | 15.5 | 10.84 | 6.42 | 29.27 | 32.78 | 29.1 | 8.58 | 9.53 | 10.47 | ** | + | | |
| HEMBA1002389 | 4.27 | 1.82 | 1.04 | 3.34 | 2.49 | 2.48 | 1.75 | 2.27 | 2.21 | | | | |
| HEMBA1002396 | 5.31 | 1.45 | 2.21 | 3.61 | 3.86 | 4.27 | 4.37 | 4.75 | 6.22 | | | | |
| HEMBA1002402 | 4.83 | 1.75 | 1.81 | 2.54 | 2.69 | 3.67 | 3.46 | 2.38 | 3.41 | | | | |
| HEMBA1002417 | 10.95 | 4.91 | 5.09 | 7.22 | 6.91 | 7.47 | 6.16 | 5.78 | 7.28 | | | | |
| HEMBA1002419 | 5.08 | 2.09 | 1.3 | 5.6 | 4.81 | 5.12 | 3.66 | 3.43 | 3.31 | | | | |
| HEMBA1002420 | 9.17 | 4.99 | 7.48 | 15.98 | 15.18 | 16.1 | 7.55 | 7.5 | 9.4 | ** | + | | |
| HEMBA1002421 | 3.35 | 2.15 | 2.59 | 6.22 | 6.03 | 5.26 | 6.83 | 6.92 | 8.74 | ** | + | ** | + |
| HEMBA1002423 | 1.54 | 0.63 | 0.83 | 2.44 | 3.48 | 3.88 | 1.7 | 2.52 | 2.63 | * | + | * | + |

TABLE 173-continued

| | | | | | | | | | | | | |
|---|---|---|---|---|---|---|---|---|---|---|---|---|
| HEMBA1002424 | 8.4 | 2.37 | 3.82 | 4.43 | 5.04 | 5.22 | 3.68 | 2.96 | 3.47 | | | |
| HEMBA1002426 | 6.49 | 3.96 | 3.42 | 4.7 | 3.88 | 6.41 | 6.1 | 4.1 | 4.43 | | | |
| HEMBA1002430 | 2.26 | 0.52 | 0.37 | 1.48 | 0.95 | 2.01 | 1.47 | 2.19 | 1.34 | | | |
| HEMBA1002439 | 5.88 | 2.46 | 3.67 | 5.4 | 4.16 | 4.53 | 3.95 | 4.58 | 3.74 | | | |
| HEMBA1002441 | 9.17 | 5.14 | 6.07 | 34.35 | 24.41 | 25.82 | 3.81 | 16.3 | 21.56 | ** | + | ** | + |
| HEMBA1002454 | 5.79 | 2.67 | 3.42 | 5.87 | 3.7 | 3.81 | 3.97 | 3.14 | 3.78 | | | |
| HEMBA1002458 | 25.18 | 17.65 | 26.81 | 56.49 | 54.86 | 61.69 | 25.04 | 31.59 | 38.07 | ** | + | |
| HEMBA1002460 | 13.9 | 7.3 | 5.63 | 4.27 | 4.5 | 4.21 | 3.8 | 3.84 | 3.88 | | | |
| HEMBA1002462 | 5.97 | 3.49 | 2.63 | 4.68 | 5.48 | 5.1 | 5.76 | 6.26 | 5.62 | | | |
| HEMBA1002465 | 1.48 | 0.35 | 0.87 | 1.94 | 1.91 | 2 | 2 | 1.62 | 1.54 | * | + | |
| HEMBA1002469 | 10.61 | 5.54 | 6.1 | 9.43 | 9.29 | 9.35 | 6.49 | 6.37 | 7.65 | | | |
| HEMBA1002475 | 2.44 | 1.25 | 1.2 | 2.62 | 1.19 | 1.93 | 1.75 | 2.35 | 1.4 | | | |
| HEMBA1002477 | 4.33 | 2.21 | 3.54 | 6.33 | 6.45 | 9.03 | 4.12 | 5.33 | 4.08 | * | + | |
| HEMBA1002480 | 12.76 | 7.21 | 8.41 | 3.9 | 9.22 | 9.97 | 6.6 | 9.31 | 9.9 | | | |
| HEMBA1002481 | 4.17 | 1.44 | 3.57 | 5.7 | 5.97 | 7.71 | 3.35 | 4.98 | 3.12 | * | + | |

TABLE 174

| | | | | | | | | | | | | |
|---|---|---|---|---|---|---|---|---|---|---|---|---|
| HEMBA1002486 | 8.76 | 6.38 | 4.66 | 8.52 | 8.8 | 10.2 | 5.18 | 4.82 | 7 | | | |
| HEMBA1002490 | 4.65 | 2.87 | 1.43 | 3.68 | 2.57 | 3.08 | 3.01 | 1.75 | 3.98 | | | |
| HEMBA1002495 | 3.72 | 2.75 | 1.63 | 4.11 | 3.81 | 4.48 | 2.24 | 3.36 | 3.9 | | | |
| HEMBA1002498 | 2.75 | 1.45 | 1.13 | 1.68 | 1.82 | 1.19 | 2.23 | 1.05 | 1.96 | | | |
| HEMBA1002501 | 4.03 | 2.44 | 2.73 | 2.79 | 3.44 | 4.73 | 2.7 | 2.56 | 4.15 | | | |
| HEMBA1002503 | 5.04 | 2.61 | 2.84 | 6.45 | 4.88 | 5.28 | 3.23 | 3.79 | 3.13 | | | |
| HEMBA1002504 | 8.07 | 4.4 | 4.13 | 10.71 | 10.32 | 10.08 | 4.47 | 6.58 | 5.92 | * | + | |
| HEMBA1002508 | 5.99 | 4.98 | 4.38 | 8.82 | 14.4 | 16.34 | 4.8 | 6.77 | 5.33 | * | + | |
| HEMBA1002513 | 8.6 | 4.28 | 4.52 | 7.08 | 4.68 | 6.71 | 4.93 | 3.86 | 4.51 | | | |
| HEMBA1002515 | 4.33 | 1.73 | 2.07 | 3.29 | 2.16 | 3.66 | 2.65 | 1.63 | 3.58 | | | |
| HEMBA1002524 | 9.35 | 6 | 4.75 | 8.16 | 6.47 | 7.51 | 5.77 | 5.05 | 6.67 | | | |
| HEMBA1002538 | 4.58 | 2.05 | 1.84 | 2.98 | 3.05 | 4.53 | 2.16 | 2.92 | 2.68 | | | |
| HEMBA1002542 | 8.07 | 5.4 | 5.41 | 9.41 | 8.04 | 9.27 | 4.65 | 5.75 | 5.16 | | | |
| HEMBA1002544 | 3.1 | 1.76 | 1.69 | 4.47 | 3.6 | 3.68 | 2.18 | 2.17 | 2.61 | * | + | |
| HEMBA1002546 | 50.52 | 34.29 | 29.94 | 56.51 | 60.33 | 61.14 | 35.34 | 44.64 | 38.68 | * | + | |
| HEMBA1002547 | 2.2 | 1.72 | 2.07 | 1.6 | 3.25 | 2.8 | 2.97 | 4.34 | 2.32 | | | |
| HEMBA1002550 | 7.14 | 5.4 | 3.96 | 4.54 | 4.38 | 4.87 | 6.51 | 4.38 | 5.24 | | | |
| HEMBA1002551 | 5.47 | 2.09 | 2.27 | 5.04 | 4.39 | 3.41 | 4.06 | 3.2 | 3.87 | | | |
| HEMBA1002552 | 12.19 | 3.86 | 6.34 | 10.16 | 9.24 | 10.66 | 6.5 | 6.73 | 6.78 | | | |
| HEMBA1002555 | 1.98 | 0.86 | 1 | 1.95 | 2.49 | 2.76 | 2.25 | 1.97 | 2.82 | | | |
| HEMBA1002558 | 7.34 | 3.99 | 4.45 | 10.47 | 9.14 | 11.18 | 5.75 | 4.9 | 5.48 | * | + | |
| HEMBA1002561 | 1.53 | 2.23 | 1.45 | 3.76 | 4.16 | 3.85 | 2.34 | 2.9 | 2.42 | ** | + | |
| HEMBA1002562 | 2.58 | 1.09 | 1.24 | 1.55 | 1.58 | 1.46 | 1.13 | 1.38 | 1.77 | | | |
| HEMBA1002568 | 4.34 | 2.05 | 1.84 | 2.65 | 3.18 | 3.63 | 2.01 | 3.91 | 2.77 | | | |
| HEMBA1002569 | 10.12 | 2.96 | 3.15 | 6.04 | 6.91 | 7.8 | 6.66 | 5.49 | 5.73 | | | |
| HEMBA1002570 | 17.18 | 8.39 | 8.43 | 7.74 | 7.84 | 6.32 | 4.15 | 4.68 | 4.47 | | | |
| HEMBA1002581 | 9.13 | 5.2 | 4.08 | 4.71 | 4.69 | 3.46 | 4.61 | 4.34 | 4.04 | | | |
| HEMBA1002583 | 2.63 | 1.94 | 1.44 | 4.35 | 4.76 | 4.81 | 4.07 | 4.23 | 4.71 | ** | + | ** | + |
| HEMBA1002587 | 9.65 | 5.73 | 4.29 | 5.38 | 5.09 | 6.69 | 6.95 | 4.55 | 5.87 | | | |
| HEMBA1002590 | 5 | 2.82 | 3.17 | 5.3 | 7.12 | 7.9 | 3.16 | 4.25 | 3.45 | * | + | |
| HEMBA1002592 | 7.22 | 3.8 | 5.73 | 9.2 | 7.27 | 11.07 | 4.7 | 6.52 | 5.38 | | | |
| HEMBA1002595 | 6.26 | 2.72 | 4.83 | 2.78 | 4.06 | 4.2 | 3.48 | 5.01 | 4.73 | | | |
| HEMBA1002609 | 4.35 | 4.09 | 2.17 | 4.02 | 4.01 | 4.31 | 3.53 | 3.64 | 3.18 | | | |
| HEMBA1002617 | 3.95 | 2.7 | 1.65 | 11.81 | 11.46 | 11.36 | 4.49 | 2.86 | 3.96 | ** | + | |
| HEMBA1002619 | 6.56 | 3.72 | 3.15 | 6.01 | 4.48 | 4.66 | 4.55 | 5.76 | 4.4 | | | |
| HEMBA1002621 | 1.33 | 2.05 | 0.58 | 1.87 | 2.25 | 1.68 | 2.5 | 2.13 | 1.22 | | | |
| HEMBA1002624 | 10.87 | 5.76 | 5.5 | 10.8 | 7.15 | 9.93 | 6.61 | 9.08 | 8.33 | | | |
| HEMBA1002628 | 2.46 | 1.89 | 1.56 | 8.26 | 8.9 | 8.55 | 6.5 | 6.76 | 7.64 | ** | + | ** | + |
| HEMBA1002629 | 2.92 | 1.59 | 1.72 | 2.35 | 1.78 | 3.13 | 2.15 | 2.22 | 2.55 | | | |
| HEMBA1002632 | 3.01 | 3.25 | 2.45 | 3.55 | 4.56 | 5.56 | 2.28 | 3.32 | 2.22 | | | |
| HEMBA1002645 | 5.23 | 3.12 | 3.3 | 9.71 | 9.85 | 8.47 | 4.08 | 4.56 | 3.84 | ** | + | |
| HEMBA1002651 | 2.74 | 3.3 | 3.7 | 3.63 | 3.14 | 3.96 | 3.35 | 3.43 | 3.18 | | | |
| HEMBA1002652 | 10.09 | 4.55 | 2.8 | 3.94 | 7.21 | 6.45 | 4.43 | 4.54 | 4.59 | | | |
| HEMBA1002659 | 10 | 4.51 | 4.33 | 9.97 | 11.66 | 8.87 | 6.05 | 6.33 | 5.41 | | | |
| HEMBA1002661 | 4.42 | 2.54 | 1.79 | 6.87 | 7.34 | 8.27 | 4.97 | 3.82 | 3.85 | ** | + | |
| HEMBA1002666 | 3.37 | 1.93 | 1.85 | 2.66 | 2.68 | 3.23 | 2.59 | 2.71 | 2.16 | | | |
| HEMBA1002667 | 3.38 | 2.19 | 2.12 | 5.95 | 5.18 | 5.02 | 0.91 | 3 | 2.2 | ** | + | |
| HEMBA1002673 | 24.31 | 16.62 | 13.86 | 16.81 | 24.76 | 24.88 | 10.84 | 15.49 | 10.36 | | | |
| HEMBA1002678 | 6.22 | 4.52 | 2.39 | 8.83 | 7 | 9.06 | 5.27 | 5.81 | 5.58 | * | + | |
| HEMBA1002679 | 6.14 | 2.98 | 2.3 | 7.06 | 5.91 | 5.92 | 4.9 | 4.03 | 4.55 | | | |
| HEMBA1002688 | 2.43 | 1.85 | 1.49 | 1.28 | 2.14 | 1.93 | 0.91 | 1.94 | 1.12 | | | |
| HEMBA1002696 | 5.94 | 3.2 | 2.68 | 4.46 | 5.16 | 4.1 | 3.48 | 3.38 | 3.28 | | | |
| HEMBA1002703 | 14.6 | 8 | 9.65 | 11.88 | 14.48 | 12.25 | 7.74 | 9.23 | 10.55 | | | |
| HEMBA1002706 | 14.74 | 6.11 | 9.63 | 11.39 | 13.51 | 13.79 | 6.16 | 6.12 | 6.47 | | | |
| HEMBA1002712 | 5.57 | 3.22 | 3.91 | 7.46 | 9.02 | 7.13 | 2.62 | 3.73 | 3.7 | * | + | |
| HEMBA1002715 | 7.56 | 4.05 | 6.71 | 7.13 | 9.71 | 10.17 | 4.38 | 6.93 | 5.48 | | | |

TABLE 175

| | | | | | | | | | | | | | |
|---|---|---|---|---|---|---|---|---|---|---|---|---|---|
| HEMBA1002716 | 2.33 | 1.79 | 1.1 | 2.97 | 1.95 | 2.33 | 1.67 | 1.27 | 1.06 | | | | |
| HEMBA1002718 | 16.72 | 11.81 | 9.31 | 17.97 | 12.98 | 15.17 | 10.44 | 10.19 | 11.13 | | | | |
| HEMBA1002728 | 9.67 | 3.54 | 5.97 | 10.61 | 2.96 | 15.33 | 7.76 | 5.08 | 9.8 | * | + | | |
| HEMBA1002730 | 7.86 | 2.52 | 3.4 | 5.36 | 7.91 | 6.74 | 6.78 | 4.96 | 7.37 | | | | |
| HEMBA1002734 | 7.73 | 4.31 | 3.55 | 7.93 | 6.46 | 7.46 | 5.62 | 6.29 | 6.83 | | | | |
| HEMBA1002742 | 3.65 | 1.6 | 2.01 | 2.64 | 2.74 | 2.6 | 1.48 | 2.29 | 1.92 | | | | |
| HEMBA1002746 | 6.82 | 4.06 | 4.19 | 4.98 | 4.66 | 5.4 | 2.78 | 4.2 | 3.33 | | | | |
| HEMBA1002748 | 4.16 | 2.16 | 3.32 | 2.53 | 4.45 | 4.03 | 2.42 | 2.8 | 3.88 | | | | |
| HEMBA1002750 | 6.45 | 3.44 | 3.09 | 5.38 | 6.22 | 7.28 | 3.44 | 2.24 | 3.97 | | | | |
| HEMBA1002755 | 6.83 | 3.3 | 3.88 | 9.75 | 9.18 | 10.07 | 4.45 | 5.29 | 5.42 | * | + | | |
| HEMBA1002759 | 2.47 | 0.92 | 1.55 | 4.32 | 3.79 | 4.12 | 2.56 | 2.66 | 2.65 | ** | + | | |
| HEMBA1002763 | 17.79 | 8.69 | 9.49 | 11.93 | 10.68 | 12.89 | 9.46 | 10.98 | 11.31 | | | | |
| HEMBA1002767 | 4.86 | 3.64 | 4.15 | 4.69 | 4.37 | 5.27 | 4.84 | 4.88 | 6.63 | | | | |
| HEMBA1002768 | 7.65 | 3.89 | 4.38 | 7.6 | 7.36 | 7.85 | 6.31 | 6.75 | 7.16 | | | | |
| HEMBA1002769 | 6.55 | 2.6 | 4.29 | 4.3 | 5.76 | 5.49 | 4.08 | 5.08 | 4.57 | | | | |
| HEMBA1002770 | 10.29 | 6.74 | 8.19 | 11.22 | 11.06 | 13.4 | 7.03 | 6.36 | 8.42 | | | | |
| HEMBA1002777 | 9.75 | 4.7 | 5.71 | 8.59 | 8.79 | 9.46 | 6.38 | 4.3 | 7.48 | | | | |
| HEMBA1002779 | 19.22 | 10.66 | 6.22 | 15.16 | 13.63 | 10.21 | 10.37 | 10.01 | 10.31 | | | | |
| HEMBA1002780 | 5.7 | 2.86 | 3 | 6.99 | 7.8 | 9.55 | 4.79 | 4.73 | 6.4 | * | + | | |
| HEMBA1002790 | 4.99 | 2.33 | 3.07 | 6.37 | 8.93 | 7.96 | 4.08 | 3.78 | 4.9 | * | + | | |
| HEMBA1002794 | 8.37 | 5.67 | 4.58 | 5.78 | 6.13 | 8.44 | 6.79 | 6.5 | 6.15 | | | | |
| HEMBA1002798 | 1.26 | 0.86 | 1.65 | 2.72 | 2.3 | 1.86 | 0.87 | 2.64 | 0.77 | * | + | | |
| HEMBA1002801 | 1.99 | 0.93 | 1.36 | 4.21 | 3.6 | 1.85 | 2.71 | 2.29 | 3.22 | | | * | + |
| HEMBA1002810 | 9.65 | 4.37 | 5.68 | 13.26 | 12.11 | 9.75 | 5.27 | 6.41 | 6.28 | | | | |
| HEMBA1002816 | 9.84 | 4.52 | 4.72 | 9.31 | 6.58 | 9.2 | 5.89 | 5.54 | 5.86 | | | | |
| HEMBA1002818 | 13.95 | 7.65 | 7.85 | 12.57 | 11.48 | 11.5 | 11.94 | 8.46 | 10.87 | | | | |
| HEMBA1002820 | 8.63 | 4.01 | 5.81 | 2.08 | 16.06 | 13.75 | 7.38 | 6.93 | 7.73 | * | + | | |
| HEMBA1002826 | 2.06 | 0.77 | 0.96 | 1 | 0.94 | 1.69 | 1.3 | 2.13 | 0.88 | | | | |
| HEMBA1002833 | 9.88 | 4.57 | 5.73 | 7.08 | 7.89 | 7.35 | 7.95 | 8.57 | 7.16 | | | | |
| HEMBA1002850 | 0.76 | 0.3 | 1.24 | 1.8 | 1.57 | 1.81 | 0.67 | 2.12 | 1.24 | * | + | | |
| HEMBA1002862 | 2.92 | 2.24 | 3.55 | 9.63 | 8.86 | 7.72 | 5.29 | 8.86 | 7.89 | ** | + | * | + |
| HEMBA1002863 | 3.16 | 2.79 | 5.23 | 4.86 | 5.55 | 5.31 | 3.6 | 5.86 | 5.95 | | | | |
| HEMBA1002867 | 3.74 | 1.09 | 1.41 | 1.95 | 2.42 | 2.24 | 1.51 | 1.85 | 1.96 | | | | |
| HEMBA1002876 | 10.81 | 3.46 | 4.85 | 5.22 | 5.51 | 6.47 | 5.11 | 4.45 | 5.37 | | | | |
| HEMBA1002886 | 1.73 | 1.14 | 1.2 | 1.8 | 3.11 | 2.84 | 1.24 | 1.52 | 0.93 | * | + | | |
| HEMBA1002896 | 5.56 | 2.89 | 2.26 | 4.16 | 5.6 | 6.36 | 4.43 | 4.26 | 5.28 | | | | |
| HEMBA1002913 | 6.83 | 3.41 | 4.1 | 6.13 | 4.56 | 5.54 | 4.4 | 4.46 | 4.22 | | | | |
| HEMBA1002921 | 5.09 | 1.35 | 3.42 | 4.01 | 3.76 | 3.47 | 2.82 | 3.68 | 1.76 | | | | |
| HEMBA1002924 | 3.44 | 1.46 | 2.03 | 3.99 | 2.79 | 5.07 | 4.7 | 2.86 | 2.66 | | | | |
| HEMBA1002934 | 19.41 | 10.56 | 13.01 | 28.28 | 26.9 | 31.77 | 13.81 | 10.62 | 17.37 | ** | + | | |
| HEMBA1002935 | 5.64 | 2.51 | 3.1 | 9.39 | 9.17 | 8.78 | 4.05 | 4.5 | 6.44 | ** | + | | |
| HEMBA1002937 | 2.94 | 0.97 | 1.56 | 5.32 | 3.72 | 3.3 | 4.25 | 3.23 | 5.41 | | | * | + |
| HEMBA1002939 | 5.23 | 2.26 | 1.27 | 6.12 | 6.22 | 7.2 | 3.36 | 5.43 | 4.03 | * | + | | |
| HEMBA1002944 | 2.39 | 1.05 | 0.97 | 2.45 | 2.94 | 1.89 | 1.97 | 1.66 | 1.79 | | | | |
| HEMBA1002951 | 4.82 | 2.48 | 2.82 | 6.08 | 7.02 | 6.04 | 4.47 | 6.63 | 5.8 | * | + | | |
| HEMBA1002954 | 3.07 | 1.62 | 1.21 | 5.05 | 3.53 | 2.74 | 1.86 | 3.21 | 2.77 | | | | |
| HEMBA1002962 | 4.7 | 4.71 | 2.06 | 11.63 | 8.54 | 7.28 | 2.97 | 4.52 | 4.25 | * | + | | |
| HEMBA1002968 | 7.62 | 3.18 | 4.17 | 11.44 | 8.51 | 9.98 | 4.32 | 4.58 | 5.82 | * | + | | |
| HEMBA1002970 | 1.55 | 2.24 | 2.05 | 3.8 | 4.05 | 2.91 | 1.8 | 3.84 | 2.44 | * | + | | |
| HEMBA1002971 | 2.55 | 2.17 | 1.09 | 2.11 | 2.8 | 2.2 | 1.84 | 1.44 | 2.55 | | | | |
| HEMBA1002973 | 4.7 | 1.37 | 2.41 | 7.46 | 7.53 | 5.02 | 4.19 | 3.07 | 3.54 | * | + | | |
| HEMBA1002978 | 4.6 | 2.2 | 2.96 | 5.07 | 6.26 | 5.9 | 2.87 | 3.98 | 1.74 | * | + | | |
| HEMBA1002981 | 10.14 | 3.92 | 5.05 | 6.62 | 5.73 | 6.85 | 4.75 | 3.37 | 4.22 | | | | |
| HEMBA1002985 | 5.65 | 3.15 | 2.63 | 4.75 | 6.26 | 6.46 | 4.22 | 6.1 | 4.66 | | | | |
| HEMBA1002986 | 8.06 | 6.02 | 4.91 | 10.22 | 16.35 | 15.33 | 12.26 | 16.22 | 12.17 | * | + | * | + |
| HEMBA1002988 | 1.58 | 0.97 | 1.43 | 5.23 | 7.34 | 7.21 | 3.78 | 3.98 | 3.2 | ** | + | ** | + |

TABLE 176

| | | | | | | | | | | | | | |
|---|---|---|---|---|---|---|---|---|---|---|---|---|---|
| HEMBA1002992 | 9.81 | 4.26 | 5.48 | 8.62 | 8.82 | 10.46 | 6.24 | 6.81 | 7.68 | | | | |
| HEMBA1002995 | 9.95 | 5.67 | 5.79 | 12.67 | 13.82 | 15.45 | 7.42 | 8.68 | 5.34 | * | + | | |
| HEMBA1002997 | 5.35 | 3.23 | 2.63 | 6.04 | 6.82 | 4.47 | 3.67 | 4.27 | 4.14 | | | | |
| HEMBA1002999 | 1.41 | 1.21 | 1 | 1.77 | 1.86 | 2.15 | 1.54 | 1.79 | * | + | | | |
| HEMBA1003004 | 4.4 | 2.05 | 2.04 | 4.44 | 2.35 | 3.6 | 4.34 | 2.86 | 3.43 | | | | |
| HEMBA1003006 | 3.81 | 3.03 | 1.95 | 4.39 | 5.85 | 4.42 | 3.51 | 4.58 | 4.16 | | | | |
| HEMBA1003008 | 3.21 | 2.19 | 2.5 | 3.68 | 6.17 | 6.62 | 2.11 | 3.8 | 2.8 | * | + | | |
| HEMBA1003021 | 7.74 | 5.2 | 3.87 | 9.69 | 18.49 | 13.68 | 7.01 | 7.68 | 6.46 | * | + | | |
| HEMBA1003027 | 2.46 | 2.25 | 2.2 | 3.48 | 3.21 | 5.26 | 3.71 | 4.99 | 5.27 | | | ** | + |
| HEMBA1003029 | 16.49 | 15.58 | 12.66 | 14.01 | 22.6 | 13.51 | 9.84 | 22.76 | 21.22 | | | | |
| HEMBA1003031 | 7 | 6.8 | 4.83 | 11.72 | 14.51 | 12.51 | 5.21 | 5.97 | 6.1 | ** | + | | |
| HEMBA1003032 | 8.54 | 5.52 | 5.51 | 6.83 | 9.05 | 7.67 | 7.01 | 6.8 | 7.13 | | | | |
| HEMBA1003033 | 13.69 | 8.92 | 7.92 | 18.19 | 20.22 | 19.59 | 7.06 | 10.97 | 9.51 | ** | + | | |
| HEMBA1003034 | 10.16 | 6.76 | 5.59 | 16.34 | 16.21 | 18.88 | 7.61 | 9.38 | 7.94 | ** | + | | |
| HEMBA1003035 | 0.86 | 0.59 | 0.52 | 1.61 | 1.97 | 0.55 | 0.09 | 2.49 | 0.47 | | | | |
| HEMBA1003037 | 14.14 | 5.43 | 5.96 | 7.58 | 8.71 | 8.97 | 7.73 | 6.56 | 7.19 | | | | |
| HEMBA1003041 | 13.54 | 5.42 | 7.39 | 11.23 | 11.7 | 11.68 | 7.62 | 7.38 | 7.89 | | | | |

TABLE 176-continued

| | | | | | | | | | | | | |
|---|---|---|---|---|---|---|---|---|---|---|---|---|
| HEMBA1003046 | 10.88 | 8 | 7.65 | 10.34 | 12.65 | 9.57 | 6.83 | 7.13 | 6.72 | | | |
| HEMBA1003047 | 6.06 | 2.52 | 2.2 | 4.15 | 5.03 | 5.74 | 4.14 | 4.89 | 5.07 | | | |
| HEMBA1003048 | 4.06 | 2.13 | 2.64 | 5.2 | 6.24 | 5.07 | 5.54 | 7.31 | 7.12 | * | + | ** | + |
| HEMBA1003064 | 1.85 | 0.88 | 1.11 | 2.44 | 3.01 | 2.83 | 0.75 | 2.55 | 1.61 | * | + | | |
| HEMBA1003067 | 3.99 | 3.75 | 3.24 | 6.04 | 4.55 | 5.67 | 2.42 | 3.41 | 2.73 | * | + | | |
| HEMBA1003071 | 4.89 | 2 | 2.46 | 3.09 | 3.36 | 3.95 | 2.75 | 4.15 | 2.46 | | | | |
| HEMBA1003072 | 5 | 3.54 | 3.49 | 9.31 | 7.84 | 7.21 | 4.62 | 3.3 | 3.28 | ** | + | | |
| HEMBA1003076 | 17.78 | 7.65 | 8.23 | 14.31 | 15.74 | 15.39 | 9.87 | 12.41 | 9.92 | | | | |
| HEMBA1003077 | 2.58 | 1.45 | 1.89 | 1.93 | 2.25 | 1.91 | 1.66 | 2.15 | 1.57 | | | | |
| HEMBA1003078 | 2.54 | 1.51 | 1.55 | 3 | 4.23 | 3.44 | 2.66 | 2.38 | 2.18 | * | + | | |
| HEMBA1003079 | 1.91 | 1.85 | 1.65 | 2.48 | 2.95 | 4.35 | 2.42 | 3.49 | 4.71 | | | | |
| HEMBA1003083 | 3.9 | 3.64 | 3.64 | 4.53 | 10.29 | 6.35 | 3.33 | 5.25 | 3.51 | | | | |
| HEMBA1003086 | 4.22 | 1.35 | 2.59 | 5.79 | 6.56 | 7.76 | 2.96 | 3.81 | 3.22 | * | + | | |
| HEMBA1003090 | 4.24 | 1.39 | 3.28 | 3.62 | 3.38 | 4 | 2.6 | 2.81 | 2.75 | | | | |
| HEMBA1003094 | 7.91 | 4.48 | 3.84 | 6.39 | 5.65 | 6.37 | 3.63 | 7.81 | 6.29 | | | | |
| HEMBA1003096 | 2.55 | 1.26 | 1.42 | 4.86 | 4.02 | 4.86 | 6.22 | 5.89 | 7.19 | ** | + | ** | + |
| HEMBA1003098 | 13.3 | 7.22 | 6.89 | 14.21 | 8.08 | 14.42 | 7.57 | 4.87 | 3.41 | | | | |
| HEMBA1003101 | 3.86 | 1.83 | 2.21 | 3.42 | 3.01 | 2.84 | 5.05 | 3.05 | 3.57 | | | | |
| HEMBA1003109 | 4.5 | 2.81 | 2.78 | 4.25 | 4.4 | 4.14 | 3.32 | 3.04 | 3.75 | | | | |
| HEMBA1003114 | 4.72 | 1.49 | 2.76 | 4.85 | 5.37 | 3.83 | 2.73 | 3.02 | 2.47 | | | | |
| HEMBA1003117 | 3.34 | 1.32 | 1.84 | 1.94 | 3.48 | 3.4 | 1.15 | 2.8 | 1.47 | | | | |
| HEMBA1003120 | 6.26 | 3.04 | 4.46 | 8.53 | 11.03 | 9.87 | 2.19 | 4.52 | 4.23 | * | + | | |
| HEMBA1003129 | 2.92 | 2.45 | 1.66 | 4.57 | 4.93 | 4.76 | 2.42 | 2.95 | 3.22 | ** | + | | |
| HEMBA1003133 | 3.76 | 2.75 | 2.66 | 4.15 | 4.94 | 3.64 | 3.03 | 3.83 | 3.17 | | | | |
| HEMBA1003136 | 10.1 | 5.38 | 5.56 | 4.76 | 5.69 | 3.55 | 4.84 | 6.06 | 5.16 | | | | |
| HEMBA1003142 | 3.63 | 2.31 | 2.57 | 5.7 | 6.12 | 5.75 | 4.06 | 4.52 | 4.11 | ** | + | * | + |
| HEMBA1003148 | 3.76 | 1.84 | 1.85 | 6.57 | 6.35 | 7.13 | 3.78 | 3.2 | 3.41 | ** | + | | |
| HEMBA1003151 | 3.06 | 1.21 | 2.06 | 3.57 | 3.12 | 3.47 | 1.14 | 2.71 | 1.88 | | | | |
| REMBA1003152 | 0.94 | 1.17 | 1.24 | 1.37 | 1.78 | 3.11 | 1.18 | 1.39 | 0.96 | | | | |
| HEMBA1003157 | 5.21 | 1.69 | 3.38 | 3.87 | 2.5 | 3.42 | 0.86 | 1.61 | 0.57 | | | | |
| HEMBA1003166 | 16.26 | 12.43 | 11.19 | 32.39 | 35.71 | 31.69 | 16.79 | 24.31 | 19.76 | ** | + | | |
| HEMBA1003171 | 2.89 | 0.72 | 0.57 | 1.31 | 1.88 | 0.92 | 1.38 | 1.84 | 1.16 | | | | |
| HEMBA1003175 | 2.6 | 1.51 | 1.44 | 3.64 | 3.88 | 4.37 | 1.98 | 2.4 | 2.06 | ** | + | | |
| HEMBA1003179 | 4.43 | 2.72 | 4.24 | 3.15 | 2.78 | 4.29 | 3.01 | 4.28 | 3.14 | | | | |
| HEMBA1003186 | 8.23 | 6.45 | 5.52 | 11.84 | 15.62 | 13.23 | 6.12 | 9.01 | 7.56 | ** | + | | |
| HEMBA1003196 | 5.41 | 2.8 | 3.15 | 4.6 | 6.06 | 5.01 | 3.65 | 4.6 | 3.58 | | | | |
| HEMBA1003197 | 1.16 | 0.72 | 0.59 | 1.88 | 2.27 | 1.84 | 1.37 | 1.38 | 0.69 | ** | + | | |
| HEMBA1003199 | 2.2 | 0.82 | 0.97 | 3.9 | 3.83 | 3.59 | 1.11 | 2.24 | 1.33 | ** | + | | |
| HEMBA1003201 | 6.51 | 4.3 | 4.72 | 9.3 | 10.18 | 10.03 | 5.76 | 4.86 | 4.67 | ** | + | | |

TABLE 177

| | | | | | | | | | | | | |
|---|---|---|---|---|---|---|---|---|---|---|---|---|
| HEMBA1003204 | 4.47 | 2.88 | 1.95 | 6.42 | 9.31 | 7.19 | 4.16 | 4.11 | 3.52 | * | + | | |
| HEMBA1003210 | 5.3 | 3.32 | 2.57 | 8.14 | 10.48 | 8.37 | 17.93 | 9.12 | 16.05 | ** | + | * | + |
| HEMBA1003212 | 10.06 | 5.15 | 6.84 | 12.91 | 14.8 | 18.49 | 9.01 | 8.88 | 9.76 | * | + | | |
| HEMBA1003218 | 1.85 | 0.63 | 1.04 | 1.36 | 1.25 | 1.72 | 1.4 | 2.5 | 1.89 | | | | |
| HEMBA1003220 | 27.66 | 24 | 25.44 | 26.62 | 36.09 | 37.79 | 16.07 | 14.85 | 17.5 | | ** | − | |
| HEMBA1003222 | 2.88 | 1.72 | 3.36 | 3.75 | 3.58 | 3.59 | 2.57 | 3.59 | 2.87 | | | | |
| HEMBA1003225 | 2.92 | 1.48 | 2.59 | 3.07 | 2.81 | 2.57 | 2.42 | 3.81 | 3.48 | | | | |
| HEMBA1003229 | 3.63 | 1 | 0.92 | 4.49 | 4.02 | 4.36 | 4.86 | 6.18 | 8.35 | | | * | + |
| HEMBA1003230 | 4.81 | 1.33 | 1.59 | 3.63 | 3.48 | 2.96 | 3.63 | 4.11 | 4.45 | | | | |
| HEMBA1003235 | 4.25 | 2.83 | 2.72 | 4.77 | 5.98 | 6.44 | 3.15 | 3.65 | 2.94 | * | + | | |
| HEMBA1003236 | 2.61 | 2.12 | 2.62 | 4.85 | 3.24 | 5.32 | 5.66 | 4.6 | 3.8 | * | + | * | + |
| HEMBA1003250 | 1.73 | 0.34 | 1.4 | 2.93 | 3 | 2.03 | 1.83 | 2.23 | 1.38 | * | + | | |
| HEMBA1003252 | 5.88 | 2.96 | 5.36 | 7.78 | 7.79 | 7.89 | 4.58 | 5.63 | 5.99 | * | + | | |
| HEMBA1003257 | 4.93 | 1.49 | 3.88 | 3.03 | 4.82 | 4.08 | 2.99 | 3.59 | 4.04 | | | | |
| HEMBA1003268 | 0.75 | 0.26 | 0.6 | 2.39 | 1.18 | 1.2 | 0.42 | 1.31 | 0.41 | | | | |
| HEMBA1003273 | 3.46 | 2.51 | 1.67 | 5.94 | 6.01 | 5.04 | 2.19 | 3.45 | 3.47 | ** | + | | |
| HEMBA1003276 | 1.81 | 1.29 | 0.96 | 4.38 | 4.69 | 4.83 | 1.54 | 2.73 | 3.03 | ** | + | * | + |
| HEMBA1003277 | 2.81 | 1.68 | 0.99 | 2.39 | 2.91 | 2.66 | 2.69 | 2.74 | 1.67 | | | | |
| HEMBA1003278 | 1.65 | 0.9 | 1.98 | 2.98 | 3.92 | 3.95 | 2.37 | 3.01 | 2.17 | ** | + | | |
| HEMBA1003280 | 3.32 | 1.78 | 3 | 4.76 | 3.3 | 3.57 | 2.93 | 5.18 | 3.65 | | | | |
| HEMBA1003281 | 4.06 | 0.91 | 2.42 | 3.46 | 3.32 | 3.57 | 2.53 | 4.81 | 3.88 | | | | |
| HEMBA1003284 | 0.48 | 0.51 | 0.58 | 2.22 | 0.82 | 1.41 | 1.13 | 2.8 | 1.15 | | | | |
| HEMBA1003286 | 3.88 | 2.4 | 2.73 | 5.92 | 3.88 | 3.67 | 2.08 | 4.79 | 3.77 | | | | |
| HEMBA1003291 | 2.38 | 1.74 | 0.96 | 2.57 | 3.95 | 3.8 | 2.72 | 4.5 | 5.97 | * | + | | |
| HEMBA1003294 | 5.2 | 3.14 | 3.02 | 8.15 | 7.24 | 7.54 | 4.43 | 4.64 | 6.12 | ** | + | | |
| HEMBA1003296 | 3.52 | 1.49 | 1.47 | 1.62 | 2.44 | 1.83 | 2.01 | 2.49 | 2.5 | | | | |
| HEMBA1003304 | 1.33 | 0.87 | 0.46 | 1.14 | 1.8 | 1.15 | 0.92 | 1.05 | 1.59 | | | | |
| HEMBA1003306 | 4.82 | 1.91 | 2.68 | 6.16 | 5.24 | 6.21 | 5.8 | 5.67 | 6.01 | * | + | * | + |
| HEMBA1003309 | 0.64 | 0.18 | 0.98 | 3.28 | 3.28 | 2.43 | 1.17 | 2.04 | 1.94 | ** | + | * | + |
| HEMBA1003314 | 30.47 | 18.15 | 16.33 | 19.29 | 25.08 | 19.75 | 20.31 | 20.79 | 24.11 | | | | |
| HEMBA1003315 | 10.03 | 5 | 5.86 | 8.82 | 6.71 | 8.85 | 7.02 | 6.3 | 8.18 | | | | |
| HEMBA1003322 | 6.46 | 2.81 | 4.38 | 11.92 | 11.23 | 7.71 | 5.2 | 4.77 | 6.83 | * | + | | |
| HEMBA1003326 | 4.18 | 1.78 | 2.35 | 2.75 | 2.35 | 2.84 | 2.28 | 3.1 | 3.12 | | | | |
| HEMBA1003327 | 1.82 | 3.14 | 1.29 | 2.95 | 3.45 | 3.27 | 2.29 | 2.03 | 3.08 | | | | |

TABLE 177-continued

| | | | | | | | | | | | | | |
|---|---|---|---|---|---|---|---|---|---|---|---|---|---|
| HEMBA1003328 | 4.01 | 4 | 2.1 | 5.29 | 8.03 | 6.1 | 3.75 | 5.53 | 3.53 | * | + | | |
| HEMBA1003330 | 11.21 | 6.43 | 6.46 | 11.55 | 10.31 | 11.11 | 5.39 | 5.56 | 6.86 | | | | |
| HEMBA1003348 | 5.75 | 4.37 | 3.56 | 10.47 | 9.4.4 | 9.51 | 4.42 | 5.42 | 4.82 | ** | + | | |
| HEMBA1003369 | 3.52 | 2.39 | 2.06 | 5.95 | 6.68 | 6.94 | 3.15 | 4.91 | 3.36 | ** | + | | |
| HEMBA1003370 | 20.51 | 11.56 | 11.02 | 25.15 | 23.1 | 21.13 | 12.45 | 14.72 | 17.99 | | | | |
| HEMBA1003373 | 3.04 | 1.4 | 0.86 | 3.17 | 2.01 | 3.32 | 2.12 | 1.4 | 2.16 | | | | |
| HEMBA1003376 | 11.18 | 5.54 | 7.92 | 20.96 | 23.88 | 21.25 | 10.64 | 10.28 | 11.12 | ** | + | | |
| MEMBA1003380 | 2.3 | 1.46 | 1.33 | 2.34 | 1.63 | 1.87 | 2.49 | 1.54 | 2.46 | | | | |
| HEMBA1003384 | 2.29 | 0.73 | 1.56 | 3.93 | 3.22 | 3.27 | 1.72 | 2.42 | 3.12 | * | + | | |
| MEMBA1003387 | 1.34 | 0.55 | 1.92 | 1.88 | 0.47 | 0.99 | 1.2 | 0.99 | 1.1 | | | | |
| HEMBA1003392 | 8.27 | 4.38 | 5.55 | 5.24 | 7.99 | 8.63 | 5.42 | 7.97 | 6.53 | | | | |
| HEMBA1003395 | 1.96 | 1.22 | 1.19 | 2.43 | 3.54 | 3.02 | 1.59 | 5.5 | 1.02 | * | + | | |
| HEMBA1003399 | 5.58 | 3.74 | 3.33 | 5.08 | 4.37 | 5.04 | 3.4 | 3.1 | 3.67 | | | | |
| HEMBA1003400 | 10.74 | 5.28 | 6.5 | 8.13 | 8.07 | 5.69 | 7.43 | 7.79 | 7.28 | | | | |
| HEMBA1003402 | 4.66 | 2.07 | 1.57 | 4.25 | 3.02 | 2.77 | 2.27 | 1.71 | 2.18 | | | | |
| HEMBA1003403 | 4.57 | 4.91 | 4.99 | 4.14 | 4.8 | 3.26 | 2.96 | 3.55 | 2.8 | | | ** | − |
| HEMBA1003408 | 10.68 | 7.13 | 5.44 | 7.16 | 7.17 | 7.67 | 7.62 | 9.08 | 7.52 | | | | |
| HEMBA1003412 | 6.57 | 4.94 | 4.07 | 6.42 | 6.27 | 6.69 | 3.99 | 6.63 | 4.67 | | | | |
| HEMBA1003417 | 4.27 | 2.26 | 3.09 | 1.9 | 2.03 | 2.19 | 2.24 | 2.99 | 2.76 | | | | |
| HEMBA1003418 | 10.03 | 4.9 | 6.22 | 10.24 | 12.15 | 12.3 | 3.46 | 6.64 | 4.53 | | | | |
| HEMBA1003420 | 1.52 | 0.53 | 0.73 | 7.04 | 2.2 | 5.31 | 11.33 | 12.68 | 10.88 | | | ** | + |
| HEMBA1003425 | 1.37 | 1.11 | 1.09 | 2.68 | 2.01 | 2.17 | 1.69 | 0.88 | 0.88 | ** | + | | |

TABLE 178

| | | | | | | | | | | | | | |
|---|---|---|---|---|---|---|---|---|---|---|---|---|---|
| HEMBA1003433 | 2.51 | 1.64 | 1.17 | 2.63 | 2.77 | 1.5 | 2.03 | 2.04 | 0.74 | | | | |
| HEMBA1003440 | 7.38 | 4.95 | 3.98 | 3.59 | 4.49 | 2.94 | 11.67 | 10.24 | 9.89 | | | * | + |
| HEMBA1003442 | 7.11 | 3.89 | 5.36 | 33.69 | 44.16 | 39.43 | 12.88 | 14.11 | 14.92 | ** | + | ** | + |
| HEMBA1003447 | 6.43 | 2.84 | 5.38 | 2.86 | 4.59 | 3.43 | 2.19 | 3.65 | 2.78 | | | | |
| HEMBA1003453 | 5.3 | 2.06 | 4.2 | 3.35 | 2.95 | 3.68 | 3.79 | 4.22 | 4.22 | | | | |
| HEMBA1003461 | 4.9 | 1.85 | 2.53 | 3.24 | 4.51 | 4.52 | 2.91 | 4.48 | 2.29 | | | | |
| HEMBA1003463 | 2.07 | 0.69 | 1.15 | 5.59 | 5.7 | 5.89 | 4.6 | 5.83 | 5.74 | ** | + | ** | + |
| HEMBA1003465 | 9.37 | 4.59 | 4.46 | 10.69 | 9.03 | 7.99 | 6.08 | 6.86 | 6.92 | | | | |
| HEMBA1003480 | 9.33 | 5.04 | 6.92 | 12.74 | 16.03 | 14.45 | 6.27 | 6.32 | 7.43 | ** | + | | |
| HEMBA1003485 | 20.75 | 10.29 | 10.54 | 10.17 | 12.27 | 12.15 | 10.87 | 6.69 | 7.13 | | | | |
| HEMBA1003487 | 4.58 | 2.05 | 1.61 | 2.41 | 3.47 | 2.58 | 3.04 | 3.53 | 2.9 | | | | |
| HEMBA1003492 | 2.07 | 1.37 | 0.95 | 2.53 | 2.7 | 2.94 | 1.03 | 2.89 | 1.4 | * | + | | |
| HEMBA1003494 | 2.49 | 0.76 | 1.49 | 27.92 | 31.78 | 20.12 | 3.6 | 6.11 | 5.48 | ** | + | * | + |
| HEMBA1003497 | 3.12 | 0.78 | 1.83 | 3.69 | 4.28 | 3.96 | 1.74 | 2.6 | 2.31 | * | + | | |
| HEMBA1003503 | 3.45 | 2.06 | 1.43 | 3.15 | 2.26 | 2.25 | 1.52 | 3 | 3.05 | | | | |
| HEMBA1003511 | 2.69 | 1.04 | 0.98 | 1.76 | 1.46 | 1.83 | 1.71 | 1.33 | 0.95 | | | | |
| HEMBA1003528 | 18.14 | 11.27 | 11.45 | 12.37 | 19.83 | 18.44 | 16.97 | 12.4 | 16.79 | | | | |
| HEMBA1003530 | 2.6 | 1.44 | 2.11 | 2.26 | 2.64 | 3.14 | 2.32 | 2.96 | 3.27 | | | | |
| HEMBA1003531 | 6.99 | 4.57 | 4.74 | 10.98 | 15.62 | 10.36 | 6.08 | 6.8 | 4.37 | * | + | | |
| HEMBA1003532 | 13.93 | 5.28 | 9.84 | 12.79 | 13.95 | 12.42 | 7.71 | 9.02 | 10.58 | | | | |
| HEMBA1003538 | 2.36 | 1.42 | 1.55 | 0.71 | 3.61 | 2.87 | 1.32 | 3.05 | 1.48 | | | | |
| HEMBA1003545 | 1.41 | 0.47 | 0.87 | 1.63 | 1.67 | 1.35 | 0.85 | 1.8 | 0.86 | | | | |
| HEMBA1003546 | 6.22 | 3.88 | 2.1 | 11.53 | 13.41 | 10.1 | 6.93 | 7.89 | 5.98 | ** | + | | |
| HEMBA1003548 | 0.92 | 0.44 | 0.29 | 1.8 | 1.25 | 1.92 | 0.41 | 1.43 | 0.38 | * | + | | |
| HEMBA1003553 | 10.98 | 8.66 | 9.18 | 19.1 | 13.8 | 21.91 | 7.81 | 8.18 | 9.02 | * | + | | |
| HEMBA1003555 | 3.02 | 1.7 | 1.46 | 1.76 | 3.2 | 2.69 | 2.27 | 3.4 | 2.27 | | | | |
| HEMBA1003556 | 4.32 | 1.68 | 2.2 | 3.83 | 6.46 | 5.67 | 2.71 | 3.54 | 2.22 | | | | |
| HEMBA1003560 | 1.14 | 1.46 | 1.03 | 0.88 | 1.35 | 1.08 | 1.46 | 2.03 | 1.63 | | | | |
| HEMBA1003565 | 4.06 | 3.07 | 3.95 | 3.82 | 4.6 | 4.62 | 4.01 | 5.7 | 5.12 | | | | |
| HEMBA1003568 | 2.91 | 0.76 | 1.15 | 1.22 | 1.08 | 1.38 | 1.05 | 1.98 | 0.77 | | | | |
| HEMBA1003569 | 8.99 | 12.88 | 9.75 | 5.29 | 6.55 | 5.16 | 4.54 | 5.33 | 5.68 | * | − | * | − |
| HEMBA1003571 | 10.48 | 4.42 | 3.13 | 21.11 | 11.99 | 10.73 | 5.96 | 8.94 | 7.11 | | | | |
| HEMBA1003579 | 5.23 | 2.72 | 1.87 | 4.14 | 3.57 | 5.4 | 3.01 | 3.4 | 2.79 | | | | |
| HEMBA1003580 | 11.03 | 7.36 | 6.64 | 6.54 | 6.56 | 8.11 | 7.97 | 8.17 | 8.81 | | | | |
| HEMBA1003581 | 5.6 | 4.24 | 4.26 | 4.68 | 5.52 | 5.87 | 5.47 | 4.38 | 5.02 | | | | |
| HEMBA1003591 | 39.81 | 31.07 | 28.74 | 52.34 | 52.04 | 48.99 | 14.34 | 10.05 | 14.79 | ** | + | ** | − |
| HEMBA1003595 | 1.99 | 0.8 | 1.07 | 3.33 | 4.04 | 3.39 | 2.08 | 3.22 | 1.45 | ** | + | | |
| HEMBA1003597 | 1.33 | 0.63 | 1.33 | 3.65 | 3.35 | 4.52 | 1.94 | 2.9 | 2.36 | ** | + | * | + |
| HEMBA1003598 | 2.9 | 0.82 | 1.41 | 1.32 | 2.05 | 2.83 | 1.88 | 0.98 | 0.49 | | | | |
| HEMBA1003600 | 5.78 | 3.55 | 3.06 | 6.44 | 7.48 | 5.87 | 4.2 | 4.07 | 5.87 | | | | |
| HEMBA1003602 | 2.69 | 1.98 | 1.66 | 3.29 | 2.76 | 2.29 | 1.48 | 2.11 | 2.34 | | | | |
| HEMBA1003604 | 11.43 | 8.02 | 8.72 | 12.24 | 9.01 | 11.87 | 7.65 | 8.32 | 8.25 | | | | |
| HEMBA1003610 | 8.44 | 6.02 | 5.83 | 14.76 | 14.29 | 15.88 | 13.42 | 9.31 | 12.15 | ** | + | * | + |
| HEMBA1003615 | 6.42 | 3.45 | 3.87 | 5.96 | 5.91 | 5.22 | 3.28 | 5.75 | 3.48 | | | | |
| HEMBA1003617 | 3.99 | 3.24 | 3.91 | 16.74 | 14.07 | 12.64 | 7.57 | 9.08 | 9.03 | ** | + | ** | + |
| HEMBA1003620 | 5.35 | 2.63 | 3.62 | 8.39 | 6.31 | 6.44 | 4.6 | 5.32 | 5.6 | * | + | | |
| HEMBA1003621 | 5.01 | 4.74 | 3.02 | 9.46 | 12.07 | 10.28 | 5.9 | 5.67 | 5.82 | ** | + | | |
| HEMBA1003622 | 1.74 | 1.02 | 0.61 | 2.09 | 2.03 | 2.5 | 0.94 | 1.66 | 0.88 | * | + | | |
| HEMBA1003630 | 1.59 | 0.33 | 0.75 | 1.41 | 1.11 | 1.15 | 1.54 | 2.32 | 1.54 | | | | |
| HEMBA1003637 | 2.15 | 0.95 | 0.99 | 3.26 | 5.54 | 3.57 | 1.75 | 2.71 | 1.99 | * | + | | |
| HEMBA1003640 | 2.27 | 1.59 | 2.11 | 4.99 | 4.15 | 5.22 | 3.36 | 5.53 | 2.27 | ** | + | | |

TABLE 178-continued

| HEMBA1003645 | 1.63 | 0.53 | 1.13 | 3.97 | 2.86 | 2.71 | 2.66 | 3.44 | 1.36 | * | + | | |
| --- | --- | --- | --- | --- | --- | --- | --- | --- | --- | --- | --- | --- | --- |
| HEMBA1003646 | 0.89 | 0.8 | 1.19 | 3.33 | 3.36 | 4.74 | 1.35 | 3.89 | 1.8 | ** | + | | |
| HEMBA1003647 | 0.79 | 0.36 | 0.72 | 3.69 | 2.19 | 3.35 | 1.03 | 2.87 | 1.04 | ** | + | | |
| HEMBA1003656 | 3.32 | 1.76 | 1.62 | 4 | 4.27 | 4.72 | 3.61 | 3.92 | 2.65 | * | + | | |
| HEMBA1003662 | 2.77 | 1.1 | 0.73 | 3.91 | 3.34 | 1.69 | 3.38 | 3 | 3.35 | | | | |

TABLE 179

| HEMBA1003666 | 1.38 | 1.05 | 0.83 | 1.72 | 1.7 | 1.06 | 0.87 | 1.13 | 0.89 | | | | |
| --- | --- | --- | --- | --- | --- | --- | --- | --- | --- | --- | --- | --- | --- |
| HEMBA1003667 | 14.71 | 11.01 | 9.94 | 14.75 | 22.82 | 18.78 | 15.24 | 10.59 | 14.49 | | | | |
| HEMBA1003670 | 0.91 | 0.22 | 0.29 | 1.11 | 1.61 | 1.82 | 0.56 | 1.43 | 0.85 | * | + | | |
| HEMBA1003674 | 26.03 | 18.94 | 18.61 | 21.67 | 28.7 | 30.08 | 14.76 | 19.25 | 20.49 | | | | |
| HEMBA1003677 | 3.73 | 1.52 | 2.36 | 7.63 | 8.16 | 6.96 | 10.74 | 10.88 | 8.28 | ** | + | ** | + |
| HEMBA1003679 | 1.48 | 0.67 | 1.25 | 5.41 | 5.58 | 4.44 | 1.61 | 3.27 | 2.24 | ** | + | | |
| HEMBA1003680 | 6.18 | 3.86 | 3.32 | 4.89 | 3.65 | 4.22 | 2.45 | 3.41 | 4.34 | | | | |
| HEMBA1003684 | 3.07 | 3.42 | 2.52 | 4.93 | 3.87 | 3.53 | 2.61 | 2.37 | 4.26 | | | | |
| HEMBA1003690 | 8.67 | 4.5 | 4.89 | 6.53 | 5.61 | 6.33 | 6.11 | 7.01 | 7.57 | | | | |
| HEMBA1003692 | 6.51 | 4.39 | 2.76 | 7.65 | 13.21 | 11.37 | 6.71 | 7.24 | 6.09 | * | + | | |
| HEMBA1003702 | 7.49 | 3.3 | 2.54 | 5.23 | 6.69 | 4.84 | 4.77 | 3.72 | 5.73 | | | | |
| HEMBA1003711 | 5.86 | 2.58 | 3.21 | 3.28 | 5.33 | 5.99 | 2.95 | 4.08 | 4.68 | | | | |
| HEMBA1003714 | 4.3 | 2.42 | 1.47 | 3.54 | 3.98 | 3.51 | 1.5 | 2.8 | 3.08 | | | | |
| HEMBA1003715 | 5.16 | 2.24 | 2.94 | 8.09 | 8.13 | 8 | 2.66 | 4.48 | 4.1 | ** | + | | |
| HEMBA1003717 | 3.17 | 2.29 | 1.96 | 4.19 | 3.55 | 5.52 | 1.88 | 1.44 | 1.67 | * | + | | |
| HEMBA1003720 | 1.56 | 1.73 | 1.27 | 3.11 | 3.53 | 3.49 | 2.3 | 1.66 | 3.08 | ** | + | | |
| HEMBA1003725 | 1.46 | 0.94 | 0.92 | 3.84 | 2.37 | 2.61 | 2.1 | 1.7 | 2.25 | * | + | * | + |
| HEMBA1003728 | 6.2 | 3.24 | 4.06 | 5.16 | 6.27 | 6.67 | 5.85 | 4.48 | 3.55 | | | | |
| HEMBA1003729 | 3.99 | 1.42 | 2.32 | 6.36 | 5.84 | 4.38 | 3.64 | 4.72 | 3.3 | * | + | | |
| HEMBA1003732 | 1.63 | 1.1 | 1 | 3.52 | 2.12 | 1.25 | 0.95 | 1.54 | 1.47 | | | | |
| HEMBA1003733 | 2.5 | 4.71 | 1.16 | 4.86 | 6.33 | 5.47 | 2.99 | 3.73 | 3.5 | | | | |
| HEMBA1003742 | 6.12 | 2.9 | 4.2 | 5.24 | 4.87 | 5.32 | 2.62 | 6.27 | 5.03 | | | | |
| HEMBA1003743 | 2.64 | 1.63 | 1.2 | 2.32 | 2.37 | 3.69 | 2.34 | 1.46 | 1.92 | | | | |
| HEMBA1003758 | 5.8 | 2.98 | 4.74 | 10.06 | 11.45 | 11.44 | 7.34 | 3.52 | 6.11 | ** | + | | |
| HEMBA1003760 | 5.32 | 2.29 | 2.62 | 4.55 | 3.7 | 4.58 | 3.57 | 4.5 | 4.37 | | | | |
| HEMBA1003764 | 5.57 | 1.67 | 3.47 | 5.12 | 2.71 | 2.62 | 3.98 | 3.91 | 4.87 | | | | |
| HEMBA1003769 | 11.09 | 7.81 | 6.22 | 7.38 | 7.99 | 10.09 | 8.32 | 6.25 | 8.19 | | | | |
| HEMBA1003773 | 4.06 | 2.15 | 2.74 | 3.4 | 2.78 | 2.89 | 3.34 | 3.66 | 3.74 | | | | |
| HEMBA1003783 | 5.9 | 5.63 | 5.15 | 7.21 | 10.97 | 7.92 | 4.02 | 5.97 | 4.35 | | | | |
| HEMBA1003784 | 1.56 | 0.55 | 0.26 | 1.01 | 1.64 | 1.14 | 0.84 | 1.59 | 1 | | | | |
| HEMBA1003794 | 22.02 | 14.74 | 15.29 | 16.32 | 23.57 | 18.51 | 19.15 | 20.16 | 23.83 | | | | |
| HEMBA1003799 | 3.18 | 0.83 | 0.69 | 1.6 | 1.44 | 2.62 | 1.76 | 1.29 | 1.44 | | | | |
| HEMBA1003803 | 5.18 | 3.99 | 2.9 | 7.41 | 7.07 | 8.96 | 7.06 | 6.07 | 5.89 | * | + | * | + |
| HEMBA1003804 | 4.31 | 3.24 | 3.27 | 5.11 | 3.19 | 3.64 | 3.81 | 3.96 | 3.99 | | | | |
| HEMBA1003805 | 9.07 | 8.11 | 9.22 | 15.23 | 14.63 | 10.98 | 7.34 | 10.04 | 6.52 | * | + | | |
| HEMBA1003807 | 2.26 | 0.57 | 1.05 | 1.41 | 1.99 | 1.42 | 1.14 | 1.69 | 1.19 | | | | |
| HEMBA1003810 | 2.67 | 2.32 | 0.99 | 3.03 | 2.59 | 2.69 | 2.81 | 4.61 | 3.57 | | | | |
| HEMBA1003827 | 25.92 | 18.96 | 19.46 | 14.46 | 20.55 | 25.66 | 14.02 | 29.91 | 19.07 | | | | |
| HEMBA1003836 | 9.8 | 5.94 | 7.41 | 16.46 | 20.73 | 18.84 | 10.1 | 7.05 | 9.1 | ** | + | | |
| HEMBA1003838 | 29.21 | 22.41 | 20.25 | 35.45 | 47.13 | 35.6 | 26.78 | 26.74 | 23.31 | * | + | | |
| HEMBA1003843 | 8.31 | 5.73 | 4.45 | 4.63 | 2.15 | 3.75 | 3.72 | 2.7 | 3.17 | | | | |
| HEMBA1003846 | 26.28 | 20.72 | 18.37 | 21.86 | 22.27 | 12.11 | 9.99 | 15.1 | 13.9 | | | * | − |
| HEMBA1003856 | 3.23 | 2.48 | 1.56 | 1.62 | 2.7 | 2.03 | 1.6 | 2.63 | 2.09 | | | | |
| HEMBA1003857 | 5.6 | 3.94 | 4.15 | 8.14 | 11.16 | 11.16 | 4.4 | 7.01 | 4.61 | ** | + | | |
| HEMBA1003864 | 4.85 | 1.81 | 2.77 | 3.23 | 4.07 | 4.12 | 3.31 | 3.39 | 2.74 | | | | |
| HEMBA1003866 | 1.42 | 0.62 | 1.37 | 1.22 | 1.21 | 1.69 | 0.7 | 1.76 | 0.89 | | | | |
| HEMBA1003868 | 13.28 | 7.75 | 6.42 | 9.42 | 7.15 | 9.18 | 5.91 | 7.86 | 7.2 | | | | |
| HEMBA1003879 | 2.14 | 1.42 | 1.52 | 4.08 | 4.35 | 3.36 | 3.08 | 2.74 | 2.28 | ** | + | * | + |
| HEMBA1003880 | 4.68 | 2.16 | 2.83 | 4.05 | 4.87 | 3.64 | 3.32 | 3.39 | 3.6 | | | | |
| HEMBA1003884 | 5.74 | 3.71 | 3.92 | 4 | 4.49 | 5.17 | 4.44 | 4.54 | 4.54 | | | | |
| HEMBA1003885 | 10.32 | 6.22 | 7.2 | 14.27 | 16.75 | 16.47 | 8.29 | 8.14 | 8.72 | ** | + | | |
| HEMBA1003887 | 5.7 | 2.76 | 3.69 | 4.8 | 4.75 | 6.26 | 4.28 | 5.31 | 3.98 | | | | |
| HEMBA1003890 | 5.76 | 2.14 | 5.85 | 3.21 | 4.35 | 4.1 | 2.43 | 1.67 | 2.34 | | | | |
| HEMBA1003893 | 24.48 | 11.91 | 15.58 | 30.06 | 36.65 | 30.84 | 15.38 | 16.42 | 17.2 | * | + | | |
| HEMBA1003896 | 19.51 | 13.33 | 11.04 | 17.41 | 24 | 18.91 | 15.03 | 15.04 | 20.6 | | | | |
| HEMBA1003902 | 8.4 | 6.56 | 5.19 | 9.58 | 9.98 | 7.89 | 5.71 | 4.62 | 5.77 | | | | |

TABLE 180

| HEMBA1003904 | 2.78 | 1.45 | 1.43 | 2.77 | 2.17 | 1.59 | 1.47 | 2.66 | 1.69 | | | | |
| --- | --- | --- | --- | --- | --- | --- | --- | --- | --- | --- | --- | --- | --- |
| HEMBA1003908 | 1.69 | 1.16 | 1.22 | 2.42 | 2.58 | 2.06 | 1.92 | 2.64 | 1.46 | * | + | | |
| HEMBA1003926 | 72.36 | 45.24 | 46.72 | 61.75 | 49.96 | 64.94 | 25.26 | 18.43 | 24.45 | | | * | − |
| HEMBA1003937 | 3.1 | 1.85 | 1.98 | 6.12 | 8.5 | 7.61 | 2.66 | 5.69 | 3.16 | ** | + | | |
| HEMBA1003939 | 1.28 | 1.62 | 1.87 | 1.85 | 4.47 | 4.22 | 0.72 | 2.97 | 2.45 | | | | |
| HEMBA1003940 | 2.82 | 0.88 | 1.71 | 2.17 | 3.19 | 2.37 | 0.51 | 2.52 | 1.7 | | | | |
| HEMBA1003941 | 4.35 | 2.77 | 1.79 | 1.96 | 4.65 | 3.03 | 2.55 | 3.88 | 2.82 | | | | |

TABLE 180-continued

| | | | | | | | | | | | | | |
|---|---|---|---|---|---|---|---|---|---|---|---|---|---|
| HEMBA1003942 | 2.44 | 1.82 | 1.09 | 3.64 | 3.65 | 2.58 | 2.38 | 2.63 | 2.03 | * | + | | |
| HEMBA1003945 | 9.46 | 3.83 | 5.74 | 8.44 | 8.96 | 9.42 | 7.88 | 6.57 | 7.46 | | | | |
| HEMBA1003949 | 2.14 | 1.99 | 0.59 | 2.89 | 3.58 | 3.78 | 1.92 | 2.25 | 1.36 | * | + | | |
| HEMBA1003950 | 1.45 | 1.52 | 0.64 | 1.83 | 1.87 | 1.76 | 1.11 | 1.8 | 1.56 | | | | |
| HEMBA1003953 | 1.96 | 0.44 | 1.34 | 3.08 | 3.28 | 3.34 | 1.95 | 3.21 | 1.37 | * | + | | |
| HEMBA1003958 | 6.98 | 4.78 | 4.74 | 10.87 | 13.86 | 10.68 | 4.23 | 6.52 | 6.23 | ** | + | | |
| HEMBA1003959 | 2.84 | 3.02 | 3.46 | 6.74 | 9.97 | 6.27 | 2.64 | 3.74 | 2.94 | * | + | | |
| HEMBA1003960 | 7.33 | 2.27 | 2.98 | 3.59 | 5.1 | 3.92 | 2.8 | 3.92 | 3.79 | | | | |
| HEMBA1003966 | 4.91 | 3.07 | 2.16 | 3.5 | 4.6 | 3.28 | 2.1 | 2.93 | 3.48 | | | | |
| HEMBA1003967 | 5.85 | 3.63 | 2.68 | 3.94 | 3.8 | 3.19 | 1.89 | 3.17 | 2.35 | | | | |
| HEMBA1003968 | 3.76 | 2.02 | 2.13 | 4.21 | 6.16 | 3.59 | 4.13 | 4.11 | 3.84 | | | | |
| HEMBA1003974 | 41.47 | 29.67 | 25.73 | 95.3 | 104.1 | 103.5 | 100 | 82.53 | 110.2 | ** | + | ** | + |
| HEMBA1003976 | 2.48 | 1.1 | 1.38 | 2.13 | 2.25 | 2.22 | 1.34 | 1.82 | 1.6 | | | | |
| HEMBA1003977 | 2.19 | 1.38 | 1.4 | 2.42 | 3.02 | 1.57 | 1.86 | 1.96 | 1.93 | | | | |
| HEMBA1003978 | 2.44 | 1.5 | 1.92 | 3.24 | 3.34 | 3.85 | 1.9 | 2.87 | 2.37 | * | + | | |
| HEMBA1003981 | 7.98 | 4.15 | 3.07 | 6.67 | 7.3 | 7.05 | 6.37 | 6.68 | 8.81 | | | | |
| HEMBA1003982 | 6.94 | 4.75 | 3.19 | 18.33 | 22.13 | 23.04 | 19.29 | 21.74 | 19.78 | ** | + | ** | + |
| HEMBA1003985 | 2.27 | 1.26 | 0.95 | 3.01 | 1.91 | 1.85 | 1.02 | 2.35 | 1.03 | | | | |
| HEMBA1003987 | 3.79 | 1.42 | 2.2 | 4.67 | 5.44 | 5.59 | 3.67 | 4.19 | 3.44 | * | + | | |
| HEMBA1003989 | 2.32 | 1.65 | 1.59 | 4.16 | 4.13 | 5.73 | 3.24 | 3.75 | 3.69 | ** | + | ** | + |
| HEMBA1004000 | 1.83 | 1.8 | 1.37 | 4.32 | 4.14 | 3.96 | 2.63 | 3.55 | 2.34 | ** | + | * | + |
| HEMBA1004006 | 1.37 | 0.24 | 1.22 | 2.13 | 0.94 | 1.32 | 1.17 | 2.2 | 0.95 | | | | |
| HEMBA1004007 | 6.04 | 2.39 | 4.27 | 10.96 | 12.86 | 11.45 | 4.4 | 6.87 | 6.82 | ** | + | | |
| HEMBA1004010 | 2.94 | 1.19 | 1.2 | 2.7 | 3.56 | 3.85 | 6.4 | 6.08 | 6.71 | | | ** | + |
| HEMBA1004011 | 1.7 | 0.78 | 0.96 | 2.15 | 2.36 | 1.93 | 1.31 | 2.48 | 1.53 | * | + | | |
| HEMBA1004012 | 3.28 | 1.3 | 2.31 | 6.01 | 4.99 | 6.51 | 2.69 | 3.48 | 2.84 | ** | + | | |
| HEMBA1004015 | 2.75 | 2.05 | 2.56 | 5.11 | 5.22 | 4.78 | 3.43 | 3.89 | 3.43 | ** | + | * | + |
| HEMBA1004024 | 5.55 | 4.27 | 3.76 | 12.33 | 16.73 | 14.13 | 7.3 | 6.98 | 6.78 | ** | + | * | + |
| HEMBA1004029 | 4.41 | 3.27 | 3.73 | 8.08 | 10.91 | 6.74 | 3.3 | 6.61 | 3.72 | * | + | | |
| HEMBA1004038 | 2.95 | 1.3 | 1.87 | 2.87 | 2.27 | 1.5 | 1.15 | 4.52 | 1.31 | | | | |
| HEMBA1004042 | 0.98 | 0.07 | 0.48 | 1.39 | 1.07 | 0.6 | 0.74 | 2.16 | 0.79 | | | | |
| HEMBA1004045 | 1.3 | 0.85 | 0.68 | 0.88 | 3.2 | 1.57 | 1.01 | 1.7 | 0.88 | | | | |
| HEMBA1004048 | 7.55 | 3.12 | 4.4 | 8.61 | 11.26 | 7.66 | 7.55 | 7.12 | 7.08 | | | | |
| HEMBA1004049 | 1.17 | 0.64 | 0.7 | 2.26 | 3.05 | 2.36 | 1.86 | 2.62 | 1.77 | ** | + | * | + |
| HEMBA1004051 | 4.38 | 1.98 | 1.73 | 3.51 | 4.36 | 4.02 | 9.79 | 8.74 | 8.15 | | | ** | + |
| HEMBA1004053 | 8.83 | 5.44 | 4.46 | 17.89 | 9.59 | 13.59 | 14.13 | 13.15 | 12.39 | | | ** | + |
| HEMBA1004055 | 2.65 | 0.36 | 1.81 | 2.57 | 2.89 | 2.7 | 1.3 | 3 | 1.6 | | | | |
| HEMBA1004056 | 7.5 | 3.93 | 5.65 | 20.02 | 18.97 | 17.23 | 8.27 | 9.56 | 8.48 | ** | + | * | + |
| HEMBA1004060 | 0.07 | 0.43 | 1.07 | 1.82 | 1.29 | 1.56 | 0.47 | 1.74 | 1.31 | * | + | | |
| HEMBA1004061 | 14.25 | 5.05 | 4.22 | 4.44 | 4.07 | 3.17 | 2.96 | 3.91 | 3.1 | | | | |
| HEMBA1004067 | 9.19 | 5.05 | 5.06 | 7.71 | 7.13 | 7.12 | 4.94 | 6.2 | 7.71 | | | | |
| HEMBA1004071 | 14.49 | 9.52 | 7.51 | 14.12 | 12.05 | 13.02 | 8.33 | 9.62 | 10.66 | | | | |
| HEMBA1004074 | 7.06 | 2.77 | 2.38 | 5.08 | 5.28 | 4.16 | 4.21 | 4.55 | 5.63 | | | | |
| HEMBA1004078 | 11.34 | 10.72 | 8 | 8.83 | 11.03 | 9.34 | 8.26 | 9.99 | 8.73 | | | | |
| HEMBA1004085 | 3.75 | 2.6 | 2.94 | 3.51 | 4.46 | 4.01 | 3.83 | 4.11 | 2.49 | | | | |
| HEMBA1004086 | 9.29 | 6.04 | 5.26 | 10.09 | 10 | 10.42 | 3.43 | 2.6 | 4.21 | | | | |
| HEMBA1004097 | 2.9 | 2.64 | 1.85 | 1.78 | 5.31 | 3.52 | 1.65 | 4.02 | 2.63 | | | | |
| HEMBA1004100 | 5.05 | 2.67 | 3.16 | 5.99 | 4.86 | 5.28 | 5.44 | 5.79 | 5.01 | | | | |
| HEMBA1004103 | 10.13 | 4.33 | 3.51 | 10.84 | 11.41 | 10.36 | 6.76 | 6.57 | 8.64 | | | | |

TABLE 181

| | | | | | | | | | | | | | |
|---|---|---|---|---|---|---|---|---|---|---|---|---|---|
| HEMBA1004110 | 14.95 | 6.9 | 7.32 | 18.8 | 19.15 | 18.28 | 8.68 | 9.12 | 8.42 | * | + | | |
| HEMBA1004111 | 4.86 | 3.05 | 3.79 | 7.76 | 8.14 | 8.2 | 4.79 | 4.58 | 4.21 | ** | + | | |
| HEMBA1004124 | 6.94 | 3.7 | 4.42 | 6.1 | 3.89 | 4.52 | 4.49 | 4.21 | 4.75 | | | | |
| HEMBA1004130 | 9.54 | 3.62 | 3.55 | 9.36 | 10.43 | 9.03 | 4.61 | 5.66 | 5.54 | | | | |
| HEMBA1004131 | 4.85 | 3.97 | 3.36 | 3.86 | 4.83 | 4.69 | 2.77 | 4.06 | 2.93 | | | | |
| HEMBA1004132 | 3.06 | 2.1 | 4.1 | 5.2 | 8.61 | 9.33 | 4.36 | 6.28 | 4.36 | * | + | | |
| HEMBA1004133 | 4.53 | 2.37 | 1.71 | 4.62 | 2.8 | 5.4 | 3.39 | 2.94 | 3.1 | | | | |
| HEMBA1004138 | 4.15 | 2.09 | 2.18 | 3.1 | 3.45 | 2.71 | 3.21 | 2.5 | 3.12 | | | | |
| HEMBA1004143 | 5.3 | 2.88 | 3.04 | 7.57 | 5.72 | 6.31 | 5.7 | 5.05 | 4.79 | * | + | | |
| HEMBA1004146 | 4.2 | 1.65 | 2.04 | 5.44 | 5.59 | 4.27 | 2.49 | 3.4 | 3.26 | | | | |
| HEMBA1004148 | 6.71 | 2.61 | 2.68 | 3.24 | 3.23 | 4.49 | 2.38 | 4.66 | 3.54 | | | | |
| HEMBA1004149 | 1.73 | 0.7 | 0.91 | 2.13 | 2.29 | 1.85 | 1.73 | 1.38 | 1.4 | * | + | | |
| HEMBA1004150 | 1.14 | 0.72 | 0.48 | 0.29 | 0.95 | 0.79 | 0.76 | 1.47 | 0.27 | | | | |
| HEMBA1004154 | 10.52 | 5.49 | 6.9 | 6.41 | 6.4 | 7.33 | 4.84 | 8.66 | 5.4 | | | | |
| HEMBA1004164 | 7.02 | 3.4 | 3.27 | 9.28 | 10.11 | 8.81 | 5.16 | 5.49 | 5.3 | * | + | | |
| HEMBA1004168 | 11.84 | 7.61 | 6.03 | 3.62 | 4.76 | 4.13 | 3.34 | 2.92 | 1.89 | | | * | − |
| HEMBA1004199 | 0.92 | 0.62 | 0.74 | 1.67 | 1.3 | 1.87 | 1.47 | 1.95 | 1.4 | * | + | * | + |
| HEMBA1004200 | 1.57 | 1.23 | 0.4 | 3.73 | 3.83 | 2.53 | 1.99 | 2.05 | 1.43 | * | + | | |
| HEMBA1004201 | 3.89 | 3.07 | 2.03 | 3.6 | 4.1 | 3.75 | 2.3 | 4.41 | 3.45 | | | | |
| HEMBA1004202 | 4.9 | 3.79 | 2.27 | 2.88 | 2.3 | 2.76 | 2.58 | 3.69 | 2.7 | | | | |
| HEMBA1004203 | 5.77 | 1.33 | 2.87 | 2.88 | 5.01 | 4.03 | 2.05 | 3.68 | 2.38 | | | | |
| HEMBA1004207 | 0.56 | 0.3 | 0.47 | 1.04 | 1.74 | 1.87 | 0.89 | 2.13 | 1.31 | * | + | | |
| HEMBA1004210 | 8.61 | 6.61 | 6.14 | 2.77 | 2.66 | 3.95 | 1.89 | 2.45 | 2.61 | ** | − | ** | − |
| HEMBA1004225 | 5.03 | 3.74 | 3.98 | 8.75 | 9.84 | 8.6 | 5.26 | 5.3 | 4.25 | ** | + | | |

TABLE 181-continued

| | | | | | | | | | | | | | |
|---|---|---|---|---|---|---|---|---|---|---|---|---|---|
| HEMBA1004227 | 3.79 | 2.62 | 4.1 | 4.2 | 4.62 | 3.31 | 3.12 | 4.12 | 2.59 | | | | |
| HEMBA1004235 | 7.02 | 4 | 4.13 | 5.38 | 8.95 | 5.38 | 4.38 | 6.22 | 4.55 | | | | |
| HEMBA1004237 | 3.9 | 2.42 | 2.47 | 3.59 | 4.2 | 5.86 | 2.12 | 3.58 | 2.89 | | | | |
| HEMBA1004238 | 6.25 | 1.89 | 3.24 | 4.96 | 7.33 | 6.03 | 3.76 | 4.17 | 3.98 | | | | |
| HEMBA1004241 | 0.67 | 0.27 | 0.46 | 0.34 | 1.31 | 1.04 | 0.22 | 1.55 | 0.61 | | | | |
| HEMBA1004242 | 32.46 | 19.09 | 20.5 | 23.42 | 40.5 | 41.44 | 12.31 | 21.44 | 17.84 | | | | |
| HEMBA1004243 | 13.89 | 7.41 | 6.2 | 5.78 | 8.65 | 6.42 | 6.33 | 5.94 | 4.6 | | | | |
| HEMBA1004246 | 2.25 | 1.26 | 2.23 | 4.03 | 4.82 | 3.81 | 2.36 | 4.78 | 2.1 | ** | + | | |
| HEMBA1004247 | 5.45 | 2.79 | 1.32 | 2 | 4.11 | 3.23 | 3.04 | 3.5 | 3.55 | | | | |
| HEMBA1004248 | 1.69 | 0.88 | 1.09 | 3.22 | 4.63 | 3.53 | 2.79 | 3 | 3.44 | ** | + | ** | + |
| HEMBA1004250 | 2.2 | 1.27 | 1.09 | 2.31 | 1.66 | 2.1 | 1.9 | 1.53 | 1.16 | | | | |
| HEMBA1004252 | 3.18 | 2.82 | 2.3 | 4.58 | 5.09 | 4.33 | 3.04 | 3.66 | 2.93 | ** | + | | |
| HEMBA1004260 | 6.17 | 5.02 | 5.43 | 14.46 | 16.02 | 13.28 | 2.04 | 6.53 | 5.94 | ** | + | | |
| HEMBA1004264 | 2.63 | 0.93 | 1.56 | 1.92 | 3.23 | 2.09 | 0.78 | 1.85 | 0.77 | | | | |
| HEMBA1004267 | 17.36 | 9.92 | 10.53 | 28.33 | 30.44 | 23.65 | 13.63 | 14.33 | 15.75 | ** | + | | |
| HEMBA1004272 | 3.25 | 1.51 | 1.9 | 3.88 | 2.89 | 3.11 | 2.45 | 3.01 | 1.7 | | | | |
| HEMBA1004274 | 4.01 | 2.2 | 1.91 | 2.76 | 5.04 | 4.3 | 3.12 | 2.65 | 2.58 | | | | |
| HEMBA1004275 | 7.65 | 2.23 | 3.79 | 6.73 | 5.64 | 5.93 | 3.97 | 4.61 | 4.77 | | | | |
| HEMBA1004276 | 2.41 | 0.9 | 1.94 | 2.49 | 2.68 | 2.17 | 2.68 | 2.47 | 2.33 | | | | |
| HEMBA1004279 | 3.98 | 2.11 | 3.24 | 4.12 | 3.59 | 4.41 | 2.04 | 2.95 | 1.7 | | | | |
| HEMBA1004284 | 2.55 | 1.22 | 1.55 | 4.17 | 5.87 | 4.34 | 1.28 | 3.05 | 2.74 | * | + | | |
| HEMBA1004286 | 2.41 | 1.26 | 2.32 | 1.53 | 2.67 | 2.43 | 1.2 | 3 | 2.02 | | | | |
| HEMBA1004289 | 4.95 | 2.88 | 2.44 | 8.79 | 8.57 | 7.77 | 4.32 | 4.66 | 6.4 | ** | + | | |
| HEMBA1004293 | 20.86 | 17.2 | 15.27 | 23.95 | 23.65 | 21.96 | 12.13 | 13.81 | 16.34 | * | + | | |
| HEMBA1004295 | 3.05 | 1.8 | 2.64 | 2.91 | 2.85 | 3.02 | 1.98 | 3.55 | 3.48 | | | | |
| HEMBA1004302 | 0.66 | 0.43 | 0.5 | 1.59 | 1.46 | 1.59 | 1.57 | 2.55 | 1.32 | ** | + | * | + |
| HEMBA1004306 | 15.93 | 11.78 | 11.41 | 15.21 | 18.98 | 13.88 | 13.95 | 14.44 | 16.14 | | | | |
| HEMBA1004312 | 2.81 | 2.1 | 2.08 | 6.27 | 6.34 | 5.38 | 1.96 | 3.12 | 2.81 | ** | + | | |
| HEMBA1004314 | 2.53 | 1.33 | 1.74 | 4.02 | 5.28 | 5.79 | 1.6 | 3.72 | 2.38 | ** | + | | |
| HEMBA1004321 | 6.87 | 2.68 | 4.89 | 6.41 | 11.51 | 10.55 | 3.56 | 5.85 | 5.02 | | | | |
| HEMBA1004323 | 6.15 | 3.8 | 3.34 | 8.44 | 11.8 | 9.65 | 4.55 | 5.84 | 5.92 | * | + | | |
| HEMBA1004327 | 4.25 | 2.43 | 2.21 | 4.5 | 3.91 | 4.05 | 2.91 | 3.47 | 3.95 | | | | |

TABLE 182

| | | | | | | | | | | | | | |
|---|---|---|---|---|---|---|---|---|---|---|---|---|---|
| HEMBA1004329 | 6.64 | 4.05 | 3.69 | 10.1 | 11.36 | 10.31 | 6.59 | 6.39 | 7.21 | ** | + | | |
| HEMBA1004330 | 3.08 | 1.92 | 1.4 | 2.71 | 3.14 | 3.34 | 2.64 | 3.02 | 3.26 | | | | |
| HEMBA1004334 | 3.9 | 1.95 | 1.91 | 3.91 | 3.51 | 4.57 | 2.69 | 2.68 | 1.57 | | | | |
| HEMBA1004335 | 4.91 | 2.24 | 2.81 | 7.41 | 9.8 | 7.49 | 5.19 | 6.78 | 5.7 | * | + | | |
| HEMBA1004341 | 6.84 | 4.27 | 5.5 | 4.53 | 6.2 | 5.05 | 5.02 | 6.83 | 6.93 | | | | |
| HEMBA1004344 | 17.75 | 13.13 | 14.74 | 15.95 | 19.67 | 19.67 | 18.23 | 19.51 | 24.66 | | | | |
| HEMBA1004347 | 4.63 | 3.35 | 2.01 | 5.16 | 6.48 | 5.36 | 2.73 | 3.19 | 3.71 | | | | |
| HEMBA1004349 | 8.89 | 2.46 | 3.99 | 12.23 | 16.69 | 10.37 | 7.71 | 6.98 | 8.61 | * | + | | |
| HEMBA1004352 | 5.41 | 3.1 | 3.3 | 7.91 | 8.12 | 10.45 | 4.93 | 5.52 | 5.36 | * | + | | |
| HEMBA1004353 | 8.35 | 7.6 | 6.31 | 15.51 | 16.38 | 15.96 | 6.75 | 8.35 | 9.31 | ** | + | | |
| HEMBA1004354 | 4.38 | 1.54 | 2.32 | 5.25 | 5.81 | 6.37 | 3.27 | 4.92 | 3.61 | * | + | | |
| HEMBA1004356 | 2.81 | 2.85 | 3.03 | 5.06 | 4.66 | 5.46 | 5.28 | 5.77 | 4.17 | ** | + | * | + |
| HEMBA1004360 | 5.79 | 2.16 | 5.01 | 6.93 | 5.95 | 5.72 | 3.15 | 6.55 | 5.08 | | | | |
| HEMBA1004366 | 2.78 | 2.3 | 2.86 | 5.4 | 6.73 | 4.61 | 2.18 | 3.01 | 3.38 | * | + | | |
| HEMBA1004372 | 0.38 | 0.27 | 0.43 | 0.47 | 0.63 | 0.99 | 0.52 | 0.83 | 0.34 | | | | |
| HEMBA1004377 | 7.38 | 3.14 | 3.85 | 11.65 | 12.1 | 15.48 | 9.22 | 8.78 | 11.95 | ** | + | * | + |
| HEMBA1004389 | 18.67 | 11.71 | 10.38 | 8.69 | 8.39 | 17.15 | 9.23 | 8.15 | 7.38 | | | | |
| HEMBA1004391 | 2.93 | 2.48 | 2.45 | 7.42 | 5.09 | 7.12 | 3.62 | 4.64 | 3.41 | ** | + | * | + |
| HEMBA1004393 | 18.44 | 14.15 | 13.12 | 19.38 | 17.77 | 18.16 | 22.31 | 14.59 | 20.28 | | | | |
| HEMBA1004394 | 1.18 | 1.11 | 1.72 | 2.3 | 1.6 | 2.38 | 1.09 | 4.42 | 1.46 | | | | |
| HEMBA1004396 | 1.79 | 1.02 | 1.22 | 3.41 | 3.48 | 3.73 | 1.3 | 3.02 | 1.73 | ** | + | | |
| HEMBA1004401 | 4.73 | 3.38 | 4.96 | 4.16 | 4.54 | 5.13 | 2.63 | 5.44 | 3.27 | | | | |
| HEMBA1004405 | 3.95 | 2.13 | 1.81 | 6.15 | 8.26 | 6.59 | 3.78 | 4.33 | 5.63 | ** | + | | |
| HEMBA1004408 | 5.72 | 3.65 | 3.17 | 5.44 | 6.45 | 4.46 | 2.34 | 3.68 | 2.97 | | | | |
| HEMBA1004414 | 8.38 | 4.86 | 5.28 | 9.94 | 19.52 | 21.58 | 6.98 | 7.48 | 7.61 | * | + | | |
| HEMBA1004429 | 3.38 | 2.07 | 1.78 | 8.58 | 8.61 | 9.23 | 4.27 | 3.18 | 4.51 | ** | + | | |
| HEMBA1004433 | 1.82 | 1.56 | 1.04 | 5.34 | 5.56 | 5.46 | 1.92 | 2.85 | 2.38 | ** | + | | |
| HEMBA1004440 | 2.19 | 0.58 | 1.67 | 2.76 | 2.16 | 2.15 | 1.08 | 2.89 | 1.62 | | | | |
| HEMBA1004444 | 4.28 | 2 | 2.33 | 6.71 | 7.29 | 10.11 | 5.5 | 5.93 | 3.39 | * | + | | |
| HEMBA1004446 | 1.19 | 0.41 | 1.18 | 2.01 | 2.51 | 2.6 | 0.58 | 1.63 | 1.83 | * | + | | |
| HEMBA1004451 | 4.92 | 5.14 | 2.78 | 5.62 | 4.16 | 5.1 | 2.95 | 3.75 | 4.07 | | | | |
| HEMBA1004452 | 1.45 | 1.3 | 0.96 | 7.34 | 8.28 | 11.36 | 3.26 | 5.07 | 5.69 | ** | + | ** | + |
| HEMBA1004454 | 2.75 | 3.17 | 2.58 | 3.68 | 3.73 | 5.7 | 3.62 | 3.63 | 3.66 | | | * | + |
| HEMBA1004460 | 8.77 | 5.29 | 4.63 | 9.49 | 11.6 | 11.51 | 5.17 | 5.78 | 6.91 | * | + | | |
| HEMBA1004461 | 3.02 | 1.29 | 1.56 | 1.22 | 2.06 | 2.62 | 1.48 | 2 | 2.51 | | | | |
| HEMBA1004468 | 9.69 | 5.12 | 5.83 | 5.76 | 9.08 | 12.25 | 6.18 | 7.22 | 5.91 | | | | |
| HEMBA1004479 | 5.17 | 2.6 | 2.53 | 3.06 | 4.8 | 5.24 | 1.98 | 4.08 | 3.44 | | | | |
| HEMBA1004482 | 2.81 | 3.98 | 3.7 | 2.47 | 3.92 | 2.52 | 2.59 | 2.29 | 3.11 | | | | |
| HEMBA1004491 | 1.37 | 1 | 0.96 | 1.25 | 1.97 | 1.96 | 0.89 | 1.47 | 2.84 | | | | |
| HEMBA1004499 | 6.22 | 5.75 | 3.57 | 9.95 | 9.17 | 8.62 | 6.22 | 6.62 | 6.45 | * | + | | |
| HEMBA1004502 | 3.1 | 2.59 | 1.77 | 4.11 | 5.34 | 4.51 | 4.17 | 2.98 | 4.03 | * | + | | |

TABLE 182-continued

| | | | | | | | | | | | | | |
|---|---|---|---|---|---|---|---|---|---|---|---|---|---|
| HEMBA1004505 | 4.8 | 2.59 | 1.93 | 2.42 | 4.25 | 3.38 | 2.91 | 2.43 | 2.1 | | | | |
| HEMBA1004506 | 2.39 | 1.28 | 1.21 | 2.96 | 3.46 | 3.27 | 2.23 | 2.51 | 1.92 | * | + | | |
| HEMBA1004507 | 70.44 | 39.05 | 46.26 | 43.39 | 51.75 | 50.62 | 19.17 | 24.55 | 22.93 | | | * | − |
| HEMBA1004509 | 5.46 | 3.62 | 4.71 | 3.53 | 4.82 | 5.37 | 2.96 | 3.83 | 2.3 | | | | |
| HEMBA1004523 | 1.41 | 0.75 | 0.59 | 1.16 | 1.53 | 1.37 | 1.32 | 1.24 | 1.24 | | | | |
| HEMBA1004528 | 3.19 | 1.97 | 1.1 | 3.38 | 4.01 | 3.33 | 4.31 | 3.09 | 4.88 | | | | |
| HEMBA1004534 | 6.12 | 2.73 | 4 | 6.77 | 8.18 | 7.93 | 6.04 | 5.56 | 6.21 | * | + | | |
| HEMBA1004536 | 4.76 | 3.38 | 3.05 | 3.55 | 4.6 | 4.52 | 2.5 | 2.23 | 2.99 | | | | |
| HEMBA1004538 | 21.21 | 15.5 | 13.77 | 31.9 | 33.44 | 32.76 | 19.4 | 20.15 | 17.02 | ** | + | | |
| HEMBA1004542 | 2.99 | 2.19 | 1.59 | 3.03 | 3.58 | 3.02 | 3.51 | 3.43 | 2.25 | | | | |
| HEMBA1004552 | 7.56 | 6.12 | 5.53 | 7.59 | 13.46 | 14.87 | 4.88 | 6.44 | 7.28 | | | | |
| HEMBA1004554 | 2.07 | 2.28 | 0.95 | 2.8 | 2.16 | 2.43 | 2.95 | 3.09 | 3.26 | | | * | + |
| HEMBA1004558 | 11.57 | 6.62 | 6.21 | 7.21 | 8.48 | 8.56 | 6.35 | 6.8 | 7.65 | | | | |
| HEMBA1004560 | 4.78 | 3.27 | 2.78 | 3.55 | 5.31 | 4.2 | 5.01 | 4.88 | 3.58 | | | | |
| HEMBA1004564 | 7.43 | 4.79 | 5.05 | 12.74 | 14.02 | 11.12 | 5.94 | 7.39 | 6.24 | ** | + | | |

TABLE 183

| | | | | | | | | | | | | | |
|---|---|---|---|---|---|---|---|---|---|---|---|---|---|
| HEMBA1004566 | 28.53 | 23.96 | 23.72 | 13.72 | 19.42 | 18.07 | 12.15 | 16.7 | 14.58 | * | − | ** | − |
| HEMBA1004573 | 2.19 | 1.72 | 1.51 | 3.93 | 5.22 | 5.71 | 3.32 | 3.47 | 1.99 | ** | + | | |
| HEMBA1004576 | 2.94 | 1.45 | 1.92 | 18.03 | 33.01 | 34.57 | 7.81 | 8.41 | 10.12 | ** | + | ** | + |
| HEMBA1004577 | 5 | 2.83 | 2.54 | 7.07 | 10.98 | 8.6 | 4.13 | 8.82 | 4.99 | * | + | | |
| HEMBA1004586 | 5.72 | 3.41 | 4.19 | 8.7 | 7.46 | 11.19 | 4.1 | 6.11 | 4.48 | * | + | | |
| HEMBA1004596 | 4.81 | 2.28 | 2.02 | 2.98 | 3.67 | 3.46 | 2.47 | 2.61 | 3 | | | | |
| HEMBA1004604 | 6.48 | 4.01 | 3.96 | 4.74 | 6.55 | 5.9 | 8.49 | 6.15 | 4.83 | | | | |
| HEMBA1004607 | 3.7 | 2.23 | 1.35 | 4.64 | 5.86 | 4.48 | 2.81 | 3.79 | 3.93 | * | + | | |
| HEMBA1004610 | 4.03 | 2.57 | 2.33 | 4.52 | 5.94 | 4.83 | 3.02 | 2.81 | 3 | * | + | | |
| HEMBA1004617 | 2.21 | 4.92 | 1 | 2.84 | 9.03 | 3.69 | 1.85 | 2.86 | 2.94 | | | | |
| HEMBA1004622 | 5.45 | 3.28 | 2.52 | 5.48 | 8.39 | 9.1 | 4.14 | 4.48 | 4.68 | | | | |
| HEMBA1004626 | 4.11 | 2.56 | 2.25 | 5.1 | 4.71 | 5.91 | 2.73 | 4.36 | 3.32 | * | + | | |
| HEMBA1004629 | 3.07 | 1.77 | 1.42 | 3.68 | 3.77 | 4.82 | 1.19 | 3.75 | 1.18 | * | + | | |
| HEMBA1004631 | 1.43 | 2.39 | 0.95 | 2.12 | 1.94 | 2.84 | 2.88 | 1.6 | 2.44 | | | | |
| HEMBA1004632 | 2.27 | 1.83 | 1.79 | 2.78 | 2.92 | 1.76 | 2.34 | 3.5 | 2 | | | | |
| HEMBA1004633 | 7.83 | 5.66 | 4.81 | 4.47 | 6.1 | 5.15 | 5.55 | 4.15 | 5.55 | | | | |
| HEMBA1004636 | 6.11 | 4.03 | 3.37 | 5.56 | 5.52 | 5.5 | 4.94 | 4.1 | 4.16 | | | | |
| HEMBA1004637 | 3.8 | 2.43 | 1.85 | 2.17 | 3.96 | 3.28 | 2.95 | 2.5 | 2 | | | | |
| HEMBA1004638 | 1.58 | 0.7 | 0.19 | 0.85 | 2.26 | 3.04 | 1.06 | 1.19 | 1.64 | | | | |
| HEMBA1004645 | 4.58 | 1.72 | 2.46 | 3.58 | 5.23 | 5.82 | 2.85 | 4.55 | 3.78 | | | | |
| HEMBA1004656 | 3.49 | 2.49 | 3.49 | 3.55 | 3.42 | 3.65 | 2.19 | 3.03 | 2 | | | | |
| HEMBA1004657 | 23.62 | 14.49 | 14.4 | 48.51 | 47.67 | 43.85 | 51.21 | 56.08 | 58.34 | ** | + | ** | + |
| HEMBA1004666 | 1.8 | 1.42 | 1.03 | 2.78 | 2.47 | 2.72 | 1.97 | 2.35 | 2.06 | ** | + | * | + |
| HEMBA1004669 | 5.4 | 3.16 | 2.59 | 6.16 | 6.23 | 6.59 | 2.94 | 2.65 | 2.66 | * | + | | |
| HEMBA1004670 | 4.37 | 2.24 | 2 | 5.27 | 6.01 | 4.17 | 2.94 | 3.39 | 4.41 | | | | |
| HEMBA1004672 | 5.55 | 2.84 | 2.98 | 5.68 | 8.28 | 8.14 | 3.49 | 6.01 | 3.36 | * | + | | |
| HEMBA1004689 | 43.34 | 14.93 | 30.58 | 21.98 | 24.65 | 26.05 | 13.05 | 14.68 | 11.72 | | | | |
| HEMBA1004690 | 4.61 | 2.61 | 2.69 | 2.94 | 2.18 | 2.84 | 1.97 | 4.01 | 2.41 | | | | |
| HEMBA1004693 | 2.15 | 1.25 | 1.33 | 2.01 | 3.2 | 3.06 | 1.39 | 3.08 | 2 | | | | |
| HEMBA1004697 | 7.39 | 3.61 | 2.79 | 5.75 | 7.36 | 9.2 | 5.36 | 4.7 | 6.2 | | | | |
| HEMBA1004702 | 21.02 | 14.02 | 11.62 | 9.2 | 10.6 | 12.82 | 11.9 | 12.65 | 12.79 | | | | |
| HEMBA1004704 | 6.08 | 3.81 | 3.24 | 8.5 | 8.45 | 8.19 | 4.75 | 5.52 | 5.39 | * | + | | |
| HEMBA1004705 | 1.15 | 0.61 | 0.21 | 1.49 | 1.26 | 1.73 | 1.37 | 1.44 | 1.36 | | | | |
| HEMBA1004706 | 3.9 | 2.72 | 2.07 | 2.01 | 3.27 | 2.47 | 3.18 | 2.94 | 2.37 | | | | |
| HEMBA1004709 | 3.4 | 2.4 | 2.61 | 5.18 | 5.97 | 7.11 | 2.19 | 3.92 | 3.09 | ** | + | | |
| HEMBA1004711 | 3.02 | 1.29 | 2.07 | 2.19 | 3.65 | 3.64 | 1.38 | 3.22 | 1.38 | | | | |
| HEMBA1004723 | 9.52 | 5.41 | 7.44 | 9.15 | 11.88 | 10.6 | 5.92 | 9.59 | 6.27 | | | | |
| HEMBA1004725 | 5.24 | 3.87 | 3.31 | 6.21 | 5.61 | 5.19 | 5.65 | 5.85 | 6.52 | | | * | + |
| HEMBA1004730 | 1.7 | 2.99 | 1.13 | 11.04 | 3.71 | 3.48 | 1.14 | 4.24 | 1.15 | | | | |
| HEMBA1004733 | 1.86 | 1.11 | 1.27 | 1.93 | 2.88 | 2.54 | 1.38 | 2.89 | 2.03 | * | + | | |
| HEMBA1004734 | 2.06 | 1.99 | 1.5 | 2.15 | 2.83 | 2.85 | 2.1 | 2.82 | 2.29 | | | | |
| HEMBA1004736 | 3.46 | 3.3 | 2.73 | 5.69 | 8.26 | 7.15 | 2.94 | 3.83 | 4.08 | ** | + | | |
| HEMBA1004748 | 4.24 | 1.57 | 1.93 | 4.83 | 6.28 | 6.83 | 2.64 | 4.21 | 2.49 | * | + | | |
| HEMBA1004749 | 7.35 | 4.59 | 5.33 | 5.23 | 6.38 | 10.26 | 4.24 | 7.9 | 6.41 | | | | |
| HEMBA1004751 | 3.74 | 2.05 | 2.99 | 5.29 | 6.07 | 7.15 | 2.9 | 5.44 | 3.62 | * | + | | |
| HEMBA1004752 | 5.63 | 3.05 | 2.11 | 4.83 | 5.66 | 7.24 | 4.55 | 3.43 | 5.1 | | | | |
| HEMBA1004753 | 85.27 | 60.35 | 45.13 | 73.61 | 76.67 | 82.04 | 35.88 | 33.51 | 34.18 | | | | |
| HEMBA1004755 | 12.21 | 10.42 | 8.56 | 18.13 | 22.58 | 19.53 | 19.43 | 13.65 | 17 | ** | + | * | + |
| HEMBA1004756 | 1.98 | 0.4 | 0.9 | 1.17 | 2.37 | 1.88 | 1.4 | 2.86 | 2.34 | | | | |
| HEMBA1004758 | 3.05 | 2.33 | 2.23 | 5.05 | 4.15 | 4.14 | 2.36 | 3.68 | 2.72 | ** | + | | |
| HEMBA1004763 | 2.53 | 2.54 | 2.42 | 3.64 | 3.57 | 2.87 | 2.52 | 4.35 | 2.6 | * | + | | |
| HEMBA1004768 | 0.63 | 0.57 | 0.48 | 2.03 | 2.91 | 1.86 | 1.11 | 2.85 | 0.94 | ** | + | | |
| HEMBA1004770 | 1.17 | 0.28 | 1.04 | 3.43 | 2.96 | 3.94 | 2.26 | 2.05 | 1.62 | ** | + | * | + |
| HEMBA1004771 | 3.01 | 1.5 | 1.36 | 3.25 | 3.04 | 3.46 | 2.2 | 2.12 | 2.05 | | | | |
| HEMBA1004775 | 6.8 | 4.62 | 3.7 | 7.13 | 8.07 | 9.04 | 7.62 | 7.16 | 8.82 | * | + | | |
| HEMBA1004776 | 3.71 | 2.57 | 1.18 | 9.61 | 3.42 | 2.31 | 3.1 | 3.48 | 4.38 | | | | |

TABLE 184

| | | | | | | | | | | | | | |
|---|---|---|---|---|---|---|---|---|---|---|---|---|---|
| HEMBA1004778 | 4.28 | 3.09 | 3.12 | 5.87 | 7.81 | 8.46 | 5.37 | 4.86 | 3.66 | * | + | | |
| HEMBA1004784 | 1.55 | 1.14 | 0.87 | 1.97 | 2.67 | 2.4 | 1.81 | 2.87 | 1.66 | * | + | | |
| HEMBA1004785 | 2.2 | 0.85 | 1.41 | 2.94 | 2.11 | 2.82 | 2.94 | 3.76 | 2.42 | | | * | + |
| HEMBA1004789 | 2.02 | 2.15 | 2.94 | 6 | 4.66 | 4.07 | 4.12 | 6.23 | 6.59 | * | + | * | + |
| HEMBA1004795 | 1.94 | 0.91 | 1.99 | 4.74 | 2.62 | 2.39 | 1.99 | 2.85 | 2.46 | | | | |
| HEMBA1004797 | 3.34 | 1.51 | 1.57 | 3.19 | 4.14 | 4.19 | 3.42 | 2.94 | 4.14 | | | | |
| HEMBA1004803 | 1.73 | 1.53 | 0.52 | 3.19 | 3.28 | 3.24 | 3.3 | 2.11 | 2.68 | ** | + | * | + |
| HEMBA1004806 | 1.99 | 0.24 | 0.76 | 2.51 | 2.13 | 1.62 | 1.14 | 2.33 | 1.41 | | | | |
| HEMBA1004807 | 6.07 | 4.25 | 4.5 | 4.85 | 8.03 | 9.33 | 4.48 | 5.59 | 5.41 | | | | |
| HEMBA1004816 | 3.49 | 2.36 | 1.89 | 3.34 | 3.8 | 3.31 | 2.37 | 4.02 | 1.69 | | | | |
| HEMBA1004820 | 1.49 | 1.14 | 1.32 | 2.51 | 2.88 | 2.8 | 1.5 | 4.47 | 1.86 | ** | + | | |
| HEMBA1004833 | 7.98 | 3.57 | 4.1 | 7.09 | 8.03 | 7.72 | 4.99 | 7.63 | 6.59 | | | | |
| HEMBA1004847 | 6.33 | 4.11 | 5.21 | 8.38 | 7.16 | 8.48 | 4.35 | 8.93 | 6.34 | * | + | | |
| HEMBA1004850 | 3.92 | 2.57 | 2.41 | 5.26 | 3.09 | 3.63 | 3.54 | 3.4 | 5.81 | | | | |
| HEMBA1004863 | 4.26 | 1.79 | 2.07 | 6.34 | 5.16 | 5.37 | 2.36 | 2.91 | 5.42 | * | + | | |
| HEMBA1004864 | 8.29 | 3.32 | 3.08 | 5.48 | 7.27 | 7.94 | 4.75 | 3.71 | 4.59 | | | | |
| HEMBA1004865 | 1.92 | 1.18 | 0.62 | 2.11 | 6.7 | 3.86 | 2.14 | 1.94 | 1.68 | | | | |
| HEMBA1004880 | 4.54 | 3.09 | 3.36 | 6.03 | 7.12 | 7.25 | 3.5 | 4.7 | 4.49 | ** | + | | |
| HEMBA1004882 | 5.35 | 4.05 | 3.06 | 4.2 | 4.72 | 3.45 | 2.62 | 4.51 | 3.09 | | | | |
| HEMBA1004885 | 1.17 | 0.68 | 0.57 | 1.14 | 0.82 | 0.86 | 0.53 | 1 | 0.47 | | | | |
| HEMBA1004889 | 3.26 | 2.08 | 1.7 | 3.09 | 2.94 | 3.37 | 2.23 | 2.83 | 5.72 | | | | |
| HEMBA1004900 | 1.39 | 1.1 | 0.25 | 1.7 | 1.35 | 1.1 | 1.57 | 1.47 | 1.61 | | | | |
| HEMBA1004909 | 6.14 | 4.05 | 3.74 | 6.91 | 8 | 7.96 | 4.94 | 4.32 | 5.82 | * | + | | |
| HEMBA1004918 | 4.98 | 2.15 | 2.73 | 5.38 | 6.39 | 6.51 | 3.65 | 3 | 3.79 | * | + | | |
| HEMBA1004923 | 1.88 | 1.64 | 1.69 | 3.18 | 2.96 | 3.02 | 2.23 | 2.61 | 2.53 | ** | + | ** | + |
| HEMBA1004929 | 2.42 | 1.04 | 1.11 | 2.68 | 2.08 | 2.3 | 2.43 | 1.05 | 1.27 | | | | |
| HEMBA1004930 | 5.54 | 5.02 | 5.16 | 8.04 | 11.27 | 11.38 | 5.24 | 6.2 | 5.58 | * | + | | |
| HEMBA1004933 | 2.24 | 1.54 | 1.06 | 2 | 2.4 | 2.08 | 1.19 | 1.47 | 2.06 | | | | |
| HEMBA1004934 | 0.55 | 0.77 | 0.07 | 1.15 | 0.99 | 1.58 | 1.85 | 2.74 | 1.58 | * | + | * | + |
| HEMBA1004937 | 6.5 | 2.53 | 3.22 | 3.69 | 3.97 | 5.19 | 4.16 | 4.2 | 3.69 | | | | |
| HEMBA1004943 | 6.44 | 2.93 | 2.55 | 5.45 | 3.9 | 5.9 | 3.81 | 4.39 | 5.14 | | | | |
| HEMBA1004944 | 4.47 | 1.97 | 2.6 | 5.4 | 4.69 | 6.01 | 3.98 | 3.08 | 5.3 | * | + | | |
| HEMBA1004946 | 6.58 | 4.26 | 2.56 | 8.23 | 7.78 | 9.16 | 5.73 | 6.06 | 6.35 | * | + | | |
| HEMBA1004952 | 5.05 | 2.8 | 1.43 | 3.17 | 3.75 | 3.4 | 2.89 | 3.56 | 3.26 | | | | |
| HEMBA1004954 | 2.94 | 2.13 | 2.53 | 7.6 | 9.09 | 8.39 | 8.28 | 11.47 | 6.83 | ** | + | * | + |
| HEMBA1004956 | 1.7 | 0.98 | 0.85 | 2.16 | 2.35 | 1.65 | 2.19 | 1.65 | 0.68 | | | | |
| HEMBA1004960 | 4.22 | 1.35 | 1.83 | 3.33 | 4.35 | 3.89 | 3.18 | 2.33 | 2.62 | | | | |
| HEMBA1004971 | 2.85 | 2.08 | 2.33 | 3.11 | 3.19 | 2.48 | 4.48 | 3.31 | 3.12 | | | | |
| HEMBA1004972 | 7.97 | 3.44 | 5.28 | 7.05 | 7.91 | 7.94 | 4.91 | 4.41 | 4.71 | | | | |
| HEMBA1004973 | 4.05 | 2.96 | 1.6 | 4.3 | 3.46 | 4.03 | 3.1 | 2.58 | 3.76 | | | | |
| HEMBA1004977 | 14.24 | 10.04 | 6.48 | 10.74 | 14.23 | 17.72 | 5.8 | 5.62 | 5.43 | | | | |
| HEMBA1004978 | 3.63 | 3.21 | 1.82 | 4.34 | 4.05 | 5.53 | 3.79 | 4.18 | 2.53 | | | | |
| HEMBA1004980 | 2.51 | 2.43 | 1.78 | 4.29 | 5.14 | 5.81 | 2.73 | 3.03 | 2.97 | ** | + | | |
| HEMBA1004982 | 1.4 | 0.95 | 0.55 | 1.1 | 1.4 | 2.11 | 0.94 | 2.12 | 0.81 | | | | |
| HEMBA1004983 | 1.7 | 1.5 | 1.07 | 1.2 | 1.85 | 1.29 | 1.7 | 1.13 | 1.37 | | | | |
| HEMBA1004995 | 4.75 | 4.53 | 4.44 | 5.51 | 5.64 | 4.6 | 3.99 | 3.69 | 4.53 | | | | |
| HEMBA1005004 | 4.11 | 3.34 | 2.48 | 4.8 | 3.41 | 3.91 | 3.87 | 2.23 | 2.59 | | | | |
| HEMBA1005008 | 5.55 | 2.4 | 3.38 | 3.53 | 5.55 | 4.97 | 3.01 | 4.08 | 3.22 | | | | |
| HEMBA1005009 | 10.15 | 9.95 | 7.66 | 7.94 | 11.36 | 8.06 | 4.21 | 5.06 | 5.68 | | | ** | − |
| HEMBA1005019 | 6.33 | 2.93 | 3.49 | 4.34 | 5.65 | 6.43 | 4.58 | 6.41 | 4.98 | | | | |
| HEMBA1005021 | 5.34 | 2.42 | 3.36 | 5.76 | 5.02 | 6.07 | 3.05 | 4.52 | 3.35 | | | | |
| HEMBA1005029 | 7.09 | 2.85 | 5.15 | 5.79 | 6.77 | 7.31 | 4.12 | 4.52 | 4.02 | | | | |
| HEMBA1005035 | 13.39 | 11.61 | 9.27 | 16.88 | 22.86 | 20.98 | 13.14 | 12.08 | 14.81 | * | + | | |
| HEMBA1005036 | 9.37 | 4.9 | 6.57 | 4.71 | 7.3 | 8.39 | 7.97 | 8.49 | 9.16 | | | | |
| HEMBA1005039 | 2.56 | 2.26 | 1.97 | 3.46 | 4.91 | 5.18 | 2.9 | 3.33 | 3.77 | * | + | * | + |
| HEMBA1005047 | 3.73 | 2.69 | 2.58 | 2.7 | 3.22 | 4.69 | 3.19 | 3.28 | 3.52 | | | | |

TABLE 185

| | | | | | | | | | | | | | |
|---|---|---|---|---|---|---|---|---|---|---|---|---|---|
| HEMBA1005050 | 8.01 | 4.69 | 4.35 | 6.4 | 8.24 | 6.75 | 4.64 | 5.95 | 4.47 | | | | |
| HEMBA1005062 | 2.24 | 3.49 | 0.58 | 2.31 | 2.34 | 1.56 | 1.28 | 2.55 | 1.35 | | | | |
| HEMBA1005066 | 1.59 | 0.53 | 1.22 | 1.43 | 2.19 | 2.08 | 0.94 | 1.37 | 2.12 | | | | |
| HEMBA1005067 | 10.97 | 5.24 | 5.8 | 11.93 | 6.24 | 15.81 | 3.48 | 6.87 | 4.63 | | | | |
| HEMBA1005070 | 54.34 | 32.66 | 23.12 | 7.48 | 7.23 | 9.46 | 4.96 | 6.22 | 5.67 | * | − | * | − |
| HEMBA1005075 | 4.78 | 2.93 | 2.39 | 9.53 | 8.99 | 8.84 | 5.77 | 6.79 | 5.19 | ** | + | * | + |
| HEMBA1005078 | 9.58 | 7.81 | 5.77 | 9.39 | 9.72 | 10.05 | 5.01 | 5.86 | 6.72 | | | | |
| HEMBA1005079 | 12.04 | 7.57 | 6.48 | 19.42 | 17.72 | 15.43 | 8.5 | 9.75 | 11.45 | * | + | | |
| HEMBA1005083 | 2.66 | 1.46 | 0.66 | 1.94 | 3.02 | 2.07 | 1.27 | 2.07 | 1.73 | | | | |
| HEMBA1005084 | 7.91 | 6.72 | 4.77 | 5.71 | 7.85 | 8.74 | 5.49 | 4.34 | 5.97 | | | | |
| HEMBA1005088 | 2.86 | 1.68 | 1.86 | 2.41 | 5.46 | 5.18 | 1.67 | 3.51 | 1.49 | | | | |
| HEMBA1005089 | 5.98 | 4.14 | 4.5 | 9.36 | 10.56 | 9.53 | 2.93 | 5.59 | 4.57 | ** | + | | |
| HEMBA1005090 | 33.54 | 22.43 | 17.55 | 44.06 | 43.43 | 42.47 | 20.48 | 22.61 | 17.3 | * | + | | |
| HEMBA1005096 | 5.76 | 3.96 | 4.37 | 6.03 | 5.87 | 6.22 | 4.23 | 3.3 | 6.27 | | | | |
| HEMBA1005101 | 5.71 | 2.76 | 3.85 | 3.75 | 5.23 | 3.72 | 2.48 | 3.36 | 3.77 | | | | |
| HEMBA1005107 | 4.5 | 1.82 | 2.91 | 2.69 | 3.89 | 3.12 | 3.06 | 3.74 | 2.52 | | | | |
| HEMBA1005113 | 1.43 | 0.81 | 0.45 | 8.23 | 11.09 | 10.71 | 5.43 | 5.23 | 6.51 | ** | + | ** | + |

TABLE 185-continued

| | | | | | | | | | | | | | |
|---|---|---|---|---|---|---|---|---|---|---|---|---|---|
| HEMBA1005123 | 10.61 | 5.86 | 5.3 | 15.09 | 21.59 | 18.64 | 8.57 | 8.85 | 8.33 | * | + | | |
| HEMBA1005133 | 2.6 | 2.55 | 2.08 | 5.44 | 6.93 | 6.67 | 3.17 | 4.12 | 2.67 | ** | + | | |
| HEMBA1005135 | 1.91 | 1.13 | 1.66 | 1.75 | 3.38 | 1.54 | 1.31 | 3.02 | 1.14 | | | | |
| HEMBA1005145 | 16.67 | 9.87 | 9.21 | 12.39 | 15.8 | 16.28 | 8.2 | 10.27 | 10.61 | | | | |
| HEMBA1005149 | 10.32 | 5.61 | 5.06 | 11.44 | 12.5 | 12.06 | 7.17 | 8.59 | 7.71 | * | + | | |
| HEMBA1005152 | 6.34 | 4.06 | 3.55 | 9.52 | 11.4 | 12.18 | 3.28 | 4.04 | 5.79 | ** | + | | |
| HEMBA1005159 | 0.7 | 1.49 | 0.94 | 1.57 | 2.36 | 1.76 | 1.22 | 2.54 | 0.91 | | | | |
| HEMBA1005172 | 43.22 | 25.23 | 24.37 | 33.5 | 39.86 | 37.96 | 32.09 | 25.74 | 34.44 | | | | |
| HEMBA1005185 | 4.97 | 4.57 | 2.99 | 2.86 | 3.27 | 4.08 | 2.48 | 3.14 | 1.7 | | | | |
| HEMBA1005186 | 3.35 | 2.42 | 3.23 | 5.64 | 6.25 | 4.46 | 2.06 | 2.21 | 2.79 | * | + | | |
| HEMBA1005195 | 1.99 | 0.84 | 0.81 | 1.89 | 2.31 | 1.52 | 1.31 | 2.87 | 1.25 | | | | |
| HEMBA1005201 | 6.2 | 5.19 | 2.55 | 5.77 | 6.88 | 6.27 | 4.89 | 5.22 | 6.55 | | | | |
| HEMBA1005202 | 8.96 | 4.63 | 5.23 | 6.96 | 8.01 | 6.67 | 8.1 | 7.62 | 9.46 | | | | |
| HEMBA1005204 | 113.3 | 93.42 | 81.36 | 145.9 | 165 | 106.5 | 90.09 | 59.5 | 89.11 | | | | |
| HEMBA1005206 | 6.48 | 3.93 | 4.87 | 5.9 | 5.71 | 6.15 | 4.98 | 4.32 | 4.52 | | | | |
| HEMBA1005219 | 2.14 | 1.72 | 1.8 | 4.03 | 2.98 | 2.85 | 3.28 | 4.04 | 4.31 | * | + | ** | + |
| HEMBA1005223 | 3.02 | 2.16 | 2.78 | 4.29 | 3.41 | 4.21 | 2.9 | 3.66 | 3.28 | * | + | | |
| HEMBA1005229 | 0.71 | 0.07 | 0.59 | 1.25 | 1.02 | 0.47 | 0.51 | 2.08 | 0.98 | | | | |
| HEMBA1005230 | 4.24 | 4.62 | 2.37 | 7.34 | 7.76 | 6.64 | 2.52 | 4.81 | 4.22 | * | + | | |
| HEMBA1005232 | 0.15 | 0.54 | 0.47 | 1.05 | 1.44 | 1.37 | 1.1 | 0.73 | 0.86 | ** | + | * | + |
| HEMBA1005238 | 5.05 | 3.37 | 2.42 | 6.46 | 5.11 | 6.11 | 4.05 | 3.86 | 3.91 | | | | |
| HEMBA1005241 | 18.2 | 11.3 | 9.41 | 11.74 | 14.66 | 18 | 9.85 | 7.33 | 9.11 | | | | |
| HEMBA1005244 | 6.45 | 3.35 | 4.4 | 5.3 | 7.24 | 5.85 | 3.98 | 5 | 6.42 | | | | |
| HEMBA1005246 | 9.39 | 6.95 | 6.65 | 15.52 | 17.83 | 13.37 | 15.28 | 9.28 | 12.96 | ** | + | | |
| HEMBA1005251 | 2.49 | 1.43 | 2.18 | 5.25 | 6.15 | 4.92 | 3.41 | 3.93 | 3.35 | ** | + | * | + |
| HEMBA1005252 | 3.83 | 2.63 | 3.03 | 3.56 | 4.92 | 3.46 | 2.88 | 4.5 | 4.38 | | | | |
| HEMBA1005267 | 1.63 | 0.84 | 1.67 | 10.27 | 7.55 | 7.28 | 1.17 | 3.13 | 1.81 | ** | + | | |
| HEMBA1005274 | 1.18 | 0.71 | 0.61 | 1.46 | 2.14 | 1.62 | 1.18 | 1.08 | 1.02 | * | + | | |
| HEMBA1005275 | 1.9 | 0.81 | 0.85 | 2.82 | 4.11 | 3.4 | 1.92 | 2.54 | 1.27 | * | + | | |
| HEMBA1005288 | 3.5 | 1.84 | 2.36 | 6.6 | 8.72 | 6.93 | 3.45 | 3.43 | 3.32 | ** | + | | |
| HEMBA1005293 | 1.91 | 2.03 | 0.55 | 4.54 | 1.95 | 1.33 | 0.58 | 2.15 | 1.2 | | | | |
| HEMBA1005296 | 401.9 | 314.1 | 296.6 | 377.8 | 403.7 | 432.4 | 228.1 | 207.4 | 230 | | | * | − |
| HEMBA1005301 | 1.98 | 0.74 | 1.57 | 2.67 | 1.35 | 1.8 | 1.62 | 2.6 | 1.33 | | | | |
| HEMBA1005304 | 4.1 | 2.37 | 2.93 | 8.99 | 8.69 | 9.63 | 4.7 | 6.26 | 5.96 | ** | + | * | + |
| HEMBA1005305 | 2.8 | 1.25 | 1.81 | 4.03 | 4.81 | 4.66 | 2.57 | 4.35 | 2.78 | ** | + | | |
| HEMBA1005311 | 2.04 | 1.03 | 1.55 | 2.81 | 2.74 | 3.45 | 0.88 | 2.3 | 2.36 | * | + | | |
| HEMBA1005313 | 6.91 | 3.99 | 3.19 | 6.31 | 4.42 | 4.78 | 4.14 | 4.74 | 6.56 | | | | |
| HEMBA1005314 | 0.55 | 0.27 | 0.2 | 1.02 | 1.14 | 0.89 | 1.2 | 0.4 | 1.03 | ** | + | | |
| HEMBA1005315 | 4.12 | 1.27 | 1.36 | 3 | 4.13 | 3.44 | 3.48 | 2.53 | 3.28 | | | | |

TABLE 186

| | | | | | | | | | | | | | |
|---|---|---|---|---|---|---|---|---|---|---|---|---|---|
| HEMBA1005317 | 1.33 | 0.36 | 0.19 | 4.23 | 3.8 | 4.6 | 1.25 | 1.46 | 1.92 | ** | + | | |
| HEMBA1005318 | 1.08 | 0.85 | 0.59 | 0.97 | 1.89 | 1.29 | 1.43 | 1.82 | 1.13 | | | | |
| HEMBA1005324 | 3.04 | 2.4 | 1.83 | 6.59 | 7.62 | 7.75 | 5.26 | 6.51 | 7.55 | ** | + | ** | + |
| HEMBA1005331 | 0.95 | 1.56 | 1.2 | 1.7 | 1.65 | 2.13 | 0.66 | 2.53 | 0.91 | | | | |
| HEMBA1005337 | 2.8 | 1.37 | 1.32 | 2.67 | 3.1 | 2.37 | 2.01 | 2.34 | 2.18 | | | | |
| HEMBA1005338 | 4.38 | 1.6 | 2.45 | 4.11 | 1.92 | 3.95 | 3.55 | 3.33 | 3.26 | | | | |
| HEMBA1005344 | 22.24 | 11.71 | 11.54 | 14.09 | 14.09 | 14.6 | 12.65 | 14.29 | 14.22 | | | | |
| HEMBA1005353 | 6.55 | 4.18 | 3.72 | 6.77 | 13.54 | 9.81 | 6.95 | 6.75 | 7.1 | | | | |
| HEMBA1005359 | 7.54 | 5.12 | 6.63 | 11.85 | 12.2 | 12.76 | 7.38 | 8.41 | 9.39 | ** | + | | |
| HEMBA1005362 | 9.18 | 7.14 | 7.14 | 5.77 | 8.95 | 8.4 | 3.09 | 3.31 | 2.6 | | | ** | − |
| HEMBA1005364 | 0.89 | 1.26 | 0.41 | 1.96 | 2.44 | 1.02 | 1.19 | 1.6 | 1.68 | | | | |
| HEMBA1005367 | 3.22 | 2.29 | 1.05 | 4.88 | 6.98 | 6.68 | 5.63 | 8 | 6.43 | * | + | ** | + |
| HEMBA1005372 | 2.2 | 0.98 | 0.77 | 1.74 | 3.83 | 3.08 | 4.16 | 2.78 | 2.66 | | | * | + |
| HEMBA1005374 | 6.99 | 3.71 | 3.35 | 12.54 | 10.52 | 8.75 | 6.1 | 6.58 | 7.22 | * | + | | |
| HEMBA1005379 | 1.84 | 1.63 | 1.2 | 1.2 | 1.49 | 2.65 | 1.75 | 1.09 | 1.97 | | | | |
| HEMBA1005382 | 7.86 | 4.67 | 5.2 | 10.89 | 7.83 | 8.14 | 5.58 | 6.98 | 6.52 | | | | |
| HEMBA1005384 | 4.42 | 2.21 | 2.13 | 6.74 | 6.14 | 5.84 | 4.87 | 4.21 | 4.01 | * | + | | |
| HEMBA1005386 | 6.04 | 3.65 | 3.38 | 6.45 | 5.92 | 6.1 | 5.2 | 4.67 | 5.78 | | | | |
| HEMBA1005389 | 5.36 | 3.94 | 2.77 | 5.75 | 6.88 | 6.02 | 2.6 | 5.56 | 3.66 | | | | |
| HEMBA1005394 | 6.27 | 3.67 | 3.58 | 3.93 | 4.59 | 4.22 | 2.21 | 4.81 | 3.15 | | | | |
| HEMBA1005403 | 11.32 | 8.45 | 6.9 | 16.3 | 23.03 | 11.57 | 16.03 | 13.06 | 13.2 | | | * | + |
| HEMBA1005408 | 4.6 | 4.51 | 2.17 | 5.61 | 4.87 | 4.3 | 5.51 | 3.2 | 4.27 | | | | |
| HEMBA1005410 | 1.48 | 1.46 | 0.98 | 2.22 | 1.83 | 2.32 | 3.82 | 2.31 | 2.31 | * | + | * | + |
| HEMBA1005411 | 3.32 | 2.25 | 1.72 | 8.56 | 7.19 | 8.45 | 4.84 | 3.85 | 4.74 | ** | + | * | + |
| HEMBA1005423 | 4.84 | 2.65 | 2.83 | 7.04 | 5.69 | 5.75 | 3.26 | 4.32 | 3.64 | * | + | | |
| HEMBA1005426 | 1.66 | 0.94 | 1.03 | 2.84 | 2.24 | 2.73 | 1.74 | 2.79 | 1.34 | ** | + | | |
| HEMBA1005427 | 18.06 | 13.04 | 14.1 | 24.89 | 25.18 | 27.94 | 11.55 | 18.31 | 15.99 | ** | + | | |
| HEMBA1005430 | 3.16 | 1.5 | 2.13 | 1.75 | 2.9 | 3.37 | 2.43 | 3.98 | 2.23 | | | | |
| HEMBA1005438 | 4.91 | 3.54 | 3.44 | 5.97 | 8.41 | 5.02 | 5.97 | 4.67 | 6.58 | | | | |
| HEMBA1005443 | 11.24 | 11.79 | 6.21 | 19.21 | 19.58 | 15.66 | 17.03 | 13.17 | 10.83 | * | + | | |
| HEMBA1005447 | 3.13 | 3.2 | 1.74 | 4.18 | 4.12 | 4.68 | 2.92 | 2.36 | 2.86 | * | + | | |
| HEMBA1005449 | 4.87 | 2.92 | 3.15 | 2.75 | 4.63 | 3.51 | 2.81 | 3.38 | 5.99 | | | | |
| HEMBA1005452 | 8.28 | 4.39 | 4.04 | 3.56 | 7.29 | 6.13 | 4.29 | 5.16 | 4.62 | | | | |
| HEMBA1005454 | 6.03 | 4.13 | 3.77 | 3.63 | 4.31 | 5.36 | 2.84 | 5.74 | 3.18 | | | | |

TABLE 186-continued

| | | | | | | | | | | | | | |
|---|---|---|---|---|---|---|---|---|---|---|---|---|---|
| HEMBA1005468 | 8.63 | 4.08 | 5.4 | 8.19 | 9.91 | 9.17 | 5.46 | 7.18 | 6.46 | | | | |
| HEMBA1005469 | 7.04 | 4.49 | 4.09 | 8.04 | 6.87 | 9.35 | 3.55 | 5.47 | 4.98 | | | | |
| HEMBA1005472 | 4.58 | 4.13 | 2.33 | 5.09 | 7.14 | 6.31 | 4.57 | 3.72 | 5.09 | | | | |
| HEMBA1005474 | 7.99 | 6.35 | 8.53 | 12.45 | 17.71 | 14.57 | 6.84 | 6.03 | 7.86 | * | + | | |
| HEMBA1005475 | 27.06 | 16.75 | 12.04 | 21.27 | 20.2 | 24.59 | 14.7 | 11.72 | 14.55 | | | | |
| HEMBA1005489 | 4.67 | 3.91 | 3.31 | 12.33 | 12.95 | 12.78 | 5.02 | 3.73 | 4.43 | ** | + | | |
| HEMBA1005497 | 1.7 | 0.87 | 0.7 | 1.28 | 2.32 | 1.65 | 1.49 | 1.73 | 0.9 | | | | |
| HEMBA1005500 | 6.11 | 2.66 | 2.28 | 6.01 | 8.49 | 7.76 | 2.99 | 5.44 | 4.21 | | | | |
| HEMBA1005506 | 1.91 | 0.96 | 0.87 | 1.02 | 1.78 | 1.61 | 1.14 | 3.14 | 1.21 | | | | |
| HEMBA1005508 | 3 | 1.68 | 2.62 | 3.65 | 3.78 | 4.7 | 1.31 | 2.01 | 2 | * | + | | |
| HEMBA1005511 | 6.78 | 4.02 | 3.71 | 12.46 | 10.15 | 10.8 | 6.67 | 5.32 | 7.37 | ** | + | | |
| HEMBA1005513 | 9.39 | 4.07 | 4.88 | 7.16 | 6.69 | 8.41 | 5.04 | 6.55 | 4.92 | | | | |
| HEMBA1005517 | 4.77 | 2.9 | 3.52 | 2.59 | 3.48 | 4.27 | 1.92 | 3.32 | 2.46 | | | | |
| HEMBA1005518 | 6.02 | 2.95 | 2.57 | 4.55 | 4.62 | 5.87 | 5.99 | 3.9 | 5.53 | | | | |
| HEMBA1005520 | 11.23 | 5.82 | 6.06 | 14.5 | 18.42 | 18.84 | 7.99 | 9.11 | 9.67 | * | + | | |
| HEMBA1005522 | 4.58 | 1.74 | 1.96 | 2.63 | 3.4 | 3.05 | 1.78 | 3.18 | 2.26 | | | | |
| HEMBA1005526 | 4 | 2.06 | 4.25 | 8.46 | 10.15 | 10.58 | 3.26 | 5.34 | 5.19 | ** | + | | |
| HEMBA1005528 | 14.83 | 10.54 | 9.95 | 13.03 | 18.88 | 16.21 | 6.65 | 7.84 | 6.97 | | | * | − |
| HEMBA1005530 | 5.44 | 2.29 | 3.17 | 4.84 | 6.25 | 8.18 | 4.67 | 4.21 | 3.84 | | | | |
| HEMBA1005538 | 4.71 | 2.93 | 2.46 | 83.2 | 102.3 | 97.16 | 227.3 | 162.3 | 210.6 | ** | + | ** | + |
| HEMBA1005539 | 7.02 | 4.61 | 3.84 | 4.34 | 5.62 | 5.7 | 5.14 | 4.99 | 5.58 | | | | |
| HEMBA1005545 | 4.05 | 4.59 | 3.18 | 3.31 | 5.22 | 4.49 | 4.33 | 4.46 | 3.97 | | | | |

TABLE 187

| | | | | | | | | | | | | | |
|---|---|---|---|---|---|---|---|---|---|---|---|---|---|
| HEMBA1005548 | 2.54 | 2.07 | 2.02 | 3.97 | 6.52 | 4.14 | 3.37 | 3.9 | 3.32 | * | + | ** | + |
| HEMBA1005552 | 9.98 | 4.38 | 5.49 | 14.16 | 16.16 | 16.24 | 6.88 | 9.1 | 7.91 | ** | + | | |
| HEMBA1005558 | 5.62 | 4.78 | 4.01 | 4.12 | 4.94 | 4.94 | 2.89 | 4.54 | 2.98 | | | | |
| HEMBA1005568 | 4.56 | 2.35 | 2.64 | 4.41 | 6.84 | 7.67 | 2.66 | 3.77 | 3.75 | | | | |
| HEMBA1005570 | 22.81 | 14.72 | 12.89 | 3.4 | 5.87 | 4.67 | 2.86 | 3.28 | 4.18 | * | − | * | − |
| HEMBA1005576 | 3.57 | 2.9 | 1.76 | 5.63 | 4.9 | 6.27 | 3.31 | 4.43 | 3.65 | * | + | | |
| HEMBA1005577 | 3.28 | 1.8 | 1.85 | 2.52 | 3.76 | 3.29 | 1.78 | 2.45 | 2.1 | | | | |
| HEMBA1005581 | 6.44 | 3.47 | 3.35 | 11.86 | 10.8 | 9.38 | 9.31 | 8.35 | 7.77 | ** | + | * | + |
| HEMBA1005582 | 3.79 | 2.19 | 1.67 | 4.94 | 4.83 | 5.37 | 3.11 | 3.69 | 2.69 | * | + | | |
| HEMBA1005583 | 2.18 | 2.16 | 1.54 | 2.99 | 3.77 | 4.66 | 2.3 | 2.75 | 1.62 | * | + | | |
| HEMBA1005588 | 3.6 | 2.49 | 3.31 | 8.28 | 7.89 | 9.86 | 3.63 | 5.17 | 4.67 | ** | + | | |
| HEMBA1005593 | 3.44 | 3.2 | 2.65 | 4.18 | 6.03 | 3.87 | 2.97 | 3.28 | 2.95 | | | | |
| HEMBA1005595 | 2.58 | 2.31 | 1.83 | 3.46 | 4.98 | 5.89 | 3.2 | 2.15 | 3.87 | * | + | | |
| HEMBA1005597 | 13.38 | 9.58 | 8.44 | 10.53 | 12.2 | 11.02 | 8.53 | 9.47 | 8.93 | | | | |
| HEMBA1005606 | 12.27 | 7.53 | 6.44 | 5.89 | 7.11 | 6.3 | 8.22 | 8.78 | 11.95 | | | | |
| HEMBA1005609 | 5.25 | 3.66 | 3.27 | 10.52 | 11.83 | 10.56 | 4.85 | 5.36 | 5.71 | ** | + | | |
| HEMBA1005616 | 5.15 | 3.24 | 2.69 | 6.77 | 7.27 | 7.69 | 4.76 | 5.32 | 4.74 | * | + | | |
| HEMBA1005621 | 5.71 | 4.59 | 4.34 | 4.48 | 5.05 | 3.45 | 2.83 | 4.75 | 2.83 | | | | |
| HEMBA1005627 | 4.83 | 2.61 | 2.82 | 6.51 | 8.02 | 6.48 | 3.29 | 4.97 | 4.83 | * | + | | |
| HEMBA1005628 | 5.64 | 3.83 | 3.44 | 12.81 | 11.82 | 14.97 | 10.64 | 9.94 | 13.34 | ** | + | ** | + |
| HEMBA1005631 | 2.21 | 1.39 | 0.65 | 2.83 | 4.04 | 3.15 | 5.61 | 3.11 | 3.88 | * | + | * | + |
| HEMBA1005632 | 11.01 | 3.49 | 3.42 | 8.83 | 9.02 | 7.82 | 5.06 | 4.35 | 5.44 | | | | |
| HEMBA1005634 | 6.35 | 2.76 | 2.05 | 5.36 | 8.63 | 6.5 | 4.98 | 5 | 6.87 | | | | |
| HEMBA1005662 | 1.07 | 1.53 | 1.02 | 2.26 | 2.43 | 2.33 | 2.04 | 1.73 | 1.38 | ** | + | | |
| HEMBA1005666 | 4.52 | 3.82 | 4.32 | 9.91 | 8.09 | 7.3 | 6.48 | 6.28 | 5.06 | ** | + | * | + |
| HEMBA1005670 | 2.29 | 2.27 | 1.9 | 7.3 | 6.51 | 7 | 3.1 | 7.04 | 3.71 | ** | + | | |
| HEMBA1005671 | 3.97 | 1.07 | 3.6 | 3.68 | 3.22 | 2.26 | 4.53 | 6.9 | 3.6 | | | | |
| HEMBA1005679 | 4.26 | 2.11 | 3.13 | 6.55 | 7.51 | 6.35 | 2.51 | 4.92 | 3.8 | ** | + | | |
| HEMBA1005680 | 6.79 | 3.09 | 2.88 | 6.98 | 9.15 | 8.11 | 7.19 | 3.45 | 6.54 | | | | |
| HEMBA1005685 | 5.15 | 2.24 | 2.86 | 3.16 | 3.75 | 6.06 | 3.75 | 2.67 | 3.13 | | | | |
| HEMBA1005698 | 6.46 | 4.64 | 3.65 | 6.51 | 6.49 | 8.04 | 4.48 | 5.97 | 6.27 | | | | |
| HEMBA1005699 | 2.04 | 1.37 | 1.03 | 2.33 | 2.8 | 2.44 | 1.39 | 3.16 | 0.93 | * | + | | |
| HEMBA1005703 | 1.57 | 1.14 | 0.53 | 2.63 | 1.8 | 1.22 | 0.95 | 3.02 | 1.71 | | | | |
| HEMBA1005705 | 4.78 | 2.62 | 3.65 | 8.55 | 5.59 | 7.85 | 3.94 | 5.46 | 2.65 | * | + | | |
| HEMBA1005712 | 1.7 | 0.73 | 0.42 | 2.78 | 2.29 | 2.36 | 1.03 | 2.79 | 1.13 | * | + | | |
| HEMBA1005717 | 1.99 | 1.9 | 1.57 | 4.59 | 18.53 | 4.07 | 1.65 | 3.65 | 2.24 | | | | |
| HEMBA1005718 | 12.46 | 6.17 | 5.4 | 10.4 | 11.53 | 8.97 | 6.74 | 7.19 | 8.25 | | | | |
| HEMBA1005721 | 15.4 | 8.95 | 6.41 | 11.18 | 12.64 | 11.59 | 11.3 | 10.89 | 13.73 | | | | |
| HEMBA1005722 | 11.88 | 7.25 | 5.73 | 15.89 | 16.63 | 13.24 | 10.07 | 13.96 | 12.55 | * | + | | |
| HEMBA1005724 | 4.23 | 1.39 | 1.12 | 1.47 | 3.11 | 2.3 | 1.44 | 1.83 | 2.83 | | | | |
| HEMBA1005732 | 4.64 | 3.73 | 2.82 | 4.17 | 4.78 | 5.5 | 3.41 | 2.84 | 3.27 | | | | |
| HEMBA1005737 | 2.11 | 1.17 | 0.89 | 1.64 | 1.86 | 1.55 | 2.37 | 1.99 | 1.73 | | | | |
| HEMBA1005742 | 2.91 | 1.85 | 1.65 | 20.12 | 22.7 | 20.93 | 10.11 | 6.75 | 7.19 | ** | + | ** | + |
| HEMBA1005746 | 3.55 | 2.22 | 2.55 | 2.88 | 5.21 | 3.91 | 2.28 | 2.67 | 1.49 | | | | |
| HEMBA1005747 | 6.73 | 2.98 | 3.61 | 4.2 | 6.34 | 4.06 | 4.88 | 4.78 | 5.21 | | | | |
| HEMBA1005749 | 16 | 15.05 | 7.61 | 16.72 | 17.56 | 14.78 | 13.73 | 10.17 | 19.02 | | | | |
| HEMBA1005755 | 1.55 | 1.38 | 0.58 | 2.76 | 3.45 | 1.74 | 2.11 | 2.82 | 2.29 | | | * | + |
| HEMBA1005760 | 6.22 | 4.23 | 3.01 | 5.27 | 5.19 | 5.24 | 4.36 | 3.24 | 4.73 | | | | |
| HEMBA1005765 | 5.47 | 4.02 | 4.47 | 8.82 | 8.58 | 6.98 | 4.72 | 5.79 | 3.58 | ** | + | | |
| HEMBA1005766 | 6.49 | 3.72 | 3.07 | 6.86 | 5.34 | 6.17 | 4.5 | 5.2 | 3.85 | | | | |
| HEMBA1005780 | 5.24 | 3.72 | 3.56 | 7.77 | 10.48 | 12.03 | 5.65 | 6.93 | 5.8 | * | + | * | + |

TABLE 187-continued

| | | | | | | | | | | | | | |
|---|---|---|---|---|---|---|---|---|---|---|---|---|---|
| HEMBA1005795 | 2.44 | 2.1 | 2.01 | 3.69 | 3.63 | 2.88 | 1.69 | 3.18 | 1.68 | * | + | | |
| HEMBA1005809 | 23.36 | 22 | 11.6 | 14.58 | 20.18 | 18.5 | 16.89 | 18.97 | 9.81 | | | | |
| HEMBA1005813 | 3.44 | 3.32 | 2.49 | 3.52 | 4.47 | 4.04 | 2.83 | 4.45 | 3.63 | | | | |
| HEMBA1005815 | 6.13 | 3.52 | 2.7 | 5.29 | 7.35 | 4.96 | 4.74 | 5.46 | 7.01 | | | | |
| HEMBA1005822 | 4.2 | 1.96 | 2.92 | 8.67 | 7.02 | 9.4 | 4.99 | 3.69 | 6.16 | ** | + | | |

TABLE 188

| | | | | | | | | | | | | | |
|---|---|---|---|---|---|---|---|---|---|---|---|---|---|
| HEMBA1005829 | 7.71 | 4.11 | 4.16 | 9.68 | 9.82 | 10.65 | 5.68 | 6.05 | 6.18 | * | + | | |
| HEMBA1005833 | 5.58 | 4.05 | 3.69 | 5.07 | 5.16 | 5.6 | 4.09 | 4.46 | 5.21 | | | | |
| HEMBA1005834 | 6.55 | 4.34 | 5.21 | 12.06 | 12.18 | 15.25 | 4.16 | 7.19 | 5.66 | ** | + | | |
| HEMBA1005844 | 55.19 | 32.63 | 42.62 | 52.31 | 50.88 | 44.4 | 13.71 | 22.39 | 16.54 | | | * | − |
| HEMBA1005852 | 14.32 | 7.35 | 8.88 | 11.42 | 13.87 | 12.28 | 12.12 | 9.6 | 10.71 | | | | |
| HEMBA1005853 | 4.46 | 3.87 | 2.7 | 5.48 | 7.15 | 7.24 | 6.76 | 3.1 | 4.03 | * | + | | |
| HEMBA1005878 | 10.9 | 9.31 | 6.82 | 15.29 | 18.75 | 18.35 | 11.26 | 9.02 | 9.91 | ** | + | | |
| HEMBA1005883 | 2.8 | 3.02 | 2.09 | 2.99 | 4.75 | 3.12 | 3.03 | 3.43 | 2.83 | | | | |
| HEMBA1005884 | 1.78 | 1.18 | 0.5 | 2.41 | 2.22 | 1.91 | 2.16 | 1.93 | 1.73 | | | | |
| HEMBA1005891 | 1.55 | 1.14 | 0.52 | 2.25 | 4.37 | 4.09 | 2.08 | 2.69 | 1.69 | * | + | | |
| HEMBA1005894 | 3.43 | 2.12 | 2.97 | 5.44 | 5.86 | 5.44 | 2.54 | 4.52 | 2.77 | ** | + | | |
| HEMBA1005898 | 16.67 | 8.8 | 11.51 | 11.61 | 18.53 | 21.97 | 6.97 | 12.21 | 8.22 | | | | |
| HEMBA1005902 | 4.41 | 3.46 | 2.55 | 2.97 | 3.31 | 3.57 | 3.63 | 4.8 | 4.43 | | | | |
| HEMBA1005907 | 1.14 | 1 | 0.32 | 1.39 | 1.9 | 1.41 | 1.83 | 2.17 | 1.38 | | | * | + |
| HEMBA1005909 | 0.96 | 0.99 | 0.06 | 0.74 | 1.52 | 0.83 | 1.8 | 0.82 | 0.95 | | | | |
| HEMBA1005911 | 5.56 | 3.24 | 3.54 | 5.59 | 8.12 | 8.18 | 4.97 | 3.97 | 5.62 | * | + | | |
| HEMBA1005912 | 6.61 | 6.28 | 5.64 | 8.63 | 10.33 | 8.51 | 7.27 | 7.15 | 4.9 | * | + | | |
| HEMBA1005913 | 3.32 | 1.87 | 2.67 | 4.85 | 5.83 | 5.39 | 4.23 | 6.09 | 5.19 | ** | + | * | + |
| HEMBA1005921 | 5.08 | 3.6 | 4.07 | 7.96 | 11.09 | 11.08 | 3.93 | 6.12 | 4.64 | ** | + | | |
| HEMBA1005922 | 9.29 | 4.86 | 8.75 | 10.31 | 11.79 | 14.59 | 5.42 | 7.95 | 6.59 | | | | |
| HEMBA1005929 | 9.26 | 6.15 | 5.27 | 8.35 | 12.25 | 12.51 | 8.91 | 7.98 | 6.88 | | | | |
| HEMBA1005931 | 13.37 | 8.03 | 6.05 | 13.2 | 15.89 | 16.14 | 10.01 | 9.04 | 10.17 | | | | |
| HEMBA1005934 | 11.83 | 7.65 | 6.91 | 11.33 | 21.92 | 13.8 | 6.94 | 9.42 | 10.1 | | | | |
| HEMBA1005945 | 9.41 | 6.42 | 4.64 | 6.1 | 7.01 | 8.67 | 8.01 | 6.77 | 7.06 | | | | |
| HEMBA1005962 | 2.52 | 1.69 | 1.85 | 2.52 | 2.44 | 3.11 | 1.69 | 3.18 | 2.61 | | | | |
| HEMBA1005963 | 1.58 | 1.29 | 0.83 | 2.22 | 2.32 | 1.65 | 0.75 | 2.23 | 1.58 | | | | |
| HEMBA1005990 | 53.63 | 37.05 | 35.87 | 22.88 | 28.11 | 30.49 | 25.75 | 38.21 | 38.5 | | | | |
| HEMBA1005991 | 4.36 | 2.88 | 2.52 | 7.83 | 8.53 | 8.07 | 3.66 | 3.18 | 4.37 | ** | + | | |
| HEMBA1005999 | 7.25 | 4.04 | 3.51 | 7.81 | 9.22 | 8.54 | 5.71 | 6.17 | 5.07 | * | + | | |
| HEMBA1006002 | 4.03 | 2.6 | 1.83 | 2.32 | 2.41 | 2.99 | 3.56 | 4.2 | 3.68 | | | | |
| HEMBA1006005 | 3.58 | 3.7 | 2.47 | 1.41 | 2.98 | 2.78 | 2.19 | 3.32 | 3.16 | | | | |
| HEMBA1006011 | 28.82 | 13.22 | 19.62 | 6.69 | 8.42 | 8.26 | 9.43 | 7.34 | 8.25 | * | − | | |
| HEMBA1006013 | 4.9 | 3.69 | 2.44 | 2.82 | 3.64 | 2.69 | 3.14 | 3.46 | 2.63 | | | | |
| HEMBA1006016 | 5.42 | 2.01 | 3.02 | 4.73 | 5.78 | 5.82 | 3.09 | 4.11 | 3.71 | | | | |
| HEMBA1006019 | 4.75 | 3.24 | 2.19 | 2.66 | 6.4 | 5.83 | 2.01 | 3.58 | 3.27 | | | | |
| HEMBA1006021 | 5.17 | 2.64 | 3.76 | 13.9 | 20.33 | 23.22 | 9.49 | 12.71 | 9.39 | ** | + | ** | + |
| HEMBA1006022 | 6.7 | 7.43 | 3.24 | 7.5 | 7.39 | 6.93 | 5.83 | 6.01 | 8.3 | | | | |
| HEMBA1006031 | 4.39 | 5.2 | 2.1 | 3.55 | 7.12 | 4.25 | 2.82 | 4.39 | 3.34 | | | | |
| HEMBA1006035 | 3.57 | 1.83 | 2.1 | 2.68 | 3.31 | 3.32 | 3.52 | 3.36 | 3.1 | | | | |
| HEMBA1006036 | 11.47 | 5.72 | 5.91 | 13.84 | 22.61 | 19.36 | 7.96 | 7.38 | 10.66 | * | + | | |
| HEMBA1006042 | 5.24 | 3.69 | 2.84 | 6.48 | 8.01 | 7.56 | 4.36 | 7.77 | 4.18 | * | + | | |
| HEMBA1006044 | 1.69 | 0.79 | 0.7 | 2 | 1.1 | 1.58 | 0.9 | 2.05 | 1.25 | | | | |
| HEMBA1006045 | 4.3 | 3.06 | 2.36 | 5.33 | 6.87 | 5.75 | 4.69 | 7.34 | 3.91 | * | + | | |
| HEMBA1006048 | 5.42 | 3.01 | 4.33 | 5.37 | 6.23 | 4.19 | 3.1 | 3.81 | 2.5 | | | | |
| HEMBA1006053 | 5.79 | 4.06 | 2.48 | 4.5 | 6.49 | 3.55 | 3.66 | 3.74 | 4.34 | | | | |
| HEMBA1006055 | 1.82 | 1.84 | 1.28 | 1.8 | 2.36 | 2.19 | 1.75 | 2.52 | 2.48 | | | | |
| HEMBA1006058 | 4.72 | 2.18 | 2.21 | 2.56 | 3.95 | 3.04 | 3.54 | 3.28 | 3.39 | | | | |
| HEMBA1006063 | 15.52 | 11.99 | 10.03 | 16.08 | 16.03 | 13.94 | 13.46 | 9.12 | 10.83 | | | | |
| HEMBA1006067 | 1.98 | 1.55 | 1.25 | 1.72 | 2.65 | 1.7 | 2.65 | 2.72 | 2.71 | | | ** | + |
| HEMBA1006081 | 3.98 | 3.25 | 2.94 | 3.52 | 4.19 | 3.86 | 2.74 | 3.6 | 2.18 | | | | |
| HEMBA1006089 | 10.88 | 7.08 | 9.01 | 8.5 | 7.48 | 9.62 | 5.26 | 4.65 | 6.13 | | | * | − |
| HEMBA1006090 | 2.72 | 1.74 | 2.31 | 2.48 | 4.09 | 2.53 | 1.71 | 3.25 | 2.66 | | | | |
| HEMBA1006091 | 8.41 | 4.97 | 5.38 | 6.67 | 13.08 | 9.53 | 6.54 | 5.82 | 7.45 | | | | |
| HEMBA1006093 | 4.66 | 3.46 | 1.8 | 4.22 | 4.68 | 5.91 | 4.02 | 4.39 | 5.59 | | | | |
| HEMBA1006099 | 8.2 | 2.83 | 3.57 | 7.25 | 7.27 | 6.62 | 8.7 | 6.8 | 7.75 | | | | |
| HEMBA1006100 | 4.94 | 3.58 | 3.48 | 6.75 | 7.94 | 7.84 | 5.43 | 4.52 | 4.63 | ** | + | | |

TABLE 189

| | | | | | | | | | | | | | |
|---|---|---|---|---|---|---|---|---|---|---|---|---|---|
| HEMBA1006108 | 5.03 | 2.45 | 2.82 | 5.62 | 4.96 | 3.72 | 3.28 | 3.95 | 3.28 | | | | |
| HEMBA1006114 | 5.25 | 4.63 | 5.08 | 7.3 | 10.42 | 7.17 | 4.76 | 5.44 | 5.87 | * | + | | |
| HEMBA1006121 | 6.32 | 2.33 | 4.31 | 5.84 | 6.44 | 7.33 | 4.17 | 6.55 | 4.7 | | | | |
| HEMBA1006124 | 3.12 | 2.28 | 2.5 | 3.33 | 4.9 | 2.3 | 1.89 | 3.9 | 2.53 | | | | |
| HEMBA1006125 | 10.14 | 8.44 | 4.52 | 7.52 | 17.2 | 16.18 | 9.52 | 10.87 | 14.31 | | | | |
| HEMBA1006130 | 2.62 | 2.68 | 2.39 | 2.72 | 3.08 | 4.43 | 3.7 | 4.3 | 4.1 | | | ** | + |
| HEMBA1006138 | 7.26 | 4.73 | 3.72 | 9.3 | 11.39 | 10.14 | 5.49 | 5.98 | 7.37 | * | + | | |

TABLE 189-continued

| | | | | | | | | | | | | | |
|---|---|---|---|---|---|---|---|---|---|---|---|---|---|
| HEMBA1006142 | 6.22 | 3.63 | 4.24 | 7.33 | 10.18 | 10.72 | 6.57 | 6.34 | 6.19 | * | + | | |
| HEMBA1006150 | 16.28 | 10.88 | 9.66 | 15.57 | 15.3 | 13.33 | 6.57 | 7.84 | 7.68 | | | | |
| HEMBA1006151 | 8.94 | 6.23 | 8.3 | 9.44 | 9.41 | 9.8 | 14.8 | 13.36 | 17.11 | | | ** | + |
| HEMBA1006155 | 4.31 | 2.12 | 3.11 | 2.99 | 2.19 | 2.62 | 2.75 | 4.44 | 3.92 | | | | |
| HEMBA1006158 | 1.99 | 2.23 | 1 | 5.52 | 2.28 | 1.62 | 0.79 | 3.02 | 2.04 | | | | |
| HEMBA1006164 | 7.82 | 6.93 | 4.48 | 10.95 | 14.83 | 12 | 6.46 | 6.96 | 7.98 | * | + | | |
| HEMBA1006171 | 3.78 | 1.96 | 1.78 | 2.93 | 3.7 | 4.2 | 6.07 | 5.07 | 5.46 | | | * | + |
| HEMBA1006173 | 3.13 | 1.34 | 2.45 | 2.99 | 4.82 | 4.35 | 2.87 | 4.45 | 2.71 | | | | |
| HEMBA1006176 | 17.29 | 15.19 | 12.08 | 17.72 | 24.16 | 22.1 | 76.2 | 63.22 | 78.98 | | | ** | + |
| HEMBA1006182 | 2.42 | 1.06 | 1.52 | 2.8 | 3.22 | 2.43 | 1.16 | 3.5 | 1.94 | | | | |
| HEMBA1006197 | 6.41 | 5.46 | 4.82 | 12.32 | 9.66 | 9.7 | 4.32 | 5.89 | 5.15 | ** | + | | |
| HEMBA1006198 | 9.58 | 7.2 | 6.52 | 9.4 | 9.55 | 10.32 | 5.65 | 8.56 | 6.79 | | | | |
| HEMBA1006213 | 2.56 | 0.9 | 1.99 | 3.02 | 4.19 | 4.18 | 1.76 | 2.58 | 3.01 | * | + | | |
| HEMBA1006217 | 23.81 | 12.95 | 14.09 | 28.71 | 29.21 | 22.65 | 54.8 | 57.77 | 74.75 | | | ** | + |
| HEMBA1006226 | 45.81 | 48.81 | 55.06 | 71.05 | 67.87 | 69.04 | 34.7 | 30.76 | 48.77 | ** | + | | |
| HEMBA1006235 | 2.69 | 1.66 | 2.93 | 2.89 | 2.63 | 3.42 | 3.26 | 2 | 2.73 | | | | |
| HEMBA1006248 | 4.57 | 1.66 | 2.14 | 4.47 | 3.25 | 4.51 | 3.57 | 3.35 | 2.98 | | | | |
| HEMBA1006251 | 7.31 | 5.13 | 5.62 | 8.77 | 8.46 | 10.53 | 8.03 | 7.68 | 7.92 | * | + | * | + |
| HEMBA1006252 | 2.83 | 2.65 | 0.76 | 1.86 | 2.33 | 3.7 | 2.51 | 1.94 | 2.08 | | | | |
| HEMBA1006253 | 5.52 | 3.08 | 3.71 | 4.06 | 4.47 | 4.75 | 2.99 | 2.68 | 1.89 | | | | |
| HEMBA1006259 | 4.17 | 1.88 | 2.86 | 4.37 | 4.88 | 6.45 | 2.66 | 2.31 | 3.49 | | | | |
| HEMBA1006261 | 6.4 | 3.95 | 3.39 | 6.02 | 5.83 | 6.2 | 5.45 | 3.63 | 10.61 | | | | |
| HEMBA1006268 | 3.66 | 2.08 | 1.88 | 4.46 | 4.9 | 5.18 | 2.58 | 2.36 | 4.27 | * | + | | |
| HEMBA1006271 | 7.71 | 2.93 | 4.51 | 11.62 | 12.09 | 12.3 | 7.07 | 5.33 | 10.91 | ** | + | | |
| HEMBA1006272 | 2.81 | 1.63 | 1 | 2.86 | 2.92 | 3.49 | 2.16 | 1.96 | 2.4 | | | | |
| HEMBA1006273 | 5.39 | 2.09 | 3.07 | 4.81 | 3.79 | 4.4 | 5.32 | 3.06 | 3.91 | | | | |
| HEMBA1006276 | 2.93 | 1.9 | 3.24 | 3.4 | 4.55 | 3.76 | 2.55 | 1.66 | 2.29 | | | | |
| HEMBA1006278 | 1.93 | 1.63 | 1.33 | 4.06 | 4.19 | 3.8 | 2.43 | 1.58 | 2.09 | ** | + | | |
| HEMBA1006283 | 7.35 | 3.25 | 3.5 | 4.82 | 5.8 | 5.93 | 4.92 | 3.12 | 4.11 | | | | |
| HEMBA1006284 | 3.83 | 2.26 | 2.04 | 5.58 | 2.8 | 4.34 | 3.15 | 2.33 | 3.82 | | | | |
| HEMBA1006291 | 4.96 | 1.36 | 1.34 | 4.1 | 2.68 | 4.41 | 3.86 | 3.13 | 3.18 | | | | |
| HEMBA1006292 | 2.77 | 2.02 | 1.73 | 2.32 | 2.22 | 1.89 | 2.26 | 1.67 | 2.38 | | | | |
| HEMBA1006293 | 3.02 | 0.92 | 0.7 | 1.9 | 1.76 | 2.36 | 1.54 | 1.85 | 1.56 | | | | |
| HEMBA1006299 | 3.49 | 2.22 | 1.51 | 13.99 | 12.93 | 16.92 | 7.99 | 7.28 | 10.15 | ** | + | ** | + |
| HEMBA1006309 | 5.39 | 3.08 | 3.38 | 5.38 | 6.85 | 7.74 | 3.06 | 4.11 | 4.45 | | | | |
| HEMBA1006310 | 3.7 | 2.35 | 2.24 | 5.29 | 3.06 | 3.56 | 2.59 | 4.56 | 4.32 | | | | |
| HEMBA1006311 | 8.15 | 4.04 | 4.72 | 3.8 | 4.97 | 7.43 | 4.03 | 5.26 | 5.64 | | | | |
| HEMBA1006313 | 2.58 | 0.57 | 1 | 1.55 | 1.73 | 1.85 | 2.63 | 1.09 | 1.3 | | | | |
| HEMBA1006316 | 2.99 | 1.66 | 1.44 | 1.74 | 2.62 | 2.14 | 2.59 | 1.79 | 1.84 | | | | |
| HEMBA1006328 | 4.68 | 2.1 | 1.68 | 6.39 | 5.95 | 6.83 | 4.27 | 3.72 | 3.95 | * | + | | |
| HEMBA1006334 | 2.26 | 1.44 | 1.07 | 1.93 | 1.34 | 1.2 | 1.12 | 1.33 | 0.99 | | | | |
| HEMBA1006335 | 10.13 | 6.95 | 5.67 | 4.72 | 4.51 | 6.4 | 10.88 | 11.65 | 14.01 | | | * | + |
| HEMBA1006344 | 4.43 | 2.82 | 4.27 | 9.97 | 8.14 | 7.72 | 4.65 | 6.26 | 4.98 | ** | + | | |
| HEMBA1006347 | 5.25 | 2.13 | 2.64 | 4.75 | 3.92 | 6.02 | 3.02 | 3.83 | 3.69 | | | | |
| HEMBA1006349 | 6.07 | 2.73 | 2.89 | 4.44 | 4.96 | 6.67 | 4.94 | 4.8 | 4.22 | | | | |
| HEMBA1006352 | 3.21 | 2.07 | 2.2 | 4.23 | 3.53 | 3.79 | 3.57 | 2.77 | 2.87 | * | + | | |
| HEMBA1006357 | 9.36 | 4.79 | 5.03 | 14.77 | 13.42 | 14.23 | 7.21 | 5.46 | 6.81 | ** | + | | |
| HEMBA1006358 | 4.06 | 2.27 | 1.93 | 3.39 | 4.53 | 4.11 | 2.56 | 2.11 | 2.8 | | | | |
| HEMBA1006359 | 11.9 | 9.22 | 8.59 | 18.27 | 21.46 | 21.84 | 9.68 | 5.92 | 7.59 | ** | + | | |

TABLE 190

| | | | | | | | | | | | | | |
|---|---|---|---|---|---|---|---|---|---|---|---|---|---|
| HEMBA1006360 | 7.98 | 4.95 | 5.62 | 5.47 | 3.56 | 4.4 | 1.94 | 2.36 | 2.5 | | | * | − |
| HEMBA1006364 | 3.11 | 1.13 | 2.29 | 5.13 | 3.18 | 5.17 | 4.53 | 10.75 | 7.49 | | | * | + |
| HEMBA1006377 | 9.83 | 4.08 | 4.81 | 9.68 | 6.73 | 11.12 | 5.12 | 6.15 | 6.04 | | | | |
| HEMBA1006380 | 8.33 | 2.76 | 3.16 | 7.63 | 7.47 | 9.64 | 4.68 | 4.63 | 5.81 | | | | |
| HEMBA1006381 | 27.84 | 15.11 | 15.63 | 23.73 | 22.47 | 28.24 | 18.48 | 12.8 | 18.34 | | | | |
| HEMBA1006385 | 9 | 3.81 | 3.21 | 10.12 | 10.82 | 10.06 | 5.78 | 6.06 | 7.86 | | | | |
| HEMBA1006390 | 10.59 | 5.3 | 6.11 | 5.74 | 8.16 | 9.4 | 6.45 | 5.63 | 5.84 | | | | |
| HEMBA1006391 | 5.9 | 2.52 | 2.93 | 4.19 | 2.98 | 3.66 | 3.7 | 3.39 | 4.92 | | | | |
| HEMBA1006398 | 1.24 | 0.85 | 0.78 | 1.46 | 2.48 | 2.33 | 1.32 | 1.57 | 1.25 | * | + | | |
| HEMBA1006405 | 6.46 | 2.31 | 3.39 | 3.97 | 5.97 | 7.86 | 4.98 | 4.43 | 6.01 | | | | |
| HEMBA1006410 | 10.66 | 4.34 | 6.26 | 48.24 | 9.18 | 6.95 | 5.67 | 6.99 | 5.47 | | | | |
| HEMBA1006416 | 7.58 | 3.75 | 4.83 | 11.17 | 11.6 | 10.4 | 5.86 | 5.53 | 5.52 | ** | + | | |
| HEMBA1006418 | 4.85 | 2.81 | 2.36 | 4.42 | 4.54 | 5.46 | 2.95 | 3.19 | 4.26 | | | | |
| HEMBA1006419 | 8.31 | 4.08 | 4.44 | 13 | 13.16 | 12.95 | 7.56 | 6.59 | 6.8 | ** | + | | |
| HEMBA1006421 | 2.57 | 1.36 | 2.21 | 4.58 | 3.93 | 3.93 | 2.69 | 2.86 | 2.95 | ** | + | | |
| HEMBA1006424 | 1.92 | 1.1 | 0.54 | 1.6 | 1.43 | 2 | 1.13 | 1.24 | 1.46 | | | | |
| HEMBA1006426 | 6.91 | 3.24 | 3.97 | 14.78 | 13.77 | 12.89 | 6.5 | 5.72 | 7.38 | ** | + | | |
| HEMBA1006430 | 4.14 | 1.54 | 1.15 | 3.22 | 4.8 | 4.46 | 2.25 | 2.55 | 3.21 | | | | |
| HEMBA1006438 | 3.24 | 1.25 | 2.86 | 4.15 | 5.58 | 5.24 | 2.63 | 2.65 | 2.43 | * | + | | |
| HEMBA1006445 | 5.47 | 3.56 | 1.09 | 4.34 | 6.2 | 5.79 | 5.24 | 5.14 | 9.55 | | | | |
| HEMBA1006446 | 2.47 | 0.4 | 0.6 | 1.78 | 0.97 | 2.17 | 2.61 | 1.77 | 0.98 | | | | |
| HEMBA1006456 | 9.3 | 7.18 | 5.88 | 27.97 | 39.53 | 36.06 | 25.26 | 23.55 | 25.96 | ** | + | ** | + |
| HEMBA1006461 | 3.9 | 2.47 | 2.09 | 3.96 | 6.32 | 5.5 | 3.18 | 2.5 | 2.97 | | | | |
| HEMBA1006467 | 3.36 | 2.3 | 2.41 | 1.89 | 3.11 | 2.94 | 1.06 | 2.01 | 1.22 | | | * | − |

TABLE 190-continued

| | | | | | | | | | | | | | |
|---|---|---|---|---|---|---|---|---|---|---|---|---|---|
| HEMBA1006470 | 3.32 | 2.6 | 1.74 | 4.73 | 4.89 | 6.17 | 2.71 | 2.99 | 2.35 | * | + | | |
| HEMBA1006471 | 2.77 | 2.01 | 2.5 | 2.54 | 4.17 | 4.09 | 1.83 | 2.8 | 1.93 | | | | |
| HEMBA1006474 | 3.4 | 0.88 | 1.69 | 1.95 | 2.26 | 1.5 | 0.73 | 1.98 | 1.64 | | | | |
| HEMBA1006476 | 7.63 | 2.81 | 3.49 | 7.03 | 6.55 | 10.28 | 5.71 | 6.01 | 8.9 | | | | |
| HEMBA1006482 | 53.61 | 36.99 | 43.8 | 47.46 | 64.27 | 63.44 | 24.67 | 21.43 | 26.34 | | | * | − |
| HEMBA1006483 | 5.77 | 3.34 | 3.12 | 9.27 | 6.33 | 10.42 | 4.67 | 4.49 | 5.8 | * | + | | |
| HEMBA1006485 | 2.4 | 0.96 | 1.41 | 4.2 | 4.91 | 5.55 | 9.43 | 7.34 | 8.87 | ** | + | ** | + |
| HEMBA1006486 | 22.07 | 14.47 | 14.17 | 13.5 | 21.65 | 20.32 | 9.55 | 5.18 | 8.79 | | | * | − |
| HEMBA1006489 | 2.84 | 0.31 | 0.23 | 0.65 | 1.22 | 0.91 | 1.3 | 1.95 | 0.72 | | | | |
| HEMBA1006492 | 22.55 | 16.4 | 18.02 | 18.63 | 19.03 | 19.21 | 4.75 | 5.92 | 5.79 | | | ** | − |
| HEMBA1006494 | 1.6 | 0.13 | 1.42 | 1.49 | 1.22 | 1.56 | 0.94 | 0.97 | 0.8 | | | | |
| HEMBA1006497 | 4.42 | 2.46 | 1.3 | 2.7 | 3.38 | 4.13 | 3.19 | 2.22 | 2.93 | | | | |
| HEMBA1006501 | 6.77 | 2.17 | 3.41 | 4.37 | 3.72 | 6.05 | 2.94 | 2.94 | 4.13 | | | | |
| HEMBA1006502 | 14.3 | 11.26 | 8.46 | 15.96 | 17.52 | 16.95 | 15.96 | 11.43 | 17.31 | * | + | | |
| HEMBA1006507 | 3.4 | 0.73 | 1.23 | 5.85 | 4.08 | 5.84 | 2.92 | 3.88 | 4.16 | * | + | | |
| HEMBA1006517 | 4.63 | 2.62 | 2.31 | 5.72 | 6.14 | 5.82 | 3.68 | 4.27 | 4.71 | * | + | | |
| HEMBA1006521 | 3.02 | 1.72 | 1.98 | 2.24 | 2.27 | 2.97 | 3.41 | 3.45 | 2.36 | | | | |
| HEMBA1006529 | 6.54 | 5.38 | 7.96 | 6.72 | 7.42 | 7.81 | 5.9 | 6.56 | 6.87 | | | | |
| HEMBA1006530 | 1.54 | 0.77 | 2.01 | 2.93 | 1.8 | 2.4 | 1.35 | 1.69 | 1.44 | | | | |
| HEMBA1006535 | 2.61 | 2.15 | 0.64 | 3.13 | 3.63 | 3.67 | 2.05 | 1.48 | 2.17 | | | | |
| HEMBA1006536 | 5.93 | 3.85 | 4.16 | 6.52 | 8.47 | 8.22 | 4.62 | 4.48 | 4.48 | * | + | | |
| HEMBA1006540 | 4.27 | 2.17 | 1.9 | 4.22 | 2.42 | 3.65 | 2.42 | 2.05 | 2.05 | | | | |
| HEMBA1006544 | 1.52 | 0.67 | 1.46 | 2.15 | 3.36 | 3.6 | 2.21 | 2.99 | 2.6 | * | + | * | + |
| HEMBA1006546 | 4.48 | 4.88 | 3.24 | 16.24 | 9.73 | 11.7 | 5.09 | 6.41 | 8.5 | * | + | | |
| HEMBA1006549 | 2.11 | 0.58 | 0.86 | 2.8 | 1.88 | 2.9 | 1.86 | 1.87 | 1.42 | | | | |
| HEMBA1006559 | 5.16 | 2.1 | 4.6 | 12.73 | 9.91 | 12.55 | 8.17 | 8.31 | 7.9 | ** | + | * | + |
| HEMBA1006562 | 2.22 | 0.76 | 1.85 | 3.22 | 2.69 | 2.84 | 1.63 | 3.25 | 2.16 | * | + | | |
| HEMBA1006566 | 1.5 | 1.62 | 0.13 | 0.8 | 1.28 | 0.97 | 1.14 | 1.33 | 0.88 | | | | |
| HEMBA1006569 | 4.26 | 2.46 | 1.96 | 4.02 | 5.76 | 5.28 | 3.58 | 2.64 | 3.6 | | | | |
| HEMBA1006572 | 1.59 | 0.24 | 0.54 | 0.56 | 0.89 | 1.09 | 1.05 | 1.04 | 1.21 | | | | |
| HEMBA1006579 | 2.51 | 1.31 | 1.43 | 2.63 | 2.93 | 3.26 | 6.37 | 6.01 | 6.92 | * | + | ** | + |
| HEMBA1006583 | 3.62 | 1.64 | 2.4 | 3.61 | 3.89 | 4.77 | 3.38 | 3.77 | 2.05 | | | | |

TABLE 191

| | | | | | | | | | | | | | |
|---|---|---|---|---|---|---|---|---|---|---|---|---|---|
| HEMBA1006595 | 4.6 | 1.32 | 2.47 | 6.45 | 3.43 | 5.48 | 2.48 | 3.17 | 3.35 | | | | |
| HEMBA1006597 | 6.19 | 2.47 | 4 | 9.61 | 11.89 | 11.02 | 4.43 | 7.63 | 6.03 | ** | + | | |
| HEMBA1006606 | 5.22 | 2.34 | 3.15 | 5.5 | 7.09 | 8.72 | 4.17 | 3.59 | 5.67 | * | + | | |
| HEMBA1006612 | 5.88 | 3.13 | 2.66 | 9.51 | 7.07 | 8.75 | 4.24 | 4.07 | 8.12 | * | + | | |
| HEMBA1006617 | 6.23 | 2.4 | 3.25 | 7.51 | 8.15 | 9.4 | 4.22 | 3.47 | 5.72 | * | + | | |
| HEMBA1006624 | 21.51 | 11.59 | 11.39 | 8.91 | 10.89 | 11.11 | 15.72 | 17.22 | 19.01 | | | | |
| HEMBA1006631 | 11.14 | 7.16 | 5.63 | 14.71 | 13.36 | 15.13 | 9.17 | 8.76 | 9.27 | * | + | | |
| HEMBA1006635 | 3.5 | 1.48 | 1.8 | 6.1 | 5.02 | 7.12 | 3.2 | 2.77 | 3.44 | * | + | | |
| HEMBA1006639 | 5.83 | 1.94 | 3.55 | 4.08 | 4.21 | 4.37 | 3.14 | 4 | 3.07 | | | | |
| HEMBA1006643 | 8.1 | 3.39 | 6.04 | 7.92 | 5.21 | 8.41 | 3.69 | 6.07 | 4.57 | | | | |
| HEMBA1006648 | 7.17 | 4.23 | 2.23 | 4.85 | 5.86 | 6.95 | 5.26 | 5.13 | 6.25 | | | | |
| HEMBA1006652 | 7.55 | 5.4 | 7.95 | 14.31 | 13.73 | 13.23 | 6.43 | 7.1 | 11.54 | ** | + | | |
| HEMBA1006653 | 6.97 | 4.5 | 3.06 | 4.22 | 5.74 | 4.88 | 4.94 | 3.37 | 4.63 | | | | |
| HEMBA1006658 | 7.71 | 4.81 | 3.99 | 9.26 | 8.5 | 11.38 | 5.3 | 4.42 | 6.47 | * | + | | |
| HEMBA1006659 | 7.41 | 4.7 | 3.7 | 5.26 | 4.56 | 4.46 | 6.04 | 3.81 | 4.25 | | | | |
| HEMBA1006665 | 1.62 | 1.53 | 0.92 | 2.6 | 1.66 | 1.94 | 1.6 | 1.36 | 2.14 | | | | |
| HEMBA1006666 | 2.8 | 1.45 | 1.19 | 5.48 | 2.51 | 3.57 | 1.85 | 1.35 | 3.75 | | | | |
| HEMBA1006671 | 4.48 | 2.13 | 2.48 | 3.04 | 6.4 | 6.86 | 3.55 | 4.19 | 4.16 | | | | |
| HEMBA1006674 | 4.97 | 3.16 | 4.4 | 5.76 | 5.14 | 7.87 | 4.61 | 3.42 | 4.54 | | | | |
| HEMBA1006676 | 10.46 | 5.08 | 3.85 | 9.54 | 8.88 | 9.7 | 6.21 | 4.55 | 6.44 | | | | |
| HEMBA1006682 | 2.27 | 1.69 | 1.34 | 3.17 | 2.06 | 2.05 | 4.61 | 1.08 | 3.99 | | | | |
| HEMBA1006688 | 6.01 | 4.37 | 2.5 | 5.47 | 6.02 | 6.19 | 4.31 | 2.6 | 4.14 | | | | |
| HEMBA1006695 | 4.5 | 1.72 | 1.74 | 6.75 | 6.52 | 5.65 | 3.76 | 2.82 | 3.65 | * | + | | |
| HEMBA1006696 | 12.87 | 6.14 | 7.8 | 9.63 | 11.85 | 11.77 | 5.03 | 6.37 | 5.41 | | | | |
| HEMBA1006702 | 2.64 | 1.17 | 1.68 | 3.05 | 1.99 | 2.26 | 2.52 | 2.64 | 2.72 | | | | |
| HEMBA1006707 | 6.85 | 2.92 | 3.19 | 5.67 | 3.46 | 4.24 | 2.84 | 4.21 | 4.09 | | | | |
| HEMBA1006708 | 8.39 | 4.87 | 3.01 | 5.26 | 5 | 6.1 | 6.53 | 3.85 | 5.31 | | | | |
| HEMBA1006709 | 6.65 | 3.16 | 3.47 | 4.07 | 5.63 | 4.68 | 6.45 | 3.52 | 4.44 | | | | |
| HEMBA1006717 | 8.88 | 2.4 | 4.14 | 4.44 | 3.37 | 2.93 | 4.5 | 3.69 | 4.56 | | | | |
| HEMBA1006724 | 3.81 | 3.86 | 1.52 | 3.61 | 3.98 | 3.44 | 2.83 | 2.11 | 3.27 | | | | |
| HEMBA1006731 | 7.51 | 3.16 | 2.94 | 4.8 | 6.48 | 6.17 | 3.61 | 3.73 | 4.13 | | | | |
| HEMBA1006737 | 5.15 | 2.61 | 1.58 | 2.17 | 3.41 | 5.22 | 2.11 | 2.54 | 2.79 | | | | |
| HEMBA1006742 | 4.81 | 2.29 | 1.84 | 6.06 | 4.83 | 6.03 | 2.78 | 3.29 | 3.24 | | | | |
| HEMBA1006743 | 7.87 | 4.47 | 4.75 | 8.29 | 5.08 | 7.45 | 3.49 | 6.04 | 3.57 | | | | |
| HEMBA1006744 | 10.08 | 3.77 | 3.8 | 14.22 | 11.75 | 16.16 | 7.99 | 6.73 | 6.12 | * | + | | |
| HEMBA1006749 | 3.53 | 3.65 | 2.98 | 4.2 | 4.74 | 5.34 | 4.08 | 3.16 | 4.37 | * | + | | |
| HEMBA1006752 | 23.27 | 11.82 | 13.93 | 14.5 | 12.58 | 14.16 | 12.27 | 10.32 | 10.17 | | | | |
| HEMBA1006754 | 1.86 | 1.19 | 1.02 | 4.17 | 4.31 | 3.82 | 2.65 | 2.7 | 3.64 | ** | + | * | + |
| HEMBA1006758 | 8.94 | 5.63 | 3.63 | 4.07 | 5.41 | 4.85 | 3.57 | 4.16 | 2.9 | | | | |
| HEMBA1006767 | 3.06 | 1 | 1.61 | 2.61 | 3 | 3.72 | 1.69 | 2.22 | 2.41 | | | | |
| HEMBA1006770 | 13.78 | 5 | 6.03 | 7.89 | 10.06 | 11.16 | 4.74 | 6.16 | 6.66 | | | | |

TABLE 191-continued

| ID | | | | | | | | | | | | | |
|---|---|---|---|---|---|---|---|---|---|---|---|---|---|
| HEMBA1006779 | 10.4 | 3.74 | 5.54 | 13.72 | 14.85 | 14.12 | 6.44 | 8.3 | 7.48 | * | + | | |
| HEMBA1006780 | 7.08 | 3.47 | 3.59 | 13.82 | 10.5 | 10.84 | 7.75 | 5.05 | 6.84 | * | + | | |
| HEMBA1006789 | 4.72 | 5.04 | 4.21 | 3.76 | 5.14 | 4.99 | 3.13 | 3.89 | 4.1 | | | | |
| HEMBA1006795 | 8.9 | 4.61 | 4.5 | 12.12 | 13.21 | 10.55 | 5.76 | 4.72 | 5.99 | * | + | | |
| HEMBA1006796 | 7.65 | 2.94 | 3.34 | 4.85 | 4.95 | 4.32 | 4.94 | 2.99 | 4.97 | | | | |
| HEMBA1006805 | 6.94 | 4.11 | 2.79 | 6.38 | 6.88 | 9.56 | 5.8 | 4.23 | 4.32 | | | | |
| HEMBA1006807 | 41.87 | 16.77 | 24.31 | 34.14 | 30.28 | 35.28 | 17.64 | 15.46 | 18.76 | | | | |
| HEMBA1006813 | 2.76 | 1.69 | 0.75 | 4.56 | 3.37 | 2.07 | 1.6 | 1.54 | 1.68 | | | | |
| HEMBA1006819 | 5.85 | 2.89 | 4.93 | 3.44 | 4.06 | 3.24 | 2.46 | 2.97 | 2.69 | | | | |
| HEMBA1006821 | 4.19 | 2.43 | 1.27 | 6.45 | 6.7 | 7.35 | 2.91 | 3.28 | 3.89 | ** | + | | |
| HEMBA1006824 | 6.62 | 2.68 | 2.84 | 7.05 | 7.56 | 7.49 | 5.6 | 3.8 | 3.89 | | | | |
| HEMBA1006832 | 34.7 | 31.52 | 23.59 | 34.4 | 30.12 | 38.56 | 20.42 | 16.73 | 24.06 | | | | |
| HEMBA1006834 | 23.99 | 11.25 | 13 | 13.06 | 14.6 | 15.62 | 11.33 | 8.76 | 11.95 | | | | |
| HEMBA1006835 | 4 | 1.43 | 1.9 | 3.69 | 3.2 | 3.36 | 2.22 | 2.96 | 1.96 | | | | |
| HEMBA1006843 | 103.5 | 33.5 | 66.05 | 133.5 | 136.8 | 126.1 | 52.72 | 23.1 | 39.64 | * | + | | |

TABLE 192

| ID | | | | | | | | | | | | | |
|---|---|---|---|---|---|---|---|---|---|---|---|---|---|
| HEMBA1006849 | 7.06 | 2.5 | 3.59 | 4.52 | 8.98 | 7.67 | 3.87 | 4.24 | 3.66 | | | | |
| HEMBA1006850 | 3.68 | 2.41 | 3.49 | 4.12 | 5.88 | 5.61 | 3.45 | 4.3 | 5.71 | * | + | | |
| HEMBA1006861 | 27.48 | 13.2 | 13.78 | 18.39 | 17.49 | 22.76 | 27.79 | 29.56 | 33.72 | | | | |
| HEMBA1006865 | 7.81 | 4.59 | 4.59 | 10.66 | 9.55 | 9.31 | 6.64 | 6.59 | 6.33 | * | + | | |
| HEMBA1006867 | 3.05 | 3.03 | 2.02 | 5.38 | 6.39 | 7.32 | 3.39 | 3.7 | 4.23 | ** | + | | |
| HEMBA1006873 | 3.17 | 1.82 | 1.33 | 4.27 | 2.94 | 4.49 | 4.02 | 3.19 | 3.84 | | | | |
| HEMBA1006877 | 6.27 | 2.4 | 2.17 | 3.46 | 3.06 | 5.26 | 2.31 | 2.13 | 2.61 | | | | |
| HEMBA1006878 | 4.34 | 4.51 | 3.67 | 4.81 | 4.9 | 5.52 | 4.18 | 3.51 | 3.8 | | | | |
| HEMBA1006879 | 17.53 | 11.84 | 12.53 | 14.59 | 8.5 | 17.01 | 9.97 | 13.17 | 14.21 | | | | |
| HEMBA1006884 | 6.78 | 4.78 | 7.19 | 7.57 | 8.09 | 8 | 6.14 | 4.53 | 8 | | | | |
| HEMBA1006885 | 14.47 | 10.91 | 10.29 | 11.14 | 13.59 | 13.12 | 8.92 | 9.99 | 11.51 | | | | |
| HEMBA1006886 | 9.88 | 9.1 | 5.85 | 13.2 | 13.5 | 12.51 | 7.07 | 6.68 | 7.13 | * | + | | |
| HEMBA1006889 | 6.59 | 4.3 | 4.26 | 4.32 | 5.23 | 5.84 | 3.48 | 4.25 | 4.38 | | | | |
| HEMBA1006896 | 16.57 | 11.14 | 9.96 | 13.58 | 12.6 | 17.46 | 13.28 | 8.89 | 13 | | | | |
| HEMBA1006900 | 11.28 | 4.72 | 4.94 | 6.26 | 7.37 | 10.33 | 5.94 | 4.33 | 6.61 | | | | |
| HEMBA1006902 | 2.57 | 1.63 | 2.97 | 3.06 | 2.5 | 3.31 | 2.84 | 4.11 | 2.62 | | | | |
| HEMBA1006912 | 9.86 | 3.49 | 5.48 | 8.69 | 10.41 | 10.91 | 5.79 | 6.47 | 5.76 | | | | |
| HEMBA1006914 | 14.14 | 7.94 | 10.37 | 14.19 | 14.05 | 16.96 | 6.19 | 5.9 | 9.72 | | | | |
| HEMBA1006916 | 9.91 | 7.1 | 4.15 | 7.61 | 7.72 | 7.02 | 3.84 | 3.67 | 4.33 | | | | |
| HEMBA1006921 | 5.33 | 2.22 | 1.77 | 2.75 | 3.09 | 2.98 | 2.63 | 2.52 | 3.45 | | | | |
| HEMBA1006926 | 4.69 | 3.93 | 4.04 | 8.12 | 6.37 | 6.61 | 5.19 | 4.08 | 4.59 | ** | + | | |
| HEMBA1006927 | 2.56 | 1.45 | 1.11 | 4.26 | 3.27 | 5.93 | 2.47 | 2.76 | 2.3 | * | + | | |
| HEMBA1006929 | 3.54 | 1.38 | 2 | 3 | 2.51 | 2.71 | 2.05 | 2.99 | 1.84 | | | | |
| HEMBA1006936 | 6.81 | 2.92 | 3.95 | 7.43 | 7.48 | 8.89 | 3.83 | 5.74 | 3.63 | | | | |
| HEMBA1006938 | 1.33 | 0.26 | 0.47 | 5.31 | 1.59 | 1.56 | 1.54 | 1.69 | 0.91 | | | | |
| HEMBA1006941 | 16.53 | 11.05 | 11.6 | 12.22 | 7.8 | 9.63 | 10.28 | 8.93 | 11.52 | | | | |
| HEMBA1006942 | 8.19 | 4.07 | 6.53 | 8.73 | 9.65 | 14.5 | 10.35 | 7.57 | 10.44 | | | | |
| HEMBA1006945 | 25.04 | 16.05 | 14.06 | 21.51 | 28.59 | 29.47 | 11.94 | 11.2 | 11.54 | | | | |
| HEMBA1006949 | 2.9 | 1.1 | 0.96 | 1.63 | 1.82 | 4.13 | 0.8 | 1.36 | 1.9 | | | | |
| HEMBA1006952 | 3.78 | 1.55 | 1.57 | 2.91 | 2.65 | 3.54 | 2.84 | 4.46 | 4.01 | | | | |
| HEMBA1006960 | 10.85 | 6.07 | 5.14 | 11.23 | 9.86 | 8.27 | 10.08 | 9.22 | 8.03 | | | | |
| HEMBA1006973 | 3.3 | 3.69 | 3.3 | 7.1 | 4.93 | 5.77 | 3.56 | 4.84 | 3.61 | * | + | | |
| HEMBA1006974 | 5.62 | 2.6 | 4.96 | 7.66 | 9.22 | 8.05 | 3.96 | 5.98 | 3.51 | * | + | | |
| HEMBA1006976 | 2.71 | 1.15 | 1.73 | 3.59 | 2.62 | 4.04 | 2.12 | 3.56 | 2.05 | | | | |
| HEMBA1006989 | 0.83 | 0.32 | 0.23 | 0.34 | 1.18 | 1.21 | 0.38 | 0.32 | 1.18 | | | | |
| HEMBA1006993 | 7.77 | 3.49 | 2.52 | 13.12 | 7.8 | 8.64 | 3.93 | 4.49 | 6.13 | | | | |
| HEMBA1006996 | 1.18 | 0.27 | 0.63 | 0.83 | 0.78 | 0.99 | 0.66 | 1 | 0.65 | | | | |
| HEMBA1007001 | 5.49 | 3.33 | 4.13 | 8.5 | 12.04 | 10.88 | 5.67 | 5.2 | 5.4 | ** | + | | |
| HEMBA1007002 | 5.81 | 2.2 | 3.66 | 4.91 | 3.97 | 4.41 | 3.34 | 3.47 | 2.91 | | | | |
| HEMBA1007013 | 3.72 | 1.85 | 2.69 | 3.52 | 4.62 | 4.75 | 3.38 | 4.47 | 2.43 | | | | |
| HEMBA1007016 | 3.01 | 1.36 | 1.4 | 2.83 | 2.49 | 3.86 | 1.86 | 2.87 | 2.52 | | | | |
| HEMBA1007017 | 0.36 | 0.56 | 0.46 | 1.7 | 1.63 | 2.47 | 0.33 | 1.63 | 0.45 | ** | + | | |
| HEMBA1007018 | 9.21 | 6.01 | 5.67 | 4.76 | 4.66 | 5.23 | 4.98 | 4.73 | 5.19 | | | | |
| HEMBA1007044 | 9.95 | 5.07 | 6.68 | 9.58 | 7.21 | 9.83 | 7.74 | 6.77 | 8.84 | | | | |
| HEMBA1007045 | 2.71 | 0.74 | 1.32 | 2.37 | 2.16 | 3.02 | 2.18 | 2.14 | 3.63 | | | | |
| HEMBA1007051 | 4.5 | 1.5 | 2.49 | 3.07 | 5.64 | 4.56 | 4.1 | 1.96 | 3.57 | | | | |
| HEMBA1007052 | 2.79 | 1.47 | 1.81 | 2.94 | 3.23 | 3.76 | 2.14 | 1.66 | 1.93 | * | + | | |
| HEMBA1007053 | 2.08 | 1.3 | 1.15 | 3.49 | 2.13 | 3.23 | 2.17 | 2.69 | 2.75 | * | + | * | + |
| HEMBA1007057 | 4.25 | 1.9 | 2.27 | 4.24 | 3.69 | 4.46 | 2.89 | 2.65 | 3.08 | | | | |
| HEMBA1007062 | 6.55 | 4.08 | 2.49 | 3.19 | 4.21 | 5.74 | 3.61 | 4.05 | 2.65 | | | | |
| HEMBA1007063 | 7.3 | 3.36 | 3.27 | 9.41 | 8.17 | 9.36 | 5.6 | 4.6 | 6.77 | * | + | | |
| HEMBA1007066 | 4.89 | 2.13 | 1.75 | 9.06 | 3.28 | 4.77 | 3.8 | 2.51 | 6.25 | | | | |
| HEMBA1007069 | 3.01 | 1.67 | 1.08 | 4.66 | 3.81 | 6.58 | 2.68 | 2.84 | 4.17 | * | + | | |
| HEMBA1007073 | 3.81 | 1.52 | 1.06 | 5.19 | 3.51 | 7.75 | 1.69 | 2.27 | 1.95 | | | | |
| HEMBA1007076 | 8.06 | 4.01 | 4.39 | 8.06 | 8.27 | 7.87 | 6.08 | 3.95 | 7.1 | | | | |
| HEMBA1007078 | 44.29 | 25.47 | 26.67 | 39.89 | 48.08 | 43.86 | 17.13 | 16.51 | 23.74 | | | | |

TABLE 193

| | | | | | | | | | | | | | |
|---|---|---|---|---|---|---|---|---|---|---|---|---|---|
| HEMBA1007080 | 6.49 | 3.94 | 5.98 | 9.98 | 8.08 | 9.96 | 7.3 | 4.03 | 5.16 | * | + | | |
| HEMBA1007084 | 6.15 | 4.73 | 3.3 | 7.53 | 11.43 | 12.96 | 4.4 | 6.54 | 5.84 | * | + | | |
| HEMBA1007085 | 11.57 | 6.03 | 6.42 | 14.47 | 16.1 | 16.28 | 10.38 | 7.67 | 10.37 | * | + | | |
| HEMBA1007087 | 8.74 | 3.56 | 5.06 | 9.07 | 6.88 | 8.89 | 6.19 | 4.83 | 6.54 | | | | |
| HEMBA1007089 | 4 | 1.08 | 1.76 | 3.78 | 3.23 | 3.34 | 2.04 | 2.11 | 2.69 | | | | |
| HEMBA1007095 | 70.95 | 56.95 | 68.33 | 67.92 | 65.09 | 77.99 | 58.54 | 73.69 | 65.61 | | | | |
| HEMBA1007101 | 8.13 | 4.48 | 3.34 | 8.09 | 6.98 | 8.85 | 8.22 | 8.26 | 10.62 | | | | |
| HEMBA1007104 | 5.96 | 2.89 | 2.91 | 5.64 | 4.63 | 4.55 | 3.31 | 2.95 | 4.74 | | | | |
| HEMBA1007106 | 14.7 | 8.59 | 9.92 | 8.69 | 10.08 | 8.52 | 4.85 | 5.28 | 6.28 | | | * | − |
| HEMBA1007112 | 2.54 | 1.7 | 2.5 | 2.24 | 3.01 | 4.69 | 1.68 | 1.95 | 2.11 | | | | |
| HEMBA1007113 | 6.43 | 3.26 | 3.02 | 9.57 | 10.18 | 12 | 5.01 | 4.74 | 6.51 | ** | + | | |
| HEMBA1007121 | 15.29 | 6.28 | 8.37 | 20.01 | 26.55 | 24.61 | 14 | 11.02 | 13.68 | * | + | | |
| HEMBA1007129 | 4.97 | 2.15 | 2.01 | 4.97 | 3.24 | 4.17 | 3.35 | 2.12 | 2.39 | | | | |
| HEMBA1007147 | 5.38 | 3.65 | 3.3 | 8.42 | 7.76 | 8.81 | 5.26 | 3.94 | 5.49 | ** | + | | |
| HEMBA1007149 | 4.94 | 2.77 | 3.26 | 6.72 | 8.54 | 6.33 | 4.3 | 4.3 | 4.5 | * | + | | |
| HEMBA1007151 | 8.13 | 3.85 | 3.81 | 6.44 | 7.95 | 11.22 | 3.61 | 4.33 | 3.79 | | | | |
| HEMBA1007172 | 7.56 | 3.48 | 4.13 | 7.44 | 5.05 | 7.28 | 4.12 | 5.13 | 4.04 | | | | |
| HEMBA1007174 | 5.89 | 2.49 | 3.67 | 3.93 | 3.83 | 5.88 | 2.72 | 4.89 | 2.91 | | | | |
| HEMBA1007176 | 9.03 | 5.34 | 6.92 | 9.78 | 8.83 | 9.47 | 8.52 | 8 | 9.63 | | | | |
| HEMBA1007178 | 32.55 | 18.88 | 15.14 | 19.06 | 21.65 | 17.59 | 9.08 | 8.47 | 7.89 | | | | |
| HEMBA1007185 | 10.22 | 4.41 | 3.64 | 8.36 | 9.55 | 9.52 | 7.01 | 9.23 | 10.25 | | | | |
| HEMBA1007186 | 5.79 | 5.42 | 2.99 | 5.38 | 6.38 | 4.34 | 5.55 | 4.63 | 4.28 | | | | |
| HEMBA1007194 | 10.77 | 5.25 | 6.27 | 6.05 | 8.58 | 8.52 | 4.54 | 4.6 | 4.86 | | | | |
| HEMBA1007200 | 4.17 | 3 | 2.87 | 3.85 | 3.81 | 6.07 | 2.25 | 5.2 | 3.91 | | | | |
| HEMBA1007203 | 7.33 | 3.38 | 4.4 | 6.6 | 5.9 | 7.76 | 3.26 | 5.38 | 5.31 | | | | |
| HEMBA1007206 | 5.36 | 1.62 | 4.58 | 8.87 | 7.23 | 9.37 | 4.17 | 4.51 | 4.13 | * | + | | |
| HEMBA1007224 | 4.31 | 3.41 | 3.02 | 7.21 | 8.94 | 7.9 | 5.84 | 2.98 | 5.52 | ** | + | | |
| HEMBA1007226 | 8.11 | 2.53 | 3.92 | 5.1 | 4.65 | 5.56 | 3.57 | 3.89 | 3.99 | | | | |
| HEMBA1007240 | 8.19 | 3.25 | 3.14 | 6.63 | 3.95 | 5.13 | 4.82 | 3.47 | 3.83 | | | | |
| HEMBA1007241 | 2.29 | 1.82 | 2.1 | 4.38 | 3.16 | 4.31 | 2.93 | 3.05 | 2.77 | * | + | ** | + |
| HEMBA1007242 | 3.53 | 1.89 | 1.63 | 1.79 | 3.06 | 2.59 | 1.23 | 2.17 | 2.42 | | | | |
| HEMBA1007243 | 5.49 | 1.9 | 2.36 | 5.15 | 4.7 | 4.56 | 2.5 | 2.45 | 3.07 | | | | |
| HEMBA1007251 | 3.85 | 1.52 | 2.26 | 3.21 | 2.8 | 3.04 | 1.54 | 2.44 | 1.83 | | | | |
| HEMBA1007256 | 2.11 | 1.7 | 2.58 | 4.85 | 3.63 | 4.4 | 1.15 | 2.23 | 2.07 | ** | + | | |
| HEMBA1007267 | 8.06 | 2.62 | 3.26 | 10.13 | 10.25 | 11.99 | 6.27 | 4.97 | 6.51 | * | + | | |
| HEMBA1007273 | 2.76 | 1.75 | 1.08 | 1.92 | 1.89 | 2.71 | 1.52 | 1.78 | 1.02 | | | | |
| HEMBA1007279 | 2.55 | 1.22 | 1.16 | 1.3 | 3.65 | 2.92 | 1.5 | 1.89 | 2.13 | | | | |
| HEMBA1007281 | 2.07 | 1.07 | 0.43 | 1.29 | 1.21 | 1.04 | 1.02 | 1.25 | 1.12 | | | | |
| HEMBA1007283 | 6.62 | 2.63 | 3.23 | 3.75 | 3.81 | 4.38 | 2.75 | 2.29 | 3.75 | | | | |
| HEMBA1007288 | 3.75 | 1.29 | 2.66 | 5.75 | 6.28 | 6.21 | 1.78 | 2.89 | 4.17 | ** | + | | |
| HEMBA1007291 | 3.22 | 0.96 | 1.72 | 2.4 | 3.14 | 3.81 | 1.55 | 2.4 | 4.26 | | | | |
| HEMBA1007299 | 23.93 | 13.7 | 15.73 | 10.56 | 22.18 | 16.89 | 17.86 | 19.6 | 16.71 | | | | |
| HEMBA1007300 | 6.22 | 3.89 | 1.52 | 4.87 | 4.49 | 5.57 | 2.96 | 3.67 | 3.54 | | | | |
| HEMBA1007301 | 4.77 | 2.47 | 2.12 | 3.91 | 6.06 | 4.53 | 5.31 | 3.92 | 4.11 | | | | |
| HEMBA1007319 | 5.04 | 2.71 | 2.66 | 4.51 | 4.51 | 4.65 | 2.4 | 2.58 | 1.88 | | | | |
| HEMBA1007320 | 3.5 | 1.62 | 1.5 | 3 | 2.95 | 3.58 | 2.72 | 2.88 | 2.98 | | | | |
| HEMBA1007322 | 28.33 | 24.69 | 28.25 | 30.89 | 47.79 | 40.83 | 20.16 | 16.66 | 16.95 | | | ** | − |
| HEMBA1007323 | 6.68 | 1.59 | 2.78 | 3.35 | 2.99 | 4.54 | 1.69 | 2.27 | 2.61 | | | | |
| HEMBA1007326 | 16.87 | 9.35 | 13.09 | 29.82 | 36.45 | 31.07 | 12.34 | 13.22 | 15.57 | ** | + | | |
| HEMBA1007327 | 6.34 | 3.6 | 4.38 | 10.61 | 13.22 | 12.6 | 4.55 | 6.34 | 5.25 | ** | + | | |
| HEMBA1007332 | 13.26 | 4.92 | 5.19 | 6.74 | 8.15 | 8.34 | 6.2 | 5.28 | 6.24 | | | | |
| HEMBA1007341 | 3.07 | 1.51 | 1.92 | 5.68 | 4.8 | 6.45 | 2.94 | 3.15 | 3.13 | ** | + | | |
| HEMBA1007342 | 3.54 | 1.8 | 1.84 | 3.52 | 2.33 | 2.69 | 2.06 | 2.55 | 1.53 | | | | |
| HEMBA1007347 | 6.86 | 4.49 | 4.81 | 9.76 | 12.67 | 13.86 | 6.9 | 5.92 | 8.38 | ** | + | | |
| HEMBA1007353 | 2.54 | 1.91 | 1.06 | 2.5 | 3.01 | 2.77 | 1.29 | 2.06 | 1.66 | | | | |
| HEMBB1000005 | 5.95 | 3.76 | 2.97 | 7.43 | 7.91 | 9.69 | 2.81 | 4.53 | 3.98 | * | + | | |

TABLE 194

| | | | | | | | | | | | | | |
|---|---|---|---|---|---|---|---|---|---|---|---|---|---|
| HEMBB1000008 | 6.33 | 3.99 | 3.55 | 9.32 | 9.9 | 11.83 | 4.69 | 4.68 | 5.58 | ** | + | | |
| HEMBB1000018 | 9.18 | 4.31 | 7.12 | 14.89 | 18.9 | 20.93 | 7.15 | 7.95 | 8.65 | ** | + | | |
| HEMBB1000024 | 8.61 | 5.93 | 3.83 | 12.18 | 15.58 | 14.42 | 6.22 | 5.32 | 8.3 | ** | + | | |
| HEMBB1000025 | 7.18 | 1.68 | 2.62 | 5.76 | 5.35 | 5.09 | 4.63 | 4.5 | 5.11 | | | | |
| HEMBB1000030 | 5.99 | 4.74 | 5.88 | 11.95 | 12.01 | 10.44 | 5.68 | 5.83 | 6.43 | ** | + | | |
| HEMBB1000036 | 5.65 | 4.09 | 3.36 | 4.79 | 4.59 | 7.69 | 4.76 | 4.78 | 5.5 | | | | |
| HEMBB1000037 | 6.62 | 4.31 | 5.17 | 7.83 | 6.16 | 9.26 | 6.18 | 5.41 | 5.32 | | | | |
| HEMBB1000039 | 3.3 | 1.35 | 2.08 | 5.56 | 6.46 | 6.46 | 3.88 | 3.39 | 2.84 | ** | + | | |
| HEMBB1000044 | 8.31 | 2.86 | 3 | 8.94 | 8.97 | 9.22 | 3.67 | 5.53 | 3.74 | | | | |
| HEMBB1000048 | 4.16 | 1.72 | 3.61 | 5.69 | 6.15 | 8.14 | 3.51 | 4.43 | 3.25 | * | + | | |
| HEMBB1000050 | 5.5 | 1.49 | 1.55 | 3.76 | 8.59 | 5.41 | 2.51 | 2.18 | 3.82 | | | | |
| HEMBB1000054 | 5.55 | 2 | 2.53 | 9.07 | 6.03 | 8.7 | 7.15 | 3.88 | 5.66 | * | + | | |
| HEMBB1000055 | 24.4 | 16.2 | 17.8 | 18.24 | 19.34 | 22.83 | 9.69 | 8.54 | 9.54 | | | * | − |
| HEMBB1000059 | 8.8 | 6.35 | 7.84 | 16.75 | 19.27 | 21.09 | 9.69 | 10.78 | 9.65 | ** | + | * | + |
| HEMBB1000072 | 9.51 | 4.64 | 5.32 | 12.83 | 10.68 | 11.19 | 7.97 | 7.6 | 5.64 | * | + | | |
| HEMBB1000081 | 3.87 | 1.35 | 1.85 | 5.08 | 5.24 | 4.46 | 3.77 | 3.99 | 4.68 | * | + | | |
| HEMBB1000083 | 4.74 | 2.08 | 3.56 | 8.88 | 6 | 6.36 | 3.2 | 5.07 | 6.07 | * | + | | |

TABLE 194-continued

| | | | | | | | | | | | | | |
|---|---|---|---|---|---|---|---|---|---|---|---|---|---|
| HEMBB1000089 | 3.6 | 2.1 | 3.13 | 10.31 | 7.12 | 8.77 | 3.62 | 4.07 | 4.02 | ** | + | | |
| HEMBB1000094 | 10.03 | 4.21 | 5.44 | 7.27 | 9.1 | 10.43 | 5.68 | 3.83 | 7.07 | | | | |
| HEMBB1000097 | 2.21 | 1.8 | 1.66 | 3.6 | 3.78 | 2.43 | 2.31 | 1.65 | 1.94 | * | + | | |
| HEMBB1000099 | 6 | 2.44 | 5.07 | 9.23 | 13.61 | 11.37 | 6.57 | 5.71 | 7.13 | * | + | | |
| HEMBB1000103 | 11.08 | 5.29 | 6.37 | 9.34 | 10.14 | 10.72 | 4.69 | 6.24 | 4.67 | | | | |
| HEMBB1000106 | 6.42 | 4 | 5.39 | 8.37 | 6.27 | 6.82 | 6.5 | 5.47 | 4.71 | | | | |
| HEMBB1000113 | 2.17 | 2 | 1.61 | 3.56 | 3.45 | 3.36 | 1.25 | 3.37 | 2.9 | ** | + | | |
| HEMBB1000119 | 4.55 | 2.45 | 4.15 | 5.3 | 3.89 | 4.98 | 2.17 | 5.09 | 5.65 | | | | |
| HEMBB1000133 | 36.74 | 19.87 | 32.19 | 17.43 | 2.43 | 25.47 | 18.03 | 19.17 | 26.05 | | | | |
| HEMBB1000134 | 8.1 | 5.02 | 4.94 | 5.99 | 6.85 | 11.63 | 3.4 | 5.64 | 6.33 | | | | |
| HEMBB1000136 | 4.52 | 2.17 | 1.45 | 2.82 | 2.31 | 2.54 | 3.01 | 2.62 | 4.93 | | | | |
| HEMBB1000141 | 5.34 | 2.26 | 2.68 | 7.34 | 8.23 | 8.82 | 4.82 | 3.93 | 6.2 | * | + | | |
| HEMBB1000144 | 4.28 | 3 | 3.58 | 12.18 | 6.95 | 9.35 | 4.11 | 4.95 | 6.86 | * | + | | |
| HEMBB1000147 | 3 | 2.36 | 0.48 | 3.68 | 2.83 | 3.66 | 1.75 | 1.4 | 2.8 | | | | |
| HEMBB1000152 | 4.26 | 2.59 | 2.98 | 3.85 | 2.52 | 3.5 | 2.62 | 3.23 | 3.16 | | | | |
| HEMBB1000154 | 3.63 | 1.65 | 1.97 | 5.05 | 4.98 | 5.15 | 2.28 | 3.46 | 4.23 | * | + | | |
| HEMBB1000155 | 3.1 | 2.14 | 2.06 | 3.13 | 4.38 | 4.5 | 2.17 | 2.09 | 2.04 | * | + | | |
| HEMBB1000173 | 11.42 | 5.05 | 6.29 | 19.61 | 16.74 | 17.56 | 10.24 | 8.45 | 9.62 | ** | + | | |
| HEMBB1000175 | 3.73 | 1.02 | 1.8 | 5.42 | 5.67 | 6.02 | 2.9 | 2.66 | 4.4 | * | + | | |
| HEMBB1000176 | 5.82 | 2.57 | 3.52 | 6.79 | 7.3 | 6.93 | 5.44 | 4.12 | 6.38 | * | + | | |
| HEMBB1000198 | 2.93 | 1.33 | 0.9 | 2.24 | 0.81 | 1.87 | 1.77 | 0.77 | 1.87 | | | | |
| HEMBB1000208 | 3.02 | 2.41 | 1.68 | 3.5 | 2.31 | 3.21 | 2.28 | 1.81 | 1.61 | | | | |
| HEMBB1000209 | 4.47 | 2.11 | 2.26 | 5.05 | 5.4 | 5.79 | 2.1 | 3.16 | 2.24 | * | + | | |
| HEMBB1000212 | 4.74 | 2.38 | 2.45 | 3.32 | 2.97 | 6.08 | 1.78 | 3.81 | 2.18 | | | | |
| HEMBB1000215 | 12.22 | 6.74 | 7.81 | 16.21 | 19.51 | 21.21 | 10.04 | 11.3 | 10.31 | * | + | | |
| HEMBB1000217 | 18.97 | 9.31 | 7.7 | 15.35 | 13.44 | 12.33 | 8.45 | 8.5 | 11.37 | | | | |
| HEMBB1000218 | 7.88 | 3.65 | 4.15 | 11.14 | 12.99 | 13.65 | 6.32 | 5.71 | 6.71 | ** | + | | |
| HEMBB1000226 | 9.75 | 5.82 | 3.67 | 9.36 | 7.18 | 7.09 | 5.55 | 5.63 | 5.67 | | | | |
| HEMBB1000230 | 2.5 | 1.54 | 1.56 | 3.16 | 2.41 | 2.47 | 1.66 | 1.86 | 2.28 | | | | |
| HEMBB1000240 | 2.54 | 1.04 | 1.59 | 2.21 | 2.34 | 2.83 | 1.25 | 2.23 | 1.86 | | | | |
| HEMBB1000244 | 3.34 | 2.45 | 3.05 | 3.32 | 3.23 | 3.4 | 1.54 | 2.3 | 1.85 | | | * | − |
| HEMBB1000250 | 1.92 | 1.49 | 1.19 | 1.79 | 2.36 | 1.56 | 0.91 | 1.67 | 0.72 | | | | |
| HEMBB1000258 | 8.84 | 4.21 | 4.45 | 9.29 | 10.64 | 11.84 | 4.49 | 4.85 | 5.22 | * | + | | |
| HEMBB1000264 | 11.16 | 4.23 | 7.12 | 14.33 | 14.62 | 15.26 | 8.98 | 6.17 | 8.91 | * | + | | |
| HEMBB1000266 | 7.49 | 4.1 | 3.58 | 5.54 | 5.59 | 6.27 | 4.11 | 3.08 | 5.07 | | | | |
| HEMBB1000272 | 2.85 | 3.68 | 1.74 | 6.38 | 5.8 | 6.11 | 4.03 | 3.45 | 3.01 | ** | + | | |
| HEMBB1000274 | 2.69 | 2.43 | 1.42 | 2.28 | 4.59 | 4.22 | 4.06 | 2.32 | 2.95 | | | | |
| HEMBB1000276 | 2.16 | 0.94 | 0.86 | 1.1 | 3.12 | 1.78 | 0.56 | 0.79 | 1.49 | | | | |
| HEMBB1000284 | 1.6 | 1.41 | 0.82 | 1.43 | 1.65 | 1.76 | 0.92 | 1.04 | 2.24 | | | | |

TABLE 195

| | | | | | | | | | | | | | |
|---|---|---|---|---|---|---|---|---|---|---|---|---|---|
| HEMBB1000307 | 4.53 | 1.84 | 2.11 | 5.17 | 5.68 | 6.34 | 1.82 | 4.17 | 2.46 | * | + | | |
| HEMBB1000309 | 4.37 | 1.32 | 2.88 | 3.56 | 4.27 | 5.98 | 1.82 | 3.44 | 1.73 | | | | |
| HEMBB1000312 | 1.28 | 2.42 | 1.55 | 2.15 | 2.18 | 2.23 | 2 | 1.79 | 3.52 | | | | |
| HEMBB1000317 | 3.2 | 2.61 | 1.78 | 3.01 | 2.88 | 2.59 | 3.81 | 2.77 | 1.93 | | | | |
| HEMBB1000318 | 4.73 | 1.3 | 2.1 | 5.96 | 5.69 | 5.2 | 3.19 | 2.91 | 3.3 | | | | |
| HEMBB1000332 | 1.76 | 1.25 | 0.79 | 0.91 | 1.05 | 1.63 | 1.26 | 1.46 | 1.31 | | | | |
| HEMBB1000335 | 2.8 | 1.5 | 1.13 | 1.18 | 3.42 | 3.3 | 2.66 | 1.47 | 1.27 | | | | |
| HEMBB1000336 | 4.55 | 1.96 | 1.92 | 2.95 | 2.84 | 3.92 | 3.25 | 2.93 | 2.41 | | | | |
| HEMBB1000337 | 14.36 | 7.11 | 10.05 | 9.07 | 12 | 11.79 | 6.71 | 8.68 | 8.74 | | | | |
| HEMBB1000338 | 4.54 | 3.23 | 3.69 | 5.82 | 6.25 | 7.43 | 2.29 | 3.11 | 3.62 | * | + | | |
| HEMBB1000339 | 6.86 | 3.25 | 2.73 | 8.08 | 11.02 | 9.45 | 5.52 | 5.3 | 4.99 | * | + | | |
| HEMBB1000341 | 6.67 | 3.9 | 3.27 | 5.51 | 6.05 | 5.75 | 4.88 | 3.76 | 5.53 | | | | |
| HEMBB1000343 | 5.14 | 3.78 | 3.56 | 8.73 | 11.85 | 8.26 | 4.26 | 5.37 | 4.59 | * | + | | |
| HEMBB1000354 | 5.87 | 3.91 | 3.47 | 10.81 | 11.74 | 10.84 | 4.26 | 5.4 | 6.59 | ** | + | | |
| HEMBB1000358 | 6.98 | 3.62 | 4.09 | 5.18 | 4.64 | 6.14 | 4.86 | 3.92 | 4.34 | | | | |
| HEMBB1000369 | 3.23 | 1.7 | 2.29 | 3.08 | 3.51 | 3.68 | 1.39 | 2.56 | 1.97 | | | | |
| HEMBB1000373 | 11.86 | 5.42 | 7.78 | 12.45 | 14.15 | 14.43 | 4.75 | 5.77 | 6.52 | | | | |
| HEMBB1000374 | 8.03 | 4.3 | 5.09 | 13.94 | 16.47 | 17.13 | 5.55 | 9.31 | 7.38 | ** | + | | |
| HEMBB1000376 | 11.27 | 4.35 | 3.91 | 16.2 | 18.49 | 19.55 | 9.94 | 8.36 | 10.29 | * | + | | |
| HEMBB1000383 | 4.6 | 2.17 | 1.96 | 4.57 | 3.4 | 3.45 | 10.39 | 7.52 | 9.9 | | | ** | + |
| HEMBB1000391 | 6.84 | 4.23 | 4.83 | 6 | 8.02 | 7.16 | 4.22 | 5.21 | 3.67 | | | | |
| HEMBB1000399 | 5.23 | 1.96 | 3.15 | 3.41 | 3.17 | 3.69 | 3.69 | 3.13 | 1.81 | | | | |
| HEMBB1000402 | 2.6 | 1.48 | 0.94 | 2.16 | 3.1 | 1.88 | 0.98 | 2.21 | 2.08 | | | | |
| HEMBB1000404 | 1.75 | 0.76 | 1.14 | 1.48 | 2.07 | 2.27 | 1.05 | 1.58 | 1.14 | | | | |
| HEMBB1000407 | 1.46 | 1.26 | 1.6 | 1.67 | 2.46 | 3.55 | 0.54 | 2.33 | 2.09 | | | | |
| HEMBB1000420 | 6.02 | 3.01 | 5.42 | 7.53 | 9.7 | 10.11 | 3.76 | 5.07 | 4.73 | * | + | | |
| HEMBB1000430 | 59.23 | 34.65 | 23.06 | 49.23 | 46.08 | 51.49 | 46.72 | 34.37 | 41.23 | | | | |
| HEMBB1000434 | 18.16 | 8.94 | 9.74 | 22.34 | 23.72 | 31.12 | 11.49 | 11.35 | 12.88 | * | + | | |
| HEMBB1000438 | 2.81 | 0.97 | 1.46 | 1.87 | 3.06 | 1.59 | 2.06 | 2.06 | 1.78 | | | | |
| HEMBB1000441 | 5.61 | 4.55 | 3.22 | 9.46 | 9.64 | 11.7 | 6.15 | 5.84 | 7.17 | ** | + | | |
| HEMBB1000447 | 6.8 | 2.32 | 3.46 | 10.82 | 16.06 | 18.31 | 25.43 | 26.28 | 30.87 | * | + | ** | + |
| HEMBB1000449 | 1.31 | 0.73 | 0.5 | 2.05 | 2.12 | 2.41 | 1.36 | 2.6 | 1.7 | ** | + | | |
| HEMBB1000453 | 8.09 | 6.85 | 8.91 | 11.38 | 10.07 | 15.36 | 7.99 | 10.3 | 12.98 | | | | |
| HEMBB1000455 | 2.98 | 3.4 | 2.03 | 3.63 | 4.91 | 3.97 | 1.67 | 3.24 | 1.52 | | | | |

TABLE 195-continued

| | | | | | | | | | | | | | |
|---|---|---|---|---|---|---|---|---|---|---|---|---|---|
| HEMBB1000472 | 7.59 | 4.06 | 3.3 | 4.71 | 4.91 | 6.8 | 5.17 | 4.42 | 5.06 | | | | |
| HEMBB1000480 | 9.8 | 3.69 | 3.57 | 8.18 | 11.17 | 10.77 | 5.35 | 5.7 | 6.17 | | | | |
| HEMBB1000486 | 7.07 | 2.27 | 3.48 | 8.16 | 9.71 | 10.13 | 5.36 | 5.39 | 6.03 | * | + | | |
| HEMBB1000487 | 2.41 | 1.44 | 1.32 | 2.02 | 2.24 | 3.56 | 1.77 | 2.52 | 2.72 | | | | |
| HEMBB1000490 | 9.25 | 6.82 | 8.08 | 12.41 | 16.92 | 19.33 | 9.89 | 8.92 | 10.33 | * | + | | |
| HEMBB1000491 | 6.31 | 3.37 | 4.57 | 9.52 | 7.65 | 10.48 | 5.02 | 4.69 | 3.79 | * | + | | |
| HEMBB1000492 | 2.22 | 0.64 | 1.44 | 4.93 | 5.13 | 7.41 | 2.99 | 2.91 | 3.63 | ** | + | * | + |
| HEMBB1000493 | 4.06 | 2.22 | 4.19 | 4.24 | 6.19 | 6.18 | 1.66 | 2.72 | 2.91 | | | | |
| HEMBB1000510 | 6.41 | 3.47 | 4.28 | 6.87 | 9.13 | 11.79 | 5.4 | 4.78 | 5.74 | | | | |
| HEMBB1000516 | 4.76 | 2.42 | 3.32 | 9.01 | 5.12 | 5.56 | 4.9 | 3.1 | 6.78 | | | | |
| HEMBB1000518 | 1.77 | 0.89 | 0.96 | 2.32 | 1.98 | 1.84 | 1.86 | 2.02 | 1.38 | | | | |
| HEMBB1000523 | 5.6 | 4.26 | 4.37 | 10.14 | 11.92 | 12.71 | 5.32 | 6.89 | 8.07 | ** | + | | |
| HEMBB1000530 | 2.95 | 1.4 | 1.93 | 9.88 | 7.75 | 9.87 | 4.5 | 4.51 | 2.86 | ** | + | | |
| HEMBB1000542 | 8.28 | 5.69 | 6.91 | 10.8 | 11.2 | 12.53 | 8.2 | 7.18 | 7.39 | ** | + | | |
| HEMBB1000550 | 1.32 | 0.8 | 1.53 | 2.82 | 2.53 | 3.26 | 1.75 | 3.01 | 2.05 | ** | + | | |
| HEMBB1000554 | 7.82 | 3.63 | 5.16 | 11.58 | 14.79 | 21.33 | 5.25 | 6.34 | 9.2 | * | + | | |
| HEMBB1000556 | 7.65 | 3.11 | 3.74 | 5.66 | 6.17 | 8.22 | 5.32 | 4.21 | 5.38 | | | | |
| HEMBB1000564 | 4.88 | 2.2 | 2.92 | 4.79 | 4.84 | 5.7 | 5.46 | 2.87 | 3.44 | | | | |
| HEMBB1000567 | 11.63 | 5.99 | 6.65 | 15.29 | 18.3 | 19.22 | 9.27 | 9.36 | 9.27 | * | + | | |
| HEMBB1000569 | 5.23 | 1.99 | 2.42 | 5.2 | 5.06 | 5.8 | 7.16 | 8.5 | 8.18 | | | * | + |
| HEMBB1000573 | 7.84 | 3.79 | 4.94 | 12.01 | 13.33 | 13.4 | 9.04 | 8.26 | 7.72 | ** | + | | |
| HEMBB1000575 | 5.33 | 4.35 | 4.85 | 8.19 | 11.22 | 12.98 | 7.01 | 6.31 | 6.36 | * | + | ** | + |

TABLE 196

| | | | | | | | | | | | | | |
|---|---|---|---|---|---|---|---|---|---|---|---|---|---|
| HEMBB1000579 | 1 | 0.63 | 1.23 | 1.94 | 1.94 | 1.61 | 0.75 | 2.27 | 0.83 | * | + | | |
| HEMBB1000585 | 1.32 | 0.9 | 1.33 | 2.89 | 2.66 | 2.35 | 1.39 | 2.41 | 1.82 | ** | + | | |
| HEMBB1000586 | 5.03 | 2.33 | 2.86 | 4.93 | 10.49 | 10.9 | 3.19 | 3.33 | 3.66 | | | | |
| HEMBB1000589 | 4.34 | 3.31 | 2.32 | 4.73 | 9.62 | 7.86 | 4.05 | 4.47 | 4.07 | | | | |
| HEMBB1000591 | 6.2 | 2.47 | 3.35 | 5.53 | 10.43 | 9.55 | 5.26 | 4.88 | 5.68 | | | | |
| HEMBB1000592 | 3.62 | 1.12 | 1.49 | 3.68 | 3.48 | 4.83 | 5.06 | 2.83 | 3.4 | | | | |
| HEMBB1000593 | 5.63 | 3.16 | 4.14 | 7.95 | 8.98 | 9.6 | 4.23 | 4.57 | 4.71 | ** | + | | |
| HEMBB1000595 | 9.73 | 4.88 | 6.49 | 11.51 | 8.83 | 10.26 | 5.12 | 4.65 | 3.54 | | | | |
| HEMBB1000598 | 3.08 | 2.45 | 2 | 3.88 | 5.18 | 4.28 | 2.89 | 4.3 | 2.68 | * | + | | |
| HEMBB1000611 | 1.33 | 0.64 | 1.43 | 2.46 | 1.17 | 1.82 | 0.83 | 1.24 | 1.6 | | | | |
| HEMBB1000617 | 12.12 | 5.56 | 4.61 | 11.59 | 16.06 | 19.06 | 7.94 | 6.34 | 10.85 | | | | |
| HEMBB1000623 | 7.8 | 2.76 | 2.97 | 7.01 | 3.89 | 6.02 | 4.57 | 2.94 | 6.61 | | | | |
| HEMBB1000630 | 2.59 | 1.28 | 1.39 | 2.17 | 2.39 | 2.78 | 2.69 | 2.13 | 3.79 | | | | |
| HEMBB1000631 | 10.27 | 4.76 | 4.53 | 6.2 | 6.77 | 8.48 | 8.04 | 7.46 | 8.07 | | | | |
| HEMBB1000632 | 6.25 | 2.1 | 3.02 | 6.63 | 6.59 | 8.13 | 4.84 | 4.67 | 4.51 | | | | |
| HEMBB1000636 | 13.35 | 4.72 | 8.11 | 7.29 | 10 | 13.28 | 8.71 | 9.3 | 9.58 | | | | |
| HEMBB1000637 | 26.51 | 17.46 | 16.75 | 28.37 | 43.24 | 52.91 | 24.53 | 21.76 | 22.76 | | | | |
| HEMBB1000638 | 1.76 | 0.67 | 1.19 | 2.95 | 4.12 | 4.45 | 1.31 | 0.92 | 1.68 | ** | + | | |
| HEMBB1000642 | 10.59 | 4.41 | 5.99 | 11.15 | 12.92 | 13.73 | 6.73 | 6.84 | 9.2 | * | + | | |
| HEMBB1000643 | 1.65 | 1.83 | 1.24 | 2.38 | 2.51 | 3.19 | 2.28 | 0.92 | 1.97 | * | + | | |
| HEMBB1000649 | 3.91 | 2.47 | 2.78 | 5.9 | 5.23 | 6.96 | 3.56 | 3.95 | 5.15 | * | + | | |
| HEMBB1000652 | 6.02 | 2.91 | 2.8 | 5.46 | 7.5 | 7.04 | 3.21 | 3.43 | 4.33 | | | | |
| HEMBB1000655 | 12.28 | 6.34 | 8.07 | 9.28 | 11.26 | 11.56 | 6.56 | 3.92 | 6.25 | | | | |
| HEMBB1000665 | 1.52 | 0.76 | 1.22 | 2.5 | 1.48 | 1.81 | 2.25 | 0.85 | 1.56 | | | | |
| HEMBB1000668 | 2.21 | 0.39 | 1.35 | 5.91 | 7.44 | 6.43 | 4.09 | 4.69 | 4.22 | ** | + | ** | + |
| HEMBB1000671 | 9.73 | 3.87 | 4.11 | 15 | 14.71 | 15.82 | 8.84 | 8.17 | 8.33 | ** | + | | |
| HEMBB1000673 | 2 | 0.92 | 2.42 | 2.06 | 2.03 | 2.24 | 2.77 | 0.96 | 1.66 | | | | |
| HEMBB1000679 | 1.96 | 1.55 | 2.94 | 3.03 | 1.89 | 3.47 | 3.49 | 2.72 | 4.24 | | | | |
| HEMBB1000684 | 10.32 | 4.72 | 6.06 | 13.49 | 17.19 | 16.84 | 8.71 | 6 | 9.32 | * | + | | |
| HEMBB1000692 | 2.42 | 1.11 | 1.48 | 1.94 | 1.06 | 1.01 | 1.68 | 1.28 | 1.89 | | | | |
| HEMBB1000693 | 6.65 | 3.11 | 3.35 | 5.7 | 3.46 | 5.14 | 5.27 | 4.98 | 4.93 | | | | |
| HEMBB1000705 | 4.28 | 2.03 | 1.45 | 4.17 | 5.14 | 4.6 | 2.08 | 2.85 | 2.66 | | | | |
| HEMBB1000706 | 2.4 | 0.82 | 1.33 | 4.76 | 1.91 | 1.69 | 2.35 | 1.33 | 2.24 | | | | |
| HEMBB1000709 | 5.9 | 4.56 | 2.82 | 9.88 | 15.43 | 11.7 | 9.92 | 8.98 | 12.92 | * | + | * | + |
| HEMBB1000714 | 4.07 | 1.84 | 2.28 | 3.51 | 2.48 | 3.46 | 4.34 | 1.56 | 2.5 | | | | |
| HEMBB1000725 | 3.83 | 2.12 | 2.8 | 3.51 | 3.57 | 2.91 | 4.38 | 2.17 | 3.5 | | | | |
| HEMBB1000726 | 6.74 | 3.26 | 3.37 | 8.38 | 10.66 | 11.11 | 5.09 | 6.26 | 5.9 | * | + | | |
| HEMBB1000729 | 5.92 | 3.12 | 3.67 | 3.82 | 5.2 | 5.28 | 2.93 | 3.03 | 3.74 | | | | |
| HEMBB1000738 | 6.27 | 2.98 | 4.84 | 7.01 | 7 | 9.14 | 5.8 | 4.68 | 8.01 | | | | |
| HEMBB1000749 | 6.38 | 4.5 | 8.03 | 10.82 | 12.38 | 19.82 | 6.87 | 7.43 | 9.13 | | | | |
| HEMBB1000763 | 4.28 | 1.52 | 4.69 | 3.87 | 3.73 | 4.04 | 3.58 | 5.24 | 3.54 | | | | |
| HEMBB1000770 | 2.56 | 1.54 | 1.45 | 4.69 | 5.02 | 5.12 | 3.94 | 2.82 | 2.01 | ** | + | | |
| HEMBB1000774 | 4.01 | 2.16 | 2.61 | 6.02 | 5.76 | 6.03 | 4.48 | 3.56 | 3.59 | ** | + | | |
| HEMBB1000777 | 16.82 | 8.94 | 10.71 | 11.64 | 9.96 | 10.04 | 11.16 | 9.95 | 10.48 | | | | |
| HEMBB1000781 | 4.68 | 2.51 | 2.03 | 4.83 | 6.62 | 5.74 | 2.82 | 4.66 | 5.27 | | | | |
| HEMBB1000788 | 1.26 | 1.09 | 0.22 | 0.77 | 1.4 | 0.96 | 0.82 | 1.05 | 1.38 | | | | |
| HEMBB1000789 | 3.3 | 1.16 | 1.77 | 2.42 | 1.9 | 2.76 | 1.89 | 2.74 | 1.95 | | | | |
| HEMBB1000790 | 4.72 | 2.05 | 3.39 | 5.79 | 6.37 | 7.78 | 3.19 | 2.91 | 4.28 | * | + | | |
| HEMBB1000794 | 0.97 | 0.54 | 1.08 | 1.04 | 2.04 | 2.15 | 0.72 | 1.24 | 1.02 | | | | |
| HEMBB1000807 | 7.3 | 3.23 | 3.76 | 7.53 | 4.81 | 6.34 | 3.19 | 2.77 | 3.98 | | | | |
| HEMBB1000809 | 10.2 | 3.24 | 6.13 | 7.78 | 12.54 | 11.13 | 7.52 | 8.8 | 9.69 | | | | |

TABLE 196-continued

| | | | | | | | | | | | | | |
|---|---|---|---|---|---|---|---|---|---|---|---|---|---|
| HEMBB1000810 | 6.83 | 2.64 | 2.68 | 4.19 | 3.73 | 4.74 | 4.18 | 2.82 | 5.16 | | | | |
| HEMBB1000821 | 3.04 | 1.01 | 1.43 | 1 | 1.91 | 2.05 | 1.27 | 2.15 | 1.75 | | | | |
| HEMBB1000822 | 1.16 | 1.15 | 0.89 | 1.14 | 1.34 | 1 | 1.68 | 1.67 | 1.68 | ** | + | | |
| HEMBB1000826 | 3.27 | 2.25 | 2.9 | 2.37 | 8.91 | 8.1 | 2.85 | 5.14 | 2.76 | | | | |
| HEMBB1000827 | 4.04 | 1.85 | 2.66 | 4.07 | 6.2 | 5.58 | 3.55 | 3.41 | 2.85 | | | | |

TABLE 197

| | | | | | | | | | | | | | |
|---|---|---|---|---|---|---|---|---|---|---|---|---|---|
| HEMBB1000831 | 5.58 | 1.72 | 2.71 | 4.5 | 3.81 | 4.21 | 2.23 | 2.64 | 2.11 | | | | |
| HEMBB1000835 | 4 | 1.57 | 1.01 | 4.73 | 4.53 | 5.6 | 3.04 | 2.52 | 2.85 | * | + | | |
| HEMBB1000840 | 6.38 | 3.54 | 3.15 | 8.28 | 10.6 | 8.97 | 6.91 | 4.2 | 4.08 | * | + | | |
| HEMBB1000848 | 4.7 | 2.4 | 2.04 | 8.23 | 8.85 | 8.6 | 7.06 | 5.5 | 6.33 | ** | + | * | + |
| HEMBB1000852 | 0.54 | 0.28 | 0.27 | 0.52 | 0.36 | 0.24 | 1.16 | 0.97 | 0.61 | | | * | + |
| HEMBB1000857 | 7.91 | 6.39 | 3.23 | 5.68 | 6.47 | 7.09 | 4.42 | 3.6 | 4.37 | | | | |
| HEMBB1000858 | 5.33 | 2.35 | 2.78 | 9.3 | 8.37 | 8.17 | 3.94 | 3.82 | 2.97 | ** | + | | |
| HEMBB1000867 | 5.01 | 2.6 | 3.3 | 9.23 | 10.12 | 8.69 | 3.49 | 5.17 | 4.45 | ** | + | | |
| HEMBB1000870 | 4.43 | 1.73 | 2.81 | 6.64 | 6.44 | 7.5 | 2.8 | 3.34 | 3.99 | * | + | | |
| HEMBB1000876 | 2.52 | 1.01 | 1.78 | 2.03 | 2.41 | 3.32 | 1.17 | 1.96 | 2.6 | | | | |
| HEMBB1000881 | 4.52 | 2.25 | 2.68 | 3.85 | 3.48 | 4.21 | 3.8 | 3.6 | 3.52 | | | | |
| HEMBB1000883 | 1.07 | 0.87 | 0.48 | 2.38 | 2.52 | 2.42 | 1.86 | 2.24 | 1.15 | ** | + | | |
| HEMBB1000887 | 16.17 | 10.38 | 8.54 | 18.39 | 28.8 | 26.71 | 14.31 | 15.73 | 15.23 | * | + | | |
| HEMBB1000888 | 1.52 | 0.47 | 0.72 | 0.71 | 0.87 | 1.25 | 1.08 | 2.54 | 2.95 | | | | |
| HEMBB1000890 | 4.2 | 1.91 | 2.82 | 6.2 | 6.22 | 11.04 | 3.56 | 3.57 | 3.05 | * | + | | |
| HEMBB1000893 | 3.13 | 1.95 | 2.57 | 3.14 | 8.44 | 5.73 | 3.88 | 3.35 | 2.73 | | | | |
| HEMBB1000900 | 2.72 | 1.85 | 1.78 | 2.31 | 2.75 | 4 | 1.77 | 1.83 | 1.88 | | | | |
| HEMBB1000905 | 7.13 | 4.79 | 4.05 | 6.15 | 5.33 | 7.36 | 6.49 | 7.74 | 6.04 | | | | |
| HEMBB1000908 | 3.42 | 1.78 | 2.53 | 3.45 | 3.15 | 4.99 | 2.18 | 3.31 | 2.95 | | | | |
| HEMBB1000910 | 3.27 | 1.5 | 0.99 | 3.5 | 4.25 | 4.18 | 2.64 | 2.6 | 2.61 | * | + | | |
| HEMBB1000913 | 1.53 | 1.02 | 1.16 | 2.35 | 1.71 | 3.01 | 2.43 | 2.82 | 3.12 | ** | + | | |
| HEMBB1000915 | 125.5 | 96.58 | 90.74 | 52.7 | 70.12 | 78.2 | 138.4 | 94.57 | 151.2 | * | − | | |
| HEMBB1000917 | 5.94 | 3.71 | 3 | 10.02 | 9.8 | 10.14 | 6.41 | 5.43 | 5.2 | ** | + | | |
| HEMBB1000927 | 3.9 | 2.3 | 4.04 | 2.93 | 2.18 | 2.45 | 3.26 | 2.61 | 3.09 | | | | |
| HEMBB1000932 | 1.41 | 0.52 | 1.78 | 2.08 | 2.21 | 2.86 | 1.55 | 1.9 | 0.46 | | | | |
| HEMBB1000933 | 63.34 | 47.44 | 31.38 | 44.11 | 52.4 | 49.52 | 46.54 | 37.21 | 45.55 | | | | |
| HEMBB1000936 | 7.16 | 3.79 | 4.04 | 4.95 | 3.87 | 5.38 | 3.06 | 2.19 | 2.36 | | | | |
| HEMBB1000939 | 9.8 | 5.4 | 5.5 | 8.13 | 8.11 | 6.88 | 7.11 | 4.16 | 5.78 | | | | |
| HEMBB1000941 | 1.26 | 1.52 | 1.91 | 2.33 | 1.33 | 3.43 | 1.03 | 2.28 | 3 | | | | |
| HEMBB1000947 | 3.84 | 2.12 | 3.17 | 3.27 | 3.95 | 6.16 | 2.65 | 3.42 | 5 | | | | |
| HEMBB1000954 | 2.09 | 0.96 | 1.77 | 3.22 | 2.47 | 2.01 | 1.52 | 2.5 | 2.09 | | | | |
| HEMBB1000959 | 1.47 | 0.69 | 1.99 | 4.15 | 4.21 | 5.2 | 2.08 | 3.64 | 2.15 | ** | + | | |
| HEMBB1000973 | 0.93 | 0.22 | 1.08 | 1.36 | 1.53 | 1.02 | 0.58 | 1.34 | 0.88 | | | | |
| HEMBB1000975 | 6.35 | 2.45 | 2.52 | 2.87 | 4.55 | 4.7 | 3.97 | 3.56 | 3.46 | | | | |
| HEMBB1000981 | 1.55 | 0.65 | 1.17 | 2.92 | 1.74 | 2.12 | 1.91 | 1.15 | 1.6 | | | | |
| HEMBB1000985 | 4.16 | 2.16 | 3.38 | 6.79 | 6.53 | 7.43 | 6.9 | 5.56 | 5.46 | ** | + | * | + |
| HEMBB1000991 | 2.4 | 0.94 | 2.24 | 1.58 | 2.01 | 2.39 | 1.83 | 3.86 | 2.04 | | | | |
| HEMBB1000996 | 6.16 | 2.86 | 5.71 | 15.05 | 12.65 | 14.03 | 9.39 | 6.89 | 7.92 | ** | + | | |
| HEMBB1001000 | 0.81 | 0.42 | 1.96 | 2.31 | 1.45 | 2 | 2.11 | 2.4 | 1.74 | | | | |
| HEMBB1001004 | 0.63 | 0.42 | 0.74 | 2.36 | 1.33 | 1.9 | 1.27 | 2.5 | 0.58 | * | + | | |
| HEMBB1001008 | 0.9 | 0.72 | 1.22 | 1.95 | 1.11 | 0.92 | 0.7 | 1.72 | 0.82 | | | | |
| HEMBB1001011 | 4.86 | 1.41 | 1.32 | 2.52 | 2.1 | 3.78 | 2.71 | 1.63 | 2.77 | | | | |
| HEMBB1001014 | 5.41 | 3.41 | 2.83 | 4.86 | 8.33 | 8.51 | 5.54 | 2.65 | 5.28 | | | | |
| HEMBB1001020 | 3.52 | 1.22 | 3.22 | 5.91 | 7.22 | 5.47 | 4.21 | 2.46 | 3.29 | * | + | | |
| HEMBB1001024 | 3.88 | 2.55 | 2.6 | 4.94 | 7.97 | 7.2 | 4.48 | 3.54 | 3.57 | * | + | | |
| HEMBB1001026 | 4.57 | 3.08 | 2.54 | 5.25 | 5.33 | 6.61 | 2.93 | 3.4 | 3.78 | * | + | | |
| HEMBB1001037 | 2.04 | 0.83 | 2.17 | 4.63 | 4.48 | 3.78 | 3.41 | 3.94 | 2.4 | ** | + | | |
| HEMBB1001042 | 2.63 | 0.37 | 1.26 | 3.42 | 3.22 | 3.69 | 2.16 | 3.39 | 1.69 | * | + | | |
| HEMBB1001046 | 3.55 | 2.14 | 2.26 | 3.89 | 3.63 | 3.68 | 3.15 | 4.56 | 3.14 | | | | |
| HEMBB1001047 | 5 | 1.57 | 1.46 | 5.39 | 4.72 | 4.88 | 2.39 | 1.51 | 4.62 | | | | |
| HEMBB1001048 | 8.53 | 3.68 | 3.67 | 9.65 | 6.39 | 8.39 | 5.59 | 5.14 | 7.15 | | | | |
| HEMBB1001051 | 1.18 | 0.9 | 0.65 | 0.91 | 1.6 | 1.29 | 0.9 | 1.3 | 2.48 | | | | |
| HEMBB1001056 | 4.02 | 2.51 | 1.82 | 4.56 | 3.43 | 4.23 | 3.26 | 2.37 | 3.48 | | | | |
| HEMBB1001058 | 4.62 | 1.41 | 2.29 | 4.81 | 4.08 | 5.54 | 4.01 | 2.62 | 3.49 | | | | |
| HEMBB1001060 | 1.13 | 0.14 | 0.28 | 1.95 | 1.91 | 2.6 | 0.75 | 1.53 | 1.56 | * | + | | |
| HEMBB1001063 | 4.1 | 1.41 | 1.69 | 3.82 | 4.69 | 5.11 | 3.01 | 2.79 | 2.86 | | | | |

TABLE 198

| | | | | | | | | | | | | | |
|---|---|---|---|---|---|---|---|---|---|---|---|---|---|
| HEMBB1001068 | 7.81 | 3.48 | 2.43 | 5.74 | 4.82 | 6.22 | 5.55 | 5.34 | 6.4 | | | | |
| HEMBB1001082 | 5.14 | 1.53 | 2.93 | 10.11 | 5.98 | 8.43 | 4.89 | 3.46 | 4.79 | * | + | | |
| HEMBB1001095 | 14.6 | 9.13 | 9.13 | 9.72 | 6.9 | 9.06 | 9.06 | 5.98 | 7.72 | 8.46 | | | |
| HEMBB1001096 | 3.56 | 1.37 | 1.54 | 4.69 | 5.52 | 4.24 | 2.24 | 1.72 | 3.53 | * | + | | |
| HEMBB1001101 | 21.47 | 17.94 | 10.93 | 10.99 | 11.87 | 12.38 | 8.8 | 9.1 | 8.37 | | | | |
| HEMBB1001102 | 2.77 | 1.29 | 0.76 | 2.93 | 2.4 | 3.87 | 2.39 | 1.32 | 2.26 | | | | |
| HEMBB1001104 | 5.43 | 2.94 | 3.94 | 9.11 | 5.73 | 9.85 | 5.68 | 2.83 | 4.42 | * | + | | |

TABLE 198-continued

| | | | | | | | | | | | | |
|---|---|---|---|---|---|---|---|---|---|---|---|---|
| HEMBB1001105 | 3.73 | 2.54 | 3.47 | 3.95 | 6.18 | 9.09 | 3.39 | 3.81 | 3.94 | | | |
| HEMBB1001112 | 8.37 | 6.64 | 4.97 | 5.94 | 6.55 | 6.82 | 6.29 | 6.97 | 5.99 | | | |
| HEMBB1001113 | 7.58 | 3.55 | 4.62 | 10.53 | 11.56 | 12 | 7.39 | 5.47 | 7.82 | ** | + | |
| HEMBB1001114 | 7.84 | 3.54 | 5.33 | 11.15 | 12.39 | 11.97 | 6.57 | 3.79 | 5.55 | ** | + | |
| HEMBB1001115 | 12.69 | 6.52 | 6.38 | 8.41 | 6.32 | 7.74 | 8.1 | 3.98 | 5.13 | | | |
| HEMBB1001117 | 1.26 | 0.59 | 1.14 | 3.99 | 3.99 | 7.09 | 4.39 | 3.19 | 2.89 | * | + | ** + |
| HEMBB1001119 | 2.73 | 0.69 | 1.36 | 3.27 | 2.76 | 3.17 | 1.69 | 1.82 | 2.33 | | | |
| HEMBB1001126 | 17.3 | 8.41 | 6.34 | 12.51 | 13.52 | 16.39 | 9.04 | 9.96 | 8.26 | | | |
| HEMBB1001133 | 7.22 | 2.46 | 6.43 | 7.94 | 11.25 | 15.48 | 5.58 | 5.96 | 7.46 | | | |
| HEMBB1001137 | 4.69 | 1.94 | 2.48 | 3.07 | 2.31 | 3.24 | 4.3 | 2.74 | 3.49 | | | |
| HEMBB1001142 | 10.97 | 4.26 | 5.7 | 14.69 | 16.82 | 16.36 | 7.91 | 5.78 | 10.87 | * | + | |
| HEMBB1001145 | 8.34 | 3.24 | 4.81 | 10.74 | 10.95 | 12.08 | 5.82 | 4.69 | 6.65 | * | + | |
| HEMBB1001151 | 8.95 | 6.02 | 5.47 | 5.12 | 6.22 | 5.78 | 8.53 | 8.19 | 8.82 | | | |
| HEMBB1001153 | 5.68 | 3.55 | 3.85 | 6.9 | 7.36 | 7.26 | 5.29 | 4.07 | 4.12 | * | + | |
| HEMBB1001158 | 5.25 | 4.46 | 4.73 | 8.21 | 9.2 | 10.97 | 4.6 | 4.37 | 5.83 | ** | + | |
| HEMBB1001169 | 5.93 | 2.46 | 2.66 | 6.12 | 6.91 | 7.13 | 3.71 | 3.73 | 4.71 | | | |
| HEMBB1001170 | 2.28 | 0.23 | 1.68 | 2.09 | 1.33 | 2.33 | 1.48 | 1.17 | 1.14 | | | |
| HEMBB1001175 | 4.7 | 2.5 | 2.14 | 5.28 | 3.05 | 6.25 | 4.06 | 3.09 | 3.56 | | | |
| HEMBB1001177 | 11.32 | 4.92 | 7.58 | 14.33 | 14.36 | 15.14 | 8.51 | 7.62 | 8 | * | + | |
| HEMBB1001182 | 7.1 | 3.3 | 3.03 | 8.51 | 7.41 | 6.84 | 6.75 | 4.9 | 5.74 | | | |
| HEMBB1001192 | 4.01 | 1.43 | 2.59 | 3.22 | 2.9 | 2.65 | 3.81 | 3.22 | 2.43 | | | |
| HEMBB1001199 | 1.24 | 0.85 | 1.37 | 0.51 | 1.77 | 3.72 | 1.58 | 1.98 | 1.27 | | | |
| HEMBB1001200 | 0.7 | 0.28 | 0.37 | 0.41 | 0.29 | 1.06 | 0.14 | 0.69 | 0.72 | | | |
| HEMBB1001208 | 6.24 | 1.58 | 2.41 | 2.54 | 3.62 | 5 | 2.67 | 3.31 | 3.15 | | | |
| HEMBB1001209 | 8.96 | 2.6 | 4.27 | 8.47 | 9.46 | 10.64 | 6.12 | 3.72 | 4.78 | | | |
| HEMBB1001210 | 3.39 | 3.6 | 6.25 | 13.57 | 15.06 | 13.24 | 8.2 | 7.86 | 10.28 | ** | + | * + |
| HEMBB1001215 | 56.1 | 31.37 | 29.04 | 36.73 | 42.52 | 41.17 | 25.87 | 19.36 | 26.75 | | | |
| HEMBB1001217 | 4.33 | 2.5 | 3.14 | 2.96 | 3.91 | 4.21 | 4.42 | 3.57 | 4.01 | | | |
| HEMBB1001218 | 4.39 | 2.08 | 2.28 | 6.07 | 7.97 | 8.92 | 4.93 | 4.87 | 4.51 | * | + | |
| HEMBB1001221 | 1.61 | 1.15 | 0.66 | 1.21 | 1.16 | 1.19 | 2.11 | 1.68 | 0.87 | | | |
| HEMBB1001224 | 2.88 | 1.37 | 1.83 | 3.46 | 3.87 | 4.78 | 1.63 | 2.85 | 1.71 | * | + | |
| HEMBB1001230 | 3.6 | 1.44 | 3.39 | 4.28 | 5.22 | 5.68 | 2.22 | 3.15 | 2.2 | * | + | |
| HEMBB1001234 | 9.13 | 2.44 | 8.29 | 5.98 | 6.49 | 5.96 | 5.83 | 7.02 | 6.04 | | | |
| HEMBB1001235 | 5.5 | 2.57 | 3.09 | 3.97 | 3.82 | 5.68 | 4.42 | 5.01 | 5.46 | | | |
| HEMBB1001237 | 11.86 | 5.88 | 6.73 | 9.88 | 9.37 | 10.19 | 7.04 | 5.53 | 6.3 | | | |
| HEMBB1001242 | 3.75 | 2.48 | 2.08 | 4.97 | 4.37 | 4.59 | 4.13 | 4.47 | 3.96 | * | + | |
| HEMBB1001244 | 1.32 | 1.13 | 0.4 | 0.82 | 0.94 | 1.53 | 1.73 | 1.61 | 1.2 | | | |
| HEMBB1001249 | 3.12 | 1.54 | 0.34 | 2.25 | 4.83 | 2.55 | 2.05 | 1.99 | 2.11 | | | |
| HEMBB1001253 | 6.29 | 1.42 | 2.97 | 13.67 | 4.84 | 8.24 | 2.79 | 2.84 | 4.65 | | | |
| HEMBB1001254 | 2.47 | 0.84 | 1.05 | 1.37 | 2.56 | 1.79 | 1.57 | 2.54 | 1.52 | | | |
| HEMBB1001266 | 1.23 | 0.44 | 1.59 | 2.72 | 2.03 | 1.62 | 2.12 | 1.69 | 5.16 | | | |
| HEMBB1001267 | 7.87 | 4.02 | 4.63 | 13.5 | 11.84 | 13.24 | 5.84 | 7.38 | 7.93 | ** | + | |
| HEMBB1001271 | 4.61 | 1.62 | 1.38 | 4.06 | 3.96 | 5.87 | 2.53 | 2.67 | 2.49 | | | |
| HEMBB1001282 | 6.27 | 3.11 | 3.61 | 3.44 | 3.72 | 3.72 | 3.96 | 3.68 | 3.39 | | | |
| HEMBB1001287 | 13.66 | 7.12 | 7.62 | 9.05 | 8.08 | 10.38 | 11.92 | 6.12 | 11.75 | | | |
| HEMBB1001288 | 3.65 | 1.71 | 2.11 | 2.38 | 2.54 | 2.69 | 2.09 | 2.39 | 1.58 | | | |
| HEMBB1001289 | 10.93 | 6.03 | 8.57 | 15.81 | 16.55 | 18.1 | 8.4 | 7.7 | 5.92 | ** | + | |
| HEMBB1001290 | 3.6 | 2.6 | 2.26 | 3.2 | 3.1 | 5.19 | 4.49 | 3.29 | 2.53 | | | |
| HEMBB1001294 | 2.74 | 1.82 | 3.02 | 1.97 | 1.99 | 2.92 | 2.55 | 2.49 | 2.42 | | | |

TABLE 199

| | | | | | | | | | | | | |
|---|---|---|---|---|---|---|---|---|---|---|---|---|
| HEMBB1001299 | 11.58 | 8.15 | 6.05 | 9.03 | 8.73 | 7.82 | 6.87 | 6.29 | 8.87 | | | |
| HEMBB1001302 | 6.82 | 4.33 | 3.28 | 5.31 | 5.44 | 7.1 | 4.47 | 4.4 | 7.2 | | | |
| HEMBB1001304 | 1.87 | 0.87 | 0.83 | 1.3 | 1.76 | 2.94 | 1.91 | 2.12 | 1.37 | | | |
| HEMBB1001314 | 2.52 | 0.38 | 1.35 | 1.89 | 2.07 | 2.7 | 1 | 1.94 | 1.9 | | | |
| HEMBB1001315 | 2.2 | 0.42 | 0.99 | 1.6 | 0.99 | 1.5 | 2.82 | 1.66 | 1.14 | | | |
| HEMBB1001317 | 5.5 | 2.93 | 3.71 | 6 | 6.29 | 9.01 | 6.12 | 6.25 | 7.04 | | | * + |
| HEMBB1001326 | 1.44 | 0.28 | 0.42 | 1.14 | 1.37 | 0.97 | 0.93 | 1.85 | 0.56 | | | |
| HEMBB1001331 | 3.49 | 1.15 | 3.33 | 3.16 | 5.21 | 4.92 | 2.94 | 2.32 | 3.4 | | | |
| HEMBB1001335 | 2.13 | 0.58 | 1.32 | 2.09 | 1.33 | 1.73 | 1.47 | 0.84 | 0.69 | | | |
| HEMBB1001337 | 4.69 | 2.11 | 3.26 | 4.29 | 6.51 | 6.35 | 3.43 | 4.14 | 3.13 | | | |
| HEMBB1001339 | 3.42 | 1.11 | 1.36 | 2.82 | 1.69 | 2.07 | 1.52 | 2.17 | 1.96 | | | |
| HEMBB1001344 | 2.99 | 1.77 | 1.84 | 2.4 | 2.3 | 3.56 | 2.28 | 2.27 | 2.05 | | | |
| HEMBB1001346 | 3.15 | 2.58 | 2.53 | 3.75 | 3.57 | 4.79 | 2.76 | 4.39 | 3.22 | * | + | |
| HEMBB1001348 | 1.96 | 1.25 | 1.97 | 4.3 | 3.56 | 4.57 | 1.75 | 3.51 | 2.64 | ** | + | |
| HEMBB1001350 | 2.69 | 1.8 | 2.82 | 11.17 | 12.83 | 10.95 | 7.44 | 8.11 | 8.86 | ** | + | ** + |
| HEMBB1001356 | 1.82 | 0.34 | 1.21 | 2 | 1.23 | 1.35 | 0.99 | 1.53 | 1.63 | | | |
| HEMBB1001364 | 1.29 | 0.93 | 0.89 | 1.8 | 2.27 | 2.41 | 2.29 | 1.24 | 1.25 | ** | + | |
| HEMBB1001366 | 3.41 | 1.36 | 1.76 | 6.29 | 5.97 | 7.89 | 2.97 | 3.23 | 3.76 | ** | + | |
| HEMBB1001367 | 5.44 | 2.63 | 4.67 | 5.82 | 13.11 | 9.17 | 6.34 | 5.62 | 5.1 | | | |
| HEMBB1001369 | 1.88 | 0.36 | 0.91 | 2.5 | 3.44 | 2.87 | 2.19 | 3.7 | 2.34 | * | + | |
| HEMBB1001380 | 3.65 | 2.5 | 3.07 | 8.69 | 9.13 | 10.12 | 4.6 | 7.63 | 4.24 | ** | + | |
| HEMBB1001381 | 7.54 | 3.35 | 4.95 | 9.78 | 7.21 | 8.91 | 5.88 | 6.12 | 6.67 | | | |
| HEMBB1001384 | 2.77 | 2.23 | 5.27 | 4.04 | 4.7 | 5.21 | 2.99 | 5.46 | 4 | | | |
| HEMBB1001387 | 1.33 | 0.72 | 1.19 | 2.84 | 1.92 | 3.26 | 0.78 | 2.08 | 0.69 | * | + | |

TABLE 199-continued

| | | | | | | | | | | | | | |
|---|---|---|---|---|---|---|---|---|---|---|---|---|---|
| HEMBB1001394 | 2.01 | 1.22 | 0.71 | 4.71 | 4.19 | 4.99 | 2.39 | 2.44 | 2.66 | ** | + | * | + |
| HEMBB1001407 | 3.37 | 1.49 | 0.8 | 2.53 | 3.21 | 2.87 | 4.47 | 1.2 | 2 | | | | |
| HEMBB1001410 | 1.19 | 0.14 | 0.37 | 0.55 | 0.79 | 0.77 | 0.44 | 1.14 | 0.17 | | | | |
| HEMBB1001413 | 2.53 | 1.15 | 2.11 | 4.01 | 6.2 | 3.82 | 2.17 | 2.18 | 2.56 | * | + | | |
| HEMBB1001419 | 3.82 | 1.67 | 2 | 5.53 | 5.54 | 4.76 | 5.16 | 3.44 | 3.45 | * | + | | |
| HEMBB1001421 | 1.55 | 0.78 | 1.24 | 9.94 | 7.28 | 9.56 | 5.74 | 5.75 | 4.91 | ** | + | ** | + |
| HEMBB1001424 | 0.54 | 0 | 0.28 | 0.9 | 0.45 | 0.6 | 0.84 | 1.22 | 0.47 | | | | |
| HEMBB1001426 | 2.45 | 0.64 | 1.42 | 3.9 | 4.18 | 3.95 | 2.09 | 3.09 | 1.9 | ** | + | | |
| HEMBB1001429 | 10.12 | 5.99 | 4.62 | 6.28 | 4.44 | 8.1 | 5.21 | 7.29 | 9.1 | | | | |
| HEMBB1001436 | 11.8 | 4.02 | 6.29 | 22.88 | 14.63 | 21.79 | 9.57 | 8.07 | 10.97 | * | + | | |
| HEMBB1001443 | 1.46 | 1.5 | 1.3 | 2.55 | 2.11 | 3.84 | 5.74 | 4.67 | 5.74 | | | ** | + |
| HEMBB1001449 | 4.24 | 1.68 | 1.33 | 4.21 | 5.76 | 5.46 | 2.38 | 1.89 | 2.76 | | | | |
| HEMBB1001454 | 4.2 | 2.22 | 2.85 | 4.88 | 5.14 | 6.3 | 1.94 | 2.02 | 3.61 | * | + | | |
| HEMBB1001458 | 4.34 | 4.36 | 3.05 | 7.92 | 4.69 | 4.55 | 3.87 | 3.06 | 3.94 | | | | |
| HEMBB1001461 | 2.41 | 1.63 | 1.39 | 3.76 | 3.78 | 6.76 | 3.87 | 1.93 | 2.34 | * | + | | |
| HEMBB1001463 | 4.41 | 1.84 | 3.33 | 6.77 | 8.03 | 7.56 | 3.07 | 2.66 | 3.3 | ** | + | | |
| HEMBB1001464 | 1.53 | 1.48 | 0.96 | 1.16 | 0.81 | 1 | 0.81 | 0.25 | 1.04 | | | | |
| HEMBB1001466 | 1.71 | 1.2 | 0.87 | 3.03 | 2.72 | 4.34 | 2.85 | 2.09 | 4.25 | * | + | | |
| HEMBB1001482 | 3.03 | 1.42 | 1.06 | 1.64 | 2.18 | 1.42 | 2.97 | 1.16 | 2.1 | | | | |
| HEMBB1001500 | 2.17 | 1.05 | 0.9 | 2.57 | 2.02 | 2.37 | 1.04 | 1.45 | 1.55 | | | | |
| HEMBB1001505 | 8.22 | 5.06 | 7.49 | 13.32 | 13.9 | 13.27 | 5.5 | 6.16 | 7.01 | ** | + | | |
| HEMBB1001521 | 2.58 | 1.03 | 1.95 | 4.68 | 3.52 | 3.79 | 2.8 | 2.46 | 2.3 | * | + | | |
| HEMBB1001527 | 14.66 | 7.32 | 7.32 | 12.93 | 16.36 | 15.19 | 7.53 | 11.09 | 12.62 | | | | |
| HEMBB1001530 | 7.24 | 3.1 | 6.46 | 5.19 | 6.93 | 5.94 | 6.69 | 5.92 | 5.53 | | | | |
| HEMBB1001531 | 5.66 | 2.3 | 2.38 | 5.05 | 4.74 | 5.69 | 3.58 | 2.66 | 2.99 | | | | |
| HEMBB1001532 | 2.05 | 0.38 | 0.82 | 1.99 | 0.87 | 2.3 | 1.76 | 1.25 | 1.24 | | | | |
| HEMBB1001535 | 3.86 | 2.42 | 2.26 | 4.62 | 4.93 | 5.74 | 3.17 | 2.1 | 4.36 | * | + | | |
| HEMBB1001536 | 5.02 | 2.43 | 2.77 | 5.57 | 4.42 | 5.08 | 2.95 | 2.46 | 3.39 | | | | |
| HEMBB1001537 | 3.43 | 1.79 | 1.93 | 5.9 | 3.91 | 6.35 | 3.35 | 2.86 | 3.81 | * | + | | |
| HEMBB1001542 | 10.24 | 4.77 | 6.29 | 8.68 | 10.49 | 11.37 | 4.75 | 4.74 | 4.61 | | | | |
| HEMBB1001543 | 4.42 | 2 | 4.45 | 6.17 | 7.07 | 7.41 | 4.96 | 3.35 | 2.51 | * | + | | |
| HEMBB1001547 | 1.69 | 0.68 | 1.1 | 3.41 | 2.74 | 1.36 | 1.07 | 2.16 | 2.08 | | | | |

TABLE 200

| | | | | | | | | | | | | | |
|---|---|---|---|---|---|---|---|---|---|---|---|---|---|
| HEMBB1001548 | 11.61 | 4.55 | 5.07 | 6.22 | 6.23 | 8.02 | 13.1 | 5.3 | 6.57 | | | | |
| HEMBB1001551 | 2.02 | 1.27 | 1.35 | 2.89 | 1.88 | 2.65 | 2.33 | 1.18 | 2 | | | | |
| HEMBB1001555 | 3.38 | 2.36 | 2.27 | 4.34 | 5.15 | 4.75 | 3.71 | 2.88 | 3.52 | ** | + | | |
| HEMBB1001562 | 6.73 | 3.72 | 2.72 | 6.03 | 4.98 | 4.88 | 4.48 | 4.21 | 3.29 | | | | |
| HEMBB1001564 | 143.7 | 103.7 | 84.35 | 117.1 | 130.5 | 149.5 | 73.73 | 78.89 | 81.45 | | | | |
| HEMBB1001565 | 4.34 | 2.01 | 6.14 | 5.35 | 4.71 | 6.93 | 2.17 | 3.81 | 2.88 | | | | |
| HEMBB1001569 | 3.35 | 1.85 | 2.92 | 2.44 | 1.48 | 3 | 2.68 | 1.66 | 2.47 | | | | |
| HEMBB1001573 | 4.11 | 1.78 | 1.25 | 2.55 | 2.8 | 4.22 | 1.76 | 2.85 | 2.7 | | | | |
| HEMBB1001585 | 5.19 | 3.43 | 2.13 | 7.14 | 9.58 | 10.48 | 5.06 | 4.35 | 4.95 | * | + | | |
| HEMBB1001586 | 2.45 | 1.89 | 1.57 | 2.45 | 2.59 | 4.79 | 2.08 | 2.01 | 1.8 | | | | |
| HEMBB1001588 | 9.91 | 4.02 | 1.68 | 7.84 | 12.44 | 10.86 | 6.94 | 6.15 | 5.93 | | | | |
| HEMBB1001595 | 2.38 | 2.13 | 1.24 | 3.04 | 4.7 | 3.31 | 4.54 | 3.91 | 4.77 | * | + | ** | + |
| HEMBB1001596 | 7.58 | 3.68 | 4.12 | 10.26 | 11.71 | 11.73 | 8.26 | 5.8 | 7.17 | ** | + | | |
| HEMBB1001599 | 1.66 | 1.47 | 1.01 | 2.08 | 1.72 | 2.54 | 1.43 | 2.23 | 1.83 | | | | |
| HEMBB1001603 | 1.5 | 0.25 | 0.77 | 1.78 | 2.38 | 2.95 | 1.47 | 2.06 | 1.36 | * | + | | |
| HEMBB1001606 | 0.98 | 0.3 | 0.79 | 0.72 | 0.7 | 0.98 | 0.73 | 0.96 | 0.76 | | | | |
| HEMBB1001612 | 7.29 | 5.01 | 5.69 | 10.05 | 12.84 | 11.6 | 6.84 | 5.75 | 5.35 | ** | + | | |
| HEMBB1001618 | 2.21 | 1.9 | 1 | 2.28 | 2.95 | 2.82 | 2.58 | 3.52 | 1.79 | | | | |
| HEMBB1001619 | 2.74 | 2.34 | 1.59 | 5 | 7.12 | 6.26 | 2.86 | 3.86 | 3.26 | ** | + | | |
| HEMBB1001623 | 3.47 | 2.37 | 1.26 | 9.12 | 1.21 | 1.26 | 2.81 | 2.15 | 1.28 | | | | |
| HEMBB1001625 | 0.39 | 0.5 | 0.61 | 1.56 | 1.46 | 2.32 | 2.13 | 1.91 | 2.02 | * | + | ** | + |
| HEMBB1001630 | 2.05 | 0.69 | 1.57 | 1.73 | 2.03 | 1.92 | 0.69 | 0.97 | 1.11 | | | | |
| HEMBB1001635 | 2.2 | 0.75 | 1.17 | 3.5 | 2.23 | 1.77 | 1.56 | 1.05 | 1.51 | | | | |
| HEMBB1001637 | 3.51 | 1.4 | 2.57 | 3.58 | 4.43 | 4.86 | 2.1 | 2.95 | 2.6 | | | | |
| HEMBB1001641 | 1.95 | 0.54 | 0.63 | 1.54 | 1.04 | 1.19 | 1.35 | 0.64 | 1.26 | | | | |
| HEMBB1001653 | 5.49 | 2.4 | 2.56 | 5.29 | 5.68 | 6.05 | 3.35 | 3.68 | 4.27 | | | | |
| HEMBB1001665 | 1.36 | 1.13 | 0.8 | 0.24 | 0.85 | 0.87 | 0.48 | 0.61 | 0.56 | | | * | − |
| HEMBB1001666 | 2.05 | 1.95 | 2.11 | 3.16 | 2.96 | 2.94 | 3.08 | 3.78 | 1.71 | ** | + | | |
| HEMBB1001667 | 2.49 | 2.15 | 1.55 | 5.36 | 1.62 | 4.96 | 1.46 | 1.39 | 2.66 | | | | |
| HEMBB1001668 | 1.24 | 0.08 | 2.02 | 7.77 | 6.22 | 7.71 | 3.16 | 4.06 | 4.45 | ** | + | * | + |
| HEMBB1001669 | 1.14 | 0.56 | 0.64 | 1.01 | 1.36 | 1.96 | 0.82 | 0.73 | 1.12 | | | | |
| HEMBB1001670 | 4.9 | 1.43 | 3.88 | 3.76 | 6.22 | 5.35 | 4.26 | 5.99 | 6.05 | | | | |
| HEMBB1001673 | 9.43 | 4.46 | 3.65 | 7.18 | 5.87 | 10.36 | 4.73 | 4.98 | 5.54 | | | | |
| HEMBB1001675 | 4.45 | 1.52 | 2.55 | 2.96 | 2.17 | 2.25 | 2.39 | 2.98 | 2.34 | | | | |
| HEMBB1001679 | 3.43 | 1.92 | 1.36 | 3.15 | 2.26 | 1.5 | 2.37 | 3.04 | 2.3 | | | | |
| HEMBB1001684 | 3.34 | 2.15 | 1.93 | 2.33 | 2.97 | 3.86 | 3.7 | 4.19 | 3.07 | | | | |
| HEMBB1001685 | 0.43 | 0.79 | 0.82 | 2.14 | 2.22 | 2.08 | 1.31 | 1.84 | 3.11 | ** | + | | |
| HEMBB1001695 | 0.91 | 0 | 0.49 | 2.21 | 2.23 | 2.38 | 1.38 | 2.34 | 1.74 | ** | + | * | + |
| HEMBB1001703 | 8.08 | 2.9 | 6.21 | 6.72 | 7.83 | 9.08 | 5.46 | 5.54 | 6.16 | | | | |
| HEMBB1001704 | 4.34 | 1.92 | 3.68 | 6.91 | 10.28 | 8.29 | 3.81 | 4.11 | 3.01 | * | + | | |
| HEMBB1001706 | 5.33 | 4.91 | 1.92 | 7.82 | 8.35 | 10.07 | 3.64 | 3.58 | 4.65 | * | + | | |

TABLE 200-continued

| | | | | | | | | | | | | | |
|---|---|---|---|---|---|---|---|---|---|---|---|---|---|
| HEMBB1001707 | 5.79 | 3.89 | 4.11 | 6.65 | 6.58 | 7.83 | 3.81 | 4.55 | 4.31 | * | + | | |
| HEMBB1001717 | 2.9 | 1.19 | 1.54 | 2.56 | 2.78 | 3.16 | 1.54 | 2.73 | 1.87 | | | | |
| HEMBB1001731 | 36.41 | 33.52 | 31.32 | 28.11 | 26.74 | 25.14 | 22.32 | 14.43 | 19.67 | * | − | ** | − |
| HEMBB1001734 | 3.1 | 2.92 | 2.47 | 4.7 | 5.73 | 6.77 | 4.4 | 3.15 | 4.26 | ** | + | | |
| HEMBB1001735 | 2.54 | 0.66 | 2.3 | 5.4 | 4.73 | 5.13 | 2.48 | 3.07 | 2.77 | ** | + | | |
| HEMBB1001736 | 5.75 | 4.06 | 4.43 | 6.69 | 5.77 | 10.19 | 4.22 | 3.36 | 4.39 | | | | |
| HEMBB1001747 | 2.44 | 0.77 | 1.23 | 3.44 | 4.21 | 3.48 | 1.4 | 1.37 | 2.22 | * | + | | |
| HEMBB1001749 | 8.77 | 3.39 | 4.72 | 11.21 | 15.68 | 17.47 | 7.58 | 5.43 | 7.33 | * | + | | |
| HEMBB1001753 | 7.34 | 3.22 | 3.36 | 7.29 | 7.53 | 8.22 | 6.29 | 5.11 | 5.25 | | | | |
| HEMBB1001756 | 3.12 | 1.84 | 2.45 | 2.82 | 2.94 | 4.26 | 3.19 | 1.55 | 3.2 | | | | |
| HEMBB1001757 | 0.84 | 0.19 | 0.52 | 0.79 | 1.64 | 1.25 | 0.88 | 2.16 | 1.24 | | | | |
| HEMBB1001760 | 1.15 | 0.71 | 0.71 | 1.53 | 1.28 | 1.9 | 0.58 | 2.3 | 0.49 | * | + | | |
| HEMBB1001762 | 2.92 | 1.03 | 2.15 | 2.66 | 1.94 | 2.8 | 2.3 | 3.2 | 2.05 | | | | |
| HEMBB1001780 | 11.82 | 11.49 | 14.29 | 11.74 | 11.14 | 12.3 | 6.31 | 7.75 | 11.3 | | | | |
| HEMBB1001785 | 0.42 | 0.01 | 1.19 | 1.62 | 1.09 | 1.43 | 0.08 | 1.04 | 1.6 | | | | |

TABLE 201

| | | | | | | | | | | | | | |
|---|---|---|---|---|---|---|---|---|---|---|---|---|---|
| HEMBB1001788 | 5.11 | 2.85 | 2.49 | 8.04 | 8.23 | 9.77 | 5.27 | 5.14 | 5.83 | ** | + | | |
| HEMBB1001793 | 13.59 | 3.52 | 4.92 | 5.61 | 7.12 | 5.14 | 6.71 | 5.28 | 5.84 | | | | |
| HEMBB1001797 | 0.88 | 0.62 | 1.95 | 0.94 | 0.65 | 0.97 | 1.07 | 1.81 | 1.9 | | | | |
| HEMBB1001802 | 6.5 | 3.72 | 4.06 | 7.5 | 8.03 | 6.58 | 5.93 | 6.91 | 6.06 | | | | |
| HEMBB1001812 | 5.74 | 3.61 | 5.29 | 9.39 | 12.73 | 12.64 | 5.58 | 6.99 | 9.37 | ** | + | | |
| HEMBB1001815 | 20.05 | 9 | 15.52 | 27.98 | 23.86 | 26.02 | 37.42 | 29.06 | 44.83 | * | + | * | + |
| HEMBB1001816 | 5.07 | 2.26 | 3.92 | 9.09 | 8.62 | 9.45 | 5.29 | 4.77 | 4.9 | ** | + | | |
| HEMBB1001831 | 1.2 | 0.45 | 0.53 | 1.8 | 1.74 | 1.99 | 0.55 | 2.73 | 1.28 | * | + | | |
| HEMBB1001834 | 19.83 | 12.47 | 10.64 | 12.5 | 19.26 | 19.83 | 14.74 | 13.9 | 15.71 | | | | |
| HEMBB1001836 | 4.06 | 3.15 | 2.68 | 7.01 | 7.21 | 7.9 | 3.1 | 3.18 | 4.01 | ** | + | | |
| HEMBB1001839 | 1.83 | 0.36 | 0.78 | 1.33 | 1.05 | 1.21 | 1.58 | 1.39 | 1.02 | | | | |
| HEMBB1001841 | 4.21 | 3.05 | 4.61 | 6.62 | 7.34 | 6.85 | 8.41 | 7.68 | 5.57 | ** | + | * | + |
| HEMBB1001844 | 4.31 | 2.59 | 2.19 | 5.78 | 3.8 | 4.04 | 2.62 | 4.06 | 3 | | | | |
| HEMBB1001847 | 11.75 | 7.16 | 10.2 | 21.65 | 17.41 | 24.55 | 7.68 | 9.92 | 9.98 | ** | + | | |
| HEMBB1001848 | 2.73 | 1.25 | 1.47 | 4.72 | 2.91 | 3.06 | 15.56 | 19.7 | 16.79 | | | ** | + |
| HEMBB1001850 | 7.3 | 4.6 | 5.92 | 9.74 | 8.83 | 8.43 | 10.59 | 7.86 | 13.13 | * | + | | |
| HEMBB1001859 | 6.4 | 9.16 | 9.93 | 12.13 | 14.98 | 16.02 | 18.07 | 14.33 | 23.47 | * | + | * | + |
| HEMBB1001863 | 6.66 | 2.82 | 3.58 | 9.9 | 10.12 | 11.35 | 6.68 | 3.16 | 7.05 | ** | + | | |
| HEMBB1001867 | 1.21 | 1.36 | 0.82 | 2.34 | 2.45 | 3.53 | 2.08 | 1.31 | 1.98 | * | + | | |
| HEMBB1001868 | 3.28 | 1.27 | 0.26 | 2.34 | 1.83 | 1.98 | 2.3 | 1.36 | 2 | | | | |
| HEMBB1001869 | 4.99 | 3.41 | 2.47 | 4.55 | 8.08 | 7.57 | 3.34 | 3.94 | 4.05 | | | | |
| HEMBB1001872 | 3.4 | 4.06 | 0.84 | 4.75 | 2.37 | 1.57 | 2.65 | 1.38 | 2.04 | | | | |
| HEMBB1001874 | 2.47 | 1.57 | 1.58 | 3.42 | 1.79 | 3.58 | 3.5 | 1.76 | 2.08 | | | | |
| HEMBB1001875 | 1.3 | 0.4 | 3.1 | 2.27 | 2.57 | 2.84 | 2.23 | 0.73 | 0.98 | | | | |
| HEMBB1001880 | 9.6 | 4.1 | 4.24 | 11.57 | 10.59 | 10.4 | 5.78 | 4.19 | 6.8 | | | | |
| HEMBB1001899 | 2.12 | 0.58 | 0.29 | 1.53 | 1.49 | 1.79 | 2.01 | 0.55 | 1.92 | | | | |
| HEMBB1001903 | 4.86 | 1.84 | 3.46 | 4.45 | 3.55 | 4.47 | 5.08 | 3.38 | 4.99 | | | | |
| HEMBB1001905 | 6.94 | 3.72 | 4.24 | 3.83 | 3.28 | 4.45 | 3.35 | 1.95 | 3.04 | | | | |
| HEMBB1001906 | 3.51 | 0.89 | 1.09 | 3.56 | 2.45 | 3.39 | 2.27 | 3.05 | 2.44 | | | | |
| HEMBB1001908 | 1.61 | 2.17 | 1.92 | 5.17 | 4.2 | 3.43 | 1.41 | 2.29 | 3.44 | * | + | | |
| HEMBB1001910 | 2.88 | 1.38 | 0.82 | 4.07 | 3.93 | 6.71 | 2.4 | 1.88 | 3.55 | * | + | | |
| HEMBB1001911 | 6.98 | 2.87 | 4.02 | 9.07 | 10.54 | 12.95 | 3.98 | 4.78 | 7.22 | * | + | | |
| HEMBB1001915 | 4.25 | 1.76 | 1.83 | 6.42 | 5.24 | 7.19 | 5.74 | 2.92 | 4.49 | * | + | | |
| HEMBB1001921 | 5.38 | 3.56 | 4.5 | 10.21 | 11.3 | 11 | 5.97 | 4.64 | 6.62 | ** | + | | |
| HEMBB1001922 | 3.83 | 1.35 | 3.8 | 5.95 | 3.77 | 3.39 | 3.48 | 2.3 | 3.67 | | | | |
| HEMBB1001925 | 3.73 | 2.29 | 2.11 | 4.2 | 3.69 | 3.62 | 2.81 | 2.27 | 3.72 | | | | |
| HEMBB1001930 | 0.59 | 0.63 | 0.42 | 2.23 | 1.25 | 1.36 | 0.41 | 1.35 | 1.01 | * | + | | |
| HEMBB1001944 | 3.88 | 3.55 | 3.94 | 5.26 | 8.37 | 10.06 | 2.98 | 4.95 | 4.6 | * | + | | |
| HEMBB1001945 | 5.17 | 3.58 | 5.47 | 3.15 | 4.34 | 6.51 | 3.41 | 6.48 | 6.46 | | | | |
| HEMBB1001947 | 6.49 | 1.48 | 5.58 | 2.11 | 3.59 | 4.92 | 2.72 | 2.7 | 2.62 | | | | |
| HEMBB1001950 | 6.47 | 3.08 | 4.75 | 4.98 | 5.8 | 5.65 | 5.08 | 4.12 | 4.55 | | | | |
| HEMBB1001952 | 4.62 | 1.75 | 2.38 | 5.87 | 7.63 | 6.22 | 3.88 | 3.07 | 2.9 | * | + | | |
| HEMBB1001953 | 3.33 | 1.23 | 1.69 | 3.8 | 4.29 | 3.6 | 2.72 | 2.28 | 2.79 | | | | |
| HEMBB1001957 | 3.22 | 1.56 | 1.85 | 3.38 | 4.52 | 4.53 | 3.81 | 1.96 | 3.18 | * | + | | |
| HEMBB1001959 | 7.02 | 7.17 | 6.24 | 7.94 | 4.73 | 8.54 | 5.15 | 5.79 | 4.06 | | | * | − |
| HEMBB1001962 | 4.04 | 1.76 | 3.14 | 4.32 | 4.25 | 6.26 | 2 | 2.46 | 5.87 | | | | |
| HEMBB1001967 | 11.44 | 5.2 | 6.57 | 12.83 | 15.13 | 16.73 | 7.11 | 8.82 | 7.6 | * | + | | |
| HEMBB1001973 | 5.08 | 2.32 | 4.1 | 4.86 | 6.84 | 9.36 | 3.18 | 5.36 | 3.55 | | | | |
| HEMBB1001978 | 7.53 | 3.35 | 6.01 | 7.28 | 6.5 | 6.97 | 5.55 | 5.59 | 5.54 | | | | |
| HEMBB1001983 | 20.88 | 11.32 | 14 | 10.33 | 15.1 | 15.82 | 11.27 | 9.2 | 12.69 | | | | |
| HEMBB1001987 | 1.67 | 0.99 | 0.76 | 2.21 | 2.1 | 2.79 | 2.2 | 1.61 | 1.87 | * | + | | |
| HEMBB1001988 | 1.86 | 1.73 | 2.04 | 2.83 | 3.58 | 3.43 | 2.01 | 2.02 | 1.85 | ** | + | | |
| HEMBB1001990 | 4.65 | 2.51 | 4.22 | 4.26 | 6.45 | 6.12 | 4.77 | 3.77 | 5.16 | | | | |
| HEMBB1001996 | 2.64 | 1.19 | 1.29 | 1.17 | 1.43 | 2.67 | 1.72 | 2.23 | 1.63 | | | | |
| HEMBB1001997 | 4.3 | 2.22 | 2.71 | 5.89 | 6.32 | 7.41 | 2.43 | 4.16 | 2.74 | * | + | | |
| HEMBB1001999 | 15.97 | 11.41 | 12.12 | 8.02 | 17.07 | 19.1 | 5.81 | 7.78 | 7.71 | | | * | − |

TABLE 202

| ID | 1 | 2 | 3 | 4 | 5 | 6 | 7 | 8 | 9 | a | b | c | d |
|---|---|---|---|---|---|---|---|---|---|---|---|---|---|
| HEMBB1002002 | 0.83 | 0.59 | 1.4 | 1.42 | 1.71 | 2.28 | 1.59 | 0.62 | 1.07 | | | | |
| HEMBB1002005 | 8.43 | 2.74 | 4.65 | 11.77 | 11.48 | 12.25 | 6.14 | 5.42 | 7.41 | * | + | | |
| HEMBB1002009 | 0.77 | 2.18 | 1.38 | 1.25 | 1.38 | 2.16 | 0.85 | 1.5 | 0.79 | | | | |
| HEMBB1002013 | 2.33 | 1.35 | 1.79 | 1.62 | 1.81 | 3.45 | 1.55 | 1.11 | 1.73 | | | | |
| HEMBB1002015 | 7.48 | 4.38 | 3.67 | 9.87 | 8.21 | 13.87 | 7.92 | 7.55 | 9.97 | | | | |
| HEMBB1002024 | 12.18 | 6.96 | 6.46 | 7.22 | 8.12 | 8.32 | 6.32 | 9.38 | 7.79 | | | | |
| HEMBB1002035 | 3.12 | 1.84 | 1.81 | 4.86 | 5.45 | 3.22 | 1.97 | 2.8 | 1.44 | * | + | | |
| HEMBB1002039 | 3.05 | 1.27 | 3 | 3.79 | 6.93 | 5.61 | 2.49 | 3.6 | 2.96 | | | | |
| HEMBB1002041 | 7.09 | 2.89 | 3.99 | 5.42 | 7.13 | 7.97 | 5.81 | 4.83 | 6.2 | | | | |
| HEMBB1002042 | 7.43 | 3.78 | 4.66 | 7.93 | 11.47 | 10.08 | 5.53 | 6.71 | 6.67 | * | + | | |
| HEMBB1002043 | 4.31 | 1.3 | 3 | 5.84 | 8.07 | 8.67 | 4.27 | 3.64 | 4.54 | * | + | | |
| HEMBB1002044 | 1.54 | 1.29 | 1.16 | 1.41 | 1.89 | 1.39 | 1.48 | 2.04 | 1.41 | | | | |
| HEMBB1002045 | 13.56 | 9.28 | 9.85 | 18.7 | 19.69 | 19.62 | 11.33 | 11.49 | 14.07 | ** | + | | |
| HEMBB1002049 | 0.94 | 0.9 | 1.48 | 2.03 | 3.05 | 3.51 | 1.86 | 1.85 | 1.5 | * | + | * | + |
| HEMBB1002050 | 2.63 | 0.87 | 2.41 | 2.24 | 3.31 | 3.77 | 1.82 | 2.42 | 2.29 | | | | |
| HEMBB1002051 | 2.77 | 1.42 | 2.72 | 3.76 | 4.08 | 3.57 | 1 | 2.97 | 1.66 | * | + | | |
| HEMBB1002068 | 11.05 | 4.29 | 3.65 | 7.71 | 6.55 | 7.57 | 7.7 | 4.29 | 6.63 | | | | |
| HEMBB1002069 | 13.1 | 6.94 | 8.01 | 16.77 | 20.06 | 18.1 | 11.13 | 9.92 | 13.2 | * | + | | |
| HEMBB1002075 | 2.31 | 1.12 | 2.72 | 4.01 | 5.39 | 4.96 | 2.61 | 2.52 | 2.47 | * | + | | |
| HEMBB1002079 | 3.29 | 1.28 | 2.08 | 2.22 | 2.42 | 2.23 | 2.53 | 2.39 | 1.66 | | | | |
| HEMBB1002080 | 1.83 | 2.55 | 0.96 | 2.15 | 2.98 | 4.39 | 1.68 | 2.81 | 2.3 | | | | |
| HEMBB1002082 | 2.22 | 1.44 | 1.38 | 1.35 | 2.4 | 2.6 | 1.2 | 1.53 | 2.07 | | | | |
| HEMBB1002084 | 1.85 | 1.72 | 1.75 | 2.73 | 3.83 | 5.21 | 2.72 | 3.71 | 3.91 | * | + | * | + |
| HEMBB1002088 | 11.64 | 8.26 | 10.3 | 14.66 | 19.71 | 16.32 | 16.11 | 15.05 | 19.56 | * | + | * | + |
| HEMBB1002092 | 8.42 | 4.12 | 3.19 | 8.1 | 10.6 | 9.29 | 6.67 | 5.28 | 5.88 | | | | |
| HEMBB1002094 | 8.51 | 6.18 | 7.26 | 14.48 | 15.44 | 15.77 | 7.48 | 6.89 | 8.09 | ** | + | | |
| HEMBB1002103 | 13.1 | 13.5 | 12.83 | 61.49 | 68.55 | 57.48 | 66.63 | 34.04 | 51.6 | ** | + | * | + |
| HEMBB1002109 | 6.77 | 3.65 | 4.41 | 10.27 | 12.78 | 11.5 | 7.97 | 4.24 | 7.06 | ** | + | | |
| HEMBB1002115 | 44.63 | 28.15 | 32.39 | 41.8 | 53.57 | 63.47 | 24.84 | 22.28 | 27.42 | | | | |
| HEMBB1002120 | 2.22 | 0.77 | 1.3 | 3.55 | 2.83 | 2.5 | 1.74 | 2.54 | 1.48 | * | + | | |
| HEMBB1002121 | 1.32 | 0.72 | 1.59 | 2.14 | 1.84 | 1.52 | 1.15 | 1.56 | 1.25 | | | | |
| HEMBB1002134 | 29.98 | 14.03 | 18.39 | 22.56 | 28.18 | 29.08 | 20.1 | 20.18 | 26.29 | | | | |
| HEMBB1002136 | 5.67 | 2.48 | 3.78 | 3.62 | 3.43 | 4.97 | 3.89 | 4.13 | 4.88 | | | | |
| HEMBB1002138 | 3.55 | 2.31 | 2.47 | 7.41 | 6.73 | 5.61 | 7.6 | 5.28 | 8.06 | ** | + | * | + |
| HEMBB1002139 | 3.56 | 2.49 | 3.1 | 6.05 | 5.07 | 6.19 | 3.34 | 5.1 | 3.14 | ** | + | | |
| HEMBB1002141 | 5.57 | 2.73 | 5.33 | 5.02 | 6.05 | 7.64 | 4.99 | 5.45 | 6.15 | | | | |
| HEMBB1002142 | 4.26 | 2.17 | 2.9 | 5.21 | 4.83 | 7.21 | 3.06 | 3.4 | 2.29 | | | | |
| HEMBB1002145 | 2.66 | 1.68 | 2.79 | 4.87 | 2.84 | 2.91 | 1.83 | 3.33 | 2.18 | | | | |
| HEMBB1002152 | 2.89 | 1.29 | 3.31 | 6.08 | 5.5 | 7.8 | 2.66 | 3.88 | 3.38 | * | + | | |
| HEMBB1002162 | 4.47 | 2.09 | 2.74 | 4.63 | 5.63 | 4.42 | 2.84 | 4.52 | 4.28 | | | | |
| HEMBB1002173 | 2.01 | 1.5 | 1.53 | 4.12 | 5.2 | 7.12 | 2.21 | 2.47 | 3.85 | * | + | | |
| HEMBB1002189 | 5.63 | 4.01 | 3.4 | 9.38 | 12.87 | 12.35 | 5.18 | 5.01 | 5.41 | ** | + | | |
| HEMBB1002190 | 4.01 | 6.72 | 3.24 | 8.35 | 6.45 | 9.57 | 5.06 | 3.62 | 5.05 | | | | |
| HEMBB1002193 | 4.3 | 2.37 | 3.54 | 3.79 | 4.24 | 4.57 | 3.11 | 3.84 | 2.85 | | | | |
| HEMBB1002217 | 8.31 | 4.18 | 4.51 | 10.88 | 11.96 | 11.17 | 4.63 | 6.35 | 5.39 | * | + | | |
| HEMBB1002218 | 21.17 | 7.63 | 13.71 | 19.12 | 24.55 | 22.92 | 14.78 | 13.7 | 19.7 | | | | |
| HEMBB1002228 | 4.29 | 2.39 | 3.53 | 7.69 | 9.04 | 7.22 | 3.92 | 7.05 | 4.8 | ** | + | | |
| HEMBB1002232 | 2.54 | 0.96 | 2.12 | 5.44 | 4.77 | 4.87 | 2 | 4.33 | 3.46 | ** | + | | |
| HEMBB1002245 | 2.24 | 0.69 | 1.25 | 1.7 | 1.97 | 1.97 | 1.7 | 1.11 | 1.6 | | | | |
| HEMBB1002247 | 2.78 | 1.52 | 2.56 | 1.84 | 2.86 | 2.26 | 3.27 | 2.52 | 2.93 | | | | |
| HEMBB1002249 | 8.45 | 3.73 | 4.77 | 12.48 | 12.32 | 13.64 | 6.18 | 5.35 | 5.42 | ** | + | | |
| HEMBB1002254 | 2.12 | 1.02 | 1.52 | 4.72 | 4.67 | 7.07 | 3.96 | 3.27 | 2.9 | ** | + | * | + |
| HEMBB1002255 | 0.31 | 0.16 | 1.07 | 0.59 | 0.84 | 2.46 | 0.5 | 0.92 | 0.27 | | | | |
| HEMBB1002266 | 1.03 | 0.51 | 0.66 | 4.13 | 2.54 | 2.5 | 1.25 | 1.72 | 1.36 | * | + | * | + |
| HEMBB1002271 | 56.56 | 35.65 | 38.07 | 20.53 | 29.91 | 28.83 | 14.93 | 16.36 | 14.09 | | | * | − |
| HEMBB1002280 | 1.89 | 0.47 | 1.28 | 2.71 | 3.38 | 2.75 | 1.12 | 1.95 | 1.11 | * | + | | |

TABLE 203

| ID | 1 | 2 | 3 | 4 | 5 | 6 | 7 | 8 | 9 | a | b | c | d |
|---|---|---|---|---|---|---|---|---|---|---|---|---|---|
| HEMBB1002296 | 19.39 | 12.59 | 10.1 | 13.85 | 9.77 | 11.58 | 17.38 | 19.09 | 20.6 | | | | |
| HEMBB1002300 | 5.98 | 2.27 | 2.27 | 4.97 | 4.83 | 5.06 | 3.39 | 2.79 | 3.87 | | | | |
| HEMBB1002302 | 4.79 | 2.37 | 2.24 | 3.34 | 4.96 | 4.22 | 3.13 | 3.11 | 2.5 | | | | |
| HEMBB1002306 | 2.53 | 0.59 | 1.19 | 2.95 | 4.01 | 3.53 | 2.16 | 2.15 | 1.9 | * | + | | |
| HEMBB1002316 | 1.37 | 0.21 | 1.01 | 1.05 | 1.85 | 1.65 | 1.5 | 1.08 | 0.63 | | | | |
| HEMBB1002326 | 9.34 | 4.41 | 4.08 | 6.83 | 11.8 | 13.52 | 5.14 | 6.95 | 5.58 | | | | |
| HEMBB1002327 | 3.74 | 1.52 | 2.2 | 3.25 | 6.69 | 8.05 | 1.41 | 2.57 | 2.14 | | | | |
| HEMBB1002329 | 6.65 | 2.85 | 3.03 | 3.55 | 3.52 | 4.81 | 3.39 | 4 | 4.24 | | | | |
| HEMBB1002340 | 2.45 | 1.14 | 0.8 | 2.72 | 7.22 | 1.38 | 1.47 | 2.32 | 1.56 | | | | |
| HEMBB1002342 | 18.78 | 10.67 | 11.1 | 11.48 | 10.39 | 11.81 | 11.37 | 10.6 | 12.37 | | | | |
| HEMBB1002358 | 8.06 | 4.65 | 5.88 | 8.32 | 11.43 | 13.39 | 7.12 | 5.37 | 8.32 | | | | |
| HEMBB1002359 | 4.65 | 2.7 | 3.21 | 2.57 | 3.59 | 5.52 | 2.05 | 3.08 | 3.75 | | | | |
| HEMBB1002364 | 3.68 | 2.01 | 1.94 | 4.35 | 5.19 | 5.12 | 3.24 | 2.77 | 3.18 | * | + | | |
| HEMBB1002366 | 26.64 | 15.48 | 15.83 | 13.61 | 16.98 | 21.16 | 15.49 | 15.91 | 17.68 | | | | |
| HEMBB1002371 | 2.23 | 1.84 | 1.61 | 9.83 | 11.88 | 12.5 | 6.86 | 8.63 | 8.95 | ** | + | ** | + |
| HEMBB1002381 | 6.41 | 3.55 | 2.93 | 4.03 | 6.29 | 6.16 | 5.19 | 4.39 | 5.77 | | | | |
| HEMBB1002383 | 10.2 | 4.93 | 4.09 | 9.89 | 9.52 | 10.26 | 9.31 | 9.32 | 10.54 | | | | |

TABLE 203-continued

| | | | | | | | | | | | | | |
|---|---|---|---|---|---|---|---|---|---|---|---|---|---|
| HEMBB1002387 | 11.72 | 4.82 | 7.2 | 7.69 | 8.97 | 9.71 | 6.05 | 7.95 | 7.6 | | | | |
| HEMBB1002409 | 4.35 | 2.96 | 2.55 | 5.95 | 6.17 | 9.26 | 3.8 | 3.76 | 3.86 | * | + | | |
| HEMBB1002413 | 10.96 | 4.94 | 5.84 | 12.47 | 15.22 | 15.46 | 7.04 | 7.35 | 7.5 | * | + | | |
| HEMBB1002415 | 2.9 | 1.63 | 1.04 | 2.46 | 1.99 | 2.7 | 2.07 | 2.58 | 1.35 | | | | |
| HEMBB1002424 | 2.41 | 2.37 | 3.44 | 2.94 | 2.65 | 5.7 | 0.8 | 2.25 | 2.17 | | | | |
| HEMBB1002425 | 6.05 | 3.85 | 3.42 | 8.18 | 9.21 | 12.24 | 4.22 | 6.67 | 5.02 | * | + | | |
| HEMBB1002427 | 8.18 | 4.1 | 4.67 | 3.14 | 4.27 | 5.26 | 6.03 | 4.48 | 3.96 | | | | |
| HEMBB1002442 | 12.17 | 4.35 | 6.23 | 11.86 | 16.23 | 14.17 | 10.19 | 3.68 | 8.32 | | | | |
| HEMBB1002447 | 8.82 | 3.51 | 5.23 | 10.28 | 11.65 | 12.71 | 5.54 | 5.46 | 6.69 | * | + | | |
| HEMBB1002453 | 10.1 | 3.7 | 4.44 | 12.2 | 12.96 | 16.06 | 5.85 | 7.3 | 7.02 | * | + | | |
| HEMBB1002457 | 8.34 | 2.86 | 3.7 | 8.87 | 9.3 | 9.53 | 4.63 | 5.01 | 4.51 | | | | |
| HEMBB1002458 | 1.84 | 0.2 | 0.83 | 2.21 | 1.65 | 2.32 | 1.18 | 4.23 | 1.59 | | | | |
| HEMBB1002463 | 13.99 | 7.17 | 7.29 | 17.97 | 18.05 | 22.29 | 8.48 | 10.09 | 10.66 | * | + | | |
| HEMBB1002465 | 3.55 | 1.09 | 2.46 | 1.87 | 2.68 | 3.41 | 1.36 | 3 | 1.53 | | | | |
| HEMBB1002477 | 3.8 | 1.74 | 1.62 | 2.44 | 2.7 | 2.39 | 2.93 | 1.14 | 1.8 | | | | |
| HEMBB1002479 | 1.35 | 1.53 | 2.03 | 10.77 | 11.28 | 12.82 | 19.91 | 17.51 | 11.35 | ** | + | ** | + |
| HEMBB1002489 | 8.63 | 4.67 | 4.63 | 7.48 | 7.18 | 7.8 | 5.28 | 6.57 | 5.43 | | | | |
| HEMBB1002492 | 2.72 | 1.93 | 0.73 | 4.55 | 5.38 | 4.56 | 3.26 | 3.14 | 4.65 | ** | + | | |
| HEMBB1002495 | 5.34 | 4.27 | 3.39 | 5.35 | 7.91 | 6.17 | 5.79 | 5.24 | 4.34 | | | | |
| HEMBB1002502 | 0.83 | 0.8 | 0.28 | 1.27 | 3.14 | 4.39 | 2.38 | 2.95 | 1.77 | | | * | + |
| HEMBB1002509 | 0.76 | 0.61 | 0.36 | 0.32 | 0.93 | 0.91 | 0.52 | 1.26 | 0.72 | | | | |
| HEMBB1002510 | 2.29 | 0.9 | 0.49 | 1.25 | 0.69 | 0.67 | 0.59 | 1.16 | 0.95 | | | | |
| HEMBB1002520 | 10.96 | 4.42 | 7.37 | 13.08 | 19.28 | 16.87 | 8.43 | 9.05 | 9.26 | * | + | | |
| HEMBB1002522 | 2.46 | 1.73 | 4.71 | 2.71 | 2.15 | 2.36 | 2.66 | 2.31 | 4.74 | | | | |
| HEMBB1002527 | 9.87 | 7.21 | 7.79 | 8.36 | 11.1 | 10.55 | 7.47 | 6.16 | 5.86 | | | | |
| HEMBB1002530 | 7.03 | 2.68 | 3.29 | 3.79 | 4.83 | 3.48 | 4.44 | 3.46 | 4.55 | | | | |
| HEMBB1002531 | 2.36 | 2.37 | 1.2 | 1.94 | 1.74 | 2.82 | 1.39 | 2.3 | 1.35 | | | | |
| HEMBB1002534 | 4.63 | 2.48 | 3.25 | 4.66 | 8.41 | 8.39 | 2.99 | 3.62 | 3.89 | | | | |
| HEMBB1002536 | 2.96 | 1.03 | 1.7 | 1.05 | 3.49 | 2.9 | 1.99 | 2.14 | 1.93 | | | | |
| HEMBB1002544 | 3.87 | 12.89 | 3.66 | 4.05 | 4.44 | 5.77 | 1.79 | 5.33 | 2.36 | | | | |
| HEMBB1002545 | 6.5 | 3.17 | 3.97 | 5.87 | 8.72 | 7.62 | 5.47 | 5.22 | 6.78 | | | | |
| HEMBB1002550 | 3.53 | 1.59 | 2.38 | 1.73 | 2.12 | 4.1 | 3.45 | 2.4 | 2.04 | | | | |
| HEMBB1002556 | 8.37 | 2.84 | 4.27 | 10.84 | 11.6 | 10.64 | 5.58 | 6.3 | 7.41 | * | + | | |
| HEMBB1002571 | 11.52 | 7.77 | 9.15 | 11.56 | 13.65 | 12.93 | 12.05 | 12.33 | 11.31 | | | | |
| HEMBB1002579 | 9.78 | 5.85 | 5.85 | 7.97 | 13.11 | 12.32 | 6.51 | 5.4 | 6.55 | | | | |
| HEMBB1002582 | 7.48 | 3.22 | 3.33 | 10.72 | 9.33 | 10.11 | 3.01 | 4.39 | 4.41 | * | + | | |
| HEMBB1002584 | 5.81 | 3.4 | 4.16 | 3.75 | 2.97 | 2.76 | 1.46 | 2.06 | 1.93 | | | * | − |
| HEMBB1002587 | 12.23 | 4.61 | 5.2 | 12.45 | 17.92 | 18.78 | 8.13 | 9.27 | 7.5 | * | + | | |
| HEMBB1002590 | 5.23 | 2.47 | 3.26 | 5.42 | 7.78 | 6.92 | 3.77 | 4.99 | 5.06 | * | + | | |

TABLE 204

| | | | | | | | | | | | | | |
|---|---|---|---|---|---|---|---|---|---|---|---|---|---|
| HEMBB1002596 | 11.09 | 4.04 | 5.16 | 6.59 | 10.3 | 10.29 | 7.09 | 7.57 | 6.28 | | | | |
| HEMBB1002600 | 3.89 | 1.64 | 1.46 | 3.06 | 2.9 | 2.86 | 2.13 | 3.4 | 3.88 | | | | |
| HEMBB1002601 | 4.5 | 1.39 | 1.18 | 5.04 | 4.66 | 4.04 | 3.46 | 3.02 | 3.12 | | | | |
| HEMBB1002603 | 4.45 | 2.06 | 2.73 | 4.75 | 4.46 | 7.27 | 5.07 | 4.62 | 4.32 | | | | |
| HEMBB1002607 | 3.19 | 2.05 | 1.88 | 4.13 | 5.39 | 8.14 | 1.36 | 2.63 | 2.56 | * | + | | |
| HEMBB1002610 | 1.6 | 0.63 | 1.12 | 0.91 | 2.52 | 2.41 | 0.43 | 2.1 | 1.33 | | | | |
| HEMBB1002613 | 5.8 | 3.36 | 3.29 | 5.19 | 8.86 | 7.2 | 3.09 | 3.91 | 3.13 | | | | |
| HEMBB1002614 | 1.91 | 1.05 | 1.32 | 2.97 | 5.34 | 5.46 | 7.36 | 8.1 | 8.6 | * | + | ** | + |
| HEMBB1002615 | 6.52 | 2.3 | 1.68 | 3.51 | 2.94 | 3.31 | 2.18 | 2.84 | 3.84 | | | | |
| HEMBB1002617 | 2.28 | 1.5 | 2.31 | 5.27 | 5.83 | 5.57 | 3.83 | 2.69 | 3.29 | ** | + | * | + |
| HEMBB1002623 | 5.51 | 3.51 | 3.7 | 8.51 | 8.93 | 10.54 | 4.79 | 3.06 | 5.59 | ** | + | | |
| HEMBB1002624 | 8.23 | 4.59 | 5.1 | 6.42 | 9.16 | 10.04 | 4.11 | 4.54 | 4.4 | | | | |
| HEMBB1002631 | 1.08 | 1.05 | 0.85 | 1.12 | 1.79 | 1.91 | 1.08 | 2.01 | 0.67 | | | | |
| HEMBB1002635 | 2.64 | 1.42 | 1.61 | 2.73 | 3.71 | 3.6 | 1.53 | 2.71 | 1.37 | * | + | | |
| HEMBB1002644 | 8.49 | 6.36 | 7.31 | 6.79 | 8.07 | 10.17 | 5.35 | 5.79 | 6.57 | | | | |
| HEMBB1002654 | 5.54 | 2.29 | 1.98 | 4.78 | 6.75 | 4.59 | 5.18 | 4.74 | 4.09 | | | | |
| HEMBB1002661 | 7.71 | 3.01 | 2.12 | 14.08 | 5.44 | 5.88 | 4.41 | 4.24 | 3.58 | | | | |
| HEMBB1002663 | 6.55 | 2.14 | 3.41 | 6.43 | 8.16 | 7.85 | 4.77 | 5.41 | 5.8 | | | | |
| HEMBB1002664 | 6.6 | 3.98 | 5.84 | 6.11 | 8.43 | 8.44 | 6.92 | 5.8 | 5.93 | | | | |
| HEMBB1002677 | 0.49 | 0.35 | 0.24 | 0.79 | 1.17 | 0.86 | 0.54 | 1.89 | 0.92 | * | + | | |
| HEMBB1002683 | 4.48 | 3.9 | 3.87 | 8.9 | 10.99 | 11.79 | 5.35 | 4.88 | 6.92 | ** | + | | |
| HEMBB1002684 | 1.16 | 0.65 | 1 | 2.27 | 2.67 | 2.14 | 1.24 | 1.93 | 1.3 | ** | + | | |
| HEMBB1002686 | 2.67 | 1.11 | 1.21 | 1.17 | 1.78 | 1.98 | 0.85 | 2.28 | 1.79 | | | | |
| HEMBB1002692 | 1.09 | 0.83 | 0.68 | 1.18 | 2.26 | 3.02 | 1.37 | 1.16 | 1.64 | | | * | + |
| HEMBB1002693 | 15.96 | 10.15 | 10.49 | 21.46 | 23.57 | 25.74 | 17.35 | 13.97 | 17.93 | ** | + | | |
| HEMBB1002697 | 2.36 | 2.43 | 3.54 | 11.69 | 11.93 | 8.98 | 4.98 | 6.73 | 4.87 | ** | + | * | + |
| HEMBB1002699 | 13.26 | 6.7 | 7.9 | 16.74 | 17.15 | 20.25 | 11.78 | 11.33 | 10.9 | * | + | | |
| HEMBB1002702 | 1.17 | 1.29 | 1.36 | 2.27 | 1.04 | 3.55 | 1.45 | 4.46 | 2.44 | | | | |
| HEMBB1002705 | 6.1 | 3.71 | 4.11 | 7.64 | 8.16 | 7.66 | 4.07 | 5.33 | 4.38 | * | + | | |
| HEMBB1002712 | 1.15 | 0.19 | 1.21 | 2.36 | 1.07 | 1.65 | 1.32 | 2.34 | 0.92 | | | | |
| IMR321000028 | 14.59 | 7.8 | 9.64 | 7.27 | 7.89 | 8.64 | 3.38 | 5.26 | 3.94 | | | * | − |
| IMR321000031 | 3.67 | 1.78 | 1.78 | 4.24 | 3.4 | 4.34 | 3.69 | 3.39 | 3.59 | | | | |
| IMR321000034 | 24.92 | 15.48 | 15.01 | 18.47 | 24.81 | 26.67 | 19.77 | 14.09 | 22.91 | | | | |
| IMR321000039 | 17.93 | 8.99 | 10.18 | 11.47 | 11.22 | 20.12 | 13.91 | 11.79 | 14.04 | | | | |

TABLE 204-continued

| | | | | | | | | | | | | | |
|---|---|---|---|---|---|---|---|---|---|---|---|---|---|
| IMR321000044 | 0.32 | 0.19 | 0.19 | 0.47 | 1.02 | 1.05 | 0.71 | 2.7 | 0.69 | * | + | | |
| IMR321000063 | 54.36 | 30.23 | 33.89 | 54.62 | 56.68 | 67.83 | 34.49 | 32.64 | 37.87 | | | | |
| IMR321000085 | 21.71 | 12.85 | 13.46 | 11.07 | 12.01 | 16.43 | 14.38 | 12.89 | 14.05 | | | | |
| IMR321000089 | 3.32 | 1.43 | 2.9 | 5.84 | 3.39 | 4.37 | 2.16 | 3.41 | 3.89 | | | | |
| IMR321000091 | 5.29 | 4.33 | 6.45 | 10.44 | 10.54 | 14.12 | 6.4 | 9.24 | 7.99 | ** | + | | |
| LIVER1000004 | 3.29 | 1.11 | 1.67 | 1.51 | 1.5 | 1.97 | 2.55 | 2.25 | 2.71 | | | | |
| LIVER1000008 | 3.19 | 0.85 | 0.9 | 1.97 | 1.35 | 1.87 | 1.63 | 1.58 | 2.33 | | | | |
| LIVER1000011 | 7.48 | 3.96 | 4.16 | 3.89 | 4.34 | 5.74 | 4.62 | 4.33 | 4.73 | | | | |
| LIVER1000022 | 18.53 | 8.45 | 9.73 | 12.74 | 12.74 | 14.58 | 13.3 | 11.15 | 13.79 | | | | |
| LIVER1000025 | 7.77 | 2.12 | 4.44 | 3.72 | 7.23 | 8.2 | 3.81 | 4.34 | 4.79 | | | | |
| LIVER1000030 | 4.56 | 1.88 | 1.59 | 2.3 | 3.48 | 3.86 | 1.46 | 2.61 | 2.79 | | | | |
| LIVER1000045 | 2.68 | 1.73 | 3.56 | 1.99 | 4.14 | 2.47 | 1.85 | 3.55 | 1.86 | | | | |
| LIVER1000046 | 6.12 | 3.21 | 3.54 | 3.3 | 3.9 | 5.04 | 5.21 | 3.87 | 9.2 | | | | |
| LIVER1000072 | 2.92 | 1.19 | 0.82 | 1.98 | 3.04 | 1.6 | 2.51 | 2.14 | 2.54 | | | | |
| LIVER1000077 | 4.63 | 3.26 | 3.43 | 3.77 | 4.63 | 3.6 | 5.23 | 4.42 | 4.9 | | | | |
| LIVER1000080 | 2 | 1.34 | 1.23 | 2.91 | 3.37 | 3.99 | 2.78 | 3.35 | 3.42 | ** | + | ** | + |
| LIVER1000086 | 4.56 | 1.24 | 1.67 | 1.64 | 5.31 | 2.33 | 4.25 | 3.53 | 3.07 | | | | |
| LIVER1000092 | 2.68 | 1.43 | 1.4 | 3.38 | 2.77 | 3.26 | 2.88 | 3.19 | 2.12 | * | + | | |
| LIVER1000095 | 4.08 | 1.45 | 1.83 | 2.66 | 3.55 | 3.63 | 2.08 | 3.97 | 1.97 | | | | |
| LIVER1000097 | 2.68 | 0.88 | 1.06 | 2.99 | 2.32 | 2.56 | 2.6 | 1.48 | 1.37 | | | | |
| LIVER1000098 | 2.82 | 0.74 | 1.66 | 1.13 | 2.25 | 2.13 | 2.82 | 1.76 | 2.99 | | | | |
| LIVER1000100 | 8.61 | 3.08 | 3.61 | 4.27 | 5.23 | 7.01 | 4.06 | 5.3 | 6.22 | | | | |

TABLE 205

| | | | | | | | | | | | |
|---|---|---|---|---|---|---|---|---|---|---|---|
| LIVER1000101 | 3.81 | 2.12 | 1.66 | 2.9 | 3.56 | 2.76 | 4.13 | 3.57 | 3.85 | | |
| LIVER1000106 | 3.32 | 1.56 | 1.67 | 3.52 | 2.18 | 3.06 | 2.2 | 1.66 | 2.75 | | |
| LIVER1000108 | 2.84 | 1.54 | 1.24 | 2.99 | 3.68 | 3.4 | 2.48 | 3.48 | 3.39 | * | + |
| LIVER1000115 | 2.61 | 1.46 | 1.12 | 3.02 | 3.28 | 3.44 | 1.96 | 2.92 | 2.86 | * | + |
| LIVER1000120 | 5.02 | 2.94 | 2.41 | 3.82 | 3 | 3.25 | 3.35 | 2.12 | 2.66 | | |
| LIVER1000138 | 4.91 | 0.99 | 2.36 | 1.52 | 2.93 | 3.2 | 2.89 | 4.4 | 2.68 | | |
| LIVER1000146 | 11.83 | 5.09 | 5.8 | 8.13 | 11.73 | 11.21 | 7.01 | 6.1 | 7.3 | | |
| LIVER1000148 | 11.43 | 4.5 | 7.19 | 7.38 | 7.37 | 7.45 | 6.46 | 5.27 | 6.13 | | |
| LIVER1000157 | 33.53 | 16.69 | 18.55 | 25.58 | 33.97 | 31.92 | 16.84 | 15.36 | 18.47 | | |
| LIVER1000161 | 7.22 | 4.95 | 3.61 | 5.26 | 5.68 | 6.24 | 4.45 | 3.94 | 6.08 | | |
| LIVER1000167 | 4.56 | 2.13 | 2.81 | 3.19 | 3.07 | 3.13 | 1.51 | 2.38 | 2.42 | | |
| LIVER1000174 | 3.84 | 1.31 | 1.5 | 1.69 | 2.19 | 2.47 | 1.08 | 2.69 | 2.65 | | |
| LIVER1000185 | 6.12 | 3.35 | 4.22 | 3.51 | 3.56 | 3.98 | 2.75 | 3.21 | 2.98 | | |
| LIVER1000187 | 3.26 | 1.56 | 0.93 | 1 | 1.39 | 1.74 | 0.82 | 3.36 | 0.61 | | |
| LIVER1000190 | 1.95 | 1.11 | 1.59 | 1.96 | 1.59 | 2.03 | 2.89 | 1.41 | 1.66 | | |
| LIVER1000192 | 10.65 | 6.24 | 5.2 | 5.75 | 5.77 | 6.49 | 6.06 | 5.8 | 6.02 | | |
| MAMMA1000009 | 5.3 | 2.68 | 2.46 | 6.62 | 5.77 | 8.83 | 4.6 | 3.23 | 5.23 | * | + |
| MAMMA1000015 | 5.84 | 1.77 | 1.87 | 1.64 | 2.88 | 3.59 | 3.38 | 2.5 | 2.77 | | |
| MAMMA1000019 | 5.66 | 2.6 | 2.84 | 4.89 | 9.82 | 8.95 | 3.81 | 3.64 | 4.85 | | |
| MAMMA1000020 | 3.8 | 3.44 | 4.09 | 3.56 | 8.72 | 8.06 | 4.37 | 4.09 | 4.16 | | |
| MAMMA1000024 | 2.87 | 0.82 | 0.95 | 1.1 | 1.88 | 2.53 | 1.55 | 2.13 | 2.01 | | |
| MAMMA1000025 | 4.87 | 2.19 | 2.6 | 4.8 | 5.71 | 6.47 | 3.27 | 3.34 | 4.13 | | |
| MAMMA1000043 | 10.51 | 5.09 | 5.02 | 14.31 | 20.26 | 13.23 | 7.72 | 9.62 | 9.43 | * | + |
| MAMMA1000045 | 1.69 | 0.97 | 1.62 | 2.91 | 3.36 | 3.57 | 3.47 | 1.81 | 1.55 | ** | + |
| MAMMA1000046 | 6.47 | 2.08 | 3.57 | 6.03 | 7.6 | 8.45 | 5.17 | 3.75 | 4.66 | | |
| MAMMA1000055 | 6 | 3.15 | 3.53 | 2.8 | 3.48 | 4.97 | 5.81 | 4.07 | 2.35 | | |
| MAMMA1000057 | 12.48 | 5.52 | 7.03 | 12.15 | 20.3 | 15.59 | 7.03 | 7.1 | 8.26 | | |
| MAMMA1000060 | 14.43 | 7.18 | 9.91 | 16.29 | 13.21 | 18.23 | 10.59 | 9.1 | 11.91 | | |
| MAMMA1000069 | 7.73 | 3.61 | 4.66 | 6.69 | 8.82 | 10.74 | 4.08 | 5.81 | 4.8 | | |
| MAMMA1000084 | 9.73 | 3.57 | 5.05 | 11.91 | 14.34 | 16.88 | 5.45 | 7.65 | 6.73 | * | + |
| MAMMA1000085 | 3.47 | 1.96 | 1.87 | 2.74 | 2.35 | 3.06 | 1.99 | 2.32 | 2.6 | | |
| MAMMA1000092 | 5.41 | 2.13 | 2.26 | 4.85 | 6.6 | 6.02 | 2.97 | 4.24 | 4.71 | | |
| MAMMA1000096 | 3.78 | 3.03 | 1.78 | 3.72 | 4.8 | 6.47 | 4.17 | 3.9 | 6.06 | | |
| MAMMA1000097 | 4.13 | 2.95 | 3.91 | 5.52 | 4.24 | 6.86 | 3.6 | 3.62 | 3.89 | | |
| MAMMA1000102 | 5.12 | 2.21 | 2.7 | 5.22 | 5.81 | 5.02 | 2.56 | 4.65 | 3.65 | | |
| MAMMA1000103 | 3.31 | 1.56 | 2.28 | 4.58 | 6.05 | 6.54 | 2.94 | 4.29 | 3.37 | * | + |
| MAMMA1000106 | 2.7 | 1.79 | 2.13 | 3.04 | 5.09 | 5.41 | 1.36 | 3.69 | 2.27 | * | + |
| MAMMA1000117 | 2.72 | 1.52 | 1.22 | 1.31 | 2.51 | 2.71 | 0.5 | 1.62 | 1.27 | | |
| MAMMA1000118 | 8.14 | 2.71 | 2.77 | 3.78 | 7.64 | 6.37 | 5.72 | 5.22 | 4.29 | | |
| MAMMA1000129 | 4.52 | 1.62 | 2.67 | 3.35 | 3.9 | 5.18 | 1.94 | 2.89 | 2.82 | | |
| MAMMA1000133 | 4.27 | 1.92 | 2.22 | 2.89 | 3.17 | 3.71 | 2.86 | 2.72 | 3.28 | | |
| MAMMA1000134 | 3.24 | 1.82 | 3.24 | 6.48 | 6.88 | 8.35 | 3.29 | 3.76 | 4.59 | ** | + |
| MAMMA1000139 | 3.29 | 2.4 | 1.31 | 3.92 | 4.25 | 4.14 | 3.22 | 2.8 | 2.68 | * | + |
| MAMMA1000141 | 3.46 | 1.27 | 2.24 | 4.07 | 4.79 | 6.79 | 1.97 | 2.52 | 1.91 | * | + |
| MAMMA1000143 | 2.16 | 0.91 | 1.71 | 2.99 | 2.74 | 3.39 | 1.31 | 2.55 | 1.46 | * | + |
| MAMMA1000150 | 10.88 | 7.04 | 8 | 8.79 | 14.06 | 12.33 | 3.84 | 10.55 | 5.74 | | |
| MAMMA1000155 | 10.85 | 5.54 | 5.47 | 9.19 | 13.85 | 13.81 | 7.6 | 7.75 | 9.58 | | |
| MAMMA1000163 | 5.58 | 3.38 | 2.67 | 5.07 | 6.46 | 5 | 2.15 | 2.84 | 6.5 | | |
| MAMMA1000171 | 7.29 | 4.5 | 4.08 | 8.95 | 12.01 | 14.93 | 6.64 | 7.02 | 7.82 | * | + |
| MAMMA1000173 | 6.86 | 4.32 | 5.72 | 5.71 | 7.66 | 7.6 | 5.97 | 5.63 | 5.95 | | |
| MAMMA1000175 | 4.12 | 1.18 | 0.23 | 1.4 | 1.36 | 1.53 | 1.51 | 3.3 | 1.81 | | |

TABLE 205-continued

| | | | | | | | | | |
|---|---|---|---|---|---|---|---|---|---|
| MAMMA1000183 | 7 | 6.5 | 5.17 | 8.02 | 15.13 | 12.18 | 4.61 | 6.16 | 5.98 |
| MAMMA1000191 | 6.82 | 3.67 | 4.83 | 4.54 | 6 | 5.86 | 3.61 | 5.7 | 4.78 |
| MAMMA1000192 | 13.21 | 7.3 | 7.84 | 8.79 | 11.31 | 9.83 | 5.1 | 9.07 | 11.26 |
| MAMMA1000193 | 6.03 | 2.64 | 1.36 | 3.73 | 3.78 | 4.43 | 3.35 | 3.38 | 4.25 |
| MAMMA1000198 | 11.19 | 3.7 | 4.24 | 11.67 | 15.53 | 12.34 | 7.74 | 5.71 | 7.75 |

TABLE 206

| | | | | | | | | | | | | | |
|---|---|---|---|---|---|---|---|---|---|---|---|---|---|
| MAMMA1000204 | 7.62 | 4.53 | 5.82 | 9.51 | 6.8 | 8.54 | 5.56 | 4.69 | 5.2 | | | | |
| MAMMA1000207 | 6.14 | 2.58 | 4.15 | 4.25 | 4.43 | 7.49 | 4.2 | 4.63 | 3.58 | | | | |
| MAMMA1000214 | 3.73 | 2.36 | 3.5 | 6.05 | 6.43 | 8.36 | 3.87 | 5.19 | 4.02 | * | + | | |
| MAMMA1000220 | 3.64 | 2.49 | 2.27 | 4.02 | 3.64 | 4.91 | 4.36 | 4.51 | 3.83 | | | * | + |
| MAMMA1000221 | 4.11 | 1.84 | 1.12 | 2.33 | 12.39 | 3.34 | 2.86 | 3.69 | 1.65 | | | | |
| MAMMA1000226 | 3.4 | 1.09 | 2.76 | 2.96 | 2.31 | 2.84 | 1.92 | 4.54 | 2.53 | | | | |
| MAMMA1000227 | 5.88 | 3.58 | 3.47 | 4.08 | 7.55 | 8.07 | 3.93 | 3.56 | 5.9 | | | | |
| MAMMA1000230 | 6.36 | 3.63 | 3.36 | 3.79 | 7.14 | 7.18 | 4.32 | 4.39 | 3.89 | | | | |
| MAMMA1000241 | 5.23 | 2.78 | 2.92 | 6.17 | 10.99 | 9.16 | 5.63 | 6.94 | 5.92 | * | + | * | + |
| MAMMA1000245 | 71.79 | 48.41 | 41.99 | 49.62 | 55.47 | 70.51 | 36.86 | 32.29 | 42.56 | | | | |
| MAMMA1000248 | 10.75 | 5.11 | 8.19 | 10.32 | 13.93 | 13.73 | 8.64 | 7.83 | 9.87 | | | | |
| MAMMA1000251 | 4.47 | 3.42 | 3.86 | 6.07 | 8.71 | 10 | 3.62 | 6.05 | 5.41 | * | + | | |
| MAMMA1000254 | 2.89 | 1.15 | 1.35 | 4.06 | 5.79 | 5.07 | 1.95 | 5.72 | 2.71 | * | + | | |
| MAMMA1000257 | 7.12 | 4.26 | 6.71 | 11.96 | 14.47 | 16.44 | 5.81 | 9.74 | 10.27 | ** | + | | |
| MAMMA1000262 | 12.13 | 6.11 | 6.35 | 9.28 | 17.3 | 14.89 | 11.45 | 12.94 | 13.68 | | | | |
| MAMMA1000264 | 1.54 | 1.94 | 1.06 | 2.96 | 5.16 | 6.26 | 1.9 | 2.25 | 1.92 | * | + | | |
| MAMMA1000266 | 1.41 | 0.76 | 1.44 | 2.49 | 3.39 | 2.45 | 2.4 | 2.54 | 1.43 | * | + | | |
| MAMMA1000270 | 8.33 | 3.85 | 6.34 | 9.35 | 14.72 | 13.36 | 5.23 | 6.67 | 8.24 | * | + | | |
| MAMMA1000271 | 3.79 | 2.55 | 1.83 | 6.46 | 5.81 | 4.43 | 3.8 | 4.01 | 4.5 | * | + | | |
| MAMMA1000277 | 2.17 | 1.07 | 1.86 | 2.66 | 2.04 | 3.91 | 1.48 | 2.33 | 1.37 | | | | |
| MAMMA1000278 | 2.46 | 1.53 | 1.53 | 2.26 | 1.74 | 1.78 | 1.61 | 3.39 | 1.57 | | | | |
| MAMMA1000279 | 4.53 | 3.12 | 3.68 | 7.71 | 9.92 | 13.85 | 2.86 | 4.21 | 4.62 | * | + | | |
| MAMMA1000283 | 2.8 | 0.74 | 1.34 | 2.2 | 3.06 | 3.24 | 2.27 | 2.64 | 2.53 | | | | |
| MAMMA1000284 | 7.09 | 3.1 | 3.89 | 5.31 | 5.61 | 7.3 | 4.33 | 4.12 | 6.21 | | | | |
| MAMMA1000287 | 3.34 | 1.37 | 2.39 | 5.26 | 5.17 | 6.99 | 4.97 | 3.06 | 4.33 | * | + | | |
| MAMMA1000294 | 18.13 | 8.47 | 8.55 | 15.55 | 11.48 | 16.82 | 12.33 | 10.64 | 11.59 | | | | |
| MAMMA1000298 | 1.54 | 0.71 | 0.82 | 0.74 | 1.91 | 1.79 | 1.37 | 1.29 | 1.02 | | | | |
| MAMMA1000302 | 5.12 | 2.71 | 2.69 | 5.15 | 5.37 | 6.89 | 4.36 | 4.77 | 2.99 | | | | |
| MAMMA1000303 | 4 | 2.05 | 1.59 | 2.54 | 3.44 | 3.95 | 1.95 | 2.67 | 2.43 | | | | |
| MAMMA1000305 | 1.38 | 0.71 | 0.71 | 1.7 | 2.67 | 3.22 | 1.16 | 1.69 | 1.13 | * | + | | |
| MAMMA1000307 | 12.76 | 5.57 | 7.52 | 10.78 | 17.15 | 13.46 | 11.84 | 12.09 | 11.6 | | | | |
| MAMMA1000309 | 0.76 | 0.89 | 1.4 | 1.06 | 1.34 | 1.72 | 1.77 | 0.93 | 1.2 | | | | |
| MAMMA1000312 | 1.8 | 1.04 | 0.87 | 1.28 | 0.56 | 1.1 | 1.25 | 1.47 | 0.9 | | | | |
| MAMMA1000313 | 2.67 | 3.77 | 1.89 | 3.1 | 6.23 | 5.66 | 3.12 | 2.28 | 2.98 | | | | |
| MAMMA1000331 | 4.12 | 2.28 | 1.93 | 3.93 | 3.97 | 5.29 | 3.56 | 3.45 | 3.82 | | | | |
| MAMMA1000335 | 6.16 | 2.7 | 3.37 | 3.54 | 3.79 | 3.88 | 3.68 | 2.45 | 3.73 | | | | |
| MAMMA1000339 | 3.25 | 1.33 | 2.61 | 3.01 | 4.9 | 3.33 | 2.91 | 2.77 | 1.92 | | | | |
| MAMMA1000340 | 2.6 | 1.63 | 1.41 | 3.96 | 4.43 | 4.29 | 1.81 | 3.28 | 2.22 | ** | + | | |
| MAMMA1000348 | 3.33 | 1.48 | 2.34 | 6.45 | 6.9 | 6.21 | 5.1 | 3.51 | 6.66 | ** | + | | |
| MAMMA1000356 | 8.13 | 2.7 | 3.74 | 9.76 | 8.55 | 10.65 | 5.97 | 5.34 | 5.67 | | | | |
| MAMMA1000358 | 4.37 | 2.17 | 1.44 | 5.1 | 4.35 | 4.38 | 3.5 | 3.09 | 3.71 | | | | |
| MAMMA1000360 | 7.72 | 3.05 | 2.69 | 11.41 | 9.78 | 10.42 | 6.57 | 4.42 | 6.39 | * | + | | |
| MAMMA1000361 | 7.91 | 2.97 | 4.89 | 10.45 | 10.37 | 13.01 | 6.44 | 5.43 | 7.13 | * | + | | |
| MAMMA1000363 | 5.44 | 2.67 | 2.71 | 3.44 | 2.89 | 4.74 | 2.99 | 2.83 | 3.16 | | | | |
| MAMMA1000370 | 8.4 | 6.64 | 6.2 | 6.19 | 7.25 | 6.56 | 6.68 | 7.49 | 4.91 | | | | |
| MAMMA1000371 | 6.81 | 4.41 | 6.08 | 4.39 | 3.58 | 5.6 | 4.96 | 6.77 | 5.24 | | | | |
| MAMMA1000372 | 11.86 | 4.03 | 5.98 | 15.22 | 16.38 | 16.77 | 7.36 | 6 | 7.47 | * | + | | |
| MAMMA1000385 | 4.62 | 2.3 | 2.77 | 5.18 | 7.04 | 8.05 | 4.85 | 4.48 | 5 | * | + | | |
| MAMMA1000388 | 6.44 | 2.83 | 3.67 | 5.65 | 4.46 | 4.85 | 4.91 | 3.34 | 5.06 | | | | |
| MAMMA1000395 | 5.17 | 2.17 | 2.95 | 3.65 | 4.16 | 4.78 | 3.21 | 2.41 | 3.84 | | | | |
| MAMMA1000402 | 7.68 | 3.41 | 2.88 | 9.51 | 10.11 | 10.62 | 5.46 | 6.68 | 5.96 | * | + | | |
| MAMMA1000403 | 6.72 | 2.73 | 3.78 | 6.04 | 7.7 | 8.56 | 4.71 | 5.83 | 4.03 | | | | |
| MAMMA1000410 | 4.02 | 2.21 | 1.56 | 4.09 | 5.7 | 5.12 | 2.32 | 3.4 | 1.98 | | | | |
| MAMMA1000413 | 1.97 | 0.9 | 1.1 | 2.1 | 2.16 | 1.61 | 0.81 | 1.47 | 1.21 | | | | |
| MAMMA1000414 | 3.35 | 1.71 | 2.96 | 4.73 | 3.34 | 2.27 | 4.52 | 4.04 | 1.89 | | | | |
| MAMMA1000416 | 14.38 | 8.87 | 8.86 | 11.04 | 19.59 | 15.46 | 12.54 | 10.99 | 12.32 | | | | |

TABLE 207

| | | | | | | | | | | | | | |
|---|---|---|---|---|---|---|---|---|---|---|---|---|---|
| MAMMA1000421 | 7.88 | 5.58 | 3.16 | 7.31 | 11.57 | 11.97 | 5.34 | 5.28 | 5.81 | | | | |
| MAMMA1000422 | 4.93 | 2.9 | 1.84 | 2.34 | 3.07 | 4.44 | 2.35 | 2.99 | 4.14 | | | | |
| MAMMA1000423 | 3.67 | 2.88 | 1.35 | 2.17 | 3.71 | 4.12 | 2.5 | 2.73 | 2.24 | | | | |
| MAMMA1000424 | 0.47 | 0.75 | 0.45 | 1.27 | 1.37 | 1.76 | 1.14 | 1.64 | 1.04 | ** | + | * | + |
| MAMMA1000429 | 32.94 | 14.89 | 22.85 | 23.37 | 29.25 | 34.16 | 20.87 | 25.24 | 25.81 | | | | |
| MAMMA1000431 | 7.98 | 3.3 | 4.81 | 7.45 | 10.34 | 14.08 | 4.8 | 6.35 | 5.12 | | | | |
| MAMMA1000432 | 4.6 | 2.09 | 3.06 | 2.28 | 3.64 | 3.72 | 3.43 | 4.61 | 3.15 | | | | |

TABLE 207-continued

| | | | | | | | | | | | | | |
|---|---|---|---|---|---|---|---|---|---|---|---|---|---|
| MAMMA1000437 | 6.14 | 5.61 | 6.7 | 6.37 | 13.88 | 6.85 | 9.07 | 7.74 | 6.38 | | | | |
| MAMMA1000444 | 10.06 | 5.02 | 5.92 | 12.4 | 21.04 | 12.87 | 7.66 | 9.16 | 10.21 | | | | |
| MAMMA1000446 | 5.86 | 2.32 | 2.37 | 3.48 | 5.41 | 5.04 | 2.92 | 3.11 | 3.2 | | | | |
| MAMMA1000449 | 5.06 | 1.88 | 4.07 | 4.87 | 7.02 | 6.19 | 3.35 | 3.99 | 3.47 | | | | |
| MAMMA1000457 | 3.42 | 1.31 | 1.57 | 3.54 | 3.24 | 3.66 | 3.14 | 3.48 | 3.29 | | | | |
| MAMMA1000458 | 3.87 | 1.25 | 2.08 | 2.19 | 3.1 | 2.93 | 2.24 | 2.82 | 1.85 | | | | |
| MAMMA1000468 | 1.49 | 0.06 | 0.79 | 0.79 | 1.06 | 1.13 | 0.34 | 1.08 | 0.62 | | | | |
| MAMMA1000472 | 11.38 | 4.74 | 6.91 | 9.55 | 12.61 | 11.92 | 6.13 | 7.53 | 8.61 | | | | |
| MAMMA1000473 | 5.96 | 3.57 | 3.53 | 12.63 | 7.19 | 13.81 | 5.26 | 5.18 | 5.28 | * | + | | |
| MAMMA1000477 | 5.82 | 2.74 | 2.51 | 5.72 | 8.15 | 7.58 | 3.74 | 4.02 | 3.75 | | | | |
| MAMMA1000478 | 9 | 4.17 | 4.73 | 12.94 | 18.52 | 17.59 | 8.49 | 7.88 | 8.95 | * | + | | |
| MAMMA1000483 | 14.86 | 5.67 | 8.42 | 11.14 | 12.83 | 12.05 | 7.76 | 6.25 | 5.28 | | | | |
| MAMMA1000490 | 3.41 | 1.2 | 1.17 | 3.21 | 2.92 | 3.1 | 1.71 | 2.32 | 2.64 | | | | |
| MAMMA1000496 | 2.46 | 1.87 | 1.02 | 2.44 | 3.29 | 2.49 | 1.44 | 3.16 | 1.85 | | | | |
| MAMMA1000500 | 1.56 | 0.84 | 0.9 | 2.28 | 2.75 | 1.98 | 1.08 | 1.9 | 1.36 | * | + | | |
| MAMMA1000501 | 11.66 | 5.38 | 5.27 | 11.85 | 14.49 | 13.05 | 6.88 | 6.5 | 10.43 | | | | |
| MAMMA1000503 | 1.33 | 0.54 | 0.92 | 1.59 | 1.74 | 1.27 | 1.8 | 2.54 | 1.09 | | | | |
| MAMMA1000506 | 12.82 | 9.48 | 10.39 | 12.58 | 12.2 | 12.4 | 9.73 | 8.88 | 12.24 | | | | |
| MAMMA1000510 | 7.01 | 5.28 | 6.34 | 4.55 | 7.48 | 6.55 | 5.31 | 5.02 | 4.6 | | | | |
| MAMMA1000515 | 7.48 | 2.78 | 3.25 | 5.65 | 6.45 | 7.72 | 3.13 | 3.76 | 3.48 | | | | |
| MAMMA1000516 | 5.84 | 1.9 | 2.82 | 5.98 | 7.85 | 7.2 | 2.82 | 3.57 | 3.21 | | | | |
| MAMMA1000522 | 2.27 | 1.18 | 1.41 | 3.64 | 3.92 | 3.54 | 1.42 | 3.62 | 1.52 | ** | + | | |
| MAMMA1000524 | 7.63 | 2.43 | 4.92 | 8.34 | 11.81 | 13.33 | 5.04 | 5.34 | 4.54 | * | + | | |
| MAMMA1000528 | 1.85 | 0.58 | 1.07 | 2.05 | 2.46 | 2.53 | 1.6 | 1.39 | 1.82 | * | + | | |
| MAMMA1000534 | 2.5 | 1.5 | 1.3 | 2.79 | 2.83 | 2.9 | 2.6 | 2.21 | 1.6 | * | + | | |
| MAMMA1000541 | 10.98 | 5.23 | 5.03 | 6.32 | 9.31 | 8.45 | 6.48 | 6.33 | 7.6 | | | | |
| MAMMA1000550 | 4.4 | 3.04 | 2.74 | 4.35 | 5.4 | 3.92 | 4.73 | 3.37 | 2.94 | | | | |
| MAMMA1000556 | 1.48 | 1.03 | 1.14 | 1.83 | 2.63 | 2.37 | 0.93 | 2.78 | 1.93 | * | + | | |
| MAMMA1000559 | 4.37 | 1.96 | 1.73 | 4.8 | 7.23 | 5.02 | 4.99 | 3.84 | 3.11 | | | | |
| MAMMA1000565 | 4.72 | 1.49 | 2.86 | 6.83 | 6.65 | 5.82 | 4.27 | 3.68 | 2.63 | * | + | | |
| MAMMA1000567 | 3.83 | 3.37 | 3.67 | 5.22 | 7.17 | 6.61 | 3.18 | 4.82 | 3.63 | * | + | | |
| MAMMA1000576 | 15.99 | 9.01 | 6.07 | 17.4 | 30.24 | 29.01 | 12.9 | 10.14 | 12.06 | * | + | | |
| MAMMA1000582 | 5.54 | 2.74 | 3.08 | 4.19 | 5.56 | 6.62 | 5.53 | 3.7 | 3.87 | | | | |
| MAMMA1000583 | 4.38 | 2.28 | 1.5 | 5.07 | 4.75 | 6.13 | 4.1 | 3.32 | 3.54 | | | | |
| MAMMA1000585 | 3.99 | 1.32 | 2.85 | 5.97 | 7.85 | 8.52 | 3.94 | 4.82 | 4.06 | * | + | | |
| MAMMA1000587 | 3.21 | 2.47 | 2 | 4.38 | 5.07 | 2.06 | 5.51 | 4.86 | 2.27 | | | | |
| MAMMA1000591 | 3.28 | 1.11 | 2.12 | 2.42 | 2.51 | 3.46 | 1.69 | 4.06 | 3.09 | | | | |
| MAMMA1000594 | 6.52 | 3.99 | 5.77 | 13.18 | 11.99 | 15.24 | 6.18 | 7.35 | 5.58 | ** | + | | |
| MAMMA1000597 | 21.18 | 8.64 | 13.27 | 24.68 | 32.8 | 31.71 | 15.42 | 19.85 | 17.87 | * | + | | |
| MAMMA1000605 | 15 | 7.83 | 7.51 | 16.1 | 27.17 | 27.84 | 15.98 | 12.24 | 13.96 | * | + | | |
| MAMMA1000612 | 7.9 | 2.22 | 3.52 | 4.29 | 4.53 | 4.73 | 3.74 | 1.84 | 4.78 | | | | |
| MAMMA1000614 | 21.9 | 15.16 | 16.51 | 11.47 | 18.81 | 18.51 | 16.91 | 14.24 | 15.41 | | | | |
| MAMMA1000616 | 0.69 | 0.1 | 0.08 | 2.78 | 1.16 | 2.29 | 1.88 | 2.45 | 1.31 | * | + | * | + |
| MAMMA1000621 | 3.29 | 2.06 | 2.49 | 3.22 | 4.74 | 3.92 | 2.54 | 4.56 | 2.58 | | | | |
| MAMMA1000623 | 3.66 | 0.62 | 3.18 | 3.6 | 1.78 | 3.6 | 1.68 | 2.93 | 1.92 | | | | |
| MAMMA1000625 | 21.85 | 13.69 | 19.79 | 20.91 | 20.47 | 21.13 | 14.29 | 16.77 | 23.93 | | | | |
| MAMMA1000635 | 0.42 | 0.29 | 0.29 | 1.14 | 0.49 | 1.07 | 0.07 | 1.98 | 0.45 | | | | |
| MAMMA1000643 | 3.78 | 2.57 | 1.76 | 4.32 | 6.22 | 6.75 | 3.82 | 3.69 | 4.44 | * | + | | |
| MAMMA1000646 | 10.28 | 5.04 | 4.34 | 5.25 | 6.7 | 11.98 | 4.93 | 10.71 | 4.89 | | | | |

TABLE 208

| | | | | | | | | | | | | | |
|---|---|---|---|---|---|---|---|---|---|---|---|---|---|
| MAMMA1000652 | 8.47 | 3.81 | 5.01 | 8.32 | 13.85 | 13.05 | 5.34 | 6.27 | 6.14 | | | | |
| MAMMA1000657 | 5.07 | 3.94 | 3.85 | 6.77 | 10.59 | 9.73 | 5.63 | 6.14 | 5.11 | * | + | | |
| MAMMA1000664 | 2.69 | 1.1 | 1.96 | 4.49 | 4.5 | 4.2 | 2.58 | 4.29 | 2.35 | ** | + | | |
| MAMMA1000667 | 4.79 | 1.98 | 2.15 | 4.21 | 4.93 | 5.76 | 3.08 | 4.06 | 3.71 | | | | |
| MAMMA1000668 | 2.4 | 1.13 | 1.67 | 3.73 | 2.97 | 3.09 | 0.95 | 4.13 | 2.08 | * | + | | |
| MAMMA1000669 | 1.17 | 0.4 | 0.79 | 2.08 | 2.59 | 2.37 | 1.24 | 0.92 | 0.96 | ** | + | | |
| MAMMA1000670 | 7.56 | 4.44 | 3.7 | 4.32 | 4.44 | 6.75 | 2.59 | 5.1 | 5.48 | | | | |
| MAMMA1000672 | 7.79 | 2.99 | 3.4 | 4.22 | 3.53 | 5.63 | 3.72 | 4.19 | 6.43 | | | | |
| MAMMA1000681 | 4.68 | 1.14 | 3.03 | 2.41 | 2.85 | 4.06 | 2.7 | 2.22 | 3.58 | | | | |
| MAMMA1000684 | 35.85 | 22.61 | 24.91 | 21.42 | 31.5 | 29.68 | 12.4 | 13.65 | 15.36 | | | * | − |
| MAMMA1000696 | 6.4 | 3.52 | 4.51 | 7.83 | 11.25 | 15.25 | 8.55 | 6.27 | 7.54 | * | + | | |
| MAMMA1000702 | 8.51 | 4.05 | 5.46 | 6.26 | 5.22 | 7.23 | 5.02 | 5.02 | 4.55 | | | | |
| MAMMA1000706 | 3.68 | 1.19 | 1.86 | 2.9 | 2.36 | 3.42 | 2.81 | 1.88 | 2.14 | | | | |
| MAMMA1000707 | 3.62 | 1.77 | 1.28 | 1.62 | 3.45 | 1.98 | 2.41 | 2.52 | 2.5 | | | | |
| MAMMA1000713 | 5.4 | 2.54 | 3.24 | 5.36 | 5.73 | 6.33 | 4.52 | 4.76 | 4.87 | | | | |
| MAMMA1000714 | 7.46 | 4.12 | 5.15 | 8.57 | 7.81 | 8.68 | 8.73 | 7.85 | 8.07 | | | | |
| MAMMA1000718 | 3.29 | 2.59 | 1.62 | 6.31 | 6.72 | 5.21 | 3.55 | 3.17 | 4.84 | ** | + | | |
| MAMMA1000720 | 11.1 | 3.49 | 5.25 | 10.45 | 13.49 | 12.85 | 6.43 | 5.97 | 7.74 | | | | |
| MAMMA1000723 | 2.28 | 1.69 | 2.12 | 4.14 | 3.59 | 4.23 | 2.79 | 2.97 | 1.93 | ** | + | | |
| MAMMA1000731 | 1.86 | 0.62 | 0.69 | 2.69 | 3.19 | 3.37 | 2.54 | 2.31 | 2.78 | * | + | * | + |
| MAMMA1000732 | 4.46 | 2.1 | 1.55 | 3.27 | 6.08 | 6 | 3.73 | 4.07 | 3.22 | | | | |
| MAMMA1000733 | 2 | 0.47 | 0.64 | 1.76 | 2.5 | 2.33 | 0.99 | 1.71 | 0.41 | | | | |
| MAMMA1000734 | 19.84 | 13.3 | 8.71 | 14.98 | 15.8 | 18.61 | 13.99 | 14.24 | 10.98 | | | | |
| MAMMA1000736 | 12.43 | 4.93 | 6.22 | 7.65 | 6.62 | 9.44 | 6.16 | 4.05 | 8.82 | | | | |

TABLE 208-continued

| ID | | | | | | | | | | | | | |
|---|---|---|---|---|---|---|---|---|---|---|---|---|---|
| MAMMA1000738 | 9.86 | 3.76 | 4.66 | 5.29 | 7.95 | 8.71 | 4.04 | 5.76 | 4.24 | | | | |
| MAMMA1000744 | 6.53 | 4.63 | 4.71 | 11 | 10.23 | 11.31 | 6.26 | 6.39 | 7.29 | ** | + | | |
| MAMMA1000746 | 1.48 | 2.11 | 1.07 | 4.85 | 6.59 | 5.04 | 2.55 | 4.44 | 6.76 | ** | + | | |
| MAMMA1000748 | 9.39 | 7.13 | 8.61 | 8.38 | 10.56 | 16.11 | 5.63 | 9.36 | 9.45 | | | | |
| MAMMA1000751 | 19.32 | 15.21 | 15.9 | 12.13 | 17.33 | 24.65 | 8.32 | 12.47 | 10.06 | | | * | − |
| MAMMA1000752 | 4.99 | 3.06 | 2.62 | 6.31 | 5.93 | 7.52 | 3.57 | 3.3 | 3.21 | * | + | | |
| MAMMA1000757 | 16.42 | 7.46 | 8.63 | 15.03 | 20.13 | 20.42 | 10.82 | 9.38 | 12.45 | | | | |
| MAMMA1000760 | 13.83 | 4.85 | 6.07 | 16.93 | 20.12 | 21.36 | 9.26 | 10.09 | 9.12 | * | + | | |
| MAMMA1000761 | 7 | 5.05 | 5.28 | 10.4 | 11.63 | 13.03 | 5.86 | 6.75 | 6.32 | ** | + | | |
| MAMMA1000775 | 4.08 | 1.66 | 2.88 | 3.15 | 4.48 | 7.4 | 3.92 | 4.45 | 3.2 | | | | |
| MAMMA1000776 | 6.7 | 4.59 | 3.36 | 9.35 | 9.08 | 9.79 | 6.68 | 5.65 | 5.84 | * | + | | |
| MAMMA1000778 | 5.98 | 3.45 | 2.59 | 7.46 | 6.58 | 10.39 | 4.17 | 4.75 | 3.98 | | | | |
| MAMMA1000781 | 5.48 | 3.83 | 3.81 | 4.84 | 4.93 | 5.96 | 2.78 | 5.06 | 3.06 | | | | |
| MAMMA1000782 | 15.43 | 7.59 | 9.38 | 7 | 8.75 | 12.93 | 6.89 | 10.66 | 10.04 | | | | |
| MAMMA1000784 | 6.69 | 3.02 | 3.41 | 4.23 | 8.26 | 6.49 | 8.78 | 3.6 | 3.47 | | | | |
| MAMMA1000788 | 18.64 | 7.23 | 10.16 | 10.95 | 9.2 | 11.24 | 9.78 | 6.25 | 8.61 | | | | |
| MAMMA1000798 | 2.84 | 1.31 | 1.28 | 2.57 | 6.45 | 2.47 | 2.42 | 2.49 | 2.05 | | | | |
| MAMMA1000802 | 10.19 | 4.79 | 5.55 | 11.64 | 14.85 | 12.54 | 8.45 | 6.23 | 7.37 | * | + | | |
| MAMMA1000810 | 10.4 | 4.83 | 5.83 | 11.45 | 14.19 | 14.79 | 8.3 | 8.84 | 9.48 | * | + | | |
| MAMMA1000813 | 3.06 | 1.41 | 1.3 | 0.97 | 1.08 | 1.47 | 1.17 | 2.87 | 1.61 | | | | |
| MAMMA1000814 | 11.43 | 4.36 | 6.48 | 10.9 | 13.12 | 14.78 | 6.64 | 8.56 | 8.44 | | | | |
| MAMMA1000824 | 4.94 | 1.4 | 2.5 | 6.51 | 8.16 | 10.38 | 6.57 | 7.55 | 6.92 | * | + | * | + |
| MAMMA1000827 | 5.81 | 3.08 | 3.37 | 6.5 | 5.83 | 6.58 | 3.91 | 3.77 | 4.74 | | | | |
| MAMMA1000831 | 3.49 | 2.19 | 2.43 | 2.04 | 2.83 | 2.54 | 2.49 | 2.54 | 3.51 | | | | |
| MAMMA1000838 | 7.72 | 7.34 | 6.75 | 10.55 | 7.02 | 15.37 | 8.46 | 6.62 | 9.4 | | | | |
| MAMMA1000839 | 9.86 | 5.11 | 5.3 | 13.32 | 14.94 | 15.98 | 11.39 | 9.61 | 11.68 | ** | + | | |
| MAMMA1000841 | 2.16 | 2.22 | 2.46 | 2.34 | 3.62 | 2.61 | 2.07 | 3.51 | 3.1 | | | | |
| MAMMA1000842 | 9.7 | 5.15 | 5.18 | 5.26 | 8.56 | 8.54 | 4.59 | 6.92 | 6.8 | | | | |
| MAMMA1000843 | 1.45 | 0.52 | 0.63 | 1.44 | 1.42 | 1.66 | 1.24 | 1.97 | 1.12 | | | | |
| MAMMA1000845 | 2.99 | 0.85 | 1.74 | 2.17 | 3.73 | 3.02 | 1.45 | 3.21 | 2.14 | | | | |
| MAMMA1000851 | 12.84 | 5.8 | 5.26 | 10.17 | 14.4 | 13.52 | 7.61 | 8.15 | 8.58 | | | | |
| MAMMA1000854 | 5.64 | 2.1 | 2.3 | 6.34 | 4.33 | 5.81 | 6.81 | 5.87 | 6.68 | | | | |

TABLE 209

| ID | | | | | | | | | | | | | |
|---|---|---|---|---|---|---|---|---|---|---|---|---|---|
| MAMMA1000855 | 1.7 | 1.63 | 1.03 | 1.59 | 2.99 | 3.96 | 1.06 | 2.13 | 1.04 | | | | |
| MAMMA1000856 | 6.3 | 3.91 | 3.68 | 6.66 | 6.53 | 6.39 | 5.69 | 5.47 | 5.67 | | | | |
| MAMMA1000859 | 30.54 | 14.5 | 21.77 | 15.43 | 16.32 | 21.44 | 10.77 | 8.93 | 11.82 | | | | |
| MAMMA1000862 | 3.63 | 1.84 | 2.53 | 2.21 | 2.9 | 4.05 | 1.42 | 1.82 | 1.19 | | | | |
| MAMMA1000863 | 6.2 | 3.01 | 3.04 | 4.59 | 9.69 | 8.1 | 4.1 | 6.66 | 5.5 | | | | |
| MAMMA1000865 | 0.8 | 0.11 | 0.15 | 0.67 | 1.37 | 0.92 | 0.2 | 1.71 | 0.5 | | | | |
| MAMMA1000867 | 4.15 | 2.15 | 1.95 | 2.19 | 5.49 | 3.51 | 1.75 | 2.5 | 2.37 | | | | |
| MAMMA1000875 | 9.92 | 4.24 | 6.11 | 6.91 | 11.92 | 12.78 | 4.67 | 4.48 | 7 | | | | |
| MAMMA1000876 | 4.63 | 2.26 | 3.14 | 3.33 | 5.28 | 6.68 | 4.51 | 3.48 | 5.36 | | | | |
| MAMMA1000877 | 9.58 | 4.24 | 6.31 | 9.18 | 13.08 | 15.47 | 7.32 | 6.45 | 8.51 | | | | |
| MAMMA1000878 | 8.16 | 4.46 | 5.1 | 7.91 | 13.1 | 10.3 | 5.72 | 5.68 | 6.98 | | | | |
| MAMMA1000880 | 4.25 | 2.2 | 2.38 | 4.84 | 4.93 | 5.5 | 2.27 | 3.49 | 2.89 | * | + | | |
| MAMMA1000881 | 4.86 | 3.39 | 4.01 | 5.58 | 9.07 | 9.97 | 3.7 | 4.59 | 4.69 | * | + | | |
| MAMMA1000883 | 4.1 | 2.09 | 3.9 | 3.29 | 3.78 | 3.16 | 2.41 | 3.12 | 3.57 | | | | |
| MAMMA1000897 | 0.87 | 0.78 | 1.52 | 1.35 | 2.84 | 1.6 | 1.61 | 1.81 | 0.9 | | | | |
| MAMMA1000898 | 14.3 | 5.37 | 5.9 | 6.61 | 8.53 | 8.2 | 8.24 | 7.58 | 9.2 | | | | |
| MAMMA1000905 | 6.32 | 4.16 | 3.03 | 7.58 | 8.06 | 10.95 | 4.06 | 4.04 | 6.22 | * | + | | |
| MAMMA1000906 | 4.24 | 2.45 | 3 | 4.3 | 3.89 | 5.72 | 2.87 | 4.2 | 3.18 | | | | |
| MAMMA1000908 | 1.27 | 0.39 | 0.86 | 1.42 | 2.93 | 1.74 | 2.49 | 2.77 | 1.87 | | | * | + |
| MAMMA1000911 | 0.41 | 1.25 | 0.84 | 1.86 | 2.28 | 2.63 | 8.08 | 5.76 | 7.77 | * | + | ** | + |
| MAMMA1000914 | 5.03 | 2.41 | 2.68 | 4.67 | 4.17 | 3.32 | 1.99 | 2.14 | 2.33 | | | | |
| MAMMA1000920 | 3.12 | 1.17 | 2.51 | 3.63 | 3.17 | 3.45 | 2.05 | 3.06 | 3.19 | | | | |
| MAMMA1000921 | 3.37 | 3.29 | 3.26 | 3.61 | 9.57 | 6.95 | 3.48 | 3.25 | 3.54 | | | | |
| MAMMA1000931 | 8.02 | 4.92 | 5.62 | 10.56 | 14.6 | 15.07 | 6.35 | 6.66 | 5.94 | * | + | | |
| MAMMA1000940 | 6.43 | 3.57 | 4.1 | 8.17 | 7.42 | 11.2 | 5.43 | 7.24 | 5.59 | * | + | | |
| MAMMA1000941 | 8.08 | 4.42 | 5.26 | 11.96 | 15.08 | 14.97 | 7.8 | 6.29 | 7.57 | ** | + | | |
| MAMMA1000942 | 16.28 | 7.28 | 9.32 | 16.51 | 16.66 | 17.99 | 9.16 | 10.49 | 11.15 | | | | |
| MAMMA1000943 | 8.02 | 5.62 | 7.75 | 12.59 | 16.34 | 17.28 | 9.76 | 9.93 | 7.72 | ** | + | | |
| MAMMA1000952 | 8.49 | 4.92 | 6.82 | 13.66 | 13.4 | 12.11 | 7.68 | 8.43 | 10.02 | ** | + | | |
| MAMMA1000956 | 1.29 | 1.15 | 1.49 | 1.35 | 3.18 | 2.29 | 2.16 | 3.08 | 2.19 | | | * | + |
| MAMMA1000957 | 6.37 | 3.36 | 2.47 | 7.39 | 11.27 | 10.47 | 4.72 | 6 | 5.03 | * | + | | |
| MAMMA1000962 | 14.04 | 6.88 | 6.94 | 17.04 | 23.21 | 26.2 | 11.63 | 8.86 | 12.79 | * | + | | |
| MAMMA1000966 | 7.34 | 3.73 | 4.5 | 10.84 | 15.74 | 12.34 | 4.66 | 6.62 | 6.12 | * | + | | |
| MAMMA1000968 | 7.71 | 3.48 | 2.83 | 8.85 | 11.98 | 9.01 | 6.3 | 7.27 | 5.97 | * | + | | |
| MAMMA1000972 | 1.58 | 1.55 | 1.15 | 4.38 | 2.9 | 3.02 | 2.22 | 4.51 | 2.3 | * | + | | |
| MAMMA1000973 | 3.5 | 1.69 | 1.59 | 3.69 | 3.21 | 4.33 | 2.55 | 2.9 | 1.2 | | | | |
| MAMMA1000975 | 2.22 | 2.8 | 2.6 | 2.48 | 6.62 | 3.03 | 2.24 | 4.33 | 2.06 | | | | |
| MAMMA1000976 | 7.5 | 4.17 | 5.75 | 10.05 | 14.48 | 15.04 | 6.28 | 7.31 | 7.44 | * | + | | |
| MAMMA1000979 | 6.1 | 3.13 | 2.84 | 6.83 | 11.15 | 7.34 | 4.03 | 3.36 | 5.99 | | | | |
| MAMMA1000986 | 8.92 | 4.73 | 5.33 | 9.12 | 17.71 | 11.66 | 6.36 | 10.27 | 8.03 | | | | |
| MAMMA1000987 | 4.61 | 3.28 | 2.96 | 7.53 | 9.04 | 9.57 | 3.67 | 3.25 | 4.14 | ** | + | | |

TABLE 209-continued

| | | | | | | | | | | | | | |
|---|---|---|---|---|---|---|---|---|---|---|---|---|---|
| MAMMA1000988 | 6.9 | 4.02 | 3.13 | 9.98 | 9.41 | 10.85 | 6.42 | 4.87 | 6.36 | * | + | | |
| MAMMA1000994 | 3.37 | 2.44 | 3.14 | 3.15 | 4.33 | 4.9 | 3.61 | 4.21 | 3.97 | | | * | + |
| MAMMA1000998 | 3.52 | 2.26 | 2.81 | 4.12 | 6.42 | 7.42 | 3.48 | 4.56 | 3.6 | * | + | | |
| MAMMA1001003 | 1.84 | 1.4 | 1.47 | 5.67 | 6.98 | 6.89 | 2.14 | 3.71 | 2.23 | ** | + | | |
| MAMMA1001007 | 0.12 | 0.01 | 0.3 | 0.22 | 0.03 | 0.58 | 0.25 | 0.21 | 0.73 | | | | |
| MAMMA1001008 | 6.4 | 6.37 | 4.3 | 6.99 | 5.97 | 6.01 | 5.02 | 5.89 | 7.81 | | | | |
| MAMMA1001013 | 6.8 | 3.38 | 4.83 | 15.25 | 11.23 | 8.98 | 5.96 | 5.39 | 9.13 | * | + | | |
| MAMMA1001014 | 7.76 | 3.67 | 2.44 | 4.42 | 6.29 | 6.7 | 2.43 | 2.82 | 2.35 | | | | |
| MAMMA1001021 | 7.09 | 2.52 | 2.8 | 7.68 | 6.46 | 6.9 | 4.64 | 3.79 | 3.74 | | | | |
| MAMMA1001024 | 8.72 | 3.44 | 3.61 | 8.02 | 10.11 | 9.19 | 4.3 | 6.16 | 5.88 | | | | |
| MAMMA1001025 | 1.98 | 1.65 | 0.42 | 0.75 | 1.1 | 1.07 | 0.62 | 0.65 | 0.73 | | | | |
| MAMMA1001028 | 3.61 | 3.77 | 2.41 | 1.41 | 2.09 | 2.3 | 1.65 | 2.01 | 1.32 | | | * | − |
| MAMMA1001030 | 3.45 | 1.67 | 2.14 | 3.47 | 2.37 | 4.44 | 2.07 | 2.57 | 2.47 | | | | |
| MAMMA1001035 | 13.14 | 8.77 | 7.89 | 19 | 23.71 | 18.79 | 11.21 | 8.37 | 14.57 | ** | + | | |
| MAMMA1001036 | 11.51 | 6.94 | 5.48 | 11.14 | 14.27 | 13.18 | 7.47 | 5.06 | 7.52 | | | | |

TABLE 210

| | | | | | | | | | | | | | |
|---|---|---|---|---|---|---|---|---|---|---|---|---|---|
| MAMMA1001037 | 9.85 | 4.28 | 3.71 | 10.53 | 13.73 | 9.2 | 7.98 | 5.87 | 7.42 | | | | |
| MAMMA1001038 | 3.03 | 1.45 | 2.07 | 4.49 | 7.26 | 6.95 | 4.49 | 3.88 | 6.41 | * | + | * | + |
| MAMMA1001041 | 6.12 | 4.31 | 3.78 | 4.26 | 5.32 | 5.37 | 5.37 | 4.53 | 3.75 | | | | |
| MAMMA1001043 | 9.46 | 4.63 | 3.66 | 5.68 | 7.75 | 7.15 | 4.92 | 3.72 | 4.88 | | | | |
| MAMMA1001050 | 6.35 | 5.89 | 3.9 | 5.29 | 10.15 | 10.16 | 5.02 | 6.56 | 5.49 | | | | |
| MAMMA1001054 | 5.51 | 4.13 | 3 | 8.5 | 8.45 | 8.15 | 5.21 | 3.63 | 4.46 | ** | + | | |
| MAMMA1001059 | 15.39 | 8.08 | 6.23 | 9.1 | 11.74 | 11.86 | 8.44 | 7.77 | 9.49 | | | | |
| MAMMA1001066 | 16.43 | 8.7 | 9.35 | 16.38 | 15.95 | 15.31 | 10.1 | 8.21 | 12.62 | | | | |
| MAMMA1001067 | 3.67 | 2.44 | 1.56 | 5.04 | 5.4 | 5.91 | 3.35 | 3.05 | 4.31 | * | + | | |
| MAMMA1001072 | 11.88 | 5.32 | 6.63 | 6.72 | 4.61 | 6.46 | 5.54 | 4.86 | 5.86 | | | | |
| MAMMA1001073 | 5.21 | 2.94 | 1.75 | 2.04 | 3.72 | 2.45 | 1.94 | 3.03 | 2.39 | | | | |
| MAMMA1001074 | 3.99 | 4.38 | 2.27 | 4.13 | 9.96 | 13.79 | 3.27 | 3.81 | 5.24 | | | | |
| MAMMA1001075 | 5.54 | 2.96 | 3.2 | 3.06 | 7.9 | 7.5 | 2.62 | 3.18 | 3.18 | | | | |
| MAMMA1001078 | 7.94 | 4.65 | 4.05 | 9.11 | 13.65 | 11.41 | 7.34 | 5.68 | 7.64 | * | + | | |
| MAMMA1001080 | 22.36 | 9.18 | 10.44 | 11.87 | 12.56 | 12.61 | 9.96 | 10.5 | 13.83 | | | | |
| MAMMA1001082 | 4.52 | 3.3 | 1.66 | 3.03 | 5.82 | 3.36 | 3.3 | 2.6 | 2.45 | | | | |
| MAMMA1001091 | 0.73 | 0.99 | 0.34 | 1.07 | 1.55 | 1.04 | 1.3 | 1.37 | 1.5 | | | * | + |
| MAMMA1001092 | 3.38 | 1.71 | 1.14 | 4.68 | 5.06 | 3.84 | 2.72 | 2.57 | 3.2 | * | + | | |
| MAMMA1001094 | 23.07 | 10.75 | 8.74 | 19.47 | 15.51 | 11.95 | 11.1 | 12.09 | 9.06 | | | | |
| MAMMA1001105 | 8.97 | 7.82 | 3.9 | 7.84 | 13.25 | 10.97 | 5.27 | 6.89 | 7.2 | | | | |
| MAMMA1001110 | 1.34 | 0.28 | 1.07 | 0.83 | 1.4 | 1.91 | 0.64 | 1.83 | 0.87 | | | | |
| MAMMA1001126 | 11.76 | 5.19 | 6.22 | 18.27 | 20.42 | 20.62 | 10.8 | 7.93 | 10.63 | ** | + | | |
| MAMMA1001133 | 13.96 | 7.98 | 6.29 | 17.52 | 21.82 | 18.6 | 12.41 | 9.09 | 11.57 | * | + | | |
| MAMMA1001139 | 16 | 10.86 | 8 | 75.48 | 52.51 | 90.41 | 4.72 | 2.94 | 4.09 | ** | + | * | − |
| MAMMA1001141 | 3.54 | 2.73 | 2.73 | 3.35 | 3.24 | 4.02 | 3.37 | 4.28 | 4.25 | | | | |
| MAMMA1001143 | 9.1 | 5.11 | 2.81 | 6.09 | 8.1 | 8.79 | 3.94 | 3.97 | 7.09 | | | | |
| MAMMA1001145 | 8.33 | 4.95 | 3.62 | 3.46 | 6.81 | 6.75 | 3.46 | 5.11 | 7.05 | | | | |
| MAMMA1001150 | 8.4 | 3.25 | 2.79 | 2.57 | 3.1 | 4.61 | 3.41 | 4.01 | 4.33 | | | | |
| MAMMA1001154 | 10.09 | 4.99 | 5.59 | 11.85 | 11.71 | 18.3 | 6.93 | 7.19 | 6.3 | | | | |
| MAMMA1001159 | 9.34 | 6.32 | 4.92 | 5.06 | 4.86 | 4.07 | 3.31 | 2.7 | 4.01 | | | | |
| MAMMA1001161 | 14.59 | 7.23 | 8.28 | 17.47 | 24.12 | 19.35 | 11.34 | 7.11 | 8.84 | * | + | | |
| MAMMA1001162 | 8.3 | 3.74 | 4.22 | 6.24 | 6.6 | 5.21 | 4.88 | 5.43 | 5.84 | | | | |
| MAMMA1001181 | 5.83 | 2.22 | 1.87 | 4.38 | 4.79 | 3.53 | 3.65 | 3.3 | 3.3 | | | | |
| MAMMA1001186 | 7.43 | 2.73 | 2.8 | 9.55 | 11.46 | 10.04 | 5.94 | 5.12 | 6.23 | * | + | | |
| MAMMA1001189 | 5.2 | 2.45 | 3.28 | 2.21 | 6.23 | 8.54 | 2.7 | 3.48 | 4.97 | | | | |
| MAMMA1001191 | 7.35 | 3.89 | 3.31 | 3.72 | 5.24 | 6.78 | 3.27 | 4.86 | 5.76 | | | | |
| MAMMA1001198 | 420.1 | 187.9 | 245.8 | 305.4 | 416.1 | 499.3 | 169.9 | 159.8 | 188.3 | | | | |
| MAMMA1001202 | 22.54 | 12.72 | 10.05 | 25.35 | 28.4 | 25.81 | 14.74 | 13.68 | 16.11 | * | + | | |
| MAMMA1001203 | 10.49 | 4.64 | 4.15 | 9.25 | 14.44 | 10.45 | 6.11 | 7.56 | 8.28 | | | | |
| MAMMA1001206 | 4.15 | 2.67 | 2.33 | 5.52 | 7.44 | 5.57 | 3.53 | 2.86 | 3.88 | * | + | | |
| MAMMA1001208 | 6.57 | 2.81 | 3.7 | 5.42 | 5.59 | 5.39 | 4.2 | 3.8 | 4.35 | | | | |
| MAMMA1001215 | 10.79 | 5.58 | 5.27 | 10.75 | 14.22 | 15.01 | 5.67 | 7.42 | 7.48 | | | | |
| MAMMA1001220 | 9.93 | 5.68 | 4.3 | 14.65 | 18.62 | 17.06 | 7.53 | 7.5 | 9.1 | ** | + | | |
| MAMMA1001222 | 1.59 | 0.92 | 0.2 | 0.96 | 1.98 | 1.96 | −0.04 | 1.13 | 0.9 | | | | |
| MAMMA1001223 | 4.89 | 1.72 | 1.83 | 2.87 | 4.51 | 4.18 | 2.3 | 4.01 | 2.37 | | | | |
| MAMMA1001232 | 8.78 | 2.9 | 3.18 | 7.54 | 10.45 | 9.18 | 4.93 | 4.96 | 6.51 | | | | |
| MAMMA1001234 | 7.4 | 4.59 | 2.41 | 6.32 | 6.84 | 8.88 | 3.78 | 3.73 | 6 | | | | |
| MAMMA1001237 | 2.49 | 1.76 | 1.72 | 1.22 | 2.15 | 2.66 | 1.99 | 1.8 | 2.56 | | | | |
| MAMMA1001243 | 2.36 | 1.9 | 1.62 | 4.41 | 7.15 | 5.33 | 4.22 | 3.46 | 4.95 | * | + | ** | + |
| MAMMA1001244 | 2.4 | 1.42 | 0.68 | 1.53 | 3.03 | 2.44 | 2.05 | 2.71 | 3.6 | | | | |
| MAMMA1001249 | 5.06 | 0.96 | 1.74 | 3.77 | 9.25 | 4.93 | 2.44 | 3.57 | 4.08 | | | | |
| MAMMA1001256 | 2.41 | 7.77 | 2.44 | 2.13 | 6.99 | 6.49 | 2.44 | 2.38 | 3.83 | | | | |
| MAMMA1001259 | 5.56 | 2.92 | 3.02 | 4.36 | 6.71 | 5.33 | 2.23 | 3.39 | 5.03 | | | | |
| MAMMA1001260 | 13.79 | 6.11 | 6.31 | 13.52 | 13.26 | 12.23 | 7.61 | 6.68 | 10.66 | | | | |
| MAMMA1001262 | 9.64 | 6.71 | 5.97 | 8.72 | 6.36 | 5.96 | 5.41 | 6.02 | 8.33 | | | | |
| MAMMA1001268 | 4.72 | 2.75 | 3.01 | 9.39 | 6.71 | 7.53 | 3.74 | 4.95 | 5.14 | * | + | | |

TABLE 211

| | | | | | | | | | | | | | |
|---|---|---|---|---|---|---|---|---|---|---|---|---|---|
| MAMMA1001271 | 18.48 | 7.38 | 8.91 | 10.48 | 14.14 | 10.31 | 9.58 | 8.4 | 12.04 | | | | |
| MAMMA1001274 | 4.43 | 3.8 | 2.81 | 4.94 | 7.96 | 7.95 | 4.24 | 5.07 | 5.33 | * | + | | |
| MAMMA1001280 | 1.75 | 0.68 | 1.07 | 1.62 | 2.08 | 1.61 | 1.59 | 2.67 | 1.12 | | | | |
| MAMMA1001283 | 7.51 | 3.83 | 5.22 | 4.97 | 9.33 | 8.85 | 4.6 | 3.72 | 6.27 | | | | |
| MAMMA1001284 | 9.53 | 6.17 | 5.52 | 8.14 | 10.72 | 8.86 | 5.52 | 7.53 | 9.35 | | | | |
| MAMMA1001286 | 24.45 | 16.7 | 10.97 | 12.09 | 12.45 | 13 | 5.97 | 6.39 | 7.92 | | | | |
| MAMMA1001289 | 8.47 | 4.9 | 3.19 | 5.53 | 5.66 | 7.55 | 4.68 | 4.32 | 5.33 | | | | |
| MAMMA1001292 | 6.67 | 3.9 | 2.86 | 4.2 | 6.48 | 5.22 | 3.23 | 4.27 | 4.41 | | | | |
| MAMMA1001296 | 7 | 4.06 | 4.91 | 10.25 | 16.18 | 16.77 | 6.43 | 5.53 | 5.34 | * | + | | |
| MAMMA1001298 | 4.11 | 3.91 | 3.07 | 8.57 | 9.18 | 8.84 | 4.16 | 3.98 | 4.76 | ** | + | | |
| MAMMA1001305 | 5.35 | 2.58 | 3.48 | 7.15 | 5.55 | 7.22 | 4.85 | 4.29 | 6.18 | * | + | | |
| MAMMA1001309 | 1.7 | 1.52 | 0.97 | 5.04 | 3.61 | 5.38 | 2.09 | 2.69 | 2.33 | ** | + | * | + |
| MAMMA1001310 | 10.44 | 4.9 | 7.15 | 8.11 | 11.15 | 12.2 | 4.69 | 5.11 | 6.27 | | | | |
| MAMMA1001322 | 2.58 | 0.43 | 0.4 | 1.79 | 2.43 | 1.77 | 1.08 | 1.1 | 1.59 | | | | |
| MAMMA1001324 | 4.35 | 2.2 | 1.73 | 3.98 | 4.2 | 3.7 | 1.97 | 2.42 | 3.42 | | | | |
| MAMMA1001330 | 13.9 | 7.33 | 5.29 | 11.99 | 11.29 | 12.32 | 6.89 | 5.13 | 7.87 | | | | |
| MAMMA1001333 | 10.64 | 5.27 | 5.22 | 12.45 | 17.04 | 13.72 | 7.27 | 8.49 | 8.86 | * | + | | |
| MAMMA1001334 | 19.83 | 12.61 | 11.33 | 16.84 | 18.12 | 18.43 | 11.85 | 9.39 | 18.95 | | | | |
| MAMMA1001337 | 6.8 | 2.68 | 3.43 | 4.92 | 5.69 | 6.15 | 4.3 | 5.31 | 5.13 | | | | |
| MAMMA1001341 | 3.94 | 2.12 | 2.51 | 4.82 | 3.58 | 4.32 | 2.93 | 4.08 | 4.66 | | | | |
| MAMMA1001343 | 4.64 | 4.02 | 3.95 | 10.45 | 11.27 | 11.13 | 3.36 | 5.55 | 6.66 | ** | + | | |
| MAMMA1001344 | 3.2 | 1.52 | 0.8 | 2.99 | 5.13 | 4.05 | 4.81 | 3.84 | 5.02 | | | * | + |
| MAMMA1001346 | 3.61 | 1.95 | 1.75 | 2.88 | 2.78 | 3.94 | 2.71 | 2.77 | 4.61 | | | | |
| MAMMA1001383 | 13.98 | 5.18 | 5.89 | 17.88 | 22.89 | 19.58 | 10.5 | 8.81 | 9.31 | * | + | | |
| MAMMA1001388 | 6.8 | 2.8 | 3.94 | 7.53 | 10.07 | 7.51 | 5.93 | 5.82 | 6.51 | | | | |
| MAMMA1001396 | 11.03 | 6.21 | 4.6 | 12.55 | 13.22 | 12.6 | 7.14 | 6.44 | 7.15 | * | + | | |
| MAMMA1001397 | 8.15 | 4.45 | 6.77 | 11.06 | 10.6 | 9.93 | 5.76 | 7.2 | 5.97 | * | + | | |
| MAMMA1001401 | 12.38 | 7.29 | 6.74 | 14.61 | 13.5 | 16.44 | 10.3 | 14.7 | 12.59 | * | + | | |
| MAMMA1001408 | 3.01 | 1.06 | 1.25 | 3.39 | 2.85 | 2.94 | 2.29 | 2.63 | 3.03 | | | | |
| MAMMA1001411 | 13.87 | 6.35 | 6.18 | 6.44 | 8.45 | 4.19 | 7.07 | 7.42 | 10.12 | | | | |
| MAMMA1001414 | 8.9 | 4.02 | 3.1 | 8.97 | 5.29 | 6.61 | 6.05 | 4.52 | 6.79 | | | | |
| MAMMA1001415 | 10.6 | 3.71 | 5.04 | 5.41 | 5.06 | 7.32 | 4.77 | 5.68 | 6.24 | | | | |
| MAMMA1001418 | 5.7 | 2.73 | 2.09 | 6.08 | 5.21 | 5.62 | 4.02 | 2.75 | 3.87 | | | | |
| MAMMA1001419 | 4.73 | 2.65 | 2.23 | 4.77 | 8 | 8.11 | 4.53 | 3.83 | 4.07 | * | + | | |
| MAMMA1001420 | 3.1 | 2.15 | 1.27 | 3.76 | 5.4 | 5.17 | 2.79 | 4.4 | 3.79 | * | + | | |
| MAMMA1001426 | 18.02 | 14.05 | 10.52 | 23.03 | 29.5 | 27.85 | 14.93 | 16.81 | 15.67 | * | + | | |
| MAMMA1001428 | 19.49 | 9.42 | 10.79 | 23.13 | 21.75 | 19.76 | 15.67 | 13.18 | 13.4 | | | | |
| MAMMA1001432 | 11.31 | 4.42 | 3.74 | 13.45 | 13.13 | 13.68 | 6.17 | 5.31 | 10.64 | * | + | | |
| MAMMA1001435 | 5.17 | 2.46 | 1.9 | 6.79 | 5.64 | 6.54 | 4.02 | 2.35 | 4.67 | * | + | | |
| MAMMA1001442 | 5.06 | 2.93 | 3.93 | 6.1 | 7.84 | 8.67 | 6.15 | 4.58 | 6.02 | * | + | | |
| MAMMA1001446 | 12.46 | 5.86 | 4.49 | 8.24 | 8.89 | 13.91 | 4.69 | 4.66 | 5.57 | | | | |
| MAMMA1001450 | 4.63 | 2.5 | 2.67 | 4.93 | 4 | 5.12 | 3.59 | 2.97 | 3.49 | | | | |
| MAMMA1001452 | 6.13 | 3.91 | 3.22 | 5.79 | 9.5 | 8.17 | 5.22 | 5.47 | 4.79 | | | | |
| MAMMA1001465 | 26.46 | 18.98 | 20.83 | 12.75 | 32.75 | 41.93 | 22.64 | 25.99 | 25.3 | | | | |
| MAMMA1001476 | 5.04 | 2.17 | 1.67 | 4.15 | 3.25 | 3.38 | 3.37 | 3.42 | 3.65 | | | | |
| MAMMA1001478 | 8.65 | 3.83 | 3.78 | 10.05 | 11.02 | 9.81 | 4.96 | 6.35 | 7.03 | * | + | | |
| MAMMA1001479 | 12.55 | 5.38 | 4.01 | 10.03 | 11.12 | 10.85 | 9.53 | 8.55 | 11.85 | | | | |
| MAMMA1001487 | 3.39 | 1.73 | 3.53 | 4.32 | 4.6 | 4.59 | 2.05 | 2.41 | 4.9 | | | | |
| MAMMA1001498 | 9.96 | 8.14 | 3.99 | 14.3 | 13.63 | 9.71 | 5.08 | 12.98 | 6.54 | | | | |
| MAMMA1001501 | 10.61 | 5.97 | 4.92 | 6.54 | 6.18 | 6.58 | 4.88 | 5.96 | 6.07 | | | | |
| MAMMA1001502 | 8.18 | 4.06 | 3.9 | 5.74 | 5.38 | 7.37 | 5.92 | 4.78 | 5.08 | | | | |
| MAMMA1001510 | 2.96 | 0.75 | 0.46 | 1.67 | 1.4 | 1.25 | 0.55 | 1.62 | 1.38 | | | | |
| MAMMA1001522 | 5.03 | 2.4 | 1.29 | 4.2 | 3.19 | 3.32 | 3.17 | 2.13 | 2.87 | | | | |
| MAMMA1001529 | 6.71 | 2.99 | 3.35 | 4.53 | 4.35 | 5.16 | 2.95 | 3.56 | 4.27 | | | | |
| MAMMA1001532 | 9.52 | 5.54 | 4.9 | 8.06 | 8.4 | 11.77 | 6.31 | 5.77 | 5.73 | | | | |
| MAMMA1001533 | 5.96 | 3.56 | 2.76 | 3.85 | 3.07 | 5.41 | 3.42 | 3.85 | 4.91 | | | | |

TABLE 212

| | | | | | | | | | |
|---|---|---|---|---|---|---|---|---|---|
| MAMMA1001534 | 1.04 | 1 | 0.48 | 0.51 | 0.82 | 0.82 | 0.58 | 0.71 | 1.3 |
| MAMMA1001535 | 4.92 | 2.88 | 1.16 | 1.88 | 3.67 | 4.55 | 1.49 | 2.38 | 2.87 |
| MAMMA1001547 | 6.61 | 3.6 | 2.98 | 6.07 | 6.82 | 8.95 | 4.29 | 5.11 | 5.04 |
| MAMMA1001551 | 6.07 | 3.86 | 3.57 | 4.63 | 5.65 | 6.3 | 4.24 | 3.97 | 4.09 |
| MAMMA1001569 | 3.5 | 1.48 | 2.2 | 2.86 | 2.79 | 2.47 | 2.33 | 2.98 | 1.96 |
| MAMMA1001575 | 8.12 | 4.85 | 4.3 | 5.13 | 5.29 | 4 | 4.97 | 4.91 | 5.14 |
| MAMMA1001576 | 20.26 | 7.19 | 9.68 | 8.21 | 9.38 | 6.87 | 9.09 | 8.98 | 9.31 |
| MAMMA1001584 | 4.62 | 2.36 | 1.31 | 4.08 | 5.15 | 3.32 | 1.55 | 1.67 | 4.4 |
| MAMMA1001586 | 1.88 | 3.47 | 0.76 | 1.07 | 3.5 | 1.99 | 1.25 | 2.13 | 3.7 |
| MAMMA1001590 | 12.7 | 4.74 | 4.76 | 9.14 | 12.67 | 13.3 | 5.6 | 5.77 | 7.89 |
| MAMMA1001599 | 4.33 | 1.21 | 1.88 | 2.45 | 2.99 | 4.36 | 2.56 | 2.76 | 2.04 |
| MAMMA1001600 | 5.33 | 1.77 | 2.89 | 2.89 | 5.09 | 5.36 | 2.48 | 3.86 | 2.92 |
| MAMMA1001604 | 7.87 | 5.11 | 1.45 | 4.32 | 5.42 | 5.07 | 3.4 | 3.25 | 5.07 |
| MAMMA1001606 | 9.46 | 4.93 | 4.75 | 9.09 | 8.64 | 10.49 | 4.91 | 6.03 | 6.85 |
| MAMMA1001609 | 2.95 | 1.2 | 1.3 | 2.12 | 2.38 | 3.64 | 2.68 | 2.56 | 2.15 |
| MAMMA1001614 | 4.39 | 2.53 | 1.88 | 2.49 | 3.22 | 3.59 | 2.48 | 3.41 | 3.61 |
| MAMMA1001615 | 6.67 | 1.9 | 1.82 | 2.35 | 2.21 | 3.65 | 2.11 | 2.71 | 3.83 |

TABLE 212-continued

| | | | | | | | | | | | |
|---|---|---|---|---|---|---|---|---|---|---|---|
| MAMMA1001619 | 19.31 | 10.08 | 12.63 | 10.87 | 10.6 | 14.3 | 14.55 | 8.6 | 14.72 | | |
| MAMMA1001620 | 8.92 | 3.44 | 4.44 | 6.63 | 10.03 | 12.83 | 4.85 | 6.18 | 5.9 | | |
| MAMMA1001623 | 3.58 | 4.58 | 2.08 | 1.56 | 2.91 | 2.34 | 1.28 | 2.13 | 2.52 | | |
| MAMMA1001626 | 2.57 | 1.13 | 1.2 | 1.48 | 2.12 | 1.89 | 1.75 | 2.77 | 3.1 | | |
| MAMMA1001627 | 2.24 | 1.39 | 0.54 | 2.13 | 3.22 | 2.88 | 2.13 | 2.52 | 2.05 | | |
| MAMMA1001630 | 3.02 | 5.98 | 2.09 | 4.38 | 4.01 | 5.45 | 2.54 | 3.3 | 3.8 | | |
| MAMMA1001633 | 6.31 | 4.02 | 1.66 | 8.75 | 9.37 | 5.34 | 5.49 | 3.61 | 5.08 | | |
| MAMMA1001634 | 8.31 | 4.18 | 4.46 | 11.22 | 16.21 | 13.47 | 7.21 | 6.09 | 6.17 | * | + |
| MAMMA1001635 | 8.83 | 4.02 | 2.32 | 12.04 | 8.31 | 8.32 | 5.06 | 3.5 | 2.52 | | |
| MAMMA1001649 | 4.06 | 1.62 | 1.65 | 3.2 | 3.67 | 3.34 | 1.61 | 2.68 | 2.21 | | |
| MAMMA1001654 | 7.5 | 5.7 | 4.13 | 5.16 | 7.53 | 6.42 | 3.33 | 5.51 | 3.69 | | |
| MAMMA1001660 | 28.42 | 20.01 | 15.26 | 32.5 | 33.59 | 28.79 | 16.52 | 14.53 | 17.32 | | |
| MAMMA1001663 | 16.19 | 8.13 | 7.37 | 24.06 | 22.04 | 19.25 | 11.83 | 9.81 | 14.91 | * | + |
| MAMMA1001670 | 6.04 | 4.74 | 3.32 | 6.72 | 7.02 | 6.98 | 4.35 | 4.11 | 5.69 | * | + |
| MAMMA1001671 | 3.01 | 0.89 | 1.27 | 2.72 | 3.99 | 2.13 | 1.77 | 2.54 | 1.32 | | |
| MAMMA1001679 | 4.8 | 3.29 | 3 | 3.03 | 4.77 | 2.84 | 4.71 | 2.51 | 4.64 | | |
| MAMMA1001683 | 6.21 | 3.81 | 4.22 | 11.62 | 10.92 | 14.02 | 7.47 | 6.25 | 5.71 | ** | + |
| MAMMA1001686 | 1.2 | 1.06 | 0.86 | 1.34 | 1.65 | 3.46 | 1.07 | 2.23 | 3.61 | | |
| MAMMA1001688 | 27.08 | 14.53 | 17.18 | 23.31 | 26.84 | 30.3 | 37.53 | 34.87 | 43.95 | * | + |
| MAMMA1001689 | 10.7 | 4.3 | 2.46 | 5.85 | 12.72 | 6.26 | 3.96 | 2.83 | 5.24 | | |
| MAMMA1001692 | 5.97 | 3.39 | 4.03 | 11.66 | 13.26 | 13.23 | 4.66 | 4.11 | 3.69 | ** | + |
| MAMMA1001711 | 7.12 | 3.2 | 3.17 | 7.6 | 8.99 | 7.95 | 4.59 | 5.62 | 7.5 | | |
| MAMMA1001715 | 5.07 | 1.86 | 2.28 | 7.77 | 5.67 | 4.34 | 3.14 | 3.85 | 3.95 | | |
| MAMMA1001730 | 5.56 | 2.96 | 1.32 | 1.82 | 2.04 | 2.43 | 2.03 | 3.01 | 2.56 | | |
| MAMMA1001735 | 17.93 | 11.2 | 11.92 | 16.49 | 13.17 | 19.36 | 14.97 | 10.91 | 15.84 | | |
| MAMMA1001740 | 2.62 | 1.39 | 2.19 | 3.94 | 5.07 | 3.81 | 2.69 | 2.45 | 2.08 | * | + |
| MAMMA1001743 | 63.77 | 35.5 | 45.41 | 34.01 | 34.01 | 44 | 19.91 | 22.06 | 23.3 | * | − |
| MAMMA1001744 | 1.18 | 0.45 | 0.11 | 1.34 | 1.3 | 0.81 | 0.46 | 0.4 | 0.67 | | |
| MAMMA1001745 | 12.45 | 7.1 | 4.31 | 14.99 | 16.74 | 16.98 | 8.77 | 5.37 | 11.73 | * | + |
| MAMMA1001751 | 5.01 | 2.42 | 3.03 | 4.8 | 5.52 | 7.04 | 3.9 | 3.22 | 3.1 | | |
| MAMMA1001752 | 15.56 | 8.33 | 10.02 | 13.09 | 14.3 | 13.11 | 10.96 | 9.67 | 11.14 | | |
| MAMMA1001754 | 5.78 | 4.59 | 3.53 | 9.06 | 6.92 | 8.14 | 9.82 | 5.67 | 8.59 | * | + |
| MAMMA1001757 | 1.64 | 0.65 | 0.62 | 1.81 | 1.16 | 1.05 | 0.91 | 2.59 | 1.38 | | |
| MAMMA1001760 | 15.19 | 8.82 | 7.01 | 15.51 | 12.28 | 21.03 | 9.85 | 11.53 | 17.24 | | |
| MAMMA1001764 | 2.52 | 1.27 | 1.35 | 2.11 | 2.1 | 2.28 | 1.29 | 2.52 | 2.02 | | |
| MAMMA1001767 | 3.67 | 2.6 | 1.45 | 4.72 | 4.48 | 6.08 | 3.4 | 1.82 | 3.79 | * | + |
| MAMMA1001768 | 3.4 | 1.95 | 1.15 | 4.85 | 4.7 | 4.24 | 2.45 | 3.01 | 3.52 | * | + |
| MAMMA1001769 | 10.2 | 4.54 | 6.07 | 16.86 | 18.38 | 16.58 | 8.55 | 6.27 | 9.46 | ** | + |
| MAMMA1001771 | 7.06 | 9.36 | 4.23 | 3.92 | 5.03 | 5.23 | 5.55 | 6.69 | 8.65 | | |

TABLE 213

| | | | | | | | | | | | |
|---|---|---|---|---|---|---|---|---|---|---|---|
| MAMMA1001773 | 6.61 | 3.09 | 3.86 | 5.22 | 5.33 | 3.63 | 5.11 | 4.68 | 6.54 | | |
| MAMMA1001778 | 4.17 | 2.72 | 2.42 | 4.48 | 7.37 | 5.12 | 3.01 | 4.78 | 4.22 | | |
| MAMMA1001783 | 6.42 | 4.36 | 3.89 | 10.62 | 14.19 | 14.31 | 4.67 | 8.23 | 6.82 | ** | + |
| MAMMA1001785 | 8.22 | 2.97 | 5.14 | 14.68 | 12.34 | 15.26 | 7.67 | 8.51 | 8.54 | ** | + |
| MAMMA1001788 | 2 | 0.87 | 0.27 | 0.81 | 1.38 | 1.73 | 1.53 | 0.58 | 0.8 | | |
| MAMMA1001790 | 5.36 | 3.86 | 1.92 | 6.66 | 16.36 | 9.58 | 3.91 | 3.27 | 3.37 | | |
| MAMMA1001800 | 3.52 | 2.19 | 1.41 | 1.85 | 4.05 | 2.73 | 1.44 | 1.76 | 1.56 | | |
| MAMMA1001804 | 6.25 | 3.82 | 2.87 | 4.53 | 3.88 | 4.64 | 4.42 | 4.04 | 3.96 | | |
| MAMMA1001806 | 3.43 | 3.08 | 1.93 | 7.24 | 8.78 | 6.25 | 3.11 | 4.51 | 5.23 | ** | + |
| MAMMA1001812 | 2.22 | 1.53 | 1.51 | 2.28 | 2.36 | 2.64 | 1.38 | 2.87 | 1.34 | | |
| MAMMA1001815 | 1.3 | 0.41 | 0.62 | 2.99 | 1.2 | 2.47 | 2.3 | 2.24 | 1.48 | * | + |
| MAMMA1001817 | 1.37 | 3.74 | 1.14 | 2.04 | 2.4 | 3.09 | 1.01 | 1.65 | 1.29 | | |
| MAMMA1001818 | 2.76 | 5.34 | 1.53 | 1.82 | 5.05 | 3.5 | 2.09 | 2.95 | 4.34 | | |
| MAMMA1001819 | 5.52 | 3.47 | 3.12 | 6.33 | 7.32 | 6.74 | 3.51 | 2.89 | 5.62 | * | + |
| MAMMA1001820 | 2.45 | 1.25 | 0.82 | 2.09 | 2.1 | 3.98 | 4.93 | 5.44 | 3.89 | ** | + |
| MAMMA1001824 | 6.23 | 3.21 | 3.26 | 6.85 | 6.39 | 6.61 | 3.99 | 4.27 | 4.97 | | |
| MAMMA1001832 | 3.67 | 1.55 | 1.58 | 4.4 | 5.34 | 6.5 | 1.89 | 2.88 | 2.54 | * | + |
| MAMMA1001836 | 7.21 | 6.9 | 2.37 | 8.79 | 8 | 7.74 | 7.22 | 5.59 | 4.27 | | |
| MAMMA1001837 | 8.71 | 5.61 | 5.12 | 7.73 | 9.45 | 10.52 | 4.01 | 4.19 | 6.46 | | |
| MAMMA1001848 | 3.49 | 1.69 | 1.44 | 2.63 | 4.08 | 4.52 | 1.91 | 2.78 | 1.99 | | |
| MAMMA1001850 | 20.05 | 8.18 | 11.43 | 18.79 | 13.27 | 17.94 | 12.58 | 9.7 | 17.74 | | |
| MAMMA1001851 | 6.25 | 2.81 | 2.47 | 7.34 | 6.62 | 10.7 | 4.31 | 3.59 | 5.68 | | |
| MAMMA1001852 | 7.89 | 5.2 | 4.18 | 14.68 | 10.33 | 12.24 | 6.74 | 5.9 | 7.65 | * | + |
| MAMMA1001854 | 8.11 | 3.75 | 3.83 | 5.47 | 8.12 | 7.92 | 4.25 | 4.74 | 5.11 | | |
| MAMMA1001858 | 5.29 | 6.33 | 3.33 | 4.8 | 9.86 | 6.77 | 4.43 | 4.52 | 4.66 | | |
| MAMMA1001864 | 6.57 | 3.87 | 3.53 | 5.26 | 5.92 | 6.2 | 4.84 | 4.25 | 4.74 | | |
| MAMMA1001868 | 7.13 | 2.35 | 1.77 | 6.07 | 8.46 | 12.04 | 4.49 | 2.72 | 4.43 | | |
| MAMMA1001874 | 2.56 | 0.8 | 0.99 | 1.13 | 2.27 | 2.32 | 0.71 | 0.85 | 1.82 | | |
| MAMMA1001878 | 14.71 | 6.24 | 5.55 | 12.93 | 17.25 | 13.98 | 8.14 | 7.86 | 10.4 | | |
| MAMMA1001880 | 8.73 | 3.97 | 3.36 | 7.33 | 11.41 | 9.31 | 6.98 | 4.88 | 7.07 | | |
| MAMMA1001885 | 8.89 | 4.03 | 4.1 | 9.41 | 9.07 | 9.64 | 3.45 | 4.7 | 8.89 | | |
| MAMMA1001890 | 10.42 | 4.8 | 4.27 | 13.94 | 12.16 | 12.45 | 5.05 | 4.52 | 6.53 | * | + |
| MAMMA1001893 | 8.64 | 3.63 | 4.1 | 6.16 | 5.52 | 7.2 | 5.63 | 4.73 | 6.76 | | |
| MAMMA1001901 | 3.39 | 1.13 | 2.13 | 3.15 | 3.75 | 4.39 | 2.43 | 2.45 | 3.16 | | |

TABLE 213-continued

| | | | | | | | | | | | |
|---|---|---|---|---|---|---|---|---|---|---|---|
| MAMMA1001907 | 12.12 | 8.44 | 5.76 | 15.43 | 12.7 | 15.66 | 5.86 | 7.16 | 6.54 | * | + |
| MAMMA1001908 | 16.6 | 10.48 | 11.12 | 10.97 | 16.32 | 14.93 | 6.4 | 9.69 | 8.54 | | |
| MAMMA1001919 | 1.82 | 0.17 | 0.6 | 0.94 | 1.34 | 0.71 | 1.26 | 0.88 | 0.98 | | |
| MAMMA1001931 | 3.36 | 2.44 | 1.38 | 2.23 | 3.72 | 3.2 | 2.14 | 2.05 | 2.86 | | |
| MAMMA1001937 | 5.76 | 3.91 | 4.17 | 7.43 | 4.75 | 5.56 | 4.86 | 3.34 | 6.3 | | |
| MAMMA1001951 | 9.42 | 4.25 | 4.02 | 11.76 | 11.79 | 12.88 | 6.81 | 5.98 | 6.3 | * | + |
| MAMMA1001956 | 12.62 | 6.26 | 4.43 | 11.46 | 11.33 | 13.51 | 7.86 | 7.63 | 5 | | |
| MAMMA1001957 | 7.69 | 6.91 | 2.97 | 9.44 | 10.13 | 11 | 3.86 | 6.71 | 4.82 | * | + |
| MAMMA1001960 | 8.09 | 4.17 | 5.2 | 8.83 | 7.29 | 10.11 | 4.77 | 4.56 | 4.66 | | |
| MAMMA1001963 | 1.4 | 0.45 | 0.94 | 0.59 | 0.92 | 1.24 | 0.53 | 1.56 | 0.54 | | |
| MAMMA1001969 | 14.58 | 7.72 | 8.73 | 21.99 | 28.29 | 25.27 | 9.69 | 8.49 | 9.83 | ** | + |
| MAMMA1001970 | 13.52 | 3.54 | 5.52 | 13.53 | 17.34 | 15.88 | 8.28 | 8.88 | 8.45 | | |
| MAMMA1001978 | 1.45 | 1.06 | 0.2 | 0.2 | 0.85 | 0.8 | 1.52 | 1.12 | 0.55 | | |
| MAMMA1001992 | 10.84 | 5.7 | 4.65 | 11.47 | 10.31 | 11.31 | 7.27 | 6.07 | 8.17 | | |
| MAMMA1001994 | 10 | 5.97 | 3.81 | 5.9 | 10.24 | 11.51 | 7.66 | 6.84 | 4.2 | | |
| MAMMA1002008 | 4.32 | 3.45 | 1.54 | 2.22 | 2.63 | 3.21 | 2.43 | 4.92 | 3.14 | | |
| MAMMA1002009 | 6.14 | 4.06 | 3.61 | 6.87 | 8.92 | 11.78 | 3.75 | 4.94 | 3.85 | * | + |
| MAMMA1002011 | 7.71 | 3.01 | 4.35 | 2.88 | 2.54 | 4.06 | 2.17 | 2.53 | 2.34 | | |
| MAMMA1002022 | 5.37 | 5.17 | 1.74 | 4.7 | 10.07 | 6.42 | 3.41 | 3.09 | 3.25 | | |
| MAMMA1002024 | 16.93 | 11.72 | 9.52 | 17.19 | 15.15 | 15.52 | 13.59 | 12.95 | 15.19 | | |
| MAMMA1002032 | 11.99 | 7.54 | 5.7 | 14.48 | 16.59 | 16.42 | 8.97 | 9.05 | 9.69 | * | + |
| MAMMA1002033 | 7.72 | 10.65 | 3.5 | 9.82 | 12.49 | 7.85 | 5.26 | 4.36 | 7.58 | | |

TABLE 214

| | | | | | | | | | | | |
|---|---|---|---|---|---|---|---|---|---|---|---|
| MAMMA1002041 | 2.83 | 1.69 | 0.23 | 3.14 | 3.37 | 3.59 | 1.39 | 2.49 | 3.1 | | |
| MAMMA1002042 | 5.88 | 3.59 | 2.24 | 4.97 | 5.99 | 7.54 | 2.94 | 3.98 | 4.72 | | |
| MAMMA1002045 | 2.41 | 1.74 | 1.47 | 5.35 | 8.87 | 6.75 | 3 | 4.53 | 2.32 | ** | + |
| MAMMA1002047 | 5.33 | 2.17 | 2.02 | 3.83 | 6.17 | 6.04 | 1.68 | 3.55 | 2.24 | | |
| MAMMA1002056 | 12.39 | 6.58 | 4.37 | 20.56 | 18.36 | 19.17 | 8.24 | 9.27 | 8.66 | ** | + |
| MAMMA1002058 | 6.27 | 2.84 | 3.39 | 8 | 8.2 | 9.71 | 5.08 | 4.13 | 6.51 | * | + |
| MAMMA1002060 | 1.5 | 3.41 | 0.94 | 1.36 | 1.83 | 1.14 | 1.54 | 1.23 | 1.52 | | |
| MAMMA1002065 | 9.08 | 4.91 | 4.66 | 8.35 | 11.05 | 9.12 | 3.27 | 5.48 | 5.84 | | |
| MAMMA1002068 | 6.34 | 2.81 | 1.47 | 4.59 | 6.64 | 9.1 | 3.39 | 3.22 | 5.73 | | |
| MAMMA1002070 | 4.29 | 2.1 | 1.76 | 2.92 | 4.72 | 3.16 | 2.15 | 3.57 | 3.06 | | |
| MAMMA1002078 | 5.04 | 2.14 | 3.64 | 3.66 | 4.1 | 4.18 | 2.08 | 3.2 | 5.45 | | |
| MAMMA1002080 | 6.83 | 3.54 | 2.1 | 2.95 | 4.44 | 2.95 | 2.06 | 5.27 | 3.19 | | |
| MAMMA1002082 | 8.06 | 4.39 | 2.39 | 7.44 | 9 | 7.6 | 3.58 | 5.19 | 3.55 | | |
| MAMMA1002084 | 5.52 | 4.28 | 3.59 | 5.1 | 6.35 | 5.81 | 3.08 | 4.41 | 3.89 | | |
| MAMMA1002087 | 2.38 | 2.18 | 1.81 | 1.76 | 3.43 | 2.93 | 2.59 | 2.65 | 3.27 | | |
| MAMMA1002091 | 5.42 | 7.29 | 2.65 | 4 | 6.91 | 4.49 | 4.2 | 3.64 | 5.26 | | |
| MAMMA1002093 | 1.93 | 2 | 0.58 | 5.96 | 1.9 | 2.8 | 1.65 | 1.71 | 2.83 | | |
| MAMMA1002095 | 5.4 | 2.74 | 3.59 | 3.25 | 4.43 | 4.61 | 2.69 | 3.88 | 4.12 | | |
| MAMMA1002108 | 5.49 | 3.13 | 2.43 | 2.96 | 4.71 | 4.19 | 2.48 | 1.84 | 3.62 | | |
| MAMMA1002112 | 2.09 | 1.02 | 0.93 | 2.26 | 2.09 | 1.19 | 0.86 | 2.05 | 1.87 | | |
| MAMMA1002118 | 4.48 | 1.67 | 0.26 | 1.23 | 3.74 | 1.59 | 0.63 | 2.22 | 1.71 | | |
| MAMMA1002119 | 8.58 | 4.34 | 2.71 | 5.72 | 6.62 | 5.85 | 3.59 | 5.08 | 6.24 | | |
| MAMMA1002125 | 9.57 | 5.01 | 5.66 | 13.06 | 12.09 | 12.55 | 6.22 | 5.68 | 8.12 | * | + |
| MAMMA1002126 | 13.46 | 5.9 | 6.29 | 18.17 | 24.01 | 20.42 | 8.52 | 7.83 | 10.14 | * | + |
| MAMMA1002128 | 5.36 | 2.96 | 2.77 | 3.71 | 5.08 | 4.6 | 3.95 | 3.22 | 4.97 | | |
| MAMMA1002132 | 10.12 | 4.97 | 5.63 | 12.89 | 10.87 | 14.39 | 10.04 | 6.43 | 10.71 | * | + |
| MAMMA1002140 | 1.72 | 1.95 | 1.35 | 4.11 | 5.59 | 3.44 | 1.38 | 1.98 | 2.23 | * | + |
| MAMMA1002142 | 6.23 | 4.13 | 6.33 | 4.88 | 8.41 | 5.57 | 2.7 | 5.34 | 6.44 | | |
| MAMMA1002143 | 7.91 | 3.86 | 1.2 | 4 | 8.63 | 6.78 | 4.54 | 4.01 | 8.01 | | |
| MAMMA1002145 | 12.14 | 5.89 | 4.12 | 12.19 | 9.19 | 9.27 | 7.73 | 5.23 | 7.12 | | |
| MAMMA1002147 | 4.21 | 2.54 | 2.46 | 6.44 | 4.91 | 6.18 | 4.06 | 3.93 | 4.81 | * | + |
| MAMMA1002153 | 5.55 | 2.41 | 3.01 | 3.35 | 4.54 | 5.5 | 3.13 | 4.08 | 5.58 | | |
| MAMMA1002155 | 9.29 | 6.93 | 5.81 | 15.05 | 16.47 | 13.36 | 7.79 | 8.57 | 9.36 | ** | + |
| MAMMA1002156 | 0.5 | 0.43 | 0.34 | 1.18 | 0.77 | 0.53 | 0.87 | 1.99 | 2.58 | | |
| MAMMA1002158 | 3.36 | 2.26 | 1.87 | 4.83 | 4.63 | 4.78 | 2.02 | 3.6 | 3.09 | ** | + |
| MAMMA1002164 | 4.2 | 5.9 | 2.06 | 5.48 | 5 | 6.18 | 2.35 | 2.71 | 6.87 | | |
| MAMMA1002165 | 9.16 | 4.19 | 3.07 | 5.86 | 7.65 | 9.97 | 4.78 | 4.68 | 8.08 | | |
| MAMMA1002170 | 2.61 | 1.94 | 1.29 | 2.52 | 2.68 | 1.48 | 2.55 | 4.49 | 2.09 | | |
| MAMMA1002174 | 4.84 | 4.21 | 3.36 | 9.26 | 11.06 | 9.43 | 3.61 | 5.85 | 5.69 | ** | + |
| MAMMA1002175 | 3.66 | 3.08 | 1.47 | 4.24 | 3.36 | 3.13 | 3.56 | 5.23 | 4.15 | | |
| MAMMA1002180 | 9.95 | 5.24 | 8.36 | 6.25 | 12 | 9.82 | 8.31 | 11.32 | 10.45 | | |
| MAMMA1002198 | 7.77 | 3.94 | 4.6 | 11.59 | 10.97 | 8.42 | 5.79 | 8.09 | 5.83 | * | + |
| MAMMA1002205 | 6.94 | 2.43 | 4.08 | 12.68 | 10.23 | 10.6 | 4.99 | 6.19 | 5.86 | * | + |
| MAMMA1002206 | 4.97 | 3.21 | 3.83 | 3.93 | 5.39 | 5.02 | 3.15 | 4.77 | 5.02 | | |
| MAMMA1002209 | 5.93 | 1.39 | 2.1 | 5.8 | 6.14 | 5.58 | 2.65 | 3.01 | 4.62 | | |
| MAMMA1002215 | 25.36 | 13.93 | 13.82 | 17.32 | 25.36 | 18.76 | 19.04 | 14.22 | 18.26 | | |
| MAMMA1002219 | 6.6 | 5.08 | 3.39 | 6.83 | 8.53 | 7.54 | 5.44 | 5.14 | 6.2 | | |
| MAMMA1002224 | 8.1 | 9.24 | 5.62 | 14.79 | 19.7 | 17.59 | 7.17 | 10.07 | 8.16 | ** | + |
| MAMMA1002229 | 3.07 | 2.57 | 2.61 | 4.9 | 4.15 | 4.71 | 3.87 | 4.96 | 3.11 | ** | + |
| MAMMA1002230 | 5.84 | 5.63 | 4.35 | 11.67 | 10.96 | 14.46 | 5.06 | 7.28 | 7.47 | ** | + |
| MAMMA1002233 | 5.99 | 1.67 | 2.56 | 4.66 | 5.13 | 4.71 | 1.73 | 5.03 | 4.75 | | |

TABLE 214-continued

| | | | | | | | | | | | |
|---|---|---|---|---|---|---|---|---|---|---|---|
| MAMMA1002234 | 2.42 | 2.28 | 2.06 | 6.51 | 4.38 | 3.03 | 2.11 | 2.84 | 3.32 | | |
| MAMMA1002236 | 9.04 | 9.45 | 4.47 | 5.41 | 11.26 | 4.51 | 4.88 | 5.38 | 10.34 | | |
| MAMMA1002243 | 5.3 | 1.99 | 1.09 | 3.09 | 2.98 | 3.83 | 2.89 | 2.41 | 4 | | |
| MAMMA1002250 | 6.06 | 6.45 | 2.48 | 6.45 | 6.62 | 8.63 | 6.12 | 5.22 | 8.76 | | |
| MAMMA1002253 | 25.92 | 17.49 | 11.68 | 17.95 | 18.93 | 21.68 | 17.92 | 18.81 | 17.12 | | |

TABLE 215

| | | | | | | | | | | | |
|---|---|---|---|---|---|---|---|---|---|---|---|
| MAMMA1002267 | 5.13 | 1.56 | 2.1 | 4.1 | 8 | 6.58 | 5.59 | 7.23 | 7.33 | * | + |
| MAMMA1002268 | 4.34 | 3.93 | 2.18 | 3.97 | 3.15 | 4.33 | 1.93 | 3.77 | 3.06 | | |
| MAMMA1002269 | 3.53 | 2.77 | 0.37 | 2.27 | 1.57 | 2.25 | 1.64 | 1.13 | 1.9 | | |
| MAMMA1002282 | 3.17 | 4.02 | 1.28 | 2.38 | 4.52 | 4.47 | 2.52 | 2.77 | 2.84 | | |
| MAMMA1002292 | 8 | 3.86 | 4.57 | 6.11 | 4.23 | 6.12 | 4.47 | 3.55 | 4.28 | | |
| MAMMA1002293 | 13.94 | 6.19 | 6.42 | 18.8 | 17.8 | 21.12 | 10.21 | 8.07 | 15.59 | * | + |
| MAMMA1002294 | 6.97 | 4.11 | 3.04 | 6.45 | 7.32 | 6.27 | 5.03 | 5.25 | 5.73 | | |
| MAMMA1002297 | 5.17 | 2.14 | 2.44 | 5.18 | 5.03 | 6.05 | 4.2 | 2.91 | 4.33 | | |
| MAMMA1002298 | 5.95 | 2.63 | 2 | 5.32 | 4.87 | 5.66 | 3.33 | 3.41 | 4.16 | | |
| MAMMA1002299 | 3.71 | 2.19 | 2.17 | 3.02 | 3.23 | 3.18 | 3.21 | 2.61 | 2.25 | | |
| MAMMA1002308 | 4.09 | 3.82 | 1.96 | 6.63 | 7.73 | 3.7 | 2.44 | 2.99 | 3.59 | | |
| MAMMA1002310 | 24.32 | 15.32 | 19.7 | 26.21 | 29.99 | 31.31 | 20.38 | 19.58 | 18.88 | * | + |
| MAMMA1002311 | 10.38 | 6.89 | 2.86 | 14.02 | 13.82 | 13.05 | 10.49 | 6.04 | 10.98 | * | + |
| MAMMA1002312 | 7.11 | 4.07 | 0.96 | 3.66 | 5.77 | 5.39 | 2.87 | 2.07 | 3.97 | | |
| MAMMA1002317 | 5.37 | 4.98 | 2.41 | 6.38 | 13.31 | 8.87 | 4.49 | 3.92 | 7.76 | | |
| MAMMA1002319 | 8.07 | 2.35 | 5.23 | 7.19 | 7.92 | 8.72 | 5.3 | 5.48 | 6.56 | | |
| MAMMA1002322 | 6.31 | 4.11 | 5.15 | 10.22 | 11.41 | 12.06 | 4.9 | 7.5 | 6 | ** | + |
| MAMMA1002329 | 4.15 | 2.37 | 1.67 | 2.9 | 3.82 | 5.04 | 2.2 | 3.87 | 3.47 | | |
| MAMMA1002332 | 4.13 | 2.74 | 1.9 | 3.61 | 6.19 | 6.87 | 2.13 | 3.26 | 3.02 | | |
| MAMMA1002333 | 7.26 | 4 | 2.1 | 6.05 | 5.74 | 3.04 | 3.25 | 4.13 | 4.42 | | |
| MAMMA1002335 | 10.93 | 3.6 | 4.03 | 10.38 | 8 | 8.37 | 5.57 | 5.29 | 6.32 | | |
| MAMMA1002339 | 7.73 | 3.96 | 3.73 | 8.81 | 10.04 | 9.53 | 3.71 | 3.46 | 7.48 | * | + |
| MAMMA1002347 | 6.93 | 4.17 | 2.03 | 4.83 | 7.45 | 7.07 | 4.3 | 4.21 | 4.94 | | |
| MAMMA1002351 | 3.84 | 5.05 | 2.4 | 3.45 | 5.38 | 4.65 | 4.23 | 5.29 | 5.91 | | |
| MAMMA1002352 | 5.21 | 4 | 2.14 | 4.04 | 3.97 | 4.72 | 2.11 | 1.72 | 2.04 | | |
| MAMMA1002353 | 9.22 | 7.52 | 2.31 | 5.95 | 8.94 | 7.55 | 4.37 | 4.54 | 4.03 | | |
| MAMMA1002355 | 5.34 | 3.25 | 2.3 | 4.76 | 5.27 | 7.77 | 2.43 | 4.79 | 2.85 | | |
| MAMMA1002356 | 3.57 | 2.35 | 1.19 | 3.19 | 4.03 | 4.8 | 2.05 | 2.5 | 2.26 | | |
| MAMMA1002359 | 13.77 | 9.98 | 8.17 | 18.6 | 20.01 | 21.01 | 10.51 | 7.95 | 8.5 | ** | + |
| MAMMA1002360 | 4.19 | 2.61 | 1.63 | 3.14 | 2.98 | 2.4 | 3 | 1.64 | 2.41 | | |
| MAMMA1002361 | 6.53 | 2.69 | 2.54 | 6.26 | 7.25 | 5.96 | 4.09 | 4.49 | 5.12 | | |
| MAMMA1002362 | 3.93 | 2.21 | 1.89 | 3.56 | 5.61 | 4.11 | 4.72 | 2.96 | 3.12 | | |
| MAMMA1002367 | 6.65 | 2.94 | 3.45 | 4.37 | 4.72 | 4.67 | 3.85 | 4.3 | 4.84 | | |
| MAMMA1002371 | 7.21 | 3.57 | 4.06 | 7.96 | 12.17 | 10.93 | 5.47 | 3.81 | 6.44 | * | + |
| MAMMA1002380 | 6.65 | 2.95 | 5.07 | 7.2 | 8.08 | 10.65 | 3.09 | 4.7 | 4.45 | | |
| MAMMA1002384 | 4 | 1.78 | 2.02 | 5.31 | 7.82 | 7.61 | 2.14 | 4.39 | 2.73 | * | + |
| MAMMA1002385 | 1.81 | 2.58 | 0.88 | 2.71 | 5.37 | 2.61 | 2.77 | 1.86 | 3.22 | | |
| MAMMA1002390 | 7.22 | 4.09 | 4.3 | 4.23 | 4.19 | 5.43 | 8.27 | 6.12 | 7.86 | | |
| MAMMA1002392 | 6.65 | 3.55 | 1.7 | 3.98 | 7.13 | 4.08 | 2.98 | 3.25 | 3.05 | | |
| MAMMA1002396 | 10.94 | 5.98 | 7.24 | 14.33 | 18.89 | 22.98 | 6.91 | 9.41 | 11.76 | * | + |
| MAMMA1002399 | 6.9 | 2.88 | 1.85 | 8.11 | 6.41 | 8.49 | 4.7 | 4.28 | 4.05 | | |
| MAMMA1002400 | 1.74 | 0.88 | 0.89 | 1.88 | 3.53 | 2.38 | 2.6 | 2.64 | 0.96 | | |
| MAMMA1002409 | 4.98 | 2.45 | 2.94 | 3.65 | 3.94 | 4.37 | 3.81 | 6.25 | 5 | | |
| MAMMA1002411 | 5.54 | 2.15 | 1.5 | 3.44 | 5.65 | 4.97 | 2.26 | 3.08 | 1.74 | | |
| MAMMA1002413 | 12.21 | 5.64 | 2.48 | 9.88 | 11.9 | 8.93 | 6.13 | 5.59 | 4.64 | | |
| MAMMA1002417 | 3.93 | 2.05 | 1.27 | 4.37 | 4.53 | 3.05 | 1.96 | 4.22 | 3.47 | | |
| MAMMA1002427 | 6.03 | 2.26 | 2.41 | 5.84 | 9.22 | 5 | 5.51 | 3.52 | 6.07 | | |
| MAMMA1002428 | 3.76 | 1.67 | 1.82 | 4.3 | 5.95 | 5.66 | 4.02 | 3.17 | 2.93 | * | + |
| MAMMA1002433 | 8.04 | 2.9 | 2.73 | 4.67 | 5.92 | 6.23 | 3.94 | 2.95 | 5.38 | | |
| MAMMA1002434 | 8.11 | 3.72 | 2.87 | 9.52 | 10.57 | 9.58 | 3.29 | 5.17 | 4 | * | + |
| MAMMA1002446 | 3.79 | 2.83 | 2.72 | 3.64 | 5.3 | 4.09 | 2.21 | 3.52 | 3.36 | | |
| MAMMA1002447 | 6.44 | 2.97 | 3.54 | 5.33 | 7.97 | 7.41 | 2.58 | 4.01 | 4.02 | | |
| MAMMA1002454 | 19.95 | 10.05 | 7.32 | 23.49 | 19.29 | 16.59 | 13.96 | 10.08 | 15.17 | | |
| MAMMA1002461 | 12.83 | 8.73 | 5.05 | 6.25 | 10.29 | 8.7 | 5.37 | 6.47 | 8.29 | | |
| MAMMA1002463 | 8.41 | 6.54 | 4.81 | 4.6 | 7.71 | 7.29 | 6.73 | 4.8 | 6.72 | | |
| MAMMA1002464 | 7.42 | 5.06 | 2.53 | 4.57 | 5.16 | 4.31 | 6.56 | 4.89 | 5.9 | | |

TABLE 216

| | | | | | | | | | | | |
|---|---|---|---|---|---|---|---|---|---|---|---|
| MAMMA1002466 | 7.61 | 3.8 | 3.03 | 7.05 | 8.64 | 7.32 | 9.99 | 8.37 | 11.38 | * | + |
| MAMMA1002470 | 5.61 | 2.03 | 2.45 | 2.62 | 3.83 | 4.24 | 2.19 | 2.79 | 3.07 | | |
| MAMMA1002475 | 2.73 | 2.58 | 1.69 | 4.8 | 5.81 | 4.75 | 1.5 | 3.35 | 3.39 | ** | + |
| MAMMA1002480 | 1.82 | 0.76 | 1.1 | 1.61 | 2.6 | 1.72 | 0.67 | 1.56 | 1.72 | | |
| MAMMA1002485 | 11.15 | 6.59 | 4.25 | 5.55 | 8.76 | 7.85 | 6.2 | 6.28 | 8.64 | | |
| MAMMA1002494 | 6.22 | 5.16 | 3 | 7.41 | 9.6 | 7.67 | 4.89 | 3.44 | 6.03 | * | + |
| MAMMA1002498 | 5.71 | 3.03 | 1.34 | 3.92 | 2.98 | 3.69 | 2.66 | 2.39 | 3.29 | | |

TABLE 216-continued

| | | | | | | | | | | | | |
|---|---|---|---|---|---|---|---|---|---|---|---|---|
| MAMMA1002524 | 7.17 | 3.31 | 2.26 | 5.6 | 4.65 | 6.85 | 3.63 | 4.86 | 5.05 | | | |
| MAMMA1002530 | 5.79 | 3.23 | 2.55 | 4.12 | 8.81 | 3.19 | 5.21 | 4.47 | 5.09 | | | |
| MAMMA1002538 | 4.01 | 3.96 | 2.85 | 3.37 | 4.2 | 2.1 | 2.88 | 2.7 | 3.45 | | | |
| MAMMA1002545 | 8.19 | 4.19 | 5.05 | 10.66 | 9.93 | 10.97 | 4.47 | 4.9 | 6.19 | * | + | |
| MAMMA1002554 | 4 | 1.52 | 3.49 | 3.57 | 3.68 | 3.97 | 1.82 | 2.91 | 3.1 | | | |
| MAMMA1002556 | 9.93 | 4.82 | 2.86 | 7.06 | 11.34 | 10.05 | 5.76 | 5.07 | 5.23 | | | |
| MAMMA1002561 | 10.06 | 3.9 | 4.44 | 12.05 | 12.4 | 15.05 | 9.97 | 6.01 | 8.09 | * | + | |
| MAMMA1002565 | 4.89 | 4.2 | 3.26 | 4.07 | 7.56 | 4.55 | 3.68 | 2.91 | 4.58 | | | |
| MAMMA1002566 | 4 | 2.15 | 0.94 | 5.93 | 2.4 | 2.55 | 2.16 | 2.54 | 3.99 | | | |
| MAMMA1002571 | 7.22 | 3.36 | 3.15 | 5.32 | 6.04 | 4.33 | 4.11 | 4.2 | 3.94 | | | |
| MAMMA1002573 | 11.2 | 4.78 | 6.52 | 15.53 | 15.17 | 13.55 | 7.02 | 8.07 | 9.44 | * | + | |
| MAMMA1002576 | 6.01 | 1.71 | 4.22 | 10.04 | 10.33 | 6.3 | 4 | 6.04 | 6.94 | | | |
| MAMMA1002584 | 11.01 | 7.77 | 8.72 | 19.33 | 19.85 | 20.62 | 8.27 | 12.03 | 12.19 | ** | + | |
| MAMMA1002585 | 7.85 | 4.99 | 2.28 | 4.43 | 8.97 | 3.79 | 4.59 | 2.67 | 4.69 | | | |
| MAMMA1002586 | 4.6 | 2.19 | 2.47 | 3.71 | 4.21 | 5.32 | 2.84 | 2.51 | 4.3 | | | |
| MAMMA1002589 | 4.94 | 2.94 | 1.69 | 6.3 | 6.89 | 4.51 | 3.93 | 3.36 | 4.69 | | | |
| MAMMA1002590 | 10.71 | 5.82 | 7.42 | 10.33 | 15.26 | 8.36 | 9.91 | 9.3 | 15.5 | | | |
| MAMMA1002593 | 7.21 | 1.7 | 2.9 | 10.38 | 6.09 | 7.62 | 3.83 | 4.23 | 4.78 | | | |
| MAMMA1002597 | 5.27 | 4.72 | 2.89 | 5.79 | 7.99 | 6.52 | 3.32 | 4.98 | 3.89 | | | |
| MAMMA1002598 | 28.18 | 14.66 | 17.3 | 23.76 | 26.47 | 26.12 | 9.35 | 11.37 | 10.26 | | | |
| MAMMA1002603 | 3.82 | 2.48 | 2.87 | 6.45 | 7.78 | 6.16 | 3.06 | 4.45 | 5.16 | ** | + | |
| MAMMA1002612 | 18.88 | 8.49 | 7.35 | 14.76 | 23.79 | 19.09 | 13.04 | 8.06 | 15.93 | | | |
| MAMMA1002617 | 20.5 | 11.92 | 10.78 | 21.62 | 26.8 | 21.46 | 18.22 | 10.24 | 15.46 | | | |
| MAMMA1002618 | 8.07 | 5.37 | 4.36 | 5.18 | 5.81 | 5.01 | 3.29 | 4.53 | 3.87 | | | |
| MAMMA1002619 | 2.75 | 1.98 | 1.32 | 3.42 | 3.69 | 3.38 | 3.52 | 2.56 | 2.73 | * | + | |
| MAMMA1002622 | 4.65 | 2.19 | 2.57 | 6.98 | 7.16 | 7 | 3.88 | 4.47 | 5.21 | ** | + | |
| MAMMA1002623 | 3.7 | 4.09 | 2.66 | 8.45 | 8.43 | 10.17 | 4.49 | 5.06 | 6.96 | ** | + | |
| MAMMA1002625 | 1.31 | 0.77 | 1.1 | 4.74 | 4.02 | 3.9 | 1.84 | 3.63 | 1.92 | ** | + | |
| MAMMA1002627 | 0.15 | 0.77 | 0.52 | 0.63 | 0.61 | 1.31 | 0.61 | 0.89 | 0.31 | | | |
| MAMMA1002629 | 5 | 1.49 | 4.04 | 8.25 | 13.1 | 6.87 | 3.59 | 5.41 | 7.41 | | | |
| MAMMA1002631 | 3.02 | 0.94 | 0.62 | 3.54 | 2.28 | 2 | 1.53 | 1.32 | 2.73 | | | |
| MAMMA1002633 | 8.62 | 2.1 | 5.7 | 4.72 | 6.74 | 7.92 | 3.72 | 4.69 | 4.2 | | | |
| MAMMA1002636 | 3.59 | 1.19 | 1.71 | 4.59 | 3.63 | 5.19 | 2.99 | 3.81 | 3.18 | | | |
| MAMMA1002637 | 1.74 | 1.17 | 1.01 | 2.51 | 1.67 | 1.58 | 1.65 | 2.79 | 2.2 | | | |
| MAMMA1002646 | 5.71 | 2.6 | 2.44 | 4.61 | 4.24 | 4.68 | 2.72 | 3.67 | 2.73 | | | |
| MAMMA1002648 | 9.62 | 6.84 | 5.82 | 8.64 | 14.71 | 12.83 | 6.98 | 7.83 | 7.07 | | | |
| MAMMA1002650 | 0.72 | 0.4 | 0.49 | 1.46 | 0.42 | 1.02 | 0.69 | 0.35 | 0.84 | | | |
| MAMMA1002652 | 6.32 | 1.69 | 4.33 | 6.84 | 5.22 | 9.05 | 3.61 | 3.81 | 5.06 | | | |
| MAMMA1002655 | 6.13 | 2.3 | 1.98 | 3.61 | 1.81 | 5.05 | 3.34 | 3.19 | 3.44 | | | |
| MAMMA1002662 | 5.15 | 2.31 | 2.11 | 6.95 | 6.87 | 5.4 | 4.01 | 4.49 | 5.25 | * | + | |
| MAMMA1002665 | 11.8 | 6.1 | 10.13 | 10.87 | 17.41 | 15.49 | 7.23 | 8.06 | 7.62 | | | |
| MAMMA1002671 | 7.41 | 2.14 | 3.42 | 5.62 | 4.48 | 5.33 | 3.61 | 3.41 | 3.76 | | | |
| MAMMA1002673 | 7.4 | 3.46 | 4.23 | 7.31 | 8.7 | 9.27 | 5.9 | 6.54 | 4.84 | | | |
| MAMMA1002684 | 9.53 | 3.22 | 5.59 | 4.24 | 7.51 | 8.57 | 6.73 | 6.88 | 7.64 | | | |
| MAMMA1002685 | 3.8 | 1.88 | 0.7 | 2.75 | 4.35 | 3.69 | 1.82 | 1.26 | 1 | | | |
| MAMMA1002692 | 7.2 | 4.36 | 3.76 | 8 | 7.57 | 6.47 | 4.09 | 3.19 | 4.9 | | | |
| MAMMA1002693 | 8.11 | 3.16 | 4.22 | 9.2 | 3.75 | 8.99 | 4.65 | 5.78 | 5.13 | | | |
| MAMMA1002698 | 5.29 | 1.74 | 2.15 | 6.64 | 6.43 | 7.76 | 3.35 | 3.54 | 3.9 | * | + | |
| MAMMA1002699 | 2.23 | 0.61 | 0.97 | 1.33 | 2.22 | 1.52 | 1.64 | 1.71 | 1.92 | | | |

TABLE 217

| | | | | | | | | | | | | | |
|---|---|---|---|---|---|---|---|---|---|---|---|---|---|
| MAMMA1002701 | 5.66 | 2.9 | 4.33 | 9.27 | 7.16 | 8.59 | 4.61 | 5.08 | 5.08 | * | + | | |
| MAMMA1002708 | 7.94 | 5.73 | 7.17 | 9.47 | 9.6 | 11.7 | 5.3 | 7.78 | 6.06 | * | + | | |
| MAMMA1002711 | 5.14 | 1.55 | 3.02 | 5.08 | 5.35 | 9.25 | 4.88 | 5.17 | 3.67 | | | | |
| MAMMA1002712 | 8.23 | 3.4 | 3.83 | 5.92 | 5.37 | 4.49 | 4.33 | 4.65 | 3.86 | | | | |
| MAMMA1002716 | 3.03 | 1.15 | 1.75 | 3.45 | 3.66 | 6.18 | 3.63 | 4.99 | 6.27 | | | * | + |
| MAMMA1002721 | 5.09 | 3.43 | 2.39 | 8.57 | 10.12 | 9.06 | 4.73 | 4.05 | 4.78 | ** | + | | |
| MAMMA1002723 | 3.9 | 1.75 | 1.64 | 3.74 | 4.55 | 4.64 | 2.71 | 2.75 | 3.13 | | | | |
| MAMMA1002727 | 1.94 | 0.37 | 0.28 | 1.65 | 1.68 | 1.6 | 1.31 | 1.6 | 1.09 | | | | |
| MAMMA1002728 | 18.85 | 12.15 | 13.58 | 19.57 | 15.85 | 19.98 | 10.65 | 11.63 | 8.96 | | | | |
| MAMMA1002742 | 24.64 | 11.73 | 11.42 | 17.86 | 18.78 | 18.95 | 12.46 | 17.75 | 16.29 | | | | |
| MAMMA1002743 | 3.32 | 1.38 | 1.48 | 2.64 | 3.77 | 2.84 | 1.3 | 3.55 | 2.08 | | | | |
| MAMMA1002744 | 5 | 2.18 | 1.83 | 8.37 | 6.2 | 7.98 | 3.63 | 3.32 | 2.37 | * | + | | |
| MAMMA1002746 | 2.51 | 0.63 | 0.79 | 1.49 | 2.16 | 1.83 | 2.14 | 1.51 | 0.81 | | | | |
| MAMMA1002748 | 3.99 | 1.96 | 1.48 | 3.96 | 2.53 | 5.35 | 2.11 | 2.64 | 2.6 | | | | |
| MAMMA1002754 | 3.27 | 1.38 | 1.23 | 3.72 | 4.67 | 3.51 | 3.5 | 2.37 | 3.36 | | | | |
| MAMMA1002758 | 1.75 | 1.23 | 0.68 | 1.23 | 1.77 | 1.88 | 1.75 | 1.78 | 0.81 | | | | |
| MAMMA1002762 | 15.53 | 11.07 | 16.89 | 14.23 | 17.23 | 16.31 | 8.35 | 12.66 | 9.99 | | | | |
| MAMMA1002764 | 6.2 | 2.6 | 2.93 | 8.75 | 9.77 | 8.81 | 4.73 | 4.74 | 4.79 | * | + | | |
| MAMMA1002765 | 4.28 | 1.57 | 1.43 | 2.94 | 4.93 | 4.38 | 2.62 | 3.87 | 2.62 | | | | |
| MAMMA1002769 | 1.56 | 0.46 | 0.63 | 2.76 | 2.64 | 1.76 | 3.07 | 2.6 | 2.53 | * | + | ** | + |
| MAMMA1002771 | 7.14 | 1.91 | 2.56 | 3.71 | 2.39 | 3.56 | 2.38 | 4.39 | 2.84 | | | | |
| MAMMA1002775 | 8.17 | 3.51 | 3.32 | 3.63 | 6.17 | 5.65 | 3.96 | 3.51 | 3 | | | | |
| MAMMA1002780 | 4.25 | 0.67 | 1.1 | 3.25 | 4.36 | 3.86 | 1.61 | 2.45 | 1.84 | | | | |
| MAMMA1002782 | 3.73 | 1.77 | 1.35 | 3.47 | 4.14 | 4.44 | 2.59 | 3.58 | 3.12 | | | | |

TABLE 217-continued

| | | | | | | | | | | | | | |
|---|---|---|---|---|---|---|---|---|---|---|---|---|---|
| MAMMA1002795 | 1.54 | 0.63 | 0.41 | 1.27 | 1.55 | 2.07 | 1.2 | 2.31 | 1.82 | | | | |
| MAMMA1002796 | 5.26 | 2.04 | 2.88 | 2.31 | 3.68 | 4.71 | 3.08 | 4.01 | 2.78 | | | | |
| MAMMA1002805 | 1.95 | 1.42 | 2.03 | 2.66 | 2.54 | 2.92 | 1.33 | 2.31 | 1.29 | * | + | | |
| MAMMA1002806 | 7.18 | 3.13 | 2.76 | 7.9 | 8.06 | 6.82 | 4.84 | 4.21 | 4.71 | | | | |
| MAMMA1002807 | 5.28 | 1.74 | 0.98 | 3.68 | 4.66 | 5.86 | 3.42 | 3.27 | 3.02 | | | | |
| MAMMA1002814 | 3.87 | 2.51 | 3.12 | 7.45 | 7.16 | 7.74 | 4.16 | 4.93 | 4.92 | ** | + | * | + |
| MAMMA1002817 | 1.7 | 0.51 | 0.6 | 1.42 | 1.13 | 1.4 | 0.99 | 1.61 | 0.6 | | | | |
| MAMMA1002820 | 1.34 | 1.92 | 0.86 | 2.57 | 2.4 | 3.83 | 1.38 | 1.74 | 1.69 | * | + | | |
| MAMMA1002830 | 27.11 | 10.85 | 16.25 | 30.04 | 35.58 | 32.67 | 18.44 | 20.75 | 20.74 | * | + | | |
| MAMMA1002833 | 6.78 | 4.02 | 4.05 | 10.31 | 9.78 | 13.03 | 4.43 | 6.24 | 5.25 | * | + | | |
| MAMMA1002835 | 3.11 | 0.73 | 1.29 | 2.37 | 4.3 | 3.68 | 1.9 | 2.74 | 1.11 | | | | |
| MAMMA1002838 | 5.08 | 1.94 | 1.5 | 7.62 | 5.02 | 5.3 | 2.99 | 3.7 | 3.52 | | | | |
| MAMMA1002842 | 6.45 | 2.71 | 2.75 | 6.39 | 9.1 | 5.17 | 5.25 | 5.53 | 5.55 | | | | |
| MAMMA1002843 | 4.18 | 1.22 | 2.78 | 4.36 | 3.92 | 4.27 | 2.84 | 3.41 | 2.54 | | | | |
| MAMMA1002844 | 15.29 | 8.97 | 10.98 | 13.02 | 14.25 | 13.61 | 12.26 | 13.86 | 18.37 | | | | |
| MAMMA1002845 | 0.94 | 0.26 | 0.38 | 2.62 | 1.75 | 2.18 | 15.33 | 12.73 | 11.67 | ** | + | ** | + |
| MAMMA1002857 | 92.97 | 61.45 | 71.01 | 93.18 | 91.48 | 102.4 | 49.65 | 49.13 | 49.57 | | | | |
| MAMMA1002858 | 270.3 | 178.2 | 193.7 | 198.5 | 285 | 325.3 | 136.6 | 154.1 | 144.4 | | | | |
| MAMMA1002863 | 6.79 | 3.17 | 3.17 | 4.69 | 5.56 | 4.89 | 3.85 | 6.3 | 4.27 | | | | |
| MAMMA1002868 | 5.34 | 2.46 | 2.35 | 7.72 | 6.47 | 7.85 | 3.3 | 3.69 | 4.4 | * | + | | |
| MAMMA1002869 | 6.13 | 2.1 | 3.45 | 4.16 | 4.01 | 5.84 | 3.15 | 3.68 | 3.35 | | | | |
| MAMMA1002871 | 0.97 | 0.66 | 0.13 | 2.7 | 2.82 | 2.55 | 1.36 | 2.18 | 2.35 | ** | + | * | + |
| MAMMA1002875 | 4.77 | 2.06 | 2.53 | 6.78 | 7.19 | 6.9 | 3.55 | 3.8 | 4.77 | * | + | | |
| MAMMA1002879 | 3.84 | 2.9 | 2.39 | 3.98 | 5.13 | 4.33 | 4.2 | 4.17 | 4.62 | | | * | + |
| MAMMA1002880 | 3.28 | 1.24 | 0.99 | 2.01 | 1.85 | 1.9 | 3.12 | 3.06 | 1.4 | | | | |
| MAMMA1002881 | 5.17 | 2.92 | 2.09 | 6.15 | 9.22 | 4.65 | 3.67 | 4.57 | 4.68 | | | | |
| MAMMA1002885 | 5.25 | 2.85 | 2.52 | 4.49 | 4.87 | 6.69 | 2.72 | 4.39 | 2.98 | | | | |
| MAMMA1002886 | 6.24 | 3.43 | 2.66 | 5.52 | 4.58 | 6.71 | 3.64 | 3.49 | 2.72 | | | | |
| MAMMA1002887 | 3.89 | 0.95 | 1 | 1.97 | 1.75 | 1.77 | 2.34 | 1.93 | 1.82 | | | | |
| MAMMA1002890 | 5.13 | 2.67 | 3.05 | 8.31 | 4.7 | 8.72 | 5.27 | 5.4 | 5.01 | | | | |
| MAMMA1002892 | 5.88 | 3.48 | 2.47 | 7.32 | 8.24 | 6.42 | 4.17 | 5.23 | 4.57 | * | + | | |
| MAMMA1002893 | 8.86 | 9.67 | 8.59 | 8.18 | 9.34 | 9.39 | 5.69 | 3.91 | 5.29 | | | ** | − |

TABLE 218

| | | | | | | | | | | | | | |
|---|---|---|---|---|---|---|---|---|---|---|---|---|---|
| MAMMA1002895 | 1.52 | 1.02 | 0.66 | 3.67 | 2.82 | 2.63 | 1.68 | 3.27 | 1.67 | ** | + | | |
| MAMMA1002898 | 5.3 | 1.67 | 2.43 | 5.04 | 3.66 | 3.54 | 3.19 | 4.2 | 4.28 | | | | |
| MAMMA1002905 | 7.3 | 4.24 | 4.9 | 4.36 | 3.31 | 5.5 | 4.49 | 4.07 | 7.6 | | | | |
| MAMMA1002906 | 7.09 | 3.55 | 2.11 | 4.13 | 4.15 | 4.17 | 3.6 | 4.08 | 4.37 | | | | |
| MAMMA1002908 | 5.1 | 3.63 | 2.55 | 7.12 | 10.01 | 7.24 | 3.97 | 3.94 | 6.08 | * | + | | |
| MAMMA1002909 | 11.19 | 2.36 | 4.9 | 18.65 | 20.5 | 19.49 | 11.96 | 9.14 | 7.19 | ** | + | | |
| MAMMA1002918 | 8.8 | 4.28 | 4.36 | 7.71 | 4.97 | 6.64 | 4.29 | 3.86 | 3.85 | | | | |
| MAMMA1002925 | 3.35 | 2.63 | 1.48 | 9.46 | 7.99 | 8.84 | 13.12 | 8.46 | 14.83 | ** | + | ** | + |
| MAMMA1002926 | 7.82 | 4.53 | 3.55 | 10.54 | 8.94 | 10.54 | 4.02 | 3.98 | 2.94 | * | + | | |
| MAMMA1002930 | 4.28 | 1.73 | 3.17 | 5.74 | 5.95 | 7.07 | 4.01 | 5.04 | 2.57 | * | + | | |
| MAMMA1002937 | 5.96 | 2.45 | 3.44 | 4.74 | 4.53 | 5.73 | 3.19 | 3.43 | 4.76 | | | | |
| MAMMA1002938 | 3.7 | 2.19 | 0.47 | 2.73 | 4.56 | 4.15 | 4.37 | 4.59 | 4.01 | | | | |
| MAMMA1002941 | 1.15 | 1.12 | 0.39 | 3.44 | 2.75 | 4.14 | 1.85 | 1.74 | 2.91 | ** | + | * | + |
| MAMMA1002947 | 6.2 | 1.75 | 2 | 3.69 | 4.63 | 4.41 | 4 | 2.74 | 2.53 | | | | |
| MAMMA1002964 | 3.13 | 0.8 | 1.6 | 3.89 | 5.54 | 5.2 | 2.56 | 3.32 | 2.95 | * | + | | |
| MAMMA1002967 | 2.77 | 0.81 | 0.72 | 2.65 | 3.25 | 3.1 | 2.15 | 2.36 | 2 | | | | |
| MAMMA1002970 | 10.68 | 5 | 6.77 | 15.62 | 18.38 | 19.77 | 9.12 | 10.6 | 10.22 | ** | + | | |
| MAMMA1002971 | 5.36 | 1.91 | 2.72 | 5.34 | 4.3 | 4.54 | 3.53 | 5.4 | 3.71 | | | | |
| MAMMA1002972 | 3.58 | 1.23 | 1.8 | 5.51 | 3.48 | 3.8 | 2.78 | 4.51 | 3.78 | | | | |
| MAMMA1002973 | 3.05 | 2.45 | 2.19 | 5.84 | 7.86 | 5.49 | 3.04 | 3.4 | 3.84 | ** | + | | |
| MAMMA1002979 | 49.45 | 21.28 | 20.21 | 54.78 | 50.04 | 57.56 | 26.52 | 29.51 | 38.14 | | | | |
| MAMMA1002982 | 1.17 | 0.84 | 0.21 | 1.07 | 1.04 | 1.44 | 0.75 | 0.85 | 2.52 | | | | |
| MAMMA1002987 | 2.51 | 2.1 | 1.94 | 4.65 | 4.24 | 4.32 | 2.66 | 3.22 | 2.69 | ** | + | | |
| MAMMA1003003 | 6.44 | 2.24 | 3.39 | 6.63 | 8.14 | 8.81 | 3.38 | 3.94 | 4.55 | | | | |
| MAMMA1003004 | 2.44 | 1.12 | 1.78 | 4.34 | 4.64 | 5.27 | 2.45 | 2.33 | 3.36 | ** | + | | |
| MAMMA1003007 | 3 | 0.97 | 0.37 | 1.72 | 3.13 | 2.66 | 1.67 | 2.02 | 2.34 | | | | |
| MAMMA1003011 | 6.89 | 3.86 | 2.58 | 10.11 | 6.23 | 6.02 | 5.56 | 4.68 | 6.89 | | | | |
| MAMMA1003013 | 4.71 | 2.5 | 3.6 | 5.96 | 2.57 | 4.98 | 4.47 | 2.47 | 4.04 | | | | |
| MAMMA1003015 | 3.11 | 1.7 | 0.83 | 3.85 | 3.23 | 4.39 | 2.92 | 3.35 | 3.6 | | | | |
| MAMMA1003019 | 1.94 | 0.48 | 0.77 | 1.44 | 1.99 | 1 | 1.47 | 1.37 | 1.39 | | | | |
| MAMMA1003020 | 4.98 | 3.11 | 2.83 | 4.85 | 4.06 | 4.94 | 3.36 | 4.67 | 2.34 | | | | |
| MAMMA1003026 | 2.22 | 1.04 | 1.33 | 2.17 | 1.21 | 1.23 | 1.15 | 1.94 | 1.66 | | | | |
| MAMMA1003031 | 10.83 | 4.3 | 5.89 | 8.39 | 13.69 | 12.78 | 6.3 | 8.07 | 8.55 | | | | |
| MAMMA1003033 | 4.26 | 3.18 | 1.65 | 3.05 | 5.95 | 7.17 | 2.79 | 4.73 | 3.1 | | | | |
| MAMMA1003035 | 9.17 | 3.04 | 2.57 | 6.09 | 5.43 | 4.4 | 3.27 | 3.33 | 2.99 | | | | |
| MAMMA1003039 | 2.73 | 0.66 | 0.77 | 3.23 | 4.07 | 2.57 | 2.03 | 1.92 | 2.63 | | | | |
| MAMMA1003040 | 5.92 | 4.5 | 4.4 | 12.47 | 14.15 | 15.98 | 6 | 7.82 | 5.59 | ** | + | | |
| MAMMA1003044 | 5.54 | 1.89 | 2.06 | 8.57 | 6.1 | 5.51 | 3.66 | 3.75 | 3.73 | | | | |
| MAMMA1003047 | 24.49 | 9.27 | 14.52 | 16.47 | 16.89 | 16.3 | 13.85 | 12.65 | 14.22 | | | | |
| MAMMA1003049 | 1.66 | 0.7 | 0.16 | 1.59 | 1.6 | 1.36 | 1.06 | 0.97 | 1.99 | | | | |
| MAMMA1003055 | 3.44 | 1.83 | 1.31 | 3.88 | 3.78 | 5.3 | 1.65 | 3.16 | 2.91 | | | | |

TABLE 218-continued

| | | | | | | | | | | | | |
|---|---|---|---|---|---|---|---|---|---|---|---|---|
| MAMMA1003056 | 3.11 | 0.29 | 1.13 | 1.54 | 2.14 | 2.78 | 1.67 | 3.29 | 1.4 | | | |
| MAMMA1003057 | 4.22 | 3.06 | 2.41 | 5.23 | 4.85 | 4.4 | 3.28 | 3.47 | 3.84 | | | |
| MAMMA1003066 | 4.41 | 2.68 | 2.13 | 7.59 | 8.47 | 7.26 | 3.45 | 3.84 | 3.94 | ** | + | |
| MAMMA1003075 | 2.52 | 1.24 | 0.49 | 2.49 | 1.99 | 2.02 | 1.98 | 1.74 | 1.75 | | | |
| MAMMA1003089 | 3.39 | 2.37 | 1.55 | 7.01 | 9.09 | 5.24 | 3.86 | 3.79 | 4.04 | * | + | |
| MAMMA1003092 | 2.28 | 2.1 | 0.75 | 1.76 | 2.8 | 2.59 | 1.29 | 2.14 | 0.99 | | | |
| MAMMA1003095 | 3.31 | 3.21 | 2.49 | 5.68 | 6.41 | 6.17 | 3.79 | 3.05 | 2.04 | ** | + | |
| MAMMA1003099 | 4.62 | 1.71 | 1.38 | 5.27 | 3.36 | 5.17 | 3.64 | 4.12 | 3.25 | | | |
| MAMMA1003102 | 4.98 | 1.87 | 1.62 | 3.02 | 1.85 | 3.96 | 2.26 | 3.51 | 2.66 | | | |
| MAMMA1003104 | 3.42 | 0.58 | 0.51 | 3.71 | 2.62 | 2.21 | 2 | 1.93 | 0.79 | | | |
| MAMMA1003113 | 7.31 | 2.8 | 2.6 | 2.96 | 4.59 | 4.44 | 3.67 | 4.2 | 3.98 | | | |
| MAMMA1003126 | 5.27 | 3.19 | 2.59 | 5.46 | 4.59 | 6.5 | 4.92 | 4.89 | 5.03 | | | |
| MAMMA1003127 | 3.2 | 0.92 | 0.9 | 2.49 | 3.46 | 2.32 | 2.81 | 3.43 | 2.3 | | | |
| MAMMA1003131 | 14.8 | 5.77 | 8.64 | 6.66 | 11.84 | 10.58 | 7.76 | 9.54 | 7.3 | | | |
| MAMMA1003135 | 2.29 | 0.95 | 1.03 | 2.13 | 1.48 | 2.22 | 0.96 | 2.28 | 1.38 | | | |

TABLE 219

| | | | | | | | | | | | | | | |
|---|---|---|---|---|---|---|---|---|---|---|---|---|---|---|
| MAMMA1003140 | 1.69 | 0.85 | 0.6 | 1.74 | 1.79 | 2.62 | 1.07 | 1.84 | 1.32 | | | | | |
| MAMMA1003146 | 3.17 | 0.64 | 1.39 | 1.41 | 2.11 | 2.74 | 2.14 | 2.47 | 2.39 | | | | | |
| MAMMA1003150 | 14.6 | 5.76 | 6.23 | 12.63 | 11.24 | 8.45 | 5.72 | 10.32 | 7.8 | | | | | |
| MAMMA1003154 | 8.12 | 5.17 | 3.61 | 5.99 | 6.38 | 3.91 | 3.93 | 4.78 | 3.8 | | | | | |
| MAMMA1003155 | 3.73 | 2.43 | 2.74 | 2.68 | 3.2 | 4.47 | 4.25 | 3.56 | 2.96 | | | | | |
| MAMMA1003157 | 3.72 | 2.17 | 1.5 | 8.43 | 9.53 | 5.52 | 5.81 | 5.42 | 4.11 | * | + | * | + | |
| MAMMA1003163 | 3.24 | 2.63 | 2.53 | 2.86 | 3.42 | 4.51 | 2.32 | 3.21 | 3.84 | | | | | |
| MAMMA1003164 | 4.04 | 1.62 | 1.78 | 2.36 | 3.89 | 3.12 | 1.98 | 3.3 | 1.9 | | | | | |
| MAMMA1003166 | 2.64 | 0.97 | 1.34 | 1.14 | 2.03 | 2.6 | 0.94 | 1.46 | 0.67 | | | | | |
| NB9N31000010 | 14.76 | 5.71 | 8.03 | 2.59 | 3.65 | 2.88 | 2.38 | 3.3 | 2.11 | | | | | |
| NB9N31000016 | 7.03 | 5.06 | 4.31 | 4.14 | 3.19 | 3.67 | 2.48 | 3.3 | 3.54 | | | | | |
| NB9N31000043 | 6.43 | 3.37 | 2.66 | 3.6 | 4.63 | 3.3 | 4.03 | 4.8 | 3.85 | | | | | |
| NB9N31000045 | 19.15 | 14.02 | 9.92 | 7.25 | 11.2 | 10.47 | 9.72 | 9.74 | 10.85 | | | | | |
| NB9N31000054 | 6.46 | 2.26 | 2.68 | 6.57 | 6.74 | 6.4 | 6.39 | 5.01 | 4.4 | | | | | |
| NB9N31000076 | 2.64 | 1.86 | 1.23 | 4.27 | 5.28 | 5.06 | 3.51 | 3.29 | 3.06 | ** | + | * | + | |
| NB9N31000086 | 3.3 | 1.41 | 1.24 | 4.91 | 5.73 | 5.78 | 4.03 | 3.25 | 4.37 | ** | + | | | |
| NT2RM1000001 | 3.65 | 2.34 | 1.78 | 2.42 | 3.06 | 4.27 | 1.46 | 2.56 | 2.65 | | | | | |
| NT2RM1000018 | 18.02 | 4.88 | 9.18 | 11.8 | 18.97 | 15.96 | 10.32 | 8.58 | 7.34 | | | | | |
| NT2RM1000032 | 2.53 | 0.99 | 1.56 | 3.18 | 2.12 | 2.58 | 1.32 | 2.6 | 2.8 | | | | | |
| NT2RM1000035 | 11.4 | 5.02 | 6.42 | 9.17 | 9.42 | 10.51 | 8.5 | 7.07 | 7.86 | | | | | |
| NT2RM1000037 | 13.15 | 8.99 | 9.27 | 10.68 | 10.22 | 12.08 | 8.43 | 7.97 | 9.91 | | | | | |
| NT2RM1000039 | 11.18 | 9.88 | 11.7 | 14.16 | 13.27 | 16.95 | 11.97 | 10.55 | 15.86 | * | + | | | |
| NT2RM1000042 | 80.13 | 61.43 | 48.95 | 80.07 | 94.16 | 101.1 | 34.69 | 35.38 | 37.43 | | | * | − | |
| NT2RM1000055 | 1.63 | 0.44 | 0.19 | 1.9 | 1.2 | 1.06 | 0.56 | 1.65 | 0.56 | | | | | |
| NT2RM1000059 | 10.72 | 6.4 | 6.93 | 10.31 | 13.85 | 13 | 8.96 | 10.38 | 10.03 | | | | | |
| NT2RM1000062 | 2 | 0.27 | 0.62 | 1.05 | 1.09 | 1.16 | 1.09 | 1.18 | 1.04 | | | | | |
| NT2RM1000065 | 113.3 | 91.26 | 69.94 | 64.48 | 58.5 | 52.5 | 34.11 | 33.99 | 50.67 | | | * | − | |
| NT2RM1000066 | 35.22 | 18.22 | 21.68 | 21.61 | 23.29 | 23.48 | 22.94 | 24.27 | 17.75 | | | | | |
| NT2RM1000071 | 63.91 | 66.46 | 45.7 | 62.4 | 99.26 | 85.6 | 34.56 | 28.87 | 36.37 | | | * | − | |
| NT2RM1000080 | 3.9 | 1.47 | 1.12 | 2.18 | 2.14 | 2.55 | 1.54 | 2.09 | 2.44 | | | | | |
| NT2RM1000086 | 19.75 | 10.02 | 12.84 | 15.85 | 21.11 | 21.57 | 16.5 | 12.7 | 16.82 | | | | | |
| NT2RM1000092 | 3.84 | 1.47 | 1.22 | 4.35 | 3.45 | 3.58 | 5.38 | 4.65 | 2.8 | | | | | |
| NT2RM1000118 | 0.16 | 0.1 | 0.44 | 0.44 | 0.48 | 0.43 | 0.45 | 1.71 | 0.2 | | | | | |
| NT2RM1000119 | 1.47 | 0.16 | 1.14 | 1.49 | 1.8 | 1.27 | 0.45 | 3.87 | 1.63 | | | | | |
| NT2RM1000121 | 3.95 | 2.18 | 1.02 | 2.75 | 2.63 | 2.42 | 2.12 | 2.47 | 2.71 | | | | | |
| NT2RM1000122 | 20.69 | 10.42 | 10.67 | 11.66 | 9.11 | 15.06 | 12.71 | 8.89 | 10.81 | | | | | |
| NT2RM1000127 | 3.09 | 0.8 | 1.57 | 1.55 | 1.35 | 2.79 | 1.74 | 2.29 | 1.61 | | | | | |
| NT2RM1000131 | 1.39 | 0.57 | 0.54 | 0.93 | 0.82 | 1.7 | 1.32 | 1.99 | 1.76 | | | | | |
| NT2RM1000132 | 3.41 | 2.17 | 2.19 | 3.36 | 2.6 | 3.36 | 3.07 | 3.21 | 1.8 | | | | | |
| NT2RM1000153 | 2.4 | 1.2 | 1 | 2.3 | 1.9 | 1.72 | 2.33 | 2.75 | 1.99 | | | | | |
| NT2RM1000184 | 12.46 | 9.34 | 11.07 | 12.61 | 11.31 | 13.35 | 27.02 | 24.07 | 25.86 | | | ** | + | |
| NT2RM1000186 | 0.96 | 0.05 | 1.17 | 1.92 | 0.66 | 0.6 | 1.01 | 1.84 | 0.71 | | | | | |
| NT2RM1000187 | 7.97 | 7.07 | 3.88 | 7.69 | 10.3 | 6.3 | 4.37 | 5.12 | 5.93 | | | | | |
| NT2RM1000199 | 2.43 | 1.17 | 0.94 | 2.23 | 1.56 | 2.06 | 2.22 | 2.21 | 0.97 | | | | | |
| NT2RM1000213 | 4.77 | 2.05 | 1.72 | 5.31 | 3.68 | 5.55 | 3.01 | 2.88 | 2.04 | | | | | |
| NT2RM1000215 | 22.27 | 12.67 | 13.12 | 16.61 | 13.19 | 18.25 | 21.54 | 17.2 | 19.32 | | | | | |
| NT2RM1000218 | 4.96 | 1.49 | 2.25 | 6.26 | 5.56 | 5.79 | 6.91 | 7.15 | 6.31 | | | * | + | |
| NT2RM1000224 | 14.47 | 7.85 | 6.71 | 14.79 | 9.45 | 14.6 | 5.58 | 5.7 | 6.61 | | | | | |
| NT2RM1000236 | 11.3 | 7.18 | 4.01 | 4.18 | 3.11 | 5.39 | 11.74 | 17.39 | 13.83 | | | | | |
| NT2RM1000242 | −0.07 | 0.1 | −0.14 | 0.21 | 0.11 | 0.96 | 0.08 | 1.21 | −0.15 | | | | | |
| NT2RM1000244 | 3.77 | 1.77 | 0.73 | 1.27 | 1.58 | 1.27 | 0.95 | 0.89 | 0.64 | | | | | |
| NT2RM1000252 | 31.79 | 17.18 | 15.85 | 26.05 | 28.99 | 28.97 | 19.44 | 15.24 | 17.84 | | | | | |
| NT2RM1000256 | 20.24 | 12.26 | 8.91 | 9.14 | 16.96 | 11.49 | 13.69 | 10.22 | 13.24 | | | | | |
| NT2RM1000257 | 16.34 | 9.13 | 9.74 | 4.83 | 6.53 | 7.09 | 5.1 | 3.9 | 3.96 | | | * | − | |
| NT2RM1000260 | 32.33 | 14.76 | 16.72 | 33.82 | 31.04 | 33.35 | 23.69 | 23.35 | 23.61 | | | | | |
| NT2RM1000269 | 12.22 | 8.71 | 9.44 | 5.25 | 3.16 | 4.72 | 1.74 | 2.23 | 1.16 | ** | − | ** | − | |

TABLE 220

| | | | | | | | | | | | | | |
|---|---|---|---|---|---|---|---|---|---|---|---|---|---|
| NT2RM1000271 | 0.75 | 0.2 | 0.04 | 1.21 | 0.35 | 0.58 | 0.94 | 0.84 | 0.49 | | | | |
| NT2RM1000272 | 54.56 | 36.55 | 40.59 | 39.42 | 48.05 | 51.89 | 35.16 | 41.56 | 36.18 | | | | |
| NT2RM1000273 | 25.51 | 11.38 | 15.12 | 14.18 | 12.87 | 14.49 | 8.99 | 9.27 | 12 | | | | |
| NT2RM1000274 | 58.21 | 39.03 | 46.94 | 45.24 | 44.74 | 49.05 | 21.9 | 22.39 | 26.39 | | | * | − |
| NT2RM1000280 | 3.79 | 2.05 | 1.14 | 3.65 | 3.57 | 2.6 | 4.36 | 3.9 | 4.03 | | | | |
| NT2RM1000295 | 1.04 | 0.33 | 0.49 | 1.43 | 1.42 | 1.12 | 1.49 | 1.59 | 1.89 | * | + | * | + |
| NT2RM1000300 | 3.37 | 1.19 | 1.93 | 2.35 | 3.27 | 3.66 | 2.84 | 2 | 3 | | | | |
| NT2RM1000304 | 119.7 | 75.04 | 105.1 | 129.6 | 102.4 | 124.9 | 50.36 | 59.48 | 58.8 | | | * | − |
| NT2RM1000314 | 14.79 | 10.41 | 9.09 | 12.21 | 10.45 | 12.98 | 11.38 | 9.76 | 12.93 | | | | |
| NT2RM1000318 | 24.15 | 19.1 | 20.62 | 18.95 | 25.93 | 22.36 | 13.38 | 12.74 | 12.13 | | | ** | − |
| NT2RM1000335 | 2.7 | 1.54 | 1.86 | 2.64 | 0.98 | 2.51 | 2.11 | 1.75 | 0.87 | | | | |
| NT2RM1000341 | 1.86 | 1.47 | 0.19 | 1.35 | 0.97 | 1.03 | 1.64 | 1.09 | 1.69 | | | | |
| NT2RM1000350 | 12.53 | 6.61 | 5.41 | 9.68 | 8.63 | 6.11 | 10.39 | 8.69 | 12.6 | | | | |
| NT2RM1000354 | 1.42 | 1.08 | 1.09 | 1.11 | 0.94 | 2.05 | 1.14 | 0.93 | 0.85 | | | | |
| NT2RM1000355 | 24.12 | 12.19 | 10.53 | 22.94 | 22.89 | 22.53 | 40.93 | 26.81 | 41.82 | | | * | + |
| NT2RM1000361 | 3.67 | 1.47 | 2.35 | 2.55 | 2.08 | 2.7 | 1.88 | 1.68 | 2.1 | | | | |
| NT2RM1000365 | 1.06 | 0.28 | 0.15 | 0.8 | 0.83 | 1.19 | 0.3 | 0.84 | 1.1 | | | | |
| NT2RM1000372 | 20.32 | 11.77 | 14.09 | 12.5 | 15.42 | 19.07 | 11.35 | 13.11 | 12.12 | | | | |
| NT2RM1000377 | 4.71 | 2.13 | 0.97 | 3.33 | 3.33 | 3.84 | 3.13 | 2.47 | 2.45 | | | | |
| NT2RM1000388 | 4.08 | 1.38 | 1.89 | 2.94 | 1.24 | 2.04 | 2.06 | 1.76 | 3.15 | | | | |
| NT2RM1000394 | 1.97 | 0.69 | 0.13 | 1.46 | 1.54 | 2.03 | 0.91 | 0.83 | 1.86 | | | | |
| NT2RM1000399 | 1.06 | 0.34 | 0.04 | 1.59 | 1.17 | 1.07 | 1.01 | 1.52 | 1.09 | | | | |
| NT2RM1000407 | 3.28 | 1.69 | 1.8 | 2.92 | 2.58 | 2.42 | 3.74 | 2.39 | 2.69 | | | | |
| NT2RM1000421 | 1.21 | 0.17 | 0.31 | 0.84 | 0.59 | 1.24 | 0.64 | 0.87 | 1.2 | | | | |
| NT2RM1000422 | 184.9 | 121.2 | 142.5 | 178.6 | 203 | 174.3 | 67.17 | 77.47 | 67.99 | | | * | − |
| NT2RM1000430 | 2.25 | 0.23 | 1.58 | 0.73 | 1.22 | 1.54 | 1.8 | 1.12 | 1.6 | | | | |
| NT2RM1000462 | 11.14 | 6.84 | 5.58 | 14.5 | 17.82 | 8.39 | 4.89 | 8.25 | 6.36 | | | | |
| NT2RM1000499 | 5.37 | 2.3 | 2.51 | 3.94 | 5.62 | 7.36 | 4.89 | 3.83 | 3.47 | | | | |
| NT2RM1000512 | 22.47 | 26.43 | 20.07 | 26.5 | 33.66 | 27.9 | 17.58 | 19.86 | 18.1 | | | | |
| NT2RM1000519 | 29.78 | 19.56 | 14.02 | 7.45 | 11.19 | 11.75 | 14.89 | 14.37 | 13.43 | | | | |
| NT2RM1000527 | 18.16 | 11.14 | 6.22 | 5.88 | 7.16 | 7 | 1.98 | 1.37 | 2.55 | | | * | − |
| NT2RM1000539 | 12.49 | 8.93 | 7.21 | 6.18 | 6.43 | 8.69 | 2.33 | 4.94 | 2.74 | | | * | − |
| NT2RM1000542 | 5.88 | 1.72 | 2.37 | 3.23 | 3.3 | 5.23 | 2.07 | 2.93 | 2.21 | | | | |
| NT2RM1000553 | 3.65 | 0.83 | 1.64 | 1.16 | 1.39 | 3.69 | 1.46 | 2.07 | 1.37 | | | | |
| NT2RM1000555 | 54.21 | 28.45 | 27.23 | 49.44 | 36.73 | 39.14 | 24.87 | 25.09 | 25.78 | | | | |
| NT2RM1000558 | 5.67 | 1.77 | 2.83 | 4.02 | 2.67 | 3.58 | 2.91 | 2.6 | 1.85 | | | | |
| NT2RM1000563 | 5.22 | 2.56 | 1.89 | 2.43 | 2.32 | 3.96 | 2.78 | 2.56 | 3.17 | | | | |
| NT2RM1000566 | 7.28 | 3.71 | 3.24 | 1.61 | 1.5 | 1.27 | 1.81 | 1.72 | 3.16 | | | | |
| NT2RM1000570 | 26.49 | 17.4 | 16.59 | 16.76 | 14.37 | 17.79 | 32.95 | 44.77 | 33.54 | | | * | + |
| NT2RM1000571 | 6.81 | 1.94 | 3.76 | 2.38 | 2.48 | 3.22 | 3.14 | 4.7 | 3.91 | | | | |
| NT2RM1000574 | 1.29 | 0.74 | 0.74 | 1.47 | 2.46 | 0.57 | 1.31 | 2.11 | 1.66 | | | | |
| NT2RM1000580 | 1.69 | 0.26 | 0.99 | 1.9 | 0.77 | 2.4 | 1.57 | 1.93 | 1.37 | | | | |
| NT2RM1000620 | 10.67 | 5.15 | 5.67 | 13.49 | 19.91 | 14.9 | 8.69 | 7.05 | 7.31 | * | + | | |
| NT2RM1000623 | 1.16 | 0.68 | −0.02 | 1.17 | 0.81 | 0.94 | 0.79 | 1.05 | 0.97 | | | | |
| NT2RM1000630 | 2.05 | 1.24 | 0.77 | 1.67 | 2.19 | 1.83 | 1.87 | 1.47 | 1.67 | | | | |
| NT2RM1000633 | 27.41 | 17.8 | 20.59 | 31.5 | 32.02 | 35.16 | 25.03 | 10.45 | 15.13 | * | + | | |
| NT2RM1000634 | 2.52 | 1 | 0.44 | 1.48 | 1.48 | 2.34 | 1.07 | 2.17 | 0.81 | | | | |
| NT2RM1000642 | 6.47 | 2.65 | 3.78 | 2.95 | 2.59 | 5.44 | 3.92 | 6.2 | 4.71 | | | | |
| NT2RM1000647 | 37.58 | 16.74 | 23.8 | 20.92 | 20.8 | 27.77 | 21.56 | 20.3 | 24.27 | | | | |
| NT2RM1000648 | 2.04 | 0.41 | 0.84 | 1.58 | 1.79 | 2.24 | 1.08 | 2.71 | 1.07 | | | | |
| NT2RM1000650 | 3.85 | 1.26 | 1.26 | 3.06 | 2.28 | 2.37 | 2.52 | 2.44 | 1.64 | | | | |
| NT2RM1000661 | 6.75 | 4.13 | 3.51 | 3.45 | 3.05 | 3.31 | 3.37 | 4.05 | 2.46 | | | | |
| NT2RM1000666 | 25.38 | 12.8 | 15.49 | 0.79 | 0.92 | 0.69 | 0.89 | 0.98 | 0.83 | * | − | * | − |
| NT2RM1000669 | 3.69 | 1.54 | 2.15 | 2.54 | 2.09 | 3.44 | 2.17 | 1.76 | 1.75 | | | | |
| NT2RM1000672 | 18.91 | 9.34 | 13.85 | 40.77 | 46.8 | 48.09 | 11.37 | 11.65 | 12.71 | ** | + | | |
| NT2RM1000681 | 7.08 | 2.25 | 3.13 | 16.21 | 18.15 | 17.39 | 29.47 | 23.33 | 30.9 | ** | + | ** | + |

TABLE 221

| | | | | | | | | | | | | | |
|---|---|---|---|---|---|---|---|---|---|---|---|---|---|
| NT2RM1000691 | 1.49 | 0.33 | 0.72 | 2.19 | 3.8 | 4.38 | 1.16 | 2.44 | 1.23 | * | + | | |
| NT2RM1000698 | 9.46 | 4.02 | 2.95 | 1.73 | 2.75 | 2.69 | 1.76 | 3.25 | 2.56 | | | | |
| NT2RM1000699 | 5.92 | 1.52 | 1.15 | 3.89 | 3.52 | 2.89 | 2.18 | 3.43 | 1.91 | | | | |
| NT2RM1000702 | 6.62 | 2.57 | 3.45 | 4.5 | 3.42 | 3.78 | 4.09 | 2.32 | 3.62 | | | | |
| NT2RM1000703 | 17.1 | 15.01 | 10.3 | 10.55 | 11.96 | 11.61 | 8.87 | 8.94 | 9.74 | | | | |
| NT2RM1000704 | 65.68 | 42.42 | 42.04 | 15.75 | 17.49 | 15.71 | 13.71 | 12.1 | 16.78 | * | − | * | − |
| NT2RM1000725 | 2.89 | 1.28 | 2.86 | 8.31 | 19.48 | 14.98 | 22.1 | 28.8 | 20.7 | * | + | ** | + |
| NT2RM1000726 | 2.12 | 1.3 | 1.96 | 2.34 | 2.21 | 3.46 | 1.65 | 2.75 | 1.67 | | | | |
| NT2RM1000731 | 5.27 | 2.15 | 2.93 | 3.31 | 4.19 | 2.99 | 4.88 | 3.29 | 2.95 | | | | |
| NT2RM1000741 | 1.93 | 0.67 | 1.46 | 0.89 | 1.2 | 1.46 | 1.17 | 1.5 | 1.29 | | | | |
| NT2RM1000742 | 23.68 | 12.81 | 12.51 | 8.34 | 8.53 | 8.89 | 7.58 | 8.47 | 7.71 | | | | |
| NT2RM1000744 | 6.58 | 2.57 | 2.31 | 5.25 | 4.4 | 4.66 | 2.69 | 3.48 | 4.72 | | | | |
| NT2RM1000746 | 6.6 | 3.69 | 2.39 | 2.21 | 4.12 | 4.39 | 2.87 | 3.97 | 3.11 | | | | |
| NT2RM1000747 | 7.04 | 3.26 | 3.4 | 5.08 | 4.8 | 5.81 | 8.95 | 8.11 | 9.87 | | | * | + |
| NT2RM1000752 | 2.53 | 0.89 | 1.4 | 2.34 | 2.42 | 2.14 | 1.42 | 2.26 | 1.37 | | | | |
| NT2RM1000767 | 7.61 | 2.5 | 4.43 | 7.29 | 7.21 | 8.59 | 10.72 | 8.37 | 9.7 | | | * | + |
| NT2RM1000770 | 5.9 | 2.04 | 3.1 | 5.61 | 2.94 | 6.75 | 3.14 | 3.37 | 3.76 | | | | |

TABLE 221-continued

| | | | | | | | | | | | | | |
|---|---|---|---|---|---|---|---|---|---|---|---|---|---|
| NT2RM1000772 | 2.24 | 0.1 | 0.45 | 1.66 | 1.02 | 0.57 | 0.12 | 1.61 | 0.68 | | | | |
| NT2RM1000779 | 21.92 | 14.11 | 10.14 | 21.3 | 25.71 | 21.61 | 29.07 | 21.85 | 26.85 | | | | |
| NT2RM1000780 | 3.49 | 1.84 | 0.6 | 4.74 | 3.37 | 4.7 | 3.33 | 3.29 | 1.67 | | | | |
| NT2RM1000781 | 0.57 | 0.24 | 0.41 | 1.11 | 0.76 | 1.25 | 0.94 | 2.16 | 0.86 | * | + | | |
| NT2RM1000789 | 3.24 | 2.46 | 2.34 | 3.02 | 3.98 | 4.62 | 2.09 | 4.84 | 3.17 | | | | |
| NT2RM1000800 | 7.44 | 3.44 | 7.11 | 8.01 | 9.85 | 8.74 | 6.51 | 5.53 | 7.87 | | | | |
| NT2RM1000802 | 9.35 | 5.25 | 6.84 | 5.12 | 5.47 | 5.85 | 9.59 | 9.36 | 9.75 | | | | |
| NT2RM1000811 | 0.9 | 0.16 | 0.89 | 1.36 | 1.11 | 1.28 | 0.91 | 1.35 | 0.23 | | | | |
| NT2RM1000826 | 26.11 | 13.59 | 16.15 | 23.62 | 25.62 | 25.75 | 12.43 | 12.08 | 10.27 | | | | |
| NT2RM1000829 | 4.42 | 3.56 | 2.62 | 8.2 | 6.8 | 9.18 | 6.67 | 6.07 | 6.37 | ** | + | ** | + |
| NT2RM1000831 | 96.56 | 76.65 | 61.3 | 78.41 | 75.7 | 87 | 48.08 | 33.56 | 47.08 | | | * | − |
| NT2RM1000833 | 6.27 | 2.21 | 1.64 | 3.09 | 3.54 | 4.73 | 6.47 | 7.68 | 4.1 | | | | |
| NT2RM1000834 | 4.84 | 2.51 | 2.09 | 5.62 | 3.9 | 3.49 | 3.8 | 5.68 | 4.28 | | | | |
| NT2RM1000841 | 32.04 | 19.08 | 20.07 | 17.66 | 18.86 | 19.57 | 17.83 | 9.4 | 13.52 | | | | |
| NT2RM1000848 | 22.37 | 12.31 | 11.25 | 14.54 | 11.17 | 13.09 | 8.36 | 10.63 | 15.1 | | | | |
| NT2RM1000850 | 1.25 | 0.36 | 0.94 | 1.01 | 0.67 | 1.33 | 1.5 | 1.94 | 1.75 | | | * | + |
| NT2RM1000852 | 3.74 | 0.76 | 1.24 | 2.68 | 2.43 | 2.34 | 2.39 | 3.1 | 1.87 | | | | |
| NT2RM1000853 | 1.46 | 0.57 | 0.14 | 1.6 | 2.87 | 1.74 | 1.25 | 0.52 | 1.87 | | | | |
| NT2RM1000855 | 19.04 | 8.47 | 10.06 | 15.32 | 18.2 | 15.69 | 26.5 | 18.76 | 20.5 | | | | |
| NT2RM1000857 | 20.9 | 10.06 | 10.76 | 20.92 | 27.84 | 24.62 | 16.83 | 13.46 | 17.36 | | | | |
| NT2RM1000858 | 22.68 | 8.04 | 9.94 | 22.93 | 26.24 | 26.47 | 20.88 | 15.02 | 18.54 | | | | |
| NT2RM1000867 | 15.69 | 9.11 | 9.26 | 15.56 | 10.14 | 14.92 | 15.07 | 11.26 | 10.73 | | | | |
| NT2RM1000874 | 9.77 | 5.6 | 5.03 | 6.49 | 6.79 | 8.79 | 8.74 | 7.92 | 8.94 | | | | |
| NT2RM1000882 | 4.01 | 2.76 | 2.65 | 5.69 | 5.23 | 6.94 | 2.13 | 4.39 | 2.7 | * | + | | |
| NT2RM1000883 | 17.32 | 10.68 | 13.68 | 15.2 | 15.74 | 17.32 | 14.61 | 9.93 | 20.96 | | | | |
| NT2RM1000885 | 31.05 | 13.08 | 10.39 | 19.2 | 20.71 | 27.92 | 20.23 | 18.36 | 23.03 | | | | |
| NT2RM1000893 | 3.73 | 1.65 | 2.82 | 3.47 | 1.63 | 2.22 | 4.97 | 4.49 | 6.3 | | | * | + |
| NT2RM1000894 | 14.4 | 9.62 | 11.92 | 7.88 | 9.3 | 10.29 | 9.51 | 9.36 | 13.18 | | | | |
| NT2RM1000898 | 2.53 | 0.85 | 1.96 | 3.01 | 2.71 | 4.11 | 3.76 | 3.77 | 6.2 | | | * | + |
| NT2RM1000899 | 1.45 | 0.26 | 1.26 | 1.48 | 1.2 | 1.14 | 1.07 | 1.69 | 0.72 | | | | |
| NT2RM1000905 | 55.04 | 22.33 | 30.63 | 36.24 | 41.24 | 41.41 | 17.87 | 22.74 | 23.3 | | | | |
| NT2RM1000910 | 7.05 | 2.93 | 6.34 | 6.29 | 7.41 | 5.83 | 7.31 | 6.05 | 5.79 | | | | |
| NT2RM1000914 | 8.32 | 4.94 | 2.32 | 6.53 | 12.83 | 8.37 | 4.34 | 8.86 | 6.23 | | | | |
| NT2RM1000919 | 4.65 | 2.11 | 2.49 | 5.45 | 3.02 | 4.5 | 2.58 | 2.81 | 4.74 | | | | |
| NT2RM1000921 | 2.3 | 0.73 | 0.47 | 1.57 | 1 | 2.01 | 1.98 | 1.39 | 1.88 | | | | |
| NT2RM1000922 | 7.7 | 4.51 | 3.3 | 6.07 | 5.41 | 6.35 | 3.4 | 3.21 | 3.38 | | | | |
| NT2RM1000924 | 3.33 | 1.7 | 1.15 | 2.35 | 2.35 | 2.87 | 1.24 | 2.25 | 1.77 | | | | |
| NT2RM1000927 | 3.83 | 1.15 | 1.76 | 5.16 | 2.77 | 6.27 | 2.3 | 3.24 | 2.14 | | | | |
| NT2RM1000951 | 8.45 | 4.91 | 4.93 | 9.07 | 6.69 | 6.96 | 5.29 | 7.06 | 3.5 | | | | |

TABLE 222

| | | | | | | | | | | | | | |
|---|---|---|---|---|---|---|---|---|---|---|---|---|---|
| NT2RM1000956 | 16.88 | 9.05 | 9.11 | 8.8 | 11.37 | 15.79 | 15.38 | 17.86 | 10.86 | | | | |
| NT2RM1000960 | 13.57 | 6.62 | 8.78 | 22.97 | 30.24 | 31.63 | 21.49 | 20.35 | 17.47 | ** | + | * | + |
| NT2RM1000961 | 4.69 | 3.03 | 1.81 | 5.01 | 3.8 | 5.09 | 4.95 | 2.93 | 3.68 | | | | |
| NT2RM1000962 | 10.02 | 5.16 | 7.78 | 8.82 | 8.11 | 7.03 | 6.17 | 4.67 | 6.47 | | | | |
| NT2RM1000973 | 24.68 | 15.4 | 13.27 | 17.56 | 15.99 | 16.81 | 11.83 | 13.98 | 10.68 | | | | |
| NT2RM1000978 | 0.62 | 0.04 | −0.01 | 0.17 | 0.58 | 0.51 | 0.69 | 0.66 | 1.52 | | | | |
| NT2RM1000982 | 2.39 | 1.7 | 1.71 | 1.03 | 0.94 | 2.7 | 1.35 | 1.92 | 1.56 | | | | |
| NT2RM1000991 | 4.41 | 2.48 | 1.07 | 2.93 | 3.33 | 3.07 | 1.23 | 1.71 | 2.43 | | | | |
| NT2RM1000994 | 8.78 | 4.48 | 6.65 | 3.77 | 4.2 | 8.32 | 4.28 | 3.9 | 4.29 | | | | |
| NT2RM1001002 | 11.56 | 5.39 | 7.09 | 9.93 | 9.4 | 9.55 | 4.65 | 6.66 | 4.14 | | | | |
| NT2RM1001003 | 9.4 | 5.64 | 4.27 | 5.67 | 5.91 | 6.46 | 6.24 | 6.75 | 4.66 | | | | |
| NT2RM1001008 | 1.85 | 1.09 | 0.94 | 1.76 | 1.19 | 2.21 | 0.79 | 1.95 | 1.36 | | | | |
| NT2RM1001011 | 8.02 | 5.18 | 3.04 | 5.49 | 6.15 | 5.88 | 8.36 | 7.88 | 8.53 | | | | |
| NT2RM1001013 | 2.47 | 1.58 | 1.45 | 1.29 | 3.7 | 3.05 | 2.27 | 3.51 | 2.54 | | | | |
| NT2RM1001017 | 2.77 | 1.58 | 1.89 | 1.79 | 2.82 | 2.34 | 1.35 | 1.86 | 1.5 | | | | |
| NT2RM1001018 | 31.03 | 16.64 | 15.26 | 25.69 | 26.32 | 22.96 | 12.01 | 17.57 | 15.08 | | | | |
| NT2RM1001026 | 5.92 | 2.62 | 3.94 | 6.27 | 6.63 | 8.85 | 2.75 | 5.72 | 4.3 | | | | |
| NT2RM1001028 | 3.4 | 0.93 | 2.15 | 2.01 | 2.78 | 3.77 | 1.36 | 3.31 | 2.13 | | | | |
| NT2RM1001043 | 15.05 | 7.93 | 6.39 | 4.61 | 4.5 | 5.16 | 5.79 | 4.43 | 5.13 | | | | |
| NT2RM1001044 | 4.89 | 2.09 | 2.59 | 3.97 | 3.59 | 4.24 | 2.42 | 2.42 | 2.72 | | | | |
| NT2RM1001059 | 2.09 | 0.86 | 1.15 | 1.37 | 1.59 | 1.67 | 1.46 | 1.35 | 0.96 | | | | |
| NT2RM1001063 | 2.45 | 1.26 | 1.65 | 1.46 | 2.05 | 1.8 | 2.13 | 2.29 | 2.06 | | | | |
| NT2RM1001066 | 1.88 | 0.18 | 0.47 | 1.26 | 1.05 | 1.21 | 0.72 | 1.03 | 1.71 | | | | |
| NT2RM1001072 | 1.32 | 0.2 | 0.66 | 1.3 | 1.67 | 2.06 | 1.25 | 1.37 | 0.66 | | | | |
| NT2RM1001074 | 3.05 | 0.93 | 1.31 | 1.69 | 2.05 | 3.12 | 1.02 | 1.75 | 1.85 | | | | |
| NT2RM1001076 | 1.54 | 0.37 | 0.75 | 0.28 | 0.39 | 1.03 | 0.31 | 0.72 | 0.38 | | | | |
| NT2RM1001082 | 6.04 | 3.83 | 2.77 | 7.68 | 5.09 | 7.64 | 2.86 | 4.04 | 3.38 | | | | |
| NT2RM1001085 | 2.68 | 0.85 | 0.53 | 1.55 | 1.52 | 1.92 | 1.8 | 2.19 | 0.8 | | | | |
| NT2RM1001092 | 7.52 | 3.6 | 5.96 | 8.95 | 10.4 | 8.32 | 6.31 | 3.61 | 6.43 | | | | |
| NT2RM1001102 | 3.26 | 0.53 | 1.68 | 1.38 | 1.75 | 2.72 | 1.2 | 2.01 | 1.94 | | | | |
| NT2RM1001103 | 0.88 | 0.73 | 0.28 | 3.91 | 4.58 | 4.4 | 2.72 | 2.34 | 1.98 | ** | + | ** | + |
| NT2RM1001105 | 1 | 0.24 | 0.43 | 1.87 | 1.39 | 1.31 | 0.88 | 1.29 | 1.26 | * | + | | |
| NT2RM1001112 | 2.67 | 1.09 | 1.84 | 2.3 | 1.58 | 2.94 | 0.99 | 2.93 | 1.7 | | | | |
| NT2RM1001115 | 4.95 | 1.32 | 1.99 | 4.02 | 5.02 | 6.62 | 3.14 | 4.83 | 3.48 | | | | |

TABLE 222-continued

| | | | | | | | | | | | | | |
|---|---|---|---|---|---|---|---|---|---|---|---|---|---|
| NT2RM1001122 | 8.5 | 4.16 | 3.4 | 8.68 | 4.04 | 8.48 | 4.45 | 3.73 | 3.94 | | | | |
| NT2RM1001136 | 4.05 | 1.12 | 0.91 | 2.5 | 2.13 | 2.13 | 2.47 | 2.49 | 2.41 | | | | |
| NT2RM1001139 | 6.27 | 3.92 | 2.62 | 3.53 | 3.94 | 4.14 | 5.81 | 5.51 | 4.63 | | | | |
| NT2RM2000003 | 2.91 | 3.18 | 0.75 | 4.84 | 2.4 | 1.79 | 5.06 | 2.26 | 0.96 | | | | |
| NT2RM2000006 | 5.44 | 1.69 | 3.43 | 6.16 | 4.98 | 7.47 | 3.88 | 4.21 | 4.64 | | | | |
| NT2RM2000010 | 9.71 | 5.56 | 5.39 | 7.07 | 8.33 | 10.49 | 7.05 | 5.99 | 5.68 | | | | |
| NT2RM2000013 | 2.55 | 2.71 | 2.44 | 3.49 | 3.87 | 4.31 | 1.27 | 2.57 | 2.16 | ** | + | | |
| NT2RM2000030 | 4.2 | 1.71 | 3.04 | 3.74 | 3.15 | 4.87 | 1.68 | 3.63 | 1.98 | | | | |
| NT2RM2000032 | 14.54 | 8.15 | 3.59 | 5.5 | 2.42 | 5.43 | 3.03 | 2.67 | 4.06 | | | | |
| NT2RM2000039 | 7.04 | 3.95 | 5.72 | 5.91 | 6.33 | 6.41 | 4.47 | 6.78 | 5.88 | | | | |
| NT2RM2000042 | 1.29 | 2.29 | 1.74 | 1.36 | 3.51 | 3.21 | 7.29 | 2.12 | 2.85 | | | | |
| NT2RM2000092 | 8.22 | 4.26 | 4.76 | 1.43 | 1.14 | 1.72 | 2.08 | 1.91 | 0.73 | * | – | * | – |
| NT2RM2000093 | 5.44 | 2.68 | 4.48 | 6.31 | 4.11 | 9.84 | 5.21 | 4.37 | 5 | | | | |
| NT2RM2000101 | 5.58 | 2.71 | 2.34 | 4.26 | 5.98 | 6.15 | 4.54 | 4.36 | 4.29 | | | | |
| NT2RM2000104 | 4.75 | 4.44 | 4.18 | 5.66 | 3.53 | 4.65 | 2.85 | 2.72 | 1.51 | | | * | – |
| NT2RM2000124 | 3.3 | 1.98 | 1.26 | 2.86 | 2.54 | 1.84 | 2.16 | 2.28 | 2.14 | | | | |
| NT2RM2000155 | 2.24 | 1.76 | 1.1 | 2.45 | 4.74 | 4 | 2.88 | 2.71 | 3.03 | | | * | + |
| NT2RM2000191 | 16.4 | 9.01 | 10.98 | 10.77 | 15.67 | 11.6 | 7.34 | 7.57 | 8.37 | | | | |
| NT2RM2000192 | 3.67 | 3.12 | 2.39 | 2.43 | 2.62 | 2.15 | 1.03 | 2.04 | 1.36 | | | * | – |
| NT2RM2000239 | 6.19 | 3.2 | 3.93 | 5.19 | 4.97 | 5.78 | 6.05 | 5.06 | 6.76 | | | | |
| NT2RM2000240 | 21.06 | 15.5 | 8.47 | 21.89 | 29.21 | 21.68 | 13.11 | 14.37 | 17.25 | | | | |
| NT2RM2000241 | 6.65 | 3.31 | 3.03 | 7.38 | 6.29 | 6.04 | 4.13 | 7.91 | 5.35 | | | | |

TABLE 223

| | | | | | | | | | | | | | |
|---|---|---|---|---|---|---|---|---|---|---|---|---|---|
| NT2RM2000250 | 6.85 | 2.87 | 3.45 | 6.74 | 6.95 | 8.42 | 4.64 | 4.72 | 5.57 | | | | |
| NT2RM2000259 | 9.6 | 4.08 | 4.77 | 6.02 | 9.47 | 7.13 | 5.19 | 6.42 | 6.9 | | | | |
| NT2RM2000260 | 9.93 | 9.2 | 6.51 | 4.88 | 7.9 | 8.73 | 11.23 | 8.04 | 9.57 | | | | |
| NT2RM2000265 | 2.4 | 1.14 | 0.66 | 1.28 | 0.86 | 1.86 | 1.3 | 1.27 | 1.08 | | | | |
| NT2RM2000287 | 10.73 | 4.68 | 6.12 | 10.38 | 10.35 | 12.59 | 6.93 | 10.27 | 8.06 | | | | |
| NT2RM2000306 | 16.48 | 15.91 | 13.02 | 16.75 | 16.33 | 10.75 | 17.88 | 8.38 | 16.11 | | | | |
| NT2RM2000312 | 57.19 | 46.28 | 42.21 | 59.66 | 41.08 | 60.14 | 43.74 | 21.02 | 32.47 | | | | |
| NT2RM2000322 | 6.45 | 2.73 | 3.3 | 5.49 | 4.98 | 2.77 | 3.63 | 4.55 | 3.78 | | | | |
| NT2RM2000343 | 5.35 | 4.3 | 5.69 | 10.01 | 10.47 | 9.81 | 6.04 | 4.74 | 6.91 | ** | + | | |
| NT2RM2000359 | 5.94 | 2.73 | 3.95 | 5.3 | 4.77 | 4.66 | 3.08 | 3.35 | 2.77 | | | | |
| NT2RM2000362 | 15.37 | 16.06 | 11.14 | 15.03 | 19.07 | 17.41 | 12.3 | 11.08 | 9.04 | | | | |
| NT2RM2000363 | 2.27 | 1.12 | 1.53 | 3.15 | 1.57 | 1.39 | 1.27 | 1.95 | 1.06 | | | | |
| NT2RM2000368 | 20.14 | 10.44 | 9.67 | 11.84 | 14.77 | 11.87 | 10.3 | 9.5 | 10.03 | | | | |
| NT2RM2000371 | 111 | 74.6 | 73.79 | 116.3 | 62.15 | 121.3 | 50.3 | 42.75 | 56.01 | | | * | – |
| NT2RM2000374 | 4.78 | 2.52 | 1.94 | 6.65 | 5.32 | 5.42 | 4.66 | 3.93 | 3.68 | * | + | | |
| NT2RM2000387 | 11.91 | 6.37 | 5.79 | 20.24 | 13.27 | 20.63 | 9.51 | 12.58 | 11.14 | * | + | | |
| NT2RM2000393 | 3.45 | 1.01 | 1.83 | 2.71 | 1.61 | 3.18 | 1.81 | 3.53 | 1.53 | | | | |
| NT2RM2000395 | 1.44 | 0.49 | 0.91 | 2.24 | 0.76 | 1.26 | 1.08 | 2.52 | 0.72 | | | | |
| NT2RM2000402 | 7.26 | 1.87 | 2.95 | 6.33 | 6.77 | 7.71 | 5.51 | 6.64 | 5.38 | | | | |
| NT2RM2000405 | 5.34 | 2.42 | 2.76 | 3.26 | 3.78 | 4.88 | 2.25 | 2.56 | 2.19 | | | | |
| NT2RM2000407 | 19.34 | 9.57 | 10.6 | 5.59 | 9.51 | 9.38 | 8.65 | 7.51 | 10.04 | | | | |
| NT2RM2000410 | 3.06 | 1.14 | 0.97 | 2.09 | 2.96 | 2.28 | 2.57 | 1.94 | 2.16 | | | | |
| NT2RM2000420 | 4.52 | 1.56 | 1.71 | 6.72 | 7.81 | 5.85 | 4.96 | 3.72 | 3.6 | * | + | | |
| NT2RM2000422 | 14.32 | 4.96 | 7.79 | 15.68 | 12.45 | 9.99 | 14.38 | 10.45 | 10.29 | | | | |
| NT2RM2000423 | 3.93 | 2.29 | 3.18 | 9.3 | 10.31 | 11.58 | 4.01 | 3.67 | 2.37 | ** | + | | |
| NT2RM2000452 | 4.1 | 1.67 | 3.69 | 10.71 | 9.43 | 6.96 | 4.45 | 5.45 | 5.35 | ** | + | | |
| NT2RM2000469 | 1.22 | 0.59 | 0.27 | 2.22 | 1.54 | 1.32 | 1.52 | 1.06 | 1.82 | | | | |
| NT2RM2000490 | 4.98 | 2.59 | 1.93 | 4.39 | 4.04 | 3.10 | 5.95 | 3.52 | 4.92 | | | | |
| NT2RM2000497 | 2.77 | 1.77 | 1.58 | 7.44 | 5.74 | 5.87 | 2.86 | 3.26 | 4.3 | ** | + | | |
| NT2RM2000502 | 4.18 | 2.99 | 2.68 | 7.32 | 4.36 | 3.54 | 3.69 | 2.68 | 5.35 | | | | |
| NT2RM2000504 | 2.49 | 1.56 | 2.01 | 5.06 | 3.93 | 4.92 | 5.83 | 4.60 | 4.88 | ** | + | ** | + |
| NT2RM2000514 | 5.60 | 3.19 | 3.45 | 8.34 | 7.66 | 5.47 | 4.66 | 4.70 | 6.69 | | | | |
| NT2RM2000522 | 0.63 | 0.58 | 0.61 | 1.36 | 0.80 | 1.01 | 0.53 | 0.67 | 1.87 | | | | |
| NT2RM2000540 | 5.03 | 4.07 | 2.80 | 5.25 | 6.86 | 2.78 | 4.31 | 3.32 | 4.3 | | | | |
| NT2RM2000556 | 0.38 | 0.75 | 0.50 | 1.40 | 1.96 | 0.69 | 3.19 | 0.77 | 0.73 | | | | |
| NT2RM2000565 | 4.89 | 2.53 | 3.37 | 4.40 | 4.50 | 4.25 | 5.66 | 3.06 | 4.57 | | | | |
| NT2RM2000566 | 5.85 | 4.38 | 3.46 | 8.37 | 5.27 | 4.67 | 4.65 | 4.38 | 5.92 | | | | |
| NT2RM2000567 | 4.29 | 3.05 | 2.89 | 4.78 | 3.00 | 1.68 | 3.19 | 2.38 | 4.64 | | | | |
| NT2RM2000569 | 6.50 | 3.15 | 2.85 | 8.65 | 8.54 | 6.48 | 4.57 | 3.91 | 4.43 | | | | |
| NT2RM2000577 | 11.83 | 4.68 | 6.45 | 6.50 | 8.99 | 3.96 | 4.84 | 6.67 | 8.79 | | | | |
| NT2RM2000581 | 6.47 | 3.33 | 5.21 | 7.46 | 8.40 | 4.99 | 4.74 | 5.34 | 7.76 | | | | |
| NT2RM2000582 | 5.88 | 3.81 | 3.49 | 9.44 | 7.98 | 6.09 | 7.69 | 6.61 | 8.15 | * | + | * | + |
| NT2RM2000588 | 22.92 | 13.30 | 11.99 | 23.97 | 16.17 | 19.54 | 16.8 | 11.46 | 18.28 | | | | |
| NT2RM2000589 | 11.18 | 6.26 | 6.74 | 9.54 | 8.57 | 7.04 | 5.39 | 6.22 | 7.18 | | | | |
| NT2RM2000594 | 11.31 | 9.59 | 11.31 | 3.91 | 4.21 | 3.25 | 3.27 | 3.48 | 2.37 | ** | – | ** | – |
| NT2RM2000599 | 22.01 | 15.12 | 17.66 | 19.78 | 24.09 | 21.66 | 15.2 | 13.93 | 15.24 | | | | |
| NT2RM2000609 | 2.49 | 1.70 | 2.43 | 4.47 | 3.94 | 1.96 | 3.24 | 2.3 | 2.3 | * | + | | |
| NT2RM2000612 | 3.82 | 2.55 | 2.84 | 4.46 | 7.55 | 3.95 | 4.78 | 3.73 | 4.27 | | | | |
| NT2RM2000622 | 8.85 | 7.06 | 10.37 | 13.55 | 16.80 | 10.42 | 7.83 | 8.92 | 10.48 | | | | |
| NT2RM2000623 | 23.78 | 13.14 | 15.60 | 19.91 | 22.53 | 23.26 | 22.22 | 15.23 | 19.45 | | | | |
| NT2RM2000624 | 16.48 | 10.64 | 4.76 | 11.37 | 17.12 | 10.30 | 8.76 | 8.23 | 137.7 | | | | |

TABLE 223-continued

| | | | | | | | | | | | | | |
|---|---|---|---|---|---|---|---|---|---|---|---|---|---|
| NT2RM2000632 | 5.44 | 2.83 | 2.35 | 3.85 | 3.76 | 2.79 | 2.22 | 2.21 | 7.42 | | | | |
| NT2RM2000635 | 2.91 | 2.32 | 2.35 | 7.82 | 9.57 | 5.76 | 5 | 4.36 | 4.83 | ** | + | ** | + |
| NT2RM2000636 | 3.87 | 2.82 | 3.19 | 5.69 | 5.77 | 3.68 | 4.63 | 3.86 | 4.55 | | | | |
| NT2RM2000639 | 4.56 | 3.86 | 3.29 | 4.47 | 7.45 | 4.02 | 3.6 | 6.93 | 4.67 | | | | |
| NT2RM2000649 | 4.09 | 4.81 | 3.74 | 4.86 | 8.90 | 5.64 | 4.74 | 5.82 | 6.57 | | | | |

TABLE 224

| | | | | | | | | | | | | | |
|---|---|---|---|---|---|---|---|---|---|---|---|---|---|
| NT2RM2000658 | 7.80 | 7.19 | 11.39 | 10.12 | 9.62 | 7.80 | 6.87 | 5.57 | 7.23 | | | | |
| NT2RM2000660 | 27.64 | 11.87 | 13.50 | 20.31 | 25.06 | 18.91 | 13.54 | 13.65 | 15.55 | | | | |
| NT2RM2000669 | 7.79 | 4.71 | 4.17 | 9.97 | 13.43 | 8.55 | 3.67 | 4.50 | 6.66 | | | | |
| NT2RM2000689 | 29.82 | 30.60 | 28.82 | 42.51 | 72.34 | 55.67 | 22.11 | 19.71 | 38.62 | * | + | | |
| NT2RM2000691 | 4.67 | 3.54 | 3.74 | 5.23 | 6.41 | 4.14 | 4.29 | 3.98 | 4.19 | | | | |
| NT2RM2000714 | 13.27 | 8.60 | 10.19 | 9.82 | 10.81 | 9.42 | 13.37 | 9.65 | 17.53 | | | | |
| NT2RM2000718 | 1.36 | 1.54 | 1.09 | 3.28 | 7.10 | 3.02 | 2.42 | 2.48 | 2.19 | | | ** | + |
| NT2RM2000732 | 6.10 | 4.20 | 5.69 | 12.72 | 15.74 | 11.49 | 5.7 | 6.42 | 7.79 | ** | + | | |
| NT2RM2000735 | 24.38 | 15.21 | 20.46 | 56.19 | 49.62 | 47.05 | 16.37 | 24.66 | 27.14 | ** | + | | |
| NT2RM2000740 | 6.48 | 2.95 | 2.62 | 6.53 | 5.49 | 3.44 | 3.93 | 3.46 | 2.74 | | | | |
| NT2RM2000743 | 21.35 | 12.67 | 14.35 | 10.73 | 9.73 | 9.68 | 2.24 | 1.81 | 2.16 | | | ** | − |
| NT2RM2000772 | 11.89 | 7.81 | 9.52 | 17.15 | 14.77 | 14.45 | 6.23 | 7.95 | 10.31 | * | + | | |
| NT2RM2000773 | 11.75 | 6.40 | 6.69 | 9.73 | 11.32 | 9.29 | 9.82 | 8.51 | 8.01 | | | | |
| NT2RM2000776 | 12.66 | 6.48 | 11.36 | 17.08 | 19.56 | 14.42 | 12.22 | 8.19 | 11.56 | * | + | | |
| NT2RM2000784 | 11.22 | 7.09 | 6.83 | 7.88 | 10.63 | 6.42 | 6.22 | 6.90 | 7.64 | | | | |
| NT2RM2000795 | 9.52 | 5.29 | 6.34 | 17.74 | 18.61 | 15.80 | 6.53 | 8.43 | 10.09 | ** | + | | |
| NT2RM2000796 | 27.57 | 17.52 | 26.46 | 2.02 | 2.40 | 3.17 | 1.82 | 2.65 | 1.66 | ** | − | ** | − |
| NT2RM2000798 | 14.84 | 8.16 | 10.91 | 45.29 | 27.47 | 24.14 | 26.69 | 20.97 | 28.82 | * | + | ** | + |
| NT2RM2000801 | 37.70 | 23.20 | 28.38 | 26.35 | 37.85 | 28.51 | 31.37 | 32.22 | 38.5 | | | | |
| NT2RM2000821 | 3.67 | 2.04 | 2.27 | 8.85 | 6.90 | 6.15 | 5.86 | 5.63 | 5.4 | ** | + | ** | + |
| NT2RM2000829 | 36.66 | 22.85 | 41.47 | 29.93 | 25.94 | 16.17 | 15.48 | 17.92 | 19.23 | | | | |
| NT2RM2000837 | 5.77 | 3.15 | 3.99 | 6.12 | 6.76 | 5.46 | 5.15 | 4.55 | 4.39 | | | | |
| NT2RM2000924 | 6.69 | 5.13 | 4.70 | 12.18 | 14.72 | 8.21 | 5.5 | 6.80 | 8.89 | * | + | | |
| NT2RM2000930 | 14.27 | 7.36 | 9.58 | 15.72 | 15.41 | 13.15 | 7.93 | 7.73 | 11.49 | | | | |
| NT2RM2000937 | 2.93 | 2.09 | 3.52 | 5.00 | 4.64 | 3.14 | 1.89 | 3.58 | 2.8 | | | | |
| NT2RM2000939 | 6.56 | 3.88 | 4.32 | 5.94 | 7.25 | 6.23 | 4.34 | 5.73 | 5.56 | | | | |
| NT2RM2000942 | 141.00 | 79.29 | 113.17 | 107.50 | 122.19 | 108.41 | 73.07 | 66.91 | 67.18 | | | | |
| NT2RM2000951 | 4.09 | 2.69 | 2.78 | 3.88 | 3.40 | 4.39 | 3.48 | 3.83 | 3.33 | | | | |
| NT2RM2000952 | 5.14 | 3.58 | 3.50 | 6.02 | 4.82 | 4.48 | 3.55 | 3.67 | 3.9 | | | | |
| NT2RM2000966 | 11.75 | 10.12 | 10.87 | 9.00 | 11.41 | 11.06 | 9.18 | 10.30 | 5.82 | | | | |
| NT2RM2000973 | 22.49 | 16.16 | 17.58 | 24.24 | 28.57 | 21.97 | 14.32 | 17.17 | 15.94 | | | | |
| NT2RM2000983 | 10.51 | 6.87 | 10.06 | 15.15 | 16.05 | 11.81 | 9.62 | 13.40 | 12.47 | * | + | | |
| NT2RM2000984 | 3.34 | 2.49 | 1.94 | 4.17 | 6.33 | 3.91 | 3.14 | 3.09 | 3.89 | | | | |
| NT2RM2000994 | 17.72 | 5.91 | 15.58 | 25.00 | 22.32 | 16.64 | 8.13 | 8.32 | 6.15 | | | | |
| NT2RM2001004 | 6.95 | 4.49 | 3.43 | 6.09 | 8.10 | 5.86 | 5.16 | 4.92 | 6.83 | | | | |
| NT2RM2001022 | 113.50 | 66.21 | 87.63 | 148.44 | 181.02 | 157.90 | 78.72 | 73.28 | 91.6 | * | + | | |
| NT2RM2001035 | 10.78 | 6.86 | 10.47 | 14.95 | 15.69 | 13.90 | 7.29 | 8.73 | 9.42 | * | + | | |
| NT2RM2001038 | 4.09 | 2.22 | 2.89 | 6.55 | 5.43 | 6.97 | 3.62 | 3.51 | 3.32 | * | + | | |
| NT2RM2001043 | 2.10 | 1.71 | 2.70 | 4.88 | 5.53 | 4.13 | 3.52 | 4.59 | 4.54 | ** | + | * | + |
| NT2RM2001050 | 8.66 | 4.61 | 6.50 | 7.54 | 9.45 | 9.85 | 5.61 | 5.16 | 6.52 | | | | |
| NT2RM2001055 | 4.62 | 4.14 | 3.41 | 6.16 | 5.15 | 5.46 | 4.13 | 4.67 | 4.8 | * | + | | |
| NT2RM2001065 | 6.07 | 2.63 | 3.08 | 8.01 | 7.85 | 5.22 | 3.46 | 3.40 | 2.98 | | | | |
| NT2RM2001075 | 101.53 | 60.27 | 56.87 | 59.75 | 60.87 | 48.63 | 40.45 | 36.79 | 33.7 | | | | |
| NT2RM2001083 | 13.68 | 8.75 | 8.30 | 8.28 | 9.63 | 7.55 | 10.14 | 7.92 | 7.18 | | | | |
| NT2RM2001100 | 8.62 | 6.13 | 5.38 | 7.77 | 11.80 | 7.92 | 8.12 | 5.53 | 6.12 | | | | |
| NT2RM2001105 | 18.36 | 12.31 | 11.09 | 26.95 | 28.47 | 25.34 | 13.8 | 13.76 | 12.91 | ** | + | | |
| NT2RM2001109 | 5.91 | 3.28 | 4.91 | 5.36 | 6.02 | 5.10 | 4.49 | 5.78 | 4.86 | | | | |
| NT2RM2001110 | 9.13 | 5.14 | 5.81 | 7.93 | 9.23 | 8.95 | 5.5 | 5.40 | 7.45 | | | | |
| NT2RM2001126 | 4.23 | 4.04 | 4.69 | 10.78 | 10.09 | 7.28 | 4.72 | 4.73 | 5.55 | ** | + | | |
| NT2RM2001131 | 9.35 | 4.34 | 5.26 | 6.74 | 7.12 | 6.44 | 4.76 | 4.21 | 3.9 | | | | |
| NT2RM2001141 | 9.27 | 7.43 | 7.38 | 17.22 | 17.01 | 12.50 | 8.53 | 7.69 | 8.62 | * | + | | |
| NT2RM2001152 | 3.64 | 1.47 | 1.46 | 2.09 | 3.47 | 2.45 | 1.42 | 1.89 | 2.81 | | | | |
| NT2RM2001177 | 8.38 | 4.92 | 5.00 | 10.70 | 11.58 | 8.68 | 5.53 | 6.90 | 6.04 | * | + | | |
| NT2RM2001194 | 10.76 | 6.38 | 8.60 | 11.33 | 15.08 | 9.90 | 8.38 | 9.20 | 9.42 | | | | |
| NT2RM2001195 | 3.62 | 3.00 | 3.18 | 4.85 | 7.13 | 3.67 | 3.45 | 3.91 | 3.64 | | | | |
| NT2RM2001196 | 7.18 | 4.57 | 6.50 | 10.22 | 17.76 | 12.85 | 4.98 | 6.12 | 9.71 | * | + | | |

TABLE 225

| | | | | | | | | | | | | | |
|---|---|---|---|---|---|---|---|---|---|---|---|---|---|
| NT2RM2001201 | 13.08 | 8.55 | 9.63 | 10.72 | 11.46 | 9.31 | 8.37 | 10.02 | 9.79 | | | | |
| NT2RM2001221 | 6.92 | 2.79 | 3.15 | 5.91 | 7.22 | 4.72 | 4.61 | 5.13 | 3.98 | | | | |
| NT2RM2001238 | 2.81 | 1.05 | 1.43 | 3.40 | 2.72 | 2.10 | 1.81 | 2.65 | 3.37 | | | | |
| NT2RM2001243 | 6.98 | 4.99 | 5.16 | 9.29 | 9.00 | 6.32 | 4.34 | 5.08 | 4.64 | | | | |
| NT2RM2001244 | 4.98 | 5.59 | 4.41 | 14.49 | 19.11 | 7.34 | 5.11 | 6.41 | 7.87 | | | | |
| NT2RM2001247 | 15.41 | 9.79 | 11.87 | 12.82 | 15.98 | 10.20 | 6.66 | 8.32 | 9.67 | | | | |
| NT2RM2001256 | 2.93 | 2.70 | 3.12 | 2.39 | 2.54 | 2.02 | 2.24 | 3.49 | 2.22 | * | − | | |

TABLE 225-continued

| | | | | | | | | | | | | | |
|---|---|---|---|---|---|---|---|---|---|---|---|---|---|
| NT2RM2001269 | 1.76 | 1.73 | 1.47 | 3.07 | 6.49 | 3.10 | 1.39 | 5.05 | 2.29 | | | | |
| NT2RM2001278 | 7.64 | 6.14 | 6.38 | 12.27 | 11.97 | 10.88 | 6.39 | 7.92 | 7.27 | ** | + | | |
| NT2RM2001291 | 4.14 | 2.35 | 1.90 | 4.62 | 4.03 | 2.79 | 3.65 | 2.48 | 3.16 | | | | |
| NT2RM2001294 | 10.67 | 6.20 | 5.16 | 12.58 | 9.68 | 9.06 | 8.36 | 5.49 | 6.33 | | | | |
| NT2RM2001295 | 4.70 | 3.78 | 3.23 | 5.43 | 4.66 | 4.21 | 4.46 | 4.14 | 4.92 | | | | |
| NT2RM2001302 | 5.63 | 4.69 | 4.19 | 1.74 | 2.61 | 0.97 | 2.97 | 3.64 | 4.24 | ** | − | | |
| NT2RM2001306 | 2.52 | 1.56 | 1.39 | 3.47 | 5.32 | 4.74 | 2.64 | 2.44 | 2.72 | * | + | | |
| NT2RM2001312 | 1.22 | 1.12 | 0.35 | 2.84 | 2.71 | 1.41 | 1.03 | 2.09 | 1.77 | | | | |
| NT2RM2001319 | 5.09 | 3.21 | 4.08 | 5.71 | 5.46 | 5.01 | 3.84 | 5.43 | 5.66 | | | | |
| NT2RM2001324 | 8.85 | 3.42 | 3.83 | 7.05 | 8.29 | 8.06 | 5.36 | 6.31 | 4.89 | | | | |
| NT2RM2001345 | 12.36 | 6.03 | 4.96 | 4.58 | 10.06 | 7.26 | 10.14 | 5.50 | 8.05 | | | | |
| NT2RM2001360 | 9.69 | 4.48 | 4.35 | 8.36 | 5.80 | 5.82 | 6.45 | 4.63 | 6.16 | | | | |
| NT2RM2001370 | 1.53 | 1.04 | 0.81 | 1.70 | 1.86 | 1.18 | 1.6 | 2.44 | 2.47 | | | * | + |
| NT2RM2001391 | 1.02 | 1.38 | 1.05 | 3.81 | 3.30 | 1.71 | 1.72 | 1.73 | 1.75 | * | + | ** | + |
| NT2RM2001393 | 6.61 | 4.78 | 7.01 | 5.53 | 6.68 | 4.32 | 4.86 | 4.39 | 4.92 | | | | |
| NT2RM2001420 | 2.35 | 0.95 | 1.41 | 3.00 | 4.15 | 1.59 | 1.98 | 2.45 | 1.71 | | | | |
| NT2RM2001423 | 11.93 | 5.27 | 6.94 | 5.59 | 7.80 | 3.34 | 2.15 | 4.14 | 4.71 | | | | |
| NT2RM2001424 | 18.20 | 9.15 | 9.42 | 11.35 | 10.96 | 8.30 | 11.11 | 9.35 | 12.67 | | | | |
| NT2RM2001482 | 15.21 | 7.55 | 7.78 | 14.57 | 12.13 | 9.92 | 11.31 | 8.31 | 11.15 | | | | |
| NT2RM2001499 | 16.92 | 9.02 | 7.05 | 8.26 | 6.45 | 6.32 | 5.19 | 4.43 | 7.42 | | | | |
| NT2RM2001504 | 3.91 | 2.51 | 1.97 | 4.23 | 4.34 | 3.86 | 4.03 | 2.84 | 4.42 | | | | |
| NT2RM2001524 | 2.28 | 1.47 | 1.87 | 2.95 | 3.08 | 2.80 | 2.63 | 3.34 | 2.29 | * | + | | |
| NT2RM2001530 | 0.78 | 0.43 | 0.54 | 2.16 | 2.44 | 1.43 | 1.65 | 1.93 | 1.93 | * | + | ** | + |
| NT2RM2001533 | 5.77 | 3.13 | 3.08 | 6.59 | 7.98 | 5.62 | 5.57 | 5.84 | 5.16 | | | | |
| NT2RM2001540 | 29.91 | 19.29 | 20.03 | 25.11 | 24.66 | 12.51 | 8.93 | 9.56 | 11.82 | | | * | − |
| NT2RM2001544 | 5.22 | 2.70 | 2.16 | 5.77 | 5.72 | 5.39 | 4.13 | 3.93 | 3.57 | | | | |
| NT2RM2001547 | 10.18 | 3.47 | 3.29 | 5.82 | 9.93 | 4.61 | 8.42 | 7.52 | 11.22 | | | | |
| NT2RM2001558 | 4.96 | 2.25 | 2.36 | 3.07 | 3.85 | 4.04 | 4.67 | 2.71 | 4.49 | | | | |
| NT2RM2001575 | 4.76 | 2.31 | 3.04 | 7.85 | 7.43 | 4.47 | 3.66 | 3.23 | 5.49 | | | | |
| NT2RM2001582 | 3.25 | 3.39 | 2.40 | 5.42 | 5.69 | 4.66 | 5.53 | 3.88 | 4.63 | ** | + | * | + |
| NT2RM2001588 | 2.97 | 1.41 | 1.47 | 4.20 | 4.38 | 3.50 | 3.05 | 3.37 | 3.85 | * | + | | |
| NT2RM2001592 | 1.95 | 2.06 | 1.67 | 3.66 | 3.58 | 2.66 | 2.98 | 2.38 | 2.72 | * | + | * | + |
| NT2RM2001603 | 7.68 | 4.12 | 5.42 | 8.07 | 9.92 | 5.79 | 4.3 | 6.45 | 7.62 | | | | |
| NT2RM2001605 | 6.36 | 3.57 | 2.87 | 8.10 | 9.32 | 7.63 | 6.11 | 4.82 | 7.04 | * | + | | |
| NT2RM2001611 | 4.43 | 2.58 | 2.01 | 5.92 | 8.58 | 4.85 | 5.15 | 3.69 | 4.23 | | | | |
| NT2RM2001613 | 5.87 | 2.94 | 3.70 | 6.48 | 9.87 | 7.29 | 8.01 | 9.10 | 11.64 | | | * | + |
| NT2RM2001626 | 11.27 | 5.06 | 6.34 | 7.63 | 9.90 | 5.32 | 10.52 | 8.42 | 10.76 | | | | |
| NT2RM2001632 | 8.60 | 4.62 | 8.41 | 12.48 | 14.32 | 11.43 | 11.18 | 11.01 | 12.96 | * | + | * | + |
| NT2RM2001633 | 1.62 | 1.36 | 1.29 | 4.23 | 3.15 | 3.36 | 2.92 | 3.34 | 2.97 | ** | + | ** | + |
| NT2RM2001635 | 6.76 | 5.69 | 4.97 | 6.78 | 9.41 | 8.26 | 7.11 | 8.37 | 8.13 | | | * | + |
| NT2RM2001636 | 4.43 | 3.06 | 3.83 | 4.52 | 5.10 | 3.16 | 3.81 | 3.42 | 3.49 | | | | |
| NT2RM2001637 | 2.79 | 1.78 | 2.31 | 4.20 | 4.67 | 2.96 | 3.03 | 3.93 | 2.28 | * | + | | |
| NT2RM2001639 | 4.58 | 2.65 | 2.19 | 3.05 | 3.54 | 3.49 | 2.88 | 2.16 | 3.34 | | | | |
| NT2RM2001641 | 3.30 | 2.69 | 1.81 | 2.72 | 3.01 | 1.92 | 1.93 | 2.95 | 2.91 | | | | |
| NT2RM2001643 | 3.00 | 1.41 | 2.34 | 4.92 | 3.73 | 2.89 | 3.15 | 3.35 | 3.43 | | | | |
| NT2RM2001648 | 3.60 | 1.94 | 2.50 | 5.96 | 6.92 | 4.37 | 6.52 | 6.11 | 8.21 | * | + | ** | + |
| NT2RM2001652 | 4.13 | 2.45 | 1.80 | 4.68 | 5.72 | 3.86 | 2.23 | 2.96 | 4.29 | | | | |
| NT2RM2001659 | 1.81 | 1.41 | 1.26 | 2.31 | 1.88 | 1.34 | 2.02 | 2.75 | 2.32 | | | * | + |
| NT2RM2001660 | 2.12 | 1.41 | 1.99 | 2.87 | 4.60 | 2.23 | 2.13 | 3.03 | 3.35 | | | | |

TABLE 226

| | | | | | | | | | | | | | |
|---|---|---|---|---|---|---|---|---|---|---|---|---|---|
| NT2RM2001664 | 5.67 | 1.74 | 2.53 | 4.44 | 5.25 | 4.88 | 2.57 | 2.77 | 3.63 | | | | |
| NT2RM2001668 | 7.83 | 4.11 | 5.80 | 12.91 | 11.03 | 10.32 | 6.9 | 5.64 | 6.89 | * | + | | |
| NT2RM2001670 | 5.07 | 2.93 | 3.57 | 4.21 | 4.81 | 3.14 | 3.67 | 3.52 | 4.76 | | | | |
| NT2RM2001671 | 2.26 | 2.13 | 2.75 | 6.03 | 4.05 | 5.74 | 4.08 | 5.29 | 5.9 | * | + | ** | + |
| NT2RM2001675 | 0.53 | 0.71 | 0.81 | 1.96 | 1.15 | 1.66 | 0.84 | 1.96 | 0.76 | * | + | | |
| NT2RM2001681 | 1.11 | 1.22 | 1.01 | 3.34 | 4.29 | 2.27 | 1.69 | 3.16 | 1.72 | * | + | | |
| NT2RM2001685 | 3.03 | 2.26 | 1.29 | 2.06 | 2.47 | 1.90 | 1.92 | 3.02 | 2.65 | | | | |
| NT2RM2001688 | 2.78 | 1.66 | 2.54 | 4.45 | 4.23 | 2.30 | 3.29 | 2.37 | 2.72 | | | | |
| NT2RM2001695 | 7.30 | 3.32 | 3.64 | 20.95 | 20.35 | 18.16 | 12.07 | 10.51 | 12.36 | ** | + | ** | + |
| NT2RM2001696 | 13.28 | 6.12 | 3.86 | 8.81 | 10.82 | 9.78 | 6.65 | 6.44 | 6.65 | | | | |
| NT2RM2001698 | 8.16 | 4.37 | 3.88 | 5.88 | 6.34 | 6.37 | 6.66 | 7.84 | 6.65 | | | | |
| NT2RM2001699 | 2.40 | 2.32 | 1.42 | 3.33 | 3.59 | 3.21 | 1.64 | 3.47 | 3.24 | * | + | | |
| NT2RM2001700 | 2.41 | 1.38 | 1.03 | 2.93 | 2.03 | 1.36 | 1.5 | 2.70 | 2.35 | | | | |
| NT2RM2001704 | 6.94 | 4.34 | 5.63 | 17.99 | 22.84 | 16.16 | 12.13 | 13.06 | 13.82 | ** | + | ** | + |
| NT2RM2001706 | 5.19 | 2.60 | 4.07 | 6.98 | 8.64 | 6.26 | 3.29 | 5.55 | 5.04 | * | + | | |
| NT2RM2001714 | 1.72 | 1.75 | 2.15 | 3.05 | 3.64 | 2.23 | 1.71 | 2.86 | 4.84 | | | | |
| NT2RM2001716 | 16.89 | 6.66 | 8.99 | 10.52 | 14.37 | 8.33 | 10.03 | 10.20 | 4.62 | | | | |
| NT2RM2001718 | 13.66 | 7.01 | 6.41 | 14.04 | 11.83 | 11.25 | 5.12 | 7.15 | 10.53 | | | | |
| NT2RM2001723 | 6.13 | 3.06 | 3.78 | 9.65 | 9.89 | 7.73 | 4.12 | 5.35 | 3.42 | * | + | | |
| NT2RM2001727 | 5.93 | 4.01 | 4.52 | 4.87 | 5.62 | 5.99 | 5.45 | 6.14 | 6.96 | | | | |
| NT2RM2001730 | 3.02 | 1.57 | 1.66 | 3.08 | 3.68 | 4.44 | 2.79 | 3.79 | 2.6 | | | | |
| NT2RM2001738 | 6.78 | 3.40 | 5.60 | 4.93 | 5.41 | 3.52 | 4.55 | 4.50 | 4.55 | | | | |
| NT2RM2001743 | 4.12 | 2.65 | 1.97 | 3.64 | 5.10 | 2.62 | 3.21 | 3.25 | 2.82 | | | | |
| NT2RM2001753 | 4.87 | 2.89 | 3.87 | 7.06 | 7.68 | 7.46 | 4.96 | 5.77 | 5.73 | ** | + | | |

TABLE 226-continued

| | | | | | | | | | | | | |
|---|---|---|---|---|---|---|---|---|---|---|---|---|
| NT2RM2001755 | 11.15 | 5.43 | 7.63 | 8.83 | 12.50 | 9.88 | 7.94 | 7.72 | 5.34 | | | |
| NT2RM2001760 | 6.52 | 3.36 | 4.22 | 8.42 | 9.37 | 6.40 | 10.28 | 9.84 | 11.76 | ** | + | |
| NT2RM2001765 | 2.13 | 1.98 | 1.79 | 3.23 | 3.97 | 3.48 | 2.65 | 2.41 | 2.82 | ** | + | * | +
| NT2RM2001767 | 12.87 | 8.82 | 9.72 | 11.08 | 15.03 | 8.12 | 9.19 | 9.22 | 14.64 | | | |
| NT2RM2001768 | 3.41 | 2.58 | 3.68 | 3.47 | 6.28 | 4.04 | 2.49 | 2.74 | 3.01 | | | |
| NT2RM2001771 | 4.11 | 3.62 | 4.50 | 11.05 | 14.86 | 9.39 | 5.06 | 5.82 | 8.71 | ** | + | |
| NT2RM2001778 | 1.70 | 1.61 | 1.19 | 3.14 | 4.69 | 2.67 | 2.01 | 2.74 | 1.97 | * | + | |
| NT2RM2001782 | 3.37 | 2.78 | 3.39 | 3.01 | 4.59 | 4.13 | 3.83 | 4.97 | 5.07 | | | * | +
| NT2RM2001784 | 3.64 | 1.97 | 1.45 | 2.55 | 4.38 | 1.85 | 2.15 | 2.16 | 2.26 | | | |
| NT2RM2001785 | 11.40 | 5.25 | 4.67 | 8.49 | 7.03 | 6.72 | 4.99 | 4.72 | 4.92 | | | |
| NT2RM2001792 | 5.79 | 3.39 | 4.17 | 6.69 | 5.40 | 4.24 | 3.59 | 5.22 | 5.39 | | | |
| NT2RM2001795 | 9.85 | 4.56 | 3.32 | 7.91 | 9.48 | 5.77 | 7.27 | 6.25 | 5.93 | | | |
| NT2RM2001797 | 5.04 | 2.64 | 2.13 | 7.82 | 15.93 | 10.34 | 3.54 | 4.95 | 3.54 | * | + | |
| NT2RM2001800 | 3.26 | 2.51 | 2.46 | 4.20 | 4.38 | 3.21 | 2.99 | 3.72 | 2.42 | | | |
| NT2RM2001803 | 3.60 | 2.31 | 2.65 | 4.14 | 6.89 | 5.00 | 2.04 | 3.10 | 3.17 | | | |
| NT2RM2001805 | 1.03 | 0.92 | 2.17 | 2.21 | 3.99 | 1.67 | 0.87 | 3.16 | 1.79 | | | |
| NT2RM2001806 | 5.77 | 1.94 | 1.66 | 4.46 | 3.73 | 2.85 | 3.42 | 3.44 | 3.44 | | | |
| NT2RM2001813 | 3.38 | 1.75 | 1.74 | 2.55 | 3.99 | 2.42 | 1.83 | 1.59 | 3.71 | | | |
| NT2RM2001814 | 3.09 | 1.71 | 2.83 | 3.06 | 4.28 | 2.96 | 1.96 | 3.02 | 3.47 | | | |
| NT2RM2001818 | 2.38 | 1.33 | 1.54 | 3.40 | 2.50 | 2.32 | 1.89 | 3.32 | 1.89 | | | |
| NT2RM2001823 | 1.26 | 1.12 | 0.39 | 0.95 | 1.88 | 0.91 | 0.96 | 2.06 | 1.08 | | | |
| NT2RM2001825 | 10.44 | 6.78 | 7.32 | 10.86 | 11.22 | 8.43 | 10.54 | 16.17 | 16.27 | | | * | +
| NT2RM2001832 | 4.52 | 2.18 | 1.93 | 4.11 | 5.31 | 3.71 | 1.98 | 4.92 | 3.68 | | | |
| NT2RM2001839 | 16.50 | 9.01 | 12.64 | 20.38 | 24.01 | 12.42 | 26.45 | 40.89 | 49.99 | | | * | +
| NT2RM2001840 | 7.75 | 3.07 | 2.83 | 17.33 | 13.18 | 10.65 | 7.84 | 6.84 | 7.97 | * | + | |
| NT2RM2001851 | 7.34 | 4.30 | 5.43 | 12.87 | 13.61 | 10.39 | 7.97 | 4.60 | 6.49 | ** | + | |
| NT2RM2001855 | 5.55 | 3.48 | 2.68 | 4.96 | 5.56 | 4.20 | 7.12 | 5.33 | 6.29 | | | |
| NT2RM2001867 | 3.35 | 3.93 | 2.06 | 5.68 | 4.49 | 3.19 | 3.59 | 2.29 | 4.09 | | | |
| NT2RM2001869 | 28.84 | 23.52 | 26.51 | 34.13 | 35.79 | 25.24 | 15.38 | 12.75 | 18.43 | | | ** | −
| NT2RM2001879 | 0.65 | 1.04 | 0.48 | 2.26 | 1.68 | 1.53 | 1.35 | 1.12 | 1.72 | * | + | * | +
| NT2RM2001883 | 3.25 | 3.47 | 2.90 | 9.89 | 19.82 | 12.52 | 5.43 | 4.02 | 7.24 | * | + | |
| NT2RM2001886 | 2.86 | 1.25 | 2.11 | 3.84 | 5.06 | 2.09 | 1.79 | 1.91 | 1.93 | | | |

TABLE 227

| | | | | | | | | | | | | |
|---|---|---|---|---|---|---|---|---|---|---|---|---|
| NT2RM2001887 | 4.05 | 2.53 | 2.07 | 3.94 | 3.93 | 2.72 | 2.74 | 2.00 | 2.87 | | | |
| NT2RM2001896 | 968.51 | 557.14 | 625.69 | 446.49 | 419.99 | 290.65 | 817.5 | 613.90 | 955.7 | | | |
| NT2RM2001902 | 1.32 | 1.09 | 1.03 | 2.63 | 3.33 | 2.08 | 2.5 | 1.84 | 1.37 | * | + | |
| NT2RM2001903 | 10.52 | 8.17 | 6.65 | 10.52 | 9.78 | 8.75 | 7 | 6.78 | 10.05 | | | |
| NT2RM2001930 | 5.61 | 3.44 | 3.21 | 5.48 | 6.96 | 3.46 | 4.44 | 4.85 | 6 | | | |
| NT2RM2001935 | 3.82 | 1.91 | 1.54 | 3.50 | 4.79 | 3.97 | 2.7 | 3.75 | 4.62 | | | |
| NT2RM2001936 | 5.82 | 4.45 | 4.35 | 6.11 | 7.15 | 5.56 | 4.64 | 4.90 | 5.38 | | | |
| NT2RM2001939 | 8.71 | 5.44 | 6.44 | 8.93 | 8.81 | 3.78 | 2.77 | 3.30 | 4.35 | | | * | −
| NT2RM2001941 | 6.75 | 2.80 | 2.92 | 6.78 | 5.32 | 3.44 | 5.9 | 3.69 | 5.46 | | | |
| NT2RM2001950 | 7.11 | 3.51 | 4.45 | 5.50 | 5.26 | 4.20 | 5.45 | 4.64 | 5.47 | | | |
| NT2RM2001952 | 2.47 | 1.60 | 2.55 | 2.69 | 4.21 | 2.27 | 1.88 | 1.01 | 2.57 | | | |
| NT2RM2001976 | 28.42 | 15.82 | 19.71 | 28.96 | 35.93 | 24.29 | 16.42 | 13.99 | 23.68 | | | |
| NT2RM2001982 | 4.42 | 1.68 | 2.40 | 3.83 | 3.46 | 2.37 | 2.4 | 2.21 | 2.73 | | | |
| NT2RM2001983 | 2.90 | 2.45 | 2.37 | 3.29 | 3.84 | 2.68 | 3.58 | 3.72 | 3.62 | ** | + | |
| NT2RM2001984 | 9.80 | 5.19 | 8.10 | 8.76 | 9.27 | 5.57 | 9.18 | 6.75 | 8.16 | | | |
| NT2RM2001989 | 11.11 | 6.20 | 6.87 | 11.27 | 9.42 | 7.93 | 6.29 | 5.35 | 7.09 | | | |
| NT2RM2001996 | 14.80 | 9.47 | 8.75 | 13.23 | 9.98 | 7.81 | 6.58 | 6.93 | 7.66 | | | |
| NT2RM2001997 | 6.28 | 4.07 | 2.81 | 7.04 | 8.03 | 5.28 | 7.41 | 5.47 | 7.79 | | | |
| NT2RM2001998 | 4.75 | 3.45 | 3.00 | 4.75 | 6.36 | 4.13 | 5.37 | 3.71 | 5.85 | | | |
| NT2RM2001999 | 10.41 | 5.56 | 7.08 | 6.38 | 11.36 | 7.48 | 5.73 | 5.79 | 10.27 | | | |
| NT2RM2002003 | 10.66 | 5.49 | 8.27 | 9.09 | 11.29 | 8.39 | 10.04 | 6.40 | 24.73 | | | |
| NT2RM2002004 | 1.63 | 1.64 | 2.11 | 1.09 | 1.63 | 1.85 | 1.23 | 1.86 | 1.25 | | | |
| NT2RM2002009 | 4.47 | 4.69 | 3.31 | 8.66 | 11.16 | 6.73 | 5.88 | 6.79 | 8.4 | * | + | * | +
| NT2RM2002014 | 2.01 | 1.63 | 2.37 | 3.01 | 3.07 | 2.13 | 1.7 | 1.98 | 2.36 | | | |
| NT2RM2002019 | 24.72 | 12.04 | 19.38 | 13.08 | 13.17 | 13.22 | 11.49 | 8.63 | 11.15 | | | |
| NT2RM2002029 | 6.40 | 7.22 | 6.06 | 8.84 | 11.57 | 6.10 | 8.68 | 6.47 | 10.53 | | | |
| NT2RM2002030 | 5.25 | 5.14 | 4.68 | 5.36 | 8.72 | 3.88 | 5.86 | 5.43 | 6.29 | | | |
| NT2RM2002034 | 8.15 | 6.62 | 4.89 | 14.77 | 20.00 | 13.04 | 13.54 | 8.03 | 15.03 | * | + | |
| NT2RM2002049 | 3.95 | 2.79 | 2.89 | 4.72 | 8.26 | 6.22 | 5.53 | 3.64 | 6.92 | * | + | |
| NT2RM2002055 | 0.27 | 0.82 | 0.37 | 0.80 | 1.13 | 1.85 | 1.04 | 1.68 | 0.63 | | | |
| NT2RM2002072 | 15.43 | 11.44 | 16.71 | 17.13 | 17.10 | 21.32 | 19.05 | 15.56 | 22.41 | | | |
| NT2RM2002088 | 7.49 | 4.56 | 5.69 | 7.90 | 6.52 | 5.70 | 5.75 | 6.67 | 7.06 | | | |
| NT2RM2002091 | 15.11 | 10.25 | 9.22 | 22.42 | 19.93 | 19.66 | 8.6 | 12.53 | 10.62 | * | + | |
| NT2RM2002100 | 4.63 | 3.56 | 2.83 | 7.24 | 10.07 | 3.66 | 3.27 | 4.23 | 5.16 | | | |
| NT2RM2002109 | 5.17 | 3.65 | 3.18 | 8.12 | 10.78 | 4.99 | 4.99 | 4.26 | 6.51 | | | |
| NT2RM2002126 | 17.67 | 11.99 | 12.06 | 15.99 | 24.43 | 15.73 | 17.49 | 13.92 | 19.27 | | | |
| NT2RM2002128 | 3.48 | 2.83 | 1.99 | 3.84 | 5.46 | 3.66 | 3.24 | 2.92 | 3.02 | | | |
| NT2RM2002129 | 4.13 | 2.91 | 3.80 | 6.20 | 6.87 | 4.06 | 5.78 | 4.67 | 7.21 | | | |
| NT2RM2002142 | 9.10 | 5.41 | 12.04 | 10.00 | 15.48 | 9.23 | 8.42 | 6.45 | 11.18 | | | |
| NT2RM2002144 | 3.36 | 3.30 | 2.97 | 3.37 | 3.35 | 3.00 | 3.79 | 3.97 | 3.53 | | | * | +
| NT2RM2002145 | 6.78 | 4.33 | 5.19 | 6.26 | 8.85 | 5.46 | 5.35 | 5.34 | 6.65 | | | |

TABLE 227-continued

| | | | | | | | | | | | | |
|---|---|---|---|---|---|---|---|---|---|---|---|---|
| NT2RM2002153 | 23.74 | 16.73 | 21.12 | 12.42 | 16.25 | 18.91 | 6.63 | 5.66 | 6.16 | | ** | − |
| NT2RM2002163 | 3.16 | 2.77 | 2.30 | 3.73 | 2.93 | 2.52 | 3.34 | 5.43 | 2.91 | | | |
| NT2RM2002170 | 3.33 | 3.09 | 3.14 | 5.55 | 7.02 | 5.69 | 2.89 | 3.62 | 2.63 | ** | + | |
| NT2RM2002178 | 5.79 | 2.91 | 3.21 | 5.77 | 6.57 | 4.62 | 3.87 | 4.53 | 5.9 | | | |
| NT2RM2002179 | 2.75 | 2.13 | 3.45 | 13.46 | 15.53 | 10.86 | 9.37 | 9.17 | 14.68 | ** | + | * | + |
| NT2RM2002270 | 6.01 | 3.32 | 3.61 | 5.54 | 5.51 | 3.68 | 4.91 | 5.60 | 3.82 | | | |
| NT2RM2002326 | 3.03 | 1.98 | 3.43 | 11.14 | 9.52 | 7.64 | 7.73 | 8.34 | 6.08 | ** | + | ** | + |
| NT2RM2002337 | 4.10 | 3.34 | 2.03 | 4.41 | 8.58 | 3.20 | 3.05 | 2.79 | 3.57 | | | |
| NT2RM2002339 | 7.43 | 4.86 | 4.58 | 4.19 | 4.70 | 6.27 | 6.54 | 7.31 | 8.68 | | | |
| NT2RM2002345 | 4.47 | 3.51 | 3.00 | 6.85 | 4.79 | 5.38 | 4.35 | 5.79 | 4.74 | | | |
| NT2RM2002368 | 4.40 | 3.36 | 3.81 | 8.23 | 7.04 | 7.08 | 3.82 | 5.20 | 3.26 | ** | + | |
| NT2RM2002381 | 1.63 | 1.57 | 2.71 | 2.99 | 3.95 | 2.46 | 1.73 | 3.26 | 3.15 | | | |
| NT2RM2002424 | 6.30 | 4.83 | 5.88 | 15.99 | 15.30 | 14.85 | 6.59 | 9.16 | 9.11 | ** | + | |
| NT2RM2002450 | 4.28 | 2.58 | 3.43 | 4.26 | 4.94 | 3.98 | 2.13 | 3.11 | 1.67 | | | |
| NT2RM2002482 | 3.24 | 2.34 | 3.46 | 4.41 | 2.79 | 3.35 | 3.25 | 3.29 | 2.2 | | | |

TABLE 228

| | | | | | | | | | | | | |
|---|---|---|---|---|---|---|---|---|---|---|---|---|
| NT2RM2002492 | 21.46 | 13.29 | 16.96 | 23.80 | 28.37 | 23.64 | 14.79 | 12.77 | 15.74 | * | + | |
| NT2RM2002575 | 14.83 | 8.83 | 9.60 | 12.39 | 15.50 | 9.64 | 5.47 | 4.77 | 4.26 | | | * | − |
| NT2RM2002580 | 10.54 | 5.71 | 6.88 | 9.66 | 15.19 | 13.67 | 6.89 | 8.73 | 8.24 | | | |
| NT2RM2002592 | 21.59 | 13.02 | 21.47 | 22.05 | 25.36 | 18.29 | 13.81 | 13.13 | 16.44 | | | |
| NT2RM2002608 | 14.51 | 10.47 | 15.10 | 11.85 | 17.10 | 10.74 | 12.25 | 12.95 | 16.2 | | | |
| NT2RM2002615 | 7.16 | 4.68 | 6.11 | 4.32 | 3.11 | 3.23 | 2.34 | 3.30 | 2.9 | * | − | * | − |
| NT2RM2002622 | 7.42 | 4.82 | 9.06 | 37.13 | 40.07 | 28.33 | 10.87 | 12.05 | 11.06 | ** | + | * | + |
| NT2RM2002630 | 7.98 | 5.03 | 5.96 | 13.25 | 13.42 | 12.82 | 6.17 | 6.79 | 6.95 | ** | + | |
| NT2RM2002634 | 5.03 | 2.59 | 3.78 | 7.49 | 9.33 | 4.95 | 4.93 | 3.29 | 2.99 | | | |
| NT2RM2002645 | 23.59 | 12.83 | 21.14 | 22.24 | 21.50 | 17.33 | 18.84 | 24.20 | 13.44 | | | |
| NT2RM2002646 | 14.00 | 9.34 | 10.97 | 13.76 | 16.22 | 12.07 | 10.73 | 9.69 | 15.13 | | | |
| NT2RM2002647 | 20.09 | 9.61 | 14.48 | 15.78 | 21.02 | 13.76 | 11.26 | 13.21 | 13.26 | | | |
| NT2RM2002652 | 5.04 | 3.66 | 3.21 | 6.10 | 6.51 | 3.39 | 2.65 | 3.93 | 4.06 | | | |
| NT2RM2002692 | 7.77 | 5.58 | 7.47 | 11.71 | 20.77 | 13.98 | 11.29 | 13.53 | 12.54 | * | + | ** | + |
| NT2RM2002721 | 24.72 | 15.21 | 18.70 | 28.40 | 46.33 | 25.49 | 20.79 | 20.54 | 32.86 | | | |
| NT2RM2002748 | 79.54 | 53.04 | 79.10 | 79.94 | 75.77 | 78.90 | 26.04 | 31.33 | 37.42 | | | * | − |
| NT2RM2002764 | 5.43 | 3.03 | 2.52 | 10.76 | 7.77 | 4.58 | 3.86 | 3.77 | 3.77 | | | |
| NT2RM2002772 | 11.93 | 7.88 | 8.81 | 11.61 | 12.84 | 7.73 | 4.61 | 5.99 | 7.99 | | | |
| NT2RM2002811 | 9.63 | 5.90 | 5.86 | 8.67 | 8.08 | 6.76 | 5.99 | 5.21 | 6.14 | | | |
| NT2RM2002818 | 6.94 | 3.95 | 3.88 | 7.36 | 7.54 | 5.33 | 2.65 | 4.06 | 4.31 | | | |
| NT2RM2002879 | 2.57 | 1.77 | 2.32 | 2.29 | 3.75 | 1.84 | 3.18 | 4.11 | 4.37 | | | * | + |
| NT2RM2002979 | 11.80 | 7.84 | 8.67 | 10.47 | 13.00 | 9.87 | 8.38 | 6.63 | 6.92 | | | |
| NT2RM2002981 | 4.75 | 2.96 | 3.25 | 4.20 | 5.55 | 4.27 | 4.3 | 5.20 | 4.19 | | | |
| NT2RM2002995 | 3.40 | 2.64 | 2.64 | 3.84 | 3.50 | 4.10 | 2.62 | 3.34 | 2.85 | * | + | |
| NT2RM2003031 | 3.92 | 1.02 | 1.63 | 4.33 | 4.68 | 2.72 | 3.7 | 2.74 | 3.72 | | | |
| NT2RM2003042 | 21.41 | 10.74 | 8.21 | 17.59 | 19.62 | 15.87 | 7.89 | 8.90 | 9.64 | | | |
| NT2RM2003044 | 3.74 | 2.06 | 1.81 | 3.99 | 6.41 | 3.64 | 2.33 | 3.97 | 3.12 | | | |
| NT2RM2003090 | 4.60 | 2.18 | 1.89 | 2.49 | 4.89 | 3.16 | 3.07 | 3.31 | 2.92 | | | |
| NT2RM2003095 | 3.67 | 1.54 | 1.20 | 3.30 | 4.47 | 3.32 | 3.18 | 3.65 | 3.25 | | | |
| NT2RM2003116 | 5.36 | 5.13 | 6.83 | 5.86 | 7.80 | 6.25 | 3.24 | 6.72 | 6.31 | | | |
| NT2RM2003222 | 2.53 | 2.08 | 1.54 | 2.39 | 2.31 | 1.74 | 0.73 | 3.10 | 1.35 | | | |
| NT2RM2003224 | 15.53 | 10.87 | 13.94 | 24.44 | 25.63 | 15.64 | 6.09 | 8.22 | 11.35 | | | |
| NT2RM2003250 | 14.48 | 5.65 | 5.15 | 9.14 | 10.21 | 4.29 | 3.99 | 3.24 | 3.21 | | | |
| NT2RM2003258 | 2.29 | 2.33 | 1.33 | 2.70 | 2.97 | 1.92 | 4.64 | 2.60 | 3.37 | | | |
| NT2RM2003262 | 12.60 | 10.45 | 8.76 | 10.06 | 13.00 | 11.50 | 9.36 | 7.15 | 7.82 | | | |
| NT2RM4000023 | 1.99 | 1.44 | 1.54 | 4.90 | 4.52 | 3.88 | 4.13 | 2.29 | 4.66 | ** | + | |
| NT2RM4000024 | 2.91 | 2.48 | 1.20 | 3.30 | 4.50 | 2.17 | 2.67 | 1.90 | 2.29 | | | |
| NT2RM4000027 | 8.53 | 4.07 | 5.06 | 2.82 | 3.04 | 1.62 | 1.79 | 2.08 | 2.61 | | | |
| NT2RM4000030 | 5.84 | 5.94 | 5.16 | 8.87 | 6.03 | 4.15 | 5.42 | 5.51 | 5.41 | | | |
| NT2RM4000033 | 1.51 | 1.27 | 1.03 | 2.93 | 3.16 | 1.42 | 1.59 | 1.08 | 1.27 | | | |
| NT2RM4000034 | 2.39 | 1.22 | 1.22 | 3.53 | 2.94 | 1.45 | 2.28 | 1.04 | 1.5 | | | |
| NT2RM4000046 | 2.68 | 1.77 | 1.53 | 3.42 | 3.11 | 1.75 | 3.04 | 1.82 | 3.01 | | | |
| NT2RM4000052 | 4.15 | 1.71 | 1.72 | 3.48 | 3.49 | 2.40 | 3.28 | 1.71 | 3.37 | | | |
| NT2RM4000054 | 26.80 | 19.29 | 17.31 | 21.55 | 22.04 | 23.11 | 25.09 | 20.51 | 27.5 | | | |
| NT2RM4000061 | 2.10 | 1.10 | 0.99 | 1.68 | 1.71 | 1.22 | 2.51 | 1.77 | 1.98 | | | |
| NT2RM4000074 | 9.55 | 7.34 | 6.67 | 13.37 | 15.17 | 7.83 | 6.11 | 5.94 | 7.27 | | | |
| NT2RM4000085 | 2.96 | 0.88 | 2.51 | 4.65 | 4.96 | 3.33 | 2.05 | 2.94 | 4.07 | | | |
| NT2RM4000086 | 5.73 | 3.89 | 4.54 | 5.27 | 5.35 | 3.12 | 1.65 | 3.66 | 5.45 | | | |
| NT2RM4000100 | 5.36 | 2.82 | 2.66 | 5.25 | 5.01 | 3.76 | 5.82 | 4.53 | 4.32 | | | |
| NT2RM4000101 | 3.85 | 2.50 | 2.70 | 3.14 | 2.31 | 2.97 | 4.25 | 3.04 | 4.67 | | | |
| NT2RM4000102 | 36.64 | 21.10 | 21.71 | 40.33 | 40.26 | 40.80 | 33.11 | 25.16 | 36.34 | | | |
| NT2RM4000104 | 1.41 | 0.89 | 0.77 | 2.16 | 1.98 | 1.38 | 2.39 | 2.42 | 1.99 | | | ** | + |
| NT2RM4000115 | 1.25 | 1.28 | 1.23 | 1.59 | 2.32 | 1.33 | 1.87 | 1.24 | 1.33 | | | |
| NT2RM4000129 | 2.55 | 2.06 | 1.92 | 3.48 | 3.51 | 3.33 | 3.04 | 3.19 | 2.54 | ** | + | |
| NT2RM4000139 | 2.48 | 1.32 | 1.75 | 2.52 | 1.95 | 2.96 | 1.63 | 2.77 | 2.58 | | | |
| NT2RM4000149 | 1.92 | 1.98 | 1.88 | 3.18 | 3.67 | 2.07 | 1.43 | 1.95 | 2.57 | | | |

TABLE 229

| ID | | | | | | | | | | | | |
|---|---|---|---|---|---|---|---|---|---|---|---|---|
| NT2RM4000155 | 8.41 | 4.25 | 5.85 | 5.71 | 7.89 | 3.63 | 6.31 | 2.89 | 10.88 | | | |
| NT2RM4000156 | 4.06 | 2.82 | 3.12 | 3.91 | 5.14 | 3.25 | 4.15 | 3.34 | 7.54 | | | |
| NT2RM4000167 | 2.76 | 1.86 | 2.44 | 3.27 | 3.78 | 2.46 | 1.7 | 2.54 | 2.08 | | | |
| NT2RM4000169 | 19.79 | 11.82 | 12.59 | 15.78 | 28.83 | 16.15 | 10.62 | 8.62 | 22.74 | | | |
| NT2RM4000191 | 5.46 | 2.93 | 3.98 | 7.00 | 12.87 | 3.95 | 5.75 | 4.22 | 5 | | | |
| NT2RM4000197 | 6.21 | 3.61 | 5.57 | 1.78 | 3.32 | 3.20 | 2.07 | 2.72 | 3.62 | | | |
| NT2RM4000198 | 6.32 | 5.24 | 5.02 | 9.16 | 10.86 | 8.33 | 6.38 | 7.74 | 6.83 | ** | + | |
| NT2RM4000199 | 3.97 | 1.83 | 1.79 | 3.99 | 4.05 | 3.81 | 2.77 | 3.05 | 3.55 | | | |
| NT2RM4000200 | 3.35 | 2.42 | 1.54 | 4.45 | 2.14 | 1.95 | 1.94 | 2.20 | 2.16 | | | |
| NT2RM4000202 | 3.63 | 1.09 | 1.43 | 2.56 | 2.87 | 2.44 | 2.2 | 2.07 | 1.78 | | | |
| NT2RM4000210 | 4.14 | 2.52 | 2.72 | 3.86 | 8.22 | 3.80 | 3.01 | 2.97 | 3.68 | | | |
| NT2RM4000215 | 5.18 | 3.07 | 5.47 | 7.27 | 8.45 | 5.15 | 4.83 | 4.89 | 4.29 | | | |
| NT2RM4000220 | 2.94 | 2.54 | 2.79 | 4.64 | 4.57 | 3.49 | 4.1 | 4.60 | 5.77 | * | + | * | + |
| NT2RM4000229 | 5.01 | 3.09 | 3.00 | 5.45 | 4.41 | 4.69 | 4.07 | 4.71 | 4.56 | | | |
| NT2RM4000231 | 4.55 | 4.22 | 5.24 | 5.48 | 9.85 | 6.48 | 5.25 | 5.36 | 6.29 | | | |
| NT2RM4000233 | 15.69 | 9.94 | 12.92 | 10.36 | 8.30 | 6.63 | 11.95 | 12.79 | 13.03 | | | |
| NT2RM4000244 | 3.55 | 2.12 | 1.68 | 2.06 | 1.74 | 1.35 | 2.28 | 2.40 | 1.4 | | | |
| NT2RM4000251 | 3.33 | 1.28 | 1.28 | 2.48 | 6.47 | 3.24 | 2.39 | 3.65 | 3.7 | | | |
| NT2RM4000255 | 2.86 | 2.35 | 2.55 | 3.65 | 4.00 | 4.45 | 3.46 | 3.56 | 4.05 | ** | + | ** | + |
| NT2RM4000265 | 4.79 | 2.78 | 4.25 | 9.35 | 12.26 | 8.62 | 3.89 | 4.46 | 7.5 | ** | + | |
| NT2RM4000283 | 70.67 | 47.66 | 58.69 | 22.90 | 27.64 | 23.33 | 20.04 | 20.53 | 29.33 | ** | − | ** | − |
| NT2RM4000284 | 3.79 | 2.43 | 3.13 | 4.73 | 5.37 | 4.18 | 3.75 | 4.06 | 5.01 | * | + | |
| NT2RM4000290 | 3.63 | 2.15 | 2.31 | 4.25 | 6.01 | 4.45 | 4.22 | 4.40 | 5.11 | * | + | * | + |
| NT2RM4000295 | 2.18 | 1.74 | 1.84 | 1.64 | 1.85 | 1.54 | 2.16 | 2.51 | 2.05 | | | |
| NT2RM4000306 | 9.76 | 5.69 | 5.53 | 3.29 | 5.79 | 3.80 | 4.99 | 4.91 | 4.19 | | | |
| NT2RM4000307 | 1.99 | 1.95 | 1.34 | 6.27 | 6.75 | 5.25 | 9.66 | 12.35 | 13.1 | ** | + | ** | + |
| NT2RM4000309 | 4.39 | 2.45 | 3.20 | 3.45 | 3.57 | 3.25 | 2.21 | 2.77 | 3.12 | | | |
| NT2RM4000313 | 4.53 | 2.93 | 3.37 | 6.76 | 7.38 | 6.57 | 4.37 | 4.56 | 4.95 | ** | + | |
| NT2RM4000318 | 3.24 | 1.42 | 3.10 | 6.35 | 5.08 | 6.14 | 3.2 | 4.49 | 3.95 | ** | + | |
| NT2RM4000324 | 3.33 | 2.91 | 2.72 | 5.10 | 4.10 | 4.09 | 3.41 | 4.13 | 3.13 | * | + | |
| NT2RM4000326 | 2.66 | 2.08 | 2.02 | 2.52 | 2.48 | 2.90 | 1.91 | 4.16 | 2.37 | | | |
| NT2RM4000327 | 5.98 | 3.83 | 5.87 | 11.13 | 9.36 | 9.04 | 5.82 | 4.08 | 6.84 | ** | + | |
| NT2RM4000344 | 18.32 | 6.89 | 6.35 | 13.95 | 16.21 | 14.72 | 10.48 | 11.38 | 12.84 | | | |
| NT2RM4000349 | 6.58 | 3.84 | 3.66 | 6.40 | 5.99 | 6.38 | 4.94 | 4.61 | 4.8 | | | |
| NT2RM4000354 | 5.00 | 2.70 | 3.37 | 3.28 | 2.86 | 2.19 | 2.4 | 2.57 | 3.45 | | | |
| NT2RM4000356 | 4.16 | 1.61 | 1.73 | 2.39 | 4.18 | 5.03 | 2.81 | 3.86 | 2.82 | | | |
| NT2RM4000366 | 51.05 | 23.81 | 40.37 | 61.56 | 72.80 | 50.45 | 36.85 | 39.74 | 37.86 | | | |
| NT2RM4000368 | 4.89 | 2.95 | 4.56 | 12.45 | 6.89 | 8.75 | 3.93 | 5.00 | 5.04 | * | + | |
| NT2RM4000373 | 3.91 | 2.54 | 3.44 | 5.84 | 6.63 | 5.55 | 3.15 | 4.00 | 4.07 | ** | + | |
| NT2RM4000386 | 2.58 | 1.67 | 2.32 | 2.56 | 2.07 | 2.16 | 1.54 | 2.11 | 1.77 | | | |
| NT2RM4000395 | 7.43 | 3.02 | 3.38 | 5.38 | 8.33 | 4.62 | 3.75 | 3.62 | 2.41 | | | |
| NT2RM4000414 | 8.01 | 4.62 | 4.45 | 4.72 | 6.23 | 4.47 | 6.27 | 6.74 | 7.44 | | | |
| NT2RM4000417 | 3.81 | 2.15 | 2.35 | 2.45 | 4.44 | 3.37 | 1.96 | 2.94 | 5.43 | | | |
| NT2RM4000421 | 4.32 | 3.14 | 3.21 | 5.52 | 5.35 | 4.92 | 3.28 | 3.80 | 2.75 | * | + | |
| NT2RM4000425 | 5.83 | 3.82 | 4.77 | 12.15 | 12.72 | 12.65 | 6.8 | 7.68 | 8.72 | ** | + | * | + |
| NT2RM4000433 | 3.24 | 1.87 | 2.39 | 3.27 | 3.60 | 3.54 | 5.12 | 3.76 | 4.32 | | | * | + |
| NT2RM4000436 | 5.20 | 2.98 | 5.09 | 4.80 | 5.70 | 3.50 | 3.27 | 3.38 | 2.58 | | | |
| NT2RM4000444 | 2.77 | 3.48 | 2.67 | 4.83 | 3.05 | 2.47 | 3.64 | 2.66 | 2.6 | | | |
| NT2RM4000457 | 15.74 | 6.60 | 7.42 | 19.58 | 21.46 | 13.99 | 7.15 | 6.46 | 8.49 | | | |
| NT2RM4000471 | 2.61 | 2.36 | 2.45 | 4.93 | 5.40 | 4.25 | 2.75 | 2.88 | 3.1 | ** | + | * | + |
| NT2RM4000472 | 18.08 | 9.02 | 12.03 | 39.03 | 47.24 | 22.44 | 10.92 | 7.97 | 22.46 | * | + | |
| NT2RM4000486 | 3.65 | 3.27 | 2.92 | 5.46 | 7.04 | 5.93 | 3.74 | 4.42 | 3.79 | ** | + | |
| NT2RM4000490 | 4.88 | 4.19 | 2.87 | 2.63 | 4.80 | 4.02 | 3.72 | 6.17 | 4.86 | | | |
| NT2RM4000496 | 4.08 | 3.13 | 4.22 | 2.96 | 3.44 | 3.46 | 3.56 | 4.42 | 3.51 | | | |
| NT2RM4000505 | 13.63 | 8.59 | 11.63 | 16.76 | 17.74 | 14.63 | 12.93 | 15.48 | 13.33 | * | + | |
| NT2RM4000511 | 58.96 | 34.63 | 49.12 | 52.44 | 54.53 | 48.10 | 20.11 | 21.96 | 24.23 | | | * | − |

TABLE 230

| ID | | | | | | | | | | | | |
|---|---|---|---|---|---|---|---|---|---|---|---|---|
| NT2RM4000514 | 5.53 | 2.38 | 2.75 | 8.23 | 11.94 | 5.81 | 3.95 | 5.11 | 3.73 | | | |
| NT2RM4000515 | 16.72 | 6.51 | 7.89 | 17.68 | 19.19 | 15.60 | 8.65 | 8.97 | 10.58 | | | |
| NT2RM4000517 | 52.07 | 29.36 | 32.93 | 47.60 | 48.78 | 40.92 | 19.63 | 19.22 | 17.95 | | | |
| NT2RM4000520 | 2.37 | 1.45 | 1.44 | 1.17 | 1.70 | 1.58 | 0.83 | 2.01 | 2.17 | | | |
| NT2RM4000531 | 1.99 | 2.27 | 1.67 | 2.66 | 3.68 | 3.90 | 3.09 | 4.12 | 3.6 | * | + | ** | + |
| NT2RM4000532 | 1.32 | 0.65 | 0.82 | 1.96 | 2.81 | 1.58 | 1.14 | 2.83 | 2.21 | * | + | |
| NT2RM4000533 | 3.05 | 2.29 | 3.20 | 1.70 | 2.71 | 1.77 | 1.32 | 2.54 | 1.44 | | | |
| NT2RM4000534 | 1.94 | 0.89 | 1.21 | 1.63 | 2.79 | 1.54 | 1.47 | 2.29 | 1.5 | | | |
| NT2RM4000563 | 8.72 | 3.55 | 3.49 | 6.44 | 4.79 | 3.51 | 5.01 | 4.09 | 5.24 | | | |
| NT2RM4000566 | 4.57 | 2.22 | 2.28 | 4.38 | 4.92 | 2.84 | 2.28 | 2.65 | 3.1 | | | |
| NT2RM4000568 | 3.97 | 2.58 | 1.85 | 3.65 | 4.45 | 3.11 | 2.68 | 3.32 | 5.31 | | | |
| NT2RM4000585 | 4.60 | 2.16 | 1.71 | 2.71 | 3.64 | 3.29 | 2.11 | 2.49 | 3.12 | | | |
| NT2RM4000587 | 2.44 | 1.07 | 2.17 | 2.90 | 3.56 | 2.74 | 2.55 | 3.03 | 3.48 | | | |
| NT2RM4000590 | 2.10 | 1.53 | 1.91 | 1.79 | 3.35 | 2.47 | 1.66 | 3.17 | 1.73 | | | |
| NT2RM4000593 | 7.87 | 4.39 | 5.71 | 12.59 | 12.23 | 10.68 | 4.27 | 7.40 | 6.4 | ** | + | |
| NT2RM4000595 | 2.17 | 1.55 | 2.08 | 3.28 | 3.82 | 2.26 | 2.16 | 3.13 | 4.82 | | | |
| NT2RM4000603 | 12.55 | 6.66 | 4.52 | 9.64 | 5.73 | 7.27 | 4.44 | 2.74 | 3.84 | | | |

TABLE 230-continued

| | | | | | | | | | | | | | |
|---|---|---|---|---|---|---|---|---|---|---|---|---|---|
| NT2RM4000611 | 4.28 | 4.40 | 1.85 | 3.49 | 3.25 | 3.20 | 4.67 | 2.74 | 3.19 | | | | |
| NT2RM4000616 | 3.34 | 2.92 | 1.37 | 4.32 | 4.33 | 3.69 | 3.56 | 2.86 | 2.97 | | | | |
| NT2RM4000621 | 16.48 | 12.72 | 9.94 | 21.48 | 22.15 | 19.49 | 9.4 | 8.56 | 8.57 | * | + | | |
| NT2RM4000648 | 2.01 | 1.43 | 1.11 | 2.32 | 1.95 | 1.99 | 1.76 | 2.62 | 1.65 | | | | |
| NT2RM4000649 | 5.47 | 3.71 | 4.22 | 6.21 | 6.35 | 6.84 | 6.07 | 5.86 | 5.42 | * | + | | |
| NT2RM4000658 | 8.60 | 4.07 | 5.16 | 8.70 | 7.92 | 4.74 | 5.84 | 5.98 | 5.36 | | | | |
| NT2RM4000661 | 10.99 | 4.92 | 5.69 | 11.11 | 10.38 | 8.21 | 15.64 | 14.68 | 17.57 | | | * | + |
| NT2RM4000673 | 9.96 | 5.23 | 4.31 | 6.63 | 5.66 | 5.28 | 8.2 | 4.95 | 5.83 | | | | |
| NT2RM4000674 | 5.01 | 2.88 | 2.93 | 4.58 | 4.03 | 4.02 | 5.28 | 3.25 | 4.19 | | | | |
| NT2RM4000689 | 6.44 | 3.20 | 3.50 | 4.50 | 6.19 | 4.47 | 3.52 | 4.05 | 3.79 | | | | |
| NT2RM4000698 | 35.87 | 22.93 | 21.16 | 15.46 | 17.90 | 22.28 | 17.5 | 16.82 | 14.8 | | | | |
| NT2RM4000700 | 3.46 | 2.08 | 2.83 | 3.85 | 2.02 | 2.52 | 2.49 | 2.37 | 1.32 | | | | |
| NT2RM4000701 | 9.78 | 5.90 | 5.74 | 10.46 | 14.71 | 8.86 | 7.95 | 6.35 | 8.32 | | | | |
| NT2RM4000712 | 2.69 | 1.64 | 2.42 | 4.68 | 4.33 | 3.64 | 2.57 | 3.33 | 2.41 | * | + | | |
| NT2RM4000717 | 12.02 | 5.07 | 6.36 | 11.87 | 8.62 | 8.11 | 7.27 | 6.28 | 7.15 | | | | |
| NT2RM4000733 | 8.98 | 3.57 | 6.27 | 6.72 | 6.26 | 7.78 | 7.76 | 4.90 | 6 | | | | |
| NT2RM4000734 | 9.72 | 3.11 | 3.90 | 7.75 | 4.13 | 5.58 | 5.8 | 4.00 | 5.07 | | | | |
| NT2RM4000741 | 4.49 | 2.29 | 3.56 | 3.14 | 3.42 | 3.32 | 3.44 | 4.03 | 2.18 | | | | |
| NT2RM4000744 | 3.69 | 2.68 | 2.61 | 2.80 | 6.32 | 4.46 | 2.85 | 3.92 | 3 | | | | |
| NT2RM4000749 | 11.40 | 7.45 | 11.83 | 11.62 | 13.08 | 12.36 | 13.08 | 12.48 | 13.4 | | | | |
| NT2RM4000751 | 6.54 | 4.81 | 4.52 | 15.28 | 14.53 | 10.59 | 6.43 | 6.81 | 9.13 | ** | + | | |
| NT2RM4000752 | 4.53 | 2.37 | 3.48 | 4.41 | 5.68 | 4.78 | 3.23 | 4.75 | 8.68 | | | | |
| NT2RM4000760 | 4.53 | 2.84 | 2.99 | 5.14 | 6.37 | 2.91 | 5.41 | 3.73 | 5.34 | | | | |
| NT2RM4000761 | 996.52 | 787.70 | 799.46 | 925.45 | 928.88 | 688.98 | 521.4 | 1076.26 | 1043 | | | | |
| NT2RM4000764 | 27.63 | 19.80 | 15.48 | 20.84 | 20.29 | 16.92 | 30.21 | 26.08 | 33.56 | | | | |
| NT2RM4000768 | 14.67 | 8.26 | 9.77 | 8.91 | 9.00 | 6.52 | 3.2 | 6.21 | 5.06 | | | * | − |
| NT2RM4000778 | 4.92 | 2.41 | 4.01 | 2.84 | 3.65 | 2.97 | 1.85 | 2.67 | 2.07 | | | | |
| NT2RM4000779 | 8.60 | 6.98 | 9.29 | 9.01 | 13.32 | 14.40 | 9.71 | 7.63 | 14.65 | | | | |
| NT2RM4000787 | 4.24 | 2.50 | 3.69 | 7.64 | 7.50 | 6.95 | 5.13 | 4.57 | 3.51 | ** | + | | |
| NT2RM4000790 | 3.29 | 2.32 | 3.49 | 4.70 | 4.95 | 5.71 | 2.8 | 3.89 | 2.61 | * | + | | |
| NT2RM4000795 | 17.99 | 8.62 | 8.95 | 7.60 | 7.29 | 5.12 | 10.59 | 11.21 | 13.05 | | | | |
| NT2RM4000796 | 9.52 | 5.97 | 4.89 | 6.98 | 7.91 | 6.65 | 7.34 | 5.94 | 6.5 | | | | |
| NT2RM4000798 | 4.86 | 3.32 | 1.92 | 4.08 | 3.21 | 6.07 | 3.4 | 3.16 | 3.56 | | | | |
| NT2RM4000800 | 25.53 | 16.14 | 15.27 | 24.04 | 32.78 | 23.66 | 18.49 | 15.32 | 20.57 | | | | |
| NT2RM4000813 | 9.68 | 4.14 | 5.79 | 3.70 | 5.76 | 3.65 | 5.28 | 6.71 | 6.8 | | | | |
| NT2RM4000820 | 6.65 | 4.53 | 5.35 | 8.29 | 7.69 | 8.43 | 5.66 | 5.99 | 4.55 | * | + | | |
| NT2RM4000827 | 7.32 | 3.89 | 5.09 | 8.78 | 8.63 | 9.18 | 6.29 | 5.93 | 5.97 | * | + | | |
| NT2RM4000830 | 6.10 | 3.43 | 4.84 | 5.47 | 6.76 | 7.08 | 5.66 | 6.54 | 4.35 | | | | |
| NT2RM4000833 | 7.52 | 4.61 | 4.22 | 4.98 | 5.08 | 4.81 | 5.7 | 5.33 | 4.23 | | | | |

TABLE 231

| | | | | | | | | | | | | | |
|---|---|---|---|---|---|---|---|---|---|---|---|---|---|
| NT2RM4000841 | 5.06 | 3.39 | 2.43 | 4.05 | 5.93 | 4.27 | 4.63 | 4.44 | 4.32 | | | | |
| NT2RM4000846 | 9.09 | 5.94 | 7.28 | 12.84 | 12.70 | 15.11 | 9.96 | 10.78 | 11.36 | ** | + | * | + |
| NT2RM4000848 | 7.88 | 5.40 | 5.25 | 6.98 | 11.06 | 5.33 | 7.53 | 6.82 | 8.25 | | | | |
| NT2RM4000852 | 6.75 | 4.64 | 5.34 | 13.69 | 17.70 | 14.08 | 11.97 | 13.34 | 10.93 | ** | + | ** | + |
| NT2RM4000855 | 4.73 | 2.86 | 4.28 | 6.84 | 5.05 | 6.75 | 4.95 | 4.71 | 3.45 | * | + | | |
| NT2RM4000859 | 13.33 | 7.63 | 8.66 | 12.33 | 11.71 | 13.85 | 10.92 | 13.05 | 13.48 | | | | |
| NT2RM4000868 | 3.39 | 2.48 | 3.24 | 2.56 | 3.27 | 2.72 | 2.54 | 2.52 | 2.34 | | | | |
| NT2RM4000870 | 7.43 | 4.59 | 4.58 | 4.56 | 7.18 | 4.83 | 5.21 | 5.55 | 10.16 | | | | |
| NT2RM4000879 | 5.36 | 4.71 | 2.54 | 2.94 | 5.60 | 3.69 | 4.73 | 3.05 | 8.38 | | | | |
| NT2RM4000882 | 13.28 | 7.67 | 8.34 | 13.87 | 16.02 | 12.84 | 11.37 | 9.53 | 8.64 | | | | |
| NT2RM4000887 | 7.73 | 5.89 | 6.66 | 6.98 | 5.77 | 6.42 | 10.56 | 10.15 | 7.39 | | | | |
| NT2RM4000895 | 5.73 | 3.47 | 4.08 | 7.64 | 7.37 | 6.94 | 4.46 | 6.14 | 5.95 | * | + | | |
| NT2RM4000897 | 7.53 | 4.28 | 4.64 | 9.70 | 11.04 | 6.20 | 7.51 | 8.32 | 7.28 | | | | |
| NT2RM4000901 | 2.04 | 1.85 | 1.79 | 2.60 | 2.63 | 3.31 | 2.13 | 2.92 | 1.47 | * | + | | |
| NT2RM4000950 | 0.56 | 0.78 | 1.17 | 2.14 | 1.27 | 1.24 | 1.41 | 2.19 | 1.17 | | | | |
| NT2RM4000965 | 9.86 | 4.20 | 4.55 | 3.73 | 5.50 | 4.12 | 5.03 | 3.46 | 4.87 | | | | |
| NT2RM4000971 | 5.30 | 5.00 | 2.48 | 7.54 | 6.04 | 2.89 | 3.53 | 4.64 | 7.17 | | | | |
| NT2RM4000979 | 4.99 | 2.53 | 1.69 | 2.02 | 3.14 | 2.85 | 2.38 | 2.83 | 3.27 | | | | |
| NT2RM4000987 | 2.44 | 1.53 | 2.68 | 3.20 | 3.68 | 2.75 | 2.62 | 4.83 | 3.64 | | | | |
| NT2RM4000989 | 4.94 | 3.38 | 3.37 | 4.04 | 2.94 | 2.51 | 3.27 | 4.13 | 3.58 | | | | |
| NT2RM4000991 | 0.93 | 1.02 | 1.31 | 2.15 | 2.31 | 2.55 | 2.33 | 4.87 | 2.11 | ** | + | | |
| NT2RM4000992 | 11.24 | 7.63 | 10.16 | 7.25 | 5.43 | 5.90 | 4.54 | 4.54 | 4.18 | * | − | ** | − |
| NT2RM4000996 | 4.06 | 2.34 | 3.75 | 9.54 | 9.91 | 8.12 | 3.46 | 4.48 | 3.87 | ** | + | | |
| NT2RM4000997 | 9.49 | 3.35 | 2.92 | 6.90 | 7.64 | 7.96 | 5.25 | 6.12 | 5.29 | | | | |
| NT2RM4001001 | 22.10 | 15.26 | 10.21 | 12.02 | 9.69 | 11.49 | 22.6 | 17.92 | 9.97 | | | | |
| NT2RM4001002 | 5.24 | 3.19 | 3.25 | 8.21 | 8.99 | 8.70 | 5.14 | 6.05 | 8.69 | ** | + | | |
| NT2RM4001016 | 4.56 | 3.14 | 3.04 | 3.93 | 5.46 | 2.92 | 3.16 | 3.93 | 3.9 | | | | |
| NT2RM4001025 | 115.98 | 53.32 | 70.45 | 58.33 | 60.27 | 42.54 | 40.15 | 40.87 | 41.74 | | | | |
| NT2RM4001027 | 0.14 | 0.43 | 0.68 | 0.22 | 0.31 | 0.94 | 0.68 | 1.67 | 1.36 | | | | |
| NT2RM4001032 | 1.80 | 1.46 | 0.81 | 3.10 | 2.87 | 2.32 | 1.9 | 2.71 | 1.77 | * | + | | |
| NT2RM4001047 | 1.37 | 0.95 | 0.95 | 2.05 | 2.61 | 2.62 | 1.72 | 2.11 | 1.51 | ** | + | * | + |
| NT2RM4001049 | 10.71 | 3.63 | 3.82 | 6.40 | 6.54 | 4.49 | 5.52 | 5.09 | 5.26 | | | | |
| NT2RM4001051 | 6.70 | 3.93 | 4.20 | 7.11 | 12.15 | 4.54 | 5.61 | 4.11 | 11.9 | | | | |
| NT2RM4001052 | 8.14 | 4.27 | 4.08 | 6.07 | 7.39 | 5.45 | 8.57 | 7.89 | 6.02 | | | | |

TABLE 231-continued

| | | | | | | | | | | | | |
|---|---|---|---|---|---|---|---|---|---|---|---|---|
| NT2RM4001053 | 27.19 | 14.20 | 21.35 | 17.33 | 19.31 | 15.07 | 12.02 | 9.63 | 10.5 | | | |
| NT2RM4001054 | 3.61 | 1.72 | 2.96 | 2.73 | 3.57 | 4.09 | 2.66 | 3.55 | 3.62 | | | |
| NT2RM4001059 | 7.61 | 4.52 | 5.00 | 8.40 | 9.15 | 6.24 | 6.45 | 6.67 | 8.15 | | | |
| NT2RM4001071 | 4.06 | 2.69 | 2.57 | 4.40 | 6.02 | 4.14 | 3.25 | 5.00 | 2.66 | | | |
| NT2RM4001084 | 4.94 | 2.76 | 3.04 | 3.73 | 6.30 | 5.46 | 4.17 | 4.56 | 4.31 | | | |
| NT2RM4001092 | 7.29 | 2.48 | 2.72 | 5.06 | 4.22 | 4.55 | 3.22 | 2.32 | 2.04 | | | |
| NT2RM4001100 | 12.18 | 6.64 | 7.67 | 10.87 | 11.09 | 10.86 | 6.95 | 8.94 | 8.4 | | | |
| NT2RM4001116 | 1.86 | 1.58 | 1.69 | 2.27 | 2.62 | 2.03 | 2.58 | 1.98 | 1.6 | * | + | |
| NT2RM4001119 | 4.12 | 2.84 | 2.77 | 3.79 | 5.02 | 3.34 | 2.23 | 3.61 | 4.07 | | | |
| NT2RM4001140 | 16.77 | 10.70 | 11.39 | 11.80 | 11.74 | 11.76 | 7 | 6.89 | 6.74 | | * | − |
| NT2RM4001148 | 13.85 | 6.50 | 6.41 | 8.02 | 8.87 | 5.20 | 9.72 | 12.16 | 8.38 | | | |
| NT2RM4001151 | 3.04 | 2.82 | 2.68 | 3.38 | 3.91 | 4.17 | 3.34 | 5.07 | 4.04 | * | + | |
| NT2RM4001155 | 3.85 | 1.95 | 2.51 | 2.48 | 2.96 | 3.06 | 2.88 | 3.51 | 1.43 | | | |
| NT2RM4001157 | 4.58 | 2.01 | 1.48 | 3.42 | 3.84 | 2.43 | 3.68 | 3.71 | 2.97 | | | |
| NT2RM4001160 | 6.16 | 2.57 | 2.15 | 5.06 | 4.60 | 3.14 | 2.68 | 2.65 | 4.39 | | | |
| NT2RM4001163 | 28.46 | 18.93 | 15.30 | 35.95 | 37.53 | 27.65 | 20.27 | 18.39 | 15.85 | | | |
| NT2RM4001187 | 5.15 | 3.42 | 2.71 | 6.56 | 6.27 | 4.41 | 3.87 | 4.84 | 4.54 | | | |
| NT2RM4001191 | 4.08 | 1.58 | 2.81 | 4.80 | 3.69 | 3.67 | 1.67 | 2.71 | 2.13 | | | |
| NT2RM4001200 | 5.87 | 3.23 | 4.14 | 11.90 | 10.51 | 10.62 | 3.7 | 6.92 | 6.13 | ** | + | |
| NT2RM4001203 | 5.49 | 3.54 | 4.23 | 5.75 | 6.16 | 5.89 | 3.38 | 6.37 | 4.68 | | | |
| NT2RM4001204 | 1.21 | 0.66 | 1.10 | 1.28 | 1.38 | 1.01 | 0.49 | 2.21 | 0.81 | | | |
| NT2RM4001217 | 2.79 | 2.05 | 1.40 | 2.03 | 2.19 | 2.27 | 3.13 | 2.64 | 2.28 | | | |

TABLE 232

| | | | | | | | | | | | | |
|---|---|---|---|---|---|---|---|---|---|---|---|---|
| NT2RM4001245 | 8.44 | 3.64 | 3.02 | 4.82 | 4.98 | 4.20 | 6.1 | 4.52 | 4.33 | | | |
| NT2RM4001247 | 3.08 | 1.77 | 1.70 | 4.91 | 4.46 | 4.61 | 4.28 | 3.78 | 3.75 | ** | + | * | + |
| NT2RM4001256 | 2.68 | 1.97 | 1.44 | 2.55 | 3.37 | 2.58 | 2.83 | 3.46 | 2.47 | | | |
| NT2RM4001258 | 3.01 | 1.08 | 1.34 | 2.58 | 2.80 | 3.08 | 2.91 | 3.65 | 2.07 | | | |
| NT2RM4001267 | 3.85 | 1.81 | 3.09 | 2.74 | 2.85 | 2.20 | 1.95 | 2.54 | 1.48 | | | |
| NT2RM4001273 | 4.22 | 3.00 | 2.18 | 5.27 | 4.13 | 4.07 | 4.07 | 4.58 | 3.5 | | | |
| NT2RM4001281 | 4.83 | 2.17 | 2.72 | 3.21 | 3.18 | 3.70 | 4.92 | 3.04 | 3.76 | | | |
| NT2RM4001286 | 200.90 | 135.14 | 135.42 | 284.75 | 209.56 | 246.97 | 164.2 | 134.29 | 151.3 | * | + | |
| NT2RM4001290 | 9.86 | 4.80 | 5.69 | 5.57 | 5.18 | 5.39 | 8.08 | 8.05 | 9.32 | | | |
| NT2RM4001309 | 4.86 | 3.06 | 2.25 | 4.98 | 6.28 | 4.18 | 3.55 | 4.91 | 3.92 | | | |
| NT2RM4001313 | 5.02 | 3.13 | 3.38 | 10.23 | 11.21 | 8.30 | 5.64 | 5.09 | 6.07 | ** | + | |
| NT2RM4001316 | 3.10 | 1.87 | 1.63 | 4.90 | 3.32 | 2.72 | 2.34 | 3.07 | 2.48 | | | |
| NT2RM4001320 | 3.57 | 1.99 | 1.80 | 4.35 | 3.95 | 2.99 | 2.67 | 3.38 | 1.95 | | | |
| NT2RM4001321 | 2.36 | 1.76 | 2.19 | 4.88 | 3.23 | 3.63 | 2.96 | 3.26 | 2.18 | * | + | |
| NT2RM4001325 | 4.26 | 2.86 | 2.43 | 3.61 | 4.06 | 3.37 | 3.66 | 2.87 | 3.97 | | | |
| NT2RM4001333 | 9.63 | 4.30 | 7.26 | 19.73 | 18.36 | 12.94 | 10.99 | 11.48 | 14.86 | * | + | |
| NT2RM4001340 | 15.08 | 7.81 | 6.58 | 8.67 | 7.96 | 8.93 | 6.1 | 7.09 | 9.47 | | | |
| NT2RM4001344 | 5.69 | 1.98 | 2.69 | 4.58 | 3.47 | 5.21 | 3.57 | 4.25 | 3.42 | | | |
| NT2RM4001347 | 2.27 | 2.16 | 1.78 | 2.66 | 5.15 | 3.34 | 3.4 | 3.43 | 2.43 | | * | + |
| NT2RM4001357 | 6.92 | 4.15 | 5.35 | 6.32 | 6.10 | 5.55 | 4.34 | 5.12 | 6.64 | | | |
| NT2RM4001360 | 5.77 | 3.29 | 3.38 | 4.26 | 4.44 | 4.12 | 4.69 | 3.72 | 3.64 | | | |
| NT2RM4001371 | 4.54 | 2.79 | 3.83 | 7.15 | 6.45 | 5.83 | 3.62 | 4.03 | 2.04 | * | + | |
| NT2RM4001377 | 10.12 | 5.47 | 3.83 | 5.72 | 6.90 | 5.90 | 6.53 | 6.36 | 7.54 | | | |
| NT2RM4001382 | 27.64 | 18.16 | 15.30 | 26.18 | 25.29 | 24.42 | 17.41 | 14.13 | 18.42 | | | |
| NT2RM4001384 | 2.18 | 1.75 | 1.21 | 2.08 | 4.07 | 2.57 | 1.73 | 1.84 | 2.63 | | | |
| NT2RM4001400 | 1.97 | 1.68 | 1.05 | 5.11 | 4.43 | 3.04 | 4.16 | 3.64 | 2.67 | * | + | * | + |
| NT2RM4001409 | 2.47 | 2.29 | 2.32 | 4.11 | 6.40 | 4.45 | 3.11 | 3.39 | 3.96 | * | + | * | + |
| NT2RM4001410 | 3.95 | 1.97 | 3.57 | 4.82 | 7.04 | 5.31 | 4.02 | 3.43 | 5.37 | * | + | |
| NT2RM4001411 | 0.83 | 0.77 | 0.89 | 2.84 | 2.80 | 2.65 | 2.26 | 2.50 | 1.14 | ** | + | |
| NT2RM4001412 | 3.72 | 2.65 | 2.59 | 3.20 | 3.12 | 4.78 | 3.05 | 4.81 | 2.12 | | | |
| NT2RM4001414 | 4.96 | 2.76 | 1.91 | 3.88 | 3.24 | 3.95 | 8.58 | 4.11 | 4.61 | | | |
| NT2RM4001436 | 10.71 | 5.74 | 4.93 | 8.68 | 8.18 | 5.45 | 5.99 | 5.69 | 6.31 | | | |
| NT2RM4001437 | 3.31 | 2.10 | 1.69 | 4.84 | 3.86 | 4.25 | 2.81 | 3.12 | 5.09 | * | + | |
| NT2RM4001444 | 17.08 | 11.93 | 9.02 | 14.24 | 23.31 | 17.28 | 9.91 | 10.57 | 15.43 | | | |
| NT2RM4001454 | 1.52 | 1.27 | 0.92 | 2.66 | 2.43 | 3.18 | 2.53 | 2.75 | 3.91 | ** | + | * | + |
| NT2RM4001455 | 1.97 | 1.35 | 0.94 | 1.41 | 2.43 | 2.26 | 1.92 | 2.49 | 2.53 | | | |
| NT2RM4001483 | 8.15 | 6.48 | 6.83 | 17.59 | 20.73 | 16.59 | 7.89 | 9.09 | 9.1 | ** | + | |
| NT2RM4001489 | 2.71 | 2.11 | 2.58 | 4.94 | 4.32 | 3.30 | 3.82 | 3.97 | 2.42 | * | + | |
| NT2RM4001495 | 18.14 | 8.14 | 7.60 | 6.61 | 8.27 | 8.97 | 13.02 | 9.27 | 7.52 | | | |
| NT2RM4001499 | 12.77 | 8.16 | 6.92 | 3.39 | 3.00 | 2.48 | 3.08 | 3.42 | 2.67 | * | − | * | − |
| NT2RM4001515 | 3.27 | 1.91 | 1.68 | 2.35 | 4.06 | 1.83 | 1.52 | 2.44 | 1.37 | | | |
| NT2RM4001519 | 5.12 | 2.84 | 4.04 | 2.41 | 3.33 | 2.32 | 2.38 | 4.57 | 1.4 | | | |
| NT2RM4001522 | 6.04 | 4.16 | 3.86 | 10.17 | 8.78 | 6.98 | 5.57 | 5.11 | 4.64 | * | + | |
| NT2RM4001523 | 2.87 | 2.23 | 1.80 | 2.40 | 4.75 | 2.55 | 2.53 | 3.39 | 1.48 | | | |
| NT2RM4001550 | 9.31 | 4.21 | 5.82 | 7.65 | 10.18 | 9.65 | 4.79 | 5.78 | 4.65 | | | |
| NT2RM4001553 | 13.10 | 6.91 | 9.72 | 15.17 | 15.42 | 12.48 | 9.84 | 10.30 | 8.03 | | | |
| NT2RM4001554 | 6.26 | 1.91 | 2.23 | 3.10 | 3.46 | 2.19 | 2.03 | 3.40 | 3.47 | | | |
| NT2RM4001557 | 1.82 | 1.50 | 1.72 | 2.44 | 4.16 | 3.37 | 2.15 | 2.77 | 2.22 | * | + | * | + |
| NT2RM4001565 | 4.45 | 2.55 | 3.09 | 4.16 | 3.19 | 4.16 | 3.34 | 4.45 | 3.44 | | | |
| NT2RM4001566 | 8.15 | 6.36 | 5.54 | 21.07 | 22.32 | 19.38 | 14.82 | 13.59 | 12.47 | ** | + | ** | + |
| NT2RM4001569 | 1.07 | 2.72 | 1.12 | 1.58 | 1.44 | 1.53 | 1.39 | 2.06 | 0.92 | | | |

TABLE 232-continued

| ID | | | | | | | | | | | | | |
|---|---|---|---|---|---|---|---|---|---|---|---|---|---|
| NT2RM4001579 | 2.12 | 1.63 | 1.82 | 2.74 | 2.69 | 2.72 | 4.53 | 3.33 | 2.15 | ** | + | | |
| NT2RM4001582 | 2.62 | 2.33 | 2.55 | 3.71 | 4.48 | 4.20 | 3.06 | 3.87 | 3.26 | ** | + | * | + |
| NT2RM4001589 | 8.35 | 5.09 | 6.66 | 12.13 | 12.37 | 10.11 | 11.51 | 12.65 | 14.42 | * | + | ** | + |
| NT2RM4001592 | 3.41 | 2.19 | 1.04 | 2.79 | 0.97 | 1.51 | 1.07 | 1.30 | 2.99 | | | | |
| NT2RM4001594 | 6.13 | 3.39 | 4.24 | 4.38 | 6.50 | 3.46 | 3.95 | 3.79 | 5.84 | | | | |

TABLE 233

| ID | | | | | | | | | | | | | |
|---|---|---|---|---|---|---|---|---|---|---|---|---|---|
| NT2RM4001597 | 9.12 | 5.34 | 5.09 | 9.11 | 10.92 | 8.47 | 7.88 | 8.77 | 8.89 | | | | |
| NT2RM4001605 | 2.56 | 1.50 | 0.61 | 1.85 | 2.19 | 2.01 | 1.99 | 3.21 | 1.69 | | | | |
| NT2RM4001609 | 89.25 | 51.45 | 54.24 | 71.13 | 77.23 | 52.58 | 39.95 | 36.11 | 41.37 | | | | |
| NT2RM4001610 | 12.00 | 8.23 | 7.07 | 12.20 | 9.44 | 8.76 | 11.99 | 11.53 | 14.72 | | | | |
| NT2RM4001611 | 2.42 | 1.85 | 2.60 | 3.39 | 3.10 | 2.31 | 2.05 | 3.53 | 1.91 | | | | |
| NT2RM4001618 | 9.99 | 6.27 | 7.80 | 11.85 | 10.16 | 11.99 | 7.45 | 6.31 | 7.61 | | | | |
| NT2RM4001622 | 26.67 | 8.64 | 17.82 | 10.07 | 12.08 | 11.47 | 11.1 | 11.92 | 5.45 | | | | |
| NT2RM4001624 | 6.68 | 3.27 | 2.64 | 4.78 | 7.08 | 4.67 | 4.35 | 3.33 | 5.32 | | | | |
| NT2RM4001625 | 6.46 | 4.15 | 3.63 | 6.09 | 6.98 | 6.57 | 5.81 | 6.49 | 4.68 | | | | |
| NT2RM4001629 | 3.08 | 1.43 | 1.44 | 3.13 | 3.87 | 3.98 | 3.34 | 3.46 | 2.65 | | | | |
| NT2RM4001632 | 29.86 | 24.78 | 26.14 | 43.08 | 46.42 | 34.45 | 16.71 | 16.75 | 13.76 | * | + | ** | − |
| NT2RM4001642 | 2.85 | 2.24 | 1.81 | 3.57 | 2.70 | 1.88 | 1.79 | 3.45 | 2.28 | | | | |
| NT2RM4001647 | 17.28 | 7.78 | 9.99 | 11.15 | 12.30 | 10.77 | 8 | 8.01 | 6.38 | | | | |
| NT2RM4001650 | 0.99 | 1.51 | 1.38 | 2.58 | 3.80 | 3.02 | 1.93 | 2.32 | 1.3 | ** | + | | |
| NT2RM4001662 | 7.87 | 3.75 | 2.87 | 5.79 | 6.00 | 4.16 | 5.7 | 4.40 | 5.34 | | | | |
| NT2RM4001666 | 5.31 | 2.73 | 1.99 | 5.11 | 5.72 | 2.91 | 2.77 | 3.37 | 5 | | | | |
| NT2RM4001670 | 11.64 | 5.63 | 4.93 | 10.66 | 7.77 | 4.83 | 7.89 | 5.98 | 5.85 | | | | |
| NT2RM4001682 | 7.63 | 4.69 | 7.88 | 11.61 | 13.13 | 10.67 | 7.98 | 7.62 | 9.49 | * | + | | |
| NT2RM4001710 | 3.51 | 1.93 | 3.14 | 2.89 | 2.81 | 2.52 | 2.94 | 3.14 | 3.23 | | | | |
| NT2RM4001712 | 4.09 | 1.48 | 2.36 | 6.28 | 6.47 | 3.67 | 3.14 | 2.79 | 2.86 | | | | |
| NT2RM4001714 | 9.74 | 6.27 | 6.28 | 8.33 | 6.94 | 5.10 | 4.33 | 4.54 | 3.78 | | | | |
| NT2RM4001715 | 9.70 | 6.79 | 8.58 | 10.69 | 5.46 | 8.50 | 6.49 | 7.88 | 6.36 | | | | |
| NT2RM4001727 | 9.24 | 3.95 | 4.64 | 8.67 | 8.28 | 6.42 | 5.55 | 4.51 | 4.54 | | | | |
| NT2RM4001731 | 13.05 | 6.04 | 4.43 | 9.34 | 11.19 | 3.94 | 6.46 | 7.94 | 7.44 | | | | |
| NT2RM4001735 | 10.60 | 7.33 | 6.23 | 6.67 | 8.99 | 10.11 | 4.77 | 6.71 | 9.86 | | | | |
| NT2RM4001739 | 4.78 | 4.21 | 5.14 | 4.57 | 4.78 | 3.04 | 2.46 | 4.65 | 3.94 | | | | |
| NT2RM4001741 | 9.97 | 6.74 | 4.99 | 10.67 | 11.48 | 8.89 | 9.93 | 7.28 | 7.04 | | | | |
| NT2RM4001746 | 4.40 | 2.92 | 3.08 | 6.46 | 6.23 | 6.82 | 4.23 | 5.87 | 3.98 | ** | + | | |
| NT2RM4001754 | 5.88 | 4.22 | 4.77 | 3.77 | 2.85 | 3.40 | 2.26 | 3.95 | 2.51 | * | − | * | − |
| NT2RM4001757 | 3.98 | 2.34 | 2.64 | 6.30 | 5.38 | 5.11 | 4.27 | 5.17 | 3.56 | * | + | | |
| NT2RM4001758 | 4.03 | 1.40 | 1.41 | 2.95 | 3.14 | 0.90 | 2.11 | 1.49 | 2.63 | | | | |
| NT2RM4001768 | 9.33 | 3.18 | 2.78 | 8.73 | 9.23 | 6.03 | 4.74 | 5.46 | 7.46 | | | | |
| NT2RM4001775 | 1.60 | 0.85 | 0.48 | 1.68 | 1.19 | 1.13 | 0.51 | 1.89 | 2.16 | | | | |
| NT2RM4001776 | 1.24 | 0.67 | 0.70 | 2.08 | 1.65 | 1.01 | 0.84 | 1.95 | 1.26 | | | | |
| NT2RM4001783 | 3.30 | 1.81 | 1.77 | 3.52 | 4.08 | 2.55 | 1.62 | 3.51 | 1.6 | | | | |
| NT2RM4001793 | 5.58 | 4.64 | 4.50 | 8.16 | 8.15 | 6.01 | 4.19 | 4.76 | 4.23 | * | + | | |
| NT2RM4001810 | 3.48 | 2.21 | 2.29 | 3.20 | 3.69 | 2.65 | 2.04 | 3.39 | 2.03 | | | | |
| NT2RM4001813 | 3.11 | 0.62 | 1.16 | 2.31 | 2.18 | 1.56 | 2 | 3.91 | 2.71 | | | | |
| NT2RM4001818 | 3.22 | 2.40 | 2.49 | 5.46 | 4.70 | 3.11 | 4.89 | 3.44 | 5.14 | | | * | + |
| NT2RM4001819 | 11.19 | 5.78 | 6.63 | 9.55 | 9.42 | 7.47 | 10.81 | 7.51 | 7.34 | | | | |
| NT2RM4001823 | 3.13 | 1.86 | 1.29 | 2.61 | 3.40 | 2.11 | 3.37 | 1.94 | 1.66 | | | | |
| NT2RM4001828 | 8.26 | 6.14 | 6.03 | 15.07 | 18.35 | 11.62 | 9.17 | 6.53 | 11.85 | * | + | | |
| NT2RM4001835 | 3.34 | 2.52 | 2.50 | 5.07 | 6.41 | 5.16 | 6.93 | 7.44 | 8.93 | ** | + | ** | + |
| NT2RM4001836 | 3.42 | 2.60 | 1.50 | 3.55 | 5.57 | 1.89 | 3.02 | 2.62 | 2.83 | | | | |
| NT2RM4001841 | 7.03 | 4.07 | 5.20 | 3.69 | 3.84 | 5.28 | 4.46 | 6.00 | 6.72 | | | | |
| NT2RM4001842 | 2.54 | 1.03 | 0.84 | 4.40 | 5.14 | 3.61 | 2.15 | 3.10 | 2.2 | * | + | | |
| NT2RM4001843 | 7.33 | 3.08 | 3.29 | 4.61 | 4.36 | 4.19 | 6.63 | 4.29 | 4.74 | | | | |
| NT2RM4001856 | 7.28 | 3.36 | 2.92 | 6.92 | 6.61 | 6.34 | 6.76 | 4.92 | 39.96 | | | | |
| NT2RM4001858 | 4.41 | 2.01 | 2.89 | 4.19 | 5.25 | 3.77 | 3.99 | 3.14 | 3.55 | | | | |
| NT2RM4001861 | 15.16 | 9.14 | 7.90 | 8.10 | 8.14 | 9.12 | 7.69 | 7.66 | 6.31 | | | | |
| NT2RM4001863 | 5.18 | 5.03 | 4.89 | 5.35 | 5.57 | 4.84 | 4.1 | 2.95 | 4.25 | | | * | − |
| NT2RM4001865 | 4.40 | 1.50 | 1.71 | 4.54 | 5.77 | 6.01 | 3.87 | 4.69 | 4.27 | * | + | | |
| NT2RM4001869 | 6.80 | 4.12 | 4.66 | 5.90 | 4.78 | 4.71 | 3.79 | 3.46 | 3.8 | | | | |
| NT2RM4001873 | 9.91 | 7.88 | 7.75 | 6.45 | 7.32 | 6.28 | 5.39 | 4.87 | 5.18 | | | ** | − |
| NT2RM4001876 | 20.13 | 9.94 | 9.70 | 9.48 | 8.26 | 10.48 | 13.84 | 12.07 | 14.41 | | | | |
| NT2RM4001880 | 6.36 | 4.04 | 3.70 | 6.23 | 5.32 | 5.66 | 5.53 | 4.83 | 6.28 | | | | |

TABLE 234

| ID | | | | | | | | | | | | | |
|---|---|---|---|---|---|---|---|---|---|---|---|---|---|
| NT2RM4001885 | 12.23 | 5.39 | 5.31 | 15.89 | 14.89 | 14.46 | 9.96 | 8.97 | 11.11 | * | + | | |
| NT2RM4001889 | 17.90 | 10.90 | 9.56 | 25.74 | 24.82 | 26.44 | 14.72 | 12.91 | 12.79 | ** | + | | |
| NT2RM4001894 | 3.99 | 3.32 | 3.07 | 4.15 | 4.34 | 4.16 | 5.09 | 3.83 | 3.49 | | | | |
| NT2RM4001897 | 4.68 | 3.36 | 3.66 | 5.57 | 7.84 | 6.03 | 9.17 | 7.60 | 6.62 | * | + | ** | + |
| NT2RM4001899 | 4.37 | 2.59 | 2.66 | 5.10 | 4.85 | 5.00 | 3.8 | 4.79 | 3.2 | * | + | | |
| NT2RM4001905 | 14.13 | 19.47 | 18.60 | 6.62 | 5.76 | 7.88 | 4.18 | 4.49 | 4.16 | ** | − | ** | − |
| NT2RM4001922 | 4.57 | 2.06 | 2.67 | 5.98 | 6.27 | 5.24 | 3.2 | 3.09 | 2.6 | * | + | | |

TABLE 234-continued

| | | | | | | | | | | | | |
|---|---|---|---|---|---|---|---|---|---|---|---|---|
| NT2RM4001930 | 7.89 | 5.36 | 5.01 | 6.12 | 7.65 | 5.79 | 3.76 | 3.60 | 3.88 | | | |
| NT2RM4001938 | 3.35 | 3.03 | 2.31 | 4.03 | 4.25 | 3.01 | 4.12 | 3.88 | 3.78 | | * | + |
| NT2RM4001940 | 8.88 | 7.21 | 7.25 | 7.65 | 9.61 | 6.94 | 5.41 | 5.68 | 5.3 | | * | − |
| NT2RM4001942 | 48.53 | 24.69 | 36.35 | 81.10 | 98.59 | 62.39 | 57.57 | 65.30 | 79.98 | * | + | * | + |
| NT2RM4001953 | 4.86 | 4.02 | 3.80 | 11.16 | 10.73 | 8.47 | 5.44 | 7.13 | 6.71 | ** | + | * | + |
| NT2RM4001965 | 3.95 | 3.09 | 2.78 | 3.89 | 4.20 | 5.02 | 3.08 | 4.34 | 1.87 | | | |
| NT2RM4001966 | 4.92 | 2.59 | 2.69 | 5.18 | 4.42 | 3.96 | 3.32 | 4.68 | 3.49 | | | |
| NT2RM4001969 | 4.52 | 3.56 | 2.88 | 4.01 | 4.54 | 3.26 | 3.65 | 2.05 | 3.76 | | | |
| NT2RM4001974 | 3.18 | 2.93 | 2.68 | 3.45 | 3.46 | 4.29 | 4 | 3.93 | 2.9 | | | |
| NT2RM4001979 | 7.10 | 5.28 | 4.65 | 8.51 | 9.51 | 9.19 | 5.57 | 5.12 | 5.65 | * | + | |
| NT2RM4001980 | 8.43 | 6.53 | 5.48 | 9.14 | 11.80 | 9.30 | 5.72 | 6.09 | 7.18 | | | |
| NT2RM4001984 | 0.37 | 0.36 | 2.68 | 1.04 | 2.24 | 1.27 | 3.83 | 2.41 | 1.54 | | | |
| NT2RM4001987 | 5.43 | 3.22 | 4.46 | 5.44 | 5.41 | 4.74 | 6.11 | 4.65 | 5.13 | | | |
| NT2RM4002013 | 4.01 | 2.99 | 3.04 | 5.45 | 6.17 | 4.31 | 4.16 | 6.39 | 4.96 | * | + | |
| NT2RM4002018 | 1.35 | 1.30 | 1.91 | 4.17 | 2.80 | 1.86 | 2.66 | 3.82 | 2.52 | | * | + |
| NT2RM4002033 | 5.95 | 4.44 | 3.94 | 8.70 | 9.58 | 8.70 | 6.99 | 4.97 | 5.08 | ** | + | |
| NT2RM4002034 | 10.16 | 6.70 | 5.00 | 9.69 | 8.87 | 7.70 | 7.22 | 5.62 | 6.43 | | | |
| NT2RM4002044 | 17.29 | 9.91 | 9.34 | 16.54 | 14.23 | 14.16 | 9.93 | 9.20 | 9.33 | | | |
| NT2RM4002047 | 4.89 | 3.52 | 4.39 | 7.70 | 9.18 | 8.38 | 5.94 | 5.42 | 6.2 | ** | + | * | + |
| NT2RM4002054 | 5.22 | 3.24 | 3.62 | 4.72 | 4.27 | 3.95 | 3.64 | 4.57 | 3.02 | | | |
| NT2RM4002055 | 4.93 | 3.27 | 3.62 | 3.58 | 4.71 | 3.15 | 4.05 | 4.74 | 4.4 | | | |
| NT2RM4002059 | 10.05 | 6.75 | 9.67 | 10.16 | 11.99 | 13.43 | 18.25 | 24.17 | 33.19 | | * | + |
| NT2RM4002061 | 3.42 | 2.42 | 3.12 | 3.99 | 4.28 | 3.66 | 2.26 | 2.93 | 1.81 | * | + | |
| NT2RM4002062 | 6.37 | 2.90 | 3.38 | 2.10 | 2.75 | 3.44 | 2.98 | 2.78 | 3.12 | | | |
| NT2RM4002063 | 8.92 | 6.28 | 4.96 | 9.35 | 7.20 | 6.28 | 7.35 | 7.35 | 6.46 | | | |
| NT2RM4002066 | 5.12 | 2.57 | 2.72 | 3.13 | 3.43 | 2.84 | 3.67 | 3.65 | 2.97 | | | |
| NT2RM4002067 | 1.89 | 1.36 | 1.11 | 3.88 | 3.13 | 3.49 | 1.44 | 3.55 | 1.91 | ** | + | |
| NT2RM4002073 | 3.81 | 3.18 | 2.17 | 3.78 | 3.91 | 3.14 | 2.82 | 4.59 | 3.46 | | | |
| NT2RM4002074 | 3.75 | 3.15 | 4.02 | 2.89 | 4.67 | 3.46 | 2.89 | 2.92 | 2.59 | | * | − |
| NT2RM4002075 | 1.30 | 1.13 | 1.76 | 2.76 | 2.64 | 2.94 | 1.69 | 2.40 | 1.5 | ** | + | |
| NT2RM4002076 | 4.00 | 1.21 | 3.46 | 2.32 | 2.53 | 2.49 | 2.84 | 3.24 | 1.6 | | | |
| NT2RM4002078 | 12.66 | 8.15 | 5.73 | 7.75 | 7.44 | 9.12 | 8.77 | 7.66 | 8.72 | | | |
| NT2RM4002081 | 5.48 | 5.00 | 3.54 | 7.62 | 9.31 | 8.00 | 5.52 | 7.35 | 6.24 | ** | + | |
| NT2RM4002082 | 4.26 | 2.31 | 2.02 | 3.34 | 2.38 | 2.66 | 2.89 | 2.98 | 2.86 | | | |
| NT2RM4002093 | 3.89 | 2.69 | 2.12 | 7.05 | 6.79 | 4.47 | 2.74 | 4.50 | 3.5 | * | + | |
| NT2RM4002109 | 5.34 | 3.93 | 2.60 | 5.27 | 7.18 | 5.20 | 3.25 | 3.84 | 4.24 | | | |
| NT2RM4002115 | 3.73 | 2.51 | 2.56 | 3.60 | 4.16 | 3.32 | 2.9 | 3.99 | 2.74 | | | |
| NT2RM4002118 | 2.39 | 1.49 | 2.46 | 3.46 | 6.34 | 3.85 | 3.47 | 4.78 | 5.61 | | * | + |
| NT2RM4002128 | 1.76 | 1.98 | 1.98 | 2.53 | 2.32 | 2.56 | 1.95 | 1.96 | 1.45 | ** | + | |
| NT2RM4002137 | 5.40 | 3.31 | 3.77 | 3.32 | 5.16 | 4.10 | 4.08 | 2.63 | 2.49 | | | |
| NT2RM4002139 | 6.38 | 4.93 | 5.07 | 14.74 | 15.06 | 13.57 | 6.58 | 7.18 | 6.59 | ** | + | |
| NT2RM4002140 | 7.07 | 3.90 | 5.01 | 9.78 | 11.72 | 9.95 | 6.8 | 5.99 | 6.18 | ** | + | |
| NT2RM4002145 | 5.69 | 2.65 | 3.96 | 6.30 | 6.51 | 4.16 | 4.2 | 6.86 | 5.05 | | | |
| NT2RM4002146 | 12.58 | 8.18 | 8.37 | 8.91 | 7.31 | 8.60 | 4.94 | 6.93 | 3.9 | | | |
| NT2RM4002161 | 1.51 | 1.71 | 1.05 | 2.14 | 2.32 | 1.65 | 1.38 | 2.18 | 1.6 | | | |
| NT2RM4002174 | 2.04 | 1.62 | 2.29 | 4.40 | 6.82 | 5.43 | 2.41 | 4.19 | 3.45 | ** | + | |
| NT2RM4002178 | 4.27 | 1.80 | 4.02 | 7.72 | 6.53 | 7.07 | 4.59 | 6.24 | 4.61 | * | + | |
| NT2RM4002180 | 14.71 | 6.92 | 6.30 | 9.50 | 9.96 | 6.78 | 4.56 | 4.83 | 5.69 | | | |
| NT2RM4002185 | 5.31 | 3.85 | 4.04 | 4.39 | 4.78 | 3.75 | 5.7 | 4.91 | 5.17 | | | |

TABLE 235

| | | | | | | | | | | | | |
|---|---|---|---|---|---|---|---|---|---|---|---|---|
| NT2RM4002189 | 27.09 | 13.74 | 15.74 | 14.48 | 15.82 | 14.29 | 21.97 | 17.24 | 13.45 | | | |
| NT2RM4002194 | 14.06 | 6.46 | 6.54 | 8.20 | 8.96 | 5.67 | 5.24 | 4.78 | 7.73 | | | |
| NT2RM4002198 | 9.72 | 5.05 | 4.64 | 9.60 | 7.14 | 7.42 | 3.99 | 6.05 | 4.24 | | | |
| NT2RM4002205 | 6.04 | 2.24 | 4.01 | 10.17 | 8.07 | 7.85 | 3.89 | 6.45 | 5.48 | * | + | |
| NT2RM4002213 | 8.85 | 5.39 | 4.89 | 8.71 | 11.13 | 8.58 | 6.75 | 7.49 | 6.59 | | | |
| NT2RM4002216 | 13.98 | 11.40 | 13.83 | 9.67 | 12.26 | 12.25 | 5.51 | 6.10 | 8.64 | | ** | − |
| NT2RM4002226 | 11.71 | 3.35 | 5.45 | 7.00 | 6.75 | 5.32 | 2.56 | 2.81 | 2.06 | | | |
| NT2RM4002237 | 12.13 | 5.23 | 4.66 | 6.69 | 6.79 | 4.62 | 5.28 | 4.25 | 5.13 | | | |
| NT2RM4002240 | 3.83 | 1.22 | 1.76 | 2.57 | 3.67 | 3.49 | 1.94 | 2.86 | 3.13 | | | |
| NT2RM4002251 | 4.23 | 2.41 | 3.59 | 5.58 | 5.63 | 2.99 | 3.14 | 4.22 | 3.57 | | | |
| NT2RM4002256 | 9.61 | 4.69 | 5.30 | 9.65 | 8.00 | 8.72 | 6.39 | 6.24 | 6.69 | | | |
| NT2RM4002262 | 2.51 | 1.66 | 3.08 | 3.94 | 4.02 | 2.93 | 2.54 | 4.64 | 4.87 | | | |
| NT2RM4002266 | 3.81 | 3.04 | 1.77 | 5.13 | 5.13 | 3.56 | 1.74 | 3.97 | 3 | | | |
| NT2RM4002276 | 6.07 | 4.19 | 4.53 | 7.03 | 5.98 | 6.29 | 6.42 | 7.40 | 4.56 | | | |
| NT2RM4002278 | 5.55 | 3.50 | 2.06 | 5.22 | 5.68 | 3.41 | 2.26 | 1.92 | 4.58 | | | |
| NT2RM4002281 | 10.82 | 3.97 | 3.78 | 8.02 | 12.45 | 5.87 | 8.47 | 7.73 | 8.03 | | | |
| NT2RM4002287 | 4.73 | 2.14 | 2.11 | 4.48 | 2.86 | 2.45 | 3.19 | 4.14 | 1.9 | | | |
| NT2RM4002294 | 3.56 | 2.28 | 1.67 | 6.99 | 5.40 | 3.49 | 3.08 | 4.20 | 3.5 | | | |
| NT2RM4002298 | 4.25 | 1.83 | 2.68 | 5.32 | 3.86 | 5.10 | 6.58 | 7.80 | 6.73 | | ** | + |
| NT2RM4002301 | 2.19 | 2.10 | 1.85 | 3.43 | 4.22 | 3.48 | 1.84 | 3.94 | 2.05 | ** | + | |
| NT2RM4002306 | 4.28 | 2.89 | 2.26 | 4.38 | 4.65 | 4.86 | 3.01 | 4.34 | 2.42 | | | |
| NT2RM4002323 | 4.07 | 3.11 | 3.95 | 9.92 | 6.06 | 6.87 | 4.61 | 4.01 | 2.32 | * | + | |
| NT2RM4002334 | 48.90 | 21.85 | 22.81 | 35.78 | 25.59 | 28.97 | 30.63 | 31.70 | 22.58 | | | |
| NT2RM4002339 | 2.06 | 1.58 | 1.46 | 1.24 | 1.64 | 1.38 | 3.19 | 1.21 | 1.93 | | | |

TABLE 235-continued

| | | | | | | | | | | | | | |
|---|---|---|---|---|---|---|---|---|---|---|---|---|---|
| NT2RM4002344 | 3.34 | 2.36 | 2.32 | 3.06 | 3.36 | 3.28 | 1.98 | 2.28 | 1.57 | | | | |
| NT2RM4002345 | 3.14 | 4.48 | 1.33 | 2.81 | 6.18 | 3.52 | 3.97 | 3.81 | 7.59 | | | | |
| NT2RM4002352 | 2.56 | 1.55 | 1.37 | 2.09 | 1.90 | 1.83 | 1.8 | 2.16 | 1.75 | | | | |
| NT2RM4002362 | 10.19 | 5.95 | 5.50 | 3.14 | 3.38 | 3.88 | 2.99 | 2.56 | 2.32 | | | * | − |
| NT2RM4002373 | 3.73 | 2.27 | 4.81 | 3.06 | 4.43 | 4.48 | 1.89 | 2.78 | 3.21 | | | | |
| NT2RM4002374 | 2.46 | 1.36 | 2.00 | 4.92 | 6.85 | 2.91 | 2.01 | 2.17 | 2.46 | | | | |
| NT2RM4002376 | 3.65 | 2.05 | 2.36 | 5.15 | 3.88 | 5.04 | 5.2 | 2.97 | 2.99 | * | + | | |
| NT2RM4002383 | 5.41 | 2.46 | 3.35 | 8.94 | 8.52 | 7.85 | 5.76 | 4.08 | 7.78 | ** | + | | |
| NT2RM4002390 | 7.22 | 2.53 | 2.49 | 3.89 | 3.09 | 3.46 | 2.47 | 3.20 | 2.59 | | | | |
| NT2RM4002398 | 4.68 | 2.42 | 2.88 | 5.08 | 6.85 | 4.30 | 3.82 | 2.28 | 3.63 | | | | |
| NT2RM4002409 | 2.87 | 2.53 | 3.04 | 4.21 | 5.07 | 3.80 | 3.49 | 3.93 | 3.64 | * | + | * | + |
| NT2RM4002414 | 5.03 | 1.84 | 3.97 | 3.80 | 4.16 | 6.28 | 4.49 | 4.44 | 4.68 | | | | |
| NT2RM4002438 | 5.21 | 2.42 | 2.20 | 4.07 | 3.59 | 4.94 | 3.44 | 3.46 | 2.5 | | | | |
| NT2RM4002440 | 4.95 | 2.33 | 3.53 | 5.69 | 5.26 | 3.20 | 3.34 | 4.02 | 4.39 | | | | |
| NT2RM4002446 | 6.41 | 3.72 | 3.77 | 5.16 | 5.23 | 4.99 | 5.81 | 3.91 | 5.57 | | | | |
| NT2RM4002450 | 7.34 | 5.13 | 5.19 | 4.41 | 3.88 | 3.16 | 3.9 | 3.82 | 4.13 | | | | |
| NT2RM4002452 | 4.76 | 3.56 | 2.63 | 3.31 | 4.00 | 4.75 | 2.58 | 2.59 | 2.32 | | | | |
| NT2RM4002457 | 3.97 | 2.35 | 2.27 | 5.42 | 4.08 | 5.14 | 4.64 | 3.85 | 2.87 | * | + | | |
| NT2RM4002458 | 2.05 | 1.17 | 1.07 | 1.55 | 3.27 | 2.46 | 2.27 | 3.06 | 1.92 | | | | |
| NT2RM4002460 | 1.51 | 0.73 | 1.48 | 0.65 | 1.16 | 0.85 | 1.55 | 1.39 | 1.26 | | | | |
| NT2RM4002464 | 2.69 | 1.95 | 2.48 | 3.72 | 3.71 | 4.31 | 2.38 | 2.92 | 1.83 | ** | + | | |
| NT2RM4002479 | 6.89 | 5.60 | 6.27 | 9.61 | 8.13 | 4.62 | 4.88 | 6.96 | 5.42 | | | | |
| NT2RM4002482 | 35.61 | 22.59 | 16.97 | 21.71 | 19.69 | 20.16 | 30.11 | 17.88 | 24.23 | | | | |
| NT2RM4002489 | 15.59 | 8.96 | 10.80 | 10.87 | 12.64 | 11.89 | 10.58 | 8.12 | 11.95 | | | | |
| NT2RM4002493 | 3.66 | 2.45 | 2.96 | 3.64 | 2.32 | 2.09 | 3.63 | 3.17 | 2.29 | | | | |
| NT2RM4002499 | 39.72 | 27.06 | 27.17 | 54.95 | 67.76 | 43.13 | 21.05 | 20.01 | 15.47 | * | + | | |
| NT2RM4002504 | 10.06 | 5.00 | 4.83 | 15.16 | 13.66 | 11.30 | 9.77 | 10.12 | 11.17 | * | + | | |
| NT2RM4002506 | 3.00 | 2.28 | 3.10 | 3.05 | 3.95 | 4.66 | 3.19 | 3.46 | 3.27 | | | | |
| NT2RM4002510 | 1.71 | 1.62 | 1.42 | 3.05 | 3.64 | 3.86 | 2.57 | 2.61 | 2.07 | ** | + | * | + |
| NT2RM4002527 | 1.36 | 1.99 | 1.93 | 1.99 | 2.17 | 2.01 | 1.62 | 2.61 | 1.13 | | | | |
| NT2RM4002532 | 8.36 | 3.92 | 4.29 | 7.17 | 9.98 | 8.89 | 6.69 | 5.89 | 6.32 | | | | |
| NT2RM4002534 | 5.34 | 2.37 | 2.56 | 3.48 | 4.24 | 3.83 | 3.66 | 4.16 | 3.67 | | | | |

TABLE 236

| | | | | | | | | | | | | | |
|---|---|---|---|---|---|---|---|---|---|---|---|---|---|
| NT2RM4002535 | 8.63 | 5.41 | 4.92 | 15.46 | 13.83 | 13.63 | 8.73 | 8.80 | 8.02 | ** | + | | |
| NT2RM4002554 | 3.24 | 2.37 | 1.91 | 1.77 | 3.57 | 2.77 | 2.58 | 2.42 | 1.39 | | | | |
| NT2RM4002558 | 3.05 | 3.08 | 3.12 | 4.82 | 3.64 | 4.78 | 4.67 | 4.24 | 3.5 | * | + | * | + |
| NT2RM4002565 | 4.27 | 2.27 | 3.74 | 8.08 | 6.46 | 7.43 | 4.53 | 4.18 | 4.36 | ** | + | | |
| NT2RM4002567 | 2.07 | 1.22 | 2.13 | 2.02 | 9.16 | 3.14 | 2.05 | 3.10 | 2.71 | | | | |
| NT2RM4002571 | 4.37 | 2.84 | 3.54 | 4.69 | 4.81 | 3.75 | 4.16 | 4.57 | 3.27 | | | | |
| NT2RM4002572 | 6.03 | 2.28 | 2.98 | 6.08 | 6.68 | 4.99 | 9.74 | 8.44 | 9.5 | | | * | + |
| NT2RM4002577 | 2.75 | 1.19 | 0.59 | 1.71 | 1.14 | 1.51 | 6.59 | 4.68 | 6.71 | | | ** | + |
| NT2RM4002583 | 3.95 | 2.68 | 2.93 | 2.91 | 3.44 | 3.57 | 3.57 | 3.67 | 3.56 | | | | |
| NT2RM4002584 | 6.72 | 4.52 | 4.49 | 7.70 | 8.13 | 5.82 | 4.85 | 4.09 | 4.77 | | | | |
| NT2RM4002593 | 11.06 | 6.50 | 9.20 | 6.84 | 5.82 | 5.78 | 2.04 | 3.51 | 4.47 | | | * | − |
| NT2RM4002594 | 4.49 | 2.50 | 2.60 | 5.70 | 6.28 | 5.59 | 4.77 | 7.23 | 6.06 | * | + | * | + |
| NT2RM4002604 | 4.69 | 2.15 | 3.00 | 3.62 | 4.47 | 4.27 | 3.38 | 3.51 | 3.57 | | | | |
| NT2RM4002614 | 2.09 | 1.88 | 1.83 | 3.05 | 2.85 | 2.71 | 1.21 | 3.15 | 1.87 | ** | + | | |
| NT2RM4002616 | 5.30 | 2.89 | 2.15 | 2.37 | 1.56 | 2.52 | 2.81 | 1.79 | 2.9 | | | | |
| NT2RM4002623 | 8.57 | 2.95 | 4.75 | 3.25 | 4.49 | 3.44 | 2.87 | 3.18 | 2.88 | | | | |
| NT2RM4002634 | 1.64 | 1.74 | 1.53 | 1.95 | 2.12 | 2.72 | 2.59 | 3.50 | 2.79 | | | ** | + |
| NT2RM4002636 | 5.12 | 3.99 | 4.07 | 4.89 | 3.26 | 2.51 | 3.1 | 3.30 | 2.24 | | | * | − |
| NT2RP1000002 | 4.91 | 2.69 | 3.55 | 5.37 | 6.59 | 6.81 | 5.02 | 6.11 | 5.97 | * | + | | |
| NT2RP1000006 | 3.58 | 2.73 | 3.36 | 3.30 | 5.24 | 3.97 | 3.46 | 5.04 | 3.59 | | | | |
| NT2RP1000015 | 0.58 | 0.54 | 1.13 | 1.73 | 1.75 | 2.13 | 1.06 | 2.60 | 1.34 | ** | + | | |
| NT2RP1000018 | 0.26 | 0.38 | 0.59 | 1.15 | 1.19 | 1.44 | 1.05 | 2.21 | 0.52 | ** | + | | |
| NT2RP1000034 | 281.35 | 132.61 | 141.44 | 137.16 | 124.07 | 106.57 | 66.03 | 58.57 | 54.32 | | | | |
| NT2RP1000035 | 3.85 | 3.38 | 2.73 | 3.70 | 4.44 | 3.26 | 2.6 | 2.77 | 2.19 | | | | |
| NT2RP1000040 | 1.60 | 1.01 | 1.16 | 1.82 | 1.72 | 0.90 | 1.72 | 1.93 | 1.4 | | | | |
| NT2RP1000042 | 0.16 | 0.85 | 0.49 | 1.42 | 1.37 | 0.52 | 0.89 | 2.70 | 1.63 | | | | |
| NT2RP1000048 | 3.91 | 1.94 | 1.67 | 2.45 | 3.78 | 2.00 | 3.04 | 5.80 | 4.69 | | | | |
| NT2RP1000050 | 2.17 | 1.06 | 1.90 | 2.79 | 3.16 | 3.31 | 1.43 | 4.04 | 2.02 | * | + | | |
| NT2RP1000056 | 29.42 | 14.22 | 19.60 | 15.96 | 16.06 | 15.82 | 8.26 | 10.94 | 9.03 | | | | |
| NT2RP1000058 | 1.76 | 1.01 | 1.59 | 2.63 | 1.51 | 1.74 | 0.73 | 1.28 | 0.3 | | | | |
| NT2RP1000063 | 2.86 | 1.68 | 1.32 | 1.33 | 2.84 | 1.66 | 1.17 | 1.53 | 1.43 | | | | |
| NT2RP1000068 | 2.57 | 1.65 | 0.98 | 2.49 | 2.52 | 1.99 | 1.28 | 2.09 | 2.14 | | | | |
| NT2RP1000072 | 111.07 | 54.80 | 68.45 | 57.17 | 59.96 | 64.56 | 51.74 | 45.59 | 52.17 | | | | |
| NT2RP1000073 | 0.97 | 0.59 | 0.56 | 1.83 | 1.57 | 2.36 | 0.84 | 2.78 | 1.72 | * | + | | |
| NT2RP1000078 | 3.33 | 1.48 | 2.67 | 2.36 | 2.30 | 2.50 | 1.17 | 3.68 | 1.39 | | | | |
| NT2RP1000079 | 2.67 | 0.92 | 1.74 | 2.69 | 2.08 | 2.10 | 4.5 | 6.28 | 4.63 | | | * | + |
| NT2RP1000080 | 7.28 | 4.50 | 5.28 | 5.11 | 5.46 | 5.42 | 2.3 | 4.02 | 3.44 | | | | |
| NT2RP1000086 | 4.35 | 3.00 | 3.48 | 3.24 | 3.23 | 2.33 | 1.02 | 2.72 | 1.4 | | | * | − |
| NT2RP1000087 | 5.00 | 2.82 | 2.77 | 4.73 | 5.17 | 3.70 | 4.25 | 2.63 | 3.17 | | | | |
| NT2RP1000089 | 21.30 | 13.02 | 9.99 | 15.70 | 10.56 | 8.76 | 7.11 | 5.03 | 7.52 | | | | |
| NT2RP1000090 | 62.12 | 34.52 | 35.37 | 65.14 | 57.48 | 42.93 | 29.21 | 27.16 | 16.48 | | | | |

TABLE 236-continued

| | | | | | | | | | | | | |
|---|---|---|---|---|---|---|---|---|---|---|---|---|
| NT2RP1000100 | 2.17 | 0.88 | 1.25 | 1.24 | 1.63 | 1.66 | 0.75 | 2.69 | 2.15 | | | |
| NT2RP1000101 | 6.92 | 3.86 | 4.62 | 6.27 | 8.56 | 8.35 | 6.29 | 5.31 | 6.14 | | | |
| NT2RP1000111 | 3.13 | 2.02 | 3.20 | 4.79 | 4.46 | 1.70 | 2.06 | 3.98 | 4.56 | | | |
| NT2RP1000112 | 1.19 | 1.17 | 1.40 | 1.98 | 2.39 | 2.90 | 2.08 | 3.24 | 1.09 | * | + | |
| NT2RP1000124 | 2.04 | 1.79 | 2.18 | 5.67 | 6.32 | 7.61 | 0.92 | 3.26 | 4.08 | ** | + | |
| NT2RP1000125 | 13.33 | 6.69 | 5.55 | 16.93 | 13.49 | 11.53 | 18.17 | 14.66 | 19.62 | | * | + |
| NT2RP1000129 | 8.42 | 3.01 | 2.92 | 5.33 | 4.43 | 3.32 | 3.8 | 3.24 | 4.62 | | | |
| NT2RP1000130 | 3.80 | 3.59 | 3.16 | 6.14 | 5.63 | 6.01 | 3.49 | 3.06 | 4.37 | ** | + | |
| NT2RP1000154 | 2.77 | 1.66 | 1.73 | 4.97 | 6.35 | 4.78 | 3.19 | 4.61 | 2.92 | ** | + | |
| NT2RP1000163 | 2.54 | 1.56 | 0.69 | 1.65 | 3.20 | 1.85 | 0.24 | 3.07 | 0.88 | | | |
| NT2RP1000170 | 1.25 | 0.62 | 0.44 | 1.93 | 1.94 | 1.90 | 0.89 | 3.09 | 1.57 | ** | + | |
| NT2RP1000174 | 0.77 | 0.39 | 0.59 | 0.80 | 1.14 | 0.73 | 0.83 | 1.30 | 0.25 | | | |
| NT2RP1000181 | 15.66 | 7.51 | 13.59 | 20.37 | 20.72 | 18.84 | 8.95 | 8.78 | 5.68 | * | + | |
| NT2RP1000191 | 2.05 | 1.96 | 1.05 | 3.54 | 1.96 | 2.31 | 1.34 | 1.45 | 2.86 | | | |
| NT2RP1000202 | 1.43 | 1.24 | 0.92 | 2.91 | 2.20 | 1.99 | 0.8 | 2.37 | 2.35 | * | + | |

TABLE 237

| | | | | | | | | | | | | |
|---|---|---|---|---|---|---|---|---|---|---|---|---|
| NT2RP1000239 | 0.54 | 0.73 | 0.33 | 1.02 | 1.34 | 0.58 | 0.16 | 1.81 | 1.18 | | | |
| NT2RP1000243 | 0.84 | 0.90 | 0.58 | 2.06 | 1.73 | 0.89 | 0.86 | 2.41 | 1.44 | | | |
| NT2RP1000255 | 0.75 | 0.34 | 1.01 | 1.49 | 0.71 | 0.80 | 0.75 | 1.85 | 0.92 | | | |
| NT2RP1000259 | 1.78 | 1.74 | 1.10 | 4.78 | 3.63 | 3.84 | 2.82 | 4.39 | 2.57 | ** | + | * | + |
| NT2RP1000261 | 1.08 | 0.77 | 0.32 | 2.74 | 1.80 | 1.60 | 0.7 | 2.51 | 1.42 | * | + | |
| NT2RP1000269 | 12.70 | 6.05 | 5.79 | 12.05 | 12.78 | 10.09 | 7.5 | 10.31 | 8.4 | | | |
| NT2RP1000271 | 65.05 | 27.46 | 27.30 | 118.92 | 88.05 | 70.43 | 44.58 | 28.04 | 22.55 | | | |
| NT2RP1000272 | 15.64 | 8.87 | 8.62 | 11.91 | 10.97 | 10.04 | 8.77 | 5.04 | 6.08 | | | |
| NT2RP1000279 | 3.64 | 2.60 | 2.62 | 4.01 | 4.52 | 4.50 | 3.4 | 3.60 | 2.95 | * | + | |
| NT2RP1000290 | 31.80 | 25.40 | 25.59 | 36.52 | 40.72 | 40.15 | 26.39 | 22.95 | 29.24 | ** | + | |
| NT2RP1000293 | 8.90 | 5.15 | 6.17 | 9.07 | 11.34 | 10.12 | 7.62 | 7.73 | 8.67 | | | |
| NT2RP1000300 | 21.75 | 19.20 | 18.07 | 20.53 | 28.21 | 20.72 | 16.45 | 24.53 | 12.12 | | | |
| NT2RP1000324 | 12.47 | 5.32 | 8.89 | 10.68 | 13.57 | 9.75 | 6.98 | 9.83 | 9.18 | | | |
| NT2RP1000325 | 91.19 | 35.26 | 49.60 | 54.44 | 61.67 | 55.26 | 47.32 | 30.15 | 44.99 | | | |
| NT2RP1000326 | 10.60 | 7.28 | 6.00 | 12.46 | 8.25 | 10.43 | 7.71 | 8.51 | 5.43 | | | |
| NT2RP1000331 | 13.85 | 7.24 | 6.82 | 12.25 | 10.31 | 7.00 | 5.01 | 4.72 | 3.71 | | | |
| NT2RP1000333 | 12.54 | 6.22 | 6.09 | 8.86 | 8.17 | 8.74 | 6.53 | 7.71 | 7.88 | | | |
| NT2RP1000336 | 1.87 | 1.73 | 1.02 | 1.35 | 1.53 | 1.21 | 3.14 | 2.70 | 2.83 | | * | + |
| NT2RP1000347 | 2.75 | 2.10 | 2.88 | 2.09 | 2.48 | 2.62 | 1.53 | 2.25 | 0.84 | | | |
| NT2RP1000348 | 1.47 | 0.48 | 0.33 | 1.45 | 1.42 | 2.72 | 1.13 | 1.89 | 0.66 | | | |
| NT2RP1000349 | 0.93 | 0.52 | 0.64 | 1.41 | 1.77 | 1.72 | 0.95 | 0.90 | 1.19 | ** | + | |
| NT2RP1000353 | 40.50 | 18.12 | 20.02 | 27.21 | 16.43 | 19.17 | 10.71 | 8.40 | 12.57 | | | |
| NT2RP1000356 | 39.98 | 22.39 | 20.90 | 32.15 | 26.26 | 25.06 | 14.83 | 10.10 | 14.28 | | | |
| NT2RP1000357 | 13.61 | 7.81 | 6.20 | 11.20 | 13.90 | 12.68 | 8.98 | 8.00 | 11.38 | | | |
| NT2RP1000358 | 11.64 | 5.39 | 5.27 | 10.20 | 9.77 | 8.75 | 7.77 | 6.88 | 9.19 | | | |
| NT2RP1000360 | 26.32 | 15.93 | 17.17 | 17.83 | 19.58 | 19.99 | 16.48 | 15.94 | 15.67 | | | |
| NT2RP1000363 | 22.05 | 14.66 | 16.07 | 21.39 | 24.54 | 24.53 | 22.26 | 17.18 | 17.26 | | | |
| NT2RP1000376 | 5.84 | 3.91 | 5.30 | 4.51 | 6.40 | 6.42 | 7.18 | 6.13 | 5.77 | | | |
| NT2RP1000386 | 31.79 | 21.04 | 23.39 | 64.26 | 64.31 | 34.90 | 56.81 | 60.95 | 58.22 | * | + | ** | + |
| NT2RP1000407 | 0.29 | 0.73 | 0.45 | 0.62 | 0.61 | 0.29 | 1.08 | 0.88 | 0.22 | | | |
| NT2RP1000409 | 2.22 | 1.91 | 0.68 | 2.83 | 3.38 | 2.80 | 2.71 | 1.86 | 1.7 | | | |
| NT2RP1000413 | 7.71 | 3.51 | 3.63 | 7.04 | 7.63 | 7.01 | 5.32 | 4.65 | 6.75 | | | |
| NT2RP1000416 | 2.07 | 0.73 | 0.71 | 1.73 | 2.70 | 2.64 | 1.38 | 1.53 | 1.42 | | | |
| NT2RP1000418 | 0.88 | 0.78 | 0.91 | 2.07 | 1.77 | 2.03 | 1.84 | 2.71 | 1.4 | ** | + | * | + |
| NT2RP1000420 | 0.51 | 0.68 | 0.34 | 1.31 | 0.46 | 1.21 | 1.33 | 1.52 | 0.65 | | | |
| NT2RP1000434 | 0.66 | 0.29 | 2.53 | 1.80 | 1.28 | 1.15 | 1.63 | 2.36 | 0.97 | | | |
| NT2RP1000439 | 13.59 | 10.41 | 10.76 | 8.22 | 11.99 | 8.15 | 6.48 | 6.20 | 3.53 | | * | − |
| NT2RP1000443 | 1.67 | 1.60 | 1.02 | 3.09 | 3.95 | 2.04 | 3.35 | 1.76 | 1.48 | | | |
| NT2RP1000447 | 2.13 | 0.82 | 0.90 | 2.07 | 1.95 | 1.21 | 1.39 | 1.67 | 1.12 | | | |
| NT2RP1000448 | 1.39 | 0.47 | 0.72 | 0.68 | 1.75 | 1.34 | 1.82 | 1.77 | 0.69 | | | |
| NT2RP1000451 | 5.40 | 2.45 | 1.97 | 5.69 | 5.15 | 3.49 | 1.66 | 2.36 | 1.96 | | | |
| NT2RP1000458 | 22.07 | 12.50 | 14.79 | 20.35 | 29.47 | 24.03 | 21.83 | 19.22 | 26.03 | | | |
| NT2RP1000460 | 19.74 | 9.97 | 12.40 | 17.61 | 20.40 | 21.09 | 17.72 | 15.83 | 18.24 | | | |
| NT2RP1000465 | 14.77 | 10.71 | 12.70 | 18.32 | 19.61 | 21.10 | 14.71 | 11.30 | 11.86 | ** | + | |
| NT2RP1000468 | 3.47 | 2.54 | 4.12 | 7.07 | 8.07 | 7.42 | 3.93 | 5.61 | 4.57 | ** | + | |
| NT2RP1000470 | 14.45 | 6.40 | 6.23 | 5.28 | 6.94 | 7.41 | 8.62 | 6.71 | 6.97 | | | |
| NT2RP1000477 | 0.33 | 0.76 | 0.21 | 0.93 | 1.49 | 0.73 | 0.8 | 1.04 | 0.52 | | | |
| NT2RP1000478 | 2.01 | 1.44 | 1.12 | 1.74 | 1.18 | 2.18 | 1.98 | 3.01 | 1.97 | | | |
| NT2RP1000481 | 3.26 | 1.45 | 1.19 | 1.27 | 1.08 | 1.24 | 0.92 | 2.02 | 0.85 | | | |
| NT2RP1000493 | 1.13 | 0.65 | 0.54 | 1.16 | 1.49 | 1.41 | 1.57 | 2.12 | 0.89 | * | + | |
| NT2RP1000513 | 8.57 | 3.43 | 5.13 | 11.73 | 10.43 | 8.69 | 10.51 | 9.55 | 9.33 | | | |
| NT2RP1000522 | 9.74 | 3.47 | 5.93 | 6.13 | 9.61 | 9.77 | 8.53 | 8.00 | 7.9 | | | |
| NT2RP1000533 | 2.49 | 0.79 | 1.93 | 2.45 | 2.66 | 3.02 | 1.21 | 2.77 | 1.5 | | | |
| NT2RP1000544 | 2.42 | 0.99 | 0.69 | 2.39 | 1.44 | 1.14 | 1.43 | 1.13 | 2.11 | | | |
| NT2RP1000547 | 0.17 | 0.54 | 0.23 | 0.77 | 0.69 | 0.77 | 0.43 | 1.67 | 0.73 | * | + | |
| NT2RP1000551 | 1.62 | 1.44 | 0.64 | 0.50 | 0.71 | 0.60 | 1.24 | 2.56 | 1.59 | | | |

TABLE 238

| | | | | | | | | | | | | | |
|---|---|---|---|---|---|---|---|---|---|---|---|---|---|
| NT2RP1000567 | 1.21 | 0.33 | 0.63 | 1.21 | 1.30 | 2.41 | 2.12 | 3.42 | 1.77 | | | * | + |
| NT2RP1000574 | 1.82 | 0.32 | 0.03 | 23.76 | 28.12 | 20.34 | 4.23 | 4.69 | 3.79 | ** | + | ** | + |
| NT2RP1000577 | 1.22 | 0.49 | 0.73 | 1.46 | 1.85 | 1.75 | 1.18 | 2.92 | 1.35 | * | + | | |
| NT2RP1000579 | 0.79 | 0.65 | 0.57 | 1.33 | 1.34 | 1.32 | 1.35 | 2.50 | 0.76 | ** | + | | |
| NT2RP1000581 | 1.36 | 0.66 | 1.82 | 2.04 | 1.55 | 1.78 | 1.95 | 2.51 | 1.03 | | | | |
| NT2RP1000593 | 2.64 | 0.66 | 1.75 | 2.65 | 2.96 | 1.71 | 1.41 | 0.83 | 1.4 | | | | |
| NT2RP1000604 | 11.50 | 7.94 | 7.40 | 3.94 | 3.98 | 3.21 | 2.12 | 2.31 | 2.08 | * | − | ** | − |
| NT2RP1000609 | 2.53 | 2.00 | 0.54 | 1.02 | 1.56 | 1.09 | 1.82 | 2.61 | 1.48 | | | | |
| NT2RP1000613 | 1.94 | 0.88 | 0.65 | 1.32 | 0.99 | 1.16 | 0.85 | 2.58 | 1.01 | | | | |
| NT2RP1000622 | 1.32 | 0.92 | 0.99 | 1.13 | 1.63 | 1.80 | 1.57 | 3.98 | 2.19 | | | | |
| NT2RP1000627 | 5.47 | 2.19 | 3.87 | 5.94 | 4.15 | 4.81 | 4.23 | 6.27 | 4.91 | | | | |
| NT2RP1000629 | 1.49 | 0.86 | 0.95 | 1.86 | 1.84 | 2.88 | 2.18 | 2.88 | 1.87 | | | * | + |
| NT2RP1000630 | 5.89 | 2.85 | 5.42 | 13.99 | 11.47 | 13.46 | 7.36 | 6.55 | 7.16 | ** | + | | |
| NT2RP1000639 | 2.68 | 1.18 | 0.53 | 1.84 | 1.97 | 0.94 | 1.56 | 1.83 | 1.5 | | | | |
| NT2RP1000640 | 81.74 | 37.60 | 35.82 | 57.27 | 52.32 | 39.58 | 48.18 | 42.34 | 41.38 | | | | |
| NT2RP1000646 | 7.82 | 4.91 | 3.97 | 8.29 | 9.40 | 9.31 | 5.5 | 5.31 | 6.52 | * | + | | |
| NT2RP1000659 | 6.71 | 2.34 | 3.90 | 4.05 | 6.32 | 6.12 | 3.31 | 4.60 | 4.15 | | | | |
| NT2RP1000674 | 4.71 | 2.08 | 3.93 | 5.76 | 7.16 | 7.25 | 3.17 | 4.95 | 4.5 | * | + | | |
| NT2RP1000677 | 9.51 | 6.01 | 6.41 | 8.66 | 8.51 | 8.83 | 7.33 | 7.01 | 8.68 | | | | |
| NT2RP1000679 | 1.23 | 0.42 | 0.82 | 1.73 | 1.38 | 1.63 | 1.09 | 2.06 | 0.76 | * | + | | |
| NT2RP1000688 | 4.67 | 2.07 | 2.03 | 5.85 | 5.34 | 3.72 | 3.1 | 4.12 | 2.68 | | | | |
| NT2RP1000689 | 2.83 | 0.64 | 1.04 | 1.11 | 1.67 | 0.84 | 1.37 | 0.88 | 0.83 | | | | |
| NT2RP1000695 | 1.62 | 1.12 | 1.10 | 1.18 | 2.39 | 1.24 | 1 | 0.87 | 0.88 | | | | |
| NT2RP1000701 | 0.90 | 0.82 | 0.62 | 0.83 | 0.27 | 1.25 | 0.87 | 1.19 | 1.4 | | | | |
| NT2RP1000702 | 0.76 | 0.35 | 1.53 | 0.66 | 1.47 | 1.82 | 0.6 | 1.47 | 2.57 | | | | |
| NT2RP1000713 | 0.23 | 0.42 | 0.37 | 0.34 | 0.89 | 0.44 | 0.17 | 1.44 | 1.47 | | | | |
| NT2RP1000721 | 10.57 | 6.36 | 5.67 | 7.28 | 13.00 | 9.92 | 8.49 | 9.05 | 8.17 | | | | |
| NT2RP1000730 | 2.55 | 1.65 | 1.97 | 4.38 | 3.90 | 3.35 | 1.75 | 3.65 | 2.95 | * | + | | |
| NT2RP1000733 | 4.46 | 2.99 | 3.71 | 5.44 | 5.04 | 3.14 | 1.44 | 3.93 | 4.16 | | | | |
| NT2RP1000738 | 28.84 | 10.50 | 11.79 | 17.48 | 18.85 | 18.44 | 15.99 | 11.65 | 12.72 | | | | |
| NT2RP1000739 | 14.40 | 7.16 | 8.58 | 10.60 | 12.85 | 8.63 | 11.15 | 9.94 | 11.2 | | | | |
| NT2RP1000740 | 3.66 | 1.37 | 2.15 | 2.84 | 4.09 | 2.86 | 2.91 | 2.60 | 3.23 | | | | |
| NT2RP1000746 | 1.31 | 0.85 | 0.82 | 1.32 | 1.26 | 0.89 | 1.26 | 2.13 | 2.46 | | | | |
| NT2RP1000750 | 9.51 | 4.76 | 5.09 | 7.09 | 6.45 | 6.48 | 4.95 | 5.43 | 4.72 | | | | |
| NT2RP1000751 | 77.49 | 46.65 | 53.99 | 41.34 | 32.45 | 28.11 | 17.67 | 20.76 | 21.6 | | | * | − |
| NT2RP1000767 | 1.53 | 0.63 | 1.06 | 1.68 | 1.34 | 1.25 | 1.21 | 2.74 | 2.71 | | | | |
| NT2RP1000769 | 4.65 | 2.64 | 3.84 | 2.57 | 3.18 | 2.72 | 4.13 | 4.77 | 3.22 | | | | |
| NT2RP1000780 | 1.51 | 0.92 | 0.80 | 2.30 | 1.18 | 0.64 | 1.37 | 0.96 | 0.77 | | | | |
| NT2RP1000782 | 5.21 | 2.12 | 2.72 | 11.13 | 10.26 | 10.71 | 6.05 | 7.66 | 6.54 | ** | + | * | + |
| NT2RP1000796 | 6.49 | 4.06 | 3.11 | 4.93 | 5.23 | 3.73 | 4.82 | 3.98 | 7.13 | | | | |
| NT2RP1000797 | 11.72 | 5.77 | 5.28 | 6.51 | 8.45 | 5.34 | 7.81 | 7.98 | 9.33 | | | | |
| NT2RP1000800 | 0.13 | 0.54 | 1.00 | 1.07 | 2.16 | 1.97 | 0.82 | 3.18 | 1.42 | * | + | | |
| NT2RP1000825 | 3.33 | 1.37 | 1.55 | 2.64 | 2.23 | 1.50 | 1.34 | 2.32 | 1.31 | | | | |
| NT2RP1000833 | 6.35 | 2.68 | 2.53 | 4.24 | 4.98 | 4.14 | 2.29 | 4.43 | 2.42 | | | | |
| NT2RP1000834 | 16.60 | 5.93 | 7.79 | 8.68 | 7.93 | 6.33 | 6.47 | 7.84 | 5.03 | | | | |
| NT2RP1000836 | 1.43 | 1.06 | 0.85 | 1.19 | 1.20 | 0.59 | 2.19 | 1.50 | 0.63 | | | | |
| NT2RP1000837 | 6.20 | 2.33 | 2.35 | 4.62 | 5.53 | 5.38 | 4.6 | 3.52 | 3.49 | | | | |
| NT2RP1000846 | 1.21 | 0.89 | 0.89 | 1.89 | 2.60 | 1.73 | 1.96 | 1.80 | 1.08 | * | + | | |
| NT2RP1000847 | 2.27 | 1.79 | 1.06 | 1.99 | 2.12 | 2.09 | 2.78 | 1.80 | 2.3 | | | | |
| NT2RP1000851 | 10.08 | 6.27 | 7.87 | 9.89 | 12.49 | 7.13 | 7.78 | 9.66 | 7.43 | | | | |
| NT2RP1000856 | 9.90 | 5.85 | 7.31 | 20.58 | 23.87 | 20.13 | 15.75 | 15.89 | 19.71 | ** | + | ** | + |
| NT2RP1000860 | 7.91 | 5.43 | 8.96 | 10.11 | 6.72 | 7.04 | 5.54 | 7.17 | 4.85 | | | | |
| NT2RP1000902 | 2.64 | 0.85 | 0.61 | 5.04 | 4.02 | 3.81 | 3.86 | 2.25 | 3.35 | * | + | | |
| NT2RP1000903 | 7.75 | 3.79 | 2.92 | 4.96 | 6.61 | 5.49 | 5.15 | 5.13 | 5.52 | | | | |
| NT2RP1000905 | 3.44 | 2.09 | 1.19 | 3.49 | 2.21 | 2.49 | 3.41 | 1.72 | 2.16 | | | | |
| NT2RP1000915 | 15.16 | 7.68 | 7.64 | 8.98 | 6.57 | 7.27 | 3.44 | 4.20 | 4 | | | | |

TABLE 239

| | | | | | | | | | | | | | |
|---|---|---|---|---|---|---|---|---|---|---|---|---|---|
| NT2RP1000916 | 3.20 | 2.97 | 0.92 | 3.11 | 2.12 | 2.20 | 3.16 | 2.17 | 2.19 | | | | |
| NT2RP1000921 | 1.84 | 1.45 | 1.78 | 3.53 | 2.23 | 2.78 | 2.9 | 2.99 | 2.53 | * | + | ** | + |
| NT2RP1000943 | 1.83 | 0.78 | 1.29 | 5.94 | 5.07 | 4.31 | 7.05 | 7.60 | 6.55 | ** | + | ** | + |
| NT2RP1000944 | 3.54 | 2.52 | 3.09 | 5.21 | 4.55 | 4.65 | 2.55 | 2.42 | 2.55 | ** | + | | |
| NT2RP1000947 | 6.99 | 4.11 | 3.31 | 6.97 | 6.41 | 5.03 | 5.81 | 4.15 | 4.54 | | | | |
| NT2RP1000954 | 5.12 | 2.35 | 2.15 | 5.93 | 4.95 | 4.84 | 4.75 | 3.63 | 4.18 | | | | |
| NT2RP1000958 | 20.62 | 10.44 | 1.43 | 11.21 | 10.24 | 6.49 | 7.05 | 5.48 | 7.18 | | | | |
| NT2RP1000959 | 72.56 | 35.16 | 43.30 | 53.44 | 48.85 | 40.35 | 20.64 | 19.16 | 22.61 | | | | |
| NT2RP1000966 | 36.86 | 19.10 | 21.19 | 22.56 | 35.39 | 24.14 | 15.07 | 9.91 | 18.23 | | | | |
| NT2RP1000974 | 10.91 | 8.14 | 8.28 | 18.92 | 22.10 | 19.21 | 14.69 | 15.24 | 13.39 | ** | + | ** | + |
| NT2RP1000980 | 3.63 | 2.59 | 2.91 | 3.75 | 4.02 | 3.96 | 2.97 | 3.22 | 2.22 | | | | |
| NT2RP1000981 | 4.96 | 3.42 | 4.61 | 4.59 | 5.02 | 3.62 | 2.94 | 3.11 | 2.77 | | | * | − |
| NT2RP1000988 | 2.69 | 1.97 | 1.73 | 4.25 | 5.22 | 4.19 | 3.95 | 3.30 | 3.66 | ** | + | * | + |
| NT2RP1001002 | 6.75 | 4.73 | 2.89 | 3.13 | 4.46 | 2.79 | 4.86 | 5.58 | 5.21 | | | | |
| NT2RP1001004 | 1.76 | 1.26 | 0.75 | 1.72 | 1.80 | 2.22 | 3.2 | 2.14 | 2.89 | | | * | + |
| NT2RP1001007 | 1.72 | 0.91 | 0.86 | 2.02 | 1.84 | 1.75 | 3 | 2.58 | 3.22 | | | ** | + |
| NT2RP1001011 | 4.98 | 3.03 | 2.17 | 7.06 | 8.67 | 6.46 | 5.23 | 4.65 | 5.76 | * | + | | |

TABLE 239-continued

| | | | | | | | | | | | | |
|---|---|---|---|---|---|---|---|---|---|---|---|---|
| NT2RP1001013 | 3.60 | 3.50 | 3.48 | 9.46 | 12.09 | 7.99 | 6.88 | 5.63 | 8.02 | ** | + | ** | + |
| NT2RP1001014 | 3.96 | 3.16 | 3.28 | 4.93 | 3.71 | 4.01 | 3.71 | 3.05 | 2.43 | | | | |
| NT2RP1001020 | 3.23 | 1.24 | 1.06 | 2.23 | 1.86 | 1.47 | 2.29 | 2.09 | 1.68 | | | | |
| NT2RP1001023 | 261.06 | 118.84 | 124.95 | 113.92 | 104.93 | 83.66 | 236.2 | 219.46 | 213.5 | | | | |
| NT2RP1001027 | 12.10 | 6.08 | 4.74 | 9.03 | 7.91 | 6.47 | 4.01 | 4.15 | 4.04 | | | | |
| NT2RP1001031 | 2.17 | 1.05 | 0.67 | 1.79 | 1.31 | 1.73 | 0.62 | 1.86 | 1.33 | | | | |
| NT2RP1001033 | 2.89 | 1.62 | 1.96 | 3.31 | 4.49 | 3.57 | 2.4 | 3.46 | 2.46 | * | + | | |
| NT2RP1001042 | 2.56 | 1.34 | 2.04 | 5.44 | 5.57 | 4.27 | 4.68 | 4.47 | 4.7 | ** | + | ** | + |
| NT2RP1001045 | 55.87 | 37.46 | 39.12 | 31.66 | 32.21 | 26.52 | 26.73 | 25.41 | 27.84 | | | * | − |
| NT2RP1001073 | 18.17 | 10.94 | 13.65 | 7.43 | 11.62 | 10.45 | 3.3 | 5.82 | 3.6 | | | * | − |
| NT2RP1001079 | 6.27 | 4.29 | 4.83 | 7.17 | 5.68 | 5.81 | 5.84 | 5.09 | 3.64 | | | | |
| NT2RP1001080 | 4.59 | 3.36 | 2.02 | 3.32 | 2.67 | 3.66 | 3.81 | 3.01 | 2.62 | | | | |
| NT2RP1001113 | 2.09 | 1.06 | 0.43 | 0.85 | 1.89 | 1.25 | 1.74 | 2.63 | 1.22 | | | | |
| NT2RP1001159 | 22.23 | 15.34 | 13.51 | 27.36 | 29.04 | 20.75 | 11.14 | 12.23 | 9.12 | | | | |
| NT2RP1001173 | 2.37 | 0.91 | 1.48 | 10.20 | 7.72 | 8.04 | 6.93 | 5.00 | 6.33 | ** | + | ** | + |
| NT2RP1001176 | 5.14 | 3.86 | 5.35 | 6.46 | 6.12 | 5.31 | 4.46 | 5.39 | 4.12 | | | | |
| NT2RP1001177 | 3.79 | 2.64 | 3.45 | 7.23 | 6.84 | 5.24 | 5.18 | 4.11 | 3.16 | * | + | | |
| NT2RP1001185 | 4.77 | 2.20 | 2.83 | 10.28 | 7.74 | 6.42 | 4.72 | 4.39 | 3.75 | * | + | | |
| NT2RP1001199 | 2.06 | 1.25 | 1.14 | 4.62 | 4.88 | 3.76 | 2.05 | 2.71 | 1.7 | ** | + | | |
| NT2RP1001205 | 19.37 | 11.82 | 11.58 | 17.19 | 17.16 | 12.69 | 6.66 | 6.05 | 4.62 | | | * | − |
| NT2RP1001215 | 5.66 | 2.61 | 2.14 | 2.79 | 3.86 | 3.71 | 2.65 | 3.10 | 2.8 | | | | |
| NT2RP1001225 | 5.42 | 2.06 | 1.65 | 2.88 | 2.39 | 2.40 | 3.21 | 4.49 | 4.21 | | | | |
| NT2RP1001245 | 3.12 | 2.43 | 4.04 | 4.32 | 4.51 | 4.91 | 3.1 | 5.42 | 4.42 | * | + | | |
| NTZRP1001247 | 1.41 | 0.44 | 0.55 | 0.62 | 0.90 | 1.10 | 0.75 | 2.81 | 1 | | | | |
| NT2RP1001248 | 2.68 | 2.07 | 1.62 | 3.98 | 2.41 | 2.41 | 1.39 | 3.80 | 1.81 | | | | |
| NT2RP1001253 | 6.69 | 3.25 | 3.71 | 6.33 | 4.35 | 5.83 | 4.57 | 5.25 | 3.74 | | | | |
| NT2RP1001286 | 3.18 | 1.26 | 2.31 | 4.52 | 3.67 | 4.87 | 3.96 | 3.81 | 2.61 | * | + | | |
| NT2RP1001294 | 9.78 | 2.41 | 4.54 | 3.50 | 4.67 | 2.27 | 2.68 | 1.87 | 2.59 | | | | |
| NT2RP1001302 | 8.57 | 3.22 | 3.02 | 3.18 | 3.24 | 3.37 | 2.74 | 2.23 | 2.95 | | | | |
| NT2RP1001310 | 9.73 | 5.23 | 5.10 | 9.63 | 10.00 | 7.15 | 7.46 | 7.70 | 6.61 | | | | |
| NT2RP1001311 | 18.47 | 7.91 | 7.87 | 5.75 | 8.43 | 7.25 | 3.98 | 5.42 | 3.54 | | | | |
| NT2RP1001313 | 10.94 | 5.16 | 4.72 | 12.65 | 11.32 | 9.22 | 3.47 | 5.55 | 4.61 | | | | |
| NT2RP1001324 | 3.38 | 2.26 | 1.54 | 3.44 | 2.03 | 2.97 | 2.03 | 3.34 | 1.99 | | | | |
| NT2RP1001349 | 3.51 | 1.77 | 2.13 | 2.29 | 2.35 | 2.91 | 2.76 | 4.09 | 1.76 | | | | |
| NT2RP1001361 | 9.53 | 5.57 | 12.07 | 15.75 | 14.43 | 10.15 | 3.96 | 7.68 | 5.72 | | | | |
| NT2RP1001379 | 9.49 | 3.63 | 4.16 | 6.43 | 5.54 | 3.66 | 4.65 | 4.16 | 4.18 | | | | |
| NT2RP1001385 | 6.18 | 2.32 | 2.60 | 4.81 | 6.35 | 3.73 | 2.76 | 3.62 | 3.67 | | | | |
| NT2RP1001395 | 5.45 | 2.82 | 3.04 | 4.04 | 3.63 | 2.71 | 4.99 | 4.64 | 3.44 | | | | |
| NT2RP1001410 | 18.25 | 5.37 | 10.42 | 15.62 | 9.58 | 11.66 | 11.21 | 9.39 | 10.03 | | | | |

TABLE 240

| | | | | | | | | | | | | |
|---|---|---|---|---|---|---|---|---|---|---|---|---|
| NT2RP1001424 | 2.87 | 1.62 | 0.72 | 3.11 | 2.58 | 2.58 | 1.61 | 3.38 | 2.21 | | | | |
| NT2RP1001432 | 2.47 | 1.17 | 2.41 | 2.23 | 2.48 | 1.53 | 1.78 | 3.14 | 1.45 | | | | |
| NT2RP1001449 | 7.62 | 4.22 | 5.10 | 9.69 | 11.61 | 8.75 | 6.99 | 5.82 | 6.74 | * | + | | |
| NT2RP1001457 | 4.04 | 2.37 | 2.71 | 3.08 | 3.14 | 2.75 | 2.72 | 2.61 | 3.14 | | | | |
| NT2RP1001459 | 10.76 | 3.49 | 3.82 | 8.95 | 9.17 | 5.61 | 7.87 | 6.73 | 6.96 | | | | |
| NT2RP1001466 | 22.82 | 9.71 | 11.08 | 9.67 | 7.98 | 7.40 | 7.72 | 5.26 | 6.18 | | | | |
| NT2RP1001475 | 6.67 | 4.07 | 4.28 | 8.53 | 10.26 | 8.11 | 4.73 | 4.80 | 4.35 | * | + | | |
| NT2RP1001482 | 11.57 | 4.98 | 6.24 | 6.89 | 5.62 | 4.62 | 2.44 | 2.41 | 2.61 | | | | |
| NT2RP1001494 | 1.38 | 1.05 | 0.95 | 2.03 | 1.52 | 1.37 | 0.9 | 2.19 | 2.18 | | | | |
| NT2RP1001500 | 2.19 | 2.12 | 1.80 | 1.11 | 1.95 | 1.39 | 1 | 2.88 | 1.81 | | | | |
| NT2RP1001517 | 1.81 | 0.96 | 1.45 | 2.37 | 1.81 | 2.59 | 1.22 | 2.90 | 1.19 | | | | |
| NT2RP1001540 | 5.66 | 2.57 | 3.71 | 5.28 | 5.66 | 5.56 | 4.29 | 5.21 | 3.47 | | | | |
| NT2RP1001543 | 8.78 | 3.57 | 3.35 | 10.80 | 11.59 | 6.71 | 5.01 | 4.67 | 5.34 | | | | |
| NT2RP1001546 | 21.79 | 10.60 | 8.72 | 53.53 | 51.38 | 41.78 | 29.72 | 27.77 | 37.59 | ** | + | * | + |
| NT2RP1001550 | 9.54 | 5.59 | 4.56 | 11.19 | 14.45 | 11.40 | 5.56 | 6.79 | 7.13 | * | + | | |
| NT2RP1001553 | 6.39 | 3.38 | 2.69 | 4.45 | 3.49 | 2.74 | 3.6 | 4.16 | 2.78 | | | | |
| NT2RP1001555 | 9.92 | 5.57 | 6.23 | 12.43 | 10.74 | 10.45 | 11.69 | 18.08 | 11.64 | | | | |
| NT2RP1001563 | 4.37 | 1.97 | 2.43 | 3.66 | 4.03 | 3.10 | 1.84 | 4.08 | 2.22 | | | | |
| NT2RP1001569 | 5.25 | 3.17 | 2.27 | 4.32 | 4.47 | 4.21 | 3.54 | 6.70 | 3.89 | | | | |
| NT2RP1001584 | 8.28 | 4.33 | 4.71 | 6.70 | 8.09 | 6.25 | 5.94 | 7.17 | 6.75 | | | | |
| NT2RP1001599 | 7.22 | 2.05 | 1.29 | 32.60 | 27.43 | 19.18 | 6.56 | 7.36 | 8.71 | ** | + | | |
| NT2RP1001616 | 3.29 | 0.83 | 1.26 | 2.03 | 2.10 | 1.09 | 2.49 | 2.44 | 3.45 | | | | |
| NT2RP1001654 | 19.86 | 5.14 | 4.62 | 10.80 | 10.51 | 8.45 | 6.66 | 9.40 | 9.83 | | | | |
| NT2RP1001665 | 1.29 | 1.28 | 0.35 | 1.08 | 1.87 | 1.90 | 0.74 | 2.81 | 0.7 | | | | |
| NT2RP1001679 | 87.88 | 43.02 | 42.15 | 72.20 | 73.59 | 55.81 | 28.48 | 41.49 | 35.04 | | | | |
| NT2RP1001681 | 21.69 | 14.86 | 18.60 | 13.78 | 17.18 | 10.98 | 7.11 | 14.27 | 11.13 | | | | |
| NT2RP1001694 | 8.51 | 6.03 | 4.96 | 4.21 | 4.41 | 2.94 | 5.31 | 11.65 | 6.79 | | | | |
| NT2RP2000001 | 6.32 | 1.40 | 2.79 | 3.24 | 2.80 | 2.62 | 3.54 | 4.14 | 4.08 | | | | |
| NT2RP2000006 | 2.04 | 1.48 | 0.96 | 4.50 | 2.92 | 2.33 | 2.69 | 2.50 | 1.61 | | | | |
| NT2RP2000007 | 10.09 | 4.44 | 5.04 | 3.97 | 3.31 | 4.03 | 3.55 | 1.69 | 1.81 | | | | |
| NT2RP2000008 | 10.88 | 5.03 | 5.27 | 12.65 | 14.30 | 9.35 | 7.5 | 5.73 | 4.32 | | | | |
| NT2RP2000010 | 1.99 | 1.02 | 0.52 | 2.09 | 3.06 | 2.49 | 2.1 | 2.41 | 2.6 | | | | |
| NT2RP2000011 | 7.02 | 4.29 | 5.02 | 10.56 | 10.46 | 8.08 | 6.55 | 5.23 | 6.43 | * | + | | |
| NT2RP2000027 | 3.12 | 1.86 | 1.41 | 5.78 | 3.32 | 2.95 | 2.99 | 2.41 | 1.39 | | | | |

TABLE 240-continued

| | | | | | | | | | | | | |
|---|---|---|---|---|---|---|---|---|---|---|---|---|
| NT2RP2000028 | 2.89 | 1.81 | 1.90 | 3.51 | 2.63 | 2.74 | 4.34 | 5.32 | 5.48 | | ** | + |
| NT2RP2000032 | 1.94 | 1.20 | 2.03 | 2.85 | 3.78 | 4.04 | 1.05 | 2.10 | 0.96 | * | + | |
| NT2RP2000040 | 37.68 | 15.23 | 16.54 | 19.89 | 18.06 | 16.95 | 22.42 | 19.65 | 16.11 | | | |
| NT2RP2000042 | 9.28 | 3.40 | 4.33 | 7.54 | 7.04 | 6.30 | 5.89 | 6.48 | 6.12 | | | |
| NT2RP2000045 | 10.41 | 4.33 | 5.29 | 6.44 | 6.23 | 7.07 | 5.45 | 5.93 | 4.14 | | | |
| NT2RP2000051 | 12.68 | 6.63 | 7.07 | 5.35 | 6.94 | 5.58 | 5.26 | 5.53 | 4.86 | | | |
| NT2RP2000054 | 5.27 | 3.29 | 2.87 | 3.98 | 5.04 | 4.42 | 5.28 | 3.65 | 4.48 | | | |
| NT2RP2000056 | 4.49 | 2.47 | 2.46 | 3.36 | 3.01 | 3.82 | 3.5 | 3.62 | 3.48 | | | |
| NT2RP2000057 | 52.52 | 38.64 | 47.28 | 59.49 | 56.29 | 50.39 | 23.72 | 29.59 | 31.7 | | * | − |
| NT2RP2000067 | 3.42 | 1.83 | 2.49 | 4.64 | 3.08 | 3.41 | 1.5 | 3.38 | 2.02 | | | |
| NT2RP2000070 | 8.99 | 4.22 | 3.23 | 5.71 | 5.95 | 7.00 | 8.23 | 3.07 | 7.09 | | | |
| NT2RP2000076 | 2.83 | 1.15 | 1.15 | 1.86 | 1.61 | 1.73 | 2.7 | 1.97 | 2.2 | | | |
| NT2RP2000077 | 10.69 | 4.72 | 3.55 | 9.58 | 8.73 | 8.11 | 7.3 | 4.40 | 8.28 | | | |
| NT2RP2000079 | 4.88 | 3.21 | 3.11 | 8.07 | 7.12 | 7.59 | 4.5 | 3.56 | 4.48 | ** | + | |
| NT2RP2000088 | 3.87 | 3.74 | 2.96 | 4.10 | 4.22 | 2.91 | 4.51 | 4.30 | 4.17 | | | |
| NT2RP2000091 | 3.05 | 2.14 | 3.45 | 10.95 | 9.06 | 8.83 | 4.37 | 6.05 | 6.43 | ** | + | * | + |
| NT2RP2000092 | 10.83 | 5.23 | 7.63 | 16.92 | 17.59 | 12.32 | 8.03 | 11.12 | 9.14 | * | + | |
| NT2RP2000097 | 2.33 | 2.76 | 2.63 | 4.90 | 4.82 | 3.90 | 2.22 | 2.43 | 2.99 | ** | + | |
| NT2RP2000098 | 10.38 | 5.79 | 6.50 | 5.56 | 4.26 | 4.65 | 2.67 | 1.61 | 2.03 | | * | − |
| NT2RP2000108 | 9.83 | 5.39 | 6.38 | 12.17 | 15.62 | 9.37 | 8.01 | 6.04 | 4.82 | | | |
| NT2RP2000114 | 2.05 | 1.50 | 1.13 | 3.20 | 1.92 | 2.20 | 3.45 | 2.13 | 2.56 | | | |
| NT2RP2000116 | 5.05 | 3.16 | 5.23 | 7.97 | 9.36 | 8.63 | 7.01 | 7.36 | 8.27 | ** | + | * | + |

TABLE 241

| | | | | | | | | | | | | |
|---|---|---|---|---|---|---|---|---|---|---|---|---|
| NT2RP2000119 | 8.68 | 3.95 | 4.21 | 9.78 | 9.83 | 7.70 | 4.38 | 5.61 | 4.76 | | | |
| NT2RP2000120 | 6.77 | 5.63 | 5.88 | 9.79 | 11.11 | 8.08 | 7.54 | 6.05 | 5.79 | * | + | |
| NT2RP2000126 | 6.86 | 4.89 | 4.70 | 8.53 | 5.94 | 6.57 | 4.76 | 5.23 | 4.11 | | | |
| NT2RP2000133 | 3.99 | 1.70 | 2.52 | 3.67 | 4.08 | 3.28 | 3.34 | 3.20 | 1.96 | | | |
| NT2RP2000147 | 10.14 | 5.06 | 4.39 | 7.57 | 6.45 | 7.93 | 7.96 | 5.91 | 7.47 | | | |
| NT2RP2000153 | 9.59 | 4.30 | 4.77 | 11.17 | 12.10 | 9.91 | 6.51 | 6.58 | 8.83 | | | |
| NT2RP2000156 | 8.43 | 4.96 | 3.48 | 10.08 | 10.36 | 9.94 | 5.38 | 4.40 | 3.72 | * | + | |
| NT2RP2000157 | 3.42 | 2.19 | 2.41 | 3.80 | 5.30 | 4.72 | 2.87 | 2.06 | 2.91 | * | + | |
| NT2RP2000161 | 3.63 | 2.23 | 2.07 | 2.95 | 5.95 | 3.11 | 2.97 | 3.99 | 3.8 | | | |
| NT2RP2000168 | 0.99 | 0.64 | 1.00 | 1.63 | 1.21 | 0.85 | 1.57 | 2.63 | 1.12 | | | |
| NT2RP2000173 | 5.26 | 3.38 | 4.83 | 5.31 | 6.20 | 4.30 | 6.86 | 7.09 | 4.77 | | | |
| NT2RP2000175 | 5.66 | 3.98 | 5.08 | 6.59 | 5.28 | 4.03 | 5.09 | 5.43 | 4.57 | | | |
| NT2RP2000178 | 4.05 | 2.68 | 1.96 | 2.97 | 4.24 | 3.15 | 4.17 | 4.26 | 3.99 | | | |
| NT2RP2000183 | 10.17 | 3.83 | 4.48 | 9.26 | 9.55 | 10.17 | 7.2 | 6.57 | 6.26 | | | |
| NT2RP2000195 | 7.49 | 2.50 | 2.99 | 9.64 | 9.13 | 9.97 | 5.54 | 5.28 | 4.35 | * | + | |
| NT2RP2000204 | 61.75 | 38.58 | 41.68 | 97.90 | 112.72 | 86.99 | 46.74 | 43.39 | 38.72 | ** | + | |
| NT2RP2000205 | 3.47 | 1.89 | 2.20 | 5.10 | 3.54 | 4.32 | 2.79 | 2.79 | 2.7 | | | |
| NT2RP2000208 | 3.13 | 2.58 | 1.85 | 5.38 | 5.41 | 5.54 | 3.65 | 4.43 | 4.57 | ** | + | * | + |
| NT2RP2000224 | 10.06 | 4.94 | 5.26 | 13.62 | 13.47 | 11.09 | 7.3 | 8.43 | 8.25 | * | + | |
| NT2RP2000230 | 10.44 | 5.32 | 7.82 | 4.62 | 4.88 | 4.53 | 6.76 | 7.92 | 6.25 | | | |
| NT2RP2000231 | 15.70 | 8.92 | 8.46 | 8.81 | 11.88 | 10.86 | 12.38 | 9.81 | 14.32 | | | |
| NT2RP2000232 | 3.82 | 2.08 | 1.56 | 2.18 | 2.93 | 2.14 | 2.17 | 3.16 | 3.23 | | | |
| NT2RP2000233 | 3.92 | 2.50 | 2.55 | 3.87 | 3.62 | 3.14 | 4.2 | 5.00 | 3.42 | | | |
| NT2RP2000239 | 5.63 | 2.55 | 4.01 | 2.51 | 2.65 | 1.68 | 2.58 | 2.65 | 2.15 | | | |
| NT2RP2000240 | 2.65 | 0.99 | 1.49 | 3.74 | 2.57 | 2.17 | 1.29 | 3.46 | 1.94 | | | |
| NT2RP2000248 | 2.07 | 1.21 | 1.92 | 5.23 | 4.26 | 2.91 | 2.54 | 3.82 | 2.58 | * | + | |
| NT2RP2000256 | 2.45 | 1.19 | 2.67 | 4.07 | 3.99 | 4.15 | 2.35 | 4.00 | 2.51 | * | + | |
| NT2RP2000257 | 4.01 | 2.58 | 4.00 | 7.82 | 7.06 | 6.67 | 4.5 | 7.31 | 5.28 | ** | + | |
| NT2RP2000258 | 4.50 | 2.39 | 2.97 | 2.52 | 3.60 | 4.01 | 2.36 | 1.90 | 2.05 | | | |
| NT2RP2000261 | 5.05 | 1.91 | 1.66 | 2.79 | 3.32 | 2.35 | 3.34 | 3.46 | 3.43 | | | |
| NT2RP2000270 | 4.76 | 3.28 | 4.00 | 7.87 | 7.75 | 6.15 | 4.27 | 5.23 | 5.14 | ** | + | |
| NT2RP2000274 | 1.79 | 1.60 | 1.36 | 2.19 | 2.83 | 2.80 | 2.75 | 3.55 | 2.34 | * | + | * | + |
| NT2RP2000277 | 2.75 | 1.21 | 1.42 | 2.17 | 1.68 | 1.96 | 1.92 | 2.84 | 2.38 | | | |
| NT2RP2000279 | 0.41 | 1.31 | 1.45 | 1.18 | 1.47 | 1.06 | 1.2 | 2.43 | 1.11 | | | |
| NT2RP2000283 | 3.37 | 2.23 | 2.52 | 5.72 | 4.12 | 4.64 | 3.18 | 4.04 | 2.42 | * | + | |
| NT2RP2000288 | 5.70 | 4.02 | 4.20 | 8.50 | 6.14 | 8.25 | 4.51 | 3.57 | 3.55 | * | + | |
| NT2RP2000289 | 6.80 | 5.85 | 3.10 | 6.12 | 5.47 | 3.78 | 3.88 | 3.57 | 4.36 | | | |
| NT2RP2000297 | 11.76 | 5.46 | 4.79 | 20.39 | 23.99 | 16.10 | 8.54 | 7.85 | 6.17 | * | + | |
| NT2RP2000298 | 4.88 | 2.68 | 4.30 | 8.97 | 6.69 | 7.77 | 3.27 | 4.79 | 4.52 | * | + | |
| NT2RP2000310 | 3.32 | 1.70 | 1.94 | 1.61 | 2.82 | 2.27 | 1.42 | 3.61 | 2.47 | | | |
| NT2RP2000327 | 2.70 | 2.09 | 1.98 | 2.16 | 2.54 | 2.15 | 1.73 | 3.66 | 2.67 | | | |
| NT2RP2000328 | 9.99 | 5.11 | 5.84 | 9.30 | 7.53 | 6.17 | 5.88 | 5.38 | 4.93 | | | |
| NT2RP2000329 | 6.52 | 3.59 | 6.38 | 14.80 | 8.75 | 11.24 | 11.8 | 13.63 | 15.25 | * | + | ** | + |
| NT2RP2000333 | 2.61 | 2.37 | 2.88 | 3.29 | 2.69 | 3.44 | 2.94 | 4.19 | 2.52 | | | |
| NT2RP2000337 | 1.84 | 1.24 | 0.70 | 1.53 | 2.14 | 1.62 | 1.08 | 1.19 | 1.29 | | | |
| NT2RP2000346 | 6.13 | 3.16 | 4.39 | 6.09 | 6.33 | 4.39 | 5.29 | 3.87 | 4.75 | | | |
| NT2RP2000357 | 4.83 | 1.57 | 2.53 | 4.81 | 4.10 | 3.76 | 2.25 | 2.94 | 2.98 | | | |
| NT2RP2000358 | 4.05 | 2.01 | 1.43 | 3.71 | 5.44 | 4.47 | 2.33 | 3.23 | 3.82 | | | |
| NT2RP2000366 | 3.62 | 3.12 | 2.58 | 3.24 | 4.65 | 4.15 | 3.46 | 5.12 | 4 | | | |
| NT2RP2000369 | 3.68 | 3.14 | 3.25 | 7.30 | 6.97 | 6.80 | 16.68 | 15.91 | 21.03 | ** | + | ** | + |
| NT2RP2000376 | 16.50 | 7.18 | 10.26 | 12.72 | 14.14 | 12.56 | 11.16 | 13.27 | 14.04 | | | |

TABLE 241-continued

| ID | | | | | | | | | | | | |
|---|---|---|---|---|---|---|---|---|---|---|---|---|
| NT2RP2000394 | 3.97 | 3.08 | 4.07 | 2.94 | 3.29 | 3.97 | 2.41 | 3.13 | 3.01 | | | |
| NT2RP2000396 | 14.08 | 6.54 | 5.86 | 11.48 | 9.74 | 7.82 | 9.11 | 5.57 | 11.18 | | | |
| NT2RP2000412 | 7.77 | 4.65 | 2.97 | 6.62 | 7.16 | 4.26 | 3.14 | 4.29 | 4.91 | | | |
| NT2RP2000414 | 18.85 | 9.88 | 9.70 | 17.32 | 11.45 | 11.38 | 9.42 | 7.23 | 10.75 | | | |
| NT2RP1000420 | 2.85 | 2.26 | 2.25 | 4.04 | 3.82 | 1.85 | 2.03 | 3.71 | 2.9 | | | |

TABLE 242

| ID | | | | | | | | | | | | |
|---|---|---|---|---|---|---|---|---|---|---|---|---|
| NT2RP2000422 | 4.34 | 2.42 | 2.61 | 4.23 | 4.79 | 3.97 | 2.48 | 4.12 | 3.58 | | | |
| NT2RP2000426 | 25.72 | 16.73 | 17.55 | 38.01 | 37.89 | 27.90 | 28.44 | 35.63 | 32.72 | * | + | * | + |
| NT2RP2000428 | 8.81 | 5.15 | 7.26 | 4.95 | 7.26 | 4.98 | 5.88 | 6.67 | 7.85 | | | |
| NT2RP2000438 | 6.31 | 4.25 | 6.08 | 7.20 | 6.52 | 5.26 | 4.94 | 5.80 | 4.64 | | | |
| NT2RP2000447 | 4.41 | 2.06 | 2.07 | 4.91 | 3.95 | 2.02 | 2.15 | 2.90 | 4.07 | | | |
| NT2RP2000448 | 7.83 | 4.29 | 4.32 | 8.83 | 10.57 | 6.61 | 6.83 | 6.72 | 9.81 | | | |
| NT2RP2000459 | 3.66 | 2.01 | 1.92 | 4.90 | 4.18 | 3.40 | 3.04 | 3.12 | 2.39 | | | |
| NT2RP2000479 | 1.93 | 0.77 | 1.02 | 3.37 | 3.48 | 3.07 | 1.64 | 3.13 | 2.2 | ** | + | |
| NT2RP2000498 | 3.73 | 1.64 | 2.79 | 6.08 | 6.58 | 5.26 | 3.06 | 4.66 | 3.3 | * | + | |
| NT2RP2000503 | 0.99 | 0.59 | 0.90 | 1.83 | 1.74 | 0.79 | 1.01 | 2.91 | 0.59 | | | |
| NT2RP2000510 | 1.06 | 0.59 | 0.92 | 1.09 | 1.85 | 1.43 | 0.94 | 2.45 | 1.3 | | | |
| NT2RP2000514 | 1.41 | 1.10 | 1.00 | 1.62 | 1.02 | 0.66 | 0.8 | 2.20 | 1.21 | | | |
| NT2RP2000516 | 2.96 | 2.89 | 1.64 | 2.85 | 2.86 | 3.71 | 3.31 | 2.30 | 4 | | | |
| NT2RP2000523 | 3.99 | 1.92 | 2.37 | 1.57 | 3.10 | 1.25 | 3.93 | 1.39 | 1.65 | | | |
| NT2RP2000533 | 8.58 | 5.78 | 6.04 | 9.66 | 6.29 | 7.70 | 8.46 | 6.89 | 6.1 | | | |
| NT2RP2000540 | 3.70 | 1.50 | 1.36 | 1.88 | 3.29 | 2.35 | 3 | 2.34 | 2.25 | | | |
| NT2RP2000547 | 4.21 | 3.25 | 2.00 | 3.94 | 5.17 | 3.32 | 3.43 | 3.90 | 3.44 | | | |
| NT2RP2000557 | 6.17 | 3.16 | 5.21 | 9.43 | 7.58 | 8.00 | 4.94 | 5.68 | 5.75 | * | + | |
| NT2RP2000558 | 6.82 | 5.39 | 2.81 | 8.42 | 7.99 | 7.74 | 3.91 | 5.66 | 3.66 | | | |
| NT2RP2000564 | 1.37 | 1.73 | 2.60 | 5.24 | 4.86 | 4.91 | 2.08 | 2.76 | 4.62 | ** | + | |
| NT2RP2000565 | 10.89 | 3.85 | 5.45 | 5.34 | 4.15 | 3.62 | 5.93 | 5.18 | 4.1 | | | |
| NT2RP2000583 | 12.11 | 7.48 | 7.41 | 14.37 | 9.94 | 10.68 | 9.35 | 8.42 | 9.2 | | | |
| NT2RP2000591 | 1.21 | 1.15 | 0.59 | 1.83 | 2.04 | 1.49 | 1.94 | 1.98 | 1.05 | * | + | |
| NT2RP2000599 | 1.47 | 1.25 | 1.53 | 1.16 | 1.55 | 1.34 | 1.22 | 2.03 | 0.81 | | | |
| NT2RP2000601 | 2.53 | 1.94 | 2.56 | 4.22 | 3.80 | 2.72 | 5.23 | 4.02 | 4.33 | | | ** | + |
| NT2RP2000603 | 3.39 | 2.35 | 1.65 | 2.95 | 3.86 | 3.73 | 3.27 | 3.61 | 3.79 | | | |
| NT2RP2000610 | 8.35 | 6.25 | 7.50 | 11.79 | 10.08 | 10.19 | 6.69 | 6.74 | 5.04 | * | + | |
| NT2RP2000614 | 96.26 | 103.19 | 118.68 | 120.08 | 119.37 | 64.42 | 36.46 | 62.71 | 38.98 | | | ** | − |
| NT2RP2000616 | 6.76 | 3.07 | 4.14 | 4.68 | 4.17 | 3.26 | 5.28 | 4.32 | 4.63 | | | |
| NT2RP2000617 | 8.33 | 1.91 | 4.08 | 4.27 | 5.55 | 4.60 | 5.01 | 3.15 | 4.64 | | | |
| NT2RP2000623 | 4.48 | 1.59 | 1.85 | 3.07 | 2.65 | 2.79 | 2.55 | 2.58 | 1.9 | | | |
| NT2RP2000634 | 2.21 | 1.66 | 0.95 | 4.67 | 6.41 | 3.91 | 3.28 | 3.56 | 3.18 | * | + | * | + |
| NT2RP2000636 | 2.78 | 1.86 | 2.23 | 5.39 | 5.75 | 3.65 | 5.59 | 4.74 | 6.43 | * | + | ** | + |
| NT2RP2000638 | 21.16 | 12.92 | 16.03 | 4.08 | 3.49 | 3.77 | 3.77 | 2.86 | 3.58 | ** | − | ** | − |
| NT2RP2000644 | 4.37 | 1.59 | 2.30 | 6.98 | 6.00 | 7.24 | 4.21 | 4.56 | 3.58 | * | + | |
| NT2RP2000649 | 7.14 | 4.82 | 5.18 | 7.37 | 7.32 | 4.24 | 9.38 | 7.32 | 6.55 | | | |
| NT2RP2000652 | 3.51 | 2.62 | 3.37 | 2.59 | 3.37 | 3.58 | 3.42 | 2.20 | 3.62 | | | |
| NT2RP2000656 | 2.66 | 3.06 | 2.65 | 4.78 | 6.50 | 7.33 | 2.65 | 3.45 | 3.99 | * | + | |
| NT2RP2000658 | 0.93 | 1.13 | 0.36 | 1.13 | 1.33 | 1.51 | 1.68 | 1.25 | 0.75 | | | |
| NT2RP2000663 | 4.22 | 2.97 | 3.08 | 9.06 | 10.89 | 6.58 | 6.13 | 6.43 | 9.35 | * | + | * | + |
| NT2RP2000664 | 23.91 | 17.42 | 14.73 | 9.66 | 12.53 | 10.44 | 7.05 | 5.83 | 8.31 | | | * | − |
| NT2RP2000668 | 5.30 | 2.81 | 4.65 | 6.71 | 5.59 | 4.69 | 6.21 | 4.52 | 4.52 | | | |
| NT2RP2000678 | 0.48 | 0.48 | 0.42 | 0.75 | 0.94 | 0.64 | 0.81 | 1.41 | 0.39 | * | + | |
| NT2RP2000694 | 2.29 | 2.24 | 2.05 | 19.86 | 17.58 | 12.78 | 4.53 | 4.69 | 3.6 | ** | + | ** | + |
| NT2RP2000704 | 6.91 | 3.49 | 2.43 | 6.07 | 5.63 | 5.83 | 4.96 | 5.30 | 4.17 | | | |
| NT2RP2000710 | 9.01 | 4.65 | 4.93 | 4.63 | 5.99 | 4.41 | 2.4 | 3.05 | 3.57 | | | |
| NT2RP2000712 | 8.69 | 3.86 | 3.32 | 7.90 | 11.98 | 9.71 | 4.72 | 4.64 | 4.82 | | | |
| NT2RP2000715 | 2.82 | 2.17 | 1.75 | 4.86 | 5.63 | 4.47 | 3.49 | 4.30 | 2.59 | ** | + | |
| NT2RP2000720 | 4.75 | 3.62 | 3.91 | 5.03 | 5.10 | 4.87 | 4.06 | 4.30 | 4.01 | | | |
| NT2RP2000731 | 2.07 | 0.87 | 1.19 | 1.70 | 1.63 | 1.57 | 2.2 | 2.35 | 1.11 | | | |
| NT2RP2000739 | 4.43 | 3.04 | 3.85 | 3.85 | 4.97 | 5.04 | 12.49 | 4.91 | 4.00 | 4.7 | | |
| NT2RP2000748 | 2.01 | 0.84 | 1.62 | 3.67 | 2.92 | 3.60 | 1.71 | 2.82 | 2.4 | * | + | |
| NT2RP2000749 | 18.07 | 9.30 | 9.03 | 17.51 | 22.01 | 17.32 | 13.66 | 13.69 | 16.17 | | | |
| NT2RP2000758 | 6.82 | 2.65 | 3.39 | 7.55 | 7.28 | 7.11 | 5.45 | 4.30 | 5.82 | | | |
| NT2RP2000764 | 6.06 | 3.40 | 3.08 | 3.96 | 3.81 | 2.89 | 3.82 | 5.32 | 3.35 | | | |
| NT2RP2000766 | 4.46 | 2.57 | 3.04 | 28.36 | 19.71 | 19.14 | 14.72 | 13.56 | 10.75 | ** | + | ** | + |

TABLE 243

| ID | | | | | | | | | | | | |
|---|---|---|---|---|---|---|---|---|---|---|---|---|
| NT2RP2000777 | 29.85 | 20.42 | 21.91 | 16.22 | 17.42 | 15.02 | 12.37 | 12.07 | 13.5 | | | * | − |
| NT2RP2000786 | 8.23 | 5.22 | 4.46 | 10.55 | 9.74 | 7.80 | 11.68 | 12.09 | 10.59 | | | * | + |
| NT2RP2000793 | 14.01 | 7.42 | 10.26 | 12.19 | 18.41 | 17.74 | 12.21 | 12.81 | 15.75 | | | |
| NT2RP2000796 | 6.25 | 2.57 | 4.14 | 5.05 | 5.14 | 3.86 | 3.27 | 4.71 | 3.04 | | | |
| NT2RP2000809 | 7.70 | 5.02 | 4.14 | 9.32 | 10.55 | 8.44 | 6.87 | 4.85 | 6.03 | * | + | |
| NT2RP2000812 | 6.41 | 3.65 | 3.75 | 7.05 | 6.14 | 5.86 | 4.83 | 5.04 | 3.67 | | | |
| NT2RP2000814 | 2.40 | 1.13 | 1.50 | 2.03 | 1.96 | 1.78 | 0.9 | 2.54 | 1.09 | | | |

TABLE 243-continued

| ID | | | | | | | | | | | | | |
|---|---|---|---|---|---|---|---|---|---|---|---|---|---|
| NT2RP2000816 | 5.89 | 1.17 | 2.01 | 3.48 | 3.06 | 4.82 | 3.84 | 4.28 | 3.29 | | | | |
| NT2RP2000818 | 2.61 | 0.71 | 0.86 | 3.13 | 3.87 | 2.75 | 2.08 | 1.63 | 3.25 | | | | |
| NT2RP2000819 | 2.57 | 1.24 | 1.34 | 1.88 | 1.49 | 1.77 | 1.81 | 2.05 | 1.32 | | | | |
| NT2RP2000841 | 2.46 | 0.72 | 1.21 | 2.94 | 1.98 | 3.02 | 1.06 | 2.75 | 1.48 | | | | |
| NT2RP2000842 | 1.34 | 0.54 | 1.09 | 1.95 | 1.45 | 1.71 | 2.84 | 2.70 | 1.53 | | | * | + |
| NT2RP2000845 | 12.78 | 5.61 | 3.57 | 11.56 | 12.23 | 11.13 | 7.34 | 7.10 | 8.72 | | | | |
| NT2RP2000863 | 2.24 | 1.48 | 1.52 | 2.02 | 1.72 | 1.96 | 1.61 | 2.25 | 1.68 | | | | |
| NT2RP2000880 | 10.87 | 4.76 | 7.03 | 10.28 | 10.84 | 10.60 | 7.87 | 8.04 | 7.97 | | | | |
| NT2RP2000892 | 3.07 | 1.45 | 2.10 | 2.15 | 3.52 | 2.03 | 2.6 | 3.34 | 2.68 | | | | |
| NT2RP2000894 | 2.45 | 1.27 | 1.87 | 2.80 | 3.03 | 2.60 | 3.77 | 5.13 | 5.17 | | | ** | + |
| NT2RP2000903 | 2.42 | 1.74 | 2.17 | 15.91 | 10.43 | 12.06 | 3.76 | 4.80 | 3.91 | ** | + | ** | + |
| NT2RP2000906 | 2.89 | 1.95 | 2.70 | 4.14 | 5.17 | 4.16 | 3.32 | 2.67 | 4.12 | * | + | | |
| NT2RP2000910 | 2.79 | 1.53 | 2.66 | 6.17 | 5.30 | 4.67 | 3.71 | 4.07 | 3.28 | * | + | * | + |
| NT2RP2000931 | 32.13 | 11.92 | 13.53 | 39.97 | 39.93 | 28.59 | 17.58 | 15.27 | 16.3 | | | | |
| NT2RP2000932 | 4.21 | 2.31 | 2.05 | 7.96 | 6.87 | 4.87 | 4.36 | 3.76 | 4.67 | * | + | | |
| NT2RP2000938 | 19.54 | 10.59 | 13.57 | 13.71 | 16.06 | 13.76 | 9.46 | 10.81 | 12.03 | | | | |
| NT2RP2000943 | 4.61 | 2.00 | 2.25 | 2.99 | 4.17 | 3.48 | 6.66 | 6.59 | 6.2 | | | * | + |
| NT2RP2000957 | 2.25 | 1.38 | 1.92 | 2.45 | 2.33 | 2.46 | 1.28 | 3.48 | 2.23 | | | | |
| NT2RP2000958 | 6.62 | 2.75 | 4.11 | 5.71 | 4.71 | 5.65 | 4.44 | 6.65 | 3.45 | | | | |
| NT2RP2000959 | 5.43 | 1.74 | 2.79 | 6.81 | 7.31 | 5.96 | 7.7 | 6.58 | 8.28 | * | + | * | + |
| NT2RP2000965 | 8.62 | 7.11 | 7.91 | 6.90 | 6.39 | 7.29 | 4.61 | 4.19 | 4.83 | | | ** | − |
| NT2RP2000970 | 6.70 | 2.82 | 2.67 | 8.85 | 8.32 | 8.60 | 5.68 | 4.48 | 4.57 | * | + | | |
| NT2RP2000973 | 2.87 | 3.35 | 2.21 | 3.68 | 3.61 | 1.94 | 3.33 | 3.24 | 2.43 | | | | |
| NT2RP2000985 | 4.15 | 2.39 | 2.33 | 2.87 | 4.28 | 3.35 | 2.71 | 2.53 | 3.95 | | | | |
| NT2RP2000987 | 2.36 | 1.40 | 1.29 | 2.94 | 3.30 | 3.87 | 2.43 | 3.02 | 3.28 | * | + | * | + |
| NT2RP2000997 | 3.92 | 3.46 | 2.91 | 6.76 | 6.13 | 8.29 | 6.06 | 7.63 | 6.82 | ** | + | ** | + |
| NT2RP2001024 | 3.02 | 2.00 | 2.80 | 4.39 | 4.00 | 3.80 | 2.57 | 2.72 | 3.03 | * | + | | |
| NT2RP2001028 | 1.53 | 1.61 | 1.49 | 3.31 | 2.89 | 2.16 | 1.09 | 3.10 | 1.56 | * | + | | |
| NT2RP2001036 | 8.99 | 5.09 | 6.28 | 14.47 | 12.09 | 13.66 | 6.21 | 7.37 | 8.86 | ** | + | | |
| NT2RP2001039 | 2.38 | 1.24 | 0.84 | 2.83 | 2.64 | 1.64 | 1.85 | 1.41 | 1.82 | | | | |
| NT2RP2001044 | 3.60 | 1.75 | 2.33 | 3.81 | 3.95 | 2.60 | 1.92 | 3.42 | 3.51 | | | | |
| NT2RP2001056 | 8.76 | 6.20 | 3.80 | 10.38 | 10.96 | 8.29 | 5.85 | 5.19 | 6.9 | | | | |
| NT2RP2001065 | 11.06 | 6.53 | 6.66 | 6.07 | 7.52 | 5.67 | 4.84 | 4.18 | 3.98 | | | | |
| NT2RP2001067 | 3.97 | 2.56 | 1.95 | 4.29 | 2.72 | 3.44 | 1.28 | 3.38 | 2.55 | | | | |
| NT2RP2001070 | 6.27 | 3.18 | 2.94 | 8.92 | 8.75 | 6.08 | 5.11 | 6.42 | 3.18 | | | | |
| NT2RP2001081 | 7.29 | 3.39 | 2.85 | 9.20 | 10.42 | 10.02 | 6.26 | 8.11 | 6.41 | * | + | | |
| NT2RP2001087 | 2.47 | 2.17 | 1.24 | 3.46 | 5.06 | 3.87 | 2.98 | 3.13 | 3.05 | * | + | * | + |
| NT2RP2001094 | 0.61 | 0.13 | 0.10 | 1.14 | 0.70 | 0.35 | 0.83 | 0.86 | 1.21 | | | * | + |
| NT2RP2001119 | 6.84 | 4.46 | 3.47 | 7.70 | 9.69 | 7.83 | 4.19 | 5.13 | 8.84 | * | + | | |
| NT2RP2001127 | 5.97 | 3.17 | 2.14 | 8.14 | 7.01 | 6.94 | 3.37 | 5.51 | 5.47 | * | + | | |
| NT2RP2001133 | 6.80 | 4.14 | 3.76 | 7.22 | 8.84 | 6.01 | 3.82 | 6.62 | 4.59 | | | | |
| NT2RP2001137 | 4.85 | 2.38 | 2.65 | 2.75 | 3.98 | 3.93 | 2.74 | 5.27 | 3.23 | | | | |
| NT2RP2001142 | 3.86 | 1.91 | 2.02 | 3.11 | 3.09 | 2.46 | 1.97 | 4.83 | 1.3 | | | | |
| NT2RP2001149 | 4.02 | 1.34 | 2.11 | 3.88 | 2.95 | 3.29 | 1.85 | 2.88 | 2.53 | | | | |
| NT2RP2001168 | 13.95 | 5.65 | 7.80 | 16.05 | 15.12 | 13.54 | 11.11 | 11.37 | 10.13 | | | | |
| NT2RP2001173 | 2.96 | 1.32 | 1.35 | 7.72 | 6.56 | 4.53 | 4.19 | 3.26 | 2.72 | * | + | | |
| NT2RP2001174 | 4.49 | 3.17 | 1.74 | 5.69 | 5.38 | 5.09 | 5.65 | 3.56 | 3.21 | | | | |
| NT2RP2001184 | 7.71 | 4.21 | 4.96 | 7.15 | 6.32 | 5.98 | 5.09 | 5.61 | 5.63 | | | | |
| NT2RP2001196 | 1.68 | 0.99 | 1.05 | 1.56 | 1.51 | 1.49 | 1.6 | 1.79 | 2.14 | | | | |

TABLE 244

| ID | | | | | | | | | | | | | |
|---|---|---|---|---|---|---|---|---|---|---|---|---|---|
| NT2RP2001200 | 3.43 | 3.44 | 2.46 | 6.55 | 4.88 | 4.21 | 3.59 | 2.77 | 3.29 | | | | |
| NT2RP2001218 | 3.11 | 1.72 | 2.13 | 3.51 | 3.65 | 3.23 | 2.31 | 2.98 | 3.88 | | | | |
| NT2RP2001223 | 5.06 | 2.55 | 3.61 | 3.72 | 4.59 | 2.27 | 3.19 | 3.20 | 3.06 | | | | |
| NT2RP2001226 | 12.72 | 7.29 | 8.85 | 12.01 | 9.47 | 7.65 | 11.46 | 8.46 | 11.8 | | | | |
| NT2RP2001227 | 6.22 | 4.18 | 3.44 | 6.26 | 5.08 | 5.75 | 7.03 | 4.88 | 5.64 | | | | |
| NT2RP2001232 | 7.29 | 3.90 | 3.93 | 7.87 | 8.17 | 8.48 | 7.39 | 5.90 | 4.44 | | | | |
| NT2RP2001233 | 14.76 | 8.17 | 8.10 | 14.08 | 19.00 | 21.01 | 13.52 | 10.12 | 10.65 | | | | |
| NT2RP2001245 | 3.69 | 2.29 | 2.63 | 3.56 | 3.59 | 3.28 | 3.42 | 3.62 | 4.39 | | | | |
| NT2RP2001246 | 2.35 | 0.80 | 3.09 | 3.34 | 4.44 | 4.13 | 4.38 | 7.67 | 6.87 | | | * | + |
| NT2RP2001268 | 5.55 | 3.73 | 6.74 | 8.43 | 9.77 | 9.29 | 5.65 | 6.17 | 7.45 | * | + | | |
| NT2RP2001270 | 14.16 | 9.13 | 9.94 | 14.63 | 14.49 | 8.30 | 11.4 | 14.47 | 14.26 | | | | |
| NT2RP2001276 | 2.24 | 1.82 | 0.94 | 3.36 | 2.75 | 2.46 | 3.31 | 2.32 | 2.92 | | | | |
| NT2RP2001277 | 3.77 | 1.80 | 1.15 | 7.12 | 6.46 | 6.90 | 6.6 | 4.91 | 5.92 | ** | + | * | + |
| NT2RP2001290 | 3.82 | 2.12 | 2.26 | 5.58 | 9.49 | 5.69 | 6.49 | 4.65 | 4.63 | * | + | * | + |
| NT2RP2001295 | 3.75 | 1.96 | 2.66 | 4.93 | 5.60 | 3.83 | 3.62 | 3.11 | 3.56 | | | | |
| NT2RP2001297 | 104.94 | 62.95 | 78.61 | 112.57 | 111.95 | 109.12 | 28.51 | 42.30 | 59.76 | | | | |
| NT2RP2001301 | 6.22 | 5.96 | 7.50 | 7.48 | 6.39 | 7.90 | 5.94 | 7.38 | 6.32 | | | | |
| NT2RP2001312 | 16.14 | 10.26 | 15.91 | 20.56 | 19.30 | 16.72 | 18.23 | 19.30 | 23.86 | | | | |
| NT2RP2001327 | 8.14 | 6.35 | 5.95 | 5.76 | 7.30 | 7.36 | 7.73 | 8.61 | 9.09 | | | | |
| NT2RP2001328 | 18.42 | 9.64 | 9.66 | 24.64 | 22.08 | 22.34 | 13.94 | 10.86 | 12.67 | * | + | | |
| NT2RP2001341 | 17.63 | 7.30 | 6.72 | 12.36 | 9.62 | 10.30 | 8.25 | 8.97 | 14.65 | | | | |
| NT2RP2001347 | 17.63 | 11.15 | 9.87 | 16.21 | 14.33 | 12.17 | 10.57 | 9.73 | 12.31 | | | | |
| NT2RP2001366 | 10.12 | 8.31 | 6.45 | 18.92 | 23.58 | 18.36 | 11.75 | 11.32 | 14.59 | ** | + | * | + |
| NT2RP2001378 | 8.29 | 6.95 | 6.58 | 6.49 | 8.22 | 6.02 | 7.98 | 9.16 | 9.41 | | | | |

TABLE 244-continued

| ID | | | | | | | | | | | | | |
|---|---|---|---|---|---|---|---|---|---|---|---|---|---|
| NT2RP2001381 | 4.07 | 2.97 | 3.94 | 2.90 | 3.52 | 4.42 | 2.95 | 2.69 | 2.85 | | | | |
| NT2RP2001388 | 3.41 | 3.63 | 3.35 | 6.25 | 9.01 | 7.41 | 5.95 | 6.27 | 6.62 | ** | + | ** | + |
| NT2RP2001391 | 210.40 | 161.64 | 144.04 | 393.09 | 492.35 | 288.04 | 175.7 | 224.46 | 230.6 | * | + | | |
| NT2RP2001392 | 7.04 | 3.01 | 3.58 | 4.59 | 5.33 | 4.71 | 6.14 | 5.70 | 5.27 | | | | |
| NT2RP2001394 | 9.60 | 6.22 | 4.32 | 15.24 | 15.30 | 14.78 | 8 | 5.76 | 7.4 | ** | + | | |
| NT2RP2001397 | 15.57 | 11.63 | 10.83 | 8.23 | 11.47 | 9.12 | 4.18 | 3.62 | 3.82 | | | ** | − |
| NT2RP2001400 | 2.42 | 2.39 | 2.33 | 4.87 | 6.19 | 6.06 | 7.4 | 8.87 | 13.18 | ** | + | * | + |
| NT2RP2001408 | 5.20 | 3.88 | 3.54 | 7.39 | 10.57 | 7.94 | 7.53 | 7.30 | 6.48 | * | + | ** | + |
| NT2RP2001420 | 4.15 | 2.99 | 3.26 | 8.92 | 7.75 | 7.19 | 4.98 | 4.32 | 3.55 | ** | + | | |
| NT2RP2001423 | 3.65 | 2.45 | 3.55 | 6.47 | 6.38 | 4.42 | 6.23 | 5.04 | 5.49 | * | + | * | + |
| NT2RP2001427 | 4.90 | 3.28 | 3.58 | 5.81 | 6.42 | 5.73 | 4.13 | 4.89 | 4.51 | * | + | | |
| NT2RP2001428 | 4.31 | 2.09 | 2.32 | 7.25 | 7.90 | 5.77 | 3.53 | 5.08 | 3.14 | * | + | | |
| NT2RP2001436 | 3.76 | 2.25 | 2.26 | 8.78 | 8.61 | 8.75 | 5.22 | 4.80 | 6.42 | ** | + | * | + |
| NT2RP2001440 | 3.29 | 2.41 | 1.73 | 3.63 | 4.88 | 4.33 | 2.34 | 3.35 | 3.86 | * | + | | |
| NT2RP2001445 | 2.95 | 1.26 | 2.68 | 2.98 | 3.78 | 3.07 | 2.47 | 3.15 | 2.23 | | | | |
| NT2RP2001449 | 2.88 | 2.13 | 1.40 | 3.15 | 3.39 | 4.62 | 2.6 | 3.60 | 1.97 | | | | |
| NT2RP2001450 | 4.05 | 2.94 | 3.13 | 3.77 | 4.31 | 3.85 | 3.71 | 4.15 | 3.13 | | | | |
| NT2RP2001467 | 2.37 | 1.91 | 2.75 | 5.44 | 4.55 | 6.16 | 5.15 | 4.88 | 3.4 | ** | + | * | + |
| NT2RP2001469 | 10.04 | 7.34 | 9.26 | 5.41 | 8.75 | 6.36 | 6.52 | 6.42 | 6.37 | | | * | − |
| NT2RP2001480 | 6.23 | 4.15 | 2.86 | 6.30 | 5.94 | 4.07 | 6.36 | 5.86 | 4.85 | | | | |
| NT2RP2001495 | 14.26 | 10.91 | 10.35 | 11.90 | 13.38 | 11.11 | 12.39 | 11.10 | 12.13 | | | | |
| NT2RP2001499 | 4.67 | 3.29 | 2.95 | 6.59 | 7.16 | 8.76 | 5.49 | 6.33 | 5.02 | ** | + | * | + |
| NT2RP2001506 | 4.89 | 3.71 | 3.86 | 7.29 | 8.04 | 7.88 | 5.96 | 6.72 | 7.88 | ** | + | * | + |
| NT2RP2001508 | 6.85 | 6.36 | 6.72 | 17.18 | 14.22 | 13.59 | 7.65 | 11.84 | 6.81 | ** | + | | |
| NT2RP2001511 | 11.59 | 6.20 | 8.17 | 12.86 | 12.37 | 12.22 | 11.15 | 9.45 | 10.6 | | | | |
| NT2RP2001514 | 6.61 | 4.54 | 5.10 | 6.50 | 5.89 | 6.49 | 5.87 | 6.17 | 7.22 | | | | |
| NT2RP2001520 | 2.37 | 1.99 | 2.43 | 3.12 | 2.75 | 2.57 | 4.35 | 3.09 | 2.57 | | | | |
| NT2RP2001526 | 12.96 | 5.00 | 5.99 | 26.60 | 29.55 | 19.41 | 14.77 | 8.09 | 13.41 | * | + | | |
| NT2RP2001529 | 8.76 | 6.16 | 5.20 | 6.03 | 7.62 | 5.55 | 4.77 | 5.25 | 10.17 | | | | |
| NT2RP2001536 | 3.16 | 2.19 | 1.50 | 3.33 | 3.18 | 2.23 | 2.35 | 2.79 | 2.24 | | | | |
| NT2RP2001538 | 75.84 | 48.30 | 57.88 | 103.08 | 97.23 | 96.04 | 48.73 | 42.09 | 45.9 | * | + | | |
| NT2RP2001547 | 5.37 | 2.86 | 3.64 | 4.76 | 4.73 | 4.52 | 3.5 | 4.96 | 4.64 | | | | |

TABLE 245

| ID | | | | | | | | | | | | | |
|---|---|---|---|---|---|---|---|---|---|---|---|---|---|
| NT2RP2001560 | 6.39 | 4.64 | 4.20 | 5.82 | 7.13 | 5.81 | 3.38 | 4.66 | 5.13 | | | | |
| NT2RP2001562 | 4.89 | 3.58 | 3.48 | 6.44 | 6.82 | 4.81 | 4.71 | 5.39 | 5.07 | | | | |
| NT2RP2001566 | 7.48 | 4.52 | 5.51 | 7.16 | 5.92 | 8.75 | 7.73 | 7.60 | 6.5 | | | | |
| NT2RP2001569 | 14.82 | 5.79 | 9.60 | 21.83 | 22.56 | 14.28 | 10.25 | 9.70 | 10.1 | | | | |
| NT2RP2001576 | 10.55 | 5.49 | 5.69 | 8.15 | 9.33 | 7.45 | 8.98 | 9.68 | 8.51 | | | | |
| NT2RP2001581 | 56.76 | 28.34 | 28.83 | 65.72 | 65.95 | 57.58 | 33.46 | 29.31 | 29.57 | | | | |
| NT2RP2001597 | 6.52 | 3.84 | 3.20 | 6.75 | 8.45 | 4.27 | 5.43 | 7.30 | 6.46 | | | | |
| NT2RP2001601 | 1.39 | 1.22 | 0.85 | 2.84 | 5.69 | 3.38 | 1.83 | 3.28 | 2.5 | * | + | * | + |
| NT2RP2001613 | 0.98 | 1.39 | 1.71 | 1.95 | 1.58 | 2.25 | 1.57 | 2.65 | 2.69 | | | | |
| NT2RP2001628 | 3.83 | 3.04 | 3.39 | 4.74 | 7.75 | 4.57 | 4.66 | 5.20 | 3.94 | | | | |
| NT2RP2001634 | 9.71 | 7.65 | 8.42 | 9.38 | 5.92 | 8.18 | 7.57 | 6.78 | 7.74 | | | | |
| NT2RP2001635 | 6.36 | 3.48 | 2.24 | 6.23 | 7.58 | 4.38 | 4.88 | 3.74 | 2.85 | | | | |
| NT2RP2001660 | 2.86 | 2.10 | 1.03 | 7.27 | 5.03 | 4.32 | 4.44 | 3.32 | 7.02 | * | + | | |
| NT2RP2001662 | 9.75 | 5.05 | 6.57 | 13.09 | 11.75 | 8.88 | 7.01 | 6.63 | 7.59 | | | | |
| NT2RP2001663 | 3.29 | 2.74 | 2.56 | 3.86 | 4.83 | 6.87 | 3.87 | 4.11 | 4.21 | | | ** | + |
| NT2RP2001672 | 3.92 | 2.66 | 2.42 | 6.76 | 8.23 | 7.05 | 3.9 | 5.21 | 5.15 | ** | + | * | + |
| NT2RP2001675 | 2.35 | 2.00 | 2.38 | 1.25 | 1.56 | 1.93 | 1.59 | 2.56 | 2.41 | * | − | | |
| NT2RP2001677 | 6.62 | 5.40 | 3.75 | 5.38 | 8.63 | 6.75 | 8.06 | 7.03 | 7.46 | | | | |
| NT2RP2001678 | 3.81 | 2.77 | 2.79 | 5.76 | 5.75 | 5.77 | 3.78 | 5.60 | 5.43 | ** | + | | |
| NT2RP2001683 | 1.31 | 1.34 | 1.35 | 2.92 | 5.85 | 2.75 | 1.53 | 1.74 | 1.61 | | | ** | + |
| NT2RP2001699 | 10.48 | 4.46 | 4.39 | 9.39 | 8.26 | 5.63 | 7.71 | 4.72 | 6.45 | | | | |
| NT2RP2001707 | 6.36 | 2.69 | 3.12 | 4.80 | 5.89 | 4.38 | 5.21 | 3.89 | 4.02 | | | | |
| NT2RP2001720 | 4.31 | 2.23 | 2.64 | 5.76 | 5.81 | 5.36 | 2.53 | 3.30 | 4.19 | * | + | | |
| NT2RP2001721 | 5.95 | 3.63 | 4.33 | 4.87 | 4.91 | 5.43 | 4.03 | 4.62 | 4.71 | | | | |
| NT2RP2001740 | 9.64 | 7.71 | 6.71 | 10.42 | 9.86 | 6.60 | 4.64 | 5.42 | 6.18 | | | | |
| NT2RP2001748 | 8.04 | 6.16 | 5.85 | 6.53 | 8.57 | 9.79 | 7.32 | 7.38 | 8.28 | | | | |
| NT2RP2001755 | 8.56 | 5.19 | 5.01 | 5.45 | 6.63 | 4.59 | 3 | 4.11 | 4.45 | | | | |
| NT2RP2001762 | 3.51 | 1.45 | 1.56 | 4.01 | 2.49 | 1.10 | 1.33 | 1.59 | 1.38 | | | | |
| NT2RP2001768 | 10.52 | 5.70 | 5.26 | 8.83 | 8.48 | 7.75 | 7.16 | 7.38 | 7.69 | | | | |
| NT2RP2001769 | 10.19 | 4.14 | 4.34 | 4.02 | 3.67 | 3.86 | 2.04 | 3.80 | 3.12 | | | | |
| NT2RP2001784 | 3.41 | 2.66 | 3.05 | 4.40 | 6.83 | 4.24 | 3.51 | 4.60 | 5.21 | | | | |
| NT2RP2001805 | 8.47 | 4.44 | 5.36 | 7.33 | 9.55 | 7.18 | 6.45 | 7.26 | 6.85 | | | | |
| NT2RP2001813 | 0.85 | 0.76 | 1.30 | 1.56 | 0.97 | 1.22 | 1.03 | 2.43 | 0.53 | | | | |
| NT2RP2001817 | 3.31 | 2.32 | 3.38 | 2.20 | 3.73 | 2.38 | 1.83 | 3.68 | 1.91 | | | | |
| NT2RP2001818 | 9.15 | 4.97 | 5.99 | 7.22 | 8.04 | 4.90 | 5.14 | 6.97 | 4.17 | | | | |
| NT2RP2001837 | 6.67 | 3.70 | 3.89 | 10.21 | 8.70 | 8.64 | 6.67 | 5.27 | 5.41 | * | + | | |
| NT2RP2001839 | 8.94 | 4.07 | 4.05 | 8.65 | 8.01 | 5.90 | 7.01 | 4.33 | 4.71 | | | | |
| NT2RP2001861 | 3.92 | 3.91 | 2.96 | 5.38 | 4.82 | 4.41 | 3.85 | 3.89 | 4.28 | * | + | | |
| NT2RP2001869 | 3.96 | 3.68 | 2.84 | 5.29 | 6.76 | 6.36 | 4.79 | 4.96 | 8.38 | ** | + | | |
| NT2RP2001876 | 5.26 | 4.39 | 3.67 | 5.40 | 6.52 | 6.44 | 4.25 | 3.45 | 3.89 | * | + | | |
| NT2RP2001878 | 2.96 | 2.08 | 2.84 | 3.77 | 3.75 | 3.70 | 4.02 | 3.19 | 4.69 | * | + | | |

TABLE 245-continued

| | | | | | | | | | | | | |
|---|---|---|---|---|---|---|---|---|---|---|---|---|
| NT2RP2001881 | 3.61 | 3.23 | 3.04 | 4.01 | 3.35 | 3.50 | 1.51 | 1.79 | 2.14 | | ** | − |
| NT2RP2001883 | 14.84 | 8.25 | 6.92 | 8.52 | 8.12 | 7.84 | 10.33 | 7.28 | 8.44 | | | |
| NT2RP2001884 | 13.60 | 7.36 | 6.43 | 4.80 | 5.47 | 5.55 | 7.44 | 5.61 | 6.14 | | | |
| NT2RP2001885 | 4.58 | 2.98 | 2.92 | 4.56 | 5.26 | 4.27 | 4.8 | 4.09 | 3.45 | | | |
| NT2RP2001898 | 5.25 | 3.59 | 4.61 | 5.09 | 5.82 | 4.63 | 4.24 | 6.45 | 7.13 | | | |
| NT2RP2001900 | 3.76 | 2.05 | 3.66 | 6.01 | 5.52 | 2.71 | 3.58 | 3.82 | 6.81 | | | |
| NT2RP2001903 | 26.27 | 19.19 | 22.63 | 20.41 | 23.55 | 21.60 | 18.49 | 17.64 | 17.95 | | | |
| NT2RP2001907 | 6.26 | 4.16 | 3.66 | 9.32 | 10.90 | 7.90 | 6.73 | 6.46 | 7.59 | * | + | |
| NT2RP2001915 | 2.75 | 1.61 | 1.89 | 3.01 | 6.15 | 2.73 | 2.2 | 4.12 | 4.37 | | | |
| NT2RP2001921 | 13.96 | 7.17 | 5.50 | 7.19 | 5.36 | 4.44 | 6.09 | 4.12 | 4.96 | | | |
| NT2RP2001926 | 2.31 | 1.57 | 1.52 | 6.10 | 5.30 | 3.82 | 6.1 | 3.59 | 5.57 | * | + | * | + |
| NT2RP2001933 | 7.86 | 5.07 | 6.52 | 8.86 | 5.68 | 6.54 | 7.83 | 5.74 | 7.63 | | | |
| NT2RP2001936 | 1.63 | 0.95 | 0.99 | 1.17 | 2.42 | 2.36 | 1.86 | 2.55 | 1.83 | | | |
| NT2RP2001943 | 51.19 | 30.10 | 31.53 | 33.01 | 35.70 | 30.61 | 29.07 | 28.57 | 30.35 | | | |
| NT2RP2001946 | 3.26 | 2.65 | 3.35 | 3.35 | 3.83 | 4.97 | 4.68 | 3.30 | 3.45 | | | |

TABLE 246

| | | | | | | | | | | | | |
|---|---|---|---|---|---|---|---|---|---|---|---|---|
| NT2RP2001947 | 4.91 | 3.61 | 5.81 | 3.96 | 7.23 | 5.13 | 4.97 | 5.37 | 4.61 | | | |
| NT2RP2001948 | 3.08 | 1.21 | 4.06 | 4.99 | 4.92 | 1.65 | 1.37 | 3.34 | 8.7 | | | |
| NT2RP2001956 | 15.21 | 7.64 | 6.12 | 7.09 | 9.06 | 8.60 | 13.91 | 9.28 | 14.64 | | | |
| NT2RP2001969 | 8.23 | 4.55 | 5.29 | 5.46 | 6.80 | 5.70 | 8.22 | 5.90 | 10.07 | | | |
| NT2RP2001976 | 2.14 | 2.20 | 2.33 | 1.64 | 3.47 | 2.44 | 1.48 | 2.24 | 2.16 | | | |
| NT2RP2001978 | 4.60 | 3.86 | 2.35 | 6.96 | 6.45 | 5.14 | 6.22 | 4.96 | 6.39 | * | + | * |
| NT2RP2001985 | 3.92 | 3.42 | 3.57 | 5.93 | 6.65 | 5.91 | 5.3 | 5.09 | 5.9 | ** | + | ** | + |
| NT2RP2001991 | 1.73 | 1.46 | 2.57 | 3.16 | 4.44 | 3.93 | 3.02 | 3.02 | 2.07 | * | + | |
| NT2RP2001997 | 3.98 | 3.95 | 3.94 | 5.87 | 6.12 | 4.91 | 4.68 | 4.05 | 3.66 | * | + | |
| NT2RP2002015 | 78.11 | 51.57 | 65.21 | 141.26 | 146.10 | 108.68 | 76.93 | 62.92 | 81.97 | ** | + | |
| NT2RP2002017 | 3.82 | 3.00 | 1.73 | 4.92 | 6.18 | 4.74 | 4 | 3.36 | 3.11 | * | + | |
| NT2RP2002025 | 9.38 | 5.00 | 3.82 | 6.47 | 6.74 | 7.41 | 7.27 | 7.03 | 6.73 | | | |
| NT2RP2002030 | 14.24 | 9.95 | 8.14 | 32.58 | 35.24 | 33.11 | 14.46 | 16.78 | 20.02 | ** | + | |
| NT2RP2002032 | 7.60 | 6.08 | 6.71 | 7.52 | 10.42 | 7.21 | 9.78 | 7.83 | 10 | | | * | + |
| NT2RP2002033 | 10.00 | 6.88 | 8.54 | 14.32 | 18.25 | 17.32 | 8.01 | 10.19 | 9.71 | ** | + | |
| NT2RP2002041 | 1.30 | 1.42 | 1.01 | 2.33 | 2.65 | 2.99 | 2.24 | 3.22 | 3.54 | ** | + | * | + |
| NT2RP2002046 | 2.29 | 2.31 | 3.63 | 4.90 | 5.83 | 4.05 | 4.05 | 4.50 | 4.31 | * | + | * | + |
| NT2RP2002047 | 5.55 | 4.39 | 6.12 | 3.39 | 3.21 | 2.86 | 3.07 | 2.96 | 1.09 | * | − | * | − |
| NT2RP2002050 | 8.38 | 3.98 | 6.12 | 10.46 | 10.43 | 10.14 | 8.27 | 8.23 | 7.23 | * | + | |
| NT2RP2002052 | 6.47 | 4.41 | 3.60 | 6.50 | 9.32 | 5.86 | 4.66 | 4.62 | 6.58 | | | |
| NT2RP2002058 | 3.62 | 2.82 | 3.02 | 3.46 | 3.52 | 2.23 | 2.78 | 3.89 | 2.56 | | | |
| NT2RP2002060 | 6.58 | 3.14 | 4.55 | 4.58 | 5.81 | 5.66 | 5.55 | 7.36 | 5.35 | | | |
| NT2RP2002063 | 1.56 | 1.90 | 1.51 | 3.69 | 1.67 | 1.86 | 2.22 | 2.63 | 1.71 | | | |
| NT2RP2002066 | 5.03 | 3.37 | 4.61 | 4.73 | 5.21 | 5.32 | 7.33 | 6.17 | 4.62 | | | |
| NT2RP2002070 | 0.79 | 0.79 | 0.34 | 1.28 | 2.20 | 1.05 | 0.97 | 2.47 | 0.94 | | | |
| NT2RP2002076 | 3.86 | 2.57 | 2.52 | 3.36 | 3.56 | 2.78 | 2.73 | 4.09 | 2.15 | | | |
| NT2RP2002078 | 5.54 | 3.35 | 3.42 | 13.66 | 10.39 | 8.08 | 7.93 | 6.64 | 6.4 | * | + | * | + |
| NT2RP2002079 | 5.14 | 3.23 | 1.70 | 5.80 | 4.94 | 6.51 | 3.67 | 4.05 | 3.99 | | | |
| NT2RP2002099 | 7.45 | 3.48 | 2.47 | 4.21 | 4.13 | 3.43 | 3.32 | 4.93 | 4.92 | | | |
| NT2RP2002105 | 5.64 | 3.25 | 3.05 | 3.88 | 4.16 | 3.68 | 4.68 | 5.62 | 4.37 | | | |
| NT2RP2002115 | 0.92 | 0.69 | 0.55 | 1.83 | 1.20 | 1.32 | 0.97 | 2.15 | 0.81 | * | + | |
| NT2RP2002124 | 2.28 | 1.30 | 1.91 | 4.70 | 4.64 | 3.30 | 3.98 | 3.75 | 2.5 | * | + | * | + |
| NT2RP2002137 | 2.93 | 1.88 | 1.87 | 2.18 | 3.16 | 2.61 | 3.4 | 4.11 | 2.95 | | | |
| NT2RP2002139 | 4.33 | 3.54 | 3.42 | 3.56 | 4.04 | 4.02 | 5.23 | 4.66 | 5.13 | | | * | + |
| NT2RP2002154 | 5.53 | 2.76 | 1.92 | 4.83 | 6.57 | 3.88 | 4.83 | 4.72 | 5.4 | | | |
| NT2RP2002155 | 279.79 | 155.93 | 163.22 | 222.28 | 242.49 | 184.60 | 219.6 | 179.59 | 177.9 | | | |
| NT2RP2002172 | 4.14 | 2.59 | 2.22 | 3.81 | 3.52 | 4.02 | 3.34 | 4.90 | 3.32 | | | |
| NT2RP2002185 | 4.32 | 3.52 | 2.95 | 4.55 | 4.64 | 4.41 | 4.65 | 5.42 | 5.45 | | | * | + |
| NT2RP2002188 | 11.41 | 5.54 | 8.75 | 9.54 | 13.32 | 9.41 | 7.96 | 10.55 | 9.63 | | | |
| NT2RP2002192 | 3.64 | 3.48 | 3.53 | 4.30 | 3.68 | 3.71 | 3.91 | 3.83 | 2.29 | | | |
| NT2RP2002193 | 3.15 | 2.72 | 2.77 | 3.68 | 4.01 | 3.41 | 3.89 | 3.36 | 4.16 | * | + | * | + |
| NT2RP2002208 | 2.07 | 2.36 | 2.72 | 6.19 | 4.41 | 5.19 | 4.33 | 5.08 | 2.51 | ** | + | |
| NT2RP2002219 | 4.17 | 1.29 | 1.62 | 2.78 | 4.30 | 2.60 | 1.31 | 1.97 | 1.84 | | | |
| NT2RP2002231 | 2.75 | 2.39 | 1.20 | 3.02 | 3.57 | 1.95 | 1.53 | 1.47 | 2.21 | | | |
| NT2RP2002232 | 5.59 | 1.67 | 2.23 | 5.04 | 5.05 | 3.28 | 3.82 | 4.55 | 3.16 | | | |
| NT2RP2002235 | 7.15 | 4.93 | 3.90 | 3.84 | 3.33 | 2.89 | 4.86 | 6.74 | 5.47 | | | |
| NT2RP2002239 | 23.74 | 15.37 | 16.41 | 23.91 | 26.96 | 19.68 | 8.59 | 12.98 | 10.06 | | | |
| NT2RP2002252 | 9.96 | 4.94 | 5.61 | 5.48 | 5.08 | 6.39 | 5.19 | 6.06 | 5.88 | | | |
| NT2RP2002256 | 1.33 | 1.22 | 1.37 | 1.71 | 2.37 | 2.14 | 1.73 | 2.95 | 1.47 | * | + | |
| NT2RP2002257 | 2.29 | 1.76 | 1.74 | 4.11 | 5.09 | 2.83 | 4.04 | 4.42 | 3.81 | * | + | ** | + |
| NT2RP2002259 | 3.72 | 2.30 | 2.90 | 6.32 | 3.45 | 2.90 | 3.06 | 3.48 | 1.66 | | | |
| NT2RP2002264 | 2.47 | 1.33 | 1.14 | 6.07 | 7.37 | 5.74 | 2.09 | 3.51 | 3.03 | ** | + | |
| NT2RP2002267 | 8.31 | 4.57 | 4.68 | 12.59 | 14.87 | 10.14 | 12.21 | 9.31 | 10.07 | * | + | * | + |
| NT2RP2002270 | 7.39 | 4.62 | 5.64 | 7.88 | 7.73 | 8.65 | 3.38 | 3.42 | 4.07 | | | |
| NT2RP2002281 | 8.20 | 4.58 | 6.60 | 7.60 | 8.32 | 8.02 | 5.18 | 6.11 | 4.33 | | | |
| NT2RP2002288 | 5.39 | 5.46 | 4.44 | 3.41 | 3.45 | 3.50 | 3.57 | 3.54 | 3.96 | ** | − | * | − |

TABLE 247

| | | | | | | | | | | | | |
|---|---|---|---|---|---|---|---|---|---|---|---|---|
| NT2RP2002292 | 13.36 | 8.93 | 10.00 | 7.24 | 12.33 | 7.03 | 8.51 | 6.90 | 8.43 | | | | |
| NT2RP2002299 | 4.86 | 3.21 | 3.87 | 7.31 | 5.99 | 7.44 | 5.79 | 6.94 | 6.46 | * | + | * | + |
| NT2RP2002304 | 3.12 | 1.09 | 1.07 | 3.72 | 6.64 | 4.48 | 2.39 | 2.10 | 2.14 | * | + | | |
| NT2RP2002312 | 3.00 | 2.02 | 1.91 | 4.87 | 5.25 | 3.26 | 3.11 | 3.70 | 3.89 | * | + | * | + |
| NT2RP2002316 | 2.57 | 2.29 | 2.38 | 6.74 | 6.43 | 5.78 | 3.25 | 3.23 | 4.39 | ** | + | * | + |
| NT2RP2002325 | 2.17 | 2.03 | 1.50 | 3.32 | 3.39 | 2.92 | 1.65 | 3.11 | 3.18 | ** | + | | |
| NT2RP2002333 | 6.45 | 4.83 | 4.75 | 7.88 | 10.32 | 7.81 | 5.66 | 5.80 | 6.3 | * | + | | |
| NT2RP2002371 | 4.90 | 4.23 | 3.63 | 9.29 | 8.56 | 8.25 | 9.75 | 10.58 | 7.26 | ** | + | ** | + |
| NT2RP2002373 | 5.37 | 4.02 | 2.70 | 5.83 | 10.05 | 6.25 | 5.7 | 8.27 | 6.72 | | | | |
| NT2RP2002381 | 0.73 | 0.29 | 0.85 | 0.79 | 0.90 | 2.57 | 1.16 | 2.65 | 1.41 | | | | |
| NT2RP2002385 | 7.34 | 2.40 | 2.24 | 6.24 | 3.86 | 3.39 | 5.09 | 3.89 | 4.74 | | | | |
| NT2RP2002394 | 1.71 | 0.33 | 0.18 | 1.03 | 1.49 | 1.31 | 0.28 | 1.27 | 2.19 | | | | |
| NT2RP2002408 | 2.38 | 1.66 | 1.45 | 4.45 | 2.73 | 2.67 | 1.95 | 4.44 | 3.16 | | | | |
| NT2RP2002409 | 29.85 | 16.62 | 15.12 | 29.12 | 39.51 | 28.40 | 19.16 | 20.28 | 16.59 | | | | |
| NT2RP2002424 | 3.78 | 2.45 | 1.98 | 3.14 | 4.67 | 3.25 | 3.81 | 5.82 | 3.46 | | | | |
| NT2RP2002426 | 5.16 | 3.36 | 3.05 | 8.68 | 9.29 | 8.07 | 5.5 | 8.86 | 7.03 | ** | + | * | + |
| NT2RP2002429 | 6.36 | 5.02 | 5.09 | 9.72 | 12.33 | 8.37 | 9.84 | 17.67 | 16.81 | * | + | * | + |
| NT2RP2002437 | 3.49 | 2.56 | 3.29 | 4.17 | 7.17 | 4.10 | 3.26 | 6.17 | 5.32 | | | | |
| NT2RP2002439 | 11.07 | 5.27 | 5.30 | 11.81 | 8.46 | 7.22 | 11.52 | 9.36 | 7.78 | | | | |
| NT2RP2002442 | 6.40 | 2.74 | 3.03 | 4.62 | 5.05 | 4.46 | 4.75 | 2.98 | 3.74 | | | | |
| NT2RP2002457 | 2.28 | 2.49 | 1.70 | 3.54 | 4.01 | 3.48 | 4.07 | 3.72 | 3.08 | ** | + | * | + |
| NT2RP2002464 | 5.19 | 2.78 | 3.13 | 3.90 | 4.79 | 4.00 | 5.08 | 3.74 | 4 | | | | |
| NT2RP2002475 | 3.58 | 3.74 | 3.05 | 8.04 | 7.22 | 4.99 | 7.48 | 6.02 | 7.62 | * | + | ** | + |
| NT2RP2002479 | 3.49 | 2.33 | 2.32 | 3.60 | 4.32 | 2.72 | 2.92 | 2.66 | 5.14 | | | | |
| NT2RP2002487 | 4.86 | 2.73 | 2.49 | 4.04 | 4.25 | 4.00 | 3.16 | 3.11 | 3.07 | | | | |
| NT2RP2002498 | 2.48 | 0.99 | 1.21 | 3.47 | 2.96 | 2.55 | 1.35 | 1.52 | 1.58 | | | | |
| NT2RP2002503 | 13.02 | 6.05 | 8.78 | 12.14 | 16.89 | 12.87 | 9.04 | 8.81 | 7.66 | | | | |
| NT2RP2002504 | 6.63 | 3.00 | 4.84 | 4.05 | 6.27 | 4.67 | 6.68 | 4.71 | 5.18 | | | | |
| NT2RP2002510 | 15.40 | 9.87 | 11.00 | 12.38 | 17.28 | 17.15 | 18.56 | 12.92 | 13.19 | | | | |
| NT2RP2002520 | 1.61 | 1.78 | 1.33 | 4.08 | 3.77 | 4.83 | 3.97 | 4.73 | 4.31 | ** | + | ** | + |
| NT2RP2002527 | 11.26 | 7.87 | 9.14 | 12.36 | 15.57 | 11.93 | 8.08 | 6.87 | 9.06 | | | | |
| NT2RP2002533 | 15.80 | 10.32 | 13.55 | 16.21 | 16.47 | 14.65 | 18.71 | 12.94 | 18.73 | | | | |
| NT2RP2002537 | 6.78 | 4.47 | 5.46 | 7.12 | 8.21 | 8.66 | 4.34 | 3.85 | 6.54 | * | + | | |
| NT2RP2002542 | 11.84 | 6.86 | 7.87 | 24.97 | 24.70 | 21.27 | 12.25 | 9.81 | 10.65 | ** | + | | |
| NT2RP2002546 | 3.51 | 1.75 | 1.39 | 2.49 | 2.71 | 2.52 | 4.4 | 3.54 | 3.7 | | | | |
| NT2RP2002549 | 8.05 | 4.99 | 5.19 | 5.57 | 6.51 | 7.45 | 6.2 | 3.49 | 5.35 | | | | |
| NT2RP2002564 | 13.08 | 7.54 | 8.36 | 11.61 | 12.09 | 10.41 | 11.1 | 8.10 | 13.89 | | | | |
| NT2RP2002591 | 9.73 | 4.99 | 4.71 | 11.69 | 11.90 | 10.05 | 7.9 | 7.42 | 7.09 | | | | |
| NT2RP2002595 | 5.43 | 4.01 | 5.43 | 9.33 | 7.85 | 7.01 | 6.61 | 6.19 | 7.33 | * | + | * | + |
| NT2RP2002602 | 4.82 | 4.74 | 4.84 | 5.43 | 11.27 | 8.16 | 5.69 | 6.45 | 7.55 | | | * | + |
| NT2RP2002606 | 5.86 | 3.02 | 3.06 | 8.03 | 9.33 | 3.93 | 3.99 | 4.72 | 6.99 | | | | |
| NT2RP2002609 | 4.71 | 2.92 | 3.43 | 5.18 | 4.82 | 3.59 | 3.34 | 4.09 | 4.4 | | | | |
| NT2RP2002618 | 4.82 | 3.33 | 2.74 | 6.13 | 4.63 | 4.67 | 4.95 | 4.51 | 4.42 | | | | |
| NT2RP2002621 | 10.26 | 6.84 | 5.48 | 15.22 | 14.98 | 13.05 | 11.07 | 8.62 | 10.72 | * | + | | |
| NT2RP2002643 | 4.22 | 2.96 | 3.21 | 5.73 | 8.43 | 4.77 | 4.53 | 4.98 | 4.94 | | | * | + |
| NT2RP2002672 | 4.36 | 3.45 | 3.37 | 8.96 | 12.04 | 8.60 | 8.5 | 8.50 | 11.85 | ** | + | ** | + |
| NT2RP2002673 | 2.97 | 2.38 | 1.11 | 7.44 | 9.35 | 7.43 | 5.4 | 7.46 | 8.29 | ** | + | ** | + |
| NT2RP2002674 | 1.07 | 1.16 | 1.07 | 0.86 | 1.66 | 1.60 | 1.52 | 2.10 | 1.72 | | | * | + |
| NT2RP2002686 | 3.43 | 3.39 | 4.42 | 4.11 | 5.80 | 4.25 | 4.81 | 4.16 | 5.05 | | | | |
| NT2RP2002688 | 13.80 | 10.26 | 10.39 | 17.41 | 16.88 | 13.34 | 9.74 | 11.51 | 8.03 | | | | |
| NT2RP2002695 | 6.80 | 3.06 | 3.92 | 5.81 | 7.30 | 4.59 | 7.03 | 4.43 | 5.61 | | | | |
| NT2RP2002701 | 6.95 | 4.89 | 4.37 | 8.51 | 9.98 | 9.57 | 8.2 | 7.53 | 9.25 | * | + | * | + |
| NT2RP2002706 | 4.89 | 2.72 | 3.50 | 5.60 | 7.16 | 5.82 | 4.64 | 4.20 | 5.97 | * | + | | |
| NT2RP2002710 | 42.99 | 27.04 | 33.49 | 47.10 | 50.09 | 39.86 | 54.16 | 44.21 | 55.65 | | | * | + |
| NT2RP2002721 | 7.76 | 5.23 | 6.54 | 9.71 | 10.64 | 8.40 | 10.35 | 8.03 | 8.87 | * | + | | |
| NT2RP2002727 | 0.98 | 1.45 | 0.99 | 2.09 | 1.15 | 2.50 | 2.3 | 2.04 | 1.73 | | | * | + |

TABLE 248

| | | | | | | | | | | | | |
|---|---|---|---|---|---|---|---|---|---|---|---|---|
| NT2RP2002734 | 4.55 | 3.02 | 5.80 | 12.41 | 12.84 | 10.69 | 6.86 | 8.07 | 7.85 | ** | + | * | + |
| NT2RP2002736 | 3.63 | 2.27 | 2.67 | 2.07 | 2.02 | 2.04 | 2.87 | 2.60 | 2.01 | | | | |
| NT2RP2002740 | 2.59 | 1.02 | 0.94 | 3.18 | 2.63 | 2.29 | 2.78 | 2.96 | 1.96 | | | | |
| NT2RP2002741 | 5.52 | 4.27 | 3.15 | 7.73 | 8.99 | 8.94 | 4.51 | 5.06 | 7.43 | ** | + | | |
| NT2RP2002750 | 7.28 | 6.29 | 4.77 | 14.35 | 17.57 | 18.80 | 8.32 | 9.26 | 7.61 | ** | + | | |
| NT2RP2002752 | 11.68 | 7.46 | 7.74 | 12.78 | 17.74 | 15.50 | 11.31 | 10.02 | 12.22 | * | + | | |
| NT2RP2002753 | 11.55 | 5.48 | 11.53 | 10.53 | 6.13 | 11.57 | 7.42 | 7.93 | 9.43 | | | | |
| NT2RP2002760 | 8.78 | 4.40 | 4.62 | 7.89 | 8.63 | 6.01 | 6.34 | 6.38 | 7.33 | | | | |
| NT2RP2002769 | 3.29 | 2.63 | 2.68 | 3.72 | 6.64 | 6.67 | 2.86 | 4.11 | 3.55 | * | + | | |
| NT2RP2002778 | 9.07 | 6.03 | 9.70 | 7.44 | 6.87 | 7.92 | 6.93 | 7.76 | 4.98 | | | | |
| NT2RP2002791 | 6.58 | 4.82 | 4.00 | 9.50 | 14.75 | 9.25 | 8.23 | 6.79 | 7.02 | * | + | | |
| NT2RP2002800 | 6.57 | 4.20 | 5.63 | 10.46 | 11.33 | 12.38 | 5.4 | 8.07 | 7.04 | ** | + | | |
| NT2RP2002805 | 1.48 | 1.18 | 0.66 | 2.57 | 1.66 | 1.18 | 2.89 | 3.53 | 1.96 | | | * | + |
| NT2RP2002811 | 5.70 | 5.54 | 4.77 | 8.54 | 7.13 | 7.69 | 6.53 | 7.67 | 6.08 | ** | + | | |
| NT2RP2002824 | 9.12 | 5.93 | 7.91 | 13.68 | 13.22 | 9.65 | 9.82 | 10.22 | 11.6 | * | + | | |
| NT2RP2002839 | 3.89 | 2.03 | 2.96 | 3.87 | 4.52 | 3.28 | 3.17 | 3.43 | 3.41 | | | | |
| NT2RP2002845 | 2.29 | 1.84 | 1.77 | 4.04 | 4.31 | 4.72 | 3.6 | 4.26 | 3.16 | ** | + | ** | + |

TABLE 248-continued

| | | | | | | | | | | | | | |
|---|---|---|---|---|---|---|---|---|---|---|---|---|---|
| NT2RP2002857 | 0.99 | 1.45 | 1.80 | 1.98 | 2.27 | 1.76 | 2.36 | 3.14 | 1.89 | | | | |
| NT2RP2002862 | 11.21 | 6.20 | 5.58 | 10.84 | 12.86 | 10.44 | 6.99 | 7.12 | 10.71 | | | | |
| NT2RP2002880 | 5.70 | 4.03 | 2.74 | 3.50 | 4.84 | 3.87 | 4.05 | 5.72 | 5 | | | | |
| NT2RP2002885 | 6.90 | 4.59 | 4.82 | 5.83 | 6.45 | 4.16 | 3.34 | 4.76 | 3.08 | | | | |
| NT2RP2002891 | 5.76 | 3.80 | 3.33 | 5.44 | 6.69 | 6.13 | 4.92 | 4.49 | 5.35 | | | | |
| NT2RP2002907 | 4.12 | 1.98 | 2.30 | 4.77 | 3.91 | 2.49 | 2.25 | 3.24 | 2.04 | | | | |
| NT2RP2002925 | 3.23 | 2.04 | 2.18 | 4.98 | 4.44 | 5.21 | 3.38 | 2.81 | 4.67 | ** | + | | |
| NT2RP2002927 | 14.45 | 8.55 | 11.84 | 14.25 | 14.86 | 13.10 | 10.66 | 9.50 | 13.04 | | | | |
| NT2RP2002928 | 1.42 | 1.26 | 2.32 | 3.26 | 2.52 | 3.14 | 1.44 | 1.91 | 1.88 | * | + | | |
| NT2RP2002929 | 6.54 | 3.13 | 3.18 | 6.60 | 7.00 | 5.63 | 5.25 | 5.85 | 5.87 | | | | |
| NT2RP2002934 | 5.87 | 2.70 | 3.00 | 3.46 | 2.95 | 4.09 | 3.58 | 3.88 | 3.47 | | | | |
| NT2RP2002939 | 6.87 | 3.02 | 3.14 | 4.78 | 4.45 | 4.28 | 3.95 | 4.36 | 3.63 | | | | |
| NT2RP2002942 | 4.16 | 2.79 | 3.25 | 6.95 | 8.21 | 6.01 | 4.14 | 5.76 | 4.58 | ** | + | | |
| NT2RP2002954 | 3.73 | 2.07 | 3.02 | 3.75 | 4.03 | 3.04 | 2.28 | 3.89 | 5.22 | | | | |
| NT2RP2002959 | 5.43 | 4.36 | 4.62 | 6.19 | 7.91 | 6.08 | 3.63 | 5.75 | 5.03 | * | + | | |
| NT2RP2002974 | 2.77 | 2.53 | 1.82 | 5.32 | 4.88 | 3.20 | 3.66 | 3.70 | 3.24 | * | + | * | + |
| NT2RP2002976 | 1.81 | 1.66 | 2.46 | 4.07 | 3.02 | 2.77 | 2.16 | 2.65 | 2.13 | * | + | | |
| NT2RP2002979 | 10.96 | 6.09 | 6.26 | 13.05 | 14.90 | 10.76 | 8.18 | 9.68 | 7.32 | | | | |
| NT2RP2002980 | 8.71 | 5.49 | 6.33 | 14.65 | 15.05 | 11.66 | 8.24 | 9.16 | 9.26 | ** | + | | |
| NT2RP2002986 | 8.28 | 6.07 | 5.22 | 6.48 | 6.46 | 9.09 | 7.74 | 9.39 | | | | | |
| NT2RP2002987 | 6.13 | 3.28 | 3.28 | 8.77 | 8.51 | 7.89 | 4.85 | 7.00 | 9.15 | * | + | | |
| NT2RP2002988 | 34.52 | 23.01 | 24.20 | 21.24 | 19.88 | 21.98 | 15.82 | 15.65 | 16.56 | | | * | − |
| NT2RP2002993 | 4.35 | 3.19 | 4.08 | 2.57 | 3.44 | 2.83 | 3.21 | 3.84 | 2.8 | | | | |
| NT2RP2003000 | 6.81 | 5.24 | 5.01 | 12.83 | 14.50 | 14.13 | 6.77 | 6.65 | 8.42 | ** | + | | |
| NT2RP2003008 | 3.03 | 1.86 | 2.21 | 2.77 | 3.21 | 3.26 | 2.46 | 3.49 | 5.58 | | | | |
| NT2RP2003020 | 7.91 | 3.15 | 3.03 | 14.51 | 13.63 | 11.55 | 10.67 | 9.71 | 9.8 | ** | + | * | + |
| NT2RP2003032 | 4.25 | 3.36 | 3.04 | 5.65 | 7.30 | 4.26 | 5.14 | 2.86 | 5.02 | | | | |
| NT2RP2003034 | 8.64 | 4.19 | 5.82 | 12.73 | 13.68 | 11.86 | 9.6 | 7.30 | 8.21 | ** | + | | |
| NT2RP1003042 | 3.77 | 2.17 | 2.53 | 3.68 | 4.54 | 3.65 | 3.09 | 3.66 | 3.89 | | | | |
| NT2RP2003050 | 2.09 | 1.93 | 2.12 | 2.58 | 4.04 | 3.16 | 2.04 | 3.12 | 2.84 | * | + | | |
| NT2RP2003060 | 6.89 | 6.04 | 6.20 | 6.11 | 6.61 | 6.02 | 4.64 | 5.08 | 4.58 | | | ** | − |
| NT2RP2003073 | 5.10 | 4.79 | 4.81 | 10.73 | 11.79 | 9.58 | 6.83 | 8.25 | 4.87 | ** | + | | |
| NT2RP2003099 | 3.77 | 3.26 | 2.86 | 5.64 | 6.07 | 7.01 | 4.27 | 4.57 | 5.19 | ** | + | * | + |
| NT2RP2003108 | 3.73 | 1.70 | 0.71 | 4.43 | 4.78 | 3.41 | 2.53 | 3.13 | 3.98 | | | | |
| NT2RP2003115 | 12.63 | 7.03 | 6.49 | 10.94 | 5.30 | 4.75 | 6.51 | 5.99 | 10.91 | | | | |
| NT2RP2003117 | 9.96 | 4.65 | 5.66 | 15.04 | 15.48 | 11.38 | 8.83 | 7.84 | 6.17 | * | + | | |
| NT2RP2003121 | 3.53 | 2.40 | 1.92 | 4.30 | 5.00 | 3.18 | 3.72 | 4.52 | 4.42 | | | * | + |
| NT2RP2003125 | 5.32 | 2.20 | 2.34 | 3.41 | 4.18 | 3.51 | 3.6 | 4.31 | 3.11 | | | | |
| NT2RP2003127 | 3.09 | 3.27 | 3.35 | 3.25 | 3.63 | 2.74 | 2.3 | 4.46 | 3.68 | | | | |

TABLE 249

| | | | | | | | | | | | | | |
|---|---|---|---|---|---|---|---|---|---|---|---|---|---|
| NT2RP2003129 | 3.68 | 2.64 | 1.93 | 5.72 | 5.89 | 5.75 | 3.03 | 4.40 | 2.82 | ** | + | | |
| NT2RP2003137 | 2.40 | 2.79 | 2.71 | 6.74 | 6.38 | 5.76 | 4.22 | 6.41 | 4.31 | ** | + | * | + |
| NT2RP2003138 | 6.42 | 2.67 | 2.97 | 5.99 | 6.92 | 3.98 | 5.12 | 3.06 | 1.92 | | | | |
| NT2RP2003146 | 4.44 | 2.51 | 1.78 | 3.73 | 3.26 | 2.77 | 3.76 | 2.57 | 1.66 | | | | |
| NT2RP2003148 | 9.10 | 6.45 | 5.51 | 11.73 | 13.86 | 11.19 | 8.71 | 8.13 | 7.46 | * | + | | |
| NT2RP2003150 | 3.26 | 2.20 | 1.35 | 8.65 | 2.99 | 4.86 | 3.92 | 2.84 | 8.35 | | | | |
| NT2RP2003157 | 7.49 | 3.86 | 3.67 | 8.41 | 10.43 | 9.55 | 4.96 | 6.45 | 5.87 | * | + | | |
| NT2RP2003158 | 1.98 | 1.89 | 2.17 | 2.26 | 3.00 | 2.46 | 2.43 | 2.76 | 2.85 | | | * | + |
| NT2RP2003161 | 1.04 | 1.33 | 0.76 | 2.12 | 4.38 | 4.18 | 1.59 | 2.84 | 8.91 | * | + | | |
| NT2RP2003164 | 2.83 | 1.78 | 1.70 | 2.90 | 2.78 | 2.57 | 2.53 | 2.97 | 2.44 | | | | |
| NT2RP2003165 | 4.31 | 2.10 | 2.06 | 5.98 | 4.84 | 6.84 | 5.12 | 3.81 | 4.72 | * | + | | |
| NT2RP2003177 | 3.18 | 2.52 | 2.22 | 3.53 | 2.99 | 3.63 | 4.35 | 2.80 | 2.79 | | | | |
| NT2RP2003179 | 4.54 | 3.39 | 3.36 | 5.90 | 7.70 | 7.29 | 4.85 | 4.79 | 6.24 | ** | + | | |
| NT2RP2003194 | 16.94 | 9.59 | 9.74 | 7.86 | 8.77 | 6.84 | 7.23 | 6.50 | 9.93 | | | | |
| NT2RP2003206 | 0.19 | 0.73 | 0.54 | 2.02 | 2.10 | 1.11 | 1.07 | 1.15 | 1.17 | * | + | * | + |
| NT2RP2003210 | 5.52 | 2.50 | 2.65 | 2.94 | 4.61 | 3.60 | 3.44 | 3.99 | 4.15 | | | | |
| NT2RP2003227 | 2.55 | 1.52 | 2.78 | 3.96 | 4.66 | 3.48 | 2.52 | 3.60 | 4.44 | * | + | | |
| NT2RP2003228 | 5.50 | 4.11 | 4.96 | 4.07 | 4.64 | 3.51 | 3.63 | 3.86 | 2.66 | | | | |
| NT2RP2003230 | 1.04 | 1.41 | 1.38 | 3.75 | 3.72 | 3.44 | 8.77 | 4.96 | 7.21 | ** | + | ** | + |
| NT2RP2003231 | 6.83 | 5.52 | 4.87 | 9.61 | 7.64 | 6.47 | 5.75 | 5.89 | 8.09 | | | | |
| NT2RP2003237 | 4.46 | 2.56 | 2.35 | 5.51 | 7.13 | 6.33 | 3.56 | 4.31 | 3.67 | * | + | | |
| NT2RP2003239 | 4.50 | 2.01 | 3.71 | 6.44 | 6.32 | 5.76 | 4.01 | 4.23 | 4.42 | * | + | | |
| NT2RP2003243 | 5.46 | 3.20 | 3.57 | 7.44 | 6.11 | 7.58 | 5.91 | 6.40 | 3.87 | * | + | | |
| NT2RP2003265 | 5.61 | 3.24 | 3.60 | 7.47 | 8.92 | 7.01 | 5.38 | 4.10 | 6.74 | * | + | | |
| NT2RP2003267 | 3.97 | 3.06 | 3.71 | 7.15 | 8.86 | 6.88 | 4.28 | 4.40 | 5.84 | ** | + | | |
| NT2RP2003272 | 5.37 | 3.98 | 5.63 | 6.49 | 6.56 | 6.62 | 7.54 | 6.51 | 7.61 | * | + | * | + |
| NT2RP2003277 | 9.14 | 5.91 | 4.66 | 7.52 | 10.35 | 9.11 | 9.97 | 7.77 | 15.8 | | | | |
| NT2RP2003280 | 3.01 | 2.25 | 1.41 | 4.02 | 6.71 | 7.68 | 6.13 | 4.20 | 7.59 | * | + | * | + |
| NT2RP2003286 | 3.53 | 1.84 | 2.37 | 2.62 | 3.15 | 2.83 | 2.96 | 2.70 | 4.01 | | | | |
| NT2RP2003293 | 6.85 | 4.64 | 6.03 | 12.22 | 12.54 | 11.97 | 6.66 | 5.15 | 8.8 | ** | + | | |
| NT2RP2003295 | 4.81 | 3.25 | 3.18 | 3.96 | 8.36 | 5.27 | 4.16 | 4.98 | 3 | | | | |
| NT2RP2003297 | 1.97 | 1.06 | 1.42 | 2.82 | 3.09 | 2.49 | 1.97 | 1.89 | 1.68 | | + | | |
| NT2RP2003300 | 5.99 | 4.89 | 4.68 | 7.75 | 7.40 | 7.47 | 7.28 | 9.19 | 9.08 | ** | + | * | + |
| NT2RP2003302 | 4.65 | 3.24 | 4.39 | 8.90 | 10.20 | 7.29 | 4.36 | 7.27 | 5.11 | ** | + | | |

TABLE 249-continued

| | | | | | | | | | | | | |
|---|---|---|---|---|---|---|---|---|---|---|---|---|
| NT2RP2003307 | 1.67 | 1.09 | 0.57 | 2.24 | 1.67 | 2.40 | 2.82 | 1.84 | 1.76 | | | |
| NT2RP2003308 | 3.09 | 2.17 | 1.85 | 4.09 | 5.19 | 2.83 | 3.04 | 2.74 | 3.16 | | | |
| NT2RP2003311 | 6.85 | 3.58 | 2.13 | 4.65 | 6.66 | 4.36 | 3.88 | 3.65 | 4.23 | | | |
| NT2RP2003329 | 3.07 | 1.86 | 1.87 | 3.19 | 5.07 | 3.49 | 3.77 | 3.82 | 5.96 | | | |
| NT2RP2003339 | 2.38 | 1.55 | 1.29 | 2.90 | 3.98 | 3.91 | 2.69 | 3.47 | 2.24 | * | + | |
| NT2RP2003345 | 1.83 | 1.44 | 1.40 | 1.51 | 1.52 | 1.92 | 2.28 | 2.65 | 1.28 | | | |
| NT2RP2003347 | 1.48 | 2.10 | 1.67 | 2.03 | 5.75 | 1.76 | 2.44 | 3.10 | 4.09 | | | * | + |
| NT2RP2003367 | 1.26 | 0.98 | 1.42 | 1.39 | 1.59 | 1.55 | 1.21 | 2.14 | 1.04 | | | |
| NT2RP2003369 | 3.82 | 2.31 | 1.37 | 1.62 | 2.10 | 1.87 | 3.19 | 2.85 | 1.99 | | | |
| NT2RP2003383 | 7.18 | 3.57 | 4.41 | 16.30 | 14.96 | 15.98 | 8.79 | 9.62 | 11.29 | ** | + | * | + |
| NT2RP2003390 | 9.92 | 6.14 | 6.73 | 11.71 | 12.19 | 9.52 | 7.92 | 9.43 | 8.34 | | | |
| NT2RP2003391 | 35.23 | 21.64 | 23.50 | 36.95 | 36.23 | 27.51 | 23.69 | 17.29 | 17.85 | | | |
| NT2RP2003393 | 2.40 | 1.57 | 1.83 | 4.13 | 5.18 | 3.56 | 3.96 | 4.34 | 3.87 | * | + | ** | + |
| NT2RP2003394 | 4.02 | 2.41 | 2.76 | 12.16 | 9.99 | 10.68 | 6.12 | 6.15 | 3.96 | ** | + | |
| NT2RP2003401 | 2.33 | 1.80 | 1.86 | 3.02 | 4.68 | 2.41 | 3.02 | 4.51 | 3.57 | | | * | + |
| NT2RP2003403 | 1.23 | 1.40 | 1.41 | 3.20 | 3.23 | 4.51 | 3.04 | 3.80 | 3.41 | ** | + | ** | + |
| NT2RP2003433 | 8.96 | 4.52 | 3.52 | 6.71 | 5.66 | 5.39 | 7.4 | 6.01 | 5.01 | | | |
| NT2RP2003445 | 3.20 | 3.09 | 2.41 | 6.94 | 6.16 | 6.94 | 13.01 | 11.43 | 14.04 | ** | + | ** | + |
| NT2RP2003446 | 5.05 | 4.02 | 2.72 | 4.09 | 6.31 | 3.82 | 5.45 | 4.95 | 5.35 | | | |
| NT2RP2003456 | 4.21 | 2.96 | 2.69 | 10.80 | 8.14 | 8.43 | 6.15 | 5.44 | 4.71 | ** | + | * | + |
| NT2RP2003466 | 5.26 | 3.68 | 3.82 | 5.95 | 5.44 | 4.60 | 3.82 | 5.23 | 9 | | | |
| NT2RP2003469 | 1.53 | 2.12 | 2.45 | 3.89 | 4.69 | 5.28 | 2.75 | 4.01 | 3.09 | * | + | |

TABLE 250

| | | | | | | | | | | | | |
|---|---|---|---|---|---|---|---|---|---|---|---|---|
| NT2RP2003470 | 11.59 | 7.42 | 9.22 | 28.44 | 23.50 | 24.05 | 11.29 | 12.07 | 8.19 | ** | + | |
| NT2RP2003471 | 0.69 | 0.28 | 0.53 | 1.86 | 1.08 | 1.71 | 2.23 | 2.31 | 0.86 | * | + | |
| NT2RP2003480 | 15.63 | 7.31 | 7.47 | 13.91 | 14.92 | 13.14 | 9.58 | 7.59 | 11 | | | |
| NT2RP2003495 | 6.78 | 5.33 | 4.65 | 5.96 | 5.20 | 6.08 | 4.27 | 5.58 | 4.14 | | | |
| NT2RP2003499 | 3.16 | 1.30 | 1.31 | 2.42 | 1.62 | 2.16 | 3.79 | 4.26 | 2.53 | | | |
| NT2RP2003505 | 2.95 | 2.52 | 1.64 | 4.06 | 3.25 | 3.65 | 2.65 | 3.70 | 2.81 | * | + | |
| NT2RP2003506 | 4.36 | 2.44 | 2.89 | 4.61 | 6.57 | 3.32 | 3.86 | 4.37 | 5.74 | | | |
| NT2RP2003511 | 5.80 | 4.98 | 5.36 | 9.63 | 8.04 | 5.73 | 6.43 | 6.77 | 8.36 | | | * | + |
| NT2RP2003513 | 3.23 | 2.52 | 3.10 | 3.94 | 3.00 | 3.76 | 2.27 | 3.48 | 3.18 | | | |
| NT2RP2003517 | 1.52 | 0.95 | 2.01 | 2.87 | 2.13 | 1.37 | 2.66 | 3.16 | 3.17 | | | * | + |
| NT2RP2003522 | 21.16 | 8.31 | 12.55 | 21.51 | 17.78 | 15.40 | 9.2 | 5.69 | 8.01 | | | |
| NT2RP2003525 | 6.58 | 6.05 | 5.00 | 12.44 | 12.64 | 12.83 | 8.86 | 7.54 | 7.95 | ** | + | * | + |
| NT2RP2003533 | 7.73 | 4.59 | 4.51 | 11.94 | 12.52 | 10.34 | 6.62 | 8.25 | 8.72 | ** | + | |
| NT2RP2003541 | 9.89 | 7.73 | 6.72 | 8.34 | 7.49 | 6.40 | 6.78 | 6.83 | 5.85 | | | |
| NT2RP2003543 | 4.46 | 3.26 | 2.49 | 5.01 | 7.76 | 4.19 | 6.57 | 7.85 | 7.39 | | | ** | + |
| NT2RP2003545 | 6.37 | 3.24 | 4.48 | 2.58 | 2.60 | 1.05 | 1.96 | 3.63 | 2.3 | | | |
| NT2RP2003559 | 1.78 | 1.16 | 2.25 | 3.59 | 3.08 | 3.14 | 2.24 | 2.88 | 3.16 | * | + | |
| NT2RP2003564 | 1.65 | 1.70 | 1.81 | 2.44 | 3.74 | 2.88 | 2.97 | 3.23 | 1.66 | * | + | |
| NT2RP2003565 | 9.14 | 3.08 | 4.12 | 8.63 | 10.17 | 6.24 | 4.03 | 4.24 | 3.56 | | | |
| NT2RP2003567 | 7.44 | 5.21 | 4.96 | 7.20 | 9.00 | 7.04 | 7.75 | 6.53 | 4.86 | | | |
| NT2RP2003575 | 5.24 | 1.86 | 2.00 | 2.78 | 2.67 | 1.70 | 1.73 | 2.24 | 4.67 | | | |
| NT2RP2003576 | 208.36 | 132.21 | 112.56 | 100.63 | 118.10 | 86.36 | 71.48 | 50.82 | 50.69 | | | * | − |
| NT2RP2003579 | 56.28 | 38.17 | 48.67 | 28.49 | 15.58 | 24.16 | 19.34 | 17.93 | 21.34 | * | − | ** | − |
| NT2RP2003581 | 4.71 | 3.22 | 3.45 | 3.09 | 5.04 | 4.47 | 3.46 | 3.82 | 4.77 | | | |
| NT2RP2003587 | 8.55 | 4.99 | 7.99 | 8.79 | 9.50 | 8.44 | 7.38 | 8.78 | 13.4 | | | |
| NT2RP2003590 | 11.27 | 7.70 | 8.07 | 4.15 | 4.86 | 4.77 | 3.73 | 6.36 | 4.84 | * | − | * | − |
| NT2RP2003593 | 9.63 | 4.82 | 5.47 | 13.80 | 9.75 | 5.79 | 6.89 | 8.08 | 6.91 | | | |
| NT2RP2003596 | 3.20 | 2.89 | 2.89 | 6.00 | 8.78 | 7.99 | 4.62 | 4.90 | 7.08 | ** | + | * | + |
| NT2RP2003599 | 8.81 | 5.81 | 5.81 | 8.37 | 10.49 | 10.48 | 10.61 | 8.00 | 12.61 | | | |
| NT2RP2003600 | 3.15 | 1.54 | 2.36 | 3.63 | 5.05 | 4.21 | 2.91 | 3.54 | 3.28 | * | + | |
| NT2RP2003604 | 8.61 | 4.63 | 5.27 | 5.66 | 7.11 | 7.00 | 5.84 | 5.70 | 5.33 | | | |
| NT2RP2003629 | 0.93 | 0.41 | 0.97 | 1.80 | 1.56 | 1.57 | 0.76 | 2.29 | 1.4 | * | + | |
| NT2RP2003630 | 3.31 | 2.56 | 2.95 | 6.23 | 8.50 | 6.34 | 5.52 | 5.72 | 4.54 | ** | + | ** | + |
| NT2RP2003643 | 16.50 | 10.48 | 12.66 | 12.59 | 15.91 | 12.75 | 9.42 | 11.38 | 10.03 | | | |
| NT2RP2003655 | 4.54 | 2.17 | 1.95 | 4.91 | 4.47 | 3.19 | 4.31 | 4.99 | 6.38 | | | |
| NT2RP2003664 | 7.29 | 4.58 | 3.44 | 9.78 | 13.11 | 10.33 | 7.53 | 12.65 | 18.19 | * | + | |
| NT2RP2003668 | 7.64 | 3.93 | 2.99 | 7.77 | 11.11 | 7.27 | 3.61 | 4.49 | 4.92 | | | |
| NT2RP2003687 | 3.50 | 2.00 | 2.53 | 2.44 | 3.28 | 2.52 | 1.34 | 3.20 | 1.86 | | | |
| NT2RP2003691 | 3.51 | 2.23 | 2.36 | 4.83 | 5.26 | 4.14 | 2.6 | 3.93 | 3.34 | * | + | |
| NT2RP2003702 | 4.72 | 3.23 | 2.91 | 5.75 | 5.42 | 5.03 | 3.29 | 5.65 | 2.48 | * | + | |
| NT2RP2003704 | 3.03 | 1.02 | 1.33 | 3.00 | 4.19 | 2.96 | 1.48 | 4.19 | 2.8 | | | |
| NT2RP2003706 | 0.54 | 0.54 | 0.40 | 1.92 | 1.23 | 0.53 | 1.37 | 2.50 | 2.1 | | | * | + |
| NT2RP2003713 | 3.77 | 2.04 | 1.68 | 4.89 | 3.40 | 3.69 | 3.54 | 1.79 | 2.29 | | | |
| NT2RP2003714 | 16.93 | 11.05 | 8.85 | 15.34 | 13.25 | 10.73 | 6.94 | 5.43 | 4.92 | | | |
| NT2RP2003727 | 9.17 | 5.59 | 4.98 | 8.92 | 8.98 | 7.11 | 5.82 | 4.15 | 6.45 | | | |
| NT2RP2003737 | 4.49 | 2.62 | 2.06 | 3.80 | 4.50 | 3.26 | 2.92 | 3.29 | 5.35 | | | |
| NT2RP2003751 | 0.82 | 0.97 | 1.07 | 1.33 | 1.62 | 0.98 | 1.33 | 0.88 | 0.72 | | | |
| NT2RP2003760 | 3.61 | 2.60 | 1.42 | 4.28 | 5.22 | 4.19 | 4.75 | 3.97 | 7.45 | * | + | |
| NT2RP2003764 | 4.43 | 3.65 | 3.32 | 3.81 | 3.64 | 3.20 | 3.86 | 3.12 | 8.26 | | | |
| NT2RP2003769 | 3.03 | 1.62 | 1.45 | 3.28 | 5.14 | 3.51 | 3.96 | 2.62 | 2.26 | | | |
| NT2RP2003770 | 11.88 | 6.14 | 5.72 | 10.96 | 9.10 | 9.34 | 9.86 | 5.90 | 7.19 | | | |

TABLE 250-continued

| | | | | | | | | | | |
|---|---|---|---|---|---|---|---|---|---|---|
| NT2RP2003777 | 8.28 | 5.95 | 4.45 | 12.14 | 8.07 | 7.31 | 6.16 | 4.05 | 5.91 | | |
| NT2RP2003781 | 6.93 | 4.17 | 4.88 | 6.60 | 9.83 | 10.25 | 6.27 | 5.64 | 6.39 | | |
| NT2RP2003785 | 5.07 | 3.24 | 3.30 | 5.65 | 5.69 | 5.57 | 6.33 | 7.73 | 14.42 | * | + |
| NT2RP2003793 | 9.26 | 6.02 | 4.92 | 6.26 | 7.16 | 5.41 | 4.28 | 4.76 | 5.16 | | |
| NT2RP2003806 | 6.44 | 4.78 | 6.02 | 12.68 | 12.04 | 12.13 | 5.52 | 7.88 | 5.99 | ** | + |

TABLE 251

| | | | | | | | | | | | | | |
|---|---|---|---|---|---|---|---|---|---|---|---|---|---|
| NT2RP2003825 | 9.16 | 5.63 | 6.57 | 17.27 | 18.54 | 12.04 | 6.67 | 8.08 | 14.03 | * | + | | |
| N12RP2003840 | 10.64 | 4.89 | 5.66 | 8.31 | 7.78 | 5.93 | 7.12 | 5.91 | 8.06 | | | | |
| NT2RP2003857 | 12.72 | 6.86 | 6.25 | 8.31 | 8.84 | 9.18 | 7.95 | 6.05 | 8.74 | | | | |
| NT2RP2003859 | 6.93 | 3.73 | 2.73 | 12.12 | 10.40 | 13.45 | 5.71 | 3.90 | 6.36 | ** | + | | |
| NT2RP2003871 | 3.42 | 3.01 | 2.13 | 9.67 | 10.18 | 8.65 | 5.24 | 4.53 | 5.97 | ** | + | * | + |
| NT2RP2003876 | 7.74 | 4.51 | 4.43 | 5.67 | 8.07 | 7.43 | 4.37 | 5.53 | 5.6 | | | | |
| NT2RP2003878 | 4.47 | 2.22 | 2.10 | 3.89 | 4.71 | 3.64 | 3.95 | 3.56 | 4.06 | | | | |
| NT2RP2003885 | 5.69 | 2.59 | 2.76 | 3.73 | 7.92 | 5.39 | 4.25 | 4.87 | 6.01 | | | | |
| NT2RP2003898 | 10.09 | 7.67 | 7.33 | 11.75 | 12.18 | 9.75 | 5.01 | 8.03 | 5.65 | | | | |
| NT2RP2003902 | 10.41 | 8.37 | 6.78 | 8.14 | 9.71 | 9.88 | 7.68 | 5.42 | 8.06 | | | | |
| NT2RP2003912 | 13.81 | 9.98 | 7.42 | 16.63 | 17.90 | 13.52 | 10.9 | 14.66 | 13.18 | | | | |
| NT2RP2003931 | 3.74 | 1.68 | 1.44 | 2.28 | 2.88 | 2.54 | 2.24 | 1.94 | 2.65 | | | | |
| NT2RP2003940 | 18.24 | 10.75 | 11.51 | 44.72 | 39.79 | 24.81 | 16 | 14.58 | 19.02 | * | + | | |
| NT2RP2003950 | 3.98 | 2.45 | 3.31 | 3.52 | 4.06 | 3.60 | 3 | 3.05 | 3.52 | | | | |
| NT2RP2003952 | 5.00 | 3.18 | 4.24 | 4.00 | 4.74 | 3.20 | 2.55 | 2.62 | 4.33 | | | | |
| NT2RP2003968 | 13.52 | 6.81 | 6.24 | 9.83 | 14.58 | 9.98 | 4.25 | 4.49 | 10.21 | | | | |
| NT2RP2003976 | 5.76 | 3.40 | 2.77 | 10.86 | 15.30 | 22.19 | 5.6 | 7.99 | 7.6 | * | + | | |
| NT2RP2003981 | 5.81 | 3.89 | 2.20 | 4.65 | 4.94 | 4.43 | 4.88 | 3.67 | 4.28 | | | | |
| NT2RP2003984 | 11.22 | 7.15 | 6.30 | 8.47 | 13.43 | 9.96 | 9.18 | 9.47 | 16.24 | | | | |
| NT2RP2003986 | 11.50 | 5.47 | 4.61 | 14.29 | 15.56 | 15.24 | 7.95 | 7.99 | 8.32 | * | + | | |
| NT2RP2003988 | 5.84 | 4.44 | 3.08 | 11.21 | 13.07 | 8.96 | 7.35 | 4.72 | 6.91 | ** | + | | |
| NT2RP2004013 | 19.46 | 11.40 | 12.00 | 20.33 | 26.92 | 19.32 | 8.59 | 11.59 | 12.13 | | | | |
| NT2RP2004014 | 5.88 | 5.77 | 8.06 | 11.00 | 14.73 | 13.84 | 6.02 | 5.49 | 4.74 | ** | + | | |
| NT2RP2004036 | 4.76 | 2.41 | 3.64 | 4.63 | 4.19 | 5.70 | 3.7 | 3.95 | 3.26 | | | | |
| NT2RP2004041 | 2.79 | 3.61 | 3.30 | 4.01 | 6.06 | 4.15 | 3.2 | 4.29 | 4.43 | | | | |
| NT2RP2004042 | 4.23 | 3.45 | 2.82 | 4.59 | 3.59 | 5.00 | 3.97 | 2.94 | 3.64 | | | | |
| NT2RP2004049 | 5.52 | 3.09 | 3.20 | 5.68 | 4.82 | 4.18 | 3.14 | 3.78 | 3.4 | | | | |
| NT2RP2004060 | 6.54 | 4.19 | 4.75 | 5.31 | 7.44 | 5.90 | 6.84 | 5.31 | 6.57 | | | | |
| NT2RP2004066 | 7.62 | 3.57 | 3.11 | 8.07 | 8.17 | 6.09 | 3.54 | 4.23 | 4.08 | | | | |
| NT2RP2004069 | 2.46 | 2.35 | 2.84 | 3.73 | 4.30 | 3.52 | 3.02 | 4.14 | 4.07 | ** | + | * | + |
| NT2RP2004076 | 1.40 | 1.15 | 1.26 | 2.49 | 2.65 | 1.93 | 1.27 | 2.46 | 1.33 | ** | + | | |
| NT2RP2004080 | 2.70 | 2.23 | 2.55 | 3.88 | 5.93 | 4.96 | 4.18 | 5.58 | 4.25 | * | + | * | + |
| NT2RP2004081 | 2.74 | 2.99 | 2.36 | 3.72 | 4.51 | 3.72 | 1.45 | 3.28 | 1.61 | * | + | | |
| NT2RP2004098 | 10.83 | 5.42 | 4.87 | 10.62 | 9.37 | 7.52 | 6.04 | 4.69 | 6.05 | | | | |
| NT2RP2004108 | 15.24 | 8.74 | 6.82 | 24.00 | 21.97 | 22.21 | 10.22 | 12.30 | 14.43 | ** | + | | |
| NT2RP2004124 | 5.29 | 4.13 | 3.63 | 5.87 | 5.42 | 5.25 | 4.18 | 2.84 | 4.23 | | | | |
| NT2RP2004130 | 9.77 | 7.17 | 7.05 | 9.85 | 13.14 | 10.78 | 12.57 | 13.32 | 11.04 | | | * | + |
| NT2RP2004133 | 11.24 | 7.82 | 7.31 | 10.46 | 12.30 | 8.54 | 8.71 | 9.42 | 8.83 | | | | |
| NT2RP2004141 | 4.33 | 2.78 | 3.55 | 5.05 | 6.27 | 4.10 | 3.83 | 4.25 | 5.14 | | | | |
| NT2RP2004142 | 3.53 | 1.25 | 3.26 | 3.70 | 5.10 | 5.11 | 2.84 | 4.94 | 3.66 | | | | |
| NT2RP2004152 | 2.68 | 1.78 | 2.43 | 4.24 | 5.04 | 5.23 | 2.05 | 2.34 | 1.5 | ** | + | | |
| NT2RP2004165 | 21.03 | 8.19 | 8.39 | 7.87 | 8.05 | 7.98 | 5.38 | 6.52 | 6.22 | | | | |
| NT2RP2004170 | 7.13 | 4.37 | 2.78 | 6.23 | 7.89 | 6.07 | 5.24 | 5.06 | 3.73 | | | | |
| NT2RP2004172 | 3.69 | 2.25 | 1.50 | 2.50 | 3.71 | 2.71 | 2.83 | 3.52 | 1.97 | | | | |
| NT2RP2004176 | 7.84 | 4.13 | 3.67 | 5.48 | 5.12 | 4.33 | 5.56 | 7.38 | 6.12 | | | | |
| NT2RP2004179 | 6.87 | 2.52 | 2.41 | 5.35 | 4.30 | 3.84 | 3.98 | 4.72 | 4.2 | | | | |
| NT2RP2004187 | 3.69 | 2.64 | 1.86 | 5.62 | 6.94 | 5.86 | 3.38 | 4.90 | 4.03 | ** | + | | |
| NT2RP2004190 | 2.07 | 2.03 | 2.45 | 3.29 | 3.28 | 2.78 | 5.06 | 5.55 | 4.18 | * | + | ** | + |
| NT2RP2004194 | 6.67 | 3.78 | 5.18 | 7.29 | 8.60 | 7.46 | 5.61 | 6.42 | 7 | | | | |
| NT2RP2004196 | 20.28 | 5.85 | 8.55 | 16.34 | 14.05 | 15.75 | 7.78 | 7.99 | 8.4 | | | | |
| NT2RP2004205 | 10.63 | 6.42 | 6.10 | 11.21 | 13.23 | 11.22 | 6.53 | 6.15 | 7.63 | | | | |
| NT2RP2004207 | 4.42 | 3.24 | 2.70 | 3.44 | 4.24 | 3.84 | 3.13 | 3.26 | 3.82 | | | | |
| NT2RP2004226 | 4.97 | 4.89 | 4.35 | 4.76 | 5.20 | 4.65 | 3.73 | 3.67 | 3.35 | | | ** | − |
| NT2RP2004232 | 2.49 | 1.77 | 2.98 | 3.76 | 4.69 | 3.30 | 2.85 | 3.10 | 2.15 | * | + | | |
| NT2RP2004239 | 4.49 | 3.56 | 3.79 | 6.17 | 7.37 | 6.14 | 4.15 | 5.46 | 4.58 | ** | + | | |
| NT2RP2004240 | 6.30 | 3.45 | 4.77 | 13.34 | 11.74 | 9.18 | 6.02 | 6.36 | 6.66 | * | + | | |

TABLE 252

| | | | | | | | | | | | |
|---|---|---|---|---|---|---|---|---|---|---|---|
| NT2RP2004242 | 4.01 | 3.66 | 4.18 | 4.80 | 6.97 | 3.56 | 2.91 | 4.22 | 3.72 | | |
| NT2RP2004245 | 4.75 | 2.29 | 3.26 | 4.55 | 5.39 | 2.63 | 3.01 | 2.48 | 2.79 | | |
| NT2RP2004270 | 18.23 | 8.30 | 7.67 | 19.68 | 17.41 | 13.31 | 11.69 | 12.72 | 8.05 | | |
| NT2RP2004300 | 3.69 | 2.58 | 2.90 | 3.43 | 6.04 | 3.65 | 2.47 | 3.40 | 4.86 | | |
| NT2RP2004304 | 6.67 | 2.88 | 6.27 | 10.77 | 12.81 | 11.19 | 6.73 | 6.65 | 7.62 | ** | + |
| NT2RP2004313 | 3.69 | 3.44 | 2.33 | 4.32 | 4.99 | 4.51 | 2.56 | 4.15 | 4.27 | * | + |
| NT2RP2004316 | 4.16 | 1.43 | 2.32 | 4.51 | 4.31 | 4.04 | 2.43 | 3.50 | 4.17 | | |

TABLE 252-continued

| | | | | | | | | | | | | |
|---|---|---|---|---|---|---|---|---|---|---|---|---|
| NT2RP2004321 | 15.92 | 11.27 | 11.28 | 36.60 | 56.46 | 33.80 | 10.57 | 12.49 | 9.91 | * | + | |
| NT2RP2004336 | 2.22 | 1.97 | 1.95 | 1.98 | 2.72 | 1.41 | 1.95 | 2.65 | 2.2 | | | |
| NT2RP2004339 | 18.02 | 10.18 | 7.42 | 25.42 | 25.92 | 20.21 | 14.54 | 10.64 | 9.51 | * | + | |
| NT2RP2004347 | 6.36 | 3.28 | 2.51 | 3.98 | 5.62 | 3.33 | 2.91 | 2.22 | 3.77 | | | |
| NT2RP2004364 | 7.25 | 3.84 | 3.16 | 7.45 | 10.83 | 6.50 | 5.33 | 5.38 | 5.14 | | | |
| NT2RP2004365 | 3.92 | 1.67 | 1.92 | 3.47 | 3.94 | 3.44 | 1.64 | 2.60 | 3.66 | | | |
| NT2RP2004366 | 3.77 | 1.94 | 2.27 | 3.01 | 4.43 | 2.63 | 2.6 | 3.92 | 2.96 | | | |
| NT2RP2004373 | 2.38 | 2.55 | 1.79 | 5.73 | 5.73 | 2.95 | 2.28 | 3.83 | 3.83 | | | |
| NT2RP2004375 | 14.49 | 9.73 | 10.51 | 9.34 | 13.60 | 9.23 | 5.43 | 7.02 | 8.38 | | | |
| NT2RP2004389 | 6.54 | 5.30 | 4.58 | 4.64 | 5.83 | 5.40 | 4.4 | 4.73 | 4.62 | | | |
| NT2RP2004392 | 28.46 | 15.89 | 13.93 | 32.21 | 29.99 | 20.99 | 14.28 | 13.07 | 11.38 | | | |
| NT2RP2004396 | 12.58 | 7.77 | 8.62 | 10.01 | 8.33 | 7.76 | 2.74 | 2.93 | 6 | * | − | |
| NT2RP2004399 | 7.37 | 3.73 | 4.44 | 6.18 | 6.63 | 5.28 | 3.66 | 5.23 | 7.06 | | | |
| NT2RP2004400 | 3.45 | 1.87 | 1.89 | 5.43 | 5.79 | 4.47 | 2.84 | 3.98 | 3.76 | * | + | |
| NT2RP2004404 | 11.50 | 7.62 | 6.89 | 11.66 | 13.80 | 10.35 | 8.27 | 8.35 | 9.19 | | | |
| NT2RP2004410 | 11.23 | 11.38 | 11.20 | 17.64 | 15.77 | 17.12 | 11.2 | 18.45 | 13.95 | ** | + | |
| NT2RP2004412 | 4.89 | 2.82 | 3.13 | 4.05 | 4.86 | 3.06 | 2.32 | 3.89 | 3.43 | | | |
| NT2RP2004414 | 6.08 | 2.18 | 5.00 | 3.14 | 3.56 | 2.80 | 1.59 | 3.95 | 2.41 | | | |
| NT2RP2004425 | 2.01 | 1.60 | 1.70 | 2.43 | 4.37 | 2.34 | 2.53 | 1.37 | 3.45 | | | |
| NT2RP2004447 | 3.57 | 2.63 | 1.82 | 4.60 | 4.54 | 3.34 | 3.94 | 3.07 | 2.46 | | | |
| NT2RP2004463 | 11.21 | 7.40 | 6.24 | 12.62 | 8.89 | 9.28 | 9.29 | 8.97 | 10.07 | | | |
| NT2RP2004476 | 4.90 | 3.15 | 2.20 | 5.47 | 5.87 | 6.15 | 2.61 | 3.85 | 5.36 | * | + | |
| NT2RP2004488 | 5.90 | 4.58 | 3.55 | 4.28 | 5.12 | 3.55 | 2.91 | 3.17 | 2.6 | | | |
| NT2RP2004490 | 4.32 | 3.15 | 2.55 | 3.51 | 4.12 | 4.44 | 2.62 | 3.95 | 8.62 | | | |
| NT2RP2004495 | 12.24 | 5.83 | 8.88 | 11.24 | 10.73 | 8.49 | 9.47 | 11.08 | 18.95 | | | |
| NT2RP2004512 | 5.33 | 2.48 | 2.45 | 3.28 | 4.26 | 3.70 | 3.48 | 2.44 | 3.06 | | | |
| NT2RP2004523 | 10.16 | 5.01 | 3.79 | 10.11 | 8.70 | 10.80 | 6.51 | 6.83 | 6.35 | | | |
| NT2RP2004524 | 3.86 | 3.51 | 2.47 | 5.08 | 4.81 | 4.16 | 5.08 | 3.55 | 3.98 | * | + | |
| NT2RP2004536 | 11.38 | 9.71 | 7.82 | 9.14 | 12.16 | 9.03 | 6.49 | 7.82 | 9.84 | | | |
| NT2RP2004538 | 38.06 | 30.58 | 30.32 | 62.14 | 68.91 | 71.97 | 40.07 | 32.51 | 41.6 | ** | + | |
| NT2RP2004548 | 5.50 | 4.46 | 3.74 | 10.83 | 12.12 | 12.54 | 4.81 | 5.53 | 8.83 | ** | + | |
| NT2RP2004551 | 3.34 | 1.83 | 3.26 | 4.96 | 5.20 | 3.92 | 2.98 | 2.39 | 13.41 | * | + | |
| NT2RP2004556 | 8.58 | 7.04 | 6.71 | 15.74 | 11.77 | 13.75 | 8.42 | 10.11 | 9.77 | ** | + | |
| NT2RP2004568 | 19.23 | 11.22 | 8.88 | 15.82 | 10.64 | 12.31 | 13.87 | 9.13 | 9.97 | | | |
| NT2RP2004580 | 7.17 | 4.71 | 2.64 | 11.67 | 9.76 | 7.99 | 7.1 | 5.36 | 6.59 | * | + | |
| NT2RP2004585 | 10.92 | 6.41 | 6.18 | 10.89 | 10.92 | 9.49 | 8.51 | 7.18 | 15.75 | | | |
| NT2RP2004587 | 2.30 | 1.65 | 0.84 | 2.47 | 1.80 | 1.78 | 1.76 | 1.48 | 2.46 | | | |
| NT2RP2004594 | 5.87 | 5.87 | 4.84 | 5.34 | 8.13 | 4.27 | 3.88 | 5.17 | 7.53 | | | |
| NT2RP2004600 | 1.88 | 2.05 | 1.13 | 2.29 | 2.11 | 2.15 | 1.86 | 2.50 | 1.01 | | | |
| NT2RP2004602 | 4.95 | 4.31 | 4.04 | 9.75 | 8.80 | 8.23 | 5.05 | 5.03 | 6.56 | ** | + | |
| NT2RP2004606 | 11.77 | 11.03 | 6.62 | 13.49 | 15.68 | 9.80 | 18.35 | 17.80 | 17.2 | | ** | + |
| NT2RP2004614 | 7.71 | 4.83 | 3.32 | 3.55 | 3.54 | 4.41 | 5.21 | 3.79 | 4.38 | | | |
| NT2RP2004648 | 6.00 | 3.54 | 2.10 | 4.35 | 4.65 | 3.29 | 4.52 | 3.41 | 7.33 | | | |
| NT2RP2004655 | 13.74 | 9.02 | 8.53 | 4.81 | 7.79 | 4.98 | 3.5 | 4.03 | 6.04 | * | − | |
| NT2RP2004664 | 6.11 | 4.51 | 4.83 | 11.64 | 9.59 | 6.61 | 6.34 | 6.03 | 5.86 | | | |
| NT2RP2004670 | 3.00 | 2.33 | 2.81 | 3.65 | 3.96 | 4.05 | 3.26 | 3.38 | 4.44 | ** | + | |
| NT2RP2004675 | 5.69 | 3.74 | 5.15 | 11.28 | 11.28 | 10.21 | 5.45 | 4.84 | 5.26 | | | |
| NT2RP2004681 | 5.04 | 3.65 | 4.78 | 6.53 | 9.83 | 7.35 | 6.37 | 6.72 | 6.63 | * | + | ** | + |
| NT2RP2004689 | 2.24 | 1.16 | 1.68 | 3.06 | 4.60 | 6.68 | 1.3 | 2.45 | 1.72 | * | + | |

TABLE 253

| | | | | | | | | | | | | | |
|---|---|---|---|---|---|---|---|---|---|---|---|---|---|
| NT2RP2004709 | 5.18 | 3.25 | 1.93 | 12.66 | 12.56 | 10.94 | 5.12 | 4.16 | 3.85 | ** | + | | |
| NT2RP2004710 | 5.83 | 4.70 | 2.80 | 7.69 | 7.61 | 6.76 | 4.34 | 3.44 | 4.54 | * | + | | |
| NT2RP2004721 | 11.13 | 7.44 | 7.40 | 6.68 | 9.65 | 8.99 | 11.35 | 9.52 | 13.55 | | | | |
| NT2RP2004736 | 6.31 | 5.30 | 5.26 | 8.14 | 9.36 | 7.77 | 6.53 | 5.39 | 5.85 | ** | + | | |
| NT2RP2004743 | 2.77 | 1.82 | 1.65 | 5.65 | 6.03 | 4.15 | 4.87 | 6.71 | 5.76 | ** | + | ** | + |
| NT2RP2004750 | 8.14 | 5.64 | 6.27 | 13.53 | 14.23 | 13.30 | 8.05 | 8.74 | 9.81 | ** | + | | |
| NT2RP2004755 | 11.30 | 7.99 | 8.26 | 16.42 | 20.16 | 17.92 | 10.59 | 13.63 | 13.47 | ** | + | | |
| NT2RP2004767 | 6.21 | 2.89 | 4.95 | 9.44 | 8.05 | 8.14 | 4.7 | 6.19 | 4.36 | * | + | | |
| NT2RP2004768 | 9.61 | 3.95 | 2.60 | 2.99 | 2.03 | 1.57 | 2.24 | 1.57 | 1.49 | | | | |
| NT2RP2004775 | 2.25 | 2.07 | 1.48 | 4.36 | 5.01 | 5.07 | 4.16 | 3.75 | 3.44 | ** | + | ** | + |
| NT2RP2004791 | 14.05 | 7.61 | 6.73 | 8.91 | 10.03 | 9.17 | 7.11 | 6.72 | 8.15 | | | | |
| NT2RP2004794 | 41.53 | 28.26 | 27.09 | 43.02 | 36.69 | 32.68 | 39.95 | 33.86 | 41.52 | | | | |
| NT2RP2004795 | 3.77 | 2.11 | 2.19 | 3.89 | 7.37 | 3.74 | 3.78 | 5.26 | 5.25 | | * | + | |
| NT2RP2004799 | 5.43 | 1.93 | 3.24 | 6.30 | 6.15 | 4.50 | 3.93 | 5.78 | 3.84 | | | | |
| NT2RP2004802 | 4.83 | 2.53 | 3.34 | 7.41 | 6.03 | 5.58 | 2.16 | 3.27 | 3.61 | * | + | | |
| NT2RP2004810 | 3.12 | 1.86 | 2.24 | 8.72 | 9.56 | 6.30 | 5.77 | 5.46 | 6.09 | ** | + | ** | + |
| NT2RP2004816 | 4.85 | 3.14 | 2.65 | 6.62 | 9.96 | 5.26 | 6.09 | 3.65 | 4.78 | | | | |
| NT2RP2004837 | 13.44 | 8.28 | 7.12 | 11.51 | 16.25 | 16.53 | 19.77 | 16.72 | 17.56 | | * | + | |
| NT2RP2004841 | 2.64 | 1.81 | 1.21 | 3.03 | 4.37 | 3.11 | 1.94 | 3.01 | 1.95 | | | | |
| NT2RP2004847 | 16.48 | 11.83 | 12.45 | 15.24 | 18.08 | 16.57 | 16.4 | 14.80 | 14 | | | | |
| NT2RP2004861 | 1.52 | 1.27 | 1.44 | 3.27 | 3.09 | 3.21 | 1.26 | 1.81 | 1.52 | ** | + | | |
| NT2RP2004897 | 1.25 | 0.88 | 1.99 | 3.40 | 2.11 | 1.91 | 1.21 | 2.22 | 1.75 | | | | |
| NT2RP2004932 | 10.00 | 7.17 | 11.03 | 13.12 | 14.42 | 13.51 | 9.72 | 9.64 | 9.65 | * | + | | |
| NT2RP2004933 | 1.78 | 1.31 | 1.88 | 3.51 | 3.60 | 2.84 | 3.51 | 3.18 | 3.33 | ** | + | ** | + |

TABLE 253-continued

| | | | | | | | | | | | | |
|---|---|---|---|---|---|---|---|---|---|---|---|---|
| NT2RP2004936 | 4.87 | 2.22 | 1.77 | 6.48 | 8.16 | 3.31 | 4.73 | 2.49 | 2.48 | | | |
| NT2RP2004951 | 5.43 | 2.53 | 1.87 | 3.02 | 4.24 | 3.02 | 2.87 | 3.70 | 11.67 | | | |
| NT2RP2004959 | 8.45 | 5.08 | 5.37 | 8.17 | 7.86 | 9.93 | 4.85 | 5.55 | 4.46 | | | |
| NT2RP2004961 | 5.21 | 3.54 | 2.31 | 7.99 | 9.20 | 8.11 | 4.59 | 5.46 | 6.53 | ** | + | | |
| NT2RP2004962 | 4.01 | 2.64 | 2.72 | 5.11 | 4.60 | 4.41 | 3.88 | 3.76 | 3.58 | * | + | | |
| NT2RP2004966 | 2.57 | 2.53 | 3.68 | 2.80 | 3.88 | 2.77 | 2.12 | 3.33 | 4.07 | | | |
| NT2RP2004967 | 2.23 | 2.61 | 2.86 | 7.50 | 6.79 | 8.12 | 3.33 | 4.64 | 3.83 | ** | + | * | + |
| NT2RP2004974 | 1.95 | 1.80 | 1.93 | 2.56 | 3.12 | 2.39 | 3.76 | 2.94 | 0.71 | * | + | | |
| NT2RP2004978 | 6.88 | 2.95 | 2.57 | 5.63 | 7.09 | 3.07 | 4.98 | 3.62 | 3.21 | | | |
| NT2RP2004982 | 1.90 | 1.58 | 1.47 | 6.52 | 6.96 | 3.08 | 1.22 | 2.05 | 1.93 | * | + | | |
| NT2RP2004985 | 24.53 | 11.76 | 13.37 | 30.81 | 35.00 | 31.74 | 21.76 | 19.69 | 22.43 | * | + | | |
| NT2RP2004999 | 4.87 | 3.06 | 2.28 | 6.14 | 7.08 | 4.89 | 3.19 | 4.04 | 3.16 | | | |
| NT2RP2005000 | 3.68 | 2.30 | 2.22 | 2.75 | 3.93 | 3.69 | 1.87 | 3.37 | 3.49 | | | |
| NT2RP2005001 | 3.57 | 1.78 | 2.11 | 2.93 | 4.06 | 3.83 | 3.59 | 4.32 | 2.86 | | | |
| NT2RP2005003 | 4.67 | 3.07 | 2.71 | 7.63 | 8.71 | 7.19 | 5.69 | 5.10 | 6.02 | ** | + | * | + |
| NT2RP2005012 | 6.73 | 4.06 | 6.10 | 5.56 | 7.80 | 5.46 | 4.68 | 6.28 | 4.92 | | | |
| NT2RP2005018 | 7.22 | 3.93 | 3.53 | 6.32 | 10.68 | 5.74 | 4.63 | 4.62 | 5.01 | | | |
| NT2RP2005020 | 17.60 | 10.40 | 7.54 | 8.46 | 8.34 | 5.63 | 6.22 | 5.13 | 5.78 | | | |
| NT2RP2005022 | 4.95 | 2.69 | 3.66 | 5.26 | 6.40 | 4.90 | 4.15 | 3.47 | 4.07 | | | |
| NT2RP2005027 | 22.97 | 13.64 | 17.61 | 9.34 | 8.66 | 7.21 | 22.54 | 22.24 | 24.2 | * | − | | |
| NT2RP2005031 | 1.59 | 1.04 | 2.13 | 1.35 | 2.05 | 1.82 | 1.32 | 2.27 | 2.73 | | | |
| NT2RP2005035 | 12.28 | 9.78 | 9.98 | 17.38 | 24.50 | 17.61 | 24.38 | 23.70 | 30.68 | * | + | ** | + |
| NT2RP2005037 | 3.95 | 3.48 | 2.80 | 4.77 | 7.93 | 4.42 | 2.77 | 3.83 | 4.79 | | | |
| NT2RP2005038 | 1.07 | 1.01 | 1.27 | 2.71 | 2.99 | 1.89 | 1.22 | 3.15 | 1.8 | * | + | | |
| NT2RP2005048 | 8.09 | 4.51 | 4.12 | 7.64 | 8.60 | 7.45 | 7.59 | 5.31 | 4.79 | | | |
| NT2RP2005069 | 25.41 | 8.17 | 11.97 | 37.61 | 33.07 | 31.21 | 30.69 | 32.10 | 38.73 | * | + | * | + |
| NT2RP2005073 | 4.93 | 2.00 | 2.06 | 7.13 | 4.92 | 3.75 | 2.76 | 2.91 | 4.07 | | | |
| NT2RP2005097 | 4.59 | 2.92 | 2.93 | 3.87 | 3.63 | 3.16 | 2.4 | 2.61 | 2.69 | | | |
| NT2RP2005108 | 3.21 | 2.75 | 1.61 | 3.23 | 2.96 | 2.92 | 1.57 | 2.62 | 2.37 | | | |
| NT2RP2005116 | 9.11 | 5.71 | 5.87 | 6.08 | 9.75 | 7.92 | 7.26 | 7.17 | 8.23 | | | |
| NT2RP2005126 | 8.28 | 8.63 | 9.53 | 6.69 | 10.50 | 10.65 | 4.18 | 6.96 | 4.15 | | | * | − |
| NT2RP2005135 | 3.79 | 3.03 | 2.85 | 3.91 | 5.50 | 2.16 | 3.03 | 4.16 | 3.27 | | | |

TABLE 254

| | | | | | | | | | | | | |
|---|---|---|---|---|---|---|---|---|---|---|---|---|
| NT2RP2005139 | 3.84 | 1.72 | 1.31 | 3.14 | 3.97 | 2.27 | 2.16 | 2.35 | 2.71 | | | |
| NT2RP2005140 | 6.44 | 3.34 | 1.76 | 2.06 | 2.19 | 1.94 | 1.62 | 2.45 | 4.48 | | | |
| NT2RP2005144 | 7.59 | 4.23 | 3.57 | 8.56 | 9.25 | 7.68 | 4.75 | 8.24 | 8.15 | | | |
| NT2RP2005147 | 3.33 | 1.34 | 1.33 | 2.20 | 2.64 | 3.04 | 4.92 | 2.37 | 1.84 | | | |
| NT2RP2005148 | 4.87 | 2.83 | 2.05 | 4.55 | 5.06 | 4.19 | 2.73 | 4.23 | 3.35 | | | |
| NT2RP2005159 | 3.35 | 2.32 | 2.38 | 3.01 | 3.13 | 3.18 | 2.03 | 3.88 | 1.9 | | | |
| NT2RP2005162 | 3.09 | 1.68 | 1.72 | 3.70 | 3.44 | 2.30 | 2.24 | 3.35 | 2.16 | | | |
| NT2RP2005163 | 25.94 | 15.25 | 17.25 | 21.49 | 24.77 | 28.25 | 17.62 | 25.86 | 21.18 | | | |
| NT2RP2005168 | 4.54 | 2.65 | 2.28 | 2.25 | 4.03 | 2.91 | 2.1 | 1.69 | 2.5 | | | |
| NT2RP2005181 | 9.05 | 4.31 | 4.53 | 4.26 | 4.18 | 3.03 | 3.8 | 2.76 | 3.1 | | | |
| NT2RP2005204 | 8.22 | 7.14 | 6.39 | 7.26 | 7.87 | 6.45 | 7 | 4.58 | 3.93 | | | |
| NT2RP2005219 | 6.43 | 4.48 | 4.74 | 6.61 | 6.15 | 4.27 | 4.15 | 5.58 | 7.21 | | | |
| NT2RP2005227 | 6.13 | 3.78 | 3.14 | 9.09 | 11.14 | 7.97 | 3.82 | 5.07 | 8.88 | * | + | | |
| NT2RP2005237 | 27.33 | 18.84 | 15.64 | 23.79 | 22.48 | 23.44 | 22.52 | 21.69 | 18.11 | | | |
| NT2RP2005239 | 3.74 | 1.34 | 1.71 | 2.73 | 2.86 | 2.63 | 2.66 | 2.69 | 2.3 | | | |
| NT2RP2005247 | 2.49 | 2.14 | 1.98 | 4.28 | 4.68 | 4.69 | 2.63 | 2.43 | 2.5 | ** | + | | |
| NT2RP2005254 | 9.04 | 3.29 | 3.29 | 8.47 | 7.53 | 8.80 | 7.01 | 6.79 | 4.08 | | | |
| NT2RP2005270 | 4.99 | 2.71 | 2.82 | 6.57 | 6.85 | 4.80 | 6.2 | 6.16 | 8.3 | * | + | | |
| NT2RP2005276 | 9.47 | 6.54 | 6.31 | 10.41 | 11.77 | 12.24 | 5.39 | 7.57 | 7.48 | * | + | | |
| NT2RP2005287 | 4.80 | 3.96 | 2.36 | 5.91 | 7.62 | 8.20 | 5.51 | 5.27 | 7.29 | * | + | | |
| NT2RP2005288 | 3.78 | 1.10 | 1.91 | 4.67 | 4.69 | 3.22 | 2.56 | 2.68 | 2.46 | | | |
| NT2RP2005289 | 3.95 | 2.82 | 3.63 | 10.36 | 10.31 | 13.45 | 7.04 | 9.38 | 8.68 | ** | + | ** | + |
| NT2RP2005293 | 4.69 | 3.98 | 2.48 | 2.80 | 6.37 | 4.36 | 1.98 | 2.19 | 8.18 | | | |
| NT2RP2005315 | 4.50 | 2.51 | 3.53 | 6.84 | 5.84 | 6.72 | 4.55 | 3.38 | 3.33 | * | + | | |
| NT2RP2005322 | 8.85 | 3.21 | 3.77 | 5.49 | 9.42 | 5.85 | 5.53 | 11.41 | 21.87 | | | |
| NT2RP2005325 | 13.28 | 7.03 | 7.32 | 9.81 | 8.97 | 5.93 | 11.14 | 10.62 | 11.49 | | | |
| NT2RP2005336 | 12.73 | 6.78 | 5.54 | 13.58 | 10.27 | 12.67 | 8.85 | 6.83 | 5.91 | | | |
| NT2RP2005343 | 6.02 | 1.89 | 2.05 | 7.45 | 9.65 | 7.01 | 10.08 | 10.85 | 12.82 | * | + | ** | + |
| NT2RP2005344 | 1.85 | 1.66 | 1.47 | 2.08 | 2.88 | 1.92 | 2.74 | 2.45 | 3.15 | | | ** | + |
| NT2RP2005347 | 4.37 | 2.71 | 1.89 | 5.25 | 5.00 | 4.78 | 3.35 | 2.93 | 2.34 | | | |
| NT2RP2005354 | 12.00 | 6.61 | 6.14 | 17.43 | 12.77 | 12.49 | 8.48 | 9.88 | 9.01 | | | |
| NT2RP2005358 | 4.88 | 3.45 | 2.64 | 4.51 | 4.14 | 3.14 | 3.97 | 2.53 | 1.99 | | | |
| NT2RP2005360 | 7.88 | 5.76 | 2.39 | 6.48 | 5.68 | 6.59 | 4.31 | 3.84 | 6.35 | | | |
| NT2RP2005378 | 18.33 | 8.81 | 8.98 | 11.83 | 10.64 | 10.23 | 12.69 | 11.85 | 15.35 | | | |
| NT2RP2005391 | 11.21 | 5.99 | 4.87 | 8.42 | 9.50 | 6.15 | 7.72 | 6.42 | 7.6 | | | |
| NT2RP2005393 | 7.14 | 5.04 | 4.09 | 7.19 | 7.55 | 7.32 | 5.14 | 5.24 | 6.8 | | | |
| NT2RP2005407 | 4.70 | 3.27 | 2.59 | 4.12 | 5.86 | 4.29 | 4.19 | 4.07 | 6.46 | | | |
| NT2RP2005419 | 2.03 | 2.94 | 2.38 | 2.87 | 3.30 | 2.26 | 2.46 | 2.93 | 2.38 | | | |
| NT2RP2005425 | 3.16 | 1.77 | 1.43 | 6.79 | 4.57 | 5.63 | 3.84 | 5.07 | 4.35 | * | + | * | + |
| NT2RP2005429 | 5.40 | 3.41 | 3.71 | 7.74 | 6.15 | 6.01 | 3.54 | 4.45 | 2.89 | * | + | | |
| NT2RP2005436 | 11.49 | 5.63 | 5.95 | 16.34 | 13.38 | 12.70 | 9.59 | 8.94 | 10.22 | * | + | | |

TABLE 254-continued

| | | | | | | | | | | | | |
|---|---|---|---|---|---|---|---|---|---|---|---|---|
| NT2RP2005441 | 2.64 | 2.24 | 1.49 | 4.39 | 3.02 | 4.62 | 2.37 | 2.61 | 2.65 | * | + | |
| NT2RP2005442 | 6.72 | 3.80 | 3.11 | 6.35 | 6.53 | 5.07 | 6.08 | 5.33 | 7.07 | | | |
| NT2RP2005444 | 14.62 | 10.40 | 7.75 | 7.08 | 9.17 | 7.55 | 7.37 | 6.88 | 8.45 | | | |
| NT2RP2005453 | 1.54 | 2.20 | 1.49 | 7.95 | 9.47 | 8.01 | 8.67 | 8.44 | 9.15 | ** | + | ** | + |
| NT2RP2005457 | 15.76 | 12.87 | 16.87 | 26.94 | 13.90 | 21.92 | 12.51 | 12.21 | 12.15 | | | |
| NT2RP2005458 | 1.63 | 1.87 | 2.03 | 5.92 | 5.93 | 3.89 | 2.67 | 3.64 | 6.17 | ** | + | |
| NT2RP2005463 | 4.65 | 3.64 | 4.43 | 7.72 | 7.84 | 5.33 | 6.02 | 6.93 | 5.84 | * | + | * | + |
| NT2RP2005464 | 11.98 | 9.14 | 6.68 | 11.62 | 10.20 | 8.75 | 5.59 | 3.86 | 4.74 | | | * | − |
| NT2RP2005465 | 4.57 | 3.64 | 2.60 | 8.98 | 7.23 | 8.68 | 2.44 | 5.04 | 5.3 | ** | + | |
| NT2RP2005472 | 10.01 | 4.28 | 4.30 | 7.95 | 7.14 | 5.73 | 3.03 | 3.71 | 5.35 | | | |
| NT2RP2005476 | 5.22 | 3.10 | 3.30 | 10.18 | 12.60 | 10.12 | 5.36 | 4.72 | 5.84 | ** | + | |
| NT2RP2005490 | 5.25 | 3.96 | 4.56 | 6.13 | 9.22 | 5.46 | 5.31 | 3.92 | 5.71 | | | |
| NT2RP2005491 | 15.97 | 8.85 | 12.00 | 4.52 | 5.86 | 4.78 | 8.53 | 10.16 | 9.41 | * | − | |
| NT2RP2005495 | 2.68 | 2.26 | 2.48 | 2.05 | 3.65 | 3.42 | 3.01 | 4.37 | 2.75 | | | |
| NT2RP2005496 | 9.04 | 5.08 | 6.06 | 16.30 | 11.28 | 12.12 | 9.01 | 10.34 | 6.32 | * | + | |

TABLE 255

| | | | | | | | | | | | | |
|---|---|---|---|---|---|---|---|---|---|---|---|---|
| NT2RP2005498 | 6.78 | 2.60 | 2.45 | 2.62 | 6.63 | 3.50 | 3.33 | 3.34 | 4.18 | | | |
| NT2RP2005501 | 4.44 | 2.53 | 2.65 | 2.38 | 4.12 | 2.69 | 2.07 | 3.28 | 2.78 | | | |
| NT2RP2005506 | 5.72 | 4.30 | 3.10 | 5.43 | 9.55 | 6.10 | 24.52 | 21.82 | 25.02 | ** | + | |
| NT2RP2005509 | 6.91 | 5.58 | 4.63 | 12.32 | 11.78 | 9.14 | 5.34 | 8.99 | 8.48 | * | + | |
| NT2RP2005514 | 3.36 | 2.23 | 2.33 | 3.96 | 5.18 | 4.19 | 3.03 | 4.16 | 4.55 | * | + | |
| NT2RP2005520 | 10.34 | 5.10 | 5.86 | 6.07 | 8.22 | 5.46 | 3.87 | 3.79 | 3.08 | | | |
| NT2RP2005525 | 6.12 | 4.01 | 5.33 | 8.58 | 7.75 | 8.13 | 5.26 | 8.01 | 5.47 | * | + | |
| NT2RP2005531 | 0.65 | 1.10 | 1.57 | 2.33 | 1.56 | 1.74 | 1.49 | 2.39 | 1.21 | | | |
| NT2RP2005535 | 36.57 | 17.31 | 21.13 | 93.90 | 73.03 | 67.87 | 27.53 | 17.14 | 25.99 | ** | + | |
| NT2RP2005539 | 10.87 | 6.53 | 4.81 | 8.43 | 9.17 | 6.85 | 6.76 | 6.87 | 5.25 | | | |
| NT2RP2005540 | 2.81 | 2.63 | 2.81 | 7.15 | 6.27 | 5.67 | 4.42 | 5.46 | 9.74 | ** | + | |
| NT2RP2005541 | 5.40 | 3.42 | 2.70 | 8.82 | 9.81 | 10.04 | 7.49 | 7.37 | 5.44 | ** | + | * | + |
| NT2RP2005549 | 3.91 | 1.98 | 1.81 | 3.23 | 3.51 | 2.41 | 2.43 | 3.46 | 2.97 | | | |
| NT2RP2005555 | 3.52 | 2.33 | 3.66 | 6.38 | 7.55 | 5.49 | 7.54 | 10.56 | 6.47 | * | + | * | + |
| NT2RP2005557 | 7.00 | 5.12 | 11.72 | 16.35 | 11.47 | 12.41 | 6.34 | 5.80 | 8.04 | | | |
| NT2RP2005581 | 5.51 | 4.09 | 4.45 | 13.70 | 13.23 | 10.54 | 6.26 | 5.62 | 5.86 | ** | + | |
| NT2RP2005586 | 7.40 | 3.49 | 4.35 | 2.55 | 4.08 | 2.63 | 1.67 | 2.60 | 2.43 | | | |
| NT2RP2005597 | 6.16 | 4.97 | 3.02 | 4.57 | 4.34 | 4.57 | 4.67 | 4.40 | 5.08 | | | |
| NT2RP2005600 | 4.06 | 2.52 | 2.53 | 3.83 | 4.26 | 3.10 | 2.47 | 4.00 | 2.95 | | | |
| NT2RP2005605 | 13.12 | 8.01 | 6.74 | 12.67 | 14.30 | 12.26 | 6.96 | 7.51 | 8 | | | |
| NT2RP2005614 | 9.18 | 5.27 | 8.25 | 16.39 | 16.00 | 13.57 | 10.11 | 8.70 | 9.2 | ** | + | |
| NT2RP2005620 | 4.07 | 2.65 | 2.40 | 3.99 | 3.40 | 3.40 | 2.45 | 3.61 | 2.26 | | | |
| NT2RP2005622 | 9.20 | 6.36 | 7.23 | 6.07 | 7.94 | 5.76 | 4.64 | 4.67 | 6.34 | | | |
| NT2RP2005632 | 3.64 | 3.42 | 2.57 | 5.77 | 4.33 | 3.82 | 2.82 | 3.85 | 3.3 | | | |
| NT2RP2005635 | 3.95 | 2.73 | 2.06 | 3.40 | 4.38 | 2.94 | 2.4 | 2.42 | 3.18 | | | |
| NT2RP2005637 | 2.20 | 1.05 | 1.68 | 13.21 | 4.02 | 4.55 | 2.2 | 2.55 | 5.6 | | | |
| NT2RP2005640 | 3.47 | 1.55 | 1.53 | 2.16 | 1.23 | 2.22 | 1.96 | 2.66 | 2.84 | | | |
| NT2RP2005645 | 6.42 | 3.67 | 2.99 | 5.68 | 11.68 | 7.34 | 5.29 | 6.74 | 5.73 | | | |
| NT2RP2005651 | 4.09 | 3.02 | 3.19 | 6.89 | 11.77 | 5.52 | 3.81 | 4.33 | 6.7 | | | |
| NT2RP2005654 | 5.50 | 3.61 | 4.20 | 6.10 | 7.84 | 5.96 | 4.19 | 5.64 | 4.96 | | | |
| NT2RP2005666 | 4.54 | 3.08 | 3.45 | 5.18 | 6.63 | 4.14 | 4.25 | 3.69 | 7.2 | | | |
| NT2RP2005669 | 6.09 | 5.35 | 5.64 | 8.34 | 9.73 | 9.01 | 4.66 | 6.00 | 6.82 | ** | + | |
| NT2RP2005670 | 2.87 | 2.37 | 1.87 | 5.75 | 5.68 | 2.37 | 1.68 | 2.33 | 3.03 | | | |
| NT2RP2005671 | 10.41 | 3.42 | 4.33 | 5.10 | 6.32 | 3.51 | 3.46 | 4.47 | 6.12 | | | |
| NT2RP2005675 | 11.31 | 4.30 | 4.30 | 8.54 | 8.22 | 4.79 | 7.64 | 6.94 | 9.43 | | | |
| NT2RP2005683 | 9.32 | 5.43 | 5.87 | 8.08 | 9.48 | 5.92 | 5.85 | 4.94 | 4.56 | | | |
| NT2RP2005690 | 3.18 | 1.30 | 1.52 | 3.24 | 4.46 | 3.75 | 2.33 | 3.71 | 3.54 | | | |
| NT2RP2005694 | 4.33 | 2.30 | 2.18 | 4.82 | 3.54 | 4.62 | 3.22 | 3.77 | 3.78 | | | |
| NT2RP2005701 | 22.21 | 13.84 | 17.86 | 22.12 | 25.56 | 24.08 | 18.18 | 17.70 | 22.41 | | | * | − |
| NT2RP2005712 | 2.84 | 3.06 | 3.02 | 3.90 | 3.94 | 3.10 | 1.15 | 2.49 | 1.88 | | | |
| NT2RP2005719 | 2.26 | 1.27 | 0.73 | 3.09 | 3.04 | 2.67 | 2.23 | 1.46 | 2.56 | * | + | |
| NT2RP2005722 | 11.76 | 8.52 | 5.52 | 18.21 | 24.59 | 18.10 | 8.26 | 9.21 | 12.37 | * | + | |
| NT2RP2005723 | 4.68 | 2.75 | 2.29 | 7.35 | 6.52 | 3.86 | 4.39 | 4.70 | 2.79 | | | |
| NT2RP2005726 | 5.41 | 2.39 | 2.73 | 5.77 | 4.51 | 4.16 | 3.27 | 4.19 | 3.67 | | | |
| NT2RP2005729 | 5.30 | 2.58 | 2.08 | 6.82 | 6.27 | 4.01 | 3.21 | 5.54 | 3.89 | | | |
| NT2RP2005731 | 0.50 | 0.60 | 0.63 | 1.06 | 1.43 | 0.80 | 0.71 | 2.81 | 0.87 | * | + | |
| NT2RP2005732 | 8.98 | 3.61 | 4.01 | 6.71 | 6.46 | 5.79 | 4.23 | 7.06 | 7.16 | | | |
| NT2RP2005737 | 10.83 | 8.16 | 10.12 | 14.65 | 17.80 | 12.60 | 12.9 | 11.51 | 9.06 | * | + | |
| NT2RP2005741 | 5.83 | 2.63 | 2.65 | 3.36 | 3.80 | 2.41 | 3.96 | 2.72 | 3.47 | | | |
| NT2RP2005748 | 3.52 | 1.63 | 2.33 | 2.18 | 2.64 | 1.48 | 3.11 | 2.62 | 2.38 | | | |
| NT2RP2005752 | 5.37 | 3.43 | 3.73 | 6.46 | 5.65 | 5.66 | 6.55 | 3.67 | 3.82 | | | |
| NT2RP2005753 | 22.04 | 14.07 | 18.05 | 15.96 | 24.14 | 20.59 | 21.63 | 18.25 | 19.82 | | | |
| NT2RP2005763 | 6.73 | 2.47 | 2.52 | 3.25 | 3.61 | 3.70 | 1.84 | 3.88 | 3.22 | | | |
| NT2RP2005767 | 2.43 | 2.60 | 2.16 | 6.91 | 6.56 | 7.20 | 3.36 | 3.03 | 4.12 | ** | + | * | + |
| NT2RP2005773 | 15.62 | 10.12 | 12.99 | 19.66 | 19.02 | 17.26 | 17.15 | 13.07 | 15.8 | * | + | |
| NT2RP2005774 | 10.33 | 5.72 | 6.91 | 21.21 | 24.60 | 21.03 | 9.42 | 7.55 | 8.22 | ** | + | |

TABLE 256

| | | | | | | | | | | | | |
|---|---|---|---|---|---|---|---|---|---|---|---|---|
| NT2RP2005775 | 4.39 | 1.98 | 1.42 | 2.12 | 2.56 | 2.56 | 2.19 | 2.08 | 1.67 | | | |
| NT2RP2005781 | 5.85 | 3.98 | 3.29 | 6.76 | 5.57 | 5.04 | 4.75 | 3.50 | 4.17 | | | |
| NT2RP2005784 | 11.14 | 6.73 | 5.29 | 8.15 | 8.38 | 8.40 | 7.85 | 8.40 | 10.24 | | | |
| NT2RP2005789 | 4.85 | 3.33 | 3.28 | 5.63 | 7.04 | 4.46 | 3.88 | 3.70 | 4.09 | | | |
| NT2RP2005799 | 1.71 | 1.81 | 1.37 | 3.76 | 5.36 | 2.16 | 2.16 | 2.19 | 2.43 | | | * | + |
| NT2RP2005804 | 6.19 | 3.18 | 3.30 | 4.57 | 7.49 | 6.42 | 5.55 | 5.88 | 4.72 | | | |
| NT2RP2005812 | 3.92 | 3.04 | 2.54 | 4.78 | 6.17 | 3.21 | 2.98 | 4.18 | 4.04 | | | |
| NT2RP2005815 | 2.54 | 2.17 | 3.20 | 3.81 | 3.69 | 2.58 | 2.35 | 2.98 | 1.88 | | | |
| NT2RP2005835 | 14.04 | 7.44 | 6.79 | 14.50 | 10.00 | 10.84 | 9.86 | 7.11 | 11.61 | | | |
| NT2RP2005841 | 6.35 | 3.23 | 3.13 | 5.70 | 4.93 | 4.82 | 5.84 | 3.68 | 4.27 | | | |
| NT2RP2005853 | 3.23 | 3.29 | 2.96 | 6.28 | 6.53 | 5.74 | 4.87 | 4.09 | 5.28 | ** | + | * | + |
| NT2RP2005857 | 8.95 | 4.28 | 4.74 | 6.65 | 7.52 | 6.19 | 1.63 | 2.12 | 1.8 | | | |
| NT2RP2005859 | 5.38 | 4.41 | 5.54 | 4.28 | 5.42 | 3.86 | 2.87 | 3.84 | 3.87 | | | * | − |
| NT2RP2005860 | 3.02 | 1.60 | 2.64 | 2.92 | 4.01 | 2.37 | 2.32 | 4.74 | 1.81 | | | |
| NT2RP2005863 | 4.66 | 2.88 | 2.88 | 3.96 | 3.85 | 3.93 | 2.02 | 2.05 | 1.69 | | | |
| NT2RP2005868 | 3.44 | 1.57 | 1.65 | 4.52 | 4.28 | 2.97 | 2.38 | 3.85 | 2.89 | | | |
| NT2RP2005876 | 13.61 | 7.01 | 5.40 | 17.03 | 13.16 | 6.91 | 8.8 | 8.61 | 107 | | | |
| NT2RP2005878 | 6.92 | 4.37 | 4.13 | 11.06 | 12.33 | 11.73 | 5.81 | 7.81 | 6.82 | ** | + | |
| NT2RP2005883 | 1.59 | 1.56 | 1.08 | 3.31 | 2.84 | 2.42 | 3.91 | 4.53 | 4.86 | ** | + | ** | + |
| NT2RP2005886 | 8.60 | 4.98 | 6.40 | 10.11 | 11.16 | 11.42 | 6.19 | 6.08 | 5.43 | * | + | |
| NT2RP2005887 | 5.47 | 3.26 | 3.97 | 12.05 | 12.81 | 9.32 | 13.75 | 10.35 | 15.02 | ** | + | ** | + |
| NT2RP2005890 | 7.74 | 6.08 | 7.50 | 6.23 | 6.35 | 4.71 | 2.57 | 2.56 | 1.86 | | | ** | − |
| NT2RP2005901 | 3.39 | 2.76 | 2.57 | 3.81 | 4.07 | 4.20 | 2.43 | 3.04 | 3.13 | * | + | |
| NT2RP2005902 | 1.86 | 0.89 | 1.33 | 3.39 | 3.77 | 2.15 | 2.13 | 2.79 | 3.13 | * | + | * | + |
| NT2RP2005908 | 9.46 | 5.71 | 4.03 | 9.28 | 7.93 | 10.45 | 6.03 | 6.26 | 6.92 | | | |
| NT2RP2005927 | 7.43 | 5.84 | 5.10 | 9.51 | 9.65 | 7.14 | 3.72 | 5.75 | 4.41 | | | |
| NT2RP2005933 | 6.32 | 4.20 | 3.63 | 5.57 | 7.02 | 4.50 | 3.29 | 2.73 | 4.08 | | | |
| NT2RP2005941 | 9.03 | 6.94 | 7.01 | 7.65 | 13.07 | 8.78 | 10.41 | 9.47 | 5.87 | | | |
| NT2RP2005942 | 3.02 | 2.03 | 1.79 | 3.90 | 4.09 | 3.96 | 2.56 | 2.68 | 2 | * | + | |
| NT2RP2005946 | 6.57 | 4.95 | 5.93 | 3.90 | 3.86 | 3.27 | 2.5 | 2.94 | 2.41 | * | − | ** | − |
| NT2RP2005970 | 12.30 | 10.25 | 11.94 | 15.87 | 16.05 | 15.06 | 14.9 | 13.37 | 14.97 | ** | + | * | + |
| NT2RP2005980 | 3.71 | 2.65 | 2.25 | 7.90 | 7.37 | 4.49 | 4.13 | 4.23 | 2.71 | * | + | |
| NT2RP2005994 | 5.01 | 2.60 | 2.01 | 2.75 | 4.22 | 1.07 | 2.23 | 3.11 | 2.43 | | | |
| NT2RP2006004 | 2.32 | 1.82 | 1.35 | 2.43 | 4.21 | 2.56 | 2.36 | 3.37 | 2.03 | | | |
| NT2RP2006013 | 4.44 | 2.15 | 4.45 | 6.09 | 6.99 | 3.28 | 4.68 | 5.22 | 4.41 | | | |
| NT2RP2006023 | 21.60 | 12.40 | 20.04 | 37.44 | 49.33 | 45.44 | 22.61 | 22.79 | 24.39 | ** | + | |
| NT2RP2006028 | 5.34 | 3.20 | 3.73 | 4.07 | 4.23 | 2.81 | 3.39 | 4.81 | 5.42 | | | |
| NT2RP2006038 | 0.34 | 0.06 | 1.28 | 0.43 | 0.83 | 3.61 | 0.25 | 1.80 | 0.18 | | | |
| NT2RP2006042 | 8.65 | 5.14 | 6.93 | 7.32 | 7.79 | 6.34 | 7.56 | 7.82 | 9.4 | | | |
| NT2RP2006043 | 5.05 | 2.75 | 2.80 | 12.32 | 12.87 | 10.73 | 8.05 | 8.08 | 7.82 | ** | + | ** | + |
| NT2RP2006052 | 2.31 | 2.64 | 1.44 | 1.42 | 2.55 | 2.98 | 1.26 | 2.10 | 2.6 | | | |
| NT2RP2006057 | 3.69 | 1.67 | 1.24 | 3.57 | 3.44 | 2.48 | 2.2 | 3.85 | 3.27 | | | |
| NT2RP2006064 | 12.49 | 6.77 | 9.83 | 12.13 | 10.85 | 6.00 | 10.28 | 6.81 | 5.57 | | | |
| NT2RP2006068 | 3.25 | 3.63 | 2.31 | 8.60 | 6.86 | 6.64 | 4.6 | 5.09 | 2.54 | ** | + | |
| NT2RP2006069 | 1.08 | 0.69 | 0.92 | 0.88 | 1.74 | 0.95 | 0.92 | 1.48 | 1.42 | | | |
| NT2RP2006071 | 2.73 | 3.23 | 2.31 | 5.07 | 7.66 | 5.45 | 2.92 | 4.00 | 2.55 | * | + | |
| NT2RP2006090 | 3.70 | 1.69 | 2.79 | 3.57 | 5.20 | 3.82 | 3.74 | 3.63 | 2.49 | | | |
| NT2RP2006092 | 3.65 | 2.47 | 2.47 | 3.19 | 3.41 | 3.44 | 2.36 | 2.80 | 2.77 | | | |
| NT2RP2006097 | 24.23 | 9.76 | 10.66 | 21.53 | 18.65 | 14.12 | 10.2 | 9.65 | 12.96 | | | |
| NT2RP2006098 | 4.17 | 2.27 | 1.77 | 4.26 | 4.04 | 2.86 | 4.03 | 6.51 | 3.5 | | | |
| NT2RP2006099 | 4.48 | 2.99 | 2.12 | 5.82 | 5.86 | 5.18 | 3.32 | 4.84 | 3.86 | * | + | |
| NT2RP2006100 | 3.88 | 1.55 | 1.83 | 3.98 | 4.92 | 3.85 | 2.1 | 3.68 | 2.65 | | | |
| NT2RP2006103 | 10.54 | 3.86 | 5.78 | 3.37 | 2.55 | 1.88 | 2.21 | 3.36 | 1.85 | | | |
| NT2RP2006106 | 8.45 | 4.11 | 4.04 | 6.45 | 5.69 | 6.30 | 4.48 | 6.29 | 4.22 | | | |
| NT2RP2006127 | 9.00 | 6.34 | 7.56 | 9.10 | 8.66 | 7.24 | 9.12 | 10.10 | 8.49 | | | |
| NT2RP2006134 | 1.55 | 1.02 | 1.47 | 1.76 | 1.82 | 1.93 | 1.55 | 2.52 | 1.29 | * | + | |

TABLE 257

| | | | | | | | | | | | | |
|---|---|---|---|---|---|---|---|---|---|---|---|---|
| NT2RP2006141 | 5.76 | 3.11 | 3.17 | 3.84 | 5.50 | 4.54 | 3.67 | 3.75 | 3.95 | | | |
| NT2RP2006166 | 7.93 | 5.66 | 5.17 | 12.63 | 13.99 | 9.56 | 6.76 | 6.08 | 6.36 | * | + | |
| NT2RP2006176 | 4.45 | 2.26 | 1.67 | 6.40 | 4.88 | 5.22 | 2.44 | 3.34 | 5.68 | * | + | |
| NT2RP2006181 | 1.58 | 1.06 | 1.00 | 1.37 | 3.24 | 3.22 | 1.23 | 2.94 | 1.73 | | | |
| NT2RP2006184 | 23.94 | 15.54 | 16.09 | 22.96 | 21.00 | 23.09 | 17.11 | 19.55 | 14.56 | | | |
| NT2RP2006186 | 1.68 | 1.14 | 2.35 | 2.02 | 3.74 | 1.74 | 1.23 | 3.31 | 1.82 | | | |
| NT2RP2006196 | 4.74 | 3.02 | 3.70 | 6.83 | 6.02 | 5.77 | 4.04 | 5.17 | 3.91 | * | + | |
| NT2RP2006199 | 2.29 | 2.59 | 2.52 | 3.33 | 3.50 | 4.30 | 2.88 | 2.76 | 2.12 | * | + | |
| NT2RP2006200 | 4.29 | 2.63 | 1.43 | 3.59 | 5.59 | 2.06 | 3.12 | 2.50 | 2.5 | | | |
| NT2RP2006210 | 59.40 | 41.07 | 36.68 | 33.45 | 39.27 | 22.58 | 11.72 | 8.31 | 9.47 | | | ** | − |
| NT2RP2006219 | 3.75 | 1.76 | 1.64 | 3.39 | 3.29 | 2.82 | 2.17 | 1.88 | 4.22 | | | |
| NT2RP2006224 | 5.72 | 3.72 | 4.01 | 5.11 | 6.26 | 6.39 | 3.82 | 3.77 | 4.2 | | | |
| NT2RP2006237 | 5.09 | 3.91 | 5.00 | 9.00 | 7.92 | 10.28 | 5.01 | 5.76 | 5.27 | ** | + | |
| NT2RP2006238 | 3.42 | 2.16 | 1.78 | 4.42 | 4.29 | 2.44 | 2.31 | 3.01 | 1.89 | | | |
| NT2RP2006258 | 9.12 | 5.55 | 6.28 | 6.08 | 7.62 | 7.68 | 6.35 | 6.07 | 3.93 | | | |
| NT2RP2006261 | 1.75 | 2.42 | 1.14 | 2.06 | 2.49 | 1.87 | 1.21 | 1.75 | 2.67 | | | |
| NT2RP2006269 | 23.86 | 9.30 | 9.53 | 15.39 | 18.13 | 13.53 | 12.46 | 10.61 | 15.67 | | | |

TABLE 257-continued

| | | | | | | | | | | | | |
|---|---|---|---|---|---|---|---|---|---|---|---|---|
| NT2RP2006275 | 4.68 | 2.71 | 2.12 | 3.99 | 3.20 | 2.45 | 2.89 | 2.81 | 3.34 | | | | |
| NT2RP2006282 | 7.12 | 3.89 | 6.34 | 8.17 | 11.45 | 9.25 | 4.48 | 4.87 | 2.85 | * | + | | |
| NT2RP2006302 | 4.86 | 2.69 | 3.31 | 10.51 | 10.47 | 9.06 | 10 | 9.83 | 3.76 | ** | + | | |
| NT2RP2006312 | 8.45 | 5.62 | 5.99 | 10.60 | 10.03 | 9.84 | 7.18 | 6.51 | 5.02 | * | + | | |
| NT2RP2006320 | 3.62 | 2.45 | 1.39 | 4.62 | 5.47 | 5.86 | 2.21 | 4.05 | 3.23 | * | + | | |
| NT2RP2006321 | 1.99 | 1.78 | 2.42 | 3.22 | 4.24 | 2.52 | 1.97 | 3.17 | 2.07 | | | | |
| NT2RP2006323 | 1.30 | 0.75 | 0.38 | 1.35 | 1.65 | 0.69 | 0.19 | 2.09 | 2.6 | | | | |
| NT2RP2006333 | 2.18 | 0.70 | 0.66 | 2.51 | 1.88 | 1.17 | 1.49 | 1.76 | 2.35 | | | | |
| NT2RP2006334 | 3.73 | 1.40 | 1.47 | 2.69 | 3.03 | 2.34 | 0.81 | 2.29 | 2.95 | | | | |
| NT2RP2006338 | 2.65 | 1.82 | 1.03 | 3.45 | 4.02 | 2.81 | 1.6 | 3.69 | 2.93 | | | | |
| NT2RP2006339 | 2.37 | 1.54 | 1.37 | 3.09 | 2.39 | 1.47 | 1.2 | 2.47 | 2.21 | | | | |
| NT2RP2006355 | 1.01 | 0.99 | 0.71 | 2.16 | 2.25 | 1.72 | 1.94 | 2.95 | 0.87 | ** | + | | |
| NT2RP2006365 | 1.51 | 1.66 | 1.15 | 3.16 | 4.39 | 3.70 | 1.83 | 4.13 | 1.9 | ** | + | | |
| NT2RP2006374 | 16.70 | 8.19 | 7.22 | 17.36 | 18.00 | 12.60 | 10.86 | 13.62 | 9.02 | | | | |
| NT2RP2006393 | 4.85 | 2.17 | 2.52 | 8.54 | 10.40 | 8.85 | 5.98 | 6.32 | 6.15 | ** | + | * | + |
| NT2RP2006394 | 2.02 | 1.64 | 1.69 | 3.46 | 1.86 | 1.52 | 3.53 | 1.56 | 2.54 | | | | |
| NT2RP2006400 | 1.99 | 1.74 | 1.43 | 2.29 | 2.67 | 2.67 | 2.79 | 1.32 | 1.33 | * | + | | |
| NT2RP2006411 | 36.13 | 23.40 | 20.23 | 18.85 | 35.68 | 22.21 | 26.26 | 22.92 | 21.44 | | | | |
| NT2RP2006429 | 3.49 | 1.96 | 1.56 | 18.22 | 22.80 | 21.81 | 7.61 | 6.72 | 8.71 | ** | + | ** | + |
| NT2RP2006435 | 2.88 | 2.61 | 2.07 | 4.19 | 4.16 | 3.86 | 3.51 | 3.02 | 3.91 | ** | + | | |
| NT2RP2006436 | 4.50 | 2.57 | 2.37 | 11.47 | 10.14 | 10.45 | 15.06 | 14.83 | 12.68 | ** | + | ** | + |
| NT2RP2006441 | 5.48 | 3.11 | 4.37 | 12.23 | 11.44 | 10.95 | 9.38 | 9.44 | 9.01 | ** | + | ** | + |
| NT2RP2006447 | 3.63 | 2.74 | 2.87 | 7.53 | 5.11 | 1.37 | 2.09 | 1.56 | 0.94 | | | * | − |
| NT2RP2006454 | 3.45 | 1.48 | 1.32 | 2.04 | 2.21 | 2.24 | 3.02 | 1.84 | 0.51 | | | | |
| NT2RP2006455 | 3.08 | 1.02 | 1.42 | 3.46 | 1.52 | 2.11 | 2.25 | 1.46 | 1.25 | | | | |
| NT2RP2006456 | 3.43 | 1.56 | 1.38 | 1.87 | 3.29 | 2.20 | 1.39 | 3.00 | 3.52 | | | | |
| NT2RP2006464 | 7.78 | 4.38 | 3.90 | 5.55 | 4.82 | 4.88 | 3.6 | 3.54 | 5.67 | | | | |
| NT2RP2006467 | 5.66 | 2.72 | 2.67 | 10.90 | 8.83 | 10.03 | 7.29 | 6.50 | 9.64 | ** | + | * | + |
| NT2RP2006472 | 7.44 | 3.78 | 3.97 | 8.69 | 8.19 | 8.22 | 5 | 4.65 | 10.62 | | | | |
| NT2RP2006474 | 8.86 | 5.98 | 7.97 | 27.71 | 30.65 | 24.91 | 30 | 37.03 | 33.44 | ** | + | ** | + |
| NT2RP2006475 | 5.24 | 3.11 | 2.17 | 15.80 | 11.04 | 13.89 | 8.72 | 6.46 | 9.93 | ** | + | * | + |
| NT2RP2006476 | 14.81 | 5.32 | 5.83 | 6.07 | 6.15 | 5.06 | 6.6 | 4.52 | 6.65 | | | | |
| NT2RP2006501 | 10.57 | 4.49 | 3.64 | 10.98 | 10.15 | 9.25 | 4.35 | 4.19 | 5.76 | | | | |
| NT2RP2006512 | 10.18 | 4.42 | 5.26 | 7.98 | 9.45 | 6.77 | 5.81 | 5.75 | 6.47 | | | | |
| NT2RP2006526 | 2.38 | 0.63 | 1.13 | 1.33 | 3.17 | 1.44 | 1.31 | 2.50 | 2.57 | | | | |
| NT2RP2006527 | 6.04 | 4.50 | 5.90 | 6.98 | 6.77 | 8.30 | 6.37 | 6.06 | 6.05 | | | | |
| NT2RP2006534 | 1.08 | 0.58 | 0.52 | 1.10 | 1.90 | 2.81 | 1.51 | 1.54 | 1.55 | | | * | + |
| NT2RP2006537 | 7.96 | 4.17 | 4.11 | 12.78 | 11.80 | 12.98 | 5.84 | 7.01 | 9.26 | ** | + | | |
| NT2RP2006543 | 2.53 | 2.49 | 1.25 | 3.82 | 3.98 | 2.63 | 5.74 | 3.55 | 4.9 | | | * | + |

TABLE 258

| | | | | | | | | | | | | |
|---|---|---|---|---|---|---|---|---|---|---|---|---|
| NT2RP2006554 | 2.93 | 1.44 | 1.64 | 4.14 | 5.11 | 5.65 | 3.05 | 2.87 | 4.34 | ** | + | * | + |
| NT2RP2006565 | 2.42 | 3.04 | 1.97 | 5.84 | 7.27 | 4.73 | 5.76 | 4.50 | 8.32 | * | + | * | + |
| NT2RP2006571 | 15.53 | 8.80 | 8.87 | 9.19 | 10.25 | 5.31 | 9.49 | 9.09 | 15.1 | | | | |
| NT2RP2006573 | 3.03 | 1.23 | 1.11 | 3.74 | 3.96 | 3.02 | 2.6 | 2.13 | 2.11 | | | | |
| NT2RP2006598 | 5.73 | 3.98 | 4.61 | 7.93 | 8.72 | 6.43 | 5.28 | 3.71 | 6.12 | * | + | | |
| NT2RP2006601 | 37.52 | 34.93 | 32.64 | 41.04 | 41.47 | 32.68 | 27.39 | 28.66 | 36.43 | | | | |
| NT2RP3000002 | 3.95 | 2.25 | 3.29 | 4.37 | 7.61 | 7.60 | 3.47 | 4.83 | 7.96 | * | + | | |
| NT2RP3000011 | 4.07 | 2.64 | 1.62 | 5.92 | 4.70 | 5.14 | 3.96 | 3.12 | 4.24 | * | + | | |
| NT2RP3000014 | 3.17 | 3.00 | 2.39 | 9.14 | 11.05 | 8.39 | 7.15 | 7.48 | 8.57 | ** | + | ** | + |
| NT2RP3000016 | 9.66 | 5.49 | 5.68 | 6.73 | 6.36 | 7.49 | 4.75 | 5.66 | 6.35 | | | | |
| NT2RP3000022 | 4.96 | 2.03 | 2.47 | 3.53 | 3.43 | 2.45 | 3.24 | 3.89 | 7.1 | | | | |
| NT2RP3000024 | 12.74 | 9.32 | 13.69 | 28.77 | 37.69 | 22.23 | 11.49 | 12.80 | 14.79 | * | + | | |
| NT2RP3000031 | 4.64 | 2.28 | 2.98 | 4.90 | 4.09 | 5.50 | 4.12 | 3.94 | 3.26 | | | | |
| NT2RP3000034 | 4.51 | 3.69 | 3.49 | 3.95 | 4.58 | 4.75 | 3.38 | 3.05 | 3.23 | | | | |
| NT2RP3000037 | 15.49 | 9.32 | 10.69 | 13.56 | 14.15 | 12.81 | 7.78 | 9.45 | 8.16 | | | | |
| NT2RP3000040 | 2.98 | 2.45 | 1.73 | 1.43 | 1.95 | 2.12 | 0.99 | 2.09 | 2.1 | | | | |
| NT2RP3000041 | 10.75 | 6.47 | 4.78 | 19.57 | 16.79 | 13.38 | 9.67 | 7.12 | 9.17 | * | + | | |
| NT2RP3000046 | 5.16 | 2.85 | 2.89 | 6.40 | 9.13 | 5.39 | 4.23 | 3.75 | 6.16 | | | | |
| NT2RP3000047 | 6.44 | 3.75 | 3.07 | 4.50 | 4.32 | 4.37 | 3.44 | 4.24 | 4.69 | | | | |
| NT2RP3000049 | 3.94 | 3.36 | 1.85 | 3.67 | 6.35 | 6.22 | 5.02 | 4.43 | 8.2 | | | | |
| NT2RP3000050 | 7.94 | 4.67 | 6.52 | 13.03 | 15.60 | 12.76 | 7.92 | 7.66 | 10.86 | ** | + | | |
| NT2RP3000051 | 6.26 | 3.23 | 4.99 | 9.29 | 9.59 | 8.78 | 5.46 | 7.17 | 6.65 | ** | + | | |
| NT2RP3000054 | 6.09 | 3.47 | 4.38 | 5.67 | 6.99 | 5.26 | 5.01 | 4.84 | 5.62 | | | | |
| NT2RP3000055 | 3.24 | 2.73 | 0.81 | 4.89 | 4.66 | 2.53 | 2.67 | 2.43 | 3.79 | | | | |
| NT2RP3000056 | 2.70 | 3.24 | 1.60 | 2.60 | 3.66 | 2.74 | 3.75 | 2.94 | 3.3 | | | | |
| NT2RP3000059 | 4.21 | 2.87 | 2.12 | 3.45 | 3.50 | 3.02 | 3.35 | 3.22 | 4.21 | | | | |
| NT2RP3000063 | 7.78 | 5.44 | 6.74 | 6.64 | 5.14 | 7.47 | 6.5 | 8.34 | 4.12 | | | | |
| NT2RP3000068 | 1.30 | 1.86 | 2.21 | 1.64 | 3.20 | 2.26 | 2.1 | 3.07 | 3.12 | | | | |
| NT2RP3000069 | 3.21 | 2.16 | 2.26 | 10.79 | 10.68 | 7.75 | 8.64 | 7.90 | 7.98 | ** | + | ** | + |
| NT2RP3000072 | 2.08 | 1.15 | 1.36 | 3.34 | 2.75 | 2.73 | 2.05 | 3.07 | 2.12 | * | + | | |
| NT2RP3000080 | 12.90 | 8.84 | 11.62 | 14.83 | 16.14 | 12.41 | 14.4 | 11.56 | 12.15 | | | | |
| NT2RP3000085 | 4.82 | 2.44 | 2.00 | 2.73 | 3.07 | 3.01 | 2.95 | 2.26 | 2.49 | | | | |
| NT2RP3000087 | 12.35 | 7.36 | 5.97 | 19.26 | 20.25 | 18.12 | 12.89 | 8.99 | 10.11 | ** | + | | |
| NT2RP3000092 | 2.83 | 2.11 | 1.59 | 4.04 | 2.45 | 1.56 | 2.71 | 2.87 | 2.87 | | | | |

TABLE 258-continued

| | | | | | | | | | | | |
|---|---|---|---|---|---|---|---|---|---|---|---|
| NT2RP3000109 | 1.75 | 1.89 | 2.71 | 5.02 | 4.39 | 3.90 | 1.58 | 3.14 | 1.97 | ** | + |
| NT2RP3000119 | 10.48 | 4.74 | 6.30 | 7.48 | 8.15 | 6.85 | 5.44 | 7.67 | 7.52 | | |
| NT2RP3000125 | 9.53 | 6.24 | 6.75 | 10.54 | 13.59 | 12.33 | 7.17 | 8.82 | 6.83 | * | + |
| NT2RP3000131 | 13.37 | 7.84 | 8.67 | 12.43 | 13.75 | 13.12 | 11.27 | 10.91 | 10.26 | | |
| NT2RP3000134 | 8.39 | 4.00 | 4.04 | 11.86 | 8.47 | 11.09 | 6.57 | 5.88 | 5.18 | * | + |
| NT2RP3000137 | 7.33 | 3.86 | 4.11 | 4.55 | 10.23 | 5.70 | 5.38 | 4.77 | 5.25 | | |
| NT2RP3000142 | 8.58 | 2.85 | 3.30 | 8.25 | 6.01 | 4.98 | 4.9 | 4.68 | 4.51 | | |
| NT2RP3000148 | 6.50 | 3.03 | 2.82 | 4.77 | 5.93 | 4.35 | 4.39 | 4.87 | 3.31 | | |
| NT2RP3000149 | 7.40 | 4.34 | 3.38 | 4.95 | 6.06 | 4.71 | 3.65 | 4.88 | 5.43 | | |
| NT2RP3000163 | 5.34 | 2.10 | 2.73 | 5.49 | 7.84 | 4.53 | 2.61 | 3.70 | 2.68 | | |
| NT2RP3000168 | 17.73 | 9.34 | 8.35 | 13.43 | 12.52 | 14.26 | 15.5 | 18.99 | 23.37 | | |
| NT2RP3000169 | 2.79 | 1.47 | 1.93 | 3.28 | 2.66 | 2.80 | 2.69 | 4.02 | 3.92 | | |
| NT2RP3000171 | 30.99 | 20.17 | 24.95 | 41.61 | 37.53 | 33.55 | 22.47 | 25.44 | 33.88 | * | + |
| NT2RP3000172 | 5.29 | 2.13 | 2.18 | 3.70 | 4.85 | 1.88 | 2.31 | 1.91 | 2.23 | | |
| NT2RP3000186 | 16.37 | 8.43 | 6.94 | 11.35 | 12.10 | 6.88 | 5.69 | 5.57 | 6.97 | | |
| NT2RP3000197 | 2.96 | 2.49 | 2.66 | 5.21 | 6.67 | 3.78 | 2.54 | 2.96 | 3.64 | * | + |
| NT2RP3000201 | 11.54 | 5.67 | 6.73 | 11.59 | 11.99 | 10.04 | 5.11 | 5.52 | 10.33 | | |
| NT2RP3000204 | 3.53 | 2.05 | 1.72 | 2.68 | 3.65 | 3.34 | 1.75 | 3.41 | 1.98 | | |
| NT2RP3000207 | 4.88 | 2.36 | 2.46 | 3.16 | 3.56 | 3.29 | 4.1 | 5.13 | 6.04 | | |
| NT2RP3000216 | 8.62 | 6.38 | 5.44 | 6.42 | 8.59 | 6.54 | 8.63 | 6.16 | 7.72 | | |
| NT2RP3000220 | 2.88 | 1.23 | 2.50 | 2.75 | 3.70 | 2.71 | 2.57 | 3.23 | 2.33 | | |
| NT2RP3000221 | 4.47 | 2.97 | 2.52 | 4.75 | 5.82 | 4.37 | 3.89 | 3.79 | 4.34 | | |

TABLE 259

| | | | | | | | | | | | | | |
|---|---|---|---|---|---|---|---|---|---|---|---|---|---|
| NT2RP3000232 | 7.80 | 2.59 | 4.87 | 14.07 | 13.78 | 10.58 | 4.43 | 6.16 | 6.42 | * | + | | |
| NT2RP3000233 | 4.29 | 2.04 | 3.30 | 4.16 | 4.02 | 3.58 | 3.88 | 4.05 | 3.95 | | | | |
| NT2RP3000234 | 5.82 | 3.69 | 3.99 | 6.88 | 6.24 | 5.76 | 5.09 | 5.25 | 5.52 | | | | |
| NT2RP3000235 | 4.07 | 2.16 | 2.75 | 4.46 | 3.39 | 3.79 | 3.35 | 4.56 | 3.36 | | | | |
| NT2RP3000239 | 7.80 | 3.65 | 4.61 | 5.36 | 6.98 | 5.05 | 3.92 | 4.89 | 7.01 | | | | |
| NT2RP3000247 | 2.30 | 1.21 | 1.95 | 2.12 | 2.01 | 2.94 | 1.85 | 3.86 | 2.35 | | | | |
| NT2RP3000251 | 8.89 | 5.54 | 6.24 | 11.87 | 10.35 | 8.87 | 9.19 | 9.33 | 7.77 | | | | |
| NT2RP3000252 | 15.04 | 4.46 | 4.08 | 9.00 | 9.21 | 5.83 | 5.52 | 5.10 | 6.74 | | | | |
| NT2RP3000255 | 5.13 | 2.85 | 2.23 | 3.53 | 3.93 | 3.32 | 2.12 | 2.52 | 4.46 | | | | |
| NT2RP3000262 | 7.20 | 3.34 | 3.67 | 7.23 | 8.28 | 5.67 | 4.7 | 4.54 | 3.81 | | | | |
| NT2RP3000266 | 13.99 | 6.47 | 5.93 | 16.36 | 16.88 | 13.38 | 9.91 | 14.29 | 13.15 | | | | |
| NT2RP3000267 | 4.19 | 1.73 | 1.51 | 3.08 | 4.17 | 2.39 | 2.28 | 3.19 | 2.31 | | | | |
| NT2RP3000271 | 7.47 | 3.16 | 2.85 | 7.84 | 6.39 | 5.57 | 3.5 | 5.30 | 3.75 | | | | |
| NT2RP3000278 | 3.14 | 2.04 | 3.02 | 4.79 | 6.42 | 5.26 | 3.22 | 5.70 | 4.21 | ** | + | | |
| NT2RP3000281 | 7.14 | 3.51 | 4.30 | 9.39 | 7.57 | 6.94 | 6.62 | 8.48 | 7.76 | | | | |
| NT2RP3000292 | 2.43 | 1.31 | 1.46 | 1.66 | 2.08 | 1.80 | 2.97 | 2.36 | 1.82 | | | | |
| NT2RP3000299 | 3.32 | 1.72 | 2.64 | 3.50 | 2.85 | 1.65 | 3.49 | 2.65 | 2.85 | | | | |
| NT2RP3000304 | 7.20 | 4.06 | 3.87 | 3.27 | 5.90 | 6.50 | 4.23 | 4.68 | 5.46 | | | | |
| NT2RP3000310 | 9.88 | 5.44 | 4.97 | 10.57 | 8.79 | 8.65 | 8.38 | 7.53 | 9.91 | | | | |
| NT2RP3000312 | 4.71 | 2.11 | 3.36 | 4.19 | 4.91 | 4.91 | 2.11 | 3.53 | 4.02 | | | | |
| NT2RP3000320 | 9.82 | 2.79 | 5.46 | 8.18 | 6.79 | 9.80 | 7.95 | 7.10 | 16.94 | | | | |
| NT2RP3000322 | 30.65 | 18.22 | 26.99 | 58.85 | 49.93 | 31.40 | 36.14 | 39.97 | 34.74 | | | * | + |
| NT2RP3000324 | 2.18 | 1.49 | 1.41 | 2.10 | 2.20 | 2.50 | 2.87 | 1.62 | 1.63 | | | | |
| NT2RP3000326 | 4.07 | 2.09 | 2.65 | 6.40 | 4.79 | 6.20 | 5.05 | 3.50 | 3.68 | * | + | | |
| NT2RP3000329 | 8.08 | 3.03 | 2.39 | 13.04 | 10.42 | 8.93 | 5.43 | 5.08 | 6.48 | * | + | | |
| NT2RP3000330 | 6.13 | 3.81 | 4.47 | 3.99 | 4.93 | 3.61 | 5.76 | 6.52 | 5.37 | | | | |
| NT2RP3000333 | 3.58 | 1.99 | 1.19 | 2.09 | 2.88 | 2.04 | 2.14 | 2.57 | 2.31 | | | | |
| NT2RP3000341 | 13.34 | 6.74 | 7.40 | 16.98 | 14.13 | 16.48 | 11.16 | 11.51 | 12.58 | * | + | | |
| NT2RP3000344 | 2.19 | 2.15 | 1.77 | 2.27 | 1.91 | 1.50 | 1.56 | 1.76 | 2.32 | | | | |
| NT2RP3000345 | 0.88 | 0.64 | 0.51 | 3.07 | 2.22 | 3.27 | 0.95 | 0.77 | 2.11 | ** | + | | |
| NT2RP3000348 | 112.18 | 53.12 | 48.19 | 87.36 | 67.82 | 76.37 | 170.4 | 141.05 | 175.2 | | | * | + |
| NT2RP3000350 | 13.69 | 7.30 | 6.99 | 9.25 | 9.00 | 7.77 | 7.42 | 5.74 | 8.01 | | | | |
| NT2RP3000359 | 10.64 | 6.49 | 5.35 | 19.00 | 17.38 | 16.68 | 15.5 | 13.49 | 16.08 | ** | + | * | + |
| NT2RP3000361 | 10.35 | 4.92 | 4.34 | 11.24 | 6.97 | 7.55 | 6.16 | 6.69 | 7.28 | | | | |
| NT2RP3000366 | 7.65 | 3.30 | 4.82 | 9.45 | 14.23 | 10.18 | 10.84 | 11.42 | 12.66 | * | + | ** | + |
| NT2RP3000378 | 4.91 | 3.67 | 4.88 | 5.34 | 6.49 | 6.00 | 4.34 | 4.99 | 3.64 | | | | |
| NT2RP3000384 | 6.56 | 5.43 | 5.50 | 8.93 | 9.13 | 11.76 | 6.91 | 6.90 | 7.16 | * | + | * | + |
| NT2RP3000389 | 14.26 | 10.15 | 11.05 | 22.04 | 27.40 | 18.38 | 12.47 | 13.44 | 23.39 | * | + | | |
| NT2RP3000393 | 5.27 | 3.15 | 2.77 | 4.98 | 4.37 | 4.43 | 4.32 | 3.00 | 3.71 | | | | |
| NT2RP3000395 | 121.26 | 84.54 | 65.25 | 98.14 | 119.90 | 103.24 | 32.56 | 26.84 | 40.17 | | | * | − |
| NT2RP3000397 | 3.69 | 4.24 | 2.44 | 2.76 | 4.13 | 3.97 | 3.48 | 2.62 | 4.13 | | | | |
| NT2RP3000398 | 6.97 | 4.09 | 4.94 | 8.35 | 10.97 | 6.66 | 5.51 | 6.21 | 5.86 | | | | |
| NT2RP3000403 | 4.82 | 3.83 | 4.35 | 9.87 | 12.59 | 8.19 | 6.65 | 6.56 | 8.79 | * | + | * | + |
| NT2RP3000418 | 4.00 | 2.62 | 2.61 | 8.58 | 12.65 | 8.62 | 5.36 | 6.28 | 7.5 | ** | + | * | + |
| NT2RP3000424 | 5.08 | 4.11 | 3.96 | 14.10 | 16.88 | 10.90 | 8.47 | 7.77 | 7.95 | ** | + | ** | + |
| NT2RP3000427 | 2.50 | 1.80 | 2.77 | 5.73 | 6.63 | 8.27 | 3.99 | 5.02 | 3.87 | ** | + | * | + |
| NT2RP3000431 | 3.51 | 2.32 | 1.35 | 4.97 | 4.03 | 2.77 | 4.39 | 4.52 | 3.47 | | | | |
| NT2RP3000433 | 4.48 | 3.35 | 3.32 | 4.96 | 5.89 | 5.97 | 3.9 | 4.05 | 4.56 | * | + | | |
| NT2RP3000436 | 11.10 | 6.79 | 5.28 | 9.34 | 10.99 | 9.24 | 10.36 | 9.52 | 16.87 | | | | |
| NT2RP3000439 | 5.21 | 2.28 | 1.00 | 3.90 | 7.56 | 3.69 | 3.69 | 4.00 | 3.42 | | | | |
| NT2RP3000441 | 1.19 | 0.92 | 0.83 | 1.64 | 2.07 | 1.50 | 2.8 | 3.37 | 2.81 | * | + | ** | + |

TABLE 259-continued

| | | | | | | | | | | | | |
|---|---|---|---|---|---|---|---|---|---|---|---|---|
| NT2RP3000444 | 2.26 | 2.00 | 1.85 | 2.13 | 2.91 | 3.48 | 2.82 | 2.26 | 2.53 | | | |
| NT2RP3000448 | 3.48 | 2.24 | 1.61 | 8.12 | 11.89 | 8.40 | 5.13 | 4.03 | 6.51 | ** | + | |
| NT2RP3000449 | 5.49 | 2.45 | 3.20 | 2.67 | 4.04 | 3.28 | 1.61 | 2.66 | 1.96 | | | |
| NT2RP3000451 | 5.47 | 3.68 | 2.74 | 2.86 | 3.50 | 4.17 | 4.01 | 4.24 | 4.31 | | | |
| NT2RP3000456 | 4.82 | 4.21 | 3.70 | 3.94 | 5.59 | 4.96 | 4.41 | 3.70 | 5.42 | | | |

TABLE 260

| | | | | | | | | | | | | |
|---|---|---|---|---|---|---|---|---|---|---|---|---|
| NT2RP3000460 | 6.78 | 3.61 | 3.73 | 8.08 | 8.65 | 7.41 | 13.4 | 12.29 | 10.37 | * | + | ** | + |
| NT2RP3000471 | 6.95 | 4.34 | 4.50 | 7.79 | 8.60 | 6.26 | 4.55 | 7.24 | 5.12 | | | |
| NT2RP3000477 | 21.65 | 12.36 | 9.87 | 23.85 | 19.48 | 15.72 | 11.17 | 14.00 | 11.16 | | | |
| NT2RP3000478 | 7.29 | 4.54 | 5.34 | 13.47 | 15.94 | 11.73 | 8.07 | 4.43 | 7.92 | ** | + | |
| NT2RP3000481 | 0.63 | 0.59 | 0.73 | 1.35 | 1.95 | 1.38 | 0.46 | 2.40 | 1.02 | * | + | |
| NT2RP3000484 | 1.55 | 0.72 | 1.25 | 1.68 | 2.10 | 2.87 | 1.12 | 2.90 | 1.09 | | | |
| NT2RP3000487 | 5.07 | 1.99 | 2.06 | 3.79 | 5.91 | 4.35 | 2.41 | 2.16 | 2.61 | | | |
| NT2RP3000512 | 6.71 | 4.34 | 3.46 | 3.23 | 5.10 | 5.08 | 2.77 | 4.20 | 4.93 | | | |
| NT2RP3000523 | 27.58 | 15.65 | 17.30 | 17.42 | 22.63 | 15.01 | 11.77 | 10.31 | 9.03 | | | |
| NT2RP3000526 | 2.57 | 1.90 | 3.01 | 5.30 | 4.16 | 4.98 | 2.88 | 5.37 | 3.11 | ** | + | |
| NT2RP3000527 | 3.80 | 1.53 | 2.25 | 4.05 | 4.14 | 5.85 | 2.46 | 3.30 | 2.31 | | | |
| NT2RP3000531 | 15.89 | 10.13 | 8.97 | 23.60 | 23.41 | 21.43 | 13.33 | 15.19 | 15.55 | ** | + | |
| NT2RP3000532 | 6.87 | 3.91 | 4.69 | 7.54 | 6.97 | 6.82 | 3.54 | 4.64 | 3.97 | | | |
| NT2RP3000542 | 4.26 | 2.58 | 3.40 | 6.33 | 6.95 | 7.50 | 5.58 | 5.25 | 4.09 | ** | + | |
| NT2RP3000554 | 21.26 | 8.36 | 10.64 | 9.79 | 12.63 | 8.67 | 7.85 | 5.66 | 7.16 | | | |
| NT2RP3000561 | 1.72 | 1.29 | 0.49 | 4.36 | 4.39 | 2.75 | 5.41 | 6.15 | 4.61 | * | + | ** | + |
| NT2RP3000562 | 5.35 | 3.52 | 2.70 | 6.24 | 5.67 | 6.85 | 4.69 | 5.36 | 4.51 | * | + | |
| NT2RP3000578 | 2.48 | 1.13 | 0.91 | 1.41 | 2.33 | 1.20 | 1.51 | 2.72 | 1.83 | | | |
| NT2RP3000582 | 2.70 | 1.06 | 2.14 | 1.55 | 1.76 | 2.00 | 1.13 | 2.91 | 1.43 | | | |
| NT2RP3000584 | 3.87 | 1.71 | 2.00 | 3.83 | 3.38 | 4.15 | 1.95 | 3.50 | 3.43 | | | |
| NT2RP3000586 | 4.68 | 3.18 | 3.48 | 5.21 | 5.82 | 4.88 | 4.06 | 4.66 | 4.73 | * | + | |
| NT2RP3000590 | 3.21 | 1.61 | 2.30 | 2.02 | 1.87 | 2.52 | 1.95 | 2.50 | 2.25 | | | |
| NT2RP3000592 | 2.67 | 1.26 | 1.45 | 1.25 | 2.76 | 1.46 | 1.33 | 1.90 | 1.13 | | | |
| NT2RP3000596 | 20.65 | 9.80 | 8.82 | 23.94 | 26.59 | 16.13 | 11.86 | 9.91 | 14.07 | | | |
| NT2RP3000599 | 3.31 | 1.41 | 2.33 | 3.96 | 4.14 | 2.63 | 2.43 | 4.34 | 3.3 | | | |
| NT2RP3000603 | 4.81 | 2.59 | 2.37 | 5.30 | 5.93 | 6.54 | 3.73 | 4.56 | 4.65 | * | + | |
| NT2RP3000605 | 2.51 | 1.85 | 1.50 | 3.30 | 3.59 | 2.96 | 2.17 | 4.09 | 3.29 | * | + | |
| NT2RP3000607 | 7.51 | 5.55 | 8.79 | 5.67 | 5.09 | 3.67 | 3.76 | 3.78 | 3.57 | | | * | − |
| NT2RP3000616 | 2.94 | 0.94 | 1.60 | 3.25 | 4.41 | 3.35 | 2.18 | 3.01 | 2.34 | | | |
| NT2RP3000621 | 4.36 | 2.30 | 3.65 | 4.44 | 7.67 | 4.30 | 4.7 | 5.31 | 5.41 | | | |
| NT2RP3000622 | 6.01 | 4.28 | 3.80 | 5.09 | 7.11 | 5.45 | 5.08 | 3.73 | 3.94 | | | |
| NT2RP3000624 | 7.72 | 5.67 | 3.32 | 6.67 | 8.14 | 5.52 | 5.24 | 3.13 | 5.14 | | | |
| NT2RP3000628 | 7.54 | 4.50 | 3.20 | 10.58 | 21.80 | 10.94 | 10.01 | 5.74 | 10.27 | | | |
| NT2RP3000631 | 16.09 | 7.17 | 9.25 | 14.57 | 17.16 | 15.18 | 7.31 | 8.71 | 8.97 | | | |
| NT2RP3000632 | 7.31 | 3.75 | 5.02 | 6.89 | 10.18 | 9.21 | 4.07 | 4.61 | 4.79 | | | |
| NT2RP3000638 | 7.68 | 5.11 | 4.32 | 4.07 | 4.85 | 4.59 | 5.9 | 6.86 | 5.24 | | | |
| NT2RP3000644 | 19.00 | 10.57 | 14.03 | 22.53 | 22.68 | 23.63 | 19.34 | 20.74 | 17.56 | * | + | |
| NT2RP3000645 | 22.63 | 12.76 | 16.07 | 25.22 | 24.49 | 30.53 | 19.65 | 22.44 | 19.81 | | | |
| NT2RP3000652 | 25.30 | 13.23 | 15.28 | 45.18 | 43.44 | 33.63 | 16.17 | 15.59 | 14.77 | * | + | |
| NT2RP3000658 | 10.87 | 4.28 | 5.61 | 9.08 | 8.70 | 4.57 | 4.84 | 5.59 | 6.4 | | | |
| NT2RP3000660 | 7.86 | 3.20 | 4.43 | 11.71 | 10.96 | 7.67 | 5.63 | 5.73 | 5.08 | | | |
| NT2RP3000661 | 5.33 | 3.07 | 4.20 | 8.73 | 10.09 | 5.63 | 4.67 | 5.28 | 4.19 | | | |
| NT2RP3000665 | 6.64 | 1.93 | 2.75 | 5.80 | 4.45 | 4.67 | 4.17 | 5.21 | 4.12 | | | |
| NT2RP3000676 | 8.20 | 4.06 | 3.78 | 8.46 | 10.33 | 8.20 | 6.83 | 8.27 | 6.88 | | | |
| NT2RP3000677 | 4.44 | 2.49 | 3.08 | 10.60 | 15.84 | 15.84 | 2.62 | 4.06 | 2.32 | ** | + | |
| NT2RP3000681 | 16.25 | 8.48 | 11.24 | 17.10 | 13.94 | 12.61 | 11.39 | 15.24 | 10.7 | | | |
| NT2RP3000683 | 10.17 | 2.34 | 3.24 | 19.41 | 15.14 | 11.09 | 6.65 | 5.82 | 9.12 | * | + | |
| NT2RP3000685 | 7.81 | 3.42 | 2.68 | 6.13 | 4.88 | 5.09 | 4.14 | 3.91 | 7.49 | | | |
| NT2RP3000690 | 3.45 | 1.81 | 2.38 | 2.69 | 3.42 | 3.19 | 1.6 | 4.35 | 4 | | | |
| NT2RP3000698 | 3.44 | 1.71 | 1.90 | 3.98 | 4.36 | 3.04 | 3.05 | 5.26 | 3.03 | | | |
| NT2RP3000708 | 8.35 | 3.44 | 2.85 | 6.09 | 5.53 | 5.09 | 2.92 | 4.17 | 5.63 | | | |
| NT2RP3000719 | 6.12 | 2.90 | 4.00 | 7.25 | 5.34 | 4.25 | 3.6 | 5.95 | 3.12 | | | |
| NT2RP3000721 | 4.08 | 2.25 | 2.01 | 4.97 | 4.56 | 3.47 | 2.13 | 3.08 | 2.89 | | | |
| NT2RP3000728 | 2.25 | 0.64 | 0.87 | 2.34 | 2.75 | 2.13 | 0.67 | 2.18 | 0.8 | | | |
| NT2RP3000730 | 1.35 | 0.93 | 1.10 | 1.92 | 2.14 | 1.30 | 2.2 | 1.20 | 1.35 | | | |
| NT2RP3000733 | 4.35 | 2.50 | 1.71 | 6.01 | 6.36 | 4.79 | 3.49 | 3.48 | 2.85 | * | + | |

TABLE 261

| | | | | | | | | | | | | |
|---|---|---|---|---|---|---|---|---|---|---|---|---|
| NT2RP3000735 | 2.00 | 1.20 | 0.61 | 2.06 | 0.92 | 1.03 | 2.17 | 1.47 | 1.63 | | | |
| NT2RP3000736 | 3.46 | 3.21 | 3.33 | 4.48 | 4.58 | 3.34 | 3.43 | 2.28 | 2.96 | | | |
| NT2RP3000739 | 15.24 | 8.34 | 8.12 | 11.53 | 11.36 | 10.77 | 13.58 | 12.81 | 14.45 | | | |
| NT2RP3000742 | 15.14 | 9.63 | 9.98 | 14.05 | 14.60 | 13.15 | 13.09 | 11.17 | 13.06 | | | |
| NT2RP3000753 | 4.09 | 1.46 | 2.26 | 4.87 | 6.45 | 3.41 | 1.81 | 3.35 | 5.41 | | | |
| NT2RP3000759 | 4.36 | 3.02 | 3.28 | 9.27 | 10.72 | 9.10 | 9.4 | 9.92 | 12.65 | ** | + | ** | + |
| NT2RP3000789 | 6.97 | 3.15 | 3.19 | 2.62 | 3.38 | 3.33 | 2.9 | 2.77 | 2.91 | | | |

TABLE 261-continued

| | | | | | | | | | | | | | |
|---|---|---|---|---|---|---|---|---|---|---|---|---|---|
| NT2RP3000815 | 3.08 | 1.87 | 2.78 | 5.08 | 5.91 | 5.79 | 4.34 | 3.06 | 3.33 | ** | + | | |
| NT2RP3000818 | 7.88 | 5.88 | 4.83 | 9.79 | 13.01 | 13.93 | 8.4 | 7.38 | 10.56 | * | + | | |
| NT2RP3000820 | 6.70 | 4.35 | 2.57 | 15.50 | 20.24 | 18.97 | 5.35 | 5.01 | 5.38 | ** | + | | |
| NT2RP3000821 | 6.58 | 4.20 | 3.95 | 5.67 | 6.08 | 4.63 | 5.13 | 4.56 | 4.66 | | | | |
| NT2RP3000825 | 0.66 | 0.26 | 0.38 | 1.28 | 1.09 | 2.20 | 0.44 | 1.29 | 0.44 | * | + | | |
| NT2RP3000826 | 14.31 | 7.15 | 8.00 | 20.59 | 14.43 | 14.08 | 24 | 29.57 | 29.39 | | | ** | + |
| NT2RP3000836 | 8.67 | 4.78 | 5.47 | 15.61 | 15.21 | 9.41 | 7.61 | 8.53 | 8.85 | * | + | | |
| NT2RP3000838 | 69.68 | 35.31 | 38.08 | 62.74 | 50.92 | 57.55 | 114.4 | 92.67 | 110.6 | | | * | + |
| NT2RP3000839 | 3.11 | 1.70 | 2.32 | 2.00 | 3.56 | 1.87 | 3.03 | 1.30 | 2.5 | | | | |
| NT2RP3000841 | 4.62 | 3.46 | 2.85 | 4.30 | 8.16 | 5.93 | 4.11 | 3.68 | 3.13 | | | | |
| NT2RP3000845 | 4.22 | 3.31 | 3.16 | 4.56 | 7.12 | 4.56 | 4.69 | 3.53 | 11.01 | | | | |
| NT2RP3000847 | 8.01 | 5.03 | 4.67 | 11.17 | 12.10 | 10.61 | 8.29 | 6.56 | 5.96 | ** | + | | |
| NT2RP3000848 | 4.58 | 2.34 | 3.27 | 5.39 | 6.00 | 5.09 | 3.72 | 3.05 | 5.42 | * | + | | |
| NT2RP3000850 | 7.12 | 3.32 | 4.95 | 11.87 | 12.25 | 13.21 | 7.48 | 7.20 | 7.92 | ** | + | | |
| NT2RP3000852 | 2.41 | 2.02 | 3.14 | 2.50 | 3.10 | 2.98 | 1.15 | 2.04 | 2 | | | | |
| NT2RP3000859 | 11.57 | 6.45 | 2.66 | 9.86 | 9.35 | 7.35 | 6.51 | 5.86 | 6.19 | | | | |
| NT2RP3000861 | 12.29 | 5.70 | 6.74 | 20.57 | 26.68 | 20.53 | 8.96 | 8.46 | 14.99 | ** | + | | |
| NT2RP3000862 | 10.74 | 6.85 | 6.61 | 6.87 | 7.71 | 5.23 | 6.09 | 5.39 | 7.24 | | | | |
| NT2RP3000865 | 2.61 | 2.77 | 1.86 | 4.46 | 4.70 | 3.49 | 3.05 | 2.82 | 3.22 | * | + | | |
| NT2RP3000866 | 3.65 | 3.07 | 3.41 | 3.79 | 4.93 | 3.08 | 2.95 | 3.92 | 4.36 | | | | |
| NT2RP3000868 | 6.63 | 4.07 | 4.55 | 6.52 | 6.19 | 4.40 | 5.59 | 4.36 | 6.01 | | | | |
| NT2RP3000869 | 7.38 | 5.89 | 6.47 | 6.37 | 7.71 | 6.66 | 5.72 | 5.36 | 5.4 | | | | |
| NT2RP3000871 | 2.80 | 1.69 | 2.21 | 3.13 | 2.44 | 2.63 | 2.19 | 2.91 | 2.3 | | | | |
| NT2RP3000875 | 6.14 | 2.07 | 3.11 | 2.15 | 2.68 | 3.67 | 3.92 | 2.74 | 3.62 | | | | |
| NT2RP3000895 | 3.27 | 2.20 | 2.57 | 3.83 | 6.39 | 6.15 | 3.73 | 2.67 | 3.88 | * | + | | |
| NT2RP3000900 | 9.85 | 5.60 | 5.12 | 11.99 | 12.50 | 10.94 | 7.71 | 7.19 | 8.22 | * | + | | |
| NT2RP3000901 | 5.01 | 2.45 | 2.11 | 6.45 | 8.36 | 6.11 | 4.49 | 5.69 | 7.42 | * | + | | |
| NT2RP3000903 | 2.28 | 1.60 | 1.75 | 4.44 | 6.62 | 5.24 | 4.43 | 2.98 | 3.76 | ** | + | * | + |
| NT2RP3000904 | 2.30 | 1.61 | 2.05 | 2.19 | 1.89 | 3.97 | 2.54 | 3.22 | 2.14 | | | | |
| NT2RP3000907 | 9.61 | 6.08 | 7.44 | 8.62 | 11.64 | 8.56 | 8.91 | 8.78 | 9.69 | | | | |
| NT2RP3000913 | 7.70 | 2.80 | 3.71 | 8.25 | 8.06 | 6.91 | 5.87 | 6.50 | 4.94 | | | | |
| NT2RP3000917 | 10.36 | 7.31 | 5.72 | 9.00 | 16.41 | 11.45 | 7.56 | 6.56 | 8.24 | | | | |
| NT2RP3000919 | 5.76 | 4.04 | 3.02 | 5.13 | 7.71 | 4.25 | 4.75 | 6.45 | 6.91 | | | | |
| NT2RP3000921 | 3.51 | 1.70 | 2.76 | 4.60 | 7.92 | 2.75 | 6.8 | 3.67 | 4.11 | | | | |
| NT2RP3000942 | 9.61 | 5.52 | 5.34 | 12.62 | 14.38 | 12.46 | 6.8 | 6.53 | 7.24 | * | + | | |
| NT2RP3000968 | 103.66 | 58.95 | 83.91 | 147.53 | 158.89 | 133.89 | 55.3 | 53.20 | 43.04 | * | + | | |
| NT2RP3000974 | 3.04 | 1.59 | 2.65 | 3.97 | 5.03 | 4.21 | 2.71 | 3.66 | 2.41 | * | + | | |
| NT2RP3000980 | 39.62 | 20.55 | 29.98 | 6.47 | 9.37 | 6.00 | 4.91 | 6.99 | 8.46 | * | − | * | − |
| NT2RP3000984 | 5.29 | 4.18 | 5.73 | 10.16 | 10.11 | 7.87 | 6.25 | 8.85 | 4.44 | ** | + | | |
| NT2RP3000994 | 3.63 | 2.42 | 1.96 | 4.75 | 5.40 | 3.69 | 3.58 | 4.22 | 3.83 | | | | |
| NT2RP3001001 | 3.47 | 2.25 | 3.10 | 3.83 | 2.41 | 2.13 | 2.68 | 3.98 | 2.58 | | | | |
| NT2RP3001004 | 1.80 | 1.40 | 1.87 | 2.71 | 2.31 | 1.48 | 2.16 | 4.18 | 3 | | | | |
| NT2RP3001007 | 4.63 | 2.03 | 2.66 | 14.00 | 6.75 | 8.49 | 6.39 | 6.25 | 5.07 | * | + | * | + |
| NT2RP3001012 | 5.10 | 1.75 | 3.11 | 5.04 | 4.34 | 5.34 | 2.86 | 4.75 | 2.29 | | | | |
| NT2RP3001042 | 5.71 | 3.43 | 4.72 | 5.27 | 4.96 | 3.88 | 3.98 | 3.86 | 2.98 | | | | |
| NT2RP3001044 | 7.02 | 3.73 | 5.60 | 14.85 | 12.04 | 12.37 | 9.89 | 10.94 | 7.73 | ** | + | * | + |
| NT2RP3001048 | 2.35 | 1.96 | 3.94 | 3.25 | 4.98 | 4.26 | 3.16 | 2.56 | 3.24 | | | | |
| NT2RP3001050 | 11.91 | 8.75 | 3.68 | 7.09 | 10.52 | 7.57 | 19.34 | 10.54 | 18.84 | | | | |
| NT2RP3001055 | 19.61 | 12.87 | 10.53 | 9.87 | 9.64 | 7.47 | 11.2 | 7.71 | 10.89 | | | | |

TABLE 262

| | | | | | | | | | | | | | |
|---|---|---|---|---|---|---|---|---|---|---|---|---|---|
| NT2RP3001057 | 8.67 | 4.03 | 5.93 | 19.26 | 14.18 | 12.30 | 8.42 | 6.94 | 7.2 | * | + | | |
| NT2RP3001061 | 5.88 | 4.01 | 4.14 | 7.75 | 9.70 | 8.03 | 5.42 | 6.19 | 4.88 | * | + | | |
| NT2RP3001069 | 9.78 | 4.93 | 5.43 | 13.99 | 17.62 | 14.76 | 9.74 | 9.96 | 12.86 | ** | + | | |
| NT2RP3001074 | 8.31 | 4.57 | 4.04 | 11.86 | 10.34 | 7.95 | 6.59 | 7.36 | 7.45 | | | | |
| NT2RP3001078 | 5.34 | 2.26 | 4.49 | 9.51 | 7.77 | 7.53 | 5.94 | 3.60 | 5.02 | * | + | | |
| NT2RP3001081 | 3.83 | 2.45 | 4.20 | 6.12 | 3.89 | 6.40 | 3.56 | 5.22 | 3.4 | | | | |
| NT2RP3001084 | 5.54 | 2.82 | 2.70 | 2.36 | 4.10 | 1.78 | 2.85 | 2.45 | 3.36 | | | | |
| NT2RP3001095 | 1.93 | 1.69 | 1.44 | 3.80 | 3.49 | 3.25 | 2.25 | 2.83 | 2.47 | ** | + | * | + |
| NT2RP3001096 | 4.61 | 2.92 | 2.43 | 5.50 | 5.58 | 4.69 | 7.37 | 7.57 | 7.11 | | | ** | + |
| NT2RP3001097 | 9.61 | 7.40 | 9.00 | 12.56 | 12.16 | 11.92 | 6.67 | 6.88 | 9.12 | ** | + | | |
| NT2RP3001107 | 6.04 | 4.02 | 3.50 | 4.89 | 5.87 | 4.23 | 3.8 | 4.49 | 5.02 | | | | |
| NT2RP3001109 | 6.26 | 3.05 | 4.30 | 3.18 | 4.47 | 2.65 | 2.28 | 2.72 | 1.85 | | | | |
| NT2RP3001111 | 4.22 | 3.38 | 2.92 | 4.13 | 5.15 | 4.60 | 4.36 | 4.69 | 3.98 | | | | |
| NT2RP3001112 | 28.16 | 25.89 | 21.28 | 24.06 | 17.68 | 24.85 | 10.06 | 10.75 | 13.22 | | | ** | − |
| NT2RP3001113 | 1.79 | 0.99 | 0.62 | 1.34 | 2.23 | 1.54 | 1.11 | 1.24 | 1.25 | | | | |
| NT2RP3001115 | 3.88 | 1.85 | 2.25 | 7.26 | 3.45 | 2.57 | 3.4 | 3.91 | 4.67 | | | | |
| NT2RP3001116 | 3.94 | 1.69 | 1.56 | 4.63 | 3.42 | 2.74 | 3.29 | 4.13 | 4.33 | | | | |
| NT2RP3001119 | 9.02 | 6.38 | 5.74 | 6.52 | 9.40 | 7.53 | 6.04 | 4.43 | 6.5 | | | | |
| NT2RP3001120 | 11.82 | 5.87 | 8.94 | 18.20 | 12.33 | 18.08 | 8.42 | 9.14 | 10.96 | * | + | | |
| NT2RP3001126 | 3.38 | 2.35 | 3.59 | 5.64 | 8.45 | 7.51 | 8.01 | 7.65 | 6.3 | * | + | ** | + |
| NT2RP3001127 | 1.21 | 0.67 | 1.51 | 2.88 | 2.70 | 1.71 | 4.11 | 3.13 | 5.1 | * | + | ** | + |
| NT2RP3001133 | 7.23 | 4.12 | 5.49 | 7.95 | 8.82 | 7.67 | 4.57 | 6.00 | 4.72 | | | | |
| NT2RP3001140 | 2.84 | 1.04 | 1.66 | 3.30 | 3.99 | 3.19 | 1.56 | 2.10 | 3.38 | * | + | | |
| NT2RP3001147 | 7.62 | 3.19 | 3.51 | 4.05 | 4.82 | 4.29 | 0.77 | 2.87 | 1.63 | | | | |

TABLE 262-continued

| | | | | | | | | | | | | |
|---|---|---|---|---|---|---|---|---|---|---|---|---|
| NT2RP3001150 | 5.19 | 1.79 | 3.13 | 6.49 | 3.73 | 3.77 | 3.8 | 3.66 | 4.52 | | | |
| NT2RP3001152 | 2.12 | 0.44 | 0.89 | 1.69 | 1.74 | 1.98 | 1.83 | 2.36 | 2.08 | | | |
| NT2RP3001155 | 6.90 | 4.51 | 4.25 | 3.69 | 4.69 | 3.75 | 1.73 | 3.87 | 3.96 | | | |
| NT2RP3001156 | 2.47 | 1.68 | 1.60 | 2.59 | 3.59 | 3.31 | 2.51 | 4.84 | 4.65 | * | + | |
| NT2RP3001159 | 12.19 | 5.40 | 5.34 | 9.00 | 9.95 | 7.35 | 6.84 | 6.11 | 6.14 | | | |
| NT2RP3001170 | 7.10 | 4.60 | 5.72 | 9.66 | 13.09 | 10.69 | 5.5 | 6.89 | 3.71 | * | + | |
| NT2RP3001176 | 9.51 | 3.49 | 2.75 | 17.93 | 12.62 | 10.20 | 6.88 | 5.97 | 13.3 | | | |
| NT2RP3001195 | 6.18 | 2.83 | 2.96 | 6.39 | 10.42 | 3.54 | 4.18 | 5.32 | 5.17 | | | |
| NT2RP3001209 | 29.33 | 14.29 | 10.79 | 23.50 | 28.08 | 21.04 | 16.75 | 19.48 | 15.61 | | | |
| NT2RP3001214 | 6.63 | 3.46 | 3.32 | 9.82 | 10.42 | 9.38 | 3.48 | 5.63 | 3.56 | ** | + | |
| NT2RP3001216 | 4.48 | 3.19 | 3.11 | 7.11 | 8.39 | 8.87 | 2.58 | 5.22 | 3.57 | ** | + | |
| NT2RP3001221 | 1.19 | 0.31 | 0.47 | 1.55 | 1.56 | 1.10 | 1.01 | 2.22 | 0.86 | | | |
| NT2RP3001226 | 7.00 | 2.58 | 2.80 | 4.50 | 5.21 | 4.34 | 3.95 | 5.75 | 3.9 | | | |
| NT2RP3001230 | 2.86 | 1.59 | 1.71 | 4.14 | 3.19 | 2.63 | 1.59 | 3.61 | 2.59 | | | |
| NT2RP3001232 | 4.81 | 1.38 | 0.57 | 1.61 | 2.09 | 1.97 | 2.63 | 1.53 | 0.99 | | | |
| NT2RP3001236 | 1.71 | 1.43 | 0.80 | 2.59 | 2.82 | 2.72 | 3.58 | 2.05 | 2.31 | ** | + | |
| NT2RP3001239 | 2.21 | 1.46 | 1.67 | 2.79 | 2.29 | 1.43 | 3.36 | 2.12 | 2 | | | |
| NT2RP3001240 | 2.39 | 2.60 | 2.79 | 4.11 | 6.20 | 4.44 | 7.84 | 6.72 | 4.74 | * | + | * | + |
| NT2RP3001245 | 3.14 | 1.64 | 2.84 | 6.19 | 9.37 | 6.48 | 4.16 | 3.07 | 4.85 | * | + | |
| NT2RP3001253 | 4.00 | 1.90 | 2.62 | 6.61 | 7.24 | 6.92 | 3.25 | 4.04 | 5.99 | ** | + | |
| NT2RP3001259 | 10.11 | 5.52 | 6.66 | 9.63 | 10.72 | 9.87 | 6.94 | 7.54 | 9.1 | | | |
| NT2RP3001260 | 1.75 | 0.60 | 0.84 | 2.44 | 2.65 | 2.56 | 1.25 | 1.75 | 2.02 | * | + | |
| NT2RP3001264 | 3.80 | 0.98 | 1.35 | 3.72 | 2.40 | 2.94 | 2.21 | 1.54 | 2.06 | | | |
| NT2RP3001268 | 5.50 | 3.38 | 4.02 | 7.85 | 8.76 | 7.64 | 4.87 | 3.66 | 4.6 | ** | + | |
| NT2RP3001271 | 28.62 | 19.09 | 17.03 | 21.24 | 19.12 | 21.60 | 21.92 | 16.59 | 24.45 | | | |
| NT2RP3001272 | 5.76 | 3.32 | 1.84 | 5.66 | 6.83 | 7.58 | 3.78 | 6.70 | 4.51 | | | |
| NT2RP3001274 | 19.11 | 14.57 | 13.97 | 21.86 | 23.69 | 19.32 | 19.59 | 16.07 | 21.69 | * | + | |
| NT2RP3001275 | 3.98 | 2.12 | 2.06 | 4.08 | 3.88 | 3.61 | 4.57 | 5.00 | 3.17 | | | |
| NT2RP3001280 | 5.95 | 4.26 | 3.61 | 5.15 | 6.58 | 6.13 | 4 | 4.48 | 3.31 | | | |
| NT2RP3001281 | 4.63 | 3.14 | 4.04 | 6.78 | 5.25 | 8.51 | 3.4 | 3.74 | 3.77 | * | + | |
| NT2RP3001288 | 14.66 | 10.02 | 11.01 | 19.91 | 17.12 | 14.80 | 31.14 | 30.59 | 36.12 | | | ** | + |
| NT2RP3001297 | 4.65 | 2.39 | 2.87 | 6.59 | 5.46 | 6.16 | 4.33 | 3.73 | 6.69 | * | + | |

TABLE 263

| | | | | | | | | | | | | |
|---|---|---|---|---|---|---|---|---|---|---|---|---|
| NT2RP3001300 | 6.60 | 4.50 | 3.63 | 5.55 | 5.25 | 4.91 | 6.62 | 5.73 | 6.77 | | | |
| NT2RP3001301 | 4.23 | 2.95 | 2.87 | 6.64 | 7.54 | 6.04 | 6.28 | 4.21 | 5.54 | ** | + | |
| NT2RP3001307 | 3.27 | 2.88 | 2.97 | 3.26 | 3.20 | 4.09 | 4.01 | 4.56 | 2.31 | | | |
| NT2RP3001310 | 14.83 | 12.54 | 13.73 | 16.67 | 19.61 | 13.33 | 4.87 | 4.68 | 5.5 | | | ** | − |
| NT2RP3001318 | 2.74 | 0.91 | 1.95 | 3.13 | 4.02 | 2.55 | 2.31 | 3.93 | 2.1 | | | |
| NT2RP3001322 | 1.63 | 0.90 | 0.90 | 2.74 | 1.95 | 2.82 | 2.79 | 4.85 | 2.34 | * | + | |
| NT2RP3001325 | 24.22 | 12.72 | 10.92 | 7.56 | 8.85 | 7.79 | 5.36 | 4.73 | 4.91 | | | |
| NT2RP3001338 | 15.76 | 12.66 | 9.88 | 10.48 | 14.22 | 14.25 | 12.53 | 9.24 | 15.76 | | | |
| NT2RP3001339 | 4.32 | 1.49 | 2.10 | 2.91 | 3.84 | 2.95 | 3.46 | 1.89 | 3.19 | | | |
| NT2RP3001340 | 19.62 | 12.27 | 15.41 | 18.07 | 21.26 | 18.46 | 16.08 | 15.90 | 21.63 | | | |
| NT2RP3001341 | 4.04 | 2.16 | 2.75 | 3.64 | 4.76 | 3.69 | 3.08 | 3.25 | 2.32 | | | |
| NT2RP3001354 | 12.69 | 8.27 | 10.24 | 14.38 | 16.19 | 12.96 | 8.57 | 6.12 | 4.87 | | | |
| NT2RP3001355 | 3.39 | 2.67 | 2.73 | 4.52 | 3.86 | 4.06 | 3.69 | 3.97 | 3.97 | * | + | * | + |
| NT2RP3001356 | 2.63 | 2.41 | 2.61 | 3.21 | 3.25 | 2.89 | 2.82 | 3.46 | 1.7 | * | + | |
| NT2RP3001359 | 5.31 | 3.10 | 1.88 | 3.19 | 6.05 | 4.15 | 4.41 | 3.34 | 3.75 | | | |
| NT2RP3001364 | 6.03 | 3.09 | 3.48 | 5.69 | 5.56 | 4.55 | 3.38 | 5.70 | 5.8 | | | |
| NT2RP3001373 | 5.46 | 3.57 | 2.36 | 4.41 | 5.80 | 3.94 | 5.01 | 3.68 | 6.3 | | | |
| NT2RP3001374 | 2.93 | 1.03 | 1.18 | 2.06 | 2.91 | 2.46 | 1.54 | 1.85 | 1.14 | | | |
| NT2RP3001383 | 6.37 | 4.77 | 6.05 | 9.28 | 12.56 | 10.77 | 4.11 | 4.30 | 3.48 | ** | + | * | − |
| NT2RP3001384 | 4.58 | 2.86 | 3.25 | 5.41 | 5.38 | 4.60 | 5.49 | 4.04 | 4.15 | | | |
| NT2RP3001388 | 3.94 | 3.65 | 4.40 | 11.98 | 17.15 | 15.81 | 10.54 | 11.04 | 15.23 | ** | + | ** | + |
| NT2RP3001392 | 3.83 | 1.90 | 3.17 | 5.39 | 4.17 | 3.84 | 3.44 | 3.44 | 2.66 | | | |
| NT2RP3001396 | 2.00 | 1.30 | 0.75 | 2.42 | 4.93 | 3.82 | 4.83 | 3.81 | 2.6 | * | + | * | + |
| NT2RP3001398 | 11.01 | 6.05 | 6.28 | 7.94 | 10.96 | 10.36 | 8.08 | 7.65 | 10.79 | | | |
| NT2RP3001399 | 8.19 | 4.25 | 5.07 | 7.54 | 8.60 | 8.41 | 4.97 | 7.59 | 6.74 | | | |
| NT2RP3001402 | 2.09 | 1.57 | 1.57 | 3.12 | 4.36 | 4.40 | 2.46 | 3.16 | 5.1 | ** | + | |
| NT2RP3001407 | 9.10 | 4.59 | 5.21 | 13.05 | 12.91 | 13.40 | 7.95 | 7.65 | 8.13 | ** | + | |
| NT2RP3001416 | 2.87 | 2.04 | 3.00 | 3.89 | 8.00 | 5.00 | 4.89 | 5.09 | 4.41 | | | ** | + |
| NT2RP3001420 | 5.16 | 2.34 | 2.93 | 5.77 | 5.70 | 6.45 | 3.3 | 5.56 | 7.47 | * | + | |
| NT2RP3001425 | 3.64 | 1.83 | 2.78 | 5.54 | 5.58 | 5.80 | 4.28 | 4.76 | 3.32 | ** | + | |
| NT2RP3001426 | 9.63 | 6.68 | 3.99 | 4.77 | 6.95 | 7.51 | 7.14 | 4.61 | 7.91 | | | |
| NT2RP3001427 | 4.50 | 3.40 | 2.04 | 4.15 | 3.27 | 4.34 | 2.81 | 4.38 | 3.95 | | | |
| NT2RP3001428 | 4.16 | 3.58 | 4.14 | 7.37 | 9.48 | 9.19 | 4.5 | 5.96 | 3.96 | ** | + | |
| NT2RP3001429 | 2.71 | 0.65 | 1.93 | 11.45 | 6.48 | 6.19 | 4.59 | 7.62 | 3.98 | * | + | * | + |
| NT2RP3001432 | 3.34 | 1.56 | 1.82 | 4.80 | 3.24 | 3.78 | 1.92 | 2.57 | 3.01 | | | |
| NT2RP3001439 | 6.50 | 4.98 | 6.18 | 6.78 | 9.50 | 6.94 | 5.45 | 6.68 | 5.8 | | | |
| NT2RP3001441 | 4.58 | 1.98 | 2.38 | 4.38 | 3.89 | 3.43 | 3.38 | 5.92 | 9.79 | | | |
| NT2RP3001446 | 2.76 | 1.22 | 2.57 | 5.62 | 7.47 | 6.18 | 5.44 | 6.68 | 4.2 | ** | + | * | + |
| NT2RP3001447 | 8.22 | 4.12 | 2.95 | 6.40 | 8.22 | 5.10 | 3.65 | 5.93 | 6.09 | | | |
| NT2RP3001449 | 4.73 | 2.05 | 2.23 | 6.25 | 6.19 | 5.57 | 6.13 | 6.05 | 7.57 | * | + | * | + |
| NT2RP3001453 | 6.27 | 2.66 | 2.61 | 7.65 | 7.63 | 7.03 | 4.7 | 5.93 | 5.45 | * | + | |

TABLE 263-continued

| | | | | | | | | | | | | |
|---|---|---|---|---|---|---|---|---|---|---|---|---|
| NT2RP3001457 | 5.03 | 2.53 | 2.21 | 3.77 | 4.85 | 3.80 | 3.24 | 4.94 | 2.94 | | | |
| NT2RP3001459 | 2.60 | 1.82 | 2.24 | 2.49 | 3.26 | 2.21 | 2.13 | 3.94 | 1.79 | | | |
| NT2RP3001463 | 3.43 | 2.23 | 2.76 | 3.05 | 4.78 | 3.63 | 2.47 | 3.86 | 2.66 | | | |
| NT2RP3001466 | 0.65 | 0.45 | 0.93 | 0.79 | 1.40 | 1.78 | 1.01 | 1.24 | 0.81 | | | |
| NT2RP3001472 | 5.02 | 3.77 | 3.20 | 8.65 | 6.87 | 6.75 | 5.25 | 4.56 | 5.18 | * | + | |
| NT2RP3001475 | 16.30 | 4.98 | 4.56 | 9.54 | 12.17 | 8.13 | 7.39 | 5.93 | 7.4 | | | |
| NT2RP3001479 | 11.30 | 7.78 | 6.68 | 11.47 | 10.59 | 7.30 | 7.74 | 6.55 | 7.95 | | | |
| NT2RP3001490 | 1.44 | 1.38 | 1.23 | 3.68 | 2.94 | 3.11 | 4.42 | 3.30 | 2.91 | ** | + | ** | + |
| NT2RP3001492 | 3.13 | 2.23 | 1.38 | 5.46 | 5.82 | 3.49 | 2.27 | 3.77 | 3.59 | * | + | |
| NT2RP3001495 | 4.27 | 2.41 | 2.48 | 4.72 | 5.59 | 4.95 | 3.72 | 4.06 | 3.66 | * | + | |
| NT2RP3001497 | 3.41 | 1.98 | 2.83 | 6.14 | 5.70 | 4.65 | 3.85 | 3.87 | 3.68 | * | + | |
| NT2RP3001501 | 3.65 | 1.22 | 1.98 | 4.41 | 3.90 | 3.76 | 3.18 | 3.14 | 3.33 | | | |
| NT2RP3001527 | 8.81 | 6.07 | 6.17 | 11.31 | 10.29 | 10.39 | 6.88 | 6.90 | 7.25 | * | + | |
| NT2RP3001529 | 9.25 | 3.58 | 2.90 | 11.50 | 12.88 | 7.44 | 5.1 | 3.82 | 4.38 | | | |
| NT2RP3001538 | 8.31 | 2.40 | 2.73 | 6.50 | 6.03 | 5.12 | 5.17 | 5.15 | 4.98 | | | |

TABLE 264

| | | | | | | | | | | | | | |
|---|---|---|---|---|---|---|---|---|---|---|---|---|---|
| NT2RP3001539 | 12.56 | 6.40 | 7.00 | 10.99 | 10.52 | 8.15 | 6.27 | 6.65 | 5.19 | | | | |
| NT2RP3001542 | 3.56 | 1.19 | 1.50 | 6.99 | 9.11 | 5.28 | 2.14 | 3.06 | 2.68 | * | + | | |
| NT2RP3001549 | 9.80 | 7.45 | 10.38 | 11.31 | 10.30 | 10.04 | 7.8 | 5.81 | 7.76 | | | | |
| NT2RP3001554 | 3.44 | 2.57 | 2.68 | 4.38 | 5.21 | 3.74 | 3.1 | 4.12 | 3.42 | * | + | | |
| NT2RP3001560 | 1.98 | 0.84 | 1.82 | 2.21 | 1.46 | 2.33 | 2.57 | 1.64 | 2.81 | | | | |
| NT2RP3001561 | 7.62 | 4.57 | 4.64 | 6.91 | 8.11 | 8.03 | 7.34 | 7.68 | 6.78 | | | | |
| NT2RP3001564 | 12.59 | 4.99 | 5.10 | 22.94 | 20.84 | 14.16 | 5.83 | 7.51 | 11.43 | * | + | | |
| NT2RP3001568 | 10.68 | 5.54 | 6.19 | 6.22 | 5.75 | 5.19 | 2.58 | 3.78 | 3.57 | | | | |
| NT2RP3001575 | 10.33 | 5.99 | 5.32 | 11.60 | 12.09 | 8.47 | 6.09 | 5.98 | 6.46 | | | | |
| NT2RP3001580 | 3.56 | 1.35 | 1.99 | 5.39 | 3.01 | 3.50 | 2.91 | 3.43 | 3.66 | | | | |
| NT2RP3001587 | 9.27 | 5.60 | 6.48 | 9.67 | 8.64 | 7.91 | 3.57 | 5.67 | 3.81 | | | | |
| NT2RP3001589 | 4.49 | 2.24 | 2.17 | 4.59 | 7.05 | 6.18 | 4.42 | 5.38 | 3.17 | * | + | | |
| NT2RP3001592 | 4.37 | 2.01 | 2.87 | 4.75 | 5.39 | 5.86 | 3.63 | 4.01 | 2.99 | * | + | | |
| NT2RP3001607 | 0.30 | 0.54 | 0.84 | 0.71 | 1.22 | 1.55 | 0.82 | 2.08 | 0.53 | | | | |
| NT2RP3001608 | 7.31 | 2.87 | 2.62 | 6.20 | 4.67 | 5.11 | 3.69 | 5.29 | 6.29 | | | | |
| NT2RP3001613 | 11.75 | 4.76 | 3.72 | 8.30 | 8.98 | 5.57 | 5.89 | 6.91 | 7.14 | | | | |
| NT2RP3001619 | 4.55 | 2.53 | 2.20 | 3.59 | 4.12 | 3.29 | 2.64 | 4.30 | 2.99 | | | | |
| NT2RP3001621 | 7.09 | 6.13 | 3.47 | 2.20 | 2.82 | 2.93 | 1.51 | 2.76 | 2.37 | | | * | − |
| NT2RP3001629 | 3.07 | 1.05 | 1.36 | 2.67 | 2.54 | 2.74 | 1.29 | 3.63 | 1.56 | | | | |
| NT2RP3001630 | 4.04 | 2.39 | 2.24 | 3.71 | 3.71 | 2.59 | 1.51 | 3.51 | 0.99 | | | | |
| NT2RP3001631 | 24.78 | 10.11 | 12.40 | 17.73 | 20.88 | 13.17 | 4.28 | 8.91 | 6.44 | | | | |
| NT2RP3001634 | 9.27 | 2.72 | 5.54 | 7.96 | 8.15 | 7.28 | 4.29 | 5.79 | 4.53 | | | | |
| NT2RP3001642 | 5.13 | 3.42 | 2.92 | 6.54 | 7.68 | 6.47 | 5.19 | 3.70 | 3.73 | * | + | | |
| NT2RP3001646 | 3.27 | 1.84 | 0.92 | 3.18 | 2.57 | 2.35 | 5 | 2.95 | 3.44 | | | | |
| NT2RP3001650 | 3.62 | 2.89 | 1.93 | 2.64 | 3.29 | 4.41 | 2.44 | 1.58 | 2.48 | | | | |
| NT2RP3001667 | 1.93 | 2.07 | 1.35 | 2.81 | 3.65 | 4.62 | 4.85 | 5.42 | 7.49 | * | + | ** | + |
| NT2RP3001671 | 7.66 | 4.46 | 4.89 | 5.72 | 6.98 | 5.49 | 3.11 | 2.99 | 4.06 | | | | |
| NT2RP3001672 | 5.04 | 4.31 | 3.86 | 3.93 | 4.78 | 3.32 | 4.59 | 4.37 | 7.43 | | | | |
| NT2RP3001676 | 3.97 | 2.04 | 5.02 | 4.84 | 5.72 | 3.79 | 2.56 | 2.60 | 3.1 | | | | |
| NT2RP3001678 | 5.11 | 3.61 | 3.12 | 4.03 | 3.95 | 2.98 | 4.85 | 3.51 | 3.88 | | | | |
| NT2RP3001679 | 5.80 | 3.94 | 3.38 | 8.40 | 8.81 | 5.85 | 11 | 8.10 | 8.4 | * | + | * | + |
| NT2RP3001682 | 11.08 | 7.03 | 6.66 | 4.48 | 3.93 | 2.41 | 1.86 | 2.18 | 2.25 | * | − | * | − |
| NT2RP3001685 | 5.84 | 2.49 | 1.45 | 5.20 | 7.06 | 5.72 | 3.81 | 3.24 | 3.24 | | | | |
| NT2RP3001688 | 9.98 | 5.14 | 4.96 | 11.67 | 15.18 | 13.11 | 7.75 | 5.30 | 4.79 | * | + | | |
| NT2RP3001690 | 6.37 | 3.50 | 2.59 | 4.35 | 7.48 | 8.72 | 4.02 | 4.96 | 4.94 | | | | |
| NT2RP3001693 | 13.26 | 8.38 | 9.13 | 9.74 | 11.97 | 8.26 | 6.72 | 8.53 | 7.59 | | | | |
| NT2RP3001696 | 6.95 | 4.47 | 3.30 | 15.86 | 17.48 | 7.56 | 13.16 | 12.78 | 11.08 | | | ** | + |
| NT2RP3001698 | 6.30 | 3.93 | 3.04 | 7.50 | 5.16 | 4.97 | 10.41 | 6.02 | 8.18 | | | | |
| NT2RP3001708 | 3.49 | 1.19 | 1.37 | 2.49 | 3.70 | 3.38 | 4.25 | 2.37 | 2.33 | | | | |
| NT2RP3001712 | 11.74 | 6.82 | 5.41 | 22.86 | 35.26 | 39.54 | 12.07 | 11.43 | 15.14 | * | + | | |
| NT2RP3001716 | 7.22 | 3.02 | 4.03 | 8.79 | 10.51 | 6.60 | 4.73 | 4.70 | 5.85 | | | | |
| NT2RP3001724 | 15.75 | 4.14 | 3.21 | 5.86 | 6.17 | 7.63 | 4.16 | 4.41 | 4.61 | | | | |
| NT2RP3001727 | 8.66 | 6.49 | 5.38 | 14.44 | 7.82 | 11.73 | 11.95 | 13.12 | 10.93 | | | * | + |
| NT2RP3001729 | 1.93 | 0.96 | 0.61 | 2.40 | 2.57 | 2.22 | 2.16 | 2.35 | 2.73 | * | + | * | + |
| NT2RP3001730 | 6.71 | 4.57 | 7.74 | 11.66 | 10.98 | 8.11 | 6.76 | 8.86 | 5.97 | | | | |
| NT2RP3001733 | 2.88 | 2.06 | 0.55 | 2.95 | 3.43 | 1.42 | 2.02 | 2.52 | 2.06 | | | | |
| NT2RP3001737 | 6.70 | 4.04 | 4.02 | 6.45 | 5.41 | 5.38 | 5.72 | 3.92 | 6.08 | | | | |
| NT2RP3001738 | 10.91 | 6.90 | 7.77 | 7.27 | 7.41 | 7.04 | 6.92 | 5.83 | 6.78 | | | | |
| NT2RP3001739 | 5.34 | 4.75 | 4.43 | 4.78 | 6.81 | 5.30 | 5.03 | 4.71 | 6.57 | | | | |
| NT2RP3001742 | 5.50 | 3.13 | 4.00 | 3.39 | 9.70 | 3.77 | 4.55 | 5.25 | 8.02 | | | | |
| NT2RP3001751 | 13.48 | 12.01 | 10.94 | 15.12 | 15.40 | 18.57 | 7.79 | 9.88 | 12.42 | * | + | | |
| NT2RP3001752 | 4.05 | 3.78 | 2.59 | 14.37 | 14.59 | 7.40 | 13.28 | 13.75 | 10.73 | * | + | ** | + |
| NT2RP3001753 | 4.22 | 3.12 | 2.93 | 5.12 | 4.27 | 8.95 | 2.67 | 3.47 | 2.04 | | | | |
| NT2RP3001754 | 24.40 | 11.37 | 10.27 | 18.41 | 20.20 | 17.55 | 14.78 | 11.55 | 16.09 | | | | |
| NT2RP3001756 | 3.63 | 3.86 | 3.16 | 12.94 | 21.73 | 28.36 | 7.24 | 4.83 | 10.97 | * | + | | |
| NT2RP3001764 | 6.68 | 4.75 | 3.99 | 4.90 | 5.39 | 5.66 | 4.26 | 4.39 | 5.91 | | | | |

TABLE 265

| | | | | | | | | | | | | |
|---|---|---|---|---|---|---|---|---|---|---|---|---|
| NT2RP3001771 | 3.51 | 2.93 | 3.35 | 3.89 | 4.06 | 3.55 | 3.61 | 4.21 | 5.23 | | | | |
| NT2RP3001777 | 4.09 | 2.96 | 3.01 | 5.51 | 4.45 | 3.91 | 4.86 | 5.16 | 6 | | | * | + |
| NT2RP3001782 | 2.53 | 2.57 | 1.95 | 6.76 | 6.36 | 6.69 | 4.29 | 4.57 | 3.41 | ** | + | * | + |
| NT2RP3001792 | 5.75 | 4.70 | 5.90 | 6.11 | 8.15 | 9.14 | 6.11 | 4.96 | 5.99 | | | | |
| NT2RP3001799 | 4.41 | 4.21 | 3.75 | 7.39 | 9.01 | 7.29 | 5.88 | 7.01 | 5.73 | ** | + | ** | + |
| NT2RP3001819 | 6.61 | 3.33 | 1.74 | 4.45 | 5.18 | 4.58 | 4.38 | 3.34 | 4.47 | | | | |
| NT2RP3001829 | 60.87 | 38.63 | 36.73 | 56.07 | 52.70 | 55.16 | 28.32 | 28.08 | 35.16 | | | | |
| NT2RP3001836 | 10.17 | 5.74 | 4.77 | 10.85 | 13.55 | 11.18 | 6.57 | 5.69 | 7.14 | | | | |
| NT2RP3001839 | 15.46 | 12.06 | 10.35 | 17.55 | 22.87 | 17.91 | 17.89 | 15.53 | 21.32 | * | + | | |
| NT2RP3001844 | 5.39 | 4.22 | 4.08 | 8.68 | 8.00 | 8.70 | 4.83 | 4.18 | 5.54 | ** | + | | |
| NT2RP3001848 | 8.51 | 3.03 | 3.37 | 7.54 | 6.39 | 7.94 | 7.05 | 8.18 | 5.83 | | | | |
| NT2RP3001854 | 4.31 | 3.66 | 2.93 | 4.93 | 7.64 | 5.42 | 5.84 | 9.19 | 10.46 | | | * | + |
| NT2RP3001855 | 1.08 | 0.62 | 0.41 | 0.88 | 3.15 | 1.50 | 2.17 | 1.51 | 1.24 | | | | |
| NT2RP3001857 | 8.74 | 5.14 | 3.23 | 3.88 | 5.79 | 4.95 | 4.34 | 4.47 | 3.21 | | | | |
| NT2RP3001858 | 5.96 | 2.68 | 3.12 | 1.87 | 2.69 | 2.83 | 2.52 | 3.04 | 2.59 | | | | |
| NT2RP3001861 | 8.95 | 6.91 | 5.65 | 7.71 | 8.95 | 8.02 | 9.41 | 9.63 | 9.39 | | | | |
| NT2RP3001866 | 1.78 | 1.67 | 1.30 | 2.40 | 3.59 | 1.96 | 3.62 | 3.94 | 3.33 | | | ** | + |
| NT2RP3001871 | 1.22 | 1.47 | 1.24 | 4.28 | 5.33 | 4.06 | 5.94 | 5.76 | 6.13 | ** | + | ** | + |
| NT2RP3001874 | 2.39 | 1.48 | 1.04 | 1.60 | 1.73 | 1.49 | 2.15 | 3.07 | 2.44 | | | | |
| NT2RP3001878 | 1.89 | 1.50 | 2.48 | 4.52 | 7.04 | 3.00 | 1.74 | 2.47 | 2.05 | | | | |
| NT2RP3001885 | 4.23 | 3.76 | 3.61 | 4.08 | 6.00 | 8.45 | 4.94 | 5.08 | 4.08 | | | | |
| NT2RP3001896 | 3.95 | 2.31 | 1.26 | 4.38 | 7.80 | 4.28 | 4.49 | 2.83 | 4.64 | | | | |
| NT2RP3001898 | 12.61 | 5.06 | 3.64 | 6.11 | 6.18 | 5.92 | 8.68 | 7.13 | 11.31 | | | | |
| NT2RP3001899 | 5.05 | 3.28 | 2.34 | 3.69 | 5.19 | 3.08 | 2.74 | 3.58 | 3.91 | | | | |
| NT2RP3001901 | 12.98 | 8.89 | 8.12 | 8.50 | 8.51 | 10.47 | 8.45 | 6.54 | 7.26 | | | | |
| NT2RP3001915 | 6.53 | 3.55 | 4.50 | 3.73 | 7.04 | 4.19 | 2.46 | 3.27 | 3.28 | | | | |
| NT2RP3001926 | 0.32 | 0.45 | 0.32 | 1.03 | 1.16 | 1.31 | 0.6 | 2.68 | 0.45 | ** | + | | |
| NT2RP3001929 | 2.79 | 2.04 | 3.11 | 3.82 | 2.97 | 3.77 | 2.42 | 3.15 | 2.72 | | | | |
| NT2RP3001931 | 4.35 | 3.16 | 3.68 | 6.47 | 4.72 | 7.93 | 3.59 | 3.28 | 4.34 | | | | |
| NT2RP3001938 | 7.26 | 2.97 | 4.06 | 7.92 | 6.46 | 6.68 | 4 | 4.10 | 3.17 | | | | |
| NT2RP3001943 | 14.11 | 5.27 | 4.51 | 10.79 | 10.92 | 8.33 | 5.43 | 5.45 | 5.13 | | | | |
| NT2RP3001944 | 3.45 | 2.33 | 1.32 | 2.72 | 2.97 | 3.31 | 3.63 | 3.49 | 2.49 | | | | |
| NT2RP3001945 | 7.29 | 7.10 | 5.59 | 8.17 | 9.64 | 11.51 | 6.42 | 7.34 | 6.69 | * | + | | |
| NT2RP3001947 | 4.79 | 4.51 | 3.45 | 5.88 | 6.32 | 6.85 | 5.07 | 6.05 | 6.08 | * | + | * | + |
| NT2RP3001949 | 2.69 | 1.52 | 2.67 | 4.00 | 3.55 | 3.46 | 2.68 | 2.84 | 2.52 | * | + | | |
| NT2RP3001952 | 16.48 | 13.65 | 16.67 | 12.37 | 9.06 | 10.48 | 18.01 | 17.39 | 16.21 | * | − | | |
| NT2RP3001954 | 5.28 | 2.86 | 2.85 | 5.44 | 4.55 | 3.42 | 3.76 | 3.67 | 4.11 | | | | |
| NT2RP3001956 | 34.22 | 13.29 | 14.18 | 28.43 | 28.08 | 22.94 | 14.79 | 12.62 | 14.22 | | | | |
| NT2RP3001967 | 7.52 | 2.65 | 2.30 | 9.80 | 9.24 | 5.06 | 8.63 | 5.51 | 4.88 | | | | |
| NT2RP3001969 | 7.99 | 4.86 | 4.65 | 5.70 | 7.31 | 4.72 | 3.47 | 2.46 | 4.31 | | | | |
| NT2RP3001976 | 7.58 | 3.71 | 3.57 | 8.43 | 12.72 | 10.69 | 5.69 | 4.81 | 4.65 | * | + | | |
| NT2RP3001986 | 4.77 | 4.42 | 3.72 | 5.84 | 6.16 | 3.49 | 3.93 | 4.27 | 4.43 | | | | |
| NT2RP3001989 | 0.59 | 0.37 | 0.61 | 1.26 | 1.01 | 1.46 | 1.37 | 2.34 | 1.2 | ** | + | * | + |
| NT2RP3002002 | 4.58 | 2.14 | 1.97 | 6.96 | 7.70 | 8.62 | 3.16 | 5.19 | 5.28 | ** | + | | |
| NT2RP3002004 | 2.02 | 1.54 | 1.44 | 3.44 | 3.14 | 2.45 | 2.24 | 2.01 | 2.64 | * | + | | |
| NT2RP3002007 | 2.30 | 1.16 | 1.11 | 2.63 | 4.31 | 2.50 | 1.57 | 1.64 | 1.85 | | | | |
| NT2RP3002014 | 4.46 | 3.07 | 2.32 | 5.12 | 6.41 | 4.59 | 6.11 | 3.83 | 4.25 | | | | |
| NT2RP3002015 | 7.60 | 4.06 | 4.17 | 6.58 | 5.55 | 3.85 | 6.25 | 4.00 | 5.51 | | | | |
| NT2RP3002033 | 1.85 | 1.50 | 1.64 | 2.80 | 2.86 | 2.23 | 1.62 | 2.56 | 2.12 | * | + | | |
| NT2RP3002045 | 1.82 | 1.00 | 1.37 | 1.94 | 4.75 | 2.88 | 1.69 | 2.27 | 2.09 | | | | |
| NT2RP3002054 | 2.00 | 1.59 | 0.94 | 1.90 | 1.75 | 2.02 | 1.61 | 2.56 | 2.14 | | | | |
| NT2RP3002056 | 2.28 | 1.93 | 1.78 | 6.00 | 7.33 | 7.83 | 2.85 | 2.69 | 4.61 | ** | + | | |
| NT2RP3002057 | 1.99 | 1.12 | 1.41 | 3.14 | 2.25 | 1.70 | 1.48 | 2.86 | 1.82 | | | | |
| NT2RP3002061 | 16.71 | 9.57 | 7.36 | 24.61 | 19.84 | 16.31 | 10.52 | 9.51 | 8.46 | | | | |
| NT2RP3002062 | 2.33 | 1.47 | 0.86 | 3.09 | 3.51 | 2.69 | 1.64 | 2.02 | 3.16 | * | + | | |
| NT2RP3002063 | 8.43 | 3.19 | 2.56 | 5.90 | 5.68 | 4.65 | 5.99 | 6.66 | 4.47 | | | | |

TABLE 266

| | | | | | | | | | | | | |
|---|---|---|---|---|---|---|---|---|---|---|---|---|
| NT2RP3002064 | 5.17 | 3.05 | 2.46 | 4.06 | 7.44 | 4.88 | 4.84 | 4.54 | 4.14 | | | | |
| NT2RP3002071 | 2.33 | 1.51 | 1.99 | 1.86 | 2.27 | 1.50 | 2.16 | 2.61 | 2.43 | | | | |
| NT2RP3002073 | 5.31 | 4.25 | 4.41 | 3.45 | 4.48 | 3.77 | 3.46 | 5.18 | 3.88 | | | | |
| NT2RP3002074 | 3.99 | 3.21 | 3.54 | 3.26 | 5.35 | 3.47 | 3.41 | 4.15 | 2.51 | | | | |
| NT2PP3002075 | 4.75 | 2.10 | 2.19 | 6.52 | 7.60 | 4.15 | 6.03 | 5.22 | 5 | | | | |
| NT2RP3002077 | 8.02 | 3.34 | 2.61 | 6.63 | 4.07 | 3.18 | 5.14 | 4.74 | 2.68 | | | | |
| NT2RP3002081 | 10.07 | 7.99 | 7.00 | 4.79 | 4.27 | 3.26 | 2.76 | 2.42 | 1.41 | * | − | ** | − |
| NT2RP3002086 | 4.94 | 3.90 | 3.43 | 7.01 | 9.40 | 7.91 | 6.79 | 5.61 | 5.45 | ** | + | * | + |
| NT2RP3002094 | 55.21 | 38.13 | 49.40 | 26.53 | 35.64 | 30.76 | 29.38 | 24.30 | 29.05 | * | − | * | − |
| NT2RP3002096 | 2.03 | 2.45 | 2.09 | 2.34 | 2.63 | 1.70 | 2.31 | 1.94 | 2.22 | | | | |
| NT2RP3002097 | 4.81 | 2.56 | 2.66 | 7.07 | 9.45 | 4.39 | 4.28 | 5.92 | 5.09 | | | | |
| NT2RP3002098 | 1.30 | 1.49 | 2.04 | 3.02 | 3.52 | 2.23 | 1.86 | 1.80 | 1.76 | * | + | | |
| NT2RP3002102 | 4.48 | 2.97 | 2.73 | 5.04 | 5.32 | 5.08 | 5.06 | 4.28 | 4.93 | * | + | | |
| NT2RP3002106 | 5.41 | 2.39 | 2.38 | 9.26 | 7.89 | 8.90 | 6.1 | 3.83 | 3.57 | ** | + | | |
| NT2RP3002108 | 6.53 | 3.49 | 4.50 | 3.88 | 5.75 | 3.58 | 3.09 | 4.07 | 3.18 | | | | |
| NT2RP3002109 | 11.23 | 5.02 | 4.28 | 16.19 | 18.27 | 13.88 | 14.35 | 12.01 | 12.31 | * | + | | |
| NT2RP3002110 | 23.37 | 14.84 | 16.48 | 34.91 | 29.71 | 40.33 | 23.01 | 21.75 | 23.48 | * | + | | |

TABLE 266-continued

| | | | | | | | | | | | | |
|---|---|---|---|---|---|---|---|---|---|---|---|---|
| NT2RP3002113 | 11.63 | 9.01 | 7.67 | 6.51 | 7.35 | 7.47 | 7.32 | 7.10 | 6.45 | | | | |
| NT2RP3002120 | 1.55 | 1.48 | 1.08 | 2.91 | 3.24 | 1.92 | 2.33 | 3.13 | 2.18 | * | + | * | + |
| NT2RP3002121 | 3.47 | 2.28 | 2.84 | 4.15 | 6.05 | 2.79 | 2.22 | 3.39 | 2.01 | | | | |
| NT2RP3002126 | 11.23 | 6.99 | 4.03 | 8.17 | 8.24 | 7.23 | 16.66 | 12.35 | 16.36 | | | * | + |
| NT2RP3002128 | 13.16 | 6.63 | 6.22 | 10.39 | 10.13 | 7.09 | 9.73 | 7.03 | 10.29 | | | | |
| NT2RP3002130 | 7.94 | 5.84 | 4.52 | 8.35 | 9.12 | 8.25 | 8.69 | 6.14 | 9.87 | | | | |
| NT2RP3002133 | 7.00 | 4.13 | 2.94 | 10.10 | 13.02 | 11.57 | 10.36 | 9.95 | 10.86 | ** | + | ** | + |
| NT2RP3002136 | 10.87 | 7.59 | 6.07 | 13.09 | 20.57 | 19.22 | 14.35 | 15.02 | 15.43 | * | + | ** | + |
| NT2RP3002140 | 4.41 | 4.46 | 5.24 | 5.99 | 5.61 | 7.54 | 7.49 | 4.80 | 5.22 | | | | |
| NT2RP3002142 | 7.81 | 6.29 | 3.94 | 14.63 | 15.34 | 11.73 | 11.3 | 15.25 | 13.24 | ** | + | * | + |
| NT2RP3002146 | 7.61 | 4.78 | 4.77 | 10.91 | 13.18 | 6.97 | 4.8 | 6.21 | 4.65 | | | | |
| NT2RP3002147 | 22.06 | 11.75 | 12.01 | 9.65 | 10.83 | 10.56 | 11.86 | 8.17 | 9.38 | | | | |
| NT2RP3002151 | 14.60 | 11.05 | 8.77 | 13.96 | 13.74 | 12.27 | 8.15 | 8.64 | 12.04 | | | | |
| NT2RP3002155 | 8.16 | 6.32 | 4.96 | 8.79 | 7.65 | 4.96 | 6.19 | 7.55 | 7.22 | | | | |
| NT2RP3002156 | 2.21 | 1.36 | 0.96 | 3.23 | 3.14 | 2.36 | 3.21 | 3.07 | 3.25 | * | + | * | + |
| NT2RP3002160 | 3.98 | 3.19 | 1.94 | 3.32 | 4.52 | 5.20 | 4.3 | 1.89 | 4.12 | | | | |
| NT2RP3002163 | 18.81 | 11.61 | 12.16 | 18.87 | 21.42 | 15.74 | 12.51 | 9.05 | 10.05 | | | | |
| NT2RP3002165 | 6.12 | 5.16 | 5.75 | 6.38 | 8.10 | 3.82 | 6.23 | 5.63 | 7.23 | | | | |
| NT2RP3002166 | 5.72 | 3.53 | 1.35 | 2.95 | 5.16 | 3.30 | 2.3 | 3.24 | 3.17 | | | | |
| NT2RP3002173 | 5.34 | 3.03 | 2.78 | 9.80 | 6.20 | 7.21 | 5.06 | 5.00 | 4.94 | * | + | | |
| NT2RP3002174 | 5.68 | 2.49 | 1.67 | 7.29 | 8.21 | 9.12 | 9.02 | 7.21 | 12.43 | * | + | * | + |
| NT2RP3002181 | 9.68 | 7.50 | 5.24 | 4.48 | 4.92 | 3.59 | 2.61 | 2.36 | 2.48 | | | * | − |
| NT2RP3002185 | 3.81 | 2.37 | 1.77 | 2.88 | 7.87 | 3.22 | 3.57 | 3.44 | 2.54 | | | | |
| NT2RP3002193 | 7.51 | 6.09 | 4.76 | 5.28 | 9.69 | 7.23 | 6.2 | 5.26 | 7.9 | | | | |
| NT2RP3002204 | 2.89 | 2.47 | 0.95 | 9.64 | 8.53 | 14.75 | 4.05 | 4.67 | 4.6 | * | + | * | + |
| NT2RP3002244 | 4.56 | 5.32 | 5.18 | 4.63 | 6.32 | 6.34 | 4.51 | 3.44 | 3.59 | | | * | − |
| NT2RP3002248 | 8.18 | 5.72 | 5.54 | 14.10 | 16.32 | 12.91 | 11.02 | 10.26 | 11.54 | ** | + | ** | + |
| NT2RP3002253 | 6.83 | 4.26 | 3.08 | 6.54 | 5.65 | 6.66 | 3.58 | 3.16 | 4.05 | | | | |
| NT2RP3002255 | 44.02 | 22.63 | 19.64 | 26.45 | 26.34 | 31.64 | 17.22 | 13.77 | 17.68 | | | | |
| NT2RP3002264 | 5.83 | 3.17 | 2.53 | 6.13 | 7.07 | 6.24 | 4.47 | 6.97 | 4.95 | | | | |
| NT2RP3002267 | 4.61 | 2.60 | 2.31 | 3.48 | 4.99 | 3.73 | 3.57 | 2.66 | 3.09 | | | | |
| NT2RP3002273 | 14.02 | 8.03 | 6.96 | 15.74 | 16.07 | 14.50 | 9.58 | 10.63 | 9.37 | | | | |
| NT2RP3002276 | 5.72 | 2.96 | 3.52 | 5.50 | 5.94 | 5.34 | 3.99 | 5.68 | 5.16 | | | | |
| NT2RP3002281 | 7.91 | 5.75 | 6.50 | 6.21 | 6.83 | 6.47 | 4.32 | 5.43 | 5.21 | | | | |
| NT2RP3002286 | 2.46 | 1.62 | 2.05 | 3.65 | 3.52 | 2.26 | 2.34 | 3.39 | 3.14 | | | | |
| NT2RP3002297 | 56.91 | 27.98 | 24.70 | 67.63 | 63.96 | 45.16 | 26.65 | 22.90 | 25.3 | | | | |
| NT2RP3002301 | 9.96 | 5.96 | 5.15 | 5.72 | 8.90 | 9.72 | 8.36 | 7.88 | 9.26 | | | | |
| NT2RP3002303 | 10.45 | 6.01 | 4.55 | 8.24 | 9.49 | 7.38 | 8.89 | 7.75 | 8.68 | | | | |
| NT2RP3002304 | 1.01 | 1.07 | 1.38 | 3.55 | 2.86 | 2.06 | 2.84 | 4.66 | 2.09 | * | + | | |

TABLE 267

| | | | | | | | | | | | | |
|---|---|---|---|---|---|---|---|---|---|---|---|---|
| NT2RP3002309 | 6.87 | 4.15 | 3.66 | 6.13 | 6.93 | 8.34 | 2.55 | 3.41 | 3.91 | | | | |
| NT2RP3002311 | 4.05 | 2.38 | 2.34 | 4.56 | 2.55 | 3.21 | 2.05 | 2.83 | 2.86 | | | | |
| NT2RP3002315 | 15.94 | 11.19 | 15.32 | 12.31 | 8.50 | 11.56 | 8.23 | 8.69 | 10.92 | | | * | − |
| NT2RP3002319 | 1.73 | 1.09 | 1.94 | 2.53 | 2.43 | 3.11 | 2.93 | 2.04 | 2.66 | * | + | | |
| NT2RP3002324 | 9.27 | 3.66 | 3.72 | 5.93 | 9.44 | 5.66 | 4.2 | 5.07 | 4.43 | | | | |
| NT2RP3002330 | 9.95 | 5.32 | 3.76 | 4.42 | 7.75 | 7.05 | 6.63 | 6.18 | 5.42 | | | | |
| NT2RP3002333 | 17.93 | 13.63 | 12.33 | 10.81 | 13.83 | 11.53 | 26.44 | 20.51 | 21.61 | | | * | + |
| NT2RP3002337 | 2.63 | 1.45 | 1.52 | 1.90 | 1.94 | 2.01 | 1.38 | 3.21 | 2.65 | | | | |
| NT2RP3002342 | 15.59 | 10.64 | 11.07 | 10.92 | 13.50 | 7.96 | 9.5 | 11.72 | 10.96 | | | | |
| NT2RP3002343 | 4.86 | 3.15 | 3.42 | 8.66 | 7.27 | 7.64 | 5.82 | 6.21 | 6.54 | ** | + | * | + |
| NT2RP3002351 | 2.14 | 1.87 | 1.48 | 1.52 | 1.49 | 1.39 | 1.37 | 2.50 | 1.29 | | | | |
| NT2RP3002352 | 3.51 | 2.49 | 2.09 | 6.56 | 3.41 | 4.41 | 3.67 | 4.42 | 2.26 | | | | |
| NT2RP3002353 | 8.54 | 2.87 | 2.50 | 5.68 | 7.93 | 6.04 | 5.65 | 4.24 | 3.09 | | | | |
| NT2RP3002362 | 10.04 | 4.71 | 5.05 | 6.95 | 8.81 | 7.91 | 8.38 | 7.04 | 7.67 | | | | |
| NT2RP3002363 | 5.45 | 3.22 | 2.99 | 4.20 | 6.31 | 4.65 | 3.29 | 3.42 | 4.78 | | | | |
| NT2RP3002377 | 6.53 | 3.54 | 3.81 | 6.50 | 6.48 | 4.79 | 3.11 | 4.43 | 2.57 | | | | |
| NT2RP3002377 | 16.05 | 6.92 | 7.02 | 15.78 | 13.73 | 11.15 | 9.35 | 6.37 | 9.19 | | | | |
| NT2RP3002394 | 3.83 | 2.35 | 2.55 | 5.43 | 6.35 | 4.75 | 5.11 | 5.17 | 5.17 | * | + | ** | + |
| NT2RP3002397 | 1.88 | 2.06 | 1.00 | 2.28 | 2.42 | 2.35 | 2.43 | 3.20 | 2.26 | | | | |
| NT2RP3002399 | 38.89 | 13.57 | 16.73 | 24.89 | 24.11 | 20.07 | 10.95 | 10.34 | 11.58 | | | | |
| NT2RP3002402 | 14.13 | 6.06 | 6.64 | 3.90 | 7.46 | 3.60 | 5.13 | 2.47 | 3.86 | | | | |
| NT2RP3002404 | 2.69 | 1.41 | 1.51 | 4.63 | 5.57 | 6.95 | 5.03 | 5.62 | 5.49 | ** | + | ** | + |
| NT2RP3002410 | 16.74 | 9.36 | 8.24 | 14.55 | 17.40 | 14.68 | 7.71 | 8.16 | 9.6 | | | | |
| NT2RP3002411 | 5.72 | 3.09 | 2.66 | 5.44 | 3.76 | 4.39 | 3.87 | 3.60 | 4.64 | | | | |
| NT2RP3002414 | 15.70 | 13.46 | 15.51 | 17.50 | 19.84 | 20.94 | 20.31 | 15.95 | 17.64 | * | + | | |
| NT2RP3002430 | 5.62 | 3.03 | 3.26 | 4.15 | 6.68 | 5.69 | 3.6 | 5.22 | 5.76 | | | | |
| NT2RP3002448 | 3.21 | 1.91 | 1.95 | 4.68 | 4.12 | 2.16 | 3.43 | 3.57 | 3.52 | | | | |
| NT2RP3002454 | 5.75 | 3.63 | 2.88 | 8.65 | 10.72 | 8.12 | 4.17 | 6.41 | 5.11 | * | + | | |
| NT2RP3002455 | 5.96 | 2.60 | 2.61 | 5.44 | 7.86 | 5.02 | 4.61 | 3.98 | 4.33 | | | | |
| NT2RP3002456 | 19.55 | 5.82 | 6.70 | 24.00 | 22.06 | 18.49 | 6.98 | 7.59 | 13.81 | | | | |
| NT2RP3002462 | 10.35 | 5.72 | 4.60 | 11.65 | 13.73 | 9.93 | 5.45 | 7.13 | 8.04 | | | | |
| NT2RP3002469 | 4.02 | 2.04 | 2.37 | 7.68 | 7.85 | 6.75 | 5.57 | 6.12 | 6.98 | ** | + | ** | + |
| NT2RP3002470 | 34.16 | 21.24 | 23.62 | 26.50 | 31.46 | 31.78 | 25.6 | 23.51 | 18.11 | | | | |
| NT2RP3002484 | 4.96 | 4.07 | 3.20 | 7.26 | 8.04 | 8.64 | 6.14 | 7.06 | 7.03 | ** | + | * | + |

TABLE 267-continued

| | | | | | | | | | | | | |
|---|---|---|---|---|---|---|---|---|---|---|---|---|
| NT2RP3002491 | 2.02 | 0.31 | 0.77 | 1.88 | 1.82 | 1.66 | 1.79 | 2.17 | 2.19 | | | |
| NT2RP3002494 | 5.69 | 5.46 | 5.09 | 5.37 | 5.09 | 4.28 | 11.1 | 14.53 | 16.58 | | ** | + |
| NT2RP3002497 | 7.34 | 2.87 | 2.34 | 7.23 | 5.25 | 4.45 | 4.45 | 4.17 | 5.52 | | | |
| NT2RP3002500 | 6.11 | 2.15 | 1.67 | 4.34 | 5.06 | 2.16 | 2.18 | 2.29 | 5.42 | | | |
| NT2RP3002501 | 11.25 | 5.11 | 3.44 | 6.23 | 6.00 | 5.47 | 2.88 | 5.58 | 5.46 | | | |
| NT2RP3002512 | 7.00 | 3.26 | 2.28 | 5.82 | 6.08 | 6.36 | 2.87 | 4.61 | 8.18 | | | |
| NT2RP3002529 | 3.20 | 3.16 | 1.84 | 7.16 | 9.33 | 8.45 | 4.14 | 4.40 | 5.49 | ** | + | * | + |
| NT2RP3002533 | 7.52 | 4.47 | 4.21 | 12.54 | 12.31 | 10.84 | 8.33 | 13.60 | 12.28 | ** | + | * | + |
| NT2RP3002539 | 6.08 | 4.61 | 2.98 | 8.67 | 11.27 | 7.39 | 2.77 | 5.22 | 3.99 | * | + | | |
| NT2RP3002540 | 2.20 | 1.79 | 1.19 | 3.09 | 3.15 | 2.53 | 2.67 | 2.99 | 2.88 | * | + | * | + |
| NT2RP3002543 | 14.24 | 6.52 | 5.35 | 11.36 | 10.19 | 12.56 | 10.27 | 10.96 | 8.43 | | | |
| NT2RP3002545 | 4.03 | 2.04 | 1.37 | 6.55 | 5.22 | 5.90 | 5.61 | 3.59 | 2.71 | * | + | |
| NT2RP3002549 | 2.56 | 1.25 | 0.83 | 5.75 | 4.78 | 6.90 | 5.63 | 3.95 | 4.81 | ** | + | * | + |
| NT2RP3002552 | 2.93 | 2.06 | 2.41 | 3.32 | 5.85 | 3.49 | 4.06 | 3.68 | 4.2 | | ** | + |
| NT2RP3002558 | 7.05 | 4.19 | 4.48 | 9.57 | 11.91 | 11.02 | 10.69 | 7.40 | 9.14 | ** | + | * | + |
| NT2RP3002565 | 4.40 | 2.70 | 2.23 | 5.52 | 4.89 | 4.10 | 2.94 | 2.79 | 3.23 | | | |
| NT2RP3002566 | 4.15 | 3.12 | 3.18 | 4.65 | 4.50 | 3.46 | 4.21 | 2.25 | 2.13 | | | |
| NT2RP3002571 | 1.43 | 0.64 | 1.11 | 2.38 | 2.79 | 1.21 | 2 | 1.13 | 1.01 | | | |
| NT2RP3002572 | 5.68 | 2.77 | 2.24 | 4.20 | 4.73 | 4.39 | 4.25 | 2.73 | 1.87 | | | |
| NT2RP3002573 | 12.53 | 5.63 | 5.03 | 10.21 | 9.69 | 14.18 | 6.47 | 7.06 | 5.93 | | | |
| NT2RP3002577 | 16.44 | 10.30 | 7.27 | 9.02 | 16.56 | 19.10 | 11.76 | 11.75 | 13.42 | | | |
| NT2RP3002579 | 5.14 | 1.77 | 2.75 | 2.43 | 7.06 | 4.13 | 4.98 | 5.48 | 3.32 | | | |

TABLE 268

| | | | | | | | | | | | | |
|---|---|---|---|---|---|---|---|---|---|---|---|---|
| NT2RP3002582 | 12.31 | 7.23 | 7.62 | 9.16 | 12.52 | 12.19 | 7.07 | 6.55 | 8.27 | | | |
| NT2RP3002587 | 2.59 | 1.37 | 0.54 | 2.46 | 2.67 | 3.02 | 1.24 | 1.89 | 1.22 | | | |
| NT2RP3002590 | 10.29 | 5.66 | 7.55 | 5.34 | 4.92 | 3.70 | 2.44 | 4.30 | 2.27 | | * | − |
| NT2RP3002602 | 2.82 | 1.08 | 1.45 | 3.79 | 2.37 | 2.51 | 2.16 | 2.20 | 1.92 | | | |
| NT2RP3002603 | 23.80 | 12.85 | 10.83 | 16.77 | 16.77 | 18.88 | 33.04 | 20.98 | 28.78 | | | |
| NT2RP3002621 | 5.83 | 2.17 | 2.11 | 2.73 | 3.73 | 3.84 | 3.77 | 3.43 | 4.67 | | | |
| NT2RP3002622 | 6.46 | 4.71 | 3.37 | 7.18 | 6.32 | 5.80 | 5.41 | 4.46 | 6.55 | | | |
| NT2RP3002624 | 1.38 | 1.46 | 0.86 | 2.16 | 2.27 | 1.71 | 1.92 | 2.31 | 2.23 | * | + | * | + |
| NT2RP3002628 | 3.88 | 4.12 | 4.54 | 3.93 | 5.95 | 4.39 | 6.01 | 5.25 | 6.35 | | * | + |
| NT2RP3002629 | 17.56 | 11.86 | 13.81 | 23.77 | 21.74 | 24.60 | 15.1 | 15.62 | 16.2 | ** | + | |
| NT2RP3002631 | 0.65 | 0.54 | 0.71 | 0.74 | 2.00 | 0.23 | 0.47 | 2.10 | 1.77 | | | |
| NT2RP3002647 | 6.35 | 4.67 | 4.32 | 5.81 | 4.61 | 3.54 | 2.45 | 3.29 | 2.94 | | * | − |
| NT2RP3002649 | 13.39 | 5.95 | 5.65 | 10.41 | 9.34 | 8.49 | 5.95 | 5.93 | 9.13 | | | |
| NT2RP3002650 | 6.81 | 4.69 | 4.82 | 5.81 | 7.89 | 6.12 | 6.83 | 5.78 | 9.56 | | | |
| NT2RP3002652 | 5.20 | 4.74 | 1.12 | 4.44 | 5.82 | 4.44 | 3.42 | 3.65 | 3.38 | | | |
| NT2RP3002654 | 16.99 | 10.82 | 13.04 | 8.59 | 8.02 | 5.74 | 6.46 | 6.13 | 9.06 | * | − | * | − |
| NT2RP3002657 | 6.11 | 3.63 | 4.64 | 10.15 | 11.45 | 6.16 | 9.57 | 10.27 | 10.97 | | ** | + |
| NT2RP3002659 | 1.43 | 1.66 | 1.88 | 2.50 | 3.07 | 1.94 | 1.45 | 2.43 | 1.88 | | | |
| NT2RP3002660 | 6.69 | 4.61 | 2.72 | 7.71 | 9.95 | 6.32 | 4.86 | 5.91 | 5.04 | | | |
| NT2RP3002663 | 2.95 | 2.45 | 2.08 | 3.55 | 3.38 | 2.69 | 2.33 | 2.32 | 1.43 | | | |
| NT2RP3002664 | 4.14 | 2.04 | 1.66 | 3.83 | 4.46 | 3.08 | 3.81 | 2.61 | 3.84 | | | |
| NT2RP3002667 | 10.84 | 11.80 | 12.31 | 7.37 | 13.24 | 10.35 | 2.54 | 3.53 | 3.86 | | ** | − |
| NT2RP3002671 | 4.10 | 3.38 | 2.05 | 3.68 | 4.13 | 3.09 | 3.64 | 4.14 | 3.95 | | | |
| NT2RP3002682 | 6.85 | 6.11 | 3.50 | 9.41 | 10.82 | 9.25 | 7.6 | 6.54 | 14.33 | * | + | |
| NT2RP3002684 | 2.31 | 2.12 | 2.06 | 2.65 | 2.46 | 1.95 | 3.43 | 3.91 | 2.52 | | | |
| NT2RP3002687 | 0.81 | 0.83 | 0.64 | 1.63 | 2.27 | 2.37 | 2.18 | 2.59 | 1.3 | ** | + | * | + |
| NT2RP3002688 | 1.90 | 1.35 | 1.30 | 2.68 | 10.84 | 4.31 | 2.62 | 3.98 | 4.96 | | | |
| NT2RP3002698 | 1.70 | 1.54 | 2.28 | 2.37 | 1.97 | 1.69 | 2.37 | 4.37 | 2.27 | | | |
| NT2RP3002701 | 9.13 | 4.28 | 3.80 | 7.31 | 8.31 | 6.47 | 5.76 | 5.84 | 9.76 | | | |
| NT2RP3002705 | 21.78 | 18.18 | 17.66 | 50.09 | 57.33 | 55.80 | 17.31 | 19.57 | 25.8 | ** | + | |
| NT2RP3002708 | 8.43 | 3.13 | 4.23 | 10.00 | 12.33 | 16.86 | 6.66 | 9.06 | 8.15 | * | + | |
| NT2RP3002711 | 10.69 | 7.85 | 6.27 | 14.28 | 17.41 | 10.11 | 7.22 | 6.34 | 9.71 | | | |
| NT2RP3002712 | 75.48 | 54.09 | 63.05 | 72.21 | 59.93 | 49.90 | 55.73 | 52.68 | 50.32 | | | |
| NT2RP3002713 | 1.12 | 1.39 | 0.99 | 1.79 | 1.94 | 1.51 | 1.51 | 1.64 | 2.24 | * | + | |
| NT2RP3002721 | 4.73 | 3.29 | 3.45 | 5.55 | 8.69 | 5.41 | 5.47 | 5.66 | 7.4 | | * | + |
| NT2RP3002722 | 18.60 | 15.91 | 19.67 | 21.10 | 20.78 | 20.71 | 21.26 | 14.74 | 13.19 | | | |
| NT2RP3002723 | 20.89 | 13.71 | 12.73 | 18.65 | 26.94 | 25.35 | 23.58 | 19.98 | 24.35 | | | |
| NT2RP3002737 | 10.83 | 5.85 | 5.46 | 7.36 | 8.93 | 8.81 | 7.12 | 8.21 | 8.27 | | | |
| NT2RP3002738 | 3.06 | 2.31 | 2.46 | 3.88 | 2.93 | 4.58 | 4.14 | 4.86 | 3.57 | | * | + |
| NT2RP3002742 | 78.11 | 50.55 | 39.19 | 56.71 | 49.99 | 44.98 | 24.65 | 24.79 | 19.15 | | * | − |
| NT2RP3002744 | 1.91 | 1.57 | 1.49 | 3.37 | 4.81 | 3.15 | 4.58 | 3.73 | 2.77 | * | + | * | + |
| NT2RP3002756 | 2.31 | 1.24 | 1.63 | 1.83 | 2.14 | 1.21 | 1.7 | 1.60 | 2.11 | | | |
| NT2RP3002757 | 4.69 | 3.13 | 4.35 | 7.14 | 8.49 | 8.18 | 8.15 | 8.37 | 8.37 | ** | + | ** | + |
| NT2RP3002758 | 7.65 | 5.42 | 7.31 | 13.02 | 12.93 | 12.57 | 12.33 | 13.43 | 11.46 | ** | + | ** | + |
| NT2RP3002762 | 17.62 | 11.52 | 8.02 | 10.66 | 16.28 | 10.88 | 8.09 | 6.08 | 11.34 | | | |
| NT2RP3002763 | 5.98 | 3.76 | 3.67 | 6.42 | 6.42 | 5.16 | 4.76 | 6.11 | 4.92 | | | |
| NT2RP3002770 | 6.69 | 2.71 | 1.54 | 4.12 | 4.84 | 3.63 | 3.88 | 6.30 | 6.14 | | | |
| NT2RP3002771 | 4.19 | 4.34 | 2.59 | 8.14 | 7.86 | 8.58 | 10.72 | 12.24 | 8.84 | ** | + | ** | + |
| NT2RP3002785 | 3.87 | 2.70 | 2.07 | 1.69 | 2.61 | 1.77 | 0.79 | 2.12 | 2.01 | | | |
| NT2RP3002790 | 2.54 | 1.59 | 2.82 | 4.68 | 4.85 | 6.90 | 3.49 | 4.63 | 2.59 | * | + | |
| NT2RP3002799 | 2.06 | 0.55 | 1.55 | 2.25 | 2.19 | 2.80 | 1.65 | 2.16 | 2.21 | | | |

TABLE 268-continued

| | | | | | | | | | | | | |
|---|---|---|---|---|---|---|---|---|---|---|---|---|
| NT2RP3002801 | 3.39 | 2.62 | 3.03 | 5.62 | 4.43 | 4.91 | 3.26 | 3.08 | 2.61 | ** | + | |
| NT2RP3002802 | 9.76 | 4.91 | 4.56 | 5.83 | 7.90 | 5.66 | 5.83 | 5.98 | 7.36 | | | |
| NT2RP3002810 | 2.05 | 2.04 | 1.36 | 1.95 | 2.29 | 2.16 | 2.36 | 3.68 | 3.36 | | * | + |
| NT2RP3002818 | 1.54 | 1.82 | 1.16 | 0.90 | 1.59 | 1.73 | 1.13 | 2.03 | 1.73 | | | |
| NT2RP3002821 | 17.00 | 12.39 | 12.28 | 12.51 | 17.54 | 13.78 | 7.96 | 8.86 | 8.91 | | * | − |

TABLE 269

| | | | | | | | | | | | | | |
|---|---|---|---|---|---|---|---|---|---|---|---|---|---|
| NT2RP3002823 | 1.32 | 1.08 | 1.04 | 1.83 | 2.17 | 1.81 | 1.57 | 3.57 | 2.5 | ** | + | | |
| NT2RP3002825 | 7.13 | 4.05 | 4.87 | 6.63 | 6.04 | 8.47 | 4.09 | 5.57 | 4.15 | | | | |
| NT2RP3002829 | 3.03 | 2.45 | 2.63 | 5.74 | 5.50 | 4.90 | 3 | 3.82 | 3.79 | ** | + | | |
| NT2RP3002831 | 3.87 | 3.21 | 2.77 | 3.69 | 2.99 | 3.89 | 2.66 | 2.74 | 2.29 | | | | |
| NT2RP3002836 | 14.03 | 6.74 | 6.74 | 9.92 | 15.02 | 8.10 | 13.6 | 10.55 | 13.13 | | | | |
| NT2RP3002845 | 6.06 | 2.27 | 2.32 | 3.35 | 4.67 | 5.99 | 2.22 | 2.92 | 5.24 | | | | |
| NT2RP3002852 | 2.14 | 1.57 | 1.15 | 1.52 | 1.72 | 1.72 | 1.78 | 2.42 | 2.44 | | | | |
| NT2RP3002861 | 4.05 | 2.12 | 1.50 | 1.55 | 2.01 | 4.44 | 1.39 | 3.44 | 3.12 | | | | |
| NT2RP3002869 | 6.92 | 5.64 | 4.79 | 4.48 | 4.94 | 3.03 | 3.48 | 5.21 | 5.99 | | | | |
| NT2RP3002874 | 3.62 | 2.41 | 3.09 | 2.41 | 2.83 | 2.25 | 3.7 | 5.14 | 4.58 | | | | |
| NT2RP3002876 | 6.38 | 5.46 | 5.19 | 8.34 | 12.34 | 10.89 | 6.16 | 7.19 | 7.18 | * | + | | |
| NT2RP3002877 | 4.36 | 2.55 | 2.24 | 6.28 | 5.72 | 7.39 | 4.17 | 3.78 | 4.69 | * | + | | |
| NT2RP3002887 | 2.31 | 2.06 | 1.28 | 2.41 | 6.33 | 3.71 | 2.23 | 1.91 | 2.99 | | | | |
| NT2RP3002900 | 4.62 | 3.12 | 1.94 | 6.79 | 7.22 | 4.89 | 6.77 | 4.56 | 5.42 | * | + | | |
| NT2RP3002902 | 13.48 | 7.11 | 7.49 | 17.13 | 16.57 | 10.16 | 8.66 | 6.18 | 6.66 | | | | |
| NT2RP3002909 | 33.33 | 17.88 | 18.92 | 24.91 | 27.67 | 27.33 | 23.19 | 23.81 | 25.55 | | | | |
| NT2RP3002911 | 2.05 | 1.51 | 2.25 | 2.06 | 2.34 | 3.42 | 1.9 | 2.88 | 2.46 | | | | |
| NT2RP3002948 | 2.87 | 2.05 | 2.73 | 3.15 | 3.80 | 3.22 | 3.02 | 3.24 | 4.14 | | | | |
| NT2RP3002953 | 2.95 | 2.20 | 2.80 | 3.91 | 2.99 | 2.13 | 3.94 | 4.99 | 3.35 | | | | |
| NT2RP3002955 | 3.21 | 2.28 | 2.19 | 2.68 | 3.66 | 2.17 | 2.8 | 4.04 | 3.2 | | | | |
| NT2RP3002958 | 5.15 | 1.89 | 1.75 | 8.65 | 9.49 | 5.11 | 5.86 | 5.70 | 7.9 | | | | |
| NT2RP3002969 | 8.37 | 4.79 | 4.07 | 7.09 | 7.89 | 5.99 | 3.82 | 5.59 | 8.02 | | | | |
| NT2RP3002972 | 2.45 | 1.77 | 1.17 | 3.30 | 4.53 | 6.41 | 2.37 | 3.50 | 4.2 | * | + | | − |
| NT2RP3002978 | 3.51 | 1.12 | 0.76 | 1.57 | 2.29 | 1.16 | 1.76 | 2.22 | 2.49 | | | | |
| NT2RP3002983 | 2.09 | 1.72 | 1.47 | 2.93 | 4.10 | 4.53 | 1.5 | 4.04 | 1.42 | * | + | | |
| NT2RP3002985 | 2.93 | 1.24 | 0.64 | 1.80 | 1.57 | 1.56 | 1.03 | 3.24 | 1.64 | | | | |
| NT2RP3002988 | 3.04 | 1.50 | 1.33 | 2.69 | 2.87 | 2.12 | 2.09 | 2.69 | 1.72 | | | | |
| NT2RP3003000 | 5.52 | 4.04 | 3.47 | 8.75 | 7.05 | 6.47 | 5.37 | 5.35 | 7.11 | * | + | | |
| NT2RP3003008 | 3.30 | 1.49 | 1.41 | 3.13 | 2.40 | 2.15 | 3.61 | 1.58 | 2.05 | | | | |
| NT2RP3003012 | 5.75 | 2.52 | 2.34 | 2.71 | 2.38 | 1.98 | 3.89 | 1.73 | 1.65 | | | | |
| NT2RP3003015 | 3.67 | 2.39 | 1.41 | 2.11 | 1.98 | 2.12 | 2.64 | 2.73 | 1.76 | | | | |
| NT2RP3003018 | 5.19 | 3.49 | 2.94 | 3.09 | 5.88 | 7.34 | 2.45 | 3.41 | 8.68 | | | | |
| NT2RP3003028 | 4.42 | 2.89 | 2.76 | 3.64 | 5.83 | 5.34 | 3.92 | 2.05 | 3.21 | | | | |
| NT2RP3003029 | 5.92 | 3.71 | 3.59 | 6.44 | 6.11 | 4.11 | 7.41 | 7.78 | 5.42 | | | | |
| NT2RP3003032 | 8.58 | 6.19 | 7.17 | 18.73 | 18.81 | 11.60 | 10.2 | 11.99 | 14.12 | * | + | * | + |
| NT2RP3003041 | 0.23 | 0.21 | 0.07 | 0.41 | 0.42 | 0.07 | 0.35 | 0.34 | −0.17 | | | | |
| NT2RP3003044 | 7.25 | 3.53 | 3.53 | 7.47 | 6.31 | 4.80 | 5.47 | 4.15 | 4.63 | | | | |
| NT2RP3003047 | 14.58 | 8.48 | 8.68 | 11.39 | 12.06 | 11.40 | 11.77 | 9.28 | 11.88 | | | | |
| NT2RP3003050 | 6.53 | 2.71 | 3.77 | 5.22 | 5.47 | 3.84 | 5.66 | 4.93 | 4.39 | | | | |
| NT2RP3003053 | 17.07 | 9.71 | 8.94 | 14.88 | 15.92 | 20.90 | 14.19 | 12.88 | 11.32 | | | | |
| NT2RP3003059 | 2.32 | 1.74 | 2.11 | 2.95 | 2.30 | 1.48 | 1.32 | 1.45 | 1.42 | | | * | − |
| NT2RP3003061 | 4.13 | 2.99 | 2.62 | 3.51 | 4.22 | 2.44 | 3.64 | 4.14 | 3.12 | | | | |
| NT2RP3003068 | 7.07 | 5.01 | 4.05 | 8.08 | 8.01 | 6.86 | 3.94 | 4.27 | 5.35 | | | | |
| NT2RP3003071 | 7.18 | 5.69 | 5.64 | 19.53 | 14.10 | 9.02 | 3.53 | 6.99 | 4.86 | | | | |
| NT2RP3003076 | 20.24 | 13.69 | 11.73 | 17.25 | 17.10 | 20.23 | 12.75 | 12.44 | 19.06 | | | | |
| NT2RP3003078 | 6.31 | 1.99 | 2.60 | 4.81 | 6.42 | 5.61 | 4.7 | 3.16 | 4.19 | | | | |
| NT2RP3003081 | 5.58 | 3.59 | 4.40 | 7.90 | 10.09 | 9.19 | 6.17 | 5.95 | 6.74 | ** | + | * | + |
| NT2RP3003090 | 4.22 | 2.78 | 2.81 | 6.19 | 7.29 | 6.41 | 3.45 | 3.07 | 3.62 | ** | + | | |
| NT2RP3003097 | 2.80 | 1.80 | 2.13 | 3.12 | 4.85 | 3.19 | 4.18 | 3.63 | 2.96 | | | * | + |
| NT2RP3003098 | 3.43 | 1.98 | 2.02 | 2.28 | 3.12 | 2.15 | 2.19 | 2.67 | 2.43 | | | | |
| NT2RP3003101 | 5.48 | 5.07 | 5.35 | 6.08 | 7.76 | 5.95 | 4.99 | 7.09 | 5.03 | | | | |
| NT2RP3003109 | 14.31 | 7.48 | 6.90 | 18.37 | 16.28 | 14.44 | 15.14 | 17.70 | 14.3 | | | | |
| NT2RP3003121 | ##### | 6.07 | 4.19 | 6.53 | 16.16 | 5.37 | 32.59 | 5.96 | 252 | | | | |
| NT2RP3003133 | 6.04 | 4.14 | 3.20 | 8.62 | 13.38 | 13.91 | 5.16 | 4.56 | 8.91 | * | + | | |
| NT2RP3003137 | 10.77 | 5.97 | 6.19 | 4.43 | 6.11 | 4.14 | 3.41 | 3.49 | 4.4 | | | | |
| NT2RP3003138 | 5.81 | 4.35 | 3.40 | 6.66 | 5.96 | 5.22 | 1.99 | 2.76 | 2.93 | | | | |

TABLE 270

| | | | | | | | | | | | | | |
|---|---|---|---|---|---|---|---|---|---|---|---|---|---|
| NT2RP3003139 | 2.43 | 1.97 | 1.82 | 4.72 | 6.45 | 3.81 | 3.26 | 3.26 | 4.15 | * | + | * | + |
| NT2RP3003145 | 2.66 | 3.16 | 2.32 | 3.58 | 4.86 | 4.52 | 5.45 | 3.67 | 3.72 | * | + | | |
| NT2RP3003150 | 4.45 | 3.91 | 3.35 | 3.70 | 3.28 | 5.66 | 5.36 | 4.59 | 2.96 | | | | |
| NT2RP3003157 | 15.45 | 8.45 | 11.15 | 23.44 | 27.58 | 18.86 | 11.74 | 13.90 | 10.21 | * | + | | |
| NT2RP3003185 | 3.41 | 2.15 | 1.16 | 2.42 | 3.21 | 3.33 | 3.63 | 2.51 | 4.07 | | | | |
| NT2RP3003193 | 5.13 | 4.24 | 4.83 | 11.32 | 20.09 | 13.42 | 6.1 | 6.95 | 8.42 | * | + | * | + |
| NT2RP3003197 | 3.94 | 1.73 | 2.04 | 2.63 | 7.18 | 5.13 | 2.76 | 3.02 | 4.74 | | | | |

TABLE 270-continued

| | | | | | | | | | | | | |
|---|---|---|---|---|---|---|---|---|---|---|---|---|
| NT2RP3003203 | 10.74 | 6.48 | 7.57 | 9.78 | 9.35 | 10.34 | 12.74 | 12.49 | 16.29 | | | * | + |
| NT2RP3003204 | 5.10 | 4.07 | 4.28 | 9.44 | 9.51 | 9.35 | 6.59 | 6.58 | 5.8 | ** | + | * | + |
| NT2RP3003210 | 2.87 | 2.26 | 2.76 | 4.58 | 4.94 | 5.68 | 4.02 | 4.31 | 4.86 | ** | + | ** | + |
| NT2RP3003212 | 3.99 | 3.41 | 3.08 | 11.16 | 9.44 | 5.92 | 5.65 | 5.21 | 4.76 | * | + | ** | + |
| NT2RP3003213 | 3.64 | 1.51 | 1.06 | 6.12 | 6.44 | 4.09 | 4.51 | 3.54 | 3.74 | * | + | | |
| NT2RP3003224 | 4.97 | 2.24 | 2.03 | 5.15 | 4.35 | 3.48 | 1.88 | 2.89 | 5.66 | | | | |
| NT2RP3003226 | 6.57 | 4.20 | 3.82 | 5.03 | 7.40 | 7.29 | 3.35 | 4.03 | 3.53 | | | | |
| NT2RP3003230 | 5.88 | 2.80 | 3.00 | 5.34 | 6.53 | 3.95 | 6.24 | 6.52 | 4.98 | | | | |
| NT2RP3003235 | 5.68 | 3.50 | 3.55 | 11.57 | 10.99 | 8.51 | 10.86 | 10.22 | 8.85 | ** | + | ** | + |
| NT2RP3003242 | 2.60 | 1.56 | 1.56 | 2.17 | 2.65 | 0.82 | 2.88 | 3.62 | 2.34 | | | | |
| NT2RP3003251 | 6.96 | 4.06 | 5.58 | 8.26 | 9.86 | 10.16 | 5.03 | 5.10 | 5.01 | * | + | | |
| NT2RP3003252 | 3.92 | 3.17 | 2.70 | 4.36 | 6.32 | 3.73 | 3.3 | 3.53 | 3.19 | | | | |
| NT2RP3003258 | 4.44 | 4.88 | 5.51 | 5.73 | 7.67 | 6.20 | 6.76 | 5.52 | 8.07 | | | | |
| NT2RP3003260 | 10.73 | 5.21 | 4.49 | 5.79 | 7.69 | 5.80 | 4.33 | 3.45 | 7.99 | | | | |
| NT2RP3003264 | 3.02 | 3.32 | 2.19 | 15.38 | 18.88 | 12.82 | 6.5 | 5.90 | 7.82 | ** | + | ** | + |
| NT2RP3003273 | 3.18 | 1.91 | 3.15 | 2.64 | 2.58 | 3.24 | 1.86 | 3.56 | 1.93 | | | | |
| NT2RP3003278 | 3.16 | 1.06 | 0.85 | 1.38 | 1.88 | 2.32 | 0.32 | 2.37 | 2.1 | | | | |
| NT2RP3003280 | 11.26 | 9.07 | 8.30 | 12.96 | 14.31 | 12.01 | 8.63 | 10.92 | 9.88 | * | + | | |
| NT2RP3003282 | 2.12 | 1.63 | 1.57 | 3.75 | 3.52 | 2.64 | 2.53 | 3.71 | 3.58 | * | + | * | + |
| NT2RP3003290 | 6.74 | 3.39 | 5.29 | 8.39 | 9.77 | 12.47 | 5.55 | 7.58 | 4.52 | * | + | | |
| NT2RP3003301 | 3.39 | 1.66 | 2.31 | 5.80 | 5.15 | 3.88 | 3.51 | 3.63 | 2.51 | * | + | | |
| NT2RP3003302 | 4.39 | 1.94 | 0.70 | 3.91 | 4.34 | 3.52 | 1.87 | 2.40 | 2.1 | | | | |
| NT2RP3003311 | 6.06 | 3.51 | 2.81 | 1.70 | 1.60 | 1.58 | 1.38 | 2.35 | 2.23 | | | | |
| NT2RP3003312 | 2.65 | 1.71 | 1.08 | 1.61 | 2.31 | 2.14 | 2.34 | 3.94 | 2.4 | | | | |
| NT2RP3003313 | 2.10 | 1.55 | 1.28 | 2.78 | 3.32 | 3.29 | 2.46 | 3.52 | 2.12 | ** | + | | |
| NT2RP3003327 | 4.75 | 3.06 | 2.77 | 5.48 | 4.57 | 3.91 | 2.76 | 4.36 | 2.87 | | | | |
| NT2RP3003330 | 2.85 | 1.28 | 1.93 | 2.62 | 3.38 | 1.73 | 2.22 | 3.78 | 2.76 | | | | |
| NT2RP3003344 | 2.79 | 2.00 | 1.76 | 2.66 | 2.98 | 3.04 | 2.26 | 1.95 | 1.8 | | | | |
| NT2RP3003346 | 5.06 | 3.51 | 3.24 | 6.69 | 7.03 | 5.74 | 4.23 | 5.12 | 4.21 | * | + | | |
| NT2RP3003349 | 9.03 | 3.41 | 4.20 | 7.42 | 11.99 | 8.27 | 4.03 | 4.39 | 5.81 | | | | |
| NT2RP3003353 | 2.34 | 1.65 | 0.86 | 3.37 | 3.35 | 2.15 | 1.15 | 2.11 | 2.73 | | | | |
| NT2RP3003354 | 28.51 | 16.58 | 19.06 | 32.92 | 34.54 | 31.72 | 24.06 | 25.56 | 26.43 | * | + | | |
| NT2RP3003368 | 4.73 | 3.35 | 3.40 | 3.00 | 5.12 | 6.89 | 5.78 | 4.93 | 4.85 | | | | |
| NT2RP3003375 | 7.10 | 4.96 | 7.12 | 8.55 | 8.55 | 5.98 | 2.32 | 4.29 | 4.97 | | | | |
| NT2RP3003377 | 7.20 | 4.93 | 4.97 | 2.66 | 4.68 | 3.75 | 3.7 | 3.85 | 3.56 | | | | |
| NT2RP3003384 | 2.46 | 2.07 | 1.01 | 3.30 | 3.65 | 2.66 | 3.02 | 2.86 | 2.88 | | | | |
| NT2RP3003385 | 5.42 | 4.79 | 5.32 | 4.48 | 4.42 | 6.30 | 6.9 | 4.85 | 5.01 | | | | |
| NT2RP3003396 | 9.36 | 4.73 | 3.86 | 5.45 | 9.23 | 6.23 | 6.71 | 5.33 | 6.72 | | | | |
| NT2RP3003403 | 3.05 | 1.65 | 1.51 | 5.41 | 4.67 | 5.69 | 2.27 | 2.49 | 2.78 | ** | + | | |
| NT2RP3003409 | 2.84 | 1.35 | 2.12 | 3.28 | 3.13 | 1.88 | 2.79 | 2.04 | 3.14 | | | | |
| NT2RP3003411 | 8.55 | 4.92 | 6.03 | 7.49 | 10.91 | 12.20 | 6.24 | 6.43 | 9.99 | | | | |
| NT2RP3003420 | 4.15 | 2.44 | 2.36 | 6.31 | 7.10 | 8.42 | 3.61 | 4.27 | 6.2 | ** | + | | |
| NT2RP3003425 | 3.63 | 2.52 | 1.95 | 2.10 | 3.46 | 2.62 | 1.83 | 3.37 | 4.24 | | | | |
| NT2RP3003426 | 9.31 | 6.11 | 5.45 | 12.48 | 10.53 | 11.34 | 9.4 | 9.12 | 8.46 | * | + | | |
| NT2RP3003427 | 8.99 | 4.74 | 5.99 | 5.37 | 7.25 | 6.52 | 7.72 | 5.96 | 8.43 | | | | |
| NT2RP3003433 | 9.63 | 4.28 | 3.87 | 11.80 | 10.94 | 8.04 | 5.78 | 4.80 | 7.07 | | | | |
| NT2RP3003437 | 18.34 | 7.27 | 6.59 | 15.83 | 19.21 | 15.84 | 12.02 | 13.41 | 15.15 | | | | |
| NT2RP3003448 | 6.95 | 4.49 | 2.68 | 9.13 | 8.95 | 5.55 | 5.56 | 5.02 | 6.11 | | | | |
| NT2RP3003455 | 8.08 | 3.54 | 2.51 | 10.14 | 9.73 | 10.02 | 5.84 | 8.37 | 5.46 | * | + | | |

TABLE 271

| | | | | | | | | | | | | |
|---|---|---|---|---|---|---|---|---|---|---|---|---|
| NT2RP3003462 | 4.12 | 2.91 | 3.40 | 4.80 | 6.31 | 3.84 | 3.87 | 5.08 | 5.3 | | | | |
| NT2RP3003464 | 2.09 | 1.93 | 2.25 | 2.69 | 2.89 | 1.33 | 2.08 | 3.11 | 2.15 | | | | |
| NT2RP3003469 | 3.14 | 2.14 | 3.25 | 2.94 | 4.36 | 3.12 | 4.25 | 4.89 | 4.48 | | | * | + |
| NT2RP3003473 | 89.05 | 73.31 | 85.12 | 31.82 | 60.74 | 51.48 | 32.07 | 37.27 | 32.95 | * | − | ** | − |
| NT2RP3003474 | 3.72 | 1.64 | 1.41 | 2.81 | 4.68 | 2.60 | 1.76 | 1.83 | 5 | | | | |
| NT2RP3003475 | 5.61 | 2.84 | 3.02 | 4.26 | 5.48 | 3.96 | 3.12 | 2.86 | 5.38 | | | | |
| NT2RP3003490 | 2.57 | 1.77 | 0.90 | 2.92 | 3.66 | 2.60 | 1.94 | 2.99 | 7.73 | | | | |
| NT2RP3003491 | 3.82 | 1.31 | 1.56 | 3.52 | 3.19 | 3.71 | 1.08 | 3.23 | 2.23 | | | | |
| NT2RP3003493 | 32.32 | 24.24 | 22.86 | 18.58 | 22.23 | 21.78 | 10.29 | 22.93 | 16.25 | | | | |
| NT2RP3003500 | 1.40 | 1.72 | 1.09 | 3.53 | 3.58 | 2.03 | 2.25 | 3.61 | 2.95 | * | + | * | + |
| NT2RP3003527 | 2.93 | 1.02 | 1.39 | 2.26 | 3.40 | 1.33 | 1.5 | 4.37 | 4.13 | | | | |
| NT2RP3003532 | 6.83 | 4.04 | 4.22 | 15.20 | 17.07 | 14.08 | 8.23 | 6.65 | 7.28 | ** | + | | |
| NT2RP3003535 | 1.58 | 1.03 | 0.30 | 1.85 | 1.07 | 0.98 | 1.62 | 1.27 | 0.97 | | | | |
| NT2RP3003536 | 2.90 | 2.77 | 1.64 | 5.15 | 3.92 | 4.74 | 3.97 | 3.71 | 2.81 | * | + | | |
| NT2RP3003543 | 4.72 | 4.39 | 3.25 | 5.41 | 8.08 | 7.02 | 5.2 | 5.49 | 1.98 | * | + | | |
| NT2RP3003549 | 2.71 | 2.81 | 2.37 | 2.41 | 3.79 | 4.08 | 3.3 | 2.30 | 1.66 | | | | |
| NT2RP3003552 | 1.05 | 1.06 | 0.00 | 1.19 | 1.29 | 1.21 | 0.42 | 0.40 | 0.79 | | | | |
| NT2RP3003555 | 7.69 | 3.49 | 4.38 | 7.36 | 8.38 | 9.29 | 5.4 | 5.33 | 4.02 | | | | |
| NT2RP3003559 | 2.48 | 1.02 | 1.13 | 2.42 | 2.15 | 3.37 | 1.46 | 1.90 | 0.56 | | | | |
| NT2RP3003564 | 6.10 | 3.28 | 3.23 | 6.06 | 5.72 | 4.12 | 4.46 | 3.78 | 4.48 | | | | |
| NT2RP3003572 | 4.33 | 3.51 | 2.66 | 3.48 | 4.50 | 3.26 | 3.67 | 4.32 | 2.39 | | | | |
| NT2RP3003576 | 14.59 | 6.63 | 6.37 | 16.23 | 21.96 | 19.84 | 10.82 | 10.96 | 8.97 | * | + | | |
| NT2RP3003587 | 15.06 | 8.22 | 7.88 | 8.40 | 8.95 | 10.51 | 3.86 | 6.31 | 3.33 | | | | |
| NT2RP3003589 | 14.90 | 11.19 | 8.98 | 10.98 | 18.16 | 17.00 | 16.77 | 16.70 | 14.61 | | | | |

TABLE 271-continued

| | | | | | | | | | | | | |
|---|---|---|---|---|---|---|---|---|---|---|---|---|
| NT2RP3003592 | 6.07 | 3.40 | 4.66 | 3.72 | 5.45 | 5.40 | 3.54 | 4.53 | 3.89 | | | |
| NT2RP3003593 | 5.28 | 1.75 | 2.13 | 3.76 | 3.86 | 7.00 | 3.06 | 4.00 | 2.78 | | | |
| NT2RP3003614 | 14.05 | 8.27 | 10.10 | 10.29 | 8.15 | 9.17 | 8.06 | 7.21 | 4.02 | | | |
| NT2RP3003621 | 3.29 | 1.07 | 1.69 | 2.23 | 2.27 | 2.45 | 2.08 | 2.77 | 2.99 | | | |
| NT2RP3003625 | 11.53 | 5.52 | 5.48 | 9.50 | 9.71 | 7.13 | 7.18 | 5.14 | 5.56 | | | |
| NT2RP3003627 | 12.05 | 7.44 | 6.80 | 53.97 | 42.81 | 41.76 | 14.96 | 15.18 | 18.14 | ** | + | * | + |
| NT2RP3003636 | 5.65 | 3.72 | 2.95 | 5.93 | 6.64 | 5.54 | 5.93 | 5.72 | 5.63 | | | |
| NT2RP3003642 | 10.88 | 8.03 | 6.37 | 13.82 | 13.96 | 17.20 | 12.37 | 12.40 | 16.41 | * | + | * | + |
| NT2RP3003645 | 4.17 | 3.33 | 1.50 | 5.78 | 5.31 | 6.65 | 5.06 | 5.99 | 4.7 | * | + | | |
| NT2RP3003648 | 3.24 | 3.31 | 3.16 | 4.15 | 4.43 | 3.91 | 5.07 | 3.21 | 3.18 | ** | + | | |
| NT2RP3003649 | 1.14 | 1.88 | 2.86 | 2.19 | 4.90 | 3.66 | 0.71 | 3.92 | 1.08 | | | |
| NT2RP3003650 | 8.11 | 4.45 | 2.20 | 4.63 | 4.76 | 4.42 | 3.39 | 3.56 | 3.36 | | | |
| NT2RP3003656 | 5.22 | 3.74 | 1.88 | 3.30 | 4.87 | 4.62 | 3.45 | 3.40 | 2.71 | | | |
| NT2RP3003659 | 7.45 | 4.72 | 4.52 | 4.36 | 6.73 | 4.25 | 3.17 | 3.21 | 3.03 | | | |
| NT2RP3003662 | 9.17 | 7.44 | 5.08 | 10.50 | 15.08 | 10.64 | 9.44 | 8.85 | 8.35 | | | |
| NT2RP3003664 | 8.73 | 4.21 | 6.55 | 11.31 | 14.75 | 9.76 | 9.24 | 8.50 | 9.85 | | | |
| NT2RP3003665 | 1.46 | 2.31 | 3.07 | 2.00 | 3.22 | 2.55 | 1.63 | 2.93 | 1.01 | | | |
| NT2RP3003671 | 3.15 | 3.24 | 2.25 | 2.59 | 7.96 | 5.47 | 2.17 | 4.14 | 1.93 | | | |
| NT2RP3003672 | 4.15 | 3.09 | 2.96 | 4.72 | 7.37 | 5.47 | 2.79 | 4.69 | 3.17 | * | + | | |
| NT2RP3003673 | 4.51 | 3.32 | 1.35 | 5.41 | 6.14 | 2.58 | 4.36 | 4.67 | 3.13 | | | |
| NT2RP3003679 | 34.38 | 42.38 | 35.15 | 32.46 | 39.83 | 37.84 | 41.64 | 35.07 | 42.5 | | | |
| NT2RP3003680 | 6.95 | 3.40 | 1.56 | 4.84 | 3.86 | 4.38 | 2.61 | 3.70 | 3.96 | | | |
| NT2RP3003686 | 5.14 | 3.55 | 2.82 | 3.79 | 4.38 | 5.04 | 4.26 | 3.62 | 2.84 | | | |
| NT2RP3003689 | 3.80 | 2.46 | 2.57 | 6.17 | 7.73 | 5.84 | 3.57 | 4.94 | 3.47 | ** | + | | |
| NT2RP3003697 | 1.90 | 2.24 | 1.34 | 1.76 | 2.19 | 2.72 | 2.08 | 3.11 | 1.51 | | | |
| NT2RP3003701 | 1.92 | 1.12 | 1.36 | 1.56 | 1.36 | 1.59 | 2.02 | 2.99 | 1.34 | | | |
| NT2RP3003704 | 5.17 | 3.39 | 3.77 | 6.61 | 6.98 | 7.53 | 4.92 | 5.10 | 3.69 | ** | + | | |
| NT2RP3003714 | 3.30 | 1.91 | 1.74 | 4.60 | 3.93 | 3.09 | 3.44 | 3.54 | 1.64 | | | |
| NT2RP3003716 | 2.44 | 2.40 | 1.34 | 4.13 | 2.42 | 3.98 | 2.31 | 2.88 | 2.92 | | | |
| NT2RP3003721 | 4.90 | 3.12 | 2.28 | 4.84 | 6.16 | 4.98 | 4.29 | 3.50 | 4.65 | | | |
| NT2RP3003722 | 8.02 | 5.81 | 5.39 | 6.08 | 4.24 | 4.20 | 2.09 | 3.67 | 2.7 | | | * | − |
| NT2RP3003726 | 6.59 | 6.25 | 3.44 | 4.38 | 3.30 | 5.00 | 5.53 | 4.21 | 4.73 | | | |

TABLE 272

| | | | | | | | | | | | | |
|---|---|---|---|---|---|---|---|---|---|---|---|---|
| NT2RP3003729 | 3.69 | 2.88 | 2.55 | 4.06 | 4.92 | 3.98 | 2.8 | 3.60 | 3.35 | * | + | | |
| NT2RP3003731 | 6.61 | 4.33 | 5.75 | 7.10 | 14.90 | 8.06 | 5.99 | 7.15 | 5.75 | | | |
| NT2RP3003740 | 4.78 | 3.50 | 4.29 | 5.32 | 3.89 | 4.79 | 4.16 | 4.89 | 3.61 | | | |
| NT2RP3003746 | 5.36 | 3.49 | 2.71 | 5.20 | 7.52 | 3.17 | 3.94 | 3.31 | 4.02 | | | |
| NT2RP3003749 | 0.76 | 0.62 | 0.17 | 0.29 | 1.19 | 1.12 | 0.64 | 1.30 | 0.75 | | | |
| NT2RP3003754 | 5.00 | 3.26 | 5.25 | 7.46 | 7.69 | 6.19 | 5.46 | 4.91 | 4.55 | * | + | | |
| NT2RP3003759 | 1.70 | 0.69 | 0.73 | 1.39 | 1.06 | 0.48 | 0.73 | 2.09 | 2.41 | | | |
| NT2RP3003764 | 7.97 | 5.68 | 5.63 | 6.40 | 8.69 | 7.67 | 5.36 | 5.99 | 4.9 | | | |
| NT2RP3003766 | 4.56 | 2.73 | 2.99 | 3.97 | 4.19 | 3.87 | 3.96 | 3.75 | 3.32 | | | |
| NT2RP3003767 | 6.96 | 5.70 | 6.63 | 13.57 | 9.41 | 11.81 | 7.79 | 9.76 | 8.37 | * | + | * | − |
| NT2RP3003778 | 5.19 | 3.99 | 4.33 | 9.90 | 11.58 | 8.75 | 5.62 | 5.86 | 5.15 | ** | + | | |
| NT2RP3003779 | 13.01 | 5.97 | 4.99 | 6.05 | 7.93 | 6.85 | 7.17 | 5.72 | 8.58 | | | |
| NT2RP3003783 | 19.26 | 10.08 | 8.20 | 11.73 | 11.20 | 13.62 | 12.33 | 9.52 | 7.82 | | | |
| NT2RP3003787 | 4.90 | 2.40 | 2.22 | 2.44 | 3.52 | 4.85 | 2.78 | 3.53 | 7.22 | | | |
| NT2RP3003789 | 5.36 | 4.73 | 2.56 | 3.44 | 7.01 | 5.23 | 5.4 | 5.55 | 4.62 | | | |
| NT2RP3003795 | 2.17 | 1.85 | 1.40 | 3.14 | 2.08 | 3.57 | 2.46 | 3.18 | 2.41 | | | |
| NT2RP3003799 | 2.89 | 2.29 | 1.32 | 1.87 | 1.75 | 2.53 | 1.45 | 2.24 | 2.66 | | | |
| NT2RP3003800 | 3.51 | 2.88 | 4.22 | 3.79 | 5.81 | 4.55 | 3.66 | 3.45 | 2.49 | | | |
| NT2RP3003805 | 6.47 | 3.37 | 3.41 | 4.89 | 4.12 | 5.73 | 3.59 | 4.60 | 4.09 | | | |
| NT2RP3003809 | 5.03 | 1.78 | 2.92 | 4.79 | 3.39 | 3.28 | 1.85 | 3.89 | 3.58 | | | |
| NT2RP3003819 | 20.93 | 12.43 | 10.20 | 22.69 | 23.35 | 18.68 | 16.05 | 13.33 | 11.82 | | | |
| NT2RP3003824 | 12.10 | 8.20 | 9.56 | 14.53 | 12.56 | 14.16 | 10.06 | 10.73 | 7.38 | * | + | | |
| NT2RP3003825 | 22.51 | 14.11 | 14.65 | 13.44 | 18.74 | 15.00 | 10.89 | 9.86 | 10.89 | | | |
| NT2RP3003828 | 3.66 | 3.06 | 2.75 | 5.51 | 4.72 | 4.12 | 2.65 | 4.12 | 4.14 | * | + | | |
| NT2RP3003831 | 2.13 | 2.74 | 2.94 | 4.32 | 4.71 | 5.94 | 3.1 | 4.50 | 4.33 | * | + | | |
| NT2RP3003833 | 5.17 | 2.54 | 2.51 | 3.72 | 3.00 | 5.07 | 4.52 | 4.42 | 4 | | | |
| NT2RP3003836 | 7.43 | 5.49 | 5.12 | 9.64 | 6.79 | 8.16 | 7.54 | 6.97 | 9.43 | | | |
| NT2RP3003842 | 17.19 | 8.40 | 7.68 | 16.76 | 16.34 | 13.12 | 12.09 | 8.43 | 8.61 | | | |
| NT2RP3003843 | 11.40 | 7.50 | 6.65 | 20.59 | 22.26 | 19.09 | 11.26 | 10.84 | 11.37 | ** | + | | |
| NT2RP3003844 | 12.70 | 8.55 | 6.42 | 7.70 | 6.74 | 8.49 | 13.96 | 12.46 | 12.2 | | | |
| NT2RP3003846 | 3.76 | 1.97 | 2.48 | 4.49 | 3.48 | 4.92 | 2.73 | 3.31 | 3.38 | | | |
| NT2RP3003849 | 4.75 | 3.02 | 2.95 | 4.08 | 4.65 | 4.41 | 2.89 | 4.41 | 5.12 | | | |
| NT2RP3003862 | 8.19 | 5.27 | 4.97 | 5.73 | 7.14 | 6.59 | 9.21 | 6.75 | 9.43 | | | |
| NT2RP3003870 | 8.87 | 6.42 | 4.81 | 9.09 | 8.35 | 8.66 | 8.21 | 7.03 | 8.25 | | | |
| NT2RP3003874 | 4.83 | 4.91 | 4.32 | 6.66 | 5.96 | 5.92 | 4.88 | 5.78 | 3.78 | ** | + | | |
| NT2RP3003876 | 8.40 | 4.71 | 3.53 | 8.21 | 6.66 | 5.04 | 3.88 | 4.35 | 5.13 | | | |
| NT2RP3003880 | 3.42 | 3.11 | 2.28 | 6.01 | 6.99 | 4.51 | 4.71 | 5.26 | 4.07 | * | + | * | + |
| NT2RP3003889 | 1.46 | 1.88 | 0.92 | 1.03 | 3.20 | 2.06 | 0.85 | 2.31 | 2.72 | | | |
| NT2RP3003891 | 1.54 | 2.30 | 0.87 | 1.75 | 2.99 | 2.00 | 1.08 | 2.80 | 2.25 | | | |
| NT2RP3003914 | 7.95 | 4.51 | 4.21 | 5.57 | 7.65 | 7.02 | 5.69 | 6.39 | 7.2 | | | |
| NT2RP3003915 | 1.86 | 2.20 | 1.19 | 1.63 | 2.60 | 2.36 | 2.19 | 3.03 | 2.1 | | | |

TABLE 272-continued

| | | | | | | | | | | | | |
|---|---|---|---|---|---|---|---|---|---|---|---|---|
| NT2RP3003918 | 5.05 | 3.66 | 2.14 | 2.83 | 4.62 | 2.98 | 3.63 | 5.42 | 5.25 | | | |
| NT2RP3003920 | 4.98 | 4.36 | 2.71 | 6.50 | 6.25 | 5.72 | 5.51 | 6.91 | 3.82 | * | + | |
| NT2RP3003924 | 6.49 | 3.55 | 2.01 | 7.69 | 8.02 | 5.14 | 4.31 | 3.95 | 7.6 | | | |
| NT2RP3003932 | 3.65 | 2.42 | 1.71 | 4.82 | 7.98 | 3.41 | 2.85 | 3.76 | 4.41 | | | |
| NT2RP3003939 | 2.69 | 1.67 | 1.95 | 3.86 | 3.92 | 3.18 | 2.41 | 3.31 | 2.98 | * | + | |
| NT2RP3003940 | 15.51 | 8.52 | 7.81 | 11.47 | 11.25 | 8.35 | 8.68 | 9.97 | 7.23 | | | |
| NT2RP3003943 | 3.63 | 3.38 | 2.60 | 2.90 | 3.77 | 1.83 | 2.48 | 3.48 | 4.35 | | | |
| NT2RP3003959 | 2.34 | 2.12 | 1.61 | 3.04 | 4.84 | 3.82 | 2.42 | 3.16 | 4.93 | * | + | |
| NT2RP3003963 | 6.98 | 5.43 | 4.54 | 7.42 | 7.40 | 5.93 | 6.05 | 7.92 | 6.84 | | | |
| NT2RP3003965 | 44.37 | 24.77 | 31.74 | 35.84 | 34.50 | 26.36 | 12.7 | 12.05 | 15.03 | | * | − |
| NT2RP3003972 | 14.33 | 10.15 | 6.83 | 27.44 | 20.29 | 23.76 | 23.62 | 15.59 | 17.39 | * | + | |
| NT2RP3003973 | 8.15 | 5.02 | 3.70 | 7.18 | 5.27 | 4.94 | 5.3 | 5.61 | 3.97 | | | |
| NT2RP3003979 | 11.32 | 8.28 | 4.38 | 9.43 | 15.88 | 13.30 | 10.9 | 7.26 | 6.82 | | | |
| NT2RP3003980 | 10.84 | 7.99 | 7.63 | 8.16 | 9.43 | 9.50 | 5.75 | 7.95 | 4.2 | | | |
| NT2RP3003982 | 1.33 | 3.01 | 1.15 | 1.21 | 2.15 | 2.04 | 1.21 | 3.30 | 0.58 | | | |

TABLE 273

| | | | | | | | | | | | | |
|---|---|---|---|---|---|---|---|---|---|---|---|---|
| NT2RP3003989 | 2.69 | 2.90 | 1.66 | 1.97 | 4.23 | 17.93 | 2.15 | 5.56 | 2.09 | | | |
| NT2RP3003992 | 4.45 | 3.19 | 2.09 | 6.85 | 5.45 | 5.48 | 2.46 | 2.01 | 2.52 | * | + | |
| NT2RP3004000 | 2.21 | 2.96 | 1.05 | 1.76 | 3.78 | 2.06 | 4.87 | 2.93 | 3.16 | | | |
| NT2RP3004001 | 10.03 | 7.36 | 4.34 | 11.63 | 8.96 | 9.72 | 6.39 | 7.58 | 6.18 | | | |
| NT2RP3004005 | 2.84 | 1.39 | 1.85 | 4.23 | 3.15 | 3.89 | 6.12 | 4.26 | 2 | * | + | |
| NT2RP3004013 | 12.35 | 8.49 | 6.06 | 13.19 | 14.63 | 10.33 | 6.81 | 8.18 | 5.23 | | | |
| NT2RP3004016 | 4.50 | 2.25 | 1.85 | 4.36 | 3.71 | 4.81 | 2.81 | 2.48 | 3.43 | | | |
| NT2RP3004025 | 4.30 | 3.53 | 3.53 | 4.99 | 6.65 | 6.46 | 4.38 | 6.03 | 4.27 | * | + | |
| NT2RP3004030 | 22.90 | 14.65 | 17.74 | 29.69 | 32.04 | 29.24 | 22.51 | 18.90 | 19.9 | ** | + | |
| NT2RP3004041 | 2.52 | 1.89 | 2.73 | 9.78 | 7.34 | 7.80 | 4.71 | 4.38 | 4.76 | ** | + | ** | + |
| NT2RP3004042 | 14.33 | 10.61 | 5.39 | 8.88 | 10.41 | 10.70 | 11.54 | 9.64 | 11.73 | | | |
| NT2RP3004044 | 21.83 | 11.12 | 9.61 | 8.22 | 9.50 | 8.35 | 6.17 | 5.06 | 6.39 | | | |
| NT2RP3004051 | 10.03 | 6.48 | 4.32 | 11.50 | 10.92 | 8.70 | 7.09 | 5.39 | 5.97 | | | |
| NT2RP3004052 | 8.89 | 3.73 | 4.41 | 8.80 | 8.69 | 8.41 | 6.86 | 4.66 | 5.92 | | | |
| NT2RP3004053 | 30.17 | 20.41 | 22.51 | 39.10 | 49.24 | 42.11 | 31.51 | 31.71 | 33.47 | * | + | |
| NT2RP3004055 | 4.37 | 1.71 | 1.44 | 3.41 | 6.47 | 4.74 | 2.67 | 3.05 | 2.47 | | | |
| NT2RP3004059 | 4.35 | 3.84 | 2.26 | 4.57 | 5.40 | 6.36 | 4.38 | 3.95 | 3.58 | | | |
| NT2RP3004063 | 3.19 | 5.38 | 4.25 | 5.25 | 3.73 | 4.82 | 2.48 | 4.55 | 2.33 | | | |
| NT2RP3004067 | 20.37 | 6.61 | 6.47 | 9.24 | 9.55 | 7.82 | 8.89 | 7.62 | 7.01 | | | |
| NT2RP3004070 | 5.14 | 4.09 | 2.46 | 6.23 | 5.56 | 5.86 | 6.96 | 3.22 | 4.36 | | | |
| NT2RP3004075 | 4.89 | 3.98 | 3.09 | 4.61 | 4.46 | 5.82 | 3.77 | 3.33 | 3.83 | | | |
| NT2RP3004078 | 6.60 | 3.72 | 3.12 | 5.82 | 6.46 | 5.79 | 5.42 | 4.95 | 4.97 | | | |
| NT2RP3004083 | 2.32 | 2.07 | 2.04 | 35.55 | 41.35 | 31.65 | 20.9 | 19.75 | 24.51 | ** | + | ** | + |
| NT2RP3004084 | 4.82 | 3.89 | 2.80 | 2.32 | 2.21 | 5.07 | 2.3 | 4.34 | 3.24 | | | |
| NT2RP3004087 | 6.30 | 4.80 | 3.92 | 7.31 | 7.31 | 7.55 | 5.02 | 5.55 | 6.07 | * | + | |
| NT2RP3004090 | 3.22 | 2.13 | 1.57 | 4.35 | 5.08 | 3.83 | 3.16 | 6.01 | 4.35 | * | + | |
| NT2RP3004093 | 5.89 | 4.55 | 3.16 | 7.72 | 8.34 | 6.85 | 6.58 | 5.64 | 6.63 | * | + | |
| NT2RP3004095 | 14.57 | 8.24 | 7.88 | 13.27 | 13.82 | 13.04 | 10.11 | 8.74 | 11.47 | | | |
| NT2RP3004102 | 11.19 | 6.90 | 6.93 | 9.17 | 11.74 | 10.70 | 9.42 | 7.28 | 9.35 | | | |
| NT2RP3004110 | 34.95 | 22.41 | 23.25 | 26.04 | 28.26 | 24.02 | 16.77 | 18.06 | 22.74 | | | |
| NT2RP3004119 | 6.91 | 5.16 | 5.08 | 8.05 | 6.96 | 6.49 | 5.73 | 4.82 | 4.73 | | | |
| NT2RP3004125 | 14.03 | 10.35 | 8.98 | 14.12 | 16.80 | 14.86 | 13.91 | 11.06 | 10.62 | | | |
| NT2RP3004129 | 3.44 | 1.56 | 2.05 | 2.41 | 2.99 | 3.58 | 2.35 | 2.48 | 1.77 | | | |
| NT2RP3004130 | 3.67 | 2.75 | 3.57 | 6.28 | 6.18 | 5.89 | 7.37 | 7.97 | 5.85 | ** | + | ** | + |
| NT2RP3004133 | 8.07 | 5.45 | 4.56 | 6.17 | 4.98 | 5.72 | 6.99 | 6.13 | 6.19 | | | |
| NT2RP3004145 | 6.56 | 4.08 | 2.26 | 3.88 | 4.54 | 4.28 | 2.91 | 4.84 | 3.57 | | | |
| NT2RP3004148 | 7.79 | 6.05 | 5.54 | 5.61 | 5.84 | 7.93 | 7.7 | 7.31 | 5.13 | | | |
| NT2RP3004155 | 3.99 | 4.60 | 2.60 | 5.64 | 5.29 | 6.17 | 3.4 | 3.66 | 2.7 | * | + | |
| NT2RP3004165 | 9.52 | 6.71 | 6.33 | 12.69 | 13.98 | 12.98 | 6.82 | 6.51 | 5.79 | ** | + | |
| NT2RP3004179 | 4.17 | 3.60 | 3.22 | 5.35 | 6.25 | 6.22 | 3.75 | 3.01 | 3.75 | ** | + | |
| NT2RP3004185 | 2.33 | 0.68 | 1.31 | 1.91 | 1.20 | 2.96 | 1.8 | 2.34 | 1.86 | | | |
| NT2RP3004188 | 8.37 | 4.08 | 5.91 | 11.26 | 11.20 | 6.76 | 4.54 | 7.20 | 6.27 | | | |
| NT2RP3004189 | 14.04 | 5.66 | 6.06 | 7.02 | 12.29 | 6.24 | 4.85 | 4.58 | 5.6 | | | |
| NT2RP3004190 | 11.54 | 5.42 | 6.63 | 7.75 | 12.77 | 11.72 | 5.49 | 4.47 | 5.81 | | | |
| NT2RP3004191 | 10.44 | 9.83 | 8.83 | 14.00 | 14.26 | 11.80 | 12.41 | 10.04 | 10.36 | * | + | |
| NT2RP3004202 | 2.35 | 2.27 | 2.03 | 3.51 | 4.57 | 3.29 | 3.6 | 3.97 | 5.67 | * | + | * | + |
| NT2RP3004205 | 10.83 | 6.54 | 6.41 | 8.47 | 10.58 | 6.84 | 7.02 | 6.54 | 6.67 | | | |
| NT2RP3004206 | 3.85 | 2.53 | 2.95 | 2.95 | 3.06 | 3.06 | 4.12 | 2.99 | 2.57 | | | |
| NT2RP3004207 | 4.93 | 2.79 | 3.03 | 4.73 | 4.14 | 4.86 | 4.28 | 4.10 | 5.09 | | | |
| NT2RP3004209 | 4.91 | 2.40 | 2.89 | 6.87 | 6.50 | 4.96 | 4.96 | 5.23 | 4.63 | * | + | |
| NT2RP3004215 | 3.55 | 2.78 | 2.14 | 12.42 | 8.20 | 7.94 | 3.86 | 4.27 | 5.18 | * | + | * | + |
| NT2RP3004219 | 16.93 | 6.45 | 7.83 | 7.64 | 9.11 | 7.10 | 7.36 | 6.55 | 7.25 | | | |
| NT2RP3004242 | 5.13 | 4.26 | 3.60 | 4.45 | 5.10 | 4.52 | 4.84 | 3.47 | 2.95 | | | |
| NT2RP3004246 | 4.82 | 4.45 | 3.64 | 5.22 | 7.08 | 6.18 | 4.56 | 5.99 | 5.39 | * | + | |
| NT2RP3004253 | 1.98 | 2.17 | 2.49 | 2.39 | 1.93 | 2.99 | 2.38 | 3.72 | 5.59 | | | |
| NT2RP3004258 | 11.77 | 7.63 | 9.50 | 10.32 | 13.55 | 13.92 | 4.51 | 6.56 | 5.46 | | * | − |

TABLE 274

| | | | | | | | | | | | | | |
|---|---|---|---|---|---|---|---|---|---|---|---|---|---|
| NT2RP3004262 | 4.35 | 2.96 | 2.85 | 2.71 | 3.57 | 4.45 | 4.01 | 4.72 | 3.41 | | | | |
| NT2RP3004275 | 3.72 | 3.04 | 2.37 | 3.29 | 3.02 | 3.38 | 3.39 | 4.75 | 1.04 | | | | |
| NT2RP3004282 | 12.87 | 5.01 | 5.72 | 9.16 | 11.91 | 6.32 | 7.38 | 7.58 | 6.69 | | | | |
| NT2RP3004289 | 3.01 | 2.85 | 1.46 | 6.88 | 5.77 | 3.72 | 2.35 | 3.31 | 3.68 | * | + | | |
| NT2RP3004294 | 7.18 | 3.41 | 2.73 | 24.46 | 29.15 | 28.18 | 20.58 | 15.67 | 20.34 | ** | + | ** | + |
| NT2RP3004298 | 7.07 | 5.08 | 3.77 | 5.00 | 5.97 | 6.16 | 6.4 | 6.06 | 5.61 | | | | |
| NT2RP3004309 | 10.96 | 7.28 | 6.61 | 7.01 | 8.68 | 7.42 | 5.52 | 6.85 | 6.57 | | | | |
| NT2RP3004321 | 11.18 | 6.12 | 7.27 | 9.56 | 8.71 | 10.32 | 7.19 | 8.23 | 10.39 | | | | |
| NT2RP3004322 | 3.28 | 2.42 | 1.89 | 3.12 | 2.58 | 3.70 | 3.77 | 3.09 | 3.39 | | | | |
| NT2RP3004332 | 6.32 | 6.72 | 6.36 | 11.24 | 8.54 | 10.03 | 4.86 | 8.82 | 5.48 | * | + | | |
| NT2RP3004334 | 4.49 | 2.34 | 2.27 | 5.43 | 4.10 | 3.66 | 2.44 | 1.92 | 2.32 | | | | |
| NT2RP3004336 | 5.86 | 3.72 | 2.08 | 6.83 | 9.08 | 6.19 | 5.13 | 6.87 | 5.49 | | | | |
| NT2RP3004338 | 11.56 | 5.52 | 9.71 | 8.36 | 5.67 | 6.93 | 5.31 | 4.61 | 6.32 | | | | |
| NT2RP3004341 | 2.24 | 1.74 | 1.67 | 2.56 | 2.48 | 3.60 | 1.13 | 2.35 | 3.45 | | | | |
| NT2RP3004345 | 3.27 | 3.23 | 2.25 | 3.71 | 4.02 | 3.88 | 3.2 | 3.07 | 4.38 | | | | |
| NT2RP3004348 | 8.53 | 5.32 | 6.83 | 14.49 | 13.97 | 11.82 | 7.76 | 7.80 | 9.23 | ** | + | | |
| NT2RP3004349 | 10.22 | 7.24 | 8.20 | 12.70 | 11.94 | 13.01 | 6.98 | 7.06 | 5.47 | * | + | | |
| NT2RP3004355 | 6.08 | 5.70 | 3.65 | 5.80 | 6.46 | 7.00 | 4.88 | 5.01 | 4.97 | | | | |
| NT2RP3004356 | 13.62 | 7.29 | 6.71 | 12.35 | 15.04 | 10.32 | 9.71 | 9.44 | 9.13 | | | | |
| NT2RP3004360 | 7.52 | 3.61 | 3.49 | 4.81 | 4.04 | 4.08 | 2.07 | 3.17 | 4.82 | | | | |
| NT2RP3004361 | 16.01 | 7.31 | 5.66 | 15.99 | 14.58 | 14.13 | 4.38 | 5.01 | 4.13 | | | | |
| NT2RP3004374 | 7.91 | 4.13 | 3.84 | 7.91 | 7.91 | 7.64 | 5.99 | 5.39 | 5.89 | | | | |
| NT2RP3004378 | 26.21 | 17.19 | 14.59 | 10.81 | 12.69 | 11.18 | 6.13 | 10.86 | 9.07 | | | * | − |
| NT2RP3004399 | 2.04 | 2.65 | 1.39 | 1.42 | 2.99 | 2.67 | 1.58 | 2.38 | 2.75 | | | | |
| NT2RP3004405 | 3.95 | 3.77 | 2.00 | 4.65 | 7.05 | 3.79 | 3.22 | 5.96 | 4.47 | | | | |
| NT2RP3004406 | 7.20 | 4.61 | 5.55 | 5.61 | 8.40 | 5.80 | 5.82 | 7.89 | 6.47 | | | | |
| NT2RP3004411 | 7.77 | 3.85 | 3.09 | 16.41 | 12.18 | 7.61 | 7.04 | 7.47 | 10.13 | | | | |
| NT2RP3004424 | 4.60 | 1.42 | 1.67 | 3.96 | 3.79 | 2.00 | 1.27 | 3.09 | 4.78 | | | | |
| NT2RP3004428 | 7.15 | 4.01 | 3.24 | 6.42 | 5.85 | 3.58 | 6.97 | 6.90 | 7.98 | | | | |
| NT2RP3004432 | 3.82 | 2.57 | 0.97 | 7.56 | 9.25 | 7.81 | 7.72 | 10.80 | 9.98 | ** | + | ** | + |
| NT2RP3004434 | 9.49 | 5.09 | 3.75 | 6.31 | 8.59 | 6.98 | 5.23 | 4.83 | 5.64 | | | | |
| NT2RP3004446 | 6.23 | 5.35 | 3.39 | 6.60 | 5.96 | 4.57 | 2.58 | 4.37 | 4.71 | | | | |
| NT2RP3004451 | 3.49 | 1.02 | 1.26 | 4.55 | 6.79 | 4.04 | 2.13 | 3.69 | 4.46 | | | | |
| NT2RP3004454 | 3.00 | 1.25 | 1.36 | 2.36 | 2.23 | 1.93 | 1.66 | 2.42 | 2.5 | | | | |
| NT2RP3004466 | 16.12 | 6.82 | 7.66 | 12.66 | 11.01 | 12.35 | 11.52 | 8.75 | 10.08 | | | | |
| NT2RP3004470 | 8.70 | 6.35 | 3.18 | 11.68 | 12.19 | 10.86 | 7.44 | 7.38 | 5.56 | * | + | | |
| NT2RP3004472 | 1.89 | 2.60 | 1.02 | 4.08 | 3.19 | 3.82 | 2.45 | 1.91 | 1.78 | * | + | | |
| NT2RP3004475 | 4.99 | 3.80 | 4.98 | 4.54 | 5.61 | 3.71 | 4.55 | 5.07 | 4.35 | | | | |
| NT2RP3004480 | 7.66 | 5.39 | 3.59 | 15.02 | 14.38 | 12.51 | 8.01 | 7.48 | 6.29 | ** | + | | |
| NT2RP3004481 | 4.24 | 6.01 | 3.44 | 3.84 | 4.84 | 6.10 | 5.51 | 4.88 | 3.41 | | | | |
| NT2RP3004490 | 1.09 | 1.00 | 1.30 | 1.59 | 2.17 | 1.90 | 1.13 | 0.94 | 0.16 | * | + | | |
| NT2RP3004496 | 11.99 | 5.64 | 6.80 | 14.82 | 15.35 | 7.87 | 12.41 | 15.48 | 10.73 | | | | |
| NT2RP3004498 | 10.57 | 6.90 | 5.91 | 5.39 | 8.13 | 7.76 | 7.22 | 4.55 | 5.58 | | | | |
| NT2RP3004503 | 8.32 | 5.77 | 4.24 | 17.06 | 17.79 | 15.82 | 8.93 | 7.92 | 6.72 | ** | + | | |
| NT2RP3004504 | 16.66 | 9.32 | 8.13 | 4.90 | 5.37 | 6.99 | 5.11 | 6.36 | 4.24 | | | | |
| NT2RP3004505 | 8.72 | 5.28 | 4.61 | 4.26 | 5.67 | 7.97 | 8.11 | 8.94 | 7.62 | | | | |
| NT2RP3004507 | 4.86 | 3.25 | 3.44 | 5.31 | 4.59 | 4.43 | 2.27 | 3.02 | 3.06 | | | | |
| NT2RP3004519 | 3.79 | 1.12 | 1.28 | 2.61 | 2.20 | 3.15 | 1.55 | 1.93 | 1.88 | | | | |
| NT2RP3004524 | 1.80 | 1.60 | 2.36 | 2.58 | 1.67 | 4.26 | 2.22 | 2.30 | 1.3 | | | | |
| NT2RP3004527 | 1.16 | 0.95 | 0.83 | 1.29 | 0.90 | 1.98 | 0.25 | 0.54 | 0.6 | | | * | − |
| NT2RP3004534 | 5.79 | 3.52 | 3.93 | 3.26 | 4.89 | 7.19 | 3.48 | 2.92 | 3 | | | | |
| NT2RP3004539 | 14.05 | 8.61 | 6.22 | 8.74 | 9.46 | 10.33 | 9.59 | 6.77 | 9.38 | | | | |
| NT2RP3004541 | 4.42 | 3.07 | 2.91 | 2.08 | 4.14 | 2.58 | 3.82 | 4.01 | 3.83 | | | | |
| NT2RP3004544 | 9.72 | 3.68 | 2.35 | 4.38 | 6.86 | 7.17 | 4.05 | 5.81 | 5.64 | | | | |
| NT2RP3004551 | 3.07 | 2.54 | 2.87 | 4.55 | 5.33 | 3.79 | 4.49 | 4.42 | 3.29 | * | + | * | + |
| NT2RP3004552 | 11.09 | 5.45 | 4.69 | 3.94 | 6.09 | 8.11 | 5.03 | 5.45 | 2.94 | | | | |

TABLE 275

| | | | | | | | | | | | | | |
|---|---|---|---|---|---|---|---|---|---|---|---|---|---|
| NT2RP3004557 | 9.04 | 5.56 | 6.56 | 5.65 | 4.56 | 3.38 | 5.82 | 5.13 | 3.59 | | | | |
| NT2RP3004561 | 5.68 | 3.44 | 3.35 | 5.27 | 5.92 | 3.88 | 4.61 | 5.03 | 4.06 | | | | |
| NT2RP3004566 | 6.63 | 6.29 | 6.33 | 12.53 | 11.01 | 9.47 | 7.43 | 8.46 | 13.57 | ** | + | | |
| NT2RP3004569 | 6.44 | 5.29 | 4.60 | 10.37 | 11.99 | 10.11 | 4.46 | 4.55 | 4.39 | ** | + | | |
| NT2RP3004572 | 3.83 | 3.21 | 2.73 | 4.62 | 5.78 | 5.28 | 4.26 | 4.30 | 2.97 | * | + | | |
| NT2RP3004578 | 5.21 | 3.44 | 2.27 | 5.01 | 7.11 | 5.48 | 3.71 | 3.96 | 4.42 | | | | |
| NT2RP3004584 | 3.59 | 3.64 | 3.56 | 3.31 | 4.74 | 4.86 | 3.85 | 3.43 | 4.22 | | | | |
| NT2RP3004588 | 3.87 | 2.70 | 2.67 | 8.15 | 6.21 | 6.68 | 4.64 | 5.48 | 4.37 | ** | + | * | + |
| NT2RP3004594 | 7.86 | 6.82 | 6.37 | 5.22 | 4.81 | 5.30 | 4.15 | 4.02 | 2.13 | * | − | * | − |
| NT2RP3004603 | 60.30 | 35.19 | 34.71 | 45.07 | 50.01 | 29.71 | 17.9 | 21.98 | 18.08 | | | * | − |
| NT2RP3004612 | 6.30 | 3.05 | 3.45 | 4.40 | 4.92 | 2.76 | 4.05 | 3.39 | 3.11 | | | | |
| NT2RP3004617 | 3.07 | 2.70 | 1.70 | 1.60 | 2.01 | 3.22 | 2.53 | 2.44 | 1.56 | | | | |
| NT2RP3004618 | 3.95 | 2.90 | 2.07 | 5.51 | 5.52 | 3.64 | 3.14 | 3.14 | 4.18 | | | | |
| NT2RP3004625 | 5.48 | 4.10 | 2.95 | 5.75 | 7.50 | 5.56 | 7.41 | 6.90 | 5.44 | | | | |
| NT2RP3004635 | 4.31 | 4.50 | 4.46 | 4.30 | 6.48 | 5.74 | 5.58 | 3.86 | 3.99 | | | | |
| NT2RP3004640 | 3.88 | 3.08 | 3.28 | 7.49 | 7.45 | 6.73 | 5.96 | 5.47 | 4.27 | ** | + | * | + |
| NT2RP3004642 | 10.28 | 8.51 | 8.84 | 14.09 | 13.53 | 15.70 | 10 | 10.58 | 5.55 | ** | + | | |

TABLE 275-continued

| | | | | | | | | | | | | |
|---|---|---|---|---|---|---|---|---|---|---|---|---|
| NT2RP3004647 | 7.16 | 4.79 | 5.37 | 9.93 | 6.54 | 8.91 | 7.81 | 5.99 | 5.6 | | | |
| NT2RP3004652 | 9.07 | 6.60 | 3.76 | 13.15 | 12.30 | 9.92 | 7.24 | 7.33 | 3.44 | * | + | |
| NT2RP3004669 | 8.16 | 5.80 | 4.33 | 5.00 | 7.93 | 5.74 | 5.7 | 5.73 | 5.33 | | | |
| NT2RP3004670 | 14.41 | 12.39 | 9.32 | 16.29 | 20.04 | 15.04 | 13.36 | 13.59 | 15.01 | | | |
| NT2RP4000008 | 15.39 | 10.91 | 11.09 | 13.50 | 10.87 | 9.28 | 9.4 | 8.75 | 8.85 | | | |
| NT2RP4000018 | 9.99 | 5.44 | 8.54 | 9.01 | 5.02 | 7.90 | 7.84 | 6.47 | 7.74 | | | |
| NT2RP4000023 | 5.20 | 4.00 | 3.38 | 3.86 | 2.64 | 2.61 | 3.51 | 4.32 | 2.67 | | | |
| NT2RP4000025 | 5.36 | 5.89 | 4.96 | 8.91 | 15.04 | 11.95 | 12.96 | 16.75 | 13.7 | * | + | ** | + |
| NT2RP4000035 | 8.26 | 5.47 | 5.42 | 13.88 | 11.54 | 12.72 | 5.97 | 11.43 | 5.65 | ** | + | |
| NT2RP4000041 | 8.69 | 5.46 | 1.79 | 1.69 | 4.25 | 2.76 | 4.28 | 5.58 | 4.93 | | | |
| NT2RP4000049 | 4.05 | 2.09 | 2.36 | 3.68 | 4.19 | 3.53 | 5.9 | 5.73 | 3.33 | | | |
| NT2RP4000050 | 3.62 | 2.75 | 1.71 | 2.29 | 3.50 | 3.25 | 3.01 | 5.38 | 3.14 | | | |
| NT2RP4000051 | 7.84 | 3.90 | 4.64 | 5.71 | 7.58 | 5.48 | 5.27 | 7.15 | 5.15 | | | |
| NT2RP4000063 | 4.66 | 2.43 | 2.44 | 3.26 | 2.94 | 4.77 | 3.68 | 5.96 | 2.61 | | | |
| NT2RP4000065 | 4.21 | 2.76 | 2.69 | 4.09 | 3.65 | 3.77 | 3.32 | 3.08 | 2.24 | | | |
| NT2RP4000070 | 3.16 | 2.60 | 2.02 | 6.63 | 8.48 | 9.49 | 3.2 | 4.92 | 3.34 | ** | + | |
| NT2RP4000074 | 1.25 | 0.65 | 0.45 | 1.09 | 0.95 | 1.43 | 1.92 | 3.35 | 1.24 | | | |
| NT2RP4000078 | 19.45 | 8.95 | 8.65 | 15.20 | 11.49 | 10.74 | 9.98 | 6.63 | 6.98 | | | |
| NT2RP4000080 | 16.31 | 10.55 | 9.31 | 16.83 | 24.18 | 15.57 | 14.36 | 10.43 | 16.69 | | | |
| NT2RP4000099 | 48.25 | 34.08 | 34.96 | 222.14 | 203.11 | 165.35 | 108.2 | 86.72 | 64.03 | ** | + | * | + |
| NT2RP4000102 | 1.59 | 3.03 | 0.75 | 2.02 | 3.06 | 3.50 | 2.33 | 2.26 | 2.57 | | | |
| NT2RP4000103 | 2.96 | 1.87 | 1.69 | 2.51 | 4.74 | 2.46 | 2.75 | 4.75 | 2.41 | | | |
| NT2RP4000108 | 7.32 | 4.36 | 4.82 | 47.03 | 44.25 | 37.96 | 49.26 | 38.51 | 49.37 | ** | + | ** | + |
| NT2RP4000109 | 12.97 | 8.34 | 8.98 | 9.50 | 12.20 | 12.85 | 13.79 | 10.89 | 9.27 | | | |
| NT2RP4000111 | 1.66 | 4.14 | 1.76 | 3.30 | 2.22 | 1.71 | 2.22 | 1.42 | 3.11 | | | |
| NT2RP4000112 | 12.62 | 5.96 | 5.20 | 13.14 | 12.78 | 6.27 | 9.14 | 9.28 | 9.82 | | | |
| NT2RP4000115 | 6.69 | 4.45 | 3.10 | 4.28 | 5.71 | 3.35 | 5.12 | 5.25 | 4.95 | | | |
| NT2RP4000129 | 5.85 | 2.83 | 2.30 | 2.80 | 3.92 | 3.49 | 3.8 | 3.85 | 2.88 | | | |
| NT2RP4000137 | 6.85 | 6.38 | 5.53 | 4.82 | 7.68 | 8.16 | 4.3 | 6.03 | 5.81 | | | |
| NT2RP4000138 | 41.16 | 22.51 | 24.42 | 13.11 | 12.17 | 10.03 | 14.81 | 14.41 | 15.27 | ** | − | * | − |
| NT2RP4000141 | 4.89 | 2.65 | 2.93 | 4.06 | 3.52 | 4.29 | 2.76 | 4.18 | 2.03 | | | |
| NT2RP4000147 | 2.17 | 1.29 | 1.74 | 2.55 | 2.46 | 3.03 | 2.68 | 3.29 | 2.54 | * | + | * | + |
| NT2RP4000150 | 7.08 | 4.20 | 5.06 | 8.60 | 7.56 | 6.25 | 7.64 | 8.70 | 6.48 | | | |
| NT2RP4000151 | 7.65 | 4.77 | 3.15 | 5.40 | 5.42 | 4.70 | 5.71 | 4.77 | 7.3 | | | |
| NT2RP4000157 | 47.42 | 28.18 | 24.63 | 140.24 | 151.70 | 90.24 | 64.55 | 61.24 | 48.04 | ** | + | * | + |
| NT2RP4000159 | 2.50 | 1.76 | 1.15 | 1.15 | 1.62 | 2.34 | 1.61 | 2.61 | 1.83 | | | |
| NT2RP4000163 | 26.39 | 20.86 | 16.59 | 7.91 | 9.36 | 8.09 | 5.61 | 5.24 | 4.41 | * | − | ** | − |
| NT2RP4000167 | 3.26 | 3.04 | 2.67 | 3.80 | 3.99 | 4.24 | 2.64 | 3.85 | 3.17 | ** | + | |
| NT2RP4000171 | 7.53 | 5.74 | 5.41 | 5.89 | 7.46 | 4.62 | 5.54 | 5.19 | 6.82 | | | |

TABLE 276

| | | | | | | | | | | | | |
|---|---|---|---|---|---|---|---|---|---|---|---|---|
| NT2RP4000175 | 26.66 | 17.23 | 19.20 | 12.23 | 15.62 | 11.17 | 16.22 | 18.62 | 19.97 | | | |
| NT2RP4000180 | 17.71 | 15.51 | 16.60 | 7.75 | 7.76 | 10.71 | 9.21 | 10.11 | 9.68 | ** | − | ** | − |
| NT2RP4000185 | 14.57 | 9.35 | 5.99 | 12.31 | 15.65 | 9.34 | 8.25 | 9.02 | 7.47 | | | |
| NT2RP4000192 | 9.26 | 5.09 | 4.80 | 6.32 | 4.48 | 3.65 | 4.83 | 4.74 | 4.23 | | | |
| NT2RP4000194 | 3.63 | 2.75 | 1.83 | 3.79 | 5.80 | 2.67 | 3.51 | 4.32 | 4.95 | | | |
| NT2RP4000196 | 8.18 | 4.81 | 3.10 | 7.96 | 7.13 | 5.03 | 5.27 | 5.97 | 5.49 | | | |
| NT2RP4000210 | 28.53 | 18.46 | 17.26 | 28.89 | 37.05 | 27.38 | 24.22 | 22.19 | 25.95 | | | |
| NT2RP4000212 | 12.06 | 7.92 | 6.39 | 16.76 | 20.50 | 16.60 | 12.59 | 12.83 | 12.92 | * | + | |
| NT2RP4000214 | 10.71 | 7.74 | 6.94 | 13.03 | 16.29 | 15.56 | 10.1 | 11.28 | 8.66 | * | + | |
| NT2RP4000216 | 5.44 | 4.53 | 4.98 | 6.46 | 9.49 | 6.90 | 5.75 | 6.76 | 4.95 | | | |
| NT2RP4000218 | 7.33 | 2.22 | 2.67 | 4.98 | 4.33 | 3.81 | 3.81 | 4.58 | 6.27 | | | |
| NT2RP4000223 | 19.92 | 13.17 | 10.28 | 22.13 | 21.62 | 13.05 | 22.62 | 26.76 | 25.86 | | | * | + |
| NT2RP4000243 | 13.18 | 9.89 | 7.93 | 15.15 | 23.34 | 10.85 | 12.84 | 16.56 | 15.03 | | | |
| NT2RP4000246 | 33.96 | 22.95 | 19.51 | 28.17 | 27.99 | 24.14 | 21.88 | 39.67 | 28.61 | | | |
| NT2RP4000250 | 7.99 | 6.43 | 5.04 | 12.08 | 14.24 | 11.05 | 12.85 | 25.59 | 17.99 | ** | + | * | + |
| NT2RP4000256 | 2.39 | 2.62 | 1.51 | 3.73 | 3.59 | 2.62 | 3.4 | 5.63 | 3.02 | | | |
| NT2RP4000257 | 47.78 | 28.06 | 32.52 | 17.19 | 17.58 | 12.15 | 20.3 | 21.14 | 18.74 | * | − | |
| NT2RP4000259 | 4.57 | 3.53 | 4.63 | 12.50 | 13.85 | 8.56 | 9.95 | 10.96 | 10.32 | * | + | ** | + |
| NT2RP4000261 | 4.69 | 3.90 | 2.69 | 4.69 | 4.12 | 2.59 | 6.07 | 3.27 | 3.23 | | | |
| NT2RP4000262 | 8.40 | 4.25 | 5.05 | 10.81 | 7.69 | 5.18 | 7.05 | 4.76 | 3.22 | | | |
| NT2RP4000263 | 2.39 | 2.26 | 1.46 | 3.24 | 1.78 | 2.52 | 2.31 | 2.43 | 1.67 | | | |
| NT2RP4000280 | 19.84 | 10.94 | 16.02 | 14.51 | 20.53 | 17.86 | 16.38 | 15.79 | 14.33 | | | |
| NT2RP4000286 | 14.05 | 12.14 | 5.20 | 8.66 | 7.23 | 8.18 | 6.73 | 10.62 | 6.93 | | | |
| NT2RP4000290 | 4.20 | 3.07 | 2.79 | 5.43 | 3.58 | 4.59 | 3.38 | 3.10 | 2.4 | | | |
| NT2RP4000291 | 18.51 | 15.32 | 18.47 | 45.30 | 38.54 | 34.77 | 17.5 | 19.25 | 13.11 | ** | + | |
| NT2RP4000301 | 2.59 | 1.81 | 1.04 | 2.23 | 2.98 | 3.54 | 2.54 | 3.49 | 1.63 | | | |
| NT2RP4000312 | 4.56 | 1.79 | 4.33 | 4.54 | 4.75 | 3.56 | 5.14 | 2.41 | 5.06 | | | |
| NT2RP4000321 | 13.60 | 6.74 | 4.54 | 13.92 | 11.99 | 10.85 | 8.51 | 8.80 | 9.62 | | | |
| NT2RP4000323 | 3.58 | 2.53 | 1.59 | 2.86 | 3.50 | 3.23 | 2.71 | 3.60 | 1.23 | | | |
| NT2RP4000324 | 7.25 | 5.08 | 2.70 | 5.19 | 6.35 | 3.74 | 5.48 | 4.98 | 4 | | | |
| NT2RP4000334 | 13.97 | 11.43 | 12.75 | 30.03 | 27.15 | 21.64 | 10.28 | 10.30 | 9.71 | ** | + | * | − |
| NT2RP4000343 | 4.98 | 3.25 | 2.65 | 4.86 | 5.56 | 3.68 | 3.76 | 4.39 | 3.15 | | | |
| NT2RP4000348 | 3.02 | 1.79 | 1.77 | 4.45 | 3.35 | 4.09 | 4.17 | 3.46 | 2.74 | * | + | |
| NT2RP4000349 | 2.02 | 3.31 | 1.01 | 2.05 | 0.64 | 3.58 | 0.41 | 1.43 | 0.27 | | | |

TABLE 276-continued

| | | | | | | | | | | | | |
|---|---|---|---|---|---|---|---|---|---|---|---|---|
| NT2RP4000355 | 10.07 | 4.28 | 4.14 | 7.89 | 8.66 | 7.17 | 5.76 | 4.78 | 6.28 | | | |
| NT2RP4000356 | 10.81 | 5.71 | 5.12 | 9.75 | 8.69 | 6.70 | 12.73 | 12.78 | 15.8 | * | + | |
| NT2RP4000360 | 5.76 | 3.41 | 2.25 | 11.67 | 15.48 | 9.10 | 8.87 | 7.21 | 7.44 | * | + | * | + |
| NT2RP4000367 | 2.23 | 2.01 | 1.13 | 1.88 | 2.90 | 1.83 | 2.17 | 1.67 | 2.44 | | | |
| NT2RP4000370 | 4.54 | 3.75 | 1.61 | 3.50 | 4.39 | 3.20 | 3.15 | 3.31 | 3.03 | | | |
| NT2RP4000373 | 4.40 | 4.53 | 4.20 | 4.85 | 4.38 | 4.02 | 3.74 | 3.46 | 2.82 | | | * | − |
| NT2RP4000376 | 3.46 | 3.35 | 3.32 | 5.35 | 3.36 | 3.31 | 2.76 | 4.60 | 2.39 | | | |
| NT2RP4000381 | 3.20 | 2.91 | 2.81 | 7.76 | 5.97 | 5.48 | 3.69 | 3.62 | 2.58 | ** | + | |
| NT2RP4000388 | 507.68 | 363.39 | 334.24 | 288.84 | 217.90 | 196.35 | 431.3 | 437.25 | 362.7 | | | |
| NT2RP4000390 | 19.01 | 14.68 | 11.68 | 24.99 | 29.51 | 23.19 | 15.68 | 13.59 | 14.64 | * | + | |
| NT2RP4000393 | 3.40 | 2.87 | 1.85 | 2.59 | 3.15 | 3.33 | 5.06 | 3.98 | 3.29 | | | |
| NT2RP4000398 | 5.34 | 4.23 | 2.50 | 10.36 | 14.48 | 10.01 | 6.8 | 5.94 | 5.69 | * | + | |
| NT2RP4000406 | 9.30 | 5.25 | 6.26 | 5.59 | 5.04 | 6.35 | 7.54 | 6.32 | 4.52 | | | |
| NT2RP4000407 | 5.98 | 4.41 | 3.78 | 8.29 | 7.16 | 4.70 | 4.32 | 5.68 | 5.13 | | | |
| NT2RP4000413 | 1.40 | 1.18 | 0.62 | 0.72 | 1.57 | 3.58 | 1.37 | 2.49 | 1.36 | | | |
| NT2RP4000415 | 10.74 | 4.75 | 5.55 | 8.27 | 6.74 | 8.60 | 4.84 | 5.48 | 2.05 | | | |
| NT2RP4000417 | 7.49 | 5.67 | 3.62 | 5.24 | 6.05 | 4.58 | 5.78 | 5.18 | 6.52 | | | |
| NT2RP4000423 | 10.91 | 8.43 | 6.08 | 17.00 | 12.75 | 12.74 | 5.48 | 6.12 | 5.86 | * | + | |
| NT2RP4000424 | 4.48 | 2.86 | 1.81 | 7.46 | 7.77 | 6.37 | 5.69 | 7.35 | 4.76 | ** | + | |
| NT2RP4000447 | 13.10 | 8.03 | 11.15 | 9.03 | 13.44 | 9.03 | 6.38 | 5.33 | 5.62 | | | * | − |
| NT2RP4000448 | 2.34 | 1.79 | 0.84 | 4.19 | 6.84 | 6.98 | 5.24 | 4.20 | 3.76 | * | + | * | + |
| NT2RP4000449 | 2.70 | 2.01 | 2.13 | 2.07 | 1.89 | 2.22 | 2.41 | 2.65 | 1.44 | | | |

TABLE 277

| | | | | | | | | | | | | |
|---|---|---|---|---|---|---|---|---|---|---|---|---|
| NT2RP4000453 | 7.28 | 6.16 | 3.48 | 2.35 | 2.43 | 4.15 | 1.8 | 4.72 | 0.91 | | | |
| NT2RP4000455 | 1.01 | 1.01 | 1.48 | 2.29 | 2.70 | 1.92 | 2.22 | 2.27 | 0.83 | * | + | |
| NT2RP4000456 | 13.97 | 7.10 | 6.36 | 13.16 | 13.46 | 10.68 | 8.85 | 8.11 | 5.28 | | | |
| NT2RP4000457 | 6.68 | 4.82 | 2.84 | 3.69 | 4.73 | 3.69 | 4.6 | 3.98 | 5.62 | | | |
| NT2RP4000461 | 5.28 | 3.96 | 3.32 | 7.87 | 8.68 | 6.42 | 5.85 | 6.52 | 5.36 | * | + | |
| NT2RP4000462 | 8.07 | 4.05 | 4.23 | 7.49 | 8.39 | 11.75 | 6.93 | 5.29 | 4.06 | | | |
| NT2RP4000463 | 9.18 | 6.18 | 6.85 | 10.59 | 9.85 | 9.05 | 5.78 | 4.84 | 4.27 | | | |
| NT2RP4000471 | 3.55 | 1.94 | 1.96 | 3.21 | 3.41 | 4.25 | 4.22 | 4.59 | 2.95 | | | |
| NT2RP4000472 | 3.05 | 2.42 | 1.96 | 12.20 | 8.76 | 6.84 | 4.36 | 5.24 | 4.11 | * | + | * | + |
| NT2RP4000476 | 1.50 | 1.02 | 0.85 | 12.49 | 11.85 | 10.88 | 21.84 | 18.65 | 17.71 | ** | + | ** | + |
| NT2RP4000480 | 15.36 | 6.51 | 5.30 | 5.47 | 9.87 | 5.81 | 7.44 | 8.54 | 5.87 | | | |
| NT2RP4000481 | 3.47 | 2.35 | 0.78 | 2.35 | 2.92 | 2.36 | 3.06 | 3.89 | 4.07 | | | |
| NT2RP4000483 | 2.86 | 2.52 | 1.45 | 2.10 | 2.49 | 1.39 | 3.11 | 4.18 | 2.64 | | | |
| NT2RP4000487 | 3.11 | 1.79 | 1.56 | 6.59 | 4.70 | 2.73 | 3.7 | 3.87 | 2.46 | | | |
| NT2RP4000496 | 0.65 | 2.01 | 0.43 | 0.74 | 1.20 | 0.89 | 1.64 | 1.30 | 1.26 | | | |
| NT2RP4000497 | 6.68 | 4.62 | 5.43 | 14.85 | 10.68 | 12.20 | 7.76 | 11.46 | 5.67 | ** | + | |
| NT2RP4000498 | 4.09 | 1.89 | 2.15 | 3.59 | 3.39 | 3.97 | 3.69 | 5.45 | 2.91 | | | |
| NT2RP4000500 | 3.65 | 2.95 | 1.78 | 3.44 | 3.70 | 2.25 | 3.4 | 3.63 | 2.11 | | | |
| NT2RP4000507 | 15.14 | 8.22 | 5.69 | 11.50 | 10.49 | 7.06 | 7.7 | 7.22 | 9.04 | | | |
| NT2RP4000515 | 15.49 | 10.59 | 8.57 | 12.80 | 13.50 | 16.10 | 12.82 | 10.19 | 8.69 | | | |
| NT2RP4000516 | 7.24 | 4.39 | 3.65 | 20.66 | 19.29 | 17.91 | 10.11 | 9.21 | 8.83 | ** | + | * | + |
| NT2RP4000517 | 3.07 | 2.43 | 1.84 | 4.04 | 5.74 | 5.81 | 3.42 | 4.89 | 3.38 | * | + | |
| NT2RP4000518 | 4.18 | 1.91 | 2.39 | 4.28 | 2.50 | 2.78 | 3.19 | 3.42 | 2.91 | | | |
| NT2RP4000519 | 1.25 | 1.47 | 1.18 | 2.14 | 1.80 | 1.86 | 1.53 | 2.34 | 1.09 | ** | + | |
| NT2RP4000524 | 0.66 | 1.08 | 0.33 | 1.66 | 1.94 | 1.79 | 1.87 | 1.81 | 1.62 | ** | + | ** | + |
| NT2RP4000528 | 1.96 | 2.16 | 0.43 | 1.52 | 2.71 | 2.98 | 1.9 | 3.84 | 1.18 | | | |
| NT2RP4000537 | 40.32 | 18.87 | 17.18 | 18.72 | 15.16 | 10.99 | 14.21 | 10.18 | 11.8 | | | |
| NT2RP4000541 | 6.42 | 4.52 | 3.64 | 6.16 | 5.27 | 3.57 | 5.96 | 5.32 | 5.79 | | | |
| NT2RP4000543 | 7.15 | 4.38 | 3.94 | 5.71 | 5.28 | 6.49 | 7.13 | 6.85 | 7.19 | | | |
| NT2RP4000545 | 22.00 | 15.60 | 11.90 | 35.02 | 30.28 | 28.43 | 15.85 | 15.53 | 13.71 | * | + | |
| NT2RP4000546 | 3.49 | 2.74 | 2.72 | 5.16 | 6.84 | 5.20 | 2.65 | 5.26 | 4.13 | * | + | |
| NT2RP4000549 | 10.31 | 6.26 | 6.97 | 10.02 | 6.99 | 7.06 | 17.04 | 10.70 | 13.71 | | | |
| NT2RP4000556 | 4.79 | 2.38 | 2.09 | 2.96 | 4.95 | 3.16 | 3.01 | 3.93 | 2.39 | | | |
| NT2RP4000557 | 2.43 | 1.89 | 1.59 | 3.06 | 2.06 | 2.13 | 1.6 | 1.76 | 2.34 | | | |
| NT2RP4000558 | 7.85 | 4.61 | 3.47 | 5.80 | 4.60 | 4.48 | 8.11 | 4.97 | 5.07 | | | |
| NT2RP4000560 | 11.62 | 8.43 | 5.62 | 16.38 | 11.32 | 8.62 | 10.3 | 8.86 | 6.76 | | | |
| NT2RP4000568 | 0.86 | 1.06 | 0.72 | 1.99 | 2.89 | 2.56 | 1.2 | 1.79 | 1.98 | ** | + | * | + |
| NT2RP4000583 | 9.91 | 5.21 | 4.91 | 9.30 | 13.09 | 14.53 | 6.79 | 5.52 | 7.23 | | | |
| NT2RP4000585 | 3.74 | 2.64 | 3.88 | 4.44 | 2.94 | 3.43 | 2.78 | 2.68 | 3.99 | | | |
| NT2RP4000588 | 1.78 | 1.61 | 0.91 | 2.23 | 3.68 | 2.01 | 2.78 | 3.01 | 2.89 | | | ** | + |
| NT2RP4000590 | 7.09 | 4.23 | 3.81 | 4.80 | 5.51 | 5.49 | 5.51 | 5.97 | 3.62 | | | |
| NT2RP4000599 | 1.53 | 1.26 | 0.87 | 1.24 | 1.41 | 1.06 | 0.44 | 2.70 | 0.51 | | | |
| NT2RP4000603 | 11.90 | 6.03 | 3.85 | 6.61 | 6.16 | 3.84 | 4.98 | 5.10 | 6.79 | | | |
| NT2RP4000607 | 9.25 | 5.54 | 5.52 | 6.95 | 7.07 | 10.29 | 4.24 | 5.47 | 7.66 | | | |
| NT2RP4000614 | 18.95 | 12.78 | 10.17 | 25.67 | 26.47 | 23.13 | 9.33 | 11.19 | 9.77 | * | + | |
| NT2RP4000634 | 4.83 | 2.61 | 1.81 | 7.54 | 6.71 | 5.97 | 5.4 | 7.61 | 4.39 | * | + | |
| NT2RP4000638 | 3.55 | 2.37 | 1.27 | 3.88 | 3.82 | 3.28 | 2.34 | 4.08 | 2.48 | | | |
| NT2RP4000648 | 3.49 | 3.15 | 1.64 | 4.18 | 4.00 | 1.87 | 2.79 | 3.50 | 2.8 | | | |
| NT2RP4000657 | 7.42 | 4.66 | 4.89 | 3.76 | 5.89 | 4.90 | 4.79 | 4.73 | 4.39 | | | |
| NT2RP4000691 | 3.57 | 4.48 | 4.25 | 6.09 | 7.82 | 5.58 | 5.65 | 7.17 | 5.49 | * | + | * | + |
| NT2RP4000697 | 11.06 | 7.17 | 4.24 | 7.59 | 7.47 | 5.97 | 4.38 | 5.33 | 7.55 | | | |

TABLE 277-continued

| | | | | | | | | | |
|---|---|---|---|---|---|---|---|---|---|
| NT2RP4000704 | 9.94 | 4.45 | 4.08 | 7.72 | 7.80 | 6.93 | 8.9 | 11.64 | 11.09 |
| NT2RP4000710 | 39.78 | 22.43 | 20.25 | 37.57 | 42.17 | 34.47 | 22.39 | 29.16 | 28.71 |
| NT2RP4000713 | 3.09 | 1.40 | 0.88 | 3.21 | 4.08 | 3.16 | 3.3 | 5.18 | 2.97 |
| NT2RP4000724 | 3.53 | 1.86 | 1.77 | 4.48 | 4.24 | 3.42 | 3.25 | 6.43 | 3.91 |
| NT2RP4000725 | 4.59 | 2.50 | 2.14 | 3.16 | 3.33 | 2.21 | 3.39 | 4.06 | 2.51 |

TABLE 278

| | | | | | | | | | | | | | |
|---|---|---|---|---|---|---|---|---|---|---|---|---|---|
| NT2RP4000728 | 21.11 | 12.54 | 13.41 | 26.39 | 33.93 | 29.91 | 18.2 | 20.00 | 17.52 | * | + | | |
| NT2RP4000737 | 2.29 | 1.59 | 0.36 | 2.95 | 3.74 | 3.56 | 1.99 | 4.28 | 1.59 | * | + | | |
| NT2RP4000739 | 3.68 | 1.68 | 1.40 | 3.64 | 3.60 | 3.19 | 3.01 | 1.32 | 2.06 | | | | |
| NT2RP4000749 | 4.61 | 2.23 | 2.17 | 5.43 | 5.08 | 3.32 | 3.77 | 2.84 | 2.99 | | | | |
| NT2RP4000769 | 4.46 | 2.77 | 1.61 | 5.35 | 5.75 | 3.06 | 3.69 | 3.92 | 2.49 | | | | |
| NT2RP4000774 | 7.04 | 3.62 | 4.69 | 6.48 | 7.03 | 5.14 | 4.99 | 3.77 | 3.67 | | | | |
| NT2RP4000781 | 1.78 | 1.82 | 2.45 | 2.48 | 1.82 | 2.08 | 1.95 | 1.67 | 1.08 | | | | |
| NT2RP4000783 | 5.52 | 3.48 | 3.60 | 5.32 | 4.17 | 5.29 | 1.54 | 2.21 | 1.91 | | | * | − |
| NT2RP4000787 | (0.08) | 0.27 | 0.06 | 0.45 | 0.09 | 1.07 | 0.1 | 0.13 | −0.1 | | | | |
| NT2RP4000788 | 7.00 | 4.42 | 3.89 | 7.56 | 7.52 | 5.50 | 5.26 | 4.25 | 3.66 | | | | |
| NT2RP4000792 | 9.90 | 5.45 | 5.18 | 4.82 | 3.85 | 3.35 | 2.89 | 1.10 | 1.13 | | | * | − |
| NT2RP4000809 | 138.97 | 85.82 | 100.50 | 13.12 | 12.28 | 11.89 | 8.69 | 10.55 | 11.51 | ** | − | ** | − |
| NT2RP4000817 | 6.53 | 3.13 | 3.81 | 7.81 | 8.21 | 7.10 | 5.75 | 6.24 | 6.14 | * | + | | |
| NT2RP4000821 | 10.40 | 5.88 | 5.97 | 8.60 | 9.00 | 10.24 | 19.32 | 14.83 | 13.61 | | | * | + |
| NT2RP4000822 | 7.54 | 4.48 | 4.61 | 11.43 | 10.03 | 11.32 | 7.11 | 5.54 | 4.78 | ** | + | | |
| NT2RP4000823 | 6.10 | 4.87 | 4.52 | 6.50 | 4.58 | 4.69 | 17.58 | 17.55 | 14.17 | | | ** | + |
| NT2RP4000831 | 4.53 | 2.70 | 1.65 | 4.00 | 4.27 | 4.75 | 3.68 | 4.83 | 3.77 | | | | |
| NT2RP4000833 | 9.98 | 4.61 | 3.88 | 12.93 | 9.95 | 9.75 | 7.85 | 6.14 | 9.61 | | | | |
| NT2RP4000837 | 16.84 | 7.67 | 8.19 | 4.27 | 7.04 | 6.55 | 7.9 | 6.72 | 7.63 | | | | |
| NT2RP4000839 | 8.09 | 4.28 | 3.15 | 6.64 | 6.35 | 8.56 | 6.01 | 3.49 | 4.81 | | | | |
| NT2RP4000846 | 7.97 | 4.70 | 3.74 | 7.70 | 5.83 | 5.14 | 6.12 | 4.09 | 4.55 | | | | |
| NT2RP4000848 | 5.78 | 2.64 | 3.11 | 8.90 | 6.26 | 8.65 | 7.07 | 7.56 | 8.46 | * | + | * | + |
| NT2RP4000855 | 3.22 | 3.08 | 1.54 | 2.41 | 2.92 | 2.82 | 2.82 | 2.57 | 2 | | | | |
| NT2RP4000863 | 3.79 | 2.50 | 2.36 | 1.24 | 1.67 | 1.78 | 2 | 2.70 | 1.71 | | | | |
| NT2RP4000865 | 9.55 | 7.40 | 5.94 | 26.23 | 26.54 | 18.52 | 8.98 | 8.90 | 8.56 | ** | + | | |
| NT2RP4000873 | 8.88 | 4.73 | 4.97 | 9.82 | 9.15 | 8.69 | 10.43 | 4.81 | 6.51 | | | | |
| NT2RP4000874 | 5.60 | 3.25 | 3.18 | 4.02 | 6.09 | 6.60 | 5.15 | 3.17 | 5.54 | | | | |
| NT2RP4000875 | 10.06 | 7.69 | 6.92 | 10.24 | 9.60 | 8.28 | 5.61 | 5.34 | 4.98 | | | * | − |
| NT2RP4000878 | 15.02 | 8.48 | 6.31 | 16.61 | 14.17 | 15.37 | 18.42 | 13.92 | 17 | | | | |
| NT2RP4000879 | 1.68 | 0.79 | 0.77 | 1.38 | 2.21 | 2.54 | 2.35 | 2.03 | 1.86 | | | * | + |
| NT2RP4000880 | 5.88 | 4.11 | 3.04 | 9.39 | 7.05 | 7.35 | 6.97 | 5.69 | 5.31 | * | + | | |
| NT2RP4000891 | 102.85 | 62.84 | 77.22 | 114.50 | 151.60 | 104.23 | 43.98 | 42.97 | 34.75 | | | * | − |
| NT2RP4000894 | 8.78 | 5.12 | 4.69 | 6.91 | 6.62 | 9.49 | 7.97 | 4.83 | 7.88 | | | | |
| NT2RP4000898 | 0.75 | 1.23 | 0.33 | 0.94 | 1.28 | 0.69 | 1.75 | 1.00 | 0.58 | | | | |
| NT2RP4000899 | 14.91 | 8.73 | 9.27 | 8.87 | 7.17 | 6.06 | 2.92 | 6.91 | 6.96 | | | | |
| NT2RP4000907 | 7.23 | 4.77 | 4.04 | 8.01 | 14.43 | 8.65 | 11.43 | 9.68 | 10.25 | ** | + | | |
| NT2RP4000908 | 3.70 | 3.82 | 2.81 | 5.39 | 5.05 | 5.27 | 4.11 | 5.22 | 3.41 | ** | + | | |
| NT2RP4000910 | 11.95 | 5.36 | 6.97 | 10.03 | 8.98 | 9.73 | 9.64 | 9.49 | 7.69 | | | | |
| NT2RP4000918 | 10.45 | 8.95 | 8.11 | 12.80 | 9.01 | 11.75 | 7.94 | 8.71 | 6.88 | | | | |
| NT2RP4000925 | 1.77 | 2.18 | 1.68 | 2.08 | 2.56 | 3.09 | 1.91 | 2.37 | 0.93 | | | | |
| NT2RP4000927 | 2.00 | 0.98 | 0.64 | 1.21 | 1.11 | 1.91 | 1.67 | 2.03 | 0.45 | | | | |
| NT2RP4000928 | 8.63 | 5.13 | 3.60 | 5.86 | 6.72 | 6.51 | 5.18 | 4.85 | 6.75 | | | | |
| NT2RP4000929 | 1.61 | 1.10 | 1.06 | 1.59 | 2.36 | 1.14 | 0.93 | 1.23 | 1.92 | | | | |
| NT2RP4000946 | 3.91 | 2.24 | 2.26 | 7.89 | 6.10 | 6.89 | 5.7 | 5.35 | 4.43 | ** | + | * | + |
| NT2RP4000947 | 1.12 | 1.54 | 1.05 | 1.80 | 1.82 | 0.62 | 1.3 | 1.55 | 0.89 | | | | |
| NT2RP4000949 | 16.12 | 8.67 | 10.24 | 5.88 | 3.51 | 5.79 | 19.02 | 19.45 | 15.95 | | | | |
| NT2RP4000955 | 9.21 | 5.55 | 4.76 | 5.43 | 4.34 | 5.39 | 4.04 | 4.48 | 4.02 | | | | |
| NT2RP4000959 | 16.07 | 16.16 | 17.01 | 17.30 | 15.74 | 18.65 | 13.76 | 14.61 | 12.03 | | | * | − |
| NT2RP4000962 | 4.28 | 2.72 | 4.02 | 3.76 | 4.20 | 2.99 | 2.02 | 3.10 | 1.89 | | | | |
| NT2RP4000973 | 6.76 | 3.78 | 2.61 | 4.40 | 5.08 | 4.18 | 8.32 | 7.27 | 7.89 | | | | |
| NT2RP4000975 | 4.74 | 2.41 | 1.77 | 5.26 | 4.90 | 3.72 | 2.88 | 4.71 | 4.07 | | | | |
| NT2RP4000979 | 6.80 | 3.38 | 3.74 | 6.77 | 5.99 | 3.62 | 6.11 | 4.01 | 4.79 | | | | |
| NT2RP4000984 | 3.24 | 3.46 | 2.61 | 2.85 | 2.49 | 5.25 | 1.35 | 3.81 | 1.22 | | | | |
| NT2RP4000986 | 3.13 | 2.19 | 3.27 | 2.70 | 3.05 | 3.24 | 3.2 | 4.03 | 2.69 | | | | |
| NT2RP4000988 | 4.24 | 3.53 | 3.97 | 6.52 | 7.14 | 6.40 | 4.03 | 5.72 | 2.89 | ** | + | | |
| NT2RP4000989 | 4.55 | 3.53 | 3.49 | 5.18 | 3.51 | 4.95 | 4.91 | 5.46 | 4.69 | | | * | + |

TABLE 279

| | | | | | | | | | | | | | |
|---|---|---|---|---|---|---|---|---|---|---|---|---|---|
| NT2RP4000990 | 0.91 | 1.17 | 0.68 | 5.32 | 4.83 | 4.20 | 3.51 | 3.92 | 3.51 | ** | + | ** | + |
| NT2RP4000994 | 6.03 | 3.61 | 2.39 | 2.73 | 3.58 | 3.95 | 4.94 | 3.50 | 5.8 | | | | |
| NT2RP4000996 | 6.29 | 4.22 | 3.37 | 8.35 | 8.21 | 4.36 | 4.41 | 5.02 | 6.24 | | | | |
| NT2RP4000997 | 61.78 | 21.49 | 33.43 | 48.43 | 44.30 | 38.85 | 25.67 | 23.78 | 20.69 | | | | |
| NT2RP4001001 | 5.72 | 4.90 | 3.47 | 5.67 | 6.31 | 7.83 | 5.36 | 5.68 | 6.44 | | | | |
| NT2RP4001004 | 2.47 | 1.20 | 1.29 | 1.66 | 1.42 | 2.31 | 0.88 | 2.30 | 2.26 | | | | |
| NT2RP4001006 | 6.01 | 3.42 | 6.46 | 5.11 | 3.94 | 7.35 | 4.19 | 4.92 | 4.66 | | | | |

TABLE 279-continued

| | | | | | | | | | | | | |
|---|---|---|---|---|---|---|---|---|---|---|---|---|
| NT2RP4001009 | 8.55 | 4.50 | 6.33 | 9.69 | 4.66 | 6.57 | 7.89 | 8.50 | 7.3 | | | |
| NT2RP4001010 | 2.33 | 1.99 | 3.31 | 3.50 | 2.89 | 4.49 | 3.41 | 2.18 | 2.22 | | | |
| NT2RP4001013 | 24.76 | 12.16 | 10.77 | 11.37 | 8.47 | 9.68 | 9.97 | 7.96 | 8.93 | | | |
| NT2RP4001029 | 12.87 | 4.18 | 5.93 | 5.61 | 5.98 | 4.93 | 3.75 | 3.75 | 3.77 | | | |
| NT2RP4001036 | 12.25 | 7.10 | 7.56 | 11.16 | 11.59 | 9.83 | 8.7 | 8.94 | 6.61 | | | |
| NT2RP4001041 | 12.91 | 6.26 | 9.00 | 10.06 | 7.34 | 6.55 | 5.46 | 5.13 | 5.26 | | | |
| NT2RP4001042 | 19.25 | 12.69 | 10.60 | 14.77 | 15.99 | 12.64 | 7.69 | 8.09 | 6.86 | | | |
| NT2RP4001046 | 7.12 | 4.49 | 4.11 | 7.61 | 7.51 | 8.81 | 6.32 | 5.77 | 5.49 | | | |
| NT2RP4001050 | 2.62 | 1.51 | 1.21 | 2.43 | 2.08 | 3.36 | 1.88 | 2.76 | 1.6 | | | |
| NT2RP4001051 | 6.34 | 2.77 | 3.34 | 9.61 | 5.53 | 9.29 | 3.29 | 7.15 | 4.7 | | | |
| NT2RP4001057 | 8.53 | 5.25 | 3.91 | 5.29 | 5.25 | 3.31 | 3.9 | 2.95 | 5.29 | | | |
| NT2RP4001063 | 10.42 | 5.01 | 5.86 | 6.23 | 5.90 | 5.66 | 7.16 | 6.14 | 5.17 | | | |
| NT2RP4001064 | 8.38 | 3.24 | 3.12 | 6.83 | 5.16 | 4.26 | 7.84 | 6.40 | 8.7 | | | |
| NT2RP4001067 | 3.31 | 1.58 | 2.32 | 2.67 | 2.92 | 2.43 | 3.23 | 3.73 | 3.54 | | | |
| NT2RP4001078 | 4.41 | 2.35 | 1.43 | 3.09 | 2.15 | 3.81 | 2.07 | 3.77 | 2.39 | | | |
| NT2RP4001079 | 3.33 | 2.47 | 3.40 | 5.24 | 5.12 | 4.58 | 4.51 | 5.49 | 6.01 | ** | + | * | + |
| NT2RP4001080 | 1.87 | 1.13 | 0.72 | 2.09 | 1.21 | 1.64 | 1.8 | 2.65 | 1.93 | | | |
| NT2RP4001086 | 6.48 | 4.50 | 4.95 | 6.91 | 6.12 | 6.66 | 5.1 | 5.61 | 4.86 | | | |
| NT2RP4001095 | 9.39 | 3.28 | 2.95 | 11.12 | 8.02 | 6.83 | 6.4 | 5.11 | 6.99 | | | |
| NT2RP4001098 | 8.66 | 3.42 | 3.13 | 5.99 | 6.59 | 3.50 | 4.06 | 3.58 | 3.83 | | | |
| NT2RP4001100 | 15.58 | 6.86 | 5.99 | 15.36 | 16.25 | 10.53 | 11.07 | 8.66 | 10.12 | | | |
| NT2RP4001105 | 11.53 | 6.11 | 5.68 | 11.42 | 12.40 | 12.53 | 6.82 | 8.59 | 7.03 | | | |
| NT2RP4001110 | 4.14 | 2.11 | 2.03 | 3.53 | 3.73 | 5.22 | 7.74 | 9.16 | 5.7 | | | * | + |
| NT2RP4001115 | 8.23 | 4.76 | 5.40 | 7.44 | 6.61 | 6.42 | 6.49 | 8.54 | 8.25 | | | |
| NT2RP4001117 | 5.86 | 2.61 | 3.66 | 4.84 | 5.68 | 5.67 | 6.82 | 7.82 | 11.35 | | | |
| NT2RP4001122 | 4.53 | 2.89 | 4.44 | 5.52 | 5.25 | 6.14 | 3.92 | 5.33 | 5.22 | * | + | |
| NT2RP4001123 | 11.03 | 6.64 | 4.19 | 7.23 | 8.62 | 6.22 | 6.52 | 4.59 | 7.16 | | | |
| NT2RP4001126 | 12.30 | 8.14 | 5.35 | 14.50 | 10.35 | 10.40 | 6.7 | 7.95 | 9.08 | | | |
| NT2RP4001127 | 2.67 | 1.52 | 0.45 | 2.09 | 2.22 | 1.57 | 1.96 | 4.17 | 3 | | | |
| NT2RP4001138 | 3.41 | 2.11 | 1.63 | 1.48 | 2.64 | 1.74 | 2.14 | 3.24 | 4.17 | | | |
| NT2RP4001143 | 6.89 | 2.21 | 3.01 | 4.13 | 4.68 | 5.32 | 4.17 | 5.67 | 5.66 | | | |
| NT2RP4001148 | 1.94 | 1.16 | 1.16 | 2.70 | 2.05 | 0.60 | 1.41 | 3.15 | 1.62 | | | |
| NT2RP4001149 | 4.34 | 2.11 | 2.80 | 3.19 | 3.00 | 3.41 | 3.12 | 4.58 | 4.05 | | | |
| NT2RP4001150 | 4.09 | 2.84 | 2.82 | 5.63 | 5.48 | 6.34 | 4.62 | 4.61 | 4.79 | ** | + | * | + |
| NT2RP4001159 | 8.72 | 3.82 | 5.00 | 5.57 | 8.96 | 6.80 | 7.8 | 6.33 | 6.38 | | | |
| NT2RP4001162 | 3.97 | 2.49 | 1.88 | 3.46 | 2.36 | 3.14 | 3.98 | 2.29 | 2.75 | | | |
| NT2RP4001170 | 9.81 | 5.75 | 5.29 | 2.68 | 3.96 | 2.23 | 2.4 | 2.44 | 1.3 | | | * | − |
| NT2RP4001174 | 6.78 | 5.08 | 5.60 | 9.49 | 9.90 | 7.92 | 7.08 | 5.86 | 4.66 | * | + | |
| NT2RP4001175 | 19.07 | 9.74 | 10.40 | 16.34 | 17.86 | 15.79 | 8.78 | 8.58 | 11.27 | | | |
| NT2RP4001176 | 62.90 | 39.84 | 55.63 | 104.65 | 115.71 | 110.77 | 63.62 | 58.35 | 46.85 | ** | + | |
| NT2RP4001184 | 10.39 | 5.65 | 5.39 | 5.95 | 4.48 | 5.41 | 4.76 | 4.78 | 4.24 | | | |
| NT2RP4001198 | 10.79 | 4.11 | 5.82 | 13.69 | 9.03 | 11.21 | 14.64 | 14.06 | 13.84 | | | * | + |
| NT2RP4001199 | 2.92 | 0.71 | 0.91 | 2.99 | 2.97 | 1.91 | 3.68 | 2.25 | 2.92 | | | |
| NT2RP4001206 | 13.96 | 4.32 | 7.41 | 11.41 | 10.25 | 10.46 | 8.73 | 9.26 | 10.42 | | | |
| NT2RP4001207 | 3.37 | 2.92 | 1.08 | 2.45 | 1.58 | 1.84 | 2.26 | 2.66 | 0.61 | | | |
| NT2RP4001210 | 2.36 | 1.47 | 2.10 | 3.13 | 2.39 | 1.71 | 1.5 | 2.49 | 2.3 | | | |
| NT2RP4001213 | 10.44 | 5.34 | 6.49 | 11.64 | 9.13 | 13.58 | 7.15 | 5.01 | 5.42 | | | |
| NT2RP4001214 | 0.95 | 1.06 | 0.59 | 2.80 | 1.54 | 8.36 | 1.71 | 2.54 | 1.49 | | | * | + |
| NT2RP4001219 | 2.55 | 2.66 | 2.86 | 4.42 | 15.66 | 4.45 | 5.58 | 7.03 | 5.57 | | | ** | + |

TABLE 280

| | | | | | | | | | | | | |
|---|---|---|---|---|---|---|---|---|---|---|---|---|
| NT2RP4001228 | 6.93 | 2.54 | 3.03 | 5.28 | 9.41 | 5.96 | 8.24 | 4.93 | 8.37 | | | |
| NT2RP4001235 | 6.11 | 4.31 | 3.21 | 5.70 | 5.94 | 5.25 | 5.94 | 4.41 | 5.1 | | | |
| NT2RP4001256 | 4.51 | 1.77 | 2.22 | 4.07 | 5.11 | 4.94 | 4.27 | 3.05 | 2.43 | | | |
| NT2RP4001257 | 6.40 | 4.02 | 2.26 | 5.05 | 5.54 | 3.44 | 5.95 | 5.21 | 4.31 | | | |
| NT2RP4001260 | 5.39 | 3.07 | 4.18 | 8.97 | 9.59 | 5.62 | 5.8 | 6.24 | 6.64 | | | * | + |
| NT2RP4001261 | 14.65 | 12.44 | 12.58 | 14.19 | 12.55 | 13.99 | 17.34 | 12.10 | 15.2 | | | |
| NT2RP4001274 | 4.71 | 4.57 | 4.07 | 7.45 | 6.65 | 6.76 | 5.26 | 6.13 | 6.26 | ** | + | * | + |
| NT2RP4001276 | 15.31 | 8.46 | 8.50 | 10.61 | 14.38 | 10.37 | 11.44 | 11.39 | 8.98 | | | |
| NT2RP4001283 | 63.21 | 34.01 | 32.33 | 24.21 | 25.03 | 19.31 | 48.06 | 42.63 | 46.56 | | | |
| NT2RP4001299 | 15.00 | 9.02 | 6.78 | 6.64 | 8.24 | 7.13 | 7.92 | 6.14 | 6.14 | | | |
| NT2RP4001313 | 3.06 | 1.56 | 1.37 | 2.51 | 0.89 | 2.21 | 1.62 | 2.23 | 2.1 | | | |
| NT2RP4001315 | 3.67 | 2.67 | 2.40 | 3.95 | 5.09 | 3.45 | 3.89 | 3.89 | 4.16 | | | |
| NT2RP4001320 | 9.02 | 4.65 | 5.15 | 9.20 | 8.51 | 8.68 | 15.43 | 12.65 | 14.49 | | | ** | + |
| NT2RP4001325 | 12.74 | 11.37 | 11.78 | 16.64 | 15.36 | 9.87 | 12.12 | 10.53 | 7.42 | | | |
| NT2RP4001336 | 6.40 | 4.16 | 5.13 | 5.38 | 3.83 | 5.19 | 4.39 | 4.05 | 2.52 | | | |
| NT2RP4001339 | 3.62 | 2.24 | 4.32 | 4.37 | 4.09 | 4.92 | 3.51 | 4.78 | 3.43 | | | |
| NT2RP4001343 | 8.44 | 4.63 | 3.67 | 7.94 | 6.79 | 5.81 | 5.7 | 6.09 | 6.51 | | | |
| NT2RP4001344 | 5.76 | 3.40 | 4.09 | 5.03 | 5.50 | 6.54 | 6.12 | 6.22 | 5.58 | | | |
| NT2RP4001345 | 6.21 | 3.12 | 2.61 | 3.29 | 6.07 | 5.15 | 4.25 | 4.33 | 4.38 | | | |
| NT2RP4001351 | 11.92 | 6.04 | 5.53 | 9.86 | 6.47 | 8.71 | 6.54 | 7.28 | 6.61 | | | |
| NT2RP4001353 | 1.80 | 1.08 | 1.42 | 2.16 | 2.00 | 2.04 | 2.15 | 2.48 | 2.23 | * | + | * | + |
| NT2RP4001355 | 2.54 | 1.08 | 2.05 | 2.40 | 2.01 | 1.99 | 2.51 | 3.62 | 2.23 | | | |
| NT2RP4001367 | 23.22 | 13.41 | 17.84 | 6.30 | 4.94 | 5.47 | 9.28 | 11.30 | 7.57 | * | − | * | − |
| NT2RP4001372 | 5.35 | 2.77 | 2.56 | 3.34 | 4.53 | 3.59 | 4.57 | 5.24 | 5.57 | | | |

TABLE 280-continued

| | | | | | | | | | | | | |
|---|---|---|---|---|---|---|---|---|---|---|---|---|
| NT2RP4001373 | 10.60 | 5.25 | 4.77 | 8.11 | 9.86 | 9.53 | 6.1 | 5.34 | 6.98 | | | |
| NT2RP4001375 | 5.11 | 3.33 | 2.60 | 2.66 | 4.56 | 3.81 | 2.85 | 3.42 | 3.31 | | | |
| NT2RP4001379 | 3.86 | 2.14 | 2.09 | 2.83 | 2.70 | 4.72 | 3.26 | 3.43 | 2.58 | | | |
| NT2RP4001381 | 8.37 | 5.24 | 5.75 | 10.66 | 11.10 | 10.55 | 6.09 | 7.62 | 6.54 | * | + | |
| NT2RP4001386 | 3.36 | 2.18 | 2.25 | 6.41 | 4.78 | 6.49 | 3.68 | 5.89 | 3.24 | ** | + | |
| NT2RP4001389 | 10.33 | 5.90 | 8.63 | 13.74 | 8.10 | 10.59 | 13.58 | 10.92 | 11.95 | | | |
| NT2RP4001396 | 1.51 | 0.17 | 0.39 | 1.10 | 1.45 | 1.19 | 1.43 | 2.48 | 0.52 | | | |
| NT2RP4001407 | 2.74 | 1.02 | 1.62 | 3.87 | 3.78 | 1.98 | 2.72 | 2.67 | 1.52 | | | |
| NT2RP4001409 | 7.90 | 3.42 | 3.68 | 8.04 | 5.25 | 6.08 | 3.89 | 2.35 | 3.87 | | | |
| NT2RP4001410 | 41.71 | 16.67 | 20.24 | 29.88 | 31.04 | 31.69 | 28.88 | 20.00 | 22.74 | | | |
| NT2RP4001414 | 11.73 | 6.50 | 5.48 | 10.69 | 11.38 | 10.17 | 10.68 | 8.69 | 10.89 | | | |
| NT2RP4001424 | 3.25 | 2.51 | 1.43 | 4.18 | 3.70 | 4.01 | 2.5 | 5.15 | 3.66 | * | + | |
| NT2RP4001433 | 10.93 | 1.50 | 1.13 | 15.16 | 15.56 | 3.13 | 10.41 | 4.52 | 7 | | | |
| NT2RP4001438 | 8.06 | 6.23 | 6.43 | 14.12 | 10.57 | 11.39 | 6.77 | 9.65 | 7.69 | * | + | |
| NT2RP4001442 | 5.25 | 2.76 | 3.72 | 6.62 | 2.55 | 2.88 | 2.74 | 3.33 | 2.46 | | | |
| NT2RP4001447 | 1.94 | 1.07 | 2.00 | 4.12 | 2.36 | 3.98 | 1.68 | 3.22 | 0.71 | * | + | |
| NT2RP4001466 | 13.13 | 5.79 | 4.82 | 7.69 | 5.30 | 6.70 | 2.91 | 4.53 | 3.9 | | | |
| NT2RP4001467 | 4.50 | 1.22 | 1.33 | 0.82 | 1.55 | 1.40 | 3.66 | 4.13 | 3.7 | | | |
| NT2RP4001472 | 4.77 | 3.08 | 3.33 | 7.29 | 7.84 | 10.23 | 7.79 | 8.21 | 9.21 | * | + | ** | + |
| NT2RP4001474 | 2.86 | 1.72 | 1.90 | 2.18 | 3.93 | 2.05 | 1.94 | 3.80 | 3.06 | | | |
| NT2RP4001483 | 2.29 | 1.49 | 1.84 | 3.04 | 2.50 | 2.14 | 2.24 | 3.68 | 2.54 | | | |
| NT2RP4001488 | 5.16 | 2.65 | 2.75 | 5.33 | 5.10 | 5.16 | 4.15 | 4.07 | 6.19 | | | |
| NT2RP4001492 | 5.93 | 3.30 | 2.87 | 5.58 | 3.40 | 4.66 | 3.78 | 4.60 | 5.29 | | | |
| NT2RP4001498 | 2.17 | 1.63 | 1.33 | 2.59 | 1.07 | 2.19 | 2.61 | 1.92 | 1.74 | | | |
| NT2RP4001502 | 36.00 | 12.08 | 15.43 | 15.15 | 11.96 | 14.06 | 11.15 | 10.06 | 10.33 | | | |
| NT2RP4001503 | 12.74 | 6.75 | 6.97 | 11.88 | 9.69 | 8.87 | 5.71 | 4.79 | 6.02 | | | |
| NT2RP4001507 | 5.29 | 3.55 | 4.09 | 6.91 | 8.58 | 5.74 | 3.85 | 4.47 | 6.06 | * | + | |
| NT2RP4001510 | 9.01 | 6.05 | 7.69 | 15.28 | 11.96 | 14.90 | 7.45 | 6.33 | 7.03 | ** | + | |
| NT2RP4001516 | 6.51 | 3.15 | 3.51 | 3.57 | 3.42 | 3.81 | 3.63 | 4.76 | 4.46 | | | |
| NT2RP4001520 | 26.12 | 11.82 | 16.11 | 17.96 | 13.99 | 17.71 | 16.8 | 15.23 | 12.31 | | | |
| NT2RP4001523 | 3.37 | 1.82 | 2.58 | 4.23 | 3.77 | 4.26 | 2.29 | 4.88 | 4.21 | * | + | |
| NT2RP4001524 | 11.16 | 7.76 | 6.79 | 8.80 | 7.75 | 9.91 | 6.38 | 9.28 | 5.14 | | | |

TABLE 281

| | | | | | | | | | | | | | |
|---|---|---|---|---|---|---|---|---|---|---|---|---|---|
| NT2RP4001529 | 9.24 | 4.27 | 3.42 | 3.66 | 4.21 | 3.95 | 6.65 | 3.78 | 5.28 | | | | |
| NT2RP4001531 | 7.58 | 4.22 | 3.87 | 4.40 | 6.79 | 5.07 | 4.85 | 4.25 | 5.33 | | | | |
| NT2RP4001546 | 27.96 | 14.34 | 13.14 | 33.50 | 26.35 | 22.36 | 39.72 | 37.62 | 23.88 | | | | |
| NT2RP4001547 | 5.16 | 3.87 | 3.59 | 6.27 | 5.81 | 5.41 | 6.77 | 5.69 | 7.74 | * | + | * | + |
| NT2RP4001551 | 4.66 | 2.25 | 2.91 | 1.72 | 2.50 | 2.23 | 1.06 | 2.31 | 2.02 | | | | |
| NT2RP4001555 | 2.63 | 1.70 | 1.48 | 1.84 | 1.34 | 1.78 | 3.29 | 2.29 | 1.99 | | | | |
| NT2RP4001567 | 4.17 | 2.21 | 3.48 | 5.17 | 4.12 | 2.97 | 3.53 | 3.55 | 4.6 | | | | |
| NT2RP4001568 | 24.66 | 11.55 | 19.71 | 26.48 | 16.71 | 27.97 | 21.61 | 20.91 | 21.83 | | | | |
| NT2RP4001569 | 13.23 | 7.51 | 6.17 | 8.88 | 7.94 | 7.65 | 6.86 | 6.56 | 7.44 | | | | |
| NT2RP4001571 | 3.88 | 2.14 | 1.80 | 4.74 | 3.69 | 4.71 | 3.97 | 5.20 | 7.86 | | | | |
| NT2RP4001574 | 8.96 | 4.84 | 4.26 | 8.19 | 9.78 | 5.65 | 6.26 | 6.22 | 8.16 | | | | |
| NT2RP4001575 | 8.04 | 4.77 | 3.76 | 6.08 | 7.50 | 5.82 | 4.63 | 5.56 | 5.85 | | | | |
| NT2RP4001578 | 11.18 | 4.73 | 6.33 | 7.50 | 4.87 | 4.81 | 7.41 | 8.00 | 7.35 | | | | |
| NT2RP4001592 | 9.35 | 5.87 | 4.90 | 5.95 | 6.70 | 4.56 | 3.37 | 8.97 | 5.41 | | | | |
| NT2RP4001593 | 6.28 | 4.83 | 5.72 | 9.71 | 12.44 | 12.90 | 7.66 | 7.56 | 6.44 | ** | + | * | + |
| NT2RP4001605 | 4.40 | 2.61 | 3.07 | 7.26 | 7.76 | 5.64 | 5.16 | 7.35 | 8.18 | * | + | * | + |
| NT2RP4001606 | 13.15 | 5.10 | 4.06 | 9.17 | 7.65 | 6.75 | 3.7 | 4.31 | 6.28 | | | | |
| NT2RP4001607 | 3.47 | 1.57 | 1.29 | 3.76 | 4.78 | 2.65 | 1.67 | 3.06 | 4.34 | | | | |
| NT2RP4001610 | 4.08 | 2.08 | 1.47 | 3.77 | 3.73 | 2.68 | 2.34 | 4.35 | 2.92 | | | | |
| NT2RP4001614 | 2.75 | 1.07 | 1.10 | 2.96 | 1.97 | 1.29 | 2.18 | 3.56 | 3.15 | | | | |
| NT2RP4001623 | 3.08 | 1.60 | 1.52 | 2.58 | 2.94 | 2.80 | 1.24 | 3.23 | 2.34 | | | | |
| NT2RP4001626 | 19.42 | 15.83 | 18.19 | 15.38 | 17.59 | 13.04 | 1.75 | 4.18 | 2.95 | | | ** | − |
| NT2RP4001634 | 4.38 | 2.77 | 2.43 | 4.92 | 4.36 | 4.52 | 1.82 | 3.51 | 2.53 | | | | |
| NT2RP4001638 | 2.68 | 1.70 | 0.84 | 1.98 | 2.75 | 2.80 | 1.64 | 3.48 | 1.26 | | | | |
| NT2RP4001644 | 3.61 | 2.50 | 2.30 | 4.35 | 3.54 | 2.45 | 4.35 | 2.84 | 4.05 | | | | |
| NT2RP4001646 | 20.39 | 11.21 | 10.21 | 30.98 | 19.98 | 25.17 | 21.75 | 14.88 | 9.56 | | | | |
| NT2RP4001656 | 6.55 | 3.72 | 4.64 | 5.20 | 5.23 | 4.49 | 4.29 | 3.23 | 2.79 | | | | |
| NT2RP4001666 | 5.11 | 3.28 | 3.35 | 4.54 | 4.56 | 3.95 | 3.53 | 3.52 | 3.5 | | | | |
| NT2RP4001670 | 7.31 | 3.77 | 5.28 | 4.59 | 6.96 | 4.67 | 4.23 | 4.15 | 4.55 | | | | |
| NT2RP4001677 | 16.68 | 12.12 | 14.19 | 29.06 | 40.57 | 32.81 | 33.86 | 36.13 | 36.39 | ** | + | ** | + |
| NT2RP4001679 | 11.61 | 4.52 | 5.94 | 19.33 | 14.25 | 14.99 | 8.64 | 9.90 | 7.91 | * | + | | |
| NT2RP4001695 | 20.41 | 7.98 | 11.64 | 19.72 | 19.63 | 15.23 | 7.89 | 9.75 | 7.32 | | | | |
| NT2RP4001696 | 6.64 | 4.27 | 3.64 | 4.33 | 3.58 | 5.85 | 4.75 | 3.99 | 3.79 | | | | |
| NT2RP4001699 | 1.63 | 1.58 | 0.71 | 2.91 | 1.63 | 2.15 | 3.74 | 2.30 | 2.42 | | | | |
| NT2RP4001717 | 5.33 | 4.49 | 3.61 | 5.92 | 6.26 | 5.39 | 3.73 | 6.49 | 5.79 | | | | |
| NT2RP4001719 | 3.81 | 3.40 | 2.34 | 4.26 | 2.94 | 3.04 | 4.14 | 3.43 | 2.54 | | | | |
| NT2RP4001725 | 4.09 | 3.08 | 1.88 | 3.37 | 4.40 | 3.86 | 2.62 | 4.74 | 3.15 | | | | |
| NT2RP4001726 | 4.90 | 3.18 | 3.91 | 4.82 | 4.39 | 4.14 | 4.14 | 5.24 | 5.01 | | | | |
| NT2RP4001730 | 0.78 | 0.69 | 0.71 | 1.42 | 1.12 | 2.01 | 0.61 | 1.16 | 0.59 | * | + | | |
| NT2RP4001739 | 4.83 | 2.71 | 3.87 | 5.22 | 3.09 | 4.63 | 4.39 | 5.41 | 4.57 | | | | |
| NT2RP4001741 | 10.82 | 7.34 | 4.37 | 12.44 | 9.41 | 10.54 | 7.99 | 6.39 | 5.79 | | | | |

TABLE 281-continued

| | | | | | | | | | | | | |
|---|---|---|---|---|---|---|---|---|---|---|---|---|
| NT2RP4001753 | 11.73 | 4.55 | 5.91 | 14.42 | 16.38 | 12.01 | 9.64 | 6.92 | 8.76 | | | |
| NT2RP4001760 | 12.48 | 7.93 | 6.76 | 6.21 | 7.16 | 7.70 | 2.14 | 2.05 | 1.86 | | * | − |
| NT2RP4001787 | 45.15 | 35.87 | 34.25 | 46.58 | 51.77 | 52.14 | 19.69 | 24.09 | 19.41 | * | + | ** | − |
| NT2RP4001790 | 6.06 | 3.59 | 2.88 | 5.91 | 6.74 | 7.08 | 5.5 | 5.13 | 5.27 | | | * | − |
| NT2RP4001795 | 25.43 | 15.84 | 22.47 | 18.33 | 17.56 | 16.99 | 11.05 | 11.79 | 10.2 | | | * | − |
| NT2RP4001803 | 3.51 | 2.55 | 1.55 | 5.77 | 4.36 | 4.15 | 4.43 | 4.25 | 2.97 | * | + | | |
| NT2RP4001805 | 4.04 | 2.46 | 2.43 | 5.53 | 4.54 | 4.71 | 3.91 | 2.59 | 3.66 | * | + | | |
| NT2RP4001809 | 14.99 | 9.07 | 7.27 | 11.92 | 10.72 | 9.25 | 11.36 | 11.25 | 11.16 | | | | |
| NT2RP4001817 | 16.10 | 8.59 | 7.80 | 8.81 | 9.92 | 9.75 | 5.74 | 6.19 | 5.7 | | | | |
| NT2RP4001822 | 9.90 | 6.09 | 4.79 | 7.82 | 4.55 | 6.51 | 6.73 | 5.44 | 6.61 | | | | |
| NT2RP4001823 | 1.63 | 1.96 | 0.82 | 1.62 | 2.17 | 1.74 | 1.56 | 1.67 | 0.88 | | | | |
| NT2RP4001827 | 5.09 | 4.68 | 4.45 | 4.54 | 5.32 | 5.79 | 7.53 | 6.64 | 8.76 | | | * | + |
| NT2RP4001828 | 17.04 | 10.89 | 10.46 | 15.89 | 15.47 | 13.14 | 13.38 | 12.00 | 9.76 | | | | |
| NT2RP4001836 | 5.07 | 3.08 | 3.80 | 4.72 | 5.04 | 5.75 | 5.07 | 4.56 | 2.8 | | | | |
| NT2RP4001838 | 6.83 | 3.89 | 5.07 | 5.21 | 2.01 | 6.41 | 4.27 | 6.56 | 2.85 | | | | |

TABLE 282

| | | | | | | | | | | | | |
|---|---|---|---|---|---|---|---|---|---|---|---|---|
| NT2RP4001841 | 5.15 | 2.19 | 2.44 | 6.33 | 5.75 | 3.95 | 4.94 | 4.03 | 3.03 | | | | |
| NT2RP4001849 | 4.08 | 2.37 | 1.90 | 1.96 | 2.08 | 2.74 | 2.12 | 3.59 | 2.22 | | | | |
| NT2RP4001861 | 19.55 | 11.05 | 8.48 | 18.06 | 19.21 | 17.61 | 12.49 | 10.31 | 10.34 | | | | |
| NT2RP4001877 | 18.38 | 12.98 | 11.71 | 13.65 | 17.92 | 15.26 | 10.17 | 11.03 | 9.86 | | | | |
| NT2RP4001879 | 6.00 | 4.86 | 5.20 | 4.62 | 6.88 | 7.55 | 4.96 | 6.52 | 5.75 | | | | |
| NT2RP4001889 | 3.83 | 2.48 | 2.26 | 4.36 | 5.15 | 5.12 | 3.39 | 5.09 | 3.84 | * | + | | |
| NT2RP4001893 | 4.85 | 2.58 | 3.31 | 5.78 | 4.46 | 6.55 | 5.02 | 4.75 | 1.96 | | | | |
| NT2RP4001896 | 4.86 | 2.86 | 3.13 | 4.46 | 5.44 | 4.95 | 3.44 | 3.93 | 1.91 | | | | |
| NT2RP4001898 | 12.63 | 7.18 | 6.38 | 11.85 | 13.48 | 14.72 | 8.27 | 7.05 | 8.92 | | | | |
| NT2RP4001901 | 9.37 | 5.10 | 4.58 | 7.22 | 7.41 | 7.58 | 5.92 | 5.84 | 4.25 | | | | |
| NT2RP4001910 | 44.22 | 14.42 | 25.27 | 36.18 | 28.56 | 31.03 | 15.44 | 16.11 | 13.43 | | | | |
| NT2RP4001925 | 6.01 | 3.53 | 4.07 | 7.13 | 8.88 | 6.52 | 5.38 | 5.68 | 3.89 | * | + | | |
| NT2RP4001926 | 5.02 | 2.32 | 4.10 | 6.70 | 3.01 | 7.01 | 3.35 | 4.83 | 1.34 | | | | |
| NT2RP4001927 | 7.81 | 3.22 | 8.37 | 2.90 | 3.77 | 4.75 | 2.11 | 3.46 | 2.61 | | | | |
| NT2RP4001931 | 12.13 | 7.10 | 9.23 | 9.30 | 11.80 | 10.57 | 7.09 | 9.58 | 5.89 | | | | |
| NT2RP4001933 | 7.27 | 5.93 | 8.24 | 33.37 | 26.48 | 21.53 | 12.07 | 15.48 | 9.59 | ** | + | * | + |
| NT2RP4001938 | 11.79 | 6.36 | 5.51 | 7.00 | 8.59 | 7.23 | 7.68 | 7.54 | 9.66 | | | | |
| NT2RP4001942 | 19.13 | 10.55 | 10.00 | 11.76 | 13.07 | 12.47 | 8.35 | 7.90 | 8.71 | | | | |
| NT2RP4001945 | 3.39 | 2.16 | 1.75 | 1.10 | 2.83 | 1.75 | 3.88 | 3.65 | 3.03 | | | | |
| NT2RP4001946 | 2.78 | 2.76 | 2.10 | 3.68 | 5.62 | 8.03 | 3.2 | 4.28 | 3.28 | ** | + | | |
| NT2RP4001947 | 0.70 | 0.50 | 0.71 | 3.55 | 3.12 | 4.05 | 1.69 | 2.42 | 0.29 | ** | + | | |
| NT2RP4001950 | 52.07 | 29.14 | 30.34 | 3.90 | 3.31 | 3.63 | 2.85 | 3.53 | 3.23 | * | − | * | − |
| NT2RP4001953 | 6.50 | 3.60 | 5.67 | 12.09 | 12.07 | 9.95 | 5.86 | 6.12 | 3.31 | ** | + | | |
| NT2RP4001966 | 3.87 | 2.06 | 1.81 | 2.93 | 2.33 | 3.06 | 2.56 | 3.55 | 1.61 | | | | |
| NT2RP4001970 | 18.77 | 7.73 | 6.33 | 7.39 | 9.12 | 8.12 | 6.83 | 7.05 | 6.87 | | | | |
| NT2RP4001975 | 16.12 | 8.35 | 8.50 | 16.73 | 14.58 | 16.13 | 21.64 | 17.08 | 14.87 | | | | |
| NT2RP4001988 | 6.11 | 2.52 | 2.36 | 2.17 | 2.97 | 2.42 | 4.05 | 5.29 | 6.8 | | | | |
| NT2RP4001996 | 8.88 | 6.41 | 7.06 | 5.35 | 6.06 | 5.33 | 4.86 | 5.72 | 5.5 | | | | |
| NT2RP4002014 | 5.46 | 3.70 | 3.51 | 5.82 | 4.28 | 3.92 | 5.71 | 6.94 | 6.45 | | | * | + |
| NT2RP4002018 | 4.51 | 3.12 | 2.83 | 6.79 | 4.88 | 5.98 | 4.66 | 10.23 | 5.14 | * | + | | |
| NT2RP4002035 | 6.12 | 4.46 | 6.67 | 7.19 | 6.57 | 6.76 | 5.8 | 5.73 | 6.32 | | | | |
| NT2RP4002043 | 17.40 | 10.99 | 15.66 | 15.62 | 10.19 | 12.89 | 8.93 | 9.28 | 5.15 | | | * | − |
| NT2RP4002046 | 6.17 | 4.77 | 3.90 | 3.50 | 9.38 | 4.20 | 6.26 | 5.07 | 7.72 | | | | |
| NT2RP4002047 | 14.83 | 7.78 | 9.72 | 12.74 | 11.88 | 9.86 | 4.4 | 4.88 | 5.22 | | | * | − |
| NT2RP4002052 | 3.82 | 2.22 | 2.36 | 3.72 | 2.89 | 4.12 | 4.34 | 4.20 | 5.03 | | | * | + |
| NT2RP4002056 | 55.72 | 38.98 | 47.46 | 51.12 | 52.01 | 41.19 | 44.9 | 38.97 | 37.38 | | | | |
| NT2RP4002057 | 17.74 | 8.34 | 10.35 | 10.25 | 6.84 | 10.23 | 9.46 | 9.43 | 9 | | | | |
| NT2RP4002058 | 5.05 | 3.72 | 3.60 | 3.34 | 2.84 | 3.35 | 3.74 | 3.86 | 2.96 | | | | |
| NT2RP4002064 | 2.43 | 1.64 | 1.15 | 2.53 | 2.72 | 2.44 | 2.13 | 3.96 | 2.74 | | | | |
| NT2RP4002071 | 6.91 | 5.83 | 6.59 | 9.94 | 11.45 | 10.50 | 6.83 | 7.79 | 5.44 | ** | + | | |
| NT2RP4002075 | 5.65 | 2.21 | 2.77 | 1.76 | 1.64 | 2.01 | 1.03 | 0.80 | 1.27 | | | | |
| NT2RP4002078 | 12.20 | 5.57 | 6.28 | 21.16 | 11.84 | 9.58 | 9.34 | 5.65 | 7.44 | | | | |
| NT2RP4002081 | 8.20 | 4.41 | 4.38 | 8.71 | 5.52 | 5.98 | 8.56 | 5.96 | 6.86 | | | | |
| NT2RP4002083 | 1.41 | 0.64 | 0.77 | 1.12 | 0.92 | 0.88 | 1.16 | 1.92 | 2.62 | | | | |
| NT2RP4002099 | 3.50 | 1.74 | 2.24 | 2.98 | 2.94 | 2.77 | 2.69 | 3.45 | 2.97 | | | | |
| NT2RP4002106 | 16.08 | 11.97 | 16.65 | 14.50 | 11.42 | 13.37 | 8.7 | 8.53 | 7.16 | | | * | − |
| NT2RP4002111 | 14.95 | 7.66 | 10.77 | 13.64 | 14.70 | 14.45 | 16.75 | 17.55 | 15.81 | | | | |
| NT2RP4002112 | 5.99 | 2.81 | 3.54 | 4.57 | 5.85 | 6.57 | 6.12 | 5.13 | 4.94 | | | | |
| NT2RP4002116 | 14.14 | 7.04 | 5.48 | 14.30 | 12.58 | 11.93 | 8.14 | 4.91 | 6.09 | | | | |
| NT2RP4002122 | 15.83 | 9.46 | 8.25 | 6.72 | 6.57 | 5.28 | 1.63 | 2.27 | 1.64 | | | * | − |
| NT2RP4002126 | 7.11 | 2.89 | 3.58 | 2.17 | 3.83 | 2.41 | 4.77 | 4.31 | 5.35 | | | | |
| NT2RP4002133 | 10.15 | 4.28 | 5.52 | 6.19 | 8.16 | 5.73 | 5.02 | 6.44 | 4.79 | | | | |
| NT2RP4002136 | 13.83 | 8.55 | 8.39 | 5.76 | 6.14 | 5.01 | 5.63 | 5.28 | 4.82 | | | * | − |
| NT2RP4002139 | 25.38 | 27.01 | 30.04 | 25.35 | 29.41 | 24.98 | 13.23 | 24.52 | 19.91 | | | | |
| NT2RP4002174 | 3.31 | 1.15 | 2.46 | 3.71 | 3.16 | 4.15 | 3.14 | 5.41 | 4.47 | | | | |
| NT2RP4002185 | 10.77 | 7.55 | 7.67 | 15.20 | 13.59 | 13.41 | 10.77 | 8.24 | 8.8 | | | * | + |

TABLE 283

| | | | | | | | | | | | | |
|---|---|---|---|---|---|---|---|---|---|---|---|---|
| NT2RP4002186 | 24.35 | 16.62 | 12.92 | 73.40 | 68.88 | 51.66 | 18.99 | 20.53 | 42.77 | ** | + | | |
| NT2RP4002187 | 16.88 | 9.15 | 8.08 | 13.25 | 18.23 | 17.99 | 14.62 | 13.98 | 23.37 | | | | |
| NT2RP4002188 | 9.49 | 5.18 | 4.64 | 14.32 | 14.99 | 9.78 | 4.92 | 6.78 | 9.43 | * | + | | |
| NTZRP4002199 | 3.33 | 0.85 | 1.71 | 2.01 | 2.76 | 1.40 | 1.46 | 4.34 | 2.92 | | | | |
| NT2RP4002206 | 7.79 | 3.61 | 3.56 | 5.56 | 5.23 | 3.75 | 3.53 | 5.24 | 4.66 | | | | |
| NT2RP4002210 | 3.95 | 1.94 | 2.05 | 3.42 | 2.86 | 2.32 | 2.13 | 4.76 | 2.28 | | | | |
| NT2RP4002222 | 4.87 | 2.50 | 3.89 | 4.48 | 5.59 | 3.24 | 4.1 | 4.89 | 3.82 | | | | |
| NT2RP4002241 | 10.39 | 8.75 | 9.34 | 8.11 | 10.75 | 7.80 | 3.37 | 5.39 | 6.12 | | | ** | − |
| NT2RP4002248 | 5.75 | 3.15 | 2.68 | 4.58 | 3.49 | 3.31 | 6.08 | 4.55 | 3.57 | | | | |
| NT2RP400Z250 | 2.77 | 1.28 | 0.36 | 1.28 | 1.49 | 1.07 | 2.02 | 0.58 | 1.13 | | | | |
| NT2RP4002259 | 11.44 | 4.70 | 6.93 | 10.37 | 10.26 | 7.96 | 6.18 | 7.00 | 6.72 | | | | |
| NT2RP4002268 | 9.49 | 7.15 | 6.70 | 7.16 | 8.97 | 8.79 | 12.35 | 10.44 | 12.35 | | | * | + |
| NT2RP4002288 | 23.22 | 15.06 | 19.08 | 20.88 | 28.68 | 23.53 | 20.32 | 17.25 | 20.1 | | | | |
| NT2RP4002290 | 9.48 | 5.25 | 5.05 | 15.46 | 15.55 | 18.46 | 13.55 | 11.18 | 12.37 | ** | + | * | + |
| NT2RP4002298 | 5.94 | 3.63 | 4.51 | 10.11 | 6.35 | 12.09 | 3.11 | 5.17 | 4.75 | | | | |
| NT2R74002306 | 5.29 | 2.43 | 3.39 | 8.59 | 7.82 | 9.25 | 3.86 | 4.05 | 3.61 | ** | + | | |
| NT2RP4002308 | 2.50 | 1.35 | 1.43 | 1.70 | 2.93 | 1.47 | 2.72 | 1.97 | 2.14 | | | | |
| NT2RP4002336 | 9.03 | 4.10 | 4.50 | 6.72 | 4.54 | 7.26 | 5.89 | 4.31 | 4.91 | | | | |
| NT2RP4002340 | 0.95 | 0.34 | 0.60 | 0.63 | 0.88 | 0.24 | 1.51 | 1.53 | 0.76 | | | | |
| NT2RP4002361 | 3.28 | 2.38 | 1.78 | 3.90 | 2.34 | 2.47 | 2.23 | 2.16 | 1.92 | | | | |
| NT2RP4002367 | 3.30 | 2.19 | 1.54 | 3.77 | 4.95 | 3.32 | 2.84 | 2.25 | 3 | | | | |
| NT2RP4002368 | 4.21 | 2.40 | 3.66 | 5.83 | 4.14 | 3.92 | 5.91 | 4.62 | 3.42 | | | | |
| NT2RP4002377 | 3.62 | 4.26 | 2.84 | 5.85 | 2.38 | 5.20 | 4.75 | 3.54 | 3.33 | | | | |
| NT2RP4002408 | 29.46 | 20.49 | 24.43 | 3.81 | 2.37 | 2.48 | 1.32 | 0.66 | 1.06 | ** | − | ** | − |
| NT2RP4002425 | 1.74 | 1.67 | 0.75 | 1.77 | 1.60 | 1.39 | 2.92 | 1.48 | 1.25 | | | | |
| NT2RP4002432 | 8.35 | 5.60 | 3.82 | 5.76 | 5.85 | 4.41 | 8.08 | 6.14 | 6.6 | | | | |
| NT2RP4002447 | 9.10 | 3.90 | 3.22 | 12.78 | 11.88 | 10.40 | 5.91 | 5.47 | 6.48 | * | + | | |
| NT2RP4001451 | 2.21 | 2.30 | 1.71 | 3.91 | 4.29 | 3.31 | 5.98 | 6.15 | 6.01 | ** | + | ** | + |
| NT2RP4002461 | 7.09 | 5.26 | 5.72 | 12.39 | 9.75 | 9.13 | 7.77 | 8.39 | 7.06 | * | + | | |
| NT2RP4002486 | 5.84 | 4.56 | 5.50 | 5.14 | 5.35 | 4.72 | 7.44 | 6.30 | 6.54 | | | * | + |
| NT2RP4002517 | 3.21 | 2.30 | 2.48 | 3.27 | 2.89 | 3.72 | 3.06 | 3.47 | 2.44 | | | | |
| NT2RP4002556 | 10.73 | 5.00 | 5.11 | 11.36 | 8.97 | 7.80 | 4.9 | 4.20 | 4.51 | | | | |
| NT2RP4002569 | 5.60 | 3.78 | 2.56 | 4.11 | 4.44 | 3.67 | 5.29 | 5.70 | 3.72 | | | | |
| NT2RP4002587 | 2.41 | 1.81 | 1.87 | 2.59 | 3.67 | 3.36 | 7.6 | 6.60 | 7.95 | * | + | ** | + |
| NT2RP4002591 | 7.42 | 6.05 | 5.29 | 12.68 | 12.07 | 10.38 | 7.78 | 4.95 | 7.6 | ** | + | | |
| NT2RP4002607 | 6.11 | 2.67 | 2.59 | 6.08 | 4.47 | 5.73 | 3.49 | 4.31 | 2.91 | | | | |
| NT2RP4002627 | 5.30 | 4.31 | 4.08 | 5.45 | 8.00 | 6.98 | 9.55 | 7.80 | 7.44 | | | ** | + |
| NT2RP4002628 | 13.62 | 7.50 | 7.90 | 12.59 | 11.82 | 9.24 | 5.81 | 7.23 | 4.46 | | | | |
| NT2RP4002630 | 3.81 | 2.47 | 2.90 | 6.00 | 2.15 | 4.82 | 6.13 | 6.96 | 4.18 | | | * | + |
| NT2RP4002639 | 4.77 | 2.18 | 3.85 | 2.27 | 2.26 | 2.48 | 1.79 | 3.34 | 1.18 | | | | |
| NT2RP4002641 | 8.72 | 3.54 | 3.33 | 4.53 | 5.23 | 4.41 | 5.45 | 5.35 | 8.22 | | | | |
| NTZRP4002658 | 39.52 | 16.53 | 21.90 | 10.69 | 10.22 | 8.63 | 12.92 | 12.25 | 13.09 | | | | |
| NT2RP4002669 | 8.68 | 5.48 | 3.61 | 6.49 | 4.90 | 5.66 | 4.3 | 4.66 | 5.21 | | | | |
| NT2RP4002677 | 11.90 | 7.10 | 10.78 | 11.62 | 13.84 | 10.32 | 4.5 | 5.32 | 4.63 | | | * | − |
| NT2RP4002715 | 6.49 | 4.85 | 5.45 | 16.06 | 11.33 | 12.78 | 11.52 | 13.89 | 13.89 | ** | + | ** | + |
| NT2RP4002750 | 11.19 | 4.76 | 5.94 | 4.82 | 3.94 | 4.94 | 3.86 | 3.11 | 3.58 | | | | |
| NT2RP4002784 | 5.22 | 3.74 | 4.33 | 6.90 | 5.66 | 7.76 | 7.61 | 4.05 | 3.39 | * | + | | |
| NTZRP4002791 | 2.32 | 2.02 | 2.01 | 4.89 | 4.01 | 4.73 | 3.62 | 3.85 | 2.33 | ** | + | | |
| NT2RP4002811 | 6.07 | 3.91 | 2.96 | 1.95 | 3.45 | 3.30 | 4.41 | 5.24 | 4.51 | | | | |
| NT2RP4002830 | 11.00 | 4.98 | 5.60 | 10.88 | 8.44 | 6.08 | 6.46 | 6.96 | 4.35 | | | | |
| NT2RP4002832 | 2.65 | 2.09 | 2.28 | 3.38 | 2.40 | 2.76 | 1.95 | 3.23 | 1.27 | | | | |
| NT2RP4002850 | 10.22 | 7.64 | 6.28 | 14.24 | 10.59 | 11.13 | 9.28 | 9.04 | 5.75 | | | | |
| NT2RP4002874 | 3.50 | 2.69 | 1.87 | 3.65 | 3.03 | 4.18 | 3.78 | 5.05 | 2.68 | | | | |
| NT2RP4002884 | 17.66 | 6.25 | 9.46 | 10.83 | 9.85 | 8.92 | 15.05 | 14.77 | 10.31 | | | | |
| NT2RP4002888 | 20.83 | 12.71 | 14.10 | 15.29 | 12.54 | 11.78 | 19.91 | 18.79 | 15.14 | | | | |
| NT2RP4002891 | 6.49 | 3.33 | 5.04 | 17.64 | 15.92 | 12.46 | 8.11 | 7.56 | 7.35 | ** | + | * | + |

TABLE 284

| | | | | | | | | | | | | |
|---|---|---|---|---|---|---|---|---|---|---|---|---|
| NT2RP4002894 | 30.47 | 15.42 | 16.30 | 15.33 | 13.44 | 13.63 | 14.61 | 7.84 | 11.34 | | | | |
| NT2RP4002896 | 5.01 | 2.57 | 1.03 | 5.77 | 4.90 | 3.35 | 4.85 | 5.20 | 6.5 | | | | |
| NT2RP4002905 | 3.65 | 2.18 | 2.47 | 3.73 | 2.63 | 3.46 | 2.67 | 3.64 | 2.22 | | | | |
| NT2RP4002907 | 6.79 | 1.23 | 2.84 | 16.01 | 14.42 | 10.02 | 12.06 | 10.10 | 6.54 | * | + | | |
| NT2RP5003459 | 65.35 | 36.44 | 48.17 | 27.67 | 30.09 | 25.05 | 9.64 | 20.91 | 22.09 | | | * | − |
| NT2RP5003461 | 4.58 | 3.60 | 3.17 | 6.87 | 4.80 | 7.46 | 3.05 | 4.17 | 2.86 | * | + | | |
| NT2RP5003471 | 5.96 | 3.26 | 3.68 | 5.59 | 5.78 | 6.38 | 36.49 | 36.45 | 36.48 | | | ** | + |
| NT2RP5003477 | 4.19 | 2.26 | 3.16 | 4.58 | 5.06 | 6.58 | 6.46 | 4.38 | 3.4 | | | | |
| NT2RP5003487 | 220.55 | 93.22 | 98.28 | 181.60 | 187.80 | 154.38 | 86.45 | 85.87 | 93.23 | | | | |
| NT2RP5003492 | 7.41 | 4.46 | 3.61 | 6.80 | 6.09 | 7.24 | 6.01 | 5.67 | 4.83 | | | | |
| NT2RP5003500 | 3.73 | 2.01 | 1.80 | 4.33 | 3.62 | 5.68 | 2.91 | 3.93 | 3.14 | | | | |
| NT2RP5003506 | 9.63 | 4.24 | 5.17 | 6.58 | 8.38 | 7.49 | 5.4 | 7.54 | 7.66 | | | | |
| NT2RP5003512 | 2.05 | 1.82 | 0.90 | 1.93 | 2.76 | 1.89 | 1.76 | 3.04 | 2.68 | | | | |
| NT2RP5003522 | 5.00 | 3.31 | 4.09 | 6.05 | 5.02 | 4.70 | 4.69 | 4.96 | 3.11 | | | | |
| NT2RP5003524 | 2.66 | 1.03 | 1.85 | 3.05 | 3.14 | 2.14 | 2.01 | 1.80 | 0.86 | | | | |
| NT2RP5003527 | 27.32 | 17.39 | 20.11 | 33.15 | 29.19 | 33.15 | 34.18 | 28.33 | 30.99 | * | + | * | + |
| NT2RP5003531 | 6.09 | 4.05 | 3.52 | 14.63 | 15.87 | 11.17 | 18.91 | 10.15 | 13.33 | ** | + | * | + |

TABLE 284-continued

| | | | | | | | | | | | | |
|---|---|---|---|---|---|---|---|---|---|---|---|---|
| NT2RP5003534 | 4.69 | 3.24 | 2.48 | 4.56 | 5.46 | 3.21 | 3.85 | 3.74 | 4.1 | | | |
| NT2RP6000020 | 14.93 | 5.50 | 7.94 | 19.43 | 12.24 | 14.47 | 28 | 17.69 | 22.01 | | * | + |
| NT2RP6000022 | 2.09 | 1.92 | 1.10 | 2.89 | 3.69 | 3.48 | 1.85 | 3.95 | 3.04 | * | + | |
| NT2RP6000050 | 6.72 | 2.85 | 2.69 | 5.15 | 4.13 | 6.91 | 3.13 | 4.74 | 4.15 | | | |
| NT2RP6000063 | 4.32 | 1.86 | 2.74 | 4.12 | 3.95 | 5.49 | 4.77 | 5.84 | 5.17 | | * | + |
| NT2RP6000074 | 7.65 | 3.63 | 3.82 | 5.82 | 4.62 | 5.47 | 3.91 | 5.25 | 4.12 | | | |
| NT2RP6000083 | 7.65 | 4.46 | 4.22 | 5.62 | 7.05 | 9.12 | 4.96 | 6.80 | 6.49 | | | |
| NT2RP6000100 | 8.20 | 3.69 | 3.69 | 11.31 | 10.03 | 10.20 | 5.69 | 6.11 | 4.22 | * | + | |
| NT2RP6000123 | 8.42 | 4.03 | 3.87 | 7.40 | 6.54 | 4.76 | 5.08 | 5.14 | 4.33 | | | |
| NT2RP6000129 | 5.14 | 2.45 | 3.11 | 3.95 | 4.30 | 4.21 | 3.96 | 4.16 | 4.57 | | | |
| NT2RP6000147 | 3.79 | 2.50 | 3.26 | 15.24 | 15.27 | 11.86 | 26.48 | 14.22 | 25.1 | ** | + | ** | + |
| NT2RP6000163 | 1.43 | 1.14 | 1.15 | 3.25 | 1.30 | 2.00 | 1.02 | 2.54 | 1.73 | | | |
| NT2RP6000181 | 7.19 | 4.67 | 4.25 | 6.16 | 6.80 | 4.73 | 6.67 | 5.10 | 6.2 | | | |
| NT2RP6000182 | 5.25 | 3.12 | 3.43 | 5.76 | 4.23 | 7.79 | 3.45 | 3.70 | 2.44 | | | |
| OVARC1000001 | 4.47 | 2.05 | 2.92 | 5.01 | 4.27 | 3.71 | 5.92 | 4.78 | 4.37 | | | |
| OVARC1000003 | 4.03 | 2.27 | 2.17 | 3.53 | 4.26 | 1.98 | 1.87 | 2.81 | 4.16 | | | |
| OVARC1000004 | 69.94 | 45.81 | 40.28 | 31.28 | 33.52 | 34.13 | 14.2 | 20.99 | 22.91 | | * | − |
| OVARC1000006 | 2.75 | 1.60 | 1.91 | 3.55 | 3.17 | 2.27 | 3.59 | 3.71 | 3.52 | | * | + |
| OVARC1000013 | 3.58 | 2.31 | 1.87 | 3.88 | 4.15 | 3.20 | 3.52 | 4.55 | 2.95 | | | |
| OVARC1000014 | 5.72 | 2.95 | 3.69 | 6.24 | 6.32 | 5.61 | 4.07 | 4.99 | 4.34 | | | |
| OVARC1000017 | 6.14 | 3.05 | 3.33 | 4.90 | 5.12 | 5.05 | 3.15 | 5.17 | 5.31 | | | |
| OVARC1000026 | 55.69 | 36.49 | 45.68 | 51.02 | 60.13 | 48.46 | 28.42 | 36.95 | 25.22 | | | |
| OVARC1000035 | 9.77 | 8.46 | 8.93 | 13.12 | 14.00 | 9.30 | 7.02 | 5.89 | 5.3 | | ** | − |
| OVARC1000037 | 31.27 | 16.99 | 12.47 | 49.92 | 39.93 | 32.59 | 18.22 | 25.08 | 32.08 | | | |
| OVARC1000058 | 10.77 | 5.52 | 3.11 | 12.87 | 13.32 | 13.63 | 6.74 | 5.82 | 8.66 | * | + | |
| OVARC1000060 | 3.24 | 1.54 | 1.26 | 3.04 | 2.70 | 2.45 | 2.09 | 2.66 | 3.05 | | | |
| OVARC1000068 | 2.38 | 1.15 | 1.10 | 3.07 | 2.77 | 1.87 | 1.01 | 3.23 | 1.66 | | | |
| OVARC1000069 | 4.64 | 2.24 | 2.58 | 7.95 | 8.04 | 5.29 | 4.94 | 7.33 | 5.21 | * | + | |
| OVARC1000071 | 4.18 | 2.24 | 2.19 | 3.21 | 4.19 | 2.93 | 1.32 | 4.38 | 1.25 | | | |
| OVARC1000075 | 116.66 | 59.06 | 70.03 | 104.67 | 109.44 | 102.05 | 127.1 | 180.67 | 194.9 | | * | + |
| OVARC1000083 | 16.13 | 9.03 | 10.85 | 16.27 | 15.52 | 17.85 | 9.32 | 13.62 | 11.15 | | | |
| OVARC1000085 | 90.31 | 52.35 | 57.44 | 84.93 | 91.25 | 74.75 | 46.89 | 55.51 | 55.51 | | | |
| OVARC1000086 | 3.63 | 2.07 | 4.18 | 7.09 | 7.77 | 8.13 | 5.87 | 6.77 | 6.77 | ** | + | * | + |
| OVARC1000087 | 2.46 | 0.70 | 0.93 | 1.65 | 1.80 | 2.44 | 2.22 | 3.58 | 3.58 | | | |
| OVARC1000090 | 7.22 | 4.69 | 6.24 | 15.64 | 14.18 | 15.90 | 5.67 | 9.11 | 9.11 | ** | + | |
| OVARC1000091 | 3.66 | 1.42 | 2.09 | 5.7 | 4.57 | 5.66 | 4.01 | 3.77 | 3.77 | * | + | |
| OVARC1000092 | 3.91 | 1.98 | 2.18 | 6.09 | 6.36 | 8.26 | 4.35 | 4.86 | 4.86 | * | + | * | + |
| OVARC1000105 | 11.95 | 8.25 | 9.35 | 12.3 | 11.58 | 13.87 | 6.66 | 8.05 | 8.05 | | | |
| OVARC1000106 | 23.29 | 10.32 | 10.91 | 20.75 | 17.39 | 12.69 | 12.13 | 18.29 | 18.29 | | | |

TABLE 285

| | | | | | | | | | | | | |
|---|---|---|---|---|---|---|---|---|---|---|---|---|
| OVARC1000109 | 10.73 | 4.48 | 6.00 | 9.44 | 8.48 | 8.37 | 6.70 | 8.07 | 8.07 | | | |
| OVARC1000113 | 4.43 | 3.28 | 2.32 | 5.28 | 7.68 | 6.28 | 3.04 | 3.01 | 3.01 | * | + | |
| OVARC1000114 | 4.61 | 1.82 | 2.98 | 6.68 | 7.59 | 8.77 | 4.82 | 5.56 | 5.56 | * | + | |
| OVARC1000133 | 2.28 | 0.62 | 2.11 | 1.97 | 3.23 | 1.32 | 1.31 | 3.42 | 3.42 | | | |
| OVARC1000137 | 7.57 | 3.31 | 3.78 | 7.45 | 5.45 | 6.40 | 5.03 | 9.51 | 9.51 | | | |
| OVARC1000139 | 8.5 | 5.04 | 5.90 | 7.42 | 5.19 | 7.20 | 5.43 | 7.04 | 7.04 | | | |
| OVARC1000145 | 1.66 | 0.51 | 1.26 | 2.03 | 2.15 | 2.60 | 1.95 | 1.96 | 1.96 | * | + | |
| OVARC1000148 | 13.99 | 5.79 | 5.64 | 16.54 | 19.40 | 9.14 | 7.33 | 8.83 | 8.83 | | | |
| OVARC1000151 | 5.62 | 2.25 | 3.47 | 4.79 | 5.94 | 4.15 | 4.17 | 6.14 | 6.14 | | | |
| OVARC1000157 | 5.78 | 3.92 | 3.63 | 20.18 | 23.53 | 19.12 | 7.05 | 10.69 | 10.69 | ** | + | * | + |
| OVARC1000162 | 1.04 | 0.27 | 1.30 | 1.82 | 2.05 | 0.82 | 1.71 | 1.67 | 1.67 | | | |
| OVARC1000168 | 6.93 | 3.43 | 5.38 | 9.14 | 7.70 | 8.50 | 5.44 | 8.50 | 8.5 | * | + | |
| OVARC1000169 | 20.78 | 9.01 | 10.52 | 18.85 | 14.31 | 18.81 | 15.67 | 26.42 | 26.42 | | | |
| OVARC1000178 | 6.27 | 4.19 | 5.21 | 6.05 | 5.93 | 6.06 | 4.30 | 5.93 | 5.93 | | | |
| OVARC1000182 | 1.08 | 0.33 | 0.60 | 3.18 | 1.53 | 2.07 | 1.58 | 1.16 | 1.16 | * | + | |
| OVARC1000186 | 11.87 | 6.09 | 4.34 | 4.72 | 8.03 | 4.57 | 4.49 | 8.00 | 8 | | | |
| OVARC1000188 | 6.88 | 3.30 | 4.11 | 6.26 | 4.11 | 4.48 | 4.18 | 5.80 | 5.8 | | | |
| OVARC1000191 | 2.39 | 0.93 | 1.25 | 1.87 | 4.24 | 1.53 | 1.02 | 3.43 | 3.43 | | | |
| OVARC1000198 | 7.48 | 2.50 | 4.22 | 12.55 | 13.51 | 9.27 | 4.79 | 6.14 | 6.14 | * | + | |
| OVARC1000208 | 7.66 | 5.85 | 6.85 | 11.11 | 11.76 | 10.78 | 8.71 | 6.63 | 6.63 | ** | + | |
| OVARC1000209 | 5.19 | 2.21 | 3.10 | 4.98 | 5.19 | 3.99 | 3.67 | 6.12 | 6.12 | | | |
| OVARC1000212 | 7.76 | 3.64 | 5.91 | 6.62 | 4.86 | 7.78 | 4.09 | 6.97 | 6.97 | | | |
| OVARC1000216 | 1.71 | 1.54 | 1.80 | 2.95 | 1.87 | 2.06 | 1.88 | 2.20 | 2.2 | | * | + |
| OVARC1000240 | 9.19 | 4.82 | 3.93 | 10.89 | 11.55 | 7.32 | 4.66 | 6.08 | 6.08 | | | |
| OVARC1000241 | 8.4 | 2.88 | 3.50 | 6.97 | 5.95 | 3.69 | 4.83 | 5.66 | 5.66 | | | |
| OVARC1000249 | 5.89 | 2.71 | 3.55 | 5.91 | 5.26 | 3.50 | 4.13 | 5.08 | 5.08 | | | |
| OVARC1000254 | 16.05 | 11.01 | 13.12 | 50.15 | 59.76 | 29.83 | 42.38 | 33.82 | 33.82 | * | + | ** | + |
| OVARC1000255 | 5.5 | 3.14 | 2.99 | 5.45 | 4.17 | 3.19 | 3.91 | 4.30 | 4.3 | | | |
| OVARC1000267 | 8.95 | 5.90 | 5.53 | 9.61 | 7.91 | 10.70 | 8.96 | 10.59 | 10.59 | | | |
| OVARC1000275 | 0.38 | 0.28 | 0.65 | 1.7 | 1.69 | 1.90 | 10.31 | 9.09 | 9.09 | ** | + | ** | + |
| OVARC1000287 | 2.16 | 1.07 | 1.61 | 5.38 | 6.97 | 4.90 | 26.09 | 33.14 | 33.14 | ** | + | ** | + |
| OVARC1000288 | 7.99 | 3.43 | 4.43 | 6.36 | 6.18 | 3.91 | 4.34 | 4.81 | 4.81 | | | |
| OVARC1000298 | 8.86 | 6.47 | 4.36 | 11.32 | 12.55 | 7.25 | 6.14 | 7.12 | 7.12 | | | |
| OVARC1000302 | 3.96 | 1.75 | 1.50 | 3.75 | 4.71 | 3.28 | 2.04 | 3.19 | 3.19 | | | |

TABLE 285-continued

| | | | | | | | | | | | | | |
|---|---|---|---|---|---|---|---|---|---|---|---|---|---|
| OVARC1000304 | 6.08 | 4.82 | 3.98 | 7.97 | 7.57 | 5.26 | 4.58 | 6.93 | 6.93 | | | | |
| OVARC1000307 | 5.1 | 1.95 | 3.30 | 4.25 | 2.68 | 4.18 | 3.69 | 3.54 | 3.54 | | | | |
| OVARC1000309 | 6.17 | 3.11 | 3.95 | 6.94 | 5.55 | 4.98 | 5.49 | 5.61 | 5.61 | | | | |
| OVARC1000312 | 4.47 | 2.31 | 2.62 | 3.43 | 3.39 | 3.03 | 5.14 | 4.44 | 4.44 | | | | |
| OVARC1000313 | 7.23 | 3.04 | 5.41 | 6.92 | 6.31 | 4.37 | 7.31 | 10.70 | 10.7 | | | | |
| OVARC1000321 | 8.81 | 5.88 | 6.66 | 13.97 | 15.87 | 13.56 | 14.26 | 12.53 | 12.53 | ** | + | ** | + |
| OVARC1000326 | 3.94 | 3.57 | 2.28 | 3.59 | 3.18 | 3.94 | 3.62 | 3.71 | 3.71 | | | | |
| OVARC1000327 | 4.66 | 2.13 | 3.59 | 7.38 | 4.82 | 4.34 | 3.97 | 5.68 | 5.68 | | | | |
| OVARC1000331 | 6.82 | 4.80 | 4.04 | 7.15 | 6.72 | 8.39 | 4.61 | 6.40 | 6.4 | | | | |
| OVARC1000335 | 5.22 | 3.45 | 3.68 | 6.19 | 5.78 | 6.01 | 4.99 | 5.32 | 5.32 | * | + | | |
| OVARC1000347 | 2.86 | 2.21 | 1.39 | 1.74 | 2.06 | 3.33 | 1.79 | 3.03 | 3.03 | | | | |
| OVARC1000348 | 7.01 | 4.29 | 4.68 | 13.43 | 12.42 | 16.47 | 7.65 | 8.17 | 8.17 | ** | + | * | + |
| OVARC1000363 | 4.22 | 3.97 | 3.08 | 6.15 | 6.28 | 7.74 | 2.83 | 4.38 | 4.38 | ** | + | | |
| OVARC1000377 | 2.82 | 1.76 | 1.53 | 3.08 | 2.53 | 1.71 | 0.35 | 2.23 | 2.23 | | | | |
| OVARC1000382 | 5.76 | 1.98 | 3.91 | 4.79 | 5.06 | 3.60 | 4.10 | 6.90 | 6.9 | | | | |
| OVARC1000384 | 6.02 | 5.30 | 4.11 | 6.76 | 8.20 | 10.33 | 8.85 | 9.44 | 9.44 | * | + | ** | + |
| OVARC1000401 | 2.8 | 1.75 | 1.96 | 2.86 | 2.28 | 2.89 | 2.67 | 3.48 | 3.48 | | | | |
| OVARC1000406 | 114.78 | 80.20 | 88.37 | 88.01 | 73.54 | 119.34 | 90.62 | 95.77 | 95.77 | | | | |
| OVARC1000407 | 4.6 | 3.44 | 3.17 | 5.58 | 5.61 | 8.84 | 5.08 | 4.38 | 4.38 | | | | |
| OVARC1000408 | 16.3 | 13.53 | 12.64 | 45.51 | 42.22 | 49.78 | 26.85 | 32.12 | 32.12 | ** | + | ** | + |
| OVARC1000410 | 6.71 | 4.55 | 5.34 | 4.6 | 7.22 | 6.74 | 6.55 | 6.11 | 6.11 | | | | |
| OVARC1000411 | 3.32 | 1.84 | 2.60 | 3.91 | 7.15 | 2.94 | 1.78 | 2.39 | 2.39 | | | | |

TABLE 286

| | | | | | | | | | | | | | |
|---|---|---|---|---|---|---|---|---|---|---|---|---|---|
| OVARC1000414 | 2.94 | 2.41 | 3.01 | 5.83 | 4.82 | 5.60 | 3.16 | 3.78 | 3.78 | ** | + | * | + |
| OVARC1000420 | 11.4 | 6.17 | 7.59 | 9.95 | 9.38 | 10.06 | 10.09 | 13.16 | 13.16 | | | | |
| OVARC1000421 | 8.6 | 6.78 | 5.53 | 8.33 | 7.86 | 10.75 | 8.17 | 6.59 | 6.59 | | | | |
| OVARC1000427 | 3.68 | 2.71 | 4.36 | 3.26 | 4.27 | 4.49 | 3.23 | 3.96 | 3.96 | | | | |
| OVARC1000431 | 28.24 | 22.85 | 26.14 | 17.5 | 18.78 | 21.85 | 14.12 | 15.50 | 15.5 | * | − | ** | − |
| OVARC1000437 | 4.74 | 2.97 | 4.16 | 5.12 | 6.15 | 7.20 | 4.22 | 6.60 | 6.6 | | | | |
| OVARC1000439 | 7.31 | 6.90 | 5.38 | 7.44 | 6.69 | 8.00 | 6.48 | 4.83 | 4.83 | | | | |
| OVARC1000440 | 10.79 | 6.84 | 6.93 | 7.88 | 7.24 | 7.80 | 6.48 | 7.22 | 7.22 | | | | |
| OVARC1000442 | 5.47 | 3.48 | 2.90 | 10.37 | 8.05 | 7.61 | 4.21 | 5.71 | 5.71 | * | + | | |
| OVARC1000443 | 2.37 | 1.87 | 2.77 | 3.52 | 3.55 | 4.55 | 2.82 | 6.19 | 6.19 | * | + | | |
| OVARC1000461 | 3.39 | 2.34 | 2.79 | 3.41 | 2.83 | 2.56 | 4.13 | 3.34 | 3.34 | | | | |
| OVARC1000465 | 4.49 | 3.75 | 4.70 | 4.65 | 4.57 | 4.49 | 3.93 | 2.86 | 2.86 | | | | |
| OVARC1000466 | 5.63 | 3.82 | 4.46 | 5.01 | 4.97 | 7.62 | 6.00 | 5.12 | 5.12 | | | | |
| OVARC1000467 | 3.64 | 2.33 | 2.91 | 3.88 | 3.66 | 4.53 | 4.40 | 4.32 | 4.32 | | | * | + |
| OVARC1000470 | 4.4 | 2.42 | 1.89 | 7.76 | 7.31 | 7.37 | 4.36 | 3.86 | 3.86 | ** | + | | |
| OVARC1000473 | 5.77 | 6.12 | 2.59 | 5.13 | 4.08 | 6.65 | 4.72 | 6.17 | 6.17 | | | | |
| OVARC1000479 | 10.65 | 6.40 | 6.55 | 8.36 | 8.23 | 12.25 | 7.74 | 6.99 | 6.99 | | | | |
| OVARC1000484 | 7.73 | 3.54 | 4.68 | 14.41 | 17.12 | 13.60 | 11.04 | 9.93 | 9.93 | ** | + | * | + |
| OVARC1000486 | 3.13 | 1.48 | 1.74 | 5.56 | 5.39 | 7.63 | 4.10 | 3.04 | 3.04 | ** | + | | |
| OVARC1000496 | 0.32 | 0.95 | 1.13 | 0.23 | 0.59 | 1.74 | 1.38 | 0.85 | 0.85 | | | | |
| OVARC1000520 | 0.79 | 1.22 | 1.43 | 1.76 | 1.97 | 2.08 | 2.17 | 1.68 | 1.68 | * | + | * | + |
| OVARC1000522 | 4.89 | 4.05 | 3.21 | 7.99 | 8.62 | 12.13 | 8.58 | 8.73 | 8.73 | * | + | ** | + |
| OVARC1000526 | 5.23 | 3.76 | 3.40 | 9.44 | 8.41 | 9.79 | 6.60 | 6.83 | 6.83 | ** | + | ** | + |
| OVARC1000529 | 8.29 | 5.03 | 3.79 | 8.43 | 8.08 | 7.91 | 6.33 | 6.00 | 6 | | | | |
| OVARC1000533 | 13.85 | 10.76 | 9.50 | 10.46 | 10.65 | 9.69 | 10.80 | 10.74 | 10.74 | | | | |
| OVARC1000543 | 2.14 | 1.23 | 0.78 | 1.99 | 1.06 | 1.67 | 1.34 | 1.95 | 1.95 | | | | |
| OVARC1000550 | 3.95 | 2.99 | 2.96 | 3.41 | 5.27 | 5.08 | 3.89 | 3.69 | 3.69 | | | | |
| OVARC1000553 | 7.96 | 6.39 | 6.63 | 10.34 | 11.92 | 12.52 | 8.20 | 8.94 | 8.94 | ** | + | * | + |
| OVARC1000556 | 2.91 | 2.73 | 2.33 | 4.64 | 4.36 | 4.57 | 3.30 | 5.76 | 5.76 | ** | + | | |
| OVARC1000557 | 1.8 | 2.00 | 2.08 | 3.66 | 2.89 | 3.58 | 2.75 | 2.23 | 2.23 | ** | + | | |
| OVARC1000561 | 5.49 | 5.12 | 4.27 | 12.79 | 11.21 | 12.35 | 4.34 | 6.50 | 6.5 | ** | + | | |
| OVARC1000564 | 11 | 4.97 | 4.49 | 6.39 | 9.03 | 5.47 | 5.12 | 5.72 | 5.72 | | | | |
| OVARC1000573 | 3.43 | 1.54 | 1.73 | 4.84 | 5.71 | 5.20 | 3.22 | 2.70 | 2.7 | ** | + | | |
| OVARC1000576 | 22.35 | 9.42 | 12.58 | 14.84 | 14.82 | 13.96 | 18.96 | 21.39 | 21.39 | | | | |
| OVARC1000578 | 3.78 | 1.92 | 1.91 | 7.25 | 4.00 | 7.95 | 3.26 | 3.45 | 3.45 | * | + | | |
| OVARC1000581 | 2.32 | 0.98 | 1.31 | 2.39 | 2.02 | 2.50 | 0.87 | 2.36 | 2.36 | | | | |
| OVARC1000586 | 4.15 | 3.94 | 3.82 | 5.69 | 4.46 | 5.03 | 7.98 | 9.37 | 9.37 | * | + | ** | + |
| OVARC1000588 | 3.09 | 2.32 | 2.34 | 6.24 | 5.07 | 6.64 | 3.10 | 4.00 | 4 | ** | + | * | + |
| OVARC1000605 | 3.48 | 1.27 | 1.57 | 3.94 | 3.34 | 1.96 | 2.17 | 3.54 | 3.54 | | | | |
| OVARC1000622 | 16.94 | 7.82 | 7.29 | 28.21 | 27.34 | 23.72 | 13.10 | 15.48 | 15.48 | * | + | | |
| OVARC1000636 | 7.07 | 3.14 | 2.94 | 8.06 | 7.46 | 5.78 | 4.15 | 5.40 | 5.4 | | | | |
| OVARC1000640 | 1.93 | 1.10 | 2.17 | 2.95 | 3.95 | 2.11 | 1.86 | 2.87 | 2.87 | | | | |
| OVARC1000649 | 6.55 | 3.47 | 4.45 | 4.81 | 4.28 | 3.96 | 4.42 | 5.10 | 5.1 | | | | |
| OVARC1000661 | 8.83 | 4.09 | 5.47 | 7.42 | 7.41 | 7.08 | 6.76 | 7.35 | 7.35 | | | | |
| OVARC1000677 | 5.49 | 3.25 | 4.84 | 5.23 | 4.19 | 5.75 | 3.47 | 4.95 | 4.95 | | | | |
| OVARC1000678 | 3.24 | 2.45 | 2.41 | 6.56 | 3.68 | 3.55 | 3.07 | 3.23 | 3.23 | | | | |
| OVARC1000679 | 2.29 | 2.05 | 2.51 | 5.5 | 7.69 | 3.61 | 2.67 | 3.02 | 3.02 | * | + | * | + |
| OVARC1000681 | 3.04 | 1.58 | 2.55 | 2.83 | 3.65 | 2.16 | 1.27 | 3.32 | 3.32 | | | | |
| OVARC1000682 | 5.34 | 2.89 | 3.15 | 10.89 | 12.80 | 6.98 | 6.81 | 6.70 | 6.7 | * | + | * | + |
| OVARC1000689 | 6.35 | 2.64 | 5.24 | 6.82 | 5.05 | 3.15 | 3.89 | 5.86 | 5.86 | | | | |
| OVARC1000700 | 4.87 | 2.36 | 3.84 | 6.43 | 6.33 | 5.87 | 5.58 | 3.71 | 3.71 | * | + | | |

TABLE 286-continued

| | | | | | | | | | | | | |
|---|---|---|---|---|---|---|---|---|---|---|---|---|
| OVARC1000703 | 6.09 | 5.10 | 4.50 | 10.85 | 8.68 | 9.16 | 5.32 | 6.24 | 6.24 | ** | + | |
| OVARC1000722 | 6.99 | 3.21 | 3.22 | 7.7 | 5.28 | 6.60 | 3.85 | 5.25 | 5.25 | | | |
| OVARC1000726 | 12.55 | 5.82 | 7.48 | 9.62 | 7.07 | 8.57 | 9.99 | 8.90 | 8.9 | | | |
| OVARC1000727 | 8.32 | 3.91 | 3.99 | 6.93 | 6.40 | 4.72 | 3.99 | 5.01 | 5.01 | | | |
| OVARC1000730 | 6.1 | 3.39 | 3.84 | 6.3 | 8.93 | 6.59 | 2.98 | 3.46 | 3.46 | | | |

TABLE 287

| | | | | | | | | | | | | | |
|---|---|---|---|---|---|---|---|---|---|---|---|---|---|
| OVARC100741 | 7.47 | 3.93 | 4.05 | 6.71 | 8.34 | 4.11 | 5.58 | 6.82 | 6.82 | | | | |
| OVARC1000746 | 2.7 | 1.49 | 1.95 | 3.42 | 4.80 | 3.86 | 2.21 | 3.03 | 3.03 | * | + | | |
| OVARC1000764 | 9.15 | 7.18 | 6.73 | 6.1 | 5.81 | 7.27 | 6.23 | 6.93 | 6.93 | | | | |
| OVARC1000769 | 1.96 | 2.22 | 1.65 | 4.18 | 3.56 | 4.40 | 2.93 | 2.93 | 2.93 | ** | + | ** | + |
| OVARC1000771 | 3.36 | 1.52 | 2.49 | 4.38 | 3.35 | 3.58 | 3.00 | 4.34 | 4.34 | | | | |
| OVARC1000773 | 223.93 | 75.55 | 197.24 | 131.33 | 115.24 | 132.74 | 69.02 | 82.73 | 82.73 | | | | |
| OVARC1000775 | 5.89 | 2.38 | 2.57 | 10.9 | 11.89 | 6.67 | 5.95 | 7.36 | 7.36 | * | + | | |
| OVARC1000778 | 5.16 | 2.89 | 2.70 | 7.19 | 7.19 | 4.94 | 4.21 | 3.79 | 3.79 | | | | |
| OVARC1000779 | 1.34 | 0.25 | 1.68 | 0.81 | 2.17 | 1.66 | 0.98 | 2.78 | 2.78 | | | | |
| OVARC1000781 | 3.01 | 1.11 | 1.81 | 3.21 | 4.12 | 3.42 | 2.43 | 3.96 | 3.96 | | | | |
| OVARC1000787 | 5.12 | 1.26 | 2.40 | 6.21 | 4.91 | 6.16 | 2.68 | 3.80 | 3.8 | | | | |
| OVARC1000789 | 17.92 | 12.51 | 11.26 | 12.68 | 11.30 | 14.18 | 7.52 | 8.71 | 8.71 | | | | |
| OVARC1000800 | 10.27 | 6.21 | 6.25 | 13.32 | 11.12 | 11.87 | 8.07 | 9.42 | 9.42 | * | + | | |
| OVARC1000802 | 3.94 | 1.53 | 1.34 | 4.85 | 5.51 | 3.97 | 3.28 | 3.23 | 3.23 | | | | |
| OVARC1000810 | 7.31 | 2.74 | 2.89 | 9.23 | 8.19 | 6.66 | 4.42 | 6.46 | 6.46 | | | | |
| OVARC1000811 | 4.94 | 1.49 | 1.98 | 3.69 | 5.14 | 3.20 | 2.80 | 3.11 | 3.11 | | | | |
| OVARC1000814 | 8.98 | 4.85 | 4.30 | 12.34 | 14.84 | 13.49 | 5.29 | 9.28 | 9.28 | * | + | | |
| OVARC1000816 | 5.55 | 2.23 | 3.34 | 6.25 | 6.38 | 4.13 | 4.96 | 10.86 | 10.86 | | | | |
| OVARC1000817 | 0.67 | 0.84 | 0.17 | 1.03 | 1.43 | 0.88 | 1.03 | 1.18 | 1.18 | | | | |
| OVARC1000834 | 7.9 | 3.52 | 4.48 | 7.01 | 4.99 | 6.90 | 5.30 | 8.11 | 8.11 | | | | |
| OVARC1000846 | 8.76 | 5.89 | 5.62 | 13.13 | 13.07 | 12.45 | 7.92 | 8.86 | 8.86 | ** | + | | |
| OVARC1000850 | 4.55 | 4.35 | 3.79 | 5.06 | 4.86 | 6.51 | 5.09 | 5.93 | 5.93 | | | * | + |
| OVARC1000853 | 10.26 | 6.75 | 7.96 | 17.45 | 22.42 | 13.77 | 15.27 | 17.34 | 17.34 | * | + | ** | + |
| OVARC1000862 | 2.31 | 1.51 | 1.67 | 2.98 | 3.34 | 3.48 | 2.84 | 3.92 | 3.92 | ** | + | * | + |
| OVARC1000873 | 5.08 | 3.94 | 3.56 | 7.67 | 7.81 | 9.71 | 8.49 | 9.22 | 9.22 | ** | + | ** | + |
| OVARC1000875 | 13.15 | 7.32 | 6.94 | 10.33 | 8.49 | 11.65 | 7.63 | 12.92 | 12.92 | | | | |
| OVARC1000876 | 3.56 | 1.95 | 2.71 | 3.83 | 2.75 | 3.80 | 2.91 | 3.90 | 3.9 | | | | |
| OVARC1000883 | 11.24 | 5.79 | 7.03 | 7.42 | 6.63 | 8.18 | 6.12 | 10.30 | 10.3 | | | | |
| OVARC1000885 | 1.99 | 1.85 | 0.96 | 2.91 | 2.72 | 4.05 | 1.81 | 1.84 | 1.84 | * | + | | |
| OVARC1000886 | 3.79 | 3.90 | 3.30 | 5.23 | 4.59 | 3.88 | 4.18 | 4.19 | 4.19 | | | * | + |
| OVARC1000890 | 16.12 | 9.23 | 8.22 | 13.23 | 13.98 | 12.06 | 8.12 | 8.78 | 8.78 | | | | |
| OVARC1000891 | 9.14 | 4.58 | 8.52 | 6.77 | 7.63 | 5.67 | 3.14 | 5.82 | 5.82 | | | | |
| OVARC1000897 | 1.42 | 0.51 | 0.89 | 0.57 | 0.73 | 1.37 | 0.82 | 2.14 | 2.14 | | | | |
| OVARC1000912 | 3.17 | 1.30 | 1.93 | 1.64 | 2.12 | 2.69 | 2.76 | 3.24 | 3.24 | | | | |
| OVARC1000914 | 1.78 | 1.84 | 1.59 | 1.55 | 2.20 | 2.36 | 1.62 | 3.25 | 3.25 | | | | |
| OVARC1000915 | 6.15 | 3.81 | 2.82 | 7.18 | 8.08 | 11.76 | 6.61 | 6.54 | 6.54 | | | | |
| OVARC1000916 | 3.99 | 3.47 | 3.85 | 4.78 | 5.13 | 5.34 | 5.36 | 5.24 | 5.24 | ** | + | ** | + |
| OVARC1000924 | 3.43 | 2.14 | 2.20 | 3.95 | 5.25 | 6.94 | 3.56 | 2.87 | 2.87 | * | + | | |
| OVARC1000928 | 2.3 | 1.45 | 1.90 | 2.94 | 5.21 | 2.82 | 3.59 | 4.30 | 4.3 | | | ** | + |
| OVARC1000936 | 2.24 | 1.71 | 1.41 | 6.64 | 6.60 | 5.33 | 2.20 | 4.51 | 4.51 | ** | + | | |
| OVARC1000937 | 4.37 | 3.36 | 3.65 | 4.37 | 4.24 | 5.18 | 4.25 | 6.07 | 6.07 | | | | |
| OVARC1000945 | 6.45 | 6.49 | 5.55 | 5.48 | 7.78 | 7.98 | 6.71 | 7.64 | 7.64 | | | | |
| OVARC1000948 | 0.7 | 1.14 | 1.80 | 0.8 | 1.44 | 1.73 | 1.79 | 1.83 | 1.83 | | | | |
| OVARC1000956 | 4.51 | 3.81 | 4.84 | 5.21 | 4.57 | 6.49 | 5.02 | 4.22 | 4.22 | | | | |
| OVARC1000959 | 3.91 | 3.29 | 2.51 | 6.03 | 6.37 | 10.71 | 4.34 | 3.63 | 3.63 | * | + | | |
| OVARC1000960 | 15.58 | 12.49 | 8.74 | 25.21 | 26.65 | 32.56 | 13.09 | 13.48 | 13.48 | ** | + | | |
| OVARC1000964 | 7.4 | 4.78 | 4.49 | 6.36 | 5.85 | 5.60 | 6.26 | 4.60 | 4.6 | | | | |
| OVARC1000971 | 2.15 | 0.88 | 1.23 | 2.29 | 3.01 | 2.68 | 1.01 | 1.16 | 1.16 | * | + | | |
| OVARC1000975 | 3.59 | 2.39 | 2.50 | 3.12 | 3.77 | 3.56 | 3.45 | 3.78 | 3.78 | | | | |
| OVARC1000976 | 1.43 | 1.10 | 0.67 | 1.47 | 1.70 | 1.61 | 1.96 | 1.76 | 1.76 | | | * | + |
| OVARC1000981 | 4.17 | 3.59 | 2.08 | 3.86 | 4.73 | 5.67 | 6.53 | 5.87 | 5.87 | | | * | + |
| OVARC1000982 | 5.28 | 3.08 | 4.53 | 3.99 | 3.64 | 7.26 | 3.94 | 5.23 | 5.23 | | | | |
| OVARC1000984 | 2.89 | 2.32 | 3.02 | 4.83 | 4.31 | 6.06 | 3.98 | 4.72 | 4.72 | * | + | ** | + |
| OVARC1000995 | 6.28 | 3.58 | 3.62 | 10.03 | 11.01 | 12.54 | 6.34 | 8.81 | 8.81 | ** | + | * | + |
| OVARC1000996 | 2.44 | 0.93 | 1.29 | 3.23 | 3.01 | 2.60 | 1.59 | 2.15 | 2.15 | * | + | | |
| OVARC1000999 | 13.81 | 7.04 | 7.16 | 18.71 | 16.83 | 17.82 | 9.89 | 10.20 | 10.2 | * | + | | |

TABLE 288

| | | | | | | | | | | | | | |
|---|---|---|---|---|---|---|---|---|---|---|---|---|---|
| OVARC1001000 | 10.01 | 7.69 | 7.61 | 19.45 | 23.56 | 18.96 | 10.07 | 11.74 | 11.74 | ** | + | * | + |
| OVARC1001004 | 1.03 | 0.80 | 0.91 | 1.57 | 2.14 | 1.61 | 1.90 | 1.48 | 1.48 | * | + | * | + |
| OVARC1001010 | 1.8 | 1.08 | 0.56 | 1.62 | 1.36 | 2.03 | 1.35 | 1.40 | 1.4 | | | | |
| OVARC1001011 | 3.43 | 2.88 | 3.13 | 3.51 | 3.30 | 4.55 | 2.89 | 3.10 | 3.1 | | | | |
| OVARC1001030 | 38.32 | 24.93 | 30.71 | 46.79 | 41.55 | 50.96 | 53.76 | 59.72 | 59.72 | * | + | ** | + |
| OVARC1001032 | 1.55 | 1.32 | 1.67 | 3.18 | 2.58 | 2.77 | 2.83 | 1.37 | 1.37 | ** | + | | |
| OVARC1001034 | 2.4 | 1.70 | 2.13 | 3.14 | 3.10 | 3.44 | 2.01 | 2.66 | 2.66 | ** | + | | |

TABLE 288-continued

| | | | | | | | | | | | | |
|---|---|---|---|---|---|---|---|---|---|---|---|---|
| OVARC1001038 | 12.68 | 9.34 | 7.92 | 11.12 | 13.30 | 12.41 | 6.75 | 6.49 | 6.49 | | | |
| OVARC1001040 | 8.91 | 6.59 | 4.66 | 14.02 | 14.04 | 19.13 | 7.93 | 7.81 | 7.81 | * | + | |
| OVARC1001041 | 6.31 | 3.56 | 4.31 | 8.16 | 10.01 | 10.61 | 5.62 | 4.95 | 4.95 | * | + | |
| OVARC1001044 | 1.81 | 1.80 | 2.22 | 2.71 | 2.48 | 2.79 | 2.22 | 2.94 | 2.94 | * | + | |
| OVARC1001049 | 9.39 | 8.47 | 8.39 | 15.62 | 16.10 | 16.18 | 9.93 | 8.69 | 8.69 | ** | + | |
| OVARC1001051 | 57.5 | 54.01 | 57.15 | 51.44 | 56.52 | 72.78 | 36.05 | 33.73 | 33.73 | | ** | − |
| OVARC1001054 | 1.32 | 1.27 | 1.50 | 2.46 | 1.80 | 2.94 | 1.81 | 1.58 | 1.58 | * | + | * | + |
| OVARC1001055 | 3.77 | 1.65 | 2.45 | 4.24 | 4.50 | 2.62 | 2.94 | 3.56 | 3.56 | | | |
| OVARC1001062 | 11.74 | 5.75 | 4.85 | 11.81 | 10.68 | 10.78 | 3.12 | 5.25 | 5.25 | | | |
| OVARC1001065 | 1.99 | 1.18 | 1.96 | 2.64 | 2.00 | 1.58 | 1.32 | 1.86 | 1.86 | | | |
| OVARC1001068 | 6.51 | 2.07 | 3.30 | 4.91 | 4.25 | 4.95 | 3.64 | 6.26 | 6.26 | | | |
| OVARC1001072 | 9.32 | 6.54 | 7.65 | 10.21 | 8.94 | 9.18 | 6.17 | 9.88 | 9.88 | | | |
| OVARC1001073 | 3.46 | 0.94 | 2.36 | 3.97 | 3.24 | 3.42 | 2.17 | 2.06 | 2.06 | | | |
| OVARC1001074 | 1.75 | 0.40 | 1.35 | 1.71 | 2.05 | 2.60 | 0.86 | 1.25 | 1.25 | | | |
| OVARC1001078 | 7.1 | 3.90 | 5.62 | 11.77 | 8.65 | 7.84 | 4.87 | 6.07 | 6.07 | | | |
| OVARC1001085 | 5.2 | 2.42 | 3.41 | 5.59 | 4.12 | 3.31 | 4.28 | 6.32 | 6.32 | | | |
| OVARC1001086 | 5.76 | 2.45 | 2.47 | 3.85 | 5.26 | 3.78 | 2.15 | 3.47 | 3.47 | | | |
| OVARC1001091 | 3.91 | 3.54 | 2.95 | 5.93 | 5.39 | 4.15 | 4.20 | 3.41 | 3.41 | * | + | |
| OVARC1001092 | 4.33 | 2.96 | 3.51 | 6.04 | 6.34 | 5.50 | 3.69 | 5.56 | 5.56 | ** | + | |
| OVARC1001104 | 1.53 | 0.53 | 0.40 | 1.32 | 1.57 | 1.20 | 0.63 | 1.14 | 1.14 | | | |
| OVARC1001107 | 9.82 | 5.46 | 6.15 | 6.8 | 4.45 | 8.10 | 6.28 | 6.79 | 6.79 | | | |
| OVARC1001113 | 4.68 | 3.14 | 2.92 | 4.82 | 4.00 | 4.79 | 2.64 | 3.74 | 3.74 | | | |
| OVARC1001117 | 6.69 | 2.96 | 3.38 | 8.53 | 8.56 | 12.29 | 4.84 | 6.35 | 6.35 | * | + | |
| OVARC1001118 | 8.12 | 5.06 | 4.70 | 11.61 | 11.15 | 10.02 | 5.36 | 7.35 | 7.35 | * | + | |
| OVARC1001125 | 18.96 | 12.37 | 9.61 | 15.08 | 18.61 | 12.67 | 4.50 | 5.26 | 5.26 | | * | − |
| OVARC1001129 | 5.21 | 3.98 | 5.45 | 6.68 | 4.55 | 3.29 | 2.17 | 3.47 | 3.47 | | * | − |
| OVARC1001132 | 6.52 | 3.70 | 5.55 | 7.12 | 8.81 | 9.06 | 2.18 | 2.72 | 2.72 | * | + | * | − |
| OVARC1001138 | 16.11 | 12.56 | 10.50 | 16.95 | 13.15 | 17.48 | 16.11 | 18.55 | 18.55 | | | |
| OVARC1001141 | 5.54 | 2.36 | 3.55 | 4.59 | 3.46 | 4.09 | 3.37 | 5.02 | 5.02 | | | |
| OVARC1001154 | 5.08 | 2.38 | 3.52 | 7.23 | 5.71 | 6.41 | 6.14 | 7.71 | 7.71 | * | + | * | + |
| OVARC1001161 | 5.7 | 2.64 | 4.14 | 8.62 | 7.37 | 7.00 | 3.80 | 4.51 | 4.51 | * | + | |
| OVARC1001162 | 7.21 | 3.90 | 4.19 | 8.88 | 8.61 | 6.05 | 4.92 | 4.79 | 4.79 | | | |
| OVARC1001163 | 8.43 | 4.40 | 4.84 | 6.45 | 6.12 | 5.05 | 5.16 | 8.27 | 8.27 | | | |
| OVARC1001167 | 6.39 | 2.75 | 3.96 | 9.57 | 10.93 | 6.52 | 6.33 | 5.84 | 5.84 | | | |
| OVARC1001169 | 2.12 | 0.82 | 1.00 | 1.91 | 2.68 | 3.48 | 1.25 | 1.14 | 1.14 | | | |
| OVARC1001170 | 5.03 | 2.13 | 3.01 | 9.37 | 9.52 | 8.69 | 6.25 | 6.17 | 6.17 | ** | + | * | + |
| OVARC1001171 | 13.87 | 7.94 | 9.22 | 17.9 | 10.0 | 17.22 | 8.13 | 7.41 | 7.41 | | | |
| OVARC1001173 | 6.07 | 4.57 | 5.00 | 13.94 | 11.16 | 14.09 | 6.22 | 8.18 | 8.18 | ** | + | * | + |
| OVARC1001176 | 120.6 | 80.54 | 85.77 | 70.13 | 72.81 | 62.53 | 40.27 | 47.98 | 47.98 | | * | − |
| OVARC1001180 | 11.62 | 7.41 | 6.61 | 16.44 | 18.19 | 11.30 | 11.76 | 9.48 | 9.48 | | | |
| OVARC1001188 | 6.48 | 2.62 | 2.03 | 5.02 | 7.63 | 5.54 | 3.93 | 4.15 | 4.15 | | | |
| OVARC1001200 | 2.22 | 1.30 | 1.20 | 5.74 | 5.77 | 3.98 | 2.73 | 3.72 | 3.72 | ** | + | * | + |
| OVARC1001202 | 7.54 | 4.54 | 7.94 | 10.59 | 9.48 | 9.04 | 5.59 | 7.44 | 7.44 | | | |
| OVARC1001206 | 4.56 | 1.77 | 2.35 | 5.27 | 2.32 | 4.40 | 4.18 | 3.01 | 3.01 | | | |
| OVARC1001209 | 5.41 | 4.08 | 4.25 | 4.84 | 4.05 | 4.40 | 5.08 | 5.10 | 5.1 | | | |
| OVARC1001219 | 2.78 | 1.08 | 2.61 | 2.53 | 1.72 | 2.02 | 0.89 | 2.02 | 2.02 | | | |
| OVARC1001222 | 2.69 | 0.99 | 2.05 | 4.33 | 4.36 | 2.81 | 4.34 | 4.56 | 4.56 | | ** | + |
| OVARC1001232 | 6.79 | 3.23 | 4.22 | 10.1 | 7.69 | 5.83 | 3.19 | 6.06 | 6.06 | | | |
| OVARC1001240 | 5.42 | 2.74 | 3.04 | 7.44 | 8.60 | 6.15 | 4.85 | 5.14 | 5.14 | * | + | |

TABLE 289

| | | | | | | | | | | | | |
|---|---|---|---|---|---|---|---|---|---|---|---|---|
| OVARC1001243 | 1.72 | 1.35 | 1.37 | 1.54 | 2.52 | 1.73 | 1.36 | 2.41 | 2.41 | | | |
| OVARC1001244 | 24.7 | 9.04 | 13.89 | 22.81 | 23.41 | 15.18 | 12.84 | 15.77 | 15.77 | | | |
| OVARC1001246 | 40.74 | 22.08 | 30.73 | 92.94 | 72.86 | 54.67 | 53.93 | 71.88 | 71.88 | * | + | * | + |
| OVARC1001247 | 8.36 | 4.54 | 5.70 | 8.31 | 7.58 | 6.86 | 6.44 | 6.70 | 6.7 | | | |
| OVARC1001260 | 5.56 | 1.98 | 3.43 | 3.72 | 4.11 | 5.56 | 3.81 | 5.29 | 5.29 | | | |
| OVARC1001261 | 7.49 | 5.34 | 5.88 | 8.27 | 8.14 | 6.50 | 4.18 | 3.66 | 3.66 | | * | − |
| OVARC1001268 | 9.66 | 6.34 | 6.78 | 20.35 | 19.09 | 14.70 | 18.61 | 12.90 | 12.9 | ** | + | * | + |
| OVARC1001270 | 2.46 | 0.92 | 1.16 | 1.01 | 0.99 | 1.69 | 1.24 | 1.98 | 1.98 | | | |
| OVARC1001271 | 7.39 | 3.05 | 5.29 | 8.27 | 10.72 | 9.05 | 7.37 | 6.66 | 6.66 | * | + | |
| OVARC1001282 | 1.01 | 0.92 | 0.97 | 0.97 | 2.26 | 1.76 | 1.02 | 2.02 | 2.02 | | | |
| OVARC1001296 | 2.46 | 1.56 | 1.43 | 2.56 | 2.90 | 3.81 | 2.32 | 2.50 | 2.5 | | | |
| OVARC1001306 | 7.3 | 3.30 | 5.02 | 6.03 | 4.37 | 5.50 | 5.45 | 6.39 | 6.39 | | | |
| OVARC1001314 | 0.91 | 0.46 | 0.79 | 1.37 | 1.95 | 2.32 | 1.59 | 1.62 | 1.62 | * | + | ** | + |
| OVARC1001316 | 1.39 | 0.64 | 0.79 | 0.83 | 1.74 | 1.83 | 1.60 | 1.04 | 1.04 | | | |
| OVARC1001329 | 14.48 | 8.75 | 10.68 | 26.47 | 22.48 | 16.87 | 10.91 | 14.31 | 14.31 | * | + | |
| OVARC1001330 | 5.69 | 3.01 | 1.92 | 3.71 | 3.31 | 3.24 | 2.35 | 2.85 | 2.85 | | | |
| OVARC1001336 | 5.35 | 4.02 | 3.78 | 4.8 | 5.04 | 6.17 | 4.16 | 5.22 | 5.22 | | | |
| OVARC1001338 | 3 | 2.42 | 3.08 | 2.63 | 3.26 | 3.21 | 2.60 | 4.03 | 4.03 | | | |
| OVARC1001339 | 18.39 | 11.67 | 11.13 | 15.76 | 12.03 | 15.86 | 13.83 | 17.02 | 17.02 | | | |
| OVARC1001340 | 3.7 | 2.44 | 2.40 | 2.48 | 2.50 | 2.72 | 1.64 | 1.40 | 1.4 | | * | − |
| OVARC1001341 | 9.61 | 7.33 | 5.62 | 10.7 | 12.45 | 13.37 | 7.41 | 10.65 | 10.65 | * | + | |
| OVARC1001342 | 133.57 | 112.33 | 102.75 | 148.81 | 134.63 | 172.83 | 71.00 | 44.68 | 44.68 | | ** | − |
| OVARC1001344 | 7.19 | 4.91 | 4.20 | 12.04 | 11.73 | 10.02 | 5.70 | 6.29 | 6.29 | ** | + | |
| OVARC1001357 | 1.77 | 0.51 | 0.85 | 0.71 | 1.22 | 1.30 | 1.05 | 2.71 | 2.71 | | | |

TABLE 289-continued

| | | | | | | | | | | | | | |
|---|---|---|---|---|---|---|---|---|---|---|---|---|---|
| OVARC1001359 | 12.91 | 9.14 | 12.19 | 10.45 | 11.07 | 11.24 | 11.72 | 11.75 | 11.75 | | | | |
| OVARC1001360 | 1.13 | 0.79 | 1.43 | 0.68 | 1.47 | 0.77 | 1.27 | 2.96 | 2.96 | | | | |
| OVARC1001369 | 3.18 | 3.27 | 2.79 | 3.55 | 2.73 | 3.58 | 3.69 | 3.39 | 3.39 | | | | |
| OVARC1001372 | 2.77 | 2.30 | 1.69 | 2.23 | 2.48 | 3.94 | 3.04 | 2.69 | 2.69 | | | | |
| OVARC1001376 | 2.87 | 2.00 | 1.97 | 5.27 | 5.80 | 7.45 | 3.84 | 3.47 | 3.47 | ** | + | * | + |
| OVARC1001381 | 9.02 | 7.72 | 5.78 | 16.38 | 17.31 | 19.84 | 9.24 | 7.41 | 7.41 | ** | + | | |
| OVARC1001391 | 4.51 | 2.73 | 2.85 | 3.51 | 4.11 | 3.13 | 3.49 | 3.91 | 3.91 | | | | |
| OVARC1001392 | 8.74 | 6.58 | 5.89 | 10.76 | 13.40 | 11.71 | 12.35 | 14.18 | 14.18 | * | + | ** | + |
| OVARC1001399 | 8.85 | 5.58 | 4.72 | 7.92 | 8.25 | 8.82 | 4.81 | 5.40 | 5.4 | | | | |
| OVARC1001417 | 2.7 | 1.43 | 2.23 | 1.21 | 1.52 | 2.52 | 2.51 | 2.99 | 2.99 | | | | |
| OVARC1001419 | 4.3 | 5.24 | 4.00 | 3.68 | 3.86 | 6.94 | 5.84 | 6.00 | 6 | | | * | + |
| OVARC1001425 | 2.29 | 2.40 | 2.49 | 3.29 | 2.74 | 4.54 | 3.29 | 3.09 | 3.09 | | | ** | + |
| OVARC1001436 | 2.31 | 2.50 | 1.77 | 3.81 | 3.30 | 4.11 | 3.38 | 2.41 | 2.41 | ** | + | | |
| OVARC1001442 | 3.28 | 3.48 | 2.35 | 2.21 | 3.99 | 4.48 | 3.98 | 3.31 | 3.31 | | | | |
| OVARC1001451 | 2.33 | 1.90 | 1.35 | 3.6 | 3.77 | 3.76 | 1.55 | 1.55 | 1.55 | ** | + | | |
| OVARC1001452 | 3.08 | 2.65 | 1.79 | 3.37 | 3.43 | 2.89 | 2.90 | 3.86 | 3.86 | | | | |
| OVARC1001453 | 1.36 | 0.57 | 0.90 | 1.69 | 3.97 | 2.45 | 2.96 | 1.73 | 1.73 | | | | |
| OVARC1001476 | 9.08 | 6.86 | 7.98 | 15.11 | 12.70 | 14.85 | 28.29 | 23.49 | 23.49 | ** | + | ** | + |
| OVARC1001480 | 2.63 | 2.84 | 2.87 | 3.18 | 2.98 | 4.97 | 4.13 | 4.00 | 4 | | | ** | + |
| OVARC1001489 | 0.44 | 0.69 | 0.81 | 2.69 | 2.29 | 3.27 | 1.10 | 4.03 | 4.03 | ** | + | | |
| OVARC1001493 | 1.25 | 1.74 | 1.87 | 2.29 | 2.11 | 2.40 | 3.16 | 2.54 | 2.54 | * | + | * | + |
| OVARC1001496 | 8.58 | 6.56 | 5.62 | 10.89 | 7.25 | 13.93 | 7.36 | 6.38 | 6.38 | | | | |
| OVARC1001499 | 2.77 | 1.81 | 1.79 | 9.3 | 11.43 | 8.77 | 4.71 | 4.12 | 4.12 | ** | + | ** | + |
| OVARC1001506 | 6.8 | 3.72 | 2.93 | 7.69 | 8.55 | 5.52 | 2.68 | 3.49 | 3.49 | | | | |
| OVARC1001509 | 1.55 | 1.98 | 1.98 | 5.58 | 4.61 | 5.41 | 3.85 | 2.97 | 2.97 | ** | + | * | + |
| OVARC1001510 | 1.71 | 1.36 | 1.70 | 2.6 | 2.03 | 1.38 | 0.87 | 1.95 | 1.95 | | | | |
| OVARC1001516 | 4.33 | 2.50 | 2.28 | 4.35 | 4.41 | 5.42 | 3.48 | 4.66 | 4.66 | | | | |
| OVARC1001525 | 1.15 | 0.47 | 0.25 | 2.5 | 1.57 | 2.82 | 0.67 | 0.87 | 0.87 | * | + | | |
| OVARC1001542 | 5.12 | 4.17 | 4.21 | 9.27 | 7.88 | 7.75 | 6.26 | 7.55 | 7.55 | ** | + | ** | + |
| OVARC1001544 | 5.06 | 4.31 | 3.88 | 10.18 | 11.66 | 10.16 | 4.91 | 5.47 | 5.47 | ** | + | | |
| OVARC1001546 | 4.58 | 2.37 | 2.41 | 4.24 | 4.04 | 3.16 | 5.16 | 4.17 | 4.17 | | | | |
| OVARC1001547 | 3.14 | 1.52 | 1.67 | 3.77 | 5.22 | 4.03 | 1.93 | 2.91 | 2.91 | * | + | | |

TABLE 290

| | | | | | | | | | | | | | |
|---|---|---|---|---|---|---|---|---|---|---|---|---|---|
| OVARC1001555 | 6.13 | 2.98 | 2.93 | 3.66 | 4.13 | 4.35 | 3.24 | 3.51 | 3.51 | | | | |
| OVARC1001560 | 5.27 | 2.89 | 4.00 | 3.57 | 5.47 | 3.00 | 1.86 | 5.44 | 5.44 | | | | |
| OVARC1001569 | 4.31 | 1.79 | 2.67 | 5.77 | 3.68 | 6.02 | 3.66 | 4.73 | 4.73 | | | | |
| OVARC1001570 | 3.15 | 1.30 | 2.66 | 3.39 | 3.35 | 3.15 | 3.14 | 2.39 | 2.39 | | | | |
| OVARC1001577 | 4.77 | 2.77 | 4.00 | 5.05 | 6.04 | 4.74 | 3.79 | 3.40 | 3.4 | | | | |
| OVARC1001578 | 0.13 | 0.13 | 0.49 | 0.11 | 0.08 | 0.34 | (0.16) | 0.33 | 0.33 | | | | |
| OVARC1001596 | 6.65 | 4.15 | 4.07 | 12.92 | 13.04 | 11.27 | 13.75 | 17.88 | 17.88 | ** | + | ** | + |
| OVARC1001600 | 4.44 | 1.10 | 1.82 | 4.64 | 5.45 | 5.21 | 2.46 | 3.26 | 3.26 | | | | |
| OVARC1001607 | 3.4 | 1.49 | 1.81 | 4.77 | 3.07 | 3.12 | 3.27 | 4.29 | 4.29 | | | | |
| OVARC1001610 | 1.98 | 0.84 | 1.36 | 1.63 | 3.05 | 2.07 | 1.29 | 1.68 | 1.68 | | | | |
| OVARC1001611 | 2.19 | 0.50 | 1.35 | 1.78 | 1.02 | 1.32 | 1.66 | 1.19 | 1.19 | | | | |
| OVARC1001615 | 4.22 | 1.84 | 2.90 | 5.28 | 3.15 | 3.01 | 2.44 | 2.96 | 2.96 | | | | |
| OVARC1001636 | 1.51 | 1.25 | 1.84 | 2.49 | 2.09 | 2.98 | 2.73 | 3.68 | 3.68 | * | + | ** | + |
| OVARC1001668 | 12.16 | 5.32 | 7.43 | 18.64 | 16.53 | 18.49 | 8.30 | 9.71 | 9.71 | * | + | | |
| OVARC1001702 | 8.57 | 3.96 | 3.47 | 6.26 | 5.42 | 3.41 | 3.42 | 6.27 | 6.27 | | | | |
| OVARC1001703 | 3.45 | 1.33 | 2.17 | 2.9 | 2.76 | 1.60 | 1.67 | 2.48 | 2.48 | | | | |
| OVARC1001710 | 12.16 | 6.40 | 8.14 | 12.51 | 12.10 | 10.06 | 5.91 | 10.48 | 10.48 | | | | |
| OVARC1001711 | 3.85 | 1.19 | 3.00 | 4.46 | 4.77 | 3.21 | 3.17 | 3.47 | 3.47 | | | | |
| OVARC1001713 | 3.83 | 1.81 | 3.06 | 4 | 3.01 | 2.37 | 3.41 | 2.97 | 2.97 | | | | |
| OVARC1001725 | 1.76 | 0.84 | 1.52 | 1.59 | 1.72 | 1.08 | 1.90 | 2.27 | 2.27 | | | | |
| OVARC1001726 | 5.39 | 1.55 | 3.13 | 5.82 | 3.63 | 5.08 | 3.26 | 3.16 | 3.16 | | | | |
| OVARC1001727 | 0.29 | 0.42 | 1.02 | 0.81 | 1.66 | 2.65 | 0.38 | 0.85 | 0.85 | | | | |
| OVARC1001731 | 69.09 | 38.65 | 38.62 | 61.15 | 63.80 | 29.40 | 50.44 | 54.36 | 54.36 | | | | |
| OVARC1001735 | 3.44 | 1.71 | 2.00 | 2.93 | 3.19 | 1.89 | 1.63 | 2.09 | 2.09 | | | | |
| OVARC1001741 | 5.73 | 2.80 | 4.04 | 7.5 | 7.39 | 7.90 | 7.54 | 6.67 | 6.67 | * | + | * | + |
| OVARC1001745 | 7.24 | 4.36 | 4.49 | 8.97 | 10.22 | 8.41 | 6.60 | 5.98 | 5.98 | * | + | | |
| OVARC1001759 | 1.01 | 0.86 | 1.04 | 1.08 | 1.84 | 2.94 | 2.19 | 2.25 | 2.25 | | | ** | + |
| OVARC1001762 | 8.58 | 3.74 | 6.34 | 5.15 | 5.47 | 7.03 | 4.95 | 5.82 | 5.82 | | | | |
| OVARC1001766 | 9.38 | 4.99 | 6.59 | 7.66 | 8.01 | 9.59 | 6.94 | 8.67 | 8.67 | | | | |
| OVARC1001767 | 3.53 | 1.57 | 1.68 | 5.51 | 3.61 | 4.66 | 1.50 | 1.77 | 1.77 | * | + | | |
| OVARC1001768 | 2.87 | 1.10 | 1.41 | 3.92 | 5.14 | 2.20 | 2.97 | 2.24 | 2.24 | | | | |
| OVARC1001770 | 8.73 | 3.17 | 3.93 | 4.79 | 3.74 | 3.92 | 3.08 | 5.26 | 5.26 | | | | |
| OVARC1001776 | 9.28 | 3.35 | 3.86 | 7.43 | 6.75 | 3.40 | 4.83 | 5.46 | 5.46 | | | | |
| OVARC1001791 | 6.37 | 2.23 | 2.37 | 4.77 | 4.93 | 3.53 | 3.51 | 5.12 | 5.12 | | | | |
| OVARC1001795 | 3.33 | 1.66 | 2.08 | 3.57 | 2.56 | 3.39 | 2.70 | 4.38 | 4.38 | | | | |
| OVARC1001798 | 7.18 | 6.07 | 6.66 | 13.95 | 10.63 | 12.79 | 7.22 | 8.63 | 8.63 | ** | + | | |
| OVARC1001802 | 9.19 | 4.54 | 5.70 | 10.35 | 10.30 | 12.39 | 7.34 | 10.40 | 10.4 | * | + | | |
| OVARC1001805 | 4.64 | 2.74 | 4.36 | 2.74 | 2.72 | 4.62 | 3.49 | 2.65 | 2.65 | | | | |
| OVARC1001807 | 8.77 | 5.93 | 4.12 | 6.55 | 5.33 | 4.82 | 5.91 | 7.39 | 7.39 | | | | |
| OVARC1001809 | 6.83 | 4.86 | 4.27 | 6.09 | 6.40 | 3.73 | 5.14 | 5.48 | 5.48 | | | | |
| OVARC1001812 | 4.12 | 3.13 | 3.09 | 7.67 | 7.95 | 5.93 | 3.66 | 6.68 | 6.68 | ** | + | | |

TABLE 290-continued

| | | | | | | | | | | | | |
|---|---|---|---|---|---|---|---|---|---|---|---|---|
| OVARC1001813 | 5.43 | 3.76 | 2.36 | 6.97 | 8.29 | 5.75 | 4.00 | 5.14 | 5.14 | | | |
| OVARC1001820 | 5.44 | 2.59 | 2.92 | 7.68 | 8.81 | 9.74 | 4.50 | 3.53 | 3.53 | ** | + | |
| OVARC1001828 | 1.52 | 0.56 | 0.82 | 0.49 | 1.38 | 1.06 | 0.77 | 2.57 | 2.57 | | | |
| OVARC1001833 | 6.47 | 2.16 | 4.12 | 4.91 | 4.44 | 4.92 | 4.40 | 5.06 | 5.06 | | | |
| OVARC1001839 | 3.71 | 1.97 | 2.01 | 2.39 | 2.11 | 1.77 | 2.84 | 1.57 | 1.57 | | | |
| OVARC1001846 | 4.41 | 2.73 | 3.00 | 4.53 | 4.51 | 2.44 | 2.43 | 1.95 | 1.95 | | | |
| OVARC1001849 | 7.54 | 4.93 | 4.04 | 7.29 | 7.04 | 10.00 | 6.63 | 6.98 | 6.98 | | | |
| OVARC1001861 | 6.18 | 3.30 | 3.37 | 5.23 | 6.05 | 5.82 | 6.62 | 5.17 | 5.17 | | | |
| OVARC1001873 | 2.23 | 3.58 | 2.82 | 5.06 | 4.34 | 4.98 | 4.48 | 5.41 | 5.41 | * | + | * | + |
| OVARC1001879 | 6.45 | 3.48 | 3.55 | 6.19 | 6.28 | 6.46 | 4.62 | 5.20 | 5.2 | | | |
| OVARC1001880 | 8.1 | 5.60 | 6.83 | 9.11 | 8.57 | 12.18 | 8.27 | 7.92 | 7.92 | | | |
| OVARC1001883 | 2.85 | 1.41 | 1.74 | 4.9 | 4.51 | 4.19 | 2.29 | 2.05 | 2.05 | ** | + | |
| OVARC1001900 | 4.98 | 3.20 | 2.77 | 3.89 | 3.38 | 3.75 | 3.72 | 2.89 | 2.89 | | | |
| OVARC1001901 | 4.87 | 3.60 | 3.92 | 3.84 | 3.21 | 3.00 | 1.68 | 3.04 | 3.04 | | | |
| OVARC1001911 | 6 | 4.01 | 3.43 | 3.55 | 3.02 | 2.97 | 2.70 | 4.72 | 4.72 | | | |

TABLE 291

| | | | | | | | | | | | | |
|---|---|---|---|---|---|---|---|---|---|---|---|---|
| OVARC1001916 | 6.98 | 5.21 | 4.19 | 6.6 | 6.42 | 9.56 | 6.23 | 7.95 | 7.95 | | | |
| OVARC1001928 | 2.06 | 0.85 | 1.79 | 2.38 | 2.75 | 2.84 | 3.26 | 4.05 | 4.05 | | | ** | + |
| OVARC1001937 | 3.08 | 3.56 | 3.08 | 6.71 | 6.67 | 8.66 | 8.49 | 10.57 | 10.57 | ** | + | ** | + |
| OVARC1001940 | 2.73 | 1.83 | 2.29 | 2.9 | 3.41 | 3.46 | 2.76 | 3.64 | 3.64 | * | + | |
| OVARC1001942 | 7.33 | 6.50 | 6.76 | 5.22 | 5.72 | 6.21 | 4.66 | 4.79 | 4.79 | * | − | ** | − |
| OVARC1001943 | 10.42 | 8.83 | 6.98 | 5.68 | 5.59 | 6.08 | 6.06 | 4.31 | 4.31 | * | − | * | − |
| OVARC1001949 | 10.36 | 7.25 | 8.90 | 17.76 | 16.95 | 14.34 | 7.64 | 7.78 | 7.78 | ** | + | |
| OVARC1001950 | 6.51 | 3.98 | 3.61 | 6.85 | 7.18 | 5.80 | 4.70 | 6.17 | 6.17 | | | |
| OVARC1001952 | 8.93 | 7.35 | 6.04 | 9.34 | 7.56 | 8.32 | 8.80 | 9.41 | 9.41 | | | |
| OVARC1001954 | 2.25 | 1.93 | 2.80 | 2.22 | 2.67 | 3.53 | 3.43 | 3.10 | 3.1 | | | * | + |
| OVARC1001963 | 4.35 | 4.65 | 3.70 | 6.06 | 6.92 | 7.14 | 5.20 | 5.61 | 5.61 | ** | + | * | + |
| OVARC1001983 | 14.69 | 9.15 | 11.07 | 15.77 | 13.57 | 18.65 | 18.62 | 19.08 | 19.08 | | | * | + |
| OVARC1001987 | 4.18 | 3.62 | 3.23 | 5.27 | 5.35 | 7.29 | 5.42 | 5.22 | 5.22 | * | + | ** | + |
| OVARC1001989 | 4.53 | 2.66 | 2.25 | 6.48 | 8.72 | 7.41 | 3.80 | 4.09 | 4.09 | * | + | |
| OVARC1001991 | 10.96 | 5.93 | 5.69 | 9.46 | 8.32 | 6.27 | 7.05 | 6.60 | 6.6 | | | |
| OVARC1002005 | 5.4 | 3.75 | 4.99 | 8.51 | 8.21 | 81.60 | 5.67 | 7.46 | 7.46 | ** | + | |
| OVARC1002044 | 5.75 | 6.74 | 4.12 | 8.85 | 9.04 | 10.30 | 6.19 | 6.78 | 6.78 | * | + | |
| OVARC1002046 | 11.4 | 8.29 | 10.75 | 14.32 | 15.39 | 13.03 | 16.29 | 16.11 | 16.11 | * | + | ** | + |
| OVARC1002050 | 7.01 | 4.34 | 4.11 | 5.04 | 4.91 | 6.69 | 6.80 | 8.61 | 8.61 | | | |
| OVARC1002058 | 2.46 | 2.25 | 3.14 | 3.04 | 3.77 | 4.08 | 4.59 | 3.85 | 3.85 | | | * | + |
| OVARC1002066 | 3.19 | 1.93 | 3.61 | 3.32 | 2.98 | 4.14 | 5.23 | 6.90 | 6.9 | | | * | + |
| OVARC1002082 | 4.87 | 5.01 | 3.84 | 11.38 | 12.17 | 13.39 | 6.27 | 6.19 | 6.19 | ** | + | * | + |
| OVARC1002091 | 9.15 | 5.09 | 5.80 | 7.51 | 5.64 | 6.50 | 4.50 | 6.13 | 6.13 | | | |
| OVARC1002092 | 1.08 | 0.92 | 1.01 | 1.95 | 2.31 | 1.47 | 1.26 | 2.01 | 2.01 | * | + | * | + |
| OVARC1002093 | 10.46 | 8.34 | 8.22 | 9.65 | 10.46 | 8.69 | 6.29 | 9.67 | 9.67 | | | |
| OVARC1002094 | 3.39 | 2.34 | 2.33 | 2.97 | 3.73 | 2.67 | 2.42 | 4.62 | 4.62 | | | |
| OVARC1002107 | 4.25 | 3.34 | 3.27 | 6.5 | 6.62 | 9.76 | 3.44 | 3.77 | 3.77 | * | + | |
| OVARC1002112 | 10.9 | 8.09 | 8.28 | 16.78 | 13.09 | 25.94 | 13.30 | 14.51 | 14.51 | | | ** | + |
| OVARC1002126 | 5.65 | 6.82 | 6.95 | 13.64 | 10.71 | 12.11 | 9.13 | 8.48 | 8.48 | ** | + | ** | + |
| OVARC1002127 | 2.58 | 2.03 | 3.02 | 3.02 | 3.11 | 2.31 | 3.36 | 3.37 | 3.37 | | | * | + |
| OVARC1002138 | 2.48 | 2.26 | 1.89 | 3.19 | 3.39 | 3.93 | 1.72 | 2.13 | 2.13 | ** | + | |
| OVARC1002143 | 1.69 | 1.30 | 0.60 | 1.38 | 1.56 | 1.86 | 1.19 | 0.95 | 0.95 | | | |
| OVARC1002156 | 1.66 | 0.93 | 0.95 | 1.52 | 1.87 | 1.95 | 2.12 | 1.74 | 1.74 | | | |
| OVARC1002158 | 2.7 | 2.62 | 1.87 | 2.12 | 2.65 | 2.44 | 2.26 | 2.68 | 2.68 | | | |
| OVARC1002165 | 7.2 | 5.63 | 4.73 | 11.72 | 8.43 | 11.59 | 6.50 | 7.88 | 7.88 | * | + | * | + |
| OVARC1002172 | 8 | 8.96 | 7.89 | 12.99 | 11.14 | 15.46 | 14.15 | 11.02 | 11.02 | * | + | * | + |
| OVARC1002178 | 1.22 | 1.02 | 1.19 | 6.91 | 5.74 | 6.72 | 4.31 | 4.39 | 4.39 | ** | + | ** | + |
| OVARC1002182 | 2.89 | 1.94 | 1.74 | 3.43 | 2.78 | 3.06 | 2.40 | 2.34 | 2.34 | | | |
| OVARC1002185 | 3.07 | 1.87 | 2.74 | 2.77 | 3.03 | 2.27 | 3.08 | 3.27 | 3.27 | | | |
| PLACE1000004 | 4.13 | 1.50 | 2.40 | 4.62 | 3.84 | 3.14 | 1.43 | 2.34 | 2.34 | | | |
| PLACE1000005 | 1.35 | 0.94 | 1.81 | 2.1 | 2.21 | 3.64 | 1.75 | 1.86 | 1.86 | | | |
| PIACE1000006 | 3.24 | 3.13 | 3.46 | 5.32 | 4.20 | 5.06 | 3.54 | 4.19 | 4.19 | * | + | * | + |
| PLACE1000007 | 3.52 | 1.48 | 1.95 | 2.76 | 2.50 | 3.15 | 1.95 | 2.86 | 2.86 | | | |
| PLACE1000014 | 4.25 | 3.03 | 3.71 | 8.86 | 8.24 | 8.01 | 5.81 | 6.21 | 6.21 | ** | + | ** | + |
| PLACE1000031 | 2.43 | 0.83 | 0.85 | 3.06 | 2.75 | 3.91 | 2.27 | 1.91 | 1.91 | * | + | |
| PLACE1000033 | 1.29 | 0.90 | 0.41 | 1.55 | 1.06 | 1.17 | 1.59 | 1.10 | 1.1 | | | |
| PLACE1000040 | 4.49 | 2.71 | 2.01 | 6.89 | 9.12 | 6.89 | 4.66 | 5.42 | 5.42 | * | + | |
| PLACE1000048 | 1.6 | 1.02 | 1.34 | 5.06 | 4.76 | 4.04 | 3.48 | 3.87 | 3.87 | ** | + | ** | + |
| PLACE1000050 | 5.68 | 3.49 | 4.13 | 5.18 | 4.97 | 6.58 | 3.56 | 3.95 | 3.95 | | | |
| PLACE1000061 | 158.3 | 101.17 | 90.85 | 157.97 | 122.81 | 120.53 | 58.82 | 94.38 | 94.38 | | | |
| PLACE1000066 | 24.72 | 10.40 | 14.31 | 13.08 | 14.83 | 12.97 | 11.89 | 17.52 | 17.52 | | | |
| PLACE1000075 | 3.77 | 2.50 | 2.49 | 11.38 | 15.88 | 19.81 | 6.47 | 10.82 | 10.82 | ** | + | * | + |
| PLACE1000078 | 3.4 | 1.72 | 2.20 | 4.82 | 4.89 | 6.42 | 2.94 | 3.88 | 3.88 | * | + | |
| PLACE1000081 | 10.27 | 4.42 | 4.34 | 7.73 | 8.15 | 4.92 | 5.06 | 4.85 | 4.85 | | | |
| PLACE1000086 | 7.07 | 5.86 | 4.84 | 7.21 | 7.07 | 4.90 | 5.17 | 6.83 | 6.83 | | | |
| PLACE1000094 | 3.81 | 2.40 | 2.03 | 2.26 | 2.48 | 2.45 | 2.38 | 2.04 | 2.04 | | | |

TABLE 292

| | | | | | | | | | | | | |
|---|---|---|---|---|---|---|---|---|---|---|---|---|
| PLACE1000101 | 2.3 | 2.12 | 2.61 | 4.62 | 5.45 | 5.31 | 2.54 | 3.96 | 3.96 | ** | + | |
| PLACE1000121 | 3.32 | 1.82 | 3.36 | 3.18 | 3.46 | 3.22 | 4.10 | 2.97 | 2.97 | | | |
| PLACE1000133 | 22.32 | 10.62 | 12.41 | 24.57 | 19.93 | 22.03 | 9.44 | 17.41 | 17.41 | | | |
| PLACE1000142 | 3.77 | 2.94 | 3.97 | 3.72 | 2.78 | 3.50 | 4.86 | 3.02 | 3.02 | | | |
| PLACE1000146 | 12.04 | 5.71 | 7.52 | 11.96 | 8.63 | 12.12 | 6.11 | 6.64 | 6.64 | | | |
| PLACE1000163 | 10.38 | 6.77 | 6.39 | 8.08 | 8.26 | 4.88 | 8.20 | 6.01 | 6.01 | | | |
| PLACE1000172 | 2.38 | 1.36 | 0.47 | 1.68 | 3.26 | 0.78 | 1.42 | 1.36 | 1.36 | | | |
| PLACE1000181 | 4.66 | 3.09 | 3.18 | 5.69 | 5.41 | 5.62 | 4.15 | 4.68 | 4.68 | * | + | |
| PLACE1000184 | 1.13 | 1.00 | 1.41 | 4.73 | 6.35 | 6.17 | 4.40 | 7.01 | 7.01 | ** | + | * | + |
| PLACE1000188 | 5.78 | 3.85 | 4.83 | 5.4 | 6.28 | 6.49 | 6.72 | 6.56 | 6.56 | | | * | + |
| PLACE1000198 | 3.55 | 2.09 | 2.55 | 2.87 | 3.21 | 4.22 | 3.14 | 3.19 | 3.19 | | | |
| PLACE1000213 | 2.64 | 0.86 | 1.73 | 2.98 | 2.54 | 2.75 | 2.24 | 2.31 | 2.31 | | | |
| PLACE1000214 | 5.38 | 1.32 | 2.03 | 4.15 | 4.37 | 5.82 | 3.05 | 3.50 | 3.5 | | | |
| PLACE1000220 | 5.9 | 3.44 | 1.89 | 3.73 | 2.84 | 3.93 | 2.23 | 3.16 | 3.16 | | | |
| PLACE1000231 | 18.42 | 11.77 | 9.30 | 14.94 | 14.15 | 14.87 | 11.91 | 14.48 | 14.48 | | | |
| PLACE1000236 | 5.6 | 2.94 | 3.19 | 6.04 | 6.27 | 4.87 | 5.66 | 5.87 | 5.87 | | | |
| PLACE1000245 | 7.5 | 5.11 | 6.34 | 10.03 | 9.79 | 11.42 | 4.16 | 7.99 | 7.99 | ** | + | |
| PLACE1000246 | 5.62 | 3.38 | 4.68 | 6.48 | 8.30 | 6.53 | 8.63 | 9.43 | 9.43 | * | + | ** | + |
| PLACE1000258 | 15.61 | 9.21 | 10.26 | 23.89 | 20.68 | 20.66 | 9.91 | 13.07 | 13.07 | * | + | |
| PLACE1000288 | 2.41 | 2.18 | 2.21 | 2.88 | 1.68 | 2.31 | 2.41 | 3.07 | 3.07 | | | |
| PLACE1000292 | 5.99 | 4.40 | 5.17 | 20.8 | 17.62 | 19.45 | 12.37 | 20.25 | 20.25 | ** | + | ** | + |
| PLACE1000302 | 1.46 | 1.42 | 1.22 | 6.15 | 8.89 | 5.78 | 5.17 | 5.07 | 5.07 | ** | + | ** | + |
| PLACE1000304 | 4.47 | 1.71 | 1.91 | 3.89 | 2.76 | 3.12 | 2.80 | 2.80 | 2.8 | | | |
| PLACE1000308 | 4.91 | 2.41 | 1.59 | 3.39 | 5.24 | 3.59 | 2.01 | 2.78 | 2.78 | | | |
| PLACE1000309 | 11.75 | 7.68 | 5.52 | 7.14 | 11.13 | 6.51 | 7.34 | 11.09 | 11.09 | | | |
| PLACE1000312 | 4.15 | 1.12 | 1.95 | 3.37 | 3.51 | 3.75 | 2.70 | 2.85 | 2.85 | | | |
| PLACE1000330 | 2.07 | 1.35 | 1.92 | 2.05 | 1.50 | 2.72 | 2.22 | 2.82 | 2.82 | | | * | + |
| PLACE1000332 | 0.54 | 0.37 | 0.59 | 1.08 | 1.22 | 2.14 | 1.43 | 1.37 | 1.37 | * | + | ** | + |
| PLACE1000347 | 3.56 | 1.98 | 2.82 | 5.26 | 6.11 | 4.66 | 4.59 | 5.16 | 5.16 | * | + | * | + |
| PLACE1000351 | 5.67 | 4.34 | 5.42 | 8.3 | 7.13 | 5.49 | 4.92 | 6.31 | 6.31 | | | |
| PLACE1000374 | 9.15 | 6.32 | 6.28 | 12.33 | 8.13 | 8.69 | 5.60 | 5.63 | 5.63 | | | |
| PLACE1000380 | 8.21 | 2.59 | 3.63 | 4.88 | 6.57 | 5.07 | 4.83 | 5.60 | 5.6 | | | |
| PLACE1000383 | 3.43 | 2.31 | 1.31 | 2.37 | 3.17 | 2.14 | 2.59 | 1.96 | 1.96 | | | |
| PLACE1000397 | 4.72 | 2.15 | 2.60 | 3.29 | 2.51 | 3.41 | 2.52 | 3.33 | 3.33 | | | |
| PLACE1000401 | 8.18 | 4.62 | 4.15 | 5.55 | 6.29 | 6.94 | 5.61 | 6.88 | 6.88 | | | |
| PLACE1000406 | 5.56 | 3.08 | 2.60 | 5.54 | 5.34 | 5.46 | 3.82 | 3.45 | 3.45 | | | |
| PLACE1000412 | 3.31 | 2.01 | 1.64 | 4.18 | 4.67 | 3.93 | 2.55 | 2.54 | 2.54 | * | + | |
| PLACE1000420 | 10.38 | 5.91 | 5.93 | 8.64 | 10.82 | 10.12 | 5.86 | 5.89 | 5.89 | | | |
| PLACE1000421 | 3.59 | 3.04 | 2.31 | 4.45 | 4.08 | 3.36 | 2.89 | 3.75 | 3.75 | | | |
| PLACE1000423 | 2.95 | 2.15 | 1.93 | 20.49 | 20.83 | 20.84 | 13.81 | 14.04 | 14.04 | ** | + | ** | + |
| PLACE1000424 | 3 | 2.12 | 1.66 | 4.43 | 3.32 | 3.59 | 1.60 | 2.52 | 2.52 | * | + | |
| PLACE1000430 | 3.63 | 1.51 | 1.58 | 2.45 | 2.43 | 3.11 | 1.57 | 3.03 | 3.03 | | | |
| PLACE1000433 | 4.59 | 1.89 | 2.39 | 2.55 | 2.63 | 3.39 | 3.84 | 2.91 | 2.91 | | | |
| PLACE1000435 | 4.53 | 3.13 | 3.03 | 9.09 | 8.39 | 8.75 | 5.45 | 3.19 | 3.19 | ** | + | |
| PLACE1000437 | 2.55 | 2.34 | 2.51 | 7.65 | 7.02 | 9.50 | 7.52 | 8.64 | 8.64 | ** | + | ** | + |
| PLACE1000442 | 12.33 | 5.94 | 10.64 | 23.09 | 26.07 | 18.20 | 10.78 | 10.42 | 10.42 | * | + | |
| PLACE1000444 | 9.31 | 6.03 | 5.50 | 16.99 | 19.05 | 17.38 | 8.02 | 10.01 | 10.01 | ** | + | |
| PLACE1000453 | 6.66 | 4.29 | 5.00 | 7.58 | 6.74 | 7.37 | 6.15 | 9.05 | 9.05 | | | |
| PLACE1000456 | 4.25 | 3.10 | 2.24 | 3.67 | 3.13 | 4.02 | 3.33 | 4.78 | 4.78 | | | |
| PLACE1000465 | 5.73 | 3.62 | 3.38 | 4.99 | 3.38 | 5.47 | 5.67 | 4.76 | 4.76 | | | |
| PLACE1000481 | 5.42 | 4.28 | 5.17 | 5.8 | 8.48 | 10.90 | 5.11 | 5.58 | 5.58 | | | |
| PLACE1000492 | 4.42 | 2.55 | 3.57 | 3.46 | 5.78 | 6.28 | 4.30 | 4.90 | 4.9 | | | |
| PLACE1000508 | 4.11 | 1.53 | 2.58 | 3.28 | 3.70 | 3.99 | 2.37 | 3.96 | 3.96 | | | |
| PLACE1000512 | 5.22 | 2.40 | 1.36 | 6.14 | 5.78 | 4.97 | 4.87 | 4.74 | 4.74 | | | |
| PLACE1000540 | 2.6 | 2.41 | 1.99 | 4.78 | 4.15 | 4.34 | 1.97 | 1.70 | 1.7 | ** | + | |
| PLACE1000541 | 6.4 | 6.38 | 5.54 | 8.78 | 7.96 | 6.93 | 7.44 | 11.12 | 11.12 | * | + | * | + |

TABLE 293

| | | | | | | | | | | | | |
|---|---|---|---|---|---|---|---|---|---|---|---|---|
| PLACE1000546 | 3.29 | 1.94 | 2.26 | 2.05 | 2.11 | 2.19 | 2.74 | 2.01 | 2.01 | | | |
| PLACE1000547 | 5.79 | 5.41 | 5.37 | 8.99 | 6.38 | 9.62 | 5.74 | 8.94 | 8.94 | * | + | |
| PLACE1000560 | 3.31 | 3.53 | 2.48 | 3.26 | 3.84 | 4.27 | 3.25 | 2.77 | 2.77 | | | |
| PLACE1000562 | 5.48 | 3.54 | 4.16 | 6.47 | 7.13 | 6.86 | 5.29 | 6.77 | 6.77 | * | + | |
| PLACE1000564 | 2.28 | 2.89 | 3.32 | 2.89 | 4.25 | 5.04 | 4.28 | 3.71 | 3.71 | | | * | + |
| PLACE1000583 | 10.76 | 7.63 | 6.51 | 18.65 | 16.27 | 17.87 | 10.12 | 7.24 | 7.24 | ** | + | |
| PLACE1000587 | 7.2 | 4.11 | 4.88 | 9.4 | 11.04 | 9.29 | 6.85 | 6.39 | 6.39 | * | + | |
| PLACE1000588 | 7.89 | 4.98 | 4.13 | 9.54 | 8.74 | 6.18 | 7.91 | 6.38 | 6.38 | | | |
| PLACE1000596 | 7.64 | 7.46 | 10.08 | 8.78 | 8.56 | 8.98 | 4.59 | 7.82 | 7.82 | | | |
| PLACE1000599 | 5.52 | 4.56 | 3.15 | 8.04 | 7.54 | 8.14 | 4.12 | 5.23 | 5.23 | ** | + | |
| PLACE1000605 | 4.13 | 3.66 | 3.53 | 4.62 | 5.26 | 5.10 | 5.59 | 5.89 | 5.89 | ** | + | ** | + |
| PLACE1000610 | 3.95 | 3.19 | 2.63 | 4.04 | 4.12 | 4.83 | 3.09 | 3.87 | 3.87 | | | |
| PLACE1000611 | 1.33 | 4.36 | 3.21 | 2.64 | 5.18 | 3.62 | 3.25 | 4.05 | 4.05 | | | |
| PLACE1000626 | 3.93 | 3.49 | 2.73 | 5.31 | 3.91 | 4.11 | 4.05 | 3.66 | 3.66 | | | |
| PLACE1000633 | 2.72 | 3.21 | 2.28 | 6.49 | 6.56 | 3.99 | 3.45 | 2.66 | 2.66 | * | + | |
| PLACE1000636 | 2.12 | 1.92 | 1.69 | 2.35 | 1.07 | 2.86 | 1.27 | 1.58 | 1.58 | | | |
| PLACE1000653 | 2.8 | 1.22 | 1.84 | 2.02 | 2.53 | 1.75 | 1.81 | 4.26 | 4.26 | | | |

TABLE 293-continued

| | | | | | | | | | | | | | |
|---|---|---|---|---|---|---|---|---|---|---|---|---|---|
| PLACE1000656 | 9.31 | 7.34 | 8.14 | 10.31 | 10.47 | 9.31 | 12.81 | 14.00 | 14 | | | ** | + |
| PLACE1000663 | 1.27 | 0.67 | 0.99 | 1.89 | 1.74 | 1.74 | 1.26 | 1.65 | 1.65 | * | + | | |
| PLACE1000706 | 11.24 | 11.57 | 11.40 | 19.1 | 16.63 | 21.24 | 10.14 | 12.25 | 12.25 | ** | + | | |
| PLACE1000712 | 1.84 | 3.33 | 4.09 | 6.55 | 4.54 | 5.89 | 4.64 | 6.19 | 6.19 | * | + | * | + |
| PLACE1000716 | 2.94 | 0.83 | 1.14 | 1.67 | 1.91 | 1.48 | 1.97 | 1.39 | 1.39 | | | | |
| PLACE1000740 | 3.04 | 1.05 | 2.32 | 2.9 | 2.88 | 3.09 | 2.84 | 2.88 | 2.88 | | | | |
| PLACE1000748 | 6.27 | 3.34 | 3.42 | 5.4 | 6.40 | 3.86 | 2.84 | 3.25 | 3.25 | | | | |
| PLACE1000749 | 12.36 | 6.45 | 8.51 | 10.43 | 9.17 | 13.07 | 10.01 | 13.44 | 13.44 | | | | |
| PLACE1000751 | 2.38 | 1.17 | 1.02 | 4.52 | 3.07 | 2.68 | 4.21 | 4.95 | 4.95 | | | ** | + |
| PLACE1000755 | 2.51 | 1.55 | 1.57 | 3.46 | 3.45 | 4.83 | 2.60 | 2.77 | 2.77 | * | + | | |
| PLACE1000769 | 2.21 | 1.01 | 1.04 | 2.25 | 2.24 | 3.89 | 2.18 | 2.07 | 2.07 | | | | |
| PLACE1000778 | 5.1 | 3.19 | 2.79 | 4.88 | 3.83 | 3.91 | 3.55 | 2.38 | 2.38 | | | | |
| PLACE1000785 | 8.86 | 6.54 | 5.09 | 10.87 | 11.53 | 8.38 | 4.96 | 7.33 | 7.33 | | | | |
| PLACE1000786 | 4.27 | 4.46 | 2.71 | 4.67 | 3.49 | 4.67 | 3.76 | 4.74 | 4.74 | | | | |
| PLACE1000793 | 6.19 | 3.54 | 4.79 | 9.71 | 9.92 | 9.47 | 5.31 | 5.48 | 5.48 | ** | + | | |
| PLACE1000795 | 9.72 | 4.72 | 5.55 | 4.52 | 4.48 | 3.39 | 4.32 | 4.67 | 4.67 | | | | |
| PLACE1000798 | 1.9 | 1.59 | 2.33 | 3.4 | 3.26 | 3.47 | 1.64 | 2.26 | 2.26 | ** | + | | |
| PLACE1000812 | 2.3 | 2.38 | 1.85 | 3.32 | 3.27 | 4.96 | 2.41 | 3.24 | 3.24 | * | + | | |
| PLACE1000823 | 7.01 | 4.40 | 5.61 | 12.77 | 10.75 | 11.18 | 7.00 | 5.92 | 5.92 | ** | + | | |
| PLACE1000825 | 6.13 | 3.73 | 3.27 | 7.05 | 6.77 | 5.20 | 4.28 | 5.79 | 5.79 | | | | |
| PLACE1000838 | 5.14 | 3.45 | 2.78 | 6.34 | 7.02 | 4.42 | 12.05 | 18.19 | 18.19 | | | ** | + |
| PLACE1000841 | 3.14 | 5.34 | 2.01 | 3.49 | 3.92 | 2.49 | 3.35 | 1.76 | 1.76 | | | | |
| PLACE1000843 | 4.46 | 2.15 | 3.63 | 4.5 | 6.77 | 4.11 | 1.87 | 4.89 | 4.89 | | | | |
| PLACE1000849 | 10.82 | 6.77 | 8.57 | 8.51 | 10.69 | 9.82 | 7.58 | 11.02 | 11.02 | | | | |
| PLACE1000856 | 2.83 | 1.51 | 2.02 | 3.37 | 2.62 | 2.73 | 2.59 | 1.96 | 1.96 | | | | |
| PLACE1000863 | 9.64 | 6.13 | 6.86 | 5.2 | 5.82 | 6.39 | 5.18 | 5.81 | 5.81 | | | | |
| PLACE1000876 | 7.89 | 4.38 | 5.88 | 7.14 | 5.51 | 8.48 | 7.94 | 7.18 | 7.18 | | | | |
| PLACE1000899 | 3.08 | 2.81 | 1.69 | 4.08 | 4.67 | 3.67 | 3.31 | 2.41 | 2.41 | * | + | | |
| PLACE1000907 | 16.44 | 10.14 | 7.86 | 22.19 | 25.12 | 16.66 | 7.95 | 11.86 | 11.86 | | | | |
| PLACE1000909 | 3.62 | 1.21 | 1.15 | 2.54 | 4.35 | 1.92 | 1.98 | 2.37 | 2.37 | | | | |
| PLACE1000912 | 6.9 | 3.41 | 4.10 | 5.35 | 5.89 | 5.24 | 4.38 | 4.49 | 4.49 | | | | |
| PLACE1000914 | 3.46 | 1.48 | 2.11 | 2.59 | 3.24 | 2.71 | 3.41 | 2.78 | 2.78 | | | | |
| PLACE1000918 | 0.79 | 0.41 | 0.85 | 0.84 | 1.40 | 1.52 | 0.67 | 1.33 | 1.33 | | | | |
| PLACE1000927 | 3.51 | 2.64 | 4.51 | 6.98 | 7.67 | 10.76 | 8.88 | 8.80 | 8.8 | * | + | ** | + |
| PLACE1000931 | 2.76 | 1.60 | 7.19 | 4.08 | 3.69 | 6.22 | 3.38 | 2.86 | 2.86 | | | | |
| PLACE1000944 | 2.02 | 1.08 | 0.51 | 4.48 | 5.07 | 3.55 | 3.07 | 1.96 | 1.96 | ** | + | | |
| PLACE1000948 | 3.27 | 0.90 | 1.90 | 2.66 | 2.46 | 1.89 | 1.91 | 1.97 | 1.97 | | | | |
| PLACE1000958 | 2.75 | 1.53 | 1.51 | 2.98 | 2.99 | 3.11 | 3.17 | 4.29 | 4.29 | | | * | + |
| PLACE1000972 | 6.67 | 4.02 | 6.08 | 7.27 | 8.73 | 6.46 | 4.61 | 7.73 | 7.73 | | | | |

TABLE 294

| | | | | | | | | | | | | | |
|---|---|---|---|---|---|---|---|---|---|---|---|---|---|
| PLACE1000977 | 2.41 | 2.94 | 1.04 | 2.67 | 2.65 | 2.73 | 2.52 | 2.72 | 2.72 | | | | |
| PLACE1000979 | 9.34 | 4.89 | 6.74 | 13.62 | 13.31 | 16.23 | 7.57 | 8.33 | 8.33 | ** | + | | |
| PLACE1000986 | 4.3 | 2.25 | 2.59 | 5.14 | 4.48 | 5.42 | 4.23 | 5.38 | 5.38 | * | + | | |
| PLACE1000987 | 7.13 | 4.86 | 5.70 | 7.21 | 6.57 | 6.09 | 7.59 | 7.62 | 7.62 | | | | |
| PLACE1001000 | 4.76 | 2.74 | 3.26 | 8.41 | 15.56 | 9.19 | 5.75 | 6.47 | 6.47 | * | + | * | + |
| PLACE1001007 | 7.63 | 3.72 | 2.80 | 5.05 | 4.48 | 4.63 | 4.14 | 4.58 | 4.58 | | | | |
| PLACE1001010 | 2.3 | 1.89 | 2.06 | 3.44 | 3.64 | 3.65 | 1.96 | 2.59 | 2.59 | ** | + | | |
| PLACE1001015 | 2.92 | 1.68 | 1.34 | 3.1 | 2.61 | 2.85 | 2.90 | 4.52 | 4.52 | | | | |
| PLACE1001016 | 7.21 | 2.36 | 3.51 | 5.03 | 5.51 | 6.32 | 4.81 | 4.26 | 4.26 | | | | |
| PLACE1001022 | 3.86 | 2.81 | 2.95 | 4.41 | 2.88 | 3.07 | 2.80 | 2.90 | 2.9 | | | | |
| PLACE1001024 | 3.88 | 2.20 | 3.13 | 2.3 | 2.95 | 4.59 | 2.73 | 3.68 | 3.68 | | | | |
| PLACE1001036 | 5.16 | 2.56 | 3.47 | 6.09 | 4.65 | 5.59 | 4.01 | 4.38 | 4.38 | | | | |
| PLACE1001038 | 28.81 | 14.88 | 16.16 | 21.4 | 17.66 | 19.48 | 21.32 | 28.28 | 28.28 | | | | |
| PLACE1001048 | 3.36 | 1.96 | 1.23 | 2.27 | 1.42 | 1.71 | 1.83 | 3.38 | 3.38 | | | | |
| PLACE1001054 | 7.9 | 5.99 | 5.59 | 6.24 | 6.31 | 4.84 | 4.36 | 6.39 | 6.39 | | | | |
| PLACE1001062 | 7.2 | 5.87 | 4.94 | 11.02 | 9.95 | 11.12 | 6.47 | 7.34 | 7.34 | ** | + | | |
| PLACE1001063 | 1.41 | 1.69 | 1.15 | 2.65 | 3.68 | 3.53 | 1.70 | 3.59 | 3.59 | ** | + | | |
| PLACE1001076 | 2.26 | 0.97 | 1.04 | 1.44 | 1.83 | 1.65 | 2.02 | 2.26 | 2.26 | | | | |
| PLACE1001081 | 12.46 | 8.57 | 9.92 | 15.12 | 11.87 | 13.36 | 10.20 | 12.65 | 12.65 | | | | |
| PLACE1001088 | 2.63 | 1.81 | 1.14 | 3.01 | 3.83 | 4.04 | 1.79 | 3.12 | 3.12 | * | + | | |
| PLACE1001092 | 6.88 | 3.43 | 3.30 | 7.95 | 6.98 | 7.48 | 8.10 | 6.69 | 6.69 | | | | |
| PLACE1001098 | 3.19 | 4.37 | 2.61 | 7.39 | 7.22 | 4.69 | 3.98 | 5.42 | 5.42 | * | + | | |
| PLACE1001100 | 4.67 | 2.56 | 3.28 | 9.14 | 7.82 | 8.01 | 4.36 | 9.43 | 9.43 | ** | + | | |
| PLACE1001104 | 4.42 | 3.38 | 3.50 | 3.41 | 4.47 | 4.62 | 3.50 | 5.47 | 5.47 | | | | |
| PLACE1001114 | 6.37 | 3.02 | 3.19 | 9.14 | 6.05 | 8.38 | 4.84 | 6.58 | 6.58 | | | | |
| PLACE1001118 | 8.99 | 8.41 | 8.16 | 18.03 | 15.27 | 17.69 | 9.35 | 8.27 | 8.27 | ** | + | | |
| PLACE1001123 | 3.67 | 2.98 | 3.43 | 6.53 | 5.15 | 5.14 | 7.08 | 8.09 | 8.09 | * | + | ** | + |
| PLACE1001136 | 6.74 | 4.90 | 3.41 | 11.43 | 11.92 | 9.20 | 6.63 | 6.95 | 6.95 | * | + | | |
| PLACE1001144 | 5.3 | 3.83 | 2.70 | 9.8 | 6.14 | 5.78 | 3.32 | 5.22 | 5.22 | | | | |
| PLACE1001147 | 6.12 | 3.41 | 3.43 | 6.85 | 6.67 | 6.42 | 5.03 | 6.28 | 6.28 | | | | |
| PLACE1001148 | 3.16 | 1.95 | 1.69 | 2.9 | 2.48 | 3.03 | 1.39 | 4.13 | 4.13 | | | | |
| PLACE1001159 | 1.33 | 1.09 | 1.58 | 2.28 | 2.10 | 1.76 | 1.96 | 4.06 | 4.06 | * | + | * | + |
| PLACE1001168 | 1.82 | 0.78 | 1.16 | 1.62 | 1.75 | 2.87 | 2.70 | 3.06 | 3.06 | | | ** | + |
| PLACE1001171 | 2.35 | 1.34 | 1.61 | 1.46 | 3.10 | 235 | 2.90 | 1.94 | 1.94 | | | | |

TABLE 294-continued

| | | | | | | | | | | | | |
|---|---|---|---|---|---|---|---|---|---|---|---|---|
| PLACE1001183 | 1.79 | 2.36 | 1.72 | 2.21 | 1.23 | 3.26 | 2.19 | 2.54 | 2.54 | | | |
| PLACE1001185 | 5.46 | 4.74 | 4.40 | 6.41 | 7.88 | 5.56 | 6.42 | 6.55 | 6.55 | | ** | + |
| PLACE1001201 | 6.18 | 4.83 | 3.75 | 5.34 | 5.15 | 4.77 | 3.30 | 2.90 | 2.9 | | | |
| PLACE1001229 | 9.82 | 5.35 | 4.18 | 9.24 | 10.40 | 7.25 | 8.28 | 8.97 | 8.97 | | | |
| PLACE1001231 | 9.55 | 4.73 | 5.18 | 5.83 | 6.30 | 4.83 | 3.56 | 5.51 | 5.51 | | | |
| PLACE1001238 | 5.01 | 3.11 | 3.77 | 6.38 | 5.60 | 5.68 | 4.47 | 4.58 | 4.58 | * | + | |
| PLACE1001241 | 2.02 | 1.58 | 1.43 | 2.15 | 2.00 | 2.71 | 2.20 | 2.62 | 2.62 | | * | + |
| PLACE1001242 | 20.17 | 17.27 | 18.47 | 18.81 | 15.90 | 19.20 | 22.68 | 25.15 | 25.15 | | ** | + |
| PLACE1001247 | 9.52 | 6.34 | 6.64 | 10.32 | 8.10 | 12.11 | 5.62 | 8.24 | 8.24 | | | |
| PLACE1001250 | 3.73 | 2.44 | 3.14 | 5.42 | 5.19 | 6.97 | 2.55 | 3.26 | 3.26 | * | + | |
| PLACE1001257 | 6.68 | 5.11 | 2.77 | 13.34 | 10.34 | 12.61 | 4.57 | 6.16 | 6.16 | ** | + | |
| PLACE1001272 | 6.36 | 4.10 | 3.44 | 7.49 | 6.51 | 5.32 | 5.11 | 6.14 | 6.14 | | | |
| PLACE1001279 | 2.31 | 1.92 | 1.89 | 3.68 | 2.64 | 2.53 | 2.56 | 2.17 | 2.17 | | | |
| PLACE1001280 | 2.63 | 3.05 | 1.70 | 3.8 | 3.92 | 4.33 | 2.23 | 2.86 | 2.86 | * | + | |
| PLACE1001294 | 1.16 | 0.01 | 1.04 | 3.47 | 4.82 | 2.72 | 5.00 | 5.65 | 5.65 | * | + | ** | + |
| PLACE1001295 | 4.29 | 3.95 | 3.46 | 3.47 | 3.85 | 3.06 | 4.31 | 5.32 | 5.32 | | | |
| PLACE1001300 | 2.58 | 2.11 | 2.36 | 2.54 | 2.70 | 1.93 | 2.20 | 3.72 | 3.72 | | | |
| PLACE1001304 | 6.77 | 5.82 | 8.24 | 17.77 | 13.08 | 18.60 | 7.86 | 9.34 | 9.34 | ** | + | |
| PLACE1001311 | 5.16 | 4.21 | 2.93 | 10.01 | 8.67 | 7.40 | 5.99 | 7.20 | 7.2 | ** | + | * | + |
| PLACE1001323 | 7.17 | 3.76 | 3.29 | 11.33 | 10.13 | 10.10 | 6.13 | 5.77 | 5.77 | * | + | |
| PLACE1001325 | 2.41 | 1.50 | 1.58 | 5.07 | 4.29 | 3.56 | 1.94 | 2.67 | 2.67 | ** | + | |
| PLACE1001340 | 8.91 | 4.41 | 6.17 | 8 | 8.54 | 6.15 | 5.24 | 8.59 | 8.59 | | | |

TABLE 295

| | | | | | | | | | | | | |
|---|---|---|---|---|---|---|---|---|---|---|---|---|
| PLACE1001344 | 2.76 | 1.50 | 1.35 | 2.41 | 3.45 | 2.46 | 1.70 | 2.00 | 2 | | | |
| PLACE1001351 | 3.23 | 1.94 | 2.24 | 3.49 | 3.29 | 3.25 | 2.62 | 4.03 | 4.03 | | | |
| PLACE1001366 | 4.38 | 2.83 | 2.63 | 5.26 | 5.03 | 5.59 | 4.18 | 3.48 | 3.48 | * | + | |
| PLACE1001377 | 2.21 | 0.95 | 1.13 | 1.75 | 2.13 | 2.07 | 1.20 | 1.68 | 1.68 | | | |
| PLACE1001383 | 3.71 | 1.90 | 1.47 | 3.95 | 6.26 | 1.71 | 1.64 | 2.49 | 2.49 | | | |
| PLACE1001384 | 3.18 | 2.05 | 1.78 | 4.94 | 5.31 | 4.83 | 2.21 | 2.83 | 2.83 | ** | + | |
| PLACE1001387 | 4.38 | 2.11 | 2.54 | 3.04 | 2.86 | 4.24 | 2.34 | 3.05 | 3.05 | | | |
| PLACE1001395 | 1.59 | 1.26 | 1.15 | 3.65 | 3.08 | 5.18 | 3.82 | 2.99 | 2.99 | * | + | ** | + |
| PLACE1001399 | 11.87 | 6.31 | 8.20 | 17.43 | 15.28 | 22.75 | 13.01 | 12.96 | 12.96 | * | + | |
| PLACE1001401 | 1.52 | 0.25 | 1.01 | 1.14 | 0.80 | 1.79 | 1.18 | 1.33 | 1.33 | | | |
| PLACE1001407 | 6.8 | 4.32 | 5.87 | 3.76 | 3.93 | 5.36 | 10.73 | 10.24 | 10.24 | | ** | + |
| PLACE1001412 | 5.12 | 1.76 | 2.22 | 3.71 | 2.25 | 2.65 | 2.13 | 1.31 | 1.31 | | | |
| PLACE1001414 | 15.81 | 9.44 | 8.70 | 18.1 | 13.15 | 13.80 | 12.97 | 12.27 | 12.27 | | | |
| PLACE1001416 | 4.85 | 3.13 | 3.24 | 4.86 | 3.47 | 4.68 | 3.85 | 4.04 | 4.04 | | | |
| PLACE1001433 | 34.75 | 27.32 | 25.94 | 41.44 | 46.72 | 44.79 | 20.21 | 24.82 | 24.82 | ** | + | |
| PLACE1001440 | 3.36 | 1.52 | 3.50 | 3.58 | 3.41 | 4.36 | 3.30 | 2.97 | 2.97 | | | |
| PLACE1001456 | 2.82 | 2.23 | 1.05 | 4.35 | 4.43 | 4.27 | 3.77 | 3.38 | 3.38 | * | + | |
| PLACE1001464 | 1.12 | 0.36 | 0.61 | 1.11 | 1.20 | 1.53 | 4.05 | 3.36 | 3.36 | | ** | + |
| PLACE1001468 | 1 | 1.48 | 0.93 | 1.65 | 1.22 | 1.79 | 1.02 | 0.92 | 0.92 | | | |
| PLACE1001484 | 5.54 | 3.35 | 3.73 | 7.43 | 7.35 | 10.20 | 3.71 | 4.16 | 4.16 | * | + | |
| PLACE1001500 | 8.54 | 6.02 | 4.38 | 7.39 | 7.18 | 5.61 | 5.36 | 6.08 | 6.08 | | | |
| PLACE1001502 | 6.06 | 4.35 | 3.12 | 4.46 | 5.05 | 4.69 | 4.11 | 4.84 | 4.84 | | | |
| PLACE1001503 | 6.09 | 4.19 | 3.41 | 7.11 | 7.79 | 6.61 | 4.97 | 5.70 | 5.7 | * | + | |
| PLACE1001505 | 20.88 | 12.93 | 14.68 | 15.96 | 17.98 | 17.32 | 9.92 | 14.48 | 14.48 | | | |
| PLACE1001513 | 6.48 | 3.77 | 5.22 | 5.72 | 3.68 | 4.54 | 4.27 | 6.65 | 6.65 | | | |
| PLACE1001516 | 10.93 | 7.17 | 9.57 | 12.22 | 8.39 | 12.84 | 8.43 | 11.33 | 11.33 | | | |
| PLACE1001517 | 5.77 | 3.37 | 4.96 | 7.37 | 4.67 | 6.00 | 5.80 | 4.89 | 4.89 | | | |
| PLACE1001523 | 23.41 | 10.77 | 16.66 | 12.24 | 9.55 | 12.27 | 10.99 | 12.94 | 12.94 | | | |
| PLACE1001526 | 7.32 | 4.41 | 2.62 | 6.04 | 11.01 | 4.64 | 4.47 | 5.72 | 5.72 | | | |
| PLACE1001534 | 4 | 1.96 | 2.04 | 4.38 | 6.28 | 3.78 | 3.64 | 3.03 | 3.03 | | | |
| PLACE1001536 | 2.83 | 1.23 | 1.62 | 1.76 | 3.23 | 2.47 | 2.13 | 1.81 | 1.81 | | | |
| PLACE1001545 | 36.23 | 12.22 | 23.79 | 37.99 | 57.83 | 39.02 | 33.62 | 43.32 | 43.32 | | | |
| PLACE1001551 | 6.66 | 3.51 | 3.07 | 3.77 | 5.41 | 4.65 | 3.22 | 3.12 | 3.12 | | ** | + |
| PLACE1001564 | 1.35 | 0.83 | 1.14 | 1.76 | 1.17 | 1.28 | 1.94 | 2.02 | 2.02 | | ** | + |
| PLACE1001570 | 0.93 | 0.34 | 0.64 | 2.16 | 2.60 | 4.80 | 1.89 | 2.31 | 2.31 | * | + | ** | + |
| PLACE1001571 | 7.95 | 4.12 | 4.74 | 8.82 | 11.30 | 11.21 | 6.14 | 8.15 | 8.15 | * | + | |
| PLACE1001595 | 11.96 | 8.35 | 6.84 | 10.3 | 8.39 | 8.08 | 8.16 | 6.97 | 6.97 | | | |
| PLACE1001602 | 10.71 | 5.17 | 5.52 | 7.59 | 10.40 | 7.10 | 3.81 | 6.12 | 6.12 | | | |
| PLACE1001603 | 2.7 | 2.04 | 2.99 | 5.01 | 5.83 | 4.53 | 3.42 | 3.10 | 3.1 | ** | + | |
| PLACE1001608 | 2.44 | 2.10 | 2.41 | 3.4 | 4.03 | 5.05 | 2.95 | 3.88 | 3.88 | * | + | * | + |
| PLACE1001610 | 5.43 | 4.80 | 5.73 | 13.88 | 9.92 | 13.14 | 7.65 | 8.25 | 8.25 | ** | + | ** | + |
| PLACE1001611 | 3.56 | 2.47 | 3.24 | 3.84 | 3.75 | 5.73 | 3.92 | 3.82 | 3.82 | | | |
| PLACE1001629 | 6.48 | 3.78 | 4.26 | 6.9 | 3.97 | 6.33 | 1.49 | 1.62 | 1.62 | | * | − |
| PLACE1001632 | 8.49 | 4.09 | 6.12 | 10.6 | 10.02 | 12.44 | 6.25 | 8.12 | 8.12 | * | + | |
| PLACE1001634 | 3.06 | 1.40 | 1.54 | 5.61 | 6.76 | 4.47 | 2.48 | 4.23 | 4.23 | * | + | |
| PLACE1001637 | 4.89 | 3.35 | 2.51 | 2.97 | 3.72 | 3.26 | 3.61 | 4.38 | 4.38 | | | |
| PLACE1001640 | 6.92 | 2.46 | 2.49 | 7.67 | 8.87 | 5.84 | 4.54 | 7.69 | 7.69 | | | |
| PLACE1001655 | 3.46 | 2.83 | 2.76 | 2.95 | 2.85 | 2.93 | 2.12 | 2.26 | 2.26 | | * | − |
| PLACE1001672 | 3.35 | 1.68 | 2.29 | 4.35 | 2.93 | 3.76 | 4.49 | 2.60 | 2.6 | | | |
| PLACE1001676 | 1.74 | 0.78 | 2.18 | 1.12 | 1.17 | 2.29 | 1.50 | 2.79 | 2.79 | | | |
| PLACE1001683 | 8.62 | 6.71 | 9.02 | 11.78 | 10.73 | 12.96 | 10.63 | 12.86 | 12.86 | * | + | * | + |

TABLE 295-continued

| | | | | | | | | | | | | |
|---|---|---|---|---|---|---|---|---|---|---|---|---|
| PLACE1001691 | 5.26 | 3.63 | 4.10 | 12.07 | 10.05 | 6.33 | 3.77 | 5.16 | 5.16 | * | + | |
| PLACE1001692 | 4.42 | 2.12 | 2.27 | 4.86 | 5.36 | 4.90 | 4.07 | 3.26 | 3.26 | | | |
| PLACE1001705 | 8.07 | 4.26 | 3.08 | 6.53 | 6.17 | 7.84 | 4.62 | 7.50 | 7.5 | | | |
| PLACE1001716 | 3.8 | 1.68 | 2.70 | 3.78 | 4.85 | 3.53 | 4.66 | 5.71 | 5.71 | | | * | + |
| PLACE1001720 | 1.91 | 1.29 | 2.34 | 3.39 | 3.22 | 2.45 | 2.24 | 3.40 | 3.4 | * | + | |

TABLE 296

| | | | | | | | | | | | | | |
|---|---|---|---|---|---|---|---|---|---|---|---|---|---|
| PLACE1001728 | 1.5 | 1.02 | 0.69 | 1.1 | 0.60 | 1.41 | 1.40 | 1.39 | 1.39 | | | | |
| PLACE1001729 | 6.79 | 3.57 | 3.61 | 3.84 | 3.10 | 4.27 | 2.54 | 6.08 | 6.08 | | | | |
| PLACE1001739 | 9.94 | 5.41 | 6.00 | 8.04 | 5.84 | 6.73 | 6.37 | 6.11 | 6.11 | | | | |
| PLACE1001740 | 1.57 | 0.32 | 0.49 | 0.97 | 1.11 | 1.42 | 1.06 | 0.82 | 0.82 | | | | |
| PLACE1001745 | 5.8 | 3.72 | 3.68 | 4.06 | 4.53 | 4.47 | 4.22 | 4.88 | 4.88 | | | | |
| PLACE1001746 | 3.57 | 1.52 | 1.71 | 4.99 | 5.18 | 6.01 | 3.66 | 5.62 | 5.62 | * | + | * | + |
| PLACE1001748 | 4.5 | 2.90 | 2.37 | 5.53 | 4.76 | 3.57 | 3.80 | 5.19 | 5.19 | | | | |
| PLACE1001753 | 3.51 | 2.28 | 3.04 | 2.88 | 3.35 | 3.77 | 3.11 | 5.17 | 5.17 | | | | |
| PLACE1001756 | 12.16 | 6.46 | 7.86 | 8.59 | 7.90 | 8.09 | 4.55 | 8.41 | 8.41 | | | | |
| PLACE1001760 | 8.72 | 4.93 | 5.18 | 11.47 | 11.77 | 9.41 | 7.48 | 10.20 | 10.2 | * | + | | |
| PLACE1001767 | 6.27 | 4.18 | 2.75 | 5.86 | 5.81 | 6.64 | 5.16 | 5.97 | 5.97 | | | | |
| PLACE1001771 | 1.84 | 1.98 | 1.82 | 2.36 | 2.85 | 5.41 | 2.31 | 1.87 | 1.87 | | | | |
| PLACE1001775 | 1.14 | 0.68 | 0.37 | 2.02 | 1.85 | 1.82 | 2.01 | 0.97 | 0.97 | ** | + | | |
| PLACE1001777 | 17.14 | 13.64 | 18.62 | 21.05 | 26.38 | 21.12 | 40.01 | 76.23 | 76.23 | | | * | + |
| PLACE1001781 | 2.45 | 1.71 | 2.59 | 2.44 | 2.81 | 2.52 | 2.91 | 5.33 | 5.33 | | | | |
| PLACE1001783 | 4.43 | 2.58 | 2.66 | 2.32 | 3.33 | 2.65 | 2.54 | 4.19 | 4.19 | | | | |
| PLACE1001786 | 1.74 | 1.05 | 1.30 | 1.23 | 1.66 | 1.40 | 1.26 | 1.69 | 1.69 | | | | |
| PLACE1001788 | 5.13 | 2.94 | 2.51 | 5.8 | 4.90 | 5.17 | 4.40 | 3.27 | 3.27 | | | | |
| PLACE1001795 | 2.72 | 1.91 | 2.58 | 4.69 | 4.12 | 5.43 | 5.56 | 6.85 | 6.85 | ** | + | ** | + |
| PLACE1001799 | 3.74 | 3.45 | 3.29 | 3.65 | 3.39 | 3.75 | 3.22 | 5.05 | 5.05 | | | | |
| PLACE1001810 | 2.43 | 0.99 | 1.08 | 2.55 | 2.29 | 2.26 | 1.22 | 1.22 | | | | | |
| PLACE1001817 | 6.6 | 4.05 | 4.21 | 9.77 | 8.48 | 6.29 | 8.47 | 8.36 | 8.36 | | | * | + |
| PLACE1001821 | 3.26 | 2.45 | 2.55 | 4.22 | 4.44 | 5.51 | 4.69 | 7.27 | 7.27 | * | + | * | + |
| PLACE1001836 | 4.29 | 2.26 | 1.81 | 2.56 | 3.00 | 3.57 | 2.41 | 2.93 | 2.93 | | | | |
| PLACE1001844 | 1.78 | 2.16 | 1.61 | 2.8 | 3.57 | 4.27 | 2.87 | 4.20 | 4.2 | * | + | * | + |
| PLACE1001845 | 2.41 | 1.41 | 2.18 | 4.39 | 5.00 | 4.06 | 2.82 | 2.33 | 2.33 | ** | + | | |
| PLACE1001858 | 4.51 | 4.42 | 4.15 | 7.53 | 6.22 | 8.84 | 4.27 | 3.55 | 3.55 | * | + | | |
| PLACE1001869 | 3.09 | 2.60 | 2.08 | 2.74 | 2.72 | 3.73 | 1.99 | 3.40 | 3.4 | | | | |
| PLACE1001890 | 2.77 | 2.42 | 1.39 | 7.46 | 6.18 | 5.66 | 5.49 | 5.13 | 5.13 | ** | + | ** | + |
| PLACE1001897 | 2.18 | 2.26 | 1.85 | 6.69 | 5.35 | 5.34 | 8.97 | 9.82 | 9.82 | ** | + | ** | + |
| PLACE1001902 | 31.17 | 17.00 | 21.61 | 32.58 | 37.84 | 31.63 | 15.20 | 15.90 | 15.9 | | | | |
| PLACE1001904 | 3.92 | 3.02 | 3.25 | 2.81 | 3.73 | 3.19 | 4.96 | 4.49 | 4.49 | | | * | + |
| PLACE1001907 | 5.11 | 3.84 | 3.69 | 6.62 | 6.43 | 7.96 | 4.32 | 5.12 | 5.12 | * | + | | |
| PLACE1001910 | 1.87 | 3.06 | 2.35 | 3.3 | 3.81 | 3.68 | 14.39 | 26.30 | 26.3 | * | + | ** | + |
| PLACE1001912 | 2.63 | 0.79 | 1.20 | 4.38 | 3.77 | 3.71 | 2.02 | 2.67 | 2.67 | * | + | | |
| PLACE1001918 | 10.38 | 7.15 | 8.90 | 11.66 | 9.55 | 15.16 | 10.15 | 14.11 | 14.11 | | | | |
| PLACE1001920 | 2.53 | 1.11 | 1.05 | 1.68 | 3.07 | 1.48 | 1.79 | 0.84 | 0.84 | | | | |
| PLACE1001928 | 8.17 | 4.57 | 3.74 | 7.72 | 5.90 | 6.65 | 3.44 | 4.51 | 4.51 | | | | |
| PLACE1001930 | 2.19 | 1.43 | 2.13 | 1.81 | 3.19 | 3.67 | 2.17 | 2.30 | 2.3 | | | | |
| PLACE1001949 | 2.08 | 1.14 | 1.41 | 2.07 | 1.98 | 1.77 | 1.69 | 2.05 | 2.05 | | | | |
| PLACE1001959 | 1.52 | 1.78 | 2.06 | 2.37 | 1.77 | 2.84 | 1.64 | 2.36 | 2.36 | | | | |
| PLACE1001969 | 4.16 | 2.19 | 2.62 | 4.17 | 4.18 | 4.94 | 2.88 | 2.78 | 2.78 | | | | |
| PLACE1001974 | 9.4 | 3.65 | 4.39 | 13.34 | 9.00 | 13.23 | 6.71 | 10.90 | 10.9 | | | | |
| PLACE1001981 | 1.69 | 1.37 | 1.20 | 2.64 | 1.90 | 2.12 | 1.52 | 1.67 | 1.67 | * | + | | |
| PLACE1001983 | 5.62 | 5.76 | 3.72 | 4.29 | 4.58 | 4.62 | 6.62 | 4.70 | 4.7 | | | | |
| PLACE1001989 | 5.11 | 2.90 | 3.88 | 7.82 | 6.79 | 6.73 | 3.99 | 4.04 | 4.04 | * | + | | |
| PLACE1002004 | 8.3 | 4.91 | 5.56 | 11.8 | 13.71 | 13.04 | 6.33 | 7.42 | 7.42 | ** | + | | |
| PLACE1002008 | 14.39 | 6.47 | 3.72 | 18.67 | 18.94 | 18.14 | 8.81 | 8.95 | 8.95 | * | + | | |
| PLACE1002015 | 8.41 | 6.18 | 4.44 | 7.71 | 7.18 | 8.85 | 8.17 | 7.96 | 7.96 | | | | |
| PLACE1002044 | 1.09 | 1.29 | 1.71 | 3.03 | 2.76 | 2.81 | 3.27 | 3.06 | 3.06 | ** | + | ** | + |
| PLACE1002046 | 3.04 | 2.60 | 2.80 | 3.24 | 2.46 | 4.89 | 3.21 | 2.77 | 2.77 | | | | |
| PLACE1002052 | 1.9 | 0.59 | 1.24 | 2.33 | 1.00 | 2.14 | 1.49 | 1.25 | 1.25 | | | | |
| PLACE1002066 | 6.22 | 4.18 | 2.39 | 10.6 | 9.81 | 10.78 | 7.57 | 8.32 | 8.32 | ** | + | * | + |
| PLACE1002072 | 4.3 | 3.28 | 3.34 | 7.74 | 8.18 | 6.54 | 4.13 | 5.29 | 5.29 | ** | + | | |
| PLACE1002073 | 4.41 | 2.63 | 2.33 | 3.9 | 3.18 | 3.49 | 2.87 | 3.67 | 3.67 | | | | |
| PLACE1002080 | 9.31 | 4.83 | 4.67 | 8.96 | 9.64 | 10.72 | 7.21 | 6.98 | 6.98 | | | | |

TABLE 297

| | | | | | | | | | | | | | |
|---|---|---|---|---|---|---|---|---|---|---|---|---|---|
| PLACE1002081 | 1.99 | 0.89 | 1.77 | 2.72 | 4.23 | 2.35 | 2.10 | 2.07 | 2.07 | | | | |
| PLACE1002090 | 14.44 | 6.66 | 9.78 | 10.42 | 12.14 | 11.62 | 5.32 | 7.78 | 7.78 | | | | |
| PLACE1002095 | 6.66 | 3.83 | 6.14 | 8.67 | 7.29 | 9.40 | 5.73 | 7.69 | 7.69 | | | | |
| PLACE1002102 | 11.71 | 6.09 | 6.01 | 11.63 | 6.93 | 8.62 | 6.39 | 8.11 | 8.11 | | | | |
| PLACE1002109 | 2.46 | 1.22 | 1.40 | 2.6 | 4.68 | 2.17 | 2.82 | 2.11 | 2.11 | | | | |
| PLACE1002115 | 3.01 | 0.88 | 0.58 | 1.13 | 2.98 | 1.33 | 0.18 | 1.10 | 1.1 | | | | |
| PLACE1002119 | 18.69 | 14.15 | 17.17 | 28.94 | 38.25 | 31.55 | 24.25 | 29.45 | 29.45 | ** | + | ** | + |

TABLE 297-continued

| | | | | | | | | | | | | | |
|---|---|---|---|---|---|---|---|---|---|---|---|---|---|
| PLACE1002140 | 7.37 | 4.29 | 6.46 | 6.39 | 6.75 | 7.33 | 4.91 | 5.86 | 5.86 | | | | |
| PLACE1002150 | 2.02 | 1.18 | 2.19 | 3.93 | 4.63 | 3.78 | 3.27 | 2.55 | 2.55 | ** | + | | |
| PLACE1002153 | 6.36 | 3.80 | 4.46 | 7.01 | 6.47 | 4.93 | 5.54 | 4.93 | 4.93 | | | | |
| PLACE1002157 | 2.68 | 1.47 | 1.39 | 4.12 | 3.06 | 4.68 | 2.90 | 3.69 | 3.69 | * | + | * | + |
| PLACE1002163 | 7.63 | 2.62 | 3.61 | 7.02 | 7.14 | 5.85 | 5.07 | 6.08 | 6.08 | | | | |
| PLACE1002168 | 4.33 | 2.82 | 2.86 | 4.8 | 4.18 | 3.05 | 4.14 | 4.00 | 4 | | | | |
| PLACE1002170 | 2.98 | 1.54 | 1.88 | 1.56 | 1.84 | 1.46 | 1.96 | 1.92 | 1.92 | | | | |
| PLACE1002171 | 13.45 | 7.42 | 8.57 | 6.89 | 9.10 | 5.13 | 2.02 | 3.14 | 3.14 | | | * | − |
| PLACE1002180 | 1.81 | 0.89 | 1.51 | 3.13 | 3.65 | 3.26 | 1.39 | 2.44 | 2.44 | ** | + | | |
| PLACE1002184 | 2.38 | 1.68 | 1.24 | 6.52 | 7.00 | 7.36 | 6.04 | 5.01 | 5.01 | ** | + | ** | + |
| PLACE1002200 | 3.74 | 3.15 | 2.61 | 3.65 | 2.78 | 3.93 | 3.98 | 4.06 | 4.06 | | | | |
| PLACE1002205 | 1.24 | 0.51 | 0.69 | 2.33 | 2.64 | 4.75 | 1.98 | 1.74 | 1.74 | * | + | * | + |
| PLACE1002213 | 8.87 | 4.30 | 5.26 | 10.21 | 8.63 | 11.56 | 6.15 | 7.84 | 7.84 | | | | |
| PLACE1002219 | 1.89 | 0.82 | 0.74 | 1.44 | 2.66 | 1.62 | 0.97 | 0.77 | 0.77 | | | | |
| PLACE1002227 | 4.82 | 2.81 | 1.66 | 4.34 | 4.54 | 4.85 | 2.92 | 3.36 | 3.36 | | | | |
| PLACE1002253 | 3.86 | 2.60 | 1.93 | 1.41 | 2.78 | 1.93 | 2.88 | 2.14 | 2.14 | | | | |
| PLACE1002256 | 1.83 | 0.92 | 1.11 | 2.87 | 3.97 | 2.85 | 1.91 | 3.59 | 3.59 | * | + | * | + |
| PLACE1002259 | 3.19 | 1.70 | 1.57 | 6.62 | 7.59 | 6.60 | 5.13 | 4.07 | 4.07 | ** | + | * | + |
| PLACE1002285 | 1.77 | 0.92 | 0.70 | 2.37 | 1.34 | 1.10 | 1.30 | 2.28 | 2.28 | | | | |
| PLACE1002301 | 3.7 | 3.54 | 3.53 | 4.57 | 5.90 | 8.65 | 6.82 | 8.88 | 8.88 | | | ** | + |
| PLACE1002310 | 2.48 | 1.29 | 1.37 | 3.99 | 3.09 | 4.29 | 7.69 | 9.72 | 9.72 | * | + | ** | + |
| PLACE1002311 | 3.44 | 2.13 | 1.55 | 3.07 | 3.48 | 2.34 | 2.76 | 2.45 | 2.45 | | | | |
| PLACE1002319 | 4.6 | 2.18 | 2.82 | 2.38 | 2.25 | 2.70 | 1.39 | 2.13 | 2.13 | | | | |
| PLACE1002329 | 4.19 | 2.99 | 2.11 | 3.47 | 3.41 | 5.33 | 3.47 | 4.66 | 4.66 | | | | |
| PLACE1002333 | 1.41 | 1.34 | 1.43 | 2.55 | 1.71 | 1.03 | 1.08 | 1.25 | 1.25 | | | * | − |
| PLACE1002342 | 3.55 | 2.39 | 2.93 | 7.53 | 5.67 | 7.31 | 3.57 | 4.06 | 4.06 | ** | + | | |
| PLACE1002343 | 3.11 | 2.65 | 3.16 | 2.86 | 3.12 | 2.88 | 2.90 | 5.44 | 5.44 | | | | |
| PLACE1002355 | 3.89 | 1.69 | 1.70 | 3.76 | 3.03 | 3.60 | 3.29 | 2.58 | 2.58 | | | | |
| PLACE1002358 | 3.55 | 2.39 | 2.49 | 3.8 | 3.99 | 2.81 | 2.23 | 2.70 | 2.7 | | | | |
| PLACE1002359 | 8 | 4.42 | 4.71 | 3.91 | 5.64 | 5.32 | 4.07 | 5.01 | 5.01 | | | | |
| PLACE1002374 | 14.74 | 8.20 | 8.86 | 9.64 | 10.72 | 8.98 | 11.09 | 14.20 | 14.2 | | | | |
| PLACE1002376 | 7.57 | 5.16 | 5.69 | 9.15 | 8.50 | 11.00 | 8.02 | 8.55 | 8.55 | * | + | * | + |
| PLACE1002379 | 3.61 | 3.25 | 3.56 | 3.36 | 3.66 | 3.11 | 4.20 | 4.20 | 4.2 | | | ** | + |
| PLACE1002386 | 5.82 | 2.32 | 2.77 | 4.29 | 2.48 | 5.32 | 6.23 | 7.32 | 7.32 | | | * | + |
| PLACE1002395 | 5.61 | 3.00 | 2.85 | 4.9 | 4.34 | 4.62 | 4.54 | 4.04 | 4.04 | | | | |
| PLACE1002399 | 2.61 | 1.20 | 1.56 | 3.06 | 2.87 | 4.76 | 3.56 | 3.31 | 3.31 | | | * | + |
| PLACE1002407 | 4.59 | 2.71 | 2.96 | 2.81 | 2.75 | 3.28 | 1.95 | 2.26 | 2.26 | | | | |
| PLACE1002433 | 5.13 | 3.15 | 3.02 | 4.68 | 5.35 | 5.03 | 2.23 | 2.89 | 2.89 | | | | |
| PLACE1002437 | 3.54 | 1.57 | 2.70 | 3.76 | 3.24 | 3.17 | 2.59 | 4.55 | 4.55 | | | | |
| PLACE1002438 | 1.21 | 1.24 | 1.22 | 1.63 | 1.79 | 2.23 | 2.23 | 2.71 | 2.71 | * | + | ** | + |
| PLACE1002446 | 5.14 | 2.19 | 2.50 | 4.51 | 3.25 | 4.13 | 6.69 | 7.98 | 7.98 | | | * | + |
| PLACE1002447 | 2.92 | 2.41 | 2.19 | 1.36 | 3.06 | 1.99 | 2.41 | 2.93 | 2.93 | | | | |
| PLACE1002450 | 1.44 | 2.03 | 1.72 | 3.08 | 3.13 | 3.49 | 2.56 | 2.00 | 2 | ** | + | | |
| PLACE1002462 | 2.28 | 1.70 | 1.59 | 1.95 | 1.67 | 3.14 | 1.58 | 2.39 | 2.39 | | | | |
| PLACE1002465 | 3.1 | 2.98 | 2.42 | 2.1 | 3.45 | 3.05 | 2.13 | 2.02 | 2.02 | | | * | − |
| PLACE1002474 | 2.91 | 2.82 | 2.76 | 8.43 | 9.88 | 7.40 | 6.02 | 7.81 | 7.81 | ** | + | ** | + |
| PLACE1002477 | 8.13 | 3.74 | 5.00 | 11.28 | 9.50 | 9.10 | 9.42 | 12.59 | 12.59 | * | + | * | + |
| PLACE1002493 | 1.9 | 2.19 | 1.21 | 1.77 | 1.63 | 1.93 | 2.11 | 3.26 | 3.26 | | | | |
| PLACE1002497 | 2.74 | 1.52 | 2.43 | 1.73 | 1.95 | 2.51 | 2.01 | 3.14 | 3.14 | | | | |

TABLE 298

| | | | | | | | | | | | | | |
|---|---|---|---|---|---|---|---|---|---|---|---|---|---|
| PLACE1002499 | 3.87 | 1.99 | 3.01 | 5.9 | 5.94 | 5.28 | 3.14 | 5.21 | 5.21 | ** | + | ** | + |
| PLACE1002500 | 3.82 | 3.46 | 3.57 | 5.63 | 5.50 | 7.08 | 4.28 | 4.54 | 4.54 | ** | + | ** | + |
| PLACE1002514 | 2.68 | 2.18 | 1.93 | 2.67 | 2.24 | 2.48 | 3.81 | 2.98 | 2.98 | | | * | + |
| PLACE1002518 | 3.35 | 3.89 | 3.09 | 9.93 | 9.60 | 8.45 | 4.26 | 3.29 | 3.29 | ** | + | | |
| PLACE1002529 | 1.4 | 1.36 | 1.04 | 1.77 | 2.14 | 1.22 | 1.26 | 1.64 | 1.64 | | | | |
| PLACE1002532 | 8.72 | 6.46 | 7.19 | 6.81 | 6.68 | 6.18 | 7.67 | 10.12 | 10.12 | | | | |
| PLACE1002536 | 4.9 | 1.91 | 3.90 | 5.09 | 4.55 | 3.56 | 4.82 | 3.96 | 3.96 | | | | |
| PLACE1002537 | 3.14 | 1.37 | 1.42 | 3.63 | 3.37 | 4.11 | 2.67 | 3.94 | 3.94 | * | + | | |
| PLACE1002539 | 3.39 | 2.92 | 3.22 | 4.41 | 4.54 | 5.47 | 3.82 | 4.68 | 4.68 | * | + | * | + |
| PLACE1002547 | 5.53 | 5.37 | 5.59 | 8.39 | 7.22 | 9.28 | 8.89 | 10.18 | 10.18 | ** | + | ** | + |
| PLACE1002571 | 4.43 | 2.94 | 4.05 | 4.84 | 4.88 | 7.44 | 4.32 | 5.08 | 5.08 | | | | |
| PLACE1002578 | 5.19 | 3.96 | 3.76 | 12.25 | 10.98 | 12.86 | 5.35 | 7.25 | 7.25 | ** | + | * | + |
| PLACE1002583 | 1.66 | 0.32 | 1.44 | 1.04 | 1.08 | 1.16 | 1.18 | 0.97 | 0.97 | | | | |
| PLACE1002591 | 3.86 | 2.09 | 2.10 | 2.84 | 2.83 | 2.65 | 2.44 | 2.62 | 2.62 | | | | |
| PLACE1002598 | 3.84 | 2.11 | 2.49 | 1.35 | 1.31 | 2.14 | 2.05 | 2.70 | 2.7 | | | | |
| PLACE1002604 | 2.65 | 2.17 | 1.64 | 2.8 | 3.94 | 3.24 | 2.45 | 2.54 | 2.54 | | | | |
| PLACE1002612 | 8.01 | 6.63 | 6.63 | 12.1 | 11.80 | 12.23 | 8.71 | 11.33 | 11.33 | ** | + | * | + |
| PLACE1002625 | 2.58 | 1.69 | 1.51 | 2.59 | 2.61 | 4.00 | 1.54 | 3.25 | 3.25 | | | | |
| PLACE1002638 | 2.18 | 2.76 | 3.22 | 4.42 | 3.44 | 3.29 | 2.42 | 3.06 | 3.06 | | | | |
| PLACE1002655 | 3.25 | 4.16 | 4.18 | 10.46 | 6.84 | 7.33 | 3.29 | 5.31 | 5.31 | * | + | | |
| PLACE1002665 | 4.13 | 3.33 | 2.98 | 6.38 | 8.85 | 5.64 | 3.53 | 3.33 | 3.33 | * | + | | |
| PLACE1002685 | 5.53 | 3.42 | 2.72 | 4.03 | 3.03 | 3.10 | 2.10 | 4.59 | 4.59 | | | | |
| PLACE1002692 | 8.81 | 6.44 | 4.56 | 11.47 | 12.80 | 10.48 | 5.21 | 5.98 | 5.98 | * | + | | |
| PLACE1002714 | 6.78 | 4.06 | 3.36 | 6.88 | 8.05 | 6.09 | 4.05 | 4.56 | 4.56 | | | | |

TABLE 298-continued

| PLACE1002721 | 6.84 | 4.40 | 5.49 | 7.7 | 6.58 | 8.37 | 3.72 | 4.94 | 4.94 | | | | |
|---|---|---|---|---|---|---|---|---|---|---|---|---|---|
| PLACE1002722 | 0.74 | 0.78 | 0.84 | 1.77 | 1.11 | 1.67 | 0.84 | 1.69 | 1.69 | * | + | | |
| PLACE1002726 | 3.49 | 5.71 | 5.81 | 8.46 | 6.47 | 7.89 | 5.02 | 5.08 | 5.08 | | | | |
| PLACE1002756 | 3.26 | 2.58 | 3.14 | 6.13 | 6.45 | 6.35 | 3.62 | 4.77 | 4.77 | ** | + | * | + |
| PLACE1002768 | 3.97 | 1.25 | 1.67 | 3.3 | 2.50 | 2.51 | 2.78 | 3.00 | 3 | | | | |
| PLACE1002772 | 1.35 | 0.09 | 0.96 | 0.92 | 1.25 | 1.40 | 1.29 | 1.37 | 1.37 | | | | |
| PLACE1002775 | 14.42 | 7.79 | 9.64 | 10.55 | 11.21 | 17.27 | 12.36 | 11.82 | 11.82 | | | | |
| PLACE1002780 | 1.98 | 1.39 | 1.23 | 1.94 | 2.57 | 3.18 | 3.07 | 5.79 | 5.79 | | | * | + |
| PLACE1002782 | 3.02 | 0.85 | 1.61 | 1.99 | 1.37 | 3.05 | 1.65 | 1.52 | 1.52 | | | | |
| PLACE1002794 | 2.49 | 1.48 | 2.20 | 1.75 | 2.76 | 3.63 | 2.18 | 2.11 | 2.11 | | | | |
| PLACE1002795 | 1.27 | 0.70 | 0.60 | 1.08 | 1.69 | 1.49 | 0.76 | 0.93 | 0.93 | | | | |
| PLACE1002811 | 3.67 | 1.25 | 0.81 | 2.9 | 2.86 | 1.50 | 2.33 | 2.50 | 2.5 | | | | |
| PLACE1002815 | 5.44 | 2.94 | 2.29 | 7.27 | 15.00 | 10.36 | 12.84 | 16.74 | 16.74 | * | + | ** | + |
| PLACE1002816 | 8.2 | 3.96 | 3.92 | 6.25 | 6.25 | 6.46 | 5.01 | 6.23 | 6.23 | | | | |
| PLACE1002822 | 3.34 | 1.86 | 2.08 | 2.36 | 4.04 | 3.46 | 2.71 | 3.36 | 3.36 | | | | |
| PLACE1002833 | 7.79 | 2.79 | 4.10 | 8.87 | 10.15 | 5.51 | 5.02 | 6.82 | 6.82 | | | | |
| PLACE1002834 | 10.13 | 4.35 | 5.31 | 13.91 | 16.58 | 13.43 | 4.69 | 8.55 | 8.55 | * | + | | |
| PLACE1002835 | 10.05 | 3.42 | 5.57 | 6.59 | 4.99 | 6.00 | 6.06 | 6.48 | 6.48 | | | | |
| PLACE1002839 | 1.69 | 0.45 | 1.30 | 1.57 | 1.51 | 2.09 | 0.58 | 1.24 | 1.24 | | | | |
| PLACE1002851 | 0.76 | 0.42 | 0.82 | 8.19 | 10.42 | 3.82 | 2.14 | 3.56 | 3.56 | * | + | ** | + |
| PLACE1002853 | 2.74 | 1.59 | 0.90 | 3.41 | 5.47 | 2.91 | 2.59 | 4.00 | 4 | | | | |
| PLACE1002881 | 6.4 | 4.73 | 3.84 | 9.33 | 10.46 | 8.15 | 5.45 | 5.65 | 5.65 | * | + | | |
| PLACE1002901 | 24.97 | 13.25 | 21.58 | 24.2 | 26.27 | 27.37 | 19.88 | 33.42 | 33.42 | | | | |
| PLACE1002904 | 1.92 | 2.64 | 1.54 | 1.71 | 2.53 | 1.56 | 1.90 | 1.68 | 1.68 | | | | |
| PLACE1002905 | 3.55 | 1.81 | 2.93 | 4.92 | 3.38 | 5.48 | 3.25 | 4.03 | 4.03 | | | | |
| PLACE1002908 | 3.03 | 1.68 | 2.53 | 3.06 | 3.13 | 3.59 | 2.41 | 3.70 | 3.7 | | | | |
| PLACE1002911 | 17.43 | 10.47 | 13.64 | 12.95 | 9.50 | 14.36 | 14.97 | 14.68 | 14.68 | | | | |
| PLACE1002941 | 4.78 | 1.82 | 1.86 | 3.71 | 4.48 | 2.93 | 2.39 | 2.15 | 2.15 | | | | |
| PLACE1002950 | 9.17 | 5.50 | 4.49 | 8.77 | 14.38 | 6.75 | 5.85 | 4.90 | 4.9 | | | | |
| PLACE1002955 | 30.87 | 12.83 | 9.17 | 24.34 | 31.40 | 20.44 | 28.45 | 32.62 | 32.62 | | | | |
| PLACE1002958 | 12.6 | 6.07 | 8.49 | 13.92 | 20.27 | 16.63 | 20.63 | 26.24 | 26.24 | * | + | ** | + |
| PLACE1002962 | 1.57 | 0.87 | 0.79 | 1.15 | 2.51 | 1.72 | 1.24 | 1.43 | 1.43 | | | | |

TABLE 299

| PLACE1002967 | 5.1 | 2.51 | 3.09 | 6.76 | 6.45 | 5.80 | 4.18 | 4.06 | 4.06 | * | + | | |
|---|---|---|---|---|---|---|---|---|---|---|---|---|---|
| PLACE1002968 | 1.23 | 0.90 | 0.78 | 1.96 | 2.73 | 1.63 | 1.67 | 2.25 | 2.25 | * | + | ** | + |
| PLACE1002976 | 14.62 | 6.59 | 8.58 | 14.43 | 17.81 | 21.24 | 10.88 | 15.26 | 15.26 | | | | |
| PLACE1002991 | 9.09 | 3.33 | 5.17 | 10.69 | 10.94 | 9.19 | 4.59 | 4.38 | 4.38 | | | | |
| PLACE1002993 | 4.97 | 3.72 | 3.40 | 7.49 | 6.57 | 6.94 | 4.40 | 4.67 | 4.67 | ** | + | | |
| PLACE1002996 | 4.17 | 2.53 | 2.14 | 3.73 | 3.53 | 2.43 | 2.53 | 3.20 | 3.2 | | | | |
| PLACE1003010 | 14.09 | 9.21 | 8.66 | 11.39 | 9.01 | 12.05 | 11.70 | 11.85 | 11.85 | | | | |
| PLACE1003025 | 3.37 | 1.92 | 1.25 | 3.12 | 3.46 | 2.82 | 2.56 | 2.83 | 2.83 | | | | |
| PLACE1003027 | 2.78 | 1.30 | 1.63 | 3.36 | 4.14 | 4.94 | 2.51 | 3.33 | 3.33 | * | + | | |
| PLACE1003044 | 5.29 | 2.38 | 3.63 | 5.05 | 4.60 | 4.39 | 4.30 | 3.74 | 3.74 | | | | |
| PLACE1003045 | 1.31 | 0.14 | 0.41 | 1.12 | 0.74 | 1.58 | 0.92 | 1.66 | 1.66 | | | | |
| PLACE1003052 | 5.81 | 2.44 | 2.52 | 4.24 | 6.72 | 5.03 | 2.74 | 4.06 | 4.06 | | | | |
| PLACE1003083 | 1.98 | 0.63 | 0.30 | 1.59 | 1.48 | 1.45 | 1.09 | 1.36 | 1.36 | | | | |
| PLACE1003085 | 8.86 | 4.56 | 4.41 | 4.48 | 5.13 | 3.76 | 5.79 | 5.25 | 5.25 | | | | |
| PLACE1003092 | 4.95 | 2.80 | 2.49 | 4.61 | 7.21 | 5.11 | 3.15 | 5.59 | 5.59 | | | | |
| PLACE1003097 | 2.48 | 1.08 | 1.75 | 2.13 | 2.19 | 3.46 | 1.83 | 1.87 | 1.87 | | | | |
| PLACE1003100 | 5.55 | 3.04 | 3.54 | 4.48 | 2.63 | 4.78 | 3.66 | 4.38 | 4.38 | | | | |
| PLACE1003108 | 2.43 | 2.01 | 1.88 | 3.79 | 4.20 | 5.56 | 3.02 | 3.15 | 3.15 | * | + | ** | + |
| PLACE1003115 | 5.59 | 4.45 | 4.08 | 5.2 | 3.47 | 4.38 | 3.94 | 4.36 | 4.36 | | | | |
| PLACE1003120 | 9.1 | 5.05 | 6.99 | 11.92 | 11.69 | 8.39 | 4.33 | 5.35 | 5.35 | | | | |
| PLACE1003135 | 7.15 | 3.42 | 2.81 | 2 | 1.71 | 2.50 | 1.33 | 2.53 | 2.53 | | | | |
| PLACE1003136 | 9.4 | 3.19 | 5.96 | 7.56 | 7.72 | 8.01 | 6.80 | 8.18 | 8.18 | | | | |
| PLACE1003141 | 1.43 | 1.20 | 0.97 | 1.12 | 1.71 | 2.12 | 1.29 | 2.62 | 2.62 | | | | |
| PLACE1003145 | 1.17 | 1.98 | 1.88 | 1.29 | 0.85 | 1.19 | 1.52 | 2.74 | 2.74 | | | | |
| PLACE1003147 | 3.88 | 1.84 | 2.10 | 3.04 | 3.09 | 5.16 | 2.94 | 6.44 | 6.44 | | | | |
| PLACE1003153 | 2.04 | 1.22 | 1.34 | 1.76 | 3.27 | 2.50 | 1.12 | 2.13 | 2.13 | | | | |
| PLACE1003163 | 5.21 | 2.54 | 2.21 | 3.71 | 2.70 | 3.59 | 1.58 | 3.29 | 3.29 | | | | |
| PLACE1003172 | 17.21 | 13.29 | 11.63 | 20.51 | 17.81 | 16.21 | 12.82 | 14.76 | 14.76 | | | | |
| PLACE1003174 | 1.86 | 0.95 | 0.96 | 2.33 | 2.68 | 2.13 | 2.07 | 2.85 | 2.85 | * | + | * | + |
| PLACE1003176 | 1.87 | 0.85 | 0.99 | 0.69 | 1.79 | 1.46 | 1.77 | 2.02 | 2.02 | | | | |
| PLACE1003181 | 2.42 | 1.29 | 1.30 | 1.36 | 1.88 | 1.93 | 2.33 | 2.76 | 2.76 | | | | |
| PLACE1003184 | 4.02 | 2.35 | 1.57 | 1.09 | 1.42 | 1.68 | 2.02 | 2.95 | 2.95 | | | | |
| PLACE1003190 | 12.59 | 7.17 | 8.42 | 3.7 | 4.03 | 4.95 | 5.55 | 3.22 | 3.22 | * | − | * | − |
| PLACE1003200 | 0.16 | 0.08 | 0.11 | 0.98 | 0.55 | 0.76 | 0.91 | 1.63 | 1.63 | ** | + | ** | + |
| PLACE1003205 | 10.63 | 4.75 | 4.99 | 13.42 | 19.02 | 15.56 | 5.60 | 9.62 | 9.62 | * | + | | |
| PLACE1003209 | 1.33 | 0.58 | 0.91 | 1.06 | 1.71 | 1.13 | 1.44 | 1.84 | 1.84 | | | * | + |
| PLACE1003214 | 3.74 | 1.92 | 0.96 | 2.48 | 3.08 | 2.07 | 2.80 | 1.58 | 1.58 | | | | |
| PLACE1003229 | 4.01 | 2.47 | 1.89 | 4.67 | 6.17 | 5.71 | 3.46 | 3.20 | 3.2 | * | + | | |
| PLACE1003238 | 0.55 | 1.29 | 0.72 | 1.01 | 1.04 | 1.42 | 1.89 | 4.82 | 4.82 | | | * | + |
| PLACE1003249 | 4.21 | 2.68 | 2.29 | 5.89 | 6.34 | 7.49 | 3.21 | 4.18 | 4.18 | ** | + | | |
| PLACE1003256 | 15.42 | 10.76 | 11.86 | 18.06 | 20.59 | 21.48 | 20.54 | 17.58 | 17.58 | * | + | * | + |

TABLE 299-continued

| | | | | | | | | | | | | | |
|---|---|---|---|---|---|---|---|---|---|---|---|---|---|
| PLACE1003258 | 1.59 | 3.70 | 0.75 | 1.91 | 1.78 | 1.15 | 1.24 | 1.39 | 1.39 | | | | |
| PLACE1003279 | 5.6 | 4.25 | 1.88 | 7.33 | 8.87 | 7.26 | 3.36 | 5.26 | 5.26 | * | + | | |
| PLACE1003294 | 5.96 | 3.04 | 2.55 | 5.19 | 4.93 | 5.17 | 2.65 | 4.69 | 4.69 | | | | |
| PLACE1003296 | 3.69 | 1.73 | 1.93 | 4.06 | 3.41 | 2.82 | 2.94 | 3.29 | 3.29 | | | | |
| PLACE1003297 | 6.38 | 2.82 | 3.60 | 6.92 | 8.35 | 6.63 | 3.36 | 5.38 | 5.38 | | | | |
| PLACE1003302 | 6.92 | 3.76 | 5.11 | 9.34 | 12.52 | 9.10 | 7.08 | 7.90 | 7.9 | * | + | | |
| PLACE1003334 | 0.67 | 1.10 | 1.68 | 2.93 | 3.55 | 4.00 | 2.24 | 3.22 | 3.22 | ** | + | * | + |
| PLACE1003337 | 10.11 | 6.39 | 4.50 | 7.53 | 11.58 | 10.30 | 6.19 | 6.17 | 6.17 | | | | |
| PLACE1003342 | 1.8 | 1.54 | 1.48 | 1.86 | 2.85 | 3.11 | 2.71 | 3.37 | 3.37 | | | ** | + |
| PLACE1003343 | 0.54 | 0.36 | 0.34 | 0.71 | 0.79 | 1.22 | 0.47 | 0.55 | 0.55 | * | + | | |
| PLACE1003344 | 24.27 | 18.53 | 13.01 | 17.74 | 21.43 | 22.39 | 17.02 | 18.57 | 18.57 | | | | |
| PLACE1003353 | 17.73 | 10.09 | 9.18 | 16.17 | 17.86 | 14.13 | 8.53 | 9.79 | 9.79 | | | | |
| PLACE1003361 | 5.88 | 2.41 | 3.54 | 11.34 | 11.94 | 9.89 | 3.99 | 5.89 | 5.89 | ** | + | | |
| PLACE1003366 | 6.48 | 3.29 | 5.05 | 6.5 | 8.30 | 6.96 | 4.61 | 4.25 | 4.25 | | | | |
| PLACE1003369 | 2.89 | 2.16 | 1.46 | 3.79 | 2.79 | 2.98 | 2.58 | 2.98 | 2.98 | | | | |

TABLE 300

| | | | | | | | | | | | | | |
|---|---|---|---|---|---|---|---|---|---|---|---|---|---|
| PLACE1003372 | 4.86 | 3.69 | 3.10 | 6.36 | 6.08 | 6.40 | 5.24 | 6.26 | 6.26 | * | + | * | + |
| PLACE1003373 | 4.59 | 2.14 | 1.77 | 6.44 | 8.87 | 7.14 | 3.34 | 3.58 | 3.58 | * | + | | |
| PLACE1003375 | 1.64 | 2.20 | 2.31 | 1.72 | 2.46 | 2.62 | 1.19 | 1.43 | 1.43 | | | * | − |
| PLACE1003378 | 2.12 | 1.60 | 1.04 | 2.23 | 1.84 | 1.68 | 2.18 | 2.69 | 2.69 | | | | |
| PLACE1003383 | 2.45 | 1.53 | 0.51 | 2.22 | 2.04 | 0.76 | 1.14 | 1.36 | 1.36 | | | | |
| PLACE1003394 | 8.16 | 3.88 | 4.89 | 10.77 | 12.17 | 8.54 | 8.17 | 10.02 | 10.02 | * | + | | |
| PLACE1003401 | 3.67 | 0.79 | 0.99 | 1.2 | 1.46 | 1.82 | 0.45 | 1.86 | 1.86 | | | | |
| PLACE1003405 | 6.01 | 6.00 | 6.98 | 4.76 | 7.61 | 8.04 | 6.47 | 7.65 | 7.65 | | | | |
| PLACE1003407 | 4.49 | 4.04 | 3.71 | 5.05 | 5.22 | 5.15 | 5.12 | 5.61 | 5.61 | * | + | ** | + |
| PLACE1003420 | 4.75 | 4.07 | 3.59 | 7.55 | 10.89 | 8.12 | 4.15 | 6.01 | 6.01 | * | + | | |
| PLACE1003428 | 2.19 | 2.41 | 3.05 | 3.29 | 4.02 | 4.47 | 2.16 | 2.43 | 2.43 | * | + | | |
| PLACE1003432 | 7.17 | 3.85 | 3.68 | 4.37 | 7.22 | 7.66 | 3.81 | 6.34 | 6.34 | | | | |
| PLACE1003438 | 9.06 | 3.37 | 4.39 | 5.86 | 7.12 | 5.43 | 5.87 | 7.15 | 7.15 | | | | |
| PLACE1003452 | 3.13 | 1.08 | 2.21 | 1.29 | 5.01 | 2.29 | 2.22 | 2.52 | 2.52 | | | | |
| PLACE1003454 | 8.4 | 4.68 | 5.18 | 7.33 | 6.34 | 9.17 | 4.92 | 7.46 | 7.46 | | | | |
| PLACE1003455 | 13.75 | 5.01 | 6.05 | 6.83 | 8.91 | 9.83 | 8.45 | 9.21 | 9.21 | | | | |
| PLACE1003456 | 7.28 | 4.38 | 4.13 | 10.64 | 12.00 | 13.60 | 7.62 | 7.20 | 7.2 | ** | + | | |
| PLACE1003460 | 7.84 | 3.76 | 6.10 | 10.15 | 7.44 | 7.77 | 6.55 | 7.66 | 7.66 | | | | |
| PLACE1003478 | 3.33 | 0.56 | 0.93 | 2.01 | 1.78 | 1.24 | 0.65 | 0.96 | 0.96 | | | | |
| PLACE1003484 | 7.55 | 4.57 | 2.88 | 11.32 | 16.35 | 7.83 | 7.21 | 9.47 | 9.47 | | | | |
| PLACE1003493 | 14.03 | 6.96 | 6.73 | 11.22 | 11.97 | 14.63 | 9.74 | 9.34 | 9.34 | | | | |
| PLACE1003503 | 42.11 | 19.93 | 34.28 | 29.63 | 36.26 | 35.89 | 25.50 | 29.49 | 29.49 | | | | |
| PLACE1003505 | 2.24 | 1.06 | 0.89 | 0.91 | 0.90 | 1.59 | 2.08 | 1.73 | 1.73 | | | | |
| PLACE1003516 | 1.01 | 0.49 | 0.89 | 2.17 | 2.40 | 2.58 | 1.68 | 1.86 | 1.86 | ** | + | ** | + |
| PLACE1003519 | 39.78 | 23.99 | 30.04 | 55.6 | 50.01 | 57.71 | 22.97 | 28.09 | 28.09 | * | + | | |
| PLACE1003520 | 45.85 | 22.30 | 34.27 | 66.52 | 30.94 | 72.87 | 38.79 | 44.73 | 44.73 | | | | |
| PLACE1003521 | 1.43 | 0.65 | 0.89 | 2.33 | 3.32 | 0.95 | 2.10 | 3.87 | 3.87 | | | * | + |
| PLACE1003525 | 15.69 | 8.19 | 8.09 | 12.57 | 19.45 | 12.58 | 15.38 | 18.26 | 18.26 | | | | |
| PLACE1003528 | 126.72 | 75.71 | 77.51 | 102.34 | 128.72 | 89.84 | 56.09 | 57.39 | 57.39 | | | | |
| PLACE1003529 | 10.31 | 6.25 | 7.90 | 10.63 | 11.63 | 11.54 | 9.31 | 9.78 | 9.78 | | | | |
| PLACE1003537 | 3.45 | 1.76 | 2.18 | 3.36 | 4.60 | 3.48 | 5.58 | 5.15 | 5.15 | | | ** | + |
| PLACE1003549 | 3.96 | 2.80 | 3.67 | 4.57 | 2.88 | 5.08 | 2.97 | 4.32 | 4.32 | | | | |
| PLACE1003553 | 6.15 | 2.35 | 3.07 | 4.85 | 4.12 | 5.00 | 3.14 | 3.29 | 3.29 | | | | |
| PLACE1003566 | 5.25 | 2.36 | 2.80 | 5.45 | 5.03 | 6.90 | 4.92 | 5.27 | 5.27 | | | | |
| PLACE1003568 | 1.39 | 1.43 | 0.56 | 1.66 | 1.56 | 1.27 | 1.01 | 0.83 | 0.83 | | | | |
| PLACE1003573 | 2.04 | 1.89 | 1.09 | 2.09 | 2.81 | 1.71 | 1.61 | 1.69 | 1.69 | | | | |
| PLACE1003575 | 3.94 | 2.36 | 1.55 | 4.2 | 5.03 | 5.48 | 3.67 | 2.41 | 2.41 | * | + | | |
| PLACE1003583 | 1.25 | 0.21 | 0.91 | 0.63 | 1.54 | 1.28 | 1.19 | 0.85 | 0.85 | | | | |
| PLACE1003584 | 3.17 | 2.52 | 1.33 | 5.76 | 4.75 | 5.94 | 2.30 | 3.30 | 3.3 | ** | + | * | + |
| PLACE1003592 | 6.37 | 4.34 | 3.44 | 8.54 | 12.20 | 11.57 | 7.98 | 8.85 | 8.85 | * | + | * | + |
| PLACE1003593 | 0.73 | 1.09 | 0.64 | 1.3 | 1.69 | 1.81 | 0.49 | 1.57 | 1.57 | * | + | | |
| PLACE1003594 | 16.13 | 4.42 | 11.69 | 14.87 | 17.87 | 21.56 | 10.51 | 11.29 | 11.29 | | | | |
| PLACE1003596 | 5.64 | 5.18 | 5.93 | 10.49 | 15.28 | 7.57 | 7.20 | 9.60 | 9.6 | | | * | + |
| PLACE1003598 | 13.48 | 8.08 | 6.25 | 8.41 | 8.96 | 8.69 | 7.81 | 8.78 | 8.78 | | | | |
| PLACE1003602 | 3.72 | 2.13 | 1.45 | 3.5 | 3.57 | 3.37 | 2.64 | 3.45 | 3.45 | | | | |
| PLACE1003605 | 18.39 | 10.93 | 10.02 | 16.96 | 17.66 | 21.30 | 9.74 | 14.50 | 14.5 | | | | |
| PLACE1003611 | 3.07 | 0.86 | 1.19 | 2.62 | 2.97 | 3.49 | 1.69 | 2.05 | 2.05 | | | | |
| PLACE1003618 | 2.42 | 0.71 | 0.96 | 1.64 | 1.41 | 1.56 | 1.78 | 2.12 | 2.12 | | | | |
| PLACE1003625 | 3.62 | 1.30 | 2.39 | 3.11 | 4.04 | 4.15 | 3.30 | 3.49 | 3.49 | | | | |
| PLACE1003626 | 13.07 | 5.94 | 8.16 | 14.48 | 13.10 | 14.74 | 12.62 | 11.51 | 11.51 | | | | |
| PLACE1003630 | 3.48 | 2.42 | 1.94 | 3.18 | 3.39 | 2.97 | 3.11 | 3.27 | 3.27 | | | | |
| PLACE1003635 | 2.04 | 1.03 | 1.44 | 2.07 | 2.17 | 2.34 | 1.81 | 1.67 | 1.67 | | | | |
| PLACE1003638 | 3.27 | 2.36 | 1.79 | 4.52 | 4.52 | 3.82 | 3.33 | 3.31 | 3.31 | * | + | | |
| PLACE1003644 | 3.31 | 2.33 | 2.10 | 5.21 | 5.95 | 5.73 | 4.05 | 4.05 | 4.05 | ** | + | * | + |
| PLACE1003654 | 4.23 | 1.54 | 1.89 | 1.81 | 2.78 | 2.00 | 0.89 | 2.32 | 2.32 | | | | |
| PLACE1003656 | 2.23 | 0.80 | 1.38 | 1.4 | 1.47 | 1.90 | 1.48 | 2.10 | 2.1 | | | | |

TABLE 301

| | | | | | | | | | | | | | |
|---|---|---|---|---|---|---|---|---|---|---|---|---|---|
| PLACE1003660 | 3.6 | 2.90 | 2.17 | 3.69 | 3.98 | 5.22 | 2.65 | 3.15 | 3.15 | | | | |
| PLACE1003669 | 3.72 | 1.83 | 1.76 | 4.6 | 5.24 | 5.00 | 3.90 | 4.38 | 4.38 | * | + | | |
| PLACE1003670 | 15.52 | 7.07 | 8.39 | 9.52 | 9.26 | 10.68 | 8.82 | 8.03 | 8.03 | | | | |
| PLACE1003671 | 4.94 | 3.13 | 2.14 | 3.75 | 4.23 | 3.08 | 3.20 | 4.09 | 4.09 | | | | |
| PLACE1003697 | 3.08 | 0.80 | 1.06 | 3.54 | 2.83 | 2.50 | 7.26 | 8.03 | 8.03 | | | ** | + |
| PLACE1003704 | 11.2 | 5.78 | 7.63 | 14.43 | 11.92 | 13.54 | 6.97 | 9.55 | 9.55 | * | + | | |
| PLACE1003709 | 4.98 | 0.98 | 1.82 | 0.79 | 0.50 | 1.26 | 1.00 | 1.96 | 1.96 | | | | |
| PLACE1003711 | 5.06 | 3.03 | 2.94 | 3.49 | 4.07 | 3.66 | 3.26 | 4.30 | 4.3 | | | | |
| PLACE1003723 | 4.06 | 2.93 | 3.32 | 6.92 | 5.34 | 6.03 | 4.19 | 5.65 | 5.65 | ** | + | * | + |
| PLACE1003724 | 9.61 | 5.81 | 6.68 | 10.85 | 14.36 | 13.13 | 7.86 | 7.40 | 7.4 | * | + | | |
| PLACE1003737 | 1.82 | 0.70 | 1.20 | 1.4 | 2.78 | 1.47 | 0.99 | 1.14 | 1.14 | | | | |
| PLACE1003738 | 4.42 | 2.23 | 2.32 | 2.25 | 3.92 | 3.77 | 2.75 | 4.94 | 4.94 | | | | |
| PLACE1003742 | 4.22 | 2.78 | 3.39 | 5.61 | 5.88 | 6.94 | 5.65 | 8.11 | 8.11 | * | + | * | + |
| PLACE1003744 | 10.38 | 5.06 | 4.96 | 6 | 6.16 | 5.58 | 7.58 | 7.15 | 7.15 | | | | |
| PLACE1003758 | 2.34 | 1.24 | 1.52 | 3.36 | 2.67 | 2.23 | 1.96 | 3.95 | 3.95 | | | | |
| PLACE1003760 | 12.25 | 10.24 | 12.40 | 34.22 | 35.40 | 36.07 | 24.12 | 29.73 | 29.73 | ** | + | ** | + |
| PLACE1003762 | 3.15 | 2.22 | 1.75 | 4.15 | 5.03 | 5.81 | 2.19 | 3.25 | 3.25 | * | + | | |
| PLACE1003765 | 3.6 | 2.58 | 2.17 | 4.49 | 5.32 | 6.00 | 3.44 | 2.48 | 2.48 | * | + | | |
| PLACE1003768 | 2.32 | 0.82 | 0.97 | 3.88 | 3.45 | 2.85 | 1.41 | 2.13 | 2.13 | * | + | | |
| PLACE1003771 | 1.14 | 0.42 | 0.47 | 3.82 | 4.60 | 4.57 | 2.76 | 2.88 | 2.88 | ** | + | ** | + |
| PLACE1003772 | 15.91 | 10.99 | 11.28 | 22.4 | 31.67 | 17.46 | 9.36 | 14.35 | 14.35 | | | | |
| PLACE1003783 | 1.42 | 1.64 | 0.56 | 2.3 | 1.57 | 1.94 | 2.32 | 2.86 | 2.86 | | | * | + |
| PLACE1003784 | 1.03 | 0.77 | 0.68 | 0.97 | 1.55 | 1.05 | 1.26 | 0.82 | 0.82 | | | | |
| PLACE1003788 | 1.09 | 0.76 | 0.74 | 1.58 | 0.81 | 1.20 | 1.20 | 1.12 | 1.12 | | | | |
| PLACE1003795 | 3.57 | 3.15 | 3.29 | 4.82 | 6.11 | 5.73 | 4.14 | 3.97 | 3.97 | ** | + | ** | + |
| PLACE1003827 | 4.25 | 3.25 | 4.26 | 3.97 | 4.73 | 4.26 | 4.86 | 4.32 | 4.32 | | | | |
| PLACE1003833 | 5.49 | 4.93 | 3.72 | 7.29 | 6.79 | 7.39 | 4.43 | 6.36 | 6.36 | * | + | | |
| PLACE1003839 | 15.63 | 9.41 | 9.25 | 19.2 | 21.48 | 17.62 | 11.21 | 10.43 | 10.43 | * | + | | |
| PLACE1003845 | 7.01 | 4.24 | 4.12 | 7.35 | 7.87 | 5.86 | 10.74 | 9.90 | 9.9 | | | ** | + |
| PLACE1003850 | 8.77 | 5.05 | 5.31 | 6.16 | 11.18 | 6.64 | 4.92 | 6.94 | 6.94 | | | | |
| PLACE1003852 | 1.98 | 0.95 | 1.19 | 2.52 | 2.43 | 1.55 | 2.10 | 2.14 | 2.14 | | | | |
| PLACE1003858 | 1.86 | 1.56 | 1.42 | 0.9 | 3.73 | 1.64 | 1.18 | 2.61 | 2.61 | | | | |
| PLACE1003861 | 3.4 | 2.90 | 2.88 | 4.73 | 4.58 | 4.45 | 3.62 | 4.50 | 4.5 | ** | + | * | + |
| PLACE1003864 | 2.18 | 1.73 | 1.70 | 2.15 | 2.33 | 2.94 | 1.58 | 1.90 | 1.9 | | | | |
| PLACE1003870 | 6.85 | 4.56 | 2.90 | 9.94 | 13.82 | 9.81 | 3.57 | 5.78 | 5.78 | * | + | | |
| PLACE1003885 | 3.97 | 2.09 | 1.62 | 4.09 | 4.19 | 2.32 | 1.33 | 1.78 | 1.78 | | | | |
| PLACE1003886 | 6.25 | 3.53 | 4.72 | 4.17 | 5.68 | 4.34 | 4.84 | 5.28 | 5.28 | | | | |
| PLACE1003888 | 2.5 | 2.14 | 1.29 | 2.33 | 2.24 | 2.51 | 1.57 | 1.20 | 1.2 | | | | |
| PLACE1003892 | 0.63 | 0.82 | 0.35 | 1.2 | 1.75 | 1.76 | 1.12 | 1.37 | 1.37 | * | + | * | + |
| PLACE1003900 | 2.12 | 3.11 | 2.67 | 2.84 | 3.42 | 2.21 | 3.08 | 3.08 | 3.08 | | | | |
| PLACE1003902 | 2.67 | 2.85 | 2.44 | 2.17 | 3.06 | 3.38 | 2.09 | 2.93 | 2.93 | | | | |
| PLACE1003903 | 3.07 | 2.52 | 2.90 | 2.6 | 2.59 | 4.30 | 2.16 | 2.90 | 2.9 | | | | |
| PLACE1003915 | 2.93 | 1.59 | 2.90 | 5.14 | 5.88 | 4.52 | 4.31 | 3.51 | 3.51 | * | + | | |
| PLACE1003918 | 6.79 | 4.23 | 4.22 | 10.17 | 14.99 | 6.89 | 4.36 | 4.29 | 4.29 | | | | |
| PLACE1003923 | 2.38 | 0.83 | 1.07 | 2.53 | 2.23 | 1.52 | 2.50 | 2.86 | 2.86 | | | | |
| PLACE1003932 | 6.11 | 3.09 | 2.41 | 4.35 | 4.43 | 3.41 | 2.40 | 3.60 | 3.6 | | | | |
| PLACE1003936 | 3.26 | 3.57 | 2.07 | 4.2 | 6.78 | 4.35 | 2.70 | 3.36 | 3.36 | | | | |
| PLACE1003966 | 2.8 | 1.71 | 1.81 | 3.31 | 3.64 | 3.17 | 2.63 | 3.00 | 3 | * | + | | |
| PLACE1003968 | 3.23 | 5.15 | 4.73 | 6.02 | 6.25 | 7.79 | 6.80 | 6.11 | 6.11 | * | + | * | + |
| PLACE1004018 | 3.13 | 3.22 | 4.15 | 3.49 | 4.47 | 4.76 | 3.66 | 5.03 | 5.03 | | | | |
| PLACE1004020 | 8.8 | 4.07 | 3.96 | 10.35 | 11.19 | 10.96 | 7.35 | 8.57 | 8.57 | * | + | | |
| PLACE1004028 | 2.58 | 0.63 | 1.65 | 1.41 | 1.48 | 2.22 | 1.55 | 1.12 | 1.12 | | | | |
| PLACE1004034 | 14.58 | 6.23 | 5.10 | 4.38 | 6.92 | 4.97 | 2.01 | 1.93 | 1.93 | | | | |
| PLACE1004042 | 13.64 | 6.23 | 8.71 | 10.86 | 12.72 | 14.34 | 11.39 | 17.16 | 17.16 | | | | |
| PLACE1004078 | 4.38 | 2.37 | 2.45 | 5.69 | 4.75 | 6.84 | 3.40 | 5.09 | 5.09 | * | + | | |
| PLACE1004103 | 7.95 | 4.34 | 4.17 | 15.49 | 14.70 | 18.99 | 9.99 | 10.73 | 10.73 | ** | + | * | + |

TABLE 302

| | | | | | | | | | | | | | |
|---|---|---|---|---|---|---|---|---|---|---|---|---|---|
| PLACE1004104 | 2.15 | 1.27 | 0.85 | 1.43 | 1.39 | 2.13 | 1.09 | 2.01 | 2.01 | | | | |
| PLACE1004113 | 4.08 | 1.68 | 3.31 | 4.6 | 4.46 | 4.54 | 3.36 | 3.05 | 3.05 | | | | |
| PLACE1004114 | 2.54 | 0.84 | 0.51 | 1.58 | 2.53 | 1.82 | 2.42 | 1.88 | 1.88 | | | | |
| PLACE1004118 | 1.98 | 1.29 | 1.42 | 1.63 | 4.01 | 2.38 | 1.61 | 2.11 | 2.11 | | | | |
| PLACE1004128 | 12.83 | 9.07 | 9.04 | 8.02 | 8.50 | 9.63 | 5.06 | 6.17 | 6.17 | | | * | − |
| PLACE1004130 | 2.24 | 2.05 | 1.32 | 1.83 | 3.44 | 3.33 | 2.12 | 1.72 | 1.72 | | | | |
| PLACE1004149 | 18 | 9.56 | 12.62 | 22.09 | 23.13 | 25.79 | 15.85 | 17.31 | 17.31 | * | + | | |
| PLACE1004156 | 8.66 | 4.78 | 4.97 | 11.23 | 13.14 | 12.83 | 5.87 | 8.14 | 8.14 | * | + | | |
| PLACE1004160 | 31.97 | 23.56 | 27.55 | 20.37 | 16.69 | 25.95 | 28.83 | 35.50 | 35.5 | | | | |
| PLACE1004161 | 12.19 | 6.98 | 6.65 | 7.81 | 8.30 | 9.68 | 8.49 | 8.65 | 8.65 | | | | |
| PLACE1004166 | 10.59 | 4.49 | 3.61 | 8.56 | 19.40 | 8.04 | 5.20 | 7.58 | 7.58 | | | | |
| PLACE1004168 | 9.22 | 3.40 | 4.94 | 7.74 | 9.05 | 6.39 | 5.52 | 5.88 | 5.88 | | | | |
| PLACE1004170 | 0.56 | 0.65 | 1.17 | 2.02 | 1.70 | 2.28 | 1.72 | 2.24 | 2.24 | ** | + | ** | + |
| PLACE1004178 | 5.68 | 2.50 | 3.59 | 4.97 | 6.58 | 6.01 | 4.61 | 7.20 | 7.2 | | | | |
| PLACE1004183 | 4.44 | 2.26 | 4.45 | 5.52 | 5.64 | 5.63 | 4.08 | 3.85 | 3.85 | | | | |
| PLACE1004197 | 1.06 | 1.17 | 1.74 | 1.07 | 1.49 | 1.13 | 2.10 | 1.67 | 1.67 | | | | |
| PLACE1004199 | 9.96 | 6.47 | 8.63 | 4.5 | 6.39 | 5.99 | 10.80 | 9.20 | 9.2 | | | | |

TABLE 302-continued

| | | | | | | | | | | | | | |
|---|---|---|---|---|---|---|---|---|---|---|---|---|---|
| PLACE1004203 | 6.09 | 3.61 | 5.37 | 4.74 | 4.70 | 4.68 | 5.77 | 5.62 | 5.62 | | | | |
| PLACE1004242 | 7.53 | 2.60 | 2.25 | 8.1 | 9.90 | 6.46 | 4.60 | 5.49 | 5.49 | | | | |
| PLACE1004249 | 25.51 | 14.54 | 13.20 | 20.9 | 26.96 | 19.21 | 17.71 | 21.13 | 21.13 | | | | |
| PLACE1004255 | 1.02 | 0.75 | 0.36 | 0.86 | 1.57 | 1.36 | 0.69 | 1.07 | 1.07 | | | | |
| PLACE1004256 | 4.42 | 1.01 | 3.09 | 9.24 | 13.36 | 13.94 | 12.44 | 10.96 | 10.96 | ** | + | ** | + |
| PLACE1004257 | 4.54 | 1.21 | 1.79 | 4.96 | 4.55 | 4.58 | 3.59 | 4.84 | 4.84 | | | | |
| PLACE1004258 | 3.59 | 2.38 | 2.35 | 2.98 | 2.70 | 2.85 | 3.20 | 2.02 | 2.02 | | | | |
| PLACE1004270 | 3.93 | 3.24 | 3.36 | 3.85 | 4.28 | 6.05 | 3.70 | 3.05 | 3.05 | | | | |
| PLACE1004272 | 4.04 | 2.85 | 3.28 | 3.85 | 5.74 | 5.17 | 3.42 | 6.23 | 6.23 | | | | |
| PLACE1004273 | 83.7 | 57.27 | 49.34 | 101.5 | 84.19 | 78.07 | 49.24 | 46.63 | 46.63 | | | | |
| PLACE1004274 | 2.95 | 0.92 | 1.52 | 1.53 | 2.26 | 1.62 | 1.54 | 1.70 | 1.7 | | | | |
| PLACE1004277 | 4.89 | 3.63 | 3.77 | 5.98 | 6.33 | 5.84 | 3.49 | 5.35 | 5.35 | * | + | | |
| PLACE1004279 | 4.14 | 2.37 | 2.56 | 4.12 | 4.89 | 5.01 | 2.41 | 5.41 | 5.41 | | | | |
| PLACE1004282 | 4.87 | 1.71 | 2.16 | 3.7 | 2.78 | 3.26 | 3.33 | 4.30 | 4.3 | | | | |
| PLACE1004284 | 5.6 | 3.43 | 5.55 | 7.94 | 7.12 | 9.08 | 5.18 | 6.08 | 6.08 | * | + | | |
| PLACE1004289 | 4.45 | 2.76 | 2.32 | 4.87 | 4.64 | 6.03 | 3.57 | 3.74 | 3.74 | | | | |
| PLACE1004299 | 3.82 | 1.87 | 1.73 | 3.07 | 2.88 | 4.42 | 3.05 | 2.95 | 2.95 | | | | |
| PLACE1004302 | 2.2 | 0.86 | 0.90 | 1.74 | 3.32 | 2.03 | 1.19 | 1.35 | 1.35 | | | | |
| PLACE1004305 | 3.85 | 2.26 | 1.59 | 1.85 | 1.24 | 2.43 | 2.28 | 2.58 | 2.58 | | | | |
| PLACE1004316 | 5.43 | 2.71 | 3.07 | 1.96 | 3.30 | 2.21 | 2.72 | 4.32 | 4.32 | | | | |
| PLACE1004322 | 1.43 | 0.69 | 0.73 | 1.49 | 2.28 | 1.46 | 1.11 | 2.06 | 2.06 | | | | |
| PLACE1004325 | 13.88 | 6.16 | 7.35 | 9.82 | 9.01 | 12.35 | 11.00 | 10.37 | 10.37 | | | | |
| PLACE1004332 | 3.01 | 1.40 | 1.75 | 1.66 | 1.82 | 2.98 | 2.54 | 3.00 | 3 | | | | |
| PLACE1004336 | 9.91 | 5.69 | 5.62 | 10.43 | 10.12 | 10.42 | 6.74 | 8.77 | 8.77 | | | | |
| PLACE1004346 | 3.07 | 2.03 | 1.73 | 2.75 | 2.78 | 2.82 | 1.63 | 2.50 | 2.5 | | | | |
| PLACE1004358 | 17.58 | 10.51 | 10.45 | 12.26 | 12.55 | 14.79 | 12.38 | 16.11 | 16.11 | | | | |
| PLACE1004376 | 21.68 | 10.31 | 10.00 | 13.3 | 12.08 | 12.35 | 12.00 | 16.69 | 16.69 | | | | |
| PLACE1004384 | 3.8 | 1.61 | 2.13 | 4.74 | 4.70 | 5.37 | 3.12 | 3.81 | 3.81 | * | + | | |
| PLACE1004385 | 1.9 | 0.86 | 0.50 | 0.57 | 1.48 | 1.53 | 0.60 | 1.25 | 1.25 | | | | |
| PLACE1004388 | 3.6 | 1.83 | 1.85 | 3.69 | 4.57 | 4.12 | 1.57 | 1.95 | 1.95 | | | | |
| PLACE1004405 | 0.61 | 1.07 | 0.82 | 0.21 | 0.91 | 1.17 | 2.14 | 2.86 | 2.86 | | | ** | + |
| PLACE1004407 | 5.17 | 3.33 | 4.50 | 6.41 | 4.17 | 7.01 | 4.80 | 3.58 | 3.58 | | | | |
| PLACE1004424 | 1.66 | 0.59 | 0.46 | 0.66 | 0.44 | 2.14 | 0.23 | 0.46 | 0.46 | | | | |
| PLACE1004425 | 1.47 | 0.52 | 1.48 | 2.94 | 3.61 | 2.12 | 1.72 | 2.14 | 2.14 | * | + | | |
| PLACE1004427 | 2.86 | 1.31 | 1.07 | 1.87 | 2.05 | 1.81 | 1.96 | 3.44 | 3.44 | | | | |
| PLACE1004428 | 3.96 | 2.20 | 1.76 | 4.03 | 5.57 | 4.86 | 3.58 | 3.24 | 3.24 | | | | |
| PLACE1004433 | 6.32 | 3.82 | 4.97 | 5.63 | 4.68 | 5.19 | 2.95 | 4.99 | 4.99 | | | | |
| PLACE1004435 | 7.56 | 3.49 | 4.09 | 10.74 | 10.16 | 12.36 | 5.74 | 11.13 | 11.13 | * | + | | |
| PLACE1004437 | 7.97 | 3.59 | 4.68 | 4.42 | 7.20 | 5.02 | 5.17 | 3.07 | 3.07 | | | | |

TABLE 303

| | | | | | | | | | | | | | |
|---|---|---|---|---|---|---|---|---|---|---|---|---|---|
| PLACE1004441 | 3.25 | 1.90 | 2.33 | 4.32 | 4.15 | 5.16 | 3.84 | 4.52 | 4.52 | * | + | * | + |
| PLACE1004446 | 1.76 | 2.09 | 0.72 | 1.34 | 1.42 | 1.87 | 2.28 | 2.32 | 2.32 | | | | |
| PLACE1004450 | 0.76 | 0.23 | 0.38 | 0.96 | 1.30 | 0.99 | 0.73 | 0.72 | 0.72 | * | + | | |
| PLACE1004451 | 2.04 | 1.05 | 0.94 | 1.87 | 2.71 | 1.33 | 1.83 | 2.40 | 2.4 | | | | |
| PLACE1004456 | 13.14 | 7.90 | 8.58 | 15.19 | 13.06 | 9.85 | 9.75 | 13.11 | 13.11 | | | | |
| PLACE1004458 | 1.13 | 0.48 | 0.38 | 2.8 | 2.09 | 3.55 | 9.05 | 9.62 | 9.62 | * | + | ** | + |
| PLACE1004460 | 1.24 | 0.45 | 0.57 | 1.15 | 1.35 | 1.69 | 1.34 | 1.71 | 1.71 | | | * | + |
| PLACE1004467 | 6.23 | 3.77 | 6.46 | 8.7 | 9.58 | 9.65 | 5.25 | 4.76 | 4.76 | * | + | | |
| PLACE1004471 | 7.06 | 5.28 | 5.80 | 10.51 | 12.81 | 16.26 | 6.17 | 7.08 | 7.08 | * | + | | |
| PLACE1004473 | 1.57 | 1.48 | 1.06 | 1.91 | 1.92 | 2.41 | 1.84 | 1.43 | 1.43 | * | + | | |
| PLACE1004475 | 17.9 | 8.89 | 9.13 | 27.5 | 24.29 | 13.71 | 28.08 | 20.33 | 20.33 | | | * | + |
| PLACE1004482 | 2.18 | 1.39 | 1.16 | 1.98 | 2.90 | 3.51 | 2.75 | 3.78 | 3.78 | | | * | + |
| PLACE1004491 | 0.74 | 0.46 | 0.72 | 0.47 | 1.01 | 0.52 | 0.69 | 1.94 | 1.94 | | | | |
| PLACE1004492 | 33.34 | 16.09 | 17.54 | 17.67 | 22.65 | 21.39 | 20.85 | 24.45 | 24.45 | | | | |
| PLACE1004506 | 5.1 | 3.77 | 3.89 | 3.53 | 5.30 | 4.79 | 5.63 | 7.41 | 7.41 | | | * | + |
| PLACE1004507 | 2.94 | 1.98 | 2.25 | 1.75 | 2.11 | 1.80 | 2.62 | 3.67 | 3.67 | | | | |
| PLACE1004510 | 2.01 | 2.57 | 2.33 | 4.62 | 4.58 | 4.58 | 3.18 | 2.57 | 2.57 | ** | + | | |
| PLACE1004516 | 1.04 | 0.43 | 0.32 | 0.6 | 0.82 | 1.51 | 0.69 | 1.14 | 1.14 | | | | |
| PLACE1004518 | 5.88 | 3.35 | 1.73 | 3.03 | 3.63 | 1.95 | 4.27 | 3.46 | 3.46 | | | | |
| PLACE1004519 | 3.55 | 1.36 | 2.17 | 1.53 | 2.33 | 1.77 | 1.26 | 1.42 | 1.42 | | | | |
| PLACE1004520 | 4.8 | 1.73 | 3.29 | 3.58 | 4.49 | 2.98 | 3.20 | 4.60 | 4.6 | | | | |
| PLACE1004530 | 7.81 | 5.59 | 5.82 | 2.93 | 4.17 | 2.72 | 3.17 | 3.36 | 3.36 | * | − | * | − |
| PLACE1004545 | 0.98 | 1.24 | 0.71 | 1.02 | 1.35 | 1.28 | 1.23 | 1.48 | 1.48 | | | | |
| PLACE1004547 | 3.48 | 2.58 | 2.62 | 3.89 | 3.59 | 4.14 | 3.27 | 6.00 | 6 | * | + | | |
| PLACE1004548 | 5.32 | 3.02 | 2.13 | 5.34 | 7.57 | 7.29 | 2.74 | 4.90 | 4.9 | | | | |
| PLACE1004550 | 4.75 | 3.89 | 2.55 | 4.32 | 5.77 | 4.11 | 3.73 | 5.54 | 5.54 | | | | |
| PLACE1004551 | 2.21 | 1.18 | 1.01 | 2.32 | 3.16 | 1.67 | 1.47 | 1.73 | 1.73 | | | | |
| PLACE1004559 | 1.69 | 0.68 | 1.41 | 2.2 | 2.41 | 1.95 | 1.58 | 1.77 | 1.77 | * | + | | |
| PLACE1004562 | 7.92 | 4.63 | 4.61 | 12.8 | 13.69 | 12.24 | 11.70 | 16.91 | 16.91 | ** | + | * | + |
| PLACE1004564 | 5.08 | 3.48 | 2.94 | 3.43 | 4.16 | 2.75 | 2.50 | 3.03 | 3.03 | | | | |
| PLACE1004604 | 1.61 | 1.65 | 0.87 | 1.96 | 1.66 | 1.23 | 6.31 | 2.27 | 2.27 | | | | |
| PLACE1004611 | 6.51 | 4.71 | 3.22 | 13.38 | 14.72 | 11.15 | 6.91 | 6.89 | 6.89 | ** | + | | |
| PLACE1004629 | 3.8 | 3.23 | 3.16 | 7.62 | 7.80 | 6.85 | 5.92 | 7.19 | 7.19 | ** | + | ** | + |
| PLACE1004630 | 4.43 | 7.59 | 4.92 | 4.3 | 3.84 | 5.63 | 3.88 | 4.82 | 4.82 | | | | |

TABLE 303-continued

| PLACE1004637 | 9.71 | 8.66 | 5.16 | 8.97 | 5.26 | 6.98 | 6.87 | 7.85 | 7.85 | | | | |
|---|---|---|---|---|---|---|---|---|---|---|---|---|---|
| PLACE1004645 | 34.24 | 15.91 | 17.01 | 26.16 | 30.73 | 32.52 | 15.81 | 17.34 | 17.34 | | | | |
| PLACE1004646 | 3.38 | 1.74 | 3.32 | 3.28 | 4.81 | 3.28 | 2.79 | 2.82 | 2.82 | | | | |
| PLACE1004648 | 14.4 | 8.71 | 8.36 | 10.69 | 11.92 | 11.67 | 15.16 | 15.16 | 15.16 | | | | |
| PLACE1004655 | 41.73 | 23.86 | 25.42 | 40 | 42.96 | 45.63 | 19.14 | 24.74 | 24.74 | | | | |
| PLACE1004658 | 4.07 | 3.17 | 2.80 | 4.22 | 4.91 | 5.38 | 4.38 | 3.84 | 3.84 | * | + | | |
| PLACE1004664 | 2.14 | 1.15 | 0.86 | 2.2 | 2.05 | 3.93 | 1.74 | 1.79 | 1.79 | | | | |
| PLACE1004672 | 11.36 | 7.67 | 9.44 | 13.22 | 15.37 | 20.21 | 6.56 | 12.23 | 12.23 | * | + | | |
| PLACE1004674 | 6.89 | 4.27 | 3.73 | 8.23 | 11.59 | 6.63 | 7.24 | 9.33 | 9.33 | | | * | + |
| PLACE1004681 | 5.36 | 2.49 | 2.37 | 3.93 | 6.34 | 2.28 | 3.03 | 2.81 | 2.81 | | | | |
| PLACE1004686 | 4.25 | 1.52 | 2.69 | 8.28 | 8.25 | 8.23 | 3.83 | 5.37 | 5.37 | ** | + | * | − |
| PLACE1004690 | 27.35 | 18.33 | 25.68 | 19.28 | 26.77 | 23.31 | 7.55 | 15.04 | 15.04 | | | | |
| PLACE1004691 | 4.78 | 2.55 | 2.69 | 4.7 | 7.55 | 6.34 | 2.68 | 5.61 | 5.61 | | | | |
| PLACE1004693 | 3.07 | 1.09 | 1.84 | 2.44 | 2.98 | 3.35 | 2.53 | 3.19 | 3.19 | | | | |
| PLACE1004701 | 23.69 | 11.94 | 19.76 | 25.99 | 21.50 | 33.00 | 23.49 | 24.31 | 24.31 | | | | |
| PLACE1004705 | 5.61 | 4.43 | 3.93 | 4.87 | 5.07 | 5.49 | 3.83 | 4.06 | 4.06 | | | | |
| PLACE1004708 | 9.98 | 7.05 | 4.96 | 7.36 | 17.22 | 7.73 | 12.21 | 12.77 | 12.77 | | | * | + |
| PLACE1004716 | 5.47 | 2.91 | 3.32 | 5.79 | 8.69 | 5.11 | 4.23 | 4.07 | 4.07 | | | | |
| PLACE1004722 | 1.53 | 1.35 | 1.55 | 1.7 | 3.73 | 3.67 | 0.90 | 2.30 | 2.3 | | | | |
| PLACE1004736 | 16.73 | 9.74 | 14.43 | 13.11 | 17.99 | 18.80 | 11.66 | 17.15 | 17.15 | | | | |
| PLACE1004737 | 2.18 | 1.67 | 1.79 | 1.43 | 3.14 | 3.32 | 1.37 | 1.80 | 1.8 | | | | |
| PLACE1004740 | 6.4 | 3.17 | 4.45 | 6.16 | 4.57 | 7.19 | 5.04 | 5.92 | 5.92 | | | | |

TABLE 304

| PLACE1004743 | 2.83 | 1.69 | 1.62 | 2.65 | 2.30 | 3.35 | 1.64 | 2.59 | 2.59 | | | | |
|---|---|---|---|---|---|---|---|---|---|---|---|---|---|
| PLACE1004751 | 3.88 | 2.76 | 2.71 | 4.3 | 4.81 | 6.07 | 2.16 | 4.03 | 4.03 | * | + | | |
| PLACE1004757 | 6.62 | 2.79 | 3.38 | 5.64 | 5.36 | 5.13 | 4.59 | 3.33 | 3.33 | | | | |
| PLACE1004761 | 1.53 | 0.69 | 0.99 | 1.89 | 2.90 | 1.43 | 1.17 | 2.01 | 2.01 | | | | |
| PLACE1004773 | 6.07 | 1.81 | 3.15 | 5.28 | 4.05 | 5.04 | 3.00 | 3.37 | 3.37 | | | | |
| PLACE1004775 | 0.59 | 0.48 | 0.41 | 0.54 | 0.33 | 0.45 | 0.35 | 1.11 | 1.11 | | | | |
| PLACE1004777 | 2.87 | 1.56 | 1.63 | 3.6 | 3.28 | 3.27 | 3.12 | 2.18 | 2.18 | * | + | | |
| PLACE1004793 | 1.91 | 0.67 | 0.75 | 1.6 | 1.01 | 2.08 | 1.33 | 1.74 | 1.74 | * | + | | |
| PLACE1004796 | 11.15 | 4.76 | 6.53 | 15.2 | 11.67 | 18.12 | 12.53 | 11.15 | 11.15 | * | + | | |
| PLACE1004804 | 2.49 | 2.83 | 3.47 | 3.45 | 3.93 | 5.58 | 2.84 | 4.15 | 4.15 | | | | |
| PLACE1004813 | 1.83 | 1.78 | 1.19 | 2.06 | 4.34 | 2.04 | 2.93 | 2.61 | 2.61 | | | ** | + |
| PLACE1004814 | 15.6 | 8.20 | 7.30 | 20.97 | 26.56 | 22.14 | 11.65 | 11.36 | 11.36 | * | + | | |
| PLACE1004815 | 2.09 | 1.04 | 1.32 | 4.73 | 4.30 | 3.56 | 2.27 | 2.36 | 2.36 | ** | + | | |
| PLACE1004816 | 3.22 | 1.11 | 2.11 | 2.58 | 2.27 | 3.19 | 1.56 | 4.07 | 4.07 | | | | |
| PLACE1004824 | 10.16 | 4.47 | 7.27 | 17.15 | 18.66 | 21.40 | 8.53 | 11.08 | 11.08 | ** | + | | |
| PLACE1004827 | 3.25 | 1.26 | 2.36 | 5.76 | 5.15 | 4.86 | 3.26 | 3.82 | 3.82 | ** | + | | |
| PLACE1004836 | 2.02 | 0.78 | 1.32 | 3.29 | 3.51 | 3.51 | 1.36 | 2.69 | 2.69 | ** | + | | |
| PLACE1004838 | 3.17 | 2.09 | 1.89 | 2.78 | 2.46 | 3.36 | 1.52 | 3.28 | 3.28 | | | | |
| PLACE1004840 | 1.23 | 0.56 | 0.64 | 2.27 | 3.76 | 2.10 | 1.40 | 1.24 | 1.24 | * | + | | |
| PLACE1004842 | 5.48 | 1.99 | 1.07 | 1.39 | 1.40 | 2.34 | 2.69 | 3.06 | 3.06 | | | | |
| PLACE1004850 | 3.11 | 1.83 | 1.19 | 2.34 | 1.99 | 1.83 | 2.00 | 3.44 | 3.44 | | | | |
| PLACE1004868 | 1.78 | 1.97 | 1.38 | 1.05 | 1.30 | 0.94 | 1.18 | 1.52 | 1.52 | * | − | | |
| PLACE1004885 | 4.12 | 2.86 | 3.03 | 6.17 | 4.95 | 6.21 | 2.81 | 3.69 | 3.69 | * | + | | |
| PLACE1004886 | 1.77 | 1.59 | 1.70 | 1.43 | 1.55 | 1.82 | 2.32 | 4.30 | 4.3 | | | * | + |
| PLACE1004887 | 25.24 | 11.67 | 14.76 | 21.81 | 38.02 | 28.05 | 8.65 | 10.31 | 10.31 | | | | |
| PLACE1004896 | 2.33 | 1.72 | 1.45 | 4.61 | 3.16 | 5.89 | 7.01 | 7.01 | 7.01 | * | + | ** | + |
| PLACE1004900 | 9.03 | 4.30 | 5.53 | 9.31 | 10.97 | 9.80 | 5.74 | 6.69 | 6.69 | | | | |
| PLACE1004902 | 15.98 | 5.16 | 8.41 | 6.64 | 13.40 | 8.82 | 7.56 | 8.91 | 8.91 | | | | |
| PLACE1004904 | 2.63 | 1.32 | 1.15 | 1.84 | 2.37 | 1.90 | 3.74 | 3.50 | 3.5 | | | * | + |
| PLACE1004911 | 1.14 | 3.11 | 1.00 | 4.23 | 0.30 | 0.65 | 0.27 | 1.36 | 1.36 | | | | |
| PLACE1004913 | 2.14 | 1.21 | 1.21 | 2.7 | 1.96 | 3.02 | 1.97 | 4.39 | 4.39 | | | | |
| PLACE1004918 | 1.11 | 0.31 | 1.10 | 1.32 | 1.60 | 1.48 | 0.91 | 1.02 | 1.02 | | | | |
| PLACE1004930 | 3.51 | 2.35 | 1.88 | 1.71 | 2.51 | 2.60 | 1.12 | 1.41 | 1.41 | | | | |
| PLACE1004934 | 2.04 | 1.42 | 1.26 | 1.7 | 2.74 | 2.49 | 1.45 | 1.52 | 1.52 | | | | |
| PLACE1004937 | 5.11 | 2.46 | 1.95 | 3.63 | 3.54 | 3.36 | 2.75 | 2.15 | 2.15 | | | | |
| PLACE1004949 | 4.03 | 1.71 | 2.54 | 6.88 | 7.76 | 8.45 | 5.04 | 9.82 | 9.82 | ** | + | * | + |
| PLACE1004969 | 3.48 | 2.29 | 1.51 | 2.73 | 3.17 | 3.01 | 2.31 | 4.32 | 4.32 | | | | |
| PLACE1004970 | 0.79 | 0.82 | 0.40 | 0.36 | 1.00 | 0.91 | 0.81 | 2.69 | 2.69 | | | | |
| PLACE1004972 | 1.78 | 1.50 | 1.56 | 2.23 | 2.38 | 3.07 | 1.16 | 2.50 | 2.5 | * | + | | |
| PLACE1004974 | 3.63 | 3.03 | 1.68 | 3.41 | 3.31 | 2.59 | 1.64 | 1.70 | 1.7 | | | | |
| PLACE1004975 | 4.46 | 3.12 | 2.44 | 4.13 | 3.11 | 5.49 | 3.51 | 3.95 | 3.95 | | | | |
| PLACE1004979 | 4.8 | 5.17 | 3.63 | 8.89 | 10.47 | 10.51 | 5.50 | 6.33 | 6.33 | ** | + | * | + |
| PLACE1004982 | 12.69 | 7.06 | 8.29 | 13.78 | 13.06 | 8.17 | 7.03 | 8.87 | 8.87 | | | | |
| PLACE1004985 | 2.12 | 0.35 | 0.79 | 2.05 | 1.96 | 1.11 | 0.99 | 3.21 | 3.21 | | | | |
| PLACE1005003 | 3.67 | 1.05 | 1.88 | 1.3 | 2.66 | 1.79 | 0.59 | 2.43 | 2.43 | | | | |
| PLACE1005004 | 1.24 | 1.06 | 1.30 | 1.55 | 1.31 | 1.17 | 1.68 | 1.83 | 1.83 | | | ** | + |
| PLACE1005005 | 8.08 | 4.02 | 3.41 | 8.61 | 8.51 | 8.54 | 5.01 | 5.29 | 5.29 | | | | |
| PLACE1005011 | 2.2 | 1.69 | 2.79 | 3 | 3.06 | 5.33 | 3.11 | 2.57 | 2.57 | | | | |
| PLACE1005026 | 2.34 | 1.90 | 2.06 | 1.86 | 2.01 | 2.93 | 1.82 | 1.53 | 1.53 | | | * | − |
| PLACE1005027 | 4.99 | 3.43 | 4.26 | 7.85 | 11.24 | 9.53 | 3.37 | 5.57 | 5.57 | ** | + | | |
| PLACE1005031 | 6.43 | 2.62 | 2.97 | 5.45 | 4.09 | 3.20 | 3.04 | 3.84 | 3.84 | | | | |

TABLE 304-continued

| | | | | | | | | | | | | | |
|---|---|---|---|---|---|---|---|---|---|---|---|---|---|
| PLACE1005036 | 7.51 | 3.86 | 5.10 | 9.33 | 12.02 | 7.99 | 3.66 | 4.98 | 4.98 | | | | |
| PLACE1005041 | 0.87 | 0.69 | 0.58 | 1.76 | 1.87 | 1.43 | 1.58 | 1.91 | 1.91 | ** | + | ** | + |
| PLACE1005046 | 7.09 | 3.32 | 3.54 | 11.1 | 10.13 | 10.18 | 4.94 | 5.99 | 5.99 | ** | + | | |
| PLACE1005047 | 3.57 | 1.97 | 1.47 | 3.2 | 3.87 | 3.39 | 2.49 | 3.04 | 3.04 | | | | |
| PLACE1005052 | 4.36 | 2.90 | 3.32 | 3.11 | 2.49 | 4.07 | 4.21 | 4.75 | 4.75 | | | | |

TABLE 305

| | | | | | | | | | | | | | |
|---|---|---|---|---|---|---|---|---|---|---|---|---|---|
| PLACE1005055 | 1.93 | 1.90 | 2.25 | 2.55 | 3.80 | 3.83 | 1.39 | 2.30 | 2.3 | * | + | | |
| PLACE1005066 | 3.73 | 3.53 | 2.95 | 3.62 | 2.74 | 3.71 | 4.65 | 6.92 | 6.92 | | | * | + |
| PLACE1005077 | 1.88 | 0.74 | 0.51 | 1.94 | 2.30 | 1.62 | 1.19 | 1.27 | 1.27 | | | | |
| PLACE1005085 | 5.35 | 2.26 | 1.94 | 7.82 | 9.01 | 6.89 | 4.04 | 4.10 | 4.1 | * | + | | |
| PLACE1005086 | 8.18 | 4.09 | 4.61 | 8.82 | 11.72 | 8.88 | 4.94 | 5.91 | 5.91 | | | | |
| PLACE1005088 | 48.83 | 27.68 | 29.69 | 27.61 | 39.82 | 34.65 | 26.01 | 25.68 | 25.68 | | | | |
| PLACE1005089 | 2.42 | 1.38 | 1.99 | 2.77 | 2.07 | 2.49 | 2.33 | 3.56 | 3.56 | | | | |
| PLACE1005101 | 6.75 | 6.64 | 8.03 | 8.45 | 9.96 | 12.39 | 8.67 | 10.11 | 10.11 | | | * | + |
| PLACE1005102 | 5.88 | 7.51 | 8.49 | 11.05 | 10.78 | 12.60 | 9.73 | 9.59 | 9.59 | * | + | * | + |
| PLACE1005108 | 5.63 | 4.27 | 3.64 | 12.01 | 12.87 | 10.10 | 5.64 | 5.46 | 5.46 | ** | + | | |
| PLACE1005110 | 6.84 | 3.16 | 2.29 | 5.61 | 4.42 | 2.27 | 2.47 | 3.96 | 3.96 | | | | |
| PLACE1005111 | 2.32 | 1.43 | 0.52 | 2.8 | 3.48 | 1.64 | 1.69 | 1.48 | 1.48 | | | | |
| PLACE1005123 | 20.53 | 8.57 | 10.06 | 12.54 | 14.07 | 10.45 | 7.24 | 8.30 | 8.3 | | | | |
| PLACE1005124 | 3.92 | 2.40 | 2.02 | 3.08 | 6.72 | 4.08 | 3.28 | 3.46 | 3.46 | | | | |
| PLACE1005128 | 10.6 | 9.42 | 9.74 | 12.9 | 15.61 | 15.03 | 14.09 | 17.89 | 17.89 | ** | + | ** | + |
| PLACE1005130 | 4.63 | 4.42 | 3.58 | 6.21 | 6.12 | 6.60 | 2.90 | 3.62 | 3.62 | ** | + | | |
| PLACE1005141 | 11.53 | 6.88 | 7.85 | 10.2 | 11.46 | 13.07 | 6.08 | 6.65 | 6.65 | | | | |
| PLACE1005146 | 2.66 | 2.45 | 2.31 | 3.79 | 4.23 | 2.90 | 1.91 | 2.35 | 2.35 | * | + | | |
| PLACE1005152 | 4.31 | 1.32 | 1.78 | 5.23 | 4.05 | 4.11 | 2.87 | 2.37 | 2.37 | | | | |
| PLACE1005157 | 3.17 | 1.71 | 2.58 | 3.61 | 2.97 | 3.04 | 1.83 | 2.24 | 2.24 | | | | |
| PLACE1005162 | 5.03 | 1.44 | 2.16 | 4.55 | 5.47 | 5.51 | 3.63 | 3.97 | 3.97 | | | | |
| PLACE1005170 | 1.73 | 0.31 | 0.62 | 1.61 | 1.26 | 1.41 | 1.34 | 1.72 | 1.72 | | | | |
| PLACE1005176 | 1.61 | 0.38 | 0.68 | 1.16 | 1.34 | 1.12 | 1.06 | 1.60 | 1.6 | | | | |
| PLACE1005181 | 0.5 | 0.24 | 0.53 | 1.19 | 0.87 | 2.59 | 0.77 | 1.26 | 1.26 | | | * | + |
| PLACE1005184 | 4.44 | 1.78 | 2.90 | 7.9 | 7.10 | 9.09 | 4.75 | 4.64 | 4.64 | ** | + | | |
| PLACE1005186 | 6.95 | 2.41 | 3.82 | 3.37 | 3.80 | 2.87 | 3.22 | 3.68 | 3.68 | | | | |
| PLACE1005187 | 3.14 | 1.53 | 1.03 | 3.09 | 5.30 | 4.21 | 2.97 | 2.82 | 2.82 | | | | |
| PLACE1005189 | 5.93 | 2.53 | 2.32 | 3.58 | 5.81 | 4.44 | 5.57 | 5.74 | 5.74 | | | | |
| PLACE1005193 | 6.13 | 3.49 | 3.63 | 4.29 | 4.51 | 4.47 | 3.64 | 4.00 | 4 | | | | |
| PLACE1005200 | 4.37 | 1.39 | 2.33 | 2.59 | 3.60 | 1.69 | 2.29 | 2.95 | 2.95 | | | | |
| PLACE1005206 | 2.34 | 0.51 | 1.37 | 1.54 | 2.19 | 3.01 | 1.80 | 1.98 | 1.98 | | | | |
| PLACE1005216 | 1.38 | 0.71 | 1.11 | 2.26 | 2.41 | 2.76 | 2.43 | 3.73 | 3.73 | ** | + | ** | + |
| PLACE1005223 | 4.29 | 2.34 | 2.64 | 6.04 | 7.76 | 7.97 | 4.06 | 6.10 | 6.1 | ** | + | | |
| PLACE1005225 | 19.66 | 8.09 | 9.52 | 16.05 | 21.00 | 13.76 | 8.27 | 9.44 | 9.44 | | | | |
| PLACE1005232 | 8.02 | 4.04 | 2.69 | 6.94 | 10.56 | 7.61 | 5.96 | 6.58 | 6.58 | | | | |
| PLACE1005239 | 5.38 | 1.20 | 2.07 | 5.01 | 3.78 | 2.93 | 2.36 | 3.31 | 3.31 | | | | |
| PLACE1005243 | 5.32 | 3.76 | 4.72 | 5.19 | 5.09 | 5.33 | 3.34 | 5.82 | 5.82 | | | | |
| PLACE1005250 | 3.75 | 1.12 | 1.85 | 3.16 | 3.89 | 3.16 | 2.16 | 2.84 | 2.84 | | | | |
| PLACE1005261 | 2.07 | 0.70 | 1.90 | 2.25 | 2.05 | 1.77 | 2.13 | 1.93 | 1.93 | | | | |
| PLACE1005266 | 1.9 | 0.95 | 1.09 | 2.57 | 2.39 | 2.64 | 2.14 | 1.90 | 1.9 | * | + | | |
| PLACE1005271 | 5.66 | 2.63 | 3.94 | 8.71 | 9.11 | 8.37 | 4.71 | 5.02 | 5.02 | ** | + | | |
| PLACE1005277 | 3.05 | 0.82 | 0.70 | 2.46 | 4.32 | 1.50 | 1.02 | 2.07 | 2.07 | | | | |
| PLACE1005287 | 6.59 | 3.30 | 3.94 | 10.35 | 15.42 | 7.57 | 8.69 | 8.45 | 8.45 | | | * | + |
| PLACE1005299 | 22.18 | 11.98 | 9.53 | 18.56 | 24.11 | 17.96 | 21.90 | 22.45 | 22.45 | | | | |
| PLACE1005305 | 5.96 | 2.44 | 4.52 | 8.17 | 10.96 | 9.42 | 8.88 | 11.22 | 11.22 | * | + | ** | + |
| PLACE1005307 | 3.74 | 1.42 | 2.86 | 4.85 | 5.32 | 3.53 | 2.69 | 4.11 | 4.11 | | | | |
| PLACE1005308 | 3.94 | 1.81 | 2.45 | 3.16 | 2.71 | 2.64 | 2.67 | 2.60 | 2.6 | | | | |
| PLACE1005313 | 1.8 | 1.22 | 2.93 | 1.89 | 0.89 | 2.76 | 1.70 | 1.69 | 1.69 | | | | |
| PLACE1005320 | 2.05 | 0.78 | 1.58 | 1.96 | 1.63 | 3.04 | 1.42 | 1.54 | 1.54 | | | | |
| PLACE1005327 | 3.57 | 2.45 | 2.12 | 2.64 | 6.29 | 3.81 | 4.41 | 6.45 | 6.45 | | | * | + |
| PLACE1005331 | 4 | 2.27 | 3.11 | 3.34 | 6.04 | 3.03 | 3.28 | 2.86 | 2.86 | | | | |
| PLACE1005335 | 9.31 | 5.05 | 4.18 | 8.68 | 7.24 | 5.98 | 5.53 | 6.95 | 6.95 | | | | |
| PLACE1005336 | 3.13 | 1.45 | 2.61 | 5.52 | 6.69 | 4.80 | 4.00 | 4.81 | 4.81 | * | + | * | + |
| PLACE1005351 | 30.75 | 16.28 | 19.31 | 14.85 | 14.56 | 18.13 | 32.39 | 30.68 | 30.68 | | | | |
| PLACE1005366 | 3.38 | 2.74 | 2.56 | 10.21 | 9.37 | 10.62 | 9.15 | 9.50 | 9.5 | ** | + | ** | + |
| PLACE1005373 | 4.26 | 1.58 | 2.70 | 3.39 | 2.69 | 4.82 | 2.63 | 3.29 | 3.29 | | | | |

TABLE 306

| | | | | | | | | | | | | | |
|---|---|---|---|---|---|---|---|---|---|---|---|---|---|
| PLACE1005374 | 5 | 2.10 | 2.77 | 8.04 | 11.61 | 11.01 | 4.31 | 6.01 | 6.01 | ** | + | | |
| PLACE1005383 | 8.86 | 3.18 | 3.37 | 5.63 | 6.03 | 4.19 | 5.25 | 6.23 | 6.23 | | | | |
| PLACE1005388 | 2.57 | 0.54 | 0.31 | 2.75 | 1.56 | 0.89 | 2.61 | 1.22 | 1.22 | | | | |
| PLACE1005409 | 5.48 | 3.06 | 2.63 | 7.59 | 8.06 | 6.25 | 3.31 | 4.02 | 4.02 | * | + | | |
| PLACE1005410 | 6.76 | 2.97 | 3.65 | 5.66 | 8.24 | 5.17 | 9.00 | 11.77 | 11.77 | | | * | + |
| PLACE1005426 | 4.46 | 1.72 | 1.45 | 2.27 | 1.48 | 1.00 | 3.43 | 3.54 | 3.54 | | | | |
| PLACE1005431 | 4.56 | 2.63 | 2.58 | 4.42 | 5.14 | 6.40 | 5.57 | 6.50 | 6.5 | | | * | + |

TABLE 306-continued

| PLACE1005453 | 3.55 | 1.77 | 2.09 | 4.33 | 4.49 | 5.14 | 1.74 | 3.20 | 3.2 | * | + | | |
|---|---|---|---|---|---|---|---|---|---|---|---|---|---|
| PLACE1005467 | 5.64 | 2.78 | 2.70 | 6.57 | 5.73 | 4.48 | 5.05 | 4.51 | 4.51 | | | | |
| PLACE1005471 | 3.36 | 0.50 | 1.20 | 3.42 | 3.09 | 2.65 | 2.30 | 3.64 | 3.64 | | | | |
| PLACE1005476 | 5.15 | 1.54 | 1.43 | 2.43 | 2.59 | 1.89 | 1.59 | 3.01 | 3.01 | | | | |
| PLACE1005477 | 2.24 | 1.35 | 1.27 | 5.66 | 7.05 | 5.00 | 4.23 | 7.05 | 7.05 | ** | + | * | + |
| PLACE1005480 | 1.93 | 1.39 | 1.29 | 1.24 | 1.52 | 1.24 | 1.31 | 1.75 | 1.75 | | | | |
| PLACE1005481 | 2.22 | 1.41 | 1.51 | 2.73 | 2.46 | 3.04 | 1.87 | 2.00 | 2 | * | + | | |
| PLACE1005494 | 1.24 | 0.38 | 0.90 | 0.8 | 0.90 | 0.66 | 0.80 | 1.98 | 1.98 | | | | |
| PLACE1005495 | 4.56 | 1.60 | 1.71 | 3.4 | 2.67 | 2.72 | 2.06 | 1.93 | 1.93 | | | | |
| PLACE1005497 | 8.06 | 4.83 | 3.69 | 4.42 | 2.88 | 4.07 | 9.50 | 10.40 | 10.4 | | | * | + |
| PLACE1005499 | 4.76 | 1.36 | 1.66 | 2.69 | 4.07 | 3.13 | 5.56 | 5.51 | 5.51 | | | | |
| PLACE1005502 | 2.69 | 0.87 | 1.10 | 2.75 | 3.41 | 2.24 | 1.89 | 4.02 | 4.02 | | | | |
| PLACE1005513 | 1.27 | 0.71 | 0.80 | 3.5 | 2.88 | 3.38 | 1.95 | 3.18 | 3.18 | ** | + | * | + |
| PLACE1005515 | 2.84 | 0.81 | 0.90 | 1.12 | 0.96 | 1.43 | 2.38 | 3.90 | 3.9 | | | | |
| PLACE1005519 | 7.14 | 2.92 | 5.14 | 2.37 | 3.46 | 3.11 | 2.55 | 3.35 | 3.35 | | | | |
| PLACE1005526 | 2.06 | 1.07 | 1.41 | 1.41 | 2.39 | 1.85 | 1.31 | 2.23 | 2.23 | | | | |
| PLACE1005528 | 6.82 | 2.99 | 3.77 | 7.7 | 10.09 | 11.05 | 4.64 | 5.96 | 5.96 | * | + | | |
| PLACE1005530 | 4.98 | 2.54 | 2.80 | 2.85 | 5.04 | 3.55 | 3.48 | 2.83 | 2.83 | | | | |
| PLACE1005536 | 4.27 | 3.13 | 1.98 | 6.1 | 4.77 | 1.67 | 4.10 | 3.87 | 3.87 | | | | |
| PLACE1005539 | 3 | 1.66 | 1.31 | 3.17 | 3.20 | 2.66 | 1.69 | 3.05 | 3.05 | | | | |
| PLACE1005543 | 2.3 | 1.25 | 1.18 | 4 | 3.96 | 4.38 | 3.55 | 3.32 | 3.32 | ** | + | ** | + |
| PLACE1005544 | 6.06 | 3.23 | 2.89 | 3.81 | 4.11 | 4.35 | 4.12 | 5.12 | 5.12 | | | | |
| PLACE1005550 | 8.49 | 4.71 | 5.86 | 4.53 | 4.75 | 4.40 | 2.14 | 3.57 | 3.57 | | | | |
| PLACE1005554 | 1.55 | 0.76 | 0.94 | 1.77 | 1.45 | 1.38 | 2.99 | 1.56 | 1.56 | | | | |
| PLACE1005557 | 3.3 | 1.97 | 2.34 | 3.4 | 5.03 | 3.76 | 3.56 | 3.17 | 3.17 | | | | |
| PLACE1005563 | 1.99 | 2.09 | 0.76 | 1.69 | 2.10 | 1.89 | 2.11 | 1.69 | 1.69 | | | | |
| PLACE1005569 | 4.54 | 2.73 | 2.52 | 4.62 | 4.22 | 2.24 | 2.63 | 3.22 | 3.22 | | | | |
| PLACE1005574 | 1.43 | 0.92 | 0.87 | 2.29 | 2.41 | 2.10 | 0.45 | 0.99 | 0.99 | ** | + | | |
| PLACE1005584 | 1.32 | 0.88 | 0.93 | 1.31 | 1.40 | 1.67 | 1.68 | 4.67 | 4.67 | | | | |
| PLACE1005590 | 2.53 | 3.81 | 2.63 | 3.18 | 2.75 | 3.39 | 4.08 | 5.93 | 5.93 | | | * | + |
| PLACE1005595 | 2.91 | 2.55 | 3.00 | 2.96 | 2.39 | 3.53 | 3.75 | 3.64 | 3.64 | | | ** | + |
| PLACE1005601 | 2.77 | 1.99 | 2.02 | 2.52 | 2.79 | 3.50 | 2.97 | 3.86 | 3.86 | | | * | + |
| PLACE1005603 | 0.9 | 0.55 | 0.69 | 0.87 | 1.06 | 0.76 | 1.27 | 1.79 | 1.79 | | | * | + |
| PLACE1005604 | 4.18 | 2.56 | 1.82 | 4.89 | 4.83 | 6.27 | 2.39 | 1.93 | 1.93 | * | + | | |
| PLACE1005611 | 2.64 | 2.26 | 1.19 | 5.02 | 2.53 | 3.51 | 2.64 | 2.53 | 2.53 | | | | |
| PLACE1005622 | 2.15 | 1.96 | 1.00 | 2.49 | 2.91 | 2.25 | 1.48 | 2.00 | 2 | | | | |
| PLACE1005623 | 4.29 | 1.35 | 2.10 | 3.3 | 3.81 | 3.92 | 2.17 | 2.70 | 2.7 | | | | |
| PLACE1005630 | 6.26 | 3.63 | 2.27 | 4.66 | 6.06 | 5.41 | 4.45 | 5.87 | 5.87 | | | | |
| PLACE1005639 | 1.47 | 1.40 | 2.08 | 1.45 | 2.40 | 2.84 | 0.78 | 1.78 | 1.78 | | | | |
| PLACE1005646 | 5.91 | 4.51 | 5.24 | 4.63 | 5.74 | 5.46 | 4.51 | 5.47 | 5.47 | | | | |
| PLACE1005647 | 0.51 | 0.39 | 0.52 | 1.16 | 1.74 | 1.90 | 2.41 | 4.04 | 4.04 | ** | + | ** | + |
| PLACE1005648 | 5.72 | 4.93 | 6.25 | 15.18 | 16.23 | 16.45 | 5.58 | 7.21 | 7.21 | ** | + | | |
| PLACE1005653 | 3.3 | 1.90 | 0.82 | 3.94 | 5.11 | 4.03 | 2.85 | 2.07 | 2.07 | * | + | | |
| PLACE1005656 | 2.07 | 1.04 | 0.59 | 1.23 | 2.09 | 0.91 | 1.88 | 0.45 | 0.45 | | | | |
| PLACE1005659 | 4.14 | 1.56 | 2.46 | 2.97 | 4.17 | 2.22 | 1.44 | 2.31 | 2.31 | | | | |
| PLACE1005660 | 5.27 | 3.90 | 2.60 | 4.31 | 5.01 | 2.96 | 3.33 | 4.29 | 4.29 | | | | |
| PLACE1005664 | 4.13 | 4.07 | 4.07 | 5.57 | 5.47 | 4.07 | 5.14 | 6.25 | 6.25 | | | ** | + |
| PLACE1005666 | 0.97 | 1.45 | 1.51 | 3.22 | 3.91 | 4.93 | 3.26 | 2.77 | 2.77 | ** | + | ** | + |
| PLACE1005669 | 4.53 | 2.92 | 2.87 | 6.24 | 4.95 | 7.16 | 3.36 | 4.69 | 4.69 | * | + | | |

TABLE 307

| PLACE1005682 | 2.11 | 2.05 | 2.13 | 4.34 | 3.23 | 4.41 | 1.89 | 2.15 | 2.15 | ** | + | | |
|---|---|---|---|---|---|---|---|---|---|---|---|---|---|
| PLACE1005698 | 4.64 | 2.14 | 3.28 | 3.89 | 3.92 | 4.16 | 1.91 | 2.53 | 2.53 | | | | |
| PLACE1005708 | 25.78 | 13.70 | 10.51 | 13.88 | 16.18 | 11.27 | 14.00 | 14.43 | 14.43 | | | | |
| PLACE1005725 | 3.83 | 1.42 | 2.33 | 2.34 | 3.92 | 2.04 | 4.70 | 4.61 | 4.61 | | | * | + |
| PLACE1005727 | 8.48 | 2.60 | 3.97 | 5.4 | 4.41 | 4.96 | 2.49 | 2.57 | 2.57 | | | | |
| PLACE1005730 | 3.57 | 0.90 | 1.62 | 1.95 | 2.02 | 2.00 | 2.05 | 2.95 | 2.95 | | | | |
| PLACE1005736 | 4.39 | 2.36 | 2.88 | 8.34 | 10.28 | 9.63 | 5.13 | 7.81 | 7.81 | ** | + | * | + |
| PLACE1005739 | 2.31 | 1.03 | 1.11 | 1.47 | 1.17 | 1.64 | 2.22 | 2.15 | 2.15 | | | | |
| PLACE1005745 | 9.25 | 5.63 | 5.40 | 10.32 | 14.44 | 8.66 | 7.38 | 8.69 | 8.69 | | | | |
| PLACE1005752 | 4.63 | 2.11 | 0.91 | 2.57 | 2.97 | 2.88 | 2.25 | 2.86 | 2.86 | | | | |
| PLACE1005755 | 0.83 | 0.18 | 0.42 | 0.66 | 1.88 | 0.70 | 0.93 | 0.93 | 0.93 | | | | |
| PLACE1005756 | 14.63 | 7.31 | 9.39 | 22.2 | 25.42 | 27.72 | 29.92 | 35.68 | 35.68 | ** | + | ** | + |
| PLACE1005760 | 7.89 | 3.72 | 4.80 | 10.59 | 12.05 | 10.96 | 9.45 | 9.92 | 9.92 | * | + | * | + |
| PLACE1005763 | 3.86 | 1.70 | 3.26 | 6.59 | 6.36 | 6.88 | 4.43 | 4.28 | 4.28 | ** | + | | |
| PLACE1005768 | 6.14 | 3.01 | 5.24 | 7.97 | 7.90 | 8.87 | 6.22 | 5.90 | 5.9 | * | + | | |
| PLACE1005771 | 7.62 | 3.12 | 5.03 | 7.4 | 7.32 | 9.76 | 6.04 | 6.48 | 6.48 | | | | |
| PLACE1005783 | 3.63 | 1.45 | 2.35 | 2.79 | 4.79 | 2.04 | 2.34 | 3.07 | 3.07 | | | | |
| PLACE1005799 | 6.45 | 3.16 | 3.38 | 5.32 | 4.64 | 3.49 | 5.15 | 5.23 | 5.23 | | | | |
| PLACE1005802 | 5.01 | 1.66 | 1.63 | 4.46 | 8.45 | 4.41 | 2.49 | 4.79 | 4.79 | | | | |
| PLACE1005803 | 11.48 | 4.59 | 6.77 | 9.23 | 10.65 | 9.39 | 6.53 | 8.91 | 8.91 | | | | |
| PLACE1005804 | 1.62 | 0.72 | 0.84 | 1.97 | 2.36 | 1.93 | 2.21 | 2.56 | 2.56 | * | + | * | + |
| PLACE1005813 | 10.74 | 3.23 | 5.61 | 11.66 | 8.19 | 9.55 | 6.52 | 6.57 | 6.57 | | | | |
| PLACE1005815 | 5.12 | 2.48 | 3.85 | 7.34 | 9.35 | 11.87 | 4.89 | 5.17 | 5.17 | * | + | | |
| PLACE1005828 | 5.16 | 3.37 | 3.80 | 8.35 | 8.98 | 9.59 | 4.86 | 6.29 | 6.29 | ** | + | | |

TABLE 307-continued

| | | | | | | | | | | | | | |
|---|---|---|---|---|---|---|---|---|---|---|---|---|---|
| PLACE1005833 | 3.06 | 1.35 | 1.59 | 18.69 | 21.23 | 11.91 | 28.00 | 30.88 | 30.88 | ** | + | ** | + |
| PLACE1005834 | 1.93 | 0.65 | 0.55 | 4 | 6.43 | 2.66 | 1.50 | 2.50 | 2.5 | * | + | | |
| PLACE1005835 | 5.07 | 4.66 | 2.88 | 5.05 | 7.51 | 3.87 | 4.83 | 4.52 | 4.52 | | | | |
| PLACE1005836 | 3.75 | 1.63 | 2.11 | 2.62 | 6.42 | 3.23 | 2.73 | 2.06 | 2.06 | | | | |
| PLACE1005845 | 4.98 | 1.86 | 2.24 | 4.26 | 4.56 | 2.61 | 2.60 | 3.15 | 3.15 | | | | |
| PLACE1005850 | 4.23 | 2.74 | 2.58 | 5.55 | 4.59 | 5.10 | 2.95 | 3.19 | 3.19 | * | + | | |
| PLACE1005851 | 1.83 | 0.96 | 1.69 | 2.54 | 2.84 | 4.11 | 1.02 | 0.85 | 0.85 | * | + | | |
| PLACE1005856 | 4.08 | 1.29 | 7.53 | 4.1 | 2.89 | 3.39 | 1.78 | 2.05 | 2.05 | | | | |
| PLACE1005875 | 3.56 | 1.05 | 0.65 | 5.19 | 5.82 | 3.59 | 3.48 | 3.10 | 3.1 | | | | |
| PLACE1005876 | 4.08 | 3.91 | 2.72 | 2.79 | 2.82 | 2.10 | 2.04 | 2.27 | 2.27 | | | * | − |
| PLACE1005878 | 5.27 | 2.13 | 2.19 | 4.92 | 3.53 | 2.84 | 3.83 | 3.82 | 3.82 | | | | |
| PLACE1005880 | 3.44 | 0.96 | 1.32 | 2.14 | 2.64 | 2.46 | 2.97 | 4.34 | 4.34 | | | | |
| PLACE1005884 | 1.76 | 0.52 | 0.55 | 1.39 | 1.77 | 1.41 | 2.43 | 2.29 | 2.29 | | | * | + |
| PLACE1005890 | 2.04 | 0.70 | 0.65 | 1.41 | 1.86 | 1.52 | 1.88 | 2.21 | 2.21 | | | | |
| PLACE1005898 | 2.99 | 2.09 | 1.71 | 4.94 | 3.42 | 2.88 | 2.46 | 3.27 | 3.27 | | | | |
| PLACE1005913 | 5.71 | 2.57 | 3.76 | 7.83 | 8.39 | 8.51 | 3.79 | 4.62 | 4.62 | * | + | | |
| PLACE1005921 | 10.98 | 4.34 | 4.34 | 9.34 | 8.32 | 8.81 | 6.16 | 6.43 | 6.43 | | | | |
| PLACE1005923 | 57.96 | 26.97 | 25.39 | 4.09 | 4.25 | 2.49 | 3.95 | 3.48 | 3.48 | * | − | * | − |
| PLACE1005925 | 2.51 | 0.91 | 2.14 | 3.11 | 3.71 | 2.82 | 1.93 | 2.80 | 2.8 | | | | |
| PLACE1005927 | 6.09 | 2.70 | 1.89 | 3.69 | 4.68 | 4.01 | 3.18 | 5.73 | 5.73 | | | | |
| PLACE1005932 | 1.82 | 0.71 | 0.41 | 1.33 | 1.76 | 1.08 | 1.15 | 1.54 | 1.54 | | | | |
| PLACE1005934 | 3.84 | 2.41 | 2.72 | 6.26 | 7.11 | 6.43 | 3.93 | 5.30 | 5.3 | ** | + | * | + |
| PLACE1005936 | 2.29 | 0.78 | 1.05 | 1.64 | 1.78 | 1.51 | 1.47 | 1.36 | 1.36 | | | | |
| PLACE1005939 | 6.69 | 4.35 | 3.92 | 5.44 | 5.46 | 3.73 | 16.40 | 25.30 | 25.3 | | | ** | + |
| PLACE1005951 | 5.63 | 2.39 | 2.32 | 4.86 | 4.02 | 3.74 | 3.42 | 3.43 | 3.43 | | | | |
| PLACE1005953 | 2.92 | 1.24 | 0.96 | 2.51 | 1.78 | 2.30 | 1.15 | 2.55 | 2.55 | | | | |
| PLACE1005955 | 3.7 | 1.62 | 1.62 | 2.35 | 3.61 | 2.40 | 3.03 | 3.07 | 3.07 | | | | |
| PLACE1005966 | 3.38 | 0.65 | 1.08 | 1.86 | 2.32 | 2.12 | 2.02 | 2.80 | 2.8 | | | | |
| PLACE1005968 | 10.55 | 5.64 | 5.72 | 7.48 | 5.88 | 6.36 | 5.68 | 7.85 | 7.85 | | | | |
| PLACE1005975 | 10.44 | 5.19 | 8.44 | 12.95 | 14.63 | 15.64 | 8.66 | 16.92 | 16.92 | * | + | | |
| PLACE1005990 | 3.19 | 1.43 | 1.58 | 2.28 | 2.05 | 1.79 | 1.80 | 3.26 | 3.26 | | | | |
| PLACE1005997 | 64.81 | 36.05 | 40.42 | 54.4 | 53.64 | 53.12 | 27.58 | 33.55 | 33.55 | | | | |

TABLE 308

| | | | | | | | | | | | | | |
|---|---|---|---|---|---|---|---|---|---|---|---|---|---|
| PLACE1006002 | 8.53 | 4.41 | 5.77 | 19.13 | 16.78 | 16.67 | 8.23 | 9.69 | 9.69 | ** | + | | |
| PLACE1006003 | 6.88 | 5.62 | 5.05 | 3.42 | 5.00 | 5.45 | 4.05 | 7.43 | 7.43 | | | | |
| PLACE1006011 | 4.72 | 2.78 | 3.04 | 3.63 | 3.41 | 3.26 | 2.90 | 3.61 | 3.61 | | | | |
| PLACE1006017 | 4.17 | 1.57 | 1.37 | 3.12 | 3.78 | 3.87 | 3.13 | 4.29 | 4.29 | | | | |
| PLACE1006037 | 8.36 | 3.71 | 4.44 | 4.09 | 4.76 | 4.29 | 2.99 | 4.73 | 4.73 | | | | |
| PLACE1006040 | 13.34 | 8.65 | 10.10 | 9.09 | 7.82 | 11.18 | 9.13 | 10.46 | 10.46 | | | | |
| PLACE1006063 | 4.18 | 2.39 | 2.46 | 2.52 | 3.00 | 2.07 | 2.59 | 2.91 | 2.91 | | | | |
| PLACE1006071 | 3.1 | 2.05 | 2.07 | 1.68 | 2.75 | 3.43 | 1.83 | 2.76 | 2.76 | | | | |
| PLACE1006073 | 3.97 | 2.14 | 1.81 | 6.25 | 6.16 | 5.43 | 3.65 | 5.10 | 5.1 | * | + | | |
| PLACE1006074 | 4.44 | 2.36 | 2.42 | 6.36 | 6.76 | 5.83 | 2.98 | 4.13 | 4.13 | * | + | | |
| PLACE1006076 | 1.24 | 0.92 | 1.14 | 3.37 | 4.38 | 2.74 | 2.16 | 3.59 | 3.59 | ** | + | * | + |
| PLACE1006079 | 4.64 | 2.47 | 2.65 | 3.89 | 4.84 | 4.04 | 4.58 | 5.85 | 5.85 | | | | |
| PLACE1006093 | 1.06 | 0.90 | 1.72 | 1.34 | 1.63 | 0.86 | 2.10 | 2.38 | 2.38 | | | * | + |
| PLACE1006116 | 2.79 | 1.95 | 1.97 | 2.66 | 2.53 | 2.69 | 3.38 | 3.33 | 3.33 | | | * | + |
| PLACE1006119 | 2.59 | 2.94 | 2.87 | 5.28 | 4.68 | 6.57 | 3.23 | 3.84 | 3.84 | ** | + | * | + |
| PLACE1006129 | 2.82 | 1.25 | 0.50 | 2.84 | 2.73 | 3.10 | 3.07 | 1.53 | 1.53 | | | | |
| PLACE1006139 | 7.84 | 6.54 | 4.25 | 6.48 | 5.34 | 5.86 | 6.94 | 4.78 | 4.78 | | | | |
| PLACE1006143 | 2.36 | 1.84 | 1.60 | 4.6 | 3.86 | 4.22 | 1.68 | 3.18 | 3.18 | ** | + | | |
| PLACE1006157 | 2.84 | 1.26 | 1.64 | 2.25 | 2.35 | 1.82 | 1.52 | 2.36 | 2.36 | | | | |
| PLACE1006159 | 1.74 | 1.38 | 1.27 | 2.48 | 3.25 | 2.76 | 3.72 | 4.61 | 4.61 | ** | + | ** | + |
| PLACE1006164 | 0.77 | 0.31 | 0.34 | 1.19 | 1.94 | 1.20 | 1.01 | 0.99 | 0.99 | * | + | * | + |
| PLACE1006167 | 6.97 | 5.82 | 7.53 | 6.63 | 9.38 | 9.10 | 8.80 | 7.88 | 7.88 | | | | |
| PLACE1006170 | 3.23 | 2.05 | 2.23 | 3.8 | 5.15 | 4.56 | 3.39 | 4.89 | 4.89 | * | + | * | + |
| PLACE1006181 | 4.1 | 2.72 | 3.53 | 6.41 | 6.16 | 6.21 | 5.86 | 6.48 | 6.48 | ** | + | ** | + |
| PLACE1006187 | 0.5 | 0.33 | 0.10 | 0.86 | 0.82 | 1.09 | 0.66 | 0.49 | 0.49 | * | + | | |
| PLACE1006195 | 3.24 | 1.23 | 1.17 | 2.67 | 2.87 | 2.14 | 2.62 | 1.30 | 1.3 | | | | |
| PLACE1006196 | 8.03 | 2.93 | 3.80 | 5.31 | 7.47 | 6.96 | 4.75 | 3.79 | 3.79 | | | | |
| PLACE1006197 | 7.57 | 3.83 | 6.49 | 6.35 | 7.27 | 5.99 | 3.44 | 4.86 | 4.86 | | | | |
| PLACE1006198 | 2.55 | 1.19 | 1.79 | 2.81 | 2.56 | 2.19 | 0.91 | 2.46 | 2.46 | | | | |
| PLACE1006205 | 0.84 | 0.89 | 1.05 | 0.57 | 0.49 | 1.57 | 0.74 | 1.36 | 1.36 | | | | |
| PLACE1006208 | 2.19 | 1.80 | 3.16 | 5 | 4.18 | 5.05 | 7.99 | 4.42 | 4.42 | ** | + | | |
| PLACE1006211 | 24.46 | 16.10 | 17.64 | 12.62 | 6.69 | 13.24 | 6.25 | 5.01 | 5.01 | | | ** | − |
| PLACE1006219 | 3.37 | 2.25 | 3.36 | 4.14 | 6.29 | 3.89 | 6.74 | 5.53 | 5.53 | | | ** | + |
| PLACE1006223 | 1.64 | 1.06 | 2.11 | 4.34 | 4.03 | 4.26 | 2.35 | 1.45 | 1.45 | ** | + | | |
| PLACE1006225 | 1.79 | 1.20 | 1.26 | 2 | 1.95 | 1.83 | 1.23 | 1.27 | 1.27 | | | | |
| PLACE1006236 | 1.44 | 1.01 | 1.87 | 3.01 | 4.09 | 1.96 | 1.59 | 2.02 | 2.02 | | | | |
| PLACE1006239 | 1.72 | 1.00 | 1.18 | 2.46 | 2.48 | 2.60 | 1.22 | 3.24 | 3.24 | ** | + | | |
| PLACE1006245 | 3.4 | 2.04 | 2.24 | 3.29 | 3.77 | 3.95 | 2.39 | 2.28 | 2.28 | | | | |
| PLACE1006246 | 2.78 | 1.91 | 2.09 | 2.77 | 4.35 | 3.44 | 2.43 | 1.97 | 1.97 | | | | |
| PLACE1006248 | 1.93 | 1.11 | 1.30 | 3.09 | 2.89 | 3.27 | 2.22 | 1.63 | 1.63 | ** | + | | |
| PLACE1006262 | 3.84 | 0.83 | 1.42 | 2.66 | 2.88 | 1.75 | 2.15 | 1.21 | 1.21 | | | | |

TABLE 308-continued

| | | | | | | | | | | | | | |
|---|---|---|---|---|---|---|---|---|---|---|---|---|---|
| PLACE1006269 | 3.04 | 1.04 | 0.97 | 1.76 | 1.81 | 1.87 | 1.28 | 1.88 | 1.88 | | | | |
| PLACE1006275 | 7.22 | 3.03 | 3.50 | 4.21 | 3.01 | 5.50 | 3.90 | 5.68 | 5.68 | | | | |
| PLACE1006277 | 2.96 | 1.17 | 2.13 | 3.73 | 2.55 | 2.62 | 1.86 | 2.11 | 2.11 | | | | |
| PLACE1006288 | 11.06 | 5.08 | 6.39 | 7.42 | 7.01 | 7.05 | 7.31 | 9.33 | 9.33 | | | | |
| PLACE1006290 | 2.57 | 0.88 | 2.08 | 1.76 | 1.36 | 2.22 | 3.49 | 3.56 | 3.56 | | | * | + |
| PLACE1006298 | 4.88 | 1.93 | 2.02 | 5.27 | 5.25 | 6.12 | 2.74 | 3.06 | 3.06 | | | | |
| PLACE1006311 | 0.92 | 0.15 | 0.41 | 0.82 | 0.31 | 0.81 | 2.11 | 2.64 | 2.64 | | | ** | + |
| PLACE1006318 | 4.74 | 1.72 | 2.13 | 3.2 | 4.07 | 2.67 | 3.29 | 3.63 | 3.63 | | | | |
| PLACE1006325 | 9.29 | 2.77 | 3.97 | 3.52 | 11.00 | 5.12 | 4.02 | 5.45 | 5.45 | | | | |
| PLACE1006331 | 4.1 | 2.50 | 3.35 | 6.3 | 7.84 | 7.16 | 3.59 | 5.15 | 5.15 | ** | + | | |
| PLACE1006335 | 4.07 | 1.71 | 1.37 | 3.4 | 2.75 | 3.34 | 2.92 | 1.94 | 1.94 | | | | |
| PLACE1006357 | 1.19 | 0.25 | 0.48 | 0.63 | 0.90 | 0.73 | 0.68 | 1.54 | 1.54 | | | | |
| PLACE1006360 | 5.46 | 2.85 | 2.81 | 3.84 | 5.35 | 5.87 | 2.18 | 2.76 | 2.76 | | | | |
| PLACE1006364 | 2.49 | 1.09 | 1.52 | 2.96 | 1.99 | 3.19 | 1.91 | 2.29 | 2.29 | | | | |
| PLACE1006365 | 0.49 | 0.34 | 1.09 | 1.19 | 1.22 | 2.88 | 0.94 | 1.48 | 1.48 | | | | |

TABLE 309

| | | | | | | | | | | | | | |
|---|---|---|---|---|---|---|---|---|---|---|---|---|---|
| PLACE1006368 | 8.01 | 4.14 | 3.31 | 4.49 | 6.87 | 3.91 | 2.14 | 3.48 | 3.48 | | | | |
| PLACE1006371 | 3.39 | 1.39 | 1.67 | 3.81 | 5.96 | 2.01 | 3.24 | 1.56 | 1.56 | | | | |
| PLACE1006373 | 3.53 | 2.18 | 2.19 | 3.47 | 4.18 | 3.83 | 2.92 | 2.88 | 2.88 | | | | |
| PLACE1006382 | 0.97 | 0.61 | 1.44 | 1.43 | 2.65 | 2.53 | 1.94 | 2.62 | 2.62 | | | * | + |
| PLACE1006385 | 4.48 | 1.74 | 2.64 | 3.36 | 3.37 | 3.94 | 3.78 | 4.13 | 4.13 | | | | |
| PLACE1006391 | 2.37 | 0.62 | 1.55 | 2.01 | 1.29 | 1.94 | 1.72 | 2.56 | 2.56 | | | | |
| PLACE1006412 | 4.8 | 2.68 | 3.85 | 7.96 | 8.66 | 10.16 | 7.60 | 4.54 | 4.54 | ** | + | | |
| PLACE1006414 | 1.25 | 0.89 | 0.94 | 1.45 | 2.86 | 1.96 | 0.92 | 1.08 | 1.08 | | | | |
| PLACE1006419 | 17.56 | 9.39 | 8.08 | 6.95 | 7.32 | 5.48 | 8.27 | 8.11 | 8.11 | | | | |
| PLACE1006438 | 8.55 | 3.61 | 3.22 | 5.14 | 6.25 | 6.01 | 5.43 | 4.95 | 4.95 | | | | |
| PLACE1006443 | 13.27 | 8.13 | 8.94 | 9.9 | 11.09 | 10.15 | 9.09 | 10.58 | 10.58 | | | | |
| PLACE1006445 | 4.37 | 2.38 | 3.95 | 6.95 | 9.30 | 6.55 | 3.68 | 5.38 | 5.38 | * | + | | |
| PLACE1006447 | 3.95 | 1.73 | 1.16 | 4.37 | 4.04 | 4.18 | 2.52 | 2.55 | 2.55 | | | | |
| PLACE1006466 | 2.16 | 1.21 | 1.47 | 2 | 2.00 | 2.12 | 1.67 | 2.19 | 2.19 | | | | |
| PLACE1006469 | 5.27 | 2.73 | 2.42 | 5.93 | 3.56 | 4.11 | 2.77 | 4.56 | 4.56 | | | | |
| PLACE1006470 | 5.41 | 1.20 | 2.14 | 5.2 | 5.53 | 6.27 | 4.08 | 3.01 | 3.01 | | | | |
| PLACE1006472 | 11.56 | 7.21 | 5.05 | 18.35 | 19.64 | 11.78 | 13.72 | 15.01 | 15.01 | * | + | * | + |
| PLACE1006476 | 5.69 | 2.73 | 2.21 | 5.81 | 8.49 | 6.21 | 4.48 | 5.62 | 5.62 | | | | |
| PLACE1006482 | 2.17 | 1.70 | 2.74 | 3.32 | 3.51 | 3.07 | 2.54 | 2.44 | 2.44 | * | + | | |
| PLACE1006488 | 12.25 | 5.32 | 6.03 | 9.43 | 11.28 | 10.04 | 10.74 | 9.34 | 9.34 | | | | |
| PLACE1006492 | 6.49 | 3.62 | 3.60 | 9.32 | 9.53 | 11.55 | 11.09 | 11.09 | 11.09 | ** | + | ** | + |
| PLACE1006506 | 4.02 | 1.67 | 1.46 | 3.66 | 1.98 | 4.89 | 2.21 | 2.62 | 2.62 | | | | |
| PLACE1006515 | 1.42 | 1.65 | 2.04 | 2.45 | 1.89 | 3.92 | 0.81 | 1.40 | 1.4 | | | | |
| PLACE1006516 | 2.44 | 0.98 | 1.54 | 4.26 | 3.82 | 5.07 | 3.64 | 3.02 | 3.02 | ** | + | * | + |
| PLACE1006520 | 3.63 | 0.73 | 1.91 | 3.9 | 6.61 | 4.44 | 1.81 | 3.39 | 3.39 | | | | |
| PLACE1006521 | 6.56 | 3.47 | 2.11 | 9.33 | 11.45 | 8.09 | 6.98 | 6.31 | 6.31 | * | + | | |
| PLACE1006529 | 8.21 | 3.84 | 3.76 | 6.99 | 8.95 | 8.26 | 5.00 | 11.36 | 11.36 | | | | |
| PLACE1006531 | 4.94 | 2.43 | 2.89 | 5.42 | 4.81 | 4.48 | 4.13 | 3.68 | 3.68 | | | | |
| PLACE1006534 | 5.02 | 1.96 | 2.25 | 4.42 | 4.01 | 5.10 | 4.71 | 2.91 | 2.91 | | | | |
| PLACE1006540 | 7.85 | 3.19 | 3.56 | 8.91 | 8.99 | 10.06 | 5.53 | 6.70 | 6.7 | * | + | | |
| PLACE1006549 | 6.58 | 4.45 | 4.11 | 5.8 | 5.03 | 4.33 | 3.92 | 6.01 | 6.01 | | | | |
| PLACE1006550 | 5.23 | 2.28 | 2.45 | 4.69 | 4.00 | 3.88 | 3.29 | 3.49 | 3.49 | | | | |
| PLACE1006552 | 6.12 | 1.72 | 2.67 | 5.75 | 4.74 | 3.07 | 2.71 | 2.86 | 2.86 | | | | |
| PLACE1006557 | 5.34 | 2.94 | 3.14 | 4.05 | 3.81 | 4.16 | 3.41 | 4.94 | 4.94 | | | | |
| PLACE1006563 | 9.2 | 2.53 | 5.98 | 6.32 | 8.19 | 6.80 | 4.10 | 7.57 | 7.57 | | | | |
| PLACE1006579 | 2.63 | 1.19 | 1.62 | 2.98 | 3.80 | 3.82 | 2.66 | 2.84 | 2.84 | * | + | | |
| PLACE1006594 | 2.07 | 1.44 | 0.90 | 5.07 | 5.06 | 4.32 | 1.36 | 3.33 | 3.33 | ** | + | | |
| PLACE1006598 | 1.81 | 0.42 | 0.76 | 1.91 | 2.22 | 2.18 | 1.31 | 2.09 | 2.09 | | | | |
| PLACE1006607 | 3.34 | 1.19 | 1.08 | 3.9 | 3.89 | 4.86 | 2.07 | 2.61 | 2.61 | * | + | | |
| PLACE1006610 | 8.31 | 5.63 | 5.00 | 11.87 | 9.53 | 10.14 | 8.32 | 7.46 | 7.46 | * | + | | |
| PLACE1006615 | 14.76 | 9.42 | 9.72 | 14.75 | 13.78 | 11.87 | 9.86 | 12.58 | 12.58 | | | | |
| PLACE1006617 | 3.05 | 1.29 | 1.68 | 3.75 | 3.86 | 3.39 | 2.76 | 2.76 | 2.76 | * | + | | |
| PLACE1006618 | 6.92 | 2.44 | 3.52 | 4.27 | 4.86 | 5.91 | 4.69 | 6.70 | 6.7 | | | | |
| PLACE1006626 | 5.11 | 2.06 | 2.30 | 4.94 | 4.91 | 4.81 | 2.78 | 5.05 | 5.05 | | | | |
| PLACE1006629 | 0.66 | 0.42 | 0.61 | 1.08 | 1.24 | 1.75 | 1.19 | 2.37 | 2.37 | * | + | * | + |
| PLACE1006637 | 4.27 | 1.61 | 1.80 | 4.69 | 6.26 | 5.06 | 2.25 | 2.76 | 2.76 | * | + | | |
| PLACE1006640 | 0.61 | 0.64 | 0.44 | 0.58 | 0.66 | 0.88 | 0.53 | 0.93 | 0.93 | | | | |
| PLACE1006644 | 4.05 | 2.79 | 2.37 | 3.98 | 3.74 | 4.19 | 3.10 | 4.40 | 4.4 | | | | |
| PLACE1006657 | 2 | 0.91 | 0.90 | 4.27 | 3.82 | 3.51 | 2.62 | 2.98 | 2.98 | ** | + | * | + |
| PLACE1006673 | 4.86 | 2.75 | 3.39 | 6.61 | 5.20 | 7.30 | 3.73 | 3.71 | 3.71 | * | + | | |
| PLACE1006678 | 2.03 | 0.79 | 2.52 | 1.93 | 2.13 | 1.51 | 1.82 | 3.83 | 3.83 | | | | |
| PLACE1006682 | 12.66 | 6.71 | 7.70 | 9.17 | 11.56 | 9.08 | 12.78 | 10.93 | 10.93 | | | | |
| PLACE1006684 | 0.85 | 0.40 | 0.58 | 0.51 | 0.62 | 0.80 | 0.74 | 0.98 | 0.98 | | | | |
| PLACE1006698 | 2.49 | 1.60 | 2.01 | 2.82 | 3.08 | 3.05 | 2.36 | 3.97 | 3.97 | * | + | | |
| PLACE1006704 | 2.61 | 1.71 | 2.74 | 4.42 | 5.65 | 7.34 | 3.32 | 3.83 | 3.83 | * | + | * | + |
| PLACE1006708 | 5.71 | 3.09 | 2.56 | 5.97 | 10.34 | 7.12 | 1.92 | 5.99 | 5.99 | | | | |

TABLE 310

| | | | | | | | | | | | | | |
|---|---|---|---|---|---|---|---|---|---|---|---|---|---|
| PLACE1006711 | 7.17 | 2.48 | 3.66 | 6.98 | 7.47 | 5.78 | 4.03 | 4.95 | 4.95 | | | | |
| PLACE1006714 | 3.92 | 2.24 | 1.78 | 5.56 | 4.95 | 3.81 | 3.00 | 4.91 | 4.91 | | | | |
| PLACE1006716 | 2.25 | 1.27 | 1.41 | 2.91 | 2.85 | 2.05 | 3.03 | 4.59 | 4.59 | | | * | + |
| PLACE1006731 | 2.78 | 1.41 | 1.10 | 2.51 | 2.88 | 3.14 | 3.12 | 3.70 | 3.7 | | | * | + |
| PLACE1006754 | 2.7 | 1.40 | 1.42 | 2.85 | 1.89 | 2.31 | 2.05 | 2.80 | 2.8 | | | | |
| PLACE1006760 | 3.7 | 1.96 | 3.99 | 17.24 | 15.19 | 18.35 | 5.74 | 7.75 | 7.75 | ** | + | * | + |
| PLACE1006779 | 0.53 | 0.60 | 0.34 | 1.36 | 0.57 | 1.21 | 0.75 | 1.01 | 1.01 | | | * | + |
| PLACE1006782 | 3.05 | 2.67 | 1.94 | 3.22 | 2.17 | 3.97 | 2.17 | 3.27 | 3.27 | | | | |
| PLACE1006783 | 2.73 | 1.09 | 1.46 | 2.19 | 2.99 | 2.41 | 1.48 | 1.96 | 1.96 | | | | |
| PLACE1006786 | 2.68 | 1.84 | 0.83 | 3.12 | 2.79 | 4.30 | 2.72 | 2.69 | 2.69 | | | | |
| PLACE1006792 | 5.78 | 3.42 | 3.75 | 8.62 | 10.09 | 8.98 | 4.28 | 5.86 | 5.86 | ** | + | | |
| PLACE1006795 | 0.68 | 0.34 | 0.21 | 1.2 | 1.49 | 1.27 | 1.37 | 1.67 | 1.67 | ** | + | ** | + |
| PLACE1006800 | 0.58 | 0.50 | 0.45 | 1.01 | 1.36 | 1.09 | 0.49 | 1.98 | 1.98 | ** | + | | |
| PLACE1006805 | 1.33 | 0.93 | 2.03 | 1.99 | 1.23 | 2.62 | 4.47 | 8.37 | 8.37 | | | * | + |
| PLACE1006809 | 3.99 | 2.53 | 2.85 | 4.94 | 4.18 | 4.26 | 2.87 | 3.81 | 3.81 | | | | |
| PLACE1006815 | 2.42 | 2.62 | 2.14 | 3.2 | 3.02 | 2.39 | 2.60 | 2.42 | 2.42 | | | | |
| PLACE1006819 | 0.94 | 0.46 | 0.62 | 1.41 | 2.34 | 1.11 | 0.55 | 1.74 | 1.74 | | | | |
| PLACE1006820 | 4.68 | 2.07 | 1.78 | 6.12 | 5.69 | 5.61 | 3.23 | 3.27 | 3.27 | * | + | | |
| PLACE1006826 | 5.96 | 2.02 | 3.35 | 4.28 | 4.36 | 3.41 | 2.91 | 3.64 | 3.64 | | | | |
| PLACE1006829 | 5.22 | 3.72 | 3.02 | 4.2 | 5.82 | 4.43 | 2.98 | 5.22 | 5.22 | | | | |
| PLACE1006853 | 1.92 | 0.96 | 0.85 | 1.93 | 2.19 | 2.15 | 1.79 | 1.77 | 1.77 | | | | |
| PLACE1006860 | 0.52 | 0.28 | 0.19 | 0.7 | 1.33 | 1.10 | 0.18 | 0.88 | 0.88 | * | + | | |
| PLACE1006867 | 3.61 | 1.51 | 1.29 | 3.02 | 3.99 | 3.62 | 1.66 | 1.92 | 1.92 | | | | |
| PLACE1006875 | 3.81 | 2.86 | 3.20 | 2.81 | 3.41 | 2.95 | 2.46 | 3.28 | 3.28 | | | | |
| PLACE1006878 | 2.74 | 2.03 | 2.05 | 2.44 | 3.93 | 2.25 | 1.87 | 2.15 | 2.15 | | | | |
| PLACE1006883 | 6.43 | 2.64 | 2.47 | 5.83 | 6.59 | 4.26 | 4.67 | 3.84 | 3.84 | | | | |
| PLACE1006898 | 2.65 | 0.75 | 0.60 | 1.14 | 1.52 | 1.02 | 0.75 | 1.07 | 1.07 | | | | |
| PLACE1006901 | 2.51 | 0.47 | 1.17 | 2.93 | 3.57 | 2.34 | 0.90 | 1.69 | 1.69 | | | | |
| PLACE1006904 | 2.19 | 1.14 | 0.97 | 3.15 | 2.91 | 3.59 | 2.13 | 2.06 | 2.06 | * | + | | |
| PLACE1006917 | 6.14 | 2.79 | 3.06 | 4.32 | 4.29 | 4.20 | 3.17 | 2.44 | 2.44 | | | | |
| PLACE1006932 | 5 | 1.78 | 2.39 | 3.19 | 3.17 | 4.46 | 2.94 | 4.82 | 4.82 | | | | |
| PLACE1006935 | 2.14 | 0.74 | 0.92 | 1.51 | 0.93 | 2.00 | 1.13 | 1.70 | 1.7 | | | | |
| PLACE1006956 | 4.8 | 2.30 | 2.67 | 3.82 | 4.93 | 3.67 | 2.67 | 3.02 | 3.02 | | | | |
| PLACE1006958 | 3.3 | 0.68 | 0.97 | 1.15 | 2.53 | 1.83 | 2.18 | 2.76 | 2.76 | | | | |
| PLACE1006959 | 5.12 | 2.95 | 4.08 | 5.45 | 7.11 | 5.94 | 4.25 | 6.06 | 6.06 | | | | |
| PLACE1006961 | 6.24 | 3.14 | 3.71 | 8.87 | 11.45 | 12.47 | 5.75 | 6.96 | 6.96 | * | + | * | + |
| PLACE1006962 | 3.09 | 1.63 | 2.08 | 6.06 | 7.00 | 5.67 | 3.12 | 4.82 | 4.82 | ** | + | * | + |
| PLACE1006966 | 3.67 | 1.18 | 1.70 | 1.85 | 1.83 | 1.79 | 1.92 | 2.51 | 2.51 | | | | |
| PLACE1006979 | 2 | 0.97 | 1.09 | 2.59 | 1.79 | 2.03 | 1.44 | 1.20 | 1.2 | | | | |
| PLACE1006989 | 6.78 | 4.06 | 4.71 | 5.85 | 5.19 | 8.95 | 4.33 | 4.95 | 4.95 | | | | |
| PLACE1007001 | 4.54 | 2.23 | 1.52 | 6.32 | 8.61 | 5.77 | 3.73 | 6.03 | 6.03 | * | + | | |
| PLACE1007014 | 7.18 | 3.58 | 3.26 | 4.66 | 5.59 | 4.03 | 3.90 | 5.33 | 5.33 | | | | |
| PLACE1007021 | 1.97 | 0.96 | 1.13 | 2.46 | 2.25 | 1.64 | 1.52 | 0.94 | 0.94 | | | | |
| PLACE1007026 | 2.03 | 0.23 | 0.75 | 2.47 | 2.67 | 2.53 | 4.15 | 4.32 | 4.32 | * | + | ** | + |
| PLACE1007028 | 3.59 | 1.48 | 2.53 | 3.68 | 2.34 | 2.63 | 3.78 | 4.37 | 4.37 | | | | |
| PLACE1007038 | 9.6 | 3.28 | 7.64 | 12.57 | 9.19 | 16.41 | 73.23 | 81.92 | 81.92 | | | ** | + |
| PLACE1007040 | 3.28 | 1.64 | 2.20 | 3.38 | 2.82 | 2.64 | 2.43 | 2.13 | 2.13 | | | | |
| PLACE1007045 | 2.23 | 0.95 | 1.52 | 6.73 | 6.04 | 4.31 | 5.12 | 5.62 | 5.62 | ** | + | ** | + |
| PLACE1007048 | 283.34 | 168.88 | 128.09 | 131.34 | 214.44 | 117.39 | 119.27 | 112.98 | 113 | | | | |
| PLACE1007053 | 5.82 | 1.54 | 2.58 | 3.59 | 4.38 | 2.76 | 2.77 | 4.36 | 4.36 | | | | |
| PLACE1007068 | 5.93 | 3.20 | 2.64 | 4.13 | 5.60 | 3.12 | 3.77 | 3.46 | 3.46 | | | | |
| PLACE1007070 | 1.79 | 1.14 | 1.74 | 2.68 | 3.48 | 2.65 | 2.23 | 3.69 | 3.69 | * | + | * | + |
| PLACE1007076 | 49.7 | 17.82 | 25.75 | 20.08 | 16.26 | 21.00 | 15.39 | 17.24 | 17.24 | | | | |
| PLACE1007077 | 2.93 | 1.23 | 2.63 | 2.96 | 2.01 | 1.85 | 3.14 | 3.21 | 3.21 | | | | |
| PLACE1007081 | 1.29 | 0.25 | 0.75 | 1.37 | 1.15 | 1.43 | 0.54 | 1.23 | 1.23 | | | | |
| PLACE1007082 | 8.76 | 4.12 | 5.94 | 5.68 | 4.75 | 5.79 | 2.91 | 3.11 | 3.11 | | | | |

TABLE 311

| | | | | | | | | | | | | | |
|---|---|---|---|---|---|---|---|---|---|---|---|---|---|
| PLACE1007092 | 13.8 | 11.82 | 5.85 | 6.03 | 7.76 | 3.70 | 4.55 | 4.38 | 4.38 | | | | |
| PLACE1007096 | 3.67 | 1.72 | 2.42 | 3.85 | 3.61 | 3.33 | 2.77 | 3.95 | 3.95 | | | | |
| PLACE1007097 | 2.22 | 0.99 | 0.99 | 1.67 | 2.32 | 2.35 | 2.32 | 1.09 | 1.09 | | | | |
| PLACE1007099 | 3.21 | 1.35 | 2.99 | 3.75 | 3.60 | 3.90 | 2.21 | 4.60 | 4.6 | | | | |
| PLACE1007105 | 3.27 | 1.47 | 1.70 | 2.02 | 1.66 | 2.46 | 3.10 | 2.81 | 2.81 | | | | |
| PLACE1007108 | 1.84 | 0.54 | 0.64 | 1.21 | 1.32 | 0.77 | 1.03 | 1.13 | 1.13 | | | | |
| PLACE1007111 | 1.12 | 0.75 | 0.77 | 2.41 | 0.87 | 1.64 | 1.17 | 1.43 | 1.43 | | | * | + |
| PLACE1007112 | 2.23 | 1.33 | 1.93 | 1.71 | 1.54 | 2.89 | 1.30 | 2.04 | 2.04 | | | | |
| PLACE1007130 | 1.72 | 0.36 | 0.26 | 1 | 1.71 | 0.63 | 0.85 | 1.29 | 1.29 | | | | |
| PLACE1007132 | 3.87 | 1.51 | 1.93 | 3.65 | 4.98 | 3.98 | 2.58 | 2.83 | 2.83 | | | | |
| PLACE1007140 | 2.78 | 1.67 | 1.49 | 5.51 | 4.02 | 1.95 | 1.59 | 4.61 | 4.61 | | | | |
| PLACE1007143 | 4.57 | 2.06 | 2.35 | 3.69 | 3.88 | 3.45 | 2.67 | 3.35 | 3.35 | | | | |
| PLACE1007169 | 7.86 | 3.91 | 6.07 | 4.6 | 3.97 | 4.34 | 4.66 | 5.06 | 5.06 | | | | |
| PLACE1007178 | 3.63 | 1.78 | 2.11 | 3.46 | 2.58 | 2.44 | 3.58 | 4.50 | 4.5 | | | | |
| PLACE1007190 | 1.52 | 0.85 | 1.18 | 1.02 | 0.96 | 1.35 | 1.62 | 1.51 | 1.51 | | | | |
| PLACE1007201 | 1.85 | 0.34 | 1.11 | 1.37 | 0.91 | 2.07 | 0.93 | 1.05 | 1.05 | | | | |
| PLACE1007202 | 18.73 | 9.75 | 12.22 | 19.49 | 17.57 | 13.05 | 23.70 | 22.24 | 22.24 | | | * | + |

TABLE 311-continued

| | | | | | | | | | | | | | |
|---|---|---|---|---|---|---|---|---|---|---|---|---|---|
| PLACE1007226 | 4.6 | 2.18 | 1.44 | 3.72 | 3.17 | 3.32 | 4.10 | 4.25 | 4.25 | | | | |
| PLACE1007238 | 4.59 | 1.78 | 4.87 | 4.05 | 4.43 | 2.63 | 3.54 | 2.85 | 2.85 | | | | |
| PLACE1007239 | 4.19 | 2.58 | 2.67 | 5.05 | 3.84 | 2.86 | 3.07 | 4.50 | 4.5 | | | | |
| PLACE1007242 | 3.6 | 1.20 | 1.84 | 1.27 | 2.10 | 2.41 | 1.99 | 2.58 | 2.58 | | | | |
| PLACE1007243 | 10.2 | 5.01 | 6.25 | 4.24 | 5.71 | 6.21 | 7.36 | 6.08 | 6.08 | | | | |
| PLACE1007247 | 3.28 | 2.10 | 1.67 | 14.75 | 8.63 | 15.61 | 4.03 | 8.60 | 8.6 | ** | + | * | + |
| PLACE1007257 | 7.61 | 5.72 | 7.16 | 3.66 | 3.64 | 3.79 | 1.96 | 3.64 | 3.64 | ** | − | ** | − |
| PLACE1007274 | 4.38 | 2.42 | 3.36 | 7.38 | 8.79 | 6.79 | 3.07 | 4.64 | 4.64 | ** | + | | |
| PLACE1007276 | 2.97 | 1.43 | 1.54 | 2.93 | 2.81 | 2.34 | 1.57 | 3.92 | 3.92 | | | | |
| PLACE1007282 | 8.6 | 4.51 | 8.76 | 10.51 | 12.35 | 10.29 | 22.66 | 27.14 | 27.14 | | | ** | + |
| PLACE1007286 | 6 | 1.42 | 3.35 | 6.08 | 8.09 | 5.91 | 3.36 | 4.27 | 4.27 | | | | |
| PLACE1007296 | 5.96 | 3.96 | 4.56 | 9.09 | 9.08 | 8.48 | 6.51 | 8.92 | 8.92 | ** | + | * | + |
| PLACE1007301 | 1.48 | 0.84 | 0.72 | 0.94 | 1.65 | 0.98 | 0.49 | 0.96 | 0.96 | | | | |
| PLACE1007314 | 7.72 | 5.09 | 4.39 | 7.99 | 9.50 | 9.98 | 8.19 | 8.10 | 8.1 | * | + | | |
| PLACE1007317 | 1.71 | 0.70 | 0.71 | 2.11 | 1.11 | 1.58 | 1.38 | 1.29 | 1.29 | | | | |
| PLACE1007329 | 1.19 | 1.05 | 0.73 | 3.19 | 2.34 | 1.79 | 1.73 | 2.65 | 2.65 | * | + | * | + |
| PLACE1007338 | 5.4 | 1.79 | 2.69 | 4.68 | 5.71 | 4.16 | 3.17 | 5.55 | 5.55 | | | | |
| PLACE1007342 | 2.46 | 2.38 | 1.37 | 2.04 | 2.30 | 2.39 | 2.65 | 5.91 | 5.91 | | | | |
| PLACE1007345 | 2.86 | 1.45 | 1.69 | 3.47 | 3.21 | 3.18 | 2.59 | 3.21 | 3.21 | * | + | | |
| PLACE1007356 | 5.8 | 4.00 | 4.67 | 8.73 | 7.57 | 8.39 | 4.92 | 8.73 | 8.73 | ** | + | | |
| PLACE1007359 | 3.11 | 1.64 | 2.21 | 3.58 | 2.56 | 2.94 | 3.24 | 3.82 | 3.82 | | | * | + |
| PLACE1007367 | 9.92 | 5.57 | 5.83 | 12.43 | 19.19 | 16.79 | 8.33 | 10.26 | 10.26 | * | + | | |
| PLACE1007375 | 1.77 | 1.76 | 1.63 | 2.23 | 2.83 | 2.75 | 1.31 | 0.63 | 0.63 | * | + | * | − |
| PLACE1007377 | 4.63 | 2.52 | 2.53 | 3.52 | 3.56 | 1.75 | 2.11 | 3.18 | 3.18 | | | | |
| PLACE1007386 | 1.87 | 0.97 | 0.83 | 6.47 | 6.90 | 6.45 | 4.13 | 3.04 | 3.04 | ** | + | * | + |
| PLACE1007392 | 2.72 | 3.07 | 3.82 | 2.83 | 2.94 | 3.03 | 2.89 | 3.43 | 3.43 | | | | |
| PLACE1007402 | 2.84 | 2.88 | 1.67 | 3.44 | 3.03 | 2.39 | 3.94 | 2.99 | 2.99 | | | | |
| PLACE1007409 | 0.93 | 0.91 | 1.34 | 1.36 | 1.18 | 1.53 | 1.35 | 1.51 | 1.51 | | | | |
| PLACE1007416 | 1.46 | 1.48 | 1.61 | 3.34 | 3.06 | 3.14 | 3.57 | 4.84 | 4.84 | ** | + | ** | + |
| PLACE1007420 | 9.86 | 15.04 | 12.94 | 15.1 | 14.93 | 22.60 | 15.85 | 14.30 | 14.3 | | | | |
| PLACE1007431 | 0.76 | 1.71 | 1.22 | 1.19 | 2.25 | 1.99 | 1.64 | 1.51 | 1.51 | | | | |
| PLACE1007450 | 4.02 | 1.67 | 1.64 | 5.21 | 4.82 | 5.24 | 2.44 | 2.49 | 2.49 | * | + | | |
| PLACE1007452 | 2.24 | 1.00 | 1.94 | 2.6 | 2.82 | 2.49 | 1.40 | 3.18 | 3.18 | | | | |
| PLACE1007454 | 10.17 | 5.34 | 5.33 | 10.9 | 13.21 | 14.02 | 9.07 | 11.14 | 11.14 | * | + | | |
| PLACE1007460 | 3.51 | 2.45 | 2.56 | 3.47 | 3.50 | 3.36 | 2.34 | 2.84 | 2.84 | | | | |
| PLACE1007478 | 1.85 | 1.34 | 0.98 | 2.14 | 2.65 | 2.21 | 0.62 | 1.89 | 1.89 | * | + | | |
| PLACE1007484 | 1.62 | 2.03 | 1.82 | 4.03 | 4.26 | 4.32 | 4.30 | 4.48 | 4.48 | ** | + | ** | + |
| PLACE1007488 | 2.83 | 1.13 | 1.39 | 2.08 | 1.66 | 1.77 | 1.01 | 1.64 | 1.64 | | | | |
| PLACE1007507 | 4.17 | 3.85 | 4.18 | 3.46 | 1.91 | 4.23 | 1.30 | 2.17 | 2.17 | | | ** | − |

TABLE 312

| | | | | | | | | | | | | | |
|---|---|---|---|---|---|---|---|---|---|---|---|---|---|
| PLACE1007511 | 1.09 | 1.11 | 0.68 | 1.33 | 1.45 | 0.75 | 0.90 | 1.48 | 1.48 | | | | |
| PLACE1007513 | 4.69 | 1.71 | 2.94 | 3.5 | 3.66 | 3.78 | 3.32 | 6.37 | 6.37 | | | | |
| PLACE1007524 | 6.92 | 2.48 | 2.90 | 3.93 | 4.08 | 2.82 | 1.80 | 1.66 | 1.66 | | | | |
| PLACE1007525 | 4.99 | 2.20 | 2.97 | 4.48 | 5.31 | 5.23 | 2.35 | 2.30 | 2.3 | | | | |
| PLACE1007537 | 3.67 | 3.75 | 2.72 | 3.67 | 3.58 | 4.70 | 2.62 | 4.19 | 4.19 | | | | |
| PLACE1007544 | 1.23 | 1.96 | 1.26 | 3.11 | 3.23 | 2.88 | 3.01 | 2.55 | 2.55 | ** | + | * | + |
| PLACE1007547 | 3.83 | 2.63 | 2.50 | 6.49 | 5.11 | 5.77 | 2.96 | 2.23 | 2.23 | ** | + | | |
| PLACE1007557 | 3.78 | 2.86 | 3.01 | 6.18 | 5.42 | 6.26 | 3.20 | 3.81 | 3.81 | ** | + | | |
| PLACE1007560 | 7.5 | 4.33 | 3.69 | 5.21 | 4.40 | 3.63 | 6.61 | 8.29 | 8.29 | | | | |
| PLACE1007565 | 1.39 | 0.57 | 0.51 | 1.55 | 0.69 | 1.08 | 1.27 | 0.93 | 0.93 | | | | |
| PLACE1007580 | 0.78 | 0.25 | 0.56 | 1.38 | 0.71 | 0.94 | 1.33 | 1.46 | 1.46 | | | ** | + |
| PLACE1007583 | 1.68 | 1.21 | 1.36 | 3.07 | 1.74 | 2.51 | 1.23 | 2.34 | 2.34 | | | | |
| PLACE1007591 | 2.78 | 0.84 | 0.81 | 2.91 | 3.12 | 3.09 | 1.72 | 2.45 | 2.45 | | | | |
| PLACE1007598 | 4.1 | 2.36 | 3.10 | 8.03 | 7.01 | 9.10 | 4.75 | 4.36 | 4.36 | ** | + | | |
| PLACE1007610 | 0.9 | 0.60 | 0.89 | 2.28 | 1.49 | 1.41 | 1.23 | 1.82 | 1.82 | * | + | * | + |
| PLACE1007618 | 1.76 | 1.24 | 1.15 | 1.76 | 2.07 | 1.52 | 1.03 | 1.29 | 1.29 | | | | |
| PLACE1007621 | 2.86 | 1.26 | 1.24 | 2.73 | 3.31 | 2.18 | 1.97 | 2.67 | 2.67 | | | | |
| PLACE1007626 | 6.13 | 3.63 | 3.43 | 16.1 | 18.88 | 18.33 | 14.85 | 19.91 | 19.91 | ** | + | ** | + |
| PLACE1007632 | 4.92 | 2.23 | 3.27 | 3.4 | 3.01 | 3.01 | 4.94 | 4.29 | 4.29 | | | | |
| PLACE1007635 | 3.04 | 0.96 | 2.65 | 2.16 | 2.56 | 2.69 | 1.76 | 2.94 | 2.94 | | | | |
| PLACE1007645 | 4.04 | 1.20 | 2.15 | 4.72 | 5.27 | 5.01 | 4.78 | 4.87 | 4.87 | * | + | * | + |
| PLACE1007649 | 1.28 | 0.79 | 0.67 | 1.29 | 1.36 | 2.38 | 1.28 | 2.15 | 2.15 | | | | |
| PLACE1007659 | 4.23 | 1.93 | 2.69 | 6.75 | 3.97 | 6.88 | 2.94 | 4.41 | 4.41 | | | | |
| PLACE1007669 | 6.2 | 1.80 | 2.99 | 5.47 | 6.53 | 4.51 | 3.57 | 2.86 | 2.86 | | | | |
| PLACE1007677 | 4.22 | 1.89 | 1.71 | 6.84 | 8.75 | 7.28 | 3.90 | 4.46 | 4.46 | ** | + | | |
| PLACE1007688 | 5.22 | 1.69 | 2.55 | 2.63 | 3.33 | 2.71 | 2.38 | 2.43 | 2.43 | | | | |
| PLACE1007690 | 3.97 | 2.16 | 3.39 | 4.09 | 4.66 | 3.97 | 3.53 | 4.50 | 4.5 | | | | |
| PLACE1007697 | 1.72 | 0.75 | 0.98 | 1.08 | 0.70 | 0.98 | 1.28 | 0.95 | 0.95 | | | | |
| PLACE1007702 | 1.76 | 0.86 | 1.32 | 1.85 | 1.37 | 3.00 | 2.01 | 1.95 | 1.95 | | | | |
| PLACE1007705 | 2.4 | 0.53 | 1.89 | 1.45 | 2.19 | 2.67 | 2.64 | 2.34 | 2.34 | | | | |
| PLACE1007706 | 2.8 | 1.14 | 1.84 | 2.88 | 2.31 | 2.20 | 2.45 | 2.27 | 2.27 | | | | |
| PLACE1007725 | 3.27 | 2.02 | 1.52 | 3.44 | 3.01 | 2.26 | 1.89 | 1.39 | 1.39 | | | | |
| PLACE1007729 | 3.75 | 0.91 | 0.48 | 1.28 | 1.88 | 1.09 | 1.35 | 1.46 | 1.46 | | | | |
| PLACE1007730 | 4.12 | 1.63 | 2.33 | 3.92 | 2.43 | 2.55 | 1.94 | 4.18 | 4.18 | | | | |

TABLE 312-continued

| | | | | | | | | | | | | | |
|---|---|---|---|---|---|---|---|---|---|---|---|---|---|
| PLACE1007737 | 4.58 | 2.53 | 1.58 | 4.31 | 5.53 | 6.14 | 3.60 | 3.45 | 3.45 | | | | |
| PLACE1007743 | 1.47 | 0.73 | 0.61 | 2.7 | 2.78 | 2.53 | 1.94 | 2.71 | 2.71 | ** | + | * | + |
| PLACE1007746 | 3.82 | 1.81 | 2.10 | 5.73 | 3.58 | 6.69 | 6.74 | 9.08 | 9.08 | | | ** | + |
| PLACE1007753 | 2.19 | 1.29 | 1.71 | 1.02 | 1.20 | 1.89 | 1.49 | 1.55 | 1.55 | | | | |
| PLACE1007769 | 0.98 | 0.53 | 0.69 | 1.58 | 1.14 | 1.77 | 1.01 | 1.04 | 1.04 | * | + | | |
| PLACE1007780 | 4.5 | 2.26 | 1.99 | 3.89 | 4.09 | 2.46 | 2.36 | 2.20 | 2.2 | | | | |
| PLACE1007791 | 5.12 | 2.18 | 2.04 | 3.75 | 4.60 | 3.26 | 2.31 | 3.66 | 3.66 | | | | |
| PLACE1007807 | 2.35 | 0.20 | 1.17 | 3.74 | 3.71 | 3.65 | 3.45 | 3.14 | 3.14 | * | + | * | + |
| PLACE1007810 | 1.24 | 0.07 | 0.47 | 1.06 | 0.82 | 1.32 | 1.17 | 1.10 | 1.1 | | | | |
| PLACE1007814 | 5.26 | 2.80 | 2.95 | 4.73 | 4.47 | 4.22 | 4.12 | 5.14 | 5.14 | | | | |
| PLACE1007828 | 1.64 | 1.27 | 1.04 | 1.35 | 1.67 | 1.95 | 1.48 | 2.89 | 2.89 | | | | |
| PLACE1007829 | 6.87 | 2.06 | 4.61 | 11.59 | 10.29 | 14.12 | 4.54 | 6.24 | 6.24 | * | + | | |
| PLACE1007841 | 2.09 | 0.69 | 0.83 | 1.22 | 2.33 | 3.41 | 1.28 | 2.06 | 2.06 | | | | |
| PLACE1007842 | 2.47 | 1.09 | 2.35 | 2.63 | 2.75 | 2.08 | 1.49 | 2.36 | 2.36 | | | | |
| PLACE1007843 | 1.12 | 0.63 | 0.54 | 0.94 | 1.58 | 0.91 | 0.72 | 0.88 | 0.88 | | | | |
| PLACE1007845 | 3.75 | 1.17 | 2.10 | 1.73 | 2.80 | 1.91 | 2.13 | 2.52 | 2.52 | | | | |
| PLACE1007846 | 4.22 | 1.07 | 1.41 | 5.34 | 3.41 | 3.57 | 3.77 | 4.73 | 4.73 | | | | |
| PLACE1007848 | 1.96 | 0.65 | 0.52 | 1.52 | 2.21 | 2.88 | 2.45 | 2.38 | 2.38 | | | * | + |
| PLACE1007852 | 2.98 | 0.96 | 2.30 | 2.1 | 4.32 | 3.04 | 2.76 | 3.44 | 3.44 | | | | |
| PLACE1007858 | 1.43 | 0.68 | 1.60 | 6.59 | 6.03 | 5.72 | 3.52 | 4.91 | 4.91 | ** | + | ** | + |
| PLACE1007866 | 30.58 | 17.58 | 17.98 | 11.58 | 9.80 | 8.70 | 10.80 | 10.41 | 10.41 | | | | |
| PLACE1007871 | 22.99 | 9.51 | 12.34 | 18.55 | 16.06 | 17.86 | 13.04 | 17.83 | 17.83 | | | | |

TABLE 313

| | | | | | | | | | | | | | |
|---|---|---|---|---|---|---|---|---|---|---|---|---|---|
| PLACE1007877 | 4.54 | 1.36 | 1.17 | 4.16 | 4.25 | 2.80 | 3.39 | 3.32 | 3.32 | | | | |
| PLACE1007878 | 4.4 | 2.07 | 2.29 | 2.41 | 2.70 | 2.37 | 3.13 | 5.04 | 5.04 | | | | |
| PLACE1007881 | 1.27 | 0.74 | 0.75 | 0.94 | 1.76 | 0.67 | 0.87 | 1.11 | 1.11 | | | | |
| PLACE1007885 | 1.23 | 1.17 | 1.11 | 1.97 | 2.06 | 1.97 | 2.46 | 3.25 | 3.25 | ** | + | ** | + |
| PLACE1007897 | 2.56 | 0.68 | 1.11 | 1.75 | 1.79 | 1.50 | 1.00 | 2.88 | 2.88 | | | | |
| PLACE1007908 | 7.68 | 3.04 | 3.27 | 4.73 | 4.71 | 5.04 | 4.39 | 4.18 | 4.18 | | | | |
| PLACE1007922 | 1.4 | 0.69 | 0.89 | 1.56 | 0.63 | 1.43 | 1.13 | 0.93 | 0.93 | | | | |
| PLACE1007946 | 4.36 | 3.22 | 3.12 | 4.56 | 4.09 | 3.11 | 2.97 | 3.28 | 3.28 | | | | |
| PLACE1007950 | 5.15 | 1.51 | 1.60 | 3.7 | 3.21 | 2.35 | 3.25 | 8.99 | 8.99 | | | | |
| PLACE1007954 | 3.66 | 2.15 | 2.27 | 2.4 | 2.26 | 2.19 | 2.79 | 1.92 | 1.92 | | | | |
| PLACE1007955 | 4.71 | 1.37 | 1.67 | 2.61 | 3.53 | 2.54 | 2.49 | 4.46 | 4.46 | | | | |
| PLACE1007956 | 4.42 | 1.04 | 2.64 | 3.61 | 3.50 | 3.32 | 2.21 | 3.84 | 3.84 | | | | |
| PLACE1007958 | 1.93 | 0.27 | 1.12 | 1.34 | 1.94 | 1.66 | 1.60 | 1.84 | 1.84 | | | | |
| PLACE1007965 | 2.55 | 1.76 | 1.99 | 2.32 | 2.51 | 3.02 | 1.19 | 2.52 | 2.52 | | | | |
| PLACE1007969 | 6.03 | 2.86 | 2.43 | 4.73 | 5.79 | 6.79 | 4.72 | 3.77 | 3.77 | | | | |
| PLACE1007971 | 3.53 | 1.27 | 2.02 | 3.82 | 4.31 | 3.71 | 3.34 | 3.31 | 3.31 | | | | |
| PLACE1007990 | 2.84 | 1.35 | 1.80 | 4.92 | 3.19 | 2.61 | 2.45 | 2.53 | 2.53 | | | | |
| PLACE1008000 | 1.73 | 0.77 | 0.35 | 3.42 | 1.14 | 0.76 | 1.28 | 1.93 | 1.93 | | | | |
| PLACE1008002 | 0.38 | 0.09 | 0.23 | 1.64 | 0.83 | 0.73 | 1.52 | 1.90 | 1.9 | * | + | ** | + |
| PLACE1008037 | 0.98 | 0.19 | 0.99 | 1.13 | 1.05 | 1.34 | 1.22 | 1.68 | 1.68 | | | | |
| PLACE1008044 | 4.87 | 3.62 | 2.89 | 3.52 | 3.76 | 3.71 | 2.56 | 3.52 | 3.52 | | | | |
| PLACE1008045 | 1.81 | 1.03 | 1.31 | 1.51 | 1.59 | 1.22 | 1.49 | 2.12 | 2.12 | | | | |
| PLACE1008080 | 4.1 | 3.05 | 2.36 | 3.11 | 3.91 | 2.99 | 2.39 | 3.89 | 3.89 | | | | |
| PLACE1008092 | 2.02 | 1.71 | 1.46 | 1.1 | 0.88 | 0.81 | 1.07 | 2.15 | 2.15 | * | − | | |
| PLACE1008095 | 2.93 | 1.27 | 1.19 | 2.55 | 1.83 | 2.32 | 1.34 | 3.34 | 3.34 | | | | |
| PLACE1008105 | 2.48 | 0.98 | 1.47 | 2.27 | 0.97 | 1.49 | 2.91 | 5.54 | 5.54 | | | * | + |
| PLACE1008107 | 6.58 | 3.57 | 3.85 | 1.29 | 1.19 | 1.39 | 4.33 | 5.78 | 5.78 | * | − | | |
| PLACE1008111 | 2.46 | 1.02 | 2.41 | 3.33 | 2.35 | 3.47 | 2.96 | 3.00 | 3 | | | | |
| PLACE1008113 | 25.85 | 13.24 | 14.36 | 22.14 | 19.88 | 22.12 | 9.93 | 8.27 | 8.27 | | | | |
| PLACE1008122 | 1.07 | 0.36 | 1.70 | 1.64 | 1.18 | 1.29 | 1.04 | 1.29 | 1.29 | | | | |
| PLACE1008129 | 1.31 | 1.01 | 1.72 | 3.06 | 3.91 | 4.22 | 1.89 | 1.53 | 1.53 | ** | + | | |
| PLACE1008132 | 2.89 | 1.43 | 1.69 | 4.85 | 4.46 | 4.06 | 3.75 | 2.77 | 2.77 | ** | + | | |
| PLACE1008137 | 3.98 | 1.85 | 1.77 | 2.91 | 2.34 | 1.96 | 2.43 | 2.78 | 2.78 | | | | |
| PLACE1008174 | 10.37 | 5.11 | 6.06 | 7.46 | 7.08 | 5.83 | 3.58 | 4.68 | 4.68 | | | | |
| PLACE1008177 | 5.22 | 2.35 | 2.42 | 4.78 | 5.45 | 4.55 | 2.08 | 2.73 | 2.73 | | | | |
| PLACE1008181 | 0.6 | 0.35 | 0.59 | 2.1 | 1.63 | 0.83 | 0.78 | 0.73 | 0.73 | | | * | + |
| PLACE1008195 | 4.21 | 3.69 | 4.41 | 3.34 | 3.31 | 4.29 | 3.54 | 5.03 | 5.03 | | | | |
| PLACE1008198 | 0.92 | 1.28 | 1.62 | 1.49 | 2.09 | 2.17 | 1.39 | 2.32 | 2.32 | | | | |
| PLACE1008201 | 1.66 | 0.51 | 1.49 | 2.83 | 2.14 | 2.43 | 2.07 | 1.72 | 1.72 | * | + | | |
| PLACE1008209 | 5.39 | 4.27 | 2.17 | 7.66 | 7.83 | 6.93 | 6.08 | 4.07 | 4.07 | * | + | | |
| PLACE1008226 | 3.09 | 1.71 | 1.62 | 2.88 | 3.33 | 2.83 | 2.61 | 2.73 | 2.73 | | | | |
| PLACE1008227 | 3.17 | 1.23 | 2.12 | 4.9 | 4.87 | 5.42 | 2.16 | 2.72 | 2.72 | ** | + | | |
| PLACE1008231 | 2.12 | 0.50 | 0.70 | 1.87 | 1.47 | 1.28 | 1.21 | 0.99 | 0.99 | | | | |
| PLACE1008238 | 3.15 | 3.76 | 3.38 | 3.65 | 4.20 | 4.83 | 4.89 | 4.62 | 4.62 | | | ** | + |
| PLACE1008244 | 1.2 | 0.39 | 0.55 | 1.23 | 1.76 | 1.25 | 0.99 | 1.37 | 1.37 | | | | |
| PLACE1008249 | 2.18 | 0.27 | 0.99 | 2.07 | 1.35 | 1.47 | 0.79 | 1.16 | 1.16 | | | | |
| PLACE1008266 | 3.92 | 3.58 | 3.56 | 7.01 | 10.06 | 9.34 | 6.60 | 6.76 | 6.76 | ** | + | ** | + |
| PLACE1008273 | 2.91 | 1.72 | 1.49 | 4.31 | 6.22 | 5.51 | 5.60 | 5.70 | 5.7 | ** | + | ** | + |
| PLACE1008275 | 1.29 | 0.61 | 1.24 | 2.1 | 1.76 | 1.18 | 1.34 | 0.60 | 0.6 | | | | |
| PLACE1008280 | 2.51 | 1.09 | 1.40 | 1.61 | 2.66 | 1.55 | 2.19 | 1.36 | 1.36 | | | | |
| PLACE1008282 | 6.02 | 2.61 | 4.50 | 6.93 | 7.87 | 7.46 | 6.98 | 6.73 | 6.73 | * | + | | |

TABLE 313-continued

| | | | | | | | | | |
|---|---|---|---|---|---|---|---|---|---|
| PLACE1008297 | 1.93 | 0.37 | 0.80 | 1.67 | 1.93 | 1.78 | 1.68 | 1.21 | 1.21 |
| PLACE1008303 | 2.86 | 2.08 | 2.50 | 1.98 | 2.20 | 2.57 | 2.27 | 1.77 | 1.77 |
| PLACE1008309 | 1 | 0.36 | 0.94 | 1.24 | 0.57 | 1.29 | 1.65 | 0.87 | 0.87 |
| PLACE1008315 | 12.99 | 6.08 | 6.62 | 5.63 | 6.15 | 4.10 | 5.15 | 5.08 | 5.08 |
| PLACE1008329 | 5.4 | 1.64 | 1.66 | 3.46 | 3.09 | 2.21 | 1.61 | 3.12 | 3.12 |

TABLE 314

| | | | | | | | | | | | | | |
|---|---|---|---|---|---|---|---|---|---|---|---|---|---|
| PLACE1008330 | 3.99 | 1.02 | 3.12 | 3.69 | 2.72 | 3.55 | 2.59 | 3.30 | 3.3 | | | | |
| PLACE1008331 | 3.5 | 1.58 | 2.61 | 2.43 | 4.87 | 4.55 | 2.21 | 5.77 | 5.77 | | | | |
| PLACE1008351 | 3.59 | 1.91 | 2.57 | 5.18 | 5.19 | 5.56 | 3.81 | 3.50 | 3.5 | ** | + | | |
| PLACE1008356 | 3.92 | 0.69 | 2.72 | 2.64 | 2.56 | 2.29 | 2.42 | 2.95 | 2.95 | | | | |
| PLACE1008359 | 1.48 | 0.76 | 0.90 | 2.22 | 1.26 | 2.34 | 1.68 | 2.46 | 2.46 | | | * | + |
| PLACE1008368 | 4.18 | 1.66 | 2.15 | 9.15 | 7.54 | 8.92 | 6.11 | 7.44 | 7.44 | ** | + | ** | + |
| PLACE1008369 | 2.77 | 0.73 | 1.19 | 2.41 | 7.30 | 3.35 | 1.02 | 1.60 | 1.6 | | | | |
| PLACE1008392 | 2.13 | 0.98 | 1.09 | 1.58 | 3.18 | 1.77 | 1.88 | 2.10 | 2.1 | | | | |
| PLACE1008394 | 26.4 | 13.24 | 13.94 | 17.36 | 15.53 | 22.06 | 16.70 | 19.87 | 19.87 | | | | |
| PLACE1008398 | 7.2 | 3.44 | 10.45 | 4.58 | 8.83 | 4.91 | 2.86 | 4.01 | 4.01 | | | | |
| PLACE1008401 | 3.08 | 0.75 | 1.07 | 1.76 | 1.56 | 2.79 | 1.84 | 3.10 | 3.1 | | | | |
| PLACE1008402 | 6.01 | 1.01 | 4.48 | 2.49 | 3.09 | 3.48 | 2.05 | 3.35 | 3.35 | | | | |
| PLACE1008405 | 25.84 | 13.96 | 18.38 | 38.51 | 28.28 | 49.12 | 27.91 | 33.39 | 33.39 | | | * | + |
| PLACE1008409 | 16.67 | 9.55 | 11.29 | 12.69 | 10.07 | 15.56 | 12.51 | 11.76 | 11.76 | | | | |
| PLACE1008420 | 5.7 | 4.00 | 2.86 | 5.32 | 4.44 | 3.71 | 4.42 | 4.23 | 4.23 | | | | |
| PLACE1008424 | 3.57 | 2.25 | 1.23 | 2.09 | 2.46 | 2.00 | 2.48 | 2.25 | 2.25 | | | | |
| PLACE1008426 | 4.1 | 1.19 | 2.55 | 2.53 | 2.76 | 1.73 | 1.42 | 1.69 | 1.69 | | | | |
| PLACE1008429 | 1.34 | 0.85 | 1.46 | 2 | 3.50 | 1.65 | 1.93 | 1.52 | 1.52 | | | | |
| PLACE1008430 | 1.82 | 0.58 | 0.88 | 2.02 | 1.64 | 0.56 | 0.86 | 2.26 | 2.26 | | | | |
| PLACE1008437 | 2.06 | 0.49 | 1.54 | 1.53 | 1.27 | 1.54 | 1.33 | 2.88 | 2.88 | | | | |
| PLACE1008453 | 3.99 | 2.14 | 2.45 | 2.78 | 2.86 | 2.41 | 2.29 | 5.19 | 5.19 | | | | |
| PLACE1008454 | 4.67 | 3.03 | 4.69 | 8.04 | 6.50 | 8.39 | 3.85 | 5.65 | 5.65 | * | + | | |
| PLACE1008455 | 6.35 | 2.17 | 1.87 | 10.14 | 10.23 | 5.77 | 6.05 | 5.82 | 5.82 | | | | |
| PLACE1008457 | 9.43 | 3.52 | 3.32 | 5.83 | 7.73 | 6.63 | 5.24 | 7.01 | 7.01 | | | | |
| PLACE1008465 | 2.14 | 1.13 | 1.61 | 1.55 | 3.02 | 1.33 | 2.20 | 2.70 | 2.7 | | | | |
| PLACE1008469 | 12.37 | 7.23 | 7.87 | 8.96 | 9.09 | 12.38 | 13.17 | 10.93 | 10.93 | | | | |
| PLACE1008488 | 1.94 | 0.92 | 1.25 | 0.9 | 1.06 | 1.44 | 1.44 | 0.95 | 0.95 | | | | |
| PLACE1008519 | 3.83 | 1.77 | 1.73 | 2.4 | 1.77 | 1.88 | 2.77 | 1.49 | 1.49 | | | | |
| PLACE1008524 | 3.06 | 0.85 | 1.87 | 3.33 | 2.40 | 3.53 | 2.10 | 1.92 | 1.92 | | | | |
| PLACE1008531 | 3.02 | 1.05 | 2.48 | 2.83 | 2.67 | 2.71 | 2.79 | 2.45 | 2.45 | | | | |
| PLACE1008532 | 1.95 | 1.34 | 1.62 | 3.81 | 2.99 | 2.68 | 2.83 | 3.90 | 3.9 | * | + | ** | + |
| PLACE1008533 | 6.08 | 2.16 | 3.15 | 4.18 | 5.64 | 3.25 | 3.67 | 5.24 | 5.24 | | | | |
| PLACE1008542 | 3.98 | 1.49 | 1.76 | 4.67 | 6.17 | 4.59 | 3.86 | 6.21 | 6.21 | * | + | | |
| PLACE1008549 | 2.51 | 1.53 | 0.88 | 1.7 | 2.81 | 1.76 | 1.36 | 1.66 | 1.66 | | | | |
| PLACE1008560 | 1.85 | 0.72 | 0.75 | 0.85 | 0.84 | 0.96 | 2.24 | 1.41 | 1.41 | | | | |
| PLACE1008567 | 2.83 | 1.62 | 2.07 | 2.6 | 2.14 | 2.90 | 2.18 | 3.74 | 3.74 | | | | |
| PLACE1008568 | 1.44 | 0.85 | 1.22 | 4.02 | 2.55 | 4.05 | 2.96 | 3.07 | 3.07 | * | + | ** | + |
| PLACE1008569 | 6.68 | 1.97 | 2.63 | 4.52 | 4.62 | 4.72 | 3.58 | 5.21 | 5.21 | | | | |
| PLACE1008584 | 2.8 | 0.91 | 1.34 | 2.88 | 1.91 | 1.76 | 1.37 | 1.81 | 1.81 | | | | |
| PLACE1008585 | 6.05 | 2.08 | 1.87 | 5.97 | 6.88 | 5.16 | 6.30 | 6.66 | 6.66 | | | | |
| PLACE1008603 | 2.79 | 0.92 | 1.64 | 1.88 | 1.63 | 1.46 | 1.46 | 2.30 | 2.3 | | | | |
| PLACE1008621 | 2.19 | 0.44 | 1.30 | 1.02 | 1.47 | 0.69 | 1.47 | 2.18 | 2.18 | | | | |
| PLACE1008625 | 0.9 | 0.37 | 0.80 | 0.8 | 0.79 | 0.63 | 1.51 | 1.36 | 1.36 | | | * | + |
| PLACE1008626 | 1.01 | 0.36 | 0.40 | 1.03 | 0.59 | 0.80 | 0.60 | 2.30 | 2.3 | | | | |
| PLACE1008627 | 3.31 | 1.35 | 1.85 | 3.04 | 2.64 | 2.27 | 2.82 | 2.83 | 2.83 | | | | |
| PLACE1008629 | 4.46 | 2.86 | 3.88 | 4.95 | 3.86 | 3.87 | 2.66 | 4.45 | 4.45 | | | | |
| PLACE1008630 | 6.49 | 3.28 | 4.20 | 4.75 | 4.80 | 4.92 | 3.62 | 3.61 | 3.61 | | | | |
| PLACE1008643 | 3.94 | 1.90 | 2.23 | 4.63 | 3.91 | 2.95 | 3.01 | 3.94 | 3.94 | | | | |
| PLACE1008650 | 1.04 | 0.28 | 0.89 | 1.14 | 0.65 | 0.67 | 0.98 | 2.48 | 2.48 | | | | |
| PLACE1008657 | 2.91 | 1.23 | 0.78 | 2.05 | 1.78 | 1.50 | 2.02 | 2.54 | 2.54 | | | | |
| PLACE1008664 | 2.55 | 1.44 | 2.26 | 1.59 | 2.27 | 1.94 | 2.31 | 1.74 | 1.74 | | | | |
| PLACE1008693 | 3.83 | 1.61 | 1.78 | 3.36 | 3.20 | 3.43 | 2.03 | 2.63 | 2.63 | | | | |
| PLACE1008696 | 1.57 | 0.88 | 1.00 | 2.25 | 2.32 | 2.53 | 1.82 | 1.87 | 1.87 | ** | + | * | + |
| PLACE1008715 | 1.2 | 1.08 | 0.38 | 2.73 | 1.58 | 1.58 | 1.30 | 1.20 | 1.2 | | | | |
| PLACE1008716 | 2.62 | 1.18 | 1.33 | 2.82 | 3.53 | 2.15 | 2.83 | 1.88 | 1.88 | | | | |
| PLACE1008722 | 8.81 | 3.15 | 4.14 | 9.07 | 11.88 | 9.16 | 5.01 | 7.77 | 7.77 | | | | |

TABLE 315

| | | | | | | | | | |
|---|---|---|---|---|---|---|---|---|---|
| PLACE1008738 | 1.83 | 2.28 | 2.00 | 1.8 | 1.24 | 1.00 | 1.36 | 3.09 | 3.09 |
| PLACE1008742 | 4.02 | 1.70 | 1.54 | 4.3 | 5.17 | 3.46 | 2.80 | 3.04 | 3.04 |
| PLACE1008744 | 1.17 | 0.49 | 0.67 | 1.04 | 1.21 | 1.19 | 1.03 | 1.69 | 1.69 |
| PLACE1008748 | 1.18 | 0.53 | 1.02 | 1.35 | 1.38 | 1.66 | 1.55 | 1.10 | 1.1 |
| PLACE1008757 | 0.57 | 0.66 | 1.64 | 0.96 | 1.31 | 1.19 | 0.28 | 1.35 | 1.35 |
| PLACE1008766 | 5.2 | 1.84 | 3.38 | 5.73 | 6.06 | 11.79 | 4.24 | 3.09 | 3.09 |
| PLACE1008785 | 3.43 | 1.55 | 1.67 | 3.73 | 3.48 | 3.51 | 2.86 | 2.40 | 2.4 |

TABLE 315-continued

| | | | | | | | | | | | | |
|---|---|---|---|---|---|---|---|---|---|---|---|---|
| PLACE1008790 | 4.68 | 2.15 | 2.15 | 5.43 | 4.49 | 3.61 | 3.28 | 3.45 | 3.45 | | | |
| PLACE1008798 | 6.35 | 0.62 | 2.86 | 2.36 | 3.47 | 2.89 | 1.71 | 2.65 | 2.65 | | | |
| PLACE1008807 | 0.99 | 1.20 | 1.36 | 0.98 | 1.48 | 1.58 | 0.90 | 2.29 | 2.29 | | | |
| PLACE1008808 | 2.02 | 1.19 | 1.16 | 1.26 | 1.76 | 1.00 | 2.24 | 1.72 | 1.72 | | | |
| PLACE1008813 | 0.94 | 0.76 | 1.96 | 0.73 | 1.40 | 0.71 | 0.81 | 2.94 | 2.94 | | | |
| PLACE1008836 | 3.35 | 2.03 | 2.82 | 3.36 | 3.83 | 3.93 | 1.76 | 4.97 | 4.97 | | | |
| PLACE1008851 | 6.7 | 2.37 | 2.20 | 3.21 | 3.73 | 4.45 | 1.84 | 2.02 | 2.02 | | | |
| PLACE1008854 | 1.01 | 0.67 | 0.67 | 0.73 | 1.08 | 1.01 | 0.89 | 0.70 | 0.7 | | | |
| PLACE1008864 | 5.23 | 2.45 | 2.26 | 6.92 | 5.09 | 5.19 | 3.11 | 3.68 | 3.68 | | | |
| PLACE1008867 | 1.96 | 1.55 | 1.26 | 5.74 | 4.65 | 5.92 | 4.30 | 4.51 | 4.51 | ** | + | ** | + |
| PLACE1008876 | 51.43 | 26.54 | 27.05 | 38 | 43.35 | 42.72 | 24.30 | 22.52 | 22.52 | | | |
| PLACE1008887 | 1.78 | 0.54 | 1.07 | 2.31 | 2.39 | 2.93 | 1.78 | 2.61 | 2.61 | * | + | |
| PLACE1008902 | 1.97 | 0.82 | 0.85 | 1.66 | 1.42 | 3.56 | 1.02 | 2.90 | 2.9 | | | |
| PLACE1008911 | 6.01 | 5.11 | 5.63 | 8.6 | 8.99 | 8.79 | 6.07 | 6.33 | 6.33 | ** | + | |
| PLACE1008917 | 3.34 | 2.37 | 2.25 | 2.83 | 3.74 | 3.27 | 2.99 | 3.43 | 3.43 | | | |
| PLACE1008920 | 1.37 | 0.52 | 0.53 | 1.3 | 2.33 | 1.36 | 0.77 | 1.37 | 1.37 | | | |
| PLACE1008925 | 1.43 | 1.01 | 0.48 | 2.16 | 1.60 | 0.85 | 1.24 | 0.93 | 0.93 | | | |
| PLACE1008930 | 8.48 | 4.04 | 4.74 | 5.59 | 5.27 | 6.20 | 2.97 | 5.51 | 5.51 | | | |
| PLACE1008934 | 2.73 | 1.83 | 1.68 | 2.96 | 2.07 | 1.68 | 2.13 | 1.92 | 1.92 | | | |
| PLACE1008941 | 2.12 | 2.49 | 2.29 | 2.81 | 3.70 | 3.18 | 1.74 | 1.69 | 1.69 | * | + | ** | − |
| PLACE1008947 | 5.3 | 4.86 | 3.97 | 6.01 | 5.96 | 5.46 | 4.91 | 5.47 | 5.47 | | | |
| PLACE1008984 | 2.32 | 1.08 | 1.90 | 4.47 | 4.44 | 4.99 | 1.56 | 2.13 | 2.13 | ** | + | |
| PLACE1008985 | 1.06 | 1.41 | 1.57 | 2.31 | 2.24 | 1.90 | 1.29 | 3.49 | 3.49 | * | + | |
| PLACE1008994 | 1.26 | 0.32 | 0.61 | 1.19 | 2.34 | 0.75 | 0.51 | 0.61 | 0.61 | | | |
| PLACE1009020 | 2.03 | 0.83 | 0.79 | 1.36 | 0.98 | 0.99 | 0.91 | 1.17 | 1.17 | | | |
| PLACE1009027 | 2.42 | 0.29 | 0.98 | 17.03 | 20.58 | 24.13 | 13.27 | 17.48 | 17.48 | ** | + | ** | + |
| PLACE1009039 | 0.66 | 0.39 | 0.60 | 0.97 | 0.77 | 0.82 | 0.81 | 1.68 | 1.68 | * | + | * | + |
| PLACE1009045 | 1.25 | 0.20 | 1.18 | 0.92 | 1.61 | 1.30 | 3.10 | 3.19 | 3.19 | | | ** | + |
| PLACE1009048 | 0.29 | 0.37 | 0.55 | 0.51 | 0.66 | 0.96 | 1.13 | 0.67 | 0.67 | | | |
| PLACE1009050 | 0.48 | (0.04) | 0.53 | 1.13 | 0.72 | 1.09 | 0.42 | 0.86 | 0.86 | * | + | |
| PLACE1009060 | 3.31 | 1.27 | 1.72 | 4.36 | 1.92 | 4.74 | 2.50 | 4.91 | 4.91 | | | |
| PLACE1009067 | 4.9 | 1.27 | 1.78 | 2.92 | 1.97 | 2.26 | 4.68 | 4.77 | 4.77 | | | |
| PLACE1009071 | 5.93 | 4.97 | 3.58 | 6.84 | 4.81 | 6.47 | 5.46 | 4.55 | 4.55 | | | |
| PLACE1009090 | 3.14 | 0.90 | 2.12 | 3.01 | 2.91 | 5.24 | 2.46 | 1.95 | 1.95 | | | |
| PLACE1009091 | 4.11 | 1.05 | 1.26 | 1.69 | 2.73 | 1.26 | 0.58 | 1.98 | 1.98 | | | |
| PLACE1009094 | 2.34 | 2.30 | 1.26 | 2.48 | 183 | 1.50 | 3.22 | 2.13 | 2.13 | | | |
| PLACE1009099 | 4.71 | 2.33 | 2.35 | 5.94 | 5.89 | 8.61 | 3.69 | 5.79 | 5.79 | * | + | |
| PLACE1009110 | 1.06 | 1.13 | 0.63 | 4.86 | 1.21 | 3.08 | 2.60 | 2.41 | 2.41 | | | ** | + |
| PLACE1009111 | 1.61 | 0.55 | 0.64 | 2.6 | 1.26 | 1.76 | 1.01 | 2.06 | 2.06 | | | |
| PLACE1009113 | 5.16 | 1.93 | 2.40 | 3.84 | 4.61 | 2.47 | 1.71 | 4.56 | 4.56 | | | |
| PLACE1009130 | 2.4 | 1.03 | 1.11 | 1.45 | 1.93 | 2.94 | 1.60 | 1.65 | 1.65 | | | |
| PLACE1009150 | 1.73 | 0.66 | 1.55 | 2.16 | 2.01 | 2.30 | 1.65 | 1.47 | 1.47 | | | |
| PLACE1009155 | 3.13 | 2.31 | 1.89 | 4.69 | 5.44 | 5.47 | 2.82 | 2.95 | 2.95 | ** | + | |
| PLACE1009158 | 3.54 | 1.36 | 1.91 | 2.88 | 2.25 | 2.53 | 2.92 | 2.13 | 2.13 | | | |
| PLACE1009166 | 2.58 | 1.73 | 2.09 | 2.03 | 2.15 | 2.17 | 2.50 | 2.39 | 2.39 | | | |
| PLACE1009172 | 2.84 | 0.78 | 1.90 | 4.25 | 3.46 | 3.67 | 2.50 | 4.14 | 4.14 | * | + | |
| PLACE1009174 | 3.1 | 1.74 | 1.40 | 4.47 | 5.90 | 4.15 | 2.46 | 2.47 | 2.47 | * | + | |
| PLACE1009183 | 6.02 | 1.51 | 2.01 | 3.8 | 4.98 | 3.03 | 2.18 | 2.53 | 2.53 | | | |
| PLACE1009186 | 3.59 | 0.98 | 1.37 | 2.08 | 2.13 | 0.57 | 1.69 | 3.99 | 3.99 | | | |

TABLE 316

| | | | | | | | | | | | | |
|---|---|---|---|---|---|---|---|---|---|---|---|---|
| PLACE1009190 | 2.12 | 1.27 | 2.18 | 1.35 | 2.00 | 2.47 | 0.78 | 2.21 | 2.21 | | | |
| PLACE1009196 | 1.64 | 0.69 | 1.48 | 2.04 | 2.57 | 3.98 | 1.85 | 1.52 | 1.52 | | | |
| PLACE1009200 | 4.32 | 1.99 | 2.61 | 4.48 | 5.35 | 4.97 | 2.74 | 2.68 | 2.68 | | | |
| PLACE1009217 | 2.54 | 0.82 | 0.83 | 0.92 | 1.24 | 1.76 | 2.27 | 2.78 | 2.78 | | | |
| PLACE1009230 | 3.29 | 1.25 | 2.57 | 3.85 | 3.86 | 4.23 | 1.77 | 4.02 | 4.02 | | | |
| PLACE1009236 | 3.68 | 1.44 | 1.56 | 2.57 | 2.82 | 2.63 | 1.54 | 2.09 | 2.09 | | | |
| PLACE1009246 | 9.73 | 3.62 | 4.17 | 6.98 | 7.72 | 5.06 | 6.33 | 5.96 | 5.96 | | | |
| PLACE1009265 | 21.04 | 8.85 | 7.61 | 12.85 | 14.86 | 12.34 | 4.96 | 7.60 | 7.6 | | | |
| PLACE1009279 | 1.84 | 0.86 | 0.79 | 1.58 | 1.52 | 1.53 | 1.15 | 1.01 | 1.01 | | | |
| PLACE1009298 | 3.7 | 2.72 | 2.61 | 7.54 | 8.77 | 8.06 | 7.00 | 9.82 | 9.82 | ** | + | ** | + |
| PLACE1009308 | 8.08 | 4.61 | 4.25 | 6.42 | 4.02 | 4.44 | 5.48 | 7.05 | 7.05 | | | |
| PLACE1009319 | 2.03 | 1.05 | 1.47 | 2.87 | 1.77 | 3.10 | 1.90 | 2.70 | 2.7 | | | |
| PLACE1009328 | 1.59 | 0.99 | 1.42 | 4.54 | 4.75 | 5.66 | 3.66 | 4.23 | 4.23 | ** | + | ** | + |
| PLACE1009335 | 1.22 | 0.54 | 0.61 | 2.18 | 1.74 | 1.92 | 1.46 | 0.54 | 0.54 | ** | + | |
| PLACE1009338 | 3.48 | 1.35 | 1.84 | 5.85 | 6.71 | 4.36 | 2.31 | 2.98 | 2.98 | * | + | |
| PLACE1009344 | 3.01 | 1.13 | 2.79 | 1.83 | 3.29 | 2.00 | 2.97 | 2.70 | 2.7 | | | |
| PLACE1009355 | 1.86 | 0.75 | 0.42 | 1.64 | 1.55 | 1.14 | 2.65 | 5.34 | 5.34 | | | * | + |
| PLACE1009368 | 2.14 | 1.43 | 1.26 | 1.31 | 1.41 | 1.74 | 1.22 | 2.07 | 2.07 | | | |
| PLACE1009375 | 1.44 | 0.73 | 1.31 | 0.98 | 2.28 | 1.80 | 1.47 | 2.25 | 2.25 | | | |
| PLACE1009388 | 1.69 | 1.27 | 1.19 | 3.96 | 2.82 | 3.05 | 1.65 | 2.75 | 2.75 | ** | + | |
| PLACE1009398 | 6.96 | 2.57 | 3.77 | 9 | 5.66 | 6.33 | 4.19 | 4.18 | 4.18 | | | |
| PLACE1009404 | 4.11 | 2.25 | 3.40 | 3.14 | 5.18 | 4.09 | 2.94 | 3.62 | 3.62 | | | |
| PLACE1009410 | 1.58 | 0.66 | 0.54 | 0.77 | 1.47 | 0.75 | 1.04 | 1.03 | 1.03 | | | |
| PLACE1009417 | 1.85 | 0.80 | 1.11 | 2.36 | 1.87 | 0.83 | 1.31 | 3.04 | 3.04 | | | |

TABLE 316-continued

| | | | | | | | | | | | | | |
|---|---|---|---|---|---|---|---|---|---|---|---|---|---|
| PLACE1009424 | 10.71 | 5.65 | 7.84 | 8.47 | 7.50 | 6.48 | 8.06 | 10.17 | 10.17 | | | | |
| PLACE1009434 | 3.29 | 1.53 | 1.47 | 2.38 | 1.85 | 1.49 | 1.58 | 1.71 | 1.71 | | | | |
| PLACE1009443 | 2.96 | 1.10 | 1.13 | 1.36 | 1.62 | 1.85 | 0.98 | 1.60 | 1.6 | | | | |
| PLACE1009444 | 3.55 | 2.71 | 1.84 | 4.89 | 4.13 | 5.32 | 3.26 | 4.47 | 4.47 | * | + | | |
| PLACE1009459 | 5.23 | 2.29 | 2.82 | 3.92 | 3.20 | 3.43 | 3.08 | 4.21 | 4.21 | | | | |
| PLACE1009460 | 0.43 | 0.37 | 0.33 | 0.44 | 0.37 | 1.88 | 0.42 | 0.69 | 0.69 | | | | |
| PLACE1009468 | 5.92 | 2.35 | 2.32 | 5.44 | 2.65 | 2.84 | 4.15 | 2.97 | 2.97 | | | | |
| PLACE1009476 | 2.6 | 0.89 | 1.54 | 2.02 | 2.17 | 1.83 | 1.69 | 2.92 | 2.92 | | | | |
| PLACE1009477 | 3.84 | 1.44 | 1.65 | 4.37 | 2.97 | 3.00 | 2.09 | 2.93 | 2.93 | | | | |
| PLACE1009493 | 2.08 | 0.70 | 1.33 | 2.12 | 1.22 | 1.24 | 0.82 | 2.09 | 2.09 | | | | |
| PLACE1009502 | 0.95 | 0.44 | 0.76 | 0.93 | 0.90 | 0.72 | 0.86 | 1.97 | 1.97 | | | | |
| PLACE1009524 | 2.21 | 0.79 | 1.36 | 1.49 | 1.81 | 1.15 | 1.58 | 2.15 | 2.15 | | | | |
| PLACE1009527 | 1.81 | 1.71 | 1.43 | 2.21 | 1.72 | 1.29 | 1.43 | 1.91 | 1.91 | | | | |
| PLACE1009531 | 5.24 | 3.01 | 2.51 | 5.69 | 3.69 | 5.37 | 6.78 | 6.24 | 6.24 | | | * | + |
| PLACE1009535 | 1.5 | 0.44 | 0.55 | 2.44 | 1.80 | 1.98 | 2.38 | 1.44 | 1.44 | * | + | | |
| PLACE1009539 | 3.39 | 1.25 | 2.38 | 2.92 | 3.40 | 3.47 | 2.40 | 3.54 | 3.54 | | | | |
| PLACE1009540 | 6 | 3.37 | 5.39 | 4.83 | 4.41 | 4.48 | 4.99 | 6.08 | 6.08 | | | | |
| PLACE1009542 | 2.35 | 1.42 | 1.51 | 1.82 | 1.71 | 1.38 | 1.98 | 2.97 | 2.97 | | | | |
| PLACE1009546 | 1.47 | 0.53 | 0.69 | 0.94 | 1.26 | 0.62 | 1.78 | 0.85 | 0.85 | | | | |
| PLACE1009556 | 1.35 | 0.95 | 1.07 | 1.35 | 2.21 | 0.98 | 2.07 | 2.20 | 2.2 | | | ** | + |
| PLACE1009569 | 2.13 | 1.30 | 1.80 | 2.87 | 2.82 | 3.16 | 1.76 | 2.07 | 2.07 | * | + | | |
| PLACE1009571 | 2.72 | 1.88 | 1.50 | 2.08 | 1.82 | 2.50 | 1.30 | 1.73 | 1.73 | | | | |
| PLACE1009573 | 8.32 | 4.58 | 4.70 | 4.98 | 4.59 | 3.46 | 3.53 | 2.68 | 2.68 | | | | |
| PLACE1009576 | 3.44 | 1.43 | 2.32 | 5.25 | 5.67 | 4.91 | 3.85 | 4.08 | 4.08 | ** | + | | |
| PLACE1009580 | 2.8 | 1.13 | 1.78 | 3.7 | 3.05 | 2.82 | 3.23 | 3.94 | 3.94 | | | * | + |
| PLACE1009581 | 2.06 | 1.05 | 0.67 | 2.39 | 2.40 | 2.16 | 4.59 | 3.83 | 3.83 | | | ** | + |
| PLACE1009587 | 1.75 | 1.08 | 0.69 | 1.11 | 1.37 | 1.41 | 1.48 | 2.01 | 2.01 | | | | |
| PLACE1009593 | 2.92 | 1.61 | 2.66 | 2.04 | 2.95 | 2.35 | 2.20 | 2.52 | 2.52 | | | | |
| PLACE1009595 | 4.18 | 2.88 | 2.05 | 6.18 | 7.63 | 5.15 | 3.71 | 4.73 | 4.73 | * | + | | |
| PLACE1009596 | 1.65 | 1.09 | 0.96 | 1.87 | 2.16 | 2.45 | 1.64 | 1.48 | 1.48 | * | + | | |
| PLACE1009600 | 6.27 | 3.95 | 2.87 | 7.95 | 6.45 | 4.31 | 4.05 | 5.38 | 5.38 | | | | |
| PLACE1009604 | 2.52 | 0.69 | 0.99 | 3.14 | 2.45 | 1.67 | 2.85 | 2.11 | 2.11 | | | | |

TABLE 317

| | | | | | | | | | | | | | |
|---|---|---|---|---|---|---|---|---|---|---|---|---|---|
| PLACE1009607 | 3.67 | 1.38 | 1.49 | 4.1 | 6.22 | 4.84 | 3.49 | 3.02 | 3.02 | * | + | | |
| PLACE1009613 | 3.3 | 1.40 | 2.05 | 3.5 | 4.21 | 3.44 | 2.36 | 3.25 | 3.25 | | | | |
| PLACE1009621 | 2.39 | 1.87 | 2.42 | 5.45 | 5.01 | 5.43 | 4.10 | 6.00 | 6 | ** | + | ** | + |
| PLACE1009622 | 1.78 | 0.78 | 1.73 | 2.06 | 1.60 | 1.99 | 2.28 | 4.60 | 4.6 | | | * | + |
| PLACE1009624 | 0.78 | 1.54 | 0.90 | 2.28 | 3.24 | 1.75 | 2.30 | 1.54 | 1.54 | | | | |
| PLACE1009637 | 1.33 | 0.77 | 0.84 | 3.69 | 2.89 | 3.73 | 3.44 | 3.33 | 3.33 | ** | + | ** | + |
| PLACE1009639 | 2.08 | 0.08 | 0.65 | 2.19 | 1.89 | 1.62 | 1.82 | 1.57 | 1.57 | | | | |
| PLACE1009654 | 2.53 | 0.76 | 1.11 | 2.83 | 1.57 | 1.39 | 1.86 | 2.31 | 2.31 | | | | |
| PLACE1009659 | 5.89 | 3.14 | 3.71 | 3.85 | 5.36 | 4.32 | 4.03 | 5.80 | 5.8 | | | | |
| PLACE1009665 | 1.27 | 1.04 | 0.92 | 2.92 | 2.14 | 2.54 | 0.79 | 2.03 | 2.03 | ** | + | | |
| PLACE1009669 | 3.5 | 3.60 | 3.11 | 3.69 | 5.37 | 3.54 | 3.97 | 4.99 | 4.99 | | | * | + |
| PLACE1009670 | 2.16 | 1.80 | 1.32 | 1.29 | 1.88 | 3.37 | 1.92 | 2.64 | 2.64 | | | | |
| PLACE1009708 | 2.48 | 1.90 | 1.93 | 4.13 | 3.31 | 5.20 | 2.14 | 3.90 | 3.9 | * | + | | |
| PLACE1009721 | 3.15 | 2.27 | 2.41 | 1.67 | 3.17 | 2.28 | 7.20 | 2.48 | 2.48 | | | | |
| PLACE1009731 | 3.26 | 1.56 | 1.59 | 2.49 | 3.83 | 1.81 | 1.89 | 2.37 | 2.37 | | | | |
| PLACE1009735 | 2.96 | 1.31 | 2.04 | 2.52 | 2.63 | 2.49 | 2.46 | 2.74 | 2.74 | | | | |
| PLACE1009737 | 2.94 | 0.82 | 1.29 | 2.21 | 2.29 | 2.41 | 1.51 | 1.54 | 1.54 | | | | |
| PLACE1009741 | 3.13 | 1.21 | 2.06 | 2.99 | 2.40 | 4.38 | 1.51 | 3.07 | 3.07 | | | | |
| PLACE1009752 | 3.23 | 1.55 | 1.75 | 2.3 | 2.72 | 2.29 | 1.86 | 1.61 | 1.61 | | | | |
| PLACE1009763 | 5.82 | 2.68 | 2.79 | 4.62 | 5.11 | 4.63 | 5.66 | 4.98 | 4.98 | | | | |
| PLACE1009766 | 1.66 | 0.72 | 1.60 | 4.14 | 2.26 | 2.27 | 1.82 | 1.34 | 1.34 | | | | |
| PLACE1009772 | 1.8 | 1.13 | 2.05 | 2.49 | 1.48 | 2.20 | 2.00 | 2.91 | 2.91 | | | | |
| PLACE1009782 | 1.79 | 1.21 | 0.99 | 3.99 | 3.99 | 2.22 | 2.25 | 2.39 | 2.39 | | | | |
| PLACE1009794 | 3.98 | 1.98 | 2.41 | 2.73 | 2.16 | 1.89 | 2.44 | 4.87 | 4.87 | | | | |
| PLACE1009798 | 3.03 | 1.31 | 2.50 | 3.63 | 5.60 | 4.46 | 2.46 | 3.00 | 3 | * | + | | |
| PLACE1009845 | 0.71 | 0.31 | 1.69 | 2.44 | 1.45 | 2.19 | 0.63 | 2.13 | 2.13 | | | | |
| PLACE1009849 | 2.59 | 1.40 | 2.09 | 2.06 | 1.75 | 1.55 | 1.88 | 1.44 | 1.44 | | | | |
| PLACE1009857 | 2.54 | 1.21 | 2.06 | 1.63 | 1.90 | 1.80 | 2.01 | 3.22 | 3.22 | | | | |
| PLACE1009861 | 3.24 | 2.05 | 2.05 | 5.01 | 4.66 | 4.82 | 3.10 | 3.89 | 3.89 | ** | + | | |
| PLACE1009872 | 43.66 | 21.33 | 23.44 | 30.54 | 23.07 | 32.80 | 14.91 | 18.35 | 18.35 | | | | |
| PLACE1009877 | 34.76 | 13.19 | 14.79 | 13.63 | 20.45 | 13.77 | 10.79 | 13.80 | 13.8 | | | | |
| PLACE1009879 | 1.98 | 0.47 | 1.85 | 1.36 | 3.33 | 1.12 | 1.96 | 1.87 | 1.87 | | | | |
| PLACE1009886 | 1.09 | 0.42 | 0.92 | 1.49 | 1.32 | 1.87 | 0.94 | 1.34 | 1.34 | * | + | | |
| PLACE1009888 | 3.11 | 1.53 | 2.24 | 1.6 | 2.71 | 2.32 | 1.87 | 2.30 | 2.3 | | | | |
| PLACE1009908 | 4.53 | 2.06 | 2.64 | 3.65 | 2.87 | 3.85 | 3.36 | 4.12 | 4.12 | | | | |
| PLACE1009919 | 5.7 | 2.20 | 3.89 | 5.91 | 4.05 | 5.41 | 4.60 | 6.30 | 6.3 | | | | |
| PLACE1009921 | 1.24 | 0.74 | 1.00 | 0.94 | 2.00 | 1.75 | 1.08 | 0.94 | 0.94 | | | | |
| PLACE1009923 | 2.95 | 1.00 | 1.09 | 2.18 | 1.25 | 5.57 | 0.84 | 2.57 | 2.57 | | | | |
| PLACE1009924 | 4.78 | 1.22 | 4.05 | 2.57 | 4.25 | 2.76 | 1.54 | 3.00 | 3 | | | | |
| PLACE1009925 | 1.27 | 0.73 | 0.91 | 0.45 | 0.87 | 0.31 | 1.52 | 2.61 | 2.61 | | | * | + |
| PLACE1009931 | 11.44 | 4.02 | 5.58 | 10.31 | 11.46 | 9.16 | 5.01 | 7.71 | 7.71 | | | | |

TABLE 317-continued

| | | | | | | | | | | | | |
|---|---|---|---|---|---|---|---|---|---|---|---|---|
| PLACE1009935 | 0.24 | 0.55 | 0.45 | 0.68 | 0.48 | 0.50 | 1.11 | 1.18 | 1.18 | | ** | + |
| PLACE1009947 | 4.92 | 1.59 | 1.73 | 2.29 | 3.03 | 2.70 | 3.05 | 3.68 | 3.68 | | | |
| PLACE1009961 | 1.11 | 1.73 | 1.45 | 1.96 | 1.63 | 2.02 | 1.58 | 0.96 | 0.96 | | | |
| PLACE1009971 | 2.28 | 1.16 | 1.31 | 3.83 | 2.51 | 3.34 | 2.27 | 2.89 | 2.89 | * | + | |
| PLACE1009982 | 7.21 | 2.79 | 4.22 | 5.07 | 5.60 | 7.20 | 6.47 | 7.74 | 7.74 | | | |
| PLACE1009992 | 3.36 | 1.01 | 0.95 | 2.29 | 3.14 | 1.23 | 2.29 | 4.00 | 4 | | | |
| PLACE1009995 | 7.97 | 4.77 | 4.17 | 10.64 | 14.64 | 12.97 | 7.62 | 12.10 | 12.1 | * | + | |
| PLACE1009997 | 3.62 | 1.37 | 1.19 | 4.05 | 4.29 | 3.62 | 2.02 | 2.74 | 2.74 | | | |
| PLACE1010002 | 3.23 | 0.90 | 2.15 | 1.8 | 3.62 | 1.37 | 1.28 | 2.45 | 2.45 | | | |
| PLACE1010011 | 3.01 | 1.89 | 1.75 | 1.26 | 1.49 | 1.10 | 1.92 | 1.85 | 1.85 | | | |
| PLACE1010013 | 1.67 | 0.86 | 0.88 | 1.15 | 1.55 | 0.74 | 1.18 | 1.56 | 1.56 | | | |
| PLACE1010021 | 2.43 | 0.87 | 2.19 | 2.61 | 2.46 | 2.89 | 3.71 | 2.58 | 2.58 | | | |
| PLACE1010023 | 4.84 | 1.80 | 2.28 | 2.57 | 2.67 | 3.95 | 1.95 | 4.34 | 4.34 | | | |
| PLACE1010031 | 5.58 | 2.99 | 1.54 | 4.23 | 4.90 | 2.66 | 3.18 | 2.93 | 2.93 | | | |
| PLACE1010039 | 1.86 | 0.50 | 0.58 | 0.41 | 1.70 | 1.28 | 1.06 | 1.35 | 1.35 | | | |

TABLE 318

| | | | | | | | | | | | | |
|---|---|---|---|---|---|---|---|---|---|---|---|---|
| PLACE1010045 | 6.37 | 3.18 | 4.06 | 5.76 | 9.98 | 5.99 | 3.46 | 7.87 | 7.87 | | | |
| PLACE1010053 | 7.31 | 4.10 | 4.89 | 8.33 | 10.67 | 7.68 | 5.23 | 4.89 | 4.89 | | | |
| PLACE1010060 | 5.81 | 2.55 | 2.85 | 4.53 | 3.83 | 3.76 | 4.23 | 4.25 | 4.25 | | | |
| PLACE1010069 | 1.38 | 1.53 | 1.33 | 0.77 | 1.42 | 0.61 | 0.88 | 2.96 | 2.96 | | | |
| PLACE1010070 | 1.16 | 0.11 | 0.64 | 0.75 | 0.45 | 1.16 | 2.70 | 1.27 | 1.27 | | | |
| PLACE1010074 | 9.55 | 3.59 | 4.51 | 8.29 | 7.15 | 7.46 | 5.88 | 9.16 | 9.16 | | | |
| PLACE1010076 | 32.02 | 14.06 | 13.18 | 16.2 | 20.29 | 12.88 | 25.05 | 26.03 | 26.03 | | | |
| PLACE1010078 | 5.69 | 2.44 | 3.34 | 4.22 | 3.97 | 3.39 | 4.99 | 6.24 | 6.24 | | | |
| PLACE1010081 | 3.3 | 1.78 | 4.36 | 4.28 | 4.59 | 3.29 | 2.67 | 5.51 | 5.51 | | | |
| PLACE1010083 | 2.72 | 1.96 | 1.66 | 0.92 | 1.44 | 1.20 | 2.07 | 2.63 | 2.63 | | | |
| PLACE1010089 | 2.82 | 1.29 | 2.28 | 4.53 | 3.47 | 5.64 | 3.30 | 4.44 | 4.44 | * | + | * | + |
| PLACE1010096 | 3.39 | 1.17 | 2.00 | 2.56 | 2.19 | 2.70 | 1.45 | 1.92 | 1.92 | | | |
| PLACE1010102 | 5.26 | 3.31 | 3.97 | 9.27 | 6.87 | 8.63 | 4.86 | 8.37 | 8.37 | * | + | |
| PLACE1010105 | 4.29 | 0.95 | 1.09 | 2.44 | 2.73 | 1.94 | 2.71 | 4.01 | 4.01 | | | |
| PLACE1010106 | 1.98 | 0.97 | 0.87 | 3.59 | 2.61 | 2.19 | 3.70 | 3.99 | 3.99 | * | + | ** | + |
| PLACE1010130 | 2.14 | 1.13 | 1.35 | 4.01 | 3.52 | 4.49 | 5.26 | 8.14 | 8.14 | ** | + | ** | + |
| PLACE1010132 | 6.25 | 4.26 | 5.07 | 4.52 | 4.25 | 5.01 | 4.63 | 5.39 | 5.39 | | | |
| PLACE1010134 | 3.87 | 1.25 | 2.18 | 2.61 | 2.68 | 1.90 | 2.26 | 2.82 | 2.82 | | | |
| PLACE1010139 | 28.44 | 17.86 | 18.97 | 14.51 | 12.81 | 13.26 | 30.01 | 30.01 | 30.01 | | | |
| PLACE1010148 | 2.71 | 1.27 | 1.28 | 1.81 | 1.73 | 1.69 | 1.33 | 1.07 | 1.07 | | | |
| PLACE1010152 | 2.7 | 1.53 | 1.95 | 4.96 | 4.00 | 5.90 | 3.04 | 3.45 | 3.45 | * | + | * | + |
| PLACE1010155 | 1.95 | 0.77 | 1.06 | 1.99 | 1.84 | 1.65 | 3.04 | 2.97 | 2.97 | | | ** | + |
| PLACE1010156 | 1.86 | 1.01 | 1.72 | 5.69 | 7.58 | 4.30 | 7.96 | 8.94 | 8.94 | * | + | ** | + |
| PLACE1010161 | 2.56 | 0.74 | 1.26 | 2.69 | 3.12 | 1.69 | 2.27 | 2.44 | 2.44 | | | |
| PLACE1010181 | 1.28 | 0.65 | 2.02 | 2 | 2.26 | 1.95 | 1.65 | 3.46 | 3.46 | | | |
| PLACE1010194 | 4.75 | 3.52 | 3.08 | 5.35 | 3.77 | 3.54 | 4.56 | 3.30 | 3.3 | | | |
| PLACE1010202 | 1.47 | 0.70 | 0.65 | 1.46 | 1.47 | 1.29 | 1.34 | 1.69 | 1.69 | | | |
| PLACE1010231 | 1.3 | 1.19 | 0.99 | 2.11 | 1.60 | 1.20 | 1.89 | 1.43 | 1.43 | | | |
| PLACE1010235 | 2.55 | 0.79 | 1.71 | 2.65 | 2.39 | 3.67 | 1.07 | 1.49 | 1.49 | | | |
| PLACE1010237 | 0.84 | 1.17 | 0.50 | 1.96 | 1.56 | 2.36 | 1.09 | 0.99 | 0.99 | * | + | |
| PLACE1010251 | 3.81 | 2.13 | 2.41 | 3.72 | 3.24 | 1.88 | 1.45 | 3.83 | 3.83 | | | |
| PLACE1010261 | 1.35 | 0.55 | 0.65 | 1.04 | 1.71 | 1.55 | 1.14 | 1.11 | 1.11 | | | |
| PLACE1010270 | 1.46 | 0.23 | 0.71 | 1.47 | 1.36 | 1.19 | 1.45 | 1.50 | 1.5 | | | |
| PLACE1010273 | 0.99 | 0.27 | 0.37 | 1.03 | 1.00 | 0.75 | 1.88 | 1.40 | 1.4 | | | * | + |
| PLACE1010274 | 5.85 | 2.65 | 3.07 | 9.77 | 6.41 | 6.98 | 9.03 | 7.48 | 7.48 | | | * | + |
| PLACE1010277 | 0.73 | 0.48 | 1.84 | 2.72 | 1.75 | 2.20 | 2.90 | 4.07 | 4.07 | | | ** | + |
| PLACE1010293 | 2.98 | 2.04 | 1.13 | 2.91 | 3.54 | 3.25 | 2.77 | 2.03 | 2.03 | | | |
| PLACE1010297 | 1.4 | 1.02 | 0.95 | 3.02 | 1.83 | 2.84 | 1.39 | 2.38 | 2.38 | * | + | |
| PLACE1010300 | 2.53 | 1.14 | 1.11 | 3.81 | 3.04 | 2.55 | 5.33 | 3.77 | 3.77 | | | * | + |
| PLACE1010310 | 32.51 | 17.93 | 15.91 | 30.53 | 26.14 | 27.60 | 23.13 | 27.43 | 27.43 | | | |
| PLACE1010321 | 4.23 | 1.98 | 2.58 | 2.3 | 3.07 | 2.72 | 3.25 | 3.30 | 3.3 | | | |
| PLACE1010324 | 1.39 | 0.54 | 0.66 | 1.12 | 1.26 | 0.93 | 0.53 | 1.22 | 1.22 | | | |
| PLACE1010329 | 2.31 | 0.98 | 1.09 | 3.01 | 2.16 | 2.51 | 0.92 | 2.83 | 2.83 | | | |
| PLACE1010330 | 5.03 | 4.25 | 4.39 | 4.99 | 4.21 | 5.53 | 4.14 | 7.36 | 7.36 | | | |
| PLACE1010335 | 15.88 | 12.79 | 14.20 | 8.65 | 7.50 | 7.75 | 5.10 | 7.02 | 7.02 | ** | − | ** | − |
| PLACE1010341 | 0.29 | 0.66 | 0.37 | 0.99 | 1.99 | 0.90 | 0.42 | 0.24 | 0.24 | | | |
| PLACE1010342 | 0.95 | 0.44 | 0.79 | 1.64 | 1.38 | 0.95 | 1.00 | 0.59 | 0.59 | | | |
| PLACE1010346 | 4.09 | 1.92 | 1.71 | 4.43 | 3.58 | 3.75 | 2.92 | 3.05 | 3.05 | | | |
| PLACE1010362 | 6.71 | 3.65 | 3.11 | 5.41 | 4.43 | 4.32 | 3.93 | 3.09 | 3.09 | | | |
| PLACE1010364 | 2.59 | 1.60 | 1.20 | 2.85 | 2.37 | 2.17 | 1.17 | 1.29 | 1.29 | | | |
| PLACE1010368 | 4.89 | 5.80 | 6.59 | 7.12 | 8.61 | 9.56 | 7.27 | 7.36 | 7.36 | * | + | * | + |
| PLACE1010373 | 5.27 | 3.94 | 4.28 | 6.3 | 5.08 | 7.04 | 5.11 | 6.77 | 6.77 | | | |
| PLACE1010383 | 4.96 | 2.31 | 2.06 | 8.93 | 6.77 | 7.08 | 4.88 | 5.39 | 5.39 | * | + | |
| PLACE1010385 | 0.33 | 0.37 | 0.29 | 0.63 | 0.70 | 0.56 | 0.54 | 0.63 | 0.63 | ** | + | ** | + |
| PLACE1010389 | 5.32 | 1.69 | 2.00 | 3.34 | 2.68 | 4.99 | 2.13 | 3.58 | 3.58 | | | |
| PLACE1010401 | 1.04 | 0.68 | 0.65 | 0.51 | 0.65 | 1.60 | 0.87 | 0.66 | 0.66 | | | |

TABLE 319

| | | | | | | | | | | | | | |
|---|---|---|---|---|---|---|---|---|---|---|---|---|---|
| PLACE1010410 | 4.61 | 1.87 | 2.21 | 5.83 | 8.60 | 7.04 | 3.70 | 4.91 | 4.91 | * | + | | |
| PLACE1010418 | 3.29 | 1.76 | 2.41 | 6.21 | 6.34 | 6.33 | 2.79 | 3.38 | 3.38 | ** | + | | |
| PLACE1010425 | 1.18 | 0.35 | 0.46 | 1.22 | 0.78 | 1.70 | 0.80 | 1.37 | 1.37 | | | | |
| PLACE1010443 | 5.43 | 3.03 | 3.71 | 5.62 | 3.76 | 6.48 | 4.57 | 5.05 | 5.05 | | | | |
| PLACE1010445 | 4.33 | 2.64 | 3.67 | 5.95 | 5.86 | 6.97 | 4.11 | 3.20 | 3.2 | * | + | | |
| PLACE1010481 | 1.37 | 1.21 | 1.06 | 0.8 | 0.77 | 1.60 | 1.13 | 1.10 | 1.1 | | | | |
| PLACE1010482 | 5.16 | 2.61 | 3.60 | 3.41 | 3.22 | 3.80 | 5.36 | 2.91 | 2.91 | | | | |
| PLACE1010491 | 2.88 | 2.21 | 3.23 | 5.03 | 5.64 | 4.25 | 5.35 | 8.41 | 8.41 | * | + | * | + |
| PLACE1010492 | 2.47 | 1.94 | 1.90 | 1.59 | 2.93 | 3.57 | 2.66 | 2.46 | 2.46 | | | | |
| PLACE1010509 | 1.31 | 0.33 | 0.65 | 0.44 | 1.02 | 0.95 | 1.07 | 1.11 | 1.11 | | | | |
| PLACE1010518 | 4.3 | 2.12 | 3.06 | 8.55 | 9.22 | 8.31 | 5.08 | 9.10 | 9.1 | ** | + | * | + |
| PLACE1010522 | 4.42 | 3.30 | 2.99 | 4.43 | 3.15 | 5.70 | 4.02 | 5.51 | 5.51 | | | | |
| PLACE1010529 | 4.44 | 3.27 | 3.34 | 4.15 | 2.17 | 4.43 | 2.83 | 4.60 | 4.6 | | | | |
| PLACE1010547 | 1.36 | 0.46 | 1.84 | 1.38 | 2.57 | 0.83 | 0.81 | 0.68 | 0.68 | | | | |
| PLACE1010560 | 3.62 | 1.42 | 1.78 | 3.44 | 4.11 | 3.17 | 1.69 | 3.25 | 3.25 | | | | |
| PLACE1010562 | 2.49 | 1.56 | 1.51 | 2.33 | 1.85 | 1.73 | 1.62 | 1.70 | 1.7 | | | | |
| PLACE1010579 | 1.43 | 1.21 | 2.19 | 1.9 | 1.92 | 3.18 | 1.68 | 1.93 | 1.93 | | | | |
| PLACE1010580 | 6.35 | 2.50 | 3.66 | 4.91 | 4.74 | 4.81 | 3.94 | 5.30 | 5.3 | | | | |
| PLACE1010599 | 2.99 | 2.56 | 2.79 | 4.69 | 2.68 | 4.02 | 2.68 | 2.87 | 2.87 | | | | |
| PLACE1010606 | 0.64 | 1.41 | 0.70 | 0.91 | 1.32 | 1.04 | 0.85 | 0.75 | 0.75 | | | | |
| PLACE1010616 | 1.07 | 0.75 | 1.12 | 3.22 | 1.83 | 3.57 | 1.94 | 1.36 | 1.36 | * | + | | |
| PLACE1010622 | 9.24 | 4.26 | 4.31 | 2.37 | 3.79 | 2.39 | 1.80 | 2.04 | 2.04 | | | | |
| PLACE1010624 | 6.73 | 4.32 | 4.19 | 2.38 | 2.68 | 1.71 | 1.73 | 1.83 | 1.83 | * | − | * | − |
| PLACE1010628 | 1.26 | 1.28 | 1.00 | 1.32 | 2.31 | 1.21 | 1.10 | 0.98 | 0.98 | | | | |
| PLACE1010629 | 1.86 | 1.74 | 1.96 | 1.86 | 4.02 | 4.33 | 2.68 | 2.28 | 2.28 | | | * | + |
| PLACE1010630 | 5.11 | 3.33 | 3.71 | 7.92 | 7.09 | 5.39 | 5.90 | 7.29 | 7.29 | * | + | * | + |
| PLACE1010631 | 1.79 | 0.95 | 0.97 | 2.41 | 2.47 | 2.83 | 1.91 | 1.86 | 1.86 | + | | | |
| PLACE1010651 | 2.68 | 2.44 | 2.01 | 2.53 | 1.74 | 2.28 | 2.68 | 4.49 | 4.49 | | | | |
| PLACE1010661 | 2.42 | 1.52 | 2.69 | 2.28 | 2.26 | 4.08 | 1.65 | 3.04 | 3.04 | | | | |
| PLACE1010662 | 2.49 | 1.93 | 2.59 | 3.46 | 2.35 | 2.86 | 1.94 | 1.49 | 1.49 | | | | |
| PLACE1010668 | 6.55 | 2.72 | 2.43 | 7.07 | 8.23 | 6.07 | 5.21 | 6.36 | 6.36 | | | | |
| PLACE1010702 | 18.26 | 8.81 | 10.62 | 33.41 | 42.20 | 27.93 | 11.82 | 16.20 | 16.2 | * | + | | |
| PLACE1010709 | 29.25 | 14.24 | 17.35 | 21.38 | 21.56 | 17.73 | 31.21 | 41.95 | 41.95 | | | * | + |
| PLACE1010713 | 11.16 | 4.98 | 5.23 | 9.06 | 10.03 | 9.81 | 9.13 | 15.19 | 15.19 | | | | |
| PLACE1010714 | 0.55 | 0.48 | 0.52 | 0.64 | 0.75 | 1.34 | 0.77 | 0.70 | 0.7 | | | ** | + |
| PLACE1010716 | 5.99 | 2.36 | 2.79 | 3.78 | 2.95 | 5.02 | 3.07 | 3.15 | 3.15 | | | | |
| PLACE1010717 | 2.06 | 1.35 | 1.59 | 2.22 | 1.80 | 2.83 | 0.90 | 1.52 | 1.52 | | | | |
| PLACE1010720 | 18.67 | 8.95 | 8.08 | 12.05 | 17.26 | 10.51 | 4.13 | 4.57 | 4.57 | | | | |
| PLACE1010739 | 1.36 | 1.32 | 0.50 | 2.03 | 2.27 | 3.00 | 2.05 | 1.94 | 1.94 | * | + | * | + |
| PLACE1010743 | 1.84 | 1.21 | 0.69 | 1.5 | 0.87 | 0.37 | 0.87 | 1.50 | 1.5 | | | | |
| PLACE1010752 | 5.21 | 2.95 | 2.72 | 2.98 | 3.08 | 1.59 | 2.31 | 3.98 | 3.98 | | | | |
| PLACE1010761 | 9.42 | 7.63 | 8.64 | 20.89 | 19.08 | 19.20 | 8.58 | 11.68 | 11.68 | ** | + | | |
| PLACE1010771 | 7.47 | 3.15 | 3.53 | 5.95 | 5.91 | 7.07 | 6.15 | 6.64 | 6.64 | | | | |
| PLACE1010784 | 0.87 | 0.52 | 1.39 | 0.62 | 1.10 | 1.01 | 1.14 | 0.89 | 0.89 | | | | |
| PLACE1010786 | 3.62 | 2.60 | 1.59 | 2.95 | 1.86 | 4.15 | 2.62 | 2.64 | 2.64 | | | | |
| PLACE1010789 | 2.47 | 1.71 | 1.29 | 7.34 | 5.69 | 4.59 | 3.94 | 2.83 | 2.83 | ** | + | | |
| PLACE1010800 | 5.09 | 2.34 | 2.77 | 6.42 | 5.52 | 4.71 | 4.26 | 4.86 | 4.86 | | | | |
| PLACE1010802 | 2.85 | 0.65 | 1.48 | 2.19 | 2.46 | 1.85 | 2.00 | 3.34 | 3.34 | | | | |
| PLACE1010811 | 3.15 | 1.56 | 1.75 | 2.32 | 2.73 | 2.52 | 1.52 | 3.78 | 3.78 | | | | |
| PLACE1010813 | 4.37 | 2.54 | 2.23 | 3.08 | 2.72 | 2.68 | 2.51 | 3.14 | 3.14 | | | | |
| PLACE1010827 | 2.09 | 0.81 | 0.76 | 1.38 | 1.83 | 1.70 | 1.14 | 4.49 | 4.49 | | | | |
| PLACE1010833 | 6.2 | 2.64 | 3.19 | 13.01 | 9.81 | 9.59 | 5.31 | 5.99 | 5.99 | * | + | | |
| PLACE1010839 | 3.43 | 2.31 | 3.38 | 7.65 | 5.31 | 7.09 | 3.40 | 4.37 | 4.37 | * | + | | |
| PLACE1010856 | 3.15 | 2.01 | 1.95 | 2.4 | 2.08 | 1.61 | 2.50 | 2.16 | 2.16 | | | | |
| PLACE1010857 | 5.31 | 2.37 | 3.64 | 2.66 | 4.62 | 2.73 | 2.23 | 4.31 | 4.31 | | | | |
| PLACE1010870 | 6.19 | 2.76 | 3.14 | 7.02 | 8.56 | 7.22 | 4.56 | 4.25 | 4.25 | * | + | | |

TABLE 320

| | | | | | | | | | | | | | |
|---|---|---|---|---|---|---|---|---|---|---|---|---|---|
| PLACE1010877 | 3.9 | 0.68 | 2.81 | 4.57 | 8.26 | 6.30 | 4.12 | 5.68 | 5.68 | | | | |
| PLACE1010882 | 1.73 | 0.87 | 1.34 | 0.94 | 1.22 | 1.41 | 1.64 | 2.79 | 2.79 | | | | |
| PLACE1010891 | 1.31 | 1.05 | 1.38 | 1.34 | 2.82 | 2.67 | 1.60 | 1.74 | 1.74 | | | * | + |
| PLACE1010896 | 2.03 | 1.93 | 1.21 | 5.65 | 5.89 | 6.07 | 2.71 | 4.67 | 4.67 | ** | + | * | + |
| PLACE1010900 | 7.45 | 5.19 | 4.52 | 6.71 | 10.28 | 6.75 | 5.29 | 6.78 | 6.78 | | | | |
| PLACE1010916 | 1.58 | 1.17 | 1.07 | 2.47 | 2.58 | 1.67 | 1.27 | 2.26 | 2.26 | * | + | | |
| PLACE1010917 | 1.05 | 0.96 | 0.11 | 1.61 | 1.38 | 1.11 | 1.25 | 1.13 | 1.13 | | | | |
| PLACE1010924 | 2.09 | 0.79 | 0.68 | 3.58 | 1.12 | 1.06 | 1.53 | 2.87 | 2.87 | | | | |
| PLACE1010925 | 6.95 | 5.48 | 6.26 | 14.31 | 3.92 | 11.11 | 10.38 | 11.87 | 11.87 | ** | + | ** | + |
| PLACE1010926 | 4.68 | 2.80 | 3.56 | 5.61 | 3.87 | 4.95 | 5.17 | 4.94 | 4.94 | | | | |
| PLACE1010942 | 9.58 | 6.01 | 6.54 | 10.63 | 11.10 | 11.71 | 7.84 | 8.22 | 8.22 | * | + | | |
| PLACE1010943 | 34.04 | 17.63 | 26.11 | 27.44 | 25.58 | 32.27 | 17.16 | 17.20 | 17.2 | | | | |
| PLACE1010944 | 4.16 | 2.44 | 1.53 | 4.69 | 4.52 | 3.10 | 3.60 | 3.71 | 3.71 | | | | |
| PLACE1010947 | 3 | 1.38 | 1.06 | 4.09 | 3.59 | 3.17 | 3.08 | 1.80 | 1.8 | | | | |
| PLACE1010954 | 5.64 | 1.64 | 2.41 | 6.89 | 7.16 | 7.06 | 4.57 | 2.95 | 2.95 | * | + | | |
| PLACE1010960 | 2.56 | 1.87 | 3.84 | 3.46 | 4.48 | 4.07 | 2.90 | 5.57 | 5.57 | | | | |
| PLACE1010965 | 2.32 | 1.81 | 1.90 | 3.82 | 3.17 | 4.63 | 3.08 | 3.88 | 3.88 | * | + | ** | + |

TABLE 320-continued

| | | | | | | | | | | | | | | |
|---|---|---|---|---|---|---|---|---|---|---|---|---|---|---|
| PLACE1010968 | 2.01 | 2.04 | 1.40 | 2.48 | 1.55 | 2.68 | 3.26 | 2.68 | 2.68 | | | * | + | |
| PLACE1010978 | 2.64 | 1.65 | 3.12 | 2.67 | 4.61 | 3.98 | 4.33 | 3.15 | 3.15 | | | | | |
| PLACE1010982 | 0.32 | 0.44 | 1.17 | 1.43 | 1.48 | 1.69 | 0.82 | 1.16 | 1.16 | * | + | | | |
| PLACE1010990 | 1.25 | 1.65 | 1.41 | 1.21 | 2.03 | 3.15 | 1.56 | 2.02 | 2.02 | | | | | |
| PLACE1011017 | 4.02 | 2.33 | 2.07 | 4.93 | 5.02 | 3.31 | 2.67 | 2.53 | 2.53 | | | | | |
| PLACE1011019 | 4.19 | 3.51 | 2.69 | 3.28 | 4.24 | 3.10 | 3.40 | 4.43 | 4.43 | | | | | |
| PLACE1011026 | 0.53 | 0.56 | 0.94 | 1 | 1.14 | 1.01 | 1.44 | 1.90 | 1.9 | | | ** | + | |
| PLACE1011032 | 1.04 | 1.26 | 1.14 | 1.35 | 3.76 | 1.41 | 1.45 | 1.09 | 1.09 | | | | | |
| PLACE1011041 | 2.22 | 2.15 | 1.83 | 3.19 | 3.33 | 2.65 | 2.20 | 2.59 | 2.59 | * | + | | | |
| PLACE1011045 | 4.26 | 2.55 | 2.05 | 3.25 | 2.44 | 2.71 | 2.62 | 4.66 | 4.66 | | | | | |
| PLACE1011046 | 2.58 | 2.74 | 2.45 | 7.65 | 5.20 | 7.76 | 2.85 | 2.98 | 2.98 | ** | + | * | + | |
| PLACE1011054 | 5.53 | 5.97 | 3.21 | 7.9 | 9.44 | 10.30 | 5.46 | 7.19 | 7.19 | * | + | | | |
| PLACE1011056 | 12.06 | 8.95 | 6.62 | 12.16 | 14.46 | 16.30 | 10.02 | 8.27 | 8.27 | | | | | |
| PLACE1011057 | 1.87 | 1.37 | 1.37 | 4.52 | 4.54 | 3.70 | 1.84 | 1.48 | 1.48 | ** | + | | | |
| PLACE1011059 | 0.6 | 0.44 | 0.37 | 1.23 | 1.32 | 1.03 | 0.88 | 0.52 | 0.52 | ** | + | | | |
| PLACE1011066 | 4.38 | 2.43 | 3.65 | 12.21 | 8.07 | 8.10 | 6.79 | 9.58 | 9.58 | * | + | ** | + | |
| PLACE1011087 | 8.25 | 6.00 | 13.05 | 11.16 | 14.93 | 13.07 | 8.67 | 11.65 | 11.65 | | | | | |
| PLACE1011090 | 3.34 | 3.04 | 3.20 | 4.44 | 8.79 | 7.02 | 2.18 | 1.69 | 1.69 | * | + | ** | − | |
| PLACE1011109 | 4.01 | 3.02 | 3.89 | 8.31 | 10.21 | 9.01 | 3.52 | 3.74 | 3.74 | ** | + | | | |
| PLACE1011114 | 3.2 | 3.86 | 3.47 | 4.71 | 3.90 | 4.13 | 3.10 | 3.01 | 3.01 | | | | | |
| PLACE1011116 | 10.05 | 5.20 | 4.98 | 6.55 | 11.37 | 7.07 | 9.74 | 10.38 | 10.38 | | | | | |
| PLACE1011122 | 1.51 | 0.61 | 0.83 | 0.61 | 2.18 | 1.37 | 1.66 | 1.51 | 1.51 | | | | | |
| PLACE1011133 | 3.84 | 1.08 | 1.97 | 3.52 | 5.23 | 3.54 | 3.50 | 2.83 | 2.83 | | | | | |
| PLACE1011134 | 3.94 | 1.65 | 2.34 | 3.61 | 3.61 | 3.94 | 2.95 | 3.46 | 3.46 | | | | | |
| PLACE1011143 | 3.34 | 0.78 | 1.07 | 1.6 | 0.98 | 1.60 | 1.65 | 1.94 | 1.94 | | | | | |
| PLACE1011146 | 5.79 | 3.61 | 4.24 | 4.94 | 3.96 | 4.87 | 4.89 | 7.01 | 7.01 | | | | | |
| PLACE1011160 | 3.37 | 3.04 | 1.43 | 3.14 | 2.88 | 3.52 | 2.47 | 3.09 | 3.09 | | | | | |
| PLACE1011165 | 2.82 | 1.49 | 1.92 | 2.09 | 2.17 | 1.87 | 1.17 | 1.03 | 1.03 | | | | | |
| PLACE1011181 | 4.06 | 3.32 | 2.04 | 6.31 | 7.78 | 3.19 | 4.22 | 5.69 | 5.69 | | | | | |
| PLACE1011185 | 3.65 | 1.45 | 1.75 | 3.91 | 3.68 | 3.21 | 2.20 | 1.92 | 1.92 | | | | | |
| PLACE1011186 | 10.21 | 6.77 | 9.51 | 8.05 | 10.88 | 9.70 | 7.96 | 8.75 | 8.75 | | | | | |
| PLACE1011203 | 0.72 | 0.41 | 0.60 | 0.86 | 1.05 | 1.05 | 0.76 | 0.91 | 0.91 | * | + | | | |
| PLACE1011214 | 2.12 | 1.28 | 1.87 | 3.46 | 4.03 | 3.52 | 3.00 | 2.98 | 2.98 | ** | + | ** | + | |
| PLACE1011219 | 5.09 | 4.32 | 4.64 | 6.07 | 4.80 | 4.51 | 3.57 | 4.01 | 4.01 | | | * | − | |
| PLACE1011221 | 8.97 | 5.27 | 6.20 | 7.22 | 3.06 | 12.50 | 3.65 | 4.01 | 4.01 | | | | | |
| PLACE1011229 | 3.75 | 1.90 | 2.65 | 1.71 | 3.17 | 2.00 | 1.40 | 2.18 | 2.18 | | | | | |
| PLACE1011231 | 3.92 | 2.25 | 2.28 | 3.91 | 4.79 | 2.77 | 5.22 | 2.91 | 2.91 | | | | | |
| PLACE1011236 | 8.67 | 4.88 | 5.11 | 4.86 | 4.69 | 4.64 | 5.23 | 5.25 | 5.25 | | | | | |
| PLACE1011247 | 4.61 | 2.86 | 4.14 | 4.95 | 3.62 | 3.74 | 4.69 | 6.05 | 6.05 | | | | | |

TABLE 321

| | | | | | | | | | | | | | | |
|---|---|---|---|---|---|---|---|---|---|---|---|---|---|---|
| PLACE1011263 | 4.63 | 1.43 | 2.06 | 5.15 | 3.30 | 5.05 | 3.84 | 4.54 | 4.54 | | | | | |
| PLACE1011273 | 0.96 | 0.21 | 0.03 | 0.28 | 0.62 | 1.29 | 0.76 | 0.83 | 0.83 | | | | | |
| PLACE1011278 | 6.81 | 4.02 | 5.42 | 10.67 | 8.60 | 12.25 | 6.32 | 6.99 | 6.99 | * | + | | | |
| PLACE1011289 | 5.66 | 2.33 | 3.18 | 4.65 | 3.12 | 5.27 | 3.01 | 3.39 | 3.39 | | | | | |
| PLACE1011291 | 16.28 | 11.06 | 10.52 | 7.72 | 9.80 | 6.81 | 14.94 | 17.29 | 17.29 | | | | | |
| PLACE1011296 | 3.24 | 2.37 | 2.66 | 4.3 | 4.86 | 3.54 | 3.68 | 3.04 | 3.04 | * | + | | | |
| PLACE1011310 | 4 | 1.37 | 1.23 | 4.91 | 7.48 | 2.45 | 2.90 | 2.71 | 2.71 | | | | | |
| PLACE1011311 | 6.86 | 4.63 | 5.58 | 11.54 | 13.47 | 10.02 | 8.99 | 6.21 | 6.21 | ** | + | | | |
| PLACE1011321 | 2.48 | 2.00 | 2.29 | 4.17 | 3.53 | 4.74 | 3.10 | 3.06 | 3.06 | ** | + | ** | + | |
| PLACE1011325 | 2.45 | 1.16 | 0.85 | 2.15 | 1.85 | 2.50 | 1.87 | 1.38 | 1.38 | | | | | |
| PLACE1011332 | 2.06 | 1.37 | 1.10 | 2.9 | 1.77 | 3.23 | 1.54 | 3.88 | 3.88 | | | | | |
| PLACE1011340 | 4.71 | 2.86 | 3.96 | 6.93 | 7.43 | 10.39 | 3.26 | 4.42 | 4.42 | * | + | | | |
| PLACE1011353 | 8.94 | 8.02 | 6.47 | 12.12 | 12.68 | 8.45 | 5.57 | 6.13 | 6.13 | | | | | |
| PLACE1011360 | 5.26 | 2.74 | 2.31 | 7.14 | 13.29 | 6.66 | 11.83 | 17.54 | 17.54 | | | ** | + | |
| PLACE1011364 | 3.45 | 2.09 | 2.62 | 4.62 | 3.01 | 2.44 | 3.75 | 3.95 | 3.95 | | | * | + | |
| PLACE1011365 | 2.35 | 1.17 | 0.95 | 2.03 | 1.96 | 2.41 | 0.96 | 2.66 | 2.66 | | | | | |
| PLACE1011371 | 5.16 | 2.45 | 2.43 | 5.08 | 2.86 | 3.23 | 3.60 | 3.42 | 3.42 | | | | | |
| PLACE1011375 | 2.23 | 1.21 | 1.56 | 1.86 | 1.08 | 1.78 | 1.86 | 1.55 | 1.55 | | | | | |
| PLACE1011386 | 8.63 | 5.02 | 6.24 | 7.07 | 6.54 | 8.61 | 7.88 | 10.06 | 10.06 | | | | | |
| PLACE1011399 | 1.83 | 1.09 | 0.89 | 5.72 | 1.66 | 3.52 | 2.58 | 2.39 | 2.39 | | | * | + | |
| PLACE1011406 | 5.14 | 2.34 | 2.53 | 3.24 | 3.16 | 4.75 | 3.03 | 4.67 | 4.67 | | | | | |
| PLACE1011407 | 5.6 | 2.12 | 1.49 | 5.65 | 6.78 | 4.60 | 3.19 | 4.91 | 4.91 | | | | | |
| PLACE1011419 | 3.79 | 1.50 | 2.18 | 3.71 | 3.80 | 3.26 | 2.85 | 4.10 | 4.1 | | | | | |
| PLACE1011433 | 3.79 | 3.19 | 4.12 | 13.24 | 18.92 | 14.07 | 5.04 | 9.50 | 9.5 | ** | + | * | + | |
| PLACE1011440 | 3.69 | 0.88 | 2.02 | 3.25 | 2.87 | 3.33 | 3.41 | 3.73 | 3.73 | | | | | |
| PLACE1011452 | 3.56 | 2.32 | 3.25 | 5.65 | 6.92 | 7.14 | 3.10 | 4.52 | 4.52 | ** | + | | | |
| PLACE1011465 | 1.9 | 0.93 | 1.60 | 1.74 | 1.90 | 2.00 | 2.17 | 2.04 | 2.04 | | | | | |
| PLACE1011472 | 5.01 | 1.93 | 2.18 | 2.83 | 4.34 | 2.95 | 3.24 | 2.62 | 2.62 | | | | | |
| PLACE1011477 | 7.19 | 3.67 | 4.99 | 9.17 | 8.71 | 7.03 | 6.34 | 7.80 | 7.8 | | | | | |
| PLACE1011478 | 4.7 | 2.46 | 2.21 | 8.34 | 7.12 | 6.47 | 4.52 | 4.33 | 4.33 | * | + | | | |
| PLACE1011492 | 5.64 | 3.42 | 3.03 | 6.13 | 7.41 | 5.44 | 6.73 | 7.31 | 7.31 | | | * | + | |
| PLACE1011498 | 2.62 | 0.69 | 0.77 | 2.57 | 1.98 | 3.73 | 3.99 | 6.38 | 6.38 | | | * | + | |
| PLACE1011501 | 1.42 | 0.15 | 0.63 | 0.39 | 1.02 | 1.21 | 0.37 | 2.92 | 2.92 | | | | | |
| PLACE1011503 | 1.26 | 0.38 | 0.38 | 0.56 | 0.61 | 1.28 | 0.65 | 1.73 | 1.73 | | | | | |

TABLE 321-continued

| | | | | | | | | | | | | | |
|---|---|---|---|---|---|---|---|---|---|---|---|---|---|
| PLACE1011509 | 2.69 | 1.51 | 1.96 | 4.97 | 3.77 | 5.32 | 2.73 | 3.70 | 3.7 | * | + | * | + |
| PLACE1011514 | 3.56 | 3.02 | 2.30 | 6.22 | 6.65 | 9.32 | 5.42 | 3.34 | 3.34 | * | + | | |
| PLACE1011516 | 9.2 | 5.83 | 6.52 | 8.39 | 11.75 | 7.44 | 6.58 | 7.31 | 7.31 | | | | |
| PLACE1011520 | 0.67 | (0.02) | 0.19 | 0.61 | 0.97 | 0.53 | 0.59 | 1.82 | 1.82 | | | | |
| PLACE1011538 | 2.38 | 1.78 | 1.26 | 2.2 | 1.67 | 2.66 | 4.47 | 5.04 | 5.04 | | | ** | + |
| PLACE1011555 | 2.73 | 2.02 | 1.56 | 3.06 | 1.29 | 2.65 | 3.42 | 3.23 | 3.23 | | | * | + |
| PLACE1011561 | 0.88 | 0.17 | 0.48 | 1.89 | 2.38 | 1.56 | 4.39 | 6.30 | 6.3 | * | + | ** | + |
| PLACE1011563 | 3.61 | 1.68 | 1.69 | 2.85 | 2.58 | 2.68 | 3.94 | 2.74 | 2.74 | | | | |
| PLACE1011567 | 2.71 | 2.13 | 1.59 | 4.37 | 4.64 | 3.78 | 1.76 | 2.11 | 2.11 | ** | + | | |
| PLACE1011569 | 0.28 | 1.00 | 0.40 | 1.55 | 1.16 | 1.18 | 0.73 | 0.92 | 0.92 | * | + | | |
| PLACE1011576 | 30.78 | 17.05 | 20.91 | 58.85 | 8.74 | 38.79 | 22.26 | 24.68 | 24.68 | * | + | | |
| PLACE1011586 | 5.24 | 2.45 | 1.64 | 5.28 | 3.51 | 3.90 | 2.49 | 2.57 | 2.57 | | | | |
| PLACE1011635 | 1.82 | 1.02 | 0.96 | 2.22 | 1.28 | 1.79 | 1.86 | 3.48 | 3.48 | | | | |
| PLACE1011641 | 0.55 | 0.39 | 0.51 | 0.79 | 0.28 | 0.18 | 0.89 | 0.98 | 0.98 | | | ** | + |
| PLACE1011642 | 2.33 | 1.95 | 2.07 | 3.44 | 2.17 | 2.75 | 1.72 | 3.63 | 3.63 | | | | |
| PLACE1011643 | 1.74 | 0.86 | 1.81 | 2.9 | 2.61 | 2.81 | 1.78 | 2.26 | 2.26 | * | + | | |
| PLACE1011646 | 4.54 | 1.91 | 2.30 | 4.88 | 5.46 | 7.17 | 3.47 | 4.39 | 4.39 | | | | |
| PLACE1011649 | 5.04 | 2.68 | 5.39 | 5.34 | 8.26 | 6.45 | 8.02 | 7.02 | 7.02 | | | * | + |
| PLACE1011650 | 9.82 | 9.33 | 4.23 | 8.72 | 9.82 | 8.25 | 7.64 | 7.21 | 7.21 | | | | |
| PLACE1011661 | 4.13 | 2.90 | 2.81 | 7.54 | 8.51 | 8.47 | 3.11 | 3.99 | 3.99 | ** | + | | |
| PLACE1011664 | 2.28 | 2.16 | 2.82 | 2.3 | 4.01 | 2.45 | 1.92 | 2.20 | 2.2 | | | | |
| PLACE1011672 | 1.34 | 0.43 | 0.59 | 1.98 | 2.38 | 1.65 | 1.43 | 1.75 | 1.75 | * | + | * | + |

TABLE 322

| | | | | | | | | | | | | | |
|---|---|---|---|---|---|---|---|---|---|---|---|---|---|
| PLACE1011675 | 0.49 | 0.41 | 0.33 | 1.54 | 2.62 | 1.74 | 1.03 | 0.63 | 0.63 | ** | + | | |
| PLACE1011682 | 1.44 | 1.27 | 1.77 | 1.27 | 1.81 | 1.50 | 0.94 | 2.14 | 2.14 | | | | |
| PLACE1011708 | 4.35 | 4.02 | 4.14 | 5.7 | 7.61 | 8.08 | 4.28 | 4.88 | 4.88 | * | + | | |
| PLACE1011719 | 1.76 | 1.55 | 1.39 | 2.03 | 3.35 | 3.13 | 2.09 | 2.66 | 2.66 | * | + | * | + |
| PLACE1011725 | 4.47 | 2.20 | 1.51 | 6.52 | 4.79 | 5.08 | 4.70 | 3.97 | 3.97 | | | | |
| PLACE1011729 | 2.26 | 0.34 | 1.16 | 2.9 | 3.70 | 2.58 | 1.88 | 1.07 | 1.07 | * | + | | |
| PLACE1011741 | 1.85 | 1.08 | 1.46 | 2.17 | 2.55 | 1.44 | 1.47 | 2.04 | 2.04 | | | | |
| PLACE1011749 | 4.07 | 1.97 | 2.35 | 5.14 | 5.66 | 5.55 | 2.94 | 2.96 | 2.96 | * | + | | |
| PLACE1011757 | 7.95 | 5.78 | 4.73 | 28.51 | 35.97 | 33.70 | 18.45 | 19.91 | 19.91 | ** | + | ** | + |
| PLACE1011762 | 0.6 | 0.62 | 0.64 | 1.51 | 2.40 | 1.43 | 1.31 | 1.98 | 1.98 | * | + | ** | + |
| PLACE1011778 | 0.68 | 0.80 | 0.85 | 0.72 | 1.28 | 1.91 | 1.16 | 0.80 | 0.8 | | | | |
| PLACE1011783 | 3.26 | 3.37 | 4.33 | 9.36 | 8.72 | 9.68 | 4.31 | 3.99 | 3.99 | ** | + | | |
| PLACE1011795 | 2.41 | 0.78 | 0.71 | 3.25 | 3.16 | 2.10 | 1.75 | 0.51 | 0.51 | | | | |
| PLACE1011810 | 1.09 | 0.35 | 0.96 | 0.57 | 0.96 | 0.71 | 1.04 | 1.41 | 1.41 | | | | |
| PLACE1011824 | 1.1 | 0.61 | 0.73 | 1.63 | 1.19 | 1.20 | 1.70 | 1.61 | 1.61 | | | ** | + |
| PLACE1011825 | 19.56 | 10.93 | 11.42 | 10.37 | 11.28 | 11.36 | 8.08 | 10.44 | 10.44 | | | | |
| PLACE1011835 | 2.12 | 1.20 | 1.49 | 1.76 | 1.50 | 1.06 | 1.49 | 0.95 | 0.95 | | | | |
| PLACE1011836 | 32.53 | 15.61 | 18.36 | 27.63 | 35.75 | 28.68 | 27.23 | 20.95 | 20.95 | | | | |
| PLACE1011847 | 0.74 | 1.05 | 0.62 | 0.62 | 0.87 | 1.11 | 1.60 | 1.10 | 1.1 | | | | |
| PLACE1011855 | 1.16 | 0.16 | 0.77 | 0.69 | 0.71 | 1.38 | 0.70 | 1.13 | 1.13 | | | | |
| PLACE1011858 | 2.38 | 2.07 | 1.60 | 2.19 | 2.08 | 1.60 | 2.79 | 2.84 | 2.84 | | | * | + |
| PLACE1011874 | 3.25 | 1.54 | 2.03 | 4.69 | 4.12 | 4.23 | 2.47 | 3.11 | 3.11 | * | + | | |
| PLACE1011875 | 1.26 | 0.66 | 0.64 | 1.26 | 1.14 | 1.27 | 0.79 | 0.74 | 0.74 | | | | |
| PLACE1011877 | 6.46 | 2.58 | 3.09 | 3.53 | 2.30 | 3.26 | 2.14 | 3.12 | 3.12 | | | | |
| PLACE1011891 | 1.77 | 0.88 | 0.81 | 1.69 | 1.67 | 1.68 | 1.49 | 2.31 | 2.31 | | | | |
| PLACE1011896 | 0.86 | 0.25 | 0.26 | 0.37 | 0.26 | 0.57 | 0.67 | 0.48 | 0.48 | | | | |
| PLACE1011920 | 2.91 | 0.83 | 1.76 | 1.44 | 1.22 | 2.34 | 1.43 | 1.54 | 1.54 | | | | |
| PLACE1011922 | 4.71 | 2.40 | 2.11 | 4.92 | 2.79 | 4.42 | 3.68 | 4.23 | 4.23 | | | | |
| PLACE1011923 | 3.63 | 1.24 | 1.28 | 5.32 | 2.65 | 2.76 | 7.49 | 10.90 | 10.9 | | | ** | + |
| PLACE1011937 | 6 | 2.51 | 3.82 | 3.74 | 4.24 | 5.24 | 4.33 | 4.96 | 4.96 | | | | |
| PLACE1011939 | 4.24 | 2.12 | 2.87 | 2.83 | 3.92 | 4.33 | 4.29 | 5.83 | 5.83 | | | * | + |
| PLACE1011940 | 5.02 | 1.82 | 3.30 | 7.08 | 7.36 | 8.48 | 4.28 | 5.85 | 5.85 | * | + | | |
| PLACE1011962 | 13.26 | 6.64 | 7.98 | 11.22 | 11.07 | 13.01 | 8.70 | 9.69 | 9.69 | | | | |
| PLACE1011964 | 2.09 | 0.16 | 0.88 | 0.97 | 0.96 | 0.80 | 0.82 | 1.29 | 1.29 | | | | |
| PLACE1011978 | 6.83 | 5.17 | 5.96 | 14.23 | 9.13 | 15.11 | 5.12 | 9.01 | 9.01 | * | + | | |
| PLACE1011980 | 5.54 | 2.72 | 4.54 | 9.74 | 12.59 | 11.01 | 4.66 | 6.64 | 6.64 | ** | + | | |
| PLACE1011981 | 6.65 | 3.37 | 3.46 | 5.38 | 6.10 | 5.01 | 3.81 | 4.69 | 4.69 | | | | |
| PLACE1011982 | 0.91 | 0.32 | 0.06 | 0.49 | 1.81 | 1.02 | 0.79 | 1.02 | 1.02 | | | | |
| PLACE1011995 | 4.44 | 2.50 | 2.12 | 5.89 | 6.15 | 5.90 | 3.97 | 3.81 | 3.81 | * | + | | |
| PLACE1012023 | 1.79 | 0.70 | 1.25 | 1.43 | 1.61 | 2.10 | 1.24 | 1.17 | 1.17 | | | | |
| PLACE1012026 | 1.87 | 0.19 | 0.62 | 1.01 | 0.13 | 0.38 | 0.66 | 0.81 | 0.81 | | | | |
| PLACE1012031 | 2.22 | 1.02 | 2.34 | 1.31 | 1.21 | 3.28 | 1.23 | 2.49 | 2.49 | | | | |
| PLACE2000003 | 10.16 | 5.53 | 7.19 | 14.74 | 10.74 | 18.79 | 8.25 | 10.16 | 10.16 | | | | |
| PLACE2000005 | 4.58 | 2.43 | 2.29 | 4.4 | 3.89 | 4.52 | 3.11 | 4.04 | 4.04 | | | | |
| PLACE2000006 | 6.31 | 3.28 | 0.91 | 2.52 | 4.28 | 3.42 | 2.99 | 2.00 | 2 | | | | |
| PLACE2000007 | 3.33 | 1.18 | 1.86 | 1.87 | 3.29 | 3.13 | 2.74 | 4.18 | 4.18 | | | | |
| PLACE2000011 | 6.03 | 2.56 | 4.49 | 6.77 | 5.68 | 6.77 | 3.61 | 4.33 | 4.33 | | | | |
| PLACE2000014 | 0.21 | 0.98 | 0.82 | 1.07 | 2.07 | 1.53 | 2.21 | 2.03 | 2.03 | | | ** | + |
| PLACE2000015 | 1.83 | 0.65 | 1.01 | 1.76 | 1.29 | 2.19 | 1.52 | 0.85 | 0.85 | | | | |
| PLACE2000017 | 3.21 | 0.73 | 1.74 | 6.58 | 4.80 | 4.12 | 2.77 | 1.87 | 1.87 | * | + | | |
| PLACE2000021 | 3.22 | 1.34 | 2.09 | 3.94 | 3.51 | 4.88 | 1.82 | 2.10 | 2.1 | * | + | | |

TABLE 322-continued

| | | | | | | | | | | | | |
|---|---|---|---|---|---|---|---|---|---|---|---|---|
| PLACE2000022 | 7.75 | 3.64 | 2.82 | 8.01 | 9.76 | 8.90 | 3.63 | 6.09 | 6.09 | | | |
| PLACE2000030 | 8.7 | 4.13 | 5.99 | 6.21 | 7.35 | 6.10 | 5.75 | 6.25 | 6.25 | | | |
| PLACE2000032 | 4.4 | 0.93 | 2.84 | 5.81 | 6.65 | 4.83 | 2.50 | 4.03 | 4.03 | | | |
| PLACE2000033 | 1.83 | 1.13 | 0.57 | 2.93 | 3.15 | 2.60 | 1.56 | 1.76 | 1.76 | * | + | |
| PLACE2000034 | 2.2 | 2.03 | 1.49 | 1.47 | 1.71 | 2.75 | 1.92 | 3.95 | 3.95 | | | |

TABLE 323

| | | | | | | | | | | | | | |
|---|---|---|---|---|---|---|---|---|---|---|---|---|---|
| PLACE2000039 | 6.48 | 4.35 | 4.61 | 11.87 | 11.66 | 13.79 | 6.80 | 7.28 | 7.28 | ** | + | * | + |
| PLACE2000043 | 2.47 | 1.44 | 2.20 | 2.31 | 3.69 | 3.32 | 3.41 | 4.52 | 4.52 | | | * | + |
| PLACE2000044 | 5.02 | 3.35 | 3.46 | 5.51 | 3.83 | 5.89 | 4.93 | 7.31 | 7.31 | | | | |
| PLACE2000047 | 8.18 | 4.36 | 3.83 | 9.19 | 11.31 | 14.75 | 5.33 | 7.74 | 7.74 | * | + | | |
| PLACE2000050 | 12.24 | 3.78 | 3.08 | 8.61 | 10.29 | 7.90 | 7.32 | 6.64 | 6.64 | | | | |
| PLACE2000061 | 2.92 | 0.96 | 0.97 | 1.52 | 9.96 | 1.26 | 1.35 | 1.85 | 1.85 | | | | |
| PLACE2000062 | 4.77 | 2.50 | 2.13 | 5.58 | 5.65 | 5.45 | 2.96 | 5.42 | 5.42 | * | + | | |
| PLACE2000072 | 2.7 | 1.26 | 2.16 | 2.17 | 3.44 | 2.93 | 1.74 | 2.43 | 2.43 | | | | |
| PLACE2000073 | 1.69 | 0.72 | 0.84 | 1.41 | 0.59 | 1.30 | 1.70 | 1.52 | 1.52 | | | | |
| PLACE2000097 | 13.16 | 8.11 | 9.49 | 11.41 | 12.05 | 13.08 | 7.86 | 8.83 | 8.83 | | | | |
| PLACE2000100 | 5.14 | 3.46 | 2.83 | 5.96 | 4.13 | 5.86 | 4.27 | 5.06 | 5.06 | | | | |
| PLACE2000103 | 4.64 | 3.10 | 3.20 | 7.22 | 5.44 | 6.13 | 4.03 | 3.95 | 3.95 | * | + | | |
| PLACE2000106 | 7.76 | 2.85 | 4.06 | 6.8 | 7.28 | 7.13 | 4.31 | 4.99 | 4.99 | | | | |
| PLACE2000111 | 4.84 | 2.29 | 3.47 | 5 | 5.26 | 5.57 | 4.32 | 7.27 | 7.27 | | | | |
| PLACE2000115 | 2.29 | 0.90 | 1.18 | 1.38 | 0.91 | 1.85 | 2.19 | 2.02 | 2.02 | | | | |
| PLACE2000118 | 40.98 | 28.15 | 29.38 | 32.74 | 33.08 | 38.40 | 30.44 | 42.97 | 42.97 | | | | |
| PLACE2000124 | 16.57 | 10.11 | 11.57 | 19.83 | 25.65 | 30.81 | 16.15 | 17.74 | 17.74 | * | + | | |
| PLACE2000132 | 7.64 | 4.32 | 5.67 | 5.55 | 4.79 | 4.71 | 7.51 | 6.44 | 6.44 | | | | |
| PLACE2000136 | 1.78 | 0.82 | 1.05 | 1.68 | 1.61 | 1.41 | 1.31 | 1.62 | 1.62 | | | | |
| PLACE2000137 | 6.66 | 4.19 | 3.94 | 4.2 | 3.59 | 5.28 | 3.96 | 5.37 | 5.37 | | | | |
| PLACE2000140 | 9.31 | 3.10 | 5.25 | 7.95 | 10.19 | 7.07 | 4.50 | 6.74 | 6.74 | | | | |
| PLACE2000147 | 2.32 | 1.00 | 0.75 | 2.39 | 2.55 | 2.14 | 1.33 | 2.93 | 2.93 | | | | |
| PLACE2000153 | 1.79 | 0.33 | 0.76 | 0.89 | 1.36 | 1.15 | 2.17 | 2.54 | 2.54 | | | * | + |
| PLACE2000164 | 2.92 | 1.24 | 1.74 | 1.97 | 2.41 | 1.94 | 1.21 | 2.25 | 2.25 | | | | |
| PLACE2000170 | 4.49 | 2.57 | 2.11 | 5.8 | 5.33 | 5.19 | 3.14 | 3.80 | 3.8 | * | + | | |
| PLACE2000172 | 3.21 | 1.40 | 2.70 | 1.1 | 3.14 | 2.28 | 1.52 | 1.72 | 1.72 | | | | |
| PLACE2000173 | 4.05 | 3.41 | 2.95 | 5.72 | 7.77 | 7.43 | 3.82 | 4.53 | 4.53 | ** | + | | |
| PLACE2000174 | 2.94 | 1.68 | 2.28 | 3.36 | 3.27 | 4.06 | 2.97 | 2.61 | 2.61 | * | + | | |
| PLACE2000176 | 6.55 | 2.90 | 2.44 | 6.47 | 6.24 | 4.58 | 3.30 | 4.24 | 4.24 | | | | |
| PLACE2000187 | 4.34 | 2.14 | 1.78 | 5.63 | 3.41 | 5.66 | 3.80 | 4.31 | 4.31 | | | | |
| PLACE2000216 | 4.17 | 2.38 | 2.18 | 6.97 | 6.14 | 5.24 | 7.33 | 12.03 | 12.03 | * | + | * | + |
| PLACE2000219 | 5.75 | 2.86 | 2.79 | 6.33 | 5.19 | 5.66 | 5.15 | 5.03 | 5.03 | | | | |
| PLACE2000221 | 6 | 4.55 | 4.10 | 13.08 | 11.16 | 10.61 | 6.14 | 6.36 | 6.36 | ** | + | | |
| PLACE2000223 | 0.66 | 0.04 | 0.44 | 2.56 | 1.05 | 0.74 | 1.35 | 0.62 | 0.62 | | | | |
| PLACE2000231 | 2.73 | 2.97 | 1.35 | 3.88 | 3.66 | 2.81 | 3.23 | 2.76 | 2.76 | | | | |
| PLACE2000235 | 5.15 | 3.31 | 3.10 | 9.33 | 15.20 | 9.28 | 4.35 | 5.69 | 5.69 | * | + | | |
| PLACE2000246 | 9.05 | 5.03 | 3.92 | 8.93 | 10.34 | 8.27 | 5.20 | 6.19 | 6.19 | | | | |
| PLACE2000264 | 4.4 | 2.75 | 1.21 | 7.23 | 5.72 | 5.03 | 3.18 | 4.43 | 4.43 | * | + | | |
| PLACE2000274 | 8.27 | 4.14 | 5.09 | 4.88 | 4.54 | 3.46 | 4.83 | 6.06 | 6.06 | | | | |
| PLACE2000287 | 14 | 9.69 | 10.03 | 11.98 | 14.31 | 14.19 | 12.42 | 12.37 | 12.37 | | | | |
| PLACE2000296 | 3.51 | 1.96 | 2.07 | 2.61 | 2.73 | 3.24 | 2.29 | 3.69 | 3.69 | | | | |
| PLACE2000302 | 2.31 | 2.23 | 2.10 | 3.57 | 4.89 | 5.77 | 3.81 | 3.32 | 3.32 | * | + | ** | + |
| PLACE2000305 | 7.13 | 5.46 | 4.88 | 12.44 | 18.75 | 14.01 | 6.85 | 6.47 | 6.47 | * | + | | |
| PLACE2000317 | 1.79 | 1.81 | 1.59 | 2.18 | 2.88 | 3.79 | 2.56 | 2.49 | 2.49 | | | ** | + |
| PLACE2000324 | 1.64 | 0.45 | 0.66 | 1.23 | 0.90 | 1.15 | 1.56 | 1.03 | 1.03 | | | | |
| PLACE2000334 | 4.7 | 3.19 | 3.38 | 3.36 | 3.85 | 3.08 | 3.51 | 4.53 | 4.53 | | | | |
| PLACE2000335 | 6.89 | 3.67 | 3.94 | 9.95 | 12.98 | 11.87 | 4.72 | 8.12 | 8.12 | ** | + | | |
| PLACE2000340 | 1.92 | 1.00 | 1.25 | 2.13 | 2.37 | 2.25 | 1.13 | 1.70 | 1.7 | * | + | | |
| PLACE2000341 | 4.05 | 3.76 | 4.37 | 3.23 | 6.79 | 4.35 | 3.93 | 3.97 | 3.97 | | | | |
| PLACE2000342 | 5.08 | 6.69 | 5.71 | 7.14 | 7.41 | 7.08 | 6.86 | 8.97 | 8.97 | * | + | * | + |
| PLACE2000347 | 4.37 | 5.20 | 4.34 | 7.13 | 9.07 | 10.11 | 6.32 | 7.54 | 7.54 | * | + | ** | + |
| PLACE2000357 | 9.87 | 8.86 | 7.75 | 8.78 | 12.51 | 9.80 | 8.70 | 9.73 | 9.73 | | | | |
| PLACE2000358 | 4.58 | 2.20 | 2.55 | 4.28 | 5.06 | 2.32 | 5.59 | 6.09 | 6.09 | | | * | + |
| PLACE2000359 | 2.5 | 0.52 | 0.79 | 3.39 | 1.81 | 2.56 | 2.27 | 0.82 | 0.82 | | | | |
| PLACE2000366 | 6.64 | 3.37 | 2.29 | 8.44 | 9.84 | 6.44 | 5.08 | 3.45 | 3.45 | | | | |
| PLACE2000371 | 4.65 | 3.72 | 1.76 | 1.73 | 2.65 | 2.33 | 2.69 | 2.16 | 2.16 | | | | |

TABLE 324

| | | | | | | | | | | | | | |
|---|---|---|---|---|---|---|---|---|---|---|---|---|---|
| PLACE2000373 | 4.09 | 3.75 | 3.16 | 3.93 | 6.78 | 5.14 | 3.59 | 5.16 | 5.16 | | | | |
| PLACE2000374 | 3.8 | 4.38 | 3.21 | 5.4 | 5.00 | 4.71 | 4.60 | 3.34 | 3.34 | * | + | | |
| PLACE2000379 | 0.43 | 0.66 | 0.58 | 0.91 | 0.73 | 1.09 | 0.79 | 0.77 | 0.77 | * | + | * | + |
| PLACE2000386 | 263.51 | 193.15 | 186.41 | 112.96 | 134.53 | 97.90 | 242.44 | 237.17 | 237.2 | * | − | | |
| PLACE2000388 | 6.14 | 2.57 | 3.20 | 4.18 | 4.37 | 4.11 | 3.57 | 5.67 | 5.67 | | | | |
| PLACE2000392 | 22.7 | 12.68 | 10.22 | 19.04 | 26.24 | 23.82 | 20.84 | 18.58 | 18.58 | | | | |
| PLACE2000394 | 4.15 | 2.33 | 2.30 | 7.45 | 7.62 | 8.22 | 3.35 | 4.27 | 4.27 | ** | + | | |

TABLE 324-continued

| | | | | | | | | | | | | | |
|---|---|---|---|---|---|---|---|---|---|---|---|---|---|
| PLACE2000398 | 5.77 | 2.40 | 4.45 | 3.51 | 4.25 | 5.84 | 4.07 | 5.00 | 5 | | | | |
| PLACE2000399 | 6.61 | 3.16 | 3.15 | 4.97 | 4.51 | 4.35 | 4.73 | 5.61 | 5.61 | | | | |
| PLACE2000402 | 7.01 | 4.23 | 4.20 | 5.54 | 4.09 | 5.56 | 4.44 | 3.54 | 3.54 | | | | |
| PLACE2000404 | 12.23 | 7.88 | 7.30 | 7.71 | 7.31 | 9.74 | 4.74 | 6.01 | 6.01 | | | | |
| PLACE2000411 | 21.27 | 11.68 | 11.82 | 11.14 | 10.88 | 25.73 | 14.78 | 18.35 | 18.35 | | | | |
| PLACE2000418 | 5.51 | 3.37 | 3.01 | 6.69 | 5.87 | 6.09 | 4.87 | 3.75 | 3.75 | | | | |
| PLACE2000419 | 7.28 | 4.27 | 3.30 | 7.57 | 9.49 | 8.40 | 4.83 | 4.59 | 4.59 | | | | |
| PLACE2000425 | 4.32 | 2.24 | 3.29 | 5.08 | 4.37 | 6.06 | 3.45 | 3.86 | 3.86 | | | | |
| PLACE2000427 | 6.26 | 3.55 | 3.23 | 4.54 | 4.54 | 5.08 | 5.10 | 5.28 | 5.28 | | | | |
| PLACE2000433 | 4.59 | 2.65 | 3.36 | 5.7 | 5.12 | 6.87 | 3.87 | 4.81 | 4.81 | * | + | | |
| PLACE2000435 | 29.19 | 15.24 | 17.32 | 14.09 | 10.07 | 16.26 | 23.39 | 24.72 | 24.72 | | | | |
| PLACE2000438 | 3.46 | 1.48 | 2.18 | 3.33 | 2.20 | 3.83 | 3.08 | 2.95 | 2.95 | | | | |
| PLACE2000450 | 9.25 | 3.49 | 4.71 | 9.32 | 13.42 | 13.35 | 5.02 | 6.24 | 6.24 | * | + | | |
| PLACE2000455 | 4.87 | 3.05 | 1.83 | 4.35 | 3.25 | 3.01 | 3.72 | 3.76 | 3.76 | | | | |
| PLACE2000458 | 7.14 | 3.76 | 3.85 | 4.27 | 6.42 | 5.62 | 5.42 | 5.04 | 5.04 | | | | |
| PLACE2000464 | 10.07 | 4.31 | 6.99 | 6.94 | 8.11 | 6.92 | 5.43 | 8.55 | 8.55 | | | | |
| PLACE2000465 | 5.73 | 2.78 | 3.87 | 8.13 | 9.58 | 9.56 | 5.26 | 6.47 | 6.47 | ** | + | | |
| PLACE2000473 | 17.94 | 8.98 | 12.76 | 32.72 | 23.26 | 29.31 | 35.66 | 50.78 | 50.78 | * | + | ** | + |
| PLACE2000477 | 1.27 | 1.02 | 0.52 | 1.09 | 0.78 | 0.53 | 1.48 | 1.22 | 1.22 | | | | |
| PLACE3000004 | 7.55 | 3.19 | 4.53 | 8.79 | 7.24 | 9.45 | 5.46 | 5.75 | 5.75 | | | | |
| PLACE3000009 | 61.9 | 29.47 | 28.32 | 32.27 | 25.30 | 29.38 | 45.27 | 58.28 | 58.28 | | | | |
| PLACE3000020 | 9.44 | 5.05 | 5.57 | 6.59 | 7.39 | 6.52 | 4.82 | 4.55 | 4.55 | | | | |
| PLACE3000029 | 9.17 | 4.67 | 4.83 | 9.55 | 12.07 | 7.65 | 6.59 | 5.44 | 5.44 | | | | |
| PLACE3000038 | 3.05 | 1.65 | 1.71 | 3.75 | 5.45 | 4.67 | 2.86 | 3.09 | 3.09 | * | + | | |
| PLACE3000052 | 4.37 | 2.71 | 2.77 | 5.23 | 4.15 | 6.64 | 3.13 | 2.24 | 2.24 | | | | |
| PLACE3000059 | 2.05 | 0.82 | 1.21 | 3.28 | 2.36 | 2.07 | 1.89 | 1.16 | 1.16 | | | | |
| PLACE3000067 | 6.3 | 3.83 | 5.04 | 11.45 | 12.93 | 15.68 | 7.26 | 8.63 | 8.63 | ** | + | * | + |
| PLACE3000069 | 5.9 | 3.04 | 3.53 | 5 | 5.11 | 8.56 | 5.67 | 5.68 | 5.68 | | | | |
| PLACE3000070 | 27.81 | 15.78 | 20.14 | 32.22 | 26.02 | 53.33 | 21.90 | 29.50 | 29.5 | | | | |
| PLACE3000103 | 2.43 | 0.95 | 1.30 | 3.54 | 4.94 | 4.26 | 1.89 | 2.90 | 2.9 | * | + | | |
| PLACE3000119 | 3.74 | 2.64 | 1.89 | 4.89 | 6.83 | 4.96 | 3.78 | 3.36 | 3.36 | * | + | | |
| PLACE3000121 | 1.44 | 1.22 | 0.45 | 2.39 | 2.51 | 2.11 | 1.78 | 2.32 | 2.32 | * | + | * | + |
| PLACE3000124 | 5.32 | 4.70 | 4.50 | 12.73 | 13.74 | 11.54 | 6.57 | 8.87 | 8.77 | ** | + | * | + |
| PLACE3000135 | 1.71 | 0.60 | 0.29 | 0.53 | 1.12 | 0.70 | 1.32 | 0.77 | 0.77 | | | | |
| PLACE3000136 | 11.16 | 7.11 | 7.56 | 7.93 | 9.54 | 12.38 | 12.19 | 8.74 | 8.74 | | | | |
| PLACE3000142 | 5.52 | 1.94 | 3.53 | 3.47 | 2.41 | 3.28 | 2.84 | 4.03 | 4.03 | | | | |
| PLACE3000145 | 6.76 | 3.35 | 3.37 | 7.36 | 7.49 | 6.80 | 6.17 | 8.06 | 8.06 | | | | |
| PLACE3000147 | 10.95 | 4.59 | 5.26 | 7.55 | 8.27 | 7.90 | 4.11 | 4.34 | 4.34 | | | | |
| PLACE3000148 | 2.39 | 0.34 | 0.58 | 0.98 | 1.42 | 1.44 | 1.27 | 2.88 | 2.88 | | | | |
| PLACE3000154 | 1.15 | 0.41 | 0.41 | 0.66 | 1.09 | 1.15 | 0.77 | 2.42 | 2.42 | | | | |
| PLACE3000155 | 7.02 | 4.85 | 4.71 | 7.95 | 8.38 | 9.70 | 5.71 | 8.16 | 8.16 | * | + | | |
| PLACE3000156 | 15.58 | 8.96 | 9.94 | 8.3 | 7.38 | 10.26 | 12.84 | 18.30 | 18.3 | | | | |
| PLACE3000157 | 4.88 | 2.44 | 2.98 | 2.64 | 3.32 | 4.31 | 4.33 | 4.39 | 4.39 | | | | |
| PLACE3000158 | 8.01 | 3.79 | 3.91 | 9.93 | 12.06 | 12.18 | 6.76 | 6.67 | 6.67 | * | + | | |
| PLACE3000160 | 0.65 | 1.38 | 1.00 | 1.99 | 1.58 | 2.78 | 2.19 | 2.27 | 2.27 | | | ** | + |
| PLACE3000169 | 8.16 | 3.98 | 2.64 | 8.16 | 12.00 | 9.90 | 6.56 | 5.46 | 5.46 | | | | |
| PLACE3000181 | 10.19 | 6.03 | 5.74 | 6.99 | 7.06 | 6.27 | 8.77 | 10.50 | 10.5 | | | | |
| PLACE3000194 | 3.17 | 1.81 | 1.47 | 3.38 | 2.68 | 2.61 | 2.86 | 3.96 | 3.96 | | | | |
| PLACE3000197 | 0.71 | 0.07 | 1.20 | 1.17 | 0.86 | 1.14 | 4.41 | 2.01 | 2.01 | | | | |

TABLE 325

| | | | | | | | | | | | | | |
|---|---|---|---|---|---|---|---|---|---|---|---|---|---|
| PLACE3000199 | 3.29 | 1.08 | 1.38 | 2.04 | 1.59 | 1.81 | 1.36 | 3.52 | 3.52 | | | | |
| PLACE3000205 | 9.93 | 4.59 | 5.70 | 17.83 | 17.57 | 18.45 | 14.66 | 13.74 | 13.74 | ** | + | * | + |
| PLACE3000207 | 5.7 | 3.47 | 2.72 | 7.85 | 6.73 | 9.27 | 4.82 | 3.93 | 3.93 | * | + | | |
| PLACE3000208 | 5.91 | 3.83 | 2.56 | 4.66 | 4.50 | 5.84 | 3.33 | 5.31 | 5.31 | | | | |
| PLACE3000213 | 3.26 | 1.41 | 0.88 | 1.85 | 1.88 | 1.34 | 1.39 | 1.20 | 1.2 | | | | |
| PLACE3000215 | 5.27 | 3.36 | 2.05 | 2.91 | 1.77 | 2.17 | 4.16 | 5.65 | 5.65 | | | | |
| PLACE3000218 | 0.67 | 1.20 | 0.52 | 0.53 | 0.72 | 1.11 | 0.94 | 1.60 | 1.6 | | | | |
| PLACE3000220 | 4.81 | 2.27 | 2.38 | 5.89 | 5.17 | 5.82 | 4.14 | 4.16 | 4.16 | * | + | | |
| PLACE3000221 | 18.58 | 12.33 | 11.49 | 19.49 | 17.73 | 21.75 | 11.62 | 11.46 | 11.46 | | | | |
| PLACE3000225 | 2.26 | 1.52 | 1.43 | 2.24 | 4.06 | 3.45 | 1.47 | 2.45 | 2.45 | | | | |
| PLACE3000226 | 4.27 | 2.49 | 2.02 | 2.27 | 5.71 | 4.75 | 1.91 | 2.73 | 2.73 | | | | |
| PLACE3000230 | 2.53 | 2.38 | 1.81 | 1.66 | 1.64 | 1.71 | 2.48 | 1.35 | 1.35 | | | | |
| PLACE3000231 | 3.29 | 1.13 | 0.60 | 2.47 | 2.81 | 2.21 | 3.05 | 2.05 | 2.05 | | | | |
| PLACE3000235 | 3.68 | 1.67 | 2.09 | 7.18 | 5.86 | 5.62 | 2.96 | 4.70 | 4.7 | ** | + | | |
| PLACE3000242 | 4.95 | 3.58 | 3.28 | 11.36 | 12.88 | 9.51 | 10.16 | 9.35 | 9.35 | ** | + | ** | + |
| PLACE3000244 | 1.78 | 1.29 | 0.91 | 1.71 | 1.41 | 0.91 | 1.35 | 0.85 | 0.85 | | | | |
| PLACE3000253 | 1.86 | 1.24 | 1.41 | 3.62 | 2.97 | 3.37 | 3.19 | 2.28 | 2.28 | ** | + | * | + |
| PLACE3000254 | 51.54 | 34.63 | 40.51 | 40.03 | 46.12 | 56.93 | 50.43 | 47.16 | 47.16 | | | | |
| PLACE3000271 | 5.35 | 3.90 | 4.49 | 12.52 | 15.43 | 16.28 | 5.75 | 8.41 | 8.41 | ** | + | * | + |
| PLACE3000276 | 1.34 | 1.63 | 0.94 | 1.51 | 1.84 | 1.69 | 1.54 | 1.70 | 1.7 | | | | |
| PLACE3000304 | 29.17 | 18.78 | 18.07 | 35.22 | 34.12 | 39.27 | 19.90 | 28.29 | 28.29 | * | + | | |
| PLACE3000309 | 5.85 | 2.02 | 1.54 | 4.32 | 5.65 | 5.33 | 3.03 | 4.10 | 4.1 | | | | |
| PLACE3000310 | 2.86 | 0.49 | 0.75 | 1.95 | 1.51 | 1.29 | 0.96 | 1.26 | 1.26 | | | | |
| PLACE3000320 | 2.43 | 0.72 | 1.39 | 2.35 | 2.67 | 2.63 | 2.57 | 2.39 | 2.39 | | | | |

TABLE 325-continued

| | | | | | | | | | | | | | |
|---|---|---|---|---|---|---|---|---|---|---|---|---|---|
| PLACE3000322 | 3.17 | 2.14 | 2.01 | 4.49 | 4.42 | 5.13 | 3.26 | 3.42 | 3.42 | ** | + | | |
| PLACE3000330 | 3.98 | 4.24 | 5.26 | 4.75 | 5.64 | 8.32 | 9.28 | 8.32 | 8.32 | | | ** | + |
| PLACE3000331 | 3.82 | 3.74 | 4.92 | 7.37 | 8.26 | 9.30 | 3.96 | 4.94 | 4.94 | ** | + | | |
| PLACE3000336 | 2.26 | 2.25 | 2.90 | 3.09 | 4.08 | 4.50 | 1.74 | 3.42 | 3.42 | * | + | | |
| PLACE3000339 | 1.51 | 1.25 | 0.97 | 2.83 | 3.03 | 1.44 | 3.34 | 1.37 | 1.37 | | | | |
| PLACE3000341 | 4.76 | 1.28 | 2.07 | 6.03 | 6.07 | 5.79 | 3.01 | 2.61 | 2.61 | * | + | | |
| PLACE3000350 | 3.67 | 2.80 | 1.30 | 3.28 | 4.94 | 3.47 | 3.39 | 2.10 | 2.1 | | | | |
| PLACE3000352 | 6.03 | 5.05 | 2.30 | 5 | 5.48 | 4.50 | 3.98 | 4.70 | 4.7 | | | | |
| PLACE3000353 | 0.84 | 1.44 | 1.91 | 1.76 | 2.65 | 2.70 | 3.03 | 3.61 | 3.61 | | | ** | + |
| PLACE3000362 | 1.98 | 1.66 | 1.84 | 6.16 | 5.62 | 6.95 | 2.53 | 2.39 | 2.39 | ** | + | ** | + |
| PLACE3000363 | 0.72 | 2.27 | 1.87 | 2.22 | 2.71 | 1.75 | 1.29 | 1.32 | 1.32 | | | | |
| PLACE3000365 | 2.24 | 1.70 | 1.83 | 4.68 | 5.39 | 5.89 | 3.33 | 4.21 | 4.21 | ** | + | ** | + |
| PLACE3000373 | 1.03 | 0.43 | 0.22 | 0.96 | 1.41 | 0.94 | 0.42 | 0.29 | 0.29 | | | | |
| PLACE3000374 | 5.08 | 1.81 | 1.87 | 6.16 | 6.24 | 4.44 | 2.12 | 2.74 | 2.74 | | | | |
| PLACE3000387 | 1.31 | 0.25 | 0.08 | 1.67 | 1.05 | 0.55 | 1.33 | 0.79 | 0.79 | | | | |
| PLACE3000388 | 2.58 | 0.80 | 0.83 | 3.55 | 3.56 | 3.31 | 2.70 | 1.73 | 1.73 | * | + | | |
| PLACE3000399 | 9.22 | 8.21 | 6.43 | 14.93 | 15.70 | 16.79 | 8.93 | 10.00 | 10 | ** | + | | |
| PLACE3000400 | 1.92 | 1.54 | 0.91 | 6.92 | 3.60 | 4.30 | 2.99 | 2.65 | 2.65 | * | + | * | + |
| PLACE3000401 | 29 | 26.24 | 24.78 | 59.59 | 55.01 | 78.12 | 29.62 | 31.31 | 31.31 | ** | + | * | + |
| PLACE3000402 | 2.02 | 1.57 | 1.10 | 4.22 | 3.77 | 2.97 | 1.86 | 1.95 | 1.95 | ** | + | | |
| PLACE3000405 | 6.4 | 2.32 | 4.16 | 6.78 | 5.01 | 5.58 | 4.43 | 5.58 | 5.58 | | | | |
| PLACE3000406 | 4.28 | 1.49 | 2.84 | 5.5 | 4.66 | 5.13 | 2.47 | 2.85 | 2.85 | | | | |
| PLACE3000413 | 8.22 | 3.55 | 3.63 | 4.09 | 5.81 | 4.91 | 5.48 | 4.88 | 4.88 | | | | |
| PLACE3000416 | 4.22 | 2.84 | 2.70 | 5.29 | 3.87 | 4.91 | 3.53 | 2.90 | 2.9 | | | | |
| PLACE3000425 | 4.82 | 2.55 | 2.93 | 8.14 | 7.04 | 8.00 | 4.35 | 5.24 | 5.24 | ** | + | | |
| PLACE3000437 | 6.6 | 2.18 | 3.38 | 8.46 | 5.80 | 8.41 | 4.73 | 5.68 | 5.68 | | | | |
| PLACE3000455 | 10.15 | 5.78 | 7.81 | 11.84 | 13.57 | 13.33 | 7.04 | 7.08 | 7.08 | * | + | | |
| PLACE3000475 | 41.33 | 26.86 | 19.78 | 25.89 | 28.01 | 22.74 | 42.53 | 36.25 | 36.25 | | | | |
| PLACE3000477 | 9.34 | 3.92 | 3.31 | 6.31 | 7.30 | 5.21 | 5.44 | 6.16 | 6.16 | | | | |
| PLACE4000003 | 2.47 | 1.31 | 0.94 | 1.5 | 2.41 | 1.58 | 1.49 | 1.63 | 1.63 | | | | |
| PLACE4000008 | 5.72 | 2.63 | 3.64 | 8.57 | 12.47 | 10.37 | 7.46 | 7.86 | 7.86 | * | + | * | + |
| PLACE4000009 | 14.5 | 7.53 | 8.72 | 15.96 | 13.93 | 14.92 | 9.76 | 11.70 | 11.7 | | | | |

TABLE 326

| | | | | | | | | | | | | | |
|---|---|---|---|---|---|---|---|---|---|---|---|---|---|
| PLACE4000014 | 5.92 | 2.92 | 3.44 | 5.18 | 6.07 | 5.84 | 4.46 | 4.89 | 4.89 | | | | |
| PLACE4000029 | 1.91 | 1.44 | 1.35 | 3.21 | 1.93 | 3.26 | 3.99 | 3.79 | 3.79 | | | ** | + |
| PLACE4000034 | 2.6 | 1.30 | 1.44 | 3.92 | 3.82 | 4.60 | 4.01 | 3.41 | 3.41 | ** | + | * | + |
| PLACE4000049 | 10.4 | 5.48 | 5.72 | 12.83 | 16.95 | 11.80 | 9.94 | 9.10 | 9.1 | * | + | | |
| PLACE4000052 | 6.49 | 3.73 | 2.47 | 4.77 | 4.17 | 5.30 | 5.23 | 5.62 | 5.62 | | | | |
| PLACE4000062 | 6.59 | 2.48 | 4.03 | 4.7 | 5.26 | 5.48 | 4.59 | 4.62 | 4.62 | | | | |
| PLACE4000063 | 7.7 | 3.50 | 3.52 | 6.91 | 6.71 | 9.08 | 5.77 | 5.40 | 5.4 | | | | |
| PLACE4000089 | 2.96 | 1.45 | 2.33 | 5.97 | 4.11 | 5.63 | 4.54 | 4.57 | 4.57 | * | + | ** | + |
| PLACE4000093 | 2.81 | 1.09 | 0.89 | 1.95 | 1.69 | 1.17 | 2.18 | 1.71 | 1.71 | | | | |
| PLACE4000100 | 4.42 | 2.89 | 2.49 | 3.93 | 4.32 | 5.21 | 3.23 | 2.62 | 2.62 | | | | |
| PLACE4000103 | 5.02 | 1.97 | 1.98 | 3.66 | 2.71 | 3.95 | 2.81 | 2.33 | 2.33 | | | | |
| PLACE4000106 | 8.72 | 4.11 | 3.74 | 4.38 | 5.75 | 4.55 | 4.28 | 4.16 | 4.16 | | | | |
| PLACE4000128 | 7.39 | 4.68 | 3.31 | 9.85 | 9.72 | 8.43 | 7.44 | 6.38 | 6.38 | * | + | | |
| PLACE4000129 | 6.04 | 2.07 | 2.84 | 4.76 | 6.70 | 6.24 | 4.40 | 2.79 | 2.79 | | | | |
| PLACE4000131 | 8.08 | 5.12 | 4.57 | 12.93 | 9.62 | 6.75 | 8.38 | 9.08 | 9.08 | | | | |
| PLACE4000147 | 1.54 | 0.95 | 0.56 | 0.28 | 1.32 | 1.44 | 1.32 | 1.12 | 1.12 | | | | |
| PLACE4000156 | 10.36 | 6.90 | 8.62 | 23.53 | 13.89 | 24.29 | 10.09 | 14.64 | 14.64 | * | + | | |
| PLACE4000175 | 2.77 | 1.36 | 1.67 | 3 | 2.23 | 3.75 | 2.99 | 2.63 | 2.63 | | | | |
| PLACE4000190 | 25.73 | 14.17 | 16.07 | 19.71 | 16.55 | 18.77 | 20.04 | 22.67 | 22.67 | | | | |
| PLACE4000192 | 19.18 | 10.59 | 8.86 | 17.39 | 19.36 | 14.48 | 12.50 | 10.81 | 10.81 | | | | |
| PLACE4000206 | 26.35 | 11.24 | 12.17 | 18.68 | 19.88 | 13.96 | 10.44 | 9.28 | 9.28 | | | | |
| PLACE4000211 | 17.59 | 9.35 | 9.22 | 14.45 | 14.14 | 14.09 | 11.01 | 11.86 | 11.86 | | | | |
| PLACE4000214 | 3.16 | 2.15 | 2.41 | 4.6 | 3.22 | 2.93 | 3.58 | 2.23 | 2.23 | | | | |
| PLACE4000222 | 5.13 | 3.77 | 3.41 | 7.67 | 6.23 | 6.64 | 5.04 | 5.14 | 5.14 | * | + | | |
| PLACE4000223 | 5.15 | 2.40 | 3.83 | 4.77 | 3.40 | 3.75 | 4.17 | 5.28 | 5.28 | | | | |
| PLACE4000229 | 2.61 | 1.29 | 1.59 | 3.13 | 1.82 | 2.66 | 3.16 | 3.28 | 3.28 | | | * | + |
| PLACE4000230 | 10.54 | 4.47 | 5.13 | 3.92 | 4.50 | 6.23 | 2.12 | 1.74 | 1.74 | | | | |
| PLACE4000233 | 7.43 | 4.11 | 1.84 | 9.98 | 7.86 | 6.99 | 4.69 | 5.82 | 5.82 | | | | |
| PLACE4000239 | 10.37 | 3.20 | 3.64 | 8.75 | 7.61 | 7.98 | 4.24 | 5.32 | 5.32 | | | | |
| PLACE4000247 | 3.98 | 2.15 | 1.70 | 4.78 | 4.11 | 3.53 | 4.31 | 3.20 | 3.2 | | | | |
| PLACE4000250 | 6.06 | 3.58 | 4.71 | 8.33 | 8.43 | 6.31 | 5.56 | 7.08 | 7.08 | * | + | | |
| PLACE4000252 | 2.91 | 1.12 | 1.52 | 2.19 | 1.94 | 1.45 | 2.33 | 2.20 | 2.2 | | | | |
| PLACE4000259 | 8.04 | 3.19 | 7.29 | 6.61 | 5.24 | 7.03 | 5.35 | 5.02 | 5.02 | | | | |
| PLACE4000261 | 12.86 | 7.43 | 11.27 | 7.94 | 6.30 | 11.29 | 13.49 | 12.71 | 12.71 | | | | |
| PLACE4000264 | 5.07 | 2.86 | 1.88 | 6.35 | 6.52 | 5.02 | 3.87 | 4.16 | 4.16 | | | | |
| PLACE4000269 | 8.57 | 4.36 | 5.52 | 8.01 | 9.34 | 7.35 | 6.12 | 5.77 | 5.77 | | | | |
| PLACE4000270 | 3.13 | 1.82 | 0.87 | 2.42 | 1.82 | 3.08 | 1.61 | 2.16 | 2.16 | | | | |
| PLACE4000281 | 19.68 | 7.73 | 9.21 | 20.75 | 31.26 | 26.50 | 19.08 | 19.52 | 19.52 | * | + | | |
| PLACE4000300 | 6.08 | 3.69 | 2.60 | 7.08 | 6.91 | 5.29 | 4.32 | 5.19 | 5.19 | | | | |
| PLACE4000320 | 5.62 | 3.77 | 3.47 | 7.13 | 6.02 | 6.80 | 4.81 | 4.30 | 4.3 | * | + | | |
| PLACE4000323 | 8.19 | 5.61 | 3.78 | 9.71 | 7.40 | 10.97 | 6.79 | 7.01 | 7.01 | | | | |

TABLE 326-continued

| | | | | | | | | | | | | | |
|---|---|---|---|---|---|---|---|---|---|---|---|---|---|
| PLACE4000326 | 4.48 | 1.87 | 1.75 | 4.11 | 3.23 | 4.42 | 3.33 | 2.91 | 2.91 | | | | |
| PLACE4000344 | 2.79 | 2.15 | 2.50 | 2.98 | 1.69 | 2.74 | 1.96 | 2.31 | 2.31 | | | | |
| PLACE4000347 | 20.7 | 10.82 | 8.58 | 19.27 | 12.61 | 11.57 | 8.40 | 11.08 | 11.08 | | | | |
| PLACE4000354 | 4.74 | 1.02 | 1.75 | 4.04 | 3.76 | 1.42 | 1.52 | 3.10 | 3.1 | | | | |
| PLACE4000367 | 2.52 | 1.53 | 1.38 | 2.65 | 2.91 | 2.67 | 2.13 | 2.39 | 2.39 | | | | |
| PLACE4000369 | 4.83 | 2.57 | 3.31 | 5.06 | 4.32 | 4.54 | 4.37 | 5.39 | 5.39 | | | | |
| PLACE4000379 | 5.69 | 3.46 | 3.45 | 6.11 | 6.24 | 7.35 | 4.30 | 5.61 | 5.61 | * | + | | |
| PLACE4000387 | 3.69 | 1.95 | 1.27 | 2.17 | 3.32 | 3.40 | 2.28 | 3.13 | 3.13 | | | | |
| PLACE4000392 | 1.14 | 0.56 | 0.17 | 0.91 | 1.44 | 1.78 | 1.07 | 1.00 | 1 | | | | |
| PLACE4000399 | 23.89 | 17.50 | 15.29 | 24.02 | 23.23 | 28.14 | 19.33 | 22.84 | 22.84 | | | | |
| PLACE4000401 | 1.48 | 0.84 | 0.45 | 2.03 | 4.11 | 1.07 | 1.24 | 1.78 | 1.78 | | | | |
| PLACE4000403 | 9.89 | 5.20 | 5.81 | 9.29 | 8.13 | 6.25 | 5.57 | 7.91 | 7.91 | | | | |
| PLACE4000411 | 5.72 | 2.12 | 2.75 | 5.81 | 4.30 | 5.15 | 4.86 | 3.29 | 3.29 | | | | |
| PLACE4000415 | 3.21 | 2.22 | 2.69 | 3.67 | 4.43 | 3.44 | 4.57 | 6.28 | 6.28 | | | ** | + |
| PLACE4000416 | 4.63 | 3.13 | 2.08 | 5.57 | 4.05 | 4.56 | 5.50 | 4.53 | 4.53 | | | | |

TABLE 327

| | | | | | | | | | | | | | |
|---|---|---|---|---|---|---|---|---|---|---|---|---|---|
| PLACE4000424 | 3.7 | 2.41 | 1.28 | 2.89 | 2.64 | 2.63 | 4.72 | 2.93 | 2.93 | | | | |
| PLACE4000431 | 5.14 | 3.98 | 3.86 | 7.9 | 6.44 | 6.77 | 5.24 | 3.01 | 3.01 | * | + | | |
| PLACE4000443 | 1.6 | 1.50 | 0.66 | 1.7 | 2.14 | 2.19 | 1.48 | 1.16 | 1.16 | | | | |
| PLACE4000445 | 9.89 | 5.81 | 4.87 | 15.7 | 14.02 | 12.69 | 8.15 | 9.68 | 9.68 | * | + | | |
| PLACE4000450 | 15.76 | 8.51 | 6.72 | 14.02 | 10.89 | 10.04 | 11.01 | 10.50 | 10.5 | | | | |
| PLACE4000455 | 3.87 | 3.67 | 2.19 | 8.55 | 5.76 | 6.75 | 4.27 | 7.65 | 7.65 | * | + | | |
| PLACE4000465 | 6.69 | 5.73 | 3.42 | 9.19 | 8.96 | 7.57 | 6.23 | 7.71 | 7.71 | * | + | | |
| PLACE4000466 | 31.49 | 24.03 | 27.55 | 30.7 | 30.16 | 27.24 | 58.59 | 49.41 | 49.41 | | | ** | + |
| PLACE4000472 | 17.06 | 12.16 | 12.26 | 19.04 | 18.92 | 24.52 | 24.99 | 19.96 | 19.96 | * | + | * | + |
| PLACE4000487 | 2.64 | 2.43 | 1.31 | 4.42 | 5.20 | 4.15 | 123 | 3.27 | 3.27 | ** | + | | |
| PLACE4000489 | 2.69 | 2.22 | 1.81 | 2.33 | 3.71 | 4.57 | 2.92 | 1.40 | 1.4 | | | | |
| PLACE4000494 | 6.6 | 3.79 | 3.88 | 6.95 | 7.91 | 8.87 | 5.80 | 5.92 | 5.92 | * | + | | |
| PLACE4000502 | 21.16 | 12.73 | 11.94 | 19.98 | 23.69 | 17.79 | 12.36 | 16.13 | 16.13 | | | | |
| PLACE4000521 | 6.7 | 5.05 | 4.78 | 4.05 | 6.11 | 3.01 | 4.55 | 6.40 | 6.4 | | | | |
| PLACE4000522 | 4.91 | 3.07 | 3.08 | 7.26 | 9.24 | 7.69 | 9.03 | 9.77 | 9.77 | ** | + | ** | + |
| PLACE4000537 | 3.84 | 2.38 | 2.93 | 3.81 | 2.89 | 3.42 | 4.63 | 4.21 | 4.21 | | | * | + |
| PLACE4000548 | 2.58 | 1.71 | 3.60 | 3.4 | 2.67 | 4.50 | 1.35 | 2.28 | 2.28 | | | | |
| PLACE4000558 | 0.39 | 0.54 | 0.56 | 2.25 | 2.45 | 2.36 | 1.46 | 1.14 | 1.14 | ** | + | ** | + |
| PLACE4000581 | 2.73 | 1.45 | 1.75 | 4.5 | 4.93 | 4.59 | 4.11 | 3.03 | 3.03 | ** | + | | |
| PLACE4000590 | 0.99 | 1.06 | 0.15 | 1.04 | 1.17 | 1.32 | 1.13 | 0.97 | 0.97 | | | | |
| PLACE4000593 | 4.55 | 1.55 | 1.52 | 5.49 | 5.70 | 3.50 | 2.55 | 3.08 | 3.08 | | | | |
| PLACE4000612 | 14.51 | 9.28 | 7.13 | 10.09 | 12.95 | 7.67 | 9.14 | 12.79 | 12.79 | | | | |
| PLACE4000638 | 3.93 | 2.21 | 3.37 | 3.98 | 5.06 | 3.32 | 3.69 | 4.06 | 4.06 | | | | |
| PLACE4000650 | 1.03 | 1.91 | 1.53 | 2.69 | 2.70 | 2.58 | 3.71 | 1.90 | 1.9 | * | + | | |
| PLACE4000651 | 8.37 | 7.37 | 5.41 | 16.13 | 16.91 | 20.29 | 11.75 | 11.67 | 11.67 | ** | + | ** | + |
| PLACE4000654 | 0.46 | 0.63 | 0.26 | 1.79 | 1.98 | 0.98 | 1.21 | 0.58 | 0.58 | * | + | | |
| PLACE4000670 | 1.04 | 0.70 | 1.13 | 2.04 | 2.89 | 1.47 | 0.74 | 0.43 | 0.43 | | | | |
| PLACE4000685 | 23.26 | 12.16 | 10.49 | 28.55 | 27.61 | 40.89 | 20.42 | 24.20 | 24.2 | * | + | | |
| PLACE4000687 | 0.45 | 0.07 | 0.48 | 0.48 | 0.65 | 1.00 | 0.21 | 0.78 | 0.78 | | | | |
| PLACE5000003 | 2.7 | 1.36 | 1.81 | 2.51 | 2.87 | 2.69 | 2.63 | 1.48 | 1.48 | | | | |
| PLACE5000005 | 2.1 | 1.91 | 0.92 | 1.98 | 1.29 | 2.16 | 2.69 | 3.30 | 3.3 | | | * | + |
| PLACE5000019 | 1.64 | 0.35 | 0.54 | 1.85 | 0.86 | 1.29 | 2.04 | 1.56 | 1.56 | | | | |
| PLACE5000021 | 0.69 | 0.31 | 0.38 | 1.1 | 1.33 | 1.32 | 0.87 | 0.51 | 0.51 | ** | + | | |
| PLACE5000022 | 1.43 | 2.14 | 1.68 | 2.67 | 2.14 | 2.05 | 1.88 | 2.93 | 2.93 | | | | |
| PLACE5000024 | 4.4 | 3.23 | 1.21 | 2.46 | 4.37 | 2.88 | 2.51 | 2.40 | 2.4 | | | | |
| PLACE5000036 | 3.16 | 1.92 | 0.93 | 2.51 | 3.73 | 2.77 | 1.58 | 2.61 | 2.61 | | | | |
| PLACE5000059 | 21.39 | 11.50 | 13.49 | 18.98 | 12.58 | 17.80 | 15.52 | 22.91 | 22.91 | | | | |
| PLACE5000076 | 1.04 | 0.14 | 0.59 | 0.44 | 1.09 | 3.27 | 1.13 | 0.58 | 0.58 | | | | |
| PLACE5000117 | 6.61 | 3.04 | 3.55 | 6.57 | 7.00 | 6.53 | 6.39 | 6.85 | 6.85 | | | | |
| PLACE5000143 | 6.9 | 3.66 | 5.74 | 7.55 | 3.91 | 6.50 | 6.13 | 5.78 | 5.78 | | | | |
| PLACE5000152 | 1.01 | 0.83 | 0.51 | 1.68 | 1.63 | 1.58 | 1.45 | 0.95 | 0.95 | ** | + | | |
| PLACE5000154 | 2.82 | 2.00 | 1.84 | 2.88 | 1.96 | 2.91 | 1.39 | 2.76 | 2.76 | | | | |
| PLACE5000155 | 24.77 | 17.51 | 14.25 | 20.28 | 21.63 | 23.82 | 15.99 | 20.71 | 20.71 | | | | |
| PLACE5000165 | 32.82 | 17.87 | 18.74 | 27.66 | 24.93 | 25.31 | 22.84 | 22.29 | 22.39 | | | | |
| SKNMC1000004 | 6.53 | 6.43 | 3.51 | 11.48 | 11.51 | 13.01 | 5.92 | 10.64 | 10.64 | ** | + | | |
| SKNMC1000011 | 4.21 | 2.51 | 3.08 | 4.72 | 4.77 | 4.26 | 3.98 | 2.83 | 2.83 | | | | |
| SKNMC1000013 | 2.14 | 1.08 | 1.20 | 1.57 | 0.87 | 2.15 | 1.79 | 2.08 | 2.08 | | | | |
| SKNMC1000014 | 2.76 | 2.14 | 1.24 | 4.71 | 2.24 | 4.37 | 3.92 | 1.88 | 1.88 | | | | |
| SKNMC1000018 | 3.3 | 2.08 | 1.94 | 2.72 | 3.17 | 4.77 | 4.12 | 2.92 | 2.92 | | | | |
| SKNMC1000020 | 4.56 | 2.73 | 1.89 | 3.66 | 1.77 | 4.25 | 2.81 | 2.80 | 2.8 | | | | |
| SKNMC1000046 | 2.2 | 1.75 | 1.00 | 2.53 | 2.58 | 2.02 | 1.58 | 2.04 | 2.04 | | | | |
| SKNMC1000050 | 2.33 | 0.87 | 1.04 | 1.57 | 3.28 | 2.53 | 3.94 | 4.06 | 4.06 | | | ** | + |
| SKNMC1000062 | 23.15 | 15.32 | 13.39 | 21.75 | 19.79 | 22.30 | 21.79 | 25.10 | 25.1 | | | | |
| SKNMC1000075 | 3.21 | 1.19 | 1.16 | 1.75 | 2.09 | 2.04 | 1.59 | 1.71 | 1.71 | | | | |
| SKNMC1000082 | 5.24 | 2.03 | 1.78 | 3.5 | 2.07 | 2.24 | 2.55 | 1.68 | 1.68 | | | | |
| SKNMC1000091 | 10.17 | 5.98 | 5.10 | 6.85 | 6.21 | 8.67 | 4.99 | 6.41 | 6.41 | | | | |

TABLE 328

| | | | | | | | | | | | | | |
|---|---|---|---|---|---|---|---|---|---|---|---|---|---|
| SKNMC1000099 | 4.27 | 1.82 | 4.32 | 2.68 | 2.85 | 4.25 | 4.90 | 2.31 | 2.31 | | | | |
| SKNMC1000104 | 2.88 | 1.34 | 1.64 | 2.26 | 2.75 | 3.25 | 1.82 | 2.06 | 2.06 | | | | |
| SKNMC1000113 | 2.91 | 1.98 | 1.70 | 2.53 | 3.12 | 2.50 | 2.17 | 2.08 | 2.08 | | | | |
| SKNMC1000119 | 4.61 | 2.84 | 2.09 | 3.6 | 4.44 | 4.19 | 3.90 | 3.35 | 3.35 | | | | |
| SKNMC1000142 | 2.86 | 0.96 | 0.73 | 2.73 | 1.96 | 2.31 | 2.39 | 2.51 | 2.51 | | | | |
| SKNMC1000170 | 4.02 | 1.58 | 1.54 | 3.23 | 3.13 | 3.75 | 2.53 | 3.66 | 3.66 | | | | |
| SKNMC1000178 | 5.92 | 3.14 | 3.92 | 5.65 | 4.47 | 6.23 | 4.68 | 4.57 | 4.57 | | | | |
| SKNMC1000194 | 3.57 | 2.37 | 1.14 | 2.02 | 1.84 | 1.46 | 1.82 | 1.68 | 1.68 | | | | |
| SKNMC1000198 | 4.86 | 3.19 | 3.66 | 3.95 | 2.35 | 5.30 | 3.50 | 3.61 | 3.61 | | | | |
| SKNMC1000225 | 3.86 | 1.48 | 1.25 | 3.04 | 2.83 | 3.41 | 1.69 | 1.50 | 1.5 | | | | |
| SKNMC1000249 | 2.6 | 1.16 | 0.14 | 2.11 | 0.98 | 1.05 | 0.97 | 1.03 | 1.03 | | | | |
| SPLEN1000007 | 3.1 | 1.45 | 1.01 | 2.61 | 2.77 | 3.19 | 1.50 | 2.71 | 2.71 | | | | |
| SPLEN1000012 | 4.58 | 1.70 | 1.35 | 3.53 | 2.59 | 2.41 | 3.41 | 4.25 | 4.25 | | | | |
| SPLEN1000014 | 6.11 | 2.53 | 3.00 | 5.55 | 7.51 | 4.48 | 3.02 | 3.02 | 3.02 | | | | |
| SPLEN1000036 | 2.67 | 1.59 | 1.60 | 2.81 | 3.21 | 2.90 | 3.30 | 2.69 | 2.69 | | | | |
| SPLEN1000059 | 0.04 | 0.28 | 0.35 | 0.37 | 0.20 | 0.93 | 0.51 | 0.65 | 0.65 | | | * | + |
| SPLEN1000068 | 2.47 | 1.01 | 1.48 | 3.14 | 3.20 | 4.62 | 4.16 | 2.46 | 2.46 | * | + | | |
| SPLEN1000072 | 3.94 | 2.95 | 2.34 | 4.26 | 4.36 | 3.28 | 3.61 | 3.41 | 3.41 | | | | |
| SPLEN1000101 | 41.57 | 16.82 | 24.85 | 23.9 | 21.81 | 9.24 | 15.06 | 12.84 | 12.84 | | | | |
| SPLEN1000108 | 3.06 | 1.50 | 1.01 | 2.01 | 2.01 | 1.31 | 1.57 | 2.16 | 2.16 | | | | |
| SPLEN1000113 | 4.35 | 2.46 | 2.67 | 4.83 | 2.55 | 2.28 | 3.11 | 3.66 | 3.66 | | | | |
| SPLEN1000114 | 2.42 | 2.37 | 1.43 | 3.43 | 2.78 | 2.56 | 2.74 | 3.97 | 3.97 | | | * | + |
| SPLEN1000132 | 4.91 | 2.27 | 3.07 | 3.65 | 2.33 | 4.08 | 4.07 | 4.65 | 4.65 | | | | |
| SPLEN1000135 | 4.83 | 1.59 | 3.15 | 4.45 | 2.38 | 2.83 | 5.59 | 5.94 | 5.94 | | | * | + |
| SPLEN1000136 | 4.48 | 3.01 | 2.79 | 7.59 | 5.71 | 8.15 | 9.03 | 12.90 | 12.9 | * | + | ** | + |
| SPLEN1000141 | 2.18 | 1.15 | 1.72 | 2.22 | 2.60 | 2.27 | 2.35 | 1.59 | 1.59 | | | | |
| SPLEN1000164 | 4.46 | 1.47 | 1.76 | 5.13 | 4.33 | 4.86 | 3.29 | 5.58 | 5.58 | | | | |
| SPLEN1000166 | 2.49 | 0.67 | 1.05 | 2.36 | 3.89 | 2.42 | 2.08 | 3.68 | 3.68 | | | | |
| SPLEN1000175 | 5.45 | 3.05 | 4.54 | 4.81 | 4.46 | 4.23 | 3.32 | 5.47 | 5.47 | | | | |
| SPLEN1000182 | 2.6 | 0.65 | 0.61 | 1.52 | 1.41 | 2.22 | 1.31 | 1.69 | 1.69 | | | | |
| SPLEN1000185 | 3.66 | 1.87 | 1.77 | 5.3 | 4.71 | 4.35 | 5.29 | 7.02 | 7.02 | * | + | ** | + |
| THYMU1000004 | 14.86 | 7.77 | 9.02 | 24.57 | 18.18 | 21.23 | 10.89 | 18.76 | 18.76 | * | + | | |
| THYMU1000009 | 8.45 | 5.32 | 5.87 | 7.04 | 5.33 | 4.60 | 6.32 | 5.23 | 5.23 | | | | |
| THYMU1000015 | 26.6 | 19.78 | 21.97 | 16.29 | 13.38 | 16.01 | 9.72 | 8.42 | 8.42 | * | − | ** | − |
| THYMU1000016 | 8.26 | 4.04 | 3.89 | 15.26 | 18.83 | 11.55 | 9.39 | 7.02 | 7.02 | * | + | | |
| THYMU1000023 | 3.89 | 1.34 | 1.23 | 2.77 | 2.08 | 3.06 | 2.39 | 2.39 | 2.39 | | | | |
| THYMU1000034 | 2.61 | 1.47 | 0.66 | 2.74 | 1.63 | 1.39 | 1.31 | 3.64 | 3.64 | | | | |
| THYMU1000035 | 1.07 | 0.61 | 0.61 | 0.44 | 0.64 | 0.76 | 1.85 | 2.01 | 2.01 | | | ** | + |
| THYMU1000037 | 1.82 | 1.82 | 1.19 | 2.22 | 2.35 | 0.98 | 2.22 | 2.11 | 2.11 | | | | |
| THYMU1000042 | 10.49 | 6.31 | 8.55 | 6.35 | 4.98 | 6.18 | 8.88 | 5.36 | 5.36 | | | | |
| THYMU1000047 | 4.11 | 2.46 | 3.11 | 10.3 | 9.57 | 11.11 | 4.74 | 4.37 | 4.74 | ** | + | * | + |
| THYMU1000080 | 3.32 | 3.11 | 1.09 | 3.11 | 4.52 | 4.74 | 2.28 | 1.83 | 1.83 | | | | |
| THYMU1000094 | 32.63 | 25.01 | 18.12 | 54.59 | 42.21 | 15.66 | 23.80 | 19.03 | 19.03 | | | | |
| THYMU1000109 | 8.44 | 4.34 | 3.79 | 6.74 | 8.15 | 5.93 | 7.23 | 6.42 | 6.42 | | | | |
| THYMU1000127 | 6.78 | 3.40 | 3.18 | 8.92 | 8.62 | 7.88 | 6.2 | 6.83 | 6.83 | * | + | | |
| THYMU1000130 | 4.13 | 1.20 | 1.02 | 4.32 | 4.36 | 3.32 | 2.41 | 3.21 | 3.21 | | | | |
| THYMU1000137 | 4.62 | 2.65 | 2.71 | 3.35 | 5.77 | 3.60 | 4.29 | 4.56 | 4.56 | | | | |
| THYMU1000146 | 4.71 | 3.58 | 4.49 | 7.3 | 4.71 | 6.30 | 5.63 | 4.56 | 4.56 | | | | |
| THYMU1000159 | 26.83 | 22.19 | 24.81 | 10.37 | 8.83 | 13.56 | 14.02 | 11.77 | 11.77 | ** | − | ** | − |
| THYMU1000163 | 6.99 | 6.16 | 7.74 | 9.39 | 10.76 | 10.43 | 5.92 | 8.13 | 8.13 | ** | + | | |
| THYMU1000167 | 2.34 | 1.29 | 1.70 | 2.93 | 3.51 | 2.43 | 1.71 | 1.52 | 1.52 | | | | |
| THYMU1000186 | 5.07 | 2.17 | 2.10 | 3.12 | 3.14 | 2.53 | 2.77 | 2.94 | 2.94 | | | | |
| THYRO1000017 | 5.52 | 2.12 | 2.08 | 4.91 | 6.19 | 6.15 | 4.38 | 3.34 | 3.34 | | | | |
| THYRO1000026 | 3.58 | 2.32 | 1.61 | 2.83 | 7.78 | 2.86 | 6.59 | 2.67 | 2.67 | | | | |
| THYRO1000034 | 3.17 | 3.08 | 1.76 | 3.93 | 4.73 | 4.25 | 3.60 | 4.07 | 4.07 | * | + | | |
| THYRO1000035 | 1.48 | 0.66 | 0.72 | 1.53 | 1.40 | 2.82 | 0.67 | 2.32 | 2.32 | | | | |

TABLE 329

| | | | | | | | | | | | | | |
|---|---|---|---|---|---|---|---|---|---|---|---|---|---|
| THYRO1000036 | 1.47 | 2.88 | 1.52 | 4.59 | 3.60 | 4.55 | 3.37 | 2.09 | 2.09 | * | + | | |
| THYRO1000040 | 3.94 | 3.60 | 4.34 | 8.08 | 4.14 | 6.42 | 4.83 | 5.15 | 5.15 | | | * | + |
| THYRO1000061 | 5.94 | 3.66 | 2.97 | 4.84 | 6.31 | 5.19 | 4.68 | 3.52 | 3.52 | | | | |
| THYRO1000067 | 15.2 | 9.77 | 9.78 | 10.78 | 13.27 | 13.10 | 11.70 | 12.59 | 12.59 | | | | |
| THYRO1000070 | 6 | 3.76 | 5.68 | 6.21 | 9.32 | 7.75 | 5.41 | 6.34 | 6.34 | | | | |
| THYRO1000072 | 2.94 | 1.82 | 1.84 | 5.83 | 8.39 | 3.32 | 2.14 | 2.54 | 2.54 | | | | |
| THYRO1000084 | 4.5 | 1.85 | 2.58 | 3.76 | 4.67 | 3.19 | 3.46 | 2.16 | 2.16 | | | | |
| THYRO1000085 | 10.88 | 13.54 | 13.23 | 14.79 | 17.02 | 16.91 | 12.99 | 15.14 | 15.14 | * | + | | |
| THYRO1000086 | 0.12 | 1.27 | 1.00 | 1.39 | 0.92 | 1.37 | 0.61 | 1.10 | 1.1 | | | | |
| THYRO1000087 | 0.56 | 0.67 | 0.91 | 1.37 | 1.09 | 0.98 | 1.47 | 0.51 | 0.51 | * | + | | |
| THYRO1000092 | 6 | 2.56 | 1.98 | 8.27 | 6.56 | 7.42 | 3.48 | 3.45 | 3.45 | * | + | | |
| THYRO1000093 | 1.44 | 1.12 | 0.93 | 2.32 | 0.88 | 2.13 | 1.21 | 1.43 | 1.43 | | | | |
| THYRO1000099 | 5.17 | 1.21 | 1.50 | 4.31 | 3.36 | 5.55 | 2.12 | 3.30 | 3.3 | | | | |
| THYRO1000107 | 2.2 | 0.53 | 1.13 | 2.82 | 7.80 | 4.79 | 2.15 | 2.47 | 2.47 | | | | |
| THYRO1000111 | 1.83 | 0.33 | 0.78 | 2.31 | 3.19 | 3.86 | 1.66 | 1.58 | 1.58 | * | + | | |
| THYRO1000121 | 3.44 | 1.10 | 1.03 | 3.02 | 3.40 | 6.52 | 2.38 | 1.76 | 1.76 | | | | |
| THYRO1000124 | 2.37 | 0.51 | 0.78 | 3.06 | 2.51 | 2.25 | 0.89 | 1.60 | 1.6 | | | | |

TABLE 329-continued

| | | | | | | | | | | | | | |
|---|---|---|---|---|---|---|---|---|---|---|---|---|---|
| THYRO1000129 | 1.3 | 0.82 | 0.51 | 1.26 | 1.52 | 1.53 | 0.49 | 1.02 | 1.02 | | | | |
| THYRO1000130 | 3.62 | 2.11 | 2.49 | 5.24 | 10.43 | 5.75 | 7.64 | 2.92 | 2.92 | | | | |
| THYRO1000132 | 8.41 | 1.76 | 1.74 | 4.45 | 6.81 | 7.03 | 2.87 | 3.11 | 3.11 | | | | |
| THYRO1000134 | 3.55 | 1.81 | 2.95 | 6.64 | 4.07 | 4.40 | 3.58 | 4.01 | 4.01 | | | | |
| THYRO1000144 | 13.82 | 5.38 | 3.94 | 8.01 | 7.60 | 7.93 | 4.07 | 4.00 | 4 | | | | |
| THYRO1000155 | 2.5 | 0.51 | 0.58 | 1.49 | 1.11 | 0.97 | 0.55 | 1.08 | 1.08 | | | | |
| THYRO1000156 | 1.89 | 1.44 | 0.82 | 2.61 | 2.67 | 3.19 | 1.97 | 1.97 | 1.97 | * | + | | |
| THYRO1000163 | 3.98 | 1.47 | 3.15 | 9.1 | 7.23 | 11.51 | 7.86 | 4.19 | 4.19 | * | + | | |
| THYRO1000173 | 2.9 | 2.72 | 1.68 | 4.44 | 4.27 | 4.08 | 1.67 | 3.61 | 3.61 | ** | + | | |
| THYRO1000186 | 9.1 | 5.19 | 4.20 | 10.2 | 15.51 | 9.61 | 7.74 | 7.44 | 7.44 | | | | |
| THYRO1000187 | 5.63 | 2.01 | 3.20 | 6.21 | 7.01 | 6.32 | 5.05 | 3.18 | 3.18 | | | | |
| THYRO1000190 | 2.89 | 1.46 | 2.17 | 5.4 | 4.76 | 5.31 | 4.40 | 2.66 | 2.66 | ** | + | | |
| THYRO1000196 | 0.92 | 0.80 | 1.33 | 2.19 | 1.72 | 1.35 | 0.94 | 1.18 | 1.18 | | | | |
| THYRO1000197 | 3.18 | 2.33 | 2.51 | 5.88 | 3.71 | 6.16 | 4.77 | 4.51 | 4.51 | * | + | ** | + |
| THYRO1000199 | 3.03 | 1.48 | 1.85 | 2.3 | 1.87 | 3.05 | 2.39 | 2.56 | 2.56 | | | | |
| THYRO1000206 | 14.52 | 5.55 | 4.65 | 11.65 | 9.64 | 12.12 | 5.64 | 6.11 | 6.11 | | | | |
| THYRO1000221 | 5.01 | 1.90 | 2.05 | 5.6 | 6.77 | 7.34 | 2.67 | 3.86 | 3.86 | * | + | | |
| THYRO1000222 | 7.73 | 2.24 | 1.94 | 3.18 | 4.68 | 4.24 | 4.78 | 2.83 | 2.83 | | | | |
| THYRO1000228 | 1.72 | 0.91 | 0.91 | 5.64 | 4.49 | 4.50 | 3.42 | 4.40 | 4.4 | ** | + | ** | + |
| THYRO1000241 | 3.26 | 1.56 | 2.99 | 5.29 | 5.78 | 7.35 | 4.01 | 4.55 | 4.55 | * | + | * | + |
| THYRO1000242 | 6.01 | 2.48 | 2.81 | 8.74 | 10.47 | 5.58 | 3.38 | 6.54 | 6.54 | | | | |
| THYRO1000246 | 2.49 | 0.94 | 1.13 | 2.44 | 2.95 | 2.72 | 4.13 | 4.49 | 4.49 | | | ** | + |
| THYRO1000253 | 3.03 | 2.39 | 2.12 | 4 | 3.56 | 6.64 | 2.35 | 3.27 | 3.27 | | | | |
| THYRO1000270 | 0.85 | 0.93 | 0.64 | 2.95 | 1.36 | 0.98 | 0.55 | 0.45 | 0.45 | | | * | − |
| THYRO1000279 | 2.19 | 0.22 | 0.27 | 0.43 | 1.67 | 1.01 | 0.46 | 0.46 | 0.46 | | | | |
| THYRO1000285 | 6.19 | 3.69 | 1.88 | 4.45 | 4.41 | 6.07 | 8.92 | 4.83 | 4.83 | | | | |
| THYRO1000288 | 7.58 | 2.67 | 2.64 | 4.38 | 5.78 | 3.82 | 4.63 | 6.75 | 6.75 | | | | |
| THYRO1000296 | 3.95 | 2.07 | 1.83 | 3.07 | 4.49 | 3.23 | 3.68 | 3.54 | 3.54 | | | | |
| THYRO1000320 | 4.13 | 0.95 | 0.96 | 3.75 | 3.95 | 6.99 | 3.33 | 5.20 | 5.2 | | | | |
| THYRO1000322 | 38.05 | 21.86 | 30.50 | 21.36 | 20.13 | 23.75 | 18.89 | 19.42 | 19.42 | | | | |
| THYRO1000327 | 1.02 | 0.47 | 0.74 | 3.44 | 1.87 | 3.51 | 2.40 | 2.03 | 2.03 | * | + | ** | + |
| THYRO1000343 | 3.18 | 0.96 | 1.50 | 2.27 | 1.34 | 2.27 | 1.96 | 1.19 | 1.19 | | | | |
| THYRO1000345 | 4.6 | 2.12 | 2.05 | 3.98 | 5.40 | 3.79 | 1.33 | 1.91 | 1.91 | | | | |
| THYRO1000358 | 7.71 | 5.28 | 3.61 | 7.26 | 4.42 | 4.45 | 5.44 | 7.71 | 7.71 | | | | |
| THYRO1000368 | 11.25 | 3.81 | 3.69 | 7.91 | 6.70 | 6.11 | 5.37 | 4.82 | 4.82 | | | | |
| THYRO1000375 | 6.52 | 5.33 | 3.32 | 11.74 | 11.72 | 9.07 | 7.23 | 13.34 | 13.34 | * | + | * | + |
| THYRO1000381 | 1.08 | 0.73 | 0.85 | 2.03 | 1.76 | 1.73 | 1.91 | 1.07 | 1.07 | ** | + | | |
| THYRO1000387 | 2.85 | 2.46 | 2.45 | 4.41 | 4.58 | 5.18 | 3.81 | 2.92 | 2.92 | ** | + | | |
| THYRO1000394 | 3.11 | 2.36 | 2.61 | 4.86 | 4.51 | 5.33 | 6.21 | 6.15 | 6.15 | ** | + | ** | + |

TABLE 330

| | | | | | | | | | | | | | |
|---|---|---|---|---|---|---|---|---|---|---|---|---|---|
| THYRO1000395 | 4.25 | 2.93 | 1.91 | 4.03 | 3.11 | 3.93 | 4.17 | 2.18 | 2.18 | | | | |
| THYRO1000400 | 4.41 | 1.20 | 1.12 | 2.44 | 2.11 | 3.30 | 1.51 | 2.67 | 2.67 | | | | |
| THYRO1000401 | 5.78 | 2.72 | 2.22 | 4.86 | 5.69 | 4.69 | 3.46 | 3.98 | 3.98 | | | | |
| THYRO1000407 | 2.85 | 1.30 | 0.87 | 2.33 | 1.72 | 1.87 | 2.55 | 3.06 | 3.06 | | | | |
| THYRO1000420 | 6.84 | 3.72 | 3.92 | 6.3 | 4.99 | 6.57 | 4.27 | 4.92 | 4.92 | | | | |
| THYRO1000438 | 3.47 | 2.61 | 5.10 | 3.55 | 4.73 | 5.14 | 3.74 | 2.32 | 2.32 | | | | |
| THYRO1000452 | 3.79 | 2.27 | 3.32 | 4.32 | 3.39 | 3.80 | 3.50 | 2.68 | 2.68 | | | | |
| THYRO1000455 | 0.86 | 0.19 | 0.08 | 0.98 | 0.97 | 1.02 | 0.43 | 0.69 | 0.69 | | | | |
| THYRO1000471 | 3.13 | 0.99 | 1.71 | 4.82 | 2.11 | 3.45 | 2.03 | 2.21 | 2.21 | | | | |
| THYRO1000481 | 3.05 | 2.09 | 1.78 | 2.49 | 2.59 | 3.24 | 2.75 | 3.65 | 3.65 | | | | |
| THYRO1000484 | 7.3 | 2.87 | 2.29 | 10.67 | 15.51 | 6.38 | 4.46 | 3.81 | 3.81 | | | | |
| THYRO1000488 | 1.1 | 0.92 | 1.15 | 1.45 | 1.81 | 1.35 | 2.24 | 2.38 | 2.38 | * | + | ** | + |
| THYRO1000501 | 2.42 | 1.63 | 1.50 | 2.59 | 2.38 | 2.19 | 2.25 | 3.01 | 3.01 | | | * | + |
| THYRO1000502 | 1.72 | 1.26 | 1.14 | 1.06 | 1.74 | 2.09 | 1.25 | 1.88 | 1.88 | | | | |
| THYRO1000505 | 1.86 | 1.15 | 0.80 | 1 | 1.66 | 1.13 | 1.93 | 1.49 | 1.49 | | | | |
| THYRO1000535 | 3.34 | 1.94 | 2.04 | 4.99 | 3.71 | 3.63 | 10.07 | 9.11 | 9.11 | | | ** | + |
| THYRO1000556 | 3.48 | 3.02 | 2.08 | 3.02 | 2.21 | 3.79 | 3.38 | 3.27 | 3.27 | | | | |
| THYRO1000558 | 2.31 | 1.23 | 1.10 | 1.93 | 1.95 | 2.49 | 2.30 | 1.39 | 1.39 | | | | |
| THYRO1000569 | 37.42 | 23.06 | 26.88 | 28.52 | 31.17 | 30.05 | 27.41 | 43.25 | 43.25 | | | | |
| THYRO1000570 | 3.86 | 2.04 | 1.70 | 2.58 | 2.40 | 4.33 | 2.86 | 3.78 | 3.78 | | | | |
| THYRO1000572 | 2.15 | 0.94 | 1.24 | 2.2 | 1.78 | 1.73 | 2.48 | 3.26 | 3.26 | | | * | + |
| THYRO1000573 | 2.15 | 0.40 | 1.11 | 1.23 | 2.42 | 1.75 | 1.79 | 2.04 | 2.04 | | | | |
| THYRO1000577 | 1.28 | 1.14 | 0.64 | 1.15 | 1.13 | 1.55 | 1.85 | 1.41 | 1.41 | | | | |
| THYRO1000580 | 5.42 | 3.17 | 3.10 | 6.46 | 6.34 | 9.14 | 4.00 | 4.26 | 4.26 | * | + | | |
| THYRO1000584 | 2.72 | 2.07 | 1.38 | 2.78 | 3.98 | 3.94 | 2.67 | 3.22 | 3.22 | | | | |
| THYRO1000585 | 2.25 | 1.51 | 1.61 | 5.52 | 5.02 | 4.69 | 3.92 | 4.40 | 4.4 | ** | + | ** | + |
| THYRO1000596 | 0.84 | 0.25 | 0.33 | 0.85 | 1.98 | 1.44 | 1.19 | 1.17 | 1.17 | | | * | + |
| THYRO1000602 | 5.45 | 3.58 | 2.07 | 8.38 | 7.15 | 5.61 | 4.80 | 5.98 | 5.98 | | | | |
| THYRO1000605 | 3.06 | 1.73 | 1.76 | 2.38 | 1.83 | 1.39 | 2.18 | 2.05 | 2.05 | | | | |
| THYRO1000615 | 1.88 | 0.80 | 0.63 | 1.19 | 1.72 | 1.17 | 1.04 | 2.25 | 2.25 | | | | |
| THYRO1000625 | 3.03 | 2.54 | 1.58 | 4.59 | 3.95 | 5.93 | 3.48 | 4.60 | 4.6 | * | + | * | + |
| THYRO1000636 | 2.66 | 2.57 | 2.75 | 6.51 | 3.94 | 8.33 | 4.69 | 4.10 | 4.1 | * | + | ** | + |
| THYRO1000637 | 1.23 | 0.82 | 0.65 | 1.88 | 1.42 | 1.92 | 2.10 | 1.39 | 1.39 | * | + | | |
| THYRO1000641 | 1.4 | 0.60 | 1.08 | 0.89 | 1.31 | 1.56 | 1.11 | 0.84 | 0.84 | | | | |

TABLE 330-continued

| | | | | | | | | | | | | |
|---|---|---|---|---|---|---|---|---|---|---|---|---|
| THYRO1000657 | 3.65 | 3.07 | 3.41 | 3.91 | 3.79 | 3.12 | 1.96 | 2.62 | 2.62 | | * | − |
| THYRO1000658 | 7.81 | 3.42 | 3.03 | 11.25 | 11.55 | 11.93 | 5.08 | 5.90 | 5.9 | * | + | |
| THYRO1000662 | 2.88 | 1.16 | 0.83 | 2.17 | 1.76 | 1.90 | 1.97 | 1.81 | 1.81 | | | |
| THYRO1000666 | 2.42 | 0.88 | 1.16 | 3.25 | 2.79 | 4.33 | 1.98 | 2.43 | 2.43 | * | + | |
| THYRO1000676 | 2.32 | 1.10 | 0.52 | 2.88 | 3.21 | 3.68 | 3.68 | 2.15 | 2.15 | * | + | |
| THYRO1000678 | −0.09 | 0.33 | 0.95 | 0.54 | 0.74 | 1.28 | 1.19 | 2.92 | 2.92 | | * | + |
| THYRO1000684 | 1.03 | 2.45 | 1.63 | 3.34 | 3.15 | 3.52 | 4.80 | 2.39 | 2.39 | * | + | |
| THYRO1000694 | 2.71 | 3.51 | 4.23 | 5.53 | 5.34 | 4.52 | 4.35 | 3.80 | 3.8 | * | + | |
| THYRO1000699 | 15.82 | 15.18 | 11.44 | 15.15 | 15.90 | 16.09 | 15.44 | 10.86 | 10.86 | | | |
| THYRO1000712 | 3.39 | 2.96 | 2.14 | 8.58 | 5.42 | 7.84 | 3.11 | 4.20 | 4.2 | * | + | |
| THYRO1000715 | 4.02 | 2.34 | 2.31 | 2.86 | 4.26 | 2.85 | 3.39 | 2.68 | 2.68 | | | |
| THYRO1000716 | 2.32 | 0.65 | 1.04 | 2.97 | 4.44 | 2.89 | 2.03 | 1.56 | 1.56 | * | + | |
| THYRO1000717 | 2.15 | 0.84 | 1.30 | 4.23 | 5.94 | 4.84 | 1.47 | 3.93 | 3.93 | ** | + | |
| THYRO1000723 | 0.84 | 0.47 | 0.25 | 0.76 | 1.49 | 1.41 | 0.88 | 0.44 | 0.44 | | | |
| THYRO1000734 | 0.78 | 0.54 | 0.33 | 1.36 | 1.43 | 0.84 | 0.50 | 0.83 | 0.83 | * | + | |
| THYRO1000748 | 0.59 | 2.46 | 1.89 | 4.51 | 7.18 | 3.35 | 2.76 | 2.25 | 2.25 | | | |
| THYRO1000755 | 6.84 | 4.25 | 3.30 | 14.94 | 19.03 | 9.44 | 6.39 | 7.81 | 7.81 | * | + | |
| THYRO1000756 | 3.41 | 1.39 | 1.44 | 2.12 | 2.71 | 3.18 | 1.98 | 2.77 | 2.77 | | | |
| THYRO1000776 | 1.32 | 1.08 | 1.00 | 2.41 | 2.21 | 1.88 | 2.52 | 1.74 | 1.74 | ** | + | * | + |
| THYRO1000777 | 2.84 | 1.43 | 1.39 | 4.03 | 2.36 | 3.89 | 2.12 | 2.28 | 2.28 | | | |
| THYRO1000779 | 0.67 | 0.56 | 0.16 | 1.05 | 0.79 | 0.60 | 0.44 | 0.25 | 0.25 | | | |
| THYRO1000782 | 3.17 | 1.32 | 2.40 | 4.64 | 3.68 | 4.39 | 4.70 | 5.63 | 5.63 | * | + | ** | + |

TABLE 331

| | | | | | | | | | | | | |
|---|---|---|---|---|---|---|---|---|---|---|---|---|
| THYRO1000783 | 1.63 | 0.89 | 1.30 | 3.1 | 2.26 | 1.53 | 1.80 | 1.30 | 1.3 | | | |
| THYRO1000786 | 4.89 | 2.61 | 2.30 | 6.28 | 3.05 | 5.87 | 4.15 | 4.10 | 4.1 | | | |
| THYRO1000787 | 10.6 | 5.80 | 4.42 | 7.07 | 6.40 | 5.00 | 7.52 | 6.30 | 6.3 | | | |
| THYRO1000792 | 6.58 | 1.87 | 1.67 | 2.34 | 3.23 | 1.91 | 2.22 | 2.34 | 2.34 | | | |
| THYRO1000793 | 2.04 | 0.81 | 0.90 | 2.24 | 3.46 | 2.95 | 1.63 | 1.90 | 1.9 | * | + | |
| THYRO1000795 | 2.76 | 1.16 | 1.46 | 2.99 | 2.52 | 3.49 | 2.58 | 3.17 | 3.17 | | | |
| THYRO1000796 | 2.38 | 0.64 | 1.44 | 4.8 | 3.84 | 4.16 | 2.52 | 2.59 | 2.59 | ** | + | |
| THYRO1000798 | 3.16 | 1.83 | 2.57 | 4.6 | 3.74 | 3.94 | 2.76 | 3.06 | 3.06 | * | + | |
| THYRO1000800 | 7.44 | 4.89 | 4.90 | 15.05 | 11.25 | 16.69 | 6.56 | 6.96 | 6.96 | ** | + | |
| THYRO1000805 | 0.7 | 1.04 | 0.84 | 1.39 | 1.41 | 1.19 | 1.16 | 1.27 | 1.27 | * | + | * | + |
| THYRO1000815 | 7 | 4.02 | 3.01 | 10.69 | 12.71 | 10.92 | 7.46 | 5.49 | 5.49 | ** | + | |
| THYRO1000829 | 4.85 | 1.50 | 0.99 | 3.49 | 4.27 | 2.08 | 2.62 | 2.36 | 2.36 | | | |
| THYRO1000835 | 2.11 | 1.21 | 1.15 | 2.86 | 3.23 | 3.63 | 4.32 | 4.32 | 4.32 | * | + | * | + |
| THYRO1000843 | 5.05 | 2.38 | 2.97 | 4.77 | 5.02 | 6.46 | 4.36 | 3.37 | 3.37 | | | |
| THYRO1000846 | 2.51 | 1.06 | 0.98 | 2.34 | 1.74 | 1.56 | 2.17 | 1.43 | 1.43 | | | |
| THYRO1000852 | 2.42 | 0.77 | 2.13 | 2.03 | 1.40 | 2.69 | 3.08 | 3.10 | 3.1 | | | |
| THYRO1000855 | 4.5 | 4.43 | 3.85 | 5.88 | 4.56 | 7.12 | 5.76 | 3.18 | 3.18 | | | |
| THYRO1000865 | 3.16 | 2.10 | 3.34 | 4.86 | 6.09 | 6.43 | 5.14 | 2.65 | 2.65 | ** | + | |
| THYRO1000866 | 11.62 | 9.40 | 6.30 | 9.67 | 9.65 | 5.08 | 11.39 | 9.54 | 9.54 | | | |
| THYRO1000881 | 36.03 | 18.32 | 15.54 | 24.61 | 23.19 | 29.23 | 22.14 | 28.98 | 28.98 | | | |
| THYRO1000894 | 3.99 | 1.72 | 1.92 | 2.01 | 2.07 | 2.23 | 2.83 | 2.03 | 2.03 | | | |
| THYRO1000895 | 2.03 | 0.86 | 1.43 | 1.55 | 2.22 | 2.83 | 1.11 | 1.40 | 1.4 | | | |
| THYRO1000916 | 3.35 | 1.86 | 1.68 | 6.43 | 4.60 | 5.32 | 3.15 | 2.84 | 2.84 | * | + | |
| THYRO1000917 | 19.78 | 13.58 | 15.27 | 18.14 | 13.63 | 19.91 | 15.55 | 24.10 | 24.1 | | | |
| THYRO1000926 | 3.79 | 1.84 | 2.71 | 4.53 | 2.38 | 2.98 | 3.39 | 2.18 | 2.18 | | | |
| THYRO1000934 | 0.9 | 1.09 | 0.59 | 2.64 | 2.45 | 2.04 | 2.64 | 2.12 | 2.12 | ** | + | ** | + |
| THYRO1000951 | 4.53 | 2.89 | 1.88 | 3.09 | 4.97 | 2.59 | 3.91 | 3.92 | 3.92 | | | |
| THYRO1000952 | 3.27 | 1.18 | 1.32 | 2.44 | 2.17 | 2.23 | 1.41 | 2.31 | 2.31 | | | |
| THYRO1000956 | 2.11 | 1.50 | 1.47 | 2.05 | 2.05 | 1.60 | 2.11 | 2.25 | 2.25 | | | |
| THYRO1000960 | 5.02 | 0.63 | 1.57 | 3.83 | 4.64 | 3.41 | 3.77 | 4.16 | 4.16 | | | |
| THYRO1000961 | 1.21 | 1.05 | 0.73 | 2.4 | 1.40 | 1.52 | 2.97 | 2.62 | 2.62 | | | ** | + |
| THYRO1000964 | 2.36 | 2.00 | 1.45 | 3.05 | 2.41 | 3.11 | 3.20 | 2.63 | 2.63 | | | |
| THYRO1000971 | 6.39 | 3.74 | 2.87 | 7.64 | 6.60 | 7.93 | 4.97 | 5.58 | 5.58 | | | |
| THYRO1000974 | 8.5 | 6.07 | 6.15 | 9.83 | 9.20 | 11.43 | 9.30 | 8.90 | 8.9 | * | + | |
| THYRO1000975 | 6.08 | 2.45 | 2.54 | 7.15 | 6.73 | 7.67 | 5.66 | 3.65 | 3.65 | * | + | |
| THYRO1000983 | 6.75 | 2.78 | 2.84 | 5.03 | 3.45 | 3.63 | 5.16 | 7.50 | 7.5 | | | |
| THYRO1000984 | 4.73 | 2.02 | 2.56 | 6.84 | 6.78 | 4.19 | 3.85 | 4.94 | 4.94 | | | |
| THYRO1000988 | 5.73 | 4.61 | 2.66 | 9.09 | 5.83 | 6.82 | 3.77 | 4.73 | 4.73 | | | |
| THYRO1000991 | 5.53 | 2.99 | 3.68 | 7.33 | 4.24 | 7.53 | 5.28 | 4.92 | 4.92 | | | |
| THYRO1000999 | 1.49 | 2.18 | 1.52 | 3.22 | 3.15 | 4.39 | 2.64 | 2.87 | 2.87 | * | + | * | + |
| THYRO1001003 | 3.32 | 1.87 | 1.67 | 2.91 | 2.45 | 1.95 | 2.38 | 1.98 | 1.98 | | | |
| THYRO1001015 | 6.07 | 3.22 | 4.17 | 6.03 | 1.39 | 4.75 | 4.51 | 4.29 | 4.29 | | | |
| THYRO1001016 | 5.47 | 1.00 | 0.49 | 0.81 | 2.15 | 1.07 | 3.41 | 1.14 | 1.14 | | | |
| THYRO1001022 | 4.57 | 1.75 | 1.46 | 2.49 | 2.37 | 2.27 | 3.16 | 2.69 | 2.69 | | | |
| THYRO1001031 | 7 | 3.67 | 3.54 | 7.94 | 8.10 | 9.10 | 7.42 | 6.69 | 6.69 | * | + | |
| THYRO1001033 | 2.8 | 0.57 | 1.23 | 2.39 | 2.37 | 1.06 | 1.41 | 2.32 | 2.32 | | | |
| THYRO1001062 | 3.82 | 2.25 | 2.08 | 5.76 | 5.14 | 5.15 | 3.45 | 3.99 | 3.99 | * | + | |
| THYRO1001063 | 2.69 | 1.60 | 2.09 | 4.12 | 3.13 | 4.17 | 2.95 | 2.51 | 2.51 | * | + | |
| THYRO1001071 | 0.69 | 1.53 | 1.22 | 0.98 | 1.08 | 0.43 | 1.16 | 1.21 | 1.21 | | | |
| THYRO1001080 | 5.05 | 2.34 | 2.74 | 5.3 | 3.96 | 5.08 | 3.55 | 4.04 | 4.04 | | | |
| THYRO1001093 | 3.71 | 2.05 | 1.76 | 6.8 | 6.51 | 4.95 | 3.07 | 3.82 | 3.82 | * | + | |

TABLE 331-continued

| | | | | | | | | | | | | | |
|---|---|---|---|---|---|---|---|---|---|---|---|---|---|
| THYRO1001100 | 2.79 | 1.59 | 1.28 | 2.23 | 2.44 | 2.67 | 1.71 | 3.71 | 3.71 | | | | |
| THYRO1001102 | 4.56 | 2.46 | 2.61 | 2.98 | 3.38 | 2.67 | 4.62 | 4.11 | 4.11 | | | | |
| THYRO1001104 | 7.28 | 6.54 | 6.58 | 7.94 | 7.41 | 6.48 | 4.57 | 5.35 | 5.35 | | | ** | − |
| THYRO1001109 | 2.63 | 2.02 | 1.30 | 2.32 | 2.09 | 1.60 | 2.52 | 1.80 | 1.8 | | | | |
| THYRO1001113 | 1.05 | 0.71 | 0.52 | 0.95 | 1.64 | 0.74 | 2.24 | 3.05 | 3.05 | | | ** | + |

TABLE 332

| | | | | | | | | | | | | | |
|---|---|---|---|---|---|---|---|---|---|---|---|---|---|
| THYRO1001120 | 3.6 | 3.56 | 2.97 | 4.01 | 3.89 | 3.81 | 3.24 | 4.59 | 4.59 | | | | |
| THYRO1001121 | 4.68 | 3.13 | 2.03 | 5.64 | 4.07 | 3.90 | 2.70 | 4.05 | 4.05 | | | | |
| THYRO1001128 | 6.11 | 5.32 | 3.34 | 12.06 | 12.42 | 10.51 | 5.36 | 6.39 | 6.39 | ** | + | | |
| THYRO1001133 | 6.15 | 4.73 | 4.57 | 9.2 | 11.55 | 7.92 | 6.41 | 7.28 | 7.28 | * | + | * | + |
| THYRO1001134 | 3.36 | 2.97 | 3.23 | 3.78 | 3.94 | 5.18 | 4.26 | 4.50 | 4.5 | | | ** | + |
| THYRO1001142 | 0.74 | 0.74 | 1.04 | 0.72 | 2.52 | 2.41 | 0.96 | 1.79 | 1.79 | | | | |
| THYRO1001173 | 15.19 | 9.02 | 12.22 | 26.91 | 29.74 | 31.51 | 28.83 | 31.54 | 31.54 | ** | + | ** | + |
| THYRO1001175 | 1.52 | 0.43 | 1.46 | 2.01 | 0.80 | 2.13 | 0.96 | 1.73 | 1.73 | | | | |
| THYRO1001177 | 2.64 | 2.90 | 2.12 | 5.03 | 6.80 | 5.41 | 2.98 | 4.26 | 4.26 | ** | + | | |
| THYRO1001189 | 11.01 | 7.39 | 8.79 | 19.93 | 32.38 | 18.70 | 9.07 | 8.97 | 8.97 | * | + | | |
| THYRO1001194 | 3.46 | 1.13 | 2.28 | 5.96 | 5.42 | 5.39 | 1.82 | 2.43 | 2.43 | ** | + | | |
| THYRO1001204 | 4.45 | 2.95 | 2.30 | 6.96 | 6.86 | 8.50 | 3.26 | 4.79 | 4.79 | ** | + | | |
| THYRO1001205 | 24.03 | 16.88 | 15.68 | 32.39 | 32.90 | 31.15 | 22.06 | 24.66 | 24.66 | ** | + | | |
| THYRO1001213 | 3.76 | 2.34 | 2.06 | 5.73 | 8.42 | 6.51 | 4.19 | 4.49 | 4.49 | * | + | * | + |
| THYRO1001224 | 9.88 | 5.89 | 5.95 | 9.43 | 12.54 | 11.82 | 5.58 | 6.76 | 6.76 | | | | |
| THYRO1001237 | 2.56 | 2.32 | 3.39 | 3.81 | 2.63 | 3.98 | 5.21 | 5.02 | 5.02 | | | ** | + |
| THYRO1001242 | 27.87 | 23.01 | 22.93 | 21.64 | 25.67 | 32.15 | 25.14 | 28.77 | 28.77 | | | | |
| THYRO1001258 | 3.57 | 5.51 | 4.92 | 4.9 | 6.74 | 6.73 | 7.47 | 5.30 | 5.3 | | | | |
| THYRO1001262 | 1.72 | 1.10 | 1.83 | 6.36 | 5.01 | 5.41 | 2.24 | 3.79 | 3.79 | ** | + | * | + |
| THYRO1001266 | 1.55 | 0.64 | 0.79 | 1.26 | 1.48 | 1.18 | 1.70 | 1.12 | 1.12 | | | | |
| THYRO1001271 | 3.44 | 2.05 | 1.29 | 2.26 | 3.55 | 2.36 | 3.05 | 2.35 | 2.35 | | | | |
| THYRO1001287 | 3.96 | 1.21 | 1.37 | 3.53 | 2.40 | 2.74 | 3.19 | 2.91 | 2.91 | | | | |
| THYRO1001290 | 1.14 | 0.69 | 1.23 | 1.44 | 2.26 | 2.04 | 2.54 | 3.09 | 3.09 | * | + | ** | + |
| THYRO1001291 | 1.66 | 1.74 | 1.06 | 3.35 | 4.38 | 3.14 | 2.28 | 4.20 | 4.2 | ** | + | * | + |
| THYRO1001297 | 5.89 | 5.62 | 3.44 | 7.28 | 6.73 | 6.27 | 3.04 | 3.57 | 3.57 | | | | |
| THYRO1001302 | 0.7 | 1.17 | 1.36 | 2.14 | 3.01 | 3.14 | 1.40 | 2.26 | 2.26 | * | + | | |
| THYRO1001313 | 4.31 | 2.12 | 1.72 | 3.28 | 3.86 | 2.48 | 2.67 | 3.67 | 3.67 | | | | |
| THYRO1001320 | 4.07 | 2.24 | 2.43 | 7.21 | 7.25 | 7.12 | 3.37 | 4.30 | 4.3 | ** | + | | |
| THYRO1001321 | 4.3 | 1.74 | 1.67 | 5.83 | 6.09 | 3.75 | 2.97 | 2.21 | 2.21 | | | | |
| THYRO1001322 | 2.79 | 2.55 | 2.39 | 3.89 | 5.05 | 3.82 | 2.48 | 1.98 | 1.98 | * | + | | |
| THYRO1001327 | 1.5 | 1.06 | 0.78 | 3.17 | 2.62 | 2.46 | 1.64 | 1.54 | 1.54 | ** | + | | |
| THYRO1001336 | 5.87 | 4.46 | 7.00 | 13.05 | 17.27 | 14.64 | 6.39 | 6.28 | 6.28 | ** | + | | |
| THYRO1001347 | 0.03 | 0.55 | 0.25 | 0.69 | 2.15 | 0.73 | 1.35 | 0.54 | 0.54 | | | | |
| THYRO1001358 | 11.06 | 9.93 | 9.25 | 14.71 | 16.38 | 14.53 | 9.85 | 8.62 | 8.62 | ** | + | | |
| THYRO1001363 | 5.86 | 3.17 | 4.11 | 5.35 | 3.91 | 6.10 | 4.52 | 5.65 | 5.65 | | | | |
| THYRO1001365 | 5.19 | 2.07 | 3.95 | 4.26 | 3.12 | 4.83 | 2.55 | 3.93 | 3.93 | | | | |
| THYRO1001374 | 9.65 | 2.81 | 3.50 | 6.43 | 5.39 | 7.37 | 3.94 | 7.65 | 7.65 | | | | |
| THYRO1001401 | 7.01 | 3.08 | 4.71 | 9.44 | 10.37 | 11.91 | 6.83 | 6.19 | 6.19 | * | + | | |
| THYRO1001403 | 5.97 | 2.05 | 2.57 | 7.36 | 6.46 | 7.19 | 3.33 | 5.45 | 5.45 | | | | |
| THYRO1001405 | 5.97 | 3.44 | 4.77 | 7.32 | 6.00 | 9.69 | 6.01 | 5.53 | 5.53 | | | | |
| THYRO1001406 | 18.99 | 10.90 | 12.10 | 23.76 | 22.00 | 31.87 | 17.99 | 23.95 | 23.95 | * | + | | |
| THYRO1001411 | 13.78 | 6.66 | 6.31 | 15.64 | 15.28 | 13.18 | 9.75 | 10.33 | 10.33 | | | | |
| THYRO1001420 | 16.57 | 7.72 | 7.86 | 12.67 | 12.64 | 10.93 | 13.35 | 14.42 | 14.42 | | | | |
| THYRO1001426 | 12.94 | 7.75 | 6.41 | 21.71 | 18.55 | 24.48 | 11.12 | 13.81 | 13.81 | ** | + | | |
| THYRO1001430 | 8.77 | 5.32 | 6.79 | 6.79 | 9.85 | 9.38 | 6.22 | 8.03 | 8.03 | | | | |
| THYRO1001434 | 4.36 | 1.78 | 2.26 | 3.34 | 4.87 | 4.04 | 2.27 | 4.13 | 4.13 | | | | |
| THYRO1001456 | 6.47 | 2.68 | 3.34 | 4.42 | 3.96 | 4.89 | 4.38 | 4.91 | 4.91 | | | | |
| THYRO1001457 | 6.96 | 3.92 | 4.84 | 6.7 | 6.42 | 9.36 | 5.12 | 7.08 | 7.08 | | | | |
| THYRO1001458 | 9.57 | 4.98 | 6.73 | 8.45 | 4.79 | 10.94 | 7.33 | 10.09 | 10.09 | | | | |
| THYRO1001459 | 11.09 | 4.54 | 5.24 | 11.67 | 15.21 | 11.24 | 5.79 | 8.41 | 8.41 | | | | |
| THYRO1001471 | 6.36 | 3.07 | 1.95 | 5.35 | 3.31 | 4.14 | 2.83 | 4.03 | 4.03 | | | | |
| THYRO1001478 | 6.87 | 2.62 | 2.63 | 3.98 | 3.73 | 5.94 | 4.03 | 6.74 | 6.74 | | | | |
| THYRO1001480 | 13.1 | 8.34 | 8.71 | 20.72 | 21.69 | 22.38 | 10.45 | 33.77 | 33.77 | ** | + | | |
| THYRO1001481 | 5.7 | 2.94 | 3.90 | 7.61 | 6.97 | 7.30 | 4.44 | 6.00 | 6 | * | + | | |
| THYRO1001487 | 7.46 | 5.22 | 5.93 | 9.3 | 8.06 | 9.99 | 6.17 | 7.84 | 7.84 | * | + | | |
| THYRO1001495 | 11.89 | 6.81 | 10.31 | 8.41 | 6.19 | 9.91 | 4.61 | 6.76 | 6.76 | | | | |

TABLE 333

| | | | | | | | | | | | | | |
|---|---|---|---|---|---|---|---|---|---|---|---|---|---|
| THYRO1001498 | 9.2 | 3.54 | 3.52 | 8.32 | 6.23 | 9.44 | 6.75 | 6.00 | 6 | | | | |
| THYRO1001510 | 8.51 | 2.92 | 3.62 | 4.12 | 4.26 | 4.21 | 2.96 | 4.74 | 4.74 | | | | |
| THYRO1001512 | 9.32 | 6.84 | 5.74 | 9.67 | 9.37 | 8.03 | 7.58 | 10.22 | 10.22 | | | | |
| THYRO1001519 | 9.13 | 4.10 | 4.70 | 9.27 | 7.38 | 9.67 | 6.98 | 8.20 | 8.2 | | | | |
| THYRO1001522 | 6.26 | 4.50 | 5.23 | 7.93 | 8.82 | 7.33 | 5.58 | 9.26 | 9.26 | * | + | | |
| THYRO1001523 | 3.53 | 2.10 | 1.99 | 6.46 | 5.54 | 6.24 | 4.04 | 4.29 | 4.29 | ** | + | * | + |
| THYRO1001526 | 6.91 | 4.84 | 5.74 | 14.18 | 9.51 | 13.49 | 12.30 | 16.11 | 16.11 | * | + | ** | + |

TABLE 333-continued

| | | | | | | | | | | | | | |
|---|---|---|---|---|---|---|---|---|---|---|---|---|---|
| THYRO1001529 | 2.41 | 1.14 | 1.41 | 2.28 | 1.58 | 4.28 | 2.24 | 2.20 | 2.2 | | | | |
| THYRO1001534 | 3.65 | 2.24 | 1.50 | 4.38 | 3.58 | 6.43 | 2.88 | 4.21 | 4.21 | | | | |
| THYRO1001537 | 18.2 | 10.50 | 9.67 | 21.59 | 21.38 | 19.81 | 8.19 | 10.14 | 10.14 | * | + | | |
| THYRO1001541 | 14.28 | 6.89 | 6.76 | 16.77 | 16.36 | 14.76 | 9.61 | 10.03 | 10.03 | | | | |
| THYRO1001545 | 3.56 | 2.76 | 2.72 | 3.42 | 3.96 | 4.48 | 3.96 | 4.30 | 4.3 | | | * | + |
| THYRO1001559 | 3.99 | 2.04 | 2.13 | 4.24 | 3.76 | 7.51 | 3.56 | 3.91 | 3.91 | | | | |
| THYRO1001563 | 11.96 | 7.39 | 6.70 | 7.96 | 5.68 | 9.41 | 7.19 | 8.07 | 8.07 | | | | |
| THYRO1001570 | 4.68 | 4.47 | 3.76 | 4.09 | 3.00 | 4.87 | 4.64 | 6.87 | 6.87 | | | | |
| THYRO1001573 | 8.02 | 5.52 | 6.21 | 6.26 | 3.61 | 8.28 | 6.11 | 6.00 | 6 | | | | |
| THYRO1001584 | 8.32 | 5.29 | 4.71 | 9.43 | 6.63 | 9.84 | 5.17 | 6.12 | 6.12 | | | | |
| THYRO1001593 | 2.99 | 0.93 | 1.22 | 3.14 | 4.86 | 2.61 | 2.01 | 4.21 | 4.21 | | | | |
| THYRO1001595 | 5.67 | 1.96 | 2.39 | 7.68 | 7.67 | 6.34 | 3.91 | 4.14 | 4.14 | * | + | | |
| THYRO1001596 | 5.89 | 2.66 | 3.80 | 3.78 | 3.65 | 3.11 | 2.98 | 3.57 | 3.57 | | | | |
| THYRO1001602 | 7.81 | 2.64 | 3.23 | 7.32 | 8.69 | 7.89 | 4.74 | 7.00 | 7 | | | | |
| THYRO1001605 | 5.26 | 2.56 | 2.24 | 5.13 | 5.05 | 4.87 | 3.48 | 3.41 | 3.41 | | | | |
| THYRO1001608 | 7.75 | 3.89 | 6.86 | 6.23 | 6.07 | 8.04 | 6.19 | 6.87 | 6.87 | | | | |
| THYRO1001617 | 14.26 | 9.34 | 10.47 | 17.37 | 15.68 | 19.92 | 9.80 | 12.17 | 12.17 | * | + | | |
| THYRO1001634 | 4.95 | 3.06 | 3.93 | 4.4 | 3.84 | 4.30 | 4.75 | 4.39 | 4.39 | | | | |
| THYRO1001637 | 10.18 | 6.14 | 4.65 | 17.45 | 14.38 | 17.46 | 8.06 | 9.17 | 9.17 | ** | + | | |
| THYRO1001641 | 6.38 | 3.44 | 3.03 | 6.59 | 5.36 | 5.81 | 6.90 | 5.59 | 5.59 | | | | |
| THYRO1001656 | 4.52 | 2.95 | 2.83 | 3.81 | 4.14 | 7.31 | 4.33 | 5.14 | 5.14 | | | | |
| THYRO1001658 | 4.29 | 2.01 | 1.79 | 2.18 | 2.89 | 2.10 | 2.16 | 2.58 | 2.58 | | | | |
| THYRO1001661 | 3.1 | 1.45 | 1.64 | 1.96 | 2.33 | 1.46 | 4.01 | 2.50 | 2.5 | | | | |
| THYRO1001671 | 5.77 | 2.59 | 2.20 | 4.22 | 4.26 | 4.64 | 3.03 | 5.39 | 5.39 | | | | |
| THYRO1001672 | 6.81 | 4.51 | 5.53 | 5.21 | 5.27 | 6.87 | 6.28 | 6.63 | 6.63 | | | | |
| THYRO1001673 | 4 | 1.65 | 1.66 | 5.32 | 3.21 | 5.73 | 2.44 | 2.64 | 2.64 | | | | |
| THYRO1001677 | 6.31 | 4.12 | 3.30 | 6.16 | 7.35 | 6.56 | 2.26 | 3.46 | 3.46 | | | | |
| THYRO1001683 | 8.24 | 4.40 | 3.37 | 4.91 | 4.29 | 8.77 | 5.76 | 11.28 | 11.28 | | | | |
| THYRO1001700 | 4.49 | 4.00 | 2.73 | 4.05 | 4.60 | 4.19 | 4.01 | 4.47 | 4.47 | | | | |
| THYRO1001702 | 15.24 | 5.52 | 7.38 | 9.42 | 10.75 | 10.20 | 8.66 | 10.47 | 10.47 | | | | |
| THYRO1001703 | 9.25 | 6.47 | 6.51 | 7.26 | 6.71 | 8.49 | 10.46 | 8.63 | 8.63 | | | | |
| THYRO1001706 | 4.3 | 2.92 | 3.16 | 5.43 | 6.68 | 7.52 | 2.62 | 4.78 | 4.78 | * | + | | |
| THYRO1001721 | 5.23 | 3.35 | 2.76 | 6.77 | 6.22 | 4.74 | 5.26 | 7.04 | 7.04 | | | * | + |
| THYRO1001725 | 4.92 | 2.94 | 2.29 | 5.59 | 6.33 | 8.71 | 2.75 | 4.72 | 4.72 | * | + | | |
| THYRO1001730 | 24.29 | 13.18 | 13.43 | 14.02 | 17.03 | 13.70 | 21.66 | 22.76 | 22.76 | | | | |
| THYRO1001738 | 9.75 | 4.90 | 4.82 | 9.04 | 5.85 | 7.43 | 4.92 | 7.98 | 7.98 | | | | |
| THYRO1001743 | 4 | 3.23 | 1.86 | 3.1 | 3.27 | 3.05 | 4.23 | 2.96 | 2.96 | | | | |
| THYRO1001745 | 2.52 | 1.07 | 1.25 | 1.89 | 1.88 | 1.53 | 1.75 | 2.88 | 2.88 | | | | |
| THYRO1001746 | 4.23 | 2.26 | 1.61 | 3.33 | 3.91 | 4.02 | 3.18 | 3.68 | 3.68 | | | | |
| THYRO1001770 | 12.11 | 9.28 | 9.48 | 15.96 | 14.31 | 15.08 | 8.82 | 12.34 | 12.34 | ** | + | | |
| THYRO1001772 | 5.17 | 2.74 | 2.39 | 6.3 | 7.93 | 7.50 | 3.31 | 3.90 | 3.9 | * | + | | |
| THYRO1001778 | 15.04 | 12.42 | 11.52 | 14.35 | 19.15 | 15.23 | 13.02 | 16.18 | 16.18 | | | | |
| THYRO1001793 | 14.69 | 6.79 | 7.43 | 12.47 | 11.95 | 9.29 | 6.11 | 8.93 | 8.93 | | | | |
| THYRO1001796 | 11.97 | 7.13 | 5.24 | 9.74 | 7.66 | 8.26 | 8.13 | 8.63 | 8.63 | | | | |
| THYRO1001800 | 6.25 | 3.20 | 2.10 | 5.72 | 6.37 | 4.12 | 5.27 | 7.47 | 7.47 | | | | |
| THYRO1001803 | 19.67 | 13.46 | 12.81 | 14.42 | 14.10 | 16.43 | 18.72 | 18.13 | 18.13 | | | | |
| THYRO1001809 | 3.63 | 3.46 | 2.67 | 3.26 | 4.76 | 4.46 | 2.91 | 5.54 | 5.54 | | | | |
| THYRO1001817 | 6.44 | 6.33 | 5.18 | 4.47 | 3.95 | 4.74 | 8.83 | 7.32 | 7.32 | * | − | * | + |
| THYRO1001819 | 5.55 | 5.75 | 5.06 | 8.24 | 5.95 | 6.83 | 5.79 | 6.86 | 6.86 | | | | |

TABLE 334

| | | | | | | | | | | | | | |
|---|---|---|---|---|---|---|---|---|---|---|---|---|---|
| THYRO1001828 | 5.58 | 5.56 | 4.00 | 9.32 | 9.83 | 9.03 | 4.86 | 6.29 | 6.29 | ** | + | | |
| THYRO1001854 | 20.22 | 7.97 | 7.27 | 24.83 | 26.41 | 23.02 | 14.19 | 14.50 | 14.5 | * | + | | |
| THYRO1001895 | 4.5 | 1.82 | 1.66 | 2.69 | 3.40 | 3.20 | 2.52 | 2.17 | 2.17 | | | | |
| THYRO1001907 | 6.37 | 2.87 | 2.77 | 7.43 | 8.35 | 6.14 | 3.08 | 4.67 | 4.67 | | | | |
| TRACH1000006 | 1.82 | 2.19 | 1.60 | 2.9 | 3.42 | 2.53 | 2.58 | 3.05 | 3.05 | * | + | * | + |
| TRACH1000013 | 2.15 | 1.13 | 1.31 | 1.45 | 1.80 | 3.25 | 1.50 | 1.76 | 1.76 | | | | |
| TRACH1000074 | 3.42 | 3.57 | 4.39 | 5.62 | 7.83 | 7.88 | 4.19 | 10.27 | 10.27 | * | + | | |
| TRACH1000095 | 2.45 | 2.91 | 2.44 | 3.1 | 3.04 | 4.04 | 2.50 | 2.45 | 2.45 | | | | |
| TRACH1000102 | 7.43 | 5.84 | 4.56 | 10.07 | 11.80 | 13.53 | 5.10 | 8.65 | 8.65 | * | + | | |
| TRACH1000108 | 3.15 | 1.08 | 0.60 | 4.55 | 2.50 | 3.75 | 3.10 | 1.49 | 1.49 | | | | |
| TRACH1000126 | 6.59 | 4.83 | 4.15 | 6.73 | 6.75 | 6.24 | 6.66 | 4.52 | 4.52 | | | | |
| TRACH1000146 | 4.1 | 2.48 | 3.17 | 3.77 | 4.50 | 3.73 | 2.81 | 3.85 | 3.85 | | | | |
| TRACH1000160 | 2.88 | 1.73 | 0.69 | 2.15 | 3.29 | 1.84 | 1.31 | 2.46 | 2.46 | | | | |
| TRACH1000184 | 9.18 | 5.15 | 6.68 | 9.87 | 12.29 | 12.18 | 7.92 | 7.13 | 7.13 | * | + | | |
| VESEN1000004 | 1.43 | 3.20 | 2.03 | 4.77 | 4.23 | 4.76 | 2.44 | 2.90 | 2.9 | * | + | | |
| VESEN1000007 | 4.67 | 3.71 | 3.03 | 4.92 | 4.79 | 4.78 | 3.45 | 3.27 | 3.27 | | | | |
| VESEN1000013 | 3.8 | 4.40 | 3.49 | 6.08 | 5.11 | 8.39 | 4.08 | 5.78 | 5.78 | | | | |
| VESEN1000028 | 10.32 | 4.13 | 4.71 | 9.23 | 9.35 | 9.07 | 7.29 | 12.27 | 12.27 | | | | |
| VESEN1000059 | 7.75 | 3.60 | 4.26 | 7.63 | 6.94 | 7.73 | 4.60 | 5.95 | 5.95 | | | | |
| VESEN1000100 | 14.3 | 7.29 | 8.52 | 11.77 | 17.29 | 16.55 | 10.06 | 12.85 | 12.85 | | | | |
| VESEN1000107 | 8.09 | 2.86 | 4.55 | 5.28 | 4.93 | 5.96 | 5.50 | 6.28 | 6.28 | | | | |
| VESEN1000117 | 4.56 | 2.53 | 3.13 | 3.83 | 3.21 | 3.98 | 3.40 | 4.83 | 4.83 | | | | |
| VESEN1000122 | 6 | 2.68 | 4.24 | 3.89 | 4.52 | 7.18 | 4.38 | 7.65 | 7.65 | | | | |
| VESEN1000137 | 2.93 | 1.73 | 1.82 | 1.57 | 3.65 | 3.17 | 2.10 | 3.43 | 3.43 | | | | |

TABLE 334-continued

| | | | | | | | | | | | | |
|---|---|---|---|---|---|---|---|---|---|---|---|---|
| VESEN1000195 | 14.98 | 5.35 | 5.89 | 8.11 | 8.22 | 6.74 | 10.54 | 12.97 | 12.97 | | | |
| VESEN1000215 | 2.26 | 0.13 | 1.20 | 1.57 | 1.68 | 0.85 | 0.67 | 1.63 | 1.63 | | | |
| VESEN1000279 | 26.58 | 15.13 | 14.91 | 21.43 | 14.13 | 23.59 | 19.30 | 20.07 | 20.07 | | | |
| VESEN1000363 | 15.34 | 8.73 | 10.79 | 17.48 | 16.61 | 12.88 | 9.72 | 13.31 | 13.31 | | | |
| VESEN1000388 | 9.91 | 6.40 | 6.52 | 7.89 | 4.01 | 10.40 | 6.86 | 10.14 | 10.14 | | | |
| VESEN1000394 | 12.12 | 6.72 | 8.23 | 12.56 | 8.96 | 9.43 | 5.04 | 9.23 | 9.23 | | | |
| VESEN1000410 | 10.78 | 2.59 | 2.39 | 6.85 | 3.24 | 4.07 | 5.06 | 8.94 | 8.94 | | | |
| VESEN1000411 | 6.18 | 3.27 | 4.03 | 5.74 | 3.11 | 6.71 | 4.21 | 5.31 | 5.31 | | | |
| VESEN1000415 | 9.24 | 6.34 | 4.20 | 8.16 | 6.27 | 5.95 | 4.08 | 7.14 | 7.14 | | | |
| VESEN1000440 | 9.05 | 5.57 | 4.80 | 8.89 | 8.64 | 8.72 | 5.45 | 8.25 | 8.25 | | | |
| VESEN1000452 | 7.8 | 4.72 | 5.60 | 4.86 | 5.38 | 4.21 | 6.76 | 5.77 | 5.77 | | | |
| VESEN1000539 | 346.75 | 188.95 | 244.65 | 158.74 | 166.73 | 144.68 | 64.90 | 151.18 | 151.2 | | | |
| VESEN1000554 | 4.46 | 3.39 | 3.95 | 4.07 | 2.23 | 3.58 | 2.95 | 2.93 | 2.93 | | * | − |
| VESEN1000557 | 6.06 | 4.00 | 4.41 | 6.38 | 3.08 | 5.06 | 6.10 | 7.77 | 7.77 | | * | + |
| VESEN1000575 | 7.82 | 4.18 | 4.70 | 6.03 | 4.15 | 4.58 | 5.87 | 6.64 | 6.64 | | | |
| VESEN1000585 | 9.14 | 4.16 | 5.29 | 6.86 | 6.14 | 7.55 | 4.21 | 6.93 | 6.93 | | | |
| VESEN1000592 | 1.51 | 0.34 | 0.06 | 1.48 | 0.81 | 0.75 | 1.11 | 0.98 | 0.98 | | | |
| VESEN1000658 | 9.42 | 5.35 | 3.63 | 6.6 | 8.13 | 5.18 | 7.65 | 9.88 | 9.88 | | | |
| VESEN1000669 | 30.52 | 16.02 | 17.70 | 27.74 | 22.51 | 23.12 | 18.76 | 27.04 | 27.04 | | | |
| VESEN1000743 | 12.62 | 7.52 | 8.22 | 9.64 | 10.40 | 10.72 | 6.57 | 9.41 | 9.41 | | | |
| VESEN1000752 | 31.33 | 20.56 | 19.92 | 44.49 | 19.58 | 40.73 | 21.19 | 32.70 | 32.7 | | | |
| VESEN1000761 | 23.86 | 13.01 | 17.50 | 12.45 | 9.94 | 17.39 | 8.43 | 10.21 | 10.21 | | | |
| VESEN2000039 | 77.69 | 44.95 | 56.28 | 57.5 | 43.19 | 64.97 | 60.33 | 69.54 | 69.54 | | | |
| VESEN2000102 | 7.33 | 4.99 | 5.35 | 6.83 | 4.25 | 7.08 | 6.69 | 8.37 | 8.37 | | | |
| VESEN2000164 | 5.18 | 3.46 | 3.31 | 9.13 | 9.21 | 6.82 | 3.36 | 3.89 | 3.89 | * | + | |
| VESEN2000175 | 1.73 | 0.97 | 0.12 | 1.01 | 1.92 | 1.13 | 0.88 | 1.17 | 1.17 | | | |
| VESEN2000186 | 19.39 | 12.37 | 11.60 | 17.79 | 16.80 | 18.96 | 15.99 | 20.01 | 20.01 | | | |
| VESEN2000199 | 28.49 | 19.51 | 19.01 | 18.68 | 21.47 | 33.21 | 23.58 | 23.01 | 23.01 | | | |
| VESEN2000200 | 6.32 | 1.63 | 3.02 | 5.06 | 3.00 | 3.70 | 3.04 | 4.39 | 4.39 | | | |
| VESEN2000204 | 4.52 | 1.87 | 3.26 | 2.47 | 1.87 | 2.02 | 2.17 | 3.09 | 3.09 | | | |
| VESEN2000218 | 6.43 | 3.74 | 5.10 | 6.59 | 6.27 | 8.76 | 4.84 | 5.35 | 5.35 | | | |
| VESEN2000230 | 5.26 | 2.88 | 3.63 | 6.04 | 5.20 | 6.82 | 6.20 | 5.85 | 5.85 | | * | + |

TABLE 335

| | | | | | | | | | | | | | | |
|---|---|---|---|---|---|---|---|---|---|---|---|---|---|---|
| VESEN2000272 | 6.36 | 2.52 | 3.61 | 13.68 | 15.50 | 9.23 | 6.37 | 6.11 | 6.11 | * | + | | | |
| VESEN2000299 | 5.8 | 3.32 | 3.03 | 6.33 | 5.54 | 5.31 | 4.11 | 3.82 | 3.82 | | | | | |
| VESEN2000323 | 3.64 | 2.70 | 3.46 | 7.25 | 6.60 | 6.83 | 4.13 | 6.99 | 6.99 | ** | + | * | + | |
| VESEN20003Z7 | 16.91 | 9.24 | 9.32 | 14.89 | 11.98 | 16.05 | 16.51 | 12.53 | 12.53 | | | | | |
| VESEN2000328 | 3.41 | 1.69 | 2.05 | 2.7 | 1.99 | 2.52 | 3.68 | 4.21 | 4.21 | | | * | + | |
| VESEN2000330 | 9.06 | 4.94 | 3.98 | 4 | 3.94 | 4.40 | 7.56 | 5.58 | 5.58 | | | | | |
| VESEN2000336 | 3.29 | 2.35 | 2.63 | 3.19 | 2.56 | 2.84 | 2.06 | 2.38 | 2.38 | | | | | |
| VESEN2000354 | 8.7 | 4.46 | 4.22 | 7.46 | 6.89 | 5.83 | 5.63 | 5.02 | 5.02 | | | | | |
| VESEN2000378 | 3.42 | 2.15 | 2.25 | 4.13 | 2.42 | 1.91 | 1.92 | 2.61 | 2.61 | | | | | |
| VESEN2000379 | 11.63 | 7.79 | 4.82 | 10.74 | 10.07 | 12.49 | 7.29 | 10.70 | 10.7 | | | | | |
| VESEN2000397 | 3.37 | 1.29 | 1.36 | 2.39 | 2.24 | 1.99 | 1.18 | 3.19 | 3.19 | | | | | |
| VESEN2000416 | 3.83 | 2.34 | 1.55 | 2.15 | 2.33 | 2.91 | 2.47 | 2.28 | 2.28 | | | | | |
| VESEN2000420 | 2.88 | 0.98 | 1.36 | 1.52 | 0.23 | 0.52 | 0.64 | 1.63 | 1.63 | | | | | |
| VESEN2000430 | 2.62 | 1.65 | 1.71 | 1.89 | 2.49 | 1.83 | 0.78 | 2.97 | 2.97 | | | | | |
| VESEN2000448 | 2.86 | 2.67 | 1.17 | 1 | 2.01 | 2.37 | 2.33 | 2.73 | 2.73 | | | | | |
| VESEN2000449 | 8.25 | 5.92 | 4.67 | 9.14 | 8.56 | 10.89 | 5.16 | 6.55 | 6.55 | | | | | |
| VESEN2000456 | 5.37 | 3.06 | 1.86 | 3.12 | 2.41 | 3.57 | 2.05 | 2.65 | 2.65 | | | | | |
| VESEN2000562 | 7.78 | 4.41 | 5.30 | 5.84 | 5.51 | 4.92 | 4.30 | 6.44 | 6.44 | | | | | |
| VESEN2000573 | 0.6 | 0.35 | 0.41 | 0.67 | 0.40 | 0.67 | 1.28 | 2.60 | 2.6 | | | * | + | |
| VESEN2000604 | 5.64 | 1.48 | 1.85 | 3.25 | 2.37 | 2.19 | 2.91 | 4.05 | 4.05 | | | | | |
| VESEN2000614 | 25.21 | 13.24 | 16.03 | 20.97 | 19.46 | 20.96 | 23.97 | 21.61 | 21.61 | | | | | |
| VESEN2000638 | 1.7 | 1.28 | 1.62 | 1.56 | 1.85 | 1.20 | 2.41 | 1.35 | 1.35 | | | | | |
| VESEN2000641 | 1.73 | 2.11 | 1.08 | 1.79 | 1.66 | 1.77 | 1.14 | 1.95 | 1.95 | | | | | |
| VESEN2000645 | 3.09 | 2.77 | 2.30 | 2.12 | 2.14 | 1.71 | 1.70 | 3.15 | 3.15 | | | | | |
| Y79AA1000013 | 10.79 | 7.40 | 5.68 | 11.91 | 9.74 | 8.63 | 7.82 | 6.74 | 6.74 | | | | | |
| Y79AA1000030 | 13.95 | 8.47 | 8.24 | 10.96 | 9.10 | 13.62 | 9.47 | 12.29 | 12.29 | | | | | |
| Y79AA1000033 | 16.96 | 12.16 | 9.55 | 7.65 | 10.20 | 8.44 | 7.18 | 10.76 | 10.76 | | | | | |
| Y79AA1000037 | 2.11 | 1.49 | 0.71 | 2.23 | 2.21 | 3.27 | 2.75 | 2.51 | 2.51 | | | * | + | |
| Y79AA1000041 | 2.2 | 2.48 | 1.77 | 2.69 | 2.36 | 2.74 | 2.02 | 3.82 | 3.82 | | | | | |
| Y79AA1000059 | 7.6 | 6.90 | 6.65 | 10.99 | 11.69 | 12.90 | 4.30 | 7.70 | 7.7 | ** | + | | | |
| Y79AA1000065 | 22.39 | 17.36 | 15.96 | 24.43 | 21.67 | 25.09 | 14.43 | 16.06 | 16.06 | | | | | |
| Y79AA1000081 | 42.69 | 41.35 | 51.24 | 111.38 | 113.45 | 103.25 | 45.62 | 16.30 | 16.3 | | | | | |
| Y79AA1000127 | 22.29 | 16.01 | 11.79 | 12.57 | 10.65 | 7.07 | 3.98 | 5.58 | 5.58 | | | * | − | |
| Y79AA1000130 | 6.17 | 3.27 | 2.80 | 10.01 | 8.60 | 9.63 | 4.89 | 5.13 | 5.13 | ** | + | | | |
| Y79AA1000131 | 448.19 | 235.19 | 299.39 | 399.75 | 486.28 | 438.12 | 277.73 | 304.61 | 304.6 | | | | | |
| Y79AA1000134 | 8.96 | 7.49 | 5.25 | 6.6 | 6.53 | 6.62 | 9.23 | 10.69 | 10.69 | | | | | |
| Y79AA1000143 | 9.99 | 4.29 | 8.06 | 7.58 | 8.06 | 8.95 | 6.96 | 8.30 | 8.3 | | | | | |
| Y79AA1000144 | 8.55 | 7.18 | 6.04 | 6.31 | 5.55 | 6.00 | 4.05 | 4.40 | 4.4 | | | * | − | |
| Y79AA1000150 | 18.22 | 14.18 | 15.26 | 14.89 | 15.33 | 21.06 | 9.92 | 9.91 | 9.91 | | | ** | − | |
| Y79AA1000153 | 201.67 | 139.66 | 172.85 | 190.71 | 189.25 | 179.30 | 103.81 | 119.17 | 119.2 | | | * | − | |
| Y79AA1000166 | 6.51 | 3.61 | 2.42 | 6.7 | 8.84 | 4.48 | 3.56 | 4.21 | 4.21 | | | | | |

TABLE 335-continued

| | | | | | | | | | | | | |
|---|---|---|---|---|---|---|---|---|---|---|---|---|
| Y79AA1000179 | 15.16 | 9.65 | 7.92 | 10.53 | 9.30 | 7.94 | 4.29 | 5.64 | 5.64 | | | |
| Y79AA1000181 | 10.66 | 5.30 | 5.63 | 7.26 | 8.22 | 5.85 | 3.94 | 5.98 | 5.98 | | | |
| Y79AA1000202 | 18.5 | 15.06 | 12.86 | 18.25 | 18.73 | 23.11 | 15.84 | 25.98 | 25.98 | | | |
| Y79AA1000207 | 5.87 | 4.02 | 4.27 | 14.67 | 14.22 | 14.10 | 7.48 | 5.85 | 5.85 | ** | + | |
| Y79AA1000214 | 29.22 | 23.27 | 20.29 | 36.32 | 37.06 | 45.40 | 22.86 | 25.86 | 25.86 | * | + | |
| Y79AA1000222 | 12.84 | 9.84 | 10.93 | 9.21 | 6.89 | 9.06 | 5.29 | 5.66 | 5.66 | | ** | − |
| Y79AA1000226 | 5.63 | 6.09 | 5.68 | 7.41 | 7.20 | 8.09 | 8.84 | 8.79 | 8.79 | ** | + | ** | + |
| Y79AA1000227 | 17.27 | 10.05 | 8.43 | 12.69 | 17.80 | 12.32 | 9.20 | 10.19 | 10.19 | | | |
| Y79AA1000230 | 6.42 | 4.02 | 2.20 | 3.72 | 4.88 | 2.48 | 3.03 | 2.90 | 2.9 | | | |
| Y79AA1000231 | 34.72 | 21.74 | 21.36 | 20.87 | 19.10 | 17.13 | 9.21 | 15.10 | 15.1 | | | |
| Y79AA1000239 | 15.79 | 9.79 | 7.30 | 10.27 | 13.40 | 11.55 | 12.77 | 13.82 | 13.82 | | | |
| Y79AA1000258 | 4.05 | 3.20 | 3.26 | 4.22 | 5.80 | 4.84 | 3.99 | 4.25 | 4.25 | | | |
| Y79AA1000268 | 7.27 | 4.70 | 4.79 | 10.11 | 6.83 | 9.96 | 5.20 | 6.24 | 6.24 | | | |
| Y79AA1000269 | 3.42 | 2.81 | 2.55 | 4.54 | 6.08 | 5.88 | 5.38 | 5.60 | 5.6 | ** | + | ** | + |
| Y79AA1000270 | 3.64 | 4.17 | 2.51 | 5.74 | 6.14 | 5.66 | 3.62 | 4.41 | 4.41 | ** | + | |

TABLE 336

| | | | | | | | | | | | | |
|---|---|---|---|---|---|---|---|---|---|---|---|---|
| Y79AA1000280 | 11.25 | 5.37 | 6.77 | 11.8 | 13.92 | 12.66 | 5.46 | 9.54 | 9.54 | | | |
| Y79AA1000285 | 4.46 | 1.52 | 2.70 | 3.31 | 1.78 | 2.60 | 2.43 | 3.53 | 3.53 | | | |
| Y79AA1000295 | 3.61 | 2.65 | 3.31 | 10.15 | 10.34 | 10.77 | 4.41 | 5.66 | 5.66 | ** | + | * | + |
| Y79AA1000307 | 12.46 | 9.65 | 13.13 | 11.87 | 8.54 | 13.75 | 5.29 | 6.68 | 6.68 | | ** | − |
| Y79AA1000313 | 15.46 | 6.94 | 8.62 | 10.28 | 12.44 | 14.87 | 10.41 | 13.90 | 13.9 | | | |
| Y79AA1000314 | 14.81 | 9.18 | 10.30 | 22.74 | 18.92 | 27.80 | 24.11 | 31.46 | 31.46 | * | + | ** | + |
| Y79AA1000328 | 3.09 | 1.87 | 2.24 | 2.09 | 2.55 | 2.73 | 1.78 | 2.96 | 2.96 | | | |
| Y79AA1000334 | 7.09 | 3.70 | 2.56 | 5.55 | 4.48 | 4.69 | 3.41 | 4.25 | 4.25 | | | |
| Y79AA1000342 | 35.87 | 15.66 | 15.62 | 22.36 | 17.70 | 23.91 | 21.00 | 29.07 | 29.07 | | | |
| Y79AA1000346 | 17.41 | 15.57 | 12.74 | 9.41 | 9.10 | 10.71 | 4.23 | 5.49 | 5.49 | * | − | ** | − |
| Y79AA1000347 | 23.11 | 14.24 | 15.07 | 23.5 | 39.38 | 38.47 | 19.81 | 25.73 | 25.73 | * | + | |
| Y79AA1000349 | 19.76 | 10.53 | 12.68 | 20.31 | 16.01 | 21.05 | 12.82 | 17.27 | 17.27 | | | |
| Y79AA1000355 | 4.87 | 2.42 | 3.06 | 7.26 | 6.44 | 8.31 | 4.76 | 6.17 | 6.17 | * | + | |
| Y79AA1000368 | 6.76 | 2.87 | 3.15 | 4.62 | 3.69 | 5.41 | 4.31 | 4.40 | 4.4 | | | |
| Y79AA1000388 | 25.23 | 15.44 | 16.71 | 26.79 | 21.25 | 29.10 | 12.60 | 17.85 | 17.85 | | | |
| Y79AA1000392 | 14.91 | 8.34 | 9.71 | 13.34 | 7.02 | 19.13 | 9.61 | 11.82 | 11.82 | | | |
| Y79AA1000405 | 24.03 | 14.82 | 7.15 | 15.39 | 22.71 | 12.76 | 14.12 | 17.35 | 17.35 | | | |
| Y79AA1000410 | 24.25 | 16.23 | 12.97 | 37.19 | 36.14 | 36.35 | 20.62 | 22.06 | 22.06 | ** | + | |
| Y79AA1000420 | 1.83 | 1.06 | 1.88 | 2.33 | 1.74 | 3.81 | 1.92 | 2.84 | 2.84 | | | |
| Y79AA1000423 | 7.25 | 4.11 | 5.48 | 9.75 | 7.86 | 8.44 | 5.00 | 5.45 | 5.45 | * | + | |
| Y79AA1000426 | 5.29 | 3.84 | 5.55 | 4.45 | 2.88 | 4.33 | 3.32 | 3.94 | 3.94 | | | |
| Y79AA1000432 | 3.27 | 2.71 | 3.28 | 1.62 | 1.68 | 2.55 | 1.63 | 2.22 | 2.22 | * | − | * | − |
| Y79AA1000453 | 141.24 | 53.68 | 107.37 | 81.71 | 59.38 | 81.50 | 30.05 | 43.77 | 43.77 | | | |
| Y79AA1000465 | 3.59 | 1.59 | 2.02 | 2.43 | 1.32 | 2.55 | 1.95 | 3.10 | 3.1 | | | |
| Y79AA1000469 | 14.01 | 11.65 | 7.90 | 12.08 | 10.53 | 7.10 | 8.31 | 7.33 | 7.33 | | | |
| Y79AA1000480 | 4.69 | 1.58 | 1.60 | 4.05 | 2.82 | 2.60 | 2.60 | 2.44 | 2.44 | | | |
| Y79AA1000502 | 12.81 | 5.39 | 8.31 | 9.83 | 13.49 | 9.32 | 5.96 | 11.12 | 11.12 | | | |
| Y79AA1000521 | 6.28 | 4.42 | 6.32 | 6.26 | 4.77 | 4.40 | 6.38 | 6.79 | 6.79 | | | |
| Y79AA1000534 | 17.26 | 8.63 | 8.69 | 10.74 | 7.23 | 7.43 | 4.39 | 5.56 | 5.56 | | | |
| Y79AA1000538 | 6.63 | 3.28 | 4.52 | 10.32 | 7.26 | 8.06 | 5.36 | 6.47 | 6.47 | * | + | |
| Y79AA1000539 | 19.25 | 8.27 | 12.78 | 24.31 | 26.47 | 21.68 | 9.27 | 11.72 | 11.72 | * | + | |
| Y79AA1000540 | 11.13 | 5.92 | 6.15 | 9.13 | 9.09 | 8.44 | 6.85 | 9.21 | 9.21 | | | |
| Y79AA1000560 | 173.06 | 134.34 | 94.53 | 202.66 | 161.69 | 169.55 | 95.78 | 139.04 | 139 | | | |
| Y79AA1000574 | 2.89 | 2.45 | 2.28 | 4.12 | 2.97 | 2.60 | 1.96 | 2.63 | 2.63 | | | |
| Y79AA1000584 | 3.2 | 1.68 | 1.63 | 1.75 | 2.10 | 2.56 | 2.05 | 2.41 | 2.41 | | | |
| Y79AA1000589 | 8.66 | 5.80 | 5.36 | 6.79 | 3.71 | 6.73 | 6.49 | 7.62 | 7.62 | | | |
| Y79AA1000598 | 5.98 | 2.97 | 4.18 | 3.57 | 3.29 | 6.10 | 4.35 | 4.63 | 4.63 | | | |
| Y79AA1000600 | 6.57 | 3.44 | 3.89 | 3.3 | 2.25 | 3.48 | 2.55 | 2.77 | 2.77 | | | |
| Y79AA1000609 | 6.92 | 3.42 | 2.75 | 2.76 | 4.04 | 6.09 | 4.13 | 5.52 | 5.52 | | | |
| Y79AA1000618 | 58.41 | 30.55 | 40.08 | 29.92 | 37.02 | 38.12 | 11.43 | 14.49 | 14.49 | | * | − |
| Y79AA1000627 | 6.08 | 3.22 | 3.45 | 5.69 | 5.50 | 4.18 | 4.40 | 3.93 | 3.93 | | | |
| Y79AA1000636 | 38.19 | 23.55 | 23.75 | 16.84 | 22.87 | 15.14 | 9.44 | 11.05 | 11.05 | | * | − |
| Y79AA1000649 | 8.69 | 4.34 | 4.67 | 4.61 | 4.61 | 4.01 | 3.93 | 8.79 | 8.79 | | | |
| Y79AA1000656 | 5.76 | 3.08 | 3.22 | 5.58 | 4.90 | 5.16 | 3.04 | 4.23 | 4.23 | | | |
| Y79AA1000673 | 5.03 | 2.72 | 1.36 | 3.23 | 1.94 | 2.41 | 3.39 | 4.06 | 4.06 | | | |
| Y79AA1000674 | 10.61 | 7.11 | 11.17 | 10.18 | 8.67 | 10.62 | 6.76 | 10.00 | 10 | | | |
| Y79AA1000678 | 7.25 | 4.89 | 6.06 | 10.19 | 6.81 | 7.33 | 5.06 | 5.92 | 5.92 | | | |
| Y79AA1000682 | 24.87 | 16.17 | 18.30 | 22.46 | 26.14 | 12.58 | 16.87 | 20.51 | 20.51 | | | |
| Y79AA1000683 | 15.32 | 7.96 | 8.21 | 6.64 | 7.38 | 6.63 | 4.88 | 6.13 | 6.13 | | | |
| Y79AA1000697 | 54.8 | 30.85 | 37.16 | 42.84 | 41.24 | 37.90 | 36.31 | 42.61 | 42.61 | | | |
| Y79AA1000700 | 9.78 | 3.97 | 5.64 | 3.6 | 3.66 | 3.51 | 4.90 | 7.29 | 7.29 | | | |
| Y79AA1000702 | 17.82 | 9.90 | 9.05 | 9.33 | 10.05 | 8.49 | 5.94 | 9.28 | 9.28 | | | |
| Y79AA1000704 | 2.05 | 0.88 | 1.35 | 0.9 | 1.80 | 0.91 | 1.41 | 1.66 | 1.66 | | | |
| Y79AA1000705 | 2.45 | 1.63 | 1.24 | 3.99 | 2.73 | 3.50 | 2.26 | 2.26 | 2.26 | * | + | |
| Y79AA1000717 | 11.47 | 6.51 | 7.68 | 14.26 | 8.53 | 10.93 | 5.99 | 11.28 | 11.28 | | | |
| Y79AA1000722 | 6.59 | 5.15 | 4.02 | 3.83 | 3.18 | 4.48 | 1.26 | 1.65 | 1.65 | | ** | − |

TABLE 337

| ID | 1 | 2 | 3 | 4 | 5 | 6 | 7 | 8 | 9 | 10 | 11 | 12 | 13 |
|---|---|---|---|---|---|---|---|---|---|---|---|---|---|
| Y79AA1000724 | 28.17 | 13.18 | 13.80 | 13.88 | 13.98 | 11.98 | 3.06 | 4.28 | 4.28 | | | * | − |
| Y79AA1000726 | 8.11 | 5.46 | 4.24 | 6.09 | 4.77 | 4.52 | 5.43 | 7.82 | 7.82 | | | | |
| Y79AA1000734 | 3.88 | 2.62 | 2.34 | 5.17 | 3.55 | 4.31 | 2.92 | 6.05 | 6.05 | | | | |
| Y79AA1000748 | 3.95 | 1.81 | 1.83 | 2.64 | 2.02 | 2.92 | 1.57 | 2.24 | 2.24 | | | | |
| Y79AA1000750 | 10.39 | 6.10 | 4.86 | 9.81 | 8.59 | 9.78 | 5.43 | 7.43 | 7.43 | | | | |
| Y79AA1000752 | 2.87 | 0.53 | 1.08 | 2.54 | 2.81 | 2.11 | 1.32 | 1.59 | 1.59 | | | | |
| Y79AA1000774 | 5.72 | 4.59 | 2.86 | 2.14 | 2.79 | 5.77 | 3.53 | 3.76 | 3.76 | | | | |
| Y79AA1000776 | 4.35 | 4.36 | 2.86 | 3.71 | 4.12 | 5.01 | 3.48 | 3.30 | 3.3 | | | | |
| Y79AA1000777 | 11.76 | 6.21 | 5.54 | 8.56 | 11.90 | 10.17 | 6.16 | 6.66 | 6.66 | | | | |
| Y79AA1000778 | 13.22 | 6.87 | 8.41 | 14.77 | 13.90 | 13.40 | 7.19 | 13.72 | 13.72 | | | | |
| Y79AA1000782 | 7.86 | 4.93 | 5.51 | 5.52 | 4.90 | 5.05 | 5.46 | 7.23 | 7.23 | | | | |
| Y79AA1000784 | 12.43 | 9.12 | 11.59 | 13 | 14.52 | 14.46 | 11.05 | 11.31 | 11.31 | | | | |
| Y79AA1000794 | 4.35 | 2.95 | 2.89 | 4.43 | 4.95 | 3.90 | 3.24 | 3.10 | 3.1 | | | | |
| Y79AA1000800 | 2.57 | 2.36 | 2.08 | 3 | 3.32 | 3.30 | 2.93 | 3.69 | 3.69 | ** | + | * | + |
| Y79AA1000802 | 1.85 | 1.48 | 1.65 | 1 | 0.76 | 1.64 | 0.34 | 1.23 | 1.23 | | | | |
| Y79AA1000805 | 4.24 | 3.55 | 2.28 | 3.22 | 3.19 | 3.89 | 2.71 | 4.15 | 4.15 | | | | |
| Y79AA1000814 | 14.61 | 9.83 | 7.28 | 9.51 | 9.83 | 6.77 | 3.86 | 4.30 | 4.3 | | | * | − |
| Y79AA1000823 | 12.6 | 9.53 | 9.56 | 15.44 | 14.21 | 12.23 | 9.08 | 15.12 | 15.12 | | | | |
| Y79AA1000824 | 4.44 | 3.44 | 2.16 | 2.49 | 3.58 | 2.72 | 2.72 | 3.74 | 3.74 | | | | |
| Y79AA1000827 | 3.1 | 1.46 | 1.84 | 2.99 | 1.29 | 1.77 | 1.89 | 2.61 | 2.61 | | | | |
| Y79AA1000831 | 5.49 | 4.85 | 5.37 | 3.74 | 4.89 | 3.85 | 3.76 | 5.38 | 5.38 | | | | |
| Y79AA1000833 | 40.22 | 31.45 | 37.17 | 40.96 | 46.51 | 50.53 | 34.20 | 40.04 | 40.04 | | | | |
| Y79AA1000850 | 2.09 | 2.81 | 2.57 | 4.27 | 3.76 | 4.02 | 3.33 | 2.26 | 2.26 | ** | + | | |
| Y79AA1000856 | 6.74 | 5.50 | 6.27 | 7.85 | 6.17 | 10.60 | 4.73 | 5.48 | 5.48 | | | | |
| Y79AA1000862 | 12.52 | 7.78 | 4.39 | 13.89 | 9.86 | 8.13 | 7.63 | 7.94 | 7.94 | | | | |
| Y79AA1000876 | 8.46 | 4.16 | 4.01 | 6.87 | 6.89 | 6.26 | 3.75 | 5.07 | 5.07 | | | | |
| Y79AA1000888 | 1.47 | 1.34 | 1.40 | 1.56 | 1.46 | 1.29 | 1.98 | 1.99 | 1.99 | | | ** | + |
| Y79AA1000902 | 16.38 | 10.81 | 14.11 | 11.4 | 9.46 | 11.97 | 5.88 | 7.23 | 7.23 | | | * | − |
| Y79AA1000935 | 16.25 | 11.98 | 13.09 | 25.37 | 21.17 | 25.92 | 23.44 | 29.28 | 29.28 | ** | + | ** | + |
| Y79AA1000959 | 3.1 | 2.66 | 3.26 | 3.18 | 3.69 | 2.84 | 2.68 | 4.50 | 4.5 | | | | |
| Y79AA1000962 | 1.8 | 2.34 | 1.77 | 4.45 | 3.80 | 4.94 | 2.33 | 2.34 | 2.34 | ** | + | | |
| Y79AA1000963 | 43.49 | 20.23 | 23.14 | 40.9 | 40.35 | 45.98 | 17.97 | 19.24 | 19.24 | | | | |
| Y79AA1000966 | 8 | 6.62 | 3.05 | 7.53 | 7.98 | 4.56 | 6.48 | 5.59 | 5.59 | | | | |
| Y79AA1000967 | 11.14 | 8.37 | 5.21 | 15.29 | 15.02 | 10.80 | 8.86 | 10.67 | 10.67 | | | | |
| Y79AA1000968 | 11.05 | 6.63 | 3.78 | 6.32 | 9.03 | 6.81 | 4.66 | 7.08 | 7.08 | | | | |
| Y79AA1000969 | 4.13 | 3.63 | 3.19 | 4.09 | 3.12 | 3.96 | 2.88 | 4.11 | 4.11 | | | | |
| Y79AA1000976 | 2.07 | 1.66 | 1.63 | 2.46 | 2.43 | 2.76 | 3.14 | 3.14 | 3.14 | * | + | * | + |
| Y79AA1000978 | 3.15 | 2.68 | 2.59 | 3.19 | 2.43 | 2.99 | 1.56 | 2.57 | 2.57 | | | | |
| Y79AA1000985 | 4.53 | 6.21 | 3.11 | 9.92 | 6.66 | 7.93 | 4.84 | 4.19 | 4.19 | | | | |
| Y79AA1000989 | 27.14 | 18.46 | 21.17 | 22.61 | 22.40 | 25.64 | 17.86 | 17.83 | 17.83 | | | | |
| Y79AA1000991 | 14.41 | 7.65 | 8.70 | 14.5 | 16.91 | 8.11 | 10.68 | 10.04 | 10.04 | | | | |
| Y79AA1001013 | 35.7 | 19.64 | 14.11 | 24.63 | 29.38 | 32.01 | 18.46 | 27.65 | 27.65 | | | | |
| Y79AA1001014 | 8.41 | 5.13 | 3.58 | 6.96 | 7.27 | 8.35 | 6.51 | 8.47 | 8.47 | | | | |
| Y79AA1001019 | 6.41 | 3.32 | 4.05 | 4.98 | 4.88 | 5.75 | 4.58 | 5.04 | 5.04 | | | | |
| Y79AA1001020 | 13.26 | 4.81 | 6.74 | 9.29 | 9.05 | 11.19 | 6.66 | 10.83 | 10.83 | | | | |
| Y79AA1001023 | 3.99 | 2.27 | 3.29 | 3.71 | 4.41 | 3.42 | 4.24 | 3.90 | 3.9 | | | | |
| Y79AA1001030 | 4.36 | 2.82 | 3.64 | 7.73 | 6.53 | 9.26 | 7.69 | 8.68 | 8.68 | ** | + | ** | + |
| Y79AA1001035 | −0.01 | 7.25 | 7.50 | 9.11 | 6.84 | 10.21 | 7.88 | 15.95 | 15.95 | | | | |
| Y79AA1001041 | 8.33 | 4.39 | 3.51 | 5.69 | 4.65 | 4.21 | 2.70 | 5.79 | 5.79 | | | | |
| Y79AA1001043 | 18.02 | 12.74 | 10.03 | 8.74 | 8.44 | 9.66 | 9.73 | 11.39 | 11.39 | | | | |
| Y79AA1001048 | 5.98 | 4.37 | 5.02 | 5.57 | 4.35 | 5.46 | 5.24 | 5.86 | 5.86 | | | | |
| Y79AA1001056 | 2.8 | 1.67 | 2.69 | 4.83 | 3.64 | 3.93 | 2.91 | 3.52 | 3.52 | * | + | | |
| Y79AA1001061 | 4.66 | 2.07 | 2.99 | 8.42 | 5.16 | 8.18 | 3.38 | 5.08 | 5.08 | * | + | | |
| Y79AA1001062 | 4.59 | 1.72 | 3.28 | 8.74 | 7.23 | 9.33 | 3.95 | 5.55 | 5.55 | ** | + | | |
| Y79AA1001068 | 7.33 | 4.55 | 5.57 | 10.85 | 9.20 | 12.48 | 5.68 | 6.64 | 6.64 | * | + | | |
| Y79AA1001073 | 12.4 | 6.75 | 7.01 | 7.75 | 5.93 | 9.79 | 5.80 | 7.72 | 7.72 | | | | |

TABLE 338

| ID | 1 | 2 | 3 | 4 | 5 | 6 | 7 | 8 | 9 | 10 | 11 | 12 | 13 |
|---|---|---|---|---|---|---|---|---|---|---|---|---|---|
| Y79AA1001077 | 11.3 | 7.81 | 9.27 | 10.02 | 10.61 | 11.75 | 11.20 | 11.01 | 11.01 | | | | |
| Y79AA1001078 | 2.85 | 2.15 | 2.01 | 4.62 | 7.48 | 2.90 | 4.22 | 3.26 | 3.26 | | | * | + |
| Y79AA1001081 | 16.61 | 9.85 | 12.79 | 10 | 10.38 | 11.30 | 5.81 | 7.08 | 7.08 | | | * | − |
| Y79AA1001088 | 26.22 | 15.63 | 20.41 | 21.72 | 24.28 | 26.25 | 25.14 | 31.31 | 31.31 | | | | |
| Y79AA1001089 | 11.17 | 5.53 | 8.30 | 9.49 | 6.56 | 8.41 | 9.43 | 10.79 | 10.79 | | | | |
| Y79AA1001090 | 4.51 | 2.54 | 4.20 | 6.81 | 5.20 | 6.61 | 4.39 | 5.95 | 5.95 | * | + | | |
| Y79AA1001105 | 27.01 | 7.71 | 19.38 | 6.68 | 4.28 | 6.75 | 6.37 | 6.27 | 6.27 | | | | |
| Y79AA1001142 | 8.95 | 5.63 | 7.03 | 5.98 | 7.11 | 5.88 | 10.76 | 13.80 | 13.8 | | | * | + |
| Y79AA1001145 | 11.65 | 9.12 | 8.63 | 15.01 | 11.35 | 17.02 | 8.48 | 10.99 | 10.99 | | | | |
| Y79AA1001162 | 4.06 | 1.39 | 1.51 | 5.09 | 3.87 | 3.44 | 4.59 | 3.13 | 3.13 | | | | |
| Y79AA1001167 | 7.25 | 3.07 | 2.49 | 5.01 | 3.56 | 4.46 | 3.63 | 5.24 | 5.24 | | | | |
| Y79AA1001176 | 4.11 | 2.23 | 2.70 | 4.09 | 2.43 | 5.22 | 2.25 | 2.60 | 2.6 | | | | |
| Y79AA1001177 | 4.68 | 4.25 | 4.38 | 3.59 | 3.61 | 5.91 | 4.61 | 3.71 | 3.71 | | | | |
| Y79AA1001179 | 21.68 | 16.62 | 20.48 | 11.99 | 9.19 | 16.21 | 8.81 | 11.14 | 11.14 | * | − | * | − |
| Y79AA1001185 | 5.31 | 2.79 | 3.61 | 5.39 | 3.59 | 5.46 | 3.84 | 4.29 | 4.29 | | | | |
| Y79AA1001201 | 28.52 | 17.14 | 23.93 | 16.35 | 22.62 | 37.53 | 18.59 | 26.16 | 26.16 | | | | |
| Y79AA1001205 | 10.97 | 3.75 | 3.90 | 5.2 | 4.84 | 4.63 | 3.49 | 3.72 | 3.72 | | | | |

TABLE 338-continued

| | | | | | | | | | | | | |
|---|---|---|---|---|---|---|---|---|---|---|---|---|
| Y79AA1001211 | 11.99 | 5.80 | 6.48 | 8.33 | 12.82 | 9.17 | 4.23 | 4.74 | 4.74 | | | |
| Y79AA1001212 | 7.31 | 3.41 | 4.24 | 5.88 | 4.00 | 4.88 | 4.13 | 6.49 | 6.49 | | | |
| Y79AA1001216 | 55.35 | 32.24 | 33.00 | 52.32 | 49.82 | 57.61 | 27.61 | 40.72 | 40.72 | | | |
| Y79AA1001228 | 9.47 | 5.39 | 6.44 | 9.83 | 8.83 | 13.70 | 14.26 | 14.88 | 14.88 | | ** | + |
| Y79AA1001233 | 7.94 | 5.13 | 5.27 | 5.47 | 5.22 | 5.58 | 6.11 | 7.96 | 7.96 | | | |
| Y79AA1001236 | 9.41 | 4.91 | 6.23 | 8.19 | 6.64 | 8.01 | 4.19 | 7.99 | 7.99 | | | |
| Y79AA1001239 | 17.51 | 11.16 | 12.48 | 23.85 | 15.23 | 20.67 | 15.26 | 22.26 | 22.26 | | | |
| Y79AA1001240 | 6.74 | 4.58 | 4.53 | 7.09 | 6.25 | 7.67 | 6.30 | 7.17 | 7.17 | | | |
| Y79AA1001255 | 11.62 | 4.94 | 6.87 | 6.84 | 9.34 | 6.89 | 3.77 | 5.35 | 5.35 | | | |
| Y79AA1001264 | 8.92 | 4.36 | 4.37 | 5.15 | 4.83 | 5.09 | 6.25 | 11.76 | 11.76 | | | |
| Y79AA1001272 | 16.07 | 9.52 | 9.48 | 17.58 | 13.84 | 18.59 | 12.50 | 13.21 | 13.21 | | | |
| Y79AA1001281 | 2.39 | 1.46 | 1.20 | 2.86 | 1.50 | 1.94 | 1.67 | 2.71 | 2.71 | | | |
| Y79AA1001299 | 15.84 | 12.69 | 13.71 | 17.01 | 14.77 | 25.21 | 17.79 | 21.80 | 21.8 | | * | + |
| Y79AA1001312 | 7.69 | 3.18 | 3.48 | 9.46 | 10.75 | 7.56 | 6.31 | 5.09 | 5.09 | | | |
| Y79AA1001319 | 9.18 | 6.58 | 8.51 | 11.43 | 8.41 | 10.88 | 8.28 | 9.95 | 9.95 | | | |
| Y79AA1001323 | 5.8 | 3.74 | 3.41 | 4.67 | 5.59 | 4.56 | 4.04 | 5.77 | 5.77 | | | |
| Y79AA1001328 | 9.21 | 5.33 | 4.01 | 6.44 | 6.42 | 8.24 | 6.73 | 9.42 | 9.42 | | | |
| Y79AA1001343 | 862.89 | 462.45 | 576.89 | 529.68 | 551.94 | 571.68 | 1081.07 | 1529.21 | 1529 | | * | + |
| Y79AA1001351 | 1.98 | 0.57 | 1.69 | 0.7 | 1.23 | 1.95 | 1.38 | 2.51 | 2.51 | | | |
| Y79AA1001364 | 13.67 | 8.79 | 10.09 | 17.42 | 16.54 | 19.67 | 6.03 | 14.83 | 14.83 | * | + | |
| Y79AA1001367 | 6.28 | 4.16 | 4.34 | 5.94 | 4.67 | 6.56 | 4.76 | 4.90 | 4.9 | | | |
| Y79AA1001384 | 1.87 | 1.73 | 1.53 | 1.86 | 1.16 | 2.08 | 1.66 | 1.46 | 1.46 | | | |
| Y79AA1001391 | 3.6 | 2.56 | 1.82 | 3.57 | 3.95 | 4.39 | 3.23 | 2.67 | 2.67 | | | |
| Y79AA1001394 | 7.58 | 3.85 | 2.91 | 6.13 | 4.47 | 4.34 | 2.98 | 3.74 | 3.74 | | | |
| Y79AA1001402 | 14.12 | 9.28 | 8.02 | 15.91 | 14.24 | 20.22 | 15.90 | 16.49 | 16.49 | | * | + |
| Y79AA1001410 | 6.61 | 3.47 | 3.47 | 4.7 | 4.77 | 5.26 | 4.23 | 5.49 | 5.49 | | | |
| Y79AA1001414 | 4.82 | 2.47 | 3.52 | 4.85 | 3.10 | 4.46 | 3.68 | 4.21 | 4.21 | | | |
| Y79AA1001426 | 6.98 | 4.46 | 5.28 | 4.95 | 5.72 | 4.24 | 5.87 | 6.84 | 6.84 | | | |
| Y79AA1001427 | 3.95 | 3.35 | 3.13 | 5.95 | 6.19 | 3.76 | 4.11 | 6.23 | 6.23 | | | |
| Y79AA1001430 | 3.36 | 4.23 | 3.56 | 4.36 | 4.28 | 5.52 | 6.35 | 7.62 | 7.62 | | ** | + |
| Y79AA1001439 | 4.05 | 2.77 | 2.23 | 5.27 | 3.53 | 5.80 | 5.59 | 7.03 | 7.03 | | ** | + |
| Y79AA1001485 | 1.52 | 0.56 | 1.47 | 1.8 | 1.02 | 1.80 | 1.03 | 1.44 | 1.44 | | | |
| Y79AA1001493 | 1.38 | 0.86 | 0.94 | 2.07 | 2.04 | 2.30 | 1.06 | 3.12 | 3.12 | ** | + | |
| Y79AA1001511 | 7.88 | 6.25 | 4.30 | 5.78 | 8.49 | 6.85 | 6.79 | 10.70 | 10.7 | | | |
| Y79AA1001523 | 10.75 | 7.00 | 5.10 | 7.67 | 3.96 | 7.11 | 7.19 | 5.22 | 5.22 | | | |
| Y79AA1001530 | 6.54 | 3.62 | 3.97 | 4.77 | 5.40 | 7.25 | 5.26 | 7.92 | 7.92 | | | |
| Y79AA1001532 | 4.4 | 3.73 | 3.24 | 7.17 | 5.68 | 6.14 | 4.71 | 4.96 | 4.96 | * | + | * | + |
| Y79AA1001533 | 5.01 | 4.00 | 3.23 | 3.96 | 6.97 | 7.08 | 2.96 | 4.09 | 4.09 | | | |
| Y79AA1001541 | 12.19 | 9.13 | 10.66 | 12.21 | 12.80 | 16.01 | 5.59 | 5.41 | 5.41 | | ** | − |

TABLE 339

| | | | | | | | | | | | | | |
|---|---|---|---|---|---|---|---|---|---|---|---|---|---|
| Y79AA1001548 | 10.61 | 7.08 | 4.15 | 16.42 | 14.68 | 15.82 | 9.30 | 9.38 | 9.38 | * | + | | |
| Y79AA1001555 | 7.52 | 5.37 | 3.80 | 6.53 | 5.95 | 5.70 | 7.04 | 7.00 | 7 | | | | |
| Y79AA1001562 | 13.12 | 10.40 | 12.01 | 18.73 | 17.97 | 15.42 | 12.97 | 18.83 | 18.83 | * | + | | |
| Y79AA1001581 | 2.59 | 2.12 | 1.33 | 2.27 | 2.33 | 1.95 | 1.31 | 2.40 | 2.4 | | | | |
| Y79AA1001585 | 1.89 | 1.52 | 2.52 | 3.13 | 3.14 | 3.51 | 2.68 | 3.89 | 3.89 | * | + | * | + |
| Y79AA1001592 | 8.75 | 5.76 | 6.22 | 9.06 | 9.03 | 12.16 | 6.95 | 10.71 | 10.71 | | | | |
| Y79AA1001594 | 2.44 | 2.99 | 2.99 | 4.89 | 6.76 | 6.84 | 2.08 | 3.52 | 3.52 | ** | + | | |
| Y79AA1001603 | 41.01 | 29.22 | 27.39 | 35.33 | 47.15 | 41.79 | 19.68 | 22.24 | 22.24 | | | | |
| Y79AA1001613 | 11.06 | 8.37 | 6.50 | 10.25 | 10.82 | 7.55 | 6.69 | 6.52 | 6.52 | | | | |
| Y79AA1001630 | 0.95 | 0.54 | 0.85 | 1.19 | 0.72 | 0.95 | 1.19 | 0.88 | 0.88 | | | | |
| Y79AA1001647 | 6.2 | 2.96 | 3.68 | 2.82 | 5.76 | 5.40 | 3.17 | 4.07 | 4.07 | | | | |
| Y79AA1001664 | 13.85 | 6.76 | 7.31 | 10.57 | 12.90 | 8.91 | 7.51 | 7.68 | 7.68 | | | | |
| Y79AA1001665 | 3.6 | 3.81 | 4.37 | 4.15 | 4.52 | 5.51 | 3.17 | 4.23 | 4.23 | | | | |
| Y79AA1001679 | 14 | 9.57 | 9.87 | 11.81 | 14.25 | 13.41 | 7.94 | 7.63 | 7.63 | | | | |
| Y79AA1001692 | 3.06 | 2.79 | 3.66 | 3.62 | 3.64 | 6.60 | 2.78 | 2.76 | 2.76 | | | | |
| Y79AA1001696 | 0.47 | 0.94 | 0.29 | 1.8 | 1.18 | 2.00 | 1.48 | 1.81 | 1.81 | * | + | * | + |
| Y79AA1001705 | 5.59 | 4.16 | 3.52 | 5.12 | 5.14 | 5.00 | 3.05 | 4.02 | 4.02 | | | | |
| Y79AA1001711 | 17.19 | 10.51 | 9.53 | 37.34 | 40.06 | 24.12 | 26.85 | 27.39 | 27.39 | * | + | * | + |
| Y79AA1001717 | 1.38 | 0.95 | 0.69 | 2.28 | 1.17 | 1.95 | 0.86 | 2.01 | 2.01 | | | | |
| Y79AA1001719 | 3.1 | 2.90 | 1.65 | 4.96 | 4.48 | 2.69 | 2.06 | 2.48 | 2.48 | | | | |
| Y79AA1001727 | 5.47 | 4.87 | 4.29 | 8.17 | 8.05 | 7.12 | 4.94 | 6.45 | 6.45 | ** | + | | |
| Y79AA1001750 | 20.76 | 27.54 | 23.83 | 38.95 | 38.37 | 32.83 | 22.83 | 25.62 | 25.62 | * | + | | |
| Y79AA1001760 | 6.22 | 6.83 | 3.78 | 10.14 | 8.09 | 8.51 | 8.09 | 4.11 | 4.11 | * | + | | |
| Y79AA1001777 | 4.19 | 4.98 | 4.30 | 10.69 | 9.61 | 8.63 | 5.89 | 5.49 | 5.49 | ** | + | * | + |
| Y79AA1001781 | 1.41 | (0.02) | 0.49 | 0.49 | 0.41 | 1.88 | 0.28 | 0.56 | 0.56 | | | | |
| Y79AA1001787 | 6.73 | 4.26 | 4.09 | 6.64 | 5.23 | 7.45 | 4.25 | 5.24 | 5.24 | | | | |
| Y79AA1001793 | 7.3 | 4.12 | 4.31 | 5.83 | 5.04 | 3.68 | 5.12 | 4.48 | 4.48 | | | | |
| Y79AA1001795 | 3 | 0.80 | 2.09 | 2.69 | 3.85 | 3.29 | 1.73 | 3.18 | 3.18 | | | | |
| Y79AA1001799 | 5.26 | 2.91 | 2.67 | 5.21 | 5.65 | 6.10 | 3.13 | 5.77 | 5.77 | | | | |
| Y79AA1001800 | 4.16 | 2.57 | 3.82 | 5.16 | 2.55 | 3.90 | 3.53 | 6.79 | 6.79 | | | | |
| Y79AA1001801 | 6.56 | 3.89 | 3.46 | 8.87 | 3.49 | 7.02 | 3.18 | 4.68 | 4.68 | | | | |
| Y79AA1001803 | 6.72 | 4.12 | 3.95 | 5.51 | 7.22 | 5.68 | 5.48 | 5.55 | 5.55 | | | | |
| Y79AA1001805 | 22.35 | 9.91 | 10.35 | 15.2 | 27.86 | 21.20 | 9.25 | 13.14 | 13.14 | | | | |
| Y79AA1001807 | 6.96 | 2.99 | 4.40 | 6.3 | 4.51 | 3.72 | 4.95 | 5.25 | 5.25 | | | | |

TABLE 339-continued

| | | | | | | | | | | | | |
|---|---|---|---|---|---|---|---|---|---|---|---|---|
| Y79AA1001827 | 8.38 | 3.69 | 5.67 | 7.55 | 7.81 | 11.23 | 9.11 | 12.46 | 12.46 | | * | + |
| Y79AA1001846 | 4.45 | 2.15 | 3.75 | 6.2 | 4.92 | 5.41 | 3.96 | 7.82 | 7.82 | | | |
| Y79AA1001848 | 2.85 | 1.48 | 2.40 | 3.01 | 2.43 | 2.61 | 2.57 | 2.46 | 2.46 | | | |
| Y79AA1001853 | 13.89 | 10.72 | 11.89 | 14.4 | 8.43 | 13.46 | 12.95 | 13.31 | 13.31 | | | |
| Y79AA1001863 | 15.14 | 7.58 | 9.41 | 15.02 | 11.89 | 14.02 | 8.02 | 12.33 | 12.33 | | | |
| Y79AA1001866 | 9.57 | 4.75 | 5.85 | 11.97 | 24.49 | 9.54 | 5.28 | 9.21 | 9.21 | | | |
| Y79AA1001874 | 1.66 | 0.73 | 0.26 | 0.48 | 1.10 | 0.61 | 0.67 | 0.63 | 0.63 | | | |
| Y79AA1001875 | 9 | 6.56 | 7.74 | 8.02 | 10.17 | 8.54 | 9.22 | 11.36 | 11.36 | | * | + |
| Y79AA1001907 | 117.42 | 47.16 | 76.24 | 98.59 | 98.47 | 94.40 | 33.03 | 51.77 | 51.77 | | | |
| Y79AA1001908 | 2.02 | 0.84 | 1.62 | 1.52 | 1.88 | 1.08 | 1.03 | 1.18 | 1.18 | | | |
| Y79AA1001923 | 4.54 | 1.74 | 1.64 | 1.87 | 1.96 | 1.62 | 3.56 | 1.90 | 1.9 | | | |
| Y79AA1001927 | 7.1 | 4.39 | 6.61 | 6.81 | 4.65 | 6.65 | 7.02 | 7.63 | 7.63 | | | |
| Y79AA1001930 | 11.14 | 5.72 | 8.19 | 8.38 | 8.79 | 9.40 | 6.07 | 5.53 | 5.53 | | | |
| Y79AA1001932 | 4.55 | 2.74 | 2.35 | 3.75 | 4.07 | 2.57 | 2.61 | 2.55 | 2.55 | | | |
| Y79AA1001933 | 5.44 | 2.77 | 4.71 | 4.94 | 5.23 | 2.92 | 4.54 | 4.08 | 4.08 | | | |
| Y79AA1001942 | 5.27 | 2.57 | 3.54 | 3.47 | 2.89 | 2.27 | 3.23 | 4.03 | 4.03 | | | |
| Y79AA1001963 | 16.6 | 6.83 | 11.89 | 12.17 | 15.10 | 11.74 | 8.04 | 11.18 | 11.18 | | | |
| Y79AA1001968 | 19.06 | 9.81 | 14.73 | 19.14 | 20.00 | 14.84 | 13.89 | 19.22 | 19.22 | | | |
| Y79AA1001983 | 8.12 | 2.93 | 5.67 | 4.13 | 3.77 | 4.79 | 3.53 | 4.78 | 4.78 | | | |
| Y79AA1002000 | 8.2 | 3.32 | 3.60 | 7.79 | 5.70 | 5.11 | 5.48 | 4.05 | 4.05 | | | |
| Y79AA1002004 | 31.21 | 14.32 | 20.67 | 18.62 | 19.17 | 22.54 | 12.67 | 21.19 | 21.19 | | | |
| Y79AA1002008 | 6.53 | 5.69 | 5.73 | 9.64 | 7.46 | 8.70 | 4.99 | 6.08 | 6.08 | * | + | |

TABLE 340

| | | | | | | | | | | | | |
|---|---|---|---|---|---|---|---|---|---|---|---|---|
| Y79AA1002012 | 3.88 | 1.69 | 1.78 | 4.4 | 6.99 | 4.19 | 2.25 | 2.80 | 2.8 | | | |
| Y79AA1002017 | 4.13 | 2.53 | 3.93 | 3.44 | 3.03 | 1.90 | 3.46 | 3.57 | 3.57 | | | |
| Y79AA1002022 | 14.79 | 9.29 | 9.45 | 11.91 | 10.49 | 14.24 | 13.65 | 16.25 | 16.25 | | | |
| Y79AA1002027 | 2.08 | 0.73 | 0.78 | 2.44 | 1.84 | 1.40 | 2.55 | 2.70 | 2.7 | | * | + |
| Y79AA1002050 | 9.08 | 4.52 | 6.60 | 9.28 | 6.06 | 9.49 | 5.33 | 7.52 | 7.52 | | | |
| Y79AA1002058 | 11.36 | 5.78 | 6.33 | 12.51 | 9.30 | 13.02 | 7.69 | 9.93 | 9.93 | | | |
| Y79AA1002060 | 25.88 | 13.74 | 19.34 | 20.14 | 18.93 | 22.49 | 14.01 | 18.58 | 18.58 | | | |
| Y79AA1002062 | 13.71 | 6.57 | 6.87 | 16.86 | 16.66 | 14.29 | 6.71 | 8.83 | 8.83 | * | + | |
| Y79AA1002065 | 12.17 | 6.23 | 5.09 | 7.95 | 5.75 | 3.68 | 6.63 | 7.77 | 7.77 | | | |
| Y79AA1002067 | 14.5 | 8.32 | 9.44 | 2.21 | 3.03 | 2.42 | 3.46 | 4.06 | 4.06 | * | − | * | − |
| Y79AA1002069 | 7.51 | 3.78 | 4.23 | 4.94 | 4.88 | 2.84 | 3.88 | 6.24 | 6.24 | | | |
| Y79AA1002070 | 60.51 | 38.18 | 52.01 | 44.77 | 31.84 | 34.13 | 26.73 | 37.56 | 37.56 | | | |
| Y79AA1002074 | 151.4 | 80.88 | 106.02 | 132.97 | 122.53 | 136.83 | 70.79 | 85.36 | 85.36 | | | |
| Y79AA1002076 | 2.73 | 1.63 | 2.34 | 2.2 | 2.35 | 2.60 | 2.59 | 2.75 | 2.75 | | | |
| Y79AA1002083 | 5 | 2.28 | 2.46 | 3.91 | 2.83 | 3.75 | 3.56 | 3.71 | 3.71 | | | |
| Y79AA1002084 | 5.09 | 3.13 | 3.51 | 5.26 | 3.68 | 3.36 | 3.65 | 3.99 | 3.99 | | | |
| Y79AA1002086 | 7.09 | 2.92 | 3.98 | 4.7 | 3.74 | 3.75 | 3.43 | 4.46 | 4.46 | | | |
| Y79AA1002087 | 17.27 | 8.44 | 10.83 | 14.51 | 15.32 | 11.91 | 7.90 | 9.56 | 9.56 | | | |
| Y79AA1002089 | 5.98 | 2.23 | 2.36 | 4.43 | 5.76 | 5.05 | 4.46 | 3.99 | 3.99 | | | |
| Y79AA1002093 | 4.42 | 1.41 | 2.73 | 3.3 | 2.91 | 3.64 | 2.40 | 3.24 | 3.24 | | | |
| Y79AA1002101 | 7.66 | 3.43 | 4.43 | 3.23 | 2.81 | 2.96 | 1.93 | 9.08 | 9.08 | | | |
| Y79AA1002103 | 9.64 | 4.31 | 6.49 | 12.68 | 13.50 | 19.90 | 7.83 | 9.63 | 9.63 | * | + | |
| Y79AA1002115 | 6.16 | 3.44 | 3.46 | 8.76 | 8.88 | 8.21 | 5.06 | 7.31 | 7.31 | * | + | |
| Y79AA1002121 | 4.13 | 1.90 | 2.75 | 5.52 | 3.99 | 4.66 | 2.99 | 2.94 | 2.94 | | | |
| Y79AA1002125 | 12.29 | 7.02 | 6.63 | 8.98 | 11.00 | 7.52 | 5.97 | 9.22 | 9.22 | | | |
| Y79AA1002129 | 4.01 | 2.55 | 2.79 | 4.98 | 5.25 | 5.00 | 4.43 | 4.07 | 4.07 | * | + | |
| Y79AA1002131 | 3.98 | 1.83 | 2.10 | 2.08 | 2.08 | 3.32 | 2.24 | 4.89 | 4.89 | | | |
| Y79AA1002139 | 1.73 | 1.39 | 1.53 | 2.67 | 1.39 | 3.06 | 1.75 | 4.33 | 4.33 | | | |
| Y79AA1002144 | 13.61 | 9.16 | 11.69 | 45.27 | 42.86 | 41.51 | 20.24 | 31.90 | 31.9 | ** | + | * | + |
| Y79AA1002177 | 11.17 | 7.99 | 8.29 | 8.46 | 8.96 | 11.14 | 8.89 | 10.57 | 10.57 | | | |
| Y79AA1002183 | 2.07 | 16.65 | 16.79 | 14.07 | 13.54 | 11.10 | 9.93 | 9.44 | 9.44 | * | − | ** | − |
| Y79AA1002202 | 16.44 | 8.10 | 6.76 | 14 | 14.11 | 9.08 | 7.13 | 7.42 | 7.42 | | | |
| Y79AA1002204 | 6.31 | 4.49 | 4.52 | 4.3 | 4.77 | 3.13 | 5.10 | 6.00 | 6 | | | |
| Y79AA1002206 | 3.17 | 2.15 | 1.77 | 3.09 | 3.03 | 2.45 | 3.04 | 3.50 | 3.5 | | | |
| Y79AA1002208 | 5.15 | 2.57 | 2.96 | 5.99 | 4.60 | 5.97 | 4.50 | 4.63 | 4.63 | | | |
| Y79AA1002209 | 3.58 | 4.01 | 5.76 | 4.15 | 3.13 | 3.39 | 4.99 | 7.55 | 7.55 | | | |
| Y79AA1002210 | 3.18 | 1.43 | 2.37 | 3.02 | 2.02 | 1.71 | 2.10 | 2.41 | 2.41 | | | |
| Y79AA1002211 | 4.91 | 3.46 | 4.17 | 4.11 | 5.81 | 4.91 | 5.34 | 5.38 | 5.38 | | * | + |
| Y79AA1002213 | 3.71 | 2.49 | 1.89 | 7.09 | 8.26 | 4.18 | 2.61 | 4.10 | 4.1 | * | + | |
| Y79AA100ZZ15 | 12.98 | 6.72 | 6.55 | 11.46 | 10.70 | 7.31 | 10.62 | 11.29 | 11.29 | | | |
| Y79AA1002220 | 3.6 | 0.24 | 1.50 | 2.1 | 2.24 | 1.13 | 3.21 | 3.17 | 3.17 | | | |
| Y79AA1002226 | 15.84 | 9.35 | 12.55 | 20.91 | 22.33 | 23.57 | 11.78 | 20.18 | 20.18 | ** | + | |
| Y79AA1002229 | 6.49 | 3.85 | 3.45 | 4.63 | 4.19 | 3.44 | 5.38 | 5.16 | 5.16 | | | |
| Y79AA1002234 | 3.86 | 2.44 | 4.84 | 4.04 | 4.91 | 5.32 | 5.97 | 5.64 | 5.64 | | * | + |
| Y79AA1002235 | 1.93 | 0.75 | 1.35 | 1.7 | 1.20 | 2.27 | 2.65 | 2.05 | 2.05 | | | |
| Y79AA1002246 | 2.63 | 2.09 | 2.74 | 2.5 | 3.97 | 3.37 | 2.34 | 1.90 | 1.9 | | | |
| Y79AA1002258 | 3.31 | 3.27 | 3.40 | 4.93 | 5.68 | 4.75 | 4.02 | 4.20 | 4.2 | ** | + | ** | + |
| Y79AA1002279 | 4.56 | 2.57 | 2.26 | 6.13 | 5.09 | 3.71 | 4.81 | 5.29 | 5.29 | | | |
| Y79AA1002292 | 6.26 | 3.04 | 2.73 | 4.57 | 5.32 | 3.62 | 2.90 | 5.67 | 5.67 | | | |
| Y79AA1002298 | 1.82 | 0.51 | 1.99 | 1.65 | 1.57 | 1.30 | 1.17 | 0.87 | 0.87 | | | |
| Y79AA1002307 | 5.23 | 1.97 | 1.83 | 2.94 | 3.94 | 2.54 | 2.69 | 3.59 | 3.59 | | | |

TABLE 340-continued

| | | | | | | | | | | | | |
|---|---|---|---|---|---|---|---|---|---|---|---|---|
| Y79AA1002309 | 1.73 | 1.34 | 1.76 | 1.52 | 3.43 | 2.98 | 1.67 | 1.76 | 1.76 | | | |
| Y79AA1002311 | 4.03 | 2.36 | 3.87 | 5 | 3.49 | 3.66 | 2.61 | 6.69 | 6.69 | | | |
| Y79AA1002334 | 2.47 | 4.14 | 2.46 | 2.65 | 3.80 | 4.63 | 2.18 | 3.21 | 3.21 | | | |
| Y79AA1002351 | 3.38 | 3.58 | 4.03 | 5.8 | 3.67 | 5.58 | 3.56 | 6.63 | 6.63 | | | |
| Y79AA1002355 | 7.23 | 3.03 | 2.25 | 63.68 | 74.46 | 52.07 | 46.06 | 44.44 | 44.44 | ** | + | ** | + |

TABLE 341

| | | | | | | | | | | | | |
|---|---|---|---|---|---|---|---|---|---|---|---|---|
| Y79AA1002361 | 5.46 | 3.35 | 2.57 | 6.5 | 7.83 | 6.14 | 2.75 | 4.60 | 4.6 | * | + | | |
| Y79AA1002365 | 1.93 | 1.66 | 1.86 | 2.93 | 2.21 | 2.54 | 1.34 | 2.05 | 2.05 | * | + | | |
| Y79AA1002373 | 3.38 | 1.43 | 1.37 | 3.37 | 3.29 | 2.38 | 2.95 | 2.21 | 2.21 | | | | |
| Y79AA1002376 | 434.81 | 300.04 | 466.40 | 120.28 | 171.61 | 120.00 | 316.81 | 454.58 | 454.6 | ** | − | | |
| Y79AA1002378 | 5.45 | 6.92 | 5.32 | 7.99 | 10.13 | 8.03 | 4.87 | 4.92 | 4.92 | * | + | | |
| Y79AA1002381 | 11.63 | 11.08 | 9.56 | 16.28 | 16.98 | 14.53 | 7.89 | 7.01 | 7.01 | ** | + | ** | − |
| Y79AA1002988 | 4.34 | 4.47 | 7.01 | 11.41 | 12.79 | 9.45 | 5.70 | 6.37 | 6.37 | * | + | | |
| Y79AA1002399 | 4.43 | 1.48 | 1.47 | 4.2 | 2.82 | 2.25 | 3.39 | 3.35 | 3.35 | | | | |
| Y79AA1002407 | 1.81 | 1.09 | 1.32 | 2.36 | 2.58 | 2.43 | 1.55 | 2.35 | 2.35 | ** | + | | |
| Y79AA1002413 | 15.88 | 6.76 | 10.60 | 19.95 | 26.46 | 17.33 | 9.58 | 12.56 | 12.56 | | | | |
| Y79AA1002416 | 5.12 | 2.89 | 2.97 | 4.45 | 4.32 | 5.10 | 4.13 | 4.19 | 4.19 | | | | |
| Y79AA1002429 | 2.82 | 1.17 | 1.77 | 2.75 | 1.85 | 2.91 | 4.10 | 5.62 | 5.62 | | | * | + |
| Y79AA1002431 | 4.04 | 2.82 | 3.86 | 2.55 | 4.38 | 4.86 | 4.06 | 5.56 | 5.56 | | | | |
| Y79AA1002433 | 11.76 | 5.78 | 6.28 | 9.49 | 4.53 | 7.78 | 4.34 | 8.17 | 8.17 | | | | |
| Y79AA1002445 | 10.95 | 9.11 | 9.11 | 11.15 | 8.78 | 14.80 | 10.37 | 11.14 | 11.14 | | | | |
| Y79AA1002461 | 10.04 | 5.58 | 4.92 | 9.55 | 8.99 | 8.05 | 5.89 | 7.75 | 7.75 | | | | |
| Y79AA1002466 | 22.18 | 13.94 | 11.33 | 23.59 | 18.02 | 25.25 | 10.79 | 17.76 | 17.76 | | | | |
| Y79AA1002471 | 5.76 | 3.00 | 5.65 | 6.94 | 8.49 | 9.26 | 5.31 | 7.89 | 7.89 | * | + | | |
| Y79AA1002472 | 12.12 | 5.83 | 9.20 | 16.86 | 14.60 | 20.34 | 6.74 | 12.38 | 12.38 | * | + | | |
| Y79AA1002474 | 3.46 | 0.84 | 1.92 | 1.74 | 1.49 | 1.64 | 2.77 | 1.35 | 1.35 | | | | |
| Y79AA1002482 | 13.92 | 8.55 | 11.10 | 23.82 | 23.90 | 29.62 | 10.40 | 14.99 | 14.99 | ** | + | | |
| Y79AA1002487 | 1.72 | 0.87 | 1.11 | 1.3 | 1.59 | 1.75 | 1.57 | 1.93 | 1.93 | | | | |
| Y79AA1002490 | 13.58 | 4.80 | 6.45 | 5.13 | 6.72 | 3.78 | 4.31 | 7.19 | 7.19 | | | | |
| Y79AA1002493 | 5.77 | 2.96 | 3.11 | 8.04 | 10.37 | 7.90 | 4.77 | 5.75 | 5.75 | * | + | | |
| ZRV6C1006278 | 1.43 | 0.95 | 1.01 | 1.16 | 2.05 | 0.47 | 1.35 | 2.06 | 2.06 | | | | |

The clone numbers shown in Tables 5–341 correspond to the respective PSEC clone numbers as follows:

| | |
|---|---|
| PSEC0001 | NT2RM1000066 |
| nnnnnnnn | nnnnnnnnnnnn |
| PSEC0005 | NT2RM1000566 |
| PSEC0007 | NT2RM1000634 |
| PSEC0008 | NT2RM1000726 |
| PSEC0012 | NT2RM1000853 |
| PSEC0017 | NT2RM1001103 |
| PSEC0019 | NT2RP1000125 |
| PSEC0020 | NT2RP1000255 |
| PSEC0021 | NT2RP1000279 |
| PSEC0028 | NT2RP1000533 |
| PSEC0029 | NT2RP1000544 |
| PSEC0030 | NT2RP1000567 |
| PSEC0031 | NT2RP1000593 |
| PSEC0035 | NT2RP1000769 |
| PSEC0038 | NT2RP1000837 |
| PSEC0040 | NT2RP1000905 |
| PSEC0041 | NT2RP1000921 |
| PSEC0045 | NT2RP1001023 |
| PSEC0048 | NT2RP2000028 |
| PSEC0049 | NT2RP2000116 |
| PSEC0051 | NT2RP2000168 |
| PSEC0052 | NT2RP2000279 |
| PSEC0053 | NT2RP2000396 |
| PSEC0055 | NT2RP2000557 |
| PSEC0059 | NT2RP2000601 |
| PSEC0061 | NT2RP2000720 |
| PSEC0068 | NT2RP2001270 |
| PSEC0070 | NT2RP2001508 |
| PSEC0071 | NT2RP2002115 |
| PSEC0072 | NT2RP2002429 |
| PSEC0073 | NT2RP2002934 |
| PSEC0074 | NT2RP2003050 |
| PSEC0075 | NT2RP2003227 |
| PSEC0076 | NT2RP2003471 |
| PSEC0077 | NT2RP2003902 |
| PSEC0079 | NT2RP2004049 |
| PSEC0080 | NT2RP2004076 |
| PSEC0081 | NT2RP2004130 |
| PSEC0082 | NT2RP2004966 |
| PSEC0085 | NT2RP2006476 |
| PSEC0086 | PLACE1000456 |
| PSEC0087 | PLACE1001022 |
| PSEC0088 | PLACE1001098 |
| PSEC0090 | PLACE1001300 |
| PSEC0094 | NT2RP2001499 |
| PSEC0095 | NT2RP2001768 |
| PSEC0098 | NT2RP2002695 |
| PSEC0099 | NT2RP2002907 |
| PSEC0100 | NT2RP2002927 |
| PSEC0101 | NT2RP2003115 |
| PSEC0104 | NT2RP2004795 |
| PSEC0105 | NT2RP2004974 |
| PSEC0106 | NT2RP2005219 |
| PSEC0107 | NT2RP2005322 |
| PSEC0108 | NT2RP2005670 |
| PSEC0109 | NT2RP2005671 |
| PSEC0110 | PLACE1010021 |
| PSEC0111 | NT2RP2006028 |
| PSEC0112 | NT2RP2006400 |
| PSEC0113 | NT2RP2006435 |
| PSEC0119 | PLACE1002376 |
| PSEC0120 | PLACE1002379 |
| PSEC0121 | PLACE1003085 |
| PSEC0124 | PLACE1003378 |
| PSEC0125 | PLACE1003405 |
| PSEC0126 | PLACE1003549 |
| PSEC0127 | PLACE1003724 |
| PSEC0128 | PLACE1004113 |
| PSEC0129 | PLACE1004170 |
| PSEC0130 | PLACE1004273 |

| | |
|---|---|
| PSEC0131 | PLACE1004322 |
| PSEC0133 | PLACE1004507 |
| PSEC0134 | PLACE1004757 |
| PSEC0135 | PLACE1004850 |
| PSEC0136 | PLACE1004904 |
| PSEC0137 | PLACE1005047 |
| PSEC0139 | PLACE1005760 |
| PSEC0143 | PLACE1006472 |
| PSEC0144 | PLACE1006610 |
| nnnnnnnn | nnnnnnnnnnnn |
| PSEC0147 | PLACE1007190 |
| PSEC0149 | PLACE1007338 |
| PSEC0150 | PLACE1007635 |
| PSEC0151 | PLACE1007878 |
| PSEC0152 | PLACE1007885 |
| PSEC0158 | PLACE1008738 |
| PSEC0159 | PLACE1008994 |
| PSEC0161 | PLACE1009580 |
| PSEC0162 | PLACE1009772 |
| PSEC0163 | PLACE1010330 |
| PSEC0164 | PLACE1010482 |
| PSEC0165 | PLACE1010978 |
| PSEC0167 | PLACE1011134 |
| PSEC0168 | PLACE1011146 |
| PSEC0169 | PLACE1011360 |
| PSEC0170 | PLACE1011386 |
| PSEC0171 | PLACE1011514 |
| PSEC0172 | PLACE1011835 |
| PSEC0173 | NT2RP2000428 |
| PSEC0178 | OVARC1000636 |
| PSEC0181 | OVARC1001499 |
| PSEC0182 | OVARC1001636 |
| PSEC0183 | OVARC1001849 |
| PSEC0190 | HEMBA1000296 |
| PSEC0191 | HEMBA1000446 |
| PSEC0192 | HEMBA1000675 |
| PSEC0197 | HEMBA1001490 |
| PSEC0198 | HEMBA1001552 |
| PSEC0199 | HEMBA1001680 |
| PSEC0200 | HEMBA1001879 |
| PSEC0203 | HEMBA1002441 |
| PSEC0204 | HEMBA1002706 |
| PSEC0205 | HEMBA1002715 |
| PSEC0207 | HEMBA1002981 |
| PSEC0209 | HEMBA1003280 |
| PSEC0210 | HEMBA1003702 |
| PSEC0213 | HEMBA1004078 |
| PSEC0214 | HEMBA1004100 |
| PSEC0215 | HEMBA1004149 |
| PSEC0216 | HEMBA1004633 |
| PSEC0218 | HEMBA1005096 |
| PSEC0220 | HEMBA1005301 |
| PSEC0222 | HEMBA1005452 |
| PSEC0223 | HEMBA1005628 |
| PSEC0224 | HEMBA1005703 |
| PSEC0226 | HEMBA1005833 |
| PSEC0227 | HEMBA1006019 |
| PSEC0228 | HEMBA1006099 |
| PSEC0230 | HEMBA1006391 |
| PSEC0232 | HEMBA1006549 |
| PSEC0233 | HEMBA1006813 |
| PSEC0235 | HEMBA1007053 |
| PSEC0236 | HEMBA1007104 |
| PSEC0240 | OVARC1001510 |
| PSEC0241 | NT2RP3000234 |
| PSEC0243 | NT2RP3000326 |
| PSEC0244 | NT2RP3000638 |
| PSEC0245 | NT2RP3000719 |
| PSEC0246 | NT2RP3001359 |
| PSEC0247 | NT2RP3001613 |
| PSEC0248 | NT2RP3001619 |
| PSEC0249 | NT2RP3001861 |
| PSEC0250 | NT2RP3001874 |
| PSEC0252 | NT2RP3003258 |
| PSEC0253 | NT2RP3003368 |
| PSEC0255 | NT2RP3003536 |
| PSEC0258 | NT2RP3003731 |
| PSEC0259 | NT2RP3003789 |
| PSEC0260 | NT2RP3004059 |
| PSEC0261 | NT2RP3004063 |
| PSEC0263 | NT2RP3004541 |
| PSEC0027 | NT2RP1000477 |
| PSEC0047 | NT2RP1001042 |
| PSEC0066 | NT2RP2001087 |
| nnnnnnnn | nnnnnnnnnnnn |
| PSEC0069 | NT2RP2001341 |
| PSEC0092 | NT2RP2000358 |
| PSEC0103 | NT2RP2004755 |
| PSEC0117 | PLACE1001904 |
| PSEC0142 | PLACE1006269 |
| PSEC0212 | HEMBA1003764 |
| PSEC0239 | OVARC1000363 |
| PSEC0242 | NT2RP3000266 |
| PSEC0251 | NT2RP3003097 |
| PSEC0256 | NT2RP3003549 |
| PSEC0195 | HEMBA1001322 |
| PSEC0206 | HEMBA1002913 |
| PSEC0078 | NT2RP2004036 |
| PSEC0084 | NT2RP2005970 |
| PSEC0237 | HEMBA1007186 |
| PSEC0264 | NT2RP3002337 |
| PSEC0265 | NT2RP3003235 |

EXAMPLE 8

Expression Frequency Analysis for PSEC Clones During the Stages of Neural Differentiation of NT2 Cells Using RT-PCR Total RNA was prepared from NT2 cells (NT2 Precursor Cells: Stratagene) at each stage of differentiation (at a pre-differentiation stage; at 1, 3, or 5 weeks after retinoic acid-treatment; after addition of cell-division inhibitor; or at a stage of NT2 neuron). Alterations in expression levels of PSEC clones were examined by RT-PCR. PSEC clones to be tested by RT-PCR were chosen among the clones obtained from cDNA libraries derived from NT2 cells (NT2RM1, NT2RP1, NT2RP2 and NT2RP3) or human embryo-derived tissues that were enriched with brain (HEMBA1).

The NT2 cells were treated basically according to supplier's instruction manual. "Undifferentiated NT2 cells" means NT2 cells successively cultured in an Opti-MEM I (GIBCO BRL; catalog No. 31985) containing 10% (v/v) fetal bovine serum and 1% (v/v) penicillin-streptomycin (GIBCO BRL). "NT2 cells cultured in the presence of retinoic acid for 1, 3, or 5 weeks after addition thereof" means the cells resulted from transferring undifferentiated NT2 cells into a retinoic acid-containing medium, which consists of D-MEM (GIBCO BRL; catalog No. 11965), 10% (v/v) fetal bovine serum, 1% (v/v) penicillin-streptomycin and 10 µM retinoic acid (GIBCO BRL), and the subsequent successive culture therein for 1, 3, or 5 weeks. "NT2 cells after addition of cell-division inhibitor" means NT2 cells resulted from transferring NT2 cells cultured in the presence of retinoic acid for 5 weeks into a cell-division inhibitor-containing medium, which consisted of D-MEM (GIBCO BRL; catalog No. 11965), 10% (v/v) fetal bovine serum, 1% (v/v) penicillin-streptomycin, 10 µM retinoic acid, 10 µM FudR (5-fluoro-2'-deoxyuridine: GIBCO BRL), 10 µM Urd (Uridine: GIBCO BRL) and 1 µM araC (Cytosine β-D-Arabinofuranoside: GIBCO BRL), and the subsequence successive culture for 2 weeks. NT2 neuron means NT2 cells resulted from successively culturing NT2 cells in the presence of cell-division inhibitor for about 10 days. The NT2 neurons were harvested by treating mildly with trypsin. Total RNA was prepared from each of the cells harvested by treating with trypsin. The preparation was performed by using an Rneasy Mini kit (QIAGEN) according to the attached protocol.

RT-PCR was performed by using 50 ng total RNA in a reaction and SUPERSCRIPT™ ONE-STEP™ RT-PCR System (GIBCO BRL). Although the reaction condition used were substantially the same as described in the protocol attached to SUPERSCRIPT™ ONE-STEP™ RT-PCR System, the annealing temperature and the number of cycles were altered in this experiment.

To analyze the PCR products obtained by the amplification, samples of each reaction solution were subjected to agarose gel electrophoresis. The bands derived from the PCR products were detected using FMBIO II Multi-View (Hitachi Ltd.). First, 90 PSEC clones obtained from cDNA libraries derived from NT2 cell (NT2RM1, NT2RP1, NT2RP2 and NT2RP3) or human embryo-derived tissues enriched with brain (HEMBA1) were analyzed for the change in the expression levels thereof between undifferentiated NT2 cells and NT2 cells cultured in the presence of cell-division inhibitor added. Many clones showed no marked change in the expression levels thereof or no specific bands in PCR assay, and therefore such clones were not analyzed further.

As for the PSEC clones whose expression levels were expected to change in the above analysis, the temporal expression at a pre-differentiation stage, 1, 3, or 5 weeks after retinoic acid-treatment and, further, the expression in NT2 neurons were examined. The result showed that the clones, PSEC0005, PSEC0048, PSEC0059, PSEC0200 and PSEC0232, exhibited the differences in the amount of the PCR products (FIGS. 4 and 5). On the other hand, no marked difference in the expression level was observed in each of the clones, PSEC0001, PSEC0029, PSEC0031, PSEC0078, PSEC0099, PSEC0173, PSEC0197, PSEC0198, PSEC0213, PSEC0124 and PSEC0260.

FIG. 6 shows changes in intensities of the bands generated by RT-PCR under particular reaction conditions (the conditions are indicated in the figure). RT-PCR was carried out by using a pair of primers shown in SEQ ID NOs: 355 and 356 for clone PSEC0005; primers shown in SEQ ID NOs: 357 and 358 for clone PSEC0048; primers shown in SEQ ID NOs: 359 and 360 for clone PSEC0059; primers shown in SEQ ID NOs: 361 and 362 for clone PSEC0200; primers shown in SEQ ID NOs: 363 and 364 for clone PSEC0232; (the annealing temperature and the number of cycles used in PCR are as indicated in FIGS. 4 and 5). A pair of primers shown in SEQ ID NOs: 365 and 366 were used for the amplification of the β-actin gene as a control. A pair of primers shown in SEQ ID NOs: 368 and 369 were used to perform RT-PCR for the gene encoding prostaglandin D2 synthase (Neuroscience, 69, 967–975 (1995); Eur. J. Neurosci. 9, 1566–1573 (1997)), which has been known to be expressed strongly (the annealing temperature and the number of cycles used in PCR are as indicated in FIGS. 4 and 5). The primers were designed based on a cDNA sequence (SEQ ID NO: 367) that was isolated from a cDNA library derived from NT2 cells and shared 94% or more residues both at the nucleotide level and at the amino acid level with the prostaglandin D2 synthase clone registered under an accession number M61900 in GenBank database.

The expression level of PSEC0232 was highly elevated depending on the degree of neural differentiation of NT2 cell. Therefore, it is clear that the gene is closely associated with neural differentiation. Although PSEC0048 and PSEC0200 exhibited only weak expression in NT2 neurons, the expression levels thereof were observed to be elevated during the course of differentiation. These genes were also considered to be associated with neural differentiation. Similarly, PSEC0059 exhibited no expression in NT2 neurons but the expression level thereof was observed to be markedly elevated during the course of differentiation. This gene was also judged to be associated with neural differentiation. The expression level of PSEC0005 was markedly decreased during the course of differentiation. Although opposite to those of other genes, the pattern of expression showed that this gene was also involved in neural differentiation.

In order to find genes associated with neural differentiation, a similar experiment was performed by using hybridization with high-density DNA filter in the same manner as described in Example 7. In this experiment, a similar result to that shown above was obtained for 3 clones (PSEC0048: NT2RP2000028, PSEC0059: NT2RP2000601 and PSEC0200: HEMBA1001879). However, the results obtained by RT-PCR method were not necessarily consistent with those obtained by the hybridization method. The possible reason for the inconsistency is that specific bands were not generated in the RT-PCR experiments or that the signal intensity detected in the hybridization experiments was too low to assess the change in the expression level of the gene.

TABLE 342

| PSEC clone name | clone name | sequence name of 5'-end sequence | 5'-end sequence SEQ ID | sequence name of 3'-end sequence | 3'-end sequence SEQ ID |
|---|---|---|---|---|---|
| PSEC0001 | NT2RM1000066 | F-NT2RM1000066 | 370 | | |
| nnnnnnnn | nnnnnnnnnnnn | F-nnnnnnnnnnnn | 371 | | |
| PSEC0005 | NT2RM1000566 | F-NT2RM1000566 | 372 | | |
| PSEC0007 | NT2RM1000634 | F-NT2RM1000634 | 373 | | |
| PSEC0008 | NT2RM1000726 | F-NT2RM1000726 | 374 | | |
| PSEC0012 | NT2RM1000853 | F-NT2RM1000853 | 375 | | |
| PSEC0017 | NT2RM1001103 | F-NT2RM1001103 | 376 | | |
| PSEC0019 | NT2RP1000125 | F-NT2RP1000125 | 377 | | |
| PSEC0020 | NT2RP1000255 | F-NT2RP1000255 | 378 | | |
| PSEC0021 | NT2RP1000279 | F-NT2RP1000279 | 379 | | |
| PSEC0027 | NT2RP1000477 | F-NT2RP1000477 | 380 | | |
| PSEC0028 | NT2RP1000533 | F-NT2RP1000533 | 381 | | |
| PSEC0029 | NT2RP1000544 | F-NT2RP1000544 | 382 | | |
| PSEC0030 | NT2RP1000567 | F-NT2RP1000567 | 383 | | |
| PSEC0031 | NT2RP1000593 | F-NT2RP1000593 | 384 | | |
| PSEC0035 | NT2RP1000769 | F-NT2RP1000769 | 385 | | |
| PSEC0038 | NT2RP1000837 | F-NT2RP1000837 | 386 | | |

TABLE 342-continued

| PSEC clone name | clone name | sequence name of 5'-end sequence | 5'-end sequence SEQ ID | sequence name of 3'-end sequence | 3'-end sequence SEQ ID |
|---|---|---|---|---|---|
| PSEC0040 | NT2RP1000905 | F-NT2RP1000905 | 387 | | |
| PSEC0041 | NT2RP1000921 | F-NT2RP1000921 | 388 | | |
| PSEC0045 | NT2RP1001023 | F-NT2RP1001023 | 389 | | |
| PSEC0047 | NT2RP1001042 | F-NT2RP1001042 | 390 | | |
| PSEC0048 | NT2RP2000028 | F-NT2RP2000028 | 391 | R-NT2RP2000028 | 541 |
| PSEC0049 | NT2RP2000116 | F-NT2RP2000116 | 392 | R-NT2RP2000116 | 542 |
| PSEC0051 | NT2RP2000168 | F-NT2RP2000168 | 393 | R-NT2RP2000168 | 543 |
| PSEC0052 | NT2RP2000279 | F-NT2RP2000279 | 394 | R-NT2RP2000279 | 544 |
| PSEC0053 | NT2RP2000396 | F-NT2RP2000396 | 395 | R-NT2RP2000396 | 545 |
| PSEC0055 | NT2RP2000557 | F-NT2RP2000557 | 396 | R-NT2RP2000557 | 546 |
| PSEC0059 | NT2RP2000601 | F-NT2RP2000601 | 397 | R-NT2RP2000601 | 547 |
| PSEC0061 | NT2RP2000720 | F-NT2RP2000720 | 398 | R-NT2RP2000720 | 548 |
| PSEC0066 | NT2RP2001087 | F-NT2RP2001087 | 399 | | |
| PSEC0068 | NT2RP2001270 | F-NT2RP2001270 | 400 | R-NT2RP2001270 | 549 |
| PSEC0069 | NT2RP2001341 | F-NT2RP2001341 | 401 | R-NT2RP2001341 | 550 |
| PSEC0070 | NT2RP2001508 | F-NT2RP2001508 | 402 | R-NT2RP2001508 | 551 |
| PSEC0071 | NT2RP2002115 | F-NT2RP2002115 | 403 | R-NT2RP2002115 | 552 |
| PSEC0072 | NT2RP2002429 | F-NT2RP2002429 | 404 | R-NT2RP2002429 | 553 |
| PSEC0073 | NT2RP2002934 | F-NT2RP2002934 | 405 | R-NT2RP2002934 | 554 |
| PSEC0074 | NT2RP2003050 | F-NT2RP2003050 | 406 | R-NT2RP2003050 | 555 |
| PSEC0075 | NT2RP2003227 | F-NT2RP2003227 | 407 | R-NT2RP2003227 | 556 |
| PSEC0076 | NT2RP2003471 | F-NT2RP2003471 | 408 | R-NT2RP2003471 | 557 |
| PSEC0077 | NT2RP2003902 | F-NT2RP2003902 | 409 | R-NT2RP2003902 | 558 |
| PSEC0079 | NT2RP2004049 | F-NT2RP2004049 | 410 | | |
| PSEC0080 | NT2RP2004076 | F-NT2RP2004076 | 411 | | |
| PSEC0081 | NT2RP2004130 | F-NT2RP2004130 | 412 | R-NT2RP2004130 | 559 |
| PSEC0082 | NT2RP2004966 | F-NT2RP2004966 | 413 | R-NT2RP2004966 | 560 |
| PSEC0085 | NT2RP2006476 | F-NT2RP2006476 | 414 | R-NT2RP2006476 | 561 |
| PSEC0086 | PLACE1000456 | F-PLACE1000456 | 415 | R-PLACE1000456 | 562 |
| PSEC0087 | PLACE1001022 | F-PLACE1001022 | 416 | R-PLACE1001022 | 563 |
| PSEC0088 | PLACE1001098 | F-PLACE1001098 | 417 | R-PLACE1001098 | 564 |
| PSEC0090 | PLACE1001300 | F-PLACE1001300 | 418 | R-PLACE1001300 | 565 |
| PSEC0092 | NT2RP2000358 | F-NT2RP2000358 | 419 | R-NT2RP2000358 | 566 |
| PSEC0094 | NT2RP2001499 | F-NT2RP2001499 | 420 | R-NT2RP2001499 | 567 |
| PSEC0095 | NT2RP2001768 | F-NT2RP2001768 | 421 | R-NT2RP2001768 | 568 |
| PSEC0098 | NT2RP2002695 | F-NT2RP2002695 | 422 | R-NT2RP2002695 | 569 |
| PSEC0099 | NT2RP2002907 | F-NT2RP2002907 | 423 | | |
| PSEC0100 | NT2RP2002927 | F-NT2RP2002927 | 424 | | |
| PSEC0101 | NT2RP2003115 | F-NT2RP2003115 | 425 | R-NT2RP2003115 | 570 |
| PSEC0103 | NT2RP2004755 | F-NT2RP2004755 | 426 | R-NT2RP2004755 | 571 |
| PSEC0104 | NT2RP2004795 | F-NT2RP2004795 | 427 | R-NT2RP2004795 | 572 |
| PSEC0105 | NT2RP2004974 | F-NT2RP2004974 | 428 | R-NT2RP2004974 | 573 |
| PSEC0106 | NT2RP2005219 | F-NT2RP2005219 | 429 | R-NT2RP2005219 | 574 |
| PSEC0107 | NT2RP2005322 | F-NT2RP2005322 | 430 | R-NT2RP2005322 | 575 |
| PSEC0108 | NT2RP2005670 | F-NT2RP2005670 | 431 | R-NT2RP2005670 | 576 |
| PSEC0109 | NT2RP2005671 | F-NT2RP2005671 | 432 | R-NT2RP2005671 | 577 |
| PSEC0110 | PLACE1010021 | F-PLACE1010021 | 433 | R-PLACE1010021 | 578 |
| PSEC0111 | NT2RP2006028 | F-NT2RP2006028 | 434 | | |
| PSEC0112 | NT2RP2006400 | F-NT2RP2006400 | 435 | | |
| PSEC0113 | NT2RP2006435 | F-NT2RP2006435 | 436 | R-NT2RP2006435 | 579 |
| PSEC0117 | PLACE1001904 | F-PLACE1001904 | 437 | R-PLACE1001904 | 580 |
| PSEC0119 | PLACE1002376 | F-PLACE1002376 | 438 | R-PLACE1002376 | 581 |
| PSEC0120 | PLACE1002379 | F-PLACE1002379 | 439 | R-PLACE1002379 | 582 |
| PSEC0121 | PLACE1003085 | F-PLACE1003085 | 440 | R-PLACE1003085 | 583 |
| PSEC0124 | PLACE1003378 | F-PLACE1003378 | 441 | R-PLACE1003378 | 584 |
| PSEC0125 | PLACE1003405 | F-PLACE1003405 | 442 | R-PLACE1003405 | 585 |
| PSEC0126 | PLACE1003549 | F-PLACE1003549 | 443 | R-PLACE1003549 | 586 |
| PSEC0127 | PLACE1003724 | F-PLACE1003724 | 444 | R-PLACE1003724 | 587 |
| PSEC0128 | PLACE1004113 | F-PLACE1004113 | 445 | R-PLACE1004113 | 588 |
| PSEC0129 | PLACE1004170 | F-PLACE1004170 | 446 | R-PLACE1004170 | 589 |
| PSEC0130 | PLACE1004273 | F-PLACE1004273 | 447 | R-PLACE1004273 | 590 |
| PSEC0131 | PLACE1004322 | F-PLACE1004322 | 448 | R-PLACE1004322 | 591 |
| PSEC0133 | PLACE1004507 | F-PLACE1004507 | 449 | R-PLACE1004507 | 592 |
| PSEC0134 | PLACE1004757 | F-PLACE1004757 | 450 | R-PLACE1004757 | 593 |
| PSEC0135 | PLACE1004850 | F-PLACE1004850 | 451 | R-PLACE1004850 | 594 |
| PSEC0136 | PLACE1004904 | F-PLACE1004904 | 452 | R-PLACE1004904 | 595 |
| PSEC0137 | PLACE1005047 | F-PLACE1005047 | 453 | R-PLACE1005047 | 596 |
| PSEC0139 | PLACE1005760 | F-PLACE1005760 | 454 | | |
| PSEC0142 | PLACE1006269 | F-PLACE1006269 | 455 | R-PLACE1006269 | 597 |
| PSEC0143 | PLACE1006472 | F-PLACE1006472 | 456 | R-PLACE1006472 | 598 |
| PSEC0144 | PLACE1006610 | F-PLACE1006610 | 457 | R-PLACE1006610 | 599 |
| PSEC0147 | PLACE1007190 | F-PLACE1007190 | 458 | R-PLACE1007190 | 600 |
| PSEC0149 | PLACE1007338 | F-PLACE1007338 | 459 | R-PLACE1007338 | 601 |
| PSEC0150 | PLACE1007635 | F-PLACE1007635 | 460 | R-PLACE1007635 | 602 |

TABLE 342-continued

| PSEC clone name | clone name | sequence name of 5'-end sequence | 5'-end sequence SEQ ID | sequence name of 3'-end sequence | 3'-end sequence SEQ ID |
|---|---|---|---|---|---|
| PSEC0151 | PLACE1007878 | F-PLACE1007878 | 461 | R-PLACE1007878 | 603 |
| PSEC0152 | PLACE1007885 | F-PLACE1007885 | 462 | R-PLACE1007885 | 604 |
| PSEC0158 | PLACE1008738 | F-PLACE1008738 | 463 | R-PLACE1008738 | 605 |
| PSEC0159 | PLACE1008994 | F-PLACE1008994 | 464 | R-PLACE1008994 | 606 |
| PSEC0161 | PLACE1009580 | F-PLACE1009580 | 465 | R-PLACE1009580 | 607 |
| PSEC0162 | PLACE1009772 | F-PLACE1009772 | 466 | R-PLACE1009772 | 608 |
| PSEC0163 | PLACE1010330 | F-PLACE1010330 | 467 | R-PLACE1010330 | 609 |
| PSEC0164 | PLACE1010482 | F-PLACE1010482 | 468 | R-PLACE1010482 | 610 |
| PSEC0165 | PLACE1010978 | F-PLACE1010978 | 469 | R-PLACE1010978 | 611 |
| PSEC0167 | PLACE1011134 | F-PLACE1011134 | 470 | R-PLACE1011134 | 612 |
| PSEC0168 | PLACE1011146 | F-PLACE1011146 | 471 | R-PLACE1011146 | 613 |
| PSEC0169 | PLACE1011360 | F-PLACE1011360 | 472 | R-PLACE1011360 | 614 |
| PSEC0170 | PLACE1011386 | F-PLACE1011386 | 473 | R-PLACE1011386 | 615 |
| PSEC0171 | PLACE1011514 | F-PLACE1011514 | 474 | R-PLACE1011514 | 616 |
| PSEC0172 | PLACE1011835 | F-PLACE1011835 | 475 | R-PLACE1011835 | 617 |
| PSEC0173 | NT2RP2000428 | F-NT2RP2000428 | 476 | R-NT2RP2000428 | 618 |
| PSEC0178 | OVARC1000636 | F-OVARC1000636 | 477 | R-OVARC1000636 | 619 |
| PSEC0181 | OVARC1001499 | F-OVARC1001499 | 478 | R-OVARC1001499 | 620 |
| PSEC0182 | OVARC1001636 | F-OVARC1001636 | 479 | R-OVARC1001636 | 621 |
| PSEC0183 | OVARC1001849 | F-OVARC1001849 | 480 | R-OVARC1001849 | 622 |
| PSEC0190 | HEMBA1000296 | F-HEMBA1000296 | 481 | R-HEMBA1000296 | 623 |
| PSEC0191 | HEMBA1000446 | F-HEMBA1000446 | 482 | R-HEMBA1000446 | 624 |
| PSEC0192 | HEMBA1000675 | F-HEMBA1000675 | 483 | R-HEMBA1000675 | 625 |
| PSEC0195 | HEMBA1001322 | F-HEMBA1001322 | 484 | R-HEMBA1001322 | 626 |
| PSEC0197 | HEMBA1001490 | F-HEMBA1001490 | 485 | R-HEMBA1001490 | 627 |
| PSEC0198 | HEMBA1001552 | F-HEMBA1001552 | 486 | R-HEMBA1001552 | 628 |
| PSEC0199 | HEMBA1001680 | F-HEMBA1001680 | 487 | R-HEMBA1001680 | 629 |
| PSEC0200 | HEMBA1001879 | F-HEMBA1001879 | 488 | R-HEMBA1001879 | 630 |
| PSEC0203 | HEMBA1002441 | F-HEMBA1002441 | 489 | R-HEMBA1002441 | 631 |
| PSEC0204 | HEMBA1002706 | F-HEMBA1002706 | 490 | R-HEMBA1002706 | 632 |
| PSEC0205 | HEMBA1002715 | F-HEMBA1002715 | 491 | | |
| PSEC0206 | HEMBA1002913 | F-HEMBA1002913 | 492 | R-HEMBA1002913 | 633 |
| PSEC0207 | HEMBA1002981 | F-HEMBA1002981 | 493 | R-HEMBA1002981 | 634 |
| PSEC0209 | HEMBA1003280 | F-HEMBA1003280 | 494 | R-HEMBA1003280 | 635 |
| PSEC0210 | HEMBA1003702 | F-HEMBA1003702 | 495 | R-HEMBA1003702 | 636 |
| PSEC0212 | HEMBA1003764 | F-HEMBA1003764 | 496 | R-HEMBA1003764 | 637 |
| PSEC0213 | HEMBA1004078 | F-HEMBA1004078 | 497 | R-HEMBA1004078 | 638 |
| PSEC0214 | HEMBA1004100 | F-HEMBA1004100 | 498 | R-HEMBA1004100 | 639 |
| PSEC0215 | HEMBA1004149 | F-HEMBA1004149 | 499 | R-HEMBA1004149 | 640 |
| PSEC0216 | HEMBA1004633 | F-HEMBA1004633 | 500 | R-HEMBA1004633 | 641 |
| PSEC0218 | HEMBA1005096 | F-HEMBA1005096 | 501 | R-HEMBA1005096 | 642 |
| PSEC0220 | HEMBA1005301 | F-HEMBA1005301 | 502 | | |
| PSEC0222 | HEMBA1005452 | F-HEMBA1005452 | 503 | | |
| PSEC0223 | HEMBA1005628 | F-HEMBA1005628 | 504 | R-HEMBA1005628 | 643 |
| PSEC0224 | HEMBA1005703 | F-HEMBA1005703 | 505 | R-HEMBA1005703 | 644 |
| PSEC0226 | HEMBA1005833 | F-HEMBA1005833 | 506 | R-HEMBA1005833 | 645 |
| PSEC0227 | HEMBA1006019 | F-HEMBA1006019 | 507 | R-HEMBA1006019 | 646 |
| PSEC0228 | HEMBA1006099 | F-HEMBA1006099 | 508 | R-HEMBA1006099 | 647 |
| PSEC0230 | HEMBA1006391 | F-HEMBA1006391 | 509 | R-HEMBA1006391 | 648 |
| PSEC0232 | HEMBA1006549 | F-HEMBA1006549 | 510 | R-HEMBA1006549 | 649 |
| PSEC0233 | HEMBA1006813 | F-HEMBA1006813 | 511 | R-HEMBA1006813 | 650 |
| PSEC0235 | HEMBA1007053 | F-HEMBA1007053 | 512 | R-HEMBA1007053 | 651 |
| PSEC0236 | HEMBA1007104 | F-HEMBA1007104 | 513 | R-HEMBA1007104 | 652 |
| PSEC0239 | OVARC1000363 | F-OVARC1000363 | 514 | R-OVARC1000363 | 653 |
| PSEC0240 | OVARC1001510 | F-OVARC1001510 | 515 | R-OVARC1001510 | 654 |
| PSEC0241 | NT2RP3000234 | F-NT2RP3000234 | 516 | R-NT2RP3000234 | 655 |
| PSEC0242 | NT2RP3000266 | F-NT2RP3000266 | 517 | R-NT2RP3000266 | 656 |
| PSEC0243 | NT2RP3000326 | F-NT2RP3000326 | 518 | R-NT2RP3000326 | 657 |
| PSEC0244 | NT2RP3000638 | F-NT2RP3000638 | 519 | R-NT2RP3000638 | 658 |
| PSEC0245 | NT2RP3000719 | F-NT2RP3000719 | 520 | R-NT2RP3000719 | 659 |
| PSEC0246 | NT2RP3001359 | F-NT2RP3001359 | 521 | R-NT2RP3001359 | 660 |
| PSEC0247 | NT2RP3001613 | F-NT2RP3001613 | 522 | R-NT2RP3001613 | 661 |
| PSEC0248 | NT2RP3001619 | F-NT2RP3001619 | 523 | R-NT2RP3001619 | 662 |
| PSEC0249 | NT2RP3001861 | F-NT2RP3001861 | 524 | R-NT2RP3001861 | 663 |
| PSEC0250 | NT2RP3001874 | F-NT2RP3001874 | 525 | R-NT2RP3001874 | 664 |
| PSEC0251 | NT2RP3003097 | F-NT2RP3003097 | 526 | R-NT2RP3003097 | 665 |
| PSEC0252 | NT2RP3003258 | F-NT2RP3003258 | 527 | R-NT2RP3003258 | 666 |
| PSEC0253 | NT2RP3003368 | F-NT2RP3003368 | 528 | R-NT2RP3003368 | 667 |
| PSEC0255 | NT2RP3003536 | F-NT2RP3003536 | 529 | R-NT2RP3003536 | 668 |
| PSEC0256 | NT2RP3003549 | F-NT2RP3003549 | 530 | R-NT2RP3003549 | 669 |
| PSEC0258 | NT2RP3003731 | F-NT2RP3003731 | 531 | R-NT2RP3003731 | 670 |
| PSEC0259 | NT2RP3003789 | F-NT2RP3003789 | 532 | R-NT2RP3003789 | 671 |
| PSEC0260 | NT2RP3004059 | F-NT2RP3004059 | 533 | R-NT2RP3004059 | 672 |
| PSEC0261 | NT2RP3004063 | F-NT2RP3004063 | 534 | R-NT2RP3004063 | 673 |

TABLE 342-continued

| PSEC clone name | clone name | sequence name of 5'-end sequence | 5'-end sequence SEQ ID | sequence name of 3'-end sequence | 3'-end sequence SEQ ID |
|---|---|---|---|---|---|
| PSEC0263 | NT2RP3004541 | F-NT2RP3004541 | 535 | R-NT2RP3004541 | 674 |
| PSEC0078 | NT2RP2004036 | F-NT2RP2004036 | 536 | R-NT2RP2004036 | 675 |
| PSEC0084 | NT2RP2005970 | F-NT2RP2005970 | 537 | R-NT2RP2005970 | 676 |
| PSEC0237 | HEMBA1007186 | F-HEMBA1007186 | 538 | R-HEMBA1007186 | 677 |
| PSEC0264 | NT2RP3002337 | F-NT2RP3002337 | 539 | R-NT2RP3002337 | 678 |
| PSEC0265 | NT2RP3003235 | F-NT2RP3003235 | 540 | R-NT2RP3003235 | 679 |

TABLE 343

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of $*: p < 0.05$ and $**: p < 0.01$.

| Clone | Synoviocyte | | | Synoviocyte_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| GAPDH(Cr1) | 0.4 | 0.8 | 0.89 | 0.9 | 1 | 1.15 | | |
| β actin(Cr2) | 385.94 | 262.23 | 582.98 | 443.28 | 422.61 | 573.47 | | |
| ADRGL1000005 | 2.72 | 2.97 | 4.46 | 7.27 | 7.45 | 3.51 | | |
| ADRGL1000007 | 4.36 | 5.19 | 9.58 | 20.78 | 19.59 | 18.29 | ** | + |
| ADRGL1000009 | 0.99 | 1.25 | 1.64 | 2.16 | 4.08 | 2.02 | | |
| ADRGL1000011 | 1.98 | 3.56 | 5.24 | 22.22 | 23.49 | 19.81 | ** | + |
| ADRGL1000027 | 0.79 | 1.22 | 1.66 | 2.82 | 4.99 | 1.9 | | |
| ADRGL1000058 | 4.12 | 7.08 | 26.9 | 62.55 | 67.32 | 49.15 | ** | + |
| ADRGL1000069 | 1.91 | 1.68 | 2.47 | 14.19 | 14.54 | 13.74 | ** | + |
| ADRGL1000077 | 1.98 | 2 | 2.54 | 5.5 | 2.9 | 4.16 | | |
| ADRGL1000092 | 2.99 | 4.79 | 12.53 | 21.46 | 22.09 | 26.19 | ** | + |
| ADRGL1000099 | 2.77 | 4.79 | 12.85 | 23.61 | 24.02 | 25.56 | ** | + |
| ADRGL1000136 | 20.49 | 27.18 | 31.85 | 62.44 | 40.69 | 48.29 | * | + |
| ADRGL1000147 | 2.09 | 2.58 | 5.47 | 5.69 | 7.52 | 3.85 | | |
| ADRGL1000159 | 1.51 | 1.77 | 3.07 | 3.4 | 4.71 | 2.59 | | |
| ADRGL1000160 | 2.42 | 4.34 | 6.89 | 8.08 | 7.24 | 7.06 | | |
| ADRGL1000171 | 0.95 | 1.11 | 1.64 | 1.89 | 2.69 | 1.87 | | |
| ADRGL1000181 | 0.64 | 1.37 | 1.74 | 3.99 | 4.27 | 3.89 | ** | + |
| BGGI11000015 | 2.13 | 3.89 | 5.02 | 10.49 | 11.35 | 9.14 | ** | + |
| BGGI11000016 | 27.77 | 35.71 | 52.17 | 57.18 | 48.51 | 63.57 | | |
| BGGI11000017 | 1.29 | 3.19 | 3.14 | 3.24 | 3.65 | 2.34 | | |
| BGGI11000022 | 4.72 | 4.45 | 6.75 | 10.71 | 5.56 | 8.27 | | |
| BGGI11000031 | 4.47 | 6.58 | 8.77 | 14.79 | 11.63 | 10.04 | * | + |
| BGGI11000042 | 9.55 | 11.29 | 20.54 | 23.39 | 18.75 | 20.23 | | |
| BGGI11000046 | 8.56 | 9.77 | 17.04 | 34.24 | 30.76 | 25.79 | ** | + |
| BNGH41000020 | 246.16 | 211.77 | 380.83 | 658.32 | 647.37 | 559.16 | ** | + |
| BNGH41000025 | 4.31 | 3.12 | 6.92 | 11.4 | 13.1 | 15.01 | ** | + |
| BNGH41000026 | 2.71 | 4.77 | 7.53 | 4.45 | 7.17 | 6.23 | | |
| BNGH41000027 | 11.52 | 13.5 | 12.69 | 20.62 | 12.48 | 24.91 | | |
| BNGH41000035 | 23.02 | 25.91 | 36.46 | 51.05 | 31.83 | 41.67 | | |
| BNGH41000037 | 2.7 | 5.21 | 6.72 | 12.95 | 8.98 | 8.59 | * | + |
| BNGH41000042 | 14.55 | 16.06 | 22.84 | 49.62 | 37.57 | 36.25 | ** | + |
| BNGH41000048 | 3.92 | 6.27 | 25.68 | 66.19 | 74.4 | 66.21 | ** | + |
| BNGH41000056 | 0.74 | 1.75 | 3.26 | 5.28 | 7.34 | 3.75 | * | + |
| BNGH41000087 | 3.36 | 4.08 | 5.19 | 5.59 | 8.15 | 3.01 | | |
| BNGH41000091 | 0.18 | 1.45 | 2.47 | 2.72 | 3.4 | 2.14 | | |
| BNGH41000157 | 6.93 | 7.99 | 6.23 | 13.37 | 10.28 | 9.98 | * | + |
| BNGH41000169 | 1.09 | 1.53 | 2.99 | 2.77 | 4.23 | 2.59 | | |
| BNGH41000181 | 3.5 | 4.06 | 7.5 | 5.71 | 6.81 | 6.09 | | |
| BNGH41000198 | 1.32 | 2.3 | 4.35 | 2.06 | 2.55 | 2.22 | | |
| BNGH41000219 | 2.29 | 3.91 | 5.61 | 12.4 | 13.73 | 10.76 | ** | + |
| BNGH41000229 | 9.65 | 9.99 | 12.99 | 18.34 | 18.92 | 18.94 | ** | + |
| BNGH41000237 | 8.4 | 12.99 | 12.61 | 27.63 | 11.26 | 13.45 | | |
| BNGH41000238 | 1.56 | 2.59 | 6.77 | 3.45 | 4.55 | 3.32 | | |
| BNGH41000243 | 5.56 | 8.95 | 6.71 | 15.03 | 12.55 | 16.36 | ** | + |
| BNGH41000270 | 2.94 | 2.77 | 2.88 | 3.67 | 3.99 | 3.74 | ** | + |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and –, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| BRAWH1000004 | 1 | 2.19 | 6.99 | 6.45 | 8.36 | 6 | | |
| BRAWH1000018 | 1.8 | 2.24 | 5.06 | 4.43 | 6.95 | 5.24 | | |
| BRAWH1000021 | 1.33 | 2.73 | 4.81 | 4.16 | 5.85 | 5.21 | | |
| BRAWH1000027 | 0.58 | 1.7 | 1.62 | 2.39 | 3.65 | 2.63 | * | + |
| BRAWH1000029 | 2.32 | 3.63 | 6.21 | 6.03 | 6.73 | 4.81 | | |
| BRAWH1000040 | 4.68 | 4.98 | 8.01 | 7.28 | 7.2 | 8.67 | | |
| BRAWH1000050 | 11.04 | 10.47 | 43.79 | 51.7 | 73.7 | 60.92 | * | + |
| BRAWH1000051 | 2.14 | 0.63 | 2.71 | 2.25 | 4.43 | 1.04 | | |
| BRAWH1000060 | 7.84 | 8.07 | 48.26 | 59.16 | 66.12 | 63.86 | * | + |
| BRAWH1000075 | 1.85 | 1.86 | 2.98 | 2.07 | 4.4 | 2.34 | | |
| BRAWH1000081 | 1.88 | 2.78 | 7.19 | 5.9 | 10.82 | 7.4 | | |
| BRAWH1000084 | 30.23 | 30.57 | 65.21 | 235.81 | 180.86 | 211.35 | ** | + |
| BRAWH1000095 | 1.38 | 2.47 | 4.51 | 3 | 4.78 | 2.67 | | |
| BRAWH1000096 | 1.37 | 2.89 | 4.71 | 3.7 | 4.8 | 5.17 | | |
| BRAWH1000097 | 3.32 | 3.27 | 10.74 | 9.24 | 10.62 | 7.75 | | |
| BRAWH1000100 | 4.77 | 5.19 | 7.69 | 6.98 | 7.06 | 7.28 | | |
| BRAWH1000101 | 12 | 12.04 | 36.52 | 46.19 | 41.09 | 50.21 | * | + |
| BRAWH1000104 | 1.37 | 0.92 | 4.33 | 1.47 | 4.47 | 2.41 | | |
| BRAWH1000107 | 0.62 | 1.88 | 2.48 | 2.43 | 5.03 | 3.15 | | |
| BRAWH1000110 | 4.4 | 4.06 | 16.81 | 13.87 | 11.1 | 15.74 | | |
| BRAWH1000111 | 3.98 | 6.14 | 6.05 | 8.85 | 8.95 | 10.64 | * | + |
| BRAWH1000135 | 4.95 | 4.91 | 7.7 | 7.37 | 9.42 | 9.98 | | |
| BRAWH1000190 | 2.22 | 3.84 | 5.07 | 4.66 | 7.16 | 4.99 | | |
| HEMBA1000005 | 5.91 | 6.44 | 11.97 | 17.55 | 22.88 | 18.65 | * | + |
| HEMBA1000006 | 2.61 | 3.17 | 4.64 | 3.08 | 8.49 | 4.75 | | |
| HEMBA1000012 | 10.97 | 11.75 | 51.07 | 71.4 | 106.82 | 74.8 | * | + |
| HEMBA1000020 | 50.65 | 49.12 | 113.3 | 197.41 | 293.79 | 216.89 | * | + |
| HEMBA1000030 | 1.93 | 3.08 | 4.67 | 5.72 | 3.62 | 6.43 | | |
| HEMBA1000034 | 3.27 | 3.21 | 5.35 | 4.62 | 10.29 | 6.85 | | |
| HEMBA1000042 | 1.64 | 3.17 | 6 | 4.72 | 6.92 | 8.12 | | |
| HEMBA1000045 | 7.13 | 9.44 | 11.07 | 9.55 | 14.43 | 10.44 | | |
| HBMBA1000046 | 1.14 | 2.24 | 2.77 | 3.73 | 5.3 | 4.34 | * | + |
| HEMBA1000047 | 1.17 | 1.99 | 3.83 | 2.98 | 4.47 | 3.78 | | |
| HEMBA1000048 | 3.76 | 4.75 | 3.64 | 8.73 | 12.38 | 5.48 | | |
| HEMBA1000050 | 0.48 | 1.77 | 1.78 | 1.4 | 3.39 | 1.46 | | |
| HEMBA1000053 | 1.64 | 1.28 | 2.57 | 4.68 | 4.03 | 3.99 | ** | + |
| HEMBA1000060 | 1.88 | 2.71 | 4.51 | 7.29 | 7.94 | 9.74 | ** | + |
| HEMBA1000072 | 52.79 | 53.46 | 135.73 | 165.97 | 221.75 | 230.97 | * | + |
| HEMBA1000073 | 16.54 | 11.43 | 27.32 | 22.4 | 36.09 | 33.78 | | |
| HEMBA1000076 | 5.06 | 5.33 | 9.77 | 12.16 | 10.46 | 11.15 | * | + |
| HEMBA1000084 | 4.75 | 4.46 | 20.71 | 30.15 | 43.67 | 33.92 | * | + |
| HEMBA1000087 | 0.51 | 1 | 3.32 | 0.65 | 2.82 | 1.61 | | |
| HEMBA1000088 | 1.98 | 2.97 | 4.6 | 6.2 | 9.87 | 8.46 | * | + |
| HEMBA1000091 | 6.36 | 5.4 | 17.56 | 30.15 | 44.04 | 35.43 | ** | + |
| HEMBA1000111 | 1.52 | 1.77 | 3.63 | 5.29 | 6.65 | 6.4 | ** | + |
| HEMBA1000121 | 0.86 | 1.17 | 3.58 | 3.52 | 4.47 | 5.83 | | |
| HEMBA1000128 | 1.52 | 2.99 | 6.04 | 4.28 | 6.05 | 5.93 | | |
| HEMBA1000129 | 2.04 | 1.81 | 3.95 | 2.66 | 3.26 | 3.32 | | |
| HEMBA1000141 | 2.31 | 3.45 | 5.98 | 3.56 | 6.67 | 5.6 | | |
| HEMBA1000146 | 0.84 | 1.29 | 2.96 | 1.93 | 4.98 | 3.52 | | |
| HEMBA100G150 | 3.34 | 3.29 | 10.65 | 8.27 | 11.97 | 9.46 | | |
| HEMBA1000154 | 25.17 | 29.21 | 82.33 | 128.3 | 134.42 | 139.59 | ** | + |
| HEMBA1000156 | 3.28 | 4 | 5.87 | 8.69 | 6.19 | 6.13 | | |
| HEMBA1000158 | 7.98 | 10.04 | 12.52 | 16.99 | 15.47 | 12.88 | | |
| HEMBA1000168 | 1.21 | 2.2 | 4.11 | 5.7 | 7.3 | 5.21 | * | + |
| HEMBA1000180 | 0.4 | 2.04 | 2.87 | 2.86 | 4.06 | 2.05 | | |
| HEMBA1000185 | 1.65 | 3.84 | 4.88 | 7.5 | 9.46 | 9.07 | ** | + |
| HEMBA1000188 | 1.37 | 1.64 | 3.31 | 4.94 | 4.19 | 3.35 | | |
| HEMBA1000193 | 1.53 | 0.66 | 3.16 | 2.68 | 4.33 | 2.5 | | |
| HEMBA1000194 | 2.18 | 2.95 | 5.68 | 9.11 | 8.74 | 8.83 | ** | + |
| HEMBA1000201 | 2.6 | 4.47 | 9.74 | 13.45 | 14.8 | 14.65 | * | + |
| HEMBA1000213 | 1.33 | 1.95 | 2.76 | 2.08 | 4.49 | 3.7 | | |
| HEMBA1000216 | 1.26 | 1.82 | 3.27 | 2.92 | 5.2 | 3.47 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1000227 | 0.99 | 2.27 | 2.38 | 3.28 | 4.21 | 1.83 | | |
| HEMBA1000231 | 1.5 | 1.97 | 5 | 7.56 | 7.19 | 6.16 | * | + |
| HEMBA1000237 | 4.5 | 6.13 | 9.14 | 14.79 | 18.3 | 14.71 | ** | + |
| HEMBA1000243 | 0.6 | 1.89 | 3.01 | 4.3 | 4.34 | 3.67 | * | + |
| HEMBA1000244 | 1.54 | 2.45 | 3.78 | 6.08 | 5.58 | 3.36 | | |
| HEMBA1000251 | 1.15 | 1.92 | 2.97 | 2.26 | 4.59 | 3.22 | | |
| HEMBA1000254 | 0.69 | 1.8 | 4.81 | 3.57 | 4.97 | 3.58 | | |
| HEMBA1000264 | 0.84 | 2.28 | 3.01 | 2.84 | 3.23 | 3.12 | | |
| HEMBA1000269 | 1.9 | 2.34 | 3.69 | 4.41 | 4.09 | 2.51 | | |
| HEMBA1000275 | 5.31 | 4.29 | 8.03 | 7.96 | 12.04 | 8.54 | | |
| HEMBA1000280 | 1.43 | 0.83 | 2.19 | 3.3 | 4.08 | 4 | ** | + |
| HEMBA1000282 | 1.15 | 1.01 | 4.23 | 6.29 | 7.01 | 5.46 | * | + |
| HEMBA1000287 | 2.86 | 3.19 | 4.45 | 5.81 | 6.04 | 6.37 | ** | + |
| HEMBA1000288 | 1.37 | 2.23 | 6.13 | 3.51 | 6.02 | 3.85 | | |
| HEMBA1000290 | 1.01 | 2.17 | 4.11 | 2.46 | 3.26 | 2.73 | | |
| HEMBA1000296 | 2.4 | 3.66 | 5.49 | 6.15 | 6.55 | 5.84 | | |
| HEMBA1000300 | 1.22 | 2.73 | 6.6 | 7.64 | 8.88 | 7.23 | | |
| HEMBA1000302 | 0.93 | 2.17 | 2.86 | 3.04 | 3.74 | 1.97 | | |
| HEMBA1000303 | 1.36 | 2.15 | 3.57 | 4.13 | 4.43 | 3 | | |
| HEMBA1000304 | 1.06 | 1.99 | 4.26 | 5.51 | 7.28 | 4.87 | * | + |
| HEMBA1000307 | 1.21 | 1.73 | 2.65 | 4.4 | 5.64 | 2.99 | * | + |
| HEMBA1000312 | 6 | 8.7 | 10.77 | 13.2 | 9.18 | 9.65 | | |
| HEMBA1000318 | 1.5 | 4.22 | 3.25 | 5.39 | 6.05 | 4.49 | | |
| HEMBA1000327 | 2.18 | 3.7 | 3.34 | 10.58 | 6.06 | 6.02 | * | + |
| HEMBA1000333 | 0.68 | 2.75 | 4.33 | 3.12 | 4.74 | 2.98 | | |
| HEMBA1000338 | 1.61 | 2.84 | 5.33 | 5.8 | 5.78 | 4.32 | | |
| HEMBA1000343 | 1.79 | 3.5 | 3.69 | 5.55 | 6.7 | 3.99 | | |
| HEMBA1000349 | 0.97 | 1.52 | 3.24 | 3.9 | 5.37 | 4.09 | * | + |
| HEMBA1000351 | 1.6 | 2.06 | 5.75 | 4.8 | 6.22 | 5.24 | | |
| HEMBA1000355 | 1.52 | 3.09 | 4.09 | 3.78 | 5.14 | 3.59 | | |
| HEMBA1000356 | 9.3 | 10.42 | 14.39 | 26.93 | 22.26 | 24.97 | ** | + |
| HEMBA1000357 | 1.88 | 2.11 | 4.76 | 3.81 | 5.7 | 4.62 | | |
| HEMBA1000366 | 1.67 | 1.94 | 3.83 | 3.14 | 4.75 | 3.28 | | |
| HEMBA1000369 | 1.87 | 2.94 | 5.17 | 2.82 | 5.2 | 4.56 | | |
| HEMBA1000370 | 2.45 | 3.4 | 4.63 | 3.75 | 5.34 | 3.6 | | |
| HEMBA1000376 | 3.64 | 4.55 | 14.48 | 26.69 | 29.98 | 28.36 | ** | + |
| HEMBA1000387 | 2.95 | 3.19 | 6.2 | 7.85 | 7.62 | 8.15 | * | + |
| HEMBA1000389 | 2.88 | 3.74 | 8.83 | 14.4 | 10.9 | 13.61 | * | + |
| HEMBA1000390 | 1.86 | 2.27 | 3.5 | 4.28 | 4.98 | 3.95 | * | + |
| HEMBA1000392 | 1.49 | 1.4 | 3.06 | 2.58 | 3.78 | 1.94 | | |
| HEMBA1000396 | 1.82 | 2.16 | 3.45 | 3.43 | 4.93 | 3.34 | | |
| HEMBA1000411 | 1.01 | 1.41 | 4.49 | 1.94 | 4.41 | 2.21 | | |
| HEMBA1000418 | 2.85 | 3.21 | 4.41 | 7.75 | 6.81 | 5.17 | * | + |
| HEMBA1000422 | 0.99 | 1.89 | 2.14 | 2.64 | 4.03 | 2.89 | | |
| HEMBA1000428 | 0.36 | 2.43 | 3.09 | 2.58 | 3.31 | 2.75 | | |
| HEMBA1000434 | 0.54 | 2.19 | 2.93 | 2.11 | 3.6 | 2.69 | | |
| HEMBA1000442 | 0.82 | 2.2 | 3.37 | 2.13 | 3.8 | 2.28 | | |
| HEMBA1000443 | 1.19 | 1.9 | 3.12 | 2.99 | 6.28 | 3.59 | | |
| HEMBA1000446 | 38.48 | 43.56 | 75.05 | 56.34 | 60.86 | 69.87 | | |
| HEMBA1000456 | 5.19 | 4.41 | 6.5 | 7.45 | 5.62 | 8.77 | | |
| HEMBA1000459 | 1.95 | 2.11 | 4.24 | 3.46 | 6.17 | 5.55 | | |
| HEMBA1000460 | 7.46 | 7.84 | 8.87 | 13.59 | 12.54 | 18.45 | * | + |
| HEMBA1000462 | 2.11 | 3.51 | 5.04 | 6.05 | 5.16 | 7.49 | | |
| HEMBA1000464 | 1.33 | 0.96 | 1.73 | 1.69 | 2.74 | 2.53 | | |
| HEMBA1000468 | 1.25 | 1.44 | 2.43 | 1.69 | 3.48 | 2.22 | | |
| HEMBA1000469 | 2.89 | 3.37 | 8.1 | 5.42 | 8.81 | 8.01 | | |
| HEMBA1000477 | 2.87 | 3.03 | 7.4 | 5.41 | 9.68 | 6.83 | | |
| HEMBA1000481 | 29.67 | 31.97 | 31.95 | 42.76 | 52.75 | 25.82 | | |
| HEMBA1000488 | 1.75 | 2.43 | 2.96 | 3.11 | 5.9 | 3 | | |
| HEMBA1000490 | 1.34 | 2 | 3.49 | 4.41 | 3.7 | 2.88 | | |
| HEMBA1000491 | 1.21 | 1.71 | 2.85 | 4.24 | 4.99 | 5.97 | * | + |
| HEMBA1000498 | 2.12 | 3.21 | 4.55 | 4.39 | 7.76 | 5.94 | | |
| HEMBA1000501 | 2.22 | 3.36 | 6.25 | 6.44 | 8.93 | 9.74 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1000504 | 2.93 | 3.18 | 4.82 | 3.63 | 5.37 | 3.83 | | |
| HEMBA1000505 | 0.81 | 1.97 | 3.33 | 2.72 | 5.1 | 3.58 | | |
| HEMBA1000507 | 1.02 | 2.24 | 5.29 | 4.17 | 8.62 | 7 | | |
| HEMBA1000508 | 2.25 | 2.3 | 7.65 | 4.84 | 8.57 | 6.64 | | |
| HEMBA1000518 | 1.38 | 0.96 | 0.98 | 1.89 | 2.97 | 1.8 | * | + |
| HEMBA1000519 | 9.5 | 7.28 | 15.97 | 19.28 | 20.99 | 19.72 | * | + |
| HEMBA1000520 | 0.45 | 1.12 | 1.18 | 1.94 | 4.83 | 4.3 | * | + |
| HEMBA1000523 | 2.32 | 1.88 | 3.22 | 3.48 | 5.33 | 3.65 | | |
| HEMBA1000531 | 1.39 | 1.46 | 2.44 | 2.67 | 5.34 | 4.63 | * | + |
| HEMBA1000534 | 0.55 | 0.95 | 2.97 | 6.63 | 11.62 | 10.39 | ** | + |
| HEMBA1000538 | 0.51 | 1.08 | 2.31 | 12.58 | 21.02 | 13.18 | ** | + |
| HEMBA1000540 | 2.8 | 3.11 | 6.06 | 5.82 | 10.38 | 6.39 | | |
| HEMBA1000542 | 9.16 | 7.79 | 43.94 | 62.25 | 95.7 | 81.15 | * | + |
| HEMBA1000545 | 1.51 | 2.31 | 1.65 | 3.19 | 4.29 | 3.7 | ** | + |
| HEMBA1000547 | 2.99 | 3.12 | 4.94 | 4.94 | 5.3 | 4.97 | | |
| HEMBA1000551 | 2.32 | 1.99 | 9.54 | 4.68 | 7.33 | 9.81 | | |
| HEMBA1000555 | 3.81 | 3.23 | 6.39 | 5.03 | 6.43 | 8.08 | | |
| HEMBA1000557 | 2.16 | 2.06 | 6.07 | 3.98 | 6.46 | 5.06 | | |
| HEMBA1000561 | 1.71 | 2.9 | 4.9 | 1.63 | 4.39 | 3.67 | | |
| HEMBA1000563 | 1.73 | 1.85 | 4.09 | 2.72 | 3.94 | 2.83 | | |
| HEMBA1000567 | 1.02 | 1.01 | 1.67 | 1.21 | 2.59 | 1.92 | | |
| HEMBA1000568 | 2.19 | 2.5 | 6.09 | 7.62 | 6.65 | 6.84 | | |
| HEMBA1000569 | 1.3 | 2.8 | 3.02 | 2.18 | 6.47 | 2.3 | | |
| HEMBA1000575 | 3.73 | 4.91 | 10.84 | 10.19 | 15.17 | 13.08 | | |
| HEMBA1000588 | 1.75 | 2.49 | 4.16 | 3.12 | 5.5 | 3.83 | | |
| HEMBA1000590 | 0.59 | 1.02 | 2.06 | 2.24 | 2.53 | 1.35 | | |
| HEMBA1000591 | 3.17 | 3.3 | 5.18 | 10.84 | 12.16 | 9.8 | ** | + |
| HEMBA1000592 | 4.2 | 5.19 | 7.77 | 13.85 | 14.94 | 11.78 | ** | + |
| HEMBA1000594 | 1.95 | 1.97 | 3.16 | 4 | 5.86 | 4.94 | * | + |
| HEMBA1000604 | 1.19 | 3.37 | 3.48 | 5.41 | 10.91 | 5.29 | | |
| HEMBA1000607 | 2.83 | 5.09 | 12.7 | 15.52 | 18.13 | 20.66 | * | + |
| HEMBA1000608 | 0.9 | 2.34 | 2.46 | 2.6 | 5.5 | 2.31 | | |
| HEMBA1000622 | 0.96 | 2.19 | 3.55 | 3.61 | 5.24 | 3.8 | | |
| HEMBA1000634 | 17.56 | 22.96 | 30.36 | 71.62 | 60.59 | 51.59 | ** | + |
| HEMBA1000636 | 4.59 | 3.95 | 6.78 | 15.48 | 12.35 | 12.73 | ** | + |
| HEMBA1000637 | 0.93 | 0.48 | 2.58 | 2.42 | 3.19 | 2.21 | | |
| HEMBA1000655 | 1.33 | 2.11 | 4.84 | 6.91 | 5.57 | 6.31 | * | + |
| HEMBA1000657 | 1.35 | 1.78 | 3.24 | 4.89 | 5.28 | 3.26 | * | + |
| HEMBA1000662 | 1.3 | 2.42 | 2.73 | 2.52 | 3.78 | 2.72 | | |
| HEMBA1000664 | 0.94 | 1.6 | 2.87 | 3.11 | 4.63 | 2.94 | | |
| HEMBA1000671 | 2.96 | 3.84 | 11.68 | 21.25 | 18.69 | 15.76 | * | + |
| HEMBA1000673 | 1.46 | 2.23 | 4.76 | 7.44 | 7.49 | 5.51 | * | + |
| HEMBA1000675 | 4.18 | 3.09 | 4.54 | 8.18 | 7.19 | 8.04 | ** | + |
| HEMBA1000678 | 2.23 | 2.7 | 4.47 | 5.03 | 7.16 | 5.16 | | |
| HEMBA1000682 | 3.4 | 4.64 | 8.41 | 13.76 | 13.69 | 14.29 | ** | + |
| HEMBA1000686 | 2.73 | 3.88 | 4.83 | 6.23 | 6.6 | 5.32 | * | + |
| HEMBA1000702 | 1.56 | 2.07 | 5.25 | 4.15 | 5.78 | 4.32 | | |
| HEMBA1000705 | 0.65 | 1.71 | 3.43 | 2.34 | 3.21 | 1.64 | | |
| HEMBA1000713 | 3.31 | 5.6 | 6.12 | 6.94 | 5.86 | 5.47 | | |
| HEMBA1000718 | 2.14 | 2.7 | 5.25 | 6.11 | 5.09 | 5.95 | | |
| HEMBA1000719 | 9.64 | 12.27 | 17.77 | 16.64 | 15.52 | 15.64 | | |
| HBMBA1000722 | 1.97 | 1.7 | 3.6 | 6.55 | 6.45 | 5.02 | ** | + |
| HEMBA1000726 | 2.2 | 2.23 | 5.12 | 9.4 | 8.77 | 9.36 | ** | + |
| HEMBA1000727 | 4.09 | 5.35 | 6.41 | 5.13 | 9.08 | 8.37 | | |
| HEMBA1000732 | 1.22 | 2.74 | 4.21 | 4.93 | 5.58 | 4.42 | | |
| HEMBA1000736 | 1.56 | 2.15 | 3.24 | 4.11 | 5.19 | 4.62 | * | + |
| HEMBA1000743 | 1.25 | 2.72 | 3.41 | 5.05 | 4.88 | 4.16 | * | + |
| HEMBA1000745 | 1.59 | 2.47 | 3.64 | 4.88 | 5.33 | 3.49 | | |
| HEMBA1000747 | 1.19 | 1.59 | 2.56 | 2.35 | 3.12 | 1.49 | | |
| HEMBA1000748 | 1.67 | 1.51 | 4.85 | 5.11 | 6.08 | 4.81 | | |
| HEMBA1000749 | 1.14 | 2.04 | 5.69 | 5.98 | 5.91 | 5.96 | | |
| HEMBA1000752 | 1.4 | 2.3 | 4.38 | 3.69 | 4.53 | 3.85 | | |
| HEMBA1000753 | 2.56 | 4.21 | 6.53 | 7.98 | 8.59 | 4.93 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1000757 | 1.95 | 2.95 | 3.27 | 6.33 | 6.68 | 5.94 | ** | + |
| HEMBA1000760 | 3.71 | 3.81 | 6.62 | 6.96 | 7.03 | 6.89 | | |
| HEMBA1000769 | 1.99 | 2.36 | 5.17 | 3.48 | 5.87 | 2.85 | | |
| HEMBA1000773 | 1 | 2.32 | 3.07 | 2.17 | 3.18 | 1.4 | | |
| HEMBA1000774 | 2.69 | 2.76 | 6.37 | 6.29 | 7.77 | 5.22 | | |
| HEMBA1000780 | 1.12 | 2.33 | 3.66 | 2.7 | 4.78 | 3.29 | | |
| HEMBA1000783 | 1.32 | 2.39 | 4.1 | 2.78 | 7.73 | 2.57 | | |
| HEMBA1000791 | 2.07 | 2.4 | 6.39 | 4.97 | 10.17 | 7.84 | | |
| HEMBA1000793 | 12.73 | 12.73 | 17.88 | 19.93 | 17.49 | 16.69 | | |
| HEMBA1000802 | 1.57 | 1.65 | 2.59 | 2.07 | 4.41 | 1.1 | | |
| HEMBA1000813 | 38.24 | 35.83 | 34.83 | 54.63 | 42.38 | 53.94 | * | + |
| HEMBA1000817 | 2.63 | 3.82 | 5.44 | 5.12 | 7.02 | 5.49 | | |
| HEMBA1000822 | 1.83 | 2.89 | 4.1 | 4.42 | 5.76 | 3.91 | | |
| HEMBA1000827 | 2.26 | 2.74 | 6.45 | 9.31 | 7.75 | 6.94 | * | + |
| HFMBA1000833 | 3.1 | 4.46 | 7.31 | 8.06 | 4.49 | 4.85 | | |
| HEMBA1000835 | 12.53 | 15.55 | 75.61 | 94.51 | 110.02 | 86.95 | * | + |
| HEMBA1000843 | 1.21 | 2.2 | 4.6 | 3.32 | 5.63 | 4.93 | | |
| HEMBA1000851 | 2.13 | 1.26 | 3.5 | 2.7 | 5.61 | 2.74 | | |
| HEMBA1000852 | 1.95 | 1.83 | 5.5 | 3.52 | 5.49 | 3.83 | | |
| HEMBA1000867 | 0.85 | 2.79 | 4.72 | 2.77 | 5.39 | 3.07 | | |
| HEMBA1000869 | 0.58 | 1.29 | 2.51 | 2.84 | 3.97 | 2.38 | | |
| HEMBA1000870 | 2.56 | 2.97 | 2.59 | 3.39 | 5.16 | 5.49 | * | + |
| HFMBA1000872 | 1.44 | 2.87 | 4.01 | 4.31 | 4.14 | 4.34 | | |
| HEMBA1000875 | 1.89 | 3.09 | 5 | 3.8 | 4.38 | 3.77 | | |
| HEMBA1000876 | 1.75 | 3.36 | 4.64 | 3.9 | 6.21 | 4.9 | | |
| HEMBA1000907 | 1.99 | 2.47 | 3.81 | 3.21 | 7.15 | 5.53 | | |
| HEMBA1000908 | 0.81 | 2.06 | 3.85 | 2 | 5.43 | 1.98 | | |
| HEMBA1000910 | 1.97 | 1.61 | 3.71 | 3.35 | 5.25 | 2.98 | | |
| HEMBA1000918 | 0.76 | 1.34 | 4.37 | 4.93 | 6.54 | 6.95 | * | + |
| HEMBA1000919 | 0.86 | 1.97 | 2.19 | 2.49 | 3.07 | 3.07 | | |
| HEMBA1000934 | 2.5 | 2.56 | 1.16 | 2.14 | 3.51 | 2.5 | | |
| HEMBA1000935 | 1.46 | 1.62 | 4.21 | 2.08 | 5.15 | 3.64 | | |
| HEMBA1000940 | 1.98 | 3.08 | 3.1 | 2.52 | 9.96 | 5.72 | | |
| HEMBA1000942 | 2.31 | 2.27 | 4.77 | 4.81 | 7.75 | 6.69 | | |
| HEMBA1000943 | 0.58 | 1.25 | 2.28 | 1.83 | 3.38 | 2.18 | | |
| HEMBA1000946 | 3.63 | 4.04 | 4.54 | 6.87 | 14.9 | 8.4 | | |
| HEMBA1000960 | 2.63 | 3.48 | 9.97 | 10.24 | 12.79 | 10.7 | | |
| HEMBA1000962 | 1.99 | 2.18 | 2.01 | 4.43 | 3.83 | 4.56 | ** | + |
| HEMBA1000968 | 1.73 | 1.86 | 4.7 | 4.1 | 4.83 | 4.66 | | |
| HEMBA1000971 | 1.75 | 2.51 | 2.9 | 4.18 | 5.27 | 5.71 | ** | + |
| HEMBA1000972 | 1.45 | 1.57 | 3.83 | 2.63 | 4.44 | 3.49 | | |
| HEMBA1000974 | 1.69 | 2.69 | 6.33 | 7.39 | 9.35 | 8.82 | * | + |
| HBMBA1000975 | 0.9 | 1.83 | 4.17 | 3.31 | 5.54 | 5.12 | | |
| HEMBA1000979 | 1.45 | 1.69 | 3.98 | 2.55 | 6.12 | 3.93 | | |
| HEMBA1000981 | 4.21 | 6.9 | 9.5 | 11.75 | 13.27 | 14.72 | * | + |
| HEMBA1000983 | 1.94 | 1.45 | 3.01 | 3.89 | 4.53 | 4.15 | * | + |
| HEMBA1000985 | 1.58 | 0.92 | 2.75 | 1.73 | 3.28 | 2.79 | | |
| HEMBA1000986 | 1.2 | 1.48 | 2.47 | 3.61 | 4.91 | 4.26 | ** | + |
| HEMBA1000991 | 1.56 | 1.86 | 3.8 | 3.11 | 5.05 | 5.96 | | |
| HEMBA1001007 | 0.89 | 1.08 | 4.08 | 1.84 | 3.89 | 2.71 | | |
| HEMBA1001008 | 3.64 | 3.41 | 5.86 | 3.89 | 7.89 | 4.95 | | |
| HEMBA1001009 | 0.89 | 1.3 | 3.07 | 1.58 | 3.83 | 1.81 | | |
| HEMBA1001014 | 3.54 | 4.39 | 9.91 | 11.82 | 15.38 | 14.12 | * | + |
| HEMBA1001017 | 4.21 | 2.82 | 5.6 | 6.04 | 5.41 | 8.55 | | |
| HEMBA1001019 | 1.92 | 2.81 | 3.97 | 8.71 | 7.74 | 8.29 | ** | + |
| HEMBA1001020 | 1.23 | 2.71 | 2.3 | 2.84 | 5.05 | 3.6 | | |
| HEMBA1001021 | 1.07 | 1.62 | 2.89 | 3.13 | 5.24 | 2.63 | | |
| HEMBA1001022 | 2.29 | 2.25 | 4.35 | 6.33 | 8.57 | 3.81 | | |
| HEMBA1001024 | 0.31 | 1.14 | 2.16 | 2.87 | 3.97 | 1.26 | | |
| HEMBA1001026 | 0.42 | 1.52 | 1.86 | 2 | 3.22 | 2 | | |
| HEMBA1001043 | 1.43 | 2.46 | 2.38 | 4.63 | 5.28 | 4.25 | ** | + |
| HEMBA1001051 | 3.36 | 2.79 | 11.52 | 13.26 | 18.17 | 18.47 | * | + |
| HEMBA1001052 | 0.86 | 2.15 | 2.18 | 1.75 | 3.58 | 2.48 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1001059 | 5.62 | 9.28 | 26.25 | 40.62 | 56.12 | 43.49 | * | + |
| HEMBA1001060 | 2.66 | 3.67 | 6.45 | 10.78 | 8.35 | 9.62 | * | + |
| HEMBA1001064 | 2.12 | 2.87 | 3.3 | 6.04 | 6.48 | 4.69 | ** | + |
| HEMBA1001071 | 29.39 | 41.54 | 55.57 | 143.9 | 102.43 | 121.71 | ** | + |
| HEMBA1001077 | 2.37 | 1.77 | 5.21 | 5.36 | 6.66 | 3.96 | | |
| HEMBA1001078 | 2.18 | 2.6 | 5.91 | 13.3 | 13.21 | 11.09 | ** | + |
| HEMBA1001080 | 4.03 | 3.46 | 11.86 | 24.15 | 26.66 | 26.65 | ** | + |
| HEMBA1001084 | 1.27 | 2.37 | 2.9 | 5.07 | 5.88 | 5.13 | ** | + |
| HEMBA1001085 | 1.24 | 2.87 | 4.04 | 4.34 | 5.41 | 4.56 | | |
| HEMBA1001088 | 6.62 | 6 | 8.04 | 3.79 | 4.34 | 5.81 | | |
| HEMBA1001093 | 0.61 | 1.76 | 2.72 | 3.09 | 3.02 | 2.99 | | |
| HEMBA1001094 | 0.64 | 0.78 | 2.07 | 2.08 | 2.99 | 1.99 | | |
| HEMBA1001099 | 1.01 | 1.72 | 3 | 2.5 | 2.95 | 2.26 | | |
| HEMBA1001104 | 1.2 | 1.75 | 2.63 | 3.64 | 8.04 | 3.3 | | |
| HEMBA1001109 | 4.87 | 3.77 | 8.57 | 11.32 | 14.48 | 11.73 | * | + |
| HEMBA1001114 | 44.68 | 41.2 | 93.35 | 141.87 | 145.19 | 167.76 | ** | + |
| HEMBA1001121 | 2.14 | 2.03 | 3.87 | 2.41 | 6 | 3.25 | | |
| HEMBA1001122 | 9.79 | 10 | 14.12 | 7.73 | 11.5 | 22.69 | | |
| HEMBA1001123 | 2.79 | 3.28 | 5.2 | 5.81 | 6.02 | 4.95 | | |
| HEMBA1001133 | 0.97 | 1.69 | 2.54 | 2.78 | 3.84 | 1.21 | | |
| HEMBA1001137 | 0.82 | 1.73 | 3.65 | 3.74 | 3.36 | 2.54 | | |
| HEMBA1001140 | 1.23 | 2.75 | 2.98 | 3.62 | 5.18 | 4.34 | * | + |
| HEMBA1001144 | 4.12 | 3.41 | 9.06 | 14.13 | 14.12 | 13.96 | ** | + |
| HEMBA1001145 | 47.87 | 43.87 | 65.7 | 98.4 | 75.15 | 81.3 | * | + |
| HEMBA1001158 | 7.55 | 9.5 | 11.62 | 13.02 | 7.58 | 12.5 | | |
| HEMBA1001172 | 1.44 | 2.85 | 4.37 | 5.32 | 5.77 | 5.17 | * | + |
| HEMBA1001174 | 0.95 | 2.06 | 2.83 | 3.88 | 6.31 | 3.25 | | |
| HEMBA1001175 | 6.93 | 8.56 | 10.73 | 14.17 | 14.5 | 10.18 | | |
| HEMBA1001182 | 16.93 | 19.89 | 82.44 | 135.93 | 145.36 | 122.22 | * | + |
| HEMBA1001184 | 1.41 | 1.24 | 2.45 | 1.85 | 3.03 | 1.47 | | |
| HEMBA1001192 | 1.72 | 1.75 | 4.01 | 5.65 | 5.17 | 3.98 | | |
| HEMBA1001196 | 2.31 | 3.63 | 7.61 | 9.43 | 10.51 | 8.97 | * | + |
| HEMBA1001197 | 31.18 | 35.89 | 86.14 | 95.35 | 83.09 | 93.59 | | |
| HEMBA1001208 | 1.83 | 2.59 | 3 | 2.67 | 5.3 | 2.61 | | |
| HEMBA1001213 | 12.99 | 16.12 | 69.9 | 102.88 | 119.96 | 113.72 | * | + |
| HEMBA1001214 | 1.39 | 3.11 | 4.36 | 5.14 | 7.04 | 4.62 | | |
| HEMBA1001221 | 1.63 | 1.62 | 3.66 | 2.06 | 4.19 | 1.89 | | |
| HEMBA1001225 | 1.06 | 2.66 | 3.53 | 1.44 | 3.43 | 1.52 | | |
| HEMBA1001226 | 4.76 | 4.65 | 11.94 | 13.58 | 15.58 | 14.92 | * | + |
| HEMBA1001228 | 72.4 | 75.3 | 102.4 | 38.23 | 64.63 | 78.89 | | |
| HEMBA1001229 | 18 | 21.39 | 82.05 | 115.91 | 145.39 | 128.91 | * | + |
| HEMBA1001235 | 3.58 | 4.11 | 6.48 | 7.31 | 6.7 | 10.2 | | |
| HEMBA1001238 | 2.46 | 2.49 | 7.23 | 4.6 | 6.94 | 4.74 | | |
| HEMBA1001242 | 15.36 | 14.03 | 91.45 | 92.81 | 94.02 | 90.34 | | |
| HEMBA1001247 | 4.41 | 4.36 | 12.46 | 12.48 | 14.07 | 15.62 | | |
| HEMBA1001253 | 8.79 | 11.4 | 61.56 | 77.17 | 102.24 | 94.81 | * | + |
| HEMBA1001257 | 1.98 | 2.71 | 3.78 | 3.52 | 4.29 | 3.17 | | |
| HEMBA1001261 | 3.01 | 3.18 | 4.56 | 4.54 | 3.75 | 5.59 | | |
| HEMBA1001262 | 1.48 | 3.79 | 2.81 | 2.42 | 4.34 | 4.59 | | |
| HEMBA1001265 | 2.76 | 3.21 | 6.85 | 5.5 | 7.32 | 5.1 | | |
| HEMBA1001266 | 3.97 | 3.17 | 6.31 | 7.8 | 10.5 | 8.38 | * | + |
| HEMBA1001269 | 15.98 | 10.36 | 12.79 | 22.69 | 24.71 | 25.21 | ** | + |
| HEMBA1001272 | 1.31 | 2.04 | 4.3 | 1.62 | 5.12 | 2.07 | | |
| HEMBA1001279 | 2.54 | 3.52 | 13.6 | 18.68 | 23.45 | 18.99 | * | + |
| HEMBA1001281 | 16.58 | 20.99 | 40.84 | 47.71 | 59.04 | 45.72 | * | + |
| HEMBA1001286 | 3.25 | 4.71 | 10.71 | 11.24 | 10.65 | 12.38 | | |
| HEMBA1001289 | 0.41 | 1.57 | 1.64 | 1.3 | 3.57 | 2.41 | | |
| HEMBA1001291 | 3.52 | 4.58 | 9.53 | 10.91 | 18.3 | 18.8 | * | + |
| HEMBA1001294 | 2.01 | 1.81 | 4.6 | 4.04 | 7.73 | 5.12 | | |
| HEMBA1001296 | 3.4 | 3.52 | 4.37 | 3.77 | 5.94 | 5.22 | | |
| HEMBA1001297 | 2.88 | 3.61 | 5.51 | 4.81 | 6.88 | 5.38 | | |
| HEMBA1001299 | 2.49 | 2.9 | 6.21 | 6.45 | 8.84 | 7.74 | * | + |
| HEMBA1001302 | 9.42 | 11.94 | 15.52 | 3.25 | 35.12 | 25.74 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1001303 | 1.8 | 1.99 | 2.61 | 3.57 | 3.8 | 3.3 | ** | + |
| HEMBA1001306 | 1.4 | 1.15 | 2.85 | 5.01 | 4.46 | 4.82 | ** | + |
| HEMBA1001308 | 3.43 | 4.37 | 16.7 | 16.31 | 18.28 | 21.75 | | |
| HEMBA1001310 | 1.93 | 1.71 | 4.17 | 2.38 | 6.26 | 3.28 | | |
| HEMBA1001312 | 10.09 | 10.35 | 17.42 | 20.51 | 24.71 | 21.67 | * | + |
| HEMBA1001319 | 1.23 | 1.41 | 3.85 | 2.23 | 4.27 | 4.01 | | |
| HEMBA1001322 | 1.81 | 2.29 | 4.17 | 2.83 | 4.74 | 3.78 | | |
| HEMBA1001323 | 4.04 | 3.65 | 8.44 | 14.68 | 23.44 | 18.68 | * | + |
| HEMBA1001326 | 8.79 | 7.35 | 10.15 | 12.24 | 13.62 | 15.04 | * | + |
| HEMBA1001327 | 0.94 | 1.65 | 3.18 | 3.55 | 5.18 | 4.56 | * | + |
| HEMBA1001330 | 1.59 | 2.22 | 6.96 | 7.36 | 9.28 | 9.64 | * | + |
| HEMBA1001348 | 1.68 | 3.99 | 3.89 | 6.33 | 9.84 | 7.47 | * | + |
| HEMBA1001350 | 5.28 | 4.16 | 6.34 | 7.24 | 13.17 | 10.12 | | |
| HEMBA1001351 | 15.37 | 14.99 | 17.64 | 37.37 | 49.52 | 25.96 | * | + |
| HEMBA1001352 | 3.25 | 3.62 | 5.97 | 8.16 | 13.65 | 5.75 | | |
| HEMBA1001353 | 30.24 | 37.73 | 49.4 | 76.74 | 96.09 | 96.34 | ** | + |
| HEMBA1001358 | 13.98 | 9.73 | 17.96 | 30.89 | 27.69 | 30.6 | ** | + |
| HEMBA1001361 | 1.7 | 3.24 | 4.96 | 4.18 | 6.08 | 6.06 | | |
| HEMBA1001364 | 0.8 | 1.71 | 2.4 | 1.47 | 4.11 | 2.95 | | |
| HEMBA1001375 | 3.45 | 2.77 | 5.75 | 5.71 | 5.83 | 6.32 | | |
| HEMBA1001377 | 2.81 | 3.16 | 7.36 | 5.37 | 7.98 | 7.89 | | |
| HEMBA1001383 | 0.25 | 1.64 | 2.61 | 1.26 | 2.47 | 1.84 | | |
| HEMBA1001387 | 1.81 | 2.15 | 3.66 | 1.94 | 5.14 | 2.47 | | |
| HEMBA1001388 | 1.52 | 1.78 | 5.07 | 2.01 | 4.61 | 3.49 | | |
| HEMBA1001390 | 34.61 | 34.52 | 66.57 | 67.03 | 50 | 56.4 | | |
| HEMBA1001391 | 1.65 | 2.77 | 4.83 | 4.32 | 7.98 | 3.82 | | |
| HEMBA1001398 | 1.98 | 2.87 | 7.47 | 7.24 | 10.42 | 8.29 | | |
| HEMBA1001405 | 1.17 | 2 | 3.87 | 2.99 | 5.3 | 2.61 | | |
| HEMBA1001406 | 2.01 | 3.27 | 3.75 | 5.35 | 6.62 | 4.33 | * | + |
| HEMBA1001407 | 1.13 | 1.78 | 3.73 | 6.39 | 6.64 | 4.44 | * | + |
| HEMBA1001411 | 1.44 | 2.81 | 4.47 | 7.2 | 6.35 | 6.04 | * | + |
| HEMBA1001413 | 1.84 | 1.53 | 3.31 | 3.61 | 3.75 | 3.76 | | |
| HEMBA1001414 | 1.47 | 2.34 | 5.3 | 5.33 | 7.22 | 5.47 | | |
| HEMBA1001415 | 1.91 | 2.36 | 4.97 | 4.4 | 5.86 | 4.29 | | |
| HEMBA1001416 | 4.73 | 4.85 | 9.54 | 8.87 | 11.06 | 9.4 | | |
| HEMBA1001432 | 1.23 | 1.27 | 4.43 | 4.27 | 6.64 | 3.59 | | |
| HEMBA1001433 | 1.96 | 2.93 | 4.55 | 4.33 | 8.66 | 3.64 | | |
| HEMBA1001435 | 2.17 | 2.27 | 6.39 | 7.02 | 10.35 | 5.88 | | |
| HEMBA1001442 | 0.99 | 0.68 | 2.02 | 2.36 | 3.12 | 1.81 | | |
| HEMBA1001446 | 1.87 | 1.84 | 5.82 | 9.71 | 8.93 | 11.01 | ** | + |
| HEMBA1001450 | 2.35 | 2.32 | 11.22 | 8.61 | 10.08 | 6.34 | | |
| HEMBA1001454 | 3.08 | 4.25 | 9.69 | 13.64 | 10.73 | 11.82 | * | + |
| HEMBA1001455 | 2.28 | 2.7 | 3.11 | 2.69 | 5.54 | 2.8 | | |
| HEMBA1001459 | 2.74 | 3.37 | 6.03 | 5.07 | 7.38 | 5.52 | | |
| HEMBA1001461 | 3.34 | 4.47 | 6.96 | 6.8 | 9.85 | 7.47 | | |
| HEMBA1001462 | 1.07 | 1.47 | 2.79 | 2.67 | 4.5 | 2.54 | | |
| HEMBA1001463 | 1.38 | 1.61 | 5.25 | 4.95 | 5.46 | 5.51 | | |
| HEMBA1001469 | 3.9 | 4.51 | 7.32 | 10.63 | 9.83 | 7.76 | * | + |
| HEMBA1001473 | 4.56 | 3.49 | 8.25 | 7.52 | 10.34 | 6.53 | | |
| HEMBA1001477 | 2.14 | 1.59 | 4.64 | 3.41 | 5.75 | 2.59 | | |
| HEMBA1001478 | 2.46 | 2.8 | 3.77 | 2.95 | 3.73 | 2.55 | | |
| HEMBA1001480 | 4.15 | 6.8 | 8.96 | 11.64 | 11.87 | 8.48 | | |
| HEMBA1001483 | 1.9 | 1.64 | 5.71 | 6.6 | 8.22 | 7.23 | * | + |
| HEMBA1001490 | 1.45 | 2.09 | 3.76 | 5.16 | 4.52 | 4.65 | * | + |
| HEMBA1001495 | 56.8 | 53.41 | 123.27 | 193.11 | 133.65 | 132.04 | | |
| HEMBA1001497 | 2.06 | 1.98 | 7.47 | 4.81 | 8.45 | 5.85 | | |
| HEMBA1001510 | 3.99 | 4.23 | 15.22 | 11.46 | 13.7 | 14.56 | | |
| HEMBA1001515 | 1.45 | 2.33 | 4.02 | 3.73 | 6.11 | 3.04 | | |
| HEMBA1001517 | 1.6 | 2.21 | 4.6 | 5.26 | 5.4 | 4.6 | | |
| HEMBA1001522 | 1.56 | 2.72 | 3.77 | 3.61 | 6.37 | 2.43 | | |
| HEMBA1001526 | 2.19 | 2.97 | 4.97 | 4.05 | 4.38 | 3.59 | | |
| HEMBA1001533 | 3.19 | 2.86 | 6.23 | 6.83 | 7.76 | 4.64 | | |
| HEMBA1001547 | 7.26 | 5.37 | 13.69 | 5 | 7.96 | 6.19 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1001552 | 7.12 | 4.72 | 17.79 | 16.12 | 16.3 | 16.05 | | |
| HEMBA1001553 | 41.67 | 45.48 | 66.23 | 57.2 | 47.01 | 79.81 | | |
| HEMBA1001557 | 2.24 | 2.93 | 5.15 | 5.81 | 8.33 | 4.59 | | |
| HEMBA1001563 | 1.69 | 2.4 | 4.56 | 3.66 | 6.99 | 4.76 | | |
| HEMBA1001566 | 1.42 | 3.27 | 8.29 | 5.94 | 9.04 | 5.84 | | |
| HEMBA1001569 | 11.15 | 11.91 | 26.6 | 30.2 | 31.14 | 32.61 | * | + |
| HEMBA1001570 | 3.25 | 4.61 | 10.2 | 9.19 | 10.25 | 9.53 | | |
| HEMBA1001579 | 3.63 | 4.4 | 7.77 | 9.26 | 7.4 | 9.93 | | |
| HEMBA1001581 | 2.79 | 3.33 | 10.95 | 8.81 | 12.09 | 9.08 | | |
| HEMBA1001582 | 3.22 | 3.18 | 6.68 | 6.35 | 6.84 | 4.03 | | |
| HEMBA1001585 | 2.7 | 3.07 | 4.52 | 4.4 | 5.6 | 3.5 | | |
| HEMBA1001589 | 1.82 | 2.31 | 3.63 | 4.39 | 6.19 | 3.78 | | |
| HEMBA1001595 | 13.06 | 15.57 | 19.7 | 13.25 | 13.29 | 14.02 | | |
| HEMBA1001604 | 1.96 | 2.67 | 3.64 | 3.76 | 6.53 | 2.82 | | |
| HEMBA1001608 | 5.58 | 7.09 | 16.17 | 14.14 | 16.46 | 14.43 | | |
| HEMBA1001615 | 113.28 | 90.33 | 205.41 | 240.97 | 118.65 | 165.59 | | |
| HEMBA1001620 | 3.71 | 5.56 | 10.54 | 12.22 | 12.24 | 11.46 | | |
| HEMBA1001621 | 0.76 | 2.13 | 3.42 | 1.76 | 3.44 | 2.97 | | |
| HEMBA1001635 | 2.32 | 2.13 | 3.41 | 3.55 | 4.9 | 2.85 | | |
| HEMBA1001636 | 1.9 | 1.93 | 4.01 | 3.34 | 5.33 | 2.97 | | |
| HEMBA1001640 | 3.07 | 3.31 | 13.65 | 10.96 | 15.01 | 10.74 | | |
| HEMBA1001647 | 8.92 | 8.44 | 57.38 | 88.92 | 112.42 | 87.46 | * | + |
| HEMBA1001651 | 2.53 | 3.54 | 7.85 | 6.62 | 9.07 | 8.73 | | |
| HEMBA1001655 | 2.09 | 2.66 | 4.78 | 3.35 | 6.75 | 4.09 | | |
| HEMBA1001658 | 4.33 | 4.5 | 9.27 | 7.26 | 11.15 | 8.6 | | |
| HEMBA1001661 | 0.75 | 1.78 | 2.8 | 1.98 | 3.22 | 1.77 | | |
| HEMBA1001665 | 1.52 | 1.85 | 3.47 | 2.63 | 6.63 | 1.73 | | |
| HEMBA1001670 | 5.32 | 6.54 | 8.82 | 12.45 | 15.21 | 12.42 | ** | + |
| HEMBA1001672 | 2.49 | 3.06 | 5.9 | 4.28 | 7.62 | 3.39 | | |
| HEMBA1001673 | 8.23 | 10.76 | 13.22 | 20.04 | 19.39 | 15.65 | * | + |
| HEMBA1001675 | 2.4 | 2.01 | 2.53 | 3.21 | 5.79 | 3.36 | | |
| HEMBA1001676 | 54.19 | 46.09 | 107.65 | 245.72 | 212.81 | 275.65 | ** | + |
| HEMBA1001678 | 9.46 | 10.2 | 21.87 | 23.65 | 19.51 | 27.88 | | |
| HEMBA1001680 | 4.58 | 4.89 | 12.32 | 9.39 | 10.95 | 11.65 | | |
| HEMBA1001681 | 1.71 | 2.44 | 5.75 | 6.25 | 9.11 | 6.36 | | |
| HEMBA1001684 | 1.89 | 2.74 | 6.26 | 4.32 | 7.57 | 6.98 | | |
| HEMBA1001695 | 1.48 | 2.08 | 3.42 | 2.3 | 4.76 | 3.15 | | |
| HEMBA1001702 | 1.54 | 2.96 | 3.55 | 2.36 | 7.57 | 3.09 | | |
| HEMBA1001709 | 1.23 | 1.8 | 3.51 | 3.21 | 4.87 | 3.5 | | |
| HEMBA1001711 | 1.29 | 1.98 | 2.83 | 2.99 | 2.45 | 3.18 | | |
| HEMBA1001712 | 0.92 | 1.55 | 2.56 | 2.13 | 3.02 | 2.24 | | |
| HEMBA1001714 | 10.37 | 10.82 | 19.06 | 23.54 | 22 | 23.8 | * | + |
| HEMBA1001717 | 79.4 | 71.16 | 124.25 | 152.62 | 195.81 | 173.65 | * | + |
| HEMBA1001718 | 1.95 | 2.12 | 7.32 | 5.99 | 6.59 | 5.26 | | |
| HEMBA1001723 | 3.43 | 3 | 10.19 | 9.09 | 12.53 | 9.64 | | |
| HEMBA1001731 | 1.3 | 1.36 | 3.27 | 1.58 | 4.8 | 2.29 | | |
| HEMBA1001734 | 2.37 | 2.38 | 4.28 | 4.78 | 6.06 | 4.27 | | |
| HEMBA1001736 | 2.3 | 2.12 | 2.87 | 3.5 | 4.69 | 5.33 | * | + |
| HEMBA1001741 | 1.69 | 2.19 | 3.5 | 4.02 | 4.74 | 2.9 | | |
| HEMBA1001744 | 0.86 | 0.94 | 2.81 | 2 | 3.64 | 2.64 | | |
| HEMBA1001745 | 0.95 | 1.56 | 2.3 | 2.53 | 5.28 | 2.58 | | |
| HEMBA1001746 | 4.02 | 3.91 | 8.66 | 9.21 | 12.06 | 7.01 | | |
| HEMBA1001761 | 2.2 | 2.01 | 4.69 | 2.58 | 3.95 | 3.37 | | |
| HEMBA1001762 | 1.41 | 1.6 | 3.57 | 1.93 | 4.38 | 2.03 | | |
| HEMBA1001781 | 1.56 | 1.5 | 4.17 | 2.15 | 5.87 | 3.25 | | |
| HEMBA1001784 | 1.36 | 1.39 | 4.5 | 4.02 | 3.58 | 3.75 | | |
| HEMBA1001791 | 2.16 | 1.74 | 6.97 | 6.04 | 7.62 | 5.68 | | |
| HEMBA1001794 | 2.15 | 4.3.11 | 2.57 | 13.54 | 13.65 | 12.96 | | |
| HEMBA1001800 | 5.61 | 9.63 | 60.44 | 84.85 | 100.03 | 76.26 | * | + |
| HEMBA1001803 | 2.84 | 4.25 | 5.36 | 4.27 | 7.02 | 3.67 | | |
| HEMBA1001804 | 6.2 | 8.13 | 20.95 | 29.84 | 26.86 | 24.39 | * | + |
| HEMBA1001808 | 1.61 | 1.6 | 3.87 | 3.71 | 3.67 | 2.89 | | |
| HEMBA1001809 | 8.07 | 6.27 | 10.64 | 14.33 | 20.56 | 16.63 | * | + |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and −, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1001811 | 8.32 | 7.83 | 16.8 | 22.75 | 21.75 | 17.6 | * | + |
| HEMBA1001815 | 1.75 | 2.67 | 6.56 | 5.58 | 6.33 | 5.03 | | |
| HEMBA1001816 | 1.96 | 2.67 | 4.47 | 3.09 | 4.6 | 3.04 | | |
| HEMBA1001819 | 0.98 | 3.09 | 6.16 | 6.19 | 8.53 | 6.3 | | |
| HEMBA1001820 | 0.93 | 1.32 | 2.22 | 2.36 | 3.32 | 1.21 | | |
| HEMBA1001822 | 1.87 | 2.06 | 5.43 | 6.02 | 7.7 | 4.44 | | |
| HEMBA1001824 | 3.21 | 4.62 | 14.88 | 12.81 | 16.29 | 12.34 | | |
| HEMBA1001835 | 1.04 | 1.05 | 3.05 | 3.72 | 5.21 | 3.14 | | |
| HEMBA1001844 | 7.88 | 6.55 | 18.04 | 17.77 | 21.36 | 13.19 | | |
| HEMBA1001847 | 0.93 | 1.8 | 5.21 | 1.96 | 5.18 | 3.06 | | |
| HEMBA1001849 | 2.32 | 2.77 | 7.58 | 6.65 | 8.19 | 7.62 | | |
| HEMBA1001850 | 2.51 | 2.71 | 8.43 | 8.76 | 8.88 | 7.89 | | |
| HEMBA1001861 | 0.95 | 2.04 | 1.73 | 2.64 | 3.93 | 2.01 | | |
| HEMBA1001862 | 138.58 | 133.42 | 191.61 | 266.65 | 221.43 | 227.58 | * | + |
| HEMBA1001864 | 1.31 | 1.16 | 2.44 | 4.79 | 2.88 | 2.59 | | |
| HEMBA1001866 | 1.49 | 2.39 | 7.45 | 7.67 | 7.07 | 4.61 | | |
| HEMBA1001869 | 7.55 | 6.84 | 10.82 | 10.31 | 7.69 | 9.02 | | |
| HEMBA1001871 | 29.48 | 30.98 | 54.77 | 63.07 | 62.43 | 66.59 | * | + |
| HEMBA1001876 | 0.96 | 1.27 | 4.42 | 2.08 | 4.57 | 2.26 | | |
| HEMBA1001878 | 2.23 | 3.34 | 5.7 | 6.83 | 8.18 | 5.5 | | |
| HEMBA1001879 | 1.89 | 2.57 | 5.58 | 5.99 | 7.24 | 5.72 | | |
| HEMBA1001884 | 6.21 | 6.49 | 17.14 | 11.31 | 12.71 | 10.87 | | |
| HEMBA1001886 | 2.12 | 2.21 | 4.38 | 4.57 | 5.67 | 4.23 | | |
| HEMBA1001888 | 2 | 2.12 | 6.6 | 7.41 | 10.17 | 9.46 | * | + |
| HEMBA1001890 | 4.03 | 3.67 | 7.6 | 6.8 | 7.01 | 4.4 | | |
| HEMBA1001896 | 1.34 | 1.61 | 2.62 | 2.27 | 4.12 | 3.01 | | |
| HEMBA1001899 | 33.43 | 39.48 | 61.77 | 106.52 | 41.01 | 101.91 | | |
| HEMBA1001904 | 76.64 | 122.45 | 233.99 | 299.33 | 174.47 | 322.82 | | |
| HEMBA1001910 | 1.4 | 1.93 | 3.23 | 2.53 | 6.35 | 2.97 | | |
| HEMBA1001911 | 8.36 | 8.75 | 10.86 | 21.15 | 16.9 | 13.23 | * | + |
| HEMBA1001912 | 8.92 | 7.97 | 33.97 | 57 | 51.9 | 48.59 | * | + |
| HEMBA1001913 | 4.89 | 6.19 | 17.29 | 18.56 | 14.16 | 16.85 | | |
| HEMBA1001915 | 1.35 | 2.61 | 4.49 | 3.3 | 5.63 | 2.46 | | |
| HEMBA1001918 | 15.23 | 13.29 | 21.07 | 17.07 | 14.3.11 | 2.13 | | |
| HEMBA1001921 | 4 | 3.5 | 4.38 | 5.2 | 5.35 | 4.86 | * | + |
| HEMBA1001931 | 1.19 | 1.95 | 2.53 | 2.14 | 5.17 | 2.19 | | |
| HEMBA1001939 | 1.92 | 1.77 | 4.72 | 1.97 | 5.21 | 2.57 | | |
| HEMBA1001940 | 2.61 | 2.99 | 7.14 | 3.51 | 5.86 | 3.24 | | |
| HEMBA1001942 | 1.18 | 1.88 | 3.71 | 2.33 | 5.14 | 1.56 | | |
| HEMBA1001944 | 4.35 | 5.83 | 42.16 | 51.42 | 66.43 | 59.75 | * | + |
| HEMBA1001945 | 0.98 | 2.3 | 2.95 | 2.98 | 3.4 | 2.21 | | |
| HEMBA1001950 | 2.56 | 2.84 | 7.87 | 5.72 | 5.23 | 3.68 | | |
| HEMBA1001951 | 10.37 | 11.26 | 15.33 | 24.16 | 18.26 | 22.94 | * | + |
| HEMBA1001958 | 1.04 | 1.28 | 2.58 | 3.1 | 4.83 | 2.54 | | |
| HEMBA1001960 | 6.87 | 6.28 | 13.93 | 10.02 | 12.99 | 12.47 | | |
| HEMBA1001962 | 1.01 | 1.08 | 4.19 | 1.58 | 4.24 | 1.67 | | |
| HEMBA1001964 | 1.39 | 3.45 | 4.13 | 2.54 | 4.45 | 3.39 | | |
| HEMBA1001967 | 6.06 | 5.65 | 9.33 | 14.45 | 10.5 | 13.18 | * | + |
| HEMBA1001979 | 0.7 | 2.67 | 3.31 | 2.04 | 3.46 | 2.4 | | |
| HEMBA1001987 | 1.96 | 3.92 | 7.99 | 6.19 | 8.35 | 7.22 | | |
| HEMBA1001991 | 1.61 | 3.59 | 9.06 | 5.06 | 8.7 | 7.44 | | |
| HEMBA1002003 | 4.86 | 4.71 | 14.56 | 15.86 | 16.03 | 22.9 | | |
| HEMBA1002005 | 2.62 | 3.39 | 7.82 | 4.16 | 7.48 | 4.76 | | |
| HEMBA1002008 | 2.64 | 3.51 | 7.78 | 6.07 | 10.15 | 6.37 | | |
| HEMBA1002018 | 1.86 | 2.37 | 4.23 | 3.32 | 5.47 | 3.87 | | |
| HEMBA1002022 | 0.52 | 2.3 | 2.5 | 2.83 | 3.53 | 2.82 | | |
| HEMBA1002029 | 43.82 | 40.22 | 73.75 | 89.27 | 96.12 | 122.81 | * | + |
| HEMBA1002030 | 2.23 | 2.88 | 4.32 | 3.88 | 4.26 | 4.67 | | |
| HEMBA1002035 | 1.69 | 1.75 | 3.82 | 5.43 | 5.14 | 3.75 | | |
| HEMBA1002037 | 4.47 | 4.34 | 6.69 | 4.5 | 6.47 | 7.94 | | |
| HEMBA1002038 | 4.12 | 3.13 | 7.74 | 6.36 | 8.8 | 5.42 | | |
| HEMBA1002039 | 2.46 | 3.43 | 7.03 | 6.74 | 8.99 | 6.37 | | |
| HEMBA1002042 | 5.52 | 5.55 | 9.8 | 10.55 | 13.01 | 9.94 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

|  | Synoviocyte | | | Synoviocute_TNF | | | t test vs TNF | INC. and DEC. |
|---|---|---|---|---|---|---|---|---|
| Clone | exp. 1 | exp. 2 | exp. 3 | exp. 1 | exp. 2 | exp. 3 | | |
| HEMBA1002043 | 3.81 | 3.79 | 11.32 | 12.53 | 12.64 | 13.95 | | |
| HEMBA1002048 | 2.76 | 2.31 | 3.81 | 2.03 | 4.32 | 3.44 | | |
| HEMBA1002049 | 1.72 | 2.35 | 5.55 | 4.43 | 5.2 | 5.2 | | |
| HEMBA1002053 | 7.33 | 6.91 | 14.52 | 11.09 | 15.25 | 13.63 | | |
| HEMBA1002055 | 9.81 | 8.76 | 10.65 | 18.44 | 13.58 | 17.78 | * | + |
| HEMBA1002056 | 2.24 | 2.62 | 4.26 | 5.46 | 8.06 | 5.67 | * | + |
| HEMBA1002061 | 2.24 | 2.51 | 4.58 | 4.17 | 5.34 | 4.58 | | |
| HEMBA1002080 | 46.55 | 49.5 | 54.6 | 91.78 | 122.41 | 83.23 | * | + |
| HEMBA1002084 | 0.71 | 1.43 | 2.36 | 3.25 | 3.66 | 2.64 | * | + |
| HEMBA1002085 | 0.97 | 1.47 | 2.87 | 3.45 | 4.52 | 3.74 | * | + |
| HEMBA1002092 | 1.79 | 1.56 | 3.94 | 4.01 | 5.53 | 4.15 | | |
| HEMBA1002098 | 1.51 | 1.82 | 4.12 | 3.2 | 5.11 | 2.83 | | |
| HEMBA1002100 | 9.07 | 8.18 | 22.37 | 25.95 | 23.04 | 29.67 | | |
| HEMBA1002101 | 18.26 | 17.64 | 27.49 | 23.44 | 27.16 | 23.74 | | |
| HEMBA1002102 | 2.65 | 1.98 | 5.99 | 4.58 | 7.06 | 6.99 | | |
| HEMBA1002105 | 6.79 | 6.2 | 22.13 | 24.47 | 40.8 | 25.31 | | |
| HEMBA1002107 | 57.97 | 37.86 | 84.35 | 155.21 | 136.27 | 136.87 | ** | + |
| HEMBA1002113 | 6.77 | 4.75 | 17.24 | 12.05 | 12.83 | 14.78 | | |
| HEMBA1002119 | 3.85 | 3.28 | 24.05 | 24.29 | 30.66 | 27.04 | | |
| HEMBA1002125 | 7.03 | 6.73 | 10.43 | 11.38 | 7.34 | 11.85 | | |
| HEMBA1002131 | 9.71 | 9.72 | 20.58 | 14.97 | 19.12 | 13.71 | | |
| HEMBA1002133 | 3.67 | 3.52 | 6.32 | 6.97 | 9.51 | 9.46 | * | + |
| HEMBA1002139 | 0.75 | 1.07 | 3.35 | 1.52 | 4.37 | 1.47 | | |
| HEMBA1002141 | 1.67 | 1.36 | 3.23 | 2.99 | 3.92 | 2.14 | | |
| HEMBA1002144 | 2.33 | 2.44 | 6.11 | 5.28 | 5.68 | 6.57 | | |
| HEMBA1002147 | 8.84 | 9.55 | 17.93 | 36.22 | 21.92 | 21.88 | | |
| HEMBA1002150 | 38.34 | 38.68 | 51.42 | 19.74 | 26.62 | 15.85 | * | |
| HEMBA1002151 | 3.76 | 3.36 | 9.95 | 11.15 | 14.23 | 9.84 | | |
| HEMBA1002153 | 0.57 | 1.74 | 3.36 | 3.39 | 5.64 | 2.96 | | |
| HEMBA1002156 | 0.8 | 1.74 | 2.33 | 1.94 | 4.28 | 1.26 | | |
| HEMBA1002160 | 2.16 | 3.17 | 5.7 | 6.08 | 7.26 | 6.18 | | |
| HEMBA1002161 | 2.13 | 2.9 | 6.99 | 13.53 | 11.79 | 9.76 | * | + |
| HEMBA1002162 | 2.65 | 2.17 | 7.76 | 5.61 | 6.27 | 7.81 | | |
| HEMBA1002163 | 12.02 | 12.04 | 19.93 | 34.48 | 19.96 | 27.11 | | |
| HEMBA1002164 | 6.58 | 10.55 | 59.92 | 71.46 | 78.61 | 67.82 | | |
| HEMBA1002166 | 21.88 | 18.32 | 39.58 | 57.35 | 49.05 | 46.09 | * | + |
| HEMBA1002167 | 0.89 | 2.89 | 3.89 | 4.96 | 5.45 | 3.98 | | |
| HEMBA1002173 | 3.24 | 3.83 | 6.22 | 7.97 | 7.11 | 6.28 | | |
| HEMBA1002177 | 1.31 | 1.78 | 3.31 | 5.68 | 4.97 | 2.98 | | |
| HEMBA1002178 | 6.91 | 10.17 | 14.77 | 23.33 | 23.58 | 17.49 | * | + |
| HEMBA1002179 | 53.56 | 46.86 | 94.4 | 58.33 | 85.22 | 54.47 | | |
| HEMBA1002185 | 2.75 | 4.07 | 13.4 | 11.73 | 16.23 | 14.56 | | |
| HEMBA1002188 | 5.76 | 7.57 | 10.27 | 11.86 | 12.9 | 9.8 | | |
| HEMBA1002189 | 1.98 | 2.85 | 4.96 | 5.23 | 4.63 | 4.71 | | |
| HEMBA1002191 | 0.67 | 2.16 | 4.96 | 3.47 | 5.44 | 2.81 | | |
| HEMBA1002192 | 2.98 | 2.83 | 4.91 | 7.53 | 8.35 | 4.57 | | |
| HEMBA1002195 | 2.96 | 3.27 | 6.6 | 10.35 | 10.11 | 7.27 | * | + |
| HEMBA1002196 | 3.34 | 4.33 | 8.55 | 8.62 | 8.85 | 8.39 | | |
| HEMBA1002199 | 1.33 | 1.86 | 4.9 | 4.62 | 5.71 | 3.52 | | |
| HEMBA1002204 | 1.31 | 1.97 | 4.08 | 5.48 | 11.37 | 3.73 | | |
| HEMBA1002208 | 24.58 | 26.61 | 45.85 | 49.77 | 25.48 | 39.6 | | |
| HEMBA1002212 | 3.73 | 5.95 | 9.01 | 8.9 | 11.85 | 17.18 | | |
| HEMBA1002215 | 1.95 | 2.63 | 4.27 | 5.1 | 3.54 | 3.78 | | |
| HEMBA1002217 | 15.61 | 16.71 | 59.91 | 78.46 | 82.88 | 80.94 | * | + |
| HEMBA1002220 | 1.11 | 2.07 | 4.1 | 3.58 | 3.39 | 2.33 | | |
| HEMBA1002226 | 2.17 | 3.13 | 9.18 | 10.47 | 12.61 | 9.58 | | |
| HEMBA1002227 | 39.9 | 47.13 | 92.5 | 109.42 | 65.74 | 71.79 | | |
| HEMBA1002229 | 4.5 | 4.77 | 13.39 | 11.16 | 13.55 | 12.49 | | |
| HEMBA1002237 | 1.73 | 3.22 | 4.08 | 3.71 | 5.64 | 3.41 | | |
| HEMBA1002239 | 9.36 | 13.83 | 72.18 | 100.62 | 109.3 | 113.84 | * | + |
| HEMBA1002241 | 7 | 7.54 | 38.36 | 64.27 | 68.93 | 68.72 | ** | + |
| HEMBA1002253 | 1.11 | 2.44 | 3.33 | 2.3 | 4.42 | 2.68 | | |
| HEMBA1002257 | 1.83 | 2.65 | 4.11 | 3.18 | 3.6 | 1.74 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1002259 | 1.12 | 2.17 | 2.69 | 3.12 | 3.6 | 2.67 | | |
| HEMBA1002262 | 6.95 | 7.37 | 19.16 | 14.43 | 14.78 | 17.04 | | |
| HEMBA1002265 | 1.35 | 1.63 | 3.7 | 3.75 | 6.23 | 2.43 | | |
| HEMBA1002267 | 16.87 | 20.81 | 22.76 | 32.99 | 16.96 | 27.5 | | |
| HEMBA1002270 | 3.73 | 4.79 | 7.49 | 8.18 | 13.43 | 8.7 | | |
| HEMBA1002286 | 1.03 | 1.86 | 5.42 | 2.85 | 5.53 | 0.98 | | |
| HEMBA1002290 | 4.73 | 3.7 | 7.52 | 5.16 | 8.88 | 4.38 | | |
| HEMBA1002302 | 6.12 | 9.63 | 45.04 | 45.66 | 49.69 | 45.23 | | |
| HEMBA1002304 | 3.28 | 3.42 | 6.88 | 5.57 | 6.97 | 4.34 | | |
| HEMBA1002307 | 45.71 | 53.69 | 92.31 | 71.87 | 55.79 | 61.03 | | |
| HEMBA1002316 | 2.16 | 3.29 | 4.63 | 3.04 | 5.32 | 2.41 | | |
| HEMBA1002319 | 1.97 | 2.96 | 4.46 | 8.32 | 9.58 | 8 | ** | + |
| HEMBA1002320 | 1.99 | 1.76 | 3.22 | 2.51 | 4.45 | 1.76 | | |
| HEMBA1002321 | 1.22 | 2.04 | 2.84 | 2.71 | 4.44 | 2.77 | | |
| HEMBA1002328 | 2.44 | 3.04 | 4.89 | 2.43 | 5.73 | 2.94 | | |
| HEMBA1002333 | 3.88 | 4.27 | 7.14 | 7.37 | 10.84 | 7.5 | | |
| HEMBA1002337 | 3.02 | 3.62 | 5.5 | 5.98 | 7.49 | 7.48 | * | + |
| HEMBA1002339 | 15.86 | 13.92 | 111.66 | 135.44 | 169.95 | 156.76 | * | + |
| HEMBA1002341 | 0.8 | 2.08 | 3.22 | 2.71 | 4.34 | 2.35 | | |
| HEMBA1002348 | 2.84 | 2.78 | 7.14 | 3.69 | 6.73 | 4.49 | | |
| HEMBA1002349 | 1.28 | 1.44 | 3.59 | 2.24 | 4.64 | 2.59 | | |
| HEMBA1002353 | 1.83 | 3.04 | 4.03 | 4.61 | 7.72 | 5.68 | | |
| HEMBA1002356 | 6.05 | 6.96 | 17.53 | 14.27 | 16.02 | 16.1 | | |
| HEMBA1002357 | 114.85 | 156.08 | 306.32 | 300.67 | 286.5 | 328.19 | | |
| HEMBA1002360 | 7.18 | 8.32 | 8.29 | 14.57 | 14.46 | 13.78 | ** | + |
| HEMBA1002363 | 2.79 | 3.35 | 4.84 | 7.02 | 8.02 | 8.72 | ** | + |
| HEMBA1002365 | 1.7 | 2.7 | 2.7 | 1.63 | 3.12 | 2.67 | | |
| HEMBA1002370 | 1.43 | 1.78 | 2.37 | 1.53 | 4.2 | 1.9 | | |
| HEMBA1002374 | 4.55 | 4.53 | 7.79 | 8.33 | 10.27 | 9.11 | * | + |
| HEMBA1002376 | 46.59 | 33.18 | 118.8 | 101.1 | 189.18 | 114.36 | | |
| HEMBA1002377 | 18.02 | 20.98 | 25.61 | 32.58 | 34.44 | 32.19 | ** | + |
| HEMBA1002380 | 5.68 | 6.36 | 16.28 | 17.43 | 21.85 | 18.83 | | |
| HEMBA1002381 | 1.52 | 1.8 | 4.16 | 4.12 | 7.16 | 4.94 | | |
| HEMBA1002384 | 1.79 | 3.09 | 3.69 | 5.67 | 4.27 | 5.71 | * | + |
| HEMBA1002389 | 1.93 | 2.93 | 2.88 | 3.63 | 5.31 | 4.7 | * | + |
| HEMBA1002396 | 21.16 | 20.01 | 36.93 | 14.29 | 14.94 | 19.1 | | |
| HEMBA1002402 | 125.09 | 124.52 | 168.42 | 100.85 | 107.79 | 164.62 | | |
| HEMBA1002417 | 1.41 | 1.07 | 4.27 | 2.17 | 3.19 | 2.6 | | |
| HEMBA1002419 | 1.42 | 2.38 | 3.8 | 1.81 | 4.59 | 2.41 | | |
| HEMBA1002420 | 9.55 | 11.97 | 14.11 | 16.34 | 18.28 | 16.16 | * | + |
| HEMBA1002421 | 7.47 | 10.35 | 12.5 | 8.97 | 10.24 | 9.6 | | |
| HEMBA1002423 | 2.89 | 1.3 | 4.28 | 3.35 | 4.29 | 3.82 | | |
| HEMBA1002424 | 11.91 | 10.05 | 25.13 | 9.11 | 9.2 | 10.43 | | |
| HEMBA1002426 | 3.42 | 3.69 | 5.56 | 7.57 | 8.24 | 5.6 | * | + |
| HEMBA1002430 | 0.39 | 1.41 | 2.51 | 1.7 | 4.19 | 2.85 | | |
| HEMBA1002439 | 1.59 | 1.94 | 4.17 | 2.69 | 4.46 | 6.8 | | |
| HEMBA1002441 | 31.85 | 29.77 | 27.79 | 48.74 | 52.7 | 34.64 | | |
| HEMBA1002454 | 0.62 | 1.48 | 2.27 | 1.76 | 2.43 | 1.55 | | |
| HEMBA1002458 | 3.17 | 5 | 8.09 | 10.24 | 10.55 | 11.71 | * | + |
| HEMBA1002460 | 2.14 | 1.59 | 3.89 | 5.16 | 4.63 | 5.01 | * | + |
| HEMBA1002462 | 5.18 | 3.83 | 9.52 | 11.92 | 9.29 | 8.58 | | |
| HEMBA1002465 | 0.93 | 1.96 | 2.26 | 1.46 | 3.13 | 1.27 | | |
| HEMBA1002469 | 6.88 | 7.27 | 45.87 | 49.02 | 75.59 | 67.74 | * | + |
| HEMBA1002475 | 1.54 | 2.35 | 8.01 | 4.88 | 7.87 | 7.66 | | |
| HEMBA1002477 | 1.75 | 1.59 | 5.25 | 3.19 | 6.99 | 3.55 | | |
| HEMBA1002480 | 4.46 | 3.98 | 8.49 | 8.76 | 13 | 10.54 | | |
| HEMBA1002481 | 1.9 | 2.02 | 4.22 | 2.71 | 6.25 | 4.7 | | |
| HEMBA1002486 | 3.62 | 3.98 | 10.08 | 9.98 | 8.04 | 9.75 | | |
| HEMBA1002490 | 2.02 | 3.08 | 5.7 | 8.76 | 9.64 | 7.65 | * | + |
| HEMBA1002495 | 2.37 | 2.29 | 3.78 | 3.92 | 4.79 | 4.08 | | |
| HEMBA1002498 | 0.95 | 2.14 | 2.97 | 1.83 | 5.09 | 2.14 | | |
| HEMBA1002501 | 2.96 | 4.73 | 14.13 | 19.98 | 23.55 | 17.54 | * | + |
| HEMBA1002503 | 1.7 | 2.52 | 5.11 | 4.68 | 7.06 | 2.97 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1002504 | 1.95 | 2.19 | 5.99 | 6.68 | 7.09 | 4.65 | | |
| HEMBA1002508 | 1.48 | 2.59 | 5.99 | 7.8 | 7.47 | 5.65 | | |
| HEMBA1002513 | 1.31 | 1.7 | 4.85 | 3.91 | 7.67 | 3.02 | | |
| HEMBA1002515 | 1.17 | 1.82 | 3.04 | 2.67 | 5.1 | 2.89 | | |
| HEMBA1002524 | 1.67 | 2.09 | 2.53 | 4.44 | 4.49 | 3.82 | ** | + |
| HEMBA1002538 | 4.68 | 4.14 | 7.39 | 9.31 | 8.91 | 7.86 | * | + |
| HEMBA1002542 | 3.31 | 3.27 | 6.77 | 10.11 | 9.3 | 7.74 | * | + |
| HEMBA1002544 | 1.42 | 2.24 | 3.33 | 2.69 | 6.59 | 3.24 | | |
| HEMBA1002546 | 31.01 | 31.64 | 56.69 | 95.52 | 83.15 | 72.77 | * | + |
| HEMBA1002547 | 3.13 | 3.22 | 8.44 | 20.11 | 20.37 | 17.21 | ** | + |
| HEMBA1002550 | 5.46 | 3.86 | 10.87 | 10.85 | 11.2 | 10.23 | | |
| HEMBA1002551 | 2.15 | 3.09 | 5.8 | 3.7 | 5.08 | 3.08 | | |
| HEMBA1002552 | 2.21 | 2.06 | 8.39 | 5.66 | 6.55 | 5.68 | | |
| HEMBA1002555 | 1.54 | 1.78 | 4.56 | 2.27 | 4.4 | 2.97 | | |
| HEMBA1002558 | 2.74 | 3.26 | 7.02 | 8.08 | 7.47 | 8.27 | | |
| HEMBA1002561 | 1.01 | 1.58 | 5.26 | 4.42 | 5.08 | 3.87 | | |
| HEMBA1002562 | 0.59 | 0.83 | 2.34 | 3.29 | 3.29 | 2.36 | | |
| HEMBA1002568 | 1.71 | 1.16 | 3.09 | 3.06 | 3.26 | 3.6 | | |
| HEMBA1002569 | 3.8 | 4.67 | 10.32 | 7.29 | 8.59 | 5.14 | | |
| HEMBA1002570 | 5.22 | 4.72 | 9.84 | 6.07 | 10.29 | 12.99 | | |
| HEMBA1002574 | 24.62 | 22.75 | 26.01 | 44.47 | 30.74 | 40.85 | * | + |
| HEMBA1002583 | 4.07 | 4.52 | 8.07 | 6.64 | 6.43 | 8.47 | | |
| HEMBA1002587 | 9.78 | 10.9 | 19.23 | 24.67 | 18.08 | 20.4 | | |
| HEMBA1002590 | 2.51 | 2.58 | 7.47 | 5.35 | 5.6 | 4.05 | | |
| HEMBA1002592 | 2.51 | 3.03 | 6.4 | 6.34 | 7.84 | 5.1 | | |
| HEMBA1002595 | 1.66 | 2.13 | 3.1 | 4.12 | 4.25 | 2.68 | | |
| HEMBA1002609 | 4.47 | 6.27 | 51 | 68.51 | 85.44 | 66.33 | * | + |
| HEMBA1002617 | 6.31 | 4.76 | 7.99 | 7.25 | 6.84 | 6.48 | | |
| HEMBA1002619 | 3.33 | 4.8 | 5.99 | 7.86 | 6.14 | 7.27 | | |
| HEMBA1002621 | 1.21 | 2.94 | 3.09 | 3.24 | 4.17 | 2.03 | | |
| HEMBA1002624 | 4.6 | 5.19 | 19.48 | 22.04 | 24.39 | 26.87 | * | + |
| HEMBA1002628 | 3.37 | 3.64 | 6.41 | 6.08 | 6.11 | 4.1 | | |
| HEMBA1002629 | 2.71 | 2.24 | 4.66 | 3.77 | 7.98 | 4.48 | | |
| HEMBA1002632 | 1.39 | 2.23 | 5.16 | 4.29 | 5.49 | 4.58 | | |
| HEMBA1002645 | 1.77 | 1.98 | 6.43 | 4.68 | 6.91 | 5.37 | | |
| HEMBA1002651 | 1.87 | 2.73 | 4.73 | 4.68 | 4.83 | 3.74 | | |
| HEMBA1002652 | 3.38 | 5.27 | 6.21 | 6.09 | 8.66 | 7.92 | | |
| HEMBA1002659 | 2.84 | 3.86 | 4.8 | 6.32 | 8.18 | 9.6 | * | + |
| HEMBA1002661 | 3 | 2.71 | 6.19 | 4.41 | 6.93 | 4.93 | | |
| HEMBA1002666 | 1.74 | 2.47 | 4.21 | 2.95 | 4.25 | 1.41 | | |
| HEMBA1002667 | 1.39 | 2.25 | 3.91 | 2.79 | 5.24 | 1.94 | | |
| HEMBA1002673 | 16.08 | 19.36 | 30.31 | 32.54 | 35.18 | 29.96 | | |
| HEMBA1002678 | 2.11 | 2.33 | 7.44 | 5.39 | 5.98 | 4.22 | | |
| HEMBA1002679 | 1.23 | 2.33 | 5.25 | 3.7 | 7.48 | 3.81 | | |
| HEMBA1002688 | 1.74 | 2.98 | 8.3 | 8.33 | 11.41 | 7.86 | | |
| HEMBA1002696 | 1.7 | 2.79 | 2.92 | 3.48 | 6.13 | 3.32 | | |
| HEMBA1002703 | 2.95 | 3.88 | 10.15 | 8.35 | 9.73 | 9.21 | | |
| HEMBA1002706 | 4.97 | 4.24 | 8.99 | 5.07 | 7.16 | 5.54 | | |
| HEMBA1002712 | 2.39 | 3.94 | 8.67 | 8.4 | 10.9 | 10.57 | | |
| HEMBA1002715 | 7.92 | 9.81 | 49.65 | 79.65 | 93.63 | 79.61 | * | + |
| HEMBA1002716 | 3.93 | 4.26 | 5.53 | 4.63 | 5.02 | 4.53 | | |
| HEMBA1002718 | 11.79 | 12.87 | 17.77 | 24.16 | 18.07 | 24.3 | * | + |
| HEMBA1002728 | 2.37 | 3.1 | 5.01 | 5.52 | 5.94 | 4.42 | | |
| HEMBA1002730 | 1.13 | 2.48 | 5.86 | 3.71 | 6.19 | 4.61 | | |
| HEMBA1002734 | 2.89 | 3.54 | 8.82 | 8.6 | 10.7 | 10.59 | | |
| HEMBA1002742 | 1.94 | 2.06 | 3.96 | 1.86 | 4.27 | 2.74 | | |
| HEMBA1002746 | 1.2 | 2.86 | 4.61 | 2.83 | 4.43 | 2.94 | | |
| HEMBA1002748 | 2.19 | 1.75 | 4.01 | 5.36 | 5.98 | 3.92 | | |
| HEMBA1002750 | 1.99 | 2.46 | 3.45 | 6.74 | 6.39 | 6.27 | ** | + |
| HEMBA1002755 | 1.85 | 3.1 | 5.31 | 5.96 | 6.62 | 5.16 | | |
| HEMBA1002759 | 1.93 | 3.12 | 7.98 | 4.65 | 7.92 | 7.08 | | |
| HEMBA1002763 | 9.62 | 12.05 | 74.52 | 68.84 | 88.82 | 77.22 | | |
| HEMBA1002767 | 4.48 | 5.85 | 5.8 | 8.88 | 6 | 6.13 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1002768 | 2.99 | 3.76 | 6.2 | 3.46 | 8.3 | 3.04 | | |
| HEMBA1002769 | 1.47 | 2.35 | 2.82 | 3.46 | 5.21 | 3.49 | | |
| HEMBA1002770 | 5.89 | 5.83 | 12.41 | 14.24 | 22.53 | 15.53 | * | + |
| HEMBA1002777 | 1.6 | 1.9 | 2.58 | 2.29 | 4.74 | 3.76 | | |
| HEMBA1002779 | 10.92 | 7.6 | 16 | 17.39 | 19.81 | 19.36 | * | + |
| HEMBA1002780 | 2.6 | 2.77 | 6.82 | 6.43 | 6.89 | 6.35 | | |
| HEMBA1002790 | 3.14 | 2.52 | 10.6 | 7.26 | 8.67 | 9.25 | | |
| HEMBA1002794 | 1.52 | 2.28 | 5.49 | 3.68 | 6.8 | 4.45 | | |
| HEMBA1002798 | 1.33 | 1.59 | 3.61 | 2.77 | 5.12 | 4 | | |
| HEMBA1002801 | 2.13 | 2.25 | 3.64 | 3.12 | 6.93 | 5.24 | | |
| HEMBA1002810 | 4.56 | 3.99 | 7.85 | 10.27 | 17.31 | 11.1 | * | + |
| HEMBA1002816 | 2.24 | 1.97 | 2.88 | 5.34 | 5.05 | 4.8 | ** | + |
| HEMBA1002818 | 24.6 | 23.26 | 95.11 | 130.84 | 121.74 | 135.78 | * | + |
| HEMBA1002820 | 1.95 | 2.63 | 6.41 | 6.96 | 6.99 | 6.04 | | |
| HEMBA1002826 | 1.96 | 1.48 | 2.99 | 3.21 | 4.84 | 3.59 | | |
| HEMBA1002833 | 8.71 | 7.46 | 19.84 | 20.18 | 21.16 | 20.04 | | |
| HEMBA1002850 | 1.16 | 1.94 | 3.67 | 3.87 | 4.96 | 5.11 | * | + |
| HEMBA1002862 | 9.06 | 9.31 | 17.9 | 20.11 | 25.3 | 13.43 | | |
| HEMBA1002863 | 2.47 | 2.93 | 5.28 | 6.16 | 8.44 | 6.52 | * | + |
| HEMBA1002867 | 1.51 | 1.17 | 2.4 | 2.3 | 3.28 | 1.87 | | |
| HEMBA1002876 | 3.9 | 3.54 | 5.48 | 5.61 | 5.78 | 6.48 | | |
| HEMBA1002886 | 1.28 | 1.56 | 2.45 | 1.83 | 3.13 | 2.71 | | |
| HEMBA1002896 | 5.82 | 3.82 | 9.38 | 7.22 | 11.23 | 8.51 | | |
| HEMBA1002913 | 2.37 | 2.22 | 4.56 | 4.19 | 4.28 | 3.11 | | |
| HEMBA1002921 | 0.97 | 0.81 | 2.36 | 1.82 | 2.41 | 1.41 | | |
| HEMBA1002924 | 1.07 | 1.2 | 2.86 | 2.11 | 4.41 | 3.27 | | |
| HEMBA1002934 | 6.01 | 5.17 | 10.48 | 9.93 | 15.27 | 13.16 | | |
| HEMBA1002935 | 4.27 | 2.55 | 6.59 | 7.1 | 5.34 | 7.14 | | |
| HEMBA1002937 | 4.61 | 5.71 | 9.4 | 10.82 | 8.36 | 7.36 | | |
| HEMBA1002939 | 2.21 | 2.92 | 5.39 | 5.51 | 5.7 | 3.26 | | |
| HEMBA1002944 | 1.45 | 1.97 | 4.66 | 3.1 | 5.68 | 3.21 | | |
| HEMBA1002951 | 5.88 | 7.88 | 10.99 | 6.04 | 12.17 | 5.67 | | |
| HEMBA1002954 | 2.4 | 4.57 | 6.12 | 6.09 | 7.78 | 4.78 | | |
| HEMBA1002962 | 3.93 | 6.02 | 9.14 | 13.42 | 15.92 | 12.44 | * | + |
| HEMBA1002968 | 1.22 | 1.71 | 4.32 | 5.34 | 4.07 | 5.3 | | |
| HEMBA1002970 | 1.13 | 1.13 | 3.14 | 2.5 | 3.72 | 3.13 | | |
| HEMBA1002971 | 0.96 | 2.02 | 2.75 | 2.02 | 3.71 | 2.43 | | |
| HEMBA1002973 | 1.68 | 3.36 | 7.84 | 6.19 | 10.81 | 6.31 | | |
| HEMBA1002978 | 2.09 | 3.81 | 4.35 | 5.49 | 5.3 | 4.22 | | |
| HEMBA1002981 | 1.82 | 2.51 | 4.01 | 9.33 | 7.48 | 6.53 | ** | + |
| HEMBA1002985 | 0.83 | 1.92 | 4.91 | 4.74 | 5.59 | 4.13 | | |
| HEMBA1002986 | 2.72 | 4.88 | 6.67 | 14.7 | 14.62 | 13 | ** | + |
| HEMBA1002988 | 1.77 | 2.36 | 4.25 | 4.2 | 5.67 | 3.46 | | |
| HEMBA1002992 | 8.73 | 11.38 | 68.65 | 83.81 | 96.4 | 94.02 | * | + |
| HEMBA1002995 | 6.13 | 6.97 | 11.94 | 8.64 | 11.47 | 14.09 | | |
| HEMBA1002997 | 5.77 | 6.33 | 9.6 | 12.88 | 10.65 | 8.75 | | |
| HEMBA1002999 | 1.36 | 2.77 | 2.84 | 2.48 | 3.92 | 3.31 | | |
| HEMBA1003004 | 0.78 | 1.39 | 1.96 | 1.86 | 3.32 | 1.37 | | |
| HEMBA1003006 | 2.03 | 1.84 | 4.26 | 5.44 | 8.08 | 5.87 | * | + |
| HEMBA1003008 | 1.58 | 1.26 | 2.83 | 3.4 | 5.4 | 2.28 | | |
| HEMBA1003021 | 1.72 | 2.09 | 5.98 | 8.49 | 8.58 | 6.67 | * | + |
| HEMBA1003027 | 1.79 | 1.73 | 4.47 | 2.11 | 6.17 | 3.72 | | |
| HEMBA1003029 | 16.39 | 17.36 | 46.06 | 37.07 | 42.91 | 45.58 | | |
| HEMBA1003031 | 33.04 | 32.41 | 50.08 | 48.18 | 24.56 | 40.3 | | |
| HEMBA1003032 | 3.42 | 6.52 | 7.98 | 8.81 | 6.53 | 9.45 | | |
| HEMBA1003033 | 2.36 | 4.11 | 6.85 | 7.85 | 8.94 | 9 | * | + |
| HEMBA1003034 | 2.43 | 3.17 | 7.63 | 8.24 | 7.47 | 8.23 | | |
| HEMBA1003035 | 1.24 | 2 | 2.59 | 2.88 | 3.46 | 1.93 | | |
| HEMBA1003037 | 1.74 | 2.09 | 6.21 | 4.13 | 7.36 | 3.43 | | |
| HEMBA1003041 | 3.4 | 4.14 | 8.51 | 10.28 | 10.48 | 9 | | |
| HEMBA1003046 | 11.44 | 11.53 | 28.31 | 33.77 | 21.19 | 36.32 | | |
| HEMBA1003047 | 2.02 | 2.35 | 5.11 | 4.57 | 5.41 | 4.03 | | |
| HEMBA1003048 | 1.8 | 2.96 | 3.76 | 7.97 | 7.47 | 9.3 | ** | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1003064 | 3.7 | 4.12 | 15.74 | 15.78 | 25.09 | 19.36 | | |
| HEMBA1003067 | 1.92 | 2.31 | 7.09 | 4.56 | 7.96 | 3.23 | | |
| HEMBA1003071 | 5.24 | 5 | 8.74 | 11.32 | 10.02 | 8.7 | | |
| HEMBA1003072 | 2.81 | 3.22 | 5.7 | 4.43 | 3.65 | 5.17 | | |
| HEMBA1003076 | 20.6 | 21.34 | 31.6 | 41.86 | 28.3 | 32.74 | | |
| HEMBA1003077 | 1.41 | 1.58 | 4.37 | 1.68 | 4.03 | 2.27 | | |
| HEMBA1003078 | 2.02 | 1.92 | 2.4 | 3.14 | 4.9 | 3.38 | * | + |
| HEMBA1003079 | 2.72 | 2.66 | 6.42 | 5.88 | 7.13 | 4.48 | | |
| HEMBA1003083 | 1.56 | 2.11 | 3.94 | 4.42 | 6.23 | 4.59 | | |
| HEMBA1003086 | 2.5 | 2.72 | 5.27 | 4.09 | 5.78 | 4.68 | | |
| HEMBA1003090 | 5.14 | 4.79 | 13.3 | 11.57 | 12.88 | 12.73 | | |
| HEMBA1003094 | 0.82 | 1.67 | 2.94 | 2.51 | 3.22 | 2.14 | | |
| HEMBA1003096 | 8.6 | 8.76 | 15.55 | 10.1 | 13.7 | 10.97 | | |
| HEMBA1003098 | 3.88 | 5.66 | 7.38 | 9.42 | 7.11 | 8.4 | | |
| HEMBA1003101 | 4.73 | 5.48 | 7.29 | 9.04 | 6.59 | 6.36 | | |
| HEMBA1003109 | 2.88 | 3.42 | 4.72 | 5.73 | 6.93 | 7.22 | * | + |
| HEMBA1003114 | 2.87 | 4.67 | 5.67 | 6.47 | 7.94 | 5.69 | | |
| HEMBA1003117 | 2.1 | 3.41 | 4.4 | 3.36 | 4.99 | 2.44 | | |
| HEMBA1003120 | 3.02 | 2.65 | 5.55 | 3.23 | 7.38 | 4.29 | | |
| HEMBA1003129 | 2.47 | 2.6 | 6.66 | 10.28 | 6.19 | 7.28 | | |
| HEMBA1003133 | 2.05 | 4.74 | 7.61 | 7.74 | 7.59 | 5.59 | | |
| HEMBA1003136 | 2.64 | 3.59 | 5.25 | 5.37 | 5.88 | 4.49 | | |
| HEMBA1003142 | 2.01 | 2.27 | 6.15 | 6.62 | 6.35 | 5.34 | | |
| HEMBA1003148 | 1.3 | 1.4 | 2.82 | 1.49 | 4.26 | 1.6 | | |
| HEMBA1003151 | 1.91 | 2.08 | 4.23 | 2.9 | 5.34 | 4.24 | | |
| HEMBA1003152 | 3.27 | 1.98 | 5.84 | 4.74 | 5.71 | 2.58 | | |
| HEMBA1003157 | 1.23 | 1.88 | 2.58 | 4.2 | 5.38 | 3.21 | * | + |
| HEMBA1003166 | 6.14 | 6.06 | 14.06 | 22.98 | 18.03 | 21.74 | * | + |
| HEMBA1003171 | 1.3 | 2.28 | 2.23 | 2.62 | 3.09 | 2.53 | | |
| HEMBA1003175 | 1.54 | 2.63 | 4.2 | 3.54 | 4.52 | 4.11 | | |
| HEMBA1003179 | 4.66 | 5.95 | 37.4 | 36.91 | 43.86 | 45.13 | | |
| HEMBA1003186 | 2.58 | 3.17 | 7.13 | 6.71 | 6.71 | 5.78 | | |
| HEMBA1003196 | 3.04 | 3.79 | 7.33 | 6.95 | 8.31 | 5.18 | | |
| HEMBA1003197 | 0.46 | 1.51 | 2.86 | 1.85 | 3.97 | 1.09 | | |
| HEMBA1003199 | 1.26 | 1 | 2.32 | 1.66 | 3.22 | 2.47 | | |
| HEMBA1003202 | 2.86 | 3.49 | 5.69 | 9.44 | 10.48 | 11.14 | ** | + |
| HEMBA1003204 | 1.67 | 2.46 | 3.35 | 4.99 | 4.72 | 4.81 | ** | + |
| HEMBA1003210 | 6.48 | 7.36 | 11.66 | 12.02 | 12.1 | 14.78 | | |
| HEMBA1003212 | 1.4 | 2.87 | 5.52 | 7.58 | 8 | 5.7 | | |
| HEMBA1003218 | 1.2 | 1.26 | 1.71 | 1.24 | 4.35 | 1.36 | | |
| HEMBA1003220 | 34.65 | 32.6 | 73.43 | 78.35 | 79.82 | 83.89 | | |
| HEMBA1003222 | 2.37 | 3.03 | 3.41 | 3.04 | 6.13 | 4.29 | | |
| HEMBA1003225 | 1.95 | 2.07 | 3.34 | 1.59 | 3.45 | 2.05 | | |
| HEMBA1003229 | 2.37 | 1.91 | 2.4 | 5.62 | 5.1 | 4.9 | ** | + |
| HEMBA1003230 | 7.83 | 7.14 | 12.08 | 11.08 | 11.44 | 10.09 | | |
| HEMBA1003235 | 0.91 | 1.33 | 4.32 | 4.98 | 5.25 | 5.44 | * | + |
| HEMBA1003236 | 5.54 | 5.43 | 10.62 | 11.5 | 15.4 | 13.97 | * | + |
| HEMBA1003250 | 1.41 | 1.4 | 2.68 | 1.76 | 2.98 | 2.42 | | |
| HEMBA1003252 | 4.96 | 7.17 | 16.59 | 17.06 | 18.68 | 14.37 | | |
| HEMBA1003257 | 2.7 | 3.33 | 7.33 | 8.25 | 8.83 | 6.78 | | |
| HEMBA1003268 | 0.95 | 0.44 | 1.92 | 1.92 | 3.36 | 1.81 | | |
| HEMBA1003273 | 1.4 | 1.38 | 2.96 | 2.5 | 3.37 | 5.1 | | |
| HEMBA1003276 | 1.13 | 1.99 | 3.18 | 4.21 | 4.42 | 3.98 | * | + |
| HEMBA1003277 | 0.95 | 0.83 | 1.85 | 0.56 | 1.63 | 1.34 | | |
| HEMBA1003278 | 1.07 | 1.18 | 3.49 | 1 | 4.56 | 2.32 | | |
| HEMBA1003280 | 2.37 | 2.6 | 4.59 | 3.08 | 4.91 | 4.2 | | |
| HEMBA1003281 | 1.83 | 1.29 | 3.53 | 1.79 | 3.85 | 2.48 | | |
| HEMBA1003284 | 1.24 | 1.91 | 3.43 | 3.03 | 5.05 | 3.32 | | |
| HEMBA1003286 | 7.75 | 6.73 | 34.23 | 45.25 | 71.61 | 51.97 | * | + |
| HEMBA1003291 | 1.65 | 1.91 | 4.84 | 3.21 | 3.32 | 3.25 | | |
| HEMBA1003294 | 1.89 | 3.5 | 7.47 | 4.86 | 5.7 | 5.62 | | |
| HEMBA1003296 | 4.74 | 8.32 | 46.61 | 63.82 | 70.23 | 54.45 | * | + |
| HEMBA1003304 | 0.77 | 1.44 | 2.88 | 2.91 | 5.37 | 1.87 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1003306 | 4.37 | 6.3 | 10.28 | 15.7 | 17.76 | 11.56 | * | + |
| HEMBA1003309 | 0.91 | 1.9 | 2.85 | 2.87 | 4 | 2.3 | | |
| HEMBA1003314 | 1.43 | 2.26 | 3.82 | 4.48 | 3.52 | 4.02 | | |
| HEMBA1003315 | 6.37 | 4.38 | 10.14 | 15.2 | 16.23 | 17.88 | ** | + |
| HEMBA1003322 | 4.81 | 5.92 | 10.9 | 8.46 | 10.83 | 8.07 | | |
| HEMBA1003326 | 1.94 | 3.97 | 5.55 | 2.93 | 7.4 | 3.68 | | |
| HEMBA1003327 | 0.81 | 1.61 | 3.63 | 2.36 | 4.3 | 2.28 | | |
| HEMBA1003328 | 0.76 | 2.43 | 5.38 | 4.25 | 5.51 | 5.06 | | |
| HEMBA1003330 | 2.27 | 2.81 | 4.84 | 4.66 | 5.83 | 6.94 | | |
| HEMBA1003348 | 3.22 | 2.45 | 11.3 | 11.28 | 13.98 | 16.37 | | |
| HEMBA1003369 | 2.39 | 2.6 | 7 | 9.64 | 8.65 | 5.33 | | |
| HEMBA1003370 | 3.14 | 3.6 | 8.85 | 12.54 | 10.83 | 13.98 | * | + |
| HEMBA1003373 | 1.12 | 1.3 | 3.4 | 2.14 | 5.05 | 2.94 | | |
| HEMBA1003376 | 3.75 | 2.83 | 7.71 | 9.83 | 12.46 | 10.39 | * | + |
| HEMBA1003380 | 1.12 | 2.3 | 3.63 | 2.25 | 3.9 | 2.57 | | |
| HEMBA1003384 | 0.98 | 1.71 | 2.91 | 2.11 | 4.78 | 2.14 | | |
| HEMBA1003387 | 1.3 | 1.24 | 2.14 | 1.83 | 3.24 | 1.98 | | |
| HEMBA1003392 | 2.51 | 2.28 | 3.43 | 5.21 | 5.91 | 4.44 | * | + |
| HEMBA1003395 | 1.02 | 1.45 | 2.84 | 4.06 | 4.29 | 2.18 | | |
| HEMBA1003399 | 1.03 | 1.4 | 3.27 | 3.21 | 3.26 | 2.19 | | |
| HEMBA1003400 | 1.36 | 2.22 | 4.64 | 3.23 | 7.19 | 5.22 | | |
| HEMBA1003402 | 1.62 | 1.74 | 3.29 | 2.32 | 4.22 | 2.59 | | |
| HEMBA1003403 | 7.13 | 9.32 | 50.9 | 66.1 | 66.81 | 77.49 | * | + |
| HEMBA1003408 | 3.68 | 4.5 | 7.27 | 6.02 | 5.77 | 7.71 | | |
| HEMBA1003412 | 5.08 | 6.79 | 8.35 | 10.96 | 8.79 | 9.75 | | |
| HEMBA1003417 | 5.71 | 6.5 | 10.15 | 8.18 | 8.86 | 7.36 | | |
| HEMBA1003418 | 4.01 | 5.12 | 6.53 | 7.37 | 11.45 | 9.3 | * | + |
| HEMBA1003420 | 16.29 | 17.91 | 35.46 | 33.32 | 34.37 | 32.89 | | |
| HEMBA1003425 | 0.76 | 1.65 | 3.06 | 2.33 | 3.58 | 2.21 | | |
| HEMBA1003433 | 1.4 | 2.43 | 3.34 | 4.88 | 4.54 | 4.09 | * | + |
| HEMBA1003440 | 11.39 | 12.08 | 19.86 | 24.13 | 13.99 | 24.26 | | |
| HEMBA1003442 | 4.37 | 4.67 | 4.94 | 3.54 | 6.73 | 5.96 | | |
| HEMBA1003447 | 7.55 | 9.08 | 49.72 | 65.41 | 63.46 | 65.15 | * | + |
| HEMBA1003453 | 21.03 | 22.03 | 42.15 | 27.85 | 29.02 | 27.64 | | |
| HEMBA1003461 | 1.5 | 2.13 | 3.49 | 2.6 | 3.63 | 2.2 | | |
| HEMBA1003463 | 2.82 | 3.68 | 6.02 | 5.97 | 3.84 | 6.41 | | |
| HEMBA1003465 | 1.77 | 2.21 | 6.31 | 4.75 | 5.02 | 3.82 | | |
| HEMBA1003480 | 2.58 | 3.91 | 8.62 | 9.63 | 9.6 | 9.42 | | |
| HEMBA1003485 | 7.06 | 4.84 | 5.29 | 6.13 | 7.26 | 5.52 | | |
| HEMBA1003487 | 1.8 | 1.85 | 3.4 | 7.12 | 6.39 | 6.79 | ** | + |
| HEMBA1003492 | 1.42 | 1.95 | 4.11 | 2.41 | 5.87 | 2.1 | | |
| HEMBA1003494 | 9.36 | 8.61 | 12.16 | 18.24 | 18.69 | 17.83 | ** | + |
| HEMBA1003497 | 2.19 | 2.16 | 3.29 | 3.35 | 6.06 | 2.97 | | |
| HEMBA1003503 | 0.98 | 1.74 | 3.37 | 5.04 | 3.18 | 2.13 | | |
| HEMBA1003511 | 0.99 | 2.19 | 3.7 | 2.3 | 4.42 | 2.5 | | |
| HEMBA1003528 | 3.33 | 4 | 6.51 | 5.77 | 5.04 | 4.46 | | |
| HEMBA1003530 | 1.33 | 0.85 | 3.62 | 1.97 | 3.15 | 2.45 | | |
| HEMBA1003531 | 1.14 | 1.72 | 5.39 | 4.74 | 7.24 | 4.51 | | |
| HEMBA1003532 | 12.97 | 14.66 | 34.3 | 28.69 | 25.31 | 31.26 | | |
| HEMBA1003538 | 2.54 | 2.4 | 17.88 | 14.54 | 21.58 | 16.83 | | |
| HEMBA1003545 | 0.68 | 2.08 | 3.17 | 1.85 | 3.6 | 2.17 | | |
| HEMBA1003546 | 1.27 | 2.03 | 1.68 | 1.98 | 2.15 | 2.42 | | |
| HEMBA1003548 | 1.4 | 3.18 | 3.6 | 1.41 | 4.15 | 2.23 | | |
| HEMBA1003553 | 31.29 | 31.45 | 47.99 | 54.36 | 41.34 | 45.65 | | |
| HEMBA1003555 | 1.39 | 2.73 | 4.81 | 3.53 | 4.48 | 5.19 | | |
| HEMBA1003556 | 1.24 | 1.76 | 2.96 | 3.14 | 5.75 | 3.31 | | |
| HEMBA1003560 | 1.89 | 2.66 | 7.87 | 10.08 | 13.24 | 9.9 | * | + |
| HEMBA1003565 | 54.27 | 66.88 | 96.28 | 121.29 | 139.88 | 148.68 | * | + |
| HEMBA1003568 | 1.86 | 2.27 | 3.24 | 2.36 | 7.41 | 2.78 | | |
| HEMBA1003569 | 2.93 | 2.61 | 2.96 | 5.07 | 3.95 | 4.53 | ** | + |
| HEMBA1003571 | 3.53 | 2.33 | 3.8 | 5.19 | 5.3 | 5.83 | * | + |
| HEMBA1003579 | 3.51 | 4.29 | 4.83 | 3.79 | 5.68 | 5.91 | | |
| HEMBA1003580 | 3.82 | 4.09 | 4.96 | 3.11 | 4.41 | 3.53 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and −, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
| --- | --- | --- | --- | --- | --- | --- | --- | --- |
| | exp. 1 | exp. 2 | exp. 3 | exp. 1 | exp. 2 | exp. 3 | | |
| HEMBA1003581 | 0.82 | 2.62 | 2.07 | 1.63 | 3.19 | 2.4 | | |
| HEMBA1003591 | 10.8 | 11.44 | 30.24 | 33.74 | 35.7 | 36.88 | * | + |
| HEMBA1003595 | 0.93 | 1.16 | 2.46 | 2.98 | 4.02 | 2.01 | | |
| HEMBA1003597 | 3.15 | 3.18 | 8.74 | 10.82 | 11.39 | 11.59 | * | + |
| HEMBA1003598 | 0.58 | 0.93 | 1.33 | 2.62 | 1.83 | 1.61 | * | + |
| HEMBA1003600 | 3.71 | 4.19 | 13.35 | 14.77 | 13.86 | 16.69 | | |
| HEMBA1003602 | 2.84 | 2.64 | 4.89 | 5.89 | 6.97 | 9.14 | * | + |
| HEMBA1003604 | 2.3 | 3.35 | 5.67 | 6.63 | 8.29 | 8.16 | * | + |
| HEMBA1003610 | 2.33 | 3.2 | 4.48 | 6.12 | 5.64 | 6.81 | * | + |
| HEMBA1003615 | 1.76 | 2.61 | 5.23 | 4.95 | 5.21 | 4.96 | | |
| HEMBA1003617 | 3.59 | 3.54 | 8.59 | 6.92 | 11.37 | 8.5 | | |
| HEMBA1003620 | 5.76 | 6.01 | 4.98 | 13.48 | 17.69 | 12.58 | ** | + |
| HEMBA1003621 | 1.6 | 1.66 | 3.19 | 4.52 | 5.42 | 5.08 | ** | + |
| HEMBA1003622 | 0.96 | 0.69 | 1.38 | 1.47 | 3.17 | 2.25 | | |
| HEMBA1003630 | 0.78 | 1.02 | 1.95 | 1.68 | 2.97 | 1.55 | | |
| HEMBA1003637 | 0.66 | 1.93 | 2.59 | 2.11 | 3.11 | 2.63 | | |
| HEMBA1003640 | 2.33 | 2.1 | 5.27 | 4.16 | 5.68 | 5.5 | | |
| HEMBA1003645 | 1.12 | 1.2 | 4.41 | 2.3 | 3.82 | 3.06 | | |
| HEMBA1003646 | 0.94 | 1.21 | 1.76 | 1.25 | 3.25 | 1.8 | | |
| HEMBA1003647 | 0.49 | 2.15 | 3.27 | 2.46 | 3.79 | 2.21 | | |
| HEMBA1003656 | 3.32 | 3.77 | 6.96 | 17.01 | 10.45 | 13.78 | * | + |
| HEMBA1003662 | 1.37 | 2.08 | 1.54 | 5.2 | 3.81 | 4.91 | ** | + |
| HEMBA1003666 | 23.84 | 17.7 | 51.57 | 21.97 | 21.85 | 24.71 | | |
| HEMBA1003667 | 4.74 | 3.63 | 6.03 | 4.61 | 6.22 | 7.09 | | |
| HEMBA1003670 | 0.83 | 0.65 | 1.94 | 1.18 | 2.61 | 1.51 | | |
| HEMBA1003674 | 32.16 | 29.41 | 63.99 | 118.95 | 138.25 | 123.17 | ** | + |
| HEMBA1003677 | 1.84 | 2.06 | 4.28 | 2.32 | 5.31 | 3.78 | | |
| HEMBA1003679 | 1.2 | 1.68 | 3.72 | 2.22 | 6.19 | 3.23 | | |
| HEMBA1003680 | 4.55 | 4.68 | 20.52 | 27.26 | 28.13 | 28.07 | * | + |
| HEMBA1003684 | 1.57 | 1.9 | 3.98 | 4 | 3.65 | 4.47 | | |
| HEMBA1003690 | 6.22 | 7.41 | 8.65 | 7.94 | 9.93 | 7.33 | | |
| HEMBA1003692 | 2.41 | 3.82 | 7.23 | 8 | 8.28 | 7.7 | | |
| HEMBA1003702 | 2.64 | 3.82 | 4.83 | 7.11 | 6.86 | 6.07 | * | + |
| HEMBA1003711 | 1.06 | 1.21 | 3.39 | 2.93 | 3.88 | 2.37 | | |
| HEMBA1003714 | 1.31 | 1.26 | 2.13 | 1.61 | 2.45 | 1.42 | | |
| HEMBA1003715 | 1.46 | 2.7 | 6.58 | 10.21 | 9.15 | 6.87 | * | + |
| HEMBA1003717 | 1.91 | 2.31 | 3.91 | 3.03 | 3.66 | 4.38 | | |
| HEMBA1003720 | 0.81 | 2.6 | 5.07 | 4.16 | 4.16 | 4.21 | | |
| HEMBA1003725 | 0.83 | 1.57 | 2.47 | 3.22 | 4.91 | 3.17 | * | + |
| HEMBA1003728 | 1.28 | 2.48 | 3.4 | 2.65 | 4.36 | 2.72 | | |
| HEMBA1003729 | 0.98 | 2.35 | 2.85 | 3.6 | 4.36 | 3.52 | * | + |
| HEMBA1003732 | 1.11 | 1.52 | 3.49 | 3.01 | 2.75 | 1.88 | | |
| HEMBA1003733 | 1.18 | 1.9 | 2.94 | 3.7 | 4.95 | 3.92 | * | + |
| HEMBA1003742 | 5.15 | 7.3 | 5.95 | 21.53 | 22.58 | 19.56 | ** | + |
| HEMBA1003743 | 1.37 | 1.76 | 3.21 | 4.13 | 4.36 | 3.68 | * | + |
| HEMBA1003758 | 3.26 | 3.29 | 11.72 | 10.07 | 16.03 | 12.24 | | |
| HEMBA1003760 | 0.82 | 2.43 | 3.09 | 1.92 | 4.19 | 3.16 | | |
| HEMBA1003764 | 0.88 | 2.06 | 4.9 | 1.86 | 4.36 | 4.24 | | |
| HEMBA1003769 | 6.61 | 8.95 | 15.57 | 22.58 | 17.05 | 20.77 | * | + |
| HEMBA1003773 | 2.16 | 3.5 | 4.48 | 5.8 | 6.7 | 5.98 | * | + |
| HEMBA1003783 | 3.12 | 3.11 | 4.95 | 8.58 | 8.64 | 8.27 | ** | + |
| HEMBA1003784 | 0.46 | 1.37 | 2.89 | 2.37 | 2.45 | 1.77 | | |
| HEMBA1003794 | 3.48 | 3.61 | 13.64 | 11.98 | 11.61 | 15.55 | | |
| HEMBA1003799 | 1.09 | 1.05 | 4.29 | 2.44 | 5.06 | 3.76 | | |
| HEMBA1003803 | 7.58 | 6.67 | 12.05 | 11.68 | 7.64 | 8.41 | | |
| HEMBA1003804 | 1.08 | 2.53 | 4.45 | 1.86 | 3.35 | 2.05 | | |
| HEMBA1003805 | 6.41 | 7.87 | 10.45 | 15.74 | 7.09 | 11.93 | | |
| HEMBA1003807 | 1.52 | 1.53 | 3.21 | 2.71 | 6.32 | 2.37 | | |
| HEMBA1003810 | 1.72 | 3.29 | 6.06 | 5.98 | 4.85 | 4.55 | | |
| HEMBA1003827 | 2.71 | 4.55 | 12.08 | 13.28 | 10.48 | 15.35 | | |
| HEMBA1003836 | 3.42 | 4.84 | 10.27 | 11.16 | 12.81 | 9.96 | | |
| HEMBA1003838 | 16.5.81 | 6.15 | 31.32 | 34.24 | 33.25 | 35.46 | | |
| HEMBA1003843 | 4.6 | 6.54 | 7.01 | 13.61 | 6.48 | 11.42 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1003846 | 19.54 | 21.94 | 61.32 | 72.86 | 70.58 | 83.4 | * | + |
| HEMBA1003856 | 1.41 | 1.66 | 2.85 | 2.07 | 4.03 | 2.51 | | |
| HEMBA1003857 | 2.89 | 3.1 | 5.85 | 5.89 | 8.29 | 6.88 | | |
| HEMBA1003864 | 1.56 | 2.61 | 4.04 | 3.32 | 4.03 | 2.75 | | |
| HEMBA1003866 | 0.89 | 0.75 | 2.21 | 1.66 | 2.23 | 0.73 | | |
| HEMBA1003868 | 10.92 | 10.88 | 18.59 | 13.26 | 7.59 | 15.72 | | |
| HEMBA1003879 | 0.95 | 1.33 | 3.16 | 3.49 | 4.42 | 3.09 | | |
| HEMBA1003880 | 1.81 | 2.35 | 2.78 | 3.53 | 4.78 | 2.3 | | |
| HEMBA1003884 | 10.97 | 11.37 | 39.03 | 54.69 | 62.46 | 57.8 | * | + |
| HEMBA1003885 | 4.59 | 4.82 | 7.14 | 9.19 | 6.32 | 8.41 | | |
| HEMBA1003887 | 3.58 | 4.93 | 7.7 | 8.65 | 7.93 | 8.18 | | |
| HEMBA1003890 | 4.2 | 4.48 | 7.18 | 7.53 | 9.1 | 6.26 | | |
| HEMBA1003893 | 4.38 | 6.39 | 9.53 | 8.75 | 13.24 | 9.94 | | |
| HEMBA1003896 | 4.15 | 4.15 | 10.62 | 7.4 | 9.12 | 6.43 | | |
| HEMBA1003902 | 1.39 | 3.78 | 5.09 | 4.91 | 6.42 | 5.1 | | |
| HEMBA1003904 | 0.87 | 2.16 | 2.46 | 2.82 | 4.32 | 2.11 | | |
| HEMBA1003908 | 1.18 | 1.3 | 2.89 | 2.12 | 5.25 | 1.43 | | |
| HEMBA1003926 | 14.46 | 12.2 | 39.79 | 45.5 | 34.97 | 55.56 | | |
| HEMBA1003937 | 2.75 | 3.31 | 5.38 | 4.3 | 6.85 | 4.57 | | |
| HEMBA1003939 | 2.43 | 2.48 | 6.56 | 8.3 | 13.32 | 8.04 | | |
| HEMBA1003940 | 2.45 | 3.08 | 5.01 | 4.29 | 6.22 | 5.55 | | |
| HEMBA1003941 | 1.4 | 2.26 | 2.48 | 3.37 | 4.57 | 4.42 | * | + |
| HEMBA1003942 | 1.63 | 2.88 | 3.13 | 2.01 | 3.85 | 2.22 | | |
| HEMBA1003945 | 12.57 | 13.75 | 22.75 | 20.99 | 14.77 | 19.74 | | |
| HEMBA1003949 | 1.4 | 1.9 | 3.53 | 3.29 | 6.22 | 4.14 | | |
| HEMBA1003950 | 3.46 | 4.86 | 6.49 | 14.69 | 17.53 | 13.02 | ** | + |
| HEMBA1003953 | 1.91 | 1.6 | 5.14 | 0.72 | 3.97 | 1.44 | | |
| HEMBA1003958 | 5.16 | 3.6 | 7.47 | 7.54 | 9.45 | 6.64 | | |
| HEMBA1003959 | 2.42 | 2.72 | 5.72 | 5.5 | 5.5 | 9.02 | | |
| HEMBA1003960 | 3.25 | 5.81 | 34.7 | 24.04 | 26.4 | 28.28 | | |
| HEMBA1003966 | 9.63 | 8.28 | 16.73 | 16.75 | 17.67 | 19.84 | | |
| HEMBA1003967 | 1.75 | 3.06 | 3.47 | 3.48 | 3.6 | 3.27 | | |
| HEMBA1003968 | 0.97 | 2.14 | 2.55 | 2.49 | 4.56 | 1.82 | | |
| HEMBA1003974 | 634.2 | 699.64 | 821.36 | 986.23 | 1340.97 | 1248.21 | * | + |
| HEMBA1003976 | 1.05 | 1.84 | 3.36 | 1.21 | 3.27 | 2.04 | | |
| HEMBA1003977 | 1.48 | 2.07 | 1.99 | 1.41 | 3.49 | 2.15 | | |
| HEMBA1003978 | 2.91 | 3.72 | 3.54 | 3.77 | 6.18 | 3.53 | | |
| HEMBA1003981 | 9.01 | 6.77 | 14.06 | 12.05 | 11.49 | 18.27 | | |
| HEMBA1003982 | 102.64 | 103.61 | 302.15 | 380.08 | 375.9 | 466.69 | * | + |
| HEMBA1003985 | 1.18 | 1.9 | 2.43 | 3.21 | 3.79 | 2.18 | | |
| HEMBA1003987 | 3.04 | 2.23 | 3.1 | 2.56 | 4.34 | 5.53 | | |
| HEMBA1003989 | 1.62 | 1.77 | 4.56 | 3.79 | 5.12 | 3.31 | | |
| HEMBA1004000 | 1.63 | 2.35 | 5.05 | 3.46 | 5.35 | 4.18 | | |
| HEMBA1004006 | 2.79 | 2.88 | 12.86 | 16.29 | 22.13 | 19.73 | * | + |
| HEMBA1004007 | 0.7 | 1.92 | 5.28 | 3.03 | 5.18 | 4.72 | | |
| HEMBA1004010 | 67.4 | 61.25 | 98.24 | 112.56 | 96.78 | 136.86 | | |
| HEMBA1004011 | 0.48 | 1.74 | 2.18 | 2.58 | 3.29 | 1.62 | | |
| HEMBA1004012 | 0.79 | 1.84 | 2.3 | 3.11 | 4.8 | 3.53 | * | + |
| HEMBA1004015 | 2.68 | 4.15 | 5.38 | 8.68 | 10.65 | 9.21 | ** | + |
| HEMBA1004024 | 1.47 | 2.73 | 5.65 | 5.68 | 8.26 | 8.07 | | |
| HEMBA1004029 | 1.93 | 3.1 | 3.03 | 4.6 | 8.38 | 13.11 | | |
| HEMBA1004038 | 1.04 | 1.24 | 1.55 | 1.18 | 3.38 | 1.59 | | |
| HEMBA1004042 | 0.89 | 1.42 | 2.22 | 1.58 | 4 | 2.48 | | |
| HEMBA1004045 | 0.28 | 0.94 | 2.42 | 3.07 | 3.32 | 2.53 | | |
| HEMBA1004048 | 4.16 | 4.16 | 12.1 | 19.93 | 14.84 | 22.3 | * | + |
| HEMBA1004049 | 3.56 | 3.18 | 4.87 | 4.92 | 6.83 | 5.48 | | |
| HEMBA1004051 | 136.19 | 118.77 | 205.49 | 243.62 | 283.22 | 223.29 | * | + |
| HEMBA1004053 | 5.11 | 4.64 | 8.92 | 25.25 | 27.24 | 21 | ** | + |
| HEMBA1004055 | 2.28 | 3.2 | 4.24 | 2.15 | 5.51 | 2.86 | | |
| HEMBA1004056 | 3.78 | 3.07 | 6.73 | 5.3 | 10.99 | 9.56 | | |
| HEMBA1004060 | 0.86 | 1 | 1.7 | 0.78 | 3.94 | 1.65 | | |
| HEMBA1004061 | 4.76 | 3.94 | 6.44 | 7.37 | 12.64 | 8.57 | | |
| HEMBA1004067 | 10.12 | 14.76 | 90.67 | 108.89 | 125.21 | 128.6 | * | + |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and −, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1004071 | 7.51 | 7.77 | 16.52 | 17.31 | 12.23 | 13.37 | | |
| HEMBA1004074 | 0.78 | 1.93 | 3.97 | 4.48 | 7.06 | 5.69 | * | |
| HEMBA1004078 | 3.87 | 2.95 | 5.22 | 6.52 | 6.2 | 6.87 | * | + |
| HEMBA1004085 | 1.05 | 1.19 | 2.83 | 3.57 | 4.57 | 2.45 | | |
| HEMBA1004086 | 3.38 | 4.95 | 6 | 8.92 | 8.09 | 6.51 | * | + |
| HEMBA1004097 | 1.18 | 1.13 | 2.97 | 3.66 | 3.28 | 2.97 | | |
| HEMBA1004100 | 3.85 | 4.81 | 8.96 | 6.9 | 9.64 | 9.55 | | |
| HEMBA1004103 | 2 | 2.91 | 6.25 | 6.25 | 7.24 | 7.38 | | |
| HEMBA1004110 | 3 | 3.77 | 5.43 | 4.18 | 4.23 | 5.02 | | |
| HEMBA1004111 | 3.96 | 7.64 | 44.2 | 53.81 | 60.1 | 57.3 | * | + |
| HEMBA1004124 | 7.14 | 10.51 | 60.12 | 83.27 | 97.96 | 83.59 | * | + |
| HEMBA1004130 | 3.12 | 3.46 | 10.29 | 9.45 | 6.84 | 8.43 | | |
| HEMBA1004131 | 2.14 | 2.12 | 3.06 | 4.08 | 3.73 | 3.21 | * | + |
| HEMBA1004132 | 0.77 | 2.22 | 4.84 | 3.94 | 6.31 | 4.2 | | |
| HEMBA1004133 | 0.69 | 1.77 | 2.56 | 3.28 | 5.17 | 3.22 | | |
| HEMBA1004138 | 0.89 | 1.19 | 3.05 | 2.21 | 4.11 | 1.83 | | |
| HEMBA1004143 | 7.1 | 7.48 | 17.43 | 18.83 | 15 | 17.6 | | |
| HEMBA1004146 | 0.89 | 2.03 | 3.01 | 2.96 | 4.21 | 2.69 | | |
| HEMBA1004148 | 1.85 | 1.57 | 2.13 | 2.25 | 3.38 | 1.99 | | |
| HEMBA1004149 | 1.54 | 1.44 | 2.77 | 2.83 | 2.59 | 3.32 | | |
| HEMBA1004150 | 0.49 | 1.06 | 2.15 | 2.31 | 1.58 | 1.08 | | |
| HEMBA1004154 | 2.24 | 1.64 | 5.28 | 6.28 | 7.07 | 4.61 | | |
| HEMBA1004164 | 1.84 | 2.23 | 5.63 | 6.89 | 7.13 | 5.81 | | |
| HEMBA1004168 | 2.16 | 2.24 | 4.69 | 3.9 | 5.32 | 7.84 | | |
| HEMBA1004199 | 1.37 | 1.92 | 2.34 | 3.17 | 3.66 | 1.8 | | |
| HEMBA1004200 | 0.84 | 1.98 | 3 | 1.5 | 4.05 | 1.78 | | |
| HEMBA1004201 | 4.87 | 5.68 | 17.64 | 26.9.43 | 2.1.72 | 5.65 | * | + |
| HEMBA1004202 | 7.7 | 10.5 | 9.9 | 18.08 | 16.29 | 15.77 | ** | + |
| HEMBA1004203 | 1.63 | 2.31 | 3.66 | 4.5 | 5.3 | 4.44 | * | + |
| HEMBA1004207 | 1.9 | 3.24 | 3.62 | 5.73 | 6.23 | 6.2 | ** | + |
| HEMBA1004210 | 1.13 | 1.72 | 2.67 | 1.95 | 4.14 | 1.87 | | |
| HEMBA1004225 | 1.1 | 2.47 | 5.23 | 5.96 | 7.12 | 5.4 | | |
| HEMBA1004227 | 2.17 | 4.44 | 3.86 | 5.14 | 5.71 | 5.16 | | |
| HEMBA1004235 | 2.68 | 2.91 | 3.74 | 5.79 | 5.78 | 4.44 | * | + |
| HEMBA1004237 | 3 | 3.31 | 5.23 | 5.95 | 4.67 | 5.47 | | |
| HEMBA1004238 | 2.06 | 3.24 | 5.93 | 5.84 | 7.64 | 6.52 | | |
| HEMBA1004241 | 2.32 | 3.09 | 3.87 | 2.74 | 3.74 | 3.35 | | |
| HEMBA1004242 | 8.66 | 13.05 | 20.15 | 26.83 | 32.28 | 26.48 | * | + |
| HEMBA1004243 | 1.8 | 2.09 | 3.58 | 2.8 | 3.03 | 2.76 | | |
| HEMBA1004246 | 1.6 | 2.68 | 5.65 | 6.18 | 6.24 | 6.15 | | |
| HEMBA1004247 | 0.89 | 2.73 | 3.74 | 3.69 | 4.23 | 3.37 | | |
| HEMBA1004248 | 4.01 | 3.54 | 3.85 | 5.91 | 8.31 | 7.47 | ** | + |
| HEMBA1004250 | 1.55 | 2.16 | 2.87 | 1.91 | 5.22 | 1.47 | | |
| HEMBA1004252 | 3.57 | 3.27 | 4.8 | 4.64 | 5.79 | 4.28 | | |
| HEMBA1004260 | 2.56 | 3.08 | 6.87 | 7.32 | 8.16 | 7.61 | | |
| HEMBA1004264 | 1.26 | 2.11 | 2.59 | 2.16 | 2.86 | 1.37 | | |
| HEMBA1004267 | 5.5 | 5.81 | 14.29 | 14.22 | 12.19 | 11.57 | | |
| HEMBA1004272 | 1.75 | 2.31 | 3.31 | 2.26 | 3.84 | 2.04 | | |
| HEMBA1004274 | 5.83 | 8.1.35 | 8.69 | 77.19 | 87.61 | 76.22 | * | + |
| HEMBA1004275 | 1 | 5.4 | 3.34 | 1.49 | 4.49 | 2.42 | | |
| HEMBA1004276 | 2.27 | 2.2 | 3.42 | 3.45 | 4.2 | 3.06 | | |
| HEMBA1004279 | 2.13 | 2.33 | 4.37 | 3.29 | 5.2 | 3.88 | | |
| HEMBA1004284 | 1.78 | 2.56 | 6.03 | 4.16 | 4.9 | 5.23 | | |
| HEMBA1004286 | 1.41 | 1.35 | 2.44 | 1.65 | 3.55 | 2.1 | | |
| HEMBA1004289 | 2.58 | 4.17 | 5.59 | 5.16 | 7.18 | 8.44 | | |
| HEMBA1004293 | 20.24 | 18.64 | 51.03 | 77.3 | 52.39 | 74.25 | * | + |
| HEMBA1004295 | 1.08 | 2.65 | 3.08 | 2.73 | 4.02 | 2.05 | | |
| HEMBA1004302 | 0.72 | 1.84 | 2.29 | 1.21 | 3.39 | 1.49 | | |
| HEMBA1004306 | 2.11 | 3.01 | 5.96 | 3.99 | 5.74 | 6.01 | | |
| HEMBA1004312 | 1.3 | 1.58 | 4.98 | 3.57 | 3.56 | 3.56 | | |
| HEMBA1004314 | 1.78 | 1.86 | 4.1 | 3.35 | 6.23 | 4.38 | | |
| HEMBA1004321 | 0.88 | 1.66 | 2.56 | 4.05 | 4.15 | 4.82 | ** | + |
| HEMBA1004323 | 2.4 | 3.16 | 4.7 | 4.77 | 5.29 | 5.1 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1004327 | 1.18 | 1.78 | 3.23 | 3.51 | 4.46 | 3.1 | | |
| HEMBA1004329 | 5.57 | 6.73 | 15.22 | 16.29 | 15.33 | 15.14 | | |
| HEMBA1004330 | 3.93 | 3.54 | 4.06 | 5.87 | 7.54 | 5.36 | * | + |
| HEMBA1004334 | 2.92 | 3.63 | 4.69 | 4.18 | 4.74 | 6.06 | | |
| HEMBA1004335 | 1.15 | 1.77 | 5.1 | 3.04 | 4.75 | 3.14 | | |
| HEMBA1004341 | 1.01 | 1.1 | 1.25 | 1.13 | 3.34 | 1.14 | | |
| HEMBA1004344 | 29.93 | 34.05 | 68.18 | 74.25 | 94.77 | 82.54 | * | + |
| HEMBA1004347 | 0.67 | 1.65 | 2.21 | 2.31 | 2.25 | 2.78 | | |
| HEMBA1004349 | 12.07 | 11.55 | 22.26 | 19.39 | 22.71 | 24.41 | | |
| HEMBA1004352 | 2.06 | 2.56 | 6.96 | 6.05 | 6.92 | 6.58 | | |
| HEMBA1004353 | 10.21 | 14.95 | 25.3 | 19.64 | 26.63 | 25.83 | | |
| HEMBA1004354 | 1.9 | 2.56 | 6.29 | 5.42 | 6.94 | 5.83 | | |
| HEMBA1004356 | 5.75 | 6.89 | 9.43 | 20.06 | 19.7 | 20.1 | ** | + |
| HEMBA1004360 | 1.35 | 1.16 | 2.73 | 1.23 | 4.23 | 2.26 | | |
| HEMBA1004366 | 1.97 | 1.91 | 3.57 | 4.53 | 6.9 | 4.73 | * | + |
| HEMBA1004372 | 0.3 | 0.67 | 1.03 | 2.04 | 1.85 | 0.96 | | |
| HEMBA1004377 | 6.57 | 5.58 | 10.48 | 16.45 | 11.58 | 13.72 | * | + |
| HEMBA1004389 | 8.39 | 7.87 | 13.69 | 16.87 | 19.3 | 11.15 | | |
| HEMBA1004391 | 1.18 | 0.88 | 1.37 | 1.27 | 4.23 | 2.34 | | |
| HEMBA1004393 | 65.85 | 84.9 | 114.17 | 77.61 | 53.19 | 85.8 | | |
| HEMBA1004394 | 0.84 | 1.14 | 1.88 | 1.68 | 3.9 | 2.59 | | |
| HEMBA1004396 | 1.62 | 0.82 | 3.24 | 2.43 | 5.44 | 2.15 | | |
| HEMBA1004401 | 4.33 | 4.37 | 5.25 | 8.95 | 14.42 | 11.05 | * | + |
| HEMBA1004405 | 3.86 | 2.57 | 5.7 | 7.45 | 7.46 | 9.38 | * | + |
| HEMBA1004408 | 4.27 | 2.66 | 5.34 | 7.19 | 8.8 | 9.85 | * | + |
| HEMBA1004414 | 1.72 | 1.74 | 5.93 | 9.48 | 8.98 | 13.19 | * | + |
| HEMBA1004429 | 2.95 | 3.96 | 4.23 | 4.68 | 6.9 | 6.8 | * | + |
| HEMBA1004433 | 1.27 | 1.43 | 2.98 | 2.55 | 2.65 | 3.47 | | |
| HEMBA1004440 | 1.33 | 1.33 | 2.62 | 2.3 | 2.63 | 1.79 | | |
| HEMBA1004444 | 2.73 | 1.9 | 4.47 | 4.64 | 5.38 | 4.66 | | |
| HEMBA1004446 | 1.37 | 0.95 | 2.26 | 1.84 | 2.94 | 3.19 | | |
| HEMBA1004451 | 3.79 | 7.37 | 7.66 | 12.15 | 9.81 | 9.87 | * | + |
| HEMBA1004452 | 0.71 | 1.96 | 2.89 | 3.53 | 8.91 | 2.36 | | |
| HEMBA1004454 | 1.56 | 1.71 | 3.06 | 2.81 | 4.83 | 4.1 | | |
| HEMBA1004460 | 1.91 | 3.49 | 7.49 | 4.39 | 6.91 | 5.19 | | |
| HEMBA1004461 | 1 | 1.87 | 1.43 | 1.09 | 3.95 | 1.99 | | |
| HEMBA1004468 | 3.22 | 4.71 | 7.36 | 9.92 | 12.73 | 8.79 | * | + |
| HEMBA1004479 | 1.02 | 1.38 | 2.44 | 2.59 | 5.99 | 3.42 | | |
| HEMBA1004482 | 2.77 | 1.93 | 5.5 | 5.62 | 5.83 | 5.6 | | |
| HEMBA1004491 | 6.18 | 5.55 | 13 | 12.32 | 15.5 | 15.72 | | |
| HEMBA1004499 | 9.09 | 12.56 | 65.85 | 86.22 | 91.62 | 102.95 | * | + |
| HEMBA1004502 | 1.81 | 1.9 | 4.82 | 3.14 | 4.83 | 2.49 | | |
| HEMBA1004505 | 1.57 | 2.42 | 4.6 | 4.78 | 7.66 | 4.09 | | |
| HEMBA1004506 | 0.96 | 2.32 | 3.48 | 3.28 | 5.58 | 2.73 | | |
| HEMBA1004507 | 29.33 | 30.94 | 74.36 | 85.26 | 112.08 | 83.25 | * | + |
| HEMBA1004509 | 1.62 | 2.92 | 3.8 | 5.09 | 5.19 | 4.5 | * | + |
| HEMBA1004523 | 1.04 | 1.68 | 1.65 | 1.82 | 3.64 | 3.02 | | |
| HEMBA1004528 | 9.41 | 10.46 | 59.94 | 86.06 | 89.35 | 98.27 | * | + |
| HEMBA1004534 | 6.43 | 9.06 | 20.99 | 14.78 | 16.24 | 20.46 | | |
| HEMBA1004536 | 1.91 | 1.91 | 4.04 | 2.58 | 5.65 | 4.53 | | |
| HEMBA1004538 | 10.84 | 12.11 | 16.22 | 14.06 | 12.69 | 14.98 | | |
| HEMBA1004542 | 4.37 | 3.88 | 23.08 | 31.45 | 41.94 | 35.14 | * | + |
| HEMBA1004552 | 2.98 | 1.35 | 4.27 | 9.89 | 9.44 | 7.1 | ** | + |
| HEMBA1004554 | 1.21 | 1.05 | 2.53 | 1.91 | 7.29 | 2.16 | | |
| HEMBA1004558 | 2.98 | 4.6 | 12.99 | 21.19 | 21.7 | 23.66 | ** | + |
| HEMBA1004560 | 1.74 | 2.06 | 4.16 | 3.47 | 6.18 | 4.25 | | |
| HEMBA1004564 | 4.31 | 3.3 | 8.73 | 7.27 | 9.96 | 8.65 | | |
| HEMBA1004566 | 50.51 | 49.26 | 83.43 | 126.94 | 55.59 | 138.13 | | |
| HEMBA1004573 | 1.07 | 1.97 | 3.91 | 2.91 | 4.11 | 2.3 | | |
| HEMBA1004576 | 3.68 | 3.22 | 10.49 | 4.73 | 5.64 | 3.11 | | |
| HEMBA1004577 | 6.11 | 7.2 | 14 | 11.74 | 13.04 | 10.71 | | |
| HEMBA1004586 | 1.56 | 1.32 | 5.09 | 5.01 | 6.65 | 4.67 | | |
| HEMBA1004596 | 3.97 | 3.19 | 19.12 | 7.4 | 39.04 | 32.16 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1004604 | 9.04 | 8.14 | 40.08 | 64.86 | 69.99 | 62.02 | * | + |
| HEMBA1004607 | 0.96 | 1.97 | 4.17 | 3.02 | 4.39 | 3.96 | | |
| HEMBA1004610 | 1.16 | 1.89 | 3.19 | 2.91 | 4.8 | 2.64 | | |
| HEMBA1004617 | 0.78 | 0.89 | 3.29 | 2.77 | 4.53 | 2.51 | | |
| HEMBA1004622 | 1.05 | 2.39 | 5.1 | 4.07 | 5.84 | 5.04 | | |
| HEMBA1004626 | 1.56 | 2.36 | 4.75 | 4.06 | 4.93 | 2.33 | | |
| HEMBA1004629 | 1.5 | 1.34 | 3.95 | 3.17 | 4.58 | 2.74 | | |
| HEMBA1004631 | 1.57 | 1.73 | 4.41 | 3.3 | 5.73 | 4.97 | | |
| HEMBA1004632 | 1.02 | 1.3 | 3.43 | 2.38 | 3.64 | 2.36 | | |
| HEMBA1004633 | 3.2 | 3.98 | 8.84 | 9.3 | 9.04 | 10.74 | | |
| HEMBA1004636 | 1.29 | 2.07 | 3.22 | 3.23 | 3.61 | 6.58 | | |
| HEMBA1004637 | 1.57 | 2.12 | 4.19 | 3.97 | 4.85 | 2.39 | | |
| HEMBA1004638 | 1.31 | 1.67 | 3.26 | 1.8 | 4.24 | 1.52 | | |
| HEMBA1004645 | 3.04 | 2.88 | 6.5 | 5.07 | 6.21 | 5.08 | | |
| HEMBA1004656 | 4.38 | 2.76 | 4.96 | 4.13 | 4.58 | 3.39 | | |
| HEMBA1004657 | 16.78 | 17.12 | 35.48 | 31.85 | 17.55 | 22.74 | | |
| HEMBA1004666 | 1.27 | 2.2 | 3.32 | 2.78 | 4.52 | 1.44 | | |
| HEMBA1004669 | 2.49 | 3.6 | 6.16 | 7.32 | 8.34 | 5.55 | | |
| HEMBA1004670 | 3.1 | 2.74 | 6.27 | 5.11 | 6.96 | 3.3 | | |
| HEMBA1004672 | 1.29 | 2.33 | 4.85 | 2.58 | 7.25 | 3.63 | | |
| HEMBA1004689 | 23.54 | 21.34 | 82.29 | 90.21 | 98.37 | 106.84 | | |
| HEMBA1004690 | 4.74 | 5.24 | 15.26 | 19.89 | 22.39 | 20.76 | * | + |
| HEMBA1004693 | 3.16 | 5.98 | 25.39 | 24.92 | 35.74 | 32.68 | | |
| HEMBA1004697 | 1.64 | 1.96 | 4.88 | 7.14 | 9.69 | 4.03 | | |
| HEMBA1004702 | 8.73 | 11.47 | 19.57 | 19.47 | 14.63 | 11.2 | | |
| HEMBA1004704 | 1.9 | 3.35 | 9.01 | 3.41 | 5.17 | 5.36 | | |
| HEMBA1004705 | 1.13 | 1.93 | 3.32 | 1.8 | 4.34 | 1.54 | | |
| HEMBA1004706 | 1.34 | 2.4 | 3.89 | 4.31 | 6.23 | 4.7 | | |
| HEMBA1004709 | 2.96 | 2.9 | 10.14 | 6.81 | 8.65 | 6.93 | | |
| HEMBA1004711 | 1.22 | 1.44 | 5.01 | 1.19 | 3.14 | 3.28 | | |
| HEMBA1004723 | 4.91 | 5.18 | 10.06 | 11.37 | 16.92 | 12.96 | * | + |
| HEMBA1004725 | 4.14 | 4.9 | 7.68 | 5.67 | 8.62 | 8.54 | | |
| HEMBA1004730 | 3.57 | 2.83 | 4.74 | 3.64 | 8.59 | 4.41 | | |
| HEMBA1004733 | 1.07 | 2.64 | 2.62 | 1.06 | 3.54 | 2.45 | | |
| HEMBA1004734 | 2.57 | 3.22 | 4.46 | 2.68 | 5.28 | 5.32 | | |
| HEMBA1004736 | 1.1 | 1.89 | 7.12 | 3.87 | 12.1 | 5.09 | | |
| HEMBA1004748 | 2.24 | 0.94 | 5.6 | 3.02 | 5.22 | 2.83 | | |
| HEMBA1004749 | 6.88 | 8.33 | 19.68 | 16.49 | 19.03 | 23.29 | | |
| HEMBA1004751 | 1.96 | 1.76 | 5.55 | 3.99 | 9.86 | 5.04 | | |
| HEMBA1004752 | 1.51 | 1.6 | 4.23 | 4.56 | 4.11 | 3.32 | | |
| HEMBA1004753 | 29.15 | 25.19 | 85.53 | 59.89 | 62.5 | 95.58 | | |
| HEMBA1004755 | 7.02 | 6.32 | 12.37 | 9.73 | 12.72 | 14.63 | | |
| HEMBA1004756 | 1.45 | 1.76 | 3.86 | 2.34 | 5.21 | 2.17 | | |
| HEMBA1004758 | 1.18 | 1.64 | 4.53 | 3.92 | 5.65 | 3.17 | | |
| HEMBA1004763 | 1.79 | 2.39 | 5.56 | 5.45 | 6.53 | 6.09 | | |
| HEMBA1004768 | 0.83 | 1.64 | 2.89 | 1.69 | 4.26 | 1.38 | | |
| HEMBA1004770 | 1.09 | 1.36 | 2.43 | 1.47 | 3.53 | 1.94 | | |
| HEMBA1004771 | 0.99 | 1.02 | 2.44 | 2.18 | 3.26 | 2.57 | | |
| HEMBA1004775 | 4.07 | 3.84 | 7.29 | 8.61 | 9.62 | 13.74 | * | + |
| HEMBA1004776 | 1.86 | 3.21 | 3.33 | 3.95 | 6.83 | 6.04 | * | + |
| HEMBA1004778 | 1.75 | 2.24 | 6.11 | 3.21 | 7.64 | 5.74 | | |
| HEMBA1004784 | 1.51 | 1.59 | 3.11 | 2.36 | 4.18 | 3.62 | | |
| HEMBA1004785 | 1 | 1.78 | 4.15 | 2.18 | 6.54 | 4.48 | | |
| HEMBA1004789 | 2.34 | 2.07 | 4.42 | 1.87 | 5.64 | 2.87 | | |
| HEMBA1004795 | 0.62 | 1.89 | 3.13 | 2.45 | 4.23 | 1.42 | | |
| HEMBA1004797 | 1.06 | 0.84 | 1.85 | 2.31 | 2.85 | 2.76 | * | + |
| HEMBA1004803 | 4.98 | 1.72 | 5.31 | 4.62 | 9.79 | 4.82 | | |
| HEMBA1004806 | 1.23 | 1.78 | 3.22 | 2.36 | 3.83 | 2.33 | | |
| HEMBA1004807 | 3.05 | 1.95 | 3.86 | 5.58 | 7.44 | 4.14 | | |
| HEMBA1004816 | 4.73 | 2.61 | 3.59 | 3.78 | 7.97 | 9.34 | | |
| HEMBA1004820 | 1.73 | 2.33 | 4.6 | 2.97 | 8.74 | 3.71 | | |
| HEMBA1004833 | 1.22 | 1.23 | 5.54 | 2.71 | 6.95 | 4.37 | | |
| HEMBA1004847 | 4.73 | 2.8 | 9.84 | 8 | 11.83 | 9.15 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1004850 | 1.01 | 1.78 | 6.15 | 6.56 | 13.54 | 6.38 | | |
| HEMBA1004863 | 1.75 | 2.3 | 4.92 | 3.34 | 4.45 | 5.17 | | |
| HEMBA1004864 | 2.66 | 3.91 | 6.68 | 4.19 | 9.03 | 6.51 | | |
| HEMBA1004865 | 1.13 | 2.61 | 4.06 | 3.86 | 6.64 | 3.38 | | |
| HEMBA1004880 | 2.22 | 3.32 | 9.22 | 9.9 | 10.38 | 9.48 | | |
| HEMBA1004882 | 5.8 | 7.1 | 10.16 | 15.5 | 15.77 | 12.03 | * | + |
| HEMBA1004885 | 2.34 | 6 | 8.67 | 8.58 | 8.67 | 9.27 | | |
| HEMBA1004889 | 3.25 | 3.24 | 6.5 | 7.67 | 10.74 | 9.8 | * | + |
| HEMBA1004900 | 1.51 | 1.59 | 3.71 | 3.21 | 5.14 | 2.84 | | |
| HEMBA1004909 | 0.71 | 1.96 | 3.59 | 3.21 | 4.47 | 4.97 | | |
| HEMBA1004918 | 1.46 | 1.7 | 4.93 | 4.03 | 7.19 | 5.77 | | |
| HEMBA1004923 | 1.1 | 1.83 | 3.72 | 3.98 | 7.3 | 4.27 | | |
| HEMBA1004929 | 1.01 | 1.7 | 2.68 | 1.66 | 3.59 | 1.38 | | |
| HEMBA1004930 | 1.4 | 2.06 | 4.31 | 3.91 | 5.87 | 4.72 | | |
| HEMBA1004933 | 2.41 | 1.5 | 5.32 | 5.59 | 5.43 | 3.38 | | |
| HEMBA1004934 | 8.61 | 8.61 | 17.67 | 26.2 | 27.77 | 26.83 | ** | + |
| HEMBA1004937 | 1.36 | 2.42 | 3.57 | 2.79 | 7.51 | 2.54 | | |
| HEMBA1004943 | 1.11 | 1.75 | 3.63 | 2.56 | 4.88 | 3.68 | | |
| HEMBA1004944 | 0.95 | 2.51 | 4.73 | 3.85 | 4.79 | 3.58 | | |
| HEMBA1004946 | 4.78 | 4.38 | 12.5 | 12.69 | 14.08 | 12.8 | | |
| HEMBA1004952 | 0.9 | 1.83 | 4.04 | 2.76 | 4.41 | 2 | | |
| HEMBA1004954 | 3.55 | 3.21 | 7.92 | 6.02 | 6.4 | 6.12 | | |
| HEMBA1004956 | 1.37 | 1.11 | 2.78 | 2.12 | 3.66 | 1.81 | | |
| HEMBA1004960 | 0.86 | 0.75 | 3.27 | 4.17 | 6.72 | 3.06 | | |
| HEMBA1004971 | 2.41 | 2.49 | 6.81 | 6.45 | 8.05 | 6.92 | | |
| HEMBA1004972 | 2.57 | 2.31 | 3.63 | 2.07 | 5.66 | 5.84 | | |
| HEMBA1004973 | 1.16 | 1.78 | 3.46 | 2.53 | 3.27 | 3.18 | | |
| HEMBA1004977 | 3.04 | 3.08 | 5.36 | 5.34 | 6.29 | 6.36 | | |
| HEMBA1004978 | 4.53 | 5.08 | 14.93 | 21.43 | 19.01 | 25.37 | * | + |
| HEMBA1004980 | 1.92 | 2.36 | 7.92 | 6.55 | 6.55 | 7.29 | | |
| HEMBA1004982 | 0.83 | 1.36 | 2.92 | 2.8 | 4.45 | 2.65 | | |
| HEMBA1004983 | 1.73 | 1.88 | 4.29 | 3.92 | 5.5 | 4.21 | | |
| HEMBA1004995 | 2.76 | 3.99 | 6.53 | 7.5 | 7.46 | 7.41 | | |
| HEMBA1005004 | 1.63 | 3.57 | 5.12 | 3.45 | 5.72 | 4.07 | | |
| HEMBA1005008 | 1.61 | 3.52 | 4.9 | 4.61 | 6.42 | 5.97 | | |
| HEMBA1005009 | 4.55 | 3.9 | 8.37 | 11.95 | 6.96 | 9.22 | | |
| HEMBA1005019 | 3.1 | 2.57 | 5.78 | 6.6 | 8.07 | 7.19 | * | + |
| HEMBA1005021 | 16.12 | 17.89 | 30.44 | 29.81 | 23.38 | 23.26 | | |
| HEMBA1005029 | 3.13 | 3.42 | 7.98 | 7.23 | 8.66 | 6.52 | | |
| HEMBA1005035 | 6.53 | 6.29 | 19.38 | 18.59 | 17.77 | 20.38 | | |
| HEMBA1005036 | 19.87 | 20.39 | 37.72 | 23.12 | 19.26 | 26.98 | | |
| HEMBA1005039 | 1.7 | 3.19 | 4.59 | 4.36 | 6.81 | 3.69 | | |
| HEMBA1005047 | 4.31 | 4.06 | 5.6 | 7.01 | 8.54 | 7.83 | ** | + |
| HEMBA1005050 | 2 | 2.93 | 5.07 | 4.33 | 6.76 | 4.39 | | |
| HEMBA1005062 | 2.48 | 3.06 | 5.62 | 2.85 | 5.13 | 2.03 | | |
| HEMBA1005066 | 2.28 | 2.55 | 5.72 | 4.81 | 8.94 | 6.89 | | |
| HEMBA1005067 | 5.81 | 10.37 | 17.44 | 25.77 | 30.77 | 26.84 | * | + |
| HEMBA1005070 | 3.33 | 3.01 | 8.9 | 8.51 | 8.13 | 6.59 | | |
| HEMBA1005075 | 1.29 | 2.45 | 6.51 | 3.97 | 5.38 | 4.49 | | |
| HEMBA1005078 | 7.47 | 6.74 | 14.34 | 14.89 | 9.95 | 11.01 | | |
| HEMBA1005079 | 5.52 | 5.68 | 13.65 | 14.98 | 16.02 | 21.42 | | |
| HEMBA1005083 | 0.94 | 0.97 | 2.69 | 2.17 | 4.96 | 1.25 | | |
| HEMBA1005084 | 5.36 | 4.49 | 8.84 | 7.48 | 10.38 | 9.99 | | |
| HEMBA1005088 | 1.63 | 1.64 | 7.16 | 3.48 | 6.18 | 4.54 | | |
| HEMBA1005089 | 3.12 | 3.47 | 5.53 | 5.04 | 9 | 5.52 | | |
| HEMBA1005090 | 5.92 | 5.56 | 11.7 | 17.14 | 12.91 | 21.06 | * | + |
| HEMBA1005096 | 0.88 | 2.47 | 3.98 | 3.35 | 3.94 | 2.88 | | |
| HEMBA1005101 | 2.29 | 2.08 | 4.54 | 3.23 | 5.6 | 4.54 | | |
| HEMBA1005107 | 1.2 | 1.92 | 3.2 | 2.25 | 4.48 | 2.3 | | |
| HEMBA1005113 | 0.96 | 2.18 | 3.35 | 2.12 | 5.53 | 2.72 | | |
| HEMBA1005123 | 3.35 | 3.46 | 10.83 | 9.05 | 10.41 | 8.28 | | |
| HEMBA1005133 | 2.6 | 2.26 | 7.59 | 5.11 | 4.58 | 7.09 | | |
| HEMBA1005135 | 1.19 | 2.77 | 3.35 | 1.47 | 5.28 | 3.69 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1005145 | 5.84 | 6.38 | 12.56 | 13.06 | 14.71 | 17.84 | | |
| HEMBA1005149 | 4.21 | 3.2 | 7.92 | 6.51 | 8.54 | 8.47 | | |
| HEMBA1005152 | 1.81 | 3.06 | 3.59 | 3.31 | 5.05 | 3.39 | | |
| HEMBA1005159 | 1.76 | 1.96 | 3.62 | 2.2 | 8.12 | 2.2 | | |
| HEMBA1005172 | 120.6 | 113.48 | 240.76 | 174.65 | 194.57 | 222.24 | | |
| HEMBA1005185 | 3.16 | 2.05 | 4.47 | 3.54 | 6.7 | 4.15 | | |
| HEMBA1005186 | 1.55 | 2.65 | 3.96 | 3.52 | 8.39 | 2.03 | | |
| HEMBA1005195 | 2.15 | 1.08 | 3.76 | 1.93 | 6.73 | 2.24 | | |
| HEMBA1005201 | 3.27 | 3.45 | 8.02 | 5.52 | 7.17 | 8.91 | | |
| HEMBA1005202 | 5.93 | 4.58 | 9.4 | 8.29 | 9.76 | 12.83 | | |
| HEMBA1005204 | 86.99 | 67.86 | 141.56 | 134.68 | 133.57 | 172.39 | | |
| HEMBA1005206 | 6.39 | 5.08 | 66.26 | 72.89 | 92.07 | 89.66 | * | + |
| HEMBA1005219 | 4.62 | 6.56 | 14.55 | 15.66 | 21.85 | 17.87 | * | + |
| HEMBA1005223 | 2.4 | 1.91 | 4.92 | 1.7 | 3.83 | 3.86 | | |
| HEMBA1005229 | 1.18 | 2.32 | 3.12 | 1.57 | 4.88 | 2.32 | | |
| HEMBA1005230 | 1.22 | 1.56 | 4.24 | 2.71 | 5.92 | 4.32 | | |
| HEMBA1005232 | 0.86 | 1.13 | 1.6 | 0.91 | 3.81 | 2.17 | | |
| HEMBA1005238 | 0.84 | 1.77 | 2.67 | 2.16 | 3.27 | 2.29 | | |
| HEMBA1005241 | 2.77 | 2.68 | 7.42 | 7.63 | 11.38 | 7.62 | | |
| HEMBA1005244 | 0.87 | 1.97 | 5.63 | 2.57 | 8.33 | 6.19 | | |
| HEMBA1005246 | 8.84 | 7.84 | 17.94 | 12.96 | 18.21 | 14.79 | | |
| HEMBA1005251 | 3.06 | 2.57 | 6.81 | 6.6 | 8.47 | 7.24 | | |
| HEMBA1005252 | 2.3 | 2.7 | 5.31 | 4.73 | 11.4 | 5.01 | | |
| HEMBA1005267 | 2.77 | 3.31 | 7.25 | 6.77 | 12.66 | 9.89 | | |
| HEMBA1005274 | 1.75 | 1.53 | 3.28 | 4.8 | 6.38 | 6.51 | ** | + |
| HEMBA1005275 | 0.62 | 1.27 | 1.59 | 1.63 | 3.44 | 2.12 | | |
| HEMBA1005288 | 3.03 | 1.16 | 6.1 | 6.49 | 6.35 | 6.68 | | |
| HEMBA1005293 | 1.46 | 1.37 | 2.53 | 1.5 | 4.09 | 1.78 | | |
| HEMBA1005296 | 440.88 | 422.67 | 780.14 | 598.1 | 568.79 | 483.77 | | |
| HEMBA1005301 | 3.93 | 3.26 | 29.41 | 28.17 | 47.57 | 44.12 | | |
| HEMBA1005304 | 1.75 | 2.3 | 7 | 3.36 | 7.29 | 7.62 | | |
| HEMBA1005305 | 0.77 | 1.18 | 2.57 | 0.74 | 3.99 | 1.71 | | |
| HEMBA1005311 | 0.97 | 1.05 | 2.08 | 0.81 | 1.97 | 2.13 | | |
| HEMBA1005313 | 20.35 | 21.96 | 39.64 | 29.02 | 19.54 | 26.39 | | |
| HEMBA1005314 | 1 | 1.36 | 2.6 | 2.2 | 4.08 | 1.99 | | |
| HEMBA1005315 | 0.81 | 2.41 | 4.27 | 1.95 | 5.32 | 3.59 | | |
| HEMBA1005317 | 0.8 | 1.48 | 2.93 | 1.9 | 3.68 | 2.43 | | |
| HEMBA1005318 | 1.42 | 0.95 | 2.68 | 1.48 | 4.54 | 2.21 | | |
| HEMBA1005324 | 6.24 | 8.79 | 28.39 | 48.36 | 52.86 | 57.05 | ** | + |
| HEMBA1005331 | 2.77 | 5.64 | 15.05 | 21.73 | 18.68 | 21.33 | * | + |
| HEMBA1005337 | 12.1 | 12.25 | 61.94 | 98.25 | 113.65 | 125.54 | * | + |
| HEMBA1005338 | 4.53 | 4.54 | 27.15 | 34.04 | 35.53 | 42.4 | * | + |
| HEMBA1005344 | 2.75 | 2.57 | 5.08 | 4.17 | 4.16 | 3.3 | | |
| HEMBA1005353 | 1.15 | 2.78 | 6.52 | 4.66 | 7.21 | 6.44 | | |
| HEMBA1005359 | 2.6 | 2.82 | 7.48 | 6.59 | 8.03 | 7.68 | | |
| HEMBA1005362 | 1.06 | 2.73 | 4.93 | 7.3 | 11.27 | 8.37 | * | + |
| HEMBA1005364 | 0.96 | 1.48 | 3 | 2.55 | 3.78 | 2.75 | | |
| HEMBA1005367 | 0.96 | 1.53 | 4.19 | 3.3 | 4.21 | 2.99 | | |
| HEMBA1005372 | 1 | 2.24 | 4.18 | 2.3 | 5.1 | 3 | | |
| HEMBA1005374 | 2.29 | 3.31 | 7.83 | 6.4 | 6.45 | 8.09 | | |
| HEMBA1005379 | 3.19 | 3.61 | 7.65 | 29.57 | 25.57 | 24.46 | ** | + |
| HEMBA1005382 | 9.85 | 11.52 | 79.62 | 88.72 | 86.53 | 120.52 | | |
| HEMBA1005384 | 1.44 | 1.76 | 3.4 | 2.78 | 3.74 | 2.78 | | |
| HEMBA1005386 | 1.52 | 2.67 | 4.54 | 4.17 | 4.66 | 4.84 | | |
| HEMBA1005389 | 1.1 | 0.8 | 3.01 | 2.51 | 4.09 | 3.75 | | |
| HEMBA1005394 | 1.64 | 2.32 | 5 | 8.09 | 10.03 | 6.99 | * | + |
| HEMBA1005403 | 4.19 | 4.24 | 8.81 | 8.46 | 11.37 | 8.87 | | |
| HEMBA1005408 | 1.43 | 1.71 | 5.3 | 4.52 | 7.12 | 6.96 | | |
| HEMBA1005410 | 1.06 | 1.74 | 3.22 | 1.78 | 4.97 | 2.42 | | |
| HEMBA1005411 | 1.38 | 2.58 | 4.54 | 2.84 | 4.09 | 2.74 | | |
| HEMBA1005423 | 4.14 | 5.87 | 4.72 | 12.75 | 8.59 | 11.04 | * | + |
| HEMBA1005426 | 0.71 | 1.79 | 2.35 | 2.08 | 3.25 | 4.15 | | |
| HEMBA1005427 | 9.12 | 12.47 | 24.08 | 37.26 | 33.57 | 35.43 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1005430 | 1.71 | 1.43 | 3.23 | 3.26 | 4.07 | 4.78 | | |
| HEMBA1005438 | 1.42 | 2.33 | 4.26 | 4.01 | 5.41 | 2.66 | | |
| HEMBA1005443 | 15.57 | 16.88 | 35.83 | 20.61 | 27.42 | 29.93 | | |
| HEMBA1005447 | 1.55 | 1.95 | 3.42 | 2.25 | 5.9 | 3 | | |
| HEMBA1005449 | 1.5 | 1.36 | 3.29 | 1.82 | 5.83 | 3.21 | | |
| HEMBA1005452 | 8.96 | 10.79 | 63.65 | 107.56 | 94.42 | 105.84 | * | + |
| HEMBA1005454 | 4.73 | 4.51 | 7.91 | 6.37 | 8.12 | 5.33 | | |
| HEMBA1005468 | 2.49 | 3.19 | 4 | 3.6 | 4.93 | 4.86 | | |
| HEMBA1005469 | 1.39 | 1.89 | 5.38 | 3.44 | 5.94 | 4.04 | | |
| HEMBA1005472 | 4.04 | 4.76 | 7.81 | 6.79 | 6.75 | 8.2 | | |
| HEMBA1005474 | 4.91 | 5.42 | 11.67 | 7.77 | 9.4 | 9.23 | | |
| HEMBA1005475 | 7.8 | 7.09 | 11.75 | 15.34 | 10.75 | 13.59 | | |
| HEMBA1005489 | 2.47 | 3.48 | 4.94 | 6.34 | 7 | 6.54 | * | + |
| HEMBA1005497 | 0.65 | 1.97 | 3.47 | 2.86 | 4.42 | 2.14 | | |
| HEMBA1005500 | 4.64 | 4.25 | 11.48 | 9.17 | 13.98 | 10.59 | | |
| HEMBA1005506 | 3.88 | 2.15 | 4.02 | 2.71 | 3.57 | 1.29 | | |
| HEMBA1005508 | 5.79 | 7.67 | 13.3 | 11.65 | 14.52 | 10.99 | | |
| HEMBA1005511 | 2.97 | 2.29 | 9 | 4.36 | 6.36 | 6.14 | | |
| HEMBA1005513 | 6.3 | 9.05 | 55.46 | 50.46 | 60.73 | 57.45 | | |
| HEMBA1005517 | 1.8 | 2.89 | 3.88 | 4.37 | 6.41 | 3.74 | | |
| HEMBA1005518 | 1.48 | 2.49 | 3.94 | 2.94 | 5.22 | 2.3 | | |
| HEMBA1005520 | 1.89 | 3.19 | 8.8 | 8.37 | 10.13 | 9.32 | | |
| HEMBA1005522 | 1.78 | 2.29 | 3.37 | 2.52 | 4.72 | 1.45 | | |
| HEMBA1005526 | 3.24 | 2.8 | 6.25 | 4.37 | 7.26 | 4.58 | | |
| HEMBA1005528 | 8.59 | 16.13 | 16.28 | 20.24 | 22.18 | 20.01 | | |
| HEMBA1005530 | 2.28 | 3.62 | 5.13 | 4.91 | 7.75 | 4.51 | | |
| HEMBA1005538 | 11.07 | 10.7 | 15.34 | 8.46 | 4.44 | 5.89 | * | − |
| HEMBA1005539 | 30.73 | 31.96 | 63.32 | 50.52 | 49.29 | 34.26 | | |
| HEMBA1005545 | 1.2 | 1.08 | 3 | 4.28 | 6.22 | 2.25 | | |
| HEMBA1005548 | 2.38 | 2.88 | 11.1 | 11.04 | 12.72 | 9.21 | | |
| HEMBA1005552 | 2.76 | 4.58 | 12.05 | 9.13 | 12.8 | 10.25 | | |
| HEMBA1005558 | 1.59 | 2 | 5.86 | 2.18 | 6.97 | 4.17 | | |
| HEMBA1005568 | 3.11 | 2.96 | 8.24 | 6.28 | 8.45 | 7.5 | | |
| HEMBA1005570 | 1.87 | 2.75 | 3 | 1.96 | 4.49 | 7.13 | | |
| HEMBA1005576 | 1.74 | 2.8 | 2.4 | 3.03 | 3.55 | 3.57 | * | + |
| HEMBA1005577 | 1.14 | 2.02 | 2.78 | 0.95 | 3.08 | 0.87 | | |
| HEMBA1005581 | 4.29 | 4.22 | 6.85 | 14.27 | 18.37 | 8.15 | | |
| HEMBA1005582 | 2.74 | 2.57 | 5.35 | 3.25 | 7.91 | 3.21 | | |
| HEMBA1005583 | 2.47 | 3.31 | 5.86 | 3.32 | 6.43 | 3.44 | | |
| HEMBA1005588 | 2.51 | 2.85 | 6.27 | 5 | 6.54 | 6.14 | | |
| HEMBA1005593 | 1.5 | 1.4 | 2.85 | 1.83 | 4.57 | 2.89 | | |
| HEMBA1005595 | 2.62 | 2.82 | 4.15 | 3.31 | 4.65 | 4.76 | | |
| HEMBA1005597 | 4.77 | 5.18 | 8.13 | 9.39 | 10.34 | 8.64 | * | + |
| HEMBA1005606 | 2.29 | 2.76 | 5.79 | 3.96 | 6.91 | 5.83 | | |
| HEMBA1005609 | 2.84 | 2.64 | 6.61 | 4.19 | 5.77 | 6.81 | | |
| HEMBA1005616 | 2.01 | 1.66 | 8.03 | 5.44 | 8.75 | 7.03 | | |
| HEMBA1005621 | 2.43 | 1.91 | 4.42 | 4.13 | 6.24 | 2.7 | | |
| HEMBA1005627 | 3.84 | 3.92 | 11.61 | 9.73 | 15.14 | 14.89 | | |
| HEMBA1005628 | 12.1 | 12.91 | 20.55 | 17.92 | 23.35 | 18.08 | | |
| HEMBA1005631 | 13.47 | 11.94 | 26.82 | 22.77 | 22.87 | 29.03 | | |
| HEMBA1005632 | 1.33 | 2.33 | 5.06 | 3.14 | 3.68 | 4.47 | | |
| HEMBA1005634 | 3.06 | 3.42 | 5.15 | 2.81 | 7.68 | 5.18 | | |
| HEMBA1005662 | 1.18 | 1.27 | 3.17 | 1.06 | 4.57 | 3.03 | | |
| HEMBA1005666 | 5.89 | 4.51 | 10.09 | 10.5 | 9.01 | 10.25 | | |
| HEMBA1005670 | 1 | 1.08 | 4.06 | 2.87 | 4.35 | 3.19 | | |
| HEMBA1005671 | 2.11 | 3.38 | 5.07 | 5.36 | 9 | 5.9 | | |
| HEMBA1005679 | 2.33 | 4.64 | 7.39 | 6.51 | 0.44 | 10.19 | | |
| HEMBA1005680 | 2.63 | 2.14 | 5.9 | 5.51 | 7.59 | 7.72 | | |
| HEMBA1005685 | 2 | 1.89 | 7.27 | 3.8 | 6.73 | 1.97 | | |
| HEMBA1005698 | 5.96 | 4.75 | 12.88 | 11.78 | 14.17 | 9.93 | | |
| HEMBA1005699 | 1.4 | 1 | 2.45 | 2.17 | 3.66 | 2.96 | | |
| HEMBA1005703 | 1.22 | 1.27 | 3.57 | 1.79 | 3.56 | 1.88 | | |
| HEMBA1005705 | 2.39 | 2.78 | 6.45 | 3.41 | 6.27 | 3.89 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and −, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1005712 | 1.23 | 1.34 | 4.52 | 2.18 | 4.84 | 2.37 | | |
| HEMBA1005717 | 1.55 | 1.89 | 4.7 | 1.34 | 5.36 | 2.16 | | |
| HEMBA1005718 | 5.27 | 4.35 | 7.8 | 10.09 | 10 | 15.72 | * | + |
| HEMBA1005721 | 15.93 | 20.34 | 26.12 | 37.74 | 25.37 | 32.79 | | |
| HEMBA1005722 | 18 | 19.32 | 35.72 | 25.36 | 30.28 | 26.91 | | |
| HEMBA1005724 | 2.17 | 2.05 | 4.6 | 2.47 | 6.56 | 2.98 | | |
| HEMBA1005732 | 1.33 | 1.54 | 4.89 | 7.22 | 8.38 | 5.67 | * | + |
| HEMBA1005737 | 1.49 | 1.19 | 2.95 | 2.44 | 4.57 | 1.75 | | |
| HEMBA1005742 | 3.4 | 4.65 | 5.7 | 4.43 | 6.35 | 4.22 | | |
| HEMBA1005746 | 1.2 | 1.61 | 3.23 | 5.69 | 4.42 | 4.85 | * | + |
| HEMBA1005747 | 3.8 | 3.51 | 7.52 | 6.08 | 6.55 | 6.67 | | |
| HEMBA1005749 | 9.64 | 9.37 | 17.99 | 21.62 | 19.82 | 18.15 | | |
| HEMBA1005755 | 0.49 | 2.5 | 3.35 | 1.66 | 4.41 | 2.9 | | |
| HEMBA1005760 | 1.59 | 2.1 | 5.37 | 3.7 | 4.86 | 4.14 | | |
| HEMBA1005765 | 1.47 | 2.89 | 5.97 | 5.91 | 7.42 | 7.21 | | |
| HEMBA1005766 | 8.52 | 10.49 | 61.64 | 93.41 | 12.09 | 106.28 | * | + |
| HEMBA1005780 | 4.98 | 5.15 | 14.49 | 13.93 | 16.26 | 12 | | |
| HEMBA1005795 | 1.15 | 1.8 | 3.71 | 4.28 | 5.45 | 4.26 | * | + |
| HEMBA1005809 | 9.13 | 9.7 | 20.95 | 14.79 | 29.83 | 22.75 | | |
| HEMBA1005813 | 1.76 | 2.74 | 6.74 | 5.39 | 9 | 7.08 | | |
| HEMBA1005815 | 0.62 | 1.86 | 2.75 | 2.74 | 4.78 | 2.13 | | |
| HEMBA1005822 | 1.34 | 2.83 | 5.82 | 3.77 | 6.65 | 5.12 | | |
| HEMBA1005829 | 1.49 | 2.66 | 4.94 | 5.11 | 4.53 | 5.52 | | |
| HEMBA1005833 | 1.83 | 1.28 | 4.41 | 3.89 | 5.17 | 4.57 | | |
| HEMBA1005834 | 2.53 | 1.87 | 4.84 | 5.48 | 11.84 | 6.81 | | |
| HEMBA1005844 | 27.89 | 31.06 | 52.5 | 62.42 | 59.49 | 58.73 | * | + |
| HEMBA1005852 | 5.75 | 4.18 | 10.12 | 10.15 | 12.34 | 11.51 | | |
| HEMBA1005853 | 2.81 | 3.05 | 9.32 | 5.68 | 13.84 | 9.26 | | |
| HEMBA1005878 | 4.42 | 4.52 | 10.14 | 8.84 | 10.05 | 11.01 | | |
| HEMBA1005883 | 1.67 | 2.81 | 4.56 | 2.81 | 5.43 | 4.01 | | |
| HEMBA1005884 | 1.87 | 2 | 3.21 | 2.27 | 5.9 | 2.28 | | |
| HEMBA1005891 | 2.39 | 3.04 | 3.59 | 4.34 | 5.46 | 3.95 | | |
| HEMBA1005894 | 2.12 | 2.41 | 8.68 | 8.23 | 9.08 | 6.9 | | |
| HEMBA1005898 | 4.52 | 3.75 | 7.4 | 10.51 | 10.74 | 9.53 | * | + |
| HEMBA1005902 | 2.57 | 3.14 | 8.63 | 5.36 | 6.75 | 5.82 | | |
| HEMBA1005907 | 1.15 | 2.28 | 2.2 | 2.28 | 4.2 | 1.74 | | |
| HEMBA1005909 | 0.93 | 2.68 | 2.97 | 2.96 | 4.55 | 2.6 | | |
| HEMBA1005911 | 1.66 | 3.12 | 4.9 | 3.96 | 9.5 | 3.41 | | |
| HEMBA1005912 | 8.83 | 7.86 | 13.57 | 16.44 | 8.16 | 15.58 | | |
| HEMBA1005913 | 5.05 | 5.39 | 10.39 | 9.57 | 7.71 | 7.06 | | |
| HEMBA1005921 | 2.36 | 3.86 | 6.29 | 5.25 | 10.06 | 7.64 | | |
| HEMBA1005922 | 5.49 | 5.47 | 6.99 | 8.51 | 10.1 | 8.74 | * | + |
| HEMBA1005929 | 1.91 | 2.53 | 7.53 | 5.05 | 5.68 | 6.47 | | |
| HEMBA1005931 | 3.32 | 2.95 | 6.04 | 5.31 | 9.49 | 6.09 | | |
| HEMBA1005934 | 2.9 | 4.69 | 8.2 | 8.17 | 10.14 | 9.73 | | |
| HEMBA1005945 | 3.1 | 4.12 | 7.73 | 6.36 | 9.39 | 6.65 | | |
| HEMBA1005962 | 1.72 | 1.81 | 3.16 | 1.93 | 3.96 | 1.72 | | |
| HEMBA1005963 | 1.86 | 1.67 | 3.91 | 2.26 | 3.95 | 2.05 | | |
| HEMBA1005990 | 6.04 | 7.39 | 17.86 | 14.14 | 16.18 | 17.02 | | |
| HEMBA1005991 | 2.39 | 3.35 | 8.55 | 7.2 | 7.64 | 6.94 | | |
| HEMBA1005999 | 2.34 | 4.39 | 8.84 | 6.52 | 8.18 | 8.75 | | |
| HEMBA1006002 | 3.53 | 5 | 7.73 | 5.96 | 10.24 | 8.99 | | |
| HEMBA1006005 | 0.96 | 2.31 | 3.93 | 2.87 | 5.65 | 3.27 | | |
| HEMBA1006011 | 26.27 | 24.03 | 34.08 | 62.88 | 44.8 | 64.92 | * | + |
| HEMBA1006013 | 2.43 | 2.57 | 6.31 | 4.17 | 6.87 | 3.74 | | |
| HEMBA1006016 | 1.65 | 1.98 | 5.64 | 3.22 | 5.34 | 2.16 | | |
| HEMBA1006019 | 2.97 | 3.23 | 6.91 | 4.46 | 7.22 | 5.44 | | |
| HEMBA1006021 | 5.06 | 6.45 | 9.21 | 10.29 | 12.48 | 8.77 | | |
| HEMBA1006022 | 3.19 | 4.34 | 6.89 | 6.52 | 6.1 | 5.94 | | |
| HEMBA1006031 | 1.32 | 2.46 | 4.38 | 3.72 | 5.57 | 5.34 | | |
| HEMBA1006035 | 3.05 | 3.72 | 7.96 | 4.99 | 6.37 | 4.54 | | |
| HEMBA1006036 | 2.02 | 2.3 | 7 | 4.27 | 10.14 | 7.22 | | |
| HEMBA1006042 | 3.36 | 3.1 | 8.51 | 5.76 | 9.59 | 8.31 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1006044 | 1.44 | 1.99 | 3.61 | 2.8 | 3.4 | 1.67 | | |
| HEMBA1006045 | 1.98 | 1.99 | 5.08 | 4.3 | 8.55 | 5.64 | | |
| HEMBA1006048 | 2.42 | 4.18 | 5.41 | 6.84 | 7.96 | 8.18 | * | + |
| HEMBA1006053 | 1.51 | 2.72 | 3.55 | 3.09 | 3.3 | 3.93 | | |
| HEMBA1006055 | 1.84 | 1.91 | 2.46 | 3.04 | 4.92 | 3.67 | * | + |
| HEMBA1006058 | 4.04 | 4.62 | 11.59 | 7.42 | 10.66 | 12.41 | | |
| HEMBA1006063 | 9.2 | 9.36 | 32.62 | 26.37 | 33.39 | 27.19 | | |
| HEMBA1006067 | 4.14 | 3.27 | 5.81 | 5.8 | 8.4 | 7.17 | | |
| HEMBA1006081 | 0.84 | 2.59 | 4.77 | 2.54 | 7.08 | 2.49 | | |
| HEMBA1006089 | 2.58 | 4.48 | 6.82 | 8.28 | 10.12 | 9.66 | * | + |
| HEMBA1006090 | 1.66 | 2.31 | 2.28 | 1.66 | 5.26 | 1.84 | | |
| HEMBA1006091 | 1.1 | 1.35 | 1.75 | 3.15 | 4.31 | 2.95 | * | + |
| HEMBA1006093 | 1.65 | 1.77 | 4.21 | 2.27 | 6.67 | 4.26 | | |
| HEMBA1006099 | 11.9 | 9.88 | 23.12 | 21.57 | 16.43 | 20.57 | | |
| HEMBA1006100 | 2.78 | 3.18 | 13.25 | 8.38 | 15.71 | 13.52 | | |
| HEMBA1006108 | 2.69 | 2.08 | 4.22 | 3.42 | 5.24 | 3.75 | | |
| HEMBA1006114 | 7.21 | 8.76 | 39.36 | 34.51 | 62.97 | 50.98 | | |
| HEMBA1006121 | 1.18 | 1.8 | 3.13 | 2.43 | 5.83 | 2.91 | | |
| HEMBA1006124 | 1.79 | 1.74 | 4.47 | 3.11 | 4.89 | 4.13 | | |
| HEMBA1006125 | 18.52 | 14.19 | 23.44 | 25.23 | 22.56 | 34.45 | | |
| HEMBA1006130 | 5.15 | 3.1 | 7.57 | 6.89 | 7.84 | 9.51 | | |
| HEMBA1006138 | 2.43 | 2.41 | 5.55 | 5.27 | 9.2 | 8.12 | | |
| HEMBA1006142 | 2.62 | 1.87 | 6.23 | 6.67 | 9.36 | 8.91 | * | + |
| HEMBA1006150 | 8.32 | 7.44 | 21.06 | 20.42 | 21.82 | 24.68 | | |
| HEMBA1006151 | 567.67 | 524.4 | 796.07 | 915.23 | 875.11 | 682.15 | | |
| HEMBA1006155 | 0.93 | 1.33 | 2.92 | 1.44 | 5.54 | 1.94 | | |
| HEMBA1006158 | 3.06 | 4.95 | 7.5 | 5.7 | 9.04 | 6.31 | | |
| HEMBA1006164 | 2.61 | 1.96 | 5.89 | 5.26 | 4.54 | 5.82 | | |
| HEMBA1006171 | 29.76 | 24.08 | 54.44 | 32.3 | 33.25 | 34 | | |
| HEMBA1006173 | 5.15 | 3.15 | 30.41 | 36.16 | 55.46 | 57.62 | * | + |
| HEMBA1006176 | 315.12 | 232.27 | 427.53 | 476.77 | 458.01 | 381.49 | | |
| HEMBA1006182 | 1.47 | 1.71 | 6.13 | 3.02 | 5.84 | 5.82 | | |
| HEMBA1006197 | 6.14 | 5.09 | 9.26 | 9.53 | 12.1 | 10.41 | | |
| HEMBA1006198 | 10.07 | 6.46 | 26.71 | 35.03 | 45.64 | 55.68 | * | + |
| HEMBA1006213 | 1.98 | 1.78 | 2.4 | 2.33 | 2.69 | 2.3 | | |
| HEMBA1006217 | 44.9 | 41.62 | 72.62 | 94.44 | 74.92 | 78.25 | | |
| HEMBA1006226 | 40.86 | 36.82 | 63.27 | 77.37 | 79.96 | 57.39 | | |
| HEMBA1006235 | 2.13 | 1.96 | 4.34 | 2.6 | 5.85 | 2.32 | | |
| HEMBA1006248 | 1.74 | 2.03 | 4.04 | 3.37 | 6.4 | 2.95 | | |
| HEMBA1006251 | 5.41 | 7.29 | 7.88 | 11.96 | 12.95 | 9.22 | * | + |
| HEMBA1006252 | 0.72 | 1.28 | 3.67 | 2.25 | 3.56 | 2.92 | | |
| HEMBA1006253 | 2.13 | 2.26 | 4.1 | 5.93 | 5.38 | 5.76 | * | + |
| HEMBA1006259 | 1.96 | 2.29 | 6.02 | 5.7 | 3.9 | 5.32 | | |
| HEMBA1006261 | 12.25 | 7.27 | 18.84 | 14.23 | 14.08 | 13.61 | | |
| HEMBA1006268 | 2.05 | 2.56 | 3.86 | 4.83 | 5.09 | 4.06 | * | + |
| HEMBA1006271 | 2.04 | 3.99 | 10.58 | 7.13 | 9.33 | 8.51 | | |
| HEMBA1006272 | 0.97 | 2.26 | 2.84 | 2.38 | 6.01 | 1.93 | | |
| HEMBA1006273 | 1.53 | 2.09 | 4.55 | 3.58 | 4.52 | 2.46 | | |
| HEMBA1006276 | 2.8 | 1.26 | 3.62 | 4.45 | 5.84 | 2.82 | | |
| HEMBA1006278 | 1.57 | 2.03 | 3.19 | 4.08 | 4.51 | 2.72 | | |
| HEMBA1006283 | 3.09 | 3 | 6.08 | 7.34 | 11.13 | 7.09 | | |
| HEMBA1006284 | 2.47 | 1.57 | 3.14 | 4.75 | 6.96 | 2.82 | | |
| HEMBA1006291 | 1.42 | 2.56 | 4.41 | 4.6 | 6.16 | 2.57 | | |
| HEMBA1006292 | 3.36 | 5.12 | 17.34 | 19.95 | 23.83 | 21.11 | * | + |
| HEMBA1006293 | 1.83 | 1.46 | 3.19 | 2.92 | 4.02 | 1.36 | | |
| HEMBA1006299 | 1.92 | 2.26 | 7.03 | 5.02 | 6.39 | 4.74 | | |
| HEMBA1006309 | 2.26 | 1.43 | 3.53 | 4.47 | 4.69 | 3.73 | * | + |
| HEMBA1006310 | 4.14 | 4.32 | 7.72 | 9.51 | 8.34 | 5.7 | | |
| HEMBA1006311 | 1.4 | 2.33 | 6.68 | 5.59 | 5.85 | 5.72 | | |
| HEMBA1006313 | 1.2 | 1.6 | 2.74 | 4.29 | 4.68 | 2.26 | | |
| HEMBA1006316 | 2.16 | 3.08 | 6.72 | 6.63 | 6.28 | 5.59 | | |
| HEMBA1006328 | 2.78 | 4.28 | 13.48 | 15.14 | 17 | 16.56 | | |
| HEMBA1006334 | 1.46 | 3.1 | 2.77 | 2.79 | 3.95 | 2.05 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and −, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1006335 | 10.42 | 13.98 | 21.66 | 20.81 | 18.03 | 16.77 | | |
| HEMBA1006344 | 2.86 | 3.55 | 6.9 | 7.18 | 6.88 | 5.75 | | |
| HEMBA1006347 | 2.04 | 1.83 | 4.2 | 2.94 | 2.76 | 1.68 | | |
| HEMBA1006349 | 2.47 | 2.79 | 6.73 | 3.62 | 5.65 | 3.5 | | |
| HEMBA1006352 | 1.65 | 1.65 | 3.27 | 2.63 | 5.64 | 1.32 | | |
| HEMBA1006357 | 4.99 | 4.26 | 8.6 | 8.36 | 7.8 | 7.74 | | |
| HEMBA1006358 | 1.67 | 2.57 | 4.95 | 4.7 | 5.11 | 5.63 | | |
| HEMBA1006359 | 1.56 | 2.17 | 4.02 | 3.67 | 5.48 | 3.3 | | |
| HEMBA1006360 | 2.53 | 2.12 | 5.1 | 9.73 | 10.02 | 8.61 | ** | + |
| HEMBA1006364 | 1.71 | 2.76 | 4.82 | 4.02 | 5.55 | 3.51 | | |
| HEMBA1006377 | 5.8 | 8.03 | 13.25 | 20.48 | 16.19 | 15.31 | * | + |
| HEMBA1006380 | 1.31 | 1.57 | 8.75 | 6.78 | 7.01 | 6.9 | | |
| HEMBA1006381 | 2.38 | 3.07 | 12.65 | 6.18 | 7.97 | 6.66 | | |
| HEMBA1006385 | 3.21 | 3.33 | 8.65 | 5.41 | 8.17 | 5.32 | | |
| HEMBA1006390 | 9.49 | 7.85 | 14.66 | 22.01 | 20.52 | 22.7 | ** | + |
| HEMBA1006391 | 6.58 | 6.85 | 6.73 | 12.83 | 10.12 | 13.15 | ** | + |
| HEMBA1006398 | 1.32 | 1.67 | 4.19 | 2.57 | 4.12 | 1.69 | | |
| HEMBA1006405 | 23.81 | 23.5 | 38.82 | 23.85 | 22.13 | 24.92 | | |
| HEMBA1006410 | 8.26 | 4.16 | 6.14 | 5.74 | 11.61 | 6.06 | | |
| HEMBA1006416 | 2.14 | 2.62 | 5.93 | 5.3 | 6.98 | 4.23 | | |
| HEMBA1006418 | 5.06 | 5.49 | 11.76 | 8.17 | 8.09 | 5.92 | | |
| HEMBA1006419 | 2.67 | 3.93 | 8 | 6.89 | 7.77 | 5.2 | | |
| HEMBA1006421 | 2.03 | 3.28 | 3.09 | 3.44 | 4.19 | 2.27 | | |
| HEMBA1006424 | 1.48 | 1.92 | 3.59 | 1.94 | 5.42 | 1.84 | | |
| HEMBA1006426 | 3.03 | 3.99 | 7.91 | 7.23 | 7.87 | 5.51 | | |
| HEMBA1006430 | 2.31 | 2.64 | 6.29 | 5.89 | 7.43 | 5.08 | | |
| HEMBA1006438 | 2.06 | 2.22 | 6.35 | 4.37 | 6.53 | 2.92 | | |
| HEMBA1006445 | 1.98 | 2.68 | 5.72 | 6.11 | 5.6 | 4.16 | | |
| HEMBA1006446 | 1.32 | 2.61 | 5.59 | 2 | 6.51 | 2.43 | | |
| HEMBA1006456 | 3.51 | 5.07 | 8.64 | 14.9 | 21.76 | 15.91 | * | + |
| HEMBA1006461 | 1.54 | 2.18 | 5.35 | 4.35 | 5.49 | 4.07 | | |
| HEMBA1006467 | 1.52 | 1.78 | 3.61 | 2.82 | 7.24 | 3.2 | | |
| HEMBA1006470 | 4.06 | 4.03 | 22.46 | 18.72 | 29.54 | 19.52 | | |
| HEMBA1006471 | 1.58 | 1.6 | 6.6 | 6.45 | 6.78 | 6.26 | | |
| HEMBA1006474 | 7.35 | 6.37 | 43.12 | 55.87 | 62.01 | 52.31 | * | + |
| HEMBA1006476 | 9.48 | 10.05 | 66.66 | 94.3 | 119.21 | 92.71 | * | + |
| HEMBA1006482 | 71.42 | 71.44 | 219.31 | 199.96 | 180.73 | 192.88 | | |
| HEMBA1006483 | 2.03 | 2.96 | 7.22 | 3.36 | 4.88 | 3.24 | | |
| HEMBA1006485 | 2.24 | 1.72 | 6.31 | 4.09 | 6.53 | 5.51 | | |
| HEMBA1006486 | 5.08 | 5.55 | 13.73 | 18.4 | 16 | 15.46 | * | + |
| HEMBA1006489 | 1.21 | 2.18 | 4.1 | 3.18 | 5.4 | 2.17 | | |
| HEMBA1006492 | 5.34 | 7.71 | 10.69 | 15.16 | 24.33 | 15.92 | * | + |
| HEMBA1006494 | 1.27 | 1.18 | 2.67 | 2.44 | 3.88 | 1.86 | | |
| HEMBA1006497 | 1.67 | 2.33 | 4.75 | 4.3 | 3.79 | 4.49 | | |
| HEMBA1006501 | 7.61 | 7.52 | 62.05 | 58.03 | 78.37 | 58.59 | | |
| HEMBA1006502 | 4.73 | 3.55 | 15.72 | 18.66 | 22.55 | 21.66 | * | + |
| HEMBA1006507 | 8.7 | 6.8 | 51 | 49.69 | 71.2 | 48.41 | | |
| HEMBA1006517 | 1.51 | 1.99 | 5.07 | 3.43 | 5.9 | 4.64 | | |
| HEMBA1006521 | 1.79 | 1.8 | 4 | 2.41 | 4.55 | 3.02 | | |
| HEMBA1006529 | 4.77 | 3.74 | 3.86 | 5.97 | 5.83 | 2.78 | | |
| HEMBA1006530 | 1.8 | 1.39 | 2.06 | 1.62 | 3.53 | 2.42 | | |
| HEMBA1006535 | 1.66 | 1.43 | 2.01 | 2.66 | 2.81 | 2.43 | ** | + |
| HEMBA1006536 | 0.59 | 2.22 | 3.96 | 3.04 | 3.23 | 2.33 | | |
| HEMBA1006540 | 1.61 | 1.68 | 3.33 | 3.05 | 4.1 | 3.56 | | |
| HEMBA1006544 | 1.39 | 1.63 | 8 | 3.54 | 5.85 | 4.35 | | |
| HEMBA1006546 | 2.06 | 2.56 | 6.98 | 4.25 | 5.77 | 4.51 | | |
| HEMBA1006549 | 1.74 | 2.13 | 5.93 | 4.57 | 4.63 | 4.61 | | |
| HEMBA1006559 | 2.55 | 1.45 | 4.63 | 2.99 | 5.76 | 3.32 | | |
| HEMBA1006562 | 0.74 | 1.32 | 4.07 | 2.39 | 5.24 | 2.72 | | |
| HEMBA1006566 | 0.67 | 1.28 | 0.97 | 1.34 | 1.69 | 0.99 | | |
| HEMBA1006569 | 2.33 | 1.36 | 3.97 | 3.25 | 3.89 | 4.02 | | |
| HEMBA1006572 | 1.02 | 2.38 | 2.94 | 2.68 | 3.92 | 2.01 | | |
| HEMBA1006579 | 20.44 | 16.82 | 51.93 | 59.14 | 66.28 | 72.54 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1006583 | 3.17 | 2.85 | 5.59 | 5.83 | 5.94 | 6.45 | | |
| HEMBA1006595 | 1.82 | 1.63 | 4.29 | 2.83 | 5.22 | 3.68 | | |
| HEMBA1006597 | 1.65 | 2.1 | 5.34 | 3.81 | 6.75 | 3.77 | | |
| HEMBA1006606 | 1.75 | 2.31 | 4.96 | 3.72 | 5.71 | 2.8 | | |
| HEMBA1006612 | 2.63 | 3.54 | 7.11 | 7.32 | 5.31 | 7.07 | | |
| HEMBA1006617 | 1.93 | 2.58 | 6.24 | 4.62 | 4.6 | 5.41 | | |
| HEMBA1006624 | 6.37 | 8.61 | 16.93 | 12.84 | 15.78 | 10.91 | | |
| HEMBA1006631 | 3.24 | 3.13 | 8.01 | 8.11 | 11.54 | 6.97 | | |
| HEMBA1006635 | 1.7 | 2.57 | 5.7 | 4.27 | 6.27 | 3.8 | | |
| HEMBA1006639 | 1.12 | 1.98 | 4.52 | 4.14 | 5.3 | 3.06 | | |
| HEMBA1006643 | 1.88 | 1.23 | 1.85 | 2.12 | 3.81 | 2.17 | | |
| HEMBA1006648 | 7.69 | 6.84 | 16.92 | 17.63 | 23.57 | 23.73 | * | + |
| HEMBA1006652 | 5.96 | 7.86 | 16.11 | 16.41 | 16.83 | 17.34 | | |
| HEMBA1006653 | 2.21 | 3.66 | 7.23 | 6.92 | 5.18 | 5.17 | | |
| HEMBA1006658 | 5.04 | 6.58 | 12.68 | 14.07 | 13.59 | 12.01 | | |
| HEMBA1006659 | 6.8 | 10.14 | 48.92 | 66.47 | 78.17 | 67.44 | * | + |
| HEMBA1006665 | 1.44 | 0.89 | 3.32 | 2.77 | 2.91 | 1.82 | | |
| HEMBA1006666 | 1.83 | 1.25 | 3.23 | 3.24 | 4.14 | 2.45 | | |
| HEMBA1006671 | 8.69 | 6.74 | 11.66 | 17.25 | 16.13 | 15.21 | ** | + |
| HEMBA1006674 | 1.64 | 1.99 | 7.42 | 6.71 | 9.73 | 7.34 | | |
| HEMBA1006676 | 1.46 | 2.36 | 5.19 | 4.28 | 6.75 | 3.19 | | |
| HEMBA1006682 | 2.17 | 1.64 | 3.43 | 2.2 | 4.98 | 1.88 | | |
| HEMBA1006688 | 1.48 | 2.46 | 4.74 | 3.31 | 4.38 | 3.54 | | |
| HEMBA1006695 | 1.58 | 2.41 | 4.85 | 3.54 | 5.79 | 2.46 | | |
| HEMBA1006696 | 2.84 | 3.93 | 6.29 | 5.95 | 6.74 | 5.82 | | |
| HEMBA1006702 | 3.31 | 1.83 | 13.28 | 4.13 | 5.58 | 4.87 | | |
| HEMBA1006707 | 2.89 | 2.62 | 5.9 | 5.04 | 7.54 | 5.5 | | |
| HEMBA1006708 | 2.21 | 1.52 | 5.71 | 4.42 | 4.57 | 2.63 | | |
| HEMBA1006709 | 1.64 | 1.97 | 4.6 | 4.29 | 5 | 4.74 | | |
| HEMBA1006717 | 1.58 | 2.28 | 3.58 | 2.5 | 4.93 | 2.28 | | |
| HEMBA1006724 | 2.68 | 3.42 | 4.55 | 4.45 | 4.5 | 5.47 | | |
| HEMBA1006731 | 1.83 | 2.95 | 3.95 | 4.12 | 5.51 | 3.1 | | |
| HEMBA1006737 | 1.82 | 3.5 | 6.59 | 3.89 | 5.09 | 4.45 | | |
| HEMBA1006742 | 1.78 | 2.44 | 4.16 | 3.32 | 4.14 | 3.61 | | |
| HEMBA1006743 | 4 | 4.02 | 11.48 | 14.16 | 17.25 | 11.88 | | |
| HEMBA1006744 | 1.84 | 1.79 | 7.74 | 6.6 | 8.29 | 5.72 | | |
| HEMBA1006749 | 1.14 | 1.27 | 3.72 | 1.88 | 3.8 | 1.71 | | |
| HEMBA1006752 | 16.53 | 16.28 | 26.81 | 35.31 | 18.85 | 33.99 | | |
| HEMBA1006754 | 1.44 | 2.6 | 3.63 | 5.55 | 4.33 | 2.49 | | |
| HEMBA1006758 | 1.38 | 2.83 | 4.25 | 6.89 | 4.68 | 4.02 | | |
| HEMBA1006767 | 3 | 4.14 | 7.88 | 6.81 | 7.89 | 5.51 | | |
| HEMBA1006770 | 5.05 | 2.61 | 7.12 | 7.89 | 8.1 | 5.05 | | |
| HEMBA1006779 | 4.44 | 4.1 | 10.99 | 9.57 | 10.28 | 8.42 | | |
| HEMBA1006780 | 3.28 | 3.19 | 10.27 | 7.6 | 8.33 | 8.38 | | |
| HEMBA1006789 | 2.83 | 1.87 | 11.34 | 4.55 | 5.42 | 5.51 | | |
| HEMBA1006795 | 2.13 | 2.45 | 7.58 | 4.56 | 7.87 | 3.29 | | |
| HEMBA1006796 | 4.31 | 3.15 | 5.37 | 5.85 | 7.06 | 4.72 | | |
| HEMBA1006805 | 2.72 | 2.73 | 5.9 | 12.77 | 17.38 | 12.96 | ** | + |
| HEMBA1006807 | 30.32 | 28.07 | 75.38 | 54.22 | 54.72 | 67.82 | | |
| HEMBA1006813 | 0.93 | 1.73 | 2.81 | 1.93 | 4.17 | 0.97 | | |
| HEMBA1006819 | 3.73 | 4.53 | 8.5 | 7.02 | 8.09 | 5.29 | | |
| HEMBA1006821 | 1.56 | 2.37 | 6.09 | 5.05 | 4.24 | 4.36 | | |
| HEMBA1006824 | 2.13 | 3.13 | 7.39 | 5.69 | 6.04 | 5.75 | | |
| HEMBA1006832 | 19.84 | 18.63 | 56.97 | 59.26 | 61.56 | 53.28 | | |
| HEMBA1006834 | 13.23 | 12.47 | 20.38 | 29.88 | 28.37 | 21.62 | * | + |
| HEMBA1006835 | 1.11 | 1.49 | 3.88 | 5.08 | 7.25 | 4.6 | * | + |
| HEMBA1006843 | 19.27 | 17.89 | 35.47 | 55.34 | 39.67 | 68.17 | * | + |
| HEMBA1006849 | 5.64 | 4.37 | 11.23 | 10.07 | 11.23 | 10.83 | | |
| HEMBA1006850 | 31.45 | 33.76 | 60.24 | 46.25 | 3.25 | 45.59 | | |
| HEMBA1006861 | 12.19 | 11.3 | 24.61 | 22.49 | 16.43 | 17.99 | | |
| HEMBA1006865 | 5.42 | 8.35 | 31 | 33.77 | 33.36 | 34.49 | | |
| HEMBA1006867 | 4.32 | 5.03 | 6.41 | 6.27 | 7.76 | 6.15 | | |
| HEMBA1006873 | 3.14 | 3.59 | 8.87 | 6.5 | 9.26 | 7.75 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
| --- | --- | --- | --- | --- | --- | --- | --- | --- |
| | exp. 1 | exp. 2 | exp. 3 | exp. 1 | exp. 2 | exp. 3 | | |
| HEMBA1006877 | 2.52 | 4.03 | 5.87 | 4.03 | 6.26 | 3.68 | | |
| HEMBA1006878 | 2.52 | 2.36 | 6.79 | 3.82 | 7.86 | 3.51 | | |
| HEMBA1006879 | 6.19 | 5.68 | 8.83 | 11.06 | 15.86 | 17.33 | * | + |
| HEMBA1006884 | 10.11 | 3.17 | 6.59 | 6.15 | 8.42 | 8.78 | | |
| HEMBA1006885 | 7.02 | 6.82 | 14.16 | 20.86 | 19.11 | 21.73 | * | + |
| HEMBA1006886 | 20.38 | 17.25 | 26.55 | 29.45 | 29.15 | 40.93 | | |
| HEMBA1006889 | 2.61 | 4.02 | 4.85 | 4.48 | 5.99 | 6.09 | | |
| HEMBA1006896 | 19.11 | 24.76 | 31.7 | 33.67 | 39.11 | 40.41 | * | + |
| HEMBA1006900 | 6.19 | 5.93 | 20.76 | 16.81 | 23.73 | 18.45 | | |
| HEMBA1006902 | 1.43 | 2.45 | 3.86 | 4.03 | 6 | 3.98 | | |
| HEMBA1006912 | 1.24 | 1.74 | 6.86 | 4.12 | 5.8 | 5.3 | | |
| HEMBA1006914 | 6.64 | 6.11 | 18.27 | 14.81 | 18.62 | 15.03 | | |
| HEMBA1006916 | 3.11 | 2.71 | 5.78 | 10.29 | 7.48 | 9.36 | * | + |
| HEMBA1006921 | 3.03 | 3.5 | 9.63 | 9.77 | 11.26 | 13.59 | | |
| HEMBA1006926 | 2.65 | 2.61 | 5.68 | 5.01 | 6.53 | 6.98 | | |
| HEMBA1006927 | 3.06 | 2.2 | 5.17 | 3.57 | 5.26 | 5.89 | | |
| HEMBA1006929 | 2.94 | 2.69 | 4.02 | 4.31 | 6.36 | 5.25 | * | + |
| HEMBA1006936 | 3.72 | 3.21 | 6.5.14 | 67 | 6.25 | 5.45 | | |
| HEMBA1006938 | 1.21 | 2.11 | 6.57 | 2.37 | 3.76 | 3.44 | | |
| HEMBA1006941 | 9.52 | 8.15 | 12 | 19.26 | 28.62 | 23.74 | ** | + |
| HEMBA1006942 | 5.2 | 2.63 | 6.65 | 10.7 | 10.65 | 11.4 | ** | + |
| HEMBA1006945 | 10.07 | 5.91 | 16.81 | 23.73 | 17.09 | 19.91 | | |
| HEMBA1006949 | 1.6 | 1.43 | 3.88 | 2.48 | 5.34 | 2.81 | | |
| HEMBA1006952 | 1.16 | 1.66 | 2.98 | 3.02 | 5.04 | 2.22 | | |
| HEMBA1006960 | 2.53 | 2.78 | 7.66 | 5.9 | 8.28 | 8.68 | | |
| HEMBA1006973 | 1.74 | 2.27 | 5.91 | 4.7 | 7.84 | 5.54 | | |
| HEMBA1006974 | 2.49 | 3.44 | 6.76 | 6.09 | 11.01 | 8.14 | | |
| HEMBA1006976 | 1.39 | 1.5 | 4.12 | 3.18 | 4.96 | 4.36 | | |
| HEMBA1006989 | 1.85 | 1.66 | 6.51 | 2.05 | 3.01 | 1.81 | | |
| HEMBA1006993 | 2.71 | 2.39 | 6.49 | 6.11 | 7.69 | 8.79 | | |
| HEMBA1006996 | 0.74 | 1.15 | 2.98 | 2.52 | 3.13 | 3.58 | | |
| HEMBA1007001 | 1.91 | 2.47 | 5.12 | 3.98 | 6.37 | 4.76 | | |
| HEMBA1007002 | 7.02 | 4.12 | 31.4 | 26.92 | 38.45 | 42.11 | | |
| HEMBA1007013 | 1.02 | 0.94 | 3.04 | 1.44 | 4.39 | 2.27 | | |
| HEMBA1007016 | 2.02 | 1.43 | 5.06 | 3.27 | 5.97 | 5.28 | | |
| HEMBA1007017 | 0.69 | 1.24 | 2.55 | 1.42 | 3.33 | 1.83 | | |
| HEMBA1007018 | 4.02 | 4.52 | 6.54 | 7.65 | 6.1 | 7.07 | | |
| HEMBA1007044 | 8.13 | 8.41 | 17.4 | 15.48 | 11.97 | 12.27 | | |
| HEMBA1007045 | 1.64 | 2.15 | 4.42 | 2.61 | 5.08 | 3.47 | | |
| HEMBA1007051 | 2.26 | 2.56 | 4.71 | 3.42 | 4.42 | 3.28 | | |
| HEMBA1007052 | 2.23 | 1.25 | 3.47 | 2.37 | 4.62 | 1.83 | | |
| HEMBA1007053 | 1.83 | 3.14 | 4.03 | 2.64 | 4 | 2.5 | | |
| HEMBA1007057 | 0.92 | 2.56 | 3.21 | 3.52 | 4.03 | 3.41 | | |
| HEMBA1007062 | 0.91 | 0.82 | 2.73 | 2.34 | 2.87 | 1.82 | | |
| HEMBA1007063 | 3.87 | 2.7 | 8.87 | 8.56 | 8.02 | 7.58 | | |
| HEMBA1007066 | 1.72 | 2.03 | 3.62 | 2.2 | 4.39 | 2.71 | | |
| HEMBA1007069 | 1.36 | 2.29 | 3.87 | 3.84 | 3.48 | 3.66 | | |
| HEMBA1007073 | 1.93 | 2.16 | 6.12 | 2.96 | 9.57 | 3.6 | | |
| HEMBA1007076 | 1.48 | 2.6 | 5.56 | 4.66 | 7.6 | 3.4 | | |
| HEMBA1007078 | 6.5 | 6.83 | 18.61 | 26.96 | 27.47 | 23.78 | * | + |
| HEMBA1007080 | 7.6 | 9.46 | 38.27 | 61.02 | 68.15 | 51.34 | * | + |
| HEMBA1007084 | 1.28 | 1.42 | 4.76 | 3.68 | 6.27 | 4.76 | | |
| HEMBA1007085 | 3.28 | 2.89 | 8.21 | 5.76 | 7.21 | 5.42 | | |
| HEMBA1007087 | 2.6 | 2.88 | 6.31 | 3.96 | 6.92 | 5.63 | | |
| HEMBA1007089 | 26.17 | 28.1 | 43.8 | 46.11 | 34.41 | 29.42 | | |
| HEMBA1007095 | 75.81 | 62.79 | 111.43 | 134.53 | 48.47 | 121.4 | | |
| HEMBA1007101 | 2.78 | 3.27 | 8 | 26.73 | 21.52 | 19.57 | ** | + |
| HEMBA1007104 | 1.87 | 1.92 | 3.52 | 2.46 | 4.53 | 2.57 | | |
| HEMBA1007106 | 4.77 | 4.8 | 9.03 | 16.42 | 12.5 | 9.49 | | |
| HEMBA1007112 | 3.01 | 3.07 | 5.16 | 6.39 | 6 | 4.77 | | |
| HEMBA1007113 | 1.53 | 2.29 | 9.04 | 6.03 | 6.1 | 5.97 | | |
| HEMBA1007121 | 13.76 | 14 | 92.08 | 116.14 | 111.53 | 129.12 | * | + |
| HEMBA1007129 | 1.54 | 2.44 | 2.87 | 2.66 | 4.37 | 1.89 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and –, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBA1007147 | 1.68 | 2.88 | 4.4 | 3.96 | 4.76 | 4.06 | | |
| HEMBA1007149 | 5.3 | 7.24 | 8.38 | 10.48 | 6.82 | 9.73 | | |
| HEMBA1007151 | 0.85 | 1.87 | 3.38 | 3.32 | 3.88 | 2.54 | | |
| HEMBA1007172 | 1.26 | 1.91 | 4.13 | 2.96 | 4.81 | 3.51 | | |
| HEMBA1007174 | 1.4 | 1.43 | 2.75 | 3.96 | 3.65 | 2.5 | | |
| HEMBA1007176 | 2.58 | 3.95 | 11.7 | 6.7 | 6.78 | 4.52 | | |
| HEMBA1007178 | 4.77 | 4.71 | 9.32 | 10.94 | 13.03 | 8.12 | | |
| HEMBA1007185 | 9.38 | 10.32 | 9.59 | 19.5 | 7.83 | 15.16 | | |
| HEMBA1007186 | 1.71 | 2.76 | 4.49 | 4.95 | 5.47 | 3.86 | | |
| HEMBA1007194 | 4.81 | 3.43 | 5.58 | 7.83 | 9.34 | 8.67 | ** | + |
| HEMBA1007200 | 1.18 | 2.33 | 2.9 | 3.25 | 4.6 | 1.66 | | |
| HEMBA1007203 | 1.54 | 3.5 | 5.38 | 6.03 | 6.87 | 5.05 | | |
| HEMBA1007206 | 1.92 | 2.46 | 5.72 | 7.07 | 7.91 | 5.94 | | |
| HEMBA1007224 | 5.4 | 6.5 | 9.06 | 9.23 | 5.85 | 8.06 | | |
| HEMBA1007226 | 7.19 | 8.07 | 40.61 | 59.31 | 70.51 | 62.19 | * | + |
| HEMBA1007240 | 10 | 10.96 | 13.45 | 15.35 | 7.71 | 11 | | |
| HEMBA1007241 | 3.59 | 2.88 | 4.56 | 4.61 | 6.81 | 3.63 | | |
| HEMBA1007242 | 2.52 | 2.86 | 5.01 | 6.29 | 6.87 | 4.23 | | |
| HEMBA1007243 | 10.23 | 10.91 | 69.57 | 70.17 | 95.69 | 82.75 | | |
| HEMBA1007251 | 1.32 | 1.8 | 4.14 | 3.02 | 3.67 | 2.01 | | |
| HEMBA1007256 | 1.39 | 1.91 | 3.36 | 3.93 | 5.74 | 3.44 | | |
| HEMBA1007267 | 3.19 | 3.71 | 8.75 | 8.73 | 9.18 | 8.1 | | |
| HEMBA1007273 | 0.98 | 2.66 | 3.84 | 3.56 | 5.82 | 2.25 | | |
| HEMBA1007279 | 1.55 | 2.25 | 3.52 | 2.95 | 4.35 | 2.02 | | |
| HEMBA1007281 | 1.73 | 1.54 | 2.12 | 2.95 | 4.43 | 1.01 | | |
| HEMBA1007283 | 2.45 | 3.15 | 6.78 | 6.37 | 6.58 | 5.96 | | |
| HEMBA1007288 | 2.12 | 2.77 | 5.54 | 4.35 | 6.74 | 5.48 | | |
| HEMBA1007291 | 1.59 | 1.8 | 4.29 | 2.14 | 4.4 | 0.98 | | |
| HEMBA1007299 | 20.39 | 22.25 | 39.67 | 40.95 | 47.97 | 40.26 | | |
| HEMBA1007300 | 2.08 | 2.75 | 3.59 | 4.17 | 4.45 | 4.07 | * | + |
| HEMBA1007301 | 1.97 | 2.82 | 3.15 | 3.73 | 3.99 | 3.44 | * | + |
| HEMBA1007319 | 2.84 | 3.61 | 6.73 | 5.21 | 6.12 | 3.32 | | |
| HEMBA1007320 | 1.29 | 1.22 | 3.12 | 4.19 | 3.45 | 2.42 | | |
| HEMBA1007322 | 19.97 | 17.81 | 27.74 | 45.24 | 39.42 | 37.31 | ** | + |
| HEMBA1007323 | 4.54 | 6.69 | 11.47 | 6 | 6.36 | 6.21 | | |
| HEMBA1007326 | 4.58 | 3.85 | 13.34 | 8.29 | 8.07 | 9 | | |
| HEMBA1007327 | 3.37 | 3.98 | 8.91 | 6.14 | 9.31 | 8.98 | | |
| HEMBA1007332 | 3.12 | 3.47 | 5.42 | 5.27 | 7.56 | 5.33 | | |
| HEMBA1007341 | 1.4 | 2.51 | 3.24 | 2.93 | 3.38 | 3.36 | | |
| HEMBA1007342 | 1.06 | 2.05 | 3.02 | 1.52 | 3.23 | 1.98 | | |
| HEMBA1007347 | 3.39 | 3.24 | 6.34 | 4.55 | 7.34 | 6.32 | | |
| HEMBA1007353 | 2.43 | 2.22 | 4.99 | 2.68 | 6.9 | 3.01 | | |
| HEMBB1000005 | 1.57 | 2.54 | 5.35 | 2.68 | 4.65 | 3.64 | | |
| HEMBB1000008 | 2.19 | 2.53 | 5.99 | 3.51 | 6.31 | 3.71 | | |
| HEMBB1000018 | 2.21 | 2.16 | 7.13 | 9.9 | 9.79 | 7.24 | | |
| HEMBB1000024 | 3.71 | 2.15 | 5.4 | 5.13 | 5.77 | 6.39 | | |
| HEMBB1000025 | 2.11 | 2.09 | 3.55 | 1.68 | 5.13 | 2.62 | | |
| HEMBB1000030 | 3.12 | 3.53 | 6.58 | 6.62 | 7.77 | 6 | | |
| HEMBB1000036 | 5.3 | 4.76 | 5.04 | 6.95 | 8.19 | 5.93 | * | + |
| HEMBB1000037 | 4.43 | 3.64 | 4.73 | 4.63 | 8.38 | 5.32 | | |
| HEMBB1000039 | 1.17 | 0.96 | 3.98 | 2.61 | 4.11 | 2.95 | | |
| HEMBB1000044 | 1.22 | 2.35 | 4.26 | 5.28 | 5.58 | 5.36 | * | + |
| HEMBB1000048 | 3.2 | 1.7 | 3.48 | 3.99 | 5.4 | 3.96 | | |
| HEMBB1000050 | 2.32 | 1.55 | 3.33 | 2.97 | 3.98 | 2.85 | | |
| HEMBB1000054 | 2.03 | 2.08 | 7.07 | 4.49 | 5.09 | 3.98 | | |
| HEMBB1000055 | 42.59 | 36.75 | 92.41 | 100.33 | 86.52 | 89.35 | | |
| HEMBB1000059 | 2.5 | 2.65 | 11.34 | 10.96 | 11.52 | 14.73 | | |
| HEMBB1000072 | 6.84 | 7.77 | 58.85 | 73.22 | 97.61 | 76.22 | * | + |
| HEMBB1000081 | 2.85 | 3.56 | 10.79 | 5.69 | 6.19 | 7.23 | | |
| HEMBB1000083 | 1.13 | 1.95 | 5.38 | 4.88 | 5.89 | 5.33 | | |
| HEMBB1000089 | 1.14 | 2.53 | 4.54 | 6.03 | 6.73 | 5.43 | * | + |
| HEMBB1000094 | 4.12 | 4.3 | 8.4 | 4.24 | 5.04 | 6.62 | | |
| HEMBB1000097 | 2.48 | 1.71 | 7.91 | 4.75 | 4.55 | 4.3 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1000099 | 2.69 | 2.07 | 6.27 | 5.18 | 6.75 | 5.64 | | |
| HEMBB1000103 | 7.19 | 5.28 | 18.55 | 13.99 | 19.26 | 16.16 | | |
| HEMBB1000106 | 3.91 | 3.75 | 8.15 | 4.24 | 6.4 | 5.9 | | |
| HEMBB1000113 | 1.25 | 1.54 | 3.33 | 1.39 | 4.14 | 2.31 | | |
| HEMBB1000119 | 2.19 | 2.17 | 5.66 | 3.34 | 6.12 | 4.05 | | |
| HEMBB1000133 | 21.01 | 22.21 | 30.57 | 43.5 | 66.13 | 60.69 | * | + |
| HEMBB1000134 | 4.92 | 2.95 | 8.69 | 13.39 | 9.79 | 9.8 | | |
| HEMBB1000136 | 7.14 | 8.81 | 29.63 | 23.11 | 26.28 | 28.23 | | |
| HEMBB1000141 | 1.98 | 2.85 | 6.18 | 4.95 | 5.75 | 6.16 | | |
| HEMBB1000144 | 2.05 | 2.59 | 4.85 | 3.09 | 5.36 | 1.38 | | |
| HEMBB1000147 | 3.77 | 2.08 | 4.51 | 4.55 | 7.39 | 3.07 | | |
| HEMBB1000152 | 0.79 | 1.45 | 3.42 | 5.13 | 5.15 | 3.45 | | |
| HEMBB1000154 | 0.98 | 1.11 | 3.43 | 2.59 | 2.89 | 2.47 | | |
| HEMBB1000155 | 0.88 | 0.54 | 3.15 | 3.33 | 4.15 | 1.92 | | |
| HEMBB1000173 | 3.35 | 3.72 | 12.14 | 10.1 | 10.89 | 7.51 | | |
| HEMBB1000175 | 1.85 | 1.32 | 3.39 | 6.06 | 4.09 | 3.86 | | |
| HEMBB1000176 | 1.48 | 4.03 | 6.12 | 3.43 | 9.75 | 5.03 | | |
| HEMBB1000198 | 0.88 | 1.72 | 3.64 | 2.6 | 3.59 | 3.22 | | |
| HEMBB1000208 | 1.12 | 1.52 | 3.04 | 1.74 | 3.23 | 2.69 | | |
| HEMBB1000209 | 1.62 | 1.54 | 3.76 | 3.32 | 3.94 | 3.28 | | |
| HEMBB1000212 | 1.88 | 1.03 | 3.26 | 4.37 | 3.93 | 1.98 | | |
| HEMBB1000215 | 1.61 | 2.13 | 3.8 | 4.67 | 5.49 | 5.32 | * | + |
| HEMBB1000217 | 5.67 | 4.97 | 11.23 | 15.21 | 18.81 | 11.78 | * | + |
| HEMBB1000218 | 2.13 | 2.28 | 11.05 | 7.47 | 10.07 | 7.05 | | |
| HEMBB1000226 | 2.63 | 3.26 | 6.02 | 4.0.25 | 86 | 3.41 | | |
| HEMBB1000230 | 1.39 | 1.83 | 3.73 | 1.95 | 4.31 | 2.58 | | |
| HEMBB1000240 | 6.04 | 8.26 | 10.01 | 3.97 | 2.7 | 1.75 | * | − |
| HEMBB1000244 | 1.39 | 1.64 | 3.51 | 2.51 | 2.63 | 1.68 | | |
| HEMBB1000250 | 1.17 | 0.99 | 1.12 | 1.9.41 | 25 | 1.12 | | |
| HEMBB1000258 | 1.71 | 1.94 | 5.8 | 4.38 | 5.63 | 3.27 | | |
| HEMBB1000264 | 2.49 | 3.12 | 11.01 | 8.64 | 8.34 | 8.1 | | |
| HEMBB1000266 | 2.81 | 2.65 | 5.52 | 3.38 | 5.95 | 3.71 | | |
| HEMBB1000272 | 4.76 | 4.16 | 6.06 | 8.38 | 6.88 | 7.45 | * | + |
| HEMBB1000274 | 1.51 | 1.15 | 3.17 | 2.5.43 | 18 | 1.88 | | |
| HEMBB1000276 | 1.12 | 1.84 | 4.72 | 3.1 | 4.01 | 2.43 | | |
| HEMBB1000284 | 0.94 | 1.81 | 2.89 | 2.83 | 3.11 | 1.65 | | |
| HEMBB1000307 | 1.52 | 1.7 | 4.78 | 2.8 | 5.31 | 3.27 | | |
| HEMBB1000309 | 1.43 | 2.73 | 3.07 | 3.09 | 3.56 | 2.19 | | |
| HEMBB1000312 | 1.99 | 1.38 | 5.18 | 7.03 | 7.2 | 4.35 | | |
| HEMBB1000317 | 0.17 | 1.62 | 3.32 | 2.6 | 4.73 | 2.14 | | |
| HEMBB1000318 | 1.11 | 2.69 | 3.85 | 2.28 | 4.46 | 1.68 | | |
| HEMBB1000332 | 3.12 | 3.84 | 4.37 | 3.75 | 3.95 | 2.72 | | |
| HEMBB1000335 | 0.77 | 2.35 | 4.66 | 6.16 | 4.66 | 3.44 | | |
| HEMBB1000336 | 0.99 | 1.11 | 3.59 | 2.09 | 3.52 | 2.29 | | |
| HEMBB1000337 | 4.3 | 5.06 | 20.22 | 22.86 | 24.84 | 22.82 | | |
| HEMBB1000338 | 2.11 | 1.92 | 5.86 | 7.13 | 8.92 | 4.71 | | |
| HEMBB1000339 | 1.66 | 1.76 | 5.84 | 3.75 | 4.99 | 3.84 | | |
| HEMBB1000341 | 1.4 | 1.91 | 3.68 | 3.06 | 4.77 | 2.83 | | |
| HEMBB1000343 | 2.51 | 3.15 | 6.96 | 7.24 | 8.68 | 7.46 | | |
| HEMBB1000354 | 3.26 | 3.5 | 10.36 | 7 | 8.93 | 8.07 | | |
| HEMBB1000358 | 1.09 | 2.11 | 3.82 | 3.43 | 2.83 | 1.93 | | |
| HEMBB1000369 | 1.93 | 2.33 | 3.87 | 5.96 | 6.54 | 2.89 | | |
| HEMBB1000373 | 1.77 | 2.73 | 3.91 | 2.26 | 6.2 | 2.94 | | |
| HEMBB1000374 | 3.27 | 4.06 | 9.34 | 9.58 | 13.36 | 6.95 | | |
| HEMBB1000376 | 2.71 | 3.92 | 12.28 | 10.03 | 6.99 | 7.71 | | |
| HEMBB1000383 | 60.87 | 62.14 | 104.01 | 69.28 | 57.52 | 83.25 | | |
| HEMBB1000391 | 1.8 | 2.66 | 4.57 | 4.89 | 6.18 | 4.29 | | |
| HEMBB1000399 | 2.51 | 3.79 | 3.69 | 3.93 | 5.72 | 3.71 | | |
| HEMBB1000402 | 1.61 | 2.06 | 3.33 | 2.67 | 5.3 | 1.72 | | |
| HEMBB1000404 | 1.34 | 1.15 | 5.18 | 2.56 | 5.29 | 1.81 | | |
| HEMBB1000407 | 2.2 | 3.36 | 6.76 | 5.57 | 5.75 | 4.66 | | |
| HEMBB1000420 | 1.93 | 1.46 | 3.86 | 4.33 | 4.76 | 4.54 | * | + |
| HEMBB1000430 | 38.77 | 36.24 | 61.06 | 51.76 | 34.69 | 50.02 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1000434 | 3.05 | 4.73 | 9.02 | 6.54 | 6.59 | 6.63 | | |
| HEMBB1000438 | 1.13 | 1.83 | 4.16 | 2.23 | 4 | 1.39 | | |
| HEMBB1000441 | 2.26 | 3 | 7.35 | 5.44 | 8 | 4.78 | | |
| HEMBB1000447 | 29.84 | 32.01 | 39.91 | 35.88 | 44.02 | 33.55 | | |
| HEMBB1000449 | 1.3 | 1.31 | 3.72 | 1.51 | 3.04 | 1.54 | | |
| HEMBB1000453 | 8.61 | 8.04 | 13.39 | 14.23 | 18.78 | 13.74 | | |
| HEMBB1000455 | 1.29 | 1.97 | 3.19 | 3.13 | 5.46 | 3.54 | | |
| HEMBB1000472 | 2.3 | 2.28 | 4.22 | 4.07 | 4.35 | 3.52 | | |
| HEMBB1000480 | 1.9 | 3.59 | 7.03 | 5.71 | 6.63 | 5.87 | | |
| HEMBB1000486 | 2.15 | 2.98 | 6.93 | 4.82 | 7.86 | 5.9 | | |
| HEMBB1000487 | 1.21 | 1.79 | 4.48 | 2.66 | 4.8 | 2.57 | | |
| HEMBB1000490 | 3.67 | 4.13 | 12.61 | 7.92 | 8.7 | 6.55 | | |
| HEMBB1000491 | 1.36 | 2.91 | 5 | 3.83 | 4.78 | 4.42 | | |
| HEMBB1000492 | 3.02 | 4.04 | 6.84 | 5.63 | 6.94 | 5.34 | | |
| HEMBB1000493 | 1.57 | 1.71 | 3.26 | 2.41 | 5.38 | 3.27 | | |
| HEMBB1000510 | 1.32 | 1.71 | 4.94 | 4.4 | 5.61 | 4.21 | | |
| HEMBB1000516 | 5.64 | 7.71 | 36.22 | 16.62 | 18.58 | 17.09 | | |
| HEMBB1000518 | 0.88 | 1.22 | 2.63 | 2.21 | 4.27 | 1.73 | | |
| HEMBB1000523 | 1.32 | 2.78 | 7.41 | 3.33 | 7.74 | 4.1 | | |
| HEMBB1000530 | 2.83 | 2.51 | 9.72 | 6.06 | 7.81 | 6.64 | | |
| HEMBB1000542 | 3.08 | 4.55 | 9.39 | 8.48 | 14.07 | 9.82 | | |
| HEMBB1000550 | 4.84 | 2.87 | 4.77 | 10.48 | 5.74 | 5.33 | | |
| HEMBB1000554 | 2.14 | 2.26 | 8.65 | 6.43 | 11.59 | 7.19 | | |
| HEMBB1000556 | 2.64 | 2.68 | 4.48 | 3.1 | 4.67 | 4.6 | | |
| HEMBB1000564 | 1.81 | 1.4 | 5.87 | 4.26 | 5.34 | 6.18 | | |
| HEMBB1000567 | 1.39 | 1.71 | 3.7 | 2.1 | 3.87 | 3.3 | | |
| HEMBB1000569 | 3.78 | 2.72 | 8.76 | 4.88 | 7.13 | 5.65 | | |
| HEMBB1000573 | 3.48 | 3.44 | 11.31 | 7.33 | 9.55 | 7.56 | | |
| HEMBB1000575 | 12.42 | 2.71 | 0.57 | 7.16 | 8.38 | 12.35 | | |
| HEMBB1000579 | 2.12 | 3.75 | 4.84 | 3.01 | 8.61 | 4.04 | | |
| HEMBB1000585 | 0.83 | 1.19 | 3.19 | 2 | 4.1 | 3.35 | | |
| HEMBB1000586 | 2.18 | 1.41 | 4.28 | 4.07 | 4.23 | 4.11 | | |
| HEMBB1000589 | 2.98 | 1.58 | 3.62 | 3.38 | 3.75 | 3.69 | | |
| HEMBB1000591 | 2.62 | 2.15 | 3.96 | 4.44 | 5.26 | 4.64 | * | + |
| HEMBB1000592 | 2.05 | 1.2 | 3.18 | 3.87 | 3.39 | 2.15 | | |
| HEMBB1000593 | 10.25 | 5.67 | 51.69 | 53.87 | 82.75 | 77.88 | * | + |
| HEMBB1000595 | 6.42 | 5.2 | 11.24 | 12.51 | 17.1 | 9.55 | | |
| HEMBB1000598 | 1.57 | 1.69 | 5.91 | 2.94 | 6.76 | 4.77 | | |
| HEMBB1000611 | 0.94 | 1.16 | 2.08 | 1.15 | 2.79 | 1.66 | | |
| HEMBB1000617 | 2.01 | 3.04 | 9.31 | 6.14 | 8.79 | 6.97 | | |
| HEMBB1000623 | 2.51 | 3.08 | 4.64 | 5.58 | 5.83 | 3.9 | | |
| HEMBB1000630 | 3.23 | 2.5 | 3.78 | 2.42 | 5.54 | 2.51 | | |
| HEMBB1000631 | 8.91 | 10.69 | 18.75 | 22.52 | 23.76 | 22.55 | * | + |
| HEMBB1000632 | 6.77 | 8.77 | 20.85 | 27.2 | 18.4 | 23.31 | | |
| HEMBB1000636 | 9.52 | 15.91 | 22.42 | 25.26 | 21.65 | 19.96 | | |
| HEMBB1000637 | 6.63 | 9.77 | 19.44 | 17.77 | 24.39 | 20.28 | | |
| HEMBB1000638 | 1.44 | 1.41 | 3.23 | 3.6 | 5.29 | 3.34 | | |
| HEMBB1000642 | 3.47 | 2.31 | 7.58 | 7.65 | 9.33 | 9.93 | | |
| HEMBB1000643 | 0.71 | 1.87 | 2.71 | 1.62 | 3.54 | 2.12 | | |
| HEMBB1000649 | 2.25 | 2.22 | 6.45 | 4.94 | 7.61 | 5.72 | | |
| HEMBB1000652 | 1.8 | 2.21 | 5.33 | 5.13 | 5.14 | 4.93 | | |
| HEMBB1000655 | 1.07 | 1.17 | 3.24 | 1.64 | 4.74 | 2.01 | | |
| HEMBB1000665 | 0.52 | 1.08 | 2.23 | 1.69 | 2.92 | 2.01 | | |
| HEMBB1000668 | 1.85 | 1.46 | 2.76 | 5.07 | 5.42 | 4.1 | ** | + |
| HEMBB1000671 | 2.36 | 2.01 | 6.77 | 7.03 | 7.81 | 6.94 | | |
| HEMBB1000673 | 0.75 | 1.27 | 2.92 | 2.84 | 4.63 | 2.43 | | |
| HEMBB1000679 | 3.26 | 2.84 | 5.59 | 4.42 | 7.19 | 5.76 | | |
| HEMBB1000684 | 1.83 | 2.53 | 6.6 | 5.01 | 6.92 | 5.6 | | |
| HEMBB1000692 | 0.93 | 2 | 2.46 | 1.77 | 2.5 | 1.09 | | |
| HEMBB1000693 | 0.96 | 1.29 | 2.47 | 1.6 | 2.79 | 1.34 | | |
| HEMBB1000705 | 2.61 | 2.52 | 4.85 | 4.97 | 8.2 | 6.53 | | |
| HEMBB1000706 | 0.78 | 1.07 | 2.18 | 2.56 | 2.93 | 1.06 | | |
| HEMBB1000709 | 3.53 | 2.92 | 8.39 | 8.16 | 7.99 | 10.26 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1000714 | 1.41 | 2.85 | 9.32 | 5.31 | 10.37 | 8.79 | | |
| HEMBB1000725 | 1.61 | 2.22 | 4.35 | 3.04 | 6.22 | 4.72 | | |
| HEMBB1000726 | 1.88 | 2.34 | 8.76 | 5.63 | 7.1 | 4.83 | | |
| HEMBB1000729 | 1.82 | 3.28 | 4.3 | 3.3 | 5.21 | 2.79 | | |
| HEMBB1000738 | 1.94 | 2.6 | 5.55 | 3.99 | 5.53 | 6.15 | | |
| HEMBB1000749 | 4.06 | 4.15 | 7.47 | 7.48 | 9.56 | 8.27 | | |
| HEMBB1000763 | 5.81 | 5.56 | 6.21 | 6.65 | 9.9 | 6.61 | | |
| HEMBB1000770 | 2.76 | 2.06 | 8.8 | 7.73 | 9.62 | 8.83 | | |
| HEMBB1000774 | 1.62 | 2.75 | 3.7 | 3.07 | 4.39 | 2.34 | | |
| HEMBB1000777 | 5.17 | 5.49 | 7.42 | 6.86 | 4.9 | 7.37 | | |
| HEMBB1000781 | 3.7 | 4.19 | 6.89 | 7.64 | 5.28 | 6.83 | | |
| HEMBB1000788 | 0.87 | 1.79 | 2.45 | 2.65 | 4.88 | 1.35 | | |
| HEMBB1000789 | 1.91 | 2.22 | 3.01 | 3.1 | 6.55 | 1.86 | | |
| HEMBB1000790 | 1.97 | 2.15 | 4.48 | 4.59 | 4.21 | 2.53 | | |
| HEMBB1000794 | 1.46 | 1.8 | 2.85 | 2.97 | 3.84 | 2.06 | | |
| HEMBB1000807 | 2.55 | 2.72 | 5.18 | 3.57 | 4 | 4.26 | | |
| HEMBB1000809 | 30.31 | 26.87 | 132.99 | 158.22 | 156.74 | 195.14 | * | + |
| HEMBB1000810 | 1.98 | 2.67 | 4.51 | 3.76 | 6.08 | 4.12 | | |
| HEMBB1000821 | 1.98 | 1.93 | 2.98 | 2.05 | 4.45 | 1.79 | | |
| HEMBB1000822 | 1.08 | 1.97 | 2.31 | 1.65 | 5.31 | 1.46 | | |
| HEMBB1000826 | 1.36 | 1.99 | 3.57 | 3.77 | 6.11 | 3.6 | | |
| HEMBB1000827 | 2.48 | 2.89 | 5.83 | 2.67 | 5.05 | 2.99 | | |
| HEMBB1000831 | 3.4 | 2.31 | 5.67 | 3.84 | 7.74 | 2.95 | | |
| HEMBB1000835 | 1.76 | 1.94 | 6.2 | 7.59 | 7.62 | 7.47 | * | + |
| HEMBB1000840 | 1.27 | 2.95 | 6.89 | 4.48 | 7.19 | 3.01 | | |
| HEMBB1000848 | 2.08 | 3.45 | 5.63 | 5.39 | 6.45 | 5.3 | | |
| HEMBB1000852 | 1.26 | 2.16 | 2.8 | 1.07 | 4.51 | 1.55 | | |
| HEMBB1000857 | 7.65 | 6.49 | 8.13 | 7.01 | 10.69 | 11.53 | | |
| HEMBB1000858 | 3.7 | 3.13 | 7.3 | 7.07 | 9.38 | 7.31 | | |
| HEMBB1000867 | 2.21 | 1.84 | 4.9 | 3.02 | 5.55 | 4.04 | | |
| HEMBB1000870 | 1.64 | 2.37 | 4.56 | 2.84 | 5.31 | 3.63 | | |
| HEMBB1000876 | 1.48 | 2.86 | 3.91 | 4.54 | 3.22 | 3.93 | | |
| HEMBB1000881 | 3.35 | 5.56 | 10.5 | 6.12 | 5.88 | 3.85 | | |
| HEMBB1000883 | 1.02 | 2.68 | 2.2 | 3.03 | 3.32 | 2.58 | | |
| HEMBB1000887 | 16.9 | 14.54 | 43.41 | 67.39 | 61.26 | 59.84 | * | + |
| HEMBB1000888 | 1.03 | 1.67 | 2.39 | 1.63 | 3.92 | 1.86 | | |
| HEMBB1000890 | 2.93 | 3.36 | 10.85 | 6.01 | 8.62 | 7.68 | | |
| HEMBB1000893 | 3.28 | 2.54 | 5.46 | 4.5 | 6.14 | 5.57 | | |
| HEMBB1000900 | 1.27 | 1.53 | 2.98 | 2.06 | 2.54 | 1.58 | | |
| HEMBB1000905 | 5.09 | 3.75 | 6.6 | 10.05 | 9.45 | 8.77 | ** | + |
| HEMBB1000908 | 3.34 | 2.79 | 3.01 | 4.48 | 4.71 | 5.7 | ** | + |
| HEMBB1000910 | 1.74 | 2.91 | 2.55 | 2.09 | 3.56 | 2.24 | | |
| HEMBB1000913 | 1.41 | 1.51 | 2.22 | 2.8 | 3.41 | 1.91 | | |
| HEMBB1000915 | 32.08 | 25.6 | 50.05 | 48 | 58.92 | 51.07 | | |
| HEMBB1000917 | 2.1 | 2.78 | 5.72 | 2.99 | 4.52 | 3.44 | | |
| HEMBB1000927 | 1.45 | 1.24 | 1.82 | 1.49 | 3.25 | 1.88 | | |
| HEMBB1000932 | 0.66 | 2.06 | 2.74 | 1.81 | 3.41 | 1.61 | | |
| HEMBB1000933 | 7.47 | 7.12 | 10.71 | 12.88 | 12.78 | 19.19 | | |
| HEMBB1000936 | 1.44 | 1.96 | 2.87 | 3.75 | 6.44 | 3.55 | | |
| HEMBB1000939 | 7.86 | 7.14 | 9.02 | 15.98 | 15.3 | 18.25 | ** | + |
| HEMBB1000941 | 1.53 | 1.86 | 3.17 | 3.99 | 4.46 | 3.52 | * | + |
| HEMBB1000947 | 3.53 | 3.34 | 4.61 | 4.67 | 6.8 | 5.72 | | |
| HEMBB1000954 | 1.08 | 1.82 | 2.54 | 1.62 | 4.01 | 3.08 | | |
| HEMBB1000959 | 0.77 | 1.41 | 3.11 | 2.23 | 4.42 | 1.87 | | |
| HEMBB1000973 | 1.21 | 1.12 | 2.6 | 2.07 | 4.47 | 3.2 | | |
| HEMBB1000975 | 0.9 | 1.28 | 1.55 | 2.48 | 2.86 | 1.7 | * | + |
| HEMBB1000981 | 1.54 | 0.66 | 1.99 | 1.84 | 3.47 | 2.03 | | |
| HEMBB1000985 | 1.67 | 1.82 | 2.71 | 3.59 | 3.99 | 3.24 | * | + |
| HEMBB1000991 | 0.99 | 1.35 | 2.83 | 1.46 | 3.75 | 2.43 | | |
| HEMBB1000996 | 4.89 | 3.12 | 6.78 | 6.75 | 6.64 | 11.18 | | |
| HEMBB1001000 | 1.86 | 1.39 | 4.06 | 3.07 | 5.46 | 3.88 | | |
| HEMBB1001004 | 1.15 | 1.32 | 2.57 | 2.56 | 4.55 | 2.42 | | |
| HEMBB1001008 | 1.48 | 1.79 | 2.75 | 2.44 | 4.6 | 2.88 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1001011 | 1.34 | 1.15 | 1.53 | 2.47 | 2.24 | 2.9 | ** | + |
| HEMBB1001014 | 1.31 | 1.43 | 2.3 | 2.73 | 4.84 | 4.1 | * | + |
| HEMBB1001020 | 1.17 | 0.75 | 2.77 | 1.77 | 2.67 | 2.26 | | |
| HEMBB1001024 | 3.31 | 1.72 | 6.27 | 5.47 | 7.56 | 6.82 | | |
| HEMBB1001026 | 5.14 | 4.03 | 5.16 | 5.46 | 7.67 | 5.44 | | |
| HEMBB1001037 | 2 | 1.45 | 4.73 | 3.52 | 5.69 | 6.67 | | |
| HEMBB1001042 | 0.52 | 1.15 | 2.69 | 1.29 | 3.61 | 0.87 | | |
| HEMBB1001046 | 1.18 | 1.28 | 2.16 | 1.67 | 3.82 | 0.96 | | |
| HEMBB1001047 | 1.01 | 1.7 | 3.79 | 2.2 | 3.83 | 3.83 | | |
| HEMBB1001048 | 2.5 | 2.34 | 7.02 | 4.34 | 11.02 | 6.93 | | |
| HEMBB1001051 | 1.44 | 2.62 | 3.23 | 3.95 | 6.26 | 3.9 | | |
| HEMBB1001056 | 1.61 | 2.67 | 4.89 | 3.75 | 5.7 | 3.78 | | |
| HEMBB1001058 | 1.3 | 1.92 | 4.72 | 2.64 | 6.92 | 2.63 | | |
| HEMBB1001060 | 0.69 | 0.68 | 1.75 | 2.05 | 4.61 | 1.85 | | |
| HEMBB1001063 | 1.23 | 1.83 | 3.52 | 2.43 | 4.21 | 2.9 | | |
| HEMBB1001068 | 1.84 | 3.62 | 3.59 | 3.46 | 7.14 | 5.2 | | |
| HEMBB1001082 | 2.24 | 2.57 | 5.98 | 5.38 | 6.93 | 6.36 | | |
| HEMBB1001095 | 6.39 | 7.45 | 11.76 | 14.04 | 14.61 | 13.16 | * | + |
| HEMBB1001096 | 1.3 | 1.91 | 3.05 | 3.21 | 4.12 | 3.49 | | |
| HEMBB1001101 | 7.41 | 8.19 | 9.74 | 19.33 | 13.1 | 16.69 | * | + |
| HEMBB1001102 | 1.04 | 1.47 | 4.57 | 3.6 | 6.07 | 4.46 | | |
| HEMBB1001104 | 1.66 | 1.89 | 3.98 | 3.1 | 4.87 | 4.25 | | |
| HEMBB1001105 | 1.57 | 1.59 | 2.13 | 3.11 | 4.82 | 2.71 | | |
| HEMBB1001112 | 9.44 | 8.91 | 73.3 | 100.88 | 136.14 | 131.28 | * | + |
| HEMBB1001113 | 2.11 | 1.94 | 9.1 | 5.65 | 8.02 | 6.81 | | |
| HEMBB1001114 | 1.88 | 2.27 | 5.18 | 4.16 | 7.06 | 4.82 | | |
| HEMBB1001115 | 5.78 | 7.88 | 14.52 | 16.77 | 9.5 | 14.78 | | |
| HEMBB1001117 | 1.7 | 1.52 | 2.92 | 1.85 | 2.79 | 1.79 | | |
| HEMBB1001119 | 1.69 | 1.57 | 4 | 2.29 | 3.74 | 2.28 | | |
| HEMBB1001126 | 1.85 | 1.88 | 3.63 | 2.69 | 4.96 | 2.9 | | |
| HEMBB1001133 | 3.15 | 2.42 | 4.24 | 6.56 | 6.15 | 6.44 | ** | + |
| HEMBB1001137 | 1.97 | 2.2 | 4.4 | 3.28 | 6.56 | 5.42 | | |
| HEMBB1001142 | 2.96 | 2.68 | 10.51 | 9.2 | 11.69 | 10.38 | | |
| HEMBB1001145 | 3.25 | 3.56 | 7.39 | 6.11 | 7.7 | 6.59 | | |
| HEMBB1001151 | 5.67 | 6.58 | 9.21 | 12.85 | 7.67 | 7.84 | | |
| HEMBB1001153 | 2 | 1.89 | 4.57 | 3.79 | 5.37 | 2.9 | | |
| HEMBB1001158 | 6.96 | 6.74 | 12.17 | 12.04 | 9.95 | 11.16 | | |
| HEMBB1001169 | 1.71 | 2.45 | 4.42 | 2.89 | 4.21 | 2.86 | | |
| HEMBB1001170 | 1 | 1.85 | 3.27 | 1.26 | 2.5 | 1.61 | | |
| HEMBB1001175 | 1.43 | 1.54 | 5.16 | 3.39 | 6.36 | 4.14 | | |
| HEMBB1001177 | 3.63 | 2.4 | 7.54 | 5.8 | 6.94 | 6.69 | | |
| HEMBB1001182 | 2.6 | 3.69 | 4.89 | 3.89 | 6.54 | 3.87 | | |
| HEMBB1001192 | 3.3 | 3.09 | 16.1 | 15.27 | 20.06 | 15.75 | | |
| HEMBB1001199 | 1.16 | 2.27 | 1.91 | 1.43 | 3.96 | 1.15 | | |
| HEMBB1001200 | 1.86 | 1.66 | 3.14 | 2.43 | 5.38 | 2.29 | | |
| HEMBB1001208 | 2.02 | 2.04 | 4.56 | 2.96 | 6.19 | 2.74 | | |
| HEMBB1001209 | 2.98 | 2.28 | 5.75 | 5.22 | 6.56 | 4.92 | | |
| HEMBB1001210 | 5.14 | 4.28 | 7.81 | 1.05 | 6.08 | 10.33 | | |
| HEMBB1001215 | 9.57 | 10.46 | 17.69 | 17.91 | 15.75 | 16.96 | | |
| HEMBB1001217 | 1.78 | 2.13 | 4.39 | 2.04 | 3.69 | 1.89 | | |
| HEMBB1001218 | 4.28 | 3.37 | 5.47 | 4.52 | 5.98 | 4.6 | | |
| HEMBB1001221 | 1.72 | 1.65 | 2.75 | 1.54 | 4.29 | 1.34 | | |
| HEMBB1001224 | 2.2 | 2.46 | 3.81 | 2.98 | 6.08 | 3.7 | | |
| HEMBB1001230 | 1.51 | 2.09 | 4.36 | 2.55 | 4.95 | 2.22 | | |
| HEMBB1001234 | 5.24 | 6.05 | 29.26 | 31 | 44.04 | 30.75 | | |
| HEMBB1001235 | 12.72 | 10.54 | 21.49 | 13.27 | 8.47 | 10.71 | | |
| HEMBB1001237 | 11 | 10.54 | 21.03 | 32.1 | 26.16 | 36.86 | * | + |
| HEMBB1001242 | 4.82 | 5.68 | 8.63 | 6.92 | 6.97 | 4.51 | | |
| HEMBB1001244 | 1.08 | 1.1 | 3.9 | 1.47 | 4.36 | 1.36 | | |
| HEMBB1001249 | 1.26 | 1.63 | 2.99 | 1.84 | 5.52 | 1.98 | | |
| HEMBB1001253 | 1.53 | 1.92 | 5.68 | 1.96 | 4.89 | 2.39 | | |
| HEMBB1001254 | 1.27 | 1.19 | 3.73 | 1.22 | 5.09 | 2.45 | | |
| HEMBB1001266 | 2 | 4.32 | 4.75 | 4.49 | 6.09 | 4.63 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1001267 | 3.51 | 2.92 | 9.98 | 8.43 | 7.63 | 8.01 | | |
| HEMBB1001271 | 2.25 | 2.93 | 3.89 | 2.59 | 5.85 | 3.91 | | |
| HEMBB1001282 | 2.27 | 2.68 | 3.9 | 2.77 | 4.86 | 2.99 | | |
| HEMBB1001287 | 54.06 | 45.71 | 83.21 | 72.79 | 57.33 | 77.51 | | |
| HEMBB1001288 | 2.45 | 2.58 | 3.64 | 4.57 | 6.08 | 3.31 | | |
| HEMBB1001289 | 4.64 | 5.82 | 12.2 | 6.93 | 9.11 | 6.88 | | |
| HEMBB1001290 | 2.82 | 1.27 | 4.55 | 2.89 | 4.14 | 1.96 | | |
| HEMBB1001294 | 1.03 | 1.91 | 3.2 | 2.93 | 3.95 | 2.51 | | |
| HEMBB1001299 | 7.06 | 7.64 | 12.49 | 16.26 | 14.41 | 17.87 | * | + |
| HEMBB1001302 | 2.16 | 2.34 | 2.41 | 1.75 | 3.39 | 1.64 | | |
| HEMBB1001304 | 1.73 | 1.34 | 2.6 | 1.81 | 5.2 | 1.67 | | |
| HEMBB1001314 | 1.16 | 1.07 | 2.47 | 1.3 | 3.63 | 1.25 | | |
| HEMBB1001315 | 1.25 | 1.62 | 1.46 | 0.87 | 4 | 0.9 | | |
| HEMBB1001317 | 2.1 | 3.38 | 6.51 | 4.12 | 8.01 | 4.41 | | |
| HEMBB1001326 | 0.88 | 1.54 | 2.36 | 1.51 | 3 | 1.69 | | |
| HEMBB1001331 | 2.11 | 2.79 | 2.81 | 3.78 | 6.14 | 4.55 | * | + |
| HEMBB1001335 | 1.39 | 0.9 | 1.44 | 1.4 | 2.81 | 1.92 | | |
| HEMBB1001337 | 1.86 | 1.7 | 3.15 | 3.34 | 4.72 | 4.51 | * | + |
| HEMBB1001339 | 4.17 | 3.87 | 5.91 | 5.83 | 7.91 | 5.25 | | |
| HEMBB1001344 | 1.27 | 1.36 | 2.25 | 1.62 | 3.44 | 1.29 | | |
| HEMBB1001346 | 2.17 | 2.32 | 7.45 | 5.89 | 6.23 | 5.7 | | |
| HEMBB1001348 | 0.68 | 1.37 | 4.05 | 1.38 | 3.68 | 2.82 | | |
| HEMBB1001350 | 2.06 | 2.09 | 4.17 | 2.07 | 7.74 | 2.57 | | |
| HEMBB1001356 | 1.4 | 1.9 | 2.33 | 1.74 | 5.54 | 2.29 | | |
| HEMBB1001364 | 0.53 | 1.28 | 1.25 | 1.49 | 2.47 | 1.43 | | |
| HEMBB1001366 | 1.61 | 1.71 | 3.46 | 4.17 | 4.27 | 3.82 | * | + |
| HEMBB1001367 | 1.11 | 2.19 | 3.79 | 5.05 | 6.25 | 5.75 | * | + |
| HEMBB1001369 | 0.56 | 1.29 | 2.54 | 1.95 | 3.39 | 2.82 | | |
| HEMBB1001380 | 3.13 | 3.56 | 6.65 | 5.43 | 7.36 | 7.75 | | |
| HEMBB1001381 | 8.45 | 6.07 | 9.53 | 10.2 | 14.39 | 11.86 | | |
| HEMBB1001384 | 3.48 | 4.92 | 5.66 | 9.52 | 13.27 | 11.91 | ** | + |
| HEMBB1001387 | 1.19 | 1.57 | 3.1 | 2.36 | 4.34 | 1.33 | | |
| HEMBB1001394 | 1.53 | 1.3 | 1.68 | 2.7 | 2.82 | 1.89 | * | + |
| HEMBB1001407 | 0.68 | 0.83 | 0.99 | 0.62 | 1.33 | 0.97 | | |
| HEMBB1001410 | 1.35 | 1.04 | 1.78 | 2.44 | 2.63 | 1.74 | | |
| HEMBB1001413 | 1.68 | 1.84 | 3.32 | 3.48 | 3.27 | 4.04 | | |
| HEMBB1001419 | 2.56 | 2.24 | 4.42 | 3.61 | 5.47 | 4.6 | | |
| HEMBB1001421 | 2.29 | 1.66 | 2.18 | 1.31 | 3.16 | 0.95 | | |
| HEMBB1001424 | 0.51 | 1.2 | 1.67 | −0.1 | 1.58 | 0.41 | | |
| HEMBB1001426 | 2.04 | 1.51 | 3.7 | 2.66 | 5.67 | 4.21 | | |
| HEMBB1001429 | 7.11 | 5.76 | 9.83 | 22.69 | 19.97 | 19.53 | ** | + |
| HEMBB1001436 | 3.13 | 2.51 | 6.8 | 7.5 | 6.44 | 7.24 | | |
| HEMBB1001443 | 5.61 | 6.48 | 20.67 | 20.46 | 27.07 | 22.15 | | |
| HEMBB1001449 | 2.02 | 2 | 4.92 | 4.26 | 6.35 | 4.27 | | |
| HEMBB1001454 | 1.2 | 1.96 | 3.77 | 3.74 | 5.13 | 2.99 | | |
| HEMBB1001458 | 4.72 | 6.48 | 12.41 | 7.88 | 9.04 | 6.89 | | |
| HEMBB1001461 | 0.55 | 1.38 | 2.01 | 2.11 | 2.65 | 1.07 | | |
| HEMBB1001463 | 2.28 | 2.1 | 3.7 | 3.95 | 5.03 | 4.66 | * | + |
| HEMBB1001464 | 1.73 | 1.29 | 3.62 | 2.66 | 3.92 | 2.27 | | |
| HEMBB1001466 | 1.15 | 1.84 | 2.75 | 1.88 | 3.77 | 2.73 | | |
| HEMBB1001482 | 1.76 | 2.21 | 4.36 | 2.94 | 5.36 | 3.97 | | |
| HEMBB1001500 | 1.01 | 1.08 | 1.77 | 1.96 | 4.39 | 1.97 | | |
| HEMBB1001505 | 3 | 3.32 | 5.87 | 9.35 | 14.06 | 11.17 | * | + |
| HEMBB1001521 | 2.06 | 2.43 | 5.4 | 5.15 | 5.78 | 7.14 | | |
| HEMBB1001527 | 2.63 | 4.74 | 11.16 | 8.69 | 9.66 | 9.6 | | |
| HEMBB1001530 | 4.15 | 3.51 | 6.57 | 9.43 | 12.39 | 7.05 | | |
| HEMBB1001531 | 1.11 | 1.34 | 4.62 | 2.99 | 5.16 | 4.17 | | |
| HEMBB1001532 | 0.63 | 1.86 | 2.77 | 1.86 | 4.41 | 2.15 | | |
| HEMBB1001535 | 1.99 | 2.01 | 4.22 | 3.34 | 4.32 | 5.75 | | |
| HEMBB1001536 | 2.18 | 2.65 | 6.37 | 4.62 | 6.87 | 5.45 | | |
| HEMBB1001537 | 1.31 | 2.24 | 3.7 | 3.21 | 6.12 | 2.75 | | |
| HEMBB1001542 | 4.39 | 4.72 | 6.28 | 5.26 | 7.83 | 5.7 | | |
| HEMBB1001543 | 7.84 | 3.58 | 8.49 | 8.13 | 7.08 | 5.38 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1001547 | 2.02 | 2.25 | 2.65 | 4.2 | 4.27 | 2.79 | * | + |
| HEMBB1001548 | 2.53 | 2.62 | 11.82 | 17.73 | 29.92 | 23.34 | * | + |
| HEMBB1001551 | 0.89 | 1.7 | 4.47 | 2.93 | 5.96 | 2.65 | | |
| HEMBB1001555 | 2.13 | 2.79 | 4.78 | 3.73 | 5.8 | 4.64 | | |
| HEMBB1001562 | 1.9 | 2.64 | 4.27 | 2.23 | 3.46 | 3 | | |
| HEMBB1001564 | 132.08 | 140.08 | 310.28 | 333.18 | 233.12 | 279.03 | | |
| HEMBB1001565 | 1.72 | 1.97 | 3.9 | 3.77 | 4.68 | 2.07 | | |
| HEMBB1001569 | 0.79 | 0.8 | 3.04 | 2.49 | 3.68 | 1.44 | | |
| HEMBB1001573 | 1.9 | 1.04 | 3.58 | 4.18 | 5.53 | 4.12 | * | + |
| HEMBB1001585 | 1.5 | 1.96 | 10.91 | 3.75 | 7.14 | 4.87 | | |
| HEMBB1001586 | 1.53 | 2.27 | 3.22 | 4.27 | 5.45 | 1.95 | | |
| HEMBB1001588 | 1.33 | 2.9 | 5.74 | 4.72 | 6.32 | 5.06 | | |
| HEMBB1001595 | 2.68 | 3.33 | 6.92 | 3.78 | 4.84 | 4.7 | | |
| HEMBB1001596 | 3.4 | 2.57 | 3.74 | 2.67 | 5.36 | 2.54 | | |
| HEMBB1001599 | 1.45 | 1.57 | 3.21 | 3.07 | 3.47 | 2.06 | | |
| HEMBB1001603 | 1.99 | 2.45 | 4.17 | 5.7 | 8.16 | 4.04 | | |
| HEMBB1001606 | 1.35 | 2.28 | 2.42 | 2 | 2.39 | 1.53 | | |
| HEMBB1001612 | 4.31 | 3.07 | 9.25 | 8.81 | 8.09 | 8.9 | | |
| HEMBB1001618 | 1.53 | 1.62 | 3.86 | 2.84 | 4.48 | 2.31 | | |
| HEMBB1001619 | 2.11 | 3.03 | 3.92 | 5.71 | 5.1 | 4.37 | * | + |
| HEMBB1001623 | 2.21 | 2.38 | 3.16 | 2.16 | 5.5 | 3.37 | | |
| HEMBB1001625 | 3.73 | 3.04 | 4.33 | 2.93 | 4.81 | 3.79 | | |
| HEMBB1001630 | 1.31 | 2.36 | 3.54 | 1.84 | 4.3 | 1.23 | | |
| HEMBB1001635 | 1.78 | 1.64 | 3.76 | 2.08 | 3.32 | 1.34 | | |
| HEMBB1001637 | 1.76 | 1.14 | 3.98 | 2.09 | 4.4 | 3.58 | | |
| HEMBB1001641 | 1.43 | 1.68 | 2.78 | 3.17 | 3.73 | 2 | | |
| HEMBB1001653 | 2.18 | 3.17 | 5.61 | 3.96 | 6.63 | 3.5 | | |
| HEMBB1001665 | 1.08 | 2.17 | 2.04 | 2.5 | 4.43 | 0.88 | | |
| HEMBB1001666 | 2.14 | 1.95 | 3.52 | 2.45 | 4.88 | 1.79 | | |
| HEMBB1001667 | 2.37 | 2.25 | 3.26 | 2.94 | 5.13 | 3.17 | | |
| HEMBB1001668 | 3.19 | 2.11 | 5.15 | 2.45 | 6.42 | 2.69 | | |
| HEMBB1001669 | 0.98 | 2.02 | 3.19 | 1.04 | 4.53 | 1.38 | | |
| HEMBB1001670 | 4.02 | 4.82 | 6.88 | 10.7 | 9.71 | 8.65 | * | + |
| HEMBB1001673 | 1.48 | 2.97 | 3.61 | 3.51 | 4.52 | 4.43 | | |
| HEMBB1001675 | 1.83 | 3.27 | 4.65 | 4.68 | 5.78 | 4.88 | | |
| HEMBB1001679 | 2.52 | 2.34 | 5.06 | 2.19 | 3.87 | 1.88 | | |
| HEMBB1001684 | 2.13 | 1.55 | 3.89 | 5.17 | 6.77 | 5.05 | * | + |
| HEMBB1001685 | 3.41 | 1.61 | 4.43 | 2.91 | 6.24 | 2.49 | | |
| HEMBB1001695 | 1.9 | 2.22 | 4.43 | 1.38 | 3.88 | 2.12 | | |
| HEMBB1001703 | 1.25 | 2.3 | 5.74 | 3.58 | 3.79 | 4.1 | | |
| HEMBB1001704 | 1.39 | 2.16 | 4.58 | 4.23 | 5.02 | 3.94 | | |
| HEMBB1001706 | 2.76 | 2.6 | 3.58 | 5.6 | 6.26 | 4.87 | ** | + |
| HEMBB1001707 | 1.35 | 2.01 | 2.87 | 2.25 | 3.67 | 2.8 | | |
| HEMBB1001717 | 1.68 | 2.21 | 3.23 | 2.61 | 3.34 | 2.83 | | |
| HEMBB1001731 | 13.81 | 13.48 | 24.03 | 11.02 | 23.09 | 25 | | |
| HEMBB1001734 | 3.47 | 3.35 | 7.62 | 6.88 | 9.22 | 4.18 | | |
| HEMBB1001735 | 1.35 | 1.4 | 3.4 | 1.58 | 3.52 | 2.03 | | |
| HEMBB1001736 | 5.01 | 6.14 | 7.87 | 7.15 | 10.91 | 8.11 | | |
| HEMBB1001747 | 0.92 | 1 | 3.23 | 1.87 | 3.67 | 2.82 | | |
| HEMBB1001749 | 4.71 | 2.99 | 9.39 | 7.29 | 5.99 | 8.16 | | |
| HEMBB1001753 | 3.79 | 3.3 | 5.5 | 7.4 | 8.97 | 9.3 | ** | + |
| HEMBB1001756 | 0.53 | 2.05 | 1.89 | 2.31 | 3.91 | 2.73 | | |
| HEMBB1001757 | 1.08 | 1.8 | 2.64 | 3.04 | 4.86 | 4.54 | * | + |
| HEMBB1001760 | 1.32 | 0.98 | 3.74 | 1.49 | 3.56 | 2.13 | | |
| HEMBB1001762 | 0.9 | 0.61 | 2.62 | 1.57 | 2.95 | 2.07 | | |
| HEMBB1001780 | 9.82 | 12.28 | 11.34 | 16.64 | 26.06 | 22.06 | * | + |
| HEMBB1001785 | 0.89 | 1.24 | 1.02 | 0.62 | 2.88 | 1.64 | | |
| HEMBB1001788 | 3.22 | 1.2.65 | 17 | 5.76 | 6.13 | 5.3 | | |
| HEMBB1001793 | 5.6 | 4.73 | 18.12 | 22.08 | 20.38 | 22.86 | * | + |
| HEMBB1001797 | 1.61 | 1.82 | 2.28 | 2.94 | 4.97 | 5.54 | * | + |
| HEMBB1001802 | 13.28 | 9.91 | 67.77 | 85.35 | 82.8 | 81.27 | * | + |
| HEMBB1001812 | 2.32 | 2.58 | 6.49 | 7.68 | 8.28 | 9.74 | * | + |
| HEMBB1001815 | 128.22 | 114.78 | 102.97 | 87.37 | 89.21 | 62.14 | * | − |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1001816 | 1.95 | 2.19 | 3.97 | 3.73 | 6.31 | 5.73 | | |
| HEMBB1001831 | 0.69 | 0.98 | 1.54 | 0.72 | 3.28 | 1.16 | | |
| HEMBB1001834 | 16.15 | 9.68 | 133.91 | 102.49 | 173.48 | 141.04 | | |
| HEMBB1001836 | 4.07 | 1.99 | 11.4 | 5.89 | 6.97 | 6.7 | | |
| HEMBB1001839 | 0.89 | 0.86 | 1.43 | 1.08 | 1.95 | 1.21 | | |
| HEMBB1001841 | 80.32 | 59.68 | 120.73 | 35.74 | 39.04 | 23.13 | * | – |
| HEMBB1001844 | 5.26 | 4.72 | 9.73 | 10.15 | 10.68 | 8.11 | | |
| HEMBB1001847 | 6.93 | 4.24 | 8.6 | 9.06 | 14.77 | 10.3 | | |
| HEMBB1001848 | 25.33 | 21.68 | 40.92 | 49.73 | 73.94 | 62.17 | * | + |
| HEMBB1001850 | 3.07 | 2.93 | 5.25 | 3.75 | 7.19 | 3.95 | | |
| HEMBB1001859 | 13.4 | 8.82 | 20.85 | 39.61 | 27.01 | 40.75 | * | + |
| HEMBB1001863 | 1.7 | 3.65 | 7.66 | 6.89 | 8.88 | 7.5 | | |
| HEMBB1001867 | 1.69 | 1.93 | 3.16 | 3.16 | 4.14 | 3 | | |
| HEMBB1001868 | 2.15 | 1.53 | 2.56 | 1.31 | 3.57 | 1.28 | | |
| HEMBB1001869 | 1.5 | 2.3 | 4.23 | 4.62 | 8.15 | 3.58 | | |
| HEMBB1001872 | 1.21 | 0.79 | 2.23 | 1.77 | 4.17 | 1.75 | | |
| HEMBB1001874 | 1.92 | 1.2 | 2.07 | 2.58 | 2.47 | 3.03 | * | + |
| HEMBB1001875 | 0.83 | 1.96 | 1.7 | 2.05 | 3.53 | 1.37 | | |
| HEMBB1001880 | 2.68 | 2.17 | 6.79 | 4.41 | 8.91 | 8.35 | | |
| HEMBB1001899 | 0.6 | 1.62 | 2.15 | 2.26 | 4.68 | 1.91 | | |
| HEMBB1001903 | 5.56 | 5.68 | 9.61 | 6.06 | 6.65 | 6.7 | | |
| HEMBB1001905 | 2.04 | 2.82 | 5.49 | 4.98 | 6.07 | 7.14 | | |
| HEMBB1001906 | 0.67 | 1.65 | 2.64 | 2.22 | 5.14 | 2.62 | | |
| HEMBB1001908 | 1.82 | 1.63 | 5.26 | 3.31 | 6.56 | 3.59 | | |
| HEMBB1001910 | 1.92 | 1.16 | 2.64 | 3.2 | 4.41 | 4.61 | * | + |
| HEMBB1001911 | 2.06 | 1.11 | 4.2 | 5.73 | 4.81 | 4.33 | | |
| HEMBB1001915 | 2.53 | 3.01 | 5.61 | 7.13 | 7.84 | 9.4 | * | + |
| HEMBB1001921 | 2.19 | 2.21 | 7.12 | 6.56 | 8.47 | 8.25 | | |
| HEMBB1001922 | 1.74 | 1.77 | 3.66 | 4.91 | 5.85 | 3.7 | | |
| HEMBB1001925 | 1.48 | 2.24 | 4.57 | 3.07 | 4.73 | 3.39 | | |
| HEMBB1001930 | 0.46 | 0.94 | 1.67 | 0.91 | 3.18 | 1.01 | | |
| HEMBB1001944 | 1.72 | 1.88 | 5.45 | 4.83 | 4.6[] | 4.49 | | |
| HEMBB1001945 | 2.15 | 1.05 | 3.58 | 2.25 | 3.97 | 2.12 | | |
| HEMBB1001947 | 2.28 | 1.13 | 3.23 | 5.35 | 5.98 | 3.15 | | |
| HEMBB1001950 | 3.49 | 1.95 | 5.38 | 5.15 | 5.46 | 3.3 | | |
| HEMBB1001952 | 1.41 | 2.05 | 4.72 | 2.31 | 4.73 | 3.1 | | |
| HEMBB1001953 | 1.62 | 2.09 | 3.45 | 3.63 | 5.78 | 3.75 | | |
| HEMBB1001957 | 1.16 | 2.02 | 4.28 | 2.68 | 4.19 | 2.19 | | |
| HEMBB1001959 | 2.05 | 3.31 | 4.07 | 4.22 | 5.75 | 3.68 | | |
| HEMBB1001962 | 5.54 | 2.61 | 5.11 | 3.34 | 6.28 | 2.54 | | |
| HEMBB1001967 | 2.59 | 2.46 | 5.62 | 6.11 | 8.49 | 6.15 | | |
| HEMBB1001973 | 2.25 | 2.4 | 6.14 | 7.62 | 10 | 7.28 | * | + |
| HEMBB1001978 | 2.08 | 1.71 | 6.29 | 7.2 | 7.57 | 5.83 | | |
| HEMBB1001983 | 9.23 | 8.69 | 24.64 | 38.93 | 34.91 | 36.79 | * | + |
| HEMBB1001987 | 1.78 | 2.34 | 3.64 | 1.66 | 4.75 | 2.38 | | |
| HEMBB1001988 | 2.02 | 1.92 | 3.42 | 2.92 | 5.17 | 1.85 | | |
| HEMBB1001990 | 7.65 | 7.72 | 9.18 | 12.44 | 11.53 | 15.42 | * | + |
| HEMBB1001996 | 1.54 | 1.47 | 3.89 | 1.61 | 3.51 | 1.22 | | |
| HEMBB1001997 | 1.46 | 2.25 | 6.1 | 4.2 | 5.98 | 4.23 | | |
| HEMBB1001999 | 10.91 | 11.08 | 16.84 | 24.47 | 26.58 | 22.28 | ** | + |
| HEMBB1002002 | 1.08 | 1.58 | 3.52 | 1.91 | 2.76 | 2.39 | | |
| HEMBB1002005 | 1.88 | 2.91 | 4.8 | 4.82 | 7.6 | 4.22 | | |
| HEMBB1002009 | 2.32 | 2.48 | 3.03 | 2.24 | 6.23 | 2.7 | | |
| HEMBB1002013 | 0.96 | 2.07 | 3.78 | 1.95 | 4.26 | 1.41 | | |
| HEMBB1002015 | 3.95 | 4.25 | 9.47 | 5.82 | 8.92 | 6.73 | | |
| HEMBB1002024 | 45.16 | 34.47 | 111.32 | 113.31 | 106.76 | 120.55 | | |
| HEMBB1002035 | 2.15 | 1.91 | 2.87 | 2.11 | 4.5 | 2.68 | | |
| HEMBB1002039 | 1.18 | 2.29 | 5.1 | 3.28 | 5.9 | 2.98 | | |
| HEMBB1002041 | 3.31 | 4.13 | 8.49 | 15.49 | 14.42 | 13.38 | ** | + |
| HEMBB1002042 | 3.97 | 4.66 | 9.49 | 8.09 | 10.63 | 9.94 | | |
| HEMBB1002043 | 1.34 | 2.21 | 4.61 | 5.97 | 5.24 | 3.36 | | |
| HEMBB1002044 | 0.4 | 1.19 | 2.68 | 1.25 | 4.19 | 1.92 | | |
| HEMBB1002045 | 2.83 | 2.5 | 10.03 | 6.34 | 7.63 | 4.56 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1002049 | 1.31 | 1.4 | 3.77 | 1.71 | 4.36 | 1.73 | | |
| HEMBB1002050 | 1.62 | 1.61 | 4.5 | 3.31 | 4.53 | 2.94 | | |
| HEMBB1002051 | 1.17 | 1.13 | 2.9 | 2.59 | 5.05 | 4.37 | | |
| HEMBB1002068 | 1.69 | 2.44 | 2.43 | 2.3 | 4.42 | 2.07 | | |
| HEMBB1002069 | 3.39 | 3.94 | 7.83 | 6.86 | 7.55 | 5 | | |
| HEMBB1002075 | 0.72 | 1.94 | 3.33 | 2.99 | 3.52 | 2.37 | | |
| HEMBB1002079 | 1.2 | 1.8 | 1.89 | 1.22 | 2.84 | 1.3 | | |
| HEMBB1002080 | 1.74 | 1.85 | 4.78 | 1.55 | 6.02 | 2.41 | | |
| HEMBB1002082 | 1.03 | 1.85 | 4.59 | 2.38 | 4.38 | 1.96 | | |
| HEMBB1002084 | 25.86 | 22.68 | 51.44 | 33.52 | 35.54 | 38.37 | | |
| HEMBB1002088 | 13.92 | 15.78 | 22.14 | 29.46 | 37.25 | 35.66 | ** | + |
| HEMBB1002092 | 2.51 | 2.24 | 4.48 | 5.34 | 3.65 | 6.27 | | |
| HEMBB1002094 | 3.21 | 2.62 | 8.2 | 5.72 | 7.27 | 6.04 | | |
| HEMBB1002103 | 2.42 | 2.97 | 3.51 | 3.74 | 5.58 | 4.47 | | |
| HEMBB1002109 | 4.27 | 3.47 | 4.84 | 5.72 | 7.83 | 6.36 | * | + |
| HEMBB1002115 | 42.37 | 37.4 | 91.88 | 95.86 | 101.94 | 101.65 | | |
| HEMBB1002120 | 0.89 | 1.22 | 2.91 | 0.86 | 2.94 | 2.41 | | |
| HEMBB1002121 | 0.75 | 1.56 | 1.63 | 1.5 | 4.66 | 2.53 | | |
| HEMBB1002134 | 11.99 | 11.22 | 112.59 | 98.93 | 166.1 | 133.77 | | |
| HEMBB1002136 | 1.29 | 1.65 | 2.9 | 2.59 | 3.26 | 2.58 | | |
| HEMBB1002138 | 10.48 | 9.64 | 20.72 | 18.78 | 23.06 | 19.4 | | |
| HEMBB1002139 | 1.84 | 1.6 | 5.46 | 4.69 | 6 | 5.84 | | |
| HEMBB1002141 | 1.53 | 0.83 | 3.44 | 1.48 | 4.64 | 2.54 | | |
| HEMBB1002142 | 1.85 | 2 | 4.95 | 3.22 | 5.98 | 6.03 | | |
| HEMBB1002145 | 1.62 | 0.83 | 2.96 | 1.49 | 3.07 | 2.42 | | |
| HEMBB1002152 | 1.27 | 1.19 | 3.15 | 2.32 | 6.36 | 3.41 | | |
| HEMBB1002162 | 1.25 | 1.55 | 3.92 | 3.42 | 5.14 | 3.61 | | |
| HEMBB1002173 | 4.18 | 1.09 | 5.58 | 2.77 | 4.48 | 3.84 | | |
| HEMBB1002189 | 2.78 | 1.95 | 6.14 | 7.01 | 8.25 | 5.93 | | |
| HEMBB1002190 | 1.81 | 2.2 | 6.36 | 8.01 | 6.93 | 8.36 | * | + |
| HEMBB1002193 | 1.84 | 1.06 | 2.06 | 4.53 | 4.37 | 5.48 | ** | + |
| HEMBB1002217 | 3.82 | 2.26 | 6.02 | 3.61 | 6.06 | 3.23 | | |
| HEMBB1002218 | 3.91 | 3.3 | 7.58 | 4.94 | 6.15 | 5.68 | | |
| HEMBB1002228 | 2.28 | 2.9 | 6.17 | 6.68 | 7.94 | 6.97 | | |
| HEMBB1002232 | 1.15 | 1.4 | 2.24 | 2.14 | 5.79 | 3.03 | | |
| HEMBB1002245 | 0.86 | 0.84 | 2.34 | 1.53 | 2.47 | 1.05 | | |
| HEMBB1002247 | 1.72 | 0.59 | 2.44 | 1.38 | 2.24 | 1.03 | | |
| HEMBB1002249 | 2.65 | 1.64 | 3.1 | 3.39 | 4.08 | 4.01 | * | + |
| HEMBB1002254 | 1.35 | 1.35 | 3.83 | 2.64 | 3.27 | 2.86 | | |
| HEMBB1002255 | 0.99 | 1.37 | 2.6 | 1.19 | 2.93 | 1.4 | | |
| HEMBB1002266 | 1.33 | 0.83 | 2.07 | 0.73 | 1.99 | 0.54 | | |
| HEMBB1002271 | 14.89 | 9.5 | 29.42 | 32.9 | 41.53 | 37.28 | * | + |
| HEMBB1002280 | 1.62 | 0.78 | 1.6 | 1.55 | 2.93 | 1.12 | | |
| HEMBB1002296 | 11.83 | 12.31 | 18.29 | 31.87 | 21.06 | 23.09 | * | + |
| HEMBB1002300 | 0.78 | 2.31 | 3.48 | 1.49 | 4.63 | 3.12 | | |
| HEMBB1002302 | 1.17 | 2.17 | 3.26 | 2.49 | 4.76 | 3.04 | | |
| HEMBB1002306 | 1.83 | 1.96 | 4.28 | 2.91 | 4.34 | 2.6 | | |
| HEMBB1002316 | 0.66 | 1.38 | 2.36 | 1.19 | 2.9 | 0.97 | | |
| HEMBB1002326 | 0.93 | 1.68 | 4.52 | 4.35 | 4.41 | 3.9 | | |
| HEMBB1002327 | 0.99 | 0.99 | 2.66 | 1.46 | 2.95 | 2.06 | | |
| HEMBB1002329 | 2.89 | 3 | 3.81 | 6.39 | 5.88 | 5.53 | ** | + |
| HEMBB1002340 | 0.6 | 1.8 | 2.05 | 2.29 | 3.38 | 2.22 | | |
| HEMBB1002342 | 8.12 | 9.23 | 14.09 | 21.68 | 18.15 | 18.03 | * | + |
| HEMBB1002358 | 1.09 | 3.22 | 6.37 | 6.52 | 7.91 | 9.2 | | |
| HEMBB1002359 | 1.09 | 2.55 | 4.29 | 4.66 | 5.4 | 3.54 | | |
| HEMBB1002364 | 1.28 | 1.82 | 2.33 | 3.17 | 5.15 | 3.11 | | |
| HEMBB1002366 | 13.63 | 21.17 | 32.35 | 56.28 | 57.48 | 53.09 | ** | + |
| HEMBB1002371 | 0.83 | 0.63 | 1.72 | 2.32 | 2.82 | 2.1 | * | + |
| HEMBB1002381 | 0.97 | 1.16 | 1.74 | 2.83 | 3.16 | 6.26 | | |
| HEMBB1002383 | 1.07 | 3.17 | 4.18 | 3.1 | 4.5 | 4.37 | | |
| HEMBB1002387 | 0.98 | 2.36 | 2.68 | 2.09 | 3.68 | 2.96 | | |
| HEMBB1002409 | 6.85 | 7.27 | 46.98 | 69.94 | 70.04 | 64.2 | * | + |
| HEMBB1002413 | 3.92 | 2.99 | 8.34 | 9.46 | 8.16 | 10.16 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1002415 | 0.84 | 1.28 | 2.79 | 2.36 | 3.49 | 2.11 | | |
| HEMBB1002424 | 1.04 | 1.17 | 1.63 | 2.89 | 3.04 | 2.66 | ** | + |
| HEMBB1002425 | 1.12 | 1.69 | 5.86 | 6.46 | 10.1 | 5.26 | | |
| HEMBB1002427 | 1.5 | 1.59 | 2.32 | 3.72 | 7.82 | 3.65 | | |
| HEMBB1002442 | 2.29 | 1.57 | 4.33 | 4.99 | 8.58 | 8.89 | * | + |
| HEMBB1002447 | 2.61 | 2.7 | 5.56 | 6.1 | 6.6 | 5.63 | | |
| HEMBB1002453 | 2.5 | 2.48 | 6.56 | 6.31 | 7.55 | 5.25 | | |
| HEMBB1002457 | 1.54 | 2.08 | 4.77 | 3.69 | 4.61 | 4.8 | | |
| HEMBB1002458 | 0.48 | 1.53 | 2.5 | 2.2 | 2.35 | 1.66 | | |
| HEMBB1002463 | 1.36 | 1.84 | 6.55 | 6.24 | 6.11 | 8.87 | | |
| HEMBB1002465 | 1.12 | 1.18 | 2.4 | 2.86 | 2.25 | 1.59 | | |
| HEMBB1002477 | 0.71 | 0.66 | 4.43 | 3 | 4.39 | 4.86 | | |
| HEMBB1002479 | 22.08 | 21.58 | 27.54 | 16.12 | 19.41 | 17.27 | * | − |
| HEMBB1002489 | 0.86 | 3.02 | 3.9 | 5.73 | 5.51 | 7.68 | * | + |
| HEMBB1002492 | 1.27 | 1.23 | 3.07 | 3.53 | 4.08 | 3.39 | * | + |
| HEMBB1002495 | 1.85 | 1.85 | 3.2 | 2.61 | 5.02 | 3.98 | | |
| HEMBB1002502 | 0.94 | 2.52 | 2.81 | 1.77 | 4.83 | 3.27 | | |
| HEMBB1002509 | 0.73 | 1.8 | 2.65 | 2.03 | 2.43 | 1.27 | | |
| HEMBB1002510 | 0.49 | 1.68 | 3.06 | 1.78 | 2.5 | 0.81 | | |
| HEMBB1002520 | 1.46 | 2.47 | 5.44 | 6.62 | 7.57 | 8.61 | * | + |
| HEMBB1002522 | 0.82 | 1.88 | 4.4.22 | 31 | 6.8 | 2.07 | | |
| HEMBB1002527 | 11.47 | 13.79 | 12.46 | 24.19 | 10.37 | 17.52 | | |
| HEMBB1002530 | 1.43 | 2.15 | 3.44 | 2.93 | 4.92 | 2.26 | | |
| HEMBB1002531 | 0.46 | 1.32 | 2.04 | 1.23 | 2.99 | 0.35 | | |
| HEMBB1002534 | 1.35 | 2.27 | 2.73 | 4.54 | 4.08 | 3.92 | ** | + |
| HEMBB1002536 | 6.58 | 5.93 | 46.38 | 45.93 | 63.71 | 42.88 | | |
| HEMBB1002544 | 3.91 | 3.45 | 6.89 | 6.79 | 7.87 | 7.99 | | |
| HEMBB1002545 | 0.92 | 2.76 | 2.83 | 3.21 | 4.15 | 4.29 | | |
| HEMBB1002550 | 1.32 | 1.69 | 1.86 | 2.99 | 4.68 | 2.42 | | |
| HEMBB1002556 | 2.9 | 3.54 | 9.69 | 8.73 | 8.12 | 10.62 | | |
| HEMBB1002571 | 17.25 | 14.03 | 19.8 | 21.91 | 16.59 | 24.61 | | |
| HEMBB1002579 | 3.32 | 2.05 | 4.87 | 4.38 | 6.6 | 6.39 | | |
| HEMBB1002582 | 1.79 | 2.11 | 5.59 | 5.77 | 6.47 | 5.63 | | |
| HEMBB1002584 | 2.82 | 1.94 | 6.09 | 3.94 | 4.67 | 3.62 | | |
| HEMBB1002587 | 6.39 | 5.82 | 10.63 | 11.3 | 9.04 | 9.94 | | |
| HEMBB1002590 | 1.6 | 3.07 | 7.46 | 5.86 | 7.3 | 5.84 | | |
| HEMBB1002596 | 1.5 | 2.01 | 3.17 | 5.59 | 4.94 | 4.21 | * | + |
| HEMBB1002600 | 1.55 | 2.72 | 3.81 | 5.02 | 7.18 | 3.93 | | |
| HEMBB1002601 | 1.28 | 2.23 | 3.9 | 2.51 | 5.59 | 2.99 | | |
| HEMBB1002603 | 2.37 | 1.64 | 5.48 | 3.53 | 6.59 | 5.6 | | |
| HEMBB1002607 | 1.48 | 1.15 | 4.34 | 2.59 | 4.26 | 2.99 | | |
| HEMBB1002610 | 1.2 | 0.96 | 3.48 | 1.95 | 3.79 | 3.45 | | |
| HEMBB1002613 | 0.96 | 2.41 | 4.31 | 3.98 | 5.39 | 3.72 | | |
| HEMBB1002614 | 3.18 | 3.34 | 5.35 | 3.87 | 6.08 | 9.76 | | |
| HEMBB1002615 | 1.47 | 3.29 | 4.63 | 2.45 | 3.83 | 2.67 | | |
| HEMBB1002617 | 0.67 | 3.09 | 2.88 | 2.1 | 3.34 | 3.4 | | |
| HEMBB1002623 | 2.31 | 3.63 | 4.36 | 3.96 | 6.28 | 5.91 | | |
| HEMBB1002624 | 2.7 | 1.56 | 7.52 | 7.96 | 8.72 | 8.3 | | |
| HEMBB1002631 | 1.65 | 2 | 4.28 | 2.14 | 3.72 | 1.74 | | |
| HEMBB1002635 | 1.84 | 1.74 | 3.55 | 3.31 | 3.64 | 3.56 | | |
| HEMBB1002644 | 7.22 | 9.04 | 15.98 | 18.52 | 23.94 | 22.55 | * | + |
| HEMBB1002654 | 5.22 | 4.21 | 7.77 | 7.92 | 7.33 | 11.74 | | |
| HEMBB1002661 | 1.93 | 2.16 | 3.96 | 1.99 | 4.13 | 5.33 | | |
| HEMBB1002663 | 1.59 | 1.8 | 3.85 | 5.45 | 5.58 | 5.17 | * | + |
| HEMBB1002664 | 1.28 | 2.4 | 4.43 | 5.05 | 9.22 | 6.76 | * | + |
| HEMBB1002677 | 1.88 | 1.83 | 1.86 | 1.81 | 4.79 | 2.34 | | |
| HEMBB1002683 | 2.68 | 2.21 | 9.21 | 5.67 | 5.9 | 8.45 | | |
| HEMBB1002684 | 1.71 | 0.81 | 2.53 | 1.92 | 2.74 | 2.63 | | |
| HEMBB1002686 | 1.23 | 1.39 | 2.88 | 1.45 | 3.37 | 1.64 | | |
| HEMBB1002692 | 0.99 | 1.4 | 1.87 | 2.5 | 2.53 | 2.98 | * | + |
| HEMBB1002693 | 1.75 | 1.75 | 4.12 | 5.03 | 5.74 | 3.46 | | |
| HEMBB1002697 | 1.09 | 2.8 | 2.73 | 4.17 | 5.58 | 5.34 | * | + |
| HEMBB1002699 | 1.59 | 2.27 | 4.93 | 4.72 | 6.74 | 6.97 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| HEMBB1002702 | 1.63 | 1.5 | 2.54 | 1.76 | 3.25 | 3.33 | | |
| HEMBB1002705 | 4.2 | 2.84 | 6.79 | 8.83 | 8.26 | 7.92 | * | + |
| HEMBB1002712 | 8.55 | 1.32 | 2.38 | 2.92 | 4.06 | 1.4 | | |
| IMR321000028 | 1.03 | 1.71 | 2.88 | 1.63 | 2.76 | 1.63 | | |
| IMR321000031 | 1.71 | 2.59 | 3.51 | 5.86 | 4.35 | 5.31 | * | + |
| IMR321000034 | 21.95 | 15.41 | 30.37 | 33.73 | 19.59 | 34.65 | | |
| IMR321000039 | 5.81 | 7.11 | 14.41 | 14.72 | 15.71 | 13.99 | | |
| IMR321000044 | 0.81 | 2.37 | 1.44 | 1.01 | 3.26 | 2.06 | | |
| IMR321000063 | 79.52 | 80.12 | 127.61 | 224.23 | 199.69 | 128.8 | | |
| IMR321000085 | 21.02 | 18.07 | 26.38 | 30.28 | 48.13 | 47.89 | * | + |
| IMR321000089 | 1.51 | 1.42 | 3.86 | 3 | 6.7 | 5.84 | | |
| IMR321000091 | 4.79 | 2.91 | 6.5 | 8.35 | 11.38 | 8.55 | * | + |
| LIVER1000004 | 8.04 | 9.67 | 34.15 | 55.9 | 56.53 | 48.86 | * | + |
| LIVER1000008 | 1.13 | 1.36 | 3.06 | 1.68 | 4 | 2.17 | | |
| LIVER1000011 | 3.03 | 5.9 | 26.65 | 37.8 | 54.37 | 45.77 | * | + |
| LIVER1000022 | 2.75 | 3.66 | 7.75 | 9.39 | 9.82 | 9.17 | * | + |
| LIVER1000025 | 1.78 | 2.77 | 5.47 | 9.83 | 10.83 | 7.7 | * | + |
| LIVER1000030 | 1.05 | 0.96 | 2.12 | 2.04 | 2.56 | 1.23 | | |
| LIVER1000045 | 1.33 | 1.37 | 3.11 | 5.11 | 5.12 | 5.89 | ** | + |
| LIVER1000046 | 1.01 | 1.53 | 3.86 | 4.14 | 7.82 | 5.34 | | |
| LIVER1000072 | 1.61 | 1.26 | 5.23 | 12.42 | 9.54 | 12.21 | ** | + |
| LIVER1000077 | 0.33 | 1.79 | 1.97 | 1.87 | 2.84 | 3.14 | | |
| LIVER1000080 | 1.53 | 3 | 5.81 | 5.96 | 4.24 | 5.41 | | |
| LIVER1000086 | 6.38 | 7.69 | 47.4 | 69.84 | 79.87 | 70.57 | * | + |
| LIVER1000092 | 1.6 | 1.46 | 3.09 | 3.85 | 3.83 | 2.41 | | |
| LIVBR1000095 | 0.91 | 2.31 | 2.56 | 2.16 | 2.46 | 1.55 | | |
| LIVER1000097 | 1.26 | 0.74 | 2.49 | 2.18 | 2.84 | 2.25 | | |
| LIVER1000098 | 0.43 | 1.37 | 2.57 | 2.76 | 3.95 | 2.29 | | |
| LIVER1000100 | 3.3 | 2.82 | 5.82 | 4.99 | 7.44 | 3.74 | | |
| LIVER100Q101 | 0.36 | 1.81 | 2.4 | 1.69 | 4.25 | 2.74 | | |
| LIVER1000106 | 0.83 | 1.95 | 1.79 | 0.97 | 2.8 | 1.29 | | |
| LIVER1000108 | 1.36 | 2.93 | 4.31 | 4.35 | 4.12 | 3.43 | | |
| LIVER1000115 | 1.12 | 1.57 | 4.32 | 6.38 | 6.13 | 6.9 | * | + |
| LIVER1000120 | 1.45 | 0.95 | 2.23 | 1.39 | 1.46 | 0.73 | | |
| LIVER1000138 | 0.6 | 1.27 | 1.86 | 2.11 | 2.36 | 1.6 | | |
| LIVER1000146 | 1.38 | 2.69 | 6.24 | 7.17 | 7.01 | 7.02 | | |
| LIVER1000148 | 0.88 | 1.24 | 2.65 | 1.68 | 5.68 | 3.51 | | |
| L1VER1000157 | 30.11 | 26.71 | 67.66 | 123.41 | 85.61 | 124.96 | * | + |
| LIVER1000161 | 1.3 | 1.59 | 2.3 | 1.73 | 3.37 | 1.84 | | |
| LIVER1000167 | 3.07 | 3.63 | 14.08 | 20.36 | 22.31 | 21.82 | * | + |
| LIVER1000174 | 1.53 | 1.68 | 1.84 | 2.1 | 3.43 | 1.29 | | |
| LIVER1000185 | 2.42 | 2.55 | 5.16 | 4.37 | 4.72 | 4.23 | | |
| LIVER1000187 | 0.96 | 1.55 | 4.84 | 6.64 | 4.17 | 3.5 | | |
| LIVER1000190 | 3.77 | 3.48 | 5.95 | 4.71 | 6.24 | 4.47 | | |
| LIVER1000192 | 2.37 | 2.92 | 3.93 | 4.1 | 5.23 | 4.04 | | |
| MAMMA1000009 | 1.39 | 2.55 | 5.12 | 3.62 | 4.72 | 3.46 | | |
| MAMMA1000015 | 1.72 | 1.59 | 4.78 | 5.23 | 4.42 | 6.42 | | |
| MAMMA1000019 | 0.69 | 2.48 | 3.4 | 4.27 | 4.81 | 3.1 | | |
| MAMMA1000020 | 2.79 | 2.35 | 5.63 | 6 | 7.86 | 5.75 | | |
| MAMMA1000024 | 0.65 | 1.76 | 3.79 | 2.42 | 2.91 | 1.61 | | |
| MAMMA1000025 | 1.92 | 2.56 | 6.92 | 4.96 | 6.72 | 5.6 | | |
| MAMMA1000043 | 1.06 | 2.36 | 6.43 | 6.93 | 8.22 | 6.6 | | |
| MAMMA1000045 | 1.38 | 2.01 | 4.84 | 2.68 | 3.96 | 2.89 | | |
| MAMMA1000046 | 1.74 | 2.44 | 3.18 | 2.88 | 4.5 | 2.37 | | |
| MAMMA1000055 | 8.51 | 8.71 | 9.57 | 9.38 | 10.74 | 9.36 | | |
| MAMMA1000057 | 4.4 | 3.29 | 7.56 | 8.38 | 9.78 | 8.16 | | |
| MAMMA1000060 | 26.78 | 24.3.34 | 5.25 | 48.69 | 33.84 | 48.6 | | |
| MAMMA1000069 | 2.13 | 1.65 | 4.1 | 3.43 | 3.1.42 | 41 | | |
| MAMMA1000084 | 2.88 | 3 | 5.81 | 5.64 | 8.15 | 7.51 | | |
| MAMMA1000085 | 2.75 | 3.74 | 7.02 | 6.45 | 5.82 | 6.97 | | |
| MAMMA1000092 | 1.45 | 2.97 | 3.8 | 4.64 | 5.15 | 4.55 | * | + |
| MAMMA1000096 | 4.45 | 4.96 | 9.29 | 8.15 | 9.11 | 6.09 | | |
| MAMMA1000097 | 2.4 | 2.96 | 3.86 | 5.93 | 6.01 | 6.97 | ** | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1000102 | 1.94 | 1.59 | 4.27 | 4.25 | 6.16 | 4.44 | | |
| MAMMA1000103 | 1.52 | 1.65 | 5 | 2.39 | 4.56 | 2.83 | | |
| MAMMA1000106 | 1.25 | 2.15 | 5.1 | 2.3 | 4.48 | 3.27 | | |
| MAMMA1000117 | 1.19 | 2.12 | 3.72 | 1.84 | 3.32 | 2.77 | | |
| MAMMA1000118 | 1.03 | 2.06 | 3.08 | 3.38 | 3.21 | 4.56 | | |
| MAMMA1000129 | 1.06 | 2.1 | 2.97 | 1.73 | 2.7 | 1.31 | | |
| MAMMA1000133 | 1.09 | 1.96 | 3.67 | 2.8 | 3.87 | 2.02 | | |
| MAMMA1000134 | 1.23 | 2.08 | 4.28 | 2.27 | 4.61 | 1.93 | | |
| MAMMA1000139 | 1.45 | 1.91 | 2.69 | 2.13 | 3.98 | 1.85 | | |
| MAMMA1000141 | 1.97 | 2.27 | 5.47 | 3.67 | 3.61 | 3.42 | | |
| MAMMA1000143 | 1.66 | 1.1 | 2.55 | 3.83 | 3.52 | 1.74 | | |
| MAMMA1000150 | 4.11 | 4.95 | 8.99 | 6.49 | 6.4 | 8.66 | | |
| MAMMA1000155 | 1.87 | 2.71 | 4.35 | 5.46 | 5.69 | 6.41 | * | + |
| MAMMA1000163 | 1.65 | 2.82 | 2.62 | 3.45 | 4.54 | 4.97 | * | + |
| MAMMA1000171 | 1.96 | 2.43 | 5.53 | 4.12 | 6.52 | 4.97 | | |
| MAMMA1000173 | 3.5 | 5.27 | 10.33 | 17.47 | 17.44 | 18.26 | ** | + |
| MAMMA1000175 | 1.58 | 1.8 | 2.89 | 4.06 | 5.14 | 3.7 | * | + |
| MAMMA1000183 | 1.14 | 2.12 | 5.29 | 3.92 | 4.7 | 4.91 | | |
| MAMMA1000191 | 3.25 | 3.34 | 14.68 | 12.56 | 14.7 | 18.23 | | |
| MAMMA1000192 | 5.76 | 8.53 | 9.67 | 16.66 | 19.91 | 17.65 | ** | + |
| MAMMA1000193 | 1.68 | 1.54 | 0.86 | 1.33 | 2.25 | 1.94 | | |
| MAMMA1000198 | 1.88 | 1.99 | 5.53 | 4.44 | 6.49 | 5.57 | | |
| MAMMA1000204 | 1.75 | 2.25 | 3.39 | 3.56 | 4.13 | 2.85 | | |
| MAMMA1000207 | 1 | 3.2 | 3.41 | 2.86 | 4.96 | 3.47 | | |
| MAMMA1000214 | 1.76 | 2.08 | 3.68 | 2.84 | 4.42 | 4.74 | | |
| MAMMA1000220 | 6.19 | 6.12 | 11.61 | 12.49 | 18.06 | 16.72 | * | + |
| MAMMA1000221 | 0.57 | 1.04 | 1.68 | 1.14 | 4.51 | 0.87 | | |
| MAMMA1000226 | 0.48 | 1.06 | 2.07 | 1.49 | 3.19 | 1.88 | | |
| MAMMA1000227 | 0.93 | 1.23 | 1.6 | 2.73 | 3.67 | 3.46 | ** | + |
| MAMMA1000230 | 1 | 1.23 | 1.77 | 2.38 | 3.04 | 2.94 | ** | + |
| MAMMA1000241 | 2.9 | 2.2 | 4.19 | 7.24 | 5.8 | 7.61 | ** | + |
| MAMMA1000245 | 76.63 | 70.15 | 118.95 | 141.45 | 166.09 | 104.88 | | |
| MAMMA1000248 | 6.79 | 4.17 | 13.48 | 13.18 | 13.4.41 | 8.8 | | |
| MAMMA1000251 | 1.68 | 1.72 | 4.7 | 5.55 | 5.39 | 5.29 | | |
| MAMMA1000254 | 1.24 | 1.22 | 3.59 | 2.14 | 5.61 | 5.02 | | |
| MAMMA1000257 | 5.39 | 2.6.22 | 5.06 | 32.2 | 43.78 | 35.79 | * | + |
| MAMMA1000262 | 15.48 | 9.75 | 18.2 | 40.81 | 33.23 | 34.89 | ** | + |
| MAMMA1000264 | 0.99 | 1.2 | 2.3 | 4.43 | 2.57 | 3.4 | * | + |
| MAMMA1000266 | 1.25 | 0.79 | 2.73 | 4.21 | 5.33 | 4.03 | * | + |
| MAMMA1000270 | 2.43 | 1.94 | 4.57 | 6.16 | 7.16 | 7.58 | * | + |
| MAMMA1000271 | 6.01 | 3.26 | 8.54 | 8.94 | 6.17 | 8.1 | | |
| MAMMA1000277 | 0.89 | 0.93 | 2.56 | 2.46 | 2.75 | 2.09 | | |
| MAMMA1000278 | 1.84 | 2.01 | 4.29 | 2.18 | 5.06 | 3.51 | | |
| MAMMA1000279 | 1.82 | 1.74 | 4.33 | 3.51 | 5.72 | 4.35 | | |
| MAMMA1000283 | 0.99 | 1.51 | 2.36 | 1.37 | 2.66 | 2.71 | | |
| MAMMA1000284 | 2.65 | 2.51 | 8.31 | 6.28 | 8.49 | 8.01 | | |
| MAMMA1000287 | 1.58 | 2.13 | 6.27 | 5.55 | 6.94 | 7.1 | | |
| MAMMA1000294 | 4.72 | 5.45 | 9.44 | 3.84 | 8.21 | 4.74 | | |
| MAMMA1000298 | 0.87 | 1.36 | 2.51 | 1.55 | 3.1 | 0.95 | | |
| MAMMA1000302 | 0.9 | 1.18 | 4.73 | 2.22 | 4.9 | 2.56 | | |
| MAMMA1000303 | 0.92 | 1.62 | 2.63 | 4.16 | 4.06 | 3.22 | * | + |
| MAMMA1000305 | 1.07 | 1.28 | 2.73 | 2.47 | 2.74 | 2.1 | | |
| MAMMA1000307 | 2.29 | 3.03 | 9.61 | 15.85 | 14.04 | 14.38 | * | + |
| MAMMA1000309 | 0.57 | 1.61 | 3.69 | 4.6 | 3.65 | 4.61 | | |
| MAMMA1000312 | 3.55 | 4.99 | 8.08 | 6.19 | 5.18 | 6.55 | | |
| MAMMA1000313 | 1.06 | 2.31 | 2.34 | 1.79 | 3.98 | 3.43 | | |
| MAMMA1000331 | 1.08 | 1.65 | 3 | 3.33 | 6.01 | 3.21 | | |
| MAMMA1000335 | 7.38 | 9.1 | 14.27 | 19.49 | 16.28 | 16.92 | * | + |
| MAMMA1000339 | 0.33 | 0.39 | 2.17 | 1.46 | 2.09 | 0.66 | | |
| MAMMA1000340 | 1.43 | 1.33 | 4.12 | 4.37 | 2.72 | 2.15 | | |
| MAMMA1000348 | 1.2 | 1.27 | 4.6 | 3.14 | 4.82 | 6.11 | | |
| MAMMA1000356 | 1.93 | 2.21 | 4.93 | 3.08 | 5.42 | 6.29 | | |
| MAMMA1000358 | 2.93 | 3.97 | 5.02 | 7.42 | 7.47 | 4.9 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1000360 | 1.41 | 1.92 | 4.6 | 3.76 | 5.2 | 4.63 | | |
| MAMMA1000361 | 2.2 | 3.45 | 8.9 | 8.94 | 10.67 | 8.93 | | |
| MAMMA1000363 | 1.09 | 1.69 | 3.86 | 1.87 | 4.37 | 4.1 | | |
| MAMMA1000370 | 0.92 | 0.71 | 1.76 | 2.02 | 2.62 | 2.57 | * | + |
| MAMMA1000371 | 2.09 | 1.73 | 6.35 | 10.02 | 12.1 | 10.1 | * | + |
| MAMMA1000372 | 4.45 | 4.1 | 12.88 | 12.01 | 12.92 | 11.97 | | |
| MAMMA1000385 | 1.79 | 2.36 | 6.41 | 6.41 | 7.66 | 8.72 | | |
| MAMMA1000388 | 1.93 | 3.02 | 6.03 | 4.7 | 4.53 | 5.06 | | |
| MAMMA1000395 | 1.3 | 2.46 | 3.12 | 1.69 | 3.49 | 0.8 | | |
| MAMMAJO00402 | 1.69 | 1.68 | 5.62 | 3.33 | 4.35 | 4.63 | | |
| MAMMA1000403 | 1.7 | 2.36 | 5.05 | 5.45 | 5.81 | 3.96 | | |
| MAMMA1000410 | 0.87 | 1.25 | 2.71 | 3.23 | 3.35 | 3.25 | * | + |
| MAMMA1000413 | 1.52 | 0.47 | 2.48 | 3.51 | 3.76 | 3.61 | * | + |
| MAMMA1000414 | 1.08 | 1.53 | 3.03 | 2.94 | 4.91 | 1.81 | | |
| MAMMA1000416 | 3.3 | 4.01 | 10.2 | 15.8 | 23.14 | 20.47 | * | + |
| MAMMA1000421 | 2.61 | 2.83 | 6.11 | 7.7 | 7.42 | 7.09 | * | + |
| MAMMA1000422 | 2.83 | 2.53 | 7.46 | 9.18 | 6.64 | 12.05 | | |
| MAMMA1000423 | 1.7 | 1.26 | 6 | 5.9 | 6.62 | 5.89 | | |
| MAMMA1000424 | 0.88 | 1.7 | 3.17 | 1.91 | 2.38 | 1.07 | | |
| MAMMA1000429 | 8.73 | 10.07 | 13.78 | 14.98 | 16.3 | 11.17 | | |
| MAMMA1000431 | 1.6 | 1.27 | 4.27 | 5.22 | 6.32 | 4.26 | | |
| MAMMA1000432 | 1.05 | 2.33 | 2.85 | 2.63 | 2.82 | 1.41 | | |
| MAMMA1000437 | 4.61 | 4.75 | 8.44 | 10.54 | 11.52 | 8.12 | | |
| MAMMA1000444 | 2.53 | 4.15 | 8.55 | 7.55 | 10.17 | 10.13 | | |
| MAMNA1000446 | 1.19 | 2.07 | 3.87 | 2.03 | 3.63 | 2.49 | | |
| MAMMA1000449 | 1.77 | 1.59 | 3.54 | 3.37 | 4.31 | 3.22 | | |
| MAMMA1000457 | 4.44 | 4.82 | 7.12 | 7.2 | 6.88 | 6.22 | | |
| MAMMA1000458 | 1.27 | 2.22 | 4.83 | 2.52 | 4.03 | 1.94 | | |
| MAMMA1000468 | 0.55 | 1.12 | 2.2 | 0.51 | 2.25 | 1.16 | | |
| MAMMA1000472 | 1.15 | 2.3 | 4.42 | 4.77 | 6.36 | 5.79 | * | + |
| MAMMA1000473 | 1.95 | 1.72 | 3.59 | 3.45 | 5.46 | 3.17 | | |
| MAMMA1000477 | 3.86 | 3.29 | 5.67 | 8.71 | 9.92 | 7.97 | ** | + |
| MAMMA1000478 | 2.85 | 3.26 | 7.41 | 5.76 | 9.1 | 7.57 | | |
| MAMMA1000483 | 4.16 | 3.16 | 8.3 | 8.09 | 6.5 | 8.63 | | |
| MAMMA1000490 | 1.65 | 2.61 | 3.68 | 2.66 | 4.96 | 2.14 | | |
| MAMNA1000496 | 1.18 | 1.7 | 3.44 | 1.3 | 3.79 | 2.01 | | |
| MAMMA1000500 | 0.68 | 1.79 | 3.22 | 1.41 | 3.2 | 2.86 | | |
| MAMMA1000501 | 3.04 | 3.89 | 7.86 | 13.71 | 15.02 | 12.51 | ** | + |
| MAMMA1000503 | 0.84 | 2.08 | 2.21 | 3.52 | 3.52 | 2.27 | | |
| MAMMA1000506 | 10.14 | 8.79 | 32.66 | 34.77 | 26.7 | 18.31 | | |
| MAMMA1000510 | 3.24 | 3.5 | 4.59 | 10.97 | 10.76 | 13.61 | ** | + |
| MAMMA1000515 | 2.12 | 1.54 | 4.56 | 5.97 | 7.55 | 6.2 | * | + |
| MAMMA1000516 | 2.18 | 2.4 | 6.29 | 3.89 | 3.85 | 5.07 | | |
| MAMMA1000522 | 1.04 | 1.47 | 4.39 | 2.4 | 3.68 | 1.85 | | |
| MAMNA1000524 | 2.04 | 2.09 | 3.53 | 3.82 | 6.18 | 3.96 | | |
| MAMMA1000528 | 3.74 | 2.72 | 2.05 | 2.7 | 4.09 | 2.88 | | |
| MAMMA1000534 | 0.91 | 2.35 | 2.11 | 1.86 | 2.91 | 2.04 | | |
| MAMMA1000541 | 2.85 | 3.16 | 11.29 | 11.22 | 8.81 | 12.04 | | |
| MAMMA1000550 | 1.21 | 2.73 | 1.86 | 2.46 | 6.65 | 4.64 | | |
| MAMMA1000556 | 1.78 | 1.32 | 4.25 | 2.66 | 3.37 | 1.4 | | |
| MAMMA1000559 | 1.32 | 1.49 | 5.56 | 2.92 | 4.2 | 3.46 | | |
| MAMMA1000565 | 1.82 | 2.74 | 3.93 | 2.13 | 4.18 | 4.22 | | |
| MAMMA1000567 | 0.99 | 2.16 | 3.77 | 2.3 | 4.07 | 3.64 | | |
| MAMMA1000576 | 3.72 | 3.12 | 13.12 | 10.45 | 9.76 | 10.02 | | |
| MAMMA1000582 | 2.07 | 2.7 | 5.64 | 4.13 | 4.81 | 6.31 | | |
| MAMMA1000583 | 1.16 | 2.33 | 2.45 | 2.19 | 4.47 | 2.93 | | |
| MAMMA1000585 | 1.66 | 2.04 | 4.19 | 3.82 | 5.38 | 3.23 | | |
| MAMMA1000587 | 1.64 | 1.51 | 3.73 | 3.12 | 5.07 | 3.49 | | |
| MAMMA1000591 | 0.96 | 1.34 | 3.11 | 1.45 | 3.74 | 1.72 | | |
| MAMMA1000594 | 2.3 | 1.76 | 4.92 | 3.55 | 7.68 | 5.16 | | |
| MAMMA1000597 | 4.42 | 3.09 | 9.64 | 9.46 | 9.63 | 10.35 | | |
| MAMMA1000605 | 2.84 | 3.94 | 11.44 | 18.34 | 15.85 | 17.89 | * | + |
| MAMMA1000612 | 1.91 | 2.15 | 5.22 | 3.85 | 4.33 | 4.95 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1000614 | 3.11 | 2.71 | 9.4 | 7.48 | 6.07 | 6.34 | | |
| MAMMA1000616 | 1.66 | 1.79 | 2.44 | 2.1 | 5.09 | 3.45 | | |
| MAMMA1000621 | 1.39 | 1.67 | 3.36 | 3.15 | 6.31 | 7.02 | | |
| MAMMA1000623 | 1.08 | 1.04 | 3.83 | 0.92 | 2.66 | 2.3 | | |
| MAMMA1000625 | 7.39 | 6.32 | 23.76 | 19.68 | 25.39 | 29.8 | | |
| MAMMA1000635 | 0.89 | 0.68 | 1.61 | 0.76 | 1.75 | 0.64 | | |
| MAMMA1000643 | 1.47 | 1.11 | 1.94 | 4.21 | 3.77 | 6.82 | * | + |
| MAMMA1000646 | 4.68 | 3.61 | 9.55 | 17.22 | 16.4 | 16.44 | ** | + |
| MAMMA1000652 | 1.98 | 1.61 | 3.56 | 4.21 | 5.34 | 5.24 | * | + |
| MAMMA1000657 | 2.28 | 1.78 | 4.51 | 2.18 | 4.48 | 3.26 | | |
| MAMMA1000664 | 1.78 | 1.49 | 5.35 | 2.9 | 6.43 | 6.85 | | |
| MAMMA1000667 | 1.24 | 1.68 | 2.17 | 1.96 | 5.64 | 2.41 | | |
| MAMMA1000668 | 0.71 | 1.11 | 3.23 | 2.44 | 3.76 | 1.74 | | |
| MAMMA1000669 | 0.76 | 0.97 | 2.01 | 0.9 | 3.94 | 2.06 | | |
| MAMMA1000670 | 3.27 | 2.78 | 4.47 | 10.4 | 6.73 | 9.28 | * | + |
| MAMMA1000672 | 1.71 | 3.23 | 6.88 | 5.43 | 5.63 | 6.03 | | |
| MAMMA1000681 | 0.98 | 1.19 | 2.53 | 1.98 | 3.73 | 2.45 | | |
| MAMMA1000684 | 6.87 | 11.61 | 18.54 | 30.76 | 32.53 | 30.62 | ** | + |
| MAMMA1000696 | 1.64 | 3.39 | 4.99 | 7.89 | 14.39 | 8.69 | * | + |
| MAMMA1000702 | 3.12 | 3.07 | 5.9 | 7.47 | 10.05 | 7.55 | * | + |
| MAMMA1000706 | 0.63 | 1.07 | 1.79 | 1.08 | 1.52 | 0.66 | | |
| MAMMA1000707 | 0.74 | 1.26 | 1.76 | 0.83 | 1.87 | 0.63 | | |
| MAMMA1000713 | 1.53 | 2.14 | 5.33 | 5.43 | 5.8 | 6.96 | | |
| MAMMA1000714 | 1.19 | 1.84 | 4.31 | 2.64 | 4.96 | 4.94 | | |
| MAMMA1000718 | 1.32 | 2.79 | 4.84 | 5.53 | 7.12 | 4.37 | | |
| MAMMA1000720 | 1.33 | 2.19 | 5.14 | 4.95 | 8.51 | 5.44 | | |
| MAMMA1000723 | 1.22 | 1.65 | 4.17 | 3.26 | 4.81 | 3.68 | | |
| MAMMA1000731 | 1.24 | 1.17 | 3.11 | 3.04 | 4.99 | 3.26 | | |
| MAMMA1000732 | 1.37 | 1.59 | 3.02 | 4.86 | 6.5 | 6.05 | ** | + |
| MAMMA1000733 | 0.58 | 0.82 | 1.54 | 2.31 | 2.41 | 1.22 | | |
| MAMMA1000734 | 12.22 | 11.56 | 22.62 | 21.95 | 22.19 | 13.18 | | |
| MAMMA1000736 | 4.26 | 4.34 | 11.96 | 4.92 | 5.77 | 6.14 | | |
| MAMMA1000738 | 0.8 | 2.06 | 3.82 | 2.52 | 4.15 | 1.95 | | |
| MAMMA1000744 | 1.12 | 2 | 5.52 | 3.27 | 3.97 | 4.67 | | |
| MAMMA1000746 | 1 | 2.03 | 2.24 | 2.38 | 4.27 | 2.48 | | |
| MAMMA1000748 | 8.23 | 8.93 | 13.13 | 15.53 | 16.06 | 15.05 | * | |
| MAMMA1000751 | 10.46 | 7.63 | 32.43 | 45.16 | 40.03 | 54.65 | * | + |
| MAMMA1000752 | 1.5 | 2.37 | 8.68 | 11.52 | 14.2 | 12.68 | * | + |
| MAMMA1000757 | 1.89 | 2.48 | 5.54 | 7.9 | 8.53 | 10.86 | * | + |
| MAMMA1000760 | 3 | 2.99 | 6.77 | 4.65 | 8.01 | 7.12 | | |
| MAMMA1000761 | 1.86 | 2.58 | 5.73 | 4.87 | 6.29 | 4.99 | | |
| MAMMA1000775 | 1.37 | 1.83 | 4.43 | 3.23 | 4.29 | 2.64 | | |
| MAMMA1000776 | 2.37 | 2.36 | 6.3 | 6.57 | 7 | 6.12 | | |
| MAMMA1000778 | 2.14 | 2.28 | 5.19 | 4.95 | 3.99 | 3.84 | | |
| MAMMA1000781 | 1.33 | 1.33 | 3.06 | 2.82 | 2.86 | 1.23 | | |
| MAMMA1000782 | 1.94 | 2.36 | 3.88 | 2.93 | 3.11 | 3.01 | | |
| MAMMA1000784 | 1.28 | 1.58 | 3.94 | 2.22 | 7.2 | 3.64 | | |
| MAMMA1000788 | 3.05 | 4.31 | 4.38 | 4.16 | 5.12 | 2.21 | | |
| MAMMA1000798 | 1.01 | 2.86 | 2.77 | 2.03 | 3.56 | 2.1 | | |
| MAMMA1000802 | 4.36 | 3.71 | 8.23 | 17.49 | 15.39 | 19.2 | ** | + |
| MAMMA1000810 | 3.91 | 4.98 | 14.15 | 17.58 | 19.04 | 16.15 | * | |
| MAMMA1000813 | 1.63 | 2.11 | 3.73 | 2.82 | 3.15 | 2.06 | | |
| MAMMA1000814 | 2.56 | 2.97 | 7.82 | 7.28 | 7.26 | 6.61 | | |
| MAMMA1000824 | 12.58 | 11.27 | 34.16 | 62.44 | 72.28 | 50.62 | * | + |
| MAMMA1000827 | 1.83 | 2.04 | 5.05 | 3.3 | 4.77 | 4.31 | | |
| MAMMA1000831 | 1.45 | 2.81 | 2.84 | 2.55 | 5.43 | 1.85 | | |
| MAMMA1000838 | 6.85 | 9.27 | 7.86 | 13.01 | 8.4.31 | 4.52 | | |
| MAMMA1000839 | 4.89 | 4.41 | 9 | 9.02 | 8.66 | 14.04 | | |
| MAMMA1000841 | 1.33 | 2.02 | 3.11 | 2.23 | 4.44 | 2.29 | | |
| MAMMA1000842 | 2.48 | 1.88 | 3.59 | 3.03 | 3.74 | 1.82 | | |
| MAMMA1000843 | 1.26 | 2.19 | 3.88 | 2.26 | 4.43 | 2.35 | | |
| MAMMA1000845 | 0.83 | 1.01 | 2.4 | 2.35 | 3.88 | 1.24 | | |
| MAMMA1000851 | 1.3 | 3.42 | 5.35 | 7.83 | 5.9 | 6.65 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1000854 | 2.77 | 3.7 | 6.33 | 5.08 | 5.68 | 5.13 | | |
| MAMMA1000855 | 0.37 | 2.97 | 2.62 | 2.51 | 3.74 | 1.78 | | |
| MAMMA1000856 | 0.87 | 1.39 | 3.11 | 2.05 | 6.37 | 3.19 | | |
| MAMMA1000859 | 9.88 | 8.56 | 20.5 | 19.52 | 18.47 | 24.31 | | |
| MAMMA1000862 | 1.13 | 1.55 | 3.53 | 1.17 | 3.18 | 0.79 | | |
| MAMMA1000863 | 2.62 | 2.08 | 4.72 | 2.59 | 5.24 | 4.91 | | |
| MAMMA1000865 | 0.35 | 0.82 | 2.48 | 0.4 | 1.84 | 0.35 | | |
| MAMMA1000867 | 1.08 | 2.83 | 2.87 | 1.95 | 3.68 | 4.76 | | |
| MAMMA1000875 | 0.89 | 2.72 | 2.34 | 3.31 | 3.57 | 2.59 | | |
| MAMMA1000876 | 1.23 | 1.64 | 4.59 | 2.4 | 3.37 | 3.22 | | |
| MAMMA1000877 | 3.15 | 2.89 | 9.22 | 8.3.91 | 0.32 | 10.07 | | |
| MAMMA1000878 | 3.05 | 3.61 | 8.94 | 6.33 | 8.52 | 9.62 | | |
| MAMMA1000880 | 1.46 | 1.15 | 4.77 | 2.45 | 3.96 | 3.01 | | |
| MAMMA1000881 | 1.81 | 2.09 | 4.52 | 3.77 | 6.07 | 4.73 | | |
| MAMMA1000883 | 0.57 | 0.79 | 2.1 | 1.37 | 2.14 | 2.11 | | |
| MAMMA1000897 | 0.76 | 2.39 | 0.36 | 1.19 | 2.99 | 6.19 | | |
| MAMMA1000898 | 1.06 | 1.99 | 1.75 | 1.41 | 2.49 | 3.7 | | |
| MAMMA1000905 | 1.8 | 2.75 | 4.68 | 8.32 | 6.86 | 10.64 | * | + |
| MAMMA1000906 | 1.17 | 2.49 | 2.63 | 2.45 | 4.27 | 4.08 | | |
| MAMMA1000908 | 1.59 | 1.63 | 4.3 | 1.77 | 3.05 | 1.43 | | |
| MAMMA1000911 | 4.97 | 6.25 | 8.37 | 21.77 | 20.01 | 20.98 | ** | + |
| MAMMA1000914 | 1.14 | 0.85 | 2.41 | 1.1 | 2.23 | 1.61 | | |
| MAMMA1000920 | 1.99 | 2.17 | 4.41 | 10.82 | 10.67 | 9.11 | ** | + |
| MAMMA1000921 | 1.03 | 1.02 | 2.41 | 3.47 | 3.84 | 3.17 | * | + |
| MAMMA1000931 | 2.68 | 3.44 | 3.95 | 6.78 | 7.66 | 7.32 | ** | + |
| MAMMA1000940 | 1.67 | 1.84 | 6.05 | 5.78 | 6.84 | 6.3 | | |
| MAMMA1000941 | 3.74 | 2.55 | 8.61 | 9.01 | 10.11 | 9.46 | | |
| MAMMA1000942 | 2.75 | 1.85 | 7.46 | 8.27 | 8.47 | 7.2 | | |
| MAMMA1000943 | 2.16 | 2.84 | 10.49 | 9.04 | 11.08 | 8.74 | | |
| MAMMA1000952 | 2.6 | 1.93 | 8.65 | 9.03 | 7.47 | 6.75 | | |
| MAMMA1000956 | 0.93 | 1.24 | 3.11 | 3.64 | 3.1 | 3.47 | | |
| MAMMA1000957 | 2.5 | 1.41 | 2.62 | 4.81 | 5.73 | 6.85 | ** | + |
| MAMMA1000962 | 3.25 | 3.57 | 10.48 | 13.62 | 11.18 | 16.85 | * | + |
| MAMMA1000966 | 1.85 | 2.19 | 6.04 | 6.34 | 6.23 | 7.04 | | |
| MAMMA1000968 | 1.6 | 1.46 | 5.49 | 4.79 | 5.62 | 4.97 | | |
| MAMMA1000972 | 2.4 | 1.41 | 3.83 | 3.34 | 3.91 | 4.32 | | |
| MAMMA1000973 | 5.14 | 3.37 | 12.58 | 7.02 | 8.56 | 10.31 | | |
| MAMMA1000975 | 1.44 | 1.99 | 3.34 | 2.37 | 4.9 | 5.05 | | |
| MAMMA1000976 | 2.46 | 2.71 | 8.57 | 9.22 | 11.17 | 8.92 | | |
| MAMMA1000979 | 1.46 | 2.62 | 3.06 | 4.34 | 4.41 | 7.71 | | |
| MAMMA1000986 | 5.75 | 5.32 | 10.24 | 8.83 | 11.32 | 13.95 | | |
| MAMMA1000987 | 1.44 | 1.36 | 3.99 | 2.43 | 3.74 | 5.66 | | |
| MAMMA1000988 | 3.76 | 4.86 | 8.88 | 10.18 | 11.34 | 10.5 | * | + |
| MAMMA1000994 | 9.82 | 7.58 | 15.88 | 12.02 | 11.56 | 9.25 | | |
| MAMMA1000998 | 1.51 | 1.07 | 3.13 | 4.21 | 5.42 | 4.04 | * | + |
| MAMMA1001003 | 1.98 | 1.83 | 5.97 | 4.2 | 6.86 | 4.39 | | |
| MAMMA1001007 | 0.38 | 1.03 | 1.77 | 0.14 | 1.38 | 0.32 | | |
| MAMMA1001008 | 11.76 | 11.09 | 40.52 | 56.73 | 50.93 | 45.37 | * | + |
| MAMMA1001013 | 3.62 | 4.16 | 12.14 | 8.42 | 11.54 | 10.08 | | |
| MAMMA1001014 | 1.4 | 1.79 | 5.49 | 4.36 | 5.16 | 4.26 | | |
| MAMMA1001021 | 0.49 | 2.08 | 7.85 | 6.46 | 5.47 | 4.26 | | |
| MAMMA1001024 | 0.85 | 1.59 | 3.14 | 2.55 | 3.92 | 1.96 | | |
| MAMMA1001025 | 1.03 | 1.47 | 2.94 | 1.27 | 2.95 | 1.41 | | |
| MAMMA1001028 | 1.3 | 1.09 | 2.23 | 3.07 | 4.73 | 3.28 | * | + |
| MAMMA1001030 | 1.63 | 0.48 | 2.22 | 3.06 | 3.24 | 2.08 | | |
| MAMMA1001035 | 2.48 | 2.92 | 10.31 | 9.29 | 11.92 | 11.54 | | |
| MAMMA1001036 | 4.69 | 4.01 | 10.7 | 11.23 | 8.22 | 11.33 | | |
| MAMMA1001037 | 1.91 | 2.88 | 6.49 | 5.28 | 7.53 | 4.69 | | |
| MAMMA1001038 | 1.18 | 1.59 | 4.28 | 4.12 | 3.85 | 4.45 | | |
| MAMMA1001041 | 1.64 | 1.87 | 3.18 | 3.75 | 4.04 | 2.64 | | |
| MAMMA1001043 | 1.09 | 1.24 | 3.67 | 3.44 | 3.35 | 3.18 | | |
| MAMMA1001050 | 1.52 | 1.55 | 5.94 | 8.4 | 8.28 | 6.51 | * | + |
| MAMMA1001054 | 2.04 | 2.58 | 6.99 | 9.29 | 11.07 | 8.36 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1001059 | 2.66 | 4.71 | 9.73 | 8.85 | 9.72 | 8.46 | | |
| MAMMA1001066 | 3.64 | 2.97 | 12.26 | 14.08 | 12.09 | 8.96 | | |
| MAMMA1001067 | 1.26 | 2 | 4.77 | 3.53 | 5.33 | 3.29 | | |
| MAMMA1001072 | 1.44 | 2.06 | 7.76 | 6.38 | 7.13 | 7.2 | | |
| MAMMA1001073 | 1.17 | 0.79 | 1.47 | 1.49 | 2.74 | 1.34 | | |
| MAMMA1001074 | 0.78 | 1.47 | 3.97 | 6.24 | 5.4 | 4.9 | * | + |
| MAMMA1001075 | 4.87 | 4.41 | 10.48 | 11.24 | 9.82 | 8.21 | | |
| MAMMA1001078 | 1.7 | 1.83 | 7.96 | 9.69 | 9.99 | 9.37 | * | + |
| MAMMA1001080 | 3.77 | 3.93 | 6.97 | 8.7.11 | 0.33 | 5.57 | | |
| MAMMA1001082 | 1.51 | 2.03 | 4.03 | 1.73 | 5.23 | 1.6 | | |
| MAMMA1001091 | 1.17 | 1.36 | 2.02 | 1.81 | 3.03 | 1.47 | | |
| MAMMA1001092 | 1.93 | 2.09 | 4.81 | 3.17 | 3.57 | 1.89 | | |
| MAMMA1001094 | 1.73 | 4.28 | 4.65 | 4 | 5.62 | 4.7 | | |
| MAMMA1001105 | 2.45 | 2.62 | 7.7 | 6.99 | 7.57 | 6.06 | | |
| MAMMA1001110 | 0.4 | 1.01 | 2.74 | 1.42 | 2.53 | 0.47 | | |
| MAMMA1001126 | 1.96 | 3.09 | 10.92 | 8.39 | 9.27 | 6.08 | | |
| MAMMA1001133 | 2.5 | 3.44 | 10.94 | 9.48 | 10.83 | 10.68 | | |
| MAMMA1001139 | 87.88 | 86.18 | 214.31 | 193.19 | 47.2 | 160.92 | | |
| MAMMA1001141 | 1.33 | 2.89 | 3.65 | 3.69 | 5.25 | 5.46 | | |
| MAMMA1001143 | 2.02 | 1.79 | 4.23 | 3.95 | 6.69 | 4.34 | | |
| MAMMA1001145 | 3.1 | 2.22 | 3.39 | 6.37 | 7.13 | 2.84 | | |
| MAMMA1001150 | 1.34 | 2.48 | 3.95 | 3.06 | 3.31 | 2.11 | | |
| MAMMA1001154 | 2.16 | 2.8 | 5.57 | 5.44 | 7.13 | 5.22 | | |
| MAMMA1001159 | 4.19 | 4.01 | 11.06 | 11.31 | 5.89 | 9.45 | | |
| MAMMA1001161 | 4.3 | 5.27 | 19.53 | 18.34 | 10.8 | 14.8 | | |
| MAMMA1001162 | 1.98 | 1.77 | 3.16 | 5.25 | 5.13 | 2.25 | | |
| MAMMA1001181 | 2.44 | 2.28 | 4.87 | 5.06 | 4.74 | 3.62 | | |
| MAMMA1001186 | 2 | 2.66 | 4.66 | 5.38 | 5.48 | 3.9 | | |
| MAMMA1001189 | 2.23 | 3.68 | 7.17 | 11 | 11.17 | 9.9 | * | + |
| MAMMA1001191 | 2.54 | 2.07 | 5.49 | 4.37 | 3.89 | 2.97 | | |
| MAMMA1001198 | 368.47 | 416.05 | 784.82 | 647.17 | 738.61 | 605.52 | | |
| MAMMA1001202 | 11.78 | 11.85 | 30.06 | 34.39 | 28.74 | 25.16 | | |
| MAMMA1001203 | 2.57 | 3.01 | 7.15 | 8.72 | 6.26 | 5.56 | | |
| MAMMA1001206 | 1.91 | 3.28 | 4.5 | 3.69 | 6.66 | 2.65 | | |
| MAMMA1001208 | 2.66 | 2.93 | 3.31 | 3.82 | 4.95 | 3.19 | | |
| MAMMA1001215 | 2.9 | 3.08 | 6.55 | 3.49 | 8.09 | 4.74 | | |
| MAMMA1001220 | 2.63 | 3.03 | 7.25 | 7.16 | 7.17 | 6.03 | | |
| MAMMA1001222 | 1.25 | 1.18 | 4.18 | 2.18 | 5.85 | 0.53 | | |
| MAMMA1001223 | 2.48 | 3.32 | 6.53 | 4.95 | 6.51 | 4.1 | | |
| MAMMA1001232 | 2.82 | 4.27 | 8.08 | 12.22 | 8.82 | 9.57 | | |
| MAMMA1001234 | 1.25 | 3.27 | 3.17 | 5.05 | 3.91 | 3.26 | | |
| MAMMA1001237 | 1.22 | 1.56 | 4.21 | 1.94 | 3.66 | 2.09 | | |
| MAMMA1001243 | 2.18 | 2.28 | 4.06 | 4.05 | 4.89 | 1.99 | | |
| MAMMA1001244 | 1.22 | 1.16 | 2.86 | 2.96 | 4.79 | 2.22 | | |
| MAMMA1001249 | 2.3 | 1.89 | 5.93 | 5.19 | 5.8 | 3.75 | | |
| MAMMA1001256 | 3 | 3.09 | 8.29 | 5.89 | 7.83 | 8.01 | | |
| MAMMA1001259 | 4.38 | 3.25 | 7.15 | 7.94 | 9.24 | 6.63 | | |
| MAMMA1001260 | 1.76 | 2.71 | 5.42 | 6.51 | 5.33 | 7.33 | | |
| MAMMA1001262 | 2.1 | 4.11 | 5.28 | 7.86 | 8.04 | 6.25 | * | + |
| MAMMA1001268 | 2 | 2.16 | 4.59 | 2.56 | 4.23 | 2.48 | | |
| MAMMA1001271 | 4.84 | 5.78 | 17.37 | 18.29 | 14.24 | 15.67 | | |
| MAMMA1001274 | 2.88 | 3.06 | 6.17 | 6.22 | 8.55 | 7.93 | | |
| MAMMA1001280 | 2.09 | 1.48 | 4.36 | 1.84 | 3.78 | 1.73 | | |
| MAMMA1001283 | 1.63 | 1.71 | 6.34 | 6.88 | 5.63 | 4.83 | | |
| MAMMA1001284 | 2.27 | 2 | 8.67 | 5.08 | 9.09 | 9.51 | | |
| MAMMA1001286 | 13.83 | 9.72 | 17.39 | 12.15 | 11.83 | 14.63 | | |
| MAMMA1001289 | 17.63 | 13.49 | 23.32 | 21.02 | 26.39 | 36.8 | | |
| MAMMA1001292 | 3 | 3.01 | 5.94 | 7.26 | 6.31 | 6.85 | * | + |
| MAMMA1001296 | 3.55 | 3.76 | 12.61 | 14.11 | 12.37 | 12.8 | | |
| MAMMA1001298 | 1.26 | 1.7 | 6.26 | 4.25 | 6.78 | 4.07 | | |
| MAMMA1001305 | 0.86 | 1.59 | 4.43 | 2.49 | 4.07 | 2.63 | | |
| MAMMA1001309 | 0.61 | 0.9 | 2.7 | 1.84 | 3 | 1.49 | | |
| MAMMA1001310 | 1.72 | 2.17 | 3.64 | 4.81 | 7.38 | 4.42 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1001322 | 0.99 | 1.54 | 1.83 | 2.83 | 1.77 | 2.13 | | |
| MAMMA1001324 | 1.3 | 1.12 | 3.16 | 2.03 | 2.83 | 1.94 | | |
| MAMMA1001330 | 3.35 | 2.65 | 9.53 | 7.93 | 9.75 | 5.36 | | |
| MAMMA1001333 | 3.1 | 3.74 | 10.23 | 9.88 | 11.4 | 9.07 | | |
| MAMMA1001334 | 5.53 | 4.17 | 4.83 | 10.97 | 8.23 | 10.16 | ** | + |
| MAMMA1001337 | 2.49 | 3.54 | 6.6 | 6.99 | 9.16 | 8.05 | * | + |
| MAMMA1001341 | 1.21 | 1.14 | 3.48 | 1.54 | 5.66 | 1.41 | | |
| MAMMA1001343 | 2.37 | 1.89 | 8.07 | 8.17 | 9.75 | 10.95 | | |
| MAMMA1001344 | 9.59 | 9.07 | 11.75 | 13.63 | 11.67 | 15.98 | | |
| MAMMA1001346 | 1.34 | 1.25 | 3.9 | 2.05 | 3.9 | 2.94 | | |
| MAMMA1001383 | 3.07 | 3.61 | 8.52 | 8.3 | 9.02 | 9.38 | | |
| MAMMA1001388 | 1.62 | 1.93 | 5.34 | 3.38 | 6.11 | 4.58 | | |
| MAMMA1001396 | 4.2 | 2.12 | 8.12 | 11.39 | 10.42 | 8.68 | | |
| MAMMA1001397 | 2.59 | 2.27 | 5.79 | 8.33 | 8.96 | 7.78 | * | + |
| MAMMA1001401 | 26.87 | 16.48 | 32.72 | 43.47 | 57.55 | 45.66 | * | + |
| MAMMA1001408 | 1.06 | 1.06 | 2.57 | 0.65 | 4.22 | 1.19 | | |
| MAMMA1001411 | 1.65 | 1.26 | 3.84 | 4.38 | 3.33 | 3.51 | | |
| MAMMA1001414 | 3.12 | 3.85 | 5.74 | 12.58 | 10.67 | 15.28 | ** | + |
| MAMMA1001415 | 2.45 | 3.16 | 11.93 | 14.57 | 20.15 | 13.69 | * | + |
| MAMMA1001418 | 0.66 | 2.2 | 5.36 | 3.57 | 6.04 | 4.46 | | |
| MAMMA1001419 | 0.8 | 2.43 | 4.93 | 6.03 | 7.01 | 3.92 | | |
| MAMMA1001420 | 0.96 | 3.09 | 4.5 | 3.23 | 4.11 | 3.41 | | |
| MAMMA1001426 | 20.24 | 32.21 | 42.42 | 44.31 | 39.63 | 38.75 | | |
| MAMMA1001428 | 1.94 | 2.83 | 6.35 | 3.8 | 6.93 | 4.33 | | |
| MAMMA1001432 | 1.19 | 2.33 | 8.19 | 5.62 | 6.19 | 6.68 | | |
| MAMMA1001435 | 1.43 | 0.78 | 3.32 | 3.48 | 3.67 | 2.64 | | |
| MAMMA1001442 | 1.96 | 3.94 | 7.41 | 8.18 | 8.6 | 6.63 | | |
| MAMMA1001446 | 2.17 | 2.57 | 6.71 | 6.9 | 7.34 | 7.97 | | |
| MAMMA1001450 | 1.22 | 2.05 | 3.58 | 2.81 | 4.18 | 2.39 | | |
| MAMMA1001452 | 1.99 | 1.78 | 5.92 | 8.38 | 6.19 | 4.83 | | |
| MAMMA1001465 | 3.93 | 3.25 | 13.61 | 16.65 | 14.6 | 13.82 | | |
| MAMMA1001476 | 1.63 | 1.09 | 4.25 | 5.87 | 5.95 | 4.64 | * | + |
| MAMMA1001478 | 2.28 | 2.12 | 5.98 | 3.55 | 6.27 | 4.19 | | |
| MAMMA1001479 | 3.11 | 4.71 | 8.32 | 5.58 | 6.74 | 6.21 | | |
| MAMMA1001487 | 1.1 | 1.14 | 3.84 | 4.73 | 3.26 | 2.08 | | |
| MAMMA1001498 | 1.93 | 3.41 | 7.78 | 6.17 | 7.45 | 5.64 | | |
| MAMMA1001501 | 0.88 | 1.97 | 4.49 | 2.8 | 4.77 | 2.36 | | |
| MAMMA1001502 | 1.82 | 1.91 | 6.48 | 3.29 | 6.29 | 6.26 | | |
| MAMMA1001510 | 0.48 | 0.78 | 2.92 | 0.54 | 3.04 | 1.19 | | |
| MAMMA1001522 | 1.03 | 1.29 | 3.94 | 5.05 | 4.9 | 3.39 | | |
| MAMMA1001529 | 0.72 | 2.06 | 3.22 | 3.74 | 4.07 | 2.57 | | |
| MAMMA1001532 | 1.74 | 1.86 | 4.27 | 3.79 | 5.71 | 3.12 | | |
| MAMMA1001533 | 0.61 | 1.31 | 2.9 | 1.52 | 3.06 | 1.64 | | |
| MAMMA1001534 | 0.44 | 2.59 | 2.4 | 1.48 | 3.64 | 1.14 | | |
| MAMMA1001535 | 1.38 | 1.91 | 3.99 | 2.12 | 3.98 | 2.38 | | |
| MAMMA1001547 | 2.8 | 2.89 | 7.77 | 9.23 | 8.22 | 6.22 | | |
| MAMMA1001551 | 1.1 | 1.48 | 4.46 | 2.23 | 2.88 | 2.99 | | |
| MAMMA1001569 | 1.27 | 1.68 | 3.41 | 2.03 | 3.41 | 1.94 | | |
| MAMMA1001575 | 1.48 | 2.41 | 3.42 | 4.01 | 4.43 | 2.81 | | |
| MAMMA1001576 | 4.79 | 8.23 | 9.65 | 14.75 | 9.39 | 17.03 | | |
| MAMMA1001584 | 0.89 | 2.48 | 3.33 | 3.11 | 4 | 3.09 | | |
| MAMMA1001586 | 1.43 | 2.41 | 3.34 | 3.78 | 3.31 | 1.84 | | |
| MAMMA1001590 | 2.96 | 2.53 | 5.55 | 5.44 | 6.47 | 6.04 | | |
| MAMMA1001599 | 4.64 | 7.15 | 16.79 | 15.81 | 5.18 | 15.06 | | |
| MAMMA1001600 | 1.45 | 2.22 | 4.73 | 2.98 | 4.68 | 2.11 | | |
| MAMMA1001604 | 1.03 | 1.76 | 3.62 | 2.35 | 4.01 | 1.64 | | |
| MAMMA1001606 | 1.64 | 2.04 | 5.15 | 3.58 | 5.45 | 4.27 | | |
| MAMMA1001609 | 1.31 | 2.37 | 4.36 | 3.05 | 5.43 | 1.59 | | |
| MAMMA1001614 | 2.91 | 3.57 | 6.15 | 5.94 | 6.11 | 4.14 | | |
| MAMMA1001615 | 3.98 | 2.61 | 10.12 | 8.87 | 8.29 | 8.41 | | |
| MAMMA1001619 | 7.73 | 7.8 | 14.29 | 16.33 | 12.93 | 14.61 | | |
| MAMMA1001620 | 2.53 | 2.41 | 7.98 | 5.77 | 7.13 | 4.54 | | |
| MAMMA1001623 | 4.11 | 4.58 | 9.3 | 7.34 | 9.28 | 6.75 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and –, respectively. The results of test for
significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1001626 | 0.83 | 1.98 | 2.52 | 3.24 | 3.93 | 1.93 | | |
| MAMMA1001627 | 1.11 | 1.98 | 3.57 | 2.63 | 3.68 | 1.63 | | |
| MAMMA1001630 | 2.02 | 3.08 | 7.83 | 7.49 | 7.53 | 4.29 | | |
| MAMMA1001633 | 2.64 | 3.12 | 8.8 | 12.09 | 9.59 | 6.16 | | |
| MAMMA1001634 | 2.83 | 2.7 | 6.11 | 8.69 | 8.27 | 6.9 | * | + |
| MAMMA1001635 | 5.65 | 2.39 | 9.52 | 7.92 | 8.3 | 8.37 | | |
| MAMMA1001649 | 1.61 | 1.63 | 4.71 | 2.95 | 4.62 | 2.53 | | |
| MAMMA1001654 | 8.14 | 9.45 | 39 | 43.45 | 5 | 46.79 | | |
| MAMMA1001660 | 19.61 | 17.92 | 37.43 | 40.94 | 27.03 | 34 | | |
| MAMMA1001663 | 1.9 | 4.73 | 9.42 | 9.59 | 9.56 | 6.58 | | |
| MAMMA1001670 | 1.12 | 2.66 | 3.97 | 3.65 | 4.09 | 2.62 | | |
| MAMMA1001671 | 1.08 | 1.42 | 3.56 | 1.37 | 4.64 | 1.77 | | |
| MAMMA1001679 | 6.85 | 6.37 | 13.89 | 11.48 | 17.04 | 13.91 | | |
| MAMMA1001683 | 2.15 | 3.29 | 9.6 | 6.58 | 6.53 | 6.96 | | |
| MAMMA1001686 | 1.25 | 1.34 | 3.77 | 1.39 | 2.97 | 3.06 | | |
| MAMMA1001688 | 113.39 | 113.61 | 245.56 | 392.2 | 458.41 | 413 | ** | + |
| MAMMA1001689 | 1.01 | 3.76 | 4.1 | 5.04 | 3.79 | 4.44 | | |
| MAMMA1001692 | 1.97 | 2.59 | 5.37 | 3.66 | 5.3 | 3.88 | | |
| MAMMA1001711 | 1.99 | 3.64 | 8.65 | 4.35 | 5.51 | 6.1 | | |
| MAMMA1001715 | 1.31 | 1.64 | 3.95 | 4.64 | 4.87 | 4.13 | | |
| MAMMA1001730 | 2.01 | 2.15 | 2.5 | 2.8 | 4.42 | 2.83 | | |
| MAMMA1001735 | 44.73 | 48.32 | 102.35 | 94.99 | 156.23 | 119.88 | | |
| MAMMA1001740 | 0.64 | 1.6 | 4.59 | 2.06 | 3.91 | 1.95 | | |
| MAMMA1001743 | 9.84 | 11.15 | 33.16 | 41.97 | 51.62 | 49.6 | * | + |
| MAMMA1001744 | 0.63 | 0.72 | 0.86 | 1.1 | 1.72 | 1.71 | * | + |
| MAMMA1001745 | 1.41 | 2.15 | 6.15 | 3.27 | 4.46 | 3.93 | | |
| MAMMA1001751 | 1.38 | 2.41 | 3.24 | 2.85 | 4.51 | 4.32 | | |
| MAMMA1001752 | 4.7 | 4.78 | 9.75 | 6.12 | 9.61 | 8.4 | | |
| MAMMA1001754 | 7.25 | 7.89 | 7.34 | 11.04 | 9.63 | 9.39 | * | + |
| MAMMA1001757 | 1.21 | 1.1 | 2.32 | 2.21 | 3.25 | 2.43 | | |
| MAMMA1001760 | 3.87 | 4.52 | 20.01 | 22.91 | 24.2 | 27.59 | * | + |
| MAMMA1001764 | 2.62 | 2.36 | 5.97 | 7.13 | 10.17 | 6.51 | | |
| MAMMA1001767 | 1.22 | 1.55 | 2.13 | 1.61 | 2.96 | 1.55 | | |
| MAMMA1001768 | 0.57 | 1.18 | 4.25 | 4.74 | 4.72 | 4.37 | | |
| MAMMA1001769 | 2.48 | 2.83 | 9.22 | 9.3 | 9.81 | 8.94 | | |
| MAMMA1001771 | 2.66 | 1.58 | 3.74 | 2.86 | 5.85 | 6.77 | | |
| MAMMA1001773 | 2.7 | 3.53 | 3.87 | 4 | 6.29 | 7.61 | | |
| MAMMA1001778 | 0.88 | 1.92 | 3.14 | 3.13 | 4.21 | 3.61 | | |
| MAMMA1001783 | 2.01 | 2.1 | 11.25 | 11.63 | 18.46 | 13.04 | | |
| MAMMA1001785 | 3 | 3.52 | 8.85 | 10.56 | 13.38 | 11 | * | + |
| MAMMA1001788 | 0.49 | 0.86 | 1.21 | 0.72 | 1.72 | 1.11 | | |
| MAMMA1001790 | 1.68 | 1.67 | 5.1 | 2.37 | 3.73 | 3.93 | | |
| MAMMA1001800 | 0.83 | 0.99 | 1.47 | 1.5 | 2.24 | 3.25 | | |
| MAMMA1001804 | 1.02 | 1.41 | 3.18 | 2.37 | 4.16 | 2.4 | | |
| MAMMA1001806 | 2.13 | 2.78 | 6.4 | 3.15 | 5.5 | 4.72 | | |
| MAMMA1001812 | 1.46 | 1.33 | 5.52 | 4.21 | 5.86 | 5.05 | | |
| MAMMA1001815 | 0.33 | 1.76 | 3.07 | 1.22 | 3.67 | 1.24 | | |
| MAMMA1001817 | 3.19 | 3.38 | 9.5 | 6.78 | 10.89 | 13.3 | | |
| MAMMA1001818 | 1.68 | 2.08 | 3.41 | 3.94 | 8.52 | 3.41 | | |
| MAMMA1001819 | 2.57 | 4.12 | 5.82 | 8.7 | 10.29 | 7.87 | * | + |
| MAMMA1001820 | 2.68 | 4.51 | 8.27 | 7.51 | 10.98 | 6.07 | | |
| MAMMA1001824 | 1.66 | 2.83 | 8.36 | 7.55 | 9.8 | 7.11 | | |
| MAMMA1001832 | 6.72 | 7.99 | 11.85 | 20.17 | 21.28 | 17.21 | ** | + |
| MAMMA1001836 | 1.74 | 1.66 | 5.08 | 4.79 | 8.19 | 4.88 | | |
| MAMMA1001837 | 2.61 | 2 | 5.84 | 7.1 | 9.19 | 5.37 | | |
| MAMMA1001848 | 1.02 | 1.61 | 3.3 | 2.81 | 5.33 | 3.18 | | |
| MAMMA1001850 | 3.79 | 4.51 | 9.31 | 9.98 | 9.93 | 14.19 | | |
| MAMMA1001851 | 1.49 | 2.33 | 4.98 | 4.97 | 4.12 | 4.02 | | |
| MAMMA1001852 | 2.98 | 4 | 9.68 | 6.4 | 7.56 | 6.8 | | |
| MAMMA1001854 | 2.56 | 3.11 | 9.16 | 10.59 | 10.64 | 9.98 | | |
| MAMMA1001858 | 3.11 | 2.22 | 5.28 | 9.93 | 7.91 | 8.87 | ** | + |
| MAMMA1001864 | 1.69 | 1.91 | 4.09 | 8.91 | 6.18 | 4.37 | | |
| MAMMA1001868 | 0.71 | 0.92 | 2.64 | 1.68 | 2.58 | 0.91 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1001874 | 1.2 | 0.87 | 2.52 | 1.06 | 3.48 | 1.17 | | |
| MAMMA1001878 | 3.1 | 3.46 | 10.86 | 7.7 | 13.37 | 6.77 | | |
| MAMMA1001880 | 2.67 | 2.99 | 7.24 | 5.58 | 7.17 | 8.12 | | |
| MAMMA1001885 | 1.14 | 1.93 | 6.19 | 4.7 | 5.54 | 4.58 | | |
| MAMMA1001890 | 3.54 | 3.95 | 12.93 | 13.59 | 13.29 | 12.2 | | |
| MAMMA1001893 | 3.74 | 3.42 | 6.25 | 6.59 | 5.49 | 5.58 | | |
| MAMMA1001901 | 1.13 | 1.5 | 5.4 | 4.53 | 5.72 | 2.67 | | |
| MAMMA1001907 | 2.57 | 1.62 | 6.43 | 4.15 | 7.36 | 6.34 | | |
| MAMMA1001908 | 3.2 | 3.36 | 8.35 | 11.83 | 12.96 | 12.46 | * | + |
| MAMMA1001919 | 0.23 | 0.97 | 3.3 | 2.24 | 3.9 | 2.07 | | |
| MAMMA1001931 | 0.76 | 1.65 | 4.04 | 3.36 | 5.89 | 3.25 | | |
| MAMMA1001937 | 2.27 | 3.15 | 5.5 | 6.44 | 5.06 | 3.78 | | |
| MAMMA1001951 | 1.74 | 2.57 | 6.47 | 6.48 | 6.15 | 4.83 | | |
| MAMMA1001956 | 3.02 | 3.48 | 9.72 | 8.52 | 7.66 | 6.76 | | |
| MAMMA1001957 | 3.39 | 3.51 | 9.15 | 7.88 | 9.47 | 7.66 | | |
| MAMMA1001960 | 3.1 | 3.34 | 7.24 | 12.06 | 9.14 | 6.1 | | |
| MAMMA1001963 | 0.57 | 0.78 | 2.14 | 1.3 | 2.36 | 1.06 | | |
| MAMMA1001969 | 1.7 | 3.43 | 10.86 | 8.54 | 11.14 | 8.74 | | |
| MAMMA1001970 | 2.86 | 3.04 | 8.48 | 13.11 | 6.59 | 6.64 | | |
| MAMMA1001978 | 0.57 | 1.85 | 1.76 | 2.42 | 3.87 | 1.53 | | |
| MAMMA1001992 | 2.07 | 2.04 | 5.65 | 6.79 | 6.75 | 5.09 | | |
| MAMMA1001994 | 7.97 | 3.65 | 11 | 18.83 | 13.23 | 17.17 | * | + |
| MAMMA1002008 | 3.28 | 3.77 | 6.42 | 3.43 | 4.06 | 1.24 | | |
| MAMMA1002009 | 1.46 | 2.94 | 5.17 | 5.73 | 7.57 | 4.06 | | |
| MAMMA1002011 | 1.77 | 1.71 | 4.26 | 6.5 | 6.45 | 3.37 | | |
| MAMMA1002022 | 1.51 | 2.1 | 5.92 | 6.64 | 7.42 | 5.2 | | |
| MAMMA1002024 | 9.79 | 9.67 | 19.03 | 17.61 | 16.96 | 22.43 | | |
| MAMMA1002032 | 2.78 | 2.41 | 7.25 | 5.29 | 6.16 | 8.07 | | |
| MAMMA1002033 | 3.23 | 3.95 | 7.73 | 11.24 | 7.23 | 6.62 | | |
| MAMMA1002041 | 2.87 | 2.25 | 3.18 | 4.74 | 5.39 | 1.71 | | |
| MAMMA1002042 | 2.54 | 2.34 | 5.66 | 5.65 | 5.78 | 3.76 | | |
| MAMMA1002045 | 2.33 | 3.51 | 7.28 | 8.39 | 5.05 | 4.44 | | |
| MAMMA1002047 | 2.58 | 2.98 | 8.83 | 8.7 | 8.9 | 6.89 | | |
| MAMMA1002056 | 2.01 | 5.78 | 11.14 | 11.35 | 10.64 | 9.14 | | |
| MAMMA1002058 | 1.67 | 2.61 | 8.19 | 4.84 | 4.66 | 4.27 | | |
| MAMMA1002060 | 1.08 | 2.08 | 1.41 | 2.5 | 4.09 | 1.2 | | |
| MAMMA1002065 | 1.81 | 2.75 | 6.04 | 7.19 | 5.19 | 3.26 | | |
| MAMMA1002068 | 2.43 | 1.84 | 5.29 | 4.98 | 5.6 | 4.47 | | |
| MAMMA1002070 | 4.5 | 2.92 | 4.15 | 2.58 | 5.23 | 2.81 | | |
| MAMMA1002078 | 1.32 | 1.43 | 2.94 | 1.12 | 4.4 | 1.07 | | |
| MAMMA1002080 | 7.98 | 9.7.11 | 3.38 | 14.92 | 20.84 | 14.26 | | |
| MAMMA1002082 | 2.54 | 4.96 | 13.04 | 9.67 | 8.15 | 7.78 | | |
| MAMMA1002084 | 1.78 | 3.47 | 3.38 | 4.68 | 4.48 | 3.6 | | |
| MAMMA1002087 | 1.12 | 2.15 | 5.37 | 3.6 | 4.67 | 2.36 | | |
| MAMMA1002091 | 3.79 | 3.22 | 4.32 | 7.18 | 6.76 | 6.41 | ** | + |
| MAMMA1002093 | 0.72 | 1.4 | 4.31 | 2.74 | 4.39 | 2.33 | | |
| MAMMA1002095 | 2.4 | 3.22 | 7.5 | 4.73 | 7.52 | 4.54 | | |
| MAMMA1002108 | 1.84 | 1.02 | 2.63 | 1.87 | 3.24 | 1.31 | | |
| MAMMA1002112 | 2.94 | 3.4 | 7.03 | 12.79 | 16.02 | 11.28 | ** | + |
| MAMMA1002118 | 1.02 | 1.61 | 2.24 | 1.41 | 3.18 | 2.01 | | |
| MAMMA1002119 | 0.76 | 2.15 | 3.61 | 1.51 | 3.12 | 2.54 | | |
| MAMMA1002125 | 1.79 | 2.61 | 6.95 | 4.52 | 4.19 | 4.11 | | |
| MAMMA1002126 | 3.72 | 4.25 | 9.79 | 10.08 | 9.02 | 11.03 | | |
| MAMMA1002128 | 0.9 | 2.36 | 3.07 | 2.7 | 3.49 | 2.88 | | |
| MAMMA1002132 | 3.78 | 3.24 | 11.42 | 6.18 | 9.05 | 6.81 | | |
| MAMMA1002140 | 1.46 | 1.87 | 3.68 | 2.18 | 3.24 | 2.33 | | |
| MAMMA1002142 | 3.13 | 3.43 | 7.06 | 5.18 | 7.62 | 5.46 | | |
| MAMMA1002143 | 5.42 | 2.27 | 7.96 | 7.98 | 9.87 | 13.23 | | |
| MAMMA1002145 | 1.47 | 1.34 | 3.3 | 2.9 | 4.02 | 2.64 | | |
| MAMMA1002147 | 0.81 | 1.59 | 2.9 | 2.71 | 4.4 | 3 | | |
| MAMMA1002153 | 0.99 | 1.92 | 5.55 | 3.52 | 6.41 | 4.75 | | |
| MAMMA1002155 | 2.11 | 1.93 | 6.76 | 4.4 | 6.46 | 4.46 | | |
| MAMMA1002156 | 0.81 | 0.8 | 1.94 | 0.67 | 2.63 | 0.78 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1002158 | 1.38 | 1.83 | 5.12 | 4.09 | 7.73 | 5.2 | | |
| MAMMA1002164 | 2.01 | 2.09 | 5.86 | 3.17 | 3.18 | 4.04 | | |
| MAMMA1002165 | 4.04 | 4.29 | 7.25 | 8.65 | 8.1 | 6.81 | | |
| MAMMA1002170 | 1.01 | 1.48 | 154.53 | 2.65 | 3.24 | 4.11 | | |
| MAMMA1002174 | 1.66 | 2.9 | 5.88 | 4.55 | 7.78 | 8.58 | | |
| MAMMA1002175 | 3.27 | 3.3 | 7.02 | 6.95 | 6.64 | 7.22 | | |
| MAMMA1002180 | 8.59 | 6.53 | 35.97 | 55.49 | 48.49 | 51.08 | * | + |
| MAMMA1002198 | 3.11 | 2.3 | 9.33 | 7.6 | 11.22 | 7.13 | | |
| MAMMA1002205 | 2.93 | 1.66 | 6.15 | 6.3 | 8.04 | 7.54 | | |
| MAMMA1002206 | 4.6 | 3.59 | 8.14 | 12.4 | 13.97 | 11.74 | ** | + |
| MAMMA1002209 | 1.7 | 1.93 | 4.03 | 4.43 | 4.23 | 4.57 | | |
| MAMMA1002215 | 4.17 | 2.72 | 15.2 | 11.05 | 12.43 | 17.14 | | |
| MAMMA1002219 | 1.57 | 1.96 | 4.99 | 4.84 | 6.34 | 5.96 | | |
| MAMMA1002224 | 3.18 | 2.9 | 8.18 | 5.49 | 7.25 | 5.86 | | |
| MAMMA1002229 | 3.74 | 2.21 | 8.83 | 8.48 | 9.26 | 6.82 | | |
| MAMMA1002230 | 2.02 | 2.21 | 6.63 | 5.31 | 8.91 | 6.58 | | |
| MAMMA1002233 | 3.01 | 1.6 | 6.08 | 4.21 | 7.91 | 6.14 | | |
| MAMMA1002234 | 3.05 | 3.06 | 6.7 | 8.6 | 10.45 | 10.76 | * | + |
| MAMMA1002236 | 4.13 | 3.68 | 14.08 | 26.56 | 20.38 | 24.71 | * | + |
| MAMMA1002243 | 0.97 | 2.48 | 3.48 | 3.28 | 3.43 | 2.96 | | |
| MAMMA1002250 | 1.06 | 2.09 | 5.2 | 3.95 | 6.82 | 6.01 | | |
| MAMMA1002253 | 2.77 | 2.39 | 3.45 | 4.84 | 6.18 | 3.37 | | |
| MAMMA1002267 | 17.17 | 19.95 | 51.71 | 30.02 | 108.53 | 115.75 | ** | + |
| MAMMA1002268 | 1.72 | 2.28 | 5.82 | 6.92 | 11.3 | 6.52 | | |
| MAMMA1002269 | 0.89 | 0.73 | 2.25 | 2.32 | 2.58 | 1.67 | | |
| MAMMA1002282 | 0.86 | 1.09 | 4.95 | 5.87 | 5.31 | 6.81 | | |
| MAMMA1002292 | 2.71 | 2.25 | 7.77 | 10.57 | 10.52 | 11.53 | * | + |
| MAMMA1002293 | 3.71 | 3.3.11 | 2.81 | 8.54 | 10.47 | 12.05 | | |
| MAMMA1002294 | 0.9 | 1.71 | 4.61 | 3.68 | 6.03 | 4.2 | | |
| MAMMA1002297 | 1.53 | 3.25 | 7.45 | 5.77 | 7.8 | 6.91 | | |
| MAMMA1002298 | 1.48 | 1.4 | 3.98 | 3.85 | 3.11 | 2.46 | | |
| MAMMA1002299 | 1.5 | 1.69 | 3.16 | 3.91 | 2.97 | 2.2 | | |
| MAMMA1002308 | 1.39 | 1.35 | 6.55 | 4.5 | 3.11 | 2.54 | | |
| MAMMA1002310 | 3.56 | 3.84 | 12.73 | 9.92 | 12.66 | 11.48 | | |
| MAMMA1002311 | 2.52 | 2.13 | 6.82 | 9.61 | 9.66 | 6.9 | * | + |
| MAMMA1002312 | 1.63 | 2.22 | 5.19 | 3.51 | 8.45 | 2.55 | | |
| MAMMA1002317 | 2.08 | 2.55 | 4.89 | 4.08 | 3.85 | 4.09 | | |
| MAMMA1002319 | 0.8 | 2.78 | 3.51 | 2.68 | 3.97 | 2.85 | | |
| MAMMA1002322 | 2.48 | 3.23 | 7.84 | 12.21 | 10.02 | 8.55 | * | + |
| MAMMA1002329 | 1.64 | 1.67 | 2.93 | 2.9 | 3.3 | 2.76 | | |
| MAMMA1002332 | 2.17 | 2.38 | 4.58 | 5.98 | 4.14 | 3.05 | | |
| MAMMA1002333 | 1.7 | 1.74 | 4.19 | 5.35 | 5.07 | 3.54 | | |
| MAMMA1002335 | 1.75 | 2.72 | 8.53 | 6.93 | 11.32 | 4.23 | | |
| MAMMA1002339 | 2.09 | 2.42 | 7.34 | 5.21 | 7.5 | 5.14 | | |
| MAMMA1002347 | 1.7 | 2.3 | 6.39 | 5.5 | 5.32 | 4.64 | | |
| MAMMA1002351 | 2.08 | 2.68 | 5.74 | 3.03 | 4.48 | 4.84 | | |
| MAMMA1002352 | 1.27 | 2.28 | 3.66 | 3.53 | 4.63 | 2.8 | | |
| MAMMA1002353 | 4.46 | 2.5 | 5.84 | 5.95 | 4.19 | 4 | | |
| MAMMA1002355 | 3.97 | 3.38 | 8.37 | 7.98 | 7.31 | 8.57 | | |
| MAMMA1002356 | 2.18 | 1.49 | 4.36 | 5.43 | 4.13 | 3.75 | | |
| MAMMA1002359 | 3.95 | 3.35 | 16.09 | 23.81 | 24.53 | 19 | * | + |
| MAMMA1002360 | 0.93 | 1.73 | 3.77 | 2.48 | 3.2 | 1.67 | | |
| MAMMA1002361 | 2.01 | 2.64 | 4.53 | 4.17 | 4.95 | 4.03 | | |
| MAMMA1002362 | 2.33 | 2.33 | 3.36 | 5.31 | 5.51 | 3.99 | * | + |
| MAMMA1002367 | 2.97 | 3.64 | 14.63 | 18.34 | 21.06 | 21.56 | * | + |
| MAMMA1002371 | 2.28 | 3.75 | 8.3 | 6.15 | 6.74 | 5.88 | | |
| MAMMA1002380 | 1.81 | 2.26 | 4.9 | 4.71 | 5.76 | 3.55 | | |
| MAMMA1002384 | 2.14 | 1.53 | 4.73 | 4.48 | 5.36 | 4.05 | | |
| MAMMA1002385 | 1.19 | 2.05 | 5.63 | 3.34 | 4.8 | 2.47 | | |
| MAMMA1002390 | 1.41 | 2.04 | 3.75 | 5.48 | 5.4 | 3.43 | | |
| MAMMA1002392 | 1.94 | 3.1 | 6.1 | 4.06 | 5.95 | 3.32 | | |
| MAMMA1002396 | 4.87 | 3.49 | 12.87 | 10.79 | 12.9 | 8.08 | | |
| MAMMA1002399 | 4.42 | 5.13 | 10.69 | 10.95 | 8.66 | 4.57 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1002400 | 3 | 2.22 | 4.69 | 3.11 | 4.36 | 3.53 | | |
| MAMMA1002409 | 51.57 | 55.16 | 63.3 | 77.54 | 80.62 | 77.88 | ** | + |
| MAMMA1002411 | 1.08 | 1.88 | 4.13 | 3.43 | 5.49 | 1.92 | | |
| MAMMA1002413 | 2.02 | 3.01 | 9.19 | 5.93 | 7.17 | 6.75 | | |
| MAMMA1002417 | 1.83 | 2.24 | 4.87 | 3.45 | 4.25 | 2.63 | | |
| MAMMA1002427 | 1.5 | 2.38 | 4.54 | 4.78 | 5.56 | 3.41 | | |
| MAMMA1002428 | 2.47 | 2.26 | 5.38 | 4.46 | 5.11 | 4.28 | | |
| MAMMA1002433 | 1.74 | 2.18 | 6.84 | 6.72 | 6.96 | 6.22 | | |
| MAMMA1002434 | 2.94 | 2.4 | 7.38 | 5.34 | 4.65 | 5.03 | | |
| MAMMA1002446 | 1.39 | 2.34 | 5.62 | 3.98 | 5.84 | 5.96 | | |
| MAMMA1002447 | 2.51 | 1.38 | 6.4 | 5.11 | 6.26 | 5.45 | | |
| MAMMA1002454 | 7.77 | 9.16 | 18.07 | 21.71 | 17.12 | 18.35 | | |
| MAMMA1002461 | 2.06 | 4.11 | 7.7 | 4.92 | 5.41 | 6.47 | | |
| MAMMA1002463 | 3.28 | 3.32 | 8.09 | 6.98 | 7.82 | 5.39 | | |
| MAMMA1002464 | 16.58 | 16.77 | 20.05 | 19.41 | 20.41 | 18.09 | | |
| MAMMA1002466 | 9.48 | 9.89 | 14.22 | 14.5.81 | 5.75 | 13.93 | | |
| MAMMA1002470 | 1.39 | 1.51 | 5.13 | 3.54 | 5.01 | 3.73 | | |
| MAMMA1002475 | 0.72 | 1.85 | 5.03 | 3.86 | 5.17 | 4.65 | | |
| MAMMA1002480 | 0.66 | 1.21 | 2.31 | 1.68 | 2.84 | 2.03 | | |
| MAMMA1002485 | 29.98 | 27.24 | 46.09 | 64.83 | 74.9 | 80.68 | ** | + |
| MAMMA1002494 | 2 | 2 | 4.11 | 4.48 | 5.12 | 5.13 | * | + |
| MAMMA1002498 | 0.97 | 2.57 | 3.16 | 2.07 | 3.18 | 1.55 | | |
| MAMMA1002524 | 3.04 | 2.96 | 6.43 | 5.18 | 7.34 | 6.1 | | |
| MAMMA1002530 | 2.5 | 3.24 | 4.88 | 3.17 | 4.41 | 2.55 | | |
| MAMMA1002538 | 2.34 | 2.38 | 5.62 | 5.46 | 5.13 | 4.91 | | |
| MAMMA1002545 | 2.37 | 2.64 | 6.26 | 4.56 | 6.49 | 4.56 | | |
| MAMMA1002554 | 1.96 | 1.42 | 5.43 | 5.3 | 6.01 | 7.81 | | |
| MAMMA1002556 | 1.3 | 1.9 | 3.6 | 3.73 | 5.75 | 3.89 | | |
| MAMMA1002561 | 2.3 | 2.99 | 7.19 | 8.13 | 10.46 | 7.98 | | |
| MAMMA1002565 | 1.22 | 2.15 | 3.52 | 2.57 | 4.51 | 2.55 | | |
| MAMMA1002566 | 0.98 | 1.87 | 6.21 | 1.65 | 4.7 | 3.9 | | |
| MAMMA1002571 | 0.53 | 1.8 | 3.06 | 1.43 | 3.1 | 4.3 | | |
| MAMMA1002573 | 2.14 | 1.86 | 7.06 | 4.54 | 5.66 | 5.97 | | |
| MAMMA1002576 | 118.77 | 131.84 | 363.97 | 348.62 | 471.73 | 358.66 | | |
| MAMMA1002584 | 3.52 | 2.27 | 11.91 | 12.86 | 17.82 | 13.46 | | |
| MAMMA1002585 | 0.76 | 1.86 | 4.38 | 1.85 | 3.6 | 5.26 | | |
| MAMMA1002586 | 1.98 | 2.55 | 3.85 | 4.12 | 5.02 | 3.3 | | |
| MAMMA1002589 | 1.08 | 1.26 | 2.44 | 2.36 | 5.06 | 3.19 | | |
| MAMMA1002590 | 1.01 | 1.57 | 5.87 | 2.58 | 6.75 | 4.57 | | |
| MAMMA1002593 | 2.48 | 2.48 | 4.89 | 4.18 | 4.07 | 3.04 | | |
| MAMMA1002597 | 2.47 | 2.52 | 7.25 | 8.06 | 9.48 | 8.78 | * | + |
| MAMMA1002598 | 12.12 | 13.52 | 30.83 | 37.28 | 48.14 | 38.91 | * | + |
| MAMMA1002603 | 1.2 | 1.39 | 3.69 | 3.25 | 6.24 | 4.35 | | |
| MAMMA1002612 | 3.51 | 3.39 | 12.6 | 7.66 | 7.78 | 9.76 | | |
| MAMMA1002617 | 4.3 | 3.41 | 10.15 | 6.3 | 7.29 | 10.05 | | |
| MAMMA1002618 | 1.68 | 2.27 | 4.02 | 2.76 | 3.59 | 3.91 | | |
| MAMMA1002619 | 2.96 | 2.8 | 5.24 | 3.22 | 5.88 | 3.49 | | |
| MAMMA1002622 | 2.51 | 2.12 | 8.02 | 7.1 | 7.18 | 7.15 | | |
| MAMMA1002623 | 2.31 | 2.21 | 6.27 | 5.89 | 6.17 | 6.19 | | |
| MAMMA1002625 | 1.32 | 1.3 | 3.23 | 2.3 | 6.42 | 2.6 | | |
| MAMMA1002627 | 0.98 | 0.82 | 2.93 | 0.6 | 1.29 | 0.21 | | |
| MAMMA1002629 | 1.8 | 2.23 | 6.09 | 5.03 | 6.74 | 7.02 | | |
| MAMMA1002631 | 1 | 1.86 | 3.61 | 3.07 | 4.55 | 2.97 | | |
| MAMMA1002633 | 6.61 | 7.44 | 21.47 | 19.33 | 24.55 | 21.53 | | |
| MAMMA1002636 | 1.02 | 2.46 | 6.97 | 6.79 | 8.77 | 9.25 | | |
| MAMMA1002637 | 1.05 | 1.4 | 4.66 | 3.39 | 4.85 | 4.28 | | |
| MAMMA1002646 | 1.69 | 0.8 | 3.32 | 2.33 | 2.86 | 1.53 | | |
| MAMMA1002648 | 10.51 | 14.07 | 21.18 | 42.29 | 31.45 | 39.76 | ** | + |
| MAMMA1002650 | 1.33 | 0.56 | 1.62 | 1.76 | 2.08 | 0.57 | | |
| MAMMA1002652 | 1.76 | 2.82 | 7.31 | 7.5 | 7.41 | 9.79 | | |
| MAMMA1002655 | 1.7 | 2.11 | 3.65 | 2.54 | 4.23 | 3.78 | | |
| MAMMA1002662 | 0.84 | 2.24 | 4.33 | 3.57 | 5.68 | 4.13 | | |
| MAMMA1002665 | 3.61 | 3.57 | 10.05 | 13.42 | 17.97 | 19.59 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1002671 | 2.84 | 3.63 | 10.17 | 17.04 | 16.47 | 19.3 | ** | + |
| MAMMA1002673 | 1.32 | 2.14 | 4.93 | 4.07 | 5.03 | 2.82 | | |
| MAMMA1002684 | 2.95 | 3.11 | 3.84 | 6.61 | 8.19 | 7.54 | ** | + |
| MAMMA1002685 | 0.68 | 1.49 | 2.57 | 2.05 | 3.74 | 2.97 | | |
| MAMMA1002692 | 1.28 | 1.96 | 5.45 | 2.46 | 4.14 | 3.62 | | |
| MAMMA1002693 | 1.84 | 4.18 | 8 | 4.63 | 7.68 | 6.61 | | |
| MAMMA1002698 | 0.99 | 1.91 | 4.05 | 2.92 | 4.42 | 3.3 | | |
| MAMMA1002699 | 2 | 2.35 | 4.43 | 4.05 | 5.22 | 3.64 | | |
| MAMMA1002701 | 2.41 | 2.56 | 8.46 | 6.72 | 8.94 | 8.93 | | |
| MAMMA1002708 | 1.51 | 1.55 | 5.38 | 4.08 | 6.16 | 6.18 | | |
| MAMMA1002711 | 1.58 | 2.08 | 7.04 | 4.37 | 7.35 | 5.81 | | |
| MAMMA1002712 | 3.05 | 3.13 | 6.98 | 4.88 | 7.12 | 7.39 | | |
| MAMMA1002716 | 0.56 | 1.75 | 3.39 | 2.38 | 6.29 | 2.9 | | |
| MAMMA1002721 | 2.11 | 2.01 | 5.57 | 3.72 | 6.34 | 4.59 | | |
| MAMMA1002723 | 2.43 | 2.46 | 4.91 | 3.85 | 5.98 | 4.88 | | |
| MAMMA1002727 | 3.85 | 5.55 | 5.78 | 5.29 | 4.45 | 6.22 | | |
| MAMMA1002728 | 21.35 | 22.03 | 57.81 | 49.09 | 54.73 | 65.13 | | |
| MAMMA1002742 | 4.12 | 4.39 | 10.35 | 7.92 | 8.63 | 7.61 | | |
| MAMMA1002743 | 4.12 | 3.89 | 6.17 | 13.81 | 14.09 | 13.46 | ** | + |
| MAMMA1002744 | 2.07 | 3.15 | 9.18 | 9.33 | 12.98 | 13.16 | | |
| MAMMA1002746 | 0.93 | 1.28 | 3.09 | 2.29 | 4.31 | 1.68 | | |
| MAMMA1002748 | 2.71 | 2.65 | 4.52 | 7.15 | 5.86 | 4.72 | * | + |
| MAMMA1002754 | 1.12 | 2.41 | 5.56 | 5.05 | 5.65 | 6.26 | | |
| MAMMA1002758 | 0.71 | 1.66 | 2.55 | 1.57 | 4.41 | 1.69 | | |
| MAMMA1002762 | 11.3 | 11.14 | 36.64 | 38.42 | 34.23 | 48.71 | | |
| MAMMA1002764 | 1.83 | 3.2 | 5.95 | 5.11 | 6.06 | 4.26 | | |
| MAMMA1002765 | 1.19 | 1.63 | 4.29 | 4.63 | 5.26 | 2.67 | | |
| MAMMA1002769 | 7.4 | 6.44 | 13.04 | 13.78 | 8.03 | 12.41 | | |
| MAMMA1002771 | 1.41 | 2.41 | 3.31 | 3.54 | 5.39 | 4.39 | | |
| MAMMA1002775 | 4.56 | 4.48 | 19.79 | 22.54 | 29.77 | 24.29 | * | + |
| MAMMA1002780 | 2.59 | 1.83 | 3.03 | 2.11 | 4.89 | 3.78 | | |
| MAMMA1002782 | 1.43 | 2.49 | 3.85 | 2.51 | 4.79 | 4.11 | | |
| MAMMA1002795 | 1.89 | 2.03 | 3.46 | 6.45 | 7.68 | 5.35 | ** | + |
| MAMMA1002796 | 4.35 | 3.97 | 7.51 | 7.2 | 8.09 | 8.17 | | |
| MAMMA1002805 | 6.61 | 11.12 | 16.52 | 15.95 | 24.7 | 16.5 | | |
| MAMMA1002806 | 1.47 | 2.02 | 3.51 | 2.28 | 4.62 | 2.17 | | |
| MAMMA1002807 | 1.63 | 2.4 | 6.77 | 6.78 | 9.66 | 6.4 | | |
| MAMMA1002814 | 3.43 | 3.52 | 7.92 | 9.58 | 12.39 | 10.66 | * | + |
| MAMMA1002817 | 1.28 | 1.56 | 2.87 | 2.89 | 5.43 | 2.91 | | |
| MAMMA1002820 | 1.66 | 1.93 | 2.61 | 2.52 | 4.77 | 2.21 | | |
| MAMMA1002830 | 67.67 | 70.46 | 130.59 | 165.92 | 139.33 | 187.18 | * | + |
| MAMMA1002833 | 4.16 | 2.88 | 9.4 | 8.22 | 10.68 | 10.58 | | |
| MAMMA1002835 | 0.77 | 1.87 | 4.03 | 1.73 | 3.97 | 2.79 | | |
| MAMMA1002838 | 1.85 | 2.66 | 5.31 | 2.91 | 4.44 | 3.93 | | |
| MAMMA1002842 | 1 | 3.83 | 3.84 | 3.32 | 4.63 | 5.15 | | |
| MAMMA1002843 | 1.72 | 2.92 | 2.33 | 4.09 | 4.81 | 3 | | |
| MAMMA1002844 | 3.05 | 3.64 | 6.52 | 5.26 | 7.3 | 4.09 | | |
| MAMMA1002845 | 1.25 | 1.57 | 2.45 | 3.59 | 3.55 | 4.67 | * | + |
| MAMMA1002857 | 92.1 | 106.97 | 208.17 | 209.17 | 202.29 | 249.13 | | |
| MAMMA1002858 | 317.94 | 188.78 | 378.89 | 560.7 | 620.76 | 724.33 | ** | + |
| MAMMA1002863 | 2.17 | 2.83 | 6.91 | 3.51 | 5.12 | 3.96 | | |
| MAMMA1002868 | 2.73 | 3.7 | 6.26 | 6.35 | 9.53 | 10.25 | * | + |
| MAMMA1002869 | 5.43 | 6.83 | 26.64 | 22.68 | 30.03 | 29.85 | | |
| MAMMA1002871 | 0.61 | 1.7 | 1.78 | 1.9 | 3.8 | 1.97 | | |
| MAMMA1002875 | 1.9 | 2.59 | 3.99 | 4.48 | 6.35 | 4.06 | | |
| MAMMA1002879 | 8.42 | 9.2 | 14.19 | 22.55 | 23.63 | 27.96 | ** | + |
| MAMMA1002880 | 1.23 | 2.02 | 2.12 | 1.48 | 5.42 | 2.03 | | |
| MAMMA1002881 | 1.21 | 1.43 | 1.84 | 3.01 | 5.43 | 2.46 | | |
| MAMMA1002885 | 0.96 | 1.59 | 2.71 | 2.6 | 3.26 | 1.59 | | |
| MAMMA1002886 | 2.63 | 2.52 | 3.9 | 6.01 | 5.37 | 7.05 | ** | + |
| MAMMA1002887 | 1.28 | 1.83 | 2.78 | 2.98 | 5.14 | 4.32 | * | + |
| MAMMA1002890 | 0.79 | 1.7 | 4.05 | 4.39 | 4.8 | 4.01 | | |
| MAMMA1002892 | 1.35 | 2.45 | 4.98 | 6.64 | 6.24 | 5.84 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1002893 | 4.52 | 3.58 | 5.4 | 7.6 | 8.03 | 8.43 | ** | + |
| MAMMA1002895 | 1.43 | 1.31 | 3.28 | 1.81 | 3.89 | 1.64 | | |
| MAMMA1002898 | 0.53 | 1.67 | 4.15 | 2.69 | 4.72 | 1.42 | | |
| MAMMA1002905 | 1.32 | 1.58 | 2.51 | 4.1 | 5.01 | 3.87 | ** | + |
| MAMMA1002906 | 15.12 | 10.76 | 15.42 | 19.47 | 13.76 | 15.58 | | |
| MAMMA1002908 | 0.99 | 1.24 | 4.28 | 3.53 | 4.24 | 4.07 | | |
| MAMMA1002909 | 1.92 | 2.64 | 5.67 | 6.82 | 8.18 | 6.57 | * | + |
| MAMMA1002918 | 2.75 | 2.69 | 5.42 | 5.27 | 7.26 | 6.58 | | |
| MAMMA1002925 | 92.88 | 85.77 | 163.7 | 127.31 | 122.97 | 178.98 | | |
| MAMMA1002926 | 6.08 | 6.31 | 16.25 | 16.64 | 19.48 | 19.9 | | |
| MAMMA1002930 | 1.21 | 1.59 | 5.67 | 4.88 | 8.91 | 4.21 | | |
| MAMMA1002937 | 4.91 | 3.87 | 30.71 | 40.45 | 75.17 | 61.59 | * | + |
| MAMMA1002938 | 1.67 | 1.86 | 2.42 | 2.35 | 3.2 | 3.56 | | |
| MAMMA1002941 | 0.49 | 1.48 | 2.78 | 2.53 | 3.59 | 2.24 | | |
| MAMMA1002947 | 2.24 | 2.59 | 4.55 | 6 | 6.8 | 7.94 | * | + |
| MAMMA1002964 | 1.73 | 2.9 | 5.91 | 6.91 | 7.24 | 7.16 | * | + |
| MAMMA1002967 | 1.94 | 1.59 | 2.28 | 2.9 | 4.19 | 2.79 | | |
| MAMMA1002970 | 2.72 | 1.77 | 6 | 7.59 | 7.28 | 8.96 | * | + |
| MAMMA1002971 | 1.52 | 1.6 | 2.9 | 2.51 | 7.27 | 3.93 | | |
| MAMMA1002972 | 1 | 1.32 | 2.95 | 1.74 | 4.56 | 2.12 | | |
| MAMMA1002973 | 1.38 | 2.45 | 6.73 | 4.36 | 6.72 | 6.78 | | |
| MAMMA1002979 | 55.6 | 60.16 | 121.72 | 134.02 | 101.19 | 107.19 | | |
| MAMMA1002982 | 0.53 | 1.98 | 2.28 | 2.04 | 3.28 | 1.9 | | |
| MAMMA1002987 | 1.56 | 2.11 | 5.56 | 3.14 | 5.55 | 4.14 | | |
| MAMMA1003003 | 0.77 | 2.18 | 4.78 | 4.46 | 6.47 | 5.08 | | |
| MAMMA1003004 | 1.65 | 1.86 | 3.7 | 3.64 | 3.59 | 3.16 | | |
| MAMMA1003007 | 0.69 | 1.16 | 2.73 | 1.88 | 3.7 | 2.32 | | |
| MAMMA1003011 | 1.56 | 1.8 | 3.67 | 3.77 | 5.41 | 3.94 | | |
| MAMMA1003013 | 3.67 | 5.57 | 39.41 | 47.56 | 59.11 | 54.29 | * | + |
| MAMMA1003015 | 1.16 | 1.8 | 2.21 | 2.54 | 2.9 | 2.19 | | |
| MAMMA1003019 | 0.6 | 1.61 | 2.1 | 3.12 | 4.61 | 2.63 | | |
| MAMMA1003020 | 2.96 | 4.19 | 5.34 | 11.31 | 10.33 | 10.09 | ** | + |
| MAMMA1003026 | 1.29 | 1.56 | 2.95 | 2.66 | 4.25 | 2.25 | | |
| MAMMA1003031 | 0.61 | 1.71 | 5.64 | 4.13 | 5.85 | 5.89 | | |
| MAMMA1003033 | 1.34 | 1.65 | 4.13 | 2.84 | 5.11 | 3.64 | | |
| MAMMA1003035 | 1.66 | 2.5 | 5.44 | 5.12 | 7.03 | 4.9 | | |
| MAMMA1003039 | 0.95 | 0.75 | 3.31 | 2.15 | 4.73 | 2.48 | | |
| MAMMA1003040 | 1.38 | 2.54 | 5.32 | 4.57 | 7.47 | 7.43 | | |
| MAMMA1003044 | 2.36 | 2.96 | 6.52 | 4.29 | 6.41 | 5.99 | | |
| MAMMA1003047 | 1.82 | 3.67 | 7.61 | 5.74 | 7.05 | 7.13 | | |
| MAMMA1003049 | 0.47 | 1.72 | 2.03 | 1.08 | 1.56 | 1.45 | | |
| MAMMA1003055 | 1.24 | 1.67 | 4.92 | 3.77 | 5.14 | 3.44 | | |
| MAMMA1003056 | 0.9 | 0.91 | 1.85 | 1.22 | 2.26 | 1.02 | | |
| MAMMA1003057 | 2.53 | 3.34 | 6.76 | 7.25 | 9.2 | 5.01 | | |
| MAMMA1003066 | 1.65 | 2.06 | 4.73 | 4.1 | 7.08 | 5.07 | | |
| MAMMA1003075 | 1.11 | 1.71 | 3.16 | 1.85 | 4.37 | 2.32 | | |
| MAMMA1003089 | 1.69 | 2.11 | 7.13 | 7.85 | 8.66 | 7.43 | | |
| MAMMA1003092 | 1.25 | 1.79 | 3.21 | 2.62 | 4.08 | 1.76 | | |
| MAMMA1003095 | 2.27 | 3.33 | 5.4 | 7.24 | 8.57 | 5.34 | | |
| MAMMA1003099 | 1.88 | 2.51 | 4.95 | 4.09 | 6.45 | 4.35 | | |
| MAMMA1003102 | 1.33 | 2.04 | 2.88 | 3.2 | 3.27 | 2.39 | | |
| MAMMA1003104 | 0.64 | 1.07 | 3.17 | 2.15 | 3.25 | 1.56 | | |
| MAMMA1003113 | 4.22 | 4.21 | 6.98 | 9.22 | 7.02 | 7.07 | | |
| MAMMA1003126 | 12.93 | 14.72 | 20.89 | 19.28 | 12 | 15.63 | | |
| MAMMA1003127 | 2.95 | 3.14 | 5.91 | 3.88 | 6.12 | 5.19 | | |
| MAMMA1003131 | 2.82 | 3.51 | 4.86 | 3.82 | 5.91 | 5.88 | | |
| MAMMA1003135 | 3.66 | 4.65 | 7.61 | 2.33 | 4.04 | 2.64 | | |
| MAMMA1003140 | 0.73 | 2.01 | 3.59 | 2.3 | 3.32 | 1.89 | | |
| MAMMA1003146 | 2.08 | 2.24 | 3.89 | 3.17 | 5.09 | 3.3 | | |
| MAMMA1003150 | 1.18 | 1.8 | 3.01 | 3.37 | 4.29 | 3.45 | * | + |
| MAMMA1003154 | 0.54 | 1.41 | 2.29 | 2.21 | 3.57 | 2.34 | | |
| MAMMA1003155 | 8.08 | 9.18 | 20.88 | 21.41 | 17.68 | 20.56 | | |
| MAMMA1003157 | 5.94 | 4.82 | 6.07 | 5.18 | 7.05 | 7.89 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| MAMMA1003163 | 1.74 | 1.69 | 4.23 | 2.55 | 5.46 | 3.08 | | |
| MAMMA1003164 | 2.94 | 4.56 | 6.23 | 4.08 | 9.9 | 8.18 | | |
| MAMMA1003166 | 3.62 | 3.5 | 5.77 | 6.24 | 8.66 | 6.12 | | |
| NB9N31000010 | 2.5 | 3.88 | 7.58 | 9.63 | 12.26 | 9.5 | * | + |
| NB9N31000016 | 0.73 | 2.8 | 5.21 | 4.04 | 4.41 | 3.15 | | |
| NB9N31000043 | 8.1 | 8.88 | 19.7.11 | 2.51 | 12.3 | 12.64 | | |
| NB9N31000045 | 167.24 | 153.32 | 255.96 | 401.78 | 320.53 | 296.06 | * | + |
| NB9N31000054 | 7.29 | 4.42 | 11.75 | 11.15 | 11.87 | 13.43 | | |
| NB9N31000076 | 2.31 | 1.94 | 3.51 | 4.5 | 6.35 | 4.44 | * | + |
| NB9N31000086 | 2.62 | 2.65 | 6.23 | 3.61 | 9.71 | 7.69 | | |
| NT2RM1000001 | 2.56 | 2.45 | 6.24 | 5.7 | 7.05 | 6.32 | | |
| NT2RM1000018 | 3.84 | 4.69 | 10.6 | 6.58 | 9.09 | 6.92 | | |
| NT2RM1000032 | 1.12 | 2.64 | 3.88 | 2.28 | 4.92 | 3.21 | | |
| NT2RM1000035 | 1.72 | 3.68 | 5.53 | 5.44 | 5.21 | 5.98 | | |
| NT2RM1000037 | 1.38 | 2.98 | 2.75 | 2.41 | 4.15 | 2.11 | | |
| NT2RM1000039 | 3.45 | 5.13 | 5.9 | 6.51 | 7.26 | 8.4 | * | + |
| NT2RM1000042 | 33.96 | 32.7 | 65.25 | 57.46 | 67.15 | 64.39 | | |
| NT2RM1000055 | 0.85 | 1.74 | 3.34 | 1.16 | 3.55 | 1.16 | | |
| NT2RM1000059 | 3.26 | 3.16 | 7.66 | 4.69 | 5.97 | 5.78 | | |
| NT2RM1000062 | 1.13 | 1.21 | 1.9 | 3.47 | 4.33 | 2.46 | * | + |
| NT2RM1000065 | 23.8 | 16.41 | 34.06 | 36.15 | 35.1 | 51.38 | | |
| NT2RM1000066 | 4.13 | 4.31 | 8.98 | 7.23 | 10.95 | 9.81 | | |
| NT2RM1000071 | 49.63 | 37.81 | 86.71 | 73.04 | 63.32 | 84.05 | | |
| NT2RM1000080 | 1.37 | 2.04 | 3.8 | 5.1 | 5.94 | 4.5 | * | + |
| NT2RM1000086 | 4.04 | 4.65 | 4.08 | 5.01 | 6.23 | 5.58 | * | + |
| NT2RM1000092 | 6.17 | 6.93 | 45.76 | 14.48 | 25.91 | 15.13 | | |
| NT2RM1000118 | 0.63 | 1.12 | 1.22 | 0.63 | 1.7 | 0.44 | | |
| NT2RM1000119 | 1.32 | 2.27 | 1.96 | 1.84 | 3.38 | 2.99 | | |
| NT2RM1000121 | 1.13 | 1.84 | 1.76 | 2.92 | 3.84 | 2.78 | * | + |
| NT2RM1000122 | 3.5 | 3.78 | 7.34 | 5.5 | 8.86 | 9.57 | | |
| NT2RM1000127 | 0.69 | 1.34 | 1.47 | 2.14 | 3.36 | 3.32 | * | + |
| NT2RM1000131 | 0.71 | 1.7 | 1.47 | 1.36 | 3.02 | 2.53 | | |
| NT2RM1000132 | 3.2 | 4.88 | 4.83 | 6.86 | 6.46 | 6.31 | * | + |
| NT2RM1000153 | 1.75 | 1.9 | 3.68 | 2.38 | 4.45 | 4.84 | | |
| NT2RM1000184 | 72.82 | 77.46 | 151.91 | 106.39 | 163.07 | 125.55 | | |
| NT2RM1000186 | 1.55 | 1.46 | 4.32 | 2.67 | 4.72 | 3.94 | | |
| NT2RM1000187 | 3.11 | 1.96 | 5.16 | 10.09 | 9.1 | 8.78 | ** | + |
| NT2RM1000199 | 1.12 | 1.37 | 2.11 | 2.41 | 3.51 | 2.72 | * | + |
| NT2RM1000213 | 1.32 | 1.75 | 2.38 | 2.66 | 2.71 | 2.22 | | |
| NT2RM1000215 | 10.95 | 11.07 | 17.21 | 19.51 | 22.84 | 15.14 | | |
| NT2RM1000218 | 9.72 | 9.95 | 23.71 | 26.94 | 24.74 | 29.21 | | |
| NT2RM1000224 | 8.8 | 8.63 | 15.2 | 15.51 | 21.29 | 17.61 | | |
| NT2RM1000236 | 30.38 | 24.19 | 61.14 | 72.86 | 82.44 | 71.5 | * | + |
| NT2RM1000242 | 0.23 | 1.17 | 1.32 | 0.39 | 2.27 | 0.12 | | |
| NT2RM1000244 | 1.41 | 1.48 | 3.43 | 6.9 | 3.69 | 6.7 | * | + |
| NT2RM1000252 | 1.75 | 1.5 | 3.4 | 3.4 | 3.06 | 3.18 | | |
| NT2RM1000256 | 7.88 | 5.89 | 9.46 | 26.12 | 29.45 | 36.8 | ** | + |
| NT2RM1000257 | 1.98 | 3.01 | 5.09 | 4.64 | 6.83 | 6.65 | | |
| NT2RM1000260 | 7.9 | 7.01 | 13.32 | 9.18 | 12.49 | 11.77 | | |
| NT2RM1000269 | 3.87 | 2.87 | 5.12 | 6.63 | 9.78 | 3.87 | | |
| NT2RM1000271 | 0.71 | 0.8 | 1.87 | 0.46 | 2.47 | 0.51 | | |
| NT2RM1000272 | 117.67 | 92.26 | 202.95 | 249.32 | 333.98 | 356.74 | * | + |
| NT2RM1000273 | 10.03 | 9.45 | 20.12 | 22.32 | 16.68 | 15.76 | | |
| NT2RM1000274 | 63.11 | 66.41 | 123.01 | 137.14 | 91.97 | 104.48 | | |
| NT2RM1000280 | 3.95 | 4.18 | 8.18 | 6.71 | 8.72 | 7.93 | | |
| NT2RM1000295 | 0.49 | 1 | 2.2 | 1.12 | 3.16 | 0.87 | | |
| NT2RM1000300 | 1.51 | 1.87 | 2.78 | 3.63 | 5.75 | 3.09 | | |
| NT2RM1000304 | 58.38 | 98.72 | 161.87 | 187.58 | 185.55 | 204.78 | * | + |
| NT2RM1000314 | 1.8 | 2.12 | 3.6 | 3.84 | 4.07 | 4.33 | | |
| NT2RM1000318 | 12.6 | 14.04 | 20.81 | 35.01 | 29.96 | 29.8 | ** | |
| NT2RM1000335 | 2.76 | 2.57 | 4.34 | 6.29 | 5.41 | 4.09 | | |
| NT2RM1000341 | 0.46 | 1.27 | 1.95 | 1.41 | 2.33 | 0.99 | | |
| NT2RM1000350 | 3.04 | 3.47 | 5.52 | 7.32 | 5.63 | 6.44 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM1000354 | 0.55 | 1.31 | 1.31 | 5.43 | 7.2 | 5.72 | ** | + |
| NT2RM1000355 | 30.2.43 | 1.5 | 56.85 | 74.62 | 50.25 | 61.33 | | |
| NT2RM1000361 | 3.63 | 3.87 | 7.23 | 14.39 | 20.29 | 18.78 | ** | + |
| NT2RM1000365 | 0.58 | 1.08 | 1.71 | 1.27 | 1.82 | 0.52 | | |
| NT2RM1000372 | 14.99 | 19.56 | 30.06 | 42.71 | 46.67 | 45.44 | ** | + |
| NT2RM1000377 | 2.04 | 2.18 | 9.66 | 13.38 | 14.74 | 13.48 | * | + |
| NT2RM1000388 | 0.35 | 1.57 | 3.01 | 2.2 | 3.8 | 2.42 | | |
| NT2RM1000394 | 0.45 | 1.31 | 1.87 | 1.43 | 2.72 | 0.69 | | |
| NT2RM1000399 | 0.53 | 1.57 | 3.25 | 1.98 | 3.2 | 1.81 | | |
| NT2RM1000407 | 1.13 | 1.52 | 2.17 | 1.02 | 2.7 | 1.51 | | |
| NT2RM1000421 | 0.84 | 0.57 | 2.78 | 1.06 | 1.77 | 1.13 | | |
| NT2RM1000422 | 20.65 | 23.31 | 54.69 | 87.5 | 82.91 | 79.47 | * | + |
| NT2RM1000430 | 1.22 | 1.57 | 2.01 | 3.2 | 3.67 | 2.95 | ** | + |
| NT2RM1000462 | 1.55 | 2.33 | 7.32 | 5.59 | 7.28 | 8.16 | | |
| NT2RM1000499 | 1.36 | 2.09 | 4.74 | 5 | 6.16 | 6.37 | * | + |
| NT2RM1000512 | 12.49 | 13.22 | 19.22 | 10.54 | 14.15 | 19.84 | | |
| NT2RM1000519 | 33.96 | 37.54 | 55.78 | 31.1.42 | 9.25 | 47.55 | | |
| NT2RM1000527 | 7.97 | 8.92 | 37.68 | 55.15 | 60.19 | 46.68 | * | + |
| NT2RM1000539 | 3.45 | 3.59 | 12.93 | 15.52 | 17.01 | 18.1 | * | + |
| NT2RM1000542 | 0.85 | 1.05 | 2.99 | 1.17 | 2.35 | 1.02 | | |
| NT2RM1000553 | 3.7 | 2.42 | 22.32 | 42.83 | 42.96 | 34.5 | * | + |
| NT2RM1000555 | 11.3 | 11.6 | 23.97 | 34.11 | 29.67 | 22.76 | | |
| NT2RM1000558 | 2.09 | 5.34 | 9.74 | 9.56 | 16.24 | 14.29 | | |
| NT2RM1000563 | 1.47 | 2.42 | 3.36 | 4.07 | 5.58 | 3.95 | * | + |
| NT2RM1000566 | 0.88 | 1.57 | 3.5 | 3.62 | 6.01 | 2.79 | | |
| NT2RM1000570 | 96.92 | 77.32 | 137.63 | 167.35 | 105.47 | 174.1 | | |
| NT2RM1000571 | 13.21 | 11.87 | 22.51 | 43.87 | 40.18 | 28.45 | * | + |
| NT2RM1000574 | 0.84 | 2.15 | 2.55 | 2.15 | 3.07 | 1.67 | | |
| NT2RM1000580 | 1.37 | 2.18 | 4.07 | 5.15 | 7.98 | 2.96 | | |
| NT2RM1000620 | 2.61 | 2.95 | 8.2 | 8.35 | 9.58 | 7.26 | | |
| NT2RM1000623 | 1.25 | 1.2 | 2.38 | 1.75 | 2.81 | 0.62 | | |
| NT2RM1000630 | 0.79 | 2.28 | 2.39 | 1.68 | 3.51 | 1.67 | | |
| NT2RM1000633 | 30.97 | 39.36 | 36.34 | 54.43 | 44.6 | 43.59 | * | + |
| NT2RM1000634 | 1.91 | 4.16 | 8.12 | 2.56 | 7.05 | 5.57 | | |
| NT2RM1000642 | 3.85 | 5.37 | 8.13 | 8.21 | 8.56 | 8.52 | | |
| NT2RM1000647 | 41.3 | 39.09 | 62.11 | 57.72 | 68.29 | 62.69 | | |
| NT2RM1000648 | 2.49 | 2.65 | 4.61 | 6.14 | 5.63 | 4.51 | | |
| NT2RM1000650 | 2.46 | 3.05 | 7.6 | 5.4 | 6.07 | 6 | | |
| NT2RM1000661 | 4.48 | 5.7 | 15.82 | 15.48 | 13.45 | 13.18 | | |
| NT2RM1000666 | 1 | 1.77 | 1.99 | 1.37 | 2.8 | 0.71 | | |
| NT2RM1000669 | 3.51 | 2.76 | 4.67 | 3.63 | 5.42 | 3.28 | | |
| NT2RM1000672 | 2.23 | 3.95 | 7.81 | 3.98 | 8.47 | 7.22 | | |
| NT2RM1000681 | 99.53 | 86.09 | 118.7 | 105.41 | 90.59 | 124.14 | | |
| NT2RM1000691 | 2.02 | 2.61 | 5.74 | 3.61 | 7.69 | 3.76 | | |
| NT2RM1000698 | 1.11 | 1.43 | 4 | 6.42 | 6.29 | 4.11 | * | + |
| NT2RM1000699 | 1.85 | 2.86 | 3.17 | 3.67 | 4.35 | 4.15 | * | + |
| NT2RM1000702 | 3.71 | 4.64 | 9.47 | 9.31 | 9.72 | 11.4 | | |
| NT2RM1000703 | 11.56 | 12.36 | 25.24 | 26.72 | 20.42 | 21.06 | | |
| NT2RM1000704 | 24.48 | 23 | 32.91 | 46.54 | 24.13 | 40.82 | | |
| NT2RM1000725 | 60.92 | 59.45 | 88.28 | 94.89 | 82.36 | 105.67 | | |
| NT2RM1000726 | 1.85 | 2.02 | 5.75 | 1.97 | 4.8 | 4 | | |
| NT2RM1000731 | 1.11 | 2.24 | 4.98 | 2.45 | 3.47 | 3.43 | | |
| NT2RM1000741 | 1.38 | 1.87 | 3.16 | 2.69 | 4.15 | 2.9 | | |
| NT2RM1000742 | 2.61 | 4.6 | 7.41 | 9.55 | 10.94 | 9.84 | * | + |
| NT2RM1000744 | 2.1 | 3.61 | 7.14 | 4.05 | 5.24 | 5.05 | | |
| NT2RM1000746 | 2.25 | 2.47 | 2.95 | 2.22 | 4.01 | 3.89 | | |
| NT2RM1000747 | 23.34 | 23.92 | 46.23 | 44.66 | 50.12 | 55.15 | | |
| NT2RM1000752 | 3.83 | 2.36 | 4.62 | 3.95 | 4.88 | 3.46 | | |
| NT2RM1000767 | 4.14 | 7.27 | 35.27 | 25.27 | 38.02 | 28.81 | | |
| NT2RM1000770 | 2.97 | 3.08 | 6.36 | 4.71 | 6.71 | 5.67 | | |
| NT2RM1000772 | 0.76 | 0.7 | 1.07 | 1.34 | 1.69 | 0.44 | | |
| NT2RM1000779 | 13.03 | 12.11 | 42.22 | 53.91 | 45.61 | 66.73 | * | + |
| NT2RM1000780 | 1.16 | 2.9 | 3.74 | 3.09 | 4.32 | 3.01 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM1000781 | 1.07 | 0.98 | 1.71 | 2.58 | 4.4 | 1.93 | | |
| NT2RM1000789 | 5.28 | 5.15 | 29.74 | 29.63 | 46.72 | 36.53 | | |
| NT2RM1000800 | 2.87 | 2.63 | 6 | 3.75 | 66.95 | 76.96 | | |
| NT2RM1000802 | 2.44 | 2.99 | 7.5 | 4.34 | 5.47 | 4.82 | | |
| NT2RM1000811 | 1.78 | 1.6 | 2.13 | 2.26 | 4.96 | 2.76 | | |
| NT2RM1000826 | 6.06 | 6.36 | 13.34 | 14.42 | 20.73 | 20.98 | * | + |
| NT2RM1000829 | 3.91 | 2.87 | 6.39 | 6.73 | 8.48 | 8.41 | * | + |
| NT2RM1000831 | 81.54 | 64.45 | 185.14 | 182.43 | 179.79 | 197.27 | | |
| NT2RM1000833 | 14.58 | 13.33 | 42.25 | 76.74 | 73.25 | 67.48 | ** | + |
| NT2RM1000834 | 4.06 | 3.09 | 6.2 | 8.49 | 9.42 | 10.49 | ** | + |
| NT2RM1000841 | 12.34 | 10.01 | 21.15 | 34.98 | 36.63 | 30.81 | ** | + |
| NT2RM1000848 | 4.79 | 4.42 | 6.44 | 9.36 | 12.74 | 10.45 | ** | + |
| NT2RM1000850 | 2.66 | 3.42 | 13.41 | 8.55 | 11.79 | 9.74 | | |
| NT2RM1000852 | 1.34 | 1.94 | 3.23 | 3.01 | 5.76 | 2.61 | | |
| NT2RM1000853 | 1.19 | 2.85 | 2.15 | 3.11 | 3.26 | 3.23 | | |
| NT2RM1000855 | 29.27 | 24.82 | 45.19 | 52.48 | 45.32 | 58.45 | | |
| NT2RM1000857 | 4.63 | 5 | 10.67 | 8.76 | 11.3 | 10.76 | | |
| NT2RM1000858 | 7.3 | 7.6 | 15.86 | 9.09 | 11.56 | 10.93 | | |
| NT2RM1000867 | 19.42 | 15.85 | 28.13 | 2.52 | 35.03 | 24.06 | | |
| NT2RM1000874 | 3.15 | 2.65 | 7.03 | 5.17 | 9.62 | 5.31 | | |
| NT2RM1000882 | 2.36 | 1.37 | 3.71 | 5.39 | 9.31 | 5.45 | * | + |
| NT2RM1000883 | 5.21 | 3.34 | 7.42 | 5.18 | 11.3 | 7.9 | | |
| NT2RM1000885 | 3.86 | 4.43 | 9.4 | 7.59 | 8.15 | 9.8 | | |
| NT2RM1000893 | 3.15 | 3.41 | 8.14 | 7.73 | 6.17 | 8.39 | | |
| NT2RM1000894 | 3.29 | 4.4 | 6.18 | 8.14 | 6.11 | 6.61 | | |
| NT2RM1000898 | 3.72 | 7.33 | 10.02 | 13.4 | 17.51 | 12.41 | * | + |
| NT2RM1000899 | 1.02 | 2.22 | 3.07 | 3.68 | 7.49 | 4.69 | | |
| NT2RM1000905 | 11.92 | 17.41 | 30.36 | 37.19 | 45.16 | 37.3 | * | + |
| NT2RM1000910 | 7.5 | 8.78 | 20.16 | 36.37 | 36.98 | 37.5 | ** | + |
| NT2RM1000914 | 6.46 | 7.69 | 19.74 | 14.28 | 17.33 | 17.77 | | |
| NT2RM1000919 | 6.1 | 3.92 | 9.91 | 14.61 | 17.49 | 15.37 | ** | + |
| NT2RM1000921 | 0.72 | 1.9 | 3.69 | 2.79 | 4.27 | 3.32 | | |
| NT2RM1000922 | 4.7 | 6.11 | 8.09 | 9.03 | 5.21 | 6.36 | | |
| NT2RM1000924 | 0.89 | 3.03 | 3.04 | 3.08 | 2.89 | 3 | | |
| NT2RM1000927 | 1.35 | 1.78 | 2.85 | 3.07 | 4.72 | 3.46 | | |
| NT2RM1000951 | 7.95 | 11.33 | 26.73 | 32.33 | 34.46 | 31.18 | * | + |
| NT2RM1000956 | 7.91 | 6.36 | 13.35 | 23.61 | 27.46 | 21.91 | ** | + |
| NT2RM1000960 | 12.48 | 10.27 | 29.06 | 34.95 | 37.47 | 38.96 | * | + |
| NT2RM1000961 | 3.28 | 3.61 | 7.45 | 9.44 | 13.18 | 8.11 | | |
| NT2RM1000962 | 4.14 | 3.5 | 8.18 | 7.59 | 10.15 | 9.86 | | |
| NT2RM1000973 | 16.71 | 15.79 | 29.32 | 31.15 | 11.56 | 27.73 | | |
| NT2RM1000978 | 0.57 | 1.46 | 1.58 | 0.95 | 2.64 | 0.44 | | |
| NT2RM1000982 | 2.34 | 2.29 | 3.52 | 3.57 | 4.94 | 4.54 | * | + |
| NT2RM1000991 | 1.61 | 1.78 | 4.25 | 3.88 | 5.56 | 5.23 | | |
| NT2RM1000994 | 6.36 | 6.16 | 12.57 | 16.52 | 16.64 | 14.53 | * | + |
| NT2RM1001002 | 5.11 | 6.69 | 15.34 | 21.78 | 22.69 | 22.28 | * | + |
| NT2RM1001003 | 5.42 | 5.15 | 11.98 | 16.24 | 9.06 | 8.46 | | |
| NT2RM1001008 | 1.4 | 2.22 | 2.48 | 1.83 | 4.34 | 4.33 | | |
| NT2RM1001011 | 6.29 | 5.43 | 7.86 | 14.4 | 10.46 | 14.72 | * | + |
| NT2RM1001013 | 2.9 | 2.75 | 4.75 | 8.29 | 7.96 | 5.81 | * | + |
| NT2RM1001017 | 1 | 1.82 | 3.44 | 3.28 | 4.86 | 3.92 | | |
| NT2RM1001018 | 65.15 | 74.45 | 146.86 | 134.65 | 125.46 | 113.93 | | |
| NT2RM1001026 | 1.37 | 2.64 | 3.17 | 2.99 | 4.61 | 3.31 | | |
| NT2RM1001028 | 0.98 | 1.73 | 2.91 | 1.74 | 1.89 | 0.76 | | |
| NT2RM1001043 | 4.47 | 3.64 | 8.42 | 11.43 | 12.7 | 8.01 | | |
| NT2RM1001044 | 2.23 | 3.17 | 4.92 | 5.03 | 5.51 | 3.93 | | |
| NT2RM1001059 | 1.47 | 3.72 | 4.12 | 4.05 | 6.11 | 3.02 | | |
| NT2RM1001063 | 4.11 | 3.29 | 6.1 | 4.22 | 5.64 | 5.6 | | |
| NT2RM1001066 | 0.86 | 1.85 | 2.44 | 2.23 | 3.99 | 2.85 | | |
| NT2RM1001072 | 1.8 | 2.8 | 4.33 | 1.94 | 3.74 | 1.52 | | |
| NT2RM1001074 | 1.66 | 2.38 | 5.18 | 5.18 | 4.19 | 2.67 | | |
| NT2RM1001076 | 1.39 | 2.2 | 4.94 | 3.43 | 4.42 | 1.72 | | |
| NT2RM1001082 | 1.79 | 2.6 | 5.23 | 5.31 | 5.92 | 4.57 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM1001085 | 1.25 | 1.65 | 2.81 | 1.16 | 3.27 | 1.17 | | |
| NT2RM1001092 | 3.82 | 4.2 | 5.57 | 9.34 | 7.94 | 9.82 | ** | + |
| NT2RM1001102 | 1.7 | 2.3 | 4.4 | 2.49 | 5.94 | 4.64 | | |
| NT2RM1001103 | 4.37 | 3.88 | 7.18 | 6.25 | 10.28 | 8.08 | | |
| NT2RM1001105 | 1.77 | 2.02 | 4.63 | 2.49 | 5.11 | 3.51 | | |
| NT2RM1001112 | 2.68 | 2.66 | 3.69 | 3.85 | 4.75 | 2.43 | | |
| NT2RM1001115 | 1.44 | 1.57 | 4.72 | 3 | 6.46 | 3.73 | | |
| NT2RM1001122 | 2.84 | 3.35 | 7.3 | 9.43 | 9.75 | 9.54 | * | + |
| NT2RM1001136 | 0.88 | 1.41 | 2.71 | 2.31 | 3.87 | 1.59 | | |
| NT2RM1001139 | 3.9 | 3.7 | 5.38 | 5.33 | 11.18 | 6.77 | | |
| NT2RM2000003 | 2.45 | 3.33 | 2.4 | 4.5 | 6.29 | 4.88 | * | + |
| NT2RM2000006 | 2.34 | 2.95 | 7.25 | 5.12 | 7.11 | 6.24 | | |
| NT2RM2000010 | 12.79 | 13.03 | 22.58 | 20.2 | 17.11 | 21.83 | | |
| NT2RM2000013 | 8.1 | 9.44 | 50.36 | 68.75 | 95.32 | 74.36 | * | + |
| NT2RM2000030 | 4.8 | 2.21 | 23.41 | 26.33 | 32.15 | 28.69 | | |
| NT2RM2000032 | 2.76 | 2.92 | 8.53 | 10.01 | 12.19 | 10.67 | * | + |
| NT2RM2000039 | 3.94 | 4.67 | 4.75 | 6.42 | 5.78 | 4.99 | | |
| NT2RM2000042 | 3.5 | 4.9 | 11.69 | 17.71 | 17.4 | 15.02 | * | + |
| NT2RM2000092 | 1 | 2.38 | 1.98 | 1.29 | 4.69 | 2.25 | | |
| NT2RM2000093 | 8.37 | 6.63 | 11.41 | 9.02 | 12.23 | 10.18 | | |
| NT2RM2000101 | 9.2 | 9.94 | 40 | 61.09 | 76.38 | 69.62 | * | + |
| NT2RM2000104 | 6.82 | 8.02 | 46.75 | 51.34 | 68.83 | 43.48 | | |
| NT2RM2000124 | 1.54 | 2.23 | 6.33 | 7.73 | 8.84 | 8.47 | * | + |
| NT2RM2000155 | 5.08 | 3.77 | 5.8 | 9.45 | 11.58 | 12.51 | ** | + |
| NT2RM2000191 | 3.33 | 5.68 | 28.62 | 26.54 | 34.38 | 31.6 | | |
| NT2RM2000192 | 1.03 | 1.29 | 2.45 | 6.3 | 4.75 | 3.83 | * | + |
| NT2RM2000239 | 1.92 | 2.79 | 3.09 | 2.85 | 5.02 | 3.1 | | |
| NT2RM2000240 | 32.78 | 29.59 | 74.35 | 61.15 | 60.54 | 61.71 | | |
| NT2RM2000241 | 4.49 | 5.9 | 6.35 | 8.24 | 11.72 | 6.78 | | |
| NT2RM2000250 | 1.29 | 1.54 | 4.16 | 2.09 | 5.05 | 2.54 | | |
| NT2RM2000259 | 3.06 | 3.42 | 3.59 | 6.38 | 8.44 | 6.74 | ** | + |
| NT2RM2000260 | 2.53 | 2.05 | 3.12 | 4.23 | 4.07 | 5.79 | * | + |
| NT2RM2000265 | 0.91 | 1.55 | 0.99 | 1.43 | 2.4 | 1.09 | | |
| NT2RM2000287 | 4.7 | 4.23 | 10.82 | 10.69 | 11.54 | 14.73 | | |
| NT2RM2000306 | 12.24 | 9.36 | 10.48 | 23.63 | 14 | 20.79 | * | + |
| NT2RM2000312 | 19.4 | 17.81 | 25.01 | 38.39 | 31.27 | 24.8 | | |
| NT2RM2000322 | 1.93 | 1.82 | 4.48 | 3.79 | 7.05 | 3.32 | | |
| NT2RM2000343 | 7.74 | 8.38 | 41.34 | 63.81 | 79.6 | 71.12 | * | + |
| NT2RM2000359 | 3.67 | 2.86 | 4.95 | 4.93 | 9.55 | 4.72 | | |
| NT2RM2000362 | 20.09 | 18.2 | 62.29 | 94.88 | 111.25 | 95.66 | * | + |
| NT2RM2000363 | 1.08 | 1.89 | 2.97 | 4.2 | 4.32 | 3.33 | * | + |
| NT2RM2000368 | 2.84 | 2.4 | 4.74 | 6.15 | 5.98 | 5.29 | * | |
| NT2RM2000371 | 76.64 | 65.68 | 119.32 | 135.82 | 125 | 44.64 | | |
| NT2RM2000374 | 1.68 | 1.92 | 5.75 | 3.34 | 4.8 | 3.58 | | |
| NT2RM2000387 | 8.98 | 9.83 | 11.92 | 20.02 | 25.18 | 17.11 | * | + |
| NT2RM2000393 | 1.7 | 1.63 | 3.75 | 3.31 | 7.65 | 3.28 | | |
| NT2RM2000395 | 1.07 | 1.51 | 1.98 | 1.72 | 4.34 | 2.23 | | |
| NT2RM2000402 | 12.38 | 11 | 15.78 | 25.15 | 18.31 | 22.51 | * | + |
| NT2RM2000405 | 1.33 | 1.25 | 2.2 | 1.52 | 3.08 | 3.16 | | |
| NT2RM2000407 | 0.76 | 1.78 | 2.49 | 1.89 | 2.72 | 2.89 | | |
| NT2RM2000410 | 0.79 | 1.94 | 2.23 | 1.98 | 2.84 | 2.09 | | |
| NT2RM2000420 | 3.09 | 2.52 | 4.43 | 4.24 | 4.5 | 3.26 | | |
| NT2RM2000422 | 3.22 | 2.44 | 5.81 | 3.61 | 6.17 | 2.87 | | |
| NT2RM2000423 | 1.91 | 1.96 | 5.69 | 3.89 | 7.64 | 4.18 | | |
| NT2RM2000452 | 3.46 | 3.18 | 4.31 | 7.35 | 8.65 | 9.57 | ** | + |
| NT2RM2000469 | 3.28 | 3.28 | 4.44 | 1.87 | 2.33 | 2.46 | * | − |
| NT2RM2000490 | 6.03 | 6.03 | 9.18 | 5.55 | 6.16 | 6.9 | | |
| NT2RM2000497 | 3.29 | 3.29 | 4.59 | 3.15 | 5.48 | 2.43 | | |
| NT2RM2000502 | 4.69 | 4.69 | 10.24 | 5.87 | 7.08 | 7.02 | | |
| NT2RM2000504 | 7.37 | 7.37 | 12.93 | 10.83 | 4.49 | 11.2 | | |
| NT2RM2000514 | 2.75 | 2.75 | 6.23 | 3.11 | 3.32 | 3.8 | | |
| NT2RM2000522 | 1.9 | 1.9 | 3.27 | 1.94 | 1.18 | 1.13 | | |
| NT2RM2000540 | 6.02 | 6.02 | 9.53 | 9.12 | 8.96 | 8.14 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM2000556 | 2.09 | 2.09 | 2.8 | 1.24 | 2.33 | 0.93 | | |
| NT2RM2000565 | 3.35 | 3.35 | 6.02 | 3.27 | 4.14 | 3.72 | | |
| NT2RM2000566 | 6.59 | 6.59 | 15.8 | 9.09 | 9.21 | 9.57 | | |
| NT2RM2000567 | 2.16 | 2.16 | 5.64 | 2 | 5.67 | 3.82 | | |
| NT2RM2000569 | 4.69 | 4.69 | 7.93 | 5.77 | 8.18 | 4.7 | | |
| NT2RM2000577 | 11.08 | 11.08 | 15.39 | 11.79 | 14.95 | 14.48 | | |
| NT2RM2000581 | 4.64 | 4.64 | 6.49 | 5.98 | 7.97 | 6.85 | | |
| NT2RM2000582 | 5.23 | 5.23 | 10.34 | 8.34 | 9.14 | 7.19 | | |
| NT2RM2000588 | 21.84 | 21.84 | 65.91 | 40.15 | 44.01 | 45.21 | | |
| NT2RM2000589 | 3.98 | 3.98 | 11.35 | 7.96 | 7.6 | 8.64 | | |
| NT2RM2000594 | 1.87 | 1.87 | 4.38 | 1.62 | 2.71 | 1.92 | | |
| NT2RM2000599 | 6.34 | 6.34 | 16.12 | 17.82 | 14.5 | 15.44 | | |
| NT2RM2000609 | 4.61 | 4.61 | 6.77 | 3.76 | 5.81 | 5.48 | | |
| NT2RM2000612 | 3.52 | 3.52 | 6.4 | 5.93 | 7.47 | 4.55 | | |
| NT2RM2000622 | 16.6 | 16.6 | 56.24 | 53.07 | 75.02 | 55.48 | | |
| NT2RM2000623 | 2.66 | 2.66 | 7.1 | 7.92 | 6.03 | 5.58 | | |
| NT2RM2000624 | 4.18 | 4.18 | 10.6 | 7.33 | 14.39 | 7.56 | | |
| NT2RM2000632 | 2.8 | 2.8 | 6.73 | 4.1 | 6.4 | 4.73 | | |
| NT2RM2000635 | 3.42 | 3.42 | 8.09 | 5.41 | 6.29 | 5.31 | | |
| NT2RM2000636 | 2.61 | 2.61 | 6.28 | 3.99 | 4.39 | 3.72 | | |
| NT2RM2000639 | 3.73 | 3.73 | 8.26 | 5.42 | 7.79 | 5.99 | | |
| NT2RM2000649 | 6.03 | 6.03 | 9.69 | 9.4 | 9.17 | 8.05 | | |
| NT2RM2000658 | 6.49 | 6.49 | 13.18 | 15.17 | 14.66 | 15.83 | * | + |
| NT2RM2000660 | 11.45 | 11.45 | 18.34 | 17.03 | 7.1 | 20.16 | | |
| NT2RM2000669 | 3.6 | 3.6 | 6.51 | 5.28 | 4.28 | 6.69 | | |
| NT2RM2000689 | 31.07 | 31.07 | 59.7 | 37.03 | 16.51 | 70.9 | | |
| NT2RM2000691 | 2.09 | 2.09 | 5.73 | 4.83 | 7.13 | 4.27 | | |
| NT2RM2000714 | 3.41 | 3.41 | 10.97 | 11.46 | 14.54 | 11.3 | | |
| NT2RM2000718 | 4.08 | 4.08 | 7.15 | 2.88 | 5.42 | 4.33 | | |
| NT2RM2000732 | 5.38 | 5.38 | 14.81 | 9.49 | 14.18 | 8.25 | | |
| NT2RM2000735 | 3.72 | 3.72 | 6.16 | 4.27 | 6.55 | 6.49 | | |
| NT2RM2000740 | 2.26 | 2.26 | 6.2 | 4.27 | 3.01 | 3.71 | | |
| NT2RM2000743 | 2.26 | 2.26 | 7.89 | 5.65 | 3.24 | 3.89 | | |
| NT2RM2000772 | 6.43 | 6.43 | 8.48 | 5.24 | 6.72 | 9.47 | | |
| NT2RM2000773 | 8.17 | 8.17 | 19.56 | 19.18 | 17.96 | 18.29 | | |
| NT2RM2000776 | 13.96 | 13.96 | 17.16 | 24.24 | 9.95 | 26.76 | | |
| NT2RM2000784 | 6.64 | 6.64 | 8.8 | 8.74 | 9.02 | 10.5 | | |
| NT2RM2000795 | 4.35 | 4.3.51 | 3.56 | 7.44 | 8.66 | 10.45 | | |
| NT2RM2000796 | 2.27 | 2.27 | 4.64 | 1.71 | 2.31 | 1.38 | | |
| NT2RM2000798 | 25.81 | 25.81 | 160.08 | 158.19 | 136.83 | 188.99 | | |
| NT2RM2000801 | 45.0.94 | 5.09 | 161.29 | 160.44 | 152.13 | 189.56 | | |
| NT2RM2000821 | 7.53 | 7.53 | 12.33 | 7.37 | 7.77 | 11.87 | | |
| NT2RM2000829 | 5.76 | 5.76 | 13.01 | 8.05 | 10.13 | 11.75 | | |
| NT2RM2000837 | 3.29 | 3.29 | 7.28 | 4.27 | 6.08 | 4.18 | | |
| NT2RM2000924 | 9.96 | 9.96 | 36.74 | 43.24 | 57.8 | 35.84 | | |
| NT2RM2000930 | 10.64 | 10.64 | 18.29 | 24.45 | 27.78 | 28.34 | ** | + |
| NT2RM2000937 | 4.35 | 4.35 | 8.62 | 5.08 | 6.66 | 6.56 | | |
| NT2RM2000939 | 1.12 | 1.12 | 2.37 | 2.67 | 1.84 | 1.82 | | |
| NT2RM2000942 | 124.8 | 124.8 | 253.61 | 161.4 | 118.61 | 210.11 | | |
| NT2RM2000951 | 1.01 | 1.01 | 2.6 | 2.13 | 3.12 | 1.6 | | |
| NT2RM2000952 | 2.53 | 2.53 | 5.31 | 5.98 | 6.41 | 6.86 | * | + |
| NT2RM2000966 | 19.69 | 19.69 | 111.88 | 95.61 | 137.32 | 135.9 | | |
| NT2RM2000973 | 23.45 | 23.45 | 16.81 | 39.12 | 39.51 | 33.8 | ** | + |
| NT2RM2000983 | 10.07 | 10.07 | 18.59 | 30.68 | 39.13 | 27.52 | * | + |
| NT2RM2000984 | 6.48 | 6.48 | 7.71 | 4.88 | 5.64 | 5.26 | * | − |
| NT2RM2000994 | 8.27 | 8.27 | 16.47 | 13.2 | 8.36 | 21.81 | | |
| NT2RM2001004 | 6.01 | 6.01 | 48.58 | 47.51 | 54.15 | 46.8 | | |
| NT2RM2001022 | 101.09 | 101.09 | 350.92 | 239.63 | 304.37 | 490.04 | | |
| NT2RM2001035 | 10.75 | 10.75 | 24.98 | 24.17 | 24.54 | 34.51 | | |
| NT2RM2001038 | 5.77 | 5.77 | 9.86 | 10.48 | 11.75 | 7.9 | | |
| NT2RM2001043 | 4.45 | 4.45 | 10.02 | 5.1 | 7.41 | 6.74 | | |
| NT2RM2001050 | 2.71 | 2.71 | 6.89 | 4.72 | 5.83 | 4.03 | | |
| NT2RM2001055 | 3.78 | 3.78 | 5.89 | 4.24 | 6.31 | 4.7 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM2001065 | 6.17 | 6.17 | 15.91 | 8.51 | 12.12 | 14.21 | | |
| NT2RM2001075 | 39.81 | 39.81 | 188.21 | 154.65 | 156.72 | 168.68 | | |
| NT2RM2001083 | 2.23 | 2.23 | 5.57 | 4.01 | 5.8 | 3.01 | | |
| NT2RM2001100 | 10.38 | 10.38 | 93.67 | 95.8 | 113.9 | 97.52 | | |
| NT2RM2001105 | 6.34 | 6.34 | 8.27 | 11.35 | 5.34 | 11.8 | | |
| NT2RM2001109 | 6.81 | 6.81 | 9.4 | 11.88 | 12.47 | 14.53 | * | + |
| NT2RM2001110 | 7.67 | 7.67 | 21.63 | 21.2 | 30.71 | 23.29 | | |
| NT2RM2001126 | 6.1 | 6.1 | 6.53 | 5.32 | 6.44 | 7.27 | | |
| NT2RM2001131 | 5.52 | 5.52 | 40.22 | 21.93 | 29.37 | 20.14 | | |
| NT2RM2001141 | 1.64 | 1.64 | 6.84 | 7.09 | 6.4 | 5.45 | | |
| NT2RM2001152 | 1.63 | 1.63 | 3.27 | 4.42 | 5.77 | 3.02 | | |
| NT2RM2001177 | 3.42 | 3.42 | 7.23 | 10.28 | 7.25 | 8.24 | | |
| NT2RM2001194 | 2.74 | 2.74 | 7.51 | 6.68 | 5.77 | 8.17 | | |
| NT2RM2001195 | 3.7 | 3.7 | 8.8 | 6.37 | 7.13 | 6.89 | | |
| NT2RM2001196 | 5.24 | 5.24 | 6.35 | 5.19 | 6.46 | 4.64 | | |
| NT2RM2001201 | 14.45 | 14.45 | 25.36 | 20.02 | 21.68 | 22.38 | | |
| NT2RM2001221 | 4.22 | 4.22 | 8.61 | 11.69 | 13.61 | 16.63 | * | + |
| NT2RM2001238 | 2.87 | 2.87 | 5.65 | 3.91 | 3.88 | 1.96 | | |
| NT2RM2001243 | 5.39 | 5.39 | 8.98 | 9.81 | 6.13 | 6.53 | | |
| NT2RM2001244 | 3.91 | 3.91 | 10.63 | 6.58 | 9.24 | 6.41 | | |
| NT2RM2001247 | 14.94 | 14.94 | 121.59 | 110.47 | 140.27 | 118.79 | | |
| NT2RM2001256 | 3.84 | 3.84 | 5.23 | 3.15 | 3.26 | 2.96 | | |
| NT2RM2001269 | 4.4 | 4.4 | 5.98 | 4.8 | 5.63 | 4.74 | | |
| NT2RM2001278 | 5.28 | 5.28 | 7.37 | 8.45 | 8.56 | 5.35 | | |
| NT2RM2001291 | 3.05 | 3.05 | 5.18 | 3.24 | 4.62 | 2.9 | | |
| NT2RM2001294 | 12.47 | 12.47 | 24.39 | 20.08 | 15.43 | 17.81 | | |
| NT2RM2001295 | 2.56 | 2.56 | 8.82 | 4.54 | 4.43 | 4.99 | | |
| NT2RM2001302 | 2.38 | 2.38 | 4.55 | 2.3 | 4.5 | 2.81 | | |
| NT2RM2001306 | 3.51 | 3.51 | 7.62 | 4.1 | 4.46 | 5.14 | | |
| NT2RM2001312 | 2.34 | 2.34 | 3.72 | 1.92 | 2.84 | 1.68 | | |
| NT2RM2001319 | 2.76 | 2.76 | 3.93 | 3.61 | 5.29 | 4.11 | | |
| NT2RM2001324 | 3.73 | 3.73 | 8.29 | 5.48 | 4.9 | 5.71 | | |
| NT2RM2001345 | 8.53 | 8.53 | 10.01 | 6.83 | 11.12 | 14.14 | | |
| NT2RM2001360 | 4.02 | 4.02 | 6.36 | 5.67 | 5.9 | 5.46 | | |
| NT2RM2001370 | 5.75 | 5.75 | 14.53 | 8.56 | 9.86 | 11.69 | | |
| NT2RM2001391 | 1.79 | 1.79 | 6.07 | 1.85 | 5.04 | 1.65 | | |
| NT2RM2001393 | 4.49 | 4.49 | 6.39 | 5.12 | 7.91 | 7.14 | | |
| NT2RM2001420 | 2.94 | 2.94 | 4.61 | 2.61 | 3.62 | 3.14 | | |
| NT2RM2001423 | 5.44 | 5.44 | 9.53 | 8.64 | 11.95 | 11.36 | | |
| NT2RM2001424 | 5.88 | 5.88 | 15.09 | 11.77 | 10.31 | 11.63 | | |
| NT2RM2001482 | 2.24 | 2.24 | 6.48 | 3.5 | 6.06 | 3.63 | | |
| NT2RM2001499 | 1.4 | 1.4 | 5.81 | 2.84 | 4.3 | 2.17 | | |
| NT2RM2001504 | 3.63 | 3.63 | 6.99 | 3.2 | 4.54 | 1.68 | | |
| NT2RM2001524 | 2.51 | 2.51 | 5.81 | 2.34 | 2.22 | 3.51 | | |
| NT2RM2001530 | 2.56 | 2.56 | 4.42 | 2.68 | 4.35 | 3.52 | | |
| NT2RM2001533 | 5.06 | 5.06 | 9.09 | 8.2 | 9.18 | 7.84 | | |
| NT2RM2001540 | 5.77 | 5.77 | 8.36 | 14.57 | 17.99 | 27.1 | * | + |
| NT2RM2001544 | 2.4 | 2.4 | 6.12 | 3.7 | 3.72 | 2.31 | | |
| NT2RM2001547 | 6.6 | 6.61 | 5.29 | 8.44 | 7.61 | 8.24 | | |
| NT2RM2001558 | 1.53 | 1.53 | 3.44 | 1.76 | 4.87 | 1.71 | | |
| NT2RM2001575 | 2.45 | 2.45 | 4.57 | 3.36 | 4.38 | 2.29 | | |
| NT2RM2001582 | 2.99 | 2.99 | 4.98 | 2.2 | 5.16 | 3.06 | | |
| NT2RM2001588 | 3.69 | 3.69 | 8.8 | 6.39 | 9.14 | 6.6 | | |
| NT2RM2001592 | 2.66 | 2.66 | 6.2 | 3.1 | 5.24 | 4.64 | | |
| NT2RM2001603 | 4.74 | 4.74 | 8.7 | 10.42 | 12.03 | 11.77 | * | + |
| NT2RM2001605 | 1.74 | 1.74 | 4.52 | 3.08 | 1.51 | 2.39 | | |
| NT2RM2001611 | 2.28 | 2.28 | 8.63 | 3.74 | 3.34 | 3.51 | | |
| NT2RM2001613 | 14.91 | 14.91 | 32.53 | 21.51 | 13.13 | 27.42 | | |
| NT2RM2001626 | 2.45 | 2.45 | 3.08 | 2.1 | 4.28 | 2.06 | | |
| NT2RM2001632 | 4.93 | 4.93 | 7.07 | 4.67 | 4.88 | 5.42 | | |
| NT2RM2001633 | 4.45 | 4.45 | 10.39 | 3.74 | 5.15 | 5.43 | | |
| NT2RM2001635 | 4.33 | 4.33 | 9.54 | 4.3 | 5.81 | 4.7 | | |
| NT2RM2001636 | 4.88 | 4.88 | 7.35 | 12.75 | 18.11 | 13.34 | ** | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM2001637 | 1.25 | 1.25 | 6.48 | 4.18 | 3.68 | 2.51 | | |
| NT2RM2001639 | 3.98 | 3.98 | 9.32 | 4.67 | 4.33 | 3.29 | | |
| NT2RM2001641 | 1.63 | 1.63 | 4.69 | 4.84 | 6.02 | 2.71 | | |
| NT2RM2001643 | 2.78 | 2.78 | 7.46 | 4.79 | 4.4 | 2.83 | | |
| NT2RM2001648 | 12.97 | 12.97 | 18.91 | 20.13 | 17.07 | 25.5 | | |
| NT2RM2001652 | 6.32 | 6.32 | 5.65 | 4.29 | 8.13 | 4.46 | | |
| NT2RM2001659 | 5.78 | 5.78 | 9.17 | 5.73 | 5.28 | 6.95 | | |
| NT2RM2001660 | 3.44 | 3.44 | 3.86 | 2.08 | 2.29 | 2.63 | ** | − |
| NT2RM2001664 | 1.24 | 1.24 | 6.12 | 4.51 | 4.89 | 4.8 | | |
| NT2RM2001668 | 3.72 | 3.72 | 8.16 | 7.66 | 5.72 | 7.02 | | |
| NT2RM2001670 | 1.62 | 1.62 | 4.11 | 2.88 | 3.96 | 3.56 | | |
| NT2RM2001671 | 2.67 | 2.67 | 5.57 | 3.9 | 6.46 | 4.85 | | |
| NT2RM2001675 | 1.94 | 1.94 | 4.28 | 1.97 | 3.73 | 0.64 | | |
| NT2RM2001681 | 2.47 | 2.47 | 5.91 | 3.13 | 4.64 | 3.39 | | |
| NT2RM2001685 | 4.58 | 4.58 | 5.68 | 1.29 | 2.72 | 1.14 | ** | − |
| NT2RM2001688 | 5.46 | 5.46 | 4.14 | 3.11 | 3.82 | 2.46 | * | − |
| NT2RM2001695 | 15.09 | 15.09 | 35.18 | 17.41 | 19.26 | 34.51 | | |
| NT2RM2001696 | 2.74 | 2.74 | 6.64 | 7.15 | 6.7 | 6.8 | | |
| NT2RM2001698 | 1.44 | 1.44 | 3 | 4.06 | 3.49 | 1.65 | | |
| NT2RM2001699 | 1.63 | 1.63 | 5.03 | 4.19 | 3.75 | 5.48 | | |
| NT2RM2001700 | 1.65 | 1.65 | 4.13 | 2.56 | 3.37 | 3.91 | | |
| NT2RM2001704 | 2.68 | 2.68 | 5.46 | 3.89 | 3.85 | 3.99 | | |
| NT2RM2001706 | 4.29 | 4.29 | 6.77 | 3.33 | 3.13 | 3.32 | | |
| NT2RM2001714 | 6.48 | 6.48 | 6.64 | 5.62 | 7.33 | 5.18 | | |
| NT2RM2001716 | 0.97 | 0.97 | 3.7 | 3.03 | 5.49 | 2.92 | | |
| NT2RM2001718 | 1.91 | 1.91 | 3.47 | 5 | 3.5 | 3 | | |
| NT2RM2001723 | 2.09 | 2.09 | 5.48 | 5.1 | 5.21 | 5.71 | | |
| NT2RM2001727 | 3.08 | 3.08 | 6.25 | 7.51 | 7.28 | 5.7 | | |
| NT2RM2001730 | 3.52 | 3.52 | 7.15 | 5.04 | 5.43 | 3.85 | | |
| NT2RM2001738 | 4.56 | 4.56 | 6.2 | 6.71 | 10.25 | 9.08 | * | + |
| NT2RM2001743 | 2.95 | 2.95 | 5.81 | 4.39 | 5.02 | 4.46 | | |
| NT2RM2001753 | 5.98 | 5.98 | 7.55 | 5.72 | 6.09 | 4.54 | | |
| NT2RM2001755 | 0.89 | 0.89 | 2.82 | 2.4 | 2.83 | 2.67 | | |
| NT2RM2001760 | 14.77 | 14.77 | 33.17 | 27.49 | 25.48 | 36.23 | | |
| NT2RM2001765 | 1.35 | 1.35 | 1.71 | 2.45 | 3.12 | 2.03 | * | + |
| NT2RM2001767 | 12.04 | 12.04 | 120.66 | 148.84 | 168.4 | 146.29 | * | + |
| NT2RM2001768 | 2.1 | 2.1 | 3.59 | 3.41 | 4.21 | 3.05 | | |
| NT2RM2001771 | 4.82 | 4.82 | 5.65 | 7.15 | 5.97 | 5.05 | | |
| NT2RM2001778 | 2.89 | 2.89 | 4.09 | 2.34 | 3.24 | 1.48 | | |
| NT2RM2001782 | 5.32 | 5.32 | 7.32 | 4.96 | 7.71 | 7.57 | | |
| NT2RM2001784 | 0.84 | 0.84 | 2.19 | 2.81 | 2.5 | 1.41 | | |
| NT2RM2001785 | 1.35 | 1.35 | 4.11 | 5.5 | 5.02 | 2.76 | | |
| NT2RM2001792 | 6.03 | 6.03 | 8.53 | 5.49 | 5.54 | 5.76 | | |
| NT2RM2001795 | 3.97 | 3.97 | 6.15 | 7.62 | 5.96 | 8.9 | | |
| NT2RM2001797 | 2.82 | 2.82 | 3.78 | 5 | 5.94 | 2.71 | | |
| NT2RM2001800 | 3.46 | 3.46 | 4.26 | 5.01 | 4.03 | 5.24 | | |
| NT2RM2001803 | 3.5 | 3.5 | 6.61 | 4.46 | 7.34 | 2.44 | | |
| NT2RM2001805 | 3.65 | 3.65 | 3.21 | 2.53 | 4.2 | 1.71 | | |
| NT2RM2001806 | 7.34 | 7.34 | 17.96 | 15.62 | 15.23 | 21.11 | | |
| NT2RM2001813 | 1.54 | 1.54 | 2.05 | 2.54 | 1.88 | 2.32 | | |
| NT2RM2001814 | 2.46 | 2.46 | 4.71 | 3.52 | 2.89 | 4.42 | | |
| NT2RM2001818 | 1.21 | 1.21 | 2.66 | 0.97 | 1.48 | 0.27 | | |
| NT2RM2001823 | 1.4 | 1.4 | 3.24 | 1.87 | 2.46 | 1.37 | | |
| NT2RM2001825 | 14.79 | 14.79 | 36.08 | 34.68 | 34.2 | 35.81 | | |
| NT2RM2001832 | 5.93 | 5.93 | 6.1 | 5.19 | 5.48 | 2.93 | | |
| NT2RM2001839 | 67.48 | 67.48 | 123.46 | 152.63 | 157.11 | 121.35 | | |
| NT2RM2001840 | 3.04 | 3.04 | 7.13 | 4.61 | 5.11 | 5.37 | | |
| NT2RM2001851 | 3.92 | 3.92 | 7.61 | 3.78 | 4.74 | 6.49 | | |
| NT2RM2001855 | 8.21 | 8.21 | 11.51 | 10.22 | 12.06 | 15.41 | | |
| NT2RM2001867 | 2.82 | 2.82 | 5.01 | 2.83 | 5.62 | 3.74 | | |
| NT2RM2001869 | 60.8 | 60.8 | 90.58 | 101.19 | 79.67 | 105.32 | | |
| NT2RM2001879 | 3.01 | 3.01 | 6.99 | 2.55 | 3.19 | 2.66 | | |
| NT2RM2001883 | 1.52 | 1.52 | 3.26 | 0.98 | 2.28 | 0.73 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM2001886 | 1.57 | 1.57 | 4.56 | 2.48 | 3.51 | 2.42 | | |
| NT2RM2001887 | 3.78 | 3.78 | 7.66 | 4.48 | 4.97 | 5.73 | | |
| NT2RM2001896 | 274.2 | 274.2 | 378.57 | 325.68 | 216.52 | 497.31 | | |
| NT2RM2001902 | 1.92 | 1.92 | 4.28 | 1.31 | 2.92 | 2.14 | | |
| NT2RM2001903 | 16.25 | 16.25 | 42.55 | 35.47 | 31.71 | 37.22 | | |
| NT2RM2001930 | 2.11 | 2.11 | 6.3 | 2.3 | 5.86 | 5.44 | | |
| NT2RM2001935 | 4.16 | 4.16 | 5.04 | 3.16 | 4.42 | 5.87 | | |
| NT2RM2001936 | 2.81 | 2.81 | 4.9 | 2.99 | 3.44 | 4 | | |
| NT2RM2001939 | 3.56 | 3.56 | 3.34 | 1.82 | 3.01 | 3.16 | | |
| NT2RM2001941 | 1.84 | 1.84 | 4.29 | 2.84 | 2.82 | 2.72 | | |
| NT2RM2001950 | 4.66 | 4.66 | 10 | 6.01 | 6 | 8.69 | | |
| NT2RM2001952 | 2.67 | 2.67 | 4.78 | 2.49 | 4.55 | 5.37 | | |
| NT2RM2001976 | 11.48 | 11.48 | 18.2 | 14.58 | 11.46 | 35.27 | | |
| NT2RM2001982 | 1.85 | 1.85 | 3.91 | 2.04 | 2.47 | 1.88 | | |
| NT2RM2001983 | 4.45 | 4.45 | 8.36 | 4.18 | 6.49 | 7.54 | | |
| NT2RM2001984 | 7.74 | 7.74 | 8.88 | 20.06 | 27.05 | 22.95 | ** | + |
| NT2RM2001989 | 2.72 | 2.72 | 3.68 | 2.99 | 4.26 | 3.7 | | |
| NT2RM2001996 | 7.51 | 7.51 | 8.09 | 4.8 | 8.01 | 5.29 | | |
| NT2RM2001997 | 3.65 | 3.65 | 7.29 | 3.18 | 5.09 | 6.78 | | |
| NT2RM2001998 | 2.24 | 2.24 | 5.07 | 3.33 | 6.53 | 3.96 | | |
| NT2RM2001999 | 4.86 | 4.86 | 7.69 | 6.88 | 6.02 | 4.01 | | |
| NT2RM2002003 | 11.33 | 11.33 | 18.17 | 10.15 | 11 | 14.9 | | |
| NT2RM2002004 | 1.99 | 1.99 | 5.79 | 2.51 | 2.09 | 1.9 | | |
| NT2RM2002009 | 5.35 | 5.35 | 9.03 | 9.85 | 11.04 | 11.09 | * | + |
| NT2RM2002014 | 2.62 | 2.62 | 3 | 3.65 | 4.47 | 4.03 | ** | + |
| NT2RM2002019 | 25.1 | 25.1 | 38.52 | 19.47 | 14.2 | 16.35 | | |
| NT2RM2002029 | 12.92 | 12.92 | 19.01 | 10.82 | 4.88 | 14.74 | | |
| NT2RM2002030 | 4.15 | 4.15 | 5.8 | 13.54 | 9.71 | 21.98 | * | + |
| NT2RM2002034 | 22.05 | 22.05 | 31.76 | 24.83 | 20.89 | 21.04 | | |
| NT2RM2002049 | 7.4 | 7.4 | 12.12 | 9.76 | 10.42 | 13.22 | | |
| NT2RM2002055 | 2.8 | 2.8 | 8.01 | 1.91 | 4.03 | 2.52 | | |
| NT2RM2002072 | 9.26 | 9.26 | 12.88 | 12.28 | 19.12 | 12.82 | | |
| NT2RM2002088 | 4.82 | 4.82 | 13.85 | 11.35 | 11.7 | 15.28 | | |
| NT2RM2002091 | 4.98 | 4.98 | 8.44 | 5.92 | 3.82 | 4.61 | | |
| NT2RM2002100 | 3.26 | 3.26 | 6.05 | 4.82 | 4.24 | 3.19 | | |
| NT2RM2002109 | 1.31 | 1.31 | 3.57 | 2.57 | 4.88 | 4.92 | | |
| NT2RM2002126 | 21.41 | 21.41 | 32.24 | 35.28 | 22.31 | 31.52 | | |
| NT2RM2002128 | 3.7 | 3.7 | 5.17 | 2.74 | 3.86 | 2.41 | | |
| NT2RM2002129 | 6.43 | 6.43 | 11.48 | 8.53 | 13.03 | 10.66 | | |
| NT2RM2002142 | 5.72 | 5.72 | 9.74 | 5.26 | 8.91 | 6.4 | | |
| NT2RM2002144 | 3.27 | 3.27 | 3.76 | 1.85 | 1.73 | 1.62 | ** | |
| NT2RM2002145 | 2.63 | 2.63 | 8.69 | 6.1 | 5.18 | 5.98 | | |
| NT2RM2002153 | 2.61 | 2.61 | 6.37 | 6.31 | 7.62 | 5.75 | | |
| NT2RM2002163 | 0.97 | 0.97 | 3.41 | 1.87 | 3.4 | 0.64 | | |
| NT2RM2002170 | 3.28 | 3.28 | 7.03 | 6.62 | 7.5 | 7.65 | | |
| NT2RM2002178 | 3.99 | 3.99 | 3.67 | 3.5 | 5.48 | 2.9 | | |
| NT2RM2002179 | 7.82 | 7.82 | 8.69 | 6.17 | 8.15 | 6.02 | | |
| NT2RM2002270 | 4.51 | 4.51 | 4.56 | 2.28 | 1.76 | 1.67 | ** | – |
| NT2RM2002326 | 2.47 | 2.47 | 3.86 | 2.13 | 3.69 | 2.34 | | |
| NT2RM2002337 | 1.88 | 1.88 | 3.97 | 5.4 | 4.22 | 4.79 | * | + |
| NT2RM2002339 | 2.83 | 2.83 | 6.29 | 5.26 | 5.22 | 3.85 | | |
| NT2RM2002345 | 5.16 | 5.16 | 6.03 | 4.04 | 4.2 | 4.21 | * | – |
| NT2RM2002368 | 2.43 | 2.43 | 5.86 | 6.05 | 7.01 | 4.96 | | |
| NT2RM2002381 | 2.23 | 2.23 | 5.16 | 3.47 | 3.65 | 2.8 | | |
| NT2RM2002424 | 4.64 | 4.64 | 7.1 | 6.69 | 8.5 | 6.3 | | |
| NT2RM2002450 | 4.17 | 4.17 | 3.87 | 2.29 | 2.39 | 1.87 | ** | – |
| NT2RM2002482 | 3.93 | 3.93 | 4.65 | 2.66 | 3.2 | 3.79 | | |
| NT2RM2002492 | 9.39 | 9.39 | 24.31 | 29.13 | 24.65 | 29.29 | | |
| NT2RM2002575 | 3.26 | 3.26 | 5.23 | 5.99 | 6.03 | 5.07 | | |
| NT2RM2002580 | 4.23 | 4.23 | 4.68 | 4.82 | 7.79 | 7.42 | | |
| NT2RM2002592 | 7.7 | 7.7 | 12.59 | 13.07 | 15.28 | 14.69 | * | + |
| NT2RM2002608 | 27.33 | 27.33 | 45.49 | 57.07 | 65.96 | 48.3 | * | + |
| NT2RM2002615 | 6.01 | 6.01 | 9.38 | 13.15 | 20.32 | 14.42 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM2002622 | 14.35 | 14.35 | 16.22 | 18.38 | 24.99 | 13.44 | | |
| NT2RM2002630 | 4.86 | 4.86 | 6.63 | 8.05 | 7.37 | 6.7 | | |
| NT2RM2002634 | 1.72 | 1.72 | 4.66 | 4.71 | 4.6 | 3.94 | | |
| NT2RM2002645 | 27.02 | 27.02 | 68.46 | 30.66 | 14.59 | 31.46 | | |
| NT2RM2002646 | 12.09 | 12.09 | 25.03 | 29.45 | 28.88 | 34.8 | | |
| NT2RM2002647 | 7.68 | 7.68 | 17.56 | 19.5 | 17.74 | 23.44 | | |
| NT2RM2002652 | 5.11 | 5.11 | 4.71 | 4.3 | 6.43 | 3.73 | | |
| NT2RM2002692 | 4.59 | 4.59 | 4.48 | 2..5 | 2.86 | 2.02 | ** | − |
| NT2RM2002721 | 30.26 | 30.26 | 46.01 | 62.71 | 84.18 | 61.02 | * | + |
| NT2RM2002748 | 18.37 | 18.37 | 43.62 | 87.35 | 119.27 | 102.35 | ** | + |
| NT2RM2002764 | 2.28 | 2.28 | 5.3 | 5.05 | 5.95 | 4.07 | | |
| NT2RM2002772 | 3.15 | 3.15 | 9.32 | 9.66 | 7.81 | 5.44 | | |
| NT2RM2002811 | 5.79 | 5.79 | 12.3 | 14.01 | 9.18 | 10.45 | | |
| NT2RM2002818 | 2.03 | 2.03 | 7.94 | 5.86 | 5.42 | 7.13 | | |
| NT2RM2002879 | 4.21 | 4.21 | 7.17 | 8.39 | 7.87 | 9.11 | * | + |
| NT2RM2002979 | 11.79 | 11.79 | 19.66 | 24.49 | 23.23 | 21.79 | * | + |
| NT2RM2002981 | 4.42 | 4.42 | 3.78 | 3.58 | 4.95 | 2.63 | | |
| NT2RM2002995 | 5.13 | 5.13 | 3.29 | 3.42 | 3.74 | 3.5 | | |
| NT2RM2003031 | 1.37 | 1.37 | 2.63 | 3 | 2.58 | 1.9 | | |
| NT2RM2003042 | 4.1 | 4.1 | 10.77 | 10.59 | 6.02 | 6.07 | | |
| NT2RM2003044 | 1.88 | 1.88 | 4.11 | 2.13 | 5.11 | 1.2 | | |
| NT2RM2003090 | 4.4 | 4.4 | 7.64 | 9.36 | 7.91 | 10.68 | * | + |
| NT2RM2003095 | 11.98 | 11.98 | 25.25 | 15.63 | 16.43 | 19.04 | | |
| NT2RM2003116 | 11.16 | 11.16 | 16.09 | 17.96 | 21.43 | 22.08 | * | + |
| NT2RM2003222 | 3.98 | 3.98 | 3.63 | 2.67 | 3.64 | 2.35 | | |
| NT2RM2003224 | 11.29 | 11.29 | 15.33 | 24.29 | 29.77 | 20.76 | * | + |
| NT2RM2003250 | 14.18 | 14.18 | 86.06 | 85.79 | 96.6 | 94.15 | | |
| NT2RM2003258 | 4.59 | 4.59 | 6.32 | 6.54 | 5.11 | 5.69 | | |
| NT2RM2003262 | 5.07 | 5.07 | 7.33 | 5.06 | 7.76 | 5.72 | | |
| NT2RM4000023 | 2.15 | 2.15 | 7.02 | 3.57 | 4.91 | 4.29 | | |
| NT2RM4000024 | 2.28 | 2.28 | 6.78 | 3.17 | 4.98 | 4.33 | | |
| NT2RM4000027 | 4.74 | 4.74 | 7.77 | 4.85 | 6.94 | 11.32 | | |
| NT2RM4000030 | 2.95 | 2.95 | 5.73 | 3.16 | 4.9 | 2.64 | | |
| NT2RM4000033 | 2.51 | 2.51 | 4.77 | 2.36 | 3.89 | 4.61 | | |
| NT2RM4000034 | 1.93 | 1.93 | 5.35 | 3.74 | 4.84 | 6.09 | | |
| NT2RM4000046 | 1.37 | 1.37 | 3.79 | 1.57 | 3.5 | 2.32 | | |
| NT2RM4000052 | 1.82 | 1.82 | 3.55 | 1.72 | 2.96 | 1.98 | | |
| NT2RM4000054 | 10.43 | 10.43 | 13.85 | 12.07 | 12.83 | 24.7 | | |
| NT2RM4000061 | 1.65 | 1.65 | 4.17 | 1.66 | 4.54 | 0.83 | | |
| NT2RM4000074 | 15.83 | 15.83 | 43.57 | 27.9 | 34.2.43 | 0.79 | | |
| NT2RM4000085 | 5.35 | 5.35 | 10.1 | 8.41 | 10.19 | 10.17 | | |
| NT2RM4000086 | 3.06 | 3.06 | 4.5 | 3.84 | 5.25 | 3.71 | | |
| NT2RM4000100 | 6.62 | 6.62 | 15.05 | 12.74 | 15.6 | 14.84 | | |
| NT2RM4000101 | 3.77 | 3.77 | 9.11 | 7.17 | 7.71 | 8.78 | | |
| NT2RM4000102 | 32.35 | 32.35 | 42.47 | 27.24 | 19.34 | 70.54 | | |
| NT2RM4000104 | 2.78 | 2.78 | 7.13 | 3.41 | 5.12 | 4.3 | | |
| NT2RM4000115 | 2.87 | 2.87 | 6.1 | 3.91 | 5.86 | 4.08 | | |
| NT2RM4000129 | 2.17 | 2.17 | 4.75 | 2.62 | 3.48 | 2.18 | | |
| NT2RM4000139 | 3.17 | 3.17 | 3.31 | 3.58 | 4.82 | 6.49 | | |
| NT2RM4000149 | 2.74 | 2.74 | 1.49 | 2.4.12 | 55 | 7.32 | | |
| NT2RM4000155 | 2.73 | 2.73 | 5.5 | 2.13 | 4.51 | 3.71 | | |
| NT2RM4000156 | 5.94 | 5.94 | 16.74 | 20.45 | 21 | 21.96 | * | + |
| NT2RM4000167 | 1.36 | 1.36 | 2.58 | 2.61 | 4.34 | 1.75 | | |
| NT2RM4000169 | 9.95 | 9.95 | 36.53 | 29.12 | 24.89 | 23.57 | | |
| NT2RM4000191 | 4.29 | 4.29 | 7.56 | 5.49 | 5.57 | 5.66 | | |
| NT2RM4000197 | 2.73 | 2.73 | 4.78 | 1.8.33 | 86 | 2.2 | | |
| NT2RM4000198 | 3.38 | 3.38 | 7.42 | 5.2.65 | 45 | 4.21 | | |
| NT2RM4000199 | 2 | 2 | 3.51 | 2.8 | 4 | 3.76 | | |
| NT2RM4000200 | 0.67 | 0.67 | 3.19 | 2.25 | 1.84 | 1.2 | | |
| NT2RM4000202 | 1 | 1 | 3.24 | 2.11 | 2.42 | 1.84 | | |
| NT2RM4000210 | 1.46 | 1.46 | 3.72 | 2.41 | 3.08 | 2.21 | | |
| NT2RM4000215 | 2.54 | 2.54 | 5.43 | 3.3 | 4.09 | 3.06 | | |
| NT2RM4000220 | 6.42 | 6.42 | 10.52 | 8.68 | 11.08 | 15.14 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM4000229 | 3.26 | 3.26 | 6.62 | 1.46 | 2.34 | 1.76 | | |
| NT2RM4000231 | 6.37 | 6.37 | 7.06 | 6.13 | 7.85 | 6.24 | | |
| NT2RM4000233 | 4.83 | 4.83 | 17.3 | 11.9 | 14.34 | 13.4 | | |
| NT2RM4000244 | 2.35 | 2.35 | 5.22 | 3.86 | 4.14 | 5.17 | | |
| NT2RM4000251 | 3.85 | 3.85 | 10.97 | 4.82 | 6.52 | 4.59 | | |
| NT2RM4000255 | 2.28 | 2.28 | 4.7 | 3.79 | 4.89 | 1.42 | | |
| NT2RM4000265 | 2.23 | 2.23 | 5.69 | 4.29 | 8.21 | 1.99 | | |
| NT2RM4000283 | 18.14 | 18.14 | 26.21 | 37.17 | 39.88 | 44.79 | ** | + |
| NT2RM4000284 | 13.85 | 13.85 | 33.72 | 31.96 | 42.88 | 40.67 | | |
| NT2RM4000290 | 6.31 | 6.31 | 7.76 | 3.77 | 4.92 | 4 | * | − |
| NT2RM4000295 | 2.36 | 2.36 | 2.16 | 2.32 | 2.13 | 0.88 | | |
| NT2RM4000306 | 3.79 | 3.79 | 7.76 | 7.1 | 6.14 | 5.02 | | |
| NT2RM4000307 | 5.04 | 5.04 | 9.13 | 9.95 | 9.99 | 11.72 | * | + |
| NT2RM4000309 | 2.48 | 2.48 | 5.34 | 3.92 | 6.52 | 5.52 | | |
| NT2RM4000313 | 3.92 | 3.92 | 9.61 | 5.75 | 7.77 | 8.52 | | |
| NT2RM4000318 | 3.38 | 3.38 | 6.87 | 4.35 | 6.36 | 3.28 | | |
| NT2RM4000324 | 4.93 | 4.93 | 5.93 | 2.79 | 4.98 | 2.12 | | |
| NT2RM4000326 | 5.32 | 5.32 | 4.61 | 2.59 | 2.45 | 2.01 | ** | |
| NT2RM4000327 | 4.97 | 4.97 | 10.95 | 7.94 | 10.32 | 7.71 | | |
| NT2RM4000344 | 5.46 | 5.46 | 16.67 | 11.16 | 10.17 | 19.18 | | |
| NT2RM4000349 | 3.68 | 3.68 | 9.99 | 11.87 | 10.88 | 13.8 | * | + |
| NT2RM4000354 | 1.65 | 1.65 | 3.13 | 4.2 | 4.31 | 3.1 | | |
| NT2RM4000356 | 1.5 | 1.5 | 3.11 | 2.5 | 4.07 | 1.64 | | |
| NT2RM4000366 | 15.75 | 15.75 | 44.48 | 38.81 | 44.07 | 58.06 | | |
| NT2RM4000368 | 3.04 | 3.04 | 5.9 | 4.36 | 5.48 | 3.48 | | |
| NT2RM4000373 | 6.49 | 6.49 | 12.29 | 12.72 | 15.96 | 16.47 | * | + |
| NT2RM4000386 | 4.92 | 4.92 | 4.71 | 3.81 | 4.57 | 4.6 | | |
| NT2RM4000395 | 2.7 | 2.7 | 4.69 | 6.36 | 6.51 | 5.68 | * | + |
| NT2RM4000414 | 1 | 1 | 2.76 | 2.38 | 2.9 | 2.19 | | |
| NT2RM4000417 | 1.66 | 1.66 | 2.83 | 3.9 | 3.95 | 3.25 | * | + |
| NT2RM4000421 | 2.99 | 2.99 | 5.17 | 4.96 | 5.47 | 4.13 | | |
| NT2RM4000425 | 10.56 | 10.56 | 26.8 | 26.49 | 31.48 | 45.28 | | |
| NT2RM4000433 | 2.78 | 2.78 | 5.39 | 1.67 | 2.21 | 1.79 | | |
| NT2RM4000436 | 3.8 | 3.8 | 9.47 | 11.84 | 16.75 | 16.38 | * | + |
| NT2RM4000444 | 4.51 | 4.51 | 12.97 | 7.29 | 8.54 | 7.38 | | |
| NT2RM4000457 | 3.35 | 3.35 | 8.69 | 13.35 | 12.38 | 13.25 | * | + |
| NT2RM4000471 | 1.73 | 1.73 | 4.01 | 4.17 | 4.87 | 2.49 | | |
| NT2RM4000472 | 2.2 | 2.2 | 7.62 | 6.64 | 7.61 | 5.39 | | |
| NT2RM4000486 | 2.98 | 2.98 | 5.92 | 6.85 | 7.54 | 6 | | |
| NT2RM4000490 | 3.85 | 3.85 | 6.41 | 7.16 | 5.1 | 5.86 | | |
| NT2RM4000496 | 3.68 | 3.68 | 3.86 | 2.16 | 2.36 | 2.04 | ** | − |
| NT2RM4000505 | 26.85 | 26.85 | 60.33 | 68.9 | 80.59 | 70.67 | * | + |
| NT2RM4000511 | 22.8 | 22.8 | 45.35 | 64.6 | 89.95 | 75.97 | * | + |
| NT2RM4000514 | 2.61 | 2.61 | 6.75 | 10.47 | 7.53 | 9.25 | * | + |
| NT2RM4000515 | 3.75 | 3.75 | 8.81 | 7.27 | 7.94 | 4.66 | | |
| NT2RM4000517 | 34.51 | 34.51 | 74.2 | 76.45 | 53.07 | 79.47 | | |
| NT2RM4000520 | 2.24 | 2.24 | 3.08 | 3.21 | 3.3 | 5.49 | | |
| NT2RM4000531 | 2.76 | 2.76 | 5.71 | 4.41 | 5.5 | 4.22 | | |
| NT2RM4000532 | 3.03 | 3.03 | 5.56 | 2.72 | 3.54 | 2.39 | | |
| NT2RM4000533 | 3.55 | 3.55 | 5.43 | 4.73 | 6.98 | 3.23 | | |
| NT2RM4000534 | 5.17 | 5.17 | 2.92 | 2.73 | 4.62 | 1.94 | | |
| NT2RM4000563 | 5.21 | 5.21 | 16.69 | 17.05 | 16.8 | 19.36 | | |
| NT2RM4000566 | 1.79 | 1.79 | 4.6 | 7.14 | 5.27 | 7.91 | * | + |
| NT2RM4000568 | 10.48 | 10.48 | 19.4 | 28.18 | 22.91 | 33.06 | * | + |
| NT2RM4000585 | 1.97 | 1.97 | 2.52 | 0.82 | 1.99 | 1.26 | | |
| NT2RM4000587 | 3.88 | 3.88 | 6.15 | 6.66 | 5.75 | 5.15 | | |
| NT2RM4000590 | 3.73 | 3.73 | 4.12 | 1.64 | 2.48 | 2.3 | ** | − |
| NT2RM4000593 | 4.46 | 4.46 | 7.83 | 10.21 | 12.36 | 7.45 | | |
| NT2RM4000595 | 3.94 | 3.94 | 3.91 | 2.27 | 4.36 | 2.45 | | |
| NT2RM4000603 | 4.18 | 4.18 | 6.98 | 6.95 | 7.23 | 7.26 | | |
| NT2RM4000611 | 9.81 | 9.81 | 18.02 | 17.1 | 17.38 | 25.49 | | |
| NT2RM4000616 | 2.05 | 2.05 | 6.19 | 2.73 | 4.14 | 4.53 | | |
| NT2RM4000621 | 26.04 | 26.04 | 70.86 | 57.5 | 62.2 | 59.07 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocyte_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM4000648 | 2.78 | 2.78 | 7.83 | 2.66 | 2.67 | 3.88 | | |
| NT2RM4000649 | 5.53 | 5.53 | 11.03 | 7.34 | 8.4 | 13.12 | | |
| NT2RM4000658 | 3.22 | 3.22 | 8.18 | 4.22 | 6.14 | 8.14 | | |
| NT2RM4000661 | 57.68 | 57.68 | 140.68 | 141.09 | 135.49 | 177.49 | | |
| NT2RM4000673 | 3.02 | 3.02 | 5.72 | 3.69 | 3.8 | 4.59 | | |
| NT2RM4000674 | 2.23 | 2.23 | 4.27 | 2.89 | 2.63 | 2.99 | | |
| NT2RM4000689 | 3.81 | 3.81 | 6.47 | 5.34 | 6.36 | 7.74 | | |
| NT2RM4000698 | 14.85 | 14.85 | 20.92 | 25.12 | 23.66 | 26.39 | * | + |
| NT2RM4000700 | 2.39 | 2.39 | 5.53 | 2.41 | 6.95 | 5.61 | | |
| NT2RM4000701 | 10.07 | 10.07 | 54.36 | 61.81 | 67.75 | 63.17 | | |
| NT2RM4000712 | 3.5 | 3.5 | 7.9 | 5.97 | 8.03 | 9.55 | | |
| NT2RM4000717 | 2.14 | 2.14 | 6.66 | 3.67 | 2.94 | 4.3 | | |
| NT2RM4000733 | 4.37 | 4.37 | 7.8 | 4.16 | 6.93 | 11.03 | | |
| NT2RM4000734 | 2.17 | 2.17 | 5.92 | 2.35 | 5.23 | 4.7 | | |
| NT2RM4000741 | 2.14 | 2.14 | 6.11 | 3.59 | 4.75 | 4.66 | | |
| NT2RM4000744 | 1.76 | 1.76 | 7.05 | 2.76 | 4.4 | 10.18 | | |
| NT2RM4000749 | 15.53 | 15.53 | 23.13 | 26.26 | 27.8 | 34.67 | * | + |
| NT2RM4000751 | 2.88 | 2.88 | 6.54 | 6.23 | 6.11 | 5.94 | | |
| NT2RM4000752 | 4.11 | 4.11 | 4.88 | 4.78 | 5.12 | 38.58 | | |
| NT2RM4000760 | 3.5 | 3.5 | 9.69 | 4.54 | 6.31 | 5.26 | | |
| NT2RM4000761 | 237.9 | 237.9 | 478.3 | 219.65 | 302.54 | 336.34 | | |
| NT2RM4000764 | 66.05 | 66.05 | 178 | 212.33 | 205.98 | 232.75 | * | + |
| NT2RM4000768 | 6.11 | 6.11 | 11.21 | 15.56 | 10.14 | 21.17 | | |
| NT2RM4000778 | 1.6 | 1.6 | 4.7 | 4.27 | 5.18 | 6.18 | | |
| NT2RM4000779 | 4.52 | 4.52 | 8.28 | 6.87 | 7.19 | 7.33 | | |
| NT2RM4000787 | 2.55 | 2.55 | 7.49 | 3.64 | 4.9 | 4.53 | | |
| NT2RM4000790 | 2.99 | 2.99 | 5.03 | 5.47 | 5.82 | 12.06 | | |
| NT2RM4000795 | 1.99 | 1.99 | 3.67 | 2.36 | 1.2 | 2.51 | | |
| NT2RM4000796 | 3.26 | 3.26 | 5.86 | 4.29 | 3.48 | 4.28 | | |
| NT2RM4000798 | 1.77 | 1.77 | 5.53 | 3.72 | 3.08 | 3.47 | | |
| NT2RM4000800 | 4.15 | 4.15 | 8.16 | 8.7 | 9.44 | 9.06 | | |
| NT2RM4000813 | 3.31 | 3.31 | 8.79 | 7.14 | 7.95 | 10.09 | | |
| NT2RM4000820 | 4.89 | 4.89 | 9.14 | 5.39 | 6.27 | 5.44 | | |
| NT2RM4000827 | 7.1 | 7.1 | 18.55 | 16.3 | 15.8 | 17.88 | | |
| NT2RM4000830 | 3.27 | 3.27 | 7.35 | 5.28 | 7.8 | 8.38 | | |
| NT2RM4000833 | 2.51 | 2.51 | 6.84 | 4.48 | 3.35 | 4.87 | | |
| NT2RM4000841 | 4 | 4 | 15 | 10.57 | 8.84 | 10.1 | | |
| NT2RM4000846 | 1.66 | 1.66 | 8.83 | 4.74 | 6.83 | 5.09 | | |
| NT2RM4000848 | 2.61 | 2.61 | 5.75 | 4.15 | 6.32 | 3.12 | | |
| NT2RM4000852 | 3.89 | 3.89 | 9.81 | 8.16 | 8.67 | 8.29 | | |
| NT2RM4000855 | 5.12 | 5.12 | 7.64 | 5.99 | 6.08 | 7.19 | | |
| NT2RM4000859 | 11.18 | 11.18 | 16.28 | 16.48 | 19.12 | 17.62 | | |
| NT2RM4000868 | 3.06 | 3.06 | 6.47 | 5.23 | 6.91 | 7.05 | | |
| NT2RM4000870 | 4 | 4 | 9.82 | 7.06 | 3.87 | 6.59 | | |
| NT2RM4000879 | 1.67 | 1.67 | 6 | 4.15 | 3.31 | 3.11 | | |
| NT2RM4000882 | 18.99 | 18.99 | 28.36 | 20.33 | 16.5 | 12.55 | | |
| NT2RM4000887 | 2.16 | 2.16 | 6.01 | 3.53 | 4.91 | 1.6 | | |
| NT2RM4000895 | 2.33 | 2.33 | 5.33 | 3.16 | 5.9 | 3.08 | | |
| NT2RM4000897 | 5.78 | 5.78 | 6.99 | 8.89 | 9.73 | 7.02 | | |
| NT2RM4000901 | 5.22 | 5.22 | 6.41 | 4.37 | 6.2 | 6.12 | | |
| NT2RM4000950 | 4.04 | 4.04 | 5.09 | 3.57 | 4.06 | 2.91 | | |
| NT2RM4000965 | 2.89 | 2.89 | 4.54 | 5.98 | 4.04 | 6.18 | | |
| NT2RM4000971 | 2.49 | 2.49 | 4.78 | 4.84 | 4.2.97 | 62 | | |
| NT2RM4000979 | 5.16 | 5.16 | 12.71 | 10.23 | 10.46 | 7.87 | | |
| NT2RM4000987 | 1.9 | 1.9 | 4.59 | 3.64 | 4.22 | 3.21 | | |
| NT2RM4000989 | 2.51 | 2.51 | 5.17 | 4.2 | 5.16 | 4.99 | | |
| NT2RM4000991 | 3.1 | 3.1 | 4.83 | 2.87 | 3.53 | 8.73 | | |
| NT2RM4000992 | 3.39 | 3.39 | 5.41 | 3.6 | 4.54 | 3.19 | | |
| NT2RM4000996 | 6.22 | 6.22 | 7.86 | 7.14 | 8 | 7.28 | | |
| NT2RM4000997 | 3.53 | 3.53 | 13.96 | 9.81 | 10.96 | 10.89 | | |
| NT2RM4001001 | 26.06 | 26.06 | 55.43 | 37.67 | 34.22 | 54.29 | | |
| NT2RM4001002 | 5.13 | 5.13 | 11.03 | 11.54 | 11.33 | 19.44 | | |
| NT2RM4001016 | 1.63 | 1.63 | 2.73 | 4.07 | 5.31 | 3.76 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| | Synoviocyte | | | Synoviocute_TNF | | | t test vs | INC. and |
|---|---|---|---|---|---|---|---|---|
| Clone | exp. 1 | exp. 2 | exp. 3 | exp. 1 | exp. 2 | exp. 3 | TNF | DEC. |
| NT2RM4001025 | 65.77 | 65.77 | 133.97 | 148.39 | 181.87 | 171.5 | * | + |
| NT2RM4001027 | 2.49 | 2.49 | 3.66 | 1.67 | 1.77 | 4.31 | | |
| NT2RM4001032 | 2.55 | 2.55 | 6.74 | 4.94 | 5.46 | 3.84 | | |
| NT2RM4001047 | 3.87 | 3.87 | 3.7 | 2.61 | 2.73 | 2.7 | ** | − |
| NT2RM4001049 | 3.97 | 3.97 | 10.12 | 18.29 | 20.63 | 26.25 | ** | + |
| NT2RM4001051 | 2.72 | 2.72 | 12.54 | 11.17 | 10.12 | 13.68 | | |
| NT2RM4001052 | 14.95 | 14.95 | 72.14 | 75.49 | 75.01 | 79.12 | | |
| NT2RM4001053 | 14.96 | 14.96 | 39.3 | 41.36 | 28.95 | 25.87 | | |
| NT2RM4001054 | 3.13 | 3.13 | 5.17 | 5.34 | 5.69 | 5.01 | | |
| NT2RM4001059 | 3.65 | 3.65 | 6.37 | 4.91 | 3.52 | 4.48 | | |
| NT2RM4001071 | 4.03 | 4.03 | 7.35 | 6.8 | 7.34 | 6.55 | | |
| NT2RM4001084 | 8.04 | 8.04 | 6.52 | 9.49 | 10.53 | 9.53 | * | + |
| NT2RM4001092 | 12.61 | 12.61 | 109.97 | 76.93 | 98.78 | 73.14 | | |
| NT2RM4001100 | 6.72 | 6.72 | 20.93 | 22.35 | 15.18 | 18.98 | | |
| NT2RM4001116 | 1.17 | 1.17 | 2.5 | 2.77 | 2.96 | 2.16 | | |
| NT2RM4001119 | 1.74 | 1.74 | 4.82 | 4.72 | 4.22 | 4.15 | | |
| NT2RM4001140 | 2.65 | 2.65 | 7.49 | 8.27 | 7.78 | 9.03 | | |
| NT2RM4001148 | 6.59 | 6.59 | 13.68 | 12.1 | 12.92 | 15.83 | | |
| NT2RM4001151 | 3.7 | 3.7 | 4.31 | 1.94 | 3.65 | 1.68 | | |
| NT2RM4001155 | 5.51 | 5.51 | 6.36 | 3.55 | 5.37 | 4.63 | | |
| NT2RM4001157 | 1.68 | 1.68 | 4.95 | 4.86 | 2.81 | 3.82 | | |
| NT2RM4001160 | 1.57 | 1.57 | 3.39 | 2.99 | 1.9 | 2.41 | | |
| NT2RM4001163 | 42.35 | 42.35 | 86.27 | 106.63 | 52.13 | 98.56 | | |
| NT2RM4001187 | 2.64 | 2.64 | 7.25 | 3.96 | 4.87 | 5.2 | | |
| NT2RM4001191 | 3.2 | 3.2 | 9.95 | 8.59 | 6.36 | 8.72 | | |
| NT2RM4001200 | 3.83 | 3.83 | 6.35 | 5.52 | 4.41 | 4.11 | | |
| NT2RM4001203 | 9.93 | 9.93 | 20.29 | 22.65 | 25.36 | 21.82 | | |
| NT2RM4001204 | 3.23 | 3.23 | 3.59 | 3.17 | 2.83 | 2.6 | | |
| NT2RM4001217 | 4.62 | 4.62 | 12.16 | 11.26 | 13.39 | 13.72 | | |
| NT2RM4001245 | 7.31 | 7.31 | 17.14 | 13.76 | 14.49 | 17.16 | | |
| NT2RM4001247 | 3.23 | 3.23 | 9.1 | 5.73 | 6.57 | 5.03 | | |
| NT2RM4001256 | 2.51 | 2.51 | 6.39 | 3.57 | 5.48 | 4.14 | | |
| NT2RM4001258 | 8.2 | 8.2 | 24.68 | 25.02 | 24.16 | 22.89 | | |
| NT2RM4001267 | 3.43 | 3.43 | 4.83 | 3.93 | 4.3 | 8.08 | | |
| NT2RM4001273 | 4.23 | 4.23 | 8.38 | 7.39 | 6.96 | 8.77 | | |
| NT2RM4001281 | 4 | 4 | 10.54 | 10.15 | 9.05 | 10 | | |
| NT2RM4001286 | 345.27 | 345.27 | 526.77 | 215.2 | 220.51 | 552.53 | | |
| NT2RM4001290 | 23.51 | 23.51 | 61.5 | 56.51 | 48.6 | 59.58 | | |
| NT2RM4001309 | 2.64 | 2.64 | 6.81 | 3.17 | 5.42 | 4.05 | | |
| NT2RM4001313 | 2.63 | 2.63 | 8.62 | 3.81 | 6.36 | 7.03 | | |
| NT2RM4001316 | 3.14 | 3.14 | 6.12 | 3.39 | 3.85 | 5.25 | | |
| NT2RM4001320 | 2.4 | 2.4 | 6.43 | 2.83 | 3.16 | 5.6 | | |
| NT2RM4001321 | 3.98 | 3.98 | 8.62 | 6.17 | 7.03 | 6.24 | | |
| NT2RM4001325 | 2.54 | 2.54 | 5.2 | 4.76 | 2.93 | 5.25 | | |
| NT2RM4001333 | 8.65 | 8.65 | 18.06 | 8.57 | 10.76 | 9.51 | | |
| NT2RM4001340 | 4.81 | 4.81 | 12.27 | 6.99 | 7.72 | 11.24 | | |
| NT2RM4001344 | 4.09 | 4.09 | 4.69 | 3.04 | 3.44 | 4.93 | | |
| NT2RM4001347 | 6.49 | 6.49 | 9.8 | 10.53 | 9.72 | 17.71 | | |
| NT2RM4001357 | 7.59 | 7.59 | 12.09 | 8.58 | 11.68 | 9.37 | | |
| NT2RM4001360 | 2.79 | 2.79 | 5.11 | 3.82 | 2.85 | 3.07 | | |
| NT2RM4001371 | 4.71 | 4.71 | 8.57 | 6.58 | 13.16 | 12.93 | | |
| NT2RM4001377 | 8.01 | 8.01 | 13.74 | 8.66 | 9.23 | 10.58 | | |
| NT2RM4001382 | 17.31 | 17.31 | 56.74 | 35.57 | 28.32 | 38.22 | | |
| NT2RM4001384 | 2.17 | 2.17 | 4.11 | 2.35 | 3.34 | 3.75 | | |
| NT2RM4001400 | 3.78 | 3.78 | 5.76 | 4.87 | 4.66 | 5.07 | | |
| NT2RM4001409 | 2.55 | 2.55 | 6.82 | 4.82 | 4.63 | 5.27 | | |
| NT2RM4001410 | 5.48 | 5.48 | 21.69 | 17.34 | 21.09 | 18.91 | | |
| NT2RM4001411 | 2.66 | 2.66 | 6.5 | 5.86 | 6.64 | 6.77 | | |
| NT2RM4001412 | 1.75 | 1.75 | 3.33 | 2.39 | 2.52 | 2.79 | | |
| NT2RM4001414 | 2.18 | 2.18 | 4.83 | 2.45 | 2.4 | 3.77 | | |
| NT2RM4001436 | 8.35 | 8.35 | 16.65 | 10.45 | 10.13 | 15.55 | | |
| NT2RM4001437 | 2.77 | 2.77 | 8.85 | 8.31 | 11.26 | 7.67 | | |
| NT2RM4001444 | 11.57 | 11.57 | 25.93 | 21.11 | 8.36 | 18.42 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
|  | exp. 1 | exp. 2 | exp. 3 | exp. 1 | exp. 2 | exp. 3 |  |  |
| NT2RM4001454 | 3.62 | 3.62 | 7.89 | 6.16 | 5.03 | 4.79 |  |  |
| NT2RM4001455 | 5.85 | 5.85 | 22.19 | 18.03 | 25.08 | 26.16 |  |  |
| NT2RM4001483 | 4.37 | 4.37 | 8.77 | 4.97 | 5.43 | 6.46 |  |  |
| NT2RM4001489 | 3.12 | 3.12 | 7.04 | 3.64 | 4.19 | 5.46 |  |  |
| NT2RM4001495 | 1.35 | 1.35 | 5.13 | 2.85 | 3.29 | 3.37 |  |  |
| NT2RM4001499 | 1.74 | 1.74 | 4.98 | 3.65 | 2.77 | 3.3 |  |  |
| NT2RM4001515 | 0.95 | 0.95 | 3.38 | 2.65 | 5.38 | 3.41 |  |  |
| NT2RM4001519 | 1.86 | 1.86 | 4.6 | 2.24 | 4.38 | 2.85 |  |  |
| NT2RM4001522 | 3.8 | 3.8 | 7.66 | 5.36 | 7.42 | 9.13 |  |  |
| NT2RM4001523 | 5.46 | 5.46 | 9.11 | 4.82 | 7.58 | 5.79 |  |  |
| NT2RM4001550 | 11.9 | 11.9 | 17.38 | 16.49 | 16.76 | 15.01 |  |  |
| NT2RM4001553 | 7.88 | 7.88 | 13.4 | 23.26 | 23.53 | 23.87 | ** | + |
| NT2RM4001554 | 0.86 | 0.86 | 1.74 | 1.85 | 1.11 | 2.2 |  |  |
| NT2RM4001557 | 2.5 | 2.5 | 6.33 | 5.05 | 3.36 | 4.89 |  |  |
| NT2RM4001565 | 1.87 | 1.87 | 4.05 | 2.46 | 3.34 | 3.23 |  |  |
| NT2RM4001566 | 3.23 | 3.23 | 8.57 | 8.91 | 10.49 | 11.42 |  |  |
| NT2RM4001569 | 1.47 | 1.47 | 5.4 | 3.35 | 4.15 | 1.56 |  |  |
| NT2RM4001579 | 6.57 | 6.57 | 16.69 | 19.23 | 23.83 | 18.22 |  |  |
| NT2RM4001582 | 4.06 | 4.06 | 5.97 | 2.16 | 3.17 | 2.67 | * | − |
| NT2RM4001589 | 21.51 | 21.51 | 37.16 | 42.45 | 55.76 | 47.57 | * | + |
| NT2RM4001592 | 1.37 | 1.37 | 2.96 | 3.02 | 2.14 | 3.71 |  |  |
| NT2RM4001594 | 1.98 | 1.98 | 4.09 | 5.4 | 5.24 | 5.67 | * | + |
| NT2RM4001597 | 2.65 | 2.65 | 5.64 | 5.17 | 4.97 | 4.33 |  |  |
| NT2RM4001605 | 2.7 | 2.7 | 6.18 | 5.71 | 5.92 | 5.93 |  |  |
| NT2RM4001609 | 23.65 | 23.65 | 45 | 61.08 | 78.89 | 77.31 | * | + |
| NT2RM4001610 | 48.1 | 48.1 | 69.16 | 132.54 | 132.39 | 115.22 | ** | + |
| NT2RM4001611 | 3.31 | 3.31 | 4.56 | 2.33 | 2.32 | 2.02 | * | − |
| NT2RM4001618 | 7.05 | 7.05 | 7.95 | 6.68 | 8.98 | 12.95 |  |  |
| NT2RM4001622 | 13.53 | 13.53 | 19.88 | 14.67 | 24.67 | 28.46 |  |  |
| NT2RM4001624 | 1.6 | 1.6 | 3.02 | 3.92 | 2.66 | 4.43 |  |  |
| NT2RM4001625 | 4.89 | 4.89 | 39.6 | 41.63 | 47.1 | 46.46 |  |  |
| NT2RM4001629 | 3.82 | 3.82 | 8.82 | 12.09 | 12.08 | 13.38 | * | + |
| NT2RM4001632 | 15.28 | 15.28 | 24.55 | 31.07 | 26.16 | 25.6 |  |  |
| NT2RM4001642 | 3.29 | 3.29 | 4.17 | 2.89 | 3.62 | 2.1 |  |  |
| NT2RM4001647 | 4.44 | 4.44 | 6.83 | 4.04 | 5.48 | 4.67 |  |  |
| NT2RM4001650 | 4.96 | 4.96 | 4.94 | 2.66 | 2.87 | 3.79 | ** | − |
| NT2RM4001662 | 2.18 | 2.18 | 5.47 | 8.31 | 6.54 | 9.39 | * | + |
| NT2RM4001666 | 2.28 | 2.28 | 6.5 | 6.24 | 6.17 | 8.14 |  |  |
| NT2RM4001670 | 3.52 | 3.52 | 10.77 | 11.16 | 10.82 | 14.91 |  |  |
| NT2RM4001682 | 12.66 | 12.66 | 31.6 | 33.03 | 26.04 | 37.07 |  |  |
| NT2RM4001710 | 6.7 | 6.7 | 38.5 | 40.58 | 58.41 | 40.31 |  |  |
| NT2RM4001712 | 4.06 | 4.06 | 7.61 | 10.19 | 10.7 | 9.98 | * | + |
| NT2RM4001714 | 10.88 | 10.88 | 19.37 | 18.67 | 19.3 | 17.65 |  |  |
| NT2RM4001715 | 10.77 | 10.77 | 11.61 | 3.55 | 16.86 | 12.99 |  |  |
| NT2RM4001727 | 3.41 | 3.41 | 5.92 | 4.83 | 5.89 | 7.6 |  |  |
| NT2RM4001731 | 2.6 | 2.6 | 10.72 | 13.46 | 11.23 | 11.73 |  |  |
| NT2RM4001735 | 12.84 | 12.84 | 21.53 | 22.01 | 20.88 | 34.93 |  |  |
| NT2RM4001739 | 2.46 | 2.46 | 7.3 | 8.13 | 5.17 | 7.14 |  |  |
| NT2RM4001741 | 14.41 | 14.41 | 29.88 | 26.98 | 27.21 | 32.35 |  |  |
| NT2RM4001746 | 3.65 | 3.65 | 6.76 | 6.89 | 6.5 | 5.33 |  |  |
| NT2RM4001754 | 3.16 | 3.16 | 4.17 | 3.39 | 3.62 | 3.84 |  |  |
| NT2RM4001757 | 5.02 | 5.02 | 5.78 | 4.7 | 6.31 | 7.97 |  |  |
| NT2RM4001758 | 1 | 1 | 0.76 | 1.98 | 0.65 | 1.46 |  |  |
| NT2RM4001768 | 4.83 | 4.83 | 10.19 | 8.48 | 6.91 | 7.83 |  |  |
| NT2RM4001775 | 3.23 | 3.23 | 2.76 | 1.9 | 1.85 | 1.71 | ** | − |
| NT2RM4001776 | 2.56 | 2.56 | 4.77 | 2.47 | 2.68 | 2.69 |  |  |
| NT2RM4001783 | 2.88 | 2.88 | 3.22 | 3.12 | 3.48 | 3.68 |  |  |
| NT2RM4001793 | 4.67 | 4.67 | 11.44 | 12.02 | 9.6 | 10.75 |  |  |
| NT2RM4001810 | 3.31 | 3.31 | 4.46 | 3.33 | 3.63 | 3.11 |  |  |
| NT2RM4001813 | 3.9 | 3.9 | 4.15 | 4.71 | 4.19 | 5.36 |  |  |
| NT2RM4001818 | 4.06 | 4.06 | 11.34 | 10.43 | 8.67 | 10.53 |  |  |
| NT2RM4001819 | 2.35 | 2.35 | 5.6 | 2.37 | 3.02 | 4.58 |  |  |
| NT2RM4001823 | 1.76 | 1.76 | 4.48 | 2.47 | 4.04 | 4.27 |  |  |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM4001828 | 5.01 | 5.01 | 11.49 | 5.67 | 7.54 | 7.51 | | |
| NT2RM4001835 | 9.75 | 9.75 | 18.65 | 21.12 | 16.5 | 26.55 | | |
| NT2RM4001836 | 3.27 | 3.27 | 8.32 | 3.65 | 3.54 | 5.58 | | |
| NT2RM4001841 | 7.94 | 7.94 | 15.82 | 20.15 | 20.96 | 23.33 | * | + |
| NT2RM4001842 | 2.1 | 2.1 | 4.44 | 3.5 | 3.35 | 4.85 | | |
| NT2RM4001843 | 5.65 | 5.65 | 14.54 | 13.34 | 12.25 | 14.94 | | |
| NT2RM4001856 | 4.42 | 4.42 | 7.16 | 7.65 | 4.71 | 16.83 | | |
| NT2RM4001858 | 5.91 | 5.91 | 15.86 | 16.09 | 17.03 | 16.93 | | |
| NT2RM4001861 | 2.91 | 2.91 | 9.57 | 6.31 | 8.66 | 9.28 | | |
| NT2RM4001863 | 8.06 | 8.06 | 9.5 | 15.16 | 15.68 | 11.77 | * | + |
| NT2RM4001865 | 5.04 | 5.04 | 11.25 | 7.44 | 10.24 | 9.03 | | |
| NT2RM4001869 | 5.1 | 5.1 | 5.96 | 5.22 | 8.45 | 21.88 | | |
| NT2RM4001873 | 9.62 | 9.62 | 18.43 | 13.33 | 15.49 | 19.21 | | |
| NT2RM4001876 | 2.24 | 2.24 | 6.94 | 3.65 | 4.39 | 7.25 | | |
| NT2RM4001880 | 3.6 | 3.6 | 8.57 | 5.13 | 5.41 | 7.67 | | |
| NT2RM4001885 | 5.71 | 5.71 | 11.11 | 7.11 | 6.56 | 11.98 | | |
| NT2RM4001889 | 10.25 | 10.25 | 18.24 | 16.31 | 15.85 | 21.33 | | |
| NT2RM4001894 | 2.61 | 2.61 | 6.07 | 3.58 | 3.65 | 3.49 | | |
| NT2RM4001897 | 7.87 | 7.87 | 20.24 | 18.41 | 20.4 | 23.46 | | |
| NT2RM4001899 | 3.36 | 3.36 | 7.43 | 4.92 | 8.19 | 8.54 | | |
| NT2RM4001905 | 3 | 3 | 4.84 | 3.3 | 4.53 | 7.1 | | |
| NT2RM4001922 | 2.55 | 2.55 | 6.05 | 3.97 | 4.84 | 5.11 | | |
| NT2RM4001930 | 2.64 | 2.64 | 8.9 | 2.88 | 6.53 | 6.38 | | |
| NT2RM4001938 | 2.65 | 2.65 | 4.91 | 5.09 | 5.65 | 6.43 | | |
| NT2RM4001940 | 2.73 | 2.73 | 6.17 | 5.91 | 4.46 | 5.48 | | |
| NT2RM4001942 | 37.36 | 37.36 | 32.02 | 53.86 | 59.28 | 82.77 | * | + |
| NT2RM4001953 | 4.65 | 4.65 | 9.68 | 5.04 | 6.79 | 4.91 | | |
| NT2RM4001965 | 4.96 | 4.96 | 8.82 | 10.18 | 8.54 | 8.39 | | |
| NT2RM4001966 | 3 | 3 | 5.14 | 6.3 | 7.45 | 8.19 | * | + |
| NT2RM4001969 | 2.22 | 2.22 | 7.29 | 5.01 | 2.95 | 4.5 | | |
| NT2RM4001974 | 1.19 | 1.19 | 4.61 | 1.89 | 2.96 | 4.83 | | |
| NT2RM4001979 | 2.09 | 2.09 | 6.37 | 3.39 | 4.65 | 7.36 | | |
| NT2RM4001980 | 4.3 | 4.3 | 7.59 | 7.58 | 8.02 | 9.33 | | |
| NT2RM4001984 | 2.31 | 2.31 | 5.36 | 2.68 | 3.49 | 4.57 | | |
| NT2RM4001987 | 3.36 | 3.36 | 9.66 | 2.92 | 4.6 | 5.01 | | |
| NT2RM4002013 | 6.62 | 6.62 | 15.13 | 13.47 | 17.16 | 19.8 | | |
| NT2RM4002018 | 2.31 | 2.31 | 5.15 | 4.09 | 5.53 | 7.1 | | |
| NT2RM4002033 | 3.19 | 3.19 | 8.16 | 4.91 | 3.27 | 5.93 | | |
| NT2RM4002034 | 1.89 | 1.89 | 6.19 | 4.82 | 4.38 | 4.03 | | |
| NT2RM4002044 | 7.71 | 7.71 | 17.9 | 18.75 | 12.3 | 18.5 | | |
| NT2RM4002047 | 3.88 | 3.88 | 5.19 | 2.68 | 5.38 | 9.2 | | |
| NT2RM4002054 | 4.54 | 4.54 | 6.97 | 2.56 | 4.3 | 3.89 | | |
| NT2RM4002055 | 13.72 | 13.72 | 74.75 | 60.51 | 91.27 | 61.53 | | |
| NT2RM4002059 | 23.73 | 23.73 | 31.85 | 48.05 | 63.09 | 52.61 | ** | + |
| NT2RM4002061 | 3.72 | 3.72 | 5.32 | 3.59 | 3.69 | 4.81 | | |
| NT2RM4002062 | 1.9 | 1.9 | 5.41 | 3.66 | 2.84 | 4.26 | | |
| NT2RM4002063 | 2.21 | 2.21 | 8.1 | 7.64 | 7.35 | 3.79 | | |
| NT2RM4002066 | 2.07 | 2.07 | 5.29 | 4.42 | 6.32 | 4.07 | | |
| NT2RM4002067 | 2.51 | 2.51 | 4.27 | 3.07 | 5.19 | 4.41 | | |
| NT2RM4002073 | 3.73 | 3.73 | 7.24 | 5.51 | 7.69 | 5.16 | | |
| NT2RM4002074 | 5.19 | 5.19 | 7.35 | 5.67 | 7.47 | 4.49 | | |
| NT2RM4002075 | 5.13 | 5.13 | 5.9 | 3.16 | 3.18 | 2.91 | ** | – |
| NT2RM4002076 | 3.13 | 3.13 | 3.05 | 1.94 | 2.52 | 1.71 | * | – |
| NT2RM4002078 | 10.3 | 10.3 | 28.06 | 23.95 | 20.81 | 26.64 | | |
| NT2RM4002081 | 10.47 | 10.47 | 30.87 | 19.18 | 17.8 | 18.22 | | |
| NT2RM4002082 | 1.25 | 1.25 | 3.02 | 3.85 | 2.58 | 1.23 | | |
| NT2RM4002093 | 2.82 | 2.82 | 3.9 | 4.79 | 4.66 | 4.79 | * | + |
| NT2RM4002109 | 4.42 | 4.42 | 11.51 | 13.95 | 15.12 | 15.21 | * | + |
| NT2RM4002115 | 2.86 | 2.86 | 4.51 | 4.81 | 4.8 | 2.52 | | |
| NT2RM4002118 | 4.48 | 4.48 | 6.14 | 4.3 | 4.86 | 4.27 | | |
| NT2RM4002128 | 3.78 | 3.78 | 4.57 | 2.84 | 3.31 | 3.13 | * | – |
| NT2RM4002137 | 3.96 | 3.96 | 8.14 | 10.27 | 7.51 | 8.92 | | |
| NT2RM4002139 | 3.78 | 3.78 | 8.98 | 7.03 | 7.84 | 7.87 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM4002140 | 4.04 | 4.04 | 9.45 | 8.87 | 7.81 | 10.17 | | |
| NT2RM4002145 | 5.99 | 5.99 | 17.51 | 25.81 | 31.07 | 24.47 | * | + |
| NT2RM4002146 | 4.51 | 4.51 | 8.23 | 8.56 | 9 | 8.92 | | |
| NT2RM4002161 | 2.33 | 2.33 | 4.97 | 1.38 | 3.15 | 5.3 | | |
| NT2RM4002174 | 4.86 | 4.86 | 8.02 | 3.12 | 4.53 | 6.15 | | |
| NT2RM4002178 | 7.3 | 7.3 | 24.43 | 28.61 | 33.13 | 29.27 | * | + |
| NT2RM4002180 | 3.47 | 3.47 | 11.93 | 9.27 | 10.02 | 11.28 | | |
| NT2RM4002185 | 5.94 | 5.94 | 35.51 | 31.59 | 32.34 | 31.69 | | |
| NT2RM4002189 | 1.6 | 1.6 | 3.24 | 3.68 | 5.59 | 4.91 | * | + |
| NT2RM4002194 | 9.3 | 9.3 | 25.94 | 37.2 | 29.64 | 38.23 | * | + |
| NT2RM4002198 | 6.09 | 6.09 | 7.61 | 9.37 | 8.4 | 10.04 | * | + |
| NT2RM4002205 | 4.01 | 4.01 | 9.05 | 6.76 | 7.86 | 8.76 | | |
| NT2RM4002213 | 5.36 | 5.36 | 8.79 | 8.05 | 11.99 | 14.41 | | |
| NT2RM4002216 | 7.35 | 7.35 | 12.58 | 16.58 | 23.93 | 18.16 | * | + |
| NT2RM4002226 | 3.84 | 3.84 | 9.71 | 20.85 | 16.65 | 16.5 | ** | + |
| NT2RM4002237 | 4.19 | 4.19 | 10.13 | 10.37 | 7.64 | 13.22 | | |
| NT2RM4002240 | 1.96 | 1.96 | 3.64 | 3.73 | 3.71 | 7.59 | | |
| NT2RM4002251 | 2.11 | 2.11 | 6.2 | 7.87 | 5.48 | 5.17 | | |
| NT2RM4002256 | 4.38 | 4.38 | 10.68 | 10.7 | 9.46 | 9.64 | | |
| NT2RM4002262 | 2.85 | 2.85 | 6.25 | 3.34 | 4.43 | 9.66 | | |
| NT2RM4002266 | 3.93 | 3.93 | 4.76 | 2.76 | 3.55 | 4.47 | | |
| NT2RM4002276 | 11.23 | 11.23 | 15.55 | 16.5 | 28.25 | 20.64 | | |
| NT2RM4002278 | 1.89 | 1.89 | 4.59 | 4.33 | 3.99 | 5.11 | | |
| NT2RM4002281 | 17.71 | 17.71 | 59.08 | 62.68 | 51.19 | 59.89 | | |
| NT2RM4002287 | 2.08 | 2.08 | 3.84 | 2.46 | 4.21 | 3.32 | | |
| NT2RM4002294 | 3.19 | 3.19 | 6.99 | 6.28 | 6.09 | 8.69 | | |
| NT2RM4002298 | 18.59 | 18.59 | 60.14 | 86.09 | 89.9 | 88.75 | * | + |
| NT2RM4002301 | 3.2 | 3.2 | 6.85 | 4.63 | 5.94 | 4.02 | | |
| NT2RM4002306 | 4.71 | 4.71 | 8.24 | 4.99 | 5.31 | 4.2 | | |
| NT2RM4002323 | 3.9 | 3.9 | 4.06 | 4.11 | 4.39 | 3.11 | | |
| NT2RM4002334 | 11.54 | 11.54 | 20.76 | 17.92 | 20.72 | 16.95 | | |
| NT2RM4002339 | 1.78 | 1.78 | 3.52 | 1.33 | 1.3 | 1.38 | | |
| NT2RM4002344 | 2.36 | 2.36 | 5.74 | 2.87 | 3.57 | 7.92 | | |
| NT2RM4002345 | 3.56 | 3.56 | 10.59 | 5.06 | 4.63 | 7.5 | | |
| NT2RM4002352 | 2.04 | 2.04 | 7.67 | 3.99 | 5.14 | 3.74 | | |
| NT2RM4002362 | 20.38 | 20.38 | 24.92 | 11.23 | 14.32 | 15.17 | * | − |
| NT2RM4002373 | 2.1 | 2.1 | 3.96 | 3.21 | 2.55 | 3.63 | | |
| NT2RM4002374 | 2.28 | 2.28 | 4.39 | 2.29 | 3.58 | 4.3 | | |
| NT2RM4002376 | 4.02 | 4.02 | 6.03 | 3.31 | 2.97 | 5.52 | | |
| NT2RM4002383 | 2.8 | 2.8 | 8.49 | 4.76 | 5.79 | 4.28 | | |
| NT2RM4002390 | 3.03 | 3.03 | 6.01 | 4.06 | 5.27 | 7.37 | | |
| NT2RM4002398 | 5.16 | 5.16 | 43.18 | 33.97 | 50.73 | 30.41 | | |
| NT2RM4002409 | 2.11 | 2.11 | 5.93 | 3.37 | 4.29 | 1.9 | | |
| NT2RM4002414 | 4.73 | 4.73 | 6.21 | 7.37 | 9.12 | 14.53 | | |
| NT2RM4002438 | 2.07 | 2.07 | 5.28 | 3.03 | 4.38 | 7.18 | | |
| NT2RM4002440 | 2.99 | 2.99 | 6.92 | 5.78 | 5.32 | 9.49 | | |
| NT2RM4002446 | 2.23 | 2.23 | 6.08 | 2.95 | 4.45 | 5.7 | | |
| NT2RM4002450 | 3.36 | 3.36 | 10.01 | 6.15 | 7.75 | 7.24 | | |
| NT2RM4002452 | 2.13 | 2.13 | 6.3 | 3.67 | 5.15 | 7.23 | | |
| NT2RM4002457 | 2.68 | 2.68 | 4.44 | 2.66 | 3.26 | 4.52 | | |
| NT2RM4002458 | 3.06 | 3.06 | 5.77 | 3.32 | 5.34 | 4.04 | | |
| NT2RM4002460 | 2.43 | 2.43 | 3.68 | 1.57 | 2.45 | 1.43 | | |
| NT2RM4002464 | 5.4 | 5.4 | 12.62 | 14.39 | 13.72 | 14.3 | | |
| NT2RM4002479 | 4.66 | 4.66 | 6.69 | 4.91 | 7.98 | 11.54 | | |
| NT2RM4002482 | 4.26 | 4.26 | 16.18 | 10.19 | 11.5 | 12.2 | | |
| NT2RM4002489 | 6.74 | 6.74 | 16.91 | 8.79 | 5.81 | 11.68 | | |
| NT2RM4002493 | 1.35 | 1.35 | 3.22 | 1.96 | 3.51 | 2.73 | | |
| NT2RM4002499 | 34.96 | 34.96 | 72.9 | 59.42 | 52.07 | 54.3 | | |
| NT2RM4002504 | 5.15 | 5.15 | 10.68 | 10.57 | 13.51 | 9.8 | | |
| NT2RM4002506 | 4.77 | 4.77 | 9.4 | 4.93 | 7.59 | 8.53 | | |
| NT2RM4002510 | 2.03 | 2.03 | 3.27 | 1.66 | 2.97 | 2.48 | | |
| NT2RM4002527 | 1.57 | 1.57 | 3.14 | 1.83 | 2.31 | 4.47 | | |
| NT2RM4002532 | 2.45 | 2.45 | 7.75 | 5.88 | 3.37 | 5.19 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RM4002534 | 1.79 | 1.79 | 4.8 | 2.1 | 3.45 | 2.94 | | |
| NT2RM4002535 | 2.5 | 2.5 | 6.51 | 5.89 | 8.1 | 6.37 | | |
| NT2RM4002554 | 3.29 | 3.29 | 5.31 | 3.31 | 5.47 | 3.12 | | |
| NT2RM4002558 | 6.91 | 6.91 | 32.57 | 32.58 | 41.54 | 25.61 | | |
| NT2RM4002565 | 5.38 | 5.38 | 13.6 | 8.22 | 9.85 | 10.53 | | |
| NT2RM4002567 | 3.34 | 3.34 | 5.43 | 4.21 | 4.49 | 7.22 | | |
| NT2RM4002571 | 4.48 | 4.48 | 15.61 | 11.95 | 16.47 | 15.24 | | |
| NT2RM4002572 | 5.57 | 5.57 | 17.2 | 13.7 | 9.59 | 13.48 | | |
| NT2RM4002577 | 7.76 | 7.76 | 15.25 | 6.59 | 5.87 | 5.65 | | |
| NT2RM4002583 | 1.08 | 1.08 | 3.58 | 2.28 | 4.83 | 2.44 | | |
| NT2RM4002584 | 1.64 | 1.64 | 5.67 | 3.24 | 5.74 | 5.56 | | |
| NT2RM4002593 | 3.29 | 3.29 | 5.17 | 2.75 | 3.91 | 4.61 | | |
| NT2RM4002594 | 11.26 | 11.26 | 46.5 | 38.21 | 55.32 | 43.58 | | |
| NT2RM4002604 | 4.83 | 4.83 | 4.64 | 1.77 | 2.03 | 2.89 | ** | − |
| NT2RM4002614 | 3.48 | 3.48 | 3.48 | 2.52 | 3.66 | 2.81 | | |
| NT2RM4002616 | 1.07 | 1.07 | 2.73 | 2.88 | 2.71 | 2.38 | | |
| NT2RM4002623 | 1.39 | 1.39 | 4.89 | 3.92 | 3.72 | 5.06 | | |
| NT2RM4002634 | 1.41 | 1.41 | 4.38 | 3.42 | 4.91 | 2.96 | | |
| NT2RM4002636 | 2.22 | 2.22 | 3.93 | 3.92 | 4.18 | 4.12 | | |
| NT2RP1000002 | 8.82 | 8.82 | 52.94 | 75.1 | 92.89 | 81.45 | * | + |
| NT2RP1000006 | 4.68 | 4.68 | 6.28 | 4.25 | 4.48 | 2.56 | | |
| NT2RP1000015 | 4.86 | 4.86 | 5.27 | 2.74 | 1.99 | 2.28 | ** | − |
| NT2RP1000018 | 5.45 | 5.45 | 5 | 5.55 | 4.83 | 4.96 | | |
| NT2RP1000034 | 18.22 | 18.22 | 49.95 | 38.04 | 30.76 | 50.07 | | |
| NT2RP1000035 | 1.93 | 1.93 | 3.2 | 5.26 | 3.23 | 3.96 | | |
| NT2RP1000040 | 1.77 | 1.77 | 3.33 | 2.93 | 3.28 | 4.28 | | |
| NT2RP1000042 | 1.3 | 1.3 | 3.44 | 1.99 | 3.22 | 2.38 | | |
| NT2RP1000048 | 3.6 | 3.6 | 10.24 | 7.25 | 9.9 | 9 | | |
| NT2RP1000050 | 2.21 | 2.21 | 4.71 | 2.89 | 4 | 3.57 | | |
| NT2RP1000056 | 4.03 | 4.03 | 3.74 | 1.09 | 0.61 | 1.96 | ** | − |
| NT2RP1000058 | 3.49 | 3.49 | 2.03 | 1.84 | 2.07 | 2.48 | | |
| NT2RP1000063 | 1.77 | 1.77 | 3.65 | 4.09 | 4 | 3.83 | | |
| NT2RP1000068 | 1.89 | 1.89 | 3.99 | 3.12 | 3.33 | 2.43 | | |
| NT2RP1000072 | 22.9 | 22.9 | 74.07 | 82.91 | 66.26 | 95.85 | | |
| NT2RP1000073 | 2.18 | 2.18 | 2.45 | 2.68 | 3.69 | 3.86 | * | + |
| NT2RP1000078 | 2.72 | 2.72 | 3.17 | 2.93 | 2.3 | 3.13 | | |
| NT2RP1000079 | 4.13 | 4.13 | 5.32 | 3.6 | 4.48 | 2.5 | | |
| NT2RP1000080 | 4.99 | 4.99 | 8.13 | 9.46 | 12.46 | 9.46 | * | + |
| NT2RP1000086 | 4.15 | 4.15 | 3.63 | 1.31 | 2.1 | 3.75 | | |
| NT2RP1000087 | 1.3 | 1.3 | 4.36 | 3.51 | 3.21 | 3.45 | | |
| NT2RP1000089 | 4.5 | 4.5 | 9.98 | 12.69 | 11.3 | 14.93 | * | + |
| NT2RP1000090 | 45.76 | 45.76 | 96.6 | 94.37 | 53.44 | 93.42 | | |
| NT2RP1000100 | 2.17 | 2.17 | 4.05 | 5.23 | 4.13 | 3.66 | | |
| NT2RP1000101 | 3.44 | 3.44 | 5.22 | 4.41 | 2.88 | 4.81 | | |
| NT2RP1000111 | 3.24 | 3.24 | 5.56 | 4.51 | 3.9 | 3.69 | | |
| NT2RP1000112 | 3.29 | 3.29 | 4.08 | 1.85 | 3.33 | 3 | | |
| NT2RP1000124 | 5.57 | 5.57 | 4.96 | 3.11 | 5.73 | 5.5 | | |
| NT2RP1000125 | 7.28 | 7.28 | 19.39 | 13.69 | 10.68 | 16.86 | | |
| NT2RP1000129 | 1.81 | 1.81 | 4.35 | 5.14 | 3.91 | 4.27 | | |
| NT2RP1000130 | 2.31 | 2.31 | 4.11 | 5.31 | 5.62 | 16.86 | | |
| NT2RP1000154 | 7.5 | 7.5 | 15.63 | 17.16 | 12.72 | 16.37 | | |
| NT2RP1000163 | 2.42 | 2.42 | 3.51 | 2.72 | 2.99 | 3.59 | | |
| NT2RP1000170 | 3.42 | 3.42 | 4.2 | 4.96 | 5.17 | 5.85 | * | + |
| NT2RP1000174 | 3.5 | 3.5 | 3.42 | 1.3 | 2.38 | 2.12 | ** | − |
| NT2RP1000181 | 6.14 | 6.14 | 7.22 | 10.97 | 14.98 | 9.38 | * | + |
| NT2RP1000191 | 1.08 | 1.08 | 5.61 | 4.94 | 3.59 | 5.71 | | |
| NT2RP1000202 | 1.06 | 1.06 | 1.66 | 2.02 | 1.2 | 2.24 | | |
| NT2RP1000239 | 1.53 | 1.53 | 4.1 | 2.15 | 0.94 | 2.07 | | |
| NT2RP1000243 | 2.37 | 2.37 | 2.04 | 1.31 | 1.14 | 1.64 | ** | − |
| NT2RP1000255 | 1.94 | 1.94 | 3.02 | 2.11 | 2.26 | 1.78 | | |
| NT2RP1000259 | 5.27 | 5.27 | 9.55 | 5.53 | 6.33 | 4.29 | | |
| NT2RP1000261 | 2.76 | 2.76 | 4.4 | 2.07 | 1.64 | 2.64 | | |
| NT2RP1000269 | 5.16 | 5.16 | 5.01 | 7.7 | 10.51 | 7.39 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP1000271 | 7.79 | 7.79 | 15.88 | 13.16 | 15.11 | 18.48 | | |
| NT2RP1000272 | 7.71 | 7.71 | 13.07 | 10.72 | 11.74 | 11.3 | | |
| NT2RP1000279 | 2.19 | 2.19 | 5.24 | 2.23 | 3.91 | 2.62 | | |
| NT2RP1000290 | 6.61 | 6.61 | 9.02 | 12.65 | 13.52 | 9.92 | * | + |
| NT2RP1000293 | 6.86 | 6.86 | 10.91 | 9.75 | 8.45 | 10.92 | | |
| NT2RP1000300 | 12.42 | 12.42 | 11.93 | 9.96 | 11.37 | 10.2 | * | – |
| NT2RP1000324 | 5.16 | 5.16 | 6 | 4.69 | 5.92 | 6.97 | | |
| NT2RP1000325 | 54.42 | 54.42 | 101.4 | 70.46 | 57.52 | 78.6 | | |
| NT2RP1000326 | 4.01 | 4.01 | 7.67 | 3.82 | 4.56 | 7.85 | | |
| NT2RP1000331 | 12.16 | 12.16 | 24.08 | 12.19 | 10.5 | 20.1 | | |
| NT2RP1000333 | 4.18 | 4.18 | 7.52 | 6.66 | 6.53 | 6.98 | | |
| NT2RP1000336 | 1.45 | 1.45 | 4.45 | 1.35 | 3.76 | 1.78 | | |
| NT2RP1000347 | 3.05 | 3.05 | 8.75 | 7.26 | 8.31 | 6.38 | | |
| NT2RP1000348 | 2.11 | 2.11 | 4.14 | 2.76 | 3 | 2.75 | | |
| NT2RP1000349 | 2.12 | 2.12 | 3.92 | 3 | 4.39 | 4.11 | | |
| NT2RP1000353 | 40.87 | 40.87 | 83.5 | 51.49 | 47.8 | 66.02 | | |
| NT2RP1000356 | 39.53 | 39.53 | 93.37 | 50.3 | 56.48 | 74.42 | | |
| NT2RP1000357 | 3.89 | 3.89 | 9.63 | 8.43 | 8.7 | 8.72 | | |
| NT2RP1000358 | 2.85 | 2.85 | 6.11 | 4.23 | 3.04 | 5.09 | | |
| NT2RP1000360 | 11.04 | 11.04 | 19.39 | 12.08 | 18.42 | 19.44 | | |
| NT2RP1000363 | 13.09 | 13.09 | 15.39 | 13.13 | 13.38 | 10.01 | | |
| NT2RP1000376 | 1.81 | 1.81 | 3.8 | 2.09 | 1.9 | 2.24 | | |
| NT2RP1000386 | 118 | 118 | 191.31 | 146.98 | 187.97 | 155.47 | | |
| NT2RP1000407 | 0.72 | 0.72 | 3.16 | 0.58 | 0.89 | 1.2 | | |
| NT2RP1000409 | 2.05 | 2.05 | 5.39 | 2.84 | 6.59 | 3.83 | | |
| NT2RP1000413 | 4.78 | 4.78 | 8.03 | 5.86 | 8.89 | 10.19 | | |
| NT2RP1000416 | 1.5 | 1.5 | 2.01 | 0.93 | 3.17 | 0.7 | | |
| NT2RP1000418 | 2.27 | 2.27 | 6.69 | 5.08 | 6.67 | 4.85 | | |
| NT2RP1000420 | 1.77 | 1.77 | 5.19 | 7.32 | 7.64 | 3.7 | | |
| NT2RP1000434 | 1.48 | 1.48 | 4.39 | 1.27 | 3.12 | 1 | | |
| NT2RP1000439 | 5.02 | 5.02 | 9.31 | 20.62 | 28.73 | 24.75 | ** | + |
| NT2RP1000443 | 1.8 | 1.8 | 3.46 | 2.24 | 1.61 | 1.63 | | |
| NT2RP1000447 | 2.21 | 2.21 | 5.57 | 2.49 | 2.87 | 3.1 | | |
| NT2RP1000448 | 1.39 | 1.39 | 3.58 | 3.09 | 4.4 | 1.41 | | |
| NT2RP1000451 | 4.2 | 4.2 | 6.37 | 5.72 | 7.27 | 7.04 | | |
| NT2RP1000458 | 15.1 | 15.1 | 10.53 | 19.73 | 8.72 | 23.03 | | |
| NT2RP1000460 | 7.55 | 7.55 | 13.82 | 8.76 | 11.49 | 8.62 | | |
| NT2RP1000465 | 4.58 | 4.58 | 20.97 | 20.41 | 19.98 | 22.46 | | |
| NT2RP1000468 | 3.25 | 3.25 | 4.64 | 3.82 | 4.1 | 4.45 | | |
| NT2RP1000470 | 2.38 | 2.38 | 5.67 | 3.99 | 2.35 | 3.8 | | |
| NT2RP1000477 | 1.11 | 1.11 | 3.81 | 1.1 | 0.84 | 0.83 | | |
| NT2RP1000478 | 4.53 | 4.53 | 12.55 | 19.87 | 18.75 | 20.39 | * | + |
| NT2RP1000481 | 1.23 | 1.23 | 3.89 | 2.48 | 4.09 | 1.2 | | |
| NT2RP1000493 | 2.44 | 2.44 | 3.8 | 1.74 | 3.83 | 0.87 | | |
| NT2RP1000513 | 13.07 | 13.07 | 16.37 | 17.06 | 17.57 | 18.97 | * | + |
| NT2RP1000522 | 6.13 | 6.13 | 12.69 | 13.13 | 13.08 | 10.32 | | |
| NT2RP1000533 | 3.72 | 3.72 | 6.17 | 2.92 | 4.49 | 2.17 | | |
| NT2RP1000544 | 1.53 | 1.53 | 2.45 | 1.38 | 1.24 | 1.44 | | |
| NT2RP1000547 | 0.88 | 0.88 | 2.45 | 2 | 1.63 | 1.23 | | |
| NT2RP1000551 | 1.7 | 1.7 | 2.62 | 2.13 | 3.2 | 1.1 | | |
| NT2RP1000567 | 1.66 | 1.66 | 4.29 | 2.54 | 4.29 | 1.77 | | |
| NT2RP1000574 | 1.99 | 1.99 | 4.28 | 1.5 | 3.43 | 1.38 | | |
| NT2RP1000577 | 3.14 | 3.14 | 6.01 | 3.16 | 5.31 | 2.05 | | |
| NT2RP1000579 | 4.64 | 4.64 | 6.24 | 3.27 | 3.97 | 2.04 | | |
| NT2RP1000581 | 5.22 | 5.22 | 3.58 | 2.07 | 1.61 | 0.93 | ** | – |
| NT2RP1000593 | 1.74 | 1.74 | 4.39 | 2.48 | 3.28 | 2.3 | | |
| NT2RP1000604 | 3.85 | 3.85 | 7.75 | 17.25 | 13.78 | 16.39 | ** | + |
| NT2RP1000609 | 1.15 | 1.15 | 2.21 | 2.84 | 2.61 | 1.55 | | |
| NT2RP1000613 | 1.12 | 1.12 | 2.56 | 1.82 | 4.29 | 0.82 | | |
| NT2RP1000622 | 5.94 | 5.94 | 15.9 | 14.91 | 19.42 | 15.46 | | |
| NT2RP1000627 | 9.18 | 9.18 | 18.96 | 23.88 | 21.9 | 14.86 | | |
| NT2RP1000629 | 4.18 | 4.18 | 5.9 | 5.92 | 5.32 | 3.17 | | |
| NT2RP1000630 | 6.54 | 6.54 | 7.84 | 7.21 | 7.67 | 7.92 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP1000639 | 0.64 | 0.64 | 0.31 | 1.53 | 2.04 | 0.28 | | |
| NT2RP1000640 | 130.14 | 130.14 | 307.77 | 227.5 | 176.05 | 232.29 | | |
| NT2RP1000646 | 4.14 | 4.14 | 9.59 | 10.19 | 11.87 | 12.15 | * | + |
| NT2RP1000659 | 2.65 | 2.65 | 7 | 8.91 | 7.99 | 6.04 | | |
| NT2RP1000674 | 13.48 | 13.48 | 28.08 | 43.62 | 45.82 | 56.95 | ** | + |
| NT2RP1000677 | 3.9 | 3.9 | 10.76 | 11.84 | 10.19 | 9.87 | | |
| NT2RP1000679 | 2.38 | 2.38 | 3.76 | 2.3 | 2.35 | 1.05 | | |
| NT2RP1000688 | 4.72 | 4.72 | 3.34 | 2.76 | 2.73 | 1.83 | * | − |
| NT2RP1000689 | 1.44 | 1.44 | 1.86 | 2.03 | 1.22 | 1.13 | | |
| NT2RP1000695 | 1.11 | 1.11 | 2.5 | 2.09 | 2.44 | 1.52 | | |
| NT2RP1000701 | 0.89 | 0.89 | 1.08 | 2.62 | 2.74 | 1.71 | * | + |
| NT2RP1000702 | 1.12 | 1.12 | 2.28 | 3.74 | 4.07 | 3.15 | * | + |
| NT2RP1000713 | 2.29 | 2.29 | 2.79 | 2.8 | 3.56 | 2.38 | | |
| NT2RP1000721 | 4.14 | 4.14 | 4.49 | 4.48 | 3.92 | 3.78 | | |
| NT2RP1000730 | 3.5 | 3.5 | 4.83 | 2.61 | 4.5 | 2.41 | | |
| NT2RP1000733 | 6.08 | 6.08 | 6.56 | 4.91 | 8.12 | 5.65 | | |
| NT2RP1000738 | 3.18 | 3.18 | 8.04 | 5.16 | 5.71 | 7.11 | | |
| NT2RP1000739 | 1.11 | 1.11 | 2.65 | 4.02 | 3.09 | 2.86 | | |
| NT2RP1000740 | 1.41 | 1.41 | 3.13 | 3.63 | 3.57 | 3.77 | * | + |
| NT2RP1000746 | 1.15 | 1.15 | 3.58 | 2.28 | 3.74 | 1.37 | | |
| NT2RP1000750 | 4 | 4 | 8.31 | 10.25 | 10.72 | 9.39 | * | + |
| NT2RP1000751 | 33.15 | 33.15 | 59.65 | 67.84 | 64.22 | 66.55 | | |
| NT2RP1000767 | 3.8 | 3.8 | 3.64 | 1.7 | 2.62 | 0.62 | * | − |
| NT2RP1000769 | 9.31 | 9.31 | 13.98 | 7.42 | 8.59 | 7.19 | | |
| NT2RP1000780 | 0.86 | 0.86 | 1.01 | 1.87 | 1.13 | 0.89 | | |
| NT2RP1000782 | 4.25 | 4.25 | 12.21 | 10.24 | 7.96 | 9.13 | | |
| NT2RP1000796 | 3.17 | 3.17 | 2.69 | 4.23 | 2.99 | 2.86 | | |
| NT2RP1000797 | 12.31 | 12.31 | 22.78 | 19.44 | 18.64 | 21.78 | | |
| NT2RP1000800 | 1.13 | 1.13 | 3.74 | 2.46 | 2.66 | 1.46 | | |
| NT2RP1000825 | 2.38 | 2.38 | 2.91 | 1.04 | 1.88 | 0.87 | * | − |
| NT2RP1000833 | 2.5 | 2.5 | 2.85 | 0.92 | 2.39 | 1.26 | | |
| NT2RP1000834 | 35.44 | 35.44 | 66.57 | 73.98 | 90.28 | 71.45 | | |
| NT2RP1000836 | 1.83 | 1.83 | 3.43 | 1.01 | 2.39 | 1.04 | | |
| NT2RP1000837 | 3.36 | 3.36 | 6.66 | 3.22 | 4.71 | 3.67 | | |
| NT2RP1000846 | 1.29 | 1.29 | 5.48 | 1.67 | 2.84 | 1.4 | | |
| NT2RP1000847 | 1.99 | 1.99 | 5.49 | 2.15 | 5.12 | 1.64 | | |
| NT2RP1000851 | 4.67 | 4.67 | 9.32 | 6.18 | 7.94 | 6.72 | | |
| NT2RP1000856 | 14.31 | 14.31 | 17.46 | 20.38 | 23.22 | 19.37 | * | + |
| NT2RP1000860 | 2.09 | 2.09 | 4.54 | 4.02 | 2.74 | 4.04 | | |
| NT2RP1000902 | 5.31 | 5.31 | 11.6 | 6.94 | 9.91 | 7.34 | | |
| NT2RP1000903 | 2.45 | 2.45 | 6.26 | 4.04 | 3.42 | 4.24 | | |
| NT2RP1000905 | 1.76 | 1.76 | 4.87 | 5.36 | 5.66 | 10 | | |
| NT2RP1000915 | 5.51 | 5.51 | 10.01 | 6.72 | 8.59 | 9.91 | | |
| NT2RP1000916 | 2.31 | 2.31 | 5.51 | 1.78 | 3.82 | 2.09 | | |
| NT2RP1000921 | 9.38 | 9.38 | 8.73 | 8.23 | 9.13 | 7.92 | | |
| NT2RP1000943 | 5.14 | 5.14 | 10.76 | 8.51 | 8.55 | 7.2 | | |
| NT2RP1000944 | 1.59 | 1.59 | 2.21 | 1.78 | 1.74 | 1.15 | | |
| NT2RP1000947 | 8.5 | 8.5 | 14.91 | 16.51 | 15.04 | 14.22 | | |
| NT2RP1000954 | 2.11 | 2.11 | 4.96 | 2.74 | 5.55 | 3.04 | | |
| NT2RP1000958 | 6.48 | 6.48 | 14.73 | 4.54 | 10.17 | 10.21 | | |
| NT2RP1000959 | 124.81 | 124.81 | 209.45 | 128.43 | 72.65 | 206.1 | | |
| NT2RP1000966 | 9.96 | 9.96 | 12.96 | 14.28 | 15.36 | 21.39 | | |
| NT2RP1000974 | 2.46 | 2.46 | 5.38 | 3.98 | 6.08 | 3.71 | | |
| NT2RP1000980 | 3.07 | 3.07 | 5.5 | 4.04 | 4.53 | 4.02 | | |
| NT2RP1000981 | 4.3 | 4.3 | 8.09 | 5.68 | 7.26 | 5.27 | | |
| NT2RP1000988 | 6.45 | 6.45 | 10.46 | 9.62 | 6.44 | 7.87 | | |
| NT2RP1001002 | 2.8 | 2.8 | 7.36 | 3.94 | 4.57 | 4.3 | | |
| NT2RP1001004 | 4.72 | 4.72 | 8.25 | 3.65 | 4.9 | 5.37 | | |
| NT2RP1001007 | 1.42 | 1.42 | 3.42 | 1.69 | 3.84 | 2.03 | | |
| NT2RP1001011 | 1.94 | 1.94 | 5.93 | 3.82 | 5.46 | 4.83 | | |
| NT2RP1001013 | 4.45 | 4.45 | 9.41 | 5.92 | 8.62 | 5.04 | | |
| NT2RP1001014 | 2.21 | 2.21 | 5.89 | 3.76 | 6.64 | 3.49 | | |
| NT2RP1001020 | 1.87 | 1.87 | 4.11 | 2.08 | 3.75 | 2.36 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP1001023 | 62.79 | 62.79 | 145.09 | 101.48 | 105.86 | 143.96 | | |
| NT2RP1001027 | 18.11 | 18.11 | 82.66 | 51.63 | 59.05 | 68.9 | | |
| NT2RP1001031 | 1.83 | 1.83 | 3.31 | 2.05 | 3.53 | 2.25 | | |
| NT2RP1001033 | 2.43 | 2.43 | 6.09 | 5.68 | 5.98 | 4.27 | | |
| NT2RP1001042 | 2.94 | 2.94 | 6.47 | 2.99 | 3.85 | 2.04 | | |
| NT2RP1001045 | 15.95 | 15.95 | 23.24 | 40.66 | 47.04 | 44.53 | ** | + |
| NT2RP1001073 | 6.64 | 6.64 | 10.57 | 8.32 | 10.46 | 7.33 | | |
| NT2RP1001079 | 2.91 | 2.91 | 6.37 | 2.16 | 2.58 | 1.48 | | |
| NT2RP1001080 | 2.16 | 2.16 | 4.89 | 6.88 | 4.2 | 4.56 | | |
| NT2RP1001113 | 1.07 | 1.07 | 3.64 | 3.55 | 3.94 | 3.26 | | |
| NT2RP1001159 | 21.42 | 21.42 | 43.84 | 22.89 | 23.31 | 34.25 | | |
| NT2RP1001173 | 1.7 | 1.7 | 3.07 | 1.38 | 4.28 | 1.52 | | |
| NT2RP1001176 | 7.4 | 7.4 | 10.13 | 13 | 9.31 | 13.95 | | |
| NT2RP1001177 | 5.31 | 5.31 | 5.75 | 3.01 | 5.5 | 2.02 | | |
| NT2RP1001185 | 6.42 | 6.42 | 9.37 | 3.79 | 4.63 | 2.73 | * | − |
| NT2RP1001199 | 3.9 | 3.9 | 7.67 | 6.93 | 5.22 | 3.28 | | |
| NT2RP1001205 | 7.78 | 7.78 | 19.46 | 16.66 | 12.64 | 23.28 | | |
| NT2RP1001215 | 1.82 | 1.82 | 5.02 | 3.79 | 4.12 | 3.15 | | |
| NT2RP1001225 | 4.54 | 4.54 | 7.96 | 7.56 | 8.77 | 6.31 | | |
| NT2RP1001245 | 7.27 | 7.27 | 10.86 | 19.68 | 21.03 | 22.13 | ** | + |
| NT2RP1001247 | 2.04 | 2.04 | 4.01 | 1.77 | 2.89 | 1.67 | | |
| NT2RP1001248 | 2.81 | 2.81 | 6.79 | 3.94 | 4.63 | 2.4 | | |
| NT2RP1001253 | 5.02 | 5.02 | 6.39 | 4.48 | 4.38 | 3.32 | | |
| NT2RP1001286 | 6.18 | 6.18 | 7.69 | 3.79 | 3.88 | 4.12 | ** | − |
| NT2RP1001294 | 2.4 | 2.4 | 4.47 | 3.6 | 2.73 | 4.18 | | |
| NT2RP1001302 | 2.46 | 2.46 | 4.51 | 4.89 | 2.9 | 5.39 | | |
| NT2RP1001310 | 15.54 | 15.54 | 34.01 | 21.13 | 20.75 | 27.15 | | |
| NT2RP1001311 | 1.9 | 1.9 | 3.22 | 2.66 | 3.16 | 2.38 | | |
| NT2RP1001313 | 2.6 | 2.6 | 7.72 | 5.45 | 7.85 | 5.78 | | |
| NT2RP1001324 | 2.47 | 2.47 | 5.3 | 3.34 | 4.17 | 2.35 | | |
| NT2RP1001349 | 3.3 | 3.3 | 6.29 | 3.63 | 3.92 | 2.14 | | |
| NT2RP1001361 | 19.41 | 19.41 | 18.28 | 23.28 | 28.33 | 24.16 | * | + |
| NT2RP1001379 | 3.82 | 3.82 | 9.52 | 4.97 | 7.97 | 7.06 | | |
| NT2RP1001385 | 2.06 | 2.06 | 4.51 | 4.09 | 3.89 | 4.4 | | |
| NT2RP1001395 | 4.96 | 4.96 | 7.86 | 6.01 | 6.32 | 8.13 | | |
| NT2RP1001410 | 8.75 | 8.75 | 20.39 | 15.74 | 15.66 | 9.94 | | |
| NT2RP1001424 | 2.39 | 2.39 | 3.34 | 3 | 3 | 1.73 | | |
| NT2RP1001432 | 4.33 | 4.33 | 3.86 | 2.19 | 1.76 | 2.05 | ** | − |
| NT2RP1001449 | 6.23 | 6.23 | 7.5 | 6.29 | 8.21 | 4.63 | | |
| NT2RP1001457 | 4.09 | 4.09 | 4.21 | 2.11 | 2.26 | 2.63 | ** | − |
| NT2RP1001459 | 21.54 | 21.54 | 132.97 | 90.96 | 107.97 | 81.08 | | |
| NT2RP1001466 | 5.73 | 5.73 | 14.97 | 11.31 | 9.39 | 10.99 | | |
| NT2RP1001475 | 2.45 | 2.45 | 6.31 | 5.98 | 6.67 | 3.9 | | |
| NT2RP1001482 | 3.93 | 3.93 | 9.18 | 15.88 | 13.03 | 8.2 | | |
| NT2RP1001494 | 1.61 | 1.61 | 4.6 | 4.34 | 4.18 | 2.25 | | |
| NT2RP1001500 | 3.39 | 3.39 | 8.13 | 8.09 | 8.65 | 7.42 | | |
| NT2RP1001517 | 5.11 | 5.11 | 7.37 | 4.41 | 5.38 | 2.36 | | |
| NT2RP1001540 | 4.74 | 4.74 | 5.03 | 4.6 | 4.86 | 3.11 | | |
| NT2RP1001543 | 1.02 | 1.02 | 1.83 | 1.49 | 1.12 | 0.98 | | |
| NT2RP1001546 | 22.51 | 22.51 | 51.51 | 34.99 | 22.76 | 33.42 | | |
| NT2RP1001550 | 9.33 | 9.33 | 21.4 | 14.35 | 12.21 | 13.42 | | |
| NT2RP1001553 | 2.07 | 2.07 | 6.07 | 5.69 | 6.04 | 4.45 | | |
| NT2RP1001555 | 36.28 | 36.28 | 58.55 | 41.1 | 53.63 | 54.35 | | |
| NT2RP1001563 | 2.28 | 2.28 | 3.44 | 2.07 | 2.24 | 1.31 | | |
| NT2RP1001569 | 9.43 | 9.43 | 16 | 17.31 | 18.21 | 13.04 | | |
| NT2RP1001584 | 15.6 | 15.6 | 19.66 | 28.1 | 32.53 | 25.83 | ** | + |
| NT2RP1001599 | 1.18 | 1.18 | 1.95 | 1.27 | 1.19 | 1.24 | | |
| NT2RP1001616 | 5 | 5 | 11.95 | 9.49 | 6.7 | 8.95 | | |
| NT2RP1001654 | 11.78 | 11.78 | 18.07 | 16.27 | 16.54 | 18.38 | | |
| NT2RP1001665 | 2.77 | 2.77 | 4.72 | 2.73 | 2.05 | 2.05 | | |
| NT2RP1001679 | 76.31 | 76.31 | 195.7 | 199.2 | 240.87 | 222.46 | | |
| NT2RP1001681 | 10.11 | 10.11 | 15.1 | 20.39 | 21.03 | 23.99 | ** | + |
| NT2RP1001694 | 3.58 | 3.58 | 3.82 | 2.45 | 2.38 | 1.97 | ** | − |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2000001 | 5.23 | 5.23 | 5.53 | 4.17 | 4.54 | 3.74 | ** | − |
| NT2RP2000006 | 3.49 | 3.49 | 7.32 | 4.12 | 3.88 | 3.4 | | |
| NT2RP2000007 | 3.18 | 3.18 | 6.56 | 4.68 | 5.66 | 4.92 | | |
| NT2RP2000008 | 2.77 | 2.77 | 6.72 | 3.66 | 5.3 | 4.9 | | |
| NT2RP2000010 | 2.89 | 2.89 | 5.59 | 2.99 | 5.06 | 2.5 | | |
| NT2RP2000011 | 7.08 | 7.08 | 17.96 | 14.55 | 14.74 | 15.15 | | |
| NT2RP2000027 | 2.28 | 2.28 | 7.42 | 4.52 | 4.89 | 3.61 | | |
| NT2RP2000028 | 22.93 | 22.93 | 62.54 | 46.48 | 51.47 | 53.47 | | |
| NT2RP2000032 | 2.5 | 2.5 | 5.85 | 3.11 | 3.71 | 6.42 | | |
| NT2RP2000040 | 11.57 | 11.57 | 23.92 | 14.38 | 14.5 | 23.1 | | |
| NT2RP2000042 | 5.28 | 5.28 | 10.32 | 6.89 | 7.21 | 12.64 | | |
| NT2RP2000045 | 5.7 | 5.7 | 9.42 | 5.27 | 6.45 | 6.3 | | |
| NT2RP2000051 | 3.16 | 3.16 | 6.29 | 9.23 | 9.96 | 9.53 | ** | + |
| NT2RP2000054 | 2.55 | 2.55 | 6.42 | 3.81 | 5.42 | 2.53 | | |
| NT2RP2000056 | 3.68 | 3.68 | 6.23 | 5.67 | 6.89 | 5.8 | | |
| NT2RP2000057 | 60.79 | 60.79 | 174.83 | 212.63 | 239.81 | 221.98 | * | + |
| NT2RP2000067 | 3.1 | 3.1 | 3.86 | 2.98 | 4.36 | 5.72 | | |
| NT2RP2000070 | 2.91 | 2.91 | 6.27 | 5.7 | 5.95 | 8.21 | | |
| NT2RP2000076 | 1.66 | 1.66 | 4.45 | 2.98 | 3.58 | 3.23 | | |
| NT2RP2000077 | 1.67 | 1.67 | 4.73 | 2.43 | 4.94 | 3.14 | | |
| NT2RP2000079 | 3.76 | 3.76 | 9.24 | 5.15 | 4.81 | 5.47 | | |
| NT2RP2000088 | 2.9 | 2.9 | 5.22 | 2.18 | 3.07 | 2.21 | | |
| NT2RP2000091 | 5.84 | 5.84 | 6.54 | 6.62 | 8.28 | 6.72 | | |
| NT2RP2000092 | 4.37 | 4.37 | 6.7 | 6.06 | 7.67 | 5.65 | | |
| NT2RP2000097 | 2.74 | 2.74 | 3.39 | 3.4 | 4.13 | 4.13 | * | + |
| NT2RP2000098 | 3.44 | 3.44 | 6.83 | 6.69 | 9.01 | 6.27 | | |
| NT2RP2000108 | 1.93 | 1.93 | 7.24 | 4.8 | 6.31 | 6.68 | | |
| NT2RP2000114 | 1.95 | 1.95 | 3.65 | 2.58 | 4.41 | 2.9 | | |
| NT2RP2000116 | 3.17 | 3.17 | 7.36 | 5.35 | 3.85 | 9.42 | | |
| NT2RP2000119 | 3.14 | 3.14 | 7.16 | 4.58 | 7.96 | 5.6 | | |
| NT2RP2000120 | 3.91 | 3.91 | 7.62 | 5.57 | 8.5 | 5.8 | | |
| NT2RP2000126 | 2.86 | 2.86 | 4.86 | 3.88 | 5.1 | 3.44 | | |
| NT2RP2000133 | 1.83 | 1.83 | 3.66 | 3.13 | 4.05 | 2.01 | | |
| NT2RP2000147 | 6.28 | 6.28 | 12.88 | 11.64 | 6.51 | 8.58 | | |
| NT2RP2000153 | 4.61 | 4.61 | 9.55 | 10.57 | 6.49 | 12.05 | | |
| NT2RP2000156 | 3.27 | 3.27 | 8.24 | 5.59 | 6.55 | 4.07 | | |
| NT2RP2000157 | 3.7 | 3.7 | 6.33 | 6.57 | 5.02 | 4.15 | | |
| NT2RP2000161 | 4.45 | 4.45 | 8.82 | 7.52 | 7.5 | 6.02 | | |
| NT2RP2000168 | 4.22 | 4.22 | 12.63 | 3.94 | 6.03 | 3.88 | | |
| NT2RP2000173 | 12.56 | 12.56 | 81.37 | 72.12 | 92.12 | 78.68 | | |
| NT2RP2000175 | 1.9 | 1.9 | 3.78 | 2.03 | 3.33 | 4.43 | | |
| NT2RP2000178 | 2.06 | 2.06 | 6.06 | 3.23 | 3.01 | 3.81 | | |
| NT2RP2000183 | 1.64 | 1.64 | 7.82 | 5.82 | 6.21 | 6.03 | | |
| NT2RP2000195 | 3.1 | 3.1 | 6.65 | 6 | 6.71 | 3.22 | | |
| NT2RP2000204 | 73.6 | 73.6 | 93.43 | 102.95 | 40.16 | 62.34 | | |
| NT2RP2000205 | 4 | 4 | 6.56 | 3.91 | 5.74 | 4.5 | | |
| NT2RP2000208 | 3.06 | 3.06 | 9.42 | 4.23 | 6.77 | 3.36 | | |
| NT2RP2000224 | 13.31 | 3.3 | 31.75 | 18.34 | 21.15 | 20.93 | | |
| NT2RP2000230 | 9.96 | 9.96 | 18.99 | 12.16 | 16.4 | 11.95 | | |
| NT2RP2000231 | 4.3 | 4.3 | 7.41 | 4.24 | 3.43 | 4.54 | | |
| NT2RP2000232 | 1.08 | 1.08 | 2.75 | 1.53 | 2.45 | 0.74 | | |
| NT2RP2000233 | 8.04 | 8.04 | 60.44 | 47.2 | 64.72 | 52.31 | | |
| NT2RP2000239 | 3 | 3 | 4.7 | 8.93 | 8.93 | 7.01 | ** | + |
| NT2RP2000240 | 2.01 | 2.01 | 5.25 | 2.49 | 3.41 | 1.45 | | |
| NT2RP2000248 | 4.29 | 4.29 | 6.09 | 2.82 | 2.39 | 0.96 | * | − |
| NT2RP2000256 | 5.7 | 5.7 | 8.25 | 5.62 | 6.22 | 5.44 | | |
| NT2RP2000257 | 3.47 | 3.47 | 6.92 | 4.86 | 6.52 | 4.34 | | |
| NT2RP2000258 | 1.53 | 1.53 | 3.83 | 3.88 | 2.93 | 3.02 | | |
| NT2RP2000261 | 2.95 | 2.95 | 3.94 | 4.47 | 3.59 | 2.91 | | |
| NT2RP2000270 | 3.12 | 3.12 | 6.26 | 6.66 | 4.06 | 4.3 | | |
| NT2RP2000274 | 1.78 | 1.78 | 3.87 | 3.48 | 5.16 | 2.56 | | |
| NT2RP2000277 | 2.18 | 2.18 | 6.13 | 3.19 | 4.02 | 2.98 | | |
| NT2RP2000279 | 2.26 | 2.26 | 4.92 | 2.43 | 2.52 | 2.17 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2000283 | 5.75 | 5.75 | 27.65 | 21.53 | 27.32 | 24.78 | | |
| NT2RP2000288 | 6.29 | 6.29 | 7.46 | 8.9 | 10.89 | 8.64 | * | + |
| NT2RP2000289 | 1.12 | 1.12 | 2.79 | 3.09 | 2.77 | 1.93 | | |
| NT2RP2000297 | 2.57 | 2.57 | 5.7 | 4.8 | 4.53 | 6.09 | | |
| NT2RP2000298 | 3.61 | 3.61 | 9.64 | 8.51 | 7.66 | 8.24 | | |
| NT2RP2000310 | 1.43 | 1.43 | 2.3 | 2.46 | 3.41 | 1.7 | | |
| NT2RP2000327 | 2.12 | 2.12 | 3.96 | 3.13 | 3.49 | 1.57 | | |
| NT2RP2000328 | 6.95 | 6.95 | 11.56 | 13.43 | 16.7 | 14.68 | * | + |
| NT2RP2000329 | 10.73 | 10.73 | 10.17 | 17.55 | 23.92 | 18.52 | ** | + |
| NT2RP2000333 | 6.35 | 6.35 | 6.4 | 6.83 | 7.17 | 4.64 | | |
| NT2RP2000337 | 2.05 | 2.05 | 5.16 | 4.43 | 5.32 | 5.31 | | |
| NT2RP2000346 | 2.55 | 2.55 | 5.18 | 7.2 | 5.63 | 4.95 | | |
| NT2RP2000357 | 1.57 | 1.57 | 6.87 | 5.48 | 5.14 | 5.35 | | |
| NT2RP2000358 | 2.09 | 2.09 | 4.52 | 5.03 | 4.9 | 4.01 | | |
| NT2RP2000366 | 3.23 | 3.23 | 4.08 | 4.16 | 4.25 | 2.32 | | |
| NT2RP2000369 | 7.22 | 7.22 | 9.94 | 44.13 | 45.2 | 44.34 | ** | + |
| NT2RP2000376 | 26.92 | 26.92 | 108.62 | 84.48 | 134.63 | 85.95 | | |
| NT2RP2000394 | 6.49 | 6.49 | 5.92 | 5.08 | 8.52 | 4.21 | | |
| NT2RP2000396 | 2.71 | 2.71 | 6.55 | 7.52 | 6.8 | 5.02 | | |
| NT2RP2000412 | 4.48 | 4.48 | 23.45 | 21.42 | 24.93 | 20.49 | | |
| NT2RP2000414 | 8.03 | 8.03 | 18.69 | 23.83 | 18.98 | 23.37 | | |
| NT2RP2000420 | 1.12 | 1.12 | 4.11 | 3.5.43 | 25 | 1.97 | | |
| NT2RP2000422 | 6.41 | 6.41 | 13.18 | 17.56 | 17.88 | 18.67 | * | + |
| NT2RP2000426 | 21.59 | 21.59 | 80.94 | 87.94 | 110.97 | 74.98 | | |
| NT2RP2000428 | 24.92 | 24.92 | 43.91 | 34.21 | 35.59 | 30.95 | | |
| NT2RP2000438 | 5.06 | 5.06 | 5.17 | 5.62 | 6.94 | 5.11 | | |
| NT2RP2000447 | 4.14 | 4.14 | 9.68 | 7.3 | 7.08 | 7.16 | | |
| NT2RP2000448 | 3.03 | 3.03 | 4.63 | 4.57 | 3.57 | 3.17 | | |
| NT2RP2000459 | 2.47 | 2.47 | 4.93 | 2.82 | 3.15 | 2.09 | | |
| NT2RP2000479 | 3.3 | 3.3 | 7.51 | 5.33 | 5.71 | 5.06 | | |
| NT2RP2000498 | 3.07 | 3.07 | 6.25 | 4.48 | 5.09 | 3.9 | | |
| NT2RP2000503 | 2.47 | 2.47 | 4.46 | 2.54 | 2.82 | 1.52 | | |
| NT2RP2000510 | 4.01 | 4.01 | 6.19 | 5.08 | 6.45 | 3.7 | | |
| NT2RP2000514 | 2.65 | 2.65 | 2.51 | 1.94 | 2.25 | 1.63 | * | − |
| NT2RP2000516 | 4.72 | 4.72 | 9.77 | 4.92 | 5.29 | 5.18 | | |
| NT2RP2000523 | 2.21 | 2.21 | 3.17 | 1.92 | 2.44 | 2.63 | | |
| NT2RP2000533 | 17.82 | 17.82 | 29.05 | 22.57 | 27.56 | 30.78 | | |
| NT2RP2000540 | 1.98 | 1.98 | 4.66 | 3.01 | 5.41 | 5.18 | | |
| NT2RP2000547 | 3.1 | 3.1 | 5.26 | 4.38 | 5.27 | 3.71 | | |
| NT2RP2000557 | 4.26 | 4.26 | 6.96 | 4.34 | 6.5 | 3.32 | | |
| NT2RP2000558 | 3.43 | 3.43 | 7.17 | 6.43 | 7.11 | 8.26 | | |
| NT2RP2000564 | 3.04 | 3.04 | 7.2 | 3.49 | 8.03 | 4.77 | | |
| NT2RP2000565 | 4.54 | 4.54 | 11.07 | 7.64 | 9.24 | 9.98 | | |
| NT2RP2000583 | 14.8 | 14.8 | 44.9 | 49.6 | 34.93 | 49.08 | | |
| NT2RP2000591 | 0.81 | 0.81 | 3.81 | 1.53 | 2.61 | 1.21 | | |
| NT2RP2000599 | 1.85 | 1.85 | 4.1 | 1.97 | 3.43 | 2.36 | | |
| NT2RP2000601 | 1.78 | 1.78 | 4.67 | 1.28 | 2.48 | 1.3 | | |
| NT2RP2000603 | 2.58 | 2.58 | 4.44 | 2.54 | 2.84 | 2.98 | | |
| NT2RP2000610 | 3.77 | 3.77 | 7.23 | 6.32 | 7.62 | 5.53 | | |
| NT2RP2000614 | 75.85 | 75.85 | 129.42 | 130.63 | 184.38 | 188.58 | * | + |
| NT2RP2000616 | 1.81 | 1.81 | 4.89 | 3.9 | 5.1 | 3.83 | | |
| NT2RP2000617 | 2.17 | 2.17 | 6.73 | 5.78 | 6.82 | 6.26 | | |
| NT2RP2000623 | 3.1 | 3.1 | 5.36 | 3.46 | 5.1 | 3.49 | | |
| NT2RP2000634 | 1.56 | 1.56 | 3.92 | 2.29 | 3.34 | 2.02 | | |
| NT2RP2000636 | 3.78 | 3.78 | 8.64 | 6.27 | 7.6 | 6.62 | | |
| NT2RP2000638 | 4.37 | 4.37 | 8.91 | 4.57 | 7.41 | 5.69 | | |
| NT2RP2000644 | 2.22 | 2.22 | 5.47 | 3.41 | 4.16 | 3.45 | | |
| NT2RP2000649 | 8.96 | 8.96 | 15.76 | 13.65 | 17.22 | 13.07 | | |
| NT2RP2000652 | 3.35 | 3.35 | 4.58 | 3.57 | 4.36 | 2.72 | | |
| NT2RP2000656 | 3.73 | 3.73 | 6.93 | 4.83 | 3.91 | 4.08 | | |
| NT2RP2000658 | 1.08 | 1.08 | 2.64 | 1.51 | 3.18 | 1.43 | | |
| NT2RP2000663 | 4.23 | 4.23 | 6.9 | 5.98 | 7.21 | 5.9 | | |
| NT2RP2000664 | 4.24 | 4.24 | 10.24 | 12.72 | 12.54 | 16.44 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2000668 | 7.49 | 7.49 | 26.84 | 16.92 | 20.41 | 17.17 | | |
| NT2RP2000678 | 1.77 | 1.77 | 3.19 | 1.77 | 2.09 | 1.13 | | |
| NT2RP2000694 | 4.89 | 4.89 | 8.39 | 11.06 | 13 | 13.36 | ** | + |
| NT2RP2000704 | 1.8 | 1.8 | 5.63 | 2.99 | 3.13 | 3.67 | | |
| NT2RP2000710 | 4.51 | 4.51 | 9.96 | 6.72 | 8.08 | 7.23 | | |
| NT2RP2000712 | 1.43 | 1.43 | 5.35 | 3.39 | 3.57 | 2.95 | | |
| NT2RP2000715 | 3.42 | 3.42 | 7.43 | 6.04 | 7.56 | 4.49 | | |
| NT2RP2000720 | 4.92 | 4.92 | 11.76 | 7.24 | 8 | 7.11 | | |
| NT2RP2000731 | 3.92 | 3.92 | 9.15 | 3.7 | 4.5 | 2.61 | | |
| NT2RP2000739 | 3.23 | 3.23 | 5.67 | 2.62 | 3.32 | 5.65 | | |
| NT2RP2000748 | 1.59 | 1.59 | 4.2 | 1.42 | 1.81 | 1.62 | | |
| NT2RP2000749 | 11.84 | 11.84 | 21.88 | 14.4 | 8.47 | 13.91 | | |
| NT2RP2000758 | 1.6 | 1.6 | 3.17 | 2.65 | 6 | 1.17 | | |
| NT2RP2000764 | 1.51 | 1.51 | 5.74 | 2.95 | 5.22 | 1.95 | | |
| NT2RP2000766 | 9.08 | 9.08 | 52.24 | 46.37 | 59.37 | 52.89 | | |
| NT2RP2000777 | 12.28 | 12.28 | 18.43 | 26.91 | 28.56 | 24.47 | ** | + |
| NT2RP2000786 | 21.32 | 21.32 | 73.91 | 55.85 | 67.59 | 58.16 | | |
| NT2RP2000793 | 5.32 | 5.32 | 6.9 | 4.32 | 3.57 | 4.38 | * | − |
| NT2RP2000796 | 5.32 | 5.32 | 7.41 | 7.38 | 9.17 | 6.66 | | |
| NT2RP2000809 | 3.25 | 3.25 | 8.3 | 6.46 | 4.69 | 5.45 | | |
| NT2RP2000812 | 6.65 | 6.65 | 17.51 | 16.43 | 14.35 | 16.89 | | |
| NT2RP2000814 | 4.16 | 4.16 | 4.97 | 3.75 | 4.6 | 3.29 | | |
| NT2RP2000816 | 1.84 | 1.84 | 5.64 | 4.64 | 5.19 | 3.58 | | |
| NT2RP2000818 | 3.28 | 3.28 | 5.19 | 3.18 | 3.66 | 1.95 | | |
| NT2RP2000819 | 2.76 | 2.76 | 5.79 | 3.03 | 3.05 | 1.94 | | |
| NT2RP2000841 | 4.35 | 4.35 | 4.51 | 2.17 | 2.48 | 1.65 | ** | − |
| NT2RP2000842 | 7.8 | 7.8 | 9.57 | 13.62 | 14.25 | 12.66 | ** | + |
| NT2RP2000845 | 2.52 | 2.52 | 8.31 | 7.51 | 6.76 | 6.93 | | |
| NT2RP2000863 | 2.45 | 2.45 | 3.48 | 3.82 | 3.37 | 2.47 | | |
| NT2RP2000880 | 5.96 | 5.96 | 11.61 | 9.5 | 11.13 | 10.25 | | |
| NT2RP2000892 | 4.3 | 4.3 | 6.43 | 6.54 | 6.97 | 5.01 | | |
| NT2RP2000894 | 5.59 | 5.59 | 11.88 | 5.41 | 5.59 | 2.16 | | |
| NT2RP2000903 | 5.71 | 5.71 | 9.12 | 10.73 | 11.92 | 7.44 | | |
| NT2RP2000906 | 4.56 | 4.56 | 5.39 | 2.63 | 3.78 | 2.19 | * | − |
| NT2RP2000910 | 4.34 | 4.34 | 4.26 | 2.9 | 2.7 | 1.68 | ** | − |
| NT2RP2000931 | 10.97 | 10.97 | 18.36 | 20.51 | 19.28 | 24.6 | | |
| NT2RP2000932 | 2.86 | 2.86 | 5.43 | 4.8 | 4.72 | 4.21 | | |
| NT2RP2000938 | 18.41 | 18.41 | 42.99 | 35.71 | 30.01 | 43.52 | | |
| NT2RP2000943 | 7.02 | 7.02 | 14.98 | 18.7 | 14.88 | 14.48 | | |
| NT2RP2000957 | 3.19 | 3.19 | 4.11 | 4.26 | 3.66 | 2.71 | | |
| NT2RP2000958 | 7 | 7 | 6.84 | 10.43 | 12.36 | 7.8 | | |
| NT2RP2000959 | 9.88 | 9.88 | 14.99 | 13.92 | 17.38 | 10.69 | | |
| NT2RP2000965 | 5.05 | 5.05 | 7.82 | 15.73 | 18.97 | 16.02 | ** | + |
| NT2RP2000970 | 2.31 | 2.31 | 6.72 | 5.14 | 5 | 4.62 | | |
| NT2RP2000973 | 0.9 | 0.9 | 1.47 | 2.56 | 2.64 | 1.57 | * | + |
| NT2RP2000985 | 2.69 | 2.69 | 6 | 9.28 | 6.29 | 13.98 | | |
| NT2RP2000987 | 1.89 | 1.89 | 3.31 | 4.54 | 3.17 | 1.66 | | |
| NT2RP2000997 | 13.83 | 13.83 | 23.99 | 38.12 | 29.73 | 40.96 | * | + |
| NT2RP2001024 | 2.86 | 2.86 | 5.34 | 3.61 | 3.12 | 2.36 | | |
| NT2RP2001028 | 4.66 | 4.66 | 4.2 | 2.65 | 4.09 | 0.99 | | |
| NT2RP2001036 | 5.14 | 5.14 | 8.86 | 6.16 | 6.44 | 4.91 | | |
| NT2RP2001039 | 1.08 | 1.08 | 3.18 | 3.47 | 1.14 | 2.24 | | |
| NT2RP2001044 | 1.13 | 1.13 | 2.5 | 2.53 | 1.89 | 2.8 | | |
| NT2RP2001056 | 4.97 | 4.97 | 28.32 | 20.16 | 26.9 | 18.16 | | |
| NT2RP2001065 | 2.38 | 2.38 | 6.24 | 7.45 | 7.4 | 5.69 | | |
| NT2RP2001067 | 2.98 | 2.98 | 5.38 | 4.12 | 5.29 | 2.41 | | |
| NT2RP2001070 | 3.3 | 3.3 | 7.63 | 4.72 | 6.17 | 3.58 | | |
| NT2RP2001081 | 2.91 | 2.91 | 8.19 | 4.8 | 6.68 | 3.9 | | |
| NT2RP2001087 | 3.93 | 3.93 | 2.36 | 2.06 | 2.92 | 1.61 | | |
| NT2RP2001094 | 0.69 | 0.69 | 1.37 | 1.25 | 1.15 | 1.04 | | |
| NT2RP2001119 | 2.02 | 2.02 | 6.11 | 5.86 | 4.44 | 4.35 | | |
| NT2RP2001127 | 1.53 | 1.53 | 4.04 | 2.69 | 1.85 | 2.1 | | |
| NT2RP2001133 | 2.45 | 2.45 | 4.73 | 4.06 | 3.61 | 3.6 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2001137 | 2.68 | 2.68 | 4.07 | 2.3 | 2.82 | 2.9 | | |
| NT2RP2001142 | 3.88 | 3.88 | 7.47 | 3.37 | 2.83 | 2.42 | | |
| NT2RP2001149 | 2.7 | 2.7 | 2.98 | 2.11 | 3.39 | 1.32 | | |
| NT2RP2001168 | 6 | 6 | 7.81 | 6.8 | 7.01 | 5.75 | | |
| NT2RP2001173 | 4.15 | 4.15 | 7.88 | 3.98 | 3.09 | 5.44 | | |
| NT2RP2001174 | 9.23 | 9.23 | 14.98 | 14.12 | 15.45 | 18.01 | | |
| NT2RP2001184 | 2.78 | 2.78 | 5.46 | 4.21 | 7.18 | 4.64 | | |
| NT2RP2001196 | 1.62 | 1.62 | 5.93 | 3.14 | 3.28 | 2.94 | | |
| NT2RP2001200 | 3.85 | 3.85 | 9.36 | 5.02 | 4.25 | 7.88 | | |
| NT2RP2001218 | 2.29 | 2.29 | 5.69 | 2.55 | 3.89 | 3.6 | | |
| NT2RP2001223 | 2.65 | 2.65 | 5.03 | 1.95 | 3.69 | 3.31 | | |
| NT2RP2001226 | 4.34 | 4.34 | 10.19 | 6.95 | 5.72 | 7.35 | | |
| NT2RP2001227 | 4.45 | 4.45 | 6.12 | 3.2 | 3.62 | 6.01 | | |
| NT2RP2001232 | 6.44 | 6.44 | 13.95 | 7.13 | 9.79 | 13.66 | | |
| NT2RP2001233 | 4.02 | 4.02 | 10.57 | 7.04 | 7.77 | 8.01 | | |
| NT2RP2001245 | 4.21 | 4.21 | 8.03 | 9.47 | 11.82 | 11.16 | * | + |
| NT2RP2001246 | 6.3 | 6.3 | 9.84 | 9 | 11.28 | 11.57 | | |
| NT2RP2001268 | 6.19 | 6.19 | 18.1 | 17.61 | 16.26 | 18.55 | | |
| NT2RP2001270 | 4.78 | 4.78 | 9.11 | 5.68 | 8.7 | 10.04 | | |
| NT2RP2001276 | 4.92 | 4.92 | 13.29 | 12.73 | 10.92 | 12.73 | | |
| NT2RP2001277 | 3.11 | 3.11 | 7.02 | 4.91 | 6.22 | 10.82 | | |
| NT2RP2001290 | 2.71 | 2.71 | 6.46 | 4.42 | 5.61 | 6.01 | | |
| NT2RP2001295 | 5.46 | 5.46 | 9.44 | 5.13 | 5.98 | 7.92 | | |
| NT2RP2001297 | 118.17 | 118.17 | 120.73 | 139.11 | 97.16 | 145.76 | | |
| NT2RP2001301 | 9.12 | 9.12 | 18.56 | 15.89 | 19.62 | 14.24 | | |
| NT2RP2001312 | 2.7 | 2.7 | 5.68 | 5.6 | 4.59 | 6.04 | | |
| NT2RP2001327 | 4.73 | 4.73 | 5.69 | 6.39 | 8.53 | 11.86 | | |
| NT2RP2001328 | 8.44 | 8.44 | 20.87 | 16.32 | 23.25 | 23.16 | | |
| NT2RP2001341 | 4.59 | 4.59 | 9.22 | 3.06 | 7.65 | 7.21 | | |
| NT2RP2001347 | 3.09 | 3.09 | 8.54 | 5.54 | 9.55 | 6.9 | | |
| NT2RP2001366 | 10.33 | 10.33 | 48.06 | 54.83 | 51.5 | 52.33 | | |
| NT2RP2001378 | 2.33 | 2.33 | 3.77 | 3.74 | 4.64 | 5.02 | | |
| NT2RP2001381 | 2.82 | 2.82 | 6.86 | 5.79 | 6.62 | 8.37 | | |
| NT2RP2001388 | 3.25 | 3.25 | 6.71 | 4.54 | 5.11 | 5.2 | | |
| NT2RP2001391 | 443.52 | 443.52 | 734.13 | 742.83 | 990.71 | 747.95 | | |
| NT2RP2001392 | 2.98 | 2.98 | 6.43 | 4.58 | 3.16 | 4.18 | | |
| NT2RP2001394 | 3.3 | 3.3 | 8.55 | 8.35 | 6.09 | 10.15 | | |
| NT2RP2001397 | 5.04 | 5.04 | 6.79 | 7.33 | 5.68 | 12.2 | | |
| NT2RP2001400 | 3.1 | 3.1 | 6.4 | 3.43 | 6.25 | 2.92 | | |
| NT2RP2001408 | 3.31 | 3.31 | 6.13 | 4.02 | 5.97 | 5.62 | | |
| NT2RP2001420 | 5.63 | 5.63 | 12.09 | 8.09 | 9.97 | 9.17 | | |
| NT2RP2001423 | 4.71 | 4.71 | 9.71 | 6.21 | 8.29 | 7.19 | | |
| NT2RP2001427 | 2.68 | 2.68 | 5.32 | 3.69 | 4.61 | 5.49 | | |
| NT2RP2001428 | 2.71 | 2.71 | 7.13 | 5.49 | 3.78 | 3.03 | | |
| NT2RP2001436 | 4.27 | 4.27 | 8.85 | 5.84 | 2.85 | 4.84 | | |
| NT2RP2001440 | 2.89 | 2.89 | 7.34 | 10.24 | 10.15 | 11.98 | * | + |
| NT2RP2001445 | 2.43 | 2.43 | 6.75 | 5.86 | 5.55 | 5.89 | | |
| NT2RP2001449 | 4.37 | 4.37 | 6.41 | 5 | 4.74 | 5.02 | | |
| NT2RP2001450 | 3.19 | 3.19 | 6.75 | 2.26 | 5.4 | 8.59 | | |
| NT2RP2001467 | 4.53 | 4.53 | 10.28 | 5.32 | 4.72 | 6.5 | | |
| NT2RP2001469 | 4.74 | 4.74 | 6.79 | 8.22 | 11.04 | 7.18 | | |
| NT2RP2001480 | 6.54 | 6.54 | 26.68 | 14.98 | 12.63 | 15.42 | | |
| NT2RP2001495 | 5.86 | 5.86 | 11.96 | 8.16 | 9.04 | 10.39 | | |
| NT2RP2001499 | 8.25 | 8.2.51 | 6.78 | 10.05 | 14.46 | 9.66 | | |
| NT2RP2001506 | 2.79 | 2.79 | 7.24 | 5.32 | 8.19 | 5.33 | | |
| NT2RP2001508 | 10.59 | 10.59 | 13.66 | 18.74 | 20.49 | 21.92 | ** | + |
| NT2RP2001511 | 6.41 | 6.41 | 9.74 | 6.08 | 8.63 | 6.53 | | |
| NT2RP2001514 | 7.04 | 7.04 | 7.02 | 7.24 | 6.44 | 6.38 | | |
| NT2RP2001520 | 2.93 | 2.93 | 4.84 | 2.6 | 3.19 | 2.87 | | |
| NT2RP2001526 | 3.88 | 3.88 | 8.49 | 7.01 | 5.27 | 3.83 | | |
| NT2RP2001529 | 9.87 | 9.87 | 53.78 | 44.74 | 55.72 | 60.88 | | |
| NT2RP2001536 | 1.63 | 1.63 | 4.17 | 3.81 | 4.52 | 4.71 | | |
| NT2RP2001538 | 83.44 | 83.44 | 178.68 | 132.75 | 146.73 | 155.87 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2001547 | 4.96 | 4.96 | 14.87 | 16.77 | 19.21 | 17.77 | * | + |
| NT2RP2001560 | 6.28 | 6.28 | 21.64 | 25.41 | 28.19 | 27.75 | * | + |
| NT2RP2001562 | 5.56 | 5.56 | 5.57 | 5.94 | 6.75 | 4.64 | | |
| NT2RP2001566 | 7.96 | 7.96 | 9.24 | 8.22 | 7.91 | 8.56 | | |
| NT2RP2001569 | 4.26 | 4.26 | 8.71 | 6.09 | 5.65 | 8.28 | | |
| NT2RP2001576 | 3.95 | 3.95 | 11.58 | 13.42 | 9 | 12.82 | | |
| NT2RP2001581 | 47.15 | 47.15 | 130.15 | 121.19 | 112.28 | 129.54 | | |
| NT2RP2001597 | 3.73 | 3.73 | 7.88 | 8.57 | 8.3 | 13.3 | | |
| NT2RP2001601 | 2.37 | 2.37 | 4.81 | 3.67 | 4.81 | 3.34 | | |
| NT2RP2001613 | 2.74 | 2.74 | 4.87 | 2.83 | 2.72 | 4.15 | | |
| NT2RP2001628 | 3.42 | 3.42 | 3.97 | 3.14 | 3.04 | 7.84 | | |
| NT2RP2001634 | 8.64 | 8.64 | 13.94 | 16.57 | 23.67 | 17.67 | * | + |
| NT2RP2001635 | 2.51 | 2.51 | 5.92 | 5.63 | 5.53 | 4.72 | | |
| NT2RP2001660 | 4.27 | 4.27 | 16.91 | 5.9 | 5.54 | 10.06 | | |
| NT2RP2001662 | 1.49 | 1.49 | 4.07 | 4.5 | 4.44 | 3.47 | | |
| NT2RP2001663 | 2.82 | 2.82 | 5.09 | 10.37 | 8.21 | 9.74 | ** | + |
| NT2RP2001672 | 3.28 | 3.28 | 3.82 | 3.88 | 4.09 | 4 | * | + |
| NT2RP2001675 | 4.1 | 4.1 | 5.01 | 5.23 | 4.73 | 5.06 | | |
| NT2RP2001677 | 9.58 | 9.58 | 18.2 | 20.9 | 26.67 | 19.74 | * | + |
| NT2RP2001678 | 4.84 | 4.84 | 6.73 | 4.6 | 4.83 | 4.5 | | |
| NT2RP2001683 | 1.89 | 1.89 | 3.12 | 4.6 | 4.72 | 2.78 | | |
| NT2RP2001699 | 3.15 | 3.15 | 6.16 | 6.5 | 5.84 | 4.88 | | |
| NT2RP2001707 | 1.24 | 1.24 | 3.19 | 3.42 | 4.13 | 4.8 | * | + |
| NT2RP2001720 | 1.47 | 1.47 | 3.6 | 3.91 | 3 | 2.72 | | |
| NT2RP2001721 | 2.26 | 2.26 | 4.57 | 5.53 | 3.96 | 3.66 | | |
| NT2RP2001740 | 12 | 12 | 60.21 | 52.38 | 79.71 | 54.73 | | |
| NT2RP2001748 | 6.43 | 6.43 | 10.8 | 8.75 | 10.25 | 8.55 | | |
| NT2RP2001755 | 5.51 | 5.51 | 4.96 | 3.71 | 4.62 | 2.69 | * | − |
| NT2RP2001762 | 1.25 | 1.25 | 2.01 | 3.87 | 2.56 | 3.52 | * | + |
| NT2RP2001768 | 1.91 | 1.91 | 4.7 | 6.7 | 5.55 | 4.55 | | |
| NT2RP2001769 | 3.06 | 3.06 | 5.86 | 10.42 | 5.06 | 11.86 | | |
| NT2RP2001784 | 3.62 | 3.62 | 6.23 | 7.06 | 6.02 | 6.91 | | |
| NT2RP2001805 | 2.33 | 2.33 | 5.61 | 6.02 | 4.93 | 6.6 | | |
| NT2RP2001813 | 2.75 | 2.75 | 3.73 | 1.84 | 1.98 | 1.94 | * | − |
| NT2RP2001817 | 3.16 | 3.16 | 4.49 | 4.03 | 5.32 | 3.45 | | |
| NT2RP2001818 | 2.72 | 2.72 | 2.45 | 2.35 | 3.62 | 2.66 | | |
| NT2RP2001837 | 5.13 | 5.13 | 13.43 | 10.29 | 10.16 | 12.33 | | |
| NT2RP2001839 | 17.02 | 17.02 | 83.84 | 60.14 | 71.06 | 82.26 | | |
| NT2RP2001861 | 2 | 2 | 6.37 | 3.16 | 3.52 | 3.87 | | |
| NT2RP2001869 | 2.64 | 2.64 | 6.54 | 4.35 | 5.77 | 8.84 | | |
| NT2RP2001876 | 12.15 | 12.15 | 27.71 | 24.54 | 24.93 | 23.67 | | |
| NT2RP2001878 | 2.32 | 2.32 | 3.96 | 2.95 | 3.32 | 4.95 | | |
| NT2RP2001881 | 3.72 | 3.72 | 5.4 | 9.67 | 12.64 | 12.16 | ** | + |
| NT2RP2001883 | 2.63 | 2.63 | 6.8 | 4.33 | 5.42 | 6.35 | | |
| NT2RP2001884 | 13.59 | 13.59 | 23.56 | 15.33 | 10.54 | 23.6 | | |
| NT2RP2001885 | 3.27 | 3.27 | 5.49 | 2.88 | 4.39 | 4.82 | | |
| NT2RP2001898 | 10.76 | 10.76 | 80.37 | 69.48 | 88.43 | 73.46 | | |
| NT2RP2001900 | 3.38 | 3.38 | 4.03 | 2.61 | 4.93 | 10.26 | | |
| NT2RP2001903 | 3.73 | 3.73 | 7.71 | 5.57 | 5.7 | 8.2 | | |
| NT2RP2001907 | 3.1 | 3.1 | 8.56 | 5.05 | 7.56 | 6.72 | | |
| NT2RP2001915 | 2.89 | 2.89 | 5.06 | 4.06 | 3.08 | 7.19 | | |
| NT2RP2001921 | 4.04 | 4.04 | 10.31 | 3.02 | 12.45 | 19.33 | * | + |
| NT2RP2001926 | 2.75 | 2.75 | 8.25 | 3.55 | 5.3 | 5.64 | | |
| NT2RP2001933 | 5.65 | 5.65 | 52.55 | 43.62 | 43.55 | 48.58 | | |
| NT2RP2001936 | 1.54 | 1.54 | 5.03 | 2.8 | 2.96 | 3.8 | | |
| NT2RP2001943 | 25.33 | 25.33 | 49.4 | 47.71 | 40.48 | 51.65 | | |
| NT2RP2001946 | 3.05 | 3.05 | 4.3 | 3.41 | 4.51 | 6.1 | | |
| NT2RP2001947 | 3.18 | 3.18 | 3.44 | 3.93 | 3.21 | 6.88 | | |
| NT2RP2001948 | 3.59 | 3.59 | 10.79 | 5.71 | 7.29 | 19.72 | | |
| NT2RP2001956 | 5.24 | 5.24 | 12.73 | 11.54 | 9.42 | 9.89 | | |
| NT2RP2001969 | 4.05 | 4.05 | 7.82 | 3.24 | 5.7 | 6 | | |
| NT2RP2001976 | 2.9 | 2.9 | 6.39 | 5.68 | 6.95 | 6.41 | | |
| NT2RP2001978 | 3.26 | 3.26 | 6.08 | 4.18 | 4.83 | 6.03 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and -, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2001985 | 2.14 | 2.14 | 3.8 | 2.56 | 4.63 | 2.51 | | |
| NT2RP2001991 | 3.34 | 3.34 | 5.7 | 1.53 | 4.62 | 5.19 | | |
| NT2RP2001997 | 3.16 | 3.16 | 8.43 | 5.31 | 7.47 | 6.98 | | |
| NT2RP2002015 | 136.21 | 136.21 | 265.98 | 266.8 | 340.89 | 272.43 | | |
| NT2RP2002017 | 3.24 | 3.24 | 6.06 | 2.06 | 3.3 | 2.57 | | |
| NT2RP2002025 | 6.08 | 6.08 | 51.73 | 31.83 | 26.94 | 37.84 | | |
| NT2RP2002030 | 6.06 | 6.06 | 11.95 | 9.77 | 8.07 | 8.76 | | |
| NT2RP2002032 | 2.31 | 2.31 | 4.95 | 2.39 | 3.81 | 2.55 | | |
| NT2RP2002033 | 3 | 3 | 6.71 | 3.53 | 7.57 | 8.05 | | |
| NT2RP2002041 | 3.5 | 3.5 | 6.37 | 2.76 | 3.15 | 9 | | |
| NT2RP2002046 | 3 | 3 | 6.88 | 2.99 | 7.4 | 6.01 | | |
| NT2RP2002047 | 2.71 | 2.71 | 3.86 | 2.06 | 3.87 | 3.83 | | |
| NT2RP2002050 | 7.67 | 7.67 | 11.66 | 9.78 | 6.47 | 7.77 | | |
| NT2RP2002052 | 3.77 | 3.77 | 8.39 | 6.6 | 3.99 | 6.28 | | |
| NT2RP2002058 | 2.07 | 2.07 | 4.11 | 3.1 | 4.82 | 3.39 | | |
| NT2RP2002060 | 1.48 | 1.48 | 3.44 | 2.1 | 5.9 | 3.18 | | |
| NT2RP2002063 | 3.61 | 3.61 | 5.83 | 3.3 | 5.2 | 6.65 | | |
| NT2RP2002066 | 10.11 | 10.11 | 13.47 | 5.47 | 9.88 | 9.73 | | |
| NT2RP2002070 | 3.74 | 3.74 | 6.3 | 2.15 | 3.1 | 3.83 | | |
| NT2RP2002076 | 3.72 | 3.72 | 5.1 | 3.35 | 5.58 | 3.63 | | |
| NT2RP2002078 | 13.09 | 13.09 | 105.74 | 73.87 | 88.51 | 76.08 | | |
| NT2RP2002079 | 5.76 | 5.76 | 36.34 | 31.87 | 32.66 | 36.54 | | |
| NT2RP2002099 | 4.19 | 4.19 | 5.82 | 4.7 | 6.75 | 6.03 | | |
| NT2RP2002105 | 2.66 | 2.66 | 12.25 | 11.41 | 14.04 | 11.23 | | |
| NT2RP2002115 | 1.63 | 1.63 | 5.21 | 1.98 | 3.42 | 1.52 | | |
| NT2RP2002124 | 3.66 | 3.66 | 6 | 4.56 | 5.38 | 3.88 | | |
| NT2RP2002137 | 3.99 | 3.99 | 4.83 | 2.21 | 2.1 | 1.76 | ** | − |
| NT2RP2002139 | 24.08 | 24.08 | 45.74 | 51.88 | 77.99 | 62.3 | * | + |
| NT2RP2002154 | 1.37 | 1.37 | 4.13 | 3.56 | 2.36 | 3.2 | | |
| NT2RP2002155 | 351.63 | 351.63 | 869.83 | 623.53 | 501.61 | 620.68 | | |
| NT2RP2002172 | 1.5 | 1.5 | 3.33 | 2.78 | 3.53 | 5.13 | | |
| NT2RP2002185 | 3.29 | 3.29 | 7.65 | 7.3 | 8.56 | 8.12 | | |
| NT2RP2002188 | 1.74 | 1.74 | 5.95 | 4.15 | 4.31 | 4.95 | | |
| NT2RP2002192 | 2.9 | 2.9 | 7.6 | 6.65 | 6.42 | 5.83 | | |
| NT2RP2002193 | 5.21 | 5.21 | 5.22 | 4.76 | 4.95 | 5.75 | | |
| NT2RP2002208 | 5.96 | 5.96 | 7.31 | 4.7 | 5.67 | 5.14 | | |
| NT2RP2002219 | 2.2 | 2.2 | 1.8 | 2.22 | 3.2 | 2.26 | | |
| NT2RP2002231 | 1.72 | 1.72 | 3.1 | 4.11 | 2.76 | 5.76 | | |
| NT2RP2002232 | 2.59 | 2.59 | 5.17 | 3.93 | 4.7 | 6.08 | | |
| NT2RP2002235 | 5.62 | 5.62 | 15.07 | 16.26 | 16.18 | 15.18 | | |
| NT2RP2002239 | 37.02 | 37.02 | 67.99 | 72.09 | 67.21 | 63.77 | | |
| NT2RP2002252 | 2.64 | 2.64 | 3.66 | 2.63 | 2.76 | 2.94 | | |
| NT2RP2002256 | 4.62 | 4.62 | 15.3 | 11.37 | 16.99 | 12.91 | | |
| NT2RP2002257 | 7.01 | 7.01 | 22.77 | 18.65 | 25.09 | 20.6 | | |
| NT2RP2002259 | 1.58 | 1.58 | 13.91 | 9.9 | 12.15 | 10.49 | | |
| NT2RP2002264 | 0.6 | 0.6 | 3.14 | 3.2 | 3.12 | 3.92 | | |
| NT2RP2002267 | 3.66 | 3.66 | 8.75 | 8.95 | 8.3 | 11.16 | | |
| NT2RP2002270 | 4.26 | 4.26 | 8.23 | 16.09 | 10.47 | 14.71 | * | + |
| NT2RP2002281 | 2.85 | 2.85 | 5.66 | 8.18 | 6.48 | 6.54 | * | + |
| NT2RP2002288 | 4.32 | 4.32 | 6.6 | 5.33 | 5.56 | 4.23 | | |
| NT2RP2002292 | 5.42 | 5.42 | 8.4 | 6.64 | 8.08 | 6.95 | | |
| NT2RP2002299 | 9.6 | 9.6 | 9.22 | 11.75 | 19.42 | 15.97 | * | + |
| NT2RP2002304 | 1.37 | 1.37 | 4.78 | 6.99 | 5.08 | 5.52 | | |
| NT2RP2002312 | 1.21 | 1.21 | 2.33 | 3.78 | 5.3 | 3.28 | * | + |
| NT2RP2002316 | 3.28 | 3.28 | 5.43 | 7.57 | 7.21 | 8.2 | ** | + |
| NT2RP2002325 | 1.95 | 1.95 | 3.46 | 2.79 | 2.22 | 4.95 | | |
| NT2RP2002333 | 2.13 | 2.13 | 3.03 | 3.53 | 4.86 | 5.69 | * | + |
| NT2RP2002371 | 5.43 | 5.43 | 9.14 | 9.72 | 12.07 | 11.65 | * | + |
| NT2RP2002373 | 10.65 | 10.65 | 40.1 | 36.72 | 58.84 | 33.58 | | |
| NT2RP2002381 | 4.68 | 4.68 | 2.35 | 2.66 | 3.19 | 3.71 | | |
| NT2RP2002385 | 5.71 | 5.71 | 11.84 | 9.95 | 11.34 | 9.47 | | |
| NT2RP2002394 | 0.94 | 0.94 | 1.52 | 1.24 | 0.96 | 1.26 | | |
| NT2RP2002408 | 2.7 | 2.7 | 5.08 | 3.89 | 3.12 | 4.29 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2002409 | 3.73 | 3.73 | 10.81 | 10.78 | 7.95 | 8.35 | | |
| NT2RP2002424 | 2.98 | 2.98 | 4.22 | 5.84 | 6.22 | 7.85 | * | + |
| NT2RP2002426 | 6.44 | 6.44 | 11.38 | 7.59 | 8.46 | 8.93 | | |
| NT2RP2002429 | 17.2 | 17.2 | 24.73 | 27.87 | 33.96 | 20.83 | | |
| NT2RP2002437 | 4.61 | 4.61 | 5.98 | 4.83 | 6.47 | 4.79 | | |
| NT2RP2002439 | 3.83 | 3.83 | 6.69 | 2.68 | 3.22 | 4 | | |
| NT2RP2002442 | 13.6.31 | 3.63 | 71.65 | 57.78 | 63.05 | 78.84 | | |
| NT2RP2002457 | 3.27 | 3.27 | 5.31 | 4.35 | 4.87 | 5.82 | | |
| NT2RP2002464 | 2.17 | 2.17 | 5.34 | 3.29 | 4.59 | 4.24 | | |
| NT2RP2002475 | 3.11 | 3.11 | 7.88 | 5.3 | 2.83 | 5.43 | | |
| NT2RP2002479 | 3.09 | 3.09 | 4.25 | 1.95 | 2.99 | 1.93 | | |
| NT2RP2002487 | 1.73 | 1.73 | 5.15 | 1.98 | 2.1 | 3.04 | | |
| NT2RP2002498 | 1.52 | 1.52 | 2.2 | 2.62 | 2.82 | 4.47 | | |
| NT2RP2002503 | 7.63 | 7.63 | 31.85 | 29.32 | 32.02 | 31.84 | | |
| NT2RP2002504 | 3.81 | 3.81 | 5.73 | 6 | 7.23 | 11.28 | | |
| NT2RP2002510 | 2.65 | 2.65 | 8.92 | 4.68 | 6.59 | 6.85 | | |
| NT2RP2002520 | 3.57 | 3.57 | 7.17 | 6.26 | 8.86 | 6.61 | | |
| NT2RP2002527 | 5.18 | 5.18 | 6.02 | 9 | 12.37 | 11.22 | ** | + |
| NT2RP2002533 | 3.34 | 3.34 | 6.27 | 4.83 | 6.94 | 5.88 | | |
| NT2RP2002537 | 3.22 | 3.22 | 4.02 | 4.09 | 5.91 | 10.08 | | |
| NT2RP2002542 | 4.81 | 4.81 | 4.64 | 5.99 | 5.93 | 9.73 | | |
| NT2RP2002546 | 4.31 | 4.31 | 5.85 | 6.5 | 4.91 | 5.24 | | |
| NT2RP2002549 | 4.06 | 4.06 | 9.33 | 7.68 | 10.49 | 11.65 | | |
| NT2RP2002564 | 4.11 | 4.11 | 11.18 | 10.67 | 9.21 | 9.29 | | |
| NT2RP2002591 | 2.45 | 2.45 | 7.03 | 3.31 | 4.79 | 5.79 | | |
| NT2RP2002595 | 9.67 | 9.67 | 12.41 | 12.06 | 13.39 | 14.79 | | |
| NT2RP2002602 | 4.19 | 4.19 | 7.53 | 5.68 | 8.96 | 10.42 | | |
| NT2RP2002606 | 1.27 | 1.27 | 2.93 | 2.26 | 2.97 | 3.95 | | |
| NT2RP2002609 | 6.12 | 6.12 | 9.95 | 4.79 | 5.48 | 7.74 | | |
| NT2RP2002618 | 2.74 | 2.74 | 6.83 | 4.2 | 6.34 | 5.44 | | |
| NT2RP2002621 | 4.24 | 4.24 | 10.22 | 6.58 | 7.52 | 9.79 | | |
| NT2RP2002643 | 1.79 | 1.79 | 4.84 | 3.11 | 5.98 | 3.94 | | |
| NT2RP2002672 | 4.48 | 4.48 | 9.23 | 8.03 | 9.37 | 9.87 | | |
| NT2RP2002673 | 4.13 | 4.13 | 5.01 | 8 | 12.88 | 17.73 | * | + |
| NT2RP2002674 | 2.4 | 2.4 | 4.06 | 2.78 | 2.37 | 1.84 | | |
| NT2RP2002686 | 2.73 | 2.73 | 4.61 | 3.17 | 5.19 | 6.49 | | |
| NT2RP2002688 | 10.73 | 10.73 | 28.07 | 22.34 | 33.34 | 28.71 | | |
| NT2RP2002695 | 2.62 | 2.62 | 7.03 | 5.26 | 4.34 | 5.52 | | |
| NT2RP2002701 | 7.29 | 7.29 | 13.37 | 11.85 | 5.18 | 10.04 | | |
| NT2RP2002706 | 3.02 | 3.02 | 5.58 | 6.47 | 8.14 | 6.19 | * | + |
| NT2RP2002710 | 11.2 | 11.2 | 36.97 | 39.43 | 33.9 | 42.75 | | |
| NT2RP2002721 | 5.53 | 5.53 | 9.42 | 7.33 | 7.34 | 8.45 | | |
| NT2RP2002727 | 3.56 | 3.56 | 6.87 | 2.17 | 3.96 | 3.52 | | |
| NT2RP2002734 | 3.59 | 3.59 | 6.65 | 5.71 | 7.65 | 7.54 | | |
| NT2RP2002736 | 5.25 | 5.25 | 13.13 | 13.17 | 13.59 | 17.58 | | |
| NT2RP2002740 | 2 | 2 | 5.11 | 3.18 | 2.81 | 3.13 | | |
| NT2RP2002741 | 2.12 | 2.12 | 4.8 | 4.68 | 5.39 | 5.78 | | |
| NT2RP2002750 | 2.5 | 2.5 | 9.22 | 7.73 | 9.57 | 8.18 | | |
| NT2RP2002752 | 4.59 | 4.59 | 10.39 | 7.93 | 7.66 | 8.03 | | |
| NT2RP2002753 | 4.49 | 4.49 | 9.91 | 8.66 | 9.04 | 14.67 | | |
| NT2RP2002760 | 4.79 | 4.79 | 10.31 | 3.56 | 4.5 | 4.13 | | |
| NT2RP2002769 | 4.42 | 4.42 | 6.06 | 3.89 | 5.67 | 6.43 | | |
| NT2RP2002778 | 4.13 | 4.13 | 10.59 | 6.8 | 8.2 | 9.12 | | |
| NT2RP2002791 | 8.89 | 8.89 | 54.27 | 48.75 | 53.08 | 50.19 | | |
| NT2RP2002800 | 1.66 | 1.66 | 4.52 | 4 | 5.19 | 5.38 | | |
| NT2RP2002805 | 3.38 | 3.38 | 5.46 | 4.75 | 6.44 | 3.81 | | |
| NT2RP2002811 | 3.27 | 3.27 | 8.23 | 5.87 | 8.13 | 10.61 | | |
| NT2RP2002824 | 18.29 | 18.29 | 25.05 | 29.95 | 34.29 | 25.05 | | |
| NT2RP2002839 | 13.26 | 13.26 | 31.21 | 16.09 | 23.42 | 16.27 | | |
| NT2RP2002845 | 5.87 | 5.87 | 7.93 | 4.61 | 6.12 | 5.5 | | |
| NT2RP2002857 | 2.95 | 2.95 | 3.6 | 2.35 | 4.23 | 2.99 | | |
| NT2RP2002862 | 4.56 | 4.56 | 12.49 | 12.55 | 9.84 | 11.34 | | |
| NT2RP2002880 | 5.27 | 5.27 | 13.89 | 13.5 | 11.56 | 11.1 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2002885 | 8.6 | 8.6 | 17.12 | 7.56 | 10.07 | 10.02 | | |
| NT2RP2002891 | 1.9 | 1.9 | 7.78 | 4.65 | 6.63 | 7.56 | | |
| NT2RP2002907 | 2.95 | 2.95 | 6.91 | 5.95 | 5.5 | 4.9 | | |
| NT2RP2002925 | 5.67 | 5.67 | 6.73 | 10.04 | 11.6 | 8.45 | * | + |
| NT2RP2002927 | 10.08 | 10.08 | 10.63 | 19.05 | 21.85 | 15.48 | ** | + |
| NT2RP2002928 | 4.32 | 4.32 | 4.56 | 2.65 | 2.34 | 2.51 | ** | − |
| NT2RP2002929 | 3.96 | 3.96 | 9.74 | 8.09 | 7.86 | 9.87 | | |
| NT2RP2002934 | 1.5 | 1.5 | 1.4 | 2.81 | 3.01 | 2.49 | ** | + |
| NT2RP2002939 | 2.96 | 2.96 | 5.09 | 5.15 | 6.71 | 4.91 | | |
| NT2RP2002942 | 2.4 | 2.4 | 5.06 | 4.35 | 5.07 | 10.81 | | |
| NT2RP2002954 | 5.41 | 5.41 | 11.46 | 7.21 | 9.1 | 8.65 | | |
| NT2RP2002959 | 8.15 | 8.15 | 12.55 | 13.81 | 16.28 | 16.69 | * | + |
| NT2RP2002974 | 5.03 | 5.03 | 6.53 | 4.7 | 3.45 | 4.54 | | |
| NT2RP2002976 | 6.92 | 6.92 | 17.08 | 11.84 | 14.66 | 12.42 | | |
| NT2RP2002979 | 4.41 | 4.41 | 8.12 | 7.03 | 8.66 | 7.6 | | |
| NT2RP2002980 | 6.44 | 6.44 | 15.09 | 15.56 | 11 | 17.45 | | |
| NT2RP2002986 | 3.87 | 3.87 | 7.6 | 6.68 | 7.4 | 7.39 | | |
| NT2RP2002987 | 3.52 | 3.52 | 8.23 | 11.1 | 9.18 | 9.4 | * | + |
| NT2RP2002988 | 14.96 | 14.96 | 22.92 | 30.07 | 31.87 | 31.36 | ** | + |
| NT2RP2002993 | 2.97 | 2.97 | 4.18 | 3.8 | 3.84 | 2.84 | | |
| NT2RP2003000 | 4.88 | 4.88 | 8.34 | 6.97 | 9.62 | 9.97 | | |
| NT2RP2003008 | 4.85 | 4.85 | 5.06 | 3.34 | 4.76 | 4.78 | | |
| NT2RP2003020 | 4.45 | 4.45 | 44.26 | 28.35 | 46.52 | 34.33 | | |
| NT2RP2003032 | 1.91 | 1.91 | 4.02 | 5.82 | 6.48 | 6.59 | ** | + |
| NT2RP2003034 | 4.21 | 4.21 | 13.47 | 13.16 | 11.15 | 16.31 | | |
| NT2RP2003042 | 2.15 | 2.15 | 3.81 | 4.57 | 3.65 | 4.92 | | |
| NT2RP2003050 | 2.32 | 2.32 | 3.56 | 2.55 | 2.17 | 1.83 | | |
| NT2RP2003060 | 7.27 | 7.27 | 15.51 | 21.53 | 18.91 | 17.46 | * | + |
| NT2RP2003073 | 5.61 | 5.61 | 8.73 | 7.06 | 10.51 | 8.17 | | |
| NT2RP2003099 | 5.05 | 5.05 | 3.67 | 3.21 | 3.73 | 2.84 | | |
| NT2RP2003108 | 3.6 | 3.6 | 4.23 | 5.29 | 3.91 | 6.62 | | |
| NT2RP2003115 | 1.68 | 1.68 | 5 | 7.75 | 4.69 | 4.84 | | |
| NT2RP2003117 | 2.71 | 2.71 | 5.69 | 3.6 | 4.66 | 4.13 | | |
| NT2RP2003121 | 1.83 | 1.83 | 3.47 | 4.03 | 2.69 | 3.33 | | |
| NT2RP2003125 | 4.13 | 4.13 | 11.44 | 15.42 | 12.55 | 13.66 | * | + |
| NT2RP2003127 | 2.36 | 2.36 | 3.94 | 1.53 | 1.66 | 1.75 | | |
| NT2RP2003129 | 3.43 | 3.43 | 7.09 | 6.08 | 6.05 | 5.42 | | |
| NT2RP2003137 | 4.49 | 4.49 | 6.14 | 7.58 | 8.4 | 6.46 | * | + |
| NT2RP2003138 | 4.66 | 4.66 | 20.24 | 16.55 | 17.45 | 16.92 | | |
| NT2RP2003146 | 6.2 | 6.2 | 24.78 | 18.5 | 23.25 | 25.96 | | |
| NT2RP2003148 | 3.09 | 3.09 | 6.73 | 3.06 | 4.6 | 4.04 | | |
| NT2RP2003150 | 1.45 | 1.45 | 5.71 | 3.98 | 5.2 | 4.3 | | |
| NT2RP2003157 | 6.93 | 6.93 | 34.27 | 34.29 | 31.85 | 32.84 | | |
| NT2RP2003158 | 6.3 | 6.3 | 25.32 | 26.87 | 28.69 | 59.31 | | |
| NT2RP2003161 | 2.73 | 2.73 | 3.36 | 2.51 | 2.82 | 6.12 | | |
| NT2RP2003164 | 1.96 | 1.96 | 2.1 | 1.28 | 1.87 | 2.46 | | |
| NT2RP2003165 | 2.18 | 2.18 | 5.94 | 3.1 | 3.69 | 4.84 | | |
| NT2RP2003177 | 1.63 | 1.63 | 4.37 | 2.79 | 3.03 | 4.42 | | |
| NT2RP2003179 | 1.23 | 1.23 | 4.98 | 4.08 | 3.63 | 7.96 | | |
| NT2RP2003194 | 4.04 | 4.04 | 7.2 | 5.73 | 6.29 | 14.77 | | |
| NT2RP2003206 | 1.59 | 1.59 | 4.47 | 1.64 | 3.52 | 1.44 | | |
| NT2RP2003210 | 5.06 | 5.06 | 15.15 | 16.14 | 12.93 | 15.9 | | |
| NT2RP2003227 | 1.62 | 1.62 | 3.97 | 2.04 | 3.66 | 6.28 | | |
| NT2RP2003228 | 6.57 | 6.57 | 29.53 | 29.56 | 43.94 | 44.24 | | |
| NT2RP2003230 | 3.51 | 3.51 | 7.91 | 4.49 | 8.04 | 8.46 | | |
| NT2RP2003231 | 2.22 | 2.22 | 5.59 | 2.46 | 3.23 | 3.83 | | |
| NT2RP2003237 | 2.52 | 2.52 | 4.59 | 4.59 | 6.4 | 6.46 | * | + |
| NT2RP2003239 | 2.3 | 2.3 | 4.46 | 2.97 | 4.46 | 4.05 | | |
| NT2RP2003243 | 2.16 | 2.16 | 4.13 | 2.38 | 3.28 | 3.98 | | |
| NT2RP2003265 | 3.93 | 3.93 | 5.33 | 4.22 | 4.88 | 4.92 | | |
| NT2RP2003267 | 2.73 | 2.73 | 3.15 | 3.24 | 4.17 | 7.42 | | |
| NT2RP2003272 | 6.03 | 6.03 | 14.8 | 16.93 | 23.85 | 32.58 | * | + |
| NT2RP2003277 | 3.85 | 3.85 | 11.29 | 5.53 | 8.39 | 6.39 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2003280 | 3.47 | 3.47 | 9.38 | 7.67 | 7.25 | 6.09 | | |
| NT2RP2003286 | 2.18 | 2.18 | 4.23 | 4.13 | 5 | 9.61 | | |
| NT2RP2003293 | 2.98 | 2.98 | 6.9 | 5.66 | 7.05 | 7.94 | | |
| NT2RP2003295 | 4.67 | 4.67 | 8.45 | 8.73 | 12.39 | 6.35 | | |
| NT2RP2003297 | 3.43 | 3.43 | 7.57 | 4.32 | 6.89 | 5.28 | | |
| NT2RP2003300 | 20.38 | 20.38 | 32.04 | 45.7 | 53.51 | 48.07 | ** | + |
| NT2RP2003302 | 2.88 | 2.88 | 4.52 | 3.46 | 3.81 | 7.26 | | |
| NT2RP2003307 | 0.57 | 0.57 | 2.62 | 1.43 | 1.49 | 1.38 | | |
| NT2RP2003308 | 1.44 | 1.44 | 4.5 | 2.77 | 4.44 | 5.44 | | |
| NT2RP2003311 | 4.18 | 4.18 | 5.83 | 7.35 | 4.25 | 8.2 | | |
| NT2RP2003329 | 2.99 | 2.99 | 4.41 | 2.63 | 3.89 | 4.44 | | |
| NT2RP2003339 | 3.06 | 3.06 | 7.01 | 3.76 | 4.92 | 3.64 | | |
| NT2RP2003345 | 4.15 | 4.15 | 8.38 | 2.77 | 3.97 | 6.33 | | |
| NT2RP2003347 | 2.55 | 2.55 | 4.23 | 2.08 | 1.98 | 3.46 | | |
| NT2RP2003367 | 2.15 | 2.15 | 4.65 | 2.7 | 1.98 | 1.44 | | |
| NT2RP2003369 | 1.34 | 1.34 | 4.71 | 2.16 | 2.36 | 0.89 | | |
| NT2RP2003383 | 4.05 | 4.05 | 6.75 | 7.66 | 7.17 | 6.99 | | |
| NT2RP2003390 | 9.1 | 9.1 | 17.93 | 16.66 | 14.27 | 12.94 | | |
| NT2RP2003391 | 9.39 | 9.39 | 12.9 | 11.96 | 9.91 | 12.84 | | |
| NT2RP2003393 | 4.23 | 4.23 | 6.99 | 6.14 | 5.03 | 9.44 | | |
| NT2RP2003394 | 8.67 | 8.67 | 16.21 | 17.56 | 21.75 | 17.23 | | |
| NT2RP2003401 | 4.39 | 4.39 | 5.97 | 3.52 | 3.72 | 2.9 | | |
| NT2RP2003403 | 3.42 | 3.42 | 7.64 | 6.62 | 8.55 | 7.79 | | |
| NT2RP2003433 | 3.02 | 3.02 | 15.54 | 13.62 | 13.5 | 13.08 | | |
| NT2RP2003445 | 3.2 | 3.2 | 4.74 | 4.08 | 3.5 | 3.93 | | |
| NT2RP2003446 | 2.67 | 2.67 | 6.23 | 5.06 | 6.05 | 4.47 | | |
| NT2RP2003456 | 2.04 | 2.04 | 6.57 | 4.26 | 5.89 | 3.81 | | |
| NT2RP2003466 | 3.56 | 3.56 | 20.09 | 17.34 | 25.96 | 23.53 | | |
| NT2RP2003469 | 6.2 | 6.2 | 5.65 | 6.19 | 7.53 | 6.33 | | |
| NT2RP2003470 | 5.64 | 5.64 | 6.47 | 5.06 | 6.11 | 6.44 | | |
| NT2RP2003471 | 2.72 | 2.72 | 3.88 | 3.22 | 2.78 | 3.38 | | |
| NT2RP2003480 | 7.15 | 7.15 | 20.74 | 19.77 | 19.89 | 21.14 | | |
| NT2RP2003495 | 3.99 | 3.99 | 6.03 | 8.07 | 7.24 | 10.72 | * | + |
| NT2RP2003499 | 1.52 | 1.52 | 4.58 | 3.67 | 4.05 | 2.75 | | |
| NT2RP2003505 | 0.98 | 0.98 | 3.21 | 2.62 | 3.88 | 1.4 | | |
| NT2RP2003506 | 2.54 | 2.54 | 6.53 | 5.65 | 5.36 | 4.78 | | |
| NT2RP2003511 | 3.67 | 3.67 | 5.57 | 4.22 | 3.1 | 2.96 | | |
| NT2RP2003513 | 3.79 | 3.79 | 6.01 | 5.49 | 5.57 | 5.71 | | |
| NT2RP2003517 | 2.9 | 2.9 | 2.52 | 1.32 | 1.11 | 0.85 | ** | − |
| NT2RP2003522 | 11.08 | 11.08 | 19.77 | 10.55 | 11.42 | 16.52 | | |
| NT2RP2003525 | 5.12 | 5.12 | 14.93 | 12.19 | 10.72 | 11.79 | | |
| NT2RP2003533 | 3.36 | 3.36 | 10.44 | 12.12 | 10.72 | 12.94 | | |
| NT2RP2003541 | 6.72 | 6.72 | 11.29 | 12.02 | 13.42 | 11.7 | | |
| NT2RP2003543 | 2.48 | 2.48 | 5.96 | 4.17 | 3.55 | 6.54 | | |
| NT2RP2003545 | 2.59 | 2.59 | 4.85 | 2.22 | 3.6 | 1.85 | | |
| NT2RP2003559 | 4.92 | 4.92 | 4.81 | 3.97 | 3.84 | 3.37 | ** | − |
| NT2RP2003564 | 4.46 | 4.46 | 3.93 | 2.53 | 1.97 | 2.42 | ** | − |
| NT2RP2003565 | 4.94 | 4.94 | 50.48 | 41.12 | 48.32 | 37.82 | | |
| NT2RP2003567 | 3.51 | 3.51 | 16.65 | 16.25 | 19.43 | 16.05 | | |
| NT2RP2003575 | 4.44 | 4.4.41 | 8.78 | 19.56 | 22.63 | 20.7 | | |
| NT2RP2003576 | 102.12 | 102.12 | 203.44 | 206.62 | 128.42 | 171.89 | | |
| NT2RP2003579 | 11.45 | 11.45 | 26.58 | 38.62 | 39.51 | 39.88 | * | + |
| NT2RP2003581 | 3.85 | 3.85 | 6.1 | 4.33 | 4.38 | 3.96 | | |
| NT2RP2003587 | 8.37 | 8.37 | 11.47 | 13.35 | 14.11 | 12.14 | * | + |
| NT2RP2003590 | 7.15 | 7.15 | 9.08 | 11.06 | 13.15 | 14.91 | * | + |
| NT2RP2003593 | 1.58 | 1.58 | 4.57 | 7.84 | 4.43 | 8.59 | | |
| NT2RP2003596 | 4.86 | 4.86 | 10.86 | 14.43 | 13.12 | 17.96 | * | + |
| NT2RP2003599 | 6.49 | 6.49 | 12.46 | 14.29 | 10.17 | 11.98 | | |
| NT2RP2003600 | 1.88 | 1.88 | 2.95 | 3.02 | 3.64 | 6.36 | | |
| NT2RP2003604 | 7.09 | 7.09 | 8.97 | 16.39 | 13.03 | 16.68 | ** | + |
| NT2RP2003629 | 3.72 | 3.72 | 5.25 | 3.11 | 4.56 | 2.38 | | |
| NT2RP2003630 | 4.09 | 4.09 | 6.66 | 4.79 | 6.78 | 3.84 | | |
| NT2RP2003643 | 5.49 | 5.49 | 4.88 | 7.15 | 9.8 | 8.51 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
| --- | --- | --- | --- | --- | --- | --- | --- | --- |
| | exp. 1 | exp. 2 | exp. 3 | exp. 1 | exp. 2 | exp. 3 | | |
| NT2RP2003655 | 4.27 | 4.27 | 11.12 | 7.52 | 6.38 | 7.59 | | |
| NT2RP2003664 | 12.29 | 12.29 | 24.31 | 17.9 | 18.07 | 17.11 | | |
| NT2RP2003668 | 2.52 | 2.52 | 5.01 | 3.3 | 3.18 | 3.62 | | |
| NT2RP2003687 | 1.61 | 1.61 | 2.77 | 1.63 | 2.42 | 1.71 | | |
| NT2RP2003691 | 3.03 | 3.03 | 5.07 | 3.7 | 4.21 | 4.57 | | |
| NT2RP2003702 | 3.99 | 3.99 | 6.14 | 2.89 | 3.02 | 2.89 | | |
| NT2RP2003704 | 3.31 | 3.31 | 4.12 | 2.65 | 3.84 | 1.99 | | |
| NT2RP2003706 | 2.44 | 2.44 | 1.24 | 1.72 | 1.42 | 1.6 | | |
| NT2RP2003713 | 4.11 | 4.11 | 5.49 | 4.16 | 3.89 | 3.87 | | |
| NT2RP2003714 | 3.39 | 3.39 | 7.8 | 5.19 | 5.31 | 5.32 | | |
| NT2RP2003727 | 3.96 | 3.96 | 11.63 | 4.81 | 6.08 | 10.46 | | |
| NT2RP2003737 | 2.52 | 2.52 | 8.58 | 4.88 | 6.47 | 4.6 | | |
| NT2RP2003751 | 1.66 | 1.66 | 4.84 | 1.24 | 1.67 | 1.37 | | |
| NT2RP2003760 | 2.52 | 2.52 | 5.47 | 3.87 | 4.19 | 5.45 | | |
| NT2RP2003764 | 2.1 | 2.1 | 2.81 | 1.44 | 1.87 | 4.62 | | |
| NT2RP2003769 | 5.52 | 5.52 | 11.45 | 7.41 | 8.17 | 10.64 | | |
| NT2RP2003770 | 7.43 | 7.43 | 12.42 | 7.17 | 5.67 | 12.82 | | |
| NT2RP2003777 | 3.44 | 3.44 | 6.78 | 5.01 | 5.6 | 9.57 | | |
| NT2RP2003781 | 4.93 | 4.93 | 15.85 | 13.04 | 11.91 | 13.48 | | |
| NT2RP2003785 | 9.69 | 9.69 | 13.44 | 11.1 | 10.68 | 8.99 | | |
| NT2RP2003793 | 9.32 | 9.32 | 9.5 | 8.29 | 13.22 | 10.51 | | |
| NT2RP2003806 | 5.6 | 5.6 | 12.03 | 8.54 | 8.75 | 12.97 | | |
| NT2RP2003825 | 10.73 | 10.73 | 62.01 | 57.88 | 71.84 | 82.78 | | |
| NT2RP2003840 | 3.19 | 3.19 | 6.07 | 3.86 | 4.44 | 4.71 | | |
| NT2RP2003857 | 4.02 | 4.02 | 4.94 | 3.15 | 4.61 | 6.12 | | |
| NT2RP2003859 | 1.82 | 1.82 | 6 | 3.35 | 4.16 | 4.21 | | |
| NT2RP2003871 | 5.22 | 5.22 | 9.43 | 5.1 | 4.59 | 7.79 | | |
| NT2RP2003876 | 3.82 | 3.82 | 8.8 | 5.92 | 5.87 | 7.92 | | |
| NT2RP2003878 | 3.38 | 3.38 | 6.49 | 3.8 | 4.9 | 4.11 | | |
| NT2RP2003885 | 2.46 | 2.46 | 3.09 | 1.66 | 3.29 | 2.37 | | |
| NT2RP2003898 | 5.39 | 5.39 | 8.91 | 12.3 | 12.73 | 18.25 | * | + |
| NT2RP2003902 | 5.09 | 5.09 | 10.78 | 8.24 | 8.23 | 10.42 | | |
| NT2RP2003912 | 3.83 | 3.83 | 14.48 | 5.91 | 7.43 | 6.74 | | |
| NT2RP2003931 | 1.81 | 1.81 | 6.03 | 3.95 | 6.86 | 4.42 | | |
| NT2RP2003940 | 2.31 | 2.31 | 9.51 | 7.1 | 6.2 | 7.3 | | |
| NT2RP2003950 | 2.81 | 2.81 | 5.48 | 3.84 | 5.57 | 2.98 | | |
| NT2RP2003952 | 1.86 | 1.86 | 5.63 | 2.58 | 4.23 | 2.98 | | |
| NT2RP2003968 | 4.82 | 4.82 | 7.38 | 9.86 | 11.76 | 13.51 | * | + |
| NT2RP2003976 | 5.35 | 5.35 | 9.56 | 12.56 | 12.6 | 13.2 | * | + |
| NT2RP2003981 | 3.27 | 3.27 | 7.41 | 4.62 | 2.03 | 4.07 | | |
| NT2RP2003984 | 5.57 | 5.57 | 15.87 | 10.21 | 4.25 | 10.34 | | |
| NT2RP2003986 | 2.79 | 2.79 | 6.22 | 6.29 | 6.32 | 5.17 | | |
| NT2RP2003988 | 2.36 | 2.36 | 6.84 | 4.51 | 7.42 | 5 | | |
| NT2RP2004013 | 8.46 | 8.46 | 13.75 | 14.68 | 13.19 | 17 | | |
| NT2RP2004014 | 4.24 | 4.24 | 10.07 | 4.06 | 5.12 | 4.08 | | |
| NT2RP2004036 | 6.88 | 6.88 | 14.85 | 14.08 | 19.02 | 16.03 | | |
| NT2RP2004041 | 2.77 | 2.77 | 5.02 | 3.96 | 4.43 | 5.19 | | |
| NT2RP2004042 | 1.99 | 1.99 | 4.6 | 4.41 | 2.02 | 4.09 | | |
| NT2RP2004049 | 4.68 | 4.68 | 19.13 | 14.24 | 15.5 | 16.3 | | |
| NT2RP2004060 | 5.7 | 5.7 | 10.41 | 7.09 | 8.67 | 10.84 | | |
| NT2RP2004066 | 2.17 | 2.17 | 4.31 | 3.05 | 4.83 | 3.65 | | |
| NT2RP2004069 | 3.99 | 3.99 | 7.24 | 3.54 | 6 | 4.26 | | |
| NT2RP2004076 | 3.73 | 3.73 | 5.82 | 1.92 | 4.2 | 3.61 | | |
| NT2RP2004080 | 4.21 | 4.21 | 9.26 | 4.45 | 6.47 | 6.15 | | |
| NT2RP2004081 | 3.27 | 3.27 | 5.39 | 3.51 | 3.71 | 4.5 | | |
| NT2RP2004098 | 2.32 | 2.32 | 6.48 | 5.4 | 3.1 | 5.75 | | |
| NT2RP2004108 | 3.82 | 3.82 | 9.56 | 7.18 | 5.89 | 7.56 | | |
| NT2RP2004124 | 3.13 | 3.13 | 5.9 | 3.68 | 5.82 | 3.92 | | |
| NT2RP2004130 | 3.67 | 3.67 | 9.32 | 5.51 | 9.12 | 8.4 | | |
| NT2RP2004133 | 2.05 | 2.05 | 6.41 | 3.69 | 6.54 | 6.25 | | |
| NT2RP2004141 | 5.72 | 5.72 | 7.15 | 5.14 | 7.05 | 7.05 | | |
| NT2RP2004142 | 5.33 | 5.33 | 8.1 | 4.18 | 5.45 | 3.93 | | |
| NT2RP2004152 | 3.34 | 3.34 | 4.78 | 5.7 | 7.49 | 4.39 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocyte_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2004165 | 3.71 | 3.71 | 8.3 | 5.87 | 5.92 | 6.54 | | |
| NT2RP2004170 | 1.86 | 1.86 | 5.97 | 5.37 | 4.17 | 4.94 | | |
| NT2RP2004172 | 2.93 | 2.93 | 5.24 | 4.69 | 5.58 | 4.26 | | |
| NT2RP2004176 | 3.45 | 3.45 | 8.4 | 7.77 | 10.21 | 8.98 | | |
| NT2RP2004179 | 4.01 | 4.01 | 9.17 | 3.94 | 5.07 | 4.15 | | |
| NT2RP2004187 | 3.16 | 3.16 | 6.36 | 3.87 | 3.88 | 4.59 | | |
| NT2RP2004190 | 5.1 | 5.1 | 5.46 | 5.49 | 7.33 | 9.98 | | |
| NT2RP2004194 | 7.54 | 7.54 | 14.57 | 18.5 | 23.44 | 19.83 | * | + |
| NT2RP2004196 | 4.28 | 4.28 | 13.77 | 10.02 | 7.87 | 14.61 | | |
| NT2RP2004205 | 2.67 | 2.67 | 8.14 | 8.64 | 6.62 | 7.81 | | |
| NT2RP2004207 | 2.57 | 2.57 | 4.38 | 4.15 | 4.97 | 3.59 | | |
| NT2RP2004226 | 2.09 | 2.09 | 4.95 | 4.11 | 6.15 | 5.33 | | |
| NT2RP2004232 | 2.79 | 2.79 | 6.52 | 6 | 6.59 | 5.33 | | |
| NT2RP2004239 | 3.57 | 3.57 | 4.49 | 2.71 | 3.97 | 5.6 | | |
| NT2RP2004240 | 7.07 | 7.07 | 12.57 | 13 | 15.8 | 8.95 | | |
| NT2RP2004242 | 3.87 | 3.87 | 6.52 | 5.77 | 6.94 | 7.27 | | |
| NT2RP2004245 | 1.74 | 1.74 | 3.47 | 2.42 | 3.29 | 3.15 | | |
| NT2RP2004270 | 9.77 | 9.77 | 33.78 | 28.39 | 27.43 | 29.48 | | |
| NT2RP2004300 | 2 | 2 | 5.22 | 4.34 | 4.52 | 3.26 | | |
| NT2RP2004304 | 6.46 | 6.46 | 15.37 | 17.41 | 12.33 | 13.9 | | |
| NT2RP2004313 | 3.17 | 3.17 | 3.78 | 5.51 | 4.18 | 4.63 | * | + |
| NT2RP2004316 | 3.46 | 3.46 | 5.84 | 4.9 | 4.96 | 4.04 | | |
| NT2RP2004321 | 4.71 | 4.71 | 6.06 | 6.79 | 7.43 | 6.29 | * | + |
| NT2RP2004336 | 4.19 | 4.19 | 4.97 | 2.73 | 4.28 | 4.53 | | |
| NT2RP2004339 | 5.3 | 5.3 | 20.89 | 17.11 | 18.07 | 15.39 | | |
| NT2RP2004347 | 1.39 | 1.39 | 3.99 | 4.78 | 5 | 4.19 | | |
| NT2RP2004364 | 2.26 | 2.26 | 6.52 | 5.08 | 6.72 | 4.76 | | |
| NT2RP2004365 | 3.18 | 3.18 | 6.58 | 6.68 | 6.34 | 7.7 | | |
| NT2RP2004366 | 2.49 | 2.49 | 6.06 | 4.49 | 4.71 | 3.08 | | |
| NT2RP2004373 | 8.17 | 8.17 | 14.38 | 7.1 | 7.22 | 5.91 | | |
| NT2RP2004375 | 9.27 | 9.27 | 13.98 | 20.89 | 26.85 | 20.68 | ** | + |
| NT2RP2004389 | 5.25 | 5.25 | 5.62 | 5.01 | 6.26 | 5.61 | | |
| NT2RP2004392 | 8.88 | 8.88 | 23.7 | 13.04 | 19.48 | 20.89 | | |
| NT2RP2004396 | 1.98 | 1.98 | 6.27 | 6.65 | 4.98 | 6.17 | | |
| NT2RP2004399 | 5.24 | 5.24 | 8.12 | 12.56 | 7.74 | 9.52 | | |
| NT2RP2004400 | 2.07 | 2.07 | 3.55 | 2.36 | 3.47 | 2 | | |
| NT2RP2004404 | 15.79 | 15.79 | 46 | 45.56 | 40.89 | 41.74 | | |
| NT2RP2004410 | 16.64 | 16.64 | 24.04 | 27.99 | 33.46 | 32.69 | * | + |
| NT2RP2004412 | 5.84 | 5.84 | 6.74 | 7.37 | 9.71 | 7.37 | | |
| NT2RP2004414 | 4.27 | 4.27 | 5.09 | 3.81 | 4.89 | 3.8 | | |
| NT2RP2004425 | 3.71 | 3.71 | 6.53 | 3.73 | 3.18 | 4.04 | | |
| NT2RP2004447 | 1.93 | 1.93 | 5.68 | 2.75 | 5.22 | 3.56 | | |
| NT2RP2004463 | 13.57 | 13.57 | 16.23 | 16.84 | 16.25 | 20.26 | | |
| NT2RP2004476 | 9.11 | 9.11 | 12.69 | 11.89 | 12.66 | 15.87 | | |
| NT2RP2004488 | 3.82 | 3.82 | 8.52 | 4.59 | 6.02 | 5.37 | | |
| NT2RP2004490 | 2.88 | 2.88 | 3.86 | 2.31 | 2.96 | 4.1 | | |
| NT2RP2004495 | 35.59 | 35.59 | 88.76 | 96.31 | 109.31 | 123.5 | * | + |
| NT2RP2004512 | 4.25 | 4.25 | 7.62 | 5.84 | 6.41 | 7.12 | | |
| NT2RP2004523 | 5.18 | 5.18 | 11.04 | 8.44 | 7.56 | 10.21 | | |
| NT2RP2004524 | 2.19 | 2.19 | 6.33 | 4.97 | 5.32 | 5.56 | | |
| NT2RP2004536 | 8.99 | 8.99 | 16.96 | 14.1 | 14.51 | 17.51 | | |
| NT2RP2004538 | 8.03 | 8.03 | 24.44 | 20.15 | 25.59 | 22.24 | | |
| NT2RP2004548 | 4.45 | 4.45 | 9.92 | 7.39 | 9.1 | 10.51 | | |
| NT2RP2004551 | 4.95 | 4.95 | 5.62 | 7.17 | 9.98 | 6.21 | | |
| NT2RP2004556 | 83.73 | 83.73 | 210.17 | 226.48 | 298.92 | 241.84 | | |
| NT2RP2004568 | 5.19 | 5.19 | 11.18 | 6.52 | 9.16 | 9.99 | | |
| NT2RP2004580 | 3.98 | 3.98 | 7.71 | 5.71 | 7.88 | 7.04 | | |
| NT2RP2004585 | 11.28 | 11.28 | 49.82 | 36.69 | 46.91 | 64.56 | | |
| NT2RP2004587 | 1.85 | 1.85 | 4.16 | 2.07 | 2.89 | 3 | | |
| NT2RP2004594 | 4.56 | 4.56 | 9.24 | 11.47 | 12.21 | 28.18 | | |
| NT2RP2004600 | 3.49 | 3.49 | 5.76 | 2.22 | 3.22 | 3.09 | | |
| NT2RP2004602 | 4.62 | 4.62 | 6.32 | 6 | 8.49 | 6.26 | | |
| NT2RP2004606 | 392.21 | 392.21 | 581.19 | 612.4 | 897.5 | 764.63 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and -, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2004614 | 2.92 | 2.92 | 4.73 | 2.69 | 3.63 | 3.81 | | |
| NT2RP2004648 | 2.52 | 2.52 | 4.96 | 3.24 | 5.01 | 4.12 | | |
| NT2RP2004655 | 5.69 | 5.69 | 10.1 | 8.37 | 6.76 | 9.46 | | |
| NT2RP2004664 | 3.64 | 3.64 | 5.35 | 3.59 | 4.62 | 5.97 | | |
| NT2RP2004670 | 1.98 | 1.98 | 3.81 | 1.98 | 3.71 | 4.27 | | |
| NT2RP2004675 | 3.37 | 3.37 | 9.29 | 4.08 | 5.87 | 5.33 | | |
| NT2RP2004681 | 3.46 | 3.46 | 7.56 | 5.72 | 8.92 | 7.55 | | |
| NT2RP2004689 | 2.63 | 2.63 | 5.75 | 5.75 | 4.73 | 7.87 | | |
| NT2RP2004709 | 3.93 | 3.93 | 7.79 | 4.46 | 2.89 | 5.25 | | |
| NT2RP2004710 | 3.15 | 3.15 | 8.37 | 5.63 | 4.61 | 6.88 | | |
| NT2RP2004721 | 1.79 | 1.79 | 5.99 | 3.39 | 4.41 | 2.78 | | |
| NT2RP2004736 | 3.26 | 3.26 | 5.81 | 6.11 | 4.79 | 4.63 | | |
| NT2RP2004743 | 4.94 | 4.94 | 7.96 | 5.94 | 6.67 | 7.36 | | |
| NT2RP2004750 | 6.21 | 6.21 | 17.46 | 11.9 | 15.49 | 11.01 | | |
| NT2RP2004755 | 11.65 | 11.65 | 19.9 | 14.84 | 22.87 | 19.91 | | |
| NT2RP2004767 | 3.54 | 3.54 | 9 | 4.05 | 5.8 | 4.81 | | |
| NT2RP2004768 | 3.48 | 3.48 | 29.51 | 18.48 | 18.73 | 19.6 | | |
| NT2RP2004775 | 4.68 | 4.68 | 5.68 | 7.71 | 5.62 | 8.26 | | |
| NT2RP2004791 | 7.23 | 7.23 | 16.58 | 9.33 | 10.24 | 11.68 | | |
| NT2RP2004794 | 14.01 | 14.01 | 25.74 | 23.04 | 16.86 | 22.78 | | |
| NT2RP2004795 | 5.15 | 5.15 | 7.97 | 6.96 | 5.67 | 11.2 | | |
| NT2RP2004799 | 6.74 | 6.74 | 10.99 | 5.35 | 8.58 | 6.3 | | |
| NT2RP2004802 | 6.35 | 6.35 | 11.79 | 6.1 | 7.62 | 6.24 | | |
| NT2RP2004810 | 3.44 | 3.44 | 8.83 | 7.37 | 7.84 | 6.03 | | |
| NT2RP2004816 | 5.58 | 5.58 | 12.1 | 11.22 | 8.76 | 11.15 | | |
| NT2RP2004837 | 4.13 | 4.13 | 9.89 | 10.43 | 7.23 | 12.98 | | |
| NT2RP2004841 | 0.91 | 0.91 | 2.86 | 3.69 | 4.03 | 8.87 | | |
| NT2RP2004847 | 3.25 | 3.2.51 | 3.75 | 13.82 | 13.87 | 17.16 | | |
| NT2RP2004861 | 2.3 | 2.3 | 5.23 | 2.33 | 4.23 | 2.46 | | |
| NT2RP2004897 | 3.35 | 3.35 | 6.43 | 4.26 | 3.27 | 3.35 | | |
| NT2RP2004932 | 6.64 | 6.64 | 10.16 | 7.96 | 8.53 | 6.91 | | |
| NT2RP2004933 | 4.63 | 4.63 | 3.41 | 2.98 | 2.93 | 3.2 | * | - |
| NT2RP2004936 | 3.69 | 3.69 | 6.41 | 4.56 | 4.42 | 7.53 | | |
| NT2RP2004951 | 2.98 | 2.98 | 10.48 | 5.09 | 5.22 | 19.28 | | |
| NT2RP2004959 | 3.13 | 3.13 | 6.61 | 6.43 | 6.26 | 6.5 | | |
| NT2RP2004961 | 2.1 | 2.1 | 4.79 | 4.89 | 6.49 | 5.44 | | |
| NT2RP2004962 | 2.27 | 2.27 | 7.28 | 4.5 | 5.57 | 4.47 | | |
| NT2RP2004966 | 2.26 | 2.26 | 6.07 | 4.1 | 4.1 | 2.97 | | |
| NT2RP2004967 | 3.87 | 3.87 | 6.16 | 4.07 | 4.82 | 3.26 | | |
| NT2RP2004974 | 5.27 | 5.27 | 5.43 | 3.59 | 3.47 | 3.89 | ** | - |
| NT2RP2004978 | 2.68 | 2.68 | 5.26 | 4.17 | 6.39 | 5.09 | | |
| NT2RP2004982 | 0.57 | 0.57 | 1.82 | 2.2 | 1.94 | 1.72 | | |
| NT2RP2004985 | 16.03 | 16.03 | 45.34 | 44.65 | 46.12 | 54.4 | | |
| NT2RP2004999 | 2.21 | 2.21 | 5.64 | 4.27 | 8.86 | 10.34 | | |
| NT2RP2005000 | 3.62 | 3.62 | 5.76 | 4.33 | 4.76 | 4.65 | | |
| NT2RP2005001 | 5.41 | 5.41 | 7.91 | 8.26 | 9.15 | 8.32 | | |
| NT2RP2005003 | 3.8 | 3.8 | 7.2 | 6.11 | 7.91 | 6.2 | | |
| NT2RP2005012 | 6.61 | 6.61 | 20.14 | 18.41 | 20.96 | 17.87 | | |
| NT2RP2005018 | 1.9 | 1.9 | 4.24 | 3.29 | 2.24 | 2.91 | | |
| NT2RP2005020 | 6.12 | 6.12 | 23.5.81 | 9.97 | 19.94 | 22.96 | | |
| NT2RP2005022 | 1.65 | 1.65 | 5.01 | 5.09 | 7.24 | 4.77 | | |
| NT2RP2005027 | 5.96 | 5.96 | 38.61 | 42.51 | 40.08 | 33.77 | | |
| NT2RP2005031 | 1.54 | 1.54 | 4.99 | 3.94 | 4.53 | 3.92 | | |
| NT2RP2005035 | 44.19 | 44.19 | 94.82 | 116.52 | 107.36 | 106.69 | * | + |
| NT2RP2005037 | 4.28 | 4.28 | 5.87 | 7.91 | 10.26 | 7.09 | * | + |
| NT2RP2005038 | 4.86 | 4.86 | 4.84 | 1.85 | 2.29 | 3.1 | ** | - |
| NT2RP2005048 | 9.92 | 9.92 | 30.91 | 30.14 | 33.38 | 32.48 | | |
| NT2RP2005069 | 16.01 | 16.01 | 34.88 | 21.99 | 20.63 | 27.64 | | |
| NT2RP2005073 | 7.36 | 7.36 | 30.35 | 29.36 | 28.24 | 30.33 | | |
| NT2RP2005097 | 2.39 | 2.39 | 5.6 | 5.27 | 5.2 | 4.6 | | |
| NT2RP2005108 | 1.76 | 1.76 | 3.95 | 2.84 | 4.21 | 7.12 | | |
| NT2RP2005116 | 3.53 | 3.53 | 5.96 | 6.27 | 5.42 | 5.89 | | |
| NT2RP2005126 | 5.88 | 5.88 | 8.31 | 8.9 | 14.96 | 8.51 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocyte_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2005135 | 5.08 | 5.08 | 5.22 | 4.65 | 6.59 | 5.47 | | |
| NT2RP2005139 | 1.94 | 1.94 | 2.77 | 1.87 | 1.81 | 2.45 | | |
| NT2RP2005140 | 3.82 | 3.82 | 4.86 | 12.39 | 6.72 | 8.55 | * | + |
| NT2RP2005144 | 4.04 | 4.04 | 6.31 | 6.69 | 5.97 | 9.7 | | |
| NT2RP2005147 | 2.23 | 2.23 | 5.49 | 5.61 | 6.15 | 6.25 | | |
| NT2RP2005148 | 2.86 | 2.86 | 5.63 | 3.83 | 6.65 | 4.83 | | |
| NT2RP2005159 | 3.92 | 3.92 | 5.6 | 4.94 | 6.38 | 7.41 | | |
| NT2RP2005162 | 3.23 | 3.23 | 5.56 | 4.57 | 5.4 | 4.21 | | |
| NT2RP2005163 | 9.15 | 9.15 | 20.61 | 24.53 | 28.92 | 23.77 | * | + |
| NT2RP2005168 | 2.87 | 2.87 | 6.14 | 5.24 | 4.79 | 4.88 | | |
| NT2RP2005181 | 2.64 | 2.64 | 5.42 | 3.4 | 2.11 | 1.98 | | |
| NT2RP2005204 | 5.4 | 5.4 | 7.81 | 9.08 | 11.94 | 11.81 | * | + |
| NT2RP2005219 | 4.61 | 4.61 | 9.64 | 7.09 | 10.28 | 8.7 | | |
| NT2RP2005227 | 3.59 | 3.59 | 10.43 | 7.55 | 5.36 | 9.97 | | |
| NT2RP2005237 | 26.49 | 26.49 | 94.81 | 86.96 | 105.8 | 93.92 | | |
| NT2RP2005239 | 2.24 | 2.24 | 6.07 | 2.62 | 4.27 | 4.34 | | |
| NT2RP2005247 | 10.63 | 10.63 | 37.59 | 35.58 | 46.1 | 46.95 | | |
| NT2RP2005254 | 4.35 | 4.35 | 9.14 | 5.7 | 6.44 | 6.93 | | |
| NT2RP2005270 | 9.06 | 9.06 | 17.44 | 10.82 | 9.28 | 17.11 | | |
| NT2RP2005276 | 7.19 | 7.19 | 11.53 | 10.88 | 11.68 | 15.71 | | |
| NT2RP2005287 | 7.98 | 7.98 | 11.97 | 8.37 | 7.7 | 13.36 | | |
| NT2RP2005288 | 2.51 | 2.51 | 5.14 | 2.89 | 5.59 | 5.22 | | |
| NT2RP2005289 | 4.26 | 4.26 | 8.48 | 6.68 | 9.08 | 7.49 | | |
| NT2RP2005293 | 5 | 5 | 6.93 | 13.68 | 14.37 | 15.66 | ** | + |
| NT2RP2005315 | 5.79 | 5.79 | 10.64 | 8.04 | 12.95 | 16.68 | | |
| NT2RP2005322 | 5.05 | 5.05 | 15.42 | 18.91 | 11.33 | 22.43 | | |
| NT2RP2005325 | 8.45 | 8.45 | 18.4 | 15.57 | 13.63 | 20.01 | | |
| NT2RP2005336 | 1.71 | 1.71 | 6.68 | 4.18 | 5.74 | 5.3 | | |
| NT2RP2005343 | 2.44 | 2.44 | 7.48 | 3.91 | 4.11 | 5.89 | | |
| NT2RP2005344 | 3.39 | 3.39 | 4.83 | 2.37 | 2.67 | 3.32 | | |
| NT2RP2005347 | 3.14 | 3.14 | 3.61 | 3.34 | 2.96 | 3.53 | | |
| NT2RP2005354 | 6.49 | 6.49 | 11.79 | 10.37 | 13 | 11.38 | | |
| NT2RP2005358 | 35.87 | 35.87 | 109.04 | 101.37 | 134.72 | 117.96 | | |
| NT2RP2005360 | 2.93 | 2.93 | 5 | 3.59 | 4.97 | 3.84 | | |
| NT2RP2005378 | 5.27 | 5.27 | 13.12 | 7.54 | 8.7 | 13.93 | | |
| NT2RP2005391 | 3.06 | 3.06 | 5.41 | 4.21 | 6.76 | 7.72 | | |
| NT2RP2005393 | 1.61 | 1.61 | 6.34 | 4.86 | 6.16 | 4.07 | | |
| NT2RP2005407 | 2.59 | 2.59 | 5.71 | 4.28 | 5.65 | 4.64 | | |
| NT2RP2005419 | 2.65 | 2.65 | 9.05 | 6.37 | 8.5 | 6.77 | | |
| NT2RP2005425 | 5.63 | 5.63 | 18.38 | 15.27 | 18.89 | 15.46 | | |
| NT2RP2005429 | 3.23 | 3.23 | 5.85 | 5.41 | 6.65 | 5.64 | | |
| NT2RP2005436 | 4.65 | 4.65 | 10.5 | 7.02 | 4.28 | 4.97 | | |
| NT2RP2005441 | 2.28 | 2.28 | 5.62 | 3.36 | 3.77 | 5.79 | | |
| NT2RP2005442 | 24.92 | 24.92 | 40.66 | 34.62 | 25.56 | 41.66 | | |
| NT2RP2005444 | 10.72 | 10.72 | 19.24 | 21.92 | 21.07 | 25.56 | * | + |
| NT2RP2005453 | 2.79 | 2.79 | 7.44 | 2.63 | 4.09 | 3.15 | | |
| NT2RP2005457 | 15.12 | 15.12 | 23.21 | 28.69 | 37.38 | 31.61 | * | + |
| NT2RP2005458 | 2.47 | 2.47 | 5.27 | 3.55 | 4.16 | 4.95 | | |
| NT2RP2005463 | 7.73 | 7.73 | 15.23 | 15.65 | 22.11 | 25.05 | * | + |
| NT2RP2005464 | 5.96 | 5.96 | 11.91 | 9.22 | 4.67 | 10.35 | | |
| NT2RP2005465 | 1.81 | 1.81 | 6.69 | 3.86 | 3.75 | 3.74 | | |
| NT2RP2005472 | 10.98 | 10.98 | 32.59 | 28.21 | 27.9 | 25.85 | | |
| NT2RP2005476 | 5.01 | 5.01 | 8.99 | 7.01 | 6.98 | 6.08 | | |
| NT2RP2005490 | 7.51 | 7.51 | 21.09 | 18.18 | 25.55 | 23.45 | | |
| NT2RP2005491 | 4.99 | 4.99 | 12.47 | 8.63 | 10.12 | 8.78 | | |
| NT2RP2005495 | 3.56 | 3.56 | 5.77 | 3.38 | 4.55 | 4.3 | | |
| NT2RP2005496 | 4.84 | 4.84 | 18.25 | 11.3 | 13.16 | 11.28 | | |
| NT2RP2005498 | 2.92 | 2.92 | 7.45 | 5.18 | 5.03 | 4.98 | | |
| NT2RP2005501 | 2.04 | 2.04 | 5.54 | 3.12 | 4.34 | 2.46 | | |
| NT2RP2005506 | 124.3 | 124.3 | 217.82 | 139.27 | 121.83 | 104.81 | | |
| NT2RP2005509 | 6.97 | 6.97 | 10.45 | 11.4 | 9.61 | 15.73 | | |
| NT2RP2005514 | 3.93 | 3.93 | 6 | 4.06 | 7.05 | 4.39 | | |
| NT2RP2005520 | 14.95 | 14.95 | 32.39 | 27.11 | 39.97 | 33.03 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2005525 | 6.19 | 6.19 | 7.01 | 7.81 | 7.68 | 4.79 | | |
| NT2RP2005531 | 2.18 | 2.18 | 3.33 | 1.67 | 2.12 | 1.9 | | |
| NT2RP2005535 | 4.66 | 4.66 | 9.09 | 9.34 | 7.79 | 8.91 | | |
| NT2RP2005539 | 3.39 | 3.39 | 6.22 | 6.43 | 5.84 | 7.45 | | |
| NT2RP2005540 | 3.2 | 3.2 | 7.15 | 4.79 | 5.58 | 6.59 | | |
| NT2RP2005541 | 21.25 | 21.25 | 39.57 | 25.85 | 38.31 | 39.61 | | |
| NT2RP2005549 | 2.69 | 2.69 | 7.66 | 6.72 | 4.85 | 7.11 | | |
| NT2RP2005555 | 7.97 | 7.97 | 10.1 | 14.96 | 16.19 | 15.37 | ** | + |
| NT2RP2005557 | 4.89 | 4.89 | 8.47 | 4.03 | 6.52 | 6.26 | | |
| NT2RP2005581 | 3.93 | 3.93 | 9.61 | 6.32 | 7.95 | 6.89 | | |
| NT2RP2005586 | 1.56 | 1.56 | 3.18 | 3.21 | 2.92 | 4.74 | | |
| NT2RP2005597 | 2.77 | 2.77 | 2.93 | 2.98 | 4.1 | 3.84 | | |
| NT2RP2005600 | 1.81 | 1.81 | 3.71 | 4.03 | 4.29 | 4.44 | * | + |
| NT2RP2005605 | 4.93 | 4.93 | 14.29 | 13.17 | 15.14 | 15.75 | | |
| NT2RP2005614 | 3.06 | 3.06 | 5.62 | 3.68 | 4.11 | 2.45 | | |
| NT2RP2005620 | 3.47 | 3.47 | 6.26 | 3.6 | 3.92 | 3.11 | | |
| NT2RP2005622 | 6.14 | 6.14 | 5.07 | 6.21 | 7.43 | 4.61 | | |
| NT2RP2005632 | 5.72 | 5.72 | 10.95 | 11.57 | 10.42 | 14.89 | | |
| NT2RP2005635 | 2.22 | 2.22 | 19.06 | 18.14 | 23.77 | 18.14 | | |
| NT2RP2005637 | 1.53 | 1.53 | 8 | 3.73 | 3.71 | 4.14 | | |
| NT2RP2005640 | 1.72 | 1.72 | 7.22 | 7.49 | 8.73 | 6.06 | | |
| NT2RP2005645 | 4.68 | 4.68 | 11.8 | 10.61 | 11.47 | 9.67 | | |
| NT2RP2005651 | 3.45 | 3.45 | 7.88 | 7.64 | 6.78 | 10.15 | | |
| NT2RP2005654 | 4.08 | 4.08 | 4.14 | 3.02 | 2.52 | 3.8 | | |
| NT2RP2005666 | 4.91 | 4.91 | 5.27 | 4.34 | 7.7 | 4.74 | | |
| NT2RP2005669 | 7.15 | 7.15 | 7.95 | 7.05 | 11.14 | 8.21 | | |
| NT2RP2005670 | 2.35 | 2.35 | 6.91 | 7.77 | 5.04 | 5.2 | | |
| NT2RP2005671 | 3.12 | 3.12 | 7.83 | 10.77 | 8.9 | 9.78 | * | + |
| NT2RP2005675 | 7.32 | 7.32 | 37.84 | 34.46 | 40.94 | 40.02 | | |
| NT2RP2005683 | 2.56 | 2.56 | 7.01 | 7.16 | 5.19 | 7.16 | | |
| NT2RP2005690 | 2.84 | 2.84 | 4.48 | 2.82 | 3.74 | 3.4 | | |
| NT2RP2005694 | 4.07 | 4.07 | 5.49 | 3.77 | 6.26 | 3.54 | | |
| NT2RP2005701 | 5.97 | 5.97 | 8.82 | 10.39 | 10.35 | 9.52 | * | + |
| NT2RP2005712 | 5.67 | 5.67 | 5.28 | 4.83 | 7.94 | 6.33 | | |
| NT2RP2005719 | 1.86 | 1.86 | 3.26 | 4.42 | 3.8 | 3.76 | * | + |
| NT2RP2005722 | 4.16 | 4.16 | 11.13 | 13.39 | 15.7 | 15.94 | * | + |
| NT2RP2005723 | 2.71 | 2.71 | 4.2 | 3.65 | 4.58 | 3.67 | | |
| NT2RP2005726 | 2.55 | 2.55 | 4.13 | 2.86 | 4.01 | 3.22 | | |
| NT2RP2005729 | 4.64 | 4.64 | 9.94 | 10.21 | 10.7 | 10.62 | | |
| NT2RP2005731 | 3.05 | 3.05 | 3.39 | 2.51 | 2.16 | 1.27 | * | − |
| NT2RP2005732 | 9.41 | 9.41 | 57.73 | 48.37 | 75.21 | 41.64 | | |
| NT2RP2005737 | 10.75 | 10.75 | 22.28 | 27.16 | 25.02 | 17.59 | | |
| NT2RP2005741 | 3.03 | 3.03 | 5.35 | 3.68 | 3.31 | 3.37 | | |
| NT2RP2005748 | 1.86 | 1.86 | 5.94 | 3.8 | 3.72 | 2.95 | | |
| NT2RP2005752 | 2.46 | 2.46 | 5.55 | 3.27 | 4.37 | 3.8 | | |
| NT2RP2005753 | 8.45 | 8.45 | 14.76 | 11.12 | 11.69 | 14.45 | | |
| NT2RP2005763 | 3 | 3 | 8.03 | 4.22 | 4.77 | 5 | | |
| NT2RP2005767 | 3.72 | 3.72 | 7.79 | 5.55 | 6.75 | 6.29 | | |
| NT2RP2005773 | 8.11 | 8.11 | 10.02 | 10.6 | 11.59 | 13.37 | * | + |
| NT2RP2005774 | 4.25 | 4.25 | 12.72 | 6.86 | 12.24 | 14.61 | | |
| NT2RP2005775 | 3.75 | 3.75 | 7.2 | 3.35 | 4.83 | 5.63 | | |
| NT2RP2005781 | 5.11 | 5.11 | 9.88 | 9.82 | 7.19 | 12.94 | | |
| NT2RP2005784 | 5.41 | 5.41 | 11.51 | 7.68 | 12.12 | 14.06 | | |
| NT2RP2005789 | 3.98 | 3.9.81 | 1.24 | 7.89 | 9.52 | 8.86 | | |
| NT2RP2005799 | 2.45 | 2.45 | 6.35 | 2.64 | 4.67 | 3.7 | | |
| NT2RP2005804 | 9.01 | 9.01 | 25 | 27.85 | 27.32 | 30.57 | | |
| NT2RP2005812 | 2.63 | 2.63 | 4.83 | 2.9 | 3.89 | 5.21 | | |
| NT2RP2005815 | 2.48 | 2.48 | 3.15 | 2.38 | 3.21 | 5.2 | | |
| NT2RP2005835 | 5.99 | 5.99 | 11.26 | 7.13 | 13.74 | 11.69 | | |
| NT2RP2005841 | 2.32 | 2.32 | 10.04 | 4.89 | 7.43 | 11.23 | | |
| NT2RP2005853 | 1.29 | 1.29 | 4.44 | 2.71 | 4.6 | 4.96 | | |
| NT2RP2005857 | 7.37 | 7.37 | 9.87 | 13.46 | 7.93 | 20.27 | | |
| NT2RP2005859 | 2.76 | 2.76 | 5 | 2.91 | 6.14 | 4.78 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2005860 | 1.41 | 1.41 | 3.54 | 1.45 | 1.89 | 2.22 | | |
| NT2RP2005863 | 3.03 | 3.03 | 6.55 | 10.76 | 18.29 | 15.94 | * | + |
| NT2RP2005868 | 3.86 | 3.86 | 5.85 | 5.1 | 6.3 | 7.77 | | |
| NT2RP2005876 | 5.7 | 5.7 | 12.31 | 7.84 | 8.29 | 8.2 | | |
| NT2RP2005878 | 2.26 | 2.26 | 8.44 | 5.25 | 4.95 | 6.32 | | |
| NT2RP2005883 | 13.54 | 13.54 | 21.06 | 23.75 | 9.57 | 28.09 | | |
| NT2RP2005886 | 7.18 | 7.18 | 50.05 | 51.13 | 62.09 | 50.14 | | |
| NT2RP2005887 | 3.76 | 3.76 | 6.51 | 4.74 | 8.05 | 4.81 | | |
| NT2RP2005890 | 4.17 | 4.17 | 9.77 | 11.87 | 17.13 | 12.15 | * | + |
| NT2RP2005901 | 3.19 | 3.19 | 5.69 | 3.91 | 6.18 | 5.14 | | |
| NT2RP2005902 | 3.17 | 3.17 | 4.33 | 4.78 | 4.77 | 6.25 | | |
| NT2RP2005908 | 3.09 | 3.09 | 7.86 | 4.89 | 3.7 | 6.34 | | |
| NT2RP2005927 | 1.77 | 1.77 | 2.66 | 2.25 | 4.36 | 3.07 | | |
| NT2RP2005933 | 2.5 | 2.5 | 5.59 | 6.4 | 4.77 | 6.42 | | |
| NT2RP2005941 | 2.09 | 2.09 | 5.2 | 3.31 | 4.41 | 3.9 | | |
| NT2RP2005942 | 4 | 4 | 6.86 | 3.08 | 4.59 | 4.64 | | |
| NT2RP2005946 | 4.63 | 4.63 | 9.49 | 5.33 | 7.06 | 6.24 | | |
| NT2RP2005970 | 5.44 | 5.4.41 | 4 | 16.16 | 22.05 | 18.9 | * | + |
| NT2RP2005980 | 3.71 | 3.71 | 5.25 | 2.69 | 3.46 | 2.37 | | |
| NT2RP2005994 | 2.99 | 2.99 | 6.76 | 4.28 | 3.28 | 5.14 | | |
| NT2RP2006004 | 1.31 | 1.31 | 2.89 | 2.07 | 6.09 | 2.58 | | |
| NT2RP2006013 | 1.38 | 1.38 | 4.91 | 3.1 | 5.07 | 4.92 | | |
| NT2RP2006023 | 8.37 | 8.37 | 17.77 | 20 | 21.43 | 21.14 | * | + |
| NT2RP2006028 | 5.03 | 5.03 | 10.23 | 7.47 | 9.89 | 9.71 | | |
| NT2RP2006038 | 4.67 | 4.67 | 5.86 | 2.79 | 5.4 | 1.09 | | |
| NT2RP2006042 | 8.3 | 8.3 | 7.22 | 6.63 | 5.89 | 6.3 | * | – |
| NT2RP2006043 | 5.65 | 5.65 | 7.59 | 7.6 | 10.99 | 8.29 | | |
| NT2RP2006052 | 1.48 | 1.48 | 4.48 | 4.13 | 3.12 | 4.54 | | |
| NT2RP2006057 | 3.73 | 3.73 | 6.23 | 5.69 | 3.83 | 4.95 | | |
| NT2RP2006064 | 4.16 | 4.16 | 7.73 | 5.86 | 6.81 | 9.08 | | |
| NT2RP2006068 | 2.76 | 2.76 | 6.75 | 6.8 | 7.81 | 5.81 | | |
| NT2RP2006069 | 1.46 | 1.46 | 4.94 | 3.56 | 3.95 | 3.3 | | |
| NT2RP2006071 | 8.37 | 8.37 | 7.8 | 9.28 | 10.48 | 9.11 | * | + |
| NT2RP2006090 | 6.62 | 6.62 | 5.78 | 3.27 | 3.55 | 3.64 | ** | – |
| NT2RP2006092 | 3.78 | 3.78 | 8.3 | 6.18 | 8.04 | 7.07 | | |
| NT2RP2006097 | 14.05 | 14.05 | 40.38 | 31.2 | 25.81 | 40.02 | | |
| NT2RP2006098 | 1.94 | 1.94 | 4.27 | 4.52 | 4.61 | 7.65 | | |
| NT2RP2006099 | 3.84 | 3.84 | 11.02 | 10.65 | 10.99 | 13.34 | | |
| NT2RP2006100 | 2.87 | 2.87 | 5.78 | 3.63 | 7.31 | 5.19 | | |
| NT2RP2006103 | 2.39 | 2.39 | 5.54 | 2.6 | 3.93 | 1.71 | | |
| NT2RP2006106 | 6.48 | 6.48 | 21.51 | 18.05 | 24.81 | 22.3 | | |
| NT2RP2006127 | 3.17 | 3.17 | 4.92 | 1.62 | 1.26 | 1.21 | * | – |
| NT2RP2006134 | 4.25 | 4.25 | 4.41 | 6.08 | 6.7 | 5.47 | ** | + |
| NT2RP2006141 | 3.91 | 3.91 | 7.94 | 7.45 | 6.04 | 9.08 | | |
| NT2RP2006166 | 3.1 | 3.1 | 10.65 | 9.01 | 8.94 | 7.85 | | |
| NT2RP2006176 | 2.15 | 2.15 | 4.26 | 3.95 | 5.73 | 4.69 | | |
| NT2RP2006181 | 1.68 | 1.68 | 2.84 | 3.21 | 3.14 | 2.45 | | |
| NT2RP2006184 | 8.85 | 8.85 | 17.16 | 20.8 | 19.95 | 17.1 | | |
| NT2RP2006186 | 3.01 | 3.01 | 4.57 | 2.77 | 2.29 | 4.33 | | |
| NT2RP2006196 | 5.24 | 5.24 | 7.21 | 5.25 | 5.23 | 4.16 | | |
| NT2RP2006199 | 5.06 | 5.06 | 4.38 | 3.81 | 3.65 | 3.64 | ** | – |
| NT2RP2006200 | 0.87 | 0.87 | 3.43 | 4.37 | 4.52 | 2.17 | | |
| NT2RP2006210 | 20.08 | 20.08 | 59.85 | 75.37 | 70.55 | 96.59 | * | + |
| NT2RP2006219 | 2.88 | 2.88 | 6.26 | 5.97 | 5.11 | 7.36 | | |
| NT2RP2006224 | 3.7 | 3.7 | 7.55 | 9 | 7.7 | 8.93 | | |
| NT2RP2006237 | 1.97 | 1.97 | 4.79 | 3.45 | 2.74 | 4.14 | | |
| NT2RP2006238 | 3.9 | 3.9 | 6.33 | 4.2 | 4.69 | 3.93 | | |
| NT2RP2006258 | 4.5 | 4.5 | 6.73 | 3.07 | 4.27 | 4.39 | | |
| NT2RP2006261 | 7.32 | 7.32 | 3.98 | 2.04 | 3.19 | 7.69 | | |
| NT2RP2006269 | 4.11 | 4.11 | 7.96 | 9.52 | 5.46 | 9.06 | | |
| NT2RP2006275 | 3.67 | 3.67 | 30.36 | 23.46 | 35.36 | 25.14 | | |
| NT2RP2006282 | 3.16 | 3.16 | 8.89 | 8.85 | 8.4 | 7.05 | | |
| NT2RP2006302 | 5.69 | 5.69 | 12.68 | 13.12 | 12.4 | 11.87 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP2006312 | 4.88 | 4.88 | 8.22 | 8.47 | 9.13 | 9.8 | | |
| NT2RP2006320 | 4.27 | 4.27 | 9.87 | 6.42 | 9.32 | 9.69 | | |
| NT2RP2006321 | 3.27 | 3.27 | 4.23 | 2.79 | 4.99 | 4.13 | | |
| NT2RP2006323 | 4.1 | 4.1 | 2.59 | 2.39 | 3.6 | 1.83 | | |
| NT2RP2006333 | 0.67 | 0.67 | 1.82 | 1.7 | 1.04 | 1.17 | | |
| NT2RP2006334 | 2.24 | 2.24 | 4.02 | 4.57 | 2.72 | 3.54 | | |
| NT2RP2006338 | 2.4 | 2.4 | 5.26 | 4.73 | 5.11 | 4.04 | | |
| NT2RP2006339 | 2.24 | 2.24 | 2.94 | 2.47 | 1.93 | 2.06 | | |
| NT2RP2006355 | 3.61 | 3.61 | 4.59 | 3.14 | 3.39 | 2.22 | | |
| NT2RP2006365 | 3.3 | 3.3 | 4.44 | 2.42 | 2.6 | 1.3 | * | − |
| NT2RP2006374 | 16.34 | 16.34 | 111.62 | 108.73 | 174.7 | 73.65 | | |
| NT2RP2006393 | 4.93 | 4.93 | 7.68 | 7.38 | 8 | 6.95 | | |
| NT2RP2006394 | 8.59 | 8.59 | 17.91 | 11.3 | 11.18 | 15.38 | | |
| NT2RP2006400 | 2.25 | 2.25 | 4.51 | 2.08 | 3.58 | 1.95 | | |
| NT2RP2006411 | 27.71 | 27.71 | 42.11 | 23.61 | 17.25 | 37.31 | | |
| NT2RP2006429 | 2.22 | 2.22 | 7.3 | 2.82 | 5.3 | 2.21 | | |
| NT2RP2006435 | 1.46 | 1.46 | 5.29 | 1.76 | 2.65 | 1.98 | | |
| NT2RP2006436 | 2.33 | 2.33 | 6.43 | 4.33 | 5.28 | 3.75 | | |
| NT2RP2006441 | 4.69 | 4.69 | 8.19 | 7.76 | 8.89 | 8.37 | | |
| NT2RP2006447 | 2.41 | 2.41 | 4.78 | 3.18 | 2.63 | 3.87 | | |
| NT2RP2006454 | 2.58 | 2.58 | 5.38 | 4.39 | 3.37 | 4.03 | | |
| NT2RP2006455 | 3.79 | 3.79 | 7.14 | 2.91 | 4.62 | 9.23 | | |
| NT2RP2006456 | 1.96 | 1.96 | 5.99 | 2.51 | 4.49 | 3.17 | | |
| NT2RP2006464 | 5.44 | 5.44 | 8.28 | 4.47 | 8.85 | 7.9 | | |
| NT2RP2006467 | 4.17 | 4.17 | 10 | 8.56 | 12.47 | 12.58 | | |
| NT2RP2006472 | 5.05 | 5.05 | 6.84 | 7.24 | 6.92 | 7.37 | | |
| NT2RP2006474 | 4.69 | 4.69 | 16.3 | 18.19 | 32.31 | 21.3 | | |
| NT2RP2006475 | 2.5 | 2.5 | 9.54 | 6.14 | 6.86 | 7.66 | | |
| NT2RP2006476 | 5.34 | 5.34 | 14.94 | 7.62 | 13.82 | 17.24 | | |
| NT2RP2006501 | 2.44 | 2.44 | 7.28 | 4.6 | 7.45 | 7.74 | | |
| NT2RP2006512 | 10.25 | 10.25 | 19.79 | 16.72 | 7.89 | 29.01 | | |
| NT2RP2006526 | 2.09 | 2.09 | 5.19 | 2.24 | 2.78 | 2.31 | | |
| NT2RP2006527 | 3.61 | 3.61 | 7.05 | 4.56 | 6.14 | 6.46 | | |
| NT2RP2006534 | 2.24 | 2.24 | 4.49 | 2.08 | 2.95 | 2.73 | | |
| NT2RP2006537 | 6.08 | 6.08 | 15.7 | 11.72 | 17.73 | 12.82 | | |
| NT2RP2006543 | 7.83 | 7.83 | 14.8 | 6.52 | 5.4 | 6.88 | | |
| NT2RP2006554 | 1.33 | 1.33 | 3.71 | 1.79 | 3.76 | 2.2 | | |
| NT2RP2006565 | 3.78 | 3.78 | 8.91 | 5.79 | 8.42 | 7.55 | | |
| NT2RP2006571 | 1.38 | 1.38 | 3.88 | 2.77 | 4.01 | 2.29 | | |
| NT2RP2006573 | 2.1 | 2.1 | 4.02 | 3.05 | 3.6 | 2.41 | | |
| NT2RP2006598 | 2.25 | 2.25 | 7.04 | 4.34 | 6.56 | 4.78 | | |
| NT2RP2006601 | 24.92 | 24.92 | 35.13 | 38.45 | 45.47 | 31.69 | | |
| NT2RP3000002 | 5.04 | 5.04 | 6.09 | 4.7 | 5.04 | 8.18 | | |
| NT2RP3000011 | 1.82 | 1.82 | 5.9 | 2.59 | 1.85 | 2.22 | | |
| NT2RP3000014 | 3.29 | 3.29 | 7.66 | 4.22 | 3.06 | 4.95 | | |
| NT2RP3000016 | 3.42 | 3.42 | 7 | 5.29 | 6.56 | 6.11 | | |
| NT2RP3000022 | 1.71 | 1.71 | 3.93 | 1.72 | 4.68 | 0.59 | | |
| NT2RP3000024 | 3.74 | 3.74 | 7.03 | 4.31 | 4.92 | 4.06 | | |
| NT2RP3000031 | 4.66 | 4.66 | 8.66 | 4 | 6.75 | 4.86 | | |
| NT2RP3000034 | 3.76 | 3.76 | 6.24 | 4.44 | 7.13 | 3.23 | | |
| NT2RP3000037 | 2.76 | 2.76 | 6.5 | 9.41 | 13.44 | 11.06 | * | + |
| NT2RP3000040 | 2.04 | 2.04 | 5.96 | 3.21 | 3.46 | 3.56 | | |
| NT2RP3000041 | 2.15 | 2.15 | 7.35 | 3.71 | 3.01 | 3.16 | | |
| NT2RP3000046 | 1.95 | 1.95 | 4.42 | 3.67 | 7.11 | 3.84 | | |
| NT2RP3000047 | 3.25 | 3.25 | 5.55 | 5.85 | 6.2 | 5.94 | | |
| NT2RP3000049 | 2.54 | 2.54 | 6.94 | 5.26 | 7.78 | 3.58 | | |
| NT2RP3000050 | 4.99 | 4.99 | 9.03 | 3.76 | 8.5 | 6.22 | | |
| NT2RP3000051 | 5.99 | 5.99 | 10.69 | 8.51 | 11.19 | 9.72 | | |
| NT2RP3000054 | 4.31 | 4.31 | 6.5 | 4.38 | 5.35 | 3.22 | | |
| NT2RP3000055 | 1.98 | 1.98 | 4.76 | 3.81 | 2.67 | 3.96 | | |
| NT2RP3000056 | 2.87 | 2.87 | 7.09 | 5.59 | 3.32 | 3.91 | | |
| NT2RP3000059 | 2.54 | 2.54 | 5.1 | 1.89 | 4.07 | 1.6 | | |
| NT2RP3000063 | 2.18 | 2.18 | 5.51 | 3.34 | 5.19 | 2.27 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3000068 | 3.76 | 3.76 | 24.22 | 25.83 | 37.88 | 23.13 | | |
| NT2RP3000069 | 17.4.41 | 7.44 | 20.58 | 22 | 28.87 | 18.2 | | |
| NT2RP3000072 | 5.9 | 5.9 | 6.18 | 4.96 | 5.39 | 4.19 | * | – |
| NT2RP3000080 | 4.38 | 4.38 | 6.72 | 3.78 | 5.28 | 3.93 | | |
| NT2RP3000085 | 1.9 | 1.9 | 4.84 | 5.13 | 4.66 | 5.5 | | |
| NT2RP3000087 | 3.77 | 3.77 | 9.1 | 6.22 | 5.61 | 6 | | |
| NT2RP3000092 | 1.92 | 1.92 | 3.6 | 2.72 | 3.2 | 2.52 | | |
| NT2RP3000109 | 1.74 | 1.74 | 5.05 | 5.63 | 7.94 | 4.24 | | |
| NT2RP3000119 | 4.66 | 4.66 | 14.27 | 11.29 | 13.7 | 14.28 | | |
| NT2RP3000125 | 3.02 | 3.02 | 5.56 | 3.42 | 4.53 | 2 | | |
| NT2RP3000131 | 7.84 | 7.84 | 14.37 | 16.23 | 19.96 | 12.93 | | |
| NT2RP3000134 | 5.96 | 5.96 | 9.01 | 6.61 | 7.25 | 6.46 | | |
| NT2RP3000137 | 3.88 | 3.88 | 6.48 | 5.58 | 6.3 | 6.11 | | |
| NT2RP3000142 | 2.87 | 2.87 | 7.77 | 7.28 | 5.03 | 5.31 | | |
| NT2RP3000148 | 1.84 | 1.84 | 6.28 | 4.9 | 5.04 | 5.34 | | |
| NT2RP3000149 | 2.51 | 2.51 | 6.97 | 6.14 | 7.77 | 8.24 | | |
| NT2RP3000163 | 2.16 | 2.16 | 6.17 | 3.27 | 3.9 | 2.5 | | |
| NT2RP3000168 | 5.53 | 5.53 | 14.55 | 12.8 | 11.65 | 11.73 | | |
| NT2RP3000169 | 3.74 | 3.74 | 6.01 | 6.03 | 8.47 | 5.72 | | |
| NT2RP3000171 | 10.86 | 10.86 | 16.71 | 28.33 | 38.98 | 25.93 | * | + |
| NT2RP3000172 | 0.86 | 0.86 | 1.53 | 1.66 | 1.2 | 1.46 | | |
| NT2RP3000186 | 4.32 | 4.32 | 10.6 | 19.18 | 15.43 | 15.82 | * | + |
| NT2RP3000197 | 1.22 | 1.22 | 3.66 | 4.03 | 4.29 | 3.39 | | |
| NT2RP3000201 | 2.4 | 2.4 | 7.2 | 10.49 | 8.4 | 7.88 | | |
| NT2RP3000204 | 2.16 | 2.16 | 4.44 | 3.88 | 4.1 | 4.25 | | |
| NT2RP3000207 | 2.87 | 2.87 | 4.71 | 3 | 2.6 | 2.45 | | |
| NT2RP3000216 | 5.38 | 5.38 | 10.1 | 5.87 | 9.5 | 5.73 | | |
| NT2RP3000220 | 5.14 | 5.14 | 5.66 | 3.68 | 5.69 | 2.92 | | |
| NT2RP3000221 | 2.18 | 2.18 | 5.45 | 6.26 | 6.63 | 5.93 | | |
| NT2RP3000232 | 2.7 | 2.7 | 8.01 | 7.1 | 5.52 | 5.92 | | |
| NT2RP3000233 | 1.55 | 1.55 | 6.01 | 6.9 | 5.91 | 4.06 | | |
| NT2RP3000234 | 3.23 | 3.23 | 9.09 | 12.89 | 10.4 | 11.41 | * | + |
| NT2RP3000235 | 1.57 | 1.57 | 3.3 | 2.35 | 2.92 | 1.38 | | |
| NT2RP3000239 | 4.61 | 4.61 | 11.11 | 9.51 | 9.71 | 14.92 | | |
| NT2RP3000247 | 3.25 | 3.25 | 5.82 | 2.92 | 4.04 | 1.96 | | |
| NT2RP3000251 | 6.11 | 6.11 | 6.52 | 5.22 | 5.82 | 3.25 | | |
| NT2RP3000252 | 3.73 | 3.73 | 7.99 | 7.61 | 8.53 | 8.4 | | |
| NT2RP3000255 | 2.18 | 2.18 | 2.96 | 3.26 | 3.13 | 1.97 | | |
| NT2RP3000262 | 6.72 | 6.72 | 9.43 | 11.67 | 7.95 | 9.13 | | |
| NT2RP3000266 | 6.47 | 6.47 | 15.5 | 13.38 | 10.83 | 12.64 | | |
| NT2RP3000267 | 2.71 | 2.71 | 4.04 | 2.9 | 2.64 | 3.03 | | |
| NT2RP3000271 | 4.38 | 4.38 | 5.57 | 5.11 | 4.84 | 3.72 | | |
| NT2RP3000278 | 7.84 | 7.84 | 56.85 | 48.55 | 82.07 | 42.57 | | |
| NT2RP3000281 | 4.94 | 4.94 | 10.72 | 8.19 | 8.22 | 7.27 | | |
| NT2RP3000292 | 5.63 | 5.63 | 14.1 | 9.17 | 6.77 | 6.93 | | |
| NT2RP3000299 | 2.31 | 2.31 | 4.92 | 3.73 | 4.89 | 4.98 | | |
| NT2RP3000304 | 2.15 | 2.15 | 3.48 | 2.85 | 3.36 | 1.64 | | |
| NT2RP3000310 | 7.24 | 7.2.42 | 4.22 | 18.94 | 23.07 | 19.88 | | |
| NT2RP3000312 | 2.99 | 2.99 | 8.16 | 3.31 | 5.25 | 3.87 | | |
| NT2RP3000320 | 7.06 | 7.06 | 6.17 | 5.25 | 4.74 | 4.74 | ** | – |
| NT2RP3000322 | 11.05 | 11.05 | 18.76 | 32.59 | 45.13 | 46.95 | ** | + |
| NT2RP3000324 | 6.91 | 6.91 | 46.42 | 36.64 | 43.53 | 39.68 | | |
| NT2RP3000326 | 1.95 | 1.95 | 6.17 | 4.02 | 5.75 | 3.53 | | |
| NT2RP3000329 | 2.5 | 2.5 | 5.96 | 4.97 | 8.84 | 5.9 | | |
| NT2RP3000330 | 4.1 | 4.1 | 6.18 | 4.62 | 5.53 | 6.12 | | |
| NT2RP3000333 | 3.23 | 3.23 | 7.45 | 4.36 | 5.28 | 4.52 | | |
| NT2RP3000341 | 8.8 | 8.8 | 12.85 | 14.81 | 18.59 | 14.41 | * | + |
| NT2RP3000344 | 2.73 | 2.73 | 3.75 | 2.69 | 3.54 | 2.29 | | |
| NT2RP3000345 | 3.09 | 3.09 | 3.57 | 1.65 | 1.97 | 2.66 | * | – |
| NT2RP3000348 | 444.59 | 444.59 | 802.63 | 824.62 | 1016.01 | 909.68 | | |
| NT2RP3000350 | 4.25 | 4.2.51 | 0.34 | 4.57 | 9.28 | 6.4 | | |
| NT2RP3000359 | 9.53 | 9.53 | 24.44 | 8.54 | 11.36 | 16.62 | | |
| NT2RP3000361 | 7.5 | 7.5 | 11.12 | 7.89 | 7.81 | 8.95 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3000366 | 7.38 | 7.38 | 14.27 | 9.52 | 11.84 | 16.13 | | |
| NT2RP3000378 | 2.67 | 2.67 | 5.75 | 3.92 | 4.78 | 2.47 | | |
| NT2RP3000384 | 5.42 | 5.42 | 10.88 | 9.52 | 13.1 | 9.28 | | |
| NT2RP3000389 | 12.54 | 12.54 | 21.49 | 23.95 | 35.02 | 27.32 | * | + |
| NT2RP3000393 | 3.74 | 3.74 | 6.16 | 5.03 | 4.53 | 4.77 | | |
| NT2RP3000395 | 110.27 | 110.27 | 212 | 108.33 | 38.18 | 148.45 | | |
| NT2RP3000397 | 2.83 | 2.83 | 5.28 | 2.51 | 5.26 | 3.31 | | |
| NT2RP3000398 | 3.39 | 3.39 | 10.12 | 11.46 | 11.18 | 12.26 | | |
| NT2RP3000403 | 3.22 | 3.22 | 9.39 | 10.1 | 8.2 | 8.44 | | |
| NT2RP3000418 | 3.4 | 3.4 | 10.22 | 7.12 | 11.08 | 13.42 | | |
| NT2RP3000424 | 2.86 | 2.86 | 9.43 | 6.25 | 9.52 | 6.86 | | |
| NT2RP3000427 | 4.65 | 4.65 | 9.05 | 11.55 | 13.43 | 12.35 | * | + |
| NT2RP3000431 | 2.05 | 2.05 | 4.93 | 3.43 | 3.26 | 3.93 | | |
| NT2RP3000433 | 2.63 | 2.63 | 8.65 | 5.65 | 7.09 | 6.65 | | |
| NT2RP3000436 | 11.39 | 11.39 | 20.93 | 18.76 | 9.35 | 18.86 | | |
| NT2RP3000439 | 1.4 | 1.4 | 3.61 | 2.54 | 3.56 | 2 | | |
| NT2RP3000441 | 3.88 | 3.88 | 7.4 | 7.56 | 7.92 | 6.39 | | |
| NT2RP3000444 | 3.31 | 3.31 | 7.29 | 2.36 | 3.25 | 2.2 | | |
| NT2RP3000448 | 4.45 | 4.4.51 | 0.15 | 4.05 | 6.54 | 3.93 | | |
| NT2RP3000449 | 2.84 | 2.84 | 4.59 | 3.1 | 3.94 | 2.93 | | |
| NT2RP3000451 | 1.76 | 1.76 | 5.12 | 3.7 | 5 | 2.96 | | |
| NT2RP3000456 | 1.69 | 1.69 | 5.48 | 4.23 | 6.67 | 4.21 | | |
| NT2RP3000460 | 18.87 | 18.87 | 36.67 | 24.52 | 25.24 | 26.25 | | |
| NT2RP3000471 | 3.14 | 3.14 | 6.49 | 2.74 | 4.98 | 5.84 | | |
| NT2RP3000477 | 19.96 | 19.96 | 23.67 | 28.98 | 17.78 | 32.78 | | |
| NT2RP3000478 | 5.86 | 5.86 | 8.95 | 5.21 | 8.98 | 2.6 | | |
| NT2RP3000481 | 5.48 | 5.48 | 5.76 | 2.76 | 3.61 | 1.52 | ** | – |
| NT2RP3000484 | 3.51 | 3.51 | 4.26 | 2.32 | 2.55 | 1.76 | * | – |
| NT2RP3000487 | 1.77 | 1.77 | 7.4 | 5.07 | 4.03 | 4.97 | | |
| NT2RP3000512 | 3.29 | 3.29 | 17.7 | 15.17 | 15.9 | 14.52 | | |
| NT2RP3000523 | 13.05 | 13.05 | 30.74 | 31.75 | 27.83 | 34.4 | | |
| NT2RP3000526 | 3.07 | 3.07 | 7.38 | 5.18 | 6.31 | 4.64 | | |
| NT2RP3000527 | 2.83 | 2.83 | 6.5 | 3.76 | 7.25 | 5.03 | | |
| NT2RP3000531 | 2.9 | 2.9 | 7.71 | 5.11 | 5.51 | 4.69 | | |
| NT2RP3000532 | 5.74 | 5.74 | 5.6 | 5.75 | 8.39 | 4.26 | | |
| NT2RP3000542 | 6.23 | 6.23 | 8.1 | 7.21 | 7.3 | 6.39 | | |
| NT2RP3000554 | 8.81 | 8.81 | 15.22 | 13.78 | 10.56 | 14.95 | | |
| NT2RP3000561 | 1.21 | 1.21 | 3.51 | 3.11 | 2.76 | 2.25 | | |
| NT2RP3000562 | 1.84 | 1.84 | 3.5 | 3.7 | 3.87 | 3.23 | | |
| NT2RP3000578 | 1.56 | 1.56 | 2.54 | 2.54 | 3.37 | 2.36 | | |
| NT2RP3000582 | 1.26 | 1.26 | 4.66 | 2.24 | 2.52 | 0.41 | | |
| NT2RP3000584 | 2.82 | 2.82 | 6.52 | 3.2 | 2.5 | 2.02 | | |
| NT2RP3000586 | 4.08 | 4.08 | 4.59 | 3.28 | 3.9 | 2.87 | | |
| NT2RP3000590 | 5.69 | 5.69 | 4.61 | 3.78 | 4.35 | 2.57 | | |
| NT2RP3000592 | 1.8 | 1.8 | 2.99 | 2.97 | 2.75 | 3.15 | | |
| NT2RP3000596 | 2.27 | 2.27 | 4.89 | 4.5 | 3.33 | 3.03 | | |
| NT2RP3000599 | 1.67 | 1.67 | 3.07 | 3.88 | 4.98 | 3.82 | * | + |
| NT2RP3000603 | 6.09 | 6.09 | 39.25 | 40.43 | 44.88 | 35.89 | | |
| NT2RP3000605 | 2.84 | 2.84 | 6.66 | 4.56 | 4.23 | 2.56 | | |
| NT2RP3000607 | 5.35 | 5.35 | 7.59 | 5.74 | 8.46 | 7.55 | | |
| NT2RP3000616 | 3.26 | 3.26 | 5.45 | 2.56 | 2.38 | 1.21 | | |
| NT2RP3000621 | 5.18 | 5.18 | 8.48 | 10.28 | 10.29 | 6.01 | | |
| NT2RP3000622 | 2.36 | 2.36 | 8.76 | 5.85 | 6.21 | 4.72 | | |
| NT2RP3000624 | 1.53 | 1.53 | 3.19 | 3.97 | 3.06 | 2.78 | | |
| NT2RP3000628 | 2.44 | 2.44 | 8.04 | 10.27 | 7.85 | 5.58 | | |
| NT2RP3000631 | 4.71 | 4.71 | 14.95 | 22.82 | 16.45 | 14.2 | | |
| NT2RP3000632 | 2.35 | 2.35 | 5.5 | 7.78 | 8.91 | 5.91 | * | + |
| NT2RP3000638 | 6.95 | 6.95 | 17.93 | 11.8 | 11.6 | 9.97 | | |
| NT2RP3000644 | 25.72 | 25.72 | 48.41 | 57.98 | 72.01 | 52.49 | * | + |
| NT2RP3000645 | 5.85 | 5.85 | 10.48 | 9.84 | 12.55 | 8.43 | | |
| NT2RP3000652 | 3.39 | 3.39 | 5.34 | 6.22 | 5.9 | 7.74 | * | + |
| NT2RP3000658 | 2.26 | 2.26 | 5.01 | 6.16 | 4.24 | 4.86 | | |
| NT2RP3000660 | 2.34 | 2.34 | 6.25 | 6.98 | 6.91 | 5.14 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3000661 | 1.98 | 1.98 | 4.49 | 4.06 | 3.87 | 3.1 | | |
| NT2RP3000665 | 4.79 | 4.79 | 12.26 | 11.83 | 11.92 | 7 | | |
| NT2RP3000676 | 4.46 | 4.46 | 7.55 | 6.65 | 7.81 | 5.42 | | |
| NT2RP3000677 | 2.87 | 2.87 | 4.13 | 2.44 | 3.07 | 1.54 | | |
| NT2RP3000681 | 19.85 | 19.85 | 30.12 | 32.94 | 41.51 | 34.34 | * | |
| NT2RP3000683 | 2.68 | 2.68 | 9.67 | 6.69 | 7.09 | 6.69 | | |
| NT2RP3000685 | 1.7 | 1.7 | 2.5 | 3.63 | 2.36 | 3.44 | | |
| NT2RP3000690 | 2.77 | 2.77 | 3.29 | 3.82 | 3.75 | 2.72 | | |
| NT2RP3000698 | 10 | 10 | 22.49 | 25.66 | 17.08 | 27.43 | | |
| NT2RP3000708 | 3.45 | 3.45 | 5.5 | 8.17 | 9.22 | 8.56 | ** | + |
| NT2RP3000719 | 2.83 | 2.83 | 2.83 | 1.16 | 1.7 | 1.91 | ** | − |
| NT2RP3000721 | 5.63 | 5.6.32 | 4.61 | 23.43 | 39.76 | 21.55 | | |
| NT2RP3000728 | 3.33 | 3.33 | 2.57 | 1.4 | 1.64 | 1.05 | ** | − |
| NT2RP3000730 | 2.06 | 2.06 | 5.04 | 2.76 | 4.23 | 1.86 | | |
| NT2RP3000733 | 2.87 | 2.87 | 6.32 | 3.48 | 4.47 | 4.25 | | |
| NT2RP3000735 | 1.74 | 1.74 | 4.22 | 1.81 | 2.22 | 1.26 | | |
| NT2RP3000736 | 2.71 | 2.71 | 6.35 | 3.29 | 5.05 | 3.65 | | |
| NT2RP3000739 | 13.76 | 13.76 | 12.16 | 18.05 | 9.37 | 20.19 | | |
| NT2RP3000742 | 3.89 | 3.89 | 10.06 | 4.54 | 4.97 | 4.43 | | |
| NT2RP3000753 | 2.29 | 2.29 | 3.9 | 2.17 | 2.65 | 6.3 | | |
| NT2RP3000759 | 9.07 | 9.07 | 15.99 | 11.11 | 17.14 | 23.05 | | |
| NT2RP3000789 | 1.58 | 1.58 | 5.76 | 4.89 | 4.23 | 3.69 | | |
| NT2RP3000815 | 1.91 | 1.91 | 5.92 | 4.49 | 5.57 | 3.08 | | |
| NT2RP3000818 | 4.35 | 4.35 | 11.29 | 6.64 | 10.49 | 8.27 | | |
| NT2RP3000820 | 9.01 | 9.01 | 18.49 | 18.58 | 20.1 | 16.9 | | |
| NT2RP3000821 | 2.13 | 2.13 | 4.83 | 3.28 | 5.19 | 2.02 | | |
| NT2RP3000825 | 1.87 | 1.87 | 4.94 | 1.92 | 1.47 | 2.27 | | |
| NT2RP3000826 | 4.04 | 4.04 | 13.59 | 10.86 | 13.8 | 12.94 | | |
| NT2RP3000836 | 5.33 | 5.33 | 11.61 | 11.55 | 14.11 | 13.3 | | |
| NT2RP3000838 | 319.2 | 319.2 | 741.74 | 710.2 | 743.55 | 1049.86 | | |
| NT2RP3000839 | 2.35 | 2.35 | 6.67 | 4.53 | 6.38 | 4.36 | | |
| NT2RP3000841 | 2.17 | 2.17 | 4.32 | 3.79 | 5.55 | 4.72 | | |
| NT2RP3000845 | 3.96 | 3.96 | 8.89 | 5.76 | 6.71 | 7.85 | | |
| NT2RP3000847 | 3.7 | 3.7 | 7.94 | 4.48 | 5.94 | 5.28 | | |
| NT2RP3000848 | 2.84 | 2.84 | 8.34 | 5.36 | 6.81 | 6.3 | | |
| NT2RP3000850 | 5.67 | 5.67 | 7.04 | 6.58 | 11.29 | 7.47 | | |
| NT2RP3000852 | 3.27 | 3.27 | 3.17 | 4.02 | 5.23 | 5.8 | * | + |
| NT2RP3000859 | 2.76 | 2.76 | 7.12 | 4.46 | 7.11 | 8.43 | | |
| NT2RP3000861 | 2.58 | 2.58 | 10.51 | 6.13 | 10.36 | 6.43 | | |
| NT2RP3000862 | 15.29 | 15.29 | 24.16 | 16.36 | 9.81 | 23.13 | | |
| NT2RP3000865 | 1.58 | 1.58 | 4.26 | 2.54 | 4.21 | 1.83 | | |
| NT2RP3000866 | 2.08 | 2.08 | 5.03 | 2.37 | 3.59 | 5.22 | | |
| NT2RP3000868 | 2.2 | 2.2 | 7.09 | 3.04 | 3.84 | 2.28 | | |
| NT2RP3000869 | 3.54 | 3.54 | 11.36 | 9.61 | 15.76 | 7.9 | | |
| NT2RP3000871 | 1.75 | 1.75 | 3.79 | 1.81 | 3.24 | 1.94 | | |
| NT2RP3000875 | 0.99 | 0.99 | 4.25 | 2.57 | 2.71 | 3.64 | | |
| NT2RP3000895 | 2.54 | 2.54 | 5.56 | 2.84 | 3.55 | 4.93 | | |
| NT2RP3000900 | 6.01 | 6.01 | 11.86 | 11.3 | 7.7 | 14.58 | | |
| NT2RP3000901 | 3.67 | 3.67 | 7.03 | 4.11 | 6.39 | 5.3 | | |
| NT2RP3000903 | 3.76 | 3.76 | 7.87 | 3.12 | 5.92 | 3.93 | | |
| NT2RP3000904 | 3.83 | 3.83 | 8.67 | 3.05 | 4.87 | 3.16 | | |
| NT2RP3000907 | 5.66 | 5.66 | 10.03 | 8.94 | 10.67 | 10.14 | | |
| NT2RP3000913 | 6.04 | 6.04 | 15.01 | 17.87 | 25.57 | 17.37 | * | + |
| NT2RP3000917 | 7.64 | 7.64 | 16.58 | 7.66 | 6.56 | 13.51 | | |
| NT2RP3000919 | 1.99 | 1.99 | 5.15 | 3.5 | 4.3 | 2.68 | | |
| NT2RP3000921 | 2.26 | 2.26 | 7.67 | 4.88 | 4.07 | 6.51 | | |
| NT2RP3000942 | 2.66 | 2.66 | 3.89 | 2.68 | 4.12 | 2.63 | | |
| NT2RP3000968 | 70.24 | 70.24 | 87.55 | 105.89 | 110.05 | 115.38 | ** | + |
| NT2RP3000974 | 5.36 | 5.36 | 9.06 | 3.21 | 4.48 | 2.64 | | |
| NT2RP3000980 | 5.77 | 5.77 | 5.77 | 2.09 | 4.14 | 2.26 | * | − |
| NT2RP3000984 | 3.17 | 3.17 | 7.65 | 6.33 | 6.68 | 4.58 | | |
| NT2RP3000994 | 2.09 | 2.09 | 4.88 | 2.4 | 3.14 | 3.37 | | |
| NT2RP3001001 | 1.46 | 1.46 | 3.45 | 3.75 | 4.14 | 1.31 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| | Synoviocyte | | | Synoviocute_TNF | | | t test vs | INC. and |
|---|---|---|---|---|---|---|---|---|
| Clone | exp. 1 | exp. 2 | exp. 3 | exp. 1 | exp. 2 | exp. 3 | TNF | DEC. |
| NT2RP3001004 | 3.37 | 3.37 | 6.52 | 3.51 | 5.63 | 5.01 | | |
| NT2RP3001007 | 4.46 | 4.46 | 9.87 | 10.02 | 10.62 | 6.81 | | |
| NT2RP3001012 | 2.78 | 2.78 | 5.4 | 4.99 | 6.83 | 3.65 | | |
| NT2RP3001042 | 4.74 | 4.74 | 5.52 | 2.99 | 5.18 | 1.38 | | |
| NT2RP3001044 | 6.26 | 6.26 | 7.12 | 7.16 | 6.76 | 4.92 | | |
| NT2RP3001048 | 2.52 | 2.52 | 3.01 | 3.5 | 3.93 | 2.42 | | |
| NT2RP3001050 | 1.79 | 1.79 | 4.99 | 4.68 | 5.94 | 4.7 | | |
| NT2RP3001055 | 6.55 | 6.55 | 15.6 | 16.48 | 12.44 | 20.49 | | |
| NT2RP3001057 | 2.79 | 2.79 | 10.84 | 5.57 | 6.05 | 5.67 | | |
| NT2RP3001061 | 3.18 | 3.18 | 6.57 | 5.03 | 7.85 | 5.42 | | |
| NT2RP3001069 | 6.03 | 6.03 | 14.95 | 18.49 | 17.53 | 15.08 | | |
| NT2RP3001074 | 4.2 | 4.2 | 7.22 | 8.72 | 10 | 6.64 | | |
| NT2RP3001078 | 5.11 | 5.11 | 7.29 | 7.51 | 8.72 | 5.18 | | |
| NT2RP3001081 | 4 | 4 | 5.72 | 4.65 | 5.19 | 3.52 | | |
| NT2RP3001084 | 2.7 | 2.7 | 7.92 | 6.85 | 6.71 | 6.23 | | |
| NT2RP3001095 | 1.57 | 1.57 | 3.88 | 3.69 | 3.68 | 3.42 | | |
| NT2RP3001096 | 2.52 | 2.52 | 7.33 | 16.78 | 8.08 | 18.7 | * | + |
| NT2RP3001097 | 3.65 | 3.65 | 4.28 | 6.42 | 8.11 | 8.5 | ** | + |
| NT2RP3001107 | 3.69 | 3.69 | 4.79 | 3.77 | 4.03 | 2.37 | | |
| NT2RP3001109 | 3.2 | 3.2 | 5.5 | 6.01 | 9.56 | 7.26 | * | + |
| NT2RP3001111 | 4.58 | 4.58 | 4.19 | 3.41 | 3.51 | 2.29 | * | – |
| NT2RP3001112 | 12.61 | 12.61 | 18.48 | 25.73 | 29.85 | 24.61 | ** | + |
| NT2RP3001113 | 1.21 | 1.21 | 2.59 | 2.47 | 3.24 | 2.19 | | |
| NT2RP3001115 | 1.51 | 1.51 | 3.32 | 2.57 | 3.77 | 2.19 | | |
| NT2RP3001116 | 1.01 | 1.01 | 2.66 | 2.55 | 4.4 | 2.91 | | |
| NT2RP3001119 | 3.69 | 3.69 | 6.75 | 9.07 | 6.67 | 5.44 | | |
| NT2RP3001120 | 5.02 | 5.02 | 8.24 | 8.85 | 7.87 | 6.71 | | |
| NT2RP3001126 | 6.16 | 6.16 | 12.34 | 17.84 | 19.66 | 17.49 | ** | + |
| NT2RP3001127 | 6.93 | 6.93 | 6.76 | 4.79 | 7.63 | 6.36 | | |
| NT2RP3001133 | 3.95 | 3.95 | 4.95 | 3.95 | 4.16 | 3.62 | | |
| NT2RP3001140 | 1.46 | 1.46 | 2.43 | 3.21 | 2.38 | 6.71 | | |
| NT2RP3001147 | 3.16 | 3.16 | 6.96 | 16.08 | 14.49 | 13.84 | ** | + |
| NT2RP3001150 | 1.99 | 1.99 | 4.32 | 4.06 | 5.68 | 3.76 | | |
| NT2RP3001152 | 1.7 | 1.7 | 3.29 | 3.15 | 3.62 | 2.51 | | |
| NT2RP3001155 | 2.95 | 2.95 | 4.35 | 3.68 | 4.35 | 3.58 | | |
| NT2RP3001156 | 4.38 | 4.38 | 6.57 | 2.91 | 5.72 | 5.67 | | |
| NT2RP3001159 | 5.38 | 5.38 | 10.5 | 7.87 | 10.86 | 7.25 | | |
| NT2RP3001170 | 7.38 | 7.38 | 5.96 | 6.12 | 8.01 | 4.56 | | |
| NT2RP3001176 | 3.49 | 3.49 | 10.75 | 6.27 | 8.23 | 9.49 | | |
| NT2RP3001195 | 2.35 | 2.35 | 4.81 | 6.79 | 5.79 | 6.22 | * | + |
| NT2RP3001209 | 3.47 | 3.47 | 5.98 | 5.96 | 4.64 | 5.22 | | |
| NT2RP3001214 | 1.63 | 1.63 | 4.91 | 3.44 | 3.87 | 3.81 | | |
| NT2RP3001216 | 3.58 | 3.58 | 6.38 | 6.25 | 4.33 | 3.6 | | |
| NT2RP3001221 | 3.33 | 3.33 | 4.27 | 3.07 | 3.06 | 1.79 | | |
| NT2RP3001226 | 5.96 | 5.96 | 29.04 | 21.93 | 31.45 | 17.76 | | |
| NT2RP3001230 | 3.17 | 3.17 | 2.41 | 3.09 | 3.14 | 1.56 | | |
| NT2RP3001232 | 1.8 | 1.8 | 4.72 | 2.36 | 3.7 | 2.85 | | |
| NT2RP3001236 | 1.68 | 1.68 | 4.3 | 1.7 | 3.26 | 1.47 | | |
| NT2RP3001239 | 1.58 | 1.58 | 5.21 | 2.81 | 4.31 | 2.01 | | |
| NT2RP3001240 | 12.83 | 12.83 | 22.18 | 23.01 | 24.3 | 14.46 | | |
| NT2RP3001245 | 3.53 | 3.53 | 9.88 | 4.08 | 6.36 | 3.39 | | |
| NT2RP3001253 | 2.79 | 2.79 | 4.87 | 3.34 | 4.53 | 5.21 | | |
| NT2RP3001259 | 6.62 | 6.62 | 11.97 | 12.33 | 15.62 | 11.83 | | |
| NT2RP3001260 | 3.74 | 3.74 | 5.15 | 3.45 | 5.44 | 3.97 | | |
| NT2RP3001264 | 2.2 | 2.2 | 10.29 | 5.99 | 6.92 | 6.38 | | |
| NT2RP3001268 | 2.25 | 2.25 | 7.18 | 4.93 | 4.72 | 4.35 | | |
| NT2RP3001271 | 7.06 | 7.06 | 16.29 | 13.07 | 12.27 | 14.24 | | |
| NT2RP3001272 | 3.73 | 3.73 | 12.45 | 9.43 | 11.09 | 10.15 | | |
| NT2RP3001274 | 6.08 | 6.08 | 8.09 | 6.72 | 6.35 | 5.11 | | |
| NT2RP3001275 | 9.78 | 9.78 | 11.58 | 21.56 | 26.84 | 22.59 | ** | + |
| NT2RP3001280 | 3.39 | 3.39 | 5.5 | 3.58 | 5.24 | 4.18 | | |
| NT2RP3001281 | 3.15 | 3.15 | 3.89 | 3.08 | 4.48 | 5.14 | | |
| NT2RP3001288 | 49.31 | 49.31 | 103.24 | 124.07 | 142.92 | 164.41 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3001297 | 6.39 | 6.39 | 42.01 | 37.04 | 42.75 | 41.14 | | |
| NT2RP3001300 | 5.23 | 5.23 | 15.92 | 16.78 | 17.41 | 17.76 | | |
| NT2RP3001301 | 2.91 | 2.91 | 6.59 | 3.96 | 4.58 | 3.9 | | |
| NT2RP3001307 | 1.76 | 1.76 | 7.67 | 2.07 | 2.81 | 2.06 | | |
| NT2RP3001310 | 11.55 | 11.55 | 17.04 | 25.54 | 26.07 | 28.13 | ** | + |
| NT2RP3001318 | 2.11 | 2.11 | 3.4 | 2.49 | 3.37 | 2.37 | | |
| NT2RP3001322 | 3.58 | 3.58 | 5.23 | 2.62 | 3.84 | 5.48 | | |
| NT2RP3001325 | 2.7 | 2.7 | 8.39 | 5.82 | 6.82 | 5.58 | | |
| NT2RP3001338 | 2.67 | 2.67 | 6.19 | 4.1 | 4.21 | 3.5 | | |
| NT2RP3001339 | 2.53 | 2.53 | 5.64 | 3.08 | 4.89 | 2.91 | | |
| NT2RP3001340 | 2.9 | 2.9 | 8.42 | 6.36 | 7.07 | 5.79 | | |
| NT2RP3001341 | 2.26 | 2.26 | 6.97 | 5.1 | 5.62 | 4.73 | | |
| NT2RP3001354 | 3.22 | 3.22 | 9.77 | 4.28 | 6.93 | 9.35 | | |
| NT2RP3001355 | 1.9 | 1.9 | 5.41 | 2.65 | 3.82 | 2.74 | | |
| NT2RP3001356 | 2 | 2 | 5.34 | 2.59 | 3.2 | 3.55 | | |
| NT2RP3001359 | 1.09 | 1.09 | 4.05 | 1.63 | 2.5 | 1.75 | | |
| NT2RP3001364 | 2.34 | 2.34 | 5.31 | 3.26 | 6.67 | 2.67 | | |
| NT2RP3001373 | 1.12 | 1.12 | 3.22 | 2.1 | 3.74 | 1.71 | | |
| NT2RP3001374 | 1.9 | 1.9 | 4.17 | 3.18 | 3.92 | 3.1 | | |
| NT2RP3001383 | 3.84 | 3.84 | 8.96 | 3.92 | 6.65 | 3.85 | | |
| NT2RP3001384 | 4.11 | 4.11 | 9.47 | 3.54 | 4.46 | 2.41 | | |
| NT2RP3001388 | 3.98 | 3.98 | 8.79 | 9.48 | 10.99 | 9.4 | | |
| NT2RP3001392 | 4.61 | 4.61 | 6.19 | 3.91 | 6.14 | 3.23 | | |
| NT2RP3001396 | 1.7 | 1.7 | 6.39 | 4.04 | 4.66 | 4.53 | | |
| NT2RP3001398 | 2.51 | 2.51 | 6.55 | 3.85 | 7.05 | 2.94 | | |
| NT2RP3001399 | 4.91 | 4.91 | 20.67 | 15.86 | 16.12 | 12.44 | | |
| NT2RP3001402 | 6.46 | 6.46 | 36.36 | 33.37 | 41.61 | 39.66 | | |
| NT2RP3001407 | 6.96 | 6.96 | 19.16 | 13.69 | 17.65 | 12.35 | | |
| NT2RP3001416 | 7.92 | 7.92 | 15.88 | 13.02 | 18.3 | 14.72 | | |
| NT2RP3001420 | 5.33 | 5.33 | 6.4 | 3.27 | 3.64 | 1.8 | * | – |
| NT2RP3001425 | 3.73 | 3.73 | 4.92 | 4.74 | 5.67 | 3.15 | | |
| NT2RP3001426 | 2.39 | 2.39 | 6.08 | 5.45 | 4.45 | 5.11 | | |
| NT2RP3001427 | 1.82 | 1.82 | 5.61 | 3.46 | 2.89 | 3.59 | | |
| NT2RP3001428 | 2.42 | 2.42 | 6.29 | 5.69 | 4.81 | 3.77 | | |
| NT2RP3001429 | 3.08 | 3.08 | 5.91 | 4.15 | 7.37 | 4.73 | | |
| NT2RP3001432 | 2.14 | 2.14 | 6.61 | 3.72 | 4.44 | 3.58 | | |
| NT2RP3001439 | 4.14 | 4.14 | 6.39 | 5.87 | 7.27 | 4.41 | | |
| NT2RP3001441 | 6.45 | 6.45 | 12.63 | 11.13 | 14.61 | 11.2 | | |
| NT2RP3001446 | 4.99 | 4.99 | 4.99 | 4.64 | 5.22 | 4.39 | | |
| NT2RP3001447 | 2.72 | 2.72 | 5.21 | 6.64 | 5.14 | 6.33 | | |
| NT2RP3001449 | 3.95 | 3.95 | 11.85 | 16.9 | 14.57 | 13.16 | * | + |
| NT2RP3001453 | 1.84 | 1.84 | 3.66 | 3.5 | 4.4 | 2.81 | | |
| NT2RP3001457 | 3.86 | 3.86 | 7.71 | 6.06 | 6.93 | 5.5 | | |
| NT2RP3001459 | 2.39 | 2.39 | 6.03 | 2.64 | 2.78 | 1.17 | | |
| NT2RP3001463 | 2.77 | 2.77 | 6.74 | 5.93 | 5.94 | 3.98 | | |
| NT2RP3001466 | 2.87 | 2.87 | 3.56 | 1.19 | 1.43 | 0.78 | ** | – |
| NT2RP3001472 | 5.74 | 5.74 | 4.02 | 3.7 | 4.85 | 4.32 | | |
| NT2RP3001475 | 3.54 | 3.54 | 7.61 | 6.91 | 6.65 | 7.39 | | |
| NT2RP3001479 | 2.54 | 2.54 | 6.66 | 4.37 | 5.69 | 5.16 | | |
| NT2RP3001490 | 3.18 | 3.18 | 9.26 | 4.4 | 6.02 | 5.21 | | |
| NT2RP3001492 | 4.36 | 4.36 | 7.84 | 7.59 | 7.08 | 5.72 | | |
| NT2RP3001495 | 4.14 | 4.14 | 3.85 | 2.75 | 2.92 | 1.76 | * | – |
| NT2RP3001497 | 5.8 | 5.8 | 6.32 | 7.47 | 9.96 | 6.8 | | |
| NT2RP3001501 | 5.36 | 5.36 | 5.52 | 3.12 | 4.49 | 3.43 | * | – |
| NT2RP3001527 | 4.89 | 4.89 | 6.71 | 4.9 | 5.14 | 3.52 | | |
| NT2RP3001529 | 1.51 | 1.51 | 3.5 | 4.12 | 3.95 | 4.18 | * | + |
| NT2RP3001538 | 1.78 | 1.78 | 6.2 | 6.93 | 7.81 | 6.23 | | |
| NT2RP3001539 | 5.81 | 5.81 | 14.5 | 15.19 | 14.15 | 16.47 | | |
| NT2RP3001542 | 1.52 | 1.52 | 5.26 | 4.23 | 4.38 | 2.13 | | |
| NT2RP3001549 | 4.75 | 4.75 | 11.12 | 14.57 | 11.37 | 13.44 | | |
| NT2RP3001554 | 3.06 | 3.06 | 6.16 | 6.37 | 7.5 | 5.05 | | |
| NT2RP3001560 | 4.96 | 4.96 | 5.73 | 4.67 | 6.35 | 2.36 | | |
| NT2RP3001561 | 8.85 | 8.85 | 20.77 | 20.38 | 27.2 | 17.15 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3001564 | 1.54 | 1.54 | 8.24 | 6.43 | 4.53 | 5.96 | | |
| NT2RP3001568 | 2.1 | 2.1 | 7.68 | 11.84 | 10.29 | 8.49 | * | + |
| NT2RP3001575 | 3.94 | 3.94 | 7.24 | 6.39 | 6.97 | 6.16 | | |
| NT2RP3001580 | 1.78 | 1.78 | 4.49 | 4.35 | 3.8 | 3.11 | | |
| NT2RP3001587 | 4.38 | 4.38 | 8.74 | 10.75 | 10.04 | 7.77 | | |
| NT2RP3001589 | 3.17 | 3.17 | 8.21 | 5.6 | 7.79 | 4.36 | | |
| NT2RP3001592 | 4.52 | 4.52 | 21.6 | 19 | 32.62 | 14.54 | | |
| NT2RP3001607 | 3.42 | 3.42 | 1.86 | 1.59 | 2.8 | 1 | | |
| NT2RP3001608 | 1.05 | 1.05 | 3.59 | 2.41 | 1.73 | 2.31 | | |
| NT2RP3001613 | 3.08 | 3.08 | 2.77 | 3.89 | 2.91 | 3.99 | | |
| NT2RP3001619 | 4.31 | 4.31 | 8.15 | 7.69 | 6.45 | 7.62 | | |
| NT2RP3001621 | 1.18 | 1.18 | 2.69 | 2.39 | 2.28 | 2.02 | | |
| NT2RP3001629 | 2.58 | 2.58 | 3.28 | 2.68 | 2.41 | 1.7 | | |
| NT2RP3001630 | 3.39 | 3.39 | 4.56 | 1.67 | 2.02 | 1.17 | ** | − |
| NT2RP3001631 | 9.01 | 9.01 | 14.34 | 18.65 | 21.16 | 15.24 | * | + |
| NT2RP3001634 | 4 | 4 | 5.29 | 4.51 | 6.89 | 5.11 | | |
| NT2RP3001642 | 3.71 | 3.71 | 7.45 | 5.77 | 4.41 | 5.09 | | |
| NT2RP3001646 | 1.56 | 1.56 | 3.7 | 0.89 | 2.79 | 0.95 | | |
| NT2RP3001650 | 2.06 | 2.06 | 5.81 | 4.86 | 7.03 | 2.08 | | |
| NT2RP3001667 | 4.66 | 4.66 | 11.91 | 6.93 | 9.95 | 5.13 | | |
| NT2RP3001671 | 2.28 | 2.28 | 7.98 | 7.7 | 4.69 | 5.99 | | |
| NT2RP3001672 | 1.33 | 1.33 | 4.55 | 1.66 | 1.47 | 1.72 | | |
| NT2RP3001676 | 2.18 | 2.18 | 5.02 | 2.35 | 3.14 | 2.24 | | |
| NT2RP3001678 | 2.86 | 2.86 | 9.24 | 5.12 | 5.14 | 6.03 | | |
| NT2RP3001679 | 6.12 | 6.12 | 9.19 | 6.74 | 4.73 | 6.91 | | |
| NT2RP3001682 | 1.82 | 1.82 | 5.09 | 4.45 | 6.18 | 3.35 | | |
| NT2RP3001685 | 3.02 | 3.02 | 6.74 | 3.52 | 6.53 | 3.01 | | |
| NT2RP3001688 | 3.01 | 3.01 | 9.42 | 5.46 | 8.21 | 6.43 | | |
| NT2RP3001690 | 3.21 | 3.21 | 4.87 | 2.91 | 3.54 | 2.99 | | |
| NT2RP3001693 | 5.69 | 5.69 | 10.93 | 16.59 | 18.34 | 16.12 | ** | + |
| NT2RP3001696 | 2.28 | 2.28 | 3.63 | 1.77 | 3.68 | 3.39 | | |
| NT2RP3001698 | 35.35 | 35.35 | 79.65 | 85.09 | 91.88 | 105.32 | | |
| NT2RP3001708 | 4.82 | 4.82 | 8.78 | 6.34 | 6.95 | 9.01 | | |
| NT2RP3001712 | 8.69 | 8.69 | 16.06 | 10.22 | 14.19 | 13 | | |
| NT2RP3001716 | 1.44 | 1.44 | 5.45 | 2.14 | 3.42 | 2.31 | | |
| NT2RP3001724 | 2.75 | 2.75 | 6 | 4.08 | 4.54 | 2.63 | | |
| NT2RP3001727 | 11.73 | 11.73 | 38.73 | 39.17 | 49.36 | 31.26 | | |
| NT2RP3001729 | 3.36 | 3.36 | 4.7 | 5.69 | 6.55 | 3.06 | | |
| NT2RP3001730 | 12.54 | 12.54 | 26.52 | 12.53 | 19.94 | 16.4 | | |
| NT2RP3001733 | 1.46 | 1.46 | 3.04 | 2.09 | 3.7 | 1.62 | | |
| NT2RP3001737 | 3.02 | 3.02 | 7.12 | 4.62 | 5.49 | 2.78 | | |
| NT2RP3001738 | 1.59 | 1.59 | 8.22 | 3.38 | 6.01 | 3.03 | | |
| NT2RP3001739 | 3.26 | 3.26 | 5.25 | 5.63 | 6.1 | 2.51 | | |
| NT2RP3001742 | 2.54 | 2.54 | 5.36 | 3.86 | 4.55 | 4.03 | | |
| NT2RP3001751 | 3.61 | 3.61 | 11.54 | 9.94 | 12.82 | 8.76 | | |
| NT2RP3001752 | 2.58 | 2.58 | 7.01 | 2.1 | 3.59 | 2.76 | | |
| NT2RP3001753 | 5.73 | 5.73 | 9.48 | 10.83 | 15.3 | 13.69 | * | + |
| NT2RP3001754 | 4.63 | 4.63 | 9.08 | 5.86 | 3.73 | 5.33 | | |
| NT2RP3001756 | 4.66 | 4.66 | 7.36 | 9.37 | 5.75 | 8.03 | | |
| NT2RP3001764 | 2.1 | 2.1 | 3.76 | 2.54 | 4.25 | 2.49 | | |
| NT2RP3001771 | 2.63 | 2.63 | 3.2 | 1.52 | 4.14 | 1.22 | | |
| NT2RP3001777 | 2.59 | 2.59 | 5.99 | 3.25 | 5.19 | 3.26 | | |
| NT2RP3001782 | 3.52 | 3.52 | 14.68 | 6.47 | 6.63 | 6.47 | | |
| NT2RP3001792 | 2.27 | 2.27 | 4.35 | 2.91 | 4.09 | 1.35 | | |
| NT2RP3001799 | 1.76 | 1.76 | 5.18 | 5.71 | 6.36 | 5.68 | | |
| NT2RP3001819 | 1.36 | 1.36 | 4.54 | 1.7 | 1.52 | 2.06 | | |
| NT2RP3001829 | 21.63 | 21.63 | 43.14 | 35.64 | 17.14 | 24.87 | | |
| NT2RP3001836 | 7.31 | 7.31 | 10.67 | 15.24 | 7.26 | 11.37 | | |
| NT2RP3001839 | 18.86 | 18.86 | 31.77 | 31.97 | 19.23 | 17.53 | | |
| NT2RP3001844 | 4.15 | 4.15 | 11.37 | 8.33 | 9.59 | 8.54 | | |
| NT2RP3001848 | 9.61 | 9.61 | 52.04 | 44.52 | 74.75 | 43.87 | | |
| NT2RP3001854 | 6.41 | 6.41 | 11.29 | 12.86 | 16.75 | 13.26 | * | + |
| NT2RP3001855 | 2.27 | 2.27 | 3.94 | 1.87 | 1 | 1.74 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and −, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3001857 | 3.1 | 3.1 | 5.22 | 5.13 | 5.6 | 3.33 | | |
| NT2RP3001858 | 1.53 | 1.53 | 4.45 | 4.41 | 6.04 | 2.97 | | |
| NT2RP3001861 | 7.35 | 7.35 | 16.34 | 11.85 | 14.46 | 10.42 | | |
| NT2RP3001866 | 4.35 | 4.35 | 9.63 | 5.52 | 10.42 | 7.93 | | |
| NT2RP3001871 | 4.82 | 4.82 | 6.34 | 5.55 | 6.38 | 4.55 | | |
| NT2RP3001874 | 6.8 | 6.8 | 9.73 | 7.72 | 11.19 | 6.14 | | |
| NT2RP3001878 | 5.98 | 5.98 | 6.35 | 4.59 | 6.89 | 5.02 | | |
| NT2RP3001885 | 3.21 | 3.21 | 5.3 | 5.65 | 5.25 | 4.42 | | |
| NT2RP3001896 | 1.64 | 1.64 | 3.49 | 3.37 | 2.13 | 2.02 | | |
| NT2RP3001898 | 9.03 | 9.03 | 17.69 | 14.71 | 8.69 | 11.94 | | |
| NT2RP3001899 | 3.21 | 3.21 | 7.33 | 4.52 | 6.9 | 5.81 | | |
| NT2RP3001901 | 4.58 | 4.58 | 9.18 | 8.19 | 9.44 | 9.21 | | |
| NT2RP3001915 | 4.84 | 4.84 | 11.12 | 14.09 | 15.67 | 14.04 | * | + |
| NT2RP3001926 | 2.8 | 2.8 | 4.88 | 2.47 | 2.45 | 1.65 | | |
| NT2RP3001929 | 3.74 | 3.74 | 4.06 | 2.56 | 3.38 | 0.86 | | |
| NT2RP3001931 | 4.63 | 4.63 | 5.26 | 3.9 | 5.62 | 2.98 | | |
| NT2RP3001938 | 2.27 | 2.27 | 5.53 | 4.93 | 3.93 | 4.75 | | |
| NT2RP3001943 | 3.27 | 3.27 | 5.36 | 5.77 | 6.5 | 5.56 | | |
| NT2RP3001944 | 1.77 | 1.77 | 3.72 | 4.08 | 5.91 | 4.34 | | |
| NT2RP3001945 | 4.25 | 4.25 | 12.2 | 11.86 | 11.78 | 6.11 | | |
| NT2RP3001947 | 2.94 | 2.94 | 5.89 | 4.06 | 5.41 | 3.4 | | |
| NT2RP3001949 | 4.21 | 4.21 | 8.9 | 10.49 | 11.08 | 8.08 | | |
| NT2RP3001952 | 23.54 | 23.54 | 43.64 | 48.59 | 88.56 | 41.86 | | |
| NT2RP3001954 | 5.06 | 5.06 | 3.68 | 4.34 | 4.79 | 1.85 | | |
| NT2RP3001956 | 4.97 | 4.97 | 9.44 | 7.76 | 8.22 | 6.29 | | |
| NT2RP3001967 | 3.78 | 3.78 | 7.74 | 6.7 | 5.37 | 5.66 | | |
| NT2RP3001969 | 1.71 | 1.71 | 2.91 | 4.05 | 4.39 | 3.62 | * | + |
| NT2RP3001976 | 2.25 | 2.25 | 4.67 | 6.22 | 6.25 | 4.84 | * | + |
| NT2RP3001986 | 3.55 | 3.55 | 3.88 | 3.43 | 2.82 | 2.19 | | |
| NT2RP3001989 | 3.76 | 3.76 | 5.23 | 2.86 | 3.58 | 2.54 | | |
| NT2RP3002002 | 6.68 | 6.68 | 9.47 | 6.25 | 8.85 | 3.86 | | |
| NT2RP3002004 | 5.02 | 5.02 | 6.23 | 3.79 | 5.74 | 3.55 | | |
| NT2RP3002007 | 1.29 | 1.29 | 2.3 | 3.46 | 4.05 | 1.69 | | |
| NT2RP3002014 | 1.38 | 1.38 | 6.23 | 6.04 | 6.24 | 4.21 | | |
| NT2RP3002015 | 3.61 | 3.61 | 10.33 | 14.17 | 9.94 | 8.85 | | |
| NT2RP3002033 | 1.54 | 1.54 | 5.03 | 7.29 | 5.03 | 3.65 | | |
| NT2RP3002045 | 1.89 | 1.89 | 5.29 | 4.67 | 4.36 | 2.5 | | |
| NT2RP3002054 | 5.26 | 5.26 | 8.12 | 6.27 | 9.17 | 5.42 | | |
| NT2RP3002056 | 5.67 | 5.67 | 5.52 | 4.24 | 4.24 | 2.7 | * | − |
| NT2RP3002057 | 4.35 | 4.35 | 3.5 | 2.87 | 2.41 | 0.81 | * | − |
| NT2RP3002061 | 4.71 | 4.71 | 13.94 | 8.64 | 8.9 | 10.74 | | |
| NT2RP3002062 | 0.8 | 0.8 | 2.42 | 3.58 | 3.26 | 1.11 | | |
| NT2RP3002063 | 5.61 | 5.61 | 10.31 | 9.29 | 9.3 | 7.31 | | |
| NT2RP3002064 | 2.6 | 2.6 | 3.37 | 2.72 | 3.74 | 2.52 | | |
| NT2RP3002071 | 1.6 | 1.6 | 3.91 | 1.99 | 3.29 | 1.45 | | |
| NT2RP3002073 | 6.47 | 6.47 | 9.55 | 10.45 | 11.13 | 8.64 | | |
| NT2RP3002074 | 4.2 | 4.2 | 7.25 | 6.33 | 7.82 | 4.24 | | |
| NT2RP3002075 | 7.58 | 7.58 | 11.93 | 21.64 | 30.17 | 18.15 | * | + |
| NT2RP3002077 | 3.81 | 3.81 | 5.95 | 2.48 | 3.05 | 2.78 | | |
| NT2RP3002081 | 4.25 | 4.25 | 7.55 | 13.22 | 12.62 | 11.13 | ** | + |
| NT2RP3002086 | 3.86 | 3.86 | 9.77 | 5.59 | 8.66 | 6.95 | | |
| NT2RP3002094 | 7.34 | 7.34 | 10.28 | 13.84 | 14.79 | 11.67 | * | + |
| NT2RP3002096 | 1.98 | 1.98 | 4.53 | 1.28 | 3.12 | 1.73 | | |
| NT2RP3002097 | 3.77 | 3.77 | 6.16 | 6.1 | 8.34 | 6.88 | | |
| NT2RP3002098 | 1.61 | 1.61 | 4.3 | 1.04 | 1.8 | 1.46 | | |
| NT2RP3002102 | 2 | 2 | 4.86 | 3.11 | 3.4 | 3.16 | | |
| NT2RP3002106 | 2.74 | 2.74 | 4.98 | 2.83 | 4.9 | 2.51 | | |
| NT2RP3002108 | 3.69 | 3.69 | 7.8 | 3.11 | 3.39 | 3.15 | | |
| NT2RP3002109 | 12.49 | 12.49 | 32.04 | 31.61 | 27.15 | 25.12 | | |
| NT2RP3002110 | 36.38 | 36.38 | 54.93 | 55.24 | 58.94 | 46.55 | | |
| NT2RP3002113 | 11.15 | 11.15 | 13.99 | 10.66 | 15.22 | 11.44 | | |
| NT2RP3002120 | 2.22 | 2.22 | 4.42 | 2.31 | 4.13 | 2.7 | | |
| NT2RP3002121 | 5.93 | 5.93 | 14.39 | 13.38 | 14.39 | 15.06 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and −, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3002126 | 34.03 | 34.03 | 108.96 | 121.18 | 130.55 | 142.49 | * | + |
| NT2RP3002128 | 4.06 | 4.06 | 8.23 | 3.36 | 6.87 | 3.92 | | |
| NT2RP3002130 | 8.29 | 8.29 | 18.59 | 11.69 | 10.7 | 14.03 | | |
| NT2RP3002133 | 14.24 | 14.24 | 18.31 | 10.06 | 8.3 | 19.51 | | |
| NT2RP3002136 | 10.32 | 10.32 | 15.42 | 12.49 | 17.64 | 17.49 | | |
| NT2RP3002140 | 3.13 | 3.13 | 6.35 | 6.15 | 3.9 | 4.16 | | |
| NT2RP3002142 | 16.86 | 16.86 | 50.85 | 56.54 | 81.25 | 62.65 | * | + |
| NT2RP3002146 | 4 | 4 | 7.22 | 5.14 | 9.31 | 6.56 | | |
| NT2RP3002147 | 3.8 | 3.8 | 10.45 | 6.06 | 7.4 | 6.2 | | |
| NT2RP3002151 | 5.62 | 5.62 | 10.64 | 6.27 | 4.43 | 7.33 | | |
| NT2RP3002155 | 1.62 | 1.62 | 3.27 | 2.01 | 4.98 | 0.8 | | |
| NT2RP3002156 | 3.15 | 3.15 | 4.82 | 2.55 | 4.08 | 2.42 | | |
| NT2RP3002160 | 1.57 | 1.57 | 3.43 | 1.36 | 3.43 | 1.56 | | |
| NT2RP3002163 | 20.86 | 20.86 | 55.1 | 35.13 | 44.03 | 32.6 | | |
| NT2RP3002165 | 4.17 | 4.17 | 3.67 | 6.21 | 8.31 | 4.86 | | |
| NT2RP3002166 | 4.04 | 4.04 | 10.53 | 7.76 | 8.79 | 5.58 | | |
| NT2RP3002173 | 2.24 | 2.24 | 5.75 | 2.95 | 3.34 | 3.53 | | |
| NT2RP3002174 | 8.41 | 8.41 | 15.8 | 13.21 | 7.82 | 14.77 | | |
| NT2RP3002181 | 1.1 | 1.1 | 3.46 | 1.87 | 3.51 | 1.61 | | |
| NT2RP3002185 | 2.69 | 2.69 | 4.51 | 2.94 | 4.35 | 2.61 | | |
| NT2RP3002193 | 5.51 | 5.51 | 13.38 | 16.39 | 15.35 | 11.36 | | |
| NT2RP3002204 | 5.66 | 5.66 | 12.49 | 17.04 | 24.14 | 18.95 | * | + |
| NT2RP3002244 | 4.03 | 4.03 | 8.29 | 5.28 | 6.11 | 4.8 | | |
| NT2RP3002248 | 5.42 | 5.42 | 11.1 | 8.19 | 11.78 | 6.52 | | |
| NT2RP3002253 | 2.61 | 2.61 | 9.3 | 9.66 | 11.26 | 6.18 | | |
| NT2RP3002255 | 11.07 | 11.07 | 26.56 | 22.78 | 11.53 | 20.93 | | |
| NT2RP3002264 | 3.06 | 3.06 | 5.54 | 5.88 | 7.37 | 4.07 | | |
| NT2RP3002267 | 1.26 | 1.26 | 4.33 | 3.1 | 4.65 | 1.82 | | |
| NT2RP3002273 | 7.51 | 7.51 | 12.98 | 10.15 | 13.8 | 12.11 | | |
| NT2RP3002276 | 5.22 | 5.22 | 7.89 | 3.08 | 7.68 | 3.48 | | |
| NT2RP3002281 | 6.37 | 6.37 | 6.83 | 7.45 | 8.46 | 3.44 | | |
| NT2RP3002286 | 3 | 3 | 4.79 | 3.54 | 4.34 | 3.88 | | |
| NT2RP3002297 | 10.62 | 10.62 | 29.36 | 22.26 | 20.57 | 23.93 | | |
| NT2RP3002301 | 5.73 | 5.73 | 13.24 | 9.47 | 7.55 | 6.21 | | |
| NT2RP3002303 | 3.01 | 3.01 | 6.39 | 5.29 | 6.65 | 4.58 | | |
| NT2RP3002304 | 2.66 | 2.66 | 7.17 | 6.3 | 7.3 | 4.91 | | |
| NT2RP3002309 | 2.3 | 2.3 | 7.18 | 9.26 | 13 | 4.39 | | |
| NT2RP3002311 | 4.54 | 4.54 | 6.67 | 3.17 | 4.02 | 1.83 | | |
| NT2RP3002315 | 15.27 | 15.27 | 20.91 | 25.82 | 33.13 | 21.82 | | |
| NT2RP3002319 | 2.37 | 2.37 | 5.06 | 3.07 | 3.51 | 2.38 | | |
| NT2RP3002324 | 8.97 | 8.97 | 61.42 | 49.85 | 51.23 | 55.4 | | |
| NT2RP3002330 | 4.74 | 4.74 | 8.33 | 10.31 | 8.24 | 8.15 | | |
| NT2RP3002333 | 5.13 | 5.13 | 14.32 | 13.14 | 13.65 | 8.12 | | |
| NT2RP3002337 | 2.61 | 2.61 | 5.14 | 4.8 | 5.57 | 4.87 | | |
| NT2RP3002342 | 5.16 | 5.16 | 11.56 | 5.52 | 7.51 | 6.43 | | |
| NT2RP3002343 | 3.38 | 3.38 | 7.29 | 5.8 | 7.03 | 4.13 | | |
| NT2RP3002351 | 4.32 | 4.32 | 4.55 | 4.38 | 3.9 | 2.55 | | |
| NT2RP3002352 | 6.3 | 6.3 | 8.01 | 4.4 | 6.76 | 4.31 | | |
| NT2RP3002353 | 3 | 3 | 4.85 | 4.87 | 6.18 | 5.9 | | |
| NT2RP3002362 | 5 | 5 | 11.74 | 15.86 | 11.03 | 10.49 | | |
| NT2RP3002363 | 2.41 | 2.41 | 3.67 | 5.53 | 6.17 | 2.32 | | |
| NT2RP3002377 | 2.61 | 2.61 | 5.47 | 6.8 | 7.31 | 4.73 | | |
| NT2RP3002377 | 4.47 | 4.47 | 7.73 | 11.4 | 5.31 | 7.09 | | |
| NT2RP3002394 | 5.58 | 5.58 | 7.35 | 7.82 | 10.17 | 4.46 | | |
| NT2RP3002397 | 3.77 | 3.77 | 4.81 | 2.7 | 3.12 | 1.68 | * | − |
| NT2RP3002399 | 4.61 | 4.61 | 7.69 | 14.65 | 13.02 | 16.16 | ** | + |
| NT2RP3002402 | 2.84 | 2.84 | 6.99 | 8.94 | 8.7 | 6.99 | | |
| NT2RP3002404 | 2.88 | 2.88 | 5.6 | 3.12 | 3.73 | 1.83 | | |
| NT2RP3002410 | 4.85 | 4.85 | 15.65 | 17.05 | 14.13 | 10.65 | | |
| NT2RP3002411 | 2.98 | 2.98 | 5.68 | 3.7 | 5.29 | 2.85 | | |
| NT2RP3002414 | 5.62 | 5.62 | 9.35 | 10.28 | 6.81 | 7.92 | | |
| NT2RP3002430 | 5.11 | 5.11 | 14.63 | 18.24 | 19.29 | 14.51 | | |
| NT2RP3002448 | 5.4 | 5.4 | 4.6 | 4.35 | 5.25 | 3.62 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3002454 | 7.3 | 7.3 | 15.31 | 12.9 | 12.71 | 9.32 | | |
| NT2RP3002455 | 4.62 | 4.62 | 12.11 | 14.31 | 9.11 | 13.25 | | |
| NT2RP3002456 | 3.21 | 3.21 | 7.75 | 7.09 | 6.57 | 5.9 | | |
| NT2RP3002462 | 2.79 | 2.79 | 4.16 | 4.94 | 6.17 | 4.79 | * | + |
| NT2RP3002469 | 3.84 | 3.84 | 6.38 | 9.24 | 6.78 | 8.07 | * | + |
| NT2RP3002470 | 6.7 | 6.7 | 14.71 | 17.86 | 16.99 | 13.48 | | |
| NT2RP3002484 | 4.01 | 4.01 | 6.86 | 6.81 | 8.01 | 4.59 | | |
| NT2RP3002491 | 3.62 | 3.62 | 4.1 | 2.05 | 2.51 | 1.46 | ** | − |
| NT2RP3002494 | 79.24 | 79.24 | 131.02 | 118.47 | 163.2 | 105.2 | | |
| NT2RP3002497 | 1.07 | 1.07 | 1.57 | 2.37 | 1.39 | 1.37 | | |
| NT2RP3002500 | 1.23 | 1.23 | 1.13 | 2.72 | 2.02 | 2.07 | ** | + |
| NT2RP3002501 | 5.25 | 5.25 | 8.49 | 8.45 | 8.11 | 9.69 | | |
| NT2RP3002512 | 2.85 | 2.85 | 3.97 | 3.3 | 2.74 | 3.57 | | |
| NT2RP3002529 | 3.94 | 3.94 | 7.5 | 6.59 | 5.14 | 5.85 | | |
| NT2RP3002533 | 7.95 | 7.95 | 10.26 | 9.79 | 10.51 | 8.18 | | |
| NT2RP3002539 | 4.39 | 4.39 | 4.32 | 5.66 | 6.61 | 2.85 | | |
| NT2RP3002540 | 5.24 | 5.24 | 5.5 | 3.48 | 4.76 | 3.65 | * | − |
| NT2RP3002543 | 3.44 | 3.44 | 7.17 | 4.93 | 6.21 | 5.31 | | |
| NT2RP3002545 | 7.34 | 7.34 | 7.46 | 5.17 | 5.52 | 6.8 | * | − |
| NT2RP3002549 | 3.27 | 3.27 | 7.8 | 4.98 | 6.11 | 4.54 | | |
| NT2RP3002552 | 3.05 | 3.05 | 6.04 | 4.17 | 5.81 | 4.06 | | |
| NT2RP3002558 | 9.54 | 9.54 | 9.39 | 9.93 | 4.26 | 11.27 | | |
| NT2RP3002565 | 1.94 | 1.94 | 4.83 | 1.73 | 2.48 | 1.52 | | |
| NT2RP3002566 | 3.62 | 3.62 | 7.02 | 4.03 | 8.51 | 3.65 | | |
| NT2RP3002571 | 2.53 | 2.53 | 4.85 | 3.77 | 5.41 | 3.74 | | |
| NT2RP3002572 | 2.98 | 2.98 | 5.28 | 4.75 | 4.74 | 5.21 | | |
| NT2RP3002573 | 4.31 | 4.31 | 11.38 | 7.06 | 9.48 | 7.06 | | |
| NT2RP3002577 | 1.57 | 1.57 | 4.61 | 2.71 | 2.32 | 1.9 | | |
| NT2RP3002579 | 3.92 | 3.92 | 6.41 | 4.03 | 7.75 | 11.16 | | |
| NT2RP3002582 | 5.02 | 5.02 | 7.17 | 11.51 | 14.07 | 8.45 | * | + |
| NT2RP3002587 | 1.9 | 1.9 | 3.13 | 2.68 | 3.04 | 1.97 | | |
| NT2RP3002590 | 3.16 | 3.16 | 5.65 | 9.06 | 10.39 | 8.06 | ** | + |
| NT2RP3002602 | 3.02 | 3.02 | 4.24 | 3.95 | 5.85 | 3.77 | | |
| NT2RP3002603 | 71.53 | 71.53 | 214.41 | 268.41 | 257.84 | 298.26 | * | + |
| NT2RP3002621 | 1.95 | 1.95 | 3.42 | 2.13 | 5.13 | 1.85 | | |
| NT2RP3002622 | 2.63 | 2.63 | 7.38 | 3.7 | 7.36 | 4.67 | | |
| NT2RP3002624 | 2.29 | 2.29 | 7.4 | 4.04 | 4.9 | 3.64 | | |
| NT2RP3002628 | 6.36 | 6.36 | 16.17 | 19.57 | 22.15 | 16.21 | | |
| NT2RP3002629 | 8.96 | 8.96 | 13.58 | 15.4 | 18.26 | 15.57 | * | + |
| NT2RP3002631 | 1.95 | 1.95 | 1.67 | 0.91 | 1.65 | 1.69 | | |
| NT2RP3002647 | 4.04 | 4.04 | 4.01 | 5.44 | 7.16 | 4.6 | | |
| NT2RP3002649 | 2.99 | 2.99 | 5.99 | 2.15 | 5.84 | 3.23 | | |
| NT2RP3002650 | 3.32 | 3.32 | 11.62 | 4.98 | 8.53 | 6.88 | | |
| NT2RP3002652 | 2.27 | 2.27 | 6.59 | 4.91 | 6.83 | 4.25 | | |
| NT2RP3002654 | 3.05 | 3.05 | 7.5 | 5.58 | 5.4 | 4.2 | | |
| NT2RP3002657 | 14.14 | 14.14 | 13.87 | 17.27 | 26.08 | 18.87 | | |
| NT2RP3002659 | 1.92 | 1.92 | 6.01 | 3.91 | 5.78 | 3.47 | | |
| NT2RP3002660 | 3.09 | 3.09 | 4.84 | 3.77 | 7.72 | 3.52 | | |
| NT2RP3002663 | 2.39 | 2.39 | 3.33 | 2.54 | 3.13 | 2.84 | | |
| NT2RP3002664 | 2.74 | 2.74 | 7.28 | 3.65 | 2.56 | 2.13 | | |
| NT2RP3002667 | 2.92 | 2.92 | 6.59 | 6.63 | 5.46 | 5.35 | | |
| NT2RP3002671 | 2.37 | 2.37 | 5.02 | 3.91 | 5.52 | 4.11 | | |
| NT2RP3002682 | 6.34 | 6.34 | 20.62 | 14.37 | 17.64 | 21.7 | | |
| NT2RP3002684 | 4 | 4 | 6.34 | 3.32 | 6.16 | 3.18 | | |
| NT2RP3002687 | 3.25 | 3.25 | 6.22 | 2.7 | 3.87 | 6.41 | | |
| NT2RP3002688 | 3.22 | 3.22 | 4.98 | 2.63 | 3.91 | 2.61 | | |
| NT2RP3002698 | 2.2 | 2.2 | 3.99 | 3.07 | 4.28 | 2.38 | | |
| NT2RP3002701 | 2.93 | 2.93 | 6.73 | 3.45 | 3.07 | 3.6 | | |
| NT2RP3002705 | 2.17 | 2.17 | 8.01 | 4.36 | 8.76 | 4.72 | | |
| NT2RP3002708 | 3.69 | 3.69 | 9.88 | 5.64 | 7.34 | 4.9 | | |
| NT2RP3002711 | 6.67 | 6.67 | 7.85 | 7.77 | 7.56 | 6.69 | | |
| NT2RP3002712 | 55.99 | 55.99 | 75.28 | 146.74 | 168.42 | 130.64 | ** | + |
| NT2RP3002713 | 4.31 | 4.31 | 7.06 | 2.66 | 2.19 | 1.87 | * | − |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3002721 | 5.77 | 5.77 | 10.06 | 11.06 | 16.94 | 8.96 | | |
| NT2RP3002722 | 7.11 | 7.11 | 10.08 | 7.8 | 6.45 | 6.62 | | |
| NT2RP3002723 | 42.31 | 42.31 | 75.85 | 60.39 | 46.74 | 58.76 | | |
| NT2RP3002737 | 8.35 | 8.35 | 18.1 | 10.97 | 11.6 | 9.37 | | |
| NT2RP3002738 | 1.9 | 1.9 | 6.13 | 3.09 | 5.23 | 3.54 | | |
| NT2RP3002742 | 14.11 | 14.11 | 23.22 | 30.39 | 28.27 | 27.66 | * | + |
| NT2RP3002744 | 4.09 | 4.09 | 5.24 | 3.92 | 4.92 | 1.71 | | |
| NT2RP3002756 | 5.8 | 5.8 | 5.8 | 3.19 | 2.68 | 1.55 | ** | − |
| NT2RP3002757 | 12 | 12 | 17.79 | 19.76 | 24.24 | 19.75 | * | + |
| NT2RP3002758 | 21.11 | 21.11 | 42.35 | 44.47 | 63.91 | 36.38 | | |
| NT2RP3002762 | 5.07 | 5.07 | 8.82 | 7.21 | 7.43 | 7.76 | | |
| NT2RP3002763 | 1.62 | 1.62 | 4.86 | 3.76 | 4.99 | 2.18 | | |
| NT2RP3002770 | 1.78 | 1.78 | 5.14 | 3.46 | 3.7 | 2.93 | | |
| NT2RP3002771 | 17.04 | 17.04 | 39.53 | 24.93 | 40.21 | 34.4 | | |
| NT2RP3002785 | 2.42 | 2.42 | 5.45 | 3.36 | 4.09 | 2.66 | | |
| NT2RP3002790 | 4.65 | 4.65 | 4.22 | 3.16 | 3.57 | 2.33 | * | − |
| NT2RP3002799 | 4.73 | 4.73 | 6.33 | 3.42 | 2.7 | 1.43 | * | − |
| NT2RP3002801 | 4.14 | 4.14 | 3.59 | 3.6 | 3.22 | 2.49 | | |
| NT2RP3002802 | 2.31 | 2.31 | 6.3 | 6.78 | 5.43 | 4.4 | | |
| NT2RP3002810 | 2.98 | 2.98 | 5.41 | 7.44 | 12.32 | 13.27 | * | + |
| NT2RP3002818 | 1.5 | 1.5 | 2.44 | 2.18 | 4.16 | 2.47 | | |
| NT2RP3002821 | 12.8 | 12.8 | 33.14 | 26.1 | 35.81 | 23.02 | | |
| NT2RP3002823 | 3.85 | 3.85 | 8.98 | 4.65 | 5.92 | 3.87 | | |
| NT2RP3002825 | 5.47 | 5.47 | 13.04 | 13.47 | 19.19 | 7.12 | | |
| NT2RP3002829 | 5.37 | 5.37 | 6.25 | 4.75 | 4.89 | 3.8 | | |
| NT2RP3002831 | 4.01 | 4.01 | 6.13 | 9.07 | 8.77 | 5.19 | | |
| NT2RP3002836 | 7.33 | 7.33 | 19.42 | 11.56 | 16.91 | 20.66 | | |
| NT2RP3002845 | 4.17 | 4.17 | 6.63 | 7.87 | 8.6 | 8.45 | * | + |
| NT2RP3002852 | 3.37 | 3.37 | 7.57 | 7.8 | 8.72 | 8.21 | | |
| NT2RP3002861 | 3.82 | 3.82 | 6.4 | 7.34 | 7.35 | 4.63 | | |
| NT2RP3002869 | 3.66 | 3.66 | 3.26 | 2.49 | 1.86 | 0.49 | * | − |
| NT2RP3002874 | 11.25 | 11.25 | 21.44 | 25.33 | 31.95 | 25.54 | * | + |
| NT2RP3002876 | 6.98 | 6.98 | 11.06 | 12.8 | 14.93 | 14.39 | * | + |
| NT2RP3002877 | 4.7 | 4.7 | 5.96 | 3.3 | 5.24 | 2.53 | | |
| NT2RP3002887 | 0.47 | 0.47 | 3.42 | 2.81 | 3.53 | 3.91 | | |
| NT2RP3002900 | 6.46 | 6.46 | 19.64 | 21.86 | 21.54 | 22.3 | | |
| NT2RP3002902 | 4.01 | 4.01 | 10.25 | 11.72 | 8.52 | 8.06 | | |
| NT2RP3002909 | 2.61 | 2.61 | 6.19 | 6.67 | 5.38 | 3.93 | | |
| NT2RP3002911 | 3.05 | 3.05 | 3.68 | 3.09 | 3.73 | 2.24 | | |
| NT2RP3002948 | 4.09 | 4.09 | 4.81 | 2.73 | 4.44 | 2.07 | | |
| NT2RP3002953 | 3.85 | 3.85 | 3.6 | 2.27 | 2.52 | 0.84 | * | − |
| NT2RP3002955 | 6.55 | 6.55 | 3.78 | 1.93 | 2.47 | 0.86 | * | − |
| NT2RP3002958 | 5.85 | 5.85 | 11.4 | 16.5 | 10.57 | 16.64 | | |
| NT2RP3002969 | 4.28 | 4.28 | 8.27 | 12.91 | 7.49 | 7.33 | | |
| NT2RP3002972 | 3.55 | 3.55 | 4.82 | 4.41 | 6.18 | 2.29 | | |
| NT2RP3002978 | 1.48 | 1.48 | 2.99 | 2.61 | 3.7 | 1.49 | | |
| NT2RP3002983 | 2.89 | 2.89 | 4.69 | 4.46 | 6.12 | 4.37 | | |
| NT2RP3002985 | 4.23 | 4.23 | 17.87 | 13.64 | 20.26 | 11.12 | | |
| NT2RP3002988 | 3.97 | 3.97 | 4.6 | 4.12 | 5.64 | 4.13 | | |
| NT2RP3003000 | 3.11 | 3.11 | 3.46 | 2.46 | 3.2 | 1.51 | | |
| NT2RP3003008 | 3.26 | 3.26 | 5.87 | 3.95 | 4.55 | 2.96 | | |
| NT2RP3003012 | 3.43 | 3.43 | 6.06 | 3.9 | 4.96 | 2.79 | | |
| NT2RP3003015 | 1.35 | 1.35 | 4.9 | 1.5 | 2.5 | 0.54 | | |
| NT2RP3003018 | 2.15 | 2.15 | 6.09 | 3.45 | 7.24 | 2.59 | | |
| NT2RP3003028 | 3.53 | 3.53 | 7.23 | 3.5 | 5.05 | 4.01 | | |
| NT2RP3003029 | 111.75 | 111.75 | 149.73 | 175.13 | 159.77 | 181.4 | * | + |
| NT2RP3003032 | 7.06 | 7.06 | 9.05 | 11.87 | 18.84 | 9.94 | | |
| NT2RP3003041 | 2.07 | 2.07 | 1.88 | 1.61 | 1.41 | 0.69 | | |
| NT2RP3003044 | 3.06 | 3.06 | 7.45 | 5.72 | 6.11 | 7.57 | | |
| NT2RP3003047 | 3.09 | 3.09 | 5.16 | 2.4 | 4.67 | 2.06 | | |
| NT2RP3003050 | 5.96 | 5.96 | 12.03 | 6.74 | 10.3 | 8.42 | | |
| NT2RP3003053 | 7.46 | 7.46 | 18 | 14.42 | 17.14 | 13.72 | | |
| NT2RP3003059 | 1.93 | 1.93 | 4.76 | 2.88 | 4.41 | 3.06 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3003061 | 2.8 | 2.8 | 8.59 | 5.49 | 5.68 | 5.16 | | |
| NT2RP3003068 | 5.99 | 5.99 | 11.77 | 9.41 | 8.75 | 10.04 | | |
| NT2RP3003071 | 7.22 | 7.22 | 10.77 | 10.39 | 14.52 | 10.39 | | |
| NT2RP3003076 | 2.67 | 2.67 | 9.49 | 6.57 | 6.57 | 4.01 | | |
| NT2RP3003078 | 1.5 | 1.5 | 4.12 | 2.09 | 4.52 | 2.43 | | |
| NT2RP3003081 | 6.21 | 6.21 | 10.54 | 9.94 | 9.6 | 9.97 | | |
| NT2RP3003090 | 1.49 | 1.49 | 5.95 | 3.28 | 3.57 | 3.25 | | |
| NT2RP3003097 | 2.42 | 2.42 | 7.15 | 2.71 | 3.72 | 2.93 | | |
| NT2RP3003098 | 2.75 | 2.75 | 4.22 | 2.73 | 3.43 | 1.73 | | |
| NT2RP3003101 | 5.56 | 5.56 | 7.24 | 7.73 | 10.35 | 7.18 | | |
| NT2RP3003109 | 16.11 | 16.11 | 27.38 | 27.36 | 41.03 | 21.91 | | |
| NT2RP3003121 | 3.39 | 3.39 | 11.03 | 4.61 | 8 | 2.44 | | |
| NT2RP3003133 | 2.09 | 2.09 | 5.78 | 4.93 | 8.58 | 3.96 | | |
| NT2RP3003137 | 3.42 | 3.42 | 5.74 | 6.32 | 7.59 | 5.29 | | |
| NT2RP3003138 | 2.36 | 2.36 | 5.27 | 5.26 | 5.7 | 3.74 | | |
| NT2RP3003139 | 2.53 | 2.53 | 7.8 | 3.15 | 5.74 | 2.7 | | |
| NT2RP3003145 | 5.08 | 5.08 | 32.56 | 25.8 | 29.74 | 19.72 | | |
| NT2RP3003150 | 2.03 | 2.03 | 5.17 | 3.56 | 3.76 | 1.97 | | |
| NT2RP3003157 | 2.52 | 2.52 | 8.34 | 6.4 | 10.1 | 4.94 | | |
| NT2RP3003185 | 1.77 | 1.77 | 3.88 | 1.91 | 3.34 | 2.62 | | |
| NT2RP3003193 | 2.62 | 2.62 | 5.75 | 6.03 | 4.59 | 2.65 | | |
| NT2RP3003197 | 2.38 | 2.38 | 3.8 | 3.11 | 4.02 | 2.2 | | |
| NT2RP3003203 | 11.82 | 11.82 | 14.35 | 16.85 | 10.17 | 15.27 | | |
| NT2RP3003204 | 3.76 | 3.76 | 7.93 | 4.04 | 6.17 | 3.79 | | |
| NT2RP3003210 | 14.48 | 14.48 | 75.3 | 58.97 | 84.6 | 68.66 | | |
| NT2RP3003212 | 5.15 | 5.15 | 9.44 | 9.21 | 10.67 | 7.36 | | |
| NT2RP3003213 | 4.16 | 4.16 | 5.68 | 5.15 | 7.02 | 5.44 | | |
| NT2RP3003224 | 1.7 | 1.7 | 4.75 | 2.43 | 2.11 | 2.64 | | |
| NT2RP3003226 | 3.25 | 3.25 | 5.68 | 6.57 | 5.94 | 3.63 | | |
| NT2RP3003230 | 7.79 | 7.79 | 11.47 | 12.39 | 8.89 | 6.72 | | |
| NT2RP3003235 | 7.61 | 7.61 | 10.79 | 7.77 | 7.73 | 6.89 | | |
| NT2RP3003242 | 12.17 | 12.17 | 23.49 | 26.68 | 32.03 | 19.25 | | |
| NT2RP3003251 | 5.61 | 5.61 | 9.47 | 3.73 | 4.95 | 4.08 | | |
| NT2RP3003252 | 3.95 | 3.95 | 5.95 | 2.19 | 3.7 | 2.42 | | |
| NT2RP3003258 | 4.92 | 4.92 | 7.89 | 19.94 | 24.95 | 15.47 | ** | + |
| NT2RP3003260 | 4.54 | 4.54 | 12.34 | 13.46 | 11.52 | 12.68 | | |
| NT2RP3003264 | 1.64 | 1.64 | 5.99 | 3.18 | 4.32 | 1.86 | | |
| NT2RP3003273 | 2.18 | 2.18 | 4.93 | 4.57 | 3.58 | 1.72 | | |
| NT2RP3003278 | 1.33 | 1.33 | 4 | 1.31 | 5.12 | 0.63 | | |
| NT2RP3003280 | 9.85 | 9.85 | 23.11 | 18.18 | 19.52 | 18.19 | | |
| NT2RP3003282 | 5.29 | 5.29 | 6.25 | 3.62 | 3.97 | 3.48 | ** | − |
| NT2RP3003290 | 6.64 | 6.64 | 9.09 | 4.8 | 5.38 | 3.78 | * | − |
| NT2RP3003301 | 4.01 | 4.01 | 5.73 | 4.31 | 4.59 | 3.23 | | |
| NT2RP3003302 | 1.45 | 1.45 | 2.31 | 2.91 | 2.64 | 1.91 | | |
| NT2RP3003311 | 2.45 | 2.45 | 6.76 | 15.72 | 13.09 | 11.55 | ** | + |
| NT2RP3003312 | 1.81 | 1.81 | 3.35 | 3.73 | 3.87 | 2.41 | | |
| NT2RP3003313 | 1.61 | 1.61 | 4.2 | 2.91 | 5.4 | 2.87 | | |
| NT2RP3003327 | 1.62 | 1.62 | 6.24 | 4.81 | 4.95 | 3.34 | | |
| NT2RP3003330 | 5.13 | 5.13 | 8.01 | 15.68 | 16.13 | 12.78 | ** | + |
| NT2RP3003344 | 3.36 | 3.36 | 4.14 | 2.92 | 3.74 | 2.6 | | |
| NT2RP3003346 | 3.81 | 3.81 | 4.83 | 4.38 | 4.05 | 1.24 | | |
| NT2RP3003349 | 4.04 | 4.04 | 6.93 | 9.96 | 9.41 | 9.65 | ** | + |
| NT2RP3003353 | 1.95 | 1.95 | 3.24 | 4.06 | 5.37 | 2.45 | | |
| NT2RP3003354 | 5.09 | 5.09 | 13.72 | 16.29 | 12.02 | 13.5 | | |
| NT2RP3003368 | 3.03 | 3.03 | 4.73 | 4.04 | 4.08 | 2.63 | | |
| NT2RP3003375 | 4.1 | 4.1 | 7.4 | 7.41 | 9.67 | 6.62 | | |
| NT2RP3003377 | 4.16 | 4.16 | 3.98 | 2.57 | 3.58 | 1.65 | | |
| NT2RP3003384 | 5.77 | 5.77 | 4.55 | 2.83 | 3.43 | 2.56 | ** | − |
| NT2RP3003385 | 4.55 | 4.55 | 3.12 | 1.9 | 2.36 | 1.47 | * | − |
| NT2RP3003396 | 3.93 | 3.93 | 13.63 | 16.4 | 8.38 | 12.32 | | |
| NT2RP3003403 | 1.62 | 1.62 | 2.54 | 3.24 | 4.73 | 1.92 | | |
| NT2RP3003409 | 1.18 | 1.18 | 2.97 | 3.3 | 4.48 | 3.03 | | |
| NT2RP3003411 | 4.59 | 4.59 | 15.42 | 14.11 | 15.42 | 10.96 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3003420 | 3.79 | 3.79 | 4.36 | 3.68 | 2.13 | 1.85 | | |
| NT2RP3003425 | 3.25 | 3.25 | 6.71 | 5.85 | 7.25 | 5.49 | | |
| NT2RP3003426 | 9.11 | 9.11 | 16.3 | 10.88 | 11.12 | 17.45 | | |
| NT2RP3003427 | 5.95 | 5.95 | 10.09 | 9.15 | 13.58 | 8.03 | | |
| NT2RP3003433 | 2.55 | 2.55 | 6.26 | 8.42 | 9.57 | 4.87 | | |
| NT2RP3003437 | 22.12 | 22.12 | 49.85 | 51.81 | 44 | 38.77 | | |
| NT2RP3003448 | 1.88 | 1.88 | 4.24 | 3.5 | 3.83 | 2.63 | | |
| NT2RP3003455 | 5.23 | 5.23 | 12.16 | 11.8 | 9.96 | 8.44 | | |
| NT2RP3003462 | 4.96 | 4.96 | 10.07 | 10.76 | 8.25 | 7.08 | | |
| NT2RP3003464 | 3.79 | 3.79 | 5.03 | 3.01 | 4.76 | 1.2 | | |
| NT2RP3003469 | 4.1 | 4.1 | 7.77 | 6.62 | 7.56 | 5.07 | | |
| NT2RP3003473 | 22.06 | 22.06 | 36.6 | 54.82 | 69.25 | 56.46 | ** | + |
| NT2RP3003474 | 8.26 | 8.26 | 23.04 | 13.23 | 12.04 | 13.52 | | |
| NT2RP3003475 | 2.84 | 2.84 | 4.04 | 4.55 | 4.45 | 3.28 | | |
| NT2RP3003490 | 2.7 | 2.7 | 5.81 | 4.21 | 4.43 | 3.12 | | |
| NT2RP3003491 | 2.26 | 2.26 | 3 | 2.14 | 2.75 | 1.26 | | |
| NT2RP3003493 | 11.75 | 11.75 | 30.77 | 34.59 | 28.9 | 34.45 | | |
| NT2RP3003500 | 4.93 | 4.93 | 5.26 | 4.99 | 7.46 | 3.65 | | |
| NT2RP3003527 | 2.73 | 2.73 | 3.09 | 2.42 | 2.92 | 1.72 | | |
| NT2RP3003532 | 2.7 | 2.7 | 1.81 | 2.14 | 3.33 | 2.13 | | |
| NT2RP3003535 | 3.14 | 3.14 | 4.37 | 1.92 | 3.4 | 2.19 | | |
| NT2RP3003536 | 3.04 | 3.04 | 5.95 | 3.45 | 5.2 | 4.97 | | |
| NT2RP3003543 | 2.61 | 2.61 | 6.24 | 3.21 | 4.81 | 3.83 | | |
| NT2RP3003549 | 1.43 | 1.43 | 6.66 | 2.18 | 4.07 | 1.55 | | |
| NT2RP3003552 | 1.8 | 1.8 | 5.76 | 0.64 | 0.84 | 1.58 | | |
| NT2RP3003555 | 4.4 | 4.4 | 14.14 | 12.16 | 17.43 | 16.23 | | |
| NT2RP3003559 | 2.81 | 2.81 | 6.7 | 3.88 | 5.11 | 5.49 | | |
| NT2RP3003564 | 3.11 | 3.11 | 5.9 | 2.24 | 4.6 | 5.25 | | |
| NT2RP3003572 | 2.1 | 2.1 | 4.21 | 1.88 | 3.02 | 2.32 | | |
| NT2RP3003576 | 5.88 | 5.88 | 10.15 | 11.32 | 8.98 | 9.22 | | |
| NT2RP3003587 | 7.39 | 7.39 | 12.41 | 10.01 | 12.71 | 12.75 | | |
| NT2RP3003589 | 15.33 | 15.33 | 22.45 | 23.89 | 23.75 | 26.58 | | |
| NT2RP3003592 | 7.77 | 7.77 | 10.4 | 8.42 | 14.48 | 9.74 | | |
| NT2RP3003593 | 8.16 | 8.16 | 13.62 | 13.47 | 13.84 | 110.49 | | |
| NT2RP3003614 | 2.66 | 2.66 | 8.18 | 3.11 | 4.48 | 7.09 | | |
| NT2RP3003621 | 1.64 | 1.64 | 3.91 | 2.1 | 3.68 | 2.96 | | |
| NT2RP3003625 | 1.54 | 1.54 | 6.94 | 3.79 | 5.09 | 4.96 | | |
| NT2RP3003627 | 6.73 | 6.73 | 20.05 | 16.23 | 13.97 | 25.71 | | |
| NT2RP3003636 | 3.3 | 3.3 | 7.74 | 5.99 | 3.79 | 10.4 | | |
| NT2RP3003642 | 7.12 | 7.12 | 12.2 | 12.85 | 13.15 | 15.83 | | |
| NT2RP3003645 | 2.91 | 2.91 | 6.07 | 2.23 | 2.42 | 3.53 | | |
| NT2RP3003648 | 2.88 | 2.88 | 3.71 | 2.17 | 2.44 | 3.13 | | |
| NT2RP3003649 | 2.7 | 2.7 | 9.28 | 6.36 | 5.11 | 12.04 | | |
| NT2RP3003650 | 2.65 | 2.65 | 4.25 | 4.38 | 3.16 | 4.09 | | |
| NT2RP3003656 | 1.69 | 1.69 | 3.23 | 1.94 | 4.12 | 3 | | |
| NT2RP3003659 | 2.76 | 2.76 | 4.56 | 2.14 | 4.8 | 4.88 | | |
| NT2RP3003662 | 31.39 | 31.39 | 53.28 | 34.35 | 14.68 | 34.64 | | |
| NT2RP3003664 | 3.56 | 3.56 | 6.5 | 6.18 | 5.45 | 6.55 | | |
| NT2RP3003665 | 1.89 | 1.89 | 4.83 | 2.07 | 2.8 | 4.96 | | |
| NT2RP3003671 | 2.88 | 2.88 | 4.33 | 3.03 | 2.6 | 4.29 | | |
| NT2RP3003672 | 4.78 | 4.78 | 9.8 | 10.69 | 14.73 | 16.35 | * | + |
| NT2RP3003673 | 4.98 | 4.98 | 9.42 | 5.35 | 3.05 | 4.12 | | |
| NT2RP3003679 | 40.1 | 40.1 | 95.75 | 69.92 | 23.86 | 83.88 | | |
| NT2RP3003680 | 3.13 | 3.13 | 5.38 | 3.96 | 4.58 | 5.88 | | |
| NT2RP3003686 | 2.22 | 2.22 | 4.43 | 2.84 | 4.85 | 2.25 | | |
| NT2RP3003689 | 4.05 | 4.05 | 9.69 | 5.94 | 5.63 | 8.27 | | |
| NT2RP3003697 | 13.79 | 13.79 | 120.74 | 108.93 | 77.49 | 68.74 | | |
| NT2RP3003701 | 2.7 | 2.7 | 5.17 | 2.58 | 3.05 | 2.57 | | |
| NT2RP3003704 | 2.99 | 2.99 | 6.96 | 7.09 | 7.61 | 6.96 | | |
| NT2RP3003714 | 1.39 | 1.39 | 4.25 | 1.68 | 0.89 | 1.14 | | |
| NT2RP3003716 | 2.05 | 2.05 | 4.23 | 3 | 2.29 | 2.24 | | |
| NT2RP3003721 | 1.83 | 1.83 | 3.27 | 1.85 | 3.45 | 2.18 | | |
| NT2RP3003722 | 3.45 | 3.45 | 8.18 | 8.08 | 7.79 | 5.45 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3003726 | 3.5 | 3.5 | 4.9 | 2.77 | 4.51 | 2.32 | | |
| NT2RP3003729 | 4.1 | 4.1 | 8.53 | 4.22 | 5.44 | 4.6 | | |
| NT2RP3003731 | 5.06 | 5.06 | 6.98 | 4.19 | 3.54 | 1.45 | | |
| NT2RP3003740 | 2.58 | 2.58 | 5.08 | 2.42 | 2.48 | 2.94 | | |
| NT2RP3003746 | 3.63 | 3.63 | 8.14 | 6.7 | 5.94 | 6.59 | | |
| NT2RP3003749 | 0.67 | 0.67 | 2.58 | 1.55 | 2.08 | 1.73 | | |
| NT2RP3003754 | 3.32 | 3.32 | 7.31 | 4.66 | 5.87 | 5.81 | | |
| NT2RP3003759 | 1.16 | 1.16 | 4.44 | 2.49 | 4.41 | 1.43 | | |
| NT2RP3003764 | 3.97 | 3.97 | 7.08 | 6.85 | 7.41 | 5.06 | | |
| NT2RP3003766 | 6.93 | 6.93 | 7.84 | 3.3 | 5.87 | 3.79 | * | − |
| NT2RP3003767 | 11.19 | 11.19 | 16.8 | 14.83 | 21.08 | 16.97 | | |
| NT2RP3003778 | 3.36 | 3.36 | 4.89 | 4.46 | 5.55 | 4.27 | | |
| NT2RP3003779 | 4.05 | 4.05 | 15.26 | 13.02 | 8.74 | 10.52 | | |
| NT2RP3003783 | 9.25 | 9.25 | 21.72 | 22.42 | 13.65 | 18.76 | | |
| NT2RP3003787 | 2.15 | 2.15 | 4.65 | 4.41 | 4.74 | 6.37 | | |
| NT2RP3003789 | 5.12 | 5.12 | 10.16 | 11.63 | 12.19 | 14.96 | * | + |
| NT2RP3003795 | 1.48 | 1.48 | 6.48 | 4.09 | 2.82 | 2.24 | | |
| NT2RP3003799 | 2.67 | 2.67 | 5.5 | 3.08 | 2.38 | 1.75 | | |
| NT2RP3003800 | 4.36 | 4.36 | 5.92 | 4.14 | 4.57 | 6.91 | | |
| NT2RP3003805 | 8.15 | 8.15 | 6.78 | 8.4 | 5.48 | 5.89 | | |
| NT2RP3003809 | 1.94 | 1.94 | 7.2 | 5.83 | 5.4 | 4.82 | | |
| NT2RP3003819 | 3.39 | 3.39 | 6.07 | 7.3 | 5.97 | 6.35 | | |
| NT2RP3003824 | 5.69 | 5.69 | 10.69 | 14.08 | 14.85 | 13.32 | * | + |
| NT2RP3003825 | 9.06 | 9.06 | 16.31 | 12.87 | 16.88 | 16.75 | | |
| NT2RP3003828 | 4.7 | 4.7 | 14.38 | 13.36 | 15.69 | 14.55 | | |
| NT2RP3003831 | 4.01 | 4.01 | 6.38 | 5.77 | 6.54 | 7.23 | | |
| NT2RP3003833 | 5.12 | 5.12 | 7.5 | 6.44 | 8.88 | 6.96 | | |
| NT2RP3003836 | 6.37 | 6.37 | 5.05 | 5.74 | 6.47 | 4.31 | | |
| NT2RP3003842 | 2.7 | 2.7 | 9.08 | 6.84 | 6.51 | 7.09 | | |
| NT2RP3003843 | 9.26 | 9.26 | 26.77 | 16.67 | 12.71 | 16.2 | | |
| NT2RP3003844 | 20.38 | 20.38 | 46.56 | 42.84 | 27.94 | 44.32 | | |
| NT2RP3003846 | 4.04 | 4.04 | 8.45 | 8.94 | 7.18 | 8.05 | | |
| NT2RP3003849 | 2.27 | 2.27 | 2.68 | 2.67 | 2.73 | 1.68 | | |
| NT2RP3003862 | 28.91 | 28.91 | 45.63 | 32 | 37.58 | 44.88 | | |
| NT2RP3003870 | 4.76 | 4.76 | 4.81 | 2.54 | 2.93 | 2.05 | ** | − |
| NT2RP3003874 | 21.46 | 21.46 | 20.88 | 33.11 | 47.25 | 36.44 | * | + |
| NT2RP3003876 | 1.62 | 1.62 | 8.08 | 5.45 | 7.49 | 6.81 | | |
| NT2RP3003880 | 1.74 | 1.74 | 4.63 | 5.31 | 4.66 | 4.73 | | |
| NT2RP3003889 | 1.69 | 1.69 | 3.04 | 3.41 | 3.53 | 9.53 | | |
| NT2RP3003891 | 1.88 | 1.88 | 2.98 | 2.56 | 3.19 | 1.37 | | |
| NT2RP3003914 | 3.1 | 3.1 | 7.35 | 6.88 | 5.15 | 7.39 | | |
| NT2RP3003915 | 5.03 | 5.03 | 8.44 | 9.52 | 11.35 | 8.6 | | |
| NT2RP3003918 | 6.79 | 6.79 | 10.39 | 10.04 | 13.71 | 12.42 | | |
| NT2RP3003920 | 6.9 | 6.9 | 9.13 | 8.31 | 10.22 | 8.96 | | |
| NT2RP3003924 | 2.25 | 2.25 | 9.57 | 6.49 | 5.34 | 6.91 | | |
| NT2RP3003932 | 1.41 | 1.41 | 3.85 | 5.17 | 5.26 | 3.85 | | |
| NT2RP3003939 | 3.48 | 3.48 | 11.88 | 9.86 | 14.05 | 11.09 | | |
| NT2RP3003940 | 11.34 | 11.34 | 27.33 | 23.54 | 20.59 | 23.06 | | |
| NT2RP3003943 | 2.6 | 2.6 | 2.83 | 2.85 | 2.78 | 3.88 | | |
| NT2RP3003959 | 3.52 | 3.52 | 6.96 | 6.54 | 5.93 | 5.49 | | |
| NT2RP3003963 | 4.83 | 4.83 | 7.59 | 4.01 | 4.61 | 2.52 | | |
| NT2RP3003965 | 11.14 | 11.14 | 13.85 | 18.75 | 20.67 | 17.22 | ** | + |
| NT2RP3003972 | 26.1 | 26.1 | 40.32 | 22.13 | 17.98 | 38.48 | | |
| NT2RP3003973 | 2.85 | 2.85 | 4.33 | 1.96 | 3.6 | 3.96 | | |
| NT2RP3003979 | 5.89 | 5.89 | 12.53 | 6.92 | 8.49 | 8.84 | | |
| NT2RP3003980 | 3.52 | 3.52 | 9.41 | 9.34 | 8.89 | 7.92 | | |
| NT2RP3003982 | 4.2 | 4.2 | 4.63 | 2.44 | 1.6 | 4.61 | | |
| NT2RP3003989 | 6.24 | 6.24 | 4.69 | 9.61 | 5.62 | 16.05 | | |
| NT2RP3003992 | 2.13 | 2.13 | 4.89 | 2.47 | 5.12 | 4.8 | | |
| NT2RP3004000 | 2.81 | 2.81 | 6 | 1.72 | 3.22 | 2.62 | | |
| NT2RP3004001 | 11.38 | 11.38 | 19.94 | 11.62 | 11.37 | 21.11 | | |
| NT2RP3004005 | 2.89 | 2.89 | 7.79 | 4.7 | 4.48 | 6.84 | | |
| NT2RP3004013 | 2.23 | 2.23 | 7.2 | 2.66 | 4.87 | 3.57 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3004016 | 1.5 | 1.5 | 7.1 | 2.22 | 3.14 | 2.88 | | |
| NT2RP3004025 | 4.02 | 4.02 | 7.69 | 7.48 | 12.19 | 9.01 | | |
| NT2RP3004030 | 7.05 | 7.05 | 12.64 | 13.97 | 15.8 | 17.66 | * | + |
| NT2RP3004041 | 5.65 | 5.65 | 11.38 | 10.48 | 9.57 | 19.81 | | |
| NT2RP3004042 | 15.22 | 15.22 | 102.33 | 97.27 | 103.6 | 99.67 | | |
| NT2RP3004044 | 2.13 | 2.13 | 6.51 | 5.14 | 7.21 | 4.22 | | |
| NT2RP3004051 | 2.6 | 2.6 | 5.79 | 2.23 | 5.51 | 4.69 | | |
| NT2RP3004052 | 7.1 | 7.1 | 11.22 | 5.63 | 4.98 | 9.78 | | |
| NT2RP3004053 | 15.87 | 15.87 | 35.04 | 23.12 | 40.67 | 40.17 | | |
| NT2RP3004055 | 2.38 | 2.38 | 5.33 | 2.98 | 3.3 | 4.47 | | |
| NT2RP3004059 | 4.05 | 4.05 | 8.8 | 8.15 | 7.03 | 11 | | |
| NT2RP3004063 | 5.13 | 5.13 | 11.23 | 8.78 | 11.27 | 12.33 | | |
| NT2RP3004067 | 4.24 | 4.24 | 8.4 | 6.62 | 6.42 | 4.47 | | |
| NT2RP3004070 | 3.58 | 3.58 | 9.92 | 6.26 | 4.4 | 5.47 | | |
| NT2RP3004075 | 4.16 | 4.16 | 11.23 | 12.62 | 11.88 | 13.3 | | |
| NT2RP3004078 | 2.6 | 2.6 | 5.25 | 4.94 | 4.19 | 2.79 | | |
| NT2RP3004083 | 2.93 | 2.93 | 6.23 | 4.57 | 6.8 | 11.37 | | |
| NT2RP3004084 | 4.65 | 4.65 | 20.29 | 6.18 | 8.56 | 5.32 | | |
| NT2RP3004087 | 4.2 | 4.2 | 7.86 | 7.14 | 10.81 | 9.03 | | |
| NT2RP3004090 | 4.11 | 4.11 | 6.42 | 9 | 8.19 | 8.61 | ** | + |
| NT2RP3004093 | 2.38 | 2.38 | 7.49 | 4.07 | 3.51 | 4.47 | | |
| NT2RP3004095 | 5.02 | 5.02 | 13.11 | 11.57 | 10.17 | 18.55 | | |
| NT2RP3004102 | 3.32 | 3.32 | 5.59 | 5.25 | 4.27 | 3.21 | | |
| NT2RP3004110 | 12.74 | 12.74 | 18.66 | 22.12 | 14.31 | 19.97 | | |
| NT2RP3004119 | 3.3 | 3.3 | 7.71 | 3.91 | 4.08 | 3.73 | | |
| NT2RP3004125 | 5.55 | 5.55 | 12.05 | 8.13 | 10.88 | 8.38 | | |
| NT2RP3004129 | 4.62 | 4.62 | 7.38 | 3.36 | 2.95 | 6.08 | | |
| NT2RP3004130 | 11.81 | 11.81 | 28.12 | 21.92 | 31.13 | 21.05 | | |
| NT2RP3004133 | 4.51 | 4.51 | 12.95 | 14.62 | 8.94 | 16.81 | | |
| NT2RP3004145 | 1.43 | 1.43 | 4.17 | 2.62 | 4.87 | 3.59 | | |
| NT2RP3004148 | 2.67 | 2.67 | 7.07 | 5.26 | 6.24 | 4.5 | | |
| NT2RP3004155 | 2.37 | 2.37 | 4.82 | 4.7 | 4.57 | 6.59 | | |
| NT2RP3004165 | 17.94 | 17.94 | 29.96 | 29.58 | 31.82 | 39.18 | | |
| NT2RP3004179 | 7.34 | 7.34 | 6.72 | 2.71 | 5.41 | 3.3 | * | − |
| NT2RP3004185 | 5.2 | 5.2 | 5.53 | 2.76 | 2.76 | 1.95 | ** | − |
| NT2RP3004188 | 4.77 | 4.77 | 10.82 | 7.74 | 11.35 | 7 | | |
| NT2RP3004189 | 4.23 | 4.23 | 5.91 | 4.97 | 4.82 | 6.28 | | |
| NT2RP3004190 | 2.6 | 2.6 | 5.57 | 5.84 | 4.36 | 5.26 | | |
| NT2RP3004191 | 14.09 | 14.09 | 23.4 | 31.41 | 29.45 | 30.09 | * | + |
| NT2RP3004202 | 2.04 | 2.04 | 4.56 | 4.16 | 4.42 | 2.3 | | |
| NT2RP3004205 | 8.75 | 8.75 | 21.54 | 21.27 | 25.35 | 20.28 | | |
| NT2RP3004206 | 4.5 | 4.5 | 9.74 | 5.14 | 6.37 | 9 | | |
| NT2RP3004207 | 5.19 | 5.19 | 4.99 | 3.09 | 3.25 | 1.77 | ** | − |
| NT2RP3004209 | 4.74 | 4.74 | 7.74 | 8.2 | 11.23 | 9.08 | * | + |
| NT2RP3004215 | 1.86 | 1.86 | 6.7 | 3.96 | 2.41 | 4.55 | | |
| NT2RP3004219 | 5.15 | 5.15 | 11.25 | 10.04 | 8.81 | 13.65 | | |
| NT2RP3004242 | 4.65 | 4.65 | 10.36 | 9.8 | 10.19 | 14.56 | | |
| NT2RP3004246 | 4.5 | 4.5 | 9.39 | 9.18 | 10.95 | 3.8 | | |
| NT2RP3004253 | 1.89 | 1.89 | 4.85 | 3.64 | 4.99 | 2.8 | | |
| NT2RP3004258 | 5.45 | 5.45 | 10.89 | 12.77 | 11.07 | 11.39 | | |
| NT2RP3004262 | 4.26 | 4.26 | 5.71 | 2.63 | 2.99 | 2.01 | * | − |
| NT2RP3004275 | 5.59 | 5.59 | 3.43 | 1.4 | 2.97 | 2.34 | * | − |
| NT2RP3004282 | 5.45 | 5.45 | 68.08 | 51.29 | 52.72 | 53.57 | | |
| NT2RP3004289 | 1.79 | 1.79 | 2.95 | 1.9 | 2.18 | 3.99 | | |
| NT2RP3004294 | 2.74 | 2.74 | 6.02 | 6.95 | 6.93 | 7.24 | * | + |
| NT2RP3004298 | 8.76 | 8.76 | 48.63 | 46.33 | 60.89 | 50.83 | | |
| NT2RP3004309 | 3.3 | 3.3 | 6.46 | 5.2 | 5.22 | 5.31 | | |
| NT2RP3004321 | 3.71 | 3.71 | 6.11 | 3.29 | 3.74 | 3.34 | | |
| NT2RP3004322 | 5.61 | 5.61 | 6.86 | 6.06 | 6.43 | 6.56 | | |
| NT2RP3004332 | 11.69 | 11.69 | 100.11 | 78.54 | 102.41 | 76.72 | | |
| NT2RP3004334 | 1.49 | 1.49 | 6.97 | 8.56 | 6.06 | 9.06 | | |
| NT2RP3004336 | 2.11 | 2.11 | 6.24 | 6.02 | 4.44 | 5.63 | | |
| NT2RP3004338 | 3.09 | 3.09 | 8.41 | 10.22 | 9.52 | 16.47 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocyte_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3004341 | 1.81 | 1.81 | 4.56 | 6.13 | 5.17 | 9.13 | | |
| NT2RP3004345 | 4.1 | 4.1 | 8.68 | 9.3 | 9.63 | 8.48 | | |
| NT2RP3004348 | 5.06 | 5.06 | 11.25 | 13.04 | 10.79 | 12.54 | | |
| NT2RP3004349 | 5 | 5 | 7.5 | 4.89 | 7.75 | 5.76 | | |
| NT2RP3004355 | 5.57 | 5.57 | 7.09 | 7.55 | 7.07 | 7.18 | | |
| NT2RP3004356 | 5.76 | 5.76 | 21.51 | 11.29 | 15.14 | 15.56 | | |
| NT2RP3004360 | 3.4 | 3.4 | 5.26 | 6.01 | 5.32 | 7.85 | | |
| NT2RP3004361 | 2.6 | 2.6 | 6.26 | 7.67 | 7.3 | 8.87 | * | + |
| NT2RP3004374 | 3.06 | 3.06 | 10.09 | 8.8 | 6.6 | 5.75 | | |
| NT2RP3004378 | 10.48 | 10.48 | 18.57 | 28.26 | 24.09 | 34.81 | * | + |
| NT2RP3004399 | 3.88 | 3.88 | 5.77 | 3.53 | 3.17 | 9.06 | | |
| NT2RP3004405 | 4.07 | 4.07 | 6.77 | 3.03 | 5.52 | 3.93 | | |
| NT2RP3004406 | 5.36 | 5.36 | 6.23 | 5.19 | 6.03 | 6.12 | | |
| NT2RP3004411 | 5.93 | 5.93 | 13.28 | 8.08 | 6.39 | 9.51 | | |
| NT2RP3004424 | 1.53 | 1.53 | 2.43 | 3.27 | 1.81 | 2.83 | | |
| NT2RP3004428 | 3.03 | 3.03 | 5.36 | 5.07 | 3.82 | 4.09 | | |
| NT2RP3004432 | 3.3 | 3.3 | 3.52 | 3.61 | 3.11 | 4.38 | | |
| NT2RP3004434 | 3.42 | 3.42 | 8.41 | 7.28 | 9.09 | 7.99 | | |
| NT2RP3004446 | 3.29 | 3.29 | 4.6 | 3.29 | 4.1 | 2.63 | | |
| NT2RP3004451 | 3.2 | 3.2 | 6.01 | 3.89 | 3.38 | 2.48 | | |
| NT2RP3004454 | 2.96 | 2.96 | 4.16 | 2.69 | 3.5 | 2.5 | | |
| NT2RP3004466 | 3.5 | 3.5 | 7.89 | 5.25 | 3.85 | 5.61 | | |
| NT2RP3004470 | 7.42 | 7.42 | 24.53 | 18.4 | 16.35 | 24.72 | | |
| NT2RP3004472 | 2.49 | 2.49 | 4.4 | 3.97 | 3.84 | 3.88 | | |
| NT2RP3004475 | 1.71 | 1.71 | 5.52 | 2.72 | 5.93 | 3.9 | | |
| NT2RP3004480 | 14.12 | 14.12 | 17.04 | 18.94 | 10.5 | 18.82 | | |
| NT2RP3004481 | 5.42 | 5.42 | 11.37 | 5.04 | 7.37 | 12.39 | | |
| NT2RP3004490 | 2.66 | 2.66 | 8.45 | 3.92 | 7.03 | 8.25 | | |
| NT2RP3004496 | 4.8 | 4.8 | 14.38 | 7.22 | 9.3 | 11.08 | | |
| NT2RP3004498 | 6.39 | 6.39 | 21.39 | 16.86 | 15.11 | 18.92 | | |
| NT2RP3004503 | 2.78 | 2.78 | 9.34 | 4.85 | 6.23 | 5.88 | | |
| NT2RP3004504 | 3.91 | 3.91 | 11.09 | 6.05 | 10.67 | 11.52 | | |
| NT2RP3004505 | 17.38 | 17.38 | 28.56 | 37.35 | 26.72 | 37.82 | | |
| NT2RP3004507 | 1.57 | 1.57 | 6.6 | 2.52 | 5.52 | 1.68 | | |
| NT2RP3004519 | 4.9 | 4.9 | 7.73 | 4.93 | 8.36 | 8.75 | | |
| NT2RP3004524 | 10.04 | 10.04 | 29.21 | 26.88 | 26.43 | 29.62 | | |
| NT2RP3004527 | 3.03 | 3.03 | 3.22 | 1.29 | 2.23 | 2.08 | * | − |
| NT2RP3004534 | 3.08 | 3.08 | 10.44 | 5.58 | 12 | 7.38 | | |
| NT2RP3004539 | 4.45 | 4.45 | 12.17 | 9.8 | 8.97 | 12 | | |
| NT2RP3004541 | 2.65 | 2.65 | 11.06 | 5.48 | 9.44 | 8.25 | | |
| NT2RP3004544 | 3.54 | 3.54 | 8.89 | 6.62 | 5.24 | 9.48 | | |
| NT2RP3004551 | 3.46 | 3.46 | 6.75 | 6.6 | 6.6 | 6.98 | | |
| NT2RP3004552 | 2.76 | 2.76 | 4.33 | 2.84 | 3.22 | 4.98 | | |
| NT2RP3004557 | 5.68 | 5.68 | 8.73 | 9.74 | 15.44 | 13.16 | * | + |
| NT2RP3004561 | 1.96 | 1.96 | 3.77 | 2.55 | 4.46 | 4.1 | | |
| NT2RP3004566 | 3.09 | 3.09 | 11.55 | 7.2 | 10.05 | 8.79 | | |
| NT2RP3004569 | 2.21 | 2.21 | 7.09 | 4.63 | 5.36 | 6.91 | | |
| NT2RP3004572 | 4.37 | 4.37 | 6.83 | 7.08 | 5.55 | 7.07 | | |
| NT2RP3004578 | 2.35 | 2.35 | 5.38 | 4.15 | 4.27 | 3.24 | | |
| NT2RP3004584 | 4.76 | 4.76 | 28.36 | 34.99 | 37.13 | 30.29 | | |
| NT2RP3004588 | 2.38 | 2.38 | 4.89 | 1.6 | 3.7 | 3.28 | | |
| NT2RP3004594 | 2.25 | 2.25 | 5.9 | 5.67 | 6.49 | 8.94 | | |
| NT2RP3004603 | 34.16 | 34.16 | 99.64 | 80.2 | 102.6 | 97.27 | | |
| NT2RP3004612 | 4.71 | 4.71 | 12.17 | 5.3 | 3.36 | 5.34 | | |
| NT2RP3004617 | 1.09 | 1.09 | 2.32 | 2.49 | 3.3 | 2.39 | | |
| NT2RP3004618 | 4.61 | 4.61 | 5.9 | 2.49 | 5.21 | 5.9 | | |
| NT2RP3004625 | 3.97 | 3.97 | 8.17 | 4.55 | 6.92 | 7.1 | | |
| NT2RP3004635 | 4.76 | 4.76 | 7.83 | 1.52 | 2.86 | 3.47 | | |
| NT2RP3004640 | 10.61 | 10.61 | 62.15 | 59.33 | 67.97 | 48.32 | | |
| NT2RP3004642 | 8.04 | 8.04 | 29.31 | 22.82 | 26.12 | 25.12 | | |
| NT2RP3004647 | 3.5 | 3.5 | 5.65 | 5.89 | 7.35 | 6.88 | * | + |
| NT2RP3004652 | 1.76 | 1.76 | 10.37 | 4.2 | 3.71 | 4.34 | | |
| NT2RP3004669 | 2.01 | 2.01 | 5.36 | 4.01 | 5.33 | 3.46 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP3004670 | 5.04 | 5.04 | 10.58 | 12.4 | 9.19 | 14.23 | | |
| NT2RP4000008 | 45.17 | 45.17 | 71.24 | 49.77 | 32.43 | 48.77 | | |
| NT2RP4000018 | 11.64 | 11.64 | 14.61 | 11.69 | 14.8 | 14.87 | | |
| NT2RP4000023 | 6.96 | 6.96 | 8.91 | 4.86 | 7.38 | 5.98 | | |
| NT2RP4000025 | 16.2 | 16.2 | 22.16 | 26.22 | 29.89 | 24.7 | * | + |
| NT2RP4000035 | 6.3 | 6.3 | 12.01 | 11.28 | 15.33 | 11.01 | | |
| NT2RP4000041 | 14.46 | 14.46 | 34.8 | 22.01 | 17.41 | 23.68 | | |
| NT2RP4000049 | 2.64 | 2.64 | 6.34 | 6.59 | 6.88 | 5.3 | | |
| NT2RP4000050 | 2.24 | 2.24 | 6.87 | 3.54 | 4.48 | 4.05 | | |
| NT2RP4000051 | 4.66 | 4.66 | 10.5 | 10.58 | 10.02 | 8.96 | | |
| NT2RP4000063 | 20.51 | 20.51 | 33.5 | 26.77 | 31 | 18.33 | | |
| NT2RP4000065 | 7.54 | 7.54 | 9.24 | 11.85 | 15.01 | 11.47 | * | + |
| NT2RP4000070 | 6.63 | 6.63 | 5.29 | 3.79 | 4.54 | 3.84 | * | – |
| NT2RP4000074 | 6.55 | 6.55 | 13.63 | 10.29 | 15.39 | 9.52 | | |
| NT2RP4000078 | 3.41 | 3.41 | 9.55 | 12.2 | 11.66 | 12.56 | * | + |
| NT2RP4000080 | 3.52 | 3.52 | 7.01 | 5.06 | 6.84 | 6.81 | | |
| NT2RP4000099 | 128.86 | 128.86 | 236.22 | 149.44 | 161.1 | 211.56 | | |
| NT2RP4000102 | 3.55 | 3.55 | 6.48 | 5.27 | 4.97 | 5.54 | | |
| NT2RP4000103 | 2 | 2 | 5.47 | 2.57 | 2.85 | 3.96 | | |
| NT2RP4000108 | 4.66 | 4.66 | 7.91 | 9.33 | 10.73 | 10.61 | * | + |
| NT2RP4000109 | 18.89 | 18.89 | 22.84 | 19.87 | 24.15 | 16.14 | | |
| NT2RP4000111 | 4.56 | 4.56 | 6.38 | 4.87 | 5.27 | 4.85 | | |
| NT2RP4000112 | 5.62 | 5.62 | 10.14 | 12.45 | 8.7 | 11.81 | | |
| NT2RP4000115 | 2.94 | 2.94 | 3.62 | 4.95 | 7.82 | 10.93 | | |
| NT2RP4000129 | 2.18 | 2.18 | 4.58 | 3.02 | 5.04 | 5.03 | | |
| NT2RP4000137 | 3.36 | 3.36 | 10.05 | 5.34 | 8.72 | 11.4 | | |
| NT2RP4000138 | 7.21 | 7.21 | 10.91 | 17.75 | 20.19 | 19.17 | ** | + |
| NT2RP4000141 | 3.25 | 3.25 | 6.1 | 5.22 | 4.9 | 3.57 | | |
| NT2RP4000147 | 6.21 | 6.21 | 4.49 | 4.27 | 5.2 | 3.47 | | |
| NT2RP4000150 | 5.96 | 5.96 | 6.93 | 7.33 | 10.41 | 7.06 | | |
| NT2RP4000151 | 2.82 | 2.82 | 7.82 | 5.69 | 6.24 | 5.05 | | |
| NT2RP4000157 | 73.27 | 73.27 | 222.87 | 169.53 | 97.51 | 73.8 | | |
| NT2RP4000159 | 2.02 | 2.02 | 5.03 | 3.38 | 5.03 | 2.92 | | |
| NT2RP4000163 | 5.21 | 5.21 | 8.74 | 10.89 | 9.18 | 6.63 | | |
| NT2RP4000167 | 3.26 | 3.26 | 4.35 | 4.32 | 3.22 | 3.69 | | |
| NT2RP4000171 | 5.72 | 5.72 | 7 | 5.72 | 7.45 | 5.03 | | |
| NT2RP4000175 | 62.48 | 62.48 | 94.56 | 144.06 | 214.73 | 147.88 | * | + |
| NT2RP4000180 | 17.17 | 17.17 | 106.15 | 88.6.11 | 23.6 | 81.8 | | |
| NT2RP4000185 | 7.64 | 7.64 | 31.76 | 31.82 | 23.23 | 34.01 | | |
| NT2RP4000192 | 1.04 | 1.04 | 4.78 | 4.19 | 3.6 | 3.05 | | |
| NT2RP4000194 | 3.13 | 3.13 | 7.53 | 7.58 | 4.98 | 6.36 | | |
| NT2RP4000196 | 6.81 | 6.81 | 43.94 | 35.57 | 46.56 | 41.91 | | |
| NT2RP4000210 | 5.63 | 5.63 | 9.71 | 9.96 | 8.35 | 9.27 | | |
| NT2RP4000212 | 5.59 | 5.59 | 8.88 | 8.57 | 8.41 | 9.08 | | |
| NT2RP4000214 | 5.53 | 5.53 | 10.21 | 5.72 | 6.68 | 11.29 | | |
| NT2RP4000216 | 8.89 | 8.89 | 7.36 | 7 | 12.63 | 10.08 | | |
| NT2RP4000218 | 3.45 | 3.45 | 9.78 | 7.25 | 6.07 | 5.77 | | |
| NT2RP4000223 | 21.18 | 21.18 | 177.28 | 121.81 | 25.75 | 125.3 | | |
| NT2RP4000243 | 16.52 | 16.52 | 54.51 | 42.94 | 41.61 | 51.74 | | |
| NT2RP4000246 | 17.75 | 17.75 | 37.97 | 26.43 | 11.42 | 27.5 | | |
| NT2RP4000250 | 16.86 | 16.86 | 31.23 | 24.92 | 23.85 | 26.39 | | |
| NT2RP4000256 | 4.38 | 4.38 | 8.45 | 4.99 | 6.44 | 4.67 | | |
| NT2RP4000257 | 32.45 | 32.45 | 44.22 | 48.67 | 57.52 | 39.19 | | |
| NT2RP4000259 | 7.07 | 7.07 | 6.96 | 8.48 | 13.07 | 9.08 | | |
| NT2RP4000261 | 4.18 | 4.18 | 8.13 | 4.07 | 4.55 | 6.48 | | |
| NT2RP4000262 | 8.36 | 8.36 | 11.02 | 7.11 | 10.05 | 7.64 | | |
| NT2RP4000263 | 2.6 | 2.6 | 5.14 | 3.47 | 3.67 | 3.78 | | |
| NT2RP4000280 | 5.84 | 5.84 | 11.62 | 9.05 | 11.58 | 14.23 | | |
| NT2RP4000286 | 4.73 | 4.73 | 10.16 | 4.38 | 6.77 | 11.94 | | |
| NT2RP4000290 | 5.77 | 5.77 | 5.42 | 3.18 | 3.19 | 5.5 | | |
| NT2RP4000291 | 42.53 | 42.53 | 73.59 | 62.12 | 70.23 | 70.61 | | |
| NT2RP4000301 | 3.31 | 3.31 | 20.59 | 22.93 | 34.62 | 26.63 | * | + |
| NT2RP4000312 | 7.76 | 7.76 | 45.27 | 39.01 | 43.59 | 45.92 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP4000321 | 3.73 | 3.73 | 8.16 | 7.88 | 7.14 | 9.75 | | |
| NT2RP4000323 | 1.44 | 1.44 | 4.26 | 2.27 | 2.55 | 2.12 | | |
| NT2RP4000324 | 7.77 | 7.77 | 16.76 | 8.33 | 10.2 | 11.08 | | |
| NT2RP4000334 | 20.97 | 20.97 | 77.78 | 63.81 | 71.76 | 68.24 | | |
| NT2RP4000343 | 2.48 | 2.48 | 5.54 | 1.57 | 3.16 | 2.38 | | |
| NT2RP4000348 | 3.4 | 3.4 | 10.81 | 8.38 | 6.75 | 13.2 | | |
| NT2RP4000349 | 1.78 | 1.78 | 0.83 | 0.37 | 0.72 | 2.48 | | |
| NT2RP4000355 | 3.98 | 3.98 | 14.84 | 7.18 | 9.13 | 9.04 | | |
| NT2RP4000356 | 8.3 | 8.3 | 22.64 | 9.22 | 11.44 | 21.13 | | |
| NT2RP4000360 | 3.04 | 3.04 | 6.98 | 5.06 | 5.43 | 4.73 | | |
| NT2RP4000367 | 2.18 | 2.18 | 3.72 | 2.04 | 2.58 | 2.83 | | |
| NT2RP4000370 | 4.21 | 4.21 | 7.51 | 3.62 | 7.12 | 5.99 | | |
| NT2RP4000373 | 3.33 | 3.33 | 5.18 | 3.19 | 5.23 | 2.95 | | |
| NT2RP4000376 | 4.2 | 4.2 | 5.5 | 4.85 | 5.53 | 6.5 | | |
| NT2RP4000381 | 1.97 | 1.97 | 6.46 | 4.31 | 7.01 | 5.59 | | |
| NT2RP4000388 | 85.82 | 85.82 | 204.63 | 128.93 | 93.38 | 116.03 | | |
| NT2RP4000390 | 12.16 | 12.16 | 94.1 | 78.97 | 76.6 | 82.02 | | |
| NT2RP4000393 | 8.66 | 8.66 | 9.77 | 9.09 | 5.99 | 10.79 | | |
| NT2RP4000398 | 5.51 | 5.51 | 26.52 | 22.08 | 28.3 | 26.61 | | |
| NT2RP4000406 | 6.68 | 6.68 | 15.61 | 12.95 | 15.02 | 10.08 | | |
| NT2RP4000407 | 6.17 | 6.17 | 11.52 | 9.41 | 14.74 | 9.13 | | |
| NT2RP4000413 | 1.79 | 1.79 | 3.63 | 1.15 | 2.35 | 2.12 | | |
| NT2RP4000415 | 7.59 | 7.59 | 26.11 | 18.6 | 21.68 | 21.68 | | |
| NT2RP4000417 | 7.76 | 7.76 | 26.64 | 14.47 | 12.79 | 19.19 | | |
| NT2RP4000423 | 3.52 | 3.52 | 7.56 | 7 | 6.98 | 6.46 | | |
| NT2RP4000424 | 2.51 | 2.51 | 7.2 | 3.07 | 5.03 | 3.27 | | |
| NT2RP4000447 | 10.3 | 10.3 | 64.21 | 64.91 | 71.82 | 68.48 | | |
| NT2RP4000448 | 5.59 | 5.59 | 6.67 | 4.32 | 3.56 | 6.27 | | |
| NT2RP4000449 | 5.67 | 5.67 | 20.48 | 14.2 | 19.45 | 14.67 | | |
| NT2RP4000453 | 3.53 | 3.53 | 6.32 | 9.02 | 10.32 | 10.12 | ** | + |
| NT2RP4000455 | 2.64 | 2.64 | 3.98 | 1.81 | 1.75 | 2.4 | | |
| NT2RP4000456 | 12.57 | 12.57 | 21.7 | 14.7 | 9.86 | 13.58 | | |
| NT2RP4000457 | 1.54 | 1.54 | 7.12 | 3.9 | 7.55 | 2.98 | | |
| NT2RP4000461 | 5.7 | 5.7 | 9.84 | 7.65 | 6.41 | 4.6 | | |
| NT2RP4000462 | 11.76 | 11.76 | 15.32 | 11.86 | 11.53 | 17.37 | | |
| NT2RP4000463 | 10.2 | 10.2 | 52.59 | 50.66 | 69.3 | 48.36 | | |
| NT2RP4000471 | 6.36 | 6.36 | 10.74 | 5.74 | 6.23 | 4.98 | | |
| NT2RP4000472 | 3.97 | 3.97 | 4.41 | 1.27 | 1.27 | 1.66 | ** | – |
| NT2RP4000476 | 27.14 | 27.14 | 52.56 | 74.95 | 94.93 | 65.35 | * | + |
| NT2RP4000480 | 11.56 | 11.56 | 29.27 | 19.08 | 9.95 | 26.66 | | |
| NT2RP4000481 | 2.29 | 2.29 | 4.76 | 3.73 | 4.16 | 4.33 | | |
| NT2RP4000483 | 1.38 | 1.38 | 7.59 | 7.58 | 7.85 | 6.26 | | |
| NT2RP4000487 | 1.54 | 1.54 | 4.9 | 2.26 | 3.17 | 0.91 | | |
| NT2RP4000496 | 2.16 | 2.16 | 4.98 | 2.95 | 4.07 | 3.65 | | |
| NT2RP4000497 | 17.15 | 17.15 | 22.33 | 34.9 | 44.46 | 29.9 | * | + |
| NT2RP4000498 | 10.46 | 10.46 | 21.39 | 20.15 | 30.33 | 24.49 | | |
| NT2RP4000500 | 2.43 | 2.43 | 3.21 | 2.03 | 1.49 | 1.39 | * | – |
| NT2RP4000507 | 5.63 | 5.63 | 9.02 | 12.49 | 10.62 | 17.51 | * | + |
| NT2RP4000515 | 12.85 | 12.85 | 88.89 | 90.3 | 101.29 | 96.12 | | |
| NT2RP4000516 | 8.77 | 8.77 | 26.09 | 19.63 | 21.76 | 21.82 | | |
| NT2RP4000517 | 3.22 | 3.22 | 5.73 | 4.69 | 5.89 | 4.79 | | |
| NT2RP4000518 | 3.42 | 3.42 | 7.4 | 4.47 | 6.05 | 3.82 | | |
| NT2RP4000519 | 2.9 | 2.9 | 5.76 | 2.18 | 2.22 | 1.77 | | |
| NT2RP4000524 | 4.2 | 4.2 | 3.44 | 2.05 | 1.72 | 1.3 | ** | – |
| NT2RP4000528 | 3.67 | 3.67 | 3.06 | 3.01 | 3.27 | 8.01 | | |
| NT2RP4000537 | 35.4 | 35.4 | 62.6 | 36.23 | 30.93 | 44.52 | | |
| NT2RP4000541 | 2.04 | 2.04 | 2.45 | 3.34 | 4.33 | 3.09 | * | + |
| NT2RP4000543 | 2.93 | 2.93 | 8.94 | 7.96 | 9.72 | 8.75 | | |
| NT2RP4000545 | 4.03 | 4.03 | 6.38 | 4.99 | 6.43 | 4.78 | | |
| NT2RP4000546 | 3.34 | 3.34 | 5.93 | 5.53 | 4.9 | 6.03 | | |
| NT2RP4000549 | 23.81 | 23.81 | 56.48 | 41.6 | 51.57 | 38.82 | | |
| NT2RP4000556 | 7.36 | 7.36 | 13.04 | 14.69 | 15.54 | 12.07 | | |
| NT2RP4000557 | 6.1 | 6.1 | 4.53 | 1.82 | 3.97 | 6.27 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP4000558 | 30.12 | 30.12 | 94.28 | 68.16 | 57.01 | 73.2 | | |
| NT2RP4000560 | 14.8 | 14.8 | 52.31 | 49.75 | 58.69 | 56.12 | | |
| NT2RP4000568 | 1.72 | 1.72 | 3.83 | 5.6 | 6.08 | 4.46 | * | + |
| NT2RP4000583 | 11.61 | 11.61 | 20.2 | 23.65 | 14.97 | 20.56 | | |
| NT2RP4000585 | 3.04 | 3.04 | 4.14 | 3.12 | 2.55 | 3.24 | | |
| NT2RP4000588 | 8.65 | 8.65 | 12.77 | 14.58 | 16.96 | 13.55 | * | + |
| NT2RP4000590 | 24.89 | 24.89 | 41.97 | 41.86 | 50.81 | 32.65 | | |
| NT2RP4000599 | 4.29 | 4.29 | 3.24 | 2.44 | 2.23 | 3.59 | | |
| NT2RP4000603 | 14.08 | 14.08 | 33.32 | 31.06 | 21.01 | 29.12 | | |
| NT2RP4000607 | 2.41 | 2.41 | 10.04 | 4.45 | 7.87 | 15.35 | | |
| NT2RP4000614 | 6.14 | 6.14 | 15.21 | 15.57 | 12.53 | 15.19 | | |
| NT2RP4000634 | 6.61 | 6.61 | 11 | 7.78 | 9.84 | 10.31 | | |
| NT2RP4000638 | 3.59 | 3.59 | 7.77 | 8.45 | 5.8 | 4.73 | | |
| NT2RP4000648 | 3.13 | 3.13 | 4.26 | 2.54 | 2.69 | 2.19 | | |
| NT2RP4000657 | 9.94 | 9.94 | 15.38 | 15.95 | 18.93 | 14.49 | | |
| NT2RP4000691 | 5.76 | 5.76 | 5.82 | 4.92 | 7.47 | 7.73 | | |
| NT2RP4000697 | 3.74 | 3.74 | 8.5 | 5.55 | 6.56 | 6.12 | | |
| NT2RP4000704 | 8.91 | 8.91 | 47.2 | 44.17 | 54.81 | 38.14 | | |
| NT2RP4000710 | 40.22 | 40.22 | 98.85 | 90.4 | 59.28 | 83.71 | | |
| NT2RP4000713 | 4.35 | 4.35 | 19.92 | 16.67 | 20.85 | 15.52 | | |
| NT2RP4000724 | 6.29 | 6.29 | 12.5 | 8.19 | 9.81 | 7.83 | | |
| NT2RP4000725 | 3.61 | 3.61 | 4 | 1.88 | 1.74 | 2.33 | ** | − |
| NT2RP4000728 | 10.13 | 10.13 | 41.12 | 43.53 | 66.46 | 39.83 | | |
| NT2RP4000737 | 4.07 | 4.07 | 2.15 | 3.63 | 3.09 | 3.28 | | |
| NT2RP4000739 | 5.07 | 5.07 | 7.71 | 4.61 | 3.63 | 5.84 | | |
| NT2RP4000749 | 2.4 | 2.4 | 5.29 | 2.59 | 3.97 | 1.68 | | |
| NT2RP4000769 | 4.93 | 4.93 | 10.12 | 4.67 | 6.27 | 6.2 | | |
| NT2RP4000774 | 3.34 | 3.34 | 8.87 | 5.12 | 6.63 | 4.27 | | |
| NT2RP4000781 | 2.15 | 2.15 | 5.12 | 2.06 | 2.26 | 1.55 | | |
| NT2RP4000783 | 6.81 | 6.81 | 15.16 | 13.48 | 15.44 | 12.67 | | |
| NT2RP4000787 | 1.45 | 1.45 | 2.27 | 0.31 | 0.51 | 0.54 | * | − |
| NT2RP4000788 | 3.58 | 3.58 | 23.26 | 16 | 18.3 | 18.73 | | |
| NT2RP4000792 | 3.68 | 3.68 | 5.64 | 5.5 | 5.8 | 9.45 | | |
| NT2RP4000809 | 43.7 | 43.7 | 56.09 | 46.75 | 50.47 | 81.62 | | |
| NT2RP4000817 | 3.65 | 3.65 | 7.83 | 7.92 | 7.25 | 5.82 | | |
| NT2RP4000821 | 31.34 | 31.34 | 38.66 | 28.32 | 33.11 | 25.22 | | |
| NT2RP4000822 | 2.46 | 2.46 | 5.91 | 4.29 | 6.19 | 2.6 | | |
| NT2RP4000823 | 697.74 | 697.74 | 1127.48 | 923.16 | 1026.8 | 947.85 | | |
| NT2RP4000831 | 9.98 | 9.98 | 61.97 | 44.37 | 68.47 | 50.69 | | |
| NT2RP4000833 | 3.19 | 3.19 | 11.26 | 6.73 | 7.19 | 11.91 | | |
| NT2RP4000837 | 1.41 | 1.41 | 4.03 | 1.56 | 3.65 | 2.29 | | |
| NT2RP4000839 | 12.23 | 12.23 | 97.13 | 79.71 | 85.74 | 86.06 | | |
| NT2RP4000846 | 3.8 | 3.8 | 10.13 | 4.65 | 3.46 | 6.65 | | |
| NT2RP4000848 | 4.63 | 4.63 | 10.74 | 8.65 | 8.58 | 6.07 | | |
| NT2RP4000855 | 2.91 | 2.91 | 4.7 | 4 | 3.85 | 3.43 | | |
| NT2RP4000863 | 3.08 | 3.08 | 4.33 | 3.11 | 5.3 | 3.78 | | |
| NT2RP4000865 | 6.43 | 6.43 | 25.36 | 20.09 | 39.64 | 21.24 | | |
| NT2RP4000873 | 9.64 | 9.64 | 88.25 | 63.22 | 69.65 | 71.33 | | |
| NT2RP4000874 | 1.76 | 1.76 | 3.98 | 2.37 | 3.67 | 2.03 | | |
| NT2RP4000875 | 3.31 | 3.31 | 9.24 | 6.88 | 6.52 | 7.19 | | |
| NT2RP4000878 | 24.17 | 24.17 | 42.53 | 28.01 | 16.35 | 29.04 | | |
| NT2RP4000879 | 2.56 | 2.56 | 5.1 | 2.95 | 5.29 | 2.62 | | |
| NT2RP4000880 | 5.17 | 5.17 | 21.59 | 20.97 | 27.22 | 16.8 | | |
| NT2RP4000891 | 81.07 | 81.07 | 192.57 | 252.29 | 351.53 | 221.08 | * | + |
| NT2RP4000894 | 5.16 | 5.16 | 9.81 | 8.53 | 4.8 | 6.97 | | |
| NT2RP4000898 | 0.86 | 0.86 | 2.74 | 1.88 | 2.14 | 1.64 | | |
| NT2RP4000899 | 9.63 | 9.63 | 29.48 | 24.01 | 20.85 | 23.95 | | |
| NT2RP4000907 | 2.14 | 2.14 | 3.58 | 1.74 | 4.04 | 0.81 | | |
| NT2RP4000908 | 4.62 | 4.62 | 9.67 | 7.51 | 5.9 | 5.87 | | |
| NT2RP4000910 | 14.4 | 14.4 | 104.68 | 124.04 | 197.74 | 160.9 | * | + |
| NT2RP4000918 | 2.85 | 2.85 | 4.76 | 4.73 | 4.26 | 5.35 | | |
| NT2RP4000925 | 3.9 | 3.9 | 5.53 | 2.81 | 3.15 | 1.86 | | |
| NT2RP4000927 | 1.99 | 1.99 | 2.5 | 0.46 | 1.08 | 0.6 | ** | − |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP4000928 | 3.11 | 3.11 | 6.8 | 4.48 | 4.22 | 5.18 | | |
| NT2RP4000929 | 1.44 | 1.44 | 3.68 | 1.94 | 2.86 | 0.84 | | |
| NT2RP4000946 | 0.92 | 0.92 | 3.41 | 1.78 | 3.22 | 1.47 | | |
| NT2RP4000947 | 1.71 | 1.71 | 3.51 | 1.94 | 3.31 | 1.79 | | |
| NT2RP4000949 | 4.94 | 4.94 | 7.84 | 3.88 | 5.48 | 2.38 | | |
| NT2RP4000955 | 4.17 | 4.17 | 6.34 | 2.07 | 2.86 | 0.54 | * | – |
| NT2RP4000959 | 20.55 | 20.55 | 28.14 | 36.21 | 42.82 | 36.14 | * | + |
| NT2RP4000962 | 3.4 | 3.4 | 4.24 | 8.33 | 10.09 | 4.53 | | |
| NT2RP4000973 | 8.6 | 8.6 | 16.04 | 10.31 | 8.92 | 9.03 | | |
| NT2RP4000975 | 2.18 | 2.18 | 5.84 | 3.29 | 3.05 | 2.62 | | |
| NT2RP4000979 | 3.83 | 3.83 | 8.67 | 5.55 | 8.13 | 7.1 | | |
| NT2RP4000984 | 1.61 | 1.61 | 4.31 | 3.15 | 3.93 | 1.85 | | |
| NT2RP4000986 | 7.32 | 7.32 | 13.27 | 12.66 | 12.35 | 2.52 | | |
| NT2RP4000988 | 5.74 | 5.74 | 8.37 | 4 | 5.2 | 2.63 | | |
| NT2RP4000989 | 6.24 | 6.24 | 6.55 | 4.05 | 3.48 | 2.89 | ** | – |
| NT2RP4000990 | 3.16 | 3.16 | 4 | 1.92 | 1.69 | 2.16 | ** | – |
| NT2RP4000994 | 4.04 | 4.04 | 7.67 | 16.48 | 10.13 | 15.95 | * | + |
| NT2RP4000996 | 3.54 | 3.54 | 7.49 | 6.77 | 6.52 | 7.38 | | |
| NT2RP4000997 | 21.59 | 21.59 | 36.81 | 28.52 | 15.18 | 34.38 | | |
| NT2RP4001001 | 5.53 | 5.53 | 9.17 | 16.66 | 18.38 | 15.09 | ** | + |
| NT2RP4001004 | 1.71 | 1.71 | 4.88 | 2.84 | 3.09 | 1.37 | | |
| NT2RP4001006 | 3.46 | 3.46 | 8.12 | 6.85 | 6.52 | 6.13 | | |
| NT2RP4001009 | 9.3 | 9.3 | 10.45 | 15.44 | 20.46 | 8.25 | | |
| NT2RP4001010 | 7.33 | 7.33 | 9.13 | 7.38 | 9.75 | 6.68 | | |
| NT2RP4001013 | 23.29 | 23.29 | 50.16 | 30.87 | 28.1 | 30.91 | | |
| NT2RP4001029 | 2.49 | 2.49 | 5.95 | 4.05 | 2.84 | 3.63 | | |
| NT2RP4001036 | 7.55 | 7.55 | 13.55 | 9.11 | 11.51 | 13.16 | | |
| NT2RP4001041 | 6.57 | 6.57 | 14.4 | 9.89 | 12.3 | 6.35 | | |
| NT2RP4001042 | 4.34 | 4.34 | 8.11 | 9.44 | 12.5 | 8.79 | | |
| NT2RP4001046 | 6.98 | 6.98 | 9.95 | 13.24 | 16.28 | 15.36 | ** | + |
| NT2RP4001050 | 5.28 | 5.28 | 4.81 | 3.79 | 4.64 | 3.35 | * | – |
| NT2RP4001051 | 6.48 | 6.48 | 8.44 | 5.43 | 6.82 | 5.26 | | |
| NT2RP4001057 | 0.76 | 0.76 | 2.19 | 2.34 | 2.43 | 1.87 | | |
| NT2RP4001063 | 1.48 | 1.48 | 4.39 | 3.34 | 3.53 | 1.8 | | |
| NT2RP4001064 | 3.51 | 3.51 | 9.18 | 12.02 | 9.13 | 11.57 | | |
| NT2RP4001067 | 4.42 | 4.42 | 9.77 | 10.96 | 9.63 | 6.6 | | |
| NT2RP4001078 | 2.12 | 2.12 | 3.43 | 2.67 | 2.53 | 1.82 | | |
| NT2RP4001079 | 5.3 | 5.3 | 9.35 | 8.51 | 8.02 | 8.98 | | |
| NT2RP4001080 | 4.1 | 4.1 | 5.27 | 3.52 | 4.52 | 2.3 | | |
| NT2RP4001086 | 5.08 | 5.08 | 4.19 | 3.93 | 6.64 | 2.85 | | |
| NT2RP4001095 | 2.49 | 2.49 | 7.25 | 7.96 | 6.49 | 6.85 | | |
| NT2RP4001098 | 0.92 | 0.92 | 3.38 | 3.87 | 2.95 | 3.41 | | |
| NT2RP4001100 | 6.47 | 6.47 | 24.34 | 20.89 | 20.64 | 16.99 | | |
| NT2RP4001105 | 3.13 | 3.13 | 7.23 | 6.51 | 5.58 | 4.61 | | |
| NT2RP4001110 | 1.75 | 1.75 | 3.5 | 7.07 | 8.35 | 5.29 | * | + |
| NT2RP4001115 | 9.95 | 9.95 | 17.68 | 20.6 | 18.48 | 15.31 | | |
| NT2RP4001117 | 19.81 | 19.81 | 30.49 | 35.35 | 42.53 | 27.5 | | |
| NT2RP4001122 | 6.06 | 6.06 | 6.09 | 5.17 | 6.25 | 3.27 | | |
| NT2RP4001123 | 3.62 | 3.62 | 7.76 | 7.95 | 5.96 | 6.27 | | |
| NT2RP4001126 | 4.36 | 4.36 | 11.28 | 10.87 | 9.09 | 8.04 | | |
| NT2RP4001127 | 3.25 | 3.25 | 4.59 | 3.39 | 3.08 | 2.17 | | |
| NT2RP4001138 | 2.46 | 2.46 | 5.8 | 3.41 | 2.56 | 1.62 | | |
| NT2RP4001143 | 2.73 | 2.73 | 5.98 | 6.44 | 6.54 | 5.66 | | |
| NT2RP4001148 | 3.72 | 3.72 | 6.76 | 3.77 | 3.03 | 2.05 | | |
| NT2RP4001149 | 5.07 | 5.07 | 7.28 | 6.76 | 9.03 | 6.37 | | |
| NT2RP4001150 | 3.8 | 3.8 | 3.17 | 3.15 | 3.7 | 2.88 | | |
| NT2RP4001159 | 7.08 | 7.08 | 11.61 | 7.69 | 5.58 | 10.46 | | |
| NT2RP4001162 | 3.77 | 3.77 | 6.14 | 4.07 | 6.06 | 3.41 | | |
| NT2RP4001170 | 1.15 | 1.15 | 4.53 | 1.28 | 3.2 | 2.15 | | |
| NT2RP4001174 | 4.16 | 4.16 | 12.27 | 7.91 | 11.95 | 5.02 | | |
| NT2RP4001175 | 9.65 | 9.65 | 19.14 | 15.72 | 21.29 | 13.28 | | |
| NT2RP4001176 | 99.19 | 99.19 | 161.51 | 174.03 | 241.92 | 194 | * | + |
| NT2RP4001184 | 4.83 | 4.83 | 27.1 | 25.76 | 32.51 | 22.85 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP4001198 | 21.66 | 21.66 | 48.22 | 29.54 | 29.17 | 38.54 | | |
| NT2RP4001199 | 2.52 | 2.52 | 6.45 | 2.59 | 4.74 | 3.71 | | |
| NT2RP4001206 | 8.25 | 8.25 | 33.2 | 25.92 | 32.07 | 25.48 | | |
| NT2RP4001207 | 2.38 | 2.38 | 5.15 | 2.21 | 3.11 | 4.01 | | |
| NT2RP4001210 | 2.73 | 2.73 | 5.2 | 3.62 | 4.26 | 2.64 | | |
| NT2RP4001213 | 3.42 | 3.42 | 5.11 | 3.99 | 4.23 | 3.63 | | |
| NT2RP4001214 | 3.34 | 3.34 | 4.3 | 3.51 | 3.76 | 2.16 | | |
| NT2RP4001219 | 7.4 | 7.4 | 12.05 | 14.35 | 19.28 | 13.39 | * | + |
| NT2RP4001228 | 5.26 | 5.26 | 9.6.31 | 2.15 | 15.74 | 20.07 | * | + |
| NT2RP4001235 | 2.42 | 2.42 | 7.45 | 3.46 | 6.02 | 4.48 | | |
| NT2RP4001256 | 2.11 | 2.11 | 4.24 | 1.66 | 3.41 | 2.66 | | |
| NT2RP4001257 | 2.48 | 2.48 | 7.27 | 4.05 | 4.35 | 4.05 | | |
| NT2RP4001260 | 3.16 | 3.16 | 5.79 | 2.52 | 3.86 | 2.92 | | |
| NT2RP4001261 | 3.84 | 3.84 | 6.63 | 8.42 | 6.47 | 5 | | |
| NT2RP4001274 | 22.92 | 22.92 | 38.08 | 25.02 | 31.56 | 21.25 | | |
| NT2RP4001276 | 5.24 | 5.24 | 10.03 | 11.38 | 15.97 | 11.63 | * | + |
| NT2RP4001283 | 20.72 | 20.72 | 122.55 | 87.44 | 93.43 | 86.47 | | |
| NT2RP4001299 | 9.62 | 9.62 | 15.14 | 14.95 | 10.52 | 15.18 | | |
| NT2RP4001313 | 1.45 | 1.45 | 3.26 | 1.72 | 2.96 | 0.97 | | |
| NT2RP4001315 | 6.06 | 6.06 | 11.14 | 7.45 | 9.92 | 7.74 | | |
| NT2RP4001320 | 14.6 | 14.6 | 42.74 | 32.02 | 38.13 | 29.24 | | |
| NT2RP4001325 | 32.53 | 32.53 | 146.14 | 142.88 | 178.36 | 128.89 | | |
| NT2RP4001336 | 6.69 | 6.69 | 40.75 | 38.55 | 46.66 | 32.11 | | |
| NT2RP4001339 | 4.12 | 4.12 | 5.6 | 3.35 | 5.56 | 2.76 | | |
| NT2RP4001343 | 10.46 | 10.46 | 83.37 | 54.71 | 61.01 | 60.06 | | |
| NT2RP4001344 | 6.7 | 6.7 | 60.08 | 49.79 | 55.21 | 42.62 | | |
| NT2RP4001345 | 1.65 | 1.65 | 6.68 | 5.64 | 5.7 | 3.87 | | |
| NT2RP4001351 | 4.1 | 4.1 | 15.97 | 10.01 | 20.05 | 11.42 | | |
| NT2RP4001353 | 2.8 | 2.8 | 5.91 | 1.63 | 2.94 | 1.86 | | |
| NT2RP4001355 | 2.57 | 2.57 | 8.67 | 1.83 | 3.12 | 2.08 | | |
| NT2RP4001367 | 10.64 | 10.64 | 17.66 | 11.92 | 17.0.61 | 3.16 | | |
| NT2RP4001372 | 2.26 | 2.26 | 3.82 | 2.1 | 2.06 | 2.07 | | |
| NT2RP4001373 | 8.86 | 8.86 | 16.4 | 10.99 | 8.59 | 11.48 | | |
| NT2RP4001375 | 2.71 | 2.71 | 6.06 | 4.91 | 7.42 | 2.94 | | |
| NT2RP4001379 | 1.74 | 1.74 | 3.52 | 2.34 | 4.67 | 1.38 | | |
| NT2RP4001381 | 5.6 | 5.6 | 12.51 | 12.8 | 12.66 | 8.27 | | |
| NT2RP4001386 | 6.39 | 6.39 | 14.52 | 14.77 | 20.11 | 12.32 | | |
| NT2RP4001389 | 7.28 | 7.28 | 8.66 | 5.43 | 9.25 | 4.09 | | |
| NT2RP4001396 | 5.76 | 5.76 | 6.42 | 2.83 | 4.61 | 2.12 | * | − |
| NT2RP4001407 | 2.92 | 2.92 | 2.98 | 3.07 | 2.04 | 1.76 | | |
| NT2RP4001409 | 13.61 | 3.6 | 28.28 | 8.87 | 5.85 | 8.84 | | |
| NT2RP4001410 | 33.56 | 33.56 | 61.26 | 40.57 | 18.92 | 37.8 | | |
| NT2RP4001414 | 16.59 | 16.59 | 37.89 | 14.29 | 21.3 | 16.8 | | |
| NT2RP4001424 | 3.55 | 3.55 | 8.85 | 7.99 | 10.45 | 7.41 | | |
| NT2RP4001433 | 3.85 | 3.85 | 6 | 8.39 | 9.79 | 3.38 | | |
| NT2RP4001438 | 9.95 | 9.95 | 27.94 | 46.22 | 53.63 | 30.76 | * | + |
| NT2RP4001442 | 4.33 | 4.33 | 4.97 | 3.3 | 3.41 | 2.64 | * | − |
| NT2RP4001447 | 4.42 | 4.42 | 4.69 | 5.08 | 5.51 | 3.41 | | |
| NT2RP4001466 | 3.74 | 3.74 | 5.45 | 7.38 | 3.23 | 5.57 | | |
| NT2RP4001467 | 21.67 | 21.67 | 58.89 | 54.18 | 44.07 | 55.8 | | |
| NT2RP4001472 | 8.05 | 8.05 | 12.19 | 11.7 | 11.76 | 11.97 | | |
| NT2RP4001474 | 2.83 | 2.83 | 4.81 | 3.2 | 5.73 | 1.98 | | |
| NT2RP4001483 | 1.48 | 1.48 | 4.33 | 2.61 | 3.7 | 1.19 | | |
| NT2RP4001488 | 21.03 | 21.03 | 32.41 | 39.07 | 46.9 | 33.42 | | |
| NT2RP4001492 | 4.18 | 4.18 | 6.73 | 3.21 | 3.81 | 1.91 | | |
| NT2RP4001498 | 4.3 | 4.3 | 2.43 | 2.95 | 3.52 | 2.13 | | |
| NT2RP4001502 | 28.2 | 28.2 | 57.38 | 27.65 | 34.81 | 41.83 | | |
| NT2RP4001503 | 3.83 | 3.83 | 6.74 | 5.51 | 4.1 | 3.37 | | |
| NT2RP4001507 | 2.39 | 2.39 | 3.69 | 5.03 | 5.95 | 5.18 | ** | + |
| NT2RP4001510 | 1.74 | 1.74 | 4.63 | 5.64 | 5.05 | 3.02 | | |
| NT2RP4001516 | 3.54 | 3.54 | 4.16 | 2.52 | 1.9 | 1.27 | * | − |
| NT2RP4001520 | 25.33 | 25.33 | 70.64 | 73.93 | 107.21 | 85.05 | | |
| NT2RP4001523 | 5.57 | 5.57 | 9.99 | 8.4 | 7.79 | 6.19 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP4001524 | 6.1 | 6.1 | 10.17 | 8.92 | 11.45 | 5.98 | | |
| NT2RP4001529 | 29.8 | 29.8 | 74.89 | 59.39 | 60.69 | 55.29 | | |
| NT2RP4001531 | 2.88 | 2.88 | 10.96 | 8.63 | 11.05 | 7.81 | | |
| NT2RP4001546 | 143.48 | 143.48 | 388.31 | 316.63 | 215.6 | 309.45 | | |
| NT2RP4001547 | 9.05 | 9.05 | 26.31 | 28.76 | 23.06 | 18.81 | | |
| NT2RP4001551 | 2.27 | 2.27 | 3.93 | 3.87 | 4.08 | 2.02 | | |
| NT2RP4001555 | 2.95 | 2.95 | 5.8 | 4.14 | 3.58 | 1.74 | | |
| NT2RP4001567 | 6.54 | 6.54 | 6.88 | 5.82 | 7.12 | 5.68 | | |
| NT2RP4001568 | 7.58 | 7.58 | 11.65 | 10.02 | 19.33 | 12.97 | | |
| NT2RP4001569 | 15.49 | 15.49 | 41.42 | 32.56 | 40.11 | 27.18 | | |
| NT2RP4001571 | 5.75 | 5.75 | 13.28 | 9.06 | 7.43 | 8.13 | | |
| NT2RP4001574 | 8.5 | 8.5 | 19.03 | 15.54 | 17.52 | 15.29 | | |
| NT2RP4001575 | 2.46 | 2.46 | 5.86 | 5.71 | 5.53 | 4.24 | | |
| NT2RP4001578 | 17.21 | 17.21 | 45.64 | 52.76 | 53.63 | 40.92 | | |
| NT2RP4001592 | 9.76 | 9.76 | 13.68 | 14.13 | 19.64 | 11.68 | | |
| NT2RP4001593 | 9.4 | 9.4 | 18.11 | 22.12 | 27.3 | 18.04 | | |
| NT2RP4001605 | 5.97 | 5.97 | 4.78 | 4.1 | 7.77 | 4.66 | | |
| NT2RP4001606 | 2.9 | 2.9 | 8.34 | 6.01 | 3.51 | 6.75 | | |
| NT2RP4001607 | 2.04 | 2.04 | 5.24 | 4.57 | 3.26 | 3.78 | | |
| NT2RP4001610 | 1.74 | 1.74 | 2.42 | 2.6 | 2.48 | 1.7 | | |
| NT2RP4001614 | 2.17 | 2.17 | 7.19 | 5.38 | 4.34 | 6.86 | | |
| NT2RP4001623 | 2.38 | 2.38 | 5.26 | 2.43 | 2.65 | 2.02 | | |
| NT2RP4001626 | 9.48 | 9.48 | 11.67 | 18.67 | 23.9 | 19.44 | ** | + |
| NT2RP4001634 | 2.74 | 2.74 | 4.93 | 3.67 | 5.24 | 4.26 | | |
| NT2RP4001638 | 3.41 | 3.41 | 3.03 | 2.36 | 2.11 | 1.87 | ** | – |
| NT2RP4001644 | 7.86 | 7.86 | 33.73 | 24.36 | 26.04 | 24.99 | | |
| NT2RP4001646 | 11.61 | 11.61 | 15.02 | 7.42 | 10.74 | 11.21 | | |
| NT2RP4001656 | 3.75 | 3.75 | 5.23 | 2.89 | 4.51 | 2.07 | | |
| NT2RP4001666 | 1.99 | 1.99 | 4.68 | 3.26 | 6.25 | 2.02 | | |
| NT2RP4001670 | 11.74 | 11.74 | 15.51 | 12.45 | 7.09 | 8.31 | | |
| NT2RP4001677 | 28.27 | 28.27 | 42.75 | 42.01 | 45.48 | 47.53 | | |
| NT2RP4001679 | 8.82 | 8.82 | 33.83 | 33.23 | 51.5 | 29.78 | | |
| NT2RP4001695 | 7.71 | 7.71 | 12.76 | 15.66 | 20.35 | 12.87 | | |
| NT2RP4001696 | 2.64 | 2.64 | 5.45 | 3.13 | 3.92 | 3.72 | | |
| NT2RP4001699 | 3.58 | 3.58 | 8.03 | 3.18 | 4.12 | 4.42 | | |
| NT2RP4001717 | 2.79 | 2.79 | 7.03 | 3.29 | 5.84 | 4.15 | | |
| NT2RP4001719 | 3.59 | 3.59 | 9.11 | 7.6 | 9.27 | 6.28 | | |
| NT2RP4001725 | 2.27 | 2.27 | 4.79 | 2.28 | 5.07 | 1.43 | | |
| NT2RP4001726 | 7.07 | 7.07 | 11.18 | 5.85 | 6.91 | 4.98 | | |
| NT2RP4001730 | 3.11 | 3.11 | 12.82 | 11.96 | 19.81 | 16.3 | | |
| NT2RP4001739 | 2.83 | 2.83 | 5.83 | 5.79 | 6.55 | 4.98 | | |
| NT2RP4001741 | 7.25 | 7.25 | 15.93 | 9.28 | 12.42 | 10.97 | | |
| NT2RP4001753 | 3.04 | 3.04 | 8.4 | 4.39 | 4.64 | 6.64 | | |
| NT2RP4001760 | 4.32 | 4.32 | 6.6 | 7.79 | 7.73 | 12.96 | | |
| NT2RP4001787 | 67.61 | 67.61 | 173.05 | 169.17 | 187.11 | 93.22 | | |
| NT2RP4001790 | 2 | 2 | 5.29 | 3.42 | 2.97 | 2.58 | | |
| NT2RP4001795 | 9.31 | 9.31 | 12.31 | 14.38 | 19.76 | 12.34 | | |
| NT2RP4001803 | 3.35 | 3.35 | 3.6 | 3.94 | 4.78 | 3.67 | | |
| NT2RP4001805 | 2.64 | 2.64 | 3.57 | 3.64 | 2.47 | 2.95 | | |
| NT2RP4001809 | 4.84 | 4.84 | 26.35 | 18.18 | 23.17 | 11.33 | | |
| NT2RP4001817 | 11.55 | 11.55 | 19.09 | 9.5 | 10.78 | 12.71 | | |
| NT2RP4001822 | 2.09 | 2.09 | 5.36 | 3.73 | 5.11 | 3.33 | | |
| NT2RP4001823 | 1.91 | 1.91 | 3.95 | 1.14 | 3.34 | 1.24 | | |
| NT2RP4001827 | 14.88 | 14.88 | 25.96 | 35.78 | 40.37 | 29.5 | * | + |
| NT2RP4001828 | 9.76 | 9.76 | 34.37 | 27.78 | 34.21 | 26.3 | | |
| NT2RP4001836 | 7.74 | 7.74 | 33.26 | 27.19 | 39.14 | 26.78 | | |
| NT2RP4001838 | 1.59 | 1.59 | 7.49 | 2.09 | 4.5 | 2.71 | | |
| NT2RP4001841 | 8.75 | 8.75 | 80.37 | 61.67 | 50.27 | 56.46 | | |
| NT2RP4001849 | 1.9 | 1.9 | 4.55 | 2.51 | 5.08 | 1.58 | | |
| NT2RP4001861 | 7.27 | 7.27 | 34.6 | 36.09 | 41.9 | 34.39 | | |
| NT2RP4001877 | 6.59 | 6.59 | 8.44 | 12.87 | 9.04 | 14.1 | * | + |
| NT2RP4001879 | 9.64 | 9.64 | 15.47 | 11.58 | 14.24 | 10.73 | | |
| NT2RP4001889 | 5.09 | 5.09 | 10.66 | 6.68 | 11.25 | 8.91 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP4001893 | 3.97 | 3.97 | 7.34 | 3.19 | 6.11 | 2.72 | | |
| NT2RP4001896 | 3.18 | 3.18 | 6.86 | 5.38 | 7.87 | 4.92 | | |
| NT2RP4001898 | 7.83 | 7.83 | 26.41 | 22.98 | 20.13 | 20.15 | | |
| NT2RP4001901 | 1.73 | 1.73 | 4.69 | 4.08 | 5.87 | 2.69 | | |
| NT2RP4001910 | 39.51 | 39.51 | 58.21 | 53.45 | 33.59 | 45.93 | | |
| NT2RP4001925 | 4.1 | 4.1 | 10.21 | 6.69 | 6.32 | 6.12 | | |
| NT2RP4001926 | 6.41 | 6.41 | 7.22 | 7.1 | 9.54 | 5.52 | | |
| NT2RP4001927 | 6.26 | 6.26 | 9.97 | 5.83 | 8.13 | 2.82 | | |
| NT2RP4001931 | 8.64 | 8.64 | 14.16 | 15.49 | 17.54 | 11.89 | | |
| NT2RP4001933 | 38.49 | 38.49 | 87.13 | 96.81 | 133.51 | 91.22 | | |
| NT2RP4001938 | 2.93 | 2.93 | 4.53 | 4.27 | 3.31 | 3.55 | | |
| NT2RP4001942 | 13.44 | 13.44 | 27.12 | 31.34 | 24.8 | 18.71 | | |
| NT2RP4001945 | 1.41 | 1.41 | 4 | 1.55 | 3.67 | 1.77 | | |
| NT2RP4001946 | 1.97 | 1.97 | 5.67 | 3.04 | 3.96 | 1.66 | | |
| NT2RP4001947 | 4.42 | 4.42 | 8.93 | 5.92 | 9.81 | 5.16 | | |
| NT2RP4001950 | 4.13 | 4.13 | 5 | 2.25 | 2.84 | 1.34 | * | − |
| NT2RP4001953 | 10.44 | 10.44 | 14.15 | 13.81 | 19.4 | 14.36 | | |
| NT2RP4001966 | 2.44 | 2.44 | 2.41 | 2.51 | 4.26 | 1.52 | | |
| NT2RP4001970 | 2.26 | 2.26 | 5.32 | 3.91 | 3.4 | 2.88 | | |
| NT2RP4001975 | 8.56 | 8.56 | 20.03 | 18.32 | 13.05 | 12.02 | | |
| NT2RP4001988 | 6.72 | 6.72 | 18.78 | 22.92 | 24.78 | 29.44 | * | + |
| NT2RP4001996 | 5.27 | 5.27 | 12.83 | 10.65 | 16.35 | 12.42 | | |
| NT2RP4002014 | 3.4 | 3.4 | 8.14 | 43.19 | 37.87 | 33.17 | ** | + |
| NT2RP4002018 | 6.19 | 6.19 | 13.71 | 10.47 | 11.39 | 10.36 | | |
| NT2RP4002035 | 5.35 | 5.35 | 5.95 | 5.4 | 4.17 | 2.54 | | |
| NT2RP4002043 | 7.1 | 7.1 | 10.8 | 9.64 | 12.2 | 6.5 | | |
| NT2RP4002046 | 9.74 | 9.74 | 20.08 | 21.94 | 15.28 | 17.11 | | |
| NT2RP4002047 | 8.37 | 8.37 | 19.18 | 22.28 | 24.07 | 28.83 | * | + |
| NT2RP4002052 | 5.78 | 5.78 | 10.36 | 9.02 | 9.36 | 9.37 | | |
| NT2RP4002056 | 32.58 | 32.58 | 71.49 | 58.09 | 76.58 | 49.75 | | |
| NT2RP4002057 | 6.37 | 6.37 | 11.06 | 12.13 | 13.58 | 7.41 | | |
| NT2RP4002058 | 3.85 | 3.85 | 6.6 | 4.1 | 4.2 | 3.22 | | |
| NT2RP4002064 | 5.93 | 5.93 | 4.39 | 2.6 | 4.16 | 2.07 | * | − |
| NT2RP4002071 | 6.67 | 6.67 | 7.07 | 6.95 | 10.06 | 6.27 | | |
| NT2RP4002075 | 1.16 | 1.16 | 2.11 | 2.27 | 2.35 | 1.27 | | |
| NT2RP4002078 | 2.25 | 2.25 | 8.63 | 6.86 | 8.24 | 4.97 | | |
| NT2RP4002081 | 8.11 | 8.11 | 26.15 | 18.73 | 18.78 | 19.42 | | |
| NT2RP4002083 | 1.39 | 1.39 | 5.25 | 3.36 | 3.16 | 1.88 | | |
| NT2RP4002099 | 3.26 | 3.26 | 4.73 | 2.84 | 3.56 | 2.51 | | |
| NT2RP4002106 | 10.35 | 10.35 | 20.34 | 22.36 | 25.93 | 20.55 | | |
| NT2RP4002111 | 11.7 | 11.7 | 12.37 | 19.77 | 30.44 | 17.72 | | |
| NT2RP4002112 | 6.15 | 6.15 | 10.97 | 8.9 | 8.34 | 3.22 | | |
| NT2RP4002116 | 12.6 | 12.6 | 47.19 | 37.43 | 41.25 | 28.65 | | |
| NT2RP4002122 | 5.34 | 5.34 | 9.29 | 14.84 | 14.86 | 12.67 | ** | + |
| NT2RP4002126 | 6.42 | 6.42 | 14.44 | 16.82 | 14.35 | 10.42 | | |
| NT2RP4002133 | 7.56 | 7.56 | 20.82 | 29.17 | 26.14 | 21 | | |
| NT2RP4002136 | 3.63 | 3.63 | 5.74 | 4.89 | 5.38 | 2.69 | | |
| NT2RP4002139 | 26.89 | 26.89 | 31.12 | 60.65 | 61.92 | 32.88 | | |
| NT2RP4002174 | 139.27 | 139.27 | 232.64 | 240.71 | 275.01 | 193.19 | | |
| NT2RP4002185 | 7.77 | 7.77 | 13.2 | 12.36 | 19.06 | 11.58 | | |
| NT2RP4002186 | 4.5 | 4.5 | 9.83 | 7.82 | 4.72 | 6.78 | | |
| NT2RP4002187 | 15.42 | 15.42 | 32.13 | 26.94 | 19.84 | 21.17 | | |
| NT2RP4002188 | 3.01 | 3.01 | 8.34 | 8.3 | 7.75 | 6.41 | | |
| NT2RP4002199 | 1.85 | 1.85 | 3.73 | 2.6 | 2.91 | 3.78 | | |
| NT2RP4002206 | 2.08 | 2.08 | 3.39 | 2.48 | 2.34 | 1.29 | | |
| NT2RP4002210 | 3.13 | 3.13 | 4.75 | 2.02 | 2.86 | 0.98 | | |
| NT2RP4002222 | 4.2 | 4.2 | 6.63 | 5.56 | 6.28 | 4.16 | | |
| NT2RP4002241 | 7.97 | 7.97 | 8.24 | 10.82 | 11.75 | 7.19 | | |
| NT2RP4002248 | 5.08 | 5.08 | 16.69 | 10.74 | 8.9 | 8.13 | | |
| NT2RP4002250 | 1.54 | 1.54 | 3.22 | 0.73 | 1.69 | 0.56 | | |
| NT2RP4002259 | 4.86 | 4.86 | 9.82 | 3.21 | 4.85 | 1.75 | | |
| NT2RP4002268 | 16.62 | 16.62 | 29.54 | 28.9 | 28.18 | 25.68 | | |
| NT2RP4002288 | 6.42 | 6.42 | 12.57 | 13.29 | 14.36 | 11.97 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP4002290 | 7.55 | 7.55 | 7.61 | 7.96 | 7.67 | 5.87 | | |
| NT2RP4002298 | 3.92 | 3.92 | 4.18 | 5.54 | 5.03 | 4.18 | | |
| NT2RP4002306 | 2.38 | 2.38 | 5.79 | 2.97 | 5.77 | 2.64 | | |
| NT2RP4002308 | 2.04 | 2.04 | 6.03 | 5.31 | 5.23 | 4.1 | | |
| NT2RP4002336 | 2.71 | 2.71 | 6.33 | 3.71 | 4.19 | 4.63 | | |
| NT2RP4002340 | 1.09 | 1.09 | 3.96 | 1.28 | 2.75 | 0.49 | | |
| NT2RP4002361 | 2.77 | 2.77 | 5.78 | 3.73 | 4.03 | 2.48 | | |
| NT2RP4002367 | 2.27 | 2.27 | 5.84 | 3.23 | 2.48 | 2.77 | | |
| NT2RP4002368 | 9.87 | 9.87 | 17.2 | 18.26 | 19.27 | 16 | | |
| NT2RP4002377 | 3.3 | 3.3 | 23.8 | 25.46 | 30.75 | 23.93 | | |
| NT2RP4002408 | 2.22 | 2.22 | 3.87 | 3.75 | 6.37 | 4.11 | | |
| NT2RP4002425 | 2.84 | 2.84 | 5.81 | 8.24 | 7.98 | 5.23 | | |
| NT2RP4002432 | 12.33 | 12.33 | 85.4 | 61.06 | 72.53 | 67.82 | | |
| NT2RP4002447 | 2.97 | 2.97 | 7.68 | 3.96 | 5.4 | 4.59 | | |
| NT2RP4002451 | 5.48 | 5.48 | 6.2 | 5.84 | 5.85 | 6.83 | | |
| NT2RP4002461 | 9.8 | 9.8 | 32.09 | 32.76 | 38.91 | 29.04 | | |
| NT2RP4002486 | 3.5 | 3.5 | 6.71 | 2.47 | 4.15 | 2.87 | | |
| NT2RP4002517 | 3.65 | 3.65 | 9.11 | 7.02 | 8.53 | 7.18 | | |
| NT2RP4002556 | 4.29 | 4.29 | 3.91 | 5.68 | 10.03 | 6.41 | | |
| NT2RP4002569 | 3.36 | 3.36 | 7.36 | 4.93 | 5.29 | 3.42 | | |
| NT2RP4002587 | 2.26 | 2.26 | 4.19 | 2.8 | 3.4 | 2.02 | | |
| NT2RP4002591 | 2.21 | 2.21 | 4.89 | 2.89 | 4.5 | 3.08 | | |
| NT2RP4002607 | 1.43 | 1.43 | 3.34 | 2.87 | 4.63 | 1.58 | | |
| NT2RP4002627 | 17.83 | 17.83 | 61.9 | 55.9 | 76.17 | 65.3 | | |
| NT2RP4002628 | 7.28 | 7.28 | 15.48 | 14.53 | 23.95 | 12.54 | | |
| NT2RP4002630 | 4.19 | 4.19 | 5.25 | 6.72 | 9.4 | 7.16 | * | + |
| NT2RP4002639 | 9.43 | 9.43 | 70.25 | 52.38 | 77.24 | 57.28 | | |
| NT2RP4002641 | 1.58 | 1.58 | 9.03 | 3.94 | 4.07 | 4.1 | | |
| NT2RP4002658 | 114.62 | 114.62 | 166.93 | 76.49 | 34.96 | 109.83 | | |
| NT2RP4002669 | 3.5 | 3.5 | 5.67 | 5.4 | 5.33 | 4.68 | | |
| NT2RP4002677 | 6.24 | 6.24 | 9.41 | 10.14 | 7.99 | 13.62 | | |
| NT2RP4002715 | 8.42 | 8.42 | 34.92 | 40.1 | 48.46 | 32.3 | | |
| NT2RP4002750 | 2.6 | 2.6 | 8.29 | 1.68 | 2.04 | 1.33 | | |
| NT2RP4002784 | 3.71 | 3.71 | 9.51 | 9.44 | 11.22 | 7.06 | | |
| NT2RP4002791 | 4.91 | 4.91 | 9.44 | 4.88 | 9.76 | 5.33 | | |
| NT2RP4002811 | 1.63 | 1.63 | 6.38 | 3.17 | 2.95 | 3.43 | | |
| NT2RP4002830 | 4.26 | 4.26 | 7.45 | 3.9 | 5.9 | 5.46 | | |
| NT2RP4002832 | 2.12 | 2.12 | 3.13 | 2.38 | 5.59 | 2.54 | | |
| NT2RP4002850 | 5.07 | 5.07 | 12.04 | 14.36 | 12.63 | 8.06 | | |
| NT2RP4002874 | 5.17 | 5.17 | 6.67 | 3.41 | 5.14 | 1.96 | | |
| NT2RP4002884 | 28.81 | 28.81 | 49.75 | 43.57 | 74.75 | 52.87 | | |
| NT2RP4002888 | 5.55 | 5.55 | 4.83 | 3.67 | 4.32 | 3.08 | * | − |
| NT2EP4002891 | 5.48 | 5.48 | 15.79 | 13.16 | 19.42 | 11.91 | | |
| NT2RP4002894 | 12.04 | 12.04 | 24.47 | 18.44 | 12.76 | 16.4 | | |
| NT2RP4002896 | 5.54 | 5.54 | 12.2 | 8.96 | 6.18 | 7.78 | | |
| NT2RP4002905 | 1.71 | 1.71 | 4.27 | 2.32 | 3.58 | 1.28 | | |
| NT2RP4002907 | 5.11 | 5.11 | 7.62 | 6.94 | 10.72 | 1.41 | | |
| NT2RP5003459 | 68.11 | 68.11 | 133.25 | 154.61 | 146.15 | 164.37 | * | + |
| NT2RP5003461 | 7.34 | 7.34 | 10.14 | 10.85 | 14.36 | 8 | | |
| NT2RP5003471 | 106.6 | 106.6 | 168.71 | 124.4 | 148.85 | 112.14 | | |
| NT2RP5003477 | 2.71 | 2.71 | 2.62 | 2.59 | 2.33 | 1.9 | | |
| NT2RP5003487 | 157.44 | 157.44 | 424.89 | 292.71 | 256.56 | 354.93 | | |
| NT2RP5003492 | 3.1 | 3.1 | 4.91 | 5.25 | 6.17 | 5.91 | * | + |
| NT2RP5003500 | 1.5 | 1.5 | 3.28 | 2.38 | 2.54 | 2.59 | | |
| NT2RP5003506 | 4.96 | 4.96 | 9.3 | 7.83 | 10.37 | 9.04 | | |
| NT2RP5003512 | 2.21 | 2.21 | 4.35 | 2.63 | 3.46 | 2.15 | | |
| NT2RP5003522 | 4.1 | 4.1 | 5.97 | 4.62 | 4.19 | 2.34 | | |
| NT2RP5003524 | 4.38 | 4.38 | 3.86 | 1.61 | 1.54 | 0.84 | ** | − |
| NT2RP5003527 | 24.72 | 24.72 | 71.27 | 76.81 | 87.24 | 60.59 | | |
| NT2RP5003531 | 7.16 | 7.16 | 17.2 | 15.58 | 14.06 | 14.11 | | |
| NT2RP5003534 | 2.68 | 2.68 | 5.49 | 5.54 | 6.82 | 4.55 | | |
| NT2RP6000020 | 8.69 | 8.69 | 19.96 | 14.65 | 15.13 | 16.29 | | |
| NT2RP6000022 | 3.19 | 3.19 | 4.05 | 4.06 | 3.96 | 2.44 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| NT2RP6000050 | 3.95 | 3.95 | 3.99 | 4.98 | 5.82 | 2.88 | | |
| NT2RP6000063 | 3.91 | 3.91 | 6.04 | 3.61 | 2.52 | 2.56 | | |
| NT2RP6000074 | 5.38 | 5.38 | 4.88 | 3.41 | 3.27 | 2.17 | ** | – |
| NT2RP6000083 | 7.76 | 7.76 | 11.18 | 11.49 | 16 | 9.91 | | |
| NT2RP6000100 | 2.49 | 2.49 | 4.58 | 4.04 | 4.71 | 3.3 | | |
| NT2RP6000123 | 1.94 | 1.94 | 3.29 | 5.1 | 4.20 | 4.22 | * | + |
| NT2RP6000129 | 1.9 | 1.9 | 4.47 | 4.06 | 4.27 | 2.74 | | |
| NT2RP6000147 | 3.75 | 3.75 | 11.74 | 10.8 | 11.03 | 7.48 | | |
| NT2RP6000163 | 2.62 | 2.62 | 4.23 | 2.28 | 1.95 | 1.71 | | |
| NT2RP6000181 | 8.03 | 8.03 | 12.4 | 9.44 | 13.25 | 9.01 | | |
| NT2RP6000182 | 5.44 | 5.44 | 6.42 | 4.82 | 5.56 | 3.88 | | |
| OVARC1000001 | 4.97 | 4.97 | 5.24 | 6.04 | 7.48 | 2.35 | | |
| OVARC1000003 | 3.21 | 3.21 | 8.31 | 8.51 | 7.66 | 7.05 | | |
| OVARC1000004 | 9.87 | 9.87 | 116.19 | 88.04 | 109.99 | 85.44 | | |
| OVARC1000006 | 3.57 | 3.57 | 6.58 | 9.04 | 7.88 | 4.73 | | |
| OVARC1000013 | 6.51 | 6.51 | 9.19 | 7.32 | 8.36 | 8.33 | | |
| OVARC1000014 | 3.39 | 3.39 | 5.02 | 4.23 | 5.02 | 4.17 | | |
| OVARC1000017 | 3.11 | 3.11 | 6.81 | 4.2 | 4.45 | 2.72 | | |
| OVARC1000026 | 24.79 | 24.79 | 32.1 | 56.82 | 69.34 | 44.53 | * | + |
| OVARC1000035 | 11.11 | 11.11 | 20.26 | 20.41 | 23.65 | 15.36 | | |
| OVARC1000037 | 8.73 | 8.73 | 19.12 | 15.64 | 9.13 | 15.9 | | |
| OVARC1000058 | 6.06 | 6.06 | 11.69 | 13.84 | 7.56 | 10.6 | | |
| OVARC1000060 | 1.89 | 1.89 | 6.28 | 5.98 | 5.24 | 5.13 | | |
| OVARC1000068 | 2.38 | 2.38 | 5.33 | 5.31 | 3.56 | 2.42 | | |
| OVARC1000069 | 74.66 | 74.66 | 101.53 | 75.95 | 84.36 | 86.42 | | |
| OVARC1000071 | 4.4 | 4.4 | 4.77 | 6.47 | 5.35 | 4.04 | | |
| OVARC1000075 | 55.43 | 55.43 | 125.63 | 120.89 | 150.97 | 117.03 | | |
| OVARC1000083 | 9.58 | 9.58 | 9.24 | 13.12 | 12.7 | 10.64 | * | + |
| OVARC1000085 | 106.6 | 90.9 | 156.14 | 214.2 | 177.05 | 273.14 | * | + |
| OVARC1000086 | 3.98 | 6.82 | 9.23 | 11.98 | 11.3 | 14.09 | * | + |
| OVARC1000087 | 1.51 | 2.83 | 1.79 | 4.03 | 3.57 | 3.35 | * | + |
| OVARC1000090 | 1.48 | 4.1 | 6.14 | 10.88 | 9.58 | 8.79 | * | + |
| OVARC1000091 | 4.88 | 8.33 | 8.01 | 7.99 | 7.76 | 6.82 | | |
| OVARC1000092 | 2.83 | 6.81 | 4.18 | 4.68 | 6.25 | 4.85 | | |
| OVARC1000105 | 9.73 | 14.86 | 17.21 | 26.29 | 25.62 | 22.88 | * | + |
| OVARC1000106 | 26.02 | 23.03 | 46.38 | 66.36 | 50.1 | 53.01 | * | + |
| OVARC1000109 | 9.12 | 13.08 | 18.04 | 16.72 | 12.91 | 17.46 | | |
| OVARC1000113 | 4.12 | 6.25 | 6.53 | 6.83 | 8.19 | 7.65 | | |
| OVARC1000114 | 2.14 | 3.44 | 5.77 | 5.94 | 5.86 | 4.98 | | |
| OVARC1000133 | 2.53 | 4.96 | 6.36 | 4.05 | 4.97 | 2.95 | | |
| OVARC1000137 | 6.14 | 10.05 | 13.51 | 13.3 | 18.59 | 14.39 | | |
| OVARC1000139 | 14.75 | 20.77 | 83.44 | 71.14 | 98.1 | 69.29 | | |
| OVARC1000145 | 0.72 | 6.64 | 2.89 | 1.78 | 2.42 | 2 | | |
| OVARC1000148 | 5.09 | 4.98 | 7.88 | 4.91 | 5.32 | 7.91 | | |
| OVARC1000151 | 1.41 | 2.11 | 2.4 | 3.58 | 4.08 | 3.58 | ** | + |
| OVARC1000157 | 10.99 | 14.16 | 17.51 | 21.21 | 25.06 | 22.76 | * | + |
| OVARC1000162 | 1.22 | 4.4 | 2.5 | 2.93 | 2.49 | 2.59 | | |
| OVARC1000168 | 1.98 | 8.46 | 6.2 | 8.01 | 9.61 | 9.96 | | |
| OVARC1000169 | 32.03 | 45.07 | 49.48 | 70.63 | 69.6 | 89.08 | * | + |
| OVARC1000178 | 0.84 | 5.08 | 2.53 | 3.37 | 3.18 | 2.78 | | |
| OVARG1000182 | 0.8 | 3.3 | 1.42 | 2.02 | 1.95 | 1.78 | | |
| OVARC1000186 | 2.51 | 3.72 | 3.23 | 5.95 | 3.27 | 4.77 | | |
| OVARC1000188 | 1.04 | 2.67 | 2.33 | 2.48 | 2.87 | 1.9 | | |
| OVARC1000191 | 1.01 | 3.8 | 2.63 | 3.12 | 2.85 | 2.54 | | |
| OVARC1000198 | 2.09 | 3.59 | 4.32 | 5.62 | 5.12 | 5.06 | * | + |
| OVARC1000208 | 6.49 | 10.37 | 22.5 | 17.79 | 24.54 | 22.02 | | |
| OVARC1000209 | 7.99 | 13.69 | 22.82 | 23.42 | 27.81 | 29.16 | | |
| OVARC1000212 | 2.47 | 5.63 | 3.59 | 4.76 | 5.03 | 4.88 | | |
| OVARC1000216 | 1.72 | 4.96 | 4.36 | 15.43 | 11.3 | 12.54 | ** | + |
| OVARC1000240 | 2.98 | 3.53 | 8.13 | 5.39 | 5.46 | 4.87 | | |
| OVARC1000241 | 1.29 | 2.47 | 3.18 | 2.65 | 3.17 | 1.4 | | |
| OVARC1000249 | 4.14 | 5.43 | 8.17 | 5.46 | 5 | 6.13 | | |
| OVARC1000254 | 33.15 | 39.39 | 100.99 | 100.41 | 131.42 | 100.89 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| OVARC1000255 | 0.85 | 4.83 | 2.51 | 2.98 | 2.45 | 1.95 | | |
| OVARC1000267 | 2.37 | 6.41 | 6.71 | 6.66 | 7.16 | 7.31 | | |
| OVARC1000275 | 79.02 | 93.7 | 161.08 | 199.43 | 240.76 | 175.96 | * | + |
| OVARC1000287 | 226.67 | 224.66 | 236.08 | 433.91 | 512.76 | 470.31 | ** | + |
| OVARC1000288 | 3.2 | 4.25 | 7.38 | 6.23 | 5.32 | 4.47 | | |
| OVARC1000298 | 8.96 | 10.09 | 19.62 | 13.37 | 7.19 | 9.6 | | |
| OVARC1000302 | 1.12 | 2.14 | 2.13 | 2.47 | 1.85 | 2 | | |
| OVARC1000304 | 1.09 | 2.68 | 3.23 | 5.02 | 3.41 | 6 | | |
| OVARC1000307 | 2.95 | 6.19 | 4.74 | 7.59 | 4.7 | 6.29 | | |
| OVARC1000309 | 1.18 | 7.16 | 3.22 | 3.24 | 2.85 | 2.4 | | |
| OVARC1000312 | 2.83 | 11.64 | 6.03 | 4.17 | 5.4 | 2.46 | | |
| OVARC1000313 | 10.48 | 19.25 | 14.81 | 9.39 | 17.54 | 22.17 | | |
| OVARC1000321 | 31.6 | 24.05 | 47.79 | 30.5 | 31.37 | 15.43 | | |
| OVARC1000326 | 1.52 | 2.3 | 3.9 | 3.84 | 3.17 | 2.79 | | |
| OVARC1000327 | 1.52 | 3.28 | 4.24 | 3.13 | 1.49 | 2.46 | | |
| OVARC1000331 | 2.22 | 4.72 | 2.41 | 4.33 | 4.45 | 4.58 | | |
| OVARC1000335 | 2.3 | 5.84 | 4.02 | 2.72 | 5.16 | 4.75 | | |
| OVARC1000347 | 1.83 | 8.18 | 6.24 | 7.35 | 9.24 | 8.44 | | |
| OVARC1000348 | 1.61 | 10.62 | 3.73 | 2.84 | 4.59 | 3.05 | | |
| OVARC1000363 | 3.7 | 9.61 | 6.51 | 7.31 | 11.52 | 6.83 | | |
| OVARC1000377 | 1.07 | 2.09 | 2.43 | 2.28 | 2.51 | 2.45 | | |
| OVARC1000382 | 3.34 | 3.39 | 4.33 | 5.07 | 2.52 | 1.03 | | |
| OVARC1000384 | 4.2 | 5.42 | 8.35 | 5.32 | 4.4 | 6.04 | | |
| OVARC1000401 | 0.62 | 3.63 | 2.09 | 3.35 | 4.08 | 3.64 | | |
| OVARC1000406 | 18.98 | 23.3 | 49.12 | 57.09 | 74.48 | 54.63 | * | + |
| OVARC1000407 | 1.99 | 6.28 | 3.99 | 4.11 | 6.42 | 3.16 | | |
| OVARC1000408 | 27.5 | 38.45 | 70.39 | 74.84 | 111.17 | 71.25 | | |
| OVARC1000410 | 6.83 | 12.72 | 10.41 | 4.78 | 6.65 | 5.01 | | |
| OVARC1000411 | 0.91 | 1.5 | 2.6 | 3.49 | 3 | 2.22 | | |
| OVARC1000414 | 1.31 | 2.22 | 3.7 | 4.5 | 3.78 | 3.71 | | |
| OVARC1000420 | 1.44 | 2.76 | 3.29 | 3.3 | 2.59 | 2.1 | | |
| OVARC1000421 | 1.42 | 2.65 | 3.33 | 3.96 | 4.21 | 4.99 | * | + |
| OVARC1000427 | 25.78 | 27.02 | 130.06 | 156.9 | 215.67 | 142.19 | | |
| OVARC1000431 | 10.51 | 17.6 | 19.12 | 33.66 | 31.78 | 25.78 | * | + |
| OVARC1000437 | 3.14 | 6.37 | 7.31 | 5.97 | 7.63 | 6.36 | | |
| OVARC1000439 | 5.81 | 10.95 | 13.82 | 21.81 | 23.01 | 21.52 | ** | + |
| OVARC1000440 | 2.56 | 3.74 | 5.01 | 7.47 | 9.31 | 7.08 | * | + |
| OVARC1000442 | 2.34 | 2.38 | 6.81 | 6.66 | 9.5 | 8.12 | | |
| OVARC1000443 | 2.09 | 2.2 | 2.88 | 3.29 | 3.41 | 2.62 | | |
| OVARC1000461 | 1.11 | 2.84 | 2.2 | 2.55 | 1.12 | 2.14 | | |
| OVARC1000465 | 3.27 | 5.01 | 3.51 | 3.94 | 4.62 | 3.95 | | |
| OVARC1000466 | 1.94 | 5.47 | 5.9 | 6.54 | 10.13 | 6.76 | | |
| OVARC1000467 | 1.01 | 5.08 | 2.41 | 3.65 | 2.98 | 3.78 | | |
| OVARC1000470 | 1.13 | 5.81 | 3.03 | 3.18 | 4.02 | 3.78 | | |
| OVARC1000473 | 1.81 | 1.95 | 2.65 | 2.44 | 4.16 | 1.39 | | |
| OVARC1000479 | 5.67 | 5.88 | 9.88 | 10.35 | 14.26 | 6.88 | | |
| OVARC1000484 | 3.99 | 5.74 | 6.54 | 8.66 | 9.93 | 6.87 | | |
| OVARC1000486 | 3.17 | 4.71 | 4.49 | 5.74 | 4.93 | 4.28 | | |
| OVARC1000496 | 0.93 | 3.55 | 0.66 | 0.31 | 1.07 | 0.62 | | |
| OVARC1000520 | 0.84 | 5.89 | 1.18 | 1.32 | 2.27 | 2 | | |
| OVARC1000522 | 4.1 | 7.19 | 12 | 13.85 | 14.03 | 10.34 | | |
| OVARC1000526 | 1.96 | 7.04 | 3.75 | 5.93 | 5.48 | 4.69 | | |
| OVARC1000529 | 2.38 | 2.57 | 4.44 | 3.66 | 4.16 | 3.08 | | |
| OVARC1000533 | 3.3 | 4.66 | 7.95 | 8.89 | 12.29 | 7.83 | | |
| OVARC1000543 | 0.84 | 2.44 | 2.06 | 2.57 | 3.08 | 2.72 | | |
| OVARC1000550 | 0.75 | 3.68 | 2.32 | 2.82 | 4.04 | 2.34 | | |
| OVARC1000553 | 2.1 | 5.63 | 7.02 | 7.72 | 7.69 | 6.95 | | |
| OVARC1000556 | 5.77 | 15.21 | 11.77 | 8.95 | 13.91 | 8.96 | | |
| OVARC1000557 | 0.83 | 5.12 | 1.4 | 1.61 | 2.29 | 1.88 | | |
| OVARC1000561 | 3.48 | 7.38 | 9.26 | 13 | 17.66 | 15.09 | * | + |
| OVARC1000564 | 8.89 | 9.02 | 10.44 | 17.84 | 11.31 | 16.69 | * | + |
| OVARC1000573 | 1.87 | 3.68 | 4.86 | 5.75 | 5.32 | 3.83 | | |
| OVARC1000576 | 24.12 | 29.23 | 124.94 | 83.09 | 93.83 | 98.58 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| OVARC1000578 | 2.43 | 4.6 | 5.53 | 8.64 | 4.46 | 3.93 | | |
| OVARC1000581 | 0.34 | 3.28 | 1.15 | 1.75 | 1.27 | 1.23 | | |
| OVARC1000586 | 22.54 | 28.9 | 41.17 | 34.58 | 43.39 | 40.93 | | |
| OVARC1000588 | 0.74 | 5.23 | 2.03 | 2.75 | 3.72 | 2.05 | | |
| OVARC1000605 | 1.98 | 2.62 | 2.88 | 4.47 | 4.23 | 3.87 | ** | + |
| OVARC1000622 | 3.86 | 4.59 | 11.57 | 12.7 | 11.13 | 11.6 | | |
| OVARC1000636 | 1.64 | 3.79 | 4.58 | 4.19 | 4.03 | 5.09 | | |
| OVARC1000640 | 1.97 | 4.72 | 3.93 | 4.21 | 3.67 | 3.09 | | |
| OVARC1000649 | 9.69 | 14.8 | 53.54 | 53.32 | 64.51 | 52.67 | | |
| OVARC1000661 | 1.14 | 9.33 | 2.99 | 5.34 | 5.24 | 5.24 | | |
| OVARC1000677 | 8.53 | 10.16 | 14.87 | 11.77 | 10.98 | 15.47 | | |
| OVARC1000678 | 1.21 | 4.49 | 2.71 | 3.28 | 4.17 | 3.26 | | |
| OVARC1000679 | 2.86 | 3.25 | 4.09 | 5.29 | 5.16 | 6.25 | * | + |
| OVARC1000681 | 1.47 | 1.55 | 3.2 | 2.41 | 2.22 | 1.71 | | |
| OVARC1000682 | 10.09 | 11.33 | 50.91 | 33.79 | 47.49 | 44.31 | | |
| OVARC1000689 | 3.81 | 7.1 | 19.94 | 20.18 | 22.12 | 21.83 | | |
| OVARC1000700 | 1.8 | 10.37 | 3.18 | 4.98 | 4.37 | 5.14 | | |
| OVARC1000703 | 1.74 | 7.18 | 5.35 | 6.4 | 6.64 | 7.77 | | |
| OVARC1000722 | 10.59 | 11.92 | 47.93 | 43.41 | 60.06 | 39.34 | | |
| OVARC1000726 | 1.44 | 3.48 | 4.62 | 4.88 | 5.89 | 3.58 | | |
| OVARC1000727 | 1.93 | 2.09 | 4.13 | 3.78 | 3.79 | 3.89 | | |
| OVARC1000730 | 5.95 | 5.86 | 9.01 | 4.07 | 4.16 | 5.62 | | |
| OVARC1000741 | 4.85 | 6.13 | 8.74 | 15.19 | 10.58 | 13.71 | * | + |
| OVARC1000746 | 0.89 | 3.61 | 2.43 | 2.06 | 2.9 | 2.84 | | |
| OVARC1000764 | 1.76 | 4.93 | 4.77 | 5.35 | 7.01 | 5.44 | | |
| OVARC1000769 | 1.13 | 4.3 | 3.6 | 3.76 | 4.42 | 5.2 | | |
| OVARC1000771 | 2.42 | 6.28 | 2.3 | 4.02 | 4.81 | 3.71 | | |
| OVARC1000773 | 19.09 | 24.7 | 31.93 | 44.69 | 56.24 | 46.24 | * | + |
| OVARC1000775 | 11.67 | 8.94 | 16.44 | 12.16 | 8.7 | 4.26 | | |
| OVARC1000778 | 2.37 | 3.89 | 5.69 | 4.59 | 6.23 | 4.92 | | |
| OVARC1000779 | 0.8 | 2.02 | 1.85 | 2.23 | 2.45 | 1.46 | | |
| OVARC1000781 | 1.67 | 5.05 | 4.16 | 6.37 | 3.45 | 5.07 | | |
| OVARC1000787 | 1.64 | 4.79 | 4.22 | 2.97 | 5.44 | 3.25 | | |
| OVARC1000789 | 7.62 | 14.23 | 16.39 | 24.95 | 29.69 | 25.94 | ** | + |
| OVARC1000800 | 2.91 | 10.72 | 5.72 | 6.41 | 10.65 | 6.2 | | |
| OVARC1000802 | 1.55 | 8.77 | 2.97 | 2.99 | 5.34 | 2.76 | | |
| OVARC1000810 | 3.37 | 3.54 | 8.29 | 6.66 | 7.99 | 7.21 | | |
| OVARC1000811 | 2.41 | 2.73 | 7.5 | 4.88 | 3.67 | 4.95 | | |
| OVARC1000814 | 3.44 | 4.55 | 9.03 | 7.92 | 11.3 | 9.05 | | |
| OVARC1000816 | 7.64 | 10.41 | 12.41 | 10.99 | 10.58 | 14.11 | | |
| OVARC1000817 | 1.18 | 3.38 | 1.27 | 1.71 | 2.14 | 1.55 | | |
| OVARC1000834 | 2.46 | 8.3 | 3.39 | 4.84 | 5.81 | 4.01 | | |
| OVARC1000846 | 2.23 | 10.02 | 5.35 | 7.38 | 9.66 | 7.72 | | |
| OVARC1000850 | 1.74 | 8.37 | 3.38 | 3.39 | 2.51 | 3.1 | | |
| OVARC1000853 | 23.21 | 24.23 | 43.4 | 30.67 | 37.81 | 18.39 | | |
| OVARC1000862 | 2.28 | 2.66 | 4.91 | 3.05 | 1.61 | 1.49 | | |
| OVARC1000873 | 2.56 | 2.98 | 4.14 | 4.4 | 3.79 | 3.85 | | |
| OVARC1000875 | 1.47 | 3.07 | 1.79 | 2.35 | 3.09 | 1.87 | | |
| OVARC1000876 | 3.71 | 5.67 | 4.46 | 5.11 | 6.06 | 5.45 | | |
| OVARC1000883 | 6.06 | 9.53 | 9.18 | 12.43 | 15.42 | 13.05 | * | + |
| OVARC1000885 | 2.84 | 9.95 | 3.38 | 3.74 | 5.66 | 4.11 | | |
| OVARC1000886 | 4.31 | 8.19 | 4.29 | 3.74 | 5.15 | 4.39 | | |
| OVARC1000890 | 17.47 | 18.3 | 91.22 | 70.97 | 78.71 | 51.68 | | |
| OVARC1000891 | 1.28 | 1.44 | 3.03 | 2.85 | 2.19 | 3.22 | | |
| OVARC1000897 | 0.48 | 1.74 | 1.29 | 1.21 | 1.33 | 0.5 | | |
| OVARC1000912 | 2.06 | 3.22 | 4.33 | 5.21 | 6.1 | 5.86 | * | + |
| OVARC1000914 | 1.48 | 6.18 | 1.61 | 3.68 | 3.02 | 2.18 | | |
| OVARC1000915 | 1.71 | 6.64 | 4.14 | 4.87 | 3.54 | 4.76 | | |
| OVARC1000916 | 1.91 | 5.19 | 2.56 | 4.05 | 4.32 | 3.88 | | |
| OVARC1000924 | 1.45 | 5.5 | 3.09 | 3.28 | 3.85 | 3.48 | | |
| OVARC1000928 | 6.05 | 5.46 | 8.78 | 4.22 | 5.83 | 5.35 | | |
| OVARC1000936 | 1.37 | 1.39 | 2.17 | 2.04 | 3.25 | 2.49 | | |
| OVARC1000937 | 1.69 | 3.01 | 1.94 | 4.17 | 3.26 | 3.24 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and –, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| OVARC1000945 | 1.55 | 3.67 | 3.62 | 3.83 | 3.22 | 2.28 | | |
| OVARC1000948 | 1.57 | 3.85 | 2.66 | 3.15 | 3.68 | 1.99 | | |
| OVARC1000956 | 1.41 | 5.08 | 4.36 | 7.56 | 7.26 | 5.51 | | |
| OVARC1000959 | 1.8 | 4.87 | 3.39 | 4.88 | 3.02 | 3.9 | | |
| OVARC1000960 | 2.64 | 7.53 | 9.55 | 11.64 | 13.89 | 12.86 | * | + |
| OVARC1000964 | 19.89 | 17.19 | 103.98 | 118.41 | 165.46 | 96.14 | | |
| OVARC1000971 | 0.42 | 1.58 | 1.4 | 2.53 | 2.27 | 2.28 | * | + |
| OVARC1000975 | 5.93 | 8.3 | 36.1 | 31.27 | 51.54 | 30.22 | | |
| OVARC1000976 | 0.65 | 2.12 | 1.27 | 2.17 | 1.46 | 1.5 | | |
| OVARC1000981 | 4.06 | 7.18 | 4.94 | 7.97 | 12.1 | 8.53 | | |
| OVARC1000982 | 2.83 | 5.41 | 2.23 | 3.13 | 3.02 | 3.54 | | |
| OVARC1000984 | 1.78 | 5.43 | 3.32 | 3.01 | 3.08 | 2.16 | | |
| OVARC1000995 | 2.94 | 6.59 | 4.5 | 5.98 | 6.19 | 6.72 | | |
| OVARC1000996 | 1.68 | 1.87 | 4.29 | 3.58 | 4.15 | 4.56 | | |
| OVARC1000999 | 6.02 | 5.65 | 15.29 | 15.6.11 | 3.18 | 13.29 | | |
| OVARC1001000 | 1.96 | 4.5 | 6.2 | 6.26 | 7.09 | 6.86 | | |
| OVARC1001004 | 0.51 | 3.4 | 1.45 | 2.05 | 3.3 | 1.47 | | |
| OVARC1001010 | 1.35 | 3.99 | 1.66 | 3.04 | 1.4 | 1.54 | | |
| OVARC1001011 | 1.46 | 5.57 | 1.13 | 2.39 | 3.27 | 2.45 | | |
| OVARC1001030 | 96.19 | 101.41 | 143.98 | 119.24 | 154.26 | 133 | | |
| OVARC1001032 | 1.42 | 5.34 | 1.89 | 1.83 | 2.82 | 1.92 | | |
| OVARC1001034 | 4.44 | 5.58 | 6.51 | 3.29 | 5.21 | 3.77 | | |
| OVARC1001038 | 3.62 | 5.03 | 7.4 | 10.3 | 10.88 | 8.61 | * | + |
| OVARC1001040 | 2.63 | 3.77 | 6.93 | 5.25 | 6.51 | 4.25 | | |
| OVARC1001041 | 4.54 | 8.03 | 12.87 | 8.57 | 12.25 | 9.4 | | |
| OVARC1001044 | 1.05 | 2.92 | 1.83 | 1.96 | 2.43 | 1.84 | | |
| OVARC1001049 | 3.78 | 8.78 | 10.67 | 10.65 | 11.87 | 10.26 | | |
| OVARC1001051 | 40.95 | 55.97 | 80.66 | 66.89 | 109.71 | 87.49 | | |
| OVARC1001054 | 1.22 | 4.06 | 3.22 | 2.86 | 4.19 | 1.93 | | |
| OVARC1001055 | 2.13 | 3.38 | 3.82 | 4.32 | 5.61 | 5.22 | * | + |
| OVARC1001062 | 5.8 | 6.15 | 12.54 | 8.04 | 9.94 | 9.57 | | |
| OVARC1001O65 | 8.85 | 13.63 | 51.33 | 51.41 | 60.3 | 56.97 | | |
| OVARC1001068 | 2.82 | 5.62 | 4.76 | 4.72 | 4.02 | 5.52 | | |
| OVARC1001072 | 0.73 | 4.18 | 4.41 | 3.2 | 3.71 | 3.07 | | |
| OVARC1001073 | 0.92 | 5.7 | 2.65 | 2.91 | 2.54 | 1.79 | | |
| OVARC1001074 | 0.81 | 4.66 | 3.31 | 1.87 | 2.95 | 2.04 | | |
| OVARC1001078 | 2 | 5.12 | 2.79 | 3.57 | 3.08 | 2.83 | | |
| OVARC1001085 | 2.41 | 2.83 | 3.66 | 5.54 | 5.02 | 6.36 | ** | + |
| OVARC1001086 | 1.97 | 3.17 | 2.85 | 3.98 | 2.83 | 4.13 | | |
| OVARC1001091 | 16.24 | 19.32 | 92.73 | 76.48 | 96.74 | 77.99 | | |
| OVARC1001092 | 4.62 | 5.35 | 7.22 | 9.69 | 7.84 | 6.05 | | |
| OVARC1001104 | 1.05 | 4.37 | 2.66 | 3.16 | 2.58 | 2.03 | | |
| OVARC1001107 | 11.59 | 15.6 | 40.28 | 31.21 | 49.49 | 42.22 | | |
| OVARC1001113 | 1.04 | 5.81 | 1.59 | 2.46 | 3.05 | 2.39 | | |
| OVARC1001117 | 2.71 | 6.63 | 4.31 | 4.67 | 5.74 | 2.67 | | |
| OVARC1001118 | 2.38 | 3.69 | 7.08 | 7.36 | 6.91 | 8.28 | | |
| OVARC1001125 | 2.02 | 2.9 | 3 | 5.92 | 4.97 | 5.9 | ** | + |
| OVARC1001129 | 2.61 | 4.58 | 3.19 | 8.46 | 9.43 | 11 | ** | + |
| OVARC1001132 | 1.7 | 6.48 | 2.66 | 3.69 | 4.26 | 4.66 | | |
| OVARC1001138 | 9.52 | 15.82 | 23.8 | 48.95 | 45.16 | 44.97 | ** | + |
| OVARC1001141 | 1.68 | 4.97 | 3.48 | 3.77 | 3.68 | 3.84 | | |
| OVARC1001154 | 18.31 | 29.49 | 68.39 | 60.43 | 83.49 | 65.64 | | |
| OVARC1001161 | 2.49 | 5.55 | 6.15 | 7.03 | 6.69 | 5.89 | | |
| OVARC1001162 | 2.2 | 3.13 | 5.34 | 5.09 | 4.86 | 5.26 | | |
| OVARC1001163 | 0.69 | 3.59 | 2.77 | 2.2 | 3.98 | 2.54 | | |
| OVARC1001167 | 3.03 | 4.57 | 7.69 | 10.19 | 12.95 | 9.3 | * | + |
| OVARC1001169 | 0.74 | 4.87 | 2.68 | 2.47 | 1.91 | 2.06 | | |
| OVARC1001170 | 7.81 | 15.04 | 17.59 | 14.61 | 19.45 | 14.99 | | |
| OVARC1001171 | 15.57 | 17.71 | 24.31 | 16.12 | 23.34 | 22.51 | | |
| OVARC1001173 | 2.09 | 5.08 | 5.1 | 4.32 | 6.75 | 5.49 | | |
| OVARC1001176 | 22.57 | 21.48 | 89.96 | 76.74 | 102.3 | 70.7 | | |
| OVARC1001180 | 3.01 | 4.58 | 12.7 | 11.81 | 10.77 | 9.56 | | |
| OVARC1001188 | 2.66 | 3.7 | 3.95 | 3.62 | 3.44 | 4.16 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| OVARC1001200 | 1.52 | 4.56 | 3.62 | 3.47 | 2.9 | 2.96 | | |
| OVARC1001202 | 3.75 | 6.65 | 6.53 | 9.26 | 7.79 | 10.23 | * | + |
| OVARC1001206 | 1.52 | 5.52 | 1.15 | 1.59 | 1.13 | 1.9 | | |
| OVARC1001209 | 4.89 | 8.92 | 27.46 | 24.69 | 30.38 | 24.27 | | |
| OVARC1001219 | 1.81 | 6.36 | 4.71 | 5.33 | 3.95 | 3.62 | | |
| OVARC1001222 | 2.5 | 8.36 | 5.01 | 3.2 | 4.34 | 5.63 | | |
| OVARC1001232 | 2.91 | 4.18 | 7.74 | 6.75 | 6.02 | 5.65 | | |
| OVARC1001240 | 2.05 | 3.27 | 6.84 | 5.55 | 5.06 | 5.4 | | |
| OVARC1001243 | 0.94 | 2.59 | 1.76 | 3.64 | 2.64 | 1.86 | | |
| OVARC1001244 | 9.07 | 12.05 | 18 | 21.61 | 18.57 | 26.62 | | |
| OVARC1001246 | 30.48 | 50.95 | 48.51 | 80.54 | 100.83 | 101.88 | ** | + |
| OVARC1001247 | 3.64 | 9.86 | 7.7 | 6.57 | 7.02 | 4.49 | | |
| OVARC1001260 | 1.05 | 9.07 | 1.85 | 2.62 | 2.65 | 1.85 | | |
| OVARC1001261 | 4.23 | 10.5 | 6.99 | 3.46 | 2.08 | 2.94 | | |
| OVARC1001268 | 24.4 | 19.69 | 52.37 | 32.58 | 35.32 | 14.16 | | |
| OVARC1001270 | 14.46 | 15.1 | 20.83 | 9.69 | 9.8 | 8.65 | * | − |
| OVARC1001271 | 2.62 | 3.62 | 3.88 | 3.95 | 7.02 | 4.26 | | |
| OVARC1001282 | 0.88 | 3.02 | 3.09 | 1.37 | 1.59 | 2 | | |
| OVARC1001296 | 3.02 | 8.06 | 2.3 | 3.04 | 4.11 | 5.41 | | |
| OVARC1001306 | 1.48 | 8.27 | 2.4 | 2.04 | 2.29 | 3.82 | | |
| OVARC1001314 | 0.49 | 8.47 | 1.57 | 1.06 | 1.79 | 1.32 | | |
| OVARC1001316 | 2.77 | 7.17 | 4.81 | 5.48 | 8.11 | 5.36 | | |
| OVARC1001329 | 6.12 | 6.18 | 21.11 | 17.09 | 19.29 | 16.22 | | |
| OVARC1001330 | 0.2 | 1.89 | 1.38 | 1.22 | 1.35 | 1.42 | | |
| OVARC1001336 | 1.92 | 3.7 | 3.59 | 5.67 | 4.09 | 4.02 | | |
| OVARC1001338 | 0.26 | 2.87 | 0.86 | 2.49 | 1.71 | 1.07 | | |
| OVARC1001339 | 12.07 | 18.29 | 22.73 | 33.65 | 32.72 | 37.29 | ** | + |
| OVARC1001340 | 0.72 | 4.83 | 1.23 | 1.33 | 2.44 | 1.3 | | |
| OVARC1001341 | 4.35 | 9.25 | 6.77 | 7.94 | 11.38 | 9.69 | | |
| OVARC1001342 | 90.37 | 98.53 | 136.12 | 129.68 | 163.22 | 127.78 | | |
| OVARC1001344 | 2.1 | 2.51 | 6.27 | 6.52 | 6.89 | 6.2 | | |
| OVARC1001357 | 5.61 | 8.93 | 16.02 | 15.52 | 11.34 | 11.69 | | |
| OVARC1001359 | 8.96 | 12.4 | 16.15 | 21.66 | 13.84 | 10.6 | | |
| OVARC1001360 | 0.44 | 2.52 | 0.99 | 1.97 | 2.6 | 1.62 | | |
| OVARC1001369 | 1.56 | 5.66 | 1.89 | 3.41 | 1.88 | 3.1 | | |
| OVARC1001372 | 0.96 | 4.23 | 3.33 | 1.52 | 2.77 | 1.95 | | |
| OVARC1001376 | 1.82 | 5.1 | 3.62 | 5.79 | 5.79 | 4.18 | | |
| QVARG1001381 | 4.51 | 6.44 | 9.94 | 10.95 | 12.91 | 11.21 | | |
| OVARC1001391 | 0.5 | 1.62 | 1.44 | 1.88 | 1.27 | 1.26 | | |
| OVARC1001392 | 2.12 | 4.69 | 6.14 | 11.96 | 12.7 | 7.79 | * | + |
| OVARC1001399 | 0.98 | 3.59 | 2.16 | 1.77 | 2.54 | 1.1 | | |
| OVARC1001417 | 1.01 | 3.07 | 1.76 | 2.39 | 3.61 | 2.81 | | |
| OVARC1001419 | 2.47 | 5.4 | 3.06 | 4.39 | 4.03 | 3.16 | | |
| OVARC1001425 | 2.29 | 5.58 | 5.15 | 8.76 | 8.5 | 8.07 | * | + |
| OVARC1001436 | 1.37 | 5.85 | 2.54 | 2.9 | 3.57 | 3.18 | | |
| OVARC1001442 | 0.64 | 4.84 | 1.39 | 2.27 | 1.52 | 0.69 | | |
| OVARC1001451 | 3.09 | 2 | 3.89 | 5.18 | 5.98 | 4.75 | * | + |
| OVARC1001452 | 1.35 | 2.41 | 2.87 | 2.96 | 4.69 | 3.13 | | |
| OVARC1001453 | 1.21 | 2.84 | 1.88 | 2.3 | 1.82 | 1.57 | | |
| OVARC1001476 | 10.67 | 14.38 | 16.52 | 17.22 | 12.9 | 13.09 | | |
| OVARC1001480 | 0.93 | 4.73 | 1.5 | 3.1 | 2.98 | 2.21 | | |
| OVARC1001489 | 0.97 | 6.89 | 2.51 | 3.01 | 2.83 | 2.09 | | |
| OVARC1001493 | 2.09 | 6.59 | 3.75 | 7.38 | 8.78 | 10.48 | * | + |
| OVARC1001496 | 4.65 | 9.58 | 8.63 | 10.74 | 7.37 | 11.03 | | |
| OVARC1001499 | 1.24 | 1.18 | 2.6 | 3.47 | 2.68 | 2.84 | | |
| OVARC1001506 | 2.9 | 2.7 | 5.31 | 5.33 | 6.73 | 5.48 | | |
| OVARC1001509 | 1.73 | 3.89 | 3.69 | 4.07 | 4.59 | 3.07 | | |
| OVARC1001510 | 0.16 | 3.69 | 1.42 | 1.94 | 1.73 | 0.86 | | |
| OVARC1001516 | 2.57 | 5.78 | 3.85 | 6.04 | 4.97 | 4.39 | | |
| OVARC1001525 | 0.53 | 4.76 | 2.12 | 1.94 | 2.01 | 1.81 | | |
| OVARC1001542 | 8.8 | 12.86 | 13.01 | 15.91 | 13.63 | 17.23 | | |
| OVARC1001544 | 2.14 | 6.6 | 6.72 | 7.54 | 8.33 | 6.22 | | |
| OVARC1001546 | 4.08 | 4.32 | 4.6 | 6.12 | 5.31 | 7.23 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| OVARC1001547 | 1.29 | 2.53 | 1.68 | 2.44 | 1.85 | 2.22 | | |
| OVARC1001555 | 10.39 | 16.51 | 68.77 | 48.66 | 65.39 | 56.39 | | |
| OVARC1001560 | 3.35 | 4.91 | 5.52 | 5.36 | 4.93 | 5.34 | | |
| OVARC1001569 | 1.63 | 4.75 | 4.79 | 5.92 | 5.19 | 5.1 | | |
| OVARC1001570 | 3.96 | 7.9 | 6.93 | 7.72 | 10.7 | 8.55 | | |
| OVARC1001577 | 1.68 | 5.89 | 5.41 | 8.61 | 6.9 | 10.2 | | |
| OVARC1001578 | 0.25 | 3.47 | 0.19 | 0.47 | 0.24 | 0.15 | | |
| OVARC1001596 | 12.13 | 11.65 | 14.23 | 13.51 | 14.82 | 27.15 | | |
| OVARC1001600 | 1.13 | 2.9 | 1.48 | 2.81 | 2.67 | 3.67 | | |
| OVARC1001607 | 6.22 | 7.72 | 10.91 | 13.42 | 14.01 | 13.45 | * | + |
| OVARC1001610 | 1.81 | 5.25 | 2.84 | 4.25 | 2.66 | 2.7 | | |
| OVARC1001611 | 0.13 | 5.11 | 1.24 | 1.48 | 2.89 | 1.79 | | |
| OVARC1001615 | 0.58 | 5.42 | 1.93 | 1.54 | 2.56 | 1.74 | | |
| OVARC1001636 | 1.09 | 3.75 | 1.05 | 2.39 | 2.05 | 2.15 | | |
| OVARC1001668 | 3.77 | 6.75 | 10.04 | 10.5 | 11.4 | 10.48 | | |
| OVARC1001702 | 1.18 | 2.21 | 2.42 | 3.86 | 2.07 | 2.25 | | |
| OVARG1001703 | 2.82 | 3.18 | 2.97 | 2.64 | 4.71 | 4.65 | | |
| OVARC1001710 | 3.58 | 7.03 | 8.67 | 8.01 | 6.28 | 9.55 | | |
| OVARC1001711 | 1.96 | 7.3 | 3.36 | 5.01 | 4.15 | 5.4 | | |
| OVARC1001713 | 9.17 | 11.54 | 44.65 | 36.47 | 51.48 | 43.79 | | |
| OVARC1001725 | 1.01 | 5.45 | 6.11 | 2.56 | 3.77 | 4.01 | | |
| OVARC1001726 | 1.64 | 4.48 | 3.23 | 4.97 | 5.6 | 5.18 | | |
| OVARC1001727 | 1.4 | 2.41 | 1.52 | 1.43 | 2.35 | 1.14 | | |
| OVARC1001731 | 120.62 | 110.86 | 255.43 | 140.73 | 139.03 | 74.2 | | |
| OVARC1001735 | 1.29 | 3.44 | 3.54 | 3.75 | 3.25 | 2.89 | | |
| OVARC1001741 | 3.3 | 4.73 | 15.28 | 13.09 | 12.93 | 13.17 | | |
| OVARC1001745 | 2.72 | 5.39 | 6.83 | 9.17 | 10.23 | 8.89 | * | + |
| OVARC1001759 | 3.31 | 9.01 | 6.31 | 7.61 | 7.61 | 11.95 | | |
| OVARC1001762 | 3.96 | 7.78 | 6.38 | 10.3 | 11.01 | 13.4 | * | + |
| OVARC1001766 | 5.33 | 7.8 | 11.99 | 15.56 | 16.86 | 15.33 | * | + |
| OVARC1001767 | 0.94 | 3.76 | 1.18 | 1.97 | 1.96 | 2.41 | | |
| OVARC1001768 | 3.31 | 3.86 | 3.76 | 5.35 | 4.59 | 3.54 | | |
| OVARC1001770 | 3.04 | 6.58 | 9.98 | 11.46 | 9.08 | 9.46 | | |
| OVARC1001776 | 2.11 | 4.7 | 3.5 | 4.72 | 3.64 | 2.92 | | |
| OVARC1001791 | 1.13 | 4.77 | 3.54 | 3.07 | 3.12 | 3.42 | | |
| OVARC1001795 | 0.89 | 6.19 | 1.24 | 2.31 | 2.87 | 2.11 | | |
| OVARC1001798 | 2.81 | 12.11 | 7.57 | 9.72 | 11.93 | 9.04 | | |
| OVARC1001802 | 1.73 | 11.64 | 4.9 | 5.6 | 5.93 | 4.01 | | |
| OVARC1001805 | 1.92 | 6.96 | 2.58 | 3.62 | 4.59 | 3.51 | | |
| OVARC1001807 | 1.9 | 2.53 | 4.18 | 3.06 | 3.12 | 2.46 | | |
| OVARC1001809 | 12.38 | 14.06 | 76.32 | 55.87 | 81.41 | 52.83 | | |
| OVARC1001812 | 1.44 | 3.39 | 3.15 | 3.23 | 4.63 | 3.71 | | |
| OVARC1001813 | 1.61 | 4.29 | 2.33 | 2.93 | 3.98 | 2.51 | | |
| OVARC1001820 | 1.67 | 7.15 | 3.21 | 3.47 | 3.76 | 3.22 | | |
| OVARC1001828 | 0.78 | 6.85 | 2.36 | 1.91 | 3.23 | 2.2 | | |
| OVARC1001833 | 1.07 | 8.12 | 2.02 | 2.4 | 2.1 | 1.92 | | |
| OVARC1001839 | 1.56 | 8.43 | 2.98 | 2.91 | 3.59 | 1.15 | | |
| OVARC1001846 | 1.91 | 1.38 | 2.9 | 2.15 | 2.11 | 1.8 | | |
| OVARC1001849 | 1.21 | 2.52 | 2.42 | 5.79 | 3.69 | 4.03 | * | + |
| OVARC1001861 | 1.46 | 3.56 | 2.73 | 2.78 | 2.5 | 2.09 | | |
| OVARC1001873 | 3.09 | 3.78 | 4.68 | 5.47 | 4.42 | 4.73 | | |
| OVARC1001879 | 1.44 | 6.08 | 3.48 | 2.35 | 2.93 | 2.22 | | |
| OVARC1001880 | 0.91 | 7.84 | 2.94 | 3.63 | 5.78 | 3.8 | | |
| OVARC1001883 | 0.99 | 7.61 | 3.12 | 2.61 | 3.42 | 2.52 | | |
| OVARC1001900 | 1.11 | 7.07 | 4.03 | 2.57 | 3.61 | 2.89 | | |
| OVARC1001901 | 0.54 | 1.84 | 1.21 | 2.42 | 1.37 | 2.43 | | |
| OVARC1001911 | 0.59 | 1.57 | 1.66 | 1.51 | 1.39 | 1.55 | | |
| OVARC1001916 | 1.86 | 3.13 | 3.35 | 4.16 | 4.61 | 3.51 | | |
| OVARC1001928 | 1.45 | 3.53 | 1.55 | 1.58 | 1.62 | 1.72 | | |
| OVARC1001937 | 5.12 | 11.69 | 8.13 | 17.41 | 11.63 | 15.16 | | |
| OVARC1001940 | 1.1 | 4.51 | 3.13 | 3.72 | 3.14 | 2.78 | | |
| OVARC1001942 | 3.85 | 7.4 | 8.03 | 11.47 | 13.91 | 12.77 | * | + |
| OVARC1001943 | 7.16 | 10.07 | 11.08 | 9.62 | 13.85 | 11.87 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| OVARC1001949 | 1.69 | 3.34 | 4.15 | 5.35 | 4.01 | 5.55 | | |
| OVARC1001950 | 1.53 | 2.41 | 3.79 | 6.3 | 4.35 | 3.98 | | |
| OVARC1001952 | 11.3 | 11.38 | 53.57 | 52.33 | 78.84 | 38.05 | | |
| OVARC1001954 | 1.12 | 2.99 | 2.2 | 3.09 | 2.67 | 2.05 | | |
| OVARC1001963 | 1 | 4.91 | 2.89 | 4.5 | 3.39 | 3.21 | | |
| OVARC1001983 | 3.62 | 14.16 | 14.25 | 20.96 | 19.21 | 21.67 | | |
| OVARC1001987 | 3.12 | 6.54 | 5.94 | 6.08 | 8.39 | 8.02 | | |
| OVARC1001989 | 1.41 | 5.2 | 4.96 | 4.54 | 5.59 | 5.26 | | |
| OVARC1001991 | 1.74 | 3.27 | 4.08 | 4.57 | 3.86 | 3.27 | | |
| OVARC1002005 | 4.14 | 3.55 | 7.66 | 10.01 | 9.06 | 8.2 | * | + |
| OVARC1002044 | 3.73 | 3.94 | 6.17 | 6.57 | 8.32 | 6.99 | * | + |
| OVARC1002046 | 10.28 | 16.21 | 20.07 | 29.4 | 37.78 | 37.02 | ** | + |
| OVARC1002050 | 1.7 | 5.6 | 2.43 | 3.96 | 3.82 | 2.53 | | |
| OVARC1002058 | 4.23 | 6.11 | 4.02 | 4.69 | 5.55 | 5.43 | | |
| OVARC1002066 | 11.47 | 13.5 | 25.49 | 26.02 | 28.69 | 22.63 | | |
| OVARC1002082 | 3.6 | 8.55 | 8.81 | 9.6 | 8.89 | 6.49 | | |
| OVARC1002091 | 3.17 | 5.67 | 8.37 | 9.49 | 5.49 | 7.64 | | |
| OVARC1002092 | 1.38 | 2.72 | 2.2 | 4 | 3.97 | 1.88 | | |
| OVARC1002093 | 1.79 | 3.1 | 4.51 | 5.01 | 4.44 | 3.88 | | |
| OVARC1002094 | 1.55 | 6.24 | 4.17 | 36.42 | 27.25 | 28.35 | ** | + |
| OVARC1002107 | 1.42 | 4.63 | 2.69 | 4.86 | 5.48 | 3.6 | | |
| OVARC1002112 | 6.17 | 11.59 | 8.5 | 13.47 | 17.48 | 11.92 | | |
| OVARC1002126 | 2.66 | 6.35 | 6.68 | 7.95 | 6.44 | 8.79 | | |
| OVARC1002127 | 0.73 | 5.04 | 1.86 | 1.92 | 2.61 | 1.52 | | |
| OVARC1002138 | 1.4 | 1.79 | 1.86 | 3.16 | 4.82 | 2.75 | * | + |
| OVARC1002143 | 0.73 | 1.51 | 1.55 | 1.29 | 3.03 | 2.09 | | |
| OVARC1002156 | 2.42 | 3.87 | 4.19 | 4.43 | 3.9 | 3.65 | | |
| OVARC1002158 | 0.88 | 2.63 | 1.6 | 2.36 | 1.57 | 1.51 | | |
| OVARC1002165 | 4.85 | 6.3 | 9.83 | 10.73 | 14.03 | 10.87 | | |
| OVARC1002176 | 0.86 | 5.08 | 3.59 | 2.01 | 3.46 | 2.64 | | |
| OVARC1002178 | 0.83 | 5.35 | 3.12 | 3.8 | 5.02 | 4.25 | | |
| OVARC1002182 | 1.29 | 2.89 | 3.77 | 2.45 | 4.64 | 3.12 | | |
| OVARC1002185 | 11.45 | 13.19 | 62.79 | 43.91 | 53.43 | 55.56 | | |
| PLACE1000004 | 1.42 | 3.23 | 2.35 | 3.87 | 4.25 | 4.05 | * | + |
| PLACE1000005 | 1.18 | 3.06 | 3.3 | 5.27 | 5.31 | 4.83 | * | + |
| PLACE1000006 | 2.01 | 8.33 | 3.23 | 4.2 | 5.44 | 4.67 | | |
| PLACE1000007 | 0.97 | 5.13 | 2.89 | 3.03 | 2.47 | 2.56 | | |
| PLACE1000014 | 2.9 | 8.06 | 6.26 | 6.67 | 8.18 | 6.55 | | |
| PLACE1000031 | 0.88 | 4.81 | 0.45 | 2.61 | 2.71 | 2.79 | | |
| PLACE1000033 | 1.23 | 2.15 | 2.75 | 2.42 | 3.17 | 2.56 | | |
| PLACE1000040 | 3.08 | 4.43 | 6.18 | 7.11 | 5.54 | 7.37 | | |
| PLACE1000048 | 1.83 | 3.24 | 2.14 | 3.32 | 3.96 | 3.74 | | |
| PLACE1000050 | 2.12 | 5.36 | 9.1 | 9 | 6.55 | 8.25 | | |
| PLACE1000061 | 138.29 | 147.36 | 249.77 | 165.55 | 233.98 | 230.37 | | |
| PLACE1000066 | 14.23 | 15 | 19.46 | 15.86 | 15.62 | 18.52 | | |
| PLACE1000075 | 3.03 | 6.24 | 9.08 | 4.98 | 6.93 | 7.11 | | |
| PLACE1000078 | 2.1 | 5.75 | 5 | 6.07 | 6.93 | 5.19 | | |
| PLACE1000081 | 1.08 | 1.88 | 1.52 | 1.13 | 1.89 | 1.27 | | |
| PLACE1000086 | 4.97 | 6.55 | 11.25 | 8.1 | 9.16 | 7.75 | | |
| PLACE1000094 | 0.7 | 4.18 | 1.72 | 1 | 3.44 | 2.96 | | |
| PLACE1000101 | 4.67 | 8.44 | 7.7 | 11.69 | 10.38 | 13.65 | * | + |
| PLACE1000121 | 0.87 | 6.29 | 2.02 | 1.95 | 2.85 | 2.39 | | |
| PLACE1000133 | 6.65 | 11.93 | 17.66 | 15.19 | 17.59 | 21.71 | | |
| PLACE1000142 | 1.79 | 6.03 | 5.66 | 2.64 | 4.77 | 4.24 | | |
| PLACE1000146 | 1.95 | 4.51 | 2.89 | 3.71 | 5.02 | 2.82 | | |
| PLACE1000163 | 4.52 | 5.99 | 10.71 | 16.27 | 10.95 | 13.78 | | |
| PLACE1000172 | 1.12 | 2.63 | 1.48 | 1.81 | 3.21 | 2.29 | | |
| PLACE1000181 | 1.06 | 3 | 2.98 | 2.63 | 3.75 | 2.86 | | |
| PLACE1000184 | 1.17 | 3.08 | 1.48 | 1.87 | 3.28 | 2.27 | | |
| PLACE1000185 | 2.99 | 6.52 | 8.47 | 9.53 | 9.99 | 12.03 | | |
| PLACE1000198 | 0.78 | 4.09 | 2.49 | 2.19 | 2.17 | 1.93 | | |
| PLACE1000213 | 3.3 | 5.87 | 7.36 | 4.35 | 5.38 | 8.09 | | |
| PLACE1000214 | 1.37 | 4.29 | 4.54 | 5.22 | 6.72 | 4.22 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1000220 | 9.61 | 7.84 | 16.78 | 7.48 | 5.77 | 4.1 | | |
| PLACE1000231 | 2.48 | 4.1 | 4.92 | 4.57 | 4.65 | 3.91 | | |
| PLACE1000236 | 0.66 | 3.33 | 2.43 | 2.8 | 3.63 | 2.37 | | |
| PLACE1000245 | 2.92 | 5.88 | 6.34 | 9.34 | 11.24 | 10.55 | * | + |
| PLACE1000246 | 5.15 | 8.27 | 9.95 | 3.29 | 2.55 | 2.86 | * | − |
| PLACE1000258 | 5.4 | 12.61 | 13.52 | 14.88 | 16.7 | 14.95 | | |
| PLACE1000288 | 1.68 | 7.22 | 2.96 | 2.83 | 4.02 | 2.48 | | |
| PLACE1000292 | 3.72 | 9.02 | 8.85 | 10.23 | 20.58 | 9.21 | | |
| PLACE1000302 | 0.56 | 1.01 | 1.39 | 1.07 | 0.92 | 0.62 | | |
| PLACE1000304 | 1.13 | 3.26 | 3.17 | 3.75 | 2.32 | 3.05 | | |
| PLACE1000308 | 2.54 | 4.35 | 4.17 | 4.42 | 3.87 | 1.34 | | |
| PLACE1000309 | 2.29 | 4.02 | 4 | 6.72 | 5.23 | 7.88 | * | + |
| PLACE1000312 | 1.33 | 3.44 | 2.48 | 2.74 | 3.99 | 2.5 | | |
| PLACE1000330 | 0.46 | 5.76 | 3.02 | 1.32 | 1.93 | 1.35 | | |
| PLACE1000332 | 1.02 | 8.82 | 2.01 | 3.01 | 3.78 | 1.68 | | |
| PLACE1000347 | 2.3 | 9.48 | 3.89 | 2.59 | 5.81 | 3.22 | | |
| PLACE1000351 | 1.2 | 1.5 | 2.87 | 2.2 | 2.4 | 2 | | |
| PLACE1000374 | 2.01 | 3.03 | 7.02 | 8.89 | 6.55 | 6.85 | | |
| PLACE1000380 | 2.39 | 4.27 | 3.95 | 4.9 | 2.12 | 2.38 | | |
| PLACE1000383 | 1.03 | 2.62 | 1.9 | 2.53 | 3.64 | 2.4 | | |
| PLACE1000397 | 0.63 | 4.06 | 1.89 | 2.82 | 3.34 | 3.47 | | |
| PLACE1000401 | 1.22 | 6.39 | 2.24 | 2.23 | 3.05 | 2.36 | | |
| PLACE1000406 | 1.08 | 8.76 | 3.4 | 3.72 | 4.08 | 3.64 | | |
| PLACE1000412 | 1.61 | 6.38 | 1.56 | 1.62 | 3.45 | 1.46 | | |
| PLACE1000420 | 2.59 | 3.51 | 4.6 | 8.95 | 7.28 | 5.6 | * | + |
| PLACE1000421 | 0.99 | 1.3 | 2.32 | 2.97 | 2 | 1.7 | | |
| PLACE1000423 | 16.6 | 23.29 | 32.85 | 10.67 | 8.02 | 8.09 | * | − |
| PLACE1000424 | 1.36 | 3.09 | 2.12 | 3.35 | 2.65 | 1.97 | | |
| PLACE1000430 | 0.77 | 4.36 | 1.95 | 3.51 | 2.94 | 3.77 | | |
| PLACE1000433 | 1.06 | 5.9 | 1.65 | 1.89 | 2.6 | 1.8 | | |
| PLACE1000435 | 1.39 | 7.21 | 4.77 | 6.22 | 6.29 | 4.22 | | |
| PLACE1000437 | 6.06 | 10.65 | 10.14 | 17.29 | 20.07 | 18.79 | ** | + |
| PLACE1000442 | 3.75 | 3.85 | 6.27 | 7.81 | 5.7 | 6.7 | | |
| PLACE1000444 | 2.14 | 3.94 | 8.96 | 11.14 | 11.55 | 9.8 | | |
| PLACE1000453 | 5.57 | 11.03 | 14.16 | 10.42 | 7.4 | 2.99 | | |
| PLACE1000456 | 1.25 | 2.21 | 1.97 | 1.33 | 2.18 | 1.07 | | |
| PLACE1000465 | 2.09 | 5.63 | 6.62 | 12.97 | 11.8 | 10.69 | ** | + |
| PLACE1000481 | 2.32 | 8.1 | 3.73 | 6.89 | 6.64 | 6.45 | | |
| PLACE1000492 | 1.15 | 4.45 | 2.95 | 3.27 | 3.06 | 2.81 | | |
| PLACE1000508 | 1.36 | 4.64 | 4 | 3.91 | 4.24 | 3.71 | | |
| PLACE1000512 | 4.91 | 4.29 | 6.39 | 8.12 | 7.8 | 4.6 | | |
| PLACE1000540 | 5.18 | 3.93 | 7.84 | 5.44 | 6.9 | 5.57 | | |
| PLACE1000541 | 13.59 | 15.07 | 48.84 | 60.62 | 81.24 | 41.96 | | |
| PLACE1000546 | 0.86 | 3.61 | 2.82 | 4.72 | 4.63 | 2.5 | | |
| PLACE1000547 | 2.16 | 4.61 | 3.83 | 6.31 | 5.64 | 5.92 | * | + |
| PLACE1000560 | 2.08 | 5.97 | 2.1 | 1.62 | 2.8 | 1.72 | | |
| PLACE1000562 | 2.8 | 6.23 | 6.04 | 8.86 | 11.26 | 8.61 | * | + |
| PLACE1000564 | 1.54 | 6.4 | 3.07 | 3.16 | 4.41 | 3.43 | | |
| PLACE1000583 | 3.75 | 3.28 | 6.32 | 6.78 | 11.53 | 6.8 | | |
| PLACE1000587 | 8.52 | 9.32 | 12.99 | 13.64 | 14.69 | 9.43 | | |
| PLACE1000588 | 1.92 | 4.36 | 3.99 | 8.79 | 8.15 | 4.48 | | |
| PLACE1000596 | 1.99 | 5.34 | 4.39 | 7.8 | 6.74 | 4.51 | | |
| PLACE1000599 | 2.39 | 5.51 | 7.05 | 7.92 | 7.79 | 6.46 | | |
| PLACE1000605 | 5.12 | 11.43 | 7.06 | 14.2 | 15.1 | 12.67 | * | + |
| PLACE1000610 | 2.01 | 6.08 | 3.54 | 5.26 | 4.48 | 2.94 | | |
| PLACE1000611 | 13.18 | 19.13 | 24.68 | 16.45 | 20.37 | 22.79 | | |
| PLACE1000626 | 3.19 | 4.04 | 8.04 | 5.71 | 9.93 | 8.12 | | |
| PLACE1000633 | 1.32 | 2.12 | 3.95 | 4.8 | 6.06 | 3.59 | | |
| PLACE1000636 | 1.15 | 2.54 | 1.43 | 2.72 | 4.25 | 2.94 | | |
| PLACE1000653 | 5.07 | 8.56 | 9.29 | 11.07 | 11.87 | 14.08 | * | + |
| PLACE1000656 | 4.2 | 12.9 | 25.22 | 16.66 | 16.71 | 12.92 | | |
| PLACE1000663 | 2 | 6.43 | 3.59 | 2.39 | 6.61 | 4.03 | | |
| PLACE1000706 | 2 | 6.3 | 5.04 | 5.37 | 7.27 | 6.26 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1000712 | 3.9 | 9.52 | 10.82 | 10.49 | 10.07 | 9.11 | | |
| PLACE1000716 | 0.98 | 2.75 | 3.44 | 2.44 | 3.2 | 2.82 | | |
| PLACE1000740 | 2.74 | 5.28 | 6.24 | 8.83 | 8.13 | 9.69 | * | + |
| PLACE1000748 | 3.35 | 3.51 | 6.81 | 3.12 | 5.02 | 4.23 | | |
| PLACE1000749 | 3.49 | 6.35 | 5.94 | 4.61 | 4.65 | 6.02 | | |
| PLACE1000751 | 2.71 | 5.34 | 4.07 | 7.81 | 8.32 | 8.36 | ** | + |
| PLACE1000755 | 1.39 | 6.14 | 1.93 | 2.55 | 5.1 | 2.96 | | |
| PLACE1000769 | 2.29 | 6.8 | 3.45 | 3.33 | 4.58 | 2.6 | | |
| PLACE1000778 | 0.87 | 1.48 | 1.99 | 2.05 | 2.94 | 2.38 | | |
| PLACE1000785 | 9.56 | 12.21 | 27.18 | 28 | 24.34 | 29.54 | | |
| PLACE1000786 | 2.68 | 4.22 | 3.63 | 3.09 | 3.77 | 3.7 | | |
| PLACE1000793 | 4.05 | 7.21 | 6.7 | 6.06 | 7.6 | 9.1 | | |
| PLACE1000795 | 2.15 | 5.5 | 3.99 | 4.44 | 5.29 | 4.31 | | |
| PLACE1000798 | 0.88 | 8.44 | 3.24 | 3.13 | 3.8 | 3.72 | | |
| PLACE1000812 | 2.13 | 5.08 | 4.46 | 5.06 | 5.16 | 6.03 | | |
| PLACE1000823 | 1.71 | 5.2 | 4.89 | 5.67 | 7.28 | 4.84 | | |
| PLACE1000825 | 1.6 | 2.86 | 2.02 | 3.77 | 3.96 | 3.76 | * | + |
| PLACE1000838 | 16 | 15.77 | 23.73 | 13.88 | 15.6 | 15.65 | | |
| PLACE1000841 | 1.22 | 3.78 | 3.31 | 3.97 | 10.65 | 3.77 | | |
| PLACE1000843 | 2.14 | 6.2 | 5.68 | 5.79 | 7.7 | 5.38 | | |
| PLACE1000849 | 2.79 | 8.82 | 6.72 | 7.24 | 6.78 | 10.02 | | |
| PLACE1000856 | 2.01 | 5.3 | 3.59 | 3.42 | 4.79 | 4.19 | | |
| PLACE1000863 | 5.2 | 7.58 | 9.56 | 8.97 | 12.34 | 11.53 | | |
| PLACE1000876 | 3.65 | 7.6 | 6.02 | 6.7 | 9.95 | 9.06 | | |
| PLACE1000899 | 1.36 | 2.24 | 3.12 | 4.12 | 5.14 | 4.22 | * | + |
| PLACE1000907 | 4.82 | 5.53 | 9.59 | 6.77 | 8.44 | 5.83 | | |
| PLACE1000909 | 1.18 | 3.31 | 2.45 | 3.65 | 3.88 | 3.44 | | |
| PLACE1000912 | 0.42 | 4.55 | 1.77 | 1.76 | 2.72 | 1.46 | | |
| PLACE1000914 | 1.05 | 4.41 | 3.5 | 3 | 6.09 | 4.22 | | |
| PLACE1000918 | 0.54 | 4.49 | 1.61 | 1.82 | 3.13 | 1.98 | | |
| PLACE1000927 | 10.48 | 12.41 | 16.9 | 20.91 | 23.21 | 25.47 | * | + |
| PLACE1000931 | 0.69 | 3.44 | 2.12 | 2.44 | 3.94 | 3.3 | | |
| PLACE1000944 | 2.55 | 2.24 | 4.78 | 3.84 | 3.32 | 2.09 | | |
| PLACE1000948 | 0.52 | 2.31 | 2.96 | 2.21 | 2.72 | 1.72 | | |
| PLACE1000958 | 0.12 | 2.2 | 1.73 | 1.11 | 1.77 | 2.27 | | |
| PLACE1000972 | 1.01 | 3.43 | 2.89 | 4.49 | 5.33 | 3.75 | | |
| PLACE1000977 | 2.33 | 5.67 | 4.42 | 2.71 | 5.33 | 5.25 | | |
| PLACE1000979 | 1.63 | 8.01 | 3.93 | 4.24 | 5.92 | 4.57 | | |
| PLACE1000986 | 3.37 | 16.51 | 6.63 | 6.97 | 8.75 | 7.69 | | |
| PLACE1000987 | 1.76 | 10.13 | 4.79 | 4.17 | 4.74 | 5.11 | | |
| PLACE1001000 | 4.85 | 4.62 | 7.76 | 6.02 | 4.25 | 3.02 | | |
| PLACE1001007 | 7 | 6.94 | 14.66 | 5.39 | 3.76 | 3.47 | | |
| PLACE1001010 | 0.61 | 2.04 | 2.45 | 2.56 | 2.73 | 2.84 | | |
| PLACE1001015 | 0.88 | 2.55 | 1.84 | 2.36 | 1.72 | 2.42 | | |
| PLACE1001016 | 1.79 | 4.54 | 4.29 | 6.37 | 9 | 6.57 | * | + |
| PLACE1001022 | 0.68 | 6.5 | 2.45 | 1.9 | 2.39 | 1.29 | | |
| PLACE1001024 | 1.05 | 8.89 | 1.83 | 1.34 | 2.49 | 2.35 | | |
| PLACE1001036 | 2.63 | 10.55 | 5.42 | 3.62 | 5.49 | 5.43 | | |
| PLACE1001038 | 50.16 | 49.81 | 118.83 | 82.67 | 64.83 | 52.8 | | |
| PLACE1001048 | 1.07 | 1.82 | 0.92 | 2.39 | 2.09 | 1.21 | | |
| PLACE1001054 | 9.95 | 10.74 | 63.88 | 62.96 | 79.44 | 66.71 | | |
| PLACE1001062 | 1.45 | 4.19 | 3.71 | 3.12 | 4.17 | 3.05 | | |
| PLACE1001063 | 1.35 | 3.74 | 2.2 | 4.06 | 3.65 | 2.74 | | |
| PLACE1001076 | 0.46 | 6.48 | 1 | 1.86 | 2.18 | 1.62 | | |
| PLACE1001081 | 1.53 | 7.95 | 3.33 | 3.65 | 5.24 | 4.8 | | |
| PLACE1001088 | 1.32 | 5.24 | 1.22 | 1.42 | 2.81 | 1.37 | | |
| PLACE1001092 | 2.31 | 2.47 | 4.68 | 5.8 | 4.18 | 3.9 | | |
| PLACE1001098 | 0.93 | 2.62 | 4.53 | 5.49 | 4.05 | 3.17 | | |
| PLACE1001100 | 1.31 | 2.58 | 2.48 | 4.27 | 4.17 | 3.37 | * | + |
| PLACE1001104 | 1.95 | 4.09 | 4.54 | 3.39 | 3.42 | 4.47 | | |
| PLACE1001114 | 1.56 | 6.54 | 4.33 | 5.17 | 3.78 | 3.27 | | |
| PLACE1001118 | 2.52 | 5.77 | 6.12 | 6.21 | 6.14 | 5.1 | | |
| PLACE1001123 | 2.86 | 5.3 | 7.53 | 7.08 | 8.51 | 7.63 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1001136 | 1.58 | 4.39 | 5.13 | 5.29 | 5.95 | 5.85 | | |
| PLACE1001144 | 6.27 | 5.67 | 13.43 | 10.34 | 11 | 10.08 | | |
| PLACE1001147 | 2.11 | 2.98 | 6.03 | 6.13 | 5.15 | 4.83 | | |
| PLACE1001148 | 1.72 | 1.31 | 1.89 | 1.76 | 2.39 | 2.31 | | |
| PLACE1001159 | 0.86 | 2.37 | 2.05 | 2.27 | 3.73 | 1.43 | | |
| PLACE1001168 | 8.87 | 14.52 | 15.09 | 25.46 | 23.18 | 30.79 | * | + |
| PLACE1001171 | 0.69 | 3.89 | 1.23 | 2.53 | 1.42 | 1.53 | | |
| PLACE1001183 | 0.24 | 3.61 | 1.81 | 1.57 | 2.78 | 1.38 | | |
| PLACE1001185 | 3.13 | 7.43 | 3.76 | 5 | 6.4 | 5.64 | | |
| PLACE1001201 | 1.77 | 2.8 | 3.29 | 6.32 | 6.94 | 6.32 | ** | + |
| PLACE1001229 | 7.51 | 8.56 | 12.64 | 15.24 | 11.45 | 10.42 | | |
| PLACE1001231 | 1.83 | 2.73 | 3.07 | 4.09 | 5.1 | 2.3 | | |
| PLACE1001238 | 1.52 | 4.35 | 3.74 | 3.65 | 4.52 | 4.57 | | |
| PLACE1001241 | 1.63 | 5.58 | 2.92 | 5.73 | 8.13 | 7.04 | | |
| PLACE1001242 | 22.28 | 29.54 | 30.28 | 46.43 | 48.89 | 62.65 | * | + |
| PLACE1001247 | 2.43 | 7.02 | 4.07 | 5.03 | 5.91 | 4.52 | | |
| PLACE1001250 | 1.01 | 5.36 | 3.61 | 4.68 | 4.39 | 4.81 | | |
| PLACE1001257 | 2.99 | 3.06 | 7.06 | 7.89 | 9.21 | 7.69 | | |
| PLACE1001272 | 3.19 | 4.27 | 5.68 | 7.13 | 6.43 | 5.14 | | |
| PLACE1001279 | 0.96 | 3.12 | 2.74 | 3.08 | 3.81 | 3.29 | | |
| PLACE1001280 | 1.08 | 4.75 | 2.68 | 4.98 | 4.45 | 2.86 | | |
| PLACE1001294 | 1.91 | 7.23 | 6.91 | 4.88 | 5.57 | 6.18 | | |
| PLACE1001295 | 4.16 | 9.94 | 7.53 | 8.55 | 11.85 | 8.43 | | |
| PLACE1001300 | 2.46 | 7.9 | 4.31 | 4.65 | 14.73 | 4.95 | | |
| PLACE1001304 | 3 | 8.27 | 10.47 | 8.57 | 10.81 | 10.64 | | |
| PLACE1001311 | 3.95 | 3.34 | 5.67 | 6.85 | 9.14 | 7.6 | * | + |
| PLACE1001323 | 2.17 | 2.95 | 5.12 | 5.66 | 8.43 | 5.5 | | |
| PLACE1001325 | 0.88 | 1.95 | 3.71 | 2.84 | 3.56 | 3.27 | | |
| PLACE1001340 | 5.18 | 6.99 | 9.8 | 8.69 | 12.02 | 10.48 | | |
| PLACE1001344 | 1.52 | 3.49 | 1.77 | 2.34 | 2.06 | 1.75 | | |
| PLACE1001351 | 3.23 | 6.39 | 8.39 | 6.4 | 8.62 | 6.1 | | |
| PLACE1001366 | 1 | 4.49 | 4.02 | 4.19 | 4.6 | 3.72 | | |
| PLACE1001377 | 3.02 | 4.97 | 5.1 | 7.91 | 7.28 | 5.83 | * | + |
| PLACE1001383 | 2.31 | 4.13 | 3.53 | 2.62 | 5.5 | 5.72 | | |
| PLACE1001384 | 1.81 | 3.23 | 2.89 | 2.05 | 3.43 | 3.15 | | |
| PLACE1001387 | 1.65 | 3.64 | 3.7 | 3.03 | 4.83 | 3 | | |
| PLACE1001395 | 3.72 | 6.64 | 6.54 | 7.01 | 7.61 | 7.73 | | |
| PLACE1001399 | 3.71 | 6.58 | 9.31 | 7.37 | 8.61 | 9.22 | | |
| PLACE1001401 | 0.83 | 5.25 | 2.33 | 1.55 | 1.76 | 0.87 | | |
| PLACE1001407 | 11.65 | 21.8 | 24.47 | 22.63 | 18.09 | 26.24 | | |
| PLACE1001412 | 1.6 | 4.98 | 4.53 | 4.08 | 4.42 | 3.83 | | |
| PLACE1001414 | 2.3 | 3.02 | 5.86 | 7.57 | 5.13 | 6.83 | | |
| PLACE1001416 | 2.99 | 4.71 | 3.29 | 5.62 | 4.04 | 7.08 | | |
| PLACE1001433 | 33.62 | 33.05 | 51.64 | 49.1 | 58.33 | 55.88 | | |
| PLACE1001440 | 1.95 | 3.99 | 3.96 | 3.6 | 3.53 | 2.1 | | |
| PLACE1001456 | 1.64 | 5.5 | 4.26 | 4.15 | 4.87 | 4.49 | | |
| PLACE1001464 | 32.76 | 28.05 | 47.41 | 53.22 | 68.42 | 61.32 | * | + |
| PLACE1001468 | 0.85 | 5.04 | 1.17 | 1.56 | 2.55 | 2.27 | | |
| PLACE1001484 | 1.31 | 4.85 | 2.96 | 4.25 | 5.8 | 3.04 | | |
| PLACE1001500 | 0.92 | 2.22 | 2.14 | 2.72 | 3.34 | 3.26 | * | + |
| PLACE1001502 | 1.36 | 3.6 | 3.9 | 3.54 | 5.9 | 4.54 | | |
| PLACE1001503 | 1.7 | 4.58 | 6.72 | 7.47 | 8.2 | 8.05 | | |
| PLACE1001505 | 6.34 | 14.13 | 16.16 | 39.97 | 27.14 | 46.65 | * | + |
| PLACE1001513 | 4.09 | 10.82 | 8.17 | 5.87 | 8.53 | 14.61 | | |
| PLACE1001516 | 0.61 | 4.33 | 1.33 | 1.71 | 3.49 | 1.99 | | |
| PLACE1001517 | 5.56 | 8.58 | 14.77 | 14.14 | 14.96 | 14.28 | | |
| PLACE1001523 | 12.83 | 14.09 | 20.42 | 22.79 | 19.74 | 32.9 | | |
| PLACE1001526 | 5.12 | 4.89 | 8.42 | 9.51 | 9.11 | 6.89 | | |
| PLACE1001534 | 2.12 | 5.12 | 3.58 | 3.62 | 5.55 | 3.99 | | |
| PLACE1001536 | 0.61 | 2.5 | 1.52 | 2.11 | 3.2 | 1.9 | | |
| PLACE1001545 | 17.97 | 23.9 | 38.46 | 33.78 | 45.13 | 66.08 | | |
| PLACE1001551 | 2.55 | 6.26 | 6.15 | 4.72 | 6.59 | 6.71 | | |
| PLACE1001564 | 1.37 | 4.87 | 2.88 | 4.01 | 3.57 | 3.7 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1001570 | 2.62 | 5.95 | 4.18 | 2.19 | 3.82 | 4.32 | | |
| PLACE1001571 | 2.04 | 4.51 | 6.07 | 5.69 | 6.27 | 5.81 | | |
| PLACE1001595 | 4.73 | 4.64 | 10.04 | 11.6 | 8.27 | 5.28 | | |
| PLACE1001602 | 7.23 | 8.39 | 18.65 | 20.38 | 18.68 | 19.71 | | |
| PLACE1001603 | 2.01 | 3.83 | 5.37 | 6.86 | 5.86 | 4.56 | | |
| PLACE1001608 | 3.44 | 7.22 | 5.9 | 5.82 | 7.73 | 8.7 | | |
| PLACE1001610 | 3.77 | 8.4 | 8.22 | 9.26 | 9.49 | 9.85 | | |
| PLACE1001611 | 1.94 | 7.34 | 3.65 | 2.28 | 3.85 | 1.88 | | |
| PLACE1001629 | 0.78 | 6.77 | 2.24 | 3.62 | 3.36 | 3.52 | | |
| PLACE1001632 | 1.66 | 8.26 | 4.04 | 4.3 | 4.14 | 4.37 | | |
| PLACE1001634 | 7.4 | 9.92 | 39.12 | 23.85 | 32.41 | 18.38 | | |
| PLACE1001637 | 0.84 | 2.16 | 1.25 | 1.41 | 2.4 | 1.1 | | |
| PLACE1001640 | 1.33 | 3.27 | 4.66 | 2.68 | 4.85 | 4.49 | | |
| PLACE1001655 | 0.83 | 2.93 | 2.06 | 2.82 | 2.14 | 2.02 | | |
| PLACE1001672 | 1.84 | 7.04 | 4.01 | 3.3 | 4.41 | 4.09 | | |
| PLACE1001676 | 1.38 | 8.49 | 3.54 | 4.63 | 4.77 | 3.85 | | |
| PLACE1001683 | 12.79 | 23.62 | 24.61 | 25.33 | 30.22 | 27.13 | | |
| PLACE1001691 | 3.41 | 12.29 | 6.72 | 9.03 | 8.96 | 9.83 | | |
| PLACE1001692 | 1.47 | 2.96 | 5.25 | 5.87 | 5.6 | 5.13 | | |
| PLACE1001705 | 3.02 | 3.75 | 9.88 | 10.06 | 9.21 | 8.32 | | |
| PLACE1001716 | 1.68 | 3 | 2.61 | 2.24 | 3.79 | 3.58 | | |
| PLACE1001720 | 1.49 | 2.62 | 2.21 | 1.56 | 2.45 | 1.71 | | |
| PLACE1001728 | 1.43 | 6.19 | 4.24 | 1.96 | 2.04 | 2.51 | | |
| PLACE1001729 | 2.12 | 8.13 | 4.44 | 3.8 | 4.52 | 4.36 | | |
| PLACE1001739 | 2.61 | 9.55 | 4.04 | 4.95 | 7.24 | 6.16 | | |
| PLACE1001740 | 0.92 | 5.36 | 2.09 | 1.92 | 2.1 | 1.69 | | |
| PLACE1001745 | 1.15 | 0.98 | 3.22 | 1.87 | 2.48 | 2.31 | | |
| PLACE1001746 | 1.04 | 2.25 | 2.55 | 4.64 | 3.4 | 2.82 | | |
| PLACE1001748 | 4.74 | 7.01 | 8.18 | 8.19 | 6.58 | 5.96 | | |
| PLACE1001753 | 2.06 | 3.54 | 3.29 | 7.44 | 5.57 | 5.82 | * | + |
| PLACE1001756 | 5.6 | 11.31 | 38.07 | 31.78 | 44.99 | 35.99 | | |
| PLACE1001760 | 6.54 | 12.23 | 12.85 | 16.36 | 16.96 | 16.66 | * | + |
| PLACE1001767 | 11.26 | 14.98 | 59.72 | 45.37 | 61.46 | 45.39 | | |
| PLACE1001771 | 1.96 | 6.64 | 4.03 | 4.32 | 5.22 | 4.54 | | |
| PLACE1001775 | 2.23 | 2.81 | 6.72 | 5.1 | 3.11 | 4.79 | | |
| PLACE1001777 | 83.34 | 145.91 | 90.82 | 142.92 | 71.27 | 59.69 | | |
| PLACE1001781 | 1.9 | 3.86 | 4.91 | 8.72 | 3.39 | 2.3 | | |
| PLACE1001783 | 0.76 | 3.21 | 2.06 | 4.84 | 2.09 | 1.54 | | |
| PLACE1001786 | 1.77 | 6.61 | 2.72 | 3.7 | 3.32 | 2.6 | | |
| PLACE1001788 | 5.16 | 9.07 | 7.14 | 10.52 | 8.74 | 9.32 | | |
| PLACE1001795 | 1.92 | 4.4 | 4.82 | 5.42 | 4.61 | 5.42 | | |
| PLACE1001799 | 0.69 | 3.62 | 2.11 | 1.86 | 2.83 | 1.97 | | |
| PLACE1001810 | 0.89 | 1.52 | 1.76 | 2.73 | 3.91 | 1.73 | | |
| PLACE1001817 | 5.53 | 6.12 | 10.88 | 10.56 | 9.4 | 6.38 | | |
| PLACE1001821 | 4.68 | 6.07 | 7.11 | 8.37 | 9.92 | 4.99 | | |
| PLACE1001836 | 0.91 | 3.12 | 2.38 | 2.69 | 4.12 | 2.63 | | |
| PLACE1001844 | 1.55 | 5.1 | 3.48 | 4.42 | 4.36 | 4.09 | | |
| PLACE1001845 | 3.62 | 8.38 | 7.39 | 7.88 | 7.55 | 9.93 | | |
| PLACE1001858 | 2.56 | 6.58 | 3.52 | 5.26 | 7.48 | 6.05 | | |
| PLACE1001869 | 3.13 | 7.15 | 4.85 | 6.09 | 6.46 | 5.66 | | |
| PLACE1001890 | 11.74 | 11.92 | 21.45 | 173.44 | 255.31 | 125.13 | * | + |
| PLACE1001897 | 9.19 | 13.85 | 16.44 | 22.22 | 23.13 | 12.95 | | |
| PLACE1001902 | 10.13 | 12.6 | 21.53 | 22.74 | 27.67 | 12.77 | | |
| PLACE1001904 | 1.38 | 3.72 | 1.51 | 2.45 | 2.53 | 2.35 | | |
| PLACE1001907 | 3.36 | 6.76 | 5.71 | 7.67 | 5.67 | 5.59 | | |
| PLACE1001910 | 83.6 | 82.16 | 135.34 | 301.29 | 325.42 | 244.59 | ** | + |
| PLACE1001912 | 1.53 | 6.6 | 3.36 | 5.54 | 5.48 | 4.85 | | |
| PLACE1001918 | 17.31 | 22.95 | 30.16 | 31.14 | 40.44 | 40.02 | * | + |
| PLACE1001920 | 2.07 | 3.51 | 5.43 | 11.97 | 13.8 | 11.4 | ** | + |
| PLACE1001928 | 3.06 | 2.96 | 4.67 | 5.29 | 9.7 | 5.31 | | |
| PLACE1001930 | 1.17 | 3.92 | 2.2 | 2.9 | 4.73 | 3.22 | | |
| PLACE1001949 | 1.16 | 3.67 | 1.78 | 3.84 | 4.24 | 3.18 | | |
| PLACE1001959 | 1.36 | 4.7 | 3.16 | 2.63 | 3.17 | 2.26 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
|  | exp. 1 | exp. 2 | exp. 3 | exp. 1 | exp. 2 | exp. 3 |  |  |
| PLACE1001969 | 2.09 | 7.83 | 7.21 | 6.56 | 10.73 | 6.57 |  |  |
| PLACE1001974 | 7.39 | 11.98 | 11.87 | 11.43 | 16.09 | 16.06 |  |  |
| PLACE1001981 | 0.77 | 4.38 | 3.22 | 1.77 | 3.88 | 2.36 |  |  |
| PLACE1001983 | 3.81 | 4.12 | 5.32 | 5.92 | 6.16 | 5.72 | * | + |
| PLACE1001989 | 2.34 | 4.15 | 5.02 | 4.37 | 5.91 | 3.72 |  |  |
| PLACE1002004 | 3.07 | 4.06 | 8.05 | 9.22 | 9.69 | 7.18 |  |  |
| PLACE1002008 | 8.4 | 11.76 | 17 | 23.36 | 22.19 | 22.42 | * | + |
| PLACE1002015 | 26.96 | 30.92 | 67.62 | 105.75 | 88.42 | 94.15 | * | + |
| PLACE1002044 | 3.79 | 8.07 | 5.86 | 4.64 | 6.39 | 6.4 |  |  |
| PLACE1002046 | 1.78 | 5.68 | 1.9 | 4.3 | 5.79 | 4.97 |  |  |
| PLACE1002052 | 1.09 | 4.98 | 2.26 | 1.38 | 2.41 | 2.32 |  |  |
| PLACE1002066 | 4.79 | 6.3 | 8.29 | 10.24 | 10.77 | 9.93 | * | + |
| PLACE1002072 | 2.55 | 3.91 | 4.86 | 6 | 5.48 | 6 | * | + |
| PLACE1002073 | 0.51 | 2.83 | 2.29 | 2.35 | 4.06 | 2.91 |  |  |
| PLACE1002080 | 1.81 | 6.49 | 6.13 | 4.76 | 6.82 | 5.72 |  |  |
| PLACE1002081 | 1.66 | 6.13 | 4.06 | 3.74 | 4.86 | 4.3 |  |  |
| PLACE1002090 | 7.74 | 16.55 | 13.87 | 12.53 | 14.4 | 19.41 |  |  |
| PLACE1002095 | 2.97 | 6.22 | 8.45 | 10.01 | 10.18 | 11.32 | * | + |
| PLACE1002102 | 4.26 | 8.56 | 8.81 | 9.47 | 9.56 | 10.67 |  |  |
| PLACE1002109 | 2.57 | 5.08 | 3.81 | 4.66 | 6.17 | 6.32 |  |  |
| PLACE1002115 | 1.75 | 3.57 | 2.48 | 2.78 | 4.26 | 2.59 |  |  |
| PLACE1002119 | 15.65 | 15.3 | 35.78 | 37.28 | 32.59 | 38.23 |  |  |
| PLACE1002140 | 5.25 | 8.45 | 14.05 | 19.93 | 17.14 | 17.19 | * | + |
| PLACE1002150 | 1.54 | 8.26 | 4.25 | 3.23 | 5.36 | 4.12 |  |  |
| PLACE1002153 | 1.6 | 5.75 | 2.58 | 3.47 | 5.76 | 4.48 |  |  |
| PLACE1002157 | 0.87 | 2.96 | 1.72 | 1.76 | 3.28 | 3.73 |  |  |
| PLACE1002163 | 2.13 | 4.67 | 4.55 | 6.21 | 8.81 | 6.03 |  |  |
| PLACE1002168 | 2.39 | 4.04 | 4.42 | 4.68 | 6.28 | 3.22 |  |  |
| PLACE1002170 | 2.73 | 3.53 | 7.35 | 4.89 | 5.33 | 3.74 |  |  |
| PLACE1002171 | 3.09 | 6.11 | 10.02 | 18.44 | 14.63 | 13.93 | * | + |
| PLACE1002180 | 3.16 | 6.23 | 6.77 | 4.63 | 8.54 | 8.39 |  |  |
| PLACE1002184 | 9.2 | 15.58 | 18.42 | 124.63 | 250.27 | 333.14 | * | + |
| PLACE1002200 | 1.35 | 5.67 | 2.38 | 2.97 | 2.89 | 2.26 |  |  |
| PLACE1002205 | 3.3 | 6.47 | 18.07 | 17.08 | 18.38 | 14.61 |  |  |
| PLACE1002213 | 2.2 | 4.16 | 4.93 | 5.52 | 8.03 | 6.03 |  |  |
| PLACE1002219 | 1.05 | 1.91 | 2.23 | 3.33 | 3.53 | 1.96 |  |  |
| PLACE1002227 | 0.68 | 2.65 | 1.7 | 1.5 | 3.03 | 1.67 |  |  |
| PLACE1002253 | 0.32 | 2.67 | 1.28 | 1.47 | 0.76 | 0.43 |  |  |
| PLACE1002256 | 1.16 | 4.78 | 3.31 | 3.54 | 3.01 | 4.79 |  |  |
| PLACE1002259 | 1.46 | 5.69 | 4.48 | 3.22 | 2.98 | 2.31 |  |  |
| PLACE1002285 | 1.16 | 10.74 | 2.29 | 1.55 | 2.38 | 1.24 |  |  |
| PLACE1002301 | 9.42 | 17.5 | 14.68 | 12.7 | 10.48 | 11.7 |  |  |
| PLACE1002310 | 4.28 | 10.16 | 9.86 | 8.82 | 7.87 | 9.94 |  |  |
| PLACE1002311 | 1.84 | 2.94 | 3.87 | 2.96 | 2.87 | 2.03 |  |  |
| PLACE1002319 | 2.31 | 2.64 | 2.94 | 3.21 | 3.23 | 3.92 | * | + |
| PLACE1002329 | 0.56 | 2.54 | 2.5 | 4.07 | 3.58 | 3.07 |  |  |
| PLACE1002333 | 1.34 | 3.1 | 1.96 | 1.22 | 2.44 | 2 |  |  |
| PLACE1002342 | 4.19 | 9.04 | 9.44 | 5.06 | 8.52 | 8.17 |  |  |
| PLACE1002343 | 0.49 | 6.98 | 2.94 | 2.08 | 1.9 | 2.52 |  |  |
| PLACE1002355 | 1.31 | 9.39 | 2.36 | 3.33 | 4.35 | 2.63 |  |  |
| PLACE1002358 | 1.15 | 7.94 | 3.3 | 2.6 | 2.65 | 2.13 |  |  |
| PLACE1002359 | 1.91 | 2.17 | 3.47 | 4.7 | 3.91 | 3.42 |  |  |
| PLACE1002374 | 29.69 | 28.18 | 54.19 | 53.9 | 34.73 | 36.14 |  |  |
| PLACE1002376 | 3.58 | 5.91 | 7.86 | 6.23 | 6.82 | 6.56 |  |  |
| PLACE1002379 | 6.24 | 7.66 | 6.63 | 10.13 | 9.68 | 10.9 | ** | + |
| PLACE1002386 | 0.86 | 5.32 | 1.35 | 1.87 | 2.05 | 1.51 |  |  |
| PLACE1002395 | 3.69 | 9.97 | 17.13 | 16.43 | 20.62 | 16.16 |  |  |
| PLACE1002399 | 2.38 | 11.09 | 3.42 | 5.31 | 10.38 | 7.39 |  |  |
| PLACE1002407 | 1.09 | 5.22 | 2.31 | 2.3 | 4.01 | 3.66 |  |  |
| PLACE1002433 | 1.63 | 2.17 | 2.97 | 2.96 | 4.35 | 3.66 |  |  |
| PLACE1002437 | 0.79 | 1.4 | 1.47 | 1.41 | 3.28 | 1.35 |  |  |
| PLACE1002438 | 0.74 | 2.38 | 1.96 | 1.8 | 2.43 | 3.38 |  |  |
| PLACE1002446 | 4.64 | 8.42 | 5.95 | 10.27 | 8.88 | 11.99 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1002447 | 1.26 | 6.06 | 2.05 | 3.92 | 3.14 | 4.32 | | |
| PLACE1002450 | 1.19 | 5.92 | 3.24 | 4.32 | 4.21 | 5.05 | | |
| PLACE1002462 | 0.81 | 4.02 | 2.94 | 3.51 | 2.99 | 3.13 | | |
| PLACE1002465 | 0.96 | 4.69 | 2.2 | 2.69 | 4.31 | 2.24 | | |
| PLACE1002474 | 1.61 | 2.26 | 3.23 | 3.85 | 4.41 | 3.6 | * | + |
| PLACE1002477 | 11.11 | 14.51 | 32.39 | 44.06 | 41.42 | 26.68 | | |
| PLACE1002493 | 3.39 | 4.1 | 10.1 | 14.39 | 16.66 | 9.49 | | |
| PLACE1002497 | 0.68 | 2.81 | 0.67 | 1.45 | 0.93 | 0.99 | | |
| PLACE1002499 | 2.12 | 4.73 | 3 | 5.98 | 6.44 | 5.28 | * | + |
| PLACE1002500 | 2.61 | 6.52 | 7.36 | 7.58 | 10.45 | 7.25 | | |
| PLACE1002514 | 0.3 | 4.49 | 1.84 | 1.74 | 2.47 | 1.75 | | |
| PLACE1002518 | 2.86 | 7.65 | 6.9 | 5.62 | 7.55 | 4.67 | | |
| PLACE1002529 | 1.14 | 1.56 | 2.21 | 3.19 | 3.4 | 1.44 | | |
| PLACE1002532 | 1.31 | 1.82 | 3.18 | 5.75 | 4.94 | 5.59 | ** | + |
| PLACE1002536 | 3.59 | 3.75 | 3.44 | 5.84 | 6.07 | 3.85 | | |
| PLACE1002537 | 1.63 | 4.06 | 2.7 | 2.69 | 4.07 | 3.08 | | |
| PLACE1002539 | 1.86 | 5.68 | 2.75 | 4.53 | 5.29 | 4.78 | | |
| PLACE1002547 | 6.09 | 8.06 | 7.3 | 12.32 | 11.02 | 11.26 | ** | + |
| PLACE1002571 | 2.84 | 6.85 | 5.19 | 6.84 | 8.65 | 6.23 | | |
| PLACE1002578 | 3.57 | 8.34 | 8.35 | 11.11 | 12.19 | 8.11 | | |
| PLACE1002583 | 1.33 | 1.61 | 2.32 | 3.18 | 4.02 | 2.46 | | |
| PLACE1002591 | 0.82 | 1.62 | 2.34 | 3.25 | 4.43 | 1.92 | | |
| PLACE1002598 | 6.56 | 10.95 | 12.39 | 11.93 | 9.04 | 7.74 | | |
| PLACE1002604 | 1.73 | 3.57 | 2.69 | 3.75 | 5.38 | 3.51 | | |
| PLACE1002612 | 2.89 | 8.47 | 5.95 | 11.25 | 10.88 | 8.06 | | |
| PLACE1002625 | 1.25 | 4.79 | 3.18 | 2.7 | 3.25 | 1.82 | | |
| PLACE1002638 | 2.94 | 8.01 | 6.66 | 7.78 | 6.81 | 7.29 | | |
| PLACE1002655 | 1.39 | 6.51 | 5.57 | 7.19 | 7.62 | 6.46 | | |
| PLACE1002665 | 4.57 | 3.88 | 5.4 | 7.47 | 12.16 | 10.75 | * | + |
| PLACE1002685 | 0.58 | 1.12 | 1.3 | 0.67 | 2.43 | 0.98 | | |
| PLACE1002692 | 7.42 | 8.56 | 16.7 | 19.27 | 22.67 | 16.29 | | |
| PLACE1002714 | 1.8 | 3 | 2.11 | 2.43 | 3.14 | 2.24 | | |
| PLACE1002721 | 2.94 | 4.37 | 3.88 | 5.88 | 7.1 | 4.28 | | |
| PLACE1002722 | 0.92 | 5.42 | 1.97 | 1.37 | 3.28 | 1.85 | | |
| PLACE1002726 | 1.6 | 6.24 | 3.66 | 4.6 | 5.7 | 5.26 | | |
| PLACE1002756 | 1.57 | 4.5 | 7.04 | 5.92 | 9.63 | 7.78 | | |
| PLACE1002768 | 1.05 | 3.72 | 2.16 | 2.1 | 2.34 | 1.71 | | |
| PLACE1002772 | 0.54 | 2.15 | 1.32 | 2.49 | 2.86 | 2.3 | | |
| PLACE1002775 | 4.33 | 4.71 | 9.15 | 7.05 | 7.08 | 8.67 | | |
| PLACE1002780 | 185.63 | 218.72 | 325.36 | 272.21 | 244.38 | 305.38 | | |
| PLACE1002782 | 0.4 | 3.76 | 1.1 | 1.62 | 1.69 | 1.14 | | |
| PLACE1002794 | 1.5 | 6.71 | 3.27 | 2.26 | 4.59 | 4.36 | | |
| PLACE1002795 | 1.92 | 6.45 | 0.81 | 2.37 | 3.63 | 2.77 | | |
| PLACE1002811 | 0.6 | 1.57 | 1.34 | 1.9 | 1.46 | 1.16 | | |
| PLACE1002815 | 6.39 | 7 | 10.49 | 7.24 | 3.16 | 9.21 | | |
| PLACE1002816 | 8.5 | 9.72 | 9.05 | 7.22 | 8.2 | 7.97 | * | − |
| PLACE1002822 | 0.58 | 2.51 | 2.06 | 2.2 | 2.87 | 1.94 | | |
| PLACE1002833 | 9.98 | 15.11 | 16.78 | 15.42 | 15.99 | 16.56 | | |
| PLACE1002834 | 3.2 | 8.08 | 6.57 | 6.23 | 6.79 | 8.41 | | |
| PLACE1002835 | 0.62 | 4.14 | 1.72 | 0.85 | 1.83 | 1.79 | | |
| PLACE1002839 | 1.13 | 5.75 | 2.72 | 2.89 | 4.72 | 2.81 | | |
| PLACE1002851 | 1.52 | 1.87 | 1.41 | 1.98 | 2.15 | 2.7 | | |
| PLACE1002853 | 4.18 | 6.23 | 9.15 | 6.26 | 5.6 | 7 | | |
| PLACE1002881 | 3.42 | 5.2 | 11.04 | 8.35 | 11.57 | 10.26 | | |
| PLACE1002901 | 9.66 | 12.66 | 20.09 | 24.14 | 25.51 | 30.67 | * | + |
| PLACE1002904 | 0.89 | 7.35 | 1.41 | 1.98 | 1.95 | 3.09 | | |
| PLACE1002905 | 1.36 | 5.46 | 3.26 | 4.04 | 4.46 | 3.4 | | |
| PLACE1002908 | 1.6 | 5.19 | 3.18 | 3.84 | 5.27 | 3.81 | | |
| PLACE1002911 | 3.91 | 6.96 | 6.9 | 4.66 | 7.89 | 6.75 | | |
| PLACE1002941 | 1.57 | 2.2 | 2.48 | 3.94 | 2.02 | 2.31 | | |
| PLACE1002950 | 9.59 | 9.15 | 14.74 | 5.31 | 8.02 | 14.51 | | |
| PLACE1002955 | 47.83 | 40.69 | 72.78 | 2.17 | 62.5 | 84.64 | | |
| PLACE1002958 | 19.36 | 26.92 | 35.27 | 35.6 | 35.35 | 59.02 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1002962 | 1.03 | 4.03 | 2.2 | 1.41 | 2.63 | 1.67 | | |
| PLACE1002967 | 1.34 | 4.83 | 3.19 | 4.37 | 3.52 | 2.81 | | |
| PLACE1002968 | 1.2 | 5.14 | 2.7 | 2.55 | 3.05 | 1.81 | | |
| PLACE1002976 | 8.94 | 12.08 | 24.23 | 24.5 | 36.89 | 30.05 | | |
| PLACE1002991 | 2.68 | 3.05 | 6.66 | 3.49 | 4.56 | 3.6 | | |
| PLACE1002993 | 2.72 | 3.86 | 5.52 | 8.21 | 6.92 | 5.56 | | |
| PLACE1002996 | 2.02 | 3.03 | 3.43 | 5.54 | 3.52 | 3.01 | | |
| PLACE1003010 | 1.91 | 3.69 | 4.27 | 4.31 | 3.86 | 3.32 | | |
| PLACE1003025 | 2.85 | 7.01 | 6.1 | 8.57 | 11.37 | 10.11 | * | + |
| PLACE1003027 | 5.02 | 13.08 | 9.31 | 8.55 | 12.45 | 12.76 | | |
| PLACE1003044 | 1.95 | 8.24 | 2.61 | 3.64 | 4.16 | 2.74 | | |
| PLACE1003045 | 1.41 | 7.75 | 1.77 | 1.88 | 2.64 | 1.01 | | |
| PLACE1003052 | 2.19 | 3.16 | 5.74 | 4.44 | 3.6 | 1.99 | | |
| PLACE1003083 | 1.59 | 3.04 | 3.23 | 3.06 | 1.61 | 2.25 | | |
| PLACE1003085 | 3.91 | 6.19 | 5.6 | 9.46 | 5.89 | 3.33 | | |
| PLACE1003092 | 3.94 | 4.87 | 6.25 | 7 | 5.6 | 6.17 | | |
| PLACE1003097 | 0.37 | 3.06 | 1.44 | 2.12 | 1.88 | 1.63 | | |
| PLACE1003100 | 1.65 | 7.1 | 4.2 | 3.88 | 4.74 | 4.29 | | |
| PLACE1003108 | 1.26 | 10.37 | 2.91 | 3.32 | 4.44 | 2.39 | | |
| PLACE1003115 | 11.39 | 18.3 | 58.59 | 73.64 | 99.24 | 69.1 | * | + |
| PLACE1003120 | 3.1 | 3.08 | 9.71 | 11.34 | 8.32 | 10.19 | | |
| PLACE1003135 | 0.72 | 2.04 | 1.09 | 1.56 | 2.89 | 1.08 | | |
| PLACE1003136 | 3.95 | 5.82 | 6.05 | 9.03 | 6.55 | 7.34 | | |
| PLACE1003141 | 2.04 | 2.97 | 2.1 | 1.97 | 2.49 | 1.8 | | |
| PLACE1003145 | 1.21 | 4.17 | 2.52 | 6.24 | 6.88 | 7.67 | * | + |
| PLACE1003147 | 2.87 | 7.85 | 5.71 | 5.02 | 5.25 | 6.28 | | |
| PLACE1003153 | 0.54 | 7.63 | 2.14 | 1.66 | 3.2 | 1.82 | | |
| PLACE1003163 | 6.09 | 13.55 | 8.19 | 8.39 | 14.09 | 12.26 | | |
| PLACE1003172 | 23.21 | 21.74 | 44.19 | 47.78 | 43.17 | 39.52 | | |
| PLACE1003174 | 2.31 | 2.49 | 3.75 | 4.3 | 3.55 | 1.68 | | |
| PLACE1003176 | 0.47 | 2 | 1.89 | 2.88 | 1.27 | 1.46 | | |
| PLACE1003181 | 1.72 | 4.19 | 2.72 | 2.5 | 2.76 | 2.36 | | |
| PLACE1003184 | 0.76 | 3.92 | 1.53 | 1.91 | 1.49 | 2.06 | | |
| PLACE1003190 | 2.39 | 9.81 | 8.67 | 10.73 | 7.98 | 10.34 | | |
| PLACE1003200 | 0.29 | 4.48 | 1.84 | 0.72 | 1.92 | 1.16 | | |
| PLACE1003205 | 3.94 | 7.07 | 9.68 | 6.82 | 10.38 | 7.2 | | |
| PLACE1003209 | 1.43 | 2.18 | 2.62 | 2.28 | 1.82 | 2.89 | | |
| PLACE1003214 | 0.83 | 1.3 | 2 | 2.15 | 2.44 | 1.81 | | |
| PLACE1003229 | 2.08 | 2.78 | 2.9 | 2.78 | 3.35 | 3.48 | | |
| PLACE1003238 | 0.46 | 2.34 | 1.24 | 1.35 | 2 | 0.75 | | |
| PLACE1003249 | 1.87 | 5.04 | 4.7 | 7.33 | 7.56 | 5.89 | | |
| PLACE1003256 | 3.47 | 7.69 | 7.94 | 8.82 | 7.68 | 6.08 | | |
| PLACE1003258 | 1.03 | 3.81 | 3.48 | 2.42 | 2.19 | 0.87 | | |
| PLACE1003279 | 3.09 | 7.19 | 9.02 | 11.15 | 13.56 | 11.58 | * | + |
| PLACE1003294 | 0.95 | 1.54 | 1.59 | 1.57 | 1.25 | 2.64 | | |
| PLACE1003296 | 1.49 | 2.6 | 2.45 | 2.59 | 3.11 | 2.4 | | |
| PLACE1003297 | 7.52 | 10.15 | 31.88 | 23.01 | 23.49 | 19.3 | | |
| PLACE1003302 | 3.92 | 5.16 | 6.99 | 5.8 | 4.72 | 5.47 | | |
| PLACE1003334 | 1.51 | 4.41 | 1.91 | 2.4 | 3.59 | 3.09 | | |
| PLACE1003337 | 13.69 | 16.3 | 29.83 | 28.53 | 34.27 | 25.76 | | |
| PLACE1003342 | 1.05 | 4.07 | 1.89 | 2.15 | 2.35 | 1.97 | | |
| PLACE1003343 | 1.07 | 4.98 | 1.61 | 2.02 | 2.75 | 2.12 | | |
| PLACE1003344 | 6.25 | 5.33 | 12.83 | 11.18 | 11.35 | 11.98 | | |
| PLACE1003353 | 19.67 | 16.04 | 40.09 | 37.78 | 42.55 | 40.26 | | |
| PLACE1003361 | 1.82 | 3.64 | 3.72 | 5.85 | 5.31 | 4.6 | * | + |
| PLACE1003366 | 1.45 | 4.35 | 3.63 | 3.22 | 3.33 | 2.97 | | |
| PLACE1003369 | 2.75 | 4.51 | 3.49 | 3.29 | 3.25 | 4.62 | | |
| PLACE1003372 | 2.08 | 5.73 | 2.68 | 5.45 | 4.72 | 3.39 | | |
| PLACE1003373 | 2.85 | 7.37 | 6.62 | 8.8 | 11.81 | 9.89 | | |
| PLACE1003375 | 1.42 | 4.91 | 1.92 | 2.59 | 2.95 | 3.21 | | |
| PLACE1003378 | 0.94 | 0.94 | 0.98 | 0.7 | 1.66 | 1.08 | | |
| PLACE1003383 | 0.87 | 1.55 | 2.33 | 1.59 | 3.15 | 1.57 | | |
| PLACE1003394 | 10.55 | 12.49 | 24.08 | 11.75 | 22.99 | 17.27 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1003401 | 0.79 | 3.91 | 1.34 | 1.03 | 2.13 | 1.04 | | |
| PLACE1003405 | 1.5 | 3.97 | 2.22 | 2.54 | 2.46 | 2.04 | | |
| PLACE1003407 | 2.39 | 6.06 | 5.16 | 3.96 | 6.3 | 4.02 | | |
| PLACE1003420 | 3.26 | 7.69 | 6.19 | 6.8 | 10.92 | 8.7 | | |
| PLACE1003428 | 0.63 | 3.3 | 2.62 | 2.07 | 2.94 | 1.96 | | |
| PLACE1003432 | 6.14 | 5.81 | 8.2 | 6.64 | 7.05 | 5.42 | | |
| PLACE1003438 | 0.45 | 2.66 | 0.93 | 2.41 | 2.34 | 1.99 | | |
| PLACE1003452 | 1.87 | 5.02 | 5.08 | 4.53 | 3.43 | 3.84 | | |
| PLACE1003454 | 2.49 | 5.59 | 7.34 | 7.31 | 6.95 | 5.61 | | |
| PLACE1003455 | 2.58 | 4.26 | 2.35 | 2.97 | 3.01 | 3.17 | | |
| PLACE1003456 | 3.22 | 7.74 | 8.62 | 6.9 | 7.2 | 7.79 | | |
| PLACE1003460 | 6.39 | 13.35 | 14.87 | 13.02 | 16.76 | 12.86 | | |
| PLACE1003478 | 1.15 | 1.71 | 0.86 | 2.33 | 2.07 | 1.24 | | |
| PLACE1003484 | 12.06 | 12.21 | 45.33 | 28.12 | 31.5 | 34.2 | | |
| PLACE1003493 | 1.61 | 4.72 | 4.9 | 3.84 | 5.96 | 5.08 | | |
| PLACE1003503 | 85.45 | 87.35 | 107.79 | 115.17 | 111.85 | 172.81 | | |
| PLACE1003505 | 1.99 | 6.77 | 4.78 | 7.44 | 6.63 | 8.87 | | |
| PLACE1003516 | 0.86 | 6.78 | 2.7 | 2.8 | 3.95 | 2.39 | | |
| PLACE1003519 | 17.58 | 26.29 | 50.41 | 45.77 | 36.97 | 58.75 | | |
| PLACE1003520 | 14.18 | 25.48 | 35.96 | 25.73 | 31.4 | 32.19 | | |
| PLACE1003521 | 2.71 | 3.64 | 4.93 | 5.97 | 4.71 | 7.4 | | |
| PLACE1003525 | 8.45 | 11.81 | 45.05 | 33.94 | 43.71 | 36.88 | | |
| PLACE1003528 | 39.18 | 44.68 | 136.4 | 106.04 | 122.76 | 127.22 | | |
| PLACE1003529 | 1.46 | 4.26 | 3.29 | 2.4 | 3.94 | 3.83 | | |
| PLACE1003537 | 4.41 | 9.05 | 11.05 | 11.36 | 13.77 | 13.3 | | |
| PLACE1003549 | 1.1 | 5.02 | 4.59 | 5.61 | 6.01 | 5.93 | | |
| PLACE1003553 | 1.6 | 5.89 | 3.88 | 4.02 | 4.17 | 4.23 | | |
| PLACE1003566 | 5.93 | 9.8 | 17.51 | 13.03 | 19.09 | 14.58 | | |
| PLACE1003568 | 3.01 | 2.71 | 5.76 | 5.69 | 4.43 | 4.04 | | |
| PLACE1003573 | 0.98 | 2.43 | 1.19 | 2.16 | 1.87 | 1.48 | | |
| PLACE1003575 | 2.16 | 3.09 | 3.44 | 3.34 | 3.5 | 4.15 | | |
| PLACE1003583 | 0.97 | 3.45 | 3.34 | 2.29 | 4.16 | 2.23 | | |
| PLACE1003584 | 1.23 | 4.46 | 4.01 | 3.56 | 3.8 | 2.65 | | |
| PLACE1003592 | 4.4 | 8.48 | 9.48 | 7.11 | 10.48 | 9.53 | | |
| PLACE1003593 | 0.84 | 5.55 | 2.4 | 2.23 | 3.02 | 1.55 | | |
| PLACE1003594 | 4.24 | 6.76 | 6.01 | 5.78 | 6.68 | 7.36 | | |
| PLACE1003596 | 13.77 | 11.31 | 22.53 | 15.68 | 17.69 | 8.25 | | |
| PLACE1003598 | 2.83 | 3.63 | 5.02 | 4.89 | 3.7 | 2.95 | | |
| PLACE1003602 | 1.8 | 4.24 | 6.36 | 4.37 | 3.54 | 2.68 | | |
| PLACE1003605 | 17.43 | 21.72 | 45.86 | 94.65 | 95.6 | 91.55 | ** | + |
| PLACE1003611 | 2.34 | 5.18 | 6.07 | 5.65 | 7.14 | 6 | | |
| PLACE1003618 | 0.67 | 7.39 | 2.09 | 1.58 | 2.4 | 1.32 | | |
| PLACE1003625 | 1.78 | 10.41 | 2.75 | 3.33 | 5.48 | 2.8 | | |
| PLACE1003626 | 8.77 | 15.99 | 17.14 | 10.87 | 14.46 | 13.19 | | |
| PLACE1003630 | 1.8 | 2.57 | 5.8 | 7.05 | 4.67 | 5.86 | | |
| PLACE1003635 | 2.15 | 1.83 | 3.19 | 2.96 | 2.82 | 2.44 | | |
| PLACE1003638 | 1.3 | 2.58 | 3 | 5.21 | 4.19 | 3.13 | | |
| PLACE1003644 | 4.01 | 5.7 | 7.25 | 7.81 | 9.13 | 8.76 | * | + |
| PLACE1003654 | 2.56 | 6.14 | 4.04 | 3.54 | 6.96 | 6.4 | | |
| PLACE1003656 | 2.69 | 7.79 | 6.12 | 6.54 | 5.63 | 4.77 | | |
| PLACE1003660 | 0.26 | 9.54 | 3.5 | 3.08 | 4.92 | 4.11 | | |
| PLACE1003669 | 2.43 | 9.05 | 3.67 | 2.59 | 4.26 | 3.08 | | |
| PLACE1003670 | 5.37 | 5.7 | 9.44 | 11.01 | 8.26 | 8.76 | | |
| PLACE1003671 | 1.66 | 1.22 | 3.57 | 3.11 | 2.57 | 1.57 | | |
| PLACE1003697 | 7.27 | 7.99 | 9.8 | 8.23 | 6.06 | 6.42 | | |
| PLACE1003704 | 3.12 | 3.97 | 5.17 | 5.96 | 7.25 | 5.97 | * | + |
| PLACE1003709 | 0.89 | 2.63 | 0.8 | 1.19 | 1.24 | 2.44 | | |
| PLACE1003711 | 0.74 | 5.48 | 1.35 | 1.87 | 1.8 | 1.39 | | |
| PLACE1003723 | 1.07 | 6.99 | 4.7 | 4.2 | 5.31 | 4.16 | | |
| PLACE1003724 | 3.31 | 10.74 | 9.1 | 9.11 | 11.79 | 10.49 | | |
| PLACE1003737 | 2.14 | 2.21 | 4.72 | 3.35 | 3.1 | 3.29 | | |
| PLACE1003738 | 1.06 | 1.94 | 3.13 | 3.96 | 3.92 | 3.41 | | |
| PLACE1003742 | 2.25 | 3.58 | 5.71 | 6.81 | 6.18 | 2.85 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1003744 | 6.13 | 8.86 | 14.6 | 16.21 | 17.96 | 19.13 | * | + |
| PLACE1003758 | 0.85 | 4.55 | 0.96 | 2 | 1.46 | 1.16 | | |
| PLACE1003760 | 13.44 | 18.68 | 27.23 | 31.82 | 20.52 | 22.79 | | |
| PLACE1003762 | 1.45 | 4.97 | 3.7 | 3.77 | 3.78 | 3.49 | | |
| PLACE1003765 | 1.18 | 5.23 | 3.45 | 2.01 | 3.1 | 2.11 | | |
| PLACE1003768 | 0.36 | 1.14 | 1.36 | 1.45 | 2.75 | 1.07 | | |
| PLACE1003771 | 1.28 | 1.94 | 2.07 | 1.84 | 3.13 | 1.43 | | |
| PLACE1003772 | 34.15 | 38.19 | 97.86 | 62.42 | 64.06 | 52.43 | | |
| PLACE1003783 | 1.48 | 3.02 | 2.22 | 18.65 | 19.53 | 16.61 | ** | + |
| PLACE1003784 | 0.69 | 3.92 | 0.87 | 2.09 | 2.19 | 2.68 | | |
| PLACE1003788 | 0.4 | 4.92 | 1.06 | 1.85 | 1.71 | 0.32 | | |
| PLACE1003795 | 1.01 | 4.1 | 3.57 | 4.73 | 4.38 | 3.54 | | |
| PLACE1003827 | 13.83 | 20.46 | 20.72 | 22.48 | 30.84 | 25.92 | | |
| PLACE1003833 | 0.98 | 1.49 | 3.9 | 3.65 | 4.33 | 3.31 | | |
| PLACE1003839 | 22.55 | 19.18 | 52.95 | 50.39 | 56.11 | 43.86 | | |
| PLACE1003845 | 6.09 | 6.88 | 11.72 | 24.98 | 19.99 | 10.6 | | |
| PLACE1003850 | 3.16 | 4.84 | 7.19 | 5.45 | 5.95 | 6.39 | | |
| PLACE1003852 | 0.25 | 3.36 | 1.09 | 0.99 | 1.58 | 1.05 | | |
| PLACE1003858 | 1.34 | 4.42 | 1.99 | 2.04 | 1.85 | 2.92 | | |
| PLACE1003861 | 0.95 | 4.51 | 1.63 | 2.98 | 2.78 | 1.73 | | |
| PLACE1003864 | 0.94 | 5.5 | 2.74 | 2.88 | 3.86 | 2.69 | | |
| PLACE1003870 | 3.84 | 3.4 | 13.2 | 10.71 | 16.12 | 12.03 | | |
| PLACE1003885 | 1.33 | 1.42 | 1.59 | 3.07 | 3.76 | 2.38 | * | + |
| PLACE1003886 | 4.56 | 6.01 | 5.75 | 9.27 | 6.87 | 4.3 | | |
| PLACE1003888 | 0.75 | 3.79 | 1.96 | 2.87 | 3.42 | 2.68 | | |
| PLACE1003892 | 4.93 | 6.91 | 20.79 | 17.21 | 22.33 | 14.87 | | |
| PLACE1003900 | 2.27 | 5.92 | 7.17 | 6.34 | 9.75 | 6.6 | | |
| PLACE1003902 | 1.91 | 7.39 | 5.25 | 5.43 | 8.07 | 6.29 | | |
| PLACE1003903 | 0.42 | 5.07 | 2.94 | 2.55 | 3.5 | 2.59 | | |
| PLACE1003915 | 8.15 | 7.04 | 10.78 | 8.31 | 9.79 | 9.84 | | |
| PLACE1003918 | 1.88 | 2.45 | 4.75 | 3.47 | 6.26 | 3.75 | | |
| PLACE1003923 | 2.06 | 3.73 | 5.63 | 2.7 | 5.54 | 3.32 | | |
| PLACE1003932 | 3.99 | 5.16 | 5.47 | 4.06 | 7.58 | 5.09 | | |
| PLACE1003936 | 1.02 | 3.82 | 2.81 | 3.63 | 2.42 | 2.78 | | |
| PLACE1003966 | 3.11 | 7.43 | 7.76 | 4.89 | 7.32 | 4.21 | | |
| PLACE1003968 | 1.68 | 5.68 | 5.94 | 3.33 | 4.26 | 4.57 | | |
| PLACE1004018 | 25.49 | 33.73 | 48.16 | 32.56 | 40.53 | 28.62 | | |
| PLACE1004020 | 8.91 | 10.18 | 13.26 | 11.42 | 18.03 | 24.15 | | |
| PLACE1004028 | 0.41 | 2.55 | 1.3 | 1.38 | 1.23 | 1.91 | | |
| PLACE1004034 | 3.56 | 4.53 | 5.22 | 8.42 | 9.03 | 13.04 | * | + |
| PLACE1004042 | 17.25 | 20.19 | 68.35 | 79.51 | 93.32 | 79.44 | * | + |
| PLACE1004078 | 1.14 | 4.1 | 3.3 | 4.95 | 6.51 | 4.45 | | |
| PLACE1004103 | 5.54 | 10.93 | 13.98 | 13.77 | 15.09 | 14.14 | | |
| PLACE1004104 | 5.94 | 12.29 | 27.78 | 24.18 | 34.98 | 29.71 | | |
| PLACE1004113 | 1.37 | 3.7 | 3.28 | 2.75 | 3.27 | 1.29 | | |
| PLACE1004114 | 1.12 | 2.55 | 2.23 | 2.84 | 2.49 | 2.93 | | |
| PLACE1004118 | 1.58 | 3.52 | 2.09 | 2.74 | 3.64 | 2.5 | | |
| PLACE1004128 | 4.4 | 6.84 | 5.66 | 6.61 | 8.13 | 9.01 | | |
| PLACE1004130 | 2.25 | 4.83 | 8.35 | 6.86 | 9.26 | 6.73 | | |
| PLACE1004149 | 3.59 | 7.3 | 9.86 | 10.23 | 13.29 | 10.12 | | |
| PLACE1004156 | 3.61 | 7.91 | 10.12 | 11.66 | 17.62 | 13.31 | | |
| PLACE1004160 | 5.45 | 9.54 | 14.36 | 13.1 | 19.65 | 14.53 | | |
| PLACE1004161 | 2.2 | 4.86 | 3.54 | 4.85 | 5.73 | 7.48 | | |
| PLACE1004166 | 5.61 | 5.81 | 9.91 | 8.3 | 8.66 | 11.2 | | |
| PLACE1004168 | 3.35 | 4.97 | 3.73 | 4.73 | 6.65 | 6.79 | | |
| PLACE1004170 | 0.78 | 3.28 | 1.93 | 2.98 | 3.42 | 2.76 | | |
| PLACE1004178 | 0.83 | 5.23 | 2.37 | 2.4 | 2.59 | 2.36 | | |
| PLACE1004183 | 0.89 | 7.99 | 4.41 | 3.53 | 4.32 | 4.84 | | |
| PLACE1004197 | 0.64 | 5.14 | 1.55 | 1.73 | 3.54 | 1.65 | | |
| PLACE1004199 | 1.66 | 4.52 | 4.09 | 3.78 | 5.88 | 4.35 | | |
| PLACE1004203 | 1.8 | 3.57 | 4.17 | 2.43 | 3.62 | 2.83 | | |
| PLACE1004242 | 3.8 | 5.64 | 11.04 | 8.55 | 8.14 | 8.64 | | |
| PLACE1004249 | 31.4 | 56.31 | 117.88 | 127.93 | 152.54 | 151.22 | * | + |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
|  | exp. 1 | exp. 2 | exp. 3 | exp. 1 | exp. 2 | exp. 3 |  |  |
| PLACE1004255 | 0.79 | 2.65 | 1.26 | 2.59 | 2.15 | 1.93 |  |  |
| PLACE1004256 | 9.06 | 11.68 | 13.63 | 14.66 | 14.18 | 23.37 |  |  |
| PLACE1004257 | 2.63 | 7.95 | 6.48 | 7.89 | 8.8 | 8.64 |  |  |
| PLACE1004258 | 1.87 | 5.21 | 3.13 | 4.59 | 3.15 | 3.11 |  |  |
| PLACE1004270 | 0.72 | 3.8 | 2.5 | 2.7 | 4.01 | 1.65 |  |  |
| PLACE1004272 | 1.34 | 3.68 | 3.73 | 3.86 | 5.38 | 6.15 |  |  |
| PLACE1004273 | 92.91 | 89.59 | 212.62 | 212.05 | 129.56 | 99.82 |  |  |
| PLACE1004274 | 2.09 | 3.61 | 6.51 | 6.42 | 7.14 | 6.74 |  |  |
| PLACE1004277 | 2.3 | 4.4 | 5.76 | 6.45 | 7.7 | 6.04 |  |  |
| PLACE1004279 | 0.54 | 3.39 | 2.23 | 3.16 | 2.64 | 2.02 |  |  |
| PLACE1004282 | 2.43 | 8.25 | 6.62 | 4.22 | 5.56 | 4.49 |  |  |
| PLACE1004284 | 4.59 | 11.31 | 7.84 | 7.38 | 8.16 | 7.15 |  |  |
| PLACE1004289 | 1.28 | 7.85 | 2.46 | 3.06 | 3.63 | 2.1 |  |  |
| PLACE1004299 | 0.33 | 6.41 | 1.38 | 1.54 | 2.67 | 1.83 |  |  |
| PLACE1004302 | 1.01 | 2.98 | 3.27 | 2.41 | 2.45 | 1.12 |  |  |
| PLACE1004305 | 1.11 | 2.09 | 1.9 | 1.9 | 1.82 | 1.78 |  |  |
| PLACE1004316 | 2.3 | 4.48 | 5.4 | 6.06 | 3.85 | 4.52 |  |  |
| PLACE1004322 | 2.49 | 3.41 | 5.25 | 6.35 | 7.14 | 5.75 | * | + |
| PLACE1004325 | 2.43 | 6.38 | 3.84 | 3.85 | 3.66 | 4 |  |  |
| PLACE1004332 | 1.21 | 7.18 | 2.8 | 3.72 | 3.46 | 3.01 |  |  |
| PLACE1004336 | 2.87 | 9.6 | 5.36 | 6.88 | 9.21 | 6.71 |  |  |
| PLACE1004346 | 0.47 | 7.22 | 2.58 | 1.87 | 2.54 | 1.69 |  |  |
| PLACE1004358 | 1.3 | 2.41 | 2.41 | 2.46 | 2.09 | 2.03 |  |  |
| PLACE1004376 | 11.07 | 10.15 | 23.35 | 19.16 | 17.04 | 16.46 |  |  |
| PLACE1004384 | 0.65 | 3.46 | 1.46 | 1.92 | 2.48 | 2.1 |  |  |
| PLACE1004385 | 1.4 | 2.89 | 1.69 | 3.52 | 1.88 | 2.67 |  |  |
| PLACE1004388 | 1.79 | 5.73 | 4.27 | 3.44 | 4.87 | 3.04 |  |  |
| PLACE1004405 | 2.16 | 8.39 | 4.42 | 13.36 | 14.48 | 16.74 | ** | + |
| PLACE1004407 | 5.05 | 13.12 | 13.37 | 11.2 | 16.24 | 11.85 |  |  |
| PLACE1004424 | 0.37 | 5.78 | 0.85 | 1.7 | 1.81 | 1.58 |  |  |
| PLACE1004425 | 1.14 | 1.94 | 3.57 | 3.28 | 3.27 | 3.44 |  |  |
| PLACE1004427 | 1.96 | 3.31 | 4.56 | 4.67 | 4.22 | 3.24 |  |  |
| PLACE1004428 | 0.88 | 2.05 | 2.17 | 2.66 | 2.08 | 2.62 |  |  |
| PLACE1004433 | 5.7 | 8.3 | 10.82 | 12.94 | 15.67 | 12.05 | * | + |
| PLACE1004435 | 0.72 | 4.17 | 1.43 | 1.95 | 1.9 | 2.15 |  |  |
| PLACE1004437 | 4.05 | 7.68 | 14.2 | 11.07 | 13.01 | 12.37 |  |  |
| PLACE1004441 | 7.82 | 11.68 | 34.06 | 30.75 | 43.19 | 26.41 |  |  |
| PLACE1004446 | 1.5 | 4.36 | 0.9 | 1.03 | 1.35 | 1.39 |  |  |
| PLACE1004450 | 0.33 | 1.46 | 1.34 | 2.57 | 1.71 | 0.7 |  |  |
| PLACE1004451 | 0.51 | 1.45 | 2.14 | 1.89 | 2.69 | 0.88 |  |  |
| PLACE1004456 | 8.22 | 9.7 | 10.97 | 16.68 | 10.4 | 4.18 |  |  |
| PLACE1004458 | 3.39 | 4.81 | 3.66 | 7.77 | 7.05 | 8.24 | ** | + |
| PLACE1004460 | 0.84 | 4.58 | 2.1 | 2.91 | 2.69 | 1.75 |  |  |
| PLACE1004467 | 5.31 | 6.81 | 10.65 | 7.67 | 10.1.41 | 0.48 |  |  |
| PLACE1004471 | 2.65 | 5.93 | 6.64 | 6.79 | 7.34 | 6.14 |  |  |
| PLACE1004473 | 1.16 | 4.66 | 3.5 | 3.18 | 3.23 | 3.21 |  |  |
| PLACE1004475 | 14.03 | 16.41 | 32.49 | 31.09 | 32.51 | 18.17 |  |  |
| PLACE1004482 | 8.37 | 6.7 | 10.79 | 10.04 | 9.76 | 9.15 |  |  |
| PLACE1004491 | 0.39 | 2.51 | 1.49 | 1.19 | 2.68 | 1.3 |  |  |
| PLACE1004492 | 61.52 | 74.8 | 127.94 | 129.92 | 127.64 | 123.82 |  |  |
| PLACE1004506 | 10.71 | 14.35 | 14.4 | 8.45 | 11.13 | 10.03 |  |  |
| PLACE1004507 | 2.9 | 7.37 | 5.09 | 7.15 | 6.87 | 6.18 |  |  |
| PLACE1004510 | 2.51 | 6.23 | 6.33 | 6.59 | 7.8 | 8.16 |  |  |
| PLACE1004516 | 0.98 | 7.36 | 2.12 | 2.79 | 3.78 | 2.22 |  |  |
| PLACE1004518 | 1.64 | 1.78 | 3.03 | 2.41 | 3.88 | 2.83 |  |  |
| PLACE1004519 | 0.17 | 0.82 | 0.62 | 1.43 | 2.79 | 1.51 | * | + |
| PLACE1004520 | 6.08 | 8.09 | 10.06 | 7.44 | 9.11 | 2.52 |  |  |
| PLACE1004530 | 33.19 | 43.86 | 68.13 | 41.86 | 27.72 | 38.09 |  |  |
| PLACE1004545 | 1.13 | 3.83 | 2.12 | 3.03 | 3.31 | 3.65 |  |  |
| PLACE1004547 | 5 | 7.61 | 7.82 | 8.66 | 11.2 | 10.28 |  |  |
| PLACE1004548 | 1.69 | 6.73 | 4.43 | 6.93 | 8.48 | 6.5 |  |  |
| PLACE1004550 | 2.27 | 6.24 | 6.67 | 5.92 | 6.78 | 6.15 |  |  |
| PLACE1004551 | 0.8 | 2.16 | 1.62 | 2.14 | 2.21 | 1.95 |  |  |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1004559 | 2.9 | 2.89 | 5.11 | 4.45 | 6.75 | 4.82 | | |
| PLACE1004562 | 8.67 | 11.27 | 16.07 | 13.01 | 14.38 | 13.34 | | |
| PLACE1004564 | 1.84 | 5.19 | 4.36 | 4.64 | 5.98 | 4.49 | | |
| PLACE1004604 | 1.69 | 4.21 | 9.88 | 2.49 | 4.34 | 1.97 | | |
| PLACE1004611 | 2.73 | 5.87 | 4.89 | 3.86 | 4.17 | 3.99 | | |
| PLACE1004629 | 9.42 | 15.75 | 19.92 | 23.93 | 30.49 | 29.01 | * | + |
| PLACE1004630 | 16.66 | 20.82 | 35.1 | 16.76 | 23.04 | 19.17 | | |
| PLACE1004637 | 5.03 | 8.82 | 10.34 | 6.61 | 9.17 | 8.29 | | |
| PLACE1004645 | 36.5 | 39.28 | 92.04 | 85.16 | 87.94 | 74.59 | | |
| PLACE1004646 | 1.07 | 2.91 | 2.87 | 3.68 | 2.19 | 2.28 | | |
| PLACE1004648 | 0.8 | 3.42 | 2.52 | 2.53 | 3.15 | 1.22 | | |
| PLACE1004655 | 45.95 | 58.09 | 130.94 | 112.14 | 126.25 | 99.01 | | |
| PLACE1004658 | 2.4 | 7.34 | 6.31 | 6.64 | 8.37 | 6 | | |
| PLACE1004664 | 1.26 | 4.83 | 1.3 | 3.02 | 2.65 | 1.89 | | |
| PLACE1004672 | 2.32 | 6.79 | 8.02 | 6.3 | 7.51 | 7.14 | | |
| PLACE1004674 | 9.4 | 11.97 | 14.7 | 8.3 | 9.75 | 15.25 | | |
| PLACE1004681 | 1.97 | 3.84 | 5.62 | 5.05 | 5.69 | 4.39 | | |
| PLACE1004686 | 2.74 | 4.33 | 7.46 | 9.22 | 10.77 | 8.59 | * | + |
| PLACE1004690 | 10.64 | 13.43 | 19.62 | 21.75 | 19.21 | 31.72 | | |
| PLACE1004691 | 1.14 | 6.71 | 3.71 | 2.92 | 4.13 | 2.75 | | |
| PLACE1004693 | 1.34 | 7.54 | 4.89 | 3.91 | 4.59 | 5.97 | | |
| PLACE1004701 | 13.01 | 18.45 | 24.24 | 25.21 | 24.46 | 25.1 | | |
| PLACE1004705 | 1.29 | 3.33 | 2.27 | 1.8 | 1.96 | 1.47 | | |
| PLACE1004708 | 37.69 | 46.37 | 80.19 | 41.34 | 39.66 | 50.98 | | |
| PLACE1004716 | 6.37 | 8.81 | 11.08 | 4.22 | 12.55 | 14.26 | | |
| PLACE1004722 | 1.31 | 3.05 | 2.6 | 2.26 | 3.28 | 2.51 | | |
| PLACE1004736 | 5.25 | 7.71 | 7.6 | 9.16 | 8.89 | 11.63 | | |
| PLACE1004737 | 5.42 | 12.71 | 16.14 | 8.15 | 11.23 | 13.78 | | |
| PLACE1004740 | 4.88 | 9.06 | 8.22 | 7.37 | 7.93 | 8.2 | | |
| PLACE1004743 | 1.31 | 4.04 | 3.1 | 1.97 | 4 | 3.55 | | |
| PLACE1004751 | 0.98 | 2.89 | 2.88 | 2.75 | 3.74 | 3.06 | | |
| PLACE1004757 | 3.45 | 4.34 | 10.53 | 8.4 | 9.6 | 7.22 | | |
| PLACE1004761 | 6.41 | 7.32 | 12.59 | 9.99 | 10.44 | 9.72 | | |
| PLACE1004773 | 1.05 | 2.34 | 1.7 | 1.94 | 2.31 | 2.72 | | |
| PLACE1004775 | 0.35 | 3.26 | 1.37 | 1.29 | 2.14 | 1.07 | | |
| PLACE1004777 | 2.1 | 7.57 | 2.97 | 3.68 | 4.25 | 4.4 | | |
| PLACE1004793 | 0.83 | 4.58 | 1.37 | 1.9 | 2.06 | 1.25 | | |
| PLACE1004796 | 6.65 | 8.7 | 13.08 | 7.79 | 8.57 | 7.88 | | |
| PLACE1004804 | 0.99 | 4.46 | 3.25 | 2.44 | 2.38 | 3.22 | | |
| PLACE1004813 | 4.55 | 7.11 | 9.84 | 6.45 | 5.19 | 5.45 | | |
| PLACE1004814 | 7.16 | 11.76 | 17.62 | 15.83 | 11.39 | 10.1 | | |
| PLACE1004815 | 0.7 | 2.81 | 2.43 | 3.12 | 2.61 | 3.44 | | |
| PLACE1004816 | 1.16 | 2.63 | 2.04 | 2.36 | 2.26 | 1.84 | | |
| PLACE1004824 | 3.25 | 7.37 | 5.27 | 8.1 | 9.13 | 8.85 | | |
| PLACE1004827 | 1.4 | 10.89 | 3.17 | 2.57 | 3.05 | 1.3 | | |
| PLACE1004836 | 1.72 | 12.95 | 4.26 | 6.25 | 7.99 | 4.49 | | |
| PLACE1004838 | 1.35 | 8.81 | 2.2 | 2.49 | 2.34 | 1.68 | | |
| PLACE1004840 | 1.59 | 2.06 | 2.21 | 1.85 | 2.08 | 1.37 | | |
| PLACE1004842 | 0.86 | 1.98 | 1.89 | 1.98 | 1.78 | 2.33 | | |
| PLACE1004850 | 0.81 | 2.35 | 1.63 | 1.83 | 2.76 | 2.36 | | |
| PLACE1004868 | 0.81 | 2.97 | 2.04 | 1.62 | 2.23 | 2 | | |
| PLACE1004885 | 1.5 | 7.09 | 3.51 | 3.4 | 6.03 | 4.77 | | |
| PLACE1004886 | 1.87 | 8.53 | 2.76 | 3.33 | 5.12 | 4.93 | | |
| PLACE1004887 | 18.14 | 34.01 | 58.51 | 36.9 | 38.66 | 30.33 | | |
| PLACE1004896 | 8.39 | 14.15 | 15.4 | 9.39 | 11.14 | 14.03 | | |
| PLACE1004900 | 1.75 | 2.7 | 6.69 | 5.66 | 5.74 | 4.44 | | |
| PLACE1004902 | 5.42 | 6.25 | 9.27 | 6.39 | 4.2 | 3.6 | | |
| PLACE1004904 | 1.7 | 4.66 | 2.52 | 6.49 | 4.78 | 3.03 | | |
| PLACE1004911 | 0.69 | 2.5 | 1.12 | 5.95 | 4.82 | 6.09 | ** | + |
| PLACE1004913 | 3.63 | 5.72 | 7.38 | 4.49 | 5.45 | 4.79 | | |
| PLACE1004918 | 1.3 | 6.69 | 2.05 | 2.39 | 3.24 | 2.64 | | |
| PLACE1004930 | 2.74 | 8.84 | 5.93 | 10.63 | 16.57 | 14.71 | * | + |
| PLACE1004934 | 1.14 | 4.3 | 3.34 | 2.97 | 2.03 | 2.5 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
|  | exp. 1 | exp. 2 | exp. 3 | exp. 1 | exp. 2 | exp. 3 |  |  |
| PLACE1004937 | 2.1 | 4.03 | 4.91 | 2.74 | 3.59 | 2.36 |  |  |
| PLACE1004949 | 4.32 | 4.98 | 7.67 | 8.53 | 8.48 | 6.04 |  |  |
| PLACE1004969 | 0.74 | 1.74 | 1.99 | 1.39 | 2.34 | 1.4 |  |  |
| PLACE1004970 | 0.45 | 2.18 | 1.2 | 1.43 | 1.31 | 1.01 |  |  |
| PLACE1004972 | 1.63 | 6.56 | 2.69 | 5.66 | 3.17 | 4.76 |  |  |
| PLACE1004974 | 1.27 | 5.21 | 4.2 | 5.6 | 5.7 | 5.62 |  |  |
| PLACE1004975 | 0.59 | 2.84 | 1.11 | 1.94 | 1.98 | 1.24 |  |  |
| PLACE1004979 | 1.58 | 4.06 | 4.26 | 4.91 | 5.69 | 4.75 |  |  |
| PLACE1004982 | 5.66 | 6.45 | 9.74 | 10.03 | 10.67 | 5.65 |  |  |
| PLACE1004985 | 1.4 | 1.47 | 1.46 | 2.5 | 2.17 | 1.2 |  |  |
| PLACE1005003 | 2.85 | 4.22 | 6 | 6.05 | 6.37 | 5.78 |  |  |
| PLACE1005004 | 0.47 | 3.36 | 0.92 | 1.5 | 0.73 | 0.85 |  |  |
| PLACE1005005 | 3.35 | 6.9 | 5.32 | 6.67 | 9.65 | 7.17 |  |  |
| PLACE1005011 | 6.03 | 11.12 | 35.8 | 37.66 | 56.97 | 36.62 |  |  |
| PLACE1005026 | 0.79 | 4.18 | 2.29 | 2.44 | 2.49 | 2.16 |  |  |
| PLACE1005027 | 2.46 | 6.72 | 6.69 | 5.36 | 6.92 | 5.68 |  |  |
| PLACE1005031 | 1.21 | 1.47 | 3.69 | 5.72 | 7.1 | 4.6 | * | + |
| PLACE1005036 | 2.27 | 3.6 | 6.83 | 9.08 | 8.91 | 7.53 | * | + |
| PLACE1005041 | 2.5 | 2.84 | 2.84 | 5.05 | 4.41 | 3.25 | * | + |
| PLACE1005046 | 2.23 | 4.11 | 4.56 | 6.04 | 3.92 | 4.33 |  |  |
| PLACE1005047 | 0.23 | 3.19 | 2.6 | 1.43 | 1.23 | 2.1 |  |  |
| PLACE1005052 | 4.24 | 8.53 | 6.36 | 8.08 | 8.15 | 8.1 |  |  |
| PLACE1005055 | 2.54 | 7.45 | 4.66 | 7.2 | 6.45 | 5.62 |  |  |
| PLACE1005066 | 4.33 | 8.26 | 7.58 | 12.9 | 14.14 | 16.49 | ** | + |
| PLACE1005077 | 1.17 | 0.68 | 1.2 | 2.1 | 2.43 | 1.54 | * | + |
| PLACE1005085 | 1.41 | 1.97 | 3.06 | 3.34 | 4.14 | 3.45 |  |  |
| PLACE1005086 | 1.93 | 3.77 | 5.17 | 5.62 | 7.78 | 4.79 |  |  |
| PLACE1005088 | 24.66 | 32.47 | 46.03 | 43.45 | 31.47 | 27.46 |  |  |
| PLACE1005089 | 1.57 | 4.78 | 3.15 | 2.52 | 3.67 | 3.14 |  |  |
| PLACE1005101 | 3.37 | 8.11 | 5.46 | 6.11 | 8.96 | 6.39 |  |  |
| PLACE1005102 | 2.56 | 7.14 | 5.01 | 4.11 | 5.51 | 3.8 |  |  |
| PLACE1005108 | 2 | 6.08 | 5.87 | 6.58 | 6.19 | 5.09 |  |  |
| PLACE1005110 | 1.34 | 1.89 | 3.08 | 1.75 | 2.75 | 2.15 |  |  |
| PLACE1005111 | 1.31 | 1.34 | 1.23 | 1.45 | 2.17 | 1.54 |  |  |
| PLACE1005123 | 26.23 | 26.21 | 47.58 | 34.26 | 49.34 | 34.98 |  |  |
| PLACE1005124 | 3.2 | 4.66 | 4.18 | 4.2 | 6.91 | 5.44 |  |  |
| PLACE1005128 | 9.54 | 8.89 | 18.22 | 16.37 | 16.36 | 16.13 |  |  |
| PLACE1005130 | 2.65 | 6.57 | 5.54 | 2.84 | 4.98 | 3.58 |  |  |
| PLACE1005141 | 6.3 | 9.92 | 11.25 | 16.15 | 20.75 | 18.95 | ** | + |
| PLACE1005146 | 1.3 | 2.71 | 3.03 | 2.17 | 2.53 | 2.29 |  |  |
| PLACE1005152 | 1.85 | 3.9 | 4.56 | 4.13 | 4.23 | 4.79 |  |  |
| PLACE1005157 | 2.66 | 5.19 | 5.3 | 4.38 | 4.09 | 7.01 |  |  |
| PLACE1005162 | 2.79 | 3.72 | 9.31 | 6.57 | 7.45 | 7.1 |  |  |
| PLACE1005170 | 17.34 | 18.92 | 29.76 | 21.38 | 18.18 | 23.73 |  |  |
| PLACE1005176 | 0.57 | 5.6 | 1.7 | 2.33 | 2.47 | 1.94 |  |  |
| PLACE1005181 | 0.53 | 5.14 | 0.96 | 0.89 | 1.36 | 0.37 |  |  |
| PLACE1005184 | 4.06 | 9.09 | 10.4 | 8.97 | 12.82 | 11.26 |  |  |
| PLACE1005186 | 3.5 | 3.41 | 8.56 | 8.05 | 5.79 | 5.73 |  |  |
| PLACE1005187 | 2.85 | 4 | 4.13 | 6.1 | 4.99 | 4.25 |  |  |
| PLACE1005189 | 6.12 | 7.71 | 5.34 | 10.84 | 10.65 | 12.22 | ** | + |
| PLACE1005193 | 1.48 | 3.78 | 1.71 | 3.84 | 2.91 | 2.61 |  |  |
| PLACE1005200 | 1.35 | 4.68 | 2.61 | 2.47 | 3.75 | 3.1 |  |  |
| PLACE1005206 | 2.43 | 6.48 | 4.26 | 3.35 | 3.95 | 2.95 |  |  |
| PLACE1005216 | 1.53 | 5.46 | 4.44 | 5.6 | 6.51 | 4.12 |  |  |
| PLACE1005223 | 1.43 | 6.21 | 5 | 4.38 | 5.66 | 3.27 |  |  |
| PLACE1005225 | 1.36 | 3.01 | 3.49 | 3.33 | 3.32 | 4.65 |  |  |
| PLACE1005232 | 1.86 | 3.31 | 4.87 | 5.63 | 6.19 | 3.88 |  |  |
| PLACE1005239 | 1.06 | 4.3 | 2.32 | 2.84 | 2.86 | 2.41 |  |  |
| PLACE1005243 | 4.35 | 7.32 | 5.41 | 8.48 | 7.49 | 10.75 |  |  |
| PLACE1005250 | 4.24 | 10.31 | 7.98 | 4.38 | 5.9 | 8.88 |  |  |
| PLACE1005261 | 3.21 | 7.43 | 4.74 | 4.78 | 5.82 | 3.51 |  |  |
| PLACE1005266 | 1.05 | 4.47 | 2.82 | 2.28 | 4.43 | 2.76 |  |  |
| PLACE1005271 | 4.66 | 5.31 | 8.79 | 5.87 | 11.16 | 7.95 |  |  |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1005277 | 2.06 | 3.48 | 2.35 | 2.62 | 1.98 | 2.64 | | |
| PLACE1005287 | 3.63 | 4.31 | 5.87 | 2.98 | 5.06 | 6.91 | | |
| PLACE1005299 | 24.16 | 22.75 | 48.29 | 35.17 | 24.24 | 41.06 | | |
| PLACE1005305 | 6.81 | 8.46 | 11.13 | 10.67 | 11.85 | 16.25 | | |
| PLACE1005307 | 1.59 | 5.44 | 4.14 | 3.15 | 5.42 | 4.84 | | |
| PLACE1005308 | 2.41 | 4.96 | 3.95 | 5.32 | 5.99 | 5.79 | | |
| PLACE1005313 | 1.08 | 3.83 | 1.6 | 1.8 | 2.05 | 1.8 | | |
| PLACE1005320 | 1.36 | 3.65 | 3.34 | 3.39 | 4.05 | 2.26 | | |
| PLACE1005327 | 10.78 | 8.74 | 16.8 | 10.36 | 7.95 | 4.43 | | |
| PLACE1005331 | 2.28 | 4.92 | 5.28 | 4.66 | 4.97 | 3.33 | | |
| PLACE1005335 | 1.53 | 3.8 | 2.24 | 2.03 | 3.22 | 2.42 | | |
| PLACE1005336 | 9.12 | 12.58 | 16.58 | 16.39 | 16.99 | 20.15 | | |
| PLACE1005351 | 2.62 | 8.18 | 10.17 | 9.28 | 8.66 | 9.52 | | |
| PLACE1005366 | 2.04 | 6.93 | 3 | 2.99 | 3.71 | 4.23 | | |
| PLACE1005373 | 1.77 | 6.34 | 4.44 | 3.91 | 5.36 | 3.37 | | |
| PLACE1005374 | 3.29 | 9.47 | 11.4 | 7.35 | 10.22 | 12.41 | | |
| PLACE1005383 | 8.16 | 7.54 | 12.81 | 7.21 | 5.93 | 4.03 | | |
| PLACE1005388 | 0.33 | 2.04 | 1.56 | 1.92 | 3.67 | 2.2 | | |
| PLACE1005409 | 2.97 | 5.02 | 4.99 | 3.9 | 4.23 | 2.97 | | |
| PLACE1005410 | 12.41 | 16.44 | 18.89 | 24.38 | 20.98 | 27.1 | * | + |
| PLACE1005426 | 5.16 | 7.48 | 9.06 | 5.51 | 7.67 | 5.45 | | |
| PLACE1005431 | 12.6 | 15.65 | 22.53 | 19.64 | 26.25 | 23.75 | | |
| PLACE1005453 | 1.4 | 10.38 | 3.93 | 4.85 | 4.45 | 3.28 | | |
| PLACE1005467 | 3.09 | 11.87 | 7 | 5.57 | 11.63 | 7.28 | | |
| PLACE1005471 | 1.6 | 1.94 | 1.66 | 2.29 | 1.52 | 1.28 | | |
| PLACE1005476 | 0.42 | 1.73 | 1.24 | 1.6 | 1.57 | 1.46 | | |
| PLACE1005477 | 1.58 | 2.26 | 2.51 | 3 | 2.93 | 2.74 | | |
| PLACE1005480 | 0.77 | 2.01 | 1.86 | 1.93 | 1.4 | 0.53 | | |
| PLACE1005481 | 0.44 | 4.81 | 2.3 | 2.77 | 3.62 | 2.44 | | |
| PLACE1005494 | 0.27 | 6.66 | 1.68 | 1.21 | 1.73 | 1.06 | | |
| PLACE1005495 | 3.86 | 12.83 | 8.31 | 6.85 | 9.25 | 7.62 | | |
| PLACE1005497 | 2.27 | 7.72 | 3.95 | 4.24 | 5.68 | 5.91 | | |
| PLACE1005499 | 5.71 | 5.86 | 11.07 | 10.82 | 7.9 | 6.49 | | |
| PLACE1005502 | 1.59 | 2.87 | 3.43 | 4.07 | 3.45 | 1.49 | | |
| PLACE1005513 | 1.77 | 4.14 | 3.35 | 1.86 | 2.85 | 1.98 | | |
| PLACE1005515 | 2.89 | 4.76 | 4.22 | 4.58 | 5.29 | 3.78 | | |
| PLACE1005519 | 1.04 | 4.53 | 3.29 | 2.85 | 2.85 | 2.83 | | |
| PLACE1005526 | 0.58 | 5.55 | 1.38 | 1.3 | 1.59 | 0.71 | | |
| PLACE1005528 | 2.08 | 7.71 | 5.57 | 5.94 | 7.12 | 5.33 | | |
| PLACE1005530 | 2.16 | 7.09 | 4.32 | 5.17 | 8.23 | 4.67 | | |
| PLACE1005536 | 1.74 | 1 | 2.74 | 3.12 | 2.43 | 2.88 | | |
| PLACE1005539 | 10.1 | 11.64 | 23.77 | 8.65 | 8.66 | 5.22 | | |
| PLACE1005543 | 1.7 | 3.57 | 5.62 | 3.54 | 4.32 | 2.57 | | |
| PLACE1005544 | 0.86 | 3.26 | 3.15 | 2.49 | 2.68 | 2.27 | | |
| PLACE1005550 | 4.32 | 7.61 | 7.85 | 10.16 | 7.25 | 6.86 | | |
| PLACE1005554 | 1.15 | 5.47 | 2.67 | 2.17 | 2.17 | 1.17 | | |
| PLACE1005557 | 1.76 | 7.21 | 4.95 | 8.22 | 7.64 | 7.7 | | |
| PLACE1005563 | 0.51 | 4 | 1.89 | 1.45 | 2.07 | 1.06 | | |
| PLACE1005569 | 0.6 | 0.5 | 1.56 | 1.59 | 1.81 | 1.09 | | |
| PLACE1005574 | 1.07 | 1.88 | 2.49 | 2.48 | 4.43 | 2.22 | | |
| PLACE1005584 | 1.3 | 2.68 | 3.91 | 3.91 | 5.58 | 3.03 | | |
| PLACE1005590 | 4.28 | 5.14 | 8.4 | 9.87 | 10.73 | 8.02 | | |
| PLACE1005595 | 3.08 | 4.03 | 2.89 | 3.65 | 3.81 | 3.89 | | |
| PLACE1005601 | 2 | 5.66 | 4.22 | 3.77 | 4 | 4.02 | | |
| PLACE1005603 | 1.08 | 4.9 | 1.04 | 2.49 | 0.95 | 1.94 | | |
| PLACE1005604 | 1.2 | 6.71 | 2.42 | 3.6 | 4.2 | 3.46 | | |
| PLACE1005611 | 2.22 | 2.3 | 3.98 | 5.15 | 5.65 | 2.89 | | |
| PLACE1005622 | 0.65 | 1.71 | 1.98 | 2.94 | 3.88 | 1.26 | | |
| PLACE1005623 | 1.42 | 3.08 | 3.27 | 3.71 | 3.65 | 1.61 | | |
| PLACE1005630 | 3.31 | 5.81 | 7.75 | 87.83 | 72.15 | 89.12 | ** | + |
| PLACE1005639 | 0.75 | 4.36 | 1.28 | 1.66 | 2.02 | 1.18 | | |
| PLACE1005646 | 2.13 | 5.41 | 4.31 | 5.4 | 5.08 | 2.55 | | |
| PLACE1005647 | 2.77 | 9.69 | 6.72 | 7.34 | 9.11 | 6.25 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1005648 | 3 | 8.11 | 9.21 | 8.34 | 10.59 | 8.22 | | |
| PLACE1005653 | 1.99 | 1.43 | 2.74 | 2.74 | 2.13 | 2.67 | | |
| PLACE1005656 | 0.92 | 2.48 | 2.24 | 1.68 | 2.78 | 1.58 | | |
| PLACE1005659 | 0.87 | 2.64 | 1.01 | 1.62 | 1.84 | 1.32 | | |
| PLACE1005660 | 3.91 | 8.03 | 5.77 | 8.87 | 8.88 | 8.34 | | |
| PLACE1005664 | 2.69 | 6.57 | 6.14 | 3.39 | 4.27 | 3.19 | | |
| PLACE1005666 | 0.89 | 5.91 | 3.55 | 4.63 | 4.93 | 3.97 | | |
| PLACE1005669 | 4.46 | 10.41 | 11.39 | 11.64 | 13.9 | 14.6 | | |
| PLACE1005682 | 1.94 | 5.27 | 4.49 | 6.2 | 5.2 | 5.47 | | |
| PLACE1005698 | 0.6 | 2.7 | 2.92 | 2.01 | 2.67 | 2.38 | | |
| PLACE1005708 | 25.32 | 34.08 | 53.46 | 53.89 | 59.98 | 53.76 | | |
| PLACE1005725 | 3.25 | 3.75 | 6.41 | 5.64 | 5.82 | 7.29 | | |
| PLACE1005727 | 2.97 | 4.54 | 4.15 | 3.9 | 3.49 | 4 | | |
| PLACE1005730 | 0.77 | 4.29 | 3.26 | 1.1 | 1.54 | 1.28 | | |
| PLACE1005736 | 5.37 | 7.55 | 5.73 | 9.25 | 12.55 | 10.19 | * | + |
| PLACE1005739 | 0.81 | 4.96 | 1.38 | 2.46 | 3.17 | 1.74 | | |
| PLACE1005745 | 8.03 | 7.11 | 11.52 | 11.98 | 6.97 | 11.44 | | |
| PLACE1005752 | 1.31 | 3.15 | 2.96 | 2.55 | 2.24 | 1.25 | | |
| PLACE1005755 | 0.8 | 2.79 | 3.02 | 1.72 | 3.28 | 2.27 | | |
| PLACE1005756 | 10.79 | 12.06 | 17.2 | 18.22 | 19.3 | 21.47 | * | + |
| PLACE1005760 | 10.22 | 15.24 | 68.06 | 49.69 | 68.81 | 53.09 | | |
| PLACE1005763 | 1.47 | 7.04 | 3.58 | 3.79 | 4.63 | 3.02 | | |
| PLACE1005768 | 1.25 | 5.63 | 3.69 | 4.58 | 5.13 | 4.19 | | |
| PLACE1005771 | 5.71 | 13.63 | 13.7 | 11.28 | 17.49 | 17.27 | | |
| PLACE1005783 | 1.82 | 2.44 | 3.64 | 3.05 | 3.71 | 3.47 | | |
| PLACE1005799 | 4.79 | 5.25 | 8.37 | 6.12 | 8.78 | 8.62 | | |
| PLACE1005802 | 1.07 | 3.78 | 3.64 | 2.7 | 3.64 | 1.96 | | |
| PLACE1005803 | 3.06 | 6.15 | 4.78 | 5.6 | 4.94 | 7.36 | | |
| PLACE1005804 | 0.92 | 8.41 | 1.33 | 2 | 1.91 | 2.44 | | |
| PLACE1005813 | 17.23 | 18.71 | 78.06 | 70.01 | 94.17 | 74.89 | | |
| PLACE1005815 | 1.43 | 5.6 | 4.38 | 3.8 | 5.01 | 4.1 | | |
| PLACE1005828 | 2.11 | 3.62 | 4.42 | 5.34 | 6.24 | 3.56 | | |
| PLACE1005833 | 119.17 | 92.82 | 182.22 | 122 | 114.37 | 107.96 | | |
| PLACE1005834 | 2.04 | 4.33 | 3.95 | 3.55 | 3.56 | 2.56 | | |
| PLACE1005835 | 22.7 | 19.1 | 51.52 | 72.32 | 60.34 | 68.56 | * | + |
| PLACE1005836 | 2.39 | 4.21 | 4.97 | 2.61 | 3.83 | 2.55 | | |
| PLACE1005845 | 0.97 | 5.42 | 2.66 | 2.67 | 3.05 | 3.65 | | |
| PLACE1005850 | 1.82 | 3.91 | 3.04 | 2.84 | 2.85 | 2.15 | | |
| PLACE1005851 | 1.03 | 3.44 | 1.46 | 1.2 | 2.01 | 1.11 | | |
| PLACE1005856 | 0.92 | 4.01 | 2.42 | 2.24 | 3.37 | 3.37 | | |
| PLACE1005875 | 1.78 | 3.89 | 4.77 | 3.3 | 3.48 | 3.17 | | |
| PLACE1005876 | 1.33 | 3.99 | 4.76 | 6.87 | 6.34 | 6.9 | * | + |
| PLACE1005878 | 1.3 | 2.67 | 2.08 | 3.54 | 4.46 | 2.79 | | |
| PLACE1005880 | 2.36 | 4.09 | 4.31 | 4.16 | 3.07 | 3.45 | | |
| PLACE1005884 | 1.6 | 4.87 | 1.89 | 2.48 | 2.21 | 2.73 | | |
| PLACE1005890 | 1.9 | 9.57 | 3.7 | 2.26 | 3.09 | 1.88 | | |
| PLACE1005898 | 3.29 | 10.87 | 5.34 | 7.36 | 8.12 | 6.36 | | |
| PLACE1005913 | 1.46 | 9.31 | 8.05 | 4.99 | 6.47 | 4.33 | | |
| PLACE1005921 | 0.99 | 1.92 | 2.03 | 1.49 | 2.22 | 0.79 | | |
| PLACE1005923 | 0.74 | 1.61 | 1.17 | 1.47 | 2.42 | 1.43 | | |
| PLACE1005925 | 0.83 | 2.67 | 3.18 | 2.19 | 2.14 | 1.68 | | |
| PLACE1005927 | 1.26 | 2.49 | 1.93 | 1.95 | 2.56 | 2.3 | | |
| PLACE1005932 | 2.04 | 5.66 | 2.44 | 2.53 | 2.32 | 2.52 | | |
| PLACE1005934 | 0.88 | 7.91 | 3.16 | 3.9 | 5.61 | 4.19 | | |
| PLACE1005936 | 1.31 | 8.96 | 3.02 | 2.02 | 2.84 | 2.3 | | |
| PLACE1005939 | 54.61 | 68.58 | 111.22 | 157.61 | 194.58 | 212.18 | ** | + |
| PLACE1005951 | 2.36 | 3.39 | 4.98 | 5.56 | 4.48 | 2.35 | | |
| PLACE1005953 | 1.5 | 1.64 | 2.64 | 2.59 | 2.43 | 3.03 | | |
| PLACE1005955 | 1.64 | 2.01 | 3.8 | 4.07 | 3.43 | 2.55 | | |
| PLACE1005966 | 0.76 | 3.42 | 1.69 | 1.75 | 2 | 2.19 | | |
| PLACE1005968 | 1.52 | 4.96 | 3.2 | 4.71 | 5.15 | 6.12 | | |
| PLACE1005975 | 2.58 | 7.11 | 5.42 | 6.18 | 7.01 | 6.49 | | |
| PLACE1005990 | 0.7 | 7.7 | 1.54 | 2.1 | 1.87 | 0.88 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1005997 | 88.15 | 118.52 | 196.48 | 189.6 | 226.97 | 172.1 | | |
| PLACE1006002 | 3.38 | 3.97 | 8.87 | 8.4 | 7.71 | 9.18 | | |
| PLACE1006003 | 1.55 | 3.02 | 4.83 | 5.09 | 4.44 | 5.33 | | |
| PLACE1006011 | 1.85 | 3.63 | 3.46 | 4.48 | 2.68 | 1.91 | | |
| PLACE1006017 | 0.84 | 2.74 | 2.81 | 3.4 | 3.4 | 3.58 | | |
| PLACE1006037 | 2.99 | 7.05 | 2.48 | 6.14 | 3.64 | 4.29 | | |
| PLACE1006040 | 2.2 | 7.87 | 3.97 | 6.64 | 6.9 | 7.77 | | |
| PLACE1006063 | 0.94 | 4.64 | 2.59 | 2.11 | 3.15 | 2.25 | | |
| PLACE1006071 | 3.06 | 6.52 | 4.97 | 5.36 | 4.03 | 4.47 | | |
| PLACE1006073 | 2.74 | 3.53 | 6.43 | 7.19 | 6.81 | 6.93 | | |
| PLACE1006074 | 1.4 | 2.22 | 3.34 | 2.62 | 3.23 | 1.69 | | |
| PLACE1006076 | 1.36 | 2.51 | 2.98 | 3.15 | 2.47 | 2.75 | | |
| PLACE1006079 | 1.38 | 4.32 | 1.78 | 2.1 | 1.1 | 1.11 | | |
| PLACE1006093 | 0.49 | 3.76 | 1 | 3.56 | 3.85 | 1.83 | | |
| PLACE1006116 | 2.99 | 6.44 | 4.04 | 5.28 | 5.01 | 4.91 | | |
| PLACE1006119 | 3.15 | 6.81 | 7.07 | 9.22 | 10.4 | 8.03 | | |
| PLACE1006129 | 2.12 | 5.6 | 3.98 | 6.59 | 7.62 | 5.65 | | |
| PLACE1006139 | 3.44 | 2.98 | 6.03 | 7.77 | 8.85 | 5.58 | | |
| PLACE1006143 | 0.5 | 1.48 | 1.87 | 3.18 | 4.13 | 3.17 | * | + |
| PLACE1006157 | 1.55 | 2.54 | 4.82 | 2.96 | 3.9 | 2.44 | | |
| PLACE1006159 | 0.69 | 3.61 | 0.94 | 2.68 | 1.98 | 1.04 | | |
| PLACE1006164 | 0.35 | 3.18 | 1.37 | 1.73 | 1.85 | 1.21 | | |
| PLACE1006167 | 2.18 | 6.5 | 3.37 | 3.95 | 4.52 | 3.13 | | |
| PLACE1006170 | 2.79 | 6.09 | 6.09 | 4.34 | 5.31 | 3.68 | | |
| PLACE1006181 | 2.75 | 7.34 | 2.84 | 5.8 | 5.51 | 5.22 | | |
| PLACE1006187 | 0.76 | 1.3 | 2.15 | 2.01 | 2.41 | 1.48 | | |
| PLACE1006195 | 0.11 | 1.24 | 1.73 | 1.93 | 1.93 | 0.87 | | |
| PLACE1006196 | 1.8 | 4.01 | 4.15 | 4.32 | 5.77 | 2.19 | | |
| PLACE1006197 | 2.12 | 5.6 | 5.24 | 4 | 3.47 | 3.39 | | |
| PLACE1006198 | 0.27 | 3.68 | 1.21 | 0.84 | 1.63 | 0.5 | | |
| PLACE1006205 | 0.89 | 5.59 | 0.99 | 2.43 | 2.18 | 1.28 | | |
| PLACE1006208 | 7.28 | 13.32 | 13.46 | 14.09 | 14.99 | 12.5 | | |
| PLACE1006211 | 2.6 | 8.05 | 7.92 | 6.07 | 9.08 | 9.35 | | |
| PLACE1006219 | 6.77 | 5.77 | 8.94 | 14.88 | 22.25 | 15.35 | * | + |
| PLACE1006223 | 1.55 | 1.46 | 3.19 | 1.39 | 3 | 1.64 | | |
| PLACE1006225 | 0.56 | 2.27 | 1.3 | 1.04 | 2.3 | 0.99 | | |
| PLACE1006236 | 1.53 | 3.2 | 2.92 | 3.06 | 5.01 | 2.29 | | |
| PLACE1006239 | 0.67 | 3.62 | 1.97 | 2.61 | 3.66 | 3.41 | | |
| PLACE1006245 | 3.86 | 7.13 | 5.45 | 4.43 | 7.44 | 3.28 | | |
| PLACE1006246 | 1.66 | 6.56 | 6.19 | 5.59 | 7.66 | 6.33 | | |
| PLACE1006248 | 1.58 | 4.47 | 5.6 | 2.77 | 3.1 | 2.82 | | |
| PLACE1006262 | 0.93 | 2.24 | 1.49 | 2.08 | 1.61 | 1.4 | | |
| PLACE1006269 | 2.28 | 4.71 | 3.42 | 2.06 | 2.47 | 2.33 | | |
| PLACE1006275 | 1.6 | 3.57 | 3.37 | 4.12 | 3.68 | 3.53 | | |
| PLACE1006277 | 1.01 | 2.42 | 1.4 | 1.79 | 3.01 | 0.88 | | |
| PLACE1006288 | 9.32 | 13.59 | 22.49 | 26.85 | 18.4 | 25.21 | | |
| PLACE1006290 | 1.79 | 6.81 | 5.99 | 8.87 | 7.56 | 9.13 | | |
| PLACE1006298 | 1.93 | 5.52 | 2.47 | 3.87 | 5.08 | 4.55 | | |
| PLACE1006311 | 0.65 | 3.38 | 1.75 | 225.97 | 161.43 | 251.12 | ** | + |
| PLACE1006318 | 3.52 | 4.03 | 4.17 | 4.04 | 3.17 | 4.01 | | |
| PLACE1006325 | 5.43 | 6.73 | 6.31 | 8.09 | 8.38 | 8.08 | ** | + |
| PLACE1006331 | 1.87 | 3.36 | 3.21 | 4.44 | 3.59 | 2.56 | | |
| PLACE1006335 | 1.76 | 3.64 | 2.55 | 4.45 | 2.98 | 2.92 | | |
| PLACE1006357 | 0.27 | 4.51 | 1.59 | 1.7 | 1.49 | 1.2 | | |
| PLACE1006360 | 1.1 | 5.11 | 1.79 | 2.46 | 2.74 | 2.62 | | |
| PLACE1006364 | 4.51 | 8.06 | 7.29 | 7.37 | 9.19 | 5.75 | | |
| PLACE1006365 | 1.68 | 4.65 | 1.97 | 1.8 | 2.12 | 0.97 | | |
| PLACE1006368 | 1.53 | 3.11 | 2.57 | 3.01 | 3.04 | 4.27 | | |
| PLACE1006371 | 1.38 | 3.2 | 1.46 | 1.68 | 3.01 | 1.67 | | |
| PLACE1006373 | 2.21 | 5.21 | 5.75 | 7.83 | 8.02 | 7.56 | * | + |
| PLACE1006382 | 0.9 | 4.67 | 2.81 | 3.3 | 1.92 | 2.95 | | |
| PLACE1006385 | 1.59 | 6.33 | 1.86 | 2.68 | 2.59 | 2.71 | | |
| PLACE1006391 | 1.19 | 5 | 1.95 | 1.96 | 2.79 | 1.63 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and −, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1006412 | 1.88 | 5.53 | 5.92 | 7.07 | 9.93 | 5.27 | | |
| PLACE1006414 | 0.63 | 3.42 | 0.95 | 1.22 | 1.87 | 1.6 | | |
| PLACE1006419 | 7.79 | 9.8 | 11.93 | 5.19 | 7.29 | 5.32 | * | − |
| PLACE1006438 | 0.99 | 6.07 | 3.42 | 3.29 | 4.56 | 5.14 | | |
| PLACE1006443 | 2.05 | 5.01 | 5.12 | 5.01 | 5.31 | 6.44 | | |
| PLACE1006445 | 0.84 | 5.76 | 3.65 | 3.53 | 3.27 | 3.55 | | |
| PLACE1006447 | 1.34 | 5.81 | 3.28 | 2.95 | 3.26 | 3.96 | | |
| PLACE1006466 | 0.75 | 4.38 | 1.35 | 1.49 | 1.66 | 1.08 | | |
| PLACE1006469 | 0.67 | 4.66 | 2.31 | 1.65 | 2.26 | 1.67 | | |
| PLACE1006470 | 2.47 | 3.71 | 3.74 | 5.25 | 7.02 | 4.35 | | |
| PLACE1006472 | 24.4 | 23.44 | 52.17 | 26.23 | 28.52 | 9.36 | | |
| PLACE1006476 | 2.52 | 4.31 | 8.67 | 6.21 | 7.23 | 5.93 | | |
| PLACE1006482 | 1.64 | 3.35 | 4.43 | 4.25 | 4.67 | 4.98 | | |
| PLACE1006488 | 14.12 | 19.42 | 32.69 | 40.76 | 34.77 | 41.4 | * | + |
| PLACE1006492 | 2.03 | 6.41 | 4.38 | 4.04 | 4.98 | 3.02 | | |
| PLACE1006506 | 1.78 | 6.67 | 4.04 | 4.41 | 5.71 | 4.17 | | |
| PLACE1006515 | 1.65 | 5.7 | 3.08 | 3.19 | 2.84 | 4.08 | | |
| PLACE1006516 | 1.1 | 7.32 | 7.05 | 4.89 | 5.69 | 7.28 | | |
| PLACE1006520 | 1.02 | 2.74 | 2.12 | 1.19 | 3 | 1.54 | | |
| PLACE1006521 | 2.4 | 3.54 | 6.38 | 6.49 | 6.86 | 5.08 | | |
| PLACE1006529 | 5.96 | 7.35 | 6.96 | 10.56 | 8.2 | 7.93 | | |
| PLACE100G531 | 1.01 | 4.31 | 3.33 | 1.84 | 2.05 | 2.43 | | |
| PLACE1006534 | 1.68 | 6.04 | 2.59 | 3.01 | 3.86 | 3.19 | | |
| PLACE1006540 | 2.68 | 9.7 | 7.77 | 8.71 | 11.21 | 4.46 | | |
| PLACE1006549 | 0.6 | 9.45 | 2.09 | 1.6 | 2.28 | 1.65 | | |
| PLACE1006550 | 1.76 | 8.82 | 4.07 | 2.77 | 2.94 | 4.14 | | |
| PLACE1006552 | 1.3 | 2.48 | 2.14 | 1.97 | 1.3 | 0.81 | | |
| PLACE1006557 | 2.38 | 4.01 | 3.79 | 2.84 | 2.51 | 2.45 | | |
| PLACE1006563 | 2.49 | 3.44 | 5.7 | 4.23 | 4.15 | 4.3 | | |
| PLACE1006579 | 1.53 | 7.5 | 4.82 | 4.88 | 5.38 | 5.78 | | |
| PLACE1006594 | 236.53 | 241.11 | 397.64 | 122.37 | 278.58 | 324.29 | | |
| PLACE1006598 | 0.72 | 8.53 | 2.4 | 1.53 | 1.58 | 2.07 | | |
| PLACE1006607 | 1.47 | 7.69 | 4.18 | 3.45 | 5.86 | 4.29 | | |
| PLACE1006610 | 9.46 | 13.73 | 38.26 | 27.65 | 32.76 | 22.64 | | |
| PLACE1006615 | 6.22 | 9.09 | 18.78 | 20.25 | 15.74 | 15.86 | | |
| PLACE1006617 | 0.91 | 1.54 | 2.66 | 1.87 | 2.49 | 2.09 | | |
| PLACE1006618 | 5.42 | 8.01 | 9.24 | 5.33 | 8.59 | 5.76 | | |
| PLACE1006626 | 1.53 | 4.11 | 1.3 | 2.47 | 2.78 | 1.16 | | |
| PLACE1006629 | 0.99 | 5.05 | 1.36 | 2.22 | 2.56 | 1.76 | | |
| PLACE1006637 | 1.29 | 6.54 | 3.97 | 3.77 | 4.23 | 4.87 | | |
| PLACE1006640 | 0.59 | 5.14 | 1.17 | 0.85 | 2.54 | 0.94 | | |
| PLACE1006644 | 1.66 | 4.46 | 2.12 | 2.79 | 2.49 | 2.39 | | |
| PLACE1006657 | 1.28 | 2.09 | 2.31 | 4.55 | 3.09 | 2.19 | | |
| PLACE1006673 | 2.29 | 4.73 | 10.34 | 11.06 | 10.89 | 6.45 | | |
| PLACE1006678 | 2.54 | 2.98 | 1.44 | 1.37 | 1.96 | 1.39 | | |
| PLACE1006682 | 3.5 | 5.93 | 2.58 | 15.44 | 20.96 | 23.99 | ** | + |
| PLACE1006684 | 1.12 | 4.8 | 1.81 | 1.64 | 2.54 | 1.65 | | |
| PLACE1006698 | 1.54 | 5.86 | 4.52 | 2.15 | 3.57 | 1.9 | | |
| PLACE1006704 | 1.81 | 5.41 | 2.71 | 2.93 | 2.92 | 2.97 | | |
| PLACE1006708 | 1.69 | 5.07 | 3.49 | 3.46 | 4.11 | 3.7 | | |
| PLACE1006711 | 14.21 | 16.18 | 29.77 | 24.34 | 26.25 | 22.42 | | |
| PLACE1006714 | 2.27 | 3.26 | 4.74 | 4.57 | 5.23 | 3.53 | | |
| PLACE1006716 | 1.51 | 2.75 | 3.7 | 6 | 7.05 | 3.99 | | |
| PLACE1006731 | 1.65 | 3.77 | 2.83 | 2.71 | 4 | 3.09 | | |
| PLACE1006754 | 0.43 | 3.94 | 1.73 | 1.8 | 1.81 | 0.99 | | |
| PLACE1006760 | 7.56 | 10.98 | 10.08 | 8.58 | 8.89 | 11.31 | | |
| PLACE1006779 | 1.44 | 4.12 | 2.88 | 3.19 | 3.79 | 2.97 | | |
| PLACE1006782 | 0.44 | 5.17 | 2.42 | 2.95 | 1.57 | 1.15 | | |
| PLACE1006783 | 9.34 | 11.46 | 18.65 | 157.98 | 223.05 | 66.46 | * | + |
| PLACE1006786 | 3.31 | 4.08 | 6.07 | 5.9 | 6.24 | 3.34 | | |
| PLACE1006792 | 1.61 | 3.31 | 5.38 | 5.66 | 3.33 | 4.18 | | |
| PLACE1006795 | 0.89 | 2.43 | 0.74 | 0.81 | 1.27 | 1.01 | | |
| PLACE1006800 | 1.62 | 4.94 | 2.53 | 4.7 | 4.56 | 3.93 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1006805 | 3.94 | 7.79 | 5.5 | 10.83 | 9.8 | 8.79 | * | + |
| PLACE1006809 | 3.55 | 5.7 | 5.94 | 9.58 | 10.61 | 8.97 | ** | + |
| PLACE1006815 | 1.7 | 7.57 | 4.1 | 5.12 | 5.23 | 5.8 | | |
| PLACE1006819 | 0.33 | 0.88 | 0.95 | 0.89 | 1.76 | 0.63 | | |
| PLACE1006820 | 2.35 | 2.01 | 4.91 | 4.84 | 6.72 | 4.18 | | |
| PLACE1006826 | 2.28 | 6.22 | 4.84 | 7.68 | 7.62 | 5.58 | | |
| PLACE1006829 | 3.76 | 5.51 | 6.54 | 9.49 | 8.66 | 8.69 | * | + |
| PLACE1006853 | 1.2 | 4.21 | 1.97 | 2.25 | 2.93 | 2.88 | | |
| PLACE1006860 | 1 | 4.29 | 1.62 | 1.61 | 2.1 | 1 | | |
| PLACE1006867 | 5.65 | 9.36 | 11.34 | 7.04 | 8.33 | 7.63 | | |
| PLACE1006875 | 1.15 | 6.19 | 5.66 | 4.84 | 4.53 | 4.63 | | |
| PLACE1006878 | 1.59 | 2.84 | 3.09 | 2.99 | 3.22 | 2.39 | | |
| PLACE1006883 | 3.21 | 5.08 | 6.78 | 6.83 | 7.38 | 6.19 | | |
| PLACE1006898 | 1.67 | 4.23 | 3.67 | 3.54 | 4.77 | 4.59 | | |
| PLACE1006901 | 2.59 | 4.75 | 4.03 | 3.71 | 3.28 | 4.14 | | |
| PLACE1006904 | 0.91 | 3.59 | 2.7 | 3.26 | 2.92 | 2.04 | | |
| PLACE1006917 | 3.63 | 7.13 | 6.1 | 5.8 | 7.21 | 7.03 | | |
| PLACE1006932 | 0.54 | 5.85 | 1.29 | 0.92 | 1.34 | 1.19 | | |
| PLACE1006935 | 1.3 | 5.46 | 2.54 | 1.59 | 4.03 | 1.6 | | |
| PLACE1006956 | 0.92 | 2.55 | 3.4 | 2.55 | 2.41 | 2.09 | | |
| PLACE1006958 | 0.78 | 2.41 | 1.35 | 1.76 | 4.2 | 3.39 | | |
| PLACE1006959 | 4.97 | 8.48 | 9.98 | 11.46 | 9.58 | 13.62 | | |
| PLACE1006961 | 8.03 | 9.85 | 14.42 | 13.73 | 11.57 | 14.2 | | |
| PLACE1006962 | 2.97 | 7.44 | 6.56 | 5.04 | 7.26 | 6.22 | | |
| PLACE1006966 | 2.02 | 6.94 | 3.46 | 3.15 | 3.89 | 2.89 | | |
| PLACE1006979 | 0.95 | 4.44 | 2.03 | 1.46 | 2.64 | 1.77 | | |
| PLACE1006989 | 2.19 | 5.05 | 3.02 | 3.27 | 3.9 | 5.06 | | |
| PLACE1007001 | 4.98 | 6.79 | 10.71 | 4.03 | 7.43 | 7.38 | | |
| PLACE1007014 | 1.37 | 3.03 | 3.45 | 1.79 | 2.18 | 2.2 | | |
| PLACE1007021 | 0.74 | 3.03 | 2.11 | 0.75 | 2.2 | 1.73 | | |
| PLACE1007026 | 2.1 | 9.23 | 3.93 | 4.15 | 4.27 | 5.42 | | |
| PLACE1007028 | 4.12 | 8.5 | 10.56 | 7.89 | 8.34 | 9.35 | | |
| PLACE1007038 | 237.33 | 267.91 | 446.14 | 406.27 | 622.67 | 671.17 | | |
| PLACE1007040 | 1.55 | 3.14 | 2.85 | 1.57 | 3.31 | 2.45 | | |
| PLACE1007045 | 1.08 | 3.74 | 2.85 | 2.9 | 5.03 | 2.74 | | |
| PLACE1007048 | 147.06 | 149.67 | 259.53 | 121.61 | 211.26 | 109.43 | | |
| PLACE1007053 | 4.9 | 6.69 | 10 | 3.59 | 4.91 | 4.71 | | |
| PLACE1007068 | 7.56 | 10.33 | 62.76 | 39.52 | 45.9 | 36.69 | | |
| PLACE1007070 | 5.97 | 10.85 | 10.28 | 8.65 | 9.6 | 14.3 | | |
| PLACE1007076 | 8.22 | 14.4 | 14.19 | 16.53 | 23.62 | 24.67 | * | + |
| PLACE1007077 | 2.65 | 6.45 | 4.01 | 5.2 | 5.28 | 5.43 | | |
| PLACE1007081 | 0.36 | 4.47 | 1.94 | 1.92 | 1.92 | 1.37 | | |
| PLACE1007082 | 1.23 | 4.66 | 4.95 | 4.32 | 4.5 | 3.99 | | |
| PLACE1007092 | 2.49 | 4.12 | 7.26 | 4.77 | 5.22 | 4.34 | | |
| PLACE1007096 | 0.72 | 2.19 | 0.74 | 1.35 | 1.63 | 0.97 | | |
| PLACE1007097 | 0.54 | 2.49 | 1.35 | 1.61 | 1.28 | 1.04 | | |
| PLACE1007099 | 1.58 | 4.66 | 2.56 | 2.77 | 3.64 | 3.72 | | |
| PLACE1007105 | 1.18 | 6.51 | 3.44 | 2.65 | 4.13 | 2.21 | | |
| PLACE1007108 | 3.55 | 13.02 | 7.41 | 5.03 | 6.87 | 5.75 | | |
| PLACE1007111 | 1.33 | 9.51 | 1.52 | 1.74 | 2.37 | 1.52 | | |
| PLACE1007112 | 1.23 | 7.26 | 1.79 | 2.09 | 3.12 | 2.36 | | |
| PLACE1007130 | 0.54 | 2.02 | 1.92 | 0.87 | 1.47 | 0.33 | | |
| PLACE1007132 | 1.46 | 3.32 | 4.63 | 3.58 | 3.38 | 2.88 | | |
| PLACE1007140 | 0.61 | 2.58 | 2.41 | 1.98 | 1.98 | 1.32 | | |
| PLACE1007143 | 2.79 | 6.32 | 4.62 | 4.9 | 5.34 | 5.33 | | |
| PLACE1007169 | 2.21 | 8.59 | 3.46 | 5.44 | 8.46 | 7.99 | | |
| PLACE1007178 | 0.82 | 8.66 | 2.48 | 3.28 | 6.28 | 4.1 | | |
| PLACE1007190 | 3.31 | 10.9 | 6.7 | 10.51 | 13.57 | 11.14 | | |
| PLACE1007201 | 0.81 | 5.82 | 1.41 | 1.72 | 3.04 | 2.51 | | |
| PLACE1007202 | 37.76 | 34.95 | 76.28 | 58.23 | 34.42 | 37.86 | | |
| PLACE1007226 | 2.01 | 2.39 | 2.73 | 1.89 | 3.14 | 2.29 | | |
| PLACE1007238 | 1.64 | 3.07 | 1.83 | 2.39 | 2.73 | 2.2 | | |
| PLACE1007239 | 1.81 | 3.68 | 2.99 | 1.76 | 2.72 | 2.44 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1007242 | 0.61 | 5.18 | 1.87 | 1.54 | 1.14 | 1.67 | | |
| PLACE1007243 | 2.21 | 7.36 | 2.29 | 2.24 | 3.27 | 3.31 | | |
| PLACE1007247 | 0.36 | 6.17 | 1.71 | 1.11 | 1.36 | 1.34 | | |
| PLACE1007257 | 1.67 | 5.33 | 3.34 | 3.3 | 5.27 | 4.25 | | |
| PLACE1007274 | 1.46 | 2.18 | 4.43 | 4.38 | 4.03 | 4.06 | | |
| PLACE1007276 | 0.93 | 2.02 | 1.1 | 2.13 | 2.1 | 1.74 | | |
| PLACE1007282 | 2.51 | 4.2 | 5.72 | 4.28 | 3.62 | 4.66 | | |
| PLACE1007286 | 2.97 | 4.8 | 7.85 | 10.14 | 12.47 | 8.79 | * | + |
| PLACE1007296 | 10.55 | 19.45 | 24.46 | 31.43 | 17.57 | 27.05 | | |
| PLACE1007301 | 0.65 | 5.17 | 1.55 | 1.19 | 1.54 | 1.11 | | |
| PLACE1007314 | 3.11 | 6.61 | 8.64 | 7.98 | 8.96 | 10.24 | | |
| PLACE1007317 | 1.19 | 3.34 | 1.27 | 1.88 | 1.62 | 1.79 | | |
| PLACE1007329 | 0.89 | 0.73 | 1.78 | 2.38 | 2.35 | 2.09 | * | + |
| PLACE1007338 | 3.96 | 6.47 | 9.58 | 11.59 | 8.93 | 2.32 | | |
| PLACE1007342 | 0.71 | 1.8 | 1.3 | 1.1 | 1.1 | 0.7 | | |
| PLACE1007345 | 1.72 | 4.57 | 2.54 | 2.72 | 3.6 | 3.29 | | |
| PLACE1007346 | 1.43 | 4.61 | 3.89 | 5.77 | 4.53 | 4.1 | | |
| PLACE1007359 | 0.74 | 4.55 | 2.16 | 2.59 | 2.44 | 3.53 | | |
| PLACE1007367 | 4.53 | 8.63 | 15.16 | 12.49 | 13.49 | 11.75 | | |
| PLACE1007375 | 0.36 | 3.24 | 2.02 | 1.75 | 2.56 | 1.59 | | |
| PLACE1007377 | 1.49 | 2.01 | 3.18 | 3.29 | 3.96 | 2.36 | | |
| PLACE1007386 | 1.55 | 1.75 | 1.47 | 2.37 | 1.68 | 1.36 | | |
| PLACE1007392 | 1.57 | 2.99 | 2.49 | 2.79 | 4.48 | 3.51 | | |
| PLACE1007402 | 2.41 | 5.66 | 3.08 | 1.52 | 2.91 | 1.8 | | |
| PLACE1007409 | 1.05 | 4.57 | 1.04 | 2.51 | 2.68 | 2.02 | | |
| PLACE1007416 | 3.45 | 6.97 | 6.5 | 7.05 | 9.14 | 6.52 | | |
| PLACE1007420 | 12.12 | 12.66 | 20.8 | 25.26 | 23.9 | 22.88 | * | + |
| PLACE1007431 | 1.87 | 7.4 | 5.51 | 7.17 | 5.28 | 5.91 | | |
| PLACE1007450 | 0.79 | 1.22 | 2.65 | 3 | 2.99 | 2.39 | | |
| PLACE1007452 | 0.42 | 2.36 | 1.76 | 2.09 | 2.98 | 1.45 | | |
| PLACE1007454 | 23.74 | 28.02 | 76.56 | 59.97 | 75.95 | 46.61 | | |
| PLACE1007460 | 0.75 | 3.52 | 2.35 | 2.34 | 1.93 | 2.58 | | |
| PLACE1007478 | 0.41 | 3.07 | 1.33 | 1.35 | 2.18 | 1.92 | | |
| PLACE1007484 | 0.6 | 4.8 | 2.57 | 2.56 | 1.45 | 1.69 | | |
| PLACE1007488 | 0.4 | 6.24 | 1.64 | 1.74 | 2.61 | 1.46 | | |
| PLACE1007507 | 2.91 | 6.36 | 4.49 | 5.31 | 8.29 | 8.11 | | |
| PLACE1007511 | 0.53 | 1.29 | 1.06 | 1.06 | 1.29 | 0.42 | | |
| PLACE1007513 | 10.57 | 10.43 | 24.05 | 12.24 | 16.88 | 16.9 | | |
| PLACE1007524 | 1.55 | 3.33 | 3.53 | 3.96 | 4.72 | 2.96 | | |
| PLACE1007525 | 1.24 | 2.95 | 3.14 | 2.38 | 2.85 | 2.24 | | |
| PLACE1007537 | 8.6 | 9.68 | 49.88 | 43.78 | 63.66 | 40.1 | | |
| PLACE1007544 | 1.55 | 6.45 | 4.97 | 3.2 | 3.92 | 4.61 | | |
| PLACEiOO7547 | 1.36 | 5.03 | 4.15 | 2.37 | 2.84 | 2.4 | | |
| PLACE1007557 | 1.12 | 3.16 | 3.14 | 3.07 | 3.9 | 3.41 | | |
| PLACE1007560 | 9.38 | 8.86 | 12.57 | 11.03 | 9.62 | 17.59 | | |
| PLACE1007565 | 0.37 | 2.27 | 1 | 1 | 1.16 | 0.91 | | |
| PLACE1007580 | 1.06 | 3.71 | 3.06 | 10.8 | 11.15 | 13.74 | ** | + |
| PLACE1007583 | 0.76 | 3.88 | 1.78 | 2.51 | 2.37 | 1.09 | | |
| PLACE1007591 | 0.79 | 4.62 | 1.7 | 2.2 | 2.53 | 2.07 | | |
| PLACE1007598 | 1.13 | 6.98 | 3.86 | 2.71 | 3.46 | 4.71 | | |
| PLACE1007610 | 0.41 | 5.63 | 1.28 | 1.33 | 3.18 | 1.5 | | |
| PLACE1007618 | 1.57 | 1.91 | 2.01 | 1.75 | 2.2 | 2.41 | | |
| PLACE1007621 | 1.78 | 2.83 | 3.64 | 3.33 | 3.57 | 4.38 | | |
| PLACE1007626 | 23.99 | 25.61 | 32.78 | 30.53 | 30.94 | 13.53 | | |
| PLACE1007632 | 2.03 | 3.26 | 2.52 | 2.65 | 3.81 | 4.63 | | |
| PLACE1007635 | 1.61 | 4.62 | 6.42 | 2.8 | 4.19 | 3.37 | | |
| PLACE1007645 | 10.59 | 11.55 | 15.06 | 9.99 | 11.58 | 11.95 | | |
| PLACE1007649 | 1.7 | 5.88 | 3.47 | 2.78 | 4.95 | 3.13 | | |
| PLACE1007659 | 1.33 | 5.85 | 3.61 | 4.88 | 6.22 | 4.9 | | |
| PLACE1007669 | 2.01 | 2.1 | 3.74 | 2.97 | 4.63 | 4.4 | | |
| PLACE1007677 | 1.25 | 2.29 | 2.81 | 2.68 | 3.07 | 2.91 | | |
| PLACE1007688 | 3.4 | 5.69 | 5.43 | 1.98 | 4.53 | 4.98 | | |
| PLACE1007690 | 1.4 | 4.03 | 2.12 | 3.74 | 3.37 | 4.61 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1007697 | 0.69 | 7.13 | 1.37 | 1.84 | 2.56 | 1.8 | | |
| PLACE1007702 | 2.03 | 7.08 | 5.7 | 4.03 | 3.91 | 4.08 | | |
| PLACE1007705 | 1.38 | 3.93 | 1.59 | 1.74 | 4.45 | 2.75 | | |
| PLACE1007706 | 3.11 | 6.08 | 4.69 | 5.25 | 8.84 | 7.49 | | |
| PLACE1007725 | 3.41 | 4.69 | 6.65 | 5.1 | 3.29 | 5.39 | | |
| PLACE1007729 | 0.98 | 2.65 | 1.8 | 2.7 | 3.11 | 1.99 | | |
| PLACE1007730 | 1.25 | 4.29 | 3.07 | 3.66 | 3.75 | 4.32 | | |
| PLACE1007737 | 1.43 | 4.79 | 3.39 | 3.79 | 4.7 | 4.17 | | |
| PLACE1007743 | 1.38 | 4.26 | 2.29 | 2.3 | 2.83 | 2.03 | | |
| PLACE1007746 | 6.56 | 9.02 | 10.42 | 9.65 | 13.29 | 12.97 | | |
| PLACE1007753 | 0.53 | 4.48 | 1.71 | 1.35 | 2.86 | 1.94 | | |
| PLACE1007769 | 1.31 | 4.31 | 3.5 | 3.27 | 4.51 | 4.58 | | |
| PLACE1007780 | 5.77 | 4.63 | 7.11 | 6.51 | 3.75 | 2.17 | | |
| PLACE1007791 | 1.82 | 3.29 | 3.38 | 3.16 | 3.69 | 2.87 | | |
| PLACE1007807 | 0.67 | 2.79 | 1.72 | 2.33 | 1.76 | 1.29 | | |
| PLACE1007810 | 0.39 | 4.45 | 2.63 | 4.11 | 4.08 | 3.27 | | |
| PLACE1007814 | 3.57 | 5.98 | 5.04 | 4.2 | 4.62 | 6.3 | | |
| PLACE1007828 | 2.01 | 7.64 | 3.34 | 2.69 | 4.64 | 3.44 | | |
| PLACE1007829 | 1.32 | 6.9 | 2.88 | 2.87 | 4.87 | 3.06 | | |
| PLACE1007841 | 1.64 | 7.26 | 1.87 | 2.25 | 3.14 | 3.39 | | |
| PLACE1007842 | 1.1 | 3.32 | 2.44 | 2.09 | 3.96 | 1.39 | | |
| PLACE1007843 | 1.2 | 1.92 | 1.43 | 2.13 | 1.48 | 1.86 | | |
| PLACE1007845 | 1.76 | 3 | 4.11 | 3.45 | 3.42 | 2.36 | | |
| PLACE1007846 | 0.99 | 3.26 | 1.64 | 2.02 | 2.73 | 1.5 | | |
| PLACE1007848 | 1.09 | 3.51 | 2.23 | 2.39 | 2.62 | 2.25 | | |
| PLACE1007852 | 2.26 | 7.88 | 3.82 | 2.94 | 4.61 | 3.24 | | |
| PLACE1007858 | 3.65 | 11.57 | 5.81 | 61.71 | 80.46 | 57.09 | ** | + |
| PLACE1007866 | 19.42 | 25.98 | 40.48 | 43 | 80.39 | 56.73 | | |
| PLACE1007871 | 8.1 | 7.9 | 15.45 | 16.17 | 12.35 | 11.08 | | |
| PLACE1007877 | 1.09 | 2.09 | 1.45 | 1.4 | 2.39 | 1.53 | | |
| PLACE1007878 | 5.98 | 9.75 | 14.61 | 13.65 | 7.49 | 8.9 | | |
| PLACE1007881 | 0.43 | 2.66 | 1.34 | 1.59 | 1.94 | 1.93 | | |
| PLACE1007885 | 4.35 | 7.85 | 6.76 | 5.57 | 6.53 | 7.01 | | |
| PLACE1007897 | 0.27 | 6.51 | 1.85 | 1.72 | 1.53 | 1.41 | | |
| PLACE1007908 | 3.14 | 12.29 | 5.73 | 5.96 | 7.9 | 8.24 | | |
| PLACE1007922 | 6.08 | 11.75 | 8.75 | 5.24 | 7.15 | 4.54 | | |
| PLACE1007946 | 1.07 | 2.03 | 1.86 | 2.71 | 2.28 | 1.94 | | |
| PLACE1007950 | 6.98 | 7.6 | 18.21 | 16.17 | 19.34 | 12.63 | | |
| PLACE1007954 | −0.03 | 2.45 | 1.15 | 2.46 | 1.57 | 1.51 | | |
| PLACE1007955 | 0.92 | 4.01 | 2.17 | 2.05 | 2.52 | 3.05 | | |
| PLACE1007956 | 0.6 | 3.61 | 2.91 | 2.35 | 2.1 | 2.22 | | |
| PLACE1007958 | 0.75 | 6.31 | 1.34 | 0.79 | 1.21 | 0.8 | | |
| PLACE1007965 | 0.64 | 5.88 | 3.25 | 3.38 | 2.91 | 2.17 | | |
| PLACE1007969 | 1.09 | 6.37 | 3.06 | 2.35 | 3.29 | 2.21 | | |
| PLACE1007971 | 2.73 | 4.17 | 5.21 | 6.1 | 4.41 | 5.92 | | |
| PLACE1007990 | 1.95 | 2.33 | 2.31 | 3.22 | 3.09 | 1.88 | | |
| PLACE1008000 | 0.32 | 2.16 | 1.98 | 1.85 | 1.27 | 0.66 | | |
| PLACE1008002 | 0.99 | 3.38 | 1.7 | 1.81 | 2.04 | 0.51 | | |
| PLACE1008037 | 0.57 | 4.19 | 1.7 | 4.59 | 2.86 | 2.02 | | |
| PLACE1008044 | 1.42 | 5.81 | 2.46 | 4.18 | 4.93 | 4.16 | | |
| PLACE1008045 | 0.4 | 4.07 | 1.54 | 1.75 | 2 | 1.65 | | |
| PLACE1008080 | 2.05 | 6.08 | 3.22 | 4.23 | 4.03 | 4.78 | | |
| PLACE1008092 | 1.56 | 1.56 | 1.48 | 1.48 | 2.98 | 1.86 | | |
| PLACE1008095 | 0.59 | 2.14 | 1.48 | 2.38 | 2.73 | 1.23 | | |
| PLACE1008105 | 0.95 | 1.76 | 1.71 | 2.24 | 2.71 | 0.74 | | |
| PLACE1008107 | 0.27 | 2.33 | 0.7 | 1.72 | 1.44 | 1.68 | | |
| PLACE1008111 | 1.73 | 5.01 | 2.12 | 4.57 | 5.4 | 4.04 | | |
| PLACE1008113 | 5.88 | 9.24 | 12.48 | 16.57 | 20.29 | 19.24 | * | + |
| PLACE1008122 | 1.22 | 5.54 | 2.55 | 1.61 | 1.57 | 1.5 | | |
| PLACE1008129 | 1.5 | 5.64 | 2.8 | 2.43 | 5.36 | 2.91 | | |
| PLACE1008132 | 5.51 | 4.47 | 8.34 | 6.61 | 11.2 | 7.63 | | |
| PLACE1008137 | 0.96 | 1.82 | 1.02 | 2.12 | 3.88 | 0.8 | | |
| PLACE1008174 | 0.77 | 3.16 | 2.43 | 5.12 | 4.39 | 2.46 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte exp. 1 | exp. 2 | exp. 3 | Synoviocute_TNF exp. 1 | exp. 2 | exp. 3 | t test vs TNF | INC. and DEC. |
|---|---|---|---|---|---|---|---|---|
| PLACE1008177 | 1.62 | 4.87 | 3.09 | 3.79 | 3.26 | 3.77 | | |
| PLACE1008181 | 1.76 | 3.87 | 1.6 | 2.06 | 2.43 | 1.43 | | |
| PLACE1008195 | 2.66 | 6.08 | 2.97 | 4.34 | 4.14 | 3.9 | | |
| PLACE1008198 | 1.06 | 5.56 | 2.52 | 2.55 | 3.31 | 1.54 | | |
| PLACE1008201 | 1.22 | 4.45 | 3.58 | 5.92 | 7.69 | 5.64 | * | + |
| PLACE1008209 | 2.35 | 2.29 | 4.46 | 2.51 | 5.31 | 4.44 | | |
| PLACE1008226 | 1.8 | 2.35 | 5.25 | 4.72 | 5.68 | 7.08 | | |
| PLACE1008227 | 0.77 | 2.67 | 3.02 | 2.38 | 4.6 | 3.54 | | |
| PLACE1008231 | 1.26 | 3.85 | 1.85 | 1.05 | 1.83 | 0.78 | | |
| PLACE1008238 | 1.22 | 3.21 | 2.9 | 2.47 | 2 | 1.72 | | |
| PLACE1008244 | 1.01 | 4.69 | 1.56 | 1.68 | 3.2 | 1.56 | | |
| PLACE1008249 | 0.8 | 4.94 | 2.55 | 1.22 | 2.17 | 2.01 | | |
| PLACE1008266 | 11.31 | 18.61 | 43.04 | 60.04 | 82.48 | 59.04 | * | + |
| PLACE1008273 | 1.47 | 3.95 | 3.81 | 3.53 | 3.8 | 4.47 | | |
| PLACE1008275 | 1.59 | 3.67 | 2.17 | 2.62 | 2.57 | 2.34 | | |
| PLACE1008280 | 0.85 | 2.6 | 1.84 | 2.42 | 2.48 | 2.36 | | |
| PLACE1008282 | 4.71 | 8.19 | 6.89 | 7.27 | 9.02 | 6.38 | | |
| PLACE1008297 | 2.32 | 4.7 | 3.36 | 2.89 | 3.42 | 3.21 | | |
| PLACE1008303 | 1.65 | 6.68 | 1.24 | 4.12 | 3.83 | 2.65 | | |
| PLACE1008309 | 0.43 | 6.52 | 0.82 | 1.77 | 1.5 | 1.29 | | |
| PLACE1008315 | 5.3 | 5.93 | 8.61 | 4.92 | 4.79 | 9.83 | | |
| PLACE1008329 | 0.47 | 2.23 | 2.06 | 2.32 | 2.8 | 2.49 | | |
| PLACE1008330 | 0.72 | 4.06 | 3.16 | 2.48 | 3.36 | 2.96 | | |
| PLACE1008331 | 0.84 | 5.01 | 2.1 | 4.5 | 2.17 | 2.91 | | |
| PLACE1008351 | 4.34 | 8.66 | 7.41 | 7.91 | 7.31 | 7.1 | | |
| PLACE1008356 | 1.56 | 8.23 | 1.93 | 2.86 | 4.16 | 3.35 | | |
| PLACE1008359 | 1.57 | 4.11 | 2.89 | 2 | 2.97 | 2.94 | | |
| PLACE1008368 | 2.27 | 6.38 | 7.43 | 5.72 | 7.33 | 6.95 | | |
| PLACE1008369 | 0.57 | 2.46 | 1.45 | 1.12 | 1.59 | 1.68 | | |
| PLACE1008392 | 0.8 | 3.09 | 2.54 | 2.44 | 3.22 | 3.24 | | |
| PLACE1008394 | 2.08 | 4.84 | 3.75 | 3.98 | 5.03 | 4.76 | | |
| PLACE1008398 | 5.32 | 9.36 | 11.44 | 11.36 | 11.3 | 12.33 | | |
| PLACE1008401 | 1.19 | 7.06 | 3.21 | 2.82 | 3.43 | 3.33 | | |
| PLACE1008402 | 3.21 | 6.45 | 7.2 | 7.23 | 10.15 | 9.26 | | |
| PLACE1008405 | 10.3 | 10.95 | 18.42 | 17.17 | 18.82 | 20.4 | | |
| PLACE1008409 | 1.88 | 5.19 | 5.69 | 4.97 | 5.41 | 5.65 | | |
| PLACE1008420 | 1.4 | 1.87 | 1.96 | 2.67 | 2.69 | 2.27 | * | + |
| PLACE1008424 | 0.88 | 2.69 | 2.54 | 1.69 | 2.34 | 1.71 | | |
| PLACE1008426 | 0.98 | 2.58 | 1.58 | 1.7 | 2.66 | 2.32 | | |
| PLACE1008429 | 0.92 | 3.17 | 2.14 | 1.91 | 3.4 | 1.84 | | |
| PLACE1008430 | 1.63 | 4.85 | 3.04 | 2.93 | 3.52 | 3 | | |
| PLACE1008437 | 0.87 | 3.64 | 3.01 | 2.83 | 1.82 | 1.57 | | |
| PLACE1008453 | 1.16 | 4.8 | 1.02 | 1.64 | 2.06 | 1.17 | | |
| PLACE1008454 | 2.14 | 6.46 | 9.23 | 5.46 | 9.02 | 5.92 | | |
| PLACE1008455 | 2.06 | 4.33 | 7.2 | 5.26 | 6.68 | 4.87 | | |
| PLACE1008457 | 0.51 | 2.6 | 2.01 | 2.28 | 2.43 | 2.47 | | |
| PLACE1008465 | 0.49 | 2.41 | 1.72 | 1.56 | 2.13 | 0.48 | | |
| PLACE1008469 | 2.42 | 4.36 | 5.32 | 5.16 | 4.75 | 7.1 | | |
| PLACE1008488 | 0.81 | 5.48 | 1.97 | 2.44 | 2.03 | 1.8 | | |
| PLACE1008519 | 1.48 | 10.85 | 6.17 | 4.41 | 4.99 | 4.51 | | |
| PLACE1008524 | 1.04 | 11.09 | 1.72 | 2 | 3.22 | 2.02 | | |
| PLACE1008531 | 0.64 | 8.37 | 1.92 | 1.33 | 2.05 | 1.72 | | |
| PLACE1008532 | 2.12 | 3 | 5.51 | 5.66 | 4.72 | 4.19 | | |
| PLACE1008533 | 2.01 | 4 | 4.07 | 5.53 | 5.18 | 3.77 | | |
| PLACE1008542 | 1.61 | 2.36 | 0.96 | 2.05 | 2.1 | 1.72 | | |
| PLACE1008549 | 0.96 | 3.06 | 0.67 | 1.45 | 2.1 | 1.53 | | |
| PLACE1008560 | 1.18 | 4.23 | 2.28 | 2.29 | 3.93 | 3.47 | | |
| PLACE1008567 | 0.87 | 7.26 | 1.85 | 2.33 | 3.67 | 2.38 | | |
| PLACE1008568 | 2.37 | 10.67 | 5.49 | 2.97 | 7.47 | 4.21 | | |
| PLACE1008569 | 3.94 | 10.32 | 6.74 | 6.1 | 8.6 | 7.6 | | |
| PLACE1008584 | 0.88 | 1.4 | 1.58 | 2.86 | 3.38 | 1.31 | | |
| PLACE1008585 | 4.96 | 4.8 | 7.56 | 11.08 | 4.84 | 3.57 | | |
| PLACE1008603 | 5.9 | 7.25 | 31 | 30.55 | 43.67 | 29.76 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1008621 | 0.55 | 2.28 | 0.95 | 0.72 | 1.89 | 1.16 | | |
| PLACE1008625 | 0.64 | 4.01 | 0.9 | 1.18 | 1.41 | 2.03 | | |
| PLACE1008626 | 0.55 | 6.06 | 0.9 | 1.03 | 0.83 | 0.95 | | |
| PLACE1008627 | 0.46 | 8.32 | 1.86 | 1.87 | 3.34 | 2.7 | | |
| PLACE1008629 | 3.22 | 9.18 | 5.84 | 5.44 | 6.75 | 4.41 | | |
| PLACE1008630 | 1.68 | 3.39 | 4.23 | 4.21 | 3.01 | 3.51 | | |
| PLACE1008643 | 1.31 | 0.93 | 1.98 | 1.72 | 2.34 | 1.94 | | |
| PLACE1008650 | 0.25 | 3.05 | 1.62 | 2.23 | 1.63 | 1.24 | | |
| PLACE1008657 | 1.17 | 2.39 | 2.51 | 2.34 | 4.04 | 2.91 | | |
| PLACE1008664 | 0.91 | 5.93 | 2.37 | 2.91 | 2.51 | 1.13 | | |
| PLACE1008693 | 0.97 | 4.93 | 3.09 | 2.53 | 3.81 | 2.2 | | |
| PLACE1008696 | 0.88 | 3.84 | 2.21 | 2.26 | 2.11 | 1.47 | | |
| PLACE1008715 | 1.05 | 4.71 | 2.11 | 1.34 | 2.65 | 2.65 | | |
| PLACE1008716 | 2.48 | 3.94 | 4.19 | 5.75 | 6.9 | 7.07 | * | + |
| PLACE1008722 | 3.85 | 4.34 | 7.37 | 7.64 | 7.19 | 3.45 | | |
| PLACE1008738 | 5.17 | 9.13 | 12.7 | 9.49 | 5.83 | 4.8 | | |
| PLACE1008742 | 6.57 | 6.87 | 14.66 | 14.94 | 15.06 | 12.41 | | |
| PLACE1008744 | 3.52 | 6.98 | 5.61 | 5.83 | 4.55 | 2.74 | | |
| PLACE1008748 | 0.63 | 4.39 | 2.75 | 2.44 | 1.67 | 1.61 | | |
| PLACE1008757 | 0.99 | 4.74 | 4.51 | 2.77 | 5.74 | 2.17 | | |
| PLACE1008766 | 2.66 | 6.75 | 3.77 | 3.51 | 6.47 | 4.06 | | |
| PLACE1008785 | 1.39 | 1.68 | 2.6 | 3.26 | 3.8 | 3.89 | * | + |
| PLACE1008790 | 1.57 | 1.8 | 2.29 | 3.5 | 5.39 | 2.96 | | |
| PLACE1008798 | 1.71 | 3.82 | 4.45 | 6 | 5.93 | 3.32 | | |
| PLACE1008807 | 1.34 | 3.95 | 1.61 | 2.54 | 2.62 | 1.8 | | |
| PLACE1008808 | 1.6 | 4.53 | 3.01 | 4.24 | 3.69 | 5.04 | | |
| PLACE1008813 | 1.38 | 4.85 | 1.97 | 1.9 | 1.95 | 2.3 | | |
| PLACE1008836 | 1.34 | 5.81 | 3.68 | 3.89 | 6.17 | 4.1 | | |
| PLACE1008851 | 1.21 | 6.65 | 3.94 | 4.85 | 10.04 | 4.54 | | |
| PLACE1008854 | 0.56 | 0.48 | 1.14 | 1.16 | 1.41 | 1.6 | | |
| PLACE1008864 | 1.98 | 1.92 | 2.96 | 2.73 | 2.65 | 2.49 | | |
| PLACE1008867 | 1.2 | 6.57 | 6.22 | 6.43 | 5.71 | 4.82 | | |
| PLACE1008876 | 11.7 | 16.5 | 27.29 | 26.74 | 20.94 | 23.24 | | |
| PLACE1008887 | 1.37 | 4.31 | 1.44 | 3.26 | 2.07 | 3.28 | | |
| PLACE1008902 | 1.33 | 5.62 | 2.93 | 3.17 | 4.58 | 2.06 | | |
| PLACE1008911 | 4.04 | 8.56 | 10.48 | 11.31 | 13.99 | 15.66 | | |
| PLACE1008917 | 0.6 | 4.53 | 2.72 | 1.7 | 2.9 | 1.71 | | |
| PLACE1008920 | 0.75 | 0.77 | 0.87 | 0.61 | 1.58 | 1.44 | | |
| PLACE1008925 | 0.25 | 0.9 | 1.04 | 0.94 | 1.91 | 0.84 | | |
| PLACE1008930 | 4.12 | 7.32 | 9.83 | 5.11 | 10.36 | 7.17 | | |
| PLACE1008934 | 0.9 | 3.42 | 2.9 | 2.89 | 2.28 | 1.7 | | |
| PLACE1008941 | 1.57 | 4.14 | 2.8 | 2.06 | 2.59 | 4.05 | | |
| PLACE1008947 | 2.3 | 5.41 | 5.51 | 3.96 | 5.84 | 5.16 | | |
| PLACE1008984 | 1.26 | 6.31 | 3.25 | 3.1 | 3.93 | 3.19 | | |
| PLACE1008985 | 0.94 | 2.75 | 2.74 | 2.84 | 2.43 | 2.7 | | |
| PLACE1008994 | 0.27 | 1.72 | 0.65 | 1.11 | 0.78 | 0.68 | | |
| PLACE1009020 | 0.46 | 3.49 | 2.42 | 2.49 | 3.1 | 2.16 | | |
| PLACE1009027 | 0.89 | 2.7 | 1.59 | 2.24 | 1.75 | 2.09 | | |
| PLACE1009039 | −0.06 | 3.31 | 3.42 | 2.39 | 1.59 | 1.49 | | |
| PLACE1009045 | 1.53 | 6.33 | 6.05 | 23.13 | 20.76 | 22.2 | ** | + |
| PLACE1009048 | 0.41 | 5.97 | 2.3 | 0.61 | 1.04 | 0.54 | | |
| PLACE1009050 | 0.97 | 4.9 | 1.68 | 1.07 | 1.47 | 1.55 | | |
| PLACE1009060 | 5.61 | 8.4 | 9.51 | 10.74 | 8.55 | 11.96 | | |
| PLACE1009067 | 1.14 | 2.8 | 2.03 | 1.6 | 2.34 | 3.4 | | |
| PLACE1009071 | 1.44 | 4.05 | 3.9 | 3.79 | 7.24 | 9.82 | | |
| PLACE1009090 | 1.27 | 6.46 | 2.35 | 3.11 | 4.73 | 2.86 | | |
| PLACE1009091 | 5.58 | 10.22 | 38.11 | 38.77 | 49.35 | 36.29 | | |
| PLACE1009094 | 0.26 | 5.68 | 1.88 | 1.67 | 5.04 | 1.71 | | |
| PLACE1009099 | 1 | 5.52 | 3.47 | 3.49 | 3.36 | 3.84 | | |
| PLACE1009110 | 1.59 | 5.82 | 1.16 | 1.68 | 4.3 | 4.39 | | |
| PLACE1009111 | 1.88 | 5.24 | 2.65 | 3.95 | 3.77 | 2.88 | | |
| PLACE1009113 | 2.24 | 3.52 | 3.62 | 6.14 | 4.87 | 7.29 | * | + |
| PLACE1009130 | 4.46 | 6.8 | 7.84 | 6.68 | 9.36 | 10.47 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1009150 | 0.88 | 3.54 | 1.95 | 3.23 | 3.3 | 3.01 | | |
| PLACE1009155 | 1.11 | 5.06 | 2.98 | 4.46 | 4.43 | 3.87 | | |
| PLACE1009158 | 1.06 | 5.77 | 1.95 | 1.77 | 2.35 | 2.88 | | |
| PLACE1009166 | 0.76 | 4.8 | 1.53 | 1.59 | 2.16 | 1.3 | | |
| PLACE1009172 | 1.43 | 3.96 | 2.45 | 2.26 | 5.85 | 2.61 | | |
| PLACE1009174 | 1.13 | 3.45 | 2.42 | 1.67 | 3.02 | 2.38 | | |
| PLACE1009183 | 1.62 | 3.54 | 4.47 | 4.1 | 6.33 | 8.06 | | |
| PLACE1009186 | 1.04 | 5.07 | 2.3 | 2.46 | 2.86 | 2.91 | | |
| PLACE1009190 | 0.75 | 2.32 | 1.44 | 1.53 | 1.9 | 1.65 | | |
| PLACE1009196 | 0.81 | 4.01 | 2.73 | 2.24 | 2.38 | 1.99 | | |
| PLACE1009200 | 1.01 | 4.44 | 2.94 | 2.84 | 4.39 | 2.91 | | |
| PLACE1009217 | 2.55 | 4.91 | 3.43 | 4.46 | 7.29 | 7.23 | | |
| PLACE1009230 | 1.9 | 5.55 | 6.63 | 5.63 | 9.16 | 9.46 | | |
| PLACE1009236 | 4.97 | 7.07 | 12.6 | 8.2.11 | 0.79 | 7.13 | | |
| PLACE1009246 | 11.71 | 11.96 | 24.75 | 14.59 | 16.36 | 9.05 | | |
| PLACE1009265 | 6.95 | 7.82 | 14.01 | 15.61 | 5.19 | 12.17 | | |
| PLACE1009279 | 0.67 | 2.07 | 2.46 | 1.93 | 2.54 | 1.63 | | |
| PLACE1009298 | 5.54 | 9.92 | 9.52 | 10.21 | 11.25 | 17.55 | | |
| PLACE1009308 | 1.13 | 6.82 | 2.04 | 2.48 | 2.48 | 2.34 | | |
| PLACE1009319 | 2.04 | 9.25 | 3.15 | 2.92 | 3.54 | 2.5 | | |
| PLACE1009328 | 1.04 | 5.78 | 1.81 | 2.98 | 3.39 | 2.17 | | |
| PLACE1009335 | 1.38 | 6.55 | 4.72 | 2.24 | 3.21 | 3.01 | | |
| PLACE1009338 | 2.56 | 4.14 | 5.1 | 3.24 | 4.3 | 1.57 | | |
| PLACE1009344 | 0.73 | 2.45 | 1.08 | 1.31 | 1.55 | 0.84 | | |
| PLACE1009355 | 5.41 | 7.37 | 9.95 | 13.44 | 10.76 | 13.55 | * | + |
| PLACE1009368 | 1.3 | 2.56 | 2.41 | 2.43 | 2.32 | 2.19 | | |
| PLACE1009375 | 1.21 | 6.41 | 3.05 | 3.04 | 4.46 | 2.53 | | |
| PLACE1009388 | 1.18 | 8.68 | 3.01 | 3.46 | 4.53 | 2.72 | | |
| PLACE1009398 | 1.19 | 9.2 | 3.74 | 3.17 | 4.28 | 3.96 | | |
| PLACE1009404 | 2.78 | 9.18 | 4.51 | 5.33 | 6.73 | 6.94 | | |
| PLACE1009410 | 1.27 | 2.35 | 2.33 | 2.51 | 2.31 | 1.44 | | |
| PLACE1009417 | 0.95 | 2.25 | 4.34 | 2.55 | 3.08 | 1.71 | | |
| PLACE1009424 | 1.88 | 3.61 | 3.18 | 2.85 | 3.24 | 3.93 | | |
| PLACE1009434 | 0.84 | 3.94 | 2.91 | 1.29 | 1.82 | 2.19 | | |
| PLACE1009443 | 1.21 | 7.2 | 2.55 | 2.42 | 3.43 | 3.17 | | |
| PLACE1009444 | 1.33 | 7.71 | 4.05 | 2.51 | 3.17 | 3.79 | | |
| PLACE1009459 | 0.23 | 7.99 | 1.55 | 1.71 | 1.83 | 0.86 | | |
| PLACE1009460 | 1.75 | 6.84 | 3.26 | 5.15 | 4.31 | 4.08 | | |
| PLACE1009468 | 0.99 | 2.83 | 3.42 | 4.43 | 4.42 | 2.97 | | |
| PLACE1009476 | 0.21 | 1.21 | 0.73 | 1.05 | 0.67 | 1.33 | | |
| PLACE1009477 | 1.35 | 3.13 | 2.67 | 3.06 | 2.35 | 2.2 | | |
| PLACE1009493 | 0.87 | 3.35 | 0.94 | 1 | 1.87 | 1.41 | | |
| PLACE1009502 | 0.76 | 4.64 | 2.13 | 1.19 | 1.89 | 1.66 | | |
| PLACE1009524 | 1.32 | 4.22 | 1.63 | 0.94 | 2.14 | 1.6 | | |
| PLACE1009527 | 0.95 | 4.51 | 2.11 | 1.64 | 2.55 | 1.28 | | |
| PLACE1009531 | 20.82 | 28.24 | 41.52 | 46.25 | 43.25 | 49.96 | | |
| PLACE1009535 | 1.1 | 1.56 | 2.68 | 2.42 | 2.15 | 1.11 | | |
| PLACE1009539 | 2.15 | 3.41 | 4.18 | 3.88 | 2.65 | 2.57 | | |
| PLACE1009540 | 5.89 | 8 | 11.66 | 14.8 | 4.47 | 3.84 | | |
| PLACE1009542 | 1.11 | 3.37 | 1.42 | 1.51 | 2.06 | 1.44 | | |
| PLACE1009546 | 0.62 | 5.27 | 0.97 | 2.24 | 1.64 | 1.25 | | |
| PLACE1009556 | 0.35 | 4.46 | 3.46 | 3.36 | 2.86 | 3.16 | | |
| PLACE1009569 | 0.05 | 3.93 | 2.46 | 3.34 | 2.7 | 3.11 | | |
| PLACE1009571 | 1.67 | 4.27 | 2.52 | 3.04 | 2.85 | 2.67 | | |
| PLACE1009573 | 3.81 | 2.97 | 6.73 | 6.92 | 8.12 | 6.49 | | |
| PLACE1009576 | 1.92 | 2.51 | 4.3 | 2.73 | 3.66 | 2.08 | | |
| PLACE1009580 | 1.42 | 1.81 | 1.74 | 2.73 | 3.47 | 2.33 | * | + |
| PLACE1009581 | 0.89 | 4.25 | 2.03 | 2.91 | 4.38 | 2.74 | | |
| PLACE1009587 | 0.96 | 4.91 | 2.29 | 2.43 | 3.2 | 1.99 | | |
| PLACE1009593 | 2.71 | 6.73 | 4.37 | 4.94 | 6.85 | 5.03 | | |
| PLACE1009595 | 1.81 | 5.44 | 2.66 | 2.67 | 5 | 2.79 | | |
| PLACE1009596 | 1.57 | 6.83 | 2.6 | 3.44 | 3.97 | 2.7 | | |
| PLACE1009600 | 3.03 | 4.27 | 4.48 | 5.48 | 9.14 | 4.42 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1009604 | 2.32 | 4.64 | 5.02 | 4.22 | 6.11 | 3.23 | | |
| PLACE1009607 | 1.29 | 2.48 | 3.18 | 3.19 | 4.17 | 3.18 | | |
| PLACE1009613 | 1.94 | 5.23 | 2.94 | 2.65 | 3.08 | 2.23 | | |
| PLACE1009621 | 1.66 | 6.72 | 3.32 | 8.21 | 8.67 | 8.06 | * | + |
| PLACE1009622 | 1.78 | 5.93 | 3.78 | 3.9 | 4.1 | 3.9 | | |
| PLACE1009624 | 1.16 | 5.77 | 3.42 | 3.2 | 3.65 | 3.5 | | |
| PLACE1009637 | 2 | 6.88 | 3.36 | 3.07 | 4.59 | 3.91 | | |
| PLACE1009639 | 1.94 | 1.76 | 4.15 | 3.44 | 3.67 | 4.99 | | |
| PLACE1009654 | 20.88 | 17.13 | 34.95 | 14.94 | 24.53 | 20.64 | | |
| PLACE1009659 | 2.77 | 6.78 | 7.45 | 6.38 | 8.38 | 6.55 | | |
| PLACE1009665 | 1.04 | 4.21 | 1.93 | 1.19 | 2.72 | 1.93 | | |
| PLACE1009669 | 7.73 | 9.64 | 14.54 | 9.85 | 16.89 | 8.82 | | |
| PLACE1009670 | 1.76 | 5.36 | 2.54 | 2.77 | 4.47 | 4.01 | | |
| PLACE1009708 | 2.1 | 5.57 | 5.09 | 3.64 | 6.54 | 5.84 | | |
| PLACE1009721 | 1.34 | 4.28 | 3.56 | 5.78 | 5.81 | 3.01 | | |
| PLACE1009731 | 1.36 | 3.59 | 3 | 3.58 | 6.53 | 5 | | |
| PLACE1009735 | 1.94 | 3.94 | 3.21 | 5.16 | 7.52 | 4.78 | | |
| PLACE1009737 | 1.89 | 4.29 | 2.95 | 4.83 | 5.61 | 5.47 | * | + |
| PLACE1009741 | 1.3 | 4.32 | 3.45 | 2.09 | 5.03 | 3.07 | | |
| PLACE1009752 | 1.34 | 5.64 | 2.65 | 2.3 | 3.33 | 1.68 | | |
| PLACE1009763 | 3.95 | 9.73 | 6.82 | 7.13 | 7.44 | 8.39 | | |
| PLACE1009766 | 1.46 | 6.98 | 3.32 | 3.07 | 5.19 | 3.75 | | |
| PLACE1009772 | 0.48 | 5.19 | 0.6 | 1.01 | 2.46 | 0.89 | | |
| PLACE1009782 | 0.91 | 2.39 | 2.03 | 2.88 | 2.91 | 3.74 | | |
| PLACE1009794 | 2.58 | 4.45 | 5.11 | 3.54 | 3.66 | 5.03 | | |
| PLACE1009798 | 1.59 | 5.37 | 4 | 6.26 | 5.57 | 5.67 | | |
| PLACE1009845 | 1.05 | 6.02 | 2.92 | 2.79 | 3.39 | 3.92 | | |
| PLACE1009849 | 0.96 | 6.61 | 2.35 | 1.79 | 3.41 | 2.59 | | |
| PLACE1009857 | 0.79 | 4.86 | 1.45 | 1.19 | 1.27 | 1.56 | | |
| PLACE1009861 | 1.43 | 4.67 | 3.87 | 4.1 | 3.47 | 3.11 | | |
| PLACE1009872 | 53.53 | 52.43 | 88.5 | 74.95 | 49.47 | 81.73 | | |
| PLACE1009877 | 5.45 | 7.59 | 12.08 | 10.03 | 10.3 | 12.32 | | |
| PLACE1009879 | 0.82 | 3.28 | 1.59 | 1.55 | 2.99 | 1.34 | | |
| PLACE1009886 | 0.68 | 4.04 | 1.53 | 1.62 | 3.04 | 1.72 | | |
| PLACE1009888 | 1.03 | 7.4 | 3.23 | 5.34 | 5.84 | 7.94 | | |
| PLACE1009908 | 1.56 | 7.63 | 8.64 | 3.37 | 6.71 | 5.9 | | |
| PLACE1009919 | 4.5 | 7.53 | 8.26 | 5.84 | 10.72 | 10.15 | | |
| PLACE1009921 | 0.96 | 3.94 | 3.32 | 1.63 | 4.28 | 2.47 | | |
| PLACE1009923 | 3.82 | 5.56 | 6.85 | 6.32 | 8.13 | 5.57 | | |
| PLACE1009924 | 3.01 | 2.49 | 4.53 | 4.43 | 4.31 | 1.04 | | |
| PLACE1009925 | 0.61 | 2.77 | 1.84 | 2.51 | 2.2 | 2.5 | | |
| PLACE1009931 | 2.78 | 5.21 | 9 | 8.71 | 6.93 | 8.09 | | |
| PLACE1009935 | 0.74 | 3.71 | 2.1 | 1.19 | 1.08 | 1.5 | | |
| PLACE1009947 | 0.47 | 3.83 | 1.64 | 1.51 | 2.46 | 2.03 | | |
| PLACE1009961 | 0.43 | 4.08 | 1.39 | 1.69 | 2.18 | 1.9 | | |
| PLACE1009971 | 0.92 | 4.9 | 1.98 | 1.35 | 1.74 | 1.45 | | |
| PLACE1009982 | 40.34 | 48.71 | 89.8 | 53.8 | 57.87 | 66.96 | | |
| PLACE1009992 | 0.94 | 1.9 | 2.59 | 1.47 | 2.52 | 0.68 | | |
| PLACE1009995 | 6.47 | 10.83 | 15.72 | 7.79 | 9.03 | 11.23 | | |
| PLACE1009997 | 0.55 | 3.7 | 3.03 | 2.76 | 3.2 | 2.64 | | |
| PLACE1010002 | 1.4 | 4.14 | 2.82 | 2.89 | 3.04 | 3.46 | | |
| PLACE1010011 | 2.09 | 8.13 | 3.85 | 4.4 | 5.21 | 4.68 | | |
| PLACE1010013 | 0.18 | 12.85 | 1.74 | 0.92 | 1.81 | 0.68 | | |
| PLACE1010021 | 3.18 | 11.98 | 5.42 | 4.12 | 4.13 | 6.06 | | |
| PLACE1010023 | 2.15 | 8.45 | 5.16 | 5.62 | 6.52 | 6.14 | | |
| PLACE1010031 | 4.6 | 4.35 | 7.23 | 6.79 | 4.91 | 1.82 | | |
| PLACE1010039 | 1.17 | 3.3 | 1.45 | 1.28 | 1.23 | 1.19 | | |
| PLACE1010045 | 1.1 | 2.83 | 3.66 | 2.52 | 3.55 | 2.64 | | |
| PLACE1010053 | 1.42 | 3.56 | 1.65 | 2.21 | 2.76 | 2.37 | | |
| PLACE1010060 | 1.63 | 6.1 | 4.13 | 4.11 | 4.6 | 4.05 | | |
| PLACE1010069 | 0.41 | 7.96 | 2.32 | 1.48 | 2.91 | 1.3 | | |
| PLACE1010070 | 0.92 | 8.04 | 1.5 | 0.45 | 1.78 | 1.09 | | |
| PLACE1010074 | 5.25 | 11.67 | 11.8 | 12.32 | 9.51 | 11.22 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1010076 | 12.75 | 11.95 | 29.01 | 19.58 | 15.88 | 16.82 | | |
| PLACE1010078 | 2.96 | 2.42 | 4.36 | 4.64 | 4.39 | 3.85 | | |
| PLACE1010081 | 2.74 | 4.1 | 3.7 | 6.85 | 7.81 | 4.59 | * | + |
| PLACE1010083 | 0.69 | 2.53 | 1.51 | 1.22 | 1.86 | 2.26 | | |
| PLACE1010089 | 1.86 | 4.89 | 3.35 | 3.45 | 3.47 | 3.48 | | |
| PLACE1010096 | 2.17 | 7.73 | 2.91 | 3.43 | 4.19 | 3.2 | | |
| PLACE1010102 | 3.89 | 10.9 | 5.33 | 7.1 | 9.64 | 7.57 | | |
| PLACE1010105 | 2.98 | 7.46 | 4.93 | 7.31 | 9.04 | 9.82 | | |
| PLACE1010106 | 2.46 | 2.95 | 4.48 | 5.47 | 4.88 | 5.8 | * | + |
| PLACE1010130 | 0.53 | 1.79 | 1.17 | 2.27 | 2.55 | 1.23 | | |
| PLACE1010132 | 2.49 | 4.65 | 5.3 | 5.07 | 4.39 | 4.19 | | |
| PLACE1010134 | 0.8 | 3.32 | 1.15 | 1.97 | 2.31 | 1.67 | | |
| PLACE1010139 | 6.67 | 10.51 | 12.98 | 14.99 | 16.1 | 14.58 | | |
| PLACE1010148 | 0.96 | 5.07 | 1.62 | 1.48 | 1.9 | 1.97 | | |
| PLACE1010152 | 3.11 | 5.68 | 5.16 | 6.33 | 6.64 | 5.76 | | |
| PLACE1010155 | 3.8 | 6.17 | 6.52 | 16.85 | 20.56 | 20.32 | ** | + |
| PLACE1010156 | 13.71 | 15.43 | 32.21 | 132.45 | 85.59 | 134.99 | ** | + |
| PLACE1010161 | 1.9 | 2.81 | 5.05 | 3.29 | 2.92 | 1.97 | | |
| PLACE1010181 | 0.73 | 2.22 | 1.51 | 2.58 | 1.99 | 2.53 | | |
| PLACE1010194 | 0.64 | 3.35 | 1.03 | 2.26 | 2.14 | 1.64 | | |
| PLACE1010202 | 0.4 | 4.14 | 1.2 | 2.91 | 1.65 | 2.16 | | |
| PLACE1010231 | 1.1 | 3.78 | 2.39 | 1.31 | 2.99 | 2.73 | | |
| PLACE1010235 | 1.26 | 4.24 | 1.94 | 2.68 | 2.42 | 3.16 | | |
| PLACE1010237 | 1.01 | 3.4 | 2.1 | 1.14 | 1.97 | 0.87 | | |
| PLACE1010251 | 0.59 | 0.98 | 1.95 | 2.57 | 3.18 | 1.62 | | |
| PLACE1010261 | 0.97 | 2.63 | 2.07 | 2.69 | 1.69 | 1.55 | | |
| PLACE1010270 | 0.76 | 2.7 | 1.3 | 1.39 | 2.33 | 1.42 | | |
| PLACE1010273 | 0.97 | 3.27 | 0.46 | 1.48 | 2.25 | 1.5 | | |
| PLACE1010274 | 6.28 | 9.23 | 9.66 | 10.49 | 12.18 | 14.28 | | |
| PLACE1010277 | 6.03 | 10.14 | 12.68 | 14.6 | 16.06 | 15.84 | * | + |
| PLACE1010293 | 1.8 | 5.68 | 3.55 | 3.65 | 3.37 | 3.96 | | |
| PLACE1010297 | 5.17 | 11.37 | 21 | 24.84 | 32.59 | 22.06 | | |
| PLACE1010300 | 4.18 | 4.78 | 8.22 | 8 | 9.95 | 6.87 | | |
| PLACE1010310 | 16.52 | 14.75 | 49.45 | 70.74 | 71 | 77.01 | * | + |
| PLACE1010321 | 2.03 | 4.92 | 2.46 | 3.37 | 4.99 | 2.73 | | |
| PLACE1010324 | 0.88 | 3.49 | 1.56 | 1.12 | 1.54 | 1.2 | | |
| PLACE1010329 | 0.73 | 4.64 | 1.95 | 2.56 | 3.37 | 1.96 | | |
| PLACE1010330 | 3.78 | 9.09 | 7.29 | 2.42 | 10.45 | 7.67 | | |
| PLACE1010335 | 6.43 | 11.15 | 7.43 | 13.15 | 17.89 | 19.1 | * | + |
| PLACE1010341 | 0.19 | 4.81 | 1.24 | 1.07 | 3.13 | 1.54 | | |
| PLACE1010342 | 0.77 | 0.9 | 0.75 | 0.48 | 2.12 | 0.8 | | |
| PLACE1010346 | 1.47 | 1.73 | 3.61 | 2.96 | 4.47 | 1.71 | | |
| PLACE1010362 | 1.31 | 2.69 | 2.22 | 2.18 | 3.49 | 3.31 | | |
| PLACE1010364 | 0.78 | 2.56 | 1.65 | 1.19 | 2.32 | 1.49 | | |
| PLACE1010368 | 1.66 | 5.44 | 3.51 | 3.41 | 3.87 | 4.48 | | |
| PLACE1010373 | 9.05 | 10.48 | 16.82 | 12.13 | 15.45 | 12.28 | | |
| PLACE1010383 | 1.91 | 5.52 | 5.13 | 5.58 | 6.39 | 4.9 | | |
| PLACE1010385 | 0.3 | 3.01 | 1.07 | 0.04 | 0.6 | 0.9 | | |
| PLACE1010389 | 6.28 | 7.98 | 13.24 | 22.3 | 13.64 | 22.94 | * | + |
| PLACE1010401 | 0.73 | 2.72 | 1.32 | 1.99 | 2.87 | 2.21 | | |
| PLACE1010410 | 3.15 | 4.83 | 6.71 | 4.78 | 7.55 | 7.32 | | |
| PLACE1010418 | 1.88 | 4.73 | 4.2 | 4.71 | 5.14 | 4.66 | | |
| PLACE1010425 | 0.93 | 4.78 | 1.43 | 1.78 | 1.96 | 2.15 | | |
| PLACE1010443 | 6.98 | 13.83 | 51.39 | 36.22 | 63.67 | 48.93 | | |
| PLACE1010445 | 0.95 | 5.02 | 0.68 | 2.69 | 3.81 | 2.44 | | |
| PLACE1010481 | 1.19 | 2.06 | 2.46 | 1.75 | 2 | 1.85 | | |
| PLACE1010482 | 28.99 | 29.39 | 53.06 | 31.75 | 19.63 | 40.44 | | |
| PLACE1010491 | 3.36 | 6.4 | 5.38 | 4.96 | 5.98 | 3.26 | | |
| PLACE1010492 | 4 | 4.75 | 5.95 | 5.57 | 8.15 | 7.77 | | |
| PLACE1010509 | 0.8 | 4.32 | 3.15 | 3.09 | 3.01 | 2.99 | | |
| PLACE1010518 | 3.33 | 6.72 | 6.58 | 7.3 | 8.25 | 8.24 | | |
| PLACE1010522 | 2.3 | 5.96 | 4.35 | 1.87 | 3.52 | 2.64 | | |
| PLACE1010529 | 1.8 | 6.5 | 3.84 | 5.43 | 8.44 | 7.2 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1010547 | 0.79 | 1.57 | 1.76 | 1.51 | 1.93 | 2.45 | | |
| PLACE1010560 | 0.63 | 2.51 | 2.06 | 3.31 | 2.2 | 2.51 | | |
| PLACE1010562 | 0.74 | 2.68 | 1.65 | 1.64 | 2.1 | 1.63 | | |
| PLACE1010579 | 1.11 | 7.13 | 2.63 | 3.45 | 4.67 | 3.26 | | |
| PLACE1010580 | 1.35 | 9.12 | 3.79 | 3.27 | 2.49 | 4.52 | | |
| PLACE1010599 | 3.56 | 6.07 | 7.94 | 8.32 | 9.26 | 8.13 | | |
| PLACE1010606 | 1.17 | 4.42 | 1.64 | 3.39 | 4.17 | 3.51 | | |
| PLACE1010616 | 1.84 | 3.72 | 5.49 | 4.09 | 8.09 | 6.81 | | |
| PLACE1010622 | 2.1 | 3.43 | 3.91 | 5.07 | 4.74 | 4.69 | * | + |
| PLACE1010624 | 1.43 | 3.35 | 3.98 | 4.21 | 6.17 | 5.22 | | |
| PLACE1010628 | 1.37 | 3.97 | 2.83 | 2.14 | 3.63 | 4.22 | | |
| PLACE1010629 | 1.08 | 4.64 | 2.24 | 3.01 | 3.3 | 3.5 | | |
| PLACE1010630 | 1.64 | 4.77 | 3.69 | 4.22 | 4.78 | 5.29 | | |
| PLACE1010631 | 0.5 | 5.35 | 2.64 | 1.55 | 1.66 | 2.67 | | |
| PLACE1010651 | 14.24 | 15.75 | 24.44 | 37.62 | 40.09 | 52.12 | * | + |
| PLACE1010661 | 1.62 | 4.09 | 2.28 | 3.56 | 6.43 | 3.22 | | |
| PLACE1010662 | 1.32 | 2.48 | 1.6 | 2.98 | 2.3 | 1.61 | | |
| PLACE1010668 | 12.87 | 15.91 | 27.82 | 37.63 | 30.53 | 28.75 | | |
| PLACE1010702 | 1.46 | 2.34 | 4.24 | 3.59 | 3.6 | 3.2 | | |
| PLACE1010709 | 79.16 | 78.33 | 115.91 | 107.07 | 96.3 | 133.25 | | |
| PLACE1010713 | 7 | 10.81 | 14.7 | 9.14 | 8.16 | 15.14 | | |
| PLACE1010714 | 0.82 | 7.41 | 1.58 | 1.75 | 2.04 | 1.47 | | |
| PLACE1010716 | 0.71 | 6.19 | 4.31 | 2.08 | 2.3 | 1.93 | | |
| PLACE1010717 | 0.9 | 6.49 | 2.13 | 2.17 | 3.9 | 2.61 | | |
| PLACE1010720 | 14.03 | 17.05 | 53.79 | 46.72 | 50.7 | 41.49 | | |
| PLACE1010739 | 0.9 | 1.2 | 1.11 | 1.73 | 1.21 | 1.93 | | |
| PLACE1010743 | 1.09 | 2.3 | 1.99 | 2.63 | 2.05 | 2.21 | | |
| PLACE1010752 | 0.87 | 2.92 | 1.85 | 1.76 | 2.05 | 1.53 | | |
| PLACE1010761 | 3.6. | 8.83 | 13.51 | 12.07 | 16.4 | 17.08 | | |
| PLACE1010771 | 1.41 | 6.89 | 5.03 | 6.13 | 10.3 | 5.42 | | |
| PLACE1010784 | 0.9 | 9.66 | 1.97 | 2.07 | 1.72 | 1.34 | | |
| PLACE1010786 | 1.21 | 8.77 | 2.83 | 2.91 | 3.68 | 2.21 | | |
| PLACE1010789 | 0.6 | 1.16 | 1.52 | 1.8 | 1.89 | 1.17 | | |
| PLACE1010800 | 2.18 | 2.86 | 3.25 | 3.95 | 3.24 | 2.93 | | |
| PLACE1010802 | 2.97 | 4.63 | 5.31 | 5.72 | 4.27 | 3.3 | | |
| PLACE1010811 | 0.89 | 2.19 | 1.96 | 1.83 | 1.75 | 2.18 | | |
| PLACE1010813 | 8.89 | 13.3 | 55.85 | 48.82 | 72.26 | 46.7 | | |
| PLACE1010827 | 1.54 | 6.43 | 3.94 | 4.3 | 5.52 | 4.81 | | |
| PLACE1010833 | 0.93 | 8.13 | 2.63 | 2.68 | 3.64 | 2.09 | | |
| PLACE1010839 | 1.57 | 6.22 | 3.21 | 4.22 | 6.72 | 4.13 | | |
| PLACE1010856 | 7.58 | 8.94 | 12.34 | 8.02 | 6.53 | 8.59 | | |
| PLACE1010857 | 3.41 | 3.81 | 7.63 | 8.24 | 5.98 | 4.56 | | |
| PLACE1010870 | 1.3 | 2.24 | 2.05 | 1.62 | 2.38 | 1.94 | | |
| PLACE1010877 | 1.67 | 4.66 | 2.69 | 2.77 | 3.92 | 2.62 | | |
| PLACE1010882 | 0.49 | 4.8 | 0.99 | 1.74 | 1.27 | 0.51 | | |
| PLACE1010891 | 1.1 | 7.73 | 1.12 | 1.85 | 1.73 | 0.95 | | |
| PLACE1010896 | 1.19 | 5.29 | 3.18 | 3.98 | 3.05 | 3.47 | | |
| PLACE1010900 | 7.41 | 13.29 | 27.9 | 23.88 | 20.99 | 18.85 | | |
| PLACE1010916 | 1.55 | 1.18 | 2.06 | 1.89 | 1.9 | 2.2 | | |
| PLACE1010917 | −0.04 | 0.82 | 0.36 | 1.05 | 2.25 | 0.56 | | |
| PLACE1010924 | 1.15 | 2.31 | 1.55 | 1.11 | 1.88 | 0.92 | | |
| PLACE1010925 | 2.76 | 5.36 | 2.17 | 4.92 | 6.32 | 4.16 | | |
| PLACE1010926 | 1.8 | 5.73 | 4.31 | 5.37 | 4.35 | 4.45 | | |
| PLACE1010942 | 1.7 | 6.25 | 5.63 | 5.53 | 7.88 | 7.69 | | |
| PLACE1010943 | 7.38 | 10.43 | 17.12 | 24.62 | 29.5 | 31.96 | ** | + |
| PLACE1010944 | 4.33 | 7.39 | 9.3 | 13.11 | 11.44 | 15.58 | * | + |
| PLACE1010947 | 1.43 | 0.9 | 2.41 | 2.57 | 2.8 | 2.25 | | |
| PLACE1010954 | 3.56 | 2.92 | 7.4 | 7.92 | 8.55 | 7.64 | | |
| PLACE1010960 | 2.06 | 3.44 | 6.07 | 4.23 | 7.89 | 2.6 | | |
| PLACE1010965 | 2.33 | 3.81 | 3.54 | 6.09 | 4.92 | 5.03 | * | + |
| PLACE1010968 | 1.55 | 4.69 | 1.38 | 4.95 | 6.51 | 3.68 | | |
| PLACE1010978 | 3.63 | 6.12 | 7.05 | 9 | 8.94 | 6.45 | | |
| PLACE1010982 | 2.23 | 5.77 | 5.6 | 4.74 | 5.66 | 4.88 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1010990 | 0.88 | 5.4 | 2.04 | 3.11 | 3.03 | 2.19 | | |
| PLACE1011017 | 5.6 | 3.78 | 22.57 | 25.64 | 35.47 | 20.97 | | |
| PLACE1011019 | 1.1 | 1.5 | 2.48 | 3.78 | 4.42 | 0.88 | | |
| PLACE1011026 | 4.17 | 4.93 | 6.23 | 6 | 5.19 | 2.74 | | |
| PLACE1011032 | 0.89 | 3.95 | 2.03 | 1.44 | 1.58 | 0.56 | | |
| PLACE1011041 | 1.07 | 4.13 | 1.03 | 1.69 | 1.22 | 1.43 | | |
| PLACE1011045 | 1.49 | 5.62 | 2.36 | 3.26 | 3.67 | 4.45 | | |
| PLACE1011046 | 0.83 | 5.25 | 1.79 | 2.57 | 3.17 | 1.87 | | |
| PLACE1011054 | 2.33 | 5.33 | 6.64 | 5.26 | 7.29 | 5.05 | | |
| PLACE1011056 | 5.78 | 5.43 | 16.22 | 14.56 | 19.78 | 15.67 | | |
| PLACE1011057 | 2 | 2.18 | 3.5 | 3.29 | 5.68 | 3.9 | | |
| PLACE1011059 | 0.93 | 1.37 | 1.56 | 1.74 | 2.96 | 1.79 | | |
| PLACE1011066 | 4.49 | 5.74 | 6.76 | 5.38 | 7.72 | 5.49 | | |
| PLACE1011087 | 7.6 | 7.04 | 16.48 | 12.43 | 17.42 | 9.79 | | |
| PLACE1011090 | 2.98 | 6.14 | 6.74 | 3.36 | 4.13 | 3.26 | | |
| PLACE1011109 | 1.99 | 7.29 | 4.29 | 4.08 | 7.96 | 3.83 | | |
| PLACE1011114 | 1.62 | 4.4 | 3.13 | 3.33 | 4.68 | 3.29 | | |
| PLACE1011116 | 4.89 | 5.94 | 6.66 | 7.43 | 6.81 | 8.98 | | |
| PLACE1011122 | 0.93 | 2.52 | 1.84 | 2.1 | 1.61 | 1.64 | | |
| PLACE1011133 | 0.83 | 2.22 | 3.03 | 3.48 | 3.52 | 2.77 | | |
| PLACE1011134 | 12.47 | 15.29 | 66.86 | 44.95 | 68.68 | 51.65 | | |
| PLACE1011143 | 0.68 | 4.53 | 1.48 | 1.84 | 2.62 | 1.41 | | |
| PLACE1011146 | 0.91 | 5.93 | 1.74 | 1.97 | 3.23 | 2.36 | | |
| PLACE1011160 | 1.67 | 7.36 | 3.81 | 3.42 | 4.53 | 4.24 | | |
| PLACE1011165 | 1.77 | 2.34 | 3.39 | 2.15 | 3.39 | 3.8 | | |
| PLACE1011181 | 5.25 | 8.31 | 37.21 | 29.38 | 38.44 | 30.55 | | |
| PLACE1011185 | 2.47 | 4 | 3.57 | 4.66 | 5.15 | 4.8 | * | + |
| PLACE1011186 | 13.16 | 12.8 | 16.45 | 21.18 | 25.69 | 28.83 | * | + |
| PLACE1011203 | 1.08 | 4.64 | 2.19 | 1.75 | 2.94 | 1.96 | | |
| PLACE1011214 | 9.02 | 16.55 | 59.24 | 46.39 | 62.58 | 47.89 | | |
| PLACE1011219 | 1.41 | 4.91 | 3.6 | 3.26 | 4.96 | 2.9 | | |
| PLACE1011221 | 2.68 | 5.47 | 6.15 | 6.23 | 8.57 | 7.51 | | |
| PLACE1011229 | 1.38 | 4.2 | 2.69 | 2.43 | 2.43 | 3.09 | | |
| PLACE1011231 | 0.53 | 1.5 | 1.62 | 1.84 | 2.59 | 2.4 | | |
| PLACE1011236 | 5.69 | 7.9 | 43.53 | 33.48 | 56.77 | 44.25 | | |
| PLACE1011247 | 8.36 | 10.08 | 19.16 | 24.17 | 26.33 | 29.74 | * | + |
| PLACE1011263 | 0.57 | 6.43 | 4.23 | 2.62 | 4.11 | 5.09 | | |
| PLACE1011273 | 0.72 | 3.62 | 1.17 | 2.01 | 1.64 | 1.72 | | |
| PLACE1011278 | 2.42 | 5 | 6.12 | 3.98 | 4.84 | 4.31 | | |
| PLACE1011289 | 2.73 | 5.84 | 7.57 | 6.34 | 6.13 | 6.08 | | |
| PLACE1011291 | 3.2 | 5.19 | 8.31 | 7.32 | 8.04 | 7.95 | | |
| PLACE1011296 | 0.93 | 2.45 | 1.94 | 1.76 | 2.63 | 2.05 | | |
| PLACE1011310 | 1.72 | 2.64 | 3.36 | 4.51 | 2.77 | 4.48 | | |
| PLACE1011311 | 1.8 | 3.97 | 6.33 | 7.8 | 9.34 | 6.73 | | |
| PLACE1011321 | 1.29 | 4.77 | 3.5 | 3.3 | 2.63 | 3.33 | | |
| PLACE1011325 | 0.63 | 4.2 | 1.84 | 2 | 2.74 | 1.59 | | |
| PLACE1011332 | 5.65 | 10.55 | 9.4 | 14.8 | 14.57 | 15.04 | * | + |
| PLACE1011340 | 0.86 | 4.88 | 3.38 | 3.81 | 4.71 | 3.47 | | |
| PLACE1011353 | 5.39 | 5.53 | 8.39 | 10.06 | 8.58 | 4.43 | | |
| PLACE1011360 | 1.09 | 3.29 | 2.18 | 2.11 | 3.06 | 2.41 | | |
| PLACE1011364 | 4.88 | 5.69 | 7.92 | 6.34 | 4.57 | 4.57 | | |
| PLACE1011365 | 0.92 | 3.36 | 2.95 | 3.01 | 3.6 | 2.06 | | |
| PLACE1011371 | 9.37 | 10.69 | 63.06 | 56.51 | 87.51 | 64.33 | | |
| PLACE1011375 | 1.62 | 9.37 | 3.35 | 2.61 | 2.74 | 1.62 | | |
| PLACE1011386 | 3.91 | 12.96 | 4.18 | 6.88 | 5.51 | 5.93 | | |
| PLACE1011399 | 1.52 | 10.14 | 4.27 | 2.12 | 4.22 | 3.77 | | |
| PLACE1011406 | 1.25 | 2.05 | 1.81 | 5.03 | 3.26 | 2.38 | | |
| PLACE1011407 | 0.64 | 2.05 | 2.58 | 2.08 | 2.19 | 2.02 | | |
| PLACE1011419 | 2.83 | 3.2 | 6.02 | 6.23 | 4.18 | 3.72 | | |
| PLACE1011433 | 3.09 | 4.43 | 6.13 | 3.41 | 4.74 | 4.99 | | |
| PLACE1011440 | 0.77 | 5.81 | 2.48 | 2.1 | 2.24 | 2.27 | | |
| PLACE1011452 | 1.06 | 8.86 | 2.43 | 2.87 | 2.71 | 2.68 | | |
| PLACE1011465 | 0.09 | 8.53 | 1.96 | 1.04 | 1.68 | 0.85 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1011472 | 1.52 | 7.67 | 3.98 | 0.97 | 2.87 | 1.59 | | |
| PLACE1011477 | 11.18 | 12.29 | 54.35 | 31.86 | 55.86 | 45.67 | | |
| PLACE1011478 | 1.24 | 1.64 | 3.11 | 5.03 | 3.02 | 3.01 | | |
| PLACE1011492 | 2.24 | 3.54 | 5.01 | 5.45 | 6.74 | 5.27 | | |
| PLACE1011498 | 0.57 | 2.77 | 0.98 | 1.18 | 1.69 | 1.15 | | |
| PLACE1011501 | 0.49 | 4.67 | 1.8 | 4.87 | 5.63 | 7.5 | | |
| PLACE1011503 | 0.44 | 5.37 | 0.79 | 0.5 | 0.82 | 0.35 | | |
| PLACE1011509 | 1.1 | 7.8 | 3.38 | 4.62 | 5.08 | 5.74 | | |
| PLACE1011514 | 5.86 | 11.61 | 11.98 | 13 | 17.7 | 13.17 | | |
| PLACE1011516 | 10.37 | 13.29 | 18.32 | 18.32 | 8.08 | 3.63 | | |
| PLACE1011520 | 0.34 | 0.95 | 1.34 | 1.3 | 1.73 | 1.01 | | |
| PLACE1011538 | 52.87 | 99.27 | 185.04 | 129.45 | 86.87 | 63.9 | | |
| PLACE1011555 | 0.87 | 2.88 | 2.83 | 1.55 | 2.03 | 1.48 | | |
| PLACE1011561 | 3.2 | 4.53 | 1.98 | 6.81 | 5.31 | 3.08 | | |
| PLACE1011563 | 1.35 | 4.74 | 3.49 | 2.52 | 2.64 | 2.87 | | |
| PLACE1011567 | 1.04 | 4.94 | 3.36 | 2.75 | 4.19 | 2.77 | | |
| PLACE1011569 | 0.32 | 4.35 | 2.77 | 2.38 | 2.46 | 2.28 | | |
| PLACE1011576 | 3.25 | 1.88 | 7.94 | 7.85 | 9.1 | 8.03 | | |
| PLACE1011586 | 3.24 | 2.5 | 6.22 | 4.43 | 4.35 | 2.94 | | |
| PLACE1011635 | 1.85 | 2.56 | 4.53 | 9.96 | 12.43 | 8.71 | ** | + |
| PLACE1011641 | 0.43 | 2.9 | 0.9 | 1.71 | 1.18 | 1.19 | | |
| PLACE1011642 | 5.05 | 6.96 | 10.37 | 12.13 | 10.86 | 10.09 | | |
| PLACE1011643 | 1.29 | 3.69 | 1.14 | 2.38 | 2.28 | 2.14 | | |
| PLACE1011646 | 8.68 | 12.8 | 30.53 | 39.05 | 54.16 | 37.76 | * | + |
| PLACE1011649 | 1.35 | 5.7 | 3.88 | 4.5 | 4.61 | 5.46 | | |
| PLACE1011650 | 1.15 | 1.45 | 2.54 | 2.47 | 3.24 | 3.75 | | |
| PLACE1011661 | 1.02 | 2.26 | 2.8 | 3.95 | 5.92 | 3.46 | | |
| PLACE1011664 | 2.21 | 3.18 | 3.99 | 5.31 | 3.93 | 1.73 | | |
| PLACE1011672 | 0.88 | 4.14 | 0.72 | 2.69 | 3.57 | 2.04 | | |
| PLACE1011675 | 0.51 | 2.31 | 1.32 | 1.66 | 0.99 | 0.83 | | |
| PLACE1011682 | 2.04 | 4.56 | 2.23 | 2.22 | 4.03 | 2.12 | | |
| PLACE1011708 | 1.1 | 5.89 | 3.8 | 5.5 | 8.12 | 4.66 | | |
| PLACE1011719 | 1.07 | 4.58 | 1.66 | 3.55 | 3.88 | 3.03 | | |
| PLACE1011725 | 1.23 | 1.19 | 2.72 | 3.73 | 5.19 | 4.3 | * | + |
| PLACE1011729 | 0.86 | 1.03 | 1.8 | 2.38 | 3.26 | 1.22 | | |
| PLACE1011741 | 2.36 | 3.67 | 3.64 | 4.16 | 2.52 | 4.23 | | |
| PLACE1011749 | 1.58 | 3.89 | 4.09 | 3.49 | 4.85 | 3.27 | | |
| PLACE1011757 | 20.92 | 30.53 | 55.88 | 56.6 | 55.88 | 49.59 | | |
| PLACE1011762 | 0.4 | 4.34 | 2.69 | 3.91 | 2.14 | 2.3 | | |
| PLACE1011778 | 0.51 | 4.39 | 1.99 | 1.34 | 2.02 | 1.34 | | |
| PLACE1011783 | 2.59 | 4.63 | 5.46 | 4.8 | 8.41 | 5.55 | | |
| PLACE1011795 | 0.74 | 1.28 | 2.24 | 1.47 | 1.8 | 1.22 | | |
| PLACE1011810 | 9.28 | 10.82 | 19.51 | 13.32 | 17.73 | 15.47 | | |
| PLACE1011824 | 5.38 | 8.17 | 38.05 | 25.52 | 42.89 | 16.75 | | |
| PLACE1011825 | 10.61 | 16.39 | 22.6 | 17.63 | 18.92 | 16.07 | | |
| PLACE1011835 | 24.64 | 32.67 | 47.67 | 32.09 | 26.75 | 37.23 | | |
| PLACE1011836 | 18.11 | 18.97 | 31.43 | 33.14 | 47.23 | 13.95 | | |
| PLACE1011847 | 2.67 | 6.74 | 6.42 | 5.34 | 7.18 | 5.84 | | |
| PLACE1011855 | 0.9 | 6.06 | 3.53 | 3.23 | 4.47 | 3.49 | | |
| PLACE1011858 | 5.83 | 7.44 | 9.37 | 6.88 | 6.25 | 8.35 | | |
| PLACE1011874 | 1.35 | 3.14 | 3.55 | 4.18 | 5.28 | 4.65 | | |
| PLACE1011875 | 0.57 | 2.29 | 1.11 | 2.66 | 2.48 | 2.64 | | |
| PLACE1011877 | 3.8 | 5.03 | 4.4 | 7.67 | 6.8 | 9.97 | * | + |
| PLACE1011891 | 0.17 | 3.81 | 1.31 | 1.13 | 1.34 | 1.26 | | |
| PLACE1011896 | −0.1 | 5.22 | 1.45 | 0.19 | 1.07 | 0.32 | | |
| PLACE1011920 | 0.21 | 5.87 | 1.04 | 1.1 | 1.92 | 1.76 | | |
| PLACE1011922 | 2.4 | 4.18 | 4.72 | 3.72 | 2.88 | 3.98 | | |
| PLACE1011923 | 3.42 | 4.82 | 7.51 | 8.09 | 5.38 | 12.28 | | |
| PLACE1011937 | 3.16 | 2.24 | 3.76 | 3.81 | 5.58 | 4.64 | | |
| PLACE1011939 | 14.93 | 17.81 | 26.01 | 41.75 | 45.05 | 47.88 | ** | + |
| PLACE1011940 | 6.13 | 7.58 | 12.68 | 5.73 | 7 | 7.23 | | |
| PLACE1011962 | 3.28 | 7.83 | 7.35 | 6.39 | 8.38 | 8.01 | | |
| PLACE1011964 | 0.39 | 5.05 | 1.66 | 1.04 | 1.95 | 1.46 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE1011978 | 1.55 | 4.65 | 3.35 | 4.48 | 5.91 | 5.14 | | |
| PLACE1011980 | 2.1 | 4.62 | 6.07 | 3.95 | 4.91 | 5.35 | | |
| PLACE1011981 | 5.77 | 7.28 | 38.2 | 27.22 | 35.24 | 34.99 | | |
| PLACE1011982 | 0.83 | 3.1 | 2.23 | 1.82 | 2.59 | 1.57 | | |
| PLACE1011995 | 0.81 | 3.4 | 3.73 | 2.51 | 3.59 | 2.86 | | |
| PLACE1012023 | 1.38 | 5.37 | 1.87 | 2.09 | 2.46 | 1.91 | | |
| PLACE1012026 | 1.95 | 5.72 | 4.23 | 6.08 | 9.51 | 9.8 | | |
| PLACE1012031 | 2.49 | 5.81 | 4.54 | 4.34 | 6.35 | 4.03 | | |
| PLACE2000003 | 1.18 | 3.64 | 6.86 | 7.38 | 8.12 | 8.92 | | |
| PLACE2000005 | 1.16 | 2.41 | 2.16 | 2.76 | 2.03 | 1.89 | | |
| PLACE2000006 | 2.52 | 4.13 | 15.6 | 11.34 | 16.58 | 13.4 | | |
| PLACE2000007 | 0.96 | 4.85 | 4.24 | 3.94 | 5.13 | 3.33 | | |
| PLACE2000011 | 1.72 | 3.27 | 3.34 | 4.3 | 5.06 | 3.62 | | |
| PLACE2000014 | 4.04 | 5.93 | 23.94 | 27.19 | 30.87 | 30.97 | * | + |
| PLACE2000015 | 1.27 | 4.79 | 3.52 | 2.77 | 3.31 | 2.69 | | |
| PLACE2000017 | 0.48 | 4.78 | 2.15 | 2.65 | 2.56 | 2.45 | | |
| PLACE2000021 | 1.99 | 5.06 | 4.09 | 3.72 | 6.24 | 5.61 | | |
| PLACE2000022 | 1.8 | 2.8 | 4.31 | 3.35 | 4.64 | 2.71 | | |
| PLACE2000030 | 9.37 | 11.08 | 71.38 | 55.43 | 60.32 | 35.97 | | |
| PLACE2000032 | 1.23 | 2.89 | 3.51 | 3.53 | 3.24 | 2.32 | | |
| PLACE2000033 | 3.29 | 6.3 | 12.11 | 12.49 | 14.25 | 9.37 | | |
| PLACE2000034 | 0.6 | 4.3 | 1.92 | 1.79 | 2.19 | 2.44 | | |
| PLACE2000039 | 2.75 | 8.06 | 3.92 | 6.27 | 8.01 | 4.81 | | |
| PLACE2000043 | 7 | 11.08 | 22.94 | 19.27 | 26.58 | 17.38 | | |
| PLACE2000044 | 0.63 | 6.92 | 1.12 | 1.8 | 1.71 | 1.29 | | |
| PLACE2000047 | 0.84 | 5.25 | 5.15 | 5.4 | 6.46 | 7.32 | | |
| PLACE2000050 | 1.48 | 2.68 | 4.78 | 2.92 | 2.98 | 1.2 | | |
| PLACE2000061 | 0.47 | 2.07 | 1.17 | 0.95 | 1.34 | 0.25 | | |
| PLACE2000062 | 1.99 | 2.83 | 4.12 | 4.89 | 4.4 | 3.09 | | |
| PLACE2000072 | 0.78 | 2.45 | 1.57 | 1.85 | 1.62 | 1.69 | | |
| PLACE2000073 | 0.89 | 5.86 | 2.86 | 2.8 | 2.61 | 3.07 | | |
| PLACE2000097 | 8.54 | 19.93 | 23.93 | 27.69 | 35.36 | 26.36 | | |
| PLACE2000100 | 1.87 | 7.79 | 3.53 | 4.23 | 6.29 | 4.22 | | |
| PLACE2000103 | 1.03 | 7.44 | 2.25 | 3.51 | 5.17 | 4.38 | | |
| PLACE2000106 | 1.53 | 2.42 | 4.19 | 5.71 | 3.29 | 4.01 | | |
| PLACE2000111 | 2.05 | 3.17 | 4.37 | 4.07 | 6.6 | 4.75 | | |
| PLACE2000115 | 0.3 | 2.06 | 0.75 | 0.31 | 1.29 | 0.97 | | |
| PLACE2000118 | 10.15 | 17.04 | 21.09 | 13.73 | 15.21 | 22.01 | | |
| PLACE2000124 | 10.14 | 17.83 | 62.13 | 53.2 | 98.37 | 62.96 | | |
| PLACE2000132 | 0.06 | 6.26 | 1.48 | 0.99 | 1.5 | 1.56 | | |
| PLACE2000136 | 0.55 | 7.94 | 0.91 | 1.47 | 1.37 | 1.02 | | |
| PLACE2000137 | 0.96 | 4.46 | 2.4 | 2.65 | 4.12 | 3.14 | | |
| PLACE2000140 | 2.91 | 5.24 | 14.34 | 13.2 | 12.08 | 9.43 | | |
| PLACE2000147 | 1.49 | 1.52 | 2.83 | 1.06 | 0.97 | 1.12 | | |
| PLACE2000153 | 0.3 | 3.44 | 2.15 | 1.69 | 2.45 | 1.95 | | |
| PLACE2000164 | 0.66 | 2.78 | 1.13 | 2.66 | 1.62 | 1.62 | | |
| PLACE2000170 | 1.54 | 6.18 | 4.69 | 5.26 | 9.09 | 6.24 | | |
| PLACE2000172 | 0.33 | 4.34 | 2.15 | 1.25 | 1.93 | 2.43 | | |
| PLACE2000173 | 0.92 | 4.97 | 3.37 | 3.33 | 3.71 | 2.74 | | |
| PLACE2000174 | 1.17 | 4.68 | 2.43 | 1.85 | 2.89 | 2.05 | | |
| PLACE2000176 | 1.22 | 1.57 | 2.58 | 3.28 | 2.27 | 1.42 | | |
| PLACE2000187 | 1.01 | 2.08 | 2.55 | 3.45 | 3.66 | 2.19 | | |
| PLACE2000216 | 7.03 | 9.28 | 11.47 | 14.09 | 9.13 | 3.68 | | |
| PLACE2000219 | 0.69 | 4.02 | 2.72 | 3.55 | 3.58 | 2.3 | | |
| PLACE2000221 | 2.49 | 6.81 | 6.53 | 7.22 | 9.33 | 8.56 | | |
| PLACE2000223 | 0.72 | 3.2 | 1.71 | 1.16 | 1.05 | 0.48 | | |
| PLACE2000231 | 1.02 | 3.97 | 3.11 | 3.43 | 2.61 | 2.47 | | |
| PLACE2000235 | 1.82 | 5.27 | 6.17 | 6.02 | 7.45 | 6.97 | | |
| PLACE2000246 | 1.93 | 2 | 6.06 | 4.58 | 5.09 | 3.93 | | |
| PLACE2000264 | 0.67 | 1.39 | 1.85 | 2.45 | 3.74 | 3 | * | + |
| PLACE2000274 | 0.65 | 2.4 | 2.12 | 3.09 | 4.11 | 2.1 | | |
| PLACE2000287 | 0.81 | 4.44 | 1.49 | 2 | 2.59 | 1.34 | | |
| PLACE2000296 | 1.01 | 4.56 | 1.55 | 2.5 | 3.16 | 1.69 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and –, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE2000302 | 1.34 | 4.67 | 2.86 | 3.52 | 3.35 | 3.45 | | |
| PLACE2000305 | 3.09 | 6.65 | 5.42 | 6.3 | 7.15 | 5.02 | | |
| PLACE2000317 | 0.92 | 6.34 | 2.26 | 3.15 | 2.95 | 2.4 | | |
| PLACE2000324 | 1.19 | 1.25 | 3.09 | 4.2 | 5.84 | 3.3 | | |
| PLACE2000334 | 3.52 | 5 | 6.6 | 7.33 | 8.12 | 5.88 | | |
| PLACE2000335 | 1.47 | 4.35 | 4.24 | 5.68 | 6.25 | 4.76 | | |
| PLACE2000340 | 0.64 | 3.47 | 1.63 | 1.58 | 1.52 | 1.65 | | |
| PLACE2000341 | 4.21 | 7.87 | 28.81 | 18.94 | 32.45 | 19.16 | | |
| PLACE2000342 | 2.07 | 5.11 | 4.32 | 4.84 | 5.82 | 4.49 | | |
| PLACE2000347 | 1.24 | 5.26 | 5.58 | 7.83 | 6.22 | 7.55 | | |
| PLACE2000357 | 8.49 | 13.56 | 15.35 | 17.83 | 18.98 | 21.24 | * | + |
| PLACE2000358 | 2.87 | 3.65 | 8.67 | 4.88 | 7.63 | 4.37 | | |
| PLACE2000359 | 1.27 | 1.79 | 4.45 | 3.28 | 6.65 | 3.61 | | |
| PLACE2000366 | 1.93 | 3.14 | 3.22 | 3.99 | 5.6 | 4.17 | | |
| PLACE2000371 | 4.29 | 5.2 | 6.08 | 5.95 | 9.06 | 7.32 | | |
| PLACE2000373 | 1.91 | 4.8 | 5.98 | 5.69 | 6.29 | 4.19 | | |
| PLACE2000374 | 1.86 | 5.17 | 2.78 | 1.62 | 2.79 | 1.49 | | |
| PLACE2000379 | 0.34 | 4.85 | 1.32 | 1.28 | 0.92 | 0.04 | | |
| PLACE2000386 | 39.29 | 43.92 | 84.66 | 87.53 | 104.55 | 76.56 | | |
| PLACE2000388 | 1.96 | 3.35 | 3.89 | 2.78 | 3.48 | 3.49 | | |
| PLACE2000392 | 33.29 | 39.2 | 59.56 | 42.5 | 52.12 | 58.24 | | |
| PLACE2000394 | 1.26 | 3.27 | 3.01 | 5.69 | 4.35 | 4.34 | * | + |
| PLACE2000398 | 0.73 | 3.88 | 2.36 | 2.03 | 3.59 | 1.35 | | |
| PLACE2000399 | 3.7 | 6.82 | 7.01 | 7.15 | 7 | 6.79 | | |
| PLACE2000402 | 2.15 | 6.88 | 3.84 | 2.86 | 3.68 | 3.9 | | |
| PLACE2000404 | 5.2 | 9.96 | 10.67 | 10.03 | 11.04 | 6.47 | | |
| PLACE2000411 | 3.21 | 7.2 | 5.21 | 5.27 | 5.73 | 6.68 | | |
| PLACE2000418 | 0.73 | 2.28 | 2.41 | 2.22 | 3.07 | 2.37 | | |
| PLACE2000419 | 0.99 | 2.32 | 2.54 | 4.95 | 4.55 | 3.29 | * | + |
| PLACE2000425 | 1.26 | 3.98 | 3.11 | 4.28 | 4.81 | 5.2 | | |
| PLACE2000427 | 0.7 | 5.13 | 3.27 | 2.54 | 3.04 | 2.47 | | |
| PLACE2000433 | 0.77 | 7.05 | 2.6 | 2.33 | 3.09 | 2.46 | | |
| PLACE2000435 | 0.48 | 5.19 | 1.49 | 1.69 | 1.63 | 1.5 | | |
| PLACE2000438 | 1.61 | 4.74 | 3.66 | 2.33 | 2.81 | 3.15 | | |
| PLACE2000450 | 3.01 | 4.38 | 5.67 | 6.51 | 7.39 | 5.63 | | |
| PLACE2000455 | 0.24 | 2.62 | 1.24 | 1.65 | 2 | 1.82 | | |
| PLACE2000458 | 0.38 | 3.3 | 1.81 | 1.06 | 2.7 | 1.24 | | |
| PLACE2000464 | 2.15 | 4.91 | 5.3 | 7.43 | 9.68 | 8.83 | * | + |
| PLACE2000465 | 1.43 | 6.72 | 6 | 6.51 | 8.27 | 6.31 | | |
| PLACE2000473 | 120.94 | 179.35 | 328.3 | 214.7 | 297.75 | 279.74 | | |
| PLACE2000477 | 0.43 | 3.87 | 1.34 | 1.13 | 2.22 | 0.97 | | |
| PLACE3000004 | 2.22 | 4.63 | 6.39 | 5.27 | 7.51 | 5.2 | | |
| PLACE3000009 | 19.91 | 19.71 | 105.63 | 77.31 | 40.99 | 92.95 | | |
| PLACE3000020 | 10.03 | 9.03 | 49.6 | 36.74 | 46.52 | 23.82 | | |
| PLACE3000029 | 6.59 | 9.63 | 24.88 | 14.88 | 18.47 | 20.04 | | |
| PLACE3000038 | 0.52 | 2.37 | 2.47 | 1.44 | 2.4 | 2.05 | | |
| PLACE3000052 | 5.13 | 7.95 | 23.92 | 25.01 | 29.61 | 24.94 | | |
| PLACE3000059 | 0.57 | 5 | 2.42 | 0.75 | 2.8 | 1.27 | | |
| PLACE3000067 | 2.51 | 5.79 | 7.44 | 5.66 | 8.53 | 7.75 | | |
| PLACE3000069 | 1.95 | 5.61 | 3.58 | 5.24 | 3.79 | 4.55 | | |
| PLACE3000070 | 2.57 | 5.57 | 9.04 | 9.5 | 10.42 | 10.57 | | |
| PLACE3000103 | 3.85 | 7.84 | 11.87 | 6.6 | 8.32 | 4.37 | | |
| PLACE3000119 | 1.59 | 2.74 | 3.15 | 3.24 | 3.67 | 2.95 | | |
| PLACE3000121 | 7.58 | 8.44 | 38.1 | 30.63 | 42.28 | 32.64 | | |
| PLACE3000124 | 1.53 | 4.54 | 5.95 | 6.35 | 7.75 | 7.18 | | |
| PLACE3000135 | 0.69 | 5.46 | 1.1 | 0.76 | 0.9 | 0.59 | | |
| PLACE3000136 | 0.77 | 10.46 | 4.46 | 2.12 | 2.77 | 2.01 | | |
| PLACE3000142 | 0.7 | 9.94 | 1.75 | 1.53 | 2.76 | 1.13 | | |
| PLACE3000145 | 8.69 | 17.55 | 55.33 | 42.85 | 49.12 | 39.96 | | |
| PLACE3000147 | 15.7 | 12.92 | 39.97 | 64.96 | 54.76 | 30.34 | | |
| PLACE3000148 | 0.7 | 2.08 | 1.48 | 0.82 | 1.4 | 1.38 | | |
| PLACE3000154 | 0.48 | 1.86 | 0.67 | 1.5 | 0.87 | 0.44 | | |
| PLACE3000155 | 1.28 | 4.26 | 2.53 | 3.97 | 4.76 | 3.04 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of $*:p < 0.05$ and $**:p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE3000156 | 1.11 | 7.96 | 2.07 | 1.96 | 3.4 | 2.81 | | |
| PLACE3000157 | 0.92 | 8.37 | 1.75 | 2.06 | 3.02 | 2.72 | | |
| PLACE3000158 | 1.73 | 8.82 | 5.05 | 3.81 | 5.63 | 4.77 | | |
| PLACE3000160 | 8.11 | 15.22 | 19.5 | 33.66 | 34.71 | 33.78 | ** | + |
| PLACE3000169 | 2.15 | 2.65 | 6.87 | 4.3 | 5.11 | 5.12 | | |
| PLACE3000181 | 1.06 | 2.14 | 3.94 | 3.22 | 2.62 | 3 | | |
| PLACE3000194 | 0.31 | 2.83 | 1.77 | 1.89 | 2.58 | 2.42 | | |
| PLACE3000197 | 1.18 | 2.66 | 2.09 | 2.42 | 2.46 | 2.21 | | |
| PLACE3000199 | 0.22 | 4.8 | 1.63 | 0.55 | 0.86 | 0.43 | | |
| PLACE3000205 | 11.79 | 17.95 | 57.49 | 51.4 | 63.83 | 42.63 | | |
| PLACE3000207 | 3.37 | 6.91 | 7.13 | 6.7 | 8.92 | 6.23 | | |
| PLACE3000208 | 2.26 | 4.96 | 2.66 | 5.28 | 5.97 | 5.84 | | |
| PLACE3000213 | 4.79 | 5.55 | 10.8 | 5.12 | 5.16 | 5.05 | | |
| PLACE3000215 | 1.88 | 5.02 | 5.71 | 4.74 | 5 | 3.03 | | |
| PLACE3000218 | 0 | 1.63 | 1.18 | 0.97 | 0.62 | 0.31 | | |
| PLACE3000220 | 1.96 | 3.55 | 4.58 | 6.74 | 7.52 | 6.69 | * | + |
| PLACE3000221 | 14.42 | 25.34 | 40.15 | 43.8 | 51.16 | 36.99 | | |
| PLACE3000225 | 1.15 | 4.68 | 3.11 | 2.11 | 2.67 | 1.28 | | |
| PLACE3000226 | 1.37 | 5.65 | 5.16 | 3.78 | 7.42 | 3.68 | | |
| PLACE3000230 | 0.83 | 3.46 | 1.36 | 2 | 2.8 | 1.73 | | |
| PLACE3000231 | 1.31 | 1.97 | 2.37 | 4.86 | 3.95 | 4.12 | ** | + |
| PLACE3000235 | 1.12 | 1.75 | 3.89 | 3.95 | 4.21 | 3.39 | | |
| PLACE3000242 | 2.6 | 5.11 | 9.24 | 9.46 | 10.97 | 8.29 | | |
| PLACE3000244 | 1.05 | 3.2 | 1.81 | 1.85 | 1.81 | 0.64 | | |
| PLACE3000253 | 0.7 | 3.75 | 1.64 | 2.67 | 2.11 | 1.27 | | |
| PLACE3000254 | 2.5 | 4.75 | 4.04 | 6.19 | 6.09 | 5.75 | * | + |
| PLACE3000271 | 2.67 | 6.06 | 6.81 | 10.96 | 10.99 | 9.5 | * | + |
| PLACE3000276 | 1.1 | 5.78 | 2.27 | 1.48 | 1.9 | 1.78 | | |
| PLACE3000304 | 5.55 | 4.69 | 10.81 | 11.19 | 11.49 | 10.5 | | |
| PLACE3000309 | 0.43 | 1.67 | 1.87 | 2.43 | 2.94 | 2.78 | * | + |
| PLACE3000310 | 2.19 | 2.19 | 3.73 | 4.84 | 4.81 | 3.4 | | |
| PLACE3000320 | 1.02 | 3.65 | 1.8 | 2.54 | 2.37 | 2.32 | | |
| PLACE3000322 | 1.31 | 4.23 | 6.63 | 7.5 | 7.8 | 6.09 | | |
| PLACE3000330 | 24.05 | 24.44 | 41.08 | 31.87 | 35.83 | 29.17 | | |
| PLACE3000331 | 1.21 | 5.86 | 4.14 | 4.34 | 5.7 | 4.31 | | |
| PLACE3000336 | 2.61 | 6.99 | 4.42 | 4.24 | 5.72 | 5.11 | | |
| PLACE3000339 | 7.36 | 5.1 | 11.41 | 16.25 | 18.28 | 17.37 | ** | + |
| PLACE3000341 | 1.65 | 1.32 | 2.41 | 4.08 | 4.35 | 3.65 | ** | + |
| PLAGB3000350 | 5.88 | 6.4 | 12.86 | 15.45 | 18.5 | 15.41 | * | + |
| PLACE3000352 | 1.54 | 3.88 | 2.13 | 2.37 | 2.25 | 1.71 | | |
| PLACE3000353 | 5.38 | 9.72 | 11.8 | 19.12 | 22.98 | 15.5 | * | + |
| PLACE3000362 | 0.62 | 4.92 | 4.72 | 3.61 | 5.33 | 3.39 | | |
| PLACE3000363 | 2.19 | 5.13 | 2.32 | 1.89 | 3.28 | 2.07 | | |
| PLACE3000365 | 1.34 | 6.11 | 3.37 | 3.34 | 4.05 | 2.12 | | |
| PLACE3000373 | 0.89 | 1.52 | 3.66 | 2.93 | 6.08 | 2.3 | | |
| PLACE3000374 | 1.07 | 1.85 | 2.91 | 2.72 | 2.99 | 2.15 | | |
| PLACE3000387 | 0.31 | 3.32 | 1.04 | 1.24 | 1.65 | 1.29 | | |
| PLACE3000388 | 1.18 | 3.22 | 1.94 | 2.76 | 3.49 | 2.22 | | |
| PLACE3000399 | 2.12 | 4.66 | 6.28 | 7.42 | 9.84 | 6.05 | | |
| PLACE3000400 | 3.08 | 5.44 | 11.87 | 7.97 | 10.77 | 7.82 | | |
| PLACE3000401 | 7.52 | 11.42 | 18.59 | 22.61 | 29.55 | 23.4 | * | + |
| PLACE3000402 | 1.79 | 3.21 | 3.4 | 2.19 | 1.74 | 1.79 | | |
| PLACE3000405 | 3.37 | 3.74 | 5.82 | 5.54 | 7.22 | 6.01 | | |
| PLACE3000406 | 2.1 | 2.91 | 3.11 | 3.48 | 3.68 | 2.42 | | |
| PLACE3000413 | 1.18 | 2.72 | 2.69 | 1.71 | 2.06 | 1.52 | | |
| PLACE3000416 | 1.05 | 4.03 | 4.04 | 3.43 | 2.67 | 2.72 | | |
| PLACE3000425 | 1.21 | 6.27 | 4.33 | 3.98 | 6.36 | 3.92 | | |
| PLACE3000437 | 4.79 | 10.85 | 29.89 | 16.69 | 25.26 | 19.14 | | |
| PLACE3000455 | 2.97 | 8.07 | 10.62 | 8.97 | 10.39 | 7.91 | | |
| PLACE3000475 | 16.52 | 19.2 | 47.35 | 40.22 | 39.77 | 34.21 | | |
| PLACE3000477 | 5.44 | 4.79 | 5.56 | 8.05 | 5.52 | 8.42 | | |
| PLACE4000003 | 0.38 | 2.97 | 1.61 | 3.14 | 2.33 | 2.31 | | |
| PLACE4000008 | 15.19 | 11.38 | 16.76 | 13.05 | 14.26 | 8.84 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE4000009 | 1.17 | 6.19 | 3.39 | 3.93 | 3.37 | 1.82 | | |
| PLACE4000014 | 1.31 | 5.12 | 1.77 | 2.16 | 3.03 | 2.19 | | |
| PLACE4000029 | 6.33 | 8.48 | 35.37 | 23.93 | 32.21 | 24.25 | | |
| PLACE4000034 | 2.27 | 6.24 | 5.22 | 6.46 | 6.52 | 4.91 | | |
| PLACE4000049 | 3.39 | 3.35 | 5.21 | 3.85 | 5.82 | 4.86 | | |
| PLACE4000052 | 1.41 | 3.36 | 2.2 | 2.62 | 2.64 | 2.02 | | |
| PLACE4000062 | 1.6 | 4.94 | 5.06 | 4.25 | 5.06 | 3.71 | | |
| PLACE4000063 | 2.59 | 6.87 | 5.19 | 4.86 | 4.81 | 3.73 | | |
| PLACE4000089 | 1.52 | 6.31 | 3.35 | 2.81 | 3.91 | 2.84 | | |
| PLACE4000093 | 0.44 | 5.6 | 1.61 | 1.28 | 1.65 | 1.98 | | |
| PLACE4000100 | 2.72 | 6.13 | 4.75 | 4.33 | 3.62 | 3.94 | | |
| PLACE4000103 | 0.63 | 4.48 | 5.64 | 4.4 | 5.67 | 2.9 | | |
| PLACE4000106 | 3.2 | 5.33 | 6.63 | 7.1 | 5.13 | 7.21 | | |
| PLACE4000128 | 1.93 | 3.97 | 4.88 | 4.15 | 4.96 | 4.4 | | |
| PLACE4000129 | 0.74 | 3.26 | 1.64 | 1.57 | 2.11 | 1.78 | | |
| PLACE4000131 | 7.14 | 10.85 | 41.43 | 32.45 | 41.08 | 31.22 | | |
| PLACE4000147 | 0.34 | 3.65 | 0.54 | 0.45 | 0.93 | 0.61 | | |
| PLACE4000156 | 2.47 | 6.08 | 8.06 | 7.83 | 13.47 | 9.07 | | |
| PLACE4000175 | 0.72 | 4.08 | 1.48 | 0.98 | 0.91 | 0.84 | | |
| PLACE4000190 | 14.55 | 18.47 | 70.34 | 49.15 | 74.82 | 60.76 | | |
| PLACE4000192 | 1.3 | 2.27 | 3.6 | 2.36 | 2 | 1.25 | | |
| PLACE4000206 | 5.35 | 6.65 | 12.44 | 7.13 | 7.1 | 6.02 | | |
| PLACE4000211 | 3.34 | 4.64 | 22.23 | 11.68 | 12.35 | 13.44 | | |
| PLACE4000214 | 0.86 | 3.61 | 2.68 | 2.08 | 2.53 | 1.69 | | |
| PLACE4000222 | 0.93 | 5.28 | 4.36 | 4.13 | 4.75 | 3.5 | | |
| PLACE4000223 | 0.46 | 4.51 | 1.79 | 1.37 | 1.22 | 0.38 | | |
| PLACE4000229 | 1.9 | 5.79 | 2.11 | 2.81 | 3.36 | 3.48 | | |
| PLACE4000230 | 1.11 | 5.89 | 6.51 | 3.61 | 6.81 | 5.15 | | |
| PLACE4000233 | 1.26 | 3.02 | 5.66 | 2.92 | 2.98 | 3.51 | | |
| PLACE4000239 | 2.35 | 3.68 | 4.17 | 4.19 | 3.97 | 3.35 | | |
| PLACE4000247 | 0.52 | 2.37 | 3.38 | 2.64 | 3.1 | 2.35 | | |
| PLACE4000250 | 1.18 | 3.24 | 2.35 | 3.33 | 3.68 | 2.8 | | |
| PLACE4000252 | 1.06 | 4.99 | 2.25 | 1.92 | 1.75 | 1.64 | | |
| PLACE4000259 | 4.42 | 11.95 | 18.1 | 14.47 | 22.09 | 14.02 | | |
| PLACE4000261 | 0.87 | 10.29 | 1.07 | 2.03 | 1.9 | 1.12 | | |
| PLACE4000264 | 15.86 | 24.96 | 36.9 | 11.96 | 21.82 | 22.51 | | |
| PLACE4000269 | 3.48 | 3.71 | 7.95 | 4.62 | 4.55 | 2.85 | | |
| PLACE4000270 | 0.43 | 1.42 | 1.87 | 1.75 | 1.83 | 0.59 | | |
| PLACE4000281 | 17.84 | 20.97 | 44.05 | 32.93 | 28.37 | 28.87 | | |
| PLACE4000300 | 0.67 | 2.06 | 2.04 | 3.21 | 2.88 | 3.58 | * | + |
| PLACE4000320 | 1.33 | 5.86 | 3.1 | 2.84 | 5.32 | 3.21 | | |
| PLACE4000323 | 1.63 | 7.43 | 5.13 | 4.03 | 4.65 | 4.82 | | |
| PLACE4000326 | 1.8 | 10.98 | 5.67 | 5.72 | 8.73 | 5.59 | | |
| PLACE4000344 | 0.22 | 5.75 | 2.62 | 1.66 | 1.6 | 1.18 | | |
| PLACE4000347 | 4.7 | 3.82 | 13.93 | 16.83 | 16.75 | 17.36 | * | + |
| PLACE4000354 | 3.18 | 6.29 | 10.68 | 5.17 | 2.81 | 2.79 | | |
| PLACE4000367 | 0.79 | 2.97 | 1.71 | 0.87 | 1.3 | 1.38 | | |
| PLACE4000369 | 1.35 | 3.97 | 2.36 | 1.99 | 1.96 | 0.82 | | |
| PLACE4000379 | 2.44 | 6.66 | 5.44 | 5.94 | 7.55 | 5.07 | | |
| PLACE4000387 | 0.88 | 5.86 | 2.11 | 1.28 | 0.84 | 1.12 | | |
| PLACE4000392 | 0.42 | 5.58 | 1.32 | 1.81 | 1.02 | 1.63 | | |
| PLACE4000399 | 10.99 | 17.08 | 75.17 | 59.1.18 | 0.22 | 58 | | |
| PLACE4000401 | 0.72 | 0.7 | 1.53 | 1.17 | 0.83 | 1.4 | | |
| PLACE4000403 | 3.15 | 4.13 | 8.51 | 5.29 | 6.38 | 5.87 | | |
| PLACE4000411 | 2.22 | 2.28 | 4 | 2.27 | 2.6 | 1.82 | | |
| PLACE4000415 | 0.7 | 3.55 | 2.8 | 1.16 | 1.86 | 0.78 | | |
| PLACE4000416 | 25.49 | 29.13 | 33.54 | 23.65 | 21.92 | 24.83 | | |
| PLACE4000424 | 1.61 | 5.59 | 3.33 | 3.27 | 3.92 | 2.51 | | |
| PLACE4000431 | 3.89 | 7.39 | 21.01 | 17.68 | 28.21 | 16.79 | | |
| PLACE4000443 | 0.07 | 4.33 | 2.15 | 1.52 | 2.83 | 1.14 | | |
| PLACE4000445 | 3.94 | 5.43 | 9.98 | 7.62 | 6.99 | 6.27 | | |
| PLACE4000450 | 2.99 | 3.65 | 23.28 | 15.51 | 24.53 | 16.04 | | |
| PLACE4000455 | 5.18 | 7.39 | 9.55 | 8 | 7.21 | 4.63 | | |

TABLE 343-continued

Expression of each cDNA in synovial cells or in the synovial cells in the
presence of TNF (This table also contains clones without description in Examples)
In the table, Synoviocyte and Synoviocyte_TNF represent synovial cells
and TNF-treated synovial cells, respectively. The assay was performed in triplicate
(n = 3), and each result is shown in the column of exp.1, exp.2, or exp.3. In
addition, "t-test vs TNF" represents a result of test for significance of
difference between the untreated synovial cells and the TNF-treated synovial cells.
The increase and decrease in the expression level of a particular gene in response
to TNF are represented by + and –, respectively. The results of test for
significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| PLACE4000465 | 1.39 | 4.34 | 3.26 | 4.15 | 6.07 | 4.34 | | |
| PLACE4000466 | 120.96 | 98.04 | 201.25 | 113.83 | 170.96 | 145.31 | | |
| PLACE4000472 | 3.12 | 9.6 | 10.17 | 10.92 | 13.21 | 9.22 | | |
| PLACE4000487 | 3.18 | 7.83 | 16.5 | 14.66 | 16.62 | 15.05 | | |
| PLACE4000489 | 0.93 | 4.69 | 3.41 | 1.95 | 3.88 | 1.69 | | |
| PLACE4000494 | 1.15 | 1.6 | 4.07 | 2.74 | 3.1 | 2.08 | | |
| PLACE4000502 | 6.3 | 5.39 | 10.92 | 11.65 | 15.08 | 6.37 | | |
| PLACE4000521 | 2.5 | 3.44 | 16.06 | 12.78 | 20.63 | 11.2 | | |
| PLACE4000522 | 5.07 | 6.17 | 9.07 | 12.43 | 8.68 | 14.11 | | |
| PLACE4000537 | 0.98 | 4.28 | 1.27 | 1.67 | 1.61 | 1.22 | | |
| PLACE4000548 | 1.99 | 5.69 | 2.46 | 3.04 | 3.68 | 2.32 | | |
| PLACE4000558 | 0.87 | 6.72 | 1.97 | 3.15 | 2.41 | 2.15 | | |
| PLACE4000581 | 2.1 | 7.22 | 7.04 | 3.9 | 5.96 | 5.44 | | |
| PLACE4000590 | 0.4 | 0.61 | 0.15 | 0.4 | 0.81 | −0.25 | | |
| PLACE4000593 | 2.94 | 2.98 | 5.22 | 4.44 | 5.82 | 3.83 | | |
| PLACE4000612 | 0.68 | 3.33 | 3.33 | 1.5 | 3.02 | 2.74 | | |
| PLACE4000638 | 1.25 | 4.24 | 0.84 | 1.2 | 1.44 | 1.58 | | |
| PLACE4000650 | 0.82 | 4.67 | 1.02 | 1.43 | 1.11 | 1.16 | | |
| PLACE4000651 | 2.42 | 6.4 | 7.48 | 5 | 7.01 | 6.07 | | |
| PLACE4000654 | 0.98 | 5.7 | 2.47 | 1.35 | 2.48 | 1.47 | | |
| PLACE4000670 | 0.5 | 4.06 | 2.92 | 0.76 | 1.29 | 0.67 | | |
| PLACE4000685 | 6.35 | 8.68 | 13.83 | 13.46 | 14.26 | 13.77 | | |
| PLACE4000687 | 0.37 | 3.02 | 1.11 | 2.2 | 1.4 | 1.12 | | |
| PLACE5000003 | 1.1 | 2.74 | 3.31 | 3.21 | 3.55 | 3.07 | | |
| PLACES000005 | 12.43 | 16.53 | 27.36 | 24.54 | 24.57 | 24.76 | | |
| PLACE5000019 | 0.4 | 4.15 | 1.13 | 0.59 | 1.89 | 0.79 | | |
| PLACE5000021 | 0.74 | 4.59 | 1.61 | 0.39 | 0.93 | 0.32 | | |
| PLACE5000022 | 1.2 | 6.11 | 2.25 | 3.17 | 2.76 | 2.09 | | |
| PLACE5000024 | 1.77 | 2.58 | 2.27 | 2.92 | 3.39 | 3.84 | * | + |
| PLACE5000036 | 1.81 | 3.24 | 3.11 | 2.41 | 3.19 | 2.84 | | |
| PLACE5000059 | 14.41 | 17.79 | 26.55 | 25.98 | 30.03 | 34.87 | | |
| PLACE5000076 | 1.41 | 3.61 | 2.22 | 4.04 | 3.96 | 2.54 | | |
| PLACE5000117 | 7.44 | 12.48 | 15.66 | 16.87 | 18.78 | 20.64 | | |
| PLACE5000143 | 0.85 | 6.45 | 2.11 | 1.67 | 2.85 | 2.73 | | |
| PLACE5000152 | 0.42 | 4.49 | 1.23 | 1.61 | 1.95 | 1.57 | | |
| PLACE5000154 | 18.23 | 23.5 | 45.06 | 21.81 | 25.65 | 31.8 | | |
| PLACE5000155 | 3.35 | 2.81 | 5.51 | 3.94 | 2.78 | 4.87 | | |
| PLACE5000165 | 3.78 | 4.4 | 6.67 | 4.51 | 5.99 | 5.82 | | |
| SKNMC1000004 | 9.7 | 11.62 | 16.77 | 10.19 | 12.16 | 13.96 | | |
| SKNMC1000011 | 1.82 | 8.58 | 4.12 | 5.89 | 3.95 | 6.77 | | |
| SKNMC1000013 | 0.51 | 6.69 | 1.13 | 1.21 | 2.14 | 1.44 | | |
| SKNMC1000014 | 1.28 | 4.18 | 3.22 | 3.77 | 6.37 | 3.96 | | |
| SKNMC1000018 | 3.42 | 5.19 | 5.25 | 5.51 | 5.68 | 3.44 | | |
| SKNMC1000020 | 0.95 | 4.03 | 3.46 | 3.6 | 4.68 | 4.56 | | |
| SKNMC1000046 | 2 | 3.17 | 3.48 | 3.95 | 3.26 | 2.55 | | |
| SKNMC1000050 | 4.99 | 8.04 | 10.32 | 5.4 | 6.28 | 6.12 | | |
| SKNMC1000062 | 9.79 | 12.62 | 0.18 | 19.2 | 15.42 | 18.73 | | |
| SKNMC1000075 | 1.45 | 4.3 | 2.01 | 1.98 | 1.89 | 2.92 | | |
| SKNMC1000082 | 1.12 | 4.39 | 2.13 | 1.85 | 1.78 | 2.39 | | |
| SKNMC1000091 | 4.54 | 7.52 | 7.95 | 11.74 | 12.86 | 12.77 | ** | + |
| SKNMC1000099 | 0.33 | 4.29 | 1.98 | 1.32 | 0.65 | 1.18 | | |
| SKNMC1000104 | 1.13 | 4.24 | 3.45 | 1.47 | 3.14 | 2.43 | | |
| SKNMC1000113 | 0.97 | 1.83 | 1.2 | 1.74 | 2.63 | 0.89 | | |
| SKNMC1000119 | 1.73 | 2.64 | 5.07 | 4.48 | 5.34 | 4.67 | | |
| SKNMC1000142 | 0.04 | 2.87 | 0.99 | 1.27 | 0.75 | 1 | | |
| SKNMC1000170 | 0.91 | 4.75 | 2.34 | 1.71 | 1.49 | 1.11 | | |
| SKNMC1000178 | 3.02 | 8.39 | 7.08 | 5.77 | 9.65 | 9.02 | | |
| SKNMC1000194 | 0.63 | 9.82 | 1.51 | 0.61 | 1.73 | 1.3 | | |
| SKNMC1000198 | 1.35 | 11.01 | 3.33 | 2.65 | 2.1 | 2.88 | | |
| SKNMC1000225 | 1.35 | 6.44 | 2.97 | 2.39 | 3.4 | 3.26 | | |
| SKNMC1000249 | 0.49 | 2.14 | 0.75 | 0.57 | 0.51 | 0.52 | | |
| SPLEN1000007 | 0.74 | 2.15 | 2.11 | 1.7 | 2.26 | 1.99 | | |
| SPLEN1000012 | 0.39 | 1.9 | 1.72 | 1.19 | 0.8 | 0.84 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

|  | Synoviocyte | | | Synoviocute_TNF | | | t test vs | INC. and |
|---|---|---|---|---|---|---|---|---|
| Clone | exp. 1 | exp. 2 | exp. 3 | exp. 1 | exp. 2 | exp. 3 | TNF | DEC. |
| SPLEN1000014 | 1.78 | 4.4 | 4.9 | 5.75 | 4.33 | 3.99 | | |
| SPLEN1000036 | 4.95 | 11.64 | 24.32 | 20.56 | 27.73 | 21.68 | | |
| SPLEN1000059 | 0.04 | 6.69 | 1.06 | 0.91 | 1.79 | 1.47 | | |
| SPLEN1000068 | 1.68 | 10.81 | 5.71 | 5.79 | 5.17 | 5.64 | | |
| SPLEN1000072 | 1 | 8.5 | 4.7 | 2.82 | 3 | 2.21 | | |
| SPLEN1000101 | 20.01 | 18.4 | 45.64 | 29.93 | 25.24 | 12.63 | | |
| SPLEN1000108 | 0.56 | 1.54 | 0.98 | 0.75 | 1.11 | 0.76 | | |
| SPLEN1000113 | 1.33 | 2.27 | 3.04 | 2.72 | 4.13 | 3.04 | | |
| SPLEN1000114 | 2.97 | 4.19 | 6.03 | 3.59 | 4.76 | 6.32 | | |
| SPLEN1000132 | 0.85 | 4 | 1.72 | 2.25 | 2.67 | 1.99 | | |
| SPLEN1000135 | 3.13 | 8.76 | 14.93 | 11.12 | 15.28 | 10.52 | | |
| SPLEN1000136 | 12.41 | 21.47 | 15.14 | 20.24 | 27.48 | 21.8 | | |
| SPLEN1000141 | 2.26 | 7.07 | 10.79 | 4.03 | 5.41 | 4.51 | | |
| SPLEN1000164 | 2.49 | 3.79 | 8.58 | 3.98 | 5.88 | 7.61 | | |
| SPLEN1000166 | 0.4 | 2.9 | 2.96 | 1.67 | 1.19 | 1.68 | | |
| SPLEN1000175 | 2.16 | 4.48 | 6.1 | 5.65 | 4.12 | 4.15 | | |
| SPLEN1000182 | 0.98 | 2.66 | 0.23 | 0.83 | 0.6 | 0.67 | | |
| SPLEN1000185 | 3.41 | 8.49 | 8.54 | 11.38 | 10.43 | 11.95 | | |
| THYMU1000004 | 10.22 | 14.07 | 20.43 | 22.34 | 22.76 | 23.6 | | |
| THYMU1000009 | 9.48 | 10.13 | 14.9 | 13.48 | 23.86 | 22.1 | | |
| THYMU1000015 | 8.87 | 10.42 | 16.18 | 19.25 | 22.21 | 20.8 | * | + |
| THYMU1000016 | 6.24 | 5.96 | 13.03 | 10.3 | 8.45 | 9.38 | | |
| THYMU1000023 | 0.77 | 1.86 | 3.6 | 5.22 | 3.68 | 3.6 | | |
| THYMU1000034 | 0.16 | 1.77 | 1.8 | 0.79 | 0.88 | 0.14 | | |
| THYMU1000035 | 0.62 | 2.8 | 0.97 | 1.17 | 0.95 | 1.31 | | |
| THYMU1000037 | 1.53 | 4.15 | 2.11 | 2.06 | 2.81 | 1.45 | | |
| THYMU1000042 | 5.97 | 10.24 | 12.23 | 12.03 | 13.98 | 13.28 | | |
| THYMU1000047 | 2.72 | 6.03 | 6.72 | 6.04 | 7.77 | 7.23 | | |
| THYMU1000080 | 0.56 | 4.31 | 2.6 | 3.26 | 1.85 | 2.11 | | |
| THYMU1000094 | 2.77 | 3.47 | 7.91 | 9.17 | 8.35 | 4.55 | | |
| THYMU1000109 | 17.28 | 14.34 | 111.37 | 98.05 | 142.29 | 93.04 | | |
| THYMU1000127 | 2.75 | 5.95 | 10.76 | 8.18 | 9.98 | 6.74 | | |
| THYMU1000130 | 2.5 | 4.4 | 4.55 | 6.69 | 6.07 | 4.94 | | |
| THYMU1000137 | 3.53 | 7.18 | 10.26 | 12.67 | 18.55 | 13.05 | * | + |
| THYMU1000146 | 4.37 | 8.38 | 6.52 | 8.29 | 7.46 | 7.74 | | |
| THYMU1000159 | 5.43 | 9.51 | 16.37 | 12.4 | 15.15 | 13.27 | | |
| THYMU1000163 | 5.85 | 12.26 | 37.58 | 45.53 | 58.37 | 36.93 | | |
| THYMU1000167 | 2.39 | 3.02 | 4.73 | 4.89 | 6.79 | 3.97 | | |
| THYMU1000186 | 0.69 | 1.05 | 1.45 | 1.31 | 2.45 | 0.66 | | |
| THYRO1000017 | 0.94 | 3.45 | 2.54 | 2.02 | 3.54 | 2.11 | | |
| THYRO1000026 | 1.56 | 5.63 | 4.02 | 3.96 | 4.82 | 3.36 | | |
| THYRO1000034 | 0.49 | 4.16 | 1.59 | 1.99 | 2 | 1.82 | | |
| THYRO1000035 | 0.86 | 4.84 | 1.34 | 2.29 | 2.48 | 2.11 | | |
| THYRO1000036 | 0.93 | 8.32 | 4 | 3.08 | 4.36 | 5.59 | | |
| THYRO1000040 | 2.58 | 7.02 | 4.76 | 4.66 | 4.83 | 4.93 | | |
| THYRO1000061 | 2.01 | 1.91 | 3.07 | 3.53 | 3.8 | 2.61 | | |
| THYRO1000067 | 1.98 | 2.8 | 5.12 | 3.37 | 4.14 | 3.3 | | |
| THYRO1000070 | 1.26 | 2.09 | 3.59 | 2.65 | 3.85 | 3.45 | | |
| THYRO1000072 | 1.33 | 3.37 | 4.22 | 2.54 | 4.08 | 2.06 | | |
| THYRO1000084 | 8.07 | 12.69 | 22.39 | 2.99 | 5.61 | 4.42 | | |
| THYRO1000085 | 1.44 | 5.66 | 3.99 | 2.42 | 3.86 | 2.85 | | |
| THYRO1000086 | −0.05 | 5.46 | 1.74 | 0.89 | 1.18 | 1.15 | | |
| THYRO1000087 | 0.72 | 3.86 | 1.01 | 0 | 0.58 | 0.17 | | |
| THYRO1000092 | 2.32 | 5.1 | 4.66 | 3.75 | 4.43 | 4.5 | | |
| THYRO1000093 | 0.35 | 3.24 | 0.83 | 1.54 | 1.27 | 0.95 | | |
| THYRO1000099 | 0.45 | 2.53 | 2.73 | 2.8 | 1.67 | 2.39 | | |
| THYRO1000107 | 0.5 | 2.95 | 2.7 | 2.86 | 3.22 | 2 | | |
| THYRO1000111 | 0.85 | 4.58 | 1.78 | 1.4 | 2.06 | 2.36 | | |
| THYRO1000121 | 1.33 | 5.72 | 2.52 | 1.94 | 2.4 | 2.95 | | |
| THYRO1000124 | 0.27 | 5.55 | 0.64 | 0.86 | 0.89 | 0.64 | | |
| THYRO1000129 | 0.36 | 2.1 | 0.11 | 0.94 | 1.11 | 0.92 | | |
| THYRO1000130 | 1.82 | 3.11 | 3.13 | 3.85 | 3.01 | 2.39 | | |
| THYRO1000132 | 2.4 | 3.62 | 9.43 | 11.14 | 6.99 | 6.26 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| THYRO1000134 | 1.5 | 4.07 | 3.22 | 4.06 | 3.65 | 3.73 | | |
| THYRO1000144 | 1.72 | 4.78 | 3.15 | 7.87 | 7.09 | 2.33 | | |
| THYRO1000155 | 1.6 | 4.1 | 1.45 | 1.77 | 1.9 | 2.23 | | |
| THYRO1000156 | 1.13 | 6.53 | 3.62 | 2.45 | 4.29 | 2.58 | | |
| THYRO1000163 | 3.62 | 8.42 | 5.28 | 4.76 | 6.63 | 2.24 | | |
| THYRO1000173 | 1.19 | 4.45 | 2.26 | 3.33 | 1.36 | 2.75 | | |
| THYRO1000186 | 1.98 | 3.24 | 7.86 | 6.91 | 6.84 | 6.35 | | |
| THYRO1000187 | 2.7 | 3.58 | 5.3 | 4.92 | 6.24 | 5.22 | | |
| THYRO1000190 | 1.12 | 3.32 | 2.94 | 3.73 | 4.55 | 2.71 | | |
| THYRO1000196 | 0.3 | 5.28 | 0.81 | 0.66 | 1.21 | 0.52 | | |
| THYRO1000197 | 2.05 | 7.28 | 4.69 | 4.08 | 6.24 | 3.89 | | |
| THYRO1000199 | 0.76 | 6.28 | 4.13 | 1.93 | 2.08 | 1.98 | | |
| THYRO1000206 | 8.47 | 6.92 | 9.25 | 8.44 | 11.6 | 7.5 | | |
| THYRO1000221 | 1.9 | 3.17 | 4.42 | 4.02 | 5.87 | 4.54 | | |
| THYRO1000222 | 3.65 | 4.26 | 4.23 | 4.68 | 4.96 | 4.93 | * | + |
| THYRO1000228 | 0.81 | 3.67 | 2.85 | 2.24 | 3.04 | 2.94 | | |
| THYRO1000241 | 1.76 | 3.7 | 6.29 | 4.62 | 5.54 | 4.01 | | |
| THYRO1000242 | 0.63 | 4.16 | 4.46 | 2.49 | 2.56 | 2.62 | | |
| THYRO1000246 | 1.61 | 5.5 | 3.9 | 3.43 | 4.7 | 3.91 | | |
| THYRO1000253 | 1.07 | 4.05 | 1.73 | 1.99 | 3.35 | 2.31 | | |
| THYRO1000270 | 1.15 | 5.12 | 1.39 | 1.22 | 2.5 | 1.26 | | |
| THYRO1000279 | 0.42 | 2.84 | 0.25 | 0.65 | 1.01 | 0.58 | | |
| THYRO1000285 | 2.75 | 4.65 | 7.31 | 7.03 | 7.75 | 4.88 | | |
| THYRO1000288 | 7.76 | 7.59 | 11.77 | 5.68 | 5.07 | 7.22 | | |
| THYRO1000296 | 4.18 | 6.04 | 6.22 | 7.4 | 11.24 | 8.96 | * | + |
| THYRO1000320 | 1.54 | 5.83 | 4.97 | 3.65 | 4.45 | 3.34 | | |
| THYRO1000322 | 1.1 | 5.48 | 2.48 | 1.76 | 3.93 | 1.76 | | |
| THYRO1000327 | 1.75 | 7.69 | 4.77 | 6.21 | 5.23 | 4.41 | | |
| THYRO1000343 | 2.5 | 6.12 | 5.35 | 5.06 | 5.04 | 6.13 | | |
| THYRO1000345 | 1.36 | 7.34 | 11.92 | 7.82 | 5.84 | 9.49 | | |
| THYRO1000358 | 1.82 | 3.39 | 3.08 | 1.92 | 2.32 | 1.54 | | |
| THYRO1000368 | 0.76 | 2.39 | 2.73 | 1.43 | 2.82 | 0.58 | | |
| THYRO1000375 | 3.2 | 7.03 | 4.79 | 7.38 | 6.09 | 9.77 | | |
| THYRO1000381 | 0.92 | 2.88 | 2.19 | 3.87 | 3.11 | 2.74 | | |
| THYRO1000387 | 0.98 | 6.66 | 3.22 | 2.53 | 3.56 | 2.51 | | |
| THYRO1000394 | 1.31 | 9.88 | 4.59 | 4.29 | 5.19 | 2.61 | | |
| THYRO1000395 | 0.8 | 10.44 | 2.26 | 1.97 | 2.07 | 2.02 | | |
| THYRO1000400 | 0.57 | 8.1 | 2.82 | 2.35 | 2.96 | 2.52 | | |
| THYRO1000401 | 0.86 | 1.94 | 2.5 | 1.87 | 1.16 | 1.57 | | |
| THYRO1000407 | 1.97 | 2.3 | 1.36 | 1.37 | 1.58 | 0.55 | | |
| THYRO1000420 | 1.8 | 2.67 | 4.46 | 3.52 | 3.53 | 3.39 | | |
| THYRO1000438 | 1.78 | 4.37 | 3.26 | 2.94 | 3.33 | 3.15 | | |
| THYRO1000452 | 2.62 | 7.99 | 6.45 | 3.71 | 5.75 | 4.38 | | |
| THYRO1000455 | 0.32 | 6.67 | 2.31 | 0.25 | 0.97 | 0.87 | | |
| THYRO1000471 | 0.99 | 8.03 | 2.05 | 1.11 | 2.08 | 1.02 | | |
| THYRO1000481 | 1.33 | 6.23 | 4.68 | 3.79 | 3.45 | 4.55 | | |
| THYRO1000484 | 1.2 | 1.42 | 2.41 | 2.35 | 3 | 2.21 | | |
| THYRO1000488 | 1.18 | 2.64 | 2.44 | 1.49 | 2.02 | 1.7 | | |
| THYRO1000501 | 1.12 | 4.01 | 2.78 | 3 | 1.92 | 1.82 | | |
| THYRO1000502 | 0.34 | 3.7 | 1.69 | 1.79 | 1.44 | 1.2 | | |
| THYRO1000505 | 0.13 | 4.64 | 1.19 | 1.14 | 1.02 | 0.6 | | |
| THYRO1000535 | 11.1 | 20.54 | 39.24 | 54.13 | 69.59 | 62.96 | * | + |
| THYRO1000556 | 1.89 | 6.36 | 4.13 | 3.77 | 5.17 | 3.69 | | |
| THYRO1000558 | 0.25 | 2.82 | 1.12 | 1.16 | 0.81 | 0.61 | | |
| THYRO1000569 | 2.88 | 4.12 | 6.05 | 5.78 | 4.46 | 4.88 | | |
| THYRO1000570 | 2.31 | 3.28 | 8.46 | 8.53 | 6.04 | 3.49 | | |
| THYRO1000572 | 0.43 | 2.04 | 1.11 | 0.17 | 0.97 | 0.42 | | |
| THYRO1000573 | 0.69 | 4.02 | 1.73 | 2.02 | 2.2 | 1.78 | | |
| THYRO1000577 | 1.06 | 5 | 1.34 | 0.96 | 1.22 | 0.71 | | |
| THYRO1000580 | 0.79 | 3.72 | 3.01 | 2.82 | 2.2 | 1.79 | | |
| THYRO1000584 | 2.18 | 6.88 | 8.8 | 7.57 | 6.61 | 7.58 | | |
| THYRO1000585 | 4.83 | 9.37 | 9.83 | 5.76 | 6.27 | 9.52 | | |
| THYRO1000596 | 0.22 | 0.93 | 1.19 | 0.44 | 1.36 | 0.21 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| THYRO1000602 | 2.08 | 2.95 | 4.01 | 4.05 | 4.65 | 4.97 | | |
| THYRO1000605 | 0.37 | 3.01 | 0.98 | 2.13 | 2.14 | 1.56 | | |
| THYRO1000615 | 1.02 | 3.62 | 1.24 | 1.55 | 1.36 | 1.29 | | |
| THYRO1000625 | 0.71 | 5.48 | 2.28 | 2.46 | 2.9 | 1.78 | | |
| THYRO1000636 | 3.67 | 5.65 | 6.9 | 6.53 | 7.84 | 6.67 | | |
| THYRO1000637 | 0.91 | 3.96 | 1.71 | 1.18 | 2.03 | 1.54 | | |
| THYRO1000641 | 0.38 | 4.19 | 2.49 | 1.36 | 1.67 | 1.64 | | |
| THYRO1000657 | 2.99 | 3.69 | 5.42 | 7.67 | 12.28 | 3.86 | | |
| THYRO1000658 | 2.68 | 3.62 | 5.39 | 5.4 | 5.55 | 6.09 | | |
| THYRO1000662 | 1.1 | 3.19 | 2.09 | 2.42 | 2.69 | 1.66 | | |
| THYRO1000666 | 0.57 | 3.19 | 2.28 | 1.63 | 1.48 | 1.43 | | |
| THYRO1000676 | 1.37 | 4.53 | 2.01 | 1.75 | 1.83 | 1.56 | | |
| THYRO1000678 | 0.52 | 5.86 | 0.99 | 1.29 | 1.4 | 0.53 | | |
| THYRO1000684 | 0.95 | 4.98 | 2.94 | 1.92 | 2.65 | 1.47 | | |
| THYRO1000694 | 2.08 | 6.64 | 4.65 | 2.8 | 2.48 | 3.59 | | |
| THYRO1000699 | 2.98 | 2.14 | 5.55 | 4.86 | 7.08 | 7.12 | | |
| THYRO1000712 | 1.88 | 4.25 | 5.9 | 6.25 | 6.75 | 7.78 | | |
| THYRO1000715 | 5.74 | 5.67 | 27.37 | 21.74 | 28.63 | 16.99 | | |
| THYRO1000716 | 0.92 | 3.26 | 3.2 | 1.88 | 1.78 | 1.35 | | |
| THYRO1000717 | 1.58 | 5 | 4.36 | 2.98 | 4.63 | 1.91 | | |
| THYRO1000723 | 0.6 | 4.54 | 1.6 | 0.55 | 1.06 | 0.85 | | |
| THYRO1000734 | −0.01 | 4.81 | 1.89 | 1.49 | 1.73 | 1.07 | | |
| THYRO1000748 | 0.98 | 5.51 | 5.23 | 2.35 | 3.85 | 3.18 | | |
| THYRO1000755 | 1.74 | 3.26 | 4.32 | 4.33 | 3.47 | 4.38 | | |
| THYRO1000756 | 2.79 | 4.24 | 3.24 | 3.46 | 4.2 | 3.41 | | |
| THYRO1000776 | 0.48 | 2.17 | 3.02 | 3.36 | 3.99 | 3.34 | | |
| THYRO1000777 | 1.81 | 3.39 | 4.54 | 4.99 | 2.05 | 2.37 | | |
| THYRO1000779 | 1.45 | 3.55 | 0.88 | 0.18 | 1.01 | 0.26 | | |
| THYRO1000782 | 3.92 | 10.13 | 12.52 | 10.76 | 15.05 | 14.05 | | |
| THYRO1000783 | 0.12 | 5.51 | 1.2 | 1.11 | 1.41 | 0.92 | | |
| THYRO1000786 | 6.65 | 9.54 | 19.71 | 15.74 | 7.92 | 13.7 | | |
| THYRO1000787 | 0.23 | 1.88 | 1.67 | 1.31 | 1.54 | 0.78 | | |
| THYRO1000792 | 1.51 | 3.13 | 2.29 | 3.09 | 3.13 | 2.11 | | |
| THYRO1000793 | 0.11 | 3.13 | 0.84 | 1.51 | 1.86 | 1.16 | | |
| THYRO1000795 | 1.23 | 6.03 | 3.54 | 2.76 | 3.1 | 3.05 | | |
| THYRO1000796 | 0.6 | 7.73 | 2.44 | 2.26 | 2.95 | 1.66 | | |
| THYRO1000798 | 1.89 | 5.82 | 2.51 | 2.59 | 3.57 | 3.53 | | |
| THYRO1000800 | 9.26 | 17.2 | 24.74 | 17.74 | 20.68 | 21.06 | | |
| THYRO1000805 | 0.49 | 3.04 | 1.08 | 0.72 | 2.66 | 1.38 | | |
| THYRO1000815 | 2.54 | 3.49 | 9.48 | 7.61 | 5.47 | 7.87 | | |
| THYRO1000829 | 5.55 | 7.83 | 10.57 | 3.78 | 8.32 | 10.01 | | |
| THYRO1000835 | 0.96 | 3.2 | 1.93 | 1.07 | 2.36 | 1.8 | | |
| THYRO1000843 | 1.09 | 11.48 | 3.56 | 3.69 | 4.41 | 3.62 | | |
| THYRO1000846 | 0.76 | 5.71 | 1.32 | 2.67 | 1.62 | 1.26 | | |
| THYRO1000852 | 1.59 | 6.02 | 5.63 | 2.8 | 4.7 | 3.32 | | |
| THYRO1000855 | 3.14 | 5.02 | 6.63 | 9.03 | 15.1 | 10.07 | * | + |
| THYRO1000865 | 1.86 | 4.3 | 11.97 | 10.01 | 11.47 | 8.95 | | |
| THYRO1000866 | 7.47 | 6.29 | 12.66 | 4.49 | 7.87 | 6.01 | | |
| THYRO1000881 | 5.62 | 7.3 | 10.93 | 15.65 | 26.64 | 29.58 | * | |
| THYRO1000894 | 0.33 | 3.95 | 1.36 | 1.75 | 1.48 | 1 | | |
| THYRO1000895 | 0.58 | 4.43 | 1.42 | 1.62 | 1.46 | 0.82 | | |
| THYRO1000916 | 1.22 | 5.49 | 3.43 | 2.43 | 3.13 | 2.29 | | |
| THYRO1000917 | 16.19 | 25.26 | 34.11 | 30.37 | 37.42 | 35.89 | | |
| THYRO1000926 | 0.78 | 3.13 | 1.27 | 1.76 | 1.57 | 0.82 | | |
| THYRO1000934 | 0.08 | 3.1 | 1.34 | 0.43 | 1.38 | 1.46 | | |
| THYRO1000951 | 0.52 | 2.46 | 1.26 | 2.33 | 2.11 | 1.9 | | |
| THYRO1000952 | 2.25 | 3.81 | 6.01 | 2.38 | 2.53 | 2.24 | | |
| THYRO1000956 | 0.06 | 2.55 | 1.81 | 1.16 | 1.5 | 0.87 | | |
| THYRO1000960 | 0.5 | 6.72 | 2.89 | 1.85 | 2.79 | 1.48 | | |
| THYRO1000961 | 1.67 | 7.77 | 3.56 | 4.73 | 5.26 | 4.64 | | |
| THYRO1000964 | 0.42 | 11.59 | 0.76 | 1 | 1.27 | 1.06 | | |
| THYRO1000971 | 1.82 | 9.9 | 3.56 | 3.29 | 3.33 | 2.19 | | |
| THYRO1000974 | 2.87 | 8.83 | 7.53 | 9.87 | 11.79 | 8.71 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| THYRO1000975 | 1.5 | 2.19 | 3.8 | 4.02 | 3.68 | 3.68 | | |
| THYRO1000983 | 6.42 | 8.31 | 11.63 | 12.67 | 8.49 | 7.12 | | |
| THYRO1000984 | 2.4 | 2.83 | 3.03 | 3.29 | 2.98 | 3.26 | | |
| THYRO1000988 | 1.36 | 4.14 | 3.23 | 3.48 | 3.68 | 2.67 | | |
| THYRO1000991 | 1.22 | 4.71 | 2.05 | 1.76 | 2.22 | 3.2 | | |
| THYRO1000999 | 0.87 | 9.64 | 3.26 | 1.96 | 3.14 | 2.26 | | |
| THYRO1001003 | 2.97 | 8.43 | 4.42 | 3.1 | 4.52 | 3.56 | | |
| THYRO1001015 | 0.6 | 6.29 | 2.04 | 2.22 | 1.79 | 1.66 | | |
| THYRO1001016 | 1.73 | 2.26 | 3.34 | 2.06 | 1.85 | 1.24 | | |
| THYRO1001022 | 0.9 | 1.86 | 0.86 | 1.68 | 1.25 | 1.41 | | |
| THYRO1001031 | 4.65 | 3.97 | 4.55 | 5.03 | 7.03 | 6.16 | | |
| THYRO1001033 | 1.18 | 3.34 | 2.46 | 2.86 | 3.45 | 2.02 | | |
| THYRO1001062 | 1.21 | 5.4 | 4.14 | 2.9 | 4.31 | 2.62 | | |
| THYRO1001063 | 0.5 | 8.74 | 2.38 | 2.37 | 2.09 | 2.84 | | |
| THYRO1001071 | 0.12 | 7.45 | 0.88 | 1.33 | 0.68 | 0.76 | | |
| THYRO1001080 | 2.56 | 6.75 | 5.11 | 4.96 | 4.31 | 4.78 | | |
| THYRO1001093 | 0.77 | 1.63 | 3.24 | 5.11 | 1.74 | 1.5 | | |
| THYRO1001100 | 0.52 | 1.89 | 2.05 | 1.89 | 1.21 | 0.78 | | |
| THYRO1001102 | 2.61 | 3.6 | 5.7 | 4.4 | 4.95 | 6.93 | | |
| THYRO1001104 | 3.67 | 6.54 | 6.55 | 8.77 | 8.01 | 11.18 | | |
| THYRO1001109 | 1.81 | 6.02 | 2.68 | 3.06 | 2.58 | 1.99 | | |
| THYRO1001113 | 11.41 | 17.42 | 32 | 21.81 | 26.65 | 18.72 | | |
| THYRO1001120 | 1.65 | 6.22 | 5.27 | 4.78 | 5.8 | 3.72 | | |
| THYRO1001121 | 1.57 | 4.28 | 4.19 | 3.92 | 2.72 | 3 | | |
| THYRO1001128 | 1.64 | 2.77 | 5.86 | 3.52 | 3.19 | 5.09 | | |
| THYRO1001133 | 1.14 | 3.02 | 7.23 | 6.54 | 4.54 | 4.12 | | |
| THYRO1001134 | 2.97 | 4.78 | 1.63 | 3.14 | 2.83 | 1.38 | | |
| THYRO1001142 | 0.3 | 2.69 | 0.63 | 1.3 | 1.71 | 0.22 | | |
| THYRO1001173 | 8.37 | 12.87 | 7.72 | 11.14 | 9.92 | 10.62 | | |
| THYRO1001175 | 3.26 | 6.63 | 5.51 | 3.46 | 4.62 | 3.52 | | |
| THYRO1001177 | 1.36 | 5.85 | 5.93 | 4.66 | 7.27 | 7.97 | | |
| THYRO1001189 | 2.74 | 6.93 | 11.42 | 7.84 | 7.27 | 9.94 | | |
| THYRO1001194 | 1.05 | 2.62 | 4.96 | 4.89 | 4.57 | 2.31 | | |
| THYRO1001204 | 2.17 | 3.58 | 4.27 | 4.03 | 4.74 | 4 | | |
| THYRO1001205 | 5.76 | 10.65 | 20.23 | 18.54 | 19.57 | 20.9 | | |
| THYRO1001213 | 1.21 | 4.69 | 4.44 | 3.12 | 3.21 | 2.33 | | |
| THYRO1001224 | 3.59 | 8.25 | 6.37 | 9.92 | 12.69 | 10.55 | * | + |
| THYRO1001237 | 2.82 | 6.25 | 4.99 | 3.61 | 4.53 | 4.46 | | |
| THYRO1001242 | 9.74 | 11.65 | 19.04 | 20.02 | 19.98 | 20.46 | | |
| THYRO1001258 | 2.08 | 5.45 | 3.58 | 3.33 | 2.05 | 2.66 | | |
| THYRO1001262 | 0.86 | 2.64 | 3.38 | 2.36 | 3.61 | 2.69 | | |
| THYRO1001266 | 0.15 | 2.39 | 1.02 | 0.97 | 1.64 | 0.66 | | |
| THYRO1001271 | 1.85 | 4.12 | 4.12 | 2.46 | 2.77 | 2.97 | | |
| THYRO1001287 | 7.3 | 8.3 | 39.26 | 30.14 | 43.68 | 26.2 | | |
| THYRO1001290 | 0.38 | 3.25 | 1.14 | 1.15 | 1.35 | 0.36 | | |
| THYRO1001291 | 0.96 | 7.17 | 4.38 | 4.31 | 4.97 | 3.5 | | |
| THYRO1001297 | 3.05 | 8.04 | 6.14 | 6.85 | 7.47 | 9.18 | | |
| THYRO1001302 | 1.72 | 5.59 | 5.17 | 3.8 | 3.71 | 3.5 | | |
| THYRO1001313 | 1.61 | 2.33 | 2.91 | 2.91 | 2.62 | 1.48 | | |
| THYRO1001320 | 1.76 | 2.52 | 5.31 | 5.07 | 5.74 | 4.83 | | |
| THYRO1001321 | 2.25 | 2.65 | 4.3 | 2.48 | 4.23 | 4.23 | | |
| THYRO1001322 | 1.34 | 3.93 | 3.34 | 1.75 | 2.67 | 2.01 | | |
| THYRO1001327 | 1.29 | 6.01 | 4.18 | 1.4 | 3.89 | 2.49 | | |
| THYRO1001336 | 1.89 | 6.84 | 6.72 | 4.62 | 4.43 | 4.18 | | |
| THYRO1001347 | 0.43 | 4.12 | 3.35 | 1.85 | 2.81 | 0.65 | | |
| THYRO1001358 | 2.57 | 5.74 | 4.52 | 4.3 | 5.75 | 5.1 | | |
| THYRO1001363 | 0.8 | 2.15 | 1.52 | 2.09 | 2.24 | 2.28 | | |
| THYRO1001365 | 0.86 | 3 | 1.6 | 2.19 | 2.6 | 1.96 | | |
| THYRO1001374 | 1.85 | 4.45 | 12.86 | 9.4 | 13.01 | 6.21 | | |
| THYRO1001401 | 1.76 | 5.33 | 4.89 | 5.39 | 7.86 | 6.29 | | |
| THYRO1001403 | 1.26 | 5.15 | 3.22 | 3.22 | 4.42 | 3.94 | | |
| THYRO1001405 | 6.99 | 12.5 | 10.86 | 6.69 | 8.56 | 10.63 | | |
| THYRO1001406 | 15.73 | 14.87 | 27.69 | 21.36 | 22.77 | 21.36 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| THYRO1001411 | 4.49 | 5.46 | 10.08 | 8.93 | 12.44 | 8.12 | | |
| THYRO1001420 | 11.55 | 15.25 | 47.52 | 42.01 | 44.49 | 49.87 | | |
| THYRO1001426 | 3.42 | 5.56 | 8.83 | 9.32 | 12.77 | 11.18 | | |
| THYRO1001430 | 6.97 | 6.54 | 10.84 | 11.13 | 11.7 | 13.81 | | |
| THYRO1001434 | 0.68 | 5.19 | 2.11 | 2.08 | 4.23 | 1.73 | | |
| THYRO1001456 | 1.74 | 6.05 | 2.63 | 2.89 | 2.66 | 2.4 | | |
| THYRO1001457 | 1.71 | 4.72 | 2.04 | 2.95 | 4.7 | 2.67 | | |
| THYRO1001458 | 0.95 | 5.44 | 6.11 | 6.13 | 9.17 | 7.23 | | |
| THYRO1001459 | 4.54 | 5.07 | 9.42 | 7.18 | 9.87 | 14.21 | | |
| THYRO1001471 | 0.91 | 2.07 | 1.93 | 2.36 | 2.91 | 1.64 | | |
| THYRO1001478 | 0.58 | 3.09 | 1.34 | 0.95 | 2.61 | 2.75 | | |
| THYRO1001480 | 5.4 | 10.53 | 13.62 | 14.79 | 15.94 | 15.57 | | |
| THYRO1001481 | 2.95 | 8.64 | 7.24 | 4.91 | 7.76 | 7.13 | | |
| THYRO1001487 | 1.36 | 5.51 | 3.52 | 4.1 | 2.67 | 3.48 | | |
| THYRO1001495 | 2.06 | 5.57 | 5.43 | 5.06 | 9.4 | 7.55 | | |
| THYRO1001498 | 5.39 | 8.08 | 13.42 | 11.59 | 16.38 | 19.6 | | |
| THYRO1001510 | 1.67 | 2.88 | 1.59 | 1.65 | 2.57 | 3.35 | | |
| THYRO1001512 | 26.7 | 26.97 | 110.28 | 56.03 | 90.95 | 68.54 | | |
| THYRO1001519 | 5.92 | 7.77 | 11.05 | 8.91 | 5.75 | 10.38 | | |
| THYRO1001522 | 2.02 | 4.7 | 5.79 | 4.15 | 4.69 | 5.51 | | |
| THYRO1001523 | 1.83 | 4.92 | 3.73 | 4.38 | 4.07 | 4.26 | | |
| THYRO1001526 | 26.21 | 28.22 | 44.73 | 34.28 | 47.64 | 46.52 | | |
| THYRO1001529 | 1.64 | 5.27 | 2.8 | 2.32 | 2.42 | 2.98 | | |
| THYRO1001534 | 1.41 | 4.01 | 4.96 | 5.1 | 5.9 | 4.54 | | |
| THYRO1001537 | 7.4 | 5.17 | 12.33 | 5.97 | 7.42 | 7.23 | | |
| THYRO1001541 | 2.14 | 3.88 | 8.27 | 7.76 | 8.7 | 6.73 | | |
| THYRO1001545 | 1.26 | 3.84 | 2.9 | 4.95 | 3.57 | 3.16 | | |
| THYRO1001559 | 4.52 | 6.34 | 8.04 | 9.06 | 10.5 | 10.54 | * | + |
| THYRO1001563 | 9.49 | 14.06 | 15.89 | 10 | 15.49 | 22.09 | | |
| THYRO1001570 | 2.01 | 8.2 | 3.85 | 4.25 | 5.17 | 3.41 | | |
| THYRO1001573 | 1.15 | 5.77 | 2.22 | 1.47 | 2.87 | 2.67 | | |
| THYRO1001584 | 2.47 | 8.54 | 8.38 | 5.14 | 7.81 | 7.29 | | |
| THYRO1001593 | 4.27 | 5.67 | 11.17 | 9.5 | 10.93 | 9.52 | | |
| THYRO1001595 | 3.14 | 4.53 | 7.06 | 5.97 | 6.35 | 7.29 | | |
| THYRO1001596 | 4.71 | 5.48 | 7.44 | 6.45 | 5.86 | 2.51 | | |
| THYRO1001602 | 1.49 | 3.26 | 3.52 | 4.95 | 5.22 | 3.41 | | |
| THYRO1001605 | 1.58 | 4.48 | 3.22 | 3.2 | 3.43 | 2.42 | | |
| THYRO1001608 | 1.87 | 9.45 | 5.1 | 5.04 | 8.23 | 4.7 | | |
| THYRO1001617 | 6.06 | 13.68 | 11.47 | 9.75 | 10.87 | 9.61 | | |
| THYRO1001634 | 1.87 | 9.08 | 3.46 | 2.93 | 5.59 | 2.05 | | |
| THYRO1001637 | 3.51 | 3.13 | 9.65 | 8.72 | 7.94 | 9.07 | | |
| THYRO1001641 | 2.57 | 3.73 | 5.09 | 4.03 | 3.08 | 2.94 | | |
| THYRO1001656 | 1.59 | 2.94 | 4.16 | 2.82 | 5.36 | 2.33 | | |
| THYRO1001658 | 22.34 | 29.19 | 40.11 | 34.98 | 33.16 | 42.01 | | |
| THYRO1001661 | 1.4 | 5.83 | 2.31 | 2.93 | 3.31 | 2.05 | | |
| THYRO1001671 | 0.67 | 7.36 | 2.68 | 1.89 | 1.34 | 1.8 | | |
| THYRO1001672 | 1.1 | 9.24 | 2.1 | 1.14 | 1.52 | 1.66 | | |
| THYRO1001673 | 1.59 | 7.6 | 3.49 | 2.86 | 4.74 | 2.16 | | |
| THYRO1001677 | 1.6 | 2.27 | 3.87 | 3.03 | 3.54 | 3.36 | | |
| THYRO1001683 | 12.71 | 17.66 | 29.06 | 24.4 | 15.4 | 16.72 | | |
| THYRO1001700 | 1.39 | 2.52 | 2.67 | 2.09 | 1.58 | 1.37 | | |
| THYRO1001702 | 11.83 | 15.98 | 16.19 | 15.63 | 14.35 | 14.29 | | |
| THYRO1001703 | 1.63 | 6.74 | 4.25 | 4.72 | 3.27 | 4.21 | | |
| THYRO1001706 | 1.7 | 6.47 | 3.01 | 2.96 | 5.6 | 3.53 | | |
| THYRO1001721 | 1.84 | 5.66 | 3.2 | 2.73 | 6.37 | 2.77 | | |
| THYRO1001725 | 5.3 | 6.55 | 9.69 | 8.97 | 8.65 | 8.29 | | |
| THYRO1001730 | 17.72 | 20.4 | 40.1 | 30.61 | 26.56 | 34.8 | | |
| THYRO1001738 | 1.35 | 3.18 | 4.65 | 3.52 | 2.82 | 1.78 | | |
| THYRO1001743 | 0.19 | 2.13 | 1.85 | 1.8 | 1.64 | 1.06 | | |
| THYRO1001745 | 0.47 | 2.88 | 1.55 | 1.05 | 1.2 | 1.27 | | |
| THYRO1001746 | 1.9 | 6.25 | 4.04 | 6.12 | 4.01 | 3.88 | | |
| THYRO1001770 | 15.49 | 20.38 | 35.39 | 41.65 | 44.42 | 40.17 | * | + |
| THYRO1001772 | 1.12 | 4.88 | 3.64 | 4.78 | 4.24 | 3.06 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| THYRO1001778 | 3.89 | 6.68 | 9.89 | 14.67 | 13.47 | 14.25 | * | + |
| THYRO1001793 | 3.85 | 3.77 | 9.43 | 10.3 | 10.42 | 4.92 | | |
| THYRO1001796 | 1.35 | 2.28 | 2.28 | 3.45 | 4.22 | 3.24 | * | + |
| THYRO1001800 | 1.82 | 2.99 | 2.75 | 4.17 | 5.12 | 2.09 | | |
| THYRO1001803 | 3.42 | 6.03 | 5.21 | 4.31 | 4.14 | 3.42 | | |
| THYRO1001809 | 1.6 | 4.26 | 3.4 | 5.9 | 4.23 | 3.39 | | |
| THYRO1001817 | 8.69 | 18.33 | 24.88 | 22.11 | 22.77 | 25.27 | | |
| THYRO1001819 | 4.68 | 8.46 | 9.01 | 7.84 | 10.46 | 6.77 | | |
| THYRO1001828 | 21.89 | 24.53 | 104.32 | 106.68 | 121.95 | 68.55 | | |
| THYRO1001854 | 6.67 | 6.12 | 12.45 | 13.43 | 15.86 | 13.31 | | |
| THYRO1001895 | 0.85 | 1.31 | 2.52 | 3.54 | 4.31 | 1.28 | | |
| THYRO1001907 | 2.16 | 3.08 | 3.37 | 3.9 | 4.53 | 2.74 | | |
| TRACH1000006 | 2.51 | 5.87 | 6.63 | 4.34 | 3.46 | 3.22 | | |
| TRACH1000013 | 1.53 | 4.65 | 3.68 | 2.55 | 3.33 | 2.65 | | |
| TRACH1000074 | 2.65 | 6.75 | 6.09 | 7.5 | 7.26 | 4.77 | | |
| TRACH1000095 | 0.28 | 5.66 | 2.23 | 2.46 | 1.48 | 1.11 | | |
| TRACH1000102 | 2.42 | 6.66 | 4.09 | 5.79 | 5.04 | 3.65 | | |
| TRACH1000108 | 1.1 | 1.01 | 2.05 | 1.75 | 2.49 | 1.09 | | |
| TRACH1000126 | 0.96 | 1.75 | 2.71 | 1.82 | 3.79 | 2.54 | | |
| TRACH1000146 | 1.3 | 2.67 | 2.31 | 3.02 | 5.18 | 3.75 | | |
| TRACH1000160 | 0.61 | 4.06 | 1.5 | 1.47 | 1.76 | 0.72 | | |
| TRACH1000184 | 4.45 | 7.16 | 10.16 | 7.47 | 8.73 | 5.69 | | |
| VESEN1000004 | 0.69 | 5.55 | 3.19 | 2.56 | 2.95 | 2.02 | | |
| VESEN1000007 | 0.93 | 5.32 | 2.94 | 2.38 | 3.45 | 2.94 | | |
| VESEN1000013 | 5.96 | 10.11 | 16.78 | 10.76 | 11.25 | 13.88 | | |
| VESEN1000028 | 5.2 | 7.5 | 9.88 | 13.18 | 11.71 | 14.08 | * | + |
| VESEN1000059 | 1.55 | 2.88 | 2.1 | 3.38 | 2.82 | 2.27 | | |
| VESEN1000100 | 1.96 | 3.22 | 3.35 | 3.49 | 4.58 | 3.59 | | |
| VESEN1000107 | 0.88 | 4.84 | 2.88 | 3.12 | 2.9 | 2.48 | | |
| VESEN1000117 | 1.63 | 6.43 | 2.46 | 2.16 | 2.7 | 1.79 | | |
| VESEN1000122 | 1.52 | 5.34 | 1.24 | 4.79 | 4.51 | 4.5 | | |
| VESEN1000137 | 0.76 | 5.47 | 1.92 | 1.75 | 3.33 | 1.65 | | |
| VESEN1000195 | 7.79 | 7.93 | 11.67 | 8.42 | 7.51 | 10.27 | | |
| VESEN1000215 | 1.48 | 3.03 | 2.06 | 2.67 | 3.84 | 1.87 | | |
| VESEN1000279 | 8.71 | 11.32 | 18.49 | 22.93 | 23.38 | 34.68 | * | + |
| VESEN1000363 | 3.52 | 6.07 | 9.99 | 7.2 | 9.06 | 4.59 | | |
| VESEN1000388 | 2.55 | 6.48 | 3.31 | 4.17 | 3.75 | 6.7 | | |
| VESEN1000394 | 0.44 | 7.11 | 2.33 | 2.37 | 2.55 | 2.36 | | |
| VESEN1000410 | 1.11 | 5 | 1.78 | 2.36 | 2.71 | 3.69 | | |
| VESEN1000411 | 2.37 | 4.95 | 5.08 | 6.76 | 7.55 | 9 | * | + |
| VESEN1000415 | 1.54 | 2.64 | 4.03 | 5.57 | 3.92 | 5.29 | | |
| VESEN1000440 | 7 | 5.53 | 7.81 | 3.79 | 9.4 | 12.22 | | |
| VESEN1000452 | 1.22 | 3.65 | 2.33 | 2.91 | 3.97 | 4.11 | | |
| VESEN1000539 | 191.54 | 185.28 | 334.6 | 389.84 | 403.89 | 547.31 | * | + |
| VESEN1000554 | 0.67 | 6.47 | 1.43 | 1.47 | 2.55 | 1.58 | | |
| VESEN1000557 | 4.22 | 7.94 | 7.73 | 6.55 | 9.07 | 10 | | |
| VESEN1000575 | 7.49 | 9.75 | 16.33 | 11.95 | 11.73 | 14.8 | | |
| VESEN1000585 | 1.69 | 4.49 | 3.37 | 2.53 | 2.93 | 3.08 | | |
| VESEN1000592 | 1.58 | 2.31 | 1.58 | 2.02 | 1.83 | 1.46 | | |
| VESEN1000658 | 1.96 | 3.56 | 4.45 | 5.86 | 3.91 | 4.91 | | |
| VESEN1000669 | 8.43 | 10.02 | 16.35 | 15.06 | 14.17 | 15.51 | | |
| VESEN1000743 | 0.97 | 3.3 | 2.52 | 1.99 | 3.37 | 3.21 | | |
| VESEN1000752 | 37.43 | 51.51 | 72.35 | 49.32 | 57.03 | 57.96 | | |
| VESEN1000761 | 13.48 | 18.17 | 19.37 | 24.6 | 33.21 | 31.28 | * | + |
| VESEN2000039 | 10.45 | 15.98 | 15.56 | 13.56 | 18.3 | 20.1 | | |
| VESEN2000102 | 0.4 | 3.99 | 1.6 | 1.21 | 1.51 | 1.61 | | |
| VESEN2000164 | 2.45 | 3.52 | 4.8 | 5.55 | 4.36 | 3.66 | | |
| VESEN2000175 | 0.57 | 2.64 | 1.94 | 3.03 | 2.05 | 2.59 | | |
| VESEN2000186 | 3.77 | 5.53 | 6.53 | 6.68 | 3.87 | 2.47 | | |
| VESEN2000199 | 8.94 | 13.26 | 21.75 | 19.58 | 24.45 | 24.12 | | |
| VESEN2000200 | 0.5 | 4.97 | 2.78 | 3.03 | 3.1 | 1.6 | | |
| VESEN2000204 | 0.48 | 12.7 | 1.02 | 0.98 | 1.2 | 0.33 | | |
| VESEN2000218 | 6.66 | 20.26 | 19.48 | 21.37 | 20.75 | 18.86 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| VESEN2000230 | 0.84 | 7.4 | 1.45 | 2.74 | 1.7 | 2.41 | | |
| VESEN2000272 | 2.29 | 4 | 8.92 | 7 | 8.31 | 5.88 | | |
| VESEN2000299 | 1.99 | 2.97 | 3.2 | 3.3 | 3.77 | 3.31 | | |
| VESEN2000323 | 4.51 | 8.12 | 8.37 | 8.91 | 9.5 | 9.36 | | |
| VESEN2000327 | 3.16 | 5.8 | 4.42 | 3.62 | 7.66 | 5.07 | | |
| VESEN2000328 | 5.44 | 8.02 | 11.88 | 8.73 | 15.35 | 14.36 | | |
| VESEN2000330 | 6.39 | 15.42 | 14.7 | 14.59 | 27.73 | 18.86 | | |
| VESEN2000336 | 0.82 | 8.97 | 2.54 | 3.46 | 3.83 | 2.88 | | |
| VESEN2000354 | 1.56 | 8.24 | 2.48 | 1.53 | 2.71 | 2.1 | | |
| VESEN2000378 | 7.17 | 8.87 | 14.57 | 13.23 | 11.14 | 10.3 | | |
| VESEN2000379 | 19.87 | 23.02 | 44.55 | 49.13 | 42.81 | 32.61 | | |
| VESEN2000397 | 0.72 | 2.38 | 1.24 | 1.36 | 2.06 | 1.54 | | |
| VESEN2000416 | 2.83 | 3.88 | 4.41 | 5.74 | 5.31 | 5.71 | * | + |
| VESEN2000420 | 1.08 | 3.58 | 1.94 | 0.95 | 1.21 | 1.13 | | |
| VESEN2000430 | 0.51 | 6.68 | 1.53 | 2.06 | 1.79 | 1.8 | | |
| VESEN2000448 | 0.51 | 6.87 | 1.73 | 2.12 | 2.69 | 1.5 | | |
| VESEN2000449 | 2.43 | 8.07 | 6.59 | 8.3 | 11.31 | 8.21 | | |
| VESEN2000456 | 0.74 | 0.87 | 2.11 | 1.54 | 1.22 | 0.87 | | |
| VESEN2000562 | 4.07 | 3.42 | 17.42 | 13.67 | 22.82 | 14.47 | | |
| VESEN2000573 | 0.18 | 1.75 | 1.75 | 1.04 | 1.21 | 1.13 | | |
| VESEN2000604 | 1.73 | 3.44 | 2.24 | 2.04 | 1.67 | 2.15 | | |
| VESEN2000614 | 4.16 | 9.02 | 14.64 | 13.54 | 16.27 | 12.27 | | |
| VESEN2000638 | 0.48 | 5.92 | 1.98 | 1.33 | 1.91 | 1.68 | | |
| VESEN2000641 | 0.83 | 3.69 | 1.34 | 1.95 | 2.21 | 1.43 | | |
| VESEN2000645 | 2.18 | 5.29 | 5.38 | 5.91 | 5.73 | 5.5 | | |
| Y79AA1000013 | 2.57 | 2.7 | 4.33 | 3.45 | 3.8 | 3.94 | | |
| Y79AA1000030 | 1.79 | 4.06 | 4.52 | 3.24 | 3.85 | 2.47 | | |
| Y79AA1000033 | 2.87 | 6 | 8.4 | 8.37 | 10.17 | 5.83 | | |
| Y79AA1000037 | 1.38 | 3.36 | 5.71 | 4.84 | 6.82 | 4.49 | | |
| Y79AA1000041 | 1.05 | 5.16 | 3.79 | 4.73 | 3.65 | 2.06 | | |
| Y79AA1000059 | 1.69 | 5 | 4.09 | 3.88 | 4.51 | 2.82 | | |
| Y79AA1000065 | 24.06 | 28.99 | 52.25 | 82.48 | 101.48 | 98.73 | ** | + |
| Y79AA1000081 | 39.47 | 49.78 | 73.62 | 113.19 | 114.49 | 98.22 | ** | + |
| Y79AA1000127 | 4.08 | 4.21 | 5.8 | 8.42 | 10.03 | 7.39 | * | + |
| Y79AA1000130 | 2.24 | 2.48 | 5.76 | 6.61 | 8.1 | 8.03 | * | + |
| Y79AA1000131 | 507.64 | 569.21 | 946.04 | 769.75 | 725.35 | 342.07 | | |
| Y79AA1000134 | 1.99 | 4.93 | 4.21 | 5.63 | 4.75 | 5.38 | | |
| Y79AA1000143 | 3.58 | 8.79 | 4.83 | 9.98 | 10.98 | 11.04 | * | + |
| Y79AA1000144 | 4.63 | 10.79 | 10.59 | 11.02 | 11.62 | 11 | | |
| Y79AA1000150 | 18.39 | 22.18 | 84.69 | 93.51 | 17.62 | 78.89 | | |
| Y79AA1000153 | 183.67 | 191.4 | 436.64 | 423.46 | 442.52 | 386.45 | | |
| Y79AA1000166 | 2.13 | 2.25 | 4.15 | 3.52 | 4.97 | 3.6 | | |
| Y79AA1000179 | 2.58 | 3.76 | 4.2 | 6.85 | 7.58 | 3.89 | | |
| Y79AA1000181 | 1.96 | 3.92 | 4.2 | 4.82 | 5.66 | 3.79 | | |
| Y79AA1000202 | 22.93 | 24.47 | 55.57 | 91.68 | 86.86 | 83.22 | ** | + |
| Y79AA1000207 | 5.22 | 7.51 | 9.82 | 14.95 | 16.24 | 12.62 | * | + |
| Y79AA1000214 | 14.94 | 22.18 | 33.76 | 50.43 | 60.78 | 41.96 | * | + |
| Y79AA1000222 | 11.8 | 14.89 | 21.69 | 49.21 | 58.01 | 68.86 | ** | + |
| Y79AA1000226 | 11.04 | 14.94 | 34.41 | 22.86 | 33.54 | 30.03 | | |
| Y79AA1000227 | 5.95 | 4.52 | 7.25 | 8.98 | 9.51 | 9.62 | * | + |
| Y79AA1000230 | 1.09 | 1.49 | 2.02 | 2.07 | 2.88 | 2.59 | | |
| Y79AA1000231 | 5.99 | 9.04 | 15.81 | 14.63 | 23.77 | 17.1 | | |
| Y79AA1000239 | 15.47 | 20.55 | 25.65 | 18.95 | 24.01 | 22.11 | | |
| Y79AA1000258 | 2.64 | 5.17 | 6.72 | 5.87 | 4.95 | 5.84 | | |
| Y79AA1000268 | 2.65 | 5.48 | 5.09 | 4.33 | 5.76 | 4.01 | | |
| Y79AA1000269 | 4.32 | 7.88 | 7.86 | 8 | 6.86 | 8.24 | | |
| Y79AA1000270 | 5.28 | 8.35 | 11.58 | 13.17 | 17.58 | 16.23 | * | + |
| Y79AA1000280 | 1.74 | 4.17 | 4.9 | 5.29 | 3.1 | 5.27 | | |
| Y79AA1000285 | 3.44 | 4.21 | 5.91 | 4.01 | 6.86 | 5.22 | | |
| Y79AA1000295 | 0.75 | 3.06 | 4.85 | 4.32 | 4.23 | 4.45 | | |
| Y79AA1000307 | 2.88 | 3.91 | 5.06 | 9.35 | 7.58 | 11.25 | * | + |
| Y79AA1000313 | 3.11 | 9.02 | 9.85 | 10.61 | 12.84 | 13.36 | | |
| Y79AA1000314 | 4.23 | 10.74 | 9.19 | 6.93 | 6.53 | 7.51 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| Y79AA1000328 | 4.65 | 10.05 | 2.64 | 7.73 | 9.28 | 8.68 | | |
| Y79AA1000334 | 1.43 | 4.22 | 3.55 | 2.68 | 2.81 | 3.46 | | |
| Y79AA1000342 | 10.65 | 10.05 | 26.47 | 23.7 | 19.13 | 28.35 | | |
| Y79AA1000346 | 7.61 | 8.17 | 7.9 | 20.1 | 22.06 | 20.18 | ** | + |
| Y79AA1000347 | 6.94 | 7.96 | 12.42 | 18.78 | 16.47 | 18.48 | ** | + |
| Y79AA1000349 | 6.93 | 9.63 | 12.67 | 12.31 | 11.96 | 14.75 | | |
| Y79AA1000355 | 3.17 | 8.28 | 8.94 | 8.84 | 13.55 | 8.77 | | |
| Y79AA1000368 | 5.24 | 8.39 | 24.43 | 22.48 | 35.67 | 22.55 | | |
| Y79AA1000388 | 22.9 | 32.66 | 62.37 | 94.17 | 128.35 | 109.08 | ** | + |
| Y79AA1000392 | 3.02 | 6.81 | 3.76 | 3.42 | 2.73 | 3.78 | | |
| Y79AA1000405 | 3.98 | 5.97 | 8.25 | 7.14 | 8.17 | 9.32 | | |
| Y79AA1000410 | 6.01 | 7.87 | 15.72 | 13.79 | 17.05 | 14.95 | | |
| Y79AA1000420 | 1.54 | 4.78 | 3.13 | 3.32 | 3.95 | 5.1 | | |
| Y79AA1000423 | 1.38 | 7.08 | 5.59 | 5.22 | 6.04 | 10.27 | | |
| Y79AA1000426 | 3.61 | 9.44 | 8.66 | 4.24 | 4.43 | 5.22 | | |
| Y79AA1000432 | 0.8 | 4.79 | 2.16 | 1.91 | 2.01 | 2.34 | | |
| Y79AA1000453 | 23.94 | 30.67 | 47.79 | 39.74 | 50.65 | 58.24 | | |
| Y79AA1000465 | 4.12 | 6.02 | 6.65 | 4.77 | 4.14 | 7.69 | | |
| Y79AA1000469 | 11.59 | 9.61 | 18.04 | 13.82 | 16.21 | 17.18 | | |
| Y79AA1000480 | 1.24 | 4.37 | 2.78 | 3.33 | 3.57 | 2.79 | | |
| Y79AA1000502 | 5.31 | 7.97 | 12.58 | 10.49 | 11.35 | 15.26 | | |
| Y79AA1000521 | 1.24 | 4.4 | 4.13 | 2.51 | 3.61 | 2.7 | | |
| Y79AA1000534 | 3.22 | 8.13 | 8.92 | 11.97 | 14.41 | 13.46 | * | + |
| Y79AA1000538 | 3.58 | 6.95 | 8.79 | 9.52 | 12.12 | 8.41 | | |
| Y79AA1000539 | 12.76 | 14.96 | 53.11 | 42.61 | 68.56 | 50.97 | | |
| Y79AA1000540 | 1.32 | 3.59 | 1.61 | 2.54 | 2.97 | 3.21 | | |
| Y79AA1000560 | 160.46 | 140.99 | 339.33 | 380.8 | 313.21 | 220.43 | | |
| Y79AA1000574 | 1 | 2.92 | 1.65 | 1.98 | 2.04 | 1.59 | | |
| Y79AA1000584 | 2.07 | 4.55 | 4.97 | 4.62 | 5.39 | 4.04 | | |
| Y79AA1000589 | 10.74 | 13.67 | 81.43 | 59.09 | 95.35 | 68.5 | | |
| Y79AA1000598 | 1.43 | 7.64 | 2.17 | 1.85 | 3.88 | 3.18 | | |
| Y79AA1000600 | 2.7 | 10.02 | 7.93 | 13.64 | 15.64 | 12.84 | * | + |
| Y79AA1000609 | 1.18 | 5.16 | 1.44 | 2.28 | 2.77 | 1.55 | | |
| Y79AA1000618 | 1.85 | 10.59 | 5.76 | 7.4 | 9.5 | 9.37 | | |
| Y79AA1000627 | 1.91 | 3.93 | 4.57 | 3.27 | 3.02 | 2.43 | | |
| Y79AA1000636 | 5.16 | 5.7 | 9.9 | 15.57 | 11.52 | 5.38 | | |
| Y79AA1000649 | 9.45 | 10.97 | 12.73 | 18.7 | 11.56 | 20.54 | | |
| Y79AA1000656 | 15.32 | 20.21 | 96.75 | 80.17 | 115.97 | 82.61 | | |
| Y79AA1000673 | 1.02 | 5.86 | 2.14 | 1.39 | 3.13 | 2.4 | | |
| Y79AA1000674 | 11.88 | 21.96 | 78.28 | 59.4 | 98.22 | 62.67 | | |
| Y79AA1000678 | 2.48 | 8.91 | 3.88 | 3.01 | 4.15 | 2.45 | | |
| Y79AA1000682 | 17.99 | 53.99 | 93.7 | 102.53 | 110.87 | 118.22 | | |
| Y79AA1000683 | 1.87 | 2.66 | 3.21 | 4.27 | 2.59 | 2.17 | | |
| Y79AA1000697 | 21.76 | 27.52 | 43.01 | 21.93 | 24.76 | 27.31 | | |
| Y79AA1000700 | 5.07 | 7.1 | 7.08 | 7.51 | 6.93 | 9.97 | | |
| Y79AA1000702 | 5.13 | 14.57 | 13.31 | 41.48 | 56.57 | 63.15 | ** | + |
| Y79AA1000704 | 1.34 | 5.24 | 1.14 | 1.5 | 2.1 | 1.18 | | |
| Y79AA1000705 | 1.86 | 9.7 | 6.24 | 6.06 | 7.98 | 6.45 | | |
| Y79AA1000717 | 6.18 | 12.39 | 9.42 | 9.73 | 11.1 | 8.7 | | |
| Y79AA1000722 | 5.61 | 8.6 | 8.65 | 26.26 | 34.81 | 34.31 | ** | + |
| Y79AA1000724 | 6.42 | 9.77 | 18.55 | 26.57 | 21.7 | 11.95 | | |
| Y79AA1000726 | 0.77 | 1.24 | 0.83 | 1.46 | 2.01 | 0.71 | | |
| Y79AA1000734 | 2.05 | 4.46 | 4.92 | 3.57 | 3.3 | 2.94 | | |
| Y79AA1000748 | 0.88 | 4.38 | 1.77 | 2.14 | 2.99 | 1.56 | | |
| Y79AA1000750 | 4.17 | 8.47 | 20.58 | 18.11 | 20.02 | 18.62 | | |
| Y79AA1000752 | 1.25 | 5.13 | 2.33 | 2.23 | 3.38 | 3.38 | | |
| Y79AA1000774 | 2.11 | 6.23 | 4.24 | 4.28 | 5.79 | 4.21 | | |
| Y79AA1000776 | 1.2 | 4.37 | 1.9 | 2.13 | 1.83 | 2.11 | | |
| Y79AA1000777 | 4.36 | 5.84 | 9.63 | 10.05 | 6.99 | 6.01 | | |
| Y79AA1000778 | 1.72 | 3.77 | 3.79 | 3.87 | 4.19 | 1.44 | | |
| Y79AA1000782 | 2.08 | 4.18 | 3.72 | 3.53 | 2.89 | 2.96 | | |
| Y79AA1000784 | 7.04 | 10.01 | 7.78 | 13.87 | 15.58 | 14.26 | ** | + |
| Y79AA1000794 | 0.61 | 5.21 | 1.88 | 2.92 | 1.69 | 1.23 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| Y79AA1000800 | 1.59 | 5.44 | 3.82 | 3.38 | 2.97 | 3.39 | | |
| Y79AA1000802 | 0.64 | 4.18 | 1.15 | 2.52 | 1.77 | 2.1 | | |
| Y79AA1000805 | 2.29 | 4.03 | 2.63 | 2.43 | 2.11 | 2.6 | | |
| Y79AA1000814 | 2.73 | 3.9 | 4.14 | 4.98 | 7.09 | 6.76 | * | + |
| Y79AA1000823 | 7.91 | 9.99 | 12.07 | 12.02 | 12.42 | 6.56 | | |
| Y79AA1000824 | 0.98 | 2.47 | 1.84 | 2.75 | 2.26 | 0.79 | | |
| Y79AA1000827 | 1.6 | 4.02 | 7.27 | 6.71 | 8.91 | 6.14 | | |
| Y79AA1000831 | 7.04 | 10.49 | 17.32 | 26.61 | 30.43 | 27.82 | ** | + |
| Y79AA1000833 | 62.14 | 67.46 | 191.76 | 270.42 | 308.16 | 248.21 | * | + |
| Y79AA1000850 | 1.69 | 5.68 | 2.72 | 4.92 | 4.59 | 4.21 | | |
| Y79AA1000856 | 3.49 | 6.78 | 6.31 | 9.28 | 6.01 | 8.51 | | |
| Y79AA1000862 | 2.22 | 2.76 | 2.44 | 3.08 | 2.87 | 2.59 | | |
| Y79AA1000876 | 7.46 | 10.04 | 17.91 | 27.36 | 27.61 | 25.46 | ** | + |
| Y79AA1000888 | 4.59 | 5.07 | 28.1 | 24.51 | 38.78 | 22.48 | | |
| Y79AA1000902 | 4.65 | 5.74 | 8.44 | 12.18 | 12.32 | 7.68 | | |
| Y79AA1000935 | 3.53 | 5.99 | 6.69 | 8.28 | 10.07 | 9.18 | * | + |
| Y79AA1000959 | 0.74 | 6.29 | 4.35 | 6.71 | 5.77 | 6.07 | | |
| Y79AA1000962 | 1.22 | 4.45 | 3.18 | 2.9 | 2.41 | 1.79 | | |
| Y79AA1000963 | 18.6 | 26.86 | 35.93 | 31.61 | 42.17 | 49.13 | | |
| Y79AA1000966 | 18.52 | 19.25 | 98.18 | 77.47 | 116.12 | 61.1 | | |
| Y79AA1000967 | 8.62 | 8.82 | 33.82 | 34.47 | 40.36 | 29.3 | | |
| Y79AA1000968 | 3.32 | 5.67 | 6.89 | 8.86 | 9.4 | 7.96 | * | + |
| Y79AA1000969 | 0.91 | 3.18 | 3.04 | 2.66 | 2.91 | 1.41 | | |
| Y79AA1000976 | 1.43 | 4.72 | 3.02 | 2.55 | 3.51 | 1.43 | | |
| Y79AA1000978 | 1.99 | 5.6 | 7.26 | 6.9 | 10.54 | 5.56 | | |
| Y79AA1000985 | 9.39 | 12.84 | 40.49 | 38.26 | 44.3 | 27.89 | | |
| Y79AA1000989 | 21.59 | 22.49 | 46.19 | 51.84 | 58.65 | 55.19 | * | |
| Y79AA1000991 | 22.11 | 22.21 | 110.42 | 72.46 | 96.96 | 82.23 | | |
| Y79AA1001013 | 59.2 | 62.64 | 140.9 | 174.85 | 214.13 | 201.9 | * | + |
| Y79AA1001014 | 2.27 | 4.16 | 4.1 | 4.8 | 5.2 | 6.55 | | |
| Y79AA1001019 | 3.37 | 5.89 | 7.74 | 9.24 | 9.02 | 9.43 | * | + |
| Y79AA1001020 | 5.37 | 7.82 | 9.43 | 12.31 | 11.11 | 10.86 | * | + |
| Y79AA1001023 | 0.83 | 6.11 | 2.29 | 1.22 | 1.95 | 1.54 | | |
| Y79AA1001030 | 4.23 | 8.79 | 10.87 | 11.14 | 10.72 | 12.43 | | |
| Y79AA1001035 | 0.19 | 2.88 | 0.03 | 14.44 | 8.19 | 17.16 | * | + |
| Y79AA1001041 | 1.78 | 2.46 | 2.36 | 2.93 | 2.45 | 2.78 | | |
| Y79AA1001043 | 11.65 | 12.62 | 15.22 | 8.64 | 12.01 | 14.71 | | |
| Y79AA1001048 | 1.1 | 4.78 | 3.73 | 4.05 | 4.52 | 4.21 | | |
| Y79AA1001056 | 4.56 | 7.82 | 11.04 | 8.27 | 7.11 | 9.94 | | |
| Y79AA1001061 | 1.53 | 7.79 | 5.28 | 6.13 | 7.46 | 6.66 | | |
| Y79AA1001062 | 2.62 | 6.14 | 5.02 | 4.44 | 6.01 | 4.67 | | |
| Y79AA1001068 | 3.46 | 6.39 | 7.29 | 6.61 | 8.69 | 7.05 | | |
| Y79AA1001073 | 8.19 | 13.08 | 17.46 | 24.14 | 22.1 | 29.81 | * | + |
| Y79AA1001077 | 7.1 | 7.08 | 17.15 | 14.69 | 14.74 | 17.08 | | |
| Y79AA1001078 | 3.11 | 8.34 | 11.07 | 5.01 | 12.15 | 12.92 | | |
| Y79AA1001081 | 3.59 | 5.61 | 4.94 | 9.62 | 9.98 | 10.5 | ** | + |
| Y79AA1001088 | 27.75 | 38.61 | 69.33 | 93.1 | 88.97 | 113.04 | * | + |
| Y79AA1001089 | 4.64 | 7.8 | 11.92 | 22.67 | 22.6 | 27.73 | ** | + |
| Y79AA1001090 | 1.38 | 4.15 | 2.2 | 3.58 | 2.83 | 2.35 | | |
| Y79AA1001105 | 3.7 | 5.23 | 15.81 | 12.52 | 22.1 | 13.35 | | |
| Y79AA1001142 | 8.53 | 13.38 | 15.85 | 14.28 | 11.42 | 22.32 | | |
| Y79AA1001145 | 2.22 | 4.68 | 5.13 | 4.97 | 6.26 | 5.87 | | |
| Y79AA1001162 | 2.27 | 2.91 | 1.62 | 1.62 | 4.56 | 4 | | |
| Y79AA1001167 | 0.86 | 2.76 | 2.38 | 1.12 | 2.35 | 0.77 | | |
| Y79AA1001176 | 0.57 | 3.33 | 1.14 | 2.02 | 1.68 | 0.88 | | |
| Y79AA1001177 | 1.21 | 5.5 | 2.22 | 2.35 | 3.01 | 1.99 | | |
| Y79AA1001179 | 6.81 | 8.66 | 16.73 | 22.82 | 22.64 | 20.07 | * | + |
| Y79AA1001185 | 1.33 | 5.3 | 4.55 | 3.65 | 4.49 | 5.8 | | |
| Y79AA1001201 | 5.69 | 11.3 | 16.13 | 14.57 | 15.21 | 19.38 | | |
| Y79AA1001205 | 1.87 | 3.28 | 2.85 | 5.87 | 4.85 | 4.09 | * | + |
| Y79AA1001211 | 1.64 | 4.75 | 6.93 | 4.83 | 4.36 | 4.15 | | |
| Y79AA1001212 | 3.55 | 6.93 | 15.91 | 13.74 | 15 | 11.65 | | |
| Y79AA1001216 | 52.59 | 51.46 | 93.73 | 76.52 | 97.53 | 109.55 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| Y79AA1001228 | 6.1 | 11.21 | 9.34 | 8.99 | 12.19 | 10.24 | | |
| Y79AA1001233 | 0.68 | 11.46 | 2.39 | 0.92 | 1.66 | 1.09 | | |
| Y79AA1001236 | 4.46 | 12.86 | 9.25 | 11.4 | 10.66 | 13.08 | | |
| Y79AA1001239 | 4.62 | 13.93 | 9.94 | 11.53 | 12.15 | 12.94 | | |
| Y79AA1001240 | 8.74 | 8.61 | 3.75 | 9.13 | 6.68 | 3.01 | | |
| Y79AA1001255 | 10.37 | 12.22 | 22.61 | 12.47 | 7.51 | 6.57 | | |
| Y79AA1001264 | 3.63 | 5.15 | 4.49 | 7.73 | 8.59 | 8.75 | ** | + |
| Y79AA1001272 | 10.81 | 13.63 | 17.47 | 21.56 | 20.67 | 21.32 | * | + |
| Y79AA1001281 | 0.45 | 4.95 | 1.89 | 1.42 | 1.81 | 0.95 | | |
| Y79AA1001299 | 2.49 | 11.34 | 9.06 | 9.9 | 9.26 | 9.81 | | |
| Y79AA1001312 | 2.49 | 10.36 | 5.17 | 2.15 | 4.77 | 4.14 | | |
| Y79AA1001319 | 3.34 | 11.88 | 5.27 | 7.23 | 6.05 | 7.15 | | |
| Y79AA1001323 | 1.22 | 1.16 | 2.09 | 1.11 | 1.55 | 0.89 | | |
| Y79AA1001328 | 2.04 | 3.18 | 3.62 | 4.66 | 4.48 | 4.05 | * | + |
| Y79AA1001343 | 154.19 | 151.55 | 345.05 | 304.88 | 394.54 | 265.65 | | |
| Y79AA1001351 | 0.81 | 2.77 | 1.67 | 0.03 | 1.26 | 0.96 | | |
| Y79AA1001364 | 1.65 | 6.07 | 4.03 | 3.39 | 4.43 | 3.6 | | |
| Y79AA1001367 | 2.16 | 7.41 | 2.93 | 3.09 | 5.34 | 3.19 | | |
| Y79AA1001384 | 0.5 | 5.14 | 1.98 | 0.73 | 1.15 | 0.94 | | |
| Y79AA1001391 | 0.59 | 3.73 | 2.88 | 1.35 | 1.65 | 1.2 | | |
| Y79AA1001394 | 3.12 | 4.66 | 12.92 | 10.94 | 9.56 | 10.94 | | |
| Y79AA1001402 | 2.77 | 3.7 | 5.95 | 5.65 | 5.09 | 4.14 | | |
| Y79AA1001410 | 0.82 | 2.78 | 2.33 | 2.06 | 2.31 | 2.25 | | |
| Y79AA1001414 | 2.76 | 7.5 | 7.59 | 11.08 | 10.73 | 10.06 | * | + |
| Y79AA1001426 | 0.61 | 4.36 | 2.61 | 1.5 | 1.43 | 1.82 | | |
| Y79AA1001427 | 14.22 | 13.44 | 86.36 | 59.92 | 88.36 | 63.53 | | |
| Y79AA1001430 | 11.28 | 16.98 | 20.98 | 29.04 | 34.03 | 34.38 | ** | + |
| Y79AA1001439 | 16.22 | 21.53 | 33.42 | 45.02 | 43.74 | 43.1 | * | + |
| Y79AA1001485 | 1.65 | 2.51 | 4.38 | 4.85 | 3.88 | 3.57 | | |
| Y79AA1001493 | 1.29 | 2.3 | 3.43 | 2.43 | 2.35 | 2.46 | | |
| Y79AA1001511 | 4.79 | 8.57 | 11.05 | 9.39 | 9.11 | 6.47 | | |
| Y79AA1001523 | 2.64 | 6.57 | 5.08 | 8.74 | 7.37 | 6.1 | | |
| Y79AA1001530 | 7.46 | 11.69 | 22 | 41.43 | 36.37 | 36.07 | ** | + |
| Y79AA1001532 | 5.12 | 7.35 | 6.69 | 10.49 | 14.82 | 12.9 | * | + |
| Y79AA1001533 | 1.84 | 4.89 | 2.53 | 4.15 | 4 | 4.19 | | |
| Y79AA1001541 | 2.82 | 5.89 | 7.54 | 7.23 | 5.08 | 7.34 | | |
| Y79AA1001548 | 4.25 | 4.84 | 9.82 | 10.46 | 7.37 | 7.1 | | |
| Y79AA1001555 | 2 | 2.55 | 3.65 | 4.7 | 5.28 | 4.25 | * | + |
| Y79AA1001562 | 7.76 | 10.11 | 17.15 | 14.07 | 16.16 | 10.83 | | |
| Y79AA1001581 | 2 | 5.05 | 4.47 | 5.1 | 7.01 | 3.54 | | |
| Y79AA1001585 | 3.18 | 7.38 | 10.96 | 9.72 | 10.93 | 8.05 | | |
| Y79AA1001592 | 2.61 | 7.38 | 5.97 | 8.15 | 8 | 7.02 | | |
| Y79AA1001594 | 0.76 | 4.73 | 3.85 | 1.96 | 3.24 | 1.73 | | |
| Y79AA1001603 | 56.74 | 70.81 | 153.14 | 131.56 | 112.16 | 107.66 | | |
| Y79AA1001613 | 3.74 | 3.52 | 14.81 | 13.12 | 15.36 | 10.66 | | |
| Y79AA1001630 | 0.71 | 2.36 | 1.73 | 1.14 | 2.64 | 0.67 | | |
| Y79AA1001647 | 1.96 | 3.57 | 2.47 | 4.14 | 4.32 | 2.65 | | |
| Y79AA1001664 | 4.67 | 8.39 | 11.43 | 8.96 | 10.01 | 8.73 | | |
| Y79AA1001665 | 1.39 | 6.4 | 3.73 | 4.67 | 4.71 | 3.75 | | |
| Y79AA1001679 | 8.92 | 15.94 | 20.71 | 20.53 | 26.67 | 25.35 | | |
| Y79AA1001692 | 1.87 | 5.55 | 3.95 | 3.99 | 3.95 | 3.51 | | |
| Y79AA1001696 | 1.97 | 6.49 | 2.77 | 1.83 | 2.63 | 2.55 | | |
| Y79AA1001705 | 6.09 | 6.44 | 10.39 | 7.62 | 7.92 | 7.85 | | |
| Y79AA1001711 | 16.17 | 12.34 | 29.74 | 13.73 | 23.83 | 21 | | |
| Y79AA1001717 | 0.72 | 2.99 | 1.29 | 1.68 | 3.13 | 1.14 | | |
| Y79AA1001719 | 2.5 | 5.79 | 6.44 | 6.15 | 6.07 | 6.43 | | |
| Y79AA1001727 | 6.87 | 12.13 | 14.99 | 8.73 | 14.71 | 8.77 | | |
| Y79AA1001750 | 10.21 | 13.63 | 21.67 | 21.92 | 32.29 | 24.33 | | |
| Y79AA1001760 | 25.24 | 27.3.11 | 22.97 | 113.56 | 1.55 | 1783.24 | | |
| Y79AA1001777 | 1.17 | 3.59 | 1.6 | 2.49 | 1.75 | 1.28 | | |
| Y79AA1001781 | 0.31 | 2.3 | 0.42 | 1.62 | 1.84 | 1.42 | | |
| Y79AA1001787 | 1 | 3.94 | 3.54 | 5.51 | 5.18 | 5.15 | | |
| Y79AA1001793 | 16.23 | 15.19 | 91.7 | 60.44 | 87.21 | 75.35 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and −, respectively. The results of test for significance of difference are shown in the columns of *:$p < 0.05$ and **:$p < 0.01$.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| Y79AA1001795 | 1.23 | 3.84 | 2.24 | 2.05 | 2.45 | 2.8 | | |
| Y79AA1001799 | 4.9 | 8.35 | 6.99 | 10.7 | 10.72 | 11.26 | * | + |
| Y79AA1001800 | 2.25 | 8.3 | 10.1 | 8.49 | 10.51 | 9.9 | | |
| Y79AA1001801 | 1.77 | 6.44 | 4.87 | 7.67 | 5.91 | 7.33 | | |
| Y79AA1001803 | 0.74 | 2.15 | 1.72 | 1.85 | 1.68 | 1.17 | | |
| Y79AA1001805 | 6.05 | 6.88 | 12.15 | 10.21 | 8.32 | 11.15 | | |
| Y79AA1001807 | 3.37 | 6.33 | 12.56 | 11.76 | 17.8 | 16.79 | | |
| Y79AA1001827 | 1.7 | 4.41 | 3.12 | 3.43 | 3.6 | 2.52 | | |
| Y79AA1001846 | 1.82 | 6.52 | 5.51 | 6.52 | 5.09 | 5.07 | | |
| Y79AA1001848 | 0.86 | 5.57 | 2.75 | 5.98 | 4.78 | 5.14 | | |
| Y79AA1001853 | 1.38 | 6.16 | 2.76 | 3.24 | 4.56 | 3.63 | | |
| Y79AA1001863 | 0.86 | 5 | 2.53 | 2.93 | 3.83 | 3.85 | | |
| Y79AA1001866 | 2.29 | 3.2 | 5.81 | 3.53 | 3.98 | 3.46 | | |
| Y79AA1001874 | 0.12 | 2.18 | −0.21 | 1.17 | 0.75 | 0.51 | | |
| Y79AA1001875 | 9.33 | 12.67 | 13.09 | 11.05 | 17.79 | 18.63 | | |
| Y79AA1001907 | 68.02 | 70.94 | 96.4 | 118.34 | 86.75 | 104.86 | | |
| Y79AA1001908 | 0.64 | 8.4 | 2.29 | 1.92 | 2.59 | 2.31 | | |
| Y79AA1001923 | 1.61 | 6.64 | 3.03 | 3.86 | 3.76 | 3.35 | | |
| Y79AA1001927 | 19.1 | 22.05 | 36.94 | 42.46 | 45.29 | 48.81 | * | + |
| Y79AA1001930 | 4.07 | 6.65 | 8.07 | 7.92 | 12.42 | 12.21 | | |
| Y79AA1001932 | 2.84 | 4.41 | 8.47 | 11.51 | 9.1 | 8.57 | | |
| Y79AA1001933 | 2.14 | 3.27 | 3.69 | 4.34 | 7.99 | 6.65 | * | + |
| Y79AA1001942 | 1.58 | 3.45 | 2.69 | 2.94 | 2.13 | 2.41 | | |
| Y79AA1001963 | 9.6 | 9.37 | 46.06 | 38.48 | 49.64 | 47.27 | | |
| Y79AA1001968 | 18.61 | 27.73 | 37.44 | 42.93 | 44.16 | 55.23 | * | + |
| Y79AA1001983 | 1.81 | 6.35 | 4.28 | 3.97 | 5.86 | 4.47 | | |
| Y79AA1002000 | 2.55 | 5.35 | 4.55 | 4.42 | 3.21 | 2.83 | | |
| Y79AA1002004 | 13.1 | 18.87 | 27.47 | 23.72 | 29.45 | 40.93 | | |
| Y79AA1002008 | 2.51 | 3.73 | 3.79 | 4.54 | 2.19 | 2.85 | | |
| Y79AA1002012 | 1.37 | 3.22 | 2.81 | 3.22 | 2.29 | 2.87 | | |
| Y79AA1002017 | 1.34 | 2.53 | 2.46 | 3.51 | 3.07 | 2.82 | | |
| Y79AA1002022 | 2.99 | 4.94 | 5.93 | 7.32 | 7.51 | 6.01 | | |
| Y79AA1002027 | 2.02 | 6.33 | 2.67 | 2.69 | 4.03 | 4.09 | | |
| Y79AA1002050 | 2.53 | 8.12 | 4.22 | 6.68 | 6.91 | 5.11 | | |
| Y79AA1002058 | 13.69 | 21.8 | 70.12 | 59.07 | 70.89 | 55.33 | | |
| Y79AA1002060 | 6.38 | 13.17 | 20.54 | 17.14 | 21.12 | 24.23 | | |
| Y79AA1002062 | 4.33 | 5.18 | 8.15 | 8.54 | 6.66 | 5.51 | | |
| Y79AA1002065 | 33.54 | 39.97 | 72.6 | 49.46 | 30.04 | 41.81 | | |
| Y79AA1002067 | 10.11 | 11.64 | 17.24 | 16.25 | 9.42 | 8.13 | | |
| Y79AA1002069 | 0.97 | 1.79 | 0.54 | 1.55 | 1.44 | 0.66 | | |
| Y79AA1002070 | 10.16 | 33.47 | 44.36 | 52.16 | 71.15 | 73.35 | * | + |
| Y79AA1002074 | 38.55 | 74.38 | 179.61 | 65.55 | 282.48 | 224.96 | | |
| Y79AA1002076 | 0.48 | 9.71 | 2.89 | 2.86 | 3.34 | 1.91 | | |
| Y79AA1002083 | 1.2 | 7.48 | 2.03 | 2.73 | 1.75 | 2.06 | | |
| Y79AA1002084 | 1.79 | 2.59 | 4.54 | 3.73 | 3.73 | 2.98 | | |
| Y79AA1002086 | 0.96 | 1.78 | 1.71 | 2.77 | 1.88 | 1.43 | | |
| Y79AA1002087 | 11.18 | 14.9 | 27.67 | 33.34 | 30.01 | 23.08 | | |
| Y79AA1002089 | 1.18 | 3.46 | 2.13 | 1.46 | 2.92 | 3.26 | | |
| Y79AA1002093 | 2.19 | 5.48 | 5.25 | 5.28 | 5.68 | 6.17 | | |
| Y79AA1002101 | 1.11 | 8.58 | 2.98 | 6.54 | 5.58 | 6.6 | | |
| Y79AA1002103 | 1.47 | 10.22 | 3.39 | 4.43 | 6.49 | 4.7 | | |
| Y79AA1002115 | 4.34 | 9.78 | 7.37 | 7.45 | 7.03 | 6.95 | | |
| Y79AA1002121 | 1.55 | 2.16 | 2.18 | 1.67 | 2.55 | 2.31 | | |
| Y79AA1002125 | 6.67 | 7.08 | 9.29 | 8.81 | 6.4 | 7.6 | | |
| Y79AA1002129 | 1.64 | 6.23 | 7.84 | 5.41 | 2.2 | 4.93 | | |
| Y79AA1002131 | 0.9 | 3.25 | 0.78 | 0.77 | 1.29 | 1.15 | | |
| Y79AA1002139 | 0.69 | 5.02 | 1.04 | 1.83 | 1.53 | 1.34 | | |
| Y79AA1002144 | 25.99 | 29.62 | 51.01 | 42.61 | 51.16 | 43.17 | | |
| Y79AA1002177 | 1.72 | 5.97 | 4.33 | 4.79 | 3.09 | 4.73 | | |
| Y79AA1002183 | 10.44 | 13.89 | 17.69 | 27.61 | 29.67 | 28.92 | ** | + |
| Y79AA1002202 | 3.97 | 7.15 | 8.34 | 18.27 | 10.12 | 17.85 | * | + |
| Y79AA1002204 | 0.53 | 0.99 | 1.56 | 1.7 | 2.2 | 1.54 | | |
| Y79AA1002206 | 2.63 | 5.36 | 7.28 | 4.35 | 2.95 | 1.49 | | |

TABLE 343-continued

Expression of each cDNA in synovial cells or in the synovial cells in the presence of TNF (This table also contains clones without description in Examples) In the table, Synoviocyte and Synoviocyte_TNF represent synovial cells and TNF-treated synovial cells, respectively. The assay was performed in triplicate (n = 3), and each result is shown in the column of exp.1, exp.2, or exp.3. In addition, "t-test vs TNF" represents a result of test for significance of difference between the untreated synovial cells and the TNF-treated synovial cells. The increase and decrease in the expression level of a particular gene in response to TNF are represented by + and –, respectively. The results of test for significance of difference are shown in the columns of *:p < 0.05 and **:p < 0.01.

| Clone | Synoviocyte | | | Synoviocute_TNF | | | t test vs TNF | INC. and DEC. |
|---|---|---|---|---|---|---|---|---|
| | exp. 1 | exp. 2 | exp. 3 | exp. 1 | exp. 2 | exp. 3 | | |
| Y79AA1002208 | 4.26 | 6.54 | 3.94 | 6.88 | 6.3 | 3.96 | | |
| Y79AA1002209 | 1.8 | 6.34 | 2.88 | 4.38 | 3.74 | 4.57 | | |
| Y79AA1002210 | 0.41 | 4.14 | 2.09 | 1.8 | 2.24 | 1.65 | | |
| Y79AA1002211 | 2.25 | 5.39 | 3.85 | 5.71 | 5.3 | 4.5 | | |
| Y79AA1002213 | 1.15 | 4.13 | 6.53 | 7.38 | 7.54 | 7.43 | | |
| Y79AA1002215 | 18.7 | 18.69 | 26.61 | 17.72 | 15.59 | 9.62 | | |
| Y79AA1002220 | 3.78 | 3.38 | 2.87 | 4.89 | 4.19 | 4.14 | * | + |
| Y79AA1002226 | 8.54 | 8.9 | 9.75 | 13.06 | 14.2 | 4.41 | | |
| Y79AA1002229 | 1.35 | 3.88 | 3.38 | 2.95 | 2.79 | 2.67 | | |
| Y79AA1002234 | 3.24 | 6.82 | 3.94 | 4.29 | 7.74 | 6.88 | | |
| Y79AA1002235 | 5.6 | 7.55 | 6.43 | 8.78 | 9.74 | 9.47 | * | + |
| Y79AA1002246 | 0.59 | 5.06 | 2.41 | 3.94 | 2.54 | 4.27 | | |
| Y79AA1002258 | 0.72 | 7.26 | 2.92 | 3.99 | 4.19 | 2.7 | | |
| Y79AA1002279 | 17.79 | 19.12 | 27.8 | 16.52 | 19.13 | 11.5 | | |
| Y79AA1002292 | 1.68 | 2.1 | 3.22 | 2.96 | 3.91 | 2.73 | | |
| Y79AA1002298 | 0.76 | 2.52 | 1.32 | 2.03 | 2.77 | 1.06 | | |
| Y79AA1002307 | 1.05 | 4.35 | 1.79 | 0.76 | 1.05 | 1.2 | | |
| Y79AA1002309 | 1.15 | 4.19 | 2.3 | 2.21 | 1.78 | 2.55 | | |
| Y79AA1002311 | 2.84 | 7.35 | 3.43 | 5.71 | 6.04 | 5.45 | | |
| Y79AA1002334 | 1.72 | 6.54 | 2.95 | 4.77 | 4.19 | 3.35 | | |
| Y79AA1002351 | 1.27 | 5.5 | 2.89 | 3.5 | 3.38 | 3.06 | | |
| Y79AA1002355 | 12.83 | 12.25 | 28.96 | 22.94 | 22.07 | 21.02 | | |
| Y79AA1002361 | 2.22 | 2.27 | 3.26 | 2.47 | 4.54 | 1.55 | | |
| Y79AA1002365 | 0.66 | 2.04 | 2.26 | 1.97 | 3.51 | 2.25 | | |
| Y79AA1002373 | 1.17 | 3.93 | 2.42 | 1.59 | 1.97 | 1.43 | | |
| Y79AA1002376 | 110.81 | 135.82 | 249.8 | 205.99 | 213.25 | 191.69 | | |
| Y79AA1002378 | 1.9 | 4.8 | 4.91 | 2.2 | 3.6 | 3 | | |
| Y79AA1002381 | 8.65 | 14.11 | 19.19 | 18.84 | 21.52 | 17.97 | | |
| Y79AA1002388 | 7.05 | 9.99 | 18.24 | 15.88 | 21.51 | 19.99 | | |
| Y79AA1002399 | 1.79 | 4.25 | 3.74 | 4.62 | 4.08 | 3.47 | | |
| Y79AA1002407 | 3.05 | 4.16 | 3.13 | 4.66 | 5.77 | 4.5 | * | + |
| Y79AA1002413 | 3.21 | 6.78 | 8.05 | 6.46 | 8.32 | 6.87 | | |
| Y79AA1002416 | 1.46 | 5 | 2.74 | 2.49 | 3.44 | 3.55 | | |
| Y79AA1002429 | 5.5 | 8.15 | 7.27 | 8 | 11.11 | 8.01 | | |
| Y79AA1002431 | 0.92 | 4.43 | 0.48 | 0.79 | 1.78 | 0.89 | | |
| Y79AA1002433 | 1.27 | 5.9 | 3.24 | 4.8 | 3.84 | 5.58 | | |
| Y79AA1002445 | 4.01 | 5.34 | 5.76 | 3.1 | 4.89 | 5.41 | | |
| Y79AA1002461 | 0.63 | 2.45 | 1.79 | 1.19 | 2.71 | 1.41 | | |
| Y79AA1002466 | 39.02 | 70.71 | 94.5 | 91.12 | 82.27 | 94.71 | | |
| Y79AA1002471 | 4.44 | 6.67 | 6.08 | 7.43 | 8.06 | 10.49 | | |
| Y79AA1002472 | 2.41 | 6.16 | 5.99 | 6.8 | 8.39 | 4.06 | | |
| Y79AA1002474 | 1.93 | 8.27 | 4.31 | 4.89 | 6.52 | 7.13 | | |
| Y79AA1002482 | 3.52 | 6.66 | 10.37 | 9.02 | 11.81 | 8.69 | | |
| Y79AA1002487 | 1.38 | 4.12 | 2.46 | 1.96 | 3.01 | 2.56 | | |
| Y79AA1002490 | 10.37 | 9.91 | 16.35 | 11.11 | 12.88 | 16.86 | | |
| Y79AA1002493 | 1.96 | 4.07 | 6.14 | 6.5 | 8.9 | 4.1 | | |
| ZRV6G1006278 | 0.61 | 4.08 | 2.22 | 1.81 | 1.58 | 2.11 | | |

SEQUENCE LISTING (679 sequences)

SEQ ID NO: 1 - DNA, 1992 bp, Homo sapiens
  CDS (192)..(869)
cgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcacgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccac

SEQ ID NO: 2 - protein, 226 aa, Homo sapiens
MKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 3 - DNA, 1883 bp, Homo sapiens
  CDS (124)..(1101): "n" may be a, t, c, g, other or unknown
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4 - protein, 326 aa, Homo sapiens
  "Xaa" may be any, other or unknown amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 5 - DNA, 1366 bp, Homo sapiens
  CDS (59)..(718)
acactcggcctaggaatttcccttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccgtcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgtggcgctagagccatccagaagtggcagtgcccaacagccttgggatgggttcgtaccttttgtttctgcctcctgctatttttcttttgactgaggatatttaaaattcatttgaaaactgagctaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgc

SEQ ID NO: 6 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAVIRDFYNPLVAEAQKRELGASLYLGWAASGLLLLGGGLLCCTCPSGGSQGPSHYMARYSTSAPAISRGPSEYPTKNYV

SEQ ID NO: 7 - DNA, 3425 bp, Homo sapiens
  CDS (135)..(1844)
gagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgccggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacaccggggtgggttgatatatggggtgagaagtttgggctgatcgccagtgatagtaaacaaaatctgtgcagagggccttagcatgggatgtgtccagtattgaaaaggctgcactgccaaccatgatttgtgagccctctgggaaattttgttattaaaggaatatatagtgtcagacagaagttataatcgtcttggaggaaccataagaaaaggtgtccagggtatctatataaagagggttaaatttttttttaacttgctggttaaaacattttagaaatattcttgagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttccttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttcccttcgaaactactttattttactaatttaaactattttgtactgatgtagccctgaggtagttcatgaaaatgctgtgcactcattccatggaataaatgttggaaagctgatcttttctgatataaaatgttgaatgatatt

SEQ ID NO: 8 - protein, 570 aa, Homo sapiens [sequence omitted]

SEQ ID NO: 9 - DNA, 978 bp, Homo sapiens
  CDS (30)..(674)
tcttccgggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccaccttcctgctgctgtcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtctt

SEQ ID NO: 10 - protein, 215 aa, Homo sapiens
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGLWLRSSGLLFATFLLLSHFFCGWPSGSWETLWAEEEEEGSSPAV

SEQ ID NO: 11 - DNA, 1499 bp, Homo sapiens
  CDS (58)..(606)
gcggctgcagcgggcttgtaggtgtccggctttgctggcccagcaagcctgataagcatgaagctcttatctttggtggccgtggtcgggtgtttgctggtgcccccagctgaagccaacaagagttctgaagatatccggtgcaaatgcatctgtccaccttatagaaacatcagtgggcatatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggatggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctc

SEQ ID NO: 12 - protein, 183 aa, Homo sapiens
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 13 - DNA, 3125 bp, Homo sapiens
  CDS (77)..(895)
gtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgtcctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagacctggtttgttacagtcttcagtaattcagtctacacaatgtatttgacatggtcagctatgaccaatgaaccagaaacaaattgcaacccaagtctactaagcataattggctacaatacaacaagcactgtcccacaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgatttttactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttattattttcttaccaagtgcattgatatgtgaagtagaatgaattgcagaggaaagttttatgaatatggtgatgagttagtaaaagtggccattattgggcttattctctgctctatagttgtgaaatgaagagtaaaaacaaatttgtttgactattttaaaattatattagaccttaagctgttttagcaagcattaaagcaaatgtatggctgccttttgaaatatttgacgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaaatacagacttagatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcag

SEQ ID NO: 14 - protein, 273 aa, Homo sapiens
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMSYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRPGLLQSSVIQSTQCI

SEQ ID NO: 15 - DNA, 1927 bp, Homo sapiens
  CDS (118)..(1134)
ggcgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcaggaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattacagtggaacgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 16 - protein, 339 aa, Homo sapiens [sequence omitted]

SEQ ID NO: 17 - DNA, 1483 bp, Homo sapiens
  CDS (70)..(1248)
aaaaaaaaaaaaaaaaaaaactcgctggcggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtag

SEQ ID NO: 18 - protein, 393 aa, Homo sapiens
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 19 - DNA, 1851 bp, Homo sapiens
  CDS (171)..(518)
aaataatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagttgtgtttttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacatactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcatt

SEQ ID NO: 20 - protein, 116 aa, Homo sapiens
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDEEKNFDQTRFLEDSLLNW

SEQ ID NO: 21 - DNA, 2395 bp, Homo sapiens
  CDS (25)..(1068)
gatgaagggtcgttggtgggaaagatggcggcggctctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgaggtgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagttaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaacc

SEQ ID NO: 22 - protein, 348 aa, Homo sapiens [sequence omitted]

SEQ ID NO: 23 - DNA, 1683 bp, Homo sapiens
  CDS (118)..(1017)
agttcctccttgctctcgcccctactctttctggtgttagatcgagcaaccctctaaaagcagtttagagtggtaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaaccgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacactt

SEQ ID NO: 24 - protein, 300 aa, Homo sapiens [sequence omitted]

SEQ ID NO: 25 - DNA, 1584 bp, Homo sapiens
  CDS (14)..(1231)
gaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctccttggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttc

SEQ ID NO: 26 - protein, 406 aa, Homo sapiens
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 27 - DNA, 1336 bp, Homo sapiens
  CDS (94)..(501)
atactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttatttttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgatatcatagtttttataccttatttaaggaggaaacaacctgacgtggcaccaatcagttctggcacatcccaacccttcacattttataaattattgtagatcatgttttgttaggagcacttttatgagagacattttccatgactaaataatcagcattagtcagtaaatcctttagaactgggttttgaaatgggagttttatcatattaaatcatttcttgtagtcttacattttttgttgttgttctggaatctacctgtaaaggaaagtagacctggattcatgtgggctcttccatggcttaagtgttgcccaagagattttgtaggtaacgattttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataaccat

SEQ ID NO: 28 - protein, 136 aa, Homo sapiens
MGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 29 - DNA, 1729 bp, Homo sapiens
  CDS (29)..(1246)
ctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgttgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggggacgtccagctctgtcctctcttcctcactcctcccttcagtgtcctgaggaacaggactttctccacattgttttgtattgcaacattttgcattaaaaggaaaatccac

SEQ ID NO: 30 - protein, 406 aa, Homo sapiens
MGPSTPLLILFLLSWSGPLQGQQHHLVEYMERRLAALEERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 31 - DNA, 1883 bp, Homo sapiens
  CDS (19)..(687)
accgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccatcgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagctacttgggaggctgaggcaggagaatcacttgagcccaggaggtggaggtttcagcgagctgagatcacaccactgcactccagccttggtgacagagtgagactctgtctc

SEQ ID NO: 32 - protein, 223 aa, Homo sapiens [sequence omitted]

SEQ ID NO: 33 - DNA, 2027 bp, Homo sapiens
  CDS (323)..(970)
cctcctcccctctgccctgtgctgaccagggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtgggggcaccgaccacaggcccggagggtggatgcctgcaggaagctgggctctgtggagcccgaggaggggctggtggccacaccccccggccccctggctcggcggccctcatgcccgccctacgtccactcctgccgctcctgctcctcctccggctgacctcgggggctggcttgctgccagggctggggagccacccgggcgtgtgccccaaccagctcagccccaacctgtgggtggacgcccagagcacctgtgagcgcgagtgtagcagggaccaggactgtgcggctgctgagaagtgctgcatcaacgtgtgtggactgcacagctgcgtggcagcacgcttccccggcagcccagctgcgccgacgacagcggcctcctgcgagggctttgtgtgcccacagcagggctcggactgcgacatctgggacgggcagcccgtgtgccgctgccgcgaccgctgtgagaaggagcccagcttcacctgcgcctcggacggcctcacctactacaaccgctgctatatggacgccgaggcctgctgcggggcctgcacctccacatcgtgccctgcaagcacgtgctcagctggccgcccagcagcccggggccgccggagaccactgcccgccccacacctggggccgcgcccgtgcctcctgccctgtacagcagcccctccccacaggcggtgcaggttgggggtacggccagcctccactgcgacgtcagcggccgcccgccgcctgctgtgacctgggagaagcagagtcaccagcgagagaacctgatcatgcgccctgatcagatgtatggcaacgtggtggtcaccagcatcgggcagctggtgctctacaacgcgcggcccgaagacgccggcctgtacacctgcaccgcgcgcaacgctgctgggctgctgcgggctgacttcccactctctgtggtccagcgagagccggccagggacgcagcccccagcatcccagccccggccgagtgcctgccggatgtgcaggcctgcacgggccccacttccccacaccttgtcctctggcactacgacccgcagcggggcggctgcatgaccttcccggcccgtggctgtgatggggcggcccgcggctttgagacctacgaggcatgccagcaggcctgtgcccgcggccccggcgacgcctgcgtgctgcctgccgtgcagggcccctgccggggctgggagccgcgctgggcctacagcccgctgctgcagcagtgccatcccttcgtgtacggtggctgcgagggcaacggcaacaacttccacagccgcgagagctgcgaggatgcctgccccgtgccgcgcacaccgccctgccgcgcctgccgcctccggagcaagctggcgctgagcctgtgccgcagcgacttcgccatcgtggggcggctcacggaggtgctggaggagcccgaggccgccggcggcatcgcccgcgtggcgctcgaggacgtgctcaaggatgacaagatgggcctcaagttcttgggcaccaagtacctggaggtgacgctgagtggcatggactgggcctgcccctgccccaacatgacggcgggcgacgggccgctggtcatcatgggtgaggtgcgcgatggcgtggccgtgctggacgccggcagctacgtccgcgccgccagcgagaagcgcgtcaagaagatcttggagctgctggagaagcaggcctgcgagctgctcaaccgcttccaggactagcccccgcaggggcctgcgccaccccgtcctggtgaataaacgcactccctgtgcctcag

SEQ ID NO: 34 - protein, 216 aa, Homo sapiens
MPALRPLLPLLLLLRLTSGAGLLPGLGSHPGVCPNQLSPNLWVDAQSTCERECSRDQDCAAAEKCCINVCGLHSCVAARFPGSPAAPTTAASCEGFVCPQQGSDCDIWDGQPVCRCRDRCEKEPSFTCASDGLTYYNRCYMDAEACCGACTSTSCPASTCSAGRPAARGRRRPLPAPHLGPRPCLLPCTAAPPHRRCRLGVRPASTATSAAARRLL

SEQ ID NO: 35 - DNA, 2518 bp, Homo sapiens
  CDS (30)..(749)
acgtcggacccggaggccctgaatgccccatgcgcaccccacagctcgcgctcctgcaagtgttctttctggtgttccccgatggcgtccggcctcagccctcttcctccccatcagaggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaacacaatcaccaccatctttttacagggctggggaccccattcttacttacttccccaagtggtctgtaataagcttgctgagacaacctgcaggagttggagctggggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgccgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtact

SEQ ID NO: 36 - protein, 240 aa, Homo sapiens [sequence omitted]

SEQ ID NO: 37 - DNA, 1631 bp, Homo sapiens
  CDS (16)..(1131)
gttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggctcaacccccaccacagtgtcagatggggaaaacaagaaggataaataagatcctcactttggcagtgctgcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaactctctgacatactccccacacccagttgatggccttccgtaataaaaagattgggatttcctttt

SEQ ID NO: 38 - protein, 372 aa, Homo sapiens
MAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVAQPPPQCQMGKTRRINKILTLAVLPLLSIPGSFHNHKPEAAAFYLCFPFGCDWVGQHAASDFKEASRELSGTLQEGLPCCGQLFHWSKKEIS

SEQ ID NO: 39 - DNA, 3707 bp, Homo sapiens
  CDS (122)..(1270)
actcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccaggggacagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaagatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcac

SEQ ID NO: 40 - protein, 383 aa, Homo sapiens [sequence omitted]

SEQ ID NO: 41 - DNA, 2652 bp, Homo sapiens
  CDS (52)..(444)
gctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaatgatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggactttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatct

SEQ ID NO: 42 - protein, 131 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 43 - DNA, 3293 bp, Homo sapiens
  CDS (106)..(786)
tttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagtatctctctttaatatctgtacccttgctcatctaccacccagctcagatccttctgggaagtgtgttggtgccaacaatcaagtcttggatggtatcaaggcagaagggagtgaagctgacaaggccgacagtataacaaaggaggtggactttctgtagcaatgtatatatgtacaggattgtacatactagcaattctgaagacttgtacttgtgaatgttgcctcaatgcatattttatttttttacacaaaaatatgagatcctgtttaagtgccttaaaatgtatttgacaagagcgttatttccaaaatatgctttgttgattactgccaggggtggtacaatatttgggggttaattttgctttcctaatgcaggaatcagtcatggtaagtgacaaaaagcaaacatgctttccctgcagcacctttgtataatacaaccctatagtagttactgtaatgtttgaaatgaggtcacaccatcaggaaaatgcccttctgatgacagtgaaaatttccaaagtcttattcatgcatactttgatttactgtgtgattctttttttctacgactgtgacatgcctcttccttatcaactcagcaggggtcatagatcgaatagatgctgaaaagcgtaagatatatgcattccttgacatcatttttaaagacattccttcaaatagtttccacacagaaattcctcactcccattatgagagattgtggttatatgtcttaaatttattataagctgcttcaaagaaagggtctgaatgtttgaattatgagtgaaatcatgtgaaattttgagttaaactctgtgatttgattttcagggtctttaaaatatatcttaatatcttcttcctctttattcaataatttctgtcttgcacttacacactcataacagccaaatatgaggcacaaaaatgttacaatcagtttgaaagcagcatcaattaatggtagattctattcacattccacaacccagaccaaatttttttccttacgcagatgtgctgagcactttccagattgcccctgttggccaaaagcagcctgttacatcctggaattaagcacacttaaggtatttgagacaatttattaatgaaagtttccttggcagatttgacaaatgttggcaatatttttttaaaagttaaatcatattgctttcatgaataaatgaaaatataaaggtcatggatgcaaacaaatgttacatatacacattctgtctctccagatgaaaagaacatgcaaaaccatttaataaccaaaatatcaagtaaaattagttcccaacggggcagcagctttcaaatgagtgtccaatatttgcttctgctatagctgcaagaactgtaactggacccaagtagagaatgaagccacgtatagaactacgagaacacttttctgtgtttcccccatgccgtcctgtcacatcctcttacacgtcctctcttgatttgatagacaatattggcatcctgggtctcactgaggccgtgctatgtcctcagcagctgtttttgttgtttcgttattatgcccacaacaaaaaatcattccttagaaactcaccaagtttatctactgtgtaaatttatattattgttactaccaggtctcatcttttgtcaatgtcattgaataaacttcataagagttattctcagtgtgaattttaaggctaatgccagatcctgcaaaaatctatgctaaccaggctgtagtacacactgttataaagaattttacttgtgtctaaaactacagtaattttgcttaggtaattgtgcttacctatggagcacaggaaggctcttaggttttgttcctacaagtttctttgaattttggagtaaatggaagtgtctgtctgtctgtcatctatctgccctatcataaaaatctttctccctaacattaaaatactgatccccgcccccaacttatctacctctattgtctaacacctatagtaggtgtgatcatgggataaaattcaactgaaaatgctatgataacattttatcgtttgctttaaaaatgtgctttgttttcaaataatctttacatagtgaactttggtggcgttagtgatatgtttatgcctatttcttttttttacacaaattccttggcatattttttcataaagaacaaaaaataaaatcaaaatttatttttaattcatgcttattgggatttaattattcagagcttaaaatattttgttatgtttatacactgtaaagctatctgttttatgcatttgttttgtctaaatgtatttatgaaagaaatacattagattatatttatgtttactcatttttccacctggattttttttaatggttgttacaaaattagattttttaatgggtaataatgttggtattttcatgttttttcttagtattaaaatttttgtgggttttttaaaatttttccctattctgttaaaaattaacacacctctagctaatgttcagtgtttgtgctaaataccaaattttttcaaaaggattggttaagtcataaagtggattatttatgatgactggaagatgaaaataattatatgattaaacaaagaatgtttcagaaatc

SEQ ID NO: 44 - protein, 227 aa, Homo sapiens [sequence omitted]

SEQ ID NO: 45 - DNA, 3635 bp, Homo sapiens
  CDS (292)..(2025)
ttgcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaggaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgccatcaatgaggcctggttccctgaggaccagcgggtactgacccccaacctggtggccgccctgccccccagcacccatggggcaggttggcagctgttttgcaggactgtgtggtcagcacactcggggcctacacggatggccacagccatcgcccgctgcgccccagatgaggagctgctgagctgctccagtttctccaggagtggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgccttcccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgtgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgggccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcct

SEQ ID NO: 46 - protein, 578 aa, Homo sapiens [sequence omitted]

SEQ ID NO: 47 - DNA, 2366 bp, Homo sapiens
  CDS (50)..(904)
gagcgagcgagcgagcgagttgccgagcgcgccccgtccctcgcgcgcgatgctcccctggacggcgctcggcctggccctgagcttgcggctggcgctggcgcggagcggcgcggagcgcggtccaccagcatcggccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggggctggtgcccagcgcccagccggggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccggagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccagcgtccccgcccacccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataatagagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacaggtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccg

SEQ ID NO: 48 - protein, 285 aa, Homo sapiens
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLGLVPSAQPGGCKTPAAARERHGLDLGRPRPGHGLRRGASA

SEQ ID NO: 49 - DNA, 2147 bp, Homo sapiens
  CDS (130)..(1122)
ccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcagtacgtgtgcatccggggtgtgtttatcctcaccacagaatgcgcctccctcaccgtcacgctcgtcgtgaccctacgcaaatttgtgagcctcatcttttccatcttgtacttccagaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggactattgaacagcccattcatttatttctgttttgtttaccgacatattcagtattattcttgttttctgaattctgagtctcctgaacaaaaggcttactatccatggtcttggaaaagattgtcccttctcttgctgttgtaatgcatctctgctacagcagtcattgtcatcctgtgaccttatcccttttgtctcccatcaccttttccttcttcagcagcacctcacagtcagtcagacgctgcaggcaccactatcaccaggagtggccaagtaaaccgagacaccagtaacagcagggctggacttcctccagcgttttgggaaggaaagagatgttcccctgagctgattcccagtgacagtgcagcaagactagtgggactcctctttcccacattttgcttttttttttttctatgcaaaagtcagatgcttctatccattgctttctgtgattagggcggccctgcagcatatctcacagcagacacagtgttcataacaaagaaaggttgtgccgggcacggtggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctc

SEQ ID NO: 50 - protein, 331 aa, Homo sapiens
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQYVCIRGVFILTTECASLTVTLVVTLRKFVSLIFSILYFQNPFTLWHWLGTLFVFIGTLMYTEVWNNLGTTKSEPQKDSKKN

SEQ ID NO: 51 - DNA, 2863 bp, Homo sapiens
  CDS (231)..(920)
tctccctctccaggggcatctccccctccaaggctctgcaaagaactgccctgtcttctagatgccttcttgaggctgcttgtggccacccacagacacttgtaaggaggagagaagtcagcctggcagagagactctgaaatgagggattagaggtgttcaaggagcaagagcttcagcctggagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcctgttatgactccacagtgtccagactaatttgtgcatgaactgaaataaaaccatcctacggtatccagggaacagaaagcaggatgcaggatgggaggacaggaaggcagcctgggacatttaaaaaattaaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcaccccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 52 - protein, 230 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 53 - DNA, 1931 bp, Homo sapiens
  CDS (32)..(1423)
gcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgggttttccagtacggagtcaaagttgtacttcaggctatgtacttgctgtggaagctgatgtggagggagccaggtgcctatatctttctccagaaccccccaggtctgccgagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgtttgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagcgggcttggctttgtgaggaactgagtgtgtccacgttgggggaacatcatacttgatacacacgtttttatttgcacaaagaaaatgctgtttttgg

SEQ ID NO: 54 - protein, 464 aa, Homo sapiens
MAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 55 - DNA, 1717 bp, Homo sapiens
  CDS (12)..(593)
ggctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcgtaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttt

SEQ ID NO: 56 - protein, 194 aa, Homo sapiens
MAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVPFKEAELRLCSVSTNSVIP

SEQ ID NO: 57 - DNA, 2510 bp, Homo sapiens
  CDS (94)..(951)
ttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgggaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttgtgtt

SEQ ID NO: 58 - protein, 286 aa, Homo sapiens
MLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQLDFRTPPGFDRTRNAEIGNKDIKFKHLEEAFTSEHWLVRIYKVKAPDNRETLDHKPRVTNIFPKQKYLSKKTTKRKRGYIKNKLVFKKGKKISKKTV

SEQ ID NO: 59 - DNA, 3558 bp, Homo sapiens
  CDS (80)..(2704)
gtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggttccctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggatttttgggagactttatcattagatatgacgtcaatagagaacagagcattggggacatccaggttctaaatggctattttgtgcactactttgctcctaaagaccttcctcctttacccaagaatgtggtattcgtgcttgacagcagtgctcctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaatgtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggaccccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggacggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccgggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccggggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaactctgtatcttgtcccaacctgcttttctgttctgttagcatatcataaagtaagcctttctggtgaaggaaggttgctatgaaactttttttcttggtggaaatggccaagtttaggcactctgctttttgccttacactaatgcttagaaagctgtcttttcagtggtgttgcaccccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattg

SEQ ID NO: 60 - protein, 875 aa, Homo sapiens
MLLLLGLCLGLSLCVGSQEEAQSWGHSSEQDGLRVPRQVRLLQRLKTKPLMTEFSVKSTIISRYAFTTVPCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGFLGDFIIRYDVNREQSIGDIQVLNGYFVHYFAPKDLPPLPKNVVFVLDSSAPMVGTKLRQTKDALFTILHDLRPQDRFSIIGFSNRIKVWKDHLISVTPDSIRDGNVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDPNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPGALPATPPGFLHCQQRGPFQQLPRTAGSVPESGCQTHRRPCRAQPEPHSPSAPSGGRGA

SEQ ID NO: 61 - DNA, 2092 bp, Homo sapiens
  CDS (161)..(1210)
gtgtggagaaagcggcagctgtcccagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaaagcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaagttttgttctttattttgtgtgtgccggtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacaactgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattcc

SEQ ID NO: 62 - protein, 350 aa, Homo sapiens [sequence omitted]

SEQ ID NO: 63 - DNA, 2341 bp, Homo sapiens
  CDS (94)..(1662)
agtgcctttggcgcactgaggtgcacagggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaacttcgacatggtgatagttgaaacttttgactactgtcctttcctgattgctgagaagcttgggaagccatttgtggccattctttccacttcattcggctctttggaatttgggctaccaatccccttgtcttatgttccagtattccgttccttgctgactgatcacatggacttctggggccgagtgaagaattttctgatgttctttagtttctgcaggaggcaacagcacatgcagtctacatttgacaacaccatcaaggaacatttcacagaaggctctaggccagttttgtctcatcttctactgaaagcagagttgtggttcattaactctgactttgcctttgattttgctcgacctctgcttcccaacactgtttatgttggaggcttgatggaaaaacctattaaaccagtaccacaagacttggagaacttcattgccaagtttgaggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctcttgtcctcctttgtttgccatcagcaagggctatgctgtgattctgtctctgagtgacttggaccactgaccctcagatttccagccttaaaatccaccttccttctcatgcgcctctccgaatcacaccctgactcttccagcctccatgtccagacctagtcagcctctctcactcctgcccctactatctatcatggaataacatccaagaaagacaccttgcatattctttcagtttctgttttgttctcccacatattctcttcaatgctcaggaagcctgccctgtgcttgagagttcagggccggacacaggctcacaggtctccacattgggtccctgtctctggtgcccacagtgagctccttcttggctgagcaggcatggagactgtaggtttccagatttcctgaaaaataaaagtttacagcgttatctctccccaacctc

SEQ ID NO: 64 - protein, 523 aa, Homo sapiens
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFEDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 65 - DNA, 2971 bp, Homo sapiens
  CDS (103)..(2412)
cgaccgagccgagaggacccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggacgaatgtcacaattttgtccagattctcgccattgccaatgcctctcacctcctcacttgtggcaccttcgcttttgatccgaagtgcggggttattgatgtgtccaggttccagcaggttgaaagacttgagagtggccgggggaaatgtccttttgagccagctcagcggtcagcagctgtaatggctgggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataag

SEQ ID NO: 66 - protein, 770 aa, Homo sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 67 - DNA, 2244 bp, Homo sapiens
  CDS (161)..(2059)
aatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacacgcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgttt

SEQ ID NO: 68 - protein, 633 aa, Homo sapiens [sequence omitted]

SEQ ID NO: 69 - DNA, 3253 bp, Homo sapiens
  CDS (9)..(2588)
gagggaagatggcacctgccggctgctgctgctgctgctgcttctggggcggcgctgtggccgccgcgggcgccgcccggcgtgtcctgctgctgctgctgctgggggtcctgtccgctgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtactctcgacatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtttcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgttttttttttcctttgttgaaaaaaataaaccagggtgatttctataaatcaccagtttttggcattgg

SEQ ID NO: 70 - protein, 860 aa, Homo sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRHLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 71 - DNA, 2195 bp, Homo sapiens
  CDS (266)..(1714)
agaggcgcggcgtgactgagctacggttctggctgcgtcccagaggcatccggggcagtaaaaccgctgcgatcgcggaggcggcggccaggccgagaggcaggccgggcaggggtgtcggacgcagggcgctgggccgggtttcggcttcggccacaggagtcatagaggctgggtggtctggcaaggacttgtgcatttgagaactgacaggtgcagcggagacttctaagagggaaaaccaagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgtttt

SEQ ID NO: 72 - protein, 483 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 73 - DNA, 1290 bp, Homo sapiens
  CDS (258)..(824)
aggggacggttgctggcccaggtgagcgggcgcgctggtccaggtgagcgggcgcgtccccccgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctaggaggcgaggacggtctctgccagtataaatgcagtgacggatctaagcctttcccacgttatggttataaaccctccccaccgaatggatgtggctctccactgtttggtgttcatcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaagg

SEQ ID NO: 74 - protein, 189 aa, Homo sapiens
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 75 - DNA, 3171 bp, Homo sapiens
  CDS (85)..(2304)
ctcctgccagcgcgctctctgtttctctgcagccccgaagctcgcgaatgtagcaggcgccccaagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacgctacttgggaggaattgctccaccagataagagttggaagggagcccttaatgtgagttatagtatcggacctggctttacagggagtgattctttcaggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggagaatgtcaaaatactccaggagagaagcattgcttatatcaactcggattcatctatagaaggcaattatactctcagagttgactgtactccccttctttaccaattagtgtataaactgacaaaagagatccccagccctgatgatgggtttgagagtaaatcactgtatgaaagctggttggaaaaagacccttcacctgaaaataaaaatttgcctagaatcaataagctgggatctggaagtgactttgaagcttattttcagagacttggaattgcttcaggcagagcccgttacactaagaataagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattgacagaccatggagtatcatttgactccttattttctgctgtgaaaaacttctcagaggctgcttcagattttcataaacgacttatacaagttgatcttaacaatcccattgcagtgagaatgatgaatgaccaactgatgctcctggaaagagcattcatcgatcctcttggtttaccaggaaagctgttctataggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgcaaagccttttttttttttgctctttaaaagttaataattatattagcaaagtgttaatctaatgaagtaaaaaactcctgtgtggcagaaagtaaaagaaaattccctaaattatagcaaggaacatgaattctcagacattgtgagtgtgggaatgtaaaatggtaaaatcacttttgaaaacagtttggcagtttcctataaagttaaacatacacttttactttaggactccagaattccacttctagttatttattcaagagaaggaaaaacaatgatcacagcaatacttgtatgcatgttcattgcaacttaaaagcgtaaaaaccccaaatgtccatccacagacgaatggataaactgtggtatccattacacaatagactacttactactcagcaataaaaatgaagtaactttcaataaatgcaatattattggcagacattgttgaaggaaaaaagccagacaaacaactacataaaatatgtttctatttagatgaagtggcaaactaatctgtagtgttaaaaattagattagtgattgcctgggccaagtggcaggttggggaggatggctgcaaagaagtatgaggaaactttctccaatagatgagaattttccgtatcttgatctgagtggcaaattgtaaacttaaaatatatataaaatttattgtatgaaaattaagcctcaataaacgtgattataaaaaac

SEQ ID NO: 76 - protein, 740 aa, Homo sapiens
MAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRYLGGIAPPDKSWKGALNVSYSIGPGFTGSDSFRKVRMHVYNINKITRIYNVVGTIRGSVEPDRYVILGGHRDSWVFGAIDPTSGVAVLQEIARSFGKLMSKGWRPRRTIIFASWDAEEFGLLGSTEWAEENVKILQERSIAYINSDSSIEGNYTLRVDCTPLLYQLVYKLTKEIPSPDDGFESKSLYESWLEKDPSPENKNLPRINKLGSGSDFEAYFQRLGIASGRARYTKNKKTDKYSSYPVYHTIYETFELVEKFYDPTFKKQLSVAQLRGALVYELVDSKIIPFNIQDYAEALKNYAASIYNLSKKHDQQLTDHGVSFDSLFSAVKNFSEAASDFHKRLIQVDLNNPIAVRMMNDQLMLLERAFIDPLGLPGKLFYRHIIFAPSSHNKYAGESFPGIYDAIFDIENKANSRLAWKEVKKHISIAAFTIQAAAGTLKEVL

SEQ ID NO: 77 - DNA, 2890 bp, Homo sapiens
  CDS (131)..(646)
agccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggaacccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggcttagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattctgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggc

SEQ ID NO: 78 - protein, 172 aa, Homo sapiens
MRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGTQQPGPPYYTDPGGPGMNPVGNSMAMAFQVPPNSPQGSVACPPPPAYCNTPPPPYEQVVKAK

SEQ ID NO: 79 - DNA, 1878 bp, Homo sapiens
  CDS (152)..(1144)
agttccggacgcgggcccagccgcgcctgcgcctccgctcgcctgtggctgcgtcgcgcgctcttcctcggagctatccaggcggctggtgtgcagcaagctccgcgccgaccccggacgcctgacgcctgacgcctgtacccggccccgcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagtgtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccacgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcattt

SEQ ID NO: 80 - protein, 331 aa, Homo sapiens [sequence omitted]

SEQ ID NO: 81 - DNA, 2392 bp, Homo sapiens
  CDS (33)..(872)
gcgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagcgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttggaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaactcgaaattgttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctaggatacatagttttcaccttaaaagaagggggaaaatcataaatacaatgaatcaactgaccattgcgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcatt

SEQ ID NO: 82 - protein, 280 aa, Homo sapiens [sequence omitted]

SEQ ID NO: 83 - DNA, 1821 bp, Homo sapiens
  CDS (137)..(1306)
agacttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgag

SEQ ID NO: 84 - protein, 390 aa, Homo sapiens
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 85 - DNA, 1808 bp, Homo sapiens
  CDS (85)..(1407)
aaactcccatctccctcaccagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcggtcggatttggggagggccctgaggacctggcccgggcaagggactctccaggctcctcctccccctggcaggcccagcaacatgtgccccagatgtggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttatt

SEQ ID NO: 86 - protein, 441 aa, Homo sapiens
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 87 - DNA, 2015 bp, Homo sapiens
  CDS (100)..(1500)
cttgactttgagcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcggatcccaggcctctggcgcccccactcaagactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgat

SEQ ID NO: 88 - protein, 467 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 89 - DNA, 1722 bp, Homo sapiens
  CDS (64)..(1692)
gctagagctctcgactctccgctgcgcggcagctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaggaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccagggaagattttctaaaccctgatgtattggacatttttatttcatctgtgcaaaaagttttccaggtggttgagagcaccaggcctggcaagaaggtctggttaggagaaacaagctctgcacatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactg

SEQ ID NO: 90 - protein, 543 aa, Homo sapiens [sequence omitted]

SEQ ID NO: 91 - DNA, 2291 bp, Homo sapiens
  CDS (46)..(1737)
ctccatctcagagcctctcctcaatctcaagcctccactcccctcatgcccaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgattcgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatc

SEQ ID NO: 92 - protein, 564 aa, Homo sapiens [sequence omitted]

SEQ ID NO: 93 - DNA, 2080 bp, Homo sapiens
  CDS (196)..(1242)
ctcgacgggcaagcggcgataagaggtggcgtcctccgcggcattgcgagcaccgccagtctgcgccgccaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccagcttctctaacgatgtctggaatggctggtctttttagcatctctggcaagatatggcatcttcacaactatttcacagtgactcttggaattcctgcttggtgttcttatgtgtttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtcc

SEQ ID NO: 94 - protein, 349 aa, Homo sapiens
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 95 - DNA, 2185 bp, Homo sapiens
  CDS (73)..(696)
accgtaaccagcgccgcggacaccggcaccggcgccacggactccgcagaccccgcgcccgccgccgccgctatgctggggctgctggtggcgttgctggccctggggctcgctgtctttgcgctgctgggcgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgttgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggtttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggtctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcacttgctgacagaggacggggcacccgggctccccactgcagtcggccttgcctcctcctcctcctctacctccagtcaggctggacggaagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgc

SEQ ID NO: 96 - protein, 208 aa, Homo sapiens [sequence omitted]

SEQ ID NO: 97 - DNA, 1627 bp, Homo sapiens
  CDS (251)..(1300)
agctggcgctggaggcttcggcgtcacgtgctggtctggatttttctcgatgcactggggaaagcggtggactcttatcgtgggagggctcttgatctgtgatttatagataggcacagggaacccaacggcagacaggtcctagtgcccatcagatacccgcggccgggactcggagctgtggggtgtggggaggcggaggcaccaactaagagcggcctagcatcgcaaagccgccctcggggcgctcatggcgggacgcctcctgggaaaggctttggccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgtgataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaacttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctat

SEQ ID NO: 98 - protein, 350 aa, Homo sapiens [sequence omitted]

SEQ ID NO: 99 - DNA, 1391 bp, Homo sapiens
  CDS (74)..(589)
gaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgataccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaagg

SEQ ID NO: 100 - protein, 172 aa, Homo sapiens
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 101 - DNA, 2547 bp, Homo sapiens
  CDS (166)..(939)
gcacagggagccggctaaaacagactactcccccgtgcagtcgttccctctaccctaataaggctttggcgcctctcccagaactcggtcctggggaatgctctttgcctggtccagccccgacaaacgtggtctgagaacagcggagcgcggaaaccgcggagcatgactcctccgaagctgcgagcgtcgctgtcgccgtcgctgctgctgctgctgagtggttgcctcctcgcggctgctcggagggagaaaggggcggctagcaacgtggcggagccggtccccgggcccactggcggctcctcgggtcgcttcctcagccccgagcagcacgcgtgcagctggcagctcctgctgcccgccccggaggccgcagcgggcagcgagctggcgctgcgctgccagagcccggacggggcgcgccaccagtgcgcctaccgcgggcatccggagcgctgcgcagcctacgccgctcgccgcgcgcacttctggaagcaggtgctgggagggctgcgcaagaagcggaggccctgtcacgaccccgcgccgctccaggcccgcttgtgcgcgggcaagaagggccacggcgccgagctgcggctagtgccccgcgcgtccccgcccgcacgccccaccgtcgcgggattcgcgggggagtccaagccccgggcccggaaccgggggcggacccgggagcgtgcgtccggcccagccgctgggaccccgcctccccaaagcgcaccgcccaaagaaaacccctcagagaggaagaccaacgtgggcaagaggaaggcggccttggtccccaacgaggagcgacccatggggaccgggcccgaccccgacgggctggacgggaacgcggagctcacggagacctactgcgctgagaagtggcactccctctgcaacttctttgtcaatttctggaacggctgagactgcctgccggcttagggagggttgatgggggaggcgtggggaagggaaagctaagggcgtcttagaccggggggtactgtgatagagattggggagaagtccaggttctcgaatgggggtgggggcaagggtaagggtgagatgcttgggatgagagtgtaaggggtatggagaatctctgggatagcagagaagttaaaaattttgaaaagtctcagtcctgattaagagcaggaaaaataatggaaacagaaataggcgtactttaaatgtgcaaaaactggagactggggagagaaatcgatgcagagagaggctgagaataagggggagatagagtgactaaagtgatgtgagtcccatgtggggagggggatgcaatgtttattgtttaacatttctattaaatgcagccatgagcaattgccaacctgagccaggttgaatcaatgtcttctcacttaatcagctaacaagactgcagactttttttccgtttctgaattggtataaacttggatgcggcgtggtgggtgtcatagataacctctatagggacagaagcctcacaggtcaagactggctccaaggaaagttttgcagaatgatttcctttccattcttttagaagagctacctttttttttttttttccctgacagggtctggcttgcccaggctggagtgcggtggctagtcacaggtgtaataataggcactgcagtctccaactcctggcctcaagggatcctcacatcttagcctccagaatagctaggagtaggagtagctgggactacaagcatgcacagctgcacttggcttagaagtgctactttatttttatttttgagacagggtcttgtgtcatccagactggagcagtggtgcaattatggctcactgcggcctcgactttccagtctcaagtgatcctctgcctcagcctccggagtagccaggactacaggggtgtgccactagaagtgctactttttaacgaaatggtgactaatgttctggaactttcccattaaccttctgcatttagaaggaattatagatgttgagtgctccagtaaacagtgattctctttatatctgattttttttttttaaacagctaaaatgtaagtatgtatctcagagtcattttgaccattatggaagttatatctctctgtttcatgtaactaattattaatatatttcatttttagtgtgatgtaatgagagactgtgtgtgtatgttaggtgctcaataaaaactgtatggttagatttaaagaagtggcaaggcaatggaaattctacctgcatttgatctacttccaagtacaccttgaattaagttcttaaacacatcttgaattgctgggaaaagacagaaactaagaagttgacataaagcaagagtcacaaactggcagccacctggccttatcattgttctatttgatttgcaccctggttctctttctttttcccttcctccccaccttcctcccatccattgttgaatctgtggatgcagagcccacggatgtggaggggcaactatatatatgtttttccattatatatataaatgtgtgtgtatgt

SEQ ID NO: 102 - protein, 258 aa, Homo sapiens
MTPPKLRASLSPSLLLLLSGCLLAAARREKGAASNVAEPVPGPTGGSSGRFLSPEQHACSWQLLLPAPEAAAGSELALRCQSPDGARHQCAYRGHPERCAAYAARRAHFWKQVLGGLRKKRRPCHDPAPLQARLCAGKKGHGAELRLVPRASPPARPTVAGFAGESKPRARNRGRTRERASGPAAGTPPPQSAPPKENPSERKTNVGKRKAALVPNEERPMGTGPDPDGLDGNAELTETYCAEKWHSLCNFFVNFWNG

SEQ ID NO: 103 - DNA, 1430 bp, Homo sapiens
  CDS (80)..(1333)
gtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaggtgaagttttgctcttgttgcccaggctggagcgcaatggcgcgatcttggctcaccgcaacctctgccacccagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccctccgtttgctgtg

SEQ ID NO: 104 - protein, 418 aa, Homo sapiens
MRTLFNLLWLALACSPVHTTLSKSDAKKAASKTLLEKVKFCSCCPGWSAMARSWLTATSATQSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 105 - DNA, 2506 bp, Homo sapiens
  CDS (24)..(1505)
gtgctgcccgctcaccgcccgccatggcccgcgcacccccgctgctcgccgcgttgaccgcgctcctcgccgccgccgctgctggcggagatgccccgccgggcaaaatcgcggtggttggggctgggattgggggctctgctgtggcccattttctccagcagcacttcggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgaggatctataagtaccaggcccacggctatgccttctcgggtgtggaggagctgctctactcactgggggagtccacctttgttaacatgacccagcactctgtggctgagtccctgctgcaggtgggcgtcacgcagcgctttattgatgatgtcgtttctgctgtcctgcgggccagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatagatttgaggtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcggacactagcttgaagtaagaggagaattatgcttttctttgctttttctacaaacccttaaaaatcacttgttttaaaaagaaagtaaaagcccttttcattc

SEQ ID NO: 106 - protein, 494 aa, Homo sapiens
MARAPPLLAALTALLAAAAAGGDAPPGKIAVVGAGIGGSAVAHFLQQHFGPRVQIDVYEKGTVGGRLATISVNKQHYESGAASFHSLSLHMQDFVKLLGLRHRREVVGRSAIFGGEHFMLEETDWYLLNLFRLWWHYGISFLRLQMWVEEVMEKFMRIYKYQAHGYAFSGVEELLYSLGESTFVNMTQHSVAESLLQVGVTQRFIDDVVSAVLRASYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 107 - DNA, 2465 bp, Homo sapiens
  CDS (457)..(1434)
agccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtacagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccaagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaaaaaag

SEQ ID NO: 108 - protein, 326 aa, Homo sapiens
MAVFRSGLLVLTTPLASLAPRLASILTSAARLVNHTLYVHLQPGMSLEGPAQPQYSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQDPAAEGPQTYGE

SEQ ID NO: 109 - DNA, 2557 bp, Homo sapiens
  CDS (101)..(490)
gctaatatgctccctctcccacaaggcagcgcgccggctcggacgcggccggctaccgagccctttgtgagagctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatgatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggcttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggactgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgctcccttctg

SEQ ID NO: 110 - protein, 130 aa, Homo sapiens
MSSSGGAPGASASSAPPAQEEGMTWWYRWLCRLSGVLGAVSCAISGLFNCITIHPLNIAAGVWMMMAVVPIVISLTLTTLLGNAIAFATGVLYGLSALGKKGDAISYARIQQQRQQADEEKLAETLEGEL

SEQ ID NO: 111 - DNA, 3099 bp, Homo sapiens
  CDS (118)..(918)
ttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctgcaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgctgcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataatatagattgtattgaaatctc

SEQ ID NO: 112 - protein, 267 aa, Homo sapiens [sequence omitted]

SEQ ID NO: 113 - DNA, 2563 bp, Homo sapiens
  CDS (31)..(2238)
gctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 114 - protein, 736 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 115 - DNA, 2179 bp, Homo sapiens
  CDS (56)..(1087)
gcacttcagcttccccccccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgt

SEQ ID NO: 116 - protein, 344 aa, Homo sapiens
MFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 117 - DNA, 3362 bp, Homo sapiens
  CDS (206)..(829)
cccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaagcctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcccgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttct

SEQ ID NO: 118 - protein, 208 aa, Homo sapiens
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 119 - DNA, 3598 bp, Homo sapiens
  CDS (180)..(1226)
aggagacgctgcccttccgcagcgatggcatcccggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccaggccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacggaggaggaagaagcaggttggtcccgagatgggaggggagcagctgggcacggtgcccctccctatcctcttggccaggaaggtcccttcagtgaagaaaggatactccagccggagagtccagagccccagcagcaagagcaacgacaccctgagtggcatctcttccattgagcccagcaagcactcgggctcctcccacagtgtggcctcgatgatggcagtgaactcatccagccccacagccgcgtgctcgggactatgggatgccagagggatggaggagtctctgaccaccagcgacggcaatgcagagagcctgtacatgcaaggcatggagctgtttgaggaagctctgcagaagtgggagcaggcactaagcgtgggccagcggggggacagcggcagcacccccatgcccagggacggcctccggaacccagagactgcatcagagccactgtctgagccagagtcacagcggaaggagtttgcagagaagctggagtccctgctgcaccgtgcctaccacctgcaggaggagttcggctccaccttccccgcagacagcatgctgctagacctcgagaggaccctcatgctgcccctgaccgagggctcgctgcggctgcgggcggacgatgaggacagcctgacttcagaggattccttcttctccgccaccgagctctttgagtccctgcagactggagattacccgatcccactctccagacccgccgctgcctatgaggaggccctgcagctggtgaaggaggggagagtgccttgccggaccctcagagccccaaaggcttcctggagagctacgaggagatgctgagctatgccctgcggcccgagacctgggccacaacacggctggagctggagggccgaggggccaaggcagagggaggaatggcctcagctacacccgttgcacagcagagcgggaaagacgtgtcccccccacgtgtgctcatgccctggaccccagcttcagtctccccatctggaaagtggccccgaggctccggcagtgcccccatgcatgagcctcccgggggcaccctctgtaggtggtatgcatgagcttcttcgacatcgtgctggacttcatcctcatggacgccttcgaggacctggagaaccctccggcctcggtgctcgccgtcctgcggaaccgctggctgtcagacagcttcaaggagacggccttggccactgcttgctggtcggtcctgaaagccaagaggaggctgctgatggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacg

SEQ ID NO: 120 - protein, 349 aa, Homo sapiens
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRAPKASWRATRRC

SEQ ID NO: 121 - DNA, 2451 bp, Homo sapiens
  CDS (60)..(1328)
tcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttccataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggtggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactcccttagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcactccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgc

SEQ ID NO: 122 - protein, 423 aa, Homo sapiens [sequence omitted]

SEQ ID NO: 123 - DNA, 2518 bp, Homo sapiens
  CDS (29)..(1693)
acggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaaccttccctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgattaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatg

SEQ ID NO: 124 - protein, 555 aa, Homo sapiens [sequence omitted]

SEQ ID NO: 125 - DNA, 2250 bp, Homo sapiens
  CDS (256)..(1161)
aaaaagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccaggtcttccggcagtttcgcttccccgcggccgtggtggtggaggatgacctggaggtggccccggacttcttcgagtactttcaggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagttgggggaggttcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagcggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctg

SEQ ID NO: 126 - protein, 302 aa, Homo sapiens [sequence omitted]

SEQ ID NO: 127 - DNA, 1666 bp, Homo sapiens
  CDS (199)..(1272)
ttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatttcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatg

SEQ ID NO: 128 - protein, 358 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 129 - DNA, 1686 bp, Homo sapiens
  CDS (121)..(1548)
ggtgactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcccttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagtgggtgacttccatcaggtaattattcgaggtggaggacatattttaccctatgaccagcctctgagagcttttgacatgattaatcgattcatttatggaaaaggatgggatccttatgttggataaactaccttcctaaaagagaacatcagaggttttcattgctgaaaagaaaatcgtaaaaacagaaaatgtcataggaataaaaaaattatcttttcatatctgcaagatttttttcatcaataaaaattatccttg

SEQ ID NO: 130 - protein, 476 aa, Homo sapiens [sequence omitted]

SEQ ID NO: 131 - DNA, 1999 bp, Homo sapiens
  CDS (121)..(888)
aaaactctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacgcctgtcctcctttgacccctgcttctaccgagacctgctgctggtgcaccgcttcctaccttatgagatgctgctcatgtgggatgcgctgaaccagcccaacctcacctgcggcaatcagacacagatctaccgagtcagcatcagggtccccagcctctgggctcctgtttccataggaaggggcgacaccttcctcccaggaagctgagacctttgtggtctgagcataagggagtgccagggaaggtttgaggtttgatgagtgaatattctggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgtccacatagagctgacgtgagaaatatctttcagcccaggagagaggggtcctgatcttaaccctttcctgggtctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccttgtagcccccagcttcaggcctcagtgtctgccagtcaagcttcacaggcattgtgatggggcagccttggggaatataaaattttgtgaagacttggagatctttttttttttttaagcaaatttacaagtttcaacagacaagtccacattcatccctaaaagtctcattttccagtagaaaatatacactggtaaaaacggggcatggggccgtggctcagggctgtaattctagcacattgggagaccaaagtgggaggatcacttgagcccaggagttctggatcctgcctctgcacaaaataaaaaattactcagg

SEQ ID NO: 132 - protein, 256 aa, Homo sapiens
MKYLRHRRPNATLILAIGAFTLLLFSLLVSPPTCKVQEQPPAIPEALAWPTPPTRPAPAPCHANTSMVTHPDFATQPQHVQNFLLYRHCRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQRLSSFDPCFYRDLLLVHRFLPYEMLLMWDALNQPNLTCGNQTQIYRVSIRVPSLWAPVSIGRGDTFLPGS

SEQ ID NO: 133 - DNA, 1906 bp, Homo sapiens
  CDS (48)..(353)
agaagaggagaagaggttgtgtgggacaagctgctcccgacagaaggatgtcgctgctgagcctgccctggctgggcctcagaccggtggcaatgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaaggactcgacccagatgtcggccacctattcccagggctttacgctgccattgcacccaaggataatctcttcatcaggttcctgaagccctggctgggtgagtacctgcaggtgaaaggggttggggacaaccttgcggggagggtaggggaagtgctgctcttgcccattgtccttggctgccctactaggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtgggctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtgctgccttccccattcaccaccaccacccccatcctctacttttgtgtgtgtgtgtgtgaattccaaggttcctagtggagggggcagggttttgatgaggaaaatccaacatcacctcaccccaaaacacacacaagtgtctctccaaggctgctggacataggaaatcccactggcaaaccttctttgtctcacctgcaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcgggaagctggaattgatcatgcgcgccgagggcgggctttggctgcgggtggagcccctgaatgtaggcttgcagtgactttctgacccatccacctgtttttttgcagattgtcatgaataaaacggtgctgtcacctc

SEQ ID NO: 134 - protein, 102 aa, Homo sapiens [sequence omitted]

SEQ ID NO: 135 - DNA, 1773 bp, Homo sapiens
  CDS (1)..(654)
atggcgcccctcagaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttagggtaaggtgacttaggttttatgttttagagccagtggtgatgatttatttgtagaaccagttggctttgtgccttgatccagataaacatttctaatgataacttgacttttttttttttttgaaatggagtttcgctccttttgcccaggctgaagtgcagtggcgggatctcagctcactgcaacctccaccttctggtttcaagtgattcttctgcctcagcctcatgagtagctgggattacaggcgcccgccaccacgcttggctaatttttgtatttttagtagagatggggtttcaccatgttggccaggctggtcttgaactcctgacctcgggattcgcaccaccccccccaatccgactcccaaagtgctgggattacaggcgtgagccaccacgcctggccgacttctttcttaatagaatcctccttaccacccaagatgggttgtactagggttctctcataattggcttagctggaatttgaatctaggtgtgacaattacaaagcctgtgttctttctttatgcttcttgaggagcacagagtggccagtatgtgggtgggcaggcctgtcatgacatcaggacaggtgctgaacttcagtgttctcatgtgatgctaactctgctgtgtggttttagactatgtatagccaggacaggcatgttgatgtcctcaatctctgctttgcccagtttgagccagattccacagagtatatcaaggttcatcacaagacctatgaagatatagataaacgtgggaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaatactg

SEQ ID NO: 136 - protein, 218 aa, Homo sapiens [sequence omitted]

SEQ ID NO: 137 - DNA, 2134 bp, Homo sapiens
  CDS (74)..(991)
atcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctggtatcaagtgactccaacaacctaaaactcaacaacgtgcgcctgccacgggagaacatgtccctcccgtccaaccttcagctcaatgacctcactccagattccagggtgaaaccagcagaccggcagatggctcagaacaacagccggccagagcttctggacccggagcccggcggcctcctcaccagccgaggaagaagaaatcaggacaaagacgcataacagagggaagaccatgggaagacacagaagatggccaagaagagacccctcagaagaaatcaatcttggtggggcgtggtggcttcacgcctgtaataccagcactgtgggaggttgaggtgggcagatcgcctgagcctaggagttcgagaccagcctgggcaacatggtgaaattccatctctacaaaaaaattagccgggtgtggtgttgagtatctgtagtcccagctacttgggaggctggggtgggaggactgcttgagtccagcaggttgaggctgcagtgagctgagattgagctactgcactccagcctgggcatagagtaataccctgtaaaaaaaaaggaaggaagggagggagggaatcaaccatgccaacaaattgatcttggactactactggactactagcctccagaactatgaaataatacatttctgatgtctaagccactcagtctatggtactttgttatggcagcctagcaaaataatacaacatgctattttttcccccgatcagtatggaattggtcatatgttttataggtaaaatacactgccatactcttttcctgtgggaatctgtgaaaaagaaactgataccaagttatgggcaagtattaacagttatatatgcattacttggtgttataatgcctaatgattccaggacaccatatgaacagagaaaatgggcatgacatctaactcaggtaacaggctctggatctaaacaagtcacagtgtgaagtttttaaactactggtttcttaaaacttcttttctctttttacaaaaaacagagtacatatagttctgcaacttgctgcaatttgcttttttcatttaacaacatatcactgatatttcttcatattagagcaaaataaggccaaataatattccattgcatagtatttcactgaatggatgtactgcaacctagctattcaatcccctaatcagacaccttcccctcaactacagcttcaaaatgctctgaggaaagagactgtttccaaattctgtgtgtttacaatcaattcttcatatacaaaaaaaatctgtctttgtagagcttacattttagtagggaagaacaaaataagtaaataaagtctatggtatgctag

SEQ ID NO: 138 - protein, 306 aa, Homo sapiens [sequence omitted]

SEQ ID NO: 139 - DNA, 1828 bp, Homo sapiens
  CDS (83)..(487)
aagcgacgacttccgccctccttagggccgtggtcccgtagctaccggtcgcgtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggcgcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccaggtgtgtataggtgagggtggggccacctaaccaagatgagccaggatggagtcacaccaggcagagcggggggcctcatgccttcttccagtctagctcagagcccctcacagctgcaagattgactggtttttttcccccaatagggtggaactggctttattttgtagttataaagaacataccatggagttggttcttgggagttgtgttctaaaggcaatctattaggcaagaattgtctgtgatcaaaactcccatgtttcattgactctaagatgccattggttgtaagaagcatcatttttaaatgcatcagtaaaaaagaaaacatactgcccttcgaactatgacaaagcacttctgtgattcacactgattttttaaaatgaaaaatatatctgcatcttagaattaatgacatatggtgtttgaaaacccccaagaaggcaccactttggagaccaacacatcttattttcccagaaactctaatagcattttctgcattagtacagactgctgctttagattaggcagcaggctcatgttcaggccatgttgtagagaatcctccagcatagcaagataccatcctccaagagactgaggggatgacagagttgcatcttccatcccaggcttgctgcagggcatctacccatggacaatgggcaaggttgctgctttactgaaatttaactgttatttccttgtcttctctcactcccaagtgcacatttggtaacagaagtctcattagtgaaatgtgggtgctctgactccactgtaggctcattgtgaaaactgaacaatacaaacaaatataaaaaagaatgtagaaaacacctataatcacaccaaagatcatactatcaacatttatgcctagatctttccaattaaaaccctttatatgattcattctttaaatgtttattgagcaaataatgtgccctaggcactgtgctagtccaagagacatgacaggggtcaaagtggtcaagatggatctgcttcctgcccttgttgagcttccagtctagcaacattaataaaatatatacaaatgtttacttagaagatgtggtaagtgctatcaaggaaaggtgctgttgggctgtataatggagggacccgatcattagatcaggtcacagctgcgagattgactggtttctttccctcaatagggtggaaatggctttattttgtggatataaaagtaatgaaccatggaattggttcttgagagttgtgttctaaaggcaacctattggcaagaattgtctgtgatcaaaactaccatatttcattgactctaagatgccattggttgtaagaagcactatttttaagtacatcagt

SEQ ID NO: 140 - protein, 135 aa, Homo sapiens
MAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQVCIGEGGAT

SEQ ID NO: 141 - DNA, 2934 bp, Homo sapiens
  CDS (10)..(804)
agttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcagctatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatgggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatctcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttg

SEQ ID NO: 142 - protein, 265 aa, Homo sapiens
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWVALPTWPHSLAFWPGLPGGNIPGTSWSQ

SEQ ID NO: 143 - DNA, 1658 bp, Homo sapiens
  CDS (57)..(947)
attgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgtt

SEQ ID NO: 144 - protein, 297 aa, Homo sapiens
MEPRALVTALSLGLSLCSLGLLVTAIFTDHWYETDPRRHKESCERSRAGADPPDQKNRLMPLSHLPLRDSPPLGRRLLPGGPGRADPESWRSLLGLGGLDAECGRPLFATYSGLWRKCYFLGIDRDIDTLILKGIAQRCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 145 - DNA, 2023 bp, Homo sapiens
  CDS (71)..(790)
gcggatcactgaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 146 - protein, 240 aa, Homo sapiens
MTAPVPAPRILLPLLLLLLLTPPPGARGEVCMASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 147 - DNA, 1898 bp, Homo sapiens
  CDS (403)..(834)
atataaaataactgaaatctggaactaatcaactgtgaaaatcaagcaacgagaaagagttgtaaattattttaaaatatctggctcgatcaactttgccagttttagagccagtctttgcaaaaagggagaaacaaaacagatgagacaagaaaggaacatccagcatgctgtgaaccccctgagactggccatgatctgaaagagtaaagctctatccagggaaccttttctgaatcatagtgtcagacttcctgctcttttcaactcccctggttttatcatctctactctgtttcagcaatctactgccatggccacatcctgaatgttgacaataccctaaactgtgccatttataagatctctgacacaccaacctctctcctcttacagctctcaatgatgtatatgacctcagcttattctaatatgcttacagattatacacccgtgatattgatggcagtggctgctgctgtcgtggctgctgctatcacgcctgctgcaacacagaggtgcgactggggctgcacatttcacggaggtgttgggagttccgccccttctgatgtggggaaagagatccccaggtgcccctgcatctgcccaaactgtggctgtggatcggaggctccaggttggcaggttgggagcttccgggtgcagctgcgaccgccctcccaggtgcaggaccctggtgtttctgcagcctgcacccttgggggccccaggaaagacccatatccttgcaggcttggaggtgtttgcttcttctgcctggcctctctcggctcccggtgcatgctctcatatctgagtgggggttggtgctgagccccggggccgtgaattgcagcaggaggcagatttattcctgggcagaaggtggcagatcccaagtaaggggaccttcaagccagggagggcctgaaggctggtggctgggctaccagtcccaccgaccagagtggggattcgtgggcctcttctgggccacccatagccacccatggaccaatcagcaagcacatcctcccctctgaggtccgtaaaagccctgggcgcagcctgagcagggcagaggaaggccagaggtgaaggagtcagagaggcgacaggataggcagctgccgagagaagtacgcctctctgctgagacctggagatgacgggaaggccagatgcagagaggagctaccctctctgcttagagctgccaggaggagctaccaaccttctctgctgagagctgcagagatgacctgctggcagagaggagctacccactgcgggtctcctctgatctgttgtaatgctgaataaagcttcttttcatcttgttcaccttccacttgtctgcatacctcattctacccggacgcaagcaagaactcgagcaaaggcacaaccagccacagaggtttctggccagaaaatcgacaccccaaaagtcctataacaatctgattctaaaagcaacatcatcttttcaatgtaattctaaaagaatttgggattattttatttaatttcaggatcccctctgaagaaaatcaacttacaaaggatggcaggtcttaagaaaggtacttagcaagtgctggtacattctaagcaatcaatatttgtcaatgttcagtaattgtacaattgtactagagaaaacaattccaggggcttaaaattatcttatacaaggatccactttattattattttttctgtttgttttggataaattactgactccttatctcagttatgttatgtgttaaatgtttacagtgttattttgtatctctcaagggcttttgttagaattttcaatgagataccttaaaacctctaaaaagaaaatggatgttataagtaaataaaaataagtctgaatggcc

SEQ ID NO: 148 - protein, 144 aa, Homo sapiens [sequence omitted]

SEQ ID NO: 149 - DNA, 1755 bp, Homo sapiens
  CDS (201)..(1166)
attcatttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcagctatggctgggttggagatggattcgtggtcatctctaggattagcccaaaccccaagtgtgggaaaaatggggtgggtgtcctgatttggaaggttccagtgagccgacagtttgcagcctattgttacaactcatctgatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagggcaaaagaatggcagaaaagtttagcccctgaaagccatggagattctcataacttgagacctaatctctgtaaagctaaaataaagaaatagaacaag

SEQ ID NO: 150 - protein, 322 aa, Homo sapiens
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 151 - DNA, 1907 bp, Homo sapiens
  CDS (21)..(1196)
ctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtacctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctgtaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactgtgttactcaggaggtttctataatgccacatagaaagaggccaattgcatgagtaattattgcaattggatttcaggttccctttttgtgccttcatgccctacttcttaatgcctctctaaagcc

SEQ ID NO: 152 - protein, 392 aa, Homo sapiens
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 153 - DNA, 2981 bp, Homo sapiens
  CDS (58)..(1770)
gactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacaccacccctcccaggaccccagaggttactccgttgcggctggagctgcagaagctgccgggattggccagcacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgccccaggatacccttagctggctgcccgccctctggcccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggcccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctggtagggccctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgcacataagtgttagccagcagctccagaaaaatcccgattcccgggatctgccacgagtcactcctactccaccctgatggccagcagaggaagggccactcttctcatgggcacagccatcctttgccgggggggcatccagcccgggtggccacccctccttatctctgggtggtgcacatgcccttctttccccactccctgccacgagccactgcacaggaggctatctgtagccccaagctgcctttctgttggacaccaactttagtcttgggctgcaagccagcccagctgaggcgaagtggactccaggcagggaatgggttgcccaattctggtccctttcctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcactgaatgcactgaactcagagttgggaagagatgcacataatcgctctcccggcacacctcatgcctcttccctgcctccccattcccctggctgcacttccttgccttctatggggttgaaatgttgaagtctcaactgtctctgttcacaagagccaccaaaagttaggggacttcagtcctagcccccagatggccgccctgaagctctctgggctcctcagcaataaagcactttattttc

SEQ ID NO: 154 - protein, 571 aa, Homo sapiens
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNTTPPRTPEVTPLRLELQKLPGLASTTLSTPNPDTQASASPDPRPLREEEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWPFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIKYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 155 - DNA, 1361 bp, Homo sapiens
  CDS (169)..(822)
tggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacagagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaact

SEQ ID NO: 156 - protein, 218 aa, Homo sapiens [sequence omitted]

SEQ ID NO: 157 - DNA, 1976 bp, Homo sapiens
  CDS (13)..(387)
atctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattacaggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataagataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccatattttaaaatctccagagttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagag

SEQ ID NO: 158 - protein, 125 aa, Homo sapiens
MYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 159 - DNA, 2067 bp, Homo sapiens
  CDS (208)..(948)
tctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccacccaccttcccacctgaccagccatgggggctgcggtgttttgcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcagtattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgccctcattctctgtctccttctcgtcggtctaccccgctacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattgggatgtgggaggggcggggaggttttctataaactgtatcattttctgctgagggtggagtgtcccatccttttaatcaaggtgattgtgattttgactaataaaaaagaatttgt

SEQ ID NO: 160 - protein, 247 aa, Homo sapiens [sequence omitted]

SEQ ID NO: 161 - DNA, 2807 bp, Homo sapiens
  CDS (264)..(1301): "n" may be a, t, c, g, other or unknown
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 162 - protein, 346 aa, Homo sapiens
  "Xaa" may be any, other or unknown amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 163 - DNA, 1964 bp, Homo sapiens
  CDS (170)..(1729)
gcgctgctgtggcggccgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagacaccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgttttaatattgggttttggagacattattgtaccaggcctgttgattgcatactgtagaagatttgatgttcagactggttcttcttacatatactatgtttcgtctacagttgcctatgcttttggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttatattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgag

SEQ ID NO: 164 - protein, 520 aa, Homo sapiens [sequence omitted]

SEQ ID NO: 165 - DNA, 1988 bp, Homo sapiens
  CDS (91)..(1386)
gctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgggtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgc

SEQ ID NO: 166 - protein, 432 aa, Homo sapiens [sequence omitted]

SEQ ID NO: 167 - DNA, 2259 bp, Homo sapiens
  CDS (20)..(670)
gcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccagactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggagggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 168 - protein, 217 aa, Homo sapiens
MGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 169 - DNA, 1688 bp, Homo sapiens
  CDS (56)..(1456)
agcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaagtggggtcctggctaaaagtcaatggagaagctatttatgaaacctatacctggcgatcccagaacgacactgtcaccccagatgtgtggtacacatccaagcctaaagaaaaattagtctatgccatttttcctaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctaactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattgatttgtctcc

SEQ ID NO: 170 - protein, 467 aa, Homo sapiens [sequence omitted]

SEQ ID NO: 171 - DNA, 2130 bp, Homo sapiens
  CDS (20)..(1141)
acatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccctttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgattttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccaccatggactgacaaccaagggtagtcttccccagtccaaggagcagtcgtgtctgacctacattgggctttcctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcatcctacgcaggctctgccacaggggttagaccccaggtccgacgcttgaccttcctgggcctcaagtgccctcccctatcaaatgaaggaatggacagcatgacctctgggtgtctctccaactcaccagttctaaaaagggtatcagattctattgtgacttcatagaatttatgatagattattttttagctattttttccatgtgtgaaccttgagtgatactaatcatgtaaagtaagagttctcttatgtattatgttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgct

SEQ ID NO: 172 - protein, 374 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDALYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGDFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 173 - DNA, 1836 bp, Homo sapiens
  CDS (150)..(560)
ctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcctcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcagccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactcccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagtt

SEQ ID NO: 174 - protein, 137 aa, Homo sapiens
MGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 175 - DNA, 2198 bp, Homo sapiens
  CDS (123)..(1238)
aaaaaactctttcttcggctcgcgagctgagaggagcaggtagaggggcagaggcgggactgtcgtctgggggagccgcccaggaggctcctcaggccgaccccagtccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccgaacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtcctgttcttacagtggcaggagacaaggtgcgccaacgccagcttcgtgctcaacggggatgatgacgtctttgcacacacagacaacatggtcttctacctgcaggaccatgaccctggccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggacatcttccccattgatgatgtcttcctgggtatgtgtctggagcttgagggactgaagcctgcctcccacagcggcatccgcacgtctggcgtgcgggctccatcgcaacgcctgtcctcctttgacccctgcttctaccgagacctgctgctggtgcaccgcttcctaccttatgagatgctgctcatgtgggatgcgctgaaccggcccaacctcacctgcggcaatcagacacagatctactgagtcagcatcagggtccccagcctctgggctcctgtttccataggaaggggcgacaccttcctcccaggaagctgagacctttgtggtctgagcataagggagtgccagggaaggtttgaggtttgatgagtgaatatactggctggcgaactcctacacatccttcaaaacccacctggtactgttccagcatcttccctggatggctggaggaactccagaaaatatccatcttctttttgtggctgctaatggcagaagtgcctgtgctagagttccaactgtggatgcatccgtcccgtttgagtcaaagtcttacttccctgctctcacctactcacagacgggatgctaagcagtgcacctgcagtggtttaatggcagataagctccgtctgcagttccaggccagccagaaactcctgtgcacatagagctgacgtgagaaatatctttcagcccaggagagaggggtcctgatcttaaccctttcctgggcctcagacaactcagaaggttggggggataccagagaggtggtggaataggaccgccccctccttacttgtgggatcaaatgctgtaatggtggaggtgtgggcagaggagggaggcaagtgtcctttgaaagttgtgagagctcagagtttctggggtcctcattaggagcccccatccctgtgttccccaagaattcagagaacagcactggggctggaatgatctttaatgggcccaaggccaacaggcatatgcctcactactgcctggagaagggagagattcaggtcctccagcagcctccctcgcccagtatgttttacagattacggggggaccgggtgagccagtgaccccctgtagcccccagcttcaggcctcagtgtctgccagtcaagcttcacaggcattgtgatggggcagccttggggaatataaaattttgtgaagacttgg

SEQ ID NO: 176 - protein, 372 aa, Homo sapiens [sequence omitted]

SEQ ID NO: 177 - DNA, 2222 bp, Homo sapiens
  CDS (45)..(1532)
aaaaaaaattccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctacctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctacc

SEQ ID NO: 178 - protein, 496 aa, Homo sapiens
MRALRRLIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 179 - DNA, 1320 bp, Homo sapiens
  CDS (90)..(902)
actcgatcagcccgccggctccggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcgcattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctgcatacggtgggcggtgttgtcgagagggatgtgtgtcatcggtgtaggcacaagcggtggcactttataaagcccactaacaagtccagagagagcagaccacggcgccaaggcgaggtcacggtcctttctgttggcagatttagagttacaaaagtggagcacaagtcaaaccagaaggaacggagaagcctgatgtctgttagtggggctgaaaccgtcaatggggaggtgccggcaacacctgtgaagagagaacgcagtggcacagagtagcagtgtcctgaatgacagctcatctacacagagtgaaactccagatatgtgacaagcagcatgggacagatgctgacaatcagaacagatgctggatgtaaacaactggtaaggctgcactggtgcatgctggcagaatcacctgctatgcatccagggagcaaatgcatctgcatgctcagcatgacaccagcttacctccctgtgcaaatcccctcccctaatcagtctcatccaaatcttctcctgcagtagcagcttctaaagctgcaagggcctccgccaccgctgcatcctcgtccacaatctccccatccccatctccatcggagccatgggtatccccctgcctgtttcctgagtcaaccacaggcatggcatgaacaggacccttctcattaaagcagatgcttag

SEQ ID NO: 180 - protein, 271 aa, Homo sapiens [sequence omitted]

SEQ ID NO: 181 - DNA, 2167 bp, Homo sapiens
  CDS (15)..(1748)
aagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctatggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgg

SEQ ID NO: 182 - protein, 578 aa, Homo sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 183 - DNA, 1877 bp, Homo sapiens
  CDS (24)..(1412)
agaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgccggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccagggggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaggacccgccctccatggcaacagaggctccaccttgcgtaacaactgaggccccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggagctcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacc

SEQ ID NO: 184 - protein, 463 aa, Homo sapiens [sequence omitted]

SEQ ID NO: 185 - DNA, 2111 bp, Homo sapiens
  CDS (4)..(729)
tgcatgctgaagctctaccggaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttaacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcggctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaagggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagtt

SEQ ID NO: 186 - protein, 242 aa, Homo sapiens [sequence omitted]

SEQ ID NO: 187 - DNA, 874 bp, Homo sapiens
  CDS (335)..(643)
aggtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggaactctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgttctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctc

SEQ ID NO: 188 - protein, 103 aa, Homo sapiens
MGMAGALSILLFSLPSHGWPSPPKPPFPCCQPLCHSLILGRRKGRFEGEGEKAYGWVWFLPFPEGLTVPGWPQGRQGPHYACALVKVTPAIYQQPWHVPAPQE

SEQ ID NO: 189 - DNA, 2533 bp, Homo sapiens
  CDS (44)..(850)
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaattgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaaggtgtccctcaatgcatggttctggcccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagcgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccatcagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccattgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgctccagggtggccccagggcaggcaggggccacactatgcctgcgccctggtaaaggtgacccctgccacttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctc

SEQ ID NO: 190 - protein, 269 aa, Homo sapiens [sequence omitted]

SEQ ID NO: 191 - DNA, 1792 bp, Homo sapiens
  CDS (187)..(798)
aaaaagcgggtccgagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggtaccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagtcttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaaccttt

SEQ ID NO: 192 - protein, 204 aa, Homo sapiens [sequence omitted]

SEQ ID NO: 193 - DNA, 2622 bp, Homo sapiens
  CDS (85)..(1143)
aaaagcgctggccggagggcccgcggccgggccgccggggtgagcgtgtcgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccgacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcgggagcctctggaagcttagggctcattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttctttgcttt

SEQ ID NO: 194 - protein, 353 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 195 - DNA, 2005 bp, Homo sapiens
  CDS (48)..(950)
atgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacagttggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtggtcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgt

SEQ ID NO: 196 - protein, 301 aa, Homo sapiens
MARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 197 - DNA, 2012 bp, Homo sapiens
  CDS (305)..(1549)
aaaacgggatattcagcagtggcctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctcccctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaaccttgtcttgcgttttctaaatcaatgcttaataaaatatttttaaagg

SEQ ID NO: 198 - protein, 415 aa, Homo sapiens [sequence omitted]

SEQ ID NO: 199 - DNA, 1740 bp, Homo sapiens
  CDS (40)..(1257)
gcacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaaattagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccac

SEQ ID NO: 200 - protein, 406 aa, Homo sapiens; identical to SEQ ID NO: 30

SEQ ID NO: 201 - DNA, 2308 bp, Homo sapiens
  CDS (269)..(934)
aggattcttctcatcgcagtgctccaggcagccactaccaatcgattggagttagcctgtgaggaaactggagaggcgtggctggaccaagacctccccccatgtgagcaggcttcctcctcccccaacaaccgttgccaccacgcccagaaacgtccttaagccctggccctcaggggaaaggtagcaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatttcagcttatgaacccctgtaaagcaatttcagctttgcttcatggtatatttgctttctatccagaggttaattcgttagttttcttaaaacaatgtttttcttaatggtcttattgtttagaagtaacaagtggactggaaaagtatatggggcctaagtttataacattgtcttctcattatcagggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacggggcacctaataaaaatgagattgggggatctggaccgagtcaagtcaaaggaagcaaaagaaacagacaaactgagacccagagacggcactgtgtctaagagcaacagaaaaagtggtttgagcagtgtgctcttgatgacagtgttgctgtgttaaacgaattaatacatgaaaggacttggaatactgcttgacatatctttccaaggcaggaaagataaagagacaaagaaagtgccttgtacagatgcaaacggaggtgtagactgtgcagctgccaaagtggtgacaagcgatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtacaaat

SEQ ID NO: 202 - protein, 222 aa, Homo sapiens [sequence omitted]

SEQ ID NO: 203 - DNA, 1890 bp, Homo sapiens
  CDS (274)..(768)
ccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagcctcttctcggcacactgctgaactgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcttgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctcccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgt

SEQ ID NO: 204 - protein, 165 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLASSRHTAELKEMPPPPALFFQPSPPTPHLPE

SEQ ID NO: 205 - DNA, 2153 bp, Homo sapiens
  CDS (176)..(2146)
tatgcctgggcagggcgaagccagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagag

SEQ ID NO: 206 - protein, 657 aa, Homo sapiens
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRSVNDLRQEECKYWHYDENLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTICTVPLIDVINGNTYEIIPQGGGDEDGYARGAWDWSMLWKRVPLTPQEKRLRKTKTEPYRSPAMAGGLFAIEREFFFELGLYDPGLQIWGGENFEISYKIWQCGGKLLFVPCSRVGHIYRLEGWQGNPPPIYVGSSPTLKNYVRVVEVWWDEYKDYFYASRPESQALPYGDISELKKFREDHNCKSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKNLHRFTHIPSGKCLDRSEVLHQVFISNCDSSKTTQKWEMNNIHSV

SEQ ID NO: 207 - DNA, 2031 bp, Homo sapiens
  CDS (202)..(1554)
ttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatccgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgagggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgtgagtgtaccctaggggtggggtgctgatggaaggtggggtccactcatgggggcgggcgggttcactagcaaccagttatttctggagcccaccgggtttcctgatggtctgtcaggtgtatccttccttatcctcagtttcatcacccatagaatgtgactattaatgctatcggcctagccaacttgggttgcaaggattaaaagaattaataggaataggctgggcgcggtggctcacgcctgtaatcccagcacagggaggccaaggcgggcagatcacctgaggtcaggagttcaagaccagcctggccaacatggtgaaaccctatctctactaaaaatacaaaaaattagctgggtgtggtggtgggtgcctataatcccagctactcgggaggctgaagcaggagaattactcgaacctaggaggcagaggtgcagtgagctgagattgcgccattgcactccaacctgggcgacaaagcaaaacttcatctc

SEQ ID NO: 208 - protein, 451 aa, Homo sapiens [sequence omitted]

SEQ ID NO: 209 - DNA, 1841 bp, Homo sapiens
  CDS (51)..(632)
tgttttgtttctttatttggacttaacggccactcatttctgttggcgccatgcgactgttgccgtgtgcagcagggacctctgccttcctctcctcccagctcacaataggtgcctcttcctcctcccggccatccacgccggcctggttttcggttctggaatacatccaaccctttcgttcgtgttcttttctcctgtcatcttctccgcctggagctcttccatgttctctttgcacaagcgactctatccttccagtttcagatgatttcacctcctcaaagaggcctttgggaccagccttttctaaagctttccttgagaatgctggtcaagatttaccttttaattttgttttttctgtttgttctgtctcctctgccggctgcttgagctccaggatcacagaggacatgagtgttctgttcccactgatgcctggtgccagactgggacacgtgtgctcagccatggctaatgtgcgcaggcagggatggtcacacagtggcctcttggcgctctggccgagtgggaggagcaaggggaggagctgtcagaaggagacctgcctagtcacaggcaggtcacagggcttccagaatcccattcaggtgatcccctcctggtggtaaacagcacacctcagaagtggtgttttgtcatagttgttcttatggctcccacagcctcatctctgttttgtccatttgggattgaggagttgttgagtccagcgtcaccttcagagccagtgcactccttatcaatagtgagggccgctcgttttgattgttccgtttcgcttgataaagctgagtgagaattatattggccaacagaaacgtctctctccatgtgaacacagccactgggtcaccagggacgtggcttacagttccagcaggctcctgtcacactggtgcctttgggcagtacagaactgtgctgctggtggtgacgtccggggctgtgcagtgtcgcttccttttgcatatgttgctattggtgtcatttcctctctgagatcagtggaagtctcaggtcagtcccgtggccctgtattgcttagtgggccatgtgtttaaacttccaaaaggcatattttaaatagttattggagtgttgatgtgaagagctcctttgataatgtattttctttgtagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatgggtaaattaaaagttttacaacattctacctaatatttttcttttaacatactctttctgttctattgtattatggtgtccgaaagctaaataacgactaggaaaaatttttttaaaaaaagaaaaatcagtttaatgtgggaagtacttaagtggtattatattttacattttcaagtatagtgcataaagaatgttttaaatgtaactgttttcatggatttcaattagacatgcctataataaactaagtatgtggctt

SEQ ID NO: 210 - protein, 194 aa, Homo sapiens
MRLLPCAAGTSAFLSSQLTIGASSSSRPSTPAWFSVLEYIQPFRSCSFLLSSSPPGALPCSLCTSDSILPVSDDFTSSKRPLGPAFSKAFLENAGQDLPFNFVFSVCSVSSAGCLSSRITEDMSVLFPLMPGARLGHVCSAMANVRRQGWSHSGLLALWPSGRSKGRSCQKETCLVTGRSQGFQNPIQVIPSWW

SEQ ID NO: 211 - DNA, 1493 bp, Homo sapiens
  CDS (77)..(1492)
acagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggggctctcggtggagtaggcatcccaggcggtgtggtgggagccggacccgccgccgccgctgccgcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtactggtgttcctggacttggagttggtgctggtgttcctggcttcggggcagtacctggtgccctggctgccgctaaagcagccaaatatggagcagcagtgcctggggtccttggagggctcggggctctcggtggagtaggcatcaacctggttgacctgtcatggccgcctgtgccctgcctccacccccatcctatactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 212 - protein, 472 aa, Homo sapiens
MAGLTAAAPRPGVLLLLLSILHPSRPGGVPGAIPGGVPGGVFYPGAGLGALGGGALGPGGKPLKPVPGGLAGAGLGAGLGALGGVGIPGGVVGAGPAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGTGVPGLGVGAGVPGFGAVPGALAAAKAAKYGAAVPGVLGGLGALGGVGINLVDLSWPPVPCLHPHPILPQGVRGCADWGARHLLPTRGVPTCSTVYPPSLPRSTELQSSSHSCPAHLFVSRCDRSINILFFVL

SEQ ID NO: 213 - DNA, 1557 bp, Homo sapiens
  CDS (137)..(595)
aactacaccagggccggtgcacctcggggcggcggcgcaggactaggctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtatgttctttttcagaagttatatttgataatagagaagggagttttatggaagtttctttgaagattttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgataagctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaagctctgtactcttatgtttaaagggttttgtatagccattttttttttcagaaagttacattgctttgtatagaaataaaaggcattattaaaatttgcttgtt

SEQ ID NO: 214 - protein, 153 aa, Homo sapiens
MALALAALAAVEPACGSRYQQLQNEEESGEPEQAAGDAPPPYSSISAESAAYFDYKDESGFPKPPSYNVATTLPSCFYDISHLIFFIFYLRNMKKKYTKMVKLLHKSAPAQSDSCKCPFICCVCISRISIGSRSGYQYIMHRSVGCLKAKQEN

SEQ ID NO: 215 - DNA, 3555 bp, Homo sapiens
  CDS (271)..(1998)
gaccccggcgcgcgcgcggcggaggacgaggaagagttgtggcgaggcagatcctgccccgtggccgcggccgtctcgtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctggctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaagagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggctgactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaagcccctgtcccacgccgtctgcacgtgcctgtgcctcacccagagccagtgtctcccagcccacataggaggtctgggcagccacccagggggccctcctgggaggagctgagggttcacaagcctcccagaaccagccctgtcccatgggttccgtgcatttcctggtgctgctcttggaggagagcagctcccactgtggggacacctgccaccctgcacactactgtgtgtccatcagcatgtgtcacagaaagtgcgtggacggatggccccggagctgctctgccctgaccctgcctcaccccccagcgcagggactttccaggtcatctccacaccagcccctcagccggtgaaccctctctcccatcaccgtctccacccagacccccacctgccccatggcccccatttcatgtctgtggctcaccagcttttccccagacccagctccggagcccacaggcgtggccgatgcagaaacctcaggaaggtgtgttgtgaatgttgggtgcacccacgttgcatttacttagcggggccaattcagatgcacaggggccacatgcagaatccagaagtttctggacaattttcagaagaataggctgcctcctccccacagcctgggggaagtaacagtcatcgcccagcagtgtctggcctgaacttacccagaacattctgcccccggaatgcacgtctgaaagagtggccagaaacgagtgtgccgggcaggaggccagccccatctcaggctcacgtgcctctgacaggagaccagccccatctcagactcacatgcctcgcggacagttggacgtggcctggggcccctgctcacttgagcatgtcgcccaccaagcttgtctgaggccacagagcagcgtcccagccctgttttccaggactggtgggtgccccagtccacggccctgccccacccgaactcctgcctcacggtgtggccttgtgcatccccatggcctgaccccgggaacagtcagaggaaggggtcccgccctcccgccagaggcctggacccaagggaacggcagtcagagactacagtccagacgtttgtgtctaggccttgctggtagctaaggaaatgccttctgttgggaaaaggtcaaatttaacatagcaaaatttttacttaattccact

SEQ ID NO: 216 - protein, 576 aa, Homo sapiens
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDVILHVLPLHHVHGVVNALLCPLWVGATCVMMPEFSPQQVWEEFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 217 - DNA, 2083 bp, Homo sapiens
  CDS (134)..(1162)
atttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttgactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctc

SEQ ID NO: 218 - protein, 343 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 219 - DNA, 2586 bp, Homo sapiens
  CDS (54)..(902)
attcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaagccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccagggtgcccagggaccagtgggtccccccgaaagcccctgtgcttgcagcagtgtccaccccagtgtctaacagtcctcccgggctgccagccctgactgtcgggcccccaagtggtcacctccccgtgtgtgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatccctcaaggctgggtgtggaggctcgcgcctgtaatctcagcattttgggaggccaagtgcggacatcacttgagaccaggagttccaaaccagccctggcaacattgtgagacccatctctataaaaacaaaaaacagtccactaaatcagccacattaattgggaatcatatgtcacaggtcatttgtggggcaaacatcactgcttttccatcaagggagcaaagaataagtgggagttttggaagagtttggatgagagacgccaaggtgcccagcgttcgtaaggcaacatgcagcctggcgtgaagcagtattttgaaactgcaaatggttcccttcttgtgtcctttcaatgctgaatattttagtgtcattctgcctgtgctcagagctccagcagcagaagtgtgtgtggttaattaggacacttctgtgagaggacccctgcacacattacgacaggtccctaaatgagcattccccaaactaggttccccgaggcactctacggaaacaagatttttttttttgagacggagtctcggtctgtcacccaggctggagtgcagtggtgcaatcttggtgcaatcttggctcagtgcaatccgcctcccaggttcaagcgattctcccgcctcagtagctgggattacaggtgcccaccactgcgcccagctaaattttgtatttttagtagagatggggcttcaccatgttggccaggctggtctggaactcctgaccttcaggtgatccacctgcctctgcctcccaaggtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggc

SEQ ID NO: 220 - protein, 283 aa, Homo sapiens
MVSAAAPSLLILLLLLLGSVPATDARSVPLKATFLEDVAGSGEAEGSSASSPSLPPPWTPALSPTSMGPQPTTLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQGAQGPVGPPESPCACSSVHPSV

SEQ ID NO: 221 - DNA, 1548 bp, Homo sapiens
  CDS (20)..(1348)
tctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgacacaacggcgacgacagaaccagcagttcacggccttactcagttgcccaattccgcagaagaactggacagtgaggacctctcagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacct

SEQ ID NO: 222 - protein, 443 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDTTATTEPAVHGLTQLPNSAEELDSEDLSDSRAGEEGSIRAVDHAVIGGVVAVVVFAMLCLLIILGRYFARHKGTYFTHEAKGADDAADADTAIINAEGGQNNSEEKKEYFI

SEQ ID NO: 223 - DNA, 1457 bp, Homo sapiens
  CDS (14)..(982)
agaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaat

SEQ ID NO: 224 - protein, 323 aa, Homo sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 225 - DNA, 1484 bp, Homo sapiens
  CDS (225)..(650)
atcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctctgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttcttgatctttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccacccactttttattttttaatgataatggagatgtctggacccttcctcaccccacctgtcggtcttgtcctggctctgcctgtcccccaccgttgttctcgtaggtgaaccccaggtcctcaactccccccctttatgtatgaaaacataaaattgaaaaaaaaaaaaaaacctacacgagcaccgtgatttcaagtaataaacagaaaatgaaacac

SEQ ID NO: 226 - protein, 142 aa, Homo sapiens
MGFASYLLHPSLLPSSSSSSSSSVCLLSPLRQVGPPCQPSPAPICSSLSGWRRVKETEKRAPSLPPPPFPPDPIQVLSQKCRYVIMHFTDEGRGRSAQNPPHPPVQTSGSPPQASSAHWATASQQVTEANEGTVSLPLLSSS

SEQ ID NO: 227 - DNA, 1656 bp, Homo sapiens
  CDS (26)..(1330)
tgggcgcgcgcccgccccagttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttcaatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtct

SEQ ID NO: 228 - protein, 435 aa, Homo sapiens [sequence omitted]

SEQ ID NO: 229 - DNA, 1754 bp, Homo sapiens
  CDS (355)..(1140)
aaatttgccattcttagcaactggccagtcaacaactcaactttataatgggaaaactagacgagctgagattcaacccacgtgagcggctgcagagccgctacccttaacagctctctctcgggattctaacattcccttctgtgacggagagacagcaggccgggacacgcatcccaggacggatccacagctggatggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcccctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctac

SEQ ID NO: 230 - protein, 262 aa, Homo sapiens [sequence omitted]

SEQ ID NO: 231 - DNA, 2144 bp, Homo sapiens
  CDS (97)..(654)
aggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtaacaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatactgctgtgtaatgggctttgtacgttccttctcatgtcacttacgtcactacttcgccatcaaattgaacaagcttttaattagatcctgaaaattcactatgctagtagtttattggtagtattatattttgagtagaactctgattttccctagaggccaaattctttttatctgggttaatttcttttaaacataacaatgttaacgctgaattgtatattaaatcccatttctaaaaaccacacaattttttctcatgtaagttgagtggaatgtggttagttaactgaatttggaatgttcatataaataatttgttgctgctcat

SEQ ID NO: 232 - protein, 186 aa, Homo sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMM

SEQ ID NO: 233 - DNA, 1689 bp, Homo sapiens
  CDS (113)..(1159)
cattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccgcagtgaacacccacgtttattcctgcctgctccggccaggactgaaccccttctccacacctgaacagttggctcaagggccaccagaagcatttctttattattattattttttaacctggacatgcattaaagggtctattagctttc

SEQ ID NO: 234 - protein, 349 aa, Homo sapiens
MCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 235 - DNA, 1824 bp, Homo sapiens
  CDS (10)..(978)
ctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagtt

SEQ ID NO: 236 - protein, 323 aa, Homo sapiens
MAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVKLSSLNLDDHAKKKLIKLVGERYCKTTDVLTIKTDRCPLRRQNYDYAVYLLTVLYHESWNTEEWEKSKTEADMEEYIWENSSSERNILETLLQMKAAEKNMEINKEELLGTKEIEEYKKSVVSLKNEEENENSISQYKESVKRLLNVT

SEQ ID NO: 237 - DNA, 1959 bp, Homo sapiens
  CDS (56)..(478)
gcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccaagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatatttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcgggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttactcttc

SEQ ID NO: 238 - protein, 141 aa, Homo sapiens
MFTSTGSSGLYKAPLSKSLLLVPSALSLLLALLLPHCQKLFVYDLHAVKNDFQPGTCVCSVCTILLLHTKSPSGTNSGSVVHHKQDIDLYIGTAAFHLWFLHLDCSHKWTYVRSVLRQQNVPGASGALHPQLDGKILFLDT

SEQ ID NO: 239 - DNA, 2112 bp, Homo sapiens
  CDS (425)..(2077)
ggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgacctggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttct

SEQ ID NO: 240 - protein, 551 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDLELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQRHRAQSGLSPRPGRAGSGRLGAAHADFWPGAIPQEPLQGRPAEEPILAPSAPSTGPPGRFPGLQAPPRGRRPPPY

SEQ ID NO: 241 - DNA, 1765 bp, Homo sapiens
  CDS (440)..(1669)
aaattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcgggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctaccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagcc

SEQ ID NO: 242 - protein, 410 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALRVHPHCTVAALQEQVFSELGFPPAVQRWVIGRCLCVPERSLASYGVRQDGDPAFLYLLSAPREAPATGPSPQHPQKMDGELGRLFPPSLGLPQAPSQLPPACPVHSSPAGPVLPAPSSMPQTALAVRCVAPRGPALGTPLLQLPPSSHQRLQGESGPSLTSPTSPGPH

SEQ ID NO: 243 - DNA, 1369 bp, Homo sapiens
  CDS (23)..(748)
aacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccag

SEQ ID NO: 244 - protein, 242 aa, Homo sapiens
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWLLKLGHHGRAPPRRSGALPPAPAAPRPALRAQRAGPAGPGAKG

SEQ ID NO: 245 - DNA, 1584 bp, Homo sapiens
  CDS (100)..(1194)
gcgctcgccgcgctcgcactgaagcccgggccctcgcgcgccgcggttcgccccgcagcctcgccccctgcccacccgggcggccgtagggcggtcacgatgctgccgcccttaccctcccgcctcgggctgctgctgctgctgctcctgtgcccggcgcacgtcggcggactgtggtgggctgtgggcagccccttggttatggaccctaccagcatctgcaggaaggcacggcggctggccgggcggcaggccgagttgtgccaggctgagccggaagtggtggcagagctagctcggggcgcccggctcggggtgcgagagtgccagttccagttccgcttccgccgctggaattgctccagccacagcaaggcctttggacgcatcctgcaacaggacattcgggagacggccttcgtgttcgccatcactgcggccggcgccagccacgccgtcacgcaggcctgttctatgggcgagctgctgcagtgcggctgccaggcgccccgctggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggccgtgcggagccacacgcgcaccgagtgcaaatgccacgggctgtcgggatcatgcgcgctgcgcacctgctggcagaagctgcctccatttcgcgaggtgggcgcgcggctgctggagcgcttccacggcgcctcacgcgtcatgggcaccaacgacggcaaggccctgctgcccgccgtccgcacgctcaagccgccgggccgagcggacctcctctacgccgccgattcgcccgacttctgcgcccccaaccgacgcaccggctcccccggcacgcgcggtcgcgcctgcaatagcagcgccccggacctcagcggctgcgacctgctgtgctgcggccgcgggcaccgccaggagagcgtgcagctcgaagagaactgcctgtgccgcttccactggtgctgcgtagtacagtgccaccgctgccgtgtgcgcaaggagctcagcctctgcctgtgacccgccgcccggccgctagactgacttcgcgcagcggtggctcgcacctgtgggacctcagggcaccggcaccgggcgcctctcgccgctcgagcccagcctctccctgccaaagcccaactcccagggctctggaaatggtgaggcgaggggcttgagaggaacgcccacccacgaaggcccagggcgccagacggccccgaaaaggcgctcggggagcgtttaaaggacactgtacaggccctccctccccttggcctctaggaggaaacagttttttagactggaaaaaagccagtctaaaggcctctggatactgggctccccagaactgctggccacaggatggtgggtgaggttagtatcaataaagatatttaaaccacc

SEQ ID NO: 246 - protein, 365 aa, Homo sapiens [sequence omitted]

SEQ ID NO: 247 - DNA, 899 bp, Homo sapiens
  CDS (77)..(493)
gtgcgcgttggggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggaggttggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatg

SEQ ID NO: 248 - protein, 139 aa, Homo sapiens
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERSF

SEQ ID NO: 249 - DNA, 1874 bp, Homo sapiens
  CDS (156)..(818)
agcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtactggcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgatcttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataatgagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccaccccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttt

SEQ ID NO: 250 - protein, 221 aa, Homo sapiens [sequence omitted]

SEQ ID NO: 251 - DNA, 1463 bp, Homo sapiens
  CDS (78)..(587)
acgcgaaggctctatcccacgaaaggactgggtgcaccccagaacgaggacgcggagcttccctgttccaagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagggttctttgccaagattgtaaagtccccccacacgtgaaagcatcaaaacagacatctcacatttttccactggacataatgattgagtgtgttaaaaattctttggtttcctcaagtccattcctgttttaattaaaggatgaagaaggctatttctgatgcacgattacacccatgtggttctgatgaaactgaaacaggaggtgattgtgttcgtcagctggctgcctcattgccacctccacctgcaggaaggccagaggttctggtggagttgattgagtccaggcttttctgtaggtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggatattctgcagcgcttctgtctttttcttggagaatcctcatgtacaaagtgtagccatcgaaagccaagaattttttgcaggcattaagctacagcctgaattgagcactatatcagaggatgggaaagaatactacctgaggatagaaagcacagttcctattatttgttctgaatttagtgagcttgatcaagaatgcaaaatctcattaaaactgaaaactattgatcaaggtaatatactaactttattttatcttattattagattgcaaacaataatgcttttttttcctgtaggaaaagtcactggagtgtactcatataataaatcatgttgcatgttgacatcaaattttagcccaatcatattactaatactcggccaaactgacgattgccaaagcaattcacatttcttcttcttggccgaaagcatacatttt

SEQ ID NO: 252 - protein, 170 aa, Homo sapiens
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEGFFAKIVKSPHT

SEQ ID NO: 253 - DNA, 2103 bp, Homo sapiens
  CDS (50)..(1480)
gacccgccacccgccgtagcccgcgcgcccctggcactcaatccccgccatgtgggggctcctgctcgccctggccgccttcgcgccggccgtcggcccggctctgggggcgcccaggaactcggtgctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtatgactgggtcacatcatacaaggtccagttcagcaatgacagtcggacctggtggggaagtaggaaccacagcagtgggatggacgcagtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagtgagggagggacaaagtgaggaaaaggtgctcattaaagctaccgggcacctt

SEQ ID NO: 254 - protein, 477 aa, Homo sapiens
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDADPWFQVDAGHPTRFSGVITQGRNSVWRYDWVTSYKVQFSNDSRTWWGSRNHSSGMDAVFPANSDPETPVLNLLPEPQVARFIRLLPQTWLQGGAPCLRAEILACPVSDPNDLFLEAPASGSSDPLDFQHHNYKAMRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPQPGLLRARQHHQRG

SEQ ID NO: 255 - DNA, 1410 bp, Homo sapiens
  CDS (130)..(1266)
ggctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgactgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggagcagcggccggctggaggtgtgggactccattgaaggggtgctgtgctgcagcagcgaggaggtctcctcaggcattaccgctctggtgttcttggacaaagggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacc

SEQ ID NO: 256 - protein, 379 aa, Homo sapiens [sequence omitted]

SEQ ID NO: 257 - DNA, 1483 bp, Homo sapiens
  CDS (92)..(529)
atcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgggttttccaccttctctcacaagaccgtctactttgactttcaagtgggcgatgagcctcccattctcccagacatggggaacagggtcacagctctcacccagggcttcagggtcttctgcctgtagctgccaaaggaagagagaatgagaaaagcccatctacctcttaaaagcccaggcccagtgggaatacgtatcacctgctcatgtcccatggatggagtccgcctgcgtgaccatccatgaggctctgaaaacggtgattgactcccagacgcattaccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagc

SEQ ID NO: 258 - protein, 146 aa, Homo sapiens [sequence omitted]

SEQ ID NO: 259 - DNA, 1784 bp, Homo sapiens
  CDS (55)..(867)
gcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaaagttgcctttttg

SEQ ID NO: 260 - protein, 271 aa, Homo sapiens
MASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSARAIVFVVDSAAFQREVKDVAEFLYQVLIDSMGLKNTPSFLIACNKQDIAMAKSAKLIQQQLEKELNTLRVTRSAAPSTLDSSSTAPAQLGKKGKEFEFSQLPLKVEFLECSAKGGRGDVGSADIQDLEKWLAKIA

SEQ ID NO: 261 - DNA, 1709 bp, Homo sapiens
  CDS (89)..(826)
agctccagtcctggcatctgcccgaggagaccacgctcccggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgtt

SEQ ID NO: 262 - protein, 246 aa, Homo sapiens
MLWRQLIYWQLLALFFLPFCLCQDEYMESPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 263 - DNA, 2499 bp, Homo sapiens
  CDS (208)..(1008)
actccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctggtgaggcctcccccttcccaagtccattcccactgtaggccgatgcctgtgcaaaggacgcagtgccatatcagagaggatccttgaagaggactcaccccaagcaagggaaaattggtgggggaacttctgccttcctggtttccttgactttggcctcctcctcttcctccttatcttctccaacctccttcctttatttgttccacagactggaccgcagatcattaccttgaaccacacagacctagttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttct

SEQ ID NO: 264 - protein, 267 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLVRPPPSQVHSHCRPMPVQRTQCHIREDP

SEQ ID NO: 265 - DNA, 1601 bp, Homo sapiens
  CDS (9)..(641)
tatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggcgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaagcttgtacttcaagtagggggaatcgtaattctaataactccttagctaagttttattattcaggcaataaacatgttttcatgt

SEQ ID NO: 266 - protein, 211 aa, Homo sapiens
MVFLKFFCMSFFCHLCQGYFDGPLYPEMSNGTLHHYFVPDGDYEENDDPEKCQLLFRVSDHRRCSQGEGSQVGSLLSLTLREEFTVLGRQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGRLKNDYLKV

SEQ ID NO: 267 - DNA, 1906 bp, Homo sapiens
  CDS (42)..(1628)
gagcggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtgcctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcgggccagttggcctgccggtgccagcacaacaccaccggcacagactgtgagcgctgcctgcccttcttccaggaccgcccgtgggcccggggcaccgccgaggctgctcacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacggtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtct

SEQ ID NO: 268 - protein, 529 aa, Homo sapiens [sequence omitted]

SEQ ID NO: 269 - DNA, 1638 bp, Homo sapiens
  CDS (380)..(1138)
agatcgcgccaggagaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccaggc

SEQ ID NO: 270 - protein, 253 aa, Homo sapiens
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLPGCSCGPVPGEPPGPGNRWGGCADNLSYGLLMGAKFSDAPMKVKKTGSQANKLMRLHNSEVGRQALRASLLVNSRCQAWEAACALPSLGSHQEQKVWPPWKEGRTSKETDKIKNNLAA

SEQ ID NO: 271 - DNA, 3593 bp, Homo sapiens
  CDS (13)..(1878)
acgcgtggcgcgatggcggcggccccacgcgcgggccggcggcgcgggcagccgctcctggcgctgctgcttctgctgctggcgccactgccgccgggggccccgccgggcgccgacgcctactttcccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtacttttcacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcggacaacatccccccaccacccaagagggagggtagctcttccgccaccaggggcaagcacaggtcctggtggccccacgccacatgttagcccccctggagggggcgccagttggagacgggggctgggtgtccctggcccactcccagtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttc

SEQ ID NO: 272 - protein, 622 aa, Homo sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 273 - DNA, 2835 bp, Homo sapiens
  CDS (160)..(2388)
aagcctcccattacggagcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgccccatggcccaggcgtctcgctcaggtagcctgcctccactcgttatcgtgcccccgctgagggcgcaacccgggggcactggggaggagcagtgggagagaagtcgaacgggcggtcttcgctgggaggttcactgctggccgagcggaacttctggagggacgccgtggtggccgacgccggcggatgtgagcgaggactacgaggctgatgctgcggcctggaggcgggggcccgcaggtggcggcccgatccctcccgcgctgcagcgtctccgggcggtgttgctgcggctgcatcgcgagcgggagcagctcctccaggcccgagactgcgcctaccacctacagtcggctgtgcgactcatgaagaccctgagtcctggctcgccatccggcggccctagccccttgccccagtggtaccgcgacctgcagctgcacccttcccaaggggcggttctgcgaatcggccctggggagactctcgagccgctgctgctagcgcgccccatcggactagccgcccagtgcctggaggctgtcatcgagatgcagcttcgcgctctcggccgggagcccgccagcccgggcctgtcgtcccaactcgccgagctgctctttgcacttcccgcctaccacacactacagagaaaagccttgagccacgtcccaggggccgcacgtcctttccccacgtcccgtgtgctccgcctcttgacgggggagcggggttgccaggtggcaagtcggctggacgaggcgctccaaggatcggcgttgagggaccagctccgcaggcggtgccaagaggagggggatctgctaccagggctgctgggcctggtcgggggcgtggcgggttcagccagctgtggactagggctcggaggggctggggccttgtggtgccaatactggaccctgctgtgggcagcctgtgctcagagtctggacctaaatctgggaccctggagggaccccagggcaacagcgcaacagctgagtcaggcactgggtcaggcatccctgcctcaggagtgtgagaaggagctggcatctttgtgtcacagactacttcatcagtcgcttatctggagctgggaccaaggtttctgccaggccttgggatcagctcttgggggtcagagcagccttcccacatcctctggcactgctgaacttttgcagcagctctttcctcctctcttggatgcccttcgagagcccaggttacgacggattttctgccagcctgcaggtctctgtacccttcagaccaccttgctctggttcctgggcagagctcagcagtacttggcagcatgggacccagcttccttcctgctcctgatccaaaaggacttacctcctctgttgcatgaggcagaagctttgtatagcctggcctcagaggaaagcttagctctggaagtggagcagcagctgggcctggagatccagaagctgactgcacagatccagctcctgcctgaagagtcactaagtgtcttttctcaagaatgtcataaacaagccatgcaaggtttcaagctctacatgccacggggtcggtactggcggcttcgtctctgtcctgaacctcccagtgctcctagtgagtatgctggtttagtggtccgcaccgtactggagcctgtgttgcaaggattgcaagggttgccacctcaagcccaggcccctgcccttggtcaggctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctactgtgtctgttgcagcagcccctgcccaagtctcaagtccacaggaggcccccctgttgctgtgcttgtcaggaggtccagaccacgaaattgcccagcagctgcctcaatagcctggagagcttggagcccccgctccagcctggaacatctccagcccagacaggtcagctgcaaagcacactaggaggaaggggacctagcccggagggctacctggtgggaaatcagcaggcctggcttgccctcaggcaacaccagcgaccccgttggcacctgccgtttttttcctgcctgggaaccagtcctgaatcctaaggagcctgggaccaggagccagaaagttaagagctccccatctctagctggaaaatccagacatttggaattgcatattaaggaagcccagaactggaagcttggaggaaagcatactggagaataagctacaaagagcctgggcttaagaatccaagattaggggctgggcgaggtggctcacgcctgtaatccagcactttgggagaccgaggcaggcggatcatgaggtcaggagatcaagaccatcctggctaacacggtgaaaccctgtttccactaaaaatacaaaaaattagccgggcgtggtggcgggtgcctgtagtcccagctactcgggaggctgaggcaggagaatggtgtgaacctgggaggcggagcttgcagtgagctgagatccagccacagcactccagcctgggtgacagagcaagactctgtctc

SEQ ID NO: 274 - protein, 743 aa, Homo sapiens
MAQASRSGSLPPLVIVPPLRAQPGGTGEEQWERSRTGGLRWEVHCWPSGTSGGTPWWPTPADVSEDYEADAAAWRRGPAGGGPIPPALQRLRAVLLRLHREREQLLQARDCAYHLQSAVRLMKTLSPGSPSGGPSPLPQWYRDLQLHPSQGAVLRIGPGETLEPLLLARPIGLAAQCLEAVIEMQLRALGREPASPGLSSQLAELLFALPAYHTLQRKALSHVPGAARPFPTSRVLRLLTGERGCQVASRLDEALQGSALRDQLRRRCQEEGDLLPGLLGLVGGVAGSASCGLGLGGAGALWCQYWTLLWAACAQSLDLNLGPWRDPRATAQQLSQALGQASLPQECEKELASLCHRLLHQSLIWSWDQGFCQALGSALGGQSSLPTSSGTAELLQQLFPPLLDALREPRLRRIFCQPAGLCTLQTTLLWFLGRAQQYLAAWDPASFLLLIQKDLPPLLHEAEALYSLASEESLALEVEQQLGLEIQKLTAQIQLLPEESLSVFSQECHKQAMQGFKLYMPRGRYWRLRLCPEPPSAPSEYAGLVVRTVLEPVLQGLQGLPPQAQAPALGQALTAIVGAWLDHILTHGIRFSLQGALQLKQDFGVVRELLEEEQWSLSPDLRQTLLMLSIFQQLDGALLCLLQQPLPKSQVHRRPPCCCACQEVQTTKLPSSCLNSLESLEPPLQPGTSPAQTGQLQSTLGGRGPSPEGYLVGNQQAWLALRQHQRPRWHLPFFSCLGTSPES

SEQ ID NO: 275 - DNA, 2063 bp, Homo sapiens
  CDS (27)..(887)
actctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacaggtaaacaatctgaaagcaggcccctaactcttctcagaaccgatattcttccttccttgcttcttactctttttttcactttgtcccagtccattgtggctctgtcttctggaatctgttttagggaaacctctgtaatgccaggtctattaaggagaggttctggggatccaggccgctgtggtacccgctctttctcaattctccctaagattggaggcaaccgctgggcaaatgctcactattctccagatcacccaccctgggggagttcctgctggaggcatctaattcttgcctctatttccttttcctgtgcttttctcatcagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgtcttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgctc

SEQ ID NO: 276 - protein, 287 aa, Homo sapiens
MGPSTPLLILFLLSWSGPLQGQQHHLVEYMERRLAALEERLAQCQDQSSRHAAELRDFKNKMLPLLEVAEKEREALRTEADTISGRVDRLEREVDYLETQNPALPCVEFDEKVTGGPGTKGKGRRNEKYDMVTGKQSESRPLTLLRTDILPSLLLTLFFTLSQSIVALSSGICFRETSVMPGLLRRGSGDPGRCGTRSFSILPKIGGNRWANAHYSPDHPPWGSSCWRHLILASISFSCAFLIRLWLHNLSSEINEDSEAIWWPSWSMDQGSTGANREDLRVRWDTE

SEQ ID NO: 277 - DNA, 2896 bp, Homo sapiens
  CDS (196)..(1449)
actgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcaaccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagacaagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggtctctgtccactaccctgaccttctccagccctgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagcttatcaggcgcagggccccagacagcttcccagccggccctagagcccggcctgggccaatgatggagggcggccaccagcccagggcctgcccatccagaagggactccccagggcctgggggaggagacccttggaaaagtcctctcttcccagctcctgattctggatctgagattctcagatcacaggcccctgtgctccaggccgaggctgggccaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgatttttt

SEQ ID NO: 278 - protein, 418 aa, Homo sapiens [sequence omitted]

SEQ ID NO: 279 - DNA, 2969 bp, Homo sapiens
  CDS (38)..(1072)
agcaacgacgccgggcagcgggagcggcggccgcgccatgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaaggatgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgttggagagacagcatataaaacagtattgaaataggctgggagagagcaatgtttctgtgctatattggatgctcagaagtgcaggagacgctggacccaattctctctgctgggtagttaccttatagcatttggggatttgggttagatgatctaaccaggaggccatcactggatggtcacccccccaaaaaaattccatttgagcatcaaaacctgctttgcacaatcctatttgatgcccccagttcagcagagtcagtggccaaagaaaactttggacgtgagtaacacccttcagcagtcgcaacgttattttggttttgtgaaggactctgaaaccatctaccctgtataaattctggctttagaaatttgcccaagaatgctcattctgagagctttcctcagcagcatatatcatcagcctcatcctaaaataggcagggagcccctcccatgagtttatccaagttctcagctcctaaaatgcaggctgccaagaccctacacctgccctggctctacagccacttacctggtttctggactgtcaccctcccagctgacctgcccgtagccaaggaatgaggacctaacttgagttggcccaaagtctgacctggctgtatgtccctgtggcccacacccagcctgtcttgctcattcatgcagcctcaacactggcctccaaagttcccttaacacttgcaaagtcctttttacctgtgcatttggacttgaggacactggtttctatcacaggtgagagccatgttcaatacctccagcaagctctcctggctccctgcactgtgcacgctcctcttcccaaggtcccaataccagcacctctagttagagttagggtcagggtcaggcctctcccaacatcccagtagtttctcctctgagacacatgggcaagagacaatttggagtcaagattttccatttggatctattttaaatcttttagaaatgcatttgaaacagtgtgtttgttttttcccttctagttaagggactatttatatgtgtataggaaagctgtctctttttttgtttttcctttaacaaggtccaaagaaagatgcaaaaggagatcacacccttgccccgctgagccccgtgataacaagtcactccagactaacctgtgtgccagacatttgtgcattgttgcactttgaggttattatttatcaagttcttgaaggaagcagaaagagggactcctctctccctccgtgtatagtctctatgtttgtgctagtttttcttttttttctctgtgtccagtcagccacagggcccgcctccctgcaggaataaggggtaaaacgttaggtgttgtttggcaagaaaccacactgactgatgaggggtaaaatggaaccaggtagagccactccgggcagctgtcacccattcagaacttctttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccactggtattttgttttgttt

SEQ ID NO: 280 - protein, 345 aa, Homo sapiens
MWLLGPLCLLLSSAAESQLLPGNNFTNECNIPGNFMCSNGRCIPGAWQCDGLPDCFDKSDEKECPKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYNVNNGIQYVASQAEQNASEVGSPPSYSEALLDQRPAWYDLPPPPYSSDTESLNQADLPPYRSRSGSANSASSQAASSLLSVEDTSHSPGQPGPQEGTAEPRDSEPSQGTEEV

SEQ ID NO: 281 - DNA, 2872 bp, Homo sapiens
  CDS (9)..(716)
aaaaactgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccaatgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcacctggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctcagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaaggcatcgaggccatttctgctgcaacaaggtttcctgtctcttcactgtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagatggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtcttaccaaattcgccctttaacagcttgctctggcaaccccataaatgacacctgagctccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaac

SEQ ID NO: 282 - protein, 236 aa, Homo sapiens
MFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 283 - DNA, 2694 bp, Homo sapiens
  CDS (71)..(586)
gcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccaccaccccccgcccctgctggccttggtgctaaggaagtggggagagcaggctctccctgcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcg

SEQ ID NO: 284 - protein, 172 aa, Homo sapiens
MSSSGGAPGASASSAPPAQEEGMTWWYRWLCRLSGVLGAVSCAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKGDAISYARIQQQRQQADEEKLAETLEGEL

SEQ ID NO: 285 - DNA, 3320 bp, Homo sapiens
  CDS (163)..(1764)
aaaaaaaaaaaaaaaaaaaaaaaaaaaaaaattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacatggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgt

SEQ ID NO: 286 - protein, 534 aa, Homo sapiens [sequence omitted]

SEQ ID NO: 287 - DNA, 2179 bp, Homo sapiens
  CDS (192)..(860)
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgagagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaagagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacataaagtctgatgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaaacttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaaagcgtttctgtgacttcaggtaccagcttaaagagcactagggatggggaacgaatgccaaatcagactccacctagagcaccaggaaacagcttgtaccctggtagggaaatggtgtcgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatctggatataatgttctttttaaacaagtataatcatatcgtcggaggttaagattatgaaattttaaaatctctattcaagatgatgttcactccaaatacactacagaatttagtcaacattttatataatgtttcaataaatgtttctttcaataaagatactatgtgcccttcatagtaataaaatctcaatcttaaagcatg

SEQ ID NO: 288 - protein, 223 aa, Homo sapiens [sequence omitted]

SEQ ID NO: 289 - DNA, 2617 bp, Homo sapiens
  CDS (306)..(1778)
gcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaaggtccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtggatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 290 - protein, 491 aa, Homo sapiens [sequence omitted]

SEQ ID NO: 291 - DNA, 2872 bp, Homo sapiens
  CDS (88)..(882)
agcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcacggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagaggggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatcc

SEQ ID NO: 292 - protein, 265 aa, Homo sapiens
MASSSVPPATVSAATAGPGPGFGFASKTKKKHFVQQKVKVFRAADPLVGVFLWGVAHSINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREPAIRKRLKNCPPLRIWTFSTRTRKYILVKRRRKYFWRS

SEQ ID NO: 293 - DNA, 3774 bp, Homo sapiens
  CDS (268)..(2328)
ggactcggcaggcagcggggaccagggctggcaggttaagcctctgggggtggatcctgaaaggtggtccagccgcctggccctgcgtgggaccctccacctggcagcagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccacgtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagtgaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtagaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggtaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagc

SEQ ID NO: 294 - protein, 687 aa, Homo sapiens [sequence omitted]

SEQ ID NO: 295 - DNA, 3791 bp, Homo sapiens
  CDS (136)..(1182)
acatcctccggctgcccgcgcacctctccacgccggccccgttccgcggctcgccctcggctgcgctcggctcccgcgggcgctcggccccgagcccctcctccccctacccgccggccggacagggaggagccaatggctgggcctgccatccacaccgctcccatgctgttcctcgtcctcctgctgcccctggagctgagcctggcaggcgcccttgcacctgggacccctgcccggaacttccctgagaatcacattgacctcccaggcccagcgctgtggacgcctcaggccagccaccaccgccggcggggcccgggcaagaaggagtggggcccaggcctgcccagccaggcccaggatggggctgtggtcaccgccaccaggcaggcctccaggctgccagaggctgaggggctgctgcctgagcagagtcctgcaggcctgctgcaggacaaggacctgctcctgggactggcattgccctaccccgagaaggagaaccgacctccaggttgggagaggaccaggaaacgcagcagggagcacaagagacgcagggacaggttgaggctgcaccaaggccgagccttggtccgaggtcccagctccctgatgaagaaggcagagctctccgaagcccaggtgctggatgcagccatggaggaatcctccaccagcctggcgcccaccatgttctttctcaccacctttgaggcagcacctgccacagaagagtccctgatcctgcccgtcacctccctgcggccccagcaggcacagcccaggtctgacggggaggtgatgcccacgctggacatggccttgttcgactggaccgattatgaagacttaaaacctgatggttggccctctgcaaagaagaaagagaaacaccgcggtaaactctccagtgatggtaacgaaacatcaccagccgaaggggaaccatgcgaccatcaccaagactgcctgccagggacttgctgcgacctgcgggagcatctctgcacaccccacaaccgaggcctcaacaacaaatgcttcgatgactgcatgtgtgtggaagggctgcgctgctatgccaaattccaccggaaccgcagggttacacggaggaaagggcgctgtgtggagcccgagacggccaacggcgaccagggatccttcatcaacgtctagcggccccgcgggactggggactgagcccaggaggtttgcacaagccgggcgatttgtttgtaactagcagtgggagatcaagttggggaacagatggctgaggctgcagactcaggcccaggacactcaaccccaggaggggagccgctcggcgaatgagctgggtgggtgcccaggagccggcccgcagcacctgcacacacgaagtccggacccacgcagcctccatcccgcgtgtcttgctctccgcgatggcaatgccgagagtgccctctactgtccgactccagcactgcaacagcttcaagttcaaaaccaagaggcgtttttgagagtggaaaagaaatttaaacttcccgaaagaaggtccaccatcaggagatgaatatggaacatctcctatgtaccaggcactgtgctaagtgctggaatacattatctcattgaattatcacaacgaccttttcaagtaggcatttcaccatgcgacaggttgaggaccgtgaggcacgctggagttatttgactcgacttgcccagggtcccaggtcagtgcttctcaaactcctgacctcaggtgatccccccgtctcagcctcccaaagtgctgggattacaggcatgagccagcatgcctggcctgtgaacgcagaattcttataaggtgtttagaacagtgcctagcacctaataaacctccagtgttagctaatttgttattctaggagaattttagatgtcggttctttgacaatgacccatcacatactctgagatcatttctaagtcaccattcaagctccttccccgaagtgtgttccatagaacactgggaccatgagatgctctattagaaagggtcagggtacggttccatggtcagagaggtttggaaaactgttccggcctcagcccttggcagcatgtgcagattccaggcaccgaggcagggctggaggagtaagtggctttgcaataaaatgggtgctggagtctaaaatgataccctgggtggagtgggggagctgagcaggaggccaggtggcaaccagtagctgctgggcccgtggcctgaaccctcctgcactcctccagctggagtctcaccgcggatcccaggaatacctgctgttcccacagggctgcctttccgtagtttgtctggagacaccaagagtggtttccatgcctgctgggaataggctgagcatgcaatgacatgagggccaaggcttgtgggaaaatgacagcttcacagccccttgaggagtgaccaagccacaaagtaaatcctaaagccacaaccccttctaccactgagctgctggaggtgggtccttatttcaagccatattcaacccacccaacaaaacctaacattgaggtggtgggcacacggcccctgccgtggggctcactctgcagctggagagacagcatacctgaaacctgcaaggaaccggtttataaaacaacagaacagccaggaaaatggtgctaggagagacagtggagaggccagagaagcaaaccactgtggctcctcactgggggtttcacggggttggactgagccctgtcacctctgtgatagtcttcactctgacaggcaatggtgactgtgtgtgtttcctggggaggaggttagcagggacggttgcctttcctgggaagggcggtttgcagaaccaggggtttatattgcagggagtgtattttctgaattctaagtcagaacaagcagtctgatacaggatccatggctgggtcacttctgggtgcaagaggctttctagaccttagacactcaagattacggtcccgggccagtaacagcacctgggagcttggtagaaatgcagaatcttagcctaggcaacatagggagacctcatctctgcaaaaaataacaaaattagccgggcatggtggtgcacacctgtagtcccagctattctccaggctgaggtgggaggatcgcttgagcccaagaggttgaggctgcagtgagccatgatcgcaccactgcactccagcttaggcaatacagcgagaccttgtctcaaaaaaagacaaaaaaaacaaaaagaaatgcagattcttgggccccaccaccccacgcctactgagccagaatctctgggggtggggcccagccatttggcttttcacaagttctccaggtcattcttgggcacgatcaaatttgagaatcacaggtctaggatacgacggggaaaacagaaatgtggggtggtcagggacattcggataattcgggctatttgtattcaggtgtgagctggcaaatccgagacctgttttgcgtagctaattaccagcaatgacaaactcccaggctctgaggcccaagcctcctgggctgcaactggtctttatttttggaggcaatgaatggagcacctcggcctgggaccctcagtgtagggttttctgactcttaggcaacttcctagggtgctgtacttcctttttaaagttggggagcggcagggggagggggaagtgccacgcccttgtagtttcatgatgtcatgttgcatgtgctcttgagctgtaaataaagagacgatggttaaaaagcc

SEQ ID NO: 296 - protein, 349 aa, Homo sapiens
MAGPAIHTAPMLFLVLLLPLELSLAGALAPGTPARNFPENHIDLPGPALWTPQASHHRRRGPGKKEWGPGLPSQAQDGAVVTATRQASRLPEAEGLLPEQSPAGLLQDKDLLLGLALPYPEKENRPPGWERTRKRSREHKRRRDRLRLHQGRALVRGPSSLMKKAELSEAQVLDAAMEESSTSLAPTMFFLTTFEAAPATEESLILPVTSLRPQQAQPRSDGEVMPTLDMALFDWTDYEDLKPDGWPSAKKKEKHRGKLSSDGNETSPAEGEPCDHHQDCLPGTCCDLREHLCTPHNRGLNNKCFDDCMCVEGLRCYAKFHRNRRVTRRKGRCVEPETANGDQGSFINV

SEQ ID NO: 297 - DNA, 2583 bp, Homo sapiens
  CDS (264)..(989)
ctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatc

SEQ ID NO: 298 - protein, 242 aa, Homo sapiens
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 299 - DNA, 2492 bp, Homo sapiens
  CDS (30)..(1517)
gttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 300 - protein, 496 aa, Homo sapiens
MALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 301 - DNA, 3080 bp, Homo sapiens
  CDS (22)..(2439)
gcacatgcgccttgagggaagatggcacctgccggctgctgctgctgctgctgcttctggggcggcgctgtggccgccgcgggcgccgcccggcgtgtcctgctgctgctgctgctgggggtcctgtccgcccggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcagattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggacaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtatcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctat

SEQ ID NO: 302 - protein, 806 aa, Homo sapiens [sequence omitted]

SEQ ID NO: 303 - DNA, 4144 bp, Homo sapiens
  CDS (14)..(2926)
atgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatctatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaactagcaattctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagcccgactcctcctataaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccatgtgatgggggaccgcagtgtgctctacaagagcctgaaccccaacctgctggccgtggtgacagagagcacggacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagcttcctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctgtttcaatttatcagaagccaagtgcatactagcgtcttgtttgttgcccattgcctatacttttcacctgagatgtgtgagttgggaccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatg

SEQ ID NO: 304 - protein, 971 aa, Homo sapiens [sequence omitted]

SEQ ID NO: 305 - DNA, 1085 bp, Homo sapiens
  CDS (1)..(813)
atgtcgccgctgctggggctccggtccgagctgcaggacacctgcacctcgctgggactgatgctgtcggtggtgctgctcatggggctggcccgcgtagtcgcccggcagcagctgcacaggccggtggcccacgccttcgtcctggagtttctagccaccttccagctctgctgctgcacccacgagctgcaactgctgagcgaacagcaccccgcgcaccccacctggacgctgacgctcgtctacttcttctcgcttgtgcatggcctgactctggtgggcacgtccagcaacccgtgcggcgtgatgatgcagatgatgctggggggcatgtcccccgagacgggtgcggtgaggctattggctcagctggttagtgccctgtgcagcaggtactgcacaagcgccttgtggagcttgggtctgacccagtatcacgtcagcgagaggagcttcgcttgcaagaatcccatccgagtcgacttgctcaaagcggtcatcacagaggccgtctgctcctttctcttccacagcgctctgctgcacttccaggaagtccgaaccaagcttcgtatccacctgctggctgcactcatcacctttttggtctatgcaggaggaagtctaacaggagctgtatttaatccagctttggcactttcgctacatttcatgtgttttgatgaagcattccctcagttttttatagtatactggctggctccttctttaggtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatctt

SEQ ID NO: 306 - protein, 271 aa, Homo sapiens
MSPLLGLRSELQDTCTSLGLMLSVVLLMGLARVVARQQLHRPVAHAFVLEFLATFQLCCCTHELQLLSEQHPAHPTWTLTLVYFFSLVHGLTLVGTSSNPCGVMMQMMLGGMSPETGAVRLLAQLVSALCSRYCTSALWSLGLTQYHVSERSFACKNPIRVDLLKAVITEAVCSFLFHSALLHFQEVRTKLRIHLLAALITFLVYAGGSLTGAVFNPALALSLHFMCFDEAFPQFFIVYWLAPSLGILLMILMFSFFLPWLHNNHTINKKE

SEQ ID NO: 307 - DNA, 2048 bp, Homo sapiens
  CDS (97)..(897)
aaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctg

SEQ ID NO: 308 - protein, 267 aa, Homo sapiens
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 309 - DNA, 2682 bp, Homo sapiens
  CDS (45)..(1466)
aggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatcccactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaggaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggtgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataaaagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctggttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgcgtcttgtgttaagaatcatttcctggccaggctcggtggctcaggcctgtaatcccagcactttgggaggctgaggcaggtgaatcacttggtcaggagatggagaccatcctggctaacatggtgaaaccccgtctctactaaaaatac

SEQ ID NO: 310 - protein, 474 aa, Homo sapiens
MELGGHWDMNSAPRLVSETAERKQEQKTGTEAEAADSGAVGARRFLLCLYLVGFLDLFGVSMVVPLLSLHVKSLGASPTVAGIVGSSYGILQLFSSTLVGCWSDVVGRRSSLLACILLSALGYLLLGAATNVFLFVLARVPAGIFKHTLSISRALLSDVVPEKERPLVIGHFNTASGVGFILGPVVGGYPTELEDGFYLTAFICFLVFILNAGLVWFFPWREAKPGSTEKGLPLRKTHVLLGRSHDTVQEAATSRRARASKKTAQPWVEVVLALRNMRNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGAQASGTLIGVGQSVTAVGRIIAPLLSGVAQEVSPCGPPSLGAVLALVAIFIMSLNKRHSSGDGNSKLKSE

SEQ ID NO: 311 - DNA, 2405 bp, Homo sapiens
  CDS (59)..(2248): "n" may be a, t, c, g, other or unknown
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 312 - protein, 730 aa, Homo sapiens
  "Xaa" may be any, other or unknown amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

(The sequence listing continues in the following parts.)

What is claimed is:

1. An isolated polynucleotide selected from the group consisting of
   (a) a polynucleotide comprising the nucleotide sequence from positions 20 to 1348 of SEQ ID NO:221; and
   (b) a polynucleotide comprising a nucleotide sequence encoding a protein comprising the amino acid sequence set forth in SEQ ID NO:222.
2. A transformant carrying the polynucleotide of claim 1.
3. A transformant expressively carrying the polynucleotide of claim 1.
4. A vector comprising the polynucleotide of claim 1.
5. A transformant carrying the vector of claim 4.
6. A transformant expressively carrying the vector of claim 4.

* * * * *